United States Patent 7,888,497 (BIOINFORMATICALLY DETECTABLE GROUP OF NOVEL REGULATORY OLIGONUCLEOTIDES AND USES THEREOF) - sequence listing, part 131

SEQ ID NO: 5553070 - DNA, 16 bp, Homo sapiens
acatcctctgatagct

SEQ ID NO: 5553071 - DNA, 16 bp, Homo sapiens
acatcctcttccatat

SEQ ID NO: 5553072 - DNA, 21 bp, Homo sapiens
acatcctgacctcctggactg

SEQ ID NO: 5553073 - DNA, 16 bp, Homo sapiens
acatcctgctttccct

SEQ ID NO: 5553074 - DNA, 19 bp, Homo sapiens
acatcctgtataagcactg

SEQ ID NO: 5553075 - DNA, 20 bp, Homo sapiens
acatcctgtcatctgagaat

SEQ ID NO: 5553076 - DNA, 22 bp, Homo sapiens
acatcctgtgggacctgggcca

SEQ ID NO: 5553077 - DNA, 16 bp, Homo sapiens
acatcctgtgtttcta

SEQ ID NO: 5553078 - DNA, 23 bp, Homo sapiens
acatcctgtgtttctagggaaat

SEQ ID NO: 5553079 - DNA, 13 bp, Homo sapiens
acatccttccttc

SEQ ID NO: 5553080 - DNA, 12 bp, Homo sapiens
acatccttctca

SEQ ID NO: 5553081 - DNA, 15 bp, Homo sapiens
acatccttgtggcac

SEQ ID NO: 5553082 - DNA, 17 bp, Homo sapiens
acatcctttctaaacaa

SEQ ID NO: 5553083 - DNA, 18 bp, Homo sapiens
acatcctttctaaacaag

SEQ ID NO: 5553084 - DNA, 19 bp, Homo sapiens
acatcctttctaaacaaga

SEQ ID NO: 5553085 - DNA, 18 bp, Homo sapiens
acatcctttgcagggcag

SEQ ID NO: 5553086 - DNA, 23 bp, Homo sapiens
acatcctttgcagggcagcccca

SEQ ID NO: 5553087 - DNA, 16 bp, Homo sapiens
acatcgatatgaaaaa

SEQ ID NO: 5553088 - DNA, 21 bp, Homo sapiens
acatcgcaatagttttttact

SEQ ID NO: 5553089 - DNA, 15 bp, Homo sapiens
acatcgcacagttta

SEQ ID NO: 5553090 - DNA, 17 bp, Homo sapiens
acatcgcttctttttca

SEQ ID NO: 5553091 - DNA, 14 bp, Homo sapiens
acatcggttcagga

SEQ ID NO: 5553092 - DNA, 15 bp, Homo sapiens
acatcgtaggcagcc

SEQ ID NO: 5553093 - DNA, 20 bp, Homo sapiens
acatcgttgccgcagcggtg

SEQ ID NO: 5553094 - DNA, 18 bp, Homo sapiens
acatcgttgttttgctgg

SEQ ID NO: 5553095 - DNA, 18 bp, Homo sapiens
acatcgtttactttttaa

SEQ ID NO: 5553096 - DNA, 20 bp, Homo sapiens
acatctaaagctttatcttt

SEQ ID NO: 5553097 - DNA, 17 bp, Homo sapiens
acatctaacctcatctt

SEQ ID NO: 5553098 - DNA, 19 bp, Homo sapiens
acatctaatgtctcttcct

SEQ ID NO: 5553099 - DNA, 19 bp, Homo sapiens
acatctaattaaatgtaga

SEQ ID NO: 5553100 - DNA, 21 bp, Homo sapiens
acatctaattcaagattacaa

SEQ ID NO: 5553101 - DNA, 17 bp, Homo sapiens
acatctacaaaacatta

SEQ ID NO: 5553102 - DNA, 15 bp, Homo sapiens
acatctacgaagcca

SEQ ID NO: 5553103 - DNA, 18 bp, Homo sapiens
acatctacgaagccacag

SEQ ID NO: 5553104 - DNA, 14 bp, Homo sapiens
acatctagcacagc

SEQ ID NO: 5553105 - DNA, 19 bp, Homo sapiens
acatctagcccaaaggtaa

SEQ ID NO: 5553106 - DNA, 16 bp, Homo sapiens
acatctatagagataa

SEQ ID NO: 5553107 - DNA, 16 bp, Homo sapiens
acatctatgtgtatgt

SEQ ID NO: 5553108 - DNA, 14 bp, Homo sapiens
acatctattctctc

SEQ ID NO: 5553109 - DNA, 18 bp, Homo sapiens
acatctattttggattgt

SEQ ID NO: 5553110 - DNA, 19 bp, Homo sapiens
acatctattttggattgta

SEQ ID NO: 5553111 - DNA, 21 bp, Homo sapiens
acatctcaacaggcctcaggg

SEQ ID NO: 5553112 - DNA, 14 bp, Homo sapiens
acatctcacctccg

SEQ ID NO: 5553113 - DNA, 11 bp, Homo sapiens
acatctcagag

SEQ ID NO: 5553114 - DNA, 12 bp, Homo sapiens
acatctcatttt

SEQ ID NO: 5553115 - DNA, 11 bp, Homo sapiens
acatctcctta

SEQ ID NO: 5553116 - DNA, 13 bp, Homo sapiens
acatctctctggc

SEQ ID NO: 5553117 - DNA, 17 bp, Homo sapiens
acatctctctggcttct

SEQ ID NO: 5553118 - DNA, 22 bp, Homo sapiens
acatctctgcaccctggggcct

SEQ ID NO: 5553119 - DNA, 12 bp, Homo sapiens
acatctctgctt

SEQ ID NO: 5553120 - DNA, 12 bp, Homo sapiens
acatctctggag

SEQ ID NO: 5553121 - DNA, 18 bp, Homo sapiens
acatctctgtaaaaagca

SEQ ID NO: 5553122 - DNA, 13 bp, Homo sapiens
acatctcttcctc

SEQ ID NO: 5553123 - DNA, 16 bp, Homo sapiens
acatctcttgagtgtc

SEQ ID NO: 5553124 - DNA, 17 bp, Homo sapiens
acatctctttcatctag

SEQ ID NO: 5553125 - DNA, 11 bp, Homo sapiens
acatctgaaaa

SEQ ID NO: 5553126 - DNA, 12 bp, Homo sapiens
acatctgaaaag

SEQ ID NO: 5553127 - DNA, 14 bp, Homo sapiens
acatctgaaaagaa

SEQ ID NO: 5553128 - DNA, 18 bp, Homo sapiens
acatctgaaaagaaatgc

SEQ ID NO: 5553129 - DNA, 15 bp, Homo sapiens
acatctgaatctcct

SEQ ID NO: 5553130 - DNA, 21 bp, Homo sapiens
acatctgaccccaagggggct

SEQ ID NO: 5553131 - DNA, 22 bp, Homo sapiens
acatctgaggaaaatggaagac

SEQ ID NO: 5553132 - DNA, 23 bp, Homo sapiens
acatctgaggttttatttcattt

SEQ ID NO: 5553133 - DNA, 12 bp, Homo sapiens
acatctgataac

SEQ ID NO: 5553134 - DNA, 12 bp, Homo sapiens
acatctgatatc

SEQ ID NO: 5553135 - DNA, 22 bp, Homo sapiens
acatctgatatcaggaaatatc

SEQ ID NO: 5553136 - DNA, 16 bp, Homo sapiens
acatctgatctgtata

SEQ ID NO: 5553137 - DNA, 23 bp, Homo sapiens
acatctgcactcctgaacacacc

SEQ ID NO: 5553138 - DNA, 22 bp, Homo sapiens
acatctgcagtgttctgtgaat

SEQ ID NO: 5553139 - DNA, 13 bp, Homo sapiens
acatctgcctcct

SEQ ID NO: 5553140 - DNA, 22 bp, Homo sapiens
acatctgcctgtaattaaacta

SEQ ID NO: 5553141 - DNA, 23 bp, Homo sapiens
acatctgcctgtaattaaactag

SEQ ID NO: 5553142 - DNA, 12 bp, Homo sapiens
acatctgcctta

SEQ ID NO: 5553143 - DNA, 13 bp, Homo sapiens
acatctgctgtgt

SEQ ID NO: 5553144 - DNA, 22 bp, Homo sapiens
acatctggaaaataaaaggtct

SEQ ID NO: 5553145 - DNA, 13 bp, Homo sapiens
acatctggccctg

SEQ ID NO: 5553146 - DNA, 14 bp, Homo sapiens
acatctggccctga

SEQ ID NO: 5553147 - DNA, 17 bp, Homo sapiens
acatctggcttatttta

SEQ ID NO: 5553148 - DNA, 19 bp, Homo sapiens
acatctggcttattttaat

SEQ ID NO: 5553149 - DNA, 19 bp, Homo sapiens
acattcctgaccctcactt

SEQ ID NO: 5553150 - DNA, 21 bp, Homo sapiens
acattcctgagattctgggaa

SEQ ID NO: 5553151 - DNA, 18 bp, Homo sapiens
acattccttctacatgta

SEQ ID NO: 5553152 - DNA, 19 bp, Homo sapiens
acattccttctacatgtaa

SEQ ID NO: 5553153 - DNA, 21 bp, Homo sapiens
acattccttgctgaaacgcat

SEQ ID NO: 5553154 - DNA, 13 bp, Homo sapiens
acattcctttgaa

SEQ ID NO: 5553155 - DNA, 13 bp, Homo sapiens
acattcctttggg

SEQ ID NO: 5553156 - DNA, 22 bp, Homo sapiens
acattcgaggtgtcaccctgca

SEQ ID NO: 5553157 - DNA, 16 bp, Homo sapiens
acattcgatctcattc

SEQ ID NO: 5553158 - DNA, 15 bp, Homo sapiens
acattcggctccctg

SEQ ID NO: 5553159 - DNA, 16 bp, Homo sapiens
acattcgggaccaata

SEQ ID NO: 5553160 - DNA, 18 bp, Homo sapiens
acattcgtgagctgggga

SEQ ID NO: 5553161 - DNA, 21 bp, Homo sapiens
acattcgttctctaaccattc

SEQ ID NO: 5553162 - DNA, 16 bp, Homo sapiens
acattctaatgcatat

SEQ ID NO: 5553163 - DNA, 18 bp, Homo sapiens
acattctacttcagcttt

SEQ ID NO: 5553164 - DNA, 17 bp, Homo sapiens
acattctagctgagaag

SEQ ID NO: 5553165 - DNA, 13 bp, Homo sapiens
acattctagttca

SEQ ID NO: 5553166 - DNA, 14 bp, Homo sapiens
acattctatctact

SEQ ID NO: 5553167 - DNA, 22 bp, Homo sapiens
acattctattttgggtattaat

SEQ ID NO: 5553168 - DNA, 19 bp, Homo sapiens
acattctcacaattgtaaa

SEQ ID NO: 5553169 - DNA, 20 bp, Homo sapiens
acattctcacaattgtaaag

SEQ ID NO: 5553170 - DNA, 13 bp, Homo sapiens
acattctcacata

SEQ ID NO: 5553171 - DNA, 18 bp, Homo sapiens
acattctcacataagccc

SEQ ID NO: 5553172 - DNA, 13 bp, Homo sapiens
acattctcagttt

SEQ ID NO: 5553173 - DNA, 15 bp, Homo sapiens
acattctcagttttt

SEQ ID NO: 5553174 - DNA, 17 bp, Homo sapiens
acattctcagtttttct

SEQ ID NO: 5553175 - DNA, 12 bp, Homo sapiens
acattctccctt

SEQ ID NO: 5553176 - DNA, 22 bp, Homo sapiens
acattctcctgtgcccctcaga

SEQ ID NO: 5553177 - DNA, 14 bp, Homo sapiens
acattctctaataa

SEQ ID NO: 5553178 - DNA, 19 bp, Homo sapiens
acattctctaataagaaaa

SEQ ID NO: 5553179 - DNA, 14 bp, Homo sapiens
acattctctattgt

SEQ ID NO: 5553180 - DNA, 20 bp, Homo sapiens
acattctctattgtaatttt

SEQ ID NO: 5553181 - DNA, 23 bp, Homo sapiens
acattctctatttttgttaatca

SEQ ID NO: 5553182 - DNA, 20 bp, Homo sapiens
acattctcttactttttgta

SEQ ID NO: 5553183 - DNA, 22 bp, Homo sapiens
acattctcttactttttgtaaa

SEQ ID NO: 5553184 - DNA, 19 bp, Homo sapiens
acattctctttgataacaa

SEQ ID NO: 5553185 - DNA, 21 bp, Homo sapiens
acattctctttgataacaaaa

SEQ ID NO: 5553186 - DNA, 11 bp, Homo sapiens
acattctgaat

SEQ ID NO: 5553187 - DNA, 21 bp, Homo sapiens
acattctgaatgcttctaagt

SEQ ID NO: 5553188 - DNA, 15 bp, Homo sapiens
acattctgcaatggc

SEQ ID NO: 5553189 - DNA, 23 bp, Homo sapiens
acattctgcctagagtgtagcct

SEQ ID NO: 5553190 - DNA, 14 bp, Homo sapiens
acattctgccttgg

SEQ ID NO: 5553191 - DNA, 20 bp, Homo sapiens
acattctgctaagattcctt

SEQ ID NO: 5553192 - DNA, 12 bp, Homo sapiens
acattctgctct

SEQ ID NO: 5553193 - DNA, 20 bp, Homo sapiens
acattctggggaaacaacat

SEQ ID NO: 5553194 - DNA, 23 bp, Homo sapiens
acattctggggaaacaacattta

SEQ ID NO: 5553195 - DNA, 20 bp, Homo sapiens
acattctggtgaccagactt

SEQ ID NO: 5553196 - DNA, 14 bp, Homo sapiens
acattctgtaaaat

SEQ ID NO: 5553197 - DNA, 14 bp, Homo sapiens
acattctgtactgg

SEQ ID NO: 5553198 - DNA, 12 bp, Homo sapiens
acattctgtcat

SEQ ID NO: 5553199 - DNA, 17 bp, Homo sapiens
acattctgtcatcaccc

SEQ ID NO: 5553200 - DNA, 22 bp, Homo sapiens
acattctgtcgccttagcatgt

SEQ ID NO: 5553201 - DNA, 22 bp, Homo sapiens
acattctgtctctgcttggctt

SEQ ID NO: 5553202 - DNA, 11 bp, Homo sapiens
acattctgtgt

SEQ ID NO: 5553203 - DNA, 18 bp, Homo sapiens
acattctgtgtgtatcta

SEQ ID NO: 5553204 - DNA, 19 bp, Homo sapiens
acattcttaaactagttgt

SEQ ID NO: 5553205 - DNA, 16 bp, Homo sapiens
acattcttaaaggaaa

SEQ ID NO: 5553206 - DNA, 15 bp, Homo sapiens
acattcttaaggcaa

SEQ ID NO: 5553207 - DNA, 10 bp, Homo sapiens
acattcttat

SEQ ID NO: 5553208 - DNA, 19 bp, Homo sapiens
acattcttattaattcttc

SEQ ID NO: 5553209 - DNA, 14 bp, Homo sapiens
acattcttcactgt

SEQ ID NO: 5553210 - DNA, 23 bp, Homo sapiens
acattcttccatcatcactgtaa

SEQ ID NO: 5553211 - DNA, 22 bp, Homo sapiens
acattcttggttgttaatttag

SEQ ID NO: 5553212 - DNA, 23 bp, Homo sapiens
acattcttggttgttaatttaga

SEQ ID NO: 5553213 - DNA, 18 bp, Homo sapiens
acattctttaacatacat

SEQ ID NO: 5553214 - DNA, 13 bp, Homo sapiens
acattctttgcta

SEQ ID NO: 5553215 - DNA, 19 bp, Homo sapiens
acattcttttaacttcttt

SEQ ID NO: 5553216 - DNA, 14 bp, Homo sapiens
acattcttttaatg

SEQ ID NO: 5553217 - DNA, 14 bp, Homo sapiens
acattctttttgct

SEQ ID NO: 5553218 - DNA, 18 bp, Homo sapiens
acattctttttgctctaa

SEQ ID NO: 5553219 - DNA, 16 bp, Homo sapiens
acattgaaactgtatt

SEQ ID NO: 5553220 - DNA, 15 bp, Homo sapiens
acattgaaagtgaaa

SEQ ID NO: 5553221 - DNA, 16 bp, Homo sapiens
acattgaaatacttga

SEQ ID NO: 5553222 - DNA, 12 bp, Homo sapiens
acattgaagaat

SEQ ID NO: 5553223 - DNA, 18 bp, Homo sapiens
acattgaagtaatgaatt

SEQ ID NO: 5553224 - DNA, 16 bp, Homo sapiens
acattgaatgcgcttt

SEQ ID NO: 5553225 - DNA, 22 bp, Homo sapiens
acattgaattagaaacataaat

SEQ ID NO: 5553226 - DNA, 13 bp, Homo sapiens
acattgacagcaa

SEQ ID NO: 5553227 - DNA, 22 bp, Homo sapiens
acattgacagtggtgggcgggg

SEQ ID NO: 5553228 - DNA, 18 bp, Homo sapiens
acattgataagatggttt

SEQ ID NO: 5553229 - DNA, 16 bp, Homo sapiens
acattgatctgtttta

SEQ ID NO: 5553230 - DNA, 19 bp, Homo sapiens
acattgatctgttttacag

SEQ ID NO: 5553231 - DNA, 19 bp, Homo sapiens
acattgatgtgttcggttt

SEQ ID NO: 5553232 - DNA, 20 bp, Homo sapiens
acattgattggataaatgct

SEQ ID NO: 5553233 - DNA, 22 bp, Homo sapiens
acattgcactttataaacactg

SEQ ID NO: 5553234 - DNA, 16 bp, Homo sapiens
acattgcagtctgctt

SEQ ID NO: 5553235 - DNA, 17 bp, Homo sapiens
acattgcatcaaagcat

SEQ ID NO: 5553236 - DNA, 19 bp, Homo sapiens
acattgcattctattgcct

SEQ ID NO: 5553237 - DNA, 17 bp, Homo sapiens
acattgccaagtcagat

SEQ ID NO: 5553238 - DNA, 20 bp, Homo sapiens
acattgccaagtcagatggt

SEQ ID NO: 5553239 - DNA, 20 bp, Homo sapiens
acattgccatgtaactatgt

SEQ ID NO: 5553240 - DNA, 22 bp, Homo sapiens
acattgccatgtaactatgtat

SEQ ID NO: 5553241 - DNA, 22 bp, Homo sapiens
acattgcccacacctgcctctg

SEQ ID NO: 5553242 - DNA, 16 bp, Homo sapiens
acattgccccaagata

SEQ ID NO: 5553243 - DNA, 15 bp, Homo sapiens
acattgccctgaggg

SEQ ID NO: 5553244 - DNA, 19 bp, Homo sapiens
acattgccgtggcatctta

SEQ ID NO: 5553245 - DNA, 19 bp, Homo sapiens
acattgcctgactaaaatg

SEQ ID NO: 5553246 - DNA, 13 bp, Homo sapiens
acattgcctgttc

SEQ ID NO: 5553247 - DNA, 15 bp, Homo sapiens
acattgcctgttctg

SEQ ID NO: 5553248 - DNA, 17 bp, Homo sapiens
acattgcctgttctgct

SEQ ID NO: 5553249 - DNA, 18 bp, Homo sapiens
acattgcctgttctgctt

SEQ ID NO: 5553250 - DNA, 14 bp, Homo sapiens
acattgccttatat

SEQ ID NO: 5553251 - DNA, 16 bp, Homo sapiens
acattgccttgcattt

SEQ ID NO: 5553252 - DNA, 23 bp, Homo sapiens
acattgcctttgaatgttaattt

SEQ ID NO: 5553253 - DNA, 21 bp, Homo sapiens
acattgcggacagccacggcc

SEQ ID NO: 5553254 - DNA, 15 bp, Homo sapiens
acattgcgtttgacc

SEQ ID NO: 5553255 - DNA, 23 bp, Homo sapiens
acattgcgtttgaccttttatgt

SEQ ID NO: 5553256 - DNA, 14 bp, Homo sapiens
acattgctaagatg

SEQ ID NO: 5553257 - DNA, 17 bp, Homo sapiens
acattgctaagatgctc

SEQ ID NO: 5553258 - DNA, 15 bp, Homo sapiens
acattgctctatgtc

SEQ ID NO: 5553259 - DNA, 21 bp, Homo sapiens
acattgctctatgtctgcctt

SEQ ID NO: 5553260 - DNA, 13 bp, Homo sapiens
acattgctggctg

SEQ ID NO: 5553261 - DNA, 14 bp, Homo sapiens
acattgctggctgc

SEQ ID NO: 5553262 - DNA, 20 bp, Homo sapiens
acattgctggtcttgtaaga

SEQ ID NO: 5553263 - DNA, 11 bp, Homo sapiens
acattgcttaa

SEQ ID NO: 5553264 - DNA, 17 bp, Homo sapiens
acattgcttaaaatata

SEQ ID NO: 5553265 - DNA, 17 bp, Homo sapiens
acattgcttttaaaact

SEQ ID NO: 5553266 - DNA, 18 bp, Homo sapiens
acattgcttttaaaacta

SEQ ID NO: 5553267 - DNA, 12 bp, Homo sapiens
acattgcttttc

SEQ ID NO: 5553268 - DNA, 13 bp, Homo sapiens
acattgcttttga

SEQ ID NO: 5553269 - DNA, 23 bp, Homo sapiens
acattggaagcaggttaaatgtt

SEQ ID NO: 5553270 - DNA, 19 bp, Homo sapiens
acattggacagaaaatgca

SEQ ID NO: 5553271 - DNA, 13 bp, Homo sapiens
acattggacttcc

SEQ ID NO: 5553272 - DNA, 15 bp, Homo sapiens
acattggacttcctt

SEQ ID NO: 5553273 - DNA, 16 bp, Homo sapiens
acattggattatcctg

SEQ ID NO: 5553274 - DNA, 22 bp, Homo sapiens
acattggcaagtgtaaaaagat

SEQ ID NO: 5553275 - DNA, 20 bp, Homo sapiens
acattggcacaatgtatact

SEQ ID NO: 5553276 - DNA, 21 bp, Homo sapiens
acattggcacctaatccaggc

SEQ ID NO: 5553277 - DNA, 14 bp, Homo sapiens
acattggcataatt

SEQ ID NO: 5553278 - DNA, 19 bp, Homo sapiens
acattgggaaggggacccc

SEQ ID NO: 5553279 - DNA, 23 bp, Homo sapiens
acattgggaaggggacccccgcc

SEQ ID NO: 5553280 - DNA, 17 bp, Homo sapiens
acattgggcagcgccct

SEQ ID NO: 5553281 - DNA, 21 bp, Homo sapiens
acattgggcagcgcccttcct

SEQ ID NO: 5553282 - DNA, 21 bp, Homo sapiens
acattggggaaatttttaagt

SEQ ID NO: 5553283 - DNA, 22 bp, Homo sapiens
acattggggaaatttttaagtt

SEQ ID NO: 5553284 - DNA, 22 bp, Homo sapiens
acattgggtggggctcctggga

SEQ ID NO: 5553285 - DNA, 22 bp, Homo sapiens
acattggtattcgcttgagaaa

SEQ ID NO: 5553286 - DNA, 22 bp, Homo sapiens
acattggtgaaggatccaggaa

SEQ ID NO: 5553287 - DNA, 23 bp, Homo sapiens
acattggtgaaggatccaggaat

SEQ ID NO: 5553288 - DNA, 22 bp, Homo sapiens
acattggtgttgtactcaattt

SEQ ID NO: 5553289 - DNA, 23 bp, Homo sapiens
acattggtgttgtactcaatttt

SEQ ID NO: 5553290 - DNA, 14 bp, Homo sapiens
acattggttcttgt

SEQ ID NO: 5553291 - DNA, 22 bp, Homo sapiens
acattgtaaatatttactcttt

SEQ ID NO: 5553292 - DNA, 16 bp, Homo sapiens
acattgtaatctgctt

SEQ ID NO: 5553293 - DNA, 15 bp, Homo sapiens
acattgtactgttgc

SEQ ID NO: 5553294 - DNA, 14 bp, Homo sapiens
acattgtagcctaa

SEQ ID NO: 5553295 - DNA, 12 bp, Homo sapiens
acattgtatgtt

SEQ ID NO: 5553296 - DNA, 19 bp, Homo sapiens
acattgtattttactttgt

SEQ ID NO: 5553297 - DNA, 21 bp, Homo sapiens
acattgtcaaagcttgccgta

SEQ ID NO: 5553298 - DNA, 19 bp, Homo sapiens
acattgtcaccagactcac

SEQ ID NO: 5553299 - DNA, 15 bp, Homo sapiens
acattgtcagaatgt

SEQ ID NO: 5553300 - DNA, 16 bp, Homo sapiens
acattgtcagaatgtt

SEQ ID NO: 5553301 - DNA, 17 bp, Homo sapiens
acattgtcatcagaggg

SEQ ID NO: 5553302 - DNA, 16 bp, Homo sapiens
acattgtcctgtagct

SEQ ID NO: 5553303 - DNA, 12 bp, Homo sapiens
acattgtctccc

SEQ ID NO: 5553304 - DNA, 16 bp, Homo sapiens
acattgtctcccgccc

SEQ ID NO: 5553305 - DNA, 22 bp, Homo sapiens
acattgtctctaaattgtgggt

SEQ ID NO: 5553306 - DNA, 15 bp, Homo sapiens
acattgtctggatac

SEQ ID NO: 5553307 - DNA, 13 bp, Homo sapiens
acattgtgaatgc

SEQ ID NO: 5553308 - DNA, 21 bp, Homo sapiens
acattgtgaatgctgtgggaa

SEQ ID NO: 5553309 - DNA, 14 bp, Homo sapiens
acattgtgatgatt

SEQ ID NO: 5553310 - DNA, 11 bp, Homo sapiens
acattgtgcca

SEQ ID NO: 5553311 - DNA, 22 bp, Homo sapiens
acattgtgccctgtagctcctt

SEQ ID NO: 5553312 - DNA, 16 bp, Homo sapiens
acattgtgcttggccc

SEQ ID NO: 5553313 - DNA, 16 bp, Homo sapiens
acattgttaaaataaa

SEQ ID NO: 5553314 - DNA, 12 bp, Homo sapiens
acattgttaata

SEQ ID NO: 5553315 - DNA, 14 bp, Homo sapiens
acattgttaatata

SEQ ID NO: 5553316 - DNA, 23 bp, Homo sapiens
acattgttatgcacttttcccca

SEQ ID NO: 5553317 - DNA, 16 bp, Homo sapiens
acattgttattcttaa

SEQ ID NO: 5553318 - DNA, 17 bp, Homo sapiens
acattgttattttcagt

SEQ ID NO: 5553319 - DNA, 16 bp, Homo sapiens
acattgttcaattaga

SEQ ID NO: 5553320 - DNA, 13 bp, Homo sapiens
acattgttcacct

SEQ ID NO: 5553321 - DNA, 21 bp, Homo sapiens
acattgttgctccctgtgaca

SEQ ID NO: 5553322 - DNA, 19 bp, Homo sapiens
acattgtttggatttcctt

SEQ ID NO: 5553323 - DNA, 17 bp, Homo sapiens
acattgttttaaaaaga

SEQ ID NO: 5553324 - DNA, 15 bp, Homo sapiens
acattgttttccaga

SEQ ID NO: 5553325 - DNA, 16 bp, Homo sapiens
acattgtttttgtata

SEQ ID NO: 5553326 - DNA, 15 bp, Homo sapiens
accaaaaccagaggg

SEQ ID NO: 5553327 - DNA, 15 bp, Homo sapiens
accaaaacccatcgt

SEQ ID NO: 5553328 - DNA, 13 bp, Homo sapiens
accaaaactgctc

SEQ ID NO: 5553329 - DNA, 18 bp, Homo sapiens
accaaaactgtgcagagt

SEQ ID NO: 5553330 - DNA, 15 bp, Homo sapiens
accaaaacttccaag

SEQ ID NO: 5553331 - DNA, 17 bp, Homo sapiens
accaaaagaatttgcac

SEQ ID NO: 5553332 - DNA, 13 bp, Homo sapiens
accaaaagacatt

SEQ ID NO: 5553333 - DNA, 17 bp, Homo sapiens
accaaaagacattagag

SEQ ID NO: 5553334 - DNA, 14 bp, Homo sapiens
accaaaagcaacat

SEQ ID NO: 5553335 - DNA, 14 bp, Homo sapiens
accaaaagttacat

SEQ ID NO: 5553336 - DNA, 19 bp, Homo sapiens
accaaaagttattaaaatt

SEQ ID NO: 5553337 - DNA, 15 bp, Homo sapiens
accaaaagttcatat

SEQ ID NO: 5553338 - DNA, 13 bp, Homo sapiens
accaaaataaaaa

SEQ ID NO: 5553339 - DNA, 17 bp, Homo sapiens
accaaaataaaaattga

SEQ ID NO: 5553340 - DNA, 15 bp, Homo sapiens
accaaaatactccaa

SEQ ID NO: 5553341 - DNA, 17 bp, Homo sapiens
accaaaatactccaaag

SEQ ID NO: 5553342 - DNA, 16 bp, Homo sapiens
accaaaatgacatctt

SEQ ID NO: 5553343 - DNA, 18 bp, Homo sapiens
accaaaatgtgtttcata

SEQ ID NO: 5553344 - DNA, 20 bp, Homo sapiens
accaaaatttaagttaactg

SEQ ID NO: 5553345 - DNA, 23 bp, Homo sapiens
accaaaatttctttttttaaatt

SEQ ID NO: 5553346 - DNA, 21 bp, Homo sapiens
accaaaatttggggtatttat

SEQ ID NO: 5553347 - DNA, 15 bp, Homo sapiens
accaaacagacaagc

SEQ ID NO: 5553348 - DNA, 21 bp, Homo sapiens
accaaacatgcttataacatt

SEQ ID NO: 5553349 - DNA, 15 bp, Homo sapiens
accaaacatttctgt

SEQ ID NO: 5553350 - DNA, 15 bp, Homo sapiens
accaaaccagccttc

SEQ ID NO: 5553351 - DNA, 19 bp, Homo sapiens
accaaacccaccctttcta

SEQ ID NO: 5553352 - DNA, 20 bp, Homo sapiens
accaaacccaccctttctac

SEQ ID NO: 5553353 - DNA, 13 bp, Homo sapiens
accaaacccagcc

SEQ ID NO: 5553354 - DNA, 14 bp, Homo sapiens
accaaacccagcca

SEQ ID NO: 5553355 - DNA, 16 bp, Homo sapiens
accaaacccagccact

SEQ ID NO: 5553356 - DNA, 20 bp, Homo sapiens
accaaaccgcaaacgtgaaa

SEQ ID NO: 5553357 - DNA, 23 bp, Homo sapiens
accaaaccgccagcgaacttgac

SEQ ID NO: 5553358 - DNA, 14 bp, Homo sapiens
accaaacctagccc

SEQ ID NO: 5553359 - DNA, 16 bp, Homo sapiens
accaaacggaactctt

SEQ ID NO: 5553360 - DNA, 20 bp, Homo sapiens
accaaactacttcattttct

SEQ ID NO: 5553361 - DNA, 14 bp, Homo sapiens
accaaactcacgga

SEQ ID NO: 5553362 - DNA, 16 bp, Homo sapiens
accaaactcaggtgat

SEQ ID NO: 5553363 - DNA, 12 bp, Homo sapiens
accaaactcctg

SEQ ID NO: 5553364 - DNA, 21 bp, Homo sapiens
accaaactcctgcctgagaat

SEQ ID NO: 5553365 - DNA, 22 bp, Homo sapiens
accaaactgcacacacagctcc

SEQ ID NO: 5553366 - DNA, 18 bp, Homo sapiens
accaaactggatcactgg

SEQ ID NO: 5553367 - DNA, 19 bp, Homo sapiens
accaaacttgttcatttag

SEQ ID NO: 5553368 - DNA, 23 bp, Homo sapiens
accaaagaaacaccacttaatct

SEQ ID NO: 5553369 - DNA, 13 bp, Homo sapiens
accaaagaagaaa

SEQ ID NO: 5553370 - DNA, 13 bp, Homo sapiens
accaaagaatagt

SEQ ID NO: 5553371 - DNA, 14 bp, Homo sapiens
accaaagaatgcat

SEQ ID NO: 5553372 - DNA, 14 bp, Homo sapiens
accaaagagacagg

SEQ ID NO: 5553373 - DNA, 17 bp, Homo sapiens
accaaagagactggagc

SEQ ID NO: 5553374 - DNA, 15 bp, Homo sapiens
accaaagagggcttc

SEQ ID NO: 5553375 - DNA, 11 bp, Homo sapiens
accaaagagta

SEQ ID NO: 5553376 - DNA, 17 bp, Homo sapiens
accaaagagtctctggc

SEQ ID NO: 5553377 - DNA, 20 bp, Homo sapiens
accaaagagtctctggctca

SEQ ID NO: 5553378 - DNA, 23 bp, Homo sapiens
accaaagagtctctggctcagct

SEQ ID NO: 5553379 - DNA, 23 bp, Homo sapiens
accaaagatgaatgaagcaaatg

SEQ ID NO: 5553380 - DNA, 16 bp, Homo sapiens
accaaagcaaggtaca

SEQ ID NO: 5553381 - DNA, 17 bp, Homo sapiens
accaaagcaatatttcc

SEQ ID NO: 5553382 - DNA, 16 bp, Homo sapiens
accaaagcaatcatta

SEQ ID NO: 5553383 - DNA, 21 bp, Homo sapiens
accaaagcagttgggagtaca

SEQ ID NO: 5553384 - DNA, 11 bp, Homo sapiens
accaaagctga

SEQ ID NO: 5553385 - DNA, 21 bp, Homo sapiens
accaaagctgacgaggctggg

SEQ ID NO: 5553386 - DNA, 13 bp, Homo sapiens
accaaagctgcct

SEQ ID NO: 5553387 - DNA, 14 bp, Homo sapiens
accaaagctgcctg

SEQ ID NO: 5553388 - DNA, 16 bp, Homo sapiens
accaaagctggcccag

SEQ ID NO: 5553389 - DNA, 15 bp, Homo sapiens
accaaagctgttttt

SEQ ID NO: 5553390 - DNA, 15 bp, Homo sapiens
accaaaggaaggaac

SEQ ID NO: 5553391 - DNA, 20 bp, Homo sapiens
accaaaggacattatgtgtg

SEQ ID NO: 5553392 - DNA, 20 bp, Homo sapiens
accaaagggaagtgaggccc

SEQ ID NO: 5553393 - DNA, 21 bp, Homo sapiens
accaaagggaagtgaggccca

SEQ ID NO: 5553394 - DNA, 22 bp, Homo sapiens
accaaagggaagtgaggcccaa

SEQ ID NO: 5553395 - DNA, 21 bp, Homo sapiens
accaaagggagagttccagag

SEQ ID NO: 5553396 - DNA, 17 bp, Homo sapiens
accaaagggagtctgcc

SEQ ID NO: 5553397 - DNA, 19 bp, Homo sapiens
accaaagggagtctgccag

SEQ ID NO: 5553398 - DNA, 13 bp, Homo sapiens
accaaagggggag

SEQ ID NO: 5553399 - DNA, 18 bp, Homo sapiens
accaaagtcccttcctgc

SEQ ID NO: 5553400 - DNA, 21 bp, Homo sapiens
accaaagtcctttttttccat

SEQ ID NO: 5553401 - DNA, 14 bp, Homo sapiens
accaaagtctgccg

SEQ ID NO: 5553402 - DNA, 21 bp, Homo sapiens
accaaagtgtcttttgacatt

SEQ ID NO: 5553403 - DNA, 16 bp, Homo sapiens
accaaagttagttcag

SEQ ID NO: 5553404 - DNA, 12 bp, Homo sapiens
accaaagttcta

SEQ ID NO: 5553405 - DNA, 14 bp, Homo sapiens
accaaagttctaat

SEQ ID NO: 5553406 - DNA, 15 bp, Homo sapiens
accaaagttctaata

SEQ ID NO: 5553407 - DNA, 16 bp, Homo sapiens
accaaataaaaatatt

SEQ ID NO: 5553408 - DNA, 13 bp, Homo sapiens
accaaataagact

SEQ ID NO: 5553409 - DNA, 17 bp, Homo sapiens
accaaataattaaaaga

SEQ ID NO: 5553410 - DNA, 12 bp, Homo sapiens
accaaatacaat

SEQ ID NO: 5553411 - DNA, 21 bp, Homo sapiens
accaaatacaattcaaatgct

SEQ ID NO: 5553412 - DNA, 15 bp, Homo sapiens
accaaatacacattt

SEQ ID NO: 5553413 - DNA, 23 bp, Homo sapiens
accaaatacctcaatttttgttt

SEQ ID NO: 5553414 - DNA, 13 bp, Homo sapiens
accaaatagtgat

SEQ ID NO: 5553415 - DNA, 20 bp, Homo sapiens
accaaatagtgattgtaaca

SEQ ID NO: 5553416 - DNA, 23 bp, Homo sapiens
accaaatagtgattgtaacaaat

SEQ ID NO: 5553417 - DNA, 12 bp, Homo sapiens
accaaatataaa

SEQ ID NO: 5553418 - DNA, 19 bp, Homo sapiens
accaaatatgttaaagttt

SEQ ID NO: 5553419 - DNA, 20 bp, Homo sapiens
accaaatattttcaagcttt

SEQ ID NO: 5553420 - DNA, 22 bp, Homo sapiens
accaaatcacccaatcccagtt

SEQ ID NO: 5553421 - DNA, 13 bp, Homo sapiens
accaaatctgaca

SEQ ID NO: 5553422 - DNA, 14 bp, Homo sapiens
accaaatctgacat

SEQ ID NO: 5553423 - DNA, 13 bp, Homo sapiens
accaaatctggaa

SEQ ID NO: 5553424 - DNA, 15 bp, Homo sapiens
accaaatctggaagc

SEQ ID NO: 5553425 - DNA, 14 bp, Homo sapiens
accaaatctgtcta

SEQ ID NO: 5553426 - DNA, 12 bp, Homo sapiens
accaaatgaatt

SEQ ID NO: 5553427 - DNA, 21 bp, Homo sapiens
accaaatgagcattagctact

SEQ ID NO: 5553428 - DNA, 11 bp, Homo sapiens
accaaatgctt

SEQ ID NO: 5553429 - DNA, 14 bp, Homo sapiens
accaaatggaaaca

SEQ ID NO: 5553430 - DNA, 19 bp, Homo sapiens
accaaatgtaaaatattta

SEQ ID NO: 5553431 - DNA, 20 bp, Homo sapiens
accaaatgtaaaatatttat

SEQ ID NO: 5553432 - DNA, 18 bp, Homo sapiens
accaaatgtgccatacta

SEQ ID NO: 5553433 - DNA, 20 bp, Homo sapiens
accaaatgtgctttgagaag

SEQ ID NO: 5553434 - DNA, 13 bp, Homo sapiens
accaaatgtgtaa

SEQ ID NO: 5553435 - DNA, 14 bp, Homo sapiens
accaaattatcttg

SEQ ID NO: 5553436 - DNA, 15 bp, Homo sapiens
accaaattatcttga

SEQ ID NO: 5553437 - DNA, 21 bp, Homo sapiens
accaaattctccctggacccc

SEQ ID NO: 5553438 - DNA, 22 bp, Homo sapiens
accaaattctgtggctgccatc

SEQ ID NO: 5553439 - DNA, 13 bp, Homo sapiens
accaaattgctga

SEQ ID NO: 5553440 - DNA, 16 bp, Homo sapiens
accaaattgcttctag

SEQ ID NO: 5553441 - DNA, 18 bp, Homo sapiens
accaaattgcttgagcct

SEQ ID NO: 5553442 - DNA, 17 bp, Homo sapiens
accaaattgctttacag

SEQ ID NO: 5553443 - DNA, 14 bp, Homo sapiens
accaaattgggaga

SEQ ID NO: 5553444 - DNA, 15 bp, Homo sapiens
accaaattttaaaag

SEQ ID NO: 5553445 - DNA, 18 bp, Homo sapiens
accaaattttaaaagcca

SEQ ID NO: 5553446 - DNA, 17 bp, Homo sapiens
accaaatttttctatca

SEQ ID NO: 5553447 - DNA, 16 bp, Homo sapiens
accaacaaaatccatg

SEQ ID NO: 5553448 - DNA, 19 bp, Homo sapiens
accaacaaggaaactttcc

SEQ ID NO: 5553449 - DNA, 23 bp, Homo sapiens
accaacaaggaaactttccttta

SEQ ID NO: 5553450 - DNA, 13 bp, Homo sapiens
accaacaagggca

SEQ ID NO: 5553451 - DNA, 16 bp, Homo sapiens
accaacaagggcagtg

SEQ ID NO: 5553452 - DNA, 14 bp, Homo sapiens
accaacaataaacc

SEQ ID NO: 5553453 - DNA, 13 bp, Homo sapiens
accaacacacagg

SEQ ID NO: 5553454 - DNA, 14 bp, Homo sapiens
accaacacacagga

SEQ ID NO: 5553455 - DNA, 18 bp, Homo sapiens
accaacacacaggaactc

SEQ ID NO: 5553456 - DNA, 19 bp, Homo sapiens
accaacacgagcaggctac

SEQ ID NO: 5553457 - DNA, 14 bp, Homo sapiens
accaacataaaaat

SEQ ID NO: 5553458 - DNA, 15 bp, Homo sapiens
accaacataaaaatg

SEQ ID NO: 5553459 - DNA, 14 bp, Homo sapiens
accaacataaaaca

SEQ ID NO: 5553460 - DNA, 17 bp, Homo sapiens
accaacatactcccatc

SEQ ID NO: 5553461 - DNA, 22 bp, Homo sapiens
accaacatactcccatctgtga

SEQ ID NO: 5553462 - DNA, 18 bp, Homo sapiens
accaacatcccattgccc

SEQ ID NO: 5553463 - DNA, 22 bp, Homo sapiens
accaacatcccattgccctggt

SEQ ID NO: 5553464 - DNA, 14 bp, Homo sapiens
accaacatctttgc

SEQ ID NO: 5553465 - DNA, 22 bp, Homo sapiens
accaacatctttgcgaaaagat

SEQ ID NO: 5553466 - DNA, 15 bp, Homo sapiens
accaacatggagaaa

SEQ ID NO: 5553467 - DNA, 15 bp, Homo sapiens
accaacatgtatctg

SEQ ID NO: 5553468 - DNA, 15 bp, Homo sapiens
accaaccaaccaacc

SEQ ID NO: 5553469 - DNA, 15 bp, Homo sapiens
accaaccaaccacaa

SEQ ID NO: 5553470 - DNA, 14 bp, Homo sapiens
accaaccaatgaaa

SEQ ID NO: 5553471 - DNA, 13 bp, Homo sapiens
accaaccacagca

SEQ ID NO: 5553472 - DNA, 13 bp, Homo sapiens
accaaccagcagg

SEQ ID NO: 5553473 - DNA, 14 bp, Homo sapiens
accaaccaggcctt

SEQ ID NO: 5553474 - DNA, 14 bp, Homo sapiens
accaaccatttcta

SEQ ID NO: 5553475 - DNA, 13 bp, Homo sapiens
accaacccagccg

SEQ ID NO: 5553476 - DNA, 20 bp, Homo sapiens
accaacccagccgctgcccg

SEQ ID NO: 5553477 - DNA, 17 bp, Homo sapiens
accaacccatgccctgc

SEQ ID NO: 5553478 - DNA, 14 bp, Homo sapiens
accaacccatgtat

SEQ ID NO: 5553479 - DNA, 20 bp, Homo sapiens
accaacccccatctccctag

SEQ ID NO: 5553480 - DNA, 17 bp, Homo sapiens
accaaccccgcggccca

SEQ ID NO: 5553481 - DNA, 20 bp, Homo sapiens
accaaccccgcggcccagac

SEQ ID NO: 5553482 - DNA, 15 bp, Homo sapiens
accaaccctcagagc

SEQ ID NO: 5553483 - DNA, 13 bp, Homo sapiens
accaaccctgtgg

SEQ ID NO: 5553484 - DNA, 19 bp, Homo sapiens
accaaccctgtttcctgag

SEQ ID NO: 5553485 - DNA, 16 bp, Homo sapiens
accaacccttccctga

SEQ ID NO: 5553486 - DNA, 12 bp, Homo sapiens
accaacctccag

SEQ ID NO: 5553487 - DNA, 21 bp, Homo sapiens
accaacctccagactcagcag

SEQ ID NO: 5553488 - DNA, 14 bp, Homo sapiens
accaacctgtttct

SEQ ID NO: 5553489 - DNA, 13 bp, Homo sapiens
accaacctttaaa

SEQ ID NO: 5553490 - DNA, 14 bp, Homo sapiens
accaacctttaaaa

SEQ ID NO: 5553491 - DNA, 21 bp, Homo sapiens
accaacctttctgacatcagc

SEQ ID NO: 5553492 - DNA, 21 bp, Homo sapiens
accaacgcgaaaccaattcct

SEQ ID NO: 5553493 - DNA, 22 bp, Homo sapiens
accaacgggtctgtgggactgg

SEQ ID NO: 5553494 - DNA, 17 bp, Homo sapiens
accaacgttactcaggg

SEQ ID NO: 5553495 - DNA, 19 bp, Homo sapiens
accaactagacattctgtc

SEQ ID NO: 5553496 - DNA, 20 bp, Homo sapiens
accaactagacattctgtcg

SEQ ID NO: 5553497 - DNA, 16 bp, Homo sapiens
accaactatccaagtg

SEQ ID NO: 5553498 - DNA, 22 bp, Homo sapiens
accaactcctagttctagaaaa

SEQ ID NO: 5553499 - DNA, 13 bp, Homo sapiens
accaactctaata

SEQ ID NO: 5553500 - DNA, 13 bp, Homo sapiens
accaactctctct

SEQ ID NO: 5553501 - DNA, 15 bp, Homo sapiens
accaactctctctgc

SEQ ID NO: 5553502 - DNA, 17 bp, Homo sapiens
accaactctctctgccc

SEQ ID NO: 5553503 - DNA, 14 bp, Homo sapiens
accaactctgcact

SEQ ID NO: 5553504 - DNA, 23 bp, Homo sapiens
accaactgaaggctaaaaagcaa

SEQ ID NO: 5553505 - DNA, 15 bp, Homo sapiens
accaactgagccaaa

SEQ ID NO: 5553506 - DNA, 17 bp, Homo sapiens
accaactgcacaatcag

SEQ ID NO: 5553507 - DNA, 13 bp, Homo sapiens
accactgggcctg

SEQ ID NO: 5553508 - DNA, 16 bp, Homo sapiens
accactggtaacatgt

SEQ ID NO: 5553509 - DNA, 22 bp, Homo sapiens
accactggtacttcctttctcc

SEQ ID NO: 5553510 - DNA, 17 bp, Homo sapiens
accactgtagttctctc

SEQ ID NO: 5553511 - DNA, 12 bp, Homo sapiens
accactgtctcc

SEQ ID NO: 5553512 - DNA, 19 bp, Homo sapiens
accactgtctgtccctgaa

SEQ ID NO: 5553513 - DNA, 15 bp, Homo sapiens
accactgtctttttc

SEQ ID NO: 5553514 - DNA, 18 bp, Homo sapiens
accactgtctttttctta

SEQ ID NO: 5553515 - DNA, 21 bp, Homo sapiens
accactgtgaacattttttat

SEQ ID NO: 5553516 - DNA, 16 bp, Homo sapiens
accactgtgcacttag

SEQ ID NO: 5553517 - DNA, 18 bp, Homo sapiens
accactgtgcacttagcc

SEQ ID NO: 5553518 - DNA, 14 bp, Homo sapiens
accactgtgccact

SEQ ID NO: 5553519 - DNA, 23 bp, Homo sapiens
accactgtgccactgacttgctg

SEQ ID NO: 5553520 - DNA, 22 bp, Homo sapiens
accactgtggcgttctgctgcc

SEQ ID NO: 5553521 - DNA, 14 bp, Homo sapiens
accactgtgtccca

SEQ ID NO: 5553522 - DNA, 23 bp, Homo sapiens
accactgttctgttcatttccta

SEQ ID NO: 5553523 - DNA, 17 bp, Homo sapiens
accactgtttcttgctt

SEQ ID NO: 5553524 - DNA, 20 bp, Homo sapiens
accactgtttcttgcttgta

SEQ ID NO: 5553525 - DNA, 22 bp, Homo sapiens
accactgtttcttgcttgtacc

SEQ ID NO: 5553526 - DNA, 23 bp, Homo sapiens
accactgtttcttgcttgtacct

SEQ ID NO: 5553527 - DNA, 17 bp, Homo sapiens
accacttacctcaaatt

SEQ ID NO: 5553528 - DNA, 13 bp, Homo sapiens
accacttagaaga

SEQ ID NO: 5553529 - DNA, 18 bp, Homo sapiens
accacttcactgaaagac

SEQ ID NO: 5553530 - DNA, 15 bp, Homo sapiens
accacttcagctgac

SEQ ID NO: 5553531 - DNA, 18 bp, Homo sapiens
accacttccagagccaga

SEQ ID NO: 5553532 - DNA, 23 bp, Homo sapiens
accacttccaggggaacctgcca

SEQ ID NO: 5553533 - DNA, 18 bp, Homo sapiens
accacttcctgctacagg

SEQ ID NO: 5553534 - DNA, 16 bp, Homo sapiens
accacttccttaacag

SEQ ID NO: 5553535 - DNA, 18 bp, Homo sapiens
accacttccttaacagct

SEQ ID NO: 5553536 - DNA, 17 bp, Homo sapiens
accacttcgcacacacc

SEQ ID NO: 5553537 - DNA, 13 bp, Homo sapiens
accacttctctgc

SEQ ID NO: 5553538 - DNA, 16 bp, Homo sapiens
accacttctctgctgc

SEQ ID NO: 5553539 - DNA, 17 bp, Homo sapiens
accacttctctgctgcc

SEQ ID NO: 5553540 - DNA, 20 bp, Homo sapiens
accacttctctgctgcctct

SEQ ID NO: 5553541 - DNA, 18 bp, Homo sapiens
accacttctgtgggcatg

SEQ ID NO: 5553542 - DNA, 15 bp, Homo sapiens
accacttcttttata

SEQ ID NO: 5553543 - DNA, 16 bp, Homo sapiens
accacttgaggcctga

SEQ ID NO: 5553544 - DNA, 20 bp, Homo sapiens
accacttgaggcctgatctg

SEQ ID NO: 5553545 - DNA, 16 bp, Homo sapiens
accacttgatgtctga

SEQ ID NO: 5553546 - DNA, 15 bp, Homo sapiens
accactttattgcaa

SEQ ID NO: 5553547 - DNA, 23 bp, Homo sapiens
accactttccactccctgcttag

SEQ ID NO: 5553548 - DNA, 20 bp, Homo sapiens
accactttcttattctgtat

SEQ ID NO: 5553549 - DNA, 21 bp, Homo sapiens
accactttcttattctgtatc

SEQ ID NO: 5553550 - DNA, 15 bp, Homo sapiens
accactttcttattt

SEQ ID NO: 5553551 - DNA, 17 bp, Homo sapiens
accacttttcattgcaa

SEQ ID NO: 5553552 - DNA, 18 bp, Homo sapiens
accacttttcattgcaaa

SEQ ID NO: 5553553 - DNA, 19 bp, Homo sapiens
accacttttcattgcaaag

SEQ ID NO: 5553554 - DNA, 20 bp, Homo sapiens
accacttttcattgcaaagt

SEQ ID NO: 5553555 - DNA, 16 bp, Homo sapiens
accacttttctgctgt

SEQ ID NO: 5553556 - DNA, 11 bp, Homo sapiens
accagaaaaaa

SEQ ID NO: 5553557 - DNA, 17 bp, Homo sapiens
accagaaaacaaatctt

SEQ ID NO: 5553558 - DNA, 15 bp, Homo sapiens
accagaaaatgagtt

SEQ ID NO: 5553559 - DNA, 23 bp, Homo sapiens
accagaaaatttttgtctttcat

SEQ ID NO: 5553560 - DNA, 17 bp, Homo sapiens
accagaaacacccctct

SEQ ID NO: 5553561 - DNA, 18 bp, Homo sapiens
accagaaaccttccagag

SEQ ID NO: 5553562 - DNA, 12 bp, Homo sapiens
accagaaagctc

SEQ ID NO: 5553563 - DNA, 21 bp, Homo sapiens
accagaaatgtttatggaaat

SEQ ID NO: 5553564 - DNA, 16 bp, Homo sapiens
accagaaattccagta

SEQ ID NO: 5553565 - DNA, 20 bp, Homo sapiens
accagaacaattatgtttct

SEQ ID NO: 5553566 - DNA, 19 bp, Homo sapiens
accagaaccaattattttc

SEQ ID NO: 5553567 - DNA, 13 bp, Homo sapiens
accagaactttct

SEQ ID NO: 5553568 - DNA, 14 bp, Homo sapiens
accagaagccaaag

SEQ ID NO: 5553569 - DNA, 14 bp, Homo sapiens
accagaagcccaga

SEQ ID NO: 5553570 - DNA, 22 bp, Homo sapiens
accagaagccggcggagctctg

SEQ ID NO: 5553571 - DNA, 20 bp, Homo sapiens
accagaaggaagccctctca

SEQ ID NO: 5553572 - DNA, 21 bp, Homo sapiens
accagaagtgcagcccctctc

SEQ ID NO: 5553573 - DNA, 19 bp, Homo sapiens
accagaagtggcaggagga

SEQ ID NO: 5553574 - DNA, 17 bp, Homo sapiens
accagaagtttaaatct

SEQ ID NO: 5553575 - DNA, 15 bp, Homo sapiens
accagaatcataatt

SEQ ID NO: 5553576 - DNA, 23 bp, Homo sapiens
accagaattagtcctcacagcct

SEQ ID NO: 5553577 - DNA, 17 bp, Homo sapiens
accagaattgtgcaaat

SEQ ID NO: 5553578 - DNA, 21 bp, Homo sapiens
accagacaatgttgtgtttgg

SEQ ID NO: 5553579 - DNA, 14 bp, Homo sapiens
accagacacccagg

SEQ ID NO: 5553580 - DNA, 17 bp, Homo sapiens
accagacaccttgacag

SEQ ID NO: 5553581 - DNA, 19 bp, Homo sapiens
accagacagagggtcacag

SEQ ID NO: 5553582 - DNA, 17 bp, Homo sapiens
accagacagcacagggc

SEQ ID NO: 5553583 - DNA, 15 bp, Homo sapiens
accagaccatgggcc

SEQ ID NO: 5553584 - DNA, 16 bp, Homo sapiens
accagaccatgggcca

SEQ ID NO: 5553585 - DNA, 17 bp, Homo sapiens
accagacctagacctgg

SEQ ID NO: 5553586 - DNA, 14 bp, Homo sapiens
accagacggggctg

SEQ ID NO: 5553587 - DNA, 15 bp, Homo sapiens
accagacggggctgg

SEQ ID NO: 5553588 - DNA, 21 bp, Homo sapiens
accagacggggctggagtgtg

SEQ ID NO: 5553589 - DNA, 19 bp, Homo sapiens
accagacggttcaccagcc

SEQ ID NO: 5553590 - DNA, 17 bp, Homo sapiens
accagacgtcaggccct

SEQ ID NO: 5553591 - DNA, 16 bp, Homo sapiens
accagactcttgcctg

SEQ ID NO: 5553592 - DNA, 14 bp, Homo sapiens
accagactgcaggt

SEQ ID NO: 5553593 - DNA, 14 bp, Homo sapiens
accagacttcaaga

SEQ ID NO: 5553594 - DNA, 13 bp, Homo sapiens
accagacttttct

SEQ ID NO: 5553595 - DNA, 23 bp, Homo sapiens
accagacttttctctagaagctg

SEQ ID NO: 5553596 - DNA, 18 bp, Homo sapiens
accagagaaaaagggagg

SEQ ID NO: 5553597 - DNA, 19 bp, Homo sapiens
accagagaacagctcccct

SEQ ID NO: 5553598 - DNA, 11 bp, Homo sapiens
accagagaagg

SEQ ID NO: 5553599 - DNA, 12 bp, Homo sapiens
accagagaatct

SEQ ID NO: 5553600 - DNA, 18 bp, Homo sapiens
accagagaatgctttgaa

SEQ ID NO: 5553601 - DNA, 13 bp, Homo sapiens
accagagaccagg

SEQ ID NO: 5553602 - DNA, 16 bp, Homo sapiens
accagagaccgtcctc

SEQ ID NO: 5553603 - DNA, 18 bp, Homo sapiens
accagagacgcccagccc

SEQ ID NO: 5553604 - DNA, 13 bp, Homo sapiens
accagagcaaaaa

SEQ ID NO: 5553605 - DNA, 16 bp, Homo sapiens
accagagcaaaaatgt

SEQ ID NO: 5553606 - DNA, 17 bp, Homo sapiens
accagagcaaaaatgta

SEQ ID NO: 5553607 - DNA, 20 bp, Homo sapiens
accagagcaacctctcactc

SEQ ID NO: 5553608 - DNA, 13 bp, Homo sapiens
accagagcactgt

SEQ ID NO: 5553609 - DNA, 16 bp, Homo sapiens
accagagcagatgcag

SEQ ID NO: 5553610 - DNA, 22 bp, Homo sapiens
accagagcagatgcagagagcc

SEQ ID NO: 5553611 - DNA, 17 bp, Homo sapiens
accagagcaggggctgc

SEQ ID NO: 5553612 - DNA, 20 bp, Homo sapiens
accagagcaggggctgctgg

SEQ ID NO: 5553613 - DNA, 21 bp, Homo sapiens
accagagcaggggctgctggg

SEQ ID NO: 5553614 - DNA, 12 bp, Homo sapiens
accagagccaga

SEQ ID NO: 5553615 - DNA, 13 bp, Homo sapiens
accagagccatgg

SEQ ID NO: 5553616 - DNA, 12 bp, Homo sapiens
accagagcccac

SEQ ID NO: 5553617 - DNA, 14 bp, Homo sapiens
accagagcccatgc

SEQ ID NO: 5553618 - DNA, 16 bp, Homo sapiens
accagagcccatgctc

SEQ ID NO: 5553619 - DNA, 14 bp, Homo sapiens
accagagccccaca

SEQ ID NO: 5553620 - DNA, 19 bp, Homo sapiens
accagagccccccacaatg

SEQ ID NO: 5553621 - DNA, 21 bp, Homo sapiens
accagagccccccacaatgat

SEQ ID NO: 5553622 - DNA, 20 bp, Homo sapiens
accagagccttcaagtgcca

SEQ ID NO: 5553623 - DNA, 21 bp, Homo sapiens
accagagccttcaagtgccaa

SEQ ID NO: 5553624 - DNA, 17 bp, Homo sapiens
accagagcgtgcacttg

SEQ ID NO: 5553625 - DNA, 12 bp, Homo sapiens
accagagctgcc

SEQ ID NO: 5553626 - DNA, 13 bp, Homo sapiens
accagagctgcca

SEQ ID NO: 5553627 - DNA, 14 bp, Homo sapiens
accagagctgcctc

SEQ ID NO: 5553628 - DNA, 19 bp, Homo sapiens
accagagctgcctccccaa

SEQ ID NO: 5553629 - DNA, 15 bp, Homo sapiens
accagagctgtctga

SEQ ID NO: 5553630 - DNA, 15 bp, Homo sapiens
accagagcttctctg

SEQ ID NO: 5553631 - DNA, 19 bp, Homo sapiens
accagagcttctctgggct

SEQ ID NO: 5553632 - DNA, 15 bp, Homo sapiens
accagaggagccttt

SEQ ID NO: 5553633 - DNA, 14 bp, Homo sapiens
accagaggctgcag

SEQ ID NO: 5553634 - DNA, 19 bp, Homo sapiens
accagaggctgcagaaggc

SEQ ID NO: 5553635 - DNA, 21 bp, Homo sapiens
accagaggctgcagaaggcca

SEQ ID NO: 5553636 - DNA, 14 bp, Homo sapiens
accagagggcagtc

SEQ ID NO: 5553637 - DNA, 15 bp, Homo sapiens
accagagggtgtggc

SEQ ID NO: 5553638 - DNA, 22 bp, Homo sapiens
accagagggtgtggctttccag

SEQ ID NO: 5553639 - DNA, 17 bp, Homo sapiens
accagagtctgtatttt

SEQ ID NO: 5553640 - DNA, 22 bp, Homo sapiens
accagagtgctgaaggaatgga

SEQ ID NO: 5553641 - DNA, 17 bp, Homo sapiens
accagagttaaagcata

SEQ ID NO: 5553642 - DNA, 22 bp, Homo sapiens
accagatatatagaaggactgc

SEQ ID NO: 5553643 - DNA, 22 bp, Homo sapiens
accagatccttttccagaaata

SEQ ID NO: 5553644 - DNA, 14 bp, Homo sapiens
accagatctttctc

SEQ ID NO: 5553645 - DNA, 16 bp, Homo sapiens
accagatctttctctt

SEQ ID NO: 5553646 - DNA, 19 bp, Homo sapiens
accagatctttctcttccc

SEQ ID NO: 5553647 - DNA, 14 bp, Homo sapiens
accagatgatgtcc

SEQ ID NO: 5553648 - DNA, 22 bp, Homo sapiens
accagatgcgtcccaagatgtt

SEQ ID NO: 5553649 - DNA, 11 bp, Homo sapiens
accagatgcta

SEQ ID NO: 5553650 - DNA, 20 bp, Homo sapiens
accagatggaacactggaac

SEQ ID NO: 5553651 - DNA, 14 bp, Homo sapiens
accagatggttgtg

SEQ ID NO: 5553652 - DNA, 15 bp, Homo sapiens
accagatggttgtgt

SEQ ID NO: 5553653 - DNA, 20 bp, Homo sapiens
accagattctatcctcatct

SEQ ID NO: 5553654 - DNA, 19 bp, Homo sapiens
accagattgctctgcccca

SEQ ID NO: 5553655 - DNA, 17 bp, Homo sapiens
accagatttattttaaa

SEQ ID NO: 5553656 - DNA, 14 bp, Homo sapiens
accagcaaacagct

SEQ ID NO: 5553657 - DNA, 20 bp, Homo sapiens
accagcaagtcccagacaag

SEQ ID NO: 5553658 - DNA, 17 bp, Homo sapiens
accagcaatatatctga

SEQ ID NO: 5553659 - DNA, 15 bp, Homo sapiens
accagcaatgccctg

SEQ ID NO: 5553660 - DNA, 16 bp, Homo sapiens
accagcaatgccctgc

SEQ ID NO: 5553661 - DNA, 23 bp, Homo sapiens
accagcaatgccctgccttgctg

SEQ ID NO: 5553662 - DNA, 15 bp, Homo sapiens
accagcacactcccg

SEQ ID NO: 5553663 - DNA, 14 bp, Homo sapiens
accagcactcagcc

SEQ ID NO: 5553664 - DNA, 12 bp, Homo sapiens
accagcactccc

SEQ ID NO: 5553665 - DNA, 17 bp, Homo sapiens
accagcactcccagggc

SEQ ID NO: 5553666 - DNA, 12 bp, Homo sapiens
accagcagaaaa

SEQ ID NO: 5553667 - DNA, 15 bp, Homo sapiens
accagcagaaaagtg

SEQ ID NO: 5553668 - DNA, 20 bp, Homo sapiens
accagcagaaatgcccccat

SEQ ID NO: 5553669 - DNA, 12 bp, Homo sapiens
accagcagagca

SEQ ID NO: 5553670 - DNA, 13 bp, Homo sapiens
accagcagagcac

SEQ ID NO: 5553671 - DNA, 14 bp, Homo sapiens
accagcagcacaat

SEQ ID NO: 5553672 - DNA, 15 bp, Homo sapiens
accagcagcacaatt

SEQ ID NO: 5553673 - DNA, 14 bp, Homo sapiens
accagcagcctgga

SEQ ID NO: 5553674 - DNA, 17 bp, Homo sapiens
accagcaggctcctcag

SEQ ID NO: 5553675 - DNA, 18 bp, Homo sapiens
accagcaggctcctcagc

SEQ ID NO: 5553676 - DNA, 20 bp, Homo sapiens
accagcaggctcctcagccc

SEQ ID NO: 5553677 - DNA, 19 bp, Homo sapiens
accagcatcacctgcctgt

SEQ ID NO: 5553678 - DNA, 21 bp, Homo sapiens
accagcatccacactgccggc

SEQ ID NO: 5553679 - DNA, 17 bp, Homo sapiens
accagcatctcagcgcc

SEQ ID NO: 5553680 - DNA, 17 bp, Homo sapiens
accagcattccttttga

SEQ ID NO: 5553681 - DNA, 17 bp, Homo sapiens
accagcattttactact

SEQ ID NO: 5553682 - DNA, 22 bp, Homo sapiens
accagccacacagagcctgcct

SEQ ID NO: 5553683 - DNA, 18 bp, Homo sapiens
accagccacagtacatat

SEQ ID NO: 5553684 - DNA, 12 bp, Homo sapiens
accagccagccc

SEQ ID NO: 5553685 - DNA, 14 bp, Homo sapiens
accagccagccctg

SEQ ID NO: 5553686 - DNA, 14 bp, Homo sapiens
accagtttattctg

SEQ ID NO: 5553687 - DNA, 13 bp, Homo sapiens
accagtttcttaa

SEQ ID NO: 5553688 - DNA, 15 bp, Homo sapiens
accagtttgcatgat

SEQ ID NO: 5553689 - DNA, 14 bp, Homo sapiens
accagttttcttta

SEQ ID NO: 5553690 - DNA, 21 bp, Homo sapiens
accagttttgagtgtactgtg

SEQ ID NO: 5553691 - DNA, 16 bp, Homo sapiens
accagttttgatattt

SEQ ID NO: 5553692 - DNA, 17 bp, Homo sapiens
accagttttgatattta

SEQ ID NO: 5553693 - DNA, 24 bp, Homo sapiens
accagtttttggataaagaatact

SEQ ID NO: 5553694 - DNA, 22 bp, Homo sapiens
accagttttttcacctccatgt

SEQ ID NO: 5553695 - DNA, 13 bp, Homo sapiens
accataaaaagag

SEQ ID NO: 5553696 - DNA, 16 bp, Homo sapiens
accataaaaagaggat

SEQ ID NO: 5553697 - DNA, 11 bp, Homo sapiens
accataaaata

SEQ ID NO: 5553698 - DNA, 22 bp, Homo sapiens
accataaaataaataatctcat

SEQ ID NO: 5553699 - DNA, 14 bp, Homo sapiens
accataaacatttg

SEQ ID NO: 5553700 - DNA, 22 bp, Homo sapiens
accataaattcaactttgtaaa

SEQ ID NO: 5553701 - DNA, 23 bp, Homo sapiens
accataacaccgtcccagggctc

SEQ ID NO: 5553702 - DNA, 17 bp, Homo sapiens
accataacagtgccagc

SEQ ID NO: 5553703 - DNA, 16 bp, Homo sapiens
accataagagaaacct

SEQ ID NO: 5553704 - DNA, 16 bp, Homo sapiens
accataagctactgcc

SEQ ID NO: 5553705 - DNA, 22 bp, Homo sapiens
accataaggtttcgtttctgta

SEQ ID NO: 5553706 - DNA, 22 bp, Homo sapiens
accataagtgacaccaataaat

SEQ ID NO: 5553707 - DNA, 19 bp, Homo sapiens
accataatcttagagacaa

SEQ ID NO: 5553708 - DNA, 22 bp, Homo sapiens
accataatgtactgatttcagt

SEQ ID NO: 5553709 - DNA, 15 bp, Homo sapiens
accataatgttacat

SEQ ID NO: 5553710 - DNA, 19 bp, Homo sapiens
accataattttttttaaag

SEQ ID NO: 5553711 - DNA, 14 bp, Homo sapiens
accatacagacagc

SEQ ID NO: 5553712 - DNA, 16 bp, Homo sapiens
accatacagatctgtt

SEQ ID NO: 5553713 - DNA, 14 bp, Homo sapiens
accatacattatca

SEQ ID NO: 5553714 - DNA, 14 bp, Homo sapiens
accatacatttaaa

SEQ ID NO: 5553715 - DNA, 17 bp, Homo sapiens
accatactaataaatat

SEQ ID NO: 5553716 - DNA, 13 bp, Homo sapiens
accatactaatta

SEQ ID NO: 5553717 - DNA, 16 bp, Homo sapiens
accatactaattatac

SEQ ID NO: 5553718 - DNA, 22 bp, Homo sapiens
accatactcaaatggtgtcatg

SEQ ID NO: 5553719 - DNA, 16 bp, Homo sapiens
accatactcctctcct

SEQ ID NO: 5553720 - DNA, 18 bp, Homo sapiens
accatactccttgcttcc

SEQ ID NO: 5553721 - DNA, 14 bp, Homo sapiens
accatagaaaaatg

SEQ ID NO: 5553722 - DNA, 19 bp, Homo sapiens
accatagcttaagaagtat

SEQ ID NO: 5553723 - DNA, 22 bp, Homo sapiens
accataggaagacataaaactt

SEQ ID NO: 5553724 - DNA, 20 bp, Homo sapiens
accatagtaccatttataca

SEQ ID NO: 5553725 - DNA, 23 bp, Homo sapiens
accatagtaccatttatacaaat

SEQ ID NO: 5553726 - DNA, 23 bp, Homo sapiens
accatagtcgggatgtcagcaga

SEQ ID NO: 5553727 - DNA, 18 bp, Homo sapiens
accatagtgtcacagaga

SEQ ID NO: 5553728 - DNA, 18 bp, Homo sapiens
accatagttactgtaaaa

SEQ ID NO: 5553729 - DNA, 23 bp, Homo sapiens
accatatactgttcttcatttta

SEQ ID NO: 5553730 - DNA, 15 bp, Homo sapiens
accatatagatttta

SEQ ID NO: 5553731 - DNA, 21 bp, Homo sapiens
accatatagattttattatgt

SEQ ID NO: 5553732 - DNA, 21 bp, Homo sapiens
accatatagcaaaacttttaa

SEQ ID NO: 5553733 - DNA, 21 bp, Homo sapiens
accatatcacctctcttctta

SEQ ID NO: 5553734 - DNA, 16 bp, Homo sapiens
accatatgaacatata

SEQ ID NO: 5553735 - DNA, 18 bp, Homo sapiens
accatatgattgaaaaga

SEQ ID NO: 5553736 - DNA, 16 bp, Homo sapiens
accatatgcccacatt

SEQ ID NO: 5553737 - DNA, 14 bp, Homo sapiens
accatattaccaca

SEQ ID NO: 5553738 - DNA, 14 bp, Homo sapiens
accatattgctctt

SEQ ID NO: 5553739 - DNA, 15 bp, Homo sapiens
accatattgctctta

SEQ ID NO: 5553740 - DNA, 20 bp, Homo sapiens
accatattgctcttaaaaat

SEQ ID NO: 5553741 - DNA, 13 bp, Homo sapiens
accatatttagca

SEQ ID NO: 5553742 - DNA, 20 bp, Homo sapiens
accatatttatccatttgta

SEQ ID NO: 5553743 - DNA, 21 bp, Homo sapiens
accatatttatccatttgtaa

SEQ ID NO: 5553744 - DNA, 14 bp, Homo sapiens
accatatttgaatt

SEQ ID NO: 5553745 - DNA, 15 bp, Homo sapiens
accatatttgaattg

SEQ ID NO: 5553746 - DNA, 16 bp, Homo sapiens
accatattttttatga

SEQ ID NO: 5553747 - DNA, 23 bp, Homo sapiens
accatcaaacaaatcattttgat

SEQ ID NO: 5553748 - DNA, 22 bp, Homo sapiens
accatcaaaggaatataagaaa

SEQ ID NO: 5553749 - DNA, 14 bp, Homo sapiens
accatcaaggcggg

SEQ ID NO: 5553750 - DNA, 16 bp, Homo sapiens
accatcaaggcgggag

SEQ ID NO: 5553751 - DNA, 13 bp, Homo sapiens
accatcaataaag

SEQ ID NO: 5553752 - DNA, 13 bp, Homo sapiens
accatcaatcctg

SEQ ID NO: 5553753 - DNA, 16 bp, Homo sapiens
accatcaatcctgatt

SEQ ID NO: 5553754 - DNA, 15 bp, Homo sapiens
accatcaatggaaac

SEQ ID NO: 5553755 - DNA, 13 bp, Homo sapiens
accatcacacatg

SEQ ID NO: 5553756 - DNA, 15 bp, Homo sapiens
accatcacagcttgt

SEQ ID NO: 5553757 - DNA, 12 bp, Homo sapiens
accatcaccctc

SEQ ID NO: 5553758 - DNA, 22 bp, Homo sapiens
accatcactcactcactcccca

SEQ ID NO: 5553759 - DNA, 10 bp, Homo sapiens
accatcactg

SEQ ID NO: 5553760 - DNA, 16 bp, Homo sapiens
accatcagaattcaga

SEQ ID NO: 5553761 - DNA, 14 bp, Homo sapiens
accatcagctctgc

SEQ ID NO: 5553762 - DNA, 22 bp, Homo sapiens
accatcagctctgccttgcact

SEQ ID NO: 5553763 - DNA, 16 bp, Homo sapiens
accatcagctgctttt

SEQ ID NO: 5553764 - DNA, 14 bp, Homo sapiens
accatcagggacag

SEQ ID NO: 5553765 - DNA, 15 bp, Homo sapiens
accatcagggacagg

SEQ ID NO: 5553766 - DNA, 17 bp, Homo sapiens
accatcagttactggtt

SEQ ID NO: 5553767 - DNA, 20 bp, Homo sapiens
accatcagttactggtttca

SEQ ID NO: 5553768 - DNA, 15 bp, Homo sapiens
accatcatgtaccaa

SEQ ID NO: 5553769 - DNA, 23 bp, Homo sapiens
accatcattgaaatctttttgct

SEQ ID NO: 5553770 - DNA, 21 bp, Homo sapiens
accatcatttaatttctaatt

SEQ ID NO: 5553771 - DNA, 15 bp, Homo sapiens
accatccaaatttat

SEQ ID NO: 5553772 - DNA, 19 bp, Homo sapiens
accatccaccttcccttct

SEQ ID NO: 5553773 - DNA, 14 bp, Homo sapiens
accatccagctccc

SEQ ID NO: 5553774 - DNA, 17 bp, Homo sapiens
accatccatccctggtg

SEQ ID NO: 5553775 - DNA, 17 bp, Homo sapiens
accatccattctcctca

SEQ ID NO: 5553776 - DNA, 15 bp, Homo sapiens
accatccccagctgg

SEQ ID NO: 5553777 - DNA, 19 bp, Homo sapiens
accatccccagctggtggc

SEQ ID NO: 5553778 - DNA, 15 bp, Homo sapiens
accatccctgccaca

SEQ ID NO: 5553779 - DNA, 15 bp, Homo sapiens
accatccctttttga

SEQ ID NO: 5553780 - DNA, 21 bp, Homo sapiens
accatccctttttgaagtgta

SEQ ID NO: 5553781 - DNA, 21 bp, Homo sapiens
accatcctcagaggctgagcc

SEQ ID NO: 5553782 - DNA, 13 bp, Homo sapiens
accatcctctgtt

SEQ ID NO: 5553783 - DNA, 15 bp, Homo sapiens
accatcctgagccag

SEQ ID NO: 5553784 - DNA, 19 bp, Homo sapiens
accatcctggccaacatga

SEQ ID NO: 5553785 - DNA, 13 bp, Homo sapiens
accatcctggccc

SEQ ID NO: 5553786 - DNA, 20 bp, Homo sapiens
accatcctggctaacacggt

SEQ ID NO: 5553787 - DNA, 18 bp, Homo sapiens
accatcctgtattcttca

SEQ ID NO: 5553788 - DNA, 12 bp, Homo sapiens
accatccttcca

SEQ ID NO: 5553789 - DNA, 17 bp, Homo sapiens
accatcgctggcccctt

SEQ ID NO: 5553790 - DNA, 16 bp, Homo sapiens
accatcgtccagccct

SEQ ID NO: 5553791 - DNA, 17 bp, Homo sapiens
accatcgtccagccctc

SEQ ID NO: 5553792 - DNA, 13 bp, Homo sapiens
accatctaatagc

SEQ ID NO: 5553793 - DNA, 17 bp, Homo sapiens
accatctaggatgattt

SEQ ID NO: 5553794 - DNA, 18 bp, Homo sapiens
accatctatgtgaatatt

SEQ ID NO: 5553795 - DNA, 21 bp, Homo sapiens
accatctatgtgaatatttgt

SEQ ID NO: 5553796 - DNA, 16 bp, Homo sapiens
accatctcagaccttt

SEQ ID NO: 5553797 - DNA, 14 bp, Homo sapiens
accatctcaggcca

SEQ ID NO: 5553798 - DNA, 15 bp, Homo sapiens
accatctcaggccac

SEQ ID NO: 5553799 - DNA, 21 bp, Homo sapiens
accatctcaggccacctgccc

SEQ ID NO: 5553800 - DNA, 12 bp, Homo sapiens
accatctccagc

SEQ ID NO: 5553801 - DNA, 11 bp, Homo sapiens
accatctccct

SEQ ID NO: 5553802 - DNA, 14 bp, Homo sapiens
accatctccctggt

SEQ ID NO: 5553803 - DNA, 17 bp, Homo sapiens
accatctccctggtgct

SEQ ID NO: 5553804 - DNA, 18 bp, Homo sapiens
accatctctccctcctgg

SEQ ID NO: 5553805 - DNA, 14 bp, Homo sapiens
accatctgctgcag

SEQ ID NO: 5553806 - DNA, 15 bp, Homo sapiens
accatctgctgcagt

SEQ ID NO: 5553807 - DNA, 13 bp, Homo sapiens
accatctgctgcc

SEQ ID NO: 5553808 - DNA, 15 bp, Homo sapiens
accatctgctgcccc

SEQ ID NO: 5553809 - DNA, 14 bp, Homo sapiens
accatctgctgtct

SEQ ID NO: 5553810 - DNA, 14 bp, Homo sapiens
accatctgctttta

SEQ ID NO: 5553811 - DNA, 18 bp, Homo sapiens
accatctgcttttattaa

SEQ ID NO: 5553812 - DNA, 15 bp, Homo sapiens
accatctggcccagg

SEQ ID NO: 5553813 - DNA, 18 bp, Homo sapiens
accatctggcccaggctg

SEQ ID NO: 5553814 - DNA, 23 bp, Homo sapiens
accatctggcccaggctggcccc

SEQ ID NO: 5553815 - DNA, 15 bp, Homo sapiens
accatctggcctggc

SEQ ID NO: 5553816 - DNA, 17 bp, Homo sapiens
accatctggcctggcct

SEQ ID NO: 5553817 - DNA, 15 bp, Homo sapiens
accatctggtgcctt

SEQ ID NO: 5553818 - DNA, 17 bp, Homo sapiens
accatctgtaccctgct

SEQ ID NO: 5553819 - DNA, 15 bp, Homo sapiens
accatctgtgactat

SEQ ID NO: 5553820 - DNA, 21 bp, Homo sapiens
accatctgtgactataaagct

SEQ ID NO: 5553821 - DNA, 22 bp, Homo sapiens
accatctgtgactataaagctg

SEQ ID NO: 5553822 - DNA, 14 bp, Homo sapiens
accatcttaatctt

SEQ ID NO: 5553823 - DNA, 15 bp, Homo sapiens
accatcttaatcttt

SEQ ID NO: 5553824 - DNA, 22 bp, Homo sapiens
accatcttaatctttattttat

SEQ ID NO: 5553825 - DNA, 17 bp, Homo sapiens
accatcttacagagact

SEQ ID NO: 5553826 - DNA, 18 bp, Homo sapiens
accatcttacagagactc

SEQ ID NO: 5553827 - DNA, 21 bp, Homo sapiens
accatcttacagagactctcc

SEQ ID NO: 5553828 - DNA, 23 bp, Homo sapiens
accatcttcagctgtatgaaagg

SEQ ID NO: 5553829 - DNA, 23 bp, Homo sapiens
accatcttctgtaccaaaaatag

SEQ ID NO: 5553830 - DNA, 13 bp, Homo sapiens
accatctttctga

SEQ ID NO: 5553831 - DNA, 17 bp, Homo sapiens
accatcttttattcttt

SEQ ID NO: 5553832 - DNA, 19 bp, Homo sapiens
accatcttttattcttttt

SEQ ID NO: 5553833 - DNA, 20 bp, Homo sapiens
accatcttttattctttttt

SEQ ID NO: 5553834 - DNA, 13 bp, Homo sapiens
accatgaaaaaat

SEQ ID NO: 5553835 - DNA, 13 bp, Homo sapiens
accatgaaaaata

SEQ ID NO: 5553836 - DNA, 15 bp, Homo sapiens
accatgaaaagtttt

SEQ ID NO: 5553837 - DNA, 17 bp, Homo sapiens
accatgaagaacataaa

SEQ ID NO: 5553838 - DNA, 15 bp, Homo sapiens
accatgaagacagga

SEQ ID NO: 5553839 - DNA, 19 bp, Homo sapiens
accatgaagagatttttca

SEQ ID NO: 5553840 - DNA, 20 bp, Homo sapiens
accatgaagagatttttcat

SEQ ID NO: 5553841 - DNA, 18 bp, Homo sapiens
accatgacaaacctagct

SEQ ID NO: 5553842 - DNA, 19 bp, Homo sapiens
accatgaccccttctctct

SEQ ID NO: 5553843 - DNA, 17 bp, Homo sapiens
accatgacgcaaagaga

SEQ ID NO: 5553844 - DNA, 21 bp, Homo sapiens
accatgagaagagggcctgtg

SEQ ID NO: 5553845 - DNA, 22 bp, Homo sapiens
accatgagaattttacttccat

SEQ ID NO: 5553846 - DNA, 17 bp, Homo sapiens
accatgaggtaaaagag

SEQ ID NO: 5553847 - DNA, 17 bp, Homo sapiens
accatgatgctgagccc

SEQ ID NO: 5553848 - DNA, 14 bp, Homo sapiens
accatgatttaatc

SEQ ID NO: 5553849 - DNA, 19 bp, Homo sapiens
accatgcaacttcctttga

SEQ ID NO: 5553850 - DNA, 16 bp, Homo sapiens
accatgcactgtaaat

SEQ ID NO: 5553851 - DNA, 17 bp, Homo sapiens
accatgcagcccctggg

SEQ ID NO: 5553852 - DNA, 18 bp, Homo sapiens
accatgcagcccctgggc

SEQ ID NO: 5553853 - DNA, 17 bp, Homo sapiens
accatgcagcttcatca

SEQ ID NO: 5553854 - DNA, 20 bp, Homo sapiens
accatgcagcttcatcaatt

SEQ ID NO: 5553855 - DNA, 18 bp, Homo sapiens
accatgcatttaaagtat

SEQ ID NO: 5553856 - DNA, 23 bp, Homo sapiens
accatgccagacccactgaaatg

SEQ ID NO: 5553857 - DNA, 20 bp, Homo sapiens
accatgccaggctaattttt

SEQ ID NO: 5553858 - DNA, 12 bp, Homo sapiens
accatgccaggg

SEQ ID NO: 5553859 - DNA, 20 bp, Homo sapiens
accatgcccagctaattttt

SEQ ID NO: 5553860 - DNA, 19 bp, Homo sapiens
accatgcctggtattttca

SEQ ID NO: 5553861 - DNA, 17 bp, Homo sapiens
accatgcgtcaggggcc

SEQ ID NO: 5553862 - DNA, 13 bp, Homo sapiens
accatgctcaact

SEQ ID NO: 5553863 - DNA, 20 bp, Homo sapiens
accatgctcatctgctggtc

SEQ ID NO: 5553864 - DNA, 16 bp, Homo sapiens
accatgctctctcacc

SEQ ID NO: 5553865 - DNA, 19 bp, Homo sapiens
acccactccgactccccct

SEQ ID NO: 5553866 - DNA, 21 bp, Homo sapiens
acccactccgactccccctcc

SEQ ID NO: 5553867 - DNA, 23 bp, Homo sapiens
acccactcggatggaccaacctg

SEQ ID NO: 5553868 - DNA, 18 bp, Homo sapiens
acccactctgcggcccgg

SEQ ID NO: 5553869 - DNA, 13 bp, Homo sapiens
acccactctggtg

SEQ ID NO: 5553870 - DNA, 14 bp, Homo sapiens
acccactctttgct

SEQ ID NO: 5553871 - DNA, 19 bp, Homo sapiens
acccactgaaatgaccaag

SEQ ID NO: 5553872 - DNA, 19 bp, Homo sapiens
acccactgaatctgagaaa

SEQ ID NO: 5553873 - DNA, 12 bp, Homo sapiens
acccactgaccc

SEQ ID NO: 5553874 - DNA, 20 bp, Homo sapiens
acccactgcagcccctgaga

SEQ ID NO: 5553875 - DNA, 21 bp, Homo sapiens
acccactgccccgtgtgaatg

SEQ ID NO: 5553876 - DNA, 10 bp, Homo sapiens
acccactgct

SEQ ID NO: 5553877 - DNA, 11 bp, Homo sapiens
acccactgctc

SEQ ID NO: 5553878 - DNA, 14 bp, Homo sapiens
acccactggactca

SEQ ID NO: 5553879 - DNA, 15 bp, Homo sapiens
acccactgtgcttac

SEQ ID NO: 5553880 - DNA, 21 bp, Homo sapiens
acccactgtggggcaagcctg

SEQ ID NO: 5553881 - DNA, 22 bp, Homo sapiens
acccactgtggggcaagcctga

SEQ ID NO: 5553882 - DNA, 15 bp, Homo sapiens
acccacttagtccac

SEQ ID NO: 5553883 - DNA, 18 bp, Homo sapiens
acccacttatttttcaag

SEQ ID NO: 5553884 - DNA, 20 bp, Homo sapiens
acccacttctcatcacacac

SEQ ID NO: 5553885 - DNA, 13 bp, Homo sapiens
acccacttctgca

SEQ ID NO: 5553886 - DNA, 17 bp, Homo sapiens
acccacttctgcacttg

SEQ ID NO: 5553887 - DNA, 13 bp, Homo sapiens
acccacttgcctg

SEQ ID NO: 5553888 - DNA, 22 bp, Homo sapiens
acccactttaaaatatctacat

SEQ ID NO: 5553889 - DNA, 13 bp, Homo sapiens
acccactttgtaa

SEQ ID NO: 5553890 - DNA, 23 bp, Homo sapiens
acccagaaaaaaagcccaacaca

SEQ ID NO: 5553891 - DNA, 20 bp, Homo sapiens
acccagaaacaacacaatcc

SEQ ID NO: 5553892 - DNA, 20 bp, Homo sapiens
acccagaaacgccacatccc

SEQ ID NO: 5553893 - DNA, 17 bp, Homo sapiens
acccagaagcagtaata

SEQ ID NO: 5553894 - DNA, 14 bp, Homo sapiens
acccagaatggagc

SEQ ID NO: 5553895 - DNA, 20 bp, Homo sapiens
acccagaatggtcatttcag

SEQ ID NO: 5553896 - DNA, 24 bp, Homo sapiens
acccagacagcctgtttctatcct

SEQ ID NO: 5553897 - DNA, 15 bp, Homo sapiens
acccagacataaagg

SEQ ID NO: 5553898 - DNA, 10 bp, Homo sapiens
acccagaccc

SEQ ID NO: 5553899 - DNA, 17 bp, Homo sapiens
acccagaccccaggctg

SEQ ID NO: 5553900 - DNA, 13 bp, Homo sapiens
acccagaccctcc

SEQ ID NO: 5553901 - DNA, 17 bp, Homo sapiens
acccagaccctccttcc

SEQ ID NO: 5553902 - DNA, 19 bp, Homo sapiens
acccagaccctccttcccc

SEQ ID NO: 5553903 - DNA, 22 bp, Homo sapiens
acccagaccctccttccccacc

SEQ ID NO: 5553904 - DNA, 16 bp, Homo sapiens
acccagacctgcctgt

SEQ ID NO: 5553905 - DNA, 23 bp, Homo sapiens
acccagacctgcctgtctcccac

SEQ ID NO: 5553906 - DNA, 22 bp, Homo sapiens
acccagacctgttagcagacag

SEQ ID NO: 5553907 - DNA, 19 bp, Homo sapiens
acccagactggaatgcagt

SEQ ID NO: 5553908 - DNA, 14 bp, Homo sapiens
acccagagagaaaa

SEQ ID NO: 5553909 - DNA, 11 bp, Homo sapiens
acccagagcac

SEQ ID NO: 5553910 - DNA, 14 bp, Homo sapiens
acccagagcacagg

SEQ ID NO: 5553911 - DNA, 21 bp, Homo sapiens
acccagagcacaggagctgcc

SEQ ID NO: 5553912 - DNA, 17 bp, Homo sapiens
acccagagccttctcct

SEQ ID NO: 5553913 - DNA, 18 bp, Homo sapiens
acccagagccttctcctg

SEQ ID NO: 5553914 - DNA, 11 bp, Homo sapiens
acccagagctg

SEQ ID NO: 5553915 - DNA, 13 bp, Homo sapiens
acccagagctgcc

SEQ ID NO: 5553916 - DNA, 15 bp, Homo sapiens
acccagagctgccta

SEQ ID NO: 5553917 - DNA, 20 bp, Homo sapiens
acccagaggccctgaagcct

SEQ ID NO: 5553918 - DNA, 19 bp, Homo sapiens
acccagaggggacgctgag

SEQ ID NO: 5553919 - DNA, 21 bp, Homo sapiens
acccagagggtagggcagcag

SEQ ID NO: 5553920 - DNA, 21 bp, Homo sapiens
acccagaggtccaggtcccag

SEQ ID NO: 5553921 - DNA, 18 bp, Homo sapiens
acccagaggtctccctat

SEQ ID NO: 5553922 - DNA, 19 bp, Homo sapiens
acccagagtcaggaagaga

SEQ ID NO: 5553923 - DNA, 17 bp, Homo sapiens
acccagatatggaaaca

SEQ ID NO: 5553924 - DNA, 20 bp, Homo sapiens
acccagatatggaaacagaa

SEQ ID NO: 5553925 - DNA, 17 bp, Homo sapiens
acccagatcaggaacca

SEQ ID NO: 5553926 - DNA, 22 bp, Homo sapiens
acccagatcaggaaccagggcc

SEQ ID NO: 5553927 - DNA, 23 bp, Homo sapiens
acccagatcaggaaccagggcct

SEQ ID NO: 5553928 - DNA, 23 bp, Homo sapiens
acccagatggcctgaagcaactg

SEQ ID NO: 5553929 - DNA, 19 bp, Homo sapiens
acccagatgttgcttttga

SEQ ID NO: 5553930 - DNA, 21 bp, Homo sapiens
acccagatgttttatttatga

SEQ ID NO: 5553931 - DNA, 17 bp, Homo sapiens
acccagattttatttat

SEQ ID NO: 5553932 - DNA, 19 bp, Homo sapiens
acccagattttgctgtata

SEQ ID NO: 5553933 - DNA, 17 bp, Homo sapiens
acccagcaactccaact

SEQ ID NO: 5553934 - DNA, 21 bp, Homo sapiens
acccagcaaggcacaggctcc

SEQ ID NO: 5553935 - DNA, 14 bp, Homo sapiens
acccagcaatagag

SEQ ID NO: 5553936 - DNA, 22 bp, Homo sapiens
acccagcagagggataacccaa

SEQ ID NO: 5553937 - DNA, 19 bp, Homo sapiens
acccagcagcgcccgaggc

SEQ ID NO: 5553938 - DNA, 18 bp, Homo sapiens
acccagcatctcccagca

SEQ ID NO: 5553939 - DNA, 16 bp, Homo sapiens
acccagccaccttcct

SEQ ID NO: 5553940 - DNA, 23 bp, Homo sapiens
acccagccaccttcctgactggg

SEQ ID NO: 5553941 - DNA, 11 bp, Homo sapiens
acccagccagc

SEQ ID NO: 5553942 - DNA, 15 bp, Homo sapiens
acccagccagctgca

SEQ ID NO: 5553943 - DNA, 18 bp, Homo sapiens
acccagccagctgcaggg

SEQ ID NO: 5553944 - DNA, 19 bp, Homo sapiens
acccagccagctgcagggc

SEQ ID NO: 5553945 - DNA, 21 bp, Homo sapiens
acccagccagctgcagggcac

SEQ ID NO: 5553946 - DNA, 14 bp, Homo sapiens
acccagccaggagg

SEQ ID NO: 5553947 - DNA, 13 bp, Homo sapiens
acccagccaggcc

SEQ ID NO: 5553948 - DNA, 18 bp, Homo sapiens
acccagccaggcccagcc

SEQ ID NO: 5553949 - DNA, 18 bp, Homo sapiens
acccagccatctgcccag

SEQ ID NO: 5553950 - DNA, 21 bp, Homo sapiens
acccagccatctgcccagggg

SEQ ID NO: 5553951 - DNA, 15 bp, Homo sapiens
acccagcccaccccc

SEQ ID NO: 5553952 - DNA, 15 bp, Homo sapiens
acccagcccacttct

SEQ ID NO: 5553953 - DNA, 18 bp, Homo sapiens
acccagcccacttctgcc

SEQ ID NO: 5553954 - DNA, 11 bp, Homo sapiens
acccagcccat

SEQ ID NO: 5553955 - DNA, 14 bp, Homo sapiens
acccagcccatctt

SEQ ID NO: 5553956 - DNA, 23 bp, Homo sapiens
acccagcccattctctctcctgt

SEQ ID NO: 5553957 - DNA, 18 bp, Homo sapiens
acccagccccaaggggtg

SEQ ID NO: 5553958 - DNA, 21 bp, Homo sapiens
acccagccccaaggggtggcc

SEQ ID NO: 5553959 - DNA, 18 bp, Homo sapiens
acccagcccctctcccct

SEQ ID NO: 5553960 - DNA, 23 bp, Homo sapiens
acccagcccctctcccctctctg

SEQ ID NO: 5553961 - DNA, 17 bp, Homo sapiens
acccagcccctgcggcc

SEQ ID NO: 5553962 - DNA, 13 bp, Homo sapiens
acccagcccctgg

SEQ ID NO: 5553963 - DNA, 15 bp, Homo sapiens
acccagccccttccc

SEQ ID NO: 5553964 - DNA, 17 bp, Homo sapiens
acccagccccttcccct

SEQ ID NO: 5553965 - DNA, 21 bp, Homo sapiens
acccagccccttcccctggga

SEQ ID NO: 5553966 - DNA, 16 bp, Homo sapiens
acccagccccttgaga

SEQ ID NO: 5553967 - DNA, 20 bp, Homo sapiens
acccagccccttgagaaacc

SEQ ID NO: 5553968 - DNA, 21 bp, Homo sapiens
acccagccccttgagaaacct

SEQ ID NO: 5553969 - DNA, 21 bp, Homo sapiens
acccagcccgcggcctggacc

SEQ ID NO: 5553970 - DNA, 16 bp, Homo sapiens
acccagccctcatccc

SEQ ID NO: 5553971 - DNA, 13 bp, Homo sapiens
acccagccctggt

SEQ ID NO: 5553972 - DNA, 14 bp, Homo sapiens
acccagccctggtc

SEQ ID NO: 5553973 - DNA, 16 bp, Homo sapiens
acccagccctggtctc

SEQ ID NO: 5553974 - DNA, 13 bp, Homo sapiens
acccagcccttcc

SEQ ID NO: 5553975 - DNA, 14 bp, Homo sapiens
acccagcccttcct

SEQ ID NO: 5553976 - DNA, 18 bp, Homo sapiens
acccagcccttccttggg

SEQ ID NO: 5553977 - DNA, 13 bp, Homo sapiens
acccagcctcagt

SEQ ID NO: 5553978 - DNA, 22 bp, Homo sapiens
acccagcctcagtcctcccctc

SEQ ID NO: 5553979 - DNA, 23 bp, Homo sapiens
acccagcctcagtcctcccctca

SEQ ID NO: 5553980 - DNA, 15 bp, Homo sapiens
acccagcctgagtgc

SEQ ID NO: 5553981 - DNA, 20 bp, Homo sapiens
acccagcctgtcccactggc

SEQ ID NO: 5553982 - DNA, 21 bp, Homo sapiens
acccagcctgtcccactggct

SEQ ID NO: 5553983 - DNA, 24 bp, Homo sapiens
acccagcctgtcccactggctcct

SEQ ID NO: 5553984 - DNA, 15 bp, Homo sapiens
acccagcctgtttta

SEQ ID NO: 5553985 - DNA, 22 bp, Homo sapiens
acccagcggcttagccaagccc

SEQ ID NO: 5553986 - DNA, 15 bp, Homo sapiens
acccagcgtggccca

SEQ ID NO: 5553987 - DNA, 14 bp, Homo sapiens
acccagctactctg

SEQ ID NO: 5553988 - DNA, 13 bp, Homo sapiens
acccagctccagg

SEQ ID NO: 5553989 - DNA, 17 bp, Homo sapiens
acccagctccaggccca

SEQ ID NO: 5553990 - DNA, 18 bp, Homo sapiens
acccagctccaggcccac

SEQ ID NO: 5553991 - DNA, 12 bp, Homo sapiens
acccagctcctc

SEQ ID NO: 5553992 - DNA, 13 bp, Homo sapiens
acccagctcctct

SEQ ID NO: 5553993 - DNA, 18 bp, Homo sapiens
acccagctcctctgagcc

SEQ ID NO: 5553994 - DNA, 19 bp, Homo sapiens
acccagctcctctgagcca

SEQ ID NO: 5553995 - DNA, 12 bp, Homo sapiens
acccagctctca

SEQ ID NO: 5553996 - DNA, 14 bp, Homo sapiens
acccagctctcagg

SEQ ID NO: 5553997 - DNA, 15 bp, Homo sapiens
acccagctctcaggg

SEQ ID NO: 5553998 - DNA, 21 bp, Homo sapiens
acccagctctcagggctgtct

SEQ ID NO: 5553999 - DNA, 13 bp, Homo sapiens
acccagctgcacc

SEQ ID NO: 5554000 - DNA, 14 bp, Homo sapiens
acccagctggtcct

SEQ ID NO: 5554001 - DNA, 22 bp, Homo sapiens
acccagctggtcctgtggatgg

SEQ ID NO: 5554002 - DNA, 15 bp, Homo sapiens
acccagcttcaaagc

SEQ ID NO: 5554003 - DNA, 14 bp, Homo sapiens
acccaggaatagtg

SEQ ID NO: 5554004 - DNA, 10 bp, Homo sapiens
acccaggaca

SEQ ID NO: 5554005 - DNA, 16 bp, Homo sapiens
acccaggacaagcatg

SEQ ID NO: 5554006 - DNA, 11 bp, Homo sapiens
acccaggacag

SEQ ID NO: 5554007 - DNA, 16 bp, Homo sapiens
acccaggaccatcctg

SEQ ID NO: 5554008 - DNA, 17 bp, Homo sapiens
acccaggacctctgggg

SEQ ID NO: 5554009 - DNA, 18 bp, Homo sapiens
acccaggacgcttctgaa

SEQ ID NO: 5554010 - DNA, 21 bp, Homo sapiens
acccaggagacaaacagccct

SEQ ID NO: 5554011 - DNA, 22 bp, Homo sapiens
acccaggagcatccacctcctt

SEQ ID NO: 5554012 - DNA, 23 bp, Homo sapiens
acccaggagcatccacctccttc

SEQ ID NO: 5554013 - DNA, 15 bp, Homo sapiens
acccaggagccccga

SEQ ID NO: 5554014 - DNA, 23 bp, Homo sapiens
acccaggagccccgaggccttct

SEQ ID NO: 5554015 - DNA, 13 bp, Homo sapiens
acccaggaggcag

SEQ ID NO: 5554016 - DNA, 23 bp, Homo sapiens
acccaggaggcagaggttgcagt

SEQ ID NO: 5554017 - DNA, 14 bp, Homo sapiens
acccaggaggcagg

SEQ ID NO: 5554018 - DNA, 23 bp, Homo sapiens
acccaggaggcggaggttgcagt

SEQ ID NO: 5554019 - DNA, 19 bp, Homo sapiens
acccaggaggggaacactg

SEQ ID NO: 5554020 - DNA, 11 bp, Homo sapiens
acccaggaggt

SEQ ID NO: 5554021 - DNA, 23 bp, Homo sapiens
acccaggaggtggaggttgcagt

SEQ ID NO: 5554022 - DNA, 16 bp, Homo sapiens
acccaggagtccagac

SEQ ID NO: 5554023 - DNA, 15 bp, Homo sapiens
acccaggagtccagc

SEQ ID NO: 5554024 - DNA, 22 bp, Homo sapiens
acccaggagtccagcccctcct

SEQ ID NO: 5554025 - DNA, 19 bp, Homo sapiens
acccaggagtttgtgtgtc

SEQ ID NO: 5554026 - DNA, 20 bp, Homo sapiens
acccaggagtttgtgtgtct

SEQ ID NO: 5554027 - DNA, 14 bp, Homo sapiens
acccaggatcccca

SEQ ID NO: 5554028 - DNA, 19 bp, Homo sapiens
acccaggattcaacatcaa

SEQ ID NO: 5554029 - DNA, 20 bp, Homo sapiens
acccaggatttgctgggaga

SEQ ID NO: 5554030 - DNA, 12 bp, Homo sapiens
acccaggcagct

SEQ ID NO: 5554031 - DNA, 22 bp, Homo sapiens
acccaggcagtaccattcagga

SEQ ID NO: 5554032 - DNA, 17 bp, Homo sapiens
acccaggcctatgttga

SEQ ID NO: 5554033 - DNA, 17 bp, Homo sapiens
acccaggcctccctgca

SEQ ID NO: 5554034 - DNA, 19 bp, Homo sapiens
acccaggcctccctgcaga

SEQ ID NO: 5554035 - DNA, 23 bp, Homo sapiens
acccaggcctgattcactggcct

SEQ ID NO: 5554036 - DNA, 13 bp, Homo sapiens
acccaggcgctgc

SEQ ID NO: 5554037 - DNA, 19 bp, Homo sapiens
acccaggctagagtgcaat

SEQ ID NO: 5554038 - DNA, 12 bp, Homo sapiens
acccaggctcca

SEQ ID NO: 5554039 - DNA, 16 bp, Homo sapiens
acccaggctccgccct

SEQ ID NO: 5554040 - DNA, 19 bp, Homo sapiens
acccaggctctggagccag

SEQ ID NO: 5554041 - DNA, 14 bp, Homo sapiens
acccaggctgcact

SEQ ID NO: 5554042 - DNA, 19 bp, Homo sapiens
acccaggctgcactgcagt

SEQ ID NO: 5554043 - DNA, 17 bp, Homo sapiens
accccatactctccttt

SEQ ID NO: 5554044 - DNA, 15 bp, Homo sapiens
accccatagacctaa

SEQ ID NO: 5554045 - DNA, 23 bp, Homo sapiens
accccatagggtcggaggtgctg

SEQ ID NO: 5554046 - DNA, 20 bp, Homo sapiens
accccatagtgccttgattt

SEQ ID NO: 5554047 - DNA, 22 bp, Homo sapiens
accccatatcttctgtttcata

SEQ ID NO: 5554048 - DNA, 23 bp, Homo sapiens
accccatcacctactcacacagg

SEQ ID NO: 5554049 - DNA, 20 bp, Homo sapiens
accccatcactcgcaggacc

SEQ ID NO: 5554050 - DNA, 13 bp, Homo sapiens
accccatccacct

SEQ ID NO: 5554051 - DNA, 14 bp, Homo sapiens
accccatccaccta

SEQ ID NO: 5554052 - DNA, 17 bp, Homo sapiens
accccatccctccccag

SEQ ID NO: 5554053 - DNA, 18 bp, Homo sapiens
accccatccctccttaag

SEQ ID NO: 5554054 - DNA, 14 bp, Homo sapiens
accccatcccttcc

SEQ ID NO: 5554055 - DNA, 15 bp, Homo sapiens
accccatcgccaact

SEQ ID NO: 5554056 - DNA, 15 bp, Homo sapiens
accccatctccaaga

SEQ ID NO: 5554057 - DNA, 13 bp, Homo sapiens
accccatctgctg

SEQ ID NO: 5554058 - DNA, 14 bp, Homo sapiens
accccatctgctga

SEQ ID NO: 5554059 - DNA, 15 bp, Homo sapiens
accccatgagctcgg

SEQ ID NO: 5554060 - DNA, 14 bp, Homo sapiens
accccatgcacctc

SEQ ID NO: 5554061 - DNA, 16 bp, Homo sapiens
accccatgccaaagct

SEQ ID NO: 5554062 - DNA, 19 bp, Homo sapiens
accccatgctggccttgcc

SEQ ID NO: 5554063 - DNA, 16 bp, Homo sapiens
accccatgctgttgat

SEQ ID NO: 5554064 - DNA, 14 bp, Homo sapiens
accccatggccggc

SEQ ID NO: 5554065 - DNA, 19 bp, Homo sapiens
accccatggctgcacagtt

SEQ ID NO: 5554066 - DNA, 14 bp, Homo sapiens
accccatgggcttg

SEQ ID NO: 5554067 - DNA, 21 bp, Homo sapiens
accccatggtgctaggaagag

SEQ ID NO: 5554068 - DNA, 23 bp, Homo sapiens
accccatgtcaccggatcctggg

SEQ ID NO: 5554069 - DNA, 14 bp, Homo sapiens
accccattcccgca

SEQ ID NO: 5554070 - DNA, 12 bp, Homo sapiens
accccattcctg

SEQ ID NO: 5554071 - DNA, 13 bp, Homo sapiens
accccattcctga

SEQ ID NO: 5554072 - DNA, 16 bp, Homo sapiens
accccattctgggact

SEQ ID NO: 5554073 - DNA, 15 bp, Homo sapiens
accccatttctctcc

SEQ ID NO: 5554074 - DNA, 16 bp, Homo sapiens
accccattttctgtgg

SEQ ID NO: 5554075 - DNA, 17 bp, Homo sapiens
acccccaaagacctgcc

SEQ ID NO: 5554076 - DNA, 18 bp, Homo sapiens
acccccaaagacctgcct

SEQ ID NO: 5554077 - DNA, 17 bp, Homo sapiens
acccccaaattcaaaag

SEQ ID NO: 5554078 - DNA, 16 bp, Homo sapiens
acccccaaattttctt

SEQ ID NO: 5554079 - DNA, 19 bp, Homo sapiens
acccccaagcttccacctg

SEQ ID NO: 5554080 - DNA, 16 bp, Homo sapiens
acccccaaggggcagt

SEQ ID NO: 5554081 - DNA, 15 bp, Homo sapiens
acccccaataaacct

SEQ ID NO: 5554082 - DNA, 20 bp, Homo sapiens
acccccacaagctgtccctg

SEQ ID NO: 5554083 - DNA, 15 bp, Homo sapiens
acccccacacctcag

SEQ ID NO: 5554084 - DNA, 17 bp, Homo sapiens
acccccacacctcagtt

SEQ ID NO: 5554085 - DNA, 22 bp, Homo sapiens
acccccacagacctgctctgga

SEQ ID NO: 5554086 - DNA, 19 bp, Homo sapiens
acccccaccactcttgact

SEQ ID NO: 5554087 - DNA, 14 bp, Homo sapiens
acccccaccagaca

SEQ ID NO: 5554088 - DNA, 21 bp, Homo sapiens
acccccaccatgcagcccctg

SEQ ID NO: 5554089 - DNA, 10 bp, Homo sapiens
acccccaccc

SEQ ID NO: 5554090 - DNA, 13 bp, Homo sapiens
acccccacccacc

SEQ ID NO: 5554091 - DNA, 14 bp, Homo sapiens
acccccaccccaca

SEQ ID NO: 5554092 - DNA, 12 bp, Homo sapiens
acccccacccct

SEQ ID NO: 5554093 - DNA, 15 bp, Homo sapiens
acccccaccccttcc

SEQ ID NO: 5554094 - DNA, 17 bp, Homo sapiens
acccccaccccttgctc

SEQ ID NO: 5554095 - DNA, 11 bp, Homo sapiens
acccccaccct

SEQ ID NO: 5554096 - DNA, 12 bp, Homo sapiens
acccccaccctt

SEQ ID NO: 5554097 - DNA, 18 bp, Homo sapiens
acccccaccgaagagccc

SEQ ID NO: 5554098 - DNA, 20 bp, Homo sapiens
acccccaccgaagagccctg

SEQ ID NO: 5554099 - DNA, 24 bp, Homo sapiens
acccccaccgaagagccctgagct

SEQ ID NO: 5554100 - DNA, 13 bp, Homo sapiens
acccccacctccc

SEQ ID NO: 5554101 - DNA, 18 bp, Homo sapiens
acccccacctccctgcag

SEQ ID NO: 5554102 - DNA, 17 bp, Homo sapiens
acccccactcccgcctc

SEQ ID NO: 5554103 - DNA, 22 bp, Homo sapiens
acccccactctcattccccagg

SEQ ID NO: 5554104 - DNA, 17 bp, Homo sapiens
acccccactggactgac

SEQ ID NO: 5554105 - DNA, 21 bp, Homo sapiens
acccccagaatgacctggccg

SEQ ID NO: 5554106 - DNA, 19 bp, Homo sapiens
acccccagagaccttttct

SEQ ID NO: 5554107 - DNA, 15 bp, Homo sapiens
acccccagaggtggc

SEQ ID NO: 5554108 - DNA, 13 bp, Homo sapiens
acccccagcaacc

SEQ ID NO: 5554109 - DNA, 18 bp, Homo sapiens
acccccagcacccgggct

SEQ ID NO: 5554110 - DNA, 12 bp, Homo sapiens
acccccagcact

SEQ ID NO: 5554111 - DNA, 16 bp, Homo sapiens
acccccagccaggcta

SEQ ID NO: 5554112 - DNA, 11 bp, Homo sapiens
acccccagccc

SEQ ID NO: 5554113 - DNA, 20 bp, Homo sapiens
acccccagcccacagagcct

SEQ ID NO: 5554114 - DNA, 12 bp, Homo sapiens
acccccagcccc

SEQ ID NO: 5554115 - DNA, 21 bp, Homo sapiens
acccccagccccgactccagc

SEQ ID NO: 5554116 - DNA, 23 bp, Homo sapiens
acccccagccccgactccagcca

SEQ ID NO: 5554117 - DNA, 15 bp, Homo sapiens
acccccagcccctcc

SEQ ID NO: 5554118 - DNA, 22 bp, Homo sapiens
acccccagccctggcccctcca

SEQ ID NO: 5554119 - DNA, 12 bp, Homo sapiens
acccccagcctc

SEQ ID NO: 5554120 - DNA, 16 bp, Homo sapiens
acccccagcctccccc

SEQ ID NO: 5554121 - DNA, 17 bp, Homo sapiens
acccccagcctccccca

SEQ ID NO: 5554122 - DNA, 14 bp, Homo sapiens
acccccagcctgct

SEQ ID NO: 5554123 - DNA, 13 bp, Homo sapiens
acccccagccttg

SEQ ID NO: 5554124 - DNA, 17 bp, Homo sapiens
acccccagccttgccca

SEQ ID NO: 5554125 - DNA, 20 bp, Homo sapiens
acccccagctaataaaccag

SEQ ID NO: 5554126 - DNA, 13 bp, Homo sapiens
acccccagctcct

SEQ ID NO: 5554127 - DNA, 13 bp, Homo sapiens
acccccagctggg

SEQ ID NO: 5554128 - DNA, 14 bp, Homo sapiens
acccccagctttgc

SEQ ID NO: 5554129 - DNA, 20 bp, Homo sapiens
acccccaggacagcacacgg

SEQ ID NO: 5554130 - DNA, 15 bp, Homo sapiens
acccccaggaccaga

SEQ ID NO: 5554131 - DNA, 16 bp, Homo sapiens
acccccaggacccctg

SEQ ID NO: 5554132 - DNA, 19 bp, Homo sapiens
acccccaggacctcttcag

SEQ ID NO: 5554133 - DNA, 13 bp, Homo sapiens
acccccaggagga

SEQ ID NO: 5554134 - DNA, 16 bp, Homo sapiens
acccccaggaggagag

SEQ ID NO: 5554135 - DNA, 18 bp, Homo sapiens
acccccaggattcccaga

SEQ ID NO: 5554136 - DNA, 21 bp, Homo sapiens
acccccaggattcccagagag

SEQ ID NO: 5554137 - DNA, 12 bp, Homo sapiens
acccccaggcct

SEQ ID NO: 5554138 - DNA, 21 bp, Homo sapiens
acccccaggcctcagtctccc

SEQ ID NO: 5554139 - DNA, 14 bp, Homo sapiens
acccccaggcctcc

SEQ ID NO: 5554140 - DNA, 21 bp, Homo sapiens
acccccaggcctcctagggga

SEQ ID NO: 5554141 - DNA, 21 bp, Homo sapiens
acccccagtcctcactgtcct

SEQ ID NO: 5554142 - DNA, 21 bp, Homo sapiens
acccccagtcctccctagctc

SEQ ID NO: 5554143 - DNA, 18 bp, Homo sapiens
acccccagtgctcacaca

SEQ ID NO: 5554144 - DNA, 19 bp, Homo sapiens
acccccagtgctcacacaa

SEQ ID NO: 5554145 - DNA, 14 bp, Homo sapiens
acccccatccagcc

SEQ ID NO: 5554146 - DNA, 23 bp, Homo sapiens
acccccatccagcctccagggca

SEQ ID NO: 5554147 - DNA, 17 bp, Homo sapiens
acccccatctccctagc

SEQ ID NO: 5554148 - DNA, 14 bp, Homo sapiens
acccccatgctgcc

SEQ ID NO: 5554149 - DNA, 17 bp, Homo sapiens
acccccatgtaaatatt

SEQ ID NO: 5554150 - DNA, 20 bp, Homo sapiens
acccccatgtggcagcccat

SEQ ID NO: 5554151 - DNA, 16 bp, Homo sapiens
acccccattaaattca

SEQ ID NO: 5554152 - DNA, 16 bp, Homo sapiens
acccccattctgtcct

SEQ ID NO: 5554153 - DNA, 18 bp, Homo sapiens
acccccatttctatttat

SEQ ID NO: 5554154 - DNA, 22 bp, Homo sapiens
accccccacactcactcctgag

SEQ ID NO: 5554155 - DNA, 13 bp, Homo sapiens
accccccacctgc

SEQ ID NO: 5554156 - DNA, 15 bp, Homo sapiens
accccccactccctg

SEQ ID NO: 5554157 - DNA, 20 bp, Homo sapiens
accccccactccctgccacc

SEQ ID NO: 5554158 - DNA, 16 bp, Homo sapiens
accccccactctgtgc

SEQ ID NO: 5554159 - DNA, 15 bp, Homo sapiens
accccccagcctcca

SEQ ID NO: 5554160 - DNA, 16 bp, Homo sapiens
accccccagcctccag

SEQ ID NO: 5554161 - DNA, 21 bp, Homo sapiens
accccccagctcgctggcttt

SEQ ID NO: 5554162 - DNA, 21 bp, Homo sapiens
accccccagtataaatttctg

SEQ ID NO: 5554163 - DNA, 18 bp, Homo sapiens
acccccccaccccaggcc

SEQ ID NO: 5554164 - DNA, 11 bp, Homo sapiens
acccccccagg

SEQ ID NO: 5554165 - DNA, 13 bp, Homo sapiens
acccccccaggcc

SEQ ID NO: 5554166 - DNA, 18 bp, Homo sapiens
acccccccccaatcggac

SEQ ID NO: 5554167 - DNA, 22 bp, Homo sapiens
accccccccccccccgcccacc

SEQ ID NO: 5554168 - DNA, 20 bp, Homo sapiens
accccccctcctgctgccta

SEQ ID NO: 5554169 - DNA, 17 bp, Homo sapiens
accccccgacctggctg

SEQ ID NO: 5554170 - DNA, 14 bp, Homo sapiens
accccccgtgggct

SEQ ID NO: 5554171 - DNA, 13 bp, Homo sapiens
acccccctcccag

SEQ ID NO: 5554172 - DNA, 18 bp, Homo sapiens
acccccctcccagacagg

SEQ ID NO: 5554173 - DNA, 14 bp, Homo sapiens
acccccctccccaa

SEQ ID NO: 5554174 - DNA, 17 bp, Homo sapiens
acccccctccccaactc

SEQ ID NO: 5554175 - DNA, 15 bp, Homo sapiens
acccccctcctcccc

SEQ ID NO: 5554176 - DNA, 17 bp, Homo sapiens
acccccctcctccccct

SEQ ID NO: 5554177 - DNA, 12 bp, Homo sapiens
acccccctcctg

SEQ ID NO: 5554178 - DNA, 20 bp, Homo sapiens
acccccctcctgctcctccc

SEQ ID NO: 5554179 - DNA, 15 bp, Homo sapiens
acccccctctgctgc

SEQ ID NO: 5554180 - DNA, 16 bp, Homo sapiens
acccccctctgctgcc

SEQ ID NO: 5554181 - DNA, 15 bp, Homo sapiens
acccccctgggctga

SEQ ID NO: 5554182 - DNA, 17 bp, Homo sapiens
acccccctgtgcctgct

SEQ ID NO: 5554183 - DNA, 18 bp, Homo sapiens
acccccctgtgcctgctg

SEQ ID NO: 5554184 - DNA, 21 bp, Homo sapiens
acccccctgtgcctgctgggc

SEQ ID NO: 5554185 - DNA, 12 bp, Homo sapiens
acccccctgttc

SEQ ID NO: 5554186 - DNA, 13 bp, Homo sapiens
accccccttctga

SEQ ID NO: 5554187 - DNA, 16 bp, Homo sapiens
acccccgaccctgccc

SEQ ID NO: 5554188 - DNA, 19 bp, Homo sapiens
acccccgaccctgccctgg

SEQ ID NO: 5554189 - DNA, 16 bp, Homo sapiens
acccccgacggcctcc

SEQ ID NO: 5554190 - DNA, 19 bp, Homo sapiens
acccccgagcttgcctcag

SEQ ID NO: 5554191 - DNA, 24 bp, Homo sapiens
acccccgagcttgcctcagggcca

SEQ ID NO: 5554192 - DNA, 22 bp, Homo sapiens
acccccgaggcccccctctgcc

SEQ ID NO: 5554193 - DNA, 17 bp, Homo sapiens
acccccgaggggagggc

SEQ ID NO: 5554194 - DNA, 20 bp, Homo sapiens
acccccgaggggagggcagg

SEQ ID NO: 5554195 - DNA, 14 bp, Homo sapiens
acccccgcaccctt

SEQ ID NO: 5554196 - DNA, 15 bp, Homo sapiens
acccccgccacctca

SEQ ID NO: 5554197 - DNA, 16 bp, Homo sapiens
acccccgccaggcgca

SEQ ID NO: 5554198 - DNA, 15 bp, Homo sapiens
acccccgcccaggct

SEQ ID NO: 5554199 - DNA, 20 bp, Homo sapiens
acccccgcccaggctggcca

SEQ ID NO: 5554200 - DNA, 21 bp, Homo sapiens
acccccgcccccaccgggctg

SEQ ID NO: 5554201 - DNA, 15 bp, Homo sapiens
acccccgccccctgc

SEQ ID NO: 5554202 - DNA, 13 bp, Homo sapiens
acccccgctggag

SEQ ID NO: 5554203 - DNA, 15 bp, Homo sapiens
acccccgctggagga

SEQ ID NO: 5554204 - DNA, 15 bp, Homo sapiens
acccccggcagcagc

SEQ ID NO: 5554205 - DNA, 19 bp, Homo sapiens
acccccggcctccaggctg

SEQ ID NO: 5554206 - DNA, 20 bp, Homo sapiens
acccccggcctccaggctgg

SEQ ID NO: 5554207 - DNA, 23 bp, Homo sapiens
acccccggcctccaggctggggc

SEQ ID NO: 5554208 - DNA, 18 bp, Homo sapiens
acccccgggatcctgccc

SEQ ID NO: 5554209 - DNA, 16 bp, Homo sapiens
acccccgggtgcctgt

SEQ ID NO: 5554210 - DNA, 20 bp, Homo sapiens
acccccgtggggcagggagc

SEQ ID NO: 5554211 - DNA, 15 bp, Homo sapiens
acccccgtggtcttt

SEQ ID NO: 5554212 - DNA, 18 bp, Homo sapiens
acccccgtggtctttgaa

SEQ ID NO: 5554213 - DNA, 19 bp, Homo sapiens
acccccgttagcttcctgc

SEQ ID NO: 5554214 - DNA, 20 bp, Homo sapiens
accccctcaagccccagcag

SEQ ID NO: 5554215 - DNA, 20 bp, Homo sapiens
accccctcaccatccagtgg

SEQ ID NO: 5554216 - DNA, 18 bp, Homo sapiens
accccctcagccttggga

SEQ ID NO: 5554217 - DNA, 11 bp, Homo sapiens
accccctcatt

SEQ ID NO: 5554218 - DNA, 16 bp, Homo sapiens
accccctcattcccct

SEQ ID NO: 5554219 - DNA, 18 bp, Homo sapiens
accccctcattcccctcg

SEQ ID NO: 5554220 - DNA, 23 bp, Homo sapiens
accccctccaccccccactcagt

SEQ ID NO: 5554221 - DNA, 18 bp, Homo sapiens
accccctccagctccagt

SEQ ID NO: 5554222 - DNA, 15 bp, Homo sapiens
accccctccccgccc

SEQ ID NO: 5554223 - DNA, 23 bp, Homo sapiens
accccctccccgcccctgtggcc

SEQ ID NO: 5554224 - DNA, 23 bp, Homo sapiens
accccctccccgggcagcagaga

SEQ ID NO: 5554225 - DNA, 19 bp, Homo sapiens
accccctccctacacacac

SEQ ID NO: 5554226 - DNA, 14 bp, Homo sapiens
accccctccctggc

SEQ ID NO: 5554227 - DNA, 13 bp, Homo sapiens
accccctccctgt

SEQ ID NO: 5554228 - DNA, 11 bp, Homo sapiens
accccctcctc

SEQ ID NO: 5554229 - DNA, 13 bp, Homo sapiens
accccctcctccc

SEQ ID NO: 5554230 - DNA, 13 bp, Homo sapiens
accccctcctctc

SEQ ID NO: 5554231 - DNA, 14 bp, Homo sapiens
accccctcctctct

SEQ ID NO: 5554232 - DNA, 15 bp, Homo sapiens
accccctcctctctg

SEQ ID NO: 5554233 - DNA, 16 bp, Homo sapiens
accccctcctctctgc

SEQ ID NO: 5554234 - DNA, 13 bp, Homo sapiens
accccctcctggc

SEQ ID NO: 5554235 - DNA, 14 bp, Homo sapiens
accccctcctggca

SEQ ID NO: 5554236 - DNA, 16 bp, Homo sapiens
accccctccttcagac

SEQ ID NO: 5554237 - DNA, 19 bp, Homo sapiens
accccctccttcagacacc

SEQ ID NO: 5554238 - DNA, 11 bp, Homo sapiens
accccctcgcc

SEQ ID NO: 5554239 - DNA, 15 bp, Homo sapiens
accccctcgccagct

SEQ ID NO: 5554240 - DNA, 16 bp, Homo sapiens
accccctcgccagctt

SEQ ID NO: 5554241 - DNA, 19 bp, Homo sapiens
accccctcgccagcttggc

SEQ ID NO: 5554242 - DNA, 16 bp, Homo sapiens
accccctcgcttggac

SEQ ID NO: 5554243 - DNA, 18 bp, Homo sapiens
accccctcggagcctgtg

SEQ ID NO: 5554244 - DNA, 15 bp, Homo sapiens
accccctctcctgga

SEQ ID NO: 5554245 - DNA, 19 bp, Homo sapiens
accccctctcctggagggc

SEQ ID NO: 5554246 - DNA, 22 bp, Homo sapiens
accccctgagatcccctgagcc

SEQ ID NO: 5554247 - DNA, 23 bp, Homo sapiens
accccctgagatcccctgagccc

SEQ ID NO: 5554248 - DNA, 17 bp, Homo sapiens
accccctgcaaagccca

SEQ ID NO: 5554249 - DNA, 20 bp, Homo sapiens
accccctgcaaagcccagct

SEQ ID NO: 5554250 - DNA, 18 bp, Homo sapiens
accccctgcagcccaggc

SEQ ID NO: 5554251 - DNA, 20 bp, Homo sapiens
accccctgcagcccaggcca

SEQ ID NO: 5554252 - DNA, 13 bp, Homo sapiens
accccctgcagct

SEQ ID NO: 5554253 - DNA, 15 bp, Homo sapiens
accccctgcagcttg

SEQ ID NO: 5554254 - DNA, 14 bp, Homo sapiens
accccctgcccaca

SEQ ID NO: 5554255 - DNA, 16 bp, Homo sapiens
accccctgccccagag

SEQ ID NO: 5554256 - DNA, 13 bp, Homo sapiens
accccctgccctg

SEQ ID NO: 5554257 - DNA, 12 bp, Homo sapiens
accccctgcctg

SEQ ID NO: 5554258 - DNA, 18 bp, Homo sapiens
accccctgctccaccagc

SEQ ID NO: 5554259 - DNA, 13 bp, Homo sapiens
accccctgctggt

SEQ ID NO: 5554260 - DNA, 15 bp, Homo sapiens
accccctgctggtgc

SEQ ID NO: 5554261 - DNA, 15 bp, Homo sapiens
accccctggccctgc

SEQ ID NO: 5554262 - DNA, 17 bp, Homo sapiens
accccctgtaaggttcc

SEQ ID NO: 5554263 - DNA, 18 bp, Homo sapiens
accccctgtcctgtgctg

SEQ ID NO: 5554264 - DNA, 13 bp, Homo sapiens
accccctgtgcct

SEQ ID NO: 5554265 - DNA, 17 bp, Homo sapiens
acccccttccctgggag

SEQ ID NO: 5554266 - DNA, 18 bp, Homo sapiens
acccccttctactgagcc

SEQ ID NO: 5554267 - DNA, 19 bp, Homo sapiens
acccccttctactgagcct

SEQ ID NO: 5554268 - DNA, 13 bp, Homo sapiens
acccccttctctg

SEQ ID NO: 5554269 - DNA, 18 bp, Homo sapiens
acccccttctctgcccat

SEQ ID NO: 5554270 - DNA, 22 bp, Homo sapiens
acccccttctctgcccattccc

SEQ ID NO: 5554271 - DNA, 16 bp, Homo sapiens
acccccttctctgctc

SEQ ID NO: 5554272 - DNA, 18 bp, Homo sapiens
acccccttctctgctcca

SEQ ID NO: 5554273 - DNA, 20 bp, Homo sapiens
acccccttctctgctccacc

SEQ ID NO: 5554274 - DNA, 13 bp, Homo sapiens
acccccttctggg

SEQ ID NO: 5554275 - DNA, 16 bp, Homo sapiens
acccccttctgggcat

SEQ ID NO: 5554276 - DNA, 16 bp, Homo sapiens
acccccttgcccaggc

SEQ ID NO: 5554277 - DNA, 21 bp, Homo sapiens
acccccttgcccaggcctccc

SEQ ID NO: 5554278 - DNA, 16 bp, Homo sapiens
acccccttgtctgctg

SEQ ID NO: 5554279 - DNA, 18 bp, Homo sapiens
acccccttgtctgctgct

SEQ ID NO: 5554280 - DNA, 19 bp, Homo sapiens
acccccttgtctgctgctc

SEQ ID NO: 5554281 - DNA, 21 bp, Homo sapiens
accccctttgactctggggtg

SEQ ID NO: 5554282 - DNA, 20 bp, Homo sapiens
accccctttggtttgacaat

SEQ ID NO: 5554283 - DNA, 18 bp, Homo sapiens
accccctttgtgctgtgg

SEQ ID NO: 5554284 - DNA, 23 bp, Homo sapiens
acccccttttcagctgagccctg

SEQ ID NO: 5554285 - DNA, 17 bp, Homo sapiens
acccccttttcccttca

SEQ ID NO: 5554286 - DNA, 19 bp, Homo sapiens
accccgaaatcagccccca

SEQ ID NO: 5554287 - DNA, 20 bp, Homo sapiens
accccgaaatcagcccccag

SEQ ID NO: 5554288 - DNA, 22 bp, Homo sapiens
accccgaaatcagcccccagcc

SEQ ID NO: 5554289 - DNA, 18 bp, Homo sapiens
accccgactatccctgca

SEQ ID NO: 5554290 - DNA, 12 bp, Homo sapiens
accccgactttt

SEQ ID NO: 5554291 - DNA, 15 bp, Homo sapiens
accccgacttttgtt

SEQ ID NO: 5554292 - DNA, 16 bp, Homo sapiens
accccgagaaccctga

SEQ ID NO: 5554293 - DNA, 15 bp, Homo sapiens
accccgagaagtgct

SEQ ID NO: 5554294 - DNA, 20 bp, Homo sapiens
accccgagaagtgctcttgg

SEQ ID NO: 5554295 - DNA, 13 bp, Homo sapiens
accccgagcccta

SEQ ID NO: 5554296 - DNA, 15 bp, Homo sapiens
accccgagggctgag

SEQ ID NO: 5554297 - DNA, 22 bp, Homo sapiens
accccgagggctgaggagcagc

SEQ ID NO: 5554298 - DNA, 17 bp, Homo sapiens
accccgatgtggacctc

SEQ ID NO: 5554299 - DNA, 15 bp, Homo sapiens
accccgcacccggct

SEQ ID NO: 5554300 - DNA, 16 bp, Homo sapiens
accccgcacccggctc

SEQ ID NO: 5554301 - DNA, 15 bp, Homo sapiens
accccgcagacacct

SEQ ID NO: 5554302 - DNA, 18 bp, Homo sapiens
accccgcagacaccttgg

SEQ ID NO: 5554303 - DNA, 18 bp, Homo sapiens
accccgcagcacgcctct

SEQ ID NO: 5554304 - DNA, 19 bp, Homo sapiens
accccgcagcacgcctctc

SEQ ID NO: 5554305 - DNA, 21 bp, Homo sapiens
accccgcagcacgcctctccc

SEQ ID NO: 5554306 - DNA, 14 bp, Homo sapiens
accccgcagcccgt

SEQ ID NO: 5554307 - DNA, 15 bp, Homo sapiens
accccgcagcccgtg

SEQ ID NO: 5554308 - DNA, 23 bp, Homo sapiens
accccgcaggatccctcctgagc

SEQ ID NO: 5554309 - DNA, 14 bp, Homo sapiens
accccgcagtcact

SEQ ID NO: 5554310 - DNA, 12 bp, Homo sapiens
accccgccagcc

SEQ ID NO: 5554311 - DNA, 19 bp, Homo sapiens
accccgccatgcatgcagc

SEQ ID NO: 5554312 - DNA, 14 bp, Homo sapiens
accccgcccctgca

SEQ ID NO: 5554313 - DNA, 15 bp, Homo sapiens
accccgcccctgcat

SEQ ID NO: 5554314 - DNA, 15 bp, Homo sapiens
accccgcctctgggc

SEQ ID NO: 5554315 - DNA, 19 bp, Homo sapiens
accccgcctgccctcatgg

SEQ ID NO: 5554316 - DNA, 17 bp, Homo sapiens
accccgcctgccctccc

SEQ ID NO: 5554317 - DNA, 21 bp, Homo sapiens
accccgcctgccctcccaccc

SEQ ID NO: 5554318 - DNA, 14 bp, Homo sapiens
accccgcctgcctc

SEQ ID NO: 5554319 - DNA, 19 bp, Homo sapiens
accccgcctgcctcctggc

SEQ ID NO: 5554320 - DNA, 22 bp, Homo sapiens
accccgcctgcctcctggctca

SEQ ID NO: 5554321 - DNA, 17 bp, Homo sapiens
accccgcggtgctctgg

SEQ ID NO: 5554322 - DNA, 19 bp, Homo sapiens
accccgcggtgctctggcg

SEQ ID NO: 5554323 - DNA, 15 bp, Homo sapiens
accccgctcttccca

SEQ ID NO: 5554324 - DNA, 22 bp, Homo sapiens
accccggaggcgtggaggagag

SEQ ID NO: 5554325 - DNA, 15 bp, Homo sapiens
accccggatcgagga

SEQ ID NO: 5554326 - DNA, 14 bp, Homo sapiens
accccggcaggccc

SEQ ID NO: 5554327 - DNA, 15 bp, Homo sapiens
accccggcaggccct

SEQ ID NO: 5554328 - DNA, 18 bp, Homo sapiens
accccggcaggccctgca

SEQ ID NO: 5554329 - DNA, 20 bp, Homo sapiens
accccggcaggccctgcagt

SEQ ID NO: 5554330 - DNA, 15 bp, Homo sapiens
accccggcctcaggg

SEQ ID NO: 5554331 - DNA, 19 bp, Homo sapiens
accccggctccccctgcca

SEQ ID NO: 5554332 - DNA, 20 bp, Homo sapiens
accccggctccccctgccag

SEQ ID NO: 5554333 - DNA, 17 bp, Homo sapiens
accccgggcccgggccc

SEQ ID NO: 5554334 - DNA, 15 bp, Homo sapiens
accccgggccggacc

SEQ ID NO: 5554335 - DNA, 15 bp, Homo sapiens
accccgggctctcct

SEQ ID NO: 5554336 - DNA, 17 bp, Homo sapiens
accccgggctctctgct

SEQ ID NO: 5554337 - DNA, 17 bp, Homo sapiens
accccggggaccctgtg

SEQ ID NO: 5554338 - DNA, 20 bp, Homo sapiens
accccggggtgcccacaggc

SEQ ID NO: 5554339 - DNA, 21 bp, Homo sapiens
accccggggtgcccacaggcc

SEQ ID NO: 5554340 - DNA, 23 bp, Homo sapiens
accccggggtgcccacaggccgc

SEQ ID NO: 5554341 - DNA, 18 bp, Homo sapiens
accccgtcccggccccgc

SEQ ID NO: 5554342 - DNA, 17 bp, Homo sapiens
accccgtccctttccct

SEQ ID NO: 5554343 - DNA, 20 bp, Homo sapiens
accccgtccctttccctgca

SEQ ID NO: 5554344 - DNA, 22 bp, Homo sapiens
accccgtccctttccctgcatc

SEQ ID NO: 5554345 - DNA, 15 bp, Homo sapiens
accccgtctctacta

SEQ ID NO: 5554346 - DNA, 19 bp, Homo sapiens
accccgtctctataccaac

SEQ ID NO: 5554347 - DNA, 14 bp, Homo sapiens
accccgtctgcccc

SEQ ID NO: 5554348 - DNA, 15 bp, Homo sapiens
accccgtctgcccct

SEQ ID NO: 5554349 - DNA, 16 bp, Homo sapiens
accccgtggctctggg

SEQ ID NO: 5554350 - DNA, 15 bp, Homo sapiens
accccgttacagctc

SEQ ID NO: 5554351 - DNA, 20 bp, Homo sapiens
accccgttgttgtccctgca

SEQ ID NO: 5554352 - DNA, 15 bp, Homo sapiens
acccctaaaaacaaa

SEQ ID NO: 5554353 - DNA, 16 bp, Homo sapiens
acccctaacctggctt

SEQ ID NO: 5554354 - DNA, 16 bp, Homo sapiens
acccctaagactgcct

SEQ ID NO: 5554355 - DNA, 18 bp, Homo sapiens
acccctaagactgccttc

SEQ ID NO: 5554356 - DNA, 20 bp, Homo sapiens
acccctaagactgccttcag

SEQ ID NO: 5554357 - DNA, 14 bp, Homo sapiens
acccctaagagact

SEQ ID NO: 5554358 - DNA, 15 bp, Homo sapiens
acccctaagtgccca

SEQ ID NO: 5554359 - DNA, 23 bp, Homo sapiens
acccctacacaaggacagaaccc

SEQ ID NO: 5554360 - DNA, 15 bp, Homo sapiens
acccctacacacaca

SEQ ID NO: 5554361 - DNA, 19 bp, Homo sapiens
acccctacacacacactcc

SEQ ID NO: 5554362 - DNA, 15 bp, Homo sapiens
acccctacacacacc

SEQ ID NO: 5554363 - DNA, 18 bp, Homo sapiens
acccctacagcctgcaca

SEQ ID NO: 5554364 - DNA, 11 bp, Homo sapiens
acccctacccc

SEQ ID NO: 5554365 - DNA, 16 bp, Homo sapiens
acccctaccccctcat

SEQ ID NO: 5554366 - DNA, 17 bp, Homo sapiens
acccctaccccctcatc

SEQ ID NO: 5554367 - DNA, 13 bp, Homo sapiens
acccctacccctg

SEQ ID NO: 5554368 - DNA, 19 bp, Homo sapiens
acccctaccgatggtccca

SEQ ID NO: 5554369 - DNA, 19 bp, Homo sapiens
acccctacttcacagagga

SEQ ID NO: 5554370 - DNA, 14 bp, Homo sapiens
acccctagccacca

SEQ ID NO: 5554371 - DNA, 18 bp, Homo sapiens
acccctagccaccagtgt

SEQ ID NO: 5554372 - DNA, 19 bp, Homo sapiens
acccctagccaccagtgtc

SEQ ID NO: 5554373 - DNA, 14 bp, Homo sapiens
acccctagccctgg

SEQ ID NO: 5554374 - DNA, 15 bp, Homo sapiens
acccctagccctggt

SEQ ID NO: 5554375 - DNA, 20 bp, Homo sapiens
acccctcacaggagcttact

SEQ ID NO: 5554376 - DNA, 17 bp, Homo sapiens
acccctcactccccagg

SEQ ID NO: 5554377 - DNA, 15 bp, Homo sapiens
acccctcactctggc

SEQ ID NO: 5554378 - DNA, 18 bp, Homo sapiens
acccctcactctggcctc

SEQ ID NO: 5554379 - DNA, 21 bp, Homo sapiens
acccctcagccccagcccaga

SEQ ID NO: 5554380 - DNA, 17 bp, Homo sapiens
acccctcagcgctccct

SEQ ID NO: 5554381 - DNA, 18 bp, Homo sapiens
acccctcagcgctccctg

SEQ ID NO: 5554382 - DNA, 17 bp, Homo sapiens
acccctcatagccctca

SEQ ID NO: 5554383 - DNA, 16 bp, Homo sapiens
acccctccacgtgtcc

SEQ ID NO: 5554384 - DNA, 13 bp, Homo sapiens
acccctccactct

SEQ ID NO: 5554385 - DNA, 14 bp, Homo sapiens
acccctccactgct

SEQ ID NO: 5554386 - DNA, 12 bp, Homo sapiens
acccctccagga

SEQ ID NO: 5554387 - DNA, 20 bp, Homo sapiens
acccctccagttttgcctga

SEQ ID NO: 5554388 - DNA, 21 bp, Homo sapiens
acccctccagttttgcctgag

SEQ ID NO: 5554389 - DNA, 10 bp, Homo sapiens
acccctccat

SEQ ID NO: 5554390 - DNA, 19 bp, Homo sapiens
acccctccatgtgggctag

SEQ ID NO: 5554391 - DNA, 23 bp, Homo sapiens
acccctccattggctcccaagtc

SEQ ID NO: 5554392 - DNA, 14 bp, Homo sapiens
acccctcccaacct

SEQ ID NO: 5554393 - DNA, 12 bp, Homo sapiens
acccctcccagc

SEQ ID NO: 5554394 - DNA, 22 bp, Homo sapiens
acccctcccagctgacagtcct

SEQ ID NO: 5554395 - DNA, 11 bp, Homo sapiens
acccctcccat

SEQ ID NO: 5554396 - DNA, 19 bp, Homo sapiens
acccctcccattaggacaa

SEQ ID NO: 5554397 - DNA, 14 bp, Homo sapiens
acccctccccagtc

SEQ ID NO: 5554398 - DNA, 21 bp, Homo sapiens
acccctccccattcacagagc

SEQ ID NO: 5554399 - DNA, 14 bp, Homo sapiens
acccctcccccacg

SEQ ID NO: 5554400 - DNA, 19 bp, Homo sapiens
acccctcccccacgtctct

SEQ ID NO: 5554401 - DNA, 20 bp, Homo sapiens
acccctcccccacgtctctc

SEQ ID NO: 5554402 - DNA, 21 bp, Homo sapiens
acccctcccccacgtctctct

SEQ ID NO: 5554403 - DNA, 22 bp, Homo sapiens
accctcagcaccccttccatgt

SEQ ID NO: 5554404 - DNA, 16 bp, Homo sapiens
accctcagccccagga

SEQ ID NO: 5554405 - DNA, 21 bp, Homo sapiens
accctcagccccaggagaagg

SEQ ID NO: 5554406 - DNA, 16 bp, Homo sapiens
accctcagccctggcc

SEQ ID NO: 5554407 - DNA, 19 bp, Homo sapiens
accctcagccctggccttt

SEQ ID NO: 5554408 - DNA, 21 bp, Homo sapiens
accctcagccctggccttttt

SEQ ID NO: 5554409 - DNA, 21 bp, Homo sapiens
accctcagccgctctttgctc

SEQ ID NO: 5554410 - DNA, 14 bp, Homo sapiens
accctcagcctcca

SEQ ID NO: 5554411 - DNA, 17 bp, Homo sapiens
accctcagctgcctcat

SEQ ID NO: 5554412 - DNA, 20 bp, Homo sapiens
accctcagctgtcacctgct

SEQ ID NO: 5554413 - DNA, 22 bp, Homo sapiens
accctcagctgtcacctgctca

SEQ ID NO: 5554414 - DNA, 15 bp, Homo sapiens
accctcaggcaggtg

SEQ ID NO: 5554415 - DNA, 16 bp, Homo sapiens
accctcaggcaggtgg

SEQ ID NO: 5554416 - DNA, 22 bp, Homo sapiens
accctcaggcataggcctgggt

SEQ ID NO: 5554417 - DNA, 23 bp, Homo sapiens
accctcaggcataggcctgggtg

SEQ ID NO: 5554418 - DNA, 17 bp, Homo sapiens
accctcagggagcctcc

SEQ ID NO: 5554419 - DNA, 18 bp, Homo sapiens
accctcataccatctgct

SEQ ID NO: 5554420 - DNA, 19 bp, Homo sapiens
accctcataccatctgctg

SEQ ID NO: 5554421 - DNA, 15 bp, Homo sapiens
accctcatctgtctg

SEQ ID NO: 5554422 - DNA, 14 bp, Homo sapiens
accctcatctttct

SEQ ID NO: 5554423 - DNA, 16 bp, Homo sapiens
accctcatctttcttc

SEQ ID NO: 5554424 - DNA, 13 bp, Homo sapiens
accctcatgaaaa

SEQ ID NO: 5554425 - DNA, 14 bp, Homo sapiens
accctcatgctgcc

SEQ ID NO: 5554426 - DNA, 16 bp, Homo sapiens
accctcatgctgccaa

SEQ ID NO: 5554427 - DNA, 13 bp, Homo sapiens
accctcattcttt

SEQ ID NO: 5554428 - DNA, 17 bp, Homo sapiens
accctcattgctgtctt

SEQ ID NO: 5554429 - DNA, 14 bp, Homo sapiens
accctccaaacact

SEQ ID NO: 5554430 - DNA, 14 bp, Homo sapiens
accctccaaaggaa

SEQ ID NO: 5554431 - DNA, 22 bp, Homo sapiens
accctccaaatggagaagctgc

SEQ ID NO: 5554432 - DNA, 17 bp, Homo sapiens
accctccacaggagccg

SEQ ID NO: 5554433 - DNA, 11 bp, Homo sapiens
accctccaccc

SEQ ID NO: 5554434 - DNA, 13 bp, Homo sapiens
accctccaccctg

SEQ ID NO: 5554435 - DNA, 16 bp, Homo sapiens
accctccaccctgtcc

SEQ ID NO: 5554436 - DNA, 18 bp, Homo sapiens
accctccaccgcagaagg

SEQ ID NO: 5554437 - DNA, 12 bp, Homo sapiens
accctccacctc

SEQ ID NO: 5554438 - DNA, 22 bp, Homo sapiens
accctccacctctcacgggccc

SEQ ID NO: 5554439 - DNA, 15 bp, Homo sapiens
accctccactctcct

SEQ ID NO: 5554440 - DNA, 15 bp, Homo sapiens
accctccactctgag

SEQ ID NO: 5554441 - DNA, 16 bp, Homo sapiens
accctccactctgagg

SEQ ID NO: 5554442 - DNA, 14 bp, Homo sapiens
accctccacttccc

SEQ ID NO: 5554443 - DNA, 15 bp, Homo sapiens
accctccagcacaga

SEQ ID NO: 5554444 - DNA, 16 bp, Homo sapiens
accctccagcacagac

SEQ ID NO: 5554445 - DNA, 16 bp, Homo sapiens
accctccagtgctgga

SEQ ID NO: 5554446 - DNA, 13 bp, Homo sapiens
accctccatgctc

SEQ ID NO: 5554447 - DNA, 19 bp, Homo sapiens
accctcccaagtagctggg

SEQ ID NO: 5554448 - DNA, 12 bp, Homo sapiens
accctcccacca

SEQ ID NO: 5554449 - DNA, 16 bp, Homo sapiens
accctcccactcccat

SEQ ID NO: 5554450 - DNA, 22 bp, Homo sapiens
accctcccagaaacatctctgg

SEQ ID NO: 5554451 - DNA, 13 bp, Homo sapiens
accctcccagctc

SEQ ID NO: 5554452 - DNA, 16 bp, Homo sapiens
accctcccagctctga

SEQ ID NO: 5554453 - DNA, 21 bp, Homo sapiens
accctcccagtctcatctcct

SEQ ID NO: 5554454 - DNA, 21 bp, Homo sapiens
accctcccatgagactgccct

SEQ ID NO: 5554455 - DNA, 23 bp, Homo sapiens
accctcccccaggaggtcgaccc

SEQ ID NO: 5554456 - DNA, 23 bp, Homo sapiens
accctccccgcaccccccaagct

SEQ ID NO: 5554457 - DNA, 20 bp, Homo sapiens
accctcccctatgctggtag

SEQ ID NO: 5554458 - DNA, 14 bp, Homo sapiens
accctcccctctcc

SEQ ID NO: 5554459 - DNA, 16 bp, Homo sapiens
accctcccctctcctg

SEQ ID NO: 5554460 - DNA, 12 bp, Homo sapiens
accctcccctgc

SEQ ID NO: 5554461 - DNA, 13 bp, Homo sapiens
accctcccctgcc

SEQ ID NO: 5554462 - DNA, 15 bp, Homo sapiens
accctccctacctga

SEQ ID NO: 5554463 - DNA, 14 bp, Homo sapiens
accctccctagctc

SEQ ID NO: 5554464 - DNA, 15 bp, Homo sapiens
accctccctagctct

SEQ ID NO: 5554465 - DNA, 14 bp, Homo sapiens
accctccctcagcc

SEQ ID NO: 5554466 - DNA, 19 bp, Homo sapiens
accctccctcagcccctct

SEQ ID NO: 5554467 - DNA, 23 bp, Homo sapiens
accctccctcagcccctcttgcc

SEQ ID NO: 5554468 - DNA, 18 bp, Homo sapiens
accctccctccactcctc

SEQ ID NO: 5554469 - DNA, 20 bp, Homo sapiens
accctccctccactcctctc

SEQ ID NO: 5554470 - DNA, 17 bp, Homo sapiens
accctccctccctaccc

SEQ ID NO: 5554471 - DNA, 16 bp, Homo sapiens
accctccctccgatcc

SEQ ID NO: 5554472 - DNA, 23 bp, Homo sapiens
accctccctctactgggagccta

SEQ ID NO: 5554473 - DNA, 17 bp, Homo sapiens
accctccctgactggcc

SEQ ID NO: 5554474 - DNA, 18 bp, Homo sapiens
accctccctgactggcct

SEQ ID NO: 5554475 - DNA, 19 bp, Homo sapiens
accctccctgactggcctg

SEQ ID NO: 5554476 - DNA, 12 bp, Homo sapiens
accctccctgct

SEQ ID NO: 5554477 - DNA, 14 bp, Homo sapiens
accctccctgctgt

SEQ ID NO: 5554478 - DNA, 12 bp, Homo sapiens
accctccctgga

SEQ ID NO: 5554479 - DNA, 14 bp, Homo sapiens
accctccctgtccc

SEQ ID NO: 5554480 - DNA, 22 bp, Homo sapiens
accctccgccttcactccggtg

SEQ ID NO: 5554481 - DNA, 20 bp, Homo sapiens
accctccggcgggtgacagc

SEQ ID NO: 5554482 - DNA, 17 bp, Homo sapiens
accctcctatcacctcc

SEQ ID NO: 5554483 - DNA, 21 bp, Homo sapiens
accctcctatcacctcccctc

SEQ ID NO: 5554484 - DNA, 14 bp, Homo sapiens
accctcctccactc

SEQ ID NO: 5554485 - DNA, 21 bp, Homo sapiens
accctcctccctccaagcctg

SEQ ID NO: 5554486 - DNA, 14 bp, Homo sapiens
accctcctcctctt

SEQ ID NO: 5554487 - DNA, 19 bp, Homo sapiens
accctcctcctcttcacca

SEQ ID NO: 5554488 - DNA, 12 bp, Homo sapiens
accctcctcctt

SEQ ID NO: 5554489 - DNA, 13 bp, Homo sapiens
accctcctctgct

SEQ ID NO: 5554490 - DNA, 17 bp, Homo sapiens
accctcctctgctggga

SEQ ID NO: 5554491 - DNA, 14 bp, Homo sapiens
accctcctcttgga

SEQ ID NO: 5554492 - DNA, 23 bp, Homo sapiens
accctcctgacccccatgtaaat

SEQ ID NO: 5554493 - DNA, 14 bp, Homo sapiens
accctcctgagcct

SEQ ID NO: 5554494 - DNA, 13 bp, Homo sapiens
accctcctgctga

SEQ ID NO: 5554495 - DNA, 15 bp, Homo sapiens
accctcctgctgagc

SEQ ID NO: 5554496 - DNA, 11 bp, Homo sapiens
accctcctggc

SEQ ID NO: 5554497 - DNA, 13 bp, Homo sapiens
accctcctggcac

SEQ ID NO: 5554498 - DNA, 16 bp, Homo sapiens
accctcctggccttcc

SEQ ID NO: 5554499 - DNA, 13 bp, Homo sapiens
accctcctggctc

SEQ ID NO: 5554500 - DNA, 22 bp, Homo sapiens
accctcctgggaaggccacctc

SEQ ID NO: 5554501 - DNA, 21 bp, Homo sapiens
accctcctgtaaatggtgtac

SEQ ID NO: 5554502 - DNA, 13 bp, Homo sapiens
accctcctgtctt

SEQ ID NO: 5554503 - DNA, 18 bp, Homo sapiens
accctcctgtcttcccag

SEQ ID NO: 5554504 - DNA, 20 bp, Homo sapiens
accctcctgtcttcccaggg

SEQ ID NO: 5554505 - DNA, 11 bp, Homo sapiens
accctccttcc

SEQ ID NO: 5554506 - DNA, 13 bp, Homo sapiens
accctccttccac

SEQ ID NO: 5554507 - DNA, 13 bp, Homo sapiens
accctccttccca

SEQ ID NO: 5554508 - DNA, 21 bp, Homo sapiens
accctccttcccactcttctc

SEQ ID NO: 5554509 - DNA, 20 bp, Homo sapiens
accctcgaagcgcgccactc

SEQ ID NO: 5554510 - DNA, 14 bp, Homo sapiens
accctcgaccaccc

SEQ ID NO: 5554511 - DNA, 14 bp, Homo sapiens
accctcgagagcct

SEQ ID NO: 5554512 - DNA, 15 bp, Homo sapiens
accctcgatgttcat

SEQ ID NO: 5554513 - DNA, 16 bp, Homo sapiens
accctcgatgttcatg

SEQ ID NO: 5554514 - DNA, 23 bp, Homo sapiens
accctcgccctgtccctcccact

SEQ ID NO: 5554515 - DNA, 13 bp, Homo sapiens
accctcgctgcca

SEQ ID NO: 5554516 - DNA, 14 bp, Homo sapiens
accctcgctgccac

SEQ ID NO: 5554517 - DNA, 12 bp, Homo sapiens
accctcgctggc

SEQ ID NO: 5554518 - DNA, 17 bp, Homo sapiens
accctcgctggccccca

SEQ ID NO: 5554519 - DNA, 22 bp, Homo sapiens
accctcgctggcccccactggc

SEQ ID NO: 5554520 - DNA, 15 bp, Homo sapiens
accctcggagccccc

SEQ ID NO: 5554521 - DNA, 17 bp, Homo sapiens
accctcgggcccacctg

SEQ ID NO: 5554522 - DNA, 19 bp, Homo sapiens
accctcgggcccacctggc

SEQ ID NO: 5554523 - DNA, 17 bp, Homo sapiens
accctcggggatgtgtc

SEQ ID NO: 5554524 - DNA, 20 bp, Homo sapiens
accctcggggatgtgtcctg

SEQ ID NO: 5554525 - DNA, 18 bp, Homo sapiens
accctcggggcaggaagt

SEQ ID NO: 5554526 - DNA, 20 bp, Homo sapiens
accctcggggggtcacaggc

SEQ ID NO: 5554527 - DNA, 21 bp, Homo sapiens
accctcggggggtcacaggcc

SEQ ID NO: 5554528 - DNA, 15 bp, Homo sapiens
accctctaacctcgc

SEQ ID NO: 5554529 - DNA, 23 bp, Homo sapiens
accctctaacctcgccctctcct

SEQ ID NO: 5554530 - DNA, 14 bp, Homo sapiens
accctctcaaacta

SEQ ID NO: 5554531 - DNA, 12 bp, Homo sapiens
accctctcactt

SEQ ID NO: 5554532 - DNA, 16 bp, Homo sapiens
accctctcagctccag

SEQ ID NO: 5554533 - DNA, 19 bp, Homo sapiens
accctctcaggtgaccaaa

SEQ ID NO: 5554534 - DNA, 16 bp, Homo sapiens
accctctccacaccca

SEQ ID NO: 5554535 - DNA, 18 bp, Homo sapiens
accctctccacacccagc

SEQ ID NO: 5554536 - DNA, 19 bp, Homo sapiens
accctctccacacccagcc

SEQ ID NO: 5554537 - DNA, 20 bp, Homo sapiens
accctctccacacccagcct

SEQ ID NO: 5554538 - DNA, 21 bp, Homo sapiens
accctctccacacccagcctg

SEQ ID NO: 5554539 - DNA, 14 bp, Homo sapiens
accctctccacccc

SEQ ID NO: 5554540 - DNA, 16 bp, Homo sapiens
accctctccaccccat

SEQ ID NO: 5554541 - DNA, 11 bp, Homo sapiens
accctctccat

SEQ ID NO: 5554542 - DNA, 23 bp, Homo sapiens
accctctccatctcccaaggctg

SEQ ID NO: 5554543 - DNA, 14 bp, Homo sapiens
accctctcccagga

SEQ ID NO: 5554544 - DNA, 23 bp, Homo sapiens
accctctccggtttgggttggga

SEQ ID NO: 5554545 - DNA, 20 bp, Homo sapiens
accctctcctgggggtggca

SEQ ID NO: 5554546 - DNA, 23 bp, Homo sapiens
accctctctccaaggtgtttcta

SEQ ID NO: 5554547 - DNA, 20 bp, Homo sapiens
accctctctgtccaatctgc

SEQ ID NO: 5554548 - DNA, 13 bp, Homo sapiens
accctctcttccc

SEQ ID NO: 5554549 - DNA, 12 bp, Homo sapiens
accctctctttc

SEQ ID NO: 5554550 - DNA, 14 bp, Homo sapiens
accctctgaaatac

SEQ ID NO: 5554551 - DNA, 16 bp, Homo sapiens
accctctgaaatacat

SEQ ID NO: 5554552 - DNA, 12 bp, Homo sapiens
accctctgaaga

SEQ ID NO: 5554553 - DNA, 15 bp, Homo sapiens
accctctgaccctag

SEQ ID NO: 5554554 - DNA, 12 bp, Homo sapiens
accctctgagac

SEQ ID NO: 5554555 - DNA, 14 bp, Homo sapiens
accctctgcagaac

SEQ ID NO: 5554556 - DNA, 21 bp, Homo sapiens
accctctgcagaacagtgaaa

SEQ ID NO: 5554557 - DNA, 13 bp, Homo sapiens
accctctgcaggg

SEQ ID NO: 5554558 - DNA, 14 bp, Homo sapiens
accctctgccacca

SEQ ID NO: 5554559 - DNA, 20 bp, Homo sapiens
accctctgccaccagagacc

SEQ ID NO: 5554560 - DNA, 15 bp, Homo sapiens
accctctgcccaggg

SEQ ID NO: 5554561 - DNA, 18 bp, Homo sapiens
accctctgcccagggagt

SEQ ID NO: 5554562 - DNA, 13 bp, Homo sapiens
accctctgctgca

SEQ ID NO: 5554563 - DNA, 11 bp, Homo sapiens
accctctggcc

SEQ ID NO: 5554564 - DNA, 19 bp, Homo sapiens
accctctgggaacctccca

SEQ ID NO: 5554565 - DNA, 11 bp, Homo sapiens
accctctgggg

SEQ ID NO: 5554566 - DNA, 12 bp, Homo sapiens
accctctgggga

SEQ ID NO: 5554567 - DNA, 15 bp, Homo sapiens
accctctggggccct

SEQ ID NO: 5554568 - DNA, 23 bp, Homo sapiens
accctctgggggtcctctctgag

SEQ ID NO: 5554569 - DNA, 14 bp, Homo sapiens
accctctggtcctt

SEQ ID NO: 5554570 - DNA, 18 bp, Homo sapiens
accctctggtccttctga

SEQ ID NO: 5554571 - DNA, 21 bp, Homo sapiens
accctctgtcccacccctagc

SEQ ID NO: 5554572 - DNA, 14 bp, Homo sapiens
accctctgtcccca

SEQ ID NO: 5554573 - DNA, 15 bp, Homo sapiens
accctctgtccccag

SEQ ID NO: 5554574 - DNA, 18 bp, Homo sapiens
accctctgtccccaggcc

SEQ ID NO: 5554575 - DNA, 14 bp, Homo sapiens
accctcttagaaaa

SEQ ID NO: 5554576 - DNA, 15 bp, Homo sapiens
accctcttcctactg

SEQ ID NO: 5554577 - DNA, 16 bp, Homo sapiens
accctcttcctgtgat

SEQ ID NO: 5554578 - DNA, 19 bp, Homo sapiens
accctcttcctgtgatcca

SEQ ID NO: 5554579 - DNA, 19 bp, Homo sapiens
accctcttctcagctccac

SEQ ID NO: 5554580 - DNA, 23 bp, Homo sapiens
accctcttctcagctccactctg

SEQ ID NO: 5554581 - DNA, 14 bp, Homo sapiens
accctcttctctgg

SEQ ID NO: 5554582 - DNA, 18 bp, Homo sapiens
accctcttgcccatcctg

SEQ ID NO: 5554583 - DNA, 16 bp, Homo sapiens
accctcttttaccaac

SEQ ID NO: 5554584 - DNA, 14 bp, Homo sapiens
accctttatttgaa

SEQ ID NO: 5554585 - DNA, 16 bp, Homo sapiens
accctttcacccccaa

SEQ ID NO: 5554586 - DNA, 22 bp, Homo sapiens
accctttccggcacactgccaa

SEQ ID NO: 5554587 - DNA, 17 bp, Homo sapiens
accctttccttccttcc

SEQ ID NO: 5554588 - DNA, 13 bp, Homo sapiens
accctttctggca

SEQ ID NO: 5554589 - DNA, 16 bp, Homo sapiens
accctttctggcacga

SEQ ID NO: 5554590 - DNA, 22 bp, Homo sapiens
accctttctgttgccagtcagc

SEQ ID NO: 5554591 - DNA, 23 bp, Homo sapiens
accctttgctgtgaggctgtcct

SEQ ID NO: 5554592 - DNA, 17 bp, Homo sapiens
accctttgggggttgaa

SEQ ID NO: 5554593 - DNA, 12 bp, Homo sapiens
accctttggttt

SEQ ID NO: 5554594 - DNA, 19 bp, Homo sapiens
accctttgttgaaaaatgt

SEQ ID NO: 5554595 - DNA, 14 bp, Homo sapiens
acccttttaagcat

SEQ ID NO: 5554596 - DNA, 23 bp, Homo sapiens
acccttttaagcatgtgatgttg

SEQ ID NO: 5554597 - DNA, 17 bp, Homo sapiens
acccttttcatgatttt

SEQ ID NO: 5554598 - DNA, 21 bp, Homo sapiens
acccttttcccccttcccatt

SEQ ID NO: 5554599 - DNA, 18 bp, Homo sapiens
acccttttcctccagaca

SEQ ID NO: 5554600 - DNA, 17 bp, Homo sapiens
acccttttcctttgtgg

SEQ ID NO: 5554601 - DNA, 13 bp, Homo sapiens
acccttttctgat

SEQ ID NO: 5554602 - DNA, 17 bp, Homo sapiens
accctttttctccagct

SEQ ID NO: 5554603 - DNA, 15 bp, Homo sapiens
acccttttttctaag

SEQ ID NO: 5554604 - DNA, 15 bp, Homo sapiens
accgaaaacgtggct

SEQ ID NO: 5554605 - DNA, 15 bp, Homo sapiens
accgaagagccctga

SEQ ID NO: 5554606 - DNA, 12 bp, Homo sapiens
accgaagcccag

SEQ ID NO: 5554607 - DNA, 15 bp, Homo sapiens
accgaaggggaaaac

SEQ ID NO: 5554608 - DNA, 21 bp, Homo sapiens
accgaagtggactggcccctg

SEQ ID NO: 5554609 - DNA, 13 bp, Homo sapiens
accgaataaatgt

SEQ ID NO: 5554610 - DNA, 21 bp, Homo sapiens
accgaatatattactgattta

SEQ ID NO: 5554611 - DNA, 15 bp, Homo sapiens
accgaatgtgtcttt

SEQ ID NO: 5554612 - DNA, 22 bp, Homo sapiens
accgaattttattttacagagc

SEQ ID NO: 5554613 - DNA, 17 bp, Homo sapiens
accgacagcggccttga

SEQ ID NO: 5554614 - DNA, 15 bp, Homo sapiens
accgacagctcttac

SEQ ID NO: 5554615 - DNA, 15 bp, Homo sapiens
accgacaggccctgg

SEQ ID NO: 5554616 - DNA, 16 bp, Homo sapiens
accgaccaactccaga

SEQ ID NO: 5554617 - DNA, 19 bp, Homo sapiens
accgaccaactccagactt

SEQ ID NO: 5554618 - DNA, 18 bp, Homo sapiens
accgaccatcgtccagcc

SEQ ID NO: 5554619 - DNA, 20 bp, Homo sapiens
accgaccatcgtccagccct

SEQ ID NO: 5554620 - DNA, 15 bp, Homo sapiens
accgacccttcctgg

SEQ ID NO: 5554621 - DNA, 16 bp, Homo sapiens
accgacccttcctggc

SEQ ID NO: 5554622 - DNA, 23 bp, Homo sapiens
accgacctggtttttaaatagag

SEQ ID NO: 5554623 - DNA, 17 bp, Homo sapiens
accgacgatccctcgac

SEQ ID NO: 5554624 - DNA, 22 bp, Homo sapiens
accgactagacacacaaagcag

SEQ ID NO: 5554625 - DNA, 17 bp, Homo sapiens
accgactagccaggaag

SEQ ID NO: 5554626 - DNA, 17 bp, Homo sapiens
accgactcacctgcgca

SEQ ID NO: 5554627 - DNA, 17 bp, Homo sapiens
accgactctgagctgct

SEQ ID NO: 5554628 - DNA, 14 bp, Homo sapiens
accgactgaccctg

SEQ ID NO: 5554629 - DNA, 18 bp, Homo sapiens
accgactgaccctgagga

SEQ ID NO: 5554630 - DNA, 14 bp, Homo sapiens
accgactgcccagc

SEQ ID NO: 5554631 - DNA, 22 bp, Homo sapiens
accgacttcaatttcccaccca

SEQ ID NO: 5554632 - DNA, 16 bp, Homo sapiens
accgagaaaaggagaa

SEQ ID NO: 5554633 - DNA, 18 bp, Homo sapiens
accgagaaggtttatccc

SEQ ID NO: 5554634 - DNA, 12 bp, Homo sapiens
accgagacatga

SEQ ID NO: 5554635 - DNA, 21 bp, Homo sapiens
accgagactcagcctctgctg

SEQ ID NO: 5554636 - DNA, 14 bp, Homo sapiens
accgagagccaaac

SEQ ID NO: 5554637 - DNA, 23 bp, Homo sapiens
accgagagtagccgagagcctgc

SEQ ID NO: 5554638 - DNA, 15 bp, Homo sapiens
accgagatgtgagtc

SEQ ID NO: 5554639 - DNA, 17 bp, Homo sapiens
accgagcaaagatcaaa

SEQ ID NO: 5554640 - DNA, 19 bp, Homo sapiens
accgagcaaagatcaaaat

SEQ ID NO: 5554641 - DNA, 13 bp, Homo sapiens
accgagccctgga

SEQ ID NO: 5554642 - DNA, 23 bp, Homo sapiens
accgagcctctgtcactgcaggc

SEQ ID NO: 5554643 - DNA, 20 bp, Homo sapiens
accgagcgctttctggaaaa

SEQ ID NO: 5554644 - DNA, 14 bp, Homo sapiens
accgagctctgtgg

SEQ ID NO: 5554645 - DNA, 16 bp, Homo sapiens
accgagctctgtggga

SEQ ID NO: 5554646 - DNA, 23 bp, Homo sapiens
accgagctctgtgggaaaaaaga

SEQ ID NO: 5554647 - DNA, 18 bp, Homo sapiens
accgaggaacaacttgga

SEQ ID NO: 5554648 - DNA, 16 bp, Homo sapiens
accgaggacagcctgc

SEQ ID NO: 5554649 - DNA, 15 bp, Homo sapiens
accgaggacatgaaa

SEQ ID NO: 5554650 - DNA, 11 bp, Homo sapiens
accgaggactc

SEQ ID NO: 5554651 - DNA, 14 bp, Homo sapiens
accgaggactccag

SEQ ID NO: 5554652 - DNA, 12 bp, Homo sapiens
accgaggagccc

SEQ ID NO: 5554653 - DNA, 21 bp, Homo sapiens
accgaggagggagagtctccc

SEQ ID NO: 5554654 - DNA, 12 bp, Homo sapiens
accgaggccctc

SEQ ID NO: 5554655 - DNA, 17 bp, Homo sapiens
accgaggggctcaggaa

SEQ ID NO: 5554656 - DNA, 20 bp, Homo sapiens
accgagggggctgctcccac

SEQ ID NO: 5554657 - DNA, 18 bp, Homo sapiens
accgaggtgttgccagtg

SEQ ID NO: 5554658 - DNA, 19 bp, Homo sapiens
accgaggtgttgccagtgc

SEQ ID NO: 5554659 - DNA, 14 bp, Homo sapiens
accgaggttcccag

SEQ ID NO: 5554660 - DNA, 16 bp, Homo sapiens
accgagtatctgtaac

SEQ ID NO: 5554661 - DNA, 17 bp, Homo sapiens
accgagtctcttctcca

SEQ ID NO: 5554662 - DNA, 18 bp, Homo sapiens
accgagtctcttctccac

SEQ ID NO: 5554663 - DNA, 21 bp, Homo sapiens
accgagtgaacctaccttcat

SEQ ID NO: 5554664 - DNA, 20 bp, Homo sapiens
accgagtgatttccatctct

SEQ ID NO: 5554665 - DNA, 21 bp, Homo sapiens
accgagtgtggagctgcttcc

SEQ ID NO: 5554666 - DNA, 13 bp, Homo sapiens
accgatgccagcc

SEQ ID NO: 5554667 - DNA, 15 bp, Homo sapiens
accgatgctccagcc

SEQ ID NO: 5554668 - DNA, 17 bp, Homo sapiens
accgatggagcccccag

SEQ ID NO: 5554669 - DNA, 19 bp, Homo sapiens
accgatggagcccccagat

SEQ ID NO: 5554670 - DNA, 18 bp, Homo sapiens
accgatggtcccaggaag

SEQ ID NO: 5554671 - DNA, 23 bp, Homo sapiens
accgatggtcccaggaagcaggg

SEQ ID NO: 5554672 - DNA, 16 bp, Homo sapiens
accgattatgctttct

SEQ ID NO: 5554673 - DNA, 13 bp, Homo sapiens
accgattcttcct

SEQ ID NO: 5554674 - DNA, 17 bp, Homo sapiens
accgattcttccttgcc

SEQ ID NO: 5554675 - DNA, 19 bp, Homo sapiens
accgattcttccttgccac

SEQ ID NO: 5554676 - DNA, 16 bp, Homo sapiens
accgattctttggagt

SEQ ID NO: 5554677 - DNA, 23 bp, Homo sapiens
accgatttcagcacatgcactac

SEQ ID NO: 5554678 - DNA, 14 bp, Homo sapiens
accgatttctgcta

SEQ ID NO: 5554679 - DNA, 18 bp, Homo sapiens
accgcaactcacacattc

SEQ ID NO: 5554680 - DNA, 15 bp, Homo sapiens
accgcaatatgggag

SEQ ID NO: 5554681 - DNA, 20 bp, Homo sapiens
accgcagaagcctccccagc

SEQ ID NO: 5554682 - DNA, 12 bp, Homo sapiens
accgcagacagg

SEQ ID NO: 5554683 - DNA, 17 bp, Homo sapiens
accgcagacaggaccag

SEQ ID NO: 5554684 - DNA, 13 bp, Homo sapiens
accgcagagtatt

SEQ ID NO: 5554685 - DNA, 15 bp, Homo sapiens
accgcagctgctgcc

SEQ ID NO: 5554686 - DNA, 17 bp, Homo sapiens
accgcagctgctgccac

SEQ ID NO: 5554687 - DNA, 18 bp, Homo sapiens
accgcagctgctgccact

SEQ ID NO: 5554688 - DNA, 19 bp, Homo sapiens
accgcagctgctgccactc

SEQ ID NO: 5554689 - DNA, 12 bp, Homo sapiens
accgcaggaagc

SEQ ID NO: 5554690 - DNA, 13 bp, Homo sapiens
accgcaggaagct

SEQ ID NO: 5554691 - DNA, 12 bp, Homo sapiens
accgcaggcccg

SEQ ID NO: 5554692 - DNA, 14 bp, Homo sapiens
accgcaggcccgga

SEQ ID NO: 5554693 - DNA, 15 bp, Homo sapiens
accgcaggcccggac

SEQ ID NO: 5554694 - DNA, 18 bp, Homo sapiens
accgcaggggactgtctc

SEQ ID NO: 5554695 - DNA, 21 bp, Homo sapiens
accgcagtcgtcgcacagtct

SEQ ID NO: 5554696 - DNA, 13 bp, Homo sapiens
accgcatatgcat

SEQ ID NO: 5554697 - DNA, 22 bp, Homo sapiens
accgcatcctcactgggctcac

SEQ ID NO: 5554698 - DNA, 24 bp, Homo sapiens
accgcatctgctcatctgatattc

SEQ ID NO: 5554699 - DNA, 14 bp, Homo sapiens
accgcatggcagct

SEQ ID NO: 5554700 - DNA, 16 bp, Homo sapiens
accgcatggcagctgg

SEQ ID NO: 5554701 - DNA, 19 bp, Homo sapiens
accgcatggcagctgggcc

SEQ ID NO: 5554702 - DNA, 23 bp, Homo sapiens
accgcatggcagctgggcccaca

SEQ ID NO: 5554703 - DNA, 17 bp, Homo sapiens
accgccagagtgtcctg

SEQ ID NO: 5554704 - DNA, 14 bp, Homo sapiens
accgccagcagcgc

SEQ ID NO: 5554705 - DNA, 23 bp, Homo sapiens
accgccagcagcgcgcaggcctg

SEQ ID NO: 5554706 - DNA, 24 bp, Homo sapiens
accgccagcagcgcgcaggcctgc

SEQ ID NO: 5554707 - DNA, 12 bp, Homo sapiens
accgccagctct

SEQ ID NO: 5554708 - DNA, 16 bp, Homo sapiens
accgccagctctgttc

SEQ ID NO: 5554709 - DNA, 17 bp, Homo sapiens
accgccatcctctgcct

SEQ ID NO: 5554710 - DNA, 18 bp, Homo sapiens
accgccatcctctgcctc

SEQ ID NO: 5554711 - DNA, 22 bp, Homo sapiens
accgccatgcaactccatgcct

SEQ ID NO: 5554712 - DNA, 19 bp, Homo sapiens
accgcccaacccccacctc

SEQ ID NO: 5554713 - DNA, 12 bp, Homo sapiens
accgcccaccca

SEQ ID NO: 5554714 - DNA, 18 bp, Homo sapiens
accgcccacccagcagcg

SEQ ID NO: 5554715 - DNA, 18 bp, Homo sapiens
accgccccaaccctcgga

SEQ ID NO: 5554716 - DNA, 23 bp, Homo sapiens
accgccccaaccctcggagcccc

SEQ ID NO: 5554717 - DNA, 12 bp, Homo sapiens
accgccccaggc

SEQ ID NO: 5554718 - DNA, 14 bp, Homo sapiens
accgcccggcagcc

SEQ ID NO: 5554719 - DNA, 17 bp, Homo sapiens
accgcccggcagcccct

SEQ ID NO: 5554720 - DNA, 22 bp, Homo sapiens
accgccctccgtcgggcccctg

SEQ ID NO: 5554721 - DNA, 12 bp, Homo sapiens
accgccctcctc

SEQ ID NO: 5554722 - DNA, 15 bp, Homo sapiens
accgccctcctccac

SEQ ID NO: 5554723 - DNA, 19 bp, Homo sapiens
accgccctcctcgctgtgc

SEQ ID NO: 5554724 - DNA, 20 bp, Homo sapiens
accgccctcctcgctgtgcc

SEQ ID NO: 5554725 - DNA, 23 bp, Homo sapiens
accgccctcctcgctgtgccacc

SEQ ID NO: 5554726 - DNA, 14 bp, Homo sapiens
accgccctgcctct

SEQ ID NO: 5554727 - DNA, 16 bp, Homo sapiens
accgccctgcgggcca

SEQ ID NO: 5554728 - DNA, 17 bp, Homo sapiens
accgccctgcgggccac

SEQ ID NO: 5554729 - DNA, 12 bp, Homo sapiens
accgccctgggc

SEQ ID NO: 5554730 - DNA, 14 bp, Homo sapiens
accgccctgggctg

SEQ ID NO: 5554731 - DNA, 15 bp, Homo sapiens
accgccctgggctgg

SEQ ID NO: 5554732 - DNA, 18 bp, Homo sapiens
accgccctgggctggact

SEQ ID NO: 5554733 - DNA, 20 bp, Homo sapiens
accgccctgggctggactgg

SEQ ID NO: 5554734 - DNA, 21 bp, Homo sapiens
accgccgactttgtacccccc

SEQ ID NO: 5554735 - DNA, 21 bp, Homo sapiens
accgccgagttaaagaggaga

SEQ ID NO: 5554736 - DNA, 16 bp, Homo sapiens
accgccgcagggacgg

SEQ ID NO: 5554737 - DNA, 22 bp, Homo sapiens
accgccgcggtagatcattttt

SEQ ID NO: 5554738 - DNA, 19 bp, Homo sapiens
accgccggggtcctgggag

SEQ ID NO: 5554739 - DNA, 23 bp, Homo sapiens
accgcctcagggttttggggtcc

SEQ ID NO: 5554740 - DNA, 21 bp, Homo sapiens
accgcctccccacctccaggc

SEQ ID NO: 5554741 - DNA, 23 bp, Homo sapiens
accgcctcgtgccagcagcctcg

SEQ ID NO: 5554742 - DNA, 19 bp, Homo sapiens
accgcctctggccgccacc

SEQ ID NO: 5554743 - DNA, 12 bp, Homo sapiens
accgcctgcccc

SEQ ID NO: 5554744 - DNA, 20 bp, Homo sapiens
accgcctgctacacaggcag

SEQ ID NO: 5554745 - DNA, 15 bp, Homo sapiens
accgcctgcttcaca

SEQ ID NO: 5554746 - DNA, 23 bp, Homo sapiens
accgcctggccctccctccctag

SEQ ID NO: 5554747 - DNA, 16 bp, Homo sapiens
accgcctgtctcttta

SEQ ID NO: 5554748 - DNA, 15 bp, Homo sapiens
accgccttgcccagc

SEQ ID NO: 5554749 - DNA, 22 bp, Homo sapiens
accgccttgcccagcctggatg

SEQ ID NO: 5554750 - DNA, 20 bp, Homo sapiens
accgcgactaatttcaaaat

SEQ ID NO: 5554751 - DNA, 14 bp, Homo sapiens
accgcgagggcctg

SEQ ID NO: 5554752 - DNA, 17 bp, Homo sapiens
accgcgcccagccaaga

SEQ ID NO: 5554753 - DNA, 17 bp, Homo sapiens
accgcgcccctgggact

SEQ ID NO: 5554754 - DNA, 17 bp, Homo sapiens
accgcggacgtgctggc

SEQ ID NO: 5554755 - DNA, 20 bp, Homo sapiens
accgcggacgtgctggcctt

SEQ ID NO: 5554756 - DNA, 14 bp, Homo sapiens
accgcgtcccagct

SEQ ID NO: 5554757 - DNA, 15 bp, Homo sapiens
accgcgtcccagctc

SEQ ID NO: 5554758 - DNA, 18 bp, Homo sapiens
accgcgttgtaaaatata

SEQ ID NO: 5554759 - DNA, 19 bp, Homo sapiens
accgcgttgtaaaatatag

SEQ ID NO: 5554760 - DNA, 21 bp, Homo sapiens
accgctacaccactctggcag

SEQ ID NO: 5554761 - DNA, 15 bp, Homo sapiens
accgctcaccctcct

SEQ ID NO: 5554762 - DNA, 19 bp, Homo sapiens
acctaaaattaagaagtac

SEQ ID NO: 5554763 - DNA, 22 bp, Homo sapiens
acctaaaatttgccctcccatc

SEQ ID NO: 5554764 - DNA, 14 bp, Homo sapiens
acctaaaccctctg

SEQ ID NO: 5554765 - DNA, 17 bp, Homo sapiens
acctaaaccctctgtga

SEQ ID NO: 5554766 - DNA, 19 bp, Homo sapiens
acctaaaccctctgtgaaa

SEQ ID NO: 5554767 - DNA, 19 bp, Homo sapiens
acctaaacggttcagtttc

SEQ ID NO: 5554768 - DNA, 10 bp, Homo sapiens
acctaaagac

SEQ ID NO: 5554769 - DNA, 14 bp, Homo sapiens
acctaaagcaataa

SEQ ID NO: 5554770 - DNA, 19 bp, Homo sapiens
acctaaagggaagccctga

SEQ ID NO: 5554771 - DNA, 12 bp, Homo sapiens
acctaaatactg

SEQ ID NO: 5554772 - DNA, 17 bp, Homo sapiens
acctaaatgacctcagc

SEQ ID NO: 5554773 - DNA, 20 bp, Homo sapiens
acctaaatgacctcagcaaa

SEQ ID NO: 5554774 - DNA, 20 bp, Homo sapiens
acctaaatggagaaagctgt

SEQ ID NO: 5554775 - DNA, 21 bp, Homo sapiens
acctaaatggagaaagctgtg

SEQ ID NO: 5554776 - DNA, 23 bp, Homo sapiens
acctaaattcgtagcaaattctg

SEQ ID NO: 5554777 - DNA, 18 bp, Homo sapiens
acctaaatttctgccaag

SEQ ID NO: 5554778 - DNA, 20 bp, Homo sapiens
acctaacaacattgtagcct

SEQ ID NO: 5554779 - DNA, 15 bp, Homo sapiens
acctaacaatgtttt

SEQ ID NO: 5554780 - DNA, 16 bp, Homo sapiens
acctaacccagaaaat

SEQ ID NO: 5554781 - DNA, 23 bp, Homo sapiens
acctaaccccagggcactgccag

SEQ ID NO: 5554782 - DNA, 16 bp, Homo sapiens
acctaacccctttcct

SEQ ID NO: 5554783 - DNA, 17 bp, Homo sapiens
acctaacccctttcctg

SEQ ID NO: 5554784 - DNA, 12 bp, Homo sapiens
acctaacctgtg

SEQ ID NO: 5554785 - DNA, 16 bp, Homo sapiens
acctaacctgtgtctg

SEQ ID NO: 5554786 - DNA, 21 bp, Homo sapiens
acctaactcacctaactcata

SEQ ID NO: 5554787 - DNA, 22 bp, Homo sapiens
acctaactccctaggcctgagt

SEQ ID NO: 5554788 - DNA, 17 bp, Homo sapiens
acctaactcttctttca

SEQ ID NO: 5554789 - DNA, 20 bp, Homo sapiens
acctaactcttttctatttt

SEQ ID NO: 5554790 - DNA, 15 bp, Homo sapiens
acctaactgtatctt

SEQ ID NO: 5554791 - DNA, 16 bp, Homo sapiens
acctaactgtatcttg

SEQ ID NO: 5554792 - DNA, 12 bp, Homo sapiens
acctaagaacaa

SEQ ID NO: 5554793 - DNA, 18 bp, Homo sapiens
acctaagaatttcactgt

SEQ ID NO: 5554794 - DNA, 16 bp, Homo sapiens
acctaagcacttctag

SEQ ID NO: 5554795 - DNA, 14 bp, Homo sapiens
acctaagccctgcc

SEQ ID NO: 5554796 - DNA, 19 bp, Homo sapiens
acctaaggcagacaggaag

SEQ ID NO: 5554797 - DNA, 22 bp, Homo sapiens
acctaaggcagacaggaaggaa

SEQ ID NO: 5554798 - DNA, 17 bp, Homo sapiens
acctaagtactgtaata

SEQ ID NO: 5554799 - DNA, 15 bp, Homo sapiens
acctaagtcaggtaa

SEQ ID NO: 5554800 - DNA, 14 bp, Homo sapiens
acctaagtctctgt

SEQ ID NO: 5554801 - DNA, 15 bp, Homo sapiens
acctaagtctctgtg

SEQ ID NO: 5554802 - DNA, 15 bp, Homo sapiens
acctaagtgttgatt

SEQ ID NO: 5554803 - DNA, 17 bp, Homo sapiens
acctaagtgttgattgt

SEQ ID NO: 5554804 - DNA, 22 bp, Homo sapiens
acctaataattgtatctacatt

SEQ ID NO: 5554805 - DNA, 13 bp, Homo sapiens
acctaatatcatt

SEQ ID NO: 5554806 - DNA, 20 bp, Homo sapiens
acctaatcaccatgtaagca

SEQ ID NO: 5554807 - DNA, 17 bp, Homo sapiens
acctaatcactaatttt

SEQ ID NO: 5554808 - DNA, 16 bp, Homo sapiens
acctaatcaggctgag

SEQ ID NO: 5554809 - DNA, 21 bp, Homo sapiens
acctaatctccacttttttca

SEQ ID NO: 5554810 - DNA, 13 bp, Homo sapiens
acctaatgaaagt

SEQ ID NO: 5554811 - DNA, 22 bp, Homo sapiens
acctaatgaaagtgatgacata

SEQ ID NO: 5554812 - DNA, 17 bp, Homo sapiens
acctaatgctggcctga

SEQ ID NO: 5554813 - DNA, 16 bp, Homo sapiens
acctaattaaggaagt

SEQ ID NO: 5554814 - DNA, 15 bp, Homo sapiens
acctaattaatatat

SEQ ID NO: 5554815 - DNA, 14 bp, Homo sapiens
acctaattaatttc

SEQ ID NO: 5554816 - DNA, 15 bp, Homo sapiens
acctaattagagcag

SEQ ID NO: 5554817 - DNA, 22 bp, Homo sapiens
acctaattgttaaatttaaaaa

SEQ ID NO: 5554818 - DNA, 15 bp, Homo sapiens
acctaatttcatttt

SEQ ID NO: 5554819 - DNA, 23 bp, Homo sapiens
acctacaaaaaaacctttattct

SEQ ID NO: 5554820 - DNA, 14 bp, Homo sapiens
acctacaaaagctt

SEQ ID NO: 5554821 - DNA, 20 bp, Homo sapiens
acctacaaaagcttgtgtat

SEQ ID NO: 5554822 - DNA, 16 bp, Homo sapiens
acctacacactgtcat

SEQ ID NO: 5554823 - DNA, 13 bp, Homo sapiens
acctacacccctg

SEQ ID NO: 5554824 - DNA, 18 bp, Homo sapiens
acctacacccctgtgctc

SEQ ID NO: 5554825 - DNA, 20 bp, Homo sapiens
acctacagacagacatacat

SEQ ID NO: 5554826 - DNA, 17 bp, Homo sapiens
acctacagactccatct

SEQ ID NO: 5554827 - DNA, 14 bp, Homo sapiens
acctacaggactgg

SEQ ID NO: 5554828 - DNA, 21 bp, Homo sapiens
acctacagggggtctggctgg

SEQ ID NO: 5554829 - DNA, 11 bp, Homo sapiens
acctacagttt

SEQ ID NO: 5554830 - DNA, 16 bp, Homo sapiens
acctacagttttaact

SEQ ID NO: 5554831 - DNA, 17 bp, Homo sapiens
acctacagttttaactg

SEQ ID NO: 5554832 - DNA, 19 bp, Homo sapiens
acctacagttttaactgtg

SEQ ID NO: 5554833 - DNA, 19 bp, Homo sapiens
acctacatccccaggtctc

SEQ ID NO: 5554834 - DNA, 12 bp, Homo sapiens
acctacatctga

SEQ ID NO: 5554835 - DNA, 16 bp, Homo sapiens
acctacatctgaaatc

SEQ ID NO: 5554836 - DNA, 21 bp, Homo sapiens
acctacatgctgaaaaatata

SEQ ID NO: 5554837 - DNA, 16 bp, Homo sapiens
acctacattccctctc

SEQ ID NO: 5554838 - DNA, 14 bp, Homo sapiens
acctaccaaaaaat

SEQ ID NO: 5554839 - DNA, 17 bp, Homo sapiens
acctaccacagtgtctg

SEQ ID NO: 5554840 - DNA, 19 bp, Homo sapiens
acctaccacagtgtctgta

SEQ ID NO: 5554841 - DNA, 16 bp, Homo sapiens
acctaccaccacgccc

SEQ ID NO: 5554842 - DNA, 16 bp, Homo sapiens
acctaccaccttccct

SEQ ID NO: 5554843 - DNA, 17 bp, Homo sapiens
acctaccagttggccat

SEQ ID NO: 5554844 - DNA, 14 bp, Homo sapiens
acctaccatgctgc

SEQ ID NO: 5554845 - DNA, 16 bp, Homo sapiens
acctaccatgctgctt

SEQ ID NO: 5554846 - DNA, 16 bp, Homo sapiens
acctaccccagccagg

SEQ ID NO: 5554847 - DNA, 16 bp, Homo sapiens
acctaccctcaaagta

SEQ ID NO: 5554848 - DNA, 13 bp, Homo sapiens
acctacctcccac

SEQ ID NO: 5554849 - DNA, 14 bp, Homo sapiens
acctacctccctcc

SEQ ID NO: 5554850 - DNA, 15 bp, Homo sapiens
acctacctgttgagc

SEQ ID NO: 5554851 - DNA, 18 bp, Homo sapiens
acctaccttatagagcac

SEQ ID NO: 5554852 - DNA, 17 bp, Homo sapiens
acctaccttcaaagctg

SEQ ID NO: 5554853 - DNA, 21 bp, Homo sapiens
acctactaaaaaagttattat

SEQ ID NO: 5554854 - DNA, 15 bp, Homo sapiens
acctactatgtgctg

SEQ ID NO: 5554855 - DNA, 16 bp, Homo sapiens
acctactcacacaggc

SEQ ID NO: 5554856 - DNA, 17 bp, Homo sapiens
acctactcacacaggca

SEQ ID NO: 5554857 - DNA, 19 bp, Homo sapiens
acctactgcactttccccc

SEQ ID NO: 5554858 - DNA, 12 bp, Homo sapiens
acctactgccca

SEQ ID NO: 5554859 - DNA, 19 bp, Homo sapiens
acctactgcccaggcactg

SEQ ID NO: 5554860 - DNA, 20 bp, Homo sapiens
acctactgtgtcttggaatc

SEQ ID NO: 5554861 - DNA, 15 bp, Homo sapiens
acctactgttctaaa

SEQ ID NO: 5554862 - DNA, 19 bp, Homo sapiens
acctacttagatatttcat

SEQ ID NO: 5554863 - DNA, 21 bp, Homo sapiens
acctacttagatatttcatgt

SEQ ID NO: 5554864 - DNA, 15 bp, Homo sapiens
acctacttcctcctc

SEQ ID NO: 5554865 - DNA, 20 bp, Homo sapiens
acctacttgtaaacttgaaa

SEQ ID NO: 5554866 - DNA, 13 bp, Homo sapiens
acctagaaatcta

SEQ ID NO: 5554867 - DNA, 15 bp, Homo sapiens
acctagaacgtgcat

SEQ ID NO: 5554868 - DNA, 21 bp, Homo sapiens
acctagaacgtgcatccttgt

SEQ ID NO: 5554869 - DNA, 20 bp, Homo sapiens
acctagaagcttaacactat

SEQ ID NO: 5554870 - DNA, 17 bp, Homo sapiens
acctagaagtctccctg

SEQ ID NO: 5554871 - DNA, 19 bp, Homo sapiens
acctagaagtctccctgca

SEQ ID NO: 5554872 - DNA, 20 bp, Homo sapiens
acctagaagtctccctgcac

SEQ ID NO: 5554873 - DNA, 20 bp, Homo sapiens
acctagaatgtcagatttct

SEQ ID NO: 5554874 - DNA, 20 bp, Homo sapiens
acctagacaaccagaggctg

SEQ ID NO: 5554875 - DNA, 18 bp, Homo sapiens
acctagaccagtttgcat

SEQ ID NO: 5554876 - DNA, 19 bp, Homo sapiens
acctagaccagtttgcatg

SEQ ID NO: 5554877 - DNA, 13 bp, Homo sapiens
acctagacctggg

SEQ ID NO: 5554878 - DNA, 19 bp, Homo sapiens
acctagaccttgcctcccc

SEQ ID NO: 5554879 - DNA, 22 bp, Homo sapiens
acctagagaacaggtggttttt

SEQ ID NO: 5554880 - DNA, 13 bp, Homo sapiens
acctagagaagat

SEQ ID NO: 5554881 - DNA, 15 bp, Homo sapiens
acctagagctttttt

SEQ ID NO: 5554882 - DNA, 18 bp, Homo sapiens
acctagagtatacctgtg

SEQ ID NO: 5554883 - DNA, 22 bp, Homo sapiens
acctagattatagtcttagtaa

SEQ ID NO: 5554884 - DNA, 17 bp, Homo sapiens
acctagatttaatataa

SEQ ID NO: 5554885 - DNA, 22 bp, Homo sapiens
acctagcaacatatctctgccg

SEQ ID NO: 5554886 - DNA, 13 bp, Homo sapiens
acctagcaattcc

SEQ ID NO: 5554887 - DNA, 14 bp, Homo sapiens
acctagcagcctca

SEQ ID NO: 5554888 - DNA, 15 bp, Homo sapiens
acctagcagcctcaa

SEQ ID NO: 5554889 - DNA, 20 bp, Homo sapiens
acctagcctggatggcccct

SEQ ID NO: 5554890 - DNA, 16 bp, Homo sapiens
acctagcgtcagtatt

SEQ ID NO: 5554891 - DNA, 17 bp, Homo sapiens
acctagctacactgagc

SEQ ID NO: 5554892 - DNA, 22 bp, Homo sapiens
acctagctgaatgtttttctaa

SEQ ID NO: 5554893 - DNA, 21 bp, Homo sapiens
acctagctggttaatggcagc

SEQ ID NO: 5554894 - DNA, 21 bp, Homo sapiens
acctagctgtgccccctctgg

SEQ ID NO: 5554895 - DNA, 15 bp, Homo sapiens
acctagctgttgtaa

SEQ ID NO: 5554896 - DNA, 19 bp, Homo sapiens
acctagctgttgtaaagaa

SEQ ID NO: 5554897 - DNA, 17 bp, Homo sapiens
acctagcttttaaaaaa

SEQ ID NO: 5554898 - DNA, 18 bp, Homo sapiens
acctaggaagcctcagat

SEQ ID NO: 5554899 - DNA, 16 bp, Homo sapiens
acctaggactgactcg

SEQ ID NO: 5554900 - DNA, 20 bp, Homo sapiens
acctaggagcagtgggccct

SEQ ID NO: 5554901 - DNA, 18 bp, Homo sapiens
acctaggcaatgaagaat

SEQ ID NO: 5554902 - DNA, 17 bp, Homo sapiens
acctaggcagtgggagg

SEQ ID NO: 5554903 - DNA, 18 bp, Homo sapiens
acctaggccactcctcca

SEQ ID NO: 5554904 - DNA, 18 bp, Homo sapiens
acctaggcccattgctga

SEQ ID NO: 5554905 - DNA, 17 bp, Homo sapiens
acctaggctagggtggg

SEQ ID NO: 5554906 - DNA, 20 bp, Homo sapiens
acctagggatgttctggccc

SEQ ID NO: 5554907 - DNA, 21 bp, Homo sapiens
acctagggtgatattaaccag

SEQ ID NO: 5554908 - DNA, 23 bp, Homo sapiens
acctaggtcgccagtgaaataga

SEQ ID NO: 5554909 - DNA, 15 bp, Homo sapiens
acctaggtctccagt

SEQ ID NO: 5554910 - DNA, 20 bp, Homo sapiens
acctagtactctctgctcta

SEQ ID NO: 5554911 - DNA, 23 bp, Homo sapiens
acctagtactctctgctctagcc

SEQ ID NO: 5554912 - DNA, 21 bp, Homo sapiens
acctagtcccctttcctctaa

SEQ ID NO: 5554913 - DNA, 21 bp, Homo sapiens
acctagtgcaaaaactgtaaa

SEQ ID NO: 5554914 - DNA, 15 bp, Homo sapiens
acctagtgccccaga

SEQ ID NO: 5554915 - DNA, 17 bp, Homo sapiens
acctagtgccccagact

SEQ ID NO: 5554916 - DNA, 18 bp, Homo sapiens
acctagtgccccagactg

SEQ ID NO: 5554917 - DNA, 16 bp, Homo sapiens
acctagtggctgtcca

SEQ ID NO: 5554918 - DNA, 18 bp, Homo sapiens
acctagtttgttacttta

SEQ ID NO: 5554919 - DNA, 14 bp, Homo sapiens
acctagttttccat

SEQ ID NO: 5554920 - DNA, 18 bp, Homo sapiens
acctataaaacaggtcaa

SEQ ID NO: 5554921 - DNA, 14 bp, Homo sapiens
acctataaaattgt

SEQ ID NO: 5554922 - DNA, 12 bp, Homo sapiens
acctataaagtg

SEQ ID NO: 5554923 - DNA, 23 bp, Homo sapiens
acctataaatactaaatatgaaa

SEQ ID NO: 5554924 - DNA, 16 bp, Homo sapiens
acctataaatggactt

SEQ ID NO: 5554925 - DNA, 17 bp, Homo sapiens
acctataatgtgtgtat

SEQ ID NO: 5554926 - DNA, 16 bp, Homo sapiens
acctatacaatgtatg

SEQ ID NO: 5554927 - DNA, 18 bp, Homo sapiens
acctatacaatgtatgta

SEQ ID NO: 5554928 - DNA, 13 bp, Homo sapiens
acctatactgaaa

SEQ ID NO: 5554929 - DNA, 22 bp, Homo sapiens
acctatactgaaagatctctgt

SEQ ID NO: 5554930 - DNA, 23 bp, Homo sapiens
acctatactgaaagatctctgtc

SEQ ID NO: 5554931 - DNA, 13 bp, Homo sapiens
acctatagaaata

SEQ ID NO: 5554932 - DNA, 19 bp, Homo sapiens
acctatagaaatagaacac

SEQ ID NO: 5554933 - DNA, 16 bp, Homo sapiens
acctatagtcccagct

SEQ ID NO: 5554934 - DNA, 16 bp, Homo sapiens
acctatattgatttaa

SEQ ID NO: 5554935 - DNA, 14 bp, Homo sapiens
acctatatttcaat

SEQ ID NO: 5554936 - DNA, 13 bp, Homo sapiens
acctatcacttac

SEQ ID NO: 5554937 - DNA, 12 bp, Homo sapiens
acctatccacac

SEQ ID NO: 5554938 - DNA, 20 bp, Homo sapiens
acctatccctaacaggctgt

SEQ ID NO: 5554939 - DNA, 13 bp, Homo sapiens
acctatctatgaa

SEQ ID NO: 5554940 - DNA, 23 bp, Homo sapiens
acctcagtgccttcctgtttttc

SEQ ID NO: 5554941 - DNA, 14 bp, Homo sapiens
acctcagtgctcct

SEQ ID NO: 5554942 - DNA, 16 bp, Homo sapiens
acctcagtgctcctgg

SEQ ID NO: 5554943 - DNA, 23 bp, Homo sapiens
acctcagtgctcctggaaactta

SEQ ID NO: 5554944 - DNA, 21 bp, Homo sapiens
acctcagtggatcttcagaac

SEQ ID NO: 5554945 - DNA, 12 bp, Homo sapiens
acctcagtggga

SEQ ID NO: 5554946 - DNA, 13 bp, Homo sapiens
acctcagtgggaa

SEQ ID NO: 5554947 - DNA, 19 bp, Homo sapiens
acctcagtgtcatttatga

SEQ ID NO: 5554948 - DNA, 22 bp, Homo sapiens
acctcagttattacatgtaatt

SEQ ID NO: 5554949 - DNA, 18 bp, Homo sapiens
acctcagttcccttggcc

SEQ ID NO: 5554950 - DNA, 19 bp, Homo sapiens
acctcagttcccttggcct

SEQ ID NO: 5554951 - DNA, 16 bp, Homo sapiens
acctcagtttcctcat

SEQ ID NO: 5554952 - DNA, 17 bp, Homo sapiens
acctcagttttatcatt

SEQ ID NO: 5554953 - DNA, 18 bp, Homo sapiens
acctcagttttatcattt

SEQ ID NO: 5554954 - DNA, 18 bp, Homo sapiens
acctcagttttatgcccc

SEQ ID NO: 5554955 - DNA, 19 bp, Homo sapiens
acctcatatcttcctcatc

SEQ ID NO: 5554956 - DNA, 20 bp, Homo sapiens
acctcatatcttcctcatca

SEQ ID NO: 5554957 - DNA, 14 bp, Homo sapiens
acctcatcactgga

SEQ ID NO: 5554958 - DNA, 18 bp, Homo sapiens
acctcatcactggactgc

SEQ ID NO: 5554959 - DNA, 18 bp, Homo sapiens
acctcatcaggatgaacc

SEQ ID NO: 5554960 - DNA, 20 bp, Homo sapiens
acctcatcaggatgaaccca

SEQ ID NO: 5554961 - DNA, 16 bp, Homo sapiens
acctcatcatccaccc

SEQ ID NO: 5554962 - DNA, 19 bp, Homo sapiens
acctcatcatccacccgct

SEQ ID NO: 5554963 - DNA, 14 bp, Homo sapiens
acctcatcattaat

SEQ ID NO: 5554964 - DNA, 15 bp, Homo sapiens
acctcatccaaacaa

SEQ ID NO: 5554965 - DNA, 14 bp, Homo sapiens
acctcatcccatga

SEQ ID NO: 5554966 - DNA, 14 bp, Homo sapiens
acctcatctctgaa

SEQ ID NO: 5554967 - DNA, 14 bp, Homo sapiens
acctcatctgcctg

SEQ ID NO: 5554968 - DNA, 19 bp, Homo sapiens
acctcatctttctccttca

SEQ ID NO: 5554969 - DNA, 20 bp, Homo sapiens
acctcatgacagccagagcc

SEQ ID NO: 5554970 - DNA, 21 bp, Homo sapiens
acctcatgacagccagagcct

SEQ ID NO: 5554971 - DNA, 21 bp, Homo sapiens
acctcatgcccaccccctgcc

SEQ ID NO: 5554972 - DNA, 17 bp, Homo sapiens
acctcatgcccagctct

SEQ ID NO: 5554973 - DNA, 21 bp, Homo sapiens
acctcatgcccagctctctga

SEQ ID NO: 5554974 - DNA, 16 bp, Homo sapiens
acctcatgccgctgtg

SEQ ID NO: 5554975 - DNA, 18 bp, Homo sapiens
acctcatggattgccaca

SEQ ID NO: 5554976 - DNA, 20 bp, Homo sapiens
acctcatggattgccacagc

SEQ ID NO: 5554977 - DNA, 18 bp, Homo sapiens
acctcatgtttatgaaaa

SEQ ID NO: 5554978 - DNA, 12 bp, Homo sapiens
acctcattccaa

SEQ ID NO: 5554979 - DNA, 17 bp, Homo sapiens
acctcattgctaccaca

SEQ ID NO: 5554980 - DNA, 14 bp, Homo sapiens
acctcattgttctg

SEQ ID NO: 5554981 - DNA, 14 bp, Homo sapiens
acctcatttatagc

SEQ ID NO: 5554982 - DNA, 14 bp, Homo sapiens
acctcatttgcatc

SEQ ID NO: 5554983 - DNA, 13 bp, Homo sapiens
acctcatttttca

SEQ ID NO: 5554984 - DNA, 14 bp, Homo sapiens
acctcatttttcat

SEQ ID NO: 5554985 - DNA, 17 bp, Homo sapiens
acctcatttttcatact

SEQ ID NO: 5554986 - DNA, 19 bp, Homo sapiens
acctccaacagaactaaat

SEQ ID NO: 5554987 - DNA, 23 bp, Homo sapiens
acctccaacccaacccaatccct

SEQ ID NO: 5554988 - DNA, 14 bp, Homo sapiens
acctccaaccctgc

SEQ ID NO: 5554989 - DNA, 15 bp, Homo sapiens
acctccaaccctgcc

SEQ ID NO: 5554990 - DNA, 22 bp, Homo sapiens
acctccaaccctgccgtcacca

SEQ ID NO: 5554991 - DNA, 17 bp, Homo sapiens
acctccaagccactgag

SEQ ID NO: 5554992 - DNA, 17 bp, Homo sapiens
acctccaatgctgcctg

SEQ ID NO: 5554993 - DNA, 14 bp, Homo sapiens
acctccacacccac

SEQ ID NO: 5554994 - DNA, 19 bp, Homo sapiens
acctccacacccgtgagaa

SEQ ID NO: 5554995 - DNA, 14 bp, Homo sapiens
acctccacagcttc

SEQ ID NO: 5554996 - DNA, 14 bp, Homo sapiens
acctccacatcctc

SEQ ID NO: 5554997 - DNA, 17 bp, Homo sapiens
acctccaccacatctgc

SEQ ID NO: 5554998 - DNA, 11 bp, Homo sapiens
acctccaccca

SEQ ID NO: 5554999 - DNA, 18 bp, Homo sapiens
acctccacccactgtccg

SEQ ID NO: 5555000 - DNA, 12 bp, Homo sapiens
acctccacccag

SEQ ID NO: 5555001 - DNA, 16 bp, Homo sapiens
acctccacccagcccc

SEQ ID NO: 5555002 - DNA, 21 bp, Homo sapiens
acctccacccccaagaaacct

SEQ ID NO: 5555003 - DNA, 20 bp, Homo sapiens
acctccacccccgccacggc

SEQ ID NO: 5555004 - DNA, 14 bp, Homo sapiens
acctccacccgtcc

SEQ ID NO: 5555005 - DNA, 13 bp, Homo sapiens
acctccaccctgc

SEQ ID NO: 5555006 - DNA, 16 bp, Homo sapiens
acctccacctcccagg

SEQ ID NO: 5555007 - DNA, 17 bp, Homo sapiens
acctccacctcccgggt

SEQ ID NO: 5555008 - DNA, 13 bp, Homo sapiens
acctccactcagc

SEQ ID NO: 5555009 - DNA, 19 bp, Homo sapiens
acctccactcagcactctg

SEQ ID NO: 5555010 - DNA, 22 bp, Homo sapiens
acctccactcagcactctggac

SEQ ID NO: 5555011 - DNA, 13 bp, Homo sapiens
acctccactccac

SEQ ID NO: 5555012 - DNA, 17 bp, Homo sapiens
acctccagactcagcag

SEQ ID NO: 5555013 - DNA, 18 bp, Homo sapiens
acctccagactcagcaga

SEQ ID NO: 5555014 - DNA, 22 bp, Homo sapiens
acctccagattattttctatat

SEQ ID NO: 5555015 - DNA, 16 bp, Homo sapiens
acctccagcacgcgac

SEQ ID NO: 5555016 - DNA, 13 bp, Homo sapiens
acctccagcccac

SEQ ID NO: 5555017 - DNA, 15 bp, Homo sapiens
acctccagcccacag

SEQ ID NO: 5555018 - DNA, 16 bp, Homo sapiens
acctccagcccgggag

SEQ ID NO: 5555019 - DNA, 15 bp, Homo sapiens
acctccagcctccct

SEQ ID NO: 5555020 - DNA, 21 bp, Homo sapiens
acctccagcctccctgtctcc

SEQ ID NO: 5555021 - DNA, 16 bp, Homo sapiens
acctccagctttcctg

SEQ ID NO: 5555022 - DNA, 17 bp, Homo sapiens
acctccaggctccagca

SEQ ID NO: 5555023 - DNA, 19 bp, Homo sapiens
acctccaggctccagcaca

SEQ ID NO: 5555024 - DNA, 18 bp, Homo sapiens
acctccaggggctcctgg

SEQ ID NO: 5555025 - DNA, 19 bp, Homo sapiens
acctccaggggctcctggg

SEQ ID NO: 5555026 - DNA, 20 bp, Homo sapiens
acctccaggggctcctgggt

SEQ ID NO: 5555027 - DNA, 21 bp, Homo sapiens
acctccaggggctcctgggtt

SEQ ID NO: 5555028 - DNA, 23 bp, Homo sapiens
acctccagtcctgctggcctgct

SEQ ID NO: 5555029 - DNA, 22 bp, Homo sapiens
acctccagtgagtacctgcaaa

SEQ ID NO: 5555030 - DNA, 18 bp, Homo sapiens
acctccagtgtcagggtc

SEQ ID NO: 5555031 - DNA, 15 bp, Homo sapiens
acctccatatgctgt

SEQ ID NO: 5555032 - DNA, 20 bp, Homo sapiens
acctccatccccctctgtct

SEQ ID NO: 5555033 - DNA, 23 bp, Homo sapiens
acctccatccccctctgtctgcc

SEQ ID NO: 5555034 - DNA, 16 bp, Homo sapiens
acctccatccctgctc

SEQ ID NO: 5555035 - DNA, 18 bp, Homo sapiens
acctccatccctgctctg

SEQ ID NO: 5555036 - DNA, 19 bp, Homo sapiens
acctccatccctgctctgg

SEQ ID NO: 5555037 - DNA, 10 bp, Homo sapiens
acctccatgc

SEQ ID NO: 5555038 - DNA, 14 bp, Homo sapiens
acctccatgccccc

SEQ ID NO: 5555039 - DNA, 12 bp, Homo sapiens
acctccatgtca

SEQ ID NO: 5555040 - DNA, 13 bp, Homo sapiens
acctccatgtcat

SEQ ID NO: 5555041 - DNA, 21 bp, Homo sapiens
acctccattctattttagaat

SEQ ID NO: 5555042 - DNA, 19 bp, Homo sapiens
acctccattggcttcctca

SEQ ID NO: 5555043 - DNA, 20 bp, Homo sapiens
acctcccaaaggctgtcatt

SEQ ID NO: 5555044 - DNA, 16 bp, Homo sapiens
acctcccacactccca

SEQ ID NO: 5555045 - DNA, 14 bp, Homo sapiens
acctcccaccccac

SEQ ID NO: 5555046 - DNA, 19 bp, Homo sapiens
acctcccaccccactccag

SEQ ID NO: 5555047 - DNA, 20 bp, Homo sapiens
acctcccaccccactccagc

SEQ ID NO: 5555048 - DNA, 14 bp, Homo sapiens
acctcccaccctga

SEQ ID NO: 5555049 - DNA, 18 bp, Homo sapiens
acctcccactcctgctgc

SEQ ID NO: 5555050 - DNA, 19 bp, Homo sapiens
acctcccactcctgctgca

SEQ ID NO: 5555051 - DNA, 12 bp, Homo sapiens
acctcccagagg

SEQ ID NO: 5555052 - DNA, 13 bp, Homo sapiens
acctcccagaggt

SEQ ID NO: 5555053 - DNA, 17 bp, Homo sapiens
acctcccagaggtccag

SEQ ID NO: 5555054 - DNA, 13 bp, Homo sapiens
acctcccagcccc

SEQ ID NO: 5555055 - DNA, 16 bp, Homo sapiens
acctcccagcccctgc

SEQ ID NO: 5555056 - DNA, 14 bp, Homo sapiens
acctcccaggacaa

SEQ ID NO: 5555057 - DNA, 11 bp, Homo sapiens
acctcccaggg

SEQ ID NO: 5555058 - DNA, 13 bp, Homo sapiens
acctcccagggct

SEQ ID NO: 5555059 - DNA, 21 bp, Homo sapiens
acctcccaggggctccacctg

SEQ ID NO: 5555060 - DNA, 23 bp, Homo sapiens
acctcccatcccgtaagaccacc

SEQ ID NO: 5555061 - DNA, 14 bp, Homo sapiens
acctcccatttctg

SEQ ID NO: 5555062 - DNA, 16 bp, Homo sapiens
acctcccatttctgtt

SEQ ID NO: 5555063 - DNA, 11 bp, Homo sapiens
acctccccaaa

SEQ ID NO: 5555064 - DNA, 14 bp, Homo sapiens
acctccccaaagca

SEQ ID NO: 5555065 - DNA, 21 bp, Homo sapiens
acctccccacacacaggcctt

SEQ ID NO: 5555066 - DNA, 22 bp, Homo sapiens
acctccccacatcgcacactgg

SEQ ID NO: 5555067 - DNA, 11 bp, Homo sapiens
acctccccacg

SEQ ID NO: 5555068 - DNA, 20 bp, Homo sapiens
acctccccacgccctcccct

SEQ ID NO: 5555069 - DNA, 22 bp, Homo sapiens
acctccccacgccctcccctcc

SEQ ID NO: 5555070 - DNA, 12 bp, Homo sapiens
acctccccactc

SEQ ID NO: 5555071 - DNA, 19 bp, Homo sapiens
acctccccactccagcaga

SEQ ID NO: 5555072 - DNA, 12 bp, Homo sapiens
acctccccagac

SEQ ID NO: 5555073 - DNA, 22 bp, Homo sapiens
acctccccagagccctgcagtc

SEQ ID NO: 5555074 - DNA, 16 bp, Homo sapiens
acctccccagcccagg

SEQ ID NO: 5555075 - DNA, 13 bp, Homo sapiens
acctccccagcct

SEQ ID NO: 5555076 - DNA, 17 bp, Homo sapiens
acctccccagcctgcgc

SEQ ID NO: 5555077 - DNA, 22 bp, Homo sapiens
acctccccagcctgcgcctgct

SEQ ID NO: 5555078 - DNA, 19 bp, Homo sapiens
acctcccccaaaccctgct

SEQ ID NO: 5555079 - DNA, 23 bp, Homo sapiens
acctcccccaaaccctgcttctg

SEQ ID NO: 5555080 - DNA, 11 bp, Homo sapiens
acctcccccac

SEQ ID NO: 5555081 - DNA, 16 bp, Homo sapiens
acctcccccactccca

SEQ ID NO: 5555082 - DNA, 12 bp, Homo sapiens
acctcccccagg

SEQ ID NO: 5555083 - DNA, 15 bp, Homo sapiens
acctcccccagggag

SEQ ID NO: 5555084 - DNA, 19 bp, Homo sapiens
acctcccccgacgctctct

SEQ ID NO: 5555085 - DNA, 12 bp, Homo sapiens
acctccccctac

SEQ ID NO: 5555086 - DNA, 15 bp, Homo sapiens
acctccccctaccca

SEQ ID NO: 5555087 - DNA, 17 bp, Homo sapiens
acctccccctacccata

SEQ ID NO: 5555088 - DNA, 19 bp, Homo sapiens
acctccccctccccggcca

SEQ ID NO: 5555089 - DNA, 22 bp, Homo sapiens
acctccccctccttcccagctg

SEQ ID NO: 5555090 - DNA, 15 bp, Homo sapiens
acctccccctgcccc

SEQ ID NO: 5555091 - DNA, 17 bp, Homo sapiens
acctccccctgcgcccc

SEQ ID NO: 5555092 - DNA, 13 bp, Homo sapiens
acctccccctgtg

SEQ ID NO: 5555093 - DNA, 21 bp, Homo sapiens
acctccccctgtgtggccctg

SEQ ID NO: 5555094 - DNA, 21 bp, Homo sapiens
acctccccctttcacactgga

SEQ ID NO: 5555095 - DNA, 20 bp, Homo sapiens
acctccccgcagagctccct

SEQ ID NO: 5555096 - DNA, 18 bp, Homo sapiens
acctccccgctctccctg

SEQ ID NO: 5555097 - DNA, 19 bp, Homo sapiens
acctccccgctctccctgt

SEQ ID NO: 5555098 - DNA, 21 bp, Homo sapiens
acctccccgctctccctgtca

SEQ ID NO: 5555099 - DNA, 23 bp, Homo sapiens
acctccccgctctccctgtcacg

SEQ ID NO: 5555100 - DNA, 23 bp, Homo sapiens
acctcccctatccacccagccca

SEQ ID NO: 5555101 - DNA, 21 bp, Homo sapiens
acctcccctccccgccccctg

SEQ ID NO: 5555102 - DNA, 23 bp, Homo sapiens
acctcccctccccgccccctgaa

SEQ ID NO: 5555103 - DNA, 17 bp, Homo sapiens
acctcccctccttgcct

SEQ ID NO: 5555104 - DNA, 14 bp, Homo sapiens
acctcccctctccc

SEQ ID NO: 5555105 - DNA, 13 bp, Homo sapiens
acctcccctcttc

SEQ ID NO: 5555106 - DNA, 13 bp, Homo sapiens
acctcccctgcct

SEQ ID NO: 5555107 - DNA, 20 bp, Homo sapiens
acctcccctgccttgctgtt

SEQ ID NO: 5555108 - DNA, 17 bp, Homo sapiens
acctcccctggtcctgc

SEQ ID NO: 5555109 - DNA, 16 bp, Homo sapiens
acctccccttgccagc

SEQ ID NO: 5555110 - DNA, 12 bp, Homo sapiens
acctccccttgg

SEQ ID NO: 5555111 - DNA, 14 bp, Homo sapiens
acctccccttttct

SEQ ID NO: 5555112 - DNA, 17 bp, Homo sapiens
acctccctatactgctt

SEQ ID NO: 5555113 - DNA, 9 bp, Homo sapiens
acctccctc

SEQ ID NO: 5555114 - DNA, 17 bp, Homo sapiens
acctccctcaacctcat

SEQ ID NO: 5555115 - DNA, 21 bp, Homo sapiens
acctccctccccagctccgga

SEQ ID NO: 5555116 - DNA, 22 bp, Homo sapiens
acctccctccccagctccggag

SEQ ID NO: 5555117 - DNA, 12 bp, Homo sapiens
acctccctccct

SEQ ID NO: 5555118 - DNA, 15 bp, Homo sapiens
acctccctccctctc

SEQ ID NO: 5555119 - DNA, 17 bp, Homo sapiens
acctggcactgctgtgc

SEQ ID NO: 5555120 - DNA, 14 bp, Homo sapiens
acctggcagacttg

SEQ ID NO: 5555121 - DNA, 18 bp, Homo sapiens
acctggcagcaaactgct

SEQ ID NO: 5555122 - DNA, 17 bp, Homo sapiens
acctggcagctctggac

SEQ ID NO: 5555123 - DNA, 12 bp, Homo sapiens
acctggcaggcc

SEQ ID NO: 5555124 - DNA, 23 bp, Homo sapiens
acctggcagggctcacactcctg

SEQ ID NO: 5555125 - DNA, 21 bp, Homo sapiens
acctggcagtggctctcagag

SEQ ID NO: 5555126 - DNA, 18 bp, Homo sapiens
acctggccacctgaggtg

SEQ ID NO: 5555127 - DNA, 21 bp, Homo sapiens
acctggccacctgaggtgggc

SEQ ID NO: 5555128 - DNA, 18 bp, Homo sapiens
acctggcccatcagggta

SEQ ID NO: 5555129 - DNA, 23 bp, Homo sapiens
acctggccccctcagctctgtcc

SEQ ID NO: 5555130 - DNA, 23 bp, Homo sapiens
acctggccccttctccagcaagc

SEQ ID NO: 5555131 - DNA, 21 bp, Homo sapiens
acctggccggtaggctgctgg

SEQ ID NO: 5555132 - DNA, 11 bp, Homo sapiens
acctggcctca

SEQ ID NO: 5555133 - DNA, 18 bp, Homo sapiens
acctggcctctgcactcc

SEQ ID NO: 5555134 - DNA, 15 bp, Homo sapiens
acctggcctctgcca

SEQ ID NO: 5555135 - DNA, 22 bp, Homo sapiens
acctggcctgccaccctcctgc

SEQ ID NO: 5555136 - DNA, 14 bp, Homo sapiens
acctggcctgctgg

SEQ ID NO: 5555137 - DNA, 16 bp, Homo sapiens
acctggcctgctggga

SEQ ID NO: 5555138 - DNA, 23 bp, Homo sapiens
acctggcctggcctccaaaatat

SEQ ID NO: 5555139 - DNA, 16 bp, Homo sapiens
acctggcctgggccac

SEQ ID NO: 5555140 - DNA, 22 bp, Homo sapiens
acctggccttaaagagggacag

SEQ ID NO: 5555141 - DNA, 15 bp, Homo sapiens
acctggcctttcact

SEQ ID NO: 5555142 - DNA, 19 bp, Homo sapiens
acctggcggagctctcctc

SEQ ID NO: 5555143 - DNA, 16 bp, Homo sapiens
acctggcggcaggaag

SEQ ID NO: 5555144 - DNA, 23 bp, Homo sapiens
acctggcggcaggaagccaaaga

SEQ ID NO: 5555145 - DNA, 14 bp, Homo sapiens
acctggcgggctgg

SEQ ID NO: 5555146 - DNA, 17 bp, Homo sapiens
acctggctctcacctct

SEQ ID NO: 5555147 - DNA, 14 bp, Homo sapiens
acctggctctgtgg

SEQ ID NO: 5555148 - DNA, 13 bp, Homo sapiens
acctggctgagca

SEQ ID NO: 5555149 - DNA, 16 bp, Homo sapiens
acctggctgcccctca

SEQ ID NO: 5555150 - DNA, 19 bp, Homo sapiens
acctggctgcccctcacct

SEQ ID NO: 5555151 - DNA, 22 bp, Homo sapiens
acctggctgcccctcaccttgg

SEQ ID NO: 5555152 - DNA, 14 bp, Homo sapiens
acctggctgctagg

SEQ ID NO: 5555153 - DNA, 19 bp, Homo sapiens
acctggctgctaggccaga

SEQ ID NO: 5555154 - DNA, 21 bp, Homo sapiens
acctggctgctaggccagagc

SEQ ID NO: 5555155 - DNA, 18 bp, Homo sapiens
acctggctggagaccgag

SEQ ID NO: 5555156 - DNA, 16 bp, Homo sapiens
acctggctgggcctgg

SEQ ID NO: 5555157 - DNA, 17 bp, Homo sapiens
acctggcttatttaata

SEQ ID NO: 5555158 - DNA, 22 bp, Homo sapiens
acctggcttcccaggaccctgg

SEQ ID NO: 5555159 - DNA, 15 bp, Homo sapiens
acctggcttgtttat

SEQ ID NO: 5555160 - DNA, 20 bp, Homo sapiens
acctggcttgtttattttgt

SEQ ID NO: 5555161 - DNA, 17 bp, Homo sapiens
acctgggaaaggaccca

SEQ ID NO: 5555162 - DNA, 23 bp, Homo sapiens
acctgggaaaggacccacccatc

SEQ ID NO: 5555163 - DNA, 20 bp, Homo sapiens
acctgggaaccatgaagctg

SEQ ID NO: 5555164 - DNA, 19 bp, Homo sapiens
acctgggaaggccagcctt

SEQ ID NO: 5555165 - DNA, 14 bp, Homo sapiens
acctgggaatttat

SEQ ID NO: 5555166 - DNA, 16 bp, Homo sapiens
acctgggaatttatat

SEQ ID NO: 5555167 - DNA, 16 bp, Homo sapiens
acctgggaatttcagc

SEQ ID NO: 5555168 - DNA, 18 bp, Homo sapiens
acctgggacaggaaagag

SEQ ID NO: 5555169 - DNA, 16 bp, Homo sapiens
acctgggacagggagc

SEQ ID NO: 5555170 - DNA, 22 bp, Homo sapiens
acctgggagatgctgggaccct

SEQ ID NO: 5555171 - DNA, 22 bp, Homo sapiens
acctgggaggcggatgttgaag

SEQ ID NO: 5555172 - DNA, 15 bp, Homo sapiens
acctgggagggtggg

SEQ ID NO: 5555173 - DNA, 15 bp, Homo sapiens
acctgggatcctgac

SEQ ID NO: 5555174 - DNA, 18 bp, Homo sapiens
acctgggattcaggaatg

SEQ ID NO: 5555175 - DNA, 16 bp, Homo sapiens
acctgggcagctcctc

SEQ ID NO: 5555176 - DNA, 17 bp, Homo sapiens
acctgggcagctcctcc

SEQ ID NO: 5555177 - DNA, 21 bp, Homo sapiens
acctgggcatactaataaagt

SEQ ID NO: 5555178 - DNA, 18 bp, Homo sapiens
acctgggcatcagggcct

SEQ ID NO: 5555179 - DNA, 20 bp, Homo sapiens
acctgggccaaaagggcagc

SEQ ID NO: 5555180 - DNA, 22 bp, Homo sapiens
acctgggccaaaagggcagcca

SEQ ID NO: 5555181 - DNA, 22 bp, Homo sapiens
acctgggcccacagagcctggc

SEQ ID NO: 5555182 - DNA, 22 bp, Homo sapiens
acctgggccccactggacaaca

SEQ ID NO: 5555183 - DNA, 18 bp, Homo sapiens
acctgggcccgggcaggc

SEQ ID NO: 5555184 - DNA, 14 bp, Homo sapiens
acctgggccctggg

SEQ ID NO: 5555185 - DNA, 15 bp, Homo sapiens
acctgggccctgggg

SEQ ID NO: 5555186 - DNA, 18 bp, Homo sapiens
acctgggccctggggcct

SEQ ID NO: 5555187 - DNA, 20 bp, Homo sapiens
acctgggccctggggcctgt

SEQ ID NO: 5555188 - DNA, 20 bp, Homo sapiens
acctgggcctttcctgtgcc

SEQ ID NO: 5555189 - DNA, 18 bp, Homo sapiens
acctgggcgccaactgct

SEQ ID NO: 5555190 - DNA, 21 bp, Homo sapiens
acctgggctctcgcggcctct

SEQ ID NO: 5555191 - DNA, 15 bp, Homo sapiens
acctgggctgggaga

SEQ ID NO: 5555192 - DNA, 14 bp, Homo sapiens
acctgggctgggcg

SEQ ID NO: 5555193 - DNA, 21 bp, Homo sapiens
acctgggctgtgctgcttttg

SEQ ID NO: 5555194 - DNA, 13 bp, Homo sapiens
acctgggctttct

SEQ ID NO: 5555195 - DNA, 18 bp, Homo sapiens
acctgggctttctggaat

SEQ ID NO: 5555196 - DNA, 19 bp, Homo sapiens
acctggggaaagcctgaag

SEQ ID NO: 5555197 - DNA, 21 bp, Homo sapiens
acctggggaccccccttgccc

SEQ ID NO: 5555198 - DNA, 17 bp, Homo sapiens
acctggggactcctcaa

SEQ ID NO: 5555199 - DNA, 21 bp, Homo sapiens
acctggggcacagtccaggaa

SEQ ID NO: 5555200 - DNA, 15 bp, Homo sapiens
acctggggctgctgg

SEQ ID NO: 5555201 - DNA, 20 bp, Homo sapiens
acctggggctgctgtgaagc

SEQ ID NO: 5555202 - DNA, 16 bp, Homo sapiens
acctgggggatggtca

SEQ ID NO: 5555203 - DNA, 16 bp, Homo sapiens
acctgggggcagaact

SEQ ID NO: 5555204 - DNA, 17 bp, Homo sapiens
acctgggggcagaactc

SEQ ID NO: 5555205 - DNA, 21 bp, Homo sapiens
acctggggtcatcgattcaaa

SEQ ID NO: 5555206 - DNA, 18 bp, Homo sapiens
acctggggtcccccctcc

SEQ ID NO: 5555207 - DNA, 19 bp, Homo sapiens
acctggggtctctctccct

SEQ ID NO: 5555208 - DNA, 14 bp, Homo sapiens
acctggggtgaata

SEQ ID NO: 5555209 - DNA, 18 bp, Homo sapiens
acctggggtgtgggaggc

SEQ ID NO: 5555210 - DNA, 21 bp, Homo sapiens
acctggggtgtgggaggcccg

SEQ ID NO: 5555211 - DNA, 19 bp, Homo sapiens
acctggggtttattttcag

SEQ ID NO: 5555212 - DNA, 19 bp, Homo sapiens
acctgggtatgtgtaggca

SEQ ID NO: 5555213 - DNA, 23 bp, Homo sapiens
acctgggtccccagcccttcctc

SEQ ID NO: 5555214 - DNA, 13 bp, Homo sapiens
acctgggtggaca

SEQ ID NO: 5555215 - DNA, 19 bp, Homo sapiens
acctgggtggacacaaggc

SEQ ID NO: 5555216 - DNA, 16 bp, Homo sapiens
acctgggtgtgctcca

SEQ ID NO: 5555217 - DNA, 21 bp, Homo sapiens
acctgggtgtgctccaggctt

SEQ ID NO: 5555218 - DNA, 17 bp, Homo sapiens
acctggtaagcaaaact

SEQ ID NO: 5555219 - DNA, 18 bp, Homo sapiens
acctggtaccctcctggc

SEQ ID NO: 5555220 - DNA, 14 bp, Homo sapiens
acctggtacctgga

SEQ ID NO: 5555221 - DNA, 21 bp, Homo sapiens
acctggtcacaggactctgcc

SEQ ID NO: 5555222 - DNA, 22 bp, Homo sapiens
acctggtcacaggactctgcct

SEQ ID NO: 5555223 - DNA, 14 bp, Homo sapiens
acctggtccccact

SEQ ID NO: 5555224 - DNA, 20 bp, Homo sapiens
acctggtccccactgctgag

SEQ ID NO: 5555225 - DNA, 16 bp, Homo sapiens
acctggtcctccgcct

SEQ ID NO: 5555226 - DNA, 21 bp, Homo sapiens
acctggtcgccaatccatgct

SEQ ID NO: 5555227 - DNA, 19 bp, Homo sapiens
acctggtctggtcaggcaa

SEQ ID NO: 5555228 - DNA, 18 bp, Homo sapiens
acctggtctgttttctgt

SEQ ID NO: 5555229 - DNA, 22 bp, Homo sapiens
acctggtgagtaacttagaaaa

SEQ ID NO: 5555230 - DNA, 11 bp, Homo sapiens
acctggtgctg

SEQ ID NO: 5555231 - DNA, 16 bp, Homo sapiens
acctggtgctgcctct

SEQ ID NO: 5555232 - DNA, 12 bp, Homo sapiens
acctggtggcac

SEQ ID NO: 5555233 - DNA, 13 bp, Homo sapiens
acctggtggccct

SEQ ID NO: 5555234 - DNA, 14 bp, Homo sapiens
acctggtggccctg

SEQ ID NO: 5555235 - DNA, 15 bp, Homo sapiens
acctggtggcctctg

SEQ ID NO: 5555236 - DNA, 14 bp, Homo sapiens
acctggtgtgcgga

SEQ ID NO: 5555237 - DNA, 18 bp, Homo sapiens
acctggtgtgcggaggca

SEQ ID NO: 5555238 - DNA, 22 bp, Homo sapiens
acctggttaaacaaaccagaat

SEQ ID NO: 5555239 - DNA, 18 bp, Homo sapiens
acctggttatgagccgac

SEQ ID NO: 5555240 - DNA, 21 bp, Homo sapiens
acctggtttacttctttagca

SEQ ID NO: 5555241 - DNA, 17 bp, Homo sapiens
acctggttttcattatt

SEQ ID NO: 5555242 - DNA, 11 bp, Homo sapiens
acctgtaaaac

SEQ ID NO: 5555243 - DNA, 14 bp, Homo sapiens
acctgtaaaacttt

SEQ ID NO: 5555244 - DNA, 20 bp, Homo sapiens
acctgtaaaactttatttta

SEQ ID NO: 5555245 - DNA, 17 bp, Homo sapiens
acctgtaaatgtcctga

SEQ ID NO: 5555246 - DNA, 19 bp, Homo sapiens
acctgtaaattattttaaa

SEQ ID NO: 5555247 - DNA, 19 bp, Homo sapiens
acctgtaacctttcggcaa

SEQ ID NO: 5555248 - DNA, 15 bp, Homo sapiens
acctgtaactctcaa

SEQ ID NO: 5555249 - DNA, 23 bp, Homo sapiens
acctgtaactgcccttttaaatg

SEQ ID NO: 5555250 - DNA, 23 bp, Homo sapiens
acctgtaagcattttaggtccca

SEQ ID NO: 5555251 - DNA, 19 bp, Homo sapiens
acctgtaagcccagcattt

SEQ ID NO: 5555252 - DNA, 16 bp, Homo sapiens
acctgtaataaatatg

SEQ ID NO: 5555253 - DNA, 17 bp, Homo sapiens
acctgtaataaatatga

SEQ ID NO: 5555254 - DNA, 23 bp, Homo sapiens
acctgtaataaatatgagtgcca

SEQ ID NO: 5555255 - DNA, 14 bp, Homo sapiens
acctgtaatcccag

SEQ ID NO: 5555256 - DNA, 19 bp, Homo sapiens
acctgtaatcccagctact

SEQ ID NO: 5555257 - DNA, 15 bp, Homo sapiens
acctgtaatgacagg

SEQ ID NO: 5555258 - DNA, 14 bp, Homo sapiens
acctgtacacacac

SEQ ID NO: 5555259 - DNA, 16 bp, Homo sapiens
acctgtacacacacag

SEQ ID NO: 5555260 - DNA, 17 bp, Homo sapiens
acctgtacacacacaga

SEQ ID NO: 5555261 - DNA, 16 bp, Homo sapiens
acctgtacactgactt

SEQ ID NO: 5555262 - DNA, 18 bp, Homo sapiens
acctgtacatacattgta

SEQ ID NO: 5555263 - DNA, 21 bp, Homo sapiens
acctgtactatgatgggcttc

SEQ ID NO: 5555264 - DNA, 21 bp, Homo sapiens
acctgtagaacacccctgtgc

SEQ ID NO: 5555265 - DNA, 18 bp, Homo sapiens
acctgtagatagtgatat

SEQ ID NO: 5555266 - DNA, 15 bp, Homo sapiens
acctgtagatgcaga

SEQ ID NO: 5555267 - DNA, 21 bp, Homo sapiens
acctgtagatgcagaaaaaga

SEQ ID NO: 5555268 - DNA, 15 bp, Homo sapiens
acctgtagccatctg

SEQ ID NO: 5555269 - DNA, 16 bp, Homo sapiens
acctgtagccatctgc

SEQ ID NO: 5555270 - DNA, 21 bp, Homo sapiens
acctgtaggaaacagaaaaga

SEQ ID NO: 5555271 - DNA, 17 bp, Homo sapiens
acctgtaggatattgga

SEQ ID NO: 5555272 - DNA, 16 bp, Homo sapiens
acctgtaggtctatga

SEQ ID NO: 5555273 - DNA, 14 bp, Homo sapiens
acctgtagtcccag

SEQ ID NO: 5555274 - DNA, 16 bp, Homo sapiens
acctgtagtgagaaac

SEQ ID NO: 5555275 - DNA, 17 bp, Homo sapiens
acctgtataaccctgtt

SEQ ID NO: 5555276 - DNA, 14 bp, Homo sapiens
acctgtatactctt

SEQ ID NO: 5555277 - DNA, 19 bp, Homo sapiens
acctgtatatttcttttaa

SEQ ID NO: 5555278 - DNA, 17 bp, Homo sapiens
acctgtatcaaactgct

SEQ ID NO: 5555279 - DNA, 18 bp, Homo sapiens
acctgtatcaaactgctt

SEQ ID NO: 5555280 - DNA, 11 bp, Homo sapiens
acctgtatctt

SEQ ID NO: 5555281 - DNA, 23 bp, Homo sapiens
acctgtatctttctatgctgctt

SEQ ID NO: 5555282 - DNA, 20 bp, Homo sapiens
acctgtattgtctgacttct

SEQ ID NO: 5555283 - DNA, 17 bp, Homo sapiens
acctgtatttaaaaata

SEQ ID NO: 5555284 - DNA, 18 bp, Homo sapiens
acctgtatttaaaaatag

SEQ ID NO: 5555285 - DNA, 14 bp, Homo sapiens
acctgtatttaagc

SEQ ID NO: 5555286 - DNA, 16 bp, Homo sapiens
acctgtatttttgtta

SEQ ID NO: 5555287 - DNA, 17 bp, Homo sapiens
acctgtatttttgttag

SEQ ID NO: 5555288 - DNA, 23 bp, Homo sapiens
acctgtcaaaaattttgaatgta

SEQ ID NO: 5555289 - DNA, 24 bp, Homo sapiens
acctgtcaaacaaagccagaagct

SEQ ID NO: 5555290 - DNA, 11 bp, Homo sapiens
acctgtcaacc

SEQ ID NO: 5555291 - DNA, 23 bp, Homo sapiens
acctgtcaacctgaattaaagtc

SEQ ID NO: 5555292 - DNA, 13 bp, Homo sapiens
acctgtcacattg

SEQ ID NO: 5555293 - DNA, 16 bp, Homo sapiens
acctgtcacattgcat

SEQ ID NO: 5555294 - DNA, 22 bp, Homo sapiens
acctgtcacattgcattctatt

SEQ ID NO: 5555295 - DNA, 22 bp, Homo sapiens
accttgcacacatcatctgtaa

SEQ ID NO: 5555296 - DNA, 20 bp, Homo sapiens
accttgcagcatttttattt

SEQ ID NO: 5555297 - DNA, 19 bp, Homo sapiens
accttgccaagctttcttc

SEQ ID NO: 5555298 - DNA, 18 bp, Homo sapiens
accttgccccaacccttc

SEQ ID NO: 5555299 - DNA, 22 bp, Homo sapiens
accttgccccaacccttcttca

SEQ ID NO: 5555300 - DNA, 16 bp, Homo sapiens
accttgccgagagagg

SEQ ID NO: 5555301 - DNA, 20 bp, Homo sapiens
accttgcctcccctcctctc

SEQ ID NO: 5555302 - DNA, 15 bp, Homo sapiens
accttgccttagaaa

SEQ ID NO: 5555303 - DNA, 18 bp, Homo sapiens
accttgccttagaaacac

SEQ ID NO: 5555304 - DNA, 14 bp, Homo sapiens
accttgccttgaaa

SEQ ID NO: 5555305 - DNA, 17 bp, Homo sapiens
accttgctctcctcatc

SEQ ID NO: 5555306 - DNA, 14 bp, Homo sapiens
accttgctgcagtg

SEQ ID NO: 5555307 - DNA, 23 bp, Homo sapiens
accttgctgggacttggatccca

SEQ ID NO: 5555308 - DNA, 13 bp, Homo sapiens
accttgcttcctt

SEQ ID NO: 5555309 - DNA, 15 bp, Homo sapiens
accttgcttccttct

SEQ ID NO: 5555310 - DNA, 12 bp, Homo sapiens
accttgcttctt

SEQ ID NO: 5555311 - DNA, 18 bp, Homo sapiens
accttgctttgagactcc

SEQ ID NO: 5555312 - DNA, 18 bp, Homo sapiens
accttgcttttgcttcta

SEQ ID NO: 5555313 - DNA, 11 bp, Homo sapiens
accttggaagg

SEQ ID NO: 5555314 - DNA, 17 bp, Homo sapiens
accttggagcatttatg

SEQ ID NO: 5555315 - DNA, 23 bp, Homo sapiens
accttggagcatttatgtagaca

SEQ ID NO: 5555316 - DNA, 23 bp, Homo sapiens
accttggaggccttccctggcct

SEQ ID NO: 5555317 - DNA, 22 bp, Homo sapiens
accttggcaccagacacccagg

SEQ ID NO: 5555318 - DNA, 14 bp, Homo sapiens
accttggcccagga

SEQ ID NO: 5555319 - DNA, 16 bp, Homo sapiens
accttggcccaggagc

SEQ ID NO: 5555320 - DNA, 22 bp, Homo sapiens
accttggcccaggagctctgcg

SEQ ID NO: 5555321 - DNA, 20 bp, Homo sapiens
accttggccctacagccctg

SEQ ID NO: 5555322 - DNA, 17 bp, Homo sapiens
accttggcctcccagaa

SEQ ID NO: 5555323 - DNA, 15 bp, Homo sapiens
accttggcctgggcc

SEQ ID NO: 5555324 - DNA, 18 bp, Homo sapiens
accttggccttctcccct

SEQ ID NO: 5555325 - DNA, 19 bp, Homo sapiens
accttggccttctcccctc

SEQ ID NO: 5555326 - DNA, 23 bp, Homo sapiens
accttggccttctcccctcttct

SEQ ID NO: 5555327 - DNA, 18 bp, Homo sapiens
accttggcgctctcagct

SEQ ID NO: 5555328 - DNA, 19 bp, Homo sapiens
accttggcgtgtgtccctg

SEQ ID NO: 5555329 - DNA, 17 bp, Homo sapiens
accttggctgcagggag

SEQ ID NO: 5555330 - DNA, 20 bp, Homo sapiens
accttggcttggccctggca

SEQ ID NO: 5555331 - DNA, 21 bp, Homo sapiens
accttggcttggccctggcag

SEQ ID NO: 5555332 - DNA, 16 bp, Homo sapiens
accttgggaccaaagg

SEQ ID NO: 5555333 - DNA, 14 bp, Homo sapiens
accttgggccctgg

SEQ ID NO: 5555334 - DNA, 15 bp, Homo sapiens
accttgggccctgga

SEQ ID NO: 5555335 - DNA, 16 bp, Homo sapiens
accttgggctggggga

SEQ ID NO: 5555336 - DNA, 23 bp, Homo sapiens
accttggggccttgatgactgcc

SEQ ID NO: 5555337 - DNA, 24 bp, Homo sapiens
accttggggccttgatgactgcct

SEQ ID NO: 5555338 - DNA, 15 bp, Homo sapiens
accttgggtctgtgt

SEQ ID NO: 5555339 - DNA, 17 bp, Homo sapiens
accttgggttagaccta

SEQ ID NO: 5555340 - DNA, 18 bp, Homo sapiens
accttgggtttgtatttt

SEQ ID NO: 5555341 - DNA, 15 bp, Homo sapiens
accttggtccctctc

SEQ ID NO: 5555342 - DNA, 18 bp, Homo sapiens
accttggtccctctcaga

SEQ ID NO: 5555343 - DNA, 16 bp, Homo sapiens
accttggtcctgcctc

SEQ ID NO: 5555344 - DNA, 17 bp, Homo sapiens
accttggtcctgcctct

SEQ ID NO: 5555345 - DNA, 15 bp, Homo sapiens
accttggtgagatgg

SEQ ID NO: 5555346 - DNA, 23 bp, Homo sapiens
accttggtgtagttgaactgata

SEQ ID NO: 5555347 - DNA, 13 bp, Homo sapiens
accttgtaaaaga

SEQ ID NO: 5555348 - DNA, 15 bp, Homo sapiens
accttgtaaaagaca

SEQ ID NO: 5555349 - DNA, 19 bp, Homo sapiens
accttgtaaattccccttc

SEQ ID NO: 5555350 - DNA, 18 bp, Homo sapiens
accttgtaaccagtgcag

SEQ ID NO: 5555351 - DNA, 14 bp, Homo sapiens
accttgtaatgtaa

SEQ ID NO: 5555352 - DNA, 22 bp, Homo sapiens
accttgtacagaaccagcactc

SEQ ID NO: 5555353 - DNA, 12 bp, Homo sapiens
accttgtataaa

SEQ ID NO: 5555354 - DNA, 12 bp, Homo sapiens
accttgtctgct

SEQ ID NO: 5555355 - DNA, 22 bp, Homo sapiens
accttgtgactcagtgtatttt

SEQ ID NO: 5555356 - DNA, 23 bp, Homo sapiens
accttgtgactcagtgtatttta

SEQ ID NO: 5555357 - DNA, 20 bp, Homo sapiens
accttgtgcattgtggctta

SEQ ID NO: 5555358 - DNA, 14 bp, Homo sapiens
accttgtgcctggc

SEQ ID NO: 5555359 - DNA, 17 bp, Homo sapiens
accttgtgcctggctca

SEQ ID NO: 5555360 - DNA, 14 bp, Homo sapiens
accttgtgcctggg

SEQ ID NO: 5555361 - DNA, 20 bp, Homo sapiens
accttgtggtctcgatgctg

SEQ ID NO: 5555362 - DNA, 22 bp, Homo sapiens
accttgtggtctcgatgctgct

SEQ ID NO: 5555363 - DNA, 21 bp, Homo sapiens
accttgtgtactttcttccct

SEQ ID NO: 5555364 - DNA, 12 bp, Homo sapiens
accttgtgtctg

SEQ ID NO: 5555365 - DNA, 18 bp, Homo sapiens
accttgtgtctgtacacg

SEQ ID NO: 5555366 - DNA, 17 bp, Homo sapiens
accttgtgtgagtgtga

SEQ ID NO: 5555367 - DNA, 15 bp, Homo sapiens
accttgttacttctg

SEQ ID NO: 5555368 - DNA, 17 bp, Homo sapiens
accttgttacttctgag

SEQ ID NO: 5555369 - DNA, 14 bp, Homo sapiens
accttgttcacact

SEQ ID NO: 5555370 - DNA, 16 bp, Homo sapiens
accttgttcacactct

SEQ ID NO: 5555371 - DNA, 15 bp, Homo sapiens
accttgttctatttt

SEQ ID NO: 5555372 - DNA, 17 bp, Homo sapiens
accttgttctatttttc

SEQ ID NO: 5555373 - DNA, 18 bp, Homo sapiens
accttgttgatgccagct

SEQ ID NO: 5555374 - DNA, 21 bp, Homo sapiens
accttgttgatgccagctgta

SEQ ID NO: 5555375 - DNA, 19 bp, Homo sapiens
accttgttggagcctgcag

SEQ ID NO: 5555376 - DNA, 20 bp, Homo sapiens
accttgttgtgtttctatct

SEQ ID NO: 5555377 - DNA, 20 bp, Homo sapiens
accttgtttattaaattgca

SEQ ID NO: 5555378 - DNA, 13 bp, Homo sapiens
accttgtttgttt

SEQ ID NO: 5555379 - DNA, 15 bp, Homo sapiens
accttgtttgtttta

SEQ ID NO: 5555380 - DNA, 21 bp, Homo sapiens
acctttaaaaagcaggaaata

SEQ ID NO: 5555381 - DNA, 20 bp, Homo sapiens
acctttaaaaatgtataatg

SEQ ID NO: 5555382 - DNA, 20 bp, Homo sapiens
acctttaaatatcattcttt

SEQ ID NO: 5555383 - DNA, 17 bp, Homo sapiens
acctttaaatgcaacag

SEQ ID NO: 5555384 - DNA, 13 bp, Homo sapiens
acctttaagaaaa

SEQ ID NO: 5555385 - DNA, 21 bp, Homo sapiens
acctttaagtagataagcaga

SEQ ID NO: 5555386 - DNA, 12 bp, Homo sapiens
acctttaatgag

SEQ ID NO: 5555387 - DNA, 13 bp, Homo sapiens
acctttacatata

SEQ ID NO: 5555388 - DNA, 21 bp, Homo sapiens
acctttagaaactcaaaaact

SEQ ID NO: 5555389 - DNA, 22 bp, Homo sapiens
acctttagaacaggagacttga

SEQ ID NO: 5555390 - DNA, 15 bp, Homo sapiens
acctttagggcagct

SEQ ID NO: 5555391 - DNA, 21 bp, Homo sapiens
acctttaggtcaaactcccta

SEQ ID NO: 5555392 - DNA, 20 bp, Homo sapiens
acctttagtggtggccattt

SEQ ID NO: 5555393 - DNA, 13 bp, Homo sapiens
acctttataggat

SEQ ID NO: 5555394 - DNA, 16 bp, Homo sapiens
acctttatccctgctt

SEQ ID NO: 5555395 - DNA, 14 bp, Homo sapiens
acctttatctttca

SEQ ID NO: 5555396 - DNA, 24 bp, Homo sapiens
acctttatgttttaatatcctagg

SEQ ID NO: 5555397 - DNA, 16 bp, Homo sapiens
acctttattaaaatct

SEQ ID NO: 5555398 - DNA, 16 bp, Homo sapiens
acctttattcacccct

SEQ ID NO: 5555399 - DNA, 21 bp, Homo sapiens
acctttattccttcatttcat

SEQ ID NO: 5555400 - DNA, 23 bp, Homo sapiens
acctttattccttcatttcatct

SEQ ID NO: 5555401 - DNA, 13 bp, Homo sapiens
acctttattctgg

SEQ ID NO: 5555402 - DNA, 13 bp, Homo sapiens
acctttattcttt

SEQ ID NO: 5555403 - DNA, 22 bp, Homo sapiens
acctttattgaagggtctgttt

SEQ ID NO: 5555404 - DNA, 18 bp, Homo sapiens
acctttattgtgatctat

SEQ ID NO: 5555405 - DNA, 19 bp, Homo sapiens
acctttatttattaaactt

SEQ ID NO: 5555406 - DNA, 20 bp, Homo sapiens
acctttatttattaaacttc

SEQ ID NO: 5555407 - DNA, 12 bp, Homo sapiens
acctttatttta

SEQ ID NO: 5555408 - DNA, 16 bp, Homo sapiens
acctttatttttctat

SEQ ID NO: 5555409 - DNA, 12 bp, Homo sapiens
acctttcaaaat

SEQ ID NO: 5555410 - DNA, 16 bp, Homo sapiens
acctttcaaaatggaa

SEQ ID NO: 5555411 - DNA, 17 bp, Homo sapiens
acctttcaaatttcaca

SEQ ID NO: 5555412 - DNA, 16 bp, Homo sapiens
acctttcagctgtgaa

SEQ ID NO: 5555413 - DNA, 15 bp, Homo sapiens
acctttcagtactct

SEQ ID NO: 5555414 - DNA, 19 bp, Homo sapiens
acctttcagtgcagtttct

SEQ ID NO: 5555415 - DNA, 23 bp, Homo sapiens
acctttcagtgcagtttcttttc

SEQ ID NO: 5555416 - DNA, 21 bp, Homo sapiens
acctttcataatctttgcttt

SEQ ID NO: 5555417 - DNA, 19 bp, Homo sapiens
acctttccaaggccccacc

SEQ ID NO: 5555418 - DNA, 23 bp, Homo sapiens
acctttccaaggccccaccttct

SEQ ID NO: 5555419 - DNA, 13 bp, Homo sapiens
acctttccaccca

SEQ ID NO: 5555420 - DNA, 14 bp, Homo sapiens
acctttccactccc

SEQ ID NO: 5555421 - DNA, 21 bp, Homo sapiens
acctttccactcccactgcca

SEQ ID NO: 5555422 - DNA, 17 bp, Homo sapiens
acctttcccactttctt

SEQ ID NO: 5555423 - DNA, 22 bp, Homo sapiens
acctttcccactttcttctacc

SEQ ID NO: 5555424 - DNA, 13 bp, Homo sapiens
acctttccctcac

SEQ ID NO: 5555425 - DNA, 12 bp, Homo sapiens
acctttcctctc

SEQ ID NO: 5555426 - DNA, 18 bp, Homo sapiens
acctttcctctcctgggt

SEQ ID NO: 5555427 - DNA, 11 bp, Homo sapiens
acctttcctga

SEQ ID NO: 5555428 - DNA, 22 bp, Homo sapiens
acctttcctgccgtccctcctg

SEQ ID NO: 5555429 - DNA, 23 bp, Homo sapiens
acctttcctgccgtccctcctgt

SEQ ID NO: 5555430 - DNA, 20 bp, Homo sapiens
acctttcctttttggggagt

SEQ ID NO: 5555431 - DNA, 20 bp, Homo sapiens
acctttctactttttctgta

SEQ ID NO: 5555432 - DNA, 16 bp, Homo sapiens
acctttctagccttag

SEQ ID NO: 5555433 - DNA, 12 bp, Homo sapiens
acctttctctga

SEQ ID NO: 5555434 - DNA, 14 bp, Homo sapiens
acctttctctgaga

SEQ ID NO: 5555435 - DNA, 15 bp, Homo sapiens
acctttctgacatca

SEQ ID NO: 5555436 - DNA, 18 bp, Homo sapiens
acctttctgacatcagca

SEQ ID NO: 5555437 - DNA, 19 bp, Homo sapiens
acctttctgacatcagcac

SEQ ID NO: 5555438 - DNA, 22 bp, Homo sapiens
acctttctgaggagtaaaaaga

SEQ ID NO: 5555439 - DNA, 15 bp, Homo sapiens
acctttctggcctgt

SEQ ID NO: 5555440 - DNA, 16 bp, Homo sapiens
acctttctggcctgtt

SEQ ID NO: 5555441 - DNA, 20 bp, Homo sapiens
acctttcttcaccaaatctt

SEQ ID NO: 5555442 - DNA, 16 bp, Homo sapiens
acctttcttcttgtgt

SEQ ID NO: 5555443 - DNA, 16 bp, Homo sapiens
acctttgagagagggg

SEQ ID NO: 5555444 - DNA, 22 bp, Homo sapiens
acctttgagagagggggcactg

SEQ ID NO: 5555445 - DNA, 20 bp, Homo sapiens
acctttgatgaattcttcct

SEQ ID NO: 5555446 - DNA, 22 bp, Homo sapiens
acctttgcgtggatcaagcttg

SEQ ID NO: 5555447 - DNA, 15 bp, Homo sapiens
acctttgctatgtaa

SEQ ID NO: 5555448 - DNA, 17 bp, Homo sapiens
acctttgctgtagtgtt

SEQ ID NO: 5555449 - DNA, 15 bp, Homo sapiens
acctttgctgtcact

SEQ ID NO: 5555450 - DNA, 19 bp, Homo sapiens
acctttgctgtcactttct

SEQ ID NO: 5555451 - DNA, 13 bp, Homo sapiens
acctttggaaaaa

SEQ ID NO: 5555452 - DNA, 17 bp, Homo sapiens
acctttggaaagctctg

SEQ ID NO: 5555453 - DNA, 15 bp, Homo sapiens
acctttggaattgtg

SEQ ID NO: 5555454 - DNA, 16 bp, Homo sapiens
acctttggaattgtgc

SEQ ID NO: 5555455 - DNA, 20 bp, Homo sapiens
acctttggacaagaggaaaa

SEQ ID NO: 5555456 - DNA, 13 bp, Homo sapiens
acctttggctggt

SEQ ID NO: 5555457 - DNA, 17 bp, Homo sapiens
acctttgggactaagct

SEQ ID NO: 5555458 - DNA, 18 bp, Homo sapiens
acctttgggttctttctg

SEQ ID NO: 5555459 - DNA, 23 bp, Homo sapiens
acctttgggttgcaatctgggga

SEQ ID NO: 5555460 - DNA, 12 bp, Homo sapiens
acctttggtgca

SEQ ID NO: 5555461 - DNA, 16 bp, Homo sapiens
acctttggtgcagagg

SEQ ID NO: 5555462 - DNA, 23 bp, Homo sapiens
acctttgtaagaaaaccaaaata

SEQ ID NO: 5555463 - DNA, 21 bp, Homo sapiens
acctttgtaagacatttgtat

SEQ ID NO: 5555464 - DNA, 13 bp, Homo sapiens
acctttgtcccca

SEQ ID NO: 5555465 - DNA, 17 bp, Homo sapiens
acctttgtccccaccgc

SEQ ID NO: 5555466 - DNA, 18 bp, Homo sapiens
acctttgtccccaccgca

SEQ ID NO: 5555467 - DNA, 22 bp, Homo sapiens
acctttgtctcacgattccagt

SEQ ID NO: 5555468 - DNA, 15 bp, Homo sapiens
acctttgtctgaagg

SEQ ID NO: 5555469 - DNA, 17 bp, Homo sapiens
acctttgtctgaaggat

SEQ ID NO: 5555470 - DNA, 22 bp, Homo sapiens
acctttgtctgaaggattttaa

SEQ ID NO: 5555471 - DNA, 18 bp, Homo sapiens
acctttgtcttctataat

SEQ ID NO: 5555472 - DNA, 15 bp, Homo sapiens
acgcagggagaccct

SEQ ID NO: 5555473 - DNA, 16 bp, Homo sapiens
acgcagggagaccctg

SEQ ID NO: 5555474 - DNA, 17 bp, Homo sapiens
acgcagggagaccctgg

SEQ ID NO: 5555475 - DNA, 20 bp, Homo sapiens
acgcagggagaccctgggag

SEQ ID NO: 5555476 - DNA, 23 bp, Homo sapiens
acgcagggccatccactgtgacg

SEQ ID NO: 5555477 - DNA, 14 bp, Homo sapiens
acgcaggggccctg

SEQ ID NO: 5555478 - DNA, 18 bp, Homo sapiens
acgcaggggccctgagcc

SEQ ID NO: 5555479 - DNA, 21 bp, Homo sapiens
acgcagttgctcgcttttcct

SEQ ID NO: 5555480 - DNA, 21 bp, Homo sapiens
acgcagttgtgtggcccagca

SEQ ID NO: 5555481 - DNA, 23 bp, Homo sapiens
acgcatacacacatgccctcctg

SEQ ID NO: 5555482 - DNA, 18 bp, Homo sapiens
acgcatcccatctctccc

SEQ ID NO: 5555483 - DNA, 20 bp, Homo sapiens
acgcatcccatctctcccac

SEQ ID NO: 5555484 - DNA, 20 bp, Homo sapiens
acgcatctcaaaacagaggg

SEQ ID NO: 5555485 - DNA, 22 bp, Homo sapiens
acgcatctcaaaacagagggct

SEQ ID NO: 5555486 - DNA, 16 bp, Homo sapiens
acgcatgagatattca

SEQ ID NO: 5555487 - DNA, 21 bp, Homo sapiens
acgcatgcagtgttggggatg

SEQ ID NO: 5555488 - DNA, 19 bp, Homo sapiens
acgcatgcctcagccagcc

SEQ ID NO: 5555489 - DNA, 14 bp, Homo sapiens
acgcatgggcattg

SEQ ID NO: 5555490 - DNA, 19 bp, Homo sapiens
acgcatgggcattgcagcc

SEQ ID NO: 5555491 - DNA, 20 bp, Homo sapiens
acgcatgggcattgcagcct

SEQ ID NO: 5555492 - DNA, 18 bp, Homo sapiens
acgcatggtcaaccctca

SEQ ID NO: 5555493 - DNA, 21 bp, Homo sapiens
acgcatgtccctccaaggctg

SEQ ID NO: 5555494 - DNA, 19 bp, Homo sapiens
acgcattaagggcctgctg

SEQ ID NO: 5555495 - DNA, 20 bp, Homo sapiens
acgcattaagggcctgctgg

SEQ ID NO: 5555496 - DNA, 18 bp, Homo sapiens
acgcattttgggttgttt

SEQ ID NO: 5555497 - DNA, 23 bp, Homo sapiens
acgcattttgggttgtttaaaaa

SEQ ID NO: 5555498 - DNA, 22 bp, Homo sapiens
acgccaaagtgcagcccttcct

SEQ ID NO: 5555499 - DNA, 19 bp, Homo sapiens
acgccaacttctcccaccc

SEQ ID NO: 5555500 - DNA, 20 bp, Homo sapiens
acgccaataataaaaaacaa

SEQ ID NO: 5555501 - DNA, 19 bp, Homo sapiens
acgccaatgttatgccagc

SEQ ID NO: 5555502 - DNA, 21 bp, Homo sapiens
acgccaatgttatgccagctc

SEQ ID NO: 5555503 - DNA, 22 bp, Homo sapiens
acgccacagcccttttgtctct

SEQ ID NO: 5555504 - DNA, 15 bp, Homo sapiens
acgccacatccccca

SEQ ID NO: 5555505 - DNA, 13 bp, Homo sapiens
acgccaccattcc

SEQ ID NO: 5555506 - DNA, 18 bp, Homo sapiens
acgccaccattcctggaa

SEQ ID NO: 5555507 - DNA, 21 bp, Homo sapiens
acgccacccccgcccccaccg

SEQ ID NO: 5555508 - DNA, 17 bp, Homo sapiens
acgccacggccgtgttc

SEQ ID NO: 5555509 - DNA, 12 bp, Homo sapiens
acgccactcatt

SEQ ID NO: 5555510 - DNA, 20 bp, Homo sapiens
acgccactcatttcatctca

SEQ ID NO: 5555511 - DNA, 18 bp, Homo sapiens
acgccactccacaaatga

SEQ ID NO: 5555512 - DNA, 16 bp, Homo sapiens
acgccactccctggga

SEQ ID NO: 5555513 - DNA, 14 bp, Homo sapiens
acgccactgcactc

SEQ ID NO: 5555514 - DNA, 23 bp, Homo sapiens
acgccagattctttcctgaggct

SEQ ID NO: 5555515 - DNA, 12 bp, Homo sapiens
acgccagctcct

SEQ ID NO: 5555516 - DNA, 16 bp, Homo sapiens
acgccagctcctctct

SEQ ID NO: 5555517 - DNA, 12 bp, Homo sapiens
acgccagctggc

SEQ ID NO: 5555518 - DNA, 14 bp, Homo sapiens
acgccagctggccc

SEQ ID NO: 5555519 - DNA, 19 bp, Homo sapiens
acgccaggagaagttgagg

SEQ ID NO: 5555520 - DNA, 22 bp, Homo sapiens
acgccaggagaagttgagggga

SEQ ID NO: 5555521 - DNA, 19 bp, Homo sapiens
acgccaggcaccacagcct

SEQ ID NO: 5555522 - DNA, 17 bp, Homo sapiens
acgccagggaccccaga

SEQ ID NO: 5555523 - DNA, 23 bp, Homo sapiens
acgccaggggaaaatcagcctgc

SEQ ID NO: 5555524 - DNA, 15 bp, Homo sapiens
acgccatcccagccc

SEQ ID NO: 5555525 - DNA, 15 bp, Homo sapiens
acgccattctcctgc

SEQ ID NO: 5555526 - DNA, 23 bp, Homo sapiens
acgccattctcctgcctcagcct

SEQ ID NO: 5555527 - DNA, 22 bp, Homo sapiens
acgccattgcactccagcctgg

SEQ ID NO: 5555528 - DNA, 19 bp, Homo sapiens
acgccattgtactccagcc

SEQ ID NO: 5555529 - DNA, 22 bp, Homo sapiens
acgccattgtactccagcctgg

SEQ ID NO: 5555530 - DNA, 13 bp, Homo sapiens
acgcccaccagcc

SEQ ID NO: 5555531 - DNA, 16 bp, Homo sapiens
acgcccaccagccttg

SEQ ID NO: 5555532 - DNA, 21 bp, Homo sapiens
acgcccaccagccttgctctc

SEQ ID NO: 5555533 - DNA, 14 bp, Homo sapiens
acgcccacccccag

SEQ ID NO: 5555534 - DNA, 23 bp, Homo sapiens
acgcccacccccagtctccaggg

SEQ ID NO: 5555535 - DNA, 15 bp, Homo sapiens
acgcccacttccctg

SEQ ID NO: 5555536 - DNA, 12 bp, Homo sapiens
acgcccagcccc

SEQ ID NO: 5555537 - DNA, 13 bp, Homo sapiens
acgcccagcccca

SEQ ID NO: 5555538 - DNA, 17 bp, Homo sapiens
acgcccagcccccaccc

SEQ ID NO: 5555539 - DNA, 23 bp, Homo sapiens
acgcccagcccccacccccgtca

SEQ ID NO: 5555540 - DNA, 14 bp, Homo sapiens
acgcccagcctcct

SEQ ID NO: 5555541 - DNA, 15 bp, Homo sapiens
acgcccagctccgcc

SEQ ID NO: 5555542 - DNA, 18 bp, Homo sapiens
acgcccagctgaggctgg

SEQ ID NO: 5555543 - DNA, 12 bp, Homo sapiens
acgcccaggaca

SEQ ID NO: 5555544 - DNA, 14 bp, Homo sapiens
acgcccatgtgtga

SEQ ID NO: 5555545 - DNA, 16 bp, Homo sapiens
acgcccatgtgtgagt

SEQ ID NO: 5555546 - DNA, 12 bp, Homo sapiens
acgccccagccc

SEQ ID NO: 5555547 - DNA, 14 bp, Homo sapiens
acgcccccccccac

SEQ ID NO: 5555548 - DNA, 18 bp, Homo sapiens
acgccccccggcctgatg

SEQ ID NO: 5555549 - DNA, 23 bp, Homo sapiens
acgcccccgcccccgccccgctg

SEQ ID NO: 5555550 - DNA, 22 bp, Homo sapiens
acgccccgctgtgtcctccctc

SEQ ID NO: 5555551 - DNA, 18 bp, Homo sapiens
acgccccgggcaaagggt

SEQ ID NO: 5555552 - DNA, 17 bp, Homo sapiens
acgccccggtcccccag

SEQ ID NO: 5555553 - DNA, 16 bp, Homo sapiens
acgcccctccaaacct

SEQ ID NO: 5555554 - DNA, 12 bp, Homo sapiens
acgcccctgtgg

SEQ ID NO: 5555555 - DNA, 13 bp, Homo sapiens
acgcccctgtggc

SEQ ID NO: 5555556 - DNA, 16 bp, Homo sapiens
acgcccctgtggccaa

SEQ ID NO: 5555557 - DNA, 22 bp, Homo sapiens
acgcccctgtggccaactgcaa

SEQ ID NO: 5555558 - DNA, 15 bp, Homo sapiens
acgcccgcacccccg

SEQ ID NO: 5555559 - DNA, 19 bp, Homo sapiens
acgccctactccactgccc

SEQ ID NO: 5555560 - DNA, 13 bp, Homo sapiens
acgccctcaagaa

SEQ ID NO: 5555561 - DNA, 15 bp, Homo sapiens
acgccctcaagaaca

SEQ ID NO: 5555562 - DNA, 18 bp, Homo sapiens
acgccctcccctcccctg

SEQ ID NO: 5555563 - DNA, 21 bp, Homo sapiens
acgccctcccctcccctgctg

SEQ ID NO: 5555564 - DNA, 18 bp, Homo sapiens
acgccctccctctcccag

SEQ ID NO: 5555565 - DNA, 14 bp, Homo sapiens
acgccctccctgct

SEQ ID NO: 5555566 - DNA, 16 bp, Homo sapiens
acgccctccctgctag

SEQ ID NO: 5555567 - DNA, 15 bp, Homo sapiens
acgccctcctccctc

SEQ ID NO: 5555568 - DNA, 16 bp, Homo sapiens
acgccctcctccctcc

SEQ ID NO: 5555569 - DNA, 21 bp, Homo sapiens
acgccctctatcatggtgaaa

SEQ ID NO: 5555570 - DNA, 14 bp, Homo sapiens
acgccctctcccca

SEQ ID NO: 5555571 - DNA, 18 bp, Homo sapiens
acgccctctccccacccc

SEQ ID NO: 5555572 - DNA, 23 bp, Homo sapiens
acgccctctccccacccctaccc

SEQ ID NO: 5555573 - DNA, 17 bp, Homo sapiens
acgccctctcctccccc

SEQ ID NO: 5555574 - DNA, 22 bp, Homo sapiens
acgccctgcgttggagccactc

SEQ ID NO: 5555575 - DNA, 18 bp, Homo sapiens
acgccctggtaaggctgg

SEQ ID NO: 5555576 - DNA, 19 bp, Homo sapiens
acgccctggtaaggctggt

SEQ ID NO: 5555577 - DNA, 14 bp, Homo sapiens
acgccctgtgtcca

SEQ ID NO: 5555578 - DNA, 22 bp, Homo sapiens
acgccctgttcacgctcaccca

SEQ ID NO: 5555579 - DNA, 18 bp, Homo sapiens
acgccctgttcccttcct

SEQ ID NO: 5555580 - DNA, 23 bp, Homo sapiens
acgccctgttcccttcctgccct

SEQ ID NO: 5555581 - DNA, 18 bp, Homo sapiens
acgcccttcaatgctgca

SEQ ID NO: 5555582 - DNA, 16 bp, Homo sapiens
acgcccttcctgtgcc

SEQ ID NO: 5555583 - DNA, 15 bp, Homo sapiens
acgcccttggagcct

SEQ ID NO: 5555584 - DNA, 19 bp, Homo sapiens
acgcccttggagccttcca

SEQ ID NO: 5555585 - DNA, 18 bp, Homo sapiens
acgccctttcctcctcag

SEQ ID NO: 5555586 - DNA, 14 bp, Homo sapiens
acgccgccctccat

SEQ ID NO: 5555587 - DNA, 21 bp, Homo sapiens
acgccgccttggccttgcagc

SEQ ID NO: 5555588 - DNA, 19 bp, Homo sapiens
acgccggccacacccctct

SEQ ID NO: 5555589 - DNA, 22 bp, Homo sapiens
acgccggcctctgctgccccct

SEQ ID NO: 5555590 - DNA, 20 bp, Homo sapiens
acgccggggacagaggcctg

SEQ ID NO: 5555591 - DNA, 19 bp, Homo sapiens
acgccggggctggccctgc

SEQ ID NO: 5555592 - DNA, 19 bp, Homo sapiens
acgccgtaattctttctgt

SEQ ID NO: 5555593 - DNA, 20 bp, Homo sapiens
acgccgtaattctttctgtc

SEQ ID NO: 5555594 - DNA, 13 bp, Homo sapiens
acgccgtggagca

SEQ ID NO: 5555595 - DNA, 16 bp, Homo sapiens
acgcctataatcccag

SEQ ID NO: 5555596 - DNA, 17 bp, Homo sapiens
acgcctatgatcccagc

SEQ ID NO: 5555597 - DNA, 18 bp, Homo sapiens
acgcctatgatcccagca

SEQ ID NO: 5555598 - DNA, 14 bp, Homo sapiens
acgcctcctggcca

SEQ ID NO: 5555599 - DNA, 16 bp, Homo sapiens
acgcctcctggccaga

SEQ ID NO: 5555600 - DNA, 14 bp, Homo sapiens
acgcctctccccac

SEQ ID NO: 5555601 - DNA, 15 bp, Homo sapiens
acgcctctccccacc

SEQ ID NO: 5555602 - DNA, 23 bp, Homo sapiens
acgcctctccctaggagaagagt

SEQ ID NO: 5555603 - DNA, 24 bp, Homo sapiens
acgcctcttgaccaggctgcctcc

SEQ ID NO: 5555604 - DNA, 15 bp, Homo sapiens
acgcctgagacagca

SEQ ID NO: 5555605 - DNA, 16 bp, Homo sapiens
acgcctgagacagcac

SEQ ID NO: 5555606 - DNA, 11 bp, Homo sapiens
acgcctgagcc

SEQ ID NO: 5555607 - DNA, 12 bp, Homo sapiens
acgcctgagccc

SEQ ID NO: 5555608 - DNA, 19 bp, Homo sapiens
acgcctgagcccagggagg

SEQ ID NO: 5555609 - DNA, 20 bp, Homo sapiens
acgcctgagcccagggaggc

SEQ ID NO: 5555610 - DNA, 21 bp, Homo sapiens
acgcctgagcccagggaggcc

SEQ ID NO: 5555611 - DNA, 23 bp, Homo sapiens
acgcctgatggtgctgctcaggc

SEQ ID NO: 5555612 - DNA, 14 bp, Homo sapiens
acgcctgcaggaga

SEQ ID NO: 5555613 - DNA, 12 bp, Homo sapiens
acgcctgcaggc

SEQ ID NO: 5555614 - DNA, 18 bp, Homo sapiens
acgcctgcaggctggaga

SEQ ID NO: 5555615 - DNA, 23 bp, Homo sapiens
acgcctgccatcttctccccgag

SEQ ID NO: 5555616 - DNA, 14 bp, Homo sapiens
acgcctgcccagcc

SEQ ID NO: 5555617 - DNA, 16 bp, Homo sapiens
acgcctgcccagcctc

SEQ ID NO: 5555618 - DNA, 19 bp, Homo sapiens
acgcctgccctccccagag

SEQ ID NO: 5555619 - DNA, 17 bp, Homo sapiens
acgcctgccctgcccag

SEQ ID NO: 5555620 - DNA, 12 bp, Homo sapiens
acgcctgccttt

SEQ ID NO: 5555621 - DNA, 20 bp, Homo sapiens
acgcctgcgatggtgctgca

SEQ ID NO: 5555622 - DNA, 12 bp, Homo sapiens
acgcctgcttct

SEQ ID NO: 5555623 - DNA, 12 bp, Homo sapiens
acgcctggaagg

SEQ ID NO: 5555624 - DNA, 11 bp, Homo sapiens
acgcctggcta

SEQ ID NO: 5555625 - DNA, 15 bp, Homo sapiens
acgcctggctccagg

SEQ ID NO: 5555626 - DNA, 17 bp, Homo sapiens
acgcctggctccaggct

SEQ ID NO: 5555627 - DNA, 19 bp, Homo sapiens
acgcctgtaatcccagcac

SEQ ID NO: 5555628 - DNA, 16 bp, Homo sapiens
acgcctgtagtcctag

SEQ ID NO: 5555629 - DNA, 16 bp, Homo sapiens
acgcctgtctgtgtgc

SEQ ID NO: 5555630 - DNA, 23 bp, Homo sapiens
acgcctgtgccaccccttcctca

SEQ ID NO: 5555631 - DNA, 13 bp, Homo sapiens
acgcctgtgtcac

SEQ ID NO: 5555632 - DNA, 16 bp, Homo sapiens
acgcctgttgttttgg

SEQ ID NO: 5555633 - DNA, 17 bp, Homo sapiens
acgccttccaggtcagg

SEQ ID NO: 5555634 - DNA, 18 bp, Homo sapiens
acgccttccaggtcagga

SEQ ID NO: 5555635 - DNA, 20 bp, Homo sapiens
acgccttttcttggttcttt

SEQ ID NO: 5555636 - DNA, 22 bp, Homo sapiens
acgcgacttccacaaacctgga

SEQ ID NO: 5555637 - DNA, 19 bp, Homo sapiens
acgcgaggggaaaggcctg

SEQ ID NO: 5555638 - DNA, 21 bp, Homo sapiens
acgcgaggggaaaggcctgtg

SEQ ID NO: 5555639 - DNA, 12 bp, Homo sapiens
acgcgcacacac

SEQ ID NO: 5555640 - DNA, 19 bp, Homo sapiens
acgcgcagatgtgcagcag

SEQ ID NO: 5555641 - DNA, 22 bp, Homo sapiens
acgcgcagatgtgcagcagatt

SEQ ID NO: 5555642 - DNA, 21 bp, Homo sapiens
acgcgccaccgagtgccttca

SEQ ID NO: 5555643 - DNA, 14 bp, Homo sapiens
acgcgcgcacacac

SEQ ID NO: 5555644 - DNA, 16 bp, Homo sapiens
acgcgcgtcgccgcca

SEQ ID NO: 5555645 - DNA, 18 bp, Homo sapiens
acgcgcttcgacttttct

SEQ ID NO: 5555646 - DNA, 14 bp, Homo sapiens
acgcggccacctca

SEQ ID NO: 5555647 - DNA, 17 bp, Homo sapiens
acgcggcgggaggccca

SEQ ID NO: 5555648 - DNA, 18 bp, Homo sapiens
acgcgggcttctggagct

SEQ ID NO: 5555649 - DNA, 15 bp, Homo sapiens
acgggttggggccgg

SEQ ID NO: 5555650 - DNA, 18 bp, Homo sapiens
acggtaagtgttctcatg

SEQ ID NO: 5555651 - DNA, 16 bp, Homo sapiens
acggtacttggtaaga

SEQ ID NO: 5555652 - DNA, 22 bp, Homo sapiens
acggtagcagccacacttcctt

SEQ ID NO: 5555653 - DNA, 19 bp, Homo sapiens
acggtagtgatgaaattat

SEQ ID NO: 5555654 - DNA, 17 bp, Homo sapiens
acggtatcctccctgcc

SEQ ID NO: 5555655 - DNA, 18 bp, Homo sapiens
acggtattatgcttcttg

SEQ ID NO: 5555656 - DNA, 23 bp, Homo sapiens
acggtcacacctcactgtcatct

SEQ ID NO: 5555657 - DNA, 15 bp, Homo sapiens
acggtcaggtttaac

SEQ ID NO: 5555658 - DNA, 14 bp, Homo sapiens
acggtcatgatgtc

SEQ ID NO: 5555659 - DNA, 19 bp, Homo sapiens
acggtcatgatgtctgcaa

SEQ ID NO: 5555660 - DNA, 18 bp, Homo sapiens
acggtccaatccagcctt

SEQ ID NO: 5555661 - DNA, 17 bp, Homo sapiens
acggtcccccaggaggc

SEQ ID NO: 5555662 - DNA, 21 bp, Homo sapiens
acggtcccccaggaggcagct

SEQ ID NO: 5555663 - DNA, 19 bp, Homo sapiens
acggtcctttaggcagcct

SEQ ID NO: 5555664 - DNA, 22 bp, Homo sapiens
acggtcggggcatctggcctgg

SEQ ID NO: 5555665 - DNA, 13 bp, Homo sapiens
acggtctgagcta

SEQ ID NO: 5555666 - DNA, 21 bp, Homo sapiens
acggtctggaggccgaggacc

SEQ ID NO: 5555667 - DNA, 16 bp, Homo sapiens
acggtctggggaagag

SEQ ID NO: 5555668 - DNA, 20 bp, Homo sapiens
acggtctgttcttgaagcag

SEQ ID NO: 5555669 - DNA, 14 bp, Homo sapiens
acggtcttctgcat

SEQ ID NO: 5555670 - DNA, 18 bp, Homo sapiens
acggtgaaatccaggtct

SEQ ID NO: 5555671 - DNA, 17 bp, Homo sapiens
acggtgacacaggtcag

SEQ ID NO: 5555672 - DNA, 22 bp, Homo sapiens
acggtgaccgcctcctgctctg

SEQ ID NO: 5555673 - DNA, 17 bp, Homo sapiens
acggtgcagtctgggtg

SEQ ID NO: 5555674 - DNA, 20 bp, Homo sapiens
acggtgccaagggccccagg

SEQ ID NO: 5555675 - DNA, 23 bp, Homo sapiens
acggtgccaagggccccaggggc

SEQ ID NO: 5555676 - DNA, 15 bp, Homo sapiens
acggtgcccaagcca

SEQ ID NO: 5555677 - DNA, 18 bp, Homo sapiens
acggtgcccatcctgcca

SEQ ID NO: 5555678 - DNA, 21 bp, Homo sapiens
acggtgccttttttcacggaa

SEQ ID NO: 5555679 - DNA, 15 bp, Homo sapiens
acggtgcgtggctgt

SEQ ID NO: 5555680 - DNA, 13 bp, Homo sapiens
acggtgctaaaaa

SEQ ID NO: 5555681 - DNA, 18 bp, Homo sapiens
acggtgctgtgagggagg

SEQ ID NO: 5555682 - DNA, 22 bp, Homo sapiens
acggtggcggctgcacaacagc

SEQ ID NO: 5555683 - DNA, 17 bp, Homo sapiens
acggtggctcacacctg

SEQ ID NO: 5555684 - DNA, 20 bp, Homo sapiens
acggtgggccttgctgggga

SEQ ID NO: 5555685 - DNA, 21 bp, Homo sapiens
acggtgggccttgctggggac

SEQ ID NO: 5555686 - DNA, 17 bp, Homo sapiens
acggtgtcttgttctgt

SEQ ID NO: 5555687 - DNA, 20 bp, Homo sapiens
acggtgtcttgttctgtcac

SEQ ID NO: 5555688 - DNA, 22 bp, Homo sapiens
acggtgtcttgttctgtcactc

SEQ ID NO: 5555689 - DNA, 19 bp, Homo sapiens
acggtgttaattttgctaa

SEQ ID NO: 5555690 - DNA, 23 bp, Homo sapiens
acggtgttaattttgctaactgg

SEQ ID NO: 5555691 - DNA, 16 bp, Homo sapiens
acggttatttaagcat

SEQ ID NO: 5555692 - DNA, 21 bp, Homo sapiens
acggttcagtttcttctgcgc

SEQ ID NO: 5555693 - DNA, 20 bp, Homo sapiens
acggttcctacacaggacag

SEQ ID NO: 5555694 - DNA, 13 bp, Homo sapiens
acggttcctggtg

SEQ ID NO: 5555695 - DNA, 18 bp, Homo sapiens
acggtttaactgtcccag

SEQ ID NO: 5555696 - DNA, 16 bp, Homo sapiens
acggtttcaaaccagg

SEQ ID NO: 5555697 - DNA, 15 bp, Homo sapiens
acggtttcagctaga

SEQ ID NO: 5555698 - DNA, 16 bp, Homo sapiens
acggtttcagctagac

SEQ ID NO: 5555699 - DNA, 14 bp, Homo sapiens
acggtttccaggga

SEQ ID NO: 5555700 - DNA, 17 bp, Homo sapiens
acggtttccagggaggg

SEQ ID NO: 5555701 - DNA, 14 bp, Homo sapiens
acggtttgtgagag

SEQ ID NO: 5555702 - DNA, 17 bp, Homo sapiens
acggttttactgcagct

SEQ ID NO: 5555703 - DNA, 21 bp, Homo sapiens
acggtttttttctttggctgc

SEQ ID NO: 5555704 - DNA, 23 bp, Homo sapiens
acggtttttttctttggctgcag

SEQ ID NO: 5555705 - DNA, 18 bp, Homo sapiens
acgtaaaatttacagtca

SEQ ID NO: 5555706 - DNA, 22 bp, Homo sapiens
acgtaaagccttgttttctctg

SEQ ID NO: 5555707 - DNA, 22 bp, Homo sapiens
acgtaaatctgttcaaggaatc

SEQ ID NO: 5555708 - DNA, 11 bp, Homo sapiens
acgtaaatgtt

SEQ ID NO: 5555709 - DNA, 14 bp, Homo sapiens
acgtaaatgttttt

SEQ ID NO: 5555710 - DNA, 22 bp, Homo sapiens
acgtaactctttctatgcccgt

SEQ ID NO: 5555711 - DNA, 15 bp, Homo sapiens
acgtaagcactgttt

SEQ ID NO: 5555712 - DNA, 16 bp, Homo sapiens
acgtaatcctcctgag

SEQ ID NO: 5555713 - DNA, 17 bp, Homo sapiens
acgtaatgcattgcctg

SEQ ID NO: 5555714 - DNA, 15 bp, Homo sapiens
acgtaatgtatttat

SEQ ID NO: 5555715 - DNA, 23 bp, Homo sapiens
acgtaatttgttatatcagcaga

SEQ ID NO: 5555716 - DNA, 16 bp, Homo sapiens
acgtacaagtagttct

SEQ ID NO: 5555717 - DNA, 18 bp, Homo sapiens
acgtacaagtagttctgt

SEQ ID NO: 5555718 - DNA, 13 bp, Homo sapiens
acgtacacatttt

SEQ ID NO: 5555719 - DNA, 14 bp, Homo sapiens
acgtacacatttta

SEQ ID NO: 5555720 - DNA, 13 bp, Homo sapiens
acgtacatacaca

SEQ ID NO: 5555721 - DNA, 23 bp, Homo sapiens
acgtaccaagccaccgcagctgc

SEQ ID NO: 5555722 - DNA, 15 bp, Homo sapiens
acgtaccttcatgtg

SEQ ID NO: 5555723 - DNA, 20 bp, Homo sapiens
acgtacgtatcagcggcccc

SEQ ID NO: 5555724 - DNA, 19 bp, Homo sapiens
acgtactacggagaaactc

SEQ ID NO: 5555725 - DNA, 16 bp, Homo sapiens
acgtactcctcagacg

SEQ ID NO: 5555726 - DNA, 14 bp, Homo sapiens
acgtactgtctgat

SEQ ID NO: 5555727 - DNA, 17 bp, Homo sapiens
acgtacttaatttactt

SEQ ID NO: 5555728 - DNA, 16 bp, Homo sapiens
acgtacttagcagcta

SEQ ID NO: 5555729 - DNA, 15 bp, Homo sapiens
acgtagaagctcttg

SEQ ID NO: 5555730 - DNA, 21 bp, Homo sapiens
acgtagactgatggaacagaa

SEQ ID NO: 5555731 - DNA, 13 bp, Homo sapiens
acgtagccacagg

SEQ ID NO: 5555732 - DNA, 21 bp, Homo sapiens
acgtagctatttttatacact

SEQ ID NO: 5555733 - DNA, 22 bp, Homo sapiens
acgtagggggctctgggcggcc

SEQ ID NO: 5555734 - DNA, 18 bp, Homo sapiens
acgtaggttccccagaga

SEQ ID NO: 5555735 - DNA, 22 bp, Homo sapiens
acgtagtgtagatttgttttgt

SEQ ID NO: 5555736 - DNA, 13 bp, Homo sapiens
acgtataaatatc

SEQ ID NO: 5555737 - DNA, 18 bp, Homo sapiens
acgtataaatatcagtat

SEQ ID NO: 5555738 - DNA, 23 bp, Homo sapiens
acgtataaatatcagtattctga

SEQ ID NO: 5555739 - DNA, 15 bp, Homo sapiens
acgtatatataaaca

SEQ ID NO: 5555740 - DNA, 16 bp, Homo sapiens
acgtatattgtatcat

SEQ ID NO: 5555741 - DNA, 17 bp, Homo sapiens
acgtatatttttaactg

SEQ ID NO: 5555742 - DNA, 14 bp, Homo sapiens
acgtatcatttcta

SEQ ID NO: 5555743 - DNA, 19 bp, Homo sapiens
acgtatgaatgatatcttt

SEQ ID NO: 5555744 - DNA, 18 bp, Homo sapiens
acgtatgcaagtctgtga

SEQ ID NO: 5555745 - DNA, 14 bp, Homo sapiens
acgtatgcatgtga

SEQ ID NO: 5555746 - DNA, 15 bp, Homo sapiens
acgtatgcatttttt

SEQ ID NO: 5555747 - DNA, 19 bp, Homo sapiens
acgtatgtaacatgatgtt

SEQ ID NO: 5555748 - DNA, 16 bp, Homo sapiens
acgtatgtatttcatt

SEQ ID NO: 5555749 - DNA, 17 bp, Homo sapiens
acgtatgtctggttctc

SEQ ID NO: 5555750 - DNA, 18 bp, Homo sapiens
acgtatgtctggttctca

SEQ ID NO: 5555751 - DNA, 15 bp, Homo sapiens
acgtatgtgctctta

SEQ ID NO: 5555752 - DNA, 18 bp, Homo sapiens
acgtattagttgccaata

SEQ ID NO: 5555753 - DNA, 14 bp, Homo sapiens
acgtattgctgtgt

SEQ ID NO: 5555754 - DNA, 21 bp, Homo sapiens
acgtattgctgtgtctcctct

SEQ ID NO: 5555755 - DNA, 18 bp, Homo sapiens
acgtattgttaaatgata

SEQ ID NO: 5555756 - DNA, 16 bp, Homo sapiens
acgtatttaatagcaa

SEQ ID NO: 5555757 - DNA, 21 bp, Homo sapiens
acgtatttatatttggaaaga

SEQ ID NO: 5555758 - DNA, 16 bp, Homo sapiens
acgtatttcacagagc

SEQ ID NO: 5555759 - DNA, 17 bp, Homo sapiens
acgtatttctccagacc

SEQ ID NO: 5555760 - DNA, 20 bp, Homo sapiens
acgtatttctccagacccag

SEQ ID NO: 5555761 - DNA, 17 bp, Homo sapiens
acgtcaaacatgaagtg

SEQ ID NO: 5555762 - DNA, 22 bp, Homo sapiens
acgtcaacccaagctctgggga

SEQ ID NO: 5555763 - DNA, 20 bp, Homo sapiens
acgtcaccaaggtggcttct

SEQ ID NO: 5555764 - DNA, 18 bp, Homo sapiens
acgtcacgctccctgact

SEQ ID NO: 5555765 - DNA, 14 bp, Homo sapiens
acgtcactgccaga

SEQ ID NO: 5555766 - DNA, 15 bp, Homo sapiens
acgtcactgccagag

SEQ ID NO: 5555767 - DNA, 19 bp, Homo sapiens
acgtcactttttggccatg

SEQ ID NO: 5555768 - DNA, 15 bp, Homo sapiens
acgtcagatgtttaa

SEQ ID NO: 5555769 - DNA, 15 bp, Homo sapiens
acgtcaggcctggcc

SEQ ID NO: 5555770 - DNA, 16 bp, Homo sapiens
acgtcaggcctggcct

SEQ ID NO: 5555771 - DNA, 17 bp, Homo sapiens
acgtcaggcctggcctc

SEQ ID NO: 5555772 - DNA, 22 bp, Homo sapiens
acgtcataggaagttagccttt

SEQ ID NO: 5555773 - DNA, 21 bp, Homo sapiens
acgtcatcggaggctgggccc

SEQ ID NO: 5555774 - DNA, 14 bp, Homo sapiens
acgtcatctcaggg

SEQ ID NO: 5555775 - DNA, 16 bp, Homo sapiens
acgtcatgtattttat

SEQ ID NO: 5555776 - DNA, 23 bp, Homo sapiens
acgtccaaaggagtgcatggcca

SEQ ID NO: 5555777 - DNA, 19 bp, Homo sapiens
acgtccacccgtttccaag

SEQ ID NO: 5555778 - DNA, 20 bp, Homo sapiens
acgtccaccctgcagccagg

SEQ ID NO: 5555779 - DNA, 14 bp, Homo sapiens
acgtccatctctct

SEQ ID NO: 5555780 - DNA, 19 bp, Homo sapiens
acgtcccacattttagaat

SEQ ID NO: 5555781 - DNA, 17 bp, Homo sapiens
acgtcccaccccacctc

SEQ ID NO: 5555782 - DNA, 21 bp, Homo sapiens
acgtcccaccccacctcttgt

SEQ ID NO: 5555783 - DNA, 19 bp, Homo sapiens
acgtcccagcggcctcagg

SEQ ID NO: 5555784 - DNA, 22 bp, Homo sapiens
acgtcccctccgccgtgccggc

SEQ ID NO: 5555785 - DNA, 15 bp, Homo sapiens
acgtccgcgggtccc

SEQ ID NO: 5555786 - DNA, 14 bp, Homo sapiens
acgtcctatctccc

SEQ ID NO: 5555787 - DNA, 21 bp, Homo sapiens
acgtcctcgaattctcagacg

SEQ ID NO: 5555788 - DNA, 13 bp, Homo sapiens
acgtcctgcctgg

SEQ ID NO: 5555789 - DNA, 14 bp, Homo sapiens
acgtcctgcctggc

SEQ ID NO: 5555790 - DNA, 15 bp, Homo sapiens
acgtcctggaatgaa

SEQ ID NO: 5555791 - DNA, 18 bp, Homo sapiens
acgtcctggaatgaagca

SEQ ID NO: 5555792 - DNA, 21 bp, Homo sapiens
acgtcctggaatgaagcatgt

SEQ ID NO: 5555793 - DNA, 21 bp, Homo sapiens
acgtcctggtctttgtttgag

SEQ ID NO: 5555794 - DNA, 21 bp, Homo sapiens
acgtcctgtcagtgccgccgc

SEQ ID NO: 5555795 - DNA, 23 bp, Homo sapiens
acgtccttccatatccctgccca

SEQ ID NO: 5555796 - DNA, 12 bp, Homo sapiens
acgtccttcctt

SEQ ID NO: 5555797 - DNA, 17 bp, Homo sapiens
acgtccttccttgactg

SEQ ID NO: 5555798 - DNA, 20 bp, Homo sapiens
acgtccttccttgactgtct

SEQ ID NO: 5555799 - DNA, 13 bp, Homo sapiens
acgtccttgggcg

SEQ ID NO: 5555800 - DNA, 19 bp, Homo sapiens
acgtcggccgaccaggctg

SEQ ID NO: 5555801 - DNA, 11 bp, Homo sapiens
acgtctagcct

SEQ ID NO: 5555802 - DNA, 19 bp, Homo sapiens
acgtctagctatgctgtat

SEQ ID NO: 5555803 - DNA, 21 bp, Homo sapiens
acgtctatttcatcagaacag

SEQ ID NO: 5555804 - DNA, 18 bp, Homo sapiens
acgtctcaggttattcgt

SEQ ID NO: 5555805 - DNA, 18 bp, Homo sapiens
acgtctccccttctctgc

SEQ ID NO: 5555806 - DNA, 12 bp, Homo sapiens
acgtctcctcct

SEQ ID NO: 5555807 - DNA, 13 bp, Homo sapiens
acgtctcctgctg

SEQ ID NO: 5555808 - DNA, 15 bp, Homo sapiens
acgtctcctgctgcg

SEQ ID NO: 5555809 - DNA, 12 bp, Homo sapiens
acgtctctctgc

SEQ ID NO: 5555810 - DNA, 16 bp, Homo sapiens
acgtctctttttggta

SEQ ID NO: 5555811 - DNA, 14 bp, Homo sapiens
acgtctgacaggca

SEQ ID NO: 5555812 - DNA, 12 bp, Homo sapiens
acgtctgccacc

SEQ ID NO: 5555813 - DNA, 13 bp, Homo sapiens
acgtctgccaggc

SEQ ID NO: 5555814 - DNA, 19 bp, Homo sapiens
acgtctgccaggcccatct

SEQ ID NO: 5555815 - DNA, 20 bp, Homo sapiens
acgtctgccaggcccatctc

SEQ ID NO: 5555816 - DNA, 22 bp, Homo sapiens
acgtctgccaggggtaacctgg

SEQ ID NO: 5555817 - DNA, 18 bp, Homo sapiens
acgtctggactgctattc

SEQ ID NO: 5555818 - DNA, 16 bp, Homo sapiens
acgtctggccaggcac

SEQ ID NO: 5555819 - DNA, 14 bp, Homo sapiens
acgtctggccctgg

SEQ ID NO: 5555820 - DNA, 19 bp, Homo sapiens
acgtctggcctacagaatg

SEQ ID NO: 5555821 - DNA, 16 bp, Homo sapiens
acgtctgtaagctgaa

SEQ ID NO: 5555822 - DNA, 15 bp, Homo sapiens
acgtctgtcttcaca

SEQ ID NO: 5555823 - DNA, 19 bp, Homo sapiens
acgtctgtcttcacagctc

SEQ ID NO: 5555824 - DNA, 18 bp, Homo sapiens
acgtctgtgacttatcta

SEQ ID NO: 5555825 - DNA, 16 bp, Homo sapiens
acgtctgtgagtctgt

SEQ ID NO: 5555826 - DNA, 14 bp, Homo sapiens
actaaatttgggga

SEQ ID NO: 5555827 - DNA, 21 bp, Homo sapiens
actaaatttggggacagattc

SEQ ID NO: 5555828 - DNA, 17 bp, Homo sapiens
actaaatttgtctttca

SEQ ID NO: 5555829 - DNA, 16 bp, Homo sapiens
actaaattttctttta

SEQ ID NO: 5555830 - DNA, 21 bp, Homo sapiens
actaaattttcttttaagcat

SEQ ID NO: 5555831 - DNA, 15 bp, Homo sapiens
actaaatttttcata

SEQ ID NO: 5555832 - DNA, 20 bp, Homo sapiens
actaacaaaatttgaataat

SEQ ID NO: 5555833 - DNA, 16 bp, Homo sapiens
actaacaaaggcagct

SEQ ID NO: 5555834 - DNA, 18 bp, Homo sapiens
actaacaaccaaagacta

SEQ ID NO: 5555835 - DNA, 14 bp, Homo sapiens
actaacaagaatgt

SEQ ID NO: 5555836 - DNA, 14 bp, Homo sapiens
actaacaatgcctt

SEQ ID NO: 5555837 - DNA, 21 bp, Homo sapiens
actaacaatgccttgttgtat

SEQ ID NO: 5555838 - DNA, 14 bp, Homo sapiens
actaacacaaggac

SEQ ID NO: 5555839 - DNA, 15 bp, Homo sapiens
actaacacaaggaca

SEQ ID NO: 5555840 - DNA, 15 bp, Homo sapiens
actaacactatttta

SEQ ID NO: 5555841 - DNA, 22 bp, Homo sapiens
actaacactattttatgcaaat

SEQ ID NO: 5555842 - DNA, 18 bp, Homo sapiens
actaacagattataataa

SEQ ID NO: 5555843 - DNA, 21 bp, Homo sapiens
actaacagattataataaatt

SEQ ID NO: 5555844 - DNA, 18 bp, Homo sapiens
actaacagctacaaactt

SEQ ID NO: 5555845 - DNA, 19 bp, Homo sapiens
actaacagctacaaacttt

SEQ ID NO: 5555846 - DNA, 12 bp, Homo sapiens
actaacaggctt

SEQ ID NO: 5555847 - DNA, 18 bp, Homo sapiens
actaacaggcttagtgat

SEQ ID NO: 5555848 - DNA, 15 bp, Homo sapiens
actaacagtaactgc

SEQ ID NO: 5555849 - DNA, 21 bp, Homo sapiens
actaacataaagaaacacttt

SEQ ID NO: 5555850 - DNA, 23 bp, Homo sapiens
actaacataaagaaacactttct

SEQ ID NO: 5555851 - DNA, 17 bp, Homo sapiens
actaacatgtcctgcct

SEQ ID NO: 5555852 - DNA, 12 bp, Homo sapiens
actaacatttcc

SEQ ID NO: 5555853 - DNA, 18 bp, Homo sapiens
actaaccaagctgagttt

SEQ ID NO: 5555854 - DNA, 22 bp, Homo sapiens
actaaccaagctgagtttccta

SEQ ID NO: 5555855 - DNA, 13 bp, Homo sapiens
actaaccacgctg

SEQ ID NO: 5555856 - DNA, 16 bp, Homo sapiens
actaaccagcagaaat

SEQ ID NO: 5555857 - DNA, 19 bp, Homo sapiens
actaaccatccccaactcc

SEQ ID NO: 5555858 - DNA, 11 bp, Homo sapiens
actaaccattt

SEQ ID NO: 5555859 - DNA, 14 bp, Homo sapiens
actaacccagtctt

SEQ ID NO: 5555860 - DNA, 21 bp, Homo sapiens
actaacccagtctttcttcac

SEQ ID NO: 5555861 - DNA, 14 bp, Homo sapiens
actaaccccgggcg

SEQ ID NO: 5555862 - DNA, 15 bp, Homo sapiens
actaacctgacatca

SEQ ID NO: 5555863 - DNA, 13 bp, Homo sapiens
actaacctgaccg

SEQ ID NO: 5555864 - DNA, 13 bp, Homo sapiens
actaacctggaga

SEQ ID NO: 5555865 - DNA, 21 bp, Homo sapiens
actaaccttgagtcagaaaac

SEQ ID NO: 5555866 - DNA, 22 bp, Homo sapiens
actaaccttgcctggtacagta

SEQ ID NO: 5555867 - DNA, 13 bp, Homo sapiens
actaaccttttat

SEQ ID NO: 5555868 - DNA, 22 bp, Homo sapiens
actaacgaaatatcaaagtcat

SEQ ID NO: 5555869 - DNA, 20 bp, Homo sapiens
actaacgaacgttttaaagc

SEQ ID NO: 5555870 - DNA, 22 bp, Homo sapiens
actaacgaccgacgcccctccg

SEQ ID NO: 5555871 - DNA, 22 bp, Homo sapiens
actaactaaaacaaagccactt

SEQ ID NO: 5555872 - DNA, 22 bp, Homo sapiens
actaactaaccacattttagga

SEQ ID NO: 5555873 - DNA, 20 bp, Homo sapiens
actaactaataaaatatata

SEQ ID NO: 5555874 - DNA, 17 bp, Homo sapiens
actaactatcaaataga

SEQ ID NO: 5555875 - DNA, 23 bp, Homo sapiens
actaactatgcatggtgccccag

SEQ ID NO: 5555876 - DNA, 15 bp, Homo sapiens
actaactcaaataca

SEQ ID NO: 5555877 - DNA, 18 bp, Homo sapiens
actaactcaaatacacat

SEQ ID NO: 5555878 - DNA, 20 bp, Homo sapiens
actaactccaggattcagga

SEQ ID NO: 5555879 - DNA, 11 bp, Homo sapiens
actaactgagg

SEQ ID NO: 5555880 - DNA, 19 bp, Homo sapiens
actaactgctgattttgac

SEQ ID NO: 5555881 - DNA, 20 bp, Homo sapiens
actaactgctggtttttaaa

SEQ ID NO: 5555882 - DNA, 13 bp, Homo sapiens
actaacttactgt

SEQ ID NO: 5555883 - DNA, 18 bp, Homo sapiens
actaacttctaaaactgt

SEQ ID NO: 5555884 - DNA, 22 bp, Homo sapiens
actaacttctaaaactgtactt

SEQ ID NO: 5555885 - DNA, 15 bp, Homo sapiens
actaacttctaaaga

SEQ ID NO: 5555886 - DNA, 16 bp, Homo sapiens
actaacttctaaagaa

SEQ ID NO: 5555887 - DNA, 13 bp, Homo sapiens
actaactttggtc

SEQ ID NO: 5555888 - DNA, 15 bp, Homo sapiens
actaactttttgaat

SEQ ID NO: 5555889 - DNA, 23 bp, Homo sapiens
actaacttttttttttttaacat

SEQ ID NO: 5555890 - DNA, 14 bp, Homo sapiens
actaagaaaagata

SEQ ID NO: 5555891 - DNA, 17 bp, Homo sapiens
actaagaaacttttgta

SEQ ID NO: 5555892 - DNA, 19 bp, Homo sapiens
actaagaaacttttgtaaa

SEQ ID NO: 5555893 - DNA, 13 bp, Homo sapiens
actaagaaagaaa

SEQ ID NO: 5555894 - DNA, 19 bp, Homo sapiens
actaagaaagaaaggaaag

SEQ ID NO: 5555895 - DNA, 23 bp, Homo sapiens
actaagaaagaaaggaaagaagg

SEQ ID NO: 5555896 - DNA, 17 bp, Homo sapiens
actaagaaatattccaa

SEQ ID NO: 5555897 - DNA, 13 bp, Homo sapiens
actaagaagaaaa

SEQ ID NO: 5555898 - DNA, 17 bp, Homo sapiens
actaagaaggaaaagaa

SEQ ID NO: 5555899 - DNA, 20 bp, Homo sapiens
actaagaataaataaagaag

SEQ ID NO: 5555900 - DNA, 15 bp, Homo sapiens
actaagaatataaat

SEQ ID NO: 5555901 - DNA, 16 bp, Homo sapiens
actaagaattcaaact

SEQ ID NO: 5555902 - DNA, 18 bp, Homo sapiens
actaagaccctggtctga

SEQ ID NO: 5555903 - DNA, 16 bp, Homo sapiens
actaagactcccgccc

SEQ ID NO: 5555904 - DNA, 20 bp, Homo sapiens
actaagagaaaattgcacta

SEQ ID NO: 5555905 - DNA, 22 bp, Homo sapiens
actaagagaaaattgcactaaa

SEQ ID NO: 5555906 - DNA, 15 bp, Homo sapiens
actaagagaaactgt

SEQ ID NO: 5555907 - DNA, 19 bp, Homo sapiens
actaagagaaactgtgtat

SEQ ID NO: 5555908 - DNA, 16 bp, Homo sapiens
actaagagaagttgta

SEQ ID NO: 5555909 - DNA, 17 bp, Homo sapiens
actaagagattcttcta

SEQ ID NO: 5555910 - DNA, 24 bp, Homo sapiens
actaagagctttatatattgatta

SEQ ID NO: 5555911 - DNA, 21 bp, Homo sapiens
actaagaggaaagtacatttt

SEQ ID NO: 5555912 - DNA, 18 bp, Homo sapiens
actaagaggctatttaaa

SEQ ID NO: 5555913 - DNA, 18 bp, Homo sapiens
actaagaggggctggacc

SEQ ID NO: 5555914 - DNA, 21 bp, Homo sapiens
actaagaggggctggacctgg

SEQ ID NO: 5555915 - DNA, 17 bp, Homo sapiens
actaagagtaaagcaac

SEQ ID NO: 5555916 - DNA, 22 bp, Homo sapiens
actaagatctgttaaaaaagaa

SEQ ID NO: 5555917 - DNA, 21 bp, Homo sapiens
actaagatgaaatgcactgta

SEQ ID NO: 5555918 - DNA, 15 bp, Homo sapiens
actaagatgaaattg

SEQ ID NO: 5555919 - DNA, 19 bp, Homo sapiens
actaagatgacattgctaa

SEQ ID NO: 5555920 - DNA, 20 bp, Homo sapiens
actaagatgacattgctaag

SEQ ID NO: 5555921 - DNA, 18 bp, Homo sapiens
actaagatgttcactgtg

SEQ ID NO: 5555922 - DNA, 19 bp, Homo sapiens
actaagcacattatgtttg

SEQ ID NO: 5555923 - DNA, 13 bp, Homo sapiens
actaagccaagct

SEQ ID NO: 5555924 - DNA, 21 bp, Homo sapiens
actaagccaggcctggctgga

SEQ ID NO: 5555925 - DNA, 18 bp, Homo sapiens
actaagcctacctgctct

SEQ ID NO: 5555926 - DNA, 17 bp, Homo sapiens
actaagctttctccttt

SEQ ID NO: 5555927 - DNA, 21 bp, Homo sapiens
actaagctttgccagctgctg

SEQ ID NO: 5555928 - DNA, 20 bp, Homo sapiens
actaaggagtaatctgtgta

SEQ ID NO: 5555929 - DNA, 16 bp, Homo sapiens
actaaggatttttcaa

SEQ ID NO: 5555930 - DNA, 14 bp, Homo sapiens
actaaggcaggtgg

SEQ ID NO: 5555931 - DNA, 19 bp, Homo sapiens
actaaggcaggtgggcaga

SEQ ID NO: 5555932 - DNA, 15 bp, Homo sapiens
actaaggccttttat

SEQ ID NO: 5555933 - DNA, 15 bp, Homo sapiens
actaaggctgcttca

SEQ ID NO: 5555934 - DNA, 16 bp, Homo sapiens
actaaggcttttattt

SEQ ID NO: 5555935 - DNA, 17 bp, Homo sapiens
actaaggggcagctcct

SEQ ID NO: 5555936 - DNA, 18 bp, Homo sapiens
actaaggggcagctcctg

SEQ ID NO: 5555937 - DNA, 20 bp, Homo sapiens
actaaggggcagctcctgac

SEQ ID NO: 5555938 - DNA, 22 bp, Homo sapiens
actaaggggcagctcctgacca

SEQ ID NO: 5555939 - DNA, 17 bp, Homo sapiens
actaagggtggagagtt

SEQ ID NO: 5555940 - DNA, 22 bp, Homo sapiens
actaaggtacggtgagactctg

SEQ ID NO: 5555941 - DNA, 15 bp, Homo sapiens
actaaggtgaagaat

SEQ ID NO: 5555942 - DNA, 18 bp, Homo sapiens
actaaggtgaagaatctt

SEQ ID NO: 5555943 - DNA, 21 bp, Homo sapiens
actaaggtgactcgagtgttt

SEQ ID NO: 5555944 - DNA, 23 bp, Homo sapiens
actaagtaacctctacaggcatt

SEQ ID NO: 5555945 - DNA, 18 bp, Homo sapiens
actaagtaagaaacacaa

SEQ ID NO: 5555946 - DNA, 20 bp, Homo sapiens
actaagtaatctcacagcat

SEQ ID NO: 5555947 - DNA, 21 bp, Homo sapiens
actaagtcaggagtgtagttg

SEQ ID NO: 5555948 - DNA, 17 bp, Homo sapiens
actaagtcatggtcctg

SEQ ID NO: 5555949 - DNA, 21 bp, Homo sapiens
actaagtcatggtcctggctg

SEQ ID NO: 5555950 - DNA, 15 bp, Homo sapiens
actaagtctctagcc

SEQ ID NO: 5555951 - DNA, 15 bp, Homo sapiens
actaagtctcttttt

SEQ ID NO: 5555952 - DNA, 18 bp, Homo sapiens
actaagtctcttttttac

SEQ ID NO: 5555953 - DNA, 19 bp, Homo sapiens
actaagtctcttttttaca

SEQ ID NO: 5555954 - DNA, 21 bp, Homo sapiens
actaagttaataataatgact

SEQ ID NO: 5555955 - DNA, 17 bp, Homo sapiens
actaagttatagtatat

SEQ ID NO: 5555956 - DNA, 21 bp, Homo sapiens
actaagttattgctgcataaa

SEQ ID NO: 5555957 - DNA, 22 bp, Homo sapiens
actaagttattttatgacatga

SEQ ID NO: 5555958 - DNA, 18 bp, Homo sapiens
actaagttgcaagatctt

SEQ ID NO: 5555959 - DNA, 22 bp, Homo sapiens
actaagttgctaacctcaattt

SEQ ID NO: 5555960 - DNA, 20 bp, Homo sapiens
actaagtttacttctcgaat

SEQ ID NO: 5555961 - DNA, 13 bp, Homo sapiens
actaagtttcctt

SEQ ID NO: 5555962 - DNA, 22 bp, Homo sapiens
actaagtttttatggcttttgt

SEQ ID NO: 5555963 - DNA, 23 bp, Homo sapiens
actaataaaaaactgtgaaccct

SEQ ID NO: 5555964 - DNA, 12 bp, Homo sapiens
actaataaaaag

SEQ ID NO: 5555965 - DNA, 15 bp, Homo sapiens
actaataaaaaggtt

SEQ ID NO: 5555966 - DNA, 17 bp, Homo sapiens
actaataaaaaggttta

SEQ ID NO: 5555967 - DNA, 22 bp, Homo sapiens
actaataaaaaggtttaatttt

SEQ ID NO: 5555968 - DNA, 15 bp, Homo sapiens
actaataaaatacat

SEQ ID NO: 5555969 - DNA, 16 bp, Homo sapiens
actaataaaatatttt

SEQ ID NO: 5555970 - DNA, 20 bp, Homo sapiens
actaataaaatattttctgt

SEQ ID NO: 5555971 - DNA, 12 bp, Homo sapiens
actaataaaatg

SEQ ID NO: 5555972 - DNA, 15 bp, Homo sapiens
actaataaaatgtga

SEQ ID NO: 5555973 - DNA, 12 bp, Homo sapiens
actaataaacca

SEQ ID NO: 5555974 - DNA, 13 bp, Homo sapiens
actaataaaccag

SEQ ID NO: 5555975 - DNA, 14 bp, Homo sapiens
actaataaaccagt

SEQ ID NO: 5555976 - DNA, 14 bp, Homo sapiens
actaataaagtgcc

SEQ ID NO: 5555977 - DNA, 14 bp, Homo sapiens
actaataaatacat

SEQ ID NO: 5555978 - DNA, 15 bp, Homo sapiens
actaataaatacata

SEQ ID NO: 5555979 - DNA, 18 bp, Homo sapiens
actaataaatataattta

SEQ ID NO: 5555980 - DNA, 11 bp, Homo sapiens
actaataattg

SEQ ID NO: 5555981 - DNA, 13 bp, Homo sapiens
actaataattgca

SEQ ID NO: 5555982 - DNA, 23 bp, Homo sapiens
actaatacgtgccagatataact

SEQ ID NO: 5555983 - DNA, 15 bp, Homo sapiens
actaatagaacttgt

SEQ ID NO: 5555984 - DNA, 14 bp, Homo sapiens
actaatagagacac

SEQ ID NO: 5555985 - DNA, 19 bp, Homo sapiens
actaatagagacacagaga

SEQ ID NO: 5555986 - DNA, 15 bp, Homo sapiens
actaatagagtactt

SEQ ID NO: 5555987 - DNA, 21 bp, Homo sapiens
actaatagagtacttaatata

SEQ ID NO: 5555988 - DNA, 17 bp, Homo sapiens
actaatagcctaaaaga

SEQ ID NO: 5555989 - DNA, 14 bp, Homo sapiens
actaataggtctgg

SEQ ID NO: 5555990 - DNA, 21 bp, Homo sapiens
actaatagtaacaggccttga

SEQ ID NO: 5555991 - DNA, 13 bp, Homo sapiens
actaatagtttgt

SEQ ID NO: 5555992 - DNA, 16 bp, Homo sapiens
actaatagtttgttga

SEQ ID NO: 5555993 - DNA, 21 bp, Homo sapiens
actaatataacttgaaaattt

SEQ ID NO: 5555994 - DNA, 11 bp, Homo sapiens
actaatatata

SEQ ID NO: 5555995 - DNA, 15 bp, Homo sapiens
actaatatatatttt

SEQ ID NO: 5555996 - DNA, 12 bp, Homo sapiens
actaatatatct

SEQ ID NO: 5555997 - DNA, 15 bp, Homo sapiens
actaatatatggacc

SEQ ID NO: 5555998 - DNA, 19 bp, Homo sapiens
actaatatatttaaaaata

SEQ ID NO: 5555999 - DNA, 20 bp, Homo sapiens
actaatatatttaaaaataa

SEQ ID NO: 5556000 - DNA, 22 bp, Homo sapiens
actaatatggttttgttttcaa

SEQ ID NO: 5556001 - DNA, 22 bp, Homo sapiens
actaatatttgtctgtgtgcta

SEQ ID NO: 5556002 - DNA, 23 bp, Homo sapiens
actaatatttgtctgtgtgctac

SEQ ID NO: 5556003 - DNA, 24 bp, Homo sapiens
actagctggaattttttattcttg

SEQ ID NO: 5556004 - DNA, 12 bp, Homo sapiens
actaggaaaatc

SEQ ID NO: 5556005 - DNA, 18 bp, Homo sapiens
actaggaaatccattcac

SEQ ID NO: 5556006 - DNA, 10 bp, Homo sapiens
actaggaatt

SEQ ID NO: 5556007 - DNA, 19 bp, Homo sapiens
actaggaatttttttcagt

SEQ ID NO: 5556008 - DNA, 14 bp, Homo sapiens
actaggacctcata

SEQ ID NO: 5556009 - DNA, 18 bp, Homo sapiens
actaggagaccagaagtg

SEQ ID NO: 5556010 - DNA, 22 bp, Homo sapiens
actaggagctttgactcaggag

SEQ ID NO: 5556011 - DNA, 23 bp, Homo sapiens
actaggagctttgactcaggagc

SEQ ID NO: 5556012 - DNA, 16 bp, Homo sapiens
actaggaggaaaagac

SEQ ID NO: 5556013 - DNA, 23 bp, Homo sapiens
actaggaggttccggtgtctgga

SEQ ID NO: 5556014 - DNA, 16 bp, Homo sapiens
actaggattgacattc

SEQ ID NO: 5556015 - DNA, 23 bp, Homo sapiens
actaggattggagtatgatttac

SEQ ID NO: 5556016 - DNA, 21 bp, Homo sapiens
actaggcagttagagatgcct

SEQ ID NO: 5556017 - DNA, 21 bp, Homo sapiens
actaggcatgtcagaggaccc

SEQ ID NO: 5556018 - DNA, 23 bp, Homo sapiens
actaggcatttgtaaatattaaa

SEQ ID NO: 5556019 - DNA, 19 bp, Homo sapiens
actaggccctggtctggct

SEQ ID NO: 5556020 - DNA, 23 bp, Homo sapiens
actaggcctgaaatgacatttca

SEQ ID NO: 5556021 - DNA, 14 bp, Homo sapiens
actaggctgggtgc

SEQ ID NO: 5556022 - DNA, 23 bp, Homo sapiens
actaggctgggtgcccacagccc

SEQ ID NO: 5556023 - DNA, 16 bp, Homo sapiens
actagggacctgggga

SEQ ID NO: 5556024 - DNA, 14 bp, Homo sapiens
actagggagccatg

SEQ ID NO: 5556025 - DNA, 19 bp, Homo sapiens
actagggagccatttgaga

SEQ ID NO: 5556026 - DNA, 16 bp, Homo sapiens
actagggaggctgagg

SEQ ID NO: 5556027 - DNA, 18 bp, Homo sapiens
actagggaggctgaggca

SEQ ID NO: 5556028 - DNA, 18 bp, Homo sapiens
actagggattcaggctgc

SEQ ID NO: 5556029 - DNA, 19 bp, Homo sapiens
actagggattcaggctgct

SEQ ID NO: 5556030 - DNA, 21 bp, Homo sapiens
actagggattcaggctgcttg

SEQ ID NO: 5556031 - DNA, 19 bp, Homo sapiens
actagggctgaggggcctg

SEQ ID NO: 5556032 - DNA, 19 bp, Homo sapiens
actaggggaggagagaggg

SEQ ID NO: 5556033 - DNA, 13 bp, Homo sapiens
actaggtaaaatt

SEQ ID NO: 5556034 - DNA, 16 bp, Homo sapiens
actaggtaacttcata

SEQ ID NO: 5556035 - DNA, 19 bp, Homo sapiens
actaggtaatgttttgtat

SEQ ID NO: 5556036 - DNA, 20 bp, Homo sapiens
actaggtaggcttctacctg

SEQ ID NO: 5556037 - DNA, 21 bp, Homo sapiens
actaggtattgtctactctga

SEQ ID NO: 5556038 - DNA, 19 bp, Homo sapiens
actaggtatttaagactga

SEQ ID NO: 5556039 - DNA, 23 bp, Homo sapiens
actaggtatttctaacgccagca

SEQ ID NO: 5556040 - DNA, 19 bp, Homo sapiens
actaggtgctgcagcccct

SEQ ID NO: 5556041 - DNA, 13 bp, Homo sapiens
actaggtgctggc

SEQ ID NO: 5556042 - DNA, 16 bp, Homo sapiens
actaggtgctggcatg

SEQ ID NO: 5556043 - DNA, 23 bp, Homo sapiens
actaggtgctggcatgtctgggt

SEQ ID NO: 5556044 - DNA, 14 bp, Homo sapiens
actaggtgtcccca

SEQ ID NO: 5556045 - DNA, 15 bp, Homo sapiens
actaggtgtccccaa

SEQ ID NO: 5556046 - DNA, 19 bp, Homo sapiens
actaggtgtccccaacgtc

SEQ ID NO: 5556047 - DNA, 16 bp, Homo sapiens
actaggttcaattccc

SEQ ID NO: 5556048 - DNA, 18 bp, Homo sapiens
actaggttggacagcccc

SEQ ID NO: 5556049 - DNA, 16 bp, Homo sapiens
actaggtttttgcttc

SEQ ID NO: 5556050 - DNA, 19 bp, Homo sapiens
actagtaagtaattatgca

SEQ ID NO: 5556051 - DNA, 22 bp, Homo sapiens
actagtaatgggccaattaaaa

SEQ ID NO: 5556052 - DNA, 13 bp, Homo sapiens
actagtacaaatt

SEQ ID NO: 5556053 - DNA, 15 bp, Homo sapiens
actagtactatttct

SEQ ID NO: 5556054 - DNA, 22 bp, Homo sapiens
actagtactgtgtactgtatag

SEQ ID NO: 5556055 - DNA, 23 bp, Homo sapiens
actagtactgtgtactgtataga

SEQ ID NO: 5556056 - DNA, 16 bp, Homo sapiens
actagtagctgttttg

SEQ ID NO: 5556057 - DNA, 22 bp, Homo sapiens
actagtatcactgctttttcct

SEQ ID NO: 5556058 - DNA, 12 bp, Homo sapiens
actagtatcaga

SEQ ID NO: 5556059 - DNA, 16 bp, Homo sapiens
actagtatcattttag

SEQ ID NO: 5556060 - DNA, 20 bp, Homo sapiens
actagtatctctggcctcct

SEQ ID NO: 5556061 - DNA, 19 bp, Homo sapiens
actagtattgtccatatca

SEQ ID NO: 5556062 - DNA, 20 bp, Homo sapiens
actagtatttctatgaaata

SEQ ID NO: 5556063 - DNA, 16 bp, Homo sapiens
actagtatttgttgag

SEQ ID NO: 5556064 - DNA, 20 bp, Homo sapiens
actagtcaaacaaaaaagaa

SEQ ID NO: 5556065 - DNA, 14 bp, Homo sapiens
actagtcaagaaaa

SEQ ID NO: 5556066 - DNA, 21 bp, Homo sapiens
actagtcaagagaagtacaga

SEQ ID NO: 5556067 - DNA, 14 bp, Homo sapiens
actagtcacctggg

SEQ ID NO: 5556068 - DNA, 23 bp, Homo sapiens
actagtctacttcttaaaattca

SEQ ID NO: 5556069 - DNA, 13 bp, Homo sapiens
actagtctgtgta

SEQ ID NO: 5556070 - DNA, 16 bp, Homo sapiens
actagtgaacaattcg

SEQ ID NO: 5556071 - DNA, 23 bp, Homo sapiens
actagtgacaagctcctggtctt

SEQ ID NO: 5556072 - DNA, 14 bp, Homo sapiens
actagtgacagctt

SEQ ID NO: 5556073 - DNA, 16 bp, Homo sapiens
actagtgacagcttgt

SEQ ID NO: 5556074 - DNA, 18 bp, Homo sapiens
actagtgagtcagcacct

SEQ ID NO: 5556075 - DNA, 17 bp, Homo sapiens
actagtgcaattccaag

SEQ ID NO: 5556076 - DNA, 13 bp, Homo sapiens
actagtgcctaga

SEQ ID NO: 5556077 - DNA, 17 bp, Homo sapiens
actagtgctgaagctta

SEQ ID NO: 5556078 - DNA, 18 bp, Homo sapiens
actagtgctgaagcttat

SEQ ID NO: 5556079 - DNA, 19 bp, Homo sapiens
actagtggaaagtcaggct

SEQ ID NO: 5556080 - DNA, 11 bp, Homo sapiens
actagtggcaa

SEQ ID NO: 5556081 - DNA, 22 bp, Homo sapiens
actagtgtccgcataagaaaaa

SEQ ID NO: 5556082 - DNA, 23 bp, Homo sapiens
actagtgtccgcataagaaaaag

SEQ ID NO: 5556083 - DNA, 19 bp, Homo sapiens
actagtgtggtgtgtttgc

SEQ ID NO: 5556084 - DNA, 20 bp, Homo sapiens
actagtgtggtgtgtttgct

SEQ ID NO: 5556085 - DNA, 16 bp, Homo sapiens
actagtgtttaagtca

SEQ ID NO: 5556086 - DNA, 22 bp, Homo sapiens
actagtgtttctgcagaggcag

SEQ ID NO: 5556087 - DNA, 18 bp, Homo sapiens
actagttacacatcttca

SEQ ID NO: 5556088 - DNA, 22 bp, Homo sapiens
actagttacacatcttcaacag

SEQ ID NO: 5556089 - DNA, 19 bp, Homo sapiens
actagttcagaggaagcac

SEQ ID NO: 5556090 - DNA, 23 bp, Homo sapiens
actagttgtctgaattgagaaaa

SEQ ID NO: 5556091 - DNA, 20 bp, Homo sapiens
actagttgtgaccttagtgt

SEQ ID NO: 5556092 - DNA, 21 bp, Homo sapiens
actagttgtgaccttagtgtt

SEQ ID NO: 5556093 - DNA, 17 bp, Homo sapiens
actagtttatgctacct

SEQ ID NO: 5556094 - DNA, 15 bp, Homo sapiens
actagtttccagtgg

SEQ ID NO: 5556095 - DNA, 17 bp, Homo sapiens
actagtttgattattat

SEQ ID NO: 5556096 - DNA, 20 bp, Homo sapiens
actagtttgttattaatcca

SEQ ID NO: 5556097 - DNA, 14 bp, Homo sapiens
actataaaacaaaa

SEQ ID NO: 5556098 - DNA, 15 bp, Homo sapiens
actataaaacaaaaa

SEQ ID NO: 5556099 - DNA, 13 bp, Homo sapiens
actataaaatctg

SEQ ID NO: 5556100 - DNA, 13 bp, Homo sapiens
actataaaatgca

SEQ ID NO: 5556101 - DNA, 13 bp, Homo sapiens
actataaacatta

SEQ ID NO: 5556102 - DNA, 20 bp, Homo sapiens
actataaacattaaaagaag

SEQ ID NO: 5556103 - DNA, 17 bp, Homo sapiens
actataaactactgtaa

SEQ ID NO: 5556104 - DNA, 18 bp, Homo sapiens
actataaacttaagggca

SEQ ID NO: 5556105 - DNA, 20 bp, Homo sapiens
actataaacttaagggcaag

SEQ ID NO: 5556106 - DNA, 13 bp, Homo sapiens
actataaagagaa

SEQ ID NO: 5556107 - DNA, 18 bp, Homo sapiens
actataaaggttgacaat

SEQ ID NO: 5556108 - DNA, 20 bp, Homo sapiens
actataaagttttatttgaa

SEQ ID NO: 5556109 - DNA, 21 bp, Homo sapiens
actataaataaaaacttattt

SEQ ID NO: 5556110 - DNA, 14 bp, Homo sapiens
actataaatatatt

SEQ ID NO: 5556111 - DNA, 13 bp, Homo sapiens
actataacaaaat

SEQ ID NO: 5556112 - DNA, 13 bp, Homo sapiens
actataacattat

SEQ ID NO: 5556113 - DNA, 16 bp, Homo sapiens
actataacattatata

SEQ ID NO: 5556114 - DNA, 20 bp, Homo sapiens
actataacattatataacaa

SEQ ID NO: 5556115 - DNA, 15 bp, Homo sapiens
actataacattcaat

SEQ ID NO: 5556116 - DNA, 19 bp, Homo sapiens
actataaccatcagttact

SEQ ID NO: 5556117 - DNA, 19 bp, Homo sapiens
actataagaactttgagct

SEQ ID NO: 5556118 - DNA, 16 bp, Homo sapiens
actataagactataaa

SEQ ID NO: 5556119 - DNA, 18 bp, Homo sapiens
actataagactataaata

SEQ ID NO: 5556120 - DNA, 18 bp, Homo sapiens
actataagatacaataaa

SEQ ID NO: 5556121 - DNA, 20 bp, Homo sapiens
actataagcaagaaggcaaa

SEQ ID NO: 5556122 - DNA, 16 bp, Homo sapiens
actataaggtgcctca

SEQ ID NO: 5556123 - DNA, 21 bp, Homo sapiens
actataagtagttggtttgta

SEQ ID NO: 5556124 - DNA, 12 bp, Homo sapiens
actataatcaaa

SEQ ID NO: 5556125 - DNA, 16 bp, Homo sapiens
actataatcaaatgat

SEQ ID NO: 5556126 - DNA, 17 bp, Homo sapiens
actataatcaaatgatt

SEQ ID NO: 5556127 - DNA, 18 bp, Homo sapiens
actataatcaaatgattt

SEQ ID NO: 5556128 - DNA, 13 bp, Homo sapiens
actataatgtaag

SEQ ID NO: 5556129 - DNA, 15 bp, Homo sapiens
actataatgtgaaat

SEQ ID NO: 5556130 - DNA, 21 bp, Homo sapiens
actataatgtgaaatgtaact

SEQ ID NO: 5556131 - DNA, 21 bp, Homo sapiens
actataattgtaaatattttg

SEQ ID NO: 5556132 - DNA, 22 bp, Homo sapiens
actataattgtaaatattttga

SEQ ID NO: 5556133 - DNA, 15 bp, Homo sapiens
actatacaattcagt

SEQ ID NO: 5556134 - DNA, 14 bp, Homo sapiens
actatacagccata

SEQ ID NO: 5556135 - DNA, 14 bp, Homo sapiens
actatacttgaaca

SEQ ID NO: 5556136 - DNA, 19 bp, Homo sapiens
actatacttgatagtttgg

SEQ ID NO: 5556137 - DNA, 16 bp, Homo sapiens
actatagcaaagtagt

SEQ ID NO: 5556138 - DNA, 15 bp, Homo sapiens
actatagcagggctg

SEQ ID NO: 5556139 - DNA, 14 bp, Homo sapiens
actatagcccaggt

SEQ ID NO: 5556140 - DNA, 17 bp, Homo sapiens
actatagcccctggtgt

SEQ ID NO: 5556141 - DNA, 23 bp, Homo sapiens
actatagcccctggtgtgtaaat

SEQ ID NO: 5556142 - DNA, 18 bp, Homo sapiens
actatagcctaggtgaca

SEQ ID NO: 5556143 - DNA, 20 bp, Homo sapiens
actatagcttgcagaactgt

SEQ ID NO: 5556144 - DNA, 15 bp, Homo sapiens
actataggtccagaa

SEQ ID NO: 5556145 - DNA, 21 bp, Homo sapiens
actatagtaacttaatactct

SEQ ID NO: 5556146 - DNA, 17 bp, Homo sapiens
actatagtctcttgttt

SEQ ID NO: 5556147 - DNA, 18 bp, Homo sapiens
actatagtctcttgtttg

SEQ ID NO: 5556148 - DNA, 15 bp, Homo sapiens
actatagtggtgaga

SEQ ID NO: 5556149 - DNA, 16 bp, Homo sapiens
actatagtgtaataat

SEQ ID NO: 5556150 - DNA, 18 bp, Homo sapiens
actatagtgtaataatgt

SEQ ID NO: 5556151 - DNA, 20 bp, Homo sapiens
actatagtgtaataatgtta

SEQ ID NO: 5556152 - DNA, 16 bp, Homo sapiens
actatagtttaaaaca

SEQ ID NO: 5556153 - DNA, 21 bp, Homo sapiens
actatagtttaatactcagag

SEQ ID NO: 5556154 - DNA, 20 bp, Homo sapiens
actatataaagtactactgt

SEQ ID NO: 5556155 - DNA, 23 bp, Homo sapiens
actatataaagtactactgtaga

SEQ ID NO: 5556156 - DNA, 12 bp, Homo sapiens
actatataaatg

SEQ ID NO: 5556157 - DNA, 18 bp, Homo sapiens
actatataagacattaag

SEQ ID NO: 5556158 - DNA, 17 bp, Homo sapiens
actatatacatatatat

SEQ ID NO: 5556159 - DNA, 18 bp, Homo sapiens
actatatacatatatatt

SEQ ID NO: 5556160 - DNA, 22 bp, Homo sapiens
actatatacatcacgttaaagt

SEQ ID NO: 5556161 - DNA, 16 bp, Homo sapiens
actatatacatgtgtg

SEQ ID NO: 5556162 - DNA, 21 bp, Homo sapiens
actatatacatgtgtgtatat

SEQ ID NO: 5556163 - DNA, 18 bp, Homo sapiens
actatatagaatttcctg

SEQ ID NO: 5556164 - DNA, 16 bp, Homo sapiens
actatatataatgtat

SEQ ID NO: 5556165 - DNA, 22 bp, Homo sapiens
actatatatataaatgtataaa

SEQ ID NO: 5556166 - DNA, 17 bp, Homo sapiens
actatatatatttctag

SEQ ID NO: 5556167 - DNA, 13 bp, Homo sapiens
actatatatgtga

SEQ ID NO: 5556168 - DNA, 17 bp, Homo sapiens
actatatatttcttaat

SEQ ID NO: 5556169 - DNA, 17 bp, Homo sapiens
actatatcagtagtgta

SEQ ID NO: 5556170 - DNA, 21 bp, Homo sapiens
actatatcagtagtgtacatt

SEQ ID NO: 5556171 - DNA, 18 bp, Homo sapiens
actatatctgtatataaa

SEQ ID NO: 5556172 - DNA, 22 bp, Homo sapiens
actatatctgtatataaaatat

SEQ ID NO: 5556173 - DNA, 23 bp, Homo sapiens
actatatctgttttactgctttt

SEQ ID NO: 5556174 - DNA, 22 bp, Homo sapiens
actatatgataaagagggatgt

SEQ ID NO: 5556175 - DNA, 11 bp, Homo sapiens
actatatgcat

SEQ ID NO: 5556176 - DNA, 16 bp, Homo sapiens
actatatgtatatctt

SEQ ID NO: 5556177 - DNA, 23 bp, Homo sapiens
actatatgtgaaacattttttct

SEQ ID NO: 5556178 - DNA, 16 bp, Homo sapiens
actatatgtttacaca

SEQ ID NO: 5556179 - DNA, 17 bp, Homo sapiens
actcaccccaaacccag

SEQ ID NO: 5556180 - DNA, 12 bp, Homo sapiens
actcaccccagc

SEQ ID NO: 5556181 - DNA, 15 bp, Homo sapiens
actcaccccagcccc

SEQ ID NO: 5556182 - DNA, 16 bp, Homo sapiens
actcaccccagcccca

SEQ ID NO: 5556183 - DNA, 17 bp, Homo sapiens
actcacccctagccctg

SEQ ID NO: 5556184 - DNA, 18 bp, Homo sapiens
actcacccctagccctgg

SEQ ID NO: 5556185 - DNA, 16 bp, Homo sapiens
actcacccctcagcaa

SEQ ID NO: 5556186 - DNA, 16 bp, Homo sapiens
actcaccctgggagcc

SEQ ID NO: 5556187 - DNA, 19 bp, Homo sapiens
actcacccttcctggccca

SEQ ID NO: 5556188 - DNA, 20 bp, Homo sapiens
actcacccttcctggcccag

SEQ ID NO: 5556189 - DNA, 23 bp, Homo sapiens
actcacccttcctggcccaggcc

SEQ ID NO: 5556190 - DNA, 14 bp, Homo sapiens
actcacccttggcc

SEQ ID NO: 5556191 - DNA, 17 bp, Homo sapiens
actcacctaatgtttat

SEQ ID NO: 5556192 - DNA, 20 bp, Homo sapiens
actcacctaatgtttatgag

SEQ ID NO: 5556193 - DNA, 14 bp, Homo sapiens
actcacctcctccc

SEQ ID NO: 5556194 - DNA, 17 bp, Homo sapiens
actcacctctctctaag

SEQ ID NO: 5556195 - DNA, 16 bp, Homo sapiens
actcacctgcgcaagt

SEQ ID NO: 5556196 - DNA, 16 bp, Homo sapiens
actcacctgctggccc

SEQ ID NO: 5556197 - DNA, 17 bp, Homo sapiens
actcacctgctggcccc

SEQ ID NO: 5556198 - DNA, 18 bp, Homo sapiens
actcacctgctggcccct

SEQ ID NO: 5556199 - DNA, 19 bp, Homo sapiens
actcacctgctggcccctc

SEQ ID NO: 5556200 - DNA, 23 bp, Homo sapiens
actcacctggggctgctggcctg

SEQ ID NO: 5556201 - DNA, 15 bp, Homo sapiens
actcacctgttactt

SEQ ID NO: 5556202 - DNA, 14 bp, Homo sapiens
actcaccttgaaca

SEQ ID NO: 5556203 - DNA, 21 bp, Homo sapiens
actcaccttgaacaccacgct

SEQ ID NO: 5556204 - DNA, 15 bp, Homo sapiens
actcacgatgaaatt

SEQ ID NO: 5556205 - DNA, 14 bp, Homo sapiens
actcacgtttgctt

SEQ ID NO: 5556206 - DNA, 15 bp, Homo sapiens
actcactcactccaa

SEQ ID NO: 5556207 - DNA, 20 bp, Homo sapiens
actcactccaagaccaccag

SEQ ID NO: 5556208 - DNA, 14 bp, Homo sapiens
actcactccagccc

SEQ ID NO: 5556209 - DNA, 16 bp, Homo sapiens
actcactccagcccaa

SEQ ID NO: 5556210 - DNA, 12 bp, Homo sapiens
actcactcccca

SEQ ID NO: 5556211 - DNA, 22 bp, Homo sapiens
actcactcctgagacccctggc

SEQ ID NO: 5556212 - DNA, 19 bp, Homo sapiens
actcactccttttaaagaa

SEQ ID NO: 5556213 - DNA, 13 bp, Homo sapiens
actcactctaaag

SEQ ID NO: 5556214 - DNA, 20 bp, Homo sapiens
actcactctgggtgcctcct

SEQ ID NO: 5556215 - DNA, 18 bp, Homo sapiens
actcactcttatgaaatg

SEQ ID NO: 5556216 - DNA, 22 bp, Homo sapiens
actcactctttagatatttaca

SEQ ID NO: 5556217 - DNA, 12 bp, Homo sapiens
actcactgaagc

SEQ ID NO: 5556218 - DNA, 16 bp, Homo sapiens
actcactgaagcctgc

SEQ ID NO: 5556219 - DNA, 18 bp, Homo sapiens
actcactgaagcctgcgt

SEQ ID NO: 5556220 - DNA, 14 bp, Homo sapiens
actcactgaggcca

SEQ ID NO: 5556221 - DNA, 17 bp, Homo sapiens
actcactgaggccatca

SEQ ID NO: 5556222 - DNA, 22 bp, Homo sapiens
actcactgaggccatcagggcc

SEQ ID NO: 5556223 - DNA, 11 bp, Homo sapiens
actcactgcat

SEQ ID NO: 5556224 - DNA, 17 bp, Homo sapiens
actcactgccaaaaata

SEQ ID NO: 5556225 - DNA, 10 bp, Homo sapiens
actcactgct

SEQ ID NO: 5556226 - DNA, 18 bp, Homo sapiens
actcactggcagccccag

SEQ ID NO: 5556227 - DNA, 23 bp, Homo sapiens
actcactggggaacgttctcttt

SEQ ID NO: 5556228 - DNA, 18 bp, Homo sapiens
actcactgtgatcaatat

SEQ ID NO: 5556229 - DNA, 12 bp, Homo sapiens
actcactgtgct

SEQ ID NO: 5556230 - DNA, 12 bp, Homo sapiens
actcactgttta

SEQ ID NO: 5556231 - DNA, 16 bp, Homo sapiens
actcactgtttataaa

SEQ ID NO: 5556232 - DNA, 19 bp, Homo sapiens
actcactgtttataaatgt

SEQ ID NO: 5556233 - DNA, 20 bp, Homo sapiens
actcacttaattctcattat

SEQ ID NO: 5556234 - DNA, 13 bp, Homo sapiens
actcacttcaatg

SEQ ID NO: 5556235 - DNA, 21 bp, Homo sapiens
actcacttgatgtttcctgga

SEQ ID NO: 5556236 - DNA, 23 bp, Homo sapiens
actcacttgccattgccaggaga

SEQ ID NO: 5556237 - DNA, 23 bp, Homo sapiens
actcactttcccttgtgtcaaga

SEQ ID NO: 5556238 - DNA, 14 bp, Homo sapiens
actcacttttcact

SEQ ID NO: 5556239 - DNA, 18 bp, Homo sapiens
actcacttttcccactcc

SEQ ID NO: 5556240 - DNA, 19 bp, Homo sapiens
actcagaaaattccctggg

SEQ ID NO: 5556241 - DNA, 21 bp, Homo sapiens
actcagaaaattccctggggt

SEQ ID NO: 5556242 - DNA, 21 bp, Homo sapiens
actcagaaagaggtctcccca

SEQ ID NO: 5556243 - DNA, 13 bp, Homo sapiens
actcagaaattca

SEQ ID NO: 5556244 - DNA, 21 bp, Homo sapiens
actcagaaatttaattcatgt

SEQ ID NO: 5556245 - DNA, 16 bp, Homo sapiens
actcagaactgtccca

SEQ ID NO: 5556246 - DNA, 14 bp, Homo sapiens
actcagaagagaaa

SEQ ID NO: 5556247 - DNA, 12 bp, Homo sapiens
actcagaagagt

SEQ ID NO: 5556248 - DNA, 13 bp, Homo sapiens
actcagaagagtc

SEQ ID NO: 5556249 - DNA, 12 bp, Homo sapiens
actcagaagcct

SEQ ID NO: 5556250 - DNA, 14 bp, Homo sapiens
actcagaagcctga

SEQ ID NO: 5556251 - DNA, 17 bp, Homo sapiens
actcagaagggagctag

SEQ ID NO: 5556252 - DNA, 14 bp, Homo sapiens
actcagaagttgtg

SEQ ID NO: 5556253 - DNA, 16 bp, Homo sapiens
actcagaatgggggct

SEQ ID NO: 5556254 - DNA, 17 bp, Homo sapiens
actcagaattattttta

SEQ ID NO: 5556255 - DNA, 15 bp, Homo sapiens
actcagacattccaa

SEQ ID NO: 5556256 - DNA, 13 bp, Homo sapiens
actcagaccagct

SEQ ID NO: 5556257 - DNA, 21 bp, Homo sapiens
actcagaccagctcccagatg

SEQ ID NO: 5556258 - DNA, 12 bp, Homo sapiens
actcagacctga

SEQ ID NO: 5556259 - DNA, 17 bp, Homo sapiens
actcagactcctggctt

SEQ ID NO: 5556260 - DNA, 21 bp, Homo sapiens
actcagagaaaaatgctcccc

SEQ ID NO: 5556261 - DNA, 20 bp, Homo sapiens
actcagagacatgcagagat

SEQ ID NO: 5556262 - DNA, 16 bp, Homo sapiens
actcagagcacagcca

SEQ ID NO: 5556263 - DNA, 12 bp, Homo sapiens
actcagagcaga

SEQ ID NO: 5556264 - DNA, 14 bp, Homo sapiens
actcagagcagagc

SEQ ID NO: 5556265 - DNA, 14 bp, Homo sapiens
actcagagctctct

SEQ ID NO: 5556266 - DNA, 14 bp, Homo sapiens
actcagagctgcgg

SEQ ID NO: 5556267 - DNA, 13 bp, Homo sapiens
actcagaggcccc

SEQ ID NO: 5556268 - DNA, 15 bp, Homo sapiens
actcagaggctggga

SEQ ID NO: 5556269 - DNA, 19 bp, Homo sapiens
actcagaggctgggagcat

SEQ ID NO: 5556270 - DNA, 22 bp, Homo sapiens
actcagagggaaggctctctgg

SEQ ID NO: 5556271 - DNA, 14 bp, Homo sapiens
actcagaggtccag

SEQ ID NO: 5556272 - DNA, 17 bp, Homo sapiens
actcagaggtccaggcc

SEQ ID NO: 5556273 - DNA, 23 bp, Homo sapiens
actcagatatagatcctgagctc

SEQ ID NO: 5556274 - DNA, 18 bp, Homo sapiens
actcagatcactactgca

SEQ ID NO: 5556275 - DNA, 19 bp, Homo sapiens
actcagatcactactgcag

SEQ ID NO: 5556276 - DNA, 12 bp, Homo sapiens
actcagatccag

SEQ ID NO: 5556277 - DNA, 16 bp, Homo sapiens
actcagatccagggac

SEQ ID NO: 5556278 - DNA, 19 bp, Homo sapiens
actcagatccagggacaga

SEQ ID NO: 5556279 - DNA, 17 bp, Homo sapiens
actcagatcctcctcat

SEQ ID NO: 5556280 - DNA, 18 bp, Homo sapiens
actcagatctgcactcct

SEQ ID NO: 5556281 - DNA, 16 bp, Homo sapiens
actcagatctgtctga

SEQ ID NO: 5556282 - DNA, 21 bp, Homo sapiens
actcagatgaccccagaaact

SEQ ID NO: 5556283 - DNA, 12 bp, Homo sapiens
actcagatgagt

SEQ ID NO: 5556284 - DNA, 24 bp, Homo sapiens
actcagatgatgccagctgtctcc

SEQ ID NO: 5556285 - DNA, 12 bp, Homo sapiens
actcagatgtcc

SEQ ID NO: 5556286 - DNA, 17 bp, Homo sapiens
actcagatttaaaacaa

SEQ ID NO: 5556287 - DNA, 21 bp, Homo sapiens
actcagcaccacattgcctca

SEQ ID NO: 5556288 - DNA, 21 bp, Homo sapiens
actcagcaccactcaagacca

SEQ ID NO: 5556289 - DNA, 17 bp, Homo sapiens
actcagcacttggccct

SEQ ID NO: 5556290 - DNA, 15 bp, Homo sapiens
actcagcagaatggt

SEQ ID NO: 5556291 - DNA, 17 bp, Homo sapiens
actcagcagacatttat

SEQ ID NO: 5556292 - DNA, 13 bp, Homo sapiens
actcagcagaggc

SEQ ID NO: 5556293 - DNA, 14 bp, Homo sapiens
actcagcagaggca

SEQ ID NO: 5556294 - DNA, 15 bp, Homo sapiens
actcagcagaggcag

SEQ ID NO: 5556295 - DNA, 14 bp, Homo sapiens
actcagcagcagag

SEQ ID NO: 5556296 - DNA, 15 bp, Homo sapiens
actcagcagcagaga

SEQ ID NO: 5556297 - DNA, 13 bp, Homo sapiens
actcagcagccct

SEQ ID NO: 5556298 - DNA, 18 bp, Homo sapiens
actcagcagccctcctca

SEQ ID NO: 5556299 - DNA, 22 bp, Homo sapiens
actcagcagccctcctcacccc

SEQ ID NO: 5556300 - DNA, 17 bp, Homo sapiens
actcagcagcctgcgct

SEQ ID NO: 5556301 - DNA, 14 bp, Homo sapiens
actcagcagtgacc

SEQ ID NO: 5556302 - DNA, 14 bp, Homo sapiens
actcagcatcccca

SEQ ID NO: 5556303 - DNA, 11 bp, Homo sapiens
actcagcatgg

SEQ ID NO: 5556304 - DNA, 22 bp, Homo sapiens
actcagcatttgattaacattt

SEQ ID NO: 5556305 - DNA, 20 bp, Homo sapiens
actcagccaaccttacttac

SEQ ID NO: 5556306 - DNA, 16 bp, Homo sapiens
actcagccaagcacag

SEQ ID NO: 5556307 - DNA, 21 bp, Homo sapiens
actcagccacaaagcccccca

SEQ ID NO: 5556308 - DNA, 22 bp, Homo sapiens
actcagccacaaagccccccag

SEQ ID NO: 5556309 - DNA, 21 bp, Homo sapiens
actcagccacgaccagcccct

SEQ ID NO: 5556310 - DNA, 16 bp, Homo sapiens
actcagccactgtcac

SEQ ID NO: 5556311 - DNA, 23 bp, Homo sapiens
actcagccactgtcacaggcata

SEQ ID NO: 5556312 - DNA, 21 bp, Homo sapiens
actcagccagaaagatgccct

SEQ ID NO: 5556313 - DNA, 11 bp, Homo sapiens
actcagcccac

SEQ ID NO: 5556314 - DNA, 14 bp, Homo sapiens
actcagcccacctg

SEQ ID NO: 5556315 - DNA, 15 bp, Homo sapiens
actcagcccacctgc

SEQ ID NO: 5556316 - DNA, 18 bp, Homo sapiens
actcagcccacctgcacc

SEQ ID NO: 5556317 - DNA, 21 bp, Homo sapiens
actcagcccacctgcacccag

SEQ ID NO: 5556318 - DNA, 12 bp, Homo sapiens
actcagccccta

SEQ ID NO: 5556319 - DNA, 19 bp, Homo sapiens
actcagcccctacccctgc

SEQ ID NO: 5556320 - DNA, 15 bp, Homo sapiens
actcagcccctagga

SEQ ID NO: 5556321 - DNA, 17 bp, Homo sapiens
actcagcccctaggagt

SEQ ID NO: 5556322 - DNA, 17 bp, Homo sapiens
actcagccccttcccgg

SEQ ID NO: 5556323 - DNA, 21 bp, Homo sapiens
actcagccctcattggctctt

SEQ ID NO: 5556324 - DNA, 11 bp, Homo sapiens
actcagccctg

SEQ ID NO: 5556325 - DNA, 17 bp, Homo sapiens
actcagcctagcacagg

SEQ ID NO: 5556326 - DNA, 14 bp, Homo sapiens
actcagcctctgct

SEQ ID NO: 5556327 - DNA, 15 bp, Homo sapiens
actcagcctctgctg

SEQ ID NO: 5556328 - DNA, 16 bp, Homo sapiens
actcagcctgctgccc

SEQ ID NO: 5556329 - DNA, 16 bp, Homo sapiens
actcagcctgggacag

SEQ ID NO: 5556330 - DNA, 11 bp, Homo sapiens
actcagcctgt

SEQ ID NO: 5556331 - DNA, 22 bp, Homo sapiens
actcagcctgttccttcctgca

SEQ ID NO: 5556332 - DNA, 13 bp, Homo sapiens
actcagccttcct

SEQ ID NO: 5556333 - DNA, 14 bp, Homo sapiens
actcagcgctcctc

SEQ ID NO: 5556334 - DNA, 16 bp, Homo sapiens
actcagcgctcctcct

SEQ ID NO: 5556335 - DNA, 22 bp, Homo sapiens
actcagcgctcctcctgtgtga

SEQ ID NO: 5556336 - DNA, 22 bp, Homo sapiens
actcagctccagaataccttct

SEQ ID NO: 5556337 - DNA, 17 bp, Homo sapiens
actcagctctcctgctg

SEQ ID NO: 5556338 - DNA, 19 bp, Homo sapiens
actcagctctgacattctg

SEQ ID NO: 5556339 - DNA, 22 bp, Homo sapiens
actcagctcttggctccactgg

SEQ ID NO: 5556340 - DNA, 22 bp, Homo sapiens
actcagctggaagtctacctgc

SEQ ID NO: 5556341 - DNA, 16 bp, Homo sapiens
actcagctgtccagaa

SEQ ID NO: 5556342 - DNA, 17 bp, Homo sapiens
actcagctgtcctgcag

SEQ ID NO: 5556343 - DNA, 19 bp, Homo sapiens
actcagctgtcctgcagca

SEQ ID NO: 5556344 - DNA, 17 bp, Homo sapiens
actcagcttcctaccca

SEQ ID NO: 5556345 - DNA, 20 bp, Homo sapiens
actcagcttcggggccggtg

SEQ ID NO: 5556346 - DNA, 17 bp, Homo sapiens
actcaggaaccctggag

SEQ ID NO: 5556347 - DNA, 17 bp, Homo sapiens
actcaggactccagccc

SEQ ID NO: 5556348 - DNA, 15 bp, Homo sapiens
actcaggagcacagc

SEQ ID NO: 5556349 - DNA, 17 bp, Homo sapiens
actcaggagcacagcca

SEQ ID NO: 5556350 - DNA, 18 bp, Homo sapiens
actcaggagcacagccat

SEQ ID NO: 5556351 - DNA, 14 bp, Homo sapiens
actcaggagcctcc

SEQ ID NO: 5556352 - DNA, 11 bp, Homo sapiens
actcaggaggc

SEQ ID NO: 5556353 - DNA, 14 bp, Homo sapiens
actcaggaggctga

SEQ ID NO: 5556354 - DNA, 18 bp, Homo sapiens
actcaggaggctgagaca

SEQ ID NO: 5556355 - DNA, 20 bp, Homo sapiens
actcaggaggctgagacagg

SEQ ID NO: 5556356 - DNA, 16 bp, Homo sapiens
actcaggaggctgagg

SEQ ID NO: 5556357 - DNA, 18 bp, Homo sapiens
actcaggaggctgaggca

SEQ ID NO: 5556358 - DNA, 16 bp, Homo sapiens
actcaggagtctgcca

SEQ ID NO: 5556359 - DNA, 14 bp, Homo sapiens
actccaaagatgac

SEQ ID NO: 5556360 - DNA, 18 bp, Homo sapiens
actccaacctctcggccc

SEQ ID NO: 5556361 - DNA, 20 bp, Homo sapiens
actccaactcccttaaaata

SEQ ID NO: 5556362 - DNA, 20 bp, Homo sapiens
actccaacttagtgtctcta

SEQ ID NO: 5556363 - DNA, 17 bp, Homo sapiens
actccaagaacaattgt

SEQ ID NO: 5556364 - DNA, 19 bp, Homo sapiens
actccaagatatggacaca

SEQ ID NO: 5556365 - DNA, 13 bp, Homo sapiens
actccaagcagac

SEQ ID NO: 5556366 - DNA, 16 bp, Homo sapiens
actccaagcagactcc

SEQ ID NO: 5556367 - DNA, 15 bp, Homo sapiens
actccaagcccagcc

SEQ ID NO: 5556368 - DNA, 17 bp, Homo sapiens
actccaagcccagccca

SEQ ID NO: 5556369 - DNA, 18 bp, Homo sapiens
actccaagcccagcccat

SEQ ID NO: 5556370 - DNA, 15 bp, Homo sapiens
actccaagccccctg

SEQ ID NO: 5556371 - DNA, 14 bp, Homo sapiens
actccaagccctgg

SEQ ID NO: 5556372 - DNA, 17 bp, Homo sapiens
actccaagccctggggc

SEQ ID NO: 5556373 - DNA, 20 bp, Homo sapiens
actccaagccctggggcagg

SEQ ID NO: 5556374 - DNA, 14 bp, Homo sapiens
actccaagcttcaa

SEQ ID NO: 5556375 - DNA, 16 bp, Homo sapiens
actccaaggcaaatgt

SEQ ID NO: 5556376 - DNA, 17 bp, Homo sapiens
actccaaggcaaatgtc

SEQ ID NO: 5556377 - DNA, 18 bp, Homo sapiens
actccaaggcaaatgtcc

SEQ ID NO: 5556378 - DNA, 19 bp, Homo sapiens
actccaaggcaaatgtcca

SEQ ID NO: 5556379 - DNA, 20 bp, Homo sapiens
actccaaggcaaatgtccaa

SEQ ID NO: 5556380 - DNA, 17 bp, Homo sapiens
actccaaggtttataaa

SEQ ID NO: 5556381 - DNA, 20 bp, Homo sapiens
actccaaggtttataaagca

SEQ ID NO: 5556382 - DNA, 23 bp, Homo sapiens
actccaaggtttataaagcagat

SEQ ID NO: 5556383 - DNA, 20 bp, Homo sapiens
actccaagtgggtcaattcc

SEQ ID NO: 5556384 - DNA, 15 bp, Homo sapiens
actccaatctggtaa

SEQ ID NO: 5556385 - DNA, 20 bp, Homo sapiens
actccaatggggccagcact

SEQ ID NO: 5556386 - DNA, 21 bp, Homo sapiens
actccaatggggccagcactg

SEQ ID NO: 5556387 - DNA, 20 bp, Homo sapiens
actccaatgtctgctgagga

SEQ ID NO: 5556388 - DNA, 21 bp, Homo sapiens
actccaattaaggattttatg

SEQ ID NO: 5556389 - DNA, 13 bp, Homo sapiens
actccacaaatga

SEQ ID NO: 5556390 - DNA, 14 bp, Homo sapiens
actccacaaatgat

SEQ ID NO: 5556391 - DNA, 11 bp, Homo sapiens
actccacacca

SEQ ID NO: 5556392 - DNA, 22 bp, Homo sapiens
actccacaccagtaataaaaag

SEQ ID NO: 5556393 - DNA, 22 bp, Homo sapiens
actccacaccttttatgaatca

SEQ ID NO: 5556394 - DNA, 14 bp, Homo sapiens
actccacactgcac

SEQ ID NO: 5556395 - DNA, 21 bp, Homo sapiens
actccacactgcacaataact

SEQ ID NO: 5556396 - DNA, 20 bp, Homo sapiens
actccacagcggaggagacc

SEQ ID NO: 5556397 - DNA, 11 bp, Homo sapiens
actccacaggg

SEQ ID NO: 5556398 - DNA, 17 bp, Homo sapiens
actccacagtgtttata

SEQ ID NO: 5556399 - DNA, 20 bp, Homo sapiens
actccaccatcactcactca

SEQ ID NO: 5556400 - DNA, 17 bp, Homo sapiens
actccacccccagagga

SEQ ID NO: 5556401 - DNA, 23 bp, Homo sapiens
actccaccccctccagctccagt

SEQ ID NO: 5556402 - DNA, 16 bp, Homo sapiens
actccaccctctgcga

SEQ ID NO: 5556403 - DNA, 21 bp, Homo sapiens
actccaccctgttagttttgt

SEQ ID NO: 5556404 - DNA, 13 bp, Homo sapiens
actccacctcaaa

SEQ ID NO: 5556405 - DNA, 17 bp, Homo sapiens
actccacctcttccttt

SEQ ID NO: 5556406 - DNA, 22 bp, Homo sapiens
actccactactttactgttggt

SEQ ID NO: 5556407 - DNA, 17 bp, Homo sapiens
actccactcactgaagc

SEQ ID NO: 5556408 - DNA, 20 bp, Homo sapiens
actccactctgattcacctc

SEQ ID NO: 5556409 - DNA, 16 bp, Homo sapiens
actccactgacctgga

SEQ ID NO: 5556410 - DNA, 16 bp, Homo sapiens
actccactggacagac

SEQ ID NO: 5556411 - DNA, 20 bp, Homo sapiens
actccactggacagacccag

SEQ ID NO: 5556412 - DNA, 19 bp, Homo sapiens
actccactggtctgtcttt

SEQ ID NO: 5556413 - DNA, 15 bp, Homo sapiens
actccactttcatag

SEQ ID NO: 5556414 - DNA, 14 bp, Homo sapiens
actccagaaagtga

SEQ ID NO: 5556415 - DNA, 14 bp, Homo sapiens
actccagaagcagc

SEQ ID NO: 5556416 - DNA, 16 bp, Homo sapiens
actccagaatctgctg

SEQ ID NO: 5556417 - DNA, 17 bp, Homo sapiens
actccagaatttcccaa

SEQ ID NO: 5556418 - DNA, 23 bp, Homo sapiens
actccagaatttcccaaagcagt

SEQ ID NO: 5556419 - DNA, 14 bp, Homo sapiens
actccagactctgg

SEQ ID NO: 5556420 - DNA, 22 bp, Homo sapiens
actccagactctgggggtggac

SEQ ID NO: 5556421 - DNA, 15 bp, Homo sapiens
actccagacttggga

SEQ ID NO: 5556422 - DNA, 17 bp, Homo sapiens
actccagagccccttta

SEQ ID NO: 5556423 - DNA, 18 bp, Homo sapiens
actccagagtctgagccc

SEQ ID NO: 5556424 - DNA, 15 bp, Homo sapiens
actccagatagagaa

SEQ ID NO: 5556425 - DNA, 20 bp, Homo sapiens
actccagcagataaggccga

SEQ ID NO: 5556426 - DNA, 11 bp, Homo sapiens
actccagcatt

SEQ ID NO: 5556427 - DNA, 20 bp, Homo sapiens
actccagccacccagccagg

SEQ ID NO: 5556428 - DNA, 11 bp, Homo sapiens
actccagccag

SEQ ID NO: 5556429 - DNA, 18 bp, Homo sapiens
actccagccagcgcctcc

SEQ ID NO: 5556430 - DNA, 19 bp, Homo sapiens
actccagccagcgcctccc

SEQ ID NO: 5556431 - DNA, 23 bp, Homo sapiens
actccagccagcgcctccctcca

SEQ ID NO: 5556432 - DNA, 12 bp, Homo sapiens
actccagcccat

SEQ ID NO: 5556433 - DNA, 13 bp, Homo sapiens
actccagcccctg

SEQ ID NO: 5556434 - DNA, 12 bp, Homo sapiens
actccagcccgc

SEQ ID NO: 5556435 - DNA, 13 bp, Homo sapiens
actccagccctgt

SEQ ID NO: 5556436 - DNA, 18 bp, Homo sapiens
actccagcctgagtgaca

SEQ ID NO: 5556437 - DNA, 12 bp, Homo sapiens
actccagcctgg

SEQ ID NO: 5556438 - DNA, 14 bp, Homo sapiens
actccagcctgggc

SEQ ID NO: 5556439 - DNA, 20 bp, Homo sapiens
actccagcctgggggacaga

SEQ ID NO: 5556440 - DNA, 16 bp, Homo sapiens
actccagcctgggtca

SEQ ID NO: 5556441 - DNA, 18 bp, Homo sapiens
actccagcctgggtcaca

SEQ ID NO: 5556442 - DNA, 19 bp, Homo sapiens
actccagcctgggtcacag

SEQ ID NO: 5556443 - DNA, 23 bp, Homo sapiens
actccagcctgggtcacagagtg

SEQ ID NO: 5556444 - DNA, 15 bp, Homo sapiens
actccagcctgggtg

SEQ ID NO: 5556445 - DNA, 20 bp, Homo sapiens
actccagcgtcctcagcacc

SEQ ID NO: 5556446 - DNA, 21 bp, Homo sapiens
actccagcgtcctcagcaccc

SEQ ID NO: 5556447 - DNA, 11 bp, Homo sapiens
actccagctga

SEQ ID NO: 5556448 - DNA, 20 bp, Homo sapiens
actccagctgacagccacac

SEQ ID NO: 5556449 - DNA, 18 bp, Homo sapiens
actccagctggtgccccc

SEQ ID NO: 5556450 - DNA, 19 bp, Homo sapiens
actccagctggtgccccca

SEQ ID NO: 5556451 - DNA, 19 bp, Homo sapiens
actccagcttgggtgataa

SEQ ID NO: 5556452 - DNA, 17 bp, Homo sapiens
actccaggaaagagcag

SEQ ID NO: 5556453 - DNA, 13 bp, Homo sapiens
actccaggattta

SEQ ID NO: 5556454 - DNA, 16 bp, Homo sapiens
actccaggatttataa

SEQ ID NO: 5556455 - DNA, 20 bp, Homo sapiens
actccaggatttataaagca

SEQ ID NO: 5556456 - DNA, 21 bp, Homo sapiens
actccaggatttataaagcaa

SEQ ID NO: 5556457 - DNA, 20 bp, Homo sapiens
actccaggcatatgtttccc

SEQ ID NO: 5556458 - DNA, 23 bp, Homo sapiens
actccaggcatgtgtctggccct

SEQ ID NO: 5556459 - DNA, 13 bp, Homo sapiens
actccaggcccaa

SEQ ID NO: 5556460 - DNA, 19 bp, Homo sapiens
actccaggcccaaggctcc

SEQ ID NO: 5556461 - DNA, 14 bp, Homo sapiens
actccaggcccccg

SEQ ID NO: 5556462 - DNA, 18 bp, Homo sapiens
actccaggccctcctctc

SEQ ID NO: 5556463 - DNA, 15 bp, Homo sapiens
actccaggccctgcc

SEQ ID NO: 5556464 - DNA, 19 bp, Homo sapiens
actccaggctgggctgagc

SEQ ID NO: 5556465 - DNA, 16 bp, Homo sapiens
actccaggcttccaca

SEQ ID NO: 5556466 - DNA, 23 bp, Homo sapiens
actccaggcttccacacttctgg

SEQ ID NO: 5556467 - DNA, 15 bp, Homo sapiens
actccaggggcacct

SEQ ID NO: 5556468 - DNA, 18 bp, Homo sapiens
actccaggggtggaggga

SEQ ID NO: 5556469 - DNA, 17 bp, Homo sapiens
actccagggtcccctgc

SEQ ID NO: 5556470 - DNA, 21 bp, Homo sapiens
actccagggttaaagaaaggc

SEQ ID NO: 5556471 - DNA, 20 bp, Homo sapiens
actccaggttcgtatagaaa

SEQ ID NO: 5556472 - DNA, 21 bp, Homo sapiens
actccaggttcgtatagaaaa

SEQ ID NO: 5556473 - DNA, 23 bp, Homo sapiens
actccagtagcgagagacggcac

SEQ ID NO: 5556474 - DNA, 16 bp, Homo sapiens
actccagtagctcctg

SEQ ID NO: 5556475 - DNA, 20 bp, Homo sapiens
actccagtatgacagaggag

SEQ ID NO: 5556476 - DNA, 17 bp, Homo sapiens
actccagtcctgccacc

SEQ ID NO: 5556477 - DNA, 19 bp, Homo sapiens
actccagtgagacagctct

SEQ ID NO: 5556478 - DNA, 20 bp, Homo sapiens
actccagtgatgttcttcaa

SEQ ID NO: 5556479 - DNA, 15 bp, Homo sapiens
actccagtgccagca

SEQ ID NO: 5556480 - DNA, 17 bp, Homo sapiens
actccagtgctcagctg

SEQ ID NO: 5556481 - DNA, 18 bp, Homo sapiens
actccagtgctcagctgt

SEQ ID NO: 5556482 - DNA, 20 bp, Homo sapiens
actccagtgctcagctgtgg

SEQ ID NO: 5556483 - DNA, 21 bp, Homo sapiens
actccagtgctcagctgtggc

SEQ ID NO: 5556484 - DNA, 10 bp, Homo sapiens
actccagtgg

SEQ ID NO: 5556485 - DNA, 22 bp, Homo sapiens
actccagtggggcaagattttc

SEQ ID NO: 5556486 - DNA, 18 bp, Homo sapiens
actccagtggtgaagaaa

SEQ ID NO: 5556487 - DNA, 19 bp, Homo sapiens
actccagtgttcccttctg

SEQ ID NO: 5556488 - DNA, 16 bp, Homo sapiens
actccatacataactt

SEQ ID NO: 5556489 - DNA, 21 bp, Homo sapiens
actccatacataacttgatat

SEQ ID NO: 5556490 - DNA, 22 bp, Homo sapiens
actccataccccgccaaggaaa

SEQ ID NO: 5556491 - DNA, 15 bp, Homo sapiens
actccatatgtgttc

SEQ ID NO: 5556492 - DNA, 16 bp, Homo sapiens
actccatatgtgttcc

SEQ ID NO: 5556493 - DNA, 17 bp, Homo sapiens
actccatcagaaaacca

SEQ ID NO: 5556494 - DNA, 18 bp, Homo sapiens
actccatcagaaaaccaa

SEQ ID NO: 5556495 - DNA, 19 bp, Homo sapiens
actccatcagaaaaccaaa

SEQ ID NO: 5556496 - DNA, 19 bp, Homo sapiens
actccatcgccatcttctt

SEQ ID NO: 5556497 - DNA, 20 bp, Homo sapiens
actccatcgccatcttcttc

SEQ ID NO: 5556498 - DNA, 22 bp, Homo sapiens
actccatcgccatcttcttccc

SEQ ID NO: 5556499 - DNA, 20 bp, Homo sapiens
actccatctcaaaacaaaac

SEQ ID NO: 5556500 - DNA, 18 bp, Homo sapiens
actccatctcttctgcaa

SEQ ID NO: 5556501 - DNA, 14 bp, Homo sapiens
actccatcttcaat

SEQ ID NO: 5556502 - DNA, 17 bp, Homo sapiens
actccatcttggtagtt

SEQ ID NO: 5556503 - DNA, 15 bp, Homo sapiens
actccatgaccaggc

SEQ ID NO: 5556504 - DNA, 17 bp, Homo sapiens
actccatgaccaggcca

SEQ ID NO: 5556505 - DNA, 18 bp, Homo sapiens
actccatgaccaggccac

SEQ ID NO: 5556506 - DNA, 14 bp, Homo sapiens
actccatgagaagc

SEQ ID NO: 5556507 - DNA, 13 bp, Homo sapiens
actccatgagcac

SEQ ID NO: 5556508 - DNA, 17 bp, Homo sapiens
actccatgagcacccca

SEQ ID NO: 5556509 - DNA, 12 bp, Homo sapiens
actccatgccta

SEQ ID NO: 5556510 - DNA, 19 bp, Homo sapiens
actccatgcctatttactg

SEQ ID NO: 5556511 - DNA, 22 bp, Homo sapiens
actccatgcctatttactggaa

SEQ ID NO: 5556512 - DNA, 13 bp, Homo sapiens
actccatgctcct

SEQ ID NO: 5556513 - DNA, 19 bp, Homo sapiens
actccatgctccttgagag

SEQ ID NO: 5556514 - DNA, 17 bp, Homo sapiens
actccatggccaccccg

SEQ ID NO: 5556515 - DNA, 19 bp, Homo sapiens
actccatggcccttcctgg

SEQ ID NO: 5556516 - DNA, 21 bp, Homo sapiens
actccatggctaagaccacag

SEQ ID NO: 5556517 - DNA, 23 bp, Homo sapiens
actccatggtgaactgaagcaga

SEQ ID NO: 5556518 - DNA, 14 bp, Homo sapiens
actccatggttctc

SEQ ID NO: 5556519 - DNA, 23 bp, Homo sapiens
actccatgtcagggaagtcgctt

SEQ ID NO: 5556520 - DNA, 20 bp, Homo sapiens
actccatgttggctagcctc

SEQ ID NO: 5556521 - DNA, 16 bp, Homo sapiens
actccattactgtgat

SEQ ID NO: 5556522 - DNA, 17 bp, Homo sapiens
actccattactgtgatt

SEQ ID NO: 5556523 - DNA, 18 bp, Homo sapiens
actccattactgtgattt

SEQ ID NO: 5556524 - DNA, 18 bp, Homo sapiens
actccattcccaactaga

SEQ ID NO: 5556525 - DNA, 15 bp, Homo sapiens
actccatttcccact

SEQ ID NO: 5556526 - DNA, 17 bp, Homo sapiens
actccatttcccacttc

SEQ ID NO: 5556527 - DNA, 16 bp, Homo sapiens
actccatttctttctt

SEQ ID NO: 5556528 - DNA, 18 bp, Homo sapiens
actcccaacttcttcctg

SEQ ID NO: 5556529 - DNA, 17 bp, Homo sapiens
actcccaagaacagcag

SEQ ID NO: 5556530 - DNA, 15 bp, Homo sapiens
actcccaagctggac

SEQ ID NO: 5556531 - DNA, 21 bp, Homo sapiens
actcccaagggacagcaagtg

SEQ ID NO: 5556532 - DNA, 14 bp, Homo sapiens
actcccaagtatgg

SEQ ID NO: 5556533 - DNA, 16 bp, Homo sapiens
actcccaatacaaaga

SEQ ID NO: 5556534 - DNA, 16 bp, Homo sapiens
actcccacagcagccc

SEQ ID NO: 5556535 - DNA, 20 bp, Homo sapiens
actcccacagcagccccagg

SEQ ID NO: 5556536 - DNA, 16 bp, Homo sapiens
actcctaggagagcca

SEQ ID NO: 5556537 - DNA, 16 bp, Homo sapiens
actcctaggcaggaca

SEQ ID NO: 5556538 - DNA, 19 bp, Homo sapiens
actcctagttctagaaaaa

SEQ ID NO: 5556539 - DNA, 16 bp, Homo sapiens
actcctataaagtgcc

SEQ ID NO: 5556540 - DNA, 23 bp, Homo sapiens
actcctatccccaggccaggtcc

SEQ ID NO: 5556541 - DNA, 13 bp, Homo sapiens
actcctatgtcat

SEQ ID NO: 5556542 - DNA, 18 bp, Homo sapiens
actcctcaaaccacttgc

SEQ ID NO: 5556543 - DNA, 20 bp, Homo sapiens
actcctcaaaccacttgcct

SEQ ID NO: 5556544 - DNA, 16 bp, Homo sapiens
actcctcaagactttg

SEQ ID NO: 5556545 - DNA, 18 bp, Homo sapiens
actcctcaagactttgat

SEQ ID NO: 5556546 - DNA, 13 bp, Homo sapiens
actcctcacactt

SEQ ID NO: 5556547 - DNA, 19 bp, Homo sapiens
actcctcactgccccacca

SEQ ID NO: 5556548 - DNA, 18 bp, Homo sapiens
actcctcacttttcaatt

SEQ ID NO: 5556549 - DNA, 12 bp, Homo sapiens
actcctcagacg

SEQ ID NO: 5556550 - DNA, 14 bp, Homo sapiens
actcctcagcaccc

SEQ ID NO: 5556551 - DNA, 18 bp, Homo sapiens
actcctcagggcagcctc

SEQ ID NO: 5556552 - DNA, 16 bp, Homo sapiens
actcctcagggttgag

SEQ ID NO: 5556553 - DNA, 19 bp, Homo sapiens
actcctcagggttgaggtc

SEQ ID NO: 5556554 - DNA, 20 bp, Homo sapiens
actcctcagtaaaagtcttc

SEQ ID NO: 5556555 - DNA, 21 bp, Homo sapiens
actcctcagtaaaagtcttct

SEQ ID NO: 5556556 - DNA, 16 bp, Homo sapiens
actcctcagtccctct

SEQ ID NO: 5556557 - DNA, 19 bp, Homo sapiens
actcctcccaactctggcc

SEQ ID NO: 5556558 - DNA, 20 bp, Homo sapiens
actcctcccaactctggcct

SEQ ID NO: 5556559 - DNA, 13 bp, Homo sapiens
actcctcccacaa

SEQ ID NO: 5556560 - DNA, 12 bp, Homo sapiens
actcctcccagg

SEQ ID NO: 5556561 - DNA, 21 bp, Homo sapiens
actcctcccagggttttaact

SEQ ID NO: 5556562 - DNA, 23 bp, Homo sapiens
actcctccccaccctcctggcct

SEQ ID NO: 5556563 - DNA, 15 bp, Homo sapiens
actcctccccctcct

SEQ ID NO: 5556564 - DNA, 18 bp, Homo sapiens
actcctccccctcctcca

SEQ ID NO: 5556565 - DNA, 22 bp, Homo sapiens
actcctccccctcctccatgct

SEQ ID NO: 5556566 - DNA, 13 bp, Homo sapiens
actcctccctccg

SEQ ID NO: 5556567 - DNA, 13 bp, Homo sapiens
actcctccctggg

SEQ ID NO: 5556568 - DNA, 15 bp, Homo sapiens
actcctccctggggg

SEQ ID NO: 5556569 - DNA, 16 bp, Homo sapiens
actcctcccttcccca

SEQ ID NO: 5556570 - DNA, 20 bp, Homo sapiens
actcctcccttccccactct

SEQ ID NO: 5556571 - DNA, 14 bp, Homo sapiens
actcctccgtgagc

SEQ ID NO: 5556572 - DNA, 15 bp, Homo sapiens
actcctccgtgagca

SEQ ID NO: 5556573 - DNA, 20 bp, Homo sapiens
actcctccgtgagcaccacc

SEQ ID NO: 5556574 - DNA, 15 bp, Homo sapiens
actcctcctagccac

SEQ ID NO: 5556575 - DNA, 18 bp, Homo sapiens
actcctcctcactaaaaa

SEQ ID NO: 5556576 - DNA, 12 bp, Homo sapiens
actcctcctcca

SEQ ID NO: 5556577 - DNA, 22 bp, Homo sapiens
actcctcctccaaaggccccct

SEQ ID NO: 5556578 - DNA, 14 bp, Homo sapiens
actcctcctccagc

SEQ ID NO: 5556579 - DNA, 21 bp, Homo sapiens
actcctcctcggaagagcccg

SEQ ID NO: 5556580 - DNA, 15 bp, Homo sapiens
actcctcctgccagc

SEQ ID NO: 5556581 - DNA, 17 bp, Homo sapiens
actcctcgggcaagggc

SEQ ID NO: 5556582 - DNA, 23 bp, Homo sapiens
actcctctaagccactcttccaa

SEQ ID NO: 5556583 - DNA, 23 bp, Homo sapiens
actcctctactcttacagagcct

SEQ ID NO: 5556584 - DNA, 14 bp, Homo sapiens
actcctctcccttg

SEQ ID NO: 5556585 - DNA, 18 bp, Homo sapiens
actcctctctagggcaga

SEQ ID NO: 5556586 - DNA, 20 bp, Homo sapiens
actcctctgcgtctatcctg

SEQ ID NO: 5556587 - DNA, 23 bp, Homo sapiens
actcctctgcgtctatcctgtgt

SEQ ID NO: 5556588 - DNA, 21 bp, Homo sapiens
actcctctggctttcccagga

SEQ ID NO: 5556589 - DNA, 12 bp, Homo sapiens
actcctctgggc

SEQ ID NO: 5556590 - DNA, 14 bp, Homo sapiens
actcctctgggcct

SEQ ID NO: 5556591 - DNA, 16 bp, Homo sapiens
actcctctgggcctgg

SEQ ID NO: 5556592 - DNA, 17 bp, Homo sapiens
actcctctgggcctggg

SEQ ID NO: 5556593 - DNA, 13 bp, Homo sapiens
actcctctgtcca

SEQ ID NO: 5556594 - DNA, 14 bp, Homo sapiens
actcctctgtccag

SEQ ID NO: 5556595 - DNA, 12 bp, Homo sapiens
actcctctgtct

SEQ ID NO: 5556596 - DNA, 15 bp, Homo sapiens
actcctctgtctctg

SEQ ID NO: 5556597 - DNA, 17 bp, Homo sapiens
actcctctgtctctgct

SEQ ID NO: 5556598 - DNA, 17 bp, Homo sapiens
actcctcttcccagagt

SEQ ID NO: 5556599 - DNA, 19 bp, Homo sapiens
actcctcttcccagagtca

SEQ ID NO: 5556600 - DNA, 19 bp, Homo sapiens
actcctgaaacctcttcct

SEQ ID NO: 5556601 - DNA, 22 bp, Homo sapiens
actcctgaaatgccaagtgcct

SEQ ID NO: 5556602 - DNA, 19 bp, Homo sapiens
actcctgaaggtctgggtc

SEQ ID NO: 5556603 - DNA, 21 bp, Homo sapiens
actcctgaaggtttcctggtc

SEQ ID NO: 5556604 - DNA, 19 bp, Homo sapiens
actcctgaagtgagtttta

SEQ ID NO: 5556605 - DNA, 22 bp, Homo sapiens
actcctgaattcagttgctttg

SEQ ID NO: 5556606 - DNA, 21 bp, Homo sapiens
actcctgacccctctcctcaa

SEQ ID NO: 5556607 - DNA, 14 bp, Homo sapiens
actcctgacctcag

SEQ ID NO: 5556608 - DNA, 15 bp, Homo sapiens
actcctgacctcagg

SEQ ID NO: 5556609 - DNA, 16 bp, Homo sapiens
actcctgacctcaggc

SEQ ID NO: 5556610 - DNA, 17 bp, Homo sapiens
actcctgacctcaggca

SEQ ID NO: 5556611 - DNA, 17 bp, Homo sapiens
actcctgacctcaggtg

SEQ ID NO: 5556612 - DNA, 12 bp, Homo sapiens
actcctgactcc

SEQ ID NO: 5556613 - DNA, 17 bp, Homo sapiens
actcctgagacccctgg

SEQ ID NO: 5556614 - DNA, 21 bp, Homo sapiens
actcctgagacccctggcctc

SEQ ID NO: 5556615 - DNA, 23 bp, Homo sapiens
actcctgagacccctggcctccg

SEQ ID NO: 5556616 - DNA, 16 bp, Homo sapiens
actcctgaggacagct

SEQ ID NO: 5556617 - DNA, 20 bp, Homo sapiens
actcctgaggacagctgtcc

SEQ ID NO: 5556618 - DNA, 21 bp, Homo sapiens
actcctgaggacagctgtcct

SEQ ID NO: 5556619 - DNA, 23 bp, Homo sapiens
actcctgagtgaggtgttgcagc

SEQ ID NO: 5556620 - DNA, 16 bp, Homo sapiens
actcctgatttttatc

SEQ ID NO: 5556621 - DNA, 13 bp, Homo sapiens
actcctgcaaaat

SEQ ID NO: 5556622 - DNA, 16 bp, Homo sapiens
actcctgcaggcagcc

SEQ ID NO: 5556623 - DNA, 22 bp, Homo sapiens
actcctgcaggcagccaggcca

SEQ ID NO: 5556624 - DNA, 22 bp, Homo sapiens
actcctgcattgttctttgcca

SEQ ID NO: 5556625 - DNA, 14 bp, Homo sapiens
actcctgccagccc

SEQ ID NO: 5556626 - DNA, 23 bp, Homo sapiens
actcctgccagcccggctcggcc

SEQ ID NO: 5556627 - DNA, 15 bp, Homo sapiens
actcctgccaggcac

SEQ ID NO: 5556628 - DNA, 13 bp, Homo sapiens
actcctgccaggg

SEQ ID NO: 5556629 - DNA, 14 bp, Homo sapiens
actcctgccaggga

SEQ ID NO: 5556630 - DNA, 18 bp, Homo sapiens
actcctgccagttgaaaa

SEQ ID NO: 5556631 - DNA, 10 bp, Homo sapiens
actcctgcct

SEQ ID NO: 5556632 - DNA, 13 bp, Homo sapiens
actcctgcctccg

SEQ ID NO: 5556633 - DNA, 14 bp, Homo sapiens
actcctgcctccgc

SEQ ID NO: 5556634 - DNA, 12 bp, Homo sapiens
actcctgcctgt

SEQ ID NO: 5556635 - DNA, 18 bp, Homo sapiens
actcctgcctgtgtttgt

SEQ ID NO: 5556636 - DNA, 13 bp, Homo sapiens
actcctgctctgc

SEQ ID NO: 5556637 - DNA, 15 bp, Homo sapiens
actcctgctctgctc

SEQ ID NO: 5556638 - DNA, 16 bp, Homo sapiens
actcctgctctgctcg

SEQ ID NO: 5556639 - DNA, 18 bp, Homo sapiens
actcctgctgcacaggcc

SEQ ID NO: 5556640 - DNA, 16 bp, Homo sapiens
actcctgctggtacct

SEQ ID NO: 5556641 - DNA, 18 bp, Homo sapiens
actcctgctggtacctgc

SEQ ID NO: 5556642 - DNA, 15 bp, Homo sapiens
actcctgcttctctc

SEQ ID NO: 5556643 - DNA, 12 bp, Homo sapiens
actcctggaaat

SEQ ID NO: 5556644 - DNA, 11 bp, Homo sapiens
actcctggact

SEQ ID NO: 5556645 - DNA, 22 bp, Homo sapiens
actcctggactactttcattga

SEQ ID NO: 5556646 - DNA, 19 bp, Homo sapiens
actcctggactccggagga

SEQ ID NO: 5556647 - DNA, 21 bp, Homo sapiens
actcctggactccggaggact

SEQ ID NO: 5556648 - DNA, 14 bp, Homo sapiens
actcctggagcact

SEQ ID NO: 5556649 - DNA, 18 bp, Homo sapiens
actcctggatccctttca

SEQ ID NO: 5556650 - DNA, 12 bp, Homo sapiens
actcctggcagg

SEQ ID NO: 5556651 - DNA, 20 bp, Homo sapiens
actcctggcagggccacctg

SEQ ID NO: 5556652 - DNA, 13 bp, Homo sapiens
actcctggcctca

SEQ ID NO: 5556653 - DNA, 22 bp, Homo sapiens
actcctggcctcaagccatctt

SEQ ID NO: 5556654 - DNA, 23 bp, Homo sapiens
actcctggctccgcaggggtttg

SEQ ID NO: 5556655 - DNA, 22 bp, Homo sapiens
actcctgggcacccttaatctt

SEQ ID NO: 5556656 - DNA, 23 bp, Homo sapiens
actcctgggttgagctgttgcct

SEQ ID NO: 5556657 - DNA, 23 bp, Homo sapiens
actcctggtaacagtaatacatt

SEQ ID NO: 5556658 - DNA, 23 bp, Homo sapiens
actcctggtcctaggctggaagg

SEQ ID NO: 5556659 - DNA, 20 bp, Homo sapiens
actcctggtgcccctcgcca

SEQ ID NO: 5556660 - DNA, 22 bp, Homo sapiens
actcctggtgcccctcgccagc

SEQ ID NO: 5556661 - DNA, 15 bp, Homo sapiens
actcctgtaattcct

SEQ ID NO: 5556662 - DNA, 13 bp, Homo sapiens
actcctgtacact

SEQ ID NO: 5556663 - DNA, 15 bp, Homo sapiens
actcctgtacactga

SEQ ID NO: 5556664 - DNA, 17 bp, Homo sapiens
actcctgtacactgaat

SEQ ID NO: 5556665 - DNA, 14 bp, Homo sapiens
actcctgtcaccta

SEQ ID NO: 5556666 - DNA, 21 bp, Homo sapiens
actcctgtcccgccttcctcc

SEQ ID NO: 5556667 - DNA, 21 bp, Homo sapiens
actcctgtcccttttccctta

SEQ ID NO: 5556668 - DNA, 15 bp, Homo sapiens
actcctgtcttctgc

SEQ ID NO: 5556669 - DNA, 18 bp, Homo sapiens
actcctgtcttctgcttt

SEQ ID NO: 5556670 - DNA, 16 bp, Homo sapiens
actcctgtcttctttc

SEQ ID NO: 5556671 - DNA, 23 bp, Homo sapiens
actcctgtcttctttctccatgg

SEQ ID NO: 5556672 - DNA, 16 bp, Homo sapiens
actcctgtgctctgga

SEQ ID NO: 5556673 - DNA, 10 bp, Homo sapiens
actcctgtgt

SEQ ID NO: 5556674 - DNA, 16 bp, Homo sapiens
actcctgttacttacc

SEQ ID NO: 5556675 - DNA, 21 bp, Homo sapiens
actcctgttagtagcagaaat

SEQ ID NO: 5556676 - DNA, 23 bp, Homo sapiens
actccttaatatgatctgtggag

SEQ ID NO: 5556677 - DNA, 15 bp, Homo sapiens
actccttattttgta

SEQ ID NO: 5556678 - DNA, 18 bp, Homo sapiens
actccttattttgtatta

SEQ ID NO: 5556679 - DNA, 17 bp, Homo sapiens
actccttcatgtttgga

SEQ ID NO: 5556680 - DNA, 20 bp, Homo sapiens
actccttccccttgtccctg

SEQ ID NO: 5556681 - DNA, 14 bp, Homo sapiens
actccttccctaat

SEQ ID NO: 5556682 - DNA, 14 bp, Homo sapiens
actccttcctcttt

SEQ ID NO: 5556683 - DNA, 22 bp, Homo sapiens
actccttcctctttgcttgggt

SEQ ID NO: 5556684 - DNA, 11 bp, Homo sapiens
actccttcctg

SEQ ID NO: 5556685 - DNA, 13 bp, Homo sapiens
actccttcctgcc

SEQ ID NO: 5556686 - DNA, 20 bp, Homo sapiens
actccttcctgccacctgct

SEQ ID NO: 5556687 - DNA, 16 bp, Homo sapiens
actccttcctggcctg

SEQ ID NO: 5556688 - DNA, 22 bp, Homo sapiens
actccttccttcaggactctgc

SEQ ID NO: 5556689 - DNA, 18 bp, Homo sapiens
actccttgaaatgtgtgt

SEQ ID NO: 5556690 - DNA, 18 bp, Homo sapiens
actccttgagagaccagg

SEQ ID NO: 5556691 - DNA, 21 bp, Homo sapiens
actccttgagagaccaggcaa

SEQ ID NO: 5556692 - DNA, 15 bp, Homo sapiens
actccttgcatcaag

SEQ ID NO: 5556693 - DNA, 13 bp, Homo sapiens
actccttgcttcc

SEQ ID NO: 5556694 - DNA, 14 bp, Homo sapiens
actccttgcttcct

SEQ ID NO: 5556695 - DNA, 16 bp, Homo sapiens
actccttgcttcctga

SEQ ID NO: 5556696 - DNA, 12 bp, Homo sapiens
actccttggcct

SEQ ID NO: 5556697 - DNA, 22 bp, Homo sapiens
actccttggtgctaaagattgt

SEQ ID NO: 5556698 - DNA, 23 bp, Homo sapiens
actcctttacaaccatactttat

SEQ ID NO: 5556699 - DNA, 19 bp, Homo sapiens
actcctttactgcagcctg

SEQ ID NO: 5556700 - DNA, 15 bp, Homo sapiens
actcctttcagccac

SEQ ID NO: 5556701 - DNA, 13 bp, Homo sapiens
actcctttccaat

SEQ ID NO: 5556702 - DNA, 23 bp, Homo sapiens
actcctttccaatagaaagaaac

SEQ ID NO: 5556703 - DNA, 15 bp, Homo sapiens
actcctttcctctga

SEQ ID NO: 5556704 - DNA, 17 bp, Homo sapiens
actcctttcctgcatct

SEQ ID NO: 5556705 - DNA, 14 bp, Homo sapiens
actcctttctcatc

SEQ ID NO: 5556706 - DNA, 19 bp, Homo sapiens
actcctttgctaatgctat

SEQ ID NO: 5556707 - DNA, 23 bp, Homo sapiens
actccttttaaagaaaaaaattg

SEQ ID NO: 5556708 - DNA, 16 bp, Homo sapiens
actcctttttattcat

SEQ ID NO: 5556709 - DNA, 15 bp, Homo sapiens
actcgaaaagagcac

SEQ ID NO: 5556710 - DNA, 18 bp, Homo sapiens
actcgaagcccttccagt

SEQ ID NO: 5556711 - DNA, 15 bp, Homo sapiens
actcgaatctgtgtg

SEQ ID NO: 5556712 - DNA, 19 bp, Homo sapiens
actcgacaaaggccacagg

SEQ ID NO: 5556713 - DNA, 14 bp, Homo sapiens
actcgactaaaaca

SEQ ID NO: 5556714 - DNA, 21 bp, Homo sapiens
actcttcagtgactcctgctg

SEQ ID NO: 5556715 - DNA, 22 bp, Homo sapiens
actcttcagtgactcctgctgg

SEQ ID NO: 5556716 - DNA, 20 bp, Homo sapiens
actcttcagttaagcctttg

SEQ ID NO: 5556717 - DNA, 19 bp, Homo sapiens
actcttccaccagagcagg

SEQ ID NO: 5556718 - DNA, 17 bp, Homo sapiens
actcttccacctctggg

SEQ ID NO: 5556719 - DNA, 17 bp, Homo sapiens
actcttccagaatccca

SEQ ID NO: 5556720 - DNA, 15 bp, Homo sapiens
actcttccatttatt

SEQ ID NO: 5556721 - DNA, 20 bp, Homo sapiens
actcttcccccactcctctt

SEQ ID NO: 5556722 - DNA, 23 bp, Homo sapiens
actcttcccctccctcccacact

SEQ ID NO: 5556723 - DNA, 17 bp, Homo sapiens
actcttccctctcgctc

SEQ ID NO: 5556724 - DNA, 20 bp, Homo sapiens
actcttccgaaaaatcctct

SEQ ID NO: 5556725 - DNA, 18 bp, Homo sapiens
actcttccgatgtttgtg

SEQ ID NO: 5556726 - DNA, 22 bp, Homo sapiens
actcttcctatttttgtagtga

SEQ ID NO: 5556727 - DNA, 19 bp, Homo sapiens
actcttcctcatcctgctt

SEQ ID NO: 5556728 - DNA, 13 bp, Homo sapiens
actcttcctcccc

SEQ ID NO: 5556729 - DNA, 15 bp, Homo sapiens
actcttcctcccctc

SEQ ID NO: 5556730 - DNA, 19 bp, Homo sapiens
actcttcctctaacatttt

SEQ ID NO: 5556731 - DNA, 11 bp, Homo sapiens
actcttcctgt

SEQ ID NO: 5556732 - DNA, 13 bp, Homo sapiens
actcttcctttct

SEQ ID NO: 5556733 - DNA, 14 bp, Homo sapiens
actcttctctcctt

SEQ ID NO: 5556734 - DNA, 15 bp, Homo sapiens
actcttctctccttt

SEQ ID NO: 5556735 - DNA, 14 bp, Homo sapiens
actcttctctctgc

SEQ ID NO: 5556736 - DNA, 15 bp, Homo sapiens
actcttctgactgcc

SEQ ID NO: 5556737 - DNA, 15 bp, Homo sapiens
actcttctgtcttgt

SEQ ID NO: 5556738 - DNA, 16 bp, Homo sapiens
actcttcttgaaattt

SEQ ID NO: 5556739 - DNA, 21 bp, Homo sapiens
actcttgaaaaatgcatgttg

SEQ ID NO: 5556740 - DNA, 16 bp, Homo sapiens
actcttgagttgtttt

SEQ ID NO: 5556741 - DNA, 20 bp, Homo sapiens
actcttgagttgtttttgta

SEQ ID NO: 5556742 - DNA, 14 bp, Homo sapiens
actcttgatgtgaa

SEQ ID NO: 5556743 - DNA, 21 bp, Homo sapiens
actcttgatttcacatttcta

SEQ ID NO: 5556744 - DNA, 15 bp, Homo sapiens
actcttgcggcaagc

SEQ ID NO: 5556745 - DNA, 12 bp, Homo sapiens
actcttgctcac

SEQ ID NO: 5556746 - DNA, 20 bp, Homo sapiens
actcttgctcactccctaaa

SEQ ID NO: 5556747 - DNA, 16 bp, Homo sapiens
actcttgctgatggct

SEQ ID NO: 5556748 - DNA, 23 bp, Homo sapiens
actcttggagcctctttttcctt

SEQ ID NO: 5556749 - DNA, 15 bp, Homo sapiens
actcttggagcctgc

SEQ ID NO: 5556750 - DNA, 15 bp, Homo sapiens
actcttggccagagc

SEQ ID NO: 5556751 - DNA, 16 bp, Homo sapiens
actcttggcctcaagc

SEQ ID NO: 5556752 - DNA, 16 bp, Homo sapiens
actcttggctattgaa

SEQ ID NO: 5556753 - DNA, 18 bp, Homo sapiens
actcttggctattgaaga

SEQ ID NO: 5556754 - DNA, 19 bp, Homo sapiens
actcttgtaagattttgaa

SEQ ID NO: 5556755 - DNA, 20 bp, Homo sapiens
actcttgtaagattttgaaa

SEQ ID NO: 5556756 - DNA, 15 bp, Homo sapiens
actcttgtacaaaag

SEQ ID NO: 5556757 - DNA, 19 bp, Homo sapiens
actcttgtattgctccatt

SEQ ID NO: 5556758 - DNA, 20 bp, Homo sapiens
actcttgtcacccaggctgg

SEQ ID NO: 5556759 - DNA, 21 bp, Homo sapiens
actcttgtcacccaggctgga

SEQ ID NO: 5556760 - DNA, 18 bp, Homo sapiens
actcttgttgaagtgctg

SEQ ID NO: 5556761 - DNA, 20 bp, Homo sapiens
actcttgttgaagtgctgtt

SEQ ID NO: 5556762 - DNA, 21 bp, Homo sapiens
actcttgttgagttctgtaga

SEQ ID NO: 5556763 - DNA, 17 bp, Homo sapiens
actcttgttgcccaggc

SEQ ID NO: 5556764 - DNA, 21 bp, Homo sapiens
actcttgttgcccaggctgga

SEQ ID NO: 5556765 - DNA, 15 bp, Homo sapiens
actcttgtttcctta

SEQ ID NO: 5556766 - DNA, 15 bp, Homo sapiens
actctttaacacatt

SEQ ID NO: 5556767 - DNA, 23 bp, Homo sapiens
actctttaagttgaaaagtaaaa

SEQ ID NO: 5556768 - DNA, 13 bp, Homo sapiens
actctttaataaa

SEQ ID NO: 5556769 - DNA, 15 bp, Homo sapiens
actctttatgcttgc

SEQ ID NO: 5556770 - DNA, 18 bp, Homo sapiens
actctttatgcttgcaaa

SEQ ID NO: 5556771 - DNA, 19 bp, Homo sapiens
actctttatttttctcttt

SEQ ID NO: 5556772 - DNA, 13 bp, Homo sapiens
actctttcaaaac

SEQ ID NO: 5556773 - DNA, 17 bp, Homo sapiens
actctttcaaattatat

SEQ ID NO: 5556774 - DNA, 22 bp, Homo sapiens
actctttcaataaatgtatcat

SEQ ID NO: 5556775 - DNA, 17 bp, Homo sapiens
actctttcatgccattt

SEQ ID NO: 5556776 - DNA, 22 bp, Homo sapiens
actctttcccccaaatcttcct

SEQ ID NO: 5556777 - DNA, 23 bp, Homo sapiens
actctttcccccaaatcttcctc

SEQ ID NO: 5556778 - DNA, 18 bp, Homo sapiens
actctttcctaaagccaa

SEQ ID NO: 5556779 - DNA, 21 bp, Homo sapiens
actctttctctcccctcctct

SEQ ID NO: 5556780 - DNA, 22 bp, Homo sapiens
actctttctgtatatacttttt

SEQ ID NO: 5556781 - DNA, 22 bp, Homo sapiens
actctttcttctctctttgtcc

SEQ ID NO: 5556782 - DNA, 21 bp, Homo sapiens
actctttctttccgttttttt

SEQ ID NO: 5556783 - DNA, 14 bp, Homo sapiens
actctttgaaatga

SEQ ID NO: 5556784 - DNA, 13 bp, Homo sapiens
actctttgaatcg

SEQ ID NO: 5556785 - DNA, 17 bp, Homo sapiens
actctttgaatgacaaa

SEQ ID NO: 5556786 - DNA, 23 bp, Homo sapiens
actctttgacgggaggcctcagt

SEQ ID NO: 5556787 - DNA, 19 bp, Homo sapiens
actctttgagatagaagaa

SEQ ID NO: 5556788 - DNA, 23 bp, Homo sapiens
actctttgagatagaagaactgc

SEQ ID NO: 5556789 - DNA, 12 bp, Homo sapiens
actctttgatat

SEQ ID NO: 5556790 - DNA, 16 bp, Homo sapiens
actctttgatatgcca

SEQ ID NO: 5556791 - DNA, 15 bp, Homo sapiens
actctttgctgttga

SEQ ID NO: 5556792 - DNA, 23 bp, Homo sapiens
actctttgctttgtagtttgctt

SEQ ID NO: 5556793 - DNA, 19 bp, Homo sapiens
actctttggctattgtcct

SEQ ID NO: 5556794 - DNA, 15 bp, Homo sapiens
actctttggctttaa

SEQ ID NO: 5556795 - DNA, 14 bp, Homo sapiens
actctttgttttct

SEQ ID NO: 5556796 - DNA, 15 bp, Homo sapiens
actcttttctatttt

SEQ ID NO: 5556797 - DNA, 13 bp, Homo sapiens
actcttttgatgg

SEQ ID NO: 5556798 - DNA, 21 bp, Homo sapiens
actcttttgatggtggccctg

SEQ ID NO: 5556799 - DNA, 12 bp, Homo sapiens
actcttttgctt

SEQ ID NO: 5556800 - DNA, 20 bp, Homo sapiens
actcttttgctttattccag

SEQ ID NO: 5556801 - DNA, 20 bp, Homo sapiens
actctttttctaaagtgttg

SEQ ID NO: 5556802 - DNA, 11 bp, Homo sapiens
actctttttgg

SEQ ID NO: 5556803 - DNA, 18 bp, Homo sapiens
actctttttgggctcctt

SEQ ID NO: 5556804 - DNA, 14 bp, Homo sapiens
actctttttgtaaa

SEQ ID NO: 5556805 - DNA, 13 bp, Homo sapiens
actctttttgtac

SEQ ID NO: 5556806 - DNA, 16 bp, Homo sapiens
actctttttgtacctg

SEQ ID NO: 5556807 - DNA, 20 bp, Homo sapiens
actctttttgtacctggtga

SEQ ID NO: 5556808 - DNA, 20 bp, Homo sapiens
actcttttttcatggacact

SEQ ID NO: 5556809 - DNA, 23 bp, Homo sapiens
actctttttttgagtgacagctt

SEQ ID NO: 5556810 - DNA, 22 bp, Homo sapiens
actgaaaaaaaaaaaaatccca

SEQ ID NO: 5556811 - DNA, 18 bp, Homo sapiens
actgaaaaaaaaaaagaa

SEQ ID NO: 5556812 - DNA, 22 bp, Homo sapiens
actgaaaaaaaaaaagaagaag

SEQ ID NO: 5556813 - DNA, 24 bp, Homo sapiens
actgaaaaaaaaaaagaagaagaa

SEQ ID NO: 5556814 - DNA, 15 bp, Homo sapiens
actgaaaaaaatgga

SEQ ID NO: 5556815 - DNA, 17 bp, Homo sapiens
actgaaaaaatactacc

SEQ ID NO: 5556816 - DNA, 17 bp, Homo sapiens
actgaaaaaatgctgag

SEQ ID NO: 5556817 - DNA, 15 bp, Homo sapiens
actgaaaaatgtcag

SEQ ID NO: 5556818 - DNA, 16 bp, Homo sapiens
actgaaaaattttatt

SEQ ID NO: 5556819 - DNA, 14 bp, Homo sapiens
actgaaaacataaa

SEQ ID NO: 5556820 - DNA, 17 bp, Homo sapiens
actgaaaacataaaaag

SEQ ID NO: 5556821 - DNA, 18 bp, Homo sapiens
actgaaaacataaaaagt

SEQ ID NO: 5556822 - DNA, 17 bp, Homo sapiens
actgaaaacatctggaa

SEQ ID NO: 5556823 - DNA, 23 bp, Homo sapiens
actgaaaaccagtcttctccctg

SEQ ID NO: 5556824 - DNA, 19 bp, Homo sapiens
actgaaaactgtaaataca

SEQ ID NO: 5556825 - DNA, 16 bp, Homo sapiens
actgaaaacttagcca

SEQ ID NO: 5556826 - DNA, 18 bp, Homo sapiens
actgaaaacttagccaga

SEQ ID NO: 5556827 - DNA, 14 bp, Homo sapiens
actgaaaagagagc

SEQ ID NO: 5556828 - DNA, 17 bp, Homo sapiens
actgaaaagagagcaga

SEQ ID NO: 5556829 - DNA, 16 bp, Homo sapiens
actgaaaagcagcctt

SEQ ID NO: 5556830 - DNA, 13 bp, Homo sapiens
actgaaaaggaaa

SEQ ID NO: 5556831 - DNA, 19 bp, Homo sapiens
actgaaaataccatcaggc

SEQ ID NO: 5556832 - DNA, 16 bp, Homo sapiens
actgaaaatgaatgcc

SEQ ID NO: 5556833 - DNA, 22 bp, Homo sapiens
actgaaaattcgaaccaggaaa

SEQ ID NO: 5556834 - DNA, 18 bp, Homo sapiens
actgaaacaaaaattgtc

SEQ ID NO: 5556835 - DNA, 20 bp, Homo sapiens
actgaaacaaaaattgtctt

SEQ ID NO: 5556836 - DNA, 14 bp, Homo sapiens
actgaaacagattt

SEQ ID NO: 5556837 - DNA, 18 bp, Homo sapiens
actgaaacagatttcata

SEQ ID NO: 5556838 - DNA, 21 bp, Homo sapiens
actgaaacattattttttaat

SEQ ID NO: 5556839 - DNA, 12 bp, Homo sapiens
actgaaaccaaa

SEQ ID NO: 5556840 - DNA, 13 bp, Homo sapiens
actgaaaccattt

SEQ ID NO: 5556841 - DNA, 15 bp, Homo sapiens
actgaaaccattttc

SEQ ID NO: 5556842 - DNA, 17 bp, Homo sapiens
actgaaacctaggaagc

SEQ ID NO: 5556843 - DNA, 17 bp, Homo sapiens
actgaaacctctgcctt

SEQ ID NO: 5556844 - DNA, 14 bp, Homo sapiens
actgaaacctctgt

SEQ ID NO: 5556845 - DNA, 18 bp, Homo sapiens
actgaaacctctgttctc

SEQ ID NO: 5556846 - DNA, 22 bp, Homo sapiens
actgaaacctctgttctcatga

SEQ ID NO: 5556847 - DNA, 22 bp, Homo sapiens
actgaaacctcttcggttgtct

SEQ ID NO: 5556848 - DNA, 18 bp, Homo sapiens
actgaaacgtattcagag

SEQ ID NO: 5556849 - DNA, 22 bp, Homo sapiens
actgaaactatttacaatgtgt

SEQ ID NO: 5556850 - DNA, 14 bp, Homo sapiens
actgaaagaaacta

SEQ ID NO: 5556851 - DNA, 16 bp, Homo sapiens
actgaaagatctctgt

SEQ ID NO: 5556852 - DNA, 21 bp, Homo sapiens
actgaaagatctctgtcacat

SEQ ID NO: 5556853 - DNA, 20 bp, Homo sapiens
actgaaaggcagaactcaga

SEQ ID NO: 5556854 - DNA, 19 bp, Homo sapiens
actgaaaggtagactttta

SEQ ID NO: 5556855 - DNA, 21 bp, Homo sapiens
actgaaaggtgattgcagctt

SEQ ID NO: 5556856 - DNA, 19 bp, Homo sapiens
actgaaaggttgcactcta

SEQ ID NO: 5556857 - DNA, 13 bp, Homo sapiens
actgaaagtggtt

SEQ ID NO: 5556858 - DNA, 20 bp, Homo sapiens
actgaaagtgttttactctt

SEQ ID NO: 5556859 - DNA, 16 bp, Homo sapiens
actgaaagttttgtaa

SEQ ID NO: 5556860 - DNA, 18 bp, Homo sapiens
actgaaagttttgtaaaa

SEQ ID NO: 5556861 - DNA, 18 bp, Homo sapiens
actgaaatagagtgaatt

SEQ ID NO: 5556862 - DNA, 15 bp, Homo sapiens
actgaaatatacaca

SEQ ID NO: 5556863 - DNA, 15 bp, Homo sapiens
actgaaatcttgtaa

SEQ ID NO: 5556864 - DNA, 18 bp, Homo sapiens
actgaaatcttgtaagta

SEQ ID NO: 5556865 - DNA, 17 bp, Homo sapiens
actgaaatgaccaagac

SEQ ID NO: 5556866 - DNA, 17 bp, Homo sapiens
actgaaatgagcatgca

SEQ ID NO: 5556867 - DNA, 20 bp, Homo sapiens
actgaaatgagcatgcattt

SEQ ID NO: 5556868 - DNA, 21 bp, Homo sapiens
actgaaatgccttactttgta

SEQ ID NO: 5556869 - DNA, 17 bp, Homo sapiens
actgaaatgctttagca

SEQ ID NO: 5556870 - DNA, 20 bp, Homo sapiens
actgaaatgtggatgtgatt

SEQ ID NO: 5556871 - DNA, 16 bp, Homo sapiens
actgaaattattttct

SEQ ID NO: 5556872 - DNA, 19 bp, Homo sapiens
actgaaattctaaatattg

SEQ ID NO: 5556873 - DNA, 20 bp, Homo sapiens
actgaaattctaaatattga

SEQ ID NO: 5556874 - DNA, 21 bp, Homo sapiens
actgaaatttgttatacttca

SEQ ID NO: 5556875 - DNA, 18 bp, Homo sapiens
actgaacaaaagctcagg

SEQ ID NO: 5556876 - DNA, 15 bp, Homo sapiens
actgaacacatgtgt

SEQ ID NO: 5556877 - DNA, 20 bp, Homo sapiens
actgaacaccattgaaggct

SEQ ID NO: 5556878 - DNA, 22 bp, Homo sapiens
actgaacaccattgaaggctta

SEQ ID NO: 5556879 - DNA, 18 bp, Homo sapiens
actgaacaggttctcttc

SEQ ID NO: 5556880 - DNA, 19 bp, Homo sapiens
actgaacatctgagtcctg

SEQ ID NO: 5556881 - DNA, 14 bp, Homo sapiens
actgaacatgttta

SEQ ID NO: 5556882 - DNA, 15 bp, Homo sapiens
actgaacatgtttac

SEQ ID NO: 5556883 - DNA, 16 bp, Homo sapiens
actgaacatgtttaca

SEQ ID NO: 5556884 - DNA, 17 bp, Homo sapiens
actgaaccacaaaaaaa

SEQ ID NO: 5556885 - DNA, 23 bp, Homo sapiens
actgaaccacaaaaaaaaaggct

SEQ ID NO: 5556886 - DNA, 12 bp, Homo sapiens
actgaaccactg

SEQ ID NO: 5556887 - DNA, 13 bp, Homo sapiens
actgaaccactgc

SEQ ID NO: 5556888 - DNA, 20 bp, Homo sapiens
actgaaccactgcttctctt

SEQ ID NO: 5556889 - DNA, 21 bp, Homo sapiens
actgaaccactgcttctcttt

SEQ ID NO: 5556890 - DNA, 18 bp, Homo sapiens
actgaaccacttgtagat

SEQ ID NO: 5556891 - DNA, 14 bp, Homo sapiens
actgacctcaccgg

SEQ ID NO: 5556892 - DNA, 21 bp, Homo sapiens
actgacctgaccccattcctg

SEQ ID NO: 5556893 - DNA, 16 bp, Homo sapiens
actgacctgcccatgt

SEQ ID NO: 5556894 - DNA, 19 bp, Homo sapiens
actgacctggttgtccagg

SEQ ID NO: 5556895 - DNA, 22 bp, Homo sapiens
actgacctgtcatgcccccctc

SEQ ID NO: 5556896 - DNA, 17 bp, Homo sapiens
actgaccttaaaactca

SEQ ID NO: 5556897 - DNA, 24 bp, Homo sapiens
actgaccttcggcagtggctgggg

SEQ ID NO: 5556898 - DNA, 15 bp, Homo sapiens
actgaccttgtaaaa

SEQ ID NO: 5556899 - DNA, 14 bp, Homo sapiens
actgacgccagggt

SEQ ID NO: 5556900 - DNA, 13 bp, Homo sapiens
actgacggactca

SEQ ID NO: 5556901 - DNA, 16 bp, Homo sapiens
actgacggactcatga

SEQ ID NO: 5556902 - DNA, 16 bp, Homo sapiens
actgacgtttctgggc

SEQ ID NO: 5556903 - DNA, 23 bp, Homo sapiens
actgacgtttctgggcggccagt

SEQ ID NO: 5556904 - DNA, 14 bp, Homo sapiens
actgactaaccatt

SEQ ID NO: 5556905 - DNA, 16 bp, Homo sapiens
actgactagagtgatg

SEQ ID NO: 5556906 - DNA, 19 bp, Homo sapiens
actgactagagtgatgact

SEQ ID NO: 5556907 - DNA, 20 bp, Homo sapiens
actgactattcttgatgtaa

SEQ ID NO: 5556908 - DNA, 21 bp, Homo sapiens
actgactctggaaaaggcata

SEQ ID NO: 5556909 - DNA, 14 bp, Homo sapiens
actgactctgttat

SEQ ID NO: 5556910 - DNA, 17 bp, Homo sapiens
actgactcttaagaaga

SEQ ID NO: 5556911 - DNA, 18 bp, Homo sapiens
actgactcttaagaagac

SEQ ID NO: 5556912 - DNA, 16 bp, Homo sapiens
actgactgaaatcagt

SEQ ID NO: 5556913 - DNA, 22 bp, Homo sapiens
actgactgaatgctgttaatat

SEQ ID NO: 5556914 - DNA, 17 bp, Homo sapiens
actgactgcagccccct

SEQ ID NO: 5556915 - DNA, 23 bp, Homo sapiens
actgactggatggtccagtgtca

SEQ ID NO: 5556916 - DNA, 21 bp, Homo sapiens
actgacttaatgctcttcaaa

SEQ ID NO: 5556917 - DNA, 13 bp, Homo sapiens
actgacttcacta

SEQ ID NO: 5556918 - DNA, 16 bp, Homo sapiens
actgacttctaagtaa

SEQ ID NO: 5556919 - DNA, 18 bp, Homo sapiens
actgactttctgattact

SEQ ID NO: 5556920 - DNA, 16 bp, Homo sapiens
actgactttgcttgct

SEQ ID NO: 5556921 - DNA, 16 bp, Homo sapiens
actgacttttcttttt

SEQ ID NO: 5556922 - DNA, 19 bp, Homo sapiens
actgactttttccattttt

SEQ ID NO: 5556923 - DNA, 23 bp, Homo sapiens
actgactttttccattttttaaa

SEQ ID NO: 5556924 - DNA, 16 bp, Homo sapiens
actgactttttccccc

SEQ ID NO: 5556925 - DNA, 23 bp, Homo sapiens
actgagaaaacgaaactgctcta

SEQ ID NO: 5556926 - DNA, 15 bp, Homo sapiens
actgagaaatgaatg

SEQ ID NO: 5556927 - DNA, 21 bp, Homo sapiens
actgagaaatttataaacttt

SEQ ID NO: 5556928 - DNA, 19 bp, Homo sapiens
actgagaagatggcactgt

SEQ ID NO: 5556929 - DNA, 14 bp, Homo sapiens
actgagaagatgtt

SEQ ID NO: 5556930 - DNA, 14 bp, Homo sapiens
actgagaagccaag

SEQ ID NO: 5556931 - DNA, 17 bp, Homo sapiens
actgagaagccaagcct

SEQ ID NO: 5556932 - DNA, 20 bp, Homo sapiens
actgagaagccaagcctgga

SEQ ID NO: 5556933 - DNA, 16 bp, Homo sapiens
actgagaaggccccag

SEQ ID NO: 5556934 - DNA, 15 bp, Homo sapiens
actgagaaggctcac

SEQ ID NO: 5556935 - DNA, 23 bp, Homo sapiens
actgagaaggctcacgaagggca

SEQ ID NO: 5556936 - DNA, 19 bp, Homo sapiens
actgagaatctaggccacc

SEQ ID NO: 5556937 - DNA, 16 bp, Homo sapiens
actgagacaatgcctt

SEQ ID NO: 5556938 - DNA, 16 bp, Homo sapiens
actgagacacgatgcc

SEQ ID NO: 5556939 - DNA, 13 bp, Homo sapiens
actgagacagatg

SEQ ID NO: 5556940 - DNA, 18 bp, Homo sapiens
actgagacagcccgggct

SEQ ID NO: 5556941 - DNA, 22 bp, Homo sapiens
actgagacagcccgggctctgc

SEQ ID NO: 5556942 - DNA, 15 bp, Homo sapiens
actgagacaggcagt

SEQ ID NO: 5556943 - DNA, 15 bp, Homo sapiens
actgagacagggtgc

SEQ ID NO: 5556944 - DNA, 16 bp, Homo sapiens
actgagaccttcaggc

SEQ ID NO: 5556945 - DNA, 12 bp, Homo sapiens
actgagacttgt

SEQ ID NO: 5556946 - DNA, 17 bp, Homo sapiens
actgagacttgttcttg

SEQ ID NO: 5556947 - DNA, 17 bp, Homo sapiens
actgagactttcccctc

SEQ ID NO: 5556948 - DNA, 13 bp, Homo sapiens
actgagagaaggt

SEQ ID NO: 5556949 - DNA, 14 bp, Homo sapiens
actgagagaagtac

SEQ ID NO: 5556950 - DNA, 17 bp, Homo sapiens
actgagagatctgctgt

SEQ ID NO: 5556951 - DNA, 18 bp, Homo sapiens
actgagagcctttttgaa

SEQ ID NO: 5556952 - DNA, 19 bp, Homo sapiens
actgagaggaggggtaaat

SEQ ID NO: 5556953 - DNA, 20 bp, Homo sapiens
actgagaggaggggtaaata

SEQ ID NO: 5556954 - DNA, 22 bp, Homo sapiens
actgagaggaggggtaaatata

SEQ ID NO: 5556955 - DNA, 23 bp, Homo sapiens
actgagaggaggggtaaatatat

SEQ ID NO: 5556956 - DNA, 15 bp, Homo sapiens
actgagagtaattca

SEQ ID NO: 5556957 - DNA, 18 bp, Homo sapiens
actgagataccagcgagg

SEQ ID NO: 5556958 - DNA, 18 bp, Homo sapiens
actgagatattattttaa

SEQ ID NO: 5556959 - DNA, 16 bp, Homo sapiens
actgagatgaatgtaa

SEQ ID NO: 5556960 - DNA, 15 bp, Homo sapiens
actgagatgttaaaa

SEQ ID NO: 5556961 - DNA, 17 bp, Homo sapiens
actgagatgttttacca

SEQ ID NO: 5556962 - DNA, 13 bp, Homo sapiens
actgagatttctt

SEQ ID NO: 5556963 - DNA, 14 bp, Homo sapiens
actgagatttctta

SEQ ID NO: 5556964 - DNA, 16 bp, Homo sapiens
actgagatttcttaaa

SEQ ID NO: 5556965 - DNA, 17 bp, Homo sapiens
actgagatttgtaaatc

SEQ ID NO: 5556966 - DNA, 22 bp, Homo sapiens
actgagcaacgctattccagct

SEQ ID NO: 5556967 - DNA, 21 bp, Homo sapiens
actgagcaagaccctgtctct

SEQ ID NO: 5556968 - DNA, 22 bp, Homo sapiens
actgagcaagatcttgtctcca

SEQ ID NO: 5556969 - DNA, 14 bp, Homo sapiens
actgagcaccctct

SEQ ID NO: 5556970 - DNA, 21 bp, Homo sapiens
actgagcaccctctggattct

SEQ ID NO: 5556971 - DNA, 15 bp, Homo sapiens
actgagcactgtttt

SEQ ID NO: 5556972 - DNA, 12 bp, Homo sapiens
actgagcagact

SEQ ID NO: 5556973 - DNA, 14 bp, Homo sapiens
actgagcagactgg

SEQ ID NO: 5556974 - DNA, 12 bp, Homo sapiens
actgagcagccg

SEQ ID NO: 5556975 - DNA, 16 bp, Homo sapiens
actgagcagccgccag

SEQ ID NO: 5556976 - DNA, 20 bp, Homo sapiens
actgagcatcactagtgaca

SEQ ID NO: 5556977 - DNA, 15 bp, Homo sapiens
actgagcatctccag

SEQ ID NO: 5556978 - DNA, 13 bp, Homo sapiens
actgagccaaaaa

SEQ ID NO: 5556979 - DNA, 18 bp, Homo sapiens
actgagccaaacacactg

SEQ ID NO: 5556980 - DNA, 23 bp, Homo sapiens
actgagccaaacacactgtaaat

SEQ ID NO: 5556981 - DNA, 19 bp, Homo sapiens
actgagccatcatttcctg

SEQ ID NO: 5556982 - DNA, 20 bp, Homo sapiens
actgagccccagcgggctgg

SEQ ID NO: 5556983 - DNA, 14 bp, Homo sapiens
actgagccctctca

SEQ ID NO: 5556984 - DNA, 19 bp, Homo sapiens
actgagccctctcactcca

SEQ ID NO: 5556985 - DNA, 23 bp, Homo sapiens
actgagccctctcactccagcca

SEQ ID NO: 5556986 - DNA, 10 bp, Homo sapiens
actgagcctg

SEQ ID NO: 5556987 - DNA, 12 bp, Homo sapiens
actgagcctggc

SEQ ID NO: 5556988 - DNA, 19 bp, Homo sapiens
actgagcctgttcattctg

SEQ ID NO: 5556989 - DNA, 18 bp, Homo sapiens
actgagcgaggaaaaaca

SEQ ID NO: 5556990 - DNA, 18 bp, Homo sapiens
actgagcgcaagccacag

SEQ ID NO: 5556991 - DNA, 21 bp, Homo sapiens
actgagcggccgcagagactg

SEQ ID NO: 5556992 - DNA, 22 bp, Homo sapiens
actgagcggccgcagagactgg

SEQ ID NO: 5556993 - DNA, 19 bp, Homo sapiens
actgagcgtagcatacagg

SEQ ID NO: 5556994 - DNA, 17 bp, Homo sapiens
actgagctcacatggga

SEQ ID NO: 5556995 - DNA, 15 bp, Homo sapiens
actgagctccccaga

SEQ ID NO: 5556996 - DNA, 16 bp, Homo sapiens
actgagctcctctggg

SEQ ID NO: 5556997 - DNA, 17 bp, Homo sapiens
actgagctctccaggcc

SEQ ID NO: 5556998 - DNA, 21 bp, Homo sapiens
actgagctctccaggccaggt

SEQ ID NO: 5556999 - DNA, 15 bp, Homo sapiens
actgagctgaatgtt

SEQ ID NO: 5557000 - DNA, 21 bp, Homo sapiens
actgagctgagaccactgagt

SEQ ID NO: 5557001 - DNA, 21 bp, Homo sapiens
actgagctgctaaaataaacc

SEQ ID NO: 5557002 - DNA, 14 bp, Homo sapiens
actgagctggctga

SEQ ID NO: 5557003 - DNA, 16 bp, Homo sapiens
actgagctggctgact

SEQ ID NO: 5557004 - DNA, 20 bp, Homo sapiens
actgagctgtccagtggagg

SEQ ID NO: 5557005 - DNA, 17 bp, Homo sapiens
actgagctgtgacccag

SEQ ID NO: 5557006 - DNA, 18 bp, Homo sapiens
actgagcttctctgtgaa

SEQ ID NO: 5557007 - DNA, 12 bp, Homo sapiens
actgagcttgga

SEQ ID NO: 5557008 - DNA, 16 bp, Homo sapiens
actgagcttggaagct

SEQ ID NO: 5557009 - DNA, 17 bp, Homo sapiens
actgagcttggaagctt

SEQ ID NO: 5557010 - DNA, 17 bp, Homo sapiens
actgaggaaagggagga

SEQ ID NO: 5557011 - DNA, 21 bp, Homo sapiens
actgaggaaatatttccatta

SEQ ID NO: 5557012 - DNA, 15 bp, Homo sapiens
actgaggaccagcca

SEQ ID NO: 5557013 - DNA, 13 bp, Homo sapiens
actgaggactgtg

SEQ ID NO: 5557014 - DNA, 18 bp, Homo sapiens
actgaggagacagaaagc

SEQ ID NO: 5557015 - DNA, 20 bp, Homo sapiens
actgaggagacagaaagcct

SEQ ID NO: 5557016 - DNA, 22 bp, Homo sapiens
actgaggagacagaaagcctcc

SEQ ID NO: 5557017 - DNA, 20 bp, Homo sapiens
actgaggagatgaccaggga

SEQ ID NO: 5557018 - DNA, 22 bp, Homo sapiens
actgaggagatgaccagggatg

SEQ ID NO: 5557019 - DNA, 18 bp, Homo sapiens
actgaggagtagctgaga

SEQ ID NO: 5557020 - DNA, 19 bp, Homo sapiens
actgaggagtagctgagag

SEQ ID NO: 5557021 - DNA, 22 bp, Homo sapiens
actgaggagtagctgagaggaa

SEQ ID NO: 5557022 - DNA, 23 bp, Homo sapiens
actgaggatattcagatgtatgt

SEQ ID NO: 5557023 - DNA, 16 bp, Homo sapiens
actgaggatgtgagcc

SEQ ID NO: 5557024 - DNA, 21 bp, Homo sapiens
actgaggatttctttttggtt

SEQ ID NO: 5557025 - DNA, 15 bp, Homo sapiens
actgaggcacgagca

SEQ ID NO: 5557026 - DNA, 20 bp, Homo sapiens
actgaggcagtttgaggatt

SEQ ID NO: 5557027 - DNA, 22 bp, Homo sapiens
actgaggccaaaagaggcctga

SEQ ID NO: 5557028 - DNA, 20 bp, Homo sapiens
actgaggccatcagggccct

SEQ ID NO: 5557029 - DNA, 21 bp, Homo sapiens
actgaggccatcagggccctg

SEQ ID NO: 5557030 - DNA, 12 bp, Homo sapiens
actgaggcccac

SEQ ID NO: 5557031 - DNA, 15 bp, Homo sapiens
actgaggcccagaga

SEQ ID NO: 5557032 - DNA, 16 bp, Homo sapiens
actgaggcccagagag

SEQ ID NO: 5557033 - DNA, 17 bp, Homo sapiens
actgaggcccagagagc

SEQ ID NO: 5557034 - DNA, 18 bp, Homo sapiens
actgaggcccagagagct

SEQ ID NO: 5557035 - DNA, 20 bp, Homo sapiens
actgaggcccagagagctga

SEQ ID NO: 5557036 - DNA, 20 bp, Homo sapiens
actgaggcccagagagggaa

SEQ ID NO: 5557037 - DNA, 21 bp, Homo sapiens
actgaggcccagagagggaag

SEQ ID NO: 5557038 - DNA, 14 bp, Homo sapiens
actgaggccctgtg

SEQ ID NO: 5557039 - DNA, 15 bp, Homo sapiens
actgaggccctgtga

SEQ ID NO: 5557040 - DNA, 21 bp, Homo sapiens
actgaggcctgcttccccctc

SEQ ID NO: 5557041 - DNA, 20 bp, Homo sapiens
actgaggccttgtgtgtcag

SEQ ID NO: 5557042 - DNA, 22 bp, Homo sapiens
actgaggccttgtgtgtcaggc

SEQ ID NO: 5557043 - DNA, 17 bp, Homo sapiens
actgaggcttagagaga

SEQ ID NO: 5557044 - DNA, 18 bp, Homo sapiens
actgagggactctgaagc

SEQ ID NO: 5557045 - DNA, 23 bp, Homo sapiens
actgagggattttagcctcttcc

SEQ ID NO: 5557046 - DNA, 12 bp, Homo sapiens
actgagggcaga

SEQ ID NO: 5557047 - DNA, 12 bp, Homo sapiens
actgagggcagt

SEQ ID NO: 5557048 - DNA, 14 bp, Homo sapiens
actgagggcagtgc

SEQ ID NO: 5557049 - DNA, 18 bp, Homo sapiens
actgagggcagtgccctt

SEQ ID NO: 5557050 - DNA, 17 bp, Homo sapiens
actgagggccagggacc

SEQ ID NO: 5557051 - DNA, 18 bp, Homo sapiens
actgagggccagggaccc

SEQ ID NO: 5557052 - DNA, 22 bp, Homo sapiens
actgaggggaggggagcatggg

SEQ ID NO: 5557053 - DNA, 16 bp, Homo sapiens
actgaggggattctct

SEQ ID NO: 5557054 - DNA, 23 bp, Homo sapiens
actgagggggagctgtcttgtca

SEQ ID NO: 5557055 - DNA, 19 bp, Homo sapiens
actgagggggcctggatgc

SEQ ID NO: 5557056 - DNA, 18 bp, Homo sapiens
actgaggggtctccagga

SEQ ID NO: 5557057 - DNA, 17 bp, Homo sapiens
actgaggtcactgggtt

SEQ ID NO: 5557058 - DNA, 19 bp, Homo sapiens
actgaggtcactgggttct

SEQ ID NO: 5557059 - DNA, 16 bp, Homo sapiens
actgaggtgcctgctc

SEQ ID NO: 5557060 - DNA, 23 bp, Homo sapiens
actgaggtgcctgctcaggtgct

SEQ ID NO: 5557061 - DNA, 13 bp, Homo sapiens
actgaggtgctat

SEQ ID NO: 5557062 - DNA, 20 bp, Homo sapiens
actgaggtgctatgaagcca

SEQ ID NO: 5557063 - DNA, 18 bp, Homo sapiens
actgaggtgttattttca

SEQ ID NO: 5557064 - DNA, 21 bp, Homo sapiens
actgaggttcatggattttcc

SEQ ID NO: 5557065 - DNA, 17 bp, Homo sapiens
actgaggtttttttgct

SEQ ID NO: 5557066 - DNA, 14 bp, Homo sapiens
actgagtaaattgg

SEQ ID NO: 5557067 - DNA, 20 bp, Homo sapiens
actgagtaaattggaaacat

SEQ ID NO: 5557068 - DNA, 15 bp, Homo sapiens
actgcaatagagact

SEQ ID NO: 5557069 - DNA, 16 bp, Homo sapiens
actgcaatagagactg

SEQ ID NO: 5557070 - DNA, 22 bp, Homo sapiens
actgcaatagagactgtagatt

SEQ ID NO: 5557071 - DNA, 16 bp, Homo sapiens
actgcaatcactgtgc

SEQ ID NO: 5557072 - DNA, 18 bp, Homo sapiens
actgcaatcactgtgcta

SEQ ID NO: 5557073 - DNA, 21 bp, Homo sapiens
actgcaatcctgtctttctga

SEQ ID NO: 5557074 - DNA, 19 bp, Homo sapiens
actgcaatctctgcctccc

SEQ ID NO: 5557075 - DNA, 12 bp, Homo sapiens
actgcaatgaaa

SEQ ID NO: 5557076 - DNA, 16 bp, Homo sapiens
actgcaatgaaagtca

SEQ ID NO: 5557077 - DNA, 20 bp, Homo sapiens
actgcaatgaaagtcaaatt

SEQ ID NO: 5557078 - DNA, 16 bp, Homo sapiens
actgcaatgtcaaagt

SEQ ID NO: 5557079 - DNA, 15 bp, Homo sapiens
actgcaatgtctgtc

SEQ ID NO: 5557080 - DNA, 15 bp, Homo sapiens
actgcaatgtgatct

SEQ ID NO: 5557081 - DNA, 14 bp, Homo sapiens
actgcaatttccat

SEQ ID NO: 5557082 - DNA, 22 bp, Homo sapiens
actgcaatttccattcttttaa

SEQ ID NO: 5557083 - DNA, 19 bp, Homo sapiens
actgcacaatgaccagcag

SEQ ID NO: 5557084 - DNA, 16 bp, Homo sapiens
actgcacacacagctc

SEQ ID NO: 5557085 - DNA, 14 bp, Homo sapiens
actgcacacagggt

SEQ ID NO: 5557086 - DNA, 16 bp, Homo sapiens
actgcacacagtgact

SEQ ID NO: 5557087 - DNA, 20 bp, Homo sapiens
actgcacacagtgacttcct

SEQ ID NO: 5557088 - DNA, 12 bp, Homo sapiens
actgcacagagc

SEQ ID NO: 5557089 - DNA, 16 bp, Homo sapiens
actgcacagagctctc

SEQ ID NO: 5557090 - DNA, 18 bp, Homo sapiens
actgcacagagctctcca

SEQ ID NO: 5557091 - DNA, 23 bp, Homo sapiens
actgcacagagctctccagctcc

SEQ ID NO: 5557092 - DNA, 15 bp, Homo sapiens
actgcacaggaggag

SEQ ID NO: 5557093 - DNA, 18 bp, Homo sapiens
actgcacaggcagcaagg

SEQ ID NO: 5557094 - DNA, 16 bp, Homo sapiens
actgcacaggtgacaa

SEQ ID NO: 5557095 - DNA, 23 bp, Homo sapiens
actgcacagtgcatctcagccca

SEQ ID NO: 5557096 - DNA, 19 bp, Homo sapiens
actgcacagtgctgttggt

SEQ ID NO: 5557097 - DNA, 20 bp, Homo sapiens
actgcacataatttgcataa

SEQ ID NO: 5557098 - DNA, 17 bp, Homo sapiens
actgcacatgaaagttt

SEQ ID NO: 5557099 - DNA, 17 bp, Homo sapiens
actgcacatgatttcac

SEQ ID NO: 5557100 - DNA, 19 bp, Homo sapiens
actgcaccagttgctgctt

SEQ ID NO: 5557101 - DNA, 18 bp, Homo sapiens
actgcaccatttaaaaac

SEQ ID NO: 5557102 - DNA, 21 bp, Homo sapiens
actgcacccacctacttagat

SEQ ID NO: 5557103 - DNA, 22 bp, Homo sapiens
actgcacccacctacttagata

SEQ ID NO: 5557104 - DNA, 22 bp, Homo sapiens
actgcacccagcatcaccagct

SEQ ID NO: 5557105 - DNA, 13 bp, Homo sapiens
actgcacccagct

SEQ ID NO: 5557106 - DNA, 19 bp, Homo sapiens
actgcacccagctccaggg

SEQ ID NO: 5557107 - DNA, 15 bp, Homo sapiens
actgcacccccctgt

SEQ ID NO: 5557108 - DNA, 18 bp, Homo sapiens
actgcacccccctgtgcc

SEQ ID NO: 5557109 - DNA, 19 bp, Homo sapiens
actgcaccccctcctgctg

SEQ ID NO: 5557110 - DNA, 18 bp, Homo sapiens
actgcacccctgccccca

SEQ ID NO: 5557111 - DNA, 16 bp, Homo sapiens
actgcaccgcctcagg

SEQ ID NO: 5557112 - DNA, 16 bp, Homo sapiens
actgcaccgggccaca

SEQ ID NO: 5557113 - DNA, 16 bp, Homo sapiens
actgcacctgcccagc

SEQ ID NO: 5557114 - DNA, 20 bp, Homo sapiens
actgcacctgcccagctccc

SEQ ID NO: 5557115 - DNA, 16 bp, Homo sapiens
actgcacctgggcagc

SEQ ID NO: 5557116 - DNA, 19 bp, Homo sapiens
actgcacctgggcagctcc

SEQ ID NO: 5557117 - DNA, 20 bp, Homo sapiens
actgcacctgggcagctcct

SEQ ID NO: 5557118 - DNA, 21 bp, Homo sapiens
actgcacctgggcagctcctc

SEQ ID NO: 5557119 - DNA, 12 bp, Homo sapiens
actgcaccttgt

SEQ ID NO: 5557120 - DNA, 20 bp, Homo sapiens
actgcactatagcctaggtg

SEQ ID NO: 5557121 - DNA, 21 bp, Homo sapiens
actgcactatagcctaggtga

SEQ ID NO: 5557122 - DNA, 19 bp, Homo sapiens
actgcactcatagggtgct

SEQ ID NO: 5557123 - DNA, 17 bp, Homo sapiens
actgcactccagcctga

SEQ ID NO: 5557124 - DNA, 18 bp, Homo sapiens
actgcactccagcctggg

SEQ ID NO: 5557125 - DNA, 20 bp, Homo sapiens
actgcactccagcctgggca

SEQ ID NO: 5557126 - DNA, 19 bp, Homo sapiens
actgcactccagcctgggg

SEQ ID NO: 5557127 - DNA, 20 bp, Homo sapiens
actgcactccagcctgggtc

SEQ ID NO: 5557128 - DNA, 17 bp, Homo sapiens
actgcactccagcttgg

SEQ ID NO: 5557129 - DNA, 22 bp, Homo sapiens
actgcactttccaatgccacag

SEQ ID NO: 5557130 - DNA, 14 bp, Homo sapiens
actgcactttcccc

SEQ ID NO: 5557131 - DNA, 19 bp, Homo sapiens
actgcactttcccccttcc

SEQ ID NO: 5557132 - DNA, 15 bp, Homo sapiens
actgcactttgttta

SEQ ID NO: 5557133 - DNA, 18 bp, Homo sapiens
actgcactttgtttagaa

SEQ ID NO: 5557134 - DNA, 17 bp, Homo sapiens
actgcacttttttattg

SEQ ID NO: 5557135 - DNA, 19 bp, Homo sapiens
actgcagaaaccctgagca

SEQ ID NO: 5557136 - DNA, 13 bp, Homo sapiens
actgcagaaagcc

SEQ ID NO: 5557137 - DNA, 12 bp, Homo sapiens
actgcagaacag

SEQ ID NO: 5557138 - DNA, 13 bp, Homo sapiens
actgcagaagcaa

SEQ ID NO: 5557139 - DNA, 18 bp, Homo sapiens
actgcagacctgtcctcc

SEQ ID NO: 5557140 - DNA, 21 bp, Homo sapiens
actgcagacctgtcctcctgg

SEQ ID NO: 5557141 - DNA, 23 bp, Homo sapiens
actgcagacctgtcctcctggtg

SEQ ID NO: 5557142 - DNA, 22 bp, Homo sapiens
actgcagacgggaatgcctagg

SEQ ID NO: 5557143 - DNA, 12 bp, Homo sapiens
actgcagagact

SEQ ID NO: 5557144 - DNA, 21 bp, Homo sapiens
actgcagaggggaaagacttc

SEQ ID NO: 5557145 - DNA, 20 bp, Homo sapiens
actgcagagtaaattgctct

SEQ ID NO: 5557146 - DNA, 19 bp, Homo sapiens
actgcagatagcccaggag

SEQ ID NO: 5557147 - DNA, 20 bp, Homo sapiens
actgcagatagcccaggagc

SEQ ID NO: 5557148 - DNA, 22 bp, Homo sapiens
actgcagcacctccaggcctgt

SEQ ID NO: 5557149 - DNA, 20 bp, Homo sapiens
actgcagcatgcccagtgcc

SEQ ID NO: 5557150 - DNA, 13 bp, Homo sapiens
actgcagcccagg

SEQ ID NO: 5557151 - DNA, 14 bp, Homo sapiens
actgcagcccagga

SEQ ID NO: 5557152 - DNA, 21 bp, Homo sapiens
actgcagccctctccaccctc

SEQ ID NO: 5557153 - DNA, 23 bp, Homo sapiens
actgcagcctcaacctcctgggc

SEQ ID NO: 5557154 - DNA, 22 bp, Homo sapiens
actgcagcctccgcttccctgg

SEQ ID NO: 5557155 - DNA, 21 bp, Homo sapiens
actgcagcctcgaactcctgg

SEQ ID NO: 5557156 - DNA, 22 bp, Homo sapiens
actgcagcctcgaactcctggg

SEQ ID NO: 5557157 - DNA, 13 bp, Homo sapiens
actgcagcctctc

SEQ ID NO: 5557158 - DNA, 17 bp, Homo sapiens
actgcagcctctctggc

SEQ ID NO: 5557159 - DNA, 16 bp, Homo sapiens
actgcagctgcaccag

SEQ ID NO: 5557160 - DNA, 11 bp, Homo sapiens
actgcagctgt

SEQ ID NO: 5557161 - DNA, 12 bp, Homo sapiens
actgcagctgtg

SEQ ID NO: 5557162 - DNA, 20 bp, Homo sapiens
actgcagcttgagtttttag

SEQ ID NO: 5557163 - DNA, 15 bp, Homo sapiens
actgcaggaatgctg

SEQ ID NO: 5557164 - DNA, 18 bp, Homo sapiens
actgcaggaatgctgaca

SEQ ID NO: 5557165 - DNA, 23 bp, Homo sapiens
actgcaggagcagtttgccaccc

SEQ ID NO: 5557166 - DNA, 12 bp, Homo sapiens
actgcaggcccc

SEQ ID NO: 5557167 - DNA, 16 bp, Homo sapiens
actgcaggccctggcc

SEQ ID NO: 5557168 - DNA, 17 bp, Homo sapiens
actgcaggccctggcct

SEQ ID NO: 5557169 - DNA, 22 bp, Homo sapiens
actgcaggccctggcctcccct

SEQ ID NO: 5557170 - DNA, 10 bp, Homo sapiens
actgcaggga

SEQ ID NO: 5557171 - DNA, 16 bp, Homo sapiens
actgcagggactgcca

SEQ ID NO: 5557172 - DNA, 17 bp, Homo sapiens
actgcagggactgccag

SEQ ID NO: 5557173 - DNA, 13 bp, Homo sapiens
actgcagggccag

SEQ ID NO: 5557174 - DNA, 12 bp, Homo sapiens
actgcagggcct

SEQ ID NO: 5557175 - DNA, 22 bp, Homo sapiens
actgcagggcctatatgccagc

SEQ ID NO: 5557176 - DNA, 14 bp, Homo sapiens
actgcagggctgct

SEQ ID NO: 5557177 - DNA, 19 bp, Homo sapiens
actgcagggctgctgtggc

SEQ ID NO: 5557178 - DNA, 14 bp, Homo sapiens
actgcagggttcaa

SEQ ID NO: 5557179 - DNA, 17 bp, Homo sapiens
actgcaggtcaagttgt

SEQ ID NO: 5557180 - DNA, 21 bp, Homo sapiens
actgcaggtggcctccctcca

SEQ ID NO: 5557181 - DNA, 21 bp, Homo sapiens
actgcaggtgggctgggccca

SEQ ID NO: 5557182 - DNA, 17 bp, Homo sapiens
actgcaggttggacccc

SEQ ID NO: 5557183 - DNA, 19 bp, Homo sapiens
actgcagtaacactggcct

SEQ ID NO: 5557184 - DNA, 13 bp, Homo sapiens
actgcagtcagat

SEQ ID NO: 5557185 - DNA, 21 bp, Homo sapiens
actgcagtcatcaacaatgat

SEQ ID NO: 5557186 - DNA, 20 bp, Homo sapiens
actgcagtcggcatgccagg

SEQ ID NO: 5557187 - DNA, 21 bp, Homo sapiens
actgcagtcggcatgccagga

SEQ ID NO: 5557188 - DNA, 21 bp, Homo sapiens
actgcagtgaaagacaagctg

SEQ ID NO: 5557189 - DNA, 11 bp, Homo sapiens
actgcagtgac

SEQ ID NO: 5557190 - DNA, 23 bp, Homo sapiens
actgcagtgatgtatacatctta

SEQ ID NO: 5557191 - DNA, 22 bp, Homo sapiens
actgcagttatttaccagaagt

SEQ ID NO: 5557192 - DNA, 14 bp, Homo sapiens
actgcagtttcctg

SEQ ID NO: 5557193 - DNA, 16 bp, Homo sapiens
actgcataaatgaata

SEQ ID NO: 5557194 - DNA, 16 bp, Homo sapiens
actgcatactttttaa

SEQ ID NO: 5557195 - DNA, 18 bp, Homo sapiens
actgcatatcggaggtgg

SEQ ID NO: 5557196 - DNA, 15 bp, Homo sapiens
actgcatcaagactt

SEQ ID NO: 5557197 - DNA, 14 bp, Homo sapiens
actgcatcatatat

SEQ ID NO: 5557198 - DNA, 19 bp, Homo sapiens
actgcatccaggcctgagg

SEQ ID NO: 5557199 - DNA, 14 bp, Homo sapiens
actgcatctggatt

SEQ ID NO: 5557200 - DNA, 21 bp, Homo sapiens
actgcatgcaaacaagaaacg

SEQ ID NO: 5557201 - DNA, 14 bp, Homo sapiens
actgcatgcaagct

SEQ ID NO: 5557202 - DNA, 15 bp, Homo sapiens
actgcatgcaagctc

SEQ ID NO: 5557203 - DNA, 12 bp, Homo sapiens
actgcatgcact

SEQ ID NO: 5557204 - DNA, 14 bp, Homo sapiens
actgcatgcccaga

SEQ ID NO: 5557205 - DNA, 17 bp, Homo sapiens
actgcatgcccagagac

SEQ ID NO: 5557206 - DNA, 17 bp, Homo sapiens
actgcatggggaggcag

SEQ ID NO: 5557207 - DNA, 18 bp, Homo sapiens
actgcatggggaggcagc

SEQ ID NO: 5557208 - DNA, 16 bp, Homo sapiens
actgcatggtaattta

SEQ ID NO: 5557209 - DNA, 20 bp, Homo sapiens
actgcatgtataaatgaagt

SEQ ID NO: 5557210 - DNA, 16 bp, Homo sapiens
actgcatgtcagagca

SEQ ID NO: 5557211 - DNA, 16 bp, Homo sapiens
actgcatgtttgctgt

SEQ ID NO: 5557212 - DNA, 16 bp, Homo sapiens
actgcattagaaacca

SEQ ID NO: 5557213 - DNA, 19 bp, Homo sapiens
actgcattcattctgagcc

SEQ ID NO: 5557214 - DNA, 20 bp, Homo sapiens
actgcattcattctgagccc

SEQ ID NO: 5557215 - DNA, 22 bp, Homo sapiens
actgcatttaaatttgatttcc

SEQ ID NO: 5557216 - DNA, 14 bp, Homo sapiens
actgcatttaggga

SEQ ID NO: 5557217 - DNA, 19 bp, Homo sapiens
actgcatttagggagtatt

SEQ ID NO: 5557218 - DNA, 18 bp, Homo sapiens
actgcatttgcctgcttc

SEQ ID NO: 5557219 - DNA, 21 bp, Homo sapiens
actgcatttgcctgcttcttt

SEQ ID NO: 5557220 - DNA, 22 bp, Homo sapiens
actgcatttggggcctttccca

SEQ ID NO: 5557221 - DNA, 10 bp, Homo sapiens
actgcatttt

SEQ ID NO: 5557222 - DNA, 12 bp, Homo sapiens
actgcattttag

SEQ ID NO: 5557223 - DNA, 12 bp, Homo sapiens
actgcattttca

SEQ ID NO: 5557224 - DNA, 13 bp, Homo sapiens
actgcattttcac

SEQ ID NO: 5557225 - DNA, 17 bp, Homo sapiens
actgcattttcacaaca

SEQ ID NO: 5557226 - DNA, 19 bp, Homo sapiens
actgcattttcacaacata

SEQ ID NO: 5557227 - DNA, 22 bp, Homo sapiens
actgcattttcacaacatatca

SEQ ID NO: 5557228 - DNA, 17 bp, Homo sapiens
actgccaaaaatagaaa

SEQ ID NO: 5557229 - DNA, 15 bp, Homo sapiens
actgccaaaacaatg

SEQ ID NO: 5557230 - DNA, 15 bp, Homo sapiens
actgccaaaacattt

SEQ ID NO: 5557231 - DNA, 15 bp, Homo sapiens
actgccaaacctcct

SEQ ID NO: 5557232 - DNA, 16 bp, Homo sapiens
actgccaaataaaatg

SEQ ID NO: 5557233 - DNA, 17 bp, Homo sapiens
actgccaaataaaatgt

SEQ ID NO: 5557234 - DNA, 15 bp, Homo sapiens
actgccaaataaaca

SEQ ID NO: 5557235 - DNA, 20 bp, Homo sapiens
actgccaaataaacagctat

SEQ ID NO: 5557236 - DNA, 20 bp, Homo sapiens
actgccaagactgctgtggc

SEQ ID NO: 5557237 - DNA, 16 bp, Homo sapiens
actgccaagagccgac

SEQ ID NO: 5557238 - DNA, 12 bp, Homo sapiens
actgccaagcca

SEQ ID NO: 5557239 - DNA, 16 bp, Homo sapiens
actgccaagcttcctg

SEQ ID NO: 5557240 - DNA, 20 bp, Homo sapiens
actgccaagcttcctgtgcc

SEQ ID NO: 5557241 - DNA, 22 bp, Homo sapiens
actgccaagcttcctgtgccct

SEQ ID NO: 5557242 - DNA, 23 bp, Homo sapiens
actgccaagcttcctgtgccctc

SEQ ID NO: 5557243 - DNA, 12 bp, Homo sapiens
actgccaagggt

SEQ ID NO: 5557244 - DNA, 18 bp, Homo sapiens
actgccaagggtgctggt

SEQ ID NO: 5557245 - DNA, 14 bp, Homo sapiens
actgccacaagcac

SEQ ID NO: 5557246 - DNA, 15 bp, Homo sapiens
actgcttctcggcca

SEQ ID NO: 5557247 - DNA, 19 bp, Homo sapiens
actgcttctcggccagccc

SEQ ID NO: 5557248 - DNA, 20 bp, Homo sapiens
actgcttctcggccagcccg

SEQ ID NO: 5557249 - DNA, 17 bp, Homo sapiens
actgcttctctttgtgc

SEQ ID NO: 5557250 - DNA, 23 bp, Homo sapiens
actgcttgaggaggggcacctgc

SEQ ID NO: 5557251 - DNA, 24 bp, Homo sapiens
actgcttgaggaggggcacctgcc

SEQ ID NO: 5557252 - DNA, 23 bp, Homo sapiens
actgcttgatgaagcaaggaaga

SEQ ID NO: 5557253 - DNA, 15 bp, Homo sapiens
actgcttgattttaa

SEQ ID NO: 5557254 - DNA, 11 bp, Homo sapiens
actgcttgcat

SEQ ID NO: 5557255 - DNA, 22 bp, Homo sapiens
actgcttgctaccaatctgtga

SEQ ID NO: 5557256 - DNA, 22 bp, Homo sapiens
actgcttgcttacaatctttat

SEQ ID NO: 5557257 - DNA, 13 bp, Homo sapiens
actgcttggagct

SEQ ID NO: 5557258 - DNA, 21 bp, Homo sapiens
actgcttgtgaaaggaaagag

SEQ ID NO: 5557259 - DNA, 16 bp, Homo sapiens
actgcttgtttcctag

SEQ ID NO: 5557260 - DNA, 15 bp, Homo sapiens
actgctttattttta

SEQ ID NO: 5557261 - DNA, 13 bp, Homo sapiens
actgctttcaagt

SEQ ID NO: 5557262 - DNA, 19 bp, Homo sapiens
actgctttcagtgcctgct

SEQ ID NO: 5557263 - DNA, 20 bp, Homo sapiens
actgctttccagcctgggca

SEQ ID NO: 5557264 - DNA, 16 bp, Homo sapiens
actgctttctgttcca

SEQ ID NO: 5557265 - DNA, 17 bp, Homo sapiens
actgctttctgttccaa

SEQ ID NO: 5557266 - DNA, 16 bp, Homo sapiens
actgctttgcaaagac

SEQ ID NO: 5557267 - DNA, 17 bp, Homo sapiens
actgcttttaaatgacc

SEQ ID NO: 5557268 - DNA, 20 bp, Homo sapiens
actgcttttaacttctgata

SEQ ID NO: 5557269 - DNA, 22 bp, Homo sapiens
actgcttttcctcaagcaataa

SEQ ID NO: 5557270 - DNA, 17 bp, Homo sapiens
actgcttttggcctgga

SEQ ID NO: 5557271 - DNA, 16 bp, Homo sapiens
actgcttttggtctgt

SEQ ID NO: 5557272 - DNA, 23 bp, Homo sapiens
actgcttttgtagtgtgttttca

SEQ ID NO: 5557273 - DNA, 20 bp, Homo sapiens
actgcttttttgattctgaa

SEQ ID NO: 5557274 - DNA, 21 bp, Homo sapiens
actgcttttttttttccagca

SEQ ID NO: 5557275 - DNA, 17 bp, Homo sapiens
actggaaaaatgaactg

SEQ ID NO: 5557276 - DNA, 16 bp, Homo sapiens
actggaaaacagaaca

SEQ ID NO: 5557277 - DNA, 19 bp, Homo sapiens
actggaaaacagaacactt

SEQ ID NO: 5557278 - DNA, 20 bp, Homo sapiens
actggaaaacagaacactta

SEQ ID NO: 5557279 - DNA, 23 bp, Homo sapiens
actggaaaacagaacacttatgt

SEQ ID NO: 5557280 - DNA, 17 bp, Homo sapiens
actggaaaacatagagt

SEQ ID NO: 5557281 - DNA, 21 bp, Homo sapiens
actggaaacatctgatttctg

SEQ ID NO: 5557282 - DNA, 15 bp, Homo sapiens
actggaaaggaaaga

SEQ ID NO: 5557283 - DNA, 15 bp, Homo sapiens
actggaaaggggaga

SEQ ID NO: 5557284 - DNA, 21 bp, Homo sapiens
actggaaaggggagagcctgc

SEQ ID NO: 5557285 - DNA, 22 bp, Homo sapiens
actggaaattccaggaaccaaa

SEQ ID NO: 5557286 - DNA, 22 bp, Homo sapiens
actggaacactagacaagccag

SEQ ID NO: 5557287 - DNA, 15 bp, Homo sapiens
actggaaccagggag

SEQ ID NO: 5557288 - DNA, 14 bp, Homo sapiens
actggaaccctttt

SEQ ID NO: 5557289 - DNA, 16 bp, Homo sapiens
actggaacccttttaa

SEQ ID NO: 5557290 - DNA, 15 bp, Homo sapiens
actggaacctccctg

SEQ ID NO: 5557291 - DNA, 18 bp, Homo sapiens
actggaacggtgaaggtg

SEQ ID NO: 5557292 - DNA, 12 bp, Homo sapiens
actggaactctc

SEQ ID NO: 5557293 - DNA, 14 bp, Homo sapiens
actggaagcacagc

SEQ ID NO: 5557294 - DNA, 19 bp, Homo sapiens
actggaagcacagcctcgg

SEQ ID NO: 5557295 - DNA, 20 bp, Homo sapiens
actggaagcatgtaggagaa

SEQ ID NO: 5557296 - DNA, 17 bp, Homo sapiens
actggaagccttccccc

SEQ ID NO: 5557297 - DNA, 20 bp, Homo sapiens
actggaagctaatttgcatt

SEQ ID NO: 5557298 - DNA, 20 bp, Homo sapiens
actggaagctttgtagaaat

SEQ ID NO: 5557299 - DNA, 14 bp, Homo sapiens
actggaaggagcac

SEQ ID NO: 5557300 - DNA, 20 bp, Homo sapiens
actggaaggctttattcttc

SEQ ID NO: 5557301 - DNA, 20 bp, Homo sapiens
actggaagttcatacctaag

SEQ ID NO: 5557302 - DNA, 22 bp, Homo sapiens
actggaagttcatacctaagta

SEQ ID NO: 5557303 - DNA, 13 bp, Homo sapiens
actggaagttgtg

SEQ ID NO: 5557304 - DNA, 13 bp, Homo sapiens
actggaagttttg

SEQ ID NO: 5557305 - DNA, 16 bp, Homo sapiens
actggaagttttgcat

SEQ ID NO: 5557306 - DNA, 17 bp, Homo sapiens
actggaagttttgcatt

SEQ ID NO: 5557307 - DNA, 16 bp, Homo sapiens
actggaataagccttc

SEQ ID NO: 5557308 - DNA, 20 bp, Homo sapiens
actggaataagccttcgaaa

SEQ ID NO: 5557309 - DNA, 19 bp, Homo sapiens
actggaataatttgtaaat

SEQ ID NO: 5557310 - DNA, 20 bp, Homo sapiens
actggaataatttgtaaatg

SEQ ID NO: 5557311 - DNA, 21 bp, Homo sapiens
actggaataatttgtaaatga

SEQ ID NO: 5557312 - DNA, 19 bp, Homo sapiens
actggaatataaaacagtc

SEQ ID NO: 5557313 - DNA, 16 bp, Homo sapiens
actggaatatctgaga

SEQ ID NO: 5557314 - DNA, 17 bp, Homo sapiens
actggaatcctttcagc

SEQ ID NO: 5557315 - DNA, 21 bp, Homo sapiens
actggaatcgatctgtactgt

SEQ ID NO: 5557316 - DNA, 22 bp, Homo sapiens
actggaatggtgttttgtcaga

SEQ ID NO: 5557317 - DNA, 17 bp, Homo sapiens
actggaattcaaagata

SEQ ID NO: 5557318 - DNA, 20 bp, Homo sapiens
actggaattttgctttatca

SEQ ID NO: 5557319 - DNA, 23 bp, Homo sapiens
actggaattttgctttatcagaa

SEQ ID NO: 5557320 - DNA, 18 bp, Homo sapiens
actggaatttttattatg

SEQ ID NO: 5557321 - DNA, 14 bp, Homo sapiens
actggacaaagaat

SEQ ID NO: 5557322 - DNA, 21 bp, Homo sapiens
actggacacaaacaggaatgt

SEQ ID NO: 5557323 - DNA, 23 bp, Homo sapiens
actggacacaaacaggaatgtct

SEQ ID NO: 5557324 - DNA, 23 bp, Homo sapiens
actggacacactaaactctgggg

SEQ ID NO: 5557325 - DNA, 16 bp, Homo sapiens
actggacagacccagg

SEQ ID NO: 5557326 - DNA, 22 bp, Homo sapiens
actggacagacccaggtcttcc

SEQ ID NO: 5557327 - DNA, 17 bp, Homo sapiens
actggacagcatcagaa

SEQ ID NO: 5557328 - DNA, 17 bp, Homo sapiens
actggacagccagggca

SEQ ID NO: 5557329 - DNA, 22 bp, Homo sapiens
actggacagcctcttctgtccc

SEQ ID NO: 5557330 - DNA, 18 bp, Homo sapiens
actggacagtcactgcca

SEQ ID NO: 5557331 - DNA, 17 bp, Homo sapiens
actggacatcacagcag

SEQ ID NO: 5557332 - DNA, 16 bp, Homo sapiens
actggacatgaaggaa

SEQ ID NO: 5557333 - DNA, 15 bp, Homo sapiens
actggaccagacaat

SEQ ID NO: 5557334 - DNA, 14 bp, Homo sapiens
actggaccaggtcc

SEQ ID NO: 5557335 - DNA, 13 bp, Homo sapiens
actggaccccact

SEQ ID NO: 5557336 - DNA, 16 bp, Homo sapiens
actggaccccactggc

SEQ ID NO: 5557337 - DNA, 19 bp, Homo sapiens
actggaccccactggctga

SEQ ID NO: 5557338 - DNA, 22 bp, Homo sapiens
actggacccccagcccccaggg

SEQ ID NO: 5557339 - DNA, 15 bp, Homo sapiens
actggaccctgttgc

SEQ ID NO: 5557340 - DNA, 16 bp, Homo sapiens
actggaccctgttgct

SEQ ID NO: 5557341 - DNA, 19 bp, Homo sapiens
actggaccctgttgctaag

SEQ ID NO: 5557342 - DNA, 23 bp, Homo sapiens
actggacccttgattcattctga

SEQ ID NO: 5557343 - DNA, 19 bp, Homo sapiens
actggaccgctgactgcac

SEQ ID NO: 5557344 - DNA, 14 bp, Homo sapiens
actggactagtgaa

SEQ ID NO: 5557345 - DNA, 21 bp, Homo sapiens
actggactatagcagggctgg

SEQ ID NO: 5557346 - DNA, 19 bp, Homo sapiens
actggactcttcaaaaact

SEQ ID NO: 5557347 - DNA, 13 bp, Homo sapiens
actggactgcatg

SEQ ID NO: 5557348 - DNA, 15 bp, Homo sapiens
actggactgggtttt

SEQ ID NO: 5557349 - DNA, 15 bp, Homo sapiens
actggacttgaatgg

SEQ ID NO: 5557350 - DNA, 18 bp, Homo sapiens
actggagacaatgcagat

SEQ ID NO: 5557351 - DNA, 21 bp, Homo sapiens
actggagacaatgcagatgcc

SEQ ID NO: 5557352 - DNA, 23 bp, Homo sapiens
actggagaccgcttcacccctgc

SEQ ID NO: 5557353 - DNA, 13 bp, Homo sapiens
actggagactgtg

SEQ ID NO: 5557354 - DNA, 14 bp, Homo sapiens
actggagagcaaca

SEQ ID NO: 5557355 - DNA, 22 bp, Homo sapiens
actggagataccagagactctg

SEQ ID NO: 5557356 - DNA, 22 bp, Homo sapiens
actggagatgcatcgggaaaga

SEQ ID NO: 5557357 - DNA, 16 bp, Homo sapiens
actggagcaccaggca

SEQ ID NO: 5557358 - DNA, 13 bp, Homo sapiens
actggagcactga

SEQ ID NO: 5557359 - DNA, 13 bp, Homo sapiens
actggagcatctg

SEQ ID NO: 5557360 - DNA, 15 bp, Homo sapiens
actggagctcatctg

SEQ ID NO: 5557361 - DNA, 23 bp, Homo sapiens
actggagctgctaagctaaagaa

SEQ ID NO: 5557362 - DNA, 23 bp, Homo sapiens
actggagcttttaaaaatgtttg

SEQ ID NO: 5557363 - DNA, 15 bp, Homo sapiens
actggaggagcagct

SEQ ID NO: 5557364 - DNA, 16 bp, Homo sapiens
actggaggagcagctt

SEQ ID NO: 5557365 - DNA, 20 bp, Homo sapiens
actggaggaggcctgtccca

SEQ ID NO: 5557366 - DNA, 17 bp, Homo sapiens
actggaggcatttcttt

SEQ ID NO: 5557367 - DNA, 18 bp, Homo sapiens
actggaggcccctggagc

SEQ ID NO: 5557368 - DNA, 13 bp, Homo sapiens
actggaggcctct

SEQ ID NO: 5557369 - DNA, 14 bp, Homo sapiens
actggaggcctctg

SEQ ID NO: 5557370 - DNA, 19 bp, Homo sapiens
actggaggcctctgcaaga

SEQ ID NO: 5557371 - DNA, 22 bp, Homo sapiens
actggaggggacgctggtagag

SEQ ID NO: 5557372 - DNA, 18 bp, Homo sapiens
actggaggggcccaccca

SEQ ID NO: 5557373 - DNA, 22 bp, Homo sapiens
actggaggggtcatccttgccc

SEQ ID NO: 5557374 - DNA, 21 bp, Homo sapiens
actggaggtacaaataattta

SEQ ID NO: 5557375 - DNA, 20 bp, Homo sapiens
actggaggtcacattcagga

SEQ ID NO: 5557376 - DNA, 21 bp, Homo sapiens
actggaggtcacattcaggaa

SEQ ID NO: 5557377 - DNA, 16 bp, Homo sapiens
actggagtcagatgag

SEQ ID NO: 5557378 - DNA, 13 bp, Homo sapiens
actggagtctgga

SEQ ID NO: 5557379 - DNA, 15 bp, Homo sapiens
actggagtctggagt

SEQ ID NO: 5557380 - DNA, 19 bp, Homo sapiens
actggagtgaggcttccag

SEQ ID NO: 5557381 - DNA, 17 bp, Homo sapiens
actggagtgcagggagg

SEQ ID NO: 5557382 - DNA, 18 bp, Homo sapiens
actggagtgcagggagga

SEQ ID NO: 5557383 - DNA, 15 bp, Homo sapiens
actggagtgcagtgg

SEQ ID NO: 5557384 - DNA, 17 bp, Homo sapiens
actggagtgtgcgtggt

SEQ ID NO: 5557385 - DNA, 16 bp, Homo sapiens
actggagttacattaa

SEQ ID NO: 5557386 - DNA, 11 bp, Homo sapiens
actggagttca

SEQ ID NO: 5557387 - DNA, 15 bp, Homo sapiens
actggagttcacttt

SEQ ID NO: 5557388 - DNA, 21 bp, Homo sapiens
actggagttccttatccctct

SEQ ID NO: 5557389 - DNA, 23 bp, Homo sapiens
actggagttccttatccctctct

SEQ ID NO: 5557390 - DNA, 15 bp, Homo sapiens
actggagttctatgc

SEQ ID NO: 5557391 - DNA, 20 bp, Homo sapiens
actggataaacttgcttcag

SEQ ID NO: 5557392 - DNA, 13 bp, Homo sapiens
actggataaattg

SEQ ID NO: 5557393 - DNA, 18 bp, Homo sapiens
actggataaattgtttag

SEQ ID NO: 5557394 - DNA, 15 bp, Homo sapiens
actggataaatttaa

SEQ ID NO: 5557395 - DNA, 14 bp, Homo sapiens
actggatagaaaaa

SEQ ID NO: 5557396 - DNA, 17 bp, Homo sapiens
actggatatttcaatct

SEQ ID NO: 5557397 - DNA, 22 bp, Homo sapiens
actggatatttcaatcttttaa

SEQ ID NO: 5557398 - DNA, 18 bp, Homo sapiens
actggatctcttaagaca

SEQ ID NO: 5557399 - DNA, 10 bp, Homo sapiens
actggatctt

SEQ ID NO: 5557400 - DNA, 10 bp, Homo sapiens
actggatgaa

SEQ ID NO: 5557401 - DNA, 20 bp, Homo sapiens
actggatgcttacagtgact

SEQ ID NO: 5557402 - DNA, 15 bp, Homo sapiens
actggatggaaagac

SEQ ID NO: 5557403 - DNA, 16 bp, Homo sapiens
actggatggtccagtg

SEQ ID NO: 5557404 - DNA, 13 bp, Homo sapiens
actggatgtccag

SEQ ID NO: 5557405 - DNA, 18 bp, Homo sapiens
actggatgtttctcatgt

SEQ ID NO: 5557406 - DNA, 12 bp, Homo sapiens
actggattaaaa

SEQ ID NO: 5557407 - DNA, 15 bp, Homo sapiens
actggattaaactta

SEQ ID NO: 5557408 - DNA, 14 bp, Homo sapiens
actggattggccaa

SEQ ID NO: 5557409 - DNA, 17 bp, Homo sapiens
actggcaaacagggcct

SEQ ID NO: 5557410 - DNA, 21 bp, Homo sapiens
actggcaaacttcagactgaa

SEQ ID NO: 5557411 - DNA, 17 bp, Homo sapiens
actggcaagaggcctca

SEQ ID NO: 5557412 - DNA, 13 bp, Homo sapiens
actggcaataaac

SEQ ID NO: 5557413 - DNA, 21 bp, Homo sapiens
actggcaataagatacacagc

SEQ ID NO: 5557414 - DNA, 21 bp, Homo sapiens
actggcaatggtagtttctgt

SEQ ID NO: 5557415 - DNA, 20 bp, Homo sapiens
actggcacagttttctgaga

SEQ ID NO: 5557416 - DNA, 23 bp, Homo sapiens
actggcacgtttgtgagaagaaa

SEQ ID NO: 5557417 - DNA, 16 bp, Homo sapiens
actggcactgaattaa

SEQ ID NO: 5557418 - DNA, 20 bp, Homo sapiens
actggcactgaattaatcat

SEQ ID NO: 5557419 - DNA, 15 bp, Homo sapiens
actggcactgtggca

SEQ ID NO: 5557420 - DNA, 17 bp, Homo sapiens
actggcactgtggcact

SEQ ID NO: 5557421 - DNA, 20 bp, Homo sapiens
actggcagaaacaggaggct

SEQ ID NO: 5557422 - DNA, 21 bp, Homo sapiens
actgggcacagattgaagaat

SEQ ID NO: 5557423 - DNA, 14 bp, Homo sapiens
actgggcacagctc

SEQ ID NO: 5557424 - DNA, 15 bp, Homo sapiens
actgggcacccctgc

SEQ ID NO: 5557425 - DNA, 16 bp, Homo sapiens
actgggcacccctgcc

SEQ ID NO: 5557426 - DNA, 20 bp, Homo sapiens
actgggcacccctgcctcct

SEQ ID NO: 5557427 - DNA, 21 bp, Homo sapiens
actgggcacccctgcctcctg

SEQ ID NO: 5557428 - DNA, 15 bp, Homo sapiens
actgggcactggggc

SEQ ID NO: 5557429 - DNA, 17 bp, Homo sapiens
actgggcaggttcctgg

SEQ ID NO: 5557430 - DNA, 20 bp, Homo sapiens
actgggcaggttcctggggc

SEQ ID NO: 5557431 - DNA, 21 bp, Homo sapiens
actgggcaggttcctggggcc

SEQ ID NO: 5557432 - DNA, 14 bp, Homo sapiens
actgggccacggag

SEQ ID NO: 5557433 - DNA, 14 bp, Homo sapiens
actgggccagcaga

SEQ ID NO: 5557434 - DNA, 14 bp, Homo sapiens
actgggccagccct

SEQ ID NO: 5557435 - DNA, 19 bp, Homo sapiens
actgggccagccctgcagc

SEQ ID NO: 5557436 - DNA, 23 bp, Homo sapiens
actgggccatgggtcctcggccc

SEQ ID NO: 5557437 - DNA, 14 bp, Homo sapiens
actgggcccaggca

SEQ ID NO: 5557438 - DNA, 15 bp, Homo sapiens
actgggcccaggcag

SEQ ID NO: 5557439 - DNA, 19 bp, Homo sapiens
actgggccccacatggctt

SEQ ID NO: 5557440 - DNA, 20 bp, Homo sapiens
actgggccccattctccctc

SEQ ID NO: 5557441 - DNA, 14 bp, Homo sapiens
actgggcccctcag

SEQ ID NO: 5557442 - DNA, 16 bp, Homo sapiens
actgggcccctcaggg

SEQ ID NO: 5557443 - DNA, 16 bp, Homo sapiens
actgggcccctgtccc

SEQ ID NO: 5557444 - DNA, 20 bp, Homo sapiens
actgggcccctgtccccagt

SEQ ID NO: 5557445 - DNA, 18 bp, Homo sapiens
actgggcccgagcctgaa

SEQ ID NO: 5557446 - DNA, 19 bp, Homo sapiens
actgggcccgagcctgaac

SEQ ID NO: 5557447 - DNA, 17 bp, Homo sapiens
actgggccctgagccag

SEQ ID NO: 5557448 - DNA, 12 bp, Homo sapiens
actgggccctgg

SEQ ID NO: 5557449 - DNA, 14 bp, Homo sapiens
actgggccctgggg

SEQ ID NO: 5557450 - DNA, 16 bp, Homo sapiens
actgggccctggggct

SEQ ID NO: 5557451 - DNA, 15 bp, Homo sapiens
actgggccctgtcca

SEQ ID NO: 5557452 - DNA, 21 bp, Homo sapiens
actgggccctgtccagggcag

SEQ ID NO: 5557453 - DNA, 12 bp, Homo sapiens
actgggccggca

SEQ ID NO: 5557454 - DNA, 18 bp, Homo sapiens
actgggcctggagccctg

SEQ ID NO: 5557455 - DNA, 21 bp, Homo sapiens
actgggcctgttgccctttct

SEQ ID NO: 5557456 - DNA, 21 bp, Homo sapiens
actgggccttagtgggccagg

SEQ ID NO: 5557457 - DNA, 22 bp, Homo sapiens
actgggccttgtgtgctggctt

SEQ ID NO: 5557458 - DNA, 16 bp, Homo sapiens
actgggcctttccaga

SEQ ID NO: 5557459 - DNA, 17 bp, Homo sapiens
actgggcgtctgactcc

SEQ ID NO: 5557460 - DNA, 20 bp, Homo sapiens
actgggctaatttgtatgtt

SEQ ID NO: 5557461 - DNA, 19 bp, Homo sapiens
actgggctcaagtgatcct

SEQ ID NO: 5557462 - DNA, 13 bp, Homo sapiens
actgggctcactg

SEQ ID NO: 5557463 - DNA, 15 bp, Homo sapiens
actgggctcactgca

SEQ ID NO: 5557464 - DNA, 11 bp, Homo sapiens
actgggctctg

SEQ ID NO: 5557465 - DNA, 13 bp, Homo sapiens
actgggctctgga

SEQ ID NO: 5557466 - DNA, 21 bp, Homo sapiens
actgggctgaacactccaatt

SEQ ID NO: 5557467 - DNA, 14 bp, Homo sapiens
actgggctgaggga

SEQ ID NO: 5557468 - DNA, 23 bp, Homo sapiens
actgggctgcccacctggctgcc

SEQ ID NO: 5557469 - DNA, 16 bp, Homo sapiens
actgggctgctggggc

SEQ ID NO: 5557470 - DNA, 22 bp, Homo sapiens
actgggctgctggggcagggcc

SEQ ID NO: 5557471 - DNA, 15 bp, Homo sapiens
actgggctggcgctt

SEQ ID NO: 5557472 - DNA, 21 bp, Homo sapiens
actgggctggcgcttggatct

SEQ ID NO: 5557473 - DNA, 23 bp, Homo sapiens
actgggctggcgcttggatctgg

SEQ ID NO: 5557474 - DNA, 15 bp, Homo sapiens
actgggctggctgcc

SEQ ID NO: 5557475 - DNA, 18 bp, Homo sapiens
actgggctgggtttgctg

SEQ ID NO: 5557476 - DNA, 15 bp, Homo sapiens
actggggacttggcc

SEQ ID NO: 5557477 - DNA, 15 bp, Homo sapiens
actggggagtgctgg

SEQ ID NO: 5557478 - DNA, 15 bp, Homo sapiens
actggggatggtggc

SEQ ID NO: 5557479 - DNA, 21 bp, Homo sapiens
actggggatggtggcacaggc

SEQ ID NO: 5557480 - DNA, 18 bp, Homo sapiens
actggggatgtgggaggg

SEQ ID NO: 5557481 - DNA, 21 bp, Homo sapiens
actggggattgggtgggcagg

SEQ ID NO: 5557482 - DNA, 12 bp, Homo sapiens
actggggcactt

SEQ ID NO: 5557483 - DNA, 12 bp, Homo sapiens
actggggcctcc

SEQ ID NO: 5557484 - DNA, 15 bp, Homo sapiens
actggggctcagagc

SEQ ID NO: 5557485 - DNA, 13 bp, Homo sapiens
actggggctgcgc

SEQ ID NO: 5557486 - DNA, 13 bp, Homo sapiens
actggggctgggg

SEQ ID NO: 5557487 - DNA, 20 bp, Homo sapiens
actggggctggggtgagaga

SEQ ID NO: 5557488 - DNA, 22 bp, Homo sapiens
actggggctggggtgagagagg

SEQ ID NO: 5557489 - DNA, 14 bp, Homo sapiens
actggggcttgcaa

SEQ ID NO: 5557490 - DNA, 20 bp, Homo sapiens
actgggggacactgtggcag

SEQ ID NO: 5557491 - DNA, 15 bp, Homo sapiens
actgggggcagacat

SEQ ID NO: 5557492 - DNA, 15 bp, Homo sapiens
actgggggcctctgc

SEQ ID NO: 5557493 - DNA, 18 bp, Homo sapiens
actgggggcctctgcctc

SEQ ID NO: 5557494 - DNA, 22 bp, Homo sapiens
actgggggcctctgcctccagg

SEQ ID NO: 5557495 - DNA, 17 bp, Homo sapiens
actgggggcgggactgg

SEQ ID NO: 5557496 - DNA, 22 bp, Homo sapiens
actgggggcggggcctgggcgg

SEQ ID NO: 5557497 - DNA, 17 bp, Homo sapiens
actggggggaccaaata

SEQ ID NO: 5557498 - DNA, 14 bp, Homo sapiens
actggggggcaggc

SEQ ID NO: 5557499 - DNA, 12 bp, Homo sapiens
actggggggcca

SEQ ID NO: 5557500 - DNA, 14 bp, Homo sapiens
actggggggccacc

SEQ ID NO: 5557501 - DNA, 13 bp, Homo sapiens
actggggggcttg

SEQ ID NO: 5557502 - DNA, 21 bp, Homo sapiens
actgggggtgccaaccacctc

SEQ ID NO: 5557503 - DNA, 18 bp, Homo sapiens
actggggtcctggggcct

SEQ ID NO: 5557504 - DNA, 20 bp, Homo sapiens
actggggtcctggggcctcg

SEQ ID NO: 5557505 - DNA, 19 bp, Homo sapiens
actggggtgccgcctgccc

SEQ ID NO: 5557506 - DNA, 24 bp, Homo sapiens
actggggtgccttcactgggccag

SEQ ID NO: 5557507 - DNA, 21 bp, Homo sapiens
actggggtgggagggggcagg

SEQ ID NO: 5557508 - DNA, 21 bp, Homo sapiens
actggggtgggaggtcttgct

SEQ ID NO: 5557509 - DNA, 19 bp, Homo sapiens
actggggttcaagcccagg

SEQ ID NO: 5557510 - DNA, 21 bp, Homo sapiens
actggggttgcgtctgaggcc

SEQ ID NO: 5557511 - DNA, 23 bp, Homo sapiens
actggggttgcgtctgaggcctg

SEQ ID NO: 5557512 - DNA, 20 bp, Homo sapiens
actgggtaaaagcagggcag

SEQ ID NO: 5557513 - DNA, 21 bp, Homo sapiens
actgggtaaaagcagggcagc

SEQ ID NO: 5557514 - DNA, 21 bp, Homo sapiens
actgggtaaatgcaaagttct

SEQ ID NO: 5557515 - DNA, 23 bp, Homo sapiens
actgggtacccaaaacacatttt

SEQ ID NO: 5557516 - DNA, 14 bp, Homo sapiens
actgggtacccaag

SEQ ID NO: 5557517 - DNA, 23 bp, Homo sapiens
actgggtacttgtggacacagct

SEQ ID NO: 5557518 - DNA, 15 bp, Homo sapiens
actgggtagtagcta

SEQ ID NO: 5557519 - DNA, 18 bp, Homo sapiens
actgggtcatcatttgtc

SEQ ID NO: 5557520 - DNA, 15 bp, Homo sapiens
actgggtctcactcc

SEQ ID NO: 5557521 - DNA, 16 bp, Homo sapiens
actgggtctcactcct

SEQ ID NO: 5557522 - DNA, 18 bp, Homo sapiens
actgggtctgacctggtg

SEQ ID NO: 5557523 - DNA, 20 bp, Homo sapiens
actgggtctgacctggtggg

SEQ ID NO: 5557524 - DNA, 22 bp, Homo sapiens
actgggtcttcagctttatccc

SEQ ID NO: 5557525 - DNA, 19 bp, Homo sapiens
actgggtgcgtctccagtc

SEQ ID NO: 5557526 - DNA, 18 bp, Homo sapiens
actgggtggggtgaggac

SEQ ID NO: 5557527 - DNA, 18 bp, Homo sapiens
actgggtggtttggtttt

SEQ ID NO: 5557528 - DNA, 19 bp, Homo sapiens
actgggtggtttggttttt

SEQ ID NO: 5557529 - DNA, 17 bp, Homo sapiens
actgggtgtcatttcat

SEQ ID NO: 5557530 - DNA, 22 bp, Homo sapiens
actgggtgtcatttcattccat

SEQ ID NO: 5557531 - DNA, 24 bp, Homo sapiens
actgggtgtggcctggcttctggg

SEQ ID NO: 5557532 - DNA, 12 bp, Homo sapiens
actgggttaaat

SEQ ID NO: 5557533 - DNA, 17 bp, Homo sapiens
actgggttaatggctag

SEQ ID NO: 5557534 - DNA, 18 bp, Homo sapiens
actgggttcaaaaagaaa

SEQ ID NO: 5557535 - DNA, 22 bp, Homo sapiens
actgggttccccacagtgacag

SEQ ID NO: 5557536 - DNA, 14 bp, Homo sapiens
actgggttcctgca

SEQ ID NO: 5557537 - DNA, 16 bp, Homo sapiens
actgggttctagaacc

SEQ ID NO: 5557538 - DNA, 21 bp, Homo sapiens
actgggttcttgttttatata

SEQ ID NO: 5557539 - DNA, 14 bp, Homo sapiens
actgggtttaaaga

SEQ ID NO: 5557540 - DNA, 16 bp, Homo sapiens
actgggtttaaagatg

SEQ ID NO: 5557541 - DNA, 22 bp, Homo sapiens
actgggtttcaagaaaatcttt

SEQ ID NO: 5557542 - DNA, 16 bp, Homo sapiens
actgggtttggacccc

SEQ ID NO: 5557543 - DNA, 19 bp, Homo sapiens
actgggttttgtctctgca

SEQ ID NO: 5557544 - DNA, 22 bp, Homo sapiens
actgggttttgtctctgcatct

SEQ ID NO: 5557545 - DNA, 20 bp, Homo sapiens
actggtacccgcccttccga

SEQ ID NO: 5557546 - DNA, 16 bp, Homo sapiens
actggtactcaagcca

SEQ ID NO: 5557547 - DNA, 17 bp, Homo sapiens
actggtacttcctttct

SEQ ID NO: 5557548 - DNA, 15 bp, Homo sapiens
actggtaggaccaag

SEQ ID NO: 5557549 - DNA, 23 bp, Homo sapiens
actggtaggaggaggcatggaaa

SEQ ID NO: 5557550 - DNA, 22 bp, Homo sapiens
actggtattagttaaaacacat

SEQ ID NO: 5557551 - DNA, 18 bp, Homo sapiens
actggtattcctgcctcc

SEQ ID NO: 5557552 - DNA, 14 bp, Homo sapiens
actggtattgttta

SEQ ID NO: 5557553 - DNA, 16 bp, Homo sapiens
actggtcagggcagtg

SEQ ID NO: 5557554 - DNA, 17 bp, Homo sapiens
actggtcagggcagtgg

SEQ ID NO: 5557555 - DNA, 22 bp, Homo sapiens
actggtcagggcagtggccaag

SEQ ID NO: 5557556 - DNA, 12 bp, Homo sapiens
actggtccagct

SEQ ID NO: 5557557 - DNA, 17 bp, Homo sapiens
actggtccagctctgac

SEQ ID NO: 5557558 - DNA, 21 bp, Homo sapiens
actggtccagctctgacatcc

SEQ ID NO: 5557559 - DNA, 21 bp, Homo sapiens
actggtccaggcatgggtccc

SEQ ID NO: 5557560 - DNA, 21 bp, Homo sapiens
actggtccaggccaggcctca

SEQ ID NO: 5557561 - DNA, 18 bp, Homo sapiens
actggtcccccatgggct

SEQ ID NO: 5557562 - DNA, 13 bp, Homo sapiens
actggtcccggtc

SEQ ID NO: 5557563 - DNA, 15 bp, Homo sapiens
actggtcctgtgtgc

SEQ ID NO: 5557564 - DNA, 21 bp, Homo sapiens
actggtctcgaactcctggcc

SEQ ID NO: 5557565 - DNA, 23 bp, Homo sapiens
actggtctcgaactcctggcctc

SEQ ID NO: 5557566 - DNA, 15 bp, Homo sapiens
actggtgaatataaa

SEQ ID NO: 5557567 - DNA, 16 bp, Homo sapiens
actggtgaatataaat

SEQ ID NO: 5557568 - DNA, 18 bp, Homo sapiens
actggtgaatataaatga

SEQ ID NO: 5557569 - DNA, 14 bp, Homo sapiens
actggtgactgatt

SEQ ID NO: 5557570 - DNA, 16 bp, Homo sapiens
actggtgagcagactg

SEQ ID NO: 5557571 - DNA, 17 bp, Homo sapiens
actggtgagggcaagag

SEQ ID NO: 5557572 - DNA, 13 bp, Homo sapiens
actggtgatatat

SEQ ID NO: 5557573 - DNA, 23 bp, Homo sapiens
actggtgcaattacagcaaaaag

SEQ ID NO: 5557574 - DNA, 21 bp, Homo sapiens
actggtgccaaaaccaggcct

SEQ ID NO: 5557575 - DNA, 16 bp, Homo sapiens
actggtgctgagtgac

SEQ ID NO: 5557576 - DNA, 12 bp, Homo sapiens
actggtggcccg

SEQ ID NO: 5557577 - DNA, 20 bp, Homo sapiens
actggtggcccgacagcctg

SEQ ID NO: 5557578 - DNA, 17 bp, Homo sapiens
actggtgggcagctgag

SEQ ID NO: 5557579 - DNA, 19 bp, Homo sapiens
actggtgggggttctggca

SEQ ID NO: 5557580 - DNA, 20 bp, Homo sapiens
actggtgggggttctggcag

SEQ ID NO: 5557581 - DNA, 21 bp, Homo sapiens
actggtggttgattggtttta

SEQ ID NO: 5557582 - DNA, 17 bp, Homo sapiens
actggtggtttttgctc

SEQ ID NO: 5557583 - DNA, 17 bp, Homo sapiens
actggtgtaaaaaacaa

SEQ ID NO: 5557584 - DNA, 21 bp, Homo sapiens
actggtgtaaaaaacaaacat

SEQ ID NO: 5557585 - DNA, 19 bp, Homo sapiens
actggtgtaatctcaatgc

SEQ ID NO: 5557586 - DNA, 20 bp, Homo sapiens
actggtgtcaccctttgcct

SEQ ID NO: 5557587 - DNA, 14 bp, Homo sapiens
actggtgtgacctg

SEQ ID NO: 5557588 - DNA, 13 bp, Homo sapiens
actggtgttaatg

SEQ ID NO: 5557589 - DNA, 14 bp, Homo sapiens
actggtgttaatga

SEQ ID NO: 5557590 - DNA, 17 bp, Homo sapiens
actggtgttaatgagta

SEQ ID NO: 5557591 - DNA, 22 bp, Homo sapiens
actggtgttaatgagtatatgt

SEQ ID NO: 5557592 - DNA, 15 bp, Homo sapiens
actggttacctggag

SEQ ID NO: 5557593 - DNA, 16 bp, Homo sapiens
actggttactttcaaa

SEQ ID NO: 5557594 - DNA, 18 bp, Homo sapiens
actggttactttcaaaat

SEQ ID NO: 5557595 - DNA, 20 bp, Homo sapiens
actggttatagttgatatgt

SEQ ID NO: 5557596 - DNA, 18 bp, Homo sapiens
actggttcaagagacact

SEQ ID NO: 5557597 - DNA, 14 bp, Homo sapiens
actggttccttcct

SEQ ID NO: 5557598 - DNA, 16 bp, Homo sapiens
actggttctgaggcca

SEQ ID NO: 5557599 - DNA, 16 bp, Homo sapiens
actgtcttactcaaga

SEQ ID NO: 5557600 - DNA, 16 bp, Homo sapiens
actgtcttcaaccctg

SEQ ID NO: 5557601 - DNA, 12 bp, Homo sapiens
actgtcttcagt

SEQ ID NO: 5557602 - DNA, 17 bp, Homo sapiens
actgtcttccctctcta

SEQ ID NO: 5557603 - DNA, 13 bp, Homo sapiens
actgtcttcctca

SEQ ID NO: 5557604 - DNA, 20 bp, Homo sapiens
actgtcttgactgtcacgga

SEQ ID NO: 5557605 - DNA, 21 bp, Homo sapiens
actgtcttgagagaaaagaaa

SEQ ID NO: 5557606 - DNA, 16 bp, Homo sapiens
actgtcttgcctgcca

SEQ ID NO: 5557607 - DNA, 16 bp, Homo sapiens
actgtcttgtttcagt

SEQ ID NO: 5557608 - DNA, 19 bp, Homo sapiens
actgtctttaaaagagaga

SEQ ID NO: 5557609 - DNA, 12 bp, Homo sapiens
actgtctttcct

SEQ ID NO: 5557610 - DNA, 14 bp, Homo sapiens
actgtctttcctag

SEQ ID NO: 5557611 - DNA, 23 bp, Homo sapiens
actgtctttggaaaaatgtttgt

SEQ ID NO: 5557612 - DNA, 23 bp, Homo sapiens
actgtcttttaaaaaacaaaaag

SEQ ID NO: 5557613 - DNA, 20 bp, Homo sapiens
actgtcttttctattaatca

SEQ ID NO: 5557614 - DNA, 17 bp, Homo sapiens
actgtcttttgaagaag

SEQ ID NO: 5557615 - DNA, 20 bp, Homo sapiens
actgtgaaaaaaaatttgtt

SEQ ID NO: 5557616 - DNA, 18 bp, Homo sapiens
actgtgaaaaatcagatg

SEQ ID NO: 5557617 - DNA, 18 bp, Homo sapiens
actgtgaaaatagtgtaa

SEQ ID NO: 5557618 - DNA, 20 bp, Homo sapiens
actgtgaaaatagtgtaaga

SEQ ID NO: 5557619 - DNA, 19 bp, Homo sapiens
actgtgaaaattgaccaag

SEQ ID NO: 5557620 - DNA, 13 bp, Homo sapiens
actgtgaaagtat

SEQ ID NO: 5557621 - DNA, 12 bp, Homo sapiens
actgtgaaatac

SEQ ID NO: 5557622 - DNA, 13 bp, Homo sapiens
actgtgaaattta

SEQ ID NO: 5557623 - DNA, 16 bp, Homo sapiens
actgtgaacagcttgc

SEQ ID NO: 5557624 - DNA, 19 bp, Homo sapiens
actgtgaaccaacccccat

SEQ ID NO: 5557625 - DNA, 12 bp, Homo sapiens
actgtgaactat

SEQ ID NO: 5557626 - DNA, 17 bp, Homo sapiens
actgtgaagacccagca

SEQ ID NO: 5557627 - DNA, 21 bp, Homo sapiens
actgtgaagacccagcaggaa

SEQ ID NO: 5557628 - DNA, 21 bp, Homo sapiens
actgtgaagagaatgtattct

SEQ ID NO: 5557629 - DNA, 15 bp, Homo sapiens
actgtgaatatgtgt

SEQ ID NO: 5557630 - DNA, 18 bp, Homo sapiens
actgtgaatatgtgtaac

SEQ ID NO: 5557631 - DNA, 11 bp, Homo sapiens
actgtgaatgc

SEQ ID NO: 5557632 - DNA, 12 bp, Homo sapiens
actgtgaatttc

SEQ ID NO: 5557633 - DNA, 17 bp, Homo sapiens
actgtgaatttcaaaaa

SEQ ID NO: 5557634 - DNA, 22 bp, Homo sapiens
actgtgacaccagaataatgag

SEQ ID NO: 5557635 - DNA, 14 bp, Homo sapiens
actgtgacattcca

SEQ ID NO: 5557636 - DNA, 18 bp, Homo sapiens
actgtgacattccacaga

SEQ ID NO: 5557637 - DNA, 15 bp, Homo sapiens
actgtgaccaaagca

SEQ ID NO: 5557638 - DNA, 23 bp, Homo sapiens
actgtgaccaaagcatttctagt

SEQ ID NO: 5557639 - DNA, 14 bp, Homo sapiens
actgtgaccacctt

SEQ ID NO: 5557640 - DNA, 16 bp, Homo sapiens
actgtgaccaccttct

SEQ ID NO: 5557641 - DNA, 17 bp, Homo sapiens
actgtgacctaagaaca

SEQ ID NO: 5557642 - DNA, 22 bp, Homo sapiens
actgtgacctgctcctgcccac

SEQ ID NO: 5557643 - DNA, 17 bp, Homo sapiens
actgtgacctttgtcta

SEQ ID NO: 5557644 - DNA, 19 bp, Homo sapiens
actgtgacctttgtctaga

SEQ ID NO: 5557645 - DNA, 20 bp, Homo sapiens
actgtgactaggcatacact

SEQ ID NO: 5557646 - DNA, 15 bp, Homo sapiens
actgtgagactgtat

SEQ ID NO: 5557647 - DNA, 20 bp, Homo sapiens
actgtgagagttgtctctgt

SEQ ID NO: 5557648 - DNA, 22 bp, Homo sapiens
actgtgagagttgtctctgttg

SEQ ID NO: 5557649 - DNA, 16 bp, Homo sapiens
actgtgagataaatat

SEQ ID NO: 5557650 - DNA, 21 bp, Homo sapiens
actgtgagcgagcctggcagg

SEQ ID NO: 5557651 - DNA, 21 bp, Homo sapiens
actgtgagctcccaggtgcag

SEQ ID NO: 5557652 - DNA, 16 bp, Homo sapiens
actgtgagcttacatt

SEQ ID NO: 5557653 - DNA, 23 bp, Homo sapiens
actgtgaggccatacttgtgaaa

SEQ ID NO: 5557654 - DNA, 19 bp, Homo sapiens
actgtgaggcggcagctgg

SEQ ID NO: 5557655 - DNA, 20 bp, Homo sapiens
actgtgaggcggcagctggg

SEQ ID NO: 5557656 - DNA, 16 bp, Homo sapiens
actgtgatacagtttt

SEQ ID NO: 5557657 - DNA, 16 bp, Homo sapiens
actgtgattactcttt

SEQ ID NO: 5557658 - DNA, 22 bp, Homo sapiens
actgtgattactctttgctttg

SEQ ID NO: 5557659 - DNA, 15 bp, Homo sapiens
actgtgatttatctt

SEQ ID NO: 5557660 - DNA, 13 bp, Homo sapiens
actgtgatttatt

SEQ ID NO: 5557661 - DNA, 17 bp, Homo sapiens
actgtgatttatttgga

SEQ ID NO: 5557662 - DNA, 12 bp, Homo sapiens
actgtgatttct

SEQ ID NO: 5557663 - DNA, 22 bp, Homo sapiens
actgtgattttatgtttaaaaa

SEQ ID NO: 5557664 - DNA, 19 bp, Homo sapiens
actgtgcaaagggctgcct

SEQ ID NO: 5557665 - DNA, 15 bp, Homo sapiens
actgtgcacatctgt

SEQ ID NO: 5557666 - DNA, 12 bp, Homo sapiens
actgtgcactgc

SEQ ID NO: 5557667 - DNA, 15 bp, Homo sapiens
actgtgcactgccct

SEQ ID NO: 5557668 - DNA, 21 bp, Homo sapiens
actgtgcagagtctagaagtt

SEQ ID NO: 5557669 - DNA, 20 bp, Homo sapiens
actgtgcagccggggagctg

SEQ ID NO: 5557670 - DNA, 22 bp, Homo sapiens
actgtgcagccggggagctgag

SEQ ID NO: 5557671 - DNA, 23 bp, Homo sapiens
actgtgcaggtgctattgttact

SEQ ID NO: 5557672 - DNA, 17 bp, Homo sapiens
actgtgcatacatgttc

SEQ ID NO: 5557673 - DNA, 19 bp, Homo sapiens
actgtgccaagatttaaaa

SEQ ID NO: 5557674 - DNA, 12 bp, Homo sapiens
actgtgccacaa

SEQ ID NO: 5557675 - DNA, 20 bp, Homo sapiens
actgtgccactgacttgctg

SEQ ID NO: 5557676 - DNA, 18 bp, Homo sapiens
actgtgccatctgtggga

SEQ ID NO: 5557677 - DNA, 16 bp, Homo sapiens
actgtgccatgtgcca

SEQ ID NO: 5557678 - DNA, 18 bp, Homo sapiens
actgtgccctgccttcag

SEQ ID NO: 5557679 - DNA, 14 bp, Homo sapiens
actgtgccctggtg

SEQ ID NO: 5557680 - DNA, 16 bp, Homo sapiens
actgtgcctagttcct

SEQ ID NO: 5557681 - DNA, 19 bp, Homo sapiens
actgtgcctcagagaccag

SEQ ID NO: 5557682 - DNA, 20 bp, Homo sapiens
actgtgcctccataatttgg

SEQ ID NO: 5557683 - DNA, 14 bp, Homo sapiens
actgtgcctggctc

SEQ ID NO: 5557684 - DNA, 16 bp, Homo sapiens
actgtgcctggctccc

SEQ ID NO: 5557685 - DNA, 18 bp, Homo sapiens
actgtgcctggctccctg

SEQ ID NO: 5557686 - DNA, 23 bp, Homo sapiens
actgtgcctttgagtttcctcag

SEQ ID NO: 5557687 - DNA, 14 bp, Homo sapiens
actgtgcctttgca

SEQ ID NO: 5557688 - DNA, 22 bp, Homo sapiens
actgtgcctttgcaaatcagtg

SEQ ID NO: 5557689 - DNA, 22 bp, Homo sapiens
actgtgcgtcttggtgtaattt

SEQ ID NO: 5557690 - DNA, 20 bp, Homo sapiens
actgtgcgttttagagtatg

SEQ ID NO: 5557691 - DNA, 12 bp, Homo sapiens
actgtgctaata

SEQ ID NO: 5557692 - DNA, 15 bp, Homo sapiens
actgtgctactgtct

SEQ ID NO: 5557693 - DNA, 22 bp, Homo sapiens
actgtgctactgtctttggaaa

SEQ ID NO: 5557694 - DNA, 23 bp, Homo sapiens
actgtgctactgtctttggaaaa

SEQ ID NO: 5557695 - DNA, 14 bp, Homo sapiens
actgtgctcagggc

SEQ ID NO: 5557696 - DNA, 15 bp, Homo sapiens
actgtgctcccacgg

SEQ ID NO: 5557697 - DNA, 21 bp, Homo sapiens
actgtgctctcccaaagccat

SEQ ID NO: 5557698 - DNA, 18 bp, Homo sapiens
actgtgctggagccacta

SEQ ID NO: 5557699 - DNA, 21 bp, Homo sapiens
actgtgctggagccactaact

SEQ ID NO: 5557700 - DNA, 12 bp, Homo sapiens
actgtgctgtgc

SEQ ID NO: 5557701 - DNA, 16 bp, Homo sapiens
actgtgctgtgcagct

SEQ ID NO: 5557702 - DNA, 16 bp, Homo sapiens
actgtgcttacagtga

SEQ ID NO: 5557703 - DNA, 23 bp, Homo sapiens
actgtgcttgttgaatgtcaatc

SEQ ID NO: 5557704 - DNA, 22 bp, Homo sapiens
actgtgctttaataggtagcat

SEQ ID NO: 5557705 - DNA, 11 bp, Homo sapiens
actgtgctttc

SEQ ID NO: 5557706 - DNA, 14 bp, Homo sapiens
actgtggaaaaata

SEQ ID NO: 5557707 - DNA, 15 bp, Homo sapiens
actgtggaaaaatat

SEQ ID NO: 5557708 - DNA, 15 bp, Homo sapiens
actgtggaacactaa

SEQ ID NO: 5557709 - DNA, 15 bp, Homo sapiens
actgtggaactgcca

SEQ ID NO: 5557710 - DNA, 14 bp, Homo sapiens
actgtggaatataa

SEQ ID NO: 5557711 - DNA, 20 bp, Homo sapiens
actgtggacctctatcatct

SEQ ID NO: 5557712 - DNA, 19 bp, Homo sapiens
actgtggagaagcccctgg

SEQ ID NO: 5557713 - DNA, 17 bp, Homo sapiens
actgtggagactgctcc

SEQ ID NO: 5557714 - DNA, 19 bp, Homo sapiens
actgtggagactttctgtt

SEQ ID NO: 5557715 - DNA, 15 bp, Homo sapiens
actgtggaggaagga

SEQ ID NO: 5557716 - DNA, 22 bp, Homo sapiens
actgtggaggaaggattgtaaa

SEQ ID NO: 5557717 - DNA, 14 bp, Homo sapiens
actgtggaggggag

SEQ ID NO: 5557718 - DNA, 15 bp, Homo sapiens
actgtggaggggagc

SEQ ID NO: 5557719 - DNA, 17 bp, Homo sapiens
actgtggaggggagctg

SEQ ID NO: 5557720 - DNA, 22 bp, Homo sapiens
actgtggaggggagctgctggc

SEQ ID NO: 5557721 - DNA, 17 bp, Homo sapiens
actgtggataaattttg

SEQ ID NO: 5557722 - DNA, 21 bp, Homo sapiens
actgtggataaattttggaag

SEQ ID NO: 5557723 - DNA, 21 bp, Homo sapiens
actgtggatacccttaccctt

SEQ ID NO: 5557724 - DNA, 19 bp, Homo sapiens
actgtggattggtgggttt

SEQ ID NO: 5557725 - DNA, 16 bp, Homo sapiens
actgtggcaactgaga

SEQ ID NO: 5557726 - DNA, 19 bp, Homo sapiens
actgtggcactgccaccag

SEQ ID NO: 5557727 - DNA, 19 bp, Homo sapiens
actgtggcacttgcctggg

SEQ ID NO: 5557728 - DNA, 14 bp, Homo sapiens
actgtggcagcagg

SEQ ID NO: 5557729 - DNA, 17 bp, Homo sapiens
actgtggcagcaggagg

SEQ ID NO: 5557730 - DNA, 15 bp, Homo sapiens
actgtggccacagcc

SEQ ID NO: 5557731 - DNA, 19 bp, Homo sapiens
actgtggccacagccccct

SEQ ID NO: 5557732 - DNA, 17 bp, Homo sapiens
actgtggccagagctgg

SEQ ID NO: 5557733 - DNA, 17 bp, Homo sapiens
actgtggccagtaaaat

SEQ ID NO: 5557734 - DNA, 20 bp, Homo sapiens
actgtggccatatatgctgt

SEQ ID NO: 5557735 - DNA, 23 bp, Homo sapiens
actgtggccatatatgctgtatt

SEQ ID NO: 5557736 - DNA, 17 bp, Homo sapiens
actgtggccgttatctg

SEQ ID NO: 5557737 - DNA, 18 bp, Homo sapiens
actgtggcctcaggaggc

SEQ ID NO: 5557738 - DNA, 16 bp, Homo sapiens
actgtggcctgcagga

SEQ ID NO: 5557739 - DNA, 15 bp, Homo sapiens
actgtggccttctca

SEQ ID NO: 5557740 - DNA, 12 bp, Homo sapiens
actgtggccttg

SEQ ID NO: 5557741 - DNA, 16 bp, Homo sapiens
actgtggcgttctgct

SEQ ID NO: 5557742 - DNA, 19 bp, Homo sapiens
actgtggctgcagagacct

SEQ ID NO: 5557743 - DNA, 12 bp, Homo sapiens
actgtggctgct

SEQ ID NO: 5557744 - DNA, 16 bp, Homo sapiens
actgtggctggtactt

SEQ ID NO: 5557745 - DNA, 15 bp, Homo sapiens
actgtgggcaattta

SEQ ID NO: 5557746 - DNA, 17 bp, Homo sapiens
actgtgggcaatttaga

SEQ ID NO: 5557747 - DNA, 19 bp, Homo sapiens
actgtgggcaatttagaaa

SEQ ID NO: 5557748 - DNA, 22 bp, Homo sapiens
actgtggggaaccaattgcttt

SEQ ID NO: 5557749 - DNA, 19 bp, Homo sapiens
actgtggggagagatggca

SEQ ID NO: 5557750 - DNA, 16 bp, Homo sapiens
actgtggggcaagcct

SEQ ID NO: 5557751 - DNA, 20 bp, Homo sapiens
actgtgggggcccctcaggt

SEQ ID NO: 5557752 - DNA, 22 bp, Homo sapiens
actgtggggtgtgcacatctct

SEQ ID NO: 5557753 - DNA, 18 bp, Homo sapiens
actgtggggtttttaatc

SEQ ID NO: 5557754 - DNA, 22 bp, Homo sapiens
actgtggggtttttaatctctt

SEQ ID NO: 5557755 - DNA, 23 bp, Homo sapiens
actgtggggtttttaatctcttg

SEQ ID NO: 5557756 - DNA, 16 bp, Homo sapiens
actgtgggtggggagg

SEQ ID NO: 5557757 - DNA, 22 bp, Homo sapiens
actgtgggtggggaggccctgc

SEQ ID NO: 5557758 - DNA, 23 bp, Homo sapiens
actgtgggtttgtggggggaggc

SEQ ID NO: 5557759 - DNA, 15 bp, Homo sapiens
actgtggtcaggccc

SEQ ID NO: 5557760 - DNA, 16 bp, Homo sapiens
actgtggtcaggccca

SEQ ID NO: 5557761 - DNA, 18 bp, Homo sapiens
actgtggtcaggcccagc

SEQ ID NO: 5557762 - DNA, 22 bp, Homo sapiens
actgtggtcgtcaactttcctc

SEQ ID NO: 5557763 - DNA, 12 bp, Homo sapiens
actgtggtgact

SEQ ID NO: 5557764 - DNA, 15 bp, Homo sapiens
actgtggtgactttg

SEQ ID NO: 5557765 - DNA, 18 bp, Homo sapiens
actgtggtgactttggat

SEQ ID NO: 5557766 - DNA, 18 bp, Homo sapiens
actgtggtttcagatgtg

SEQ ID NO: 5557767 - DNA, 19 bp, Homo sapiens
actgtggtttcagatgtgc

SEQ ID NO: 5557768 - DNA, 17 bp, Homo sapiens
actgtggttttgactta

SEQ ID NO: 5557769 - DNA, 19 bp, Homo sapiens
actgtgtaaaatgtaatgc

SEQ ID NO: 5557770 - DNA, 14 bp, Homo sapiens
actgtgtaaactca

SEQ ID NO: 5557771 - DNA, 15 bp, Homo sapiens
actgtgtaaccagca

SEQ ID NO: 5557772 - DNA, 23 bp, Homo sapiens
actgtgtaaccagcagtcacagg

SEQ ID NO: 5557773 - DNA, 22 bp, Homo sapiens
actgtgtaagaagctgtgaata

SEQ ID NO: 5557774 - DNA, 15 bp, Homo sapiens
actgtgtaatataaa

SEQ ID NO: 5557775 - DNA, 21 bp, Homo sapiens
actgtgtaatataaaagatct

SEQ ID NO: 5557776 - DNA, 19 bp, Homo sapiens
actgtttaatatttataga

SEQ ID NO: 5557777 - DNA, 22 bp, Homo sapiens
actgtttaatcatagttactgt

SEQ ID NO: 5557778 - DNA, 11 bp, Homo sapiens
actgtttacag

SEQ ID NO: 5557779 - DNA, 15 bp, Homo sapiens
actgtttactcacat

SEQ ID NO: 5557780 - DNA, 14 bp, Homo sapiens
actgtttagatgaa

SEQ ID NO: 5557781 - DNA, 16 bp, Homo sapiens
actgtttataaatgtt

SEQ ID NO: 5557782 - DNA, 14 bp, Homo sapiens
actgtttataatag

SEQ ID NO: 5557783 - DNA, 23 bp, Homo sapiens
actgtttataataggtggagact

SEQ ID NO: 5557784 - DNA, 18 bp, Homo sapiens
actgtttatacactgtgt

SEQ ID NO: 5557785 - DNA, 19 bp, Homo sapiens
actgtttatacactgtgta

SEQ ID NO: 5557786 - DNA, 12 bp, Homo sapiens
actgtttatata

SEQ ID NO: 5557787 - DNA, 13 bp, Homo sapiens
actgtttatataa

SEQ ID NO: 5557788 - DNA, 21 bp, Homo sapiens
actgtttatatgtgttgaaaa

SEQ ID NO: 5557789 - DNA, 20 bp, Homo sapiens
actgtttattaccagattca

SEQ ID NO: 5557790 - DNA, 16 bp, Homo sapiens
actgtttattcaacaa

SEQ ID NO: 5557791 - DNA, 23 bp, Homo sapiens
actgtttatttaaggatggatgg

SEQ ID NO: 5557792 - DNA, 19 bp, Homo sapiens
actgtttatttctgtttct

SEQ ID NO: 5557793 - DNA, 18 bp, Homo sapiens
actgtttcactaatactt

SEQ ID NO: 5557794 - DNA, 21 bp, Homo sapiens
actgtttcactgaaatgtttg

SEQ ID NO: 5557795 - DNA, 17 bp, Homo sapiens
actgtttcagaaaacat

SEQ ID NO: 5557796 - DNA, 14 bp, Homo sapiens
actgtttcagtcct

SEQ ID NO: 5557797 - DNA, 17 bp, Homo sapiens
actgtttcatctcagct

SEQ ID NO: 5557798 - DNA, 20 bp, Homo sapiens
actgtttcatctcagctttt

SEQ ID NO: 5557799 - DNA, 18 bp, Homo sapiens
actgtttcatgagcccaa

SEQ ID NO: 5557800 - DNA, 14 bp, Homo sapiens
actgtttcattcac

SEQ ID NO: 5557801 - DNA, 16 bp, Homo sapiens
actgtttcattcactg

SEQ ID NO: 5557802 - DNA, 19 bp, Homo sapiens
actgtttcattcactgtgc

SEQ ID NO: 5557803 - DNA, 14 bp, Homo sapiens
actgtttccacatt

SEQ ID NO: 5557804 - DNA, 16 bp, Homo sapiens
actgtttccctgctga

SEQ ID NO: 5557805 - DNA, 17 bp, Homo sapiens
actgtttcctgggcacg

SEQ ID NO: 5557806 - DNA, 14 bp, Homo sapiens
actgtttctctgct

SEQ ID NO: 5557807 - DNA, 17 bp, Homo sapiens
actgtttctcttgagct

SEQ ID NO: 5557808 - DNA, 18 bp, Homo sapiens
actgtttctcttgagctg

SEQ ID NO: 5557809 - DNA, 15 bp, Homo sapiens
actgtttcttgcact

SEQ ID NO: 5557810 - DNA, 19 bp, Homo sapiens
actgtttcttgcttgtacc

SEQ ID NO: 5557811 - DNA, 20 bp, Homo sapiens
actgtttcttgcttgtacct

SEQ ID NO: 5557812 - DNA, 19 bp, Homo sapiens
actgtttgaaaagaaataa

SEQ ID NO: 5557813 - DNA, 18 bp, Homo sapiens
actgtttgcatgcgcccg

SEQ ID NO: 5557814 - DNA, 20 bp, Homo sapiens
actgtttgtaatatacagtt

SEQ ID NO: 5557815 - DNA, 15 bp, Homo sapiens
actgtttgtcttctc

SEQ ID NO: 5557816 - DNA, 20 bp, Homo sapiens
actgtttgtcttctccccag

SEQ ID NO: 5557817 - DNA, 22 bp, Homo sapiens
actgtttgttccagaatctgta

SEQ ID NO: 5557818 - DNA, 17 bp, Homo sapiens
actgttttaaaatgtga

SEQ ID NO: 5557819 - DNA, 20 bp, Homo sapiens
actgttttaataaaagattt

SEQ ID NO: 5557820 - DNA, 24 bp, Homo sapiens
actgttttaatttatactggcatg

SEQ ID NO: 5557821 - DNA, 17 bp, Homo sapiens
actgttttagaaattgg

SEQ ID NO: 5557822 - DNA, 24 bp, Homo sapiens
actgttttatctctgtgaatcttg

SEQ ID NO: 5557823 - DNA, 14 bp, Homo sapiens
actgttttatgttg

SEQ ID NO: 5557824 - DNA, 16 bp, Homo sapiens
actgttttatgttgat

SEQ ID NO: 5557825 - DNA, 12 bp, Homo sapiens
actgttttcaat

SEQ ID NO: 5557826 - DNA, 13 bp, Homo sapiens
actgttttcatgt

SEQ ID NO: 5557827 - DNA, 14 bp, Homo sapiens
actgttttcatgtg

SEQ ID NO: 5557828 - DNA, 17 bp, Homo sapiens
actgttttccagttcat

SEQ ID NO: 5557829 - DNA, 13 bp, Homo sapiens
actgttttctagt

SEQ ID NO: 5557830 - DNA, 17 bp, Homo sapiens
actgttttctagtgtat

SEQ ID NO: 5557831 - DNA, 23 bp, Homo sapiens
actgttttctctcggctccccat

SEQ ID NO: 5557832 - DNA, 15 bp, Homo sapiens
actgttttcttcttg

SEQ ID NO: 5557833 - DNA, 14 bp, Homo sapiens
actgttttgaggaa

SEQ ID NO: 5557834 - DNA, 12 bp, Homo sapiens
actgtttttaat

SEQ ID NO: 5557835 - DNA, 14 bp, Homo sapiens
actgtttttaccca

SEQ ID NO: 5557836 - DNA, 23 bp, Homo sapiens
actgtttttatatgcacatgtaa

SEQ ID NO: 5557837 - DNA, 19 bp, Homo sapiens
actgtttttattccttcca

SEQ ID NO: 5557838 - DNA, 23 bp, Homo sapiens
actgtttttcagggaggtggctg

SEQ ID NO: 5557839 - DNA, 22 bp, Homo sapiens
actgtttttccatagttttgat

SEQ ID NO: 5557840 - DNA, 18 bp, Homo sapiens
actgtttttcggacagtt

SEQ ID NO: 5557841 - DNA, 19 bp, Homo sapiens
actgtttttcggacagttt

SEQ ID NO: 5557842 - DNA, 14 bp, Homo sapiens
actgtttttgaaga

SEQ ID NO: 5557843 - DNA, 17 bp, Homo sapiens
actgtttttgataaagt

SEQ ID NO: 5557844 - DNA, 15 bp, Homo sapiens
actgtttttgctatt

SEQ ID NO: 5557845 - DNA, 23 bp, Homo sapiens
actgtttttgctattacatgtgt

SEQ ID NO: 5557846 - DNA, 20 bp, Homo sapiens
actgttttttaaactaggaa

SEQ ID NO: 5557847 - DNA, 19 bp, Homo sapiens
actgttttttttgcagggg

SEQ ID NO: 5557848 - DNA, 20 bp, Homo sapiens
acttaaaaaaaaaaaaaagc

SEQ ID NO: 5557849 - DNA, 15 bp, Homo sapiens
acttaaaaaaatgac

SEQ ID NO: 5557850 - DNA, 16 bp, Homo sapiens
acttaaaaaaatgaca

SEQ ID NO: 5557851 - DNA, 14 bp, Homo sapiens
acttaaaaaatgtc

SEQ ID NO: 5557852 - DNA, 13 bp, Homo sapiens
acttaaaaagtct

SEQ ID NO: 5557853 - DNA, 21 bp, Homo sapiens
acttaaaaatggtttaaatgg

SEQ ID NO: 5557854 - DNA, 17 bp, Homo sapiens
acttaaaaatgtaaata

SEQ ID NO: 5557855 - DNA, 14 bp, Homo sapiens
acttaaaaattaat

SEQ ID NO: 5557856 - DNA, 15 bp, Homo sapiens
acttaaaaattagca

SEQ ID NO: 5557857 - DNA, 13 bp, Homo sapiens
acttaaaacatat

SEQ ID NO: 5557858 - DNA, 13 bp, Homo sapiens
acttaaaacatgg

SEQ ID NO: 5557859 - DNA, 17 bp, Homo sapiens
acttaaaagaaaacaaa

SEQ ID NO: 5557860 - DNA, 14 bp, Homo sapiens
acttaaaagaacat

SEQ ID NO: 5557861 - DNA, 21 bp, Homo sapiens
acttaaaagatggtgaactgt

SEQ ID NO: 5557862 - DNA, 22 bp, Homo sapiens
acttaaaagttaagttggtaaa

SEQ ID NO: 5557863 - DNA, 13 bp, Homo sapiens
acttaaaatattt

SEQ ID NO: 5557864 - DNA, 19 bp, Homo sapiens
acttaaaatgacaaagcca

SEQ ID NO: 5557865 - DNA, 16 bp, Homo sapiens
acttaaaatgtgcagt

SEQ ID NO: 5557866 - DNA, 17 bp, Homo sapiens
acttaaaattagtcttt

SEQ ID NO: 5557867 - DNA, 21 bp, Homo sapiens
acttaaaattgtaacctgcat

SEQ ID NO: 5557868 - DNA, 14 bp, Homo sapiens
acttaaacaaaaaa

SEQ ID NO: 5557869 - DNA, 14 bp, Homo sapiens
acttaaacaaaaac

SEQ ID NO: 5557870 - DNA, 20 bp, Homo sapiens
acttaaacagaagcagaggc

SEQ ID NO: 5557871 - DNA, 13 bp, Homo sapiens
acttaaacagctt

SEQ ID NO: 5557872 - DNA, 13 bp, Homo sapiens
acttaaacatcat

SEQ ID NO: 5557873 - DNA, 18 bp, Homo sapiens
acttaaacatcattggat

SEQ ID NO: 5557874 - DNA, 17 bp, Homo sapiens
acttaaacctgtgcttt

SEQ ID NO: 5557875 - DNA, 18 bp, Homo sapiens
acttaaacctgtgctttc

SEQ ID NO: 5557876 - DNA, 19 bp, Homo sapiens
acttaaacctgtgctttca

SEQ ID NO: 5557877 - DNA, 20 bp, Homo sapiens
acttaaacttgcacatttga

SEQ ID NO: 5557878 - DNA, 21 bp, Homo sapiens
acttaaactttgtcacttctg

SEQ ID NO: 5557879 - DNA, 15 bp, Homo sapiens
acttaaagaagtatt

SEQ ID NO: 5557880 - DNA, 22 bp, Homo sapiens
acttaaagaagtatttttagaa

SEQ ID NO: 5557881 - DNA, 22 bp, Homo sapiens
acttaaagcaaaatagtattgc

SEQ ID NO: 5557882 - DNA, 15 bp, Homo sapiens
acttaaagcttgttt

SEQ ID NO: 5557883 - DNA, 20 bp, Homo sapiens
acttaaaggacaggaggagg

SEQ ID NO: 5557884 - DNA, 18 bp, Homo sapiens
acttaaaggcacaaatag

SEQ ID NO: 5557885 - DNA, 12 bp, Homo sapiens
acttaaagtttt

SEQ ID NO: 5557886 - DNA, 13 bp, Homo sapiens
acttaaataattt

SEQ ID NO: 5557887 - DNA, 18 bp, Homo sapiens
acttaaatatcaatcatt

SEQ ID NO: 5557888 - DNA, 14 bp, Homo sapiens
acttaaatattgta

SEQ ID NO: 5557889 - DNA, 22 bp, Homo sapiens
acttaaatattgtaatatgaca

SEQ ID NO: 5557890 - DNA, 14 bp, Homo sapiens
acttaaatatttga

SEQ ID NO: 5557891 - DNA, 15 bp, Homo sapiens
acttaaatatttgaa

SEQ ID NO: 5557892 - DNA, 22 bp, Homo sapiens
acttaaatgaacacagctcttt

SEQ ID NO: 5557893 - DNA, 11 bp, Homo sapiens
acttaaatgag

SEQ ID NO: 5557894 - DNA, 19 bp, Homo sapiens
acttaaatggtaataagca

SEQ ID NO: 5557895 - DNA, 16 bp, Homo sapiens
acttaaatgttaatga

SEQ ID NO: 5557896 - DNA, 14 bp, Homo sapiens
acttaaatgttatg

SEQ ID NO: 5557897 - DNA, 18 bp, Homo sapiens
acttaaatgttattatct

SEQ ID NO: 5557898 - DNA, 15 bp, Homo sapiens
acttaaattcttttg

SEQ ID NO: 5557899 - DNA, 23 bp, Homo sapiens
acttaaatttggtttgttaattc

SEQ ID NO: 5557900 - DNA, 13 bp, Homo sapiens
acttaaatttgtt

SEQ ID NO: 5557901 - DNA, 18 bp, Homo sapiens
acttaacaaatacattca

SEQ ID NO: 5557902 - DNA, 19 bp, Homo sapiens
acttaacaaatacattcaa

SEQ ID NO: 5557903 - DNA, 15 bp, Homo sapiens
acttaacattcctaa

SEQ ID NO: 5557904 - DNA, 21 bp, Homo sapiens
acttaacattcctaaaatgct

SEQ ID NO: 5557905 - DNA, 14 bp, Homo sapiens
acttaacattgcat

SEQ ID NO: 5557906 - DNA, 16 bp, Homo sapiens
acttaaccgcatcaga

SEQ ID NO: 5557907 - DNA, 18 bp, Homo sapiens
acttaaccgcatcagaag

SEQ ID NO: 5557908 - DNA, 14 bp, Homo sapiens
acttaaccttgaaa

SEQ ID NO: 5557909 - DNA, 19 bp, Homo sapiens
acttaacggctccaggatt

SEQ ID NO: 5557910 - DNA, 13 bp, Homo sapiens
acttaactacttt

SEQ ID NO: 5557911 - DNA, 22 bp, Homo sapiens
acttaactgaaatgcctgcttt

SEQ ID NO: 5557912 - DNA, 17 bp, Homo sapiens
acttaactgtgtgaaga

SEQ ID NO: 5557913 - DNA, 19 bp, Homo sapiens
acttaactgtgtgaagaaa

SEQ ID NO: 5557914 - DNA, 16 bp, Homo sapiens
acttaactgtttcaaa

SEQ ID NO: 5557915 - DNA, 16 bp, Homo sapiens
acttaactttaactga

SEQ ID NO: 5557916 - DNA, 15 bp, Homo sapiens
acttaactttttaac

SEQ ID NO: 5557917 - DNA, 17 bp, Homo sapiens
acttaagaaagcaaaac

SEQ ID NO: 5557918 - DNA, 13 bp, Homo sapiens
acttaagaattga

SEQ ID NO: 5557919 - DNA, 19 bp, Homo sapiens
acttaagacaaatgggact

SEQ ID NO: 5557920 - DNA, 22 bp, Homo sapiens
acttaagacaaatgggactgat

SEQ ID NO: 5557921 - DNA, 23 bp, Homo sapiens
acttaagacaaatgggactgatg

SEQ ID NO: 5557922 - DNA, 11 bp, Homo sapiens
acttaagactt

SEQ ID NO: 5557923 - DNA, 14 bp, Homo sapiens
acttaagagaaatg

SEQ ID NO: 5557924 - DNA, 15 bp, Homo sapiens
acttaagagaaatgg

SEQ ID NO: 5557925 - DNA, 13 bp, Homo sapiens
acttaagattaaa

SEQ ID NO: 5557926 - DNA, 13 bp, Homo sapiens
acttaagcaaaag

SEQ ID NO: 5557927 - DNA, 17 bp, Homo sapiens
acttaagcatctggctc

SEQ ID NO: 5557928 - DNA, 21 bp, Homo sapiens
acttaagcccagtgcactgaa

SEQ ID NO: 5557929 - DNA, 19 bp, Homo sapiens
acttaagctcccctgcctt

SEQ ID NO: 5557930 - DNA, 16 bp, Homo sapiens
acttaaggaagtttga

SEQ ID NO: 5557931 - DNA, 16 bp, Homo sapiens
acttaaggagaaatag

SEQ ID NO: 5557932 - DNA, 16 bp, Homo sapiens
acttaagtgcactttt

SEQ ID NO: 5557933 - DNA, 14 bp, Homo sapiens
acttaagtgttcat

SEQ ID NO: 5557934 - DNA, 15 bp, Homo sapiens
acttaagtgttcatt

SEQ ID NO: 5557935 - DNA, 16 bp, Homo sapiens
acttaagtgttcattt

SEQ ID NO: 5557936 - DNA, 21 bp, Homo sapiens
acttaagtttgtaagacagtg

SEQ ID NO: 5557937 - DNA, 20 bp, Homo sapiens
acttaataacacttcacctt

SEQ ID NO: 5557938 - DNA, 15 bp, Homo sapiens
acttaataatcaaga

SEQ ID NO: 5557939 - DNA, 20 bp, Homo sapiens
acttaataatttttacctaa

SEQ ID NO: 5557940 - DNA, 21 bp, Homo sapiens
acttaatactaccttgaaaat

SEQ ID NO: 5557941 - DNA, 17 bp, Homo sapiens
acttaatactgaatttc

SEQ ID NO: 5557942 - DNA, 18 bp, Homo sapiens
acttaatcaattaatttt

SEQ ID NO: 5557943 - DNA, 19 bp, Homo sapiens
acttaatcaattaattttt

SEQ ID NO: 5557944 - DNA, 14 bp, Homo sapiens
acttaatcatatca

SEQ ID NO: 5557945 - DNA, 17 bp, Homo sapiens
acttaatctaaatggaa

SEQ ID NO: 5557946 - DNA, 19 bp, Homo sapiens
acttaatctaaatggaacc

SEQ ID NO: 5557947 - DNA, 22 bp, Homo sapiens
acttaatctaaatggaaccact

SEQ ID NO: 5557948 - DNA, 16 bp, Homo sapiens
acttaatctaagaaac

SEQ ID NO: 5557949 - DNA, 11 bp, Homo sapiens
acttaatcttc

SEQ ID NO: 5557950 - DNA, 19 bp, Homo sapiens
acttaatcttctctcttga

SEQ ID NO: 5557951 - DNA, 13 bp, Homo sapiens
acttaatgaacca

SEQ ID NO: 5557952 - DNA, 20 bp, Homo sapiens
acttaatgaccatgttatat

SEQ ID NO: 5557953 - DNA, 23 bp, Homo sapiens
acttaatggctgttgagggccac

SEQ ID NO: 5557954 - DNA, 13 bp, Homo sapiens
acttaatgtatgt

SEQ ID NO: 5557955 - DNA, 19 bp, Homo sapiens
acttcagttttatttttgc

SEQ ID NO: 5557956 - DNA, 16 bp, Homo sapiens
acttcatacaacatat

SEQ ID NO: 5557957 - DNA, 16 bp, Homo sapiens
acttcatataactgag

SEQ ID NO: 5557958 - DNA, 14 bp, Homo sapiens
acttcatatagcat

SEQ ID NO: 5557959 - DNA, 19 bp, Homo sapiens
acttcatatagcattgata

SEQ ID NO: 5557960 - DNA, 15 bp, Homo sapiens
acttcatattttata

SEQ ID NO: 5557961 - DNA, 15 bp, Homo sapiens
acttcatcaaacatg

SEQ ID NO: 5557962 - DNA, 20 bp, Homo sapiens
acttcatcaaacatgggttt

SEQ ID NO: 5557963 - DNA, 16 bp, Homo sapiens
acttcatcccagctgc

SEQ ID NO: 5557964 - DNA, 19 bp, Homo sapiens
acttcatcccagctgctga

SEQ ID NO: 5557965 - DNA, 21 bp, Homo sapiens
acttcatcccagctgctgagg

SEQ ID NO: 5557966 - DNA, 23 bp, Homo sapiens
acttcatcccggagcgcacctgc

SEQ ID NO: 5557967 - DNA, 18 bp, Homo sapiens
acttcatcgacttagcct

SEQ ID NO: 5557968 - DNA, 14 bp, Homo sapiens
acttcatctgccac

SEQ ID NO: 5557969 - DNA, 16 bp, Homo sapiens
acttcatctggctgcc

SEQ ID NO: 5557970 - DNA, 20 bp, Homo sapiens
acttcatcttccccaagtgc

SEQ ID NO: 5557971 - DNA, 18 bp, Homo sapiens
acttcatgagcattcata

SEQ ID NO: 5557972 - DNA, 13 bp, Homo sapiens
acttcatgcccac

SEQ ID NO: 5557973 - DNA, 18 bp, Homo sapiens
acttcatgcccactgccg

SEQ ID NO: 5557974 - DNA, 13 bp, Homo sapiens
acttcatggacca

SEQ ID NO: 5557975 - DNA, 14 bp, Homo sapiens
acttcatggaccaa

SEQ ID NO: 5557976 - DNA, 22 bp, Homo sapiens
acttcatggcctttgataaatg

SEQ ID NO: 5557977 - DNA, 22 bp, Homo sapiens
acttcatgtaattttattttaa

SEQ ID NO: 5557978 - DNA, 14 bp, Homo sapiens
acttcatgtcaact

SEQ ID NO: 5557979 - DNA, 20 bp, Homo sapiens
acttcatgtttttcacctat

SEQ ID NO: 5557980 - DNA, 17 bp, Homo sapiens
acttcattaataataaa

SEQ ID NO: 5557981 - DNA, 18 bp, Homo sapiens
acttcattaatttcaatc

SEQ ID NO: 5557982 - DNA, 22 bp, Homo sapiens
acttcattcagaggttttgtta

SEQ ID NO: 5557983 - DNA, 13 bp, Homo sapiens
acttcattctaaa

SEQ ID NO: 5557984 - DNA, 18 bp, Homo sapiens
acttcattctaaaccaaa

SEQ ID NO: 5557985 - DNA, 20 bp, Homo sapiens
acttcattctaaaccaaaac

SEQ ID NO: 5557986 - DNA, 14 bp, Homo sapiens
acttcattcttgaa

SEQ ID NO: 5557987 - DNA, 15 bp, Homo sapiens
acttcattcttgaaa

SEQ ID NO: 5557988 - DNA, 21 bp, Homo sapiens
acttcattcttgaaagctgtg

SEQ ID NO: 5557989 - DNA, 17 bp, Homo sapiens
acttcattgtaaatcac

SEQ ID NO: 5557990 - DNA, 19 bp, Homo sapiens
acttcattgtaaatcactt

SEQ ID NO: 5557991 - DNA, 20 bp, Homo sapiens
acttcatttaaaaaaatcac

SEQ ID NO: 5557992 - DNA, 13 bp, Homo sapiens
acttcatttaaca

SEQ ID NO: 5557993 - DNA, 20 bp, Homo sapiens
acttcatttctgatgtgaaa

SEQ ID NO: 5557994 - DNA, 17 bp, Homo sapiens
acttcatttggtgctgg

SEQ ID NO: 5557995 - DNA, 15 bp, Homo sapiens
acttcatttgtgcca

SEQ ID NO: 5557996 - DNA, 17 bp, Homo sapiens
acttcattttatattta

SEQ ID NO: 5557997 - DNA, 14 bp, Homo sapiens
acttcattttcaga

SEQ ID NO: 5557998 - DNA, 16 bp, Homo sapiens
acttcattttcagagt

SEQ ID NO: 5557999 - DNA, 16 bp, Homo sapiens
acttcattttctcaaa

SEQ ID NO: 5558000 - DNA, 19 bp, Homo sapiens
acttcatttttaagaaagg

SEQ ID NO: 5558001 - DNA, 23 bp, Homo sapiens
acttcatttttaagaaaggaagc

SEQ ID NO: 5558002 - DNA, 14 bp, Homo sapiens
acttcatttttaat

SEQ ID NO: 5558003 - DNA, 22 bp, Homo sapiens
acttcatttttattaaacagtg

SEQ ID NO: 5558004 - DNA, 22 bp, Homo sapiens
acttcattttttaaaaaatctg

SEQ ID NO: 5558005 - DNA, 16 bp, Homo sapiens
acttccaaaattctta

SEQ ID NO: 5558006 - DNA, 15 bp, Homo sapiens
acttccaaacagtgt

SEQ ID NO: 5558007 - DNA, 16 bp, Homo sapiens
acttccaaactaattt

SEQ ID NO: 5558008 - DNA, 18 bp, Homo sapiens
acttccaaactaattttt

SEQ ID NO: 5558009 - DNA, 19 bp, Homo sapiens
acttccaaactaattttta

SEQ ID NO: 5558010 - DNA, 24 bp, Homo sapiens
acttccaaagactccctccatagc

SEQ ID NO: 5558011 - DNA, 20 bp, Homo sapiens
acttccaaagggttaggact

SEQ ID NO: 5558012 - DNA, 15 bp, Homo sapiens
acttccaaatcctgg

SEQ ID NO: 5558013 - DNA, 22 bp, Homo sapiens
acttccaagacctgactcaggc

SEQ ID NO: 5558014 - DNA, 20 bp, Homo sapiens
acttccaagtgataatttta

SEQ ID NO: 5558015 - DNA, 22 bp, Homo sapiens
acttccacaaaattatgctgca

SEQ ID NO: 5558016 - DNA, 18 bp, Homo sapiens
acttccacacaattattt

SEQ ID NO: 5558017 - DNA, 20 bp, Homo sapiens
acttccacagggtcccacag

SEQ ID NO: 5558018 - DNA, 21 bp, Homo sapiens
acttccacagggtcccacagc

SEQ ID NO: 5558019 - DNA, 20 bp, Homo sapiens
acttccacccccagctcctt

SEQ ID NO: 5558020 - DNA, 22 bp, Homo sapiens
acttccacccccgttagcttcc

SEQ ID NO: 5558021 - DNA, 23 bp, Homo sapiens
acttccacctccaccacatctgc

SEQ ID NO: 5558022 - DNA, 13 bp, Homo sapiens
acttccactttgt

SEQ ID NO: 5558023 - DNA, 21 bp, Homo sapiens
acttccagaggacagctctgg

SEQ ID NO: 5558024 - DNA, 13 bp, Homo sapiens
acttccagagggg

SEQ ID NO: 5558025 - DNA, 17 bp, Homo sapiens
acttccagatatccaca

SEQ ID NO: 5558026 - DNA, 18 bp, Homo sapiens
acttccagatatccacat

SEQ ID NO: 5558027 - DNA, 22 bp, Homo sapiens
acttccagatatccacataaat

SEQ ID NO: 5558028 - DNA, 20 bp, Homo sapiens
acttccagatcctggaaatc

SEQ ID NO: 5558029 - DNA, 13 bp, Homo sapiens
acttccagatttg

SEQ ID NO: 5558030 - DNA, 18 bp, Homo sapiens
acttccagcaaaatccaa

SEQ ID NO: 5558031 - DNA, 19 bp, Homo sapiens
acttccagcaaaatccaaa

SEQ ID NO: 5558032 - DNA, 23 bp, Homo sapiens
acttccagcaaaatccaaactgc

SEQ ID NO: 5558033 - DNA, 17 bp, Homo sapiens
acttccagcttgcctgt

SEQ ID NO: 5558034 - DNA, 19 bp, Homo sapiens
acttccaggagcccagagg

SEQ ID NO: 5558035 - DNA, 16 bp, Homo sapiens
acttccaggggaacct

SEQ ID NO: 5558036 - DNA, 20 bp, Homo sapiens
acttccaggggaacctgcca

SEQ ID NO: 5558037 - DNA, 20 bp, Homo sapiens
acttccaggtctgcctggtt

SEQ ID NO: 5558038 - DNA, 20 bp, Homo sapiens
acttccaggtgttactgtaa

SEQ ID NO: 5558039 - DNA, 21 bp, Homo sapiens
acttccaggtgttactgtaat

SEQ ID NO: 5558040 - DNA, 18 bp, Homo sapiens
acttccagtctggagagc

SEQ ID NO: 5558041 - DNA, 20 bp, Homo sapiens
acttccagtgcaacactgaa

SEQ ID NO: 5558042 - DNA, 19 bp, Homo sapiens
acttccataggacatactg

SEQ ID NO: 5558043 - DNA, 22 bp, Homo sapiens
acttccataggacatactgcat

SEQ ID NO: 5558044 - DNA, 14 bp, Homo sapiens
acttccatgaattt

SEQ ID NO: 5558045 - DNA, 17 bp, Homo sapiens
acttccatgatacttta

SEQ ID NO: 5558046 - DNA, 17 bp, Homo sapiens
acttccattctttcttc

SEQ ID NO: 5558047 - DNA, 19 bp, Homo sapiens
acttccattctttcttcct

SEQ ID NO: 5558048 - DNA, 18 bp, Homo sapiens
acttccattgcaaaatag

SEQ ID NO: 5558049 - DNA, 22 bp, Homo sapiens
acttccattgcaaaatagaaga

SEQ ID NO: 5558050 - DNA, 15 bp, Homo sapiens
acttccattgtttaa

SEQ ID NO: 5558051 - DNA, 22 bp, Homo sapiens
acttccatttggaatcatatgg

SEQ ID NO: 5558052 - DNA, 16 bp, Homo sapiens
acttccatttgtattc

SEQ ID NO: 5558053 - DNA, 17 bp, Homo sapiens
acttcccaacagcctta

SEQ ID NO: 5558054 - DNA, 11 bp, Homo sapiens
acttcccaagc

SEQ ID NO: 5558055 - DNA, 19 bp, Homo sapiens
acttcccaagccctggtga

SEQ ID NO: 5558056 - DNA, 20 bp, Homo sapiens
acttcccacacggcagcccc

SEQ ID NO: 5558057 - DNA, 22 bp, Homo sapiens
acttcccacacggcagcccccc

SEQ ID NO: 5558058 - DNA, 11 bp, Homo sapiens
acttcccagct

SEQ ID NO: 5558059 - DNA, 13 bp, Homo sapiens
acttcccagctgg

SEQ ID NO: 5558060 - DNA, 16 bp, Homo sapiens
acttcccagctggcag

SEQ ID NO: 5558061 - DNA, 14 bp, Homo sapiens
acttcccatctcca

SEQ ID NO: 5558062 - DNA, 13 bp, Homo sapiens
acttccccaagat

SEQ ID NO: 5558063 - DNA, 20 bp, Homo sapiens
acttccccaagatctgccag

SEQ ID NO: 5558064 - DNA, 15 bp, Homo sapiens
acttccccaagcctg

SEQ ID NO: 5558065 - DNA, 20 bp, Homo sapiens
acttccccaagcctggcagg

SEQ ID NO: 5558066 - DNA, 18 bp, Homo sapiens
acttccccaatatcttgc

SEQ ID NO: 5558067 - DNA, 21 bp, Homo sapiens
acttccccaatatcttgcttg

SEQ ID NO: 5558068 - DNA, 21 bp, Homo sapiens
acttccccacggatggcggtg

SEQ ID NO: 5558069 - DNA, 18 bp, Homo sapiens
acttccccatacaaataa

SEQ ID NO: 5558070 - DNA, 14 bp, Homo sapiens
acttccccatctgt

SEQ ID NO: 5558071 - DNA, 20 bp, Homo sapiens
acttccccatggccctgagc

SEQ ID NO: 5558072 - DNA, 21 bp, Homo sapiens
acttcccccaaatttaaagaa

SEQ ID NO: 5558073 - DNA, 22 bp, Homo sapiens
acttcccccaccccagaagatt

SEQ ID NO: 5558074 - DNA, 16 bp, Homo sapiens
acttcccccaccctgg

SEQ ID NO: 5558075 - DNA, 19 bp, Homo sapiens
acttccccctcttcagcat

SEQ ID NO: 5558076 - DNA, 22 bp, Homo sapiens
acttccccctcttcttctgaag

SEQ ID NO: 5558077 - DNA, 14 bp, Homo sapiens
acttcccctatgga

SEQ ID NO: 5558078 - DNA, 16 bp, Homo sapiens
acttcccctcctaccc

SEQ ID NO: 5558079 - DNA, 16 bp, Homo sapiens
acttcccctgcctcct

SEQ ID NO: 5558080 - DNA, 14 bp, Homo sapiens
acttcccctgggca

SEQ ID NO: 5558081 - DNA, 14 bp, Homo sapiens
acttccccttccaa

SEQ ID NO: 5558082 - DNA, 14 bp, Homo sapiens
acttccccttcttg

SEQ ID NO: 5558083 - DNA, 21 bp, Homo sapiens
acttccccttgcaccccttcc

SEQ ID NO: 5558084 - DNA, 17 bp, Homo sapiens
acttccccttgtctccc

SEQ ID NO: 5558085 - DNA, 20 bp, Homo sapiens
acttccccttgtctccctgg

SEQ ID NO: 5558086 - DNA, 19 bp, Homo sapiens
acttcccgggccagggctg

SEQ ID NO: 5558087 - DNA, 22 bp, Homo sapiens
acttcccgtcccatatcctgcc

SEQ ID NO: 5558088 - DNA, 14 bp, Homo sapiens
acttccctagaagt

SEQ ID NO: 5558089 - DNA, 22 bp, Homo sapiens
acttccctgacactgcggggct

SEQ ID NO: 5558090 - DNA, 21 bp, Homo sapiens
acttccctgattgacctgctc

SEQ ID NO: 5558091 - DNA, 22 bp, Homo sapiens
acttccctgattgacctgctcc

SEQ ID NO: 5558092 - DNA, 14 bp, Homo sapiens
acttccctgggaac

SEQ ID NO: 5558093 - DNA, 13 bp, Homo sapiens
acttccctgggcc

SEQ ID NO: 5558094 - DNA, 16 bp, Homo sapiens
acttccctgggcctca

SEQ ID NO: 5558095 - DNA, 14 bp, Homo sapiens
acttccctggtcac

SEQ ID NO: 5558096 - DNA, 16 bp, Homo sapiens
acttccctggtcacca

SEQ ID NO: 5558097 - DNA, 12 bp, Homo sapiens
acttccctgtgt

SEQ ID NO: 5558098 - DNA, 12 bp, Homo sapiens
acttcccttcct

SEQ ID NO: 5558099 - DNA, 22 bp, Homo sapiens
acttccctttctgcttgtgtta

SEQ ID NO: 5558100 - DNA, 15 bp, Homo sapiens
acttccgcctcctgt

SEQ ID NO: 5558101 - DNA, 15 bp, Homo sapiens
acttccgctccctgg

SEQ ID NO: 5558102 - DNA, 13 bp, Homo sapiens
acttccgctgagg

SEQ ID NO: 5558103 - DNA, 22 bp, Homo sapiens
acttccgctgaggggtctcgga

SEQ ID NO: 5558104 - DNA, 16 bp, Homo sapiens
acttccgtcacatccc

SEQ ID NO: 5558105 - DNA, 22 bp, Homo sapiens
acttcctaatgccctatgtgta

SEQ ID NO: 5558106 - DNA, 14 bp, Homo sapiens
acttcctacagagc

SEQ ID NO: 5558107 - DNA, 21 bp, Homo sapiens
acttcctagagcatctgtccc

SEQ ID NO: 5558108 - DNA, 16 bp, Homo sapiens
acttcctattaattta

SEQ ID NO: 5558109 - DNA, 22 bp, Homo sapiens
acttcctccacagtcccccacc

SEQ ID NO: 5558110 - DNA, 15 bp, Homo sapiens
acttcctccagaagc

SEQ ID NO: 5558111 - DNA, 19 bp, Homo sapiens
acttcctccagaagcctcc

SEQ ID NO: 5558112 - DNA, 13 bp, Homo sapiens
acttcctcctacc

SEQ ID NO: 5558113 - DNA, 17 bp, Homo sapiens
acttcctcctacctggg

SEQ ID NO: 5558114 - DNA, 23 bp, Homo sapiens
acttcctcctacctggggactcc

SEQ ID NO: 5558115 - DNA, 17 bp, Homo sapiens
acttcctcctccccact

SEQ ID NO: 5558116 - DNA, 13 bp, Homo sapiens
acttcctcctcct

SEQ ID NO: 5558117 - DNA, 14 bp, Homo sapiens
acttcctcctcctc

SEQ ID NO: 5558118 - DNA, 12 bp, Homo sapiens
acttcctcctga

SEQ ID NO: 5558119 - DNA, 23 bp, Homo sapiens
acttcctcctgatggccaagagc

SEQ ID NO: 5558120 - DNA, 17 bp, Homo sapiens
acttcctcgcctctccc

SEQ ID NO: 5558121 - DNA, 20 bp, Homo sapiens
acttcctctaggaaatgtac

SEQ ID NO: 5558122 - DNA, 15 bp, Homo sapiens
acttcctctccagcc

SEQ ID NO: 5558123 - DNA, 20 bp, Homo sapiens
acttcctctctaccccccac

SEQ ID NO: 5558124 - DNA, 21 bp, Homo sapiens
acttcctctctaccccccacc

SEQ ID NO: 5558125 - DNA, 15 bp, Homo sapiens
acttcctctctcgga

SEQ ID NO: 5558126 - DNA, 14 bp, Homo sapiens
acttcctctgccat

SEQ ID NO: 5558127 - DNA, 16 bp, Homo sapiens
acttcctgactctcac

SEQ ID NO: 5558128 - DNA, 21 bp, Homo sapiens
acttcctgactctcacctgta

SEQ ID NO: 5558129 - DNA, 23 bp, Homo sapiens
acttcctgattggtttctcttct

SEQ ID NO: 5558130 - DNA, 12 bp, Homo sapiens
acttcctgccta

SEQ ID NO: 5558131 - DNA, 20 bp, Homo sapiens
acttgatgtttcctggaagc

SEQ ID NO: 5558132 - DNA, 16 bp, Homo sapiens
acttgattaagatttt

SEQ ID NO: 5558133 - DNA, 15 bp, Homo sapiens
acttgattcaggagg

SEQ ID NO: 5558134 - DNA, 17 bp, Homo sapiens
acttgattcatctctgg

SEQ ID NO: 5558135 - DNA, 18 bp, Homo sapiens
acttgattcatctctggt

SEQ ID NO: 5558136 - DNA, 13 bp, Homo sapiens
acttgattcttgt

SEQ ID NO: 5558137 - DNA, 14 bp, Homo sapiens
acttgattgagaaa

SEQ ID NO: 5558138 - DNA, 15 bp, Homo sapiens
acttgattgagaaag

SEQ ID NO: 5558139 - DNA, 23 bp, Homo sapiens
acttgcaaaaagggtcagtatgg

SEQ ID NO: 5558140 - DNA, 23 bp, Homo sapiens
acttgcaaaaagtagacttggtg

SEQ ID NO: 5558141 - DNA, 14 bp, Homo sapiens
acttgcaaaatgga

SEQ ID NO: 5558142 - DNA, 19 bp, Homo sapiens
acttgcaaatgaatgcctt

SEQ ID NO: 5558143 - DNA, 16 bp, Homo sapiens
acttgcaactaaggac

SEQ ID NO: 5558144 - DNA, 18 bp, Homo sapiens
acttgcaactaaggacaa

SEQ ID NO: 5558145 - DNA, 22 bp, Homo sapiens
acttgcaactaaggacaaatta

SEQ ID NO: 5558146 - DNA, 14 bp, Homo sapiens
acttgcacaagctt

SEQ ID NO: 5558147 - DNA, 17 bp, Homo sapiens
acttgcacaagcttgta

SEQ ID NO: 5558148 - DNA, 23 bp, Homo sapiens
acttgcacactctcccattatat

SEQ ID NO: 5558149 - DNA, 14 bp, Homo sapiens
acttgcacatctct

SEQ ID NO: 5558150 - DNA, 17 bp, Homo sapiens
acttgcacatctctgca

SEQ ID NO: 5558151 - DNA, 16 bp, Homo sapiens
acttgcacatttgaat

SEQ ID NO: 5558152 - DNA, 23 bp, Homo sapiens
acttgcacatttgaattcatttg

SEQ ID NO: 5558153 - DNA, 19 bp, Homo sapiens
acttgcactctttaacaca

SEQ ID NO: 5558154 - DNA, 13 bp, Homo sapiens
acttgcactgaag

SEQ ID NO: 5558155 - DNA, 23 bp, Homo sapiens
acttgcactgaagccggacagct

SEQ ID NO: 5558156 - DNA, 19 bp, Homo sapiens
acttgcactgggggaacag

SEQ ID NO: 5558157 - DNA, 23 bp, Homo sapiens
acttgcactgggggaacagatgc

SEQ ID NO: 5558158 - DNA, 15 bp, Homo sapiens
acttgcactgtgctt

SEQ ID NO: 5558159 - DNA, 12 bp, Homo sapiens
acttgcagagga

SEQ ID NO: 5558160 - DNA, 17 bp, Homo sapiens
acttgcagaggagccca

SEQ ID NO: 5558161 - DNA, 19 bp, Homo sapiens
acttgcagaggagcccagt

SEQ ID NO: 5558162 - DNA, 20 bp, Homo sapiens
acttgcagcgccaagtggcc

SEQ ID NO: 5558163 - DNA, 16 bp, Homo sapiens
acttgcagtgtctttc

SEQ ID NO: 5558164 - DNA, 13 bp, Homo sapiens
acttgcagttgtg

SEQ ID NO: 5558165 - DNA, 14 bp, Homo sapiens
acttgcatcactta

SEQ ID NO: 5558166 - DNA, 19 bp, Homo sapiens
acttgcatgtcccatcacg

SEQ ID NO: 5558167 - DNA, 14 bp, Homo sapiens
acttgcatttttgc

SEQ ID NO: 5558168 - DNA, 17 bp, Homo sapiens
acttgcatttttgcagg

SEQ ID NO: 5558169 - DNA, 21 bp, Homo sapiens
acttgccaaaatgttggctgc

SEQ ID NO: 5558170 - DNA, 22 bp, Homo sapiens
acttgccaaaatgttggctgcg

SEQ ID NO: 5558171 - DNA, 19 bp, Homo sapiens
acttgccaaatttagattt

SEQ ID NO: 5558172 - DNA, 15 bp, Homo sapiens
acttgccactgccat

SEQ ID NO: 5558173 - DNA, 20 bp, Homo sapiens
acttgccagaagttgtggat

SEQ ID NO: 5558174 - DNA, 13 bp, Homo sapiens
acttgccagggct

SEQ ID NO: 5558175 - DNA, 20 bp, Homo sapiens
acttgccatgaaggcacctg

SEQ ID NO: 5558176 - DNA, 21 bp, Homo sapiens
acttgccatgaaggcacctgc

SEQ ID NO: 5558177 - DNA, 21 bp, Homo sapiens
acttgccatgtgactctggct

SEQ ID NO: 5558178 - DNA, 19 bp, Homo sapiens
acttgccattgccaggaga

SEQ ID NO: 5558179 - DNA, 17 bp, Homo sapiens
acttgccatttctttat

SEQ ID NO: 5558180 - DNA, 16 bp, Homo sapiens
acttgccctgaccatg

SEQ ID NO: 5558181 - DNA, 20 bp, Homo sapiens
acttgccctgaccatgcatt

SEQ ID NO: 5558182 - DNA, 21 bp, Homo sapiens
acttgccctgaccatgcattt

SEQ ID NO: 5558183 - DNA, 22 bp, Homo sapiens
acttgccctgagcactcctggt

SEQ ID NO: 5558184 - DNA, 12 bp, Homo sapiens
acttgccctgct

SEQ ID NO: 5558185 - DNA, 16 bp, Homo sapiens
acttgcctatctgact

SEQ ID NO: 5558186 - DNA, 22 bp, Homo sapiens
acttgcctatgatactgtctct

SEQ ID NO: 5558187 - DNA, 11 bp, Homo sapiens
acttgcctcca

SEQ ID NO: 5558188 - DNA, 15 bp, Homo sapiens
acttgcctccatctt

SEQ ID NO: 5558189 - DNA, 16 bp, Homo sapiens
acttgcctccatcttt

SEQ ID NO: 5558190 - DNA, 20 bp, Homo sapiens
acttgcctccatctttttct

SEQ ID NO: 5558191 - DNA, 23 bp, Homo sapiens
acttgcctccatctttttcttgg

SEQ ID NO: 5558192 - DNA, 18 bp, Homo sapiens
acttgcctccgtgtcacc

SEQ ID NO: 5558193 - DNA, 17 bp, Homo sapiens
acttgcctcttccttga

SEQ ID NO: 5558194 - DNA, 20 bp, Homo sapiens
acttgcctcttttacctgct

SEQ ID NO: 5558195 - DNA, 22 bp, Homo sapiens
acttgcctcttttacctgctgc

SEQ ID NO: 5558196 - DNA, 21 bp, Homo sapiens
acttgcctgcctttccatcca

SEQ ID NO: 5558197 - DNA, 13 bp, Homo sapiens
acttgcctggggc

SEQ ID NO: 5558198 - DNA, 17 bp, Homo sapiens
acttgcctggggccaca

SEQ ID NO: 5558199 - DNA, 17 bp, Homo sapiens
acttgcctgtcacccca

SEQ ID NO: 5558200 - DNA, 20 bp, Homo sapiens
acttgcctgttggctgctgc

SEQ ID NO: 5558201 - DNA, 20 bp, Homo sapiens
acttgccttcttcacccagc

SEQ ID NO: 5558202 - DNA, 17 bp, Homo sapiens
acttgcgagaaattcgt

SEQ ID NO: 5558203 - DNA, 14 bp, Homo sapiens
acttgcgagtccaa

SEQ ID NO: 5558204 - DNA, 14 bp, Homo sapiens
acttgcgcagaaaa

SEQ ID NO: 5558205 - DNA, 12 bp, Homo sapiens
acttgcggccac

SEQ ID NO: 5558206 - DNA, 14 bp, Homo sapiens
acttgcggccacag

SEQ ID NO: 5558207 - DNA, 21 bp, Homo sapiens
acttgcggccacagcactaga

SEQ ID NO: 5558208 - DNA, 20 bp, Homo sapiens
acttgcggttccggcatgga

SEQ ID NO: 5558209 - DNA, 14 bp, Homo sapiens
acttgcgtcctgca

SEQ ID NO: 5558210 - DNA, 17 bp, Homo sapiens
acttgcgtcctgcagag

SEQ ID NO: 5558211 - DNA, 16 bp, Homo sapiens
acttgctaaagcactt

SEQ ID NO: 5558212 - DNA, 20 bp, Homo sapiens
acttgctagtgatacactgt

SEQ ID NO: 5558213 - DNA, 22 bp, Homo sapiens
acttgctagtgatacactgtat

SEQ ID NO: 5558214 - DNA, 16 bp, Homo sapiens
acttgctataaataga

SEQ ID NO: 5558215 - DNA, 23 bp, Homo sapiens
acttgctcagacgagacacccta

SEQ ID NO: 5558216 - DNA, 22 bp, Homo sapiens
acttgctcaggtacttgtaaat

SEQ ID NO: 5558217 - DNA, 23 bp, Homo sapiens
acttgctctctggccttttccta

SEQ ID NO: 5558218 - DNA, 14 bp, Homo sapiens
acttgctctggacc

SEQ ID NO: 5558219 - DNA, 16 bp, Homo sapiens
acttgctctggacctg

SEQ ID NO: 5558220 - DNA, 19 bp, Homo sapiens
acttgctctggacctgccc

SEQ ID NO: 5558221 - DNA, 14 bp, Homo sapiens
acttgctcttgatg

SEQ ID NO: 5558222 - DNA, 16 bp, Homo sapiens
acttgctcttgatgcc

SEQ ID NO: 5558223 - DNA, 20 bp, Homo sapiens
acttgctcttgatgcctggc

SEQ ID NO: 5558224 - DNA, 13 bp, Homo sapiens
acttgctgaaaaa

SEQ ID NO: 5558225 - DNA, 18 bp, Homo sapiens
acttgctgaaaaacacaa

SEQ ID NO: 5558226 - DNA, 21 bp, Homo sapiens
acttgctgcagtatgaaaata

SEQ ID NO: 5558227 - DNA, 14 bp, Homo sapiens
acttgctgctcaca

SEQ ID NO: 5558228 - DNA, 15 bp, Homo sapiens
acttgctgctttttc

SEQ ID NO: 5558229 - DNA, 16 bp, Homo sapiens
acttgctggctgtgaa

SEQ ID NO: 5558230 - DNA, 13 bp, Homo sapiens
acttgctgtccag

SEQ ID NO: 5558231 - DNA, 16 bp, Homo sapiens
acttgctgtccaggca

SEQ ID NO: 5558232 - DNA, 16 bp, Homo sapiens
acttgctgtgaaatga

SEQ ID NO: 5558233 - DNA, 21 bp, Homo sapiens
acttgctgtgtgaccctgggc

SEQ ID NO: 5558234 - DNA, 16 bp, Homo sapiens
acttgcttaaatgtga

SEQ ID NO: 5558235 - DNA, 17 bp, Homo sapiens
acttgcttaaatgtgaa

SEQ ID NO: 5558236 - DNA, 20 bp, Homo sapiens
acttgcttaaattgtgggca

SEQ ID NO: 5558237 - DNA, 18 bp, Homo sapiens
acttgcttaaatttctta

SEQ ID NO: 5558238 - DNA, 23 bp, Homo sapiens
acttgcttaaatttcttatgtga

SEQ ID NO: 5558239 - DNA, 20 bp, Homo sapiens
acttgcttattacatttaaa

SEQ ID NO: 5558240 - DNA, 17 bp, Homo sapiens
acttgcttccaagccct

SEQ ID NO: 5558241 - DNA, 14 bp, Homo sapiens
acttgcttcctgca

SEQ ID NO: 5558242 - DNA, 18 bp, Homo sapiens
acttgcttctaaatgccc

SEQ ID NO: 5558243 - DNA, 15 bp, Homo sapiens
acttgcttctctagc

SEQ ID NO: 5558244 - DNA, 22 bp, Homo sapiens
acttgcttcttgtgtttgaaac

SEQ ID NO: 5558245 - DNA, 15 bp, Homo sapiens
acttgcttgccaact

SEQ ID NO: 5558246 - DNA, 21 bp, Homo sapiens
acttgctttatttttcattac

SEQ ID NO: 5558247 - DNA, 14 bp, Homo sapiens
acttgctttcttct

SEQ ID NO: 5558248 - DNA, 15 bp, Homo sapiens
acttgctttcttctt

SEQ ID NO: 5558249 - DNA, 14 bp, Homo sapiens
acttggaaaaagaa

SEQ ID NO: 5558250 - DNA, 18 bp, Homo sapiens
acttggaaaaagaaagaa

SEQ ID NO: 5558251 - DNA, 19 bp, Homo sapiens
acttggaaaggtttcaaga

SEQ ID NO: 5558252 - DNA, 21 bp, Homo sapiens
acttggaaataataaattaac

SEQ ID NO: 5558253 - DNA, 21 bp, Homo sapiens
acttggaaatcagtagaaagc

SEQ ID NO: 5558254 - DNA, 23 bp, Homo sapiens
acttggaacctcattgctaccac

SEQ ID NO: 5558255 - DNA, 14 bp, Homo sapiens
acttggaagctccg

SEQ ID NO: 5558256 - DNA, 15 bp, Homo sapiens
acttggaatttgctt

SEQ ID NO: 5558257 - DNA, 23 bp, Homo sapiens
acttggaatttgcttagccttta

SEQ ID NO: 5558258 - DNA, 21 bp, Homo sapiens
acttggaatttgtaacctcag

SEQ ID NO: 5558259 - DNA, 15 bp, Homo sapiens
acttggacatctctc

SEQ ID NO: 5558260 - DNA, 17 bp, Homo sapiens
acttggacatctctctg

SEQ ID NO: 5558261 - DNA, 19 bp, Homo sapiens
acttggacatctctctggc

SEQ ID NO: 5558262 - DNA, 22 bp, Homo sapiens
acttggacatctctctggcttc

SEQ ID NO: 5558263 - DNA, 12 bp, Homo sapiens
acttggacattt

SEQ ID NO: 5558264 - DNA, 14 bp, Homo sapiens
acttggacatttat

SEQ ID NO: 5558265 - DNA, 20 bp, Homo sapiens
acttggacccaaaaaatcat

SEQ ID NO: 5558266 - DNA, 18 bp, Homo sapiens
acttggactcttgctctt

SEQ ID NO: 5558267 - DNA, 19 bp, Homo sapiens
acttggactcttgctcttt

SEQ ID NO: 5558268 - DNA, 17 bp, Homo sapiens
acttggacttttgatag

SEQ ID NO: 5558269 - DNA, 16 bp, Homo sapiens
acttggagaatactgc

SEQ ID NO: 5558270 - DNA, 18 bp, Homo sapiens
acttggagagagattcag

SEQ ID NO: 5558271 - DNA, 23 bp, Homo sapiens
acttggagagagattcagaagtt

SEQ ID NO: 5558272 - DNA, 20 bp, Homo sapiens
acttggagagcaaaggccca

SEQ ID NO: 5558273 - DNA, 22 bp, Homo sapiens
acttggagagcaaaggcccatg

SEQ ID NO: 5558274 - DNA, 23 bp, Homo sapiens
acttggagagggacgaagaaagg

SEQ ID NO: 5558275 - DNA, 17 bp, Homo sapiens
acttggagatctttgct

SEQ ID NO: 5558276 - DNA, 12 bp, Homo sapiens
acttggagcccg

SEQ ID NO: 5558277 - DNA, 14 bp, Homo sapiens
acttggagcccgtg

SEQ ID NO: 5558278 - DNA, 14 bp, Homo sapiens
acttggagctgtcc

SEQ ID NO: 5558279 - DNA, 14 bp, Homo sapiens
acttggagggccca

SEQ ID NO: 5558280 - DNA, 15 bp, Homo sapiens
acttggagggcccag

SEQ ID NO: 5558281 - DNA, 22 bp, Homo sapiens
acttggagggtctgggggcagc

SEQ ID NO: 5558282 - DNA, 24 bp, Homo sapiens
acttggagggtctgggggcagctg

SEQ ID NO: 5558283 - DNA, 15 bp, Homo sapiens
acttggagtttgcat

SEQ ID NO: 5558284 - DNA, 19 bp, Homo sapiens
acttggatattcaagcctt

SEQ ID NO: 5558285 - DNA, 21 bp, Homo sapiens
acttggatcagatagcaggag

SEQ ID NO: 5558286 - DNA, 13 bp, Homo sapiens
acttggatgagga

SEQ ID NO: 5558287 - DNA, 13 bp, Homo sapiens
acttggatggact

SEQ ID NO: 5558288 - DNA, 15 bp, Homo sapiens
acttggattcaattt

SEQ ID NO: 5558289 - DNA, 13 bp, Homo sapiens
acttggattctct

SEQ ID NO: 5558290 - DNA, 15 bp, Homo sapiens
acttggattctctaa

SEQ ID NO: 5558291 - DNA, 16 bp, Homo sapiens
acttggcaacagaagc

SEQ ID NO: 5558292 - DNA, 22 bp, Homo sapiens
acttggcaaggtcatagacaat

SEQ ID NO: 5558293 - DNA, 18 bp, Homo sapiens
acttggcaccaataaagg

SEQ ID NO: 5558294 - DNA, 13 bp, Homo sapiens
acttggcacttaa

SEQ ID NO: 5558295 - DNA, 15 bp, Homo sapiens
acttggcagccttgt

SEQ ID NO: 5558296 - DNA, 20 bp, Homo sapiens
acttggcagctttttctgtg

SEQ ID NO: 5558297 - DNA, 21 bp, Homo sapiens
acttggcagctttttctgtgg

SEQ ID NO: 5558298 - DNA, 14 bp, Homo sapiens
acttggcaggctga

SEQ ID NO: 5558299 - DNA, 20 bp, Homo sapiens
acttggcatacaaaatattt

SEQ ID NO: 5558300 - DNA, 15 bp, Homo sapiens
acttggcatttctat

SEQ ID NO: 5558301 - DNA, 19 bp, Homo sapiens
acttggccaagcagggagg

SEQ ID NO: 5558302 - DNA, 22 bp, Homo sapiens
acttggcccagaaagctgcgga

SEQ ID NO: 5558303 - DNA, 18 bp, Homo sapiens
acttggcccccttcagga

SEQ ID NO: 5558304 - DNA, 20 bp, Homo sapiens
acttggcccccttcaggagc

SEQ ID NO: 5558305 - DNA, 17 bp, Homo sapiens
acttggccgcttcccta

SEQ ID NO: 5558306 - DNA, 15 bp, Homo sapiens
acttggcctcagctg

SEQ ID NO: 5558307 - DNA, 16 bp, Homo sapiens
acttggcctcagctgg

SEQ ID NO: 5558308 - DNA, 23 bp, Homo sapiens
acttgtgtcccatgatccctgtg

SEQ ID NO: 5558309 - DNA, 11 bp, Homo sapiens
acttgtgtctg

SEQ ID NO: 5558310 - DNA, 23 bp, Homo sapiens
acttgtgtgtgggctgtgagtgt

SEQ ID NO: 5558311 - DNA, 14 bp, Homo sapiens
acttgtgttcattg

SEQ ID NO: 5558312 - DNA, 14 bp, Homo sapiens
acttgtgtttgctt

SEQ ID NO: 5558313 - DNA, 20 bp, Homo sapiens
acttgtgtttgtatataaat

SEQ ID NO: 5558314 - DNA, 17 bp, Homo sapiens
acttgtgttttaaaata

SEQ ID NO: 5558315 - DNA, 16 bp, Homo sapiens
acttgtgttttgcaag

SEQ ID NO: 5558316 - DNA, 17 bp, Homo sapiens
acttgttacctttccca

SEQ ID NO: 5558317 - DNA, 15 bp, Homo sapiens
acttgttagatctag

SEQ ID NO: 5558318 - DNA, 21 bp, Homo sapiens
acttgttcaacagtttctcaa

SEQ ID NO: 5558319 - DNA, 11 bp, Homo sapiens
acttgttcatt

SEQ ID NO: 5558320 - DNA, 14 bp, Homo sapiens
acttgttcatttct

SEQ ID NO: 5558321 - DNA, 15 bp, Homo sapiens
acttgttccagctct

SEQ ID NO: 5558322 - DNA, 21 bp, Homo sapiens
acttgttctcagagcactgtg

SEQ ID NO: 5558323 - DNA, 19 bp, Homo sapiens
acttgttcttccaaagcag

SEQ ID NO: 5558324 - DNA, 17 bp, Homo sapiens
acttgttcttggttcct

SEQ ID NO: 5558325 - DNA, 14 bp, Homo sapiens
acttgttgaattta

SEQ ID NO: 5558326 - DNA, 22 bp, Homo sapiens
acttgttgcagactggtgttaa

SEQ ID NO: 5558327 - DNA, 16 bp, Homo sapiens
acttgttgcctataag

SEQ ID NO: 5558328 - DNA, 22 bp, Homo sapiens
acttgttggcgtaggctacaga

SEQ ID NO: 5558329 - DNA, 14 bp, Homo sapiens
acttgttggtgtgg

SEQ ID NO: 5558330 - DNA, 16 bp, Homo sapiens
acttgttggtgtggat

SEQ ID NO: 5558331 - DNA, 20 bp, Homo sapiens
acttgttgtatctgctggat

SEQ ID NO: 5558332 - DNA, 15 bp, Homo sapiens
acttgttgtggctct

SEQ ID NO: 5558333 - DNA, 18 bp, Homo sapiens
acttgttgtttaatgttt

SEQ ID NO: 5558334 - DNA, 20 bp, Homo sapiens
acttgttgtttaatgtttaa

SEQ ID NO: 5558335 - DNA, 14 bp, Homo sapiens
acttgtttaacatt

SEQ ID NO: 5558336 - DNA, 14 bp, Homo sapiens
acttgtttaataaa

SEQ ID NO: 5558337 - DNA, 17 bp, Homo sapiens
acttgtttagagagcct

SEQ ID NO: 5558338 - DNA, 13 bp, Homo sapiens
acttgtttccaat

SEQ ID NO: 5558339 - DNA, 12 bp, Homo sapiens
acttgtttctat

SEQ ID NO: 5558340 - DNA, 20 bp, Homo sapiens
acttgtttgaatatttgttt

SEQ ID NO: 5558341 - DNA, 21 bp, Homo sapiens
acttgtttgtaaaagagctgt

SEQ ID NO: 5558342 - DNA, 20 bp, Homo sapiens
acttgtttgtgcatcctgtg

SEQ ID NO: 5558343 - DNA, 16 bp, Homo sapiens
acttgtttgtgtttga

SEQ ID NO: 5558344 - DNA, 16 bp, Homo sapiens
acttgttttctgggaa

SEQ ID NO: 5558345 - DNA, 16 bp, Homo sapiens
acttgttttggatgcc

SEQ ID NO: 5558346 - DNA, 19 bp, Homo sapiens
acttgttttggatggcttg

SEQ ID NO: 5558347 - DNA, 13 bp, Homo sapiens
actttaaaaagga

SEQ ID NO: 5558348 - DNA, 14 bp, Homo sapiens
actttaaaaaggaa

SEQ ID NO: 5558349 - DNA, 20 bp, Homo sapiens
actttaaaaaggaaatttgt

SEQ ID NO: 5558350 - DNA, 15 bp, Homo sapiens
actttaaaagaaaat

SEQ ID NO: 5558351 - DNA, 14 bp, Homo sapiens
actttaaaagcatt

SEQ ID NO: 5558352 - DNA, 16 bp, Homo sapiens
actttaaaaggcaact

SEQ ID NO: 5558353 - DNA, 20 bp, Homo sapiens
actttaaaaggcaactcaaa

SEQ ID NO: 5558354 - DNA, 20 bp, Homo sapiens
actttaaaatgcgaaattat

SEQ ID NO: 5558355 - DNA, 11 bp, Homo sapiens
actttaaacta

SEQ ID NO: 5558356 - DNA, 12 bp, Homo sapiens
actttaaaggaa

SEQ ID NO: 5558357 - DNA, 12 bp, Homo sapiens
actttaaagtct

SEQ ID NO: 5558358 - DNA, 15 bp, Homo sapiens
actttaaagtctttc

SEQ ID NO: 5558359 - DNA, 12 bp, Homo sapiens
actttaaatatt

SEQ ID NO: 5558360 - DNA, 19 bp, Homo sapiens
actttaaatcctaccaaag

SEQ ID NO: 5558361 - DNA, 20 bp, Homo sapiens
actttaaatcctaccaaagt

SEQ ID NO: 5558362 - DNA, 21 bp, Homo sapiens
actttaaatcctaccaaagta

SEQ ID NO: 5558363 - DNA, 18 bp, Homo sapiens
actttaaatcttttcttc

SEQ ID NO: 5558364 - DNA, 14 bp, Homo sapiens
actttaaattatat

SEQ ID NO: 5558365 - DNA, 16 bp, Homo sapiens
actttaaattatatga

SEQ ID NO: 5558366 - DNA, 16 bp, Homo sapiens
actttaaatttaaagt

SEQ ID NO: 5558367 - DNA, 17 bp, Homo sapiens
actttaaattttttaaa

SEQ ID NO: 5558368 - DNA, 23 bp, Homo sapiens
actttaacataagctatttttct

SEQ ID NO: 5558369 - DNA, 16 bp, Homo sapiens
actttaacattttgga

SEQ ID NO: 5558370 - DNA, 19 bp, Homo sapiens
actttaacattttggaaat

SEQ ID NO: 5558371 - DNA, 22 bp, Homo sapiens
actttaacattttggaaattgt

SEQ ID NO: 5558372 - DNA, 19 bp, Homo sapiens
actttaaccctctcttccc

SEQ ID NO: 5558373 - DNA, 20 bp, Homo sapiens
actttaaccctctcttccct

SEQ ID NO: 5558374 - DNA, 20 bp, Homo sapiens
actttaacttagttttgcat

SEQ ID NO: 5558375 - DNA, 17 bp, Homo sapiens
actttaacttccacttt

SEQ ID NO: 5558376 - DNA, 21 bp, Homo sapiens
actttaacttccactttgtat

SEQ ID NO: 5558377 - DNA, 15 bp, Homo sapiens
actttaacttttaat

SEQ ID NO: 5558378 - DNA, 17 bp, Homo sapiens
actttaagagagaaatc

SEQ ID NO: 5558379 - DNA, 23 bp, Homo sapiens
actttaagagagaaatctgaaaa

SEQ ID NO: 5558380 - DNA, 13 bp, Homo sapiens
actttaagcacta

SEQ ID NO: 5558381 - DNA, 14 bp, Homo sapiens
actttaagcactac

SEQ ID NO: 5558382 - DNA, 16 bp, Homo sapiens
actttaagcactacat

SEQ ID NO: 5558383 - DNA, 18 bp, Homo sapiens
actttaagttaaatatgt

SEQ ID NO: 5558384 - DNA, 15 bp, Homo sapiens
actttaagtttcagg

SEQ ID NO: 5558385 - DNA, 22 bp, Homo sapiens
actttaataataaaaatcatgc

SEQ ID NO: 5558386 - DNA, 21 bp, Homo sapiens
actttaatactcacctcctcc

SEQ ID NO: 5558387 - DNA, 12 bp, Homo sapiens
actttaatgata

SEQ ID NO: 5558388 - DNA, 15 bp, Homo sapiens
actttaatggcctgg

SEQ ID NO: 5558389 - DNA, 17 bp, Homo sapiens
actttaattgaagaact

SEQ ID NO: 5558390 - DNA, 12 bp, Homo sapiens
actttaattgtg

SEQ ID NO: 5558391 - DNA, 13 bp, Homo sapiens
actttaattgtgt

SEQ ID NO: 5558392 - DNA, 14 bp, Homo sapiens
actttaattgtgtg

SEQ ID NO: 5558393 - DNA, 10 bp, Homo sapiens
actttaattt

SEQ ID NO: 5558394 - DNA, 22 bp, Homo sapiens
actttaatttatgtaacttgaa

SEQ ID NO: 5558395 - DNA, 22 bp, Homo sapiens
actttaatttttataaatatgt

SEQ ID NO: 5558396 - DNA, 19 bp, Homo sapiens
actttacaaacctttgttt

SEQ ID NO: 5558397 - DNA, 16 bp, Homo sapiens
actttacacaagaatc

SEQ ID NO: 5558398 - DNA, 18 bp, Homo sapiens
actttacacaatagaatt

SEQ ID NO: 5558399 - DNA, 18 bp, Homo sapiens
actttacactcggctttg

SEQ ID NO: 5558400 - DNA, 21 bp, Homo sapiens
actttacactctctgtacaaa

SEQ ID NO: 5558401 - DNA, 14 bp, Homo sapiens
actttacagaaatg

SEQ ID NO: 5558402 - DNA, 24 bp, Homo sapiens
actttacaggaaaaaaaattctgt

SEQ ID NO: 5558403 - DNA, 14 bp, Homo sapiens
actttacaggaggt

SEQ ID NO: 5558404 - DNA, 21 bp, Homo sapiens
actttacaggaggttgtggat

SEQ ID NO: 5558405 - DNA, 17 bp, Homo sapiens
actttacatgacacagc

SEQ ID NO: 5558406 - DNA, 18 bp, Homo sapiens
actttacatgacacagct

SEQ ID NO: 5558407 - DNA, 20 bp, Homo sapiens
actttacatgacacagcttt

SEQ ID NO: 5558408 - DNA, 18 bp, Homo sapiens
actttaccaaatgaaatg

SEQ ID NO: 5558409 - DNA, 15 bp, Homo sapiens
actttaccaccccca

SEQ ID NO: 5558410 - DNA, 15 bp, Homo sapiens
actttacctctctgt

SEQ ID NO: 5558411 - DNA, 19 bp, Homo sapiens
actttaccttttttataca

SEQ ID NO: 5558412 - DNA, 22 bp, Homo sapiens
actttaccttttttatacataa

SEQ ID NO: 5558413 - DNA, 18 bp, Homo sapiens
actttacgctgtctgtaa

SEQ ID NO: 5558414 - DNA, 19 bp, Homo sapiens
actttacgctgtctgtaat

SEQ ID NO: 5558415 - DNA, 13 bp, Homo sapiens
actttactctaag

SEQ ID NO: 5558416 - DNA, 15 bp, Homo sapiens
actttacttgtggtg

SEQ ID NO: 5558417 - DNA, 13 bp, Homo sapiens
actttactttcag

SEQ ID NO: 5558418 - DNA, 21 bp, Homo sapiens
actttacttttgctgtttata

SEQ ID NO: 5558419 - DNA, 19 bp, Homo sapiens
actttactttttccatttg

SEQ ID NO: 5558420 - DNA, 12 bp, Homo sapiens
actttagaaata

SEQ ID NO: 5558421 - DNA, 15 bp, Homo sapiens
actttagaagcctgc

SEQ ID NO: 5558422 - DNA, 19 bp, Homo sapiens
actttagaagtgcatttct

SEQ ID NO: 5558423 - DNA, 15 bp, Homo sapiens
actttagagtagcat

SEQ ID NO: 5558424 - DNA, 23 bp, Homo sapiens
actttagagtgactaaaaggaaa

SEQ ID NO: 5558425 - DNA, 13 bp, Homo sapiens
actttagatgctg

SEQ ID NO: 5558426 - DNA, 22 bp, Homo sapiens
actttagatgttttgggatcag

SEQ ID NO: 5558427 - DNA, 15 bp, Homo sapiens
actttagcatcagaa

SEQ ID NO: 5558428 - DNA, 16 bp, Homo sapiens
actttagctatgtgga

SEQ ID NO: 5558429 - DNA, 22 bp, Homo sapiens
actttagctgcatcctccaaga

SEQ ID NO: 5558430 - DNA, 16 bp, Homo sapiens
actttagcttttcctt

SEQ ID NO: 5558431 - DNA, 20 bp, Homo sapiens
actttaggatgagcaaaaca

SEQ ID NO: 5558432 - DNA, 17 bp, Homo sapiens
actttaggctttcagct

SEQ ID NO: 5558433 - DNA, 18 bp, Homo sapiens
actttaggctttcagctt

SEQ ID NO: 5558434 - DNA, 13 bp, Homo sapiens
actttagggaagt

SEQ ID NO: 5558435 - DNA, 23 bp, Homo sapiens
actttagggctgtaaaatgcatg

SEQ ID NO: 5558436 - DNA, 19 bp, Homo sapiens
actttagggtaaaaattgc

SEQ ID NO: 5558437 - DNA, 20 bp, Homo sapiens
actttaggtttttttaatga

SEQ ID NO: 5558438 - DNA, 23 bp, Homo sapiens
actttagtatgacgctgatacat

SEQ ID NO: 5558439 - DNA, 15 bp, Homo sapiens
actttagtgaaacat

SEQ ID NO: 5558440 - DNA, 17 bp, Homo sapiens
actttagtgaaacataa

SEQ ID NO: 5558441 - DNA, 15 bp, Homo sapiens
actttagtgattgct

SEQ ID NO: 5558442 - DNA, 16 bp, Homo sapiens
actttagtgccctgcc

SEQ ID NO: 5558443 - DNA, 19 bp, Homo sapiens
actttagtgccctgccccc

SEQ ID NO: 5558444 - DNA, 17 bp, Homo sapiens
actttagtgtattttct

SEQ ID NO: 5558445 - DNA, 21 bp, Homo sapiens
actttagttagcatgcgcgct

SEQ ID NO: 5558446 - DNA, 19 bp, Homo sapiens
actttagttatattcactg

SEQ ID NO: 5558447 - DNA, 18 bp, Homo sapiens
actttagtttgtgttatt

SEQ ID NO: 5558448 - DNA, 14 bp, Homo sapiens
actttataaaagca

SEQ ID NO: 5558449 - DNA, 22 bp, Homo sapiens
actttatacattagtaaatgtc

SEQ ID NO: 5558450 - DNA, 19 bp, Homo sapiens
actttatacccagaaagtt

SEQ ID NO: 5558451 - DNA, 18 bp, Homo sapiens
actttatagaagaatgca

SEQ ID NO: 5558452 - DNA, 13 bp, Homo sapiens
actttatatctgt

SEQ ID NO: 5558453 - DNA, 19 bp, Homo sapiens
actttatatctgtaatgat

SEQ ID NO: 5558454 - DNA, 12 bp, Homo sapiens
actttatatgaa

SEQ ID NO: 5558455 - DNA, 14 bp, Homo sapiens
actttatatgaagt

SEQ ID NO: 5558456 - DNA, 16 bp, Homo sapiens
actttatatgaagtat

SEQ ID NO: 5558457 - DNA, 18 bp, Homo sapiens
actttatattttctatat

SEQ ID NO: 5558458 - DNA, 20 bp, Homo sapiens
actttatattttctatattt

SEQ ID NO: 5558459 - DNA, 23 bp, Homo sapiens
actttatattttctatatttgta

SEQ ID NO: 5558460 - DNA, 14 bp, Homo sapiens
actttatcaaagat

SEQ ID NO: 5558461 - DNA, 19 bp, Homo sapiens
actttatcaatgtgtcttt

SEQ ID NO: 5558462 - DNA, 20 bp, Homo sapiens
actttatcactttttgaact

SEQ ID NO: 5558463 - DNA, 13 bp, Homo sapiens
actttatcatgaa

SEQ ID NO: 5558464 - DNA, 16 bp, Homo sapiens
actttatcatgaatgc

SEQ ID NO: 5558465 - DNA, 21 bp, Homo sapiens
actttatctgtgaccacacgc

SEQ ID NO: 5558466 - DNA, 20 bp, Homo sapiens
actttatgaaaaaaatatat

SEQ ID NO: 5558467 - DNA, 23 bp, Homo sapiens
actttatgaaaaaaatatatttt

SEQ ID NO: 5558468 - DNA, 14 bp, Homo sapiens
actttatgcaataa

SEQ ID NO: 5558469 - DNA, 19 bp, Homo sapiens
actttatgcagcttccttt

SEQ ID NO: 5558470 - DNA, 13 bp, Homo sapiens
actttatgcatct

SEQ ID NO: 5558471 - DNA, 20 bp, Homo sapiens
actttatgccggatgtgctt

SEQ ID NO: 5558472 - DNA, 23 bp, Homo sapiens
actttatgccggatgtgcttttc

SEQ ID NO: 5558473 - DNA, 17 bp, Homo sapiens
actttatgctaagtgaa

SEQ ID NO: 5558474 - DNA, 17 bp, Homo sapiens
actttatgtagagaaaa

SEQ ID NO: 5558475 - DNA, 18 bp, Homo sapiens
actttatgtagagaaaag

SEQ ID NO: 5558476 - DNA, 13 bp, Homo sapiens
actttatgtgtaa

SEQ ID NO: 5558477 - DNA, 21 bp, Homo sapiens
actttatgtgtaaatacataa

SEQ ID NO: 5558478 - DNA, 13 bp, Homo sapiens
actttatgttgta

SEQ ID NO: 5558479 - DNA, 19 bp, Homo sapiens
actttatgttgtatgattc

SEQ ID NO: 5558480 - DNA, 22 bp, Homo sapiens
actttatgttgtatgattccaa

SEQ ID NO: 5558481 - DNA, 23 bp, Homo sapiens
actttatgttgtatgattccaat

SEQ ID NO: 5558482 - DNA, 18 bp, Homo sapiens
actttatgtttgtctttt

SEQ ID NO: 5558483 - DNA, 16 bp, Homo sapiens
actttattaacttacg

SEQ ID NO: 5558484 - DNA, 20 bp, Homo sapiens
actttattacaatttgtatt

SEQ ID NO: 5558485 - DNA, 16 bp, Homo sapiens
actttattagcagctg

SEQ ID NO: 5558486 - DNA, 19 bp, Homo sapiens
actttgaataaagaatact

SEQ ID NO: 5558487 - DNA, 17 bp, Homo sapiens
actttgaatagtcctaa

SEQ ID NO: 5558488 - DNA, 12 bp, Homo sapiens
actttgaatgtt

SEQ ID NO: 5558489 - DNA, 14 bp, Homo sapiens
actttgaatttata

SEQ ID NO: 5558490 - DNA, 21 bp, Homo sapiens
actttgaatttatataaagta

SEQ ID NO: 5558491 - DNA, 17 bp, Homo sapiens
actttgacacttttcat

SEQ ID NO: 5558492 - DNA, 22 bp, Homo sapiens
actttgacacttttcatatcat

SEQ ID NO: 5558493 - DNA, 23 bp, Homo sapiens
actttgacacttttcatatcatt

SEQ ID NO: 5558494 - DNA, 20 bp, Homo sapiens
actttgacaggttcctttta

SEQ ID NO: 5558495 - DNA, 12 bp, Homo sapiens
actttgacctct

SEQ ID NO: 5558496 - DNA, 23 bp, Homo sapiens
actttgacgagtcaccttccagg

SEQ ID NO: 5558497 - DNA, 19 bp, Homo sapiens
actttgactaatacccaaa

SEQ ID NO: 5558498 - DNA, 15 bp, Homo sapiens
actttgagaggctga

SEQ ID NO: 5558499 - DNA, 18 bp, Homo sapiens
actttgagaggctgaggt

SEQ ID NO: 5558500 - DNA, 21 bp, Homo sapiens
actttgagatgtgttcctcct

SEQ ID NO: 5558501 - DNA, 18 bp, Homo sapiens
actttgagcatttttaag

SEQ ID NO: 5558502 - DNA, 18 bp, Homo sapiens
actttgagcctgcatctt

SEQ ID NO: 5558503 - DNA, 21 bp, Homo sapiens
actttgagcctgcatcttctt

SEQ ID NO: 5558504 - DNA, 19 bp, Homo sapiens
actttgagggtgtatattt

SEQ ID NO: 5558505 - DNA, 23 bp, Homo sapiens
actttgagggtgtatattttctg

SEQ ID NO: 5558506 - DNA, 16 bp, Homo sapiens
actttgaggtgtctca

SEQ ID NO: 5558507 - DNA, 22 bp, Homo sapiens
actttgataaagtaaaaaagtt

SEQ ID NO: 5558508 - DNA, 18 bp, Homo sapiens
actttgatactaccaggg

SEQ ID NO: 5558509 - DNA, 15 bp, Homo sapiens
actttgatccttgga

SEQ ID NO: 5558510 - DNA, 16 bp, Homo sapiens
actttgatctctgctt

SEQ ID NO: 5558511 - DNA, 18 bp, Homo sapiens
actttgatctctgcttac

SEQ ID NO: 5558512 - DNA, 17 bp, Homo sapiens
actttgatgcatttcca

SEQ ID NO: 5558513 - DNA, 12 bp, Homo sapiens
actttgatgtca

SEQ ID NO: 5558514 - DNA, 16 bp, Homo sapiens
actttgatgtcagcag

SEQ ID NO: 5558515 - DNA, 18 bp, Homo sapiens
actttgattcacatgttt

SEQ ID NO: 5558516 - DNA, 23 bp, Homo sapiens
actttgattcacatgttttcaaa

SEQ ID NO: 5558517 - DNA, 20 bp, Homo sapiens
actttgcacattttgatttt

SEQ ID NO: 5558518 - DNA, 15 bp, Homo sapiens
actttgcacctgcaa

SEQ ID NO: 5558519 - DNA, 20 bp, Homo sapiens
actttgcacgacgccctctc

SEQ ID NO: 5558520 - DNA, 17 bp, Homo sapiens
actttgcactgatatat

SEQ ID NO: 5558521 - DNA, 17 bp, Homo sapiens
actttgcaggcggccct

SEQ ID NO: 5558522 - DNA, 23 bp, Homo sapiens
actttgcaggcggccctcagtgc

SEQ ID NO: 5558523 - DNA, 20 bp, Homo sapiens
actttgccaaaaaaaaaaga

SEQ ID NO: 5558524 - DNA, 21 bp, Homo sapiens
actttgccactgctgtatttt

SEQ ID NO: 5558525 - DNA, 14 bp, Homo sapiens
actttgccattttt

SEQ ID NO: 5558526 - DNA, 15 bp, Homo sapiens
actttgcccctttca

SEQ ID NO: 5558527 - DNA, 18 bp, Homo sapiens
actttgcccttcactgtt

SEQ ID NO: 5558528 - DNA, 16 bp, Homo sapiens
actttgcctcctgtgt

SEQ ID NO: 5558529 - DNA, 18 bp, Homo sapiens
actttgccttctggttat

SEQ ID NO: 5558530 - DNA, 20 bp, Homo sapiens
actttgctcaaaattttaaa

SEQ ID NO: 5558531 - DNA, 15 bp, Homo sapiens
actttgctccgtgga

SEQ ID NO: 5558532 - DNA, 18 bp, Homo sapiens
actttgctctcaattaaa

SEQ ID NO: 5558533 - DNA, 19 bp, Homo sapiens
actttgctctcaattaaag

SEQ ID NO: 5558534 - DNA, 15 bp, Homo sapiens
actttgctgatttcc

SEQ ID NO: 5558535 - DNA, 21 bp, Homo sapiens
actttgctgttactgcttctc

SEQ ID NO: 5558536 - DNA, 14 bp, Homo sapiens
actttgcttcccat

SEQ ID NO: 5558537 - DNA, 14 bp, Homo sapiens
actttgcttcccct

SEQ ID NO: 5558538 - DNA, 17 bp, Homo sapiens
actttgcttcccctcca

SEQ ID NO: 5558539 - DNA, 15 bp, Homo sapiens
actttgcttctctcc

SEQ ID NO: 5558540 - DNA, 13 bp, Homo sapiens
actttgcttgctt

SEQ ID NO: 5558541 - DNA, 20 bp, Homo sapiens
actttgcttgctttgaagta

SEQ ID NO: 5558542 - DNA, 19 bp, Homo sapiens
actttgctttaatataaat

SEQ ID NO: 5558543 - DNA, 22 bp, Homo sapiens
actttgctttaatataaatgca

SEQ ID NO: 5558544 - DNA, 19 bp, Homo sapiens
actttgctttctgaattgg

SEQ ID NO: 5558545 - DNA, 12 bp, Homo sapiens
actttgctttgg

SEQ ID NO: 5558546 - DNA, 22 bp, Homo sapiens
actttgctttgggtttgtggca

SEQ ID NO: 5558547 - DNA, 15 bp, Homo sapiens
actttggaaaatgca

SEQ ID NO: 5558548 - DNA, 13 bp, Homo sapiens
actttggaaagac

SEQ ID NO: 5558549 - DNA, 17 bp, Homo sapiens
actttggaaagccaagg

SEQ ID NO: 5558550 - DNA, 15 bp, Homo sapiens
actttggaacaagat

SEQ ID NO: 5558551 - DNA, 15 bp, Homo sapiens
actttggaacactac

SEQ ID NO: 5558552 - DNA, 16 bp, Homo sapiens
actttggaaccagact

SEQ ID NO: 5558553 - DNA, 11 bp, Homo sapiens
actttggaagc

SEQ ID NO: 5558554 - DNA, 14 bp, Homo sapiens
actttggaaggagg

SEQ ID NO: 5558555 - DNA, 18 bp, Homo sapiens
actttggaatacatttct

SEQ ID NO: 5558556 - DNA, 16 bp, Homo sapiens
actttggaatgttgaa

SEQ ID NO: 5558557 - DNA, 22 bp, Homo sapiens
actttggacaggagttaattaa

SEQ ID NO: 5558558 - DNA, 18 bp, Homo sapiens
actttggacagtggcctc

SEQ ID NO: 5558559 - DNA, 14 bp, Homo sapiens
actttggactgagt

SEQ ID NO: 5558560 - DNA, 20 bp, Homo sapiens
actttggagaactcatttca

SEQ ID NO: 5558561 - DNA, 22 bp, Homo sapiens
actttggagagggaaaatcttc

SEQ ID NO: 5558562 - DNA, 12 bp, Homo sapiens
actttggataat

SEQ ID NO: 5558563 - DNA, 20 bp, Homo sapiens
actttggatgacttgttcat

SEQ ID NO: 5558564 - DNA, 20 bp, Homo sapiens
actttggcaacatcttggct

SEQ ID NO: 5558565 - DNA, 16 bp, Homo sapiens
actttggcaatttcct

SEQ ID NO: 5558566 - DNA, 19 bp, Homo sapiens
actttggcaatttcctggc

SEQ ID NO: 5558567 - DNA, 18 bp, Homo sapiens
actttggccaagcaagag

SEQ ID NO: 5558568 - DNA, 18 bp, Homo sapiens
actttggccacagcccca

SEQ ID NO: 5558569 - DNA, 22 bp, Homo sapiens
actttggccattacccccagct

SEQ ID NO: 5558570 - DNA, 17 bp, Homo sapiens
actttggctatgggtgg

SEQ ID NO: 5558571 - DNA, 13 bp, Homo sapiens
actttggctgatt

SEQ ID NO: 5558572 - DNA, 21 bp, Homo sapiens
actttggctgatttaaaaagt

SEQ ID NO: 5558573 - DNA, 21 bp, Homo sapiens
actttggcttacatttgaata

SEQ ID NO: 5558574 - DNA, 23 bp, Homo sapiens
actttggcttacatttgaataat

SEQ ID NO: 5558575 - DNA, 19 bp, Homo sapiens
actttggcttataattctt

SEQ ID NO: 5558576 - DNA, 17 bp, Homo sapiens
actttggcttctcctgt

SEQ ID NO: 5558577 - DNA, 19 bp, Homo sapiens
actttggcttctcctgtga

SEQ ID NO: 5558578 - DNA, 17 bp, Homo sapiens
actttgggaggccaagg

SEQ ID NO: 5558579 - DNA, 19 bp, Homo sapiens
actttgggaggccaaggtg

SEQ ID NO: 5558580 - DNA, 22 bp, Homo sapiens
actttgggaggccgaggcaggt

SEQ ID NO: 5558581 - DNA, 17 bp, Homo sapiens
actttgggaggctgagg

SEQ ID NO: 5558582 - DNA, 14 bp, Homo sapiens
actttgggcccaga

SEQ ID NO: 5558583 - DNA, 11 bp, Homo sapiens
actttggggac

SEQ ID NO: 5558584 - DNA, 21 bp, Homo sapiens
actttggggacaccctcctgc

SEQ ID NO: 5558585 - DNA, 23 bp, Homo sapiens
actttggggttcggcctgtgtcc

SEQ ID NO: 5558586 - DNA, 20 bp, Homo sapiens
actttgggtttttaactcat

SEQ ID NO: 5558587 - DNA, 21 bp, Homo sapiens
actttggtaatgtgtcaaaga

SEQ ID NO: 5558588 - DNA, 22 bp, Homo sapiens
actttggtagctgggaaagcat

SEQ ID NO: 5558589 - DNA, 23 bp, Homo sapiens
actttggtagctgggaaagcata

SEQ ID NO: 5558590 - DNA, 17 bp, Homo sapiens
actttggtattcaattt

SEQ ID NO: 5558591 - DNA, 21 bp, Homo sapiens
actttggtattcaatttgatt

SEQ ID NO: 5558592 - DNA, 19 bp, Homo sapiens
actttggtcacccagacta

SEQ ID NO: 5558593 - DNA, 15 bp, Homo sapiens
actttggtcatttct

SEQ ID NO: 5558594 - DNA, 13 bp, Homo sapiens
actttggttattt

SEQ ID NO: 5558595 - DNA, 21 bp, Homo sapiens
actttggttattttacttttt

SEQ ID NO: 5558596 - DNA, 14 bp, Homo sapiens
actttgtaaataaa

SEQ ID NO: 5558597 - DNA, 17 bp, Homo sapiens
actttgtaaccagaatt

SEQ ID NO: 5558598 - DNA, 17 bp, Homo sapiens
actttgtaatttttgct

SEQ ID NO: 5558599 - DNA, 18 bp, Homo sapiens
actttgtacatgttacag

SEQ ID NO: 5558600 - DNA, 14 bp, Homo sapiens
actttgtagacatt

SEQ ID NO: 5558601 - DNA, 14 bp, Homo sapiens
actttgtataaatt

SEQ ID NO: 5558602 - DNA, 18 bp, Homo sapiens
actttgtatactttaaat

SEQ ID NO: 5558603 - DNA, 17 bp, Homo sapiens
actttgtatagttatgt

SEQ ID NO: 5558604 - DNA, 14 bp, Homo sapiens
actttgtattctct

SEQ ID NO: 5558605 - DNA, 24 bp, Homo sapiens
actttgtattgtcctattagtgtt

SEQ ID NO: 5558606 - DNA, 14 bp, Homo sapiens
actttgtattttga

SEQ ID NO: 5558607 - DNA, 14 bp, Homo sapiens
actttgtcacttct

SEQ ID NO: 5558608 - DNA, 15 bp, Homo sapiens
actttgtcagaggca

SEQ ID NO: 5558609 - DNA, 22 bp, Homo sapiens
actttgtcagtgttgcctcttg

SEQ ID NO: 5558610 - DNA, 19 bp, Homo sapiens
actttgtcgtggttcttaa

SEQ ID NO: 5558611 - DNA, 20 bp, Homo sapiens
actttgtcgtggttcttaaa

SEQ ID NO: 5558612 - DNA, 19 bp, Homo sapiens
actttgtctaagaaacatt

SEQ ID NO: 5558613 - DNA, 15 bp, Homo sapiens
actttgtctctcctg

SEQ ID NO: 5558614 - DNA, 20 bp, Homo sapiens
actttgtctctcctggctgg

SEQ ID NO: 5558615 - DNA, 13 bp, Homo sapiens
actttgtctctga

SEQ ID NO: 5558616 - DNA, 15 bp, Homo sapiens
actttgtctgaaaaa

SEQ ID NO: 5558617 - DNA, 13 bp, Homo sapiens
actttgtctgtac

SEQ ID NO: 5558618 - DNA, 14 bp, Homo sapiens
actttgtctgtaca

SEQ ID NO: 5558619 - DNA, 20 bp, Homo sapiens
actttgtgaattaacacagt

SEQ ID NO: 5558620 - DNA, 12 bp, Homo sapiens
actttgtgagcc

SEQ ID NO: 5558621 - DNA, 18 bp, Homo sapiens
actttgtgcattctggat

SEQ ID NO: 5558622 - DNA, 16 bp, Homo sapiens
actttgtggatgtctt

SEQ ID NO: 5558623 - DNA, 17 bp, Homo sapiens
actttgtggatgtcttc

SEQ ID NO: 5558624 - DNA, 18 bp, Homo sapiens
actttgtggtctaaagtg

SEQ ID NO: 5558625 - DNA, 14 bp, Homo sapiens
actttgtgtctttt

SEQ ID NO: 5558626 - DNA, 19 bp, Homo sapiens
actttgtgtcttttgttct

SEQ ID NO: 5558627 - DNA, 23 bp, Homo sapiens
actttgtgtcttttgttctctct

SEQ ID NO: 5558628 - DNA, 19 bp, Homo sapiens
actttgtgtttttttaatt

SEQ ID NO: 5558629 - DNA, 12 bp, Homo sapiens
actttgttaatt

SEQ ID NO: 5558630 - DNA, 15 bp, Homo sapiens
actttgttaatttat

SEQ ID NO: 5558631 - DNA, 14 bp, Homo sapiens
actttgttagaaag

SEQ ID NO: 5558632 - DNA, 13 bp, Homo sapiens
actttgttctgct

SEQ ID NO: 5558633 - DNA, 16 bp, Homo sapiens
actttgttctggctct

SEQ ID NO: 5558634 - DNA, 20 bp, Homo sapiens
actttgttctggctcttcca

SEQ ID NO: 5558635 - DNA, 15 bp, Homo sapiens
actttgttctgttgt

SEQ ID NO: 5558636 - DNA, 18 bp, Homo sapiens
actttgttctgttgtctg

SEQ ID NO: 5558637 - DNA, 21 bp, Homo sapiens
actttgttggcccttccagtg

SEQ ID NO: 5558638 - DNA, 23 bp, Homo sapiens
actttgttggtagccatttggta

SEQ ID NO: 5558639 - DNA, 16 bp, Homo sapiens
actttgtttagaaaaa

SEQ ID NO: 5558640 - DNA, 17 bp, Homo sapiens
actttgtttatgcatat

SEQ ID NO: 5558641 - DNA, 12 bp, Homo sapiens
actttgtttatt

SEQ ID NO: 5558642 - DNA, 23 bp, Homo sapiens
actttgtttcctccttgtcactg

SEQ ID NO: 5558643 - DNA, 23 bp, Homo sapiens
actttgtttcttttgcttaggaa

SEQ ID NO: 5558644 - DNA, 21 bp, Homo sapiens
actttgttttaaaaagcatca

SEQ ID NO: 5558645 - DNA, 14 bp, Homo sapiens
actttgtttttcca

SEQ ID NO: 5558646 - DNA, 17 bp, Homo sapiens
actttgtttttccatgt

SEQ ID NO: 5558647 - DNA, 17 bp, Homo sapiens
acttttaaaaaacaaaa

SEQ ID NO: 5558648 - DNA, 18 bp, Homo sapiens
acttttaaaaaacaaaaa

SEQ ID NO: 5558649 - DNA, 22 bp, Homo sapiens
acttttaaaaaacaaaaaaaga

SEQ ID NO: 5558650 - DNA, 18 bp, Homo sapiens
acttttaaaactttgcca

SEQ ID NO: 5558651 - DNA, 18 bp, Homo sapiens
acttttaaaagtaggaaa

SEQ ID NO: 5558652 - DNA, 20 bp, Homo sapiens
acttttaaaataaattctct

SEQ ID NO: 5558653 - DNA, 18 bp, Homo sapiens
acttttaaaatttgtaga

SEQ ID NO: 5558654 - DNA, 15 bp, Homo sapiens
acttttaaacagtga

SEQ ID NO: 5558655 - DNA, 13 bp, Homo sapiens
acttttaaagaat

SEQ ID NO: 5558656 - DNA, 21 bp, Homo sapiens
acttttaaaggaatgtgaaat

SEQ ID NO: 5558657 - DNA, 23 bp, Homo sapiens
acttttaaagttttgtcagaaaa

SEQ ID NO: 5558658 - DNA, 22 bp, Homo sapiens
acttttaaataaattatgaata

SEQ ID NO: 5558659 - DNA, 12 bp, Homo sapiens
acttttaagact

SEQ ID NO: 5558660 - DNA, 23 bp, Homo sapiens
acttttaagacttaatctttgct

SEQ ID NO: 5558661 - DNA, 14 bp, Homo sapiens
acttttaaggcagt

SEQ ID NO: 5558662 - DNA, 15 bp, Homo sapiens
acttttaataaagta

SEQ ID NO: 5558663 - DNA, 12 bp, Homo sapiens
agaaaacatcta

SEQ ID NO: 5558664 - DNA, 20 bp, Homo sapiens
agaaaacatgcagaacaaat

SEQ ID NO: 5558665 - DNA, 19 bp, Homo sapiens
agaaaacatgtctgtgaac

SEQ ID NO: 5558666 - DNA, 14 bp, Homo sapiens
agaaaacattccag

SEQ ID NO: 5558667 - DNA, 12 bp, Homo sapiens
agaaaacattgt

SEQ ID NO: 5558668 - DNA, 13 bp, Homo sapiens
agaaaacattgtt

SEQ ID NO: 5558669 - DNA, 19 bp, Homo sapiens
agaaaacattgttccagat

SEQ ID NO: 5558670 - DNA, 12 bp, Homo sapiens
agaaaacattta

SEQ ID NO: 5558671 - DNA, 20 bp, Homo sapiens
agaaaacatttaacataatg

SEQ ID NO: 5558672 - DNA, 17 bp, Homo sapiens
agaaaaccaaaatgata

SEQ ID NO: 5558673 - DNA, 15 bp, Homo sapiens
agaaaaccacccctt

SEQ ID NO: 5558674 - DNA, 16 bp, Homo sapiens
agaaaaccagtggaag

SEQ ID NO: 5558675 - DNA, 13 bp, Homo sapiens
agaaaacccaccc

SEQ ID NO: 5558676 - DNA, 20 bp, Homo sapiens
agaaaaccccacagaaatct

SEQ ID NO: 5558677 - DNA, 22 bp, Homo sapiens
agaaaaccctaagtgtggatgt

SEQ ID NO: 5558678 - DNA, 16 bp, Homo sapiens
agaaaaccgagaatat

SEQ ID NO: 5558679 - DNA, 19 bp, Homo sapiens
agaaaacctaagcaaactt

SEQ ID NO: 5558680 - DNA, 23 bp, Homo sapiens
agaaaacctgatgctggggacac

SEQ ID NO: 5558681 - DNA, 20 bp, Homo sapiens
agaaaacctgtatttttgtt

SEQ ID NO: 5558682 - DNA, 22 bp, Homo sapiens
agaaaacctgtttttaacatgt

SEQ ID NO: 5558683 - DNA, 20 bp, Homo sapiens
agaaaacggagagtgcttgg

SEQ ID NO: 5558684 - DNA, 20 bp, Homo sapiens
agaaaacggttaaaactgtc

SEQ ID NO: 5558685 - DNA, 23 bp, Homo sapiens
agaaaactacatgtaaaatcttg

SEQ ID NO: 5558686 - DNA, 19 bp, Homo sapiens
agaaaactcccaatacaaa

SEQ ID NO: 5558687 - DNA, 21 bp, Homo sapiens
agaaaactcccaatacaaaga

SEQ ID NO: 5558688 - DNA, 21 bp, Homo sapiens
agaaaactcctttagcaggtg

SEQ ID NO: 5558689 - DNA, 14 bp, Homo sapiens
agaaaactgcacaa

SEQ ID NO: 5558690 - DNA, 12 bp, Homo sapiens
agaaaactggaa

SEQ ID NO: 5558691 - DNA, 14 bp, Homo sapiens
agaaaactggaaat

SEQ ID NO: 5558692 - DNA, 15 bp, Homo sapiens
agaaaactggaaatc

SEQ ID NO: 5558693 - DNA, 18 bp, Homo sapiens
agaaaactggcagtgcac

SEQ ID NO: 5558694 - DNA, 23 bp, Homo sapiens
agaaaacttcagagaaattatgt

SEQ ID NO: 5558695 - DNA, 20 bp, Homo sapiens
agaaaacttgaacaagaaat

SEQ ID NO: 5558696 - DNA, 22 bp, Homo sapiens
agaaaacttgaattcatagaaa

SEQ ID NO: 5558697 - DNA, 21 bp, Homo sapiens
agaaaacttgacatgtagctt

SEQ ID NO: 5558698 - DNA, 20 bp, Homo sapiens
agaaaactttaaaaaatatt

SEQ ID NO: 5558699 - DNA, 20 bp, Homo sapiens
agaaaactttgttaggccaa

SEQ ID NO: 5558700 - DNA, 10 bp, Homo sapiens
agaaaagaaa

SEQ ID NO: 5558701 - DNA, 12 bp, Homo sapiens
agaaaagaaaaa

SEQ ID NO: 5558702 - DNA, 17 bp, Homo sapiens
agaaaagaaaaaaaaag

SEQ ID NO: 5558703 - DNA, 14 bp, Homo sapiens
agaaaagaaaaaga

SEQ ID NO: 5558704 - DNA, 18 bp, Homo sapiens
agaaaagaaaacatttaa

SEQ ID NO: 5558705 - DNA, 21 bp, Homo sapiens
agaaaagaaaacatttaacat

SEQ ID NO: 5558706 - DNA, 12 bp, Homo sapiens
agaaaagacact

SEQ ID NO: 5558707 - DNA, 15 bp, Homo sapiens
agaaaagacacttca

SEQ ID NO: 5558708 - DNA, 17 bp, Homo sapiens
agaaaagaccccagact

SEQ ID NO: 5558709 - DNA, 19 bp, Homo sapiens
agaaaagacgcaccagccc

SEQ ID NO: 5558710 - DNA, 13 bp, Homo sapiens
agaaaagagaaac

SEQ ID NO: 5558711 - DNA, 19 bp, Homo sapiens
agaaaagagatattttaaa

SEQ ID NO: 5558712 - DNA, 18 bp, Homo sapiens
agaaaagagccactttca

SEQ ID NO: 5558713 - DNA, 15 bp, Homo sapiens
agaaaagataaagat

SEQ ID NO: 5558714 - DNA, 16 bp, Homo sapiens
agaaaagataaagatg

SEQ ID NO: 5558715 - DNA, 19 bp, Homo sapiens
agaaaagatatgtattcta

SEQ ID NO: 5558716 - DNA, 12 bp, Homo sapiens
agaaaagatgca

SEQ ID NO: 5558717 - DNA, 13 bp, Homo sapiens
agaaaagatgcac

SEQ ID NO: 5558718 - DNA, 19 bp, Homo sapiens
agaaaagatgcactttgct

SEQ ID NO: 5558719 - DNA, 15 bp, Homo sapiens
agaaaagattcttct

SEQ ID NO: 5558720 - DNA, 20 bp, Homo sapiens
agaaaagattcttcttaaaa

SEQ ID NO: 5558721 - DNA, 15 bp, Homo sapiens
agaaaagattttaat

SEQ ID NO: 5558722 - DNA, 20 bp, Homo sapiens
agaaaagattttaatcaagt

SEQ ID NO: 5558723 - DNA, 15 bp, Homo sapiens
agaaaagcacctgcc

SEQ ID NO: 5558724 - DNA, 14 bp, Homo sapiens
agaaaagcacttaa

SEQ ID NO: 5558725 - DNA, 15 bp, Homo sapiens
agaaaagcacttttg

SEQ ID NO: 5558726 - DNA, 18 bp, Homo sapiens
agaaaagcacttttgtta

SEQ ID NO: 5558727 - DNA, 21 bp, Homo sapiens
agaaaagcagacgcagcagct

SEQ ID NO: 5558728 - DNA, 21 bp, Homo sapiens
agaaaagcagtcccattcata

SEQ ID NO: 5558729 - DNA, 12 bp, Homo sapiens
agaaaagcattt

SEQ ID NO: 5558730 - DNA, 13 bp, Homo sapiens
agaaaagcatttt

SEQ ID NO: 5558731 - DNA, 15 bp, Homo sapiens
agaaaagcattttca

SEQ ID NO: 5558732 - DNA, 17 bp, Homo sapiens
agaaaagcattttcagt

SEQ ID NO: 5558733 - DNA, 18 bp, Homo sapiens
agaaaagccagatgacag

SEQ ID NO: 5558734 - DNA, 23 bp, Homo sapiens
agaaaagccagatgacagggagc

SEQ ID NO: 5558735 - DNA, 22 bp, Homo sapiens
agaaaagcgcgttgtgtatatt

SEQ ID NO: 5558736 - DNA, 18 bp, Homo sapiens
agaaaagctattaaagtt

SEQ ID NO: 5558737 - DNA, 14 bp, Homo sapiens
agaaaagctcagag

SEQ ID NO: 5558738 - DNA, 15 bp, Homo sapiens
agaaaagctcagagt

SEQ ID NO: 5558739 - DNA, 12 bp, Homo sapiens
agaaaagctgat

SEQ ID NO: 5558740 - DNA, 19 bp, Homo sapiens
agaaaagctgccatttccc

SEQ ID NO: 5558741 - DNA, 14 bp, Homo sapiens
agaaaagcttccta

SEQ ID NO: 5558742 - DNA, 18 bp, Homo sapiens
agaaaaggaaaagaaaaa

SEQ ID NO: 5558743 - DNA, 16 bp, Homo sapiens
agaaaaggaatgcaag

SEQ ID NO: 5558744 - DNA, 18 bp, Homo sapiens
agaaaaggaatgcaagag

SEQ ID NO: 5558745 - DNA, 17 bp, Homo sapiens
agaaaaggcaaaagact

SEQ ID NO: 5558746 - DNA, 18 bp, Homo sapiens
agaaaaggcaaaagactg

SEQ ID NO: 5558747 - DNA, 13 bp, Homo sapiens
agaaaaggcatgg

SEQ ID NO: 5558748 - DNA, 17 bp, Homo sapiens
agaaaagggaaaaaaga

SEQ ID NO: 5558749 - DNA, 21 bp, Homo sapiens
agaaaagggaaaaaagaaaga

SEQ ID NO: 5558750 - DNA, 22 bp, Homo sapiens
agaaaagggaaaaaagaaagaa

SEQ ID NO: 5558751 - DNA, 19 bp, Homo sapiens
agaaaaggttctgaataat

SEQ ID NO: 5558752 - DNA, 15 bp, Homo sapiens
agaaaagtagaatta

SEQ ID NO: 5558753 - DNA, 18 bp, Homo sapiens
agaaaagtagaattatat

SEQ ID NO: 5558754 - DNA, 23 bp, Homo sapiens
agaaaagtagaattatatctaat

SEQ ID NO: 5558755 - DNA, 15 bp, Homo sapiens
agaaaagtagacaat

SEQ ID NO: 5558756 - DNA, 17 bp, Homo sapiens
agaaaagtattctcaaa

SEQ ID NO: 5558757 - DNA, 15 bp, Homo sapiens
agaaaagtgaattga

SEQ ID NO: 5558758 - DNA, 21 bp, Homo sapiens
agaaaagtgcatatttatcca

SEQ ID NO: 5558759 - DNA, 14 bp, Homo sapiens
agaaaagtgcctga

SEQ ID NO: 5558760 - DNA, 17 bp, Homo sapiens
agaaaagtgcttagaaa

SEQ ID NO: 5558761 - DNA, 13 bp, Homo sapiens
agaaaagtgggct

SEQ ID NO: 5558762 - DNA, 16 bp, Homo sapiens
agaaaagtgttttgtt

SEQ ID NO: 5558763 - DNA, 19 bp, Homo sapiens
agaaaagttgcagatgtat

SEQ ID NO: 5558764 - DNA, 20 bp, Homo sapiens
agaaaagttgcagatgtatt

SEQ ID NO: 5558765 - DNA, 15 bp, Homo sapiens
agaaaagtttataaa

SEQ ID NO: 5558766 - DNA, 23 bp, Homo sapiens
agaaaagtttcgacttatttctt

SEQ ID NO: 5558767 - DNA, 18 bp, Homo sapiens
agaaaataaaaaaaagaa

SEQ ID NO: 5558768 - DNA, 16 bp, Homo sapiens
agaaaataaaaagtta

SEQ ID NO: 5558769 - DNA, 17 bp, Homo sapiens
agaaaataaaaagttaa

SEQ ID NO: 5558770 - DNA, 18 bp, Homo sapiens
agaaaataaaaagttaaa

SEQ ID NO: 5558771 - DNA, 21 bp, Homo sapiens
agaaaataaaactaagctctt

SEQ ID NO: 5558772 - DNA, 21 bp, Homo sapiens
agaaaataaagacaaccatat

SEQ ID NO: 5558773 - DNA, 22 bp, Homo sapiens
agaaaataacaagagttttaac

SEQ ID NO: 5558774 - DNA, 13 bp, Homo sapiens
agaaaataataag

SEQ ID NO: 5558775 - DNA, 17 bp, Homo sapiens
agaaaataatcattctt

SEQ ID NO: 5558776 - DNA, 14 bp, Homo sapiens
agaaaatacattat

SEQ ID NO: 5558777 - DNA, 18 bp, Homo sapiens
agaaaatacattattaga

SEQ ID NO: 5558778 - DNA, 20 bp, Homo sapiens
agaaaatagcttttattgag

SEQ ID NO: 5558779 - DNA, 20 bp, Homo sapiens
agaaaatagggtggacagaa

SEQ ID NO: 5558780 - DNA, 23 bp, Homo sapiens
agaaaatagggtggacagaagct

SEQ ID NO: 5558781 - DNA, 19 bp, Homo sapiens
agaaaatagtggtgtgatt

SEQ ID NO: 5558782 - DNA, 13 bp, Homo sapiens
agaaaatataaat

SEQ ID NO: 5558783 - DNA, 14 bp, Homo sapiens
agaaaatataaatg

SEQ ID NO: 5558784 - DNA, 19 bp, Homo sapiens
agaaaatatactgtaaaga

SEQ ID NO: 5558785 - DNA, 21 bp, Homo sapiens
agaaaatatactgtaaagaaa

SEQ ID NO: 5558786 - DNA, 22 bp, Homo sapiens
agaaaatatactgtaaagaaag

SEQ ID NO: 5558787 - DNA, 11 bp, Homo sapiens
agaaaatatat

SEQ ID NO: 5558788 - DNA, 14 bp, Homo sapiens
agaaaatatatgta

SEQ ID NO: 5558789 - DNA, 23 bp, Homo sapiens
agaaaatatatgtatttttatat

SEQ ID NO: 5558790 - DNA, 18 bp, Homo sapiens
agaaaatatattctttca

SEQ ID NO: 5558791 - DNA, 15 bp, Homo sapiens
agaaaatatcactgt

SEQ ID NO: 5558792 - DNA, 14 bp, Homo sapiens
agaaaatatgatat

SEQ ID NO: 5558793 - DNA, 11 bp, Homo sapiens
agaaaatattc

SEQ ID NO: 5558794 - DNA, 19 bp, Homo sapiens
agaaaatatttaatatcaa

SEQ ID NO: 5558795 - DNA, 23 bp, Homo sapiens
agaaaatatttaatatcaaaaga

SEQ ID NO: 5558796 - DNA, 16 bp, Homo sapiens
agaaaatattttgtct

SEQ ID NO: 5558797 - DNA, 19 bp, Homo sapiens
agaaaatattttgtctaaa

SEQ ID NO: 5558798 - DNA, 18 bp, Homo sapiens
agaaaatatttttaaatg

SEQ ID NO: 5558799 - DNA, 18 bp, Homo sapiens
agaaaatatttttgtgga

SEQ ID NO: 5558800 - DNA, 16 bp, Homo sapiens
agaaaatcaaagcagt

SEQ ID NO: 5558801 - DNA, 14 bp, Homo sapiens
agaaaatcaatgaa

SEQ ID NO: 5558802 - DNA, 21 bp, Homo sapiens
agaaaatcagattttctcctg

SEQ ID NO: 5558803 - DNA, 12 bp, Homo sapiens
agaaaatcatca

SEQ ID NO: 5558804 - DNA, 17 bp, Homo sapiens
agaaaatcatcaagaag

SEQ ID NO: 5558805 - DNA, 16 bp, Homo sapiens
agaaaatcatgttgaa

SEQ ID NO: 5558806 - DNA, 15 bp, Homo sapiens
agaaaatccttcagc

SEQ ID NO: 5558807 - DNA, 23 bp, Homo sapiens
agaaaatctgaattggaatgcac

SEQ ID NO: 5558808 - DNA, 12 bp, Homo sapiens
agaaaatctttg

SEQ ID NO: 5558809 - DNA, 16 bp, Homo sapiens
agaaaatgaaaaacaa

SEQ ID NO: 5558810 - DNA, 17 bp, Homo sapiens
agaaaatgaaatgcata

SEQ ID NO: 5558811 - DNA, 11 bp, Homo sapiens
agaaaatgaag

SEQ ID NO: 5558812 - DNA, 16 bp, Homo sapiens
agaaaatgaagcccta

SEQ ID NO: 5558813 - DNA, 13 bp, Homo sapiens
agaaaatgaattt

SEQ ID NO: 5558814 - DNA, 15 bp, Homo sapiens
agaaaatgaatttgg

SEQ ID NO: 5558815 - DNA, 19 bp, Homo sapiens
agaaaatgacttatttctg

SEQ ID NO: 5558816 - DNA, 16 bp, Homo sapiens
agaaaatgactttatt

SEQ ID NO: 5558817 - DNA, 23 bp, Homo sapiens
agaaaatgactttatttttctaa

SEQ ID NO: 5558818 - DNA, 16 bp, Homo sapiens
agaaaatgatgagttt

SEQ ID NO: 5558819 - DNA, 18 bp, Homo sapiens
agaaaatgatgagttttt

SEQ ID NO: 5558820 - DNA, 18 bp, Homo sapiens
agaaaatgcctagagata

SEQ ID NO: 5558821 - DNA, 22 bp, Homo sapiens
agaaaatgcctcaattcacata

SEQ ID NO: 5558822 - DNA, 16 bp, Homo sapiens
agaaaatgctttctca

SEQ ID NO: 5558823 - DNA, 18 bp, Homo sapiens
agaaaatgctttctcatg

SEQ ID NO: 5558824 - DNA, 22 bp, Homo sapiens
agaaaatggaaaatatacaagt

SEQ ID NO: 5558825 - DNA, 16 bp, Homo sapiens
agaaaatggaaagaag

SEQ ID NO: 5558826 - DNA, 22 bp, Homo sapiens
agaaaatggaaccaggcttgga

SEQ ID NO: 5558827 - DNA, 17 bp, Homo sapiens
agaaaatggaattactc

SEQ ID NO: 5558828 - DNA, 18 bp, Homo sapiens
agaaaatggaattactcc

SEQ ID NO: 5558829 - DNA, 20 bp, Homo sapiens
agaaaatggacgtgttatga

SEQ ID NO: 5558830 - DNA, 22 bp, Homo sapiens
agaaaatggatgacaaagaaaa

SEQ ID NO: 5558831 - DNA, 12 bp, Homo sapiens
agaaaatggcac

SEQ ID NO: 5558832 - DNA, 18 bp, Homo sapiens
agaaaatgggaagcatta

SEQ ID NO: 5558833 - DNA, 18 bp, Homo sapiens
agaaaatggggcttgccc

SEQ ID NO: 5558834 - DNA, 21 bp, Homo sapiens
agaaaatggtttattttgtat

SEQ ID NO: 5558835 - DNA, 21 bp, Homo sapiens
agaaaatgtaaaggagggaga

SEQ ID NO: 5558836 - DNA, 10 bp, Homo sapiens
agaaaatgtc

SEQ ID NO: 5558837 - DNA, 14 bp, Homo sapiens
agaaaatgtgtctg

SEQ ID NO: 5558838 - DNA, 23 bp, Homo sapiens
agaaaatgtgtctgcaacatgga

SEQ ID NO: 5558839 - DNA, 24 bp, Homo sapiens
agaaaatgtgtctgcaacatggat

SEQ ID NO: 5558840 - DNA, 18 bp, Homo sapiens
agaaaatgttctgtttgc

SEQ ID NO: 5558841 - DNA, 19 bp, Homo sapiens
agaaacggtctttatgaat

SEQ ID NO: 5558842 - DNA, 21 bp, Homo sapiens
agaaacggtctttatgaatta

SEQ ID NO: 5558843 - DNA, 15 bp, Homo sapiens
agaaacgtccatctc

SEQ ID NO: 5558844 - DNA, 23 bp, Homo sapiens
agaaacgtccatctctctccctt

SEQ ID NO: 5558845 - DNA, 16 bp, Homo sapiens
agaaacgtctacgtat

SEQ ID NO: 5558846 - DNA, 16 bp, Homo sapiens
agaaacgtcttctaaa

SEQ ID NO: 5558847 - DNA, 18 bp, Homo sapiens
agaaacgtcttctaaact

SEQ ID NO: 5558848 - DNA, 21 bp, Homo sapiens
agaaacgtcttctaaacttcc

SEQ ID NO: 5558849 - DNA, 16 bp, Homo sapiens
agaaactaaacagaaa

SEQ ID NO: 5558850 - DNA, 15 bp, Homo sapiens
agaaactaacttggt

SEQ ID NO: 5558851 - DNA, 18 bp, Homo sapiens
agaaactaagatttatct

SEQ ID NO: 5558852 - DNA, 17 bp, Homo sapiens
agaaactacaaatatag

SEQ ID NO: 5558853 - DNA, 14 bp, Homo sapiens
agaaactactaatt

SEQ ID NO: 5558854 - DNA, 24 bp, Homo sapiens
agaaactagtatctctggcctcct

SEQ ID NO: 5558855 - DNA, 16 bp, Homo sapiens
agaaactatcaagaga

SEQ ID NO: 5558856 - DNA, 19 bp, Homo sapiens
agaaactatgaagatctga

SEQ ID NO: 5558857 - DNA, 20 bp, Homo sapiens
agaaactatgatgtggagaa

SEQ ID NO: 5558858 - DNA, 22 bp, Homo sapiens
agaaactatgatgtggagaaag

SEQ ID NO: 5558859 - DNA, 11 bp, Homo sapiens
agaaactattg

SEQ ID NO: 5558860 - DNA, 19 bp, Homo sapiens
agaaactcaatgcacaaca

SEQ ID NO: 5558861 - DNA, 15 bp, Homo sapiens
agaaactcaccccca

SEQ ID NO: 5558862 - DNA, 17 bp, Homo sapiens
agaaactcacgatgaaa

SEQ ID NO: 5558863 - DNA, 14 bp, Homo sapiens
agaaactccttttg

SEQ ID NO: 5558864 - DNA, 21 bp, Homo sapiens
agaaactccttttgctgtctt

SEQ ID NO: 5558865 - DNA, 19 bp, Homo sapiens
agaaactcgatgaatgtgt

SEQ ID NO: 5558866 - DNA, 22 bp, Homo sapiens
agaaactcgggcactccctaag

SEQ ID NO: 5558867 - DNA, 14 bp, Homo sapiens
agaaactctcattt

SEQ ID NO: 5558868 - DNA, 12 bp, Homo sapiens
agaaactgaaag

SEQ ID NO: 5558869 - DNA, 15 bp, Homo sapiens
agaaactgaaagtgt

SEQ ID NO: 5558870 - DNA, 12 bp, Homo sapiens
agaaactgaacc

SEQ ID NO: 5558871 - DNA, 22 bp, Homo sapiens
agaaactgaaccaacagaagca

SEQ ID NO: 5558872 - DNA, 15 bp, Homo sapiens
agaaactgaatgaat

SEQ ID NO: 5558873 - DNA, 20 bp, Homo sapiens
agaaactgacatgccctccc

SEQ ID NO: 5558874 - DNA, 12 bp, Homo sapiens
agaaactgagga

SEQ ID NO: 5558875 - DNA, 21 bp, Homo sapiens
agaaactgaggagtagctgag

SEQ ID NO: 5558876 - DNA, 15 bp, Homo sapiens
agaaactgaggccca

SEQ ID NO: 5558877 - DNA, 18 bp, Homo sapiens
agaaactgaggcccacgg

SEQ ID NO: 5558878 - DNA, 16 bp, Homo sapiens
agaaactgagtcctgt

SEQ ID NO: 5558879 - DNA, 12 bp, Homo sapiens
agaaactgatgc

SEQ ID NO: 5558880 - DNA, 18 bp, Homo sapiens
agaaactgatgccaaggg

SEQ ID NO: 5558881 - DNA, 15 bp, Homo sapiens
agaaactgcagggaa

SEQ ID NO: 5558882 - DNA, 15 bp, Homo sapiens
agaaactgccacata

SEQ ID NO: 5558883 - DNA, 14 bp, Homo sapiens
agaaactgcttaca

SEQ ID NO: 5558884 - DNA, 17 bp, Homo sapiens
agaaactggaaatacta

SEQ ID NO: 5558885 - DNA, 18 bp, Homo sapiens
agaaactggattaaaaca

SEQ ID NO: 5558886 - DNA, 19 bp, Homo sapiens
agaaactggattaaaacaa

SEQ ID NO: 5558887 - DNA, 15 bp, Homo sapiens
agaaactggcaaagc

SEQ ID NO: 5558888 - DNA, 16 bp, Homo sapiens
agaaactggcaaagca

SEQ ID NO: 5558889 - DNA, 17 bp, Homo sapiens
agaaactggcaaagcag

SEQ ID NO: 5558890 - DNA, 21 bp, Homo sapiens
agaaactggttctgtgttgaa

SEQ ID NO: 5558891 - DNA, 17 bp, Homo sapiens
agaaactgtctagcact

SEQ ID NO: 5558892 - DNA, 15 bp, Homo sapiens
agaaactgttcccac

SEQ ID NO: 5558893 - DNA, 16 bp, Homo sapiens
agaaactgtttgatta

SEQ ID NO: 5558894 - DNA, 14 bp, Homo sapiens
agaaacttaaagaa

SEQ ID NO: 5558895 - DNA, 17 bp, Homo sapiens
agaaacttaaatgaaca

SEQ ID NO: 5558896 - DNA, 22 bp, Homo sapiens
agaaacttaaatgaacacagct

SEQ ID NO: 5558897 - DNA, 17 bp, Homo sapiens
agaaacttaaatgttat

SEQ ID NO: 5558898 - DNA, 20 bp, Homo sapiens
agaaacttaaatgttattat

SEQ ID NO: 5558899 - DNA, 19 bp, Homo sapiens
agaaacttaccaattgatg

SEQ ID NO: 5558900 - DNA, 12 bp, Homo sapiens
agaaacttagag

SEQ ID NO: 5558901 - DNA, 16 bp, Homo sapiens
agaaacttcattcaga

SEQ ID NO: 5558902 - DNA, 12 bp, Homo sapiens
agaaacttccag

SEQ ID NO: 5558903 - DNA, 21 bp, Homo sapiens
agaaacttgaactccaggatg

SEQ ID NO: 5558904 - DNA, 14 bp, Homo sapiens
agaaacttggatgt

SEQ ID NO: 5558905 - DNA, 18 bp, Homo sapiens
agaaacttgtaaatatct

SEQ ID NO: 5558906 - DNA, 16 bp, Homo sapiens
agaaacttgtgcttta

SEQ ID NO: 5558907 - DNA, 13 bp, Homo sapiens
agaaacttgttct

SEQ ID NO: 5558908 - DNA, 18 bp, Homo sapiens
agaaactttctggtgctg

SEQ ID NO: 5558909 - DNA, 20 bp, Homo sapiens
agaaactttgagtacagata

SEQ ID NO: 5558910 - DNA, 22 bp, Homo sapiens
agaaactttgagtacagatact

SEQ ID NO: 5558911 - DNA, 19 bp, Homo sapiens
agaaactttgatctctgct

SEQ ID NO: 5558912 - DNA, 15 bp, Homo sapiens
agaaactttggaagc

SEQ ID NO: 5558913 - DNA, 22 bp, Homo sapiens
agaaactttggaagttttactt

SEQ ID NO: 5558914 - DNA, 22 bp, Homo sapiens
agaaacttttatctattctgag

SEQ ID NO: 5558915 - DNA, 11 bp, Homo sapiens
agaaacttttg

SEQ ID NO: 5558916 - DNA, 13 bp, Homo sapiens
agaaacttttgta

SEQ ID NO: 5558917 - DNA, 15 bp, Homo sapiens
agaaacttttgtaaa

SEQ ID NO: 5558918 - DNA, 19 bp, Homo sapiens
agaaactttttaataaagt

SEQ ID NO: 5558919 - DNA, 14 bp, Homo sapiens
agaaactttttcta

SEQ ID NO: 5558920 - DNA, 19 bp, Homo sapiens
agaaacttttttatttaaa

SEQ ID NO: 5558921 - DNA, 16 bp, Homo sapiens
agaaagaaaaaatttt

SEQ ID NO: 5558922 - DNA, 12 bp, Homo sapiens
agaaagaaaagg

SEQ ID NO: 5558923 - DNA, 13 bp, Homo sapiens
agaaagaaaaggc

SEQ ID NO: 5558924 - DNA, 14 bp, Homo sapiens
agaaagaaaatgaa

SEQ ID NO: 5558925 - DNA, 18 bp, Homo sapiens
agaaagaaaatggaaaga

SEQ ID NO: 5558926 - DNA, 22 bp, Homo sapiens
agaaagaaaatggaaagaagga

SEQ ID NO: 5558927 - DNA, 23 bp, Homo sapiens
agaaagaaaatggaaagaaggaa

SEQ ID NO: 5558928 - DNA, 22 bp, Homo sapiens
agaaagaaacccgacagaggga

SEQ ID NO: 5558929 - DNA, 10 bp, Homo sapiens
agaaagaaag

SEQ ID NO: 5558930 - DNA, 13 bp, Homo sapiens
agaaagaaaggaa

SEQ ID NO: 5558931 - DNA, 20 bp, Homo sapiens
agaaagaaaggaaagaagga

SEQ ID NO: 5558932 - DNA, 18 bp, Homo sapiens
agaaagaaagggaaactg

SEQ ID NO: 5558933 - DNA, 17 bp, Homo sapiens
agaaagaaatggctttt

SEQ ID NO: 5558934 - DNA, 11 bp, Homo sapiens
agaaagaaatt

SEQ ID NO: 5558935 - DNA, 12 bp, Homo sapiens
agaaagaaatta

SEQ ID NO: 5558936 - DNA, 23 bp, Homo sapiens
agaaagaaatttgaaaaaacttt

SEQ ID NO: 5558937 - DNA, 14 bp, Homo sapiens
agaaagaacatttt

SEQ ID NO: 5558938 - DNA, 20 bp, Homo sapiens
agaaagaacggaagaagaga

SEQ ID NO: 5558939 - DNA, 16 bp, Homo sapiens
agaaagaactatcttc

SEQ ID NO: 5558940 - DNA, 21 bp, Homo sapiens
agaaagaactttaaagctcag

SEQ ID NO: 5558941 - DNA, 15 bp, Homo sapiens
agaaagaagagaagg

SEQ ID NO: 5558942 - DNA, 13 bp, Homo sapiens
agaaagaagagac

SEQ ID NO: 5558943 - DNA, 18 bp, Homo sapiens
agaaagaagatagtgaga

SEQ ID NO: 5558944 - DNA, 15 bp, Homo sapiens
agaaagaagatgaat

SEQ ID NO: 5558945 - DNA, 17 bp, Homo sapiens
agaaagaagcagttctc

SEQ ID NO: 5558946 - DNA, 18 bp, Homo sapiens
agaaagaaggaagtgaag

SEQ ID NO: 5558947 - DNA, 21 bp, Homo sapiens
agaaagaaggacacttgtatg

SEQ ID NO: 5558948 - DNA, 16 bp, Homo sapiens
agaaagaagtcagtta

SEQ ID NO: 5558949 - DNA, 16 bp, Homo sapiens
agaaagaataaaatgt

SEQ ID NO: 5558950 - DNA, 19 bp, Homo sapiens
agaaagaataaaatgtttc

SEQ ID NO: 5558951 - DNA, 15 bp, Homo sapiens
agaaagaatgagaaa

SEQ ID NO: 5558952 - DNA, 16 bp, Homo sapiens
agaaagaatgcaagag

SEQ ID NO: 5558953 - DNA, 21 bp, Homo sapiens
agaaagaatgttactgcctta

SEQ ID NO: 5558954 - DNA, 17 bp, Homo sapiens
agaaagaattaaaaact

SEQ ID NO: 5558955 - DNA, 14 bp, Homo sapiens
agaaagaattagcc

SEQ ID NO: 5558956 - DNA, 15 bp, Homo sapiens
agaaagaattcctgc

SEQ ID NO: 5558957 - DNA, 20 bp, Homo sapiens
agaaagaattgcagtaaagt

SEQ ID NO: 5558958 - DNA, 22 bp, Homo sapiens
agaaagaatttagtattatcaa

SEQ ID NO: 5558959 - DNA, 13 bp, Homo sapiens
agaaagacattct

SEQ ID NO: 5558960 - DNA, 17 bp, Homo sapiens
agaaagaccctgatgca

SEQ ID NO: 5558961 - DNA, 22 bp, Homo sapiens
agaaagactatctaaatgttga

SEQ ID NO: 5558962 - DNA, 20 bp, Homo sapiens
agaaagactattcaaacagt

SEQ ID NO: 5558963 - DNA, 23 bp, Homo sapiens
agaaagactattcaaacagtctc

SEQ ID NO: 5558964 - DNA, 18 bp, Homo sapiens
agaaagactggacgggga

SEQ ID NO: 5558965 - DNA, 17 bp, Homo sapiens
agaaagagaaacagttg

SEQ ID NO: 5558966 - DNA, 15 bp, Homo sapiens
agaaagagaatgaac

SEQ ID NO: 5558967 - DNA, 21 bp, Homo sapiens
agaaagagactgtggggaggg

SEQ ID NO: 5558968 - DNA, 10 bp, Homo sapiens
agaaagagag

SEQ ID NO: 5558969 - DNA, 15 bp, Homo sapiens
agaaagagagaaaat

SEQ ID NO: 5558970 - DNA, 16 bp, Homo sapiens
agaaagagagaaaata

SEQ ID NO: 5558971 - DNA, 18 bp, Homo sapiens
agaaagagagaaaataaa

SEQ ID NO: 5558972 - DNA, 21 bp, Homo sapiens
agaaagagagaagccagccac

SEQ ID NO: 5558973 - DNA, 23 bp, Homo sapiens
agaaagagagagaattctttcaa

SEQ ID NO: 5558974 - DNA, 14 bp, Homo sapiens
agaaagagagagag

SEQ ID NO: 5558975 - DNA, 17 bp, Homo sapiens
agaaagagagagataca

SEQ ID NO: 5558976 - DNA, 13 bp, Homo sapiens
agaaagagcactt

SEQ ID NO: 5558977 - DNA, 15 bp, Homo sapiens
agaaagagctgcctg

SEQ ID NO: 5558978 - DNA, 15 bp, Homo sapiens
agaaagaggaataaa

SEQ ID NO: 5558979 - DNA, 22 bp, Homo sapiens
agaaagaggcaccaggaagccg

SEQ ID NO: 5558980 - DNA, 14 bp, Homo sapiens
agaaagaggcaggg

SEQ ID NO: 5558981 - DNA, 17 bp, Homo sapiens
agaaagagtctgaccct

SEQ ID NO: 5558982 - DNA, 15 bp, Homo sapiens
agaaagagtttgaaa

SEQ ID NO: 5558983 - DNA, 22 bp, Homo sapiens
agaaagagtttgaaactcgaga

SEQ ID NO: 5558984 - DNA, 13 bp, Homo sapiens
agaaagatatcta

SEQ ID NO: 5558985 - DNA, 17 bp, Homo sapiens
agaaagatcattgaaat

SEQ ID NO: 5558986 - DNA, 14 bp, Homo sapiens
agaaagatccaccc

SEQ ID NO: 5558987 - DNA, 19 bp, Homo sapiens
agaaagatctaagcagctg

SEQ ID NO: 5558988 - DNA, 17 bp, Homo sapiens
agaaagatgaaactgaa

SEQ ID NO: 5558989 - DNA, 24 bp, Homo sapiens
agaaagatgaaactgaaagcacat

SEQ ID NO: 5558990 - DNA, 14 bp, Homo sapiens
agaaagatgttcca

SEQ ID NO: 5558991 - DNA, 17 bp, Homo sapiens
agaaagattaaatatat

SEQ ID NO: 5558992 - DNA, 23 bp, Homo sapiens
agaaagattaaatatatctttgt

SEQ ID NO: 5558993 - DNA, 23 bp, Homo sapiens
agaaagattgtaaactaaagtgt

SEQ ID NO: 5558994 - DNA, 16 bp, Homo sapiens
agaaagatttgatgta

SEQ ID NO: 5558995 - DNA, 16 bp, Homo sapiens
agaaagatttggaaaa

SEQ ID NO: 5558996 - DNA, 18 bp, Homo sapiens
agaaagatttggaaaatt

SEQ ID NO: 5558997 - DNA, 22 bp, Homo sapiens
agaaagatttggaaaattcaca

SEQ ID NO: 5558998 - DNA, 14 bp, Homo sapiens
agaaagatttgtta

SEQ ID NO: 5558999 - DNA, 16 bp, Homo sapiens
agaaagcaaaaaataa

SEQ ID NO: 5559000 - DNA, 18 bp, Homo sapiens
agaaagcaaaaaataaaa

SEQ ID NO: 5559001 - DNA, 19 bp, Homo sapiens
agaaagcaaaaaataaaat

SEQ ID NO: 5559002 - DNA, 23 bp, Homo sapiens
agaaagcaaaaaataaaataagt

SEQ ID NO: 5559003 - DNA, 17 bp, Homo sapiens
agaaagcaaaattatgt

SEQ ID NO: 5559004 - DNA, 15 bp, Homo sapiens
agaaagcaaacaaaa

SEQ ID NO: 5559005 - DNA, 23 bp, Homo sapiens
agaaagcaaaggtgcactccaga

SEQ ID NO: 5559006 - DNA, 21 bp, Homo sapiens
agaaagcaagtgtttttgtat

SEQ ID NO: 5559007 - DNA, 18 bp, Homo sapiens
agaaagcagaacagtgat

SEQ ID NO: 5559008 - DNA, 23 bp, Homo sapiens
agaaagcagacagcaagggcttg

SEQ ID NO: 5559009 - DNA, 15 bp, Homo sapiens
agaaagcagaggctg

SEQ ID NO: 5559010 - DNA, 16 bp, Homo sapiens
agaaagcagaggctgg

SEQ ID NO: 5559011 - DNA, 23 bp, Homo sapiens
agaaagcagaggctggcctcaga

SEQ ID NO: 5559012 - DNA, 18 bp, Homo sapiens
agaaagcatatcccacca

SEQ ID NO: 5559013 - DNA, 15 bp, Homo sapiens
agaaagcatattgac

SEQ ID NO: 5559014 - DNA, 14 bp, Homo sapiens
agaaagcatctatt

SEQ ID NO: 5559015 - DNA, 21 bp, Homo sapiens
agaaagcatttgaatgcattt

SEQ ID NO: 5559016 - DNA, 17 bp, Homo sapiens
agaaagcattttgggat

SEQ ID NO: 5559017 - DNA, 19 bp, Homo sapiens
agaaagccaccttgttaca

SEQ ID NO: 5559018 - DNA, 21 bp, Homo sapiens
agaaagccacgccctccctgc

SEQ ID NO: 5559019 - DNA, 23 bp, Homo sapiens
agaaatatacagtttgacttttt

SEQ ID NO: 5559020 - DNA, 18 bp, Homo sapiens
agaaatatagtgcaatag

SEQ ID NO: 5559021 - DNA, 13 bp, Homo sapiens
agaaatatatata

SEQ ID NO: 5559022 - DNA, 16 bp, Homo sapiens
agaaatatatatacat

SEQ ID NO: 5559023 - DNA, 19 bp, Homo sapiens
agaaatatatatacatatg

SEQ ID NO: 5559024 - DNA, 14 bp, Homo sapiens
agaaatatattcat

SEQ ID NO: 5559025 - DNA, 14 bp, Homo sapiens
agaaatatattttt

SEQ ID NO: 5559026 - DNA, 16 bp, Homo sapiens
agaaatatattttttg

SEQ ID NO: 5559027 - DNA, 20 bp, Homo sapiens
agaaatatccctcatttcat

SEQ ID NO: 5559028 - DNA, 20 bp, Homo sapiens
agaaatatctgaaaatgtat

SEQ ID NO: 5559029 - DNA, 23 bp, Homo sapiens
agaaatatctgtgaaatatcatc

SEQ ID NO: 5559030 - DNA, 20 bp, Homo sapiens
agaaatatctttctcttacc

SEQ ID NO: 5559031 - DNA, 13 bp, Homo sapiens
agaaatatgattt

SEQ ID NO: 5559032 - DNA, 21 bp, Homo sapiens
agaaatatgcacaatagcagt

SEQ ID NO: 5559033 - DNA, 15 bp, Homo sapiens
agaaatatgtggttt

SEQ ID NO: 5559034 - DNA, 11 bp, Homo sapiens
agaaatattaa

SEQ ID NO: 5559035 - DNA, 17 bp, Homo sapiens
agaaatattaatatgta

SEQ ID NO: 5559036 - DNA, 18 bp, Homo sapiens
agaaatattaatatgtac

SEQ ID NO: 5559037 - DNA, 18 bp, Homo sapiens
agaaatattataaatcca

SEQ ID NO: 5559038 - DNA, 21 bp, Homo sapiens
agaaatattggttgaaagtta

SEQ ID NO: 5559039 - DNA, 17 bp, Homo sapiens
agaaatatttataaact

SEQ ID NO: 5559040 - DNA, 13 bp, Homo sapiens
agaaatatttgct

SEQ ID NO: 5559041 - DNA, 21 bp, Homo sapiens
agaaatattttaatttttaaa

SEQ ID NO: 5559042 - DNA, 17 bp, Homo sapiens
agaaatcaaagagagaa

SEQ ID NO: 5559043 - DNA, 23 bp, Homo sapiens
agaaatcaacaggagggcagccc

SEQ ID NO: 5559044 - DNA, 18 bp, Homo sapiens
agaaatcaagcataaatc

SEQ ID NO: 5559045 - DNA, 19 bp, Homo sapiens
agaaatcaatagttgaatt

SEQ ID NO: 5559046 - DNA, 22 bp, Homo sapiens
agaaatcacaattttcctgtgg

SEQ ID NO: 5559047 - DNA, 16 bp, Homo sapiens
agaaatcacaggggcg

SEQ ID NO: 5559048 - DNA, 19 bp, Homo sapiens
agaaatcacaggggcgggg

SEQ ID NO: 5559049 - DNA, 11 bp, Homo sapiens
agaaatcactg

SEQ ID NO: 5559050 - DNA, 17 bp, Homo sapiens
agaaatcactgtgaaat

SEQ ID NO: 5559051 - DNA, 14 bp, Homo sapiens
agaaatcagaaaaa

SEQ ID NO: 5559052 - DNA, 16 bp, Homo sapiens
agaaatcaggtgtttt

SEQ ID NO: 5559053 - DNA, 22 bp, Homo sapiens
agaaatcaggtgttttaagact

SEQ ID NO: 5559054 - DNA, 12 bp, Homo sapiens
agaaatcatgtt

SEQ ID NO: 5559055 - DNA, 13 bp, Homo sapiens
agaaatcatgtta

SEQ ID NO: 5559056 - DNA, 16 bp, Homo sapiens
agaaatcattgtagaa

SEQ ID NO: 5559057 - DNA, 22 bp, Homo sapiens
agaaatcattgtagaaacacag

SEQ ID NO: 5559058 - DNA, 21 bp, Homo sapiens
agaaatcatttgggttaatat

SEQ ID NO: 5559059 - DNA, 22 bp, Homo sapiens
agaaatcattttgcaatccctt

SEQ ID NO: 5559060 - DNA, 16 bp, Homo sapiens
agaaatccatatctta

SEQ ID NO: 5559061 - DNA, 18 bp, Homo sapiens
agaaatcccagttcatgt

SEQ ID NO: 5559062 - DNA, 22 bp, Homo sapiens
agaaatcccagttcatgttgct

SEQ ID NO: 5559063 - DNA, 20 bp, Homo sapiens
agaaatcccctaactgattt

SEQ ID NO: 5559064 - DNA, 22 bp, Homo sapiens
agaaatcccctaactgatttcc

SEQ ID NO: 5559065 - DNA, 19 bp, Homo sapiens
agaaatccctgtttaatat

SEQ ID NO: 5559066 - DNA, 18 bp, Homo sapiens
agaaatcctggtttgtaa

SEQ ID NO: 5559067 - DNA, 17 bp, Homo sapiens
agaaatcctttcataaa

SEQ ID NO: 5559068 - DNA, 20 bp, Homo sapiens
agaaatcgccttatgagaac

SEQ ID NO: 5559069 - DNA, 15 bp, Homo sapiens
agaaatctaagctgt

SEQ ID NO: 5559070 - DNA, 14 bp, Homo sapiens
agaaatctagaaga

SEQ ID NO: 5559071 - DNA, 20 bp, Homo sapiens
agaaatctatagaaagtgtt

SEQ ID NO: 5559072 - DNA, 21 bp, Homo sapiens
agaaatctatagaaagtgttc

SEQ ID NO: 5559073 - DNA, 17 bp, Homo sapiens
agaaatctccagtgtgc

SEQ ID NO: 5559074 - DNA, 21 bp, Homo sapiens
agaaatctcctaacaaaagaa

SEQ ID NO: 5559075 - DNA, 17 bp, Homo sapiens
agaaatctctagctcag

SEQ ID NO: 5559076 - DNA, 22 bp, Homo sapiens
agaaatctctcacccagttcag

SEQ ID NO: 5559077 - DNA, 14 bp, Homo sapiens
agaaatctgaaaaa

SEQ ID NO: 5559078 - DNA, 21 bp, Homo sapiens
agaaatctgaaaaatggccat

SEQ ID NO: 5559079 - DNA, 14 bp, Homo sapiens
agaaatctggccca

SEQ ID NO: 5559080 - DNA, 19 bp, Homo sapiens
agaaatctggcccagggtg

SEQ ID NO: 5559081 - DNA, 22 bp, Homo sapiens
agaaatctggtcttgttagaaa

SEQ ID NO: 5559082 - DNA, 12 bp, Homo sapiens
agaaatcttaag

SEQ ID NO: 5559083 - DNA, 13 bp, Homo sapiens
agaaatcttgctt

SEQ ID NO: 5559084 - DNA, 13 bp, Homo sapiens
agaaatctttcca

SEQ ID NO: 5559085 - DNA, 16 bp, Homo sapiens
agaaatctttccagtt

SEQ ID NO: 5559086 - DNA, 17 bp, Homo sapiens
agaaatgaaaaaatata

SEQ ID NO: 5559087 - DNA, 14 bp, Homo sapiens
agaaatgaaacaga

SEQ ID NO: 5559088 - DNA, 14 bp, Homo sapiens
agaaatgaaatagc

SEQ ID NO: 5559089 - DNA, 13 bp, Homo sapiens
agaaatgaaattg

SEQ ID NO: 5559090 - DNA, 16 bp, Homo sapiens
agaaatgaaattgaca

SEQ ID NO: 5559091 - DNA, 14 bp, Homo sapiens
agaaatgaaatttt

SEQ ID NO: 5559092 - DNA, 16 bp, Homo sapiens
agaaatgaacattcca

SEQ ID NO: 5559093 - DNA, 14 bp, Homo sapiens
agaaatgaagcaga

SEQ ID NO: 5559094 - DNA, 17 bp, Homo sapiens
agaaatgaagcagagga

SEQ ID NO: 5559095 - DNA, 18 bp, Homo sapiens
agaaatgaagtttatatt

SEQ ID NO: 5559096 - DNA, 17 bp, Homo sapiens
agaaatgactaattagg

SEQ ID NO: 5559097 - DNA, 12 bp, Homo sapiens
agaaatgagaaa

SEQ ID NO: 5559098 - DNA, 14 bp, Homo sapiens
agaaatgagaaatt

SEQ ID NO: 5559099 - DNA, 16 bp, Homo sapiens
agaaatgagaaattgt

SEQ ID NO: 5559100 - DNA, 22 bp, Homo sapiens
agaaatgaggaggatgctaaaa

SEQ ID NO: 5559101 - DNA, 15 bp, Homo sapiens
agaaatgatgtgaaa

SEQ ID NO: 5559102 - DNA, 20 bp, Homo sapiens
agaaatgatgtgaaagataa

SEQ ID NO: 5559103 - DNA, 18 bp, Homo sapiens
agaaatgatgttggagaa

SEQ ID NO: 5559104 - DNA, 16 bp, Homo sapiens
agaaatgatgttgtca

SEQ ID NO: 5559105 - DNA, 16 bp, Homo sapiens
agaaatgcaaattctc

SEQ ID NO: 5559106 - DNA, 21 bp, Homo sapiens
agaaatgcactaagacaagaa

SEQ ID NO: 5559107 - DNA, 13 bp, Homo sapiens
agaaatgcatatt

SEQ ID NO: 5559108 - DNA, 21 bp, Homo sapiens
agaaatgccaaaaatgtgcct

SEQ ID NO: 5559109 - DNA, 21 bp, Homo sapiens
agaaatgccaagcacttcttt

SEQ ID NO: 5559110 - DNA, 11 bp, Homo sapiens
agaaatgccag

SEQ ID NO: 5559111 - DNA, 13 bp, Homo sapiens
agaaatgccccag

SEQ ID NO: 5559112 - DNA, 14 bp, Homo sapiens
agaaatgccccagt

SEQ ID NO: 5559113 - DNA, 24 bp, Homo sapiens
agaaatgcccttcactttctcctg

SEQ ID NO: 5559114 - DNA, 17 bp, Homo sapiens
agaaatgccgctgtgtc

SEQ ID NO: 5559115 - DNA, 13 bp, Homo sapiens
agaaatgctgctg

SEQ ID NO: 5559116 - DNA, 17 bp, Homo sapiens
agaaatgctgctggcca

SEQ ID NO: 5559117 - DNA, 20 bp, Homo sapiens
agaaatgctggtttttcagt

SEQ ID NO: 5559118 - DNA, 16 bp, Homo sapiens
agaaatggaaagcaga

SEQ ID NO: 5559119 - DNA, 15 bp, Homo sapiens
agaaatggaatgaat

SEQ ID NO: 5559120 - DNA, 18 bp, Homo sapiens
agaaatggcgtctgctct

SEQ ID NO: 5559121 - DNA, 15 bp, Homo sapiens
agaaatgggaatcat

SEQ ID NO: 5559122 - DNA, 12 bp, Homo sapiens
agaaatgggcag

SEQ ID NO: 5559123 - DNA, 16 bp, Homo sapiens
agaaatgggcagttct

SEQ ID NO: 5559124 - DNA, 17 bp, Homo sapiens
agaaatgggcagttctc

SEQ ID NO: 5559125 - DNA, 19 bp, Homo sapiens
agaaatgggcagttctccc

SEQ ID NO: 5559126 - DNA, 22 bp, Homo sapiens
agaaatgggcagttctcccagg

SEQ ID NO: 5559127 - DNA, 15 bp, Homo sapiens
agaaatgggcctcag

SEQ ID NO: 5559128 - DNA, 17 bp, Homo sapiens
agaaatgggcctcagcc

SEQ ID NO: 5559129 - DNA, 16 bp, Homo sapiens
agaaatgggcctgcct

SEQ ID NO: 5559130 - DNA, 17 bp, Homo sapiens
agaaatgggcctgcctg

SEQ ID NO: 5559131 - DNA, 18 bp, Homo sapiens
agaaatgggcctgcctgc

SEQ ID NO: 5559132 - DNA, 23 bp, Homo sapiens
agaaatgggcctgcctgcctcca

SEQ ID NO: 5559133 - DNA, 17 bp, Homo sapiens
agaaatggttgtattag

SEQ ID NO: 5559134 - DNA, 20 bp, Homo sapiens
agaaatggtttcctctggat

SEQ ID NO: 5559135 - DNA, 13 bp, Homo sapiens
agaaatgtaaact

SEQ ID NO: 5559136 - DNA, 20 bp, Homo sapiens
agaaatgtaattatgttcta

SEQ ID NO: 5559137 - DNA, 18 bp, Homo sapiens
agaaatgtagatgatatg

SEQ ID NO: 5559138 - DNA, 18 bp, Homo sapiens
agaaatgtagcagcagcc

SEQ ID NO: 5559139 - DNA, 15 bp, Homo sapiens
agaaatgtagttgat

SEQ ID NO: 5559140 - DNA, 16 bp, Homo sapiens
agaaatgtataaactt

SEQ ID NO: 5559141 - DNA, 12 bp, Homo sapiens
agaaatgtatat

SEQ ID NO: 5559142 - DNA, 22 bp, Homo sapiens
agaaatgtattcctgaaaagct

SEQ ID NO: 5559143 - DNA, 22 bp, Homo sapiens
agaaatgtcataaattactgtt

SEQ ID NO: 5559144 - DNA, 13 bp, Homo sapiens
agaaatgtctaat

SEQ ID NO: 5559145 - DNA, 24 bp, Homo sapiens
agaaatgtctatgttttctactcc

SEQ ID NO: 5559146 - DNA, 18 bp, Homo sapiens
agaaatgtctctgctcct

SEQ ID NO: 5559147 - DNA, 17 bp, Homo sapiens
agaaatgtctggagaat

SEQ ID NO: 5559148 - DNA, 21 bp, Homo sapiens
agaaatgtcttaatttttgaa

SEQ ID NO: 5559149 - DNA, 17 bp, Homo sapiens
agaaatgtgaagggtgg

SEQ ID NO: 5559150 - DNA, 20 bp, Homo sapiens
agaaatgtgaagggtggggt

SEQ ID NO: 5559151 - DNA, 21 bp, Homo sapiens
agaaatgtgacttggccgggc

SEQ ID NO: 5559152 - DNA, 19 bp, Homo sapiens
agaaatgtgctgcaaagag

SEQ ID NO: 5559153 - DNA, 21 bp, Homo sapiens
agaaatgtgtagctgcaaaaa

SEQ ID NO: 5559154 - DNA, 14 bp, Homo sapiens
agaaatgttataaa

SEQ ID NO: 5559155 - DNA, 23 bp, Homo sapiens
agaaatgttggttacatgaatga

SEQ ID NO: 5559156 - DNA, 16 bp, Homo sapiens
agaaatgttgttcatt

SEQ ID NO: 5559157 - DNA, 21 bp, Homo sapiens
agaaatgtttatggaaatatt

SEQ ID NO: 5559158 - DNA, 16 bp, Homo sapiens
agaaattaacacccaa

SEQ ID NO: 5559159 - DNA, 18 bp, Homo sapiens
agaaattacctgtggata

SEQ ID NO: 5559160 - DNA, 17 bp, Homo sapiens
agaaattagctgtgtga

SEQ ID NO: 5559161 - DNA, 19 bp, Homo sapiens
agaaattagggctctaatt

SEQ ID NO: 5559162 - DNA, 20 bp, Homo sapiens
agaaattatacgtacataca

SEQ ID NO: 5559163 - DNA, 21 bp, Homo sapiens
agaaattatacgtacatacac

SEQ ID NO: 5559164 - DNA, 16 bp, Homo sapiens
agaaattatctttagt

SEQ ID NO: 5559165 - DNA, 13 bp, Homo sapiens
agaaattatgaaa

SEQ ID NO: 5559166 - DNA, 17 bp, Homo sapiens
agaaattatttaataaa

SEQ ID NO: 5559167 - DNA, 19 bp, Homo sapiens
agaaattcaagaagtattt

SEQ ID NO: 5559168 - DNA, 11 bp, Homo sapiens
agaaattcagg

SEQ ID NO: 5559169 - DNA, 15 bp, Homo sapiens
agaaattcattaaag

SEQ ID NO: 5559170 - DNA, 20 bp, Homo sapiens
agaaattccaactcctgatg

SEQ ID NO: 5559171 - DNA, 17 bp, Homo sapiens
agaaattccctggacca

SEQ ID NO: 5559172 - DNA, 23 bp, Homo sapiens
agaaattccctggaccagatgct

SEQ ID NO: 5559173 - DNA, 20 bp, Homo sapiens
agaaattcctgtagcatctt

SEQ ID NO: 5559174 - DNA, 20 bp, Homo sapiens
agaaattcgcatgtttaatg

SEQ ID NO: 5559175 - DNA, 22 bp, Homo sapiens
agaaattcgcatgtttaatgtg

SEQ ID NO: 5559176 - DNA, 23 bp, Homo sapiens
agaaattcgccccattttcttta

SEQ ID NO: 5559177 - DNA, 23 bp, Homo sapiens
agaaattcgtgtgtttttttatg

SEQ ID NO: 5559178 - DNA, 15 bp, Homo sapiens
agaaattctaactta

SEQ ID NO: 5559179 - DNA, 15 bp, Homo sapiens
agaaattctataaga

SEQ ID NO: 5559180 - DNA, 22 bp, Homo sapiens
agaaattctataagagacaaag

SEQ ID NO: 5559181 - DNA, 19 bp, Homo sapiens
agaaattctcaaaatacgt

SEQ ID NO: 5559182 - DNA, 18 bp, Homo sapiens
agaaattctgaagagagt

SEQ ID NO: 5559183 - DNA, 19 bp, Homo sapiens
agaaattctggcccagcca

SEQ ID NO: 5559184 - DNA, 12 bp, Homo sapiens
agaaattctgtt

SEQ ID NO: 5559185 - DNA, 14 bp, Homo sapiens
agaaattctgttaa

SEQ ID NO: 5559186 - DNA, 21 bp, Homo sapiens
agaaattctgtttttaaaaat

SEQ ID NO: 5559187 - DNA, 16 bp, Homo sapiens
agaaattgaatacttt

SEQ ID NO: 5559188 - DNA, 17 bp, Homo sapiens
agaaattgaatactttg

SEQ ID NO: 5559189 - DNA, 21 bp, Homo sapiens
agaaattgaatactttgaatg

SEQ ID NO: 5559190 - DNA, 22 bp, Homo sapiens
agaaattgaatactttgaatgt

SEQ ID NO: 5559191 - DNA, 13 bp, Homo sapiens
agaaattgaatgt

SEQ ID NO: 5559192 - DNA, 14 bp, Homo sapiens
agaaattgaggttg

SEQ ID NO: 5559193 - DNA, 20 bp, Homo sapiens
agaaattgcctatcctgctg

SEQ ID NO: 5559194 - DNA, 16 bp, Homo sapiens
agaaattgcctccagt

SEQ ID NO: 5559195 - DNA, 16 bp, Homo sapiens
agaaattggtacatag

SEQ ID NO: 5559196 - DNA, 14 bp, Homo sapiens
agaactctggcttt

SEQ ID NO: 5559197 - DNA, 20 bp, Homo sapiens
agaactctggcttttggaag

SEQ ID NO: 5559198 - DNA, 14 bp, Homo sapiens
agaactctgggctg

SEQ ID NO: 5559199 - DNA, 12 bp, Homo sapiens
agaactcttcct

SEQ ID NO: 5559200 - DNA, 15 bp, Homo sapiens
agaactcttcctcct

SEQ ID NO: 5559201 - DNA, 14 bp, Homo sapiens
agaactctttcaaa

SEQ ID NO: 5559202 - DNA, 16 bp, Homo sapiens
agaactgaaaaattac

SEQ ID NO: 5559203 - DNA, 16 bp, Homo sapiens
agaactgaaaggcttt

SEQ ID NO: 5559204 - DNA, 23 bp, Homo sapiens
agaactgaaccggctttaccaaa

SEQ ID NO: 5559205 - DNA, 15 bp, Homo sapiens
agaactgaactgtaa

SEQ ID NO: 5559206 - DNA, 15 bp, Homo sapiens
agaactgaagccact

SEQ ID NO: 5559207 - DNA, 18 bp, Homo sapiens
agaactgacttcctgaac

SEQ ID NO: 5559208 - DNA, 20 bp, Homo sapiens
agaactgagcatctccagca

SEQ ID NO: 5559209 - DNA, 16 bp, Homo sapiens
agaactgagctcctct

SEQ ID NO: 5559210 - DNA, 22 bp, Homo sapiens
agaactgagggctctgtttgtg

SEQ ID NO: 5559211 - DNA, 15 bp, Homo sapiens
agaactgattacatc

SEQ ID NO: 5559212 - DNA, 16 bp, Homo sapiens
agaactgattttacaa

SEQ ID NO: 5559213 - DNA, 15 bp, Homo sapiens
agaactgcacatgaa

SEQ ID NO: 5559214 - DNA, 13 bp, Homo sapiens
agaactgcacttt

SEQ ID NO: 5559215 - DNA, 20 bp, Homo sapiens
agaactgcagacctcactgt

SEQ ID NO: 5559216 - DNA, 19 bp, Homo sapiens
agaactgcagatagcccag

SEQ ID NO: 5559217 - DNA, 21 bp, Homo sapiens
agaactgcagatagcccagga

SEQ ID NO: 5559218 - DNA, 23 bp, Homo sapiens
agaactgcagatagcccaggagc

SEQ ID NO: 5559219 - DNA, 18 bp, Homo sapiens
agaactgcaggccctggc

SEQ ID NO: 5559220 - DNA, 20 bp, Homo sapiens
agaactgcaggccctggcct

SEQ ID NO: 5559221 - DNA, 15 bp, Homo sapiens
agaactgcatatgtt

SEQ ID NO: 5559222 - DNA, 19 bp, Homo sapiens
agaactgcatatgtttcgc

SEQ ID NO: 5559223 - DNA, 15 bp, Homo sapiens
agaactgcccccact

SEQ ID NO: 5559224 - DNA, 12 bp, Homo sapiens
agaactgccctt

SEQ ID NO: 5559225 - DNA, 22 bp, Homo sapiens
agaactgcctttggcagagttc

SEQ ID NO: 5559226 - DNA, 18 bp, Homo sapiens
agaactgctggggctggt

SEQ ID NO: 5559227 - DNA, 15 bp, Homo sapiens
agaactgctgtttca

SEQ ID NO: 5559228 - DNA, 16 bp, Homo sapiens
agaactgcttgcattt

SEQ ID NO: 5559229 - DNA, 19 bp, Homo sapiens
agaactgcttgcatttctt

SEQ ID NO: 5559230 - DNA, 15 bp, Homo sapiens
agaactggactcagg

SEQ ID NO: 5559231 - DNA, 22 bp, Homo sapiens
agaactggactcaggatgccca

SEQ ID NO: 5559232 - DNA, 17 bp, Homo sapiens
agaactggcaggagcct

SEQ ID NO: 5559233 - DNA, 14 bp, Homo sapiens
agaactggctgggc

SEQ ID NO: 5559234 - DNA, 16 bp, Homo sapiens
agaactggctgggccc

SEQ ID NO: 5559235 - DNA, 17 bp, Homo sapiens
agaactggctgggcccc

SEQ ID NO: 5559236 - DNA, 21 bp, Homo sapiens
agaactggctgggcccctggg

SEQ ID NO: 5559237 - DNA, 23 bp, Homo sapiens
agaactggctgggcccctgggga

SEQ ID NO: 5559238 - DNA, 15 bp, Homo sapiens
agaactgggatttga

SEQ ID NO: 5559239 - DNA, 23 bp, Homo sapiens
agaactgggatttgaacccccgc

SEQ ID NO: 5559240 - DNA, 23 bp, Homo sapiens
agaactggggttcaagcccaggc

SEQ ID NO: 5559241 - DNA, 12 bp, Homo sapiens
agaactgggtaa

SEQ ID NO: 5559242 - DNA, 19 bp, Homo sapiens
agaactgggtaaatgcaaa

SEQ ID NO: 5559243 - DNA, 17 bp, Homo sapiens
agaactggttcttgcct

SEQ ID NO: 5559244 - DNA, 16 bp, Homo sapiens
agaactgtacattgtg

SEQ ID NO: 5559245 - DNA, 22 bp, Homo sapiens
agaactgtacattgtgagctct

SEQ ID NO: 5559246 - DNA, 19 bp, Homo sapiens
agaactgtatgtcagacat

SEQ ID NO: 5559247 - DNA, 16 bp, Homo sapiens
agaactgtcaccctga

SEQ ID NO: 5559248 - DNA, 22 bp, Homo sapiens
agaactgtcatgtaaacatacc

SEQ ID NO: 5559249 - DNA, 11 bp, Homo sapiens
agaactgtccc

SEQ ID NO: 5559250 - DNA, 12 bp, Homo sapiens
agaactgtccca

SEQ ID NO: 5559251 - DNA, 22 bp, Homo sapiens
agaactgtcccacaaaatattt

SEQ ID NO: 5559252 - DNA, 21 bp, Homo sapiens
agaactgtcccatccccaggt

SEQ ID NO: 5559253 - DNA, 23 bp, Homo sapiens
agaactgtcggaggaaagacaac

SEQ ID NO: 5559254 - DNA, 15 bp, Homo sapiens
agaactgtctttcat

SEQ ID NO: 5559255 - DNA, 19 bp, Homo sapiens
agaactgtgaaatttacaa

SEQ ID NO: 5559256 - DNA, 16 bp, Homo sapiens
agaactgtgataaaaa

SEQ ID NO: 5559257 - DNA, 20 bp, Homo sapiens
agaactgtgataaaaagagg

SEQ ID NO: 5559258 - DNA, 14 bp, Homo sapiens
agaactgtgctctc

SEQ ID NO: 5559259 - DNA, 19 bp, Homo sapiens
agaactgtgtttcaagttc

SEQ ID NO: 5559260 - DNA, 20 bp, Homo sapiens
agaactgtgtttcaagttca

SEQ ID NO: 5559261 - DNA, 22 bp, Homo sapiens
agaactgttgcctaattggaaa

SEQ ID NO: 5559262 - DNA, 16 bp, Homo sapiens
agaactgttggctgct

SEQ ID NO: 5559263 - DNA, 20 bp, Homo sapiens
agaacttaaattatgtttta

SEQ ID NO: 5559264 - DNA, 22 bp, Homo sapiens
agaacttagcctttacctgtga

SEQ ID NO: 5559265 - DNA, 15 bp, Homo sapiens
agaacttagttttgt

SEQ ID NO: 5559266 - DNA, 19 bp, Homo sapiens
agaacttcaagatgagcct

SEQ ID NO: 5559267 - DNA, 23 bp, Homo sapiens
agaacttcaagatgagcctgggc

SEQ ID NO: 5559268 - DNA, 14 bp, Homo sapiens
agaacttcagaaag

SEQ ID NO: 5559269 - DNA, 17 bp, Homo sapiens
agaacttcagaaagact

SEQ ID NO: 5559270 - DNA, 20 bp, Homo sapiens
agaacttccccatacaaata

SEQ ID NO: 5559271 - DNA, 20 bp, Homo sapiens
agaacttctccgtcctcgat

SEQ ID NO: 5559272 - DNA, 17 bp, Homo sapiens
agaacttctctaagcct

SEQ ID NO: 5559273 - DNA, 13 bp, Homo sapiens
agaacttgaacaa

SEQ ID NO: 5559274 - DNA, 18 bp, Homo sapiens
agaacttgcagtgtcttt

SEQ ID NO: 5559275 - DNA, 14 bp, Homo sapiens
agaacttgctgctg

SEQ ID NO: 5559276 - DNA, 16 bp, Homo sapiens
agaacttgctgctgtc

SEQ ID NO: 5559277 - DNA, 21 bp, Homo sapiens
agaacttgttgctgattttga

SEQ ID NO: 5559278 - DNA, 23 bp, Homo sapiens
agaacttgttgctgattttgacc

SEQ ID NO: 5559279 - DNA, 14 bp, Homo sapiens
agaacttgtttaca

SEQ ID NO: 5559280 - DNA, 15 bp, Homo sapiens
agaacttgtttacaa

SEQ ID NO: 5559281 - DNA, 15 bp, Homo sapiens
agaactttatttcca

SEQ ID NO: 5559282 - DNA, 17 bp, Homo sapiens
agaactttattttggat

SEQ ID NO: 5559283 - DNA, 15 bp, Homo sapiens
agaactttcattttt

SEQ ID NO: 5559284 - DNA, 19 bp, Homo sapiens
agaactttcggagcctgcc

SEQ ID NO: 5559285 - DNA, 20 bp, Homo sapiens
agaactttgcatagcagctg

SEQ ID NO: 5559286 - DNA, 23 bp, Homo sapiens
agaactttgccttaagtttccct

SEQ ID NO: 5559287 - DNA, 17 bp, Homo sapiens
agaactttgtatagtta

SEQ ID NO: 5559288 - DNA, 16 bp, Homo sapiens
agaactttgtattttc

SEQ ID NO: 5559289 - DNA, 18 bp, Homo sapiens
agaacttttcatagatga

SEQ ID NO: 5559290 - DNA, 13 bp, Homo sapiens
agaacttttttaa

SEQ ID NO: 5559291 - DNA, 15 bp, Homo sapiens
agaacttttttaaat

SEQ ID NO: 5559292 - DNA, 17 bp, Homo sapiens
agaacttttttaaataa

SEQ ID NO: 5559293 - DNA, 21 bp, Homo sapiens
agaacttttttaaataaactt

SEQ ID NO: 5559294 - DNA, 22 bp, Homo sapiens
agaacttttttaaataaacttt

SEQ ID NO: 5559295 - DNA, 23 bp, Homo sapiens
agaacttttttaaataaactttt

SEQ ID NO: 5559296 - DNA, 13 bp, Homo sapiens
agaagaaaaaaac

SEQ ID NO: 5559297 - DNA, 21 bp, Homo sapiens
agaagaaaaaaacgaaaacag

SEQ ID NO: 5559298 - DNA, 14 bp, Homo sapiens
agaagaaaaaagaa

SEQ ID NO: 5559299 - DNA, 12 bp, Homo sapiens
agaagaaaacag

SEQ ID NO: 5559300 - DNA, 14 bp, Homo sapiens
agaagaaaacatat

SEQ ID NO: 5559301 - DNA, 16 bp, Homo sapiens
agaagaaaacatatat

SEQ ID NO: 5559302 - DNA, 15 bp, Homo sapiens
agaagaaaacatcta

SEQ ID NO: 5559303 - DNA, 11 bp, Homo sapiens
agaagaaaacc

SEQ ID NO: 5559304 - DNA, 13 bp, Homo sapiens
agaagaaaacccg

SEQ ID NO: 5559305 - DNA, 13 bp, Homo sapiens
agaagaaaagact

SEQ ID NO: 5559306 - DNA, 15 bp, Homo sapiens
agaagaaaagactta

SEQ ID NO: 5559307 - DNA, 13 bp, Homo sapiens
agaagaaaagaga

SEQ ID NO: 5559308 - DNA, 15 bp, Homo sapiens
agaagaaaagagaag

SEQ ID NO: 5559309 - DNA, 20 bp, Homo sapiens
agaagaaaagagaagaagaa

SEQ ID NO: 5559310 - DNA, 18 bp, Homo sapiens
agaagaaaagattcttct

SEQ ID NO: 5559311 - DNA, 22 bp, Homo sapiens
agaagaaaatggaaccaggctt

SEQ ID NO: 5559312 - DNA, 14 bp, Homo sapiens
agaagaaaatttaa

SEQ ID NO: 5559313 - DNA, 13 bp, Homo sapiens
agaagaaacaagg

SEQ ID NO: 5559314 - DNA, 13 bp, Homo sapiens
agaagaaactagg

SEQ ID NO: 5559315 - DNA, 14 bp, Homo sapiens
agaagaaactattt

SEQ ID NO: 5559316 - DNA, 13 bp, Homo sapiens
agaagaaactcct

SEQ ID NO: 5559317 - DNA, 11 bp, Homo sapiens
agaagaaactg

SEQ ID NO: 5559318 - DNA, 14 bp, Homo sapiens
agaagaaagaaaat

SEQ ID NO: 5559319 - DNA, 15 bp, Homo sapiens
agaagaaagaactat

SEQ ID NO: 5559320 - DNA, 19 bp, Homo sapiens
agaagaaagaagcactctg

SEQ ID NO: 5559321 - DNA, 14 bp, Homo sapiens
agaagaaagactct

SEQ ID NO: 5559322 - DNA, 12 bp, Homo sapiens
agaagaaagatg

SEQ ID NO: 5559323 - DNA, 14 bp, Homo sapiens
agaagaaagcaaaa

SEQ ID NO: 5559324 - DNA, 12 bp, Homo sapiens
agaagaaaggac

SEQ ID NO: 5559325 - DNA, 14 bp, Homo sapiens
agaagaaaggagct

SEQ ID NO: 5559326 - DNA, 13 bp, Homo sapiens
agaagaaagtaaa

SEQ ID NO: 5559327 - DNA, 16 bp, Homo sapiens
agaagaaagtctatgc

SEQ ID NO: 5559328 - DNA, 23 bp, Homo sapiens
agaagaaataaataatctacatc

SEQ ID NO: 5559329 - DNA, 20 bp, Homo sapiens
agaagaaatagcagagccta

SEQ ID NO: 5559330 - DNA, 18 bp, Homo sapiens
agaagaaatgacattttg

SEQ ID NO: 5559331 - DNA, 13 bp, Homo sapiens
agaagaaattagg

SEQ ID NO: 5559332 - DNA, 13 bp, Homo sapiens
agaagaaattatt

SEQ ID NO: 5559333 - DNA, 22 bp, Homo sapiens
agaagaaattatttaatatgca

SEQ ID NO: 5559334 - DNA, 14 bp, Homo sapiens
agaagaacagcaga

SEQ ID NO: 5559335 - DNA, 13 bp, Homo sapiens
agaagaacatcca

SEQ ID NO: 5559336 - DNA, 17 bp, Homo sapiens
agaagaaccaggcatgg

SEQ ID NO: 5559337 - DNA, 22 bp, Homo sapiens
agaagaaccaggcatggaaaga

SEQ ID NO: 5559338 - DNA, 19 bp, Homo sapiens
agaagaactagaggtttta

SEQ ID NO: 5559339 - DNA, 19 bp, Homo sapiens
agaagaactatatgtgaat

SEQ ID NO: 5559340 - DNA, 17 bp, Homo sapiens
agaagaactttgcctta

SEQ ID NO: 5559341 - DNA, 15 bp, Homo sapiens
agaagaagaaaagag

SEQ ID NO: 5559342 - DNA, 15 bp, Homo sapiens
agaagaagaagaagg

SEQ ID NO: 5559343 - DNA, 20 bp, Homo sapiens
agaagaagagaagctgctga

SEQ ID NO: 5559344 - DNA, 22 bp, Homo sapiens
agaagaagcggccaggcggggc

SEQ ID NO: 5559345 - DNA, 13 bp, Homo sapiens
agaagaagctgag

SEQ ID NO: 5559346 - DNA, 17 bp, Homo sapiens
agaagaaggaaatgaat

SEQ ID NO: 5559347 - DNA, 14 bp, Homo sapiens
agaagaaggcagca

SEQ ID NO: 5559348 - DNA, 15 bp, Homo sapiens
agaagaaggccagag

SEQ ID NO: 5559349 - DNA, 17 bp, Homo sapiens
agaagaaggccagagag

SEQ ID NO: 5559350 - DNA, 14 bp, Homo sapiens
agaagaagtgcttg

SEQ ID NO: 5559351 - DNA, 23 bp, Homo sapiens
agaagaagtgcttgggggttttt

SEQ ID NO: 5559352 - DNA, 19 bp, Homo sapiens
agaagaagtggctgccaca

SEQ ID NO: 5559353 - DNA, 15 bp, Homo sapiens
agaagaagtgggagc

SEQ ID NO: 5559354 - DNA, 17 bp, Homo sapiens
agaagaagtgggagcag

SEQ ID NO: 5559355 - DNA, 24 bp, Homo sapiens
agaagaagtgggagcagcttcttg

SEQ ID NO: 5559356 - DNA, 14 bp, Homo sapiens
agaagaagtgtgtc

SEQ ID NO: 5559357 - DNA, 16 bp, Homo sapiens
agaagaagttcatgtc

SEQ ID NO: 5559358 - DNA, 20 bp, Homo sapiens
agaagaatacaaacatattt

SEQ ID NO: 5559359 - DNA, 15 bp, Homo sapiens
agaagaatatcaaat

SEQ ID NO: 5559360 - DNA, 18 bp, Homo sapiens
agaagaatatcaaataat

SEQ ID NO: 5559361 - DNA, 22 bp, Homo sapiens
agaagaatattgtattgttaga

SEQ ID NO: 5559362 - DNA, 18 bp, Homo sapiens
agaagaatccacaaggac

SEQ ID NO: 5559363 - DNA, 22 bp, Homo sapiens
agaagaatctcatctcagtgaa

SEQ ID NO: 5559364 - DNA, 23 bp, Homo sapiens
agaagaatcttcctggcacaatg

SEQ ID NO: 5559365 - DNA, 22 bp, Homo sapiens
agaagaatgcatgctttccata

SEQ ID NO: 5559366 - DNA, 19 bp, Homo sapiens
agaagaattgaacccagga

SEQ ID NO: 5559367 - DNA, 20 bp, Homo sapiens
agaagaattgaacccaggag

SEQ ID NO: 5559368 - DNA, 13 bp, Homo sapiens
agaagaattttat

SEQ ID NO: 5559369 - DNA, 21 bp, Homo sapiens
agaagaattttatttttctgt

SEQ ID NO: 5559370 - DNA, 13 bp, Homo sapiens
agaagacaaaaag

SEQ ID NO: 5559371 - DNA, 12 bp, Homo sapiens
agaagacaaaat

SEQ ID NO: 5559372 - DNA, 13 bp, Homo sapiens
agaagacaaaatt

SEQ ID NO: 5559373 - DNA, 15 bp, Homo sapiens
agaagacaaactgct

SEQ ID NO: 5559374 - DNA, 14 bp, Homo sapiens
agaagacaaagtct

SEQ ID NO: 5559375 - DNA, 22 bp, Homo sapiens
agaagccaggaggcctgcacca

SEQ ID NO: 5559376 - DNA, 13 bp, Homo sapiens
agaagccagtctg

SEQ ID NO: 5559377 - DNA, 14 bp, Homo sapiens
agaagccagtctgc

SEQ ID NO: 5559378 - DNA, 17 bp, Homo sapiens
agaagccagtctgcgtc

SEQ ID NO: 5559379 - DNA, 21 bp, Homo sapiens
agaagccatatatgaccagaa

SEQ ID NO: 5559380 - DNA, 16 bp, Homo sapiens
agaagccatcacctca

SEQ ID NO: 5559381 - DNA, 20 bp, Homo sapiens
agaagccatcacctcagatg

SEQ ID NO: 5559382 - DNA, 22 bp, Homo sapiens
agaagccatcacctcagatggc

SEQ ID NO: 5559383 - DNA, 22 bp, Homo sapiens
agaagccatggaaaaacttcct

SEQ ID NO: 5559384 - DNA, 14 bp, Homo sapiens
agaagccatgggac

SEQ ID NO: 5559385 - DNA, 11 bp, Homo sapiens
agaagccattg

SEQ ID NO: 5559386 - DNA, 20 bp, Homo sapiens
agaagccattgtcttcggaa

SEQ ID NO: 5559387 - DNA, 22 bp, Homo sapiens
agaagcccaaattcatataaaa

SEQ ID NO: 5559388 - DNA, 11 bp, Homo sapiens
agaagcccaga

SEQ ID NO: 5559389 - DNA, 16 bp, Homo sapiens
agaagcccaggaaagg

SEQ ID NO: 5559390 - DNA, 20 bp, Homo sapiens
agaagcccaggaaaggctcc

SEQ ID NO: 5559391 - DNA, 16 bp, Homo sapiens
agaagcccatgtcttc

SEQ ID NO: 5559392 - DNA, 17 bp, Homo sapiens
agaagcccatgtcttct

SEQ ID NO: 5559393 - DNA, 20 bp, Homo sapiens
agaagcccatgtcttctgct

SEQ ID NO: 5559394 - DNA, 22 bp, Homo sapiens
agaagcccatgtcttctgctgt

SEQ ID NO: 5559395 - DNA, 17 bp, Homo sapiens
agaagccccacagcctg

SEQ ID NO: 5559396 - DNA, 17 bp, Homo sapiens
agaagcccccagctaag

SEQ ID NO: 5559397 - DNA, 15 bp, Homo sapiens
agaagccccgacaca

SEQ ID NO: 5559398 - DNA, 15 bp, Homo sapiens
agaagccccttcccc

SEQ ID NO: 5559399 - DNA, 18 bp, Homo sapiens
agaagcccggctcctggt

SEQ ID NO: 5559400 - DNA, 17 bp, Homo sapiens
agaagccctccttgcca

SEQ ID NO: 5559401 - DNA, 19 bp, Homo sapiens
agaagccctgctgggccca

SEQ ID NO: 5559402 - DNA, 17 bp, Homo sapiens
agaagccctgttctcgt

SEQ ID NO: 5559403 - DNA, 21 bp, Homo sapiens
agaagccgagagccttttgtg

SEQ ID NO: 5559404 - DNA, 16 bp, Homo sapiens
agaagccggctcttca

SEQ ID NO: 5559405 - DNA, 17 bp, Homo sapiens
agaagcctaattgtcac

SEQ ID NO: 5559406 - DNA, 15 bp, Homo sapiens
agaagcctagaaaag

SEQ ID NO: 5559407 - DNA, 22 bp, Homo sapiens
agaagcctagtgtgtgtgcttt

SEQ ID NO: 5559408 - DNA, 15 bp, Homo sapiens
agaagcctattgtaa

SEQ ID NO: 5559409 - DNA, 20 bp, Homo sapiens
agaagcctccaagcacagag

SEQ ID NO: 5559410 - DNA, 15 bp, Homo sapiens
agaagcctccccagc

SEQ ID NO: 5559411 - DNA, 12 bp, Homo sapiens
agaagcctcctg

SEQ ID NO: 5559412 - DNA, 19 bp, Homo sapiens
agaagcctccttacattaa

SEQ ID NO: 5559413 - DNA, 20 bp, Homo sapiens
agaagcctccttacattaaa

SEQ ID NO: 5559414 - DNA, 21 bp, Homo sapiens
agaagcctccttacattaaaa

SEQ ID NO: 5559415 - DNA, 14 bp, Homo sapiens
agaagcctctggct

SEQ ID NO: 5559416 - DNA, 22 bp, Homo sapiens
agaagcctctgggtcagtggtc

SEQ ID NO: 5559417 - DNA, 13 bp, Homo sapiens
agaagcctgatct

SEQ ID NO: 5559418 - DNA, 17 bp, Homo sapiens
agaagcctgatgctgac

SEQ ID NO: 5559419 - DNA, 19 bp, Homo sapiens
agaagcctgggggcctggc

SEQ ID NO: 5559420 - DNA, 20 bp, Homo sapiens
agaagcctgggggcctggct

SEQ ID NO: 5559421 - DNA, 14 bp, Homo sapiens
agaagcctgggtgg

SEQ ID NO: 5559422 - DNA, 20 bp, Homo sapiens
agaagcctgtaacactcctc

SEQ ID NO: 5559423 - DNA, 14 bp, Homo sapiens
agaagcctgtttca

SEQ ID NO: 5559424 - DNA, 21 bp, Homo sapiens
agaagccttaatttgcacagt

SEQ ID NO: 5559425 - DNA, 17 bp, Homo sapiens
agaagccttcaagctct

SEQ ID NO: 5559426 - DNA, 19 bp, Homo sapiens
agaagccttcaagctctga

SEQ ID NO: 5559427 - DNA, 20 bp, Homo sapiens
agaagccttcaagctctgag

SEQ ID NO: 5559428 - DNA, 21 bp, Homo sapiens
agaagccttcaagctctgagg

SEQ ID NO: 5559429 - DNA, 17 bp, Homo sapiens
agaagccttcagctcca

SEQ ID NO: 5559430 - DNA, 18 bp, Homo sapiens
agaagccttcagctccag

SEQ ID NO: 5559431 - DNA, 12 bp, Homo sapiens
agaagccttctt

SEQ ID NO: 5559432 - DNA, 18 bp, Homo sapiens
agaagccttcttgctgcc

SEQ ID NO: 5559433 - DNA, 21 bp, Homo sapiens
agaagccttctttttctgaga

SEQ ID NO: 5559434 - DNA, 22 bp, Homo sapiens
agaagccttggaaccagcccca

SEQ ID NO: 5559435 - DNA, 15 bp, Homo sapiens
agaagcggctggcag

SEQ ID NO: 5559436 - DNA, 16 bp, Homo sapiens
agaagcggctggcagc

SEQ ID NO: 5559437 - DNA, 19 bp, Homo sapiens
agaagcggtttccaggcca

SEQ ID NO: 5559438 - DNA, 16 bp, Homo sapiens
agaagcgtttttaacc

SEQ ID NO: 5559439 - DNA, 18 bp, Homo sapiens
agaagctaaggtttagat

SEQ ID NO: 5559440 - DNA, 23 bp, Homo sapiens
agaagctaatgtaggactgtata

SEQ ID NO: 5559441 - DNA, 19 bp, Homo sapiens
agaagctagatgcccctgc

SEQ ID NO: 5559442 - DNA, 23 bp, Homo sapiens
agaagctatattagctgaaacaa

SEQ ID NO: 5559443 - DNA, 18 bp, Homo sapiens
agaagctatgtttttaaa

SEQ ID NO: 5559444 - DNA, 13 bp, Homo sapiens
agaagctcagctg

SEQ ID NO: 5559445 - DNA, 17 bp, Homo sapiens
agaagctcagctgcatt

SEQ ID NO: 5559446 - DNA, 18 bp, Homo sapiens
agaagctcagctgcattc

SEQ ID NO: 5559447 - DNA, 18 bp, Homo sapiens
agaagctcaggttccctg

SEQ ID NO: 5559448 - DNA, 22 bp, Homo sapiens
agaagctcaggttccctgccac

SEQ ID NO: 5559449 - DNA, 21 bp, Homo sapiens
agaagctcccagatgctgggg

SEQ ID NO: 5559450 - DNA, 17 bp, Homo sapiens
agaagctcccaggaaca

SEQ ID NO: 5559451 - DNA, 20 bp, Homo sapiens
agaagctcctctccccagcc

SEQ ID NO: 5559452 - DNA, 19 bp, Homo sapiens
agaagctcctgaatccctt

SEQ ID NO: 5559453 - DNA, 13 bp, Homo sapiens
agaagctcctgct

SEQ ID NO: 5559454 - DNA, 16 bp, Homo sapiens
agaagctcctgctact

SEQ ID NO: 5559455 - DNA, 18 bp, Homo sapiens
agaagctcctgctacttc

SEQ ID NO: 5559456 - DNA, 17 bp, Homo sapiens
agaagctcgccccacct

SEQ ID NO: 5559457 - DNA, 18 bp, Homo sapiens
agaagctctgattttgct

SEQ ID NO: 5559458 - DNA, 23 bp, Homo sapiens
agaagctctgtttataaaaacaa

SEQ ID NO: 5559459 - DNA, 23 bp, Homo sapiens
agaagctcttggacaacagctct

SEQ ID NO: 5559460 - DNA, 13 bp, Homo sapiens
agaagctgatgag

SEQ ID NO: 5559461 - DNA, 23 bp, Homo sapiens
agaagctgccaggtgagaaactg

SEQ ID NO: 5559462 - DNA, 11 bp, Homo sapiens
agaagctgctc

SEQ ID NO: 5559463 - DNA, 13 bp, Homo sapiens
agaagctgctcaa

SEQ ID NO: 5559464 - DNA, 23 bp, Homo sapiens
agaagctgctcaacttgcaaaat

SEQ ID NO: 5559465 - DNA, 22 bp, Homo sapiens
agaagctgctccaggcctgcag

SEQ ID NO: 5559466 - DNA, 17 bp, Homo sapiens
agaagctgctctggaat

SEQ ID NO: 5559467 - DNA, 14 bp, Homo sapiens
agaagctgctgacc

SEQ ID NO: 5559468 - DNA, 16 bp, Homo sapiens
agaagctgctgaccaa

SEQ ID NO: 5559469 - DNA, 17 bp, Homo sapiens
agaagctgggagggagg

SEQ ID NO: 5559470 - DNA, 14 bp, Homo sapiens
agaagctgttgtac

SEQ ID NO: 5559471 - DNA, 15 bp, Homo sapiens
agaagcttaggcagg

SEQ ID NO: 5559472 - DNA, 13 bp, Homo sapiens
agaagcttcagca

SEQ ID NO: 5559473 - DNA, 19 bp, Homo sapiens
agaagcttccacaaaatta

SEQ ID NO: 5559474 - DNA, 12 bp, Homo sapiens
agaagcttctaa

SEQ ID NO: 5559475 - DNA, 19 bp, Homo sapiens
agaagcttcttgctcctgt

SEQ ID NO: 5559476 - DNA, 14 bp, Homo sapiens
agaagcttggagga

SEQ ID NO: 5559477 - DNA, 23 bp, Homo sapiens
agaagctttagcttcattttact

SEQ ID NO: 5559478 - DNA, 16 bp, Homo sapiens
agaagctttatttcta

SEQ ID NO: 5559479 - DNA, 22 bp, Homo sapiens
agaagcttttgaataaaaactt

SEQ ID NO: 5559480 - DNA, 18 bp, Homo sapiens
agaaggaaaaaaggagga

SEQ ID NO: 5559481 - DNA, 22 bp, Homo sapiens
agaaggaaaaatttgaagtatt

SEQ ID NO: 5559482 - DNA, 23 bp, Homo sapiens
agaaggaaaacatgctgctctgg

SEQ ID NO: 5559483 - DNA, 16 bp, Homo sapiens
agaaggaaaaggcagg

SEQ ID NO: 5559484 - DNA, 16 bp, Homo sapiens
agaaggaaaaggctgg

SEQ ID NO: 5559485 - DNA, 18 bp, Homo sapiens
agaaggaaaaggctggca

SEQ ID NO: 5559486 - DNA, 21 bp, Homo sapiens
agaaggaaaaggctggcaagg

SEQ ID NO: 5559487 - DNA, 13 bp, Homo sapiens
agaaggaaagcat

SEQ ID NO: 5559488 - DNA, 11 bp, Homo sapiens
agaaggaaatg

SEQ ID NO: 5559489 - DNA, 13 bp, Homo sapiens
agaaggaaatgat

SEQ ID NO: 5559490 - DNA, 14 bp, Homo sapiens
agaaggaaatgcag

SEQ ID NO: 5559491 - DNA, 17 bp, Homo sapiens
agaaggaaattgagatt

SEQ ID NO: 5559492 - DNA, 13 bp, Homo sapiens
agaaggaactgat

SEQ ID NO: 5559493 - DNA, 14 bp, Homo sapiens
agaaggaagcaggt

SEQ ID NO: 5559494 - DNA, 20 bp, Homo sapiens
agaaggaagccctctcagat

SEQ ID NO: 5559495 - DNA, 15 bp, Homo sapiens
agaaggaaggaggca

SEQ ID NO: 5559496 - DNA, 17 bp, Homo sapiens
agaaggaaggaggcaga

SEQ ID NO: 5559497 - DNA, 20 bp, Homo sapiens
agaaggaaggcctgagcccc

SEQ ID NO: 5559498 - DNA, 19 bp, Homo sapiens
agaaggaaggttggcgggg

SEQ ID NO: 5559499 - DNA, 17 bp, Homo sapiens
agaaggaagtgaagagg

SEQ ID NO: 5559500 - DNA, 14 bp, Homo sapiens
agaaggaatcttct

SEQ ID NO: 5559501 - DNA, 22 bp, Homo sapiens
agaaggaatggtgcttggcagg

SEQ ID NO: 5559502 - DNA, 14 bp, Homo sapiens
agaaggaatgtctt

SEQ ID NO: 5559503 - DNA, 22 bp, Homo sapiens
agaaggaattctaggcatccca

SEQ ID NO: 5559504 - DNA, 15 bp, Homo sapiens
agaaggaatttgagt

SEQ ID NO: 5559505 - DNA, 16 bp, Homo sapiens
agaaggaatttgtact

SEQ ID NO: 5559506 - DNA, 20 bp, Homo sapiens
agaaggacacctccttcctc

SEQ ID NO: 5559507 - DNA, 15 bp, Homo sapiens
agaaggacattttct

SEQ ID NO: 5559508 - DNA, 20 bp, Homo sapiens
agaaggacggtgccaagggc

SEQ ID NO: 5559509 - DNA, 15 bp, Homo sapiens
agaaggagacagaat

SEQ ID NO: 5559510 - DNA, 19 bp, Homo sapiens
agaaggagagaaagtgggt

SEQ ID NO: 5559511 - DNA, 16 bp, Homo sapiens
agaaggagagggagta

SEQ ID NO: 5559512 - DNA, 13 bp, Homo sapiens
agaaggagatgaa

SEQ ID NO: 5559513 - DNA, 22 bp, Homo sapiens
agaaggagatgaatagaagaaa

SEQ ID NO: 5559514 - DNA, 22 bp, Homo sapiens
agaaggagatgtaatgacagag

SEQ ID NO: 5559515 - DNA, 21 bp, Homo sapiens
agaaggagcagaataaatgtt

SEQ ID NO: 5559516 - DNA, 19 bp, Homo sapiens
agaaggagctcaactaaaa

SEQ ID NO: 5559517 - DNA, 14 bp, Homo sapiens
agaaggaggaaccc

SEQ ID NO: 5559518 - DNA, 17 bp, Homo sapiens
agaaggaggaagggact

SEQ ID NO: 5559519 - DNA, 19 bp, Homo sapiens
agaaggaggaagggactgg

SEQ ID NO: 5559520 - DNA, 18 bp, Homo sapiens
agaaggaggagagggaaa

SEQ ID NO: 5559521 - DNA, 22 bp, Homo sapiens
agaaggaggagagggaaaatgt

SEQ ID NO: 5559522 - DNA, 16 bp, Homo sapiens
agaaggaggatggctt

SEQ ID NO: 5559523 - DNA, 12 bp, Homo sapiens
agaaggagggca

SEQ ID NO: 5559524 - DNA, 17 bp, Homo sapiens
agaaggagggcagagcc

SEQ ID NO: 5559525 - DNA, 18 bp, Homo sapiens
agaaggagggcagagcca

SEQ ID NO: 5559526 - DNA, 19 bp, Homo sapiens
agaaggagggcagagccat

SEQ ID NO: 5559527 - DNA, 19 bp, Homo sapiens
agaaggagggttgtgccca

SEQ ID NO: 5559528 - DNA, 22 bp, Homo sapiens
agaaggaggtaaaggatgaggg

SEQ ID NO: 5559529 - DNA, 14 bp, Homo sapiens
agaaggatacaagg

SEQ ID NO: 5559530 - DNA, 19 bp, Homo sapiens
agaaggatagcctcagcca

SEQ ID NO: 5559531 - DNA, 14 bp, Homo sapiens
agaaggatgaatga

SEQ ID NO: 5559532 - DNA, 19 bp, Homo sapiens
agaaggatgggtcccctcc

SEQ ID NO: 5559533 - DNA, 16 bp, Homo sapiens
agaaggcaaaaatagt

SEQ ID NO: 5559534 - DNA, 15 bp, Homo sapiens
agaaggcaaaaatgt

SEQ ID NO: 5559535 - DNA, 20 bp, Homo sapiens
agaaggcaaatgactttgga

SEQ ID NO: 5559536 - DNA, 17 bp, Homo sapiens
agaaggcaacttgaaga

SEQ ID NO: 5559537 - DNA, 20 bp, Homo sapiens
agaaggcaacttgaagaaac

SEQ ID NO: 5559538 - DNA, 21 bp, Homo sapiens
agaaggcaacttgaagaaacg

SEQ ID NO: 5559539 - DNA, 13 bp, Homo sapiens
agaaggcaaggct

SEQ ID NO: 5559540 - DNA, 22 bp, Homo sapiens
agaaggcacaggtgtaaatata

SEQ ID NO: 5559541 - DNA, 15 bp, Homo sapiens
agaaggcactgggaa

SEQ ID NO: 5559542 - DNA, 20 bp, Homo sapiens
agaaggcagcaaagaggggc

SEQ ID NO: 5559543 - DNA, 21 bp, Homo sapiens
agaaggcagcaaagaggggcg

SEQ ID NO: 5559544 - DNA, 16 bp, Homo sapiens
agaaggcagcctaggc

SEQ ID NO: 5559545 - DNA, 16 bp, Homo sapiens
agaaggcagggaatgc

SEQ ID NO: 5559546 - DNA, 21 bp, Homo sapiens
agaaggcagggaatgcctgga

SEQ ID NO: 5559547 - DNA, 23 bp, Homo sapiens
agaaggcagggaatgcctggagg

SEQ ID NO: 5559548 - DNA, 16 bp, Homo sapiens
agaaggcatgagaaag

SEQ ID NO: 5559549 - DNA, 23 bp, Homo sapiens
agaaggcattggcatctgctttt

SEQ ID NO: 5559550 - DNA, 18 bp, Homo sapiens
agaaggcatttgcagggt

SEQ ID NO: 5559551 - DNA, 13 bp, Homo sapiens
agaaggccaagag

SEQ ID NO: 5559552 - DNA, 15 bp, Homo sapiens
agaatacaatgggaa

SEQ ID NO: 5559553 - DNA, 13 bp, Homo sapiens
agaatacaattca

SEQ ID NO: 5559554 - DNA, 15 bp, Homo sapiens
agaatacaattcagt

SEQ ID NO: 5559555 - DNA, 19 bp, Homo sapiens
agaatacaattcagtttta

SEQ ID NO: 5559556 - DNA, 15 bp, Homo sapiens
agaatacacatataa

SEQ ID NO: 5559557 - DNA, 17 bp, Homo sapiens
agaatacacatataaaa

SEQ ID NO: 5559558 - DNA, 14 bp, Homo sapiens
agaatacagaaaat

SEQ ID NO: 5559559 - DNA, 12 bp, Homo sapiens
agaatacatcag

SEQ ID NO: 5559560 - DNA, 13 bp, Homo sapiens
agaatacatcaga

SEQ ID NO: 5559561 - DNA, 14 bp, Homo sapiens
agaatacatcagaa

SEQ ID NO: 5559562 - DNA, 21 bp, Homo sapiens
agaatacattttatatctgga

SEQ ID NO: 5559563 - DNA, 16 bp, Homo sapiens
agaataccacatcaaa

SEQ ID NO: 5559564 - DNA, 18 bp, Homo sapiens
agaataccacatcaaata

SEQ ID NO: 5559565 - DNA, 17 bp, Homo sapiens
agaataccccaccagca

SEQ ID NO: 5559566 - DNA, 18 bp, Homo sapiens
agaataccccaccagcag

SEQ ID NO: 5559567 - DNA, 14 bp, Homo sapiens
agaatactgatgga

SEQ ID NO: 5559568 - DNA, 21 bp, Homo sapiens
agaatactgatggaatttttt

SEQ ID NO: 5559569 - DNA, 22 bp, Homo sapiens
agaatactgccaaaacatttat

SEQ ID NO: 5559570 - DNA, 20 bp, Homo sapiens
agaatactgttaaaggaaaa

SEQ ID NO: 5559571 - DNA, 15 bp, Homo sapiens
agaatacttgaactt

SEQ ID NO: 5559572 - DNA, 15 bp, Homo sapiens
agaatacttgcactc

SEQ ID NO: 5559573 - DNA, 16 bp, Homo sapiens
agaatacttgcactct

SEQ ID NO: 5559574 - DNA, 20 bp, Homo sapiens
agaatactttgcttcatagt

SEQ ID NO: 5559575 - DNA, 10 bp, Homo sapiens
agaatagaaa

SEQ ID NO: 5559576 - DNA, 14 bp, Homo sapiens
agaatagaaacgta

SEQ ID NO: 5559577 - DNA, 13 bp, Homo sapiens
agaatagaaagaa

SEQ ID NO: 5559578 - DNA, 14 bp, Homo sapiens
agaatagaaatttg

SEQ ID NO: 5559579 - DNA, 16 bp, Homo sapiens
agaatagaaatttgcc

SEQ ID NO: 5559580 - DNA, 17 bp, Homo sapiens
agaatagaaatttgccc

SEQ ID NO: 5559581 - DNA, 19 bp, Homo sapiens
agaatagaacaacatatac

SEQ ID NO: 5559582 - DNA, 12 bp, Homo sapiens
agaatagaactt

SEQ ID NO: 5559583 - DNA, 20 bp, Homo sapiens
agaatagaaggaaactagct

SEQ ID NO: 5559584 - DNA, 13 bp, Homo sapiens
agaatagactgga

SEQ ID NO: 5559585 - DNA, 18 bp, Homo sapiens
agaatagatcagtatttc

SEQ ID NO: 5559586 - DNA, 23 bp, Homo sapiens
agaatagatctgatggtgagctg

SEQ ID NO: 5559587 - DNA, 18 bp, Homo sapiens
agaatagcagagagccaa

SEQ ID NO: 5559588 - DNA, 13 bp, Homo sapiens
agaatagcatctg

SEQ ID NO: 5559589 - DNA, 21 bp, Homo sapiens
agaatagcatctgtacaaagg

SEQ ID NO: 5559590 - DNA, 19 bp, Homo sapiens
agaatagccacatttggaa

SEQ ID NO: 5559591 - DNA, 21 bp, Homo sapiens
agaatagccacatttggaata

SEQ ID NO: 5559592 - DNA, 13 bp, Homo sapiens
agaatagctgttt

SEQ ID NO: 5559593 - DNA, 23 bp, Homo sapiens
agaatagctgttttgtgtatatt

SEQ ID NO: 5559594 - DNA, 12 bp, Homo sapiens
agaataggaaaa

SEQ ID NO: 5559595 - DNA, 15 bp, Homo sapiens
agaataggacttgtt

SEQ ID NO: 5559596 - DNA, 17 bp, Homo sapiens
agaataggcaaactttt

SEQ ID NO: 5559597 - DNA, 20 bp, Homo sapiens
agaataggcactttaaaaca

SEQ ID NO: 5559598 - DNA, 22 bp, Homo sapiens
agaataggcactttaaaacact

SEQ ID NO: 5559599 - DNA, 18 bp, Homo sapiens
agaataggcattaacaca

SEQ ID NO: 5559600 - DNA, 23 bp, Homo sapiens
agaatagggcccatgggagggag

SEQ ID NO: 5559601 - DNA, 17 bp, Homo sapiens
agaataggtcattttct

SEQ ID NO: 5559602 - DNA, 21 bp, Homo sapiens
agaatagtcatacctggaatg

SEQ ID NO: 5559603 - DNA, 14 bp, Homo sapiens
agaatagtgtctga

SEQ ID NO: 5559604 - DNA, 21 bp, Homo sapiens
agaatagttgaacctatttct

SEQ ID NO: 5559605 - DNA, 15 bp, Homo sapiens
agaatagttgtcaga

SEQ ID NO: 5559606 - DNA, 16 bp, Homo sapiens
agaatataaaaaactt

SEQ ID NO: 5559607 - DNA, 13 bp, Homo sapiens
agaatataaagtt

SEQ ID NO: 5559608 - DNA, 13 bp, Homo sapiens
agaatataacatg

SEQ ID NO: 5559609 - DNA, 16 bp, Homo sapiens
agaatataacatgaaa

SEQ ID NO: 5559610 - DNA, 22 bp, Homo sapiens
agaatataacatgaaatgatag

SEQ ID NO: 5559611 - DNA, 13 bp, Homo sapiens
agaatataatact

SEQ ID NO: 5559612 - DNA, 21 bp, Homo sapiens
agaatataatatttgaagcag

SEQ ID NO: 5559613 - DNA, 21 bp, Homo sapiens
agaatatactgtcttgtctca

SEQ ID NO: 5559614 - DNA, 19 bp, Homo sapiens
agaatatagaagcatttga

SEQ ID NO: 5559615 - DNA, 20 bp, Homo sapiens
agaatatagcatctttcata

SEQ ID NO: 5559616 - DNA, 21 bp, Homo sapiens
agaatatagcatctttcatat

SEQ ID NO: 5559617 - DNA, 14 bp, Homo sapiens
agaatataggtctc

SEQ ID NO: 5559618 - DNA, 14 bp, Homo sapiens
agaatatataaacg

SEQ ID NO: 5559619 - DNA, 22 bp, Homo sapiens
agaatatataaacgatatatgt

SEQ ID NO: 5559620 - DNA, 15 bp, Homo sapiens
agaatatatgctttt

SEQ ID NO: 5559621 - DNA, 16 bp, Homo sapiens
agaatatattgccaaa

SEQ ID NO: 5559622 - DNA, 20 bp, Homo sapiens
agaatatatttatttaaagc

SEQ ID NO: 5559623 - DNA, 23 bp, Homo sapiens
agaatatatttatttaaagcatt

SEQ ID NO: 5559624 - DNA, 16 bp, Homo sapiens
agaatatatttttgat

SEQ ID NO: 5559625 - DNA, 12 bp, Homo sapiens
agaatatcaaat

SEQ ID NO: 5559626 - DNA, 18 bp, Homo sapiens
agaatatcaaataataaa

SEQ ID NO: 5559627 - DNA, 16 bp, Homo sapiens
agaatatcacagaaaa

SEQ ID NO: 5559628 - DNA, 19 bp, Homo sapiens
agaatatcctatactggtt

SEQ ID NO: 5559629 - DNA, 18 bp, Homo sapiens
agaatatcgatataaatt

SEQ ID NO: 5559630 - DNA, 11 bp, Homo sapiens
agaatatctgg

SEQ ID NO: 5559631 - DNA, 21 bp, Homo sapiens
agaatatgacaatctaccaac

SEQ ID NO: 5559632 - DNA, 21 bp, Homo sapiens
agaatatgacctaaatccatt

SEQ ID NO: 5559633 - DNA, 13 bp, Homo sapiens
agaatatgataaa

SEQ ID NO: 5559634 - DNA, 20 bp, Homo sapiens
agaatatgcatcttaaaatg

SEQ ID NO: 5559635 - DNA, 18 bp, Homo sapiens
agaatatggacttaaatg

SEQ ID NO: 5559636 - DNA, 16 bp, Homo sapiens
agaatatggaggctgg

SEQ ID NO: 5559637 - DNA, 13 bp, Homo sapiens
agaatatgtaata

SEQ ID NO: 5559638 - DNA, 23 bp, Homo sapiens
agaatatgttgatttttatcagg

SEQ ID NO: 5559639 - DNA, 19 bp, Homo sapiens
agaatatgttgctttgaaa

SEQ ID NO: 5559640 - DNA, 13 bp, Homo sapiens
agaatatgtttca

SEQ ID NO: 5559641 - DNA, 21 bp, Homo sapiens
agaatatgtttcaaactttgg

SEQ ID NO: 5559642 - DNA, 13 bp, Homo sapiens
agaatatgtttcc

SEQ ID NO: 5559643 - DNA, 15 bp, Homo sapiens
agaatattaaatatt

SEQ ID NO: 5559644 - DNA, 15 bp, Homo sapiens
agaatattaagcaca

SEQ ID NO: 5559645 - DNA, 16 bp, Homo sapiens
agaatattaagcacat

SEQ ID NO: 5559646 - DNA, 16 bp, Homo sapiens
agaatattaatacaat

SEQ ID NO: 5559647 - DNA, 21 bp, Homo sapiens
agaatattagctttactgttt

SEQ ID NO: 5559648 - DNA, 23 bp, Homo sapiens
agaatattagctttactgtttgt

SEQ ID NO: 5559649 - DNA, 17 bp, Homo sapiens
agaatattcaaaattcc

SEQ ID NO: 5559650 - DNA, 14 bp, Homo sapiens
agaatattcaaatg

SEQ ID NO: 5559651 - DNA, 14 bp, Homo sapiens
agaatattcagaca

SEQ ID NO: 5559652 - DNA, 18 bp, Homo sapiens
agaatattcagagaatat

SEQ ID NO: 5559653 - DNA, 18 bp, Homo sapiens
agaatattcctacttgca

SEQ ID NO: 5559654 - DNA, 13 bp, Homo sapiens
agaatattgcaaa

SEQ ID NO: 5559655 - DNA, 18 bp, Homo sapiens
agaatattgcaaaataca

SEQ ID NO: 5559656 - DNA, 19 bp, Homo sapiens
agaatattgcaaaatacat

SEQ ID NO: 5559657 - DNA, 22 bp, Homo sapiens
agaatattgcaaaatacatgaa

SEQ ID NO: 5559658 - DNA, 19 bp, Homo sapiens
agaatattgtaactcacat

SEQ ID NO: 5559659 - DNA, 16 bp, Homo sapiens
agaatattgtattgtt

SEQ ID NO: 5559660 - DNA, 12 bp, Homo sapiens
agaatattgtcc

SEQ ID NO: 5559661 - DNA, 18 bp, Homo sapiens
agaatattgttaaaacct

SEQ ID NO: 5559662 - DNA, 21 bp, Homo sapiens
agaatattgttcctaagttct

SEQ ID NO: 5559663 - DNA, 15 bp, Homo sapiens
agaatatttaagaaa

SEQ ID NO: 5559664 - DNA, 15 bp, Homo sapiens
agaatatttcaaatg

SEQ ID NO: 5559665 - DNA, 17 bp, Homo sapiens
agaatatttctattgaa

SEQ ID NO: 5559666 - DNA, 19 bp, Homo sapiens
agaatatttggttttcctg

SEQ ID NO: 5559667 - DNA, 19 bp, Homo sapiens
agaatattttaagtattgc

SEQ ID NO: 5559668 - DNA, 20 bp, Homo sapiens
agaatattttaagtattgca

SEQ ID NO: 5559669 - DNA, 21 bp, Homo sapiens
agaatatttttatatttcctt

SEQ ID NO: 5559670 - DNA, 14 bp, Homo sapiens
agaatatttttccc

SEQ ID NO: 5559671 - DNA, 22 bp, Homo sapiens
agaatatttttggcattcctct

SEQ ID NO: 5559672 - DNA, 13 bp, Homo sapiens
agaatcaaatact

SEQ ID NO: 5559673 - DNA, 16 bp, Homo sapiens
agaatcaacagatgat

SEQ ID NO: 5559674 - DNA, 23 bp, Homo sapiens
agaatcaacatttctcaataatt

SEQ ID NO: 5559675 - DNA, 23 bp, Homo sapiens
agaatcaactaggtatttaagac

SEQ ID NO: 5559676 - DNA, 14 bp, Homo sapiens
agaatcaagtctgt

SEQ ID NO: 5559677 - DNA, 16 bp, Homo sapiens
agaatcaatttaagtg

SEQ ID NO: 5559678 - DNA, 16 bp, Homo sapiens
agaatcacaggctggg

SEQ ID NO: 5559679 - DNA, 19 bp, Homo sapiens
agaatcacctaattaattt

SEQ ID NO: 5559680 - DNA, 22 bp, Homo sapiens
agaatcactgcacttagctgtt

SEQ ID NO: 5559681 - DNA, 18 bp, Homo sapiens
agaatcactgctccaggc

SEQ ID NO: 5559682 - DNA, 17 bp, Homo sapiens
agaatcacttaagcctg

SEQ ID NO: 5559683 - DNA, 19 bp, Homo sapiens
agaatcacttaagcctgga

SEQ ID NO: 5559684 - DNA, 21 bp, Homo sapiens
agaatcacttaagcctggaag

SEQ ID NO: 5559685 - DNA, 11 bp, Homo sapiens
agaatcagaat

SEQ ID NO: 5559686 - DNA, 20 bp, Homo sapiens
agaatcagaatcatggagaa

SEQ ID NO: 5559687 - DNA, 13 bp, Homo sapiens
agaatcagagaag

SEQ ID NO: 5559688 - DNA, 17 bp, Homo sapiens
agaatcaggagagggat

SEQ ID NO: 5559689 - DNA, 21 bp, Homo sapiens
agaatcagggcaggcttgcca

SEQ ID NO: 5559690 - DNA, 16 bp, Homo sapiens
agaatcagtaggacca

SEQ ID NO: 5559691 - DNA, 18 bp, Homo sapiens
agaatcagtaggaccagg

SEQ ID NO: 5559692 - DNA, 15 bp, Homo sapiens
agaatcataattttc

SEQ ID NO: 5559693 - DNA, 18 bp, Homo sapiens
agaatcatagtgccatag

SEQ ID NO: 5559694 - DNA, 20 bp, Homo sapiens
agaatcatgctgttctcttt

SEQ ID NO: 5559695 - DNA, 13 bp, Homo sapiens
agaatcatggaga

SEQ ID NO: 5559696 - DNA, 15 bp, Homo sapiens
agaatcatggagaaa

SEQ ID NO: 5559697 - DNA, 17 bp, Homo sapiens
agaatcatggatttatt

SEQ ID NO: 5559698 - DNA, 21 bp, Homo sapiens
agaatcatggatttatttttt

SEQ ID NO: 5559699 - DNA, 16 bp, Homo sapiens
agaatcatgtattttg

SEQ ID NO: 5559700 - DNA, 20 bp, Homo sapiens
agaatcatgtattttgtaaa

SEQ ID NO: 5559701 - DNA, 13 bp, Homo sapiens
agaatcatgtttc

SEQ ID NO: 5559702 - DNA, 13 bp, Homo sapiens
agaatcattacct

SEQ ID NO: 5559703 - DNA, 14 bp, Homo sapiens
agaatcattgctta

SEQ ID NO: 5559704 - DNA, 17 bp, Homo sapiens
agaatcattgtgcttaa

SEQ ID NO: 5559705 - DNA, 16 bp, Homo sapiens
agaatccaaacttgga

SEQ ID NO: 5559706 - DNA, 14 bp, Homo sapiens
agaatccaaagtgg

SEQ ID NO: 5559707 - DNA, 21 bp, Homo sapiens
agaatccaagacaaactaaac

SEQ ID NO: 5559708 - DNA, 22 bp, Homo sapiens
agaatccaagacaaactaaact

SEQ ID NO: 5559709 - DNA, 15 bp, Homo sapiens
agaatccaatactgc

SEQ ID NO: 5559710 - DNA, 14 bp, Homo sapiens
agaatccacaagga

SEQ ID NO: 5559711 - DNA, 23 bp, Homo sapiens
agaatccacacatatatatccta

SEQ ID NO: 5559712 - DNA, 20 bp, Homo sapiens
agaatccacgtattcccctt

SEQ ID NO: 5559713 - DNA, 20 bp, Homo sapiens
agaatccagcaccggcccca

SEQ ID NO: 5559714 - DNA, 19 bp, Homo sapiens
agaatccataaatgtgttc

SEQ ID NO: 5559715 - DNA, 20 bp, Homo sapiens
agaatccataaatgtgttcc

SEQ ID NO: 5559716 - DNA, 19 bp, Homo sapiens
agaatcccaaatttgattg

SEQ ID NO: 5559717 - DNA, 17 bp, Homo sapiens
agaatcccaatgtttga

SEQ ID NO: 5559718 - DNA, 16 bp, Homo sapiens
agaatcccacattagc

SEQ ID NO: 5559719 - DNA, 23 bp, Homo sapiens
agaatcccatggatgtttcttct

SEQ ID NO: 5559720 - DNA, 23 bp, Homo sapiens
agaatccccaagtgcctgctttt

SEQ ID NO: 5559721 - DNA, 15 bp, Homo sapiens
agaatcccctgggga

SEQ ID NO: 5559722 - DNA, 16 bp, Homo sapiens
agaatccctctacatg

SEQ ID NO: 5559723 - DNA, 17 bp, Homo sapiens
agaatccctgtgttaat

SEQ ID NO: 5559724 - DNA, 21 bp, Homo sapiens
agaatccctgtgttaatttaa

SEQ ID NO: 5559725 - DNA, 14 bp, Homo sapiens
agaatccctgttca

SEQ ID NO: 5559726 - DNA, 20 bp, Homo sapiens
agaatcccttaaaattacca

SEQ ID NO: 5559727 - DNA, 16 bp, Homo sapiens
agaatccgtattgaat

SEQ ID NO: 5559728 - DNA, 19 bp, Homo sapiens
agaatccgtattgaatttg

SEQ ID NO: 5559729 - DNA, 12 bp, Homo sapiens
agaatcctctcc

SEQ ID NO: 5559730 - DNA, 15 bp, Homo sapiens
agactctgtgtggct

SEQ ID NO: 5559731 - DNA, 22 bp, Homo sapiens
agactctgtgtggctgtgcaat

SEQ ID NO: 5559732 - DNA, 19 bp, Homo sapiens
agactctgtttgcttgtgt

SEQ ID NO: 5559733 - DNA, 20 bp, Homo sapiens
agactcttaagtatattgtg

SEQ ID NO: 5559734 - DNA, 12 bp, Homo sapiens
agactcttgctc

SEQ ID NO: 5559735 - DNA, 16 bp, Homo sapiens
agactcttgctcctgc

SEQ ID NO: 5559736 - DNA, 21 bp, Homo sapiens
agactcttgctcctgcttctc

SEQ ID NO: 5559737 - DNA, 17 bp, Homo sapiens
agactctttaataaatt

SEQ ID NO: 5559738 - DNA, 22 bp, Homo sapiens
agactctttatttttctctttc

SEQ ID NO: 5559739 - DNA, 23 bp, Homo sapiens
agactctttgggtccattcagat

SEQ ID NO: 5559740 - DNA, 22 bp, Homo sapiens
agactctttttgtacctggtga

SEQ ID NO: 5559741 - DNA, 21 bp, Homo sapiens
agactctttttttgagtgaca

SEQ ID NO: 5559742 - DNA, 23 bp, Homo sapiens
agactctttttttgagtgacagc

SEQ ID NO: 5559743 - DNA, 17 bp, Homo sapiens
agactgaaagaaactaa

SEQ ID NO: 5559744 - DNA, 16 bp, Homo sapiens
agactgaaagcagcag

SEQ ID NO: 5559745 - DNA, 17 bp, Homo sapiens
agactgaaagcagcagc

SEQ ID NO: 5559746 - DNA, 18 bp, Homo sapiens
agactgaaagcagcagct

SEQ ID NO: 5559747 - DNA, 21 bp, Homo sapiens
agactgaaagcagcagctagg

SEQ ID NO: 5559748 - DNA, 16 bp, Homo sapiens
agactgaactgtgtga

SEQ ID NO: 5559749 - DNA, 22 bp, Homo sapiens
agactgaattttaaatgttcac

SEQ ID NO: 5559750 - DNA, 18 bp, Homo sapiens
agactgacagacttagaa

SEQ ID NO: 5559751 - DNA, 20 bp, Homo sapiens
agactgaccttgatgagctg

SEQ ID NO: 5559752 - DNA, 23 bp, Homo sapiens
agactgaccttgatgtcttgaga

SEQ ID NO: 5559753 - DNA, 13 bp, Homo sapiens
agactgagaactt

SEQ ID NO: 5559754 - DNA, 18 bp, Homo sapiens
agactgagaacttttttg

SEQ ID NO: 5559755 - DNA, 13 bp, Homo sapiens
agactgagcagcc

SEQ ID NO: 5559756 - DNA, 20 bp, Homo sapiens
agactgagctctccaggcca

SEQ ID NO: 5559757 - DNA, 23 bp, Homo sapiens
agactgagctctccaggccaggt

SEQ ID NO: 5559758 - DNA, 14 bp, Homo sapiens
agactgagtcagat

SEQ ID NO: 5559759 - DNA, 21 bp, Homo sapiens
agactgataacttggggaggc

SEQ ID NO: 5559760 - DNA, 17 bp, Homo sapiens
agactgataattttaca

SEQ ID NO: 5559761 - DNA, 17 bp, Homo sapiens
agactgatagacaccat

SEQ ID NO: 5559762 - DNA, 13 bp, Homo sapiens
agactgatccaaa

SEQ ID NO: 5559763 - DNA, 11 bp, Homo sapiens
agactgatctc

SEQ ID NO: 5559764 - DNA, 14 bp, Homo sapiens
agactgatgagcac

SEQ ID NO: 5559765 - DNA, 17 bp, Homo sapiens
agactgatggaacagaa

SEQ ID NO: 5559766 - DNA, 20 bp, Homo sapiens
agactgatgggacatcaaat

SEQ ID NO: 5559767 - DNA, 19 bp, Homo sapiens
agactgatgttttagcatt

SEQ ID NO: 5559768 - DNA, 17 bp, Homo sapiens
agactgcaagaactgtt

SEQ ID NO: 5559769 - DNA, 21 bp, Homo sapiens
agactgcaagaggctcctgtc

SEQ ID NO: 5559770 - DNA, 13 bp, Homo sapiens
agactgcaagctg

SEQ ID NO: 5559771 - DNA, 12 bp, Homo sapiens
agactgcaatat

SEQ ID NO: 5559772 - DNA, 14 bp, Homo sapiens
agactgcaatatag

SEQ ID NO: 5559773 - DNA, 15 bp, Homo sapiens
agactgcacccagga

SEQ ID NO: 5559774 - DNA, 17 bp, Homo sapiens
agactgcacccaggagg

SEQ ID NO: 5559775 - DNA, 20 bp, Homo sapiens
agactgcacccaggagggga

SEQ ID NO: 5559776 - DNA, 22 bp, Homo sapiens
agactgcagaacccccaggtgg

SEQ ID NO: 5559777 - DNA, 18 bp, Homo sapiens
agactgcagacattctca

SEQ ID NO: 5559778 - DNA, 14 bp, Homo sapiens
agactgcagagggg

SEQ ID NO: 5559779 - DNA, 17 bp, Homo sapiens
agactgcagctgctgaa

SEQ ID NO: 5559780 - DNA, 22 bp, Homo sapiens
agactgcaggtgggctgggccc

SEQ ID NO: 5559781 - DNA, 15 bp, Homo sapiens
agactgccacaagga

SEQ ID NO: 5559782 - DNA, 11 bp, Homo sapiens
agactgccagc

SEQ ID NO: 5559783 - DNA, 13 bp, Homo sapiens
agactgccagctc

SEQ ID NO: 5559784 - DNA, 12 bp, Homo sapiens
agactgccaggt

SEQ ID NO: 5559785 - DNA, 20 bp, Homo sapiens
agactgccatattaaatttt

SEQ ID NO: 5559786 - DNA, 12 bp, Homo sapiens
agactgcccacc

SEQ ID NO: 5559787 - DNA, 13 bp, Homo sapiens
agactgcccaccc

SEQ ID NO: 5559788 - DNA, 14 bp, Homo sapiens
agactgcccaccct

SEQ ID NO: 5559789 - DNA, 19 bp, Homo sapiens
agactgcccaccctgggcc

SEQ ID NO: 5559790 - DNA, 20 bp, Homo sapiens
agactgccccacggccctgt

SEQ ID NO: 5559791 - DNA, 21 bp, Homo sapiens
agactgccccacggccctgtc

SEQ ID NO: 5559792 - DNA, 12 bp, Homo sapiens
agactgccctgc

SEQ ID NO: 5559793 - DNA, 18 bp, Homo sapiens
agactgccctgcccaggt

SEQ ID NO: 5559794 - DNA, 14 bp, Homo sapiens
agactgcccttctc

SEQ ID NO: 5559795 - DNA, 19 bp, Homo sapiens
agactgcctccctctcttc

SEQ ID NO: 5559796 - DNA, 21 bp, Homo sapiens
agactgcgccacggcactcca

SEQ ID NO: 5559797 - DNA, 23 bp, Homo sapiens
agactgcgccacggcactccagc

SEQ ID NO: 5559798 - DNA, 18 bp, Homo sapiens
agactgcggagcagcctc

SEQ ID NO: 5559799 - DNA, 16 bp, Homo sapiens
agactgctcctgagcc

SEQ ID NO: 5559800 - DNA, 21 bp, Homo sapiens
agactgctcctgagcccccag

SEQ ID NO: 5559801 - DNA, 23 bp, Homo sapiens
agactgctcctgagcccccagct

SEQ ID NO: 5559802 - DNA, 14 bp, Homo sapiens
agactgctcctggg

SEQ ID NO: 5559803 - DNA, 14 bp, Homo sapiens
agactgctgggact

SEQ ID NO: 5559804 - DNA, 20 bp, Homo sapiens
agactgctgggactggccag

SEQ ID NO: 5559805 - DNA, 19 bp, Homo sapiens
agactgcttccaattttct

SEQ ID NO: 5559806 - DNA, 14 bp, Homo sapiens
agactgcttgacaa

SEQ ID NO: 5559807 - DNA, 15 bp, Homo sapiens
agactgcttggccag

SEQ ID NO: 5559808 - DNA, 23 bp, Homo sapiens
agactggaaaagtgatgtatttt

SEQ ID NO: 5559809 - DNA, 17 bp, Homo sapiens
agactggaagcacagct

SEQ ID NO: 5559810 - DNA, 11 bp, Homo sapiens
agactggaagg

SEQ ID NO: 5559811 - DNA, 20 bp, Homo sapiens
agactggaccgctgactgca

SEQ ID NO: 5559812 - DNA, 17 bp, Homo sapiens
agactggagaaatgctt

SEQ ID NO: 5559813 - DNA, 14 bp, Homo sapiens
agactggagcatct

SEQ ID NO: 5559814 - DNA, 16 bp, Homo sapiens
agactggagcatctga

SEQ ID NO: 5559815 - DNA, 18 bp, Homo sapiens
agactggagcatctgact

SEQ ID NO: 5559816 - DNA, 22 bp, Homo sapiens
agactggaggcatttcttttta

SEQ ID NO: 5559817 - DNA, 23 bp, Homo sapiens
agactggaggggacgctggtaga

SEQ ID NO: 5559818 - DNA, 19 bp, Homo sapiens
agactggaggtcgaagcaa

SEQ ID NO: 5559819 - DNA, 23 bp, Homo sapiens
agactggagtgaggcttccaggc

SEQ ID NO: 5559820 - DNA, 15 bp, Homo sapiens
agactggatactgcc

SEQ ID NO: 5559821 - DNA, 20 bp, Homo sapiens
agactggatagtccgtctct

SEQ ID NO: 5559822 - DNA, 17 bp, Homo sapiens
agactggatttgcagaa

SEQ ID NO: 5559823 - DNA, 21 bp, Homo sapiens
agactggatttgcagaagttt

SEQ ID NO: 5559824 - DNA, 13 bp, Homo sapiens
agactggcaataa

SEQ ID NO: 5559825 - DNA, 16 bp, Homo sapiens
agactggcagccaggg

SEQ ID NO: 5559826 - DNA, 12 bp, Homo sapiens
agactggcaggc

SEQ ID NO: 5559827 - DNA, 21 bp, Homo sapiens
agactggcatggacatcagca

SEQ ID NO: 5559828 - DNA, 11 bp, Homo sapiens
agactggccca

SEQ ID NO: 5559829 - DNA, 16 bp, Homo sapiens
agactggccgggcagg

SEQ ID NO: 5559830 - DNA, 18 bp, Homo sapiens
agactggcgtgaacccag

SEQ ID NO: 5559831 - DNA, 15 bp, Homo sapiens
agactggctgcacag

SEQ ID NO: 5559832 - DNA, 16 bp, Homo sapiens
agactggctgcacagc

SEQ ID NO: 5559833 - DNA, 21 bp, Homo sapiens
agactgggaagataggctctg

SEQ ID NO: 5559834 - DNA, 22 bp, Homo sapiens
agactgggaagataggctctgc

SEQ ID NO: 5559835 - DNA, 22 bp, Homo sapiens
agactgggaaggcttgggattt

SEQ ID NO: 5559836 - DNA, 22 bp, Homo sapiens
agactgggacacctttaacaca

SEQ ID NO: 5559837 - DNA, 18 bp, Homo sapiens
agactgggagccacttct

SEQ ID NO: 5559838 - DNA, 19 bp, Homo sapiens
agactgggcacccctgcct

SEQ ID NO: 5559839 - DNA, 21 bp, Homo sapiens
agactgggcacccctgcctcc

SEQ ID NO: 5559840 - DNA, 13 bp, Homo sapiens
agactgggcccag

SEQ ID NO: 5559841 - DNA, 15 bp, Homo sapiens
agactgggcccaggc

SEQ ID NO: 5559842 - DNA, 23 bp, Homo sapiens
agactgggcccaggcaggtctgc

SEQ ID NO: 5559843 - DNA, 13 bp, Homo sapiens
agactgggcccca

SEQ ID NO: 5559844 - DNA, 17 bp, Homo sapiens
agactgggccccacatg

SEQ ID NO: 5559845 - DNA, 16 bp, Homo sapiens
agactgggctgaggga

SEQ ID NO: 5559846 - DNA, 20 bp, Homo sapiens
agactgggctgagggagcct

SEQ ID NO: 5559847 - DNA, 13 bp, Homo sapiens
agactgggctggc

SEQ ID NO: 5559848 - DNA, 18 bp, Homo sapiens
agactgggctggctgcct

SEQ ID NO: 5559849 - DNA, 19 bp, Homo sapiens
agactgggctggctgcctt

SEQ ID NO: 5559850 - DNA, 15 bp, Homo sapiens
agactgggctgtagt

SEQ ID NO: 5559851 - DNA, 21 bp, Homo sapiens
agactggtattctctttgcct

SEQ ID NO: 5559852 - DNA, 16 bp, Homo sapiens
agactggtccacaggg

SEQ ID NO: 5559853 - DNA, 17 bp, Homo sapiens
agactggtgactgattc

SEQ ID NO: 5559854 - DNA, 19 bp, Homo sapiens
agactggtgactgattctt

SEQ ID NO: 5559855 - DNA, 20 bp, Homo sapiens
agactggtgactgattcttc

SEQ ID NO: 5559856 - DNA, 23 bp, Homo sapiens
agactggtgagcagactggtggg

SEQ ID NO: 5559857 - DNA, 22 bp, Homo sapiens
agactggtttcccggtgacaca

SEQ ID NO: 5559858 - DNA, 21 bp, Homo sapiens
agactggtttgtttgcttaat

SEQ ID NO: 5559859 - DNA, 15 bp, Homo sapiens
agactggttttctgc

SEQ ID NO: 5559860 - DNA, 18 bp, Homo sapiens
agactggttttctgccaa

SEQ ID NO: 5559861 - DNA, 21 bp, Homo sapiens
agactgtaacttccaaataaa

SEQ ID NO: 5559862 - DNA, 22 bp, Homo sapiens
agactgtaacttccaaataaat

SEQ ID NO: 5559863 - DNA, 20 bp, Homo sapiens
agactgtaactttttttcag

SEQ ID NO: 5559864 - DNA, 21 bp, Homo sapiens
agactgtaactttttttcagt

SEQ ID NO: 5559865 - DNA, 15 bp, Homo sapiens
agactgtaagatgtt

SEQ ID NO: 5559866 - DNA, 19 bp, Homo sapiens
agactgtacataattgcat

SEQ ID NO: 5559867 - DNA, 19 bp, Homo sapiens
agactgtactggccagtgt

SEQ ID NO: 5559868 - DNA, 21 bp, Homo sapiens
agactgtacttattttccaat

SEQ ID NO: 5559869 - DNA, 17 bp, Homo sapiens
agactgtagatatgtat

SEQ ID NO: 5559870 - DNA, 21 bp, Homo sapiens
agactgtagcttctcttgctc

SEQ ID NO: 5559871 - DNA, 20 bp, Homo sapiens
agactgtaggaagagtagca

SEQ ID NO: 5559872 - DNA, 22 bp, Homo sapiens
agactgtaggaagagtagcatt

SEQ ID NO: 5559873 - DNA, 23 bp, Homo sapiens
agactgtatgttttaattgcatt

SEQ ID NO: 5559874 - DNA, 18 bp, Homo sapiens
agactgtcattgcccctc

SEQ ID NO: 5559875 - DNA, 20 bp, Homo sapiens
agactgtcattgcccctccg

SEQ ID NO: 5559876 - DNA, 19 bp, Homo sapiens
agactgtccacttctagct

SEQ ID NO: 5559877 - DNA, 15 bp, Homo sapiens
agactgtccagggaa

SEQ ID NO: 5559878 - DNA, 15 bp, Homo sapiens
agactgtcctgccct

SEQ ID NO: 5559879 - DNA, 24 bp, Homo sapiens
agactgtcggagaggctgtctggg

SEQ ID NO: 5559880 - DNA, 14 bp, Homo sapiens
agactgtctcaaga

SEQ ID NO: 5559881 - DNA, 18 bp, Homo sapiens
agactgtcttacctggca

SEQ ID NO: 5559882 - DNA, 21 bp, Homo sapiens
agactgtcttacctggcagca

SEQ ID NO: 5559883 - DNA, 22 bp, Homo sapiens
agactgtgaacttgactgggtg

SEQ ID NO: 5559884 - DNA, 19 bp, Homo sapiens
agactgtgacatcagaagt

SEQ ID NO: 5559885 - DNA, 18 bp, Homo sapiens
agactgtgaggcggcagc

SEQ ID NO: 5559886 - DNA, 19 bp, Homo sapiens
agactgtgccagaggccag

SEQ ID NO: 5559887 - DNA, 20 bp, Homo sapiens
agactgtgccagaggccaga

SEQ ID NO: 5559888 - DNA, 14 bp, Homo sapiens
agactgtgccatgg

SEQ ID NO: 5559889 - DNA, 15 bp, Homo sapiens
agactgtgccatggt

SEQ ID NO: 5559890 - DNA, 20 bp, Homo sapiens
agactgtgcggcacaggaaa

SEQ ID NO: 5559891 - DNA, 15 bp, Homo sapiens
agactgtgctctctg

SEQ ID NO: 5559892 - DNA, 20 bp, Homo sapiens
agactgtggctgctagcact

SEQ ID NO: 5559893 - DNA, 15 bp, Homo sapiens
agactgtggggaggg

SEQ ID NO: 5559894 - DNA, 19 bp, Homo sapiens
agactgtggggagggtcat

SEQ ID NO: 5559895 - DNA, 23 bp, Homo sapiens
agactgtgggtggggaggccctg

SEQ ID NO: 5559896 - DNA, 13 bp, Homo sapiens
agactgtggtagg

SEQ ID NO: 5559897 - DNA, 21 bp, Homo sapiens
agactgtggtaggggcaggga

SEQ ID NO: 5559898 - DNA, 16 bp, Homo sapiens
agactgtgtgtgccct

SEQ ID NO: 5559899 - DNA, 17 bp, Homo sapiens
agactgtgtgtgccctc

SEQ ID NO: 5559900 - DNA, 23 bp, Homo sapiens
agactgtgtgtgccctctgggct

SEQ ID NO: 5559901 - DNA, 15 bp, Homo sapiens
agactgttactttgg

SEQ ID NO: 5559902 - DNA, 17 bp, Homo sapiens
agactgttccctccaag

SEQ ID NO: 5559903 - DNA, 16 bp, Homo sapiens
agactgttcctgagcc

SEQ ID NO: 5559904 - DNA, 19 bp, Homo sapiens
agactgttcctgagccttc

SEQ ID NO: 5559905 - DNA, 14 bp, Homo sapiens
agactgttgagtta

SEQ ID NO: 5559906 - DNA, 12 bp, Homo sapiens
agagaaaataaa

SEQ ID NO: 5559907 - DNA, 15 bp, Homo sapiens
agagaaaataaaaag

SEQ ID NO: 5559908 - DNA, 14 bp, Homo sapiens
agagaaaatatatg

SEQ ID NO: 5559909 - DNA, 14 bp, Homo sapiens
agagaaaatgaatt

SEQ ID NO: 5559910 - DNA, 20 bp, Homo sapiens
agagaaaatgagaaaggaca

SEQ ID NO: 5559911 - DNA, 18 bp, Homo sapiens
agagaaaatgatgagttt

SEQ ID NO: 5559912 - DNA, 18 bp, Homo sapiens
agagaaaatgtaaaggag

SEQ ID NO: 5559913 - DNA, 16 bp, Homo sapiens
agagaaaatgtaaata

SEQ ID NO: 5559914 - DNA, 13 bp, Homo sapiens
agagaaaattcag

SEQ ID NO: 5559915 - DNA, 14 bp, Homo sapiens
agagaaaattgaat

SEQ ID NO: 5559916 - DNA, 15 bp, Homo sapiens
agagaaaattgcact

SEQ ID NO: 5559917 - DNA, 14 bp, Homo sapiens
agagaaaatttgaa

SEQ ID NO: 5559918 - DNA, 18 bp, Homo sapiens
agagaaacaataaagaga

SEQ ID NO: 5559919 - DNA, 16 bp, Homo sapiens
agagaaacagttggta

SEQ ID NO: 5559920 - DNA, 13 bp, Homo sapiens
agagaaaccagct

SEQ ID NO: 5559921 - DNA, 15 bp, Homo sapiens
agagaaaccagcttc

SEQ ID NO: 5559922 - DNA, 17 bp, Homo sapiens
agagaaaccagcttcct

SEQ ID NO: 5559923 - DNA, 22 bp, Homo sapiens
agagaaaccagcttccttcaga

SEQ ID NO: 5559924 - DNA, 17 bp, Homo sapiens
agagaaaccgtcctctt

SEQ ID NO: 5559925 - DNA, 21 bp, Homo sapiens
agagaaaccgtcctctttttc

SEQ ID NO: 5559926 - DNA, 14 bp, Homo sapiens
agagaaacctgcca

SEQ ID NO: 5559927 - DNA, 20 bp, Homo sapiens
agagaaacttgtaatggtct

SEQ ID NO: 5559928 - DNA, 19 bp, Homo sapiens
agagaaactttgtgctaca

SEQ ID NO: 5559929 - DNA, 16 bp, Homo sapiens
agagaaagaaaaggca

SEQ ID NO: 5559930 - DNA, 21 bp, Homo sapiens
agagaaagaaaaggcaaaaga

SEQ ID NO: 5559931 - DNA, 14 bp, Homo sapiens
agagaaagaagaga

SEQ ID NO: 5559932 - DNA, 11 bp, Homo sapiens
agagaaagaat

SEQ ID NO: 5559933 - DNA, 16 bp, Homo sapiens
agagaaagagaaatca

SEQ ID NO: 5559934 - DNA, 13 bp, Homo sapiens
agagaaagagaac

SEQ ID NO: 5559935 - DNA, 12 bp, Homo sapiens
agagaaagagag

SEQ ID NO: 5559936 - DNA, 17 bp, Homo sapiens
agagaaagagagaagcc

SEQ ID NO: 5559937 - DNA, 19 bp, Homo sapiens
agagaaagcatattgactt

SEQ ID NO: 5559938 - DNA, 16 bp, Homo sapiens
agagaaagccaggcag

SEQ ID NO: 5559939 - DNA, 22 bp, Homo sapiens
agagaaagccaggcaggtagcc

SEQ ID NO: 5559940 - DNA, 17 bp, Homo sapiens
agagaaaggcctgcaca

SEQ ID NO: 5559941 - DNA, 18 bp, Homo sapiens
agagaaagtacttctcca

SEQ ID NO: 5559942 - DNA, 18 bp, Homo sapiens
agagaaagtgatttctag

SEQ ID NO: 5559943 - DNA, 22 bp, Homo sapiens
agagaaagttggtgctgctcat

SEQ ID NO: 5559944 - DNA, 15 bp, Homo sapiens
agagaaatacagctg

SEQ ID NO: 5559945 - DNA, 22 bp, Homo sapiens
agagaaatacagctggctatct

SEQ ID NO: 5559946 - DNA, 14 bp, Homo sapiens
agagaaatatgaag

SEQ ID NO: 5559947 - DNA, 14 bp, Homo sapiens
agagaaatatttta

SEQ ID NO: 5559948 - DNA, 17 bp, Homo sapiens
agagaaatcaggcctga

SEQ ID NO: 5559949 - DNA, 11 bp, Homo sapiens
agagaaatctc

SEQ ID NO: 5559950 - DNA, 15 bp, Homo sapiens
agagaaatgaggaag

SEQ ID NO: 5559951 - DNA, 18 bp, Homo sapiens
agagaaatgccccagtgt

SEQ ID NO: 5559952 - DNA, 13 bp, Homo sapiens
agagaaatggcaa

SEQ ID NO: 5559953 - DNA, 14 bp, Homo sapiens
agagaaatgtcttt

SEQ ID NO: 5559954 - DNA, 21 bp, Homo sapiens
agagaaatttttatttttgaa

SEQ ID NO: 5559955 - DNA, 23 bp, Homo sapiens
agagaacagaaaacaacaaaaga

SEQ ID NO: 5559956 - DNA, 13 bp, Homo sapiens
agagaacaggact

SEQ ID NO: 5559957 - DNA, 14 bp, Homo sapiens
agagaacaggacta

SEQ ID NO: 5559958 - DNA, 22 bp, Homo sapiens
agagaacagtattgggcaggag

SEQ ID NO: 5559959 - DNA, 23 bp, Homo sapiens
agagaacagtattgggcaggagg

SEQ ID NO: 5559960 - DNA, 11 bp, Homo sapiens
agagaacagtt

SEQ ID NO: 5559961 - DNA, 12 bp, Homo sapiens
agagaacatttt

SEQ ID NO: 5559962 - DNA, 24 bp, Homo sapiens
agagaaccaaaccgcaaacgtgaa

SEQ ID NO: 5559963 - DNA, 23 bp, Homo sapiens
agagaaccaagcttgtctttaaa

SEQ ID NO: 5559964 - DNA, 15 bp, Homo sapiens
agagaaccaggaggg

SEQ ID NO: 5559965 - DNA, 15 bp, Homo sapiens
agagaaccatgtgct

SEQ ID NO: 5559966 - DNA, 14 bp, Homo sapiens
agagaacccagccc

SEQ ID NO: 5559967 - DNA, 15 bp, Homo sapiens
agagaaccgagcaaa

SEQ ID NO: 5559968 - DNA, 22 bp, Homo sapiens
agagaacctcaaactaggagga

SEQ ID NO: 5559969 - DNA, 14 bp, Homo sapiens
agagaacctcagat

SEQ ID NO: 5559970 - DNA, 19 bp, Homo sapiens
agagaacctttagaatatc

SEQ ID NO: 5559971 - DNA, 23 bp, Homo sapiens
agagaacgggcgtcaggggtgca

SEQ ID NO: 5559972 - DNA, 19 bp, Homo sapiens
agagaactactaaggaaaa

SEQ ID NO: 5559973 - DNA, 13 bp, Homo sapiens
agagaactagtgg

SEQ ID NO: 5559974 - DNA, 22 bp, Homo sapiens
agagaactcgcgctcagtaaac

SEQ ID NO: 5559975 - DNA, 12 bp, Homo sapiens
agagaactgaaa

SEQ ID NO: 5559976 - DNA, 16 bp, Homo sapiens
agagaactgagcatct

SEQ ID NO: 5559977 - DNA, 13 bp, Homo sapiens
agagaactgcctt

SEQ ID NO: 5559978 - DNA, 18 bp, Homo sapiens
agagaactttattttgga

SEQ ID NO: 5559979 - DNA, 20 bp, Homo sapiens
agagaactttcggagcctgc

SEQ ID NO: 5559980 - DNA, 16 bp, Homo sapiens
agagaactttttgtta

SEQ ID NO: 5559981 - DNA, 17 bp, Homo sapiens
agagaagaaagaacgga

SEQ ID NO: 5559982 - DNA, 10 bp, Homo sapiens
agagaagaag

SEQ ID NO: 5559983 - DNA, 13 bp, Homo sapiens
agagaagaagaaa

SEQ ID NO: 5559984 - DNA, 11 bp, Homo sapiens
agagaagacaa

SEQ ID NO: 5559985 - DNA, 15 bp, Homo sapiens
agagaagacaggctg

SEQ ID NO: 5559986 - DNA, 14 bp, Homo sapiens
agagaagagcccca

SEQ ID NO: 5559987 - DNA, 15 bp, Homo sapiens
agagaagagccccac

SEQ ID NO: 5559988 - DNA, 18 bp, Homo sapiens
agagaagagccccactct

SEQ ID NO: 5559989 - DNA, 17 bp, Homo sapiens
agagaagagggcccagc

SEQ ID NO: 5559990 - DNA, 20 bp, Homo sapiens
agagaagagggcccagccca

SEQ ID NO: 5559991 - DNA, 17 bp, Homo sapiens
agagaagagtccaggaa

SEQ ID NO: 5559992 - DNA, 13 bp, Homo sapiens
agagaagataatt

SEQ ID NO: 5559993 - DNA, 21 bp, Homo sapiens
agagaagataattgttgaaat

SEQ ID NO: 5559994 - DNA, 18 bp, Homo sapiens
agagaagatgcctgttaa

SEQ ID NO: 5559995 - DNA, 21 bp, Homo sapiens
agagaagcaaaatcttttttc

SEQ ID NO: 5559996 - DNA, 14 bp, Homo sapiens
agagaagcacccca

SEQ ID NO: 5559997 - DNA, 14 bp, Homo sapiens
agagaagcaggcag

SEQ ID NO: 5559998 - DNA, 15 bp, Homo sapiens
agagaagccacgctg

SEQ ID NO: 5559999 - DNA, 13 bp, Homo sapiens
agagaagccagcc

SEQ ID NO: 5560000 - DNA, 19 bp, Homo sapiens
agagaagccagccacagac

SEQ ID NO: 5560001 - DNA, 14 bp, Homo sapiens
agagaagccagctt

SEQ ID NO: 5560002 - DNA, 13 bp, Homo sapiens
agagaagccataa

SEQ ID NO: 5560003 - DNA, 22 bp, Homo sapiens
agagaagccatcacctcagatg

SEQ ID NO: 5560004 - DNA, 14 bp, Homo sapiens
agagaagccccgca

SEQ ID NO: 5560005 - DNA, 23 bp, Homo sapiens
agagaagccccttccccatggga

SEQ ID NO: 5560006 - DNA, 20 bp, Homo sapiens
agagaagcctatttttatat

SEQ ID NO: 5560007 - DNA, 22 bp, Homo sapiens
agagaagcctatttttatattt

SEQ ID NO: 5560008 - DNA, 12 bp, Homo sapiens
agagaagccttc

SEQ ID NO: 5560009 - DNA, 22 bp, Homo sapiens
agagaagccttttccataaagt

SEQ ID NO: 5560010 - DNA, 16 bp, Homo sapiens
agagaagctgagaaga

SEQ ID NO: 5560011 - DNA, 17 bp, Homo sapiens
agagaagctgagaagaa

SEQ ID NO: 5560012 - DNA, 13 bp, Homo sapiens
agagaagctgctg

SEQ ID NO: 5560013 - DNA, 14 bp, Homo sapiens
agagaagctgctga

SEQ ID NO: 5560014 - DNA, 16 bp, Homo sapiens
agagaaggaaaagact

SEQ ID NO: 5560015 - DNA, 13 bp, Homo sapiens
agagaaggaatgt

SEQ ID NO: 5560016 - DNA, 20 bp, Homo sapiens
agagaaggaatgtctttggt

SEQ ID NO: 5560017 - DNA, 14 bp, Homo sapiens
agagaaggagatca

SEQ ID NO: 5560018 - DNA, 17 bp, Homo sapiens
agagaaggagatcaggg

SEQ ID NO: 5560019 - DNA, 22 bp, Homo sapiens
agagaaggagatgtaatgacag

SEQ ID NO: 5560020 - DNA, 13 bp, Homo sapiens
agagaaggagcag

SEQ ID NO: 5560021 - DNA, 12 bp, Homo sapiens
agagaaggagcc

SEQ ID NO: 5560022 - DNA, 13 bp, Homo sapiens
agagaaggcacac

SEQ ID NO: 5560023 - DNA, 12 bp, Homo sapiens
agagaaggcagg

SEQ ID NO: 5560024 - DNA, 13 bp, Homo sapiens
agagaaggcagga

SEQ ID NO: 5560025 - DNA, 13 bp, Homo sapiens
agagaaggcctct

SEQ ID NO: 5560026 - DNA, 20 bp, Homo sapiens
agagaaggcctggtcagcag

SEQ ID NO: 5560027 - DNA, 12 bp, Homo sapiens
agagaaggcctt

SEQ ID NO: 5560028 - DNA, 15 bp, Homo sapiens
agagaaggcttcctc

SEQ ID NO: 5560029 - DNA, 13 bp, Homo sapiens
agagaagggaagc

SEQ ID NO: 5560030 - DNA, 20 bp, Homo sapiens
agagaagggagctgaggcca

SEQ ID NO: 5560031 - DNA, 19 bp, Homo sapiens
agagaaggggcccaagaga

SEQ ID NO: 5560032 - DNA, 21 bp, Homo sapiens
agagaaggggcccaagagaga

SEQ ID NO: 5560033 - DNA, 21 bp, Homo sapiens
agagaaggtagggtgtgtata

SEQ ID NO: 5560034 - DNA, 20 bp, Homo sapiens
agagaaggtggacctggcag

SEQ ID NO: 5560035 - DNA, 15 bp, Homo sapiens
agagaagtaagcaga

SEQ ID NO: 5560036 - DNA, 18 bp, Homo sapiens
agagaagtcacagggcag

SEQ ID NO: 5560037 - DNA, 19 bp, Homo sapiens
agagaagtcacagggcagt

SEQ ID NO: 5560038 - DNA, 23 bp, Homo sapiens
agagaagtcacagggcagtacct

SEQ ID NO: 5560039 - DNA, 20 bp, Homo sapiens
agagaagtcggccaggtagg

SEQ ID NO: 5560040 - DNA, 18 bp, Homo sapiens
agagaagtgacagggaag

SEQ ID NO: 5560041 - DNA, 20 bp, Homo sapiens
agagaagtgacagggaagct

SEQ ID NO: 5560042 - DNA, 18 bp, Homo sapiens
agagaagtggccagggct

SEQ ID NO: 5560043 - DNA, 23 bp, Homo sapiens
agagaagttgctgcttgtgatct

SEQ ID NO: 5560044 - DNA, 12 bp, Homo sapiens
agagaagttgta

SEQ ID NO: 5560045 - DNA, 17 bp, Homo sapiens
agagaagtttgtagcca

SEQ ID NO: 5560046 - DNA, 13 bp, Homo sapiens
agagaataaagac

SEQ ID NO: 5560047 - DNA, 13 bp, Homo sapiens
agagaataaattg

SEQ ID NO: 5560048 - DNA, 16 bp, Homo sapiens
agagaataatttctgt

SEQ ID NO: 5560049 - DNA, 15 bp, Homo sapiens
agagaatacacatat

SEQ ID NO: 5560050 - DNA, 14 bp, Homo sapiens
agagaatagagctg

SEQ ID NO: 5560051 - DNA, 21 bp, Homo sapiens
agagaatagagctgccactgg

SEQ ID NO: 5560052 - DNA, 19 bp, Homo sapiens
agagaataggggagccaag

SEQ ID NO: 5560053 - DNA, 16 bp, Homo sapiens
agagaatataacatga

SEQ ID NO: 5560054 - DNA, 17 bp, Homo sapiens
agagaatataacatgaa

SEQ ID NO: 5560055 - DNA, 18 bp, Homo sapiens
agagaatataacatgaaa

SEQ ID NO: 5560056 - DNA, 17 bp, Homo sapiens
agagaatatatttttga

SEQ ID NO: 5560057 - DNA, 15 bp, Homo sapiens
agagaatatgtctgc

SEQ ID NO: 5560058 - DNA, 23 bp, Homo sapiens
agagaatatttttggcattcctc

SEQ ID NO: 5560059 - DNA, 17 bp, Homo sapiens
agagaatcaacagatga

SEQ ID NO: 5560060 - DNA, 23 bp, Homo sapiens
agagaatcaaggccgtgtcccct

SEQ ID NO: 5560061 - DNA, 18 bp, Homo sapiens
agagaatctcttgggagt

SEQ ID NO: 5560062 - DNA, 19 bp, Homo sapiens
agagaatctgaagctattg

SEQ ID NO: 5560063 - DNA, 22 bp, Homo sapiens
agagaatctgaagctattgatg

SEQ ID NO: 5560064 - DNA, 20 bp, Homo sapiens
agagaatgaactgtggaatt

SEQ ID NO: 5560065 - DNA, 22 bp, Homo sapiens
agagaatgaactgtggaattta

SEQ ID NO: 5560066 - DNA, 14 bp, Homo sapiens
agagaatgagaaat

SEQ ID NO: 5560067 - DNA, 14 bp, Homo sapiens
agagaatgagagag

SEQ ID NO: 5560068 - DNA, 17 bp, Homo sapiens
agagaatgagagcgaca

SEQ ID NO: 5560069 - DNA, 16 bp, Homo sapiens
agagaatgattgtctt

SEQ ID NO: 5560070 - DNA, 16 bp, Homo sapiens
agagaatgctgacctg

SEQ ID NO: 5560071 - DNA, 21 bp, Homo sapiens
agagaatgggtttactctcaa

SEQ ID NO: 5560072 - DNA, 22 bp, Homo sapiens
agagaatgtattttcatagatg

SEQ ID NO: 5560073 - DNA, 16 bp, Homo sapiens
agagaatgtctgatct

SEQ ID NO: 5560074 - DNA, 15 bp, Homo sapiens
agagaatgtggaaat

SEQ ID NO: 5560075 - DNA, 20 bp, Homo sapiens
agagaatgtgtgtgtgtggc

SEQ ID NO: 5560076 - DNA, 13 bp, Homo sapiens
agagaatgttata

SEQ ID NO: 5560077 - DNA, 20 bp, Homo sapiens
agagaatgttatagtgaatt

SEQ ID NO: 5560078 - DNA, 16 bp, Homo sapiens
agagaatgttccagac

SEQ ID NO: 5560079 - DNA, 14 bp, Homo sapiens
agagaatgttccta

SEQ ID NO: 5560080 - DNA, 14 bp, Homo sapiens
agagaattacttat

SEQ ID NO: 5560081 - DNA, 17 bp, Homo sapiens
agagaattagacaaatt

SEQ ID NO: 5560082 - DNA, 16 bp, Homo sapiens
agagaattagattata

SEQ ID NO: 5560083 - DNA, 17 bp, Homo sapiens
agagaattatctcaagt

SEQ ID NO: 5560084 - DNA, 16 bp, Homo sapiens
agagaattcactttac

SEQ ID NO: 5560085 - DNA, 18 bp, Homo sapiens
agagaattcagtattttt

SEQ ID NO: 5560086 - DNA, 23 bp, Homo sapiens
agagagacttggaagaggaggag

SEQ ID NO: 5560087 - DNA, 10 bp, Homo sapiens
agagagagaa

SEQ ID NO: 5560088 - DNA, 13 bp, Homo sapiens
agagagagaaaga

SEQ ID NO: 5560089 - DNA, 14 bp, Homo sapiens
agagagagagaaag

SEQ ID NO: 5560090 - DNA, 16 bp, Homo sapiens
agagagagagagagcg

SEQ ID NO: 5560091 - DNA, 14 bp, Homo sapiens
agagagagcagggt

SEQ ID NO: 5560092 - DNA, 12 bp, Homo sapiens
agagagaggagg

SEQ ID NO: 5560093 - DNA, 13 bp, Homo sapiens
agagagaggaggc

SEQ ID NO: 5560094 - DNA, 14 bp, Homo sapiens
agagagaggaggga

SEQ ID NO: 5560095 - DNA, 14 bp, Homo sapiens
agagagaggctgcc

SEQ ID NO: 5560096 - DNA, 18 bp, Homo sapiens
agagagaggctgcctcag

SEQ ID NO: 5560097 - DNA, 14 bp, Homo sapiens
agagagaggggaag

SEQ ID NO: 5560098 - DNA, 19 bp, Homo sapiens
agagagaggttctggggag

SEQ ID NO: 5560099 - DNA, 21 bp, Homo sapiens
agagagaggttctggggagga

SEQ ID NO: 5560100 - DNA, 15 bp, Homo sapiens
agagagagtgtgtgt

SEQ ID NO: 5560101 - DNA, 21 bp, Homo sapiens
agagagatcttcccataataa

SEQ ID NO: 5560102 - DNA, 18 bp, Homo sapiens
agagagatgagaaagctt

SEQ ID NO: 5560103 - DNA, 18 bp, Homo sapiens
agagagatgggagctcct

SEQ ID NO: 5560104 - DNA, 19 bp, Homo sapiens
agagagatgtgtaattttt

SEQ ID NO: 5560105 - DNA, 16 bp, Homo sapiens
agagagattggatttt

SEQ ID NO: 5560106 - DNA, 22 bp, Homo sapiens
agagagcaagaaaaaagtacag

SEQ ID NO: 5560107 - DNA, 22 bp, Homo sapiens
agagagcaatcttgctgtgaaa

SEQ ID NO: 5560108 - DNA, 18 bp, Homo sapiens
agagagcacccctctctg

SEQ ID NO: 5560109 - DNA, 16 bp, Homo sapiens
agagagcagaaataaa

SEQ ID NO: 5560110 - DNA, 15 bp, Homo sapiens
agagagcagcgccca

SEQ ID NO: 5560111 - DNA, 20 bp, Homo sapiens
agagagcagctccctttctc

SEQ ID NO: 5560112 - DNA, 22 bp, Homo sapiens
agagagcagctccctttctcag

SEQ ID NO: 5560113 - DNA, 23 bp, Homo sapiens
agagagcagctccctttctcagg

SEQ ID NO: 5560114 - DNA, 19 bp, Homo sapiens
agagagcagcttctgccac

SEQ ID NO: 5560115 - DNA, 14 bp, Homo sapiens
agagagcagggcta

SEQ ID NO: 5560116 - DNA, 14 bp, Homo sapiens
agagagcaggggag

SEQ ID NO: 5560117 - DNA, 21 bp, Homo sapiens
agagagcaggggagcttggga

SEQ ID NO: 5560118 - DNA, 23 bp, Homo sapiens
agagagcaggggagcttgggact

SEQ ID NO: 5560119 - DNA, 20 bp, Homo sapiens
agagagcatcttttcctccc

SEQ ID NO: 5560120 - DNA, 12 bp, Homo sapiens
agagagccagga

SEQ ID NO: 5560121 - DNA, 13 bp, Homo sapiens
agagagccatttt

SEQ ID NO: 5560122 - DNA, 18 bp, Homo sapiens
agagagccattttgtgaa

SEQ ID NO: 5560123 - DNA, 19 bp, Homo sapiens
agagagccattttgtgaat

SEQ ID NO: 5560124 - DNA, 21 bp, Homo sapiens
agagagccctgggtgacttca

SEQ ID NO: 5560125 - DNA, 22 bp, Homo sapiens
agagagccctgggtgacttcag

SEQ ID NO: 5560126 - DNA, 16 bp, Homo sapiens
agagagcccttcccag

SEQ ID NO: 5560127 - DNA, 17 bp, Homo sapiens
agagagcccttcccagg

SEQ ID NO: 5560128 - DNA, 23 bp, Homo sapiens
agagagcctccctgcagccacca

SEQ ID NO: 5560129 - DNA, 14 bp, Homo sapiens
agagagcctgcagg

SEQ ID NO: 5560130 - DNA, 22 bp, Homo sapiens
agagagcctgcccggccggaga

SEQ ID NO: 5560131 - DNA, 14 bp, Homo sapiens
agagagcctgtcac

SEQ ID NO: 5560132 - DNA, 15 bp, Homo sapiens
agagagccttaactt

SEQ ID NO: 5560133 - DNA, 21 bp, Homo sapiens
agagagccttgggagccactg

SEQ ID NO: 5560134 - DNA, 23 bp, Homo sapiens
agagagccttggttcatcagtgt

SEQ ID NO: 5560135 - DNA, 16 bp, Homo sapiens
agagagcgaccagcag

SEQ ID NO: 5560136 - DNA, 20 bp, Homo sapiens
agagagcgaccagcaggctc

SEQ ID NO: 5560137 - DNA, 22 bp, Homo sapiens
agagagcgcagccgccttcaca

SEQ ID NO: 5560138 - DNA, 19 bp, Homo sapiens
agagagcgcgggagagagt

SEQ ID NO: 5560139 - DNA, 16 bp, Homo sapiens
agagagcggtctcagg

SEQ ID NO: 5560140 - DNA, 16 bp, Homo sapiens
agagagctcatcatca

SEQ ID NO: 5560141 - DNA, 17 bp, Homo sapiens
agagagctggagtctgg

SEQ ID NO: 5560142 - DNA, 23 bp, Homo sapiens
agagagctggtagttagtagcat

SEQ ID NO: 5560143 - DNA, 14 bp, Homo sapiens
agagagctgtatta

SEQ ID NO: 5560144 - DNA, 17 bp, Homo sapiens
agagagcttcctcccct

SEQ ID NO: 5560145 - DNA, 14 bp, Homo sapiens
agagagcttcctgt

SEQ ID NO: 5560146 - DNA, 20 bp, Homo sapiens
agagagcttcctgtttctaa

SEQ ID NO: 5560147 - DNA, 16 bp, Homo sapiens
agagagcttctgttgc

SEQ ID NO: 5560148 - DNA, 23 bp, Homo sapiens
agagagcttctgttgctgcctca

SEQ ID NO: 5560149 - DNA, 23 bp, Homo sapiens
agagagcttggcaattcatgggg

SEQ ID NO: 5560150 - DNA, 12 bp, Homo sapiens
agagaggaagga

SEQ ID NO: 5560151 - DNA, 18 bp, Homo sapiens
agagaggaaggacccctc

SEQ ID NO: 5560152 - DNA, 11 bp, Homo sapiens
agagaggaagt

SEQ ID NO: 5560153 - DNA, 14 bp, Homo sapiens
agagaggaatcaga

SEQ ID NO: 5560154 - DNA, 16 bp, Homo sapiens
agagaggacaaaataa

SEQ ID NO: 5560155 - DNA, 12 bp, Homo sapiens
agagaggacagt

SEQ ID NO: 5560156 - DNA, 15 bp, Homo sapiens
agagaggaccaggtt

SEQ ID NO: 5560157 - DNA, 17 bp, Homo sapiens
agagaggacctccatgc

SEQ ID NO: 5560158 - DNA, 13 bp, Homo sapiens
agagaggagaaag

SEQ ID NO: 5560159 - DNA, 15 bp, Homo sapiens
agagaggagaaaggg

SEQ ID NO: 5560160 - DNA, 13 bp, Homo sapiens
agagaggagagga

SEQ ID NO: 5560161 - DNA, 15 bp, Homo sapiens
agagaggagaggaga

SEQ ID NO: 5560162 - DNA, 14 bp, Homo sapiens
agagaggaggagag

SEQ ID NO: 5560163 - DNA, 21 bp, Homo sapiens
agagaggagttcaatgatcta

SEQ ID NO: 5560164 - DNA, 12 bp, Homo sapiens
agagaggcacct

SEQ ID NO: 5560165 - DNA, 15 bp, Homo sapiens
agagaggcacctgct

SEQ ID NO: 5560166 - DNA, 19 bp, Homo sapiens
agagaggcacctgctggaa

SEQ ID NO: 5560167 - DNA, 22 bp, Homo sapiens
agagaggccattctttcccaac

SEQ ID NO: 5560168 - DNA, 20 bp, Homo sapiens
agagaggccttttggaatgt

SEQ ID NO: 5560169 - DNA, 20 bp, Homo sapiens
agagaggcgcgtctgcccca

SEQ ID NO: 5560170 - DNA, 14 bp, Homo sapiens
agagaggctctggg

SEQ ID NO: 5560171 - DNA, 15 bp, Homo sapiens
agagaggctggatga

SEQ ID NO: 5560172 - DNA, 13 bp, Homo sapiens
agagagggaaaag

SEQ ID NO: 5560173 - DNA, 17 bp, Homo sapiens
agagagggaattctctt

SEQ ID NO: 5560174 - DNA, 18 bp, Homo sapiens
agagagggacacatgccc

SEQ ID NO: 5560175 - DNA, 12 bp, Homo sapiens
agagagggccca

SEQ ID NO: 5560176 - DNA, 13 bp, Homo sapiens
agagagggcgccc

SEQ ID NO: 5560177 - DNA, 16 bp, Homo sapiens
agagagggcgcccagc

SEQ ID NO: 5560178 - DNA, 17 bp, Homo sapiens
agagagggcgcccagcc

SEQ ID NO: 5560179 - DNA, 18 bp, Homo sapiens
agagagggctgagccatg

SEQ ID NO: 5560180 - DNA, 20 bp, Homo sapiens
agagagggctgagccatggg

SEQ ID NO: 5560181 - DNA, 15 bp, Homo sapiens
agagagggctttaat

SEQ ID NO: 5560182 - DNA, 16 bp, Homo sapiens
agagaggggaagaatt

SEQ ID NO: 5560183 - DNA, 18 bp, Homo sapiens
agagaggggaagaattta

SEQ ID NO: 5560184 - DNA, 21 bp, Homo sapiens
agagaggggaagaatttaatg

SEQ ID NO: 5560185 - DNA, 18 bp, Homo sapiens
agagaggggacatttccc

SEQ ID NO: 5560186 - DNA, 15 bp, Homo sapiens
agagaggggcctgca

SEQ ID NO: 5560187 - DNA, 22 bp, Homo sapiens
agagagggggcactgtggtcag

SEQ ID NO: 5560188 - DNA, 15 bp, Homo sapiens
agagagggggctctc

SEQ ID NO: 5560189 - DNA, 23 bp, Homo sapiens
agagagggtgagtcctccagaac

SEQ ID NO: 5560190 - DNA, 21 bp, Homo sapiens
agagagggtggtgacctctgc

SEQ ID NO: 5560191 - DNA, 16 bp, Homo sapiens
agagaggtaaagggtg

SEQ ID NO: 5560192 - DNA, 22 bp, Homo sapiens
agagaggtagcgagctgctctg

SEQ ID NO: 5560193 - DNA, 23 bp, Homo sapiens
agagaggtcaagcccaggaggac

SEQ ID NO: 5560194 - DNA, 17 bp, Homo sapiens
agagaggtccagccccc

SEQ ID NO: 5560195 - DNA, 23 bp, Homo sapiens
agagaggtgccggggaggggcag

SEQ ID NO: 5560196 - DNA, 20 bp, Homo sapiens
agagaggtggagaactggga

SEQ ID NO: 5560197 - DNA, 14 bp, Homo sapiens
agagaggtggccac

SEQ ID NO: 5560198 - DNA, 13 bp, Homo sapiens
agagaggttctgg

SEQ ID NO: 5560199 - DNA, 14 bp, Homo sapiens
agagaggttctggg

SEQ ID NO: 5560200 - DNA, 22 bp, Homo sapiens
agagaggttctggggaggaagg

SEQ ID NO: 5560201 - DNA, 24 bp, Homo sapiens
agagaggttctggggaggaagggc

SEQ ID NO: 5560202 - DNA, 14 bp, Homo sapiens
agagaggttgagga

SEQ ID NO: 5560203 - DNA, 22 bp, Homo sapiens
agagaggtttttcttgggaaag

SEQ ID NO: 5560204 - DNA, 12 bp, Homo sapiens
agagagtagctc

SEQ ID NO: 5560205 - DNA, 14 bp, Homo sapiens
agagagtataaata

SEQ ID NO: 5560206 - DNA, 16 bp, Homo sapiens
agagagtatggtgctg

SEQ ID NO: 5560207 - DNA, 19 bp, Homo sapiens
agagagtattaaatattta

SEQ ID NO: 5560208 - DNA, 21 bp, Homo sapiens
agagagtattaaatatttaac

SEQ ID NO: 5560209 - DNA, 18 bp, Homo sapiens
agagagtcccactgcctc

SEQ ID NO: 5560210 - DNA, 21 bp, Homo sapiens
agagagtcccactgcctcagg

SEQ ID NO: 5560211 - DNA, 16 bp, Homo sapiens
agagagtcttccaggt

SEQ ID NO: 5560212 - DNA, 15 bp, Homo sapiens
agagagtcttttaac

SEQ ID NO: 5560213 - DNA, 17 bp, Homo sapiens
agagagtcttttaactt

SEQ ID NO: 5560214 - DNA, 23 bp, Homo sapiens
agagagtgctgagaaggacacct

SEQ ID NO: 5560215 - DNA, 18 bp, Homo sapiens
agagagtggagagagcag

SEQ ID NO: 5560216 - DNA, 16 bp, Homo sapiens
agagagtggctcctcc

SEQ ID NO: 5560217 - DNA, 16 bp, Homo sapiens
agagagtggctggggc

SEQ ID NO: 5560218 - DNA, 21 bp, Homo sapiens
agagagtggtaaaaaagaaat

SEQ ID NO: 5560219 - DNA, 20 bp, Homo sapiens
agagagtgtgtgtttgtgtg

SEQ ID NO: 5560220 - DNA, 21 bp, Homo sapiens
agagagttgacccctcctgaa

SEQ ID NO: 5560221 - DNA, 14 bp, Homo sapiens
agagagtttgtaag

SEQ ID NO: 5560222 - DNA, 15 bp, Homo sapiens
agagataaaaatcat

SEQ ID NO: 5560223 - DNA, 14 bp, Homo sapiens
agagataaatattt

SEQ ID NO: 5560224 - DNA, 19 bp, Homo sapiens
agagataaatatttatgca

SEQ ID NO: 5560225 - DNA, 13 bp, Homo sapiens
agagataataaga

SEQ ID NO: 5560226 - DNA, 14 bp, Homo sapiens
agagataataagat

SEQ ID NO: 5560227 - DNA, 16 bp, Homo sapiens
agagataatgaggcaa

SEQ ID NO: 5560228 - DNA, 21 bp, Homo sapiens
agagataattcttaaaaggga

SEQ ID NO: 5560229 - DNA, 20 bp, Homo sapiens
agagataccaagatgccatc

SEQ ID NO: 5560230 - DNA, 18 bp, Homo sapiens
agagataccctctgagac

SEQ ID NO: 5560231 - DNA, 16 bp, Homo sapiens
agagatagcagaggaa

SEQ ID NO: 5560232 - DNA, 21 bp, Homo sapiens
agagatagcagaggaaaaaga

SEQ ID NO: 5560233 - DNA, 16 bp, Homo sapiens
agagatagcctgtggc

SEQ ID NO: 5560234 - DNA, 16 bp, Homo sapiens
agagatagcttctctt

SEQ ID NO: 5560235 - DNA, 18 bp, Homo sapiens
agagataggaaactgaag

SEQ ID NO: 5560236 - DNA, 14 bp, Homo sapiens
agagatataaatga

SEQ ID NO: 5560237 - DNA, 15 bp, Homo sapiens
agagatataaatgaa

SEQ ID NO: 5560238 - DNA, 19 bp, Homo sapiens
agagatatatctgaaaact

SEQ ID NO: 5560239 - DNA, 22 bp, Homo sapiens
agagatatttaggaaaatgctt

SEQ ID NO: 5560240 - DNA, 13 bp, Homo sapiens
agagatattttaa

SEQ ID NO: 5560241 - DNA, 18 bp, Homo sapiens
agagatattttaaaatga

SEQ ID NO: 5560242 - DNA, 13 bp, Homo sapiens
agagatattttgg

SEQ ID NO: 5560243 - DNA, 16 bp, Homo sapiens
agagatattttgtaaa

SEQ ID NO: 5560244 - DNA, 14 bp, Homo sapiens
agagatcaaagatg

SEQ ID NO: 5560245 - DNA, 19 bp, Homo sapiens
agagatcaaatggaaagga

SEQ ID NO: 5560246 - DNA, 19 bp, Homo sapiens
agagatcaccatgacttga

SEQ ID NO: 5560247 - DNA, 14 bp, Homo sapiens
agagatcagcagtg

SEQ ID NO: 5560248 - DNA, 16 bp, Homo sapiens
agagatcagcagtggc

SEQ ID NO: 5560249 - DNA, 16 bp, Homo sapiens
agagatcatgaattat

SEQ ID NO: 5560250 - DNA, 14 bp, Homo sapiens
agagatccaaagac

SEQ ID NO: 5560251 - DNA, 16 bp, Homo sapiens
agagatccaaagactc

SEQ ID NO: 5560252 - DNA, 19 bp, Homo sapiens
agagatctacacatgttgc

SEQ ID NO: 5560253 - DNA, 23 bp, Homo sapiens
agagatctccaactctctctgtg

SEQ ID NO: 5560254 - DNA, 22 bp, Homo sapiens
agagatctcccttctcatctcc

SEQ ID NO: 5560255 - DNA, 20 bp, Homo sapiens
agagatctctgtagaaggag

SEQ ID NO: 5560256 - DNA, 17 bp, Homo sapiens
agagatctgcaggctgc

SEQ ID NO: 5560257 - DNA, 14 bp, Homo sapiens
agagatctgctgtc

SEQ ID NO: 5560258 - DNA, 15 bp, Homo sapiens
agagatcttcccata

SEQ ID NO: 5560259 - DNA, 12 bp, Homo sapiens
agagatgaatta

SEQ ID NO: 5560260 - DNA, 18 bp, Homo sapiens
agagatgactgagtcctc

SEQ ID NO: 5560261 - DNA, 15 bp, Homo sapiens
agagatgagaaatga

SEQ ID NO: 5560262 - DNA, 18 bp, Homo sapiens
agagatgagaagccagga

SEQ ID NO: 5560263 - DNA, 12 bp, Homo sapiens
agagatgagccc

SEQ ID NO: 5560264 - DNA, 18 bp, Homo sapiens
agagcccgtcgcgctgga

SEQ ID NO: 5560265 - DNA, 22 bp, Homo sapiens
agagcccgtcgcgctggacagc

SEQ ID NO: 5560266 - DNA, 13 bp, Homo sapiens
agagccctccaca

SEQ ID NO: 5560267 - DNA, 18 bp, Homo sapiens
agagccctccacattttc

SEQ ID NO: 5560268 - DNA, 12 bp, Homo sapiens
agagccctgagc

SEQ ID NO: 5560269 - DNA, 13 bp, Homo sapiens
agagccctgagct

SEQ ID NO: 5560270 - DNA, 21 bp, Homo sapiens
agagccctgagctcaggctga

SEQ ID NO: 5560271 - DNA, 23 bp, Homo sapiens
agagccctgagctcaggctgagc

SEQ ID NO: 5560272 - DNA, 14 bp, Homo sapiens
agagccctgaggcc

SEQ ID NO: 5560273 - DNA, 20 bp, Homo sapiens
agagccctgaggggctgggc

SEQ ID NO: 5560274 - DNA, 13 bp, Homo sapiens
agagccctgctgt

SEQ ID NO: 5560275 - DNA, 13 bp, Homo sapiens
agagccctggaca

SEQ ID NO: 5560276 - DNA, 17 bp, Homo sapiens
agagccctggccagccc

SEQ ID NO: 5560277 - DNA, 19 bp, Homo sapiens
agagccctggccagccctt

SEQ ID NO: 5560278 - DNA, 18 bp, Homo sapiens
agagccctggctctgccc

SEQ ID NO: 5560279 - DNA, 14 bp, Homo sapiens
agagccctggctgg

SEQ ID NO: 5560280 - DNA, 15 bp, Homo sapiens
agagccctggctggg

SEQ ID NO: 5560281 - DNA, 12 bp, Homo sapiens
agagccctggga

SEQ ID NO: 5560282 - DNA, 19 bp, Homo sapiens
agagccctgggtgacttca

SEQ ID NO: 5560283 - DNA, 21 bp, Homo sapiens
agagccctgtatcaacccaga

SEQ ID NO: 5560284 - DNA, 20 bp, Homo sapiens
agagccctgtccctgccctc

SEQ ID NO: 5560285 - DNA, 14 bp, Homo sapiens
agagccctgtggcc

SEQ ID NO: 5560286 - DNA, 15 bp, Homo sapiens
agagcccttcatttg

SEQ ID NO: 5560287 - DNA, 16 bp, Homo sapiens
agagcccttccaggag

SEQ ID NO: 5560288 - DNA, 15 bp, Homo sapiens
agagcccttcccagg

SEQ ID NO: 5560289 - DNA, 17 bp, Homo sapiens
agagcccttcccagggc

SEQ ID NO: 5560290 - DNA, 19 bp, Homo sapiens
agagcccttgactgtacag

SEQ ID NO: 5560291 - DNA, 19 bp, Homo sapiens
agagccgaggggagagagg

SEQ ID NO: 5560292 - DNA, 16 bp, Homo sapiens
agagccgcaaatcaac

SEQ ID NO: 5560293 - DNA, 19 bp, Homo sapiens
agagccggccgccttctcc

SEQ ID NO: 5560294 - DNA, 22 bp, Homo sapiens
agagccggccgccttctcccct

SEQ ID NO: 5560295 - DNA, 22 bp, Homo sapiens
agagccgggcacattgagctgt

SEQ ID NO: 5560296 - DNA, 21 bp, Homo sapiens
agagccgtggtccctgaggat

SEQ ID NO: 5560297 - DNA, 15 bp, Homo sapiens
agagccgttcctggg

SEQ ID NO: 5560298 - DNA, 17 bp, Homo sapiens
agagcctagccacctcc

SEQ ID NO: 5560299 - DNA, 18 bp, Homo sapiens
agagcctagccacctccc

SEQ ID NO: 5560300 - DNA, 19 bp, Homo sapiens
agagcctattttggtgagg

SEQ ID NO: 5560301 - DNA, 14 bp, Homo sapiens
agagcctcaatttt

SEQ ID NO: 5560302 - DNA, 18 bp, Homo sapiens
agagcctcagcttctggg

SEQ ID NO: 5560303 - DNA, 13 bp, Homo sapiens
agagcctccactt

SEQ ID NO: 5560304 - DNA, 23 bp, Homo sapiens
agagcctccacttagttttggga

SEQ ID NO: 5560305 - DNA, 20 bp, Homo sapiens
agagcctcctttctggcttt

SEQ ID NO: 5560306 - DNA, 20 bp, Homo sapiens
agagcctcgtccctccctca

SEQ ID NO: 5560307 - DNA, 21 bp, Homo sapiens
agagcctcgtccctccctcac

SEQ ID NO: 5560308 - DNA, 13 bp, Homo sapiens
agagcctctgctg

SEQ ID NO: 5560309 - DNA, 12 bp, Homo sapiens
agagcctctggc

SEQ ID NO: 5560310 - DNA, 15 bp, Homo sapiens
agagcctctttgctg

SEQ ID NO: 5560311 - DNA, 20 bp, Homo sapiens
agagcctctttgctggagtc

SEQ ID NO: 5560312 - DNA, 23 bp, Homo sapiens
agagcctgaaatcatctttgttg

SEQ ID NO: 5560313 - DNA, 18 bp, Homo sapiens
agagcctgaagctggcct

SEQ ID NO: 5560314 - DNA, 12 bp, Homo sapiens
agagcctgacct

SEQ ID NO: 5560315 - DNA, 19 bp, Homo sapiens
agagcctgacgctcagccc

SEQ ID NO: 5560316 - DNA, 13 bp, Homo sapiens
agagcctgactgt

SEQ ID NO: 5560317 - DNA, 18 bp, Homo sapiens
agagcctgactgtgttca

SEQ ID NO: 5560318 - DNA, 21 bp, Homo sapiens
agagcctgactgtgttcagtg

SEQ ID NO: 5560319 - DNA, 14 bp, Homo sapiens
agagcctgagactg

SEQ ID NO: 5560320 - DNA, 11 bp, Homo sapiens
agagcctgagg

SEQ ID NO: 5560321 - DNA, 14 bp, Homo sapiens
agagcctgagggat

SEQ ID NO: 5560322 - DNA, 19 bp, Homo sapiens
agagcctgatctcttcctg

SEQ ID NO: 5560323 - DNA, 21 bp, Homo sapiens
agagcctgcagcggaagggac

SEQ ID NO: 5560324 - DNA, 17 bp, Homo sapiens
agagcctgcaggatctc

SEQ ID NO: 5560325 - DNA, 20 bp, Homo sapiens
agagcctgcagggtgacctg

SEQ ID NO: 5560326 - DNA, 12 bp, Homo sapiens
agagcctgcccc

SEQ ID NO: 5560327 - DNA, 16 bp, Homo sapiens
agagcctgccccagcg

SEQ ID NO: 5560328 - DNA, 17 bp, Homo sapiens
agagcctgccccagcgc

SEQ ID NO: 5560329 - DNA, 19 bp, Homo sapiens
agagcctgccccagcgctg

SEQ ID NO: 5560330 - DNA, 11 bp, Homo sapiens
agagcctgcct

SEQ ID NO: 5560331 - DNA, 22 bp, Homo sapiens
agagcctgcctaaccaggccca

SEQ ID NO: 5560332 - DNA, 18 bp, Homo sapiens
agagcctgcctcagctgc

SEQ ID NO: 5560333 - DNA, 15 bp, Homo sapiens
agagcctgcctggag

SEQ ID NO: 5560334 - DNA, 13 bp, Homo sapiens
agagcctgctccc

SEQ ID NO: 5560335 - DNA, 15 bp, Homo sapiens
agagcctgctccccc

SEQ ID NO: 5560336 - DNA, 11 bp, Homo sapiens
agagcctgctg

SEQ ID NO: 5560337 - DNA, 13 bp, Homo sapiens
agagcctgctggc

SEQ ID NO: 5560338 - DNA, 19 bp, Homo sapiens
agagcctgctggcacccac

SEQ ID NO: 5560339 - DNA, 24 bp, Homo sapiens
agagcctgctggcacccaccgtgg

SEQ ID NO: 5560340 - DNA, 15 bp, Homo sapiens
agagcctggagaagc

SEQ ID NO: 5560341 - DNA, 16 bp, Homo sapiens
agagcctggccccagg

SEQ ID NO: 5560342 - DNA, 11 bp, Homo sapiens
agagcctggcg

SEQ ID NO: 5560343 - DNA, 15 bp, Homo sapiens
agagcctggctttgg

SEQ ID NO: 5560344 - DNA, 13 bp, Homo sapiens
agagcctgggcgc

SEQ ID NO: 5560345 - DNA, 16 bp, Homo sapiens
agagcctggggctcta

SEQ ID NO: 5560346 - DNA, 16 bp, Homo sapiens
agagcctgtaaacttt

SEQ ID NO: 5560347 - DNA, 15 bp, Homo sapiens
agagcctgtcaccag

SEQ ID NO: 5560348 - DNA, 19 bp, Homo sapiens
agagcctgtcaccagagct

SEQ ID NO: 5560349 - DNA, 20 bp, Homo sapiens
agagcctgtcaccagagctt

SEQ ID NO: 5560350 - DNA, 13 bp, Homo sapiens
agagcctgtcccc

SEQ ID NO: 5560351 - DNA, 16 bp, Homo sapiens
agagcctgtccccgcc

SEQ ID NO: 5560352 - DNA, 22 bp, Homo sapiens
agagcctgtccccgccttccct

SEQ ID NO: 5560353 - DNA, 23 bp, Homo sapiens
agagcctgtccccgccttccctc

SEQ ID NO: 5560354 - DNA, 13 bp, Homo sapiens
agagcctgtcttt

SEQ ID NO: 5560355 - DNA, 20 bp, Homo sapiens
agagcctgtctttcagcatt

SEQ ID NO: 5560356 - DNA, 21 bp, Homo sapiens
agagcctgtctttcagcattc

SEQ ID NO: 5560357 - DNA, 18 bp, Homo sapiens
agagcctgtggaggggct

SEQ ID NO: 5560358 - DNA, 20 bp, Homo sapiens
agagcctgtggaggggcttg

SEQ ID NO: 5560359 - DNA, 21 bp, Homo sapiens
agagcctgttttaaaaaatac

SEQ ID NO: 5560360 - DNA, 13 bp, Homo sapiens
agagccttaaaac

SEQ ID NO: 5560361 - DNA, 14 bp, Homo sapiens
agagccttaaaaca

SEQ ID NO: 5560362 - DNA, 16 bp, Homo sapiens
agagccttaaaacatc

SEQ ID NO: 5560363 - DNA, 14 bp, Homo sapiens
agagccttaataaa

SEQ ID NO: 5560364 - DNA, 19 bp, Homo sapiens
agagccttaatggatgctc

SEQ ID NO: 5560365 - DNA, 14 bp, Homo sapiens
agagccttcaagtg

SEQ ID NO: 5560366 - DNA, 16 bp, Homo sapiens
agagccttcagcctta

SEQ ID NO: 5560367 - DNA, 16 bp, Homo sapiens
agagccttctcagaag

SEQ ID NO: 5560368 - DNA, 22 bp, Homo sapiens
agagccttctgatgtctctaaa

SEQ ID NO: 5560369 - DNA, 19 bp, Homo sapiens
agagccttgagagacccag

SEQ ID NO: 5560370 - DNA, 21 bp, Homo sapiens
agagccttggcctgacctggc

SEQ ID NO: 5560371 - DNA, 20 bp, Homo sapiens
agagccttggcgagggcagc

SEQ ID NO: 5560372 - DNA, 15 bp, Homo sapiens
agagccttgggagcc

SEQ ID NO: 5560373 - DNA, 16 bp, Homo sapiens
agagccttgggagcca

SEQ ID NO: 5560374 - DNA, 17 bp, Homo sapiens
agagccttgggagccac

SEQ ID NO: 5560375 - DNA, 21 bp, Homo sapiens
agagccttggtgtccacctgg

SEQ ID NO: 5560376 - DNA, 23 bp, Homo sapiens
agagccttggtgtccacctggcc

SEQ ID NO: 5560377 - DNA, 15 bp, Homo sapiens
agagcctttatacaa

SEQ ID NO: 5560378 - DNA, 22 bp, Homo sapiens
agagcctttctccagcccatgc

SEQ ID NO: 5560379 - DNA, 14 bp, Homo sapiens
agagcctttgcctt

SEQ ID NO: 5560380 - DNA, 18 bp, Homo sapiens
agagcctttttctaggcc

SEQ ID NO: 5560381 - DNA, 14 bp, Homo sapiens
agagcgacacagac

SEQ ID NO: 5560382 - DNA, 15 bp, Homo sapiens
agagcgacagagcag

SEQ ID NO: 5560383 - DNA, 20 bp, Homo sapiens
agagcgaccagcaggctcct

SEQ ID NO: 5560384 - DNA, 21 bp, Homo sapiens
agagcgaccagcaggctcctc

SEQ ID NO: 5560385 - DNA, 18 bp, Homo sapiens
agagcgagactctgtctc

SEQ ID NO: 5560386 - DNA, 14 bp, Homo sapiens
agagcgcacaggga

SEQ ID NO: 5560387 - DNA, 13 bp, Homo sapiens
agagcgcagcccc

SEQ ID NO: 5560388 - DNA, 13 bp, Homo sapiens
agagcgcagcccg

SEQ ID NO: 5560389 - DNA, 15 bp, Homo sapiens
agagcgccacccgcc

SEQ ID NO: 5560390 - DNA, 16 bp, Homo sapiens
agagcgccacccgccc

SEQ ID NO: 5560391 - DNA, 20 bp, Homo sapiens
agagcgccacccgcccgccc

SEQ ID NO: 5560392 - DNA, 15 bp, Homo sapiens
agagcgccagctcct

SEQ ID NO: 5560393 - DNA, 17 bp, Homo sapiens
agagcgccaggaagcca

SEQ ID NO: 5560394 - DNA, 13 bp, Homo sapiens
agagcgcccctcc

SEQ ID NO: 5560395 - DNA, 14 bp, Homo sapiens
agagcgcccctccc

SEQ ID NO: 5560396 - DNA, 17 bp, Homo sapiens
agagcgcctcttcctct

SEQ ID NO: 5560397 - DNA, 21 bp, Homo sapiens
agagcgcctcttcctctgggc

SEQ ID NO: 5560398 - DNA, 15 bp, Homo sapiens
agagcgcgcccctag

SEQ ID NO: 5560399 - DNA, 20 bp, Homo sapiens
agagcgcgcccctagccggt

SEQ ID NO: 5560400 - DNA, 17 bp, Homo sapiens
agagcgcgggagagagt

SEQ ID NO: 5560401 - DNA, 20 bp, Homo sapiens
agagcgctcctctgccttgg

SEQ ID NO: 5560402 - DNA, 13 bp, Homo sapiens
agagcggctgccc

SEQ ID NO: 5560403 - DNA, 12 bp, Homo sapiens
agagcggctgga

SEQ ID NO: 5560404 - DNA, 14 bp, Homo sapiens
agagcgggagtgac

SEQ ID NO: 5560405 - DNA, 19 bp, Homo sapiens
agagcggggtcccctctgt

SEQ ID NO: 5560406 - DNA, 17 bp, Homo sapiens
agagcgtccttggctgc

SEQ ID NO: 5560407 - DNA, 19 bp, Homo sapiens
agagcgtccttggctgccg

SEQ ID NO: 5560408 - DNA, 19 bp, Homo sapiens
agagcgtgcacttgtgatc

SEQ ID NO: 5560409 - DNA, 16 bp, Homo sapiens
agagctaaaaaggccc

SEQ ID NO: 5560410 - DNA, 20 bp, Homo sapiens
agagctaaactccttcctgg

SEQ ID NO: 5560411 - DNA, 21 bp, Homo sapiens
agagctaataaatctcttctt

SEQ ID NO: 5560412 - DNA, 18 bp, Homo sapiens
agagctacataatttagt

SEQ ID NO: 5560413 - DNA, 14 bp, Homo sapiens
agagctacgtattt

SEQ ID NO: 5560414 - DNA, 17 bp, Homo sapiens
agagctacgtatttaat

SEQ ID NO: 5560415 - DNA, 14 bp, Homo sapiens
agagctactcagaa

SEQ ID NO: 5560416 - DNA, 19 bp, Homo sapiens
agagctactcagaaatgga

SEQ ID NO: 5560417 - DNA, 17 bp, Homo sapiens
agagctactcccacagc

SEQ ID NO: 5560418 - DNA, 15 bp, Homo sapiens
agagctactgagact

SEQ ID NO: 5560419 - DNA, 21 bp, Homo sapiens
agagctacttgggccatagct

SEQ ID NO: 5560420 - DNA, 21 bp, Homo sapiens
agagctagaaaaataaaatgt

SEQ ID NO: 5560421 - DNA, 18 bp, Homo sapiens
agagctagaacatggaga

SEQ ID NO: 5560422 - DNA, 19 bp, Homo sapiens
agagctagaacatggagag

SEQ ID NO: 5560423 - DNA, 22 bp, Homo sapiens
agagctagaacctggagaacta

SEQ ID NO: 5560424 - DNA, 14 bp, Homo sapiens
agagctaggaaccc

SEQ ID NO: 5560425 - DNA, 18 bp, Homo sapiens
agagctaggaaccctgga

SEQ ID NO: 5560426 - DNA, 20 bp, Homo sapiens
agagctaggaaccctggagg

SEQ ID NO: 5560427 - DNA, 18 bp, Homo sapiens
agagctaggagcaaagcc

SEQ ID NO: 5560428 - DNA, 16 bp, Homo sapiens
agagctagggctgctg

SEQ ID NO: 5560429 - DNA, 22 bp, Homo sapiens
agagctagggctgctgcttctg

SEQ ID NO: 5560430 - DNA, 13 bp, Homo sapiens
agagctatgcaca

SEQ ID NO: 5560431 - DNA, 16 bp, Homo sapiens
agagctatgcacacca

SEQ ID NO: 5560432 - DNA, 17 bp, Homo sapiens
agagctatgcacaccaa

SEQ ID NO: 5560433 - DNA, 19 bp, Homo sapiens
agagctatggacagcattg

SEQ ID NO: 5560434 - DNA, 23 bp, Homo sapiens
agagctatggacagcattgccag

SEQ ID NO: 5560435 - DNA, 18 bp, Homo sapiens
agagctatggcccagaaa

SEQ ID NO: 5560436 - DNA, 17 bp, Homo sapiens
agagctatgttccctcc

SEQ ID NO: 5560437 - DNA, 23 bp, Homo sapiens
agagctatttaatggccggctgg

SEQ ID NO: 5560438 - DNA, 14 bp, Homo sapiens
agagctattttaga

SEQ ID NO: 5560439 - DNA, 16 bp, Homo sapiens
agagctcaccatggaa

SEQ ID NO: 5560440 - DNA, 13 bp, Homo sapiens
agagctcagacat

SEQ ID NO: 5560441 - DNA, 20 bp, Homo sapiens
agagctcagaggagtctggg

SEQ ID NO: 5560442 - DNA, 17 bp, Homo sapiens
agagctcagcacagcct

SEQ ID NO: 5560443 - DNA, 12 bp, Homo sapiens
agaggaactgtc

SEQ ID NO: 5560444 - DNA, 17 bp, Homo sapiens
agaggaactgtccagag

SEQ ID NO: 5560445 - DNA, 12 bp, Homo sapiens
agaggaagagaa

SEQ ID NO: 5560446 - DNA, 13 bp, Homo sapiens
agaggaagagaga

SEQ ID NO: 5560447 - DNA, 19 bp, Homo sapiens
agaggaagagagagaccct

SEQ ID NO: 5560448 - DNA, 17 bp, Homo sapiens
agaggaagagtgcaaaa

SEQ ID NO: 5560449 - DNA, 15 bp, Homo sapiens
agaggaagccagctg

SEQ ID NO: 5560450 - DNA, 16 bp, Homo sapiens
agaggaagccttgccc

SEQ ID NO: 5560451 - DNA, 15 bp, Homo sapiens
agaggaaggaaacat

SEQ ID NO: 5560452 - DNA, 14 bp, Homo sapiens
agaggaaggagggt

SEQ ID NO: 5560453 - DNA, 18 bp, Homo sapiens
agaggaagggaggcctga

SEQ ID NO: 5560454 - DNA, 16 bp, Homo sapiens
agaggaaggggccaga

SEQ ID NO: 5560455 - DNA, 23 bp, Homo sapiens
agaggaaggggccagaggctcgt

SEQ ID NO: 5560456 - DNA, 20 bp, Homo sapiens
agaggaataaagctgtgagc

SEQ ID NO: 5560457 - DNA, 21 bp, Homo sapiens
agaggaatcctggcagcccag

SEQ ID NO: 5560458 - DNA, 20 bp, Homo sapiens
agaggaatctacctgtggtg

SEQ ID NO: 5560459 - DNA, 22 bp, Homo sapiens
agaggaatctacctgtggtgac

SEQ ID NO: 5560460 - DNA, 12 bp, Homo sapiens
agaggaatctgt

SEQ ID NO: 5560461 - DNA, 10 bp, Homo sapiens
agaggaatgt

SEQ ID NO: 5560462 - DNA, 19 bp, Homo sapiens
agaggaatgtagggcctgc

SEQ ID NO: 5560463 - DNA, 21 bp, Homo sapiens
agaggaatgtagggcctgcat

SEQ ID NO: 5560464 - DNA, 15 bp, Homo sapiens
agaggaatgtgggct

SEQ ID NO: 5560465 - DNA, 19 bp, Homo sapiens
agaggaatttataacaaat

SEQ ID NO: 5560466 - DNA, 14 bp, Homo sapiens
agaggacaaggaag

SEQ ID NO: 5560467 - DNA, 15 bp, Homo sapiens
agaggacaaggaagt

SEQ ID NO: 5560468 - DNA, 16 bp, Homo sapiens
agaggacaaggaagtg

SEQ ID NO: 5560469 - DNA, 21 bp, Homo sapiens
agaggacacctgtactggaga

SEQ ID NO: 5560470 - DNA, 23 bp, Homo sapiens
agaggacagatcaatggcgcagt

SEQ ID NO: 5560471 - DNA, 14 bp, Homo sapiens
agaggacagctctg

SEQ ID NO: 5560472 - DNA, 15 bp, Homo sapiens
agaggacagctctgg

SEQ ID NO: 5560473 - DNA, 17 bp, Homo sapiens
agaggacagtctggaga

SEQ ID NO: 5560474 - DNA, 19 bp, Homo sapiens
agaggacagtctggagaag

SEQ ID NO: 5560475 - DNA, 23 bp, Homo sapiens
agaggacagtttaggacccaagg

SEQ ID NO: 5560476 - DNA, 16 bp, Homo sapiens
agaggacatattcaca

SEQ ID NO: 5560477 - DNA, 18 bp, Homo sapiens
agaggaccaatgcttgca

SEQ ID NO: 5560478 - DNA, 17 bp, Homo sapiens
agaggaccagggccttt

SEQ ID NO: 5560479 - DNA, 15 bp, Homo sapiens
agaggaccagtgagt

SEQ ID NO: 5560480 - DNA, 16 bp, Homo sapiens
agaggacccatcctgc

SEQ ID NO: 5560481 - DNA, 13 bp, Homo sapiens
agaggaccccagg

SEQ ID NO: 5560482 - DNA, 14 bp, Homo sapiens
agaggaccccaggg

SEQ ID NO: 5560483 - DNA, 23 bp, Homo sapiens
agaggaccccattctgggactgc

SEQ ID NO: 5560484 - DNA, 15 bp, Homo sapiens
agaggaccggcggct

SEQ ID NO: 5560485 - DNA, 12 bp, Homo sapiens
agaggacctcca

SEQ ID NO: 5560486 - DNA, 14 bp, Homo sapiens
agaggacctccatg

SEQ ID NO: 5560487 - DNA, 16 bp, Homo sapiens
agaggacctccatgcc

SEQ ID NO: 5560488 - DNA, 22 bp, Homo sapiens
agaggacgagcgattgaggtgt

SEQ ID NO: 5560489 - DNA, 17 bp, Homo sapiens
agaggacgcacgctcgc

SEQ ID NO: 5560490 - DNA, 15 bp, Homo sapiens
agaggacgccttcag

SEQ ID NO: 5560491 - DNA, 19 bp, Homo sapiens
agaggacggccctgcctgc

SEQ ID NO: 5560492 - DNA, 21 bp, Homo sapiens
agaggactacacatcagggct

SEQ ID NO: 5560493 - DNA, 19 bp, Homo sapiens
agaggactactcagcactg

SEQ ID NO: 5560494 - DNA, 21 bp, Homo sapiens
agaggactcccaaccctggct

SEQ ID NO: 5560495 - DNA, 17 bp, Homo sapiens
agaggactcgcttgtaa

SEQ ID NO: 5560496 - DNA, 23 bp, Homo sapiens
agaggactggttctgaggccaga

SEQ ID NO: 5560497 - DNA, 22 bp, Homo sapiens
agaggacttcggggtagaggct

SEQ ID NO: 5560498 - DNA, 23 bp, Homo sapiens
agaggacttcggggtagaggctg

SEQ ID NO: 5560499 - DNA, 23 bp, Homo sapiens
agaggacttttctttgtggcttc

SEQ ID NO: 5560500 - DNA, 22 bp, Homo sapiens
agaggagaaaaaaaaagtgaaa

SEQ ID NO: 5560501 - DNA, 17 bp, Homo sapiens
agaggagaaaaagaaga

SEQ ID NO: 5560502 - DNA, 22 bp, Homo sapiens
agaggagaaaaagaagaaaaga

SEQ ID NO: 5560503 - DNA, 22 bp, Homo sapiens
agaggagaaatgcaataactct

SEQ ID NO: 5560504 - DNA, 17 bp, Homo sapiens
agaggagaacagtagga

SEQ ID NO: 5560505 - DNA, 19 bp, Homo sapiens
agaggagaacttgctgcct

SEQ ID NO: 5560506 - DNA, 20 bp, Homo sapiens
agaggagaacttgctgcctc

SEQ ID NO: 5560507 - DNA, 18 bp, Homo sapiens
agaggagacagcctgtct

SEQ ID NO: 5560508 - DNA, 13 bp, Homo sapiens
agaggagaccctg

SEQ ID NO: 5560509 - DNA, 14 bp, Homo sapiens
agaggagacttttt

SEQ ID NO: 5560510 - DNA, 22 bp, Homo sapiens
agaggagagaatgagagagtgt

SEQ ID NO: 5560511 - DNA, 11 bp, Homo sapiens
agaggagagag

SEQ ID NO: 5560512 - DNA, 17 bp, Homo sapiens
agaggagagcatctgct

SEQ ID NO: 5560513 - DNA, 21 bp, Homo sapiens
agaggagagcatctgctctga

SEQ ID NO: 5560514 - DNA, 12 bp, Homo sapiens
agaggagagcca

SEQ ID NO: 5560515 - DNA, 23 bp, Homo sapiens
agaggagagccagagaagtgaca

SEQ ID NO: 5560516 - DNA, 12 bp, Homo sapiens
agaggagaggaa

SEQ ID NO: 5560517 - DNA, 14 bp, Homo sapiens
agaggagaggaaaa

SEQ ID NO: 5560518 - DNA, 17 bp, Homo sapiens
agaggagaggagagagg

SEQ ID NO: 5560519 - DNA, 15 bp, Homo sapiens
agaggagaggctgct

SEQ ID NO: 5560520 - DNA, 12 bp, Homo sapiens
agaggagatcag

SEQ ID NO: 5560521 - DNA, 23 bp, Homo sapiens
agaggagatcagggcgacctgca

SEQ ID NO: 5560522 - DNA, 11 bp, Homo sapiens
agaggagatgt

SEQ ID NO: 5560523 - DNA, 18 bp, Homo sapiens
agaggagcaaattgaggt

SEQ ID NO: 5560524 - DNA, 15 bp, Homo sapiens
agaggagcaggaagc

SEQ ID NO: 5560525 - DNA, 17 bp, Homo sapiens
agaggagccaccagttc

SEQ ID NO: 5560526 - DNA, 15 bp, Homo sapiens
agaggagccacctgg

SEQ ID NO: 5560527 - DNA, 16 bp, Homo sapiens
agaggagcccagcggc

SEQ ID NO: 5560528 - DNA, 21 bp, Homo sapiens
agaggagcccagtgggctgca

SEQ ID NO: 5560529 - DNA, 23 bp, Homo sapiens
agaggagccctgcctctccgccc

SEQ ID NO: 5560530 - DNA, 14 bp, Homo sapiens
agaggagcctcaga

SEQ ID NO: 5560531 - DNA, 15 bp, Homo sapiens
agaggagcctcagaa

SEQ ID NO: 5560532 - DNA, 17 bp, Homo sapiens
agaggagcctcagaaga

SEQ ID NO: 5560533 - DNA, 21 bp, Homo sapiens
agaggagcctttccagaacta

SEQ ID NO: 5560534 - DNA, 15 bp, Homo sapiens
agaggagcgcaggca

SEQ ID NO: 5560535 - DNA, 21 bp, Homo sapiens
agaggagcgcaggcagcgcag

SEQ ID NO: 5560536 - DNA, 20 bp, Homo sapiens
agaggagcgggacctgtggc

SEQ ID NO: 5560537 - DNA, 15 bp, Homo sapiens
agaggagcgtgtcct

SEQ ID NO: 5560538 - DNA, 12 bp, Homo sapiens
agaggagctcta

SEQ ID NO: 5560539 - DNA, 14 bp, Homo sapiens
agaggagctctccc

SEQ ID NO: 5560540 - DNA, 15 bp, Homo sapiens
agaggagcttttctg

SEQ ID NO: 5560541 - DNA, 13 bp, Homo sapiens
agaggaggaaaag

SEQ ID NO: 5560542 - DNA, 22 bp, Homo sapiens
agaggaggaagactctggagcc

SEQ ID NO: 5560543 - DNA, 20 bp, Homo sapiens
agaggaggacccctgccttc

SEQ ID NO: 5560544 - DNA, 14 bp, Homo sapiens
agaggaggaggagg

SEQ ID NO: 5560545 - DNA, 19 bp, Homo sapiens
agaggaggaggtgggggct

SEQ ID NO: 5560546 - DNA, 17 bp, Homo sapiens
agaggaggcagaaagat

SEQ ID NO: 5560547 - DNA, 13 bp, Homo sapiens
agaggaggcagcc

SEQ ID NO: 5560548 - DNA, 16 bp, Homo sapiens
agaggaggcagccccc

SEQ ID NO: 5560549 - DNA, 21 bp, Homo sapiens
agaggaggcagccccctccac

SEQ ID NO: 5560550 - DNA, 22 bp, Homo sapiens
agaggaggccagcctcacctca

SEQ ID NO: 5560551 - DNA, 14 bp, Homo sapiens
agaggaggcctgga

SEQ ID NO: 5560552 - DNA, 16 bp, Homo sapiens
agaggaggcctggacc

SEQ ID NO: 5560553 - DNA, 17 bp, Homo sapiens
agaggaggcctggaccg

SEQ ID NO: 5560554 - DNA, 18 bp, Homo sapiens
agaggaggcctggaccga

SEQ ID NO: 5560555 - DNA, 23 bp, Homo sapiens
agaggagggacctactgaaccca

SEQ ID NO: 5560556 - DNA, 23 bp, Homo sapiens
agaggagggagcatcagtgccct

SEQ ID NO: 5560557 - DNA, 13 bp, Homo sapiens
agaggagggcatg

SEQ ID NO: 5560558 - DNA, 16 bp, Homo sapiens
agaggagggggcaggc

SEQ ID NO: 5560559 - DNA, 16 bp, Homo sapiens
agaggaggggtaaata

SEQ ID NO: 5560560 - DNA, 13 bp, Homo sapiens
agaggaggtgtgg

SEQ ID NO: 5560561 - DNA, 17 bp, Homo sapiens
agaggaggtgtggagtg

SEQ ID NO: 5560562 - DNA, 20 bp, Homo sapiens
agaggaggtttgcctgtgat

SEQ ID NO: 5560563 - DNA, 14 bp, Homo sapiens
agaggagtcagaga

SEQ ID NO: 5560564 - DNA, 16 bp, Homo sapiens
agaggagtgactgagc

SEQ ID NO: 5560565 - DNA, 13 bp, Homo sapiens
agaggagttcaat

SEQ ID NO: 5560566 - DNA, 23 bp, Homo sapiens
agaggagttcaggaacccttctc

SEQ ID NO: 5560567 - DNA, 18 bp, Homo sapiens
agaggagttctaacacat

SEQ ID NO: 5560568 - DNA, 16 bp, Homo sapiens
agaggataaataataa

SEQ ID NO: 5560569 - DNA, 17 bp, Homo sapiens
agaggatcgtagtgtgt

SEQ ID NO: 5560570 - DNA, 17 bp, Homo sapiens
agaggatctaggatggg

SEQ ID NO: 5560571 - DNA, 16 bp, Homo sapiens
agaggatgaaggaagg

SEQ ID NO: 5560572 - DNA, 14 bp, Homo sapiens
agaggatgagagcc

SEQ ID NO: 5560573 - DNA, 20 bp, Homo sapiens
agaggatgagctctacccag

SEQ ID NO: 5560574 - DNA, 19 bp, Homo sapiens
agaggatgaggtgggctga

SEQ ID NO: 5560575 - DNA, 17 bp, Homo sapiens
agaggatgccttttctg

SEQ ID NO: 5560576 - DNA, 18 bp, Homo sapiens
agaggatgctgtgaaatt

SEQ ID NO: 5560577 - DNA, 19 bp, Homo sapiens
agaggatgcttagtcttaa

SEQ ID NO: 5560578 - DNA, 18 bp, Homo sapiens
agaggatggccagtgtct

SEQ ID NO: 5560579 - DNA, 22 bp, Homo sapiens
agaggatggccagtgtctgtcc

SEQ ID NO: 5560580 - DNA, 19 bp, Homo sapiens
agaggatggcccagggtga

SEQ ID NO: 5560581 - DNA, 21 bp, Homo sapiens
agaggatggtcttacagcagg

SEQ ID NO: 5560582 - DNA, 13 bp, Homo sapiens
agaggatgtgcaa

SEQ ID NO: 5560583 - DNA, 21 bp, Homo sapiens
agaggatgtggcctggttcaa

SEQ ID NO: 5560584 - DNA, 19 bp, Homo sapiens
agaggattagacagtaaga

SEQ ID NO: 5560585 - DNA, 22 bp, Homo sapiens
agaggattaggttccatccttt

SEQ ID NO: 5560586 - DNA, 19 bp, Homo sapiens
agaggattagtagaaaata

SEQ ID NO: 5560587 - DNA, 15 bp, Homo sapiens
agaggattgtaaaat

SEQ ID NO: 5560588 - DNA, 21 bp, Homo sapiens
agaggattgtccaccttctgc

SEQ ID NO: 5560589 - DNA, 21 bp, Homo sapiens
agaggatttggctcgctgtgg

SEQ ID NO: 5560590 - DNA, 18 bp, Homo sapiens
agaggatttttttctgag

SEQ ID NO: 5560591 - DNA, 20 bp, Homo sapiens
agaggatttttttctgagcg

SEQ ID NO: 5560592 - DNA, 18 bp, Homo sapiens
agaggcaaagaaaggaga

SEQ ID NO: 5560593 - DNA, 15 bp, Homo sapiens
agaggcaacaggatt

SEQ ID NO: 5560594 - DNA, 23 bp, Homo sapiens
agaggcaacagtgttctgagccc

SEQ ID NO: 5560595 - DNA, 20 bp, Homo sapiens
agaggcaagagacagaatga

SEQ ID NO: 5560596 - DNA, 18 bp, Homo sapiens
agaggcaagctgaaattt

SEQ ID NO: 5560597 - DNA, 14 bp, Homo sapiens
agaggcaaggttgc

SEQ ID NO: 5560598 - DNA, 18 bp, Homo sapiens
agaggcaatggctccttc

SEQ ID NO: 5560599 - DNA, 17 bp, Homo sapiens
agaggcaccaggaagcc

SEQ ID NO: 5560600 - DNA, 16 bp, Homo sapiens
agaggcaccagtccag

SEQ ID NO: 5560601 - DNA, 17 bp, Homo sapiens
agaggcaccagtccagc

SEQ ID NO: 5560602 - DNA, 13 bp, Homo sapiens
agaggcacctgct

SEQ ID NO: 5560603 - DNA, 16 bp, Homo sapiens
agaggcacctgctgga

SEQ ID NO: 5560604 - DNA, 19 bp, Homo sapiens
agaggcactcagtgagcct

SEQ ID NO: 5560605 - DNA, 20 bp, Homo sapiens
agaggcagaaaattgcacaa

SEQ ID NO: 5560606 - DNA, 15 bp, Homo sapiens
agaggcagaaccctg

SEQ ID NO: 5560607 - DNA, 19 bp, Homo sapiens
agaggcagaaccctggtga

SEQ ID NO: 5560608 - DNA, 13 bp, Homo sapiens
agaggcagagaaa

SEQ ID NO: 5560609 - DNA, 14 bp, Homo sapiens
agaggcagagaaag

SEQ ID NO: 5560610 - DNA, 22 bp, Homo sapiens
agaggcagagaaagaagagaca

SEQ ID NO: 5560611 - DNA, 19 bp, Homo sapiens
agaggcagagattggagtg

SEQ ID NO: 5560612 - DNA, 22 bp, Homo sapiens
agaggcagagtgaaataaaatg

SEQ ID NO: 5560613 - DNA, 21 bp, Homo sapiens
agaggcagagtgccccacctg

SEQ ID NO: 5560614 - DNA, 17 bp, Homo sapiens
agaggcagcaggagcca

SEQ ID NO: 5560615 - DNA, 13 bp, Homo sapiens
agaggcagccaga

SEQ ID NO: 5560616 - DNA, 11 bp, Homo sapiens
agaggcagccc

SEQ ID NO: 5560617 - DNA, 19 bp, Homo sapiens
agaggcagccccattctgc

SEQ ID NO: 5560618 - DNA, 22 bp, Homo sapiens
agaggcagccccattctgcctg

SEQ ID NO: 5560619 - DNA, 24 bp, Homo sapiens
agaggcagccccattctgcctgcc

SEQ ID NO: 5560620 - DNA, 12 bp, Homo sapiens
agagggacagat

SEQ ID NO: 5560621 - DNA, 21 bp, Homo sapiens
agagggacagcccactgagaa

SEQ ID NO: 5560622 - DNA, 15 bp, Homo sapiens
agagggacaggcact

SEQ ID NO: 5560623 - DNA, 13 bp, Homo sapiens
agagggacagggt

SEQ ID NO: 5560624 - DNA, 18 bp, Homo sapiens
agagggacatagaatctg

SEQ ID NO: 5560625 - DNA, 20 bp, Homo sapiens
agagggaccaaattgcttct

SEQ ID NO: 5560626 - DNA, 22 bp, Homo sapiens
agagggaccaaattgcttctag

SEQ ID NO: 5560627 - DNA, 14 bp, Homo sapiens
agagggaccagctg

SEQ ID NO: 5560628 - DNA, 17 bp, Homo sapiens
agagggaccagctgggg

SEQ ID NO: 5560629 - DNA, 14 bp, Homo sapiens
agagggaccatgtg

SEQ ID NO: 5560630 - DNA, 15 bp, Homo sapiens
agagggacctctccc

SEQ ID NO: 5560631 - DNA, 15 bp, Homo sapiens
agagggacgcctggg

SEQ ID NO: 5560632 - DNA, 21 bp, Homo sapiens
agagggacgcctgggggtgcc

SEQ ID NO: 5560633 - DNA, 20 bp, Homo sapiens
agagggacggccaagaatgt

SEQ ID NO: 5560634 - DNA, 21 bp, Homo sapiens
agagggacggccaagaatgta

SEQ ID NO: 5560635 - DNA, 14 bp, Homo sapiens
agagggactcaagg

SEQ ID NO: 5560636 - DNA, 18 bp, Homo sapiens
agagggactcaagggaaa

SEQ ID NO: 5560637 - DNA, 16 bp, Homo sapiens
agagggactccaagcc

SEQ ID NO: 5560638 - DNA, 12 bp, Homo sapiens
agagggactgga

SEQ ID NO: 5560639 - DNA, 17 bp, Homo sapiens
agagggactggacagcc

SEQ ID NO: 5560640 - DNA, 21 bp, Homo sapiens
agagggactggacagccaggg

SEQ ID NO: 5560641 - DNA, 14 bp, Homo sapiens
agagggagaagaag

SEQ ID NO: 5560642 - DNA, 15 bp, Homo sapiens
agagggagaagaagt

SEQ ID NO: 5560643 - DNA, 16 bp, Homo sapiens
agagggagaagcatga

SEQ ID NO: 5560644 - DNA, 19 bp, Homo sapiens
agagggagaagcatgaaaa

SEQ ID NO: 5560645 - DNA, 19 bp, Homo sapiens
agagggagaaggagaggct

SEQ ID NO: 5560646 - DNA, 22 bp, Homo sapiens
agagggagaaggagaggctctg

SEQ ID NO: 5560647 - DNA, 14 bp, Homo sapiens
agagggagacagag

SEQ ID NO: 5560648 - DNA, 12 bp, Homo sapiens
agagggagagag

SEQ ID NO: 5560649 - DNA, 10 bp, Homo sapiens
agagggagca

SEQ ID NO: 5560650 - DNA, 14 bp, Homo sapiens
agagggagcaagcc

SEQ ID NO: 5560651 - DNA, 12 bp, Homo sapiens
agagggagctgt

SEQ ID NO: 5560652 - DNA, 21 bp, Homo sapiens
agagggaggaatgtgtgcctt

SEQ ID NO: 5560653 - DNA, 22 bp, Homo sapiens
agagggaggacctgttgtgttc

SEQ ID NO: 5560654 - DNA, 18 bp, Homo sapiens
agagggaggcaagccctg

SEQ ID NO: 5560655 - DNA, 13 bp, Homo sapiens
agagggaggggcc

SEQ ID NO: 5560656 - DNA, 14 bp, Homo sapiens
agagggaggggccc

SEQ ID NO: 5560657 - DNA, 15 bp, Homo sapiens
agagggaggtaagga

SEQ ID NO: 5560658 - DNA, 14 bp, Homo sapiens
agagggaggtgttt

SEQ ID NO: 5560659 - DNA, 19 bp, Homo sapiens
agagggagtacaaagacag

SEQ ID NO: 5560660 - DNA, 20 bp, Homo sapiens
agagggagtagaatacgcag

SEQ ID NO: 5560661 - DNA, 21 bp, Homo sapiens
agagggataacccaaacaaaa

SEQ ID NO: 5560662 - DNA, 15 bp, Homo sapiens
agagggataaggcag

SEQ ID NO: 5560663 - DNA, 19 bp, Homo sapiens
agagggataaggcagttga

SEQ ID NO: 5560664 - DNA, 17 bp, Homo sapiens
agagggatgggttcctg

SEQ ID NO: 5560665 - DNA, 18 bp, Homo sapiens
agagggatgggttcctgc

SEQ ID NO: 5560666 - DNA, 18 bp, Homo sapiens
agagggatgtaactattg

SEQ ID NO: 5560667 - DNA, 18 bp, Homo sapiens
agagggatttccctgcag

SEQ ID NO: 5560668 - DNA, 13 bp, Homo sapiens
agagggcaaagct

SEQ ID NO: 5560669 - DNA, 16 bp, Homo sapiens
agagggcactcccagg

SEQ ID NO: 5560670 - DNA, 17 bp, Homo sapiens
agagggcagagcacatg

SEQ ID NO: 5560671 - DNA, 21 bp, Homo sapiens
agagggccaacaactgtccct

SEQ ID NO: 5560672 - DNA, 22 bp, Homo sapiens
agagggccaacaactgtccctc

SEQ ID NO: 5560673 - DNA, 17 bp, Homo sapiens
agagggccaagagagac

SEQ ID NO: 5560674 - DNA, 13 bp, Homo sapiens
agagggccagcag

SEQ ID NO: 5560675 - DNA, 21 bp, Homo sapiens
agagggccagcaggctcctgg

SEQ ID NO: 5560676 - DNA, 19 bp, Homo sapiens
agagggccatgcaattcat

SEQ ID NO: 5560677 - DNA, 21 bp, Homo sapiens
agagggcccagcccagagcca

SEQ ID NO: 5560678 - DNA, 13 bp, Homo sapiens
agagggcccagct

SEQ ID NO: 5560679 - DNA, 17 bp, Homo sapiens
agagggcccaggcaggc

SEQ ID NO: 5560680 - DNA, 16 bp, Homo sapiens
agagggcccatcaggc

SEQ ID NO: 5560681 - DNA, 18 bp, Homo sapiens
agagggccctgcctgctg

SEQ ID NO: 5560682 - DNA, 16 bp, Homo sapiens
agagggcctgcaaggg

SEQ ID NO: 5560683 - DNA, 14 bp, Homo sapiens
agagggcctggacc

SEQ ID NO: 5560684 - DNA, 14 bp, Homo sapiens
agagggccttgctt

SEQ ID NO: 5560685 - DNA, 16 bp, Homo sapiens
agagggccttgcttct

SEQ ID NO: 5560686 - DNA, 21 bp, Homo sapiens
agagggcgagggatgatgagg

SEQ ID NO: 5560687 - DNA, 16 bp, Homo sapiens
agagggcgcccagccc

SEQ ID NO: 5560688 - DNA, 17 bp, Homo sapiens
agagggcgcccagccca

SEQ ID NO: 5560689 - DNA, 21 bp, Homo sapiens
agagggcgcccagcccaggcc

SEQ ID NO: 5560690 - DNA, 16 bp, Homo sapiens
agagggctacaaagga

SEQ ID NO: 5560691 - DNA, 15 bp, Homo sapiens
agagggctagccctg

SEQ ID NO: 5560692 - DNA, 18 bp, Homo sapiens
agagggctagccctgagc

SEQ ID NO: 5560693 - DNA, 17 bp, Homo sapiens
agagggctgagccatgg

SEQ ID NO: 5560694 - DNA, 22 bp, Homo sapiens
agagggctgcgagcatttccct

SEQ ID NO: 5560695 - DNA, 12 bp, Homo sapiens
agagggctggag

SEQ ID NO: 5560696 - DNA, 20 bp, Homo sapiens
agagggctggtccttattta

SEQ ID NO: 5560697 - DNA, 22 bp, Homo sapiens
agagggctgttggacagctgct

SEQ ID NO: 5560698 - DNA, 23 bp, Homo sapiens
agagggctgttggacagctgctt

SEQ ID NO: 5560699 - DNA, 22 bp, Homo sapiens
agagggcttcctctagaagcca

SEQ ID NO: 5560700 - DNA, 14 bp, Homo sapiens
agagggcttgtgaa

SEQ ID NO: 5560701 - DNA, 18 bp, Homo sapiens
agagggcttgtgaacaga

SEQ ID NO: 5560702 - DNA, 17 bp, Homo sapiens
agagggctttaattttt

SEQ ID NO: 5560703 - DNA, 15 bp, Homo sapiens
agaggggaaaaaatc

SEQ ID NO: 5560704 - DNA, 19 bp, Homo sapiens
agaggggaaaaaatcatat

SEQ ID NO: 5560705 - DNA, 16 bp, Homo sapiens
agaggggaagagactt

SEQ ID NO: 5560706 - DNA, 19 bp, Homo sapiens
agaggggaatgagggctga

SEQ ID NO: 5560707 - DNA, 16 bp, Homo sapiens
agaggggacgcaggcc

SEQ ID NO: 5560708 - DNA, 18 bp, Homo sapiens
agaggggacgcaggcccc

SEQ ID NO: 5560709 - DNA, 22 bp, Homo sapiens
agaggggagacattagaaaaaa

SEQ ID NO: 5560710 - DNA, 15 bp, Homo sapiens
agaggggagggaggg

SEQ ID NO: 5560711 - DNA, 20 bp, Homo sapiens
agaggggagggctcctgggg

SEQ ID NO: 5560712 - DNA, 18 bp, Homo sapiens
agaggggaggggcctagg

SEQ ID NO: 5560713 - DNA, 15 bp, Homo sapiens
agaggggaggtcact

SEQ ID NO: 5560714 - DNA, 13 bp, Homo sapiens
agaggggatgggg

SEQ ID NO: 5560715 - DNA, 16 bp, Homo sapiens
agaggggcagaacagc

SEQ ID NO: 5560716 - DNA, 14 bp, Homo sapiens
agaggggcagccct

SEQ ID NO: 5560717 - DNA, 15 bp, Homo sapiens
agaggggcagccctt

SEQ ID NO: 5560718 - DNA, 13 bp, Homo sapiens
agaggggcagccg

SEQ ID NO: 5560719 - DNA, 14 bp, Homo sapiens
agaggggcagccgc

SEQ ID NO: 5560720 - DNA, 18 bp, Homo sapiens
agaggggccaggcccagg

SEQ ID NO: 5560721 - DNA, 23 bp, Homo sapiens
agaggggccaggcccaggcagag

SEQ ID NO: 5560722 - DNA, 13 bp, Homo sapiens
agaggggcctctg

SEQ ID NO: 5560723 - DNA, 16 bp, Homo sapiens
agaggggcctgatgag

SEQ ID NO: 5560724 - DNA, 18 bp, Homo sapiens
agaggggcctgcaggtga

SEQ ID NO: 5560725 - DNA, 14 bp, Homo sapiens
agaggggcctgcca

SEQ ID NO: 5560726 - DNA, 12 bp, Homo sapiens
agaggggcctgg

SEQ ID NO: 5560727 - DNA, 15 bp, Homo sapiens
agaggggcctgggaa

SEQ ID NO: 5560728 - DNA, 19 bp, Homo sapiens
agaggggcctgggaaagga

SEQ ID NO: 5560729 - DNA, 23 bp, Homo sapiens
agaggggcgccttttcagccctt

SEQ ID NO: 5560730 - DNA, 14 bp, Homo sapiens
agaggggcgctgtc

SEQ ID NO: 5560731 - DNA, 17 bp, Homo sapiens
agaggggcgctgtcctg

SEQ ID NO: 5560732 - DNA, 14 bp, Homo sapiens
agaggggcgggctc

SEQ ID NO: 5560733 - DNA, 21 bp, Homo sapiens
agaggggcgggctcagagctt

SEQ ID NO: 5560734 - DNA, 15 bp, Homo sapiens
agaggggcggggcca

SEQ ID NO: 5560735 - DNA, 12 bp, Homo sapiens
agaggggctgca

SEQ ID NO: 5560736 - DNA, 18 bp, Homo sapiens
agaggggctggacctggc

SEQ ID NO: 5560737 - DNA, 13 bp, Homo sapiens
agaggggctgggg

SEQ ID NO: 5560738 - DNA, 15 bp, Homo sapiens
agaggggctggggca

SEQ ID NO: 5560739 - DNA, 16 bp, Homo sapiens
agagggggagacccct

SEQ ID NO: 5560740 - DNA, 18 bp, Homo sapiens
agagggggaggggaagct

SEQ ID NO: 5560741 - DNA, 21 bp, Homo sapiens
agagggggcacccggggagga

SEQ ID NO: 5560742 - DNA, 13 bp, Homo sapiens
agagggggcactg

SEQ ID NO: 5560743 - DNA, 18 bp, Homo sapiens
agagggggcactgtggtc

SEQ ID NO: 5560744 - DNA, 13 bp, Homo sapiens
agagggggccgga

SEQ ID NO: 5560745 - DNA, 12 bp, Homo sapiens
agagggggcctg

SEQ ID NO: 5560746 - DNA, 19 bp, Homo sapiens
agagggggcctgggacttc

SEQ ID NO: 5560747 - DNA, 13 bp, Homo sapiens
agagggggctctc

SEQ ID NO: 5560748 - DNA, 15 bp, Homo sapiens
agagggggctctcca

SEQ ID NO: 5560749 - DNA, 22 bp, Homo sapiens
agagggggctctgcccacctgg

SEQ ID NO: 5560750 - DNA, 19 bp, Homo sapiens
agagggggctggtgggtgc

SEQ ID NO: 5560751 - DNA, 17 bp, Homo sapiens
agagggggtggcctccc

SEQ ID NO: 5560752 - DNA, 15 bp, Homo sapiens
agaggggtattcttc

SEQ ID NO: 5560753 - DNA, 17 bp, Homo sapiens
agaggggtcacacccac

SEQ ID NO: 5560754 - DNA, 14 bp, Homo sapiens
agaggggtgagaca

SEQ ID NO: 5560755 - DNA, 19 bp, Homo sapiens
agaggggtgcagaggctgt

SEQ ID NO: 5560756 - DNA, 15 bp, Homo sapiens
agagggtagacaggg

SEQ ID NO: 5560757 - DNA, 23 bp, Homo sapiens
agagggtatttgtggaaactgtc

SEQ ID NO: 5560758 - DNA, 18 bp, Homo sapiens
agagggtcggggaggagg

SEQ ID NO: 5560759 - DNA, 22 bp, Homo sapiens
agagggtctggagaagcagtga

SEQ ID NO: 5560760 - DNA, 18 bp, Homo sapiens
agagggtgagggccttct

SEQ ID NO: 5560761 - DNA, 19 bp, Homo sapiens
agagggtgataatagaaga

SEQ ID NO: 5560762 - DNA, 23 bp, Homo sapiens
agagggtgccggaaagagagctg

SEQ ID NO: 5560763 - DNA, 23 bp, Homo sapiens
agagggtgctgccccatgaagcc

SEQ ID NO: 5560764 - DNA, 20 bp, Homo sapiens
agagggtggtgacctctgcc

SEQ ID NO: 5560765 - DNA, 23 bp, Homo sapiens
agagggtggtgacctctgcctga

SEQ ID NO: 5560766 - DNA, 15 bp, Homo sapiens
agagggtgtcatcta

SEQ ID NO: 5560767 - DNA, 21 bp, Homo sapiens
agagggtgtgggtgccctgtt

SEQ ID NO: 5560768 - DNA, 13 bp, Homo sapiens
agagggttcctgt

SEQ ID NO: 5560769 - DNA, 20 bp, Homo sapiens
agagggttgctggtcctgca

SEQ ID NO: 5560770 - DNA, 21 bp, Homo sapiens
agaggtaaaaaaaagaagtgt

SEQ ID NO: 5560771 - DNA, 22 bp, Homo sapiens
agaggtaaaagtgtgagcagtg

SEQ ID NO: 5560772 - DNA, 22 bp, Homo sapiens
agaggtaacagaacagcttcag

SEQ ID NO: 5560773 - DNA, 21 bp, Homo sapiens
agaggtaactatcaatattta

SEQ ID NO: 5560774 - DNA, 21 bp, Homo sapiens
agaggtacagggtttttacct

SEQ ID NO: 5560775 - DNA, 20 bp, Homo sapiens
agaggtaccaaaaaagaaag

SEQ ID NO: 5560776 - DNA, 14 bp, Homo sapiens
agaggtaccctggg

SEQ ID NO: 5560777 - DNA, 15 bp, Homo sapiens
agaggtaccctgggt

SEQ ID NO: 5560778 - DNA, 17 bp, Homo sapiens
agaggtaccctgggtgt

SEQ ID NO: 5560779 - DNA, 18 bp, Homo sapiens
agaggtactagaatgctt

SEQ ID NO: 5560780 - DNA, 20 bp, Homo sapiens
agaggtactgtaatgggtaa

SEQ ID NO: 5560781 - DNA, 13 bp, Homo sapiens
agaggtagagaaa

SEQ ID NO: 5560782 - DNA, 19 bp, Homo sapiens
agaggtagcactctcagag

SEQ ID NO: 5560783 - DNA, 17 bp, Homo sapiens
agaggtagcgagctgct

SEQ ID NO: 5560784 - DNA, 19 bp, Homo sapiens
agaggtagcgagctgctct

SEQ ID NO: 5560785 - DNA, 23 bp, Homo sapiens
agaggtagcgagctgctctgcta

SEQ ID NO: 5560786 - DNA, 15 bp, Homo sapiens
agaggtatcctcttt

SEQ ID NO: 5560787 - DNA, 21 bp, Homo sapiens
agaggtatcctctttttgctc

SEQ ID NO: 5560788 - DNA, 21 bp, Homo sapiens
agaggtatcttactttcctct

SEQ ID NO: 5560789 - DNA, 16 bp, Homo sapiens
agaggtcaagcccagg

SEQ ID NO: 5560790 - DNA, 18 bp, Homo sapiens
agaggtcaagcccaggag

SEQ ID NO: 5560791 - DNA, 20 bp, Homo sapiens
agaggtcaagcccaggagga

SEQ ID NO: 5560792 - DNA, 14 bp, Homo sapiens
agaggtcagccttg

SEQ ID NO: 5560793 - DNA, 15 bp, Homo sapiens
agaggtccagcccat

SEQ ID NO: 5560794 - DNA, 15 bp, Homo sapiens
agaggtccaggcccc

SEQ ID NO: 5560795 - DNA, 12 bp, Homo sapiens
agaggtccaggt

SEQ ID NO: 5560796 - DNA, 21 bp, Homo sapiens
agaggtcccaaggttctgggt

SEQ ID NO: 5560797 - DNA, 20 bp, Homo sapiens
agaggtcccagccccaggcc

SEQ ID NO: 5560798 - DNA, 21 bp, Homo sapiens
agagtcattgtaatgttgtga

SEQ ID NO: 5560799 - DNA, 14 bp, Homo sapiens
agagtcatttctga

SEQ ID NO: 5560800 - DNA, 22 bp, Homo sapiens
agagtccaactcacttccagtg

SEQ ID NO: 5560801 - DNA, 19 bp, Homo sapiens
agagtccaaggtttaaaga

SEQ ID NO: 5560802 - DNA, 17 bp, Homo sapiens
agagtccaatttaagga

SEQ ID NO: 5560803 - DNA, 21 bp, Homo sapiens
agagtccaggaggccctggtc

SEQ ID NO: 5560804 - DNA, 15 bp, Homo sapiens
agagtccaggcccca

SEQ ID NO: 5560805 - DNA, 17 bp, Homo sapiens
agagtccaggcctgggt

SEQ ID NO: 5560806 - DNA, 22 bp, Homo sapiens
agagtccagtgctctgcctcag

SEQ ID NO: 5560807 - DNA, 13 bp, Homo sapiens
agagtcccactgc

SEQ ID NO: 5560808 - DNA, 14 bp, Homo sapiens
agagtcccactgcc

SEQ ID NO: 5560809 - DNA, 15 bp, Homo sapiens
agagtcccactgcct

SEQ ID NO: 5560810 - DNA, 18 bp, Homo sapiens
agagtcccactgcctcag

SEQ ID NO: 5560811 - DNA, 21 bp, Homo sapiens
agagtcccagagcaggaggcc

SEQ ID NO: 5560812 - DNA, 19 bp, Homo sapiens
agagtcccaggttggctct

SEQ ID NO: 5560813 - DNA, 21 bp, Homo sapiens
agagtccccccactcccagca

SEQ ID NO: 5560814 - DNA, 22 bp, Homo sapiens
agagtccccccgaccagatcct

SEQ ID NO: 5560815 - DNA, 17 bp, Homo sapiens
agagtccctgcctggac

SEQ ID NO: 5560816 - DNA, 16 bp, Homo sapiens
agagtccggaggcagc

SEQ ID NO: 5560817 - DNA, 19 bp, Homo sapiens
agagtccggatttctaaca

SEQ ID NO: 5560818 - DNA, 17 bp, Homo sapiens
agagtcctcattataaa

SEQ ID NO: 5560819 - DNA, 21 bp, Homo sapiens
agagtcctccttcccagctct

SEQ ID NO: 5560820 - DNA, 14 bp, Homo sapiens
agagtcctgaggca

SEQ ID NO: 5560821 - DNA, 19 bp, Homo sapiens
agagtcctgaggcagaacc

SEQ ID NO: 5560822 - DNA, 22 bp, Homo sapiens
agagtcctgaggcagaacctgg

SEQ ID NO: 5560823 - DNA, 21 bp, Homo sapiens
agagtcctgcacagttttctg

SEQ ID NO: 5560824 - DNA, 22 bp, Homo sapiens
agagtcctgccgacggagccac

SEQ ID NO: 5560825 - DNA, 13 bp, Homo sapiens
agagtcctggccc

SEQ ID NO: 5560826 - DNA, 14 bp, Homo sapiens
agagtcctggccct

SEQ ID NO: 5560827 - DNA, 16 bp, Homo sapiens
agagtcctgggagccc

SEQ ID NO: 5560828 - DNA, 22 bp, Homo sapiens
agagtcctggtttcctcagcct

SEQ ID NO: 5560829 - DNA, 20 bp, Homo sapiens
agagtccttaagacggaagt

SEQ ID NO: 5560830 - DNA, 16 bp, Homo sapiens
agagtccttagcctgg

SEQ ID NO: 5560831 - DNA, 19 bp, Homo sapiens
agagtccttagcctgggcc

SEQ ID NO: 5560832 - DNA, 20 bp, Homo sapiens
agagtccttagcctgggcct

SEQ ID NO: 5560833 - DNA, 21 bp, Homo sapiens
agagtccttagcctgggcctc

SEQ ID NO: 5560834 - DNA, 14 bp, Homo sapiens
agagtcgatgctca

SEQ ID NO: 5560835 - DNA, 19 bp, Homo sapiens
agagtcgctgtgccacagg

SEQ ID NO: 5560836 - DNA, 16 bp, Homo sapiens
agagtcggtctgcttt

SEQ ID NO: 5560837 - DNA, 19 bp, Homo sapiens
agagtcggtctgctttgga

SEQ ID NO: 5560838 - DNA, 18 bp, Homo sapiens
agagtcgttggagactga

SEQ ID NO: 5560839 - DNA, 14 bp, Homo sapiens
agagtctaaagatg

SEQ ID NO: 5560840 - DNA, 23 bp, Homo sapiens
agagtctaaagatggagtttcta

SEQ ID NO: 5560841 - DNA, 18 bp, Homo sapiens
agagtctaagataaaagc

SEQ ID NO: 5560842 - DNA, 21 bp, Homo sapiens
agagtctaatagtctttgcca

SEQ ID NO: 5560843 - DNA, 17 bp, Homo sapiens
agagtctagattcaaag

SEQ ID NO: 5560844 - DNA, 21 bp, Homo sapiens
agagtctagattcaaaggttc

SEQ ID NO: 5560845 - DNA, 15 bp, Homo sapiens
agagtctatcaacat

SEQ ID NO: 5560846 - DNA, 17 bp, Homo sapiens
agagtctattgtctcct

SEQ ID NO: 5560847 - DNA, 18 bp, Homo sapiens
agagtctatttacggaac

SEQ ID NO: 5560848 - DNA, 22 bp, Homo sapiens
agagtctcactgttgcccaggc

SEQ ID NO: 5560849 - DNA, 20 bp, Homo sapiens
agagtctcagaaactcccct

SEQ ID NO: 5560850 - DNA, 23 bp, Homo sapiens
agagtctcattctgttgcccagg

SEQ ID NO: 5560851 - DNA, 15 bp, Homo sapiens
agagtctccatttaa

SEQ ID NO: 5560852 - DNA, 15 bp, Homo sapiens
agagtctcccaggga

SEQ ID NO: 5560853 - DNA, 13 bp, Homo sapiens
agagtctccttct

SEQ ID NO: 5560854 - DNA, 23 bp, Homo sapiens
agagtctctacccctttctgttc

SEQ ID NO: 5560855 - DNA, 12 bp, Homo sapiens
agagtctctcca

SEQ ID NO: 5560856 - DNA, 14 bp, Homo sapiens
agagtctctccagc

SEQ ID NO: 5560857 - DNA, 17 bp, Homo sapiens
agagtctctccagcctc

SEQ ID NO: 5560858 - DNA, 13 bp, Homo sapiens
agagtctctggct

SEQ ID NO: 5560859 - DNA, 15 bp, Homo sapiens
agagtctctggctca

SEQ ID NO: 5560860 - DNA, 19 bp, Homo sapiens
agagtctctggctcagctg

SEQ ID NO: 5560861 - DNA, 22 bp, Homo sapiens
agagtctctggctcagctgtgg

SEQ ID NO: 5560862 - DNA, 12 bp, Homo sapiens
agagtctgagcc

SEQ ID NO: 5560863 - DNA, 13 bp, Homo sapiens
agagtctgagccc

SEQ ID NO: 5560864 - DNA, 19 bp, Homo sapiens
agagtctgagcccccggct

SEQ ID NO: 5560865 - DNA, 12 bp, Homo sapiens
agagtctgaggg

SEQ ID NO: 5560866 - DNA, 22 bp, Homo sapiens
agagtctgagggcttgtagttc

SEQ ID NO: 5560867 - DNA, 14 bp, Homo sapiens
agagtctggagctg

SEQ ID NO: 5560868 - DNA, 13 bp, Homo sapiens
agagtctggccct

SEQ ID NO: 5560869 - DNA, 21 bp, Homo sapiens
agagtctggggaccagcttgg

SEQ ID NO: 5560870 - DNA, 19 bp, Homo sapiens
agagtctgtgtgtagccag

SEQ ID NO: 5560871 - DNA, 21 bp, Homo sapiens
agagtctgtgtgtagccagga

SEQ ID NO: 5560872 - DNA, 18 bp, Homo sapiens
agagtcttacaatcaaat

SEQ ID NO: 5560873 - DNA, 22 bp, Homo sapiens
agagtcttccaggtgcctggcc

SEQ ID NO: 5560874 - DNA, 14 bp, Homo sapiens
agagtcttgcagtg

SEQ ID NO: 5560875 - DNA, 18 bp, Homo sapiens
agagtcttgcagtgatta

SEQ ID NO: 5560876 - DNA, 17 bp, Homo sapiens
agagtgaaaccatgact

SEQ ID NO: 5560877 - DNA, 21 bp, Homo sapiens
agagtgaaaccatgactgtga

SEQ ID NO: 5560878 - DNA, 11 bp, Homo sapiens
agagtgaaata

SEQ ID NO: 5560879 - DNA, 18 bp, Homo sapiens
agagtgaaataattaaaa

SEQ ID NO: 5560880 - DNA, 20 bp, Homo sapiens
agagtgaaataattaaaaac

SEQ ID NO: 5560881 - DNA, 14 bp, Homo sapiens
agagtgaaatattg

SEQ ID NO: 5560882 - DNA, 20 bp, Homo sapiens
agagtgaaatattgtaaatg

SEQ ID NO: 5560883 - DNA, 17 bp, Homo sapiens
agagtgaaattcaattc

SEQ ID NO: 5560884 - DNA, 14 bp, Homo sapiens
agagtgaacaaatt

SEQ ID NO: 5560885 - DNA, 15 bp, Homo sapiens
agagtgaagaatctt

SEQ ID NO: 5560886 - DNA, 14 bp, Homo sapiens
agagtgaagagcat

SEQ ID NO: 5560887 - DNA, 14 bp, Homo sapiens
agagtgaagagtga

SEQ ID NO: 5560888 - DNA, 16 bp, Homo sapiens
agagtgaatttcagta

SEQ ID NO: 5560889 - DNA, 21 bp, Homo sapiens
agagtgacacccaagagggct

SEQ ID NO: 5560890 - DNA, 23 bp, Homo sapiens
agagtgacacccaagagggctgc

SEQ ID NO: 5560891 - DNA, 17 bp, Homo sapiens
agagtgacaggcaccag

SEQ ID NO: 5560892 - DNA, 20 bp, Homo sapiens
agagtgacctcggacagagc

SEQ ID NO: 5560893 - DNA, 16 bp, Homo sapiens
agagtgactccaagaa

SEQ ID NO: 5560894 - DNA, 16 bp, Homo sapiens
agagtgacttggagag

SEQ ID NO: 5560895 - DNA, 19 bp, Homo sapiens
agagtgagaataattgtgt

SEQ ID NO: 5560896 - DNA, 21 bp, Homo sapiens
agagtgagaccatgtttcaaa

SEQ ID NO: 5560897 - DNA, 14 bp, Homo sapiens
agagtgagaccctg

SEQ ID NO: 5560898 - DNA, 12 bp, Homo sapiens
agagtgagactc

SEQ ID NO: 5560899 - DNA, 16 bp, Homo sapiens
agagtgagactctgtc

SEQ ID NO: 5560900 - DNA, 13 bp, Homo sapiens
agagtgagagaga

SEQ ID NO: 5560901 - DNA, 19 bp, Homo sapiens
agagtgagagcacaaagat

SEQ ID NO: 5560902 - DNA, 17 bp, Homo sapiens
agagtgagctctggtgg

SEQ ID NO: 5560903 - DNA, 20 bp, Homo sapiens
agagtgagctttagctctct

SEQ ID NO: 5560904 - DNA, 12 bp, Homo sapiens
agagtgaggccc

SEQ ID NO: 5560905 - DNA, 18 bp, Homo sapiens
agagtgagggcctgaggt

SEQ ID NO: 5560906 - DNA, 23 bp, Homo sapiens
agagtgaggtcatcccggggcca

SEQ ID NO: 5560907 - DNA, 22 bp, Homo sapiens
agagtgatagtcttttgctttt

SEQ ID NO: 5560908 - DNA, 14 bp, Homo sapiens
agagtgatgactgc

SEQ ID NO: 5560909 - DNA, 14 bp, Homo sapiens
agagtgattctagt

SEQ ID NO: 5560910 - DNA, 15 bp, Homo sapiens
agagtgattgcagct

SEQ ID NO: 5560911 - DNA, 16 bp, Homo sapiens
agagtgattgcagctt

SEQ ID NO: 5560912 - DNA, 18 bp, Homo sapiens
agagtgattgcagcttta

SEQ ID NO: 5560913 - DNA, 14 bp, Homo sapiens
agagtgcaaaacat

SEQ ID NO: 5560914 - DNA, 17 bp, Homo sapiens
agagtgcaacagtagca

SEQ ID NO: 5560915 - DNA, 16 bp, Homo sapiens
agagtgcacagctgtc

SEQ ID NO: 5560916 - DNA, 14 bp, Homo sapiens
agagtgcacatgcc

SEQ ID NO: 5560917 - DNA, 15 bp, Homo sapiens
agagtgcataaataa

SEQ ID NO: 5560918 - DNA, 14 bp, Homo sapiens
agagtgccactgcg

SEQ ID NO: 5560919 - DNA, 16 bp, Homo sapiens
agagtgccatccctga

SEQ ID NO: 5560920 - DNA, 17 bp, Homo sapiens
agagtgcccagcagagg

SEQ ID NO: 5560921 - DNA, 18 bp, Homo sapiens
agagtgccccacctgcca

SEQ ID NO: 5560922 - DNA, 12 bp, Homo sapiens
agagtgccctgg

SEQ ID NO: 5560923 - DNA, 19 bp, Homo sapiens
agagtgcccttaaaataat

SEQ ID NO: 5560924 - DNA, 21 bp, Homo sapiens
agagtgcgccgagtctgtctc

SEQ ID NO: 5560925 - DNA, 12 bp, Homo sapiens
agagtgctctga

SEQ ID NO: 5560926 - DNA, 16 bp, Homo sapiens
agagtgctctgaccct

SEQ ID NO: 5560927 - DNA, 18 bp, Homo sapiens
agagtgctctgaccctgg

SEQ ID NO: 5560928 - DNA, 12 bp, Homo sapiens
agagtgctgaga

SEQ ID NO: 5560929 - DNA, 14 bp, Homo sapiens
agagtgctggactg

SEQ ID NO: 5560930 - DNA, 20 bp, Homo sapiens
agagtgctgtcgggaccaca

SEQ ID NO: 5560931 - DNA, 19 bp, Homo sapiens
agagtggaaattcatgaga

SEQ ID NO: 5560932 - DNA, 13 bp, Homo sapiens
agagtggaaggac

SEQ ID NO: 5560933 - DNA, 16 bp, Homo sapiens
agagtggacctgtgct

SEQ ID NO: 5560934 - DNA, 18 bp, Homo sapiens
agagtggacctgtgctgt

SEQ ID NO: 5560935 - DNA, 12 bp, Homo sapiens
agagtggactgc

SEQ ID NO: 5560936 - DNA, 15 bp, Homo sapiens
agagtggactgcatt

SEQ ID NO: 5560937 - DNA, 18 bp, Homo sapiens
agagtggagagaagctct

SEQ ID NO: 5560938 - DNA, 19 bp, Homo sapiens
agagtggagagaagctctt

SEQ ID NO: 5560939 - DNA, 15 bp, Homo sapiens
agagtggaggaggag

SEQ ID NO: 5560940 - DNA, 17 bp, Homo sapiens
agagtggagtctgagtc

SEQ ID NO: 5560941 - DNA, 18 bp, Homo sapiens
agagtggagtctgagtct

SEQ ID NO: 5560942 - DNA, 20 bp, Homo sapiens
agagtggcaggtgggctgcc

SEQ ID NO: 5560943 - DNA, 23 bp, Homo sapiens
agagtggcaggtgggctgcctgc

SEQ ID NO: 5560944 - DNA, 21 bp, Homo sapiens
agagtggccacggcccaggga

SEQ ID NO: 5560945 - DNA, 13 bp, Homo sapiens
agagtggcccctc

SEQ ID NO: 5560946 - DNA, 15 bp, Homo sapiens
agagtggcctccctg

SEQ ID NO: 5560947 - DNA, 16 bp, Homo sapiens
agagtggcctccctgc

SEQ ID NO: 5560948 - DNA, 18 bp, Homo sapiens
agagtggcctccctgctg

SEQ ID NO: 5560949 - DNA, 22 bp, Homo sapiens
agagtggcctggccaggagctc

SEQ ID NO: 5560950 - DNA, 13 bp, Homo sapiens
agagtggcctggg

SEQ ID NO: 5560951 - DNA, 20 bp, Homo sapiens
agagtggcgtgagctgcccg

SEQ ID NO: 5560952 - DNA, 14 bp, Homo sapiens
agagtggcgtggcc

SEQ ID NO: 5560953 - DNA, 23 bp, Homo sapiens
agagtggctcactggctgggagt

SEQ ID NO: 5560954 - DNA, 12 bp, Homo sapiens
agagtggctcct

SEQ ID NO: 5560955 - DNA, 15 bp, Homo sapiens
agagtggctcctccc

SEQ ID NO: 5560956 - DNA, 14 bp, Homo sapiens
agagtggctttcta

SEQ ID NO: 5560957 - DNA, 14 bp, Homo sapiens
agagtgggagaggc

SEQ ID NO: 5560958 - DNA, 11 bp, Homo sapiens
agagtgggagc

SEQ ID NO: 5560959 - DNA, 23 bp, Homo sapiens
agagtgggctttggtggccaggg

SEQ ID NO: 5560960 - DNA, 19 bp, Homo sapiens
agagtggggatatgattta

SEQ ID NO: 5560961 - DNA, 23 bp, Homo sapiens
agagtggggctagactgggctgg

SEQ ID NO: 5560962 - DNA, 21 bp, Homo sapiens
agagtggggggaggaagcaga

SEQ ID NO: 5560963 - DNA, 22 bp, Homo sapiens
agagtgggtcttggaccagggc

SEQ ID NO: 5560964 - DNA, 16 bp, Homo sapiens
agagtggtaaaaaaga

SEQ ID NO: 5560965 - DNA, 20 bp, Homo sapiens
agagtggtaaaaaagaaatg

SEQ ID NO: 5560966 - DNA, 18 bp, Homo sapiens
agagtggtatttgcagac

SEQ ID NO: 5560967 - DNA, 12 bp, Homo sapiens
agagtggtgagt

SEQ ID NO: 5560968 - DNA, 23 bp, Homo sapiens
agagtggtgagtggaagggagga

SEQ ID NO: 5560969 - DNA, 22 bp, Homo sapiens
agagtggtggcagctcaaaatg

SEQ ID NO: 5560970 - DNA, 18 bp, Homo sapiens
agagtgtagaagcattcc

SEQ ID NO: 5560971 - DNA, 11 bp, Homo sapiens
agagtgtagct

SEQ ID NO: 5560972 - DNA, 14 bp, Homo sapiens
agagtgtagctgta

SEQ ID NO: 5560973 - DNA, 20 bp, Homo sapiens
agagtgtagctgtaagggca

SEQ ID NO: 5560974 - DNA, 14 bp, Homo sapiens
agagtgtatgcata

SEQ ID NO: 5560975 - DNA, 17 bp, Homo sapiens
agagtgtcaaccagaca

SEQ ID NO: 5560976 - DNA, 22 bp, Homo sapiens
agataggtttgagttcaaattt

SEQ ID NO: 5560977 - DNA, 18 bp, Homo sapiens
agatagtaaaacacttat

SEQ ID NO: 5560978 - DNA, 14 bp, Homo sapiens
agatagtacataaa

SEQ ID NO: 5560979 - DNA, 18 bp, Homo sapiens
agatagtacataaaggtg

SEQ ID NO: 5560980 - DNA, 15 bp, Homo sapiens
agatagtgccaggtg

SEQ ID NO: 5560981 - DNA, 19 bp, Homo sapiens
agatagtgtaacttgctta

SEQ ID NO: 5560982 - DNA, 16 bp, Homo sapiens
agatagttacatttat

SEQ ID NO: 5560983 - DNA, 11 bp, Homo sapiens
agatagtttat

SEQ ID NO: 5560984 - DNA, 11 bp, Homo sapiens
agatagttttc

SEQ ID NO: 5560985 - DNA, 20 bp, Homo sapiens
agatataaatactgacaatg

SEQ ID NO: 5560986 - DNA, 14 bp, Homo sapiens
agatataaatgaag

SEQ ID NO: 5560987 - DNA, 15 bp, Homo sapiens
agatataaatgaagt

SEQ ID NO: 5560988 - DNA, 17 bp, Homo sapiens
agatataaatggctggt

SEQ ID NO: 5560989 - DNA, 15 bp, Homo sapiens
agatataactgtaca

SEQ ID NO: 5560990 - DNA, 15 bp, Homo sapiens
agatataactgtctt

SEQ ID NO: 5560991 - DNA, 21 bp, Homo sapiens
agatataagagaagtctcatt

SEQ ID NO: 5560992 - DNA, 14 bp, Homo sapiens
agatataagatttg

SEQ ID NO: 5560993 - DNA, 20 bp, Homo sapiens
agatataaggggaaagataa

SEQ ID NO: 5560994 - DNA, 12 bp, Homo sapiens
agatataagtaa

SEQ ID NO: 5560995 - DNA, 21 bp, Homo sapiens
agatataagtgctgtataaaa

SEQ ID NO: 5560996 - DNA, 23 bp, Homo sapiens
agatataagtgctgtataaaatc

SEQ ID NO: 5560997 - DNA, 16 bp, Homo sapiens
agatataatgaacaaa

SEQ ID NO: 5560998 - DNA, 20 bp, Homo sapiens
agatatacttgtttttgtaa

SEQ ID NO: 5560999 - DNA, 21 bp, Homo sapiens
agatatacttgtttttgtaaa

SEQ ID NO: 5561000 - DNA, 15 bp, Homo sapiens
agatatactttgtgg

SEQ ID NO: 5561001 - DNA, 17 bp, Homo sapiens
agatataggataaaata

SEQ ID NO: 5561002 - DNA, 20 bp, Homo sapiens
agatatagggtgtggctcct

SEQ ID NO: 5561003 - DNA, 20 bp, Homo sapiens
agatatataaataatcacac

SEQ ID NO: 5561004 - DNA, 19 bp, Homo sapiens
agatatatacatggaatcg

SEQ ID NO: 5561005 - DNA, 13 bp, Homo sapiens
agatatatattca

SEQ ID NO: 5561006 - DNA, 14 bp, Homo sapiens
agatatatatttcc

SEQ ID NO: 5561007 - DNA, 22 bp, Homo sapiens
agatatatatttccaaatattc

SEQ ID NO: 5561008 - DNA, 23 bp, Homo sapiens
agatatatatttccaaatattct

SEQ ID NO: 5561009 - DNA, 21 bp, Homo sapiens
agatatatctgaaaactggaa

SEQ ID NO: 5561010 - DNA, 17 bp, Homo sapiens
agatatatgtgtataca

SEQ ID NO: 5561011 - DNA, 13 bp, Homo sapiens
agatatattaaaa

SEQ ID NO: 5561012 - DNA, 18 bp, Homo sapiens
agatatattaaaaatata

SEQ ID NO: 5561013 - DNA, 21 bp, Homo sapiens
agatatattaaaaatataaaa

SEQ ID NO: 5561014 - DNA, 14 bp, Homo sapiens
agatatatttcact

SEQ ID NO: 5561015 - DNA, 16 bp, Homo sapiens
agatatatttccaaga

SEQ ID NO: 5561016 - DNA, 15 bp, Homo sapiens
agatatatttctcca

SEQ ID NO: 5561017 - DNA, 17 bp, Homo sapiens
agatatatttttaagat

SEQ ID NO: 5561018 - DNA, 14 bp, Homo sapiens
agatatatttttca

SEQ ID NO: 5561019 - DNA, 13 bp, Homo sapiens
agatatcaaaatt

SEQ ID NO: 5561020 - DNA, 19 bp, Homo sapiens
agatatcatactgattttt

SEQ ID NO: 5561021 - DNA, 21 bp, Homo sapiens
agatatcatactgatttttaa

SEQ ID NO: 5561022 - DNA, 13 bp, Homo sapiens
agatatccatctt

SEQ ID NO: 5561023 - DNA, 13 bp, Homo sapiens
agatatcctctcc

SEQ ID NO: 5561024 - DNA, 13 bp, Homo sapiens
agatatctgcatg

SEQ ID NO: 5561025 - DNA, 15 bp, Homo sapiens
agatatctgcatgtg

SEQ ID NO: 5561026 - DNA, 13 bp, Homo sapiens
agatatcttttct

SEQ ID NO: 5561027 - DNA, 14 bp, Homo sapiens
agatatcttttctt

SEQ ID NO: 5561028 - DNA, 14 bp, Homo sapiens
agatatctttttat

SEQ ID NO: 5561029 - DNA, 14 bp, Homo sapiens
agatatctttttca

SEQ ID NO: 5561030 - DNA, 15 bp, Homo sapiens
agatatgaaagctga

SEQ ID NO: 5561031 - DNA, 17 bp, Homo sapiens
agatatgatatgtaaac

SEQ ID NO: 5561032 - DNA, 14 bp, Homo sapiens
agatatgattcaaa

SEQ ID NO: 5561033 - DNA, 16 bp, Homo sapiens
agatatgattcaaatg

SEQ ID NO: 5561034 - DNA, 13 bp, Homo sapiens
agatatgcaaaag

SEQ ID NO: 5561035 - DNA, 15 bp, Homo sapiens
agatatgcaataaat

SEQ ID NO: 5561036 - DNA, 21 bp, Homo sapiens
agatatgcaataaatattatt

SEQ ID NO: 5561037 - DNA, 22 bp, Homo sapiens
agatatgcacacacagatgcac

SEQ ID NO: 5561038 - DNA, 18 bp, Homo sapiens
agatatgcattcaagaga

SEQ ID NO: 5561039 - DNA, 12 bp, Homo sapiens
agatatgcctta

SEQ ID NO: 5561040 - DNA, 15 bp, Homo sapiens
agatatgccttaaaa

SEQ ID NO: 5561041 - DNA, 14 bp, Homo sapiens
agatatggaaacag

SEQ ID NO: 5561042 - DNA, 15 bp, Homo sapiens
agatatggaaacaga

SEQ ID NO: 5561043 - DNA, 20 bp, Homo sapiens
agatatggaaacagaagaca

SEQ ID NO: 5561044 - DNA, 22 bp, Homo sapiens
agatatggaccatcagtgactc

SEQ ID NO: 5561045 - DNA, 18 bp, Homo sapiens
agatatgtatatttttga

SEQ ID NO: 5561046 - DNA, 16 bp, Homo sapiens
agatatgtattacttt

SEQ ID NO: 5561047 - DNA, 15 bp, Homo sapiens
agatatgtattcttt

SEQ ID NO: 5561048 - DNA, 12 bp, Homo sapiens
agatatgtgaga

SEQ ID NO: 5561049 - DNA, 18 bp, Homo sapiens
agatatgtgtgtgtttgg

SEQ ID NO: 5561050 - DNA, 19 bp, Homo sapiens
agatattaaaatttggtgc

SEQ ID NO: 5561051 - DNA, 13 bp, Homo sapiens
agatattaaagat

SEQ ID NO: 5561052 - DNA, 14 bp, Homo sapiens
agatattaaagatt

SEQ ID NO: 5561053 - DNA, 13 bp, Homo sapiens
agatattaaattc

SEQ ID NO: 5561054 - DNA, 15 bp, Homo sapiens
agatattaccagttt

SEQ ID NO: 5561055 - DNA, 21 bp, Homo sapiens
agatattactacttaccattt

SEQ ID NO: 5561056 - DNA, 13 bp, Homo sapiens
agatattacttta

SEQ ID NO: 5561057 - DNA, 15 bp, Homo sapiens
agatattactttatc

SEQ ID NO: 5561058 - DNA, 17 bp, Homo sapiens
agatattactttatcac

SEQ ID NO: 5561059 - DNA, 19 bp, Homo sapiens
agatattataagggagagc

SEQ ID NO: 5561060 - DNA, 23 bp, Homo sapiens
agatattatgtataaaatgtaac

SEQ ID NO: 5561061 - DNA, 21 bp, Homo sapiens
agatattatgtatagaaaata

SEQ ID NO: 5561062 - DNA, 20 bp, Homo sapiens
agatattattcaccatgtaa

SEQ ID NO: 5561063 - DNA, 14 bp, Homo sapiens
agatattattgctt

SEQ ID NO: 5561064 - DNA, 16 bp, Homo sapiens
agatattatttaaatg

SEQ ID NO: 5561065 - DNA, 15 bp, Homo sapiens
agatattatttgtct

SEQ ID NO: 5561066 - DNA, 16 bp, Homo sapiens
agatattatttgtctt

SEQ ID NO: 5561067 - DNA, 21 bp, Homo sapiens
agatattattttagcttcagt

SEQ ID NO: 5561068 - DNA, 22 bp, Homo sapiens
agatattattttagcttcagtt

SEQ ID NO: 5561069 - DNA, 17 bp, Homo sapiens
agatattcaggtggcca

SEQ ID NO: 5561070 - DNA, 22 bp, Homo sapiens
agatattccagaccaaaataat

SEQ ID NO: 5561071 - DNA, 19 bp, Homo sapiens
agatattgaaggagaaaat

SEQ ID NO: 5561072 - DNA, 20 bp, Homo sapiens
agatattgaggccaagaata

SEQ ID NO: 5561073 - DNA, 19 bp, Homo sapiens
agatattgatcaaatatag

SEQ ID NO: 5561074 - DNA, 14 bp, Homo sapiens
agatattgcactag

SEQ ID NO: 5561075 - DNA, 16 bp, Homo sapiens
agatattggacaaaga

SEQ ID NO: 5561076 - DNA, 18 bp, Homo sapiens
agatattgggacacacat

SEQ ID NO: 5561077 - DNA, 18 bp, Homo sapiens
agatattgtacataaaag

SEQ ID NO: 5561078 - DNA, 12 bp, Homo sapiens
agatattgtatt

SEQ ID NO: 5561079 - DNA, 20 bp, Homo sapiens
agatattgtattatcatata

SEQ ID NO: 5561080 - DNA, 21 bp, Homo sapiens
agatattgtattatcatatat

SEQ ID NO: 5561081 - DNA, 22 bp, Homo sapiens
agatattgtattatcatatatg

SEQ ID NO: 5561082 - DNA, 22 bp, Homo sapiens
agatattgttttctgtaaataa

SEQ ID NO: 5561083 - DNA, 23 bp, Homo sapiens
agatattgttttctgtaaataac

SEQ ID NO: 5561084 - DNA, 21 bp, Homo sapiens
agatatttaaaagacaaacac

SEQ ID NO: 5561085 - DNA, 21 bp, Homo sapiens
agatatttaaagaatgagaaa

SEQ ID NO: 5561086 - DNA, 23 bp, Homo sapiens
agatatttaagtataaaatacaa

SEQ ID NO: 5561087 - DNA, 23 bp, Homo sapiens
agatatttacatgaattgcattt

SEQ ID NO: 5561088 - DNA, 19 bp, Homo sapiens
agatatttagctctgtgga

SEQ ID NO: 5561089 - DNA, 21 bp, Homo sapiens
agatatttaggaaaatgctta

SEQ ID NO: 5561090 - DNA, 17 bp, Homo sapiens
agatatttatatatatt

SEQ ID NO: 5561091 - DNA, 17 bp, Homo sapiens
agatatttatatgttat

SEQ ID NO: 5561092 - DNA, 17 bp, Homo sapiens
agatatttcaaacatca

SEQ ID NO: 5561093 - DNA, 24 bp, Homo sapiens
agatatttcaaacatcagctgaat

SEQ ID NO: 5561094 - DNA, 17 bp, Homo sapiens
agatatttcaagctcat

SEQ ID NO: 5561095 - DNA, 12 bp, Homo sapiens
agatatttcatg

SEQ ID NO: 5561096 - DNA, 15 bp, Homo sapiens
agatatttcatgtgc

SEQ ID NO: 5561097 - DNA, 15 bp, Homo sapiens
agatatttgatgtag

SEQ ID NO: 5561098 - DNA, 11 bp, Homo sapiens
agatatttggc

SEQ ID NO: 5561099 - DNA, 16 bp, Homo sapiens
agatatttggcttaaa

SEQ ID NO: 5561100 - DNA, 14 bp, Homo sapiens
agatatttgtattt

SEQ ID NO: 5561101 - DNA, 21 bp, Homo sapiens
agatatttgtatttatttcca

SEQ ID NO: 5561102 - DNA, 23 bp, Homo sapiens
agatattttatatgtatggatct

SEQ ID NO: 5561103 - DNA, 21 bp, Homo sapiens
agatattttcatatttaaagc

SEQ ID NO: 5561104 - DNA, 12 bp, Homo sapiens
agatattttcca

SEQ ID NO: 5561105 - DNA, 13 bp, Homo sapiens
agatattttccat

SEQ ID NO: 5561106 - DNA, 18 bp, Homo sapiens
agatattttccatatatt

SEQ ID NO: 5561107 - DNA, 22 bp, Homo sapiens
agatattttccatatattggca

SEQ ID NO: 5561108 - DNA, 14 bp, Homo sapiens
agatattttgcacg

SEQ ID NO: 5561109 - DNA, 13 bp, Homo sapiens
agatattttgtaa

SEQ ID NO: 5561110 - DNA, 19 bp, Homo sapiens
agatatttttatctttata

SEQ ID NO: 5561111 - DNA, 16 bp, Homo sapiens
agatatttttattcaa

SEQ ID NO: 5561112 - DNA, 13 bp, Homo sapiens
agatatttttcat

SEQ ID NO: 5561113 - DNA, 12 bp, Homo sapiens
agatatttttgt

SEQ ID NO: 5561114 - DNA, 23 bp, Homo sapiens
agatatttttgtacgttatatat

SEQ ID NO: 5561115 - DNA, 18 bp, Homo sapiens
agatattttttcagaaat

SEQ ID NO: 5561116 - DNA, 21 bp, Homo sapiens
agatattttttcagaaatatg

SEQ ID NO: 5561117 - DNA, 22 bp, Homo sapiens
agatattttttcagaaatatgt

SEQ ID NO: 5561118 - DNA, 14 bp, Homo sapiens
agatcaaaaaggct

SEQ ID NO: 5561119 - DNA, 18 bp, Homo sapiens
agatcaaaaggttaataa

SEQ ID NO: 5561120 - DNA, 12 bp, Homo sapiens
agatcaaaataa

SEQ ID NO: 5561121 - DNA, 13 bp, Homo sapiens
agatcaaagatga

SEQ ID NO: 5561122 - DNA, 14 bp, Homo sapiens
agatcaaatacttt

SEQ ID NO: 5561123 - DNA, 20 bp, Homo sapiens
agatcaaatactttaaagga

SEQ ID NO: 5561124 - DNA, 14 bp, Homo sapiens
agatcaaatagttg

SEQ ID NO: 5561125 - DNA, 19 bp, Homo sapiens
agatcaaatagttgcatag

SEQ ID NO: 5561126 - DNA, 14 bp, Homo sapiens
agatcaaatttcac

SEQ ID NO: 5561127 - DNA, 22 bp, Homo sapiens
agatcaacacttttctccaggg

SEQ ID NO: 5561128 - DNA, 19 bp, Homo sapiens
agatcaaccccttcgctcc

SEQ ID NO: 5561129 - DNA, 22 bp, Homo sapiens
agatcaagaggcaggttagaag

SEQ ID NO: 5561130 - DNA, 16 bp, Homo sapiens
agatcaagcctgcctc

SEQ ID NO: 5561131 - DNA, 17 bp, Homo sapiens
agatcaagcctgcctca

SEQ ID NO: 5561132 - DNA, 14 bp, Homo sapiens
agatcaagctgtga

SEQ ID NO: 5561133 - DNA, 14 bp, Homo sapiens
agatcaatgtgacg

SEQ ID NO: 5561134 - DNA, 20 bp, Homo sapiens
agatcaattaattcttaata

SEQ ID NO: 5561135 - DNA, 22 bp, Homo sapiens
agatcaattccctctctcagca

SEQ ID NO: 5561136 - DNA, 19 bp, Homo sapiens
agatcacaccaatttagaa

SEQ ID NO: 5561137 - DNA, 18 bp, Homo sapiens
agatcacaccactgtact

SEQ ID NO: 5561138 - DNA, 14 bp, Homo sapiens
agatcacagcccca

SEQ ID NO: 5561139 - DNA, 17 bp, Homo sapiens
agatcacagccccaccc

SEQ ID NO: 5561140 - DNA, 23 bp, Homo sapiens
agatcacagccccacccttgtcc

SEQ ID NO: 5561141 - DNA, 21 bp, Homo sapiens
agatcacagcctccagggccc

SEQ ID NO: 5561142 - DNA, 18 bp, Homo sapiens
agatcacataccagagtc

SEQ ID NO: 5561143 - DNA, 19 bp, Homo sapiens
agatcacataccagagtct

SEQ ID NO: 5561144 - DNA, 19 bp, Homo sapiens
agatcacatcttaaattca

SEQ ID NO: 5561145 - DNA, 14 bp, Homo sapiens
agatcaccagcccg

SEQ ID NO: 5561146 - DNA, 16 bp, Homo sapiens
agatcaccagcccggc

SEQ ID NO: 5561147 - DNA, 21 bp, Homo sapiens
agatcaccagcccggcctgct

SEQ ID NO: 5561148 - DNA, 14 bp, Homo sapiens
agatcaccccagcc

SEQ ID NO: 5561149 - DNA, 16 bp, Homo sapiens
agatcaccttgtattc

SEQ ID NO: 5561150 - DNA, 13 bp, Homo sapiens
agatcacgaggtc

SEQ ID NO: 5561151 - DNA, 15 bp, Homo sapiens
agatcacgccactgc

SEQ ID NO: 5561152 - DNA, 15 bp, Homo sapiens
agatcacgctccccg

SEQ ID NO: 5561153 - DNA, 15 bp, Homo sapiens
agatcactactgcag

SEQ ID NO: 5561154 - DNA, 14 bp, Homo sapiens
agatcactgaactt

SEQ ID NO: 5561155 - DNA, 16 bp, Homo sapiens
agatgaccataaccac

SEQ ID NO: 5561156 - DNA, 20 bp, Homo sapiens
agatgaccataaccactgaa

SEQ ID NO: 5561157 - DNA, 23 bp, Homo sapiens
agatgaccataattttttttaaa

SEQ ID NO: 5561158 - DNA, 22 bp, Homo sapiens
agatgacccccaggtattgtct

SEQ ID NO: 5561159 - DNA, 23 bp, Homo sapiens
agatgacccccaggtattgtctt

SEQ ID NO: 5561160 - DNA, 11 bp, Homo sapiens
agatgacccct

SEQ ID NO: 5561161 - DNA, 13 bp, Homo sapiens
agatgacccctac

SEQ ID NO: 5561162 - DNA, 22 bp, Homo sapiens
agatgacccctaccccctcatc

SEQ ID NO: 5561163 - DNA, 16 bp, Homo sapiens
agatgaccgtgtacaa

SEQ ID NO: 5561164 - DNA, 23 bp, Homo sapiens
agatgacctcgtactcaggagcc

SEQ ID NO: 5561165 - DNA, 15 bp, Homo sapiens
agatgacctcgttcc

SEQ ID NO: 5561166 - DNA, 16 bp, Homo sapiens
agatgacctgaggaaa

SEQ ID NO: 5561167 - DNA, 15 bp, Homo sapiens
agatgaccttttgga

SEQ ID NO: 5561168 - DNA, 15 bp, Homo sapiens
agatgactattactt

SEQ ID NO: 5561169 - DNA, 21 bp, Homo sapiens
agatgactcactccattccta

SEQ ID NO: 5561170 - DNA, 13 bp, Homo sapiens
agatgactggaaa

SEQ ID NO: 5561171 - DNA, 16 bp, Homo sapiens
agatgactggaaacaa

SEQ ID NO: 5561172 - DNA, 14 bp, Homo sapiens
agatgacttgaggc

SEQ ID NO: 5561173 - DNA, 17 bp, Homo sapiens
agatgactttgcagatg

SEQ ID NO: 5561174 - DNA, 13 bp, Homo sapiens
agatgagaaagct

SEQ ID NO: 5561175 - DNA, 22 bp, Homo sapiens
agatgagaaagcttttattcct

SEQ ID NO: 5561176 - DNA, 20 bp, Homo sapiens
agatgagaaatgatgaaaag

SEQ ID NO: 5561177 - DNA, 13 bp, Homo sapiens
agatgagaacaaa

SEQ ID NO: 5561178 - DNA, 17 bp, Homo sapiens
agatgagaacagataaa

SEQ ID NO: 5561179 - DNA, 22 bp, Homo sapiens
agatgagatctagacgccccca

SEQ ID NO: 5561180 - DNA, 16 bp, Homo sapiens
agatgagatgaccacc

SEQ ID NO: 5561181 - DNA, 17 bp, Homo sapiens
agatgagatgaccacca

SEQ ID NO: 5561182 - DNA, 18 bp, Homo sapiens
agatgagatttgccagca

SEQ ID NO: 5561183 - DNA, 21 bp, Homo sapiens
agatgagatttgccagcacag

SEQ ID NO: 5561184 - DNA, 19 bp, Homo sapiens
agatgagcaaccacattta

SEQ ID NO: 5561185 - DNA, 21 bp, Homo sapiens
agatgagcaaccacatttaga

SEQ ID NO: 5561186 - DNA, 13 bp, Homo sapiens
agatgagcaagga

SEQ ID NO: 5561187 - DNA, 19 bp, Homo sapiens
agatgagcaaggacattgc

SEQ ID NO: 5561188 - DNA, 22 bp, Homo sapiens
agatgagcaaggacattgcccc

SEQ ID NO: 5561189 - DNA, 16 bp, Homo sapiens
agatgagcaggagctt

SEQ ID NO: 5561190 - DNA, 21 bp, Homo sapiens
agatgagccccacgtggagct

SEQ ID NO: 5561191 - DNA, 12 bp, Homo sapiens
agatgagcctgg

SEQ ID NO: 5561192 - DNA, 20 bp, Homo sapiens
agatgagctttctttttaaa

SEQ ID NO: 5561193 - DNA, 16 bp, Homo sapiens
agatgagcttttctag

SEQ ID NO: 5561194 - DNA, 18 bp, Homo sapiens
agatgaggagtaaaattc

SEQ ID NO: 5561195 - DNA, 21 bp, Homo sapiens
agatgaggcaaacagcaagag

SEQ ID NO: 5561196 - DNA, 16 bp, Homo sapiens
agatgaggccagacca

SEQ ID NO: 5561197 - DNA, 21 bp, Homo sapiens
agatgaggccagaccatggac

SEQ ID NO: 5561198 - DNA, 22 bp, Homo sapiens
agatgaggccagaccatggaca

SEQ ID NO: 5561199 - DNA, 12 bp, Homo sapiens
agatgaggccct

SEQ ID NO: 5561200 - DNA, 15 bp, Homo sapiens
agatgaggccctgca

SEQ ID NO: 5561201 - DNA, 20 bp, Homo sapiens
agatgagggatgggcctggc

SEQ ID NO: 5561202 - DNA, 13 bp, Homo sapiens
agatgagggctgg

SEQ ID NO: 5561203 - DNA, 16 bp, Homo sapiens
agatgaggggccactg

SEQ ID NO: 5561204 - DNA, 16 bp, Homo sapiens
agatgagggtgactgt

SEQ ID NO: 5561205 - DNA, 13 bp, Homo sapiens
agatgagtcctgt

SEQ ID NO: 5561206 - DNA, 16 bp, Homo sapiens
agatgagtgggcttcg

SEQ ID NO: 5561207 - DNA, 15 bp, Homo sapiens
agatgagtgtgtgtt

SEQ ID NO: 5561208 - DNA, 16 bp, Homo sapiens
agatgagttgcagttt

SEQ ID NO: 5561209 - DNA, 19 bp, Homo sapiens
agatgataaatatttatgc

SEQ ID NO: 5561210 - DNA, 20 bp, Homo sapiens
agatgatacatccaaagcag

SEQ ID NO: 5561211 - DNA, 13 bp, Homo sapiens
agatgatattaca

SEQ ID NO: 5561212 - DNA, 19 bp, Homo sapiens
agatgatattacaggactg

SEQ ID NO: 5561213 - DNA, 16 bp, Homo sapiens
agatgatcaacataat

SEQ ID NO: 5561214 - DNA, 22 bp, Homo sapiens
agatgatcagtggacagtctgc

SEQ ID NO: 5561215 - DNA, 13 bp, Homo sapiens
agatgatcatttg

SEQ ID NO: 5561216 - DNA, 13 bp, Homo sapiens
agatgatccttgc

SEQ ID NO: 5561217 - DNA, 18 bp, Homo sapiens
agatgatccttgcacaga

SEQ ID NO: 5561218 - DNA, 22 bp, Homo sapiens
agatgatctctccacggtagca

SEQ ID NO: 5561219 - DNA, 11 bp, Homo sapiens
agatgatgatg

SEQ ID NO: 5561220 - DNA, 19 bp, Homo sapiens
agatgatgatgatctttaa

SEQ ID NO: 5561221 - DNA, 15 bp, Homo sapiens
agatgatgatgttaa

SEQ ID NO: 5561222 - DNA, 21 bp, Homo sapiens
agatgatgctcagttttaaac

SEQ ID NO: 5561223 - DNA, 17 bp, Homo sapiens
agatgatgctttggaag

SEQ ID NO: 5561224 - DNA, 16 bp, Homo sapiens
agatgatggatgccaa

SEQ ID NO: 5561225 - DNA, 18 bp, Homo sapiens
agatgatggccatttcta

SEQ ID NO: 5561226 - DNA, 18 bp, Homo sapiens
agatgatggggtcagcag

SEQ ID NO: 5561227 - DNA, 18 bp, Homo sapiens
agatgatgtaaaaatatg

SEQ ID NO: 5561228 - DNA, 12 bp, Homo sapiens
agatgatgtgat

SEQ ID NO: 5561229 - DNA, 23 bp, Homo sapiens
agatgatgtgatggaacacacac

SEQ ID NO: 5561230 - DNA, 17 bp, Homo sapiens
agatgattcaaagtagt

SEQ ID NO: 5561231 - DNA, 21 bp, Homo sapiens
agatgattctggctgaaaaag

SEQ ID NO: 5561232 - DNA, 13 bp, Homo sapiens
agatgattgaata

SEQ ID NO: 5561233 - DNA, 21 bp, Homo sapiens
agatgattgttcttttgtttc

SEQ ID NO: 5561234 - DNA, 22 bp, Homo sapiens
agatgattgttcttttgtttca

SEQ ID NO: 5561235 - DNA, 19 bp, Homo sapiens
agatgatttaaaagggaag

SEQ ID NO: 5561236 - DNA, 21 bp, Homo sapiens
agatgatttaatgttgatttt

SEQ ID NO: 5561237 - DNA, 15 bp, Homo sapiens
agatgatttaattct

SEQ ID NO: 5561238 - DNA, 17 bp, Homo sapiens
agatgatttaattctta

SEQ ID NO: 5561239 - DNA, 20 bp, Homo sapiens
agatgatttcagttctagga

SEQ ID NO: 5561240 - DNA, 23 bp, Homo sapiens
agatgatttcagttctaggaaaa

SEQ ID NO: 5561241 - DNA, 16 bp, Homo sapiens
agatgatttgggcaga

SEQ ID NO: 5561242 - DNA, 17 bp, Homo sapiens
agatgattttttgaaag

SEQ ID NO: 5561243 - DNA, 20 bp, Homo sapiens
agatgattttttgaaagtta

SEQ ID NO: 5561244 - DNA, 20 bp, Homo sapiens
agatgcaaagaggcaagagg

SEQ ID NO: 5561245 - DNA, 16 bp, Homo sapiens
agatgcaaatgtcaca

SEQ ID NO: 5561246 - DNA, 14 bp, Homo sapiens
agatgcaacctcac

SEQ ID NO: 5561247 - DNA, 16 bp, Homo sapiens
agatgcaagaaggagg

SEQ ID NO: 5561248 - DNA, 13 bp, Homo sapiens
agatgcaagatat

SEQ ID NO: 5561249 - DNA, 18 bp, Homo sapiens
agatgcaaggaccaggac

SEQ ID NO: 5561250 - DNA, 20 bp, Homo sapiens
agatgcaaggaccaggactc

SEQ ID NO: 5561251 - DNA, 15 bp, Homo sapiens
agatgcaaggtgctg

SEQ ID NO: 5561252 - DNA, 16 bp, Homo sapiens
agatgcaaggtgctgg

SEQ ID NO: 5561253 - DNA, 15 bp, Homo sapiens
agatgcaagtctctt

SEQ ID NO: 5561254 - DNA, 16 bp, Homo sapiens
agatgcaagtctcttg

SEQ ID NO: 5561255 - DNA, 18 bp, Homo sapiens
agatgcaatgtgctactg

SEQ ID NO: 5561256 - DNA, 16 bp, Homo sapiens
agatgcacatgagctg

SEQ ID NO: 5561257 - DNA, 18 bp, Homo sapiens
agatgcaccaccaagcca

SEQ ID NO: 5561258 - DNA, 22 bp, Homo sapiens
agatgcaccacccatggagagg

SEQ ID NO: 5561259 - DNA, 14 bp, Homo sapiens
agatgcaccagccc

SEQ ID NO: 5561260 - DNA, 21 bp, Homo sapiens
agatgcacgtggggcccactg

SEQ ID NO: 5561261 - DNA, 23 bp, Homo sapiens
agatgcactatatgtttacacaa

SEQ ID NO: 5561262 - DNA, 22 bp, Homo sapiens
agatgcactgaaaacttagcca

SEQ ID NO: 5561263 - DNA, 15 bp, Homo sapiens
agatgcactttgctt

SEQ ID NO: 5561264 - DNA, 14 bp, Homo sapiens
agatgcagaaaaag

SEQ ID NO: 5561265 - DNA, 18 bp, Homo sapiens
agatgcagagagccattt

SEQ ID NO: 5561266 - DNA, 19 bp, Homo sapiens
agatgcagcaaaatgtgaa

SEQ ID NO: 5561267 - DNA, 21 bp, Homo sapiens
agatgcagcaaaatgtgaatg

SEQ ID NO: 5561268 - DNA, 22 bp, Homo sapiens
agatgcagccaccacatccctt

SEQ ID NO: 5561269 - DNA, 11 bp, Homo sapiens
agatgcagcct

SEQ ID NO: 5561270 - DNA, 17 bp, Homo sapiens
agatgcagctactggaa

SEQ ID NO: 5561271 - DNA, 13 bp, Homo sapiens
agatgcagctctt

SEQ ID NO: 5561272 - DNA, 15 bp, Homo sapiens
agatgcaggacagga

SEQ ID NO: 5561273 - DNA, 19 bp, Homo sapiens
agatgcaggacaggaggcg

SEQ ID NO: 5561274 - DNA, 16 bp, Homo sapiens
agatgcagggcagtca

SEQ ID NO: 5561275 - DNA, 17 bp, Homo sapiens
agatgcagtcctcagga

SEQ ID NO: 5561276 - DNA, 16 bp, Homo sapiens
agatgcagttcaaaaa

SEQ ID NO: 5561277 - DNA, 17 bp, Homo sapiens
agatgcagttctgaaga

SEQ ID NO: 5561278 - DNA, 15 bp, Homo sapiens
agatgcatatagaca

SEQ ID NO: 5561279 - DNA, 21 bp, Homo sapiens
agatgcatcatctcttcctca

SEQ ID NO: 5561280 - DNA, 21 bp, Homo sapiens
agatgcatcgggaaagaagaa

SEQ ID NO: 5561281 - DNA, 17 bp, Homo sapiens
agatgcatgacttgtgt

SEQ ID NO: 5561282 - DNA, 21 bp, Homo sapiens
agatgcatgatccagctgtgt

SEQ ID NO: 5561283 - DNA, 21 bp, Homo sapiens
agatgcatgttactgccaaaa

SEQ ID NO: 5561284 - DNA, 18 bp, Homo sapiens
agatgcattttaaatgtc

SEQ ID NO: 5561285 - DNA, 22 bp, Homo sapiens
agatgcattttaaatgtctata

SEQ ID NO: 5561286 - DNA, 17 bp, Homo sapiens
agatgccaacagacact

SEQ ID NO: 5561287 - DNA, 18 bp, Homo sapiens
agatgccaacttcccaca

SEQ ID NO: 5561288 - DNA, 22 bp, Homo sapiens
agatgccaacttcccacacggc

SEQ ID NO: 5561289 - DNA, 14 bp, Homo sapiens
agatgccaaggagg

SEQ ID NO: 5561290 - DNA, 17 bp, Homo sapiens
agatgccaccctagcca

SEQ ID NO: 5561291 - DNA, 17 bp, Homo sapiens
agatgccacttctaaga

SEQ ID NO: 5561292 - DNA, 20 bp, Homo sapiens
agatgccacttctaagaaaa

SEQ ID NO: 5561293 - DNA, 12 bp, Homo sapiens
agatgccagagc

SEQ ID NO: 5561294 - DNA, 16 bp, Homo sapiens
agatgccagcccttca

SEQ ID NO: 5561295 - DNA, 19 bp, Homo sapiens
agatgccagcccttcagga

SEQ ID NO: 5561296 - DNA, 14 bp, Homo sapiens
agatgccagtgaag

SEQ ID NO: 5561297 - DNA, 13 bp, Homo sapiens
agatgccatgata

SEQ ID NO: 5561298 - DNA, 18 bp, Homo sapiens
agatgccattcatagaga

SEQ ID NO: 5561299 - DNA, 22 bp, Homo sapiens
agatgcccagagggcccaggca

SEQ ID NO: 5561300 - DNA, 12 bp, Homo sapiens
agatgccccaga

SEQ ID NO: 5561301 - DNA, 17 bp, Homo sapiens
agatgccccagggatgg

SEQ ID NO: 5561302 - DNA, 23 bp, Homo sapiens
agatgccccattccttgcgcctc

SEQ ID NO: 5561303 - DNA, 16 bp, Homo sapiens
agatgccccctccagg

SEQ ID NO: 5561304 - DNA, 19 bp, Homo sapiens
agatgccccctccaggaga

SEQ ID NO: 5561305 - DNA, 21 bp, Homo sapiens
agatgccccctccaggagaga

SEQ ID NO: 5561306 - DNA, 23 bp, Homo sapiens
agatgccccctccaggagagagc

SEQ ID NO: 5561307 - DNA, 11 bp, Homo sapiens
agatgccctga

SEQ ID NO: 5561308 - DNA, 14 bp, Homo sapiens
agatgccctgctag

SEQ ID NO: 5561309 - DNA, 14 bp, Homo sapiens
agatgcccttgctg

SEQ ID NO: 5561310 - DNA, 16 bp, Homo sapiens
agatgcccttgctggg

SEQ ID NO: 5561311 - DNA, 20 bp, Homo sapiens
agatgccggagccccaagac

SEQ ID NO: 5561312 - DNA, 20 bp, Homo sapiens
agatgcctacttttggcctc

SEQ ID NO: 5561313 - DNA, 13 bp, Homo sapiens
agatgcctcagta

SEQ ID NO: 5561314 - DNA, 15 bp, Homo sapiens
agatgcctccaccgc

SEQ ID NO: 5561315 - DNA, 21 bp, Homo sapiens
agatgcctccaccgctgccta

SEQ ID NO: 5561316 - DNA, 19 bp, Homo sapiens
agatgcctccctgaccctg

SEQ ID NO: 5561317 - DNA, 18 bp, Homo sapiens
agatgcctcttaggactg

SEQ ID NO: 5561318 - DNA, 14 bp, Homo sapiens
agatgcctgatcag

SEQ ID NO: 5561319 - DNA, 21 bp, Homo sapiens
agatgcctgatttcattcctc

SEQ ID NO: 5561320 - DNA, 11 bp, Homo sapiens
agatgcctggg

SEQ ID NO: 5561321 - DNA, 15 bp, Homo sapiens
agatgcctgggcctg

SEQ ID NO: 5561322 - DNA, 13 bp, Homo sapiens
agatgcctggtga

SEQ ID NO: 5561323 - DNA, 19 bp, Homo sapiens
agatgcctgttaatttata

SEQ ID NO: 5561324 - DNA, 21 bp, Homo sapiens
agatgccttctagattcactg

SEQ ID NO: 5561325 - DNA, 21 bp, Homo sapiens
agatgcgaaccacccaaaaca

SEQ ID NO: 5561326 - DNA, 22 bp, Homo sapiens
agatgcgaaccacccaaaacac

SEQ ID NO: 5561327 - DNA, 22 bp, Homo sapiens
agatgcgagcgctatcttcaca

SEQ ID NO: 5561328 - DNA, 14 bp, Homo sapiens
agatgcgcaaagag

SEQ ID NO: 5561329 - DNA, 18 bp, Homo sapiens
agatgcgcagccccatct

SEQ ID NO: 5561330 - DNA, 15 bp, Homo sapiens
agatgcgtcccaaga

SEQ ID NO: 5561331 - DNA, 17 bp, Homo sapiens
agatgcgtgcccagctc

SEQ ID NO: 5561332 - DNA, 18 bp, Homo sapiens
agatggggtctgtaaaat

SEQ ID NO: 5561333 - DNA, 19 bp, Homo sapiens
agatggggtctgtgactgg

SEQ ID NO: 5561334 - DNA, 16 bp, Homo sapiens
agatgggtattaaact

SEQ ID NO: 5561335 - DNA, 17 bp, Homo sapiens
agatgggtattaaactt

SEQ ID NO: 5561336 - DNA, 18 bp, Homo sapiens
agatgggtattaaacttg

SEQ ID NO: 5561337 - DNA, 20 bp, Homo sapiens
agatgggtctgatattaatc

SEQ ID NO: 5561338 - DNA, 21 bp, Homo sapiens
agatgggtctgatattaatca

SEQ ID NO: 5561339 - DNA, 21 bp, Homo sapiens
agatgggtgaaggctggcatg

SEQ ID NO: 5561340 - DNA, 22 bp, Homo sapiens
agatgggtgcttggaggaagga

SEQ ID NO: 5561341 - DNA, 22 bp, Homo sapiens
agatgggtgggaggagatgaaa

SEQ ID NO: 5561342 - DNA, 15 bp, Homo sapiens
agatgggttcttagc

SEQ ID NO: 5561343 - DNA, 18 bp, Homo sapiens
agatgggttgagtttgct

SEQ ID NO: 5561344 - DNA, 22 bp, Homo sapiens
agatgggtttggggctggcccc

SEQ ID NO: 5561345 - DNA, 22 bp, Homo sapiens
agatgggttttgttaggggtgg

SEQ ID NO: 5561346 - DNA, 18 bp, Homo sapiens
agatggtaaaccagatct

SEQ ID NO: 5561347 - DNA, 20 bp, Homo sapiens
agatggtaatctacagctca

SEQ ID NO: 5561348 - DNA, 16 bp, Homo sapiens
agatggtaatcttttc

SEQ ID NO: 5561349 - DNA, 22 bp, Homo sapiens
agatggtacaacctttattctt

SEQ ID NO: 5561350 - DNA, 21 bp, Homo sapiens
agatggtactgctgaggtccc

SEQ ID NO: 5561351 - DNA, 22 bp, Homo sapiens
agatggtagaaactttggaagt

SEQ ID NO: 5561352 - DNA, 13 bp, Homo sapiens
agatggtagcaga

SEQ ID NO: 5561353 - DNA, 15 bp, Homo sapiens
agatggtagcagata

SEQ ID NO: 5561354 - DNA, 17 bp, Homo sapiens
agatggtagttgagggt

SEQ ID NO: 5561355 - DNA, 14 bp, Homo sapiens
agatggtatgaaat

SEQ ID NO: 5561356 - DNA, 19 bp, Homo sapiens
agatggtcacgcacctggg

SEQ ID NO: 5561357 - DNA, 21 bp, Homo sapiens
agatggtcacgcacctgggtg

SEQ ID NO: 5561358 - DNA, 19 bp, Homo sapiens
agatggtcatatttaaaca

SEQ ID NO: 5561359 - DNA, 20 bp, Homo sapiens
agatggtccatttgttcctg

SEQ ID NO: 5561360 - DNA, 14 bp, Homo sapiens
agatggtccgtgcc

SEQ ID NO: 5561361 - DNA, 19 bp, Homo sapiens
agatggtccgtgcccaggc

SEQ ID NO: 5561362 - DNA, 13 bp, Homo sapiens
agatggtctgcat

SEQ ID NO: 5561363 - DNA, 22 bp, Homo sapiens
agatggtgaggctgtcagtgta

SEQ ID NO: 5561364 - DNA, 15 bp, Homo sapiens
agatggtgccccctg

SEQ ID NO: 5561365 - DNA, 14 bp, Homo sapiens
agatggtgctgaga

SEQ ID NO: 5561366 - DNA, 17 bp, Homo sapiens
agatggtgctgagaagc

SEQ ID NO: 5561367 - DNA, 11 bp, Homo sapiens
agatggtggat

SEQ ID NO: 5561368 - DNA, 15 bp, Homo sapiens
agatggtggccacag

SEQ ID NO: 5561369 - DNA, 20 bp, Homo sapiens
agatggtggccacagactga

SEQ ID NO: 5561370 - DNA, 17 bp, Homo sapiens
agatggtggctgtgtct

SEQ ID NO: 5561371 - DNA, 23 bp, Homo sapiens
agatggtggctgtgtctctcccc

SEQ ID NO: 5561372 - DNA, 12 bp, Homo sapiens
agatggtgggat

SEQ ID NO: 5561373 - DNA, 22 bp, Homo sapiens
agatggtgtgggtgtcctgcct

SEQ ID NO: 5561374 - DNA, 19 bp, Homo sapiens
agatggttaaaaaggccaa

SEQ ID NO: 5561375 - DNA, 21 bp, Homo sapiens
agatggttaaaaaggccaaag

SEQ ID NO: 5561376 - DNA, 17 bp, Homo sapiens
agatggttcaaagatac

SEQ ID NO: 5561377 - DNA, 15 bp, Homo sapiens
agatggttccctttg

SEQ ID NO: 5561378 - DNA, 16 bp, Homo sapiens
agatggtttcaattca

SEQ ID NO: 5561379 - DNA, 11 bp, Homo sapiens
agatggtttcc

SEQ ID NO: 5561380 - DNA, 13 bp, Homo sapiens
agatggttttgat

SEQ ID NO: 5561381 - DNA, 17 bp, Homo sapiens
agatgtaaaatgagttt

SEQ ID NO: 5561382 - DNA, 21 bp, Homo sapiens
agatgtaaatcgggaaggatg

SEQ ID NO: 5561383 - DNA, 22 bp, Homo sapiens
agatgtaaatcgggaaggatgg

SEQ ID NO: 5561384 - DNA, 20 bp, Homo sapiens
agatgtaaattgaagaagcc

SEQ ID NO: 5561385 - DNA, 17 bp, Homo sapiens
agatgtaagaagctaaa

SEQ ID NO: 5561386 - DNA, 17 bp, Homo sapiens
agatgtaatgacagaga

SEQ ID NO: 5561387 - DNA, 18 bp, Homo sapiens
agatgtaatgacagagag

SEQ ID NO: 5561388 - DNA, 13 bp, Homo sapiens
agatgtaatgtag

SEQ ID NO: 5561389 - DNA, 23 bp, Homo sapiens
agatgtaatgttttctttgcaaa

SEQ ID NO: 5561390 - DNA, 22 bp, Homo sapiens
agatgtaattgtttgtctttaa

SEQ ID NO: 5561391 - DNA, 14 bp, Homo sapiens
agatgtaattttgt

SEQ ID NO: 5561392 - DNA, 17 bp, Homo sapiens
agatgtaattttgtgta

SEQ ID NO: 5561393 - DNA, 21 bp, Homo sapiens
agatgtacatagagatctatt

SEQ ID NO: 5561394 - DNA, 16 bp, Homo sapiens
agatgtacatctttca

SEQ ID NO: 5561395 - DNA, 12 bp, Homo sapiens
agatgtacattt

SEQ ID NO: 5561396 - DNA, 18 bp, Homo sapiens
agatgtacatttaataat

SEQ ID NO: 5561397 - DNA, 22 bp, Homo sapiens
agatgtactataacatagaatt

SEQ ID NO: 5561398 - DNA, 17 bp, Homo sapiens
agatgtactgagaggag

SEQ ID NO: 5561399 - DNA, 22 bp, Homo sapiens
agatgtactgagaggaggggta

SEQ ID NO: 5561400 - DNA, 13 bp, Homo sapiens
agatgtactgcaa

SEQ ID NO: 5561401 - DNA, 20 bp, Homo sapiens
agatgtagacagttgggttt

SEQ ID NO: 5561402 - DNA, 16 bp, Homo sapiens
agatgtagaggagaaa

SEQ ID NO: 5561403 - DNA, 19 bp, Homo sapiens
agatgtagataaactcaga

SEQ ID NO: 5561404 - DNA, 22 bp, Homo sapiens
agatgtagcaaaccctgtcaaa

SEQ ID NO: 5561405 - DNA, 15 bp, Homo sapiens
agatgtagcattgtt

SEQ ID NO: 5561406 - DNA, 21 bp, Homo sapiens
agatgtagcattgttccacac

SEQ ID NO: 5561407 - DNA, 15 bp, Homo sapiens
agatgtaggagggac

SEQ ID NO: 5561408 - DNA, 16 bp, Homo sapiens
agatgtaggagggact

SEQ ID NO: 5561409 - DNA, 14 bp, Homo sapiens
agatgtatcattaa

SEQ ID NO: 5561410 - DNA, 13 bp, Homo sapiens
agatgtatgcaca

SEQ ID NO: 5561411 - DNA, 20 bp, Homo sapiens
agatgtatgcacacacatat

SEQ ID NO: 5561412 - DNA, 23 bp, Homo sapiens
agatgtatgcacacacatatatt

SEQ ID NO: 5561413 - DNA, 22 bp, Homo sapiens
agatgtatgctttgaatgcaaa

SEQ ID NO: 5561414 - DNA, 16 bp, Homo sapiens
agatgtattatgcaaa

SEQ ID NO: 5561415 - DNA, 21 bp, Homo sapiens
agatgtattatgcaaagtacc

SEQ ID NO: 5561416 - DNA, 17 bp, Homo sapiens
agatgtattcagagcca

SEQ ID NO: 5561417 - DNA, 16 bp, Homo sapiens
agatgtattctttata

SEQ ID NO: 5561418 - DNA, 15 bp, Homo sapiens
agatgtattgactgt

SEQ ID NO: 5561419 - DNA, 16 bp, Homo sapiens
agatgtattgactgta

SEQ ID NO: 5561420 - DNA, 14 bp, Homo sapiens
agatgtcaaaatgt

SEQ ID NO: 5561421 - DNA, 19 bp, Homo sapiens
agatgtcaaatatctcaga

SEQ ID NO: 5561422 - DNA, 21 bp, Homo sapiens
agatgtcaataggaattgcat

SEQ ID NO: 5561423 - DNA, 20 bp, Homo sapiens
agatgtcagccgagccgggc

SEQ ID NO: 5561424 - DNA, 16 bp, Homo sapiens
agatgtcatcccattg

SEQ ID NO: 5561425 - DNA, 13 bp, Homo sapiens
agatgtccagggc

SEQ ID NO: 5561426 - DNA, 13 bp, Homo sapiens
agatgtcccacag

SEQ ID NO: 5561427 - DNA, 12 bp, Homo sapiens
agatgtccctga

SEQ ID NO: 5561428 - DNA, 15 bp, Homo sapiens
agatgtccctgaagt

SEQ ID NO: 5561429 - DNA, 21 bp, Homo sapiens
agatgtccctttcttggccag

SEQ ID NO: 5561430 - DNA, 16 bp, Homo sapiens
agatgtccgtctctct

SEQ ID NO: 5561431 - DNA, 17 bp, Homo sapiens
agatgtcgctgggtcct

SEQ ID NO: 5561432 - DNA, 22 bp, Homo sapiens
agatgtcgctgggtcctctgca

SEQ ID NO: 5561433 - DNA, 23 bp, Homo sapiens
agatgtcgtggactccagctcta

SEQ ID NO: 5561434 - DNA, 21 bp, Homo sapiens
agatgtctatgtagctgaaaa

SEQ ID NO: 5561435 - DNA, 14 bp, Homo sapiens
agatgtctcaaaaa

SEQ ID NO: 5561436 - DNA, 21 bp, Homo sapiens
agatgtctcaaaaatccttat

SEQ ID NO: 5561437 - DNA, 19 bp, Homo sapiens
agatgtctcagagccttcc

SEQ ID NO: 5561438 - DNA, 20 bp, Homo sapiens
agatgtctcctcaagcctgt

SEQ ID NO: 5561439 - DNA, 22 bp, Homo sapiens
agatgtctctggcgtgtgggta

SEQ ID NO: 5561440 - DNA, 15 bp, Homo sapiens
agatgtctctggggc

SEQ ID NO: 5561441 - DNA, 14 bp, Homo sapiens
agatgtctgtgtat

SEQ ID NO: 5561442 - DNA, 15 bp, Homo sapiens
agatgtctgtgtata

SEQ ID NO: 5561443 - DNA, 22 bp, Homo sapiens
agatgtctgtgtatacatatgt

SEQ ID NO: 5561444 - DNA, 13 bp, Homo sapiens
agatgtctgttct

SEQ ID NO: 5561445 - DNA, 13 bp, Homo sapiens
agatgtcttcatc

SEQ ID NO: 5561446 - DNA, 22 bp, Homo sapiens
agatgtcttccctgggctgcca

SEQ ID NO: 5561447 - DNA, 15 bp, Homo sapiens
agatgtcttcgtaca

SEQ ID NO: 5561448 - DNA, 20 bp, Homo sapiens
agatgtcttcgtacagttct

SEQ ID NO: 5561449 - DNA, 13 bp, Homo sapiens
agatgtcttggaa

SEQ ID NO: 5561450 - DNA, 14 bp, Homo sapiens
agatgtcttggaac

SEQ ID NO: 5561451 - DNA, 18 bp, Homo sapiens
agatgtcttttcccattt

SEQ ID NO: 5561452 - DNA, 13 bp, Homo sapiens
agatgtgaaaatt

SEQ ID NO: 5561453 - DNA, 14 bp, Homo sapiens
agatgtgaattatt

SEQ ID NO: 5561454 - DNA, 22 bp, Homo sapiens
agatgtgaattattgacactga

SEQ ID NO: 5561455 - DNA, 23 bp, Homo sapiens
agatgtgacggggtgtgtggccc

SEQ ID NO: 5561456 - DNA, 16 bp, Homo sapiens
agatgtgagagaaaga

SEQ ID NO: 5561457 - DNA, 19 bp, Homo sapiens
agatgtgagtcctgttgaa

SEQ ID NO: 5561458 - DNA, 17 bp, Homo sapiens
agatgtgatacactgaa

SEQ ID NO: 5561459 - DNA, 18 bp, Homo sapiens
agatgtgatattctaaga

SEQ ID NO: 5561460 - DNA, 19 bp, Homo sapiens
agatgtgatattctaagac

SEQ ID NO: 5561461 - DNA, 16 bp, Homo sapiens
agatgtgatcaggccc

SEQ ID NO: 5561462 - DNA, 13 bp, Homo sapiens
agatgtgatgctg

SEQ ID NO: 5561463 - DNA, 19 bp, Homo sapiens
agatgtgattcctgcattt

SEQ ID NO: 5561464 - DNA, 20 bp, Homo sapiens
agatgtgattcctgcatttt

SEQ ID NO: 5561465 - DNA, 18 bp, Homo sapiens
agatgtgcaaatgcaagc

SEQ ID NO: 5561466 - DNA, 19 bp, Homo sapiens
agatgtgcaagtcttgtca

SEQ ID NO: 5561467 - DNA, 17 bp, Homo sapiens
agatgtgcaataatttg

SEQ ID NO: 5561468 - DNA, 18 bp, Homo sapiens
agatgtgcaataatttgt

SEQ ID NO: 5561469 - DNA, 14 bp, Homo sapiens
agatgtgcaataga

SEQ ID NO: 5561470 - DNA, 22 bp, Homo sapiens
agatgtgcccagagtagcccag

SEQ ID NO: 5561471 - DNA, 14 bp, Homo sapiens
agatgtgcctgtgg

SEQ ID NO: 5561472 - DNA, 21 bp, Homo sapiens
agatgtgcctgtgggaggggg

SEQ ID NO: 5561473 - DNA, 18 bp, Homo sapiens
agatgtgctcccaccagg

SEQ ID NO: 5561474 - DNA, 16 bp, Homo sapiens
agatgtgctgctttga

SEQ ID NO: 5561475 - DNA, 13 bp, Homo sapiens
agatgtgcttctg

SEQ ID NO: 5561476 - DNA, 15 bp, Homo sapiens
agatgtgctttgctg

SEQ ID NO: 5561477 - DNA, 23 bp, Homo sapiens
agatgtgggctcagatcctgggc

SEQ ID NO: 5561478 - DNA, 22 bp, Homo sapiens
agatgtggggctgagctgggga

SEQ ID NO: 5561479 - DNA, 22 bp, Homo sapiens
agatgtggttgcataaggtttt

SEQ ID NO: 5561480 - DNA, 15 bp, Homo sapiens
agatgtggtttttaa

SEQ ID NO: 5561481 - DNA, 16 bp, Homo sapiens
agatgtgtaaacaggt

SEQ ID NO: 5561482 - DNA, 20 bp, Homo sapiens
agatgtgtaaacaggtattt

SEQ ID NO: 5561483 - DNA, 20 bp, Homo sapiens
agatgtgtaaataagcgttt

SEQ ID NO: 5561484 - DNA, 21 bp, Homo sapiens
agatgtgtaatttttctgtat

SEQ ID NO: 5561485 - DNA, 20 bp, Homo sapiens
agatgtgtcccccccaggcc

SEQ ID NO: 5561486 - DNA, 21 bp, Homo sapiens
agatgtgtcccccccaggcct

SEQ ID NO: 5561487 - DNA, 23 bp, Homo sapiens
agatgtgtctcctgtttcagacc

SEQ ID NO: 5561488 - DNA, 19 bp, Homo sapiens
agatgtgtctgggagagcc

SEQ ID NO: 5561489 - DNA, 23 bp, Homo sapiens
agatgtgtctgggagagcctggc

SEQ ID NO: 5561490 - DNA, 21 bp, Homo sapiens
agatgtgtgagcatcctgcaa

SEQ ID NO: 5561491 - DNA, 17 bp, Homo sapiens
agatgtgtgtgtgtgta

SEQ ID NO: 5561492 - DNA, 17 bp, Homo sapiens
agatgtgtgttgatact

SEQ ID NO: 5561493 - DNA, 21 bp, Homo sapiens
agatgtgtgttgatactgttg

SEQ ID NO: 5561494 - DNA, 24 bp, Homo sapiens
agatgtgtgttgatactgttgcac

SEQ ID NO: 5561495 - DNA, 18 bp, Homo sapiens
agatgtgttcacaatgga

SEQ ID NO: 5561496 - DNA, 18 bp, Homo sapiens
agatgtgttcaggcattc

SEQ ID NO: 5561497 - DNA, 15 bp, Homo sapiens
agatgtgttcctcct

SEQ ID NO: 5561498 - DNA, 20 bp, Homo sapiens
agatgtgttcctcctgctgt

SEQ ID NO: 5561499 - DNA, 11 bp, Homo sapiens
agatgtgttct

SEQ ID NO: 5561500 - DNA, 19 bp, Homo sapiens
agatgtgttttgttttgga

SEQ ID NO: 5561501 - DNA, 22 bp, Homo sapiens
agatgtgttttgttttggactc

SEQ ID NO: 5561502 - DNA, 12 bp, Homo sapiens
agatgttaaaaa

SEQ ID NO: 5561503 - DNA, 13 bp, Homo sapiens
agatgttaaaata

SEQ ID NO: 5561504 - DNA, 14 bp, Homo sapiens
agatgttaaaatag

SEQ ID NO: 5561505 - DNA, 13 bp, Homo sapiens
agatgttaaaatc

SEQ ID NO: 5561506 - DNA, 11 bp, Homo sapiens
agatgttaaat

SEQ ID NO: 5561507 - DNA, 15 bp, Homo sapiens
agatgttaaatggaa

SEQ ID NO: 5561508 - DNA, 21 bp, Homo sapiens
agattgtacttttatcttaaa

SEQ ID NO: 5561509 - DNA, 14 bp, Homo sapiens
agattgtattgctg

SEQ ID NO: 5561510 - DNA, 22 bp, Homo sapiens
agattgtccttttctcccattt

SEQ ID NO: 5561511 - DNA, 18 bp, Homo sapiens
agattgtgcgttcaaacc

SEQ ID NO: 5561512 - DNA, 16 bp, Homo sapiens
agattgtggaatgttg

SEQ ID NO: 5561513 - DNA, 22 bp, Homo sapiens
agattgtggaatgttggataag

SEQ ID NO: 5561514 - DNA, 13 bp, Homo sapiens
agattgtgtaaat

SEQ ID NO: 5561515 - DNA, 21 bp, Homo sapiens
agattgtgtaacaattttaat

SEQ ID NO: 5561516 - DNA, 21 bp, Homo sapiens
agattgtgtacatagagcaat

SEQ ID NO: 5561517 - DNA, 14 bp, Homo sapiens
agattgttggtgaa

SEQ ID NO: 5561518 - DNA, 20 bp, Homo sapiens
agattgttggtgaattttca

SEQ ID NO: 5561519 - DNA, 23 bp, Homo sapiens
agattgttgtttgccatactttg

SEQ ID NO: 5561520 - DNA, 16 bp, Homo sapiens
agattgtttatctaga

SEQ ID NO: 5561521 - DNA, 19 bp, Homo sapiens
agattgtttatctagatgt

SEQ ID NO: 5561522 - DNA, 23 bp, Homo sapiens
agattgttttttcctaaggaaac

SEQ ID NO: 5561523 - DNA, 12 bp, Homo sapiens
agatttaaaata

SEQ ID NO: 5561524 - DNA, 19 bp, Homo sapiens
agatttaaactctgaattt

SEQ ID NO: 5561525 - DNA, 19 bp, Homo sapiens
agatttaaaggcagacagt

SEQ ID NO: 5561526 - DNA, 13 bp, Homo sapiens
agatttaacccct

SEQ ID NO: 5561527 - DNA, 14 bp, Homo sapiens
agatttaacctgtt

SEQ ID NO: 5561528 - DNA, 20 bp, Homo sapiens
agatttaacctgttatttct

SEQ ID NO: 5561529 - DNA, 22 bp, Homo sapiens
agatttaacctgttatttctat

SEQ ID NO: 5561530 - DNA, 11 bp, Homo sapiens
agatttaagca

SEQ ID NO: 5561531 - DNA, 20 bp, Homo sapiens
agatttaagcacaaacttta

SEQ ID NO: 5561532 - DNA, 18 bp, Homo sapiens
agatttaagccttacaaa

SEQ ID NO: 5561533 - DNA, 20 bp, Homo sapiens
agatttaagccttgacacac

SEQ ID NO: 5561534 - DNA, 23 bp, Homo sapiens
agatttaagccttgacacactgt

SEQ ID NO: 5561535 - DNA, 23 bp, Homo sapiens
agatttaatataaagttttatat

SEQ ID NO: 5561536 - DNA, 15 bp, Homo sapiens
agatttaatgttaca

SEQ ID NO: 5561537 - DNA, 13 bp, Homo sapiens
agatttaatttgc

SEQ ID NO: 5561538 - DNA, 17 bp, Homo sapiens
agatttaatttgccaaa

SEQ ID NO: 5561539 - DNA, 21 bp, Homo sapiens
agatttaatttgccaaaataa

SEQ ID NO: 5561540 - DNA, 15 bp, Homo sapiens
agatttacactggga

SEQ ID NO: 5561541 - DNA, 20 bp, Homo sapiens
agatttaccctttatagaac

SEQ ID NO: 5561542 - DNA, 22 bp, Homo sapiens
agatttaccttttctgttgtac

SEQ ID NO: 5561543 - DNA, 22 bp, Homo sapiens
agatttactgctctagaaagta

SEQ ID NO: 5561544 - DNA, 20 bp, Homo sapiens
agatttactgtcccaggagc

SEQ ID NO: 5561545 - DNA, 17 bp, Homo sapiens
agatttagagcaatgca

SEQ ID NO: 5561546 - DNA, 19 bp, Homo sapiens
agatttagctgaagggctt

SEQ ID NO: 5561547 - DNA, 22 bp, Homo sapiens
agatttagggttctatatttac

SEQ ID NO: 5561548 - DNA, 18 bp, Homo sapiens
agatttagtgaaagctag

SEQ ID NO: 5561549 - DNA, 19 bp, Homo sapiens
agatttagttttgtaactt

SEQ ID NO: 5561550 - DNA, 18 bp, Homo sapiens
agatttatacagttgaaa

SEQ ID NO: 5561551 - DNA, 13 bp, Homo sapiens
agatttatcaaat

SEQ ID NO: 5561552 - DNA, 15 bp, Homo sapiens
agatttatcaaatca

SEQ ID NO: 5561553 - DNA, 16 bp, Homo sapiens
agatttatcaaatcag

SEQ ID NO: 5561554 - DNA, 20 bp, Homo sapiens
agatttatgaacagaaatat

SEQ ID NO: 5561555 - DNA, 14 bp, Homo sapiens
agatttatgcatat

SEQ ID NO: 5561556 - DNA, 14 bp, Homo sapiens
agatttattaaaga

SEQ ID NO: 5561557 - DNA, 16 bp, Homo sapiens
agatttattaaagaaa

SEQ ID NO: 5561558 - DNA, 17 bp, Homo sapiens
agatttattaaagaaaa

SEQ ID NO: 5561559 - DNA, 18 bp, Homo sapiens
agatttattaaagaaaaa

SEQ ID NO: 5561560 - DNA, 13 bp, Homo sapiens
agatttattaatt

SEQ ID NO: 5561561 - DNA, 13 bp, Homo sapiens
agatttatttagc

SEQ ID NO: 5561562 - DNA, 19 bp, Homo sapiens
agatttatttgtttgattt

SEQ ID NO: 5561563 - DNA, 15 bp, Homo sapiens
agatttattttgtta

SEQ ID NO: 5561564 - DNA, 16 bp, Homo sapiens
agatttatttttaata

SEQ ID NO: 5561565 - DNA, 19 bp, Homo sapiens
agatttatttttaatatgt

SEQ ID NO: 5561566 - DNA, 14 bp, Homo sapiens
agatttcaaaaaaa

SEQ ID NO: 5561567 - DNA, 18 bp, Homo sapiens
agatttcaagaaaaaata

SEQ ID NO: 5561568 - DNA, 15 bp, Homo sapiens
agatttcacatcagc

SEQ ID NO: 5561569 - DNA, 13 bp, Homo sapiens
agatttcactctc

SEQ ID NO: 5561570 - DNA, 20 bp, Homo sapiens
agatttcagctatgcagaaa

SEQ ID NO: 5561571 - DNA, 14 bp, Homo sapiens
agatttcagtaatg

SEQ ID NO: 5561572 - DNA, 18 bp, Homo sapiens
agatttcagtaatgtctt

SEQ ID NO: 5561573 - DNA, 20 bp, Homo sapiens
agatttcagtaatgtcttca

SEQ ID NO: 5561574 - DNA, 22 bp, Homo sapiens
agatttcagtaatgtcttcagt

SEQ ID NO: 5561575 - DNA, 12 bp, Homo sapiens
agatttcagtag

SEQ ID NO: 5561576 - DNA, 23 bp, Homo sapiens
agatttcagtagtttctaagtct

SEQ ID NO: 5561577 - DNA, 15 bp, Homo sapiens
agatttcagtctttt

SEQ ID NO: 5561578 - DNA, 19 bp, Homo sapiens
agatttcatagttcagaat

SEQ ID NO: 5561579 - DNA, 20 bp, Homo sapiens
agatttcatagttcagaatt

SEQ ID NO: 5561580 - DNA, 20 bp, Homo sapiens
agatttcatctgctctcctt

SEQ ID NO: 5561581 - DNA, 21 bp, Homo sapiens
agatttcatctgctctccttc

SEQ ID NO: 5561582 - DNA, 15 bp, Homo sapiens
agatttccatttgtc

SEQ ID NO: 5561583 - DNA, 18 bp, Homo sapiens
agatttccctaaaaattc

SEQ ID NO: 5561584 - DNA, 22 bp, Homo sapiens
agatttcctccatggtggaagg

SEQ ID NO: 5561585 - DNA, 17 bp, Homo sapiens
agatttccttaacctta

SEQ ID NO: 5561586 - DNA, 22 bp, Homo sapiens
agatttccttttttcttttctt

SEQ ID NO: 5561587 - DNA, 24 bp, Homo sapiens
agatttctagcagtatgtgtgctc

SEQ ID NO: 5561588 - DNA, 18 bp, Homo sapiens
agatttctataaaagcaa

SEQ ID NO: 5561589 - DNA, 17 bp, Homo sapiens
agatttctcactatata

SEQ ID NO: 5561590 - DNA, 16 bp, Homo sapiens
agatttctcattgact

SEQ ID NO: 5561591 - DNA, 20 bp, Homo sapiens
agatttctcatttgccaata

SEQ ID NO: 5561592 - DNA, 14 bp, Homo sapiens
agatttctcctgac

SEQ ID NO: 5561593 - DNA, 11 bp, Homo sapiens
agatttctctt

SEQ ID NO: 5561594 - DNA, 20 bp, Homo sapiens
agatttctcttgggcaggca

SEQ ID NO: 5561595 - DNA, 14 bp, Homo sapiens
agatttctgaggaa

SEQ ID NO: 5561596 - DNA, 15 bp, Homo sapiens
agatttctgaggaaa

SEQ ID NO: 5561597 - DNA, 17 bp, Homo sapiens
agatttctggcatatgt

SEQ ID NO: 5561598 - DNA, 18 bp, Homo sapiens
agatttctggcatatgtt

SEQ ID NO: 5561599 - DNA, 19 bp, Homo sapiens
agatttctggttgatttgt

SEQ ID NO: 5561600 - DNA, 13 bp, Homo sapiens
agatttcttaaat

SEQ ID NO: 5561601 - DNA, 19 bp, Homo sapiens
agatttcttgagttttgtt

SEQ ID NO: 5561602 - DNA, 19 bp, Homo sapiens
agatttcttttttatgtga

SEQ ID NO: 5561603 - DNA, 11 bp, Homo sapiens
agatttgaaaa

SEQ ID NO: 5561604 - DNA, 21 bp, Homo sapiens
agatttgaaaacaaacttctc

SEQ ID NO: 5561605 - DNA, 16 bp, Homo sapiens
agatttgaaaattgta

SEQ ID NO: 5561606 - DNA, 13 bp, Homo sapiens
agatttgaccaaa

SEQ ID NO: 5561607 - DNA, 14 bp, Homo sapiens
agatttgatatatg

SEQ ID NO: 5561608 - DNA, 17 bp, Homo sapiens
agatttgatatatgtat

SEQ ID NO: 5561609 - DNA, 16 bp, Homo sapiens
agatttgatatttgca

SEQ ID NO: 5561610 - DNA, 13 bp, Homo sapiens
agatttgatgtat

SEQ ID NO: 5561611 - DNA, 21 bp, Homo sapiens
agatttgattgtgaggcttct

SEQ ID NO: 5561612 - DNA, 15 bp, Homo sapiens
agatttgcacaaaaa

SEQ ID NO: 5561613 - DNA, 13 bp, Homo sapiens
agatttgccagca

SEQ ID NO: 5561614 - DNA, 18 bp, Homo sapiens
agatttgccatagagtac

SEQ ID NO: 5561615 - DNA, 20 bp, Homo sapiens
agatttgcccatttacactt

SEQ ID NO: 5561616 - DNA, 12 bp, Homo sapiens
agatttggaaaa

SEQ ID NO: 5561617 - DNA, 13 bp, Homo sapiens
agatttggaaaat

SEQ ID NO: 5561618 - DNA, 20 bp, Homo sapiens
agatttggaaaattcacaga

SEQ ID NO: 5561619 - DNA, 18 bp, Homo sapiens
agatttggagactttgtt

SEQ ID NO: 5561620 - DNA, 14 bp, Homo sapiens
agatttgggctgga

SEQ ID NO: 5561621 - DNA, 18 bp, Homo sapiens
agatttgggtcatttaga

SEQ ID NO: 5561622 - DNA, 19 bp, Homo sapiens
agatttggtaactcatttg

SEQ ID NO: 5561623 - DNA, 21 bp, Homo sapiens
agatttggtgaatttgaatct

SEQ ID NO: 5561624 - DNA, 18 bp, Homo sapiens
agatttggtgatggaaaa

SEQ ID NO: 5561625 - DNA, 22 bp, Homo sapiens
agatttggtttttgtcttgcat

SEQ ID NO: 5561626 - DNA, 20 bp, Homo sapiens
agatttgtaaatctttgtga

SEQ ID NO: 5561627 - DNA, 14 bp, Homo sapiens
agatttgtaacatt

SEQ ID NO: 5561628 - DNA, 15 bp, Homo sapiens
agatttgtaacatta

SEQ ID NO: 5561629 - DNA, 15 bp, Homo sapiens
agatttgtacatatt

SEQ ID NO: 5561630 - DNA, 16 bp, Homo sapiens
agatttgtatttatat

SEQ ID NO: 5561631 - DNA, 18 bp, Homo sapiens
agatttgtatttatatta

SEQ ID NO: 5561632 - DNA, 23 bp, Homo sapiens
agatttgtccttttatttctcca

SEQ ID NO: 5561633 - DNA, 16 bp, Homo sapiens
agatttgtgaactcag

SEQ ID NO: 5561634 - DNA, 19 bp, Homo sapiens
agatttgtgaactggaaga

SEQ ID NO: 5561635 - DNA, 19 bp, Homo sapiens
agatttgtgtgcatcaggc

SEQ ID NO: 5561636 - DNA, 13 bp, Homo sapiens
agatttgtgttat

SEQ ID NO: 5561637 - DNA, 17 bp, Homo sapiens
agatttgttactgtatt

SEQ ID NO: 5561638 - DNA, 13 bp, Homo sapiens
agatttgttcatt

SEQ ID NO: 5561639 - DNA, 13 bp, Homo sapiens
agatttgtttcct

SEQ ID NO: 5561640 - DNA, 14 bp, Homo sapiens
agatttgttttgtg

SEQ ID NO: 5561641 - DNA, 18 bp, Homo sapiens
agatttgtttttgtagag

SEQ ID NO: 5561642 - DNA, 12 bp, Homo sapiens
agattttaaaaa

SEQ ID NO: 5561643 - DNA, 22 bp, Homo sapiens
agattttaaattcacaatagaa

SEQ ID NO: 5561644 - DNA, 17 bp, Homo sapiens
agattttaaattttatg

SEQ ID NO: 5561645 - DNA, 20 bp, Homo sapiens
agattttaaattttatgtca

SEQ ID NO: 5561646 - DNA, 16 bp, Homo sapiens
agattttaatcaaatt

SEQ ID NO: 5561647 - DNA, 18 bp, Homo sapiens
agattttaatttatttgt

SEQ ID NO: 5561648 - DNA, 21 bp, Homo sapiens
agattttaatttatttgtttc

SEQ ID NO: 5561649 - DNA, 17 bp, Homo sapiens
agattttacaaaagatg

SEQ ID NO: 5561650 - DNA, 20 bp, Homo sapiens
agattttacaaaagatgtat

SEQ ID NO: 5561651 - DNA, 21 bp, Homo sapiens
agattttacctgggatatgac

SEQ ID NO: 5561652 - DNA, 22 bp, Homo sapiens
agattttagttttattttctaa

SEQ ID NO: 5561653 - DNA, 15 bp, Homo sapiens
agattttatattttc

SEQ ID NO: 5561654 - DNA, 22 bp, Homo sapiens
agattttatggttttataacta

SEQ ID NO: 5561655 - DNA, 19 bp, Homo sapiens
agattttatgtgcttgaag

SEQ ID NO: 5561656 - DNA, 14 bp, Homo sapiens
agattttatgttta

SEQ ID NO: 5561657 - DNA, 15 bp, Homo sapiens
agattttattatgta

SEQ ID NO: 5561658 - DNA, 20 bp, Homo sapiens
agattttattatgtaaatcc

SEQ ID NO: 5561659 - DNA, 13 bp, Homo sapiens
agattttatttgt

SEQ ID NO: 5561660 - DNA, 14 bp, Homo sapiens
agattttatttgta

SEQ ID NO: 5561661 - DNA, 17 bp, Homo sapiens
agattttattttgacag

SEQ ID NO: 5561662 - DNA, 12 bp, Homo sapiens
agattttcattg

SEQ ID NO: 5561663 - DNA, 15 bp, Homo sapiens
agattttcattttag

SEQ ID NO: 5561664 - DNA, 16 bp, Homo sapiens
agattttcctaaggcc

SEQ ID NO: 5561665 - DNA, 19 bp, Homo sapiens
agattttcctcagattaga

SEQ ID NO: 5561666 - DNA, 15 bp, Homo sapiens
agattttctcctgtg

SEQ ID NO: 5561667 - DNA, 13 bp, Homo sapiens
agattttctctgg

SEQ ID NO: 5561668 - DNA, 17 bp, Homo sapiens
agattttctggttctaa

SEQ ID NO: 5561669 - DNA, 14 bp, Homo sapiens
agattttcttggca

SEQ ID NO: 5561670 - DNA, 12 bp, Homo sapiens
agattttgaaaa

SEQ ID NO: 5561671 - DNA, 15 bp, Homo sapiens
agattttgaaaaatt

SEQ ID NO: 5561672 - DNA, 17 bp, Homo sapiens
agattttgaaaactaca

SEQ ID NO: 5561673 - DNA, 18 bp, Homo sapiens
agattttgataactgttt

SEQ ID NO: 5561674 - DNA, 13 bp, Homo sapiens
agattttgcattt

SEQ ID NO: 5561675 - DNA, 23 bp, Homo sapiens
agattttgcctttcttttggaag

SEQ ID NO: 5561676 - DNA, 16 bp, Homo sapiens
agattttgcttttcca

SEQ ID NO: 5561677 - DNA, 16 bp, Homo sapiens
agattttgtatattta

SEQ ID NO: 5561678 - DNA, 14 bp, Homo sapiens
agattttgttttgc

SEQ ID NO: 5561679 - DNA, 16 bp, Homo sapiens
agattttgttttgctt

SEQ ID NO: 5561680 - DNA, 17 bp, Homo sapiens
agattttgttttgcttt

SEQ ID NO: 5561681 - DNA, 22 bp, Homo sapiens
agattttgttttgctttttctg

SEQ ID NO: 5561682 - DNA, 23 bp, Homo sapiens
agattttgttttgttggacattt

SEQ ID NO: 5561683 - DNA, 21 bp, Homo sapiens
agatttttaaaatgaatctta

SEQ ID NO: 5561684 - DNA, 17 bp, Homo sapiens
agatttttaacaaaaaa

SEQ ID NO: 5561685 - DNA, 18 bp, Homo sapiens
agatttttaacaaaaaac

SEQ ID NO: 5561686 - DNA, 18 bp, Homo sapiens
agcaaatcctcttctaac

SEQ ID NO: 5561687 - DNA, 21 bp, Homo sapiens
agcaaatcctcttctaactca

SEQ ID NO: 5561688 - DNA, 20 bp, Homo sapiens
agcaaatcgaatgaaattaa

SEQ ID NO: 5561689 - DNA, 17 bp, Homo sapiens
agcaaatcgtacattgt

SEQ ID NO: 5561690 - DNA, 19 bp, Homo sapiens
agcaaatctacagatcctt

SEQ ID NO: 5561691 - DNA, 23 bp, Homo sapiens
agcaaatctgccaccgtggggga

SEQ ID NO: 5561692 - DNA, 15 bp, Homo sapiens
agcaaatgaaggatg

SEQ ID NO: 5561693 - DNA, 15 bp, Homo sapiens
agcaaatgacagatt

SEQ ID NO: 5561694 - DNA, 19 bp, Homo sapiens
agcaaatgagatgtatgcc

SEQ ID NO: 5561695 - DNA, 12 bp, Homo sapiens
agcaaatgcaaa

SEQ ID NO: 5561696 - DNA, 17 bp, Homo sapiens
agcaaatgcaaaaataa

SEQ ID NO: 5561697 - DNA, 15 bp, Homo sapiens
agcaaatgccttttc

SEQ ID NO: 5561698 - DNA, 22 bp, Homo sapiens
agcaaatgtaaaaatttaattt

SEQ ID NO: 5561699 - DNA, 20 bp, Homo sapiens
agcaaatgtcatgctgcctt

SEQ ID NO: 5561700 - DNA, 20 bp, Homo sapiens
agcaaatgtcttcctggatt

SEQ ID NO: 5561701 - DNA, 15 bp, Homo sapiens
agcaaatgtgacctg

SEQ ID NO: 5561702 - DNA, 15 bp, Homo sapiens
agcaaatgtttactg

SEQ ID NO: 5561703 - DNA, 16 bp, Homo sapiens
agcaaatgtttctgca

SEQ ID NO: 5561704 - DNA, 14 bp, Homo sapiens
agcaaattaatgtg

SEQ ID NO: 5561705 - DNA, 21 bp, Homo sapiens
agcaaattaattggcagcaga

SEQ ID NO: 5561706 - DNA, 17 bp, Homo sapiens
agcaaattagttggttt

SEQ ID NO: 5561707 - DNA, 22 bp, Homo sapiens
agcaaattatttttaaaagaaa

SEQ ID NO: 5561708 - DNA, 14 bp, Homo sapiens
agcaaattccaata

SEQ ID NO: 5561709 - DNA, 18 bp, Homo sapiens
agcaaattccaatacatt

SEQ ID NO: 5561710 - DNA, 11 bp, Homo sapiens
agcaaattgat

SEQ ID NO: 5561711 - DNA, 15 bp, Homo sapiens
agcaaatttaagaga

SEQ ID NO: 5561712 - DNA, 20 bp, Homo sapiens
agcaaatttataattttaag

SEQ ID NO: 5561713 - DNA, 14 bp, Homo sapiens
agcaaatttcaaaa

SEQ ID NO: 5561714 - DNA, 20 bp, Homo sapiens
agcaaatttcatctttccaa

SEQ ID NO: 5561715 - DNA, 18 bp, Homo sapiens
agcaaatttcattatcta

SEQ ID NO: 5561716 - DNA, 15 bp, Homo sapiens
agcaaattttcagca

SEQ ID NO: 5561717 - DNA, 17 bp, Homo sapiens
agcaacaaaactatgga

SEQ ID NO: 5561718 - DNA, 19 bp, Homo sapiens
agcaacaaaactatggaaa

SEQ ID NO: 5561719 - DNA, 20 bp, Homo sapiens
agcaacaaaactatggaaat

SEQ ID NO: 5561720 - DNA, 20 bp, Homo sapiens
agcaacaaagattgagaagc

SEQ ID NO: 5561721 - DNA, 17 bp, Homo sapiens
agcaacaaatatgtcaa

SEQ ID NO: 5561722 - DNA, 23 bp, Homo sapiens
agcaacaacaattggtaaaactc

SEQ ID NO: 5561723 - DNA, 16 bp, Homo sapiens
agcaacaactgtcagt

SEQ ID NO: 5561724 - DNA, 21 bp, Homo sapiens
agcaacaactgtcagttcatc

SEQ ID NO: 5561725 - DNA, 16 bp, Homo sapiens
agcaacaacttactaa

SEQ ID NO: 5561726 - DNA, 21 bp, Homo sapiens
agcaacaactttgtttctcat

SEQ ID NO: 5561727 - DNA, 12 bp, Homo sapiens
agcaacaagact

SEQ ID NO: 5561728 - DNA, 14 bp, Homo sapiens
agcaacaagctatt

SEQ ID NO: 5561729 - DNA, 11 bp, Homo sapiens
agcaacaagta

SEQ ID NO: 5561730 - DNA, 15 bp, Homo sapiens
agcaacaatttatga

SEQ ID NO: 5561731 - DNA, 15 bp, Homo sapiens
agcaacaattttcag

SEQ ID NO: 5561732 - DNA, 16 bp, Homo sapiens
agcaacacaaagcttt

SEQ ID NO: 5561733 - DNA, 20 bp, Homo sapiens
agcaacacaagctggaagca

SEQ ID NO: 5561734 - DNA, 13 bp, Homo sapiens
agcaacacaatgt

SEQ ID NO: 5561735 - DNA, 13 bp, Homo sapiens
agcaacacagcct

SEQ ID NO: 5561736 - DNA, 15 bp, Homo sapiens
agcaacacagcctgg

SEQ ID NO: 5561737 - DNA, 13 bp, Homo sapiens
agcaacacccaag

SEQ ID NO: 5561738 - DNA, 16 bp, Homo sapiens
agcaacacttggaaca

SEQ ID NO: 5561739 - DNA, 22 bp, Homo sapiens
agcaacagagtgagaccctgtc

SEQ ID NO: 5561740 - DNA, 19 bp, Homo sapiens
agcaacagcctttgaatgt

SEQ ID NO: 5561741 - DNA, 22 bp, Homo sapiens
agcaacagcctttgaatgtaac

SEQ ID NO: 5561742 - DNA, 17 bp, Homo sapiens
agcaacagctggacacc

SEQ ID NO: 5561743 - DNA, 21 bp, Homo sapiens
agcaacagctggacaccccct

SEQ ID NO: 5561744 - DNA, 22 bp, Homo sapiens
agcaacaggaatctcagagaca

SEQ ID NO: 5561745 - DNA, 16 bp, Homo sapiens
agcaacaggaccagga

SEQ ID NO: 5561746 - DNA, 17 bp, Homo sapiens
agcaacaggaccaggag

SEQ ID NO: 5561747 - DNA, 19 bp, Homo sapiens
agcaacaggttttataatt

SEQ ID NO: 5561748 - DNA, 19 bp, Homo sapiens
agcaacagtaattattatt

SEQ ID NO: 5561749 - DNA, 17 bp, Homo sapiens
agcaacagtagcaggga

SEQ ID NO: 5561750 - DNA, 19 bp, Homo sapiens
agcaacatatctctgccgt

SEQ ID NO: 5561751 - DNA, 15 bp, Homo sapiens
agcaacatcagcttg

SEQ ID NO: 5561752 - DNA, 22 bp, Homo sapiens
agcaacattttacccacacaca

SEQ ID NO: 5561753 - DNA, 13 bp, Homo sapiens
agcaacattttat

SEQ ID NO: 5561754 - DNA, 17 bp, Homo sapiens
agcaaccacaaatgcat

SEQ ID NO: 5561755 - DNA, 15 bp, Homo sapiens
agcaaccagttggct

SEQ ID NO: 5561756 - DNA, 16 bp, Homo sapiens
agcaaccccaggctga

SEQ ID NO: 5561757 - DNA, 19 bp, Homo sapiens
agcaacccctggaccccag

SEQ ID NO: 5561758 - DNA, 21 bp, Homo sapiens
agcaacccctggaccccagcc

SEQ ID NO: 5561759 - DNA, 23 bp, Homo sapiens
agcaacccctgtacccagctcct

SEQ ID NO: 5561760 - DNA, 21 bp, Homo sapiens
agcaaccctacagtatataag

SEQ ID NO: 5561761 - DNA, 14 bp, Homo sapiens
agcaaccctctgaa

SEQ ID NO: 5561762 - DNA, 19 bp, Homo sapiens
agcaaccgcctcaaaatgt

SEQ ID NO: 5561763 - DNA, 16 bp, Homo sapiens
agcaaccgtgcagcca

SEQ ID NO: 5561764 - DNA, 17 bp, Homo sapiens
agcaaccgtgcagccac

SEQ ID NO: 5561765 - DNA, 20 bp, Homo sapiens
agcaacctgggtccaaataa

SEQ ID NO: 5561766 - DNA, 20 bp, Homo sapiens
agcaacctgtaactcacatt

SEQ ID NO: 5561767 - DNA, 21 bp, Homo sapiens
agcaacgatcacaaatgactt

SEQ ID NO: 5561768 - DNA, 15 bp, Homo sapiens
agcaacgcccctcca

SEQ ID NO: 5561769 - DNA, 20 bp, Homo sapiens
agcaacgcccctccaaacct

SEQ ID NO: 5561770 - DNA, 14 bp, Homo sapiens
agcaacgcctgcct

SEQ ID NO: 5561771 - DNA, 20 bp, Homo sapiens
agcaacgcctgccttctggg

SEQ ID NO: 5561772 - DNA, 23 bp, Homo sapiens
agcaacgcttgtagaactcactc

SEQ ID NO: 5561773 - DNA, 16 bp, Homo sapiens
agcaacggccccagcg

SEQ ID NO: 5561774 - DNA, 17 bp, Homo sapiens
agcaacggccccagcgc

SEQ ID NO: 5561775 - DNA, 19 bp, Homo sapiens
agcaacgggaacacctgct

SEQ ID NO: 5561776 - DNA, 17 bp, Homo sapiens
agcaacgttagtagaac

SEQ ID NO: 5561777 - DNA, 21 bp, Homo sapiens
agcaactaatgtttgaacaaa

SEQ ID NO: 5561778 - DNA, 16 bp, Homo sapiens
agcaactatcagacta

SEQ ID NO: 5561779 - DNA, 12 bp, Homo sapiens
agcaactcccac

SEQ ID NO: 5561780 - DNA, 20 bp, Homo sapiens
agcaactccgtgtgcctggg

SEQ ID NO: 5561781 - DNA, 23 bp, Homo sapiens
agcaactctaagactacagcaca

SEQ ID NO: 5561782 - DNA, 18 bp, Homo sapiens
agcaactctccactccat

SEQ ID NO: 5561783 - DNA, 16 bp, Homo sapiens
agcaactcttatttct

SEQ ID NO: 5561784 - DNA, 16 bp, Homo sapiens
agcaactcttgattat

SEQ ID NO: 5561785 - DNA, 12 bp, Homo sapiens
agcaactgaata

SEQ ID NO: 5561786 - DNA, 21 bp, Homo sapiens
agcaactgaataaatacctct

SEQ ID NO: 5561787 - DNA, 14 bp, Homo sapiens
agcaactgacctga

SEQ ID NO: 5561788 - DNA, 20 bp, Homo sapiens
agcaactgcgacaaaacatt

SEQ ID NO: 5561789 - DNA, 14 bp, Homo sapiens
agcaactggaaaag

SEQ ID NO: 5561790 - DNA, 22 bp, Homo sapiens
agcaactggaaaagtgttcctt

SEQ ID NO: 5561791 - DNA, 12 bp, Homo sapiens
agcaactgggac

SEQ ID NO: 5561792 - DNA, 16 bp, Homo sapiens
agcaactgtctatttc

SEQ ID NO: 5561793 - DNA, 21 bp, Homo sapiens
agcaactgtctatttctgctg

SEQ ID NO: 5561794 - DNA, 17 bp, Homo sapiens
agcaactgtgcagcacc

SEQ ID NO: 5561795 - DNA, 20 bp, Homo sapiens
agcaactgttagctgggaag

SEQ ID NO: 5561796 - DNA, 17 bp, Homo sapiens
agcaactgttatgaaat

SEQ ID NO: 5561797 - DNA, 12 bp, Homo sapiens
agcaactgttgg

SEQ ID NO: 5561798 - DNA, 17 bp, Homo sapiens
agcaacttcatcccagc

SEQ ID NO: 5561799 - DNA, 18 bp, Homo sapiens
agcaacttcatcccagct

SEQ ID NO: 5561800 - DNA, 14 bp, Homo sapiens
agcaacttctagca

SEQ ID NO: 5561801 - DNA, 19 bp, Homo sapiens
agcaacttctagcatatag

SEQ ID NO: 5561802 - DNA, 15 bp, Homo sapiens
agcaacttcttctcc

SEQ ID NO: 5561803 - DNA, 16 bp, Homo sapiens
agcaacttcttctcca

SEQ ID NO: 5561804 - DNA, 18 bp, Homo sapiens
agcaacttcttctccatc

SEQ ID NO: 5561805 - DNA, 21 bp, Homo sapiens
agcaacttcttctccatccct

SEQ ID NO: 5561806 - DNA, 22 bp, Homo sapiens
agcaacttgaacttcacctgca

SEQ ID NO: 5561807 - DNA, 14 bp, Homo sapiens
agcaacttgtccta

SEQ ID NO: 5561808 - DNA, 21 bp, Homo sapiens
agcaacttgtcctagcacaga

SEQ ID NO: 5561809 - DNA, 15 bp, Homo sapiens
agcaacttgtctttt

SEQ ID NO: 5561810 - DNA, 20 bp, Homo sapiens
agcaacttgtctttttctgg

SEQ ID NO: 5561811 - DNA, 23 bp, Homo sapiens
agcaacttgtctttttctggact

SEQ ID NO: 5561812 - DNA, 17 bp, Homo sapiens
agcaactttccaacttt

SEQ ID NO: 5561813 - DNA, 14 bp, Homo sapiens
agcaacttttctca

SEQ ID NO: 5561814 - DNA, 16 bp, Homo sapiens
agcaagaaaaaaaaat

SEQ ID NO: 5561815 - DNA, 19 bp, Homo sapiens
agcaagaaaaaaaaatgcc

SEQ ID NO: 5561816 - DNA, 20 bp, Homo sapiens
agcaagaaaaaaaaatgcca

SEQ ID NO: 5561817 - DNA, 19 bp, Homo sapiens
agcaagaaaaaagtacaga

SEQ ID NO: 5561818 - DNA, 12 bp, Homo sapiens
agcaagaaagaa

SEQ ID NO: 5561819 - DNA, 22 bp, Homo sapiens
agcaagaaagagggtcccaggg

SEQ ID NO: 5561820 - DNA, 12 bp, Homo sapiens
agcaagaaagcc

SEQ ID NO: 5561821 - DNA, 19 bp, Homo sapiens
agcaagaagaaaatgtggc

SEQ ID NO: 5561822 - DNA, 22 bp, Homo sapiens
agcaagaagaaaatgtggccct

SEQ ID NO: 5561823 - DNA, 12 bp, Homo sapiens
agcaagaagaat

SEQ ID NO: 5561824 - DNA, 16 bp, Homo sapiens
agcaagaagattctaa

SEQ ID NO: 5561825 - DNA, 18 bp, Homo sapiens
agcaagaagattctaaaa

SEQ ID NO: 5561826 - DNA, 19 bp, Homo sapiens
agcaagaaggcaaaaatag

SEQ ID NO: 5561827 - DNA, 20 bp, Homo sapiens
agcaagaaggcaacttgaag

SEQ ID NO: 5561828 - DNA, 23 bp, Homo sapiens
agcaagaaggcaacttgaagaaa

SEQ ID NO: 5561829 - DNA, 17 bp, Homo sapiens
agcaagacacgtggcct

SEQ ID NO: 5561830 - DNA, 14 bp, Homo sapiens
agcaagacattata

SEQ ID NO: 5561831 - DNA, 16 bp, Homo sapiens
agcaagaccctgcctc

SEQ ID NO: 5561832 - DNA, 13 bp, Homo sapiens
agcaagacctcat

SEQ ID NO: 5561833 - DNA, 15 bp, Homo sapiens
agcaagacgccctct

SEQ ID NO: 5561834 - DNA, 20 bp, Homo sapiens
agcaagacgctgtgctgccc

SEQ ID NO: 5561835 - DNA, 21 bp, Homo sapiens
agcaagacgctgtgctgccct

SEQ ID NO: 5561836 - DNA, 17 bp, Homo sapiens
agcaagactccatttca

SEQ ID NO: 5561837 - DNA, 12 bp, Homo sapiens
agcaagactctg

SEQ ID NO: 5561838 - DNA, 21 bp, Homo sapiens
agcaagacttctctttgcctc

SEQ ID NO: 5561839 - DNA, 22 bp, Homo sapiens
agcaagacttctctttgcctca

SEQ ID NO: 5561840 - DNA, 12 bp, Homo sapiens
agcaagagagag

SEQ ID NO: 5561841 - DNA, 22 bp, Homo sapiens
agcaagagagagagagaatgag

SEQ ID NO: 5561842 - DNA, 20 bp, Homo sapiens
agcaagagagcagcgcccag

SEQ ID NO: 5561843 - DNA, 21 bp, Homo sapiens
agcaagagagcagcgcccagg

SEQ ID NO: 5561844 - DNA, 16 bp, Homo sapiens
agcaagagatgagaaa

SEQ ID NO: 5561845 - DNA, 17 bp, Homo sapiens
agcaagaggaggacaga

SEQ ID NO: 5561846 - DNA, 21 bp, Homo sapiens
agcaagagggaacaaaactgt

SEQ ID NO: 5561847 - DNA, 17 bp, Homo sapiens
agcaagatgagctgtgc

SEQ ID NO: 5561848 - DNA, 15 bp, Homo sapiens
agcaagatgtttctt

SEQ ID NO: 5561849 - DNA, 21 bp, Homo sapiens
agcaagatgttttgtataaaa

SEQ ID NO: 5561850 - DNA, 22 bp, Homo sapiens
agcaagatgttttgtataaaat

SEQ ID NO: 5561851 - DNA, 14 bp, Homo sapiens
agcaagatttcaga

SEQ ID NO: 5561852 - DNA, 17 bp, Homo sapiens
agcaagattttgtcaaa

SEQ ID NO: 5561853 - DNA, 20 bp, Homo sapiens
agcaagcaaacagggtggcc

SEQ ID NO: 5561854 - DNA, 16 bp, Homo sapiens
agcaagcaactaattt

SEQ ID NO: 5561855 - DNA, 15 bp, Homo sapiens
agcaagcaccaacct

SEQ ID NO: 5561856 - DNA, 22 bp, Homo sapiens
agcaagcaccaacctccagact

SEQ ID NO: 5561857 - DNA, 14 bp, Homo sapiens
agcaagcacctggg

SEQ ID NO: 5561858 - DNA, 14 bp, Homo sapiens
agcaagcagatgaa

SEQ ID NO: 5561859 - DNA, 11 bp, Homo sapiens
agcaagccaga

SEQ ID NO: 5561860 - DNA, 17 bp, Homo sapiens
agcaagccatcatcctc

SEQ ID NO: 5561861 - DNA, 19 bp, Homo sapiens
agcaagccctacagagctg

SEQ ID NO: 5561862 - DNA, 20 bp, Homo sapiens
agcaagccctacagagctgt

SEQ ID NO: 5561863 - DNA, 18 bp, Homo sapiens
agcacatgcctctctcag

SEQ ID NO: 5561864 - DNA, 20 bp, Homo sapiens
agcacatgcgggctcgccca

SEQ ID NO: 5561865 - DNA, 19 bp, Homo sapiens
agcacatgcgtatatgtgc

SEQ ID NO: 5561866 - DNA, 15 bp, Homo sapiens
agcacatgctggcca

SEQ ID NO: 5561867 - DNA, 21 bp, Homo sapiens
agcacatgctggccagcctgg

SEQ ID NO: 5561868 - DNA, 15 bp, Homo sapiens
agcacatggtttaaa

SEQ ID NO: 5561869 - DNA, 18 bp, Homo sapiens
agcacatgtgtatttata

SEQ ID NO: 5561870 - DNA, 13 bp, Homo sapiens
agcacattatgtt

SEQ ID NO: 5561871 - DNA, 21 bp, Homo sapiens
agcacattcgggaccaatata

SEQ ID NO: 5561872 - DNA, 19 bp, Homo sapiens
agcacattcttaaaggaaa

SEQ ID NO: 5561873 - DNA, 20 bp, Homo sapiens
agcacattcttaaaggaaaa

SEQ ID NO: 5561874 - DNA, 16 bp, Homo sapiens
agcacattgccctgag

SEQ ID NO: 5561875 - DNA, 18 bp, Homo sapiens
agcacattgccctgaggg

SEQ ID NO: 5561876 - DNA, 18 bp, Homo sapiens
agcacatttcctctctat

SEQ ID NO: 5561877 - DNA, 14 bp, Homo sapiens
agcacatttctcct

SEQ ID NO: 5561878 - DNA, 21 bp, Homo sapiens
agcacatttctcctgtttaca

SEQ ID NO: 5561879 - DNA, 21 bp, Homo sapiens
agcacatttgttaatgattct

SEQ ID NO: 5561880 - DNA, 19 bp, Homo sapiens
agcacattttcagactgca

SEQ ID NO: 5561881 - DNA, 16 bp, Homo sapiens
agcaccaaaataagaa

SEQ ID NO: 5561882 - DNA, 19 bp, Homo sapiens
agcaccaaaataagaaaag

SEQ ID NO: 5561883 - DNA, 21 bp, Homo sapiens
agcaccaaaataagaaaagat

SEQ ID NO: 5561884 - DNA, 15 bp, Homo sapiens
agcaccaaccacagc

SEQ ID NO: 5561885 - DNA, 16 bp, Homo sapiens
agcaccaacctccaga

SEQ ID NO: 5561886 - DNA, 18 bp, Homo sapiens
agcaccaacctccagact

SEQ ID NO: 5561887 - DNA, 17 bp, Homo sapiens
agcaccaagctcaaagc

SEQ ID NO: 5561888 - DNA, 22 bp, Homo sapiens
agcaccaccaaacacagtgtat

SEQ ID NO: 5561889 - DNA, 13 bp, Homo sapiens
agcaccaccaggg

SEQ ID NO: 5561890 - DNA, 19 bp, Homo sapiens
agcaccaccatttaatttc

SEQ ID NO: 5561891 - DNA, 17 bp, Homo sapiens
agcaccacctacacagg

SEQ ID NO: 5561892 - DNA, 19 bp, Homo sapiens
agcaccacctacacaggag

SEQ ID NO: 5561893 - DNA, 20 bp, Homo sapiens
agcaccacctacacaggagt

SEQ ID NO: 5561894 - DNA, 16 bp, Homo sapiens
agcaccacggccagaa

SEQ ID NO: 5561895 - DNA, 14 bp, Homo sapiens
agcaccactctggg

SEQ ID NO: 5561896 - DNA, 14 bp, Homo sapiens
agcaccagaatgta

SEQ ID NO: 5561897 - DNA, 22 bp, Homo sapiens
agcaccagcaattctctttctt

SEQ ID NO: 5561898 - DNA, 14 bp, Homo sapiens
agcaccagcctcag

SEQ ID NO: 5561899 - DNA, 23 bp, Homo sapiens
agcaccagcctcagtgcagcccc

SEQ ID NO: 5561900 - DNA, 13 bp, Homo sapiens
agcaccagcctga

SEQ ID NO: 5561901 - DNA, 15 bp, Homo sapiens
agcaccagctgcctc

SEQ ID NO: 5561902 - DNA, 10 bp, Homo sapiens
agcaccaggg

SEQ ID NO: 5561903 - DNA, 19 bp, Homo sapiens
agcaccagggagaggcctc

SEQ ID NO: 5561904 - DNA, 20 bp, Homo sapiens
agcaccagggagaggcctcg

SEQ ID NO: 5561905 - DNA, 17 bp, Homo sapiens
agcaccagggctcacgt

SEQ ID NO: 5561906 - DNA, 23 bp, Homo sapiens
agcaccagtgggactgtggtgac

SEQ ID NO: 5561907 - DNA, 23 bp, Homo sapiens
agcaccagttatgtttgaatgaa

SEQ ID NO: 5561908 - DNA, 16 bp, Homo sapiens
agcaccatcccctccg

SEQ ID NO: 5561909 - DNA, 21 bp, Homo sapiens
agcaccatggaggcaggctcc

SEQ ID NO: 5561910 - DNA, 17 bp, Homo sapiens
agcacccacagccgcag

SEQ ID NO: 5561911 - DNA, 15 bp, Homo sapiens
agcacccacccatgc

SEQ ID NO: 5561912 - DNA, 14 bp, Homo sapiens
agcacccactcagc

SEQ ID NO: 5561913 - DNA, 11 bp, Homo sapiens
agcacccactg

SEQ ID NO: 5561914 - DNA, 11 bp, Homo sapiens
agcacccaggc

SEQ ID NO: 5561915 - DNA, 13 bp, Homo sapiens
agcacccaggctc

SEQ ID NO: 5561916 - DNA, 18 bp, Homo sapiens
agcacccaggctccatgg

SEQ ID NO: 5561917 - DNA, 23 bp, Homo sapiens
agcacccaggctccatggggaag

SEQ ID NO: 5561918 - DNA, 19 bp, Homo sapiens
agcacccatatctgtgtgc

SEQ ID NO: 5561919 - DNA, 23 bp, Homo sapiens
agcacccatccaccgtcccctcc

SEQ ID NO: 5561920 - DNA, 14 bp, Homo sapiens
agcaccccactcct

SEQ ID NO: 5561921 - DNA, 16 bp, Homo sapiens
agcacccccacccacc

SEQ ID NO: 5561922 - DNA, 20 bp, Homo sapiens
agcacccccacgccctcatt

SEQ ID NO: 5561923 - DNA, 12 bp, Homo sapiens
agcacccccagc

SEQ ID NO: 5561924 - DNA, 13 bp, Homo sapiens
agcacccccagcc

SEQ ID NO: 5561925 - DNA, 14 bp, Homo sapiens
agcacccccagcct

SEQ ID NO: 5561926 - DNA, 20 bp, Homo sapiens
agcacccccagcctccccca

SEQ ID NO: 5561927 - DNA, 22 bp, Homo sapiens
agcacccccagcctcccccagg

SEQ ID NO: 5561928 - DNA, 14 bp, Homo sapiens
agcaccccctcatt

SEQ ID NO: 5561929 - DNA, 18 bp, Homo sapiens
agcaccccctcattcccc

SEQ ID NO: 5561930 - DNA, 16 bp, Homo sapiens
agcaccccctctcctg

SEQ ID NO: 5561931 - DNA, 20 bp, Homo sapiens
agcaccccctgctccaccag

SEQ ID NO: 5561932 - DNA, 22 bp, Homo sapiens
agcaccccgaagggagcatctg

SEQ ID NO: 5561933 - DNA, 18 bp, Homo sapiens
agcacccctactcacata

SEQ ID NO: 5561934 - DNA, 24 bp, Homo sapiens
agcaccctataaatcaacacctta

SEQ ID NO: 5561935 - DNA, 13 bp, Homo sapiens
agcaccctccccc

SEQ ID NO: 5561936 - DNA, 13 bp, Homo sapiens
agcaccctctccg

SEQ ID NO: 5561937 - DNA, 18 bp, Homo sapiens
agcaccctctcctggggg

SEQ ID NO: 5561938 - DNA, 19 bp, Homo sapiens
agcaccctctcctgggggt

SEQ ID NO: 5561939 - DNA, 13 bp, Homo sapiens
agcaccctctgga

SEQ ID NO: 5561940 - DNA, 13 bp, Homo sapiens
agcaccctgaggg

SEQ ID NO: 5561941 - DNA, 15 bp, Homo sapiens
agcaccctgagggcg

SEQ ID NO: 5561942 - DNA, 20 bp, Homo sapiens
agcaccctgcagagcacaca

SEQ ID NO: 5561943 - DNA, 13 bp, Homo sapiens
agcaccctgccct

SEQ ID NO: 5561944 - DNA, 13 bp, Homo sapiens
agcaccctgggtg

SEQ ID NO: 5561945 - DNA, 14 bp, Homo sapiens
agcaccctgggtgc

SEQ ID NO: 5561946 - DNA, 21 bp, Homo sapiens
agcacccttctcggagaccca

SEQ ID NO: 5561947 - DNA, 17 bp, Homo sapiens
agcacccttctgctgta

SEQ ID NO: 5561948 - DNA, 16 bp, Homo sapiens
agcaccgaatattgag

SEQ ID NO: 5561949 - DNA, 14 bp, Homo sapiens
agcaccgcagcatg

SEQ ID NO: 5561950 - DNA, 17 bp, Homo sapiens
agcaccggaccagcctg

SEQ ID NO: 5561951 - DNA, 19 bp, Homo sapiens
agcaccggaccagcctggc

SEQ ID NO: 5561952 - DNA, 15 bp, Homo sapiens
agcaccgggggagag

SEQ ID NO: 5561953 - DNA, 22 bp, Homo sapiens
agcaccgtgccaaccccaccca

SEQ ID NO: 5561954 - DNA, 23 bp, Homo sapiens
agcaccgtgccaaccccacccag

SEQ ID NO: 5561955 - DNA, 17 bp, Homo sapiens
agcaccgtggtgtgagg

SEQ ID NO: 5561956 - DNA, 19 bp, Homo sapiens
agcaccgtggtgtgaggcc

SEQ ID NO: 5561957 - DNA, 21 bp, Homo sapiens
agcaccgtggtgtgaggcccc

SEQ ID NO: 5561958 - DNA, 15 bp, Homo sapiens
agcaccgttctgtgc

SEQ ID NO: 5561959 - DNA, 17 bp, Homo sapiens
agcaccgttctgtgcac

SEQ ID NO: 5561960 - DNA, 15 bp, Homo sapiens
agcacctacagtgta

SEQ ID NO: 5561961 - DNA, 21 bp, Homo sapiens
agcacctacagtgtacagtct

SEQ ID NO: 5561962 - DNA, 23 bp, Homo sapiens
agcacctactatgtgctgggtgc

SEQ ID NO: 5561963 - DNA, 16 bp, Homo sapiens
agcacctaggtggggc

SEQ ID NO: 5561964 - DNA, 14 bp, Homo sapiens
agcacctccagcct

SEQ ID NO: 5561965 - DNA, 15 bp, Homo sapiens
agcacctccaggcct

SEQ ID NO: 5561966 - DNA, 13 bp, Homo sapiens
agcacctcccagc

SEQ ID NO: 5561967 - DNA, 14 bp, Homo sapiens
agcacctcccagcc

SEQ ID NO: 5561968 - DNA, 13 bp, Homo sapiens
agcacctccccag

SEQ ID NO: 5561969 - DNA, 17 bp, Homo sapiens
agcacctccccagacag

SEQ ID NO: 5561970 - DNA, 22 bp, Homo sapiens
agcacctccccagacagggctc

SEQ ID NO: 5561971 - DNA, 14 bp, Homo sapiens
agcacctccccgct

SEQ ID NO: 5561972 - DNA, 18 bp, Homo sapiens
agcacctcctctctgctg

SEQ ID NO: 5561973 - DNA, 19 bp, Homo sapiens
agcacctcctctctgctgg

SEQ ID NO: 5561974 - DNA, 16 bp, Homo sapiens
agcacctcctgcctcg

SEQ ID NO: 5561975 - DNA, 23 bp, Homo sapiens
agcacctgaaccccatgggcttg

SEQ ID NO: 5561976 - DNA, 20 bp, Homo sapiens
agcacctgccagaggatgct

SEQ ID NO: 5561977 - DNA, 13 bp, Homo sapiens
agcacctgccagg

SEQ ID NO: 5561978 - DNA, 17 bp, Homo sapiens
agcacctgccagggccc

SEQ ID NO: 5561979 - DNA, 12 bp, Homo sapiens
agcacctgcccc

SEQ ID NO: 5561980 - DNA, 16 bp, Homo sapiens
agcacctgccgacctc

SEQ ID NO: 5561981 - DNA, 21 bp, Homo sapiens
agcacctgcctcctcgttcct

SEQ ID NO: 5561982 - DNA, 15 bp, Homo sapiens
agcacctgctcccag

SEQ ID NO: 5561983 - DNA, 22 bp, Homo sapiens
agcacctggaccccctgcccgc

SEQ ID NO: 5561984 - DNA, 18 bp, Homo sapiens
agcacctggagcccacag

SEQ ID NO: 5561985 - DNA, 13 bp, Homo sapiens
agcacctgggccc

SEQ ID NO: 5561986 - DNA, 12 bp, Homo sapiens
agcacctgggtg

SEQ ID NO: 5561987 - DNA, 19 bp, Homo sapiens
agcacctgggtgtgctcca

SEQ ID NO: 5561988 - DNA, 22 bp, Homo sapiens
agcacctgtctcctttcacccc

SEQ ID NO: 5561989 - DNA, 23 bp, Homo sapiens
agcacctgtgcccatggcttctg

SEQ ID NO: 5561990 - DNA, 21 bp, Homo sapiens
agcaccttagacagtccctgc

SEQ ID NO: 5561991 - DNA, 23 bp, Homo sapiens
agcaccttagacagtccctgcca

SEQ ID NO: 5561992 - DNA, 20 bp, Homo sapiens
agcaccttagggagggactg

SEQ ID NO: 5561993 - DNA, 15 bp, Homo sapiens
agcaccttcctcact

SEQ ID NO: 5561994 - DNA, 18 bp, Homo sapiens
agcaccttcctcacttcc

SEQ ID NO: 5561995 - DNA, 22 bp, Homo sapiens
agcaccttctttctggactggc

SEQ ID NO: 5561996 - DNA, 15 bp, Homo sapiens
agcaccttgaatgga

SEQ ID NO: 5561997 - DNA, 14 bp, Homo sapiens
agcaccttgcagat

SEQ ID NO: 5561998 - DNA, 16 bp, Homo sapiens
agcaccttggcccagg

SEQ ID NO: 5561999 - DNA, 16 bp, Homo sapiens
agcaccttgtgcctgg

SEQ ID NO: 5562000 - DNA, 23 bp, Homo sapiens
agcacctttagaatattaaaaat

SEQ ID NO: 5562001 - DNA, 16 bp, Homo sapiens
agcaccttttctcctc

SEQ ID NO: 5562002 - DNA, 17 bp, Homo sapiens
agcacgacagtggatgc

SEQ ID NO: 5562003 - DNA, 13 bp, Homo sapiens
agcacgatttctg

SEQ ID NO: 5562004 - DNA, 14 bp, Homo sapiens
agcacgatttctgt

SEQ ID NO: 5562005 - DNA, 19 bp, Homo sapiens
agcacgatttctgtttaga

SEQ ID NO: 5562006 - DNA, 20 bp, Homo sapiens
agcacgcatgtccctccaag

SEQ ID NO: 5562007 - DNA, 13 bp, Homo sapiens
agcacgcctgcca

SEQ ID NO: 5562008 - DNA, 15 bp, Homo sapiens
agcacgcctgccatc

SEQ ID NO: 5562009 - DNA, 20 bp, Homo sapiens
agcacgcctgccatcttctc

SEQ ID NO: 5562010 - DNA, 13 bp, Homo sapiens
agcacgcctggct

SEQ ID NO: 5562011 - DNA, 17 bp, Homo sapiens
agcacgcgacttctcag

SEQ ID NO: 5562012 - DNA, 23 bp, Homo sapiens
agcacgcggccttgtctgggtgc

SEQ ID NO: 5562013 - DNA, 17 bp, Homo sapiens
agcacgctaccaaatct

SEQ ID NO: 5562014 - DNA, 21 bp, Homo sapiens
agcacgctgcctgccaaagta

SEQ ID NO: 5562015 - DNA, 17 bp, Homo sapiens
agcacggacaataaacc

SEQ ID NO: 5562016 - DNA, 21 bp, Homo sapiens
agcacggacaataaacctccg

SEQ ID NO: 5562017 - DNA, 20 bp, Homo sapiens
agcacggagtgttggggctg

SEQ ID NO: 5562018 - DNA, 21 bp, Homo sapiens
agcacggagtgttggggctgg

SEQ ID NO: 5562019 - DNA, 16 bp, Homo sapiens
agcacggcccggcccc

SEQ ID NO: 5562020 - DNA, 19 bp, Homo sapiens
agcacggcccggcccctca

SEQ ID NO: 5562021 - DNA, 15 bp, Homo sapiens
agcacgggacaggag

SEQ ID NO: 5562022 - DNA, 20 bp, Homo sapiens
agcacgggcgttatgtaagt

SEQ ID NO: 5562023 - DNA, 17 bp, Homo sapiens
agcacggggctggcagg

SEQ ID NO: 5562024 - DNA, 18 bp, Homo sapiens
agcacggtcccccaggag

SEQ ID NO: 5562025 - DNA, 19 bp, Homo sapiens
agcacggtgactctgtcca

SEQ ID NO: 5562026 - DNA, 15 bp, Homo sapiens
agcacggttgcctga

SEQ ID NO: 5562027 - DNA, 21 bp, Homo sapiens
agcacgtaaatgcgtccctgt

SEQ ID NO: 5562028 - DNA, 18 bp, Homo sapiens
agcacgtcgccatccgtc

SEQ ID NO: 5562029 - DNA, 13 bp, Homo sapiens
agcacgtgcaagg

SEQ ID NO: 5562030 - DNA, 16 bp, Homo sapiens
agcacgtgcaaggact

SEQ ID NO: 5562031 - DNA, 14 bp, Homo sapiens
agcacgtggagata

SEQ ID NO: 5562032 - DNA, 22 bp, Homo sapiens
agcacgtggagatagtgccagg

SEQ ID NO: 5562033 - DNA, 22 bp, Homo sapiens
agcacgttttctggcttctgct

SEQ ID NO: 5562034 - DNA, 20 bp, Homo sapiens
agcactaaagcagtggacac

SEQ ID NO: 5562035 - DNA, 20 bp, Homo sapiens
agcactaacctatgagggtg

SEQ ID NO: 5562036 - DNA, 16 bp, Homo sapiens
agcactaacgtaaata

SEQ ID NO: 5562037 - DNA, 14 bp, Homo sapiens
agcactaaggtgga

SEQ ID NO: 5562038 - DNA, 16 bp, Homo sapiens
agcactacaatcatgg

SEQ ID NO: 5562039 - DNA, 18 bp, Homo sapiens
agcactacaccttgcctt

SEQ ID NO: 5562040 - DNA, 16 bp, Homo sapiens
agcactacataaactg

SEQ ID NO: 5562041 - DNA, 16 bp, Homo sapiens
agcagcaacacaatgt

SEQ ID NO: 5562042 - DNA, 13 bp, Homo sapiens
agcagcaactgaa

SEQ ID NO: 5562043 - DNA, 15 bp, Homo sapiens
agcagcaactgaaga

SEQ ID NO: 5562044 - DNA, 16 bp, Homo sapiens
agcagcaacttgtcct

SEQ ID NO: 5562045 - DNA, 13 bp, Homo sapiens
agcagcaagaaaa

SEQ ID NO: 5562046 - DNA, 15 bp, Homo sapiens
agcagcaagaaaaaa

SEQ ID NO: 5562047 - DNA, 14 bp, Homo sapiens
agcagcaagaagca

SEQ ID NO: 5562048 - DNA, 19 bp, Homo sapiens
agcagcaagaagcagcctg

SEQ ID NO: 5562049 - DNA, 20 bp, Homo sapiens
agcagcaagaagcagcctgt

SEQ ID NO: 5562050 - DNA, 16 bp, Homo sapiens
agcagcaagattgctt

SEQ ID NO: 5562051 - DNA, 23 bp, Homo sapiens
agcagcaaggtcttgctctccta

SEQ ID NO: 5562052 - DNA, 20 bp, Homo sapiens
agcagcaaggtgggggtcag

SEQ ID NO: 5562053 - DNA, 13 bp, Homo sapiens
agcagcaagtgtg

SEQ ID NO: 5562054 - DNA, 17 bp, Homo sapiens
agcagcaatctgtcttt

SEQ ID NO: 5562055 - DNA, 14 bp, Homo sapiens
agcagcaattaatt

SEQ ID NO: 5562056 - DNA, 19 bp, Homo sapiens
agcagcacacctcagcccc

SEQ ID NO: 5562057 - DNA, 13 bp, Homo sapiens
agcagcacctcct

SEQ ID NO: 5562058 - DNA, 21 bp, Homo sapiens
agcagcacctcctcagcctga

SEQ ID NO: 5562059 - DNA, 16 bp, Homo sapiens
agcagcacctgcccta

SEQ ID NO: 5562060 - DNA, 17 bp, Homo sapiens
agcagcacctgccctac

SEQ ID NO: 5562061 - DNA, 21 bp, Homo sapiens
agcagcacgattttgcacaaa

SEQ ID NO: 5562062 - DNA, 22 bp, Homo sapiens
agcagcactcaaacctggagct

SEQ ID NO: 5562063 - DNA, 15 bp, Homo sapiens
agcagcactcccgct

SEQ ID NO: 5562064 - DNA, 20 bp, Homo sapiens
agcagcactcccgctgcaca

SEQ ID NO: 5562065 - DNA, 23 bp, Homo sapiens
agcagcactccgcatcacctcac

SEQ ID NO: 5562066 - DNA, 14 bp, Homo sapiens
agcagcactgcaga

SEQ ID NO: 5562067 - DNA, 13 bp, Homo sapiens
agcagcactgggg

SEQ ID NO: 5562068 - DNA, 18 bp, Homo sapiens
agcagcacttagacctgc

SEQ ID NO: 5562069 - DNA, 20 bp, Homo sapiens
agcagcacttagacctgcca

SEQ ID NO: 5562070 - DNA, 15 bp, Homo sapiens
agcagcacttataaa

SEQ ID NO: 5562071 - DNA, 18 bp, Homo sapiens
agcagcacttataaatca

SEQ ID NO: 5562072 - DNA, 13 bp, Homo sapiens
agcagcagaggca

SEQ ID NO: 5562073 - DNA, 22 bp, Homo sapiens
agcagcagaggtgagaactcag

SEQ ID NO: 5562074 - DNA, 23 bp, Homo sapiens
agcagcagaggtgagaactcaga

SEQ ID NO: 5562075 - DNA, 17 bp, Homo sapiens
agcagcagatctgtagt

SEQ ID NO: 5562076 - DNA, 13 bp, Homo sapiens
agcagcagcactt

SEQ ID NO: 5562077 - DNA, 14 bp, Homo sapiens
agcagcagcagcag

SEQ ID NO: 5562078 - DNA, 12 bp, Homo sapiens
agcagcagcagg

SEQ ID NO: 5562079 - DNA, 13 bp, Homo sapiens
agcagcagcaggt

SEQ ID NO: 5562080 - DNA, 12 bp, Homo sapiens
agcagcagccag

SEQ ID NO: 5562081 - DNA, 13 bp, Homo sapiens
agcagcagccagc

SEQ ID NO: 5562082 - DNA, 14 bp, Homo sapiens
agcagcagccagca

SEQ ID NO: 5562083 - DNA, 23 bp, Homo sapiens
agcagcagccgctgccaggggct

SEQ ID NO: 5562084 - DNA, 16 bp, Homo sapiens
agcagcagcctactga

SEQ ID NO: 5562085 - DNA, 13 bp, Homo sapiens
agcagcagcctcg

SEQ ID NO: 5562086 - DNA, 19 bp, Homo sapiens
agcagcagcctttaatgca

SEQ ID NO: 5562087 - DNA, 16 bp, Homo sapiens
agcagcagcgctcggc

SEQ ID NO: 5562088 - DNA, 22 bp, Homo sapiens
agcagcagctaggactgaggag

SEQ ID NO: 5562089 - DNA, 19 bp, Homo sapiens
agcagcagcttggggagag

SEQ ID NO: 5562090 - DNA, 13 bp, Homo sapiens
agcagcaggaagg

SEQ ID NO: 5562091 - DNA, 21 bp, Homo sapiens
agcagcaggaggggggaggga

SEQ ID NO: 5562092 - DNA, 22 bp, Homo sapiens
agcagcaggaggggggagggaa

SEQ ID NO: 5562093 - DNA, 14 bp, Homo sapiens
agcagcaggcctct

SEQ ID NO: 5562094 - DNA, 15 bp, Homo sapiens
agcagcaggcctctg

SEQ ID NO: 5562095 - DNA, 13 bp, Homo sapiens
agcagcaggctca

SEQ ID NO: 5562096 - DNA, 16 bp, Homo sapiens
agcagcagggagggct

SEQ ID NO: 5562097 - DNA, 14 bp, Homo sapiens
agcagcagggtttt

SEQ ID NO: 5562098 - DNA, 13 bp, Homo sapiens
agcagcaggtagc

SEQ ID NO: 5562099 - DNA, 16 bp, Homo sapiens
agcagcaggtctagaa

SEQ ID NO: 5562100 - DNA, 18 bp, Homo sapiens
agcagcagtgaaaacaag

SEQ ID NO: 5562101 - DNA, 15 bp, Homo sapiens
agcagcagtgtccag

SEQ ID NO: 5562102 - DNA, 21 bp, Homo sapiens
agcagcatagaacaggacctc

SEQ ID NO: 5562103 - DNA, 16 bp, Homo sapiens
agcagcatcccagcct

SEQ ID NO: 5562104 - DNA, 11 bp, Homo sapiens
agcagcatctc

SEQ ID NO: 5562105 - DNA, 18 bp, Homo sapiens
agcagcattctggagggg

SEQ ID NO: 5562106 - DNA, 17 bp, Homo sapiens
agcagcatttacagaaa

SEQ ID NO: 5562107 - DNA, 22 bp, Homo sapiens
agcagcatttttaattttcaca

SEQ ID NO: 5562108 - DNA, 23 bp, Homo sapiens
agcagcatttttaattttcacaa

SEQ ID NO: 5562109 - DNA, 11 bp, Homo sapiens
agcagccacat

SEQ ID NO: 5562110 - DNA, 22 bp, Homo sapiens
agcagccaccccatgctggcct

SEQ ID NO: 5562111 - DNA, 10 bp, Homo sapiens
agcagccacg

SEQ ID NO: 5562112 - DNA, 13 bp, Homo sapiens
agcagccacgagg

SEQ ID NO: 5562113 - DNA, 13 bp, Homo sapiens
agcagccagagct

SEQ ID NO: 5562114 - DNA, 22 bp, Homo sapiens
agcagccagagctgtgcctgct

SEQ ID NO: 5562115 - DNA, 12 bp, Homo sapiens
agcagccagcac

SEQ ID NO: 5562116 - DNA, 14 bp, Homo sapiens
agcagccagcacca

SEQ ID NO: 5562117 - DNA, 11 bp, Homo sapiens
agcagccagcc

SEQ ID NO: 5562118 - DNA, 18 bp, Homo sapiens
agcagccagccctgcctg

SEQ ID NO: 5562119 - DNA, 17 bp, Homo sapiens
agcagccagctctcagc

SEQ ID NO: 5562120 - DNA, 18 bp, Homo sapiens
agcagccagctctcagcc

SEQ ID NO: 5562121 - DNA, 23 bp, Homo sapiens
agcagccagctctcagccaacga

SEQ ID NO: 5562122 - DNA, 11 bp, Homo sapiens
agcagccagga

SEQ ID NO: 5562123 - DNA, 19 bp, Homo sapiens
agcagccaggacccgcctg

SEQ ID NO: 5562124 - DNA, 16 bp, Homo sapiens
agcagccaggagggac

SEQ ID NO: 5562125 - DNA, 14 bp, Homo sapiens
agcagccagggacc

SEQ ID NO: 5562126 - DNA, 14 bp, Homo sapiens
agcagccagtctca

SEQ ID NO: 5562127 - DNA, 23 bp, Homo sapiens
agcagccagtctcagagaccagc

SEQ ID NO: 5562128 - DNA, 18 bp, Homo sapiens
agcagcccaagcttccct

SEQ ID NO: 5562129 - DNA, 21 bp, Homo sapiens
agcagcccaagcttccctcca

SEQ ID NO: 5562130 - DNA, 18 bp, Homo sapiens
agcagcccacccagcaga

SEQ ID NO: 5562131 - DNA, 13 bp, Homo sapiens
agcagcccaccct

SEQ ID NO: 5562132 - DNA, 20 bp, Homo sapiens
agcagcccacctgctgcccg

SEQ ID NO: 5562133 - DNA, 11 bp, Homo sapiens
agcagcccagc

SEQ ID NO: 5562134 - DNA, 16 bp, Homo sapiens
agcagcccagcacaac

SEQ ID NO: 5562135 - DNA, 15 bp, Homo sapiens
agcagcccagcattt

SEQ ID NO: 5562136 - DNA, 12 bp, Homo sapiens
agcagcccagct

SEQ ID NO: 5562137 - DNA, 13 bp, Homo sapiens
agcagcccagctt

SEQ ID NO: 5562138 - DNA, 14 bp, Homo sapiens
agcagcccagggcc

SEQ ID NO: 5562139 - DNA, 16 bp, Homo sapiens
agcagcccagggccta

SEQ ID NO: 5562140 - DNA, 17 bp, Homo sapiens
agcagcccatggcctct

SEQ ID NO: 5562141 - DNA, 23 bp, Homo sapiens
agcagccccacaccagggccagc

SEQ ID NO: 5562142 - DNA, 20 bp, Homo sapiens
agcagcccccaaagagctgt

SEQ ID NO: 5562143 - DNA, 17 bp, Homo sapiens
agcagccccccagcact

SEQ ID NO: 5562144 - DNA, 18 bp, Homo sapiens
agcagccccgtctgccca

SEQ ID NO: 5562145 - DNA, 19 bp, Homo sapiens
agcagcccctcgaggccta

SEQ ID NO: 5562146 - DNA, 20 bp, Homo sapiens
agcagcccctgagagcctgt

SEQ ID NO: 5562147 - DNA, 18 bp, Homo sapiens
agcagccctaaggatctc

SEQ ID NO: 5562148 - DNA, 21 bp, Homo sapiens
agcagccctagcggctgctcc

SEQ ID NO: 5562149 - DNA, 13 bp, Homo sapiens
agcagccctcctc

SEQ ID NO: 5562150 - DNA, 18 bp, Homo sapiens
agcagccctcctcacccc

SEQ ID NO: 5562151 - DNA, 15 bp, Homo sapiens
agcagccctctgcct

SEQ ID NO: 5562152 - DNA, 17 bp, Homo sapiens
agcagccctgccccaca

SEQ ID NO: 5562153 - DNA, 15 bp, Homo sapiens
agcagccctggagtc

SEQ ID NO: 5562154 - DNA, 15 bp, Homo sapiens
agcagccctggatgg

SEQ ID NO: 5562155 - DNA, 13 bp, Homo sapiens
agcagcccttggc

SEQ ID NO: 5562156 - DNA, 19 bp, Homo sapiens
agcagcccttgtgtgtgcc

SEQ ID NO: 5562157 - DNA, 22 bp, Homo sapiens
agcagcccttgtgtgtgccctg

SEQ ID NO: 5562158 - DNA, 22 bp, Homo sapiens
agcagccggaagtctgttctca

SEQ ID NO: 5562159 - DNA, 20 bp, Homo sapiens
agcagccggaatagagcctc

SEQ ID NO: 5562160 - DNA, 22 bp, Homo sapiens
agcagcctcaaaacgggtcagt

SEQ ID NO: 5562161 - DNA, 20 bp, Homo sapiens
agcagcctcagaacaaagtg

SEQ ID NO: 5562162 - DNA, 14 bp, Homo sapiens
agcagcctcagagt

SEQ ID NO: 5562163 - DNA, 19 bp, Homo sapiens
agcagcctccactgtgtcc

SEQ ID NO: 5562164 - DNA, 16 bp, Homo sapiens
agcagcctccagtgct

SEQ ID NO: 5562165 - DNA, 22 bp, Homo sapiens
agcagcctccagtgctggctgc

SEQ ID NO: 5562166 - DNA, 16 bp, Homo sapiens
agcagcctccctgtca

SEQ ID NO: 5562167 - DNA, 16 bp, Homo sapiens
agcagcctcgaggctg

SEQ ID NO: 5562168 - DNA, 17 bp, Homo sapiens
agcagcctcgaggctgg

SEQ ID NO: 5562169 - DNA, 23 bp, Homo sapiens
agcagcctcgaggctggtggttt

SEQ ID NO: 5562170 - DNA, 12 bp, Homo sapiens
agcagcctcgca

SEQ ID NO: 5562171 - DNA, 14 bp, Homo sapiens
agcagcctcgcaca

SEQ ID NO: 5562172 - DNA, 17 bp, Homo sapiens
agcagcctcgcacaggc

SEQ ID NO: 5562173 - DNA, 20 bp, Homo sapiens
agcagcctcgcccctggcag

SEQ ID NO: 5562174 - DNA, 23 bp, Homo sapiens
agcagcctcgtggagctcgcccc

SEQ ID NO: 5562175 - DNA, 15 bp, Homo sapiens
agcagcctctcccca

SEQ ID NO: 5562176 - DNA, 21 bp, Homo sapiens
agcagcctctccccaggtcca

SEQ ID NO: 5562177 - DNA, 17 bp, Homo sapiens
agcagcctctgatctgt

SEQ ID NO: 5562178 - DNA, 17 bp, Homo sapiens
agcagcctctgccaggc

SEQ ID NO: 5562179 - DNA, 12 bp, Homo sapiens
agcagcctctgg

SEQ ID NO: 5562180 - DNA, 16 bp, Homo sapiens
agcagcctctggacag

SEQ ID NO: 5562181 - DNA, 18 bp, Homo sapiens
agcagcctgattgaaaag

SEQ ID NO: 5562182 - DNA, 10 bp, Homo sapiens
agcagcctgc

SEQ ID NO: 5562183 - DNA, 15 bp, Homo sapiens
agcagcctgcacctg

SEQ ID NO: 5562184 - DNA, 16 bp, Homo sapiens
agcagcctgcacctgc

SEQ ID NO: 5562185 - DNA, 17 bp, Homo sapiens
agcagcctgcacctgcc

SEQ ID NO: 5562186 - DNA, 18 bp, Homo sapiens
agcagcctgcacctgccc

SEQ ID NO: 5562187 - DNA, 19 bp, Homo sapiens
agcagcctgcacctgcccc

SEQ ID NO: 5562188 - DNA, 12 bp, Homo sapiens
agcagcctgcca

SEQ ID NO: 5562189 - DNA, 19 bp, Homo sapiens
agcagcctgcgctcggcag

SEQ ID NO: 5562190 - DNA, 21 bp, Homo sapiens
agcagcctgcgctcggcagga

SEQ ID NO: 5562191 - DNA, 15 bp, Homo sapiens
agcagcctggagccc

SEQ ID NO: 5562192 - DNA, 19 bp, Homo sapiens
agcagcctggctcccctgg

SEQ ID NO: 5562193 - DNA, 19 bp, Homo sapiens
agcagccttactattcata

SEQ ID NO: 5562194 - DNA, 13 bp, Homo sapiens
agcagccttccag

SEQ ID NO: 5562195 - DNA, 15 bp, Homo sapiens
agcagcctttctgtg

SEQ ID NO: 5562196 - DNA, 20 bp, Homo sapiens
agcagcctttttcaccatgg

SEQ ID NO: 5562197 - DNA, 21 bp, Homo sapiens
agcagcgaccacccctgcctc

SEQ ID NO: 5562198 - DNA, 22 bp, Homo sapiens
agcagcgaccacccctgcctcc

SEQ ID NO: 5562199 - DNA, 15 bp, Homo sapiens
agcagcgagcctgct

SEQ ID NO: 5562200 - DNA, 14 bp, Homo sapiens
agcagcgagtgcat

SEQ ID NO: 5562201 - DNA, 20 bp, Homo sapiens
agcagcgcagccgagcccca

SEQ ID NO: 5562202 - DNA, 15 bp, Homo sapiens
agcagcgcccaggcc

SEQ ID NO: 5562203 - DNA, 19 bp, Homo sapiens
agcagcgcccaggcctgct

SEQ ID NO: 5562204 - DNA, 22 bp, Homo sapiens
agcagcgcccaggcctgctggc

SEQ ID NO: 5562205 - DNA, 16 bp, Homo sapiens
agcagcgcccgaggcc

SEQ ID NO: 5562206 - DNA, 14 bp, Homo sapiens
agcagcgcctttcc

SEQ ID NO: 5562207 - DNA, 15 bp, Homo sapiens
agcagcgcctttccc

SEQ ID NO: 5562208 - DNA, 17 bp, Homo sapiens
agcagcgcgcaggcctg

SEQ ID NO: 5562209 - DNA, 18 bp, Homo sapiens
agcagcgctagtggaggg

SEQ ID NO: 5562210 - DNA, 22 bp, Homo sapiens
agcagcggattgctctggagca

SEQ ID NO: 5562211 - DNA, 17 bp, Homo sapiens
agcagcggcccagattg

SEQ ID NO: 5562212 - DNA, 23 bp, Homo sapiens
agcagcgggctaacgggaggctg

SEQ ID NO: 5562213 - DNA, 18 bp, Homo sapiens
agcagcgggggcggccca

SEQ ID NO: 5562214 - DNA, 21 bp, Homo sapiens
agcagcgggggcggcccagcc

SEQ ID NO: 5562215 - DNA, 23 bp, Homo sapiens
agcagcggtaccccagggcctac

SEQ ID NO: 5562216 - DNA, 16 bp, Homo sapiens
agcagcggtggcctct

SEQ ID NO: 5562217 - DNA, 23 bp, Homo sapiens
agcagcggtttggggagcagaga

SEQ ID NO: 5562218 - DNA, 13 bp, Homo sapiens
agcagcgtttcta

SEQ ID NO: 5562219 - DNA, 16 bp, Homo sapiens
agcagctaactccgag

SEQ ID NO: 5562220 - DNA, 13 bp, Homo sapiens
agcagtgttctca

SEQ ID NO: 5562221 - DNA, 19 bp, Homo sapiens
agcagtgttctcacagtgt

SEQ ID NO: 5562222 - DNA, 23 bp, Homo sapiens
agcagtgttctctctgaatgctg

SEQ ID NO: 5562223 - DNA, 16 bp, Homo sapiens
agcagtgttctgggtg

SEQ ID NO: 5562224 - DNA, 18 bp, Homo sapiens
agcagtgttgctcagctc

SEQ ID NO: 5562225 - DNA, 20 bp, Homo sapiens
agcagtgtttaaaaaatgag

SEQ ID NO: 5562226 - DNA, 12 bp, Homo sapiens
agcagtgttttc

SEQ ID NO: 5562227 - DNA, 22 bp, Homo sapiens
agcagttaactttaagactgag

SEQ ID NO: 5562228 - DNA, 23 bp, Homo sapiens
agcagttaatcacccaccatagg

SEQ ID NO: 5562229 - DNA, 13 bp, Homo sapiens
agcagttacagct

SEQ ID NO: 5562230 - DNA, 19 bp, Homo sapiens
agcagttacagctctgtag

SEQ ID NO: 5562231 - DNA, 20 bp, Homo sapiens
agcagttacagctctgtagt

SEQ ID NO: 5562232 - DNA, 22 bp, Homo sapiens
agcagttactccctacactgat

SEQ ID NO: 5562233 - DNA, 23 bp, Homo sapiens
agcagttactccctacactgatg

SEQ ID NO: 5562234 - DNA, 15 bp, Homo sapiens
agcagttaggcacct

SEQ ID NO: 5562235 - DNA, 13 bp, Homo sapiens
agcagttataaca

SEQ ID NO: 5562236 - DNA, 20 bp, Homo sapiens
agcagttcacctatttcaaa

SEQ ID NO: 5562237 - DNA, 15 bp, Homo sapiens
agcagttcacttcct

SEQ ID NO: 5562238 - DNA, 17 bp, Homo sapiens
agcagttcacttcctag

SEQ ID NO: 5562239 - DNA, 15 bp, Homo sapiens
agcagttcagagctg

SEQ ID NO: 5562240 - DNA, 17 bp, Homo sapiens
agcagttcagagctgcc

SEQ ID NO: 5562241 - DNA, 19 bp, Homo sapiens
agcagttcagagctgccct

SEQ ID NO: 5562242 - DNA, 13 bp, Homo sapiens
agcagttcattct

SEQ ID NO: 5562243 - DNA, 14 bp, Homo sapiens
agcagttcattcta

SEQ ID NO: 5562244 - DNA, 16 bp, Homo sapiens
agcagttccatgaaga

SEQ ID NO: 5562245 - DNA, 19 bp, Homo sapiens
agcagttccatgaagacac

SEQ ID NO: 5562246 - DNA, 18 bp, Homo sapiens
agcagttcccaaggacag

SEQ ID NO: 5562247 - DNA, 23 bp, Homo sapiens
agcagttcccaaggacagtcagc

SEQ ID NO: 5562248 - DNA, 23 bp, Homo sapiens
agcagttcctgtcccacatggcc

SEQ ID NO: 5562249 - DNA, 16 bp, Homo sapiens
agcagttctctgccaa

SEQ ID NO: 5562250 - DNA, 23 bp, Homo sapiens
agcagttctgcaaatagaaaaca

SEQ ID NO: 5562251 - DNA, 21 bp, Homo sapiens
agcagttcttaacccagtgtc

SEQ ID NO: 5562252 - DNA, 22 bp, Homo sapiens
agcagttgacatccaaatctag

SEQ ID NO: 5562253 - DNA, 22 bp, Homo sapiens
agcagttgagacaagaaaataa

SEQ ID NO: 5562254 - DNA, 23 bp, Homo sapiens
agcagttgagtcgtcatcacttt

SEQ ID NO: 5562255 - DNA, 17 bp, Homo sapiens
agcagttgcaatgatca

SEQ ID NO: 5562256 - DNA, 21 bp, Homo sapiens
agcagttgctagcaacaactt

SEQ ID NO: 5562257 - DNA, 17 bp, Homo sapiens
agcagttgctggtaaaa

SEQ ID NO: 5562258 - DNA, 23 bp, Homo sapiens
agcagttgctggtaaaatgaaga

SEQ ID NO: 5562259 - DNA, 19 bp, Homo sapiens
agcagttggatcttttgaa

SEQ ID NO: 5562260 - DNA, 13 bp, Homo sapiens
agcagttggggcc

SEQ ID NO: 5562261 - DNA, 13 bp, Homo sapiens
agcagttgttcca

SEQ ID NO: 5562262 - DNA, 15 bp, Homo sapiens
agcagtttattataa

SEQ ID NO: 5562263 - DNA, 12 bp, Homo sapiens
agcagtttcaat

SEQ ID NO: 5562264 - DNA, 15 bp, Homo sapiens
agcagtttcaataaa

SEQ ID NO: 5562265 - DNA, 17 bp, Homo sapiens
agcagtttcaataaagt

SEQ ID NO: 5562266 - DNA, 22 bp, Homo sapiens
agcagtttcaccatctttgagg

SEQ ID NO: 5562267 - DNA, 14 bp, Homo sapiens
agcagtttcactgc

SEQ ID NO: 5562268 - DNA, 14 bp, Homo sapiens
agcagtttcagata

SEQ ID NO: 5562269 - DNA, 16 bp, Homo sapiens
agcagtttcagataaa

SEQ ID NO: 5562270 - DNA, 23 bp, Homo sapiens
agcagtttcagataaatcatggg

SEQ ID NO: 5562271 - DNA, 14 bp, Homo sapiens
agcagtttcaggta

SEQ ID NO: 5562272 - DNA, 15 bp, Homo sapiens
agcagtttcattgtg

SEQ ID NO: 5562273 - DNA, 22 bp, Homo sapiens
agcagtttccagagagtggaga

SEQ ID NO: 5562274 - DNA, 13 bp, Homo sapiens
agcagtttccagt

SEQ ID NO: 5562275 - DNA, 15 bp, Homo sapiens
agcagtttcccagaa

SEQ ID NO: 5562276 - DNA, 15 bp, Homo sapiens
agcagtttcctcagt

SEQ ID NO: 5562277 - DNA, 20 bp, Homo sapiens
agcagtttctgtcctgctgg

SEQ ID NO: 5562278 - DNA, 17 bp, Homo sapiens
agcagtttgagcttgct

SEQ ID NO: 5562279 - DNA, 17 bp, Homo sapiens
agcagtttgcctctgca

SEQ ID NO: 5562280 - DNA, 18 bp, Homo sapiens
agcagtttgcctctgcac

SEQ ID NO: 5562281 - DNA, 22 bp, Homo sapiens
agcagtttgcctctgcacgtgc

SEQ ID NO: 5562282 - DNA, 13 bp, Homo sapiens
agcagttttcaag

SEQ ID NO: 5562283 - DNA, 17 bp, Homo sapiens
agcagttttcaagtcaa

SEQ ID NO: 5562284 - DNA, 21 bp, Homo sapiens
agcagttttcaagtcaaatta

SEQ ID NO: 5562285 - DNA, 16 bp, Homo sapiens
agcagttttcccctgg

SEQ ID NO: 5562286 - DNA, 18 bp, Homo sapiens
agcagttttcccctggcc

SEQ ID NO: 5562287 - DNA, 19 bp, Homo sapiens
agcagttttcccctggcct

SEQ ID NO: 5562288 - DNA, 20 bp, Homo sapiens
agcagttttcccctggcctc

SEQ ID NO: 5562289 - DNA, 16 bp, Homo sapiens
agcagttttgtaaatg

SEQ ID NO: 5562290 - DNA, 15 bp, Homo sapiens
agcagtttttccccc

SEQ ID NO: 5562291 - DNA, 16 bp, Homo sapiens
agcagtttttgaaaga

SEQ ID NO: 5562292 - DNA, 23 bp, Homo sapiens
agcataaaaattgaattcgtttc

SEQ ID NO: 5562293 - DNA, 14 bp, Homo sapiens
agcataaaacctaa

SEQ ID NO: 5562294 - DNA, 19 bp, Homo sapiens
agcataaaagatcaccttg

SEQ ID NO: 5562295 - DNA, 21 bp, Homo sapiens
agcataaaagatcaccttgta

SEQ ID NO: 5562296 - DNA, 18 bp, Homo sapiens
agcataaacatcacatgg

SEQ ID NO: 5562297 - DNA, 20 bp, Homo sapiens
agcataaacatcacatggca

SEQ ID NO: 5562298 - DNA, 11 bp, Homo sapiens
agcataaagaa

SEQ ID NO: 5562299 - DNA, 14 bp, Homo sapiens
agcataaagaattt

SEQ ID NO: 5562300 - DNA, 13 bp, Homo sapiens
agcataaagctca

SEQ ID NO: 5562301 - DNA, 22 bp, Homo sapiens
agcataaatcacttcaactgct

SEQ ID NO: 5562302 - DNA, 13 bp, Homo sapiens
agcataaatctgt

SEQ ID NO: 5562303 - DNA, 23 bp, Homo sapiens
agcataaatctgttagcattatt

SEQ ID NO: 5562304 - DNA, 13 bp, Homo sapiens
agcataaatttaa

SEQ ID NO: 5562305 - DNA, 18 bp, Homo sapiens
agcataaatttaatgtag

SEQ ID NO: 5562306 - DNA, 13 bp, Homo sapiens
agcataactgtag

SEQ ID NO: 5562307 - DNA, 13 bp, Homo sapiens
agcataagaccaa

SEQ ID NO: 5562308 - DNA, 20 bp, Homo sapiens
agcataatatgaagcctttg

SEQ ID NO: 5562309 - DNA, 15 bp, Homo sapiens
agcataatattttct

SEQ ID NO: 5562310 - DNA, 15 bp, Homo sapiens
agcataatctgaaaa

SEQ ID NO: 5562311 - DNA, 17 bp, Homo sapiens
agcataatctgaaaaca

SEQ ID NO: 5562312 - DNA, 21 bp, Homo sapiens
agcataatgctcccatctcct

SEQ ID NO: 5562313 - DNA, 12 bp, Homo sapiens
agcataattaat

SEQ ID NO: 5562314 - DNA, 21 bp, Homo sapiens
agcataattgaaagttctgaa

SEQ ID NO: 5562315 - DNA, 18 bp, Homo sapiens
agcataatttaaaaatat

SEQ ID NO: 5562316 - DNA, 17 bp, Homo sapiens
agcataatttgtttaaa

SEQ ID NO: 5562317 - DNA, 18 bp, Homo sapiens
agcatacaaaaatatatt

SEQ ID NO: 5562318 - DNA, 12 bp, Homo sapiens
agcatacaactt

SEQ ID NO: 5562319 - DNA, 21 bp, Homo sapiens
agcatacaccaaacatttctg

SEQ ID NO: 5562320 - DNA, 13 bp, Homo sapiens
agcatacatttat

SEQ ID NO: 5562321 - DNA, 22 bp, Homo sapiens
agcataccaattacccataaac

SEQ ID NO: 5562322 - DNA, 21 bp, Homo sapiens
agcataccagttcttgcaata

SEQ ID NO: 5562323 - DNA, 17 bp, Homo sapiens
agcatacgtacacattt

SEQ ID NO: 5562324 - DNA, 12 bp, Homo sapiens
agcatactgatg

SEQ ID NO: 5562325 - DNA, 21 bp, Homo sapiens
agcatactggcttcaccatca

SEQ ID NO: 5562326 - DNA, 13 bp, Homo sapiens
agcatactgtgta

SEQ ID NO: 5562327 - DNA, 14 bp, Homo sapiens
agcatactgtgtat

SEQ ID NO: 5562328 - DNA, 15 bp, Homo sapiens
agcatacttctagga

SEQ ID NO: 5562329 - DNA, 14 bp, Homo sapiens
agcatactttgtaa

SEQ ID NO: 5562330 - DNA, 17 bp, Homo sapiens
agcatactttgtaaata

SEQ ID NO: 5562331 - DNA, 16 bp, Homo sapiens
agcatagaaaccacta

SEQ ID NO: 5562332 - DNA, 19 bp, Homo sapiens
agcatagaatagcgacagg

SEQ ID NO: 5562333 - DNA, 13 bp, Homo sapiens
agcatagagaaca

SEQ ID NO: 5562334 - DNA, 19 bp, Homo sapiens
agcatagataatattgttt

SEQ ID NO: 5562335 - DNA, 20 bp, Homo sapiens
agcatagatatctatatttt

SEQ ID NO: 5562336 - DNA, 21 bp, Homo sapiens
agcatagcagaggggccaggc

SEQ ID NO: 5562337 - DNA, 22 bp, Homo sapiens
agcatagcagaggggccaggcc

SEQ ID NO: 5562338 - DNA, 23 bp, Homo sapiens
agcatagcagaggggccaggccc

SEQ ID NO: 5562339 - DNA, 16 bp, Homo sapiens
agcatagccagcattc

SEQ ID NO: 5562340 - DNA, 17 bp, Homo sapiens
agcatagcctgcctgat

SEQ ID NO: 5562341 - DNA, 16 bp, Homo sapiens
agcatagcttattatt

SEQ ID NO: 5562342 - DNA, 18 bp, Homo sapiens
agcatagcttattattga

SEQ ID NO: 5562343 - DNA, 17 bp, Homo sapiens
agcataggctggggaca

SEQ ID NO: 5562344 - DNA, 15 bp, Homo sapiens
agcataggggggagg

SEQ ID NO: 5562345 - DNA, 16 bp, Homo sapiens
agcataggggggaggg

SEQ ID NO: 5562346 - DNA, 17 bp, Homo sapiens
agcataggggggagggt

SEQ ID NO: 5562347 - DNA, 14 bp, Homo sapiens
agcataggtatgct

SEQ ID NO: 5562348 - DNA, 23 bp, Homo sapiens
agcataggtgatccatgtaactg

SEQ ID NO: 5562349 - DNA, 16 bp, Homo sapiens
agcatagttctgcaat

SEQ ID NO: 5562350 - DNA, 20 bp, Homo sapiens
agcatagttctgcaataaca

SEQ ID NO: 5562351 - DNA, 15 bp, Homo sapiens
agcatataaaatggc

SEQ ID NO: 5562352 - DNA, 16 bp, Homo sapiens
agcatatagactatat

SEQ ID NO: 5562353 - DNA, 16 bp, Homo sapiens
agcatatataaaacaa

SEQ ID NO: 5562354 - DNA, 18 bp, Homo sapiens
agcatatataatcaaaat

SEQ ID NO: 5562355 - DNA, 21 bp, Homo sapiens
agcatatatagtatttaattg

SEQ ID NO: 5562356 - DNA, 17 bp, Homo sapiens
agcatatatataaaata

SEQ ID NO: 5562357 - DNA, 18 bp, Homo sapiens
agcatatatataaaatac

SEQ ID NO: 5562358 - DNA, 14 bp, Homo sapiens
agcatatcccacca

SEQ ID NO: 5562359 - DNA, 16 bp, Homo sapiens
agcatatcgtttaatt

SEQ ID NO: 5562360 - DNA, 16 bp, Homo sapiens
agcatatctgattgtt

SEQ ID NO: 5562361 - DNA, 15 bp, Homo sapiens
agcatatctgccttt

SEQ ID NO: 5562362 - DNA, 20 bp, Homo sapiens
agcatatctggtatatgtca

SEQ ID NO: 5562363 - DNA, 19 bp, Homo sapiens
agcatatgacaaatgtttc

SEQ ID NO: 5562364 - DNA, 20 bp, Homo sapiens
agcatatgagtttcatagct

SEQ ID NO: 5562365 - DNA, 15 bp, Homo sapiens
agcatatgcagccaa

SEQ ID NO: 5562366 - DNA, 23 bp, Homo sapiens
agcatatgcagccaaccaagatg

SEQ ID NO: 5562367 - DNA, 20 bp, Homo sapiens
agcatatgggttagatgttg

SEQ ID NO: 5562368 - DNA, 19 bp, Homo sapiens
agcatatgttccatgcctg

SEQ ID NO: 5562369 - DNA, 14 bp, Homo sapiens
agcatattcaggaa

SEQ ID NO: 5562370 - DNA, 16 bp, Homo sapiens
agcatattcaggaagc

SEQ ID NO: 5562371 - DNA, 19 bp, Homo sapiens
agcatatttgccaataaag

SEQ ID NO: 5562372 - DNA, 18 bp, Homo sapiens
agcatatttgtatagttg

SEQ ID NO: 5562373 - DNA, 21 bp, Homo sapiens
agcatatttgtatagttgctt

SEQ ID NO: 5562374 - DNA, 15 bp, Homo sapiens
agcatattttctcta

SEQ ID NO: 5562375 - DNA, 22 bp, Homo sapiens
agcatattttcttacttttatt

SEQ ID NO: 5562376 - DNA, 15 bp, Homo sapiens
agcatcaaacatgaa

SEQ ID NO: 5562377 - DNA, 16 bp, Homo sapiens
agcatcaaacatgaaa

SEQ ID NO: 5562378 - DNA, 17 bp, Homo sapiens
agcatcaaacatgaaaa

SEQ ID NO: 5562379 - DNA, 15 bp, Homo sapiens
agcatcaacctagga

SEQ ID NO: 5562380 - DNA, 19 bp, Homo sapiens
agcatcaacctaggagcag

SEQ ID NO: 5562381 - DNA, 15 bp, Homo sapiens
agcatcacaaatgat

SEQ ID NO: 5562382 - DNA, 16 bp, Homo sapiens
agcatcacacagtggc

SEQ ID NO: 5562383 - DNA, 19 bp, Homo sapiens
agcatcacacagtggcact

SEQ ID NO: 5562384 - DNA, 15 bp, Homo sapiens
agcatcacagttttg

SEQ ID NO: 5562385 - DNA, 17 bp, Homo sapiens
agcatcacagttttggt

SEQ ID NO: 5562386 - DNA, 20 bp, Homo sapiens
agcatcaccactcattttga

SEQ ID NO: 5562387 - DNA, 13 bp, Homo sapiens
agcatcacctcag

SEQ ID NO: 5562388 - DNA, 13 bp, Homo sapiens
agcatcacctgcc

SEQ ID NO: 5562389 - DNA, 19 bp, Homo sapiens
agcatcactagtgacaagt

SEQ ID NO: 5562390 - DNA, 20 bp, Homo sapiens
agcatcactccccaaggaag

SEQ ID NO: 5562391 - DNA, 13 bp, Homo sapiens
agcatcactgatg

SEQ ID NO: 5562392 - DNA, 22 bp, Homo sapiens
agcatcactgatgggaataaaa

SEQ ID NO: 5562393 - DNA, 21 bp, Homo sapiens
agcatcactgccttggcccct

SEQ ID NO: 5562394 - DNA, 16 bp, Homo sapiens
agcatcacttaaaaca

SEQ ID NO: 5562395 - DNA, 17 bp, Homo sapiens
agcatcacttaaaacac

SEQ ID NO: 5562396 - DNA, 23 bp, Homo sapiens
agcatcagagagtgtacatcatg

SEQ ID NO: 5562397 - DNA, 20 bp, Homo sapiens
agcattgtcaccgcaggtgc

SEQ ID NO: 5562398 - DNA, 21 bp, Homo sapiens
agcattgtcaccgcaggtgct

SEQ ID NO: 5562399 - DNA, 15 bp, Homo sapiens
agcattgtctatttt

SEQ ID NO: 5562400 - DNA, 14 bp, Homo sapiens
agcattgtcttgtt

SEQ ID NO: 5562401 - DNA, 18 bp, Homo sapiens
agcattgtcttgttctgt

SEQ ID NO: 5562402 - DNA, 23 bp, Homo sapiens
agcattgtctttgctgtactctt

SEQ ID NO: 5562403 - DNA, 17 bp, Homo sapiens
agcattgtgcaatacag

SEQ ID NO: 5562404 - DNA, 16 bp, Homo sapiens
agcattgtgtggaatt

SEQ ID NO: 5562405 - DNA, 23 bp, Homo sapiens
agcattgtgtgtgcagacttcag

SEQ ID NO: 5562406 - DNA, 23 bp, Homo sapiens
agcattgttccacacatttaaaa

SEQ ID NO: 5562407 - DNA, 17 bp, Homo sapiens
agcattgtttgcttatt

SEQ ID NO: 5562408 - DNA, 21 bp, Homo sapiens
agcattgtttgcttattgttc

SEQ ID NO: 5562409 - DNA, 13 bp, Homo sapiens
agcatttaaaatg

SEQ ID NO: 5562410 - DNA, 14 bp, Homo sapiens
agcatttaaggaaa

SEQ ID NO: 5562411 - DNA, 16 bp, Homo sapiens
agcatttaaggaaact

SEQ ID NO: 5562412 - DNA, 20 bp, Homo sapiens
agcatttaatggcagctagt

SEQ ID NO: 5562413 - DNA, 17 bp, Homo sapiens
agcatttaccaacatgt

SEQ ID NO: 5562414 - DNA, 22 bp, Homo sapiens
agcatttaccaacatgtatctg

SEQ ID NO: 5562415 - DNA, 18 bp, Homo sapiens
agcatttactatgcacaa

SEQ ID NO: 5562416 - DNA, 15 bp, Homo sapiens
agcatttagaaaact

SEQ ID NO: 5562417 - DNA, 14 bp, Homo sapiens
agcatttagagctt

SEQ ID NO: 5562418 - DNA, 14 bp, Homo sapiens
agcatttaggagaa

SEQ ID NO: 5562419 - DNA, 21 bp, Homo sapiens
agcatttaggagaatagcaga

SEQ ID NO: 5562420 - DNA, 21 bp, Homo sapiens
agcatttagtccaatgtcttt

SEQ ID NO: 5562421 - DNA, 16 bp, Homo sapiens
agcatttatcattctt

SEQ ID NO: 5562422 - DNA, 17 bp, Homo sapiens
agcatttatggtaatca

SEQ ID NO: 5562423 - DNA, 16 bp, Homo sapiens
agcatttatgtagaca

SEQ ID NO: 5562424 - DNA, 17 bp, Homo sapiens
agcatttatgtagacat

SEQ ID NO: 5562425 - DNA, 20 bp, Homo sapiens
agcatttatgtagacattgt

SEQ ID NO: 5562426 - DNA, 22 bp, Homo sapiens
agcatttatgtagacattgtaa

SEQ ID NO: 5562427 - DNA, 15 bp, Homo sapiens
agcatttatttctct

SEQ ID NO: 5562428 - DNA, 17 bp, Homo sapiens
agcatttcaaagccctg

SEQ ID NO: 5562429 - DNA, 19 bp, Homo sapiens
agcatttcaaagccctgcc

SEQ ID NO: 5562430 - DNA, 22 bp, Homo sapiens
agcatttcaaagccctgcctct

SEQ ID NO: 5562431 - DNA, 23 bp, Homo sapiens
agcatttcaaagccctgcctctg

SEQ ID NO: 5562432 - DNA, 24 bp, Homo sapiens
agcatttcaaagccctgcctctgt

SEQ ID NO: 5562433 - DNA, 17 bp, Homo sapiens
agcatttcacttattta

SEQ ID NO: 5562434 - DNA, 11 bp, Homo sapiens
agcatttcatg

SEQ ID NO: 5562435 - DNA, 22 bp, Homo sapiens
agcatttccaacaccacagaca

SEQ ID NO: 5562436 - DNA, 15 bp, Homo sapiens
agcatttcccgaagg

SEQ ID NO: 5562437 - DNA, 11 bp, Homo sapiens
agcatttccta

SEQ ID NO: 5562438 - DNA, 14 bp, Homo sapiens
agcatttccttcca

SEQ ID NO: 5562439 - DNA, 23 bp, Homo sapiens
agcatttccttccagcccatcca

SEQ ID NO: 5562440 - DNA, 20 bp, Homo sapiens
agcatttcgcgatggacaga

SEQ ID NO: 5562441 - DNA, 18 bp, Homo sapiens
agcatttctagaacaatt

SEQ ID NO: 5562442 - DNA, 14 bp, Homo sapiens
agcatttctcatca

SEQ ID NO: 5562443 - DNA, 21 bp, Homo sapiens
agcatttcttttctctttaat

SEQ ID NO: 5562444 - DNA, 12 bp, Homo sapiens
agcatttgaatg

SEQ ID NO: 5562445 - DNA, 13 bp, Homo sapiens
agcatttgaatgc

SEQ ID NO: 5562446 - DNA, 14 bp, Homo sapiens
agcatttgaatgca

SEQ ID NO: 5562447 - DNA, 16 bp, Homo sapiens
agcatttgaatgcatt

SEQ ID NO: 5562448 - DNA, 17 bp, Homo sapiens
agcatttgataatgata

SEQ ID NO: 5562449 - DNA, 12 bp, Homo sapiens
agcatttgatat

SEQ ID NO: 5562450 - DNA, 22 bp, Homo sapiens
agcatttgatctgttgcaagcc

SEQ ID NO: 5562451 - DNA, 17 bp, Homo sapiens
agcatttgattaacatt

SEQ ID NO: 5562452 - DNA, 16 bp, Homo sapiens
agcatttgatttccat

SEQ ID NO: 5562453 - DNA, 17 bp, Homo sapiens
agcatttgccattcctg

SEQ ID NO: 5562454 - DNA, 19 bp, Homo sapiens
agcatttgccattcctgga

SEQ ID NO: 5562455 - DNA, 12 bp, Homo sapiens
agcatttggaaa

SEQ ID NO: 5562456 - DNA, 18 bp, Homo sapiens
agcatttggaaggaaagg

SEQ ID NO: 5562457 - DNA, 20 bp, Homo sapiens
agcatttggaaggaaaggaa

SEQ ID NO: 5562458 - DNA, 23 bp, Homo sapiens
agcatttggaccaatagcccaca

SEQ ID NO: 5562459 - DNA, 14 bp, Homo sapiens
agcatttggtgctt

SEQ ID NO: 5562460 - DNA, 16 bp, Homo sapiens
agcatttgtccaccca

SEQ ID NO: 5562461 - DNA, 13 bp, Homo sapiens
agcatttgtcctt

SEQ ID NO: 5562462 - DNA, 20 bp, Homo sapiens
agcatttgtccttttgtgaa

SEQ ID NO: 5562463 - DNA, 17 bp, Homo sapiens
agcatttgtgttgaaga

SEQ ID NO: 5562464 - DNA, 17 bp, Homo sapiens
agcatttgttctttgcc

SEQ ID NO: 5562465 - DNA, 20 bp, Homo sapiens
agcatttgttctttgccagt

SEQ ID NO: 5562466 - DNA, 13 bp, Homo sapiens
agcattttaaaca

SEQ ID NO: 5562467 - DNA, 20 bp, Homo sapiens
agcattttaaacaaaataga

SEQ ID NO: 5562468 - DNA, 21 bp, Homo sapiens
agcattttaatagtttctaaa

SEQ ID NO: 5562469 - DNA, 17 bp, Homo sapiens
agcattttaatgatatt

SEQ ID NO: 5562470 - DNA, 16 bp, Homo sapiens
agcattttagaaacta

SEQ ID NO: 5562471 - DNA, 20 bp, Homo sapiens
agcattttagaaactacaaa

SEQ ID NO: 5562472 - DNA, 23 bp, Homo sapiens
agcattttagcaatttatacaat

SEQ ID NO: 5562473 - DNA, 11 bp, Homo sapiens
agcattttata

SEQ ID NO: 5562474 - DNA, 15 bp, Homo sapiens
agcattttataaatc

SEQ ID NO: 5562475 - DNA, 13 bp, Homo sapiens
agcattttcagca

SEQ ID NO: 5562476 - DNA, 17 bp, Homo sapiens
agcattttcctctgctt

SEQ ID NO: 5562477 - DNA, 18 bp, Homo sapiens
agcattttcctctgcttt

SEQ ID NO: 5562478 - DNA, 21 bp, Homo sapiens
agcattttcctctgctttgaa

SEQ ID NO: 5562479 - DNA, 18 bp, Homo sapiens
agcattttcctgtttact

SEQ ID NO: 5562480 - DNA, 23 bp, Homo sapiens
agcattttcttagacctcttcag

SEQ ID NO: 5562481 - DNA, 19 bp, Homo sapiens
agcattttctttctgtttt

SEQ ID NO: 5562482 - DNA, 13 bp, Homo sapiens
agcattttgcaaa

SEQ ID NO: 5562483 - DNA, 13 bp, Homo sapiens
agcattttgctaa

SEQ ID NO: 5562484 - DNA, 15 bp, Homo sapiens
agcattttgctaaat

SEQ ID NO: 5562485 - DNA, 22 bp, Homo sapiens
agcattttgctaaatgtgaatg

SEQ ID NO: 5562486 - DNA, 14 bp, Homo sapiens
agcattttggcgct

SEQ ID NO: 5562487 - DNA, 15 bp, Homo sapiens
agcattttgtgtctt

SEQ ID NO: 5562488 - DNA, 23 bp, Homo sapiens
agcatttttaagggagtggcctc

SEQ ID NO: 5562489 - DNA, 20 bp, Homo sapiens
agcatttttaattttcacaa

SEQ ID NO: 5562490 - DNA, 14 bp, Homo sapiens
agcatttttatgca

SEQ ID NO: 5562491 - DNA, 17 bp, Homo sapiens
agcatttttatgcagac

SEQ ID NO: 5562492 - DNA, 20 bp, Homo sapiens
agcatttttattcatgccat

SEQ ID NO: 5562493 - DNA, 16 bp, Homo sapiens
agcatttttatttcag

SEQ ID NO: 5562494 - DNA, 12 bp, Homo sapiens
agcatttttcaa

SEQ ID NO: 5562495 - DNA, 13 bp, Homo sapiens
agcatttttcaat

SEQ ID NO: 5562496 - DNA, 16 bp, Homo sapiens
agcatttttcaatata

SEQ ID NO: 5562497 - DNA, 22 bp, Homo sapiens
agcatttttcaatatattgaac

SEQ ID NO: 5562498 - DNA, 23 bp, Homo sapiens
agcatttttcagagttttctaac

SEQ ID NO: 5562499 - DNA, 21 bp, Homo sapiens
agcatttttctttagtcattt

SEQ ID NO: 5562500 - DNA, 17 bp, Homo sapiens
agcatttttttattcag

SEQ ID NO: 5562501 - DNA, 16 bp, Homo sapiens
agccaaaaacaataaa

SEQ ID NO: 5562502 - DNA, 17 bp, Homo sapiens
agccaaaaacaataaac

SEQ ID NO: 5562503 - DNA, 22 bp, Homo sapiens
agccaaaaatagctaaatacct

SEQ ID NO: 5562504 - DNA, 12 bp, Homo sapiens
agccaaaacact

SEQ ID NO: 5562505 - DNA, 20 bp, Homo sapiens
agccaaaagtccctccctgc

SEQ ID NO: 5562506 - DNA, 18 bp, Homo sapiens
agccaaaatgcagtctta

SEQ ID NO: 5562507 - DNA, 23 bp, Homo sapiens
agccaaaatgtgagtggttgaat

SEQ ID NO: 5562508 - DNA, 13 bp, Homo sapiens
agccaaacaaaac

SEQ ID NO: 5562509 - DNA, 13 bp, Homo sapiens
agccaaacaagcc

SEQ ID NO: 5562510 - DNA, 14 bp, Homo sapiens
agccaaacaagcct

SEQ ID NO: 5562511 - DNA, 18 bp, Homo sapiens
agccaaacaagccttagc

SEQ ID NO: 5562512 - DNA, 15 bp, Homo sapiens
agccaaacacactgt

SEQ ID NO: 5562513 - DNA, 17 bp, Homo sapiens
agccaaacacactgtaa

SEQ ID NO: 5562514 - DNA, 13 bp, Homo sapiens
agccaaacagagc

SEQ ID NO: 5562515 - DNA, 12 bp, Homo sapiens
agccaaacagga

SEQ ID NO: 5562516 - DNA, 21 bp, Homo sapiens
agccaaacatatatatactat

SEQ ID NO: 5562517 - DNA, 18 bp, Homo sapiens
agccaaacatcctacaag

SEQ ID NO: 5562518 - DNA, 19 bp, Homo sapiens
agccaaaccaacaccccat

SEQ ID NO: 5562519 - DNA, 15 bp, Homo sapiens
agccaaacccactct

SEQ ID NO: 5562520 - DNA, 15 bp, Homo sapiens
agccaaacccctaga

SEQ ID NO: 5562521 - DNA, 18 bp, Homo sapiens
agccaaacctttcctgta

SEQ ID NO: 5562522 - DNA, 16 bp, Homo sapiens
agccaaacgggagctt

SEQ ID NO: 5562523 - DNA, 18 bp, Homo sapiens
agccaaactcaggcccag

SEQ ID NO: 5562524 - DNA, 14 bp, Homo sapiens
agccaaactgtctt

SEQ ID NO: 5562525 - DNA, 12 bp, Homo sapiens
agccaaagaaac

SEQ ID NO: 5562526 - DNA, 17 bp, Homo sapiens
agccaaagaaacaagct

SEQ ID NO: 5562527 - DNA, 20 bp, Homo sapiens
agccaaagaatatttaaata

SEQ ID NO: 5562528 - DNA, 15 bp, Homo sapiens
agccaaagagactgg

SEQ ID NO: 5562529 - DNA, 18 bp, Homo sapiens
agccaaagaggcattcag

SEQ ID NO: 5562530 - DNA, 14 bp, Homo sapiens
agccaaagccagag

SEQ ID NO: 5562531 - DNA, 14 bp, Homo sapiens
agccaaaggcagct

SEQ ID NO: 5562532 - DNA, 20 bp, Homo sapiens
agccaaaggccgtgcctggt

SEQ ID NO: 5562533 - DNA, 23 bp, Homo sapiens
agccaaaggccgtgcctggtggg

SEQ ID NO: 5562534 - DNA, 14 bp, Homo sapiens
agccaaaggggagc

SEQ ID NO: 5562535 - DNA, 16 bp, Homo sapiens
agccaaaggggagcca

SEQ ID NO: 5562536 - DNA, 17 bp, Homo sapiens
agccaaaggggagccag

SEQ ID NO: 5562537 - DNA, 18 bp, Homo sapiens
agccaaaggtcaaacagg

SEQ ID NO: 5562538 - DNA, 17 bp, Homo sapiens
agccaaagttttcaaac

SEQ ID NO: 5562539 - DNA, 21 bp, Homo sapiens
agccaaagttttcaaactgct

SEQ ID NO: 5562540 - DNA, 20 bp, Homo sapiens
agccaaatgaccgagccctg

SEQ ID NO: 5562541 - DNA, 14 bp, Homo sapiens
agccaaattttatc

SEQ ID NO: 5562542 - DNA, 14 bp, Homo sapiens
agccaacaagaccg

SEQ ID NO: 5562543 - DNA, 15 bp, Homo sapiens
agccaacaagaccgc

SEQ ID NO: 5562544 - DNA, 19 bp, Homo sapiens
agccaacacccatctgttt

SEQ ID NO: 5562545 - DNA, 18 bp, Homo sapiens
agccaacagaagcttcca

SEQ ID NO: 5562546 - DNA, 20 bp, Homo sapiens
agccaacagctacaacagcc

SEQ ID NO: 5562547 - DNA, 19 bp, Homo sapiens
agccaacaggtaaacacat

SEQ ID NO: 5562548 - DNA, 16 bp, Homo sapiens
agccaacatgtggctc

SEQ ID NO: 5562549 - DNA, 14 bp, Homo sapiens
agccaaccagcctt

SEQ ID NO: 5562550 - DNA, 18 bp, Homo sapiens
agccaaccctggaaaagg

SEQ ID NO: 5562551 - DNA, 16 bp, Homo sapiens
agccaacctaagcaag

SEQ ID NO: 5562552 - DNA, 18 bp, Homo sapiens
agccaacctcggcttgtg

SEQ ID NO: 5562553 - DNA, 20 bp, Homo sapiens
agccaacctcggcttgtggg

SEQ ID NO: 5562554 - DNA, 13 bp, Homo sapiens
agccaacctggac

SEQ ID NO: 5562555 - DNA, 17 bp, Homo sapiens
agccaacctggacttcc

SEQ ID NO: 5562556 - DNA, 18 bp, Homo sapiens
agccaacctggacttcct

SEQ ID NO: 5562557 - DNA, 19 bp, Homo sapiens
agccaaccttacttacagc

SEQ ID NO: 5562558 - DNA, 20 bp, Homo sapiens
agccaaccttcaaagaaact

SEQ ID NO: 5562559 - DNA, 23 bp, Homo sapiens
agccaaccttgctcttggggaag

SEQ ID NO: 5562560 - DNA, 21 bp, Homo sapiens
agccaacgacaaagccaaact

SEQ ID NO: 5562561 - DNA, 16 bp, Homo sapiens
agccaactagcccctg

SEQ ID NO: 5562562 - DNA, 17 bp, Homo sapiens
agccaactatgattatt

SEQ ID NO: 5562563 - DNA, 12 bp, Homo sapiens
agccaactccat

SEQ ID NO: 5562564 - DNA, 18 bp, Homo sapiens
agccaactctaacaggca

SEQ ID NO: 5562565 - DNA, 14 bp, Homo sapiens
agccaactctccca

SEQ ID NO: 5562566 - DNA, 22 bp, Homo sapiens
agccaactgattttgtatgtaa

SEQ ID NO: 5562567 - DNA, 21 bp, Homo sapiens
agccaactgctaatgcaaatt

SEQ ID NO: 5562568 - DNA, 14 bp, Homo sapiens
agccaactgctgct

SEQ ID NO: 5562569 - DNA, 21 bp, Homo sapiens
agccaactgctgctttttgag

SEQ ID NO: 5562570 - DNA, 19 bp, Homo sapiens
agccaactgtttccctgct

SEQ ID NO: 5562571 - DNA, 16 bp, Homo sapiens
agccaacttaaacctg

SEQ ID NO: 5562572 - DNA, 15 bp, Homo sapiens
agccaacttgtaaat

SEQ ID NO: 5562573 - DNA, 17 bp, Homo sapiens
agccaagaaagatgtat

SEQ ID NO: 5562574 - DNA, 12 bp, Homo sapiens
agccaagaagtg

SEQ ID NO: 5562575 - DNA, 21 bp, Homo sapiens
agccagatgctaggctgtctg

SEQ ID NO: 5562576 - DNA, 17 bp, Homo sapiens
agccagattaggcctgg

SEQ ID NO: 5562577 - DNA, 18 bp, Homo sapiens
agccagattaggcctgga

SEQ ID NO: 5562578 - DNA, 20 bp, Homo sapiens
agccagattctcttgaataa

SEQ ID NO: 5562579 - DNA, 18 bp, Homo sapiens
agccagattggccaatta

SEQ ID NO: 5562580 - DNA, 19 bp, Homo sapiens
agccagattggccaattaa

SEQ ID NO: 5562581 - DNA, 18 bp, Homo sapiens
agccagattttttaaaat

SEQ ID NO: 5562582 - DNA, 23 bp, Homo sapiens
agccagcaaagcctccagcatct

SEQ ID NO: 5562583 - DNA, 16 bp, Homo sapiens
agccagcaagaggaag

SEQ ID NO: 5562584 - DNA, 21 bp, Homo sapiens
agccagcaccacctacacagg

SEQ ID NO: 5562585 - DNA, 15 bp, Homo sapiens
agccagcacccacct

SEQ ID NO: 5562586 - DNA, 22 bp, Homo sapiens
agccagcaccgccggctttcag

SEQ ID NO: 5562587 - DNA, 13 bp, Homo sapiens
agccagcacctgg

SEQ ID NO: 5562588 - DNA, 15 bp, Homo sapiens
agccagcacttgtat

SEQ ID NO: 5562589 - DNA, 22 bp, Homo sapiens
agccagcacttgtccagctgag

SEQ ID NO: 5562590 - DNA, 16 bp, Homo sapiens
agccagcagacattgt

SEQ ID NO: 5562591 - DNA, 15 bp, Homo sapiens
agccagcagcaggat

SEQ ID NO: 5562592 - DNA, 14 bp, Homo sapiens
agccagcagccagc

SEQ ID NO: 5562593 - DNA, 16 bp, Homo sapiens
agccagcagccagctc

SEQ ID NO: 5562594 - DNA, 16 bp, Homo sapiens
agccagcagctgaagt

SEQ ID NO: 5562595 - DNA, 14 bp, Homo sapiens
agccagcaggctct

SEQ ID NO: 5562596 - DNA, 16 bp, Homo sapiens
agccagcaggctctca

SEQ ID NO: 5562597 - DNA, 18 bp, Homo sapiens
agccagcaggctctcagg

SEQ ID NO: 5562598 - DNA, 19 bp, Homo sapiens
agccagcaggctctcaggc

SEQ ID NO: 5562599 - DNA, 23 bp, Homo sapiens
agccagcaggctctcaggccagc

SEQ ID NO: 5562600 - DNA, 13 bp, Homo sapiens
agccagcagggcg

SEQ ID NO: 5562601 - DNA, 23 bp, Homo sapiens
agccagcagggcgggccaggaga

SEQ ID NO: 5562602 - DNA, 14 bp, Homo sapiens
agccagcagggctg

SEQ ID NO: 5562603 - DNA, 16 bp, Homo sapiens
agccagcagggctgtg

SEQ ID NO: 5562604 - DNA, 14 bp, Homo sapiens
agccagcagttcag

SEQ ID NO: 5562605 - DNA, 16 bp, Homo sapiens
agccagcatctgggcc

SEQ ID NO: 5562606 - DNA, 18 bp, Homo sapiens
agccagcattcagcacac

SEQ ID NO: 5562607 - DNA, 17 bp, Homo sapiens
agccagcatttcctcag

SEQ ID NO: 5562608 - DNA, 20 bp, Homo sapiens
agccagccaaatccatcctg

SEQ ID NO: 5562609 - DNA, 24 bp, Homo sapiens
agccagccaagctttaaattatgt

SEQ ID NO: 5562610 - DNA, 10 bp, Homo sapiens
agccagccac

SEQ ID NO: 5562611 - DNA, 11 bp, Homo sapiens
agccagccaca

SEQ ID NO: 5562612 - DNA, 20 bp, Homo sapiens
agccagccacagacccctgg

SEQ ID NO: 5562613 - DNA, 11 bp, Homo sapiens
agccagccacc

SEQ ID NO: 5562614 - DNA, 12 bp, Homo sapiens
agccagccaccc

SEQ ID NO: 5562615 - DNA, 18 bp, Homo sapiens
agccagccacccctgcca

SEQ ID NO: 5562616 - DNA, 13 bp, Homo sapiens
agccagccaccct

SEQ ID NO: 5562617 - DNA, 14 bp, Homo sapiens
agccagccactcta

SEQ ID NO: 5562618 - DNA, 21 bp, Homo sapiens
agccagccactctaccagtgc

SEQ ID NO: 5562619 - DNA, 22 bp, Homo sapiens
agccagccaggaactggctcct

SEQ ID NO: 5562620 - DNA, 15 bp, Homo sapiens
agccagccaggtgca

SEQ ID NO: 5562621 - DNA, 11 bp, Homo sapiens
agccagcccag

SEQ ID NO: 5562622 - DNA, 15 bp, Homo sapiens
agccagcccagccca

SEQ ID NO: 5562623 - DNA, 23 bp, Homo sapiens
agccagcccagctccactcaggg

SEQ ID NO: 5562624 - DNA, 19 bp, Homo sapiens
agccagcccatggccccca

SEQ ID NO: 5562625 - DNA, 17 bp, Homo sapiens
agccagccccctccagc

SEQ ID NO: 5562626 - DNA, 17 bp, Homo sapiens
agccagcccctcttccc

SEQ ID NO: 5562627 - DNA, 19 bp, Homo sapiens
agccagcccgtgtgtataa

SEQ ID NO: 5562628 - DNA, 13 bp, Homo sapiens
agccagccctccc

SEQ ID NO: 5562629 - DNA, 15 bp, Homo sapiens
agccagccctccctg

SEQ ID NO: 5562630 - DNA, 16 bp, Homo sapiens
agccagccctccctgt

SEQ ID NO: 5562631 - DNA, 20 bp, Homo sapiens
agccagccctccctgtcctc

SEQ ID NO: 5562632 - DNA, 23 bp, Homo sapiens
agccagccctgcctggaggacct

SEQ ID NO: 5562633 - DNA, 15 bp, Homo sapiens
agccagccctggagg

SEQ ID NO: 5562634 - DNA, 18 bp, Homo sapiens
agccagccctggaggctg

SEQ ID NO: 5562635 - DNA, 13 bp, Homo sapiens
agccagccctggc

SEQ ID NO: 5562636 - DNA, 15 bp, Homo sapiens
agccagccctggccc

SEQ ID NO: 5562637 - DNA, 14 bp, Homo sapiens
agccagcccttccc

SEQ ID NO: 5562638 - DNA, 23 bp, Homo sapiens
agccagcccttcccaggccagcg

SEQ ID NO: 5562639 - DNA, 21 bp, Homo sapiens
agccagccgagcaggaggcct

SEQ ID NO: 5562640 - DNA, 15 bp, Homo sapiens
agccagccgccctgg

SEQ ID NO: 5562641 - DNA, 17 bp, Homo sapiens
agccagccgccctgggc

SEQ ID NO: 5562642 - DNA, 15 bp, Homo sapiens
agccagccggtgcct

SEQ ID NO: 5562643 - DNA, 17 bp, Homo sapiens
agccagccgtggccaga

SEQ ID NO: 5562644 - DNA, 10 bp, Homo sapiens
agccagcctc

SEQ ID NO: 5562645 - DNA, 18 bp, Homo sapiens
agccagcctcgcccatcc

SEQ ID NO: 5562646 - DNA, 11 bp, Homo sapiens
agccagcctga

SEQ ID NO: 5562647 - DNA, 17 bp, Homo sapiens
agccagcctgcttccca

SEQ ID NO: 5562648 - DNA, 22 bp, Homo sapiens
agccagcctgcttcccacaact

SEQ ID NO: 5562649 - DNA, 19 bp, Homo sapiens
agccagcctggctctgccc

SEQ ID NO: 5562650 - DNA, 18 bp, Homo sapiens
agccagcctgggggctgg

SEQ ID NO: 5562651 - DNA, 12 bp, Homo sapiens
agccagcctggt

SEQ ID NO: 5562652 - DNA, 18 bp, Homo sapiens
agccagccttcttccatc

SEQ ID NO: 5562653 - DNA, 12 bp, Homo sapiens
agccagccttgg

SEQ ID NO: 5562654 - DNA, 12 bp, Homo sapiens
agccagcgcctc

SEQ ID NO: 5562655 - DNA, 17 bp, Homo sapiens
agccagcgcctccctcc

SEQ ID NO: 5562656 - DNA, 14 bp, Homo sapiens
agccagcgcctgcc

SEQ ID NO: 5562657 - DNA, 21 bp, Homo sapiens
agccagcggcatatacttgtt

SEQ ID NO: 5562658 - DNA, 15 bp, Homo sapiens
agccagcggctccaa

SEQ ID NO: 5562659 - DNA, 17 bp, Homo sapiens
agccagcgtcctcctct

SEQ ID NO: 5562660 - DNA, 18 bp, Homo sapiens
agccagcgtcctcctctg

SEQ ID NO: 5562661 - DNA, 19 bp, Homo sapiens
agccagcgtcctcctctgt

SEQ ID NO: 5562662 - DNA, 20 bp, Homo sapiens
agccagcgtcggtctgtgcc

SEQ ID NO: 5562663 - DNA, 15 bp, Homo sapiens
agccagctcatttca

SEQ ID NO: 5562664 - DNA, 11 bp, Homo sapiens
agccagctccc

SEQ ID NO: 5562665 - DNA, 14 bp, Homo sapiens
agccagctcctggt

SEQ ID NO: 5562666 - DNA, 13 bp, Homo sapiens
agccagctctagg

SEQ ID NO: 5562667 - DNA, 16 bp, Homo sapiens
agccagctctcagcca

SEQ ID NO: 5562668 - DNA, 13 bp, Homo sapiens
agccagctctctc

SEQ ID NO: 5562669 - DNA, 13 bp, Homo sapiens
agccagctctggg

SEQ ID NO: 5562670 - DNA, 20 bp, Homo sapiens
agccagctgcagctgggctg

SEQ ID NO: 5562671 - DNA, 13 bp, Homo sapiens
agccagctgcagg

SEQ ID NO: 5562672 - DNA, 14 bp, Homo sapiens
agccagctgcaggg

SEQ ID NO: 5562673 - DNA, 17 bp, Homo sapiens
agccagctgcagggcac

SEQ ID NO: 5562674 - DNA, 19 bp, Homo sapiens
agccagctgcagggcacgg

SEQ ID NO: 5562675 - DNA, 14 bp, Homo sapiens
agccagctgcccta

SEQ ID NO: 5562676 - DNA, 16 bp, Homo sapiens
agccagctgccgacca

SEQ ID NO: 5562677 - DNA, 14 bp, Homo sapiens
agccagctgcctag

SEQ ID NO: 5562678 - DNA, 15 bp, Homo sapiens
agccagctgcctagg

SEQ ID NO: 5562679 - DNA, 11 bp, Homo sapiens
agccagctgct

SEQ ID NO: 5562680 - DNA, 13 bp, Homo sapiens
agccagctgcttt

SEQ ID NO: 5562681 - DNA, 15 bp, Homo sapiens
agccagctgcttttt

SEQ ID NO: 5562682 - DNA, 19 bp, Homo sapiens
agccagcttcctgtgcaga

SEQ ID NO: 5562683 - DNA, 17 bp, Homo sapiens
agccagcttggtggtta

SEQ ID NO: 5562684 - DNA, 13 bp, Homo sapiens
agccagctttccc

SEQ ID NO: 5562685 - DNA, 16 bp, Homo sapiens
agccagctttccctgc

SEQ ID NO: 5562686 - DNA, 16 bp, Homo sapiens
agccaggaaacatgaa

SEQ ID NO: 5562687 - DNA, 20 bp, Homo sapiens
agccaggaacagggaccagc

SEQ ID NO: 5562688 - DNA, 16 bp, Homo sapiens
agccaggaagccccgc

SEQ ID NO: 5562689 - DNA, 20 bp, Homo sapiens
agccaggaatttcccaggac

SEQ ID NO: 5562690 - DNA, 22 bp, Homo sapiens
agccaggacaccgggcagggcc

SEQ ID NO: 5562691 - DNA, 19 bp, Homo sapiens
agccaggacccgcctgctc

SEQ ID NO: 5562692 - DNA, 23 bp, Homo sapiens
agccaggacccgcctgctcccat

SEQ ID NO: 5562693 - DNA, 20 bp, Homo sapiens
agccaggactcccagaacct

SEQ ID NO: 5562694 - DNA, 16 bp, Homo sapiens
agccaggactccttag

SEQ ID NO: 5562695 - DNA, 21 bp, Homo sapiens
agccaggagaagacccctgcc

SEQ ID NO: 5562696 - DNA, 20 bp, Homo sapiens
agccaggagaagctcagctg

SEQ ID NO: 5562697 - DNA, 12 bp, Homo sapiens
agccaggagacc

SEQ ID NO: 5562698 - DNA, 18 bp, Homo sapiens
agccaggagaccctgtct

SEQ ID NO: 5562699 - DNA, 19 bp, Homo sapiens
agccaggagaccctgtctt

SEQ ID NO: 5562700 - DNA, 14 bp, Homo sapiens
agccaggagacctg

SEQ ID NO: 5562701 - DNA, 13 bp, Homo sapiens
agccaggagcaaa

SEQ ID NO: 5562702 - DNA, 12 bp, Homo sapiens
agccaggagcag

SEQ ID NO: 5562703 - DNA, 13 bp, Homo sapiens
agccaggagcaga

SEQ ID NO: 5562704 - DNA, 20 bp, Homo sapiens
agccaggagcagccctggcc

SEQ ID NO: 5562705 - DNA, 13 bp, Homo sapiens
agccaggagcgca

SEQ ID NO: 5562706 - DNA, 15 bp, Homo sapiens
agccaggagctgtca

SEQ ID NO: 5562707 - DNA, 19 bp, Homo sapiens
agccaggaggaaactacac

SEQ ID NO: 5562708 - DNA, 14 bp, Homo sapiens
agccaggaggcctg

SEQ ID NO: 5562709 - DNA, 18 bp, Homo sapiens
agccaggaggcctgcacc

SEQ ID NO: 5562710 - DNA, 16 bp, Homo sapiens
agccaggaggcctgct

SEQ ID NO: 5562711 - DNA, 19 bp, Homo sapiens
agccaggaggcctgctagg

SEQ ID NO: 5562712 - DNA, 11 bp, Homo sapiens
agccaggaggg

SEQ ID NO: 5562713 - DNA, 14 bp, Homo sapiens
agccaggagtgggt

SEQ ID NO: 5562714 - DNA, 23 bp, Homo sapiens
agccaggatcatggtgtaataag

SEQ ID NO: 5562715 - DNA, 14 bp, Homo sapiens
agccaggatgccca

SEQ ID NO: 5562716 - DNA, 13 bp, Homo sapiens
agccaggatggtc

SEQ ID NO: 5562717 - DNA, 18 bp, Homo sapiens
agccaggccaactgcccc

SEQ ID NO: 5562718 - DNA, 12 bp, Homo sapiens
agccaggccaca

SEQ ID NO: 5562719 - DNA, 10 bp, Homo sapiens
agccaggccc

SEQ ID NO: 5562720 - DNA, 11 bp, Homo sapiens
agccaggccca

SEQ ID NO: 5562721 - DNA, 12 bp, Homo sapiens
agccaggcccag

SEQ ID NO: 5562722 - DNA, 18 bp, Homo sapiens
agccaggcccaggccagc

SEQ ID NO: 5562723 - DNA, 11 bp, Homo sapiens
agccaggcccc

SEQ ID NO: 5562724 - DNA, 12 bp, Homo sapiens
agccaggcccca

SEQ ID NO: 5562725 - DNA, 13 bp, Homo sapiens
agccaggccccac

SEQ ID NO: 5562726 - DNA, 17 bp, Homo sapiens
agccaggccccacccct

SEQ ID NO: 5562727 - DNA, 14 bp, Homo sapiens
agccaggccccagg

SEQ ID NO: 5562728 - DNA, 15 bp, Homo sapiens
agccaggccccaggc

SEQ ID NO: 5562729 - DNA, 22 bp, Homo sapiens
agccaggcccttgtcggcccca

SEQ ID NO: 5562730 - DNA, 13 bp, Homo sapiens
agccaggcctccc

SEQ ID NO: 5562731 - DNA, 18 bp, Homo sapiens
agccaggcctcccgcatg

SEQ ID NO: 5562732 - DNA, 13 bp, Homo sapiens
agccaggcctcgc

SEQ ID NO: 5562733 - DNA, 15 bp, Homo sapiens
agccaggcctcgcct

SEQ ID NO: 5562734 - DNA, 20 bp, Homo sapiens
agccaggcctcgcctgccct

SEQ ID NO: 5562735 - DNA, 12 bp, Homo sapiens
agccaggcctga

SEQ ID NO: 5562736 - DNA, 14 bp, Homo sapiens
agccaggcctggct

SEQ ID NO: 5562737 - DNA, 16 bp, Homo sapiens
agccaggcctgtcatg

SEQ ID NO: 5562738 - DNA, 14 bp, Homo sapiens
agccaggcgggctc

SEQ ID NO: 5562739 - DNA, 15 bp, Homo sapiens
agccaggcgggctca

SEQ ID NO: 5562740 - DNA, 18 bp, Homo sapiens
agccaggcgggctcaagg

SEQ ID NO: 5562741 - DNA, 21 bp, Homo sapiens
agccaggctagctggagcctg

SEQ ID NO: 5562742 - DNA, 16 bp, Homo sapiens
agccaggctatggttg

SEQ ID NO: 5562743 - DNA, 21 bp, Homo sapiens
agccaggctatggttgccacc

SEQ ID NO: 5562744 - DNA, 15 bp, Homo sapiens
agccaggctcactca

SEQ ID NO: 5562745 - DNA, 15 bp, Homo sapiens
agccaggctcaggag

SEQ ID NO: 5562746 - DNA, 17 bp, Homo sapiens
agccaggctcaggagaa

SEQ ID NO: 5562747 - DNA, 13 bp, Homo sapiens
agccaggctccta

SEQ ID NO: 5562748 - DNA, 15 bp, Homo sapiens
agccaggctgagtga

SEQ ID NO: 5562749 - DNA, 17 bp, Homo sapiens
agccaggctgagtgagc

SEQ ID NO: 5562750 - DNA, 20 bp, Homo sapiens
agccaggctgccaaggccag

SEQ ID NO: 5562751 - DNA, 14 bp, Homo sapiens
agccaggctgggcc

SEQ ID NO: 5562752 - DNA, 23 bp, Homo sapiens
agccaggcttttctcaggagctt

SEQ ID NO: 5562753 - DNA, 16 bp, Homo sapiens
agccagggaaagactg

SEQ ID NO: 5562754 - DNA, 18 bp, Homo sapiens
agccagggaacagcccca

SEQ ID NO: 5562755 - DNA, 22 bp, Homo sapiens
agccagggaacagccccagggt

SEQ ID NO: 5562756 - DNA, 20 bp, Homo sapiens
agccagggacccccagaaca

SEQ ID NO: 5562757 - DNA, 20 bp, Homo sapiens
agcccagaacaaaaagaaat

SEQ ID NO: 5562758 - DNA, 16 bp, Homo sapiens
agcccagaaccacaga

SEQ ID NO: 5562759 - DNA, 17 bp, Homo sapiens
agcccagaaccacagat

SEQ ID NO: 5562760 - DNA, 17 bp, Homo sapiens
agcccagaacgggcctc

SEQ ID NO: 5562761 - DNA, 21 bp, Homo sapiens
agcccagaacgggcctccccg

SEQ ID NO: 5562762 - DNA, 16 bp, Homo sapiens
agcccagaaggccaga

SEQ ID NO: 5562763 - DNA, 16 bp, Homo sapiens
agcccagaagtgcaga

SEQ ID NO: 5562764 - DNA, 23 bp, Homo sapiens
agcccagacccccagtgtatttt

SEQ ID NO: 5562765 - DNA, 21 bp, Homo sapiens
agcccagacctcccctcttcc

SEQ ID NO: 5562766 - DNA, 23 bp, Homo sapiens
agcccagactttagtgccctgcc

SEQ ID NO: 5562767 - DNA, 10 bp, Homo sapiens
agcccagaga

SEQ ID NO: 5562768 - DNA, 14 bp, Homo sapiens
agcccagagaagct

SEQ ID NO: 5562769 - DNA, 11 bp, Homo sapiens
agcccagagac

SEQ ID NO: 5562770 - DNA, 21 bp, Homo sapiens
agcccagagacatacttgaag

SEQ ID NO: 5562771 - DNA, 21 bp, Homo sapiens
agcccagagagaccctgccaa

SEQ ID NO: 5562772 - DNA, 13 bp, Homo sapiens
agcccagagccac

SEQ ID NO: 5562773 - DNA, 21 bp, Homo sapiens
agcccagagcctggctgccca

SEQ ID NO: 5562774 - DNA, 15 bp, Homo sapiens
agcccagaggagggc

SEQ ID NO: 5562775 - DNA, 20 bp, Homo sapiens
agcccagaggtaacagaaca

SEQ ID NO: 5562776 - DNA, 21 bp, Homo sapiens
agcccagatacgggggctgtg

SEQ ID NO: 5562777 - DNA, 18 bp, Homo sapiens
agcccagatcagctccta

SEQ ID NO: 5562778 - DNA, 15 bp, Homo sapiens
agcccagatcccaag

SEQ ID NO: 5562779 - DNA, 20 bp, Homo sapiens
agcccagatggaaagacgtt

SEQ ID NO: 5562780 - DNA, 16 bp, Homo sapiens
agcccagatggctccc

SEQ ID NO: 5562781 - DNA, 19 bp, Homo sapiens
agcccagatggctccctgg

SEQ ID NO: 5562782 - DNA, 22 bp, Homo sapiens
agcccagatgttttacgtctgg

SEQ ID NO: 5562783 - DNA, 18 bp, Homo sapiens
agcccagattcccctgtg

SEQ ID NO: 5562784 - DNA, 20 bp, Homo sapiens
agcccagattcccctgtgtc

SEQ ID NO: 5562785 - DNA, 13 bp, Homo sapiens
agcccagcacaac

SEQ ID NO: 5562786 - DNA, 18 bp, Homo sapiens
agcccagcaccccttcct

SEQ ID NO: 5562787 - DNA, 18 bp, Homo sapiens
agcccagcacctgctccc

SEQ ID NO: 5562788 - DNA, 15 bp, Homo sapiens
agcccagcactgctt

SEQ ID NO: 5562789 - DNA, 16 bp, Homo sapiens
agcccagcagtgtgga

SEQ ID NO: 5562790 - DNA, 14 bp, Homo sapiens
agcccagccacctc

SEQ ID NO: 5562791 - DNA, 15 bp, Homo sapiens
agcccagccacctcc

SEQ ID NO: 5562792 - DNA, 21 bp, Homo sapiens
agcccagccacctcccaagga

SEQ ID NO: 5562793 - DNA, 15 bp, Homo sapiens
agcccagccacggac

SEQ ID NO: 5562794 - DNA, 21 bp, Homo sapiens
agcccagccattaccatggag

SEQ ID NO: 5562795 - DNA, 16 bp, Homo sapiens
agcccagcccaagcac

SEQ ID NO: 5562796 - DNA, 16 bp, Homo sapiens
agcccagcccagctgc

SEQ ID NO: 5562797 - DNA, 15 bp, Homo sapiens
agcccagcccaggag

SEQ ID NO: 5562798 - DNA, 19 bp, Homo sapiens
agcccagccccactcctct

SEQ ID NO: 5562799 - DNA, 12 bp, Homo sapiens
agcccagcccct

SEQ ID NO: 5562800 - DNA, 15 bp, Homo sapiens
agcccagccctgttc

SEQ ID NO: 5562801 - DNA, 22 bp, Homo sapiens
agcccagcctatctctcttctg

SEQ ID NO: 5562802 - DNA, 11 bp, Homo sapiens
agcccagcctc

SEQ ID NO: 5562803 - DNA, 13 bp, Homo sapiens
agcccagcctgca

SEQ ID NO: 5562804 - DNA, 14 bp, Homo sapiens
agcccagcctgccc

SEQ ID NO: 5562805 - DNA, 23 bp, Homo sapiens
agcccagcctgccccctatcttg

SEQ ID NO: 5562806 - DNA, 14 bp, Homo sapiens
agcccagcgacaca

SEQ ID NO: 5562807 - DNA, 14 bp, Homo sapiens
agcccagcgctctg

SEQ ID NO: 5562808 - DNA, 16 bp, Homo sapiens
agcccagcggcccaag

SEQ ID NO: 5562809 - DNA, 12 bp, Homo sapiens
agcccagctcca

SEQ ID NO: 5562810 - DNA, 14 bp, Homo sapiens
agcccagctccagg

SEQ ID NO: 5562811 - DNA, 19 bp, Homo sapiens
agcccagctcctgaataaa

SEQ ID NO: 5562812 - DNA, 11 bp, Homo sapiens
agcccagctct

SEQ ID NO: 5562813 - DNA, 17 bp, Homo sapiens
agcccagctctgctttt

SEQ ID NO: 5562814 - DNA, 15 bp, Homo sapiens
agcccagctcttgct

SEQ ID NO: 5562815 - DNA, 19 bp, Homo sapiens
agcccagctctttgttcag

SEQ ID NO: 5562816 - DNA, 14 bp, Homo sapiens
agcccagctgcctg

SEQ ID NO: 5562817 - DNA, 17 bp, Homo sapiens
agcccagctgcctggag

SEQ ID NO: 5562818 - DNA, 22 bp, Homo sapiens
agcccagctgctctgcccagag

SEQ ID NO: 5562819 - DNA, 15 bp, Homo sapiens
agcccagctggccgg

SEQ ID NO: 5562820 - DNA, 14 bp, Homo sapiens
agcccagctggcct

SEQ ID NO: 5562821 - DNA, 13 bp, Homo sapiens
agcccagctgggt

SEQ ID NO: 5562822 - DNA, 16 bp, Homo sapiens
agcccagctggtggga

SEQ ID NO: 5562823 - DNA, 23 bp, Homo sapiens
agcccagcttgaaaccttcactt

SEQ ID NO: 5562824 - DNA, 19 bp, Homo sapiens
agcccaggaaaggctccag

SEQ ID NO: 5562825 - DNA, 22 bp, Homo sapiens
agcccaggaaaggctccaggag

SEQ ID NO: 5562826 - DNA, 24 bp, Homo sapiens
agcccaggaaaggctccaggagca

SEQ ID NO: 5562827 - DNA, 21 bp, Homo sapiens
agcccaggaagtctcatctgg

SEQ ID NO: 5562828 - DNA, 17 bp, Homo sapiens
agcccaggacactgcct

SEQ ID NO: 5562829 - DNA, 23 bp, Homo sapiens
agcccaggagaagtcccaccagg

SEQ ID NO: 5562830 - DNA, 13 bp, Homo sapiens
agcccaggagaga

SEQ ID NO: 5562831 - DNA, 17 bp, Homo sapiens
agcccaggagagagaaa

SEQ ID NO: 5562832 - DNA, 16 bp, Homo sapiens
agcccaggagcaacag

SEQ ID NO: 5562833 - DNA, 20 bp, Homo sapiens
agcccaggagcaacagccta

SEQ ID NO: 5562834 - DNA, 14 bp, Homo sapiens
agcccaggagccca

SEQ ID NO: 5562835 - DNA, 16 bp, Homo sapiens
agcccaggagcctcac

SEQ ID NO: 5562836 - DNA, 18 bp, Homo sapiens
agcccaggagctcccctc

SEQ ID NO: 5562837 - DNA, 19 bp, Homo sapiens
agcccaggagctcccctcc

SEQ ID NO: 5562838 - DNA, 12 bp, Homo sapiens
agcccaggagga

SEQ ID NO: 5562839 - DNA, 19 bp, Homo sapiens
agcccaggagggagcagag

SEQ ID NO: 5562840 - DNA, 22 bp, Homo sapiens
agcccaggagtcccactccaag

SEQ ID NO: 5562841 - DNA, 10 bp, Homo sapiens
agcccaggat

SEQ ID NO: 5562842 - DNA, 19 bp, Homo sapiens
agcccaggatactggcaca

SEQ ID NO: 5562843 - DNA, 22 bp, Homo sapiens
agcccaggattgtacgtgggag

SEQ ID NO: 5562844 - DNA, 20 bp, Homo sapiens
agcccaggcaatagtgttga

SEQ ID NO: 5562845 - DNA, 17 bp, Homo sapiens
agcccaggcatctcctt

SEQ ID NO: 5562846 - DNA, 21 bp, Homo sapiens
agcccaggcatctccttgggc

SEQ ID NO: 5562847 - DNA, 12 bp, Homo sapiens
agcccaggccac

SEQ ID NO: 5562848 - DNA, 13 bp, Homo sapiens
agcccaggccaga

SEQ ID NO: 5562849 - DNA, 19 bp, Homo sapiens
agcccaggccaggactctg

SEQ ID NO: 5562850 - DNA, 21 bp, Homo sapiens
agcccaggccaggactctgca

SEQ ID NO: 5562851 - DNA, 11 bp, Homo sapiens
agcccaggccg

SEQ ID NO: 5562852 - DNA, 23 bp, Homo sapiens
agcccaggccgttccccttggct

SEQ ID NO: 5562853 - DNA, 11 bp, Homo sapiens
agcccaggcct

SEQ ID NO: 5562854 - DNA, 12 bp, Homo sapiens
agcccaggcctc

SEQ ID NO: 5562855 - DNA, 19 bp, Homo sapiens
agcccaggcctcctacagc

SEQ ID NO: 5562856 - DNA, 14 bp, Homo sapiens
agcccaggcctggc

SEQ ID NO: 5562857 - DNA, 22 bp, Homo sapiens
agcccaggctcggaggaccctg

SEQ ID NO: 5562858 - DNA, 12 bp, Homo sapiens
agcccaggctga

SEQ ID NO: 5562859 - DNA, 13 bp, Homo sapiens
agcccaggcttcc

SEQ ID NO: 5562860 - DNA, 20 bp, Homo sapiens
agcccagggagcggaaagca

SEQ ID NO: 5562861 - DNA, 16 bp, Homo sapiens
agcccagggaggccga

SEQ ID NO: 5562862 - DNA, 19 bp, Homo sapiens
agcccagggcaccatccag

SEQ ID NO: 5562863 - DNA, 21 bp, Homo sapiens
agcccagggcatcccatgggg

SEQ ID NO: 5562864 - DNA, 12 bp, Homo sapiens
agcccagggcct

SEQ ID NO: 5562865 - DNA, 17 bp, Homo sapiens
agcccagggctcctgca

SEQ ID NO: 5562866 - DNA, 23 bp, Homo sapiens
agcccagggctcctgcacttact

SEQ ID NO: 5562867 - DNA, 21 bp, Homo sapiens
agcccaggggagaatgcagcc

SEQ ID NO: 5562868 - DNA, 21 bp, Homo sapiens
agcccagggtgctgggatggc

SEQ ID NO: 5562869 - DNA, 19 bp, Homo sapiens
agcccagggttcccccagc

SEQ ID NO: 5562870 - DNA, 16 bp, Homo sapiens
agcccaggtcccagtg

SEQ ID NO: 5562871 - DNA, 22 bp, Homo sapiens
agcccaggtcctgctgcctctc

SEQ ID NO: 5562872 - DNA, 20 bp, Homo sapiens
agcccagtccactgagcaag

SEQ ID NO: 5562873 - DNA, 16 bp, Homo sapiens
agcccagtcgagacct

SEQ ID NO: 5562874 - DNA, 16 bp, Homo sapiens
agcccagtgaagcctc

SEQ ID NO: 5562875 - DNA, 12 bp, Homo sapiens
agcccagtgacc

SEQ ID NO: 5562876 - DNA, 18 bp, Homo sapiens
agcccagtgacctgaccg

SEQ ID NO: 5562877 - DNA, 15 bp, Homo sapiens
agcccagtgcttctc

SEQ ID NO: 5562878 - DNA, 19 bp, Homo sapiens
agcccagtggtgaggaaag

SEQ ID NO: 5562879 - DNA, 22 bp, Homo sapiens
agcccagtgttttctttgagga

SEQ ID NO: 5562880 - DNA, 18 bp, Homo sapiens
agcccagttcagcttggg

SEQ ID NO: 5562881 - DNA, 17 bp, Homo sapiens
agcccagtttcccttct

SEQ ID NO: 5562882 - DNA, 16 bp, Homo sapiens
agcccatactcagcct

SEQ ID NO: 5562883 - DNA, 19 bp, Homo sapiens
agcccatactcagcctgct

SEQ ID NO: 5562884 - DNA, 19 bp, Homo sapiens
agcccatagctattttcct

SEQ ID NO: 5562885 - DNA, 20 bp, Homo sapiens
agcccatagctattttcctt

SEQ ID NO: 5562886 - DNA, 13 bp, Homo sapiens
agcccatcaatta

SEQ ID NO: 5562887 - DNA, 19 bp, Homo sapiens
agcccatccatagtaactg

SEQ ID NO: 5562888 - DNA, 21 bp, Homo sapiens
agcccatccattaggccagca

SEQ ID NO: 5562889 - DNA, 16 bp, Homo sapiens
agcccatcccctgcct

SEQ ID NO: 5562890 - DNA, 19 bp, Homo sapiens
agcccatcccctgcctcta

SEQ ID NO: 5562891 - DNA, 18 bp, Homo sapiens
agcccatccctgcctggt

SEQ ID NO: 5562892 - DNA, 20 bp, Homo sapiens
agcccatccctgcctggtca

SEQ ID NO: 5562893 - DNA, 14 bp, Homo sapiens
agcccatcctgacc

SEQ ID NO: 5562894 - DNA, 15 bp, Homo sapiens
agcccatcctgacca

SEQ ID NO: 5562895 - DNA, 18 bp, Homo sapiens
agcccatccttccctttg

SEQ ID NO: 5562896 - DNA, 18 bp, Homo sapiens
agcccatcgccacaaact

SEQ ID NO: 5562897 - DNA, 18 bp, Homo sapiens
agcccatctgcctgttct

SEQ ID NO: 5562898 - DNA, 19 bp, Homo sapiens
agcccatcttgcctccatg

SEQ ID NO: 5562899 - DNA, 17 bp, Homo sapiens
agcccatgccctgccgt

SEQ ID NO: 5562900 - DNA, 19 bp, Homo sapiens
agcccatggagattgacct

SEQ ID NO: 5562901 - DNA, 22 bp, Homo sapiens
agcccatggagattgacctgga

SEQ ID NO: 5562902 - DNA, 15 bp, Homo sapiens
agcccatggccccca

SEQ ID NO: 5562903 - DNA, 16 bp, Homo sapiens
agcccatggcccccaa

SEQ ID NO: 5562904 - DNA, 21 bp, Homo sapiens
agcccatggcccccaataaag

SEQ ID NO: 5562905 - DNA, 23 bp, Homo sapiens
agcccatggcccccaataaaggc

SEQ ID NO: 5562906 - DNA, 15 bp, Homo sapiens
agcccatggcctctg

SEQ ID NO: 5562907 - DNA, 22 bp, Homo sapiens
agcccatggcctctggccaggc

SEQ ID NO: 5562908 - DNA, 16 bp, Homo sapiens
agcccatgggtatgac

SEQ ID NO: 5562909 - DNA, 23 bp, Homo sapiens
agcccatggtaacgaacccctag

SEQ ID NO: 5562910 - DNA, 19 bp, Homo sapiens
agcccatgtcttctgctgt

SEQ ID NO: 5562911 - DNA, 22 bp, Homo sapiens
agcccatgtcttctgctgttct

SEQ ID NO: 5562912 - DNA, 19 bp, Homo sapiens
agcccatgtggctaaaaaa

SEQ ID NO: 5562913 - DNA, 22 bp, Homo sapiens
agcccattcattccattctgga

SEQ ID NO: 5562914 - DNA, 14 bp, Homo sapiens
agcccattcctctg

SEQ ID NO: 5562915 - DNA, 12 bp, Homo sapiens
agcccattctca

SEQ ID NO: 5562916 - DNA, 16 bp, Homo sapiens
agcccattctctctcc

SEQ ID NO: 5562917 - DNA, 21 bp, Homo sapiens
agcccattctctctcctgtcc

SEQ ID NO: 5562918 - DNA, 22 bp, Homo sapiens
agcccattctctctcctgtcca

SEQ ID NO: 5562919 - DNA, 19 bp, Homo sapiens
agcccattgctgcaaatgc

SEQ ID NO: 5562920 - DNA, 17 bp, Homo sapiens
agcccattgctgccaag

SEQ ID NO: 5562921 - DNA, 15 bp, Homo sapiens
agcccattggccgag

SEQ ID NO: 5562922 - DNA, 15 bp, Homo sapiens
agcccatttctccag

SEQ ID NO: 5562923 - DNA, 17 bp, Homo sapiens
agcccatttctccagaa

SEQ ID NO: 5562924 - DNA, 21 bp, Homo sapiens
agcccatttctccagaaccca

SEQ ID NO: 5562925 - DNA, 14 bp, Homo sapiens
agcccatttctggg

SEQ ID NO: 5562926 - DNA, 22 bp, Homo sapiens
agcccatttctgttaacctctt

SEQ ID NO: 5562927 - DNA, 20 bp, Homo sapiens
agcccatttggagggcctgg

SEQ ID NO: 5562928 - DNA, 23 bp, Homo sapiens
agcccatttgggcagagaggctg

SEQ ID NO: 5562929 - DNA, 17 bp, Homo sapiens
agcccatttgggctctg

SEQ ID NO: 5562930 - DNA, 15 bp, Homo sapiens
agccccaaaccaggg

SEQ ID NO: 5562931 - DNA, 18 bp, Homo sapiens
agccccaaagatcccacg

SEQ ID NO: 5562932 - DNA, 23 bp, Homo sapiens
agccccaaagtcaattaaaggct

SEQ ID NO: 5562933 - DNA, 17 bp, Homo sapiens
agccccaacatgttcag

SEQ ID NO: 5562934 - DNA, 20 bp, Homo sapiens
agccccgactccagccagcg

SEQ ID NO: 5562935 - DNA, 14 bp, Homo sapiens
agccccgacttcct

SEQ ID NO: 5562936 - DNA, 19 bp, Homo sapiens
agccccgagacaccatcct

SEQ ID NO: 5562937 - DNA, 20 bp, Homo sapiens
agccccgagacaccatcctg

SEQ ID NO: 5562938 - DNA, 16 bp, Homo sapiens
agccccgcacgggctg

SEQ ID NO: 5562939 - DNA, 16 bp, Homo sapiens
agccccgcagacctcc

SEQ ID NO: 5562940 - DNA, 22 bp, Homo sapiens
agccccgcagacctccccagcc

SEQ ID NO: 5562941 - DNA, 18 bp, Homo sapiens
agccccgccccaccccgt

SEQ ID NO: 5562942 - DNA, 15 bp, Homo sapiens
agccccgccccagcc

SEQ ID NO: 5562943 - DNA, 19 bp, Homo sapiens
agccccgccccagccctca

SEQ ID NO: 5562944 - DNA, 15 bp, Homo sapiens
agccccgccctcttc

SEQ ID NO: 5562945 - DNA, 18 bp, Homo sapiens
agccccgccctcttcctg

SEQ ID NO: 5562946 - DNA, 22 bp, Homo sapiens
agccccgccgtgtctgtggccc

SEQ ID NO: 5562947 - DNA, 17 bp, Homo sapiens
agccccgcgaccacccc

SEQ ID NO: 5562948 - DNA, 21 bp, Homo sapiens
agccccgcgaccacccctgtg

SEQ ID NO: 5562949 - DNA, 23 bp, Homo sapiens
agccccgcgaccacccctgtgcg

SEQ ID NO: 5562950 - DNA, 23 bp, Homo sapiens
agccccgcgtggaactcgtgtct

SEQ ID NO: 5562951 - DNA, 21 bp, Homo sapiens
agccccgctcctcccctcttg

SEQ ID NO: 5562952 - DNA, 19 bp, Homo sapiens
agccccggagcaccacggg

SEQ ID NO: 5562953 - DNA, 22 bp, Homo sapiens
agccccggcaagccacaggaag

SEQ ID NO: 5562954 - DNA, 21 bp, Homo sapiens
agccccggccactccctgcca

SEQ ID NO: 5562955 - DNA, 13 bp, Homo sapiens
agccccggccccc

SEQ ID NO: 5562956 - DNA, 16 bp, Homo sapiens
agccccggccctgggc

SEQ ID NO: 5562957 - DNA, 18 bp, Homo sapiens
agccccggccctgggctc

SEQ ID NO: 5562958 - DNA, 13 bp, Homo sapiens
agccccggctctt

SEQ ID NO: 5562959 - DNA, 17 bp, Homo sapiens
agccccggggccccctg

SEQ ID NO: 5562960 - DNA, 15 bp, Homo sapiens
agccccgtctgaccc

SEQ ID NO: 5562961 - DNA, 16 bp, Homo sapiens
agccccgtctgacccc

SEQ ID NO: 5562962 - DNA, 18 bp, Homo sapiens
agccccgtggggttcctc

SEQ ID NO: 5562963 - DNA, 13 bp, Homo sapiens
agcccctaagccc

SEQ ID NO: 5562964 - DNA, 19 bp, Homo sapiens
agcccctacaactccagcc

SEQ ID NO: 5562965 - DNA, 12 bp, Homo sapiens
agcccctacccc

SEQ ID NO: 5562966 - DNA, 21 bp, Homo sapiens
agcccctaccccacaccaggc

SEQ ID NO: 5562967 - DNA, 22 bp, Homo sapiens
agcccctacccctgccctgctc

SEQ ID NO: 5562968 - DNA, 23 bp, Homo sapiens
agcccctactgctgtgaaccctg

SEQ ID NO: 5562969 - DNA, 23 bp, Homo sapiens
agcccctagaaacccaagctcct

SEQ ID NO: 5562970 - DNA, 21 bp, Homo sapiens
agcccctagatgaagaaagag

SEQ ID NO: 5562971 - DNA, 19 bp, Homo sapiens
agcccctagcccaggagag

SEQ ID NO: 5562972 - DNA, 17 bp, Homo sapiens
agcccctatcctgcacc

SEQ ID NO: 5562973 - DNA, 16 bp, Homo sapiens
agcccctcaaagactt

SEQ ID NO: 5562974 - DNA, 17 bp, Homo sapiens
agcccctcacctcagga

SEQ ID NO: 5562975 - DNA, 13 bp, Homo sapiens
agcccctcagaga

SEQ ID NO: 5562976 - DNA, 17 bp, Homo sapiens
agcccctcagcccttgc

SEQ ID NO: 5562977 - DNA, 18 bp, Homo sapiens
agcccctcagcccttgcc

SEQ ID NO: 5562978 - DNA, 20 bp, Homo sapiens
agcccctcagcgcccccaga

SEQ ID NO: 5562979 - DNA, 13 bp, Homo sapiens
agcccctccatct

SEQ ID NO: 5562980 - DNA, 16 bp, Homo sapiens
agcccctccatctgta

SEQ ID NO: 5562981 - DNA, 10 bp, Homo sapiens
agcccctccc

SEQ ID NO: 5562982 - DNA, 19 bp, Homo sapiens
agcccctcccaagctggct

SEQ ID NO: 5562983 - DNA, 16 bp, Homo sapiens
agcccctcccagccta

SEQ ID NO: 5562984 - DNA, 17 bp, Homo sapiens
agcccctccccagactc

SEQ ID NO: 5562985 - DNA, 16 bp, Homo sapiens
agcccctccccagcca

SEQ ID NO: 5562986 - DNA, 17 bp, Homo sapiens
agcccctccccagccag

SEQ ID NO: 5562987 - DNA, 21 bp, Homo sapiens
agcccctccccagccagccct

SEQ ID NO: 5562988 - DNA, 22 bp, Homo sapiens
agcccctccccagccagccctt

SEQ ID NO: 5562989 - DNA, 21 bp, Homo sapiens
agcccctccccatggtgcagt

SEQ ID NO: 5562990 - DNA, 19 bp, Homo sapiens
agcccctccccgcctcctc

SEQ ID NO: 5562991 - DNA, 15 bp, Homo sapiens
agcccctccctcctc

SEQ ID NO: 5562992 - DNA, 22 bp, Homo sapiens
agcccctcctccagcccctgtc

SEQ ID NO: 5562993 - DNA, 16 bp, Homo sapiens
agcccctcctcccctt

SEQ ID NO: 5562994 - DNA, 22 bp, Homo sapiens
agcccctcctccccttcctgca

SEQ ID NO: 5562995 - DNA, 17 bp, Homo sapiens
agcccctcctccctcaa

SEQ ID NO: 5562996 - DNA, 20 bp, Homo sapiens
agcccctcctccctcagacc

SEQ ID NO: 5562997 - DNA, 22 bp, Homo sapiens
agcccctcctccctcagaccca

SEQ ID NO: 5562998 - DNA, 18 bp, Homo sapiens
agcccctcctccctcagg

SEQ ID NO: 5562999 - DNA, 23 bp, Homo sapiens
agcccctcctccctcaggcccag

SEQ ID NO: 5563000 - DNA, 14 bp, Homo sapiens
agcccctcctctcc

SEQ ID NO: 5563001 - DNA, 17 bp, Homo sapiens
agcccctcctctcctcg

SEQ ID NO: 5563002 - DNA, 19 bp, Homo sapiens
agcccctcctctgccacct

SEQ ID NO: 5563003 - DNA, 20 bp, Homo sapiens
agcccctcctctgccacctc

SEQ ID NO: 5563004 - DNA, 13 bp, Homo sapiens
agcccctccttct

SEQ ID NO: 5563005 - DNA, 21 bp, Homo sapiens
agcccctccttctcccctgcc

SEQ ID NO: 5563006 - DNA, 13 bp, Homo sapiens
agcccctcgaggc

SEQ ID NO: 5563007 - DNA, 14 bp, Homo sapiens
agcccctcggctct

SEQ ID NO: 5563008 - DNA, 17 bp, Homo sapiens
agcccctcggctctgga

SEQ ID NO: 5563009 - DNA, 16 bp, Homo sapiens
agcccctctcccctct

SEQ ID NO: 5563010 - DNA, 11 bp, Homo sapiens
agcccctctct

SEQ ID NO: 5563011 - DNA, 12 bp, Homo sapiens
agcccctctctc

SEQ ID NO: 5563012 - DNA, 14 bp, Homo sapiens
agcccctctcttat

SEQ ID NO: 5563013 - DNA, 20 bp, Homo sapiens
agcccctctggattcccttt

SEQ ID NO: 5563014 - DNA, 12 bp, Homo sapiens
agcccctctggt

SEQ ID NO: 5563015 - DNA, 13 bp, Homo sapiens
agcccctctggtc

SEQ ID NO: 5563016 - DNA, 10 bp, Homo sapiens
agcccctctt

SEQ ID NO: 5563017 - DNA, 13 bp, Homo sapiens
agcccctcttccc

SEQ ID NO: 5563018 - DNA, 17 bp, Homo sapiens
agcccctcttccccaat

SEQ ID NO: 5563019 - DNA, 14 bp, Homo sapiens
agcccctcttccct

SEQ ID NO: 5563020 - DNA, 16 bp, Homo sapiens
agcccctcttgccccc

SEQ ID NO: 5563021 - DNA, 20 bp, Homo sapiens
agcccctcttgccccccacc

SEQ ID NO: 5563022 - DNA, 21 bp, Homo sapiens
agcccctcttgccccccaccc

SEQ ID NO: 5563023 - DNA, 22 bp, Homo sapiens
agcccctcttgccccccacccc

SEQ ID NO: 5563024 - DNA, 17 bp, Homo sapiens
agcccctcttggagaag

SEQ ID NO: 5563025 - DNA, 22 bp, Homo sapiens
agcccctctttctgtcccctct

SEQ ID NO: 5563026 - DNA, 16 bp, Homo sapiens
agcccctgaaagccat

SEQ ID NO: 5563027 - DNA, 14 bp, Homo sapiens
agcccctgacccgc

SEQ ID NO: 5563028 - DNA, 17 bp, Homo sapiens
agcccctgagagcctgt

SEQ ID NO: 5563029 - DNA, 14 bp, Homo sapiens
agcccctgaggaca

SEQ ID NO: 5563030 - DNA, 20 bp, Homo sapiens
agcccctgatcctgtgaagt

SEQ ID NO: 5563031 - DNA, 18 bp, Homo sapiens
agcccctgatctctgacc

SEQ ID NO: 5563032 - DNA, 22 bp, Homo sapiens
agcccctgatctctgacctctg

SEQ ID NO: 5563033 - DNA, 23 bp, Homo sapiens
agcccctgcagacgtctggccct

SEQ ID NO: 5563034 - DNA, 12 bp, Homo sapiens
agcccctgccca

SEQ ID NO: 5563035 - DNA, 13 bp, Homo sapiens
agcccctgcccca

SEQ ID NO: 5563036 - DNA, 23 bp, Homo sapiens
agcccctgccccagcccaagtcc

SEQ ID NO: 5563037 - DNA, 16 bp, Homo sapiens
agcccctgcccctcct

SEQ ID NO: 5563038 - DNA, 17 bp, Homo sapiens
agcccctgccctgggga

SEQ ID NO: 5563039 - DNA, 14 bp, Homo sapiens
agcccctgcctggg

SEQ ID NO: 5563040 - DNA, 23 bp, Homo sapiens
agcccctgcctgggttgggggca

SEQ ID NO: 5563041 - DNA, 16 bp, Homo sapiens
agcccctgctggacca

SEQ ID NO: 5563042 - DNA, 21 bp, Homo sapiens
agcccctgctggaccaaggtg

SEQ ID NO: 5563043 - DNA, 19 bp, Homo sapiens
agcccctggacccctgggg

SEQ ID NO: 5563044 - DNA, 14 bp, Homo sapiens
agcccctggagcct

SEQ ID NO: 5563045 - DNA, 12 bp, Homo sapiens
agcccctgggaa

SEQ ID NO: 5563046 - DNA, 14 bp, Homo sapiens
agcccctgggccca

SEQ ID NO: 5563047 - DNA, 18 bp, Homo sapiens
agcccctggggcccagcc

SEQ ID NO: 5563048 - DNA, 19 bp, Homo sapiens
agcccctggggcccagccc

SEQ ID NO: 5563049 - DNA, 11 bp, Homo sapiens
agcccctgtcc

SEQ ID NO: 5563050 - DNA, 13 bp, Homo sapiens
agcccctgtcgcc

SEQ ID NO: 5563051 - DNA, 23 bp, Homo sapiens
agcccctgtcgcccacccagctg

SEQ ID NO: 5563052 - DNA, 20 bp, Homo sapiens
agcccctgtctagagaggga

SEQ ID NO: 5563053 - DNA, 16 bp, Homo sapiens
agcccctgtgaccctc

SEQ ID NO: 5563054 - DNA, 20 bp, Homo sapiens
agcccctgtgaccctctcac

SEQ ID NO: 5563055 - DNA, 18 bp, Homo sapiens
agcccctgtggagactgg

SEQ ID NO: 5563056 - DNA, 18 bp, Homo sapiens
agcccctgtgtgggaggg

SEQ ID NO: 5563057 - DNA, 19 bp, Homo sapiens
agcccctgtgtgggagggc

SEQ ID NO: 5563058 - DNA, 15 bp, Homo sapiens
agcccctgtttctcc

SEQ ID NO: 5563059 - DNA, 19 bp, Homo sapiens
agcccctgttttctgctgt

SEQ ID NO: 5563060 - DNA, 21 bp, Homo sapiens
agccccttactatgatctcag

SEQ ID NO: 5563061 - DNA, 14 bp, Homo sapiens
agccccttagcccc

SEQ ID NO: 5563062 - DNA, 17 bp, Homo sapiens
agccccttatttttagc

SEQ ID NO: 5563063 - DNA, 17 bp, Homo sapiens
agccccttcaattattt

SEQ ID NO: 5563064 - DNA, 15 bp, Homo sapiens
agccccttcctgggt

SEQ ID NO: 5563065 - DNA, 16 bp, Homo sapiens
agccccttctcagaat

SEQ ID NO: 5563066 - DNA, 13 bp, Homo sapiens
agccccttctccc

SEQ ID NO: 5563067 - DNA, 18 bp, Homo sapiens
agccccttctcccagcac

SEQ ID NO: 5563068 - DNA, 19 bp, Homo sapiens
agccccttctcccctcccc

SEQ ID NO: 5563069 - DNA, 16 bp, Homo sapiens
agccccttctgaccca

SEQ ID NO: 5563070 - DNA, 20 bp, Homo sapiens
agccccttctgacccatgct

SEQ ID NO: 5563071 - DNA, 19 bp, Homo sapiens
agccccttctgctcagctc

SEQ ID NO: 5563072 - DNA, 15 bp, Homo sapiens
agccccttgctctca

SEQ ID NO: 5563073 - DNA, 23 bp, Homo sapiens
agccccttgctctcccctgccct

SEQ ID NO: 5563074 - DNA, 12 bp, Homo sapiens
agccccttggag

SEQ ID NO: 5563075 - DNA, 22 bp, Homo sapiens
agccccttggagagagaggctg

SEQ ID NO: 5563076 - DNA, 15 bp, Homo sapiens
agccccttgtcctct

SEQ ID NO: 5563077 - DNA, 16 bp, Homo sapiens
agcccctttccaaaat

SEQ ID NO: 5563078 - DNA, 21 bp, Homo sapiens
agcccctttgcctctgtcctc

SEQ ID NO: 5563079 - DNA, 21 bp, Homo sapiens
agccccttttctctgctcttg

SEQ ID NO: 5563080 - DNA, 16 bp, Homo sapiens
agccccttttctttgg

SEQ ID NO: 5563081 - DNA, 13 bp, Homo sapiens
agcccgaagccca

SEQ ID NO: 5563082 - DNA, 18 bp, Homo sapiens
agcccgaagcccagtttc

SEQ ID NO: 5563083 - DNA, 18 bp, Homo sapiens
agcccgaagtctgctgct

SEQ ID NO: 5563084 - DNA, 14 bp, Homo sapiens
agcccgaatacaaa

SEQ ID NO: 5563085 - DNA, 15 bp, Homo sapiens
agcccgaatacaaac

SEQ ID NO: 5563086 - DNA, 18 bp, Homo sapiens
agcccgaatttctcactc

SEQ ID NO: 5563087 - DNA, 20 bp, Homo sapiens
agcccgacagtgccatcccc

SEQ ID NO: 5563088 - DNA, 17 bp, Homo sapiens
agcccgaggaccgggct

SEQ ID NO: 5563089 - DNA, 14 bp, Homo sapiens
agcccgaggaggtg

SEQ ID NO: 5563090 - DNA, 17 bp, Homo sapiens
agcccgagggcctgaca

SEQ ID NO: 5563091 - DNA, 18 bp, Homo sapiens
agcccgagtggtctcctc

SEQ ID NO: 5563092 - DNA, 22 bp, Homo sapiens
agcccgatattctccctgacct

SEQ ID NO: 5563093 - DNA, 18 bp, Homo sapiens
agcccgcaactctccagc

SEQ ID NO: 5563094 - DNA, 18 bp, Homo sapiens
agcccgcacccccaccct

SEQ ID NO: 5563095 - DNA, 19 bp, Homo sapiens
agcccgcactgtcccagta

SEQ ID NO: 5563096 - DNA, 16 bp, Homo sapiens
agcccgcaggatcagg

SEQ ID NO: 5563097 - DNA, 21 bp, Homo sapiens
agcccgcagggccatgcagac

SEQ ID NO: 5563098 - DNA, 18 bp, Homo sapiens
agcccgcccaaggggact

SEQ ID NO: 5563099 - DNA, 18 bp, Homo sapiens
agcccgcccacctgggcc

SEQ ID NO: 5563100 - DNA, 22 bp, Homo sapiens
agcccgccgtcagggtggctgg

SEQ ID NO: 5563101 - DNA, 16 bp, Homo sapiens
agcccgccgtctgcag

SEQ ID NO: 5563102 - DNA, 18 bp, Homo sapiens
agcccgccgtctgcaggg

SEQ ID NO: 5563103 - DNA, 13 bp, Homo sapiens
agcccgcctgaca

SEQ ID NO: 5563104 - DNA, 18 bp, Homo sapiens
agcccgcctgacagaaac

SEQ ID NO: 5563105 - DNA, 14 bp, Homo sapiens
agcccgcctgccag

SEQ ID NO: 5563106 - DNA, 16 bp, Homo sapiens
agcccgcctgccagtc

SEQ ID NO: 5563107 - DNA, 21 bp, Homo sapiens
agcccgcctgccagtcctagc

SEQ ID NO: 5563108 - DNA, 22 bp, Homo sapiens
agcccgcctgccagtcctagct

SEQ ID NO: 5563109 - DNA, 20 bp, Homo sapiens
agcccgcctgccgtgcatgg

SEQ ID NO: 5563110 - DNA, 22 bp, Homo sapiens
agcccgcctgcgccccccagtg

SEQ ID NO: 5563111 - DNA, 23 bp, Homo sapiens
agcccttgactgtacagagactc

SEQ ID NO: 5563112 - DNA, 20 bp, Homo sapiens
agcccttgagggagaactta

SEQ ID NO: 5563113 - DNA, 22 bp, Homo sapiens
agcccttgcacaggccacttgc

SEQ ID NO: 5563114 - DNA, 22 bp, Homo sapiens
agcccttgcccatgctgggctc

SEQ ID NO: 5563115 - DNA, 14 bp, Homo sapiens
agcccttgcctccc

SEQ ID NO: 5563116 - DNA, 21 bp, Homo sapiens
agcccttgctctacctggccg

SEQ ID NO: 5563117 - DNA, 22 bp, Homo sapiens
agcccttgctctacctggccgg

SEQ ID NO: 5563118 - DNA, 17 bp, Homo sapiens
agcccttggcttctgct

SEQ ID NO: 5563119 - DNA, 18 bp, Homo sapiens
agcccttggcttctgctt

SEQ ID NO: 5563120 - DNA, 20 bp, Homo sapiens
agcccttggcttgtgttatc

SEQ ID NO: 5563121 - DNA, 22 bp, Homo sapiens
agcccttgggggtcctcctcca

SEQ ID NO: 5563122 - DNA, 12 bp, Homo sapiens
agcccttgggtt

SEQ ID NO: 5563123 - DNA, 19 bp, Homo sapiens
agcccttgtgtgtgccctg

SEQ ID NO: 5563124 - DNA, 21 bp, Homo sapiens
agccctttacttgacctccta

SEQ ID NO: 5563125 - DNA, 15 bp, Homo sapiens
agccctttccaagct

SEQ ID NO: 5563126 - DNA, 15 bp, Homo sapiens
agccctttccccact

SEQ ID NO: 5563127 - DNA, 12 bp, Homo sapiens
agccctttctgt

SEQ ID NO: 5563128 - DNA, 13 bp, Homo sapiens
agccctttctgtg

SEQ ID NO: 5563129 - DNA, 20 bp, Homo sapiens
agccctttgcaggcccagca

SEQ ID NO: 5563130 - DNA, 22 bp, Homo sapiens
agccctttgctctgatttcctt

SEQ ID NO: 5563131 - DNA, 23 bp, Homo sapiens
agccctttgctctgatttccttc

SEQ ID NO: 5563132 - DNA, 13 bp, Homo sapiens
agccctttgctgt

SEQ ID NO: 5563133 - DNA, 23 bp, Homo sapiens
agccctttggagaacgccagtct

SEQ ID NO: 5563134 - DNA, 23 bp, Homo sapiens
agccctttggggacaagggctgc

SEQ ID NO: 5563135 - DNA, 21 bp, Homo sapiens
agcccttttacagctcttggc

SEQ ID NO: 5563136 - DNA, 17 bp, Homo sapiens
agccgaactccaggctg

SEQ ID NO: 5563137 - DNA, 16 bp, Homo sapiens
agccgaatagctgatg

SEQ ID NO: 5563138 - DNA, 22 bp, Homo sapiens
agccgacaactatttcggcctt

SEQ ID NO: 5563139 - DNA, 16 bp, Homo sapiens
agccgacaatgccctg

SEQ ID NO: 5563140 - DNA, 14 bp, Homo sapiens
agccgaccctcctg

SEQ ID NO: 5563141 - DNA, 13 bp, Homo sapiens
agccgactcagca

SEQ ID NO: 5563142 - DNA, 17 bp, Homo sapiens
agccgactccactttca

SEQ ID NO: 5563143 - DNA, 17 bp, Homo sapiens
agccgactctggccctg

SEQ ID NO: 5563144 - DNA, 18 bp, Homo sapiens
agccgactctggccctgg

SEQ ID NO: 5563145 - DNA, 23 bp, Homo sapiens
agccgactgcacagcggcccctg

SEQ ID NO: 5563146 - DNA, 14 bp, Homo sapiens
agccgactgtcttg

SEQ ID NO: 5563147 - DNA, 18 bp, Homo sapiens
agccgagatcacgccact

SEQ ID NO: 5563148 - DNA, 20 bp, Homo sapiens
agccgagattgcaccactgc

SEQ ID NO: 5563149 - DNA, 21 bp, Homo sapiens
agccgagattgcaccactgca

SEQ ID NO: 5563150 - DNA, 18 bp, Homo sapiens
agccgagattgcgccact

SEQ ID NO: 5563151 - DNA, 14 bp, Homo sapiens
agccgagcccaggg

SEQ ID NO: 5563152 - DNA, 13 bp, Homo sapiens
agccgagccccag

SEQ ID NO: 5563153 - DNA, 15 bp, Homo sapiens
agccgagccccagga

SEQ ID NO: 5563154 - DNA, 15 bp, Homo sapiens
agccgagcgtagtga

SEQ ID NO: 5563155 - DNA, 17 bp, Homo sapiens
agccgaggcctggccaa

SEQ ID NO: 5563156 - DNA, 15 bp, Homo sapiens
agccgagggcgtcag

SEQ ID NO: 5563157 - DNA, 20 bp, Homo sapiens
agccgagggcgtcagagaga

SEQ ID NO: 5563158 - DNA, 21 bp, Homo sapiens
agccgagggcgtcagagagac

SEQ ID NO: 5563159 - DNA, 14 bp, Homo sapiens
agccgaggggagag

SEQ ID NO: 5563160 - DNA, 15 bp, Homo sapiens
agccgaggggagaga

SEQ ID NO: 5563161 - DNA, 17 bp, Homo sapiens
agccgaggggagagagg

SEQ ID NO: 5563162 - DNA, 20 bp, Homo sapiens
agccgaggggagagagggac

SEQ ID NO: 5563163 - DNA, 18 bp, Homo sapiens
agccgaggtccctgctgc

SEQ ID NO: 5563164 - DNA, 19 bp, Homo sapiens
agccgatatcagaatttgt

SEQ ID NO: 5563165 - DNA, 15 bp, Homo sapiens
agccgatctggtctc

SEQ ID NO: 5563166 - DNA, 19 bp, Homo sapiens
agccgatctggtctcgtgt

SEQ ID NO: 5563167 - DNA, 18 bp, Homo sapiens
agccgattcacctgagca

SEQ ID NO: 5563168 - DNA, 21 bp, Homo sapiens
agccgattcctccagccctgg

SEQ ID NO: 5563169 - DNA, 22 bp, Homo sapiens
agccgattttagagttcttttg

SEQ ID NO: 5563170 - DNA, 20 bp, Homo sapiens
agccgcaaatcaaccccaga

SEQ ID NO: 5563171 - DNA, 14 bp, Homo sapiens
agccgcaagctctc

SEQ ID NO: 5563172 - DNA, 15 bp, Homo sapiens
agccgcaagctctca

SEQ ID NO: 5563173 - DNA, 22 bp, Homo sapiens
agccgcaaggatccttccctgt

SEQ ID NO: 5563174 - DNA, 23 bp, Homo sapiens
agccgcacatctggtctcggagc

SEQ ID NO: 5563175 - DNA, 20 bp, Homo sapiens
agccgcaccctgcacctgct

SEQ ID NO: 5563176 - DNA, 16 bp, Homo sapiens
agccgcaccctggctg

SEQ ID NO: 5563177 - DNA, 22 bp, Homo sapiens
agccgcagagaaatgccccagt

SEQ ID NO: 5563178 - DNA, 15 bp, Homo sapiens
agccgcagaggcccg

SEQ ID NO: 5563179 - DNA, 18 bp, Homo sapiens
agccgcagaggcccgagg

SEQ ID NO: 5563180 - DNA, 19 bp, Homo sapiens
agccgcagaggcccgaggc

SEQ ID NO: 5563181 - DNA, 18 bp, Homo sapiens
agccgcagcctccctctg

SEQ ID NO: 5563182 - DNA, 15 bp, Homo sapiens
agccgcagcgcagcc

SEQ ID NO: 5563183 - DNA, 16 bp, Homo sapiens
agccgcatcccagact

SEQ ID NO: 5563184 - DNA, 16 bp, Homo sapiens
agccgcatcttctcca

SEQ ID NO: 5563185 - DNA, 15 bp, Homo sapiens
agccgcattggtgac

SEQ ID NO: 5563186 - DNA, 22 bp, Homo sapiens
agccgccactcctatccccagg

SEQ ID NO: 5563187 - DNA, 14 bp, Homo sapiens
agccgccagctggg

SEQ ID NO: 5563188 - DNA, 21 bp, Homo sapiens
agccgccaggaccgccaaaga

SEQ ID NO: 5563189 - DNA, 18 bp, Homo sapiens
agccgccagtacttgtca

SEQ ID NO: 5563190 - DNA, 17 bp, Homo sapiens
agccgccagttcatctt

SEQ ID NO: 5563191 - DNA, 17 bp, Homo sapiens
agccgccattgccacca

SEQ ID NO: 5563192 - DNA, 18 bp, Homo sapiens
agccgccattgccaccag

SEQ ID NO: 5563193 - DNA, 12 bp, Homo sapiens
agccgcccaagg

SEQ ID NO: 5563194 - DNA, 16 bp, Homo sapiens
agccgcccaaggcctt

SEQ ID NO: 5563195 - DNA, 14 bp, Homo sapiens
agccgccccagccc

SEQ ID NO: 5563196 - DNA, 15 bp, Homo sapiens
agccgccccagcccc

SEQ ID NO: 5563197 - DNA, 12 bp, Homo sapiens
agccgccctggg

SEQ ID NO: 5563198 - DNA, 24 bp, Homo sapiens
agccgccctgggctgtctgtcacc

SEQ ID NO: 5563199 - DNA, 19 bp, Homo sapiens
agccgccgggcaggcctgc

SEQ ID NO: 5563200 - DNA, 20 bp, Homo sapiens
agccgccgttttcatgacca

SEQ ID NO: 5563201 - DNA, 22 bp, Homo sapiens
agccgcctcggagtgtggcctg

SEQ ID NO: 5563202 - DNA, 16 bp, Homo sapiens
agccgcctgcctgcga

SEQ ID NO: 5563203 - DNA, 23 bp, Homo sapiens
agccgcctgcctgcgaaacccag

SEQ ID NO: 5563204 - DNA, 14 bp, Homo sapiens
agccgccttccctt

SEQ ID NO: 5563205 - DNA, 16 bp, Homo sapiens
agccgcgcggccgctt

SEQ ID NO: 5563206 - DNA, 20 bp, Homo sapiens
agccgcgctctgcccctccg

SEQ ID NO: 5563207 - DNA, 17 bp, Homo sapiens
agccgcgggccaggagg

SEQ ID NO: 5563208 - DNA, 15 bp, Homo sapiens
agccgctaggagaga

SEQ ID NO: 5563209 - DNA, 19 bp, Homo sapiens
agccgctaggagagactga

SEQ ID NO: 5563210 - DNA, 17 bp, Homo sapiens
agccgctcctgtctgcc

SEQ ID NO: 5563211 - DNA, 13 bp, Homo sapiens
agccgctctcctg

SEQ ID NO: 5563212 - DNA, 17 bp, Homo sapiens
agccgctctcctgccac

SEQ ID NO: 5563213 - DNA, 19 bp, Homo sapiens
agccgctgcagggctccca

SEQ ID NO: 5563214 - DNA, 22 bp, Homo sapiens
agccgctgcagggctcccatgg

SEQ ID NO: 5563215 - DNA, 18 bp, Homo sapiens
agccgctgccaggggctg

SEQ ID NO: 5563216 - DNA, 18 bp, Homo sapiens
agccgctgcccggcgccc

SEQ ID NO: 5563217 - DNA, 22 bp, Homo sapiens
agccgctgcccggcgccctctg

SEQ ID NO: 5563218 - DNA, 20 bp, Homo sapiens
agccgctggcaacaacagct

SEQ ID NO: 5563219 - DNA, 14 bp, Homo sapiens
agccgctggggcca

SEQ ID NO: 5563220 - DNA, 19 bp, Homo sapiens
agccgctgtgagcccctgg

SEQ ID NO: 5563221 - DNA, 17 bp, Homo sapiens
agccgcttccccagctc

SEQ ID NO: 5563222 - DNA, 20 bp, Homo sapiens
agccgcttccccagctcaga

SEQ ID NO: 5563223 - DNA, 20 bp, Homo sapiens
agccgcttggcgatgccagc

SEQ ID NO: 5563224 - DNA, 21 bp, Homo sapiens
agccgcttggcgatgccagcc

SEQ ID NO: 5563225 - DNA, 16 bp, Homo sapiens
agccggaatagagcct

SEQ ID NO: 5563226 - DNA, 17 bp, Homo sapiens
agccggacacaagcggc

SEQ ID NO: 5563227 - DNA, 23 bp, Homo sapiens
agccggacacaagcggccctgac

SEQ ID NO: 5563228 - DNA, 15 bp, Homo sapiens
agccggacacggctt

SEQ ID NO: 5563229 - DNA, 17 bp, Homo sapiens
agccggacacggcttca

SEQ ID NO: 5563230 - DNA, 21 bp, Homo sapiens
agccggacacggcttcactga

SEQ ID NO: 5563231 - DNA, 19 bp, Homo sapiens
agccggacagctgcccaga

SEQ ID NO: 5563232 - DNA, 23 bp, Homo sapiens
agccggaccaagatgggcacatg

SEQ ID NO: 5563233 - DNA, 20 bp, Homo sapiens
agccggagcagttggcctgt

SEQ ID NO: 5563234 - DNA, 17 bp, Homo sapiens
agccggaggaggagatg

SEQ ID NO: 5563235 - DNA, 19 bp, Homo sapiens
agccggagggcaccaggga

SEQ ID NO: 5563236 - DNA, 16 bp, Homo sapiens
agccggcacagggtct

SEQ ID NO: 5563237 - DNA, 22 bp, Homo sapiens
agccggcacctacatccccagg

SEQ ID NO: 5563238 - DNA, 14 bp, Homo sapiens
agccggcactgcat

SEQ ID NO: 5563239 - DNA, 15 bp, Homo sapiens
agccggcactgcatg

SEQ ID NO: 5563240 - DNA, 17 bp, Homo sapiens
agccggcagaaatagct

SEQ ID NO: 5563241 - DNA, 18 bp, Homo sapiens
agccggccaatggaaacc

SEQ ID NO: 5563242 - DNA, 19 bp, Homo sapiens
agccggccaccagatgctg

SEQ ID NO: 5563243 - DNA, 13 bp, Homo sapiens
agccggcccaacc

SEQ ID NO: 5563244 - DNA, 21 bp, Homo sapiens
agccggccgccttctcccctc

SEQ ID NO: 5563245 - DNA, 18 bp, Homo sapiens
agccggccgtggaaggag

SEQ ID NO: 5563246 - DNA, 19 bp, Homo sapiens
agccggcggagctctggct

SEQ ID NO: 5563247 - DNA, 13 bp, Homo sapiens
agccggcggccca

SEQ ID NO: 5563248 - DNA, 14 bp, Homo sapiens
agccggcggcctct

SEQ ID NO: 5563249 - DNA, 16 bp, Homo sapiens
agccggcggcctctcg

SEQ ID NO: 5563250 - DNA, 19 bp, Homo sapiens
agccggcgtggcaaatata

SEQ ID NO: 5563251 - DNA, 16 bp, Homo sapiens
agccggcttgatttcc

SEQ ID NO: 5563252 - DNA, 23 bp, Homo sapiens
agccgggaacagacaacagaagt

SEQ ID NO: 5563253 - DNA, 15 bp, Homo sapiens
agccgggaccctcag

SEQ ID NO: 5563254 - DNA, 17 bp, Homo sapiens
agccgggaccctcaggt

SEQ ID NO: 5563255 - DNA, 13 bp, Homo sapiens
agccgggagccaa

SEQ ID NO: 5563256 - DNA, 23 bp, Homo sapiens
agccgggaggaaaaggcccctgc

SEQ ID NO: 5563257 - DNA, 19 bp, Homo sapiens
agccgggcacccccaacct

SEQ ID NO: 5563258 - DNA, 20 bp, Homo sapiens
agccgggcatggtggcatgt

SEQ ID NO: 5563259 - DNA, 22 bp, Homo sapiens
agccgggccccatggtcacaga

SEQ ID NO: 5563260 - DNA, 16 bp, Homo sapiens
agccgggcccctgggc

SEQ ID NO: 5563261 - DNA, 11 bp, Homo sapiens
agccgggccgc

SEQ ID NO: 5563262 - DNA, 22 bp, Homo sapiens
agccgggcgtggtggcgggcac

SEQ ID NO: 5563263 - DNA, 14 bp, Homo sapiens
agccgggctctgca

SEQ ID NO: 5563264 - DNA, 20 bp, Homo sapiens
agccggggactcccaggctg

SEQ ID NO: 5563265 - DNA, 21 bp, Homo sapiens
agccggggactcccaggctgg

SEQ ID NO: 5563266 - DNA, 15 bp, Homo sapiens
agccggggcctgcct

SEQ ID NO: 5563267 - DNA, 23 bp, Homo sapiens
agccggggccttatcgggctcca

SEQ ID NO: 5563268 - DNA, 16 bp, Homo sapiens
agccgggggaggggcc

SEQ ID NO: 5563269 - DNA, 17 bp, Homo sapiens
agccgggggaggggccc

SEQ ID NO: 5563270 - DNA, 20 bp, Homo sapiens
agccggggggccgggggagg

SEQ ID NO: 5563271 - DNA, 19 bp, Homo sapiens
agccggggtgtaacttcct

SEQ ID NO: 5563272 - DNA, 21 bp, Homo sapiens
agccggggtgtaacttcctgc

SEQ ID NO: 5563273 - DNA, 23 bp, Homo sapiens
agccgggtccggcctctccctgc

SEQ ID NO: 5563274 - DNA, 18 bp, Homo sapiens
agccgggtgtgtgtctgc

SEQ ID NO: 5563275 - DNA, 14 bp, Homo sapiens
agccggtgcccacc

SEQ ID NO: 5563276 - DNA, 16 bp, Homo sapiens
agccggtgggtgagga

SEQ ID NO: 5563277 - DNA, 13 bp, Homo sapiens
agccggtggtgcc

SEQ ID NO: 5563278 - DNA, 15 bp, Homo sapiens
agccggtggtgcccg

SEQ ID NO: 5563279 - DNA, 21 bp, Homo sapiens
agccggttcctgtccctgcgc

SEQ ID NO: 5563280 - DNA, 22 bp, Homo sapiens
agccggttctgctagagcagac

SEQ ID NO: 5563281 - DNA, 17 bp, Homo sapiens
agccggtttgggagaga

SEQ ID NO: 5563282 - DNA, 19 bp, Homo sapiens
agccggtttgggagagacc

SEQ ID NO: 5563283 - DNA, 17 bp, Homo sapiens
agccgtaaaaactgaag

SEQ ID NO: 5563284 - DNA, 12 bp, Homo sapiens
agccgtagaggg

SEQ ID NO: 5563285 - DNA, 15 bp, Homo sapiens
agccgtagagggtgg

SEQ ID NO: 5563286 - DNA, 15 bp, Homo sapiens
agccgtaggacccag

SEQ ID NO: 5563287 - DNA, 14 bp, Homo sapiens
agcctcatgttctg

SEQ ID NO: 5563288 - DNA, 16 bp, Homo sapiens
agcctcatgttctgtg

SEQ ID NO: 5563289 - DNA, 16 bp, Homo sapiens
agcctcattcactgtc

SEQ ID NO: 5563290 - DNA, 20 bp, Homo sapiens
agcctcattctgaggcctga

SEQ ID NO: 5563291 - DNA, 17 bp, Homo sapiens
agcctcattgtgccaag

SEQ ID NO: 5563292 - DNA, 22 bp, Homo sapiens
agcctccaaagtggagctggga

SEQ ID NO: 5563293 - DNA, 23 bp, Homo sapiens
agcctccaactccagctgagtcc

SEQ ID NO: 5563294 - DNA, 24 bp, Homo sapiens
agcctccaactccagctgagtcct

SEQ ID NO: 5563295 - DNA, 13 bp, Homo sapiens
agcctccaagcct

SEQ ID NO: 5563296 - DNA, 18 bp, Homo sapiens
agcctccaagcctgcctc

SEQ ID NO: 5563297 - DNA, 13 bp, Homo sapiens
agcctccaagggt

SEQ ID NO: 5563298 - DNA, 23 bp, Homo sapiens
agcctccacagcgagggcagctg

SEQ ID NO: 5563299 - DNA, 16 bp, Homo sapiens
agcctccaccatcccc

SEQ ID NO: 5563300 - DNA, 22 bp, Homo sapiens
agcctccaccccacaacccaaa

SEQ ID NO: 5563301 - DNA, 16 bp, Homo sapiens
agcctccacctgcagc

SEQ ID NO: 5563302 - DNA, 17 bp, Homo sapiens
agcctccaccttgagca

SEQ ID NO: 5563303 - DNA, 21 bp, Homo sapiens
agcctccactccctgtctgaa

SEQ ID NO: 5563304 - DNA, 22 bp, Homo sapiens
agcctccactccctgtctgaaa

SEQ ID NO: 5563305 - DNA, 18 bp, Homo sapiens
agcctccacttccccaca

SEQ ID NO: 5563306 - DNA, 15 bp, Homo sapiens
agcctccagagaagc

SEQ ID NO: 5563307 - DNA, 17 bp, Homo sapiens
agcctccagagaagccc

SEQ ID NO: 5563308 - DNA, 12 bp, Homo sapiens
agcctccagagc

SEQ ID NO: 5563309 - DNA, 14 bp, Homo sapiens
agcctccagagcca

SEQ ID NO: 5563310 - DNA, 15 bp, Homo sapiens
agcctccagagccag

SEQ ID NO: 5563311 - DNA, 21 bp, Homo sapiens
agcctccagagccagcctggg

SEQ ID NO: 5563312 - DNA, 18 bp, Homo sapiens
agcctccagcctctgttc

SEQ ID NO: 5563313 - DNA, 19 bp, Homo sapiens
agcctccagggcattgctc

SEQ ID NO: 5563314 - DNA, 20 bp, Homo sapiens
agcctccagggcattgctca

SEQ ID NO: 5563315 - DNA, 21 bp, Homo sapiens
agcctccagggcattgctcag

SEQ ID NO: 5563316 - DNA, 14 bp, Homo sapiens
agcctccagggccc

SEQ ID NO: 5563317 - DNA, 17 bp, Homo sapiens
agcctccagggcccccc

SEQ ID NO: 5563318 - DNA, 22 bp, Homo sapiens
agcctccagtccaaagccggct

SEQ ID NO: 5563319 - DNA, 23 bp, Homo sapiens
agcctccagtccaaagccggctt

SEQ ID NO: 5563320 - DNA, 14 bp, Homo sapiens
agcctccagtgctg

SEQ ID NO: 5563321 - DNA, 16 bp, Homo sapiens
agcctccagtgctggc

SEQ ID NO: 5563322 - DNA, 21 bp, Homo sapiens
agcctccatttagttctttgt

SEQ ID NO: 5563323 - DNA, 13 bp, Homo sapiens
agcctcccaaagt

SEQ ID NO: 5563324 - DNA, 18 bp, Homo sapiens
agcctcccaaagtgctgg

SEQ ID NO: 5563325 - DNA, 21 bp, Homo sapiens
agcctcccaaagtgctgggat

SEQ ID NO: 5563326 - DNA, 19 bp, Homo sapiens
agcctcccaagtagctggg

SEQ ID NO: 5563327 - DNA, 20 bp, Homo sapiens
agcctcccaagtagctggga

SEQ ID NO: 5563328 - DNA, 21 bp, Homo sapiens
agcctcccacactgaaaccaa

SEQ ID NO: 5563329 - DNA, 18 bp, Homo sapiens
agcctcccacagtgctgg

SEQ ID NO: 5563330 - DNA, 13 bp, Homo sapiens
agcctcccacccc

SEQ ID NO: 5563331 - DNA, 18 bp, Homo sapiens
agcctccccatctgtcca

SEQ ID NO: 5563332 - DNA, 19 bp, Homo sapiens
agcctccccatctgtccag

SEQ ID NO: 5563333 - DNA, 12 bp, Homo sapiens
agcctcccccac

SEQ ID NO: 5563334 - DNA, 14 bp, Homo sapiens
agcctcccccacaa

SEQ ID NO: 5563335 - DNA, 13 bp, Homo sapiens
agcctcccccagg

SEQ ID NO: 5563336 - DNA, 14 bp, Homo sapiens
agcctcccccaggc

SEQ ID NO: 5563337 - DNA, 15 bp, Homo sapiens
agcctcccccaggct

SEQ ID NO: 5563338 - DNA, 21 bp, Homo sapiens
agcctcccccaggctgcgcct

SEQ ID NO: 5563339 - DNA, 22 bp, Homo sapiens
agcctcccccaggctgcgcctg

SEQ ID NO: 5563340 - DNA, 19 bp, Homo sapiens
agcctcccccgccagcccc

SEQ ID NO: 5563341 - DNA, 13 bp, Homo sapiens
agcctccccctca

SEQ ID NO: 5563342 - DNA, 14 bp, Homo sapiens
agcctccccctcag

SEQ ID NO: 5563343 - DNA, 23 bp, Homo sapiens
agcctccccctcagatgatctct

SEQ ID NO: 5563344 - DNA, 16 bp, Homo sapiens
agcctcccctgccagg

SEQ ID NO: 5563345 - DNA, 17 bp, Homo sapiens
agcctcccctgccaggg

SEQ ID NO: 5563346 - DNA, 22 bp, Homo sapiens
agcctcccctgccagggcaggg

SEQ ID NO: 5563347 - DNA, 22 bp, Homo sapiens
agcctcccctgggttaacaaat

SEQ ID NO: 5563348 - DNA, 23 bp, Homo sapiens
agcctcccctgggttaacaaatg

SEQ ID NO: 5563349 - DNA, 11 bp, Homo sapiens
agcctcccctt

SEQ ID NO: 5563350 - DNA, 14 bp, Homo sapiens
agcctccccttccc

SEQ ID NO: 5563351 - DNA, 17 bp, Homo sapiens
agcctccccttcccaga

SEQ ID NO: 5563352 - DNA, 18 bp, Homo sapiens
agcctccccttcccagac

SEQ ID NO: 5563353 - DNA, 23 bp, Homo sapiens
agcctccccttcttcccgcccca

SEQ ID NO: 5563354 - DNA, 20 bp, Homo sapiens
agcctcccgaatagctggga

SEQ ID NO: 5563355 - DNA, 17 bp, Homo sapiens
agcctcccgagtagctg

SEQ ID NO: 5563356 - DNA, 19 bp, Homo sapiens
agcctcccgagtagctggg

SEQ ID NO: 5563357 - DNA, 20 bp, Homo sapiens
agcctcccgagtagctggga

SEQ ID NO: 5563358 - DNA, 21 bp, Homo sapiens
agcctccctcagccacgcctc

SEQ ID NO: 5563359 - DNA, 13 bp, Homo sapiens
agcctccctcctc

SEQ ID NO: 5563360 - DNA, 14 bp, Homo sapiens
agcctccctcctcg

SEQ ID NO: 5563361 - DNA, 14 bp, Homo sapiens
agcctccctgaagc

SEQ ID NO: 5563362 - DNA, 15 bp, Homo sapiens
agcctccctgaagcc

SEQ ID NO: 5563363 - DNA, 21 bp, Homo sapiens
agcctccctgacgtctgccac

SEQ ID NO: 5563364 - DNA, 14 bp, Homo sapiens
agcctccctgagcc

SEQ ID NO: 5563365 - DNA, 17 bp, Homo sapiens
agcctccctgagcctgc

SEQ ID NO: 5563366 - DNA, 18 bp, Homo sapiens
agcctccctgagcctgca

SEQ ID NO: 5563367 - DNA, 12 bp, Homo sapiens
agcctccctgca

SEQ ID NO: 5563368 - DNA, 16 bp, Homo sapiens
agcctccctgtctcca

SEQ ID NO: 5563369 - DNA, 22 bp, Homo sapiens
agcctccctgtctccagctgcc

SEQ ID NO: 5563370 - DNA, 24 bp, Homo sapiens
agcctccctgtctccagctgcctg

SEQ ID NO: 5563371 - DNA, 18 bp, Homo sapiens
agcctccctttgccagcc

SEQ ID NO: 5563372 - DNA, 20 bp, Homo sapiens
agcctccgccaagatctaca

SEQ ID NO: 5563373 - DNA, 15 bp, Homo sapiens
agcctccgctgggct

SEQ ID NO: 5563374 - DNA, 16 bp, Homo sapiens
agcctccgctgggctt

SEQ ID NO: 5563375 - DNA, 17 bp, Homo sapiens
agcctccgctgggcttc

SEQ ID NO: 5563376 - DNA, 15 bp, Homo sapiens
agcctccggaagctg

SEQ ID NO: 5563377 - DNA, 21 bp, Homo sapiens
agcctccggggttcagcctcc

SEQ ID NO: 5563378 - DNA, 23 bp, Homo sapiens
agcctccggggttcagcctcctg

SEQ ID NO: 5563379 - DNA, 22 bp, Homo sapiens
agcctccgtcatccatgccctc

SEQ ID NO: 5563380 - DNA, 18 bp, Homo sapiens
agcctccgttcccacctc

SEQ ID NO: 5563381 - DNA, 23 bp, Homo sapiens
agcctccgttcccacctctgagg

SEQ ID NO: 5563382 - DNA, 18 bp, Homo sapiens
agcctccgtttatgggcc

SEQ ID NO: 5563383 - DNA, 18 bp, Homo sapiens
agcctcctaagcagctgg

SEQ ID NO: 5563384 - DNA, 14 bp, Homo sapiens
agcctcctcagggg

SEQ ID NO: 5563385 - DNA, 14 bp, Homo sapiens
agcctcctcccacc

SEQ ID NO: 5563386 - DNA, 22 bp, Homo sapiens
agcctcctcccaccaccctccc

SEQ ID NO: 5563387 - DNA, 12 bp, Homo sapiens
agcctcctcctg

SEQ ID NO: 5563388 - DNA, 13 bp, Homo sapiens
agcctcctcctga

SEQ ID NO: 5563389 - DNA, 17 bp, Homo sapiens
agcctcctcctgggctc

SEQ ID NO: 5563390 - DNA, 11 bp, Homo sapiens
agcctcctctg

SEQ ID NO: 5563391 - DNA, 12 bp, Homo sapiens
agcctcctctgc

SEQ ID NO: 5563392 - DNA, 19 bp, Homo sapiens
agcctcctctggacggcag

SEQ ID NO: 5563393 - DNA, 20 bp, Homo sapiens
agcctcctctgtctgccctt

SEQ ID NO: 5563394 - DNA, 21 bp, Homo sapiens
agcctcctctgtctgcccttc

SEQ ID NO: 5563395 - DNA, 23 bp, Homo sapiens
agcctcctgaagttgctgctgtg

SEQ ID NO: 5563396 - DNA, 14 bp, Homo sapiens
agcctcctgacctg

SEQ ID NO: 5563397 - DNA, 18 bp, Homo sapiens
agcctcctgacctgaggc

SEQ ID NO: 5563398 - DNA, 12 bp, Homo sapiens
agcctcctgagt

SEQ ID NO: 5563399 - DNA, 17 bp, Homo sapiens
agcctcctgagtagctg

SEQ ID NO: 5563400 - DNA, 11 bp, Homo sapiens
agcctcctgcc

SEQ ID NO: 5563401 - DNA, 13 bp, Homo sapiens
agcctcctgccca

SEQ ID NO: 5563402 - DNA, 18 bp, Homo sapiens
agcctcctgcccagtccc

SEQ ID NO: 5563403 - DNA, 16 bp, Homo sapiens
agcctcctgccccctg

SEQ ID NO: 5563404 - DNA, 18 bp, Homo sapiens
agcctcctgccccctgcc

SEQ ID NO: 5563405 - DNA, 20 bp, Homo sapiens
agcctcctgccccctgccag

SEQ ID NO: 5563406 - DNA, 14 bp, Homo sapiens
agcctcctgctgag

SEQ ID NO: 5563407 - DNA, 14 bp, Homo sapiens
agcctcctgggtag

SEQ ID NO: 5563408 - DNA, 18 bp, Homo sapiens
agcctcctgtacctcagt

SEQ ID NO: 5563409 - DNA, 15 bp, Homo sapiens
agcctcctgtgcctg

SEQ ID NO: 5563410 - DNA, 21 bp, Homo sapiens
agcctcctgtgtagctgggat

SEQ ID NO: 5563411 - DNA, 18 bp, Homo sapiens
agcctcctgtttgcaggc

SEQ ID NO: 5563412 - DNA, 19 bp, Homo sapiens
agcctccttacattaaaaa

SEQ ID NO: 5563413 - DNA, 16 bp, Homo sapiens
agcctccttgctgacc

SEQ ID NO: 5563414 - DNA, 19 bp, Homo sapiens
agcctccttgctgacccca

SEQ ID NO: 5563415 - DNA, 23 bp, Homo sapiens
agcctccttgtgcaattgtcttt

SEQ ID NO: 5563416 - DNA, 17 bp, Homo sapiens
agcctcgaactcctggg

SEQ ID NO: 5563417 - DNA, 16 bp, Homo sapiens
agcctcgacctccctg

SEQ ID NO: 5563418 - DNA, 17 bp, Homo sapiens
agcctcgacctccctgg

SEQ ID NO: 5563419 - DNA, 17 bp, Homo sapiens
agcctcgaggctggtgg

SEQ ID NO: 5563420 - DNA, 20 bp, Homo sapiens
agcctcgaggctggtggttt

SEQ ID NO: 5563421 - DNA, 21 bp, Homo sapiens
agcctcgatgtcctcctctgt

SEQ ID NO: 5563422 - DNA, 22 bp, Homo sapiens
agcctcgatgtcctcctctgtg

SEQ ID NO: 5563423 - DNA, 23 bp, Homo sapiens
agcctcgatgtcctcctctgtga

SEQ ID NO: 5563424 - DNA, 18 bp, Homo sapiens
agcctcgcaacccgtgcc

SEQ ID NO: 5563425 - DNA, 21 bp, Homo sapiens
agcctcgcaacccgtgccaag

SEQ ID NO: 5563426 - DNA, 23 bp, Homo sapiens
agcctcgcaacccgtgccaagtc

SEQ ID NO: 5563427 - DNA, 15 bp, Homo sapiens
agcctcgcacaggcc

SEQ ID NO: 5563428 - DNA, 17 bp, Homo sapiens
agcctcgcacaggccct

SEQ ID NO: 5563429 - DNA, 20 bp, Homo sapiens
agcctcgcacaggccctagc

SEQ ID NO: 5563430 - DNA, 20 bp, Homo sapiens
agcctcgcaggcctccctgc

SEQ ID NO: 5563431 - DNA, 23 bp, Homo sapiens
agcctcgcaggcctccctgccag

SEQ ID NO: 5563432 - DNA, 15 bp, Homo sapiens
agcctcgcccctggc

SEQ ID NO: 5563433 - DNA, 19 bp, Homo sapiens
agcctcgcccctggcagag

SEQ ID NO: 5563434 - DNA, 14 bp, Homo sapiens
agcctcgcctgtca

SEQ ID NO: 5563435 - DNA, 19 bp, Homo sapiens
agcctcgcctgtcaccccc

SEQ ID NO: 5563436 - DNA, 21 bp, Homo sapiens
agcctcgcctgtcacccccac

SEQ ID NO: 5563437 - DNA, 22 bp, Homo sapiens
agcctcgcctgtcacccccact

SEQ ID NO: 5563438 - DNA, 23 bp, Homo sapiens
agcctcgcctgtcacccccactc

SEQ ID NO: 5563439 - DNA, 15 bp, Homo sapiens
agcctcgctttttca

SEQ ID NO: 5563440 - DNA, 16 bp, Homo sapiens
agcctcgctttttcat

SEQ ID NO: 5563441 - DNA, 22 bp, Homo sapiens
agcctcgctttttcatccttct

SEQ ID NO: 5563442 - DNA, 14 bp, Homo sapiens
agcctcgggtgggg

SEQ ID NO: 5563443 - DNA, 16 bp, Homo sapiens
agcctcggtggccatg

SEQ ID NO: 5563444 - DNA, 17 bp, Homo sapiens
agcctcgtccctccctc

SEQ ID NO: 5563445 - DNA, 14 bp, Homo sapiens
agcctcgtgtcctg

SEQ ID NO: 5563446 - DNA, 22 bp, Homo sapiens
agcctcgtgtcctgctagctgt

SEQ ID NO: 5563447 - DNA, 14 bp, Homo sapiens
agcctcgttaggac

SEQ ID NO: 5563448 - DNA, 19 bp, Homo sapiens
agcctcgttaggacaaggc

SEQ ID NO: 5563449 - DNA, 21 bp, Homo sapiens
agcctcgttaggacaaggctg

SEQ ID NO: 5563450 - DNA, 21 bp, Homo sapiens
agcctcgttggagagcagcag

SEQ ID NO: 5563451 - DNA, 16 bp, Homo sapiens
agcctctaacaaatga

SEQ ID NO: 5563452 - DNA, 23 bp, Homo sapiens
agcctctaagcgtgctgacatca

SEQ ID NO: 5563453 - DNA, 18 bp, Homo sapiens
agcctctagggacccctc

SEQ ID NO: 5563454 - DNA, 20 bp, Homo sapiens
agcctctagggacccctcct

SEQ ID NO: 5563455 - DNA, 14 bp, Homo sapiens
agcctctccaggaa

SEQ ID NO: 5563456 - DNA, 23 bp, Homo sapiens
agcctctccaggcaccatctccc

SEQ ID NO: 5563457 - DNA, 12 bp, Homo sapiens
agcctctcccac

SEQ ID NO: 5563458 - DNA, 22 bp, Homo sapiens
agcctctcccacccggccacag

SEQ ID NO: 5563459 - DNA, 14 bp, Homo sapiens
agcctctcccctgc

SEQ ID NO: 5563460 - DNA, 21 bp, Homo sapiens
agcctctcccctgcctgccct

SEQ ID NO: 5563461 - DNA, 13 bp, Homo sapiens
agcctctcccggc

SEQ ID NO: 5563462 - DNA, 20 bp, Homo sapiens
agcctctcccggctgcctgc

SEQ ID NO: 5563463 - DNA, 13 bp, Homo sapiens
agcctgggcctcc

SEQ ID NO: 5563464 - DNA, 15 bp, Homo sapiens
agcctgggcctcctc

SEQ ID NO: 5563465 - DNA, 17 bp, Homo sapiens
agcctgggcctcctcct

SEQ ID NO: 5563466 - DNA, 22 bp, Homo sapiens
agcctgggcctcctcctagctg

SEQ ID NO: 5563467 - DNA, 23 bp, Homo sapiens
agcctgggcgacaaaaacgaaac

SEQ ID NO: 5563468 - DNA, 14 bp, Homo sapiens
agcctgggcgacag

SEQ ID NO: 5563469 - DNA, 11 bp, Homo sapiens
agcctgggctc

SEQ ID NO: 5563470 - DNA, 15 bp, Homo sapiens
agcctgggctcactg

SEQ ID NO: 5563471 - DNA, 22 bp, Homo sapiens
agcctgggctcactgtgctggg

SEQ ID NO: 5563472 - DNA, 16 bp, Homo sapiens
agcctgggctccctct

SEQ ID NO: 5563473 - DNA, 18 bp, Homo sapiens
agcctgggctccctcttg

SEQ ID NO: 5563474 - DNA, 19 bp, Homo sapiens
agcctgggctcctctgcat

SEQ ID NO: 5563475 - DNA, 15 bp, Homo sapiens
agcctgggcttgagc

SEQ ID NO: 5563476 - DNA, 13 bp, Homo sapiens
agcctggggcctg

SEQ ID NO: 5563477 - DNA, 14 bp, Homo sapiens
agcctggggcctgg

SEQ ID NO: 5563478 - DNA, 15 bp, Homo sapiens
agcctggggcctggc

SEQ ID NO: 5563479 - DNA, 16 bp, Homo sapiens
agcctggggcctggca

SEQ ID NO: 5563480 - DNA, 17 bp, Homo sapiens
agcctggggcctggcag

SEQ ID NO: 5563481 - DNA, 21 bp, Homo sapiens
agcctggggcctggggatgta

SEQ ID NO: 5563482 - DNA, 19 bp, Homo sapiens
agcctggggccttcctggc

SEQ ID NO: 5563483 - DNA, 21 bp, Homo sapiens
agcctggggccttcctggctt

SEQ ID NO: 5563484 - DNA, 23 bp, Homo sapiens
agcctggggccttcctggctttg

SEQ ID NO: 5563485 - DNA, 20 bp, Homo sapiens
agcctggggcggtgtgtgtg

SEQ ID NO: 5563486 - DNA, 12 bp, Homo sapiens
agcctggggctc

SEQ ID NO: 5563487 - DNA, 18 bp, Homo sapiens
agcctggggctccctctc

SEQ ID NO: 5563488 - DNA, 14 bp, Homo sapiens
agcctggggctcta

SEQ ID NO: 5563489 - DNA, 22 bp, Homo sapiens
agcctggggctctaacgcctga

SEQ ID NO: 5563490 - DNA, 20 bp, Homo sapiens
agcctggggctctctgaccc

SEQ ID NO: 5563491 - DNA, 18 bp, Homo sapiens
agcctggggcttgaattt

SEQ ID NO: 5563492 - DNA, 17 bp, Homo sapiens
agcctgggggcctggct

SEQ ID NO: 5563493 - DNA, 19 bp, Homo sapiens
agcctgggggcctggctgg

SEQ ID NO: 5563494 - DNA, 20 bp, Homo sapiens
agcctgggggcctggctggc

SEQ ID NO: 5563495 - DNA, 16 bp, Homo sapiens
agcctgggggctggga

SEQ ID NO: 5563496 - DNA, 23 bp, Homo sapiens
agcctggggtgatagaacaagac

SEQ ID NO: 5563497 - DNA, 21 bp, Homo sapiens
agcctggggtgggtgtgagca

SEQ ID NO: 5563498 - DNA, 16 bp, Homo sapiens
agcctggggttgtccc

SEQ ID NO: 5563499 - DNA, 19 bp, Homo sapiens
agcctgggtctggatggga

SEQ ID NO: 5563500 - DNA, 23 bp, Homo sapiens
agcctgggtctggatgggaggag

SEQ ID NO: 5563501 - DNA, 14 bp, Homo sapiens
agcctgggtgacaa

SEQ ID NO: 5563502 - DNA, 19 bp, Homo sapiens
agcctgggtgacaaagcga

SEQ ID NO: 5563503 - DNA, 20 bp, Homo sapiens
agcctgggtgacagagcgag

SEQ ID NO: 5563504 - DNA, 21 bp, Homo sapiens
agcctgggtgacagagcgaga

SEQ ID NO: 5563505 - DNA, 21 bp, Homo sapiens
agcctgggtgacagagtgaga

SEQ ID NO: 5563506 - DNA, 13 bp, Homo sapiens
agcctgggtgaga

SEQ ID NO: 5563507 - DNA, 21 bp, Homo sapiens
agcctgggtgagaatcctgcc

SEQ ID NO: 5563508 - DNA, 20 bp, Homo sapiens
agcctgggtgtaaaacctgg

SEQ ID NO: 5563509 - DNA, 22 bp, Homo sapiens
agcctgggtgtaaaacctggag

SEQ ID NO: 5563510 - DNA, 20 bp, Homo sapiens
agcctgggtgtcaagtgcct

SEQ ID NO: 5563511 - DNA, 18 bp, Homo sapiens
agcctggtagagactagg

SEQ ID NO: 5563512 - DNA, 18 bp, Homo sapiens
agcctggtccttccctga

SEQ ID NO: 5563513 - DNA, 18 bp, Homo sapiens
agcctggtctgtgcattg

SEQ ID NO: 5563514 - DNA, 14 bp, Homo sapiens
agcctggtgacagg

SEQ ID NO: 5563515 - DNA, 15 bp, Homo sapiens
agcctggtgacaggc

SEQ ID NO: 5563516 - DNA, 11 bp, Homo sapiens
agcctggtgcc

SEQ ID NO: 5563517 - DNA, 16 bp, Homo sapiens
agcctggtgctgctgc

SEQ ID NO: 5563518 - DNA, 13 bp, Homo sapiens
agcctggtggccc

SEQ ID NO: 5563519 - DNA, 14 bp, Homo sapiens
agcctggtgggcct

SEQ ID NO: 5563520 - DNA, 18 bp, Homo sapiens
agcctggtgttgttcttc

SEQ ID NO: 5563521 - DNA, 18 bp, Homo sapiens
agcctggttcagacacag

SEQ ID NO: 5563522 - DNA, 23 bp, Homo sapiens
agcctggttcagacacagctctt

SEQ ID NO: 5563523 - DNA, 15 bp, Homo sapiens
agcctggttccctct

SEQ ID NO: 5563524 - DNA, 18 bp, Homo sapiens
agcctggttccctctttc

SEQ ID NO: 5563525 - DNA, 22 bp, Homo sapiens
agcctggttccctctttcctgt

SEQ ID NO: 5563526 - DNA, 18 bp, Homo sapiens
agcctggtttagcctgga

SEQ ID NO: 5563527 - DNA, 22 bp, Homo sapiens
agcctggttttcgtcatcttcc

SEQ ID NO: 5563528 - DNA, 23 bp, Homo sapiens
agcctgtaaacggtgctatttct

SEQ ID NO: 5563529 - DNA, 20 bp, Homo sapiens
agcctgtaacactcctctgc

SEQ ID NO: 5563530 - DNA, 18 bp, Homo sapiens
agcctgtaagcctgcaag

SEQ ID NO: 5563531 - DNA, 16 bp, Homo sapiens
agcctgtaatcccagc

SEQ ID NO: 5563532 - DNA, 18 bp, Homo sapiens
agcctgtaatcccagcta

SEQ ID NO: 5563533 - DNA, 16 bp, Homo sapiens
agcctgtaattatgta

SEQ ID NO: 5563534 - DNA, 20 bp, Homo sapiens
agcctgtagcttatatttga

SEQ ID NO: 5563535 - DNA, 14 bp, Homo sapiens
agcctgtagggaac

SEQ ID NO: 5563536 - DNA, 16 bp, Homo sapiens
agcctgtagggaactt

SEQ ID NO: 5563537 - DNA, 19 bp, Homo sapiens
agcctgtatagacagcact

SEQ ID NO: 5563538 - DNA, 15 bp, Homo sapiens
agcctgtcaccagag

SEQ ID NO: 5563539 - DNA, 18 bp, Homo sapiens
agcctgtcaccagagctt

SEQ ID NO: 5563540 - DNA, 22 bp, Homo sapiens
agcctgtcaccagagcttctct

SEQ ID NO: 5563541 - DNA, 14 bp, Homo sapiens
agcctgtcacgtgg

SEQ ID NO: 5563542 - DNA, 15 bp, Homo sapiens
agcctgtcagccaac

SEQ ID NO: 5563543 - DNA, 22 bp, Homo sapiens
agcctgtcatccttggtctttg

SEQ ID NO: 5563544 - DNA, 20 bp, Homo sapiens
agcctgtcccactggctcct

SEQ ID NO: 5563545 - DNA, 21 bp, Homo sapiens
agcctgtcccactggctcctc

SEQ ID NO: 5563546 - DNA, 17 bp, Homo sapiens
agcctgtccccagacca

SEQ ID NO: 5563547 - DNA, 23 bp, Homo sapiens
agcctgtccccagaccaaccctg

SEQ ID NO: 5563548 - DNA, 20 bp, Homo sapiens
agcctgtccccgccttccct

SEQ ID NO: 5563549 - DNA, 23 bp, Homo sapiens
agcctgtccccgccttccctcac

SEQ ID NO: 5563550 - DNA, 15 bp, Homo sapiens
agcctgtcctcaccg

SEQ ID NO: 5563551 - DNA, 11 bp, Homo sapiens
agcctgtcctg

SEQ ID NO: 5563552 - DNA, 14 bp, Homo sapiens
agcctgtcctgggc

SEQ ID NO: 5563553 - DNA, 21 bp, Homo sapiens
agcctgtcctggtacagcagg

SEQ ID NO: 5563554 - DNA, 22 bp, Homo sapiens
agcctgtcctggtacagcaggg

SEQ ID NO: 5563555 - DNA, 23 bp, Homo sapiens
agcctgtcctggtacagcagggt

SEQ ID NO: 5563556 - DNA, 12 bp, Homo sapiens
agcctgtcctgt

SEQ ID NO: 5563557 - DNA, 13 bp, Homo sapiens
agcctgtcctgtc

SEQ ID NO: 5563558 - DNA, 14 bp, Homo sapiens
agcctgtcctgtca

SEQ ID NO: 5563559 - DNA, 18 bp, Homo sapiens
agcctgtcctgtcatcat

SEQ ID NO: 5563560 - DNA, 17 bp, Homo sapiens
agcctgtcggccacacc

SEQ ID NO: 5563561 - DNA, 17 bp, Homo sapiens
agcctgtcgtgtccagc

SEQ ID NO: 5563562 - DNA, 18 bp, Homo sapiens
agcctgtcgtgtccagcc

SEQ ID NO: 5563563 - DNA, 13 bp, Homo sapiens
agcctgtctcggg

SEQ ID NO: 5563564 - DNA, 17 bp, Homo sapiens
agcctgtctcgggctga

SEQ ID NO: 5563565 - DNA, 14 bp, Homo sapiens
agcctgtctctccc

SEQ ID NO: 5563566 - DNA, 16 bp, Homo sapiens
agcctgtctctttcca

SEQ ID NO: 5563567 - DNA, 14 bp, Homo sapiens
agcctgtcttcaga

SEQ ID NO: 5563568 - DNA, 22 bp, Homo sapiens
agcctgtcttcagatcctgctg

SEQ ID NO: 5563569 - DNA, 15 bp, Homo sapiens
agcctgtctttcagc

SEQ ID NO: 5563570 - DNA, 15 bp, Homo sapiens
agcctgtgaacccag

SEQ ID NO: 5563571 - DNA, 18 bp, Homo sapiens
agcctgtgaacccaggac

SEQ ID NO: 5563572 - DNA, 20 bp, Homo sapiens
agcctgtgaacccaggacaa

SEQ ID NO: 5563573 - DNA, 15 bp, Homo sapiens
agcctgtgaccttgg

SEQ ID NO: 5563574 - DNA, 17 bp, Homo sapiens
agcctgtgaccttggga

SEQ ID NO: 5563575 - DNA, 13 bp, Homo sapiens
agcctgtgaggga

SEQ ID NO: 5563576 - DNA, 20 bp, Homo sapiens
agcctgtgcaaaaaaattaa

SEQ ID NO: 5563577 - DNA, 15 bp, Homo sapiens
agcctgtgccacctg

SEQ ID NO: 5563578 - DNA, 11 bp, Homo sapiens
agcctgtgcct

SEQ ID NO: 5563579 - DNA, 12 bp, Homo sapiens
agcctgtgcctc

SEQ ID NO: 5563580 - DNA, 17 bp, Homo sapiens
agcctgtgccttcctcc

SEQ ID NO: 5563581 - DNA, 19 bp, Homo sapiens
agcctgtgcgtcccagctg

SEQ ID NO: 5563582 - DNA, 22 bp, Homo sapiens
agcctgtgctggaccagctggc

SEQ ID NO: 5563583 - DNA, 15 bp, Homo sapiens
agcctgtggatgatc

SEQ ID NO: 5563584 - DNA, 22 bp, Homo sapiens
agcctgtggcatctttgccttg

SEQ ID NO: 5563585 - DNA, 16 bp, Homo sapiens
agcctgtggccagcag

SEQ ID NO: 5563586 - DNA, 23 bp, Homo sapiens
agcctgtggccccgaggctggga

SEQ ID NO: 5563587 - DNA, 15 bp, Homo sapiens
agcctgtggccctgt

SEQ ID NO: 5563588 - DNA, 14 bp, Homo sapiens
agcctgtggcctca

SEQ ID NO: 5563589 - DNA, 20 bp, Homo sapiens
agcctgtggcctcagcatct

SEQ ID NO: 5563590 - DNA, 19 bp, Homo sapiens
agcctgtggcggtgcctgg

SEQ ID NO: 5563591 - DNA, 22 bp, Homo sapiens
agcctgtggcggtgcctgggtg

SEQ ID NO: 5563592 - DNA, 16 bp, Homo sapiens
agcctgtggctgtgga

SEQ ID NO: 5563593 - DNA, 19 bp, Homo sapiens
agcctgtggcttggagtgg

SEQ ID NO: 5563594 - DNA, 20 bp, Homo sapiens
agcctgtgggagtagaaaaa

SEQ ID NO: 5563595 - DNA, 13 bp, Homo sapiens
agcctgtgggcag

SEQ ID NO: 5563596 - DNA, 23 bp, Homo sapiens
agcctgtgggcagcatgcccaga

SEQ ID NO: 5563597 - DNA, 15 bp, Homo sapiens
agcctgtgggtcctt

SEQ ID NO: 5563598 - DNA, 19 bp, Homo sapiens
agcctgtggttacagtgca

SEQ ID NO: 5563599 - DNA, 18 bp, Homo sapiens
agcctgtgtaacagctcc

SEQ ID NO: 5563600 - DNA, 12 bp, Homo sapiens
agcctgtgtcct

SEQ ID NO: 5563601 - DNA, 14 bp, Homo sapiens
agcctgtgtcctga

SEQ ID NO: 5563602 - DNA, 17 bp, Homo sapiens
agcctgtgtcctgaaga

SEQ ID NO: 5563603 - DNA, 14 bp, Homo sapiens
agcctgtgtgcagt

SEQ ID NO: 5563604 - DNA, 23 bp, Homo sapiens
agcctgtgtgcagtggagctggc

SEQ ID NO: 5563605 - DNA, 14 bp, Homo sapiens
agcctgtgtgttct

SEQ ID NO: 5563606 - DNA, 23 bp, Homo sapiens
agcctgtgttagtgtctgtccat

SEQ ID NO: 5563607 - DNA, 23 bp, Homo sapiens
agcctgttacaggaatgaagtaa

SEQ ID NO: 5563608 - DNA, 16 bp, Homo sapiens
agcctgttcatggcag

SEQ ID NO: 5563609 - DNA, 19 bp, Homo sapiens
agcctgttcattctgatgt

SEQ ID NO: 5563610 - DNA, 17 bp, Homo sapiens
agcctgttccagaagga

SEQ ID NO: 5563611 - DNA, 14 bp, Homo sapiens
agcctgttggaccc

SEQ ID NO: 5563612 - DNA, 22 bp, Homo sapiens
agcctgttggacccgctctgga

SEQ ID NO: 5563613 - DNA, 20 bp, Homo sapiens
agcctgttgttcccatctgc

SEQ ID NO: 5563614 - DNA, 15 bp, Homo sapiens
agcctgtttaagaga

SEQ ID NO: 5563615 - DNA, 16 bp, Homo sapiens
agcctgtttattgcca

SEQ ID NO: 5563616 - DNA, 17 bp, Homo sapiens
agcctgtttattgccat

SEQ ID NO: 5563617 - DNA, 18 bp, Homo sapiens
agcctgtttgggaggctg

SEQ ID NO: 5563618 - DNA, 17 bp, Homo sapiens
agcctgttttaaaaaat

SEQ ID NO: 5563619 - DNA, 20 bp, Homo sapiens
agcctgttttcactcagctt

SEQ ID NO: 5563620 - DNA, 19 bp, Homo sapiens
agccttaaaacatcattcc

SEQ ID NO: 5563621 - DNA, 22 bp, Homo sapiens
agccttaaaacatcattccttt

SEQ ID NO: 5563622 - DNA, 19 bp, Homo sapiens
agccttaaaatgcattgaa

SEQ ID NO: 5563623 - DNA, 14 bp, Homo sapiens
agccttaactaaga

SEQ ID NO: 5563624 - DNA, 15 bp, Homo sapiens
agccttaactttaaa

SEQ ID NO: 5563625 - DNA, 17 bp, Homo sapiens
agccttaagaaagctat

SEQ ID NO: 5563626 - DNA, 16 bp, Homo sapiens
agccttaagaaatggt

SEQ ID NO: 5563627 - DNA, 14 bp, Homo sapiens
agccttaagcaaat

SEQ ID NO: 5563628 - DNA, 14 bp, Homo sapiens
agccttaagctgca

SEQ ID NO: 5563629 - DNA, 18 bp, Homo sapiens
agccttaaggccctcatt

SEQ ID NO: 5563630 - DNA, 20 bp, Homo sapiens
agccttaaggccctcattct

SEQ ID NO: 5563631 - DNA, 21 bp, Homo sapiens
agccttaatagacttctctta

SEQ ID NO: 5563632 - DNA, 20 bp, Homo sapiens
agccttaatggatgctcatt

SEQ ID NO: 5563633 - DNA, 23 bp, Homo sapiens
agccttaatggatgctcattcat

SEQ ID NO: 5563634 - DNA, 16 bp, Homo sapiens
agccttaatgtatttg

SEQ ID NO: 5563635 - DNA, 15 bp, Homo sapiens
agccttaatttgcac

SEQ ID NO: 5563636 - DNA, 20 bp, Homo sapiens
agccttaatttttttttcat

SEQ ID NO: 5563637 - DNA, 21 bp, Homo sapiens
agccttacaaggttatgtaga

SEQ ID NO: 5563638 - DNA, 22 bp, Homo sapiens
agccttacacagggcgaggggt

SEQ ID NO: 5563639 - DNA, 21 bp, Homo sapiens
agccttaccaagactcctgca

SEQ ID NO: 5563640 - DNA, 23 bp, Homo sapiens
agcgcccccaggcctgccctgct

SEQ ID NO: 5563641 - DNA, 18 bp, Homo sapiens
agcgcccccatctgtctt

SEQ ID NO: 5563642 - DNA, 18 bp, Homo sapiens
agcgcccccgagccctga

SEQ ID NO: 5563643 - DNA, 15 bp, Homo sapiens
agcgccccgccccca

SEQ ID NO: 5563644 - DNA, 17 bp, Homo sapiens
agcgccccgcccccacc

SEQ ID NO: 5563645 - DNA, 22 bp, Homo sapiens
agcgcccctcactcctgcgctg

SEQ ID NO: 5563646 - DNA, 11 bp, Homo sapiens
agcgcccctcc

SEQ ID NO: 5563647 - DNA, 16 bp, Homo sapiens
agcgcccctccctagt

SEQ ID NO: 5563648 - DNA, 16 bp, Homo sapiens
agcgcccctggctgcc

SEQ ID NO: 5563649 - DNA, 14 bp, Homo sapiens
agcgcccgctgggc

SEQ ID NO: 5563650 - DNA, 11 bp, Homo sapiens
agcgccctcac

SEQ ID NO: 5563651 - DNA, 21 bp, Homo sapiens
agcgccctgcagaccctgccc

SEQ ID NO: 5563652 - DNA, 14 bp, Homo sapiens
agcgccctgcaggg

SEQ ID NO: 5563653 - DNA, 14 bp, Homo sapiens
agcgccctggcccc

SEQ ID NO: 5563654 - DNA, 12 bp, Homo sapiens
agcgcccttcct

SEQ ID NO: 5563655 - DNA, 15 bp, Homo sapiens
agcgcccttcctctc

SEQ ID NO: 5563656 - DNA, 16 bp, Homo sapiens
agcgcccttcctctcc

SEQ ID NO: 5563657 - DNA, 16 bp, Homo sapiens
agcgccgactccctga

SEQ ID NO: 5563658 - DNA, 18 bp, Homo sapiens
agcgccggggggagggag

SEQ ID NO: 5563659 - DNA, 19 bp, Homo sapiens
agcgccgtgagttctcagg

SEQ ID NO: 5563660 - DNA, 20 bp, Homo sapiens
agcgccgtgagttctcaggg

SEQ ID NO: 5563661 - DNA, 22 bp, Homo sapiens
agcgccgtgagttctcagggct

SEQ ID NO: 5563662 - DNA, 24 bp, Homo sapiens
agcgccgtgagttctcagggctcc

SEQ ID NO: 5563663 - DNA, 15 bp, Homo sapiens
agcgcctcacctgca

SEQ ID NO: 5563664 - DNA, 16 bp, Homo sapiens
agcgcctcacctgcat

SEQ ID NO: 5563665 - DNA, 21 bp, Homo sapiens
agcgcctcagttacacaggaa

SEQ ID NO: 5563666 - DNA, 19 bp, Homo sapiens
agcgcctccaaccctagca

SEQ ID NO: 5563667 - DNA, 15 bp, Homo sapiens
agcgcctccaccctg

SEQ ID NO: 5563668 - DNA, 18 bp, Homo sapiens
agcgcctccaccctgccc

SEQ ID NO: 5563669 - DNA, 20 bp, Homo sapiens
agcgcctccatccaaggcca

SEQ ID NO: 5563670 - DNA, 22 bp, Homo sapiens
agcgcctccatccaaggccagg

SEQ ID NO: 5563671 - DNA, 15 bp, Homo sapiens
agcgcctcccgccgc

SEQ ID NO: 5563672 - DNA, 18 bp, Homo sapiens
agcgcctcccgccgcctc

SEQ ID NO: 5563673 - DNA, 20 bp, Homo sapiens
agcgcctcccgccgcctcgg

SEQ ID NO: 5563674 - DNA, 13 bp, Homo sapiens
agcgcctccctcc

SEQ ID NO: 5563675 - DNA, 16 bp, Homo sapiens
agcgcctcctggacac

SEQ ID NO: 5563676 - DNA, 21 bp, Homo sapiens
agcgcctcttcctctgggcag

SEQ ID NO: 5563677 - DNA, 15 bp, Homo sapiens
agcgcctgccctccc

SEQ ID NO: 5563678 - DNA, 21 bp, Homo sapiens
agcgcctgcgttcccagacca

SEQ ID NO: 5563679 - DNA, 22 bp, Homo sapiens
agcgcctgtcccctcacagact

SEQ ID NO: 5563680 - DNA, 16 bp, Homo sapiens
agcgcctgtgcacaca

SEQ ID NO: 5563681 - DNA, 17 bp, Homo sapiens
agcgcctgtgcacacac

SEQ ID NO: 5563682 - DNA, 20 bp, Homo sapiens
agcgcctgtgctgaggactc

SEQ ID NO: 5563683 - DNA, 14 bp, Homo sapiens
agcgcgcaggcctg

SEQ ID NO: 5563684 - DNA, 19 bp, Homo sapiens
agcgcgccactcgcttccc

SEQ ID NO: 5563685 - DNA, 16 bp, Homo sapiens
agcgcggccagcgtcc

SEQ ID NO: 5563686 - DNA, 15 bp, Homo sapiens
agcgcggccctcccg

SEQ ID NO: 5563687 - DNA, 19 bp, Homo sapiens
agcgcggcttggccgccat

SEQ ID NO: 5563688 - DNA, 16 bp, Homo sapiens
agcgcgggagagagtg

SEQ ID NO: 5563689 - DNA, 12 bp, Homo sapiens
agcgcgggcgga

SEQ ID NO: 5563690 - DNA, 15 bp, Homo sapiens
agcgcgtgccttccc

SEQ ID NO: 5563691 - DNA, 22 bp, Homo sapiens
agcgctcagaacagtatctttg

SEQ ID NO: 5563692 - DNA, 18 bp, Homo sapiens
agcgctcatgttgagcca

SEQ ID NO: 5563693 - DNA, 19 bp, Homo sapiens
agcgctcatgttgagccag

SEQ ID NO: 5563694 - DNA, 12 bp, Homo sapiens
agcgctcccagc

SEQ ID NO: 5563695 - DNA, 13 bp, Homo sapiens
agcgctcccagcc

SEQ ID NO: 5563696 - DNA, 12 bp, Homo sapiens
agcgctcctcct

SEQ ID NO: 5563697 - DNA, 18 bp, Homo sapiens
agcgctcctcctgtgtga

SEQ ID NO: 5563698 - DNA, 16 bp, Homo sapiens
agcgctcctctgcctt

SEQ ID NO: 5563699 - DNA, 17 bp, Homo sapiens
agcgctcctctgccttg

SEQ ID NO: 5563700 - DNA, 17 bp, Homo sapiens
agcgctcctgccgcaga

SEQ ID NO: 5563701 - DNA, 21 bp, Homo sapiens
agcgctcgccacgctcagtgc

SEQ ID NO: 5563702 - DNA, 16 bp, Homo sapiens
agcgctcggcccggag

SEQ ID NO: 5563703 - DNA, 23 bp, Homo sapiens
agcgctcggcccggagcagcagg

SEQ ID NO: 5563704 - DNA, 13 bp, Homo sapiens
agcgctctcctgg

SEQ ID NO: 5563705 - DNA, 17 bp, Homo sapiens
agcgctctcctggacgc

SEQ ID NO: 5563706 - DNA, 12 bp, Homo sapiens
agcgctctgcct

SEQ ID NO: 5563707 - DNA, 12 bp, Homo sapiens
agcgctctggac

SEQ ID NO: 5563708 - DNA, 16 bp, Homo sapiens
agcgctctggacagat

SEQ ID NO: 5563709 - DNA, 14 bp, Homo sapiens
agcgctctggtgct

SEQ ID NO: 5563710 - DNA, 22 bp, Homo sapiens
agcgctgacgtgtcaggaaaac

SEQ ID NO: 5563711 - DNA, 11 bp, Homo sapiens
agcgctgccca

SEQ ID NO: 5563712 - DNA, 13 bp, Homo sapiens
agcgctgcccaca

SEQ ID NO: 5563713 - DNA, 18 bp, Homo sapiens
agcgctgcccacaccacc

SEQ ID NO: 5563714 - DNA, 13 bp, Homo sapiens
agcgctgccctgt

SEQ ID NO: 5563715 - DNA, 20 bp, Homo sapiens
agcgctgccctgtgagagcc

SEQ ID NO: 5563716 - DNA, 18 bp, Homo sapiens
agcgctgccgcaccccag

SEQ ID NO: 5563717 - DNA, 21 bp, Homo sapiens
agcgctgccgcaccccagagt

SEQ ID NO: 5563718 - DNA, 22 bp, Homo sapiens
agcgctggccgggaccccgagc

SEQ ID NO: 5563719 - DNA, 18 bp, Homo sapiens
agcgctggcgagatacca

SEQ ID NO: 5563720 - DNA, 15 bp, Homo sapiens
agcgctggctcagga

SEQ ID NO: 5563721 - DNA, 22 bp, Homo sapiens
agcgctggtcccctccctctgt

SEQ ID NO: 5563722 - DNA, 20 bp, Homo sapiens
agcgctgtggactgtcctga

SEQ ID NO: 5563723 - DNA, 16 bp, Homo sapiens
agcgctgttgcccgcc

SEQ ID NO: 5563724 - DNA, 19 bp, Homo sapiens
agcgctgttgcccgccctc

SEQ ID NO: 5563725 - DNA, 20 bp, Homo sapiens
agcgctgttgcccgccctcc

SEQ ID NO: 5563726 - DNA, 19 bp, Homo sapiens
agcgcttaaaaaaacaaat

SEQ ID NO: 5563727 - DNA, 13 bp, Homo sapiens
agcgcttagaaac

SEQ ID NO: 5563728 - DNA, 17 bp, Homo sapiens
agcgcttagaaacatgt

SEQ ID NO: 5563729 - DNA, 21 bp, Homo sapiens
agcgcttctgcagcctcggcc

SEQ ID NO: 5563730 - DNA, 21 bp, Homo sapiens
agcgctttgggaggccgaggc

SEQ ID NO: 5563731 - DNA, 22 bp, Homo sapiens
agcggaaaaggttttattttgt

SEQ ID NO: 5563732 - DNA, 16 bp, Homo sapiens
agcggaaaagttgtct

SEQ ID NO: 5563733 - DNA, 15 bp, Homo sapiens
agcggaaacaggtgt

SEQ ID NO: 5563734 - DNA, 14 bp, Homo sapiens
agcggaaagcagct

SEQ ID NO: 5563735 - DNA, 19 bp, Homo sapiens
agcggaagggactctgggc

SEQ ID NO: 5563736 - DNA, 20 bp, Homo sapiens
agcggaagggactctgggct

SEQ ID NO: 5563737 - DNA, 12 bp, Homo sapiens
agcggaataaac

SEQ ID NO: 5563738 - DNA, 14 bp, Homo sapiens
agcggaataaacta

SEQ ID NO: 5563739 - DNA, 16 bp, Homo sapiens
agcggacagtggcagg

SEQ ID NO: 5563740 - DNA, 20 bp, Homo sapiens
agcggacagtggcaggacag

SEQ ID NO: 5563741 - DNA, 19 bp, Homo sapiens
agcggacatcagctggtca

SEQ ID NO: 5563742 - DNA, 20 bp, Homo sapiens
agcggactcctcctttctcc

SEQ ID NO: 5563743 - DNA, 20 bp, Homo sapiens
agcggagaaaggaagggctg

SEQ ID NO: 5563744 - DNA, 17 bp, Homo sapiens
agcggagagagccaaga

SEQ ID NO: 5563745 - DNA, 19 bp, Homo sapiens
agcggagagagccaagacg

SEQ ID NO: 5563746 - DNA, 15 bp, Homo sapiens
agcggagaggacccc

SEQ ID NO: 5563747 - DNA, 21 bp, Homo sapiens
agcggagagggctagccctga

SEQ ID NO: 5563748 - DNA, 22 bp, Homo sapiens
agcggagagggctagccctgag

SEQ ID NO: 5563749 - DNA, 13 bp, Homo sapiens
agcggagcccagc

SEQ ID NO: 5563750 - DNA, 18 bp, Homo sapiens
agcggagcccagcctggg

SEQ ID NO: 5563751 - DNA, 21 bp, Homo sapiens
agcggagcccgatattctccc

SEQ ID NO: 5563752 - DNA, 13 bp, Homo sapiens
agcggagcttgcc

SEQ ID NO: 5563753 - DNA, 16 bp, Homo sapiens
agcggagcttgcctgc

SEQ ID NO: 5563754 - DNA, 14 bp, Homo sapiens
agcggagcttggcc

SEQ ID NO: 5563755 - DNA, 17 bp, Homo sapiens
agcggagcttggccctg

SEQ ID NO: 5563756 - DNA, 18 bp, Homo sapiens
agcggaggagaccagctc

SEQ ID NO: 5563757 - DNA, 20 bp, Homo sapiens
agcggaggagaccagctcag

SEQ ID NO: 5563758 - DNA, 14 bp, Homo sapiens
agcggaggaggaag

SEQ ID NO: 5563759 - DNA, 16 bp, Homo sapiens
agcggaggctgtgtgc

SEQ ID NO: 5563760 - DNA, 22 bp, Homo sapiens
agcggaggggtttgggagtcag

SEQ ID NO: 5563761 - DNA, 14 bp, Homo sapiens
agcggaggtgtgga

SEQ ID NO: 5563762 - DNA, 22 bp, Homo sapiens
agcggaggttgcagtgagctga

SEQ ID NO: 5563763 - DNA, 16 bp, Homo sapiens
agcggattgctctgga

SEQ ID NO: 5563764 - DNA, 22 bp, Homo sapiens
agcggattgctctggagcagcc

SEQ ID NO: 5563765 - DNA, 14 bp, Homo sapiens
agcggcaccctggt

SEQ ID NO: 5563766 - DNA, 18 bp, Homo sapiens
agcggcaccctggtctgt

SEQ ID NO: 5563767 - DNA, 13 bp, Homo sapiens
agcggcagagcaa

SEQ ID NO: 5563768 - DNA, 22 bp, Homo sapiens
agcggcagagcaattccaggct

SEQ ID NO: 5563769 - DNA, 20 bp, Homo sapiens
agcggcagtgggcctgctga

SEQ ID NO: 5563770 - DNA, 21 bp, Homo sapiens
agcggcagtgggcctgctgag

SEQ ID NO: 5563771 - DNA, 15 bp, Homo sapiens
agcggcatagcaccc

SEQ ID NO: 5563772 - DNA, 13 bp, Homo sapiens
agcggcatcaggc

SEQ ID NO: 5563773 - DNA, 14 bp, Homo sapiens
agcggccaggcggg

SEQ ID NO: 5563774 - DNA, 15 bp, Homo sapiens
agcggcccaagagcc

SEQ ID NO: 5563775 - DNA, 20 bp, Homo sapiens
agcggccccccgcacagcca

SEQ ID NO: 5563776 - DNA, 18 bp, Homo sapiens
agcggccccgcacccctc

SEQ ID NO: 5563777 - DNA, 22 bp, Homo sapiens
agcggccccgcacccctcctcc

SEQ ID NO: 5563778 - DNA, 23 bp, Homo sapiens
agcggccccgcacccctcctcct

SEQ ID NO: 5563779 - DNA, 20 bp, Homo sapiens
agcggccccgcggagccccc

SEQ ID NO: 5563780 - DNA, 12 bp, Homo sapiens
agcggcccctcc

SEQ ID NO: 5563781 - DNA, 13 bp, Homo sapiens
agcggcccctccc

SEQ ID NO: 5563782 - DNA, 21 bp, Homo sapiens
agcggcccggcccacgcagag

SEQ ID NO: 5563783 - DNA, 17 bp, Homo sapiens
agcggccctaagggagt

SEQ ID NO: 5563784 - DNA, 15 bp, Homo sapiens
agcggccctggagga

SEQ ID NO: 5563785 - DNA, 18 bp, Homo sapiens
agcggccctgtcatccag

SEQ ID NO: 5563786 - DNA, 18 bp, Homo sapiens
agcggccgcctgtccttg

SEQ ID NO: 5563787 - DNA, 14 bp, Homo sapiens
agcggcctcagggt

SEQ ID NO: 5563788 - DNA, 12 bp, Homo sapiens
agcggcgcagag

SEQ ID NO: 5563789 - DNA, 16 bp, Homo sapiens
agcggcgccctggact

SEQ ID NO: 5563790 - DNA, 17 bp, Homo sapiens
agcggcgccctggactt

SEQ ID NO: 5563791 - DNA, 21 bp, Homo sapiens
agcggcgccctggacttggta

SEQ ID NO: 5563792 - DNA, 15 bp, Homo sapiens
agcggctcaagaata

SEQ ID NO: 5563793 - DNA, 13 bp, Homo sapiens
agcggctctcctg

SEQ ID NO: 5563794 - DNA, 14 bp, Homo sapiens
agcggctctcctga

SEQ ID NO: 5563795 - DNA, 15 bp, Homo sapiens
agcggctcttcctgg

SEQ ID NO: 5563796 - DNA, 15 bp, Homo sapiens
agcggctgaggacgg

SEQ ID NO: 5563797 - DNA, 19 bp, Homo sapiens
agcggctgagtcatgatct

SEQ ID NO: 5563798 - DNA, 20 bp, Homo sapiens
agcggctgggtggtgaagga

SEQ ID NO: 5563799 - DNA, 17 bp, Homo sapiens
agcggctggtgcagggc

SEQ ID NO: 5563800 - DNA, 16 bp, Homo sapiens
agcggctgttccccct

SEQ ID NO: 5563801 - DNA, 18 bp, Homo sapiens
agcggctgtttactgctt

SEQ ID NO: 5563802 - DNA, 22 bp, Homo sapiens
agcggcttccccattgccttct

SEQ ID NO: 5563803 - DNA, 20 bp, Homo sapiens
agcggcttgcctgcctgctc

SEQ ID NO: 5563804 - DNA, 14 bp, Homo sapiens
agcgggaaaaggag

SEQ ID NO: 5563805 - DNA, 15 bp, Homo sapiens
agcgggacaaagcct

SEQ ID NO: 5563806 - DNA, 16 bp, Homo sapiens
agcgggacctgtggct

SEQ ID NO: 5563807 - DNA, 15 bp, Homo sapiens
agcgggaggcagagt

SEQ ID NO: 5563808 - DNA, 21 bp, Homo sapiens
agcgggaggcagagtttgcct

SEQ ID NO: 5563809 - DNA, 22 bp, Homo sapiens
agcgggagggagtctcaggagg

SEQ ID NO: 5563810 - DNA, 22 bp, Homo sapiens
agcgggatcccagcatctcaga

SEQ ID NO: 5563811 - DNA, 12 bp, Homo sapiens
agcgggcacagg

SEQ ID NO: 5563812 - DNA, 15 bp, Homo sapiens
agcgggcacagggca

SEQ ID NO: 5563813 - DNA, 23 bp, Homo sapiens
agcgggcacagggcaccagaggc

SEQ ID NO: 5563814 - DNA, 11 bp, Homo sapiens
agcgggcagcc

SEQ ID NO: 5563815 - DNA, 12 bp, Homo sapiens
agcgggcagccc

SEQ ID NO: 5563816 - DNA, 12 bp, Homo sapiens
agcgggccaggc

SEQ ID NO: 5563817 - DNA, 16 bp, Homo sapiens
agcgggccaggcccgc

SEQ ID NO: 5563818 - DNA, 13 bp, Homo sapiens
agcgggcccagca

SEQ ID NO: 5563819 - DNA, 22 bp, Homo sapiens
agctaagatagaaagctggact

SEQ ID NO: 5563820 - DNA, 22 bp, Homo sapiens
agctaagatgtggtgcttttct

SEQ ID NO: 5563821 - DNA, 15 bp, Homo sapiens
agctaagcctgatga

SEQ ID NO: 5563822 - DNA, 18 bp, Homo sapiens
agctaagctcaaatgtat

SEQ ID NO: 5563823 - DNA, 16 bp, Homo sapiens
agctaaggaagacaca

SEQ ID NO: 5563824 - DNA, 19 bp, Homo sapiens
agctaaggccaatgggcta

SEQ ID NO: 5563825 - DNA, 16 bp, Homo sapiens
agctaaggccagctag

SEQ ID NO: 5563826 - DNA, 15 bp, Homo sapiens
agctaaggctctatg

SEQ ID NO: 5563827 - DNA, 20 bp, Homo sapiens
agctaaggctctatgagtct

SEQ ID NO: 5563828 - DNA, 18 bp, Homo sapiens
agctaagggaagacattt

SEQ ID NO: 5563829 - DNA, 21 bp, Homo sapiens
agctaagggtgggtgctcaga

SEQ ID NO: 5563830 - DNA, 22 bp, Homo sapiens
agctaaggtctataaacatgaa

SEQ ID NO: 5563831 - DNA, 23 bp, Homo sapiens
agctaaggtctataaacatgaag

SEQ ID NO: 5563832 - DNA, 15 bp, Homo sapiens
agctaagtaaaaata

SEQ ID NO: 5563833 - DNA, 13 bp, Homo sapiens
agctaagtagaaa

SEQ ID NO: 5563834 - DNA, 18 bp, Homo sapiens
agctaataaaaagctttt

SEQ ID NO: 5563835 - DNA, 24 bp, Homo sapiens
agctaataaaagtcagagctcagg

SEQ ID NO: 5563836 - DNA, 14 bp, Homo sapiens
agctaataaaatat

SEQ ID NO: 5563837 - DNA, 15 bp, Homo sapiens
agctaataaaatatc

SEQ ID NO: 5563838 - DNA, 17 bp, Homo sapiens
agctaataaaatatcat

SEQ ID NO: 5563839 - DNA, 20 bp, Homo sapiens
agctaataaaatatcattca

SEQ ID NO: 5563840 - DNA, 13 bp, Homo sapiens
agctaataaacca

SEQ ID NO: 5563841 - DNA, 12 bp, Homo sapiens
agctaataaatc

SEQ ID NO: 5563842 - DNA, 16 bp, Homo sapiens
agctaataactgatct

SEQ ID NO: 5563843 - DNA, 21 bp, Homo sapiens
agctaataataaatgcataga

SEQ ID NO: 5563844 - DNA, 16 bp, Homo sapiens
agctaataattcttca

SEQ ID NO: 5563845 - DNA, 16 bp, Homo sapiens
agctaatcagcattct

SEQ ID NO: 5563846 - DNA, 21 bp, Homo sapiens
agctaatcagcattctcactc

SEQ ID NO: 5563847 - DNA, 14 bp, Homo sapiens
agctaatctgcctg

SEQ ID NO: 5563848 - DNA, 22 bp, Homo sapiens
agctaatctgcctggttttatt

SEQ ID NO: 5563849 - DNA, 20 bp, Homo sapiens
agctaatctgtagggctgga

SEQ ID NO: 5563850 - DNA, 22 bp, Homo sapiens
agctaatgaactctttcaaatt

SEQ ID NO: 5563851 - DNA, 16 bp, Homo sapiens
agctaatggaaaatga

SEQ ID NO: 5563852 - DNA, 17 bp, Homo sapiens
agctaattaggaagctt

SEQ ID NO: 5563853 - DNA, 12 bp, Homo sapiens
agctaattattt

SEQ ID NO: 5563854 - DNA, 15 bp, Homo sapiens
agctaattattttaa

SEQ ID NO: 5563855 - DNA, 21 bp, Homo sapiens
agctaattattttaattaggt

SEQ ID NO: 5563856 - DNA, 15 bp, Homo sapiens
agctaattgggagtc

SEQ ID NO: 5563857 - DNA, 13 bp, Homo sapiens
agctaatttgcat

SEQ ID NO: 5563858 - DNA, 15 bp, Homo sapiens
agctaatttttgtat

SEQ ID NO: 5563859 - DNA, 18 bp, Homo sapiens
agctacaaaaaactgcag

SEQ ID NO: 5563860 - DNA, 22 bp, Homo sapiens
agctacaaagcatgggaaaaag

SEQ ID NO: 5563861 - DNA, 23 bp, Homo sapiens
agctacaaccctaccctggcagg

SEQ ID NO: 5563862 - DNA, 15 bp, Homo sapiens
agctacaagggaagc

SEQ ID NO: 5563863 - DNA, 18 bp, Homo sapiens
agctacaatattctctct

SEQ ID NO: 5563864 - DNA, 19 bp, Homo sapiens
agctacaattgtaaactag

SEQ ID NO: 5563865 - DNA, 13 bp, Homo sapiens
agctacaatttgt

SEQ ID NO: 5563866 - DNA, 22 bp, Homo sapiens
agctacacctttctcctttgta

SEQ ID NO: 5563867 - DNA, 19 bp, Homo sapiens
agctacactcgccttctgc

SEQ ID NO: 5563868 - DNA, 17 bp, Homo sapiens
agctacagagaaaccag

SEQ ID NO: 5563869 - DNA, 18 bp, Homo sapiens
agctacagagaaaccagc

SEQ ID NO: 5563870 - DNA, 21 bp, Homo sapiens
agctacagagaaaccagcttc

SEQ ID NO: 5563871 - DNA, 14 bp, Homo sapiens
agctacagccagcg

SEQ ID NO: 5563872 - DNA, 19 bp, Homo sapiens
agctacagcctctttccta

SEQ ID NO: 5563873 - DNA, 16 bp, Homo sapiens
agctacagcttgttta

SEQ ID NO: 5563874 - DNA, 18 bp, Homo sapiens
agctacagcttgtttaac

SEQ ID NO: 5563875 - DNA, 12 bp, Homo sapiens
agctacaggact

SEQ ID NO: 5563876 - DNA, 13 bp, Homo sapiens
agctacaggcttg

SEQ ID NO: 5563877 - DNA, 20 bp, Homo sapiens
agctacaggttacaacagat

SEQ ID NO: 5563878 - DNA, 17 bp, Homo sapiens
agctacaggttgtgaaa

SEQ ID NO: 5563879 - DNA, 13 bp, Homo sapiens
agctacagttgtc

SEQ ID NO: 5563880 - DNA, 17 bp, Homo sapiens
agctacatagcagactt

SEQ ID NO: 5563881 - DNA, 16 bp, Homo sapiens
agctacatctacttaa

SEQ ID NO: 5563882 - DNA, 19 bp, Homo sapiens
agctacatgggaggctgag

SEQ ID NO: 5563883 - DNA, 17 bp, Homo sapiens
agctacattcctcagct

SEQ ID NO: 5563884 - DNA, 18 bp, Homo sapiens
agctacattcctcagctg

SEQ ID NO: 5563885 - DNA, 18 bp, Homo sapiens
agctacattttcagaagt

SEQ ID NO: 5563886 - DNA, 18 bp, Homo sapiens
agctaccaactaagttgt

SEQ ID NO: 5563887 - DNA, 14 bp, Homo sapiens
agctaccaggaaga

SEQ ID NO: 5563888 - DNA, 15 bp, Homo sapiens
agctaccaggaagag

SEQ ID NO: 5563889 - DNA, 16 bp, Homo sapiens
agctaccaggaagagg

SEQ ID NO: 5563890 - DNA, 17 bp, Homo sapiens
agctacccaaaagagaa

SEQ ID NO: 5563891 - DNA, 19 bp, Homo sapiens
agctacccaaaagagaaaa

SEQ ID NO: 5563892 - DNA, 22 bp, Homo sapiens
agctacccaggaggctgaggca

SEQ ID NO: 5563893 - DNA, 21 bp, Homo sapiens
agctacccctgcagctgggga

SEQ ID NO: 5563894 - DNA, 14 bp, Homo sapiens
agctaccctcagcc

SEQ ID NO: 5563895 - DNA, 22 bp, Homo sapiens
agctacccttttcctttgtggt

SEQ ID NO: 5563896 - DNA, 12 bp, Homo sapiens
agctacctgaga

SEQ ID NO: 5563897 - DNA, 15 bp, Homo sapiens
agctacctggggtgg

SEQ ID NO: 5563898 - DNA, 22 bp, Homo sapiens
agctacctgtgtggacaggact

SEQ ID NO: 5563899 - DNA, 23 bp, Homo sapiens
agctacgaaaggatgagcagagc

SEQ ID NO: 5563900 - DNA, 16 bp, Homo sapiens
agctacgtatttaata

SEQ ID NO: 5563901 - DNA, 15 bp, Homo sapiens
agctacgtttactca

SEQ ID NO: 5563902 - DNA, 21 bp, Homo sapiens
agctactaacctggagacagt

SEQ ID NO: 5563903 - DNA, 16 bp, Homo sapiens
agctactaatgatgtt

SEQ ID NO: 5563904 - DNA, 22 bp, Homo sapiens
agctactatatgcataaacaac

SEQ ID NO: 5563905 - DNA, 22 bp, Homo sapiens
agctactcaagaggctgaggca

SEQ ID NO: 5563906 - DNA, 14 bp, Homo sapiens
agctactcagaaat

SEQ ID NO: 5563907 - DNA, 20 bp, Homo sapiens
agctactcagaagcctgagg

SEQ ID NO: 5563908 - DNA, 21 bp, Homo sapiens
agctactcaggaggctgaggc

SEQ ID NO: 5563909 - DNA, 16 bp, Homo sapiens
agctactcagtggggc

SEQ ID NO: 5563910 - DNA, 22 bp, Homo sapiens
agctactcccctttcttccaaa

SEQ ID NO: 5563911 - DNA, 19 bp, Homo sapiens
agctactcgatagcctgag

SEQ ID NO: 5563912 - DNA, 20 bp, Homo sapiens
agctactcgatagcctgagg

SEQ ID NO: 5563913 - DNA, 15 bp, Homo sapiens
agctactcgggaggc

SEQ ID NO: 5563914 - DNA, 22 bp, Homo sapiens
agctactcgggaggctgaggca

SEQ ID NO: 5563915 - DNA, 15 bp, Homo sapiens
agctactctagttct

SEQ ID NO: 5563916 - DNA, 18 bp, Homo sapiens
agctactctagttctgtt

SEQ ID NO: 5563917 - DNA, 23 bp, Homo sapiens
agctactctccccacgagggctg

SEQ ID NO: 5563918 - DNA, 12 bp, Homo sapiens
agctactctgtc

SEQ ID NO: 5563919 - DNA, 16 bp, Homo sapiens
agctactctgtccagg

SEQ ID NO: 5563920 - DNA, 19 bp, Homo sapiens
agctactctgtccaggcca

SEQ ID NO: 5563921 - DNA, 18 bp, Homo sapiens
agctactgaaccagccac

SEQ ID NO: 5563922 - DNA, 12 bp, Homo sapiens
agctactgaatt

SEQ ID NO: 5563923 - DNA, 14 bp, Homo sapiens
agctactgaattta

SEQ ID NO: 5563924 - DNA, 22 bp, Homo sapiens
agctactgagaacataaaatct

SEQ ID NO: 5563925 - DNA, 20 bp, Homo sapiens
agctactgatttcctttgga

SEQ ID NO: 5563926 - DNA, 18 bp, Homo sapiens
agctactgccatcctggc

SEQ ID NO: 5563927 - DNA, 18 bp, Homo sapiens
agctactgcggaaaagga

SEQ ID NO: 5563928 - DNA, 19 bp, Homo sapiens
agctactggaatggtgttt

SEQ ID NO: 5563929 - DNA, 14 bp, Homo sapiens
agctactggggagg

SEQ ID NO: 5563930 - DNA, 15 bp, Homo sapiens
agctactgtaacttt

SEQ ID NO: 5563931 - DNA, 16 bp, Homo sapiens
agctactgtaactttt

SEQ ID NO: 5563932 - DNA, 17 bp, Homo sapiens
agctactgtaacttttt

SEQ ID NO: 5563933 - DNA, 17 bp, Homo sapiens
agctactgtagaaagga

SEQ ID NO: 5563934 - DNA, 20 bp, Homo sapiens
agctactgtagaaaggaaat

SEQ ID NO: 5563935 - DNA, 16 bp, Homo sapiens
agctactgtatgcaaa

SEQ ID NO: 5563936 - DNA, 15 bp, Homo sapiens
agctactgtgtgtgt

SEQ ID NO: 5563937 - DNA, 17 bp, Homo sapiens
agctacttagctggcca

SEQ ID NO: 5563938 - DNA, 22 bp, Homo sapiens
agctacttgggaagctgaggcg

SEQ ID NO: 5563939 - DNA, 17 bp, Homo sapiens
agctacttgggagcctg

SEQ ID NO: 5563940 - DNA, 14 bp, Homo sapiens
agctacttgggagg

SEQ ID NO: 5563941 - DNA, 17 bp, Homo sapiens
agctacttggtttgtgt

SEQ ID NO: 5563942 - DNA, 15 bp, Homo sapiens
agctactttccattt

SEQ ID NO: 5563943 - DNA, 16 bp, Homo sapiens
agctactttccatttg

SEQ ID NO: 5563944 - DNA, 19 bp, Homo sapiens
agctagaaaaataaaatgt

SEQ ID NO: 5563945 - DNA, 17 bp, Homo sapiens
agctagaaaacattttt

SEQ ID NO: 5563946 - DNA, 17 bp, Homo sapiens
agctagaaacaatctat

SEQ ID NO: 5563947 - DNA, 11 bp, Homo sapiens
agctagaaagt

SEQ ID NO: 5563948 - DNA, 21 bp, Homo sapiens
agctagaacattccatttgct

SEQ ID NO: 5563949 - DNA, 16 bp, Homo sapiens
agctagaacccggcag

SEQ ID NO: 5563950 - DNA, 16 bp, Homo sapiens
agctagaaccctctgt

SEQ ID NO: 5563951 - DNA, 16 bp, Homo sapiens
agctagaacctggaga

SEQ ID NO: 5563952 - DNA, 15 bp, Homo sapiens
agctagaagtgggcc

SEQ ID NO: 5563953 - DNA, 24 bp, Homo sapiens
agctagaagtgggccaggacaggc

SEQ ID NO: 5563954 - DNA, 20 bp, Homo sapiens
agctagaattgagtgtttaa

SEQ ID NO: 5563955 - DNA, 13 bp, Homo sapiens
agctagaatttga

SEQ ID NO: 5563956 - DNA, 16 bp, Homo sapiens
agctagaatttgatat

SEQ ID NO: 5563957 - DNA, 13 bp, Homo sapiens
agctagactggtg

SEQ ID NO: 5563958 - DNA, 14 bp, Homo sapiens
agctagactggtga

SEQ ID NO: 5563959 - DNA, 17 bp, Homo sapiens
agctagagaggggcctc

SEQ ID NO: 5563960 - DNA, 15 bp, Homo sapiens
agctagagcttccac

SEQ ID NO: 5563961 - DNA, 19 bp, Homo sapiens
agctagagcttccactgtc

SEQ ID NO: 5563962 - DNA, 15 bp, Homo sapiens
agctagatgcccctg

SEQ ID NO: 5563963 - DNA, 16 bp, Homo sapiens
agctagatgcccctgc

SEQ ID NO: 5563964 - DNA, 16 bp, Homo sapiens
agctagatgctttagg

SEQ ID NO: 5563965 - DNA, 23 bp, Homo sapiens
agctagcaaaaaaactcttgttt

SEQ ID NO: 5563966 - DNA, 19 bp, Homo sapiens
agctagcaaaagaagtaac

SEQ ID NO: 5563967 - DNA, 20 bp, Homo sapiens
agctagcaaaagaagtaaca

SEQ ID NO: 5563968 - DNA, 23 bp, Homo sapiens
agctagcaaaagaagtaacaaga

SEQ ID NO: 5563969 - DNA, 18 bp, Homo sapiens
agctagccaactcctcct

SEQ ID NO: 5563970 - DNA, 12 bp, Homo sapiens
agctagccagcc

SEQ ID NO: 5563971 - DNA, 23 bp, Homo sapiens
agctagcccagtccctggagctg

SEQ ID NO: 5563972 - DNA, 23 bp, Homo sapiens
agctagcctccagctttggggac

SEQ ID NO: 5563973 - DNA, 16 bp, Homo sapiens
agctagcctgaaggat

SEQ ID NO: 5563974 - DNA, 14 bp, Homo sapiens
agctagcgctgccg

SEQ ID NO: 5563975 - DNA, 20 bp, Homo sapiens
agctagcgctgccgcacccc

SEQ ID NO: 5563976 - DNA, 17 bp, Homo sapiens
agctagcgtgtgccagg

SEQ ID NO: 5563977 - DNA, 16 bp, Homo sapiens
agctagctatttctat

SEQ ID NO: 5563978 - DNA, 20 bp, Homo sapiens
agctagctcccctcctctcc

SEQ ID NO: 5563979 - DNA, 13 bp, Homo sapiens
agctagctgccac

SEQ ID NO: 5563980 - DNA, 14 bp, Homo sapiens
agctagctgccact

SEQ ID NO: 5563981 - DNA, 15 bp, Homo sapiens
agctagctgccactt

SEQ ID NO: 5563982 - DNA, 15 bp, Homo sapiens
agctagcttttagga

SEQ ID NO: 5563983 - DNA, 17 bp, Homo sapiens
agctaggaaaagaaatc

SEQ ID NO: 5563984 - DNA, 15 bp, Homo sapiens
agctaggaaaggcag

SEQ ID NO: 5563985 - DNA, 20 bp, Homo sapiens
agctaggaaccctggaggta

SEQ ID NO: 5563986 - DNA, 18 bp, Homo sapiens
agctaggaagagcaggac

SEQ ID NO: 5563987 - DNA, 21 bp, Homo sapiens
agctaggaagagcaggactcc

SEQ ID NO: 5563988 - DNA, 13 bp, Homo sapiens
agctaggactgag

SEQ ID NO: 5563989 - DNA, 22 bp, Homo sapiens
agctaggagaagggctgaaccc

SEQ ID NO: 5563990 - DNA, 18 bp, Homo sapiens
agctaggagcaaagcctg

SEQ ID NO: 5563991 - DNA, 17 bp, Homo sapiens
agctaggagcaggcttg

SEQ ID NO: 5563992 - DNA, 18 bp, Homo sapiens
agctaggagcaggcttgt

SEQ ID NO: 5563993 - DNA, 23 bp, Homo sapiens
agctaggagcaggcttgtggcag

SEQ ID NO: 5563994 - DNA, 21 bp, Homo sapiens
agctaggatggttctgtgacc

SEQ ID NO: 5563995 - DNA, 23 bp, Homo sapiens
agctaggatttgaacacttggtg

SEQ ID NO: 5563996 - DNA, 13 bp, Homo sapiens
agctcacactcat

SEQ ID NO: 5563997 - DNA, 14 bp, Homo sapiens
agctcacactcatc

SEQ ID NO: 5563998 - DNA, 19 bp, Homo sapiens
agctcacactccagtggca

SEQ ID NO: 5563999 - DNA, 22 bp, Homo sapiens
agctcacacttgggctggcacc

SEQ ID NO: 5564000 - DNA, 22 bp, Homo sapiens
agctcacagcacatttgttaat

SEQ ID NO: 5564001 - DNA, 20 bp, Homo sapiens
agctcacatccagccttgga

SEQ ID NO: 5564002 - DNA, 17 bp, Homo sapiens
agctcacatgggactgg

SEQ ID NO: 5564003 - DNA, 13 bp, Homo sapiens
agctcaccagccc

SEQ ID NO: 5564004 - DNA, 14 bp, Homo sapiens
agctcaccagcccc

SEQ ID NO: 5564005 - DNA, 19 bp, Homo sapiens
agctcaccagccccagtgc

SEQ ID NO: 5564006 - DNA, 20 bp, Homo sapiens
agctcaccagccccagtgcc

SEQ ID NO: 5564007 - DNA, 20 bp, Homo sapiens
agctcaccaggcctggcctc

SEQ ID NO: 5564008 - DNA, 22 bp, Homo sapiens
agctcaccaggcctggcctctg

SEQ ID NO: 5564009 - DNA, 14 bp, Homo sapiens
agctcacccaaggt

SEQ ID NO: 5564010 - DNA, 15 bp, Homo sapiens
agctcacccaaggtc

SEQ ID NO: 5564011 - DNA, 14 bp, Homo sapiens
agctcaccccccac

SEQ ID NO: 5564012 - DNA, 17 bp, Homo sapiens
agctcaccccccacact

SEQ ID NO: 5564013 - DNA, 13 bp, Homo sapiens
agctcacccctgg

SEQ ID NO: 5564014 - DNA, 19 bp, Homo sapiens
agctcaccctgcccgctcc

SEQ ID NO: 5564015 - DNA, 22 bp, Homo sapiens
agctcaccctgcccgctcccaa

SEQ ID NO: 5564016 - DNA, 15 bp, Homo sapiens
agctcaccctgctcc

SEQ ID NO: 5564017 - DNA, 18 bp, Homo sapiens
agctcacctgttgcttac

SEQ ID NO: 5564018 - DNA, 19 bp, Homo sapiens
agctcacctgttgcttaca

SEQ ID NO: 5564019 - DNA, 23 bp, Homo sapiens
agctcacctgttgcttacaattt

SEQ ID NO: 5564020 - DNA, 15 bp, Homo sapiens
agctcacgcttcaca

SEQ ID NO: 5564021 - DNA, 16 bp, Homo sapiens
agctcacgtcacactt

SEQ ID NO: 5564022 - DNA, 21 bp, Homo sapiens
agctcacgtcctgagaaagct

SEQ ID NO: 5564023 - DNA, 23 bp, Homo sapiens
agctcactgcaacctccgcatcc

SEQ ID NO: 5564024 - DNA, 22 bp, Homo sapiens
agctcactgcaagctctgcctc

SEQ ID NO: 5564025 - DNA, 17 bp, Homo sapiens
agctcactgcagcctca

SEQ ID NO: 5564026 - DNA, 18 bp, Homo sapiens
agctcactggtttacaaa

SEQ ID NO: 5564027 - DNA, 20 bp, Homo sapiens
agctcactggtttacaaata

SEQ ID NO: 5564028 - DNA, 23 bp, Homo sapiens
agctcactggtttacaaatatag

SEQ ID NO: 5564029 - DNA, 21 bp, Homo sapiens
agctcactgtgacctccgcct

SEQ ID NO: 5564030 - DNA, 17 bp, Homo sapiens
agctcacttcaagctca

SEQ ID NO: 5564031 - DNA, 13 bp, Homo sapiens
agctcacttctgg

SEQ ID NO: 5564032 - DNA, 18 bp, Homo sapiens
agctcagaaaatatccct

SEQ ID NO: 5564033 - DNA, 14 bp, Homo sapiens
agctcagaacccag

SEQ ID NO: 5564034 - DNA, 15 bp, Homo sapiens
agctcagaacccagg

SEQ ID NO: 5564035 - DNA, 16 bp, Homo sapiens
agctcagaacccaggg

SEQ ID NO: 5564036 - DNA, 15 bp, Homo sapiens
agctcagaaggctct

SEQ ID NO: 5564037 - DNA, 23 bp, Homo sapiens
agctcagaaggctcttctgacta

SEQ ID NO: 5564038 - DNA, 15 bp, Homo sapiens
agctcagacccccac

SEQ ID NO: 5564039 - DNA, 17 bp, Homo sapiens
agctcagacccccactc

SEQ ID NO: 5564040 - DNA, 20 bp, Homo sapiens
agctcagacccccactctca

SEQ ID NO: 5564041 - DNA, 12 bp, Homo sapiens
agctcagagagg

SEQ ID NO: 5564042 - DNA, 16 bp, Homo sapiens
agctcagagagggcag

SEQ ID NO: 5564043 - DNA, 22 bp, Homo sapiens
agctcagagcagcctctgtcct

SEQ ID NO: 5564044 - DNA, 17 bp, Homo sapiens
agctcagaggagtctgg

SEQ ID NO: 5564045 - DNA, 19 bp, Homo sapiens
agctcagaggagtctggga

SEQ ID NO: 5564046 - DNA, 15 bp, Homo sapiens
agctcagaggcccag

SEQ ID NO: 5564047 - DNA, 19 bp, Homo sapiens
agctcagaggcgcactgtg

SEQ ID NO: 5564048 - DNA, 24 bp, Homo sapiens
agctcagcagacatccacacacag

SEQ ID NO: 5564049 - DNA, 21 bp, Homo sapiens
agctcagcagttcacttccta

SEQ ID NO: 5564050 - DNA, 19 bp, Homo sapiens
agctcagccaccactcagt

SEQ ID NO: 5564051 - DNA, 21 bp, Homo sapiens
agctcagcccacccccctcat

SEQ ID NO: 5564052 - DNA, 13 bp, Homo sapiens
agctcagccctgg

SEQ ID NO: 5564053 - DNA, 19 bp, Homo sapiens
agctcagccctggcctggc

SEQ ID NO: 5564054 - DNA, 22 bp, Homo sapiens
agctcagccctggcctggctgg

SEQ ID NO: 5564055 - DNA, 16 bp, Homo sapiens
agctcagcctcccccc

SEQ ID NO: 5564056 - DNA, 22 bp, Homo sapiens
agctcagcctccccctgctgct

SEQ ID NO: 5564057 - DNA, 13 bp, Homo sapiens
agctcagcctgcc

SEQ ID NO: 5564058 - DNA, 13 bp, Homo sapiens
agctcagccttct

SEQ ID NO: 5564059 - DNA, 11 bp, Homo sapiens
agctcagctca

SEQ ID NO: 5564060 - DNA, 13 bp, Homo sapiens
agctcagctgcat

SEQ ID NO: 5564061 - DNA, 23 bp, Homo sapiens
agctcagctgcattccgcagccc

SEQ ID NO: 5564062 - DNA, 14 bp, Homo sapiens
agctcagctgccca

SEQ ID NO: 5564063 - DNA, 16 bp, Homo sapiens
agctcagctgcccatc

SEQ ID NO: 5564064 - DNA, 22 bp, Homo sapiens
agctcagctgcccatcccagtc

SEQ ID NO: 5564065 - DNA, 15 bp, Homo sapiens
agctcagctgggcca

SEQ ID NO: 5564066 - DNA, 19 bp, Homo sapiens
agctcagctgggccactcc

SEQ ID NO: 5564067 - DNA, 21 bp, Homo sapiens
agctcagctgggccactcctc

SEQ ID NO: 5564068 - DNA, 13 bp, Homo sapiens
agctcagcttcct

SEQ ID NO: 5564069 - DNA, 17 bp, Homo sapiens
agctcagcttcttccta

SEQ ID NO: 5564070 - DNA, 21 bp, Homo sapiens
agctcagcttcttcctaggtc

SEQ ID NO: 5564071 - DNA, 22 bp, Homo sapiens
agctcaggaaccgaggcaggga

SEQ ID NO: 5564072 - DNA, 17 bp, Homo sapiens
agctcaggaagaagaga

SEQ ID NO: 5564073 - DNA, 18 bp, Homo sapiens
agctcaggaattccctgg

SEQ ID NO: 5564074 - DNA, 14 bp, Homo sapiens
agctcaggaccagg

SEQ ID NO: 5564075 - DNA, 15 bp, Homo sapiens
agctcaggagaaggc

SEQ ID NO: 5564076 - DNA, 22 bp, Homo sapiens
agctcaggagaaggcctgcccc

SEQ ID NO: 5564077 - DNA, 17 bp, Homo sapiens
agctcaggaggcgccct

SEQ ID NO: 5564078 - DNA, 23 bp, Homo sapiens
agctcaggagggtgacgcccagc

SEQ ID NO: 5564079 - DNA, 16 bp, Homo sapiens
agctcaggatatggct

SEQ ID NO: 5564080 - DNA, 18 bp, Homo sapiens
agctcaggatgagggaaa

SEQ ID NO: 5564081 - DNA, 14 bp, Homo sapiens
agctcaggcgcagc

SEQ ID NO: 5564082 - DNA, 15 bp, Homo sapiens
agctcaggcgcagcc

SEQ ID NO: 5564083 - DNA, 16 bp, Homo sapiens
agctcaggcgcagccc

SEQ ID NO: 5564084 - DNA, 13 bp, Homo sapiens
agctcaggctgag

SEQ ID NO: 5564085 - DNA, 14 bp, Homo sapiens
agctcaggctgagc

SEQ ID NO: 5564086 - DNA, 16 bp, Homo sapiens
agctcagggcctggct

SEQ ID NO: 5564087 - DNA, 14 bp, Homo sapiens
agctcagggctgga

SEQ ID NO: 5564088 - DNA, 16 bp, Homo sapiens
agctcagggctggatt

SEQ ID NO: 5564089 - DNA, 21 bp, Homo sapiens
agctcagggctggattggcag

SEQ ID NO: 5564090 - DNA, 22 bp, Homo sapiens
agctcagggctggattggcagg

SEQ ID NO: 5564091 - DNA, 18 bp, Homo sapiens
agctcaggggacactggc

SEQ ID NO: 5564092 - DNA, 23 bp, Homo sapiens
agctcaggggacactggccccac

SEQ ID NO: 5564093 - DNA, 16 bp, Homo sapiens
agctcaggtcctgctg

SEQ ID NO: 5564094 - DNA, 10 bp, Homo sapiens
agctcaggtg

SEQ ID NO: 5564095 - DNA, 15 bp, Homo sapiens
agctcaggtgcctta

SEQ ID NO: 5564096 - DNA, 16 bp, Homo sapiens
agctcaggtgggcgtg

SEQ ID NO: 5564097 - DNA, 21 bp, Homo sapiens
agctcaggtgtccctgcactt

SEQ ID NO: 5564098 - DNA, 12 bp, Homo sapiens
agctcaggttcc

SEQ ID NO: 5564099 - DNA, 19 bp, Homo sapiens
agctcaggttccctgccac

SEQ ID NO: 5564100 - DNA, 18 bp, Homo sapiens
agctcaggtttctggaca

SEQ ID NO: 5564101 - DNA, 22 bp, Homo sapiens
agctcaggtttgtcctggtcat

SEQ ID NO: 5564102 - DNA, 20 bp, Homo sapiens
agctcagtaacataactgct

SEQ ID NO: 5564103 - DNA, 22 bp, Homo sapiens
agctcagtaacataactgcttc

SEQ ID NO: 5564104 - DNA, 14 bp, Homo sapiens
agctcagtacaggg

SEQ ID NO: 5564105 - DNA, 11 bp, Homo sapiens
agctcagtcat

SEQ ID NO: 5564106 - DNA, 14 bp, Homo sapiens
agctcagtcccaca

SEQ ID NO: 5564107 - DNA, 13 bp, Homo sapiens
agctcagtcccat

SEQ ID NO: 5564108 - DNA, 21 bp, Homo sapiens
agctcagtcttccctagggct

SEQ ID NO: 5564109 - DNA, 19 bp, Homo sapiens
agctcagtgatacctcctt

SEQ ID NO: 5564110 - DNA, 15 bp, Homo sapiens
agctcagtgccaaag

SEQ ID NO: 5564111 - DNA, 17 bp, Homo sapiens
agctcagtgctctctcc

SEQ ID NO: 5564112 - DNA, 18 bp, Homo sapiens
agctcagtgctctctcca

SEQ ID NO: 5564113 - DNA, 20 bp, Homo sapiens
agctcagtgctctctccact

SEQ ID NO: 5564114 - DNA, 21 bp, Homo sapiens
agctcagttctagtctctctg

SEQ ID NO: 5564115 - DNA, 22 bp, Homo sapiens
agctcagttctagtctctctgg

SEQ ID NO: 5564116 - DNA, 21 bp, Homo sapiens
agctcagttgagaaacagttc

SEQ ID NO: 5564117 - DNA, 17 bp, Homo sapiens
agctcagtttggctgta

SEQ ID NO: 5564118 - DNA, 14 bp, Homo sapiens
agctcataaaatgg

SEQ ID NO: 5564119 - DNA, 20 bp, Homo sapiens
agctcatagagtcccccctc

SEQ ID NO: 5564120 - DNA, 16 bp, Homo sapiens
agctcatagcacatgt

SEQ ID NO: 5564121 - DNA, 17 bp, Homo sapiens
agctcatagcacatgtt

SEQ ID NO: 5564122 - DNA, 23 bp, Homo sapiens
agctcatagcacatgttttacaa

SEQ ID NO: 5564123 - DNA, 15 bp, Homo sapiens
agctcatattttgta

SEQ ID NO: 5564124 - DNA, 16 bp, Homo sapiens
agctcatcactgtgcc

SEQ ID NO: 5564125 - DNA, 16 bp, Homo sapiens
agctcatcccccctgc

SEQ ID NO: 5564126 - DNA, 17 bp, Homo sapiens
agctcatcccccctgct

SEQ ID NO: 5564127 - DNA, 20 bp, Homo sapiens
agctcatcccccctgctgcc

SEQ ID NO: 5564128 - DNA, 21 bp, Homo sapiens
agctcatcccccctgctgccc

SEQ ID NO: 5564129 - DNA, 22 bp, Homo sapiens
agctcatcccccctgctgccca

SEQ ID NO: 5564130 - DNA, 23 bp, Homo sapiens
agctcatcccccctgctgcccag

SEQ ID NO: 5564131 - DNA, 14 bp, Homo sapiens
agctcatccctgga

SEQ ID NO: 5564132 - DNA, 18 bp, Homo sapiens
agctcatcttttcctgct

SEQ ID NO: 5564133 - DNA, 21 bp, Homo sapiens
agctcatgtaggtgagcctgg

SEQ ID NO: 5564134 - DNA, 23 bp, Homo sapiens
agctcatgtcattatgacatttc

SEQ ID NO: 5564135 - DNA, 18 bp, Homo sapiens
agctcattaaactttttt

SEQ ID NO: 5564136 - DNA, 19 bp, Homo sapiens
agctcattatgaaaaacat

SEQ ID NO: 5564137 - DNA, 14 bp, Homo sapiens
agctcattcccaac

SEQ ID NO: 5564138 - DNA, 23 bp, Homo sapiens
agctcattcccaacgtgcaaagc

SEQ ID NO: 5564139 - DNA, 20 bp, Homo sapiens
agctcatttaatcccaggaa

SEQ ID NO: 5564140 - DNA, 15 bp, Homo sapiens
agctcatttcacttt

SEQ ID NO: 5564141 - DNA, 17 bp, Homo sapiens
agctcatttcatgctct

SEQ ID NO: 5564142 - DNA, 21 bp, Homo sapiens
agctcatttggggaccacaga

SEQ ID NO: 5564143 - DNA, 15 bp, Homo sapiens
agctccaacagcttg

SEQ ID NO: 5564144 - DNA, 19 bp, Homo sapiens
agctccaacagcttgacca

SEQ ID NO: 5564145 - DNA, 15 bp, Homo sapiens
agctccaacctgcaa

SEQ ID NO: 5564146 - DNA, 16 bp, Homo sapiens
agctccaacctgcaaa

SEQ ID NO: 5564147 - DNA, 22 bp, Homo sapiens
agctccaacctgcaaagatctg

SEQ ID NO: 5564148 - DNA, 13 bp, Homo sapiens
agctccaactccc

SEQ ID NO: 5564149 - DNA, 22 bp, Homo sapiens
agctccaagacctgttggttcc

SEQ ID NO: 5564150 - DNA, 23 bp, Homo sapiens
agctccaagacctgttggttcca

SEQ ID NO: 5564151 - DNA, 19 bp, Homo sapiens
agctccaagctcccaggca

SEQ ID NO: 5564152 - DNA, 13 bp, Homo sapiens
agctccaagctgt

SEQ ID NO: 5564153 - DNA, 16 bp, Homo sapiens
agctccaagctgttaa

SEQ ID NO: 5564154 - DNA, 20 bp, Homo sapiens
agctccaagctgttaaagat

SEQ ID NO: 5564155 - DNA, 19 bp, Homo sapiens
agctccacacattccagcc

SEQ ID NO: 5564156 - DNA, 22 bp, Homo sapiens
agctccacacattccagccagg

SEQ ID NO: 5564157 - DNA, 23 bp, Homo sapiens
agctccacacattccagccaggc

SEQ ID NO: 5564158 - DNA, 23 bp, Homo sapiens
agctccacaccctctcccaggac

SEQ ID NO: 5564159 - DNA, 14 bp, Homo sapiens
agctccacacgccc

SEQ ID NO: 5564160 - DNA, 13 bp, Homo sapiens
agctccaccactg

SEQ ID NO: 5564161 - DNA, 14 bp, Homo sapiens
agctccaccactgt

SEQ ID NO: 5564162 - DNA, 15 bp, Homo sapiens
agctccaccactgtg

SEQ ID NO: 5564163 - DNA, 16 bp, Homo sapiens
agctccaccactgtgc

SEQ ID NO: 5564164 - DNA, 14 bp, Homo sapiens
agctccaccctccc

SEQ ID NO: 5564165 - DNA, 15 bp, Homo sapiens
agctccaccctcccc

SEQ ID NO: 5564166 - DNA, 16 bp, Homo sapiens
agctccaccctcccct

SEQ ID NO: 5564167 - DNA, 12 bp, Homo sapiens
agctccacctct

SEQ ID NO: 5564168 - DNA, 21 bp, Homo sapiens
agctccacggtgcgtggctgt

SEQ ID NO: 5564169 - DNA, 14 bp, Homo sapiens
agctccactcaggg

SEQ ID NO: 5564170 - DNA, 20 bp, Homo sapiens
agctccactcagggctggcc

SEQ ID NO: 5564171 - DNA, 11 bp, Homo sapiens
agctccactct

SEQ ID NO: 5564172 - DNA, 12 bp, Homo sapiens
agctccactctg

SEQ ID NO: 5564173 - DNA, 19 bp, Homo sapiens
agctctgagatcctggagt

SEQ ID NO: 5564174 - DNA, 10 bp, Homo sapiens
agctctgagc

SEQ ID NO: 5564175 - DNA, 14 bp, Homo sapiens
agctctgagcagac

SEQ ID NO: 5564176 - DNA, 12 bp, Homo sapiens
agctctgagccg

SEQ ID NO: 5564177 - DNA, 12 bp, Homo sapiens
agctctgagctg

SEQ ID NO: 5564178 - DNA, 14 bp, Homo sapiens
agctctgagctgtc

SEQ ID NO: 5564179 - DNA, 15 bp, Homo sapiens
agctctgatgagaga

SEQ ID NO: 5564180 - DNA, 20 bp, Homo sapiens
agctctgcaggcttaataaa

SEQ ID NO: 5564181 - DNA, 19 bp, Homo sapiens
agctctgcatctcctgtct

SEQ ID NO: 5564182 - DNA, 12 bp, Homo sapiens
agctctgcatta

SEQ ID NO: 5564183 - DNA, 13 bp, Homo sapiens
agctctgcattat

SEQ ID NO: 5564184 - DNA, 19 bp, Homo sapiens
agctctgcccccgcgggtt

SEQ ID NO: 5564185 - DNA, 12 bp, Homo sapiens
agctctgccctg

SEQ ID NO: 5564186 - DNA, 13 bp, Homo sapiens
agctctgccctgg

SEQ ID NO: 5564187 - DNA, 18 bp, Homo sapiens
agctctgccgtctctgga

SEQ ID NO: 5564188 - DNA, 12 bp, Homo sapiens
agctctgcctca

SEQ ID NO: 5564189 - DNA, 19 bp, Homo sapiens
agctctgcctcaactccac

SEQ ID NO: 5564190 - DNA, 11 bp, Homo sapiens
agctctgcctt

SEQ ID NO: 5564191 - DNA, 21 bp, Homo sapiens
agctctgccttgcactgtggt

SEQ ID NO: 5564192 - DNA, 16 bp, Homo sapiens
agctctgcgccaggca

SEQ ID NO: 5564193 - DNA, 18 bp, Homo sapiens
agctctgcgccaggcaga

SEQ ID NO: 5564194 - DNA, 22 bp, Homo sapiens
agctctgcgccaggcagagctg

SEQ ID NO: 5564195 - DNA, 22 bp, Homo sapiens
agctctgcgtcggtcctggtgc

SEQ ID NO: 5564196 - DNA, 23 bp, Homo sapiens
agctctgctattaggccagcaag

SEQ ID NO: 5564197 - DNA, 12 bp, Homo sapiens
agctctgctcct

SEQ ID NO: 5564198 - DNA, 20 bp, Homo sapiens
agctctgctttatctgagtt

SEQ ID NO: 5564199 - DNA, 17 bp, Homo sapiens
agctctggaccagcctg

SEQ ID NO: 5564200 - DNA, 13 bp, Homo sapiens
agctctggagaac

SEQ ID NO: 5564201 - DNA, 14 bp, Homo sapiens
agctctggagccac

SEQ ID NO: 5564202 - DNA, 19 bp, Homo sapiens
agctctggagccacctgtc

SEQ ID NO: 5564203 - DNA, 20 bp, Homo sapiens
agctctggaggggaggggga

SEQ ID NO: 5564204 - DNA, 20 bp, Homo sapiens
agctctggaggtgctgctct

SEQ ID NO: 5564205 - DNA, 22 bp, Homo sapiens
agctctggaggtgctgctctag

SEQ ID NO: 5564206 - DNA, 23 bp, Homo sapiens
agctctggagtgagtctgtcata

SEQ ID NO: 5564207 - DNA, 18 bp, Homo sapiens
agctctggatgaaggcaa

SEQ ID NO: 5564208 - DNA, 18 bp, Homo sapiens
agctctggccccaggctt

SEQ ID NO: 5564209 - DNA, 15 bp, Homo sapiens
agctctggctcacag

SEQ ID NO: 5564210 - DNA, 20 bp, Homo sapiens
agctctggctctgcctcagg

SEQ ID NO: 5564211 - DNA, 21 bp, Homo sapiens
agctctggctctgcctcagga

SEQ ID NO: 5564212 - DNA, 18 bp, Homo sapiens
agctctggctgaaccctg

SEQ ID NO: 5564213 - DNA, 21 bp, Homo sapiens
agctctggctgaaccctgtgc

SEQ ID NO: 5564214 - DNA, 23 bp, Homo sapiens
agctctggctgaaccctgtgctg

SEQ ID NO: 5564215 - DNA, 12 bp, Homo sapiens
agctctggcttc

SEQ ID NO: 5564216 - DNA, 20 bp, Homo sapiens
agctctggcttccagaaaac

SEQ ID NO: 5564217 - DNA, 17 bp, Homo sapiens
agctctggcttcctgct

SEQ ID NO: 5564218 - DNA, 18 bp, Homo sapiens
agctctggcttcctgctg

SEQ ID NO: 5564219 - DNA, 21 bp, Homo sapiens
agctctgggaaatttaataca

SEQ ID NO: 5564220 - DNA, 18 bp, Homo sapiens
agctctggggacagcttc

SEQ ID NO: 5564221 - DNA, 23 bp, Homo sapiens
agctctggggacagcttcctcac

SEQ ID NO: 5564222 - DNA, 15 bp, Homo sapiens
agctctggggatggg

SEQ ID NO: 5564223 - DNA, 18 bp, Homo sapiens
agctctgggggctccagc

SEQ ID NO: 5564224 - DNA, 14 bp, Homo sapiens
agctctggggtggg

SEQ ID NO: 5564225 - DNA, 19 bp, Homo sapiens
agctctggggtgggcagtt

SEQ ID NO: 5564226 - DNA, 21 bp, Homo sapiens
agctctggggtgggcagtttt

SEQ ID NO: 5564227 - DNA, 20 bp, Homo sapiens
agctctggtccatagagagc

SEQ ID NO: 5564228 - DNA, 19 bp, Homo sapiens
agctctggtgacaccagcc

SEQ ID NO: 5564229 - DNA, 20 bp, Homo sapiens
agctctggtgacaccagcct

SEQ ID NO: 5564230 - DNA, 14 bp, Homo sapiens
agctctggtggaga

SEQ ID NO: 5564231 - DNA, 22 bp, Homo sapiens
agctctgtagaaagaatgtgtt

SEQ ID NO: 5564232 - DNA, 22 bp, Homo sapiens
agctctgtagcctggtctgtgc

SEQ ID NO: 5564233 - DNA, 13 bp, Homo sapiens
agctctgtccact

SEQ ID NO: 5564234 - DNA, 23 bp, Homo sapiens
agctctgtccccaccccatgggc

SEQ ID NO: 5564235 - DNA, 13 bp, Homo sapiens
agctctgtctgaa

SEQ ID NO: 5564236 - DNA, 14 bp, Homo sapiens
agctctgtctgtcc

SEQ ID NO: 5564237 - DNA, 12 bp, Homo sapiens
agctctgtggcc

SEQ ID NO: 5564238 - DNA, 16 bp, Homo sapiens
agctctgtggccacat

SEQ ID NO: 5564239 - DNA, 19 bp, Homo sapiens
agctctgtggcctgtgtcc

SEQ ID NO: 5564240 - DNA, 19 bp, Homo sapiens
agctctgtgggtctctgga

SEQ ID NO: 5564241 - DNA, 15 bp, Homo sapiens
agctctgtgttgcca

SEQ ID NO: 5564242 - DNA, 16 bp, Homo sapiens
agctctgtgttgccat

SEQ ID NO: 5564243 - DNA, 18 bp, Homo sapiens
agctctgtgttgccatgt

SEQ ID NO: 5564244 - DNA, 22 bp, Homo sapiens
agctctgttccatgcaactgga

SEQ ID NO: 5564245 - DNA, 15 bp, Homo sapiens
agctctgttcttcct

SEQ ID NO: 5564246 - DNA, 20 bp, Homo sapiens
agctctgttcttcctcagcc

SEQ ID NO: 5564247 - DNA, 20 bp, Homo sapiens
agctctgtttataaaaacaa

SEQ ID NO: 5564248 - DNA, 17 bp, Homo sapiens
agctcttactctttcct

SEQ ID NO: 5564249 - DNA, 19 bp, Homo sapiens
agctcttagtcctccctgc

SEQ ID NO: 5564250 - DNA, 18 bp, Homo sapiens
agctcttagtttttaaaa

SEQ ID NO: 5564251 - DNA, 19 bp, Homo sapiens
agctcttagtttttaaaaa

SEQ ID NO: 5564252 - DNA, 17 bp, Homo sapiens
agctcttcactcagcca

SEQ ID NO: 5564253 - DNA, 20 bp, Homo sapiens
agctcttcactcagccacac

SEQ ID NO: 5564254 - DNA, 23 bp, Homo sapiens
agctcttcactcagccacacccc

SEQ ID NO: 5564255 - DNA, 14 bp, Homo sapiens
agctcttcatctgc

SEQ ID NO: 5564256 - DNA, 18 bp, Homo sapiens
agctcttcattccattga

SEQ ID NO: 5564257 - DNA, 20 bp, Homo sapiens
agctcttcattgcactgcag

SEQ ID NO: 5564258 - DNA, 15 bp, Homo sapiens
agctcttcatttctg

SEQ ID NO: 5564259 - DNA, 16 bp, Homo sapiens
agctcttccagggcag

SEQ ID NO: 5564260 - DNA, 23 bp, Homo sapiens
agctcttcccctttcctggggga

SEQ ID NO: 5564261 - DNA, 15 bp, Homo sapiens
agctcttcccttgct

SEQ ID NO: 5564262 - DNA, 17 bp, Homo sapiens
agctcttcctccccagg

SEQ ID NO: 5564263 - DNA, 17 bp, Homo sapiens
agctcttcggtttctga

SEQ ID NO: 5564264 - DNA, 15 bp, Homo sapiens
agctcttctaaggaa

SEQ ID NO: 5564265 - DNA, 16 bp, Homo sapiens
agctcttctatttaaa

SEQ ID NO: 5564266 - DNA, 23 bp, Homo sapiens
agctcttctatttaaaaaataaa

SEQ ID NO: 5564267 - DNA, 17 bp, Homo sapiens
agctcttctccaggctg

SEQ ID NO: 5564268 - DNA, 18 bp, Homo sapiens
agctcttctccaggctgt

SEQ ID NO: 5564269 - DNA, 14 bp, Homo sapiens
agctcttctccatc

SEQ ID NO: 5564270 - DNA, 20 bp, Homo sapiens
agctcttctccccaggtgtg

SEQ ID NO: 5564271 - DNA, 12 bp, Homo sapiens
agctcttctctt

SEQ ID NO: 5564272 - DNA, 22 bp, Homo sapiens
agctcttctgccggccctgggg

SEQ ID NO: 5564273 - DNA, 14 bp, Homo sapiens
agctcttctttttt

SEQ ID NO: 5564274 - DNA, 17 bp, Homo sapiens
agctcttgacagaaagc

SEQ ID NO: 5564275 - DNA, 19 bp, Homo sapiens
agctcttgacagaaagcag

SEQ ID NO: 5564276 - DNA, 19 bp, Homo sapiens
agctcttgatttgggtgga

SEQ ID NO: 5564277 - DNA, 18 bp, Homo sapiens
agctcttgcccttccctg

SEQ ID NO: 5564278 - DNA, 22 bp, Homo sapiens
agctcttgcccttccctgtccc

SEQ ID NO: 5564279 - DNA, 13 bp, Homo sapiens
agctcttgctaat

SEQ ID NO: 5564280 - DNA, 19 bp, Homo sapiens
agctcttgctaatcagtgt

SEQ ID NO: 5564281 - DNA, 15 bp, Homo sapiens
agctcttgctctctt

SEQ ID NO: 5564282 - DNA, 14 bp, Homo sapiens
agctcttgctgtta

SEQ ID NO: 5564283 - DNA, 13 bp, Homo sapiens
agctcttgctttg

SEQ ID NO: 5564284 - DNA, 16 bp, Homo sapiens
agctcttggaagagct

SEQ ID NO: 5564285 - DNA, 20 bp, Homo sapiens
agctcttggaagagctcttc

SEQ ID NO: 5564286 - DNA, 14 bp, Homo sapiens
agctcttggacaac

SEQ ID NO: 5564287 - DNA, 16 bp, Homo sapiens
agctcttggcaggagt

SEQ ID NO: 5564288 - DNA, 17 bp, Homo sapiens
agctcttggcccctgtg

SEQ ID NO: 5564289 - DNA, 20 bp, Homo sapiens
agctcttggcccctgtgtga

SEQ ID NO: 5564290 - DNA, 23 bp, Homo sapiens
agctcttggcccctgtgtgagtt

SEQ ID NO: 5564291 - DNA, 12 bp, Homo sapiens
agctcttggcct

SEQ ID NO: 5564292 - DNA, 15 bp, Homo sapiens
agctcttggcctttg

SEQ ID NO: 5564293 - DNA, 17 bp, Homo sapiens
agctcttggcctttgca

SEQ ID NO: 5564294 - DNA, 13 bp, Homo sapiens
agctcttgggcct

SEQ ID NO: 5564295 - DNA, 14 bp, Homo sapiens
agctcttgggcctg

SEQ ID NO: 5564296 - DNA, 18 bp, Homo sapiens
agctcttgggcctgacct

SEQ ID NO: 5564297 - DNA, 20 bp, Homo sapiens
agctcttgggcctgacctcc

SEQ ID NO: 5564298 - DNA, 20 bp, Homo sapiens
agctcttggggaaatagctt

SEQ ID NO: 5564299 - DNA, 19 bp, Homo sapiens
agctcttggtgggcccagg

SEQ ID NO: 5564300 - DNA, 22 bp, Homo sapiens
agctcttggtgggcccagggac

SEQ ID NO: 5564301 - DNA, 13 bp, Homo sapiens
agctcttgtgagg

SEQ ID NO: 5564302 - DNA, 16 bp, Homo sapiens
agctcttgtgaggaaa

SEQ ID NO: 5564303 - DNA, 19 bp, Homo sapiens
agctcttgttccgtgccag

SEQ ID NO: 5564304 - DNA, 20 bp, Homo sapiens
agctcttgttccgtgccagg

SEQ ID NO: 5564305 - DNA, 22 bp, Homo sapiens
agctcttgttccgtgccaggca

SEQ ID NO: 5564306 - DNA, 17 bp, Homo sapiens
agctcttgtttctgttt

SEQ ID NO: 5564307 - DNA, 16 bp, Homo sapiens
agctctttatatgttg

SEQ ID NO: 5564308 - DNA, 17 bp, Homo sapiens
agctctttcatctttta

SEQ ID NO: 5564309 - DNA, 12 bp, Homo sapiens
agctctttcctc

SEQ ID NO: 5564310 - DNA, 15 bp, Homo sapiens
agctctttcctcctt

SEQ ID NO: 5564311 - DNA, 17 bp, Homo sapiens
agctctttcctccttcc

SEQ ID NO: 5564312 - DNA, 11 bp, Homo sapiens
agctctttctc

SEQ ID NO: 5564313 - DNA, 15 bp, Homo sapiens
agctctttcttcttt

SEQ ID NO: 5564314 - DNA, 14 bp, Homo sapiens
agctctttgcacta

SEQ ID NO: 5564315 - DNA, 19 bp, Homo sapiens
agctctttggtctattttc

SEQ ID NO: 5564316 - DNA, 15 bp, Homo sapiens
agctctttgtctcac

SEQ ID NO: 5564317 - DNA, 18 bp, Homo sapiens
agctctttgtctcaccag

SEQ ID NO: 5564318 - DNA, 11 bp, Homo sapiens
agctcttttaa

SEQ ID NO: 5564319 - DNA, 18 bp, Homo sapiens
agctcttttttgtttgtt

SEQ ID NO: 5564320 - DNA, 19 bp, Homo sapiens
agctgaaaaatcacatcct

SEQ ID NO: 5564321 - DNA, 20 bp, Homo sapiens
agctgaaaagggcactccca

SEQ ID NO: 5564322 - DNA, 21 bp, Homo sapiens
agctgaaaagggcactcccaa

SEQ ID NO: 5564323 - DNA, 12 bp, Homo sapiens
agctgaaaatat

SEQ ID NO: 5564324 - DNA, 14 bp, Homo sapiens
agctgaaaatgtgt

SEQ ID NO: 5564325 - DNA, 21 bp, Homo sapiens
agctgaaacattccgaagagg

SEQ ID NO: 5564326 - DNA, 12 bp, Homo sapiens
agctgaaagagg

SEQ ID NO: 5564327 - DNA, 14 bp, Homo sapiens
agctgaaagttggg

SEQ ID NO: 5564328 - DNA, 20 bp, Homo sapiens
agctgaaatatgctggctgg

SEQ ID NO: 5564329 - DNA, 13 bp, Homo sapiens
agctgaaatgctg

SEQ ID NO: 5564330 - DNA, 16 bp, Homo sapiens
agctgaaatgctgcat

SEQ ID NO: 5564331 - DNA, 12 bp, Homo sapiens
agctgaaattga

SEQ ID NO: 5564332 - DNA, 16 bp, Homo sapiens
agctgaaattgaaaag

SEQ ID NO: 5564333 - DNA, 21 bp, Homo sapiens
agctgaacaataggctgttcc

SEQ ID NO: 5564334 - DNA, 16 bp, Homo sapiens
agctgaacacatttct

SEQ ID NO: 5564335 - DNA, 17 bp, Homo sapiens
agctgaacacatttctt

SEQ ID NO: 5564336 - DNA, 19 bp, Homo sapiens
agctgaacacatttctttt

SEQ ID NO: 5564337 - DNA, 21 bp, Homo sapiens
agctgaacacatttgcccaat

SEQ ID NO: 5564338 - DNA, 17 bp, Homo sapiens
agctgaaccacagaaat

SEQ ID NO: 5564339 - DNA, 14 bp, Homo sapiens
agctgaaccccctc

SEQ ID NO: 5564340 - DNA, 15 bp, Homo sapiens
agctgaacctgggta

SEQ ID NO: 5564341 - DNA, 22 bp, Homo sapiens
agctgaagaaaaaatcagaact

SEQ ID NO: 5564342 - DNA, 15 bp, Homo sapiens
agctgaagaaaatga

SEQ ID NO: 5564343 - DNA, 14 bp, Homo sapiens
agctgaagaaatta

SEQ ID NO: 5564344 - DNA, 18 bp, Homo sapiens
agctgaagaattgaaaag

SEQ ID NO: 5564345 - DNA, 22 bp, Homo sapiens
agctgaagagcacggtccccca

SEQ ID NO: 5564346 - DNA, 15 bp, Homo sapiens
agctgaagagctggg

SEQ ID NO: 5564347 - DNA, 18 bp, Homo sapiens
agctgaagatccccaact

SEQ ID NO: 5564348 - DNA, 21 bp, Homo sapiens
agctgaagatccccaactgct

SEQ ID NO: 5564349 - DNA, 23 bp, Homo sapiens
agctgaagatccccaactgctcc

SEQ ID NO: 5564350 - DNA, 24 bp, Homo sapiens
agctgaagatccccaactgctcca

SEQ ID NO: 5564351 - DNA, 22 bp, Homo sapiens
agctgctcacttaaacaatgtc

SEQ ID NO: 5564352 - DNA, 14 bp, Homo sapiens
agctgctcagaatt

SEQ ID NO: 5564353 - DNA, 16 bp, Homo sapiens
agctgctcagaattca

SEQ ID NO: 5564354 - DNA, 17 bp, Homo sapiens
agctgctcagagccaag

SEQ ID NO: 5564355 - DNA, 16 bp, Homo sapiens
agctgctcagggaaaa

SEQ ID NO: 5564356 - DNA, 19 bp, Homo sapiens
agctgctcattacagttct

SEQ ID NO: 5564357 - DNA, 23 bp, Homo sapiens
agctgctcattacagttctttcc

SEQ ID NO: 5564358 - DNA, 19 bp, Homo sapiens
agctgctccaggcctgcag

SEQ ID NO: 5564359 - DNA, 21 bp, Homo sapiens
agctgctcccacacttgtgcc

SEQ ID NO: 5564360 - DNA, 12 bp, Homo sapiens
agctgctcccca

SEQ ID NO: 5564361 - DNA, 19 bp, Homo sapiens
agctgctccccaggccacc

SEQ ID NO: 5564362 - DNA, 20 bp, Homo sapiens
agctgctccccaggccaccc

SEQ ID NO: 5564363 - DNA, 13 bp, Homo sapiens
agctgctcccctc

SEQ ID NO: 5564364 - DNA, 14 bp, Homo sapiens
agctgctcccctcc

SEQ ID NO: 5564365 - DNA, 16 bp, Homo sapiens
agctgctcccctgcca

SEQ ID NO: 5564366 - DNA, 22 bp, Homo sapiens
agctgctccgaggacccaggaa

SEQ ID NO: 5564367 - DNA, 20 bp, Homo sapiens
agctgctcctagagggaggg

SEQ ID NO: 5564368 - DNA, 19 bp, Homo sapiens
agctgctcctttaccctct

SEQ ID NO: 5564369 - DNA, 14 bp, Homo sapiens
agctgctcgcacag

SEQ ID NO: 5564370 - DNA, 16 bp, Homo sapiens
agctgctcgcacagat

SEQ ID NO: 5564371 - DNA, 17 bp, Homo sapiens
agctgctctaagcccag

SEQ ID NO: 5564372 - DNA, 14 bp, Homo sapiens
agctgctctattgt

SEQ ID NO: 5564373 - DNA, 23 bp, Homo sapiens
agctgctctccttcactctgaca

SEQ ID NO: 5564374 - DNA, 16 bp, Homo sapiens
agctgctctgagccac

SEQ ID NO: 5564375 - DNA, 13 bp, Homo sapiens
agctgctctgccc

SEQ ID NO: 5564376 - DNA, 14 bp, Homo sapiens
agctgctctgccca

SEQ ID NO: 5564377 - DNA, 15 bp, Homo sapiens
agctgctctgcccct

SEQ ID NO: 5564378 - DNA, 12 bp, Homo sapiens
agctgctctgct

SEQ ID NO: 5564379 - DNA, 16 bp, Homo sapiens
agctgctctgtcttct

SEQ ID NO: 5564380 - DNA, 21 bp, Homo sapiens
agctgctcttgcatctgggcc

SEQ ID NO: 5564381 - DNA, 23 bp, Homo sapiens
agctgctcttgcatctgggccag

SEQ ID NO: 5564382 - DNA, 16 bp, Homo sapiens
agctgctgaaacaaca

SEQ ID NO: 5564383 - DNA, 21 bp, Homo sapiens
agctgctgaccaattgtgctg

SEQ ID NO: 5564384 - DNA, 22 bp, Homo sapiens
agctgctgaccaattgtgctgc

SEQ ID NO: 5564385 - DNA, 21 bp, Homo sapiens
agctgctgagccgcagagaag

SEQ ID NO: 5564386 - DNA, 16 bp, Homo sapiens
agctgctgagtgacag

SEQ ID NO: 5564387 - DNA, 19 bp, Homo sapiens
agctgctgcagccctgcca

SEQ ID NO: 5564388 - DNA, 13 bp, Homo sapiens
agctgctgccact

SEQ ID NO: 5564389 - DNA, 15 bp, Homo sapiens
agctgctgccactct

SEQ ID NO: 5564390 - DNA, 19 bp, Homo sapiens
agctgctgccactctgctg

SEQ ID NO: 5564391 - DNA, 12 bp, Homo sapiens
agctgctgccat

SEQ ID NO: 5564392 - DNA, 22 bp, Homo sapiens
agctgctgctctcccctcccag

SEQ ID NO: 5564393 - DNA, 23 bp, Homo sapiens
agctgctgctctcccctcccagt

SEQ ID NO: 5564394 - DNA, 13 bp, Homo sapiens
agctgctgctctg

SEQ ID NO: 5564395 - DNA, 12 bp, Homo sapiens
agctgctggagc

SEQ ID NO: 5564396 - DNA, 13 bp, Homo sapiens
agctgctggagcc

SEQ ID NO: 5564397 - DNA, 14 bp, Homo sapiens
agctgctggatgac

SEQ ID NO: 5564398 - DNA, 14 bp, Homo sapiens
agctgctggccagg

SEQ ID NO: 5564399 - DNA, 18 bp, Homo sapiens
agctgctggccatggctg

SEQ ID NO: 5564400 - DNA, 20 bp, Homo sapiens
agctgctggccatggctgct

SEQ ID NO: 5564401 - DNA, 13 bp, Homo sapiens
agctgctggctga

SEQ ID NO: 5564402 - DNA, 19 bp, Homo sapiens
agctgctggctgacctggg

SEQ ID NO: 5564403 - DNA, 20 bp, Homo sapiens
agctgctggctgacctgggc

SEQ ID NO: 5564404 - DNA, 14 bp, Homo sapiens
agctgctggcttgc

SEQ ID NO: 5564405 - DNA, 17 bp, Homo sapiens
agctgctggcttgcagt

SEQ ID NO: 5564406 - DNA, 13 bp, Homo sapiens
agctgctgggcca

SEQ ID NO: 5564407 - DNA, 17 bp, Homo sapiens
agctgctgggccagtgg

SEQ ID NO: 5564408 - DNA, 18 bp, Homo sapiens
agctgctgggccagtggc

SEQ ID NO: 5564409 - DNA, 21 bp, Homo sapiens
agctgctgggccagtggcact

SEQ ID NO: 5564410 - DNA, 23 bp, Homo sapiens
agctgctgggccagtggcactct

SEQ ID NO: 5564411 - DNA, 13 bp, Homo sapiens
agctgctgggcta

SEQ ID NO: 5564412 - DNA, 19 bp, Homo sapiens
agctgctgggtggcagggg

SEQ ID NO: 5564413 - DNA, 19 bp, Homo sapiens
agctgctgtgactgtgtcc

SEQ ID NO: 5564414 - DNA, 13 bp, Homo sapiens
agctgctgtgcca

SEQ ID NO: 5564415 - DNA, 22 bp, Homo sapiens
agctgctgtgccaggactgtga

SEQ ID NO: 5564416 - DNA, 18 bp, Homo sapiens
agctgctgtgccccacca

SEQ ID NO: 5564417 - DNA, 17 bp, Homo sapiens
agctgctgtgtcctcta

SEQ ID NO: 5564418 - DNA, 16 bp, Homo sapiens
agctgctgttctcagg

SEQ ID NO: 5564419 - DNA, 18 bp, Homo sapiens
agctgctgttctcaggac

SEQ ID NO: 5564420 - DNA, 18 bp, Homo sapiens
agctgctgttgaactttt

SEQ ID NO: 5564421 - DNA, 18 bp, Homo sapiens
agctgcttaacagttgct

SEQ ID NO: 5564422 - DNA, 17 bp, Homo sapiens
agctgcttcactaggga

SEQ ID NO: 5564423 - DNA, 18 bp, Homo sapiens
agctgcttcactagggaa

SEQ ID NO: 5564424 - DNA, 14 bp, Homo sapiens
agctgcttccagtt

SEQ ID NO: 5564425 - DNA, 23 bp, Homo sapiens
agctgcttctcccacttggccaa

SEQ ID NO: 5564426 - DNA, 14 bp, Homo sapiens
agctgcttctcccc

SEQ ID NO: 5564427 - DNA, 16 bp, Homo sapiens
agctgcttctgcccac

SEQ ID NO: 5564428 - DNA, 17 bp, Homo sapiens
agctgcttctgcccacc

SEQ ID NO: 5564429 - DNA, 23 bp, Homo sapiens
agctgcttctgcccaccccgcct

SEQ ID NO: 5564430 - DNA, 22 bp, Homo sapiens
agctgcttgactatcacataca

SEQ ID NO: 5564431 - DNA, 22 bp, Homo sapiens
agctgcttggacctcgtgcttt

SEQ ID NO: 5564432 - DNA, 20 bp, Homo sapiens
agctgcttggacggattcct

SEQ ID NO: 5564433 - DNA, 16 bp, Homo sapiens
agctgcttgggcttca

SEQ ID NO: 5564434 - DNA, 20 bp, Homo sapiens
agctgcttgggcttcatcct

SEQ ID NO: 5564435 - DNA, 21 bp, Homo sapiens
agctgcttgggcttcatcctc

SEQ ID NO: 5564436 - DNA, 12 bp, Homo sapiens
agctgcttgtcc

SEQ ID NO: 5564437 - DNA, 15 bp, Homo sapiens
agctgcttgtgggcc

SEQ ID NO: 5564438 - DNA, 19 bp, Homo sapiens
agctgctttcgaataaagt

SEQ ID NO: 5564439 - DNA, 19 bp, Homo sapiens
agctgctttctgttgtcat

SEQ ID NO: 5564440 - DNA, 13 bp, Homo sapiens
agctgctttcttc

SEQ ID NO: 5564441 - DNA, 15 bp, Homo sapiens
agctgctttcttctc

SEQ ID NO: 5564442 - DNA, 16 bp, Homo sapiens
agctgctttcttctct

SEQ ID NO: 5564443 - DNA, 17 bp, Homo sapiens
agctgctttcttctctg

SEQ ID NO: 5564444 - DNA, 21 bp, Homo sapiens
agctgctttcttctctgcctc

SEQ ID NO: 5564445 - DNA, 13 bp, Homo sapiens
agctgctttgtta

SEQ ID NO: 5564446 - DNA, 14 bp, Homo sapiens
agctgctttgttac

SEQ ID NO: 5564447 - DNA, 17 bp, Homo sapiens
agctgctttgttacctt

SEQ ID NO: 5564448 - DNA, 21 bp, Homo sapiens
agctgctttgttaccttaaaa

SEQ ID NO: 5564449 - DNA, 20 bp, Homo sapiens
agctgcttttgcagaaatca

SEQ ID NO: 5564450 - DNA, 14 bp, Homo sapiens
agctgcttttgcat

SEQ ID NO: 5564451 - DNA, 18 bp, Homo sapiens
agctgcttttgcatttct

SEQ ID NO: 5564452 - DNA, 21 bp, Homo sapiens
agctgcttttgtctatgggac

SEQ ID NO: 5564453 - DNA, 13 bp, Homo sapiens
agctggaaaagta

SEQ ID NO: 5564454 - DNA, 23 bp, Homo sapiens
agctggaaaggccagcagccttc

SEQ ID NO: 5564455 - DNA, 18 bp, Homo sapiens
agctggaaagttgggccc

SEQ ID NO: 5564456 - DNA, 11 bp, Homo sapiens
agctggaaata

SEQ ID NO: 5564457 - DNA, 12 bp, Homo sapiens
agctggaaataa

SEQ ID NO: 5564458 - DNA, 17 bp, Homo sapiens
agctggaaataaacctg

SEQ ID NO: 5564459 - DNA, 22 bp, Homo sapiens
agctggaaataaacctggagat

SEQ ID NO: 5564460 - DNA, 24 bp, Homo sapiens
agctggaaataaacctggagatga

SEQ ID NO: 5564461 - DNA, 18 bp, Homo sapiens
agctggaacatttgatat

SEQ ID NO: 5564462 - DNA, 19 bp, Homo sapiens
agctggaacatttgatatt

SEQ ID NO: 5564463 - DNA, 22 bp, Homo sapiens
agctggaagactgtgcagaaga

SEQ ID NO: 5564464 - DNA, 13 bp, Homo sapiens
agctggaagcact

SEQ ID NO: 5564465 - DNA, 13 bp, Homo sapiens
agctggaagcctg

SEQ ID NO: 5564466 - DNA, 15 bp, Homo sapiens
agctggaagcctgcc

SEQ ID NO: 5564467 - DNA, 12 bp, Homo sapiens
agctggaaggca

SEQ ID NO: 5564468 - DNA, 22 bp, Homo sapiens
agctggaaggcagggcagaggg

SEQ ID NO: 5564469 - DNA, 13 bp, Homo sapiens
agctggaaggggc

SEQ ID NO: 5564470 - DNA, 18 bp, Homo sapiens
agctggaaggggccacgt

SEQ ID NO: 5564471 - DNA, 22 bp, Homo sapiens
agctggaatgtgccacagaggc

SEQ ID NO: 5564472 - DNA, 18 bp, Homo sapiens
agctggaattgctgctct

SEQ ID NO: 5564473 - DNA, 21 bp, Homo sapiens
agctggaattgctgctctctg

SEQ ID NO: 5564474 - DNA, 23 bp, Homo sapiens
agctggaattttttattcttgtg

SEQ ID NO: 5564475 - DNA, 14 bp, Homo sapiens
agctggacaagaag

SEQ ID NO: 5564476 - DNA, 18 bp, Homo sapiens
agctggacaagaagctgc

SEQ ID NO: 5564477 - DNA, 19 bp, Homo sapiens
agctggacaagaagctgct

SEQ ID NO: 5564478 - DNA, 20 bp, Homo sapiens
agctggacaagaagctgcta

SEQ ID NO: 5564479 - DNA, 13 bp, Homo sapiens
agctggacagagg

SEQ ID NO: 5564480 - DNA, 17 bp, Homo sapiens
agctggacagaggggac

SEQ ID NO: 5564481 - DNA, 21 bp, Homo sapiens
agctggacagaggggactctg

SEQ ID NO: 5564482 - DNA, 22 bp, Homo sapiens
agctggacagaggggactctgg

SEQ ID NO: 5564483 - DNA, 23 bp, Homo sapiens
agctggacagaggggactctggg

SEQ ID NO: 5564484 - DNA, 19 bp, Homo sapiens
agctggacatactgctgga

SEQ ID NO: 5564485 - DNA, 22 bp, Homo sapiens
agctggacatactgctggagtc

SEQ ID NO: 5564486 - DNA, 23 bp, Homo sapiens
agctggacatactgctggagtcc

SEQ ID NO: 5564487 - DNA, 15 bp, Homo sapiens
agctggaccagtggt

SEQ ID NO: 5564488 - DNA, 15 bp, Homo sapiens
agctggacctcacca

SEQ ID NO: 5564489 - DNA, 15 bp, Homo sapiens
agctggactacccac

SEQ ID NO: 5564490 - DNA, 16 bp, Homo sapiens
agctggactacccacg

SEQ ID NO: 5564491 - DNA, 14 bp, Homo sapiens
agctggactagtgt

SEQ ID NO: 5564492 - DNA, 16 bp, Homo sapiens
agctggactctgcatc

SEQ ID NO: 5564493 - DNA, 15 bp, Homo sapiens
agctggactgggtgg

SEQ ID NO: 5564494 - DNA, 16 bp, Homo sapiens
agctggacttctgtgg

SEQ ID NO: 5564495 - DNA, 12 bp, Homo sapiens
agctggagaaat

SEQ ID NO: 5564496 - DNA, 17 bp, Homo sapiens
agctggagaaatatggt

SEQ ID NO: 5564497 - DNA, 15 bp, Homo sapiens
agctggagaagaccc

SEQ ID NO: 5564498 - DNA, 21 bp, Homo sapiens
agctggagagagagttctcac

SEQ ID NO: 5564499 - DNA, 19 bp, Homo sapiens
agctggagaggagccctgc

SEQ ID NO: 5564500 - DNA, 21 bp, Homo sapiens
agctggagaggagccctgcct

SEQ ID NO: 5564501 - DNA, 17 bp, Homo sapiens
agctggagatactgatt

SEQ ID NO: 5564502 - DNA, 23 bp, Homo sapiens
agctggagatctgaacccagctg

SEQ ID NO: 5564503 - DNA, 23 bp, Homo sapiens
agctggagatgaggccagaccat

SEQ ID NO: 5564504 - DNA, 15 bp, Homo sapiens
agctggagcagcgga

SEQ ID NO: 5564505 - DNA, 20 bp, Homo sapiens
agctggagcccccagcagag

SEQ ID NO: 5564506 - DNA, 14 bp, Homo sapiens
agctggagcctggt

SEQ ID NO: 5564507 - DNA, 19 bp, Homo sapiens
agctggagcctggtgccct

SEQ ID NO: 5564508 - DNA, 23 bp, Homo sapiens
agctggagcggagaggaagccag

SEQ ID NO: 5564509 - DNA, 20 bp, Homo sapiens
agctggaggactagaacctg

SEQ ID NO: 5564510 - DNA, 13 bp, Homo sapiens
agctggaggcagg

SEQ ID NO: 5564511 - DNA, 21 bp, Homo sapiens
agctggaggcaggggcttcct

SEQ ID NO: 5564512 - DNA, 15 bp, Homo sapiens
agctggaggctccag

SEQ ID NO: 5564513 - DNA, 20 bp, Homo sapiens
agctggaggctccaggactc

SEQ ID NO: 5564514 - DNA, 19 bp, Homo sapiens
agctggaggggtggggagc

SEQ ID NO: 5564515 - DNA, 18 bp, Homo sapiens
agctggagtctgggctcc

SEQ ID NO: 5564516 - DNA, 14 bp, Homo sapiens
agctggagtgcagt

SEQ ID NO: 5564517 - DNA, 20 bp, Homo sapiens
agctggagtgccatggctgg

SEQ ID NO: 5564518 - DNA, 21 bp, Homo sapiens
agctggagtgccatggctggg

SEQ ID NO: 5564519 - DNA, 23 bp, Homo sapiens
agctggagtgccatggctggggg

SEQ ID NO: 5564520 - DNA, 20 bp, Homo sapiens
agctggatagacttgggatg

SEQ ID NO: 5564521 - DNA, 21 bp, Homo sapiens
agctggatagacttgggatgg

SEQ ID NO: 5564522 - DNA, 17 bp, Homo sapiens
agctggatataatgtat

SEQ ID NO: 5564523 - DNA, 15 bp, Homo sapiens
agctggatcgctgca

SEQ ID NO: 5564524 - DNA, 22 bp, Homo sapiens
agctggatctccattctctcag

SEQ ID NO: 5564525 - DNA, 22 bp, Homo sapiens
agctggatggggcggcctgcag

SEQ ID NO: 5564526 - DNA, 23 bp, Homo sapiens
agctggatggggcggcctgcaga

SEQ ID NO: 5564527 - DNA, 17 bp, Homo sapiens
agctggattcaattcct

SEQ ID NO: 5564528 - DNA, 23 bp, Homo sapiens
agctggattgggttatgaatatt

SEQ ID NO: 5564529 - DNA, 16 bp, Homo sapiens
agctggcaaccagcca

SEQ ID NO: 5564530 - DNA, 22 bp, Homo sapiens
agctggcaaccagccagcgtcc

SEQ ID NO: 5564531 - DNA, 13 bp, Homo sapiens
agctggcacaaaa

SEQ ID NO: 5564532 - DNA, 17 bp, Homo sapiens
agctggcagagagcaca

SEQ ID NO: 5564533 - DNA, 21 bp, Homo sapiens
agctggcagagagcacagtga

SEQ ID NO: 5564534 - DNA, 16 bp, Homo sapiens
agctggcagcctccag

SEQ ID NO: 5564535 - DNA, 13 bp, Homo sapiens
agctggcagcgcc

SEQ ID NO: 5564536 - DNA, 20 bp, Homo sapiens
agctggcagcgcctcccgcc

SEQ ID NO: 5564537 - DNA, 13 bp, Homo sapiens
agctggcaggaca

SEQ ID NO: 5564538 - DNA, 23 bp, Homo sapiens
agctggcaggacacatcccggcc

SEQ ID NO: 5564539 - DNA, 12 bp, Homo sapiens
agctggcaggag

SEQ ID NO: 5564540 - DNA, 14 bp, Homo sapiens
agctggccaaagtc

SEQ ID NO: 5564541 - DNA, 15 bp, Homo sapiens
agctggccaaagtca

SEQ ID NO: 5564542 - DNA, 20 bp, Homo sapiens
agctggccacagtgagctga

SEQ ID NO: 5564543 - DNA, 12 bp, Homo sapiens
agctggccaggc

SEQ ID NO: 5564544 - DNA, 13 bp, Homo sapiens
agctggccaggcc

SEQ ID NO: 5564545 - DNA, 23 bp, Homo sapiens
agctggccaggccactgggccct

SEQ ID NO: 5564546 - DNA, 19 bp, Homo sapiens
agctggcccactgctggct

SEQ ID NO: 5564547 - DNA, 15 bp, Homo sapiens
agctggccccgccgc

SEQ ID NO: 5564548 - DNA, 18 bp, Homo sapiens
agctggccccgccgcctg

SEQ ID NO: 5564549 - DNA, 20 bp, Homo sapiens
agctggccccgcttggtggc

SEQ ID NO: 5564550 - DNA, 13 bp, Homo sapiens
agctggccctcag

SEQ ID NO: 5564551 - DNA, 15 bp, Homo sapiens
agctggccctcagct

SEQ ID NO: 5564552 - DNA, 17 bp, Homo sapiens
agctggccctcagctcc

SEQ ID NO: 5564553 - DNA, 17 bp, Homo sapiens
agctggccctgcctcct

SEQ ID NO: 5564554 - DNA, 18 bp, Homo sapiens
agctggccctgcctcctg

SEQ ID NO: 5564555 - DNA, 20 bp, Homo sapiens
agctggccctgcctcctggg

SEQ ID NO: 5564556 - DNA, 19 bp, Homo sapiens
agctggccggaaggagact

SEQ ID NO: 5564557 - DNA, 18 bp, Homo sapiens
agctggccgggagcctga

SEQ ID NO: 5564558 - DNA, 16 bp, Homo sapiens
agctggccgtgggcct

SEQ ID NO: 5564559 - DNA, 19 bp, Homo sapiens
agctggcctaggtgggagc

SEQ ID NO: 5564560 - DNA, 13 bp, Homo sapiens
agctggcctcccc

SEQ ID NO: 5564561 - DNA, 19 bp, Homo sapiens
agctggcctcccccaacac

SEQ ID NO: 5564562 - DNA, 16 bp, Homo sapiens
agctggcctctcactg

SEQ ID NO: 5564563 - DNA, 22 bp, Homo sapiens
agctggcctctcactgcctccc

SEQ ID NO: 5564564 - DNA, 16 bp, Homo sapiens
agctggcctctctagc

SEQ ID NO: 5564565 - DNA, 21 bp, Homo sapiens
agctggcctgagaggggaagc

SEQ ID NO: 5564566 - DNA, 15 bp, Homo sapiens
agctggcctgcggtg

SEQ ID NO: 5564567 - DNA, 22 bp, Homo sapiens
agctggcctggtttcctcgaga

SEQ ID NO: 5564568 - DNA, 20 bp, Homo sapiens
agctggcgactgcagctgca

SEQ ID NO: 5564569 - DNA, 17 bp, Homo sapiens
agctggcgctcagcagc

SEQ ID NO: 5564570 - DNA, 19 bp, Homo sapiens
agctggcgctcagcagccc

SEQ ID NO: 5564571 - DNA, 22 bp, Homo sapiens
agctggcgctcagcagccctag

SEQ ID NO: 5564572 - DNA, 16 bp, Homo sapiens
agctggcgtcacctgt

SEQ ID NO: 5564573 - DNA, 23 bp, Homo sapiens
agctggctagcattcctcaggaa

SEQ ID NO: 5564574 - DNA, 12 bp, Homo sapiens
agctggctccag

SEQ ID NO: 5564575 - DNA, 11 bp, Homo sapiens
agctggctctg

SEQ ID NO: 5564576 - DNA, 12 bp, Homo sapiens
agctggctctgc

SEQ ID NO: 5564577 - DNA, 13 bp, Homo sapiens
agctggctctgca

SEQ ID NO: 5564578 - DNA, 20 bp, Homo sapiens
agctggctctgcagcacatt

SEQ ID NO: 5564579 - DNA, 14 bp, Homo sapiens
agctggctctgtga

SEQ ID NO: 5564580 - DNA, 21 bp, Homo sapiens
agctggctctgtgagggtgct

SEQ ID NO: 5564581 - DNA, 11 bp, Homo sapiens
agctggctgac

SEQ ID NO: 5564582 - DNA, 20 bp, Homo sapiens
agctggctgagacactgaag

SEQ ID NO: 5564583 - DNA, 20 bp, Homo sapiens
agctggctggcaggtgttgg

SEQ ID NO: 5564584 - DNA, 12 bp, Homo sapiens
agctggctgggc

SEQ ID NO: 5564585 - DNA, 14 bp, Homo sapiens
agctggctgggcct

SEQ ID NO: 5564586 - DNA, 14 bp, Homo sapiens
agctggctggggtg

SEQ ID NO: 5564587 - DNA, 15 bp, Homo sapiens
agctggctggggtgg

SEQ ID NO: 5564588 - DNA, 20 bp, Homo sapiens
agctggctggggtggcctgt

SEQ ID NO: 5564589 - DNA, 13 bp, Homo sapiens
agctggctgggtc

SEQ ID NO: 5564590 - DNA, 23 bp, Homo sapiens
agctggctgggtcgcccctcctc

SEQ ID NO: 5564591 - DNA, 19 bp, Homo sapiens
agctggctgtactgccaag

SEQ ID NO: 5564592 - DNA, 15 bp, Homo sapiens
agctggctgtcttcc

SEQ ID NO: 5564593 - DNA, 14 bp, Homo sapiens
agctggctgtgcct

SEQ ID NO: 5564594 - DNA, 17 bp, Homo sapiens
agctggctgtgcctgct

SEQ ID NO: 5564595 - DNA, 18 bp, Homo sapiens
agctggctgtgcctgctt

SEQ ID NO: 5564596 - DNA, 20 bp, Homo sapiens
agctggctgtgcctgcttct

SEQ ID NO: 5564597 - DNA, 22 bp, Homo sapiens
agctggctgtgcctgcttctgt

SEQ ID NO: 5564598 - DNA, 14 bp, Homo sapiens
agctggcttctgtg

SEQ ID NO: 5564599 - DNA, 20 bp, Homo sapiens
agctggctttgaaacctcag

SEQ ID NO: 5564600 - DNA, 20 bp, Homo sapiens
agctgggaaaaaagttttga

SEQ ID NO: 5564601 - DNA, 22 bp, Homo sapiens
agctgggaaaaaagttttgatg

SEQ ID NO: 5564602 - DNA, 14 bp, Homo sapiens
agctgggaaacagg

SEQ ID NO: 5564603 - DNA, 14 bp, Homo sapiens
agctgggaaagcat

SEQ ID NO: 5564604 - DNA, 20 bp, Homo sapiens
agctgggaaattcatgtgga

SEQ ID NO: 5564605 - DNA, 14 bp, Homo sapiens
agctgggaaccagc

SEQ ID NO: 5564606 - DNA, 22 bp, Homo sapiens
agctgggaacccgactgtgaaa

SEQ ID NO: 5564607 - DNA, 22 bp, Homo sapiens
agctgggaaggccgcaagaggc

SEQ ID NO: 5564608 - DNA, 14 bp, Homo sapiens
agctgggacccctc

SEQ ID NO: 5564609 - DNA, 22 bp, Homo sapiens
agctgggacctaatgctggcct

SEQ ID NO: 5564610 - DNA, 16 bp, Homo sapiens
agctgggactacaggc

SEQ ID NO: 5564611 - DNA, 17 bp, Homo sapiens
agctgggactacaggca

SEQ ID NO: 5564612 - DNA, 20 bp, Homo sapiens
agctgggactacaggcaccc

SEQ ID NO: 5564613 - DNA, 19 bp, Homo sapiens
agctgggactacaggcgcc

SEQ ID NO: 5564614 - DNA, 21 bp, Homo sapiens
agctgggactacaggtgtgca

SEQ ID NO: 5564615 - DNA, 18 bp, Homo sapiens
agctgggagccaggctct

SEQ ID NO: 5564616 - DNA, 17 bp, Homo sapiens
agctgggagccagtgtg

SEQ ID NO: 5564617 - DNA, 14 bp, Homo sapiens
agctgggaggaaaa

SEQ ID NO: 5564618 - DNA, 13 bp, Homo sapiens
agctgggaggcaa

SEQ ID NO: 5564619 - DNA, 16 bp, Homo sapiens
agctgggaggcaagag

SEQ ID NO: 5564620 - DNA, 19 bp, Homo sapiens
agctgggaggcaagagggg

SEQ ID NO: 5564621 - DNA, 16 bp, Homo sapiens
agctgggaggcatggc

SEQ ID NO: 5564622 - DNA, 16 bp, Homo sapiens
agctgggagggagggg

SEQ ID NO: 5564623 - DNA, 19 bp, Homo sapiens
agctgggatacacacggct

SEQ ID NO: 5564624 - DNA, 21 bp, Homo sapiens
agctgggatcacagctgcagg

SEQ ID NO: 5564625 - DNA, 22 bp, Homo sapiens
agctgggatcacatgtggactt

SEQ ID NO: 5564626 - DNA, 15 bp, Homo sapiens
agctgggatggggcc

SEQ ID NO: 5564627 - DNA, 17 bp, Homo sapiens
agctgggatgtttctgt

SEQ ID NO: 5564628 - DNA, 17 bp, Homo sapiens
agctgggattacaggcg

SEQ ID NO: 5564629 - DNA, 21 bp, Homo sapiens
agctgggattacaggctcctg

SEQ ID NO: 5564630 - DNA, 23 bp, Homo sapiens
agctgggattacaggctcctgcc

SEQ ID NO: 5564631 - DNA, 22 bp, Homo sapiens
agctgggatttgaactgagccg

SEQ ID NO: 5564632 - DNA, 23 bp, Homo sapiens
agctgggatttgaactgagccgt

SEQ ID NO: 5564633 - DNA, 15 bp, Homo sapiens
agctgggattttaaa

SEQ ID NO: 5564634 - DNA, 16 bp, Homo sapiens
agctgggattttaaac

SEQ ID NO: 5564635 - DNA, 21 bp, Homo sapiens
agctgggcaaacccttctctt

SEQ ID NO: 5564636 - DNA, 16 bp, Homo sapiens
agctgggcagaaggcc

SEQ ID NO: 5564637 - DNA, 15 bp, Homo sapiens
agctgggcagctgga

SEQ ID NO: 5564638 - DNA, 14 bp, Homo sapiens
agctgggcagggtg

SEQ ID NO: 5564639 - DNA, 20 bp, Homo sapiens
agctgggcatgccatgtctg

SEQ ID NO: 5564640 - DNA, 17 bp, Homo sapiens
agctgggcatggtacca

SEQ ID NO: 5564641 - DNA, 21 bp, Homo sapiens
agctgggcatggtaccagccc

SEQ ID NO: 5564642 - DNA, 20 bp, Homo sapiens
agctgggccactcctcttca

SEQ ID NO: 5564643 - DNA, 20 bp, Homo sapiens
agctgggccagccgcccacc

SEQ ID NO: 5564644 - DNA, 11 bp, Homo sapiens
agctgggccca

SEQ ID NO: 5564645 - DNA, 20 bp, Homo sapiens
agctgggcccaaccctgtct

SEQ ID NO: 5564646 - DNA, 20 bp, Homo sapiens
agctgggcccacagccccca

SEQ ID NO: 5564647 - DNA, 22 bp, Homo sapiens
agctgggcccacagcccccacc

SEQ ID NO: 5564648 - DNA, 23 bp, Homo sapiens
agctgggcccacagcccccaccc

SEQ ID NO: 5564649 - DNA, 15 bp, Homo sapiens
agctgggcccagccc

SEQ ID NO: 5564650 - DNA, 17 bp, Homo sapiens
agctgggcccagcccct

SEQ ID NO: 5564651 - DNA, 15 bp, Homo sapiens
agctgggccccagcc

SEQ ID NO: 5564652 - DNA, 18 bp, Homo sapiens
agctgggccccagcccac

SEQ ID NO: 5564653 - DNA, 22 bp, Homo sapiens
agctgggccccagcccaccctc

SEQ ID NO: 5564654 - DNA, 19 bp, Homo sapiens
agctgggccccatgctctg

SEQ ID NO: 5564655 - DNA, 20 bp, Homo sapiens
agctgggccccatgctctgc

SEQ ID NO: 5564656 - DNA, 22 bp, Homo sapiens
agctgggcccctgcacaggcac

SEQ ID NO: 5564657 - DNA, 12 bp, Homo sapiens
agctgggccctg

SEQ ID NO: 5564658 - DNA, 16 bp, Homo sapiens
agctgggccctgcctg

SEQ ID NO: 5564659 - DNA, 21 bp, Homo sapiens
agctgggccctgcctgcagcc

SEQ ID NO: 5564660 - DNA, 23 bp, Homo sapiens
agctgggccctgcctgcagccag

SEQ ID NO: 5564661 - DNA, 17 bp, Homo sapiens
agctgggccggccagcc

SEQ ID NO: 5564662 - DNA, 15 bp, Homo sapiens
agctgggcctcctgc

SEQ ID NO: 5564663 - DNA, 17 bp, Homo sapiens
agctgggcctcctgcct

SEQ ID NO: 5564664 - DNA, 13 bp, Homo sapiens
agctgggcctggt

SEQ ID NO: 5564665 - DNA, 15 bp, Homo sapiens
agctgggcctggtct

SEQ ID NO: 5564666 - DNA, 23 bp, Homo sapiens
agctgggcggggctcgaggctgg

SEQ ID NO: 5564667 - DNA, 17 bp, Homo sapiens
agctgggctaagtaaat

SEQ ID NO: 5564668 - DNA, 14 bp, Homo sapiens
agctgggctctgcc

SEQ ID NO: 5564669 - DNA, 16 bp, Homo sapiens
agctgggctggggagg

SEQ ID NO: 5564670 - DNA, 15 bp, Homo sapiens
agctgggcttggcct

SEQ ID NO: 5564671 - DNA, 19 bp, Homo sapiens
agctgggctttcctctgtg

SEQ ID NO: 5564672 - DNA, 20 bp, Homo sapiens
agctggggaatcccctcgct

SEQ ID NO: 5564673 - DNA, 11 bp, Homo sapiens
agctggggaca

SEQ ID NO: 5564674 - DNA, 14 bp, Homo sapiens
agctggggacaact

SEQ ID NO: 5564675 - DNA, 17 bp, Homo sapiens
agctggggactcaggga

SEQ ID NO: 5564676 - DNA, 11 bp, Homo sapiens
agctggggaga

SEQ ID NO: 5564677 - DNA, 15 bp, Homo sapiens
agctggggagatggg

SEQ ID NO: 5564678 - DNA, 18 bp, Homo sapiens
agctggggagcagctgag

SEQ ID NO: 5564679 - DNA, 14 bp, Homo sapiens
agctggggagccct

SEQ ID NO: 5564680 - DNA, 16 bp, Homo sapiens
agctggggagggaggc

SEQ ID NO: 5564681 - DNA, 12 bp, Homo sapiens
agctggggaggt

SEQ ID NO: 5564682 - DNA, 15 bp, Homo sapiens
agctggggatgtctc

SEQ ID NO: 5564683 - DNA, 16 bp, Homo sapiens
agctggggccagaggc

SEQ ID NO: 5564684 - DNA, 21 bp, Homo sapiens
agctggggcctggagaggggc

SEQ ID NO: 5564685 - DNA, 18 bp, Homo sapiens
agctggggcgtggggagg

SEQ ID NO: 5564686 - DNA, 19 bp, Homo sapiens
agctggggcttctttctgc

SEQ ID NO: 5564687 - DNA, 21 bp, Homo sapiens
agctggggcttctttctgctg

SEQ ID NO: 5564688 - DNA, 18 bp, Homo sapiens
agctgggggccatgagct

SEQ ID NO: 5564689 - DNA, 24 bp, Homo sapiens
agctggggggcaccggctcaggag

SEQ ID NO: 5564690 - DNA, 18 bp, Homo sapiens
agctggggggctgtcctg

SEQ ID NO: 5564691 - DNA, 19 bp, Homo sapiens
agctgggggtgggccaggc

SEQ ID NO: 5564692 - DNA, 16 bp, Homo sapiens
agctggggtctgggca

SEQ ID NO: 5564693 - DNA, 17 bp, Homo sapiens
agctggggtctgggcag

SEQ ID NO: 5564694 - DNA, 21 bp, Homo sapiens
agctggggtctgggcagtgcc

SEQ ID NO: 5564695 - DNA, 20 bp, Homo sapiens
agctggggtgggagctcctc

SEQ ID NO: 5564696 - DNA, 20 bp, Homo sapiens
agctggggtggggacctcag

SEQ ID NO: 5564697 - DNA, 16 bp, Homo sapiens
agctgggtaccaggcc

SEQ ID NO: 5564698 - DNA, 17 bp, Homo sapiens
agctgggtaccaggcca

SEQ ID NO: 5564699 - DNA, 23 bp, Homo sapiens
agctgggtacggtggcacgtgcc

SEQ ID NO: 5564700 - DNA, 16 bp, Homo sapiens
agctgggtcaggcagg

SEQ ID NO: 5564701 - DNA, 22 bp, Homo sapiens
agctgggtgagtggggagacac

SEQ ID NO: 5564702 - DNA, 15 bp, Homo sapiens
agctgggtgccccag

SEQ ID NO: 5564703 - DNA, 16 bp, Homo sapiens
agctgggtgccccagg

SEQ ID NO: 5564704 - DNA, 13 bp, Homo sapiens
agcttatcaattt

SEQ ID NO: 5564705 - DNA, 22 bp, Homo sapiens
agcttatcaatttgtcattttg

SEQ ID NO: 5564706 - DNA, 19 bp, Homo sapiens
agcttatcatgctgtcttt

SEQ ID NO: 5564707 - DNA, 16 bp, Homo sapiens
agcttatctccctgct

SEQ ID NO: 5564708 - DNA, 14 bp, Homo sapiens
agcttatctctttt

SEQ ID NO: 5564709 - DNA, 17 bp, Homo sapiens
agcttatctcttttata

SEQ ID NO: 5564710 - DNA, 22 bp, Homo sapiens
agcttatctcttttatatttgt

SEQ ID NO: 5564711 - DNA, 16 bp, Homo sapiens
agcttatctgcccctc

SEQ ID NO: 5564712 - DNA, 18 bp, Homo sapiens
agcttatctttctttcca

SEQ ID NO: 5564713 - DNA, 22 bp, Homo sapiens
agcttatctttctttccattta

SEQ ID NO: 5564714 - DNA, 15 bp, Homo sapiens
agcttatgaaaagaa

SEQ ID NO: 5564715 - DNA, 13 bp, Homo sapiens
agcttatgtttct

SEQ ID NO: 5564716 - DNA, 15 bp, Homo sapiens
agcttatgtttctta

SEQ ID NO: 5564717 - DNA, 17 bp, Homo sapiens
agcttattaatgctaag

SEQ ID NO: 5564718 - DNA, 18 bp, Homo sapiens
agcttattaatgctaagg

SEQ ID NO: 5564719 - DNA, 21 bp, Homo sapiens
agcttattaatgctaagggca

SEQ ID NO: 5564720 - DNA, 17 bp, Homo sapiens
agcttattcaatattta

SEQ ID NO: 5564721 - DNA, 22 bp, Homo sapiens
agcttattcatctgtttttctt

SEQ ID NO: 5564722 - DNA, 20 bp, Homo sapiens
agcttattgtgtgcgctgcc

SEQ ID NO: 5564723 - DNA, 22 bp, Homo sapiens
agcttattgtgtgcgctgcctg

SEQ ID NO: 5564724 - DNA, 22 bp, Homo sapiens
agcttattgtttctctgaaagt

SEQ ID NO: 5564725 - DNA, 19 bp, Homo sapiens
agcttatttagcacatttt

SEQ ID NO: 5564726 - DNA, 15 bp, Homo sapiens
agcttatttctaact

SEQ ID NO: 5564727 - DNA, 13 bp, Homo sapiens
agcttcaaaaact

SEQ ID NO: 5564728 - DNA, 14 bp, Homo sapiens
agcttcaaaaactt

SEQ ID NO: 5564729 - DNA, 16 bp, Homo sapiens
agcttcaaaaactttg

SEQ ID NO: 5564730 - DNA, 12 bp, Homo sapiens
agcttcaaagct

SEQ ID NO: 5564731 - DNA, 14 bp, Homo sapiens
agcttcaaagttta

SEQ ID NO: 5564732 - DNA, 14 bp, Homo sapiens
agcttcaaatgcaa

SEQ ID NO: 5564733 - DNA, 23 bp, Homo sapiens
agcttcaaattatagaaacaata

SEQ ID NO: 5564734 - DNA, 21 bp, Homo sapiens
agcttcaaccctcagccttga

SEQ ID NO: 5564735 - DNA, 19 bp, Homo sapiens
agcttcaagtctgtgcctg

SEQ ID NO: 5564736 - DNA, 13 bp, Homo sapiens
agcttcaagtgat

SEQ ID NO: 5564737 - DNA, 15 bp, Homo sapiens
agcttcaagtgatat

SEQ ID NO: 5564738 - DNA, 14 bp, Homo sapiens
agcttcaagtgcct

SEQ ID NO: 5564739 - DNA, 15 bp, Homo sapiens
agcttcaagtgcctt

SEQ ID NO: 5564740 - DNA, 19 bp, Homo sapiens
agcttcaatataagaagca

SEQ ID NO: 5564741 - DNA, 18 bp, Homo sapiens
agcttcacagtacccaaa

SEQ ID NO: 5564742 - DNA, 15 bp, Homo sapiens
agcttcaccagagca

SEQ ID NO: 5564743 - DNA, 22 bp, Homo sapiens
agcttcacccaccaggccagct

SEQ ID NO: 5564744 - DNA, 21 bp, Homo sapiens
agcttcaccccaatcccagct

SEQ ID NO: 5564745 - DNA, 19 bp, Homo sapiens
agcttcacgattatgacta

SEQ ID NO: 5564746 - DNA, 15 bp, Homo sapiens
agcttcactcagctg

SEQ ID NO: 5564747 - DNA, 21 bp, Homo sapiens
agcttcagaagtttggcaata

SEQ ID NO: 5564748 - DNA, 17 bp, Homo sapiens
agcttcagacctccctc

SEQ ID NO: 5564749 - DNA, 15 bp, Homo sapiens
agcttcagactcaag

SEQ ID NO: 5564750 - DNA, 13 bp, Homo sapiens
agcttcagccagg

SEQ ID NO: 5564751 - DNA, 15 bp, Homo sapiens
agcttcagccaggag

SEQ ID NO: 5564752 - DNA, 17 bp, Homo sapiens
agcttcagccaggagct

SEQ ID NO: 5564753 - DNA, 21 bp, Homo sapiens
agcttcagccaggtctgactc

SEQ ID NO: 5564754 - DNA, 22 bp, Homo sapiens
agcttcagccaggtctgactcc

SEQ ID NO: 5564755 - DNA, 18 bp, Homo sapiens
agcttcagctagctttta

SEQ ID NO: 5564756 - DNA, 17 bp, Homo sapiens
agcttcagctatactta

SEQ ID NO: 5564757 - DNA, 20 bp, Homo sapiens
agcttcagctcaactcacag

SEQ ID NO: 5564758 - DNA, 17 bp, Homo sapiens
agcttcaggatactgta

SEQ ID NO: 5564759 - DNA, 14 bp, Homo sapiens
agcttcaggcacca

SEQ ID NO: 5564760 - DNA, 17 bp, Homo sapiens
agcttcaggccccagga

SEQ ID NO: 5564761 - DNA, 17 bp, Homo sapiens
agcttcagggctgggca

SEQ ID NO: 5564762 - DNA, 18 bp, Homo sapiens
agcttcaggtgagccaag

SEQ ID NO: 5564763 - DNA, 13 bp, Homo sapiens
agcttcaggttat

SEQ ID NO: 5564764 - DNA, 21 bp, Homo sapiens
agcttcagtaagttatctttg

SEQ ID NO: 5564765 - DNA, 22 bp, Homo sapiens
agcttcagtaagttatctttga

SEQ ID NO: 5564766 - DNA, 19 bp, Homo sapiens
agcttcagtcattaaatta

SEQ ID NO: 5564767 - DNA, 18 bp, Homo sapiens
agcttcagtctctgcagt

SEQ ID NO: 5564768 - DNA, 15 bp, Homo sapiens
agcttcagttgcttg

SEQ ID NO: 5564769 - DNA, 13 bp, Homo sapiens
agcttcagttgtt

SEQ ID NO: 5564770 - DNA, 13 bp, Homo sapiens
agcttcatatcta

SEQ ID NO: 5564771 - DNA, 21 bp, Homo sapiens
agcttcatcttgagcctgagc

SEQ ID NO: 5564772 - DNA, 15 bp, Homo sapiens
agcttcatgcctttg

SEQ ID NO: 5564773 - DNA, 22 bp, Homo sapiens
agcttcatgcctttgtaagtta

SEQ ID NO: 5564774 - DNA, 19 bp, Homo sapiens
agcttcatggcagaaggca

SEQ ID NO: 5564775 - DNA, 16 bp, Homo sapiens
agcttcatgtggcttc

SEQ ID NO: 5564776 - DNA, 16 bp, Homo sapiens
agcttcattctccttg

SEQ ID NO: 5564777 - DNA, 16 bp, Homo sapiens
agcttcatttccgtga

SEQ ID NO: 5564778 - DNA, 17 bp, Homo sapiens
agcttcatttgtgtcaa

SEQ ID NO: 5564779 - DNA, 12 bp, Homo sapiens
agcttccaaagc

SEQ ID NO: 5564780 - DNA, 16 bp, Homo sapiens
agcttccaaagcctag

SEQ ID NO: 5564781 - DNA, 20 bp, Homo sapiens
agcttccaaggggcaaattt

SEQ ID NO: 5564782 - DNA, 17 bp, Homo sapiens
agcttccaattttcctt

SEQ ID NO: 5564783 - DNA, 13 bp, Homo sapiens
agcttccacctca

SEQ ID NO: 5564784 - DNA, 14 bp, Homo sapiens
agcttccacctcat

SEQ ID NO: 5564785 - DNA, 15 bp, Homo sapiens
agcttccacctcatg

SEQ ID NO: 5564786 - DNA, 22 bp, Homo sapiens
agcttccacctcatggattgcc

SEQ ID NO: 5564787 - DNA, 20 bp, Homo sapiens
agcttccactgtcagccctc

SEQ ID NO: 5564788 - DNA, 21 bp, Homo sapiens
agcttccactgtcagccctca

SEQ ID NO: 5564789 - DNA, 13 bp, Homo sapiens
agcttccagcagg

SEQ ID NO: 5564790 - DNA, 21 bp, Homo sapiens
agcttccaggctgcatagaag

SEQ ID NO: 5564791 - DNA, 19 bp, Homo sapiens
agcttccagtgcatgttgc

SEQ ID NO: 5564792 - DNA, 17 bp, Homo sapiens
agcttccatagctgctg

SEQ ID NO: 5564793 - DNA, 15 bp, Homo sapiens
agcttccatgatgca

SEQ ID NO: 5564794 - DNA, 23 bp, Homo sapiens
agcttccatgatgcacagtatct

SEQ ID NO: 5564795 - DNA, 21 bp, Homo sapiens
agcttccatgtttaatgttat

SEQ ID NO: 5564796 - DNA, 15 bp, Homo sapiens
agcttccattttaat

SEQ ID NO: 5564797 - DNA, 18 bp, Homo sapiens
agcttcccacacctgcct

SEQ ID NO: 5564798 - DNA, 21 bp, Homo sapiens
agcttcccagccatgcccagg

SEQ ID NO: 5564799 - DNA, 22 bp, Homo sapiens
agcttccccaacacgcaggagc

SEQ ID NO: 5564800 - DNA, 22 bp, Homo sapiens
agcttccccaggagctctctgc

SEQ ID NO: 5564801 - DNA, 17 bp, Homo sapiens
agcttcccccaaggctg

SEQ ID NO: 5564802 - DNA, 22 bp, Homo sapiens
agcttcccctcgctgtcctgct

SEQ ID NO: 5564803 - DNA, 17 bp, Homo sapiens
agcttcccctctctcct

SEQ ID NO: 5564804 - DNA, 12 bp, Homo sapiens
agcttccctccc

SEQ ID NO: 5564805 - DNA, 14 bp, Homo sapiens
agcttccgctttga

SEQ ID NO: 5564806 - DNA, 22 bp, Homo sapiens
agcttccgctttgaaagaagca

SEQ ID NO: 5564807 - DNA, 22 bp, Homo sapiens
agcttcctacccacacctctgc

SEQ ID NO: 5564808 - DNA, 15 bp, Homo sapiens
agcttcctcacaccc

SEQ ID NO: 5564809 - DNA, 19 bp, Homo sapiens
agcttcctcacacccctgt

SEQ ID NO: 5564810 - DNA, 15 bp, Homo sapiens
agcttcctgagggct

SEQ ID NO: 5564811 - DNA, 20 bp, Homo sapiens
agcttcctgctgctggggcc

SEQ ID NO: 5564812 - DNA, 15 bp, Homo sapiens
agcttcctggctctg

SEQ ID NO: 5564813 - DNA, 16 bp, Homo sapiens
agcttcctggctctgg

SEQ ID NO: 5564814 - DNA, 14 bp, Homo sapiens
agcttcctggggac

SEQ ID NO: 5564815 - DNA, 16 bp, Homo sapiens
agcttcctggggacca

SEQ ID NO: 5564816 - DNA, 18 bp, Homo sapiens
agcttcctggggaccaag

SEQ ID NO: 5564817 - DNA, 20 bp, Homo sapiens
agcttcctggggaccaagat

SEQ ID NO: 5564818 - DNA, 20 bp, Homo sapiens
agcttcctgtccccatctgt

SEQ ID NO: 5564819 - DNA, 21 bp, Homo sapiens
agcttcctgtccccatctgtc

SEQ ID NO: 5564820 - DNA, 15 bp, Homo sapiens
agcttcctgtctgtt

SEQ ID NO: 5564821 - DNA, 17 bp, Homo sapiens
agcttcctgtctgttta

SEQ ID NO: 5564822 - DNA, 13 bp, Homo sapiens
agcttcctgtgca

SEQ ID NO: 5564823 - DNA, 13 bp, Homo sapiens
agcttcctgtgcc

SEQ ID NO: 5564824 - DNA, 15 bp, Homo sapiens
agcttcctgtgccct

SEQ ID NO: 5564825 - DNA, 20 bp, Homo sapiens
agcttcctgtgccctcaccc

SEQ ID NO: 5564826 - DNA, 23 bp, Homo sapiens
agcttccttcagagagcagtgct

SEQ ID NO: 5564827 - DNA, 17 bp, Homo sapiens
agcttccttcatctcta

SEQ ID NO: 5564828 - DNA, 14 bp, Homo sapiens
agcttccttccaag

SEQ ID NO: 5564829 - DNA, 19 bp, Homo sapiens
agcttccttctgtgaaagt

SEQ ID NO: 5564830 - DNA, 15 bp, Homo sapiens
agcttccttggcttt

SEQ ID NO: 5564831 - DNA, 19 bp, Homo sapiens
agcttcggagggcccctgc

SEQ ID NO: 5564832 - DNA, 21 bp, Homo sapiens
agcttcggagggcccctgcgt

SEQ ID NO: 5564833 - DNA, 16 bp, Homo sapiens
agcttcggggcctcct

SEQ ID NO: 5564834 - DNA, 22 bp, Homo sapiens
agcttcggttctccagaatgta

SEQ ID NO: 5564835 - DNA, 23 bp, Homo sapiens
agcttcgtcttgtgtttgctgca

SEQ ID NO: 5564836 - DNA, 20 bp, Homo sapiens
agcttcgtgccaacagagag

SEQ ID NO: 5564837 - DNA, 16 bp, Homo sapiens
agcttcgtgctggagg

SEQ ID NO: 5564838 - DNA, 22 bp, Homo sapiens
agcttcgttagaatgtctgcct

SEQ ID NO: 5564839 - DNA, 20 bp, Homo sapiens
agcttcgtttattttcaaga

SEQ ID NO: 5564840 - DNA, 20 bp, Homo sapiens
agcttctaaatggtgctgca

SEQ ID NO: 5564841 - DNA, 19 bp, Homo sapiens
agcttctactcctgcctca

SEQ ID NO: 5564842 - DNA, 21 bp, Homo sapiens
agcttctagtctggaactgct

SEQ ID NO: 5564843 - DNA, 23 bp, Homo sapiens
agcttctagtgatttctggggcc

SEQ ID NO: 5564844 - DNA, 17 bp, Homo sapiens
agcttctattaaatgta

SEQ ID NO: 5564845 - DNA, 18 bp, Homo sapiens
agcttctcaaagtactgg

SEQ ID NO: 5564846 - DNA, 19 bp, Homo sapiens
agcttctcagtttctgcct

SEQ ID NO: 5564847 - DNA, 21 bp, Homo sapiens
agcttctcagtttctgcctgg

SEQ ID NO: 5564848 - DNA, 12 bp, Homo sapiens
agcttctccaag

SEQ ID NO: 5564849 - DNA, 15 bp, Homo sapiens
agcttctccagccac

SEQ ID NO: 5564850 - DNA, 21 bp, Homo sapiens
agcttctccaggaagcccagg

SEQ ID NO: 5564851 - DNA, 13 bp, Homo sapiens
agcttctcctctg

SEQ ID NO: 5564852 - DNA, 16 bp, Homo sapiens
agcttctcctgcgccc

SEQ ID NO: 5564853 - DNA, 20 bp, Homo sapiens
agcttctcctgcgccccgcc

SEQ ID NO: 5564854 - DNA, 23 bp, Homo sapiens
agcttctcctgcgccccgcccac

SEQ ID NO: 5564855 - DNA, 21 bp, Homo sapiens
agcttctcctgtgtgattgac

SEQ ID NO: 5564856 - DNA, 17 bp, Homo sapiens
agcttctctctccaggg

SEQ ID NO: 5564857 - DNA, 20 bp, Homo sapiens
agcttctctctccctgtcac

SEQ ID NO: 5564858 - DNA, 13 bp, Homo sapiens
agcttctctctga

SEQ ID NO: 5564859 - DNA, 12 bp, Homo sapiens
agcttctctgcc

SEQ ID NO: 5564860 - DNA, 14 bp, Homo sapiens
agcttctctgggct

SEQ ID NO: 5564861 - DNA, 15 bp, Homo sapiens
agcttctctgggctg

SEQ ID NO: 5564862 - DNA, 19 bp, Homo sapiens
agcttctcttctttctgaa

SEQ ID NO: 5564863 - DNA, 19 bp, Homo sapiens
agcttctctttaactcagg

SEQ ID NO: 5564864 - DNA, 22 bp, Homo sapiens
agcttctctttaactcaggact

SEQ ID NO: 5564865 - DNA, 23 bp, Homo sapiens
agcttctctttaactcaggactc

SEQ ID NO: 5564866 - DNA, 16 bp, Homo sapiens
agcttctgacctcagc

SEQ ID NO: 5564867 - DNA, 17 bp, Homo sapiens
agcttctgacctcagca

SEQ ID NO: 5564868 - DNA, 17 bp, Homo sapiens
agcttctgccacataaa

SEQ ID NO: 5564869 - DNA, 14 bp, Homo sapiens
agcttctgctgggc

SEQ ID NO: 5564870 - DNA, 17 bp, Homo sapiens
agcttctgctgggctgg

SEQ ID NO: 5564871 - DNA, 14 bp, Homo sapiens
agcttctggtactc

SEQ ID NO: 5564872 - DNA, 18 bp, Homo sapiens
agcttctgtattttcaaa

SEQ ID NO: 5564873 - DNA, 13 bp, Homo sapiens
agcttctgtctcc

SEQ ID NO: 5564874 - DNA, 17 bp, Homo sapiens
agcttctgtctccagct

SEQ ID NO: 5564875 - DNA, 21 bp, Homo sapiens
agcttctgtgtgtgagctacc

SEQ ID NO: 5564876 - DNA, 13 bp, Homo sapiens
agcttctgttggc

SEQ ID NO: 5564877 - DNA, 18 bp, Homo sapiens
agcttcttaaatgagaag

SEQ ID NO: 5564878 - DNA, 21 bp, Homo sapiens
agcttcttaatataactgcct

SEQ ID NO: 5564879 - DNA, 19 bp, Homo sapiens
agcttcttaattaatttga

SEQ ID NO: 5564880 - DNA, 13 bp, Homo sapiens
agcttcttcacag

SEQ ID NO: 5564881 - DNA, 18 bp, Homo sapiens
agcttttcccaggagacc

SEQ ID NO: 5564882 - DNA, 13 bp, Homo sapiens
agcttttcccttc

SEQ ID NO: 5564883 - DNA, 16 bp, Homo sapiens
agcttttcccttcttt

SEQ ID NO: 5564884 - DNA, 15 bp, Homo sapiens
agcttttcctcaggg

SEQ ID NO: 5564885 - DNA, 20 bp, Homo sapiens
agcttttcctcagggtgtcc

SEQ ID NO: 5564886 - DNA, 15 bp, Homo sapiens
agcttttcctttctt

SEQ ID NO: 5564887 - DNA, 15 bp, Homo sapiens
agcttttctgatggt

SEQ ID NO: 5564888 - DNA, 19 bp, Homo sapiens
agcttttcttattcctttt

SEQ ID NO: 5564889 - DNA, 19 bp, Homo sapiens
agcttttcttgccagctca

SEQ ID NO: 5564890 - DNA, 20 bp, Homo sapiens
agcttttcttgccagctcag

SEQ ID NO: 5564891 - DNA, 18 bp, Homo sapiens
agcttttctttttctgta

SEQ ID NO: 5564892 - DNA, 21 bp, Homo sapiens
agcttttgatgtctccaagta

SEQ ID NO: 5564893 - DNA, 19 bp, Homo sapiens
agcttttgattagtataat

SEQ ID NO: 5564894 - DNA, 14 bp, Homo sapiens
agcttttgcatttc

SEQ ID NO: 5564895 - DNA, 15 bp, Homo sapiens
agcttttgcatttcc

SEQ ID NO: 5564896 - DNA, 19 bp, Homo sapiens
agcttttgccagtattatg

SEQ ID NO: 5564897 - DNA, 17 bp, Homo sapiens
agcttttgcctgcaaga

SEQ ID NO: 5564898 - DNA, 18 bp, Homo sapiens
agcttttggagagtgggc

SEQ ID NO: 5564899 - DNA, 23 bp, Homo sapiens
agcttttggttaatatgtctttt

SEQ ID NO: 5564900 - DNA, 21 bp, Homo sapiens
agcttttgtgggggactgtaa

SEQ ID NO: 5564901 - DNA, 17 bp, Homo sapiens
agctttttaaaacatta

SEQ ID NO: 5564902 - DNA, 17 bp, Homo sapiens
agctttttaatagcact

SEQ ID NO: 5564903 - DNA, 12 bp, Homo sapiens
agctttttaatt

SEQ ID NO: 5564904 - DNA, 17 bp, Homo sapiens
agctttttaattaagca

SEQ ID NO: 5564905 - DNA, 22 bp, Homo sapiens
agctttttaattgttgtttctt

SEQ ID NO: 5564906 - DNA, 15 bp, Homo sapiens
agctttttattattt

SEQ ID NO: 5564907 - DNA, 18 bp, Homo sapiens
agctttttattattttaa

SEQ ID NO: 5564908 - DNA, 15 bp, Homo sapiens
agctttttattccct

SEQ ID NO: 5564909 - DNA, 17 bp, Homo sapiens
agctttttattccctgc

SEQ ID NO: 5564910 - DNA, 23 bp, Homo sapiens
agctttttcagaaacagggcagc

SEQ ID NO: 5564911 - DNA, 15 bp, Homo sapiens
agctttttcctcctg

SEQ ID NO: 5564912 - DNA, 17 bp, Homo sapiens
agctttttcctcctgga

SEQ ID NO: 5564913 - DNA, 21 bp, Homo sapiens
agctttttgatcctctactgt

SEQ ID NO: 5564914 - DNA, 14 bp, Homo sapiens
agctttttggtttg

SEQ ID NO: 5564915 - DNA, 14 bp, Homo sapiens
agctttttgtatta

SEQ ID NO: 5564916 - DNA, 13 bp, Homo sapiens
agctttttgtctt

SEQ ID NO: 5564917 - DNA, 15 bp, Homo sapiens
agctttttgttccct

SEQ ID NO: 5564918 - DNA, 16 bp, Homo sapiens
agctttttgtttgcat

SEQ ID NO: 5564919 - DNA, 18 bp, Homo sapiens
agcttttttacacaaatg

SEQ ID NO: 5564920 - DNA, 18 bp, Homo sapiens
agcttttttattttaata

SEQ ID NO: 5564921 - DNA, 21 bp, Homo sapiens
agcttttttcctcctttctct

SEQ ID NO: 5564922 - DNA, 22 bp, Homo sapiens
agcttttttcctcctttctctg

SEQ ID NO: 5564923 - DNA, 14 bp, Homo sapiens
agcttttttcctgt

SEQ ID NO: 5564924 - DNA, 21 bp, Homo sapiens
agcttttttccttaatccagc

SEQ ID NO: 5564925 - DNA, 20 bp, Homo sapiens
agcttttttctctgatacag

SEQ ID NO: 5564926 - DNA, 23 bp, Homo sapiens
agcttttttctctgatacagaaa

SEQ ID NO: 5564927 - DNA, 17 bp, Homo sapiens
agctttttttcttgcta

SEQ ID NO: 5564928 - DNA, 18 bp, Homo sapiens
aggaaaaaaaacacaaaa

SEQ ID NO: 5564929 - DNA, 23 bp, Homo sapiens
aggaaaaaaactgggataactga

SEQ ID NO: 5564930 - DNA, 21 bp, Homo sapiens
aggaaaaaaacttttataaat

SEQ ID NO: 5564931 - DNA, 14 bp, Homo sapiens
aggaaaaaaagact

SEQ ID NO: 5564932 - DNA, 15 bp, Homo sapiens
aggaaaaaaagcatg

SEQ ID NO: 5564933 - DNA, 20 bp, Homo sapiens
aggaaaaaaattacaaagaa

SEQ ID NO: 5564934 - DNA, 16 bp, Homo sapiens
aggaaaaaagaaaaaa

SEQ ID NO: 5564935 - DNA, 20 bp, Homo sapiens
aggaaaaaagaaccaaaact

SEQ ID NO: 5564936 - DNA, 22 bp, Homo sapiens
aggaaaaaaggaggatagaaaa

SEQ ID NO: 5564937 - DNA, 17 bp, Homo sapiens
aggaaaaaataaaaaga

SEQ ID NO: 5564938 - DNA, 18 bp, Homo sapiens
aggaaaaaataaaaagag

SEQ ID NO: 5564939 - DNA, 15 bp, Homo sapiens
aggaaaaaataaaca

SEQ ID NO: 5564940 - DNA, 20 bp, Homo sapiens
aggaaaaaatggtataaaag

SEQ ID NO: 5564941 - DNA, 13 bp, Homo sapiens
aggaaaaaattat

SEQ ID NO: 5564942 - DNA, 21 bp, Homo sapiens
aggaaaaaattgaaagaactt

SEQ ID NO: 5564943 - DNA, 20 bp, Homo sapiens
aggaaaaacaaaacaaagaa

SEQ ID NO: 5564944 - DNA, 19 bp, Homo sapiens
aggaaaaacagaacatttc

SEQ ID NO: 5564945 - DNA, 16 bp, Homo sapiens
aggaaaaacagggaaa

SEQ ID NO: 5564946 - DNA, 14 bp, Homo sapiens
aggaaaaacaggtc

SEQ ID NO: 5564947 - DNA, 17 bp, Homo sapiens
aggaaaaacatgcttaa

SEQ ID NO: 5564948 - DNA, 16 bp, Homo sapiens
aggaaaaaccaacagg

SEQ ID NO: 5564949 - DNA, 13 bp, Homo sapiens
aggaaaaagaaaa

SEQ ID NO: 5564950 - DNA, 12 bp, Homo sapiens
aggaaaaagaac

SEQ ID NO: 5564951 - DNA, 16 bp, Homo sapiens
aggaaaaagaacttcc

SEQ ID NO: 5564952 - DNA, 18 bp, Homo sapiens
aggaaaaagctccatgtg

SEQ ID NO: 5564953 - DNA, 14 bp, Homo sapiens
aggaaaaaggacag

SEQ ID NO: 5564954 - DNA, 22 bp, Homo sapiens
aggaaaaaggacaggcagaaag

SEQ ID NO: 5564955 - DNA, 15 bp, Homo sapiens
aggaaaaaggctggt

SEQ ID NO: 5564956 - DNA, 14 bp, Homo sapiens
aggaaaaataatca

SEQ ID NO: 5564957 - DNA, 15 bp, Homo sapiens
aggaaaaataatcaa

SEQ ID NO: 5564958 - DNA, 21 bp, Homo sapiens
aggaaaaatgccactccctac

SEQ ID NO: 5564959 - DNA, 22 bp, Homo sapiens
aggaaaaatgccactccctacc

SEQ ID NO: 5564960 - DNA, 18 bp, Homo sapiens
aggaaaaatgggagccag

SEQ ID NO: 5564961 - DNA, 19 bp, Homo sapiens
aggaaaaatgggagccagg

SEQ ID NO: 5564962 - DNA, 22 bp, Homo sapiens
aggaaaaatgggagccaggagt

SEQ ID NO: 5564963 - DNA, 12 bp, Homo sapiens
aggaaaaatgta

SEQ ID NO: 5564964 - DNA, 18 bp, Homo sapiens
aggaaaacaaatcactgt

SEQ ID NO: 5564965 - DNA, 13 bp, Homo sapiens
aggaaaacagcta

SEQ ID NO: 5564966 - DNA, 12 bp, Homo sapiens
aggaaaacattg

SEQ ID NO: 5564967 - DNA, 22 bp, Homo sapiens
aggaaaaccaagccgtggcttc

SEQ ID NO: 5564968 - DNA, 14 bp, Homo sapiens
aggaaaaccaggga

SEQ ID NO: 5564969 - DNA, 16 bp, Homo sapiens
aggaaaaccagggata

SEQ ID NO: 5564970 - DNA, 19 bp, Homo sapiens
aggaaaaccagggatagct

SEQ ID NO: 5564971 - DNA, 16 bp, Homo sapiens
aggaaaacctgaagac

SEQ ID NO: 5564972 - DNA, 17 bp, Homo sapiens
aggaaaacgggaaagaa

SEQ ID NO: 5564973 - DNA, 18 bp, Homo sapiens
aggaaaacgggaaagaat

SEQ ID NO: 5564974 - DNA, 22 bp, Homo sapiens
aggaaaacgggaaagaatataa

SEQ ID NO: 5564975 - DNA, 17 bp, Homo sapiens
aggaaaacgtgaacaaa

SEQ ID NO: 5564976 - DNA, 14 bp, Homo sapiens
aggaaaactcttgg

SEQ ID NO: 5564977 - DNA, 21 bp, Homo sapiens
aggaaaactcttggcctctgc

SEQ ID NO: 5564978 - DNA, 16 bp, Homo sapiens
aggaaaactgaatcca

SEQ ID NO: 5564979 - DNA, 24 bp, Homo sapiens
aggaaaactgcatggagacgcatt

SEQ ID NO: 5564980 - DNA, 17 bp, Homo sapiens
aggaaaagaaaaatttc

SEQ ID NO: 5564981 - DNA, 17 bp, Homo sapiens
aggaaaagaaacctggg

SEQ ID NO: 5564982 - DNA, 14 bp, Homo sapiens
aggaaaagaaatct

SEQ ID NO: 5564983 - DNA, 15 bp, Homo sapiens
aggaaaagaaatcta

SEQ ID NO: 5564984 - DNA, 11 bp, Homo sapiens
aggaaaagagt

SEQ ID NO: 5564985 - DNA, 16 bp, Homo sapiens
aggaaaagagtatcaa

SEQ ID NO: 5564986 - DNA, 15 bp, Homo sapiens
aggaaaagattcctg

SEQ ID NO: 5564987 - DNA, 16 bp, Homo sapiens
aggaaaagcaaattga

SEQ ID NO: 5564988 - DNA, 20 bp, Homo sapiens
aggaaaagcacaagaaactt

SEQ ID NO: 5564989 - DNA, 15 bp, Homo sapiens
aggaaaaggaaaaaa

SEQ ID NO: 5564990 - DNA, 17 bp, Homo sapiens
aggaaaaggcccctgca

SEQ ID NO: 5564991 - DNA, 14 bp, Homo sapiens
aggaaaaggcctgg

SEQ ID NO: 5564992 - DNA, 18 bp, Homo sapiens
aggaaaaggctaagaaaa

SEQ ID NO: 5564993 - DNA, 20 bp, Homo sapiens
aggaaaaggctaagaaaaag

SEQ ID NO: 5564994 - DNA, 17 bp, Homo sapiens
aggaaaaggctgcagct

SEQ ID NO: 5564995 - DNA, 15 bp, Homo sapiens
aggaaaagggagcta

SEQ ID NO: 5564996 - DNA, 13 bp, Homo sapiens
aggaaaaggttaa

SEQ ID NO: 5564997 - DNA, 20 bp, Homo sapiens
aggaaaagtaagggaataaa

SEQ ID NO: 5564998 - DNA, 16 bp, Homo sapiens
aggaaaagtacattta

SEQ ID NO: 5564999 - DNA, 18 bp, Homo sapiens
aggaaaagtcttcctaat

SEQ ID NO: 5565000 - DNA, 19 bp, Homo sapiens
aggaaaagtgcaatgcgtg

SEQ ID NO: 5565001 - DNA, 18 bp, Homo sapiens
aggaaaagttctttcaac

SEQ ID NO: 5565002 - DNA, 21 bp, Homo sapiens
aggaaaagtttaatattaaag

SEQ ID NO: 5565003 - DNA, 24 bp, Homo sapiens
aggaaaagtttaatattaaagcca

SEQ ID NO: 5565004 - DNA, 12 bp, Homo sapiens
aggaaaataagt

SEQ ID NO: 5565005 - DNA, 13 bp, Homo sapiens
aggaaaataagtg

SEQ ID NO: 5565006 - DNA, 22 bp, Homo sapiens
aggaaaataatgtaattgtaat

SEQ ID NO: 5565007 - DNA, 12 bp, Homo sapiens
aggaaaatacat

SEQ ID NO: 5565008 - DNA, 12 bp, Homo sapiens
aggaaaatattg

SEQ ID NO: 5565009 - DNA, 23 bp, Homo sapiens
aggaaaatcaatgctttatctga

SEQ ID NO: 5565010 - DNA, 14 bp, Homo sapiens
aggaaaatcctctg

SEQ ID NO: 5565011 - DNA, 11 bp, Homo sapiens
aggaaaatgag

SEQ ID NO: 5565012 - DNA, 18 bp, Homo sapiens
aggaaaatggaagaccta

SEQ ID NO: 5565013 - DNA, 22 bp, Homo sapiens
aggaaaatggaagacctaaggc

SEQ ID NO: 5565014 - DNA, 17 bp, Homo sapiens
aggaaaatgtacatact

SEQ ID NO: 5565015 - DNA, 17 bp, Homo sapiens
aggaaaatgtattgatt

SEQ ID NO: 5565016 - DNA, 11 bp, Homo sapiens
aggaaaattat

SEQ ID NO: 5565017 - DNA, 15 bp, Homo sapiens
aggaaaattgaaagt

SEQ ID NO: 5565018 - DNA, 19 bp, Homo sapiens
aggaaaattgaaagtattc

SEQ ID NO: 5565019 - DNA, 14 bp, Homo sapiens
aggaaaattgaatg

SEQ ID NO: 5565020 - DNA, 21 bp, Homo sapiens
aggaaaattttagcgtgctca

SEQ ID NO: 5565021 - DNA, 21 bp, Homo sapiens
aggaaacaaaccttgccttga

SEQ ID NO: 5565022 - DNA, 20 bp, Homo sapiens
aggaaacaaatgtgtataaa

SEQ ID NO: 5565023 - DNA, 13 bp, Homo sapiens
aggaaacaagtga

SEQ ID NO: 5565024 - DNA, 16 bp, Homo sapiens
aggaaacagaaaagag

SEQ ID NO: 5565025 - DNA, 13 bp, Homo sapiens
aggaaacaggctc

SEQ ID NO: 5565026 - DNA, 12 bp, Homo sapiens
aggaaacagtta

SEQ ID NO: 5565027 - DNA, 17 bp, Homo sapiens
aggaaacagttgcatgt

SEQ ID NO: 5565028 - DNA, 21 bp, Homo sapiens
aggaaacagttgcatgtagta

SEQ ID NO: 5565029 - DNA, 22 bp, Homo sapiens
aggaaacatgaagcataatttg

SEQ ID NO: 5565030 - DNA, 14 bp, Homo sapiens
aggaaacattttat

SEQ ID NO: 5565031 - DNA, 18 bp, Homo sapiens
aggaaaccaaaggaatcg

SEQ ID NO: 5565032 - DNA, 20 bp, Homo sapiens
aggaaaccacaaccttgcag

SEQ ID NO: 5565033 - DNA, 15 bp, Homo sapiens
aggaaacccagctct

SEQ ID NO: 5565034 - DNA, 18 bp, Homo sapiens
aggaaaccccgagaagga

SEQ ID NO: 5565035 - DNA, 23 bp, Homo sapiens
aggaaaccgagtagaaaatgtga

SEQ ID NO: 5565036 - DNA, 16 bp, Homo sapiens
aggaaaccgcctagtt

SEQ ID NO: 5565037 - DNA, 19 bp, Homo sapiens
aggaaacctctgacttgct

SEQ ID NO: 5565038 - DNA, 12 bp, Homo sapiens
aggaaacctggc

SEQ ID NO: 5565039 - DNA, 17 bp, Homo sapiens
aggaaaccttttcttgt

SEQ ID NO: 5565040 - DNA, 15 bp, Homo sapiens
aggaaacgagacttt

SEQ ID NO: 5565041 - DNA, 20 bp, Homo sapiens
aggaaacgagactttccatt

SEQ ID NO: 5565042 - DNA, 23 bp, Homo sapiens
aggaaacgccccgggcaaagggt

SEQ ID NO: 5565043 - DNA, 13 bp, Homo sapiens
aggaaacggaagc

SEQ ID NO: 5565044 - DNA, 22 bp, Homo sapiens
aggaaactaactggtgtgagtc

SEQ ID NO: 5565045 - DNA, 20 bp, Homo sapiens
aggaaactccacatctgcct

SEQ ID NO: 5565046 - DNA, 20 bp, Homo sapiens
aggaaactcctgacagtctt

SEQ ID NO: 5565047 - DNA, 12 bp, Homo sapiens
aggaaactctta

SEQ ID NO: 5565048 - DNA, 13 bp, Homo sapiens
aggaaactcttat

SEQ ID NO: 5565049 - DNA, 15 bp, Homo sapiens
aggaaactgaagcat

SEQ ID NO: 5565050 - DNA, 17 bp, Homo sapiens
aggaaactgaggcccag

SEQ ID NO: 5565051 - DNA, 15 bp, Homo sapiens
aggaaactgctttat

SEQ ID NO: 5565052 - DNA, 21 bp, Homo sapiens
aggaaactgctttatttttat

SEQ ID NO: 5565053 - DNA, 23 bp, Homo sapiens
aggaaactggcgatctcccaggg

SEQ ID NO: 5565054 - DNA, 21 bp, Homo sapiens
aggaaacttctgatgtttatt

SEQ ID NO: 5565055 - DNA, 18 bp, Homo sapiens
aggaaacttggacattta

SEQ ID NO: 5565056 - DNA, 18 bp, Homo sapiens
aggaaactttatttaaat

SEQ ID NO: 5565057 - DNA, 21 bp, Homo sapiens
aggaaactttatttaaatgca

SEQ ID NO: 5565058 - DNA, 15 bp, Homo sapiens
aggaaacttttaact

SEQ ID NO: 5565059 - DNA, 21 bp, Homo sapiens
aggaaggcgtgtccaggagac

SEQ ID NO: 5565060 - DNA, 22 bp, Homo sapiens
aggaaggctctcgggtggggga

SEQ ID NO: 5565061 - DNA, 15 bp, Homo sapiens
aggaaggctctgtca

SEQ ID NO: 5565062 - DNA, 20 bp, Homo sapiens
aggaaggctcttctccccag

SEQ ID NO: 5565063 - DNA, 14 bp, Homo sapiens
aggaagggaagcgt

SEQ ID NO: 5565064 - DNA, 17 bp, Homo sapiens
aggaagggaccaaggca

SEQ ID NO: 5565065 - DNA, 15 bp, Homo sapiens
aggaagggactggtc

SEQ ID NO: 5565066 - DNA, 19 bp, Homo sapiens
aggaagggactggtccagg

SEQ ID NO: 5565067 - DNA, 15 bp, Homo sapiens
aggaagggagaggag

SEQ ID NO: 5565068 - DNA, 19 bp, Homo sapiens
aggaagggaggcctgaggg

SEQ ID NO: 5565069 - DNA, 15 bp, Homo sapiens
aggaagggagggagc

SEQ ID NO: 5565070 - DNA, 17 bp, Homo sapiens
aggaagggagggagctg

SEQ ID NO: 5565071 - DNA, 18 bp, Homo sapiens
aggaagggagggagctga

SEQ ID NO: 5565072 - DNA, 21 bp, Homo sapiens
aggaagggagggagctgaggc

SEQ ID NO: 5565073 - DNA, 15 bp, Homo sapiens
aggaagggcaggaaa

SEQ ID NO: 5565074 - DNA, 12 bp, Homo sapiens
aggaagggccag

SEQ ID NO: 5565075 - DNA, 17 bp, Homo sapiens
aggaagggccagagcct

SEQ ID NO: 5565076 - DNA, 16 bp, Homo sapiens
aggaagggccaggaga

SEQ ID NO: 5565077 - DNA, 21 bp, Homo sapiens
aggaagggccaggagagagat

SEQ ID NO: 5565078 - DNA, 23 bp, Homo sapiens
aggaagggccattttggtgctta

SEQ ID NO: 5565079 - DNA, 13 bp, Homo sapiens
aggaagggccccc

SEQ ID NO: 5565080 - DNA, 23 bp, Homo sapiens
aggaagggctgggccaccaggga

SEQ ID NO: 5565081 - DNA, 21 bp, Homo sapiens
aggaagggggtctaaggtcta

SEQ ID NO: 5565082 - DNA, 22 bp, Homo sapiens
aggaaggggtgctgtgaggctt

SEQ ID NO: 5565083 - DNA, 16 bp, Homo sapiens
aggaagggtggctttg

SEQ ID NO: 5565084 - DNA, 21 bp, Homo sapiens
aggaagggtgggaagcttgct

SEQ ID NO: 5565085 - DNA, 22 bp, Homo sapiens
aggaagggtgggaagcttgctg

SEQ ID NO: 5565086 - DNA, 14 bp, Homo sapiens
aggaaggtaaaaag

SEQ ID NO: 5565087 - DNA, 20 bp, Homo sapiens
aggaaggtcccatggcctgc

SEQ ID NO: 5565088 - DNA, 22 bp, Homo sapiens
aggaaggtcccatggcctgctg

SEQ ID NO: 5565089 - DNA, 18 bp, Homo sapiens
aggaaggtgactgtgtgt

SEQ ID NO: 5565090 - DNA, 14 bp, Homo sapiens
aggaaggtgcctgg

SEQ ID NO: 5565091 - DNA, 21 bp, Homo sapiens
aggaaggtgctgagcttagcc

SEQ ID NO: 5565092 - DNA, 17 bp, Homo sapiens
aggaagtaaaataaata

SEQ ID NO: 5565093 - DNA, 17 bp, Homo sapiens
aggaagtaagggagtca

SEQ ID NO: 5565094 - DNA, 15 bp, Homo sapiens
aggaagtactggaga

SEQ ID NO: 5565095 - DNA, 17 bp, Homo sapiens
aggaagtagatgtgaaa

SEQ ID NO: 5565096 - DNA, 16 bp, Homo sapiens
aggaagtagcacaggc

SEQ ID NO: 5565097 - DNA, 18 bp, Homo sapiens
aggaagtagcacaggctg

SEQ ID NO: 5565098 - DNA, 19 bp, Homo sapiens
aggaagtagcacaggctga

SEQ ID NO: 5565099 - DNA, 14 bp, Homo sapiens
aggaagtaggaagt

SEQ ID NO: 5565100 - DNA, 15 bp, Homo sapiens
aggaagtaggaagta

SEQ ID NO: 5565101 - DNA, 17 bp, Homo sapiens
aggaagtatcagcacta

SEQ ID NO: 5565102 - DNA, 14 bp, Homo sapiens
aggaagtcacagat

SEQ ID NO: 5565103 - DNA, 17 bp, Homo sapiens
aggaagtcaggagccag

SEQ ID NO: 5565104 - DNA, 13 bp, Homo sapiens
aggaagtccctga

SEQ ID NO: 5565105 - DNA, 19 bp, Homo sapiens
aggaagtctcatctgggga

SEQ ID NO: 5565106 - DNA, 20 bp, Homo sapiens
aggaagtctcatctggggag

SEQ ID NO: 5565107 - DNA, 15 bp, Homo sapiens
aggaagtgacttgaa

SEQ ID NO: 5565108 - DNA, 19 bp, Homo sapiens
aggaagtggctggtctgga

SEQ ID NO: 5565109 - DNA, 20 bp, Homo sapiens
aggaagtggctggtctggag

SEQ ID NO: 5565110 - DNA, 18 bp, Homo sapiens
aggaagtgggagaagtgg

SEQ ID NO: 5565111 - DNA, 21 bp, Homo sapiens
aggaagtgggagaagtggccc

SEQ ID NO: 5565112 - DNA, 20 bp, Homo sapiens
aggaagtgggggccgctggc

SEQ ID NO: 5565113 - DNA, 21 bp, Homo sapiens
aggaagtgggggccgctggcc

SEQ ID NO: 5565114 - DNA, 12 bp, Homo sapiens
aggaagtggggt

SEQ ID NO: 5565115 - DNA, 19 bp, Homo sapiens
aggaagtggggtctggcct

SEQ ID NO: 5565116 - DNA, 20 bp, Homo sapiens
aggaagtggggtctggcctg

SEQ ID NO: 5565117 - DNA, 21 bp, Homo sapiens
aggaagtgttgaagggaggtg

SEQ ID NO: 5565118 - DNA, 14 bp, Homo sapiens
aggaagttcagatc

SEQ ID NO: 5565119 - DNA, 20 bp, Homo sapiens
aggaagttcttttttgtaca

SEQ ID NO: 5565120 - DNA, 22 bp, Homo sapiens
aggaagttgctgagaaatgggg

SEQ ID NO: 5565121 - DNA, 19 bp, Homo sapiens
aggaagtttgatttttgtt

SEQ ID NO: 5565122 - DNA, 15 bp, Homo sapiens
aggaagtttggtcag

SEQ ID NO: 5565123 - DNA, 15 bp, Homo sapiens
aggaagttttctgta

SEQ ID NO: 5565124 - DNA, 16 bp, Homo sapiens
aggaagttttctgtag

SEQ ID NO: 5565125 - DNA, 22 bp, Homo sapiens
aggaagttttgcatgcaggctg

SEQ ID NO: 5565126 - DNA, 18 bp, Homo sapiens
aggaataaagcttctctc

SEQ ID NO: 5565127 - DNA, 21 bp, Homo sapiens
aggaataaagcttctctctga

SEQ ID NO: 5565128 - DNA, 16 bp, Homo sapiens
aggaataaagtttttt

SEQ ID NO: 5565129 - DNA, 20 bp, Homo sapiens
aggaataaattgctccttga

SEQ ID NO: 5565130 - DNA, 15 bp, Homo sapiens
aggaataacactgca

SEQ ID NO: 5565131 - DNA, 12 bp, Homo sapiens
aggaataagaat

SEQ ID NO: 5565132 - DNA, 15 bp, Homo sapiens
aggaataatgggctt

SEQ ID NO: 5565133 - DNA, 23 bp, Homo sapiens
aggaataatgggcttagagcagt

SEQ ID NO: 5565134 - DNA, 15 bp, Homo sapiens
aggaatacaatatat

SEQ ID NO: 5565135 - DNA, 15 bp, Homo sapiens
aggaatacattttat

SEQ ID NO: 5565136 - DNA, 17 bp, Homo sapiens
aggaatagaggaagaaa

SEQ ID NO: 5565137 - DNA, 20 bp, Homo sapiens
aggaatagaggaagaaatgt

SEQ ID NO: 5565138 - DNA, 17 bp, Homo sapiens
aggaatagccagagagg

SEQ ID NO: 5565139 - DNA, 16 bp, Homo sapiens
aggaatagctttgtat

SEQ ID NO: 5565140 - DNA, 21 bp, Homo sapiens
aggaatagtggacatggtcac

SEQ ID NO: 5565141 - DNA, 21 bp, Homo sapiens
aggaatatatatggaataagt

SEQ ID NO: 5565142 - DNA, 17 bp, Homo sapiens
aggaatatatgtgtgcc

SEQ ID NO: 5565143 - DNA, 21 bp, Homo sapiens
aggaatatccagtcaaagacg

SEQ ID NO: 5565144 - DNA, 20 bp, Homo sapiens
aggaatatctgttcccagcc

SEQ ID NO: 5565145 - DNA, 21 bp, Homo sapiens
aggaatatctgttcccagccc

SEQ ID NO: 5565146 - DNA, 17 bp, Homo sapiens
aggaatatgactcagga

SEQ ID NO: 5565147 - DNA, 17 bp, Homo sapiens
aggaatattatatttgg

SEQ ID NO: 5565148 - DNA, 19 bp, Homo sapiens
aggaatattatatttggat

SEQ ID NO: 5565149 - DNA, 22 bp, Homo sapiens
aggaatatttcctccattcctg

SEQ ID NO: 5565150 - DNA, 16 bp, Homo sapiens
aggaatattttccaaa

SEQ ID NO: 5565151 - DNA, 20 bp, Homo sapiens
aggaatattttccaaagagt

SEQ ID NO: 5565152 - DNA, 17 bp, Homo sapiens
aggaatcaacagggcag

SEQ ID NO: 5565153 - DNA, 21 bp, Homo sapiens
aggaatcaagagctgccctcc

SEQ ID NO: 5565154 - DNA, 15 bp, Homo sapiens
aggaatcaattattt

SEQ ID NO: 5565155 - DNA, 16 bp, Homo sapiens
aggaatcacccctctg

SEQ ID NO: 5565156 - DNA, 18 bp, Homo sapiens
aggaatcacccctctgcc

SEQ ID NO: 5565157 - DNA, 21 bp, Homo sapiens
aggaatcacccctctgcccct

SEQ ID NO: 5565158 - DNA, 22 bp, Homo sapiens
aggaatcacccctctgcccctg

SEQ ID NO: 5565159 - DNA, 15 bp, Homo sapiens
aggaatcactcttgt

SEQ ID NO: 5565160 - DNA, 16 bp, Homo sapiens
aggaatcactggggat

SEQ ID NO: 5565161 - DNA, 18 bp, Homo sapiens
aggaatcactggggatgg

SEQ ID NO: 5565162 - DNA, 22 bp, Homo sapiens
aggaatcactggggatggtggc

SEQ ID NO: 5565163 - DNA, 22 bp, Homo sapiens
aggaatcagcaagaagatccta

SEQ ID NO: 5565164 - DNA, 14 bp, Homo sapiens
aggaatcagctgca

SEQ ID NO: 5565165 - DNA, 23 bp, Homo sapiens
aggaatcatctcctttgcagaat

SEQ ID NO: 5565166 - DNA, 23 bp, Homo sapiens
aggaatcatgtcaggcctgtgtg

SEQ ID NO: 5565167 - DNA, 21 bp, Homo sapiens
aggaatccaaaagacaaaaat

SEQ ID NO: 5565168 - DNA, 21 bp, Homo sapiens
aggaatccactcccaggcagc

SEQ ID NO: 5565169 - DNA, 22 bp, Homo sapiens
aggaatccatcctgcaaaggcc

SEQ ID NO: 5565170 - DNA, 16 bp, Homo sapiens
aggaatcccggctcca

SEQ ID NO: 5565171 - DNA, 18 bp, Homo sapiens
aggaatcctagcacttgt

SEQ ID NO: 5565172 - DNA, 21 bp, Homo sapiens
aggaatcctagcacttgtctc

SEQ ID NO: 5565173 - DNA, 23 bp, Homo sapiens
aggaatcctagcacttgtctcag

SEQ ID NO: 5565174 - DNA, 17 bp, Homo sapiens
aggaatcctggattttg

SEQ ID NO: 5565175 - DNA, 15 bp, Homo sapiens
aggaatccttactga

SEQ ID NO: 5565176 - DNA, 12 bp, Homo sapiens
aggaatcctttg

SEQ ID NO: 5565177 - DNA, 23 bp, Homo sapiens
aggaatcctttgagaatgtgatt

SEQ ID NO: 5565178 - DNA, 20 bp, Homo sapiens
aggaatcgaggaaccagagc

SEQ ID NO: 5565179 - DNA, 22 bp, Homo sapiens
aggaatcgtttttgctgcagag

SEQ ID NO: 5565180 - DNA, 15 bp, Homo sapiens
aggaatctcagagac

SEQ ID NO: 5565181 - DNA, 16 bp, Homo sapiens
aggaatctcagagaca

SEQ ID NO: 5565182 - DNA, 15 bp, Homo sapiens
aggaatctcttcact

SEQ ID NO: 5565183 - DNA, 14 bp, Homo sapiens
aggaatctgccttc

SEQ ID NO: 5565184 - DNA, 17 bp, Homo sapiens
aggaatctgccttccag

SEQ ID NO: 5565185 - DNA, 18 bp, Homo sapiens
aggaatctgtttctctgc

SEQ ID NO: 5565186 - DNA, 22 bp, Homo sapiens
aggaatctgtttctctgctgtc

SEQ ID NO: 5565187 - DNA, 18 bp, Homo sapiens
aggaatcttgctccaata

SEQ ID NO: 5565188 - DNA, 16 bp, Homo sapiens
aggaatctttaagcag

SEQ ID NO: 5565189 - DNA, 16 bp, Homo sapiens
aggaatcttttactgt

SEQ ID NO: 5565190 - DNA, 16 bp, Homo sapiens
aggaatgaaaaaagct

SEQ ID NO: 5565191 - DNA, 13 bp, Homo sapiens
aggaatgaagata

SEQ ID NO: 5565192 - DNA, 21 bp, Homo sapiens
aggaatgaccacgggcctcag

SEQ ID NO: 5565193 - DNA, 20 bp, Homo sapiens
aggaatgactcatgcctctg

SEQ ID NO: 5565194 - DNA, 22 bp, Homo sapiens
aggaatgagtcaatcagccttt

SEQ ID NO: 5565195 - DNA, 14 bp, Homo sapiens
aggaatgatcctag

SEQ ID NO: 5565196 - DNA, 18 bp, Homo sapiens
aggaatgcaagagaagga

SEQ ID NO: 5565197 - DNA, 13 bp, Homo sapiens
aggaatgcaatat

SEQ ID NO: 5565198 - DNA, 24 bp, Homo sapiens
aggaatgcctcctccctgggcaga

SEQ ID NO: 5565199 - DNA, 21 bp, Homo sapiens
aggaatgcctgtgccaataaa

SEQ ID NO: 5565200 - DNA, 16 bp, Homo sapiens
aggaatgcctgtgtga

SEQ ID NO: 5565201 - DNA, 20 bp, Homo sapiens
aggaatgcggttgggaggca

SEQ ID NO: 5565202 - DNA, 22 bp, Homo sapiens
aggaatgcggttgggaggcagg

SEQ ID NO: 5565203 - DNA, 20 bp, Homo sapiens
aggaatgctaacagttcact

SEQ ID NO: 5565204 - DNA, 22 bp, Homo sapiens
aggaatgctaacagttcacttg

SEQ ID NO: 5565205 - DNA, 16 bp, Homo sapiens
aggaatgctcaatgtg

SEQ ID NO: 5565206 - DNA, 17 bp, Homo sapiens
aggaatgctcaatgtgc

SEQ ID NO: 5565207 - DNA, 21 bp, Homo sapiens
aggaatgctcaatgtgctgtt

SEQ ID NO: 5565208 - DNA, 15 bp, Homo sapiens
aggaatgctccccca

SEQ ID NO: 5565209 - DNA, 21 bp, Homo sapiens
aggaatgctgacaatgctgcc

SEQ ID NO: 5565210 - DNA, 15 bp, Homo sapiens
aggaatgctggactg

SEQ ID NO: 5565211 - DNA, 14 bp, Homo sapiens
aggaatgctgggcc

SEQ ID NO: 5565212 - DNA, 16 bp, Homo sapiens
aggaatgcttggaata

SEQ ID NO: 5565213 - DNA, 20 bp, Homo sapiens
aggaatgcttggaatatctg

SEQ ID NO: 5565214 - DNA, 23 bp, Homo sapiens
aggaatggaatcttctccagtat

SEQ ID NO: 5565215 - DNA, 17 bp, Homo sapiens
aggaatggacatttcta

SEQ ID NO: 5565216 - DNA, 23 bp, Homo sapiens
aggaatggagcctgcacggtgaa

SEQ ID NO: 5565217 - DNA, 22 bp, Homo sapiens
aggaatggaggagccaggcccc

SEQ ID NO: 5565218 - DNA, 22 bp, Homo sapiens
aggaatggaggccatatttcca

SEQ ID NO: 5565219 - DNA, 21 bp, Homo sapiens
aggaatggaggctctaattga

SEQ ID NO: 5565220 - DNA, 22 bp, Homo sapiens
aggaatggctgcaagagcccag

SEQ ID NO: 5565221 - DNA, 20 bp, Homo sapiens
aggaatgggggcctcttcaa

SEQ ID NO: 5565222 - DNA, 21 bp, Homo sapiens
aggaatggggggcgggccagg

SEQ ID NO: 5565223 - DNA, 16 bp, Homo sapiens
aggaatgggggtcaga

SEQ ID NO: 5565224 - DNA, 15 bp, Homo sapiens
aggaatgtagggcct

SEQ ID NO: 5565225 - DNA, 15 bp, Homo sapiens
aggaatgtctttggt

SEQ ID NO: 5565226 - DNA, 16 bp, Homo sapiens
aggaatgtgggctatg

SEQ ID NO: 5565227 - DNA, 14 bp, Homo sapiens
aggaatgtgtccaa

SEQ ID NO: 5565228 - DNA, 18 bp, Homo sapiens
aggaatgtgtccaagaca

SEQ ID NO: 5565229 - DNA, 14 bp, Homo sapiens
aggaatgtgtgcct

SEQ ID NO: 5565230 - DNA, 19 bp, Homo sapiens
aggaatgtgtgccttgttc

SEQ ID NO: 5565231 - DNA, 12 bp, Homo sapiens
aggaatgtttca

SEQ ID NO: 5565232 - DNA, 21 bp, Homo sapiens
aggaattaccaagaatatcct

SEQ ID NO: 5565233 - DNA, 16 bp, Homo sapiens
aggaattacgtgctct

SEQ ID NO: 5565234 - DNA, 14 bp, Homo sapiens
aggacgcttctgaa

SEQ ID NO: 5565235 - DNA, 16 bp, Homo sapiens
aggacggagttcagag

SEQ ID NO: 5565236 - DNA, 21 bp, Homo sapiens
aggacggcaaggctgaggtgg

SEQ ID NO: 5565237 - DNA, 17 bp, Homo sapiens
aggacggccctgcctgc

SEQ ID NO: 5565238 - DNA, 18 bp, Homo sapiens
aggacggccctgcctgcc

SEQ ID NO: 5565239 - DNA, 22 bp, Homo sapiens
aggacggccctgcctgcctctt

SEQ ID NO: 5565240 - DNA, 13 bp, Homo sapiens
aggacgggccaca

SEQ ID NO: 5565241 - DNA, 23 bp, Homo sapiens
aggacgggccacacgtggctggc

SEQ ID NO: 5565242 - DNA, 15 bp, Homo sapiens
aggacggggcagagc

SEQ ID NO: 5565243 - DNA, 17 bp, Homo sapiens
aggacggggcagagctg

SEQ ID NO: 5565244 - DNA, 15 bp, Homo sapiens
aggacggggccggcc

SEQ ID NO: 5565245 - DNA, 17 bp, Homo sapiens
aggacggtctgtgcccg

SEQ ID NO: 5565246 - DNA, 22 bp, Homo sapiens
aggacggtgccaagggccccag

SEQ ID NO: 5565247 - DNA, 14 bp, Homo sapiens
aggacgtaaaattt

SEQ ID NO: 5565248 - DNA, 22 bp, Homo sapiens
aggacgtatttataataggtat

SEQ ID NO: 5565249 - DNA, 22 bp, Homo sapiens
aggacgtccttccatatccctg

SEQ ID NO: 5565250 - DNA, 16 bp, Homo sapiens
aggacgtgaagcctcc

SEQ ID NO: 5565251 - DNA, 22 bp, Homo sapiens
aggacgtggatgaccctcccct

SEQ ID NO: 5565252 - DNA, 14 bp, Homo sapiens
aggacgtgggcggc

SEQ ID NO: 5565253 - DNA, 19 bp, Homo sapiens
aggacgtgggctgggccca

SEQ ID NO: 5565254 - DNA, 14 bp, Homo sapiens
aggacgttggcctc

SEQ ID NO: 5565255 - DNA, 22 bp, Homo sapiens
aggactaacactcagaagcctg

SEQ ID NO: 5565256 - DNA, 23 bp, Homo sapiens
aggactaacactcagaagcctgg

SEQ ID NO: 5565257 - DNA, 17 bp, Homo sapiens
aggactaatagaaaagt

SEQ ID NO: 5565258 - DNA, 17 bp, Homo sapiens
aggactaatgcatgtgg

SEQ ID NO: 5565259 - DNA, 11 bp, Homo sapiens
aggactacaga

SEQ ID NO: 5565260 - DNA, 16 bp, Homo sapiens
aggactaccgcaggcc

SEQ ID NO: 5565261 - DNA, 22 bp, Homo sapiens
aggactaccgcaggcccggact

SEQ ID NO: 5565262 - DNA, 19 bp, Homo sapiens
aggactacgttaagggaag

SEQ ID NO: 5565263 - DNA, 17 bp, Homo sapiens
aggactagaacctggag

SEQ ID NO: 5565264 - DNA, 22 bp, Homo sapiens
aggactagaacctggagggctg

SEQ ID NO: 5565265 - DNA, 21 bp, Homo sapiens
aggactagaagattagaaact

SEQ ID NO: 5565266 - DNA, 22 bp, Homo sapiens
aggactagagcacaacataatt

SEQ ID NO: 5565267 - DNA, 17 bp, Homo sapiens
aggactaggcatgtcag

SEQ ID NO: 5565268 - DNA, 16 bp, Homo sapiens
aggactatattaatca

SEQ ID NO: 5565269 - DNA, 16 bp, Homo sapiens
aggactatgggtacat

SEQ ID NO: 5565270 - DNA, 15 bp, Homo sapiens
aggactattatgtgg

SEQ ID NO: 5565271 - DNA, 23 bp, Homo sapiens
aggactattatgtggaataatac

SEQ ID NO: 5565272 - DNA, 17 bp, Homo sapiens
aggactcaacattacat

SEQ ID NO: 5565273 - DNA, 13 bp, Homo sapiens
aggactcagctcc

SEQ ID NO: 5565274 - DNA, 17 bp, Homo sapiens
aggactcagctccccag

SEQ ID NO: 5565275 - DNA, 18 bp, Homo sapiens
aggactcagctccccaga

SEQ ID NO: 5565276 - DNA, 14 bp, Homo sapiens
aggactcaggcctg

SEQ ID NO: 5565277 - DNA, 18 bp, Homo sapiens
aggactcaggcctgccaa

SEQ ID NO: 5565278 - DNA, 19 bp, Homo sapiens
aggactcaggcctgccaat

SEQ ID NO: 5565279 - DNA, 16 bp, Homo sapiens
aggactccactggaca

SEQ ID NO: 5565280 - DNA, 18 bp, Homo sapiens
aggactccactggacaga

SEQ ID NO: 5565281 - DNA, 22 bp, Homo sapiens
aggactccactggacagaccca

SEQ ID NO: 5565282 - DNA, 18 bp, Homo sapiens
aggactccaggcagcaga

SEQ ID NO: 5565283 - DNA, 19 bp, Homo sapiens
aggactccaggcagcagac

SEQ ID NO: 5565284 - DNA, 19 bp, Homo sapiens
aggactccatttctttctt

SEQ ID NO: 5565285 - DNA, 20 bp, Homo sapiens
aggactcccaaccctggctt

SEQ ID NO: 5565286 - DNA, 12 bp, Homo sapiens
aggactcccaga

SEQ ID NO: 5565287 - DNA, 14 bp, Homo sapiens
aggactcccagaac

SEQ ID NO: 5565288 - DNA, 16 bp, Homo sapiens
aggactcccagaacct

SEQ ID NO: 5565289 - DNA, 18 bp, Homo sapiens
aggactcccagaacctct

SEQ ID NO: 5565290 - DNA, 18 bp, Homo sapiens
aggactccccaggccagg

SEQ ID NO: 5565291 - DNA, 20 bp, Homo sapiens
aggactccccaggccaggcc

SEQ ID NO: 5565292 - DNA, 21 bp, Homo sapiens
aggactcccggagcctgtgca

SEQ ID NO: 5565293 - DNA, 16 bp, Homo sapiens
aggactccctcctcac

SEQ ID NO: 5565294 - DNA, 17 bp, Homo sapiens
aggactccctcctcacc

SEQ ID NO: 5565295 - DNA, 22 bp, Homo sapiens
aggactcctccccaccctcctg

SEQ ID NO: 5565296 - DNA, 17 bp, Homo sapiens
aggactccttaaatttg

SEQ ID NO: 5565297 - DNA, 16 bp, Homo sapiens
aggactcggccactgt

SEQ ID NO: 5565298 - DNA, 18 bp, Homo sapiens
aggactcggccactgtgt

SEQ ID NO: 5565299 - DNA, 21 bp, Homo sapiens
aggactcggccactgtgtctc

SEQ ID NO: 5565300 - DNA, 23 bp, Homo sapiens
aggactcgggctaagtccagctc

SEQ ID NO: 5565301 - DNA, 17 bp, Homo sapiens
aggactctagaagctca

SEQ ID NO: 5565302 - DNA, 20 bp, Homo sapiens
aggactctagaagctcaggt

SEQ ID NO: 5565303 - DNA, 15 bp, Homo sapiens
aggactctctccagg

SEQ ID NO: 5565304 - DNA, 16 bp, Homo sapiens
aggactctctccagga

SEQ ID NO: 5565305 - DNA, 18 bp, Homo sapiens
aggactctctccaggagg

SEQ ID NO: 5565306 - DNA, 19 bp, Homo sapiens
aggactctctccaggaggg

SEQ ID NO: 5565307 - DNA, 21 bp, Homo sapiens
aggactctctccaggagggct

SEQ ID NO: 5565308 - DNA, 14 bp, Homo sapiens
aggactctctttct

SEQ ID NO: 5565309 - DNA, 14 bp, Homo sapiens
aggactctgaggct

SEQ ID NO: 5565310 - DNA, 16 bp, Homo sapiens
aggactctgcagcctc

SEQ ID NO: 5565311 - DNA, 17 bp, Homo sapiens
aggactctgcagcctca

SEQ ID NO: 5565312 - DNA, 18 bp, Homo sapiens
aggactctgccccttctg

SEQ ID NO: 5565313 - DNA, 14 bp, Homo sapiens
aggactctgcctcc

SEQ ID NO: 5565314 - DNA, 16 bp, Homo sapiens
aggactctgcctcctc

SEQ ID NO: 5565315 - DNA, 18 bp, Homo sapiens
aggactctgcctcctctt

SEQ ID NO: 5565316 - DNA, 12 bp, Homo sapiens
aggactctgcgg

SEQ ID NO: 5565317 - DNA, 17 bp, Homo sapiens
aggactctgcttaaaca

SEQ ID NO: 5565318 - DNA, 20 bp, Homo sapiens
aggactctgcttaaacaaag

SEQ ID NO: 5565319 - DNA, 12 bp, Homo sapiens
aggactctggaa

SEQ ID NO: 5565320 - DNA, 21 bp, Homo sapiens
aggactcttccatcagagatg

SEQ ID NO: 5565321 - DNA, 19 bp, Homo sapiens
aggactctttccgactgcc

SEQ ID NO: 5565322 - DNA, 20 bp, Homo sapiens
aggactctttccgactgccc

SEQ ID NO: 5565323 - DNA, 12 bp, Homo sapiens
aggactctttga

SEQ ID NO: 5565324 - DNA, 23 bp, Homo sapiens
aggactgaaagaagaaaacagta

SEQ ID NO: 5565325 - DNA, 14 bp, Homo sapiens
aggactgaactcca

SEQ ID NO: 5565326 - DNA, 16 bp, Homo sapiens
aggactgaagaaaatc

SEQ ID NO: 5565327 - DNA, 20 bp, Homo sapiens
aggactgaattgtccccagt

SEQ ID NO: 5565328 - DNA, 14 bp, Homo sapiens
aggactgacctgcc

SEQ ID NO: 5565329 - DNA, 22 bp, Homo sapiens
aggactgactgaggcagtttga

SEQ ID NO: 5565330 - DNA, 12 bp, Homo sapiens
aggactgagccc

SEQ ID NO: 5565331 - DNA, 15 bp, Homo sapiens
aggactgagccccca

SEQ ID NO: 5565332 - DNA, 16 bp, Homo sapiens
aggactgagccccgca

SEQ ID NO: 5565333 - DNA, 24 bp, Homo sapiens
aggactgagccccgcagacctccc

SEQ ID NO: 5565334 - DNA, 13 bp, Homo sapiens
aggactgagccct

SEQ ID NO: 5565335 - DNA, 17 bp, Homo sapiens
aggactgagccctctca

SEQ ID NO: 5565336 - DNA, 12 bp, Homo sapiens
aggactgagggc

SEQ ID NO: 5565337 - DNA, 14 bp, Homo sapiens
aggactgagggcag

SEQ ID NO: 5565338 - DNA, 22 bp, Homo sapiens
aggactgagtcccctccaggaa

SEQ ID NO: 5565339 - DNA, 17 bp, Homo sapiens
aggactgatgtctccta

SEQ ID NO: 5565340 - DNA, 20 bp, Homo sapiens
aggactgatgtctcctaagc

SEQ ID NO: 5565341 - DNA, 18 bp, Homo sapiens
aggactgatttcagagtg

SEQ ID NO: 5565342 - DNA, 21 bp, Homo sapiens
aggactgcacagcgtcctgtc

SEQ ID NO: 5565343 - DNA, 20 bp, Homo sapiens
aggactgcaccattgctgct

SEQ ID NO: 5565344 - DNA, 15 bp, Homo sapiens
aggactgcagacagg

SEQ ID NO: 5565345 - DNA, 20 bp, Homo sapiens
aggactgcagagcagatggc

SEQ ID NO: 5565346 - DNA, 17 bp, Homo sapiens
aggactgcagagggctc

SEQ ID NO: 5565347 - DNA, 13 bp, Homo sapiens
aggactgcagtgt

SEQ ID NO: 5565348 - DNA, 18 bp, Homo sapiens
aggactgccccgtgcaga

SEQ ID NO: 5565349 - DNA, 16 bp, Homo sapiens
aggactggaaaaatga

SEQ ID NO: 5565350 - DNA, 19 bp, Homo sapiens
aggactggaaaaatgaact

SEQ ID NO: 5565351 - DNA, 23 bp, Homo sapiens
aggactggaaaaatgaactgtat

SEQ ID NO: 5565352 - DNA, 16 bp, Homo sapiens
aggactggagaccgct

SEQ ID NO: 5565353 - DNA, 16 bp, Homo sapiens
aggactggccgtggct

SEQ ID NO: 5565354 - DNA, 12 bp, Homo sapiens
aggactggctca

SEQ ID NO: 5565355 - DNA, 16 bp, Homo sapiens
aggactggctcacccc

SEQ ID NO: 5565356 - DNA, 18 bp, Homo sapiens
aggactgggagcccccag

SEQ ID NO: 5565357 - DNA, 21 bp, Homo sapiens
aggactgggagcccccagcct

SEQ ID NO: 5565358 - DNA, 15 bp, Homo sapiens
aggactgggccactt

SEQ ID NO: 5565359 - DNA, 15 bp, Homo sapiens
aggactgggccgggc

SEQ ID NO: 5565360 - DNA, 22 bp, Homo sapiens
aggactgggccgggcccagggc

SEQ ID NO: 5565361 - DNA, 17 bp, Homo sapiens
aggactgggtctgacct

SEQ ID NO: 5565362 - DNA, 18 bp, Homo sapiens
aggactgggtctgacctg

SEQ ID NO: 5565363 - DNA, 22 bp, Homo sapiens
aggactgggtctgacctggtgg

SEQ ID NO: 5565364 - DNA, 23 bp, Homo sapiens
aggactggtgaatataaatgatg

SEQ ID NO: 5565365 - DNA, 14 bp, Homo sapiens
aggactggtgcctg

SEQ ID NO: 5565366 - DNA, 15 bp, Homo sapiens
aggactggttccttc

SEQ ID NO: 5565367 - DNA, 22 bp, Homo sapiens
aggactggttccttccttagtt

SEQ ID NO: 5565368 - DNA, 22 bp, Homo sapiens
aggactggttctgaggccagaa

SEQ ID NO: 5565369 - DNA, 15 bp, Homo sapiens
aggactgtaaagatt

SEQ ID NO: 5565370 - DNA, 16 bp, Homo sapiens
aggactgtatttgtga

SEQ ID NO: 5565371 - DNA, 17 bp, Homo sapiens
aggactgtatttgtgac

SEQ ID NO: 5565372 - DNA, 23 bp, Homo sapiens
aggactgtccccttgaaggagaa

SEQ ID NO: 5565373 - DNA, 21 bp, Homo sapiens
aggactgtcctcccacagacc

SEQ ID NO: 5565374 - DNA, 22 bp, Homo sapiens
aggactgtcctcccacagacct

SEQ ID NO: 5565375 - DNA, 21 bp, Homo sapiens
aggactgtgacaggcagcaga

SEQ ID NO: 5565376 - DNA, 14 bp, Homo sapiens
aggactgtgaccaa

SEQ ID NO: 5565377 - DNA, 16 bp, Homo sapiens
aggactgtgaccaaag

SEQ ID NO: 5565378 - DNA, 18 bp, Homo sapiens
aggactgtgaccaaagca

SEQ ID NO: 5565379 - DNA, 19 bp, Homo sapiens
aggactgtgaccaaagcat

SEQ ID NO: 5565380 - DNA, 21 bp, Homo sapiens
aggactgtgatgccctgccct

SEQ ID NO: 5565381 - DNA, 12 bp, Homo sapiens
aggactgtgcct

SEQ ID NO: 5565382 - DNA, 14 bp, Homo sapiens
aggactgtggaggg

SEQ ID NO: 5565383 - DNA, 16 bp, Homo sapiens
aggactgtggagggga

SEQ ID NO: 5565384 - DNA, 23 bp, Homo sapiens
aggactgtggcgactctgcagag

SEQ ID NO: 5565385 - DNA, 14 bp, Homo sapiens
aggactgttctaac

SEQ ID NO: 5565386 - DNA, 17 bp, Homo sapiens
aggactgttctttgctg

SEQ ID NO: 5565387 - DNA, 23 bp, Homo sapiens
aggactgttggctgattggaaaa

SEQ ID NO: 5565388 - DNA, 13 bp, Homo sapiens
aggactgttgtgg

SEQ ID NO: 5565389 - DNA, 19 bp, Homo sapiens
aggactgtttcaaacatgc

SEQ ID NO: 5565390 - DNA, 21 bp, Homo sapiens
aggacttaaaattagtctttt

SEQ ID NO: 5565391 - DNA, 18 bp, Homo sapiens
aggacttaacggctccag

SEQ ID NO: 5565392 - DNA, 23 bp, Homo sapiens
aggacttaagacaaatgggactg

SEQ ID NO: 5565393 - DNA, 20 bp, Homo sapiens
aggacttagccgactgcgct

SEQ ID NO: 5565394 - DNA, 22 bp, Homo sapiens
aggacttcaaaaggtgattaaa

SEQ ID NO: 5565395 - DNA, 16 bp, Homo sapiens
aggacttccacatttt

SEQ ID NO: 5565396 - DNA, 15 bp, Homo sapiens
aggacttccatctgt

SEQ ID NO: 5565397 - DNA, 20 bp, Homo sapiens
aggacttccccggagggctg

SEQ ID NO: 5565398 - DNA, 23 bp, Homo sapiens
aggacttcctgctacagtagctg

SEQ ID NO: 5565399 - DNA, 20 bp, Homo sapiens
aggacttcctgtccagctcc

SEQ ID NO: 5565400 - DNA, 20 bp, Homo sapiens
aggacttcggggtagaggct

SEQ ID NO: 5565401 - DNA, 16 bp, Homo sapiens
aggacttgaaagcatc

SEQ ID NO: 5565402 - DNA, 19 bp, Homo sapiens
aggacttgaaagcatccat

SEQ ID NO: 5565403 - DNA, 23 bp, Homo sapiens
aggacttggagagaatcatgctg

SEQ ID NO: 5565404 - DNA, 22 bp, Homo sapiens
aggacttggagggtctgggggc

SEQ ID NO: 5565405 - DNA, 16 bp, Homo sapiens
aggacttggtctgatt

SEQ ID NO: 5565406 - DNA, 23 bp, Homo sapiens
aggacttggtctgatttcaggat

SEQ ID NO: 5565407 - DNA, 22 bp, Homo sapiens
aggacttggtcttttttctggg

SEQ ID NO: 5565408 - DNA, 23 bp, Homo sapiens
aggacttggtgattacctgaaag

SEQ ID NO: 5565409 - DNA, 11 bp, Homo sapiens
aggagcctggc

SEQ ID NO: 5565410 - DNA, 13 bp, Homo sapiens
aggagcctggcca

SEQ ID NO: 5565411 - DNA, 12 bp, Homo sapiens
aggagcctgtcc

SEQ ID NO: 5565412 - DNA, 17 bp, Homo sapiens
aggagcctgtcctgcct

SEQ ID NO: 5565413 - DNA, 19 bp, Homo sapiens
aggagcctgtcctgcctgt

SEQ ID NO: 5565414 - DNA, 21 bp, Homo sapiens
aggagcctgtcctgcctgtgg

SEQ ID NO: 5565415 - DNA, 11 bp, Homo sapiens
aggagcctgtg

SEQ ID NO: 5565416 - DNA, 13 bp, Homo sapiens
aggagcctgtgaa

SEQ ID NO: 5565417 - DNA, 18 bp, Homo sapiens
aggagcctgtgaacccag

SEQ ID NO: 5565418 - DNA, 22 bp, Homo sapiens
aggagcctgtgaacccaggaca

SEQ ID NO: 5565419 - DNA, 12 bp, Homo sapiens
aggagcctgtgc

SEQ ID NO: 5565420 - DNA, 20 bp, Homo sapiens
aggagcctgtgcgtcccagc

SEQ ID NO: 5565421 - DNA, 22 bp, Homo sapiens
aggagcctgtgcgtcccagctg

SEQ ID NO: 5565422 - DNA, 21 bp, Homo sapiens
aggagccttcctttctcctgc

SEQ ID NO: 5565423 - DNA, 11 bp, Homo sapiens
aggagccttga

SEQ ID NO: 5565424 - DNA, 16 bp, Homo sapiens
aggagccttgagtctg

SEQ ID NO: 5565425 - DNA, 22 bp, Homo sapiens
aggagccttgataatacttgac

SEQ ID NO: 5565426 - DNA, 13 bp, Homo sapiens
aggagccttgctg

SEQ ID NO: 5565427 - DNA, 14 bp, Homo sapiens
aggagccttgctgg

SEQ ID NO: 5565428 - DNA, 20 bp, Homo sapiens
aggagccttgctgggccagg

SEQ ID NO: 5565429 - DNA, 21 bp, Homo sapiens
aggagccttgctgggccaggg

SEQ ID NO: 5565430 - DNA, 19 bp, Homo sapiens
aggagcctttttaaaacac

SEQ ID NO: 5565431 - DNA, 15 bp, Homo sapiens
aggagcgagcatgtc

SEQ ID NO: 5565432 - DNA, 14 bp, Homo sapiens
aggagcgcatctca

SEQ ID NO: 5565433 - DNA, 16 bp, Homo sapiens
aggagcgctagtgcct

SEQ ID NO: 5565434 - DNA, 21 bp, Homo sapiens
aggagcgctagtgccttgccc

SEQ ID NO: 5565435 - DNA, 15 bp, Homo sapiens
aggagcggcgccctg

SEQ ID NO: 5565436 - DNA, 18 bp, Homo sapiens
aggagcgggacctgtggc

SEQ ID NO: 5565437 - DNA, 17 bp, Homo sapiens
aggagcgggcagggccg

SEQ ID NO: 5565438 - DNA, 21 bp, Homo sapiens
aggagcgtggactctgctaga

SEQ ID NO: 5565439 - DNA, 22 bp, Homo sapiens
aggagcgtggactctgctagac

SEQ ID NO: 5565440 - DNA, 14 bp, Homo sapiens
aggagcgtgtccta

SEQ ID NO: 5565441 - DNA, 15 bp, Homo sapiens
aggagcgtgtcctat

SEQ ID NO: 5565442 - DNA, 15 bp, Homo sapiens
aggagctaaggctct

SEQ ID NO: 5565443 - DNA, 16 bp, Homo sapiens
aggagctaaggctcta

SEQ ID NO: 5565444 - DNA, 21 bp, Homo sapiens
aggagctaaggctctatgagt

SEQ ID NO: 5565445 - DNA, 23 bp, Homo sapiens
aggagctacctgtgtggacagga

SEQ ID NO: 5565446 - DNA, 18 bp, Homo sapiens
aggagctagcccagtccc

SEQ ID NO: 5565447 - DNA, 24 bp, Homo sapiens
aggagctagcccagtccctggagc

SEQ ID NO: 5565448 - DNA, 15 bp, Homo sapiens
aggagctcaactaaa

SEQ ID NO: 5565449 - DNA, 16 bp, Homo sapiens
aggagctcaccctgcc

SEQ ID NO: 5565450 - DNA, 14 bp, Homo sapiens
aggagctccagtgt

SEQ ID NO: 5565451 - DNA, 20 bp, Homo sapiens
aggagctcccctccccaact

SEQ ID NO: 5565452 - DNA, 17 bp, Homo sapiens
aggagctcccctgtttg

SEQ ID NO: 5565453 - DNA, 15 bp, Homo sapiens
aggagctcccttttt

SEQ ID NO: 5565454 - DNA, 16 bp, Homo sapiens
aggagctcctggaagc

SEQ ID NO: 5565455 - DNA, 19 bp, Homo sapiens
aggagctctaccctgctcc

SEQ ID NO: 5565456 - DNA, 21 bp, Homo sapiens
aggagctctgcgccaggcaga

SEQ ID NO: 5565457 - DNA, 20 bp, Homo sapiens
aggagctcttcttgtgaaat

SEQ ID NO: 5565458 - DNA, 22 bp, Homo sapiens
aggagctcttcttgtgaaatgt

SEQ ID NO: 5565459 - DNA, 23 bp, Homo sapiens
aggagctgagaatagaaggaaac

SEQ ID NO: 5565460 - DNA, 14 bp, Homo sapiens
aggagctgagggag

SEQ ID NO: 5565461 - DNA, 19 bp, Homo sapiens
aggagctgagggagggagc

SEQ ID NO: 5565462 - DNA, 21 bp, Homo sapiens
aggagctgagggagggagcca

SEQ ID NO: 5565463 - DNA, 18 bp, Homo sapiens
aggagctgagtcacctcc

SEQ ID NO: 5565464 - DNA, 12 bp, Homo sapiens
aggagctgatgg

SEQ ID NO: 5565465 - DNA, 19 bp, Homo sapiens
aggagctgatttccaggcc

SEQ ID NO: 5565466 - DNA, 22 bp, Homo sapiens
aggagctgatttccaggcccct

SEQ ID NO: 5565467 - DNA, 23 bp, Homo sapiens
aggagctgatttccaggcccctg

SEQ ID NO: 5565468 - DNA, 13 bp, Homo sapiens
aggagctgcagtt

SEQ ID NO: 5565469 - DNA, 20 bp, Homo sapiens
aggagctgccgcaaggccct

SEQ ID NO: 5565470 - DNA, 16 bp, Homo sapiens
aggagctgcctggacc

SEQ ID NO: 5565471 - DNA, 18 bp, Homo sapiens
aggagctgcctggacccg

SEQ ID NO: 5565472 - DNA, 21 bp, Homo sapiens
aggagctgccttggctcagac

SEQ ID NO: 5565473 - DNA, 22 bp, Homo sapiens
aggagctgccttggctcagaca

SEQ ID NO: 5565474 - DNA, 20 bp, Homo sapiens
aggagctgctatagcctggg

SEQ ID NO: 5565475 - DNA, 13 bp, Homo sapiens
aggagctgctggc

SEQ ID NO: 5565476 - DNA, 16 bp, Homo sapiens
aggagctggaggggtg

SEQ ID NO: 5565477 - DNA, 12 bp, Homo sapiens
aggagctggcct

SEQ ID NO: 5565478 - DNA, 13 bp, Homo sapiens
aggagctggcctg

SEQ ID NO: 5565479 - DNA, 14 bp, Homo sapiens
aggagctggcctgc

SEQ ID NO: 5565480 - DNA, 15 bp, Homo sapiens
aggagctggcctgtg

SEQ ID NO: 5565481 - DNA, 17 bp, Homo sapiens
aggagctggctggcagg

SEQ ID NO: 5565482 - DNA, 18 bp, Homo sapiens
aggagctgggagccgggc

SEQ ID NO: 5565483 - DNA, 17 bp, Homo sapiens
aggagctgggaggaaaa

SEQ ID NO: 5565484 - DNA, 18 bp, Homo sapiens
aggagctgggatcctaag

SEQ ID NO: 5565485 - DNA, 17 bp, Homo sapiens
aggagctggggagggag

SEQ ID NO: 5565486 - DNA, 21 bp, Homo sapiens
aggagctggggatccctcccc

SEQ ID NO: 5565487 - DNA, 21 bp, Homo sapiens
aggagctggggcttctttctg

SEQ ID NO: 5565488 - DNA, 20 bp, Homo sapiens
aggagctgggggaaggcagg

SEQ ID NO: 5565489 - DNA, 20 bp, Homo sapiens
aggagctgtcaccaaggaaa

SEQ ID NO: 5565490 - DNA, 21 bp, Homo sapiens
aggagctgtcaccaaggaaac

SEQ ID NO: 5565491 - DNA, 16 bp, Homo sapiens
aggagctgttggggca

SEQ ID NO: 5565492 - DNA, 18 bp, Homo sapiens
aggagcttacccaagctg

SEQ ID NO: 5565493 - DNA, 19 bp, Homo sapiens
aggagcttacccaagctgt

SEQ ID NO: 5565494 - DNA, 17 bp, Homo sapiens
aggagcttacctcccac

SEQ ID NO: 5565495 - DNA, 20 bp, Homo sapiens
aggagcttccagtgcatgtt

SEQ ID NO: 5565496 - DNA, 11 bp, Homo sapiens
aggagcttcct

SEQ ID NO: 5565497 - DNA, 20 bp, Homo sapiens
aggagcttcctgtcctccca

SEQ ID NO: 5565498 - DNA, 22 bp, Homo sapiens
aggagcttctcccagtgtgaga

SEQ ID NO: 5565499 - DNA, 14 bp, Homo sapiens
aggagcttctgggg

SEQ ID NO: 5565500 - DNA, 22 bp, Homo sapiens
aggagcttctggggtccccagg

SEQ ID NO: 5565501 - DNA, 19 bp, Homo sapiens
aggagcttcttgtttcctt

SEQ ID NO: 5565502 - DNA, 16 bp, Homo sapiens
aggagcttgcaagaag

SEQ ID NO: 5565503 - DNA, 14 bp, Homo sapiens
aggagcttggcaga

SEQ ID NO: 5565504 - DNA, 22 bp, Homo sapiens
aggagcttgggcagtgccccag

SEQ ID NO: 5565505 - DNA, 16 bp, Homo sapiens
aggagctttctcaatg

SEQ ID NO: 5565506 - DNA, 18 bp, Homo sapiens
aggagctttcttgtttct

SEQ ID NO: 5565507 - DNA, 24 bp, Homo sapiens
aggagctttttagtttttcagctt

SEQ ID NO: 5565508 - DNA, 19 bp, Homo sapiens
aggaggaaaaaggctggtg

SEQ ID NO: 5565509 - DNA, 19 bp, Homo sapiens
aggaggaaaacacagcctc

SEQ ID NO: 5565510 - DNA, 20 bp, Homo sapiens
aggaggaaaacacagcctcc

SEQ ID NO: 5565511 - DNA, 17 bp, Homo sapiens
aggaggaaaattccatt

SEQ ID NO: 5565512 - DNA, 13 bp, Homo sapiens
aggaggaaacagt

SEQ ID NO: 5565513 - DNA, 21 bp, Homo sapiens
aggaggaaataaattgcagag

SEQ ID NO: 5565514 - DNA, 12 bp, Homo sapiens
aggaggaacagg

SEQ ID NO: 5565515 - DNA, 20 bp, Homo sapiens
aggaggaacaggtttaaaaa

SEQ ID NO: 5565516 - DNA, 14 bp, Homo sapiens
aggaggaacagtgg

SEQ ID NO: 5565517 - DNA, 15 bp, Homo sapiens
aggaggaacgggcag

SEQ ID NO: 5565518 - DNA, 17 bp, Homo sapiens
aggaggaacgggcagcc

SEQ ID NO: 5565519 - DNA, 21 bp, Homo sapiens
aggaggaacgggcagccacag

SEQ ID NO: 5565520 - DNA, 19 bp, Homo sapiens
aggaggaactggtccaggc

SEQ ID NO: 5565521 - DNA, 23 bp, Homo sapiens
aggaggaactggtccaggccagg

SEQ ID NO: 5565522 - DNA, 21 bp, Homo sapiens
aggaggaagactctggagcca

SEQ ID NO: 5565523 - DNA, 14 bp, Homo sapiens
aggaggaagcagaa

SEQ ID NO: 5565524 - DNA, 11 bp, Homo sapiens
aggaggaagcc

SEQ ID NO: 5565525 - DNA, 15 bp, Homo sapiens
aggaggaaggcaaag

SEQ ID NO: 5565526 - DNA, 23 bp, Homo sapiens
aggaggaaggcaaagcccctgga

SEQ ID NO: 5565527 - DNA, 16 bp, Homo sapiens
aggaggaagggactgg

SEQ ID NO: 5565528 - DNA, 17 bp, Homo sapiens
aggaggaagggactggt

SEQ ID NO: 5565529 - DNA, 18 bp, Homo sapiens
aggaggaagggactggtc

SEQ ID NO: 5565530 - DNA, 14 bp, Homo sapiens
aggaggaatactga

SEQ ID NO: 5565531 - DNA, 12 bp, Homo sapiens
aggaggaatcag

SEQ ID NO: 5565532 - DNA, 19 bp, Homo sapiens
aggaggaatgctggactgg

SEQ ID NO: 5565533 - DNA, 22 bp, Homo sapiens
aggaggaatgctggactggagg

SEQ ID NO: 5565534 - DNA, 15 bp, Homo sapiens
aggaggacaagaccc

SEQ ID NO: 5565535 - DNA, 13 bp, Homo sapiens
aggaggacaattc

SEQ ID NO: 5565536 - DNA, 19 bp, Homo sapiens
aggaggacacagcacaagg

SEQ ID NO: 5565537 - DNA, 20 bp, Homo sapiens
aggaggacagagtgccctgg

SEQ ID NO: 5565538 - DNA, 12 bp, Homo sapiens
aggaggacaggg

SEQ ID NO: 5565539 - DNA, 18 bp, Homo sapiens
aggaggacaggtggaggc

SEQ ID NO: 5565540 - DNA, 13 bp, Homo sapiens
aggaggaccagtc

SEQ ID NO: 5565541 - DNA, 14 bp, Homo sapiens
aggaggaccagtca

SEQ ID NO: 5565542 - DNA, 21 bp, Homo sapiens
aggaggaccagtcaggatgag

SEQ ID NO: 5565543 - DNA, 13 bp, Homo sapiens
aggaggacccagg

SEQ ID NO: 5565544 - DNA, 15 bp, Homo sapiens
aggaggacccaggac

SEQ ID NO: 5565545 - DNA, 23 bp, Homo sapiens
aggaggacccctgccttcctctg

SEQ ID NO: 5565546 - DNA, 19 bp, Homo sapiens
aggaggaccctgaatttga

SEQ ID NO: 5565547 - DNA, 16 bp, Homo sapiens
aggaggacctgggggg

SEQ ID NO: 5565548 - DNA, 22 bp, Homo sapiens
aggaggacctggggggggcaag

SEQ ID NO: 5565549 - DNA, 10 bp, Homo sapiens
aggaggagaa

SEQ ID NO: 5565550 - DNA, 23 bp, Homo sapiens
aggaggagaccctcccctgcctc

SEQ ID NO: 5565551 - DNA, 17 bp, Homo sapiens
aggaggagagagatgct

SEQ ID NO: 5565552 - DNA, 23 bp, Homo sapiens
aggaggagatgttgaggggagga

SEQ ID NO: 5565553 - DNA, 19 bp, Homo sapiens
aggaggagccttgctgggc

SEQ ID NO: 5565554 - DNA, 23 bp, Homo sapiens
aggaggagccttgctgggccagg

SEQ ID NO: 5565555 - DNA, 14 bp, Homo sapiens
aggaggagctgccg

SEQ ID NO: 5565556 - DNA, 16 bp, Homo sapiens
aggaggagctgccgca

SEQ ID NO: 5565557 - DNA, 16 bp, Homo sapiens
aggaggagcttctggg

SEQ ID NO: 5565558 - DNA, 13 bp, Homo sapiens
aggaggaggaagg

SEQ ID NO: 5565559 - DNA, 14 bp, Homo sapiens
aggaggaggaaggc

SEQ ID NO: 5565560 - DNA, 12 bp, Homo sapiens
aggaggaggagg

SEQ ID NO: 5565561 - DNA, 14 bp, Homo sapiens
aggaggaggaggaa

SEQ ID NO: 5565562 - DNA, 16 bp, Homo sapiens
aggaggaggaggaagg

SEQ ID NO: 5565563 - DNA, 13 bp, Homo sapiens
aggaggaggagtc

SEQ ID NO: 5565564 - DNA, 18 bp, Homo sapiens
aggaggaggctgccctga

SEQ ID NO: 5565565 - DNA, 18 bp, Homo sapiens
aggaggagggagaagaga

SEQ ID NO: 5565566 - DNA, 14 bp, Homo sapiens
aggaggagggaggc

SEQ ID NO: 5565567 - DNA, 18 bp, Homo sapiens
aggaggaggtgccaacag

SEQ ID NO: 5565568 - DNA, 15 bp, Homo sapiens
aggaggatagaaaaa

SEQ ID NO: 5565569 - DNA, 15 bp, Homo sapiens
aggaggatccgggct

SEQ ID NO: 5565570 - DNA, 18 bp, Homo sapiens
aggaggatccgggctttg

SEQ ID NO: 5565571 - DNA, 16 bp, Homo sapiens
aggaggatgtaaggcc

SEQ ID NO: 5565572 - DNA, 15 bp, Homo sapiens
aggaggatgtccctg

SEQ ID NO: 5565573 - DNA, 20 bp, Homo sapiens
aggaggatgtccctgggcca

SEQ ID NO: 5565574 - DNA, 13 bp, Homo sapiens
aggaggattgcct

SEQ ID NO: 5565575 - DNA, 20 bp, Homo sapiens
aggaggattgcttgagccca

SEQ ID NO: 5565576 - DNA, 21 bp, Homo sapiens
aggaggattgcttgagcccag

SEQ ID NO: 5565577 - DNA, 23 bp, Homo sapiens
aggaggcaacactgatcccccag

SEQ ID NO: 5565578 - DNA, 22 bp, Homo sapiens
aggaggcaagcgtgttctcagc

SEQ ID NO: 5565579 - DNA, 18 bp, Homo sapiens
aggaggcacctacactca

SEQ ID NO: 5565580 - DNA, 15 bp, Homo sapiens
aggaggcagaaagat

SEQ ID NO: 5565581 - DNA, 14 bp, Homo sapiens
aggaggcagaacca

SEQ ID NO: 5565582 - DNA, 22 bp, Homo sapiens
aggaggcagaataagaaaacaa

SEQ ID NO: 5565583 - DNA, 16 bp, Homo sapiens
aggaggcagctcagga

SEQ ID NO: 5565584 - DNA, 17 bp, Homo sapiens
aggaggcagctcaggat

SEQ ID NO: 5565585 - DNA, 14 bp, Homo sapiens
aggaggcaggacct

SEQ ID NO: 5565586 - DNA, 13 bp, Homo sapiens
aggaggcaggagt

SEQ ID NO: 5565587 - DNA, 19 bp, Homo sapiens
aggatggttagacagcaca

SEQ ID NO: 5565588 - DNA, 18 bp, Homo sapiens
aggatgtaaacagtgcct

SEQ ID NO: 5565589 - DNA, 19 bp, Homo sapiens
aggatgtaaacagtgcctg

SEQ ID NO: 5565590 - DNA, 20 bp, Homo sapiens
aggatgtaaacagtgcctgc

SEQ ID NO: 5565591 - DNA, 11 bp, Homo sapiens
aggatgtaaag

SEQ ID NO: 5565592 - DNA, 15 bp, Homo sapiens
aggatgtaaggcctt

SEQ ID NO: 5565593 - DNA, 15 bp, Homo sapiens
aggatgtagcttttc

SEQ ID NO: 5565594 - DNA, 16 bp, Homo sapiens
aggatgtagcttttca

SEQ ID NO: 5565595 - DNA, 19 bp, Homo sapiens
aggatgtagcttttcacct

SEQ ID NO: 5565596 - DNA, 20 bp, Homo sapiens
aggatgtaggggttaacttg

SEQ ID NO: 5565597 - DNA, 20 bp, Homo sapiens
aggatgtatattttatataa

SEQ ID NO: 5565598 - DNA, 15 bp, Homo sapiens
aggatgtatgctgtt

SEQ ID NO: 5565599 - DNA, 12 bp, Homo sapiens
aggatgtatgtg

SEQ ID NO: 5565600 - DNA, 14 bp, Homo sapiens
aggatgtatgtgta

SEQ ID NO: 5565601 - DNA, 16 bp, Homo sapiens
aggatgtatgtgtata

SEQ ID NO: 5565602 - DNA, 15 bp, Homo sapiens
aggatgtcacagggc

SEQ ID NO: 5565603 - DNA, 17 bp, Homo sapiens
aggatgtcacagggcca

SEQ ID NO: 5565604 - DNA, 15 bp, Homo sapiens
aggatgtcatgtctg

SEQ ID NO: 5565605 - DNA, 19 bp, Homo sapiens
aggatgtccgttccaggag

SEQ ID NO: 5565606 - DNA, 14 bp, Homo sapiens
aggatgtgaattgt

SEQ ID NO: 5565607 - DNA, 21 bp, Homo sapiens
aggatgtggagctactgatga

SEQ ID NO: 5565608 - DNA, 22 bp, Homo sapiens
aggatgtggatggaggtgatga

SEQ ID NO: 5565609 - DNA, 16 bp, Homo sapiens
aggatgtggcactgct

SEQ ID NO: 5565610 - DNA, 24 bp, Homo sapiens
aggatgtggcaggggcagtggcct

SEQ ID NO: 5565611 - DNA, 16 bp, Homo sapiens
aggatgtgtgcatgtg

SEQ ID NO: 5565612 - DNA, 17 bp, Homo sapiens
aggatgtgtttgctttc

SEQ ID NO: 5565613 - DNA, 15 bp, Homo sapiens
aggatgtgttttgca

SEQ ID NO: 5565614 - DNA, 23 bp, Homo sapiens
aggatgttacaagtttgctaaaa

SEQ ID NO: 5565615 - DNA, 21 bp, Homo sapiens
aggatgttagacttgctccct

SEQ ID NO: 5565616 - DNA, 22 bp, Homo sapiens
aggatgttagacttgctccctc

SEQ ID NO: 5565617 - DNA, 22 bp, Homo sapiens
aggatgttctggacctccccct

SEQ ID NO: 5565618 - DNA, 14 bp, Homo sapiens
aggatgttgcttct

SEQ ID NO: 5565619 - DNA, 22 bp, Homo sapiens
aggatgttgcttctgaatcact

SEQ ID NO: 5565620 - DNA, 17 bp, Homo sapiens
aggatgtttagcagtgg

SEQ ID NO: 5565621 - DNA, 14 bp, Homo sapiens
aggatgtttttcat

SEQ ID NO: 5565622 - DNA, 15 bp, Homo sapiens
aggattaaaatggat

SEQ ID NO: 5565623 - DNA, 19 bp, Homo sapiens
aggattaactaaagaagag

SEQ ID NO: 5565624 - DNA, 17 bp, Homo sapiens
aggattaatatattgaa

SEQ ID NO: 5565625 - DNA, 18 bp, Homo sapiens
aggattaatctctaaaat

SEQ ID NO: 5565626 - DNA, 15 bp, Homo sapiens
aggattacttgaaac

SEQ ID NO: 5565627 - DNA, 14 bp, Homo sapiens
aggattagacagta

SEQ ID NO: 5565628 - DNA, 18 bp, Homo sapiens
aggattagacagtaagag

SEQ ID NO: 5565629 - DNA, 16 bp, Homo sapiens
aggattataaatgaaa

SEQ ID NO: 5565630 - DNA, 18 bp, Homo sapiens
aggattataaatgaaatt

SEQ ID NO: 5565631 - DNA, 18 bp, Homo sapiens
aggattatgggtcctgca

SEQ ID NO: 5565632 - DNA, 20 bp, Homo sapiens
aggattattactaattctat

SEQ ID NO: 5565633 - DNA, 17 bp, Homo sapiens
aggattcaaaagataaa

SEQ ID NO: 5565634 - DNA, 12 bp, Homo sapiens
aggattcaacat

SEQ ID NO: 5565635 - DNA, 18 bp, Homo sapiens
aggattcaaccctggctt

SEQ ID NO: 5565636 - DNA, 22 bp, Homo sapiens
aggattcacaccccacctgcgc

SEQ ID NO: 5565637 - DNA, 16 bp, Homo sapiens
aggattcagccggagg

SEQ ID NO: 5565638 - DNA, 18 bp, Homo sapiens
aggattcaggcagcagtg

SEQ ID NO: 5565639 - DNA, 14 bp, Homo sapiens
aggattcaggcctc

SEQ ID NO: 5565640 - DNA, 19 bp, Homo sapiens
aggattcaggcctctgagg

SEQ ID NO: 5565641 - DNA, 14 bp, Homo sapiens
aggattccaaagtt

SEQ ID NO: 5565642 - DNA, 14 bp, Homo sapiens
aggattccccctgc

SEQ ID NO: 5565643 - DNA, 16 bp, Homo sapiens
aggattcccttctggg

SEQ ID NO: 5565644 - DNA, 18 bp, Homo sapiens
aggattcccttctgggct

SEQ ID NO: 5565645 - DNA, 19 bp, Homo sapiens
aggattcctcttttctctg

SEQ ID NO: 5565646 - DNA, 18 bp, Homo sapiens
aggattccttcttcccca

SEQ ID NO: 5565647 - DNA, 12 bp, Homo sapiens
aggattctaaaa

SEQ ID NO: 5565648 - DNA, 17 bp, Homo sapiens
aggattctaaacagatg

SEQ ID NO: 5565649 - DNA, 15 bp, Homo sapiens
aggattctaggtgga

SEQ ID NO: 5565650 - DNA, 20 bp, Homo sapiens
aggattctcaccagctgtgt

SEQ ID NO: 5565651 - DNA, 22 bp, Homo sapiens
aggattctctaattagaaattt

SEQ ID NO: 5565652 - DNA, 19 bp, Homo sapiens
aggattctgacagagcaag

SEQ ID NO: 5565653 - DNA, 12 bp, Homo sapiens
aggattctgcag

SEQ ID NO: 5565654 - DNA, 20 bp, Homo sapiens
aggattctgctggcctctgc

SEQ ID NO: 5565655 - DNA, 16 bp, Homo sapiens
aggattcttcccgctc

SEQ ID NO: 5565656 - DNA, 23 bp, Homo sapiens
aggattcttcccgctccccacct

SEQ ID NO: 5565657 - DNA, 15 bp, Homo sapiens
aggattctttcccca

SEQ ID NO: 5565658 - DNA, 17 bp, Homo sapiens
aggattctttccccaga

SEQ ID NO: 5565659 - DNA, 11 bp, Homo sapiens
aggattctttt

SEQ ID NO: 5565660 - DNA, 20 bp, Homo sapiens
aggattcttttttcaatgta

SEQ ID NO: 5565661 - DNA, 19 bp, Homo sapiens
aggattgcaggtgcctggc

SEQ ID NO: 5565662 - DNA, 18 bp, Homo sapiens
aggattgcatcctgctgg

SEQ ID NO: 5565663 - DNA, 18 bp, Homo sapiens
aggattgcctttaatatt

SEQ ID NO: 5565664 - DNA, 17 bp, Homo sapiens
aggattgcgagagatgt

SEQ ID NO: 5565665 - DNA, 17 bp, Homo sapiens
aggattgctactgtcct

SEQ ID NO: 5565666 - DNA, 14 bp, Homo sapiens
aggattgctgccag

SEQ ID NO: 5565667 - DNA, 16 bp, Homo sapiens
aggattgctgccagag

SEQ ID NO: 5565668 - DNA, 18 bp, Homo sapiens
aggattgctgccagagaa

SEQ ID NO: 5565669 - DNA, 21 bp, Homo sapiens
aggattggcaactcttcagac

SEQ ID NO: 5565670 - DNA, 23 bp, Homo sapiens
aggattgggggatgtgaagaaat

SEQ ID NO: 5565671 - DNA, 16 bp, Homo sapiens
aggattgtacgtggga

SEQ ID NO: 5565672 - DNA, 19 bp, Homo sapiens
aggattgtccacaaatgtc

SEQ ID NO: 5565673 - DNA, 22 bp, Homo sapiens
aggattgtctgctgcctccaag

SEQ ID NO: 5565674 - DNA, 23 bp, Homo sapiens
aggattgtctgctgcctccaagt

SEQ ID NO: 5565675 - DNA, 12 bp, Homo sapiens
aggattgtggaa

SEQ ID NO: 5565676 - DNA, 18 bp, Homo sapiens
aggattgtggaaaaccag

SEQ ID NO: 5565677 - DNA, 15 bp, Homo sapiens
aggatttaaaaactg

SEQ ID NO: 5565678 - DNA, 18 bp, Homo sapiens
aggatttaaaaactggaa

SEQ ID NO: 5565679 - DNA, 20 bp, Homo sapiens
aggatttaacagtcatttaa

SEQ ID NO: 5565680 - DNA, 13 bp, Homo sapiens
aggatttaaggag

SEQ ID NO: 5565681 - DNA, 15 bp, Homo sapiens
aggatttaatttgtt

SEQ ID NO: 5565682 - DNA, 14 bp, Homo sapiens
aggatttaggcctt

SEQ ID NO: 5565683 - DNA, 14 bp, Homo sapiens
aggatttatacata

SEQ ID NO: 5565684 - DNA, 19 bp, Homo sapiens
aggatttatacatacagag

SEQ ID NO: 5565685 - DNA, 16 bp, Homo sapiens
aggatttattctcaga

SEQ ID NO: 5565686 - DNA, 21 bp, Homo sapiens
aggatttattctcagaacacc

SEQ ID NO: 5565687 - DNA, 17 bp, Homo sapiens
aggatttatttaaaata

SEQ ID NO: 5565688 - DNA, 12 bp, Homo sapiens
aggatttcaagc

SEQ ID NO: 5565689 - DNA, 14 bp, Homo sapiens
aggatttcagccat

SEQ ID NO: 5565690 - DNA, 15 bp, Homo sapiens
aggatttccctgaag

SEQ ID NO: 5565691 - DNA, 18 bp, Homo sapiens
aggatttccctgaagcta

SEQ ID NO: 5565692 - DNA, 20 bp, Homo sapiens
aggatttccctgaagctatg

SEQ ID NO: 5565693 - DNA, 15 bp, Homo sapiens
aggatttcctacccc

SEQ ID NO: 5565694 - DNA, 13 bp, Homo sapiens
aggatttcctgga

SEQ ID NO: 5565695 - DNA, 16 bp, Homo sapiens
aggatttcctggagtg

SEQ ID NO: 5565696 - DNA, 13 bp, Homo sapiens
aggatttcgtggg

SEQ ID NO: 5565697 - DNA, 15 bp, Homo sapiens
aggatttcttaaatt

SEQ ID NO: 5565698 - DNA, 17 bp, Homo sapiens
aggatttcttcaaatct

SEQ ID NO: 5565699 - DNA, 18 bp, Homo sapiens
aggatttcttgtattggt

SEQ ID NO: 5565700 - DNA, 11 bp, Homo sapiens
aggatttgatg

SEQ ID NO: 5565701 - DNA, 13 bp, Homo sapiens
aggatttgatgct

SEQ ID NO: 5565702 - DNA, 22 bp, Homo sapiens
aggatttgatgcttttctctca

SEQ ID NO: 5565703 - DNA, 23 bp, Homo sapiens
aggatttgcacagaagcacatgc

SEQ ID NO: 5565704 - DNA, 17 bp, Homo sapiens
aggatttggctcgctgt

SEQ ID NO: 5565705 - DNA, 16 bp, Homo sapiens
aggatttggttgttta

SEQ ID NO: 5565706 - DNA, 18 bp, Homo sapiens
aggattttaaatgctgta

SEQ ID NO: 5565707 - DNA, 23 bp, Homo sapiens
aggattttaacaaaagcaagact

SEQ ID NO: 5565708 - DNA, 13 bp, Homo sapiens
aggattttaccaa

SEQ ID NO: 5565709 - DNA, 11 bp, Homo sapiens
aggattttatg

SEQ ID NO: 5565710 - DNA, 14 bp, Homo sapiens
aggattttatgctt

SEQ ID NO: 5565711 - DNA, 15 bp, Homo sapiens
aggattttatgcttt

SEQ ID NO: 5565712 - DNA, 16 bp, Homo sapiens
aggattttatgcttta

SEQ ID NO: 5565713 - DNA, 20 bp, Homo sapiens
aggattttatgctttaaaca

SEQ ID NO: 5565714 - DNA, 14 bp, Homo sapiens
aggattttcacaca

SEQ ID NO: 5565715 - DNA, 15 bp, Homo sapiens
aggattttgaaccca

SEQ ID NO: 5565716 - DNA, 23 bp, Homo sapiens
aggattttgggtggccaaagtgt

SEQ ID NO: 5565717 - DNA, 17 bp, Homo sapiens
aggattttgtattgcca

SEQ ID NO: 5565718 - DNA, 18 bp, Homo sapiens
aggattttgtattgccat

SEQ ID NO: 5565719 - DNA, 17 bp, Homo sapiens
aggattttgtgtttttt

SEQ ID NO: 5565720 - DNA, 15 bp, Homo sapiens
aggatttttaaaact

SEQ ID NO: 5565721 - DNA, 18 bp, Homo sapiens
aggatttttagagcatta

SEQ ID NO: 5565722 - DNA, 23 bp, Homo sapiens
aggatttttagagcattaaaata

SEQ ID NO: 5565723 - DNA, 15 bp, Homo sapiens
aggatttttatgtac

SEQ ID NO: 5565724 - DNA, 16 bp, Homo sapiens
aggattttttaaaaat

SEQ ID NO: 5565725 - DNA, 19 bp, Homo sapiens
aggattttttaaaaattgg

SEQ ID NO: 5565726 - DNA, 17 bp, Homo sapiens
aggatttttttctgagc

SEQ ID NO: 5565727 - DNA, 15 bp, Homo sapiens
aggcaaaaacaaaga

SEQ ID NO: 5565728 - DNA, 16 bp, Homo sapiens
aggcaaaaaccagaaa

SEQ ID NO: 5565729 - DNA, 17 bp, Homo sapiens
aggcaaaaactgtactg

SEQ ID NO: 5565730 - DNA, 21 bp, Homo sapiens
aggcaaaaataatttattttg

SEQ ID NO: 5565731 - DNA, 15 bp, Homo sapiens
aggcaaaaatatcag

SEQ ID NO: 5565732 - DNA, 12 bp, Homo sapiens
aggcaaaaatgt

SEQ ID NO: 5565733 - DNA, 16 bp, Homo sapiens
aggcaaaagactggtt

SEQ ID NO: 5565734 - DNA, 20 bp, Homo sapiens
aggcaaaagagagaagagtc

SEQ ID NO: 5565735 - DNA, 12 bp, Homo sapiens
aggcaaaaggag

SEQ ID NO: 5565736 - DNA, 19 bp, Homo sapiens
aggcaaaataccagctgat

SEQ ID NO: 5565737 - DNA, 19 bp, Homo sapiens
aggcaaaatccttgcttat

SEQ ID NO: 5565738 - DNA, 20 bp, Homo sapiens
aggcaaaattgcaaatcttg

SEQ ID NO: 5565739 - DNA, 15 bp, Homo sapiens
aggcaaaattgtgaa

SEQ ID NO: 5565740 - DNA, 17 bp, Homo sapiens
aggcaaaattgtgaagc

SEQ ID NO: 5565741 - DNA, 21 bp, Homo sapiens
aggcaaacaatcccaatcttt

SEQ ID NO: 5565742 - DNA, 15 bp, Homo sapiens
aggcaaacatttctt

SEQ ID NO: 5565743 - DNA, 18 bp, Homo sapiens
aggcaaaccaatacagaa

SEQ ID NO: 5565744 - DNA, 21 bp, Homo sapiens
aggcaaaccaatttgttctgt

SEQ ID NO: 5565745 - DNA, 18 bp, Homo sapiens
aggcaaacgaataaagat

SEQ ID NO: 5565746 - DNA, 17 bp, Homo sapiens
aggcaaacttttatgca

SEQ ID NO: 5565747 - DNA, 17 bp, Homo sapiens
aggcaaagaaaatgaaa

SEQ ID NO: 5565748 - DNA, 16 bp, Homo sapiens
aggcaaaggcagagga

SEQ ID NO: 5565749 - DNA, 17 bp, Homo sapiens
aggcaaaggcagaggaa

SEQ ID NO: 5565750 - DNA, 19 bp, Homo sapiens
aggcaaagggtccagaagg

SEQ ID NO: 5565751 - DNA, 14 bp, Homo sapiens
aggcaaagtacaaa

SEQ ID NO: 5565752 - DNA, 21 bp, Homo sapiens
aggcaaagtttacagatgttt

SEQ ID NO: 5565753 - DNA, 19 bp, Homo sapiens
aggcaaagttttacagaga

SEQ ID NO: 5565754 - DNA, 15 bp, Homo sapiens
aggcaaataaaattc

SEQ ID NO: 5565755 - DNA, 19 bp, Homo sapiens
aggcaaatataagctggga

SEQ ID NO: 5565756 - DNA, 21 bp, Homo sapiens
aggcaaatattgaagttgttt

SEQ ID NO: 5565757 - DNA, 17 bp, Homo sapiens
aggcaaatcaggtaaaa

SEQ ID NO: 5565758 - DNA, 18 bp, Homo sapiens
aggcaaatcaggtaaaat

SEQ ID NO: 5565759 - DNA, 14 bp, Homo sapiens
aggcaaatgacttt

SEQ ID NO: 5565760 - DNA, 13 bp, Homo sapiens
aggcaaatgtcca

SEQ ID NO: 5565761 - DNA, 21 bp, Homo sapiens
aggcaaatgtccaagcatcag

SEQ ID NO: 5565762 - DNA, 17 bp, Homo sapiens
aggcaaatgtgtacatg

SEQ ID NO: 5565763 - DNA, 15 bp, Homo sapiens
aggcaaatttgcatt

SEQ ID NO: 5565764 - DNA, 22 bp, Homo sapiens
aggcaaatttgcattaaattac

SEQ ID NO: 5565765 - DNA, 23 bp, Homo sapiens
aggcaacacctgtggataaaaca

SEQ ID NO: 5565766 - DNA, 19 bp, Homo sapiens
aggccaagtacactgagag

SEQ ID NO: 5565767 - DNA, 18 bp, Homo sapiens
aggccaagtcaggccctt

SEQ ID NO: 5565768 - DNA, 16 bp, Homo sapiens
aggccaataaaaagtt

SEQ ID NO: 5565769 - DNA, 17 bp, Homo sapiens
aggccaataaaaagttc

SEQ ID NO: 5565770 - DNA, 15 bp, Homo sapiens
aggccaatagtttta

SEQ ID NO: 5565771 - DNA, 16 bp, Homo sapiens
aggccaatcagaagct

SEQ ID NO: 5565772 - DNA, 12 bp, Homo sapiens
aggccaatgggc

SEQ ID NO: 5565773 - DNA, 15 bp, Homo sapiens
aggccaatgggctag

SEQ ID NO: 5565774 - DNA, 18 bp, Homo sapiens
aggccacaagacccttgt

SEQ ID NO: 5565775 - DNA, 19 bp, Homo sapiens
aggccacaagacccttgtg

SEQ ID NO: 5565776 - DNA, 23 bp, Homo sapiens
aggccacactggcatctccctga

SEQ ID NO: 5565777 - DNA, 21 bp, Homo sapiens
aggccacactttctgggaaat

SEQ ID NO: 5565778 - DNA, 21 bp, Homo sapiens
aggccacagaaggtgaacttt

SEQ ID NO: 5565779 - DNA, 17 bp, Homo sapiens
aggccacagcccctggc

SEQ ID NO: 5565780 - DNA, 12 bp, Homo sapiens
aggccacagccg

SEQ ID NO: 5565781 - DNA, 16 bp, Homo sapiens
aggccacaggccactg

SEQ ID NO: 5565782 - DNA, 17 bp, Homo sapiens
aggccacaggccactgc

SEQ ID NO: 5565783 - DNA, 21 bp, Homo sapiens
aggccacagtggggctgcagg

SEQ ID NO: 5565784 - DNA, 18 bp, Homo sapiens
aggccacatacctctctg

SEQ ID NO: 5565785 - DNA, 16 bp, Homo sapiens
aggccacatgagtccc

SEQ ID NO: 5565786 - DNA, 19 bp, Homo sapiens
aggccacatggggctgggc

SEQ ID NO: 5565787 - DNA, 21 bp, Homo sapiens
aggccacatgtcaccgtggac

SEQ ID NO: 5565788 - DNA, 15 bp, Homo sapiens
aggccacatgtgaaa

SEQ ID NO: 5565789 - DNA, 12 bp, Homo sapiens
aggccaccagga

SEQ ID NO: 5565790 - DNA, 20 bp, Homo sapiens
aggccacccactgtggggca

SEQ ID NO: 5565791 - DNA, 20 bp, Homo sapiens
aggccaccccaaaccccagc

SEQ ID NO: 5565792 - DNA, 15 bp, Homo sapiens
aggccacccgggctg

SEQ ID NO: 5565793 - DNA, 18 bp, Homo sapiens
aggccacccgggctgcct

SEQ ID NO: 5565794 - DNA, 15 bp, Homo sapiens
aggccaccctgtgca

SEQ ID NO: 5565795 - DNA, 22 bp, Homo sapiens
aggccaccctgtgcagaaggga

SEQ ID NO: 5565796 - DNA, 20 bp, Homo sapiens
aggccaccgggacagacctg

SEQ ID NO: 5565797 - DNA, 18 bp, Homo sapiens
aggccacctagctttttg

SEQ ID NO: 5565798 - DNA, 16 bp, Homo sapiens
aggccacctcccactc

SEQ ID NO: 5565799 - DNA, 15 bp, Homo sapiens
aggccacctctgcct

SEQ ID NO: 5565800 - DNA, 16 bp, Homo sapiens
aggccacctctgcctc

SEQ ID NO: 5565801 - DNA, 15 bp, Homo sapiens
aggccacctcttcct

SEQ ID NO: 5565802 - DNA, 23 bp, Homo sapiens
aggccacctcttcctggccggtg

SEQ ID NO: 5565803 - DNA, 12 bp, Homo sapiens
aggccacctgca

SEQ ID NO: 5565804 - DNA, 16 bp, Homo sapiens
aggccacctgccccct

SEQ ID NO: 5565805 - DNA, 18 bp, Homo sapiens
aggccacctgcccccttc

SEQ ID NO: 5565806 - DNA, 21 bp, Homo sapiens
aggccacctggctctcacctc

SEQ ID NO: 5565807 - DNA, 19 bp, Homo sapiens
aggccacgctcaggcccgg

SEQ ID NO: 5565808 - DNA, 14 bp, Homo sapiens
aggccacgggggag

SEQ ID NO: 5565809 - DNA, 23 bp, Homo sapiens
aggccacgggggaggccgaggca

SEQ ID NO: 5565810 - DNA, 22 bp, Homo sapiens
aggccacgtatagtcctagctg

SEQ ID NO: 5565811 - DNA, 15 bp, Homo sapiens
aggccacgtcccacc

SEQ ID NO: 5565812 - DNA, 13 bp, Homo sapiens
aggccactagtga

SEQ ID NO: 5565813 - DNA, 17 bp, Homo sapiens
aggccactagtgacagt

SEQ ID NO: 5565814 - DNA, 12 bp, Homo sapiens
aggccactcagg

SEQ ID NO: 5565815 - DNA, 13 bp, Homo sapiens
aggccactcctcc

SEQ ID NO: 5565816 - DNA, 22 bp, Homo sapiens
aggccactgacctcccactttg

SEQ ID NO: 5565817 - DNA, 14 bp, Homo sapiens
aggccactggagac

SEQ ID NO: 5565818 - DNA, 20 bp, Homo sapiens
aggccactggagacgcatat

SEQ ID NO: 5565819 - DNA, 15 bp, Homo sapiens
aggccactgtggcca

SEQ ID NO: 5565820 - DNA, 20 bp, Homo sapiens
aggccacttagtcgtctttt

SEQ ID NO: 5565821 - DNA, 16 bp, Homo sapiens
aggccactttgagagg

SEQ ID NO: 5565822 - DNA, 20 bp, Homo sapiens
aggccagaaaaagaagaagg

SEQ ID NO: 5565823 - DNA, 14 bp, Homo sapiens
aggccagaaaggtg

SEQ ID NO: 5565824 - DNA, 17 bp, Homo sapiens
aggccagaaggaggggg

SEQ ID NO: 5565825 - DNA, 14 bp, Homo sapiens
aggccagacctgca

SEQ ID NO: 5565826 - DNA, 20 bp, Homo sapiens
aggccagagaaagcaaaggt

SEQ ID NO: 5565827 - DNA, 18 bp, Homo sapiens
aggccagagacacaagcc

SEQ ID NO: 5565828 - DNA, 14 bp, Homo sapiens
aggccagagaggga

SEQ ID NO: 5565829 - DNA, 22 bp, Homo sapiens
aggccagagagggaaaaggcag

SEQ ID NO: 5565830 - DNA, 19 bp, Homo sapiens
aggccagagcaaacagaaa

SEQ ID NO: 5565831 - DNA, 15 bp, Homo sapiens
aggccagagcccact

SEQ ID NO: 5565832 - DNA, 22 bp, Homo sapiens
aggccagaggaagggaggcctg

SEQ ID NO: 5565833 - DNA, 17 bp, Homo sapiens
aggccagaggagagctg

SEQ ID NO: 5565834 - DNA, 12 bp, Homo sapiens
aggccagaggcc

SEQ ID NO: 5565835 - DNA, 15 bp, Homo sapiens
aggccagaggcccat

SEQ ID NO: 5565836 - DNA, 15 bp, Homo sapiens
aggccagagggcagt

SEQ ID NO: 5565837 - DNA, 18 bp, Homo sapiens
aggccagagggcagtggc

SEQ ID NO: 5565838 - DNA, 15 bp, Homo sapiens
aggccagagtctccc

SEQ ID NO: 5565839 - DNA, 19 bp, Homo sapiens
aggccagagtctcccagtg

SEQ ID NO: 5565840 - DNA, 17 bp, Homo sapiens
aggccagagtggcctgg

SEQ ID NO: 5565841 - DNA, 21 bp, Homo sapiens
aggccagagtggcctggccag

SEQ ID NO: 5565842 - DNA, 16 bp, Homo sapiens
aggccagatggcccct

SEQ ID NO: 5565843 - DNA, 19 bp, Homo sapiens
aggccagcaacattggcac

SEQ ID NO: 5565844 - DNA, 12 bp, Homo sapiens
aggccagcaacg

SEQ ID NO: 5565845 - DNA, 17 bp, Homo sapiens
aggccagcaacgcttgt

SEQ ID NO: 5565846 - DNA, 17 bp, Homo sapiens
aggccagcaaggtggag

SEQ ID NO: 5565847 - DNA, 17 bp, Homo sapiens
aggccagcaataaaaac

SEQ ID NO: 5565848 - DNA, 16 bp, Homo sapiens
aggccagcacccaaag

SEQ ID NO: 5565849 - DNA, 13 bp, Homo sapiens
aggccagcagcct

SEQ ID NO: 5565850 - DNA, 16 bp, Homo sapiens
aggccagcagccttcc

SEQ ID NO: 5565851 - DNA, 15 bp, Homo sapiens
aggccagcagctgat

SEQ ID NO: 5565852 - DNA, 16 bp, Homo sapiens
aggccagcagctgatg

SEQ ID NO: 5565853 - DNA, 20 bp, Homo sapiens
aggccagcaggcgggctcct

SEQ ID NO: 5565854 - DNA, 11 bp, Homo sapiens
aggccagccca

SEQ ID NO: 5565855 - DNA, 17 bp, Homo sapiens
aggccagcccactgggc

SEQ ID NO: 5565856 - DNA, 14 bp, Homo sapiens
aggccagcccagcc

SEQ ID NO: 5565857 - DNA, 17 bp, Homo sapiens
aggccagcccagccagg

SEQ ID NO: 5565858 - DNA, 19 bp, Homo sapiens
aggccagcccagccaggcc

SEQ ID NO: 5565859 - DNA, 15 bp, Homo sapiens
aggccagccccaccc

SEQ ID NO: 5565860 - DNA, 21 bp, Homo sapiens
aggccagccccacccaggagg

SEQ ID NO: 5565861 - DNA, 16 bp, Homo sapiens
aggccagcccggacct

SEQ ID NO: 5565862 - DNA, 17 bp, Homo sapiens
aggccagccctggttct

SEQ ID NO: 5565863 - DNA, 19 bp, Homo sapiens
aggccagccctggttctcc

SEQ ID NO: 5565864 - DNA, 10 bp, Homo sapiens
aggccagcct

SEQ ID NO: 5565865 - DNA, 13 bp, Homo sapiens
aggccagcctcac

SEQ ID NO: 5565866 - DNA, 16 bp, Homo sapiens
aggccagcctcacctc

SEQ ID NO: 5565867 - DNA, 14 bp, Homo sapiens
aggccagcctccga

SEQ ID NO: 5565868 - DNA, 23 bp, Homo sapiens
aggccagcctccgagagggagag

SEQ ID NO: 5565869 - DNA, 22 bp, Homo sapiens
aggccagcctgcgggaagctga

SEQ ID NO: 5565870 - DNA, 12 bp, Homo sapiens
aggccagcctgg

SEQ ID NO: 5565871 - DNA, 14 bp, Homo sapiens
aggccagcctggcc

SEQ ID NO: 5565872 - DNA, 17 bp, Homo sapiens
aggccagcctggcctcc

SEQ ID NO: 5565873 - DNA, 23 bp, Homo sapiens
aggccagcctggcctcctgcctc

SEQ ID NO: 5565874 - DNA, 24 bp, Homo sapiens
aggccagcggtgaccagcctgtca

SEQ ID NO: 5565875 - DNA, 10 bp, Homo sapiens
aggccagcta

SEQ ID NO: 5565876 - DNA, 15 bp, Homo sapiens
aggccagctagagct

SEQ ID NO: 5565877 - DNA, 16 bp, Homo sapiens
aggccagctagagctt

SEQ ID NO: 5565878 - DNA, 18 bp, Homo sapiens
aggccagctatctgcctg

SEQ ID NO: 5565879 - DNA, 22 bp, Homo sapiens
aggccagctatctgcctgacag

SEQ ID NO: 5565880 - DNA, 24 bp, Homo sapiens
aggccagctatctgcctgacaggc

SEQ ID NO: 5565881 - DNA, 13 bp, Homo sapiens
aggccagctcagg

SEQ ID NO: 5565882 - DNA, 11 bp, Homo sapiens
aggccagctcc

SEQ ID NO: 5565883 - DNA, 19 bp, Homo sapiens
aggccagctccttagacac

SEQ ID NO: 5565884 - DNA, 13 bp, Homo sapiens
aggccagctgcct

SEQ ID NO: 5565885 - DNA, 12 bp, Homo sapiens
aggccagctgcg

SEQ ID NO: 5565886 - DNA, 18 bp, Homo sapiens
aggccagctgcggccagg

SEQ ID NO: 5565887 - DNA, 12 bp, Homo sapiens
aggccagctgct

SEQ ID NO: 5565888 - DNA, 13 bp, Homo sapiens
aggccagctgctt

SEQ ID NO: 5565889 - DNA, 13 bp, Homo sapiens
aggccagcttccc

SEQ ID NO: 5565890 - DNA, 16 bp, Homo sapiens
aggccaggaccacaca

SEQ ID NO: 5565891 - DNA, 23 bp, Homo sapiens
aggccaggactctgcagcctcag

SEQ ID NO: 5565892 - DNA, 11 bp, Homo sapiens
aggccaggagt

SEQ ID NO: 5565893 - DNA, 15 bp, Homo sapiens
aggccaggagttcaa

SEQ ID NO: 5565894 - DNA, 14 bp, Homo sapiens
aggccaggccacca

SEQ ID NO: 5565895 - DNA, 16 bp, Homo sapiens
aggccaggccaccagg

SEQ ID NO: 5565896 - DNA, 17 bp, Homo sapiens
aggccaggccaccagga

SEQ ID NO: 5565897 - DNA, 18 bp, Homo sapiens
aggccaggccaccaggat

SEQ ID NO: 5565898 - DNA, 14 bp, Homo sapiens
aggccaggccaccc

SEQ ID NO: 5565899 - DNA, 18 bp, Homo sapiens
aggccaggccaccctgcc

SEQ ID NO: 5565900 - DNA, 13 bp, Homo sapiens
aggccaggccctc

SEQ ID NO: 5565901 - DNA, 18 bp, Homo sapiens
aggccaggccctcctgct

SEQ ID NO: 5565902 - DNA, 14 bp, Homo sapiens
aggccaggccctct

SEQ ID NO: 5565903 - DNA, 15 bp, Homo sapiens
aggccaggccctctg

SEQ ID NO: 5565904 - DNA, 18 bp, Homo sapiens
aggccaggccctctgccc

SEQ ID NO: 5565905 - DNA, 13 bp, Homo sapiens
aggccaggcctct

SEQ ID NO: 5565906 - DNA, 23 bp, Homo sapiens
aggccaggcctctactaggtctg

SEQ ID NO: 5565907 - DNA, 15 bp, Homo sapiens
aggccaggctcccga

SEQ ID NO: 5565908 - DNA, 19 bp, Homo sapiens
aggccagggacagtaataa

SEQ ID NO: 5565909 - DNA, 19 bp, Homo sapiens
aggccagggagcagtggct

SEQ ID NO: 5565910 - DNA, 18 bp, Homo sapiens
aggccagggatagaggat

SEQ ID NO: 5565911 - DNA, 19 bp, Homo sapiens
aggccagggcacagctgga

SEQ ID NO: 5565912 - DNA, 15 bp, Homo sapiens
aggccagggcatgtg

SEQ ID NO: 5565913 - DNA, 12 bp, Homo sapiens
aggccagggccg

SEQ ID NO: 5565914 - DNA, 12 bp, Homo sapiens
aggccagggcct

SEQ ID NO: 5565915 - DNA, 11 bp, Homo sapiens
aggccagggct

SEQ ID NO: 5565916 - DNA, 23 bp, Homo sapiens
aggccagggctatagctcaggac

SEQ ID NO: 5565917 - DNA, 21 bp, Homo sapiens
aggccagggctcaccagctgg

SEQ ID NO: 5565918 - DNA, 14 bp, Homo sapiens
aggccagggctcct

SEQ ID NO: 5565919 - DNA, 20 bp, Homo sapiens
aggccagggctcctgtggca

SEQ ID NO: 5565920 - DNA, 21 bp, Homo sapiens
aggccagggctgggtcacagg

SEQ ID NO: 5565921 - DNA, 22 bp, Homo sapiens
aggccaggggacccctgccagt

SEQ ID NO: 5565922 - DNA, 15 bp, Homo sapiens
aggccaggggatctg

SEQ ID NO: 5565923 - DNA, 23 bp, Homo sapiens
aggccagggggccagtccctgag

SEQ ID NO: 5565924 - DNA, 20 bp, Homo sapiens
aggccagggtcactgaaggc

SEQ ID NO: 5565925 - DNA, 10 bp, Homo sapiens
aggccaggtc

SEQ ID NO: 5565926 - DNA, 17 bp, Homo sapiens
aggccaggtccagagag

SEQ ID NO: 5565927 - DNA, 12 bp, Homo sapiens
aggccaggtgca

SEQ ID NO: 5565928 - DNA, 16 bp, Homo sapiens
aggccaggtgcccagg

SEQ ID NO: 5565929 - DNA, 20 bp, Homo sapiens
aggccaggttatgcctcatg

SEQ ID NO: 5565930 - DNA, 20 bp, Homo sapiens
aggccagtaatcccagtgac

SEQ ID NO: 5565931 - DNA, 15 bp, Homo sapiens
aggccagtaggagac

SEQ ID NO: 5565932 - DNA, 23 bp, Homo sapiens
aggccagtcagacgccaggcacc

SEQ ID NO: 5565933 - DNA, 14 bp, Homo sapiens
aggccagtgagcca

SEQ ID NO: 5565934 - DNA, 13 bp, Homo sapiens
aggccagtgccag

SEQ ID NO: 5565935 - DNA, 20 bp, Homo sapiens
aggccagtggacagagggag

SEQ ID NO: 5565936 - DNA, 17 bp, Homo sapiens
aggccagtgggcctggt

SEQ ID NO: 5565937 - DNA, 13 bp, Homo sapiens
aggccagtgtctg

SEQ ID NO: 5565938 - DNA, 19 bp, Homo sapiens
aggccagttgatctgctct

SEQ ID NO: 5565939 - DNA, 15 bp, Homo sapiens
aggccatattttaaa

SEQ ID NO: 5565940 - DNA, 15 bp, Homo sapiens
aggccatcagggccc

SEQ ID NO: 5565941 - DNA, 17 bp, Homo sapiens
aggccatcagggccctg

SEQ ID NO: 5565942 - DNA, 19 bp, Homo sapiens
aggccatcagggccctgcc

SEQ ID NO: 5565943 - DNA, 22 bp, Homo sapiens
aggccatcagggccctgcccca

SEQ ID NO: 5565944 - DNA, 14 bp, Homo sapiens
aggccatctcagga

SEQ ID NO: 5565945 - DNA, 19 bp, Homo sapiens
aggccatctcaggagatgg

SEQ ID NO: 5565946 - DNA, 20 bp, Homo sapiens
aggccgcgcgtccagctgcc

SEQ ID NO: 5565947 - DNA, 15 bp, Homo sapiens
aggccgcggcccaga

SEQ ID NO: 5565948 - DNA, 16 bp, Homo sapiens
aggccgcggcctcccc

SEQ ID NO: 5565949 - DNA, 18 bp, Homo sapiens
aggccgcggcctccccga

SEQ ID NO: 5565950 - DNA, 20 bp, Homo sapiens
aggccgcggcctccccgagg

SEQ ID NO: 5565951 - DNA, 19 bp, Homo sapiens
aggccgctgcagggtggca

SEQ ID NO: 5565952 - DNA, 18 bp, Homo sapiens
aggccgctgccccagccc

SEQ ID NO: 5565953 - DNA, 15 bp, Homo sapiens
aggccgctgcccctg

SEQ ID NO: 5565954 - DNA, 17 bp, Homo sapiens
aggccgctgttcaccca

SEQ ID NO: 5565955 - DNA, 18 bp, Homo sapiens
aggccgcttagtgctgct

SEQ ID NO: 5565956 - DNA, 17 bp, Homo sapiens
aggccggagacccacag

SEQ ID NO: 5565957 - DNA, 23 bp, Homo sapiens
aggccggagacccacagccctga

SEQ ID NO: 5565958 - DNA, 19 bp, Homo sapiens
aggccggagaggagttcag

SEQ ID NO: 5565959 - DNA, 15 bp, Homo sapiens
aggccggagcccaga

SEQ ID NO: 5565960 - DNA, 13 bp, Homo sapiens
aggccggcagccc

SEQ ID NO: 5565961 - DNA, 20 bp, Homo sapiens
aggccggcagccccagcctg

SEQ ID NO: 5565962 - DNA, 16 bp, Homo sapiens
aggccggcagcgggcg

SEQ ID NO: 5565963 - DNA, 15 bp, Homo sapiens
aggccggccagcctc

SEQ ID NO: 5565964 - DNA, 20 bp, Homo sapiens
aggccggccctgcccctccc

SEQ ID NO: 5565965 - DNA, 19 bp, Homo sapiens
aggccgggaagagccacct

SEQ ID NO: 5565966 - DNA, 22 bp, Homo sapiens
aggccgggaagagccacctggc

SEQ ID NO: 5565967 - DNA, 18 bp, Homo sapiens
aggccgggcacagtggct

SEQ ID NO: 5565968 - DNA, 13 bp, Homo sapiens
aggccgggcagag

SEQ ID NO: 5565969 - DNA, 21 bp, Homo sapiens
aggccgggccgaatcccctcc

SEQ ID NO: 5565970 - DNA, 18 bp, Homo sapiens
aggccgggcctgctgtca

SEQ ID NO: 5565971 - DNA, 15 bp, Homo sapiens
aggccgggcctgtac

SEQ ID NO: 5565972 - DNA, 18 bp, Homo sapiens
aggccgggcggtcacagc

SEQ ID NO: 5565973 - DNA, 15 bp, Homo sapiens
aggccggggtccagg

SEQ ID NO: 5565974 - DNA, 16 bp, Homo sapiens
aggccggggtccaggc

SEQ ID NO: 5565975 - DNA, 19 bp, Homo sapiens
aggccggggtccaggcccg

SEQ ID NO: 5565976 - DNA, 20 bp, Homo sapiens
aggccgggtgctcagggctg

SEQ ID NO: 5565977 - DNA, 20 bp, Homo sapiens
aggccgtgacgtctgggtgg

SEQ ID NO: 5565978 - DNA, 21 bp, Homo sapiens
aggccgtgacgtctgggtggc

SEQ ID NO: 5565979 - DNA, 14 bp, Homo sapiens
aggccgtgccttgt

SEQ ID NO: 5565980 - DNA, 22 bp, Homo sapiens
aggccgtggactggctcatgcc

SEQ ID NO: 5565981 - DNA, 12 bp, Homo sapiens
aggccgtggctg

SEQ ID NO: 5565982 - DNA, 15 bp, Homo sapiens
aggccgtggctgctg

SEQ ID NO: 5565983 - DNA, 16 bp, Homo sapiens
aggccgtgggacccag

SEQ ID NO: 5565984 - DNA, 22 bp, Homo sapiens
aggccgtgggacccaggctccc

SEQ ID NO: 5565985 - DNA, 13 bp, Homo sapiens
aggccgtgtctct

SEQ ID NO: 5565986 - DNA, 18 bp, Homo sapiens
aggccgtgtctctgagga

SEQ ID NO: 5565987 - DNA, 21 bp, Homo sapiens
aggccgtgtgtttagaagcct

SEQ ID NO: 5565988 - DNA, 21 bp, Homo sapiens
aggccgttgctgacttagaat

SEQ ID NO: 5565989 - DNA, 18 bp, Homo sapiens
aggcctaaggaagccagt

SEQ ID NO: 5565990 - DNA, 19 bp, Homo sapiens
aggcctaatctcatacctc

SEQ ID NO: 5565991 - DNA, 22 bp, Homo sapiens
aggcctaatctcatacctctga

SEQ ID NO: 5565992 - DNA, 19 bp, Homo sapiens
aggcctaatttttttttgt

SEQ ID NO: 5565993 - DNA, 19 bp, Homo sapiens
aggcctacagaaattgaaa

SEQ ID NO: 5565994 - DNA, 19 bp, Homo sapiens
aggcctacagaggaggcct

SEQ ID NO: 5565995 - DNA, 21 bp, Homo sapiens
aggcctacagccacatcccca

SEQ ID NO: 5565996 - DNA, 23 bp, Homo sapiens
aggcctacatgctttgtgaacaa

SEQ ID NO: 5565997 - DNA, 14 bp, Homo sapiens
aggcctaccccagt

SEQ ID NO: 5565998 - DNA, 21 bp, Homo sapiens
aggcctaccccagttcctagc

SEQ ID NO: 5565999 - DNA, 19 bp, Homo sapiens
aggcctaccccgcagacac

SEQ ID NO: 5566000 - DNA, 14 bp, Homo sapiens
aggcctacctcaag

SEQ ID NO: 5566001 - DNA, 13 bp, Homo sapiens
aggcctacctctc

SEQ ID NO: 5566002 - DNA, 23 bp, Homo sapiens
aggcctacctctcgtttctgccc

SEQ ID NO: 5566003 - DNA, 14 bp, Homo sapiens
aggcctacctgctc

SEQ ID NO: 5566004 - DNA, 17 bp, Homo sapiens
aggcctacctgctcccc

SEQ ID NO: 5566005 - DNA, 13 bp, Homo sapiens
aggcctactcctg

SEQ ID NO: 5566006 - DNA, 15 bp, Homo sapiens
aggcctactcctgtc

SEQ ID NO: 5566007 - DNA, 17 bp, Homo sapiens
aggcctactcctgtctt

SEQ ID NO: 5566008 - DNA, 17 bp, Homo sapiens
aggcctagactctgtct

SEQ ID NO: 5566009 - DNA, 21 bp, Homo sapiens
aggcctagactctgtctacct

SEQ ID NO: 5566010 - DNA, 16 bp, Homo sapiens
aggcctaggacctcag

SEQ ID NO: 5566011 - DNA, 17 bp, Homo sapiens
aggcctaggacctcagg

SEQ ID NO: 5566012 - DNA, 18 bp, Homo sapiens
aggcctaggacctcaggc

SEQ ID NO: 5566013 - DNA, 19 bp, Homo sapiens
aggcctaggacctcaggcg

SEQ ID NO: 5566014 - DNA, 17 bp, Homo sapiens
aggcctaggagggtcct

SEQ ID NO: 5566015 - DNA, 18 bp, Homo sapiens
aggcctaggagggtcctc

SEQ ID NO: 5566016 - DNA, 19 bp, Homo sapiens
aggcctaggctaggacgtt

SEQ ID NO: 5566017 - DNA, 22 bp, Homo sapiens
aggcctagtaaccaaggccctg

SEQ ID NO: 5566018 - DNA, 16 bp, Homo sapiens
aggcctagtacaatct

SEQ ID NO: 5566019 - DNA, 18 bp, Homo sapiens
aggcctagtacaatcttg

SEQ ID NO: 5566020 - DNA, 19 bp, Homo sapiens
aggcctagtacaatcttgg

SEQ ID NO: 5566021 - DNA, 15 bp, Homo sapiens
aggcctagtcctgcg

SEQ ID NO: 5566022 - DNA, 16 bp, Homo sapiens
aggcctataaccccag

SEQ ID NO: 5566023 - DNA, 15 bp, Homo sapiens
aggcctatgcagaca

SEQ ID NO: 5566024 - DNA, 23 bp, Homo sapiens
aggcctatgcagacatctctgga

SEQ ID NO: 5566025 - DNA, 20 bp, Homo sapiens
aggcctatgccacctgcagc

SEQ ID NO: 5566026 - DNA, 19 bp, Homo sapiens
aggcctattgttgaataaa

SEQ ID NO: 5566027 - DNA, 21 bp, Homo sapiens
aggcctattgttgaataaatg

SEQ ID NO: 5566028 - DNA, 22 bp, Homo sapiens
aggcctattgttgaataaatgt

SEQ ID NO: 5566029 - DNA, 14 bp, Homo sapiens
aggcctatttaaca

SEQ ID NO: 5566030 - DNA, 15 bp, Homo sapiens
aggcctatttaacaa

SEQ ID NO: 5566031 - DNA, 15 bp, Homo sapiens
aggcctcaactcctc

SEQ ID NO: 5566032 - DNA, 19 bp, Homo sapiens
aggcctcaactcctcccat

SEQ ID NO: 5566033 - DNA, 19 bp, Homo sapiens
aggcctcaccacctgacgc

SEQ ID NO: 5566034 - DNA, 13 bp, Homo sapiens
aggcctcaccctg

SEQ ID NO: 5566035 - DNA, 14 bp, Homo sapiens
aggcctcaccctgc

SEQ ID NO: 5566036 - DNA, 15 bp, Homo sapiens
aggcctcaccctgct

SEQ ID NO: 5566037 - DNA, 16 bp, Homo sapiens
aggcctcaccctgctt

SEQ ID NO: 5566038 - DNA, 17 bp, Homo sapiens
aggcctcaccctgcttg

SEQ ID NO: 5566039 - DNA, 17 bp, Homo sapiens
aggcctcacctcccagg

SEQ ID NO: 5566040 - DNA, 20 bp, Homo sapiens
aggcctcacctcccagggct

SEQ ID NO: 5566041 - DNA, 15 bp, Homo sapiens
aggcctcacctggct

SEQ ID NO: 5566042 - DNA, 22 bp, Homo sapiens
aggcctcactactcgagcccac

SEQ ID NO: 5566043 - DNA, 19 bp, Homo sapiens
aggcctcactcaagcctga

SEQ ID NO: 5566044 - DNA, 15 bp, Homo sapiens
aggcctcagccagag

SEQ ID NO: 5566045 - DNA, 16 bp, Homo sapiens
aggcctcaggcctccc

SEQ ID NO: 5566046 - DNA, 17 bp, Homo sapiens
aggcctcaggcctccca

SEQ ID NO: 5566047 - DNA, 16 bp, Homo sapiens
aggcctcagggaccaa

SEQ ID NO: 5566048 - DNA, 22 bp, Homo sapiens
aggcctcagggaccaaggagat

SEQ ID NO: 5566049 - DNA, 19 bp, Homo sapiens
aggcctcaggtgctgtcca

SEQ ID NO: 5566050 - DNA, 13 bp, Homo sapiens
aggcctcagttct

SEQ ID NO: 5566051 - DNA, 22 bp, Homo sapiens
aggcctcagtttctccatcagc

SEQ ID NO: 5566052 - DNA, 15 bp, Homo sapiens
aggcctcatccctcg

SEQ ID NO: 5566053 - DNA, 16 bp, Homo sapiens
aggcctcatccctcgg

SEQ ID NO: 5566054 - DNA, 23 bp, Homo sapiens
aggcctcatcctcctggacccag

SEQ ID NO: 5566055 - DNA, 13 bp, Homo sapiens
aggcctcatgcct

SEQ ID NO: 5566056 - DNA, 16 bp, Homo sapiens
aggcctcatgcctgct

SEQ ID NO: 5566057 - DNA, 19 bp, Homo sapiens
aggcctccaacgcccctgt

SEQ ID NO: 5566058 - DNA, 22 bp, Homo sapiens
aggcctccaacgcccctgtggc

SEQ ID NO: 5566059 - DNA, 23 bp, Homo sapiens
aggcctccaacgcccctgtggcc

SEQ ID NO: 5566060 - DNA, 12 bp, Homo sapiens
aggcctccactc

SEQ ID NO: 5566061 - DNA, 17 bp, Homo sapiens
aggcctccagcctctcc

SEQ ID NO: 5566062 - DNA, 18 bp, Homo sapiens
aggcctccagcctctccc

SEQ ID NO: 5566063 - DNA, 13 bp, Homo sapiens
aggcctcccaagc

SEQ ID NO: 5566064 - DNA, 13 bp, Homo sapiens
aggcctcccacag

SEQ ID NO: 5566065 - DNA, 16 bp, Homo sapiens
aggcctcccacagtga

SEQ ID NO: 5566066 - DNA, 12 bp, Homo sapiens
aggcctccccag

SEQ ID NO: 5566067 - DNA, 13 bp, Homo sapiens
aggcctccccagc

SEQ ID NO: 5566068 - DNA, 18 bp, Homo sapiens
aggcctccccagcaccta

SEQ ID NO: 5566069 - DNA, 11 bp, Homo sapiens
aggcctcccct

SEQ ID NO: 5566070 - DNA, 12 bp, Homo sapiens
aggcctcccctg

SEQ ID NO: 5566071 - DNA, 22 bp, Homo sapiens
aggcctcccctgaggatcccct

SEQ ID NO: 5566072 - DNA, 17 bp, Homo sapiens
aggcctcccgcatgctg

SEQ ID NO: 5566073 - DNA, 18 bp, Homo sapiens
aggcctccctagcacctc

SEQ ID NO: 5566074 - DNA, 14 bp, Homo sapiens
aggcctccctcagg

SEQ ID NO: 5566075 - DNA, 20 bp, Homo sapiens
aggcctccctcaggctctgt

SEQ ID NO: 5566076 - DNA, 23 bp, Homo sapiens
aggcctccctgcagactccaatg

SEQ ID NO: 5566077 - DNA, 14 bp, Homo sapiens
aggcctccctgcca

SEQ ID NO: 5566078 - DNA, 15 bp, Homo sapiens
aggcctccctgccag

SEQ ID NO: 5566079 - DNA, 16 bp, Homo sapiens
aggcctccctgccagt

SEQ ID NO: 5566080 - DNA, 17 bp, Homo sapiens
aggcctccctgccagta

SEQ ID NO: 5566081 - DNA, 13 bp, Homo sapiens
aggcctccctgtt

SEQ ID NO: 5566082 - DNA, 19 bp, Homo sapiens
aggcctccctttggggaga

SEQ ID NO: 5566083 - DNA, 15 bp, Homo sapiens
aggcctcctagggga

SEQ ID NO: 5566084 - DNA, 16 bp, Homo sapiens
aggcctcctaggggaa

SEQ ID NO: 5566085 - DNA, 17 bp, Homo sapiens
aggcctcctaggggaag

SEQ ID NO: 5566086 - DNA, 21 bp, Homo sapiens
aggcctcctaggggaaggggg

SEQ ID NO: 5566087 - DNA, 16 bp, Homo sapiens
aggcctcctcccccac

SEQ ID NO: 5566088 - DNA, 15 bp, Homo sapiens
aggcctcctctctgc

SEQ ID NO: 5566089 - DNA, 14 bp, Homo sapiens
aggcctcctggctg

SEQ ID NO: 5566090 - DNA, 16 bp, Homo sapiens
aggcctcgcacttgca

SEQ ID NO: 5566091 - DNA, 19 bp, Homo sapiens
aggcctcgcacttgcagag

SEQ ID NO: 5566092 - DNA, 20 bp, Homo sapiens
aggcctcgcctgccctcctc

SEQ ID NO: 5566093 - DNA, 24 bp, Homo sapiens
aggcctcggcagaactctctgtct

SEQ ID NO: 5566094 - DNA, 20 bp, Homo sapiens
aggcctcggctgtctcctgt

SEQ ID NO: 5566095 - DNA, 17 bp, Homo sapiens
aggcctctactaggtct

SEQ ID NO: 5566096 - DNA, 14 bp, Homo sapiens
aggcctctcagaaa

SEQ ID NO: 5566097 - DNA, 21 bp, Homo sapiens
aggcctctccagtttgcacct

SEQ ID NO: 5566098 - DNA, 23 bp, Homo sapiens
aggcctctccagtttgcacctgt

SEQ ID NO: 5566099 - DNA, 24 bp, Homo sapiens
aggcctctccagtttgcacctgtc

SEQ ID NO: 5566100 - DNA, 21 bp, Homo sapiens
aggcctctcggtgctccatct

SEQ ID NO: 5566101 - DNA, 12 bp, Homo sapiens
aggcctctctct

SEQ ID NO: 5566102 - DNA, 16 bp, Homo sapiens
aggcctctctctgcct

SEQ ID NO: 5566103 - DNA, 17 bp, Homo sapiens
aggcctctctctgcctg

SEQ ID NO: 5566104 - DNA, 15 bp, Homo sapiens
aggcctctctctgct

SEQ ID NO: 5566105 - DNA, 17 bp, Homo sapiens
aggcctctctctgctcc

SEQ ID NO: 5566106 - DNA, 18 bp, Homo sapiens
aggcctctctctgctcca

SEQ ID NO: 5566107 - DNA, 20 bp, Homo sapiens
aggcctctctctgctccatc

SEQ ID NO: 5566108 - DNA, 21 bp, Homo sapiens
aggcctctcttttccccgcct

SEQ ID NO: 5566109 - DNA, 19 bp, Homo sapiens
aggcctctgagcccaagct

SEQ ID NO: 5566110 - DNA, 18 bp, Homo sapiens
aggcctctgaggagccca

SEQ ID NO: 5566111 - DNA, 14 bp, Homo sapiens
aggcctctgcagaa

SEQ ID NO: 5566112 - DNA, 19 bp, Homo sapiens
aggcctctgccccaagagc

SEQ ID NO: 5566113 - DNA, 22 bp, Homo sapiens
aggcctctgccccaagagcagg

SEQ ID NO: 5566114 - DNA, 18 bp, Homo sapiens
aggcctctgcctcacaac

SEQ ID NO: 5566115 - DNA, 13 bp, Homo sapiens
aggcctctgcctg

SEQ ID NO: 5566116 - DNA, 15 bp, Homo sapiens
aggcctctgcctgct

SEQ ID NO: 5566117 - DNA, 22 bp, Homo sapiens
aggcctctgcctgctggggatt

SEQ ID NO: 5566118 - DNA, 20 bp, Homo sapiens
aggcctctgctgccgccctt

SEQ ID NO: 5566119 - DNA, 15 bp, Homo sapiens
aggcctctgctggct

SEQ ID NO: 5566120 - DNA, 13 bp, Homo sapiens
aggcctctggact

SEQ ID NO: 5566121 - DNA, 23 bp, Homo sapiens
aggcctctggactggcctgtctg

SEQ ID NO: 5566122 - DNA, 12 bp, Homo sapiens
aggcctctggcc

SEQ ID NO: 5566123 - DNA, 14 bp, Homo sapiens
aggctcgattttgt

SEQ ID NO: 5566124 - DNA, 15 bp, Homo sapiens
aggctcgattttgta

SEQ ID NO: 5566125 - DNA, 23 bp, Homo sapiens
aggctcgattttgtatctgcagg

SEQ ID NO: 5566126 - DNA, 16 bp, Homo sapiens
aggctcgccaaggcct

SEQ ID NO: 5566127 - DNA, 15 bp, Homo sapiens
aggctcgccttccct

SEQ ID NO: 5566128 - DNA, 20 bp, Homo sapiens
aggctcggaggaccctggaa

SEQ ID NO: 5566129 - DNA, 15 bp, Homo sapiens
aggctcggccgtggg

SEQ ID NO: 5566130 - DNA, 22 bp, Homo sapiens
aggctcggccgtgggccgggag

SEQ ID NO: 5566131 - DNA, 12 bp, Homo sapiens
aggctcggggct

SEQ ID NO: 5566132 - DNA, 14 bp, Homo sapiens
aggctcggggctcc

SEQ ID NO: 5566133 - DNA, 17 bp, Homo sapiens
aggctcggggctcccca

SEQ ID NO: 5566134 - DNA, 23 bp, Homo sapiens
aggctcggggctccccacgcccc

SEQ ID NO: 5566135 - DNA, 18 bp, Homo sapiens
aggctcgtcagccacctg

SEQ ID NO: 5566136 - DNA, 16 bp, Homo sapiens
aggctcgtttggatct

SEQ ID NO: 5566137 - DNA, 18 bp, Homo sapiens
aggctctaaccacacagc

SEQ ID NO: 5566138 - DNA, 23 bp, Homo sapiens
aggctctaattctctaggaaagt

SEQ ID NO: 5566139 - DNA, 17 bp, Homo sapiens
aggctctagatcataag

SEQ ID NO: 5566140 - DNA, 16 bp, Homo sapiens
aggctctatctgctgg

SEQ ID NO: 5566141 - DNA, 23 bp, Homo sapiens
aggctctattccaataaactatg

SEQ ID NO: 5566142 - DNA, 16 bp, Homo sapiens
aggctctattgagcca

SEQ ID NO: 5566143 - DNA, 22 bp, Homo sapiens
aggctctcactaccgtggacca

SEQ ID NO: 5566144 - DNA, 14 bp, Homo sapiens
aggctctcaggcca

SEQ ID NO: 5566145 - DNA, 14 bp, Homo sapiens
aggctctcaggtgc

SEQ ID NO: 5566146 - DNA, 11 bp, Homo sapiens
aggctctcccc

SEQ ID NO: 5566147 - DNA, 14 bp, Homo sapiens
aggctctcccctct

SEQ ID NO: 5566148 - DNA, 16 bp, Homo sapiens
aggctctcccctctcg

SEQ ID NO: 5566149 - DNA, 12 bp, Homo sapiens
aggctctccctc

SEQ ID NO: 5566150 - DNA, 19 bp, Homo sapiens
aggctctccctctctgcac

SEQ ID NO: 5566151 - DNA, 22 bp, Homo sapiens
aggctctccctctctgcacctg

SEQ ID NO: 5566152 - DNA, 23 bp, Homo sapiens
aggctctcctggctgtcctacca

SEQ ID NO: 5566153 - DNA, 14 bp, Homo sapiens
aggctctctaagaa

SEQ ID NO: 5566154 - DNA, 22 bp, Homo sapiens
aggctctctaagaaaagagagg

SEQ ID NO: 5566155 - DNA, 23 bp, Homo sapiens
aggctctctcataacccctctat

SEQ ID NO: 5566156 - DNA, 12 bp, Homo sapiens
aggctctctcct

SEQ ID NO: 5566157 - DNA, 17 bp, Homo sapiens
aggctctctctgtccct

SEQ ID NO: 5566158 - DNA, 19 bp, Homo sapiens
aggctctctggtctacctg

SEQ ID NO: 5566159 - DNA, 15 bp, Homo sapiens
aggctctgaatctct

SEQ ID NO: 5566160 - DNA, 19 bp, Homo sapiens
aggctctgagagtctagat

SEQ ID NO: 5566161 - DNA, 20 bp, Homo sapiens
aggctctgagagtctagatt

SEQ ID NO: 5566162 - DNA, 21 bp, Homo sapiens
aggctctgagagtctagattc

SEQ ID NO: 5566163 - DNA, 23 bp, Homo sapiens
aggctctgagagtctagattctc

SEQ ID NO: 5566164 - DNA, 19 bp, Homo sapiens
aggctctgaggggatgcaa

SEQ ID NO: 5566165 - DNA, 17 bp, Homo sapiens
aggctctgaggggcacg

SEQ ID NO: 5566166 - DNA, 15 bp, Homo sapiens
aggctctgcacagat

SEQ ID NO: 5566167 - DNA, 13 bp, Homo sapiens
aggctctgcccag

SEQ ID NO: 5566168 - DNA, 13 bp, Homo sapiens
aggctctgccctg

SEQ ID NO: 5566169 - DNA, 14 bp, Homo sapiens
aggctctgccttcg

SEQ ID NO: 5566170 - DNA, 21 bp, Homo sapiens
aggctctgctgacttctgagc

SEQ ID NO: 5566171 - DNA, 12 bp, Homo sapiens
aggctctggaca

SEQ ID NO: 5566172 - DNA, 15 bp, Homo sapiens
aggctctggacagca

SEQ ID NO: 5566173 - DNA, 21 bp, Homo sapiens
aggctctggacagcagaagcc

SEQ ID NO: 5566174 - DNA, 22 bp, Homo sapiens
aggctctggacagcagaagcct

SEQ ID NO: 5566175 - DNA, 13 bp, Homo sapiens
aggctctggagcc

SEQ ID NO: 5566176 - DNA, 15 bp, Homo sapiens
aggctctggagccca

SEQ ID NO: 5566177 - DNA, 18 bp, Homo sapiens
aggctctggagcccactg

SEQ ID NO: 5566178 - DNA, 22 bp, Homo sapiens
aggctctggagcccactgtact

SEQ ID NO: 5566179 - DNA, 13 bp, Homo sapiens
aggctctggccct

SEQ ID NO: 5566180 - DNA, 17 bp, Homo sapiens
aggctctgggcacagtg

SEQ ID NO: 5566181 - DNA, 19 bp, Homo sapiens
aggctctgggcacagtgct

SEQ ID NO: 5566182 - DNA, 22 bp, Homo sapiens
aggctctgggcacagtgctgcc

SEQ ID NO: 5566183 - DNA, 13 bp, Homo sapiens
aggctctgggctc

SEQ ID NO: 5566184 - DNA, 17 bp, Homo sapiens
aggctctgggctcaggg

SEQ ID NO: 5566185 - DNA, 13 bp, Homo sapiens
aggctctgtcact

SEQ ID NO: 5566186 - DNA, 17 bp, Homo sapiens
aggctctgtgccttggt

SEQ ID NO: 5566187 - DNA, 16 bp, Homo sapiens
aggctctgtgctgacc

SEQ ID NO: 5566188 - DNA, 22 bp, Homo sapiens
aggctctgtgtgttaaaatgag

SEQ ID NO: 5566189 - DNA, 21 bp, Homo sapiens
aggctctgttatcagctgggc

SEQ ID NO: 5566190 - DNA, 17 bp, Homo sapiens
aggctctgttccacata

SEQ ID NO: 5566191 - DNA, 18 bp, Homo sapiens
aggctcttaagcagcatg

SEQ ID NO: 5566192 - DNA, 21 bp, Homo sapiens
aggctcttctccttggaggac

SEQ ID NO: 5566193 - DNA, 15 bp, Homo sapiens
aggctcttcttcctc

SEQ ID NO: 5566194 - DNA, 16 bp, Homo sapiens
aggctcttcttcctca

SEQ ID NO: 5566195 - DNA, 15 bp, Homo sapiens
aggctcttctttccc

SEQ ID NO: 5566196 - DNA, 17 bp, Homo sapiens
aggctgaaaagtgcttt

SEQ ID NO: 5566197 - DNA, 12 bp, Homo sapiens
aggctgaaagcc

SEQ ID NO: 5566198 - DNA, 21 bp, Homo sapiens
aggctgaaatatccacccagc

SEQ ID NO: 5566199 - DNA, 23 bp, Homo sapiens
aggctgaaatatccacccagcag

SEQ ID NO: 5566200 - DNA, 16 bp, Homo sapiens
aggctgaactcttcag

SEQ ID NO: 5566201 - DNA, 19 bp, Homo sapiens
aggctgaagagagggacag

SEQ ID NO: 5566202 - DNA, 21 bp, Homo sapiens
aggctgaatcaaagacatttc

SEQ ID NO: 5566203 - DNA, 23 bp, Homo sapiens
aggctgacacagaggctggcact

SEQ ID NO: 5566204 - DNA, 21 bp, Homo sapiens
aggctgacacctaactcttct

SEQ ID NO: 5566205 - DNA, 18 bp, Homo sapiens
aggctgacatgctcacac

SEQ ID NO: 5566206 - DNA, 18 bp, Homo sapiens
aggctgactgggggcctc

SEQ ID NO: 5566207 - DNA, 19 bp, Homo sapiens
aggctgactgggggcctct

SEQ ID NO: 5566208 - DNA, 21 bp, Homo sapiens
aggctgactgggggcctctgc

SEQ ID NO: 5566209 - DNA, 23 bp, Homo sapiens
aggctgactgggggcctctgcct

SEQ ID NO: 5566210 - DNA, 21 bp, Homo sapiens
aggctgagaactcgttcacct

SEQ ID NO: 5566211 - DNA, 13 bp, Homo sapiens
aggctgagaagga

SEQ ID NO: 5566212 - DNA, 15 bp, Homo sapiens
aggctgagacacagc

SEQ ID NO: 5566213 - DNA, 14 bp, Homo sapiens
aggctgagacagga

SEQ ID NO: 5566214 - DNA, 17 bp, Homo sapiens
aggctgagacaggagaa

SEQ ID NO: 5566215 - DNA, 18 bp, Homo sapiens
aggctgagacaggagaat

SEQ ID NO: 5566216 - DNA, 19 bp, Homo sapiens
aggctgagacgcaaggatc

SEQ ID NO: 5566217 - DNA, 17 bp, Homo sapiens
aggctgagactgcagag

SEQ ID NO: 5566218 - DNA, 21 bp, Homo sapiens
aggctgagactgcagaggagc

SEQ ID NO: 5566219 - DNA, 14 bp, Homo sapiens
aggctgagagccag

SEQ ID NO: 5566220 - DNA, 16 bp, Homo sapiens
aggctgagatgcacca

SEQ ID NO: 5566221 - DNA, 14 bp, Homo sapiens
aggctgagcacctt

SEQ ID NO: 5566222 - DNA, 13 bp, Homo sapiens
aggctgagccatg

SEQ ID NO: 5566223 - DNA, 16 bp, Homo sapiens
aggctgagccatgagg

SEQ ID NO: 5566224 - DNA, 16 bp, Homo sapiens
aggctgagcccagcca

SEQ ID NO: 5566225 - DNA, 18 bp, Homo sapiens
aggctgagccctgtaccc

SEQ ID NO: 5566226 - DNA, 23 bp, Homo sapiens
aggctgagccctgtacccacccc

SEQ ID NO: 5566227 - DNA, 21 bp, Homo sapiens
aggctgagccgatctggtctc

SEQ ID NO: 5566228 - DNA, 15 bp, Homo sapiens
aggctgaggaaaggc

SEQ ID NO: 5566229 - DNA, 11 bp, Homo sapiens
aggctgaggac

SEQ ID NO: 5566230 - DNA, 13 bp, Homo sapiens
aggctgaggactt

SEQ ID NO: 5566231 - DNA, 20 bp, Homo sapiens
aggctgaggcaccagaattg

SEQ ID NO: 5566232 - DNA, 14 bp, Homo sapiens
aggctgaggcagaa

SEQ ID NO: 5566233 - DNA, 15 bp, Homo sapiens
aggctgaggcagaag

SEQ ID NO: 5566234 - DNA, 15 bp, Homo sapiens
aggctgaggcaggag

SEQ ID NO: 5566235 - DNA, 19 bp, Homo sapiens
aggctgaggcaggagaatg

SEQ ID NO: 5566236 - DNA, 18 bp, Homo sapiens
aggctgaggcaggagact

SEQ ID NO: 5566237 - DNA, 17 bp, Homo sapiens
aggctgaggcaggagga

SEQ ID NO: 5566238 - DNA, 16 bp, Homo sapiens
aggctgaggcaggtgg

SEQ ID NO: 5566239 - DNA, 14 bp, Homo sapiens
aggctgaggcctgg

SEQ ID NO: 5566240 - DNA, 13 bp, Homo sapiens
aggctgaggctgc

SEQ ID NO: 5566241 - DNA, 14 bp, Homo sapiens
aggctgaggctgcc

SEQ ID NO: 5566242 - DNA, 15 bp, Homo sapiens
aggctgaggctgccc

SEQ ID NO: 5566243 - DNA, 18 bp, Homo sapiens
aggctgaggctggcacag

SEQ ID NO: 5566244 - DNA, 19 bp, Homo sapiens
aggctgagggctgccagca

SEQ ID NO: 5566245 - DNA, 22 bp, Homo sapiens
aggctgagggctgccagcagcc

SEQ ID NO: 5566246 - DNA, 22 bp, Homo sapiens
aggctgaggggaggatcactgg

SEQ ID NO: 5566247 - DNA, 16 bp, Homo sapiens
aggctgagggtcgtgg

SEQ ID NO: 5566248 - DNA, 14 bp, Homo sapiens
aggctgaggtggca

SEQ ID NO: 5566249 - DNA, 15 bp, Homo sapiens
aggctgaggtgggga

SEQ ID NO: 5566250 - DNA, 19 bp, Homo sapiens
aggctgaggttgcgccact

SEQ ID NO: 5566251 - DNA, 14 bp, Homo sapiens
aggctgagtccaga

SEQ ID NO: 5566252 - DNA, 17 bp, Homo sapiens
aggctgagtccagagct

SEQ ID NO: 5566253 - DNA, 18 bp, Homo sapiens
aggctgagtgagccacag

SEQ ID NO: 5566254 - DNA, 17 bp, Homo sapiens
aggctgagtgcaggccc

SEQ ID NO: 5566255 - DNA, 18 bp, Homo sapiens
aggctgagtgcaggccca

SEQ ID NO: 5566256 - DNA, 20 bp, Homo sapiens
aggctgagtgcaggcccacc

SEQ ID NO: 5566257 - DNA, 14 bp, Homo sapiens
aggctgagttctgg

SEQ ID NO: 5566258 - DNA, 23 bp, Homo sapiens
aggctgagtttagtttttcactt

SEQ ID NO: 5566259 - DNA, 20 bp, Homo sapiens
aggctgataattccagtggt

SEQ ID NO: 5566260 - DNA, 19 bp, Homo sapiens
aggctgatgcattcccggt

SEQ ID NO: 5566261 - DNA, 23 bp, Homo sapiens
aggctgatgccgtgcgggctaat

SEQ ID NO: 5566262 - DNA, 16 bp, Homo sapiens
aggctgatttggagtg

SEQ ID NO: 5566263 - DNA, 14 bp, Homo sapiens
aggctgcaaaatta

SEQ ID NO: 5566264 - DNA, 17 bp, Homo sapiens
aggctgcaagctgcagg

SEQ ID NO: 5566265 - DNA, 22 bp, Homo sapiens
aggctgcaaggtttaggctggt

SEQ ID NO: 5566266 - DNA, 14 bp, Homo sapiens
aggctgcacagcat

SEQ ID NO: 5566267 - DNA, 21 bp, Homo sapiens
aggctgcacctctggctagag

SEQ ID NO: 5566268 - DNA, 23 bp, Homo sapiens
aggctgcacctctggctagagcc

SEQ ID NO: 5566269 - DNA, 24 bp, Homo sapiens
aggctgcacctctggctagagccg

SEQ ID NO: 5566270 - DNA, 11 bp, Homo sapiens
aggctgcactg

SEQ ID NO: 5566271 - DNA, 13 bp, Homo sapiens
aggctgcactgca

SEQ ID NO: 5566272 - DNA, 19 bp, Homo sapiens
aggctgcactgcagccaca

SEQ ID NO: 5566273 - DNA, 18 bp, Homo sapiens
aggctgcactggagccac

SEQ ID NO: 5566274 - DNA, 19 bp, Homo sapiens
aggctgcactggagccaca

SEQ ID NO: 5566275 - DNA, 20 bp, Homo sapiens
aggctgcactggagccacag

SEQ ID NO: 5566276 - DNA, 21 bp, Homo sapiens
aggctgcagaaggccaagaat

SEQ ID NO: 5566277 - DNA, 20 bp, Homo sapiens
aggctgcagagctgacccag

SEQ ID NO: 5566278 - DNA, 19 bp, Homo sapiens
aggctgcagaggcacctca

SEQ ID NO: 5566279 - DNA, 23 bp, Homo sapiens
aggctgcagataacagaaaggct

SEQ ID NO: 5566280 - DNA, 19 bp, Homo sapiens
aggctgcagcaggtgctgg

SEQ ID NO: 5566281 - DNA, 15 bp, Homo sapiens
aggctgcagccaggc

SEQ ID NO: 5566282 - DNA, 16 bp, Homo sapiens
aggctgcagccaggcc

SEQ ID NO: 5566283 - DNA, 18 bp, Homo sapiens
aggctgcagccaggccac

SEQ ID NO: 5566284 - DNA, 17 bp, Homo sapiens
aggctgcagccaggcct

SEQ ID NO: 5566285 - DNA, 23 bp, Homo sapiens
aggctgcagcctccacttccctc

SEQ ID NO: 5566286 - DNA, 22 bp, Homo sapiens
aggctgcagctaatttgtgaaa

SEQ ID NO: 5566287 - DNA, 16 bp, Homo sapiens
aggctgcagctggaca

SEQ ID NO: 5566288 - DNA, 21 bp, Homo sapiens
aggctgcagctggacagaggg

SEQ ID NO: 5566289 - DNA, 22 bp, Homo sapiens
aggctgcagctggacagagggg

SEQ ID NO: 5566290 - DNA, 14 bp, Homo sapiens
aggctgcaggaggg

SEQ ID NO: 5566291 - DNA, 15 bp, Homo sapiens
aggctgcaggagggc

SEQ ID NO: 5566292 - DNA, 14 bp, Homo sapiens
aggctgcagtcagc

SEQ ID NO: 5566293 - DNA, 17 bp, Homo sapiens
aggctgcagtgagccga

SEQ ID NO: 5566294 - DNA, 19 bp, Homo sapiens
aggctgcagtgagccgaga

SEQ ID NO: 5566295 - DNA, 19 bp, Homo sapiens
aggctgcagtggctcccct

SEQ ID NO: 5566296 - DNA, 22 bp, Homo sapiens
aggctgcagtggctcccctgcc

SEQ ID NO: 5566297 - DNA, 19 bp, Homo sapiens
aggctgcatagaaggagga

SEQ ID NO: 5566298 - DNA, 17 bp, Homo sapiens
aggctgcatgctctgga

SEQ ID NO: 5566299 - DNA, 20 bp, Homo sapiens
aggctgcatgctctggaagc

SEQ ID NO: 5566300 - DNA, 16 bp, Homo sapiens
aggcttggtcccatcg

SEQ ID NO: 5566301 - DNA, 19 bp, Homo sapiens
aggcttggttccttcccaa

SEQ ID NO: 5566302 - DNA, 19 bp, Homo sapiens
aggcttgtcactagcagct

SEQ ID NO: 5566303 - DNA, 15 bp, Homo sapiens
aggcttgtcagagct

SEQ ID NO: 5566304 - DNA, 18 bp, Homo sapiens
aggcttgtcagagctggg

SEQ ID NO: 5566305 - DNA, 14 bp, Homo sapiens
aggctttaaagctg

SEQ ID NO: 5566306 - DNA, 17 bp, Homo sapiens
aggctttaagctccagc

SEQ ID NO: 5566307 - DNA, 15 bp, Homo sapiens
aggctttagaagaga

SEQ ID NO: 5566308 - DNA, 19 bp, Homo sapiens
aggctttattcttccaagt

SEQ ID NO: 5566309 - DNA, 22 bp, Homo sapiens
aggctttattcttccaagttca

SEQ ID NO: 5566310 - DNA, 21 bp, Homo sapiens
aggctttatttataaaataaa

SEQ ID NO: 5566311 - DNA, 14 bp, Homo sapiens
aggctttcaaatgt

SEQ ID NO: 5566312 - DNA, 16 bp, Homo sapiens
aggctttcaaatgtac

SEQ ID NO: 5566313 - DNA, 21 bp, Homo sapiens
aggctttcaattgtattttat

SEQ ID NO: 5566314 - DNA, 14 bp, Homo sapiens
aggctttcagggcc

SEQ ID NO: 5566315 - DNA, 18 bp, Homo sapiens
aggctttcccacttccca

SEQ ID NO: 5566316 - DNA, 22 bp, Homo sapiens
aggctttcccacttcccaccct

SEQ ID NO: 5566317 - DNA, 23 bp, Homo sapiens
aggctttctattggcatggattt

SEQ ID NO: 5566318 - DNA, 13 bp, Homo sapiens
aggctttctctac

SEQ ID NO: 5566319 - DNA, 22 bp, Homo sapiens
aggctttctgggctctggactc

SEQ ID NO: 5566320 - DNA, 23 bp, Homo sapiens
aggctttctgggctctggactcc

SEQ ID NO: 5566321 - DNA, 19 bp, Homo sapiens
aggctttctgggtgtgact

SEQ ID NO: 5566322 - DNA, 21 bp, Homo sapiens
aggctttgccatgggcctgct

SEQ ID NO: 5566323 - DNA, 22 bp, Homo sapiens
aggctttgccatgggcctgctg

SEQ ID NO: 5566324 - DNA, 23 bp, Homo sapiens
aggctttgccatgggcctgctgc

SEQ ID NO: 5566325 - DNA, 18 bp, Homo sapiens
aggctttggcaacagaaa

SEQ ID NO: 5566326 - DNA, 22 bp, Homo sapiens
aggctttgggaacactggcctg

SEQ ID NO: 5566327 - DNA, 23 bp, Homo sapiens
aggctttggggtcctagcccagt

SEQ ID NO: 5566328 - DNA, 18 bp, Homo sapiens
aggctttgggtggctcac

SEQ ID NO: 5566329 - DNA, 22 bp, Homo sapiens
aggctttgggtggctcactact

SEQ ID NO: 5566330 - DNA, 24 bp, Homo sapiens
aggctttgtgagagaggacctcca

SEQ ID NO: 5566331 - DNA, 18 bp, Homo sapiens
aggctttgtgttgtaatt

SEQ ID NO: 5566332 - DNA, 15 bp, Homo sapiens
aggcttttattagaa

SEQ ID NO: 5566333 - DNA, 15 bp, Homo sapiens
aggcttttatttctg

SEQ ID NO: 5566334 - DNA, 18 bp, Homo sapiens
aggcttttcactgcctgt

SEQ ID NO: 5566335 - DNA, 22 bp, Homo sapiens
aggcttttgtttcctttttcag

SEQ ID NO: 5566336 - DNA, 17 bp, Homo sapiens
aggctttttaggaactc

SEQ ID NO: 5566337 - DNA, 10 bp, Homo sapiens
agggaaaaaa

SEQ ID NO: 5566338 - DNA, 19 bp, Homo sapiens
agggaaaaaaaacaggagg

SEQ ID NO: 5566339 - DNA, 14 bp, Homo sapiens
agggaaaaaaagaa

SEQ ID NO: 5566340 - DNA, 19 bp, Homo sapiens
agggaaaaaaatgcttctt

SEQ ID NO: 5566341 - DNA, 14 bp, Homo sapiens
agggaaaaaacaag

SEQ ID NO: 5566342 - DNA, 17 bp, Homo sapiens
agggaaaaaacatgtaa

SEQ ID NO: 5566343 - DNA, 11 bp, Homo sapiens
agggaaaaaag

SEQ ID NO: 5566344 - DNA, 14 bp, Homo sapiens
agggaaaaaagaaa

SEQ ID NO: 5566345 - DNA, 16 bp, Homo sapiens
agggaaaaaagaaaga

SEQ ID NO: 5566346 - DNA, 18 bp, Homo sapiens
agggaaaaaagaaagaaa

SEQ ID NO: 5566347 - DNA, 21 bp, Homo sapiens
agggaaaaaagaaagaaaaag

SEQ ID NO: 5566348 - DNA, 18 bp, Homo sapiens
agggaaaaaagagtttaa

SEQ ID NO: 5566349 - DNA, 22 bp, Homo sapiens
agggaaaaaagagtttaaacaa

SEQ ID NO: 5566350 - DNA, 14 bp, Homo sapiens
agggaaaaaataaa

SEQ ID NO: 5566351 - DNA, 13 bp, Homo sapiens
agggaaaaagttg

SEQ ID NO: 5566352 - DNA, 13 bp, Homo sapiens
agggaaaacacag

SEQ ID NO: 5566353 - DNA, 22 bp, Homo sapiens
agggaaaacacggccctcctgg

SEQ ID NO: 5566354 - DNA, 23 bp, Homo sapiens
agggaaaacacggccctcctggg

SEQ ID NO: 5566355 - DNA, 13 bp, Homo sapiens
agggaaaacagaa

SEQ ID NO: 5566356 - DNA, 15 bp, Homo sapiens
agggaaaacagaaaa

SEQ ID NO: 5566357 - DNA, 16 bp, Homo sapiens
agggaaaacattccat

SEQ ID NO: 5566358 - DNA, 18 bp, Homo sapiens
agggaaaacattccatcc

SEQ ID NO: 5566359 - DNA, 13 bp, Homo sapiens
agggaaaagcaga

SEQ ID NO: 5566360 - DNA, 15 bp, Homo sapiens
agggaaaagcagatg

SEQ ID NO: 5566361 - DNA, 15 bp, Homo sapiens
agggaaaagctaaga

SEQ ID NO: 5566362 - DNA, 16 bp, Homo sapiens
agggaaaaggggctcc

SEQ ID NO: 5566363 - DNA, 17 bp, Homo sapiens
agggaaaaggggctcct

SEQ ID NO: 5566364 - DNA, 18 bp, Homo sapiens
agggaaaataggcaggaa

SEQ ID NO: 5566365 - DNA, 16 bp, Homo sapiens
agggaaaatcttcact

SEQ ID NO: 5566366 - DNA, 22 bp, Homo sapiens
agggaaaatgcagcagggatgc

SEQ ID NO: 5566367 - DNA, 21 bp, Homo sapiens
agggaaaatggatatagaaaa

SEQ ID NO: 5566368 - DNA, 16 bp, Homo sapiens
agggaaaattgcccca

SEQ ID NO: 5566369 - DNA, 16 bp, Homo sapiens
agggaaacaaaatatt

SEQ ID NO: 5566370 - DNA, 21 bp, Homo sapiens
agggaaaccagagtctgtatt

SEQ ID NO: 5566371 - DNA, 20 bp, Homo sapiens
agggaaacccggggaactgg

SEQ ID NO: 5566372 - DNA, 11 bp, Homo sapiens
agggaaacctt

SEQ ID NO: 5566373 - DNA, 17 bp, Homo sapiens
agggaaaccttggagag

SEQ ID NO: 5566374 - DNA, 15 bp, Homo sapiens
agggaaactaagatt

SEQ ID NO: 5566375 - DNA, 19 bp, Homo sapiens
agggaaactaagattcttt

SEQ ID NO: 5566376 - DNA, 22 bp, Homo sapiens
agggaaactaagattcttttaa

SEQ ID NO: 5566377 - DNA, 19 bp, Homo sapiens
agggaaactcagatgtcca

SEQ ID NO: 5566378 - DNA, 16 bp, Homo sapiens
agggaaactctggaga

SEQ ID NO: 5566379 - DNA, 17 bp, Homo sapiens
agggaaactctggagag

SEQ ID NO: 5566380 - DNA, 15 bp, Homo sapiens
agggaaactgccagc

SEQ ID NO: 5566381 - DNA, 16 bp, Homo sapiens
agggaaactgccagca

SEQ ID NO: 5566382 - DNA, 13 bp, Homo sapiens
agggaaactggct

SEQ ID NO: 5566383 - DNA, 15 bp, Homo sapiens
agggaaactggctga

SEQ ID NO: 5566384 - DNA, 15 bp, Homo sapiens
agggaaactgtgaat

SEQ ID NO: 5566385 - DNA, 15 bp, Homo sapiens
agggaaacttcccgt

SEQ ID NO: 5566386 - DNA, 16 bp, Homo sapiens
agggaaagaattgagg

SEQ ID NO: 5566387 - DNA, 12 bp, Homo sapiens
agggaaagactg

SEQ ID NO: 5566388 - DNA, 16 bp, Homo sapiens
agggaaagcatttaaa

SEQ ID NO: 5566389 - DNA, 16 bp, Homo sapiens
agggaaagccagcctg

SEQ ID NO: 5566390 - DNA, 14 bp, Homo sapiens
agggaaagcctctg

SEQ ID NO: 5566391 - DNA, 21 bp, Homo sapiens
agggaaagcgggcagccccgt

SEQ ID NO: 5566392 - DNA, 14 bp, Homo sapiens
agggaaagggaggg

SEQ ID NO: 5566393 - DNA, 17 bp, Homo sapiens
agggaaaggttttgtat

SEQ ID NO: 5566394 - DNA, 21 bp, Homo sapiens
agggaaaggttttgtattttt

SEQ ID NO: 5566395 - DNA, 21 bp, Homo sapiens
agggaaagttttgttctgtat

SEQ ID NO: 5566396 - DNA, 15 bp, Homo sapiens
agggaaatagaaaaa

SEQ ID NO: 5566397 - DNA, 23 bp, Homo sapiens
agggaaatagaaaaaccctgccc

SEQ ID NO: 5566398 - DNA, 22 bp, Homo sapiens
agggaaatcaatttaaaggaaa

SEQ ID NO: 5566399 - DNA, 23 bp, Homo sapiens
agggaaatcaatttaaaggaaag

SEQ ID NO: 5566400 - DNA, 14 bp, Homo sapiens
agggaaatcttggt

SEQ ID NO: 5566401 - DNA, 18 bp, Homo sapiens
agggaaatcttggtgtaa

SEQ ID NO: 5566402 - DNA, 15 bp, Homo sapiens
agggaaatgctgttg

SEQ ID NO: 5566403 - DNA, 18 bp, Homo sapiens
agggaaatggagggtggg

SEQ ID NO: 5566404 - DNA, 17 bp, Homo sapiens
agggaaatggccttccc

SEQ ID NO: 5566405 - DNA, 13 bp, Homo sapiens
agggaaatttcag

SEQ ID NO: 5566406 - DNA, 20 bp, Homo sapiens
agggaacaagttgagctatg

SEQ ID NO: 5566407 - DNA, 17 bp, Homo sapiens
agggaacagacaggaga

SEQ ID NO: 5566408 - DNA, 18 bp, Homo sapiens
agggaacagacctcggct

SEQ ID NO: 5566409 - DNA, 15 bp, Homo sapiens
agggaacagccccag

SEQ ID NO: 5566410 - DNA, 17 bp, Homo sapiens
agggaacagcctgagcc

SEQ ID NO: 5566411 - DNA, 13 bp, Homo sapiens
agggaacatgcag

SEQ ID NO: 5566412 - DNA, 16 bp, Homo sapiens
agggaacatgcagctc

SEQ ID NO: 5566413 - DNA, 13 bp, Homo sapiens
agggaaccagccc

SEQ ID NO: 5566414 - DNA, 18 bp, Homo sapiens
agggaaccagccctccag

SEQ ID NO: 5566415 - DNA, 23 bp, Homo sapiens
agggaacccagctctaatacatt

SEQ ID NO: 5566416 - DNA, 20 bp, Homo sapiens
agggaaccgtctgtttttaa

SEQ ID NO: 5566417 - DNA, 16 bp, Homo sapiens
agggaacctgttagtc

SEQ ID NO: 5566418 - DNA, 16 bp, Homo sapiens
agggaactaggaaggc

SEQ ID NO: 5566419 - DNA, 14 bp, Homo sapiens
agggaactggcctg

SEQ ID NO: 5566420 - DNA, 19 bp, Homo sapiens
agggaactgggaagatgct

SEQ ID NO: 5566421 - DNA, 23 bp, Homo sapiens
agggaactgggaagatgctggcc

SEQ ID NO: 5566422 - DNA, 13 bp, Homo sapiens
agggaagaaaaag

SEQ ID NO: 5566423 - DNA, 13 bp, Homo sapiens
agggaagaaactg

SEQ ID NO: 5566424 - DNA, 12 bp, Homo sapiens
agggaagaactc

SEQ ID NO: 5566425 - DNA, 15 bp, Homo sapiens
agggaagaaggagga

SEQ ID NO: 5566426 - DNA, 16 bp, Homo sapiens
agggaagaaggggcca

SEQ ID NO: 5566427 - DNA, 19 bp, Homo sapiens
agggaagaaggggccatca

SEQ ID NO: 5566428 - DNA, 16 bp, Homo sapiens
agggaagacagagcag

SEQ ID NO: 5566429 - DNA, 18 bp, Homo sapiens
agggaagacagagcaggc

SEQ ID NO: 5566430 - DNA, 22 bp, Homo sapiens
agggaagacagagcaggctttg

SEQ ID NO: 5566431 - DNA, 17 bp, Homo sapiens
agggaagacctgaaaga

SEQ ID NO: 5566432 - DNA, 19 bp, Homo sapiens
agggaagagacagcccagg

SEQ ID NO: 5566433 - DNA, 14 bp, Homo sapiens
agggaagagggaga

SEQ ID NO: 5566434 - DNA, 20 bp, Homo sapiens
agggaagagtcttccaaggc

SEQ ID NO: 5566435 - DNA, 13 bp, Homo sapiens
agggaagagtgga

SEQ ID NO: 5566436 - DNA, 17 bp, Homo sapiens
agggaagataagttgga

SEQ ID NO: 5566437 - DNA, 18 bp, Homo sapiens
agggaagataagttggaa

SEQ ID NO: 5566438 - DNA, 18 bp, Homo sapiens
agggaagatcttgatggt

SEQ ID NO: 5566439 - DNA, 21 bp, Homo sapiens
agggaagatgacctgccccaa

SEQ ID NO: 5566440 - DNA, 13 bp, Homo sapiens
agggaagatggag

SEQ ID NO: 5566441 - DNA, 19 bp, Homo sapiens
agggaagcaagcctgtcct

SEQ ID NO: 5566442 - DNA, 16 bp, Homo sapiens
agggaagcagagcctg

SEQ ID NO: 5566443 - DNA, 19 bp, Homo sapiens
agggaagcagagcctgggg

SEQ ID NO: 5566444 - DNA, 17 bp, Homo sapiens
agggaagcaggcagagc

SEQ ID NO: 5566445 - DNA, 19 bp, Homo sapiens
agggaagcaggcagagcgg

SEQ ID NO: 5566446 - DNA, 15 bp, Homo sapiens
agggaagcagtgcgt

SEQ ID NO: 5566447 - DNA, 13 bp, Homo sapiens
agggaagccatgt

SEQ ID NO: 5566448 - DNA, 20 bp, Homo sapiens
agggaagcccacccgcccca

SEQ ID NO: 5566449 - DNA, 21 bp, Homo sapiens
agggaagcccacccgccccag

SEQ ID NO: 5566450 - DNA, 22 bp, Homo sapiens
agggaagcccacccgccccaga

SEQ ID NO: 5566451 - DNA, 15 bp, Homo sapiens
agggaagcccagcct

SEQ ID NO: 5566452 - DNA, 18 bp, Homo sapiens
agggaagcccagcctgca

SEQ ID NO: 5566453 - DNA, 14 bp, Homo sapiens
agggaagcccagct

SEQ ID NO: 5566454 - DNA, 23 bp, Homo sapiens
agggaagcccagctccagggcca

SEQ ID NO: 5566455 - DNA, 13 bp, Homo sapiens
agggaagccctga

SEQ ID NO: 5566456 - DNA, 16 bp, Homo sapiens
agggaagcctgactgc

SEQ ID NO: 5566457 - DNA, 19 bp, Homo sapiens
agggaagctacaggttaca

SEQ ID NO: 5566458 - DNA, 13 bp, Homo sapiens
agggaagctgata

SEQ ID NO: 5566459 - DNA, 21 bp, Homo sapiens
agggaagctgatacagagaga

SEQ ID NO: 5566460 - DNA, 12 bp, Homo sapiens
agggaagctggc

SEQ ID NO: 5566461 - DNA, 13 bp, Homo sapiens
agggaagctggcc

SEQ ID NO: 5566462 - DNA, 16 bp, Homo sapiens
agggaagctggccgag

SEQ ID NO: 5566463 - DNA, 15 bp, Homo sapiens
agggaaggaacagga

SEQ ID NO: 5566464 - DNA, 23 bp, Homo sapiens
agggaaggaactctggcttccag

SEQ ID NO: 5566465 - DNA, 18 bp, Homo sapiens
agggaaggacagaaagga

SEQ ID NO: 5566466 - DNA, 22 bp, Homo sapiens
agggaaggacaggaccctcagg

SEQ ID NO: 5566467 - DNA, 22 bp, Homo sapiens
agggaaggatacaaaagcatgt

SEQ ID NO: 5566468 - DNA, 15 bp, Homo sapiens
agggaaggatttaag

SEQ ID NO: 5566469 - DNA, 15 bp, Homo sapiens
agggaaggcaaaggc

SEQ ID NO: 5566470 - DNA, 12 bp, Homo sapiens
agggaaggcagg

SEQ ID NO: 5566471 - DNA, 14 bp, Homo sapiens
agggaaggcaggca

SEQ ID NO: 5566472 - DNA, 20 bp, Homo sapiens
agggaaggcaggcagggctc

SEQ ID NO: 5566473 - DNA, 16 bp, Homo sapiens
agggaaggccacctgc

SEQ ID NO: 5566474 - DNA, 14 bp, Homo sapiens
agggaaggctgctg

SEQ ID NO: 5566475 - DNA, 16 bp, Homo sapiens
agggaaggctgctgtg

SEQ ID NO: 5566476 - DNA, 19 bp, Homo sapiens
agggaaggctggactaggc

SEQ ID NO: 5566477 - DNA, 16 bp, Homo sapiens
agggaaggctggtctc

SEQ ID NO: 5566478 - DNA, 18 bp, Homo sapiens
agggattcggccgcggct

SEQ ID NO: 5566479 - DNA, 20 bp, Homo sapiens
agggattctgggcttggggt

SEQ ID NO: 5566480 - DNA, 22 bp, Homo sapiens
agggattctggtcttcactgcc

SEQ ID NO: 5566481 - DNA, 19 bp, Homo sapiens
agggattgaggggccctgg

SEQ ID NO: 5566482 - DNA, 19 bp, Homo sapiens
agggattgattttaaaatg

SEQ ID NO: 5566483 - DNA, 17 bp, Homo sapiens
agggattgtagataaca

SEQ ID NO: 5566484 - DNA, 12 bp, Homo sapiens
agggatttgagg

SEQ ID NO: 5566485 - DNA, 22 bp, Homo sapiens
agggatttgcctcaccttgggg

SEQ ID NO: 5566486 - DNA, 17 bp, Homo sapiens
agggattttcagccctc

SEQ ID NO: 5566487 - DNA, 15 bp, Homo sapiens
agggcaaaccaggct

SEQ ID NO: 5566488 - DNA, 18 bp, Homo sapiens
agggcaaaccatttcaaa

SEQ ID NO: 5566489 - DNA, 11 bp, Homo sapiens
agggcaaagcc

SEQ ID NO: 5566490 - DNA, 12 bp, Homo sapiens
agggcaaagctg

SEQ ID NO: 5566491 - DNA, 14 bp, Homo sapiens
agggcaaagctgat

SEQ ID NO: 5566492 - DNA, 16 bp, Homo sapiens
agggcaaagctgattt

SEQ ID NO: 5566493 - DNA, 21 bp, Homo sapiens
agggcaaatccagtcccaatg

SEQ ID NO: 5566494 - DNA, 13 bp, Homo sapiens
agggcaaatctgc

SEQ ID NO: 5566495 - DNA, 20 bp, Homo sapiens
agggcaaatgacatgcactg

SEQ ID NO: 5566496 - DNA, 22 bp, Homo sapiens
agggcaaatgacatgcactgac

SEQ ID NO: 5566497 - DNA, 14 bp, Homo sapiens
agggcaaatgttta

SEQ ID NO: 5566498 - DNA, 21 bp, Homo sapiens
agggcaaatgtttacattttg

SEQ ID NO: 5566499 - DNA, 17 bp, Homo sapiens
agggcaacacagtgaga

SEQ ID NO: 5566500 - DNA, 20 bp, Homo sapiens
agggcaacataataagactt

SEQ ID NO: 5566501 - DNA, 20 bp, Homo sapiens
agggcaagaacccaagtgcc

SEQ ID NO: 5566502 - DNA, 15 bp, Homo sapiens
agggcaagaaggaaa

SEQ ID NO: 5566503 - DNA, 18 bp, Homo sapiens
agggcaagaattcttatg

SEQ ID NO: 5566504 - DNA, 22 bp, Homo sapiens
agggcaagaattcttatgctta

SEQ ID NO: 5566505 - DNA, 22 bp, Homo sapiens
agggcaagaggtgcctgggagg

SEQ ID NO: 5566506 - DNA, 14 bp, Homo sapiens
agggcaagccacca

SEQ ID NO: 5566507 - DNA, 15 bp, Homo sapiens
agggcaagccctgcc

SEQ ID NO: 5566508 - DNA, 18 bp, Homo sapiens
agggcaagctcatagcac

SEQ ID NO: 5566509 - DNA, 17 bp, Homo sapiens
agggcaagctccgcagg

SEQ ID NO: 5566510 - DNA, 16 bp, Homo sapiens
agggcaaggccccttc

SEQ ID NO: 5566511 - DNA, 22 bp, Homo sapiens
agggcaagggccatgctgaagg

SEQ ID NO: 5566512 - DNA, 16 bp, Homo sapiens
agggcaaggggttccc

SEQ ID NO: 5566513 - DNA, 13 bp, Homo sapiens
agggcaagtgcat

SEQ ID NO: 5566514 - DNA, 21 bp, Homo sapiens
agggcaagtggatgggaattt

SEQ ID NO: 5566515 - DNA, 14 bp, Homo sapiens
agggcaatcagcaa

SEQ ID NO: 5566516 - DNA, 15 bp, Homo sapiens
agggcaatcttgtcc

SEQ ID NO: 5566517 - DNA, 15 bp, Homo sapiens
agggcaatctttgcc

SEQ ID NO: 5566518 - DNA, 19 bp, Homo sapiens
agggcaatgccatcagccc

SEQ ID NO: 5566519 - DNA, 20 bp, Homo sapiens
agggcaatgccatcagcccc

SEQ ID NO: 5566520 - DNA, 19 bp, Homo sapiens
agggcaattaattccttca

SEQ ID NO: 5566521 - DNA, 14 bp, Homo sapiens
agggcaattggaac

SEQ ID NO: 5566522 - DNA, 11 bp, Homo sapiens
agggcacaaaa

SEQ ID NO: 5566523 - DNA, 21 bp, Homo sapiens
agggcacaccgccatcctctg

SEQ ID NO: 5566524 - DNA, 15 bp, Homo sapiens
agggcacagaaggct

SEQ ID NO: 5566525 - DNA, 19 bp, Homo sapiens
agggcacagcatctgtagt

SEQ ID NO: 5566526 - DNA, 18 bp, Homo sapiens
agggcacagctgccctgc

SEQ ID NO: 5566527 - DNA, 13 bp, Homo sapiens
agggcacaggagc

SEQ ID NO: 5566528 - DNA, 20 bp, Homo sapiens
agggcacaggagctacctgt

SEQ ID NO: 5566529 - DNA, 17 bp, Homo sapiens
agggcacaggccatgga

SEQ ID NO: 5566530 - DNA, 17 bp, Homo sapiens
agggcacagggcctggc

SEQ ID NO: 5566531 - DNA, 19 bp, Homo sapiens
agggcacagggcctggccc

SEQ ID NO: 5566532 - DNA, 21 bp, Homo sapiens
agggcacattaactccctcca

SEQ ID NO: 5566533 - DNA, 20 bp, Homo sapiens
agggcacattccttgcctgc

SEQ ID NO: 5566534 - DNA, 21 bp, Homo sapiens
agggcacattgcccatggctg

SEQ ID NO: 5566535 - DNA, 23 bp, Homo sapiens
agggcacattgcccatggctggg

SEQ ID NO: 5566536 - DNA, 15 bp, Homo sapiens
agggcaccaccaaga

SEQ ID NO: 5566537 - DNA, 21 bp, Homo sapiens
agggcaccaggggtttctcgc

SEQ ID NO: 5566538 - DNA, 12 bp, Homo sapiens
agggcacccagg

SEQ ID NO: 5566539 - DNA, 14 bp, Homo sapiens
agggcacccaggca

SEQ ID NO: 5566540 - DNA, 17 bp, Homo sapiens
agggcaccgtattcctc

SEQ ID NO: 5566541 - DNA, 22 bp, Homo sapiens
agggcaccgtattcctctccca

SEQ ID NO: 5566542 - DNA, 15 bp, Homo sapiens
agggcacgaggctct

SEQ ID NO: 5566543 - DNA, 16 bp, Homo sapiens
agggcacggggacctg

SEQ ID NO: 5566544 - DNA, 14 bp, Homo sapiens
agggcactctctgc

SEQ ID NO: 5566545 - DNA, 19 bp, Homo sapiens
agggcactctctgccagct

SEQ ID NO: 5566546 - DNA, 21 bp, Homo sapiens
agggcactctgttcccctccc

SEQ ID NO: 5566547 - DNA, 18 bp, Homo sapiens
agggcactgggctgttgt

SEQ ID NO: 5566548 - DNA, 14 bp, Homo sapiens
agggcactggtggc

SEQ ID NO: 5566549 - DNA, 17 bp, Homo sapiens
agggcacttaatttgta

SEQ ID NO: 5566550 - DNA, 16 bp, Homo sapiens
agggcacttcaggtcc

SEQ ID NO: 5566551 - DNA, 20 bp, Homo sapiens
agggcacttcaggtccgtgg

SEQ ID NO: 5566552 - DNA, 21 bp, Homo sapiens
agggcacttcaggtccgtggg

SEQ ID NO: 5566553 - DNA, 15 bp, Homo sapiens
agggcacttcctcca

SEQ ID NO: 5566554 - DNA, 17 bp, Homo sapiens
agggcagaacactaacc

SEQ ID NO: 5566555 - DNA, 20 bp, Homo sapiens
agggcagaaggggaagatac

SEQ ID NO: 5566556 - DNA, 14 bp, Homo sapiens
agggcagaatgaat

SEQ ID NO: 5566557 - DNA, 21 bp, Homo sapiens
agggcagacaatagtatagaa

SEQ ID NO: 5566558 - DNA, 15 bp, Homo sapiens
agggcagagaatggc

SEQ ID NO: 5566559 - DNA, 12 bp, Homo sapiens
agggcagagcca

SEQ ID NO: 5566560 - DNA, 14 bp, Homo sapiens
agggcagagctggt

SEQ ID NO: 5566561 - DNA, 15 bp, Homo sapiens
agggcagagctggtg

SEQ ID NO: 5566562 - DNA, 17 bp, Homo sapiens
agggcagagctggtgcg

SEQ ID NO: 5566563 - DNA, 16 bp, Homo sapiens
agggcagaggaagaga

SEQ ID NO: 5566564 - DNA, 22 bp, Homo sapiens
agggcagaggaatgtagggcct

SEQ ID NO: 5566565 - DNA, 15 bp, Homo sapiens
agggcagaggcaagg

SEQ ID NO: 5566566 - DNA, 22 bp, Homo sapiens
agggcagagggaatgttccctg

SEQ ID NO: 5566567 - DNA, 23 bp, Homo sapiens
agggcagagggaatgttccctgc

SEQ ID NO: 5566568 - DNA, 14 bp, Homo sapiens
agggcagagggaga

SEQ ID NO: 5566569 - DNA, 18 bp, Homo sapiens
agggcagagggagaatcc

SEQ ID NO: 5566570 - DNA, 17 bp, Homo sapiens
agggcagagtcacacgg

SEQ ID NO: 5566571 - DNA, 19 bp, Homo sapiens
agggcagagtgagacccag

SEQ ID NO: 5566572 - DNA, 15 bp, Homo sapiens
agggcagagtgggct

SEQ ID NO: 5566573 - DNA, 21 bp, Homo sapiens
agggcagagtgggctgcctgg

SEQ ID NO: 5566574 - DNA, 17 bp, Homo sapiens
agggcagattttcatgc

SEQ ID NO: 5566575 - DNA, 23 bp, Homo sapiens
agggcagcaagggacctgctcat

SEQ ID NO: 5566576 - DNA, 15 bp, Homo sapiens
agggcagcagccagc

SEQ ID NO: 5566577 - DNA, 21 bp, Homo sapiens
agggcagcagccagccctgcc

SEQ ID NO: 5566578 - DNA, 12 bp, Homo sapiens
agggcagcaggc

SEQ ID NO: 5566579 - DNA, 14 bp, Homo sapiens
agggcagcaggcca

SEQ ID NO: 5566580 - DNA, 19 bp, Homo sapiens
agggcagcaggccagagaa

SEQ ID NO: 5566581 - DNA, 14 bp, Homo sapiens
agggcagcagggct

SEQ ID NO: 5566582 - DNA, 15 bp, Homo sapiens
agggcagcagggcta

SEQ ID NO: 5566583 - DNA, 17 bp, Homo sapiens
agggcagcagtggggtg

SEQ ID NO: 5566584 - DNA, 15 bp, Homo sapiens
agggcagcatggaga

SEQ ID NO: 5566585 - DNA, 14 bp, Homo sapiens
agggcagccaggga

SEQ ID NO: 5566586 - DNA, 19 bp, Homo sapiens
agggcagccagggagagcc

SEQ ID NO: 5566587 - DNA, 18 bp, Homo sapiens
agggcagccaggggctgc

SEQ ID NO: 5566588 - DNA, 19 bp, Homo sapiens
agggcagccaggggctgct

SEQ ID NO: 5566589 - DNA, 12 bp, Homo sapiens
agggcagcccca

SEQ ID NO: 5566590 - DNA, 15 bp, Homo sapiens
agggcagccccgcga

SEQ ID NO: 5566591 - DNA, 15 bp, Homo sapiens
agggcagcccctccc

SEQ ID NO: 5566592 - DNA, 15 bp, Homo sapiens
agggcagccctccac

SEQ ID NO: 5566593 - DNA, 20 bp, Homo sapiens
agggcagccctccatggtcc

SEQ ID NO: 5566594 - DNA, 18 bp, Homo sapiens
agggcagcctgcctggag

SEQ ID NO: 5566595 - DNA, 19 bp, Homo sapiens
agggcagcctggatccctg

SEQ ID NO: 5566596 - DNA, 18 bp, Homo sapiens
agggcagcctgtgggaga

SEQ ID NO: 5566597 - DNA, 14 bp, Homo sapiens
agggcagcgccagg

SEQ ID NO: 5566598 - DNA, 17 bp, Homo sapiens
agggcagcgccaggctg

SEQ ID NO: 5566599 - DNA, 12 bp, Homo sapiens
agggcagctgcc

SEQ ID NO: 5566600 - DNA, 13 bp, Homo sapiens
agggcagctgcct

SEQ ID NO: 5566601 - DNA, 16 bp, Homo sapiens
agggcagctgcctggc

SEQ ID NO: 5566602 - DNA, 17 bp, Homo sapiens
agggcagctgggcccaa

SEQ ID NO: 5566603 - DNA, 11 bp, Homo sapiens
agggcagcttg

SEQ ID NO: 5566604 - DNA, 18 bp, Homo sapiens
agggcagcttgccccggc

SEQ ID NO: 5566605 - DNA, 16 bp, Homo sapiens
agggcagctttgctca

SEQ ID NO: 5566606 - DNA, 16 bp, Homo sapiens
agggcaggaaggagag

SEQ ID NO: 5566607 - DNA, 18 bp, Homo sapiens
agggcaggaaggagagcc

SEQ ID NO: 5566608 - DNA, 19 bp, Homo sapiens
agggcaggaaggagagcct

SEQ ID NO: 5566609 - DNA, 21 bp, Homo sapiens
agggcaggaaggagagcctgc

SEQ ID NO: 5566610 - DNA, 12 bp, Homo sapiens
agggcaggacca

SEQ ID NO: 5566611 - DNA, 16 bp, Homo sapiens
agggcaggaccagccc

SEQ ID NO: 5566612 - DNA, 15 bp, Homo sapiens
agggcaggagcctag

SEQ ID NO: 5566613 - DNA, 19 bp, Homo sapiens
agggcaggagcctagagga

SEQ ID NO: 5566614 - DNA, 15 bp, Homo sapiens
agggcaggagctcac

SEQ ID NO: 5566615 - DNA, 22 bp, Homo sapiens
agggcaggatggcctttccttc

SEQ ID NO: 5566616 - DNA, 11 bp, Homo sapiens
agggcaggcag

SEQ ID NO: 5566617 - DNA, 13 bp, Homo sapiens
agggcaggcctgt

SEQ ID NO: 5566618 - DNA, 23 bp, Homo sapiens
agggcaggcctgttccctgagga

SEQ ID NO: 5566619 - DNA, 15 bp, Homo sapiens
agggcaggccttgct

SEQ ID NO: 5566620 - DNA, 23 bp, Homo sapiens
agggcaggccttgctggggtcca

SEQ ID NO: 5566621 - DNA, 12 bp, Homo sapiens
agggcaggctga

SEQ ID NO: 5566622 - DNA, 18 bp, Homo sapiens
agggcaggctgaggtggg

SEQ ID NO: 5566623 - DNA, 23 bp, Homo sapiens
agggcaggctgaggtggggaagg

SEQ ID NO: 5566624 - DNA, 22 bp, Homo sapiens
agggcagggaccacaccctgta

SEQ ID NO: 5566625 - DNA, 18 bp, Homo sapiens
agggcagggcagcctgtc

SEQ ID NO: 5566626 - DNA, 13 bp, Homo sapiens
agggcagggcatc

SEQ ID NO: 5566627 - DNA, 12 bp, Homo sapiens
agggcagggccc

SEQ ID NO: 5566628 - DNA, 15 bp, Homo sapiens
agggcagggctctga

SEQ ID NO: 5566629 - DNA, 23 bp, Homo sapiens
agggcaggggatgcccagaagag

SEQ ID NO: 5566630 - DNA, 23 bp, Homo sapiens
agggcaggggccgtgcagggcca

SEQ ID NO: 5566631 - DNA, 14 bp, Homo sapiens
agggcagggtctgg

SEQ ID NO: 5566632 - DNA, 23 bp, Homo sapiens
agggcagggtctgggctgggcac

SEQ ID NO: 5566633 - DNA, 18 bp, Homo sapiens
agggcagggtgggcagcc

SEQ ID NO: 5566634 - DNA, 18 bp, Homo sapiens
agggcaggtccagctctg

SEQ ID NO: 5566635 - DNA, 16 bp, Homo sapiens
agggcaggtgcttcag

SEQ ID NO: 5566636 - DNA, 15 bp, Homo sapiens
agggcaggtggggtg

SEQ ID NO: 5566637 - DNA, 16 bp, Homo sapiens
agggcagtgcaaggag

SEQ ID NO: 5566638 - DNA, 15 bp, Homo sapiens
agggcagtgcccttt

SEQ ID NO: 5566639 - DNA, 22 bp, Homo sapiens
agggcagtgctagtgagctggg

SEQ ID NO: 5566640 - DNA, 13 bp, Homo sapiens
agggcagtggagg

SEQ ID NO: 5566641 - DNA, 23 bp, Homo sapiens
agggcagtggcacgatctcagct

SEQ ID NO: 5566642 - DNA, 21 bp, Homo sapiens
agggcagtggccaagcctgct

SEQ ID NO: 5566643 - DNA, 22 bp, Homo sapiens
agggcagtggccaagcctgctg

SEQ ID NO: 5566644 - DNA, 19 bp, Homo sapiens
agggcagtggcttctttcc

SEQ ID NO: 5566645 - DNA, 20 bp, Homo sapiens
agggcagtggcttctttcca

SEQ ID NO: 5566646 - DNA, 19 bp, Homo sapiens
agggcagttcgcagccacc

SEQ ID NO: 5566647 - DNA, 18 bp, Homo sapiens
agggcagttctgcaccca

SEQ ID NO: 5566648 - DNA, 13 bp, Homo sapiens
agggcagttttct

SEQ ID NO: 5566649 - DNA, 14 bp, Homo sapiens
agggcataaaacag

SEQ ID NO: 5566650 - DNA, 15 bp, Homo sapiens
agggcataaaacagc

SEQ ID NO: 5566651 - DNA, 15 bp, Homo sapiens
agggcataaagtaaa

SEQ ID NO: 5566652 - DNA, 15 bp, Homo sapiens
agggcataatgatga

SEQ ID NO: 5566653 - DNA, 19 bp, Homo sapiens
agggcataatgatgatggg

SEQ ID NO: 5566654 - DNA, 20 bp, Homo sapiens
agggcatcagctttccctgg

SEQ ID NO: 5566655 - DNA, 24 bp, Homo sapiens
agggcatcagctttccctggctca

SEQ ID NO: 5566656 - DNA, 14 bp, Homo sapiens
aggggaaagattat

SEQ ID NO: 5566657 - DNA, 14 bp, Homo sapiens
aggggaaatcaagg

SEQ ID NO: 5566658 - DNA, 17 bp, Homo sapiens
aggggaaccctgtccct

SEQ ID NO: 5566659 - DNA, 12 bp, Homo sapiens
aggggaagaaaa

SEQ ID NO: 5566660 - DNA, 15 bp, Homo sapiens
aggggaagaaaaact

SEQ ID NO: 5566661 - DNA, 18 bp, Homo sapiens
aggggaagagagaggcct

SEQ ID NO: 5566662 - DNA, 20 bp, Homo sapiens
aggggaagagagaggcctgg

SEQ ID NO: 5566663 - DNA, 14 bp, Homo sapiens
aggggaagaggcct

SEQ ID NO: 5566664 - DNA, 15 bp, Homo sapiens
aggggaagaggcctg

SEQ ID NO: 5566665 - DNA, 17 bp, Homo sapiens
aggggaagcactcgtgt

SEQ ID NO: 5566666 - DNA, 23 bp, Homo sapiens
aggggaagcaggacccagtggtc

SEQ ID NO: 5566667 - DNA, 22 bp, Homo sapiens
aggggaagctgccacccctctt

SEQ ID NO: 5566668 - DNA, 11 bp, Homo sapiens
aggggaaggaa

SEQ ID NO: 5566669 - DNA, 19 bp, Homo sapiens
aggggaaggaaggagggca

SEQ ID NO: 5566670 - DNA, 20 bp, Homo sapiens
aggggaaggaaggagggcac

SEQ ID NO: 5566671 - DNA, 12 bp, Homo sapiens
aggggaaggccc

SEQ ID NO: 5566672 - DNA, 16 bp, Homo sapiens
aggggaaggccctgag

SEQ ID NO: 5566673 - DNA, 12 bp, Homo sapiens
aggggaagggca

SEQ ID NO: 5566674 - DNA, 15 bp, Homo sapiens
aggggaagggcaggc

SEQ ID NO: 5566675 - DNA, 17 bp, Homo sapiens
aggggaagggcaggcac

SEQ ID NO: 5566676 - DNA, 16 bp, Homo sapiens
aggggaaggggccggg

SEQ ID NO: 5566677 - DNA, 19 bp, Homo sapiens
aggggaaggggccggggag

SEQ ID NO: 5566678 - DNA, 14 bp, Homo sapiens
aggggaaggggctg

SEQ ID NO: 5566679 - DNA, 16 bp, Homo sapiens
aggggaaggggctgag

SEQ ID NO: 5566680 - DNA, 13 bp, Homo sapiens
aggggaagggggt

SEQ ID NO: 5566681 - DNA, 22 bp, Homo sapiens
aggggaagggggtgcaaagact

SEQ ID NO: 5566682 - DNA, 14 bp, Homo sapiens
aggggaagtccctg

SEQ ID NO: 5566683 - DNA, 22 bp, Homo sapiens
aggggaagtgtgctgaggtggg

SEQ ID NO: 5566684 - DNA, 17 bp, Homo sapiens
aggggaataatagaaga

SEQ ID NO: 5566685 - DNA, 16 bp, Homo sapiens
aggggaatcagaactc

SEQ ID NO: 5566686 - DNA, 23 bp, Homo sapiens
aggggaatctggaacgctctagg

SEQ ID NO: 5566687 - DNA, 20 bp, Homo sapiens
aggggaatctggaggtagcc

SEQ ID NO: 5566688 - DNA, 14 bp, Homo sapiens
aggggaatgagggg

SEQ ID NO: 5566689 - DNA, 22 bp, Homo sapiens
aggggacactggccccacagga

SEQ ID NO: 5566690 - DNA, 23 bp, Homo sapiens
aggggacacttccctctgtttct

SEQ ID NO: 5566691 - DNA, 15 bp, Homo sapiens
aggggacactttgtt

SEQ ID NO: 5566692 - DNA, 17 bp, Homo sapiens
aggggacagagctgagg

SEQ ID NO: 5566693 - DNA, 19 bp, Homo sapiens
aggggacagaggccctgcc

SEQ ID NO: 5566694 - DNA, 21 bp, Homo sapiens
aggggacagatttgaggactg

SEQ ID NO: 5566695 - DNA, 14 bp, Homo sapiens
aggggacaggcctc

SEQ ID NO: 5566696 - DNA, 21 bp, Homo sapiens
aggggaccaattctggacaga

SEQ ID NO: 5566697 - DNA, 12 bp, Homo sapiens
aggggaccagga

SEQ ID NO: 5566698 - DNA, 13 bp, Homo sapiens
aggggaccaggag

SEQ ID NO: 5566699 - DNA, 14 bp, Homo sapiens
aggggaccaggagt

SEQ ID NO: 5566700 - DNA, 15 bp, Homo sapiens
aggggaccaggagtg

SEQ ID NO: 5566701 - DNA, 20 bp, Homo sapiens
aggggaccaggagtgggtgg

SEQ ID NO: 5566702 - DNA, 18 bp, Homo sapiens
aggggaccatgaagagac

SEQ ID NO: 5566703 - DNA, 14 bp, Homo sapiens
aggggacccaagaa

SEQ ID NO: 5566704 - DNA, 17 bp, Homo sapiens
aggggacccagctcctc

SEQ ID NO: 5566705 - DNA, 22 bp, Homo sapiens
aggggacccccgccccctgccc

SEQ ID NO: 5566706 - DNA, 19 bp, Homo sapiens
aggggaccctccgctctgt

SEQ ID NO: 5566707 - DNA, 21 bp, Homo sapiens
aggggaccgccccaggcaccg

SEQ ID NO: 5566708 - DNA, 21 bp, Homo sapiens
aggggacctctccacacaggt

SEQ ID NO: 5566709 - DNA, 18 bp, Homo sapiens
aggggacctggagctgcc

SEQ ID NO: 5566710 - DNA, 16 bp, Homo sapiens
aggggacgcaggcccc

SEQ ID NO: 5566711 - DNA, 19 bp, Homo sapiens
aggggacgcaggcccctct

SEQ ID NO: 5566712 - DNA, 17 bp, Homo sapiens
aggggacgcctgtgtca

SEQ ID NO: 5566713 - DNA, 15 bp, Homo sapiens
aggggacgctgagga

SEQ ID NO: 5566714 - DNA, 14 bp, Homo sapiens
aggggacgctggct

SEQ ID NO: 5566715 - DNA, 21 bp, Homo sapiens
aggggacgggcaagtgagagg

SEQ ID NO: 5566716 - DNA, 16 bp, Homo sapiens
aggggacgtgggccct

SEQ ID NO: 5566717 - DNA, 17 bp, Homo sapiens
aggggacgtgggccctg

SEQ ID NO: 5566718 - DNA, 18 bp, Homo sapiens
aggggacgtgggccctgc

SEQ ID NO: 5566719 - DNA, 19 bp, Homo sapiens
aggggactatttatgaagg

SEQ ID NO: 5566720 - DNA, 19 bp, Homo sapiens
aggggactgcatgcaagct

SEQ ID NO: 5566721 - DNA, 13 bp, Homo sapiens
aggggactgccac

SEQ ID NO: 5566722 - DNA, 15 bp, Homo sapiens
aggggactgccacct

SEQ ID NO: 5566723 - DNA, 14 bp, Homo sapiens
aggggactgggcca

SEQ ID NO: 5566724 - DNA, 15 bp, Homo sapiens
aggggactgggccat

SEQ ID NO: 5566725 - DNA, 21 bp, Homo sapiens
aggggactgggggactgggag

SEQ ID NO: 5566726 - DNA, 19 bp, Homo sapiens
aggggactggtgatgggac

SEQ ID NO: 5566727 - DNA, 15 bp, Homo sapiens
aggggagaaaattaa

SEQ ID NO: 5566728 - DNA, 16 bp, Homo sapiens
aggggagaaactgaaa

SEQ ID NO: 5566729 - DNA, 11 bp, Homo sapiens
aggggagaaag

SEQ ID NO: 5566730 - DNA, 14 bp, Homo sapiens
aggggagaaagagg

SEQ ID NO: 5566731 - DNA, 14 bp, Homo sapiens
aggggagaaaggaa

SEQ ID NO: 5566732 - DNA, 19 bp, Homo sapiens
aggggagaagggccagccc

SEQ ID NO: 5566733 - DNA, 19 bp, Homo sapiens
aggggagaagtcagctact

SEQ ID NO: 5566734 - DNA, 16 bp, Homo sapiens
aggggagaatgcagcc

SEQ ID NO: 5566735 - DNA, 19 bp, Homo sapiens
aggggagaatgcagcccac

SEQ ID NO: 5566736 - DNA, 16 bp, Homo sapiens
aggggagacaggagcc

SEQ ID NO: 5566737 - DNA, 21 bp, Homo sapiens
aggggagacctcagaagtaaa

SEQ ID NO: 5566738 - DNA, 21 bp, Homo sapiens
aggggagacttaggccagagg

SEQ ID NO: 5566739 - DNA, 15 bp, Homo sapiens
aggggagactttgat

SEQ ID NO: 5566740 - DNA, 14 bp, Homo sapiens
aggggagagacagg

SEQ ID NO: 5566741 - DNA, 20 bp, Homo sapiens
aggggagagagcagagaagt

SEQ ID NO: 5566742 - DNA, 15 bp, Homo sapiens
aggggagagcctgct

SEQ ID NO: 5566743 - DNA, 17 bp, Homo sapiens
aggggagagcctgctgg

SEQ ID NO: 5566744 - DNA, 14 bp, Homo sapiens
aggggagagctctc

SEQ ID NO: 5566745 - DNA, 16 bp, Homo sapiens
aggggagaggaaaagt

SEQ ID NO: 5566746 - DNA, 17 bp, Homo sapiens
aggggagaggaagcaca

SEQ ID NO: 5566747 - DNA, 17 bp, Homo sapiens
aggggagagggtctgga

SEQ ID NO: 5566748 - DNA, 15 bp, Homo sapiens
aggggagaggtcagc

SEQ ID NO: 5566749 - DNA, 20 bp, Homo sapiens
aggggagatactctccctga

SEQ ID NO: 5566750 - DNA, 15 bp, Homo sapiens
aggggagatatagat

SEQ ID NO: 5566751 - DNA, 18 bp, Homo sapiens
aggggagcaaggctgcta

SEQ ID NO: 5566752 - DNA, 17 bp, Homo sapiens
aggggagcacggagccg

SEQ ID NO: 5566753 - DNA, 19 bp, Homo sapiens
aggggagcacggagccgcg

SEQ ID NO: 5566754 - DNA, 22 bp, Homo sapiens
aggggagcagaggggcagaggc

SEQ ID NO: 5566755 - DNA, 16 bp, Homo sapiens
aggggagccagaaatg

SEQ ID NO: 5566756 - DNA, 12 bp, Homo sapiens
aggggagccagc

SEQ ID NO: 5566757 - DNA, 19 bp, Homo sapiens
aggggagccagctgcttga

SEQ ID NO: 5566758 - DNA, 12 bp, Homo sapiens
aggggagcccac

SEQ ID NO: 5566759 - DNA, 13 bp, Homo sapiens
aggggagcccact

SEQ ID NO: 5566760 - DNA, 15 bp, Homo sapiens
aggggagccttacca

SEQ ID NO: 5566761 - DNA, 22 bp, Homo sapiens
aggggagcctttggggggccac

SEQ ID NO: 5566762 - DNA, 16 bp, Homo sapiens
aggggagcgtggggag

SEQ ID NO: 5566763 - DNA, 16 bp, Homo sapiens
aggggagctctgtctg

SEQ ID NO: 5566764 - DNA, 14 bp, Homo sapiens
aggggagcttggga

SEQ ID NO: 5566765 - DNA, 20 bp, Homo sapiens
aggggagcttgggactcagg

SEQ ID NO: 5566766 - DNA, 13 bp, Homo sapiens
aggggaggaaaaa

SEQ ID NO: 5566767 - DNA, 20 bp, Homo sapiens
aggggaggaaaaaagaacca

SEQ ID NO: 5566768 - DNA, 12 bp, Homo sapiens
aggggaggagaa

SEQ ID NO: 5566769 - DNA, 13 bp, Homo sapiens
aggggaggagaat

SEQ ID NO: 5566770 - DNA, 19 bp, Homo sapiens
aggggaggagagagggtct

SEQ ID NO: 5566771 - DNA, 14 bp, Homo sapiens
aggggaggagggga

SEQ ID NO: 5566772 - DNA, 13 bp, Homo sapiens
aggggaggcacac

SEQ ID NO: 5566773 - DNA, 14 bp, Homo sapiens
aggggaggcacact

SEQ ID NO: 5566774 - DNA, 17 bp, Homo sapiens
aggggaggcacctccag

SEQ ID NO: 5566775 - DNA, 21 bp, Homo sapiens
aggggaggcagccggcaccca

SEQ ID NO: 5566776 - DNA, 16 bp, Homo sapiens
aggggaggccatctgg

SEQ ID NO: 5566777 - DNA, 15 bp, Homo sapiens
aggggaggccttcca

SEQ ID NO: 5566778 - DNA, 22 bp, Homo sapiens
aggggagggaaaagctaagagg

SEQ ID NO: 5566779 - DNA, 17 bp, Homo sapiens
aggggagggcaggcttg

SEQ ID NO: 5566780 - DNA, 15 bp, Homo sapiens
aggggagggctcctg

SEQ ID NO: 5566781 - DNA, 18 bp, Homo sapiens
aggggagggctcctgggg

SEQ ID NO: 5566782 - DNA, 14 bp, Homo sapiens
aggggaggggccta

SEQ ID NO: 5566783 - DNA, 16 bp, Homo sapiens
aggggaggggcctccc

SEQ ID NO: 5566784 - DNA, 18 bp, Homo sapiens
aggggaggggctcctttc

SEQ ID NO: 5566785 - DNA, 20 bp, Homo sapiens
aggggaggggctcctttcca

SEQ ID NO: 5566786 - DNA, 19 bp, Homo sapiens
aggggaggggggagccaga

SEQ ID NO: 5566787 - DNA, 16 bp, Homo sapiens
aggggagggtggcagg

SEQ ID NO: 5566788 - DNA, 22 bp, Homo sapiens
aggggagggtgtatctagctct

SEQ ID NO: 5566789 - DNA, 19 bp, Homo sapiens
aggggatactgaaaaatac

SEQ ID NO: 5566790 - DNA, 18 bp, Homo sapiens
aggggatataggagagga

SEQ ID NO: 5566791 - DNA, 13 bp, Homo sapiens
aggggatatttaa

SEQ ID NO: 5566792 - DNA, 16 bp, Homo sapiens
aggggatatttactgc

SEQ ID NO: 5566793 - DNA, 20 bp, Homo sapiens
aggggatcaaagttcctgtt

SEQ ID NO: 5566794 - DNA, 15 bp, Homo sapiens
aggggatccagccac

SEQ ID NO: 5566795 - DNA, 16 bp, Homo sapiens
aggggatccagccact

SEQ ID NO: 5566796 - DNA, 20 bp, Homo sapiens
aggggatctaaaaaaatgtt

SEQ ID NO: 5566797 - DNA, 16 bp, Homo sapiens
aggggatctaaaagga

SEQ ID NO: 5566798 - DNA, 22 bp, Homo sapiens
aggggatctaaaaggaggacag

SEQ ID NO: 5566799 - DNA, 19 bp, Homo sapiens
aggggatctggaagggcca

SEQ ID NO: 5566800 - DNA, 16 bp, Homo sapiens
aggggatgataaagga

SEQ ID NO: 5566801 - DNA, 17 bp, Homo sapiens
aggggatgataaaggaa

SEQ ID NO: 5566802 - DNA, 17 bp, Homo sapiens
aggggatgcccagaaga

SEQ ID NO: 5566803 - DNA, 18 bp, Homo sapiens
aggggatggacaccccca

SEQ ID NO: 5566804 - DNA, 19 bp, Homo sapiens
aggggatggacacccccag

SEQ ID NO: 5566805 - DNA, 21 bp, Homo sapiens
aggggatggaggccagagtct

SEQ ID NO: 5566806 - DNA, 14 bp, Homo sapiens
aggggatggagtga

SEQ ID NO: 5566807 - DNA, 14 bp, Homo sapiens
aggggatgggaaat

SEQ ID NO: 5566808 - DNA, 14 bp, Homo sapiens
aggggatggggagg

SEQ ID NO: 5566809 - DNA, 19 bp, Homo sapiens
aggggatgtatccatgggg

SEQ ID NO: 5566810 - DNA, 17 bp, Homo sapiens
aggggatgtgtgtgtgc

SEQ ID NO: 5566811 - DNA, 18 bp, Homo sapiens
aggggattaatatgaaaa

SEQ ID NO: 5566812 - DNA, 17 bp, Homo sapiens
aggggcaaaaatatttt

SEQ ID NO: 5566813 - DNA, 18 bp, Homo sapiens
aggggcaaaaatattttg

SEQ ID NO: 5566814 - DNA, 19 bp, Homo sapiens
aggggcaaagaactgcccc

SEQ ID NO: 5566815 - DNA, 17 bp, Homo sapiens
aggggcaaattcttttg

SEQ ID NO: 5566816 - DNA, 19 bp, Homo sapiens
aggggcaaccaactgcccc

SEQ ID NO: 5566817 - DNA, 22 bp, Homo sapiens
aggggcaatggggtgcctacta

SEQ ID NO: 5566818 - DNA, 21 bp, Homo sapiens
aggggcacaccactgccctgc

SEQ ID NO: 5566819 - DNA, 23 bp, Homo sapiens
aggggcacaccactgccctgcct

SEQ ID NO: 5566820 - DNA, 19 bp, Homo sapiens
aggggcacactacagagca

SEQ ID NO: 5566821 - DNA, 17 bp, Homo sapiens
aggggcaccctccaaac

SEQ ID NO: 5566822 - DNA, 15 bp, Homo sapiens
aggggcacctgccac

SEQ ID NO: 5566823 - DNA, 16 bp, Homo sapiens
aggggcacctgccacc

SEQ ID NO: 5566824 - DNA, 21 bp, Homo sapiens
aggggcacctgggaaaacaga

SEQ ID NO: 5566825 - DNA, 22 bp, Homo sapiens
aggggcacgccctcctcagcga

SEQ ID NO: 5566826 - DNA, 17 bp, Homo sapiens
aggggcactgtgttctc

SEQ ID NO: 5566827 - DNA, 12 bp, Homo sapiens
aggggcagaagg

SEQ ID NO: 5566828 - DNA, 15 bp, Homo sapiens
aggggcagaaggagg

SEQ ID NO: 5566829 - DNA, 17 bp, Homo sapiens
aggggcagagaggaagt

SEQ ID NO: 5566830 - DNA, 22 bp, Homo sapiens
aggggcagagaggaagtggtct

SEQ ID NO: 5566831 - DNA, 23 bp, Homo sapiens
aggggcagatgccaccctgccca

SEQ ID NO: 5566832 - DNA, 14 bp, Homo sapiens
aggggcagcaggag

SEQ ID NO: 5566833 - DNA, 13 bp, Homo sapiens
aggggcagccaca

SEQ ID NO: 5566834 - DNA, 14 bp, Homo sapiens
aggggcagccacac

SEQ ID NO: 5566835 - DNA, 16 bp, Homo sapiens
agggtccgcaccagct

SEQ ID NO: 5566836 - DNA, 17 bp, Homo sapiens
agggtccgcaccagctg

SEQ ID NO: 5566837 - DNA, 18 bp, Homo sapiens
agggtccgcaccagctgc

SEQ ID NO: 5566838 - DNA, 19 bp, Homo sapiens
agggtccgcaccagctgct

SEQ ID NO: 5566839 - DNA, 20 bp, Homo sapiens
agggtccgcaccagctgctc

SEQ ID NO: 5566840 - DNA, 20 bp, Homo sapiens
agggtccgtggaccaggagg

SEQ ID NO: 5566841 - DNA, 17 bp, Homo sapiens
agggtcctcaggcagtg

SEQ ID NO: 5566842 - DNA, 13 bp, Homo sapiens
agggtcctctctt

SEQ ID NO: 5566843 - DNA, 16 bp, Homo sapiens
agggtcctctcttcca

SEQ ID NO: 5566844 - DNA, 19 bp, Homo sapiens
agggtcctctcttccacag

SEQ ID NO: 5566845 - DNA, 23 bp, Homo sapiens
agggtcctctcttccacagtggc

SEQ ID NO: 5566846 - DNA, 17 bp, Homo sapiens
agggtcctgcagcctgc

SEQ ID NO: 5566847 - DNA, 14 bp, Homo sapiens
agggtcctgccctc

SEQ ID NO: 5566848 - DNA, 21 bp, Homo sapiens
agggtcctgccctccggagga

SEQ ID NO: 5566849 - DNA, 22 bp, Homo sapiens
agggtcctgccctccggaggag

SEQ ID NO: 5566850 - DNA, 20 bp, Homo sapiens
agggtcctgccggtgggacc

SEQ ID NO: 5566851 - DNA, 23 bp, Homo sapiens
agggtcctgccggtgggaccctg

SEQ ID NO: 5566852 - DNA, 16 bp, Homo sapiens
agggtcctgctttctc

SEQ ID NO: 5566853 - DNA, 19 bp, Homo sapiens
agggtcctggctcctgagg

SEQ ID NO: 5566854 - DNA, 20 bp, Homo sapiens
agggtcctggctcctgaggg

SEQ ID NO: 5566855 - DNA, 13 bp, Homo sapiens
agggtcctgggag

SEQ ID NO: 5566856 - DNA, 15 bp, Homo sapiens
agggtcctggggaac

SEQ ID NO: 5566857 - DNA, 23 bp, Homo sapiens
agggtcctggggaacctgacccc

SEQ ID NO: 5566858 - DNA, 18 bp, Homo sapiens
agggtcctgggggctgct

SEQ ID NO: 5566859 - DNA, 15 bp, Homo sapiens
agggtcctgtcgcca

SEQ ID NO: 5566860 - DNA, 22 bp, Homo sapiens
agggtccttccctctccccaag

SEQ ID NO: 5566861 - DNA, 14 bp, Homo sapiens
agggtcgagggttt

SEQ ID NO: 5566862 - DNA, 18 bp, Homo sapiens
agggtcgccacacccggc

SEQ ID NO: 5566863 - DNA, 23 bp, Homo sapiens
agggtcgccacacccggctcccc

SEQ ID NO: 5566864 - DNA, 24 bp, Homo sapiens
agggtcgctgcataaactgttgta

SEQ ID NO: 5566865 - DNA, 23 bp, Homo sapiens
agggtcggggaggaaataccaaa

SEQ ID NO: 5566866 - DNA, 15 bp, Homo sapiens
agggtcgtgagccca

SEQ ID NO: 5566867 - DNA, 15 bp, Homo sapiens
agggtcgtgggaaag

SEQ ID NO: 5566868 - DNA, 20 bp, Homo sapiens
agggtcgtgggaaaggggag

SEQ ID NO: 5566869 - DNA, 21 bp, Homo sapiens
agggtcgtgggaaaggggagt

SEQ ID NO: 5566870 - DNA, 17 bp, Homo sapiens
agggtctaaagagaaca

SEQ ID NO: 5566871 - DNA, 18 bp, Homo sapiens
agggtctaaagagaacaa

SEQ ID NO: 5566872 - DNA, 17 bp, Homo sapiens
agggtctatcttgtaaa

SEQ ID NO: 5566873 - DNA, 14 bp, Homo sapiens
agggtctcactctg

SEQ ID NO: 5566874 - DNA, 16 bp, Homo sapiens
agggtctcactctgtc

SEQ ID NO: 5566875 - DNA, 14 bp, Homo sapiens
agggtctcactgct

SEQ ID NO: 5566876 - DNA, 16 bp, Homo sapiens
agggtctcactgtgtt

SEQ ID NO: 5566877 - DNA, 11 bp, Homo sapiens
agggtctccag

SEQ ID NO: 5566878 - DNA, 12 bp, Homo sapiens
agggtctccagt

SEQ ID NO: 5566879 - DNA, 16 bp, Homo sapiens
agggtctcccctcctg

SEQ ID NO: 5566880 - DNA, 18 bp, Homo sapiens
agggtctcccctcctgca

SEQ ID NO: 5566881 - DNA, 20 bp, Homo sapiens
agggtctcccctcctgcaca

SEQ ID NO: 5566882 - DNA, 13 bp, Homo sapiens
agggtctccctgg

SEQ ID NO: 5566883 - DNA, 22 bp, Homo sapiens
agggtctccctgggcaccctgc

SEQ ID NO: 5566884 - DNA, 15 bp, Homo sapiens
agggtctccttcctt

SEQ ID NO: 5566885 - DNA, 16 bp, Homo sapiens
agggtctccttccttc

SEQ ID NO: 5566886 - DNA, 17 bp, Homo sapiens
agggtctcgctgtcact

SEQ ID NO: 5566887 - DNA, 19 bp, Homo sapiens
agggtctcgtcaggaggtg

SEQ ID NO: 5566888 - DNA, 22 bp, Homo sapiens
agggtctcgtcaggaggtgcct

SEQ ID NO: 5566889 - DNA, 16 bp, Homo sapiens
agggtctctagtgctg

SEQ ID NO: 5566890 - DNA, 13 bp, Homo sapiens
agggtctctcagg

SEQ ID NO: 5566891 - DNA, 15 bp, Homo sapiens
agggtctctcaggga

SEQ ID NO: 5566892 - DNA, 12 bp, Homo sapiens
agggtctctccc

SEQ ID NO: 5566893 - DNA, 16 bp, Homo sapiens
agggtctctccctcag

SEQ ID NO: 5566894 - DNA, 22 bp, Homo sapiens
agggtctctctccaggtcagcc

SEQ ID NO: 5566895 - DNA, 12 bp, Homo sapiens
agggtctctgct

SEQ ID NO: 5566896 - DNA, 16 bp, Homo sapiens
agggtctctgctccag

SEQ ID NO: 5566897 - DNA, 18 bp, Homo sapiens
agggtctgaaaggggtgt

SEQ ID NO: 5566898 - DNA, 10 bp, Homo sapiens
agggtctgag

SEQ ID NO: 5566899 - DNA, 17 bp, Homo sapiens
agggtctgcagcctgct

SEQ ID NO: 5566900 - DNA, 21 bp, Homo sapiens
agggtctgcagcctgctgggg

SEQ ID NO: 5566901 - DNA, 23 bp, Homo sapiens
agggtctgcagcctgctggggct

SEQ ID NO: 5566902 - DNA, 13 bp, Homo sapiens
agggtctgctctt

SEQ ID NO: 5566903 - DNA, 13 bp, Homo sapiens
agggtctggagaa

SEQ ID NO: 5566904 - DNA, 15 bp, Homo sapiens
agggtctggagaagc

SEQ ID NO: 5566905 - DNA, 21 bp, Homo sapiens
agggtctggcagagcctctga

SEQ ID NO: 5566906 - DNA, 21 bp, Homo sapiens
agggtctgggaaatgagcagg

SEQ ID NO: 5566907 - DNA, 17 bp, Homo sapiens
agggtctgggcaggact

SEQ ID NO: 5566908 - DNA, 13 bp, Homo sapiens
agggtctgggctg

SEQ ID NO: 5566909 - DNA, 14 bp, Homo sapiens
agggtctgggggca

SEQ ID NO: 5566910 - DNA, 22 bp, Homo sapiens
agggtctgggggcacaagactg

SEQ ID NO: 5566911 - DNA, 17 bp, Homo sapiens
agggtctgggggcagct

SEQ ID NO: 5566912 - DNA, 21 bp, Homo sapiens
agggtctgtaggttgcacact

SEQ ID NO: 5566913 - DNA, 16 bp, Homo sapiens
agggtctgtcccgggt

SEQ ID NO: 5566914 - DNA, 15 bp, Homo sapiens
agggtctgtgtgaat

SEQ ID NO: 5566915 - DNA, 22 bp, Homo sapiens
agggtcttacctctctgggacc

SEQ ID NO: 5566916 - DNA, 18 bp, Homo sapiens
agggtcttgctctgtccc

SEQ ID NO: 5566917 - DNA, 15 bp, Homo sapiens
agggtcttgggaaat

SEQ ID NO: 5566918 - DNA, 16 bp, Homo sapiens
agggtcttgggaaata

SEQ ID NO: 5566919 - DNA, 14 bp, Homo sapiens
agggtcttgggcta

SEQ ID NO: 5566920 - DNA, 22 bp, Homo sapiens
agggtcttgggctactggcagc

SEQ ID NO: 5566921 - DNA, 20 bp, Homo sapiens
agggtcttgggggtcagggg

SEQ ID NO: 5566922 - DNA, 21 bp, Homo sapiens
agggtcttggttccagcctgc

SEQ ID NO: 5566923 - DNA, 13 bp, Homo sapiens
agggtctttactg

SEQ ID NO: 5566924 - DNA, 21 bp, Homo sapiens
agggtctttctcaaagaaata

SEQ ID NO: 5566925 - DNA, 16 bp, Homo sapiens
agggtctttgcagatg

SEQ ID NO: 5566926 - DNA, 20 bp, Homo sapiens
agggtcttttaccctgtgtc

SEQ ID NO: 5566927 - DNA, 21 bp, Homo sapiens
agggtcttttaccctgtgtca

SEQ ID NO: 5566928 - DNA, 23 bp, Homo sapiens
agggtcttttaccctgtgtcaga

SEQ ID NO: 5566929 - DNA, 15 bp, Homo sapiens
agggtcttttttcat

SEQ ID NO: 5566930 - DNA, 15 bp, Homo sapiens
agggtgaaaggcagg

SEQ ID NO: 5566931 - DNA, 18 bp, Homo sapiens
agggtgaataagattaat

SEQ ID NO: 5566932 - DNA, 13 bp, Homo sapiens
agggtgacatccc

SEQ ID NO: 5566933 - DNA, 18 bp, Homo sapiens
agggtgacatcccaggag

SEQ ID NO: 5566934 - DNA, 20 bp, Homo sapiens
agggtgacatggggaaggca

SEQ ID NO: 5566935 - DNA, 15 bp, Homo sapiens
agggtgacccacagc

SEQ ID NO: 5566936 - DNA, 19 bp, Homo sapiens
agggtgacccacagctctg

SEQ ID NO: 5566937 - DNA, 22 bp, Homo sapiens
agggtgacccatttcaggaggt

SEQ ID NO: 5566938 - DNA, 18 bp, Homo sapiens
agggtgacgcccagctcc

SEQ ID NO: 5566939 - DNA, 19 bp, Homo sapiens
agggtgacgcccagctccg

SEQ ID NO: 5566940 - DNA, 18 bp, Homo sapiens
agggtgactcacagccgc

SEQ ID NO: 5566941 - DNA, 19 bp, Homo sapiens
agggtgagacactgcacag

SEQ ID NO: 5566942 - DNA, 15 bp, Homo sapiens
agggtgagactccat

SEQ ID NO: 5566943 - DNA, 16 bp, Homo sapiens
agggtgagactccatc

SEQ ID NO: 5566944 - DNA, 18 bp, Homo sapiens
agggtgagaggaagggtg

SEQ ID NO: 5566945 - DNA, 17 bp, Homo sapiens
agggtgagctggtgcct

SEQ ID NO: 5566946 - DNA, 13 bp, Homo sapiens
agggtgaggatgg

SEQ ID NO: 5566947 - DNA, 22 bp, Homo sapiens
agggtgaggcgtgggatccaga

SEQ ID NO: 5566948 - DNA, 23 bp, Homo sapiens
agggtgaggcgtgggatccagag

SEQ ID NO: 5566949 - DNA, 18 bp, Homo sapiens
agggtgagggccttctta

SEQ ID NO: 5566950 - DNA, 14 bp, Homo sapiens
agggtgatgccagg

SEQ ID NO: 5566951 - DNA, 15 bp, Homo sapiens
agggtgatgccaggt

SEQ ID NO: 5566952 - DNA, 23 bp, Homo sapiens
agggtgattttatgatcagtgtt

SEQ ID NO: 5566953 - DNA, 20 bp, Homo sapiens
agggtgcagccctcttgccc

SEQ ID NO: 5566954 - DNA, 18 bp, Homo sapiens
agggtgcaggcgcgcacc

SEQ ID NO: 5566955 - DNA, 13 bp, Homo sapiens
agggtgcatagct

SEQ ID NO: 5566956 - DNA, 23 bp, Homo sapiens
agggtgcatggcttggggagcag

SEQ ID NO: 5566957 - DNA, 14 bp, Homo sapiens
agggtgcccagaac

SEQ ID NO: 5566958 - DNA, 20 bp, Homo sapiens
agggtgccccgcctgagtca

SEQ ID NO: 5566959 - DNA, 15 bp, Homo sapiens
agggtgcccctggga

SEQ ID NO: 5566960 - DNA, 16 bp, Homo sapiens
agggtgcccgagtgcg

SEQ ID NO: 5566961 - DNA, 17 bp, Homo sapiens
agggtgccctttggggt

SEQ ID NO: 5566962 - DNA, 24 bp, Homo sapiens
agggtgcccttttccagcctcagc

SEQ ID NO: 5566963 - DNA, 12 bp, Homo sapiens
agggtgccgcgg

SEQ ID NO: 5566964 - DNA, 24 bp, Homo sapiens
agggtgccgtgtcccctgacaggg

SEQ ID NO: 5566965 - DNA, 16 bp, Homo sapiens
agggtgcctcaggacc

SEQ ID NO: 5566966 - DNA, 12 bp, Homo sapiens
agggtgcctgct

SEQ ID NO: 5566967 - DNA, 17 bp, Homo sapiens
agggtgcctgctctcct

SEQ ID NO: 5566968 - DNA, 14 bp, Homo sapiens
agggtgcctggact

SEQ ID NO: 5566969 - DNA, 15 bp, Homo sapiens
agggtgcctggctgg

SEQ ID NO: 5566970 - DNA, 16 bp, Homo sapiens
agggtgcctggctggg

SEQ ID NO: 5566971 - DNA, 17 bp, Homo sapiens
agggtgcctggctgggc

SEQ ID NO: 5566972 - DNA, 18 bp, Homo sapiens
agggtgcctggctgggct

SEQ ID NO: 5566973 - DNA, 17 bp, Homo sapiens
agggtgcgtctgggagg

SEQ ID NO: 5566974 - DNA, 18 bp, Homo sapiens
agggtgctccctcctcag

SEQ ID NO: 5566975 - DNA, 14 bp, Homo sapiens
agggtgctgactgg

SEQ ID NO: 5566976 - DNA, 21 bp, Homo sapiens
agggtgctgatgggaaggagg

SEQ ID NO: 5566977 - DNA, 13 bp, Homo sapiens
agggtggaccagg

SEQ ID NO: 5566978 - DNA, 20 bp, Homo sapiens
agggtggaccccctgagtca

SEQ ID NO: 5566979 - DNA, 20 bp, Homo sapiens
agggtggacttagaaagcag

SEQ ID NO: 5566980 - DNA, 21 bp, Homo sapiens
agggtggagactaagccctgt

SEQ ID NO: 5566981 - DNA, 14 bp, Homo sapiens
agggtggagctgag

SEQ ID NO: 5566982 - DNA, 22 bp, Homo sapiens
agggtggaggaaggtgctgagc

SEQ ID NO: 5566983 - DNA, 23 bp, Homo sapiens
agggtggaggaaggtgctgagct

SEQ ID NO: 5566984 - DNA, 19 bp, Homo sapiens
agggtggatgacagggcag

SEQ ID NO: 5566985 - DNA, 18 bp, Homo sapiens
agggtggatgctctcagg

SEQ ID NO: 5566986 - DNA, 19 bp, Homo sapiens
agggtggatgtgctggagg

SEQ ID NO: 5566987 - DNA, 23 bp, Homo sapiens
agggtggcacccaccactctcag

SEQ ID NO: 5566988 - DNA, 19 bp, Homo sapiens
agggtggcagagacagtgg

SEQ ID NO: 5566989 - DNA, 11 bp, Homo sapiens
agggtggcagc

SEQ ID NO: 5566990 - DNA, 15 bp, Homo sapiens
agggtggcaggtcac

SEQ ID NO: 5566991 - DNA, 13 bp, Homo sapiens
agggtggccacac

SEQ ID NO: 5566992 - DNA, 17 bp, Homo sapiens
agggtggccacacaggc

SEQ ID NO: 5566993 - DNA, 22 bp, Homo sapiens
agggtggccacacaggcagggc

SEQ ID NO: 5566994 - DNA, 18 bp, Homo sapiens
agggtggcccaggtggct

SEQ ID NO: 5566995 - DNA, 20 bp, Homo sapiens
agggtggccccctgtgccag

SEQ ID NO: 5566996 - DNA, 14 bp, Homo sapiens
agggtggcctgttc

SEQ ID NO: 5566997 - DNA, 15 bp, Homo sapiens
agggtggcgccctgc

SEQ ID NO: 5566998 - DNA, 11 bp, Homo sapiens
agggtggctgc

SEQ ID NO: 5566999 - DNA, 18 bp, Homo sapiens
agggtggctgccagccca

SEQ ID NO: 5567000 - DNA, 20 bp, Homo sapiens
agggtggctttaattgtata

SEQ ID NO: 5567001 - DNA, 15 bp, Homo sapiens
agggtggctttgcat

SEQ ID NO: 5567002 - DNA, 20 bp, Homo sapiens
agggtggctttgcatttctt

SEQ ID NO: 5567003 - DNA, 15 bp, Homo sapiens
agggtggctttgctg

SEQ ID NO: 5567004 - DNA, 16 bp, Homo sapiens
agggtggctttgctgt

SEQ ID NO: 5567005 - DNA, 18 bp, Homo sapiens
agggtgggaagaaagaat

SEQ ID NO: 5567006 - DNA, 21 bp, Homo sapiens
agggtgggaagcttgctggct

SEQ ID NO: 5567007 - DNA, 12 bp, Homo sapiens
agggtgggaagg

SEQ ID NO: 5567008 - DNA, 16 bp, Homo sapiens
agggtgggagagccca

SEQ ID NO: 5567009 - DNA, 17 bp, Homo sapiens
agggtgggagagcccag

SEQ ID NO: 5567010 - DNA, 14 bp, Homo sapiens
agggtgggaggcaa

SEQ ID NO: 5567011 - DNA, 14 bp, Homo sapiens
agggtgggagggag

SEQ ID NO: 5567012 - DNA, 16 bp, Homo sapiens
agggtgggagggagga

SEQ ID NO: 5567013 - DNA, 20 bp, Homo sapiens
aggtccgagctctgtcctct

SEQ ID NO: 5567014 - DNA, 15 bp, Homo sapiens
aggtccggaggggtt

SEQ ID NO: 5567015 - DNA, 17 bp, Homo sapiens
aggtccgtagctcccct

SEQ ID NO: 5567016 - DNA, 19 bp, Homo sapiens
aggtccgtagctcccctgg

SEQ ID NO: 5567017 - DNA, 20 bp, Homo sapiens
aggtccgtagctcccctggc

SEQ ID NO: 5567018 - DNA, 13 bp, Homo sapiens
aggtcctaaggca

SEQ ID NO: 5567019 - DNA, 18 bp, Homo sapiens
aggtcctcacagcagtca

SEQ ID NO: 5567020 - DNA, 21 bp, Homo sapiens
aggtcctcacagcagtcacag

SEQ ID NO: 5567021 - DNA, 16 bp, Homo sapiens
aggtcctcagaaagtg

SEQ ID NO: 5567022 - DNA, 14 bp, Homo sapiens
aggtcctcaggtca

SEQ ID NO: 5567023 - DNA, 21 bp, Homo sapiens
aggtcctcaggtcagctggga

SEQ ID NO: 5567024 - DNA, 15 bp, Homo sapiens
aggtcctccatcacc

SEQ ID NO: 5567025 - DNA, 21 bp, Homo sapiens
aggtcctccgtagggtctttc

SEQ ID NO: 5567026 - DNA, 13 bp, Homo sapiens
aggtcctcctggc

SEQ ID NO: 5567027 - DNA, 15 bp, Homo sapiens
aggtcctctgaggca

SEQ ID NO: 5567028 - DNA, 13 bp, Homo sapiens
aggtcctctgtca

SEQ ID NO: 5567029 - DNA, 21 bp, Homo sapiens
aggtcctgaaagtctgtgtcc

SEQ ID NO: 5567030 - DNA, 22 bp, Homo sapiens
aggtcctgaaagtctgtgtcca

SEQ ID NO: 5567031 - DNA, 16 bp, Homo sapiens
aggtcctgagcactgc

SEQ ID NO: 5567032 - DNA, 18 bp, Homo sapiens
aggtcctgagcactgcca

SEQ ID NO: 5567033 - DNA, 19 bp, Homo sapiens
aggtcctgagcactgccag

SEQ ID NO: 5567034 - DNA, 13 bp, Homo sapiens
aggtcctgcccat

SEQ ID NO: 5567035 - DNA, 23 bp, Homo sapiens
aggtcctgcccatgtgtcccctc

SEQ ID NO: 5567036 - DNA, 12 bp, Homo sapiens
aggtcctgccct

SEQ ID NO: 5567037 - DNA, 19 bp, Homo sapiens
aggtcctgctccgctgcct

SEQ ID NO: 5567038 - DNA, 20 bp, Homo sapiens
aggtcctgctccgctgcctg

SEQ ID NO: 5567039 - DNA, 23 bp, Homo sapiens
aggtcctgctccgctgcctggaa

SEQ ID NO: 5567040 - DNA, 23 bp, Homo sapiens
aggtcctgctgcctctctttcac

SEQ ID NO: 5567041 - DNA, 16 bp, Homo sapiens
aggtcctgctgtggaa

SEQ ID NO: 5567042 - DNA, 23 bp, Homo sapiens
aggtcctgcttgaactgctgcca

SEQ ID NO: 5567043 - DNA, 22 bp, Homo sapiens
aggtcctggcttctagatctgg

SEQ ID NO: 5567044 - DNA, 22 bp, Homo sapiens
aggtcctggggaggctgagact

SEQ ID NO: 5567045 - DNA, 22 bp, Homo sapiens
aggtcctgggggcctgacctcc

SEQ ID NO: 5567046 - DNA, 14 bp, Homo sapiens
aggtcctggtgggg

SEQ ID NO: 5567047 - DNA, 17 bp, Homo sapiens
aggtcctggtgggtcag

SEQ ID NO: 5567048 - DNA, 19 bp, Homo sapiens
aggtcctgtgatcttattt

SEQ ID NO: 5567049 - DNA, 20 bp, Homo sapiens
aggtcctgtgatcttatttt

SEQ ID NO: 5567050 - DNA, 23 bp, Homo sapiens
aggtcctgtgatcttatttttct

SEQ ID NO: 5567051 - DNA, 20 bp, Homo sapiens
aggtccttaggcctctgaga

SEQ ID NO: 5567052 - DNA, 14 bp, Homo sapiens
aggtccttcccaga

SEQ ID NO: 5567053 - DNA, 14 bp, Homo sapiens
aggtccttgcctcc

SEQ ID NO: 5567054 - DNA, 15 bp, Homo sapiens
aggtccttgcctcct

SEQ ID NO: 5567055 - DNA, 17 bp, Homo sapiens
aggtccttgcctcctgg

SEQ ID NO: 5567056 - DNA, 19 bp, Homo sapiens
aggtccttgcctcctggaa

SEQ ID NO: 5567057 - DNA, 21 bp, Homo sapiens
aggtccttgcctgaactccag

SEQ ID NO: 5567058 - DNA, 23 bp, Homo sapiens
aggtccttgcctgaactccagag

SEQ ID NO: 5567059 - DNA, 14 bp, Homo sapiens
aggtcctttagaaa

SEQ ID NO: 5567060 - DNA, 16 bp, Homo sapiens
aggtcctttccttctc

SEQ ID NO: 5567061 - DNA, 21 bp, Homo sapiens
aggtcctttggacagctgact

SEQ ID NO: 5567062 - DNA, 20 bp, Homo sapiens
aggtcgaagcaatcagcaaa

SEQ ID NO: 5567063 - DNA, 14 bp, Homo sapiens
aggtcgaggcagga

SEQ ID NO: 5567064 - DNA, 20 bp, Homo sapiens
aggtcgcttgggaattttat

SEQ ID NO: 5567065 - DNA, 17 bp, Homo sapiens
aggtcggagtgcctgga

SEQ ID NO: 5567066 - DNA, 15 bp, Homo sapiens
aggtcgggacagctg

SEQ ID NO: 5567067 - DNA, 16 bp, Homo sapiens
aggtcgggctgccagc

SEQ ID NO: 5567068 - DNA, 19 bp, Homo sapiens
aggtcgggctgccagccca

SEQ ID NO: 5567069 - DNA, 15 bp, Homo sapiens
aggtcgggtgttaaa

SEQ ID NO: 5567070 - DNA, 18 bp, Homo sapiens
aggtcgttttccaaagag

SEQ ID NO: 5567071 - DNA, 19 bp, Homo sapiens
aggtcgttttccaaagagc

SEQ ID NO: 5567072 - DNA, 19 bp, Homo sapiens
aggtctaactgtggaatat

SEQ ID NO: 5567073 - DNA, 22 bp, Homo sapiens
aggtctacctgaaaattcaaca

SEQ ID NO: 5567074 - DNA, 16 bp, Homo sapiens
aggtctagaaggccag

SEQ ID NO: 5567075 - DNA, 16 bp, Homo sapiens
aggtctagactttctc

SEQ ID NO: 5567076 - DNA, 17 bp, Homo sapiens
aggtctagactttctca

SEQ ID NO: 5567077 - DNA, 14 bp, Homo sapiens
aggtctagagagaa

SEQ ID NO: 5567078 - DNA, 17 bp, Homo sapiens
aggtctataaacatgaa

SEQ ID NO: 5567079 - DNA, 21 bp, Homo sapiens
aggtctattggccaacaatcc

SEQ ID NO: 5567080 - DNA, 20 bp, Homo sapiens
aggtctatttaaaaaaaaag

SEQ ID NO: 5567081 - DNA, 17 bp, Homo sapiens
aggtctcacactcctcc

SEQ ID NO: 5567082 - DNA, 21 bp, Homo sapiens
aggtctcacactcctcctgcc

SEQ ID NO: 5567083 - DNA, 22 bp, Homo sapiens
aggtctcaccttcgcctttgct

SEQ ID NO: 5567084 - DNA, 13 bp, Homo sapiens
aggtctcacgggc

SEQ ID NO: 5567085 - DNA, 12 bp, Homo sapiens
aggtctcagccc

SEQ ID NO: 5567086 - DNA, 17 bp, Homo sapiens
aggtctcatctcccagg

SEQ ID NO: 5567087 - DNA, 21 bp, Homo sapiens
aggtctcatctcccaggcccc

SEQ ID NO: 5567088 - DNA, 17 bp, Homo sapiens
aggtctcatctcttcag

SEQ ID NO: 5567089 - DNA, 12 bp, Homo sapiens
aggtctcatgcc

SEQ ID NO: 5567090 - DNA, 23 bp, Homo sapiens
aggtctcatgcccactcccccag

SEQ ID NO: 5567091 - DNA, 15 bp, Homo sapiens
aggtctcatgcctga

SEQ ID NO: 5567092 - DNA, 18 bp, Homo sapiens
aggtctcatgctgttgct

SEQ ID NO: 5567093 - DNA, 18 bp, Homo sapiens
aggtctcattgcttctga

SEQ ID NO: 5567094 - DNA, 23 bp, Homo sapiens
aggtctcatttgatattgtgtag

SEQ ID NO: 5567095 - DNA, 12 bp, Homo sapiens
aggtctccaagg

SEQ ID NO: 5567096 - DNA, 17 bp, Homo sapiens
aggtctccaagggaggg

SEQ ID NO: 5567097 - DNA, 18 bp, Homo sapiens
aggtctccaagggagggt

SEQ ID NO: 5567098 - DNA, 14 bp, Homo sapiens
aggtctccacccct

SEQ ID NO: 5567099 - DNA, 19 bp, Homo sapiens
aggtctccacctgcacatt

SEQ ID NO: 5567100 - DNA, 21 bp, Homo sapiens
aggtctccactgaggatgtga

SEQ ID NO: 5567101 - DNA, 22 bp, Homo sapiens
aggtctccactgaggatgtgag

SEQ ID NO: 5567102 - DNA, 18 bp, Homo sapiens
aggtctccaggggcctgc

SEQ ID NO: 5567103 - DNA, 12 bp, Homo sapiens
aggtctcccaca

SEQ ID NO: 5567104 - DNA, 21 bp, Homo sapiens
aggtctcccctgatccagaca

SEQ ID NO: 5567105 - DNA, 13 bp, Homo sapiens
aggtctcccggga

SEQ ID NO: 5567106 - DNA, 13 bp, Homo sapiens
aggtctccctgga

SEQ ID NO: 5567107 - DNA, 13 bp, Homo sapiens
aggtctcctctta

SEQ ID NO: 5567108 - DNA, 20 bp, Homo sapiens
aggtctccttactctgagcc

SEQ ID NO: 5567109 - DNA, 21 bp, Homo sapiens
aggtctccttactctgagccc

SEQ ID NO: 5567110 - DNA, 17 bp, Homo sapiens
aggtctcgaccctgtcc

SEQ ID NO: 5567111 - DNA, 22 bp, Homo sapiens
aggtctcgaccctgtcccctag

SEQ ID NO: 5567112 - DNA, 21 bp, Homo sapiens
aggtctcgctgatgctgggct

SEQ ID NO: 5567113 - DNA, 22 bp, Homo sapiens
aggtctcgctgatgctgggctg

SEQ ID NO: 5567114 - DNA, 23 bp, Homo sapiens
aggtctcgctgatgctgggctgg

SEQ ID NO: 5567115 - DNA, 14 bp, Homo sapiens
aggtctctgagaca

SEQ ID NO: 5567116 - DNA, 16 bp, Homo sapiens
aggtctctgagacagg

SEQ ID NO: 5567117 - DNA, 15 bp, Homo sapiens
aggtctctggcagag

SEQ ID NO: 5567118 - DNA, 14 bp, Homo sapiens
aggtctctgggagc

SEQ ID NO: 5567119 - DNA, 12 bp, Homo sapiens
aggtctcttccc

SEQ ID NO: 5567120 - DNA, 13 bp, Homo sapiens
aggtctcttcccc

SEQ ID NO: 5567121 - DNA, 16 bp, Homo sapiens
aggtctcttcccctct

SEQ ID NO: 5567122 - DNA, 18 bp, Homo sapiens
aggtctcttcctttgctc

SEQ ID NO: 5567123 - DNA, 17 bp, Homo sapiens
aggtctcttctcccaga

SEQ ID NO: 5567124 - DNA, 19 bp, Homo sapiens
aggtctcttctcccagaat

SEQ ID NO: 5567125 - DNA, 22 bp, Homo sapiens
aggtctcttctcccagaatccc

SEQ ID NO: 5567126 - DNA, 23 bp, Homo sapiens
aggtctcttctcccagaatccca

SEQ ID NO: 5567127 - DNA, 16 bp, Homo sapiens
aggtctcttgagggag

SEQ ID NO: 5567128 - DNA, 13 bp, Homo sapiens
aggtctgaaatgg

SEQ ID NO: 5567129 - DNA, 23 bp, Homo sapiens
aggtctgaaatttttcttcttga

SEQ ID NO: 5567130 - DNA, 17 bp, Homo sapiens
aggtctgaccaaaacca

SEQ ID NO: 5567131 - DNA, 23 bp, Homo sapiens
aggtctgaccaaaaccagagggc

SEQ ID NO: 5567132 - DNA, 15 bp, Homo sapiens
aggtctgactccaaa

SEQ ID NO: 5567133 - DNA, 20 bp, Homo sapiens
aggtctgagttgttacccca

SEQ ID NO: 5567134 - DNA, 14 bp, Homo sapiens
aggtctgattggct

SEQ ID NO: 5567135 - DNA, 16 bp, Homo sapiens
aggtctgatttgcagg

SEQ ID NO: 5567136 - DNA, 21 bp, Homo sapiens
aggtctgatttgcaggatttt

SEQ ID NO: 5567137 - DNA, 16 bp, Homo sapiens
aggtctgcacacataa

SEQ ID NO: 5567138 - DNA, 23 bp, Homo sapiens
aggtctgcacacataacacacat

SEQ ID NO: 5567139 - DNA, 12 bp, Homo sapiens
aggtctgcaggc

SEQ ID NO: 5567140 - DNA, 15 bp, Homo sapiens
aggtctgcaggccac

SEQ ID NO: 5567141 - DNA, 16 bp, Homo sapiens
aggtctgcaggccacc

SEQ ID NO: 5567142 - DNA, 13 bp, Homo sapiens
aggtctgcatttt

SEQ ID NO: 5567143 - DNA, 16 bp, Homo sapiens
aggtctgcattttctc

SEQ ID NO: 5567144 - DNA, 21 bp, Homo sapiens
aggtctgcattttctcaggca

SEQ ID NO: 5567145 - DNA, 13 bp, Homo sapiens
aggtctgcctggt

SEQ ID NO: 5567146 - DNA, 20 bp, Homo sapiens
aggtctggaaggtctgatct

SEQ ID NO: 5567147 - DNA, 23 bp, Homo sapiens
aggtctggctgagcccctgggga

SEQ ID NO: 5567148 - DNA, 14 bp, Homo sapiens
aggtctgggcaagt

SEQ ID NO: 5567149 - DNA, 21 bp, Homo sapiens
aggtctgggctaggtagaaaa

SEQ ID NO: 5567150 - DNA, 19 bp, Homo sapiens
aggtctgggtggggcccag

SEQ ID NO: 5567151 - DNA, 18 bp, Homo sapiens
aggtctgtaactgcccag

SEQ ID NO: 5567152 - DNA, 19 bp, Homo sapiens
aggtctgtaactgcccagc

SEQ ID NO: 5567153 - DNA, 20 bp, Homo sapiens
aggtctgtaactgcccagcc

SEQ ID NO: 5567154 - DNA, 17 bp, Homo sapiens
aggtctgtatggctgta

SEQ ID NO: 5567155 - DNA, 18 bp, Homo sapiens
aggtctgtatgtcatgga

SEQ ID NO: 5567156 - DNA, 15 bp, Homo sapiens
aggtctgttctttcc

SEQ ID NO: 5567157 - DNA, 13 bp, Homo sapiens
aggtctgttgaag

SEQ ID NO: 5567158 - DNA, 20 bp, Homo sapiens
aggtctgtttaaagtggcaa

SEQ ID NO: 5567159 - DNA, 14 bp, Homo sapiens
aggtcttaaagtag

SEQ ID NO: 5567160 - DNA, 13 bp, Homo sapiens
aggtcttaggaat

SEQ ID NO: 5567161 - DNA, 15 bp, Homo sapiens
aggtcttaggaattg

SEQ ID NO: 5567162 - DNA, 23 bp, Homo sapiens
aggtcttcatatttttgatcatc

SEQ ID NO: 5567163 - DNA, 20 bp, Homo sapiens
aggtcttcatcgaatctact

SEQ ID NO: 5567164 - DNA, 12 bp, Homo sapiens
aggtcttccaga

SEQ ID NO: 5567165 - DNA, 13 bp, Homo sapiens
aggtcttccagac

SEQ ID NO: 5567166 - DNA, 15 bp, Homo sapiens
aggtcttccagacct

SEQ ID NO: 5567167 - DNA, 18 bp, Homo sapiens
aggtcttccagacctgct

SEQ ID NO: 5567168 - DNA, 22 bp, Homo sapiens
aggtcttcccgcaaggcctctc

SEQ ID NO: 5567169 - DNA, 14 bp, Homo sapiens
aggtcttcctgtgg

SEQ ID NO: 5567170 - DNA, 18 bp, Homo sapiens
aggtcttcttgtgtcctg

SEQ ID NO: 5567171 - DNA, 21 bp, Homo sapiens
aggtcttgaactcctggcctc

SEQ ID NO: 5567172 - DNA, 15 bp, Homo sapiens
aggtcttgactcatg

SEQ ID NO: 5567173 - DNA, 22 bp, Homo sapiens
aggtcttgactcatggcagctg

SEQ ID NO: 5567174 - DNA, 17 bp, Homo sapiens
aggtcttgccaactcca

SEQ ID NO: 5567175 - DNA, 12 bp, Homo sapiens
aggtcttgctgg

SEQ ID NO: 5567176 - DNA, 16 bp, Homo sapiens
aggtcttgctggaaga

SEQ ID NO: 5567177 - DNA, 19 bp, Homo sapiens
aggtcttgctggaagacag

SEQ ID NO: 5567178 - DNA, 21 bp, Homo sapiens
aggtcttggaacttgcctgcc

SEQ ID NO: 5567179 - DNA, 22 bp, Homo sapiens
aggtcttggagctgagcctctc

SEQ ID NO: 5567180 - DNA, 21 bp, Homo sapiens
aggtctttaaacctttcataa

SEQ ID NO: 5567181 - DNA, 11 bp, Homo sapiens
aggtctttcct

SEQ ID NO: 5567182 - DNA, 17 bp, Homo sapiens
aggtctttctcctcagg

SEQ ID NO: 5567183 - DNA, 21 bp, Homo sapiens
aggtctttctcctcaggacaa

SEQ ID NO: 5567184 - DNA, 14 bp, Homo sapiens
aggtctttctctca

SEQ ID NO: 5567185 - DNA, 15 bp, Homo sapiens
aggtctttctctcag

SEQ ID NO: 5567186 - DNA, 18 bp, Homo sapiens
aggtctttggttcagcta

SEQ ID NO: 5567187 - DNA, 10 bp, Homo sapiens
aggtctttgt

SEQ ID NO: 5567188 - DNA, 17 bp, Homo sapiens
aggtctttgtaaaatct

SEQ ID NO: 5567189 - DNA, 14 bp, Homo sapiens
aggtcttttacata

SEQ ID NO: 5567190 - DNA, 19 bp, Homo sapiens
aggtgggcaaagggaagta

SEQ ID NO: 5567191 - DNA, 20 bp, Homo sapiens
aggtgggcagatcacttgag

SEQ ID NO: 5567192 - DNA, 17 bp, Homo sapiens
aggtgggcagcagctca

SEQ ID NO: 5567193 - DNA, 13 bp, Homo sapiens
aggtgggcagctg

SEQ ID NO: 5567194 - DNA, 14 bp, Homo sapiens
aggtgggcagctgg

SEQ ID NO: 5567195 - DNA, 15 bp, Homo sapiens
aggtgggcagctggg

SEQ ID NO: 5567196 - DNA, 16 bp, Homo sapiens
aggtgggcagctgggc

SEQ ID NO: 5567197 - DNA, 18 bp, Homo sapiens
aggtgggcagctgggccc

SEQ ID NO: 5567198 - DNA, 22 bp, Homo sapiens
aggtgggcatgccaccctcaca

SEQ ID NO: 5567199 - DNA, 22 bp, Homo sapiens
aggtgggccacacccaggaagg

SEQ ID NO: 5567200 - DNA, 18 bp, Homo sapiens
aggtgggccagcccctcc

SEQ ID NO: 5567201 - DNA, 21 bp, Homo sapiens
aggtgggccagcccctcccac

SEQ ID NO: 5567202 - DNA, 12 bp, Homo sapiens
aggtgggcccag

SEQ ID NO: 5567203 - DNA, 14 bp, Homo sapiens
aggtgggcccagga

SEQ ID NO: 5567204 - DNA, 16 bp, Homo sapiens
aggtgggcccaggacc

SEQ ID NO: 5567205 - DNA, 12 bp, Homo sapiens
aggtgggcccgg

SEQ ID NO: 5567206 - DNA, 23 bp, Homo sapiens
aggtgggccgcaggcgggaaaag

SEQ ID NO: 5567207 - DNA, 20 bp, Homo sapiens
aggtgggcctggcggcctgt

SEQ ID NO: 5567208 - DNA, 13 bp, Homo sapiens
aggtgggcctggg

SEQ ID NO: 5567209 - DNA, 21 bp, Homo sapiens
aggtgggccttgctacctcaa

SEQ ID NO: 5567210 - DNA, 21 bp, Homo sapiens
aggtgggcggacaaaagggcc

SEQ ID NO: 5567211 - DNA, 19 bp, Homo sapiens
aggtgggcgggcagcacag

SEQ ID NO: 5567212 - DNA, 14 bp, Homo sapiens
aggtgggcggtgtg

SEQ ID NO: 5567213 - DNA, 15 bp, Homo sapiens
aggtgggctgagccc

SEQ ID NO: 5567214 - DNA, 16 bp, Homo sapiens
aggtgggctgcctgct

SEQ ID NO: 5567215 - DNA, 21 bp, Homo sapiens
aggtgggctggggctgctccc

SEQ ID NO: 5567216 - DNA, 21 bp, Homo sapiens
aggtgggcttcccagtggctg

SEQ ID NO: 5567217 - DNA, 19 bp, Homo sapiens
aggtggggaagagagcctg

SEQ ID NO: 5567218 - DNA, 22 bp, Homo sapiens
aggtggggaagagagcctgccc

SEQ ID NO: 5567219 - DNA, 13 bp, Homo sapiens
aggtggggaagga

SEQ ID NO: 5567220 - DNA, 14 bp, Homo sapiens
aggtggggaaggag

SEQ ID NO: 5567221 - DNA, 22 bp, Homo sapiens
aggtggggaaggagggacttgg

SEQ ID NO: 5567222 - DNA, 21 bp, Homo sapiens
aggtggggacctggggggagg

SEQ ID NO: 5567223 - DNA, 15 bp, Homo sapiens
aggtggggagaaggg

SEQ ID NO: 5567224 - DNA, 22 bp, Homo sapiens
aggtggggagggggtttggggg

SEQ ID NO: 5567225 - DNA, 13 bp, Homo sapiens
aggtggggagtca

SEQ ID NO: 5567226 - DNA, 18 bp, Homo sapiens
aggtggggccctgcccct

SEQ ID NO: 5567227 - DNA, 16 bp, Homo sapiens
aggtggggcctcagcc

SEQ ID NO: 5567228 - DNA, 20 bp, Homo sapiens
aggtggggcctggggtagga

SEQ ID NO: 5567229 - DNA, 21 bp, Homo sapiens
aggtggggcgggaaagccagt

SEQ ID NO: 5567230 - DNA, 17 bp, Homo sapiens
aggtgggggagcctgga

SEQ ID NO: 5567231 - DNA, 19 bp, Homo sapiens
aggtgggggagcctggagc

SEQ ID NO: 5567232 - DNA, 22 bp, Homo sapiens
aggtgggggagcctggagcccc

SEQ ID NO: 5567233 - DNA, 23 bp, Homo sapiens
aggtgggggagcctggagcccct

SEQ ID NO: 5567234 - DNA, 16 bp, Homo sapiens
aggtgggggatgctga

SEQ ID NO: 5567235 - DNA, 20 bp, Homo sapiens
aggtgggggatgctgaggag

SEQ ID NO: 5567236 - DNA, 18 bp, Homo sapiens
aggtgggggtcggcgcct

SEQ ID NO: 5567237 - DNA, 21 bp, Homo sapiens
aggtggggtagtgccgcagtg

SEQ ID NO: 5567238 - DNA, 21 bp, Homo sapiens
aggtggggtctttgtgagagt

SEQ ID NO: 5567239 - DNA, 14 bp, Homo sapiens
aggtggggtgctgg

SEQ ID NO: 5567240 - DNA, 21 bp, Homo sapiens
aggtggggtggagtcccagag

SEQ ID NO: 5567241 - DNA, 18 bp, Homo sapiens
aggtgggtccaggaaggc

SEQ ID NO: 5567242 - DNA, 17 bp, Homo sapiens
aggtgggtgaggctggg

SEQ ID NO: 5567243 - DNA, 21 bp, Homo sapiens
aggtgggtgattcctcccagg

SEQ ID NO: 5567244 - DNA, 17 bp, Homo sapiens
aggtgggtgctgccctg

SEQ ID NO: 5567245 - DNA, 14 bp, Homo sapiens
aggtgggtgggcct

SEQ ID NO: 5567246 - DNA, 16 bp, Homo sapiens
aggtgggtgggcctga

SEQ ID NO: 5567247 - DNA, 18 bp, Homo sapiens
aggtgggtgggcctgact

SEQ ID NO: 5567248 - DNA, 19 bp, Homo sapiens
aggtgggtgggcctgactg

SEQ ID NO: 5567249 - DNA, 19 bp, Homo sapiens
aggtgggtggtgggcttct

SEQ ID NO: 5567250 - DNA, 21 bp, Homo sapiens
aggtgggtgtgggtggaaggg

SEQ ID NO: 5567251 - DNA, 15 bp, Homo sapiens
aggtgggttccaggg

SEQ ID NO: 5567252 - DNA, 21 bp, Homo sapiens
aggtgggttttcttcccatca

SEQ ID NO: 5567253 - DNA, 23 bp, Homo sapiens
aggtgggttttcttcccatcact

SEQ ID NO: 5567254 - DNA, 17 bp, Homo sapiens
aggtggtagctctgagc

SEQ ID NO: 5567255 - DNA, 19 bp, Homo sapiens
aggtggtagctctgagccc

SEQ ID NO: 5567256 - DNA, 21 bp, Homo sapiens
aggtggtagctctgagccctc

SEQ ID NO: 5567257 - DNA, 20 bp, Homo sapiens
aggtggtagtaaaacacaga

SEQ ID NO: 5567258 - DNA, 21 bp, Homo sapiens
aggtggtagtaaaacacagag

SEQ ID NO: 5567259 - DNA, 22 bp, Homo sapiens
aggtggtagtaaaacacagagg

SEQ ID NO: 5567260 - DNA, 20 bp, Homo sapiens
aggtggtatgtaatttatgc

SEQ ID NO: 5567261 - DNA, 12 bp, Homo sapiens
aggtggtcccat

SEQ ID NO: 5567262 - DNA, 22 bp, Homo sapiens
aggtggtcctcctatctccctg

SEQ ID NO: 5567263 - DNA, 21 bp, Homo sapiens
aggtggtctgaatgttctgac

SEQ ID NO: 5567264 - DNA, 22 bp, Homo sapiens
aggtggtctgaatgttctgaca

SEQ ID NO: 5567265 - DNA, 20 bp, Homo sapiens
aggtggtctgcaccccacag

SEQ ID NO: 5567266 - DNA, 21 bp, Homo sapiens
aggtggtctgctcgggcccag

SEQ ID NO: 5567267 - DNA, 22 bp, Homo sapiens
aggtggtctgctcgggcccagg

SEQ ID NO: 5567268 - DNA, 22 bp, Homo sapiens
aggtggtctgcttttgctgggg

SEQ ID NO: 5567269 - DNA, 20 bp, Homo sapiens
aggtggtcttggagaggagg

SEQ ID NO: 5567270 - DNA, 21 bp, Homo sapiens
aggtggtcttggagaggaggt

SEQ ID NO: 5567271 - DNA, 23 bp, Homo sapiens
aggtggtgaattttccaagaaca

SEQ ID NO: 5567272 - DNA, 15 bp, Homo sapiens
aggtggtgccttctc

SEQ ID NO: 5567273 - DNA, 15 bp, Homo sapiens
aggtggtggaggggc

SEQ ID NO: 5567274 - DNA, 23 bp, Homo sapiens
aggtggtgggacactgggcagca

SEQ ID NO: 5567275 - DNA, 13 bp, Homo sapiens
aggtggtggggct

SEQ ID NO: 5567276 - DNA, 18 bp, Homo sapiens
aggtggtgggggcaggga

SEQ ID NO: 5567277 - DNA, 21 bp, Homo sapiens
aggtggtggtggtggtgaagg

SEQ ID NO: 5567278 - DNA, 17 bp, Homo sapiens
aggtggtgtcactgtcc

SEQ ID NO: 5567279 - DNA, 17 bp, Homo sapiens
aggtggttatggagagg

SEQ ID NO: 5567280 - DNA, 21 bp, Homo sapiens
aggtggttcagacaagacaga

SEQ ID NO: 5567281 - DNA, 16 bp, Homo sapiens
aggtggttcgtgctgt

SEQ ID NO: 5567282 - DNA, 20 bp, Homo sapiens
aggtggttctttttatttta

SEQ ID NO: 5567283 - DNA, 20 bp, Homo sapiens
aggtggttttattttccctt

SEQ ID NO: 5567284 - DNA, 13 bp, Homo sapiens
aggtgtaataaga

SEQ ID NO: 5567285 - DNA, 13 bp, Homo sapiens
aggtgtacactaa

SEQ ID NO: 5567286 - DNA, 21 bp, Homo sapiens
aggtgtaggtcagatatttga

SEQ ID NO: 5567287 - DNA, 21 bp, Homo sapiens
aggtgtatagggaattttcat

SEQ ID NO: 5567288 - DNA, 22 bp, Homo sapiens
aggtgtattgtgtatgtagcct

SEQ ID NO: 5567289 - DNA, 13 bp, Homo sapiens
aggtgtatttaaa

SEQ ID NO: 5567290 - DNA, 18 bp, Homo sapiens
aggtgtcaccatcatttc

SEQ ID NO: 5567291 - DNA, 15 bp, Homo sapiens
aggtgtcaccctgca

SEQ ID NO: 5567292 - DNA, 19 bp, Homo sapiens
aggtgtcaccctgcagagc

SEQ ID NO: 5567293 - DNA, 21 bp, Homo sapiens
aggtgtcaccctgcagagcta

SEQ ID NO: 5567294 - DNA, 14 bp, Homo sapiens
aggtgtcaggcccg

SEQ ID NO: 5567295 - DNA, 22 bp, Homo sapiens
aggtgtcaggcccgtcggagct

SEQ ID NO: 5567296 - DNA, 18 bp, Homo sapiens
aggtgtcaggctgctggc

SEQ ID NO: 5567297 - DNA, 17 bp, Homo sapiens
aggtgtcatccacaggc

SEQ ID NO: 5567298 - DNA, 19 bp, Homo sapiens
aggtgtccagcattgctgg

SEQ ID NO: 5567299 - DNA, 23 bp, Homo sapiens
aggtgtccagcattgctggactc

SEQ ID NO: 5567300 - DNA, 11 bp, Homo sapiens
aggtgtcccca

SEQ ID NO: 5567301 - DNA, 15 bp, Homo sapiens
aggtgtccccaacgt

SEQ ID NO: 5567302 - DNA, 16 bp, Homo sapiens
aggtgtccctgcactt

SEQ ID NO: 5567303 - DNA, 20 bp, Homo sapiens
aggtgtccctgcacttgcag

SEQ ID NO: 5567304 - DNA, 14 bp, Homo sapiens
aggtgtccctgcct

SEQ ID NO: 5567305 - DNA, 17 bp, Homo sapiens
aggtgtcctacagaaaa

SEQ ID NO: 5567306 - DNA, 17 bp, Homo sapiens
aggtgtcctttcccctc

SEQ ID NO: 5567307 - DNA, 20 bp, Homo sapiens
aggtgtcctttcccctctct

SEQ ID NO: 5567308 - DNA, 15 bp, Homo sapiens
aggtgtccttttcct

SEQ ID NO: 5567309 - DNA, 13 bp, Homo sapiens
aggtgtctcaggc

SEQ ID NO: 5567310 - DNA, 14 bp, Homo sapiens
aggtgtctcaggct

SEQ ID NO: 5567311 - DNA, 15 bp, Homo sapiens
aggtgtctctgggcc

SEQ ID NO: 5567312 - DNA, 21 bp, Homo sapiens
aggtgtctctgggcctgtgtg

SEQ ID NO: 5567313 - DNA, 14 bp, Homo sapiens
aggtgtctgcaccc

SEQ ID NO: 5567314 - DNA, 21 bp, Homo sapiens
aggtgtctgcacccaggggtg

SEQ ID NO: 5567315 - DNA, 15 bp, Homo sapiens
aggtgtctgccttca

SEQ ID NO: 5567316 - DNA, 20 bp, Homo sapiens
aggtgtctgccttcacaaat

SEQ ID NO: 5567317 - DNA, 21 bp, Homo sapiens
aggtgtctggggtgagggagt

SEQ ID NO: 5567318 - DNA, 20 bp, Homo sapiens
aggtgtcttcctcccaagtg

SEQ ID NO: 5567319 - DNA, 19 bp, Homo sapiens
aggtgtgaacagctttgta

SEQ ID NO: 5567320 - DNA, 23 bp, Homo sapiens
aggtgtgaaccaccacacccagc

SEQ ID NO: 5567321 - DNA, 18 bp, Homo sapiens
aggtgtgaaccactgtgc

SEQ ID NO: 5567322 - DNA, 22 bp, Homo sapiens
aggtgtgaacctacctgccttg

SEQ ID NO: 5567323 - DNA, 13 bp, Homo sapiens
aggtgtgaatgca

SEQ ID NO: 5567324 - DNA, 23 bp, Homo sapiens
aggtgtgaccctgagggctcctc

SEQ ID NO: 5567325 - DNA, 16 bp, Homo sapiens
aggtgtgactctagca

SEQ ID NO: 5567326 - DNA, 20 bp, Homo sapiens
aggtgtgactgaatttcttt

SEQ ID NO: 5567327 - DNA, 12 bp, Homo sapiens
aggtgtgaggag

SEQ ID NO: 5567328 - DNA, 13 bp, Homo sapiens
aggtgtgaggaga

SEQ ID NO: 5567329 - DNA, 15 bp, Homo sapiens
aggtgtgaggagaga

SEQ ID NO: 5567330 - DNA, 14 bp, Homo sapiens
aggtgtgagtcacc

SEQ ID NO: 5567331 - DNA, 17 bp, Homo sapiens
aggtgtgagtctggctg

SEQ ID NO: 5567332 - DNA, 16 bp, Homo sapiens
aggtgtgatggtctgg

SEQ ID NO: 5567333 - DNA, 15 bp, Homo sapiens
aggtgtgattataaa

SEQ ID NO: 5567334 - DNA, 14 bp, Homo sapiens
aggtgtgcaagaga

SEQ ID NO: 5567335 - DNA, 17 bp, Homo sapiens
aggtgtgcacagaaaac

SEQ ID NO: 5567336 - DNA, 19 bp, Homo sapiens
aggtgtgccagaaagtccc

SEQ ID NO: 5567337 - DNA, 14 bp, Homo sapiens
aggtgtgcccctcc

SEQ ID NO: 5567338 - DNA, 19 bp, Homo sapiens
aggtgtgcccctccaagtc

SEQ ID NO: 5567339 - DNA, 24 bp, Homo sapiens
aggtgtgcctggcctctgcctcca

SEQ ID NO: 5567340 - DNA, 13 bp, Homo sapiens
aggtgtgctacag

SEQ ID NO: 5567341 - DNA, 20 bp, Homo sapiens
aggtgtgctctgagccacag

SEQ ID NO: 5567342 - DNA, 16 bp, Homo sapiens
aggtgtggaggctcct

SEQ ID NO: 5567343 - DNA, 17 bp, Homo sapiens
aggtgtggaggctcctg

SEQ ID NO: 5567344 - DNA, 18 bp, Homo sapiens
aggtgtggaggctcctgt

SEQ ID NO: 5567345 - DNA, 21 bp, Homo sapiens
aggtgtggaggctcctgtggt

SEQ ID NO: 5567346 - DNA, 16 bp, Homo sapiens
aggtgtggagtggagg

SEQ ID NO: 5567347 - DNA, 19 bp, Homo sapiens
aggtgtgggatctggggag

SEQ ID NO: 5567348 - DNA, 17 bp, Homo sapiens
aggtgtgggccagagat

SEQ ID NO: 5567349 - DNA, 17 bp, Homo sapiens
aggtgtgggctcccacg

SEQ ID NO: 5567350 - DNA, 20 bp, Homo sapiens
aggtgtgggctcccacgccc

SEQ ID NO: 5567351 - DNA, 22 bp, Homo sapiens
aggtgtggggacacagcagtga

SEQ ID NO: 5567352 - DNA, 14 bp, Homo sapiens
aggtgtgggggctg

SEQ ID NO: 5567353 - DNA, 18 bp, Homo sapiens
aggtgtgggggctgcagc

SEQ ID NO: 5567354 - DNA, 21 bp, Homo sapiens
aggtgtggtgtaatttataaa

SEQ ID NO: 5567355 - DNA, 17 bp, Homo sapiens
aggtgtgtactcagggc

SEQ ID NO: 5567356 - DNA, 19 bp, Homo sapiens
aggtgtgtccttgaactga

SEQ ID NO: 5567357 - DNA, 23 bp, Homo sapiens
aggtgtgtccttgaactgaggcc

SEQ ID NO: 5567358 - DNA, 14 bp, Homo sapiens
aggtgtgtgcttta

SEQ ID NO: 5567359 - DNA, 16 bp, Homo sapiens
aggtgtgtgtgaactg

SEQ ID NO: 5567360 - DNA, 23 bp, Homo sapiens
aggtgtgtgtgaactgggcacag

SEQ ID NO: 5567361 - DNA, 18 bp, Homo sapiens
aggtgtgtgtgtccagag

SEQ ID NO: 5567362 - DNA, 17 bp, Homo sapiens
aggtgttaacattccaa

SEQ ID NO: 5567363 - DNA, 23 bp, Homo sapiens
aggtgttaacattccaagactct

SEQ ID NO: 5567364 - DNA, 15 bp, Homo sapiens
aggtgttatgtattc

SEQ ID NO: 5567365 - DNA, 17 bp, Homo sapiens
agtaaaaccttttttct

SEQ ID NO: 5567366 - DNA, 19 bp, Homo sapiens
agtaaaacttgtattggaa

SEQ ID NO: 5567367 - DNA, 13 bp, Homo sapiens
agtaaaagaaacc

SEQ ID NO: 5567368 - DNA, 12 bp, Homo sapiens
agtaaaagctaa

SEQ ID NO: 5567369 - DNA, 19 bp, Homo sapiens
agtaaaagtggtctctgct

SEQ ID NO: 5567370 - DNA, 12 bp, Homo sapiens
agtaaaagttat

SEQ ID NO: 5567371 - DNA, 23 bp, Homo sapiens
agtaaaataggcaccattgctta

SEQ ID NO: 5567372 - DNA, 16 bp, Homo sapiens
agtaaaataggtcccg

SEQ ID NO: 5567373 - DNA, 12 bp, Homo sapiens
agtaaaatcaca

SEQ ID NO: 5567374 - DNA, 16 bp, Homo sapiens
agtaaaattatactgt

SEQ ID NO: 5567375 - DNA, 23 bp, Homo sapiens
agtaaaattatcctctttgtaat

SEQ ID NO: 5567376 - DNA, 14 bp, Homo sapiens
agtaaaattcagtt

SEQ ID NO: 5567377 - DNA, 15 bp, Homo sapiens
agtaaaattgaagca

SEQ ID NO: 5567378 - DNA, 14 bp, Homo sapiens
agtaaaattgccat

SEQ ID NO: 5567379 - DNA, 23 bp, Homo sapiens
agtaaaattgccatattgcacat

SEQ ID NO: 5567380 - DNA, 23 bp, Homo sapiens
agtaaacaataaaagtgtccatt

SEQ ID NO: 5567381 - DNA, 21 bp, Homo sapiens
agtaaacatttgtaaaaatac

SEQ ID NO: 5567382 - DNA, 24 bp, Homo sapiens
agtaaacatttgtaaaaatactgt

SEQ ID NO: 5567383 - DNA, 15 bp, Homo sapiens
agtaaaccactgaaa

SEQ ID NO: 5567384 - DNA, 15 bp, Homo sapiens
agtaaacctgaacaa

SEQ ID NO: 5567385 - DNA, 16 bp, Homo sapiens
agtaaacctgaacaaa

SEQ ID NO: 5567386 - DNA, 14 bp, Homo sapiens
agtaaactaaagta

SEQ ID NO: 5567387 - DNA, 16 bp, Homo sapiens
agtaaactaatgagtt

SEQ ID NO: 5567388 - DNA, 19 bp, Homo sapiens
agtaaactaatgagtttct

SEQ ID NO: 5567389 - DNA, 14 bp, Homo sapiens
agtaaactgtttct

SEQ ID NO: 5567390 - DNA, 16 bp, Homo sapiens
agtaaagaaagcagaa

SEQ ID NO: 5567391 - DNA, 16 bp, Homo sapiens
agtaaagaattatttt

SEQ ID NO: 5567392 - DNA, 14 bp, Homo sapiens
agtaaagagtacac

SEQ ID NO: 5567393 - DNA, 21 bp, Homo sapiens
agtaaagataaaaggatagga

SEQ ID NO: 5567394 - DNA, 17 bp, Homo sapiens
agtaaagcagaggatgc

SEQ ID NO: 5567395 - DNA, 13 bp, Homo sapiens
agtaaagccatta

SEQ ID NO: 5567396 - DNA, 20 bp, Homo sapiens
agtaaagccattaaatgaat

SEQ ID NO: 5567397 - DNA, 14 bp, Homo sapiens
agtaaagctaaaat

SEQ ID NO: 5567398 - DNA, 23 bp, Homo sapiens
agtaaaggaaataagagcagtca

SEQ ID NO: 5567399 - DNA, 12 bp, Homo sapiens
agtaaaggagga

SEQ ID NO: 5567400 - DNA, 16 bp, Homo sapiens
agtaaaggcaaactta

SEQ ID NO: 5567401 - DNA, 16 bp, Homo sapiens
agtaaaggcattgtcc

SEQ ID NO: 5567402 - DNA, 16 bp, Homo sapiens
agtaaaggcctcctcc

SEQ ID NO: 5567403 - DNA, 16 bp, Homo sapiens
agtaaaggttaaaaat

SEQ ID NO: 5567404 - DNA, 17 bp, Homo sapiens
agtaaagtacaagctgt

SEQ ID NO: 5567405 - DNA, 18 bp, Homo sapiens
agtaaagtgaagaattta

SEQ ID NO: 5567406 - DNA, 12 bp, Homo sapiens
agtaaagtggtt

SEQ ID NO: 5567407 - DNA, 22 bp, Homo sapiens
agtaaagtgtaacatatgcaaa

SEQ ID NO: 5567408 - DNA, 24 bp, Homo sapiens
agtaaagttccacttagagaacaa

SEQ ID NO: 5567409 - DNA, 21 bp, Homo sapiens
agtaaagttgtatgtaagctg

SEQ ID NO: 5567410 - DNA, 15 bp, Homo sapiens
agtaaagtttaaaaa

SEQ ID NO: 5567411 - DNA, 17 bp, Homo sapiens
agtaaagtttaaaaaat

SEQ ID NO: 5567412 - DNA, 17 bp, Homo sapiens
agtaaagtttatttcat

SEQ ID NO: 5567413 - DNA, 17 bp, Homo sapiens
agtaaataaaattaaca

SEQ ID NO: 5567414 - DNA, 15 bp, Homo sapiens
agtaaataaacaagt

SEQ ID NO: 5567415 - DNA, 18 bp, Homo sapiens
agtaaataaactcttcaa

SEQ ID NO: 5567416 - DNA, 13 bp, Homo sapiens
agtaaataaactg

SEQ ID NO: 5567417 - DNA, 19 bp, Homo sapiens
agtaaataaattgtttgac

SEQ ID NO: 5567418 - DNA, 14 bp, Homo sapiens
agtaaataatgctt

SEQ ID NO: 5567419 - DNA, 17 bp, Homo sapiens
agtaaatacaagactgt

SEQ ID NO: 5567420 - DNA, 19 bp, Homo sapiens
agtaaatacaagactgttg

SEQ ID NO: 5567421 - DNA, 15 bp, Homo sapiens
agtaaatacaatttt

SEQ ID NO: 5567422 - DNA, 18 bp, Homo sapiens
agtaaatacactgtgaag

SEQ ID NO: 5567423 - DNA, 14 bp, Homo sapiens
agtaaatacagcaa

SEQ ID NO: 5567424 - DNA, 23 bp, Homo sapiens
agtaaatagtttgaattcagtaa

SEQ ID NO: 5567425 - DNA, 17 bp, Homo sapiens
agtaaatatatatgtca

SEQ ID NO: 5567426 - DNA, 18 bp, Homo sapiens
agtaaatatatatgtcaa

SEQ ID NO: 5567427 - DNA, 17 bp, Homo sapiens
agtaaatatgtgaagaa

SEQ ID NO: 5567428 - DNA, 17 bp, Homo sapiens
agtaaatattgtcacaa

SEQ ID NO: 5567429 - DNA, 14 bp, Homo sapiens
agtaaatcaaagat

SEQ ID NO: 5567430 - DNA, 20 bp, Homo sapiens
agtaaatcacgctttttgaa

SEQ ID NO: 5567431 - DNA, 18 bp, Homo sapiens
agtaaatcagatgttgaa

SEQ ID NO: 5567432 - DNA, 18 bp, Homo sapiens
agtaaatccacagtgagt

SEQ ID NO: 5567433 - DNA, 15 bp, Homo sapiens
agtaaatcctcattt

SEQ ID NO: 5567434 - DNA, 17 bp, Homo sapiens
agtaaatctaaagaaat

SEQ ID NO: 5567435 - DNA, 15 bp, Homo sapiens
agtaaatctatctct

SEQ ID NO: 5567436 - DNA, 20 bp, Homo sapiens
agtaaatctatctctatata

SEQ ID NO: 5567437 - DNA, 14 bp, Homo sapiens
agtaaatctcttct

SEQ ID NO: 5567438 - DNA, 15 bp, Homo sapiens
agtaaatctcttctg

SEQ ID NO: 5567439 - DNA, 18 bp, Homo sapiens
agtaaatctcttctgtgt

SEQ ID NO: 5567440 - DNA, 19 bp, Homo sapiens
agtaaatgggggtgcattt

SEQ ID NO: 5567441 - DNA, 20 bp, Homo sapiens
agtaaatgtgattcacctct

SEQ ID NO: 5567442 - DNA, 12 bp, Homo sapiens
agtaaatgttaa

SEQ ID NO: 5567443 - DNA, 16 bp, Homo sapiens
agtaaattaagagcat

SEQ ID NO: 5567444 - DNA, 13 bp, Homo sapiens
agtaaattatgat

SEQ ID NO: 5567445 - DNA, 15 bp, Homo sapiens
agtaaattattaagc

SEQ ID NO: 5567446 - DNA, 19 bp, Homo sapiens
agtaaattcctaattctat

SEQ ID NO: 5567447 - DNA, 11 bp, Homo sapiens
agtaaattctg

SEQ ID NO: 5567448 - DNA, 13 bp, Homo sapiens
agtaaattctgtt

SEQ ID NO: 5567449 - DNA, 15 bp, Homo sapiens
agtaaattgctctgt

SEQ ID NO: 5567450 - DNA, 15 bp, Homo sapiens
agtaaattggaaaca

SEQ ID NO: 5567451 - DNA, 20 bp, Homo sapiens
agtaaatttgtataaataag

SEQ ID NO: 5567452 - DNA, 20 bp, Homo sapiens
agtaacaaaaaataaagaat

SEQ ID NO: 5567453 - DNA, 15 bp, Homo sapiens
agtaacaaggtgtct

SEQ ID NO: 5567454 - DNA, 19 bp, Homo sapiens
agtaacaatacaaatggat

SEQ ID NO: 5567455 - DNA, 15 bp, Homo sapiens
agtaacaatacatga

SEQ ID NO: 5567456 - DNA, 21 bp, Homo sapiens
agtaacaatacatgagaaaga

SEQ ID NO: 5567457 - DNA, 20 bp, Homo sapiens
agtaacaatatgtaatcaaa

SEQ ID NO: 5567458 - DNA, 17 bp, Homo sapiens
agtaacaatctatggct

SEQ ID NO: 5567459 - DNA, 19 bp, Homo sapiens
agtaacaatgaagataaaa

SEQ ID NO: 5567460 - DNA, 19 bp, Homo sapiens
agtaacaatgcatgctttg

SEQ ID NO: 5567461 - DNA, 19 bp, Homo sapiens
agtaacacagattattcat

SEQ ID NO: 5567462 - DNA, 14 bp, Homo sapiens
agtaacacaggcca

SEQ ID NO: 5567463 - DNA, 13 bp, Homo sapiens
agtaacacagtat

SEQ ID NO: 5567464 - DNA, 14 bp, Homo sapiens
agtaacacagtatt

SEQ ID NO: 5567465 - DNA, 14 bp, Homo sapiens
agtaacacataaag

SEQ ID NO: 5567466 - DNA, 17 bp, Homo sapiens
agtaacactaatatatt

SEQ ID NO: 5567467 - DNA, 15 bp, Homo sapiens
agtaacactggcctt

SEQ ID NO: 5567468 - DNA, 19 bp, Homo sapiens
agtaacacttgaaaagtgt

SEQ ID NO: 5567469 - DNA, 23 bp, Homo sapiens
agtaacactttaaaaccagttac

SEQ ID NO: 5567470 - DNA, 23 bp, Homo sapiens
agtaacaggaaaccacttatcac

SEQ ID NO: 5567471 - DNA, 20 bp, Homo sapiens
agtaacaggccttgagcaca

SEQ ID NO: 5567472 - DNA, 17 bp, Homo sapiens
agtaacagggcagaaat

SEQ ID NO: 5567473 - DNA, 16 bp, Homo sapiens
agtaacagtcatcatt

SEQ ID NO: 5567474 - DNA, 17 bp, Homo sapiens
agtaacagtcatcattt

SEQ ID NO: 5567475 - DNA, 18 bp, Homo sapiens
agtaacagtcatcattta

SEQ ID NO: 5567476 - DNA, 19 bp, Homo sapiens
agtaacagtcatcatttat

SEQ ID NO: 5567477 - DNA, 18 bp, Homo sapiens
agtaacagttgaagaaaa

SEQ ID NO: 5567478 - DNA, 19 bp, Homo sapiens
agtaacataactgcttctt

SEQ ID NO: 5567479 - DNA, 19 bp, Homo sapiens
agtaacatgacttccttat

SEQ ID NO: 5567480 - DNA, 21 bp, Homo sapiens
agtaacatgacttccttattt

SEQ ID NO: 5567481 - DNA, 17 bp, Homo sapiens
agtaacatgaggggaca

SEQ ID NO: 5567482 - DNA, 20 bp, Homo sapiens
agtaacattaactcagtgga

SEQ ID NO: 5567483 - DNA, 14 bp, Homo sapiens
agtaacattctact

SEQ ID NO: 5567484 - DNA, 15 bp, Homo sapiens
agtaacatttctgtt

SEQ ID NO: 5567485 - DNA, 19 bp, Homo sapiens
agtaacatttctgttctca

SEQ ID NO: 5567486 - DNA, 15 bp, Homo sapiens
agtaacatttgctgt

SEQ ID NO: 5567487 - DNA, 17 bp, Homo sapiens
agtaacatttgctgttt

SEQ ID NO: 5567488 - DNA, 20 bp, Homo sapiens
agtaaccaggccccagcctc

SEQ ID NO: 5567489 - DNA, 17 bp, Homo sapiens
agtaaccatttaatgtc

SEQ ID NO: 5567490 - DNA, 11 bp, Homo sapiens
agtaacccagc

SEQ ID NO: 5567491 - DNA, 18 bp, Homo sapiens
agtaacccccactggact

SEQ ID NO: 5567492 - DNA, 16 bp, Homo sapiens
agtaacccctcctggc

SEQ ID NO: 5567493 - DNA, 13 bp, Homo sapiens
agtaacctttaaa

SEQ ID NO: 5567494 - DNA, 16 bp, Homo sapiens
agtaacgtgctgctca

SEQ ID NO: 5567495 - DNA, 16 bp, Homo sapiens
agtaacgtgttactgg

SEQ ID NO: 5567496 - DNA, 15 bp, Homo sapiens
agtaactaagcacat

SEQ ID NO: 5567497 - DNA, 15 bp, Homo sapiens
agtaactaattttgt

SEQ ID NO: 5567498 - DNA, 13 bp, Homo sapiens
agtaactactttt

SEQ ID NO: 5567499 - DNA, 20 bp, Homo sapiens
agtaactataacaaaaaaag

SEQ ID NO: 5567500 - DNA, 15 bp, Homo sapiens
agtaactattattat

SEQ ID NO: 5567501 - DNA, 22 bp, Homo sapiens
agtaactcataatctataaaca

SEQ ID NO: 5567502 - DNA, 14 bp, Homo sapiens
agtaactcatctgt

SEQ ID NO: 5567503 - DNA, 11 bp, Homo sapiens
agtaactccca

SEQ ID NO: 5567504 - DNA, 16 bp, Homo sapiens
agtaactcccactcct

SEQ ID NO: 5567505 - DNA, 19 bp, Homo sapiens
agtaactgccatcaagatg

SEQ ID NO: 5567506 - DNA, 15 bp, Homo sapiens
agtaactgccctttc

SEQ ID NO: 5567507 - DNA, 18 bp, Homo sapiens
agtaactggtgatatatc

SEQ ID NO: 5567508 - DNA, 17 bp, Homo sapiens
agtaactggttgctgtg

SEQ ID NO: 5567509 - DNA, 17 bp, Homo sapiens
agtaactgtcaggctga

SEQ ID NO: 5567510 - DNA, 22 bp, Homo sapiens
agtaactgtccctgctttctgg

SEQ ID NO: 5567511 - DNA, 20 bp, Homo sapiens
agtaacttagaaaagtggtg

SEQ ID NO: 5567512 - DNA, 16 bp, Homo sapiens
agtaacttatttgact

SEQ ID NO: 5567513 - DNA, 15 bp, Homo sapiens
agtaacttggctttc

SEQ ID NO: 5567514 - DNA, 15 bp, Homo sapiens
agtaacttggttata

SEQ ID NO: 5567515 - DNA, 22 bp, Homo sapiens
agtaacttggttatacatgaca

SEQ ID NO: 5567516 - DNA, 15 bp, Homo sapiens
agtaacttgtcttaa

SEQ ID NO: 5567517 - DNA, 20 bp, Homo sapiens
agtaacttgtcttaaataaa

SEQ ID NO: 5567518 - DNA, 23 bp, Homo sapiens
agtaacttgtcttaaataaaaga

SEQ ID NO: 5567519 - DNA, 20 bp, Homo sapiens
agtaactttactctgtgttt

SEQ ID NO: 5567520 - DNA, 19 bp, Homo sapiens
agtaactttatgtgtaaat

SEQ ID NO: 5567521 - DNA, 20 bp, Homo sapiens
agtaactttatgtgtaaata

SEQ ID NO: 5567522 - DNA, 15 bp, Homo sapiens
agtaactttattctt

SEQ ID NO: 5567523 - DNA, 13 bp, Homo sapiens
agtaacttttaaa

SEQ ID NO: 5567524 - DNA, 19 bp, Homo sapiens
agtaacttttaaaatttgt

SEQ ID NO: 5567525 - DNA, 14 bp, Homo sapiens
agtaacttttttgt

SEQ ID NO: 5567526 - DNA, 16 bp, Homo sapiens
agtaagaaaatatttt

SEQ ID NO: 5567527 - DNA, 20 bp, Homo sapiens
agtaagaaatgggcctcagc

SEQ ID NO: 5567528 - DNA, 21 bp, Homo sapiens
agtaagaacatccctgtctta

SEQ ID NO: 5567529 - DNA, 12 bp, Homo sapiens
agtaagaagagg

SEQ ID NO: 5567530 - DNA, 20 bp, Homo sapiens
agtaagaagaggagcctcag

SEQ ID NO: 5567531 - DNA, 20 bp, Homo sapiens
agtaagaatgtgtgtgcaga

SEQ ID NO: 5567532 - DNA, 15 bp, Homo sapiens
agtaagacatctcaa

SEQ ID NO: 5567533 - DNA, 17 bp, Homo sapiens
agtaagacatctcaaat

SEQ ID NO: 5567534 - DNA, 16 bp, Homo sapiens
agtaagaccggaagct

SEQ ID NO: 5567535 - DNA, 21 bp, Homo sapiens
agtaagacttttattaataaa

SEQ ID NO: 5567536 - DNA, 23 bp, Homo sapiens
agtaagagctctaagtacctttc

SEQ ID NO: 5567537 - DNA, 15 bp, Homo sapiens
agtaagagtttacaa

SEQ ID NO: 5567538 - DNA, 15 bp, Homo sapiens
agtaagatcactgtt

SEQ ID NO: 5567539 - DNA, 18 bp, Homo sapiens
agtaagatctctttctaa

SEQ ID NO: 5567540 - DNA, 20 bp, Homo sapiens
agtaagcacctttagaatat

SEQ ID NO: 5567541 - DNA, 20 bp, Homo sapiens
agtaagcagagttctttgca

SEQ ID NO: 5567542 - DNA, 22 bp, Homo sapiens
agtaagcagagttctttgcaag

SEQ ID NO: 5567543 - DNA, 12 bp, Homo sapiens
agtaagcagtgt

SEQ ID NO: 5567544 - DNA, 23 bp, Homo sapiens
agtacttggtttttttttttctt

SEQ ID NO: 5567545 - DNA, 17 bp, Homo sapiens
agtacttgtagttccac

SEQ ID NO: 5567546 - DNA, 21 bp, Homo sapiens
agtacttgtgaaacacagctg

SEQ ID NO: 5567547 - DNA, 20 bp, Homo sapiens
agtactttagactaattgtg

SEQ ID NO: 5567548 - DNA, 17 bp, Homo sapiens
agtactttagcctggta

SEQ ID NO: 5567549 - DNA, 16 bp, Homo sapiens
agtactttatagaaga

SEQ ID NO: 5567550 - DNA, 18 bp, Homo sapiens
agtactttatagaagaat

SEQ ID NO: 5567551 - DNA, 19 bp, Homo sapiens
agtactttatagaagaatg

SEQ ID NO: 5567552 - DNA, 15 bp, Homo sapiens
agtactttatgaaaa

SEQ ID NO: 5567553 - DNA, 22 bp, Homo sapiens
agtactttcgttaatcttgctg

SEQ ID NO: 5567554 - DNA, 19 bp, Homo sapiens
agtacttttgttgtatggg

SEQ ID NO: 5567555 - DNA, 13 bp, Homo sapiens
agtacttttttaa

SEQ ID NO: 5567556 - DNA, 15 bp, Homo sapiens
agtacttttttaaat

SEQ ID NO: 5567557 - DNA, 18 bp, Homo sapiens
agtagaaaaattgtttcc

SEQ ID NO: 5567558 - DNA, 14 bp, Homo sapiens
agtagaaaatgtga

SEQ ID NO: 5567559 - DNA, 18 bp, Homo sapiens
agtagaaaatgtgaccct

SEQ ID NO: 5567560 - DNA, 22 bp, Homo sapiens
agtagaaagacatctgcctgta

SEQ ID NO: 5567561 - DNA, 15 bp, Homo sapiens
agtagaaagagtgtt

SEQ ID NO: 5567562 - DNA, 14 bp, Homo sapiens
agtagaaagctaaa

SEQ ID NO: 5567563 - DNA, 14 bp, Homo sapiens
agtagaaaggcctt

SEQ ID NO: 5567564 - DNA, 16 bp, Homo sapiens
agtagaaaggccttta

SEQ ID NO: 5567565 - DNA, 17 bp, Homo sapiens
agtagaaaggcctttaa

SEQ ID NO: 5567566 - DNA, 20 bp, Homo sapiens
agtagaaatgccagaaacag

SEQ ID NO: 5567567 - DNA, 14 bp, Homo sapiens
agtagaaattttac

SEQ ID NO: 5567568 - DNA, 15 bp, Homo sapiens
agtagaacaaaaact

SEQ ID NO: 5567569 - DNA, 13 bp, Homo sapiens
agtagaacagata

SEQ ID NO: 5567570 - DNA, 17 bp, Homo sapiens
agtagaactcttaaata

SEQ ID NO: 5567571 - DNA, 21 bp, Homo sapiens
agtagaactttgtatagttat

SEQ ID NO: 5567572 - DNA, 20 bp, Homo sapiens
agtagaagatttgatgctgg

SEQ ID NO: 5567573 - DNA, 17 bp, Homo sapiens
agtagaagcatgtttgt

SEQ ID NO: 5567574 - DNA, 21 bp, Homo sapiens
agtagaaggtcggaggcttgg

SEQ ID NO: 5567575 - DNA, 19 bp, Homo sapiens
agtagaagtcttagatgta

SEQ ID NO: 5567576 - DNA, 18 bp, Homo sapiens
agtagaataaagaaaaac

SEQ ID NO: 5567577 - DNA, 16 bp, Homo sapiens
agtagaatctcagcac

SEQ ID NO: 5567578 - DNA, 21 bp, Homo sapiens
agtagaatctcagttgatttt

SEQ ID NO: 5567579 - DNA, 18 bp, Homo sapiens
agtagaatggacaatttc

SEQ ID NO: 5567580 - DNA, 18 bp, Homo sapiens
agtagaatggcagctgga

SEQ ID NO: 5567581 - DNA, 14 bp, Homo sapiens
agtagaattgattt

SEQ ID NO: 5567582 - DNA, 15 bp, Homo sapiens
agtagaattgcattg

SEQ ID NO: 5567583 - DNA, 15 bp, Homo sapiens
agtagacacatttaa

SEQ ID NO: 5567584 - DNA, 21 bp, Homo sapiens
agtagacacgagcttaatcaa

SEQ ID NO: 5567585 - DNA, 24 bp, Homo sapiens
agtagacagcaataactcggtgtg

SEQ ID NO: 5567586 - DNA, 17 bp, Homo sapiens
agtagacatgaatttta

SEQ ID NO: 5567587 - DNA, 16 bp, Homo sapiens
agtagacattttaaca

SEQ ID NO: 5567588 - DNA, 20 bp, Homo sapiens
agtagaccaaatcttgttat

SEQ ID NO: 5567589 - DNA, 13 bp, Homo sapiens
agtagacccctgg

SEQ ID NO: 5567590 - DNA, 21 bp, Homo sapiens
agtagacctgattttcaaaat

SEQ ID NO: 5567591 - DNA, 21 bp, Homo sapiens
agtagaccttgttacttctga

SEQ ID NO: 5567592 - DNA, 15 bp, Homo sapiens
agtagactactgttc

SEQ ID NO: 5567593 - DNA, 16 bp, Homo sapiens
agtagactgattacac

SEQ ID NO: 5567594 - DNA, 20 bp, Homo sapiens
agtagactgattacactgag

SEQ ID NO: 5567595 - DNA, 13 bp, Homo sapiens
agtagacttatag

SEQ ID NO: 5567596 - DNA, 19 bp, Homo sapiens
agtagacttgctttggtca

SEQ ID NO: 5567597 - DNA, 16 bp, Homo sapiens
agtagacttggtgtga

SEQ ID NO: 5567598 - DNA, 14 bp, Homo sapiens
agtagagaggcccg

SEQ ID NO: 5567599 - DNA, 22 bp, Homo sapiens
agtagagatttcatagctattt

SEQ ID NO: 5567600 - DNA, 15 bp, Homo sapiens
agtagaggcttagag

SEQ ID NO: 5567601 - DNA, 22 bp, Homo sapiens
agtagaggtacacttgtgaata

SEQ ID NO: 5567602 - DNA, 18 bp, Homo sapiens
agtagaggtataattgtg

SEQ ID NO: 5567603 - DNA, 16 bp, Homo sapiens
agtagaggtttaaaga

SEQ ID NO: 5567604 - DNA, 18 bp, Homo sapiens
agtagaggtttaaagaaa

SEQ ID NO: 5567605 - DNA, 15 bp, Homo sapiens
agtagagtatattga

SEQ ID NO: 5567606 - DNA, 19 bp, Homo sapiens
agtagagtatattgaaaag

SEQ ID NO: 5567607 - DNA, 15 bp, Homo sapiens
agtagatactctcag

SEQ ID NO: 5567608 - DNA, 15 bp, Homo sapiens
agtagatattacttt

SEQ ID NO: 5567609 - DNA, 17 bp, Homo sapiens
agtagatattactttat

SEQ ID NO: 5567610 - DNA, 17 bp, Homo sapiens
agtagatcatggcagca

SEQ ID NO: 5567611 - DNA, 18 bp, Homo sapiens
agtagatcatggcagcat

SEQ ID NO: 5567612 - DNA, 16 bp, Homo sapiens
agtagatccatttcca

SEQ ID NO: 5567613 - DNA, 15 bp, Homo sapiens
agtagatctatatta

SEQ ID NO: 5567614 - DNA, 23 bp, Homo sapiens
agtagatctatattagatcaaat

SEQ ID NO: 5567615 - DNA, 16 bp, Homo sapiens
agtagatctgtggcga

SEQ ID NO: 5567616 - DNA, 22 bp, Homo sapiens
agtagatgcatttgggtccagg

SEQ ID NO: 5567617 - DNA, 21 bp, Homo sapiens
agtagatgcgcagccccatct

SEQ ID NO: 5567618 - DNA, 19 bp, Homo sapiens
agtagattaaaaattatag

SEQ ID NO: 5567619 - DNA, 13 bp, Homo sapiens
agtagattaaaat

SEQ ID NO: 5567620 - DNA, 22 bp, Homo sapiens
agtagattatggcctttttaag

SEQ ID NO: 5567621 - DNA, 19 bp, Homo sapiens
agtagattttaaagacaaa

SEQ ID NO: 5567622 - DNA, 23 bp, Homo sapiens
agtagattttctttaaaagaatg

SEQ ID NO: 5567623 - DNA, 15 bp, Homo sapiens
agtagatttttaaca

SEQ ID NO: 5567624 - DNA, 20 bp, Homo sapiens
agtagcaaatgagacagcag

SEQ ID NO: 5567625 - DNA, 21 bp, Homo sapiens
agtagcaaatgtttactgtat

SEQ ID NO: 5567626 - DNA, 17 bp, Homo sapiens
agtagcaaggaaggaca

SEQ ID NO: 5567627 - DNA, 16 bp, Homo sapiens
agtagcaatgtgcctt

SEQ ID NO: 5567628 - DNA, 21 bp, Homo sapiens
agtagcaattatggaaaaaaa

SEQ ID NO: 5567629 - DNA, 14 bp, Homo sapiens
agtagcacaggctg

SEQ ID NO: 5567630 - DNA, 15 bp, Homo sapiens
agtagcacaggctga

SEQ ID NO: 5567631 - DNA, 22 bp, Homo sapiens
agtagcacaggctgagtgcagg

SEQ ID NO: 5567632 - DNA, 17 bp, Homo sapiens
agtagcactgactattt

SEQ ID NO: 5567633 - DNA, 12 bp, Homo sapiens
agtagcagaaat

SEQ ID NO: 5567634 - DNA, 14 bp, Homo sapiens
agtagcagctgtgt

SEQ ID NO: 5567635 - DNA, 12 bp, Homo sapiens
agtagcaggact

SEQ ID NO: 5567636 - DNA, 13 bp, Homo sapiens
agtagcaggccca

SEQ ID NO: 5567637 - DNA, 14 bp, Homo sapiens
agtagcagtgattg

SEQ ID NO: 5567638 - DNA, 23 bp, Homo sapiens
agtagcagtgattgttatgcctt

SEQ ID NO: 5567639 - DNA, 15 bp, Homo sapiens
agtagcatttcattc

SEQ ID NO: 5567640 - DNA, 19 bp, Homo sapiens
agtagccaaacaccacttt

SEQ ID NO: 5567641 - DNA, 20 bp, Homo sapiens
agtagccaaacaccactttg

SEQ ID NO: 5567642 - DNA, 19 bp, Homo sapiens
agtagccaaacccctagag

SEQ ID NO: 5567643 - DNA, 17 bp, Homo sapiens
agtagccattttgtaac

SEQ ID NO: 5567644 - DNA, 22 bp, Homo sapiens
agtagcccctaatcacatgtgc

SEQ ID NO: 5567645 - DNA, 16 bp, Homo sapiens
agtagccgagagcctg

SEQ ID NO: 5567646 - DNA, 22 bp, Homo sapiens
agtagcctaacacactccaaga

SEQ ID NO: 5567647 - DNA, 22 bp, Homo sapiens
agtagcctctcctgtatttaac

SEQ ID NO: 5567648 - DNA, 13 bp, Homo sapiens
agtagcctctggg

SEQ ID NO: 5567649 - DNA, 22 bp, Homo sapiens
agtagcctctgggatctgccaa

SEQ ID NO: 5567650 - DNA, 16 bp, Homo sapiens
agtagcgctatagtta

SEQ ID NO: 5567651 - DNA, 19 bp, Homo sapiens
agtagcggtaccaatgcag

SEQ ID NO: 5567652 - DNA, 20 bp, Homo sapiens
agtagctccgcgtgtctcat

SEQ ID NO: 5567653 - DNA, 17 bp, Homo sapiens
agtagctcgtcctcact

SEQ ID NO: 5567654 - DNA, 16 bp, Homo sapiens
agtagctcgtgtgctt

SEQ ID NO: 5567655 - DNA, 13 bp, Homo sapiens
agtagctcttaga

SEQ ID NO: 5567656 - DNA, 13 bp, Homo sapiens
agtagctgagact

SEQ ID NO: 5567657 - DNA, 21 bp, Homo sapiens
agtagctgagattacaggcgc

SEQ ID NO: 5567658 - DNA, 14 bp, Homo sapiens
agtagctgataaag

SEQ ID NO: 5567659 - DNA, 15 bp, Homo sapiens
agtagctgcagcctt

SEQ ID NO: 5567660 - DNA, 21 bp, Homo sapiens
agtagctgccaaaaagaacac

SEQ ID NO: 5567661 - DNA, 17 bp, Homo sapiens
agtagctgctaccttct

SEQ ID NO: 5567662 - DNA, 18 bp, Homo sapiens
agtagctgctaccttctt

SEQ ID NO: 5567663 - DNA, 22 bp, Homo sapiens
agtagctgctaccttctttggc

SEQ ID NO: 5567664 - DNA, 18 bp, Homo sapiens
agtagctggcgcccatcc

SEQ ID NO: 5567665 - DNA, 22 bp, Homo sapiens
agtagctgggaccacaggcatg

SEQ ID NO: 5567666 - DNA, 13 bp, Homo sapiens
agtagctgggact

SEQ ID NO: 5567667 - DNA, 21 bp, Homo sapiens
agtagctgggactacaggcgt

SEQ ID NO: 5567668 - DNA, 12 bp, Homo sapiens
agtagctgggat

SEQ ID NO: 5567669 - DNA, 13 bp, Homo sapiens
agtagctgggatg

SEQ ID NO: 5567670 - DNA, 17 bp, Homo sapiens
agtagctgggattacag

SEQ ID NO: 5567671 - DNA, 23 bp, Homo sapiens
agtagctgggattacagatctgc

SEQ ID NO: 5567672 - DNA, 21 bp, Homo sapiens
agtagctgggattacaggcat

SEQ ID NO: 5567673 - DNA, 21 bp, Homo sapiens
agtagctgggattacaggtgt

SEQ ID NO: 5567674 - DNA, 19 bp, Homo sapiens
agtagctgggcctgtgcac

SEQ ID NO: 5567675 - DNA, 19 bp, Homo sapiens
agtagctgtggggagctgg

SEQ ID NO: 5567676 - DNA, 14 bp, Homo sapiens
agtagcttaaataa

SEQ ID NO: 5567677 - DNA, 16 bp, Homo sapiens
agtagcttaaataaat

SEQ ID NO: 5567678 - DNA, 20 bp, Homo sapiens
agtagcttaaataaattcaa

SEQ ID NO: 5567679 - DNA, 20 bp, Homo sapiens
agtagcttatctcagttatg

SEQ ID NO: 5567680 - DNA, 15 bp, Homo sapiens
agtagcttgaaattg

SEQ ID NO: 5567681 - DNA, 14 bp, Homo sapiens
agtagcttgctccc

SEQ ID NO: 5567682 - DNA, 17 bp, Homo sapiens
agtagcttgctccctgt

SEQ ID NO: 5567683 - DNA, 14 bp, Homo sapiens
agtagctttccaca

SEQ ID NO: 5567684 - DNA, 20 bp, Homo sapiens
agtagctttgctttgcagtc

SEQ ID NO: 5567685 - DNA, 21 bp, Homo sapiens
agtagctttggaaaggtgccc

SEQ ID NO: 5567686 - DNA, 14 bp, Homo sapiens
agtagctttgggca

SEQ ID NO: 5567687 - DNA, 18 bp, Homo sapiens
agtagctttgggcatagg

SEQ ID NO: 5567688 - DNA, 23 bp, Homo sapiens
agtaggaaagtcacccaaacact

SEQ ID NO: 5567689 - DNA, 17 bp, Homo sapiens
agtaggaagactttgga

SEQ ID NO: 5567690 - DNA, 18 bp, Homo sapiens
agtaggaagactttggaa

SEQ ID NO: 5567691 - DNA, 21 bp, Homo sapiens
agtaggaatgtacatgaagca

SEQ ID NO: 5567692 - DNA, 16 bp, Homo sapiens
agtaggaccaatgttg

SEQ ID NO: 5567693 - DNA, 17 bp, Homo sapiens
agtaggaccaggccacc

SEQ ID NO: 5567694 - DNA, 23 bp, Homo sapiens
agtaggagacacagatggcacct

SEQ ID NO: 5567695 - DNA, 22 bp, Homo sapiens
agtaggagacacgacagcacac

SEQ ID NO: 5567696 - DNA, 23 bp, Homo sapiens
agtaggagacacgacagcacaca

SEQ ID NO: 5567697 - DNA, 13 bp, Homo sapiens
agtaggagcccag

SEQ ID NO: 5567698 - DNA, 23 bp, Homo sapiens
agtaggagtggctgaccaggccc

SEQ ID NO: 5567699 - DNA, 14 bp, Homo sapiens
agtaggattgctgt

SEQ ID NO: 5567700 - DNA, 23 bp, Homo sapiens
agtaggatttatgtattttgaaa

SEQ ID NO: 5567701 - DNA, 18 bp, Homo sapiens
agtaggcatatatcacta

SEQ ID NO: 5567702 - DNA, 14 bp, Homo sapiens
agtaggcattcttt

SEQ ID NO: 5567703 - DNA, 12 bp, Homo sapiens
agtaggccctgc

SEQ ID NO: 5567704 - DNA, 16 bp, Homo sapiens
agtaggctaaaaacat

SEQ ID NO: 5567705 - DNA, 21 bp, Homo sapiens
agtaggctaaaaacattttaa

SEQ ID NO: 5567706 - DNA, 17 bp, Homo sapiens
agtaggctcatttactg

SEQ ID NO: 5567707 - DNA, 18 bp, Homo sapiens
agtaggctgtattttctt

SEQ ID NO: 5567708 - DNA, 23 bp, Homo sapiens
agtagggatgcggatcctgctgg

SEQ ID NO: 5567709 - DNA, 13 bp, Homo sapiens
agtagggccctga

SEQ ID NO: 5567710 - DNA, 19 bp, Homo sapiens
agtaggggaagaataattt

SEQ ID NO: 5567711 - DNA, 20 bp, Homo sapiens
agtaggggtaccactgaatc

SEQ ID NO: 5567712 - DNA, 16 bp, Homo sapiens
agtaggggttgaagaa

SEQ ID NO: 5567713 - DNA, 20 bp, Homo sapiens
agtaggtaccatttgtgtct

SEQ ID NO: 5567714 - DNA, 18 bp, Homo sapiens
agtaggtctgaaggcctc

SEQ ID NO: 5567715 - DNA, 15 bp, Homo sapiens
agtaggtctgcacac

SEQ ID NO: 5567716 - DNA, 23 bp, Homo sapiens
agtaggtctgcacacataacaca

SEQ ID NO: 5567717 - DNA, 17 bp, Homo sapiens
agtaggtctgggatgga

SEQ ID NO: 5567718 - DNA, 16 bp, Homo sapiens
agtaggtggcttgagc

SEQ ID NO: 5567719 - DNA, 17 bp, Homo sapiens
agtaggtgggggaacac

SEQ ID NO: 5567720 - DNA, 14 bp, Homo sapiens
agtcaatgtgcagt

SEQ ID NO: 5567721 - DNA, 18 bp, Homo sapiens
agtcaattaaacagctgg

SEQ ID NO: 5567722 - DNA, 21 bp, Homo sapiens
agtcaattactctataataca

SEQ ID NO: 5567723 - DNA, 21 bp, Homo sapiens
agtcaattagtacagtagctt

SEQ ID NO: 5567724 - DNA, 16 bp, Homo sapiens
agtcaattctgtgtgg

SEQ ID NO: 5567725 - DNA, 19 bp, Homo sapiens
agtcaattctgtgtggtat

SEQ ID NO: 5567726 - DNA, 20 bp, Homo sapiens
agtcacaaaataaagctgtg

SEQ ID NO: 5567727 - DNA, 22 bp, Homo sapiens
agtcacaaactgatctaaaatg

SEQ ID NO: 5567728 - DNA, 12 bp, Homo sapiens
agtcacaaagac

SEQ ID NO: 5567729 - DNA, 13 bp, Homo sapiens
agtcacaatgttc

SEQ ID NO: 5567730 - DNA, 17 bp, Homo sapiens
agtcacaatttgcaaat

SEQ ID NO: 5567731 - DNA, 11 bp, Homo sapiens
agtcacacaga

SEQ ID NO: 5567732 - DNA, 23 bp, Homo sapiens
agtcacacagtgagtcgaggaca

SEQ ID NO: 5567733 - DNA, 14 bp, Homo sapiens
agtcacacattata

SEQ ID NO: 5567734 - DNA, 13 bp, Homo sapiens
agtcacacccact

SEQ ID NO: 5567735 - DNA, 15 bp, Homo sapiens
agtcacactgtggcc

SEQ ID NO: 5567736 - DNA, 13 bp, Homo sapiens
agtcacagccacc

SEQ ID NO: 5567737 - DNA, 20 bp, Homo sapiens
agtcacagctgcagctgggc

SEQ ID NO: 5567738 - DNA, 15 bp, Homo sapiens
agtcacatcacaata

SEQ ID NO: 5567739 - DNA, 15 bp, Homo sapiens
agtcacatcacagga

SEQ ID NO: 5567740 - DNA, 21 bp, Homo sapiens
agtcacatcagtgaggaggga

SEQ ID NO: 5567741 - DNA, 23 bp, Homo sapiens
agtcacatcctgggatccagtgt

SEQ ID NO: 5567742 - DNA, 23 bp, Homo sapiens
agtcacatggcctatgcacatat

SEQ ID NO: 5567743 - DNA, 18 bp, Homo sapiens
agtcacattcctgaacag

SEQ ID NO: 5567744 - DNA, 20 bp, Homo sapiens
agtcacattcctgaacagga

SEQ ID NO: 5567745 - DNA, 15 bp, Homo sapiens
agtcacattctgctt

SEQ ID NO: 5567746 - DNA, 16 bp, Homo sapiens
agtcacattgatgtaa

SEQ ID NO: 5567747 - DNA, 19 bp, Homo sapiens
agtcacattgccatcactc

SEQ ID NO: 5567748 - DNA, 21 bp, Homo sapiens
agtcaccaaatagtgtgaaat

SEQ ID NO: 5567749 - DNA, 13 bp, Homo sapiens
agtcaccacccag

SEQ ID NO: 5567750 - DNA, 16 bp, Homo sapiens
agtcaccattctgcat

SEQ ID NO: 5567751 - DNA, 19 bp, Homo sapiens
agtcaccattctgcattta

SEQ ID NO: 5567752 - DNA, 14 bp, Homo sapiens
agtcacccaaacac

SEQ ID NO: 5567753 - DNA, 22 bp, Homo sapiens
agtcacccaaacacttctgctt

SEQ ID NO: 5567754 - DNA, 15 bp, Homo sapiens
agtcacccagagcac

SEQ ID NO: 5567755 - DNA, 14 bp, Homo sapiens
agtcacccccactt

SEQ ID NO: 5567756 - DNA, 21 bp, Homo sapiens
agtcacccctccctccctctt

SEQ ID NO: 5567757 - DNA, 23 bp, Homo sapiens
agtcacccctctgtccagccagc

SEQ ID NO: 5567758 - DNA, 17 bp, Homo sapiens
agtcacccctgcctaaa

SEQ ID NO: 5567759 - DNA, 20 bp, Homo sapiens
agtcacccctttctgtccca

SEQ ID NO: 5567760 - DNA, 15 bp, Homo sapiens
agtcaccctgtggca

SEQ ID NO: 5567761 - DNA, 16 bp, Homo sapiens
agtcacccttctgggc

SEQ ID NO: 5567762 - DNA, 17 bp, Homo sapiens
agtcacccttctgggca

SEQ ID NO: 5567763 - DNA, 20 bp, Homo sapiens
agtcacctaaccctctgtca

SEQ ID NO: 5567764 - DNA, 12 bp, Homo sapiens
agtcacctcctc

SEQ ID NO: 5567765 - DNA, 22 bp, Homo sapiens
agtcacctcctccactcactcc

SEQ ID NO: 5567766 - DNA, 13 bp, Homo sapiens
agtcacctcctgc

SEQ ID NO: 5567767 - DNA, 13 bp, Homo sapiens
agtcacctctgtc

SEQ ID NO: 5567768 - DNA, 18 bp, Homo sapiens
agtcacctgcaagcccca

SEQ ID NO: 5567769 - DNA, 20 bp, Homo sapiens
agtcacctgccccagcactc

SEQ ID NO: 5567770 - DNA, 11 bp, Homo sapiens
agtcacctgct

SEQ ID NO: 5567771 - DNA, 14 bp, Homo sapiens
agtcacctgctcca

SEQ ID NO: 5567772 - DNA, 15 bp, Homo sapiens
agtcacctgctccag

SEQ ID NO: 5567773 - DNA, 18 bp, Homo sapiens
agtcacctgctccagaag

SEQ ID NO: 5567774 - DNA, 21 bp, Homo sapiens
agtcacctgctccagaagatg

SEQ ID NO: 5567775 - DNA, 17 bp, Homo sapiens
agtcacctgctggttgt

SEQ ID NO: 5567776 - DNA, 20 bp, Homo sapiens
agtcaccttccaggacccct

SEQ ID NO: 5567777 - DNA, 13 bp, Homo sapiens
agtcaccttccct

SEQ ID NO: 5567778 - DNA, 16 bp, Homo sapiens
agtcaccttcccttgc

SEQ ID NO: 5567779 - DNA, 23 bp, Homo sapiens
agtcaccttcccttgccactttg

SEQ ID NO: 5567780 - DNA, 17 bp, Homo sapiens
agtcacctttctgggct

SEQ ID NO: 5567781 - DNA, 18 bp, Homo sapiens
agtcacctttctgggctt

SEQ ID NO: 5567782 - DNA, 20 bp, Homo sapiens
agtcaccttttctgtggctg

SEQ ID NO: 5567783 - DNA, 14 bp, Homo sapiens
agtcacgcctgaaa

SEQ ID NO: 5567784 - DNA, 20 bp, Homo sapiens
agtcacggctgcgcactgtg

SEQ ID NO: 5567785 - DNA, 19 bp, Homo sapiens
agtcacgtgaggcccctgt

SEQ ID NO: 5567786 - DNA, 17 bp, Homo sapiens
agtcactaaatttctca

SEQ ID NO: 5567787 - DNA, 19 bp, Homo sapiens
agtcactaaatttctcagt

SEQ ID NO: 5567788 - DNA, 13 bp, Homo sapiens
agtcactagaagt

SEQ ID NO: 5567789 - DNA, 20 bp, Homo sapiens
agtcactagtgaacaattcg

SEQ ID NO: 5567790 - DNA, 16 bp, Homo sapiens
agtcactattttggct

SEQ ID NO: 5567791 - DNA, 21 bp, Homo sapiens
agtcactattttggctcaaac

SEQ ID NO: 5567792 - DNA, 19 bp, Homo sapiens
agtcactcacactggccac

SEQ ID NO: 5567793 - DNA, 13 bp, Homo sapiens
agtcactccctct

SEQ ID NO: 5567794 - DNA, 18 bp, Homo sapiens
agtcactccctctgcctt

SEQ ID NO: 5567795 - DNA, 19 bp, Homo sapiens
agtcactccctctgccttc

SEQ ID NO: 5567796 - DNA, 13 bp, Homo sapiens
agtcactcctctc

SEQ ID NO: 5567797 - DNA, 14 bp, Homo sapiens
agtcactcctctct

SEQ ID NO: 5567798 - DNA, 15 bp, Homo sapiens
agtcactcctctcta

SEQ ID NO: 5567799 - DNA, 18 bp, Homo sapiens
agtcactctaggactctg

SEQ ID NO: 5567800 - DNA, 21 bp, Homo sapiens
agtcactcttttgggatctaa

SEQ ID NO: 5567801 - DNA, 12 bp, Homo sapiens
agtcactgagca

SEQ ID NO: 5567802 - DNA, 13 bp, Homo sapiens
agtcactgcacag

SEQ ID NO: 5567803 - DNA, 18 bp, Homo sapiens
agtcactgcatttgcctg

SEQ ID NO: 5567804 - DNA, 20 bp, Homo sapiens
agtcactgcatttgcctgct

SEQ ID NO: 5567805 - DNA, 21 bp, Homo sapiens
agtcactgcatttgcctgctt

SEQ ID NO: 5567806 - DNA, 21 bp, Homo sapiens
agtcactgccactttgcacat

SEQ ID NO: 5567807 - DNA, 11 bp, Homo sapiens
agtcactgcct

SEQ ID NO: 5567808 - DNA, 17 bp, Homo sapiens
agtcactgcctctccct

SEQ ID NO: 5567809 - DNA, 20 bp, Homo sapiens
agtcactgcctctccctggc

SEQ ID NO: 5567810 - DNA, 14 bp, Homo sapiens
agtcactgcctgca

SEQ ID NO: 5567811 - DNA, 16 bp, Homo sapiens
agtcactgcctgcaga

SEQ ID NO: 5567812 - DNA, 12 bp, Homo sapiens
agtcactgctct

SEQ ID NO: 5567813 - DNA, 17 bp, Homo sapiens
agtcactgctgcaaggt

SEQ ID NO: 5567814 - DNA, 21 bp, Homo sapiens
agtcactggaggttgaagcca

SEQ ID NO: 5567815 - DNA, 15 bp, Homo sapiens
agtcactggcagcct

SEQ ID NO: 5567816 - DNA, 16 bp, Homo sapiens
agtcactggcagcctg

SEQ ID NO: 5567817 - DNA, 17 bp, Homo sapiens
agtcactggcagcctgc

SEQ ID NO: 5567818 - DNA, 13 bp, Homo sapiens
agtcactgggaga

SEQ ID NO: 5567819 - DNA, 11 bp, Homo sapiens
agtcactgtga

SEQ ID NO: 5567820 - DNA, 16 bp, Homo sapiens
agtcacttaacttaca

SEQ ID NO: 5567821 - DNA, 15 bp, Homo sapiens
agtcacttccagtgt

SEQ ID NO: 5567822 - DNA, 15 bp, Homo sapiens
agtcacttccccaag

SEQ ID NO: 5567823 - DNA, 20 bp, Homo sapiens
agtcacttccccaagatctg

SEQ ID NO: 5567824 - DNA, 20 bp, Homo sapiens
agtcacttgggagctgctgg

SEQ ID NO: 5567825 - DNA, 22 bp, Homo sapiens
agtcacttgggagctgctgggc

SEQ ID NO: 5567826 - DNA, 14 bp, Homo sapiens
agtcactttgacag

SEQ ID NO: 5567827 - DNA, 14 bp, Homo sapiens
agtcactttgctta

SEQ ID NO: 5567828 - DNA, 18 bp, Homo sapiens
agtcactttgcttaagat

SEQ ID NO: 5567829 - DNA, 19 bp, Homo sapiens
agtcactttttttttccaa

SEQ ID NO: 5567830 - DNA, 12 bp, Homo sapiens
agtcagaaaaca

SEQ ID NO: 5567831 - DNA, 17 bp, Homo sapiens
agtcagaacagcagact

SEQ ID NO: 5567832 - DNA, 21 bp, Homo sapiens
agtcagaagatctttcttaat

SEQ ID NO: 5567833 - DNA, 20 bp, Homo sapiens
agtcagaatgtgaaaaagga

SEQ ID NO: 5567834 - DNA, 21 bp, Homo sapiens
agtcagaatgtgaaaaaggaa

SEQ ID NO: 5567835 - DNA, 18 bp, Homo sapiens
agtcagaatttttaactg

SEQ ID NO: 5567836 - DNA, 22 bp, Homo sapiens
agtcagaatttttaactgtact

SEQ ID NO: 5567837 - DNA, 18 bp, Homo sapiens
agtcagacacgattgaga

SEQ ID NO: 5567838 - DNA, 19 bp, Homo sapiens
agtcagacatttctttgga

SEQ ID NO: 5567839 - DNA, 21 bp, Homo sapiens
agtcagacatttggtatatta

SEQ ID NO: 5567840 - DNA, 19 bp, Homo sapiens
agtcagacgccaggcacca

SEQ ID NO: 5567841 - DNA, 23 bp, Homo sapiens
agtcagactggatagtccgtctc

SEQ ID NO: 5567842 - DNA, 15 bp, Homo sapiens
agtcagagaaaacac

SEQ ID NO: 5567843 - DNA, 18 bp, Homo sapiens
agtcagagaaaacacttt

SEQ ID NO: 5567844 - DNA, 21 bp, Homo sapiens
agtcagagaaaacactttcct

SEQ ID NO: 5567845 - DNA, 14 bp, Homo sapiens
agtcagagagaatc

SEQ ID NO: 5567846 - DNA, 17 bp, Homo sapiens
agtcagagagagtgttt

SEQ ID NO: 5567847 - DNA, 22 bp, Homo sapiens
agtcagagccctggctgggttc

SEQ ID NO: 5567848 - DNA, 18 bp, Homo sapiens
agtcagaggatggccagt

SEQ ID NO: 5567849 - DNA, 22 bp, Homo sapiens
agtcagaggatggccagtgtct

SEQ ID NO: 5567850 - DNA, 17 bp, Homo sapiens
agtcagagtataatttt

SEQ ID NO: 5567851 - DNA, 18 bp, Homo sapiens
agtcagagtccagtgctc

SEQ ID NO: 5567852 - DNA, 16 bp, Homo sapiens
agtcagagttaaaata

SEQ ID NO: 5567853 - DNA, 17 bp, Homo sapiens
agtcagagttaaaatat

SEQ ID NO: 5567854 - DNA, 11 bp, Homo sapiens
agtcagatgag

SEQ ID NO: 5567855 - DNA, 21 bp, Homo sapiens
agtcagatgagcaaggacatt

SEQ ID NO: 5567856 - DNA, 14 bp, Homo sapiens
agtcagatgaggca

SEQ ID NO: 5567857 - DNA, 17 bp, Homo sapiens
agtcagatgaggccctg

SEQ ID NO: 5567858 - DNA, 20 bp, Homo sapiens
agtcagatggaaaattcatt

SEQ ID NO: 5567859 - DNA, 22 bp, Homo sapiens
agtcagatggaaaattcatttt

SEQ ID NO: 5567860 - DNA, 21 bp, Homo sapiens
agtcagatttttaaagttttg

SEQ ID NO: 5567861 - DNA, 22 bp, Homo sapiens
agtcagatttttaaagttttgt

SEQ ID NO: 5567862 - DNA, 12 bp, Homo sapiens
agtcagcacaga

SEQ ID NO: 5567863 - DNA, 19 bp, Homo sapiens
agtcagcaccttggcccag

SEQ ID NO: 5567864 - DNA, 23 bp, Homo sapiens
agtcagcaccttggcccaggagc

SEQ ID NO: 5567865 - DNA, 13 bp, Homo sapiens
agtcagcagcagc

SEQ ID NO: 5567866 - DNA, 21 bp, Homo sapiens
agtcagcatgcttcccagagg

SEQ ID NO: 5567867 - DNA, 22 bp, Homo sapiens
agtcagcatgcttcccagaggg

SEQ ID NO: 5567868 - DNA, 23 bp, Homo sapiens
agtcagcatgcttcccagaggga

SEQ ID NO: 5567869 - DNA, 17 bp, Homo sapiens
agtcagcattttcttag

SEQ ID NO: 5567870 - DNA, 12 bp, Homo sapiens
agtcagccagct

SEQ ID NO: 5567871 - DNA, 15 bp, Homo sapiens
agtcagccagcttgg

SEQ ID NO: 5567872 - DNA, 18 bp, Homo sapiens
agtcagccaggagctgtc

SEQ ID NO: 5567873 - DNA, 14 bp, Homo sapiens
agtcagccagtggc

SEQ ID NO: 5567874 - DNA, 20 bp, Homo sapiens
agtcagccatgtctgtgctg

SEQ ID NO: 5567875 - DNA, 16 bp, Homo sapiens
agtcagcccagtggga

SEQ ID NO: 5567876 - DNA, 20 bp, Homo sapiens
agtcagccccgacttcctga

SEQ ID NO: 5567877 - DNA, 21 bp, Homo sapiens
agtcagccccgacttcctgac

SEQ ID NO: 5567878 - DNA, 18 bp, Homo sapiens
agtcagcccgaatgcctg

SEQ ID NO: 5567879 - DNA, 16 bp, Homo sapiens
agtcagcctacataac

SEQ ID NO: 5567880 - DNA, 16 bp, Homo sapiens
agtcagcctcgcaggc

SEQ ID NO: 5567881 - DNA, 23 bp, Homo sapiens
agtcagcctcgcaggcctccctg

SEQ ID NO: 5567882 - DNA, 11 bp, Homo sapiens
agtcagcctct

SEQ ID NO: 5567883 - DNA, 16 bp, Homo sapiens
agtcagcctctctccc

SEQ ID NO: 5567884 - DNA, 17 bp, Homo sapiens
agtcagcctctctccca

SEQ ID NO: 5567885 - DNA, 21 bp, Homo sapiens
agtcagcctctctcccagtct

SEQ ID NO: 5567886 - DNA, 15 bp, Homo sapiens
agtcagcctggctgg

SEQ ID NO: 5567887 - DNA, 15 bp, Homo sapiens
agtcagcgggcccag

SEQ ID NO: 5567888 - DNA, 20 bp, Homo sapiens
agtcagcgtgacaatatact

SEQ ID NO: 5567889 - DNA, 20 bp, Homo sapiens
agtcagctactctagttctg

SEQ ID NO: 5567890 - DNA, 13 bp, Homo sapiens
agtcagctgaccc

SEQ ID NO: 5567891 - DNA, 23 bp, Homo sapiens
agtcagctggccagatttcctca

SEQ ID NO: 5567892 - DNA, 14 bp, Homo sapiens
agtcaggaaagaga

SEQ ID NO: 5567893 - DNA, 15 bp, Homo sapiens
agtcaggaaagagaa

SEQ ID NO: 5567894 - DNA, 16 bp, Homo sapiens
agtcaggaaagagaac

SEQ ID NO: 5567895 - DNA, 14 bp, Homo sapiens
agtcaggaagagat

SEQ ID NO: 5567896 - DNA, 13 bp, Homo sapiens
agtcaggaaggga

SEQ ID NO: 5567897 - DNA, 15 bp, Homo sapiens
agtcaggacctccgg

SEQ ID NO: 5567898 - DNA, 20 bp, Homo sapiens
agtccccagcccttctgcct

SEQ ID NO: 5567899 - DNA, 21 bp, Homo sapiens
agtccccaggccccaggaagc

SEQ ID NO: 5567900 - DNA, 18 bp, Homo sapiens
agtccccattttctggta

SEQ ID NO: 5567901 - DNA, 23 bp, Homo sapiens
agtcccccaactctgagcccatg

SEQ ID NO: 5567902 - DNA, 24 bp, Homo sapiens
agtcccccacccacctcctgcggc

SEQ ID NO: 5567903 - DNA, 18 bp, Homo sapiens
agtcccccagcagaacca

SEQ ID NO: 5567904 - DNA, 12 bp, Homo sapiens
agtccccccacc

SEQ ID NO: 5567905 - DNA, 21 bp, Homo sapiens
agtccccccacccctccccac

SEQ ID NO: 5567906 - DNA, 14 bp, Homo sapiens
agtccccccactcc

SEQ ID NO: 5567907 - DNA, 21 bp, Homo sapiens
agtcccccctcgccccaaagt

SEQ ID NO: 5567908 - DNA, 18 bp, Homo sapiens
agtccccctatccttggc

SEQ ID NO: 5567909 - DNA, 19 bp, Homo sapiens
agtccccctatccttggca

SEQ ID NO: 5567910 - DNA, 15 bp, Homo sapiens
agtccccctgtgcat

SEQ ID NO: 5567911 - DNA, 19 bp, Homo sapiens
agtccccgaggagctgggc

SEQ ID NO: 5567912 - DNA, 15 bp, Homo sapiens
agtccccgctagtgg

SEQ ID NO: 5567913 - DNA, 18 bp, Homo sapiens
agtccccgggcatctttg

SEQ ID NO: 5567914 - DNA, 16 bp, Homo sapiens
agtccccgtctgcctg

SEQ ID NO: 5567915 - DNA, 16 bp, Homo sapiens
agtcccctcacctcct

SEQ ID NO: 5567916 - DNA, 14 bp, Homo sapiens
agtcccctccagga

SEQ ID NO: 5567917 - DNA, 17 bp, Homo sapiens
agtcccctccaggaaga

SEQ ID NO: 5567918 - DNA, 21 bp, Homo sapiens
agtcccctctcctccacattt

SEQ ID NO: 5567919 - DNA, 19 bp, Homo sapiens
agtcccctgtttgtttctg

SEQ ID NO: 5567920 - DNA, 23 bp, Homo sapiens
agtcccggcaaccagatttcagt

SEQ ID NO: 5567921 - DNA, 11 bp, Homo sapiens
agtcccggctt

SEQ ID NO: 5567922 - DNA, 21 bp, Homo sapiens
agtccctataataaaggctga

SEQ ID NO: 5567923 - DNA, 15 bp, Homo sapiens
agtccctatgtattt

SEQ ID NO: 5567924 - DNA, 11 bp, Homo sapiens
agtccctcacc

SEQ ID NO: 5567925 - DNA, 22 bp, Homo sapiens
agtccctcacgtttcttcccca

SEQ ID NO: 5567926 - DNA, 16 bp, Homo sapiens
agtccctccctgcctg

SEQ ID NO: 5567927 - DNA, 16 bp, Homo sapiens
agtccctcctccccca

SEQ ID NO: 5567928 - DNA, 18 bp, Homo sapiens
agtccctcgccgtccctc

SEQ ID NO: 5567929 - DNA, 12 bp, Homo sapiens
agtccctctgag

SEQ ID NO: 5567930 - DNA, 19 bp, Homo sapiens
agtccctgactctctgtga

SEQ ID NO: 5567931 - DNA, 21 bp, Homo sapiens
agtccctgactctctgtgacc

SEQ ID NO: 5567932 - DNA, 15 bp, Homo sapiens
agtccctgagaagcc

SEQ ID NO: 5567933 - DNA, 19 bp, Homo sapiens
agtccctgaggcaggtccc

SEQ ID NO: 5567934 - DNA, 20 bp, Homo sapiens
agtccctgaggcaggtcccc

SEQ ID NO: 5567935 - DNA, 22 bp, Homo sapiens
agtccctgaggcaggtccccag

SEQ ID NO: 5567936 - DNA, 18 bp, Homo sapiens
agtccctgcaggtgaata

SEQ ID NO: 5567937 - DNA, 12 bp, Homo sapiens
agtccctgccaa

SEQ ID NO: 5567938 - DNA, 21 bp, Homo sapiens
agtccctgccacactcagtcc

SEQ ID NO: 5567939 - DNA, 22 bp, Homo sapiens
agtccctgccacgaatttctgt

SEQ ID NO: 5567940 - DNA, 12 bp, Homo sapiens
agtccctgcccc

SEQ ID NO: 5567941 - DNA, 14 bp, Homo sapiens
agtccctgcctgga

SEQ ID NO: 5567942 - DNA, 15 bp, Homo sapiens
agtccctgcctggac

SEQ ID NO: 5567943 - DNA, 15 bp, Homo sapiens
agtccctgcttatga

SEQ ID NO: 5567944 - DNA, 20 bp, Homo sapiens
agtccctgcttatgatgggc

SEQ ID NO: 5567945 - DNA, 22 bp, Homo sapiens
agtccctggagctgtccttcat

SEQ ID NO: 5567946 - DNA, 17 bp, Homo sapiens
agtccctgggagcaagt

SEQ ID NO: 5567947 - DNA, 22 bp, Homo sapiens
agtccctgggggaagccctgga

SEQ ID NO: 5567948 - DNA, 15 bp, Homo sapiens
agtccctggttcatt

SEQ ID NO: 5567949 - DNA, 18 bp, Homo sapiens
agtccctgtaattgttgt

SEQ ID NO: 5567950 - DNA, 23 bp, Homo sapiens
agtccctgtaattgttgtttgta

SEQ ID NO: 5567951 - DNA, 16 bp, Homo sapiens
agtccctgtcacctct

SEQ ID NO: 5567952 - DNA, 17 bp, Homo sapiens
agtccctgtcacctctt

SEQ ID NO: 5567953 - DNA, 18 bp, Homo sapiens
agtccctgtcacctcttc

SEQ ID NO: 5567954 - DNA, 18 bp, Homo sapiens
agtccctgtgatggccag

SEQ ID NO: 5567955 - DNA, 15 bp, Homo sapiens
agtcccttaaaaatt

SEQ ID NO: 5567956 - DNA, 19 bp, Homo sapiens
agtcccttagaagatctgc

SEQ ID NO: 5567957 - DNA, 20 bp, Homo sapiens
agtcccttagtactcttcta

SEQ ID NO: 5567958 - DNA, 12 bp, Homo sapiens
agtcccttcaat

SEQ ID NO: 5567959 - DNA, 17 bp, Homo sapiens
agtcccttcccctccct

SEQ ID NO: 5567960 - DNA, 20 bp, Homo sapiens
agtcccttcccctccctggc

SEQ ID NO: 5567961 - DNA, 14 bp, Homo sapiens
agtcccttcctatt

SEQ ID NO: 5567962 - DNA, 14 bp, Homo sapiens
agtcccttcctgct

SEQ ID NO: 5567963 - DNA, 23 bp, Homo sapiens
agtcccttctcacttatagagct

SEQ ID NO: 5567964 - DNA, 22 bp, Homo sapiens
agtcccttctctctttctaagg

SEQ ID NO: 5567965 - DNA, 14 bp, Homo sapiens
agtcccttgttttg

SEQ ID NO: 5567966 - DNA, 22 bp, Homo sapiens
agtcccttttcattctcctcct

SEQ ID NO: 5567967 - DNA, 21 bp, Homo sapiens
agtccgacctggcctgtctgt

SEQ ID NO: 5567968 - DNA, 21 bp, Homo sapiens
agtccgaggcctggctctgga

SEQ ID NO: 5567969 - DNA, 17 bp, Homo sapiens
agtccgaggggcgggac

SEQ ID NO: 5567970 - DNA, 17 bp, Homo sapiens
agtccgcagaagccctg

SEQ ID NO: 5567971 - DNA, 17 bp, Homo sapiens
agtccgcagtctggcct

SEQ ID NO: 5567972 - DNA, 18 bp, Homo sapiens
agtccgcagttgtagcag

SEQ ID NO: 5567973 - DNA, 22 bp, Homo sapiens
agtccgcagttgtagcagaaac

SEQ ID NO: 5567974 - DNA, 14 bp, Homo sapiens
agtccgcccatccc

SEQ ID NO: 5567975 - DNA, 20 bp, Homo sapiens
agtccgcctggccggctcca

SEQ ID NO: 5567976 - DNA, 22 bp, Homo sapiens
agtccgcctggccggctccagt

SEQ ID NO: 5567977 - DNA, 13 bp, Homo sapiens
agtccgctgaaga

SEQ ID NO: 5567978 - DNA, 20 bp, Homo sapiens
agtccgctgaagatggaggg

SEQ ID NO: 5567979 - DNA, 12 bp, Homo sapiens
agtccggtgcct

SEQ ID NO: 5567980 - DNA, 19 bp, Homo sapiens
agtccggttcttcttgtct

SEQ ID NO: 5567981 - DNA, 15 bp, Homo sapiens
agtccgtcaaaacag

SEQ ID NO: 5567982 - DNA, 20 bp, Homo sapiens
agtccgtgctgacagctgct

SEQ ID NO: 5567983 - DNA, 23 bp, Homo sapiens
agtccgtgctgacagctgctcct

SEQ ID NO: 5567984 - DNA, 18 bp, Homo sapiens
agtccgtgtggatccaat

SEQ ID NO: 5567985 - DNA, 19 bp, Homo sapiens
agtccgtgtggatccaatg

SEQ ID NO: 5567986 - DNA, 24 bp, Homo sapiens
agtcctaaaagttctcaatgtaga

SEQ ID NO: 5567987 - DNA, 13 bp, Homo sapiens
agtcctaacaaat

SEQ ID NO: 5567988 - DNA, 17 bp, Homo sapiens
agtcctaactttctgaa

SEQ ID NO: 5567989 - DNA, 21 bp, Homo sapiens
agtcctaattcaatcctactt

SEQ ID NO: 5567990 - DNA, 17 bp, Homo sapiens
agtcctacaatgtgaaa

SEQ ID NO: 5567991 - DNA, 12 bp, Homo sapiens
agtcctagagct

SEQ ID NO: 5567992 - DNA, 15 bp, Homo sapiens
agtcctagagctcct

SEQ ID NO: 5567993 - DNA, 16 bp, Homo sapiens
agtcctaggacttaaa

SEQ ID NO: 5567994 - DNA, 13 bp, Homo sapiens
agtcctagtgaac

SEQ ID NO: 5567995 - DNA, 18 bp, Homo sapiens
agtcctatcgactttata

SEQ ID NO: 5567996 - DNA, 23 bp, Homo sapiens
agtcctatctgggcttcctggag

SEQ ID NO: 5567997 - DNA, 24 bp, Homo sapiens
agtcctatctgggcttcctggagc

SEQ ID NO: 5567998 - DNA, 15 bp, Homo sapiens
agtcctatggaaaaa

SEQ ID NO: 5567999 - DNA, 19 bp, Homo sapiens
agtcctatggaaaaaacca

SEQ ID NO: 5568000 - DNA, 13 bp, Homo sapiens
agtcctcaaagca

SEQ ID NO: 5568001 - DNA, 19 bp, Homo sapiens
agtcctcaaagctttttga

SEQ ID NO: 5568002 - DNA, 20 bp, Homo sapiens
agtcctcaaagctttttgaa

SEQ ID NO: 5568003 - DNA, 23 bp, Homo sapiens
agtcctcaaagctttttgaaaac

SEQ ID NO: 5568004 - DNA, 20 bp, Homo sapiens
agtcctcaaggggccatcct

SEQ ID NO: 5568005 - DNA, 13 bp, Homo sapiens
agtcctcacagcc

SEQ ID NO: 5568006 - DNA, 19 bp, Homo sapiens
agtcctcaccttctgtttt

SEQ ID NO: 5568007 - DNA, 10 bp, Homo sapiens
agtcctcaga

SEQ ID NO: 5568008 - DNA, 19 bp, Homo sapiens
agtcctcaggaagggggcc

SEQ ID NO: 5568009 - DNA, 16 bp, Homo sapiens
agtcctcattgaatcc

SEQ ID NO: 5568010 - DNA, 17 bp, Homo sapiens
agtcctcattgttcaga

SEQ ID NO: 5568011 - DNA, 12 bp, Homo sapiens
agtcctccagaa

SEQ ID NO: 5568012 - DNA, 14 bp, Homo sapiens
agtcctccagaact

SEQ ID NO: 5568013 - DNA, 21 bp, Homo sapiens
agtcctccagaactcttcctc

SEQ ID NO: 5568014 - DNA, 16 bp, Homo sapiens
agtcctcccaagctgt

SEQ ID NO: 5568015 - DNA, 20 bp, Homo sapiens
agtcctcccaccttggcctc

SEQ ID NO: 5568016 - DNA, 12 bp, Homo sapiens
agtcctcccctc

SEQ ID NO: 5568017 - DNA, 15 bp, Homo sapiens
agtcctcccctcaca

SEQ ID NO: 5568018 - DNA, 21 bp, Homo sapiens
agtcctcccctcacagcctct

SEQ ID NO: 5568019 - DNA, 14 bp, Homo sapiens
agtcctccctagct

SEQ ID NO: 5568020 - DNA, 16 bp, Homo sapiens
agtcctccctcctgca

SEQ ID NO: 5568021 - DNA, 20 bp, Homo sapiens
agtcctccctcctgcaggct

SEQ ID NO: 5568022 - DNA, 22 bp, Homo sapiens
agtcctccctgacttttctgtg

SEQ ID NO: 5568023 - DNA, 17 bp, Homo sapiens
agtcctccctgctcagc

SEQ ID NO: 5568024 - DNA, 19 bp, Homo sapiens
agtcctccctgctcagctg

SEQ ID NO: 5568025 - DNA, 20 bp, Homo sapiens
agtcctcctagaactccagt

SEQ ID NO: 5568026 - DNA, 19 bp, Homo sapiens
agtcctcctcaggagaagg

SEQ ID NO: 5568027 - DNA, 15 bp, Homo sapiens
agtcctccttcccag

SEQ ID NO: 5568028 - DNA, 19 bp, Homo sapiens
agtcctccttcccagctct

SEQ ID NO: 5568029 - DNA, 16 bp, Homo sapiens
agtcctcgccccccgc

SEQ ID NO: 5568030 - DNA, 17 bp, Homo sapiens
agtcctcgtagccatct

SEQ ID NO: 5568031 - DNA, 21 bp, Homo sapiens
agtcctcgtagccatctctct

SEQ ID NO: 5568032 - DNA, 17 bp, Homo sapiens
agtcctctagcaggcct

SEQ ID NO: 5568033 - DNA, 13 bp, Homo sapiens
agtcctctccacc

SEQ ID NO: 5568034 - DNA, 14 bp, Homo sapiens
agtcctctccacct

SEQ ID NO: 5568035 - DNA, 21 bp, Homo sapiens
agtcctctccacctagtggct

SEQ ID NO: 5568036 - DNA, 12 bp, Homo sapiens
agtcctctccag

SEQ ID NO: 5568037 - DNA, 20 bp, Homo sapiens
agtcctctcccaagtccaca

SEQ ID NO: 5568038 - DNA, 12 bp, Homo sapiens
agtcctctcttc

SEQ ID NO: 5568039 - DNA, 15 bp, Homo sapiens
agtcctctcttctct

SEQ ID NO: 5568040 - DNA, 22 bp, Homo sapiens
agtcctctggatggcaccagag

SEQ ID NO: 5568041 - DNA, 14 bp, Homo sapiens
agtcctctgtggcc

SEQ ID NO: 5568042 - DNA, 19 bp, Homo sapiens
agtcctgaacctttcaaaa

SEQ ID NO: 5568043 - DNA, 20 bp, Homo sapiens
agtcctgaacctttcaaaat

SEQ ID NO: 5568044 - DNA, 12 bp, Homo sapiens
agtcctgaagag

SEQ ID NO: 5568045 - DNA, 13 bp, Homo sapiens
agtcctgaagagg

SEQ ID NO: 5568046 - DNA, 16 bp, Homo sapiens
agtcctgactgggctg

SEQ ID NO: 5568047 - DNA, 22 bp, Homo sapiens
agtcctgactgggctgggtttg

SEQ ID NO: 5568048 - DNA, 12 bp, Homo sapiens
agtcctgaggca

SEQ ID NO: 5568049 - DNA, 20 bp, Homo sapiens
agtcctgatcagagccgtgg

SEQ ID NO: 5568050 - DNA, 12 bp, Homo sapiens
agtcctgatcct

SEQ ID NO: 5568051 - DNA, 22 bp, Homo sapiens
agtcctgatcctaaccctgggc

SEQ ID NO: 5568052 - DNA, 20 bp, Homo sapiens
agtcctgcacagttttctgg

SEQ ID NO: 5568053 - DNA, 18 bp, Homo sapiens
agtcctgccaagtggttt

SEQ ID NO: 5568054 - DNA, 13 bp, Homo sapiens
agtcctgcccgcc

SEQ ID NO: 5568055 - DNA, 22 bp, Homo sapiens
agtcctgccgacggagccactg

SEQ ID NO: 5568056 - DNA, 17 bp, Homo sapiens
agtcctgcctggccagg

SEQ ID NO: 5568057 - DNA, 21 bp, Homo sapiens
agtcctgcctggccaggcaga

SEQ ID NO: 5568058 - DNA, 21 bp, Homo sapiens
agtcctgccttcttccttgag

SEQ ID NO: 5568059 - DNA, 23 bp, Homo sapiens
agtcctgccttcttccttgaggg

SEQ ID NO: 5568060 - DNA, 12 bp, Homo sapiens
agtcctgccttt

SEQ ID NO: 5568061 - DNA, 22 bp, Homo sapiens
agtcctgcgaaaacccccaaac

SEQ ID NO: 5568062 - DNA, 15 bp, Homo sapiens
agtcctgctacctcc

SEQ ID NO: 5568063 - DNA, 19 bp, Homo sapiens
agtcctgctacctcccttg

SEQ ID NO: 5568064 - DNA, 21 bp, Homo sapiens
agtcctgctacctcccttgcc

SEQ ID NO: 5568065 - DNA, 22 bp, Homo sapiens
agtcctgctacctcccttgcct

SEQ ID NO: 5568066 - DNA, 14 bp, Homo sapiens
agtcctgctccttt

SEQ ID NO: 5568067 - DNA, 15 bp, Homo sapiens
agtcctgctcctttc

SEQ ID NO: 5568068 - DNA, 11 bp, Homo sapiens
agtcctgctgc

SEQ ID NO: 5568069 - DNA, 15 bp, Homo sapiens
agtcctgctgcctgg

SEQ ID NO: 5568070 - DNA, 16 bp, Homo sapiens
agtcctgctgcctgga

SEQ ID NO: 5568071 - DNA, 17 bp, Homo sapiens
agtcctgctgcctggag

SEQ ID NO: 5568072 - DNA, 18 bp, Homo sapiens
agtcctgctgcctggagt

SEQ ID NO: 5568073 - DNA, 14 bp, Homo sapiens
agtcctgctggcct

SEQ ID NO: 5568074 - DNA, 16 bp, Homo sapiens
agtcctgctggcctgc

SEQ ID NO: 5568075 - DNA, 13 bp, Homo sapiens
agtctctttctgt

SEQ ID NO: 5568076 - DNA, 16 bp, Homo sapiens
agtctctttcttcctt

SEQ ID NO: 5568077 - DNA, 18 bp, Homo sapiens
agtctctttcttcctttc

SEQ ID NO: 5568078 - DNA, 23 bp, Homo sapiens
agtctcttttctttagagcattg

SEQ ID NO: 5568079 - DNA, 19 bp, Homo sapiens
agtctcttttttacaaagg

SEQ ID NO: 5568080 - DNA, 22 bp, Homo sapiens
agtctcttttttacaaaggctg

SEQ ID NO: 5568081 - DNA, 21 bp, Homo sapiens
agtctgaaactggcttcccca

SEQ ID NO: 5568082 - DNA, 15 bp, Homo sapiens
agtctgaaagacaga

SEQ ID NO: 5568083 - DNA, 17 bp, Homo sapiens
agtctgaacccttgtgc

SEQ ID NO: 5568084 - DNA, 18 bp, Homo sapiens
agtctgaacccttgtgct

SEQ ID NO: 5568085 - DNA, 20 bp, Homo sapiens
agtctgaacctatttcttaa

SEQ ID NO: 5568086 - DNA, 13 bp, Homo sapiens
agtctgaagcact

SEQ ID NO: 5568087 - DNA, 20 bp, Homo sapiens
agtctgaaggagaggagtgc

SEQ ID NO: 5568088 - DNA, 22 bp, Homo sapiens
agtctgaagtgcctactggggg

SEQ ID NO: 5568089 - DNA, 18 bp, Homo sapiens
agtctgaagtttcattta

SEQ ID NO: 5568090 - DNA, 15 bp, Homo sapiens
agtctgaatctccca

SEQ ID NO: 5568091 - DNA, 20 bp, Homo sapiens
agtctgaatctcccaaggag

SEQ ID NO: 5568092 - DNA, 14 bp, Homo sapiens
agtctgaatggcat

SEQ ID NO: 5568093 - DNA, 14 bp, Homo sapiens
agtctgaattctgc

SEQ ID NO: 5568094 - DNA, 14 bp, Homo sapiens
agtctgacaggaag

SEQ ID NO: 5568095 - DNA, 20 bp, Homo sapiens
agtctgacaggaagactgga

SEQ ID NO: 5568096 - DNA, 18 bp, Homo sapiens
agtctgagaccagcctgg

SEQ ID NO: 5568097 - DNA, 17 bp, Homo sapiens
agtctgagcccccggct

SEQ ID NO: 5568098 - DNA, 16 bp, Homo sapiens
agtctgagggaaacca

SEQ ID NO: 5568099 - DNA, 17 bp, Homo sapiens
agtctgagggcttgtag

SEQ ID NO: 5568100 - DNA, 21 bp, Homo sapiens
agtctgagggcttgtagttct

SEQ ID NO: 5568101 - DNA, 16 bp, Homo sapiens
agtctgaggtcctgag

SEQ ID NO: 5568102 - DNA, 19 bp, Homo sapiens
agtctgaggtcctgagcac

SEQ ID NO: 5568103 - DNA, 20 bp, Homo sapiens
agtctgaggtcctgagcact

SEQ ID NO: 5568104 - DNA, 17 bp, Homo sapiens
agtctgagtctgagtcc

SEQ ID NO: 5568105 - DNA, 20 bp, Homo sapiens
agtctgagttctctttctta

SEQ ID NO: 5568106 - DNA, 15 bp, Homo sapiens
agtctgataaactga

SEQ ID NO: 5568107 - DNA, 22 bp, Homo sapiens
agtctgatccatatttaataat

SEQ ID NO: 5568108 - DNA, 16 bp, Homo sapiens
agtctgatccctgcca

SEQ ID NO: 5568109 - DNA, 22 bp, Homo sapiens
agtctgatcgtgacgctgaata

SEQ ID NO: 5568110 - DNA, 23 bp, Homo sapiens
agtctgatcgtgacgctgaataa

SEQ ID NO: 5568111 - DNA, 16 bp, Homo sapiens
agtctgatgttctttc

SEQ ID NO: 5568112 - DNA, 22 bp, Homo sapiens
agtctgattataccatgtgtgc

SEQ ID NO: 5568113 - DNA, 21 bp, Homo sapiens
agtctgattcccaagctctgc

SEQ ID NO: 5568114 - DNA, 12 bp, Homo sapiens
agtctgatttaa

SEQ ID NO: 5568115 - DNA, 18 bp, Homo sapiens
agtctgattttaatgaaa

SEQ ID NO: 5568116 - DNA, 23 bp, Homo sapiens
agtctgcacatgcagctgcaccc

SEQ ID NO: 5568117 - DNA, 21 bp, Homo sapiens
agtctgcagatagaaagcatt

SEQ ID NO: 5568118 - DNA, 11 bp, Homo sapiens
agtctgcagct

SEQ ID NO: 5568119 - DNA, 20 bp, Homo sapiens
agtctgcagctattcacaca

SEQ ID NO: 5568120 - DNA, 23 bp, Homo sapiens
agtctgcataaacttcatcttca

SEQ ID NO: 5568121 - DNA, 12 bp, Homo sapiens
agtctgcatata

SEQ ID NO: 5568122 - DNA, 13 bp, Homo sapiens
agtctgcattaca

SEQ ID NO: 5568123 - DNA, 12 bp, Homo sapiens
agtctgccaact

SEQ ID NO: 5568124 - DNA, 11 bp, Homo sapiens
agtctgccact

SEQ ID NO: 5568125 - DNA, 19 bp, Homo sapiens
agtctgcctatcctggcca

SEQ ID NO: 5568126 - DNA, 20 bp, Homo sapiens
agtctgccttcccccaaccc

SEQ ID NO: 5568127 - DNA, 17 bp, Homo sapiens
agtctgctatattttca

SEQ ID NO: 5568128 - DNA, 18 bp, Homo sapiens
agtctgctctcagcttgt

SEQ ID NO: 5568129 - DNA, 20 bp, Homo sapiens
agtctgctctcagcttgtgc

SEQ ID NO: 5568130 - DNA, 14 bp, Homo sapiens
agtctgctctgctg

SEQ ID NO: 5568131 - DNA, 18 bp, Homo sapiens
agtctgctgccctccatc

SEQ ID NO: 5568132 - DNA, 20 bp, Homo sapiens
agtctgcttaccaaaacata

SEQ ID NO: 5568133 - DNA, 21 bp, Homo sapiens
agtctgcttaccaaaacataa

SEQ ID NO: 5568134 - DNA, 20 bp, Homo sapiens
agtctgcttgtcttagatgt

SEQ ID NO: 5568135 - DNA, 20 bp, Homo sapiens
agtctgctttcactgtgact

SEQ ID NO: 5568136 - DNA, 18 bp, Homo sapiens
agtctggaaaacagaaac

SEQ ID NO: 5568137 - DNA, 11 bp, Homo sapiens
agtctggaaag

SEQ ID NO: 5568138 - DNA, 13 bp, Homo sapiens
agtctggaaagtg

SEQ ID NO: 5568139 - DNA, 17 bp, Homo sapiens
agtctggaaagttggga

SEQ ID NO: 5568140 - DNA, 19 bp, Homo sapiens
agtctggaactgctgctga

SEQ ID NO: 5568141 - DNA, 20 bp, Homo sapiens
agtctggaactgctgctgac

SEQ ID NO: 5568142 - DNA, 22 bp, Homo sapiens
agtctggaactgctgctgaccc

SEQ ID NO: 5568143 - DNA, 19 bp, Homo sapiens
agtctggaagaagaggagg

SEQ ID NO: 5568144 - DNA, 22 bp, Homo sapiens
agtctggaagaagaggaggaag

SEQ ID NO: 5568145 - DNA, 17 bp, Homo sapiens
agtctggaatgcagtgg

SEQ ID NO: 5568146 - DNA, 18 bp, Homo sapiens
agtctggaatgcagtggt

SEQ ID NO: 5568147 - DNA, 16 bp, Homo sapiens
agtctggacctccatc

SEQ ID NO: 5568148 - DNA, 18 bp, Homo sapiens
agtctggacctccatccc

SEQ ID NO: 5568149 - DNA, 22 bp, Homo sapiens
agtctggacctccatccctgct

SEQ ID NO: 5568150 - DNA, 14 bp, Homo sapiens
agtctggagaaggt

SEQ ID NO: 5568151 - DNA, 19 bp, Homo sapiens
agtctggagaccaggactc

SEQ ID NO: 5568152 - DNA, 15 bp, Homo sapiens
agtctggagagctgt

SEQ ID NO: 5568153 - DNA, 17 bp, Homo sapiens
agtctggagctgagcta

SEQ ID NO: 5568154 - DNA, 14 bp, Homo sapiens
agtctggaggtccc

SEQ ID NO: 5568155 - DNA, 23 bp, Homo sapiens
agtctggaggtcccagacatgct

SEQ ID NO: 5568156 - DNA, 19 bp, Homo sapiens
agtctggagtgggatagga

SEQ ID NO: 5568157 - DNA, 18 bp, Homo sapiens
agtctggataatttgtat

SEQ ID NO: 5568158 - DNA, 17 bp, Homo sapiens
agtctggcaaacatgtg

SEQ ID NO: 5568159 - DNA, 12 bp, Homo sapiens
agtctggcacca

SEQ ID NO: 5568160 - DNA, 18 bp, Homo sapiens
agtctggcaccatgttgg

SEQ ID NO: 5568161 - DNA, 20 bp, Homo sapiens
agtctggcccactgtgcagt

SEQ ID NO: 5568162 - DNA, 13 bp, Homo sapiens
agtctggccctag

SEQ ID NO: 5568163 - DNA, 22 bp, Homo sapiens
agtctggccctagactcggggt

SEQ ID NO: 5568164 - DNA, 15 bp, Homo sapiens
agtctggcctgggcg

SEQ ID NO: 5568165 - DNA, 22 bp, Homo sapiens
agtctggctaggttaaaggcca

SEQ ID NO: 5568166 - DNA, 21 bp, Homo sapiens
agtctgggacacaaaactccg

SEQ ID NO: 5568167 - DNA, 22 bp, Homo sapiens
agtctgggacacaaaactccgc

SEQ ID NO: 5568168 - DNA, 22 bp, Homo sapiens
agtctgggcaatgaaaccaaag

SEQ ID NO: 5568169 - DNA, 13 bp, Homo sapiens
agtctgggcctct

SEQ ID NO: 5568170 - DNA, 23 bp, Homo sapiens
agtctgggcctctgactctgagt

SEQ ID NO: 5568171 - DNA, 16 bp, Homo sapiens
agtctgggctgccggg

SEQ ID NO: 5568172 - DNA, 17 bp, Homo sapiens
agtctggggaccagctt

SEQ ID NO: 5568173 - DNA, 10 bp, Homo sapiens
agtctgggtc

SEQ ID NO: 5568174 - DNA, 11 bp, Homo sapiens
agtctgggtca

SEQ ID NO: 5568175 - DNA, 17 bp, Homo sapiens
agtctgggtccatcctg

SEQ ID NO: 5568176 - DNA, 14 bp, Homo sapiens
agtctgggtgtctc

SEQ ID NO: 5568177 - DNA, 15 bp, Homo sapiens
agtctggtcagagcc

SEQ ID NO: 5568178 - DNA, 16 bp, Homo sapiens
agtctggtcagagcca

SEQ ID NO: 5568179 - DNA, 17 bp, Homo sapiens
agtctggtcagagccac

SEQ ID NO: 5568180 - DNA, 18 bp, Homo sapiens
agtctggtcagagccaca

SEQ ID NO: 5568181 - DNA, 15 bp, Homo sapiens
agtctggtttctaga

SEQ ID NO: 5568182 - DNA, 20 bp, Homo sapiens
agtctggtttctagacttgt

SEQ ID NO: 5568183 - DNA, 15 bp, Homo sapiens
agtctgtaaaaccag

SEQ ID NO: 5568184 - DNA, 21 bp, Homo sapiens
agtctgtacctcaaatgaatt

SEQ ID NO: 5568185 - DNA, 22 bp, Homo sapiens
agtctgtactaaacagtaagat

SEQ ID NO: 5568186 - DNA, 21 bp, Homo sapiens
agtctgtatcaaacccacgat

SEQ ID NO: 5568187 - DNA, 18 bp, Homo sapiens
agtctgtatccaaataat

SEQ ID NO: 5568188 - DNA, 21 bp, Homo sapiens
agtctgtatttttaaagcatg

SEQ ID NO: 5568189 - DNA, 18 bp, Homo sapiens
agtctgtcacccaggctg

SEQ ID NO: 5568190 - DNA, 23 bp, Homo sapiens
agtctgtcatgaacatgttcctg

SEQ ID NO: 5568191 - DNA, 20 bp, Homo sapiens
agtctgtccacgtggagaga

SEQ ID NO: 5568192 - DNA, 19 bp, Homo sapiens
agtctgtccagataagtta

SEQ ID NO: 5568193 - DNA, 14 bp, Homo sapiens
agtctgtcctggaa

SEQ ID NO: 5568194 - DNA, 13 bp, Homo sapiens
agtctgtcctgtg

SEQ ID NO: 5568195 - DNA, 12 bp, Homo sapiens
agtctgtccttg

SEQ ID NO: 5568196 - DNA, 18 bp, Homo sapiens
agtctgtctactgtggtg

SEQ ID NO: 5568197 - DNA, 19 bp, Homo sapiens
agtctgtctactgtggtga

SEQ ID NO: 5568198 - DNA, 21 bp, Homo sapiens
agtctgtctactgtggtgatc

SEQ ID NO: 5568199 - DNA, 17 bp, Homo sapiens
agtctgtctcaaaagaa

SEQ ID NO: 5568200 - DNA, 18 bp, Homo sapiens
agtctgtctctgtcatgg

SEQ ID NO: 5568201 - DNA, 19 bp, Homo sapiens
agtctgtctcttggctttg

SEQ ID NO: 5568202 - DNA, 15 bp, Homo sapiens
agtctgtctgcactg

SEQ ID NO: 5568203 - DNA, 22 bp, Homo sapiens
agtctgtcttctgtatataaat

SEQ ID NO: 5568204 - DNA, 21 bp, Homo sapiens
agtctgtctttcctgaaccat

SEQ ID NO: 5568205 - DNA, 21 bp, Homo sapiens
agtctgtgagtgcgtctgagg

SEQ ID NO: 5568206 - DNA, 12 bp, Homo sapiens
agtctgtgcctc

SEQ ID NO: 5568207 - DNA, 15 bp, Homo sapiens
agtctgtgcctcagt

SEQ ID NO: 5568208 - DNA, 21 bp, Homo sapiens
agtctgtggagcgtccttgtc

SEQ ID NO: 5568209 - DNA, 18 bp, Homo sapiens
agtctgtggcccaagaga

SEQ ID NO: 5568210 - DNA, 22 bp, Homo sapiens
agtctgtggcttggtgagtctg

SEQ ID NO: 5568211 - DNA, 16 bp, Homo sapiens
agtctgtgggagctca

SEQ ID NO: 5568212 - DNA, 12 bp, Homo sapiens
agtctgtgtgaa

SEQ ID NO: 5568213 - DNA, 15 bp, Homo sapiens
agtctgtgtgaaggt

SEQ ID NO: 5568214 - DNA, 21 bp, Homo sapiens
agtctgtgtgatgaactttct

SEQ ID NO: 5568215 - DNA, 23 bp, Homo sapiens
agtctgtgtgctgtggttcctgg

SEQ ID NO: 5568216 - DNA, 19 bp, Homo sapiens
agtctgtgtggccagcagc

SEQ ID NO: 5568217 - DNA, 22 bp, Homo sapiens
agtctgtgtgggactgtacaca

SEQ ID NO: 5568218 - DNA, 18 bp, Homo sapiens
agtctgtgtgtagccagg

SEQ ID NO: 5568219 - DNA, 21 bp, Homo sapiens
agtctgtgttgtgtcctgaca

SEQ ID NO: 5568220 - DNA, 19 bp, Homo sapiens
agtctgttattgttttgtt

SEQ ID NO: 5568221 - DNA, 21 bp, Homo sapiens
agtctgttattgttttgttaa

SEQ ID NO: 5568222 - DNA, 14 bp, Homo sapiens
agtctgttatttat

SEQ ID NO: 5568223 - DNA, 21 bp, Homo sapiens
agtctgttcactgcattcacc

SEQ ID NO: 5568224 - DNA, 18 bp, Homo sapiens
agtctgttggcaattgag

SEQ ID NO: 5568225 - DNA, 16 bp, Homo sapiens
agtctgttgtgtgtca

SEQ ID NO: 5568226 - DNA, 15 bp, Homo sapiens
agtctgtttgaaatg

SEQ ID NO: 5568227 - DNA, 16 bp, Homo sapiens
agtctgtttgaaatgc

SEQ ID NO: 5568228 - DNA, 14 bp, Homo sapiens
agtctgttttatga

SEQ ID NO: 5568229 - DNA, 18 bp, Homo sapiens
agtctgttttatgacttc

SEQ ID NO: 5568230 - DNA, 21 bp, Homo sapiens
agtctgttttcccaacctcct

SEQ ID NO: 5568231 - DNA, 21 bp, Homo sapiens
agtctgttttgggaaacactt

SEQ ID NO: 5568232 - DNA, 16 bp, Homo sapiens
agtctgttttgtaaag

SEQ ID NO: 5568233 - DNA, 24 bp, Homo sapiens
agtcttaaaataaaaataaattta

SEQ ID NO: 5568234 - DNA, 12 bp, Homo sapiens
agtcttaacaaa

SEQ ID NO: 5568235 - DNA, 21 bp, Homo sapiens
agtcttaacaacagcttcttg

SEQ ID NO: 5568236 - DNA, 24 bp, Homo sapiens
agtcttaacaacagcttcttgctt

SEQ ID NO: 5568237 - DNA, 21 bp, Homo sapiens
agtcttaaggacaaagtgcca

SEQ ID NO: 5568238 - DNA, 19 bp, Homo sapiens
agtcttaagggtcactggc

SEQ ID NO: 5568239 - DNA, 15 bp, Homo sapiens
agtcttaataaaata

SEQ ID NO: 5568240 - DNA, 19 bp, Homo sapiens
agtcttaattgtgtttatt

SEQ ID NO: 5568241 - DNA, 18 bp, Homo sapiens
agtcttacaatcaaatct

SEQ ID NO: 5568242 - DNA, 20 bp, Homo sapiens
agtcttacaatcaaatctcc

SEQ ID NO: 5568243 - DNA, 21 bp, Homo sapiens
agtcttacaatcaaatctcct

SEQ ID NO: 5568244 - DNA, 15 bp, Homo sapiens
agtcttacaggaagc

SEQ ID NO: 5568245 - DNA, 22 bp, Homo sapiens
agtcttacataaaccatttttg

SEQ ID NO: 5568246 - DNA, 16 bp, Homo sapiens
agtcttacgaatactt

SEQ ID NO: 5568247 - DNA, 18 bp, Homo sapiens
agtcttactacagaaatg

SEQ ID NO: 5568248 - DNA, 18 bp, Homo sapiens
agtcttactctgtctccc

SEQ ID NO: 5568249 - DNA, 13 bp, Homo sapiens
agtcttagatcat

SEQ ID NO: 5568250 - DNA, 23 bp, Homo sapiens
agtcttagctgaggctgagaaag

SEQ ID NO: 5568251 - DNA, 22 bp, Homo sapiens
agtgactatgaacttctctcag

SEQ ID NO: 5568252 - DNA, 21 bp, Homo sapiens
agtgactcagaacttctgcct

SEQ ID NO: 5568253 - DNA, 12 bp, Homo sapiens
agtgactccagg

SEQ ID NO: 5568254 - DNA, 13 bp, Homo sapiens
agtgactccagga

SEQ ID NO: 5568255 - DNA, 17 bp, Homo sapiens
agtgactccaggagagg

SEQ ID NO: 5568256 - DNA, 22 bp, Homo sapiens
agtgactccccagcccagcacc

SEQ ID NO: 5568257 - DNA, 23 bp, Homo sapiens
agtgactccccagcccagcaccc

SEQ ID NO: 5568258 - DNA, 16 bp, Homo sapiens
agtgactccctgggag

SEQ ID NO: 5568259 - DNA, 19 bp, Homo sapiens
agtgactcgggctcctgtg

SEQ ID NO: 5568260 - DNA, 23 bp, Homo sapiens
agtgactcggtgtaaaaccatgt

SEQ ID NO: 5568261 - DNA, 14 bp, Homo sapiens
agtgactctccagg

SEQ ID NO: 5568262 - DNA, 15 bp, Homo sapiens
agtgactctccaggg

SEQ ID NO: 5568263 - DNA, 15 bp, Homo sapiens
agtgactctcctgcc

SEQ ID NO: 5568264 - DNA, 17 bp, Homo sapiens
agtgactctggctgcca

SEQ ID NO: 5568265 - DNA, 18 bp, Homo sapiens
agtgactgaaaccatttt

SEQ ID NO: 5568266 - DNA, 16 bp, Homo sapiens
agtgactgaattctgc

SEQ ID NO: 5568267 - DNA, 20 bp, Homo sapiens
agtgactgctgcgctgtgct

SEQ ID NO: 5568268 - DNA, 22 bp, Homo sapiens
agtgactgctgcgctgtgctgg

SEQ ID NO: 5568269 - DNA, 22 bp, Homo sapiens
agtgactggcaggtgcagatgg

SEQ ID NO: 5568270 - DNA, 14 bp, Homo sapiens
agtgactgggccct

SEQ ID NO: 5568271 - DNA, 16 bp, Homo sapiens
agtgactgggccctgt

SEQ ID NO: 5568272 - DNA, 17 bp, Homo sapiens
agtgactgggccctgtc

SEQ ID NO: 5568273 - DNA, 19 bp, Homo sapiens
agtgactgtagttacttaa

SEQ ID NO: 5568274 - DNA, 15 bp, Homo sapiens
agtgactgtatctgt

SEQ ID NO: 5568275 - DNA, 20 bp, Homo sapiens
agtgactgtcgtgtttacaa

SEQ ID NO: 5568276 - DNA, 20 bp, Homo sapiens
agtgactgttcaagagcaca

SEQ ID NO: 5568277 - DNA, 23 bp, Homo sapiens
agtgactgttgtagcattttcct

SEQ ID NO: 5568278 - DNA, 16 bp, Homo sapiens
agtgacttaatatcta

SEQ ID NO: 5568279 - DNA, 13 bp, Homo sapiens
agtgacttcctgg

SEQ ID NO: 5568280 - DNA, 16 bp, Homo sapiens
agtgacttcctggtga

SEQ ID NO: 5568281 - DNA, 23 bp, Homo sapiens
agtgacttctgaatccttagaat

SEQ ID NO: 5568282 - DNA, 14 bp, Homo sapiens
agtgacttctgaga

SEQ ID NO: 5568283 - DNA, 15 bp, Homo sapiens
agtgacttctgagat

SEQ ID NO: 5568284 - DNA, 13 bp, Homo sapiens
agtgacttctttt

SEQ ID NO: 5568285 - DNA, 14 bp, Homo sapiens
agtgacttgaatgt

SEQ ID NO: 5568286 - DNA, 17 bp, Homo sapiens
agtgacttggccccaga

SEQ ID NO: 5568287 - DNA, 19 bp, Homo sapiens
agtgacttgttctgagtaa

SEQ ID NO: 5568288 - DNA, 20 bp, Homo sapiens
agtgacttgttctgagtaag

SEQ ID NO: 5568289 - DNA, 19 bp, Homo sapiens
agtgactttaaaagaaaat

SEQ ID NO: 5568290 - DNA, 18 bp, Homo sapiens
agtgactttggctgcatg

SEQ ID NO: 5568291 - DNA, 20 bp, Homo sapiens
agtgactttgtatagagaat

SEQ ID NO: 5568292 - DNA, 17 bp, Homo sapiens
agtgacttttcagacat

SEQ ID NO: 5568293 - DNA, 14 bp, Homo sapiens
agtgagaaaaagct

SEQ ID NO: 5568294 - DNA, 18 bp, Homo sapiens
agtgagaaaaagctcctg

SEQ ID NO: 5568295 - DNA, 17 bp, Homo sapiens
agtgagaaaactgtgac

SEQ ID NO: 5568296 - DNA, 14 bp, Homo sapiens
agtgagaaattttt

SEQ ID NO: 5568297 - DNA, 14 bp, Homo sapiens
agtgagaagaatat

SEQ ID NO: 5568298 - DNA, 16 bp, Homo sapiens
agtgagaagataaaaa

SEQ ID NO: 5568299 - DNA, 16 bp, Homo sapiens
agtgagaagctttgcc

SEQ ID NO: 5568300 - DNA, 14 bp, Homo sapiens
agtgagaagggcat

SEQ ID NO: 5568301 - DNA, 23 bp, Homo sapiens
agtgagaagggcctgctctgctt

SEQ ID NO: 5568302 - DNA, 16 bp, Homo sapiens
agtgagaagggctcag

SEQ ID NO: 5568303 - DNA, 20 bp, Homo sapiens
agtgagaataattgtgtaca

SEQ ID NO: 5568304 - DNA, 17 bp, Homo sapiens
agtgagaataggcagcc

SEQ ID NO: 5568305 - DNA, 16 bp, Homo sapiens
agtgagacaaaatttt

SEQ ID NO: 5568306 - DNA, 14 bp, Homo sapiens
agtgagacacagag

SEQ ID NO: 5568307 - DNA, 16 bp, Homo sapiens
agtgagacagaccgcc

SEQ ID NO: 5568308 - DNA, 13 bp, Homo sapiens
agtgagacagact

SEQ ID NO: 5568309 - DNA, 18 bp, Homo sapiens
agtgagacatcagggagt

SEQ ID NO: 5568310 - DNA, 15 bp, Homo sapiens
agtgagaccctgtct

SEQ ID NO: 5568311 - DNA, 13 bp, Homo sapiens
agtgagaccttgt

SEQ ID NO: 5568312 - DNA, 18 bp, Homo sapiens
agtgagactccacctcaa

SEQ ID NO: 5568313 - DNA, 15 bp, Homo sapiens
agtgagactccatct

SEQ ID NO: 5568314 - DNA, 22 bp, Homo sapiens
agtgagactcctgattgctctg

SEQ ID NO: 5568315 - DNA, 16 bp, Homo sapiens
agtgagactctgtctc

SEQ ID NO: 5568316 - DNA, 17 bp, Homo sapiens
agtgagactctgtctca

SEQ ID NO: 5568317 - DNA, 15 bp, Homo sapiens
agtgagactgcccca

SEQ ID NO: 5568318 - DNA, 22 bp, Homo sapiens
agtgagactggggccactacat

SEQ ID NO: 5568319 - DNA, 13 bp, Homo sapiens
agtgagagacatt

SEQ ID NO: 5568320 - DNA, 21 bp, Homo sapiens
agtgagagacattaactcatt

SEQ ID NO: 5568321 - DNA, 11 bp, Homo sapiens
agtgagagaga

SEQ ID NO: 5568322 - DNA, 18 bp, Homo sapiens
agtgagagaggaggcctg

SEQ ID NO: 5568323 - DNA, 21 bp, Homo sapiens
agtgagagagtggctggggca

SEQ ID NO: 5568324 - DNA, 20 bp, Homo sapiens
agtgagagcagggctgggcg

SEQ ID NO: 5568325 - DNA, 16 bp, Homo sapiens
agtgagagccagcagc

SEQ ID NO: 5568326 - DNA, 12 bp, Homo sapiens
agtgagaggctg

SEQ ID NO: 5568327 - DNA, 14 bp, Homo sapiens
agtgagaggggagg

SEQ ID NO: 5568328 - DNA, 15 bp, Homo sapiens
agtgagaggggaggg

SEQ ID NO: 5568329 - DNA, 16 bp, Homo sapiens
agtgagaggggaggga

SEQ ID NO: 5568330 - DNA, 18 bp, Homo sapiens
agtgagaggggagggagg

SEQ ID NO: 5568331 - DNA, 14 bp, Homo sapiens
agtgagatagaata

SEQ ID NO: 5568332 - DNA, 19 bp, Homo sapiens
agtgagatagcattgtgaa

SEQ ID NO: 5568333 - DNA, 14 bp, Homo sapiens
agtgagatgaggga

SEQ ID NO: 5568334 - DNA, 23 bp, Homo sapiens
agtgagatgagggatgggcctgg

SEQ ID NO: 5568335 - DNA, 17 bp, Homo sapiens
agtgagatttgtattta

SEQ ID NO: 5568336 - DNA, 14 bp, Homo sapiens
agtgagcaaccagc

SEQ ID NO: 5568337 - DNA, 14 bp, Homo sapiens
agtgagcactaagg

SEQ ID NO: 5568338 - DNA, 16 bp, Homo sapiens
agtgagcactcccaag

SEQ ID NO: 5568339 - DNA, 19 bp, Homo sapiens
agtgagcagcctggagccc

SEQ ID NO: 5568340 - DNA, 12 bp, Homo sapiens
agtgagcagcta

SEQ ID NO: 5568341 - DNA, 14 bp, Homo sapiens
agtgagcagctact

SEQ ID NO: 5568342 - DNA, 21 bp, Homo sapiens
agtgagcagctactgtaactt

SEQ ID NO: 5568343 - DNA, 21 bp, Homo sapiens
agtgagcagtcaggaaagaga

SEQ ID NO: 5568344 - DNA, 19 bp, Homo sapiens
agtgagcagtcgcctgcct

SEQ ID NO: 5568345 - DNA, 17 bp, Homo sapiens
agtgagcagtgttagct

SEQ ID NO: 5568346 - DNA, 14 bp, Homo sapiens
agtgagcagtgttg

SEQ ID NO: 5568347 - DNA, 15 bp, Homo sapiens
agtgagcagtgttgc

SEQ ID NO: 5568348 - DNA, 12 bp, Homo sapiens
agtgagcatgct

SEQ ID NO: 5568349 - DNA, 21 bp, Homo sapiens
agtgagcatggaacacttcga

SEQ ID NO: 5568350 - DNA, 20 bp, Homo sapiens
agtgagccacagaccacctg

SEQ ID NO: 5568351 - DNA, 21 bp, Homo sapiens
agtgagccacagaccacctgc

SEQ ID NO: 5568352 - DNA, 15 bp, Homo sapiens
agtgagccactccgg

SEQ ID NO: 5568353 - DNA, 13 bp, Homo sapiens
agtgagcccctcc

SEQ ID NO: 5568354 - DNA, 21 bp, Homo sapiens
agtgagcccctccccagccag

SEQ ID NO: 5568355 - DNA, 19 bp, Homo sapiens
agtgagccctcttgcccag

SEQ ID NO: 5568356 - DNA, 11 bp, Homo sapiens
agtgagccctg

SEQ ID NO: 5568357 - DNA, 12 bp, Homo sapiens
agtgagccctgc

SEQ ID NO: 5568358 - DNA, 14 bp, Homo sapiens
agtgagccctgctc

SEQ ID NO: 5568359 - DNA, 16 bp, Homo sapiens
agtgagccctgctctt

SEQ ID NO: 5568360 - DNA, 22 bp, Homo sapiens
agtgagccgcatcttctccatc

SEQ ID NO: 5568361 - DNA, 12 bp, Homo sapiens
agtgagcctctg

SEQ ID NO: 5568362 - DNA, 22 bp, Homo sapiens
agtgagcctctgcgcctctcca

SEQ ID NO: 5568363 - DNA, 14 bp, Homo sapiens
agtgagcctgggcc

SEQ ID NO: 5568364 - DNA, 15 bp, Homo sapiens
agtgagcctgggcca

SEQ ID NO: 5568365 - DNA, 16 bp, Homo sapiens
agtgagcctgggccag

SEQ ID NO: 5568366 - DNA, 19 bp, Homo sapiens
agtgagcgagtggatgctg

SEQ ID NO: 5568367 - DNA, 23 bp, Homo sapiens
agtgagcggtgctgtcctcaggt

SEQ ID NO: 5568368 - DNA, 18 bp, Homo sapiens
agtgagctaccaggaaga

SEQ ID NO: 5568369 - DNA, 20 bp, Homo sapiens
agtgagctcaggagagagct

SEQ ID NO: 5568370 - DNA, 12 bp, Homo sapiens
agtgagctgaga

SEQ ID NO: 5568371 - DNA, 15 bp, Homo sapiens
agtgagctgagatca

SEQ ID NO: 5568372 - DNA, 23 bp, Homo sapiens
agtgagctggtttttagcggaga

SEQ ID NO: 5568373 - DNA, 14 bp, Homo sapiens
agtgagctttgctg

SEQ ID NO: 5568374 - DNA, 22 bp, Homo sapiens
agtgagcttttatattctaaat

SEQ ID NO: 5568375 - DNA, 14 bp, Homo sapiens
agtgaggaaatcaa

SEQ ID NO: 5568376 - DNA, 14 bp, Homo sapiens
agtgaggaaggcag

SEQ ID NO: 5568377 - DNA, 18 bp, Homo sapiens
agtgaggactcggccact

SEQ ID NO: 5568378 - DNA, 21 bp, Homo sapiens
agtgaggactcggccactgtg

SEQ ID NO: 5568379 - DNA, 12 bp, Homo sapiens
agtgaggaggga

SEQ ID NO: 5568380 - DNA, 15 bp, Homo sapiens
agtgaggagggatgt

SEQ ID NO: 5568381 - DNA, 16 bp, Homo sapiens
agtgaggatgaaaaaa

SEQ ID NO: 5568382 - DNA, 19 bp, Homo sapiens
agtgaggatgctgcagtga

SEQ ID NO: 5568383 - DNA, 14 bp, Homo sapiens
agtgaggatgtctg

SEQ ID NO: 5568384 - DNA, 15 bp, Homo sapiens
agtgaggcaggagaa

SEQ ID NO: 5568385 - DNA, 19 bp, Homo sapiens
agtgaggcatctctctggg

SEQ ID NO: 5568386 - DNA, 17 bp, Homo sapiens
agtgaggccactgaaga

SEQ ID NO: 5568387 - DNA, 18 bp, Homo sapiens
agtgaggccactgaagag

SEQ ID NO: 5568388 - DNA, 18 bp, Homo sapiens
agtgaggcccaaggagct

SEQ ID NO: 5568389 - DNA, 13 bp, Homo sapiens
agtgaggcccagg

SEQ ID NO: 5568390 - DNA, 15 bp, Homo sapiens
agtgaggcccaggga

SEQ ID NO: 5568391 - DNA, 23 bp, Homo sapiens
agtgaggcccccgcacgcaagcc

SEQ ID NO: 5568392 - DNA, 13 bp, Homo sapiens
agtgaggctctgc

SEQ ID NO: 5568393 - DNA, 14 bp, Homo sapiens
agtgaggctctgcc

SEQ ID NO: 5568394 - DNA, 17 bp, Homo sapiens
agtgaggctctgccctt

SEQ ID NO: 5568395 - DNA, 20 bp, Homo sapiens
agtgaggctctgcccttggt

SEQ ID NO: 5568396 - DNA, 12 bp, Homo sapiens
agtgaggctggg

SEQ ID NO: 5568397 - DNA, 17 bp, Homo sapiens
agtgaggcttccaggct

SEQ ID NO: 5568398 - DNA, 18 bp, Homo sapiens
agtgaggcttccaggctc

SEQ ID NO: 5568399 - DNA, 19 bp, Homo sapiens
agtgaggcttccaggctct

SEQ ID NO: 5568400 - DNA, 17 bp, Homo sapiens
agtgagggagacaggaa

SEQ ID NO: 5568401 - DNA, 16 bp, Homo sapiens
agtgagggagatccca

SEQ ID NO: 5568402 - DNA, 13 bp, Homo sapiens
agtgagggaggag

SEQ ID NO: 5568403 - DNA, 20 bp, Homo sapiens
agtgagggaggagggctttg

SEQ ID NO: 5568404 - DNA, 15 bp, Homo sapiens
agtgagggcctcaga

SEQ ID NO: 5568405 - DNA, 17 bp, Homo sapiens
agtgagggcctcagagc

SEQ ID NO: 5568406 - DNA, 20 bp, Homo sapiens
agtgagggcctcagagcctg

SEQ ID NO: 5568407 - DNA, 12 bp, Homo sapiens
agtgagggctgg

SEQ ID NO: 5568408 - DNA, 13 bp, Homo sapiens
agtgagggctggg

SEQ ID NO: 5568409 - DNA, 14 bp, Homo sapiens
agtgagggctgggc

SEQ ID NO: 5568410 - DNA, 14 bp, Homo sapiens
agtgaggggccctc

SEQ ID NO: 5568411 - DNA, 15 bp, Homo sapiens
agtgagggtcagaga

SEQ ID NO: 5568412 - DNA, 16 bp, Homo sapiens
agtgaggtcctggggg

SEQ ID NO: 5568413 - DNA, 15 bp, Homo sapiens
agtgaggtgcccagc

SEQ ID NO: 5568414 - DNA, 20 bp, Homo sapiens
agtgaggttagttctgtgtg

SEQ ID NO: 5568415 - DNA, 19 bp, Homo sapiens
agtgaggttcttgtaccac

SEQ ID NO: 5568416 - DNA, 20 bp, Homo sapiens
agtgagtaattttggatttt

SEQ ID NO: 5568417 - DNA, 16 bp, Homo sapiens
agtgagtacctgcaaa

SEQ ID NO: 5568418 - DNA, 15 bp, Homo sapiens
agtgagtactgttaa

SEQ ID NO: 5568419 - DNA, 22 bp, Homo sapiens
agtgagtactgttaagaataat

SEQ ID NO: 5568420 - DNA, 17 bp, Homo sapiens
agtgagtcacctgctcc

SEQ ID NO: 5568421 - DNA, 15 bp, Homo sapiens
agtgagtcagcacct

SEQ ID NO: 5568422 - DNA, 14 bp, Homo sapiens
agtgagtctctctg

SEQ ID NO: 5568423 - DNA, 15 bp, Homo sapiens
agtgagtctctctgg

SEQ ID NO: 5568424 - DNA, 24 bp, Homo sapiens
agtgagtctctctgggccttagga

SEQ ID NO: 5568425 - DNA, 15 bp, Homo sapiens
agtgagtctgaattg

SEQ ID NO: 5568426 - DNA, 18 bp, Homo sapiens
agtgagtgaaactcccac

SEQ ID NO: 5568427 - DNA, 20 bp, Homo sapiens
agtgagtgaaactcccaccc

SEQ ID NO: 5568428 - DNA, 14 bp, Homo sapiens
agtgagtgagcctg

SEQ ID NO: 5568429 - DNA, 16 bp, Homo sapiens
agtgagtgagcctggc

SEQ ID NO: 5568430 - DNA, 14 bp, Homo sapiens
agtgagtgaggttc

SEQ ID NO: 5568431 - DNA, 22 bp, Homo sapiens
agtgctgccccttgcaagccat

SEQ ID NO: 5568432 - DNA, 23 bp, Homo sapiens
agtgctgccccttgcaagccata

SEQ ID NO: 5568433 - DNA, 13 bp, Homo sapiens
agtgctgccctgc

SEQ ID NO: 5568434 - DNA, 15 bp, Homo sapiens
agtgctgctgaagat

SEQ ID NO: 5568435 - DNA, 16 bp, Homo sapiens
agtgctgctgtaaata

SEQ ID NO: 5568436 - DNA, 12 bp, Homo sapiens
agtgctgcttct

SEQ ID NO: 5568437 - DNA, 13 bp, Homo sapiens
agtgctgcttctc

SEQ ID NO: 5568438 - DNA, 14 bp, Homo sapiens
agtgctgcttcttg

SEQ ID NO: 5568439 - DNA, 15 bp, Homo sapiens
agtgctgctttgcca

SEQ ID NO: 5568440 - DNA, 18 bp, Homo sapiens
agtgctgctttgccaaat

SEQ ID NO: 5568441 - DNA, 14 bp, Homo sapiens
agtgctggaaggga

SEQ ID NO: 5568442 - DNA, 15 bp, Homo sapiens
agtgctggagaaatc

SEQ ID NO: 5568443 - DNA, 22 bp, Homo sapiens
agtgctggagtctcctgaggac

SEQ ID NO: 5568444 - DNA, 19 bp, Homo sapiens
agtgctggattgtccttgg

SEQ ID NO: 5568445 - DNA, 21 bp, Homo sapiens
agtgctggccacacagcagcg

SEQ ID NO: 5568446 - DNA, 16 bp, Homo sapiens
agtgctggcccaccca

SEQ ID NO: 5568447 - DNA, 13 bp, Homo sapiens
agtgctggctcac

SEQ ID NO: 5568448 - DNA, 15 bp, Homo sapiens
agtgctggctcacag

SEQ ID NO: 5568449 - DNA, 21 bp, Homo sapiens
agtgctggctcacagtacagc

SEQ ID NO: 5568450 - DNA, 21 bp, Homo sapiens
agtgctggctccacgccctgg

SEQ ID NO: 5568451 - DNA, 11 bp, Homo sapiens
agtgctggctg

SEQ ID NO: 5568452 - DNA, 15 bp, Homo sapiens
agtgctggctgctgg

SEQ ID NO: 5568453 - DNA, 17 bp, Homo sapiens
agtgctgggaccagagc

SEQ ID NO: 5568454 - DNA, 19 bp, Homo sapiens
agtgctgggattacagaca

SEQ ID NO: 5568455 - DNA, 17 bp, Homo sapiens
agtgctgggattacagg

SEQ ID NO: 5568456 - DNA, 19 bp, Homo sapiens
agtgctgggattacaggca

SEQ ID NO: 5568457 - DNA, 20 bp, Homo sapiens
agtgctgggattacaggcat

SEQ ID NO: 5568458 - DNA, 20 bp, Homo sapiens
agtgctgggattacaggcgt

SEQ ID NO: 5568459 - DNA, 19 bp, Homo sapiens
agtgctgggattacaggct

SEQ ID NO: 5568460 - DNA, 19 bp, Homo sapiens
agtgctgggcactgctcca

SEQ ID NO: 5568461 - DNA, 21 bp, Homo sapiens
agtgctgggcactgctccaag

SEQ ID NO: 5568462 - DNA, 17 bp, Homo sapiens
agtgctgggcccagccg

SEQ ID NO: 5568463 - DNA, 22 bp, Homo sapiens
agtgctggtcagagagacctca

SEQ ID NO: 5568464 - DNA, 20 bp, Homo sapiens
agtgctgtaatattgtaaat

SEQ ID NO: 5568465 - DNA, 21 bp, Homo sapiens
agtgctgtacccttccacctc

SEQ ID NO: 5568466 - DNA, 13 bp, Homo sapiens
agtgctgtataaa

SEQ ID NO: 5568467 - DNA, 15 bp, Homo sapiens
agtgctgtataaaat

SEQ ID NO: 5568468 - DNA, 19 bp, Homo sapiens
agtgctgtcgggaccacat

SEQ ID NO: 5568469 - DNA, 22 bp, Homo sapiens
agtgctgtcgggaccacatctg

SEQ ID NO: 5568470 - DNA, 18 bp, Homo sapiens
agtgctgtcttgatgact

SEQ ID NO: 5568471 - DNA, 23 bp, Homo sapiens
agtgctgtcttgatgactgctga

SEQ ID NO: 5568472 - DNA, 13 bp, Homo sapiens
agtgctgtgaaaa

SEQ ID NO: 5568473 - DNA, 12 bp, Homo sapiens
agtgctgtgctg

SEQ ID NO: 5568474 - DNA, 14 bp, Homo sapiens
agtgctgtggcctg

SEQ ID NO: 5568475 - DNA, 16 bp, Homo sapiens
agtgctgtggcctggg

SEQ ID NO: 5568476 - DNA, 18 bp, Homo sapiens
agtgctgtggcctgggca

SEQ ID NO: 5568477 - DNA, 20 bp, Homo sapiens
agtgctgtggcctgggcaag

SEQ ID NO: 5568478 - DNA, 19 bp, Homo sapiens
agtgctgttgaagatttga

SEQ ID NO: 5568479 - DNA, 16 bp, Homo sapiens
agtgctgtttaagcta

SEQ ID NO: 5568480 - DNA, 21 bp, Homo sapiens
agtgctgtttattaatcttag

SEQ ID NO: 5568481 - DNA, 21 bp, Homo sapiens
agtgctgtttgagatgtgatg

SEQ ID NO: 5568482 - DNA, 20 bp, Homo sapiens
agtgctgtttgggcaggagt

SEQ ID NO: 5568483 - DNA, 20 bp, Homo sapiens
agtgctgttttattactgtt

SEQ ID NO: 5568484 - DNA, 22 bp, Homo sapiens
agtgctgttttgtcctttgaga

SEQ ID NO: 5568485 - DNA, 16 bp, Homo sapiens
agtgcttaaaaatcat

SEQ ID NO: 5568486 - DNA, 20 bp, Homo sapiens
agtgcttaacatttgttgaa

SEQ ID NO: 5568487 - DNA, 22 bp, Homo sapiens
agtgcttaacatttgttgaata

SEQ ID NO: 5568488 - DNA, 20 bp, Homo sapiens
agtgcttagaaagttattgt

SEQ ID NO: 5568489 - DNA, 21 bp, Homo sapiens
agtgcttcacaggttttatgt

SEQ ID NO: 5568490 - DNA, 15 bp, Homo sapiens
agtgcttcagagttt

SEQ ID NO: 5568491 - DNA, 16 bp, Homo sapiens
agtgcttcagcctgag

SEQ ID NO: 5568492 - DNA, 17 bp, Homo sapiens
agtgcttcagcctgagg

SEQ ID NO: 5568493 - DNA, 16 bp, Homo sapiens
agtgcttccaaggatg

SEQ ID NO: 5568494 - DNA, 17 bp, Homo sapiens
agtgcttccaaggcaga

SEQ ID NO: 5568495 - DNA, 13 bp, Homo sapiens
agtgcttcctaca

SEQ ID NO: 5568496 - DNA, 14 bp, Homo sapiens
agtgcttccttttc

SEQ ID NO: 5568497 - DNA, 18 bp, Homo sapiens
agtgcttctccaacactg

SEQ ID NO: 5568498 - DNA, 14 bp, Homo sapiens
agtgcttctctaca

SEQ ID NO: 5568499 - DNA, 14 bp, Homo sapiens
agtgcttcttacta

SEQ ID NO: 5568500 - DNA, 21 bp, Homo sapiens
agtgcttcttactattaagca

SEQ ID NO: 5568501 - DNA, 13 bp, Homo sapiens
agtgcttcttgta

SEQ ID NO: 5568502 - DNA, 20 bp, Homo sapiens
agtgcttgccaccaccagat

SEQ ID NO: 5568503 - DNA, 13 bp, Homo sapiens
agtgcttgctggc

SEQ ID NO: 5568504 - DNA, 14 bp, Homo sapiens
agtgcttgctggcc

SEQ ID NO: 5568505 - DNA, 12 bp, Homo sapiens
agtgcttgcttt

SEQ ID NO: 5568506 - DNA, 13 bp, Homo sapiens
agtgcttggaaca

SEQ ID NO: 5568507 - DNA, 12 bp, Homo sapiens
agtgcttggccc

SEQ ID NO: 5568508 - DNA, 14 bp, Homo sapiens
agtgcttggcccag

SEQ ID NO: 5568509 - DNA, 18 bp, Homo sapiens
agtgcttggcccaggagt

SEQ ID NO: 5568510 - DNA, 17 bp, Homo sapiens
agtgcttggctgcccca

SEQ ID NO: 5568511 - DNA, 21 bp, Homo sapiens
agtgcttgggggtttttgaag

SEQ ID NO: 5568512 - DNA, 17 bp, Homo sapiens
agtgcttggttgaaaag

SEQ ID NO: 5568513 - DNA, 18 bp, Homo sapiens
agtgcttgtatagctttt

SEQ ID NO: 5568514 - DNA, 19 bp, Homo sapiens
agtgcttgtcccctaagag

SEQ ID NO: 5568515 - DNA, 18 bp, Homo sapiens
agtgcttgtggagatcac

SEQ ID NO: 5568516 - DNA, 22 bp, Homo sapiens
agtgcttgtgtaatttatgtga

SEQ ID NO: 5568517 - DNA, 14 bp, Homo sapiens
agtgcttgtttact

SEQ ID NO: 5568518 - DNA, 16 bp, Homo sapiens
agtgctttaagaatga

SEQ ID NO: 5568519 - DNA, 20 bp, Homo sapiens
agtgctttaagaatgaacac

SEQ ID NO: 5568520 - DNA, 21 bp, Homo sapiens
agtgctttacctaagtgttga

SEQ ID NO: 5568521 - DNA, 16 bp, Homo sapiens
agtgctttatccacat

SEQ ID NO: 5568522 - DNA, 17 bp, Homo sapiens
agtgctttatccacatt

SEQ ID NO: 5568523 - DNA, 20 bp, Homo sapiens
agtgctttatccacattgta

SEQ ID NO: 5568524 - DNA, 19 bp, Homo sapiens
agtgctttccttttttaaa

SEQ ID NO: 5568525 - DNA, 13 bp, Homo sapiens
agtgctttcttgt

SEQ ID NO: 5568526 - DNA, 17 bp, Homo sapiens
agtgctttgacttcttg

SEQ ID NO: 5568527 - DNA, 19 bp, Homo sapiens
agtgctttgcatgtattag

SEQ ID NO: 5568528 - DNA, 15 bp, Homo sapiens
agtgctttgcccttg

SEQ ID NO: 5568529 - DNA, 20 bp, Homo sapiens
agtgctttgttgatttagat

SEQ ID NO: 5568530 - DNA, 17 bp, Homo sapiens
agtgcttttaaactgga

SEQ ID NO: 5568531 - DNA, 16 bp, Homo sapiens
agtgcttttctgttta

SEQ ID NO: 5568532 - DNA, 12 bp, Homo sapiens
agtggaaaaaag

SEQ ID NO: 5568533 - DNA, 23 bp, Homo sapiens
agtggaaaaaagagaaaaaccaa

SEQ ID NO: 5568534 - DNA, 16 bp, Homo sapiens
agtggaaaaagaaatt

SEQ ID NO: 5568535 - DNA, 18 bp, Homo sapiens
agtggaaaaatagcctgc

SEQ ID NO: 5568536 - DNA, 14 bp, Homo sapiens
agtggaaaacaaag

SEQ ID NO: 5568537 - DNA, 12 bp, Homo sapiens
agtggaaaacat

SEQ ID NO: 5568538 - DNA, 23 bp, Homo sapiens
agtggaaaataggctttttaatc

SEQ ID NO: 5568539 - DNA, 22 bp, Homo sapiens
agtggaaacatgctgaaatcta

SEQ ID NO: 5568540 - DNA, 16 bp, Homo sapiens
agtggaaacatttata

SEQ ID NO: 5568541 - DNA, 15 bp, Homo sapiens
agtggaaactcagcc

SEQ ID NO: 5568542 - DNA, 18 bp, Homo sapiens
agtggaaagattgtgtct

SEQ ID NO: 5568543 - DNA, 18 bp, Homo sapiens
agtggaaagtcacctaca

SEQ ID NO: 5568544 - DNA, 16 bp, Homo sapiens
agtggaaagtcaggct

SEQ ID NO: 5568545 - DNA, 14 bp, Homo sapiens
agtggaaagtgatt

SEQ ID NO: 5568546 - DNA, 23 bp, Homo sapiens
agtggaaatggggaactccccca

SEQ ID NO: 5568547 - DNA, 14 bp, Homo sapiens
agtggaaattcagg

SEQ ID NO: 5568548 - DNA, 16 bp, Homo sapiens
agtggaacagcgggag

SEQ ID NO: 5568549 - DNA, 21 bp, Homo sapiens
agtggaacagtcacccttctg

SEQ ID NO: 5568550 - DNA, 16 bp, Homo sapiens
agtggaaccagcccag

SEQ ID NO: 5568551 - DNA, 18 bp, Homo sapiens
agtggaactcaatatata

SEQ ID NO: 5568552 - DNA, 16 bp, Homo sapiens
agtggaagaagaggga

SEQ ID NO: 5568553 - DNA, 17 bp, Homo sapiens
agtggaagaagcagatg

SEQ ID NO: 5568554 - DNA, 22 bp, Homo sapiens
agtggaagacagagatggcaga

SEQ ID NO: 5568555 - DNA, 19 bp, Homo sapiens
agtggaagagcagcctgat

SEQ ID NO: 5568556 - DNA, 20 bp, Homo sapiens
agtggaagagcagcctgatg

SEQ ID NO: 5568557 - DNA, 23 bp, Homo sapiens
agtggaagagcagcctgatggcc

SEQ ID NO: 5568558 - DNA, 13 bp, Homo sapiens
agtggaagagctg

SEQ ID NO: 5568559 - DNA, 15 bp, Homo sapiens
agtggaagggaggag

SEQ ID NO: 5568560 - DNA, 17 bp, Homo sapiens
agtggaagttcttcaag

SEQ ID NO: 5568561 - DNA, 19 bp, Homo sapiens
agtggaatagtatcctcca

SEQ ID NO: 5568562 - DNA, 19 bp, Homo sapiens
agtggaatcactgtatttt

SEQ ID NO: 5568563 - DNA, 11 bp, Homo sapiens
agtggaatcat

SEQ ID NO: 5568564 - DNA, 17 bp, Homo sapiens
agtggaatgcagggaag

SEQ ID NO: 5568565 - DNA, 22 bp, Homo sapiens
agtggaatgcttcctagaagtt

SEQ ID NO: 5568566 - DNA, 16 bp, Homo sapiens
agtggaattccaactt

SEQ ID NO: 5568567 - DNA, 23 bp, Homo sapiens
agtggaattccaacttgaaggat

SEQ ID NO: 5568568 - DNA, 24 bp, Homo sapiens
agtggaattccaacttgaaggatt

SEQ ID NO: 5568569 - DNA, 21 bp, Homo sapiens
agtggacagagcgcccctccc

SEQ ID NO: 5568570 - DNA, 12 bp, Homo sapiens
agtggacagcag

SEQ ID NO: 5568571 - DNA, 15 bp, Homo sapiens
agtggacagcagctg

SEQ ID NO: 5568572 - DNA, 17 bp, Homo sapiens
agtggacagcagctgga

SEQ ID NO: 5568573 - DNA, 19 bp, Homo sapiens
agtggacagcagctggact

SEQ ID NO: 5568574 - DNA, 15 bp, Homo sapiens
agtggacagtctgct

SEQ ID NO: 5568575 - DNA, 14 bp, Homo sapiens
agtggacagtgctg

SEQ ID NO: 5568576 - DNA, 19 bp, Homo sapiens
agtggacatcgtaggcagc

SEQ ID NO: 5568577 - DNA, 14 bp, Homo sapiens
agtggacatttgtt

SEQ ID NO: 5568578 - DNA, 21 bp, Homo sapiens
agtggaccacttggaaataaa

SEQ ID NO: 5568579 - DNA, 14 bp, Homo sapiens
agtggaccaggaca

SEQ ID NO: 5568580 - DNA, 16 bp, Homo sapiens
agtggaccaggacagg

SEQ ID NO: 5568581 - DNA, 16 bp, Homo sapiens
agtggaccctgaaatg

SEQ ID NO: 5568582 - DNA, 16 bp, Homo sapiens
agtggacctagcctgg

SEQ ID NO: 5568583 - DNA, 17 bp, Homo sapiens
agtggacctagcctgga

SEQ ID NO: 5568584 - DNA, 18 bp, Homo sapiens
agtggacctagcctggat

SEQ ID NO: 5568585 - DNA, 19 bp, Homo sapiens
agtggacctagcctggatg

SEQ ID NO: 5568586 - DNA, 16 bp, Homo sapiens
agtggacctgtgctgt

SEQ ID NO: 5568587 - DNA, 17 bp, Homo sapiens
agtggaccttaggcctt

SEQ ID NO: 5568588 - DNA, 15 bp, Homo sapiens
agtggacggagagcc

SEQ ID NO: 5568589 - DNA, 16 bp, Homo sapiens
agtggacggagagcct

SEQ ID NO: 5568590 - DNA, 18 bp, Homo sapiens
agtggacgtgggctccag

SEQ ID NO: 5568591 - DNA, 18 bp, Homo sapiens
agtggacgttaggccagg

SEQ ID NO: 5568592 - DNA, 20 bp, Homo sapiens
agtggacgttaggccaggcc

SEQ ID NO: 5568593 - DNA, 22 bp, Homo sapiens
agtggacgttaggccaggcctt

SEQ ID NO: 5568594 - DNA, 15 bp, Homo sapiens
agtggactctctgac

SEQ ID NO: 5568595 - DNA, 20 bp, Homo sapiens
agtggactctggggcgcggc

SEQ ID NO: 5568596 - DNA, 18 bp, Homo sapiens
agtggactctttggtggc

SEQ ID NO: 5568597 - DNA, 18 bp, Homo sapiens
agtggactgaatgtgcct

SEQ ID NO: 5568598 - DNA, 18 bp, Homo sapiens
agtggactggcccctggg

SEQ ID NO: 5568599 - DNA, 22 bp, Homo sapiens
agtggactggcctcaaagcaag

SEQ ID NO: 5568600 - DNA, 13 bp, Homo sapiens
agtggacttgttt

SEQ ID NO: 5568601 - DNA, 22 bp, Homo sapiens
agtggacttgttttaattttag

SEQ ID NO: 5568602 - DNA, 12 bp, Homo sapiens
agtggagaaata

SEQ ID NO: 5568603 - DNA, 18 bp, Homo sapiens
agtggagaaatatttata

SEQ ID NO: 5568604 - DNA, 17 bp, Homo sapiens
agtggagaaatgaaaag

SEQ ID NO: 5568605 - DNA, 19 bp, Homo sapiens
agtggagaactgggcttgc

SEQ ID NO: 5568606 - DNA, 16 bp, Homo sapiens
agtggagaattatata

SEQ ID NO: 5568607 - DNA, 15 bp, Homo sapiens
agtggagagtgttcc

SEQ ID NO: 5568608 - DNA, 22 bp, Homo sapiens
agtggagcaaatgcttaaaaca

SEQ ID NO: 5568609 - DNA, 16 bp, Homo sapiens
agtgtagctgtgaaat

SEQ ID NO: 5568610 - DNA, 15 bp, Homo sapiens
agtgtagcttctgaa

SEQ ID NO: 5568611 - DNA, 13 bp, Homo sapiens
agtgtaggcagac

SEQ ID NO: 5568612 - DNA, 14 bp, Homo sapiens
agtgtaggcagaca

SEQ ID NO: 5568613 - DNA, 15 bp, Homo sapiens
agtgtaggcagacac

SEQ ID NO: 5568614 - DNA, 16 bp, Homo sapiens
agtgtaggcagacaca

SEQ ID NO: 5568615 - DNA, 22 bp, Homo sapiens
agtgtaggcagacacagggact

SEQ ID NO: 5568616 - DNA, 19 bp, Homo sapiens
agtgtaggctttacttagc

SEQ ID NO: 5568617 - DNA, 20 bp, Homo sapiens
agtgtagtggcatgatctcg

SEQ ID NO: 5568618 - DNA, 16 bp, Homo sapiens
agtgtagttaatttat

SEQ ID NO: 5568619 - DNA, 17 bp, Homo sapiens
agtgtagtttacagaaa

SEQ ID NO: 5568620 - DNA, 17 bp, Homo sapiens
agtgtagttttcctttt

SEQ ID NO: 5568621 - DNA, 22 bp, Homo sapiens
agtgtataaatccaatatcatg

SEQ ID NO: 5568622 - DNA, 15 bp, Homo sapiens
agtgtataataagaa

SEQ ID NO: 5568623 - DNA, 22 bp, Homo sapiens
agtgtatacatgtgtgggtgct

SEQ ID NO: 5568624 - DNA, 18 bp, Homo sapiens
agtgtataccacctgtac

SEQ ID NO: 5568625 - DNA, 18 bp, Homo sapiens
agtgtatgagtgtgagtg

SEQ ID NO: 5568626 - DNA, 21 bp, Homo sapiens
agtgtatgagtgtgagtgtgt

SEQ ID NO: 5568627 - DNA, 22 bp, Homo sapiens
agtgtatgagttgcatttgtaa

SEQ ID NO: 5568628 - DNA, 14 bp, Homo sapiens
agtgtatgattact

SEQ ID NO: 5568629 - DNA, 15 bp, Homo sapiens
agtgtatgcatacaa

SEQ ID NO: 5568630 - DNA, 13 bp, Homo sapiens
agtgtatgtatac

SEQ ID NO: 5568631 - DNA, 14 bp, Homo sapiens
agtgtatgtataca

SEQ ID NO: 5568632 - DNA, 13 bp, Homo sapiens
agtgtatgtcttg

SEQ ID NO: 5568633 - DNA, 13 bp, Homo sapiens
agtgtatgtgtgt

SEQ ID NO: 5568634 - DNA, 14 bp, Homo sapiens
agtgtattaaatga

SEQ ID NO: 5568635 - DNA, 17 bp, Homo sapiens
agtgtattaatcataga

SEQ ID NO: 5568636 - DNA, 13 bp, Homo sapiens
agtgtattagatg

SEQ ID NO: 5568637 - DNA, 17 bp, Homo sapiens
agtgtattagatgtggt

SEQ ID NO: 5568638 - DNA, 16 bp, Homo sapiens
agtgtattatcactgt

SEQ ID NO: 5568639 - DNA, 21 bp, Homo sapiens
agtgtattatcactgtctgtt

SEQ ID NO: 5568640 - DNA, 18 bp, Homo sapiens
agtgtattgtaatgtata

SEQ ID NO: 5568641 - DNA, 18 bp, Homo sapiens
agtgtatttaatgtttgt

SEQ ID NO: 5568642 - DNA, 20 bp, Homo sapiens
agtgtatttaatgtttgtaa

SEQ ID NO: 5568643 - DNA, 19 bp, Homo sapiens
agtgtattttaaaatagag

SEQ ID NO: 5568644 - DNA, 17 bp, Homo sapiens
agtgtattttactattt

SEQ ID NO: 5568645 - DNA, 15 bp, Homo sapiens
agtgtattttattca

SEQ ID NO: 5568646 - DNA, 17 bp, Homo sapiens
agtgtcaaccagacaga

SEQ ID NO: 5568647 - DNA, 20 bp, Homo sapiens
agtgtcaaggggccctagga

SEQ ID NO: 5568648 - DNA, 23 bp, Homo sapiens
agtgtcaagtcctgactgggctg

SEQ ID NO: 5568649 - DNA, 15 bp, Homo sapiens
agtgtcaagttgtgc

SEQ ID NO: 5568650 - DNA, 17 bp, Homo sapiens
agtgtcaagttgtgctt

SEQ ID NO: 5568651 - DNA, 18 bp, Homo sapiens
agtgtcaagttgtgcttg

SEQ ID NO: 5568652 - DNA, 16 bp, Homo sapiens
agtgtcacatgaggaa

SEQ ID NO: 5568653 - DNA, 17 bp, Homo sapiens
agtgtcaccctgtgggt

SEQ ID NO: 5568654 - DNA, 16 bp, Homo sapiens
agtgtcacctctctca

SEQ ID NO: 5568655 - DNA, 21 bp, Homo sapiens
agtgtcacctctctcagagca

SEQ ID NO: 5568656 - DNA, 16 bp, Homo sapiens
agtgtcacttgactct

SEQ ID NO: 5568657 - DNA, 16 bp, Homo sapiens
agtgtcacttggtgca

SEQ ID NO: 5568658 - DNA, 19 bp, Homo sapiens
agtgtcagactatccattt

SEQ ID NO: 5568659 - DNA, 16 bp, Homo sapiens
agtgtcaggcccccag

SEQ ID NO: 5568660 - DNA, 22 bp, Homo sapiens
agtgtcaggcccccagtgggac

SEQ ID NO: 5568661 - DNA, 17 bp, Homo sapiens
agtgtcaggctctgaat

SEQ ID NO: 5568662 - DNA, 16 bp, Homo sapiens
agtgtcagtactaagg

SEQ ID NO: 5568663 - DNA, 12 bp, Homo sapiens
agtgtcagtgtt

SEQ ID NO: 5568664 - DNA, 13 bp, Homo sapiens
agtgtcagtgttg

SEQ ID NO: 5568665 - DNA, 23 bp, Homo sapiens
agtgtcagttcaactttcagaag

SEQ ID NO: 5568666 - DNA, 15 bp, Homo sapiens
agtgtcataaagatt

SEQ ID NO: 5568667 - DNA, 22 bp, Homo sapiens
agtgtcatgaatgttgcatgac

SEQ ID NO: 5568668 - DNA, 14 bp, Homo sapiens
agtgtcattattag

SEQ ID NO: 5568669 - DNA, 19 bp, Homo sapiens
agtgtcattcccctttgca

SEQ ID NO: 5568670 - DNA, 21 bp, Homo sapiens
agtgtcattcccctttgcact

SEQ ID NO: 5568671 - DNA, 13 bp, Homo sapiens
agtgtcatttcca

SEQ ID NO: 5568672 - DNA, 13 bp, Homo sapiens
agtgtcatttctt

SEQ ID NO: 5568673 - DNA, 16 bp, Homo sapiens
agtgtcatttctttta

SEQ ID NO: 5568674 - DNA, 17 bp, Homo sapiens
agtgtcattttctgtta

SEQ ID NO: 5568675 - DNA, 21 bp, Homo sapiens
agtgtccagaagcggcctgtg

SEQ ID NO: 5568676 - DNA, 17 bp, Homo sapiens
agtgtccagcttccaaa

SEQ ID NO: 5568677 - DNA, 21 bp, Homo sapiens
agtgtccatagatataaagcc

SEQ ID NO: 5568678 - DNA, 23 bp, Homo sapiens
agtgtccattgacatgtacagag

SEQ ID NO: 5568679 - DNA, 15 bp, Homo sapiens
agtgtcccaggcagc

SEQ ID NO: 5568680 - DNA, 18 bp, Homo sapiens
agtgtccccaaagactac

SEQ ID NO: 5568681 - DNA, 13 bp, Homo sapiens
agtgtccccaggg

SEQ ID NO: 5568682 - DNA, 16 bp, Homo sapiens
agtgtccccaggggca

SEQ ID NO: 5568683 - DNA, 21 bp, Homo sapiens
agtgtccccccttgaagcaat

SEQ ID NO: 5568684 - DNA, 15 bp, Homo sapiens
agtgtcccctccact

SEQ ID NO: 5568685 - DNA, 18 bp, Homo sapiens
agtgtcccctgccccaga

SEQ ID NO: 5568686 - DNA, 18 bp, Homo sapiens
agtgtcctaccactctaa

SEQ ID NO: 5568687 - DNA, 23 bp, Homo sapiens
agtgtcctatgcaataaaattat

SEQ ID NO: 5568688 - DNA, 20 bp, Homo sapiens
agtgtcctccaagtgccccc

SEQ ID NO: 5568689 - DNA, 21 bp, Homo sapiens
agtgtcctcccctcaaggaca

SEQ ID NO: 5568690 - DNA, 18 bp, Homo sapiens
agtgtcctgagccccagg

SEQ ID NO: 5568691 - DNA, 13 bp, Homo sapiens
agtgtcctgagct

SEQ ID NO: 5568692 - DNA, 14 bp, Homo sapiens
agtgtcctgatttg

SEQ ID NO: 5568693 - DNA, 15 bp, Homo sapiens
agtgtcctgcccatg

SEQ ID NO: 5568694 - DNA, 16 bp, Homo sapiens
agtgtcctgcccatgc

SEQ ID NO: 5568695 - DNA, 21 bp, Homo sapiens
agtgtcctgctacctttgtct

SEQ ID NO: 5568696 - DNA, 18 bp, Homo sapiens
agtgtcctggctgtgaat

SEQ ID NO: 5568697 - DNA, 18 bp, Homo sapiens
agtgtcctgtctgctggg

SEQ ID NO: 5568698 - DNA, 20 bp, Homo sapiens
agtgtcctgtctgctgggct

SEQ ID NO: 5568699 - DNA, 20 bp, Homo sapiens
agtgtcctgtgctttctgca

SEQ ID NO: 5568700 - DNA, 14 bp, Homo sapiens
agtgtccttagaac

SEQ ID NO: 5568701 - DNA, 17 bp, Homo sapiens
agtgtccttcttgctcc

SEQ ID NO: 5568702 - DNA, 19 bp, Homo sapiens
agtgtcgccgtccctctgc

SEQ ID NO: 5568703 - DNA, 19 bp, Homo sapiens
agtgtcggatcctgtgagt

SEQ ID NO: 5568704 - DNA, 19 bp, Homo sapiens
agtgtcgtgtctgctgttg

SEQ ID NO: 5568705 - DNA, 16 bp, Homo sapiens
agtgtctacatgtgcc

SEQ ID NO: 5568706 - DNA, 17 bp, Homo sapiens
agtgtctagtttctcaa

SEQ ID NO: 5568707 - DNA, 20 bp, Homo sapiens
agtgtctataaaagaaacac

SEQ ID NO: 5568708 - DNA, 22 bp, Homo sapiens
agtgtctattagttttctttgt

SEQ ID NO: 5568709 - DNA, 23 bp, Homo sapiens
agtgtctcaaaggagctttctca

SEQ ID NO: 5568710 - DNA, 19 bp, Homo sapiens
agtgtctcagtccacctga

SEQ ID NO: 5568711 - DNA, 22 bp, Homo sapiens
agtgtctcagtccacctgagct

SEQ ID NO: 5568712 - DNA, 20 bp, Homo sapiens
agtgtctccagtcaagctct

SEQ ID NO: 5568713 - DNA, 17 bp, Homo sapiens
agtgtctccccgtgtcc

SEQ ID NO: 5568714 - DNA, 15 bp, Homo sapiens
agtgtctctgcctgg

SEQ ID NO: 5568715 - DNA, 16 bp, Homo sapiens
agtgtctctgttttat

SEQ ID NO: 5568716 - DNA, 18 bp, Homo sapiens
agtgtctgacttttgtta

SEQ ID NO: 5568717 - DNA, 12 bp, Homo sapiens
agtgtctgcagt

SEQ ID NO: 5568718 - DNA, 19 bp, Homo sapiens
agtgtctgccagctgggcc

SEQ ID NO: 5568719 - DNA, 22 bp, Homo sapiens
agtgtctgccagctgggcccag

SEQ ID NO: 5568720 - DNA, 16 bp, Homo sapiens
agtgtctggaattgtg

SEQ ID NO: 5568721 - DNA, 16 bp, Homo sapiens
agtgtctggagcggct

SEQ ID NO: 5568722 - DNA, 21 bp, Homo sapiens
agtgtctggagcggctgctcg

SEQ ID NO: 5568723 - DNA, 21 bp, Homo sapiens
agtgtctggatcagtaaaatt

SEQ ID NO: 5568724 - DNA, 23 bp, Homo sapiens
agtgtctggatcagtaaaattat

SEQ ID NO: 5568725 - DNA, 13 bp, Homo sapiens
agtgtctggctgc

SEQ ID NO: 5568726 - DNA, 14 bp, Homo sapiens
agtgtctgggctga

SEQ ID NO: 5568727 - DNA, 19 bp, Homo sapiens
agtgtctgggctgactggg

SEQ ID NO: 5568728 - DNA, 22 bp, Homo sapiens
agtgtctgggtttggcccaaga

SEQ ID NO: 5568729 - DNA, 17 bp, Homo sapiens
agtgtctggtgccctgg

SEQ ID NO: 5568730 - DNA, 15 bp, Homo sapiens
agtgtctgtaaatca

SEQ ID NO: 5568731 - DNA, 14 bp, Homo sapiens
agtgtctgtatttg

SEQ ID NO: 5568732 - DNA, 12 bp, Homo sapiens
agtgtctgtgag

SEQ ID NO: 5568733 - DNA, 19 bp, Homo sapiens
agtgtctgtgccatggatt

SEQ ID NO: 5568734 - DNA, 22 bp, Homo sapiens
agtgtctgtgtgcaagtgtgtg

SEQ ID NO: 5568735 - DNA, 16 bp, Homo sapiens
agtgtctgtgttttga

SEQ ID NO: 5568736 - DNA, 13 bp, Homo sapiens
agtgtctgttcag

SEQ ID NO: 5568737 - DNA, 17 bp, Homo sapiens
agtgtcttaaggagact

SEQ ID NO: 5568738 - DNA, 19 bp, Homo sapiens
agtgtcttatggtcttgat

SEQ ID NO: 5568739 - DNA, 15 bp, Homo sapiens
agtgtcttccataat

SEQ ID NO: 5568740 - DNA, 16 bp, Homo sapiens
agtgtcttcctgtggg

SEQ ID NO: 5568741 - DNA, 15 bp, Homo sapiens
agtgtcttctgttcc

SEQ ID NO: 5568742 - DNA, 23 bp, Homo sapiens
agtgtctttaaatacttcatgag

SEQ ID NO: 5568743 - DNA, 14 bp, Homo sapiens
agtgtctttctagc

SEQ ID NO: 5568744 - DNA, 23 bp, Homo sapiens
agtgtctttctagccataataaa

SEQ ID NO: 5568745 - DNA, 21 bp, Homo sapiens
agtgtctttctggtgttttat

SEQ ID NO: 5568746 - DNA, 22 bp, Homo sapiens
agtgtctttctttggtgccttt

SEQ ID NO: 5568747 - DNA, 23 bp, Homo sapiens
agtgtctttctttggtgcctttc

SEQ ID NO: 5568748 - DNA, 19 bp, Homo sapiens
agtgtctttgtttaaaatt

SEQ ID NO: 5568749 - DNA, 15 bp, Homo sapiens
agtgtcttttaaaca

SEQ ID NO: 5568750 - DNA, 15 bp, Homo sapiens
agtgtctttttttgt

SEQ ID NO: 5568751 - DNA, 17 bp, Homo sapiens
agtgtctttttttgtat

SEQ ID NO: 5568752 - DNA, 17 bp, Homo sapiens
agtgtgaaaggtgctga

SEQ ID NO: 5568753 - DNA, 16 bp, Homo sapiens
agtgtgaaatatatta

SEQ ID NO: 5568754 - DNA, 14 bp, Homo sapiens
agtgtgaactggac

SEQ ID NO: 5568755 - DNA, 23 bp, Homo sapiens
agtgtgaactggaccctgttgct

SEQ ID NO: 5568756 - DNA, 12 bp, Homo sapiens
agtgtgaagatc

SEQ ID NO: 5568757 - DNA, 18 bp, Homo sapiens
agtgtgaataaagtgctg

SEQ ID NO: 5568758 - DNA, 16 bp, Homo sapiens
agtgtgaatactgctt

SEQ ID NO: 5568759 - DNA, 16 bp, Homo sapiens
agtgtgaatagcctgg

SEQ ID NO: 5568760 - DNA, 21 bp, Homo sapiens
agtgtgaatagcctggccacc

SEQ ID NO: 5568761 - DNA, 18 bp, Homo sapiens
agtgtgaatataaatgtg

SEQ ID NO: 5568762 - DNA, 21 bp, Homo sapiens
agtgtgaatataaatgtgtgt

SEQ ID NO: 5568763 - DNA, 17 bp, Homo sapiens
agtgtgaatgctgggcc

SEQ ID NO: 5568764 - DNA, 20 bp, Homo sapiens
agtgtgaattgcaaaaccca

SEQ ID NO: 5568765 - DNA, 11 bp, Homo sapiens
agtgtgacagg

SEQ ID NO: 5568766 - DNA, 22 bp, Homo sapiens
agtgtgacagggccagtggggc

SEQ ID NO: 5568767 - DNA, 18 bp, Homo sapiens
agtgtgacagtttccaaa

SEQ ID NO: 5568768 - DNA, 17 bp, Homo sapiens
agtgtgaccaaaagtta

SEQ ID NO: 5568769 - DNA, 22 bp, Homo sapiens
agtgtgaccaaaagttacatgt

SEQ ID NO: 5568770 - DNA, 18 bp, Homo sapiens
agtgtgaccccactgcca

SEQ ID NO: 5568771 - DNA, 12 bp, Homo sapiens
agtgtgactcct

SEQ ID NO: 5568772 - DNA, 19 bp, Homo sapiens
agtgtgacttcccttctaa

SEQ ID NO: 5568773 - DNA, 12 bp, Homo sapiens
agtgtgagaatc

SEQ ID NO: 5568774 - DNA, 16 bp, Homo sapiens
agtgtgagcagtgagt

SEQ ID NO: 5568775 - DNA, 14 bp, Homo sapiens
agtgtgagcgcctt

SEQ ID NO: 5568776 - DNA, 15 bp, Homo sapiens
agtgtgagctcttcc

SEQ ID NO: 5568777 - DNA, 18 bp, Homo sapiens
agtgtgagctcttccctt

SEQ ID NO: 5568778 - DNA, 15 bp, Homo sapiens
agtgtgagggcagca

SEQ ID NO: 5568779 - DNA, 13 bp, Homo sapiens
agtgtgagggtgc

SEQ ID NO: 5568780 - DNA, 22 bp, Homo sapiens
agtgtgagggtgcagggaccaa

SEQ ID NO: 5568781 - DNA, 18 bp, Homo sapiens
agtgtgagtaatctgaga

SEQ ID NO: 5568782 - DNA, 19 bp, Homo sapiens
agtgtgagtggcagccatg

SEQ ID NO: 5568783 - DNA, 19 bp, Homo sapiens
agtgtgagtgtgtgtgcat

SEQ ID NO: 5568784 - DNA, 17 bp, Homo sapiens
agtgtgagtgttagaaa

SEQ ID NO: 5568785 - DNA, 20 bp, Homo sapiens
agtgtgattgggaataaata

SEQ ID NO: 5568786 - DNA, 18 bp, Homo sapiens
agttaaggagaatcatgt

SEQ ID NO: 5568787 - DNA, 22 bp, Homo sapiens
agttaaggcaaatcaggtaaaa

SEQ ID NO: 5568788 - DNA, 14 bp, Homo sapiens
agttaagtatttac

SEQ ID NO: 5568789 - DNA, 12 bp, Homo sapiens
agttaagtcaat

SEQ ID NO: 5568790 - DNA, 16 bp, Homo sapiens
agttaataagcaaaat

SEQ ID NO: 5568791 - DNA, 13 bp, Homo sapiens
agttaataatgta

SEQ ID NO: 5568792 - DNA, 20 bp, Homo sapiens
agttaatacttaacattgat

SEQ ID NO: 5568793 - DNA, 15 bp, Homo sapiens
agttaatataaatgt

SEQ ID NO: 5568794 - DNA, 21 bp, Homo sapiens
agttaatattggaagtgaaat

SEQ ID NO: 5568795 - DNA, 21 bp, Homo sapiens
agttaatattttgttcttatt

SEQ ID NO: 5568796 - DNA, 14 bp, Homo sapiens
agttaatcaactga

SEQ ID NO: 5568797 - DNA, 18 bp, Homo sapiens
agttaatcagaaagaaaa

SEQ ID NO: 5568798 - DNA, 15 bp, Homo sapiens
agttaatcatcaaga

SEQ ID NO: 5568799 - DNA, 13 bp, Homo sapiens
agttaatctataa

SEQ ID NO: 5568800 - DNA, 14 bp, Homo sapiens
agttaatcttgctt

SEQ ID NO: 5568801 - DNA, 17 bp, Homo sapiens
agttaatctttgaaaac

SEQ ID NO: 5568802 - DNA, 14 bp, Homo sapiens
agttaatgaaataa

SEQ ID NO: 5568803 - DNA, 15 bp, Homo sapiens
agttaatgaaataaa

SEQ ID NO: 5568804 - DNA, 22 bp, Homo sapiens
agttaatgaaggtgtgctacag

SEQ ID NO: 5568805 - DNA, 20 bp, Homo sapiens
agttaatgcttaagagggaa

SEQ ID NO: 5568806 - DNA, 18 bp, Homo sapiens
agttaatgtatataaaaa

SEQ ID NO: 5568807 - DNA, 13 bp, Homo sapiens
agttaatgtgcca

SEQ ID NO: 5568808 - DNA, 14 bp, Homo sapiens
agttaatgtgccaa

SEQ ID NO: 5568809 - DNA, 17 bp, Homo sapiens
agttaattctcaccatt

SEQ ID NO: 5568810 - DNA, 18 bp, Homo sapiens
agttaatttatctaaatt

SEQ ID NO: 5568811 - DNA, 18 bp, Homo sapiens
agttaatttgataaagat

SEQ ID NO: 5568812 - DNA, 20 bp, Homo sapiens
agttaatttgataaagatct

SEQ ID NO: 5568813 - DNA, 13 bp, Homo sapiens
agttaatttttgt

SEQ ID NO: 5568814 - DNA, 21 bp, Homo sapiens
agttaattttttttgtattct

SEQ ID NO: 5568815 - DNA, 16 bp, Homo sapiens
agttacaaaaatagta

SEQ ID NO: 5568816 - DNA, 15 bp, Homo sapiens
agttacaaagttata

SEQ ID NO: 5568817 - DNA, 21 bp, Homo sapiens
agttacaaattataatgtatt

SEQ ID NO: 5568818 - DNA, 23 bp, Homo sapiens
agttacaaattataatgtattca

SEQ ID NO: 5568819 - DNA, 21 bp, Homo sapiens
agttacaacttcctaatttta

SEQ ID NO: 5568820 - DNA, 14 bp, Homo sapiens
agttacaataaagt

SEQ ID NO: 5568821 - DNA, 20 bp, Homo sapiens
agttacaattacatctctaa

SEQ ID NO: 5568822 - DNA, 16 bp, Homo sapiens
agttacacaattaatt

SEQ ID NO: 5568823 - DNA, 20 bp, Homo sapiens
agttacacagaaatgctgct

SEQ ID NO: 5568824 - DNA, 21 bp, Homo sapiens
agttacacagaaatgctgctg

SEQ ID NO: 5568825 - DNA, 15 bp, Homo sapiens
agttacagaattcct

SEQ ID NO: 5568826 - DNA, 14 bp, Homo sapiens
agttacagacaaag

SEQ ID NO: 5568827 - DNA, 19 bp, Homo sapiens
agttacaggggattttatt

SEQ ID NO: 5568828 - DNA, 17 bp, Homo sapiens
agttacagttgatgttt

SEQ ID NO: 5568829 - DNA, 15 bp, Homo sapiens
agttacagtttgata

SEQ ID NO: 5568830 - DNA, 20 bp, Homo sapiens
agttacatatgtatacatgt

SEQ ID NO: 5568831 - DNA, 14 bp, Homo sapiens
agttacatgcataa

SEQ ID NO: 5568832 - DNA, 18 bp, Homo sapiens
agttacatgcataaaagg

SEQ ID NO: 5568833 - DNA, 18 bp, Homo sapiens
agttacattaaaataaac

SEQ ID NO: 5568834 - DNA, 23 bp, Homo sapiens
agttacattaaaataaaccaaat

SEQ ID NO: 5568835 - DNA, 16 bp, Homo sapiens
agttacattaatgtta

SEQ ID NO: 5568836 - DNA, 13 bp, Homo sapiens
agttacatttatg

SEQ ID NO: 5568837 - DNA, 17 bp, Homo sapiens
agttaccacacatctat

SEQ ID NO: 5568838 - DNA, 17 bp, Homo sapiens
agttaccattaaaccat

SEQ ID NO: 5568839 - DNA, 22 bp, Homo sapiens
agttacccaacagaaacattct

SEQ ID NO: 5568840 - DNA, 20 bp, Homo sapiens
agttacccaccctaatttgc

SEQ ID NO: 5568841 - DNA, 22 bp, Homo sapiens
agttaccccgatccgtttgcaa

SEQ ID NO: 5568842 - DNA, 16 bp, Homo sapiens
agttacccctgaaatc

SEQ ID NO: 5568843 - DNA, 17 bp, Homo sapiens
agttacctcaaggccta

SEQ ID NO: 5568844 - DNA, 23 bp, Homo sapiens
agttacctgagagatttaacatt

SEQ ID NO: 5568845 - DNA, 20 bp, Homo sapiens
agttaccttatagttactgt

SEQ ID NO: 5568846 - DNA, 21 bp, Homo sapiens
agttaccttatagttactgtg

SEQ ID NO: 5568847 - DNA, 19 bp, Homo sapiens
agttacctttgctgtcact

SEQ ID NO: 5568848 - DNA, 13 bp, Homo sapiens
agttacggaggga

SEQ ID NO: 5568849 - DNA, 22 bp, Homo sapiens
agttacggagggaggacatcat

SEQ ID NO: 5568850 - DNA, 17 bp, Homo sapiens
agttactaaaatttaca

SEQ ID NO: 5568851 - DNA, 12 bp, Homo sapiens
agttactaatat

SEQ ID NO: 5568852 - DNA, 15 bp, Homo sapiens
agttactaatatatc

SEQ ID NO: 5568853 - DNA, 23 bp, Homo sapiens
agttactactgattttaaaatga

SEQ ID NO: 5568854 - DNA, 17 bp, Homo sapiens
agttactaggtaacttc

SEQ ID NO: 5568855 - DNA, 19 bp, Homo sapiens
agttactatagtggtgaga

SEQ ID NO: 5568856 - DNA, 23 bp, Homo sapiens
agttactatcatgtcaaacgtga

SEQ ID NO: 5568857 - DNA, 14 bp, Homo sapiens
agttactcagatga

SEQ ID NO: 5568858 - DNA, 12 bp, Homo sapiens
agttactcagcc

SEQ ID NO: 5568859 - DNA, 17 bp, Homo sapiens
agttactccctacactg

SEQ ID NO: 5568860 - DNA, 15 bp, Homo sapiens
agttactgaaatctt

SEQ ID NO: 5568861 - DNA, 12 bp, Homo sapiens
agttactgaatg

SEQ ID NO: 5568862 - DNA, 14 bp, Homo sapiens
agttactgaatgca

SEQ ID NO: 5568863 - DNA, 14 bp, Homo sapiens
agttactgtaaatg

SEQ ID NO: 5568864 - DNA, 21 bp, Homo sapiens
agttactgtcctgttgattaa

SEQ ID NO: 5568865 - DNA, 23 bp, Homo sapiens
agttactgtgagccatattacta

SEQ ID NO: 5568866 - DNA, 14 bp, Homo sapiens
agttactgtgcatt

SEQ ID NO: 5568867 - DNA, 11 bp, Homo sapiens
agttactgtgt

SEQ ID NO: 5568868 - DNA, 15 bp, Homo sapiens
agttactgtgtaaac

SEQ ID NO: 5568869 - DNA, 15 bp, Homo sapiens
agttactgttcatgg

SEQ ID NO: 5568870 - DNA, 13 bp, Homo sapiens
agttactgttgtg

SEQ ID NO: 5568871 - DNA, 14 bp, Homo sapiens
agttacttcctatc

SEQ ID NO: 5568872 - DNA, 23 bp, Homo sapiens
agttacttgaaaaaatgttctat

SEQ ID NO: 5568873 - DNA, 23 bp, Homo sapiens
agttacttgctataaatagattt

SEQ ID NO: 5568874 - DNA, 18 bp, Homo sapiens
agttacttgtctgaggcc

SEQ ID NO: 5568875 - DNA, 20 bp, Homo sapiens
agttacttgtctgaggcctc

SEQ ID NO: 5568876 - DNA, 15 bp, Homo sapiens
agttactttagatgg

SEQ ID NO: 5568877 - DNA, 14 bp, Homo sapiens
agttactttatgtt

SEQ ID NO: 5568878 - DNA, 21 bp, Homo sapiens
agttactttccaattctcctt

SEQ ID NO: 5568879 - DNA, 23 bp, Homo sapiens
agttactttccaattctccttta

SEQ ID NO: 5568880 - DNA, 11 bp, Homo sapiens
agttactttgt

SEQ ID NO: 5568881 - DNA, 16 bp, Homo sapiens
agttactttgtaattt

SEQ ID NO: 5568882 - DNA, 18 bp, Homo sapiens
agttacttttccttgcat

SEQ ID NO: 5568883 - DNA, 21 bp, Homo sapiens
agttacttttccttgcataca

SEQ ID NO: 5568884 - DNA, 23 bp, Homo sapiens
agttacttttccttgcatacaaa

SEQ ID NO: 5568885 - DNA, 13 bp, Homo sapiens
agttactttttcc

SEQ ID NO: 5568886 - DNA, 16 bp, Homo sapiens
agttactttttgtaga

SEQ ID NO: 5568887 - DNA, 18 bp, Homo sapiens
agttactttttgtagaga

SEQ ID NO: 5568888 - DNA, 20 bp, Homo sapiens
agttagaaaattcagctcct

SEQ ID NO: 5568889 - DNA, 22 bp, Homo sapiens
agttagaaatctccagtgtgcg

SEQ ID NO: 5568890 - DNA, 23 bp, Homo sapiens
agttagaacaagcccaaatttaa

SEQ ID NO: 5568891 - DNA, 22 bp, Homo sapiens
agttagaaccacagcagacacc

SEQ ID NO: 5568892 - DNA, 23 bp, Homo sapiens
agttagactcaaagaagtactgt

SEQ ID NO: 5568893 - DNA, 12 bp, Homo sapiens
agttagactgtt

SEQ ID NO: 5568894 - DNA, 21 bp, Homo sapiens
agttagagaactaaactagtt

SEQ ID NO: 5568895 - DNA, 17 bp, Homo sapiens
agttagagaatatattt

SEQ ID NO: 5568896 - DNA, 17 bp, Homo sapiens
agttagagattttacaa

SEQ ID NO: 5568897 - DNA, 18 bp, Homo sapiens
agttagagattttacaaa

SEQ ID NO: 5568898 - DNA, 20 bp, Homo sapiens
agttagagcccattaatctt

SEQ ID NO: 5568899 - DNA, 21 bp, Homo sapiens
agttagagcccattaatcttg

SEQ ID NO: 5568900 - DNA, 17 bp, Homo sapiens
agttagagtgagtgctg

SEQ ID NO: 5568901 - DNA, 15 bp, Homo sapiens
agttagcaaactttg

SEQ ID NO: 5568902 - DNA, 11 bp, Homo sapiens
agttagcacca

SEQ ID NO: 5568903 - DNA, 14 bp, Homo sapiens
agttagcaggaaat

SEQ ID NO: 5568904 - DNA, 18 bp, Homo sapiens
agttagcaggaaatagtg

SEQ ID NO: 5568905 - DNA, 20 bp, Homo sapiens
agttagcatgtatgaatgta

SEQ ID NO: 5568906 - DNA, 16 bp, Homo sapiens
agttagcattgtttct

SEQ ID NO: 5568907 - DNA, 20 bp, Homo sapiens
agttagcatttaccaacatg

SEQ ID NO: 5568908 - DNA, 23 bp, Homo sapiens
agttagccatctaatgcttgttt

SEQ ID NO: 5568909 - DNA, 20 bp, Homo sapiens
agttagccccagaaaatgaa

SEQ ID NO: 5568910 - DNA, 21 bp, Homo sapiens
agttagccccagaaaatgaaa

SEQ ID NO: 5568911 - DNA, 13 bp, Homo sapiens
agttagcccggcc

SEQ ID NO: 5568912 - DNA, 14 bp, Homo sapiens
agttagccctcagt

SEQ ID NO: 5568913 - DNA, 15 bp, Homo sapiens
agttagcctccacca

SEQ ID NO: 5568914 - DNA, 16 bp, Homo sapiens
agttagcctttatcta

SEQ ID NO: 5568915 - DNA, 14 bp, Homo sapiens
agttagctcaggag

SEQ ID NO: 5568916 - DNA, 17 bp, Homo sapiens
agttagctccataaagt

SEQ ID NO: 5568917 - DNA, 12 bp, Homo sapiens
agttaggaaata

SEQ ID NO: 5568918 - DNA, 21 bp, Homo sapiens
agttaggaaataaaacctttc

SEQ ID NO: 5568919 - DNA, 18 bp, Homo sapiens
agttaggaagttacctgg

SEQ ID NO: 5568920 - DNA, 16 bp, Homo sapiens
agttaggattcagatc

SEQ ID NO: 5568921 - DNA, 16 bp, Homo sapiens
agttaggccacgctcc

SEQ ID NO: 5568922 - DNA, 16 bp, Homo sapiens
agttaggctttctctt

SEQ ID NO: 5568923 - DNA, 13 bp, Homo sapiens
agttagggagaga

SEQ ID NO: 5568924 - DNA, 17 bp, Homo sapiens
agttagggagagagaag

SEQ ID NO: 5568925 - DNA, 20 bp, Homo sapiens
agttagggcatttttcttgg

SEQ ID NO: 5568926 - DNA, 12 bp, Homo sapiens
agttagggctgt

SEQ ID NO: 5568927 - DNA, 20 bp, Homo sapiens
agttaggggagaggaaaagt

SEQ ID NO: 5568928 - DNA, 18 bp, Homo sapiens
agttagggggttcttatt

SEQ ID NO: 5568929 - DNA, 17 bp, Homo sapiens
agttaggtgtgccaaac

SEQ ID NO: 5568930 - DNA, 21 bp, Homo sapiens
agttaggttgtctccaggcca

SEQ ID NO: 5568931 - DNA, 17 bp, Homo sapiens
agttagtagcatgttga

SEQ ID NO: 5568932 - DNA, 20 bp, Homo sapiens
agttagtatcttttgatatg

SEQ ID NO: 5568933 - DNA, 18 bp, Homo sapiens
agttagtattaaaatcta

SEQ ID NO: 5568934 - DNA, 18 bp, Homo sapiens
agttagtcgccctacaga

SEQ ID NO: 5568935 - DNA, 18 bp, Homo sapiens
agttagtgagactagaca

SEQ ID NO: 5568936 - DNA, 18 bp, Homo sapiens
agttagtgattatatttc

SEQ ID NO: 5568937 - DNA, 17 bp, Homo sapiens
agttagtggaaatctga

SEQ ID NO: 5568938 - DNA, 13 bp, Homo sapiens
agttagtgtagat

SEQ ID NO: 5568939 - DNA, 13 bp, Homo sapiens
agttagttcagta

SEQ ID NO: 5568940 - DNA, 14 bp, Homo sapiens
agttagtttgtata

SEQ ID NO: 5568941 - DNA, 12 bp, Homo sapiens
agttataaaaat

SEQ ID NO: 5568942 - DNA, 23 bp, Homo sapiens
agttataaaaattacataattca

SEQ ID NO: 5568943 - DNA, 16 bp, Homo sapiens
agttataaaaggcttt

SEQ ID NO: 5568944 - DNA, 13 bp, Homo sapiens
agttataaaccaa

SEQ ID NO: 5568945 - DNA, 15 bp, Homo sapiens
agttataaaccaatg

SEQ ID NO: 5568946 - DNA, 19 bp, Homo sapiens
agttataaaccaatgaaat

SEQ ID NO: 5568947 - DNA, 19 bp, Homo sapiens
agttataaagaaagattgt

SEQ ID NO: 5568948 - DNA, 16 bp, Homo sapiens
agttataaatagcctt

SEQ ID NO: 5568949 - DNA, 19 bp, Homo sapiens
agttataaatagccttcaa

SEQ ID NO: 5568950 - DNA, 18 bp, Homo sapiens
agttataacagatgtgaa

SEQ ID NO: 5568951 - DNA, 23 bp, Homo sapiens
agttataagaaaactacatgtaa

SEQ ID NO: 5568952 - DNA, 21 bp, Homo sapiens
agttataagtagcaggccaag

SEQ ID NO: 5568953 - DNA, 20 bp, Homo sapiens
agttataataactgaactgt

SEQ ID NO: 5568954 - DNA, 21 bp, Homo sapiens
agttataataactgaactgtt

SEQ ID NO: 5568955 - DNA, 22 bp, Homo sapiens
agttataataactgaactgttt

SEQ ID NO: 5568956 - DNA, 18 bp, Homo sapiens
agttatacagttataaaa

SEQ ID NO: 5568957 - DNA, 17 bp, Homo sapiens
agttatacatcttcatt

SEQ ID NO: 5568958 - DNA, 16 bp, Homo sapiens
agttataggattttca

SEQ ID NO: 5568959 - DNA, 23 bp, Homo sapiens
agttatagtgaatactgctacag

SEQ ID NO: 5568960 - DNA, 14 bp, Homo sapiens
agttatagtgttta

SEQ ID NO: 5568961 - DNA, 19 bp, Homo sapiens
agttatagtgtttaactgg

SEQ ID NO: 5568962 - DNA, 13 bp, Homo sapiens
agttatagtttca

SEQ ID NO: 5568963 - DNA, 16 bp, Homo sapiens
agttatagtttcagat

SEQ ID NO: 5568964 - DNA, 12 bp, Homo sapiens
agttggcttcta

SEQ ID NO: 5568965 - DNA, 13 bp, Homo sapiens
agttggcttctaa

SEQ ID NO: 5568966 - DNA, 19 bp, Homo sapiens
agttggcttctgtttctag

SEQ ID NO: 5568967 - DNA, 16 bp, Homo sapiens
agttggctttgcccac

SEQ ID NO: 5568968 - DNA, 14 bp, Homo sapiens
agttggctttgcta

SEQ ID NO: 5568969 - DNA, 15 bp, Homo sapiens
agttgggagcactgg

SEQ ID NO: 5568970 - DNA, 14 bp, Homo sapiens
agttgggaggagga

SEQ ID NO: 5568971 - DNA, 17 bp, Homo sapiens
agttgggcccctgagga

SEQ ID NO: 5568972 - DNA, 19 bp, Homo sapiens
agttgggcttgctattctg

SEQ ID NO: 5568973 - DNA, 19 bp, Homo sapiens
agttggggaagccaggtga

SEQ ID NO: 5568974 - DNA, 16 bp, Homo sapiens
agttggggacacatgt

SEQ ID NO: 5568975 - DNA, 13 bp, Homo sapiens
agttggggccctc

SEQ ID NO: 5568976 - DNA, 19 bp, Homo sapiens
agttggggccctcttgcca

SEQ ID NO: 5568977 - DNA, 21 bp, Homo sapiens
agttggggccctcttgccagc

SEQ ID NO: 5568978 - DNA, 17 bp, Homo sapiens
agttgggggagggaaga

SEQ ID NO: 5568979 - DNA, 21 bp, Homo sapiens
agttgggggccagcacagctg

SEQ ID NO: 5568980 - DNA, 15 bp, Homo sapiens
agttgggggctaggg

SEQ ID NO: 5568981 - DNA, 21 bp, Homo sapiens
agttgggggtcagtgctgcct

SEQ ID NO: 5568982 - DNA, 18 bp, Homo sapiens
agttgggtagaaaaatta

SEQ ID NO: 5568983 - DNA, 21 bp, Homo sapiens
agttgggtagaaaaattatta

SEQ ID NO: 5568984 - DNA, 20 bp, Homo sapiens
agttgggtagatgggtgggg

SEQ ID NO: 5568985 - DNA, 20 bp, Homo sapiens
agttgggtctgaaaggaaaa

SEQ ID NO: 5568986 - DNA, 19 bp, Homo sapiens
agttgggttcacttgccat

SEQ ID NO: 5568987 - DNA, 22 bp, Homo sapiens
agttgggtttcacgagtgttcc

SEQ ID NO: 5568988 - DNA, 20 bp, Homo sapiens
agttggtaacttttgtgaat

SEQ ID NO: 5568989 - DNA, 14 bp, Homo sapiens
agttggtattttat

SEQ ID NO: 5568990 - DNA, 15 bp, Homo sapiens
agttggtcttacttt

SEQ ID NO: 5568991 - DNA, 21 bp, Homo sapiens
agttggtcttactttgtgcaa

SEQ ID NO: 5568992 - DNA, 21 bp, Homo sapiens
agttggtgaacagagagaacc

SEQ ID NO: 5568993 - DNA, 20 bp, Homo sapiens
agttggtgagaaacctgtat

SEQ ID NO: 5568994 - DNA, 12 bp, Homo sapiens
agttggtggggc

SEQ ID NO: 5568995 - DNA, 15 bp, Homo sapiens
agttggtggggccag

SEQ ID NO: 5568996 - DNA, 21 bp, Homo sapiens
agttggtgtaatcattttaaa

SEQ ID NO: 5568997 - DNA, 23 bp, Homo sapiens
agttggtgtgtttttgggatgtc

SEQ ID NO: 5568998 - DNA, 19 bp, Homo sapiens
agttggttacctattgctg

SEQ ID NO: 5568999 - DNA, 15 bp, Homo sapiens
agttggttggataag

SEQ ID NO: 5569000 - DNA, 16 bp, Homo sapiens
agttggtttggatttt

SEQ ID NO: 5569001 - DNA, 23 bp, Homo sapiens
agttggttttgcatgtctgcatg

SEQ ID NO: 5569002 - DNA, 13 bp, Homo sapiens
agttgtaaagtat

SEQ ID NO: 5569003 - DNA, 20 bp, Homo sapiens
agttgtaaataattttctaa

SEQ ID NO: 5569004 - DNA, 14 bp, Homo sapiens
agttgtaaatatag

SEQ ID NO: 5569005 - DNA, 15 bp, Homo sapiens
agttgtaaatatata

SEQ ID NO: 5569006 - DNA, 20 bp, Homo sapiens
agttgtaaatatataaatat

SEQ ID NO: 5569007 - DNA, 18 bp, Homo sapiens
agttgtaacttatattga

SEQ ID NO: 5569008 - DNA, 20 bp, Homo sapiens
agttgtaaggattgcctttg

SEQ ID NO: 5569009 - DNA, 13 bp, Homo sapiens
agttgtacaaatg

SEQ ID NO: 5569010 - DNA, 14 bp, Homo sapiens
agttgtacaaatgt

SEQ ID NO: 5569011 - DNA, 11 bp, Homo sapiens
agttgtacatg

SEQ ID NO: 5569012 - DNA, 13 bp, Homo sapiens
agttgtacatgaa

SEQ ID NO: 5569013 - DNA, 19 bp, Homo sapiens
agttgtacatgataagaca

SEQ ID NO: 5569014 - DNA, 15 bp, Homo sapiens
agttgtaccaaaaca

SEQ ID NO: 5569015 - DNA, 16 bp, Homo sapiens
agttgtaccaaaacat

SEQ ID NO: 5569016 - DNA, 18 bp, Homo sapiens
agttgtaccaaaacatcc

SEQ ID NO: 5569017 - DNA, 19 bp, Homo sapiens
agttgtaccgcaatgtgac

SEQ ID NO: 5569018 - DNA, 18 bp, Homo sapiens
agttgtacgtaatgtatt

SEQ ID NO: 5569019 - DNA, 20 bp, Homo sapiens
agttgtacgtaatgtattta

SEQ ID NO: 5569020 - DNA, 22 bp, Homo sapiens
agttgtactggttagattcatt

SEQ ID NO: 5569021 - DNA, 15 bp, Homo sapiens
agttgtactgtatgc

SEQ ID NO: 5569022 - DNA, 13 bp, Homo sapiens
agttgtacttctg

SEQ ID NO: 5569023 - DNA, 13 bp, Homo sapiens
agttgtactttaa

SEQ ID NO: 5569024 - DNA, 23 bp, Homo sapiens
agttgtactttaaaaatttacta

SEQ ID NO: 5569025 - DNA, 16 bp, Homo sapiens
agttgtagaatgtatt

SEQ ID NO: 5569026 - DNA, 17 bp, Homo sapiens
agttgtagaatgtattg

SEQ ID NO: 5569027 - DNA, 18 bp, Homo sapiens
agttgtagaatgtattgt

SEQ ID NO: 5569028 - DNA, 14 bp, Homo sapiens
agttgtagacaaag

SEQ ID NO: 5569029 - DNA, 11 bp, Homo sapiens
agttgtagtga

SEQ ID NO: 5569030 - DNA, 16 bp, Homo sapiens
agttgtataaaaacat

SEQ ID NO: 5569031 - DNA, 14 bp, Homo sapiens
agttgtatctcttt

SEQ ID NO: 5569032 - DNA, 15 bp, Homo sapiens
agttgtatctctttt

SEQ ID NO: 5569033 - DNA, 17 bp, Homo sapiens
agttgtatctcttttga

SEQ ID NO: 5569034 - DNA, 22 bp, Homo sapiens
agttgtatctcttttgaatcca

SEQ ID NO: 5569035 - DNA, 16 bp, Homo sapiens
agttgtatgtttgctg

SEQ ID NO: 5569036 - DNA, 17 bp, Homo sapiens
agttgtatgtttgctga

SEQ ID NO: 5569037 - DNA, 17 bp, Homo sapiens
agttgtattttgacaaa

SEQ ID NO: 5569038 - DNA, 19 bp, Homo sapiens
agttgtattttgacaaaaa

SEQ ID NO: 5569039 - DNA, 16 bp, Homo sapiens
agttgtcaaagaagct

SEQ ID NO: 5569040 - DNA, 13 bp, Homo sapiens
agttgtcaacttg

SEQ ID NO: 5569041 - DNA, 19 bp, Homo sapiens
agttgtcaagtctctgctg

SEQ ID NO: 5569042 - DNA, 21 bp, Homo sapiens
agttgtcacagaaattatgat

SEQ ID NO: 5569043 - DNA, 21 bp, Homo sapiens
agttgtcacagtcttgtgaac

SEQ ID NO: 5569044 - DNA, 15 bp, Homo sapiens
agttgtcactgcttt

SEQ ID NO: 5569045 - DNA, 21 bp, Homo sapiens
agttgtcagaatatgtatgta

SEQ ID NO: 5569046 - DNA, 13 bp, Homo sapiens
agttgtcaggtta

SEQ ID NO: 5569047 - DNA, 17 bp, Homo sapiens
agttgtccacaaatctt

SEQ ID NO: 5569048 - DNA, 18 bp, Homo sapiens
agttgtccagatcactga

SEQ ID NO: 5569049 - DNA, 18 bp, Homo sapiens
agttgtcctatggacaac

SEQ ID NO: 5569050 - DNA, 18 bp, Homo sapiens
agttgtctattctgagcc

SEQ ID NO: 5569051 - DNA, 19 bp, Homo sapiens
agttgtctattctgagcct

SEQ ID NO: 5569052 - DNA, 14 bp, Homo sapiens
agttgtctccttcc

SEQ ID NO: 5569053 - DNA, 16 bp, Homo sapiens
agttgtctctgatgca

SEQ ID NO: 5569054 - DNA, 17 bp, Homo sapiens
agttgtctctgatgcag

SEQ ID NO: 5569055 - DNA, 13 bp, Homo sapiens
agttgtctgtgct

SEQ ID NO: 5569056 - DNA, 21 bp, Homo sapiens
agttgtctgtgcttccttggt

SEQ ID NO: 5569057 - DNA, 12 bp, Homo sapiens
agttgtcttaaa

SEQ ID NO: 5569058 - DNA, 22 bp, Homo sapiens
agttgtcttatgtgaaaaatta

SEQ ID NO: 5569059 - DNA, 23 bp, Homo sapiens
agttgtcttatgtgaaaaattaa

SEQ ID NO: 5569060 - DNA, 13 bp, Homo sapiens
agttgtctttctt

SEQ ID NO: 5569061 - DNA, 17 bp, Homo sapiens
agttgtctttctttgct

SEQ ID NO: 5569062 - DNA, 20 bp, Homo sapiens
agttgtgaaagaaagctgag

SEQ ID NO: 5569063 - DNA, 14 bp, Homo sapiens
agttgtgaaagttt

SEQ ID NO: 5569064 - DNA, 20 bp, Homo sapiens
agttgtgaaagttttgagta

SEQ ID NO: 5569065 - DNA, 21 bp, Homo sapiens
agttgtgagccctctagggca

SEQ ID NO: 5569066 - DNA, 19 bp, Homo sapiens
agttgtgataatagcattt

SEQ ID NO: 5569067 - DNA, 20 bp, Homo sapiens
agttgtgatacagagtatat

SEQ ID NO: 5569068 - DNA, 14 bp, Homo sapiens
agttgtgatataaa

SEQ ID NO: 5569069 - DNA, 15 bp, Homo sapiens
agttgtgatataaag

SEQ ID NO: 5569070 - DNA, 13 bp, Homo sapiens
agttgtgatcatc

SEQ ID NO: 5569071 - DNA, 15 bp, Homo sapiens
agttgtgatggaggg

SEQ ID NO: 5569072 - DNA, 21 bp, Homo sapiens
agttgtgatttctgtggatcc

SEQ ID NO: 5569073 - DNA, 21 bp, Homo sapiens
agttgtgcaacggccagggtt

SEQ ID NO: 5569074 - DNA, 18 bp, Homo sapiens
agttgtgcacatggctta

SEQ ID NO: 5569075 - DNA, 15 bp, Homo sapiens
agttgtgcacgcaga

SEQ ID NO: 5569076 - DNA, 16 bp, Homo sapiens
agttgtgcatgtatgt

SEQ ID NO: 5569077 - DNA, 20 bp, Homo sapiens
agttgtgcatgtatgtatac

SEQ ID NO: 5569078 - DNA, 18 bp, Homo sapiens
agttgtgccttttatagc

SEQ ID NO: 5569079 - DNA, 22 bp, Homo sapiens
agttgtgccttttatagctatt

SEQ ID NO: 5569080 - DNA, 14 bp, Homo sapiens
agttgtgcttgagc

SEQ ID NO: 5569081 - DNA, 19 bp, Homo sapiens
agttgtgcttgtttacagc

SEQ ID NO: 5569082 - DNA, 14 bp, Homo sapiens
agttgtggaaagat

SEQ ID NO: 5569083 - DNA, 20 bp, Homo sapiens
agttgtggaaagcctctgct

SEQ ID NO: 5569084 - DNA, 14 bp, Homo sapiens
agttgtggaggagg

SEQ ID NO: 5569085 - DNA, 18 bp, Homo sapiens
agttgtggatttcagttt

SEQ ID NO: 5569086 - DNA, 14 bp, Homo sapiens
agttgtgggcaaca

SEQ ID NO: 5569087 - DNA, 21 bp, Homo sapiens
agttgtgtctggcagtttata

SEQ ID NO: 5569088 - DNA, 14 bp, Homo sapiens
agttgtgtgaccct

SEQ ID NO: 5569089 - DNA, 11 bp, Homo sapiens
agttgtgtgct

SEQ ID NO: 5569090 - DNA, 16 bp, Homo sapiens
agttgtgtggcccagc

SEQ ID NO: 5569091 - DNA, 17 bp, Homo sapiens
agttgtgtggcccagca

SEQ ID NO: 5569092 - DNA, 18 bp, Homo sapiens
agttgtgtgtatgtgtgt

SEQ ID NO: 5569093 - DNA, 18 bp, Homo sapiens
agttgtgttagcctcttg

SEQ ID NO: 5569094 - DNA, 11 bp, Homo sapiens
agttgtgttca

SEQ ID NO: 5569095 - DNA, 23 bp, Homo sapiens
agttgtgttgacacatatgaaca

SEQ ID NO: 5569096 - DNA, 23 bp, Homo sapiens
agttgtgttgttttttgttcaat

SEQ ID NO: 5569097 - DNA, 22 bp, Homo sapiens
agttgtgtttgttgctggcttg

SEQ ID NO: 5569098 - DNA, 17 bp, Homo sapiens
agttgtgttttttaaga

SEQ ID NO: 5569099 - DNA, 21 bp, Homo sapiens
agttgtgttttttaagatggc

SEQ ID NO: 5569100 - DNA, 12 bp, Homo sapiens
agttgttaaaac

SEQ ID NO: 5569101 - DNA, 13 bp, Homo sapiens
agttgttacattt

SEQ ID NO: 5569102 - DNA, 19 bp, Homo sapiens
agttgttacatttttaagt

SEQ ID NO: 5569103 - DNA, 20 bp, Homo sapiens
agttgttactaactaaactc

SEQ ID NO: 5569104 - DNA, 22 bp, Homo sapiens
agttgttactaactaaactctc

SEQ ID NO: 5569105 - DNA, 23 bp, Homo sapiens
agttgttactaactaaactctct

SEQ ID NO: 5569106 - DNA, 15 bp, Homo sapiens
agttgttactgaagt

SEQ ID NO: 5569107 - DNA, 16 bp, Homo sapiens
agttgttactgaagtt

SEQ ID NO: 5569108 - DNA, 18 bp, Homo sapiens
agttgttactgaagttat

SEQ ID NO: 5569109 - DNA, 20 bp, Homo sapiens
agttgttagattaagaaata

SEQ ID NO: 5569110 - DNA, 17 bp, Homo sapiens
agttgttattgttgaac

SEQ ID NO: 5569111 - DNA, 18 bp, Homo sapiens
agttgttattgttgaaca

SEQ ID NO: 5569112 - DNA, 13 bp, Homo sapiens
agttgttcctaga

SEQ ID NO: 5569113 - DNA, 23 bp, Homo sapiens
agttgttcgggccaaggacctga

SEQ ID NO: 5569114 - DNA, 21 bp, Homo sapiens
agttgttctcaggggtgctgg

SEQ ID NO: 5569115 - DNA, 11 bp, Homo sapiens
agttgttcttt

SEQ ID NO: 5569116 - DNA, 13 bp, Homo sapiens
agttgttctttgt

SEQ ID NO: 5569117 - DNA, 14 bp, Homo sapiens
agttgttgcattcc

SEQ ID NO: 5569118 - DNA, 15 bp, Homo sapiens
agttgttgcattccc

SEQ ID NO: 5569119 - DNA, 16 bp, Homo sapiens
agttgttggtctgtag

SEQ ID NO: 5569120 - DNA, 12 bp, Homo sapiens
agttgttgtaac

SEQ ID NO: 5569121 - DNA, 14 bp, Homo sapiens
agttgttgtagaga

SEQ ID NO: 5569122 - DNA, 16 bp, Homo sapiens
agttgttgtgtacaga

SEQ ID NO: 5569123 - DNA, 14 bp, Homo sapiens
agttgttgtttgcc

SEQ ID NO: 5569124 - DNA, 17 bp, Homo sapiens
agttgtttaactgtgca

SEQ ID NO: 5569125 - DNA, 18 bp, Homo sapiens
agttgtttaactgtgcat

SEQ ID NO: 5569126 - DNA, 14 bp, Homo sapiens
agttgtttaataag

SEQ ID NO: 5569127 - DNA, 13 bp, Homo sapiens
agttgtttataaa

SEQ ID NO: 5569128 - DNA, 15 bp, Homo sapiens
agttgtttataaaaa

SEQ ID NO: 5569129 - DNA, 16 bp, Homo sapiens
agttgtttataaaaac

SEQ ID NO: 5569130 - DNA, 14 bp, Homo sapiens
agttgtttatgtat

SEQ ID NO: 5569131 - DNA, 23 bp, Homo sapiens
agttgtttctaagagcagagtct

SEQ ID NO: 5569132 - DNA, 23 bp, Homo sapiens
agttgtttctagactataaatgt

SEQ ID NO: 5569133 - DNA, 13 bp, Homo sapiens
agttgtttgatgc

SEQ ID NO: 5569134 - DNA, 21 bp, Homo sapiens
agttgtttgattcagacagct

SEQ ID NO: 5569135 - DNA, 23 bp, Homo sapiens
agttgtttgattcagacagctgc

SEQ ID NO: 5569136 - DNA, 17 bp, Homo sapiens
agttgtttgtttttgct

SEQ ID NO: 5569137 - DNA, 18 bp, Homo sapiens
agttgtttgtttttgctt

SEQ ID NO: 5569138 - DNA, 15 bp, Homo sapiens
agttgttttaacaga

SEQ ID NO: 5569139 - DNA, 19 bp, Homo sapiens
agttgttttggtgcctgcc

SEQ ID NO: 5569140 - DNA, 16 bp, Homo sapiens
agttgttttgttttat

SEQ ID NO: 5569141 - DNA, 14 bp, Homo sapiens
agtttaaaaaaata

SEQ ID NO: 5569142 - DNA, 16 bp, Homo sapiens
agtttaaaaaaataac

SEQ ID NO: 5569143 - DNA, 18 bp, Homo sapiens
agttttgatatttctagc

SEQ ID NO: 5569144 - DNA, 14 bp, Homo sapiens
agttttgatgaaat

SEQ ID NO: 5569145 - DNA, 19 bp, Homo sapiens
agttttgatgactggcatt

SEQ ID NO: 5569146 - DNA, 19 bp, Homo sapiens
agttttgccagaacagttt

SEQ ID NO: 5569147 - DNA, 23 bp, Homo sapiens
agttttgcctttctaagggaggg

SEQ ID NO: 5569148 - DNA, 13 bp, Homo sapiens
agttttgctgcta

SEQ ID NO: 5569149 - DNA, 19 bp, Homo sapiens
agttttgctttagtacaat

SEQ ID NO: 5569150 - DNA, 13 bp, Homo sapiens
agttttggaatct

SEQ ID NO: 5569151 - DNA, 20 bp, Homo sapiens
agttttggaatctaagctgt

SEQ ID NO: 5569152 - DNA, 18 bp, Homo sapiens
agttttggatgcagtgct

SEQ ID NO: 5569153 - DNA, 15 bp, Homo sapiens
agttttggcagccag

SEQ ID NO: 5569154 - DNA, 16 bp, Homo sapiens
agttttggcagccatg

SEQ ID NO: 5569155 - DNA, 20 bp, Homo sapiens
agttttgggaaatgtagccc

SEQ ID NO: 5569156 - DNA, 19 bp, Homo sapiens
agttttgggaagttaaagg

SEQ ID NO: 5569157 - DNA, 20 bp, Homo sapiens
agttttggttatttctaaac

SEQ ID NO: 5569158 - DNA, 20 bp, Homo sapiens
agttttgtaacttagcttta

SEQ ID NO: 5569159 - DNA, 17 bp, Homo sapiens
agttttgtaagccctct

SEQ ID NO: 5569160 - DNA, 15 bp, Homo sapiens
agttttgtataaata

SEQ ID NO: 5569161 - DNA, 17 bp, Homo sapiens
agttttgtataaataat

SEQ ID NO: 5569162 - DNA, 18 bp, Homo sapiens
agttttgtataaataata

SEQ ID NO: 5569163 - DNA, 20 bp, Homo sapiens
agttttgtataaataataaa

SEQ ID NO: 5569164 - DNA, 13 bp, Homo sapiens
agttttgtcagaa

SEQ ID NO: 5569165 - DNA, 12 bp, Homo sapiens
agttttgtctgt

SEQ ID NO: 5569166 - DNA, 13 bp, Homo sapiens
agttttgtgaaat

SEQ ID NO: 5569167 - DNA, 14 bp, Homo sapiens
agttttgtgaaatt

SEQ ID NO: 5569168 - DNA, 20 bp, Homo sapiens
agttttgtgaaatttttcat

SEQ ID NO: 5569169 - DNA, 17 bp, Homo sapiens
agttttgtgatgcattt

SEQ ID NO: 5569170 - DNA, 16 bp, Homo sapiens
agttttgtgtacagta

SEQ ID NO: 5569171 - DNA, 20 bp, Homo sapiens
agttttgtgtacagtatgtg

SEQ ID NO: 5569172 - DNA, 21 bp, Homo sapiens
agttttgtgtacagtatgtgt

SEQ ID NO: 5569173 - DNA, 22 bp, Homo sapiens
agttttgtgtttgttgtagatt

SEQ ID NO: 5569174 - DNA, 14 bp, Homo sapiens
agttttgttgcccc

SEQ ID NO: 5569175 - DNA, 23 bp, Homo sapiens
agttttgttgtacttaaatggta

SEQ ID NO: 5569176 - DNA, 12 bp, Homo sapiens
agttttgtttat

SEQ ID NO: 5569177 - DNA, 21 bp, Homo sapiens
agttttgtttcactttgacat

SEQ ID NO: 5569178 - DNA, 23 bp, Homo sapiens
agtttttaaaaaggcctttggga

SEQ ID NO: 5569179 - DNA, 20 bp, Homo sapiens
agtttttaaaaataaaggaa

SEQ ID NO: 5569180 - DNA, 21 bp, Homo sapiens
agtttttaaagccttctggat

SEQ ID NO: 5569181 - DNA, 23 bp, Homo sapiens
agtttttaattcatatttttcct

SEQ ID NO: 5569182 - DNA, 17 bp, Homo sapiens
agtttttacaagatgta

SEQ ID NO: 5569183 - DNA, 17 bp, Homo sapiens
agtttttacctaccaca

SEQ ID NO: 5569184 - DNA, 21 bp, Homo sapiens
agtttttacctaccacagtgt

SEQ ID NO: 5569185 - DNA, 14 bp, Homo sapiens
agtttttaccttgt

SEQ ID NO: 5569186 - DNA, 16 bp, Homo sapiens
agtttttactttctgt

SEQ ID NO: 5569187 - DNA, 19 bp, Homo sapiens
agtttttagaatgttgaaa

SEQ ID NO: 5569188 - DNA, 17 bp, Homo sapiens
agtttttataatagatt

SEQ ID NO: 5569189 - DNA, 13 bp, Homo sapiens
agtttttatacca

SEQ ID NO: 5569190 - DNA, 22 bp, Homo sapiens
agtttttatatagtctacagtt

SEQ ID NO: 5569191 - DNA, 23 bp, Homo sapiens
agtttttatggcttttgtgcatt

SEQ ID NO: 5569192 - DNA, 16 bp, Homo sapiens
agtttttatggttcca

SEQ ID NO: 5569193 - DNA, 19 bp, Homo sapiens
agtttttattcaaagcagc

SEQ ID NO: 5569194 - DNA, 15 bp, Homo sapiens
agtttttattgcttg

SEQ ID NO: 5569195 - DNA, 15 bp, Homo sapiens
agtttttattttaaa

SEQ ID NO: 5569196 - DNA, 13 bp, Homo sapiens
agtttttcagaaa

SEQ ID NO: 5569197 - DNA, 18 bp, Homo sapiens
agtttttcagaaagtttg

SEQ ID NO: 5569198 - DNA, 20 bp, Homo sapiens
agtttttcaggagcgcaaga

SEQ ID NO: 5569199 - DNA, 17 bp, Homo sapiens
agtttttcatactgtac

SEQ ID NO: 5569200 - DNA, 19 bp, Homo sapiens
agtttttcatactgtacac

SEQ ID NO: 5569201 - DNA, 18 bp, Homo sapiens
agtttttcattatttgga

SEQ ID NO: 5569202 - DNA, 12 bp, Homo sapiens
agtttttcattt

SEQ ID NO: 5569203 - DNA, 15 bp, Homo sapiens
agtttttcatttgtt

SEQ ID NO: 5569204 - DNA, 22 bp, Homo sapiens
agtttttcatttgttttgcttt

SEQ ID NO: 5569205 - DNA, 22 bp, Homo sapiens
agtttttcccagctacaccttt

SEQ ID NO: 5569206 - DNA, 23 bp, Homo sapiens
agtttttcccagctacacctttc

SEQ ID NO: 5569207 - DNA, 21 bp, Homo sapiens
agtttttcctaacgttttcta

SEQ ID NO: 5569208 - DNA, 12 bp, Homo sapiens
agtttttcctcc

SEQ ID NO: 5569209 - DNA, 18 bp, Homo sapiens
agtttttctaatactaat

SEQ ID NO: 5569210 - DNA, 16 bp, Homo sapiens
agtttttctgtatttt

SEQ ID NO: 5569211 - DNA, 17 bp, Homo sapiens
agtttttgaaaattatg

SEQ ID NO: 5569212 - DNA, 14 bp, Homo sapiens
agtttttgaaagac

SEQ ID NO: 5569213 - DNA, 16 bp, Homo sapiens
agtttttgaaagacaa

SEQ ID NO: 5569214 - DNA, 13 bp, Homo sapiens
agtttttgatagt

SEQ ID NO: 5569215 - DNA, 14 bp, Homo sapiens
agtttttgctgaag

SEQ ID NO: 5569216 - DNA, 11 bp, Homo sapiens
agtttttgctt

SEQ ID NO: 5569217 - DNA, 16 bp, Homo sapiens
agtttttggttgggaa

SEQ ID NO: 5569218 - DNA, 17 bp, Homo sapiens
agtttttggttgggaat

SEQ ID NO: 5569219 - DNA, 19 bp, Homo sapiens
agtttttgtactgtaaaga

SEQ ID NO: 5569220 - DNA, 21 bp, Homo sapiens
agtttttgttcaccttctgtg

SEQ ID NO: 5569221 - DNA, 17 bp, Homo sapiens
agtttttgttcttaaaa

SEQ ID NO: 5569222 - DNA, 20 bp, Homo sapiens
agtttttgttcttaattgca

SEQ ID NO: 5569223 - DNA, 16 bp, Homo sapiens
agtttttgtttggaga

SEQ ID NO: 5569224 - DNA, 18 bp, Homo sapiens
agtttttgtttgtttctt

SEQ ID NO: 5569225 - DNA, 16 bp, Homo sapiens
agtttttgtttttgca

SEQ ID NO: 5569226 - DNA, 19 bp, Homo sapiens
agtttttgtttttgcatga

SEQ ID NO: 5569227 - DNA, 22 bp, Homo sapiens
agtttttgtttttgcatgaaat

SEQ ID NO: 5569228 - DNA, 19 bp, Homo sapiens
agttttttaaacaaatgag

SEQ ID NO: 5569229 - DNA, 18 bp, Homo sapiens
agttttttacttctctta

SEQ ID NO: 5569230 - DNA, 17 bp, Homo sapiens
agttttttatatatgaa

SEQ ID NO: 5569231 - DNA, 20 bp, Homo sapiens
agttttttcttccttttcac

SEQ ID NO: 5569232 - DNA, 23 bp, Homo sapiens
agttttttcttccttttcactgc

SEQ ID NO: 5569233 - DNA, 17 bp, Homo sapiens
agttttttgccactgca

SEQ ID NO: 5569234 - DNA, 20 bp, Homo sapiens
agttttttgccactgcaaac

SEQ ID NO: 5569235 - DNA, 18 bp, Homo sapiens
agttttttgcttctcttt

SEQ ID NO: 5569236 - DNA, 15 bp, Homo sapiens
agttttttgtaccaa

SEQ ID NO: 5569237 - DNA, 15 bp, Homo sapiens
agtttttttatttct

SEQ ID NO: 5569238 - DNA, 18 bp, Homo sapiens
agtttttttcaaagtcca

SEQ ID NO: 5569239 - DNA, 16 bp, Homo sapiens
agtttttttctgttta

SEQ ID NO: 5569240 - DNA, 18 bp, Homo sapiens
agtttttttctgtttata

SEQ ID NO: 5569241 - DNA, 14 bp, Homo sapiens
agtttttttctttg

SEQ ID NO: 5569242 - DNA, 12 bp, Homo sapiens
agtttttttgct

SEQ ID NO: 5569243 - DNA, 17 bp, Homo sapiens
agtttttttttttccag

SEQ ID NO: 5569244 - DNA, 20 bp, Homo sapiens
ataaaaaaaaaaggatgaaa

SEQ ID NO: 5569245 - DNA, 21 bp, Homo sapiens
ataaaaaaaaaaggatgaaag

SEQ ID NO: 5569246 - DNA, 22 bp, Homo sapiens
ataaaaaaaaacctagtgctga

SEQ ID NO: 5569247 - DNA, 22 bp, Homo sapiens
ataaaaaaaaatagatgtcttt

SEQ ID NO: 5569248 - DNA, 17 bp, Homo sapiens
ataaaaaaaagaaaaaa

SEQ ID NO: 5569249 - DNA, 15 bp, Homo sapiens
ataaaaaaacagctt

SEQ ID NO: 5569250 - DNA, 14 bp, Homo sapiens
ataaaaaaatacag

SEQ ID NO: 5569251 - DNA, 16 bp, Homo sapiens
ataaaaaaatacagta

SEQ ID NO: 5569252 - DNA, 17 bp, Homo sapiens
ataaaaaaatacagtaa

SEQ ID NO: 5569253 - DNA, 17 bp, Homo sapiens
ataaaaaaatatataca

SEQ ID NO: 5569254 - DNA, 20 bp, Homo sapiens
ataaaaaaatatatacagat

SEQ ID NO: 5569255 - DNA, 13 bp, Homo sapiens
ataaaaaaatgat

SEQ ID NO: 5569256 - DNA, 15 bp, Homo sapiens
ataaaaaaatgatgc

SEQ ID NO: 5569257 - DNA, 17 bp, Homo sapiens
ataaaaaaatgatgcag

SEQ ID NO: 5569258 - DNA, 20 bp, Homo sapiens
ataaaaaacatttattttca

SEQ ID NO: 5569259 - DNA, 10 bp, Homo sapiens
ataaaaaaga

SEQ ID NO: 5569260 - DNA, 13 bp, Homo sapiens
ataaaaaagaaaa

SEQ ID NO: 5569261 - DNA, 14 bp, Homo sapiens
ataaaaaagaaaga

SEQ ID NO: 5569262 - DNA, 14 bp, Homo sapiens
ataaaaaagaaatc

SEQ ID NO: 5569263 - DNA, 18 bp, Homo sapiens
ataaaaaagaagcacttt

SEQ ID NO: 5569264 - DNA, 15 bp, Homo sapiens
ataaaaaagatccca

SEQ ID NO: 5569265 - DNA, 17 bp, Homo sapiens
ataaaaaagatcccaaa

SEQ ID NO: 5569266 - DNA, 16 bp, Homo sapiens
ataaaaaagattctac

SEQ ID NO: 5569267 - DNA, 15 bp, Homo sapiens
ataaaaaagtctcta

SEQ ID NO: 5569268 - DNA, 18 bp, Homo sapiens
ataaaaaagtctctattt

SEQ ID NO: 5569269 - DNA, 14 bp, Homo sapiens
ataaaaaatagaca

SEQ ID NO: 5569270 - DNA, 15 bp, Homo sapiens
ataaaaaatagacat

SEQ ID NO: 5569271 - DNA, 14 bp, Homo sapiens
ataaaaaatatatg

SEQ ID NO: 5569272 - DNA, 13 bp, Homo sapiens
ataaaaaatctga

SEQ ID NO: 5569273 - DNA, 11 bp, Homo sapiens
ataaaaaatgg

SEQ ID NO: 5569274 - DNA, 21 bp, Homo sapiens
ataaaaaatggttaatgacaa

SEQ ID NO: 5569275 - DNA, 16 bp, Homo sapiens
ataaaaaatgtaacat

SEQ ID NO: 5569276 - DNA, 15 bp, Homo sapiens
ataaaaaattatgac

SEQ ID NO: 5569277 - DNA, 18 bp, Homo sapiens
ataaaaaattttgtaatt

SEQ ID NO: 5569278 - DNA, 21 bp, Homo sapiens
ataaaaaattttgtaattttc

SEQ ID NO: 5569279 - DNA, 15 bp, Homo sapiens
ataaaaacaaaaaca

SEQ ID NO: 5569280 - DNA, 12 bp, Homo sapiens
ataaaaaccaga

SEQ ID NO: 5569281 - DNA, 13 bp, Homo sapiens
ataaaaaccagaa

SEQ ID NO: 5569282 - DNA, 14 bp, Homo sapiens
ataaaaaccagaat

SEQ ID NO: 5569283 - DNA, 18 bp, Homo sapiens
ataaaaaccataaacatt

SEQ ID NO: 5569284 - DNA, 16 bp, Homo sapiens
ataaaaacccacaaaa

SEQ ID NO: 5569285 - DNA, 14 bp, Homo sapiens
ataaaaaccttcca

SEQ ID NO: 5569286 - DNA, 12 bp, Homo sapiens
ataaaaactaaa

SEQ ID NO: 5569287 - DNA, 19 bp, Homo sapiens
ataaaaactcctgggctta

SEQ ID NO: 5569288 - DNA, 16 bp, Homo sapiens
ataaaaactgatttgc

SEQ ID NO: 5569289 - DNA, 13 bp, Homo sapiens
ataaaaacttgaa

SEQ ID NO: 5569290 - DNA, 14 bp, Homo sapiens
ataaaaacttttga

SEQ ID NO: 5569291 - DNA, 13 bp, Homo sapiens
ataaaaagaaatt

SEQ ID NO: 5569292 - DNA, 21 bp, Homo sapiens
ataaaaagactattaagagca

SEQ ID NO: 5569293 - DNA, 11 bp, Homo sapiens
ataaaaagaga

SEQ ID NO: 5569294 - DNA, 22 bp, Homo sapiens
ataaaaagaggatgatttcaga

SEQ ID NO: 5569295 - DNA, 19 bp, Homo sapiens
ataaaaagataatctcagt

SEQ ID NO: 5569296 - DNA, 18 bp, Homo sapiens
ataaaaagatcactttct

SEQ ID NO: 5569297 - DNA, 16 bp, Homo sapiens
ataaaaagcaaaacaa

SEQ ID NO: 5569298 - DNA, 18 bp, Homo sapiens
ataaaaagcagaatttta

SEQ ID NO: 5569299 - DNA, 20 bp, Homo sapiens
ataaaaagcagaattttaat

SEQ ID NO: 5569300 - DNA, 13 bp, Homo sapiens
ataaaaagcctct

SEQ ID NO: 5569301 - DNA, 20 bp, Homo sapiens
ataaaaagcctgcaatttca

SEQ ID NO: 5569302 - DNA, 22 bp, Homo sapiens
ataaaaagcctgcaatttcata

SEQ ID NO: 5569303 - DNA, 23 bp, Homo sapiens
ataaaaaggaagtggggacagat

SEQ ID NO: 5569304 - DNA, 21 bp, Homo sapiens
ataaaaaggcacctataaaac

SEQ ID NO: 5569305 - DNA, 13 bp, Homo sapiens
ataaaaaggttta

SEQ ID NO: 5569306 - DNA, 17 bp, Homo sapiens
ataaaaagtcacaatga

SEQ ID NO: 5569307 - DNA, 18 bp, Homo sapiens
ataaaaagtgaacttttg

SEQ ID NO: 5569308 - DNA, 20 bp, Homo sapiens
ataaaaagtgacacagcagc

SEQ ID NO: 5569309 - DNA, 12 bp, Homo sapiens
ataaaaagttaa

SEQ ID NO: 5569310 - DNA, 11 bp, Homo sapiens
ataaaaagttc

SEQ ID NO: 5569311 - DNA, 23 bp, Homo sapiens
ataaaaagtttcacaggtcaata

SEQ ID NO: 5569312 - DNA, 19 bp, Homo sapiens
ataaaaataaaaaagatcc

SEQ ID NO: 5569313 - DNA, 16 bp, Homo sapiens
ataaaaataaaagaga

SEQ ID NO: 5569314 - DNA, 17 bp, Homo sapiens
ataaaaataaagttttt

SEQ ID NO: 5569315 - DNA, 12 bp, Homo sapiens
ataaaaataata

SEQ ID NO: 5569316 - DNA, 18 bp, Homo sapiens
ataaaaataatatatgct

SEQ ID NO: 5569317 - DNA, 13 bp, Homo sapiens
ataaaaatacaca

SEQ ID NO: 5569318 - DNA, 14 bp, Homo sapiens
ataaaaatacacat

SEQ ID NO: 5569319 - DNA, 17 bp, Homo sapiens
ataaaaatacacatgaa

SEQ ID NO: 5569320 - DNA, 13 bp, Homo sapiens
ataaaaatataaa

SEQ ID NO: 5569321 - DNA, 17 bp, Homo sapiens
ataaaaatataaattgt

SEQ ID NO: 5569322 - DNA, 15 bp, Homo sapiens
ataaagtactgcaaa

SEQ ID NO: 5569323 - DNA, 13 bp, Homo sapiens
ataaagtacttga

SEQ ID NO: 5569324 - DNA, 13 bp, Homo sapiens
ataaagtagaaat

SEQ ID NO: 5569325 - DNA, 21 bp, Homo sapiens
ataaagtagcaaaacaaattc

SEQ ID NO: 5569326 - DNA, 18 bp, Homo sapiens
ataaagtaggaaagaatt

SEQ ID NO: 5569327 - DNA, 20 bp, Homo sapiens
ataaagtaggaaagaatttg

SEQ ID NO: 5569328 - DNA, 14 bp, Homo sapiens
ataaagtagttatt

SEQ ID NO: 5569329 - DNA, 19 bp, Homo sapiens
ataaagtagttattttata

SEQ ID NO: 5569330 - DNA, 17 bp, Homo sapiens
ataaagtataatgttta

SEQ ID NO: 5569331 - DNA, 13 bp, Homo sapiens
ataaagtatatat

SEQ ID NO: 5569332 - DNA, 17 bp, Homo sapiens
ataaagtatattgaaag

SEQ ID NO: 5569333 - DNA, 14 bp, Homo sapiens
ataaagtatctaca

SEQ ID NO: 5569334 - DNA, 21 bp, Homo sapiens
ataaagtatgaatatttcatt

SEQ ID NO: 5569335 - DNA, 20 bp, Homo sapiens
ataaagtattccaccttaaa

SEQ ID NO: 5569336 - DNA, 19 bp, Homo sapiens
ataaagtattgtctaccag

SEQ ID NO: 5569337 - DNA, 19 bp, Homo sapiens
ataaagtatttaattagtg

SEQ ID NO: 5569338 - DNA, 22 bp, Homo sapiens
ataaagtatttttataatgact

SEQ ID NO: 5569339 - DNA, 15 bp, Homo sapiens
ataaagtcaaatcaa

SEQ ID NO: 5569340 - DNA, 19 bp, Homo sapiens
ataaagtcaggacctggct

SEQ ID NO: 5569341 - DNA, 22 bp, Homo sapiens
ataaagtcattaacaagaaaca

SEQ ID NO: 5569342 - DNA, 21 bp, Homo sapiens
ataaagtcctgaacctttcaa

SEQ ID NO: 5569343 - DNA, 22 bp, Homo sapiens
ataaagtcctgaacctttcaaa

SEQ ID NO: 5569344 - DNA, 14 bp, Homo sapiens
ataaagtctaagca

SEQ ID NO: 5569345 - DNA, 21 bp, Homo sapiens
ataaagtctaagcaagatgtt

SEQ ID NO: 5569346 - DNA, 18 bp, Homo sapiens
ataaagtctgagaaatag

SEQ ID NO: 5569347 - DNA, 19 bp, Homo sapiens
ataaagtgaacagatttta

SEQ ID NO: 5569348 - DNA, 12 bp, Homo sapiens
ataaagtgaata

SEQ ID NO: 5569349 - DNA, 13 bp, Homo sapiens
ataaagtgactga

SEQ ID NO: 5569350 - DNA, 20 bp, Homo sapiens
ataaagtgatctgtgttcaa

SEQ ID NO: 5569351 - DNA, 16 bp, Homo sapiens
ataaagtgcaaacaga

SEQ ID NO: 5569352 - DNA, 21 bp, Homo sapiens
ataaagtgcaaacagaagtgc

SEQ ID NO: 5569353 - DNA, 14 bp, Homo sapiens
ataaagtgcaattg

SEQ ID NO: 5569354 - DNA, 16 bp, Homo sapiens
ataaagtgcaattgca

SEQ ID NO: 5569355 - DNA, 22 bp, Homo sapiens
ataaagtgctgcggagcaagag

SEQ ID NO: 5569356 - DNA, 23 bp, Homo sapiens
ataaagtgctgcggagcaagagg

SEQ ID NO: 5569357 - DNA, 16 bp, Homo sapiens
ataaagtgctttaaaa

SEQ ID NO: 5569358 - DNA, 24 bp, Homo sapiens
ataaagtggcatttctttatgaaa

SEQ ID NO: 5569359 - DNA, 19 bp, Homo sapiens
ataaagtgtaacaattgtg

SEQ ID NO: 5569360 - DNA, 13 bp, Homo sapiens
ataaagtgtaata

SEQ ID NO: 5569361 - DNA, 15 bp, Homo sapiens
ataaagtgtgtgtgc

SEQ ID NO: 5569362 - DNA, 11 bp, Homo sapiens
ataaagttaaa

SEQ ID NO: 5569363 - DNA, 17 bp, Homo sapiens
ataaagttacttgaatt

SEQ ID NO: 5569364 - DNA, 16 bp, Homo sapiens
ataaagttagaatcta

SEQ ID NO: 5569365 - DNA, 13 bp, Homo sapiens
ataaagttattaa

SEQ ID NO: 5569366 - DNA, 14 bp, Homo sapiens
ataaagttccttaa

SEQ ID NO: 5569367 - DNA, 22 bp, Homo sapiens
ataaagttctctgtaattacaa

SEQ ID NO: 5569368 - DNA, 21 bp, Homo sapiens
ataaagttctgagtgttttta

SEQ ID NO: 5569369 - DNA, 23 bp, Homo sapiens
ataaagttgagagacagtaacac

SEQ ID NO: 5569370 - DNA, 20 bp, Homo sapiens
ataaagttgataaagatttt

SEQ ID NO: 5569371 - DNA, 20 bp, Homo sapiens
ataaagttgtatttcaaata

SEQ ID NO: 5569372 - DNA, 15 bp, Homo sapiens
ataaagttgttgcat

SEQ ID NO: 5569373 - DNA, 14 bp, Homo sapiens
ataaagttgtttta

SEQ ID NO: 5569374 - DNA, 13 bp, Homo sapiens
ataaagtttacaa

SEQ ID NO: 5569375 - DNA, 14 bp, Homo sapiens
ataaagtttacaag

SEQ ID NO: 5569376 - DNA, 23 bp, Homo sapiens
ataaagtttatcagatattttca

SEQ ID NO: 5569377 - DNA, 13 bp, Homo sapiens
ataaagtttctca

SEQ ID NO: 5569378 - DNA, 22 bp, Homo sapiens
ataaagtttgatcttcctctgc

SEQ ID NO: 5569379 - DNA, 18 bp, Homo sapiens
ataaagtttgctttcaga

SEQ ID NO: 5569380 - DNA, 12 bp, Homo sapiens
ataaagtttgta

SEQ ID NO: 5569381 - DNA, 22 bp, Homo sapiens
ataaagtttgtaagaaaatgtt

SEQ ID NO: 5569382 - DNA, 19 bp, Homo sapiens
ataaagtttgtacactttc

SEQ ID NO: 5569383 - DNA, 18 bp, Homo sapiens
ataaagttttatatatta

SEQ ID NO: 5569384 - DNA, 20 bp, Homo sapiens
ataaagttttatatattata

SEQ ID NO: 5569385 - DNA, 23 bp, Homo sapiens
ataaagttttgccccatgataaa

SEQ ID NO: 5569386 - DNA, 22 bp, Homo sapiens
ataaagtttttttccttaaaaa

SEQ ID NO: 5569387 - DNA, 13 bp, Homo sapiens
ataaataaaaata

SEQ ID NO: 5569388 - DNA, 17 bp, Homo sapiens
ataaataaaaatggata

SEQ ID NO: 5569389 - DNA, 14 bp, Homo sapiens
ataaataaaactga

SEQ ID NO: 5569390 - DNA, 16 bp, Homo sapiens
ataaataaaactgaat

SEQ ID NO: 5569391 - DNA, 14 bp, Homo sapiens
ataaataaaagata

SEQ ID NO: 5569392 - DNA, 18 bp, Homo sapiens
ataaataaaagatagcaa

SEQ ID NO: 5569393 - DNA, 12 bp, Homo sapiens
ataaataaaagc

SEQ ID NO: 5569394 - DNA, 20 bp, Homo sapiens
ataaataaaatcatgtagtt

SEQ ID NO: 5569395 - DNA, 14 bp, Homo sapiens
ataaataaaatgac

SEQ ID NO: 5569396 - DNA, 14 bp, Homo sapiens
ataaataaaatgga

SEQ ID NO: 5569397 - DNA, 19 bp, Homo sapiens
ataaataaaattcatttct

SEQ ID NO: 5569398 - DNA, 17 bp, Homo sapiens
ataaataaacttcaaca

SEQ ID NO: 5569399 - DNA, 16 bp, Homo sapiens
ataaataaagaagaaa

SEQ ID NO: 5569400 - DNA, 18 bp, Homo sapiens
ataaataaagaagaaaat

SEQ ID NO: 5569401 - DNA, 20 bp, Homo sapiens
ataaataaagaagaaaataa

SEQ ID NO: 5569402 - DNA, 15 bp, Homo sapiens
ataaataaataaata

SEQ ID NO: 5569403 - DNA, 13 bp, Homo sapiens
ataaataaatata

SEQ ID NO: 5569404 - DNA, 15 bp, Homo sapiens
ataaataaatatata

SEQ ID NO: 5569405 - DNA, 13 bp, Homo sapiens
ataaataacaaaa

SEQ ID NO: 5569406 - DNA, 12 bp, Homo sapiens
ataaataacttt

SEQ ID NO: 5569407 - DNA, 14 bp, Homo sapiens
ataaataatattat

SEQ ID NO: 5569408 - DNA, 19 bp, Homo sapiens
ataaataatattatattgt

SEQ ID NO: 5569409 - DNA, 21 bp, Homo sapiens
ataaataatcggcccacagct

SEQ ID NO: 5569410 - DNA, 15 bp, Homo sapiens
ataaataatctacat

SEQ ID NO: 5569411 - DNA, 15 bp, Homo sapiens
ataaataatctgtac

SEQ ID NO: 5569412 - DNA, 18 bp, Homo sapiens
ataaataattgaaacaat

SEQ ID NO: 5569413 - DNA, 12 bp, Homo sapiens
ataaataatttt

SEQ ID NO: 5569414 - DNA, 13 bp, Homo sapiens
ataaataatttta

SEQ ID NO: 5569415 - DNA, 15 bp, Homo sapiens
ataaataattttaat

SEQ ID NO: 5569416 - DNA, 13 bp, Homo sapiens
ataaatacaaatc

SEQ ID NO: 5569417 - DNA, 21 bp, Homo sapiens
ataaatacaaatctgtataaa

SEQ ID NO: 5569418 - DNA, 13 bp, Homo sapiens
ataaatacagcta

SEQ ID NO: 5569419 - DNA, 19 bp, Homo sapiens
ataaatacatacggtcagg

SEQ ID NO: 5569420 - DNA, 15 bp, Homo sapiens
ataaatacatttata

SEQ ID NO: 5569421 - DNA, 18 bp, Homo sapiens
ataaatacctcttagctg

SEQ ID NO: 5569422 - DNA, 16 bp, Homo sapiens
ataaatactaaatatg

SEQ ID NO: 5569423 - DNA, 17 bp, Homo sapiens
ataaatactgacaatgt

SEQ ID NO: 5569424 - DNA, 14 bp, Homo sapiens
ataaatagaactat

SEQ ID NO: 5569425 - DNA, 15 bp, Homo sapiens
ataaatagaactatc

SEQ ID NO: 5569426 - DNA, 18 bp, Homo sapiens
ataaatagcatttggaaa

SEQ ID NO: 5569427 - DNA, 20 bp, Homo sapiens
ataaatagccttcaaaaaga

SEQ ID NO: 5569428 - DNA, 14 bp, Homo sapiens
ataaatagctatat

SEQ ID NO: 5569429 - DNA, 17 bp, Homo sapiens
ataaatagctgaaaact

SEQ ID NO: 5569430 - DNA, 20 bp, Homo sapiens
ataaatagctgaaaactaat

SEQ ID NO: 5569431 - DNA, 22 bp, Homo sapiens
ataaataggtcaatacaaatgt

SEQ ID NO: 5569432 - DNA, 15 bp, Homo sapiens
ataaatagtaaataa

SEQ ID NO: 5569433 - DNA, 15 bp, Homo sapiens
ataaatagtagaaaa

SEQ ID NO: 5569434 - DNA, 22 bp, Homo sapiens
ataaatagtgaaaattttattg

SEQ ID NO: 5569435 - DNA, 20 bp, Homo sapiens
ataaatataatttataagca

SEQ ID NO: 5569436 - DNA, 17 bp, Homo sapiens
ataaatatactaataaa

SEQ ID NO: 5569437 - DNA, 23 bp, Homo sapiens
ataaatatactaataaaaaggtt

SEQ ID NO: 5569438 - DNA, 19 bp, Homo sapiens
ataaatatacttctgctgt

SEQ ID NO: 5569439 - DNA, 17 bp, Homo sapiens
ataaatatagttgtctt

SEQ ID NO: 5569440 - DNA, 12 bp, Homo sapiens
ataaatatatat

SEQ ID NO: 5569441 - DNA, 16 bp, Homo sapiens
ataaatatatataaag

SEQ ID NO: 5569442 - DNA, 15 bp, Homo sapiens
ataaatatatatgat

SEQ ID NO: 5569443 - DNA, 14 bp, Homo sapiens
ataaatatatattt

SEQ ID NO: 5569444 - DNA, 19 bp, Homo sapiens
ataaatatatatttttcaa

SEQ ID NO: 5569445 - DNA, 21 bp, Homo sapiens
ataaatatatatttttcaaat

SEQ ID NO: 5569446 - DNA, 18 bp, Homo sapiens
ataaatatattattactt

SEQ ID NO: 5569447 - DNA, 23 bp, Homo sapiens
ataaatatattattacttgtaaa

SEQ ID NO: 5569448 - DNA, 15 bp, Homo sapiens
ataaatatattgtat

SEQ ID NO: 5569449 - DNA, 21 bp, Homo sapiens
ataaatatcagtattctgaca

SEQ ID NO: 5569450 - DNA, 21 bp, Homo sapiens
ataaatatcctttaattgatc

SEQ ID NO: 5569451 - DNA, 13 bp, Homo sapiens
ataaatatctatt

SEQ ID NO: 5569452 - DNA, 13 bp, Homo sapiens
ataaatatgaaag

SEQ ID NO: 5569453 - DNA, 14 bp, Homo sapiens
ataaatatgaagct

SEQ ID NO: 5569454 - DNA, 14 bp, Homo sapiens
ataaatatgagtgc

SEQ ID NO: 5569455 - DNA, 13 bp, Homo sapiens
ataaatatgcagt

SEQ ID NO: 5569456 - DNA, 14 bp, Homo sapiens
ataaatatgtaata

SEQ ID NO: 5569457 - DNA, 12 bp, Homo sapiens
ataaatatgtga

SEQ ID NO: 5569458 - DNA, 14 bp, Homo sapiens
ataaatatgtgaaa

SEQ ID NO: 5569459 - DNA, 15 bp, Homo sapiens
ataaatatgtgaaaa

SEQ ID NO: 5569460 - DNA, 18 bp, Homo sapiens
ataaatatgtttcacaca

SEQ ID NO: 5569461 - DNA, 12 bp, Homo sapiens
ataaatattata

SEQ ID NO: 5569462 - DNA, 22 bp, Homo sapiens
ataaatatttatgcagaaggta

SEQ ID NO: 5569463 - DNA, 20 bp, Homo sapiens
ataaatatttatgtagatgt

SEQ ID NO: 5569464 - DNA, 22 bp, Homo sapiens
ataaatatttggtaattctgtg

SEQ ID NO: 5569465 - DNA, 18 bp, Homo sapiens
ataaatattttacagtat

SEQ ID NO: 5569466 - DNA, 18 bp, Homo sapiens
ataaatatttttgccata

SEQ ID NO: 5569467 - DNA, 13 bp, Homo sapiens
ataaatcaaaatt

SEQ ID NO: 5569468 - DNA, 19 bp, Homo sapiens
ataaatcaatggttcaagt

SEQ ID NO: 5569469 - DNA, 15 bp, Homo sapiens
ataaatcacagatgc

SEQ ID NO: 5569470 - DNA, 15 bp, Homo sapiens
ataaatcagaaagtt

SEQ ID NO: 5569471 - DNA, 15 bp, Homo sapiens
ataaatcagactctt

SEQ ID NO: 5569472 - DNA, 18 bp, Homo sapiens
ataaatcagagagcaagg

SEQ ID NO: 5569473 - DNA, 15 bp, Homo sapiens
ataaatcagtatttt

SEQ ID NO: 5569474 - DNA, 15 bp, Homo sapiens
ataaatcagtcaagc

SEQ ID NO: 5569475 - DNA, 21 bp, Homo sapiens
ataaatcagtgggatttggta

SEQ ID NO: 5569476 - DNA, 12 bp, Homo sapiens
ataaatcataaa

SEQ ID NO: 5569477 - DNA, 15 bp, Homo sapiens
ataaatcatattgat

SEQ ID NO: 5569478 - DNA, 18 bp, Homo sapiens
ataaatcatattgatgaa

SEQ ID NO: 5569479 - DNA, 21 bp, Homo sapiens
ataaatcatattgatgaaaag

SEQ ID NO: 5569480 - DNA, 14 bp, Homo sapiens
ataaatcatgggca

SEQ ID NO: 5569481 - DNA, 16 bp, Homo sapiens
ataaatcatgggcatt

SEQ ID NO: 5569482 - DNA, 21 bp, Homo sapiens
ataaatcatgttgttgtgtgt

SEQ ID NO: 5569483 - DNA, 21 bp, Homo sapiens
ataaatcattcttactaaaaa

SEQ ID NO: 5569484 - DNA, 15 bp, Homo sapiens
ataaatcatttcagt

SEQ ID NO: 5569485 - DNA, 17 bp, Homo sapiens
ataaatccaaaacaaac

SEQ ID NO: 5569486 - DNA, 18 bp, Homo sapiens
ataaatccacccatgtta

SEQ ID NO: 5569487 - DNA, 20 bp, Homo sapiens
ataaatccagtgacctctct

SEQ ID NO: 5569488 - DNA, 17 bp, Homo sapiens
ataaatccgcttctcct

SEQ ID NO: 5569489 - DNA, 16 bp, Homo sapiens
ataaatcgcttttgat

SEQ ID NO: 5569490 - DNA, 19 bp, Homo sapiens
ataaatcgcttttgataat

SEQ ID NO: 5569491 - DNA, 21 bp, Homo sapiens
ataaatctaataattattcat

SEQ ID NO: 5569492 - DNA, 20 bp, Homo sapiens
ataaatctaggatgtgatga

SEQ ID NO: 5569493 - DNA, 17 bp, Homo sapiens
ataaatctctccagcta

SEQ ID NO: 5569494 - DNA, 13 bp, Homo sapiens
ataaatctgaagt

SEQ ID NO: 5569495 - DNA, 16 bp, Homo sapiens
ataaatctgacccagt

SEQ ID NO: 5569496 - DNA, 19 bp, Homo sapiens
ataaatctgacccagtgcc

SEQ ID NO: 5569497 - DNA, 17 bp, Homo sapiens
ataaatctgccatttca

SEQ ID NO: 5569498 - DNA, 12 bp, Homo sapiens
ataaatctgtct

SEQ ID NO: 5569499 - DNA, 21 bp, Homo sapiens
ataaatctgtgaacttgaaat

SEQ ID NO: 5569500 - DNA, 13 bp, Homo sapiens
ataaatcttaaaa

SEQ ID NO: 5569501 - DNA, 20 bp, Homo sapiens
ataagagagatgagaaagct

SEQ ID NO: 5569502 - DNA, 14 bp, Homo sapiens
ataagagcatgaaa

SEQ ID NO: 5569503 - DNA, 22 bp, Homo sapiens
ataagagcttccaattttcctt

SEQ ID NO: 5569504 - DNA, 20 bp, Homo sapiens
ataagaggactgtagtttaa

SEQ ID NO: 5569505 - DNA, 21 bp, Homo sapiens
ataagaggctgataattccag

SEQ ID NO: 5569506 - DNA, 18 bp, Homo sapiens
ataagagggcatatacag

SEQ ID NO: 5569507 - DNA, 18 bp, Homo sapiens
ataagagggctttttaaa

SEQ ID NO: 5569508 - DNA, 22 bp, Homo sapiens
ataagagggctttttaaatttg

SEQ ID NO: 5569509 - DNA, 23 bp, Homo sapiens
ataagagtaacagtcatcattta

SEQ ID NO: 5569510 - DNA, 15 bp, Homo sapiens
ataagagtctccttc

SEQ ID NO: 5569511 - DNA, 15 bp, Homo sapiens
ataagagtgtaacat

SEQ ID NO: 5569512 - DNA, 18 bp, Homo sapiens
ataagagttacttccctt

SEQ ID NO: 5569513 - DNA, 22 bp, Homo sapiens
ataagagttgctttgccagagc

SEQ ID NO: 5569514 - DNA, 23 bp, Homo sapiens
ataagagttgctttgccagagca

SEQ ID NO: 5569515 - DNA, 17 bp, Homo sapiens
ataagataaaataaaat

SEQ ID NO: 5569516 - DNA, 16 bp, Homo sapiens
ataagataaaatgatg

SEQ ID NO: 5569517 - DNA, 18 bp, Homo sapiens
ataagataaaatgatgtt

SEQ ID NO: 5569518 - DNA, 16 bp, Homo sapiens
ataagatacacagctc

SEQ ID NO: 5569519 - DNA, 18 bp, Homo sapiens
ataagatattctttacaa

SEQ ID NO: 5569520 - DNA, 19 bp, Homo sapiens
ataagatcctagatcctaa

SEQ ID NO: 5569521 - DNA, 15 bp, Homo sapiens
ataagatcttttatt

SEQ ID NO: 5569522 - DNA, 17 bp, Homo sapiens
ataagatgactgtgttg

SEQ ID NO: 5569523 - DNA, 19 bp, Homo sapiens
ataagatgtattctttata

SEQ ID NO: 5569524 - DNA, 20 bp, Homo sapiens
ataagattagaatgaaaatt

SEQ ID NO: 5569525 - DNA, 21 bp, Homo sapiens
ataagattcatatttacttct

SEQ ID NO: 5569526 - DNA, 12 bp, Homo sapiens
ataagattctaa

SEQ ID NO: 5569527 - DNA, 13 bp, Homo sapiens
ataagattctaac

SEQ ID NO: 5569528 - DNA, 15 bp, Homo sapiens
ataagattgtgaagg

SEQ ID NO: 5569529 - DNA, 13 bp, Homo sapiens
ataagatttaatt

SEQ ID NO: 5569530 - DNA, 15 bp, Homo sapiens
ataagatttttcaaa

SEQ ID NO: 5569531 - DNA, 17 bp, Homo sapiens
ataagatttttcaaaat

SEQ ID NO: 5569532 - DNA, 10 bp, Homo sapiens
ataagcaaaa

SEQ ID NO: 5569533 - DNA, 20 bp, Homo sapiens
ataagcaaaaacaaaaagaa

SEQ ID NO: 5569534 - DNA, 14 bp, Homo sapiens
ataagcaaaatcct

SEQ ID NO: 5569535 - DNA, 21 bp, Homo sapiens
ataagcaaaatgaaaagagaa

SEQ ID NO: 5569536 - DNA, 21 bp, Homo sapiens
ataagcaagaaggcaaaaata

SEQ ID NO: 5569537 - DNA, 16 bp, Homo sapiens
ataagcaagacagtgg

SEQ ID NO: 5569538 - DNA, 16 bp, Homo sapiens
ataagcacaccaagtt

SEQ ID NO: 5569539 - DNA, 15 bp, Homo sapiens
ataagcacagacaat

SEQ ID NO: 5569540 - DNA, 18 bp, Homo sapiens
ataagcactcctttaaag

SEQ ID NO: 5569541 - DNA, 14 bp, Homo sapiens
ataagcactgtgct

SEQ ID NO: 5569542 - DNA, 14 bp, Homo sapiens
ataagcacttgaat

SEQ ID NO: 5569543 - DNA, 15 bp, Homo sapiens
ataagcacttgcctg

SEQ ID NO: 5569544 - DNA, 16 bp, Homo sapiens
ataagcacttgcctgg

SEQ ID NO: 5569545 - DNA, 19 bp, Homo sapiens
ataagcacttgcctggaat

SEQ ID NO: 5569546 - DNA, 20 bp, Homo sapiens
ataagcacttgcctggaata

SEQ ID NO: 5569547 - DNA, 16 bp, Homo sapiens
ataagcagatttaaca

SEQ ID NO: 5569548 - DNA, 16 bp, Homo sapiens
ataagcaggtggatct

SEQ ID NO: 5569549 - DNA, 22 bp, Homo sapiens
ataagcaggtggatctatttca

SEQ ID NO: 5569550 - DNA, 17 bp, Homo sapiens
ataagcataaaagatca

SEQ ID NO: 5569551 - DNA, 19 bp, Homo sapiens
ataagcataagaccaatct

SEQ ID NO: 5569552 - DNA, 16 bp, Homo sapiens
ataagcatcaaactct

SEQ ID NO: 5569553 - DNA, 20 bp, Homo sapiens
ataagcattgacttgccgtc

SEQ ID NO: 5569554 - DNA, 20 bp, Homo sapiens
ataagcattgctcaagagga

SEQ ID NO: 5569555 - DNA, 22 bp, Homo sapiens
ataagccaaaaaatgcttgctt

SEQ ID NO: 5569556 - DNA, 14 bp, Homo sapiens
ataagccaattttt

SEQ ID NO: 5569557 - DNA, 20 bp, Homo sapiens
ataagccagtgttgcctaag

SEQ ID NO: 5569558 - DNA, 17 bp, Homo sapiens
ataagccatagccccag

SEQ ID NO: 5569559 - DNA, 16 bp, Homo sapiens
ataagccatttctact

SEQ ID NO: 5569560 - DNA, 21 bp, Homo sapiens
ataagcccaaatggctctgtg

SEQ ID NO: 5569561 - DNA, 22 bp, Homo sapiens
ataagcccaacaagttgaagaa

SEQ ID NO: 5569562 - DNA, 17 bp, Homo sapiens
ataagcccagctctgct

SEQ ID NO: 5569563 - DNA, 16 bp, Homo sapiens
ataagcctcaggcctg

SEQ ID NO: 5569564 - DNA, 23 bp, Homo sapiens
ataagcctcaggcctggcccttt

SEQ ID NO: 5569565 - DNA, 13 bp, Homo sapiens
ataagcctgagcc

SEQ ID NO: 5569566 - DNA, 23 bp, Homo sapiens
ataagcctgagccttagctccca

SEQ ID NO: 5569567 - DNA, 18 bp, Homo sapiens
ataagccttatgaggtca

SEQ ID NO: 5569568 - DNA, 18 bp, Homo sapiens
ataagcgttaagggcaga

SEQ ID NO: 5569569 - DNA, 20 bp, Homo sapiens
ataagcgttaagggcagagt

SEQ ID NO: 5569570 - DNA, 16 bp, Homo sapiens
ataagctaaagaggct

SEQ ID NO: 5569571 - DNA, 16 bp, Homo sapiens
ataagctactgccatc

SEQ ID NO: 5569572 - DNA, 18 bp, Homo sapiens
ataagctagttgaatact

SEQ ID NO: 5569573 - DNA, 23 bp, Homo sapiens
ataagctatcacctagcagcctc

SEQ ID NO: 5569574 - DNA, 20 bp, Homo sapiens
ataagctatccgtgttgcag

SEQ ID NO: 5569575 - DNA, 15 bp, Homo sapiens
ataagctatttgatg

SEQ ID NO: 5569576 - DNA, 22 bp, Homo sapiens
ataagctatttgatgtaatact

SEQ ID NO: 5569577 - DNA, 16 bp, Homo sapiens
ataagctatttttcta

SEQ ID NO: 5569578 - DNA, 18 bp, Homo sapiens
ataagctatttttctaac

SEQ ID NO: 5569579 - DNA, 17 bp, Homo sapiens
ataagctcgagtgaatt

SEQ ID NO: 5569580 - DNA, 11 bp, Homo sapiens
ataagctctat

SEQ ID NO: 5569581 - DNA, 16 bp, Homo sapiens
ataagctgaataaagt

SEQ ID NO: 5569582 - DNA, 17 bp, Homo sapiens
ataagctggactagtgt

SEQ ID NO: 5569583 - DNA, 22 bp, Homo sapiens
ataagctgggaaaaaagttttg

SEQ ID NO: 5569584 - DNA, 16 bp, Homo sapiens
ataagctggtatcagt

SEQ ID NO: 5569585 - DNA, 19 bp, Homo sapiens
ataagctgtaatatcattt

SEQ ID NO: 5569586 - DNA, 23 bp, Homo sapiens
ataagctgtaatatcattttata

SEQ ID NO: 5569587 - DNA, 23 bp, Homo sapiens
ataagcttccaggctgcatagaa

SEQ ID NO: 5569588 - DNA, 22 bp, Homo sapiens
ataagctttctctcagaaatgc

SEQ ID NO: 5569589 - DNA, 20 bp, Homo sapiens
ataagcttttcacaaacatt

SEQ ID NO: 5569590 - DNA, 13 bp, Homo sapiens
ataagcttttctt

SEQ ID NO: 5569591 - DNA, 20 bp, Homo sapiens
ataagctttttaatgctgta

SEQ ID NO: 5569592 - DNA, 16 bp, Homo sapiens
ataaggaaaagtttaa

SEQ ID NO: 5569593 - DNA, 18 bp, Homo sapiens
ataaggaaagcaataaat

SEQ ID NO: 5569594 - DNA, 22 bp, Homo sapiens
ataaggaaatcaacttgcttat

SEQ ID NO: 5569595 - DNA, 20 bp, Homo sapiens
ataaggaaatgtgtgttgta

SEQ ID NO: 5569596 - DNA, 12 bp, Homo sapiens
ataaggaaattt

SEQ ID NO: 5569597 - DNA, 14 bp, Homo sapiens
ataaggaagagggc

SEQ ID NO: 5569598 - DNA, 10 bp, Homo sapiens
ataaggaatt

SEQ ID NO: 5569599 - DNA, 15 bp, Homo sapiens
ataaggactgcatgg

SEQ ID NO: 5569600 - DNA, 15 bp, Homo sapiens
ataaggacttcctga

SEQ ID NO: 5569601 - DNA, 14 bp, Homo sapiens
ataaggaggaaaac

SEQ ID NO: 5569602 - DNA, 22 bp, Homo sapiens
ataaggaggaggagggagaaga

SEQ ID NO: 5569603 - DNA, 23 bp, Homo sapiens
ataaggagttagaaccacagcag

SEQ ID NO: 5569604 - DNA, 18 bp, Homo sapiens
ataaggataaggagggaa

SEQ ID NO: 5569605 - DNA, 14 bp, Homo sapiens
ataaggatgacttt

SEQ ID NO: 5569606 - DNA, 18 bp, Homo sapiens
ataaggatgttgttatga

SEQ ID NO: 5569607 - DNA, 17 bp, Homo sapiens
ataaggatttattctca

SEQ ID NO: 5569608 - DNA, 18 bp, Homo sapiens
ataaggatttattctcag

SEQ ID NO: 5569609 - DNA, 11 bp, Homo sapiens
ataaggcaggg

SEQ ID NO: 5569610 - DNA, 13 bp, Homo sapiens
ataaggcagttga

SEQ ID NO: 5569611 - DNA, 14 bp, Homo sapiens
ataaggccagaaac

SEQ ID NO: 5569612 - DNA, 19 bp, Homo sapiens
ataaggccataaaacaggt

SEQ ID NO: 5569613 - DNA, 15 bp, Homo sapiens
ataaggccgagccca

SEQ ID NO: 5569614 - DNA, 20 bp, Homo sapiens
ataaggccgagcccacacca

SEQ ID NO: 5569615 - DNA, 19 bp, Homo sapiens
ataaggcctactatacatt

SEQ ID NO: 5569616 - DNA, 16 bp, Homo sapiens
ataaggcctcatcctc

SEQ ID NO: 5569617 - DNA, 16 bp, Homo sapiens
ataaggcctgccctcc

SEQ ID NO: 5569618 - DNA, 16 bp, Homo sapiens
ataaggccttaatatg

SEQ ID NO: 5569619 - DNA, 15 bp, Homo sapiens
ataaggctaaatgta

SEQ ID NO: 5569620 - DNA, 16 bp, Homo sapiens
ataaggctaaatgtaa

SEQ ID NO: 5569621 - DNA, 19 bp, Homo sapiens
ataaggctgagggctgcca

SEQ ID NO: 5569622 - DNA, 21 bp, Homo sapiens
ataaggcttaggtgccaggct

SEQ ID NO: 5569623 - DNA, 11 bp, Homo sapiens
ataaggcttca

SEQ ID NO: 5569624 - DNA, 13 bp, Homo sapiens
ataagggaaaaat

SEQ ID NO: 5569625 - DNA, 15 bp, Homo sapiens
ataagggaaaaatca

SEQ ID NO: 5569626 - DNA, 13 bp, Homo sapiens
ataagggaaaaga

SEQ ID NO: 5569627 - DNA, 13 bp, Homo sapiens
ataagggagaggg

SEQ ID NO: 5569628 - DNA, 18 bp, Homo sapiens
ataagggccctgccctgt

SEQ ID NO: 5569629 - DNA, 20 bp, Homo sapiens
ataagggccctgccctgtac

SEQ ID NO: 5569630 - DNA, 21 bp, Homo sapiens
ataaggggccttgctctgagc

SEQ ID NO: 5569631 - DNA, 21 bp, Homo sapiens
ataaggggtcaaaatttgctg

SEQ ID NO: 5569632 - DNA, 15 bp, Homo sapiens
ataaggggtggggga

SEQ ID NO: 5569633 - DNA, 20 bp, Homo sapiens
ataaggggtttgccatttga

SEQ ID NO: 5569634 - DNA, 13 bp, Homo sapiens
ataagggtagccc

SEQ ID NO: 5569635 - DNA, 14 bp, Homo sapiens
ataaggtaaaattt

SEQ ID NO: 5569636 - DNA, 21 bp, Homo sapiens
ataaggtacctttcacataga

SEQ ID NO: 5569637 - DNA, 14 bp, Homo sapiens
ataaggtataagga

SEQ ID NO: 5569638 - DNA, 22 bp, Homo sapiens
ataaggtgttttctgtgtaacc

SEQ ID NO: 5569639 - DNA, 14 bp, Homo sapiens
ataaggttgtctgt

SEQ ID NO: 5569640 - DNA, 17 bp, Homo sapiens
ataaggtttaaaaagat

SEQ ID NO: 5569641 - DNA, 23 bp, Homo sapiens
ataaggtttcctgctccagtgta

SEQ ID NO: 5569642 - DNA, 20 bp, Homo sapiens
ataaggtttcgtttctgtat

SEQ ID NO: 5569643 - DNA, 16 bp, Homo sapiens
ataagtaaacaacata

SEQ ID NO: 5569644 - DNA, 16 bp, Homo sapiens
ataagtaaagacagct

SEQ ID NO: 5569645 - DNA, 19 bp, Homo sapiens
ataagtaacactagtagct

SEQ ID NO: 5569646 - DNA, 16 bp, Homo sapiens
ataagtaacatataaa

SEQ ID NO: 5569647 - DNA, 14 bp, Homo sapiens
ataagtaagaaaat

SEQ ID NO: 5569648 - DNA, 20 bp, Homo sapiens
ataagtaagaaatttctagt

SEQ ID NO: 5569649 - DNA, 13 bp, Homo sapiens
ataagtaatgaaa

SEQ ID NO: 5569650 - DNA, 20 bp, Homo sapiens
ataagtaatgaaggcatatt

SEQ ID NO: 5569651 - DNA, 21 bp, Homo sapiens
ataagtagatctgctttctgt

SEQ ID NO: 5569652 - DNA, 13 bp, Homo sapiens
ataagtagtaaat

SEQ ID NO: 5569653 - DNA, 22 bp, Homo sapiens
ataagtagtaaatcagaaagta

SEQ ID NO: 5569654 - DNA, 19 bp, Homo sapiens
ataagtagttggtttgtat

SEQ ID NO: 5569655 - DNA, 16 bp, Homo sapiens
ataagtatataaatac

SEQ ID NO: 5569656 - DNA, 15 bp, Homo sapiens
ataagtatttataat

SEQ ID NO: 5569657 - DNA, 14 bp, Homo sapiens
ataagtatttggaa

SEQ ID NO: 5569658 - DNA, 15 bp, Homo sapiens
ataagtcaaaaggaa

SEQ ID NO: 5569659 - DNA, 23 bp, Homo sapiens
ataagtcaaaataatctgaaatg

SEQ ID NO: 5569660 - DNA, 16 bp, Homo sapiens
ataagtcaacagtaaa

SEQ ID NO: 5569661 - DNA, 13 bp, Homo sapiens
ataagtcaagcac

SEQ ID NO: 5569662 - DNA, 16 bp, Homo sapiens
ataagtcaagcacatg

SEQ ID NO: 5569663 - DNA, 19 bp, Homo sapiens
ataagtcaagcacatgtaa

SEQ ID NO: 5569664 - DNA, 16 bp, Homo sapiens
ataagtcatgttcctt

SEQ ID NO: 5569665 - DNA, 14 bp, Homo sapiens
ataagtcattgaaa

SEQ ID NO: 5569666 - DNA, 16 bp, Homo sapiens
ataagtcattgaaatt

SEQ ID NO: 5569667 - DNA, 16 bp, Homo sapiens
ataagtcattgtatgt

SEQ ID NO: 5569668 - DNA, 23 bp, Homo sapiens
ataagtccatgaatgttcatata

SEQ ID NO: 5569669 - DNA, 11 bp, Homo sapiens
ataagtctgat

SEQ ID NO: 5569670 - DNA, 17 bp, Homo sapiens
ataagtctgattctctt

SEQ ID NO: 5569671 - DNA, 13 bp, Homo sapiens
ataagtctgattt

SEQ ID NO: 5569672 - DNA, 14 bp, Homo sapiens
ataagtgaaaatct

SEQ ID NO: 5569673 - DNA, 18 bp, Homo sapiens
ataagtgaagggaaagat

SEQ ID NO: 5569674 - DNA, 15 bp, Homo sapiens
ataagtgaagtgata

SEQ ID NO: 5569675 - DNA, 14 bp, Homo sapiens
ataagtgaatattt

SEQ ID NO: 5569676 - DNA, 18 bp, Homo sapiens
ataagtgaatctaataaa

SEQ ID NO: 5569677 - DNA, 20 bp, Homo sapiens
ataagtgaatctaataaaat

SEQ ID NO: 5569678 - DNA, 14 bp, Homo sapiens
ataagtgaatttat

SEQ ID NO: 5569679 - DNA, 16 bp, Homo sapiens
ataatggaaaatgcca

SEQ ID NO: 5569680 - DNA, 17 bp, Homo sapiens
ataatggaagagaaatc

SEQ ID NO: 5569681 - DNA, 19 bp, Homo sapiens
ataatggacagattaatat

SEQ ID NO: 5569682 - DNA, 12 bp, Homo sapiens
ataatggactct

SEQ ID NO: 5569683 - DNA, 18 bp, Homo sapiens
ataatggagaatcacttt

SEQ ID NO: 5569684 - DNA, 22 bp, Homo sapiens
ataatggagaatcacttttcta

SEQ ID NO: 5569685 - DNA, 14 bp, Homo sapiens
ataatggccctgta

SEQ ID NO: 5569686 - DNA, 17 bp, Homo sapiens
ataatggccctgtagct

SEQ ID NO: 5569687 - DNA, 23 bp, Homo sapiens
ataatggcctcttaaaaattatc

SEQ ID NO: 5569688 - DNA, 15 bp, Homo sapiens
ataatgggagacagt

SEQ ID NO: 5569689 - DNA, 19 bp, Homo sapiens
ataatgggattagaaacaa

SEQ ID NO: 5569690 - DNA, 22 bp, Homo sapiens
ataatgggccactgaaatctgt

SEQ ID NO: 5569691 - DNA, 20 bp, Homo sapiens
ataatgggctgcaaaatgaa

SEQ ID NO: 5569692 - DNA, 15 bp, Homo sapiens
ataatggtaccagat

SEQ ID NO: 5569693 - DNA, 18 bp, Homo sapiens
ataatggtaccagataaa

SEQ ID NO: 5569694 - DNA, 19 bp, Homo sapiens
ataatggtaccagataaaa

SEQ ID NO: 5569695 - DNA, 18 bp, Homo sapiens
ataatggtcccatccagg

SEQ ID NO: 5569696 - DNA, 17 bp, Homo sapiens
ataatggtgatgtcata

SEQ ID NO: 5569697 - DNA, 19 bp, Homo sapiens
ataatggtgttactaaagt

SEQ ID NO: 5569698 - DNA, 16 bp, Homo sapiens
ataatggttactcatt

SEQ ID NO: 5569699 - DNA, 18 bp, Homo sapiens
ataatggttactcatttt

SEQ ID NO: 5569700 - DNA, 22 bp, Homo sapiens
ataatggtttactgctgtcatt

SEQ ID NO: 5569701 - DNA, 14 bp, Homo sapiens
ataatggtttcaaa

SEQ ID NO: 5569702 - DNA, 13 bp, Homo sapiens
ataatgtaactga

SEQ ID NO: 5569703 - DNA, 20 bp, Homo sapiens
ataatgtaactgaagcataa

SEQ ID NO: 5569704 - DNA, 21 bp, Homo sapiens
ataatgtaactgaagcataaa

SEQ ID NO: 5569705 - DNA, 14 bp, Homo sapiens
ataatgtaagctct

SEQ ID NO: 5569706 - DNA, 15 bp, Homo sapiens
ataatgtaagctcta

SEQ ID NO: 5569707 - DNA, 16 bp, Homo sapiens
ataatgtaatactgta

SEQ ID NO: 5569708 - DNA, 15 bp, Homo sapiens
ataatgtaattgtaa

SEQ ID NO: 5569709 - DNA, 16 bp, Homo sapiens
ataatgtaatttagtc

SEQ ID NO: 5569710 - DNA, 21 bp, Homo sapiens
ataatgtacctattccttcag

SEQ ID NO: 5569711 - DNA, 19 bp, Homo sapiens
ataatgtactcacatataa

SEQ ID NO: 5569712 - DNA, 15 bp, Homo sapiens
ataatgtagtgcagt

SEQ ID NO: 5569713 - DNA, 14 bp, Homo sapiens
ataatgtatgaatt

SEQ ID NO: 5569714 - DNA, 19 bp, Homo sapiens
ataatgtatgaattttgta

SEQ ID NO: 5569715 - DNA, 14 bp, Homo sapiens
ataatgtattgtaa

SEQ ID NO: 5569716 - DNA, 11 bp, Homo sapiens
ataatgtattt

SEQ ID NO: 5569717 - DNA, 14 bp, Homo sapiens
ataatgtattttca

SEQ ID NO: 5569718 - DNA, 17 bp, Homo sapiens
ataatgtccatatgcta

SEQ ID NO: 5569719 - DNA, 18 bp, Homo sapiens
ataatgtctagattttga

SEQ ID NO: 5569720 - DNA, 19 bp, Homo sapiens
ataatgtctctgtgagact

SEQ ID NO: 5569721 - DNA, 10 bp, Homo sapiens
ataatgtctt

SEQ ID NO: 5569722 - DNA, 13 bp, Homo sapiens
ataatgtcttgtt

SEQ ID NO: 5569723 - DNA, 20 bp, Homo sapiens
ataatgtcttgttaatattc

SEQ ID NO: 5569724 - DNA, 16 bp, Homo sapiens
ataatgtgaaaatggt

SEQ ID NO: 5569725 - DNA, 16 bp, Homo sapiens
ataatgtgaaatatga

SEQ ID NO: 5569726 - DNA, 15 bp, Homo sapiens
ataatgtgaaatgta

SEQ ID NO: 5569727 - DNA, 18 bp, Homo sapiens
ataatgtgcagaaaatat

SEQ ID NO: 5569728 - DNA, 17 bp, Homo sapiens
ataatgtggatttccta

SEQ ID NO: 5569729 - DNA, 18 bp, Homo sapiens
ataatgtggatttcctat

SEQ ID NO: 5569730 - DNA, 19 bp, Homo sapiens
ataatgtgtagttcatgta

SEQ ID NO: 5569731 - DNA, 11 bp, Homo sapiens
ataatgtgtat

SEQ ID NO: 5569732 - DNA, 13 bp, Homo sapiens
ataatgtgtataa

SEQ ID NO: 5569733 - DNA, 20 bp, Homo sapiens
ataatgtgtctgtgttgctt

SEQ ID NO: 5569734 - DNA, 10 bp, Homo sapiens
ataatgttaa

SEQ ID NO: 5569735 - DNA, 19 bp, Homo sapiens
ataatgttaaatttgtaag

SEQ ID NO: 5569736 - DNA, 18 bp, Homo sapiens
ataatgttaaccaaggaa

SEQ ID NO: 5569737 - DNA, 15 bp, Homo sapiens
ataatgttattcatt

SEQ ID NO: 5569738 - DNA, 14 bp, Homo sapiens
ataatgttcatttt

SEQ ID NO: 5569739 - DNA, 13 bp, Homo sapiens
ataatgttcctta

SEQ ID NO: 5569740 - DNA, 14 bp, Homo sapiens
ataatgttctgcta

SEQ ID NO: 5569741 - DNA, 19 bp, Homo sapiens
ataatgttctttaatgttg

SEQ ID NO: 5569742 - DNA, 22 bp, Homo sapiens
ataatgttgccttggaaacatt

SEQ ID NO: 5569743 - DNA, 16 bp, Homo sapiens
ataatgttggtgtgga

SEQ ID NO: 5569744 - DNA, 17 bp, Homo sapiens
ataatgttgtatttaat

SEQ ID NO: 5569745 - DNA, 21 bp, Homo sapiens
ataatgttgtggtttgttgcc

SEQ ID NO: 5569746 - DNA, 14 bp, Homo sapiens
ataatgttgttatt

SEQ ID NO: 5569747 - DNA, 19 bp, Homo sapiens
ataatgttgttatttaaag

SEQ ID NO: 5569748 - DNA, 20 bp, Homo sapiens
ataatgtttaaatcatgtat

SEQ ID NO: 5569749 - DNA, 17 bp, Homo sapiens
ataatgtttattaaatg

SEQ ID NO: 5569750 - DNA, 22 bp, Homo sapiens
ataatgtttccctcaagaacaa

SEQ ID NO: 5569751 - DNA, 15 bp, Homo sapiens
ataatgtttttcctt

SEQ ID NO: 5569752 - DNA, 19 bp, Homo sapiens
ataattaaaatttatctta

SEQ ID NO: 5569753 - DNA, 21 bp, Homo sapiens
ataattaaacttcttttctct

SEQ ID NO: 5569754 - DNA, 18 bp, Homo sapiens
ataattaaagaaaattgc

SEQ ID NO: 5569755 - DNA, 21 bp, Homo sapiens
ataattaaagaaaattgccaa

SEQ ID NO: 5569756 - DNA, 16 bp, Homo sapiens
ataattaaagatgcca

SEQ ID NO: 5569757 - DNA, 20 bp, Homo sapiens
ataattaaagcttaaactga

SEQ ID NO: 5569758 - DNA, 12 bp, Homo sapiens
ataattaaagtg

SEQ ID NO: 5569759 - DNA, 15 bp, Homo sapiens
ataattaaagtgtcc

SEQ ID NO: 5569760 - DNA, 13 bp, Homo sapiens
ataattaaatctc

SEQ ID NO: 5569761 - DNA, 19 bp, Homo sapiens
ataattaaattttaatgta

SEQ ID NO: 5569762 - DNA, 20 bp, Homo sapiens
ataattaaattttgagttct

SEQ ID NO: 5569763 - DNA, 17 bp, Homo sapiens
ataattaacatgttaaa

SEQ ID NO: 5569764 - DNA, 20 bp, Homo sapiens
ataattaacatgttaaacca

SEQ ID NO: 5569765 - DNA, 21 bp, Homo sapiens
ataattaacatgttaaaccat

SEQ ID NO: 5569766 - DNA, 22 bp, Homo sapiens
ataattaacatgttaaaccatg

SEQ ID NO: 5569767 - DNA, 17 bp, Homo sapiens
ataattaacttaactga

SEQ ID NO: 5569768 - DNA, 19 bp, Homo sapiens
ataattaacttaactgaag

SEQ ID NO: 5569769 - DNA, 22 bp, Homo sapiens
ataattaacttaactgaagaaa

SEQ ID NO: 5569770 - DNA, 16 bp, Homo sapiens
ataattaatcagctcg

SEQ ID NO: 5569771 - DNA, 19 bp, Homo sapiens
ataattaattaattaacat

SEQ ID NO: 5569772 - DNA, 21 bp, Homo sapiens
ataattaattaattaacatca

SEQ ID NO: 5569773 - DNA, 23 bp, Homo sapiens
ataattaatttggacattatttc

SEQ ID NO: 5569774 - DNA, 12 bp, Homo sapiens
ataattacaata

SEQ ID NO: 5569775 - DNA, 18 bp, Homo sapiens
ataattacagaatatact

SEQ ID NO: 5569776 - DNA, 12 bp, Homo sapiens
ataattacattc

SEQ ID NO: 5569777 - DNA, 14 bp, Homo sapiens
ataattacttttga

SEQ ID NO: 5569778 - DNA, 21 bp, Homo sapiens
ataattagaacaatagctatt

SEQ ID NO: 5569779 - DNA, 18 bp, Homo sapiens
ataattagagttgtgata

SEQ ID NO: 5569780 - DNA, 19 bp, Homo sapiens
ataattagatccattaatt

SEQ ID NO: 5569781 - DNA, 21 bp, Homo sapiens
ataattagatgattatatatt

SEQ ID NO: 5569782 - DNA, 20 bp, Homo sapiens
ataattagcttgttacaatt

SEQ ID NO: 5569783 - DNA, 13 bp, Homo sapiens
ataattaggatct

SEQ ID NO: 5569784 - DNA, 14 bp, Homo sapiens
ataattaggatcta

SEQ ID NO: 5569785 - DNA, 19 bp, Homo sapiens
ataattaggatctatgcaa

SEQ ID NO: 5569786 - DNA, 23 bp, Homo sapiens
ataattaggatctatgcaatttt

SEQ ID NO: 5569787 - DNA, 17 bp, Homo sapiens
ataattaggttaacatt

SEQ ID NO: 5569788 - DNA, 19 bp, Homo sapiens
ataattagtcgggcatgag

SEQ ID NO: 5569789 - DNA, 16 bp, Homo sapiens
ataattataatatact

SEQ ID NO: 5569790 - DNA, 17 bp, Homo sapiens
ataattatataactgta

SEQ ID NO: 5569791 - DNA, 19 bp, Homo sapiens
ataattatataactgtatt

SEQ ID NO: 5569792 - DNA, 23 bp, Homo sapiens
ataattatatgctatttctatat

SEQ ID NO: 5569793 - DNA, 19 bp, Homo sapiens
ataattatcacaatgtact

SEQ ID NO: 5569794 - DNA, 18 bp, Homo sapiens
ataattatgggaacaagt

SEQ ID NO: 5569795 - DNA, 20 bp, Homo sapiens
ataattatgttattgaaaaa

SEQ ID NO: 5569796 - DNA, 23 bp, Homo sapiens
ataattatgttattgaaaaaaat

SEQ ID NO: 5569797 - DNA, 20 bp, Homo sapiens
ataattattccttcttactc

SEQ ID NO: 5569798 - DNA, 22 bp, Homo sapiens
ataattatttattacataattt

SEQ ID NO: 5569799 - DNA, 21 bp, Homo sapiens
ataattatttatttaataaca

SEQ ID NO: 5569800 - DNA, 19 bp, Homo sapiens
ataattatttctaacacta

SEQ ID NO: 5569801 - DNA, 19 bp, Homo sapiens
ataattatttgtctcagat

SEQ ID NO: 5569802 - DNA, 14 bp, Homo sapiens
ataattcaccaaaa

SEQ ID NO: 5569803 - DNA, 21 bp, Homo sapiens
ataattcaccaaaagttcata

SEQ ID NO: 5569804 - DNA, 13 bp, Homo sapiens
ataattcactcaa

SEQ ID NO: 5569805 - DNA, 17 bp, Homo sapiens
ataattcagcgttattt

SEQ ID NO: 5569806 - DNA, 23 bp, Homo sapiens
ataattcagggtggtaaagtatg

SEQ ID NO: 5569807 - DNA, 14 bp, Homo sapiens
ataattcatttgta

SEQ ID NO: 5569808 - DNA, 16 bp, Homo sapiens
ataattcatttgtatt

SEQ ID NO: 5569809 - DNA, 17 bp, Homo sapiens
ataattccctatctttt

SEQ ID NO: 5569810 - DNA, 18 bp, Homo sapiens
ataattcctacagcacta

SEQ ID NO: 5569811 - DNA, 19 bp, Homo sapiens
ataattccttaaaattttc

SEQ ID NO: 5569812 - DNA, 21 bp, Homo sapiens
ataattccttaaaattttcat

SEQ ID NO: 5569813 - DNA, 22 bp, Homo sapiens
ataattccttaaaattttcatt

SEQ ID NO: 5569814 - DNA, 15 bp, Homo sapiens
ataattcgagcaaac

SEQ ID NO: 5569815 - DNA, 12 bp, Homo sapiens
ataattctaaat

SEQ ID NO: 5569816 - DNA, 19 bp, Homo sapiens
ataattctatactgttgat

SEQ ID NO: 5569817 - DNA, 14 bp, Homo sapiens
ataattctattgaa

SEQ ID NO: 5569818 - DNA, 14 bp, Homo sapiens
ataattctcattaa

SEQ ID NO: 5569819 - DNA, 12 bp, Homo sapiens
ataattctgaaa

SEQ ID NO: 5569820 - DNA, 16 bp, Homo sapiens
ataattctgaaatgtt

SEQ ID NO: 5569821 - DNA, 17 bp, Homo sapiens
ataattctgaaatgttt

SEQ ID NO: 5569822 - DNA, 18 bp, Homo sapiens
ataattctgaagttatat

SEQ ID NO: 5569823 - DNA, 19 bp, Homo sapiens
ataattctgatcaatcatt

SEQ ID NO: 5569824 - DNA, 14 bp, Homo sapiens
ataattctgtacat

SEQ ID NO: 5569825 - DNA, 15 bp, Homo sapiens
ataattctgtactga

SEQ ID NO: 5569826 - DNA, 21 bp, Homo sapiens
ataattcttagtggaagacaa

SEQ ID NO: 5569827 - DNA, 14 bp, Homo sapiens
ataattcttatttt

SEQ ID NO: 5569828 - DNA, 19 bp, Homo sapiens
ataattcttgtatattatg

SEQ ID NO: 5569829 - DNA, 15 bp, Homo sapiens
ataattctttcaata

SEQ ID NO: 5569830 - DNA, 23 bp, Homo sapiens
ataattctttcaatacagatata

SEQ ID NO: 5569831 - DNA, 16 bp, Homo sapiens
ataattctttgattat

SEQ ID NO: 5569832 - DNA, 22 bp, Homo sapiens
ataattcttttttattaatcac

SEQ ID NO: 5569833 - DNA, 22 bp, Homo sapiens
ataattgaaaagattttaacaa

SEQ ID NO: 5569834 - DNA, 12 bp, Homo sapiens
ataattgaagaa

SEQ ID NO: 5569835 - DNA, 15 bp, Homo sapiens
ataattgaagtgtat

SEQ ID NO: 5569836 - DNA, 19 bp, Homo sapiens
ataattgattaaaatctct

SEQ ID NO: 5569837 - DNA, 16 bp, Homo sapiens
ataattgcaagggaag

SEQ ID NO: 5569838 - DNA, 17 bp, Homo sapiens
ataattgcatcagttca

SEQ ID NO: 5569839 - DNA, 22 bp, Homo sapiens
ataattgcatcagttcattgac

SEQ ID NO: 5569840 - DNA, 19 bp, Homo sapiens
ataattgcatctaggtaat

SEQ ID NO: 5569841 - DNA, 17 bp, Homo sapiens
ataattgcatgaaaata

SEQ ID NO: 5569842 - DNA, 14 bp, Homo sapiens
ataattgcattcat

SEQ ID NO: 5569843 - DNA, 16 bp, Homo sapiens
ataattgcattgactt

SEQ ID NO: 5569844 - DNA, 17 bp, Homo sapiens
ataattgccaaaaagtg

SEQ ID NO: 5569845 - DNA, 22 bp, Homo sapiens
ataattgcctacatttatcatg

SEQ ID NO: 5569846 - DNA, 18 bp, Homo sapiens
ataattgctttgccaaaa

SEQ ID NO: 5569847 - DNA, 23 bp, Homo sapiens
ataattgctttgccaaaatacca

SEQ ID NO: 5569848 - DNA, 18 bp, Homo sapiens
ataattggatttcctaat

SEQ ID NO: 5569849 - DNA, 20 bp, Homo sapiens
ataattggatttcctaatac

SEQ ID NO: 5569850 - DNA, 21 bp, Homo sapiens
ataattggctttgcagatatt

SEQ ID NO: 5569851 - DNA, 20 bp, Homo sapiens
ataattgtaaaggtgatgaa

SEQ ID NO: 5569852 - DNA, 20 bp, Homo sapiens
ataattgtaaatattttgat

SEQ ID NO: 5569853 - DNA, 13 bp, Homo sapiens
ataattgtacaaa

SEQ ID NO: 5569854 - DNA, 24 bp, Homo sapiens
ataattgtacaaaattaagcaaat

SEQ ID NO: 5569855 - DNA, 13 bp, Homo sapiens
ataattgtatcgt

SEQ ID NO: 5569856 - DNA, 16 bp, Homo sapiens
atacaggctgggaagt

SEQ ID NO: 5569857 - DNA, 21 bp, Homo sapiens
atacagggcatgcattttgca

SEQ ID NO: 5569858 - DNA, 20 bp, Homo sapiens
atacaggggaatattttatt

SEQ ID NO: 5569859 - DNA, 19 bp, Homo sapiens
atacagggtctcttccttc

SEQ ID NO: 5569860 - DNA, 15 bp, Homo sapiens
atacaggtcatatta

SEQ ID NO: 5569861 - DNA, 18 bp, Homo sapiens
atacaggtgacagtgaag

SEQ ID NO: 5569862 - DNA, 22 bp, Homo sapiens
atacaggttactaccctcaccc

SEQ ID NO: 5569863 - DNA, 17 bp, Homo sapiens
atacagtaaagtttaaa

SEQ ID NO: 5569864 - DNA, 19 bp, Homo sapiens
atacagtaactttatgtgt

SEQ ID NO: 5569865 - DNA, 16 bp, Homo sapiens
atacagtacaggcagc

SEQ ID NO: 5569866 - DNA, 15 bp, Homo sapiens
atacagtacagtggt

SEQ ID NO: 5569867 - DNA, 16 bp, Homo sapiens
atacagtacagtggtt

SEQ ID NO: 5569868 - DNA, 19 bp, Homo sapiens
atacagtacggatttgtcc

SEQ ID NO: 5569869 - DNA, 17 bp, Homo sapiens
atacagtagtgagaaga

SEQ ID NO: 5569870 - DNA, 15 bp, Homo sapiens
atacagtattctgta

SEQ ID NO: 5569871 - DNA, 22 bp, Homo sapiens
atacagtccctaaagaaaaaaa

SEQ ID NO: 5569872 - DNA, 15 bp, Homo sapiens
atacagtctctattt

SEQ ID NO: 5569873 - DNA, 19 bp, Homo sapiens
atacagtctctatttgatt

SEQ ID NO: 5569874 - DNA, 20 bp, Homo sapiens
atacagtctctatttgattt

SEQ ID NO: 5569875 - DNA, 21 bp, Homo sapiens
atacagtctctatttgatttg

SEQ ID NO: 5569876 - DNA, 23 bp, Homo sapiens
atacagtctctatttgatttgca

SEQ ID NO: 5569877 - DNA, 20 bp, Homo sapiens
atacagtcttccatttgcaa

SEQ ID NO: 5569878 - DNA, 19 bp, Homo sapiens
atacagtgagctctagcaa

SEQ ID NO: 5569879 - DNA, 13 bp, Homo sapiens
atacagtgcagag

SEQ ID NO: 5569880 - DNA, 12 bp, Homo sapiens
atacagtgccca

SEQ ID NO: 5569881 - DNA, 17 bp, Homo sapiens
atacagtgtacatgtac

SEQ ID NO: 5569882 - DNA, 15 bp, Homo sapiens
atacagtgtgtagtt

SEQ ID NO: 5569883 - DNA, 16 bp, Homo sapiens
atacagtgttaaaaga

SEQ ID NO: 5569884 - DNA, 19 bp, Homo sapiens
atacagtgttttttaggaa

SEQ ID NO: 5569885 - DNA, 20 bp, Homo sapiens
atacagttattttggatata

SEQ ID NO: 5569886 - DNA, 17 bp, Homo sapiens
atacagttgtataaact

SEQ ID NO: 5569887 - DNA, 20 bp, Homo sapiens
atacagttgttggcctccgg

SEQ ID NO: 5569888 - DNA, 23 bp, Homo sapiens
atacagttttaaagaatcattat

SEQ ID NO: 5569889 - DNA, 12 bp, Homo sapiens
atacagttttat

SEQ ID NO: 5569890 - DNA, 15 bp, Homo sapiens
atacagttttatgct

SEQ ID NO: 5569891 - DNA, 21 bp, Homo sapiens
atacagttttcctaaatgtat

SEQ ID NO: 5569892 - DNA, 14 bp, Homo sapiens
atacataaaaatta

SEQ ID NO: 5569893 - DNA, 20 bp, Homo sapiens
atacataaaagaaataaacc

SEQ ID NO: 5569894 - DNA, 14 bp, Homo sapiens
atacataaaagaat

SEQ ID NO: 5569895 - DNA, 17 bp, Homo sapiens
atacataaaagaatgta

SEQ ID NO: 5569896 - DNA, 23 bp, Homo sapiens
atacataaaagaatgtacagaaa

SEQ ID NO: 5569897 - DNA, 14 bp, Homo sapiens
atacataaacagtt

SEQ ID NO: 5569898 - DNA, 15 bp, Homo sapiens
atacataactaaatt

SEQ ID NO: 5569899 - DNA, 19 bp, Homo sapiens
atacataactaaatttgat

SEQ ID NO: 5569900 - DNA, 17 bp, Homo sapiens
atacataagcagcattt

SEQ ID NO: 5569901 - DNA, 16 bp, Homo sapiens
atacataagttaatat

SEQ ID NO: 5569902 - DNA, 20 bp, Homo sapiens
atacataagttaatattgga

SEQ ID NO: 5569903 - DNA, 13 bp, Homo sapiens
atacataataaag

SEQ ID NO: 5569904 - DNA, 15 bp, Homo sapiens
atacataataaagtg

SEQ ID NO: 5569905 - DNA, 13 bp, Homo sapiens
atacataatacaa

SEQ ID NO: 5569906 - DNA, 20 bp, Homo sapiens
atacataatgtttttccttt

SEQ ID NO: 5569907 - DNA, 22 bp, Homo sapiens
atacataatgtttttcctttct

SEQ ID NO: 5569908 - DNA, 16 bp, Homo sapiens
atacatacacatacat

SEQ ID NO: 5569909 - DNA, 17 bp, Homo sapiens
atacatacacatatata

SEQ ID NO: 5569910 - DNA, 14 bp, Homo sapiens
atacatacagagat

SEQ ID NO: 5569911 - DNA, 11 bp, Homo sapiens
atacatacata

SEQ ID NO: 5569912 - DNA, 18 bp, Homo sapiens
atacatacatacaaatat

SEQ ID NO: 5569913 - DNA, 18 bp, Homo sapiens
atacatacatacatatat

SEQ ID NO: 5569914 - DNA, 19 bp, Homo sapiens
atacatacatacatatata

SEQ ID NO: 5569915 - DNA, 14 bp, Homo sapiens
atacatacatatat

SEQ ID NO: 5569916 - DNA, 14 bp, Homo sapiens
atacatacatgtat

SEQ ID NO: 5569917 - DNA, 13 bp, Homo sapiens
atacatacctact

SEQ ID NO: 5569918 - DNA, 18 bp, Homo sapiens
atacatacgcaattgtat

SEQ ID NO: 5569919 - DNA, 19 bp, Homo sapiens
atacatacgcaattgtata

SEQ ID NO: 5569920 - DNA, 21 bp, Homo sapiens
atacatacggtcaggtttaac

SEQ ID NO: 5569921 - DNA, 14 bp, Homo sapiens
atacatactaatga

SEQ ID NO: 5569922 - DNA, 15 bp, Homo sapiens
atacatactaatgaa

SEQ ID NO: 5569923 - DNA, 15 bp, Homo sapiens
atacatactatgaaa

SEQ ID NO: 5569924 - DNA, 14 bp, Homo sapiens
atacatagacattt

SEQ ID NO: 5569925 - DNA, 19 bp, Homo sapiens
atacatagacatttcaaaa

SEQ ID NO: 5569926 - DNA, 20 bp, Homo sapiens
atacatagacatttcaaaat

SEQ ID NO: 5569927 - DNA, 18 bp, Homo sapiens
atacatagggatatgcgt

SEQ ID NO: 5569928 - DNA, 23 bp, Homo sapiens
atacataggtctgtatggctgta

SEQ ID NO: 5569929 - DNA, 22 bp, Homo sapiens
atacatatactgattctgtgta

SEQ ID NO: 5569930 - DNA, 16 bp, Homo sapiens
atacatatagatagat

SEQ ID NO: 5569931 - DNA, 11 bp, Homo sapiens
atacatatata

SEQ ID NO: 5569932 - DNA, 15 bp, Homo sapiens
atacatatatacatt

SEQ ID NO: 5569933 - DNA, 20 bp, Homo sapiens
atacatatatatatacacat

SEQ ID NO: 5569934 - DNA, 20 bp, Homo sapiens
atacatatatatatataaca

SEQ ID NO: 5569935 - DNA, 18 bp, Homo sapiens
atacatatatatatttgt

SEQ ID NO: 5569936 - DNA, 14 bp, Homo sapiens
atacatatatatct

SEQ ID NO: 5569937 - DNA, 19 bp, Homo sapiens
atacatatatatctgataa

SEQ ID NO: 5569938 - DNA, 15 bp, Homo sapiens
atacatatatctaca

SEQ ID NO: 5569939 - DNA, 20 bp, Homo sapiens
atacatatatctacacatac

SEQ ID NO: 5569940 - DNA, 13 bp, Homo sapiens
atacatatcagaa

SEQ ID NO: 5569941 - DNA, 14 bp, Homo sapiens
atacatatcagaaa

SEQ ID NO: 5569942 - DNA, 15 bp, Homo sapiens
atacatatcagaaaa

SEQ ID NO: 5569943 - DNA, 18 bp, Homo sapiens
atacatatcagaaaagta

SEQ ID NO: 5569944 - DNA, 16 bp, Homo sapiens
atacatatcgctgact

SEQ ID NO: 5569945 - DNA, 14 bp, Homo sapiens
atacatatggatgt

SEQ ID NO: 5569946 - DNA, 14 bp, Homo sapiens
atacatatgtagaa

SEQ ID NO: 5569947 - DNA, 20 bp, Homo sapiens
atacatatgtagaaacattt

SEQ ID NO: 5569948 - DNA, 16 bp, Homo sapiens
atacatatgtatgtgt

SEQ ID NO: 5569949 - DNA, 17 bp, Homo sapiens
atacatatgtatgtgtg

SEQ ID NO: 5569950 - DNA, 15 bp, Homo sapiens
atacatattataaat

SEQ ID NO: 5569951 - DNA, 16 bp, Homo sapiens
atacatattataaata

SEQ ID NO: 5569952 - DNA, 18 bp, Homo sapiens
atacatattataaataaa

SEQ ID NO: 5569953 - DNA, 18 bp, Homo sapiens
atacatattcaaagtata

SEQ ID NO: 5569954 - DNA, 14 bp, Homo sapiens
atacatatttccaa

SEQ ID NO: 5569955 - DNA, 21 bp, Homo sapiens
atacatattttatagaacttc

SEQ ID NO: 5569956 - DNA, 14 bp, Homo sapiens
atacatattttgta

SEQ ID NO: 5569957 - DNA, 16 bp, Homo sapiens
atacatcaatatgtat

SEQ ID NO: 5569958 - DNA, 17 bp, Homo sapiens
atacatcaattggaaat

SEQ ID NO: 5569959 - DNA, 14 bp, Homo sapiens
atacatcacttcct

SEQ ID NO: 5569960 - DNA, 17 bp, Homo sapiens
atacatcacttcctgtt

SEQ ID NO: 5569961 - DNA, 19 bp, Homo sapiens
atacatcacttcctgtttt

SEQ ID NO: 5569962 - DNA, 21 bp, Homo sapiens
atacatcacttcctgttttaa

SEQ ID NO: 5569963 - DNA, 16 bp, Homo sapiens
atacatcagaaaataa

SEQ ID NO: 5569964 - DNA, 14 bp, Homo sapiens
atacatcagttatt

SEQ ID NO: 5569965 - DNA, 21 bp, Homo sapiens
atacatcattttttgtttctt

SEQ ID NO: 5569966 - DNA, 17 bp, Homo sapiens
atacatccctcagtttc

SEQ ID NO: 5569967 - DNA, 20 bp, Homo sapiens
atacatcccttacctgggaa

SEQ ID NO: 5569968 - DNA, 14 bp, Homo sapiens
atacatcctgggta

SEQ ID NO: 5569969 - DNA, 15 bp, Homo sapiens
atacatcctgggtaa

SEQ ID NO: 5569970 - DNA, 14 bp, Homo sapiens
atacatcttataga

SEQ ID NO: 5569971 - DNA, 16 bp, Homo sapiens
atacatcttcattaat

SEQ ID NO: 5569972 - DNA, 19 bp, Homo sapiens
atacatcttgtttctgagt

SEQ ID NO: 5569973 - DNA, 22 bp, Homo sapiens
atacatgaagaatagaaacaag

SEQ ID NO: 5569974 - DNA, 21 bp, Homo sapiens
atacatgaatgggcatttcta

SEQ ID NO: 5569975 - DNA, 15 bp, Homo sapiens
atacatgacactgaa

SEQ ID NO: 5569976 - DNA, 19 bp, Homo sapiens
atacatgacactgaaatgc

SEQ ID NO: 5569977 - DNA, 16 bp, Homo sapiens
atacatgactcagcat

SEQ ID NO: 5569978 - DNA, 16 bp, Homo sapiens
atacatgatacatttt

SEQ ID NO: 5569979 - DNA, 19 bp, Homo sapiens
atacatgatgatttcagaa

SEQ ID NO: 5569980 - DNA, 16 bp, Homo sapiens
atacatgcaaaaagaa

SEQ ID NO: 5569981 - DNA, 12 bp, Homo sapiens
atacatgcacag

SEQ ID NO: 5569982 - DNA, 21 bp, Homo sapiens
atacatgccacatcaaacctt

SEQ ID NO: 5569983 - DNA, 20 bp, Homo sapiens
atacatgctaagaaagcaaa

SEQ ID NO: 5569984 - DNA, 22 bp, Homo sapiens
atacatgctaagagaagtagaa

SEQ ID NO: 5569985 - DNA, 13 bp, Homo sapiens
atacatgctactt

SEQ ID NO: 5569986 - DNA, 14 bp, Homo sapiens
atacatgctacttt

SEQ ID NO: 5569987 - DNA, 15 bp, Homo sapiens
atacatgctgctaat

SEQ ID NO: 5569988 - DNA, 15 bp, Homo sapiens
atacatggggaactg

SEQ ID NO: 5569989 - DNA, 24 bp, Homo sapiens
atacatgggtagcttctgacctca

SEQ ID NO: 5569990 - DNA, 16 bp, Homo sapiens
atacatggtttaaagt

SEQ ID NO: 5569991 - DNA, 18 bp, Homo sapiens
atacatggtttaaagtca

SEQ ID NO: 5569992 - DNA, 16 bp, Homo sapiens
atacatgtaaaaatgt

SEQ ID NO: 5569993 - DNA, 19 bp, Homo sapiens
atacatgtacctatagaaa

SEQ ID NO: 5569994 - DNA, 20 bp, Homo sapiens
atacatgtacctatagaaat

SEQ ID NO: 5569995 - DNA, 12 bp, Homo sapiens
atacatgtatag

SEQ ID NO: 5569996 - DNA, 18 bp, Homo sapiens
atacatgtgatacatttt

SEQ ID NO: 5569997 - DNA, 14 bp, Homo sapiens
atacatgtgtacat

SEQ ID NO: 5569998 - DNA, 22 bp, Homo sapiens
atacatgtgtacatatatgtat

SEQ ID NO: 5569999 - DNA, 19 bp, Homo sapiens
atacatgttattgttttca

SEQ ID NO: 5570000 - DNA, 16 bp, Homo sapiens
atacatgtttatgtaa

SEQ ID NO: 5570001 - DNA, 17 bp, Homo sapiens
atacatgtttgcagtgt

SEQ ID NO: 5570002 - DNA, 23 bp, Homo sapiens
atacatgtttttctattaaaaat

SEQ ID NO: 5570003 - DNA, 18 bp, Homo sapiens
atacattaaaactaggta

SEQ ID NO: 5570004 - DNA, 19 bp, Homo sapiens
atacattaacggtgctaaa

SEQ ID NO: 5570005 - DNA, 20 bp, Homo sapiens
atacattacatgtaaattaa

SEQ ID NO: 5570006 - DNA, 14 bp, Homo sapiens
atacattagacaca

SEQ ID NO: 5570007 - DNA, 18 bp, Homo sapiens
atacattagtaaatgtct

SEQ ID NO: 5570008 - DNA, 21 bp, Homo sapiens
atacattagtaaatgtctttg

SEQ ID NO: 5570009 - DNA, 23 bp, Homo sapiens
atacattagtaaatgtctttgta

SEQ ID NO: 5570010 - DNA, 16 bp, Homo sapiens
atacattattagaata

SEQ ID NO: 5570011 - DNA, 13 bp, Homo sapiens
atacattatttct

SEQ ID NO: 5570012 - DNA, 23 bp, Homo sapiens
atacattcataaggaaatgtgtg

SEQ ID NO: 5570013 - DNA, 21 bp, Homo sapiens
atacattccatcacagccagc

SEQ ID NO: 5570014 - DNA, 19 bp, Homo sapiens
atacattccctatcaaaac

SEQ ID NO: 5570015 - DNA, 10 bp, Homo sapiens
atacattcct

SEQ ID NO: 5570016 - DNA, 13 bp, Homo sapiens
atacattcctgag

SEQ ID NO: 5570017 - DNA, 20 bp, Homo sapiens
atacattctatgacattttt

SEQ ID NO: 5570018 - DNA, 19 bp, Homo sapiens
atacattgaattagaaaca

SEQ ID NO: 5570019 - DNA, 16 bp, Homo sapiens
atacattgaattcatt

SEQ ID NO: 5570020 - DNA, 14 bp, Homo sapiens
atacattgtacgaa

SEQ ID NO: 5570021 - DNA, 16 bp, Homo sapiens
atacattgtctctaaa

SEQ ID NO: 5570022 - DNA, 14 bp, Homo sapiens
atacattgtcttga

SEQ ID NO: 5570023 - DNA, 11 bp, Homo sapiens
atacatttaaa

SEQ ID NO: 5570024 - DNA, 20 bp, Homo sapiens
atacatttaaaaaacatttt

SEQ ID NO: 5570025 - DNA, 21 bp, Homo sapiens
atacatttaaaaaacatttta

SEQ ID NO: 5570026 - DNA, 19 bp, Homo sapiens
atacatttaaagatttaaa

SEQ ID NO: 5570027 - DNA, 13 bp, Homo sapiens
atacatttaataa

SEQ ID NO: 5570028 - DNA, 20 bp, Homo sapiens
atacatttataatgtttgct

SEQ ID NO: 5570029 - DNA, 17 bp, Homo sapiens
atacatttatcttctgt

SEQ ID NO: 5570030 - DNA, 23 bp, Homo sapiens
atacatttatcttctgtttttct

SEQ ID NO: 5570031 - DNA, 13 bp, Homo sapiens
atacatttgtatt

SEQ ID NO: 5570032 - DNA, 22 bp, Homo sapiens
atacatttgtggtcacatgctt

SEQ ID NO: 5570033 - DNA, 13 bp, Homo sapiens
atacatttgttgg

SEQ ID NO: 5570034 - DNA, 13 bp, Homo sapiens
atactgaagatgc

SEQ ID NO: 5570035 - DNA, 13 bp, Homo sapiens
atactgaaggaaa

SEQ ID NO: 5570036 - DNA, 14 bp, Homo sapiens
atactgaagtcttt

SEQ ID NO: 5570037 - DNA, 17 bp, Homo sapiens
atactgaagtgtgggat

SEQ ID NO: 5570038 - DNA, 20 bp, Homo sapiens
atactgaatgcataaataaa

SEQ ID NO: 5570039 - DNA, 21 bp, Homo sapiens
atactgaatgcataaataaat

SEQ ID NO: 5570040 - DNA, 18 bp, Homo sapiens
atactgaattgttatgta

SEQ ID NO: 5570041 - DNA, 17 bp, Homo sapiens
atactgacaatgtattt

SEQ ID NO: 5570042 - DNA, 18 bp, Homo sapiens
atactgacagaagttatt

SEQ ID NO: 5570043 - DNA, 16 bp, Homo sapiens
atactgacctacctca

SEQ ID NO: 5570044 - DNA, 13 bp, Homo sapiens
atactgagaacct

SEQ ID NO: 5570045 - DNA, 16 bp, Homo sapiens
atactgagatgctggg

SEQ ID NO: 5570046 - DNA, 17 bp, Homo sapiens
atactgagatgctgggc

SEQ ID NO: 5570047 - DNA, 13 bp, Homo sapiens
atactgagcctgc

SEQ ID NO: 5570048 - DNA, 18 bp, Homo sapiens
atactgagctgctaaaat

SEQ ID NO: 5570049 - DNA, 13 bp, Homo sapiens
atactgagctttt

SEQ ID NO: 5570050 - DNA, 22 bp, Homo sapiens
atactgagggaccaactgggcc

SEQ ID NO: 5570051 - DNA, 23 bp, Homo sapiens
atactgaggggttggtgataact

SEQ ID NO: 5570052 - DNA, 18 bp, Homo sapiens
atactgatgagacaacac

SEQ ID NO: 5570053 - DNA, 21 bp, Homo sapiens
atactgatgagacaacacaca

SEQ ID NO: 5570054 - DNA, 13 bp, Homo sapiens
atactgatgtgtt

SEQ ID NO: 5570055 - DNA, 14 bp, Homo sapiens
atactgattatgaa

SEQ ID NO: 5570056 - DNA, 16 bp, Homo sapiens
atactgattctgtgta

SEQ ID NO: 5570057 - DNA, 15 bp, Homo sapiens
atactgattttcaaa

SEQ ID NO: 5570058 - DNA, 17 bp, Homo sapiens
atactgattttcaaaaa

SEQ ID NO: 5570059 - DNA, 20 bp, Homo sapiens
atactgattttcaaaaaaat

SEQ ID NO: 5570060 - DNA, 14 bp, Homo sapiens
atactgatttttaa

SEQ ID NO: 5570061 - DNA, 21 bp, Homo sapiens
atactgcaaactatttaaaga

SEQ ID NO: 5570062 - DNA, 19 bp, Homo sapiens
atactgcacagtggcacaa

SEQ ID NO: 5570063 - DNA, 16 bp, Homo sapiens
atactgcacttacaat

SEQ ID NO: 5570064 - DNA, 18 bp, Homo sapiens
atactgcactttagtgta

SEQ ID NO: 5570065 - DNA, 15 bp, Homo sapiens
atactgcagggccag

SEQ ID NO: 5570066 - DNA, 19 bp, Homo sapiens
atactgcagtgtgaatttt

SEQ ID NO: 5570067 - DNA, 21 bp, Homo sapiens
atactgcatactttttaaatg

SEQ ID NO: 5570068 - DNA, 22 bp, Homo sapiens
atactgcatatcctggtgtcta

SEQ ID NO: 5570069 - DNA, 23 bp, Homo sapiens
atactgcatgtaagccaagtcat

SEQ ID NO: 5570070 - DNA, 22 bp, Homo sapiens
atactgccaaaacatttatgac

SEQ ID NO: 5570071 - DNA, 15 bp, Homo sapiens
atactgccagatgct

SEQ ID NO: 5570072 - DNA, 18 bp, Homo sapiens
atactgccgctgccccca

SEQ ID NO: 5570073 - DNA, 16 bp, Homo sapiens
atactgccttgtttaa

SEQ ID NO: 5570074 - DNA, 19 bp, Homo sapiens
atactgccttgtttaatgt

SEQ ID NO: 5570075 - DNA, 22 bp, Homo sapiens
atactgccttgtttaatgttaa

SEQ ID NO: 5570076 - DNA, 20 bp, Homo sapiens
atactgcggaccaagggact

SEQ ID NO: 5570077 - DNA, 19 bp, Homo sapiens
atactgctacagcaatttc

SEQ ID NO: 5570078 - DNA, 22 bp, Homo sapiens
atactgctacagcaatttctaa

SEQ ID NO: 5570079 - DNA, 20 bp, Homo sapiens
atactgctactgtaatttta

SEQ ID NO: 5570080 - DNA, 12 bp, Homo sapiens
atactgctgaga

SEQ ID NO: 5570081 - DNA, 21 bp, Homo sapiens
atactgctgagatacatacag

SEQ ID NO: 5570082 - DNA, 14 bp, Homo sapiens
atactgctgcttgt

SEQ ID NO: 5570083 - DNA, 18 bp, Homo sapiens
atactgctgcttgtcaaa

SEQ ID NO: 5570084 - DNA, 14 bp, Homo sapiens
atactgctgtataa

SEQ ID NO: 5570085 - DNA, 18 bp, Homo sapiens
atactgcttaattgctga

SEQ ID NO: 5570086 - DNA, 19 bp, Homo sapiens
atactgcttgaataaacac

SEQ ID NO: 5570087 - DNA, 22 bp, Homo sapiens
atactgcttgaccgtactctca

SEQ ID NO: 5570088 - DNA, 13 bp, Homo sapiens
atactggaagttt

SEQ ID NO: 5570089 - DNA, 15 bp, Homo sapiens
atactggaataattt

SEQ ID NO: 5570090 - DNA, 18 bp, Homo sapiens
atactggaataatttgta

SEQ ID NO: 5570091 - DNA, 14 bp, Homo sapiens
atactggactcagg

SEQ ID NO: 5570092 - DNA, 15 bp, Homo sapiens
atactggattgtact

SEQ ID NO: 5570093 - DNA, 13 bp, Homo sapiens
atactggcacaga

SEQ ID NO: 5570094 - DNA, 12 bp, Homo sapiens
atactggcatgc

SEQ ID NO: 5570095 - DNA, 16 bp, Homo sapiens
atactggcatgctaaa

SEQ ID NO: 5570096 - DNA, 11 bp, Homo sapiens
atactggcctc

SEQ ID NO: 5570097 - DNA, 17 bp, Homo sapiens
atactggcctcgcctgg

SEQ ID NO: 5570098 - DNA, 22 bp, Homo sapiens
atactggcctcgcctggcctga

SEQ ID NO: 5570099 - DNA, 12 bp, Homo sapiens
atactggcctct

SEQ ID NO: 5570100 - DNA, 13 bp, Homo sapiens
atactggcctctg

SEQ ID NO: 5570101 - DNA, 15 bp, Homo sapiens
atactggcctggact

SEQ ID NO: 5570102 - DNA, 20 bp, Homo sapiens
atactgggagagaagaggac

SEQ ID NO: 5570103 - DNA, 23 bp, Homo sapiens
atactggggagtaaacggcccag

SEQ ID NO: 5570104 - DNA, 16 bp, Homo sapiens
atactgggggcaaaat

SEQ ID NO: 5570105 - DNA, 16 bp, Homo sapiens
atactggggggcaggc

SEQ ID NO: 5570106 - DNA, 19 bp, Homo sapiens
atactgggtacaagagcca

SEQ ID NO: 5570107 - DNA, 15 bp, Homo sapiens
atactgggtttcaag

SEQ ID NO: 5570108 - DNA, 20 bp, Homo sapiens
atactgggtttcaagaaaat

SEQ ID NO: 5570109 - DNA, 22 bp, Homo sapiens
atactgggtttcaagaaaatct

SEQ ID NO: 5570110 - DNA, 14 bp, Homo sapiens
atactggttatagt

SEQ ID NO: 5570111 - DNA, 21 bp, Homo sapiens
atactggttatagttgatatg

SEQ ID NO: 5570112 - DNA, 20 bp, Homo sapiens
atactggttatcctgtgcta

SEQ ID NO: 5570113 - DNA, 22 bp, Homo sapiens
atactggttatcctgtgctaca

SEQ ID NO: 5570114 - DNA, 12 bp, Homo sapiens
atactgtaaaga

SEQ ID NO: 5570115 - DNA, 18 bp, Homo sapiens
atactgtaaagaaagaga

SEQ ID NO: 5570116 - DNA, 22 bp, Homo sapiens
atactgtaaagaaagagagaaa

SEQ ID NO: 5570117 - DNA, 18 bp, Homo sapiens
atactgtaatcaaaagga

SEQ ID NO: 5570118 - DNA, 20 bp, Homo sapiens
atactgtacaatgactttat

SEQ ID NO: 5570119 - DNA, 12 bp, Homo sapiens
atactgtacaca

SEQ ID NO: 5570120 - DNA, 17 bp, Homo sapiens
atactgtacacatttct

SEQ ID NO: 5570121 - DNA, 14 bp, Homo sapiens
atactgtacataga

SEQ ID NO: 5570122 - DNA, 22 bp, Homo sapiens
atactgtacatagatgtatcat

SEQ ID NO: 5570123 - DNA, 15 bp, Homo sapiens
atactgtacatgaaa

SEQ ID NO: 5570124 - DNA, 19 bp, Homo sapiens
atactgtacatgctatgct

SEQ ID NO: 5570125 - DNA, 21 bp, Homo sapiens
atactgtactgatactattca

SEQ ID NO: 5570126 - DNA, 16 bp, Homo sapiens
atactgtacttaataa

SEQ ID NO: 5570127 - DNA, 18 bp, Homo sapiens
atactgtagaaatattgc

SEQ ID NO: 5570128 - DNA, 15 bp, Homo sapiens
atactgtagacactc

SEQ ID NO: 5570129 - DNA, 18 bp, Homo sapiens
atactgtaggtgttatgt

SEQ ID NO: 5570130 - DNA, 20 bp, Homo sapiens
atactgtatatgtcaaaaat

SEQ ID NO: 5570131 - DNA, 22 bp, Homo sapiens
atactgtatatgtcaaaaatat

SEQ ID NO: 5570132 - DNA, 19 bp, Homo sapiens
atactgtatattcaggact

SEQ ID NO: 5570133 - DNA, 18 bp, Homo sapiens
atactgtatctgggctga

SEQ ID NO: 5570134 - DNA, 15 bp, Homo sapiens
atactgtattaagag

SEQ ID NO: 5570135 - DNA, 16 bp, Homo sapiens
atactgtcccacttct

SEQ ID NO: 5570136 - DNA, 20 bp, Homo sapiens
atactgtcccacttctcatc

SEQ ID NO: 5570137 - DNA, 15 bp, Homo sapiens
atactgtctctggag

SEQ ID NO: 5570138 - DNA, 17 bp, Homo sapiens
atactgtctctttcatg

SEQ ID NO: 5570139 - DNA, 13 bp, Homo sapiens
atactgtctttgc

SEQ ID NO: 5570140 - DNA, 20 bp, Homo sapiens
atactgtgaagttacatgca

SEQ ID NO: 5570141 - DNA, 18 bp, Homo sapiens
atactgtgagcttacatt

SEQ ID NO: 5570142 - DNA, 14 bp, Homo sapiens
atactgtgcagaat

SEQ ID NO: 5570143 - DNA, 18 bp, Homo sapiens
atactgtgcagaataatg

SEQ ID NO: 5570144 - DNA, 21 bp, Homo sapiens
atactgtgcagaataatggaa

SEQ ID NO: 5570145 - DNA, 22 bp, Homo sapiens
atactgtgcagaataatggaaa

SEQ ID NO: 5570146 - DNA, 20 bp, Homo sapiens
atactgtgctggagccacta

SEQ ID NO: 5570147 - DNA, 11 bp, Homo sapiens
atactgtggcc

SEQ ID NO: 5570148 - DNA, 15 bp, Homo sapiens
atactgtggcctgca

SEQ ID NO: 5570149 - DNA, 19 bp, Homo sapiens
atactgtggcctgcaggag

SEQ ID NO: 5570150 - DNA, 22 bp, Homo sapiens
atactgtgtcatggtgatgcaa

SEQ ID NO: 5570151 - DNA, 20 bp, Homo sapiens
atactgtgtgggatacttag

SEQ ID NO: 5570152 - DNA, 13 bp, Homo sapiens
atactgtgtgtga

SEQ ID NO: 5570153 - DNA, 21 bp, Homo sapiens
atactgtgtgttttcccaaag

SEQ ID NO: 5570154 - DNA, 20 bp, Homo sapiens
atactgttattctttgcact

SEQ ID NO: 5570155 - DNA, 18 bp, Homo sapiens
atactgttctatacgagt

SEQ ID NO: 5570156 - DNA, 17 bp, Homo sapiens
atactgttctcaacata

SEQ ID NO: 5570157 - DNA, 18 bp, Homo sapiens
atactgttgatacaaacc

SEQ ID NO: 5570158 - DNA, 13 bp, Homo sapiens
atactgttgcacg

SEQ ID NO: 5570159 - DNA, 14 bp, Homo sapiens
atactgttgcacgt

SEQ ID NO: 5570160 - DNA, 18 bp, Homo sapiens
atactgttgcacgtgtgt

SEQ ID NO: 5570161 - DNA, 14 bp, Homo sapiens
atactgtttcacta

SEQ ID NO: 5570162 - DNA, 21 bp, Homo sapiens
atactgtttcttgcactgaat

SEQ ID NO: 5570163 - DNA, 20 bp, Homo sapiens
atactgtttgaggtttttaa

SEQ ID NO: 5570164 - DNA, 19 bp, Homo sapiens
atactgtttgtaatataca

SEQ ID NO: 5570165 - DNA, 19 bp, Homo sapiens
atactgttttaaaatgtga

SEQ ID NO: 5570166 - DNA, 19 bp, Homo sapiens
atacttaaaaatatgtgag

SEQ ID NO: 5570167 - DNA, 21 bp, Homo sapiens
atacttaaaaatatgtgagca

SEQ ID NO: 5570168 - DNA, 15 bp, Homo sapiens
atacttaaaaattaa

SEQ ID NO: 5570169 - DNA, 22 bp, Homo sapiens
atacttaaaatgacaaagccat

SEQ ID NO: 5570170 - DNA, 13 bp, Homo sapiens
atacttaaataaa

SEQ ID NO: 5570171 - DNA, 21 bp, Homo sapiens
atacttaaatggaaaaaatga

SEQ ID NO: 5570172 - DNA, 17 bp, Homo sapiens
atacttaaatgttatgt

SEQ ID NO: 5570173 - DNA, 16 bp, Homo sapiens
atacttaaatttggtt

SEQ ID NO: 5570174 - DNA, 15 bp, Homo sapiens
atacttaacaaatac

SEQ ID NO: 5570175 - DNA, 17 bp, Homo sapiens
atacttaacaaatacat

SEQ ID NO: 5570176 - DNA, 15 bp, Homo sapiens
atacttaacatttca

SEQ ID NO: 5570177 - DNA, 16 bp, Homo sapiens
atacttaactttacta

SEQ ID NO: 5570178 - DNA, 20 bp, Homo sapiens
atacttaactttactaagta

SEQ ID NO: 5570179 - DNA, 13 bp, Homo sapiens
atacttaataaaa

SEQ ID NO: 5570180 - DNA, 17 bp, Homo sapiens
atacttaataaaacatt

SEQ ID NO: 5570181 - DNA, 22 bp, Homo sapiens
atacttaataaatctgccattt

SEQ ID NO: 5570182 - DNA, 17 bp, Homo sapiens
atacttacatgttccca

SEQ ID NO: 5570183 - DNA, 21 bp, Homo sapiens
atacttacatttcagacatat

SEQ ID NO: 5570184 - DNA, 15 bp, Homo sapiens
atacttacatttcca

SEQ ID NO: 5570185 - DNA, 21 bp, Homo sapiens
atacttacctagtgaaacttt

SEQ ID NO: 5570186 - DNA, 23 bp, Homo sapiens
atacttagaaacaaaaagagctt

SEQ ID NO: 5570187 - DNA, 18 bp, Homo sapiens
atacttagcaaaaagtgg

SEQ ID NO: 5570188 - DNA, 22 bp, Homo sapiens
atacttaggaggcttacttctt

SEQ ID NO: 5570189 - DNA, 22 bp, Homo sapiens
atacttagttcatggcttttct

SEQ ID NO: 5570190 - DNA, 15 bp, Homo sapiens
atacttatatttccc

SEQ ID NO: 5570191 - DNA, 14 bp, Homo sapiens
atacttatattttc

SEQ ID NO: 5570192 - DNA, 22 bp, Homo sapiens
atacttatattttcgtatgaaa

SEQ ID NO: 5570193 - DNA, 16 bp, Homo sapiens
atacttatctctctgt

SEQ ID NO: 5570194 - DNA, 20 bp, Homo sapiens
atacttatctctctgtgctg

SEQ ID NO: 5570195 - DNA, 15 bp, Homo sapiens
atacttatttaaata

SEQ ID NO: 5570196 - DNA, 22 bp, Homo sapiens
atacttatttaaatagatgaca

SEQ ID NO: 5570197 - DNA, 22 bp, Homo sapiens
atacttattttattttttacca

SEQ ID NO: 5570198 - DNA, 14 bp, Homo sapiens
atacttattttcag

SEQ ID NO: 5570199 - DNA, 23 bp, Homo sapiens
atacttcaaatgtcatttcatac

SEQ ID NO: 5570200 - DNA, 15 bp, Homo sapiens
atacttcacactgaa

SEQ ID NO: 5570201 - DNA, 21 bp, Homo sapiens
atacttcacactgaactcagg

SEQ ID NO: 5570202 - DNA, 16 bp, Homo sapiens
atacttcactacttta

SEQ ID NO: 5570203 - DNA, 14 bp, Homo sapiens
atacttcactcact

SEQ ID NO: 5570204 - DNA, 18 bp, Homo sapiens
atacttcaggtgcttttg

SEQ ID NO: 5570205 - DNA, 20 bp, Homo sapiens
atacttcatttaaaaaaatc

SEQ ID NO: 5570206 - DNA, 21 bp, Homo sapiens
atacttccatatggagcattt

SEQ ID NO: 5570207 - DNA, 20 bp, Homo sapiens
atacttccatgcactcttca

SEQ ID NO: 5570208 - DNA, 23 bp, Homo sapiens
atacttcctgggatgatgtgtga

SEQ ID NO: 5570209 - DNA, 12 bp, Homo sapiens
atacttccttat

SEQ ID NO: 5570210 - DNA, 17 bp, Homo sapiens
atacttccttataaaaa

SEQ ID NO: 5570211 - DNA, 15 bp, Homo sapiens
atagatatataaata

SEQ ID NO: 5570212 - DNA, 23 bp, Homo sapiens
atagatatataagaaaaaattct

SEQ ID NO: 5570213 - DNA, 22 bp, Homo sapiens
atagatattactggaaactaat

SEQ ID NO: 5570214 - DNA, 18 bp, Homo sapiens
atagatcacggcatgttt

SEQ ID NO: 5570215 - DNA, 19 bp, Homo sapiens
atagatcagccattaaaat

SEQ ID NO: 5570216 - DNA, 22 bp, Homo sapiens
atagatcagccattaaaataaa

SEQ ID NO: 5570217 - DNA, 13 bp, Homo sapiens
atagatcatttct

SEQ ID NO: 5570218 - DNA, 13 bp, Homo sapiens
atagatctccagc

SEQ ID NO: 5570219 - DNA, 19 bp, Homo sapiens
atagatctccagcgtcagc

SEQ ID NO: 5570220 - DNA, 16 bp, Homo sapiens
atagatgaacttttta

SEQ ID NO: 5570221 - DNA, 23 bp, Homo sapiens
atagatgaactttttaacaaatg

SEQ ID NO: 5570222 - DNA, 19 bp, Homo sapiens
atagatgaatactaaatgg

SEQ ID NO: 5570223 - DNA, 17 bp, Homo sapiens
atagatgactttgcaga

SEQ ID NO: 5570224 - DNA, 14 bp, Homo sapiens
atagatgagaaaac

SEQ ID NO: 5570225 - DNA, 17 bp, Homo sapiens
atagatgagaaaactga

SEQ ID NO: 5570226 - DNA, 19 bp, Homo sapiens
atagatgagtttttcatta

SEQ ID NO: 5570227 - DNA, 22 bp, Homo sapiens
atagatgagtttttcattattt

SEQ ID NO: 5570228 - DNA, 23 bp, Homo sapiens
atagatgagtttttcattatttg

SEQ ID NO: 5570229 - DNA, 16 bp, Homo sapiens
atagatgcaagatatt

SEQ ID NO: 5570230 - DNA, 14 bp, Homo sapiens
atagatgccctgct

SEQ ID NO: 5570231 - DNA, 18 bp, Homo sapiens
atagatgcctgggcctga

SEQ ID NO: 5570232 - DNA, 21 bp, Homo sapiens
atagatggacagtttgtttcc

SEQ ID NO: 5570233 - DNA, 23 bp, Homo sapiens
atagatggacagtttgtttcctg

SEQ ID NO: 5570234 - DNA, 23 bp, Homo sapiens
atagatggaccagtagacaactg

SEQ ID NO: 5570235 - DNA, 15 bp, Homo sapiens
atagatgggaatgaa

SEQ ID NO: 5570236 - DNA, 19 bp, Homo sapiens
atagatgggaatgaagctt

SEQ ID NO: 5570237 - DNA, 23 bp, Homo sapiens
atagatggggcatataataaaga

SEQ ID NO: 5570238 - DNA, 22 bp, Homo sapiens
atagatgggtctggctgagctg

SEQ ID NO: 5570239 - DNA, 19 bp, Homo sapiens
atagatgtccctttcttgg

SEQ ID NO: 5570240 - DNA, 21 bp, Homo sapiens
atagatgtcgtggactccagc

SEQ ID NO: 5570241 - DNA, 16 bp, Homo sapiens
atagatgtctcaaaaa

SEQ ID NO: 5570242 - DNA, 13 bp, Homo sapiens
atagatgtctgtg

SEQ ID NO: 5570243 - DNA, 16 bp, Homo sapiens
atagatgtctgtgtat

SEQ ID NO: 5570244 - DNA, 14 bp, Homo sapiens
atagatgtcttcat

SEQ ID NO: 5570245 - DNA, 15 bp, Homo sapiens
atagatgtcttttat

SEQ ID NO: 5570246 - DNA, 16 bp, Homo sapiens
atagatgtcttttata

SEQ ID NO: 5570247 - DNA, 19 bp, Homo sapiens
atagatgtcttttatagtg

SEQ ID NO: 5570248 - DNA, 16 bp, Homo sapiens
atagatgtgaaaatgc

SEQ ID NO: 5570249 - DNA, 16 bp, Homo sapiens
atagatgtgagccagc

SEQ ID NO: 5570250 - DNA, 19 bp, Homo sapiens
atagatgtgattcctgcat

SEQ ID NO: 5570251 - DNA, 15 bp, Homo sapiens
atagatgttgctctt

SEQ ID NO: 5570252 - DNA, 15 bp, Homo sapiens
atagatgttttaact

SEQ ID NO: 5570253 - DNA, 23 bp, Homo sapiens
atagatgttttggtagattaaat

SEQ ID NO: 5570254 - DNA, 14 bp, Homo sapiens
atagattaaaggaa

SEQ ID NO: 5570255 - DNA, 12 bp, Homo sapiens
atagattaaatc

SEQ ID NO: 5570256 - DNA, 17 bp, Homo sapiens
atagattaatggcactg

SEQ ID NO: 5570257 - DNA, 18 bp, Homo sapiens
atagattaatggcactga

SEQ ID NO: 5570258 - DNA, 19 bp, Homo sapiens
atagattaatggcactgat

SEQ ID NO: 5570259 - DNA, 14 bp, Homo sapiens
atagattagaaaaa

SEQ ID NO: 5570260 - DNA, 15 bp, Homo sapiens
atagattagaattct

SEQ ID NO: 5570261 - DNA, 21 bp, Homo sapiens
atagattataacttgtctaaa

SEQ ID NO: 5570262 - DNA, 15 bp, Homo sapiens
atagattattataaa

SEQ ID NO: 5570263 - DNA, 16 bp, Homo sapiens
atagattattataaac

SEQ ID NO: 5570264 - DNA, 15 bp, Homo sapiens
atagattcacctgta

SEQ ID NO: 5570265 - DNA, 18 bp, Homo sapiens
atagattcacctgtaaaa

SEQ ID NO: 5570266 - DNA, 13 bp, Homo sapiens
atagattctaaag

SEQ ID NO: 5570267 - DNA, 14 bp, Homo sapiens
atagattctaaaga

SEQ ID NO: 5570268 - DNA, 19 bp, Homo sapiens
atagattctcttgtataag

SEQ ID NO: 5570269 - DNA, 14 bp, Homo sapiens
atagattctttatt

SEQ ID NO: 5570270 - DNA, 18 bp, Homo sapiens
atagattgagttattaac

SEQ ID NO: 5570271 - DNA, 12 bp, Homo sapiens
atagattgattt

SEQ ID NO: 5570272 - DNA, 22 bp, Homo sapiens
atagattgccccataacatagt

SEQ ID NO: 5570273 - DNA, 18 bp, Homo sapiens
atagattgtaatacacat

SEQ ID NO: 5570274 - DNA, 15 bp, Homo sapiens
atagattgtatctct

SEQ ID NO: 5570275 - DNA, 18 bp, Homo sapiens
atagattgtgaataatga

SEQ ID NO: 5570276 - DNA, 20 bp, Homo sapiens
atagatttaccctttataga

SEQ ID NO: 5570277 - DNA, 20 bp, Homo sapiens
atagatttagtctgttatat

SEQ ID NO: 5570278 - DNA, 17 bp, Homo sapiens
atagatttattttacat

SEQ ID NO: 5570279 - DNA, 21 bp, Homo sapiens
atagatttcagctatgcagaa

SEQ ID NO: 5570280 - DNA, 16 bp, Homo sapiens
atagatttctcctctt

SEQ ID NO: 5570281 - DNA, 14 bp, Homo sapiens
atagatttctgatt

SEQ ID NO: 5570282 - DNA, 15 bp, Homo sapiens
atagatttctgattt

SEQ ID NO: 5570283 - DNA, 13 bp, Homo sapiens
atagatttggaat

SEQ ID NO: 5570284 - DNA, 15 bp, Homo sapiens
atagattttctctgg

SEQ ID NO: 5570285 - DNA, 19 bp, Homo sapiens
atagatttttgattcagct

SEQ ID NO: 5570286 - DNA, 14 bp, Homo sapiens
atagattttttaaa

SEQ ID NO: 5570287 - DNA, 17 bp, Homo sapiens
atagcaaaagaagaagt

SEQ ID NO: 5570288 - DNA, 21 bp, Homo sapiens
atagcaaaatattatctgaac

SEQ ID NO: 5570289 - DNA, 15 bp, Homo sapiens
atagcaaactccagg

SEQ ID NO: 5570290 - DNA, 15 bp, Homo sapiens
atagcaaagatatat

SEQ ID NO: 5570291 - DNA, 14 bp, Homo sapiens
atagcaaattcaaa

SEQ ID NO: 5570292 - DNA, 17 bp, Homo sapiens
atagcaacaacaattgg

SEQ ID NO: 5570293 - DNA, 23 bp, Homo sapiens
atagcaagaactctgcacagcaa

SEQ ID NO: 5570294 - DNA, 16 bp, Homo sapiens
atagcaagatattgat

SEQ ID NO: 5570295 - DNA, 16 bp, Homo sapiens
atagcaagtgctattt

SEQ ID NO: 5570296 - DNA, 13 bp, Homo sapiens
atagcaataactg

SEQ ID NO: 5570297 - DNA, 15 bp, Homo sapiens
atagcaataactgaa

SEQ ID NO: 5570298 - DNA, 19 bp, Homo sapiens
atagcaatacttggagggc

SEQ ID NO: 5570299 - DNA, 13 bp, Homo sapiens
atagcacaagata

SEQ ID NO: 5570300 - DNA, 18 bp, Homo sapiens
atagcacaagataaattg

SEQ ID NO: 5570301 - DNA, 18 bp, Homo sapiens
atagcacagaccctgccc

SEQ ID NO: 5570302 - DNA, 14 bp, Homo sapiens
atagcacaggctaa

SEQ ID NO: 5570303 - DNA, 17 bp, Homo sapiens
atagcacaggctaattt

SEQ ID NO: 5570304 - DNA, 22 bp, Homo sapiens
atagcacatccaccaaactcct

SEQ ID NO: 5570305 - DNA, 15 bp, Homo sapiens
atagcacatgatttg

SEQ ID NO: 5570306 - DNA, 16 bp, Homo sapiens
atagcacatgattttc

SEQ ID NO: 5570307 - DNA, 23 bp, Homo sapiens
atagcacatgattttcttttgtt

SEQ ID NO: 5570308 - DNA, 12 bp, Homo sapiens
atagcacatgtt

SEQ ID NO: 5570309 - DNA, 18 bp, Homo sapiens
atagcacctaaacttaca

SEQ ID NO: 5570310 - DNA, 22 bp, Homo sapiens
atagcactggtttgtttctcaa

SEQ ID NO: 5570311 - DNA, 11 bp, Homo sapiens
atagcactttc

SEQ ID NO: 5570312 - DNA, 15 bp, Homo sapiens
atagcactttcattg

SEQ ID NO: 5570313 - DNA, 18 bp, Homo sapiens
atagcactttcattgcca

SEQ ID NO: 5570314 - DNA, 15 bp, Homo sapiens
atagcactttgaaat

SEQ ID NO: 5570315 - DNA, 22 bp, Homo sapiens
atagcactttgaaatacctcat

SEQ ID NO: 5570316 - DNA, 20 bp, Homo sapiens
atagcagaagaaaaagttgc

SEQ ID NO: 5570317 - DNA, 15 bp, Homo sapiens
atagcagagagccaa

SEQ ID NO: 5570318 - DNA, 17 bp, Homo sapiens
atagcagagagccaaat

SEQ ID NO: 5570319 - DNA, 19 bp, Homo sapiens
atagcagaggaaaaagaaa

SEQ ID NO: 5570320 - DNA, 14 bp, Homo sapiens
atagcagaggggcc

SEQ ID NO: 5570321 - DNA, 17 bp, Homo sapiens
atagcagaggggccagg

SEQ ID NO: 5570322 - DNA, 18 bp, Homo sapiens
atagcagaggggccaggc

SEQ ID NO: 5570323 - DNA, 23 bp, Homo sapiens
atagcagaggggccaggcccagg

SEQ ID NO: 5570324 - DNA, 19 bp, Homo sapiens
atagcagccagttcaaaaa

SEQ ID NO: 5570325 - DNA, 17 bp, Homo sapiens
atagcagctttgtctct

SEQ ID NO: 5570326 - DNA, 19 bp, Homo sapiens
atagcaggtgtaataagac

SEQ ID NO: 5570327 - DNA, 15 bp, Homo sapiens
atagcagtaaaaaat

SEQ ID NO: 5570328 - DNA, 18 bp, Homo sapiens
atagcagtatatgttaat

SEQ ID NO: 5570329 - DNA, 22 bp, Homo sapiens
atagcagtgctaggataaacca

SEQ ID NO: 5570330 - DNA, 19 bp, Homo sapiens
atagcataatatgaagcct

SEQ ID NO: 5570331 - DNA, 16 bp, Homo sapiens
atagcatactgtgtat

SEQ ID NO: 5570332 - DNA, 20 bp, Homo sapiens
atagcatactgtgtatgttt

SEQ ID NO: 5570333 - DNA, 18 bp, Homo sapiens
atagcatagattgtcaaa

SEQ ID NO: 5570334 - DNA, 17 bp, Homo sapiens
atagcatatgacaaatg

SEQ ID NO: 5570335 - DNA, 20 bp, Homo sapiens
atagcatatgacaaatgttt

SEQ ID NO: 5570336 - DNA, 23 bp, Homo sapiens
atagcatatgacaaatgtttcta

SEQ ID NO: 5570337 - DNA, 16 bp, Homo sapiens
atagcatcacttaaaa

SEQ ID NO: 5570338 - DNA, 23 bp, Homo sapiens
atagcatctcaggagatttcatg

SEQ ID NO: 5570339 - DNA, 14 bp, Homo sapiens
atagcatctgctct

SEQ ID NO: 5570340 - DNA, 19 bp, Homo sapiens
atagcatctgtacaaaggg

SEQ ID NO: 5570341 - DNA, 18 bp, Homo sapiens
atagcatcttctcattcc

SEQ ID NO: 5570342 - DNA, 22 bp, Homo sapiens
atagcatcttgtggctttgcaa

SEQ ID NO: 5570343 - DNA, 18 bp, Homo sapiens
atagcatgaattctgcat

SEQ ID NO: 5570344 - DNA, 19 bp, Homo sapiens
atagcatgacatttctttg

SEQ ID NO: 5570345 - DNA, 13 bp, Homo sapiens
atagcatgcatct

SEQ ID NO: 5570346 - DNA, 15 bp, Homo sapiens
atagcatgcttcctt

SEQ ID NO: 5570347 - DNA, 16 bp, Homo sapiens
atagcatgcttccttt

SEQ ID NO: 5570348 - DNA, 14 bp, Homo sapiens
atagcatgggaggt

SEQ ID NO: 5570349 - DNA, 16 bp, Homo sapiens
atagcatggggcccct

SEQ ID NO: 5570350 - DNA, 17 bp, Homo sapiens
atagcatggggcccctg

SEQ ID NO: 5570351 - DNA, 15 bp, Homo sapiens
atagcatgtattgtg

SEQ ID NO: 5570352 - DNA, 22 bp, Homo sapiens
atagcatgtgtattaatgtcta

SEQ ID NO: 5570353 - DNA, 21 bp, Homo sapiens
atagcattaactaatctattg

SEQ ID NO: 5570354 - DNA, 20 bp, Homo sapiens
atagcattaataaaactgtg

SEQ ID NO: 5570355 - DNA, 13 bp, Homo sapiens
atagcattcataa

SEQ ID NO: 5570356 - DNA, 17 bp, Homo sapiens
atagcattgataatctt

SEQ ID NO: 5570357 - DNA, 18 bp, Homo sapiens
atagcattgataatcttc

SEQ ID NO: 5570358 - DNA, 21 bp, Homo sapiens
atagcattgtttttgtcatgt

SEQ ID NO: 5570359 - DNA, 15 bp, Homo sapiens
atagcatttaaagat

SEQ ID NO: 5570360 - DNA, 20 bp, Homo sapiens
atagcatttaaagataccaa

SEQ ID NO: 5570361 - DNA, 19 bp, Homo sapiens
atagcatttgtgtaaagac

SEQ ID NO: 5570362 - DNA, 19 bp, Homo sapiens
atagcatttttgatttatg

SEQ ID NO: 5570363 - DNA, 14 bp, Homo sapiens
atagccaaaaatag

SEQ ID NO: 5570364 - DNA, 16 bp, Homo sapiens
atagccaaaaatagct

SEQ ID NO: 5570365 - DNA, 16 bp, Homo sapiens
atagccaactctccca

SEQ ID NO: 5570366 - DNA, 15 bp, Homo sapiens
atagccaactgtagc

SEQ ID NO: 5570367 - DNA, 15 bp, Homo sapiens
atagccaaggccaaa

SEQ ID NO: 5570368 - DNA, 13 bp, Homo sapiens
atagccacatttg

SEQ ID NO: 5570369 - DNA, 16 bp, Homo sapiens
atagccacatttggaa

SEQ ID NO: 5570370 - DNA, 16 bp, Homo sapiens
atagccaccccagaaa

SEQ ID NO: 5570371 - DNA, 11 bp, Homo sapiens
atagccacctt

SEQ ID NO: 5570372 - DNA, 14 bp, Homo sapiens
atagccagacacat

SEQ ID NO: 5570373 - DNA, 20 bp, Homo sapiens
atagccagcattcagcacac

SEQ ID NO: 5570374 - DNA, 23 bp, Homo sapiens
atagccagcattcagcacacaca

SEQ ID NO: 5570375 - DNA, 18 bp, Homo sapiens
atagccagggattgaagt

SEQ ID NO: 5570376 - DNA, 20 bp, Homo sapiens
atagccatatttgtaaaatg

SEQ ID NO: 5570377 - DNA, 22 bp, Homo sapiens
atagccatatttgtaaaatgac

SEQ ID NO: 5570378 - DNA, 22 bp, Homo sapiens
atagccatcgactcctgcctga

SEQ ID NO: 5570379 - DNA, 23 bp, Homo sapiens
atagccatgtatcataattacca

SEQ ID NO: 5570380 - DNA, 18 bp, Homo sapiens
atagccattcatttacaa

SEQ ID NO: 5570381 - DNA, 19 bp, Homo sapiens
atagccatttgaagaagga

SEQ ID NO: 5570382 - DNA, 17 bp, Homo sapiens
atagccatttgccccaa

SEQ ID NO: 5570383 - DNA, 19 bp, Homo sapiens
atagccatttggaagcttt

SEQ ID NO: 5570384 - DNA, 14 bp, Homo sapiens
atagcccagatcag

SEQ ID NO: 5570385 - DNA, 13 bp, Homo sapiens
atagcccaggagc

SEQ ID NO: 5570386 - DNA, 13 bp, Homo sapiens
atagccccagact

SEQ ID NO: 5570387 - DNA, 15 bp, Homo sapiens
atagccccagactgg

SEQ ID NO: 5570388 - DNA, 18 bp, Homo sapiens
atagccccagactgggcc

SEQ ID NO: 5570389 - DNA, 15 bp, Homo sapiens
atataacatgaaatg

SEQ ID NO: 5570390 - DNA, 16 bp, Homo sapiens
atataaccaatgttta

SEQ ID NO: 5570391 - DNA, 20 bp, Homo sapiens
atataaccaatgtttaaaaa

SEQ ID NO: 5570392 - DNA, 23 bp, Homo sapiens
atataaccacaaagcacagtttg

SEQ ID NO: 5570393 - DNA, 18 bp, Homo sapiens
atataaccacatttctaa

SEQ ID NO: 5570394 - DNA, 20 bp, Homo sapiens
atataaccacatttctaagc

SEQ ID NO: 5570395 - DNA, 17 bp, Homo sapiens
atataaccataaatcaa

SEQ ID NO: 5570396 - DNA, 21 bp, Homo sapiens
atataaccattacatgtttaa

SEQ ID NO: 5570397 - DNA, 22 bp, Homo sapiens
atataacccactgctgaaaaag

SEQ ID NO: 5570398 - DNA, 19 bp, Homo sapiens
atataaccctaggaattta

SEQ ID NO: 5570399 - DNA, 19 bp, Homo sapiens
atataactattttaaatat

SEQ ID NO: 5570400 - DNA, 20 bp, Homo sapiens
atataactgtatttgaaata

SEQ ID NO: 5570401 - DNA, 14 bp, Homo sapiens
atataactgtcttg

SEQ ID NO: 5570402 - DNA, 16 bp, Homo sapiens
atataactgtcttgtt

SEQ ID NO: 5570403 - DNA, 19 bp, Homo sapiens
atataactgtcttgtttca

SEQ ID NO: 5570404 - DNA, 21 bp, Homo sapiens
atataacttaaaaatgtaaat

SEQ ID NO: 5570405 - DNA, 15 bp, Homo sapiens
atataactttagaaa

SEQ ID NO: 5570406 - DNA, 21 bp, Homo sapiens
atataagaaaagtaatgaaga

SEQ ID NO: 5570407 - DNA, 14 bp, Homo sapiens
atataagaaaatgc

SEQ ID NO: 5570408 - DNA, 16 bp, Homo sapiens
atataagaaaatgctt

SEQ ID NO: 5570409 - DNA, 15 bp, Homo sapiens
atataagaaagacat

SEQ ID NO: 5570410 - DNA, 19 bp, Homo sapiens
atataagaacttgatatat

SEQ ID NO: 5570411 - DNA, 23 bp, Homo sapiens
atataagaagcaatctttgaaat

SEQ ID NO: 5570412 - DNA, 14 bp, Homo sapiens
atataagaataaaa

SEQ ID NO: 5570413 - DNA, 17 bp, Homo sapiens
atataagacaagtctga

SEQ ID NO: 5570414 - DNA, 15 bp, Homo sapiens
atataagacattaag

SEQ ID NO: 5570415 - DNA, 15 bp, Homo sapiens
atataagacatttgt

SEQ ID NO: 5570416 - DNA, 16 bp, Homo sapiens
atataagactgctgca

SEQ ID NO: 5570417 - DNA, 14 bp, Homo sapiens
atataagattttct

SEQ ID NO: 5570418 - DNA, 13 bp, Homo sapiens
atataagcaaaat

SEQ ID NO: 5570419 - DNA, 17 bp, Homo sapiens
atataagcaaaatgaaa

SEQ ID NO: 5570420 - DNA, 19 bp, Homo sapiens
atataagcataaaagatca

SEQ ID NO: 5570421 - DNA, 12 bp, Homo sapiens
atataagccata

SEQ ID NO: 5570422 - DNA, 22 bp, Homo sapiens
atataagcccttgattggaagg

SEQ ID NO: 5570423 - DNA, 19 bp, Homo sapiens
atataagctgaaattgtgt

SEQ ID NO: 5570424 - DNA, 12 bp, Homo sapiens
atataagctgtt

SEQ ID NO: 5570425 - DNA, 15 bp, Homo sapiens
atataagcttaaaat

SEQ ID NO: 5570426 - DNA, 16 bp, Homo sapiens
atataagcttaaaata

SEQ ID NO: 5570427 - DNA, 17 bp, Homo sapiens
atataagcttaaaataa

SEQ ID NO: 5570428 - DNA, 19 bp, Homo sapiens
atataagcttgtattcctt

SEQ ID NO: 5570429 - DNA, 16 bp, Homo sapiens
atataaggaggaaaac

SEQ ID NO: 5570430 - DNA, 14 bp, Homo sapiens
atataagggaagta

SEQ ID NO: 5570431 - DNA, 23 bp, Homo sapiens
atataagggaagtagttatcatg

SEQ ID NO: 5570432 - DNA, 22 bp, Homo sapiens
atataaggtcatagattcttga

SEQ ID NO: 5570433 - DNA, 22 bp, Homo sapiens
atataagtcttggtaacaaata

SEQ ID NO: 5570434 - DNA, 18 bp, Homo sapiens
atataagtttattgtaaa

SEQ ID NO: 5570435 - DNA, 18 bp, Homo sapiens
atataagtttctttagaa

SEQ ID NO: 5570436 - DNA, 14 bp, Homo sapiens
atataagtttgaag

SEQ ID NO: 5570437 - DNA, 17 bp, Homo sapiens
atataagtttgaaggaa

SEQ ID NO: 5570438 - DNA, 21 bp, Homo sapiens
atataagtttgaaggaaacag

SEQ ID NO: 5570439 - DNA, 18 bp, Homo sapiens
atataataaaagtgcctt

SEQ ID NO: 5570440 - DNA, 21 bp, Homo sapiens
atataataaagctactgattt

SEQ ID NO: 5570441 - DNA, 14 bp, Homo sapiens
atataataaagtat

SEQ ID NO: 5570442 - DNA, 20 bp, Homo sapiens
atataataaagtattccacc

SEQ ID NO: 5570443 - DNA, 14 bp, Homo sapiens
atataataaatact

SEQ ID NO: 5570444 - DNA, 22 bp, Homo sapiens
atataataaatatatatttatc

SEQ ID NO: 5570445 - DNA, 23 bp, Homo sapiens
atataataaatatatatttatca

SEQ ID NO: 5570446 - DNA, 15 bp, Homo sapiens
atataataaatggga

SEQ ID NO: 5570447 - DNA, 12 bp, Homo sapiens
atataataactt

SEQ ID NO: 5570448 - DNA, 15 bp, Homo sapiens
atataataactttat

SEQ ID NO: 5570449 - DNA, 22 bp, Homo sapiens
atataataatagttattattta

SEQ ID NO: 5570450 - DNA, 16 bp, Homo sapiens
atataataattactta

SEQ ID NO: 5570451 - DNA, 17 bp, Homo sapiens
atataatacacaaaatc

SEQ ID NO: 5570452 - DNA, 12 bp, Homo sapiens
atataatacata

SEQ ID NO: 5570453 - DNA, 14 bp, Homo sapiens
atataatactaaag

SEQ ID NO: 5570454 - DNA, 15 bp, Homo sapiens
atataatactaaagt

SEQ ID NO: 5570455 - DNA, 16 bp, Homo sapiens
atataatactaaagtg

SEQ ID NO: 5570456 - DNA, 15 bp, Homo sapiens
atataatacttaaaa

SEQ ID NO: 5570457 - DNA, 17 bp, Homo sapiens
atataatacttaaaaat

SEQ ID NO: 5570458 - DNA, 13 bp, Homo sapiens
atataatatacta

SEQ ID NO: 5570459 - DNA, 23 bp, Homo sapiens
atataatatatatatatatcagt

SEQ ID NO: 5570460 - DNA, 15 bp, Homo sapiens
atataatatatgttt

SEQ ID NO: 5570461 - DNA, 20 bp, Homo sapiens
atataatatctaaagttata

SEQ ID NO: 5570462 - DNA, 14 bp, Homo sapiens
atataatatgaata

SEQ ID NO: 5570463 - DNA, 14 bp, Homo sapiens
atataatatgtcac

SEQ ID NO: 5570464 - DNA, 22 bp, Homo sapiens
atataatattcagccagcttaa

SEQ ID NO: 5570465 - DNA, 16 bp, Homo sapiens
atataatatttactgt

SEQ ID NO: 5570466 - DNA, 13 bp, Homo sapiens
atataatcaaatg

SEQ ID NO: 5570467 - DNA, 17 bp, Homo sapiens
atataatcatcaagtaa

SEQ ID NO: 5570468 - DNA, 23 bp, Homo sapiens
atataatcatgctcatgtatatt

SEQ ID NO: 5570469 - DNA, 14 bp, Homo sapiens
atataatcattatt

SEQ ID NO: 5570470 - DNA, 23 bp, Homo sapiens
atataatctgaatcctgttaaat

SEQ ID NO: 5570471 - DNA, 20 bp, Homo sapiens
atataatgagtcacaaaata

SEQ ID NO: 5570472 - DNA, 18 bp, Homo sapiens
atataatgagtttcatta

SEQ ID NO: 5570473 - DNA, 21 bp, Homo sapiens
atataatggcctcttaaaaat

SEQ ID NO: 5570474 - DNA, 19 bp, Homo sapiens
atataatggtgatgtcata

SEQ ID NO: 5570475 - DNA, 18 bp, Homo sapiens
atataatggtttactgct

SEQ ID NO: 5570476 - DNA, 19 bp, Homo sapiens
atataatggtttactgctg

SEQ ID NO: 5570477 - DNA, 21 bp, Homo sapiens
atataatggtttcaaagattc

SEQ ID NO: 5570478 - DNA, 12 bp, Homo sapiens
atataatgtatt

SEQ ID NO: 5570479 - DNA, 16 bp, Homo sapiens
atataatgtgtgcttt

SEQ ID NO: 5570480 - DNA, 15 bp, Homo sapiens
atataatgttgataa

SEQ ID NO: 5570481 - DNA, 20 bp, Homo sapiens
atataatgttgataatatat

SEQ ID NO: 5570482 - DNA, 19 bp, Homo sapiens
atataattatgttattgaa

SEQ ID NO: 5570483 - DNA, 19 bp, Homo sapiens
atataattctgaaatgttt

SEQ ID NO: 5570484 - DNA, 13 bp, Homo sapiens
atataattctgta

SEQ ID NO: 5570485 - DNA, 14 bp, Homo sapiens
atataattctgtaa

SEQ ID NO: 5570486 - DNA, 17 bp, Homo sapiens
atataattctgtacata

SEQ ID NO: 5570487 - DNA, 19 bp, Homo sapiens
atataattctgtacatagc

SEQ ID NO: 5570488 - DNA, 13 bp, Homo sapiens
atataattctttt

SEQ ID NO: 5570489 - DNA, 15 bp, Homo sapiens
atataattgggattt

SEQ ID NO: 5570490 - DNA, 18 bp, Homo sapiens
atataattgggattttaa

SEQ ID NO: 5570491 - DNA, 18 bp, Homo sapiens
atataattgttttttatc

SEQ ID NO: 5570492 - DNA, 13 bp, Homo sapiens
atataatttaaca

SEQ ID NO: 5570493 - DNA, 23 bp, Homo sapiens
atataatttaacagaagttgtga

SEQ ID NO: 5570494 - DNA, 21 bp, Homo sapiens
atataatttactttgtagact

SEQ ID NO: 5570495 - DNA, 15 bp, Homo sapiens
atataatttataagc

SEQ ID NO: 5570496 - DNA, 22 bp, Homo sapiens
atataatttatttccactaaaa

SEQ ID NO: 5570497 - DNA, 17 bp, Homo sapiens
atataatttgagtgtat

SEQ ID NO: 5570498 - DNA, 18 bp, Homo sapiens
atataatttgagtgtata

SEQ ID NO: 5570499 - DNA, 23 bp, Homo sapiens
atataatttgagtgtatatatat

SEQ ID NO: 5570500 - DNA, 19 bp, Homo sapiens
atataattttcacttctgt

SEQ ID NO: 5570501 - DNA, 22 bp, Homo sapiens
atataattttggtaattttgat

SEQ ID NO: 5570502 - DNA, 11 bp, Homo sapiens
atataattttt

SEQ ID NO: 5570503 - DNA, 15 bp, Homo sapiens
atataatttttcctt

SEQ ID NO: 5570504 - DNA, 15 bp, Homo sapiens
atatacaaaaagaaa

SEQ ID NO: 5570505 - DNA, 15 bp, Homo sapiens
atatacaaaacttta

SEQ ID NO: 5570506 - DNA, 15 bp, Homo sapiens
atatacaaacatgta

SEQ ID NO: 5570507 - DNA, 21 bp, Homo sapiens
atatacaaacctttagctgtg

SEQ ID NO: 5570508 - DNA, 19 bp, Homo sapiens
atatacaagctacagttgt

SEQ ID NO: 5570509 - DNA, 14 bp, Homo sapiens
atatacaagtaaat

SEQ ID NO: 5570510 - DNA, 18 bp, Homo sapiens
atatacaataacataatt

SEQ ID NO: 5570511 - DNA, 14 bp, Homo sapiens
atatacaataatgg

SEQ ID NO: 5570512 - DNA, 17 bp, Homo sapiens
atatacaataatggaaa

SEQ ID NO: 5570513 - DNA, 19 bp, Homo sapiens
atatacaatatatattttg

SEQ ID NO: 5570514 - DNA, 21 bp, Homo sapiens
atatacaatatatattttgtg

SEQ ID NO: 5570515 - DNA, 20 bp, Homo sapiens
atatacacaaagatattatt

SEQ ID NO: 5570516 - DNA, 13 bp, Homo sapiens
atatacacacaca

SEQ ID NO: 5570517 - DNA, 18 bp, Homo sapiens
atatacacacacaaagag

SEQ ID NO: 5570518 - DNA, 20 bp, Homo sapiens
atatacacacacaaagagag

SEQ ID NO: 5570519 - DNA, 13 bp, Homo sapiens
atatacacatttt

SEQ ID NO: 5570520 - DNA, 17 bp, Homo sapiens
atatacacattttgtaa

SEQ ID NO: 5570521 - DNA, 18 bp, Homo sapiens
atatacacattttgtaaa

SEQ ID NO: 5570522 - DNA, 17 bp, Homo sapiens
atatacagacctccaga

SEQ ID NO: 5570523 - DNA, 12 bp, Homo sapiens
atatacagagcc

SEQ ID NO: 5570524 - DNA, 14 bp, Homo sapiens
atatacagaggaaa

SEQ ID NO: 5570525 - DNA, 19 bp, Homo sapiens
atatacagcaggatgtgcc

SEQ ID NO: 5570526 - DNA, 22 bp, Homo sapiens
atatacagcatgagattgtaca

SEQ ID NO: 5570527 - DNA, 14 bp, Homo sapiens
atatacagtaactt

SEQ ID NO: 5570528 - DNA, 17 bp, Homo sapiens
atatacagtatagattt

SEQ ID NO: 5570529 - DNA, 16 bp, Homo sapiens
atatacagtgtgtagt

SEQ ID NO: 5570530 - DNA, 14 bp, Homo sapiens
atatacagttattt

SEQ ID NO: 5570531 - DNA, 19 bp, Homo sapiens
atatacagttattttggat

SEQ ID NO: 5570532 - DNA, 17 bp, Homo sapiens
atatacagtttttgtaa

SEQ ID NO: 5570533 - DNA, 12 bp, Homo sapiens
atatacataaaa

SEQ ID NO: 5570534 - DNA, 13 bp, Homo sapiens
atatacatataca

SEQ ID NO: 5570535 - DNA, 23 bp, Homo sapiens
atatacatatatatatacacata

SEQ ID NO: 5570536 - DNA, 15 bp, Homo sapiens
atatacatattataa

SEQ ID NO: 5570537 - DNA, 20 bp, Homo sapiens
atatacatcatacttaactt

SEQ ID NO: 5570538 - DNA, 22 bp, Homo sapiens
atatacatcatacttaacttta

SEQ ID NO: 5570539 - DNA, 17 bp, Homo sapiens
atatacatctagcacag

SEQ ID NO: 5570540 - DNA, 18 bp, Homo sapiens
atatacatctagcacagc

SEQ ID NO: 5570541 - DNA, 19 bp, Homo sapiens
atatacatgaaaattttaa

SEQ ID NO: 5570542 - DNA, 18 bp, Homo sapiens
atatacatgtaaaaatgt

SEQ ID NO: 5570543 - DNA, 15 bp, Homo sapiens
atatacatgtatagt

SEQ ID NO: 5570544 - DNA, 16 bp, Homo sapiens
atatacatgtgtgtat

SEQ ID NO: 5570545 - DNA, 21 bp, Homo sapiens
atatacatgtgtgtatatatg

SEQ ID NO: 5570546 - DNA, 22 bp, Homo sapiens
atatacatgtgtgtatatatgt

SEQ ID NO: 5570547 - DNA, 21 bp, Homo sapiens
atatacatgtttatgtaaaca

SEQ ID NO: 5570548 - DNA, 21 bp, Homo sapiens
atatacatgtttttctattaa

SEQ ID NO: 5570549 - DNA, 10 bp, Homo sapiens
atatacatta

SEQ ID NO: 5570550 - DNA, 17 bp, Homo sapiens
atatacattagacacac

SEQ ID NO: 5570551 - DNA, 15 bp, Homo sapiens
atatacattatttct

SEQ ID NO: 5570552 - DNA, 11 bp, Homo sapiens
atatacattgt

SEQ ID NO: 5570553 - DNA, 12 bp, Homo sapiens
atatacattgtg

SEQ ID NO: 5570554 - DNA, 23 bp, Homo sapiens
atatacattgtgtgaaaaaagaa

SEQ ID NO: 5570555 - DNA, 12 bp, Homo sapiens
atatacatttca

SEQ ID NO: 5570556 - DNA, 18 bp, Homo sapiens
atatacatttgttggtaa

SEQ ID NO: 5570557 - DNA, 13 bp, Homo sapiens
atatacattttgc

SEQ ID NO: 5570558 - DNA, 23 bp, Homo sapiens
atatacatttttagcctgtgtca

SEQ ID NO: 5570559 - DNA, 21 bp, Homo sapiens
atataccaatgacttccatat

SEQ ID NO: 5570560 - DNA, 14 bp, Homo sapiens
atataccatttatc

SEQ ID NO: 5570561 - DNA, 19 bp, Homo sapiens
atataccccaaattgtgta

SEQ ID NO: 5570562 - DNA, 19 bp, Homo sapiens
atatacctataatgtgtgt

SEQ ID NO: 5570563 - DNA, 21 bp, Homo sapiens
atatacctataatgtgtgtat

SEQ ID NO: 5570564 - DNA, 16 bp, Homo sapiens
atataccttatttatt

SEQ ID NO: 5570565 - DNA, 21 bp, Homo sapiens
atataccttatttatttttgt

SEQ ID NO: 5570566 - DNA, 21 bp, Homo sapiens
atataccttttttgttccact

SEQ ID NO: 5570567 - DNA, 15 bp, Homo sapiens
atatccagttcctgc

SEQ ID NO: 5570568 - DNA, 17 bp, Homo sapiens
atatccagttcctgctc

SEQ ID NO: 5570569 - DNA, 13 bp, Homo sapiens
atatccatatgaa

SEQ ID NO: 5570570 - DNA, 23 bp, Homo sapiens
atatccattctgtagacttttga

SEQ ID NO: 5570571 - DNA, 15 bp, Homo sapiens
atatccatttatctt

SEQ ID NO: 5570572 - DNA, 17 bp, Homo sapiens
atatccatttatctttt

SEQ ID NO: 5570573 - DNA, 14 bp, Homo sapiens
atatcccaaactgt

SEQ ID NO: 5570574 - DNA, 16 bp, Homo sapiens
atatcccaaactgtga

SEQ ID NO: 5570575 - DNA, 15 bp, Homo sapiens
atatcccaacattct

SEQ ID NO: 5570576 - DNA, 11 bp, Homo sapiens
atatcccagag

SEQ ID NO: 5570577 - DNA, 15 bp, Homo sapiens
atatccccactactc

SEQ ID NO: 5570578 - DNA, 18 bp, Homo sapiens
atatcccctatttaacag

SEQ ID NO: 5570579 - DNA, 17 bp, Homo sapiens
atatcccgggggtgggg

SEQ ID NO: 5570580 - DNA, 16 bp, Homo sapiens
atatccctacatgtat

SEQ ID NO: 5570581 - DNA, 17 bp, Homo sapiens
atatccctacatgtatt

SEQ ID NO: 5570582 - DNA, 20 bp, Homo sapiens
atatccctcatttcattatt

SEQ ID NO: 5570583 - DNA, 11 bp, Homo sapiens
atatccctccc

SEQ ID NO: 5570584 - DNA, 23 bp, Homo sapiens
atatccctcccctctctccctgg

SEQ ID NO: 5570585 - DNA, 20 bp, Homo sapiens
atatccctcctgttgggaga

SEQ ID NO: 5570586 - DNA, 14 bp, Homo sapiens
atatccctcttgta

SEQ ID NO: 5570587 - DNA, 18 bp, Homo sapiens
atatccctgcccagcctg

SEQ ID NO: 5570588 - DNA, 14 bp, Homo sapiens
atatcccttacttt

SEQ ID NO: 5570589 - DNA, 11 bp, Homo sapiens
atatcccttcc

SEQ ID NO: 5570590 - DNA, 13 bp, Homo sapiens
atatcccttccag

SEQ ID NO: 5570591 - DNA, 22 bp, Homo sapiens
atatcccttggacattttatgt

SEQ ID NO: 5570592 - DNA, 23 bp, Homo sapiens
atatcccttggacattttatgtc

SEQ ID NO: 5570593 - DNA, 22 bp, Homo sapiens
atatccgggtgctcaataaact

SEQ ID NO: 5570594 - DNA, 15 bp, Homo sapiens
atatcctaaacatca

SEQ ID NO: 5570595 - DNA, 13 bp, Homo sapiens
atatcctaataaa

SEQ ID NO: 5570596 - DNA, 14 bp, Homo sapiens
atatcctaataaaa

SEQ ID NO: 5570597 - DNA, 18 bp, Homo sapiens
atatcctaataaaaaggt

SEQ ID NO: 5570598 - DNA, 23 bp, Homo sapiens
atatcctaataaaaaggtgacca

SEQ ID NO: 5570599 - DNA, 19 bp, Homo sapiens
atatcctctccccctcctc

SEQ ID NO: 5570600 - DNA, 20 bp, Homo sapiens
atatcctctccccctcctcc

SEQ ID NO: 5570601 - DNA, 21 bp, Homo sapiens
atatcctgaaagcattatttt

SEQ ID NO: 5570602 - DNA, 17 bp, Homo sapiens
atatcctggtgtctagt

SEQ ID NO: 5570603 - DNA, 13 bp, Homo sapiens
atatcctgtgact

SEQ ID NO: 5570604 - DNA, 14 bp, Homo sapiens
atatcctgtgactg

SEQ ID NO: 5570605 - DNA, 17 bp, Homo sapiens
atatcctgtttgtattt

SEQ ID NO: 5570606 - DNA, 18 bp, Homo sapiens
atatcctgtttgtatttt

SEQ ID NO: 5570607 - DNA, 21 bp, Homo sapiens
atatccttaaccattctgtcc

SEQ ID NO: 5570608 - DNA, 17 bp, Homo sapiens
atatccttatcagagct

SEQ ID NO: 5570609 - DNA, 22 bp, Homo sapiens
atatccttctagatcatacaca

SEQ ID NO: 5570610 - DNA, 20 bp, Homo sapiens
atatcctttgccccaaggct

SEQ ID NO: 5570611 - DNA, 20 bp, Homo sapiens
atatcgctgatgcagacaca

SEQ ID NO: 5570612 - DNA, 21 bp, Homo sapiens
atatcgctgatgcagacacag

SEQ ID NO: 5570613 - DNA, 21 bp, Homo sapiens
atatcggaggtggtggaggag

SEQ ID NO: 5570614 - DNA, 13 bp, Homo sapiens
atatcgtgtgtgt

SEQ ID NO: 5570615 - DNA, 14 bp, Homo sapiens
atatctaaaatatt

SEQ ID NO: 5570616 - DNA, 14 bp, Homo sapiens
atatctaaagttat

SEQ ID NO: 5570617 - DNA, 16 bp, Homo sapiens
atatctaaagttatat

SEQ ID NO: 5570618 - DNA, 12 bp, Homo sapiens
atatctaacttt

SEQ ID NO: 5570619 - DNA, 13 bp, Homo sapiens
atatctaatatat

SEQ ID NO: 5570620 - DNA, 19 bp, Homo sapiens
atatctaatatatatgaat

SEQ ID NO: 5570621 - DNA, 15 bp, Homo sapiens
atatctaatatgaag

SEQ ID NO: 5570622 - DNA, 18 bp, Homo sapiens
atatctaattatttccac

SEQ ID NO: 5570623 - DNA, 13 bp, Homo sapiens
atatctaatttac

SEQ ID NO: 5570624 - DNA, 23 bp, Homo sapiens
atatctaatttatacaaaataat

SEQ ID NO: 5570625 - DNA, 21 bp, Homo sapiens
atatctacagcttctattcat

SEQ ID NO: 5570626 - DNA, 23 bp, Homo sapiens
atatctaccccagactagatgta

SEQ ID NO: 5570627 - DNA, 17 bp, Homo sapiens
atatctacctgccctct

SEQ ID NO: 5570628 - DNA, 17 bp, Homo sapiens
atatctagatttctaga

SEQ ID NO: 5570629 - DNA, 17 bp, Homo sapiens
atatctaggtttatgac

SEQ ID NO: 5570630 - DNA, 21 bp, Homo sapiens
atatctaggtttatgacagta

SEQ ID NO: 5570631 - DNA, 15 bp, Homo sapiens
atatctagtatgaaa

SEQ ID NO: 5570632 - DNA, 17 bp, Homo sapiens
atatctagtatgaaatt

SEQ ID NO: 5570633 - DNA, 14 bp, Homo sapiens
atatctagtgctaa

SEQ ID NO: 5570634 - DNA, 15 bp, Homo sapiens
atatctagtgctaaa

SEQ ID NO: 5570635 - DNA, 15 bp, Homo sapiens
atatctataaaatag

SEQ ID NO: 5570636 - DNA, 17 bp, Homo sapiens
atatctataaaatagat

SEQ ID NO: 5570637 - DNA, 22 bp, Homo sapiens
atatctataaaatagatataaa

SEQ ID NO: 5570638 - DNA, 20 bp, Homo sapiens
atatctatagtagtcaatta

SEQ ID NO: 5570639 - DNA, 22 bp, Homo sapiens
atatctatagtagtcaattagt

SEQ ID NO: 5570640 - DNA, 23 bp, Homo sapiens
atatctatagtagtcaattagta

SEQ ID NO: 5570641 - DNA, 17 bp, Homo sapiens
atatctatatatataat

SEQ ID NO: 5570642 - DNA, 18 bp, Homo sapiens
atatctatatatgtatct

SEQ ID NO: 5570643 - DNA, 19 bp, Homo sapiens
atatctatatatgtatcta

SEQ ID NO: 5570644 - DNA, 14 bp, Homo sapiens
atatctatatcata

SEQ ID NO: 5570645 - DNA, 13 bp, Homo sapiens
atatctatatctc

SEQ ID NO: 5570646 - DNA, 18 bp, Homo sapiens
atatctatatgtctataa

SEQ ID NO: 5570647 - DNA, 14 bp, Homo sapiens
atatctatattcta

SEQ ID NO: 5570648 - DNA, 17 bp, Homo sapiens
atatctatattctaaag

SEQ ID NO: 5570649 - DNA, 18 bp, Homo sapiens
atatctatattctaaaga

SEQ ID NO: 5570650 - DNA, 16 bp, Homo sapiens
atatctatattttaca

SEQ ID NO: 5570651 - DNA, 14 bp, Homo sapiens
atatctatctattt

SEQ ID NO: 5570652 - DNA, 17 bp, Homo sapiens
atatctatctatttgag

SEQ ID NO: 5570653 - DNA, 13 bp, Homo sapiens
atatctatcttat

SEQ ID NO: 5570654 - DNA, 14 bp, Homo sapiens
atatctatcttata

SEQ ID NO: 5570655 - DNA, 20 bp, Homo sapiens
atatctatcttatatagttt

SEQ ID NO: 5570656 - DNA, 14 bp, Homo sapiens
atatctatgggaaa

SEQ ID NO: 5570657 - DNA, 15 bp, Homo sapiens
atatctattaatata

SEQ ID NO: 5570658 - DNA, 18 bp, Homo sapiens
atatctattaatatatgt

SEQ ID NO: 5570659 - DNA, 14 bp, Homo sapiens
atatctattatgta

SEQ ID NO: 5570660 - DNA, 21 bp, Homo sapiens
atatctattattataaaaata

SEQ ID NO: 5570661 - DNA, 21 bp, Homo sapiens
atatctatttgaataaattat

SEQ ID NO: 5570662 - DNA, 20 bp, Homo sapiens
atatctatttgagagcagat

SEQ ID NO: 5570663 - DNA, 23 bp, Homo sapiens
atatctcaatgtgcaataacttg

SEQ ID NO: 5570664 - DNA, 18 bp, Homo sapiens
atatctccatagctggga

SEQ ID NO: 5570665 - DNA, 21 bp, Homo sapiens
atatctccatagctgggaaac

SEQ ID NO: 5570666 - DNA, 22 bp, Homo sapiens
atatctccatgaagttttccca

SEQ ID NO: 5570667 - DNA, 19 bp, Homo sapiens
atatctccgtcaactcata

SEQ ID NO: 5570668 - DNA, 13 bp, Homo sapiens
atatctcctgaaa

SEQ ID NO: 5570669 - DNA, 23 bp, Homo sapiens
atatctcctgaaaaggtttatga

SEQ ID NO: 5570670 - DNA, 13 bp, Homo sapiens
atatctcctggaa

SEQ ID NO: 5570671 - DNA, 20 bp, Homo sapiens
atatctctgccaacatgagg

SEQ ID NO: 5570672 - DNA, 12 bp, Homo sapiens
atatctctgccg

SEQ ID NO: 5570673 - DNA, 22 bp, Homo sapiens
atatctctgccgtctctcctgc

SEQ ID NO: 5570674 - DNA, 17 bp, Homo sapiens
atatctcttggaaaata

SEQ ID NO: 5570675 - DNA, 17 bp, Homo sapiens
atatctgaaaactggaa

SEQ ID NO: 5570676 - DNA, 23 bp, Homo sapiens
atatctgaaaactggaataagaa

SEQ ID NO: 5570677 - DNA, 14 bp, Homo sapiens
atatctgaaaatat

SEQ ID NO: 5570678 - DNA, 18 bp, Homo sapiens
atatctgaacatttacta

SEQ ID NO: 5570679 - DNA, 13 bp, Homo sapiens
atatctgaagatt

SEQ ID NO: 5570680 - DNA, 12 bp, Homo sapiens
atatctgaatat

SEQ ID NO: 5570681 - DNA, 15 bp, Homo sapiens
atatctgaccaagat

SEQ ID NO: 5570682 - DNA, 16 bp, Homo sapiens
atatctgaccaagatt

SEQ ID NO: 5570683 - DNA, 20 bp, Homo sapiens
atatctgactgaaattaaac

SEQ ID NO: 5570684 - DNA, 18 bp, Homo sapiens
atatctgacttctaggat

SEQ ID NO: 5570685 - DNA, 23 bp, Homo sapiens
atatctgagaattgcaaaactag

SEQ ID NO: 5570686 - DNA, 23 bp, Homo sapiens
atatctgagagacctgtgtgaac

SEQ ID NO: 5570687 - DNA, 17 bp, Homo sapiens
atatctgaggaattctg

SEQ ID NO: 5570688 - DNA, 21 bp, Homo sapiens
atatctgaggaattctgtata

SEQ ID NO: 5570689 - DNA, 22 bp, Homo sapiens
atatctgaggaattctgtatag

SEQ ID NO: 5570690 - DNA, 15 bp, Homo sapiens
atatctgagttgtgc

SEQ ID NO: 5570691 - DNA, 18 bp, Homo sapiens
atatctgagttgtgcctc

SEQ ID NO: 5570692 - DNA, 13 bp, Homo sapiens
atatctgcaaaaa

SEQ ID NO: 5570693 - DNA, 16 bp, Homo sapiens
atatctgcatgtgtca

SEQ ID NO: 5570694 - DNA, 22 bp, Homo sapiens
atatctgcatttaccactgtat

SEQ ID NO: 5570695 - DNA, 18 bp, Homo sapiens
atatctgcctttattgtg

SEQ ID NO: 5570696 - DNA, 20 bp, Homo sapiens
atatctgcctttattgtgtt

SEQ ID NO: 5570697 - DNA, 13 bp, Homo sapiens
atatctgctgtat

SEQ ID NO: 5570698 - DNA, 22 bp, Homo sapiens
atatctggagtgagaggccccc

SEQ ID NO: 5570699 - DNA, 19 bp, Homo sapiens
atatctggcactgttaata

SEQ ID NO: 5570700 - DNA, 20 bp, Homo sapiens
atatctggcctaaaatcttg

SEQ ID NO: 5570701 - DNA, 16 bp, Homo sapiens
atatctggctcaacat

SEQ ID NO: 5570702 - DNA, 17 bp, Homo sapiens
atatctgggattctact

SEQ ID NO: 5570703 - DNA, 15 bp, Homo sapiens
atatctggtatatgt

SEQ ID NO: 5570704 - DNA, 23 bp, Homo sapiens
atatctgtaaatttaactgcata

SEQ ID NO: 5570705 - DNA, 15 bp, Homo sapiens
atatctgtaatggta

SEQ ID NO: 5570706 - DNA, 20 bp, Homo sapiens
atatctgtacagatcaagaa

SEQ ID NO: 5570707 - DNA, 12 bp, Homo sapiens
atatctgtatgt

SEQ ID NO: 5570708 - DNA, 15 bp, Homo sapiens
atatctgtatgtatt

SEQ ID NO: 5570709 - DNA, 21 bp, Homo sapiens
atatctgtatgtattagtgat

SEQ ID NO: 5570710 - DNA, 19 bp, Homo sapiens
atatctgtgcaatggaata

SEQ ID NO: 5570711 - DNA, 21 bp, Homo sapiens
atatctgtgcaatggaatata

SEQ ID NO: 5570712 - DNA, 14 bp, Homo sapiens
atatctgtgtaaga

SEQ ID NO: 5570713 - DNA, 17 bp, Homo sapiens
atatctgtgtgccctag

SEQ ID NO: 5570714 - DNA, 15 bp, Homo sapiens
atatctgttagatgc

SEQ ID NO: 5570715 - DNA, 21 bp, Homo sapiens
atatctgttcaacctcagtat

SEQ ID NO: 5570716 - DNA, 16 bp, Homo sapiens
atatctgttggagaaa

SEQ ID NO: 5570717 - DNA, 14 bp, Homo sapiens
atatctgtttattc

SEQ ID NO: 5570718 - DNA, 16 bp, Homo sapiens
atatctgtttattctg

SEQ ID NO: 5570719 - DNA, 17 bp, Homo sapiens
atatctgtttgcttcta

SEQ ID NO: 5570720 - DNA, 16 bp, Homo sapiens
atatctgttttactgc

SEQ ID NO: 5570721 - DNA, 20 bp, Homo sapiens
atatctgttttactgctttt

SEQ ID NO: 5570722 - DNA, 15 bp, Homo sapiens
atatcttacagccag

SEQ ID NO: 5570723 - DNA, 19 bp, Homo sapiens
atatcttcacattgtgtga

SEQ ID NO: 5570724 - DNA, 17 bp, Homo sapiens
atatcttcaccctgtaa

SEQ ID NO: 5570725 - DNA, 20 bp, Homo sapiens
atatcttcagctctttttgt

SEQ ID NO: 5570726 - DNA, 13 bp, Homo sapiens
atatcttcagttt

SEQ ID NO: 5570727 - DNA, 16 bp, Homo sapiens
atatcttcatttctaa

SEQ ID NO: 5570728 - DNA, 15 bp, Homo sapiens
atatcttcctttggg

SEQ ID NO: 5570729 - DNA, 15 bp, Homo sapiens
atatcttgaaatgaa

SEQ ID NO: 5570730 - DNA, 12 bp, Homo sapiens
atatcttgaaga

SEQ ID NO: 5570731 - DNA, 13 bp, Homo sapiens
atatcttgccttc

SEQ ID NO: 5570732 - DNA, 23 bp, Homo sapiens
atatcttgcttgaacttacaggt

SEQ ID NO: 5570733 - DNA, 19 bp, Homo sapiens
atatcttggacaaatcaca

SEQ ID NO: 5570734 - DNA, 23 bp, Homo sapiens
atatcttggcctaaacctcagtt

SEQ ID NO: 5570735 - DNA, 14 bp, Homo sapiens
atatcttgtttaca

SEQ ID NO: 5570736 - DNA, 21 bp, Homo sapiens
atatcttgtttacaataaaga

SEQ ID NO: 5570737 - DNA, 17 bp, Homo sapiens
atatctttaaataaatg

SEQ ID NO: 5570738 - DNA, 18 bp, Homo sapiens
atatctttaaataaatgt

SEQ ID NO: 5570739 - DNA, 19 bp, Homo sapiens
atatctttaaataaatgtg

SEQ ID NO: 5570740 - DNA, 21 bp, Homo sapiens
atatctttacaagcaggcact

SEQ ID NO: 5570741 - DNA, 12 bp, Homo sapiens
atatctttatac

SEQ ID NO: 5570742 - DNA, 14 bp, Homo sapiens
atatctttatgcaa

SEQ ID NO: 5570743 - DNA, 13 bp, Homo sapiens
atatctttatgta

SEQ ID NO: 5570744 - DNA, 14 bp, Homo sapiens
atatctttctcatt

SEQ ID NO: 5570745 - DNA, 14 bp, Homo sapiens
atattaaattctca

SEQ ID NO: 5570746 - DNA, 21 bp, Homo sapiens
atattaaatttatatcttata

SEQ ID NO: 5570747 - DNA, 18 bp, Homo sapiens
atattaaattttttgttg

SEQ ID NO: 5570748 - DNA, 20 bp, Homo sapiens
atattaacacgctgcctggt

SEQ ID NO: 5570749 - DNA, 16 bp, Homo sapiens
atattaacatcatctt

SEQ ID NO: 5570750 - DNA, 22 bp, Homo sapiens
atattaactgacgaagaagcaa

SEQ ID NO: 5570751 - DNA, 22 bp, Homo sapiens
atattaagaaaaatatcaagta

SEQ ID NO: 5570752 - DNA, 24 bp, Homo sapiens
atattaagaaagactatctaaatg

SEQ ID NO: 5570753 - DNA, 18 bp, Homo sapiens
atattaagaactgctgtt

SEQ ID NO: 5570754 - DNA, 19 bp, Homo sapiens
atattaagaagcaataact

SEQ ID NO: 5570755 - DNA, 13 bp, Homo sapiens
atattaagaatct

SEQ ID NO: 5570756 - DNA, 14 bp, Homo sapiens
atattaagaatgat

SEQ ID NO: 5570757 - DNA, 22 bp, Homo sapiens
atattaagacagacgcctgctt

SEQ ID NO: 5570758 - DNA, 14 bp, Homo sapiens
atattaagacagtg

SEQ ID NO: 5570759 - DNA, 16 bp, Homo sapiens
atattaagacagtgta

SEQ ID NO: 5570760 - DNA, 19 bp, Homo sapiens
atattaagacagtgtacaa

SEQ ID NO: 5570761 - DNA, 12 bp, Homo sapiens
atattaagcaca

SEQ ID NO: 5570762 - DNA, 20 bp, Homo sapiens
atattaagcacattattgta

SEQ ID NO: 5570763 - DNA, 18 bp, Homo sapiens
atattaagctaaaaggtt

SEQ ID NO: 5570764 - DNA, 22 bp, Homo sapiens
atattaaggaagacaatgtgaa

SEQ ID NO: 5570765 - DNA, 16 bp, Homo sapiens
atattaagtgttgtac

SEQ ID NO: 5570766 - DNA, 17 bp, Homo sapiens
atattaataaaacttta

SEQ ID NO: 5570767 - DNA, 22 bp, Homo sapiens
atattaatataagtttctttag

SEQ ID NO: 5570768 - DNA, 15 bp, Homo sapiens
atattaatatgtact

SEQ ID NO: 5570769 - DNA, 14 bp, Homo sapiens
atattaatattcct

SEQ ID NO: 5570770 - DNA, 11 bp, Homo sapiens
atattaatcaa

SEQ ID NO: 5570771 - DNA, 19 bp, Homo sapiens
atattaatcaaaattgtct

SEQ ID NO: 5570772 - DNA, 14 bp, Homo sapiens
atattaatgccttt

SEQ ID NO: 5570773 - DNA, 15 bp, Homo sapiens
atattaatgccttta

SEQ ID NO: 5570774 - DNA, 17 bp, Homo sapiens
atattaatgcctttaaa

SEQ ID NO: 5570775 - DNA, 18 bp, Homo sapiens
atattaattgcctgttaa

SEQ ID NO: 5570776 - DNA, 12 bp, Homo sapiens
atattaatttat

SEQ ID NO: 5570777 - DNA, 22 bp, Homo sapiens
atattaatttttgaaacccatt

SEQ ID NO: 5570778 - DNA, 14 bp, Homo sapiens
atattacaaaaaca

SEQ ID NO: 5570779 - DNA, 13 bp, Homo sapiens
atattacaacaag

SEQ ID NO: 5570780 - DNA, 15 bp, Homo sapiens
atattacaacattta

SEQ ID NO: 5570781 - DNA, 12 bp, Homo sapiens
atattacaatga

SEQ ID NO: 5570782 - DNA, 15 bp, Homo sapiens
atattacaatgatca

SEQ ID NO: 5570783 - DNA, 19 bp, Homo sapiens
atattacaatggccagccc

SEQ ID NO: 5570784 - DNA, 20 bp, Homo sapiens
atattacaatggccagccca

SEQ ID NO: 5570785 - DNA, 15 bp, Homo sapiens
atattacactacaca

SEQ ID NO: 5570786 - DNA, 16 bp, Homo sapiens
atattacagcttattt

SEQ ID NO: 5570787 - DNA, 21 bp, Homo sapiens
atattacaggactgcagaaca

SEQ ID NO: 5570788 - DNA, 17 bp, Homo sapiens
atattacatgtaaagct

SEQ ID NO: 5570789 - DNA, 23 bp, Homo sapiens
atattacatgtaaagctgttaaa

SEQ ID NO: 5570790 - DNA, 15 bp, Homo sapiens
atattacattgcatt

SEQ ID NO: 5570791 - DNA, 14 bp, Homo sapiens
atattacatttcat

SEQ ID NO: 5570792 - DNA, 19 bp, Homo sapiens
atattacatttcatttata

SEQ ID NO: 5570793 - DNA, 18 bp, Homo sapiens
atattaccaaaaaagtat

SEQ ID NO: 5570794 - DNA, 19 bp, Homo sapiens
atattaccaaaaaagtatt

SEQ ID NO: 5570795 - DNA, 16 bp, Homo sapiens
atattaccaactacat

SEQ ID NO: 5570796 - DNA, 19 bp, Homo sapiens
atattaccacagacatact

SEQ ID NO: 5570797 - DNA, 16 bp, Homo sapiens
atattaccatcttaat

SEQ ID NO: 5570798 - DNA, 20 bp, Homo sapiens
atattaccatcttaatcttt

SEQ ID NO: 5570799 - DNA, 21 bp, Homo sapiens
atattaccatcttaatcttta

SEQ ID NO: 5570800 - DNA, 14 bp, Homo sapiens
atattaccctcaga

SEQ ID NO: 5570801 - DNA, 18 bp, Homo sapiens
atattaccctcagaatat

SEQ ID NO: 5570802 - DNA, 21 bp, Homo sapiens
atattacctaatgaaagtgat

SEQ ID NO: 5570803 - DNA, 14 bp, Homo sapiens
atattacgttgttt

SEQ ID NO: 5570804 - DNA, 18 bp, Homo sapiens
atattacgttgtttctta

SEQ ID NO: 5570805 - DNA, 15 bp, Homo sapiens
atattactactcctt

SEQ ID NO: 5570806 - DNA, 21 bp, Homo sapiens
atattactacttaccatttgc

SEQ ID NO: 5570807 - DNA, 16 bp, Homo sapiens
atattactagcatatg

SEQ ID NO: 5570808 - DNA, 21 bp, Homo sapiens
atattactctagtttattcta

SEQ ID NO: 5570809 - DNA, 14 bp, Homo sapiens
atattactgacatt

SEQ ID NO: 5570810 - DNA, 15 bp, Homo sapiens
atattactgacattt

SEQ ID NO: 5570811 - DNA, 12 bp, Homo sapiens
atattactggat

SEQ ID NO: 5570812 - DNA, 19 bp, Homo sapiens
atattactgtctttattct

SEQ ID NO: 5570813 - DNA, 21 bp, Homo sapiens
atattactgtctttattctta

SEQ ID NO: 5570814 - DNA, 17 bp, Homo sapiens
atattactgttgcattt

SEQ ID NO: 5570815 - DNA, 20 bp, Homo sapiens
atattactgttgcatttact

SEQ ID NO: 5570816 - DNA, 21 bp, Homo sapiens
atattactgtttatttctgtt

SEQ ID NO: 5570817 - DNA, 16 bp, Homo sapiens
atattacttgcctatc

SEQ ID NO: 5570818 - DNA, 13 bp, Homo sapiens
atattactttatc

SEQ ID NO: 5570819 - DNA, 19 bp, Homo sapiens
atattactttatcactttt

SEQ ID NO: 5570820 - DNA, 14 bp, Homo sapiens
atattagaaaactt

SEQ ID NO: 5570821 - DNA, 15 bp, Homo sapiens
atattagaaaacttt

SEQ ID NO: 5570822 - DNA, 20 bp, Homo sapiens
atattagagtgcccttaaaa

SEQ ID NO: 5570823 - DNA, 23 bp, Homo sapiens
atattagataaccatattcacaa

SEQ ID NO: 5570824 - DNA, 13 bp, Homo sapiens
atattagatcaaa

SEQ ID NO: 5570825 - DNA, 20 bp, Homo sapiens
atattagatgctctgagaaa

SEQ ID NO: 5570826 - DNA, 13 bp, Homo sapiens
atattagatgtga

SEQ ID NO: 5570827 - DNA, 14 bp, Homo sapiens
atattagatgtgat

SEQ ID NO: 5570828 - DNA, 20 bp, Homo sapiens
atattagatgtgatttaata

SEQ ID NO: 5570829 - DNA, 16 bp, Homo sapiens
atattagcaaagaagc

SEQ ID NO: 5570830 - DNA, 19 bp, Homo sapiens
atattagcgacaacagatt

SEQ ID NO: 5570831 - DNA, 15 bp, Homo sapiens
atattaggaaaatat

SEQ ID NO: 5570832 - DNA, 18 bp, Homo sapiens
atattaggctataaatgt

SEQ ID NO: 5570833 - DNA, 19 bp, Homo sapiens
atattaggggggaaagtca

SEQ ID NO: 5570834 - DNA, 21 bp, Homo sapiens
atattaggtccattcattaat

SEQ ID NO: 5570835 - DNA, 19 bp, Homo sapiens
atattagtattatcttgtt

SEQ ID NO: 5570836 - DNA, 19 bp, Homo sapiens
atattagtcatagaagaac

SEQ ID NO: 5570837 - DNA, 13 bp, Homo sapiens
atattagtcctac

SEQ ID NO: 5570838 - DNA, 15 bp, Homo sapiens
atattagtcctacac

SEQ ID NO: 5570839 - DNA, 19 bp, Homo sapiens
atattagttacttgctata

SEQ ID NO: 5570840 - DNA, 20 bp, Homo sapiens
atattataaatccaaagtaa

SEQ ID NO: 5570841 - DNA, 16 bp, Homo sapiens
atattataactctgta

SEQ ID NO: 5570842 - DNA, 20 bp, Homo sapiens
atattataactctgtataat

SEQ ID NO: 5570843 - DNA, 10 bp, Homo sapiens
atattataag

SEQ ID NO: 5570844 - DNA, 22 bp, Homo sapiens
atattataagggagagctgagc

SEQ ID NO: 5570845 - DNA, 15 bp, Homo sapiens
atattataagttgac

SEQ ID NO: 5570846 - DNA, 23 bp, Homo sapiens
atattataccagatgaacatttc

SEQ ID NO: 5570847 - DNA, 14 bp, Homo sapiens
atattatacttgta

SEQ ID NO: 5570848 - DNA, 12 bp, Homo sapiens
atattatagaaa

SEQ ID NO: 5570849 - DNA, 22 bp, Homo sapiens
atattatagctcctattaaatt

SEQ ID NO: 5570850 - DNA, 17 bp, Homo sapiens
atattatataactcttt

SEQ ID NO: 5570851 - DNA, 14 bp, Homo sapiens
atattatatatatc

SEQ ID NO: 5570852 - DNA, 16 bp, Homo sapiens
atattatatatatcta

SEQ ID NO: 5570853 - DNA, 15 bp, Homo sapiens
atattatatttggat

SEQ ID NO: 5570854 - DNA, 19 bp, Homo sapiens
atattatcatgcaaatgct

SEQ ID NO: 5570855 - DNA, 18 bp, Homo sapiens
atattatcctaagggaag

SEQ ID NO: 5570856 - DNA, 14 bp, Homo sapiens
atattatctacctg

SEQ ID NO: 5570857 - DNA, 21 bp, Homo sapiens
atattatctacctgttctgta

SEQ ID NO: 5570858 - DNA, 12 bp, Homo sapiens
atattatctgaa

SEQ ID NO: 5570859 - DNA, 21 bp, Homo sapiens
atattatgaaaattaagatta

SEQ ID NO: 5570860 - DNA, 13 bp, Homo sapiens
atattatgaaatt

SEQ ID NO: 5570861 - DNA, 13 bp, Homo sapiens
atattatgaataa

SEQ ID NO: 5570862 - DNA, 16 bp, Homo sapiens
atattatgaataaaat

SEQ ID NO: 5570863 - DNA, 13 bp, Homo sapiens
atattatgatttt

SEQ ID NO: 5570864 - DNA, 20 bp, Homo sapiens
atattatgattttatttaaa

SEQ ID NO: 5570865 - DNA, 12 bp, Homo sapiens
atattatgctgc

SEQ ID NO: 5570866 - DNA, 18 bp, Homo sapiens
atattatggtgtaatgca

SEQ ID NO: 5570867 - DNA, 20 bp, Homo sapiens
atattatggtgtaatgcaca

SEQ ID NO: 5570868 - DNA, 22 bp, Homo sapiens
atattatggtgtaatgcacaat

SEQ ID NO: 5570869 - DNA, 23 bp, Homo sapiens
atattatggtgtaatgcacaatt

SEQ ID NO: 5570870 - DNA, 22 bp, Homo sapiens
atattatgtatagaaaataaaa

SEQ ID NO: 5570871 - DNA, 21 bp, Homo sapiens
atattatgtatttatattttg

SEQ ID NO: 5570872 - DNA, 21 bp, Homo sapiens
atattatgtgaagaatttaga

SEQ ID NO: 5570873 - DNA, 14 bp, Homo sapiens
atattatgttaaaa

SEQ ID NO: 5570874 - DNA, 14 bp, Homo sapiens
atattatgttatga

SEQ ID NO: 5570875 - DNA, 17 bp, Homo sapiens
atattatgttatgaaaa

SEQ ID NO: 5570876 - DNA, 18 bp, Homo sapiens
atattatgtttatttcat

SEQ ID NO: 5570877 - DNA, 16 bp, Homo sapiens
atattattaaaatctt

SEQ ID NO: 5570878 - DNA, 12 bp, Homo sapiens
atattattactt

SEQ ID NO: 5570879 - DNA, 15 bp, Homo sapiens
atattattacttgta

SEQ ID NO: 5570880 - DNA, 18 bp, Homo sapiens
atattattataatcttat

SEQ ID NO: 5570881 - DNA, 19 bp, Homo sapiens
atattattataatcttata

SEQ ID NO: 5570882 - DNA, 23 bp, Homo sapiens
atattattataatcttataattg

SEQ ID NO: 5570883 - DNA, 13 bp, Homo sapiens
atattattatgaa

SEQ ID NO: 5570884 - DNA, 15 bp, Homo sapiens
atattattccaaagt

SEQ ID NO: 5570885 - DNA, 13 bp, Homo sapiens
atattattctcat

SEQ ID NO: 5570886 - DNA, 14 bp, Homo sapiens
atattattctcatt

SEQ ID NO: 5570887 - DNA, 16 bp, Homo sapiens
atattattctcattta

SEQ ID NO: 5570888 - DNA, 18 bp, Homo sapiens
atattattctcatttagt

SEQ ID NO: 5570889 - DNA, 14 bp, Homo sapiens
atattattggggtt

SEQ ID NO: 5570890 - DNA, 13 bp, Homo sapiens
atattattgtaag

SEQ ID NO: 5570891 - DNA, 23 bp, Homo sapiens
atattattgtaagttgtacaaat

SEQ ID NO: 5570892 - DNA, 13 bp, Homo sapiens
atattatttaaat

SEQ ID NO: 5570893 - DNA, 13 bp, Homo sapiens
atattatttctag

SEQ ID NO: 5570894 - DNA, 14 bp, Homo sapiens
atattatttgatga

SEQ ID NO: 5570895 - DNA, 13 bp, Homo sapiens
atattatttggca

SEQ ID NO: 5570896 - DNA, 16 bp, Homo sapiens
atattatttggcagtt

SEQ ID NO: 5570897 - DNA, 15 bp, Homo sapiens
atattatttgtctta

SEQ ID NO: 5570898 - DNA, 18 bp, Homo sapiens
atattatttgtgtttcct

SEQ ID NO: 5570899 - DNA, 23 bp, Homo sapiens
atattattttagcttcagttgtt

SEQ ID NO: 5570900 - DNA, 12 bp, Homo sapiens
atattattttct

SEQ ID NO: 5570901 - DNA, 18 bp, Homo sapiens
atattcaaacacacagta

SEQ ID NO: 5570902 - DNA, 13 bp, Homo sapiens
atattcaaagcag

SEQ ID NO: 5570903 - DNA, 18 bp, Homo sapiens
atattcaaagcagcagcc

SEQ ID NO: 5570904 - DNA, 23 bp, Homo sapiens
atattcaaagtatatacagagcc

SEQ ID NO: 5570905 - DNA, 23 bp, Homo sapiens
atattcaaatcagcaagcttgta

SEQ ID NO: 5570906 - DNA, 11 bp, Homo sapiens
atattcaacca

SEQ ID NO: 5570907 - DNA, 21 bp, Homo sapiens
atattcaactattcttcattt

SEQ ID NO: 5570908 - DNA, 22 bp, Homo sapiens
atattcaactattcttcattta

SEQ ID NO: 5570909 - DNA, 19 bp, Homo sapiens
atattcaagagtgggggga

SEQ ID NO: 5570910 - DNA, 17 bp, Homo sapiens
atattcaagcctttgga

SEQ ID NO: 5570911 - DNA, 20 bp, Homo sapiens
atattcaagtaacactttaa

SEQ ID NO: 5570912 - DNA, 18 bp, Homo sapiens
atattcaatcttaacaaa

SEQ ID NO: 5570913 - DNA, 14 bp, Homo sapiens
atattcaatgtatt

SEQ ID NO: 5570914 - DNA, 17 bp, Homo sapiens
atattcacaatggaaac

SEQ ID NO: 5570915 - DNA, 16 bp, Homo sapiens
atattcacatgttcta

SEQ ID NO: 5570916 - DNA, 18 bp, Homo sapiens
atattcacatgttctaat

SEQ ID NO: 5570917 - DNA, 11 bp, Homo sapiens
atattcactct

SEQ ID NO: 5570918 - DNA, 19 bp, Homo sapiens
atattcagaatctttgtta

SEQ ID NO: 5570919 - DNA, 12 bp, Homo sapiens
atattcagaatt

SEQ ID NO: 5570920 - DNA, 22 bp, Homo sapiens
atattcagacaaaatggataca

SEQ ID NO: 5570921 - DNA, 17 bp, Homo sapiens
atattcagagaatatca

SEQ ID NO: 5570922 - DNA, 23 bp, Homo sapiens
atattcagagatgtaccatgtta

SEQ ID NO: 5570923 - DNA, 17 bp, Homo sapiens
atattcagccagcttaa

SEQ ID NO: 5570924 - DNA, 15 bp, Homo sapiens
atatttatatcatat

SEQ ID NO: 5570925 - DNA, 21 bp, Homo sapiens
atatttatatcatccagaaaa

SEQ ID NO: 5570926 - DNA, 15 bp, Homo sapiens
atatttatatgttat

SEQ ID NO: 5570927 - DNA, 23 bp, Homo sapiens
atatttatatgttattaaacagg

SEQ ID NO: 5570928 - DNA, 15 bp, Homo sapiens
atatttatatttcac

SEQ ID NO: 5570929 - DNA, 17 bp, Homo sapiens
atatttatgaagaaaat

SEQ ID NO: 5570930 - DNA, 18 bp, Homo sapiens
atatttatgaatgtgcat

SEQ ID NO: 5570931 - DNA, 14 bp, Homo sapiens
atatttatgaccag

SEQ ID NO: 5570932 - DNA, 22 bp, Homo sapiens
atatttatgaccagagcaaaaa

SEQ ID NO: 5570933 - DNA, 21 bp, Homo sapiens
atatttatgatgttaacattt

SEQ ID NO: 5570934 - DNA, 12 bp, Homo sapiens
atatttatgctt

SEQ ID NO: 5570935 - DNA, 13 bp, Homo sapiens
atatttatgctta

SEQ ID NO: 5570936 - DNA, 18 bp, Homo sapiens
atatttatgtatcttgat

SEQ ID NO: 5570937 - DNA, 23 bp, Homo sapiens
atatttatgtatcttgatgttca

SEQ ID NO: 5570938 - DNA, 18 bp, Homo sapiens
atatttatgtctatttaa

SEQ ID NO: 5570939 - DNA, 14 bp, Homo sapiens
atatttatgtctct

SEQ ID NO: 5570940 - DNA, 20 bp, Homo sapiens
atatttatgtttaagtgctt

SEQ ID NO: 5570941 - DNA, 23 bp, Homo sapiens
atatttattaaataaaatcaatt

SEQ ID NO: 5570942 - DNA, 14 bp, Homo sapiens
atatttattacctc

SEQ ID NO: 5570943 - DNA, 23 bp, Homo sapiens
atatttattattttcacctgttt

SEQ ID NO: 5570944 - DNA, 16 bp, Homo sapiens
atatttattcattatt

SEQ ID NO: 5570945 - DNA, 12 bp, Homo sapiens
atatttattgaa

SEQ ID NO: 5570946 - DNA, 16 bp, Homo sapiens
atatttattgactctt

SEQ ID NO: 5570947 - DNA, 14 bp, Homo sapiens
atatttattgatta

SEQ ID NO: 5570948 - DNA, 12 bp, Homo sapiens
atatttattgct

SEQ ID NO: 5570949 - DNA, 18 bp, Homo sapiens
atatttattgctttataa

SEQ ID NO: 5570950 - DNA, 18 bp, Homo sapiens
atatttatttctagcaaa

SEQ ID NO: 5570951 - DNA, 15 bp, Homo sapiens
atatttattttaata

SEQ ID NO: 5570952 - DNA, 22 bp, Homo sapiens
atatttattttcagtatactgt

SEQ ID NO: 5570953 - DNA, 20 bp, Homo sapiens
atatttattttcttccccaa

SEQ ID NO: 5570954 - DNA, 19 bp, Homo sapiens
atatttattttttttaagt

SEQ ID NO: 5570955 - DNA, 19 bp, Homo sapiens
atatttcaaacatcagctg

SEQ ID NO: 5570956 - DNA, 15 bp, Homo sapiens
atatttcaaatgatt

SEQ ID NO: 5570957 - DNA, 18 bp, Homo sapiens
atatttcaagtacactga

SEQ ID NO: 5570958 - DNA, 23 bp, Homo sapiens
atatttcaagtgcctagactgtt

SEQ ID NO: 5570959 - DNA, 18 bp, Homo sapiens
atatttcaataaatgata

SEQ ID NO: 5570960 - DNA, 11 bp, Homo sapiens
atatttcaatc

SEQ ID NO: 5570961 - DNA, 15 bp, Homo sapiens
atatttcaatctttt

SEQ ID NO: 5570962 - DNA, 19 bp, Homo sapiens
atatttcacaggctgtaaa

SEQ ID NO: 5570963 - DNA, 20 bp, Homo sapiens
atatttcacaggctgtaaat

SEQ ID NO: 5570964 - DNA, 16 bp, Homo sapiens
atatttcacatgttta

SEQ ID NO: 5570965 - DNA, 19 bp, Homo sapiens
atatttcacttaaactttg

SEQ ID NO: 5570966 - DNA, 22 bp, Homo sapiens
atatttcacttaaactttgtca

SEQ ID NO: 5570967 - DNA, 18 bp, Homo sapiens
atatttcacttttgttct

SEQ ID NO: 5570968 - DNA, 19 bp, Homo sapiens
atatttcacttttgttctg

SEQ ID NO: 5570969 - DNA, 20 bp, Homo sapiens
atatttcacttttgttctgc

SEQ ID NO: 5570970 - DNA, 18 bp, Homo sapiens
atatttcagacattttca

SEQ ID NO: 5570971 - DNA, 15 bp, Homo sapiens
atatttcagatgtaa

SEQ ID NO: 5570972 - DNA, 19 bp, Homo sapiens
atatttcagatgtaatgtt

SEQ ID NO: 5570973 - DNA, 20 bp, Homo sapiens
atatttcagatgtaatgttt

SEQ ID NO: 5570974 - DNA, 12 bp, Homo sapiens
atatttcagtga

SEQ ID NO: 5570975 - DNA, 20 bp, Homo sapiens
atatttcagtgatttttagt

SEQ ID NO: 5570976 - DNA, 14 bp, Homo sapiens
atatttcataaatt

SEQ ID NO: 5570977 - DNA, 18 bp, Homo sapiens
atatttcataaattaaca

SEQ ID NO: 5570978 - DNA, 11 bp, Homo sapiens
atatttcatca

SEQ ID NO: 5570979 - DNA, 14 bp, Homo sapiens
atatttcattgaat

SEQ ID NO: 5570980 - DNA, 15 bp, Homo sapiens
atatttcattttgag

SEQ ID NO: 5570981 - DNA, 24 bp, Homo sapiens
atatttccaagattggttataata

SEQ ID NO: 5570982 - DNA, 12 bp, Homo sapiens
atatttccaatg

SEQ ID NO: 5570983 - DNA, 23 bp, Homo sapiens
atatttccaggctgcatttgtat

SEQ ID NO: 5570984 - DNA, 18 bp, Homo sapiens
atatttcccatgatttca

SEQ ID NO: 5570985 - DNA, 22 bp, Homo sapiens
atatttcccatgatttcatgta

SEQ ID NO: 5570986 - DNA, 20 bp, Homo sapiens
atatttccctggaatttaat

SEQ ID NO: 5570987 - DNA, 18 bp, Homo sapiens
atatttcctataccattt

SEQ ID NO: 5570988 - DNA, 17 bp, Homo sapiens
atatttcctcttctgta

SEQ ID NO: 5570989 - DNA, 22 bp, Homo sapiens
atatttcctgacttgagtgttc

SEQ ID NO: 5570990 - DNA, 17 bp, Homo sapiens
atatttcctttatgtga

SEQ ID NO: 5570991 - DNA, 19 bp, Homo sapiens
atatttcctttatgtgaat

SEQ ID NO: 5570992 - DNA, 16 bp, Homo sapiens
atatttccttttgtaa

SEQ ID NO: 5570993 - DNA, 16 bp, Homo sapiens
atatttctaactatat

SEQ ID NO: 5570994 - DNA, 20 bp, Homo sapiens
atatttctaagcttatttct

SEQ ID NO: 5570995 - DNA, 15 bp, Homo sapiens
atatttctatgtaaa

SEQ ID NO: 5570996 - DNA, 19 bp, Homo sapiens
atatttctatgttgtaata

SEQ ID NO: 5570997 - DNA, 23 bp, Homo sapiens
atatttctattttattatgaaga

SEQ ID NO: 5570998 - DNA, 10 bp, Homo sapiens
atatttctga

SEQ ID NO: 5570999 - DNA, 23 bp, Homo sapiens
atatttctgtaattatatctaaa

SEQ ID NO: 5571000 - DNA, 14 bp, Homo sapiens
atatttctgtggaa

SEQ ID NO: 5571001 - DNA, 14 bp, Homo sapiens
atatttcttaattt

SEQ ID NO: 5571002 - DNA, 22 bp, Homo sapiens
atatttcttagcaacattttct

SEQ ID NO: 5571003 - DNA, 14 bp, Homo sapiens
atatttcttcaaat

SEQ ID NO: 5571004 - DNA, 19 bp, Homo sapiens
atatttcttcgtgatgaca

SEQ ID NO: 5571005 - DNA, 15 bp, Homo sapiens
atatttcttgctttc

SEQ ID NO: 5571006 - DNA, 20 bp, Homo sapiens
atatttcttttgttgtactt

SEQ ID NO: 5571007 - DNA, 21 bp, Homo sapiens
atatttcttttgttgtacttt

SEQ ID NO: 5571008 - DNA, 16 bp, Homo sapiens
atatttctttttcttg

SEQ ID NO: 5571009 - DNA, 14 bp, Homo sapiens
atatttgaaaaaat

SEQ ID NO: 5571010 - DNA, 15 bp, Homo sapiens
atatttgaaaattac

SEQ ID NO: 5571011 - DNA, 13 bp, Homo sapiens
atatttgaaactg

SEQ ID NO: 5571012 - DNA, 17 bp, Homo sapiens
atatttgaaataaagtt

SEQ ID NO: 5571013 - DNA, 19 bp, Homo sapiens
atatttgaaatattgactt

SEQ ID NO: 5571014 - DNA, 12 bp, Homo sapiens
atatttgaaatt

SEQ ID NO: 5571015 - DNA, 15 bp, Homo sapiens
atatttgaacaaaaa

SEQ ID NO: 5571016 - DNA, 15 bp, Homo sapiens
atatttgaatcttgt

SEQ ID NO: 5571017 - DNA, 18 bp, Homo sapiens
atatttgaatcttgtctc

SEQ ID NO: 5571018 - DNA, 19 bp, Homo sapiens
atatttgaattgacagggg

SEQ ID NO: 5571019 - DNA, 13 bp, Homo sapiens
atatttgaatttt

SEQ ID NO: 5571020 - DNA, 12 bp, Homo sapiens
atatttgacatg

SEQ ID NO: 5571021 - DNA, 19 bp, Homo sapiens
atatttgacttgaaaagaa

SEQ ID NO: 5571022 - DNA, 18 bp, Homo sapiens
atatttgagtttctttca

SEQ ID NO: 5571023 - DNA, 17 bp, Homo sapiens
atatttgatacatataa

SEQ ID NO: 5571024 - DNA, 12 bp, Homo sapiens
atatttgattta

SEQ ID NO: 5571025 - DNA, 15 bp, Homo sapiens
atatttgatttatta

SEQ ID NO: 5571026 - DNA, 14 bp, Homo sapiens
atatttgatttcta

SEQ ID NO: 5571027 - DNA, 18 bp, Homo sapiens
atatttgatttctaattg

SEQ ID NO: 5571028 - DNA, 21 bp, Homo sapiens
atatttgcaaaccctttgtat

SEQ ID NO: 5571029 - DNA, 16 bp, Homo sapiens
atatttgcacatggga

SEQ ID NO: 5571030 - DNA, 18 bp, Homo sapiens
atatttgcacatgggatt

SEQ ID NO: 5571031 - DNA, 20 bp, Homo sapiens
atatttgcacttatgtactt

SEQ ID NO: 5571032 - DNA, 19 bp, Homo sapiens
atatttgcagtttttcatt

SEQ ID NO: 5571033 - DNA, 13 bp, Homo sapiens
atatttgcattat

SEQ ID NO: 5571034 - DNA, 23 bp, Homo sapiens
atatttgcattgaggaaatatta

SEQ ID NO: 5571035 - DNA, 17 bp, Homo sapiens
atatttgcgtaaatggt

SEQ ID NO: 5571036 - DNA, 19 bp, Homo sapiens
atatttgcgtaaatggttt

SEQ ID NO: 5571037 - DNA, 23 bp, Homo sapiens
atatttgcgtaaatggttttcaa

SEQ ID NO: 5571038 - DNA, 17 bp, Homo sapiens
atatttgctaagaatgt

SEQ ID NO: 5571039 - DNA, 21 bp, Homo sapiens
atatttgctagactctagaca

SEQ ID NO: 5571040 - DNA, 13 bp, Homo sapiens
atatttgctgcaa

SEQ ID NO: 5571041 - DNA, 14 bp, Homo sapiens
atatttgctggagt

SEQ ID NO: 5571042 - DNA, 15 bp, Homo sapiens
atatttgcttattta

SEQ ID NO: 5571043 - DNA, 16 bp, Homo sapiens
atatttgcttatttat

SEQ ID NO: 5571044 - DNA, 21 bp, Homo sapiens
atatttggaagaaaaaaatct

SEQ ID NO: 5571045 - DNA, 23 bp, Homo sapiens
atatttggaagaaaaaaatcttc

SEQ ID NO: 5571046 - DNA, 16 bp, Homo sapiens
atatttggaattgaac

SEQ ID NO: 5571047 - DNA, 23 bp, Homo sapiens
atatttggcgatgaggtaattct

SEQ ID NO: 5571048 - DNA, 23 bp, Homo sapiens
atatttggggtccttttttatac

SEQ ID NO: 5571049 - DNA, 16 bp, Homo sapiens
atatttggttttcctg

SEQ ID NO: 5571050 - DNA, 14 bp, Homo sapiens
atatttgtaaaagc

SEQ ID NO: 5571051 - DNA, 15 bp, Homo sapiens
atatttgtaaaagct

SEQ ID NO: 5571052 - DNA, 20 bp, Homo sapiens
atatttgtaacattgtaaag

SEQ ID NO: 5571053 - DNA, 13 bp, Homo sapiens
atatttgtaactt

SEQ ID NO: 5571054 - DNA, 12 bp, Homo sapiens
atatttgtacat

SEQ ID NO: 5571055 - DNA, 13 bp, Homo sapiens
atatttgtacata

SEQ ID NO: 5571056 - DNA, 14 bp, Homo sapiens
atatttgtactttc

SEQ ID NO: 5571057 - DNA, 17 bp, Homo sapiens
atatttgtactttctgt

SEQ ID NO: 5571058 - DNA, 13 bp, Homo sapiens
atatttgtaggag

SEQ ID NO: 5571059 - DNA, 16 bp, Homo sapiens
atatttgtaggtatac

SEQ ID NO: 5571060 - DNA, 18 bp, Homo sapiens
atatttgtatagttgctt

SEQ ID NO: 5571061 - DNA, 12 bp, Homo sapiens
atatttgtatcg

SEQ ID NO: 5571062 - DNA, 22 bp, Homo sapiens
atatttgtatgtttttctgtat

SEQ ID NO: 5571063 - DNA, 19 bp, Homo sapiens
atatttgtatttattcttt

SEQ ID NO: 5571064 - DNA, 13 bp, Homo sapiens
atatttgtcattt

SEQ ID NO: 5571065 - DNA, 20 bp, Homo sapiens
atatttgtcgatatttccat

SEQ ID NO: 5571066 - DNA, 17 bp, Homo sapiens
atatttgtctcattttg

SEQ ID NO: 5571067 - DNA, 24 bp, Homo sapiens
atatttgtctcattttgtatgtat

SEQ ID NO: 5571068 - DNA, 15 bp, Homo sapiens
atatttgtctgtgtg

SEQ ID NO: 5571069 - DNA, 22 bp, Homo sapiens
atatttgtctgtgtgctactaa

SEQ ID NO: 5571070 - DNA, 20 bp, Homo sapiens
atatttgtgatagcactttc

SEQ ID NO: 5571071 - DNA, 17 bp, Homo sapiens
atatttgtgctatttaa

SEQ ID NO: 5571072 - DNA, 17 bp, Homo sapiens
atatttgtgctttgaaa

SEQ ID NO: 5571073 - DNA, 14 bp, Homo sapiens
atatttgtggaata

SEQ ID NO: 5571074 - DNA, 12 bp, Homo sapiens
atatttgtgtat

SEQ ID NO: 5571075 - DNA, 21 bp, Homo sapiens
atatttgtgtattttcctgga

SEQ ID NO: 5571076 - DNA, 17 bp, Homo sapiens
atatttgtgtgttcact

SEQ ID NO: 5571077 - DNA, 14 bp, Homo sapiens
atatttgtgttcag

SEQ ID NO: 5571078 - DNA, 22 bp, Homo sapiens
atatttgttactttacttttgc

SEQ ID NO: 5571079 - DNA, 16 bp, Homo sapiens
atatttgtttatggta

SEQ ID NO: 5571080 - DNA, 16 bp, Homo sapiens
atattttaaaaaatca

SEQ ID NO: 5571081 - DNA, 13 bp, Homo sapiens
atattttaaatct

SEQ ID NO: 5571082 - DNA, 14 bp, Homo sapiens
atattttaaatgtg

SEQ ID NO: 5571083 - DNA, 15 bp, Homo sapiens
atattttaaatgtgg

SEQ ID NO: 5571084 - DNA, 18 bp, Homo sapiens
atattttaaattctcata

SEQ ID NO: 5571085 - DNA, 19 bp, Homo sapiens
atattttaacctgcataaa

SEQ ID NO: 5571086 - DNA, 14 bp, Homo sapiens
atattttaagcatt

SEQ ID NO: 5571087 - DNA, 17 bp, Homo sapiens
atattttaagcattact

SEQ ID NO: 5571088 - DNA, 18 bp, Homo sapiens
atattttaagccttcatt

SEQ ID NO: 5571089 - DNA, 21 bp, Homo sapiens
atattttaagccttcatttgc

SEQ ID NO: 5571090 - DNA, 14 bp, Homo sapiens
atattttaataaag

SEQ ID NO: 5571091 - DNA, 17 bp, Homo sapiens
atattttaatagaaata

SEQ ID NO: 5571092 - DNA, 23 bp, Homo sapiens
atattttaattaaaattggtaaa

SEQ ID NO: 5571093 - DNA, 15 bp, Homo sapiens
atattttacataaat

SEQ ID NO: 5571094 - DNA, 15 bp, Homo sapiens
atattttacatctga

SEQ ID NO: 5571095 - DNA, 15 bp, Homo sapiens
atattttacttgaat

SEQ ID NO: 5571096 - DNA, 17 bp, Homo sapiens
atattttagaaaatgtt

SEQ ID NO: 5571097 - DNA, 17 bp, Homo sapiens
atattttagaaccacaa

SEQ ID NO: 5571098 - DNA, 12 bp, Homo sapiens
atattttatact

SEQ ID NO: 5571099 - DNA, 17 bp, Homo sapiens
atattttatatgttcat

SEQ ID NO: 5571100 - DNA, 19 bp, Homo sapiens
atattttatatgttcatat

SEQ ID NO: 5571101 - DNA, 13 bp, Homo sapiens
atattttatcctg

SEQ ID NO: 5571102 - DNA, 17 bp, Homo sapiens
atattttatcttgttct

SEQ ID NO: 5571103 - DNA, 19 bp, Homo sapiens
atcaagcaggaattatgtc

SEQ ID NO: 5571104 - DNA, 19 bp, Homo sapiens
atcaagcctttatggctgc

SEQ ID NO: 5571105 - DNA, 13 bp, Homo sapiens
atcaagctaataa

SEQ ID NO: 5571106 - DNA, 15 bp, Homo sapiens
atcaagctaataaaa

SEQ ID NO: 5571107 - DNA, 20 bp, Homo sapiens
atcaagctagaaggccacat

SEQ ID NO: 5571108 - DNA, 14 bp, Homo sapiens
atcaagctcaaggc

SEQ ID NO: 5571109 - DNA, 19 bp, Homo sapiens
atcaagcttagtgagcagt

SEQ ID NO: 5571110 - DNA, 13 bp, Homo sapiens
atcaagcttttct

SEQ ID NO: 5571111 - DNA, 16 bp, Homo sapiens
atcaaggaaaggctca

SEQ ID NO: 5571112 - DNA, 14 bp, Homo sapiens
atcaaggaagtctt

SEQ ID NO: 5571113 - DNA, 20 bp, Homo sapiens
atcaaggaagtcttcaaatt

SEQ ID NO: 5571114 - DNA, 13 bp, Homo sapiens
atcaaggagcctc

SEQ ID NO: 5571115 - DNA, 13 bp, Homo sapiens
atcaaggaggtca

SEQ ID NO: 5571116 - DNA, 21 bp, Homo sapiens
atcaaggagtcttctaatgta

SEQ ID NO: 5571117 - DNA, 19 bp, Homo sapiens
atcaaggataaatatctta

SEQ ID NO: 5571118 - DNA, 23 bp, Homo sapiens
atcaaggattttcatgttgatga

SEQ ID NO: 5571119 - DNA, 18 bp, Homo sapiens
atcaaggcaaaaggaatt

SEQ ID NO: 5571120 - DNA, 14 bp, Homo sapiens
atcaaggcactgcc

SEQ ID NO: 5571121 - DNA, 16 bp, Homo sapiens
atcaaggcactgcctg

SEQ ID NO: 5571122 - DNA, 22 bp, Homo sapiens
atcaaggctgcctggagaaagg

SEQ ID NO: 5571123 - DNA, 23 bp, Homo sapiens
atcaaggctgcctggagaaagga

SEQ ID NO: 5571124 - DNA, 18 bp, Homo sapiens
atcaagggaagaactatt

SEQ ID NO: 5571125 - DNA, 16 bp, Homo sapiens
atcaagggtcaggcct

SEQ ID NO: 5571126 - DNA, 15 bp, Homo sapiens
atcaaggtccagtgg

SEQ ID NO: 5571127 - DNA, 16 bp, Homo sapiens
atcaaggtccagtgga

SEQ ID NO: 5571128 - DNA, 14 bp, Homo sapiens
atcaaggtgaaata

SEQ ID NO: 5571129 - DNA, 18 bp, Homo sapiens
atcaaggtgaaggatctg

SEQ ID NO: 5571130 - DNA, 21 bp, Homo sapiens
atcaaggtgaaggatctgtcc

SEQ ID NO: 5571131 - DNA, 19 bp, Homo sapiens
atcaaggtgctcttctcat

SEQ ID NO: 5571132 - DNA, 20 bp, Homo sapiens
atcaaggtgctcttctcatt

SEQ ID NO: 5571133 - DNA, 21 bp, Homo sapiens
atcaaggtgctcttctcattt

SEQ ID NO: 5571134 - DNA, 16 bp, Homo sapiens
atcaagtaatacaaac

SEQ ID NO: 5571135 - DNA, 21 bp, Homo sapiens
atcaagtacctatattgattt

SEQ ID NO: 5571136 - DNA, 19 bp, Homo sapiens
atcaagtagaacaaaaact

SEQ ID NO: 5571137 - DNA, 18 bp, Homo sapiens
atcaagtagactactgtt

SEQ ID NO: 5571138 - DNA, 19 bp, Homo sapiens
atcaagtatagaaaatctt

SEQ ID NO: 5571139 - DNA, 21 bp, Homo sapiens
atcaagtattactaaattgac

SEQ ID NO: 5571140 - DNA, 13 bp, Homo sapiens
atcaagtattata

SEQ ID NO: 5571141 - DNA, 21 bp, Homo sapiens
atcaagtatttgggaagtgaa

SEQ ID NO: 5571142 - DNA, 13 bp, Homo sapiens
atcaagtattttg

SEQ ID NO: 5571143 - DNA, 12 bp, Homo sapiens
atcaagtcaccg

SEQ ID NO: 5571144 - DNA, 13 bp, Homo sapiens
atcaagtccagag

SEQ ID NO: 5571145 - DNA, 15 bp, Homo sapiens
atcaagtccagagcc

SEQ ID NO: 5571146 - DNA, 16 bp, Homo sapiens
atcaagtccatctgac

SEQ ID NO: 5571147 - DNA, 17 bp, Homo sapiens
atcaagtccatctgaca

SEQ ID NO: 5571148 - DNA, 22 bp, Homo sapiens
atcaagtccatgttattctctc

SEQ ID NO: 5571149 - DNA, 22 bp, Homo sapiens
atcaagtcccgaggcagcaaca

SEQ ID NO: 5571150 - DNA, 13 bp, Homo sapiens
atcaagtctgtga

SEQ ID NO: 5571151 - DNA, 13 bp, Homo sapiens
atcaagtctgttt

SEQ ID NO: 5571152 - DNA, 14 bp, Homo sapiens
atcaagtgcaccta

SEQ ID NO: 5571153 - DNA, 21 bp, Homo sapiens
atcaagtgcatttctgggcct

SEQ ID NO: 5571154 - DNA, 13 bp, Homo sapiens
atcaagtgccaga

SEQ ID NO: 5571155 - DNA, 16 bp, Homo sapiens
atcaagtgtgcatata

SEQ ID NO: 5571156 - DNA, 16 bp, Homo sapiens
atcaagtgttctaaaa

SEQ ID NO: 5571157 - DNA, 22 bp, Homo sapiens
atcaagttattgacaaactctc

SEQ ID NO: 5571158 - DNA, 16 bp, Homo sapiens
atcaagttcagccacc

SEQ ID NO: 5571159 - DNA, 16 bp, Homo sapiens
atcaagttcttaaaat

SEQ ID NO: 5571160 - DNA, 15 bp, Homo sapiens
atcaagttgaattga

SEQ ID NO: 5571161 - DNA, 22 bp, Homo sapiens
atcaagttgtaacttatattga

SEQ ID NO: 5571162 - DNA, 22 bp, Homo sapiens
atcaagttgttgactgtgatta

SEQ ID NO: 5571163 - DNA, 20 bp, Homo sapiens
atcaagtttccaagcaaatg

SEQ ID NO: 5571164 - DNA, 17 bp, Homo sapiens
atcaagttttaagtgaa

SEQ ID NO: 5571165 - DNA, 15 bp, Homo sapiens
atcaataaaaaatta

SEQ ID NO: 5571166 - DNA, 16 bp, Homo sapiens
atcaataaaattctgt

SEQ ID NO: 5571167 - DNA, 14 bp, Homo sapiens
atcaataaacgatt

SEQ ID NO: 5571168 - DNA, 15 bp, Homo sapiens
atcaataaacgattt

SEQ ID NO: 5571169 - DNA, 14 bp, Homo sapiens
atcaataaagcact

SEQ ID NO: 5571170 - DNA, 13 bp, Homo sapiens
atcaataagaagg

SEQ ID NO: 5571171 - DNA, 16 bp, Homo sapiens
atcaataatatatttt

SEQ ID NO: 5571172 - DNA, 18 bp, Homo sapiens
atcaataatatattttct

SEQ ID NO: 5571173 - DNA, 13 bp, Homo sapiens
atcaatactttga

SEQ ID NO: 5571174 - DNA, 15 bp, Homo sapiens
atcaatacttttgtg

SEQ ID NO: 5571175 - DNA, 21 bp, Homo sapiens
atcaatagaaagtcatctttg

SEQ ID NO: 5571176 - DNA, 22 bp, Homo sapiens
atcaatagactgtacttatttt

SEQ ID NO: 5571177 - DNA, 23 bp, Homo sapiens
atcaatagattgtaatacacata

SEQ ID NO: 5571178 - DNA, 22 bp, Homo sapiens
atcaatagtgtcctatgcaata

SEQ ID NO: 5571179 - DNA, 19 bp, Homo sapiens
atcaatatcccaacattct

SEQ ID NO: 5571180 - DNA, 20 bp, Homo sapiens
atcaatatcccaacattctg

SEQ ID NO: 5571181 - DNA, 15 bp, Homo sapiens
atcaatatgtatata

SEQ ID NO: 5571182 - DNA, 22 bp, Homo sapiens
atcaatattgtcattcctgtat

SEQ ID NO: 5571183 - DNA, 12 bp, Homo sapiens
atcaatcaaata

SEQ ID NO: 5571184 - DNA, 13 bp, Homo sapiens
atcaatcaaataa

SEQ ID NO: 5571185 - DNA, 15 bp, Homo sapiens
atcaatcaaataagt

SEQ ID NO: 5571186 - DNA, 19 bp, Homo sapiens
atcaatcaaataagtattt

SEQ ID NO: 5571187 - DNA, 13 bp, Homo sapiens
atcaatcaaatat

SEQ ID NO: 5571188 - DNA, 15 bp, Homo sapiens
atcaatcaaatattt

SEQ ID NO: 5571189 - DNA, 19 bp, Homo sapiens
atcaatcacaaaagtatat

SEQ ID NO: 5571190 - DNA, 15 bp, Homo sapiens
atcaatcagtaatta

SEQ ID NO: 5571191 - DNA, 19 bp, Homo sapiens
atcaatcatctgtgtgaaa

SEQ ID NO: 5571192 - DNA, 20 bp, Homo sapiens
atcaatcatctgtgtgaaaa

SEQ ID NO: 5571193 - DNA, 16 bp, Homo sapiens
atcaatcattgtacag

SEQ ID NO: 5571194 - DNA, 17 bp, Homo sapiens
atcaatcattgtacagt

SEQ ID NO: 5571195 - DNA, 19 bp, Homo sapiens
atcaatcattgtacagttt

SEQ ID NO: 5571196 - DNA, 15 bp, Homo sapiens
atcaatcattttcta

SEQ ID NO: 5571197 - DNA, 16 bp, Homo sapiens
atcaatccttgttcag

SEQ ID NO: 5571198 - DNA, 16 bp, Homo sapiens
atcaatcctttattat

SEQ ID NO: 5571199 - DNA, 14 bp, Homo sapiens
atcaatctttatgt

SEQ ID NO: 5571200 - DNA, 13 bp, Homo sapiens
atcaatgaagatt

SEQ ID NO: 5571201 - DNA, 18 bp, Homo sapiens
atcaatgaaggatttctt

SEQ ID NO: 5571202 - DNA, 21 bp, Homo sapiens
atcaatgaatttgttctttct

SEQ ID NO: 5571203 - DNA, 20 bp, Homo sapiens
atcaatgaggtatcttcttt

SEQ ID NO: 5571204 - DNA, 14 bp, Homo sapiens
atcaatggaaacag

SEQ ID NO: 5571205 - DNA, 15 bp, Homo sapiens
atcaatggaaacagg

SEQ ID NO: 5571206 - DNA, 19 bp, Homo sapiens
atcaatggaaacagggcag

SEQ ID NO: 5571207 - DNA, 18 bp, Homo sapiens
atcaatgggattttctag

SEQ ID NO: 5571208 - DNA, 16 bp, Homo sapiens
atcaatggtgcaaaaa

SEQ ID NO: 5571209 - DNA, 17 bp, Homo sapiens
atcaatggtgcaaaaaa

SEQ ID NO: 5571210 - DNA, 13 bp, Homo sapiens
atcaatgtgacat

SEQ ID NO: 5571211 - DNA, 17 bp, Homo sapiens
atcaatgtgacatttac

SEQ ID NO: 5571212 - DNA, 13 bp, Homo sapiens
atcaatgttcatt

SEQ ID NO: 5571213 - DNA, 15 bp, Homo sapiens
atcaatgttcattgt

SEQ ID NO: 5571214 - DNA, 17 bp, Homo sapiens
atcaatgttcattgtaa

SEQ ID NO: 5571215 - DNA, 13 bp, Homo sapiens
atcaattaaatgt

SEQ ID NO: 5571216 - DNA, 22 bp, Homo sapiens
atcaattaatttttttattgtt

SEQ ID NO: 5571217 - DNA, 23 bp, Homo sapiens
atcaattcaacacattacttgca

SEQ ID NO: 5571218 - DNA, 24 bp, Homo sapiens
atcaattcaacacattacttgcac

SEQ ID NO: 5571219 - DNA, 18 bp, Homo sapiens
atcaattccctctctcag

SEQ ID NO: 5571220 - DNA, 23 bp, Homo sapiens
atcaattccctctctcagcacag

SEQ ID NO: 5571221 - DNA, 24 bp, Homo sapiens
atcaattccctctctcagcacagc

SEQ ID NO: 5571222 - DNA, 19 bp, Homo sapiens
atcaattctgatacagcct

SEQ ID NO: 5571223 - DNA, 19 bp, Homo sapiens
atcaattcttaaatttctt

SEQ ID NO: 5571224 - DNA, 22 bp, Homo sapiens
atcaattggaaatcaatcctgt

SEQ ID NO: 5571225 - DNA, 20 bp, Homo sapiens
atcaattggcagtgactttg

SEQ ID NO: 5571226 - DNA, 23 bp, Homo sapiens
atcaattggcagtgactttgtat

SEQ ID NO: 5571227 - DNA, 18 bp, Homo sapiens
atcaattgggttttgatc

SEQ ID NO: 5571228 - DNA, 15 bp, Homo sapiens
atcaatttaaaaagc

SEQ ID NO: 5571229 - DNA, 23 bp, Homo sapiens
atcaatttaaaatcattcaatat

SEQ ID NO: 5571230 - DNA, 19 bp, Homo sapiens
atcaatttaaatgtttact

SEQ ID NO: 5571231 - DNA, 20 bp, Homo sapiens
atcaatttaaatgtttacta

SEQ ID NO: 5571232 - DNA, 17 bp, Homo sapiens
atcaatttatcactgtt

SEQ ID NO: 5571233 - DNA, 16 bp, Homo sapiens
atcaatttcccagaag

SEQ ID NO: 5571234 - DNA, 19 bp, Homo sapiens
atcaatttctaatgtttac

SEQ ID NO: 5571235 - DNA, 21 bp, Homo sapiens
atcaatttctaatgtttacta

SEQ ID NO: 5571236 - DNA, 20 bp, Homo sapiens
atcaatttgtcattttgaag

SEQ ID NO: 5571237 - DNA, 18 bp, Homo sapiens
atcaatttgtttgtgttc

SEQ ID NO: 5571238 - DNA, 21 bp, Homo sapiens
atcaattttaacatttgatgt

SEQ ID NO: 5571239 - DNA, 17 bp, Homo sapiens
atcaattttaaggaaac

SEQ ID NO: 5571240 - DNA, 12 bp, Homo sapiens
atcaattttcat

SEQ ID NO: 5571241 - DNA, 20 bp, Homo sapiens
atcaattttcattaaacttg

SEQ ID NO: 5571242 - DNA, 22 bp, Homo sapiens
atcaattttcattaaacttgaa

SEQ ID NO: 5571243 - DNA, 22 bp, Homo sapiens
atcaattttgacttaatgtgat

SEQ ID NO: 5571244 - DNA, 12 bp, Homo sapiens
atcaattttgtc

SEQ ID NO: 5571245 - DNA, 20 bp, Homo sapiens
atcaattttgtctattaaag

SEQ ID NO: 5571246 - DNA, 15 bp, Homo sapiens
atcaatttttaggaa

SEQ ID NO: 5571247 - DNA, 15 bp, Homo sapiens
atcaatttttataca

SEQ ID NO: 5571248 - DNA, 18 bp, Homo sapiens
atcaatttttatacatat

SEQ ID NO: 5571249 - DNA, 19 bp, Homo sapiens
atcaatttttatacatatc

SEQ ID NO: 5571250 - DNA, 22 bp, Homo sapiens
atcaatttttatacatatcaga

SEQ ID NO: 5571251 - DNA, 16 bp, Homo sapiens
atcaatttttcccagt

SEQ ID NO: 5571252 - DNA, 20 bp, Homo sapiens
atcaatttttcccagtattt

SEQ ID NO: 5571253 - DNA, 19 bp, Homo sapiens
atcaatttttcttatttca

SEQ ID NO: 5571254 - DNA, 16 bp, Homo sapiens
atcacaaaaacaaaaa

SEQ ID NO: 5571255 - DNA, 20 bp, Homo sapiens
atcacaaaaacaaaaaaact

SEQ ID NO: 5571256 - DNA, 23 bp, Homo sapiens
atcacaaaagctgtgtctctgta

SEQ ID NO: 5571257 - DNA, 12 bp, Homo sapiens
atcacaaaatgt

SEQ ID NO: 5571258 - DNA, 13 bp, Homo sapiens
atcacaaacatat

SEQ ID NO: 5571259 - DNA, 18 bp, Homo sapiens
atcacaaactcatccatt

SEQ ID NO: 5571260 - DNA, 22 bp, Homo sapiens
atcacaaaggctgacattcact

SEQ ID NO: 5571261 - DNA, 14 bp, Homo sapiens
atcacaaagtggaa

SEQ ID NO: 5571262 - DNA, 15 bp, Homo sapiens
atcacaaagtggaac

SEQ ID NO: 5571263 - DNA, 13 bp, Homo sapiens
atcacaaatgact

SEQ ID NO: 5571264 - DNA, 20 bp, Homo sapiens
atcacaaatgactttattat

SEQ ID NO: 5571265 - DNA, 19 bp, Homo sapiens
atcacaaatttcacttata

SEQ ID NO: 5571266 - DNA, 17 bp, Homo sapiens
atcacaacactggctga

SEQ ID NO: 5571267 - DNA, 21 bp, Homo sapiens
atcacaaccaccgttacaagt

SEQ ID NO: 5571268 - DNA, 15 bp, Homo sapiens
atcacaacgtgcatt

SEQ ID NO: 5571269 - DNA, 17 bp, Homo sapiens
atcacaacgtgcattgt

SEQ ID NO: 5571270 - DNA, 15 bp, Homo sapiens
atcacaacttttctg

SEQ ID NO: 5571271 - DNA, 19 bp, Homo sapiens
atcacaacttttctgctac

SEQ ID NO: 5571272 - DNA, 22 bp, Homo sapiens
atcacaagagtccccagactct

SEQ ID NO: 5571273 - DNA, 14 bp, Homo sapiens
atcacaagcaataa

SEQ ID NO: 5571274 - DNA, 17 bp, Homo sapiens
atcacaagcaataatta

SEQ ID NO: 5571275 - DNA, 18 bp, Homo sapiens
atcacaagcaataattag

SEQ ID NO: 5571276 - DNA, 12 bp, Homo sapiens
atcacaatcagt

SEQ ID NO: 5571277 - DNA, 21 bp, Homo sapiens
atcacacaagatttgactgta

SEQ ID NO: 5571278 - DNA, 11 bp, Homo sapiens
atcacacacat

SEQ ID NO: 5571279 - DNA, 19 bp, Homo sapiens
atcacacactttctcttca

SEQ ID NO: 5571280 - DNA, 22 bp, Homo sapiens
atcaggctgctggaaacacagt

SEQ ID NO: 5571281 - DNA, 17 bp, Homo sapiens
atcaggctgttattatg

SEQ ID NO: 5571282 - DNA, 13 bp, Homo sapiens
atcaggcttcctg

SEQ ID NO: 5571283 - DNA, 18 bp, Homo sapiens
atcaggcttcctggtgag

SEQ ID NO: 5571284 - DNA, 18 bp, Homo sapiens
atcaggcttggaatgaat

SEQ ID NO: 5571285 - DNA, 23 bp, Homo sapiens
atcaggcttggaatgaattctct

SEQ ID NO: 5571286 - DNA, 14 bp, Homo sapiens
atcaggctttctta

SEQ ID NO: 5571287 - DNA, 13 bp, Homo sapiens
atcagggaccagc

SEQ ID NO: 5571288 - DNA, 15 bp, Homo sapiens
atcagggaccagctt

SEQ ID NO: 5571289 - DNA, 15 bp, Homo sapiens
atcagggagcactgg

SEQ ID NO: 5571290 - DNA, 20 bp, Homo sapiens
atcagggagcactggaggcc

SEQ ID NO: 5571291 - DNA, 14 bp, Homo sapiens
atcagggaggaaga

SEQ ID NO: 5571292 - DNA, 19 bp, Homo sapiens
atcagggcccaaataacag

SEQ ID NO: 5571293 - DNA, 23 bp, Homo sapiens
atcagggccctgccccaggcctg

SEQ ID NO: 5571294 - DNA, 11 bp, Homo sapiens
atcagggcctg

SEQ ID NO: 5571295 - DNA, 12 bp, Homo sapiens
atcagggcctga

SEQ ID NO: 5571296 - DNA, 14 bp, Homo sapiens
atcagggcctgccc

SEQ ID NO: 5571297 - DNA, 15 bp, Homo sapiens
atcagggcctgcccc

SEQ ID NO: 5571298 - DNA, 20 bp, Homo sapiens
atcagggcctttctcctccc

SEQ ID NO: 5571299 - DNA, 22 bp, Homo sapiens
atcagggcggcctcccaggtcc

SEQ ID NO: 5571300 - DNA, 17 bp, Homo sapiens
atcaggggaatttcagg

SEQ ID NO: 5571301 - DNA, 13 bp, Homo sapiens
atcaggggcagga

SEQ ID NO: 5571302 - DNA, 20 bp, Homo sapiens
atcaggggccagagagcagg

SEQ ID NO: 5571303 - DNA, 20 bp, Homo sapiens
atcaggggtgcattctggcc

SEQ ID NO: 5571304 - DNA, 22 bp, Homo sapiens
atcagggtagcagcagaggcag

SEQ ID NO: 5571305 - DNA, 23 bp, Homo sapiens
atcagggtagcagcagaggcagg

SEQ ID NO: 5571306 - DNA, 13 bp, Homo sapiens
atcaggtaaaata

SEQ ID NO: 5571307 - DNA, 15 bp, Homo sapiens
atcaggtaaaatatt

SEQ ID NO: 5571308 - DNA, 21 bp, Homo sapiens
atcaggtaaaatattttccaa

SEQ ID NO: 5571309 - DNA, 18 bp, Homo sapiens
atcaggtaaactgatgct

SEQ ID NO: 5571310 - DNA, 21 bp, Homo sapiens
atcaggtagaccatattctaa

SEQ ID NO: 5571311 - DNA, 14 bp, Homo sapiens
atcaggtagacttt

SEQ ID NO: 5571312 - DNA, 19 bp, Homo sapiens
atcaggtcctgctcagcag

SEQ ID NO: 5571313 - DNA, 22 bp, Homo sapiens
atcaggtgacttctagcagaga

SEQ ID NO: 5571314 - DNA, 16 bp, Homo sapiens
atcaggtgcccctctt

SEQ ID NO: 5571315 - DNA, 14 bp, Homo sapiens
atcaggtgctgcca

SEQ ID NO: 5571316 - DNA, 15 bp, Homo sapiens
atcaggtgctgccat

SEQ ID NO: 5571317 - DNA, 17 bp, Homo sapiens
atcaggtgctgccatcc

SEQ ID NO: 5571318 - DNA, 21 bp, Homo sapiens
atcagtaaaattatactgtgt

SEQ ID NO: 5571319 - DNA, 13 bp, Homo sapiens
atcagtaaacact

SEQ ID NO: 5571320 - DNA, 21 bp, Homo sapiens
atcagtaaagtacctttatgt

SEQ ID NO: 5571321 - DNA, 22 bp, Homo sapiens
atcagtaaatagtgtcatataa

SEQ ID NO: 5571322 - DNA, 15 bp, Homo sapiens
atcagtaaccccctt

SEQ ID NO: 5571323 - DNA, 19 bp, Homo sapiens
atcagtaagaaaaagaaga

SEQ ID NO: 5571324 - DNA, 17 bp, Homo sapiens
atcagtaattaacatat

SEQ ID NO: 5571325 - DNA, 18 bp, Homo sapiens
atcagtacaattctttgt

SEQ ID NO: 5571326 - DNA, 23 bp, Homo sapiens
atcagtacaattctttgttgctt

SEQ ID NO: 5571327 - DNA, 21 bp, Homo sapiens
atcagtacttttattaatatt

SEQ ID NO: 5571328 - DNA, 15 bp, Homo sapiens
atcagtagaaagcta

SEQ ID NO: 5571329 - DNA, 16 bp, Homo sapiens
atcagtagaaagctaa

SEQ ID NO: 5571330 - DNA, 17 bp, Homo sapiens
atcagtagaaagctaaa

SEQ ID NO: 5571331 - DNA, 14 bp, Homo sapiens
atcagtagcatttt

SEQ ID NO: 5571332 - DNA, 15 bp, Homo sapiens
atcagtaggaccagg

SEQ ID NO: 5571333 - DNA, 14 bp, Homo sapiens
atcagtaggctaat

SEQ ID NO: 5571334 - DNA, 18 bp, Homo sapiens
atcagtaggctaatgtca

SEQ ID NO: 5571335 - DNA, 23 bp, Homo sapiens
atcagtagttcacatacaaatca

SEQ ID NO: 5571336 - DNA, 14 bp, Homo sapiens
atcagtataattct

SEQ ID NO: 5571337 - DNA, 16 bp, Homo sapiens
atcagtataattctgt

SEQ ID NO: 5571338 - DNA, 18 bp, Homo sapiens
atcagtatattttctgta

SEQ ID NO: 5571339 - DNA, 22 bp, Homo sapiens
atcagtatattttctgtattta

SEQ ID NO: 5571340 - DNA, 15 bp, Homo sapiens
atcagtatgaagaca

SEQ ID NO: 5571341 - DNA, 17 bp, Homo sapiens
atcagtattaagctaat

SEQ ID NO: 5571342 - DNA, 15 bp, Homo sapiens
atcagtattaatact

SEQ ID NO: 5571343 - DNA, 15 bp, Homo sapiens
atcagtattctgaca

SEQ ID NO: 5571344 - DNA, 16 bp, Homo sapiens
atcagtattctgacat

SEQ ID NO: 5571345 - DNA, 19 bp, Homo sapiens
atcagtattctgacatgta

SEQ ID NO: 5571346 - DNA, 14 bp, Homo sapiens
atcagtattgtgta

SEQ ID NO: 5571347 - DNA, 14 bp, Homo sapiens
atcagtatttcctt

SEQ ID NO: 5571348 - DNA, 21 bp, Homo sapiens
atcagtatttggactttttaa

SEQ ID NO: 5571349 - DNA, 23 bp, Homo sapiens
atcagtatttttttttaattttg

SEQ ID NO: 5571350 - DNA, 13 bp, Homo sapiens
atcagtcaatatt

SEQ ID NO: 5571351 - DNA, 16 bp, Homo sapiens
atcagtcaattgcttg

SEQ ID NO: 5571352 - DNA, 21 bp, Homo sapiens
atcagtcagtgctggagaaat

SEQ ID NO: 5571353 - DNA, 19 bp, Homo sapiens
atcagtcatgacagatgaa

SEQ ID NO: 5571354 - DNA, 23 bp, Homo sapiens
atcagtccacccccattgtgaat

SEQ ID NO: 5571355 - DNA, 13 bp, Homo sapiens
atcagtcccctcc

SEQ ID NO: 5571356 - DNA, 16 bp, Homo sapiens
atcagtccctatgtat

SEQ ID NO: 5571357 - DNA, 21 bp, Homo sapiens
atcagtccctatgtatttgca

SEQ ID NO: 5571358 - DNA, 13 bp, Homo sapiens
atcagtctctgag

SEQ ID NO: 5571359 - DNA, 18 bp, Homo sapiens
atcagtctctgagggctt

SEQ ID NO: 5571360 - DNA, 19 bp, Homo sapiens
atcagtcttccttgtggaa

SEQ ID NO: 5571361 - DNA, 22 bp, Homo sapiens
atcagtctttgtcaatgctcta

SEQ ID NO: 5571362 - DNA, 14 bp, Homo sapiens
atcagtgaatataa

SEQ ID NO: 5571363 - DNA, 16 bp, Homo sapiens
atcagtgaatataaat

SEQ ID NO: 5571364 - DNA, 13 bp, Homo sapiens
atcagtgactgaa

SEQ ID NO: 5571365 - DNA, 21 bp, Homo sapiens
atcagtgactgaattctgcct

SEQ ID NO: 5571366 - DNA, 14 bp, Homo sapiens
atcagtgataattg

SEQ ID NO: 5571367 - DNA, 22 bp, Homo sapiens
atcagtgatctcactaaaaata

SEQ ID NO: 5571368 - DNA, 15 bp, Homo sapiens
atcagtgatgggagt

SEQ ID NO: 5571369 - DNA, 14 bp, Homo sapiens
atcagtgattttca

SEQ ID NO: 5571370 - DNA, 15 bp, Homo sapiens
atcagtgcagtgata

SEQ ID NO: 5571371 - DNA, 17 bp, Homo sapiens
atcagtgccagcccctg

SEQ ID NO: 5571372 - DNA, 23 bp, Homo sapiens
atcagtggaactcaatatatagt

SEQ ID NO: 5571373 - DNA, 21 bp, Homo sapiens
atcagtggacagtctgctcta

SEQ ID NO: 5571374 - DNA, 15 bp, Homo sapiens
atcagtggatttccc

SEQ ID NO: 5571375 - DNA, 22 bp, Homo sapiens
atcagtggcatggctccagtct

SEQ ID NO: 5571376 - DNA, 17 bp, Homo sapiens
atcagtgggatttggta

SEQ ID NO: 5571377 - DNA, 22 bp, Homo sapiens
atcagtgggcaggataaactga

SEQ ID NO: 5571378 - DNA, 20 bp, Homo sapiens
atcagtggggccccaaagcc

SEQ ID NO: 5571379 - DNA, 17 bp, Homo sapiens
atcagtggtgttacatt

SEQ ID NO: 5571380 - DNA, 20 bp, Homo sapiens
atcagtggtgttacattttc

SEQ ID NO: 5571381 - DNA, 19 bp, Homo sapiens
atcagtgtaaaaaggaaaa

SEQ ID NO: 5571382 - DNA, 23 bp, Homo sapiens
atcagtgtagttaaggagcctaa

SEQ ID NO: 5571383 - DNA, 20 bp, Homo sapiens
atcagtgtcattttctgtta

SEQ ID NO: 5571384 - DNA, 17 bp, Homo sapiens
atcagtgtcctcttgct

SEQ ID NO: 5571385 - DNA, 13 bp, Homo sapiens
atcagtgtccttt

SEQ ID NO: 5571386 - DNA, 13 bp, Homo sapiens
atcagtgtgaatg

SEQ ID NO: 5571387 - DNA, 13 bp, Homo sapiens
atcagtgtgcccc

SEQ ID NO: 5571388 - DNA, 14 bp, Homo sapiens
atcagtgtgccccc

SEQ ID NO: 5571389 - DNA, 23 bp, Homo sapiens
atcagtgtgctaacctcactgcc

SEQ ID NO: 5571390 - DNA, 15 bp, Homo sapiens
atcagtgtgtaaata

SEQ ID NO: 5571391 - DNA, 17 bp, Homo sapiens
atcagtgtgtaaataat

SEQ ID NO: 5571392 - DNA, 19 bp, Homo sapiens
atcagtgtgtctaaatttg

SEQ ID NO: 5571393 - DNA, 23 bp, Homo sapiens
atcagtgtgtctaaatttgaatg

SEQ ID NO: 5571394 - DNA, 14 bp, Homo sapiens
atcagtgtgttact

SEQ ID NO: 5571395 - DNA, 12 bp, Homo sapiens
atcagtgttaaa

SEQ ID NO: 5571396 - DNA, 13 bp, Homo sapiens
atcagtgttaaaa

SEQ ID NO: 5571397 - DNA, 18 bp, Homo sapiens
atcagtgttaaattcatt

SEQ ID NO: 5571398 - DNA, 20 bp, Homo sapiens
atcagtgttaaattcatttt

SEQ ID NO: 5571399 - DNA, 20 bp, Homo sapiens
atcagtgttcttctcaagga

SEQ ID NO: 5571400 - DNA, 15 bp, Homo sapiens
atcagtgttggccat

SEQ ID NO: 5571401 - DNA, 16 bp, Homo sapiens
atcagtgttgtctcat

SEQ ID NO: 5571402 - DNA, 15 bp, Homo sapiens
atcagtgtttggtgt

SEQ ID NO: 5571403 - DNA, 13 bp, Homo sapiens
atcagtgtttgtt

SEQ ID NO: 5571404 - DNA, 15 bp, Homo sapiens
atcagtgtttgttgg

SEQ ID NO: 5571405 - DNA, 18 bp, Homo sapiens
atcagtgttttaaattct

SEQ ID NO: 5571406 - DNA, 19 bp, Homo sapiens
atcagtgttttaaattctg

SEQ ID NO: 5571407 - DNA, 20 bp, Homo sapiens
atcagtgttttaaattctga

SEQ ID NO: 5571408 - DNA, 19 bp, Homo sapiens
atcagttaaaatcacattt

SEQ ID NO: 5571409 - DNA, 21 bp, Homo sapiens
atcagttaaaatcacatttta

SEQ ID NO: 5571410 - DNA, 22 bp, Homo sapiens
atcagttaaaatcacattttaa

SEQ ID NO: 5571411 - DNA, 20 bp, Homo sapiens
atcagttacccactcggtcc

SEQ ID NO: 5571412 - DNA, 18 bp, Homo sapiens
atcagttactaagaagaa

SEQ ID NO: 5571413 - DNA, 17 bp, Homo sapiens
atcagttactcagccct

SEQ ID NO: 5571414 - DNA, 13 bp, Homo sapiens
atcagttactggt

SEQ ID NO: 5571415 - DNA, 22 bp, Homo sapiens
atcagttactggtttcagttga

SEQ ID NO: 5571416 - DNA, 21 bp, Homo sapiens
atcagttatatcttgtggcat

SEQ ID NO: 5571417 - DNA, 13 bp, Homo sapiens
atcagttatatga

SEQ ID NO: 5571418 - DNA, 20 bp, Homo sapiens
atcagttatatgatattctt

SEQ ID NO: 5571419 - DNA, 19 bp, Homo sapiens
atcagttatattctttaaa

SEQ ID NO: 5571420 - DNA, 19 bp, Homo sapiens
atcagttatcctttgtgag

SEQ ID NO: 5571421 - DNA, 21 bp, Homo sapiens
atcagttatctgtttgttact

SEQ ID NO: 5571422 - DNA, 23 bp, Homo sapiens
atcagttattaaataatgttcat

SEQ ID NO: 5571423 - DNA, 16 bp, Homo sapiens
atcagttattcattct

SEQ ID NO: 5571424 - DNA, 21 bp, Homo sapiens
atcagttcattagaaatattt

SEQ ID NO: 5571425 - DNA, 22 bp, Homo sapiens
atcagttccagccttctctcaa

SEQ ID NO: 5571426 - DNA, 22 bp, Homo sapiens
atcagttcctttgatctcgctg

SEQ ID NO: 5571427 - DNA, 23 bp, Homo sapiens
atcagttcctttgatctcgctgt

SEQ ID NO: 5571428 - DNA, 15 bp, Homo sapiens
atcagttgactttaa

SEQ ID NO: 5571429 - DNA, 15 bp, Homo sapiens
atcagttgatttttc

SEQ ID NO: 5571430 - DNA, 18 bp, Homo sapiens
atcagttgcaataatact

SEQ ID NO: 5571431 - DNA, 17 bp, Homo sapiens
atcagttgccccccatc

SEQ ID NO: 5571432 - DNA, 19 bp, Homo sapiens
atcagttgcgcgttctgaa

SEQ ID NO: 5571433 - DNA, 13 bp, Homo sapiens
atcagttgtgaat

SEQ ID NO: 5571434 - DNA, 20 bp, Homo sapiens
atcagtttaaaagcacgaca

SEQ ID NO: 5571435 - DNA, 22 bp, Homo sapiens
atcagtttaaaagcacgacagt

SEQ ID NO: 5571436 - DNA, 19 bp, Homo sapiens
atcagtttaggccttggct

SEQ ID NO: 5571437 - DNA, 15 bp, Homo sapiens
atcagtttatcctga

SEQ ID NO: 5571438 - DNA, 10 bp, Homo sapiens
atcagtttga

SEQ ID NO: 5571439 - DNA, 22 bp, Homo sapiens
atcagtttgctagcagaaatct

SEQ ID NO: 5571440 - DNA, 17 bp, Homo sapiens
atcagttttatccacag

SEQ ID NO: 5571441 - DNA, 18 bp, Homo sapiens
atcagttttgtgtacagt

SEQ ID NO: 5571442 - DNA, 13 bp, Homo sapiens
atcagtttttaaa

SEQ ID NO: 5571443 - DNA, 17 bp, Homo sapiens
atcagtttttaaaatat

SEQ ID NO: 5571444 - DNA, 21 bp, Homo sapiens
atcagtttttaaaatatttag

SEQ ID NO: 5571445 - DNA, 20 bp, Homo sapiens
atcagtttttgttcttaaaa

SEQ ID NO: 5571446 - DNA, 23 bp, Homo sapiens
atcataaaaggtgacccttctgt

SEQ ID NO: 5571447 - DNA, 12 bp, Homo sapiens
atcataaaataa

SEQ ID NO: 5571448 - DNA, 18 bp, Homo sapiens
atcataaaatccaatgct

SEQ ID NO: 5571449 - DNA, 16 bp, Homo sapiens
atcataaactgtgtgc

SEQ ID NO: 5571450 - DNA, 22 bp, Homo sapiens
atcataaagagcacgttttcca

SEQ ID NO: 5571451 - DNA, 12 bp, Homo sapiens
atcataaagcat

SEQ ID NO: 5571452 - DNA, 14 bp, Homo sapiens
atcataaaggatat

SEQ ID NO: 5571453 - DNA, 13 bp, Homo sapiens
atcataaagtcag

SEQ ID NO: 5571454 - DNA, 18 bp, Homo sapiens
atcataacatagttgaaa

SEQ ID NO: 5571455 - DNA, 15 bp, Homo sapiens
atcataacttaataa

SEQ ID NO: 5571456 - DNA, 18 bp, Homo sapiens
atcataagaatttttcag

SEQ ID NO: 5571457 - DNA, 18 bp, Homo sapiens
atcatttaataatatact

SEQ ID NO: 5571458 - DNA, 19 bp, Homo sapiens
atcatttaataatatactt

SEQ ID NO: 5571459 - DNA, 19 bp, Homo sapiens
atcatttacaagacaacat

SEQ ID NO: 5571460 - DNA, 13 bp, Homo sapiens
atcatttactctt

SEQ ID NO: 5571461 - DNA, 19 bp, Homo sapiens
atcatttataatactgttt

SEQ ID NO: 5571462 - DNA, 15 bp, Homo sapiens
atcatttattggatg

SEQ ID NO: 5571463 - DNA, 22 bp, Homo sapiens
atcatttattttttacattatt

SEQ ID NO: 5571464 - DNA, 15 bp, Homo sapiens
atcatttcattcgtg

SEQ ID NO: 5571465 - DNA, 20 bp, Homo sapiens
atcatttccagcaaaatata

SEQ ID NO: 5571466 - DNA, 15 bp, Homo sapiens
atcatttcccctccc

SEQ ID NO: 5571467 - DNA, 19 bp, Homo sapiens
atcatttccgttttgcctg

SEQ ID NO: 5571468 - DNA, 23 bp, Homo sapiens
atcatttcctgggagaaagacca

SEQ ID NO: 5571469 - DNA, 17 bp, Homo sapiens
atcatttctaattttaa

SEQ ID NO: 5571470 - DNA, 12 bp, Homo sapiens
atcatttctagg

SEQ ID NO: 5571471 - DNA, 21 bp, Homo sapiens
atcatttctattaaatgagca

SEQ ID NO: 5571472 - DNA, 15 bp, Homo sapiens
atcatttctatttct

SEQ ID NO: 5571473 - DNA, 19 bp, Homo sapiens
atcatttctcctttaaaga

SEQ ID NO: 5571474 - DNA, 14 bp, Homo sapiens
atcatttctcttcc

SEQ ID NO: 5571475 - DNA, 11 bp, Homo sapiens
atcatttctgg

SEQ ID NO: 5571476 - DNA, 18 bp, Homo sapiens
atcatttcttgggccctc

SEQ ID NO: 5571477 - DNA, 22 bp, Homo sapiens
atcatttcttgggccctcctga

SEQ ID NO: 5571478 - DNA, 15 bp, Homo sapiens
atcatttctttagag

SEQ ID NO: 5571479 - DNA, 23 bp, Homo sapiens
atcatttctttttgggagagact

SEQ ID NO: 5571480 - DNA, 19 bp, Homo sapiens
atcatttgatttaaacaat

SEQ ID NO: 5571481 - DNA, 17 bp, Homo sapiens
atcatttgcagctgctg

SEQ ID NO: 5571482 - DNA, 15 bp, Homo sapiens
atcatttgcccttaa

SEQ ID NO: 5571483 - DNA, 18 bp, Homo sapiens
atcatttgcccttaagga

SEQ ID NO: 5571484 - DNA, 23 bp, Homo sapiens
atcatttggccgagtcagcacgt

SEQ ID NO: 5571485 - DNA, 16 bp, Homo sapiens
atcatttgtcctgttc

SEQ ID NO: 5571486 - DNA, 13 bp, Homo sapiens
atcatttgtgaag

SEQ ID NO: 5571487 - DNA, 18 bp, Homo sapiens
atcatttgtgaagaatta

SEQ ID NO: 5571488 - DNA, 18 bp, Homo sapiens
atcatttgttggaatgaa

SEQ ID NO: 5571489 - DNA, 18 bp, Homo sapiens
atcatttgtttaaaaagg

SEQ ID NO: 5571490 - DNA, 17 bp, Homo sapiens
atcattttaaaaacttt

SEQ ID NO: 5571491 - DNA, 22 bp, Homo sapiens
atcattttacagtgaccttttc

SEQ ID NO: 5571492 - DNA, 17 bp, Homo sapiens
atcattttagaattaaa

SEQ ID NO: 5571493 - DNA, 16 bp, Homo sapiens
atcattttaggaaagg

SEQ ID NO: 5571494 - DNA, 21 bp, Homo sapiens
atcattttagtatagttttcg

SEQ ID NO: 5571495 - DNA, 14 bp, Homo sapiens
atcattttatagaa

SEQ ID NO: 5571496 - DNA, 16 bp, Homo sapiens
atcattttatagaaaa

SEQ ID NO: 5571497 - DNA, 18 bp, Homo sapiens
atcattttatataaagaa

SEQ ID NO: 5571498 - DNA, 19 bp, Homo sapiens
atcattttatataaagaaa

SEQ ID NO: 5571499 - DNA, 18 bp, Homo sapiens
atcattttatatgtcaaa

SEQ ID NO: 5571500 - DNA, 14 bp, Homo sapiens
atcattttattcac

SEQ ID NO: 5571501 - DNA, 11 bp, Homo sapiens
atcattttcat

SEQ ID NO: 5571502 - DNA, 14 bp, Homo sapiens
atcattttcattaa

SEQ ID NO: 5571503 - DNA, 18 bp, Homo sapiens
atcattttccaattaatt

SEQ ID NO: 5571504 - DNA, 17 bp, Homo sapiens
atcattttcctgggagt

SEQ ID NO: 5571505 - DNA, 20 bp, Homo sapiens
atcattttgatgtattatta

SEQ ID NO: 5571506 - DNA, 22 bp, Homo sapiens
atcattttgcaatcccttaata

SEQ ID NO: 5571507 - DNA, 19 bp, Homo sapiens
atcattttgcattcaaatt

SEQ ID NO: 5571508 - DNA, 16 bp, Homo sapiens
atcattttgttttcca

SEQ ID NO: 5571509 - DNA, 18 bp, Homo sapiens
atcatttttacactattg

SEQ ID NO: 5571510 - DNA, 16 bp, Homo sapiens
atcatttttataacca

SEQ ID NO: 5571511 - DNA, 18 bp, Homo sapiens
atcatttttatcccgcca

SEQ ID NO: 5571512 - DNA, 18 bp, Homo sapiens
atcatttttccaggactc

SEQ ID NO: 5571513 - DNA, 14 bp, Homo sapiens
atcatttttccttc

SEQ ID NO: 5571514 - DNA, 23 bp, Homo sapiens
atcatttttccttcccttctcca

SEQ ID NO: 5571515 - DNA, 16 bp, Homo sapiens
atcatttttgtacagt

SEQ ID NO: 5571516 - DNA, 22 bp, Homo sapiens
atcatttttgtacagtttgctg

SEQ ID NO: 5571517 - DNA, 20 bp, Homo sapiens
atcatttttgtaggaagcat

SEQ ID NO: 5571518 - DNA, 17 bp, Homo sapiens
atcatttttgtgcacag

SEQ ID NO: 5571519 - DNA, 14 bp, Homo sapiens
atcattttttactt

SEQ ID NO: 5571520 - DNA, 14 bp, Homo sapiens
atcattttttcctg

SEQ ID NO: 5571521 - DNA, 16 bp, Homo sapiens
atcattttttgtttct

SEQ ID NO: 5571522 - DNA, 21 bp, Homo sapiens
atccaaaaagctctgaaaaca

SEQ ID NO: 5571523 - DNA, 18 bp, Homo sapiens
atccaaaaatagccctgc

SEQ ID NO: 5571524 - DNA, 15 bp, Homo sapiens
atccaaaagaaaaac

SEQ ID NO: 5571525 - DNA, 13 bp, Homo sapiens
atccaaaagaagc

SEQ ID NO: 5571526 - DNA, 22 bp, Homo sapiens
atccaaaagaagcccccagcta

SEQ ID NO: 5571527 - DNA, 13 bp, Homo sapiens
atccaaaataaat

SEQ ID NO: 5571528 - DNA, 17 bp, Homo sapiens
atccaaaatagtcatgt

SEQ ID NO: 5571529 - DNA, 22 bp, Homo sapiens
atccaaaatagtcatgtttctg

SEQ ID NO: 5571530 - DNA, 19 bp, Homo sapiens
atccaaaatcttgatcagt

SEQ ID NO: 5571531 - DNA, 20 bp, Homo sapiens
atccaaaatgaatgcaaaat

SEQ ID NO: 5571532 - DNA, 18 bp, Homo sapiens
atccaaacaatttaaaaa

SEQ ID NO: 5571533 - DNA, 20 bp, Homo sapiens
atccaaacactgaggcagcc

SEQ ID NO: 5571534 - DNA, 23 bp, Homo sapiens
atccaaacagaaaagtgcaaagt

SEQ ID NO: 5571535 - DNA, 21 bp, Homo sapiens
atccaaacatgtatttatgta

SEQ ID NO: 5571536 - DNA, 18 bp, Homo sapiens
atccaaactcagaaggct

SEQ ID NO: 5571537 - DNA, 14 bp, Homo sapiens
atccaaactgctgt

SEQ ID NO: 5571538 - DNA, 21 bp, Homo sapiens
atccaaagaaaaagggctgcc

SEQ ID NO: 5571539 - DNA, 19 bp, Homo sapiens
atccaaaggctcctgagac

SEQ ID NO: 5571540 - DNA, 11 bp, Homo sapiens
atccaaagtaa

SEQ ID NO: 5571541 - DNA, 15 bp, Homo sapiens
atccaaataatgaat

SEQ ID NO: 5571542 - DNA, 16 bp, Homo sapiens
atccaaataatgaatc

SEQ ID NO: 5571543 - DNA, 19 bp, Homo sapiens
atccaaatcttgaatttct

SEQ ID NO: 5571544 - DNA, 22 bp, Homo sapiens
atccaaatttttttttaaagca

SEQ ID NO: 5571545 - DNA, 12 bp, Homo sapiens
atccaacaagaa

SEQ ID NO: 5571546 - DNA, 13 bp, Homo sapiens
atccaacaagaag

SEQ ID NO: 5571547 - DNA, 21 bp, Homo sapiens
atccaacaagaagaaatatga

SEQ ID NO: 5571548 - DNA, 18 bp, Homo sapiens
atccaacagaaagcatag

SEQ ID NO: 5571549 - DNA, 14 bp, Homo sapiens
atccaacagacctg

SEQ ID NO: 5571550 - DNA, 21 bp, Homo sapiens
atccaacagacctggtgctct

SEQ ID NO: 5571551 - DNA, 14 bp, Homo sapiens
atccaacatttcct

SEQ ID NO: 5571552 - DNA, 16 bp, Homo sapiens
atccaactaatgcctt

SEQ ID NO: 5571553 - DNA, 18 bp, Homo sapiens
atccaactaatgccttac

SEQ ID NO: 5571554 - DNA, 15 bp, Homo sapiens
atccaactattaaga

SEQ ID NO: 5571555 - DNA, 14 bp, Homo sapiens
atccaactcctcta

SEQ ID NO: 5571556 - DNA, 18 bp, Homo sapiens
atccaactggaaattcca

SEQ ID NO: 5571557 - DNA, 14 bp, Homo sapiens
atccaactttgtag

SEQ ID NO: 5571558 - DNA, 17 bp, Homo sapiens
atccaagacaaactaaa

SEQ ID NO: 5571559 - DNA, 20 bp, Homo sapiens
atccaagacaaactaaactt

SEQ ID NO: 5571560 - DNA, 22 bp, Homo sapiens
atccaagacagaataatgaatg

SEQ ID NO: 5571561 - DNA, 13 bp, Homo sapiens
atccaagagggac

SEQ ID NO: 5571562 - DNA, 16 bp, Homo sapiens
atccaagatcaattcc

SEQ ID NO: 5571563 - DNA, 22 bp, Homo sapiens
atccaagatcaattccctctct

SEQ ID NO: 5571564 - DNA, 21 bp, Homo sapiens
atccaagcaccaccaaacaca

SEQ ID NO: 5571565 - DNA, 13 bp, Homo sapiens
atccaagccagag

SEQ ID NO: 5571566 - DNA, 14 bp, Homo sapiens
atccaagcctccac

SEQ ID NO: 5571567 - DNA, 18 bp, Homo sapiens
atccaagcctccacagcg

SEQ ID NO: 5571568 - DNA, 18 bp, Homo sapiens
atccaagctccctgcccc

SEQ ID NO: 5571569 - DNA, 14 bp, Homo sapiens
atccaaggaaacat

SEQ ID NO: 5571570 - DNA, 20 bp, Homo sapiens
atccaaggaacctaattgaa

SEQ ID NO: 5571571 - DNA, 22 bp, Homo sapiens
atccaaggaacctaattgaaat

SEQ ID NO: 5571572 - DNA, 23 bp, Homo sapiens
atccaaggaacctaattgaaatt

SEQ ID NO: 5571573 - DNA, 19 bp, Homo sapiens
atccaaggagaaacagaga

SEQ ID NO: 5571574 - DNA, 22 bp, Homo sapiens
atccaaggagaaacagagacag

SEQ ID NO: 5571575 - DNA, 13 bp, Homo sapiens
atccaaggcaaac

SEQ ID NO: 5571576 - DNA, 15 bp, Homo sapiens
atccaaggcaaacaa

SEQ ID NO: 5571577 - DNA, 20 bp, Homo sapiens
atccaaggcagggaaaggaa

SEQ ID NO: 5571578 - DNA, 19 bp, Homo sapiens
atccaaggggctagctgga

SEQ ID NO: 5571579 - DNA, 22 bp, Homo sapiens
atccaagggttgagagccagtg

SEQ ID NO: 5571580 - DNA, 21 bp, Homo sapiens
atccaaggtggggtggaagct

SEQ ID NO: 5571581 - DNA, 12 bp, Homo sapiens
atccaagtggcc

SEQ ID NO: 5571582 - DNA, 15 bp, Homo sapiens
atccaagttaaatgt

SEQ ID NO: 5571583 - DNA, 13 bp, Homo sapiens
atccaataaaaaa

SEQ ID NO: 5571584 - DNA, 21 bp, Homo sapiens
atccaataaaaatcaggagcc

SEQ ID NO: 5571585 - DNA, 21 bp, Homo sapiens
atccaatatcatgtcttgtgc

SEQ ID NO: 5571586 - DNA, 22 bp, Homo sapiens
atccaatattttctttaatgct

SEQ ID NO: 5571587 - DNA, 13 bp, Homo sapiens
atccaatcaatct

SEQ ID NO: 5571588 - DNA, 21 bp, Homo sapiens
atccaatcaatttaaatgttt

SEQ ID NO: 5571589 - DNA, 22 bp, Homo sapiens
atccaatcagagaccaggccct

SEQ ID NO: 5571590 - DNA, 19 bp, Homo sapiens
atccaatcctcactgggtg

SEQ ID NO: 5571591 - DNA, 20 bp, Homo sapiens
atccaatcctcactgggtgg

SEQ ID NO: 5571592 - DNA, 22 bp, Homo sapiens
atccaatcctcaggatttcatt

SEQ ID NO: 5571593 - DNA, 23 bp, Homo sapiens
atccaatctgctcagcaggccct

SEQ ID NO: 5571594 - DNA, 22 bp, Homo sapiens
atccaatgaatgatcattgaaa

SEQ ID NO: 5571595 - DNA, 22 bp, Homo sapiens
atccaatggactgcataaataa

SEQ ID NO: 5571596 - DNA, 14 bp, Homo sapiens
atccaatgtcgctg

SEQ ID NO: 5571597 - DNA, 18 bp, Homo sapiens
atccaatgtcgctgtaaa

SEQ ID NO: 5571598 - DNA, 20 bp, Homo sapiens
atccaattagcttatgttaa

SEQ ID NO: 5571599 - DNA, 22 bp, Homo sapiens
atccaattagcttatgttaact

SEQ ID NO: 5571600 - DNA, 17 bp, Homo sapiens
atccaattatgtgacaa

SEQ ID NO: 5571601 - DNA, 22 bp, Homo sapiens
atccaattatgtgacaaccttt

SEQ ID NO: 5571602 - DNA, 23 bp, Homo sapiens
atccaattatgtgacaacctttg

SEQ ID NO: 5571603 - DNA, 16 bp, Homo sapiens
atccaattcatctttt

SEQ ID NO: 5571604 - DNA, 21 bp, Homo sapiens
atccaattttaaaatgaaatg

SEQ ID NO: 5571605 - DNA, 18 bp, Homo sapiens
atccacaaagccgtgcct

SEQ ID NO: 5571606 - DNA, 16 bp, Homo sapiens
atccacaaattcctcc

SEQ ID NO: 5571607 - DNA, 20 bp, Homo sapiens
atccacaatgagatgcatga

SEQ ID NO: 5571608 - DNA, 21 bp, Homo sapiens
atccacacaacaccaggactt

SEQ ID NO: 5571609 - DNA, 14 bp, Homo sapiens
atccacacacagca

SEQ ID NO: 5571610 - DNA, 18 bp, Homo sapiens
atccacaccaaagggaga

SEQ ID NO: 5571611 - DNA, 13 bp, Homo sapiens
atccacagactcc

SEQ ID NO: 5571612 - DNA, 20 bp, Homo sapiens
atccacagagagtcccactg

SEQ ID NO: 5571613 - DNA, 21 bp, Homo sapiens
atccacagccaacaaacatag

SEQ ID NO: 5571614 - DNA, 13 bp, Homo sapiens
atccacagtattg

SEQ ID NO: 5571615 - DNA, 14 bp, Homo sapiens
atccacagtattgt

SEQ ID NO: 5571616 - DNA, 20 bp, Homo sapiens
atccacagtctcccccaccc

SEQ ID NO: 5571617 - DNA, 13 bp, Homo sapiens
atccacataaaag

SEQ ID NO: 5571618 - DNA, 20 bp, Homo sapiens
atccacatctttactcaggc

SEQ ID NO: 5571619 - DNA, 13 bp, Homo sapiens
atccacatgcaca

SEQ ID NO: 5571620 - DNA, 16 bp, Homo sapiens
atccacatgtttcaga

SEQ ID NO: 5571621 - DNA, 15 bp, Homo sapiens
atccacattgtagcc

SEQ ID NO: 5571622 - DNA, 15 bp, Homo sapiens
atccaccaatatcat

SEQ ID NO: 5571623 - DNA, 15 bp, Homo sapiens
atccaccaccttgcc

SEQ ID NO: 5571624 - DNA, 15 bp, Homo sapiens
atccacccacctcag

SEQ ID NO: 5571625 - DNA, 16 bp, Homo sapiens
atccacccacctcagc

SEQ ID NO: 5571626 - DNA, 18 bp, Homo sapiens
atccacccacctcagcct

SEQ ID NO: 5571627 - DNA, 20 bp, Homo sapiens
atccacccacctcggcctcc

SEQ ID NO: 5571628 - DNA, 16 bp, Homo sapiens
atccacccagcaggca

SEQ ID NO: 5571629 - DNA, 13 bp, Homo sapiens
atccacccagtgc

SEQ ID NO: 5571630 - DNA, 14 bp, Homo sapiens
atccacccagtgct

SEQ ID NO: 5571631 - DNA, 16 bp, Homo sapiens
atccacccagtgctgc

SEQ ID NO: 5571632 - DNA, 19 bp, Homo sapiens
atccacccatgtttattaa

SEQ ID NO: 5571633 - DNA, 20 bp, Homo sapiens
atccaccccagccccactgc

SEQ ID NO: 5571634 - DNA, 20 bp, Homo sapiens
atcccagcacctgccagggc

SEQ ID NO: 5571635 - DNA, 16 bp, Homo sapiens
atcccagcacctgcct

SEQ ID NO: 5571636 - DNA, 14 bp, Homo sapiens
atcccagcagccca

SEQ ID NO: 5571637 - DNA, 12 bp, Homo sapiens
atcccagcatct

SEQ ID NO: 5571638 - DNA, 18 bp, Homo sapiens
atcccagcattttgagag

SEQ ID NO: 5571639 - DNA, 13 bp, Homo sapiens
atcccagcccacc

SEQ ID NO: 5571640 - DNA, 19 bp, Homo sapiens
atcccagccccaattttct

SEQ ID NO: 5571641 - DNA, 14 bp, Homo sapiens
atcccagccccctg

SEQ ID NO: 5571642 - DNA, 22 bp, Homo sapiens
atcccagccggccaatggaaac

SEQ ID NO: 5571643 - DNA, 10 bp, Homo sapiens
atcccagcct

SEQ ID NO: 5571644 - DNA, 22 bp, Homo sapiens
atcccagcctcagaagccttct

SEQ ID NO: 5571645 - DNA, 23 bp, Homo sapiens
atcccagcctcagaagccttctt

SEQ ID NO: 5571646 - DNA, 23 bp, Homo sapiens
atcccagcctgggggccagtggg

SEQ ID NO: 5571647 - DNA, 15 bp, Homo sapiens
atcccagcctgtggt

SEQ ID NO: 5571648 - DNA, 16 bp, Homo sapiens
atcccagcctgtggtt

SEQ ID NO: 5571649 - DNA, 19 bp, Homo sapiens
atcccagctacatgggagc

SEQ ID NO: 5571650 - DNA, 19 bp, Homo sapiens
atcccagctacccaggagg

SEQ ID NO: 5571651 - DNA, 20 bp, Homo sapiens
atcccagctactcgggaggc

SEQ ID NO: 5571652 - DNA, 22 bp, Homo sapiens
atcccagctacttgggaggctg

SEQ ID NO: 5571653 - DNA, 13 bp, Homo sapiens
atcccagctcacg

SEQ ID NO: 5571654 - DNA, 15 bp, Homo sapiens
atcccagctcactgc

SEQ ID NO: 5571655 - DNA, 20 bp, Homo sapiens
atcccagctcactgcagcct

SEQ ID NO: 5571656 - DNA, 11 bp, Homo sapiens
atcccagctcc

SEQ ID NO: 5571657 - DNA, 13 bp, Homo sapiens
atcccagctgcct

SEQ ID NO: 5571658 - DNA, 14 bp, Homo sapiens
atcccagctgccta

SEQ ID NO: 5571659 - DNA, 15 bp, Homo sapiens
atcccagcttgcccc

SEQ ID NO: 5571660 - DNA, 19 bp, Homo sapiens
atcccagctttaaaaagaa

SEQ ID NO: 5571661 - DNA, 13 bp, Homo sapiens
atcccagctttgg

SEQ ID NO: 5571662 - DNA, 12 bp, Homo sapiens
atcccaggacac

SEQ ID NO: 5571663 - DNA, 23 bp, Homo sapiens
atcccaggatcgcaagagccatg

SEQ ID NO: 5571664 - DNA, 19 bp, Homo sapiens
atcccaggatgctgggtgg

SEQ ID NO: 5571665 - DNA, 24 bp, Homo sapiens
atcccaggcccctggaggctgcct

SEQ ID NO: 5571666 - DNA, 13 bp, Homo sapiens
atcccagggctgg

SEQ ID NO: 5571667 - DNA, 16 bp, Homo sapiens
atcccagggctggctc

SEQ ID NO: 5571668 - DNA, 20 bp, Homo sapiens
atcccaggggaccacacctc

SEQ ID NO: 5571669 - DNA, 19 bp, Homo sapiens
atcccaggggcccaaggcg

SEQ ID NO: 5571670 - DNA, 23 bp, Homo sapiens
atcccagggtacactcttctcca

SEQ ID NO: 5571671 - DNA, 16 bp, Homo sapiens
atcccagggtcccacc

SEQ ID NO: 5571672 - DNA, 23 bp, Homo sapiens
atcccaggtgaggaatttgaagc

SEQ ID NO: 5571673 - DNA, 19 bp, Homo sapiens
atcccagtagtgtttggaa

SEQ ID NO: 5571674 - DNA, 18 bp, Homo sapiens
atcccagtgacttaggag

SEQ ID NO: 5571675 - DNA, 13 bp, Homo sapiens
atcccagtgtcct

SEQ ID NO: 5571676 - DNA, 14 bp, Homo sapiens
atcccagtgtccta

SEQ ID NO: 5571677 - DNA, 18 bp, Homo sapiens
atcccagttcttcctgca

SEQ ID NO: 5571678 - DNA, 15 bp, Homo sapiens
atcccagtttctgct

SEQ ID NO: 5571679 - DNA, 14 bp, Homo sapiens
atcccataaagaaa

SEQ ID NO: 5571680 - DNA, 15 bp, Homo sapiens
atcccataaagaaag

SEQ ID NO: 5571681 - DNA, 15 bp, Homo sapiens
atcccatcatggctg

SEQ ID NO: 5571682 - DNA, 20 bp, Homo sapiens
atcccatctattctctgcct

SEQ ID NO: 5571683 - DNA, 11 bp, Homo sapiens
atcccatctct

SEQ ID NO: 5571684 - DNA, 15 bp, Homo sapiens
atcccatctctaaaa

SEQ ID NO: 5571685 - DNA, 18 bp, Homo sapiens
atcccatctctacaaaaa

SEQ ID NO: 5571686 - DNA, 23 bp, Homo sapiens
atcccatctctacaaaaaatgca

SEQ ID NO: 5571687 - DNA, 16 bp, Homo sapiens
atcccatctctcccac

SEQ ID NO: 5571688 - DNA, 13 bp, Homo sapiens
atcccatgagcct

SEQ ID NO: 5571689 - DNA, 17 bp, Homo sapiens
atcccatgagcctcagc

SEQ ID NO: 5571690 - DNA, 19 bp, Homo sapiens
atcccatgagcctcagcat

SEQ ID NO: 5571691 - DNA, 16 bp, Homo sapiens
atcccatgtaacagaa

SEQ ID NO: 5571692 - DNA, 15 bp, Homo sapiens
atcccatgtatttat

SEQ ID NO: 5571693 - DNA, 19 bp, Homo sapiens
atcccatgtcacctcagct

SEQ ID NO: 5571694 - DNA, 18 bp, Homo sapiens
atcccattaatcatttcc

SEQ ID NO: 5571695 - DNA, 14 bp, Homo sapiens
atcccattattcaa

SEQ ID NO: 5571696 - DNA, 20 bp, Homo sapiens
atcccattattcaaagttgc

SEQ ID NO: 5571697 - DNA, 17 bp, Homo sapiens
atcccattgccctggtt

SEQ ID NO: 5571698 - DNA, 16 bp, Homo sapiens
atcccattgtatttaa

SEQ ID NO: 5571699 - DNA, 15 bp, Homo sapiens
atcccatttaaaaaa

SEQ ID NO: 5571700 - DNA, 16 bp, Homo sapiens
atcccatttcttgaaa

SEQ ID NO: 5571701 - DNA, 21 bp, Homo sapiens
atcccatttcttgaaaagcct

SEQ ID NO: 5571702 - DNA, 13 bp, Homo sapiens
atccccaaaaaag

SEQ ID NO: 5571703 - DNA, 23 bp, Homo sapiens
atccccaaaacaggccaggtgtg

SEQ ID NO: 5571704 - DNA, 16 bp, Homo sapiens
atccccaaactgtgcc

SEQ ID NO: 5571705 - DNA, 13 bp, Homo sapiens
atccccaactcca

SEQ ID NO: 5571706 - DNA, 15 bp, Homo sapiens
atccccaactgctcc

SEQ ID NO: 5571707 - DNA, 21 bp, Homo sapiens
atccccaactgctccagcctc

SEQ ID NO: 5571708 - DNA, 22 bp, Homo sapiens
atccccaactgctccagcctct

SEQ ID NO: 5571709 - DNA, 15 bp, Homo sapiens
atccccaagtgcctg

SEQ ID NO: 5571710 - DNA, 16 bp, Homo sapiens
atccccaagtgtgaac

SEQ ID NO: 5571711 - DNA, 12 bp, Homo sapiens
atccccaataat

SEQ ID NO: 5571712 - DNA, 19 bp, Homo sapiens
atccccaataattgcagaa

SEQ ID NO: 5571713 - DNA, 21 bp, Homo sapiens
atccccaataattgcagaact

SEQ ID NO: 5571714 - DNA, 17 bp, Homo sapiens
atccccaatcagctcct

SEQ ID NO: 5571715 - DNA, 19 bp, Homo sapiens
atccccacagctggctctg

SEQ ID NO: 5571716 - DNA, 12 bp, Homo sapiens
atccccaccagc

SEQ ID NO: 5571717 - DNA, 15 bp, Homo sapiens
atccccaccccacct

SEQ ID NO: 5571718 - DNA, 13 bp, Homo sapiens
atccccacccttg

SEQ ID NO: 5571719 - DNA, 16 bp, Homo sapiens
atccccacgacccctg

SEQ ID NO: 5571720 - DNA, 15 bp, Homo sapiens
atccccacgccacag

SEQ ID NO: 5571721 - DNA, 17 bp, Homo sapiens
atccccacgccacagcc

SEQ ID NO: 5571722 - DNA, 19 bp, Homo sapiens
atccccactgggaccaacc

SEQ ID NO: 5571723 - DNA, 13 bp, Homo sapiens
atccccagagccc

SEQ ID NO: 5571724 - DNA, 16 bp, Homo sapiens
atccccagagcccagc

SEQ ID NO: 5571725 - DNA, 23 bp, Homo sapiens
atccccagccagggagcttgcca

SEQ ID NO: 5571726 - DNA, 17 bp, Homo sapiens
atccccagcccctcctc

SEQ ID NO: 5571727 - DNA, 11 bp, Homo sapiens
atccccagcct

SEQ ID NO: 5571728 - DNA, 14 bp, Homo sapiens
atccccagctttct

SEQ ID NO: 5571729 - DNA, 22 bp, Homo sapiens
atccccaggccaggtccctgga

SEQ ID NO: 5571730 - DNA, 12 bp, Homo sapiens
atccccagggca

SEQ ID NO: 5571731 - DNA, 16 bp, Homo sapiens
atccccagggcagcct

SEQ ID NO: 5571732 - DNA, 17 bp, Homo sapiens
atccccagggcagcctc

SEQ ID NO: 5571733 - DNA, 19 bp, Homo sapiens
atccccaggggtcccagcc

SEQ ID NO: 5571734 - DNA, 21 bp, Homo sapiens
atccccaggggtcccagccac

SEQ ID NO: 5571735 - DNA, 23 bp, Homo sapiens
atccccaggggtcccagccaccc

SEQ ID NO: 5571736 - DNA, 20 bp, Homo sapiens
atccccaggtccccaaactt

SEQ ID NO: 5571737 - DNA, 22 bp, Homo sapiens
atccccaggtctctccactgct

SEQ ID NO: 5571738 - DNA, 14 bp, Homo sapiens
atccccagtcccaa

SEQ ID NO: 5571739 - DNA, 12 bp, Homo sapiens
atccccagtgcc

SEQ ID NO: 5571740 - DNA, 16 bp, Homo sapiens
atccccagtgccagct

SEQ ID NO: 5571741 - DNA, 20 bp, Homo sapiens
atccccatcaggtagctgtc

SEQ ID NO: 5571742 - DNA, 23 bp, Homo sapiens
atccccatccctctactttcccc

SEQ ID NO: 5571743 - DNA, 17 bp, Homo sapiens
atccccatcctccagct

SEQ ID NO: 5571744 - DNA, 20 bp, Homo sapiens
atccccatctccctgcctgg

SEQ ID NO: 5571745 - DNA, 23 bp, Homo sapiens
atccccatggaacagccctgcac

SEQ ID NO: 5571746 - DNA, 12 bp, Homo sapiens
atcccccagact

SEQ ID NO: 5571747 - DNA, 15 bp, Homo sapiens
atccccccatcttgc

SEQ ID NO: 5571748 - DNA, 14 bp, Homo sapiens
atcccccccagcct

SEQ ID NO: 5571749 - DNA, 14 bp, Homo sapiens
atcccccctcacca

SEQ ID NO: 5571750 - DNA, 22 bp, Homo sapiens
atccccctccccccaggttcct

SEQ ID NO: 5571751 - DNA, 21 bp, Homo sapiens
atccccctctcacgccacccc

SEQ ID NO: 5571752 - DNA, 20 bp, Homo sapiens
atccccctctttgcacagca

SEQ ID NO: 5571753 - DNA, 14 bp, Homo sapiens
atccccctgccctc

SEQ ID NO: 5571754 - DNA, 14 bp, Homo sapiens
atccccctgtggaa

SEQ ID NO: 5571755 - DNA, 23 bp, Homo sapiens
atcccccttagaatgtttctatt

SEQ ID NO: 5571756 - DNA, 17 bp, Homo sapiens
atcccccttcttcctcc

SEQ ID NO: 5571757 - DNA, 18 bp, Homo sapiens
atcccccttgccacccca

SEQ ID NO: 5571758 - DNA, 16 bp, Homo sapiens
atccccgacagtggct

SEQ ID NO: 5571759 - DNA, 15 bp, Homo sapiens
atccccgcacaaagc

SEQ ID NO: 5571760 - DNA, 20 bp, Homo sapiens
atccccgcctggccaggagc

SEQ ID NO: 5571761 - DNA, 16 bp, Homo sapiens
atccccgctggctggg

SEQ ID NO: 5571762 - DNA, 16 bp, Homo sapiens
atccccgtgctcacag

SEQ ID NO: 5571763 - DNA, 22 bp, Homo sapiens
atccccgttcctgacatcacag

SEQ ID NO: 5571764 - DNA, 18 bp, Homo sapiens
atccccgtttcttgcaag

SEQ ID NO: 5571765 - DNA, 13 bp, Homo sapiens
atcccctaaaata

SEQ ID NO: 5571766 - DNA, 22 bp, Homo sapiens
atcccctaaacaaaaagaacaa

SEQ ID NO: 5571767 - DNA, 17 bp, Homo sapiens
atcccctagaaatcctg

SEQ ID NO: 5571768 - DNA, 14 bp, Homo sapiens
atcccctcaacacc

SEQ ID NO: 5571769 - DNA, 22 bp, Homo sapiens
atcccctcaacaccctgcttct

SEQ ID NO: 5571770 - DNA, 19 bp, Homo sapiens
atcccctccctgcctgctc

SEQ ID NO: 5571771 - DNA, 15 bp, Homo sapiens
atcccctccctgtca

SEQ ID NO: 5571772 - DNA, 15 bp, Homo sapiens
atcccctccttgggc

SEQ ID NO: 5571773 - DNA, 15 bp, Homo sapiens
atcccctctcaggag

SEQ ID NO: 5571774 - DNA, 23 bp, Homo sapiens
atcccctctcaggagagtgtgca

SEQ ID NO: 5571775 - DNA, 15 bp, Homo sapiens
atcccctctcccccc

SEQ ID NO: 5571776 - DNA, 23 bp, Homo sapiens
atcccctctcccccccccctcca

SEQ ID NO: 5571777 - DNA, 14 bp, Homo sapiens
atcccctctctgtg

SEQ ID NO: 5571778 - DNA, 12 bp, Homo sapiens
atcccctgagcc

SEQ ID NO: 5571779 - DNA, 14 bp, Homo sapiens
atcccctgagcccc

SEQ ID NO: 5571780 - DNA, 22 bp, Homo sapiens
atcccctgagggtggtcagcca

SEQ ID NO: 5571781 - DNA, 20 bp, Homo sapiens
atcccctgcactaggcaggt

SEQ ID NO: 5571782 - DNA, 13 bp, Homo sapiens
atcccctgcctcc

SEQ ID NO: 5571783 - DNA, 14 bp, Homo sapiens
atcccctgcctcct

SEQ ID NO: 5571784 - DNA, 17 bp, Homo sapiens
atcccctgcctcctgcc

SEQ ID NO: 5571785 - DNA, 18 bp, Homo sapiens
atcccctgcctcctgcca

SEQ ID NO: 5571786 - DNA, 18 bp, Homo sapiens
atcccctgcgctttgaac

SEQ ID NO: 5571787 - DNA, 20 bp, Homo sapiens
atcccctgcttctggctcct

SEQ ID NO: 5571788 - DNA, 20 bp, Homo sapiens
atcccctggaaacccacctc

SEQ ID NO: 5571789 - DNA, 16 bp, Homo sapiens
atcccctgtcccctgg

SEQ ID NO: 5571790 - DNA, 17 bp, Homo sapiens
atcccctgtcccctggg

SEQ ID NO: 5571791 - DNA, 23 bp, Homo sapiens
atcccctgtcccctggggctggt

SEQ ID NO: 5571792 - DNA, 19 bp, Homo sapiens
atcccctgtgccctgcacg

SEQ ID NO: 5571793 - DNA, 11 bp, Homo sapiens
atccccttcca

SEQ ID NO: 5571794 - DNA, 12 bp, Homo sapiens
atccccttccag

SEQ ID NO: 5571795 - DNA, 13 bp, Homo sapiens
atccccttccagc

SEQ ID NO: 5571796 - DNA, 16 bp, Homo sapiens
atccccttccagctcc

SEQ ID NO: 5571797 - DNA, 17 bp, Homo sapiens
atccccttccagctccc

SEQ ID NO: 5571798 - DNA, 19 bp, Homo sapiens
atccccttcccccatccct

SEQ ID NO: 5571799 - DNA, 21 bp, Homo sapiens
atccccttctcatcactcccc

SEQ ID NO: 5571800 - DNA, 13 bp, Homo sapiens
atccccttctccc

SEQ ID NO: 5571801 - DNA, 21 bp, Homo sapiens
atccccttgtgtcagagacag

SEQ ID NO: 5571802 - DNA, 12 bp, Homo sapiens
atcccctttcct

SEQ ID NO: 5571803 - DNA, 18 bp, Homo sapiens
atcccctttcctccccac

SEQ ID NO: 5571804 - DNA, 20 bp, Homo sapiens
atcccctttcctccccacct

SEQ ID NO: 5571805 - DNA, 17 bp, Homo sapiens
atcccctttcctgcccc

SEQ ID NO: 5571806 - DNA, 14 bp, Homo sapiens
atcccgaaaatctc

SEQ ID NO: 5571807 - DNA, 15 bp, Homo sapiens
atcccgacctcttag

SEQ ID NO: 5571808 - DNA, 21 bp, Homo sapiens
atcccgagcaaccctctgaag

SEQ ID NO: 5571809 - DNA, 22 bp, Homo sapiens
atcccgagcaaccctctgaaga

SEQ ID NO: 5571810 - DNA, 17 bp, Homo sapiens
atcccgagcacctccac

SEQ ID NO: 5571811 - DNA, 19 bp, Homo sapiens
atcccgagcacctccacat

SEQ ID NO: 5571812 - DNA, 13 bp, Homo sapiens
atcccgagtctgg

SEQ ID NO: 5571813 - DNA, 18 bp, Homo sapiens
atcctggcagcccagaga

SEQ ID NO: 5571814 - DNA, 19 bp, Homo sapiens
atcctggcagcccagagac

SEQ ID NO: 5571815 - DNA, 15 bp, Homo sapiens
atcctggccctgggg

SEQ ID NO: 5571816 - DNA, 18 bp, Homo sapiens
atcctggctaacatggtg

SEQ ID NO: 5571817 - DNA, 15 bp, Homo sapiens
atcctggcttgaaaa

SEQ ID NO: 5571818 - DNA, 16 bp, Homo sapiens
atcctggctttgccca

SEQ ID NO: 5571819 - DNA, 18 bp, Homo sapiens
atcctggctttgcccaac

SEQ ID NO: 5571820 - DNA, 11 bp, Homo sapiens
atcctgggacc

SEQ ID NO: 5571821 - DNA, 22 bp, Homo sapiens
atcctgggacctccccagccca

SEQ ID NO: 5571822 - DNA, 16 bp, Homo sapiens
atcctgggatgtaaac

SEQ ID NO: 5571823 - DNA, 16 bp, Homo sapiens
atcctgggcaatcaga

SEQ ID NO: 5571824 - DNA, 23 bp, Homo sapiens
atcctgggcatccccagccccct

SEQ ID NO: 5571825 - DNA, 20 bp, Homo sapiens
atcctgggcatgatgggccg

SEQ ID NO: 5571826 - DNA, 14 bp, Homo sapiens
atcctgggccccca

SEQ ID NO: 5571827 - DNA, 17 bp, Homo sapiens
atcctgggccttacctc

SEQ ID NO: 5571828 - DNA, 14 bp, Homo sapiens
atcctgggggaaga

SEQ ID NO: 5571829 - DNA, 18 bp, Homo sapiens
atcctgggggaagaggag

SEQ ID NO: 5571830 - DNA, 21 bp, Homo sapiens
atcctgggggacccaatgtag

SEQ ID NO: 5571831 - DNA, 18 bp, Homo sapiens
atcctgggggcctgggtt

SEQ ID NO: 5571832 - DNA, 12 bp, Homo sapiens
atcctgggtaat

SEQ ID NO: 5571833 - DNA, 21 bp, Homo sapiens
atcctggtaagaggcaaagaa

SEQ ID NO: 5571834 - DNA, 17 bp, Homo sapiens
atcctggtaattaaaag

SEQ ID NO: 5571835 - DNA, 16 bp, Homo sapiens
atcctggtattgtaat

SEQ ID NO: 5571836 - DNA, 18 bp, Homo sapiens
atcctggtattgtaatat

SEQ ID NO: 5571837 - DNA, 19 bp, Homo sapiens
atcctggtattgtaatatt

SEQ ID NO: 5571838 - DNA, 22 bp, Homo sapiens
atcctggttggtgttgcagaag

SEQ ID NO: 5571839 - DNA, 17 bp, Homo sapiens
atcctgtacaagtgctc

SEQ ID NO: 5571840 - DNA, 20 bp, Homo sapiens
atcctgtaccaaatctgaca

SEQ ID NO: 5571841 - DNA, 21 bp, Homo sapiens
atcctgtaggaaggtactgta

SEQ ID NO: 5571842 - DNA, 17 bp, Homo sapiens
atcctgtatattatggt

SEQ ID NO: 5571843 - DNA, 20 bp, Homo sapiens
atcctgtattcttgtttgaa

SEQ ID NO: 5571844 - DNA, 21 bp, Homo sapiens
atcctgtattcttgttttaca

SEQ ID NO: 5571845 - DNA, 15 bp, Homo sapiens
atcctgtcagtgtca

SEQ ID NO: 5571846 - DNA, 18 bp, Homo sapiens
atcctgtcatctgagaat

SEQ ID NO: 5571847 - DNA, 20 bp, Homo sapiens
atcctgtcatctgagaatga

SEQ ID NO: 5571848 - DNA, 20 bp, Homo sapiens
atcctgtcccatgggctctg

SEQ ID NO: 5571849 - DNA, 14 bp, Homo sapiens
atcctgtcctcagc

SEQ ID NO: 5571850 - DNA, 17 bp, Homo sapiens
atcctgtctgaaaagga

SEQ ID NO: 5571851 - DNA, 18 bp, Homo sapiens
atcctgtctttctgagca

SEQ ID NO: 5571852 - DNA, 21 bp, Homo sapiens
atcctgtgactgtctcactta

SEQ ID NO: 5571853 - DNA, 11 bp, Homo sapiens
atcctgtgcat

SEQ ID NO: 5571854 - DNA, 20 bp, Homo sapiens
atcctgtgggacctgggcca

SEQ ID NO: 5571855 - DNA, 13 bp, Homo sapiens
atcctgtgggtga

SEQ ID NO: 5571856 - DNA, 12 bp, Homo sapiens
atcctgtgtaac

SEQ ID NO: 5571857 - DNA, 14 bp, Homo sapiens
atcctgtgtagcat

SEQ ID NO: 5571858 - DNA, 19 bp, Homo sapiens
atcctgtgtcagaaaccct

SEQ ID NO: 5571859 - DNA, 23 bp, Homo sapiens
atcctgtgtcagaaaccctggtc

SEQ ID NO: 5571860 - DNA, 14 bp, Homo sapiens
atcctgtgtcccct

SEQ ID NO: 5571861 - DNA, 21 bp, Homo sapiens
atcctgtgtggagagggaatg

SEQ ID NO: 5571862 - DNA, 23 bp, Homo sapiens
atcctgtgtggagagggaatgtg

SEQ ID NO: 5571863 - DNA, 14 bp, Homo sapiens
atcctgtgtttcta

SEQ ID NO: 5571864 - DNA, 16 bp, Homo sapiens
atcctgttctgcgctg

SEQ ID NO: 5571865 - DNA, 19 bp, Homo sapiens
atcctgttgaaaagccatg

SEQ ID NO: 5571866 - DNA, 19 bp, Homo sapiens
atcctgttggctgctgcca

SEQ ID NO: 5571867 - DNA, 16 bp, Homo sapiens
atcctgtttgtatttt

SEQ ID NO: 5571868 - DNA, 20 bp, Homo sapiens
atcctgttttcatggacagc

SEQ ID NO: 5571869 - DNA, 21 bp, Homo sapiens
atcctgttttcatggacagct

SEQ ID NO: 5571870 - DNA, 21 bp, Homo sapiens
atcctgtttttagtgctgact

SEQ ID NO: 5571871 - DNA, 13 bp, Homo sapiens
atcctgtttttcc

SEQ ID NO: 5571872 - DNA, 23 bp, Homo sapiens
atccttaaaaagaccatgcattc

SEQ ID NO: 5571873 - DNA, 22 bp, Homo sapiens
atccttaaatcttaatgttcct

SEQ ID NO: 5571874 - DNA, 13 bp, Homo sapiens
atccttaacagat

SEQ ID NO: 5571875 - DNA, 16 bp, Homo sapiens
atccttaaccaataat

SEQ ID NO: 5571876 - DNA, 17 bp, Homo sapiens
atccttaaccattctgt

SEQ ID NO: 5571877 - DNA, 16 bp, Homo sapiens
atccttaactgtccag

SEQ ID NO: 5571878 - DNA, 20 bp, Homo sapiens
atccttaagagaagaaatgt

SEQ ID NO: 5571879 - DNA, 21 bp, Homo sapiens
atccttaaggcatatactttg

SEQ ID NO: 5571880 - DNA, 19 bp, Homo sapiens
atccttaagtatcagaaag

SEQ ID NO: 5571881 - DNA, 17 bp, Homo sapiens
atccttaatggccttaa

SEQ ID NO: 5571882 - DNA, 12 bp, Homo sapiens
atccttacaaat

SEQ ID NO: 5571883 - DNA, 14 bp, Homo sapiens
atccttacaaatga

SEQ ID NO: 5571884 - DNA, 18 bp, Homo sapiens
atccttacaaatgattgc

SEQ ID NO: 5571885 - DNA, 15 bp, Homo sapiens
atccttacatttcac

SEQ ID NO: 5571886 - DNA, 14 bp, Homo sapiens
atccttacttccag

SEQ ID NO: 5571887 - DNA, 19 bp, Homo sapiens
atccttactttatctgggc

SEQ ID NO: 5571888 - DNA, 22 bp, Homo sapiens
atccttagaatggcctctttgt

SEQ ID NO: 5571889 - DNA, 13 bp, Homo sapiens
atccttagaggtc

SEQ ID NO: 5571890 - DNA, 14 bp, Homo sapiens
atccttagatctgg

SEQ ID NO: 5571891 - DNA, 18 bp, Homo sapiens
atccttagatctggcatg

SEQ ID NO: 5571892 - DNA, 15 bp, Homo sapiens
atccttagcaacagc

SEQ ID NO: 5571893 - DNA, 16 bp, Homo sapiens
atccttatcagagcta

SEQ ID NO: 5571894 - DNA, 16 bp, Homo sapiens
atccttatcccaagct

SEQ ID NO: 5571895 - DNA, 21 bp, Homo sapiens
atccttatctagtgtttgatt

SEQ ID NO: 5571896 - DNA, 12 bp, Homo sapiens
atccttatgaga

SEQ ID NO: 5571897 - DNA, 17 bp, Homo sapiens
atccttatgatgtccaa

SEQ ID NO: 5571898 - DNA, 14 bp, Homo sapiens
atccttattgttca

SEQ ID NO: 5571899 - DNA, 14 bp, Homo sapiens
atccttatttatat

SEQ ID NO: 5571900 - DNA, 18 bp, Homo sapiens
atccttcaaaataaaaag

SEQ ID NO: 5571901 - DNA, 20 bp, Homo sapiens
atccttcaagaactctgggc

SEQ ID NO: 5571902 - DNA, 18 bp, Homo sapiens
atccttcacaatttcaat

SEQ ID NO: 5571903 - DNA, 22 bp, Homo sapiens
atccttcacaatttcaatgctt

SEQ ID NO: 5571904 - DNA, 23 bp, Homo sapiens
atccttcacaatttcaatgcttc

SEQ ID NO: 5571905 - DNA, 17 bp, Homo sapiens
atccttcacaggcagtg

SEQ ID NO: 5571906 - DNA, 16 bp, Homo sapiens
atccttcaccagagcc

SEQ ID NO: 5571907 - DNA, 21 bp, Homo sapiens
atccttcaccagagcccatgc

SEQ ID NO: 5571908 - DNA, 20 bp, Homo sapiens
atccttcaccagcaactctg

SEQ ID NO: 5571909 - DNA, 16 bp, Homo sapiens
atccttcactgctcac

SEQ ID NO: 5571910 - DNA, 15 bp, Homo sapiens
atccttcagcacagg

SEQ ID NO: 5571911 - DNA, 18 bp, Homo sapiens
atccttcagcacaggaat

SEQ ID NO: 5571912 - DNA, 22 bp, Homo sapiens
atccttcatcacagcatgtgca

SEQ ID NO: 5571913 - DNA, 23 bp, Homo sapiens
atccttcatcgaacaaactgatg

SEQ ID NO: 5571914 - DNA, 22 bp, Homo sapiens
atccttcatctggattccagag

SEQ ID NO: 5571915 - DNA, 17 bp, Homo sapiens
atccttcatcttttaaa

SEQ ID NO: 5571916 - DNA, 12 bp, Homo sapiens
atccttccacgg

SEQ ID NO: 5571917 - DNA, 13 bp, Homo sapiens
atccttccatcct

SEQ ID NO: 5571918 - DNA, 15 bp, Homo sapiens
atccttccatcctga

SEQ ID NO: 5571919 - DNA, 18 bp, Homo sapiens
atccttccatcctgagga

SEQ ID NO: 5571920 - DNA, 14 bp, Homo sapiens
atccttccattcca

SEQ ID NO: 5571921 - DNA, 12 bp, Homo sapiens
atccttcccaag

SEQ ID NO: 5571922 - DNA, 13 bp, Homo sapiens
atccttcccaagg

SEQ ID NO: 5571923 - DNA, 22 bp, Homo sapiens
atccttcccaagtaagaggctg

SEQ ID NO: 5571924 - DNA, 12 bp, Homo sapiens
atccttcccact

SEQ ID NO: 5571925 - DNA, 13 bp, Homo sapiens
atccttcccatga

SEQ ID NO: 5571926 - DNA, 21 bp, Homo sapiens
atccttccccaacttccctag

SEQ ID NO: 5571927 - DNA, 14 bp, Homo sapiens
atccttcccgcagc

SEQ ID NO: 5571928 - DNA, 15 bp, Homo sapiens
atccttcccgcagca

SEQ ID NO: 5571929 - DNA, 19 bp, Homo sapiens
atccttcccgcagcaccag

SEQ ID NO: 5571930 - DNA, 24 bp, Homo sapiens
atccttcccgcagcaccagcctga

SEQ ID NO: 5571931 - DNA, 16 bp, Homo sapiens
atccttccctgctctt

SEQ ID NO: 5571932 - DNA, 15 bp, Homo sapiens
atccttcctggggac

SEQ ID NO: 5571933 - DNA, 12 bp, Homo sapiens
atccttccttca

SEQ ID NO: 5571934 - DNA, 22 bp, Homo sapiens
atccttccttcccacccatcgc

SEQ ID NO: 5571935 - DNA, 22 bp, Homo sapiens
atccttcggggcgatgctccct

SEQ ID NO: 5571936 - DNA, 19 bp, Homo sapiens
atccttcgggtgctggaag

SEQ ID NO: 5571937 - DNA, 21 bp, Homo sapiens
atccttcgtcctaacataaca

SEQ ID NO: 5571938 - DNA, 18 bp, Homo sapiens
atccttctaaagtgctgg

SEQ ID NO: 5571939 - DNA, 20 bp, Homo sapiens
atccttctaactaaactaaa

SEQ ID NO: 5571940 - DNA, 12 bp, Homo sapiens
atccttctaatc

SEQ ID NO: 5571941 - DNA, 17 bp, Homo sapiens
atccttctagtttccca

SEQ ID NO: 5571942 - DNA, 14 bp, Homo sapiens
atccttctcactgc

SEQ ID NO: 5571943 - DNA, 15 bp, Homo sapiens
atccttctccccaag

SEQ ID NO: 5571944 - DNA, 22 bp, Homo sapiens
atccttctctttcaatgtgttt

SEQ ID NO: 5571945 - DNA, 13 bp, Homo sapiens
atccttctgagct

SEQ ID NO: 5571946 - DNA, 14 bp, Homo sapiens
atccttctgagctc

SEQ ID NO: 5571947 - DNA, 21 bp, Homo sapiens
atccttctgagctccacctct

SEQ ID NO: 5571948 - DNA, 13 bp, Homo sapiens
atccttctggctg

SEQ ID NO: 5571949 - DNA, 19 bp, Homo sapiens
atccttcttatgtttgctt

SEQ ID NO: 5571950 - DNA, 18 bp, Homo sapiens
atccttcttggcttcctg

SEQ ID NO: 5571951 - DNA, 15 bp, Homo sapiens
atccttgaaggtata

SEQ ID NO: 5571952 - DNA, 16 bp, Homo sapiens
atccttgaaggtatat

SEQ ID NO: 5571953 - DNA, 13 bp, Homo sapiens
atccttgaatcct

SEQ ID NO: 5571954 - DNA, 17 bp, Homo sapiens
atccttgaatcctatgt

SEQ ID NO: 5571955 - DNA, 21 bp, Homo sapiens
atccttgactgaagcgaacat

SEQ ID NO: 5571956 - DNA, 15 bp, Homo sapiens
atccttgacttttta

SEQ ID NO: 5571957 - DNA, 16 bp, Homo sapiens
atccttgagattctga

SEQ ID NO: 5571958 - DNA, 22 bp, Homo sapiens
atccttgaggacctccacctgg

SEQ ID NO: 5571959 - DNA, 18 bp, Homo sapiens
atccttgatgatgtgttt

SEQ ID NO: 5571960 - DNA, 19 bp, Homo sapiens
atccttgattacttccact

SEQ ID NO: 5571961 - DNA, 12 bp, Homo sapiens
atccttgcacag

SEQ ID NO: 5571962 - DNA, 15 bp, Homo sapiens
atccttgcacctcag

SEQ ID NO: 5571963 - DNA, 22 bp, Homo sapiens
atccttgcagtttaagatgaca

SEQ ID NO: 5571964 - DNA, 17 bp, Homo sapiens
atccttgcctccaacgt

SEQ ID NO: 5571965 - DNA, 16 bp, Homo sapiens
atccttggagagcagc

SEQ ID NO: 5571966 - DNA, 19 bp, Homo sapiens
atccttggagagcagctgg

SEQ ID NO: 5571967 - DNA, 16 bp, Homo sapiens
atccttggcaccaaag

SEQ ID NO: 5571968 - DNA, 12 bp, Homo sapiens
atccttggcagt

SEQ ID NO: 5571969 - DNA, 22 bp, Homo sapiens
atccttgggccataattatgaa

SEQ ID NO: 5571970 - DNA, 18 bp, Homo sapiens
atccttggtctttgtatc

SEQ ID NO: 5571971 - DNA, 14 bp, Homo sapiens
atccttggtgctgt

SEQ ID NO: 5571972 - DNA, 22 bp, Homo sapiens
atccttgtataaaaaaaatagt

SEQ ID NO: 5571973 - DNA, 15 bp, Homo sapiens
atccttgtcagttgt

SEQ ID NO: 5571974 - DNA, 20 bp, Homo sapiens
atccttgtgttcagctcttt

SEQ ID NO: 5571975 - DNA, 20 bp, Homo sapiens
atccttgttgaagttttttt

SEQ ID NO: 5571976 - DNA, 16 bp, Homo sapiens
atccttgtttcaaaca

SEQ ID NO: 5571977 - DNA, 17 bp, Homo sapiens
atcctttaaaatttaaa

SEQ ID NO: 5571978 - DNA, 18 bp, Homo sapiens
atcctttaactctgcgga

SEQ ID NO: 5571979 - DNA, 19 bp, Homo sapiens
atcctttattttattgaaa

SEQ ID NO: 5571980 - DNA, 22 bp, Homo sapiens
atcctttcaaaagaagagtttt

SEQ ID NO: 5571981 - DNA, 19 bp, Homo sapiens
atcctttcacttctttccc

SEQ ID NO: 5571982 - DNA, 22 bp, Homo sapiens
atcctttcacttctttcccttc

SEQ ID NO: 5571983 - DNA, 17 bp, Homo sapiens
atcctttcatatagtta

SEQ ID NO: 5571984 - DNA, 19 bp, Homo sapiens
atcctttcattaggcaaag

SEQ ID NO: 5571985 - DNA, 15 bp, Homo sapiens
atcctttccctctcc

SEQ ID NO: 5571986 - DNA, 19 bp, Homo sapiens
atcctttcctctagctttt

SEQ ID NO: 5571987 - DNA, 22 bp, Homo sapiens
atcctttcctctagcttttcta

SEQ ID NO: 5571988 - DNA, 14 bp, Homo sapiens
atcctttctgcccc

SEQ ID NO: 5571989 - DNA, 16 bp, Homo sapiens
atcctttctgccgacc

SEQ ID NO: 5571990 - DNA, 17 bp, Homo sapiens
atcctttgatcccagaa

SEQ ID NO: 5571991 - DNA, 19 bp, Homo sapiens
atctattgtttctcctctg

SEQ ID NO: 5571992 - DNA, 15 bp, Homo sapiens
atctatttaaaaaac

SEQ ID NO: 5571993 - DNA, 20 bp, Homo sapiens
atctatttaaaaaactgtat

SEQ ID NO: 5571994 - DNA, 12 bp, Homo sapiens
atctatttacat

SEQ ID NO: 5571995 - DNA, 15 bp, Homo sapiens
atctatttctgagaa

SEQ ID NO: 5571996 - DNA, 13 bp, Homo sapiens
atctatttgagag

SEQ ID NO: 5571997 - DNA, 16 bp, Homo sapiens
atctatttgagattga

SEQ ID NO: 5571998 - DNA, 12 bp, Homo sapiens
atctatttgagg

SEQ ID NO: 5571999 - DNA, 12 bp, Homo sapiens
atctatttgtac

SEQ ID NO: 5572000 - DNA, 13 bp, Homo sapiens
atctatttgtaca

SEQ ID NO: 5572001 - DNA, 14 bp, Homo sapiens
atctatttgtacaa

SEQ ID NO: 5572002 - DNA, 17 bp, Homo sapiens
atctatttgtacaattt

SEQ ID NO: 5572003 - DNA, 23 bp, Homo sapiens
atctatttgtagattaggattaa

SEQ ID NO: 5572004 - DNA, 12 bp, Homo sapiens
atctattttatt

SEQ ID NO: 5572005 - DNA, 20 bp, Homo sapiens
atctattttattttattgaa

SEQ ID NO: 5572006 - DNA, 21 bp, Homo sapiens
atctattttgagttaattttt

SEQ ID NO: 5572007 - DNA, 22 bp, Homo sapiens
atctattttgagttaatttttg

SEQ ID NO: 5572008 - DNA, 15 bp, Homo sapiens
atctatttttaaaat

SEQ ID NO: 5572009 - DNA, 23 bp, Homo sapiens
atctatttttttttctttttaaa

SEQ ID NO: 5572010 - DNA, 18 bp, Homo sapiens
atctcaaaaaaaaacaaa

SEQ ID NO: 5572011 - DNA, 15 bp, Homo sapiens
atctcaaaacaaaac

SEQ ID NO: 5572012 - DNA, 23 bp, Homo sapiens
atctcaaaagatctcctgtgcac

SEQ ID NO: 5572013 - DNA, 12 bp, Homo sapiens
atctcaaaatta

SEQ ID NO: 5572014 - DNA, 14 bp, Homo sapiens
atctcaaagcacaa

SEQ ID NO: 5572015 - DNA, 16 bp, Homo sapiens
atctcaaaggagaaaa

SEQ ID NO: 5572016 - DNA, 17 bp, Homo sapiens
atctcaaaggagaaaaa

SEQ ID NO: 5572017 - DNA, 19 bp, Homo sapiens
atctcaaaggagaaaaaaa

SEQ ID NO: 5572018 - DNA, 21 bp, Homo sapiens
atctcaaatacagtagtataa

SEQ ID NO: 5572019 - DNA, 15 bp, Homo sapiens
atctcaaatccactg

SEQ ID NO: 5572020 - DNA, 13 bp, Homo sapiens
atctcaaatgttt

SEQ ID NO: 5572021 - DNA, 20 bp, Homo sapiens
atctcaaattttaagttaaa

SEQ ID NO: 5572022 - DNA, 19 bp, Homo sapiens
atctcaacaggcctcaggg

SEQ ID NO: 5572023 - DNA, 20 bp, Homo sapiens
atctcaacaggcctcagggc

SEQ ID NO: 5572024 - DNA, 21 bp, Homo sapiens
atctcaacatggaaaaatcct

SEQ ID NO: 5572025 - DNA, 14 bp, Homo sapiens
atctcaacctacct

SEQ ID NO: 5572026 - DNA, 14 bp, Homo sapiens
atctcaactctgtt

SEQ ID NO: 5572027 - DNA, 22 bp, Homo sapiens
atctcaactttggttcctgtga

SEQ ID NO: 5572028 - DNA, 20 bp, Homo sapiens
atctcaagataggaagaaaa

SEQ ID NO: 5572029 - DNA, 18 bp, Homo sapiens
atctcaagatattcaggt

SEQ ID NO: 5572030 - DNA, 23 bp, Homo sapiens
atctcaagatgggggcagggctg

SEQ ID NO: 5572031 - DNA, 18 bp, Homo sapiens
atctcaaggaatctttaa

SEQ ID NO: 5572032 - DNA, 21 bp, Homo sapiens
atctcaaggggcccagcctcc

SEQ ID NO: 5572033 - DNA, 11 bp, Homo sapiens
atctcaagtaa

SEQ ID NO: 5572034 - DNA, 13 bp, Homo sapiens
atctcaagtaaaa

SEQ ID NO: 5572035 - DNA, 15 bp, Homo sapiens
atctcaagtaaaaca

SEQ ID NO: 5572036 - DNA, 17 bp, Homo sapiens
atctcaagtaaaacaaa

SEQ ID NO: 5572037 - DNA, 21 bp, Homo sapiens
atctcaagtaaaacaaatgaa

SEQ ID NO: 5572038 - DNA, 12 bp, Homo sapiens
atctcaagtata

SEQ ID NO: 5572039 - DNA, 18 bp, Homo sapiens
atctcaagtatatgtcat

SEQ ID NO: 5572040 - DNA, 22 bp, Homo sapiens
atctcaataaagtgctttaaaa

SEQ ID NO: 5572041 - DNA, 17 bp, Homo sapiens
atctcaatacagcctga

SEQ ID NO: 5572042 - DNA, 17 bp, Homo sapiens
atctcaatctgcagcca

SEQ ID NO: 5572043 - DNA, 23 bp, Homo sapiens
atctcaatgaaccataaattcaa

SEQ ID NO: 5572044 - DNA, 14 bp, Homo sapiens
atctcaatggcatg

SEQ ID NO: 5572045 - DNA, 16 bp, Homo sapiens
atctcaattcttccct

SEQ ID NO: 5572046 - DNA, 23 bp, Homo sapiens
atctcaatttaagatacaaataa

SEQ ID NO: 5572047 - DNA, 22 bp, Homo sapiens
atctcacaaaacatattttaca

SEQ ID NO: 5572048 - DNA, 23 bp, Homo sapiens
atctcacaaaacatattttacat

SEQ ID NO: 5572049 - DNA, 23 bp, Homo sapiens
atctcacacatgagcatcaggcc

SEQ ID NO: 5572050 - DNA, 17 bp, Homo sapiens
atctcacaccttagcta

SEQ ID NO: 5572051 - DNA, 22 bp, Homo sapiens
atctcacactcatgcattgtcc

SEQ ID NO: 5572052 - DNA, 20 bp, Homo sapiens
atctcacagcacactcagca

SEQ ID NO: 5572053 - DNA, 16 bp, Homo sapiens
atctcacaggagttgg

SEQ ID NO: 5572054 - DNA, 13 bp, Homo sapiens
atctcacaggctg

SEQ ID NO: 5572055 - DNA, 15 bp, Homo sapiens
atctcaccaggcagc

SEQ ID NO: 5572056 - DNA, 22 bp, Homo sapiens
atctcaccaggcagcctctggg

SEQ ID NO: 5572057 - DNA, 17 bp, Homo sapiens
atctcacctccgaactg

SEQ ID NO: 5572058 - DNA, 16 bp, Homo sapiens
atctcacctcctgctg

SEQ ID NO: 5572059 - DNA, 19 bp, Homo sapiens
atctcacctctaggcctca

SEQ ID NO: 5572060 - DNA, 15 bp, Homo sapiens
atctcactgcccagt

SEQ ID NO: 5572061 - DNA, 17 bp, Homo sapiens
atctcacttaatacaga

SEQ ID NO: 5572062 - DNA, 16 bp, Homo sapiens
atctcacttagtcctt

SEQ ID NO: 5572063 - DNA, 15 bp, Homo sapiens
atctcacttcagttg

SEQ ID NO: 5572064 - DNA, 22 bp, Homo sapiens
atctcacttcagttgtggcctc

SEQ ID NO: 5572065 - DNA, 21 bp, Homo sapiens
atctcacttcatcaatcaaat

SEQ ID NO: 5572066 - DNA, 14 bp, Homo sapiens
atctcacttcttct

SEQ ID NO: 5572067 - DNA, 18 bp, Homo sapiens
atctcacttgtgccaaca

SEQ ID NO: 5572068 - DNA, 22 bp, Homo sapiens
atctcacttgtgccaacactca

SEQ ID NO: 5572069 - DNA, 20 bp, Homo sapiens
atctcactttaataataaaa

SEQ ID NO: 5572070 - DNA, 18 bp, Homo sapiens
atctcactttgtaaataa

SEQ ID NO: 5572071 - DNA, 19 bp, Homo sapiens
atctcactttgtaaataaa

SEQ ID NO: 5572072 - DNA, 16 bp, Homo sapiens
atctcagaaagtgcct

SEQ ID NO: 5572073 - DNA, 18 bp, Homo sapiens
atctcagaaagtgcctga

SEQ ID NO: 5572074 - DNA, 19 bp, Homo sapiens
atctcagaaagtgcctgac

SEQ ID NO: 5572075 - DNA, 15 bp, Homo sapiens
atctcagaagatggg

SEQ ID NO: 5572076 - DNA, 20 bp, Homo sapiens
atctcagaattccttttcta

SEQ ID NO: 5572077 - DNA, 12 bp, Homo sapiens
atctcagagaca

SEQ ID NO: 5572078 - DNA, 22 bp, Homo sapiens
atctcagagacaggtggcctag

SEQ ID NO: 5572079 - DNA, 15 bp, Homo sapiens
atctcagagtccact

SEQ ID NO: 5572080 - DNA, 14 bp, Homo sapiens
atctcagatactta

SEQ ID NO: 5572081 - DNA, 18 bp, Homo sapiens
atctcagatacttatgaa

SEQ ID NO: 5572082 - DNA, 19 bp, Homo sapiens
atctcagatacttatgaaa

SEQ ID NO: 5572083 - DNA, 19 bp, Homo sapiens
atctcagatgttaaaataa

SEQ ID NO: 5572084 - DNA, 19 bp, Homo sapiens
atctcagcaaagctacagg

SEQ ID NO: 5572085 - DNA, 10 bp, Homo sapiens
atctcagcac

SEQ ID NO: 5572086 - DNA, 20 bp, Homo sapiens
atctcagcatcctggaaatt

SEQ ID NO: 5572087 - DNA, 22 bp, Homo sapiens
atctcagccatccgcagactgc

SEQ ID NO: 5572088 - DNA, 12 bp, Homo sapiens
atctcagccatt

SEQ ID NO: 5572089 - DNA, 18 bp, Homo sapiens
atctcagcctcctgagcc

SEQ ID NO: 5572090 - DNA, 21 bp, Homo sapiens
atctcagcctcctgagcctgt

SEQ ID NO: 5572091 - DNA, 24 bp, Homo sapiens
atctcagcctcctgagcctgtggg

SEQ ID NO: 5572092 - DNA, 12 bp, Homo sapiens
atctcagctcat

SEQ ID NO: 5572093 - DNA, 13 bp, Homo sapiens
atctcagctttga

SEQ ID NO: 5572094 - DNA, 22 bp, Homo sapiens
atctcagctttgagaagccttc

SEQ ID NO: 5572095 - DNA, 18 bp, Homo sapiens
atctcagcttttctgtcc

SEQ ID NO: 5572096 - DNA, 19 bp, Homo sapiens
atctcaggacacttccgta

SEQ ID NO: 5572097 - DNA, 16 bp, Homo sapiens
atctcaggagcttgca

SEQ ID NO: 5572098 - DNA, 18 bp, Homo sapiens
atctcagggaactgaccc

SEQ ID NO: 5572099 - DNA, 20 bp, Homo sapiens
atctcagggaactgaccctc

SEQ ID NO: 5572100 - DNA, 17 bp, Homo sapiens
atctcagggaagcccag

SEQ ID NO: 5572101 - DNA, 19 bp, Homo sapiens
atctcagggaagcccagct

SEQ ID NO: 5572102 - DNA, 22 bp, Homo sapiens
atctcagggaagcccagctcca

SEQ ID NO: 5572103 - DNA, 23 bp, Homo sapiens
atctcagggaagcccagctccag

SEQ ID NO: 5572104 - DNA, 15 bp, Homo sapiens
atctcaggggccaga

SEQ ID NO: 5572105 - DNA, 17 bp, Homo sapiens
atctcaggggccagagg

SEQ ID NO: 5572106 - DNA, 14 bp, Homo sapiens
atctcaggtctgaa

SEQ ID NO: 5572107 - DNA, 24 bp, Homo sapiens
atctcaggtgccactccctgagct

SEQ ID NO: 5572108 - DNA, 16 bp, Homo sapiens
atctcaggtggcattt

SEQ ID NO: 5572109 - DNA, 18 bp, Homo sapiens
atctcaggtggcatttgc

SEQ ID NO: 5572110 - DNA, 19 bp, Homo sapiens
atctcaggtggcatttgca

SEQ ID NO: 5572111 - DNA, 16 bp, Homo sapiens
atctcaggttggcggc

SEQ ID NO: 5572112 - DNA, 16 bp, Homo sapiens
atctcagtaataaaaa

SEQ ID NO: 5572113 - DNA, 18 bp, Homo sapiens
atctcagtatgaattatt

SEQ ID NO: 5572114 - DNA, 16 bp, Homo sapiens
atctcagtcacttttt

SEQ ID NO: 5572115 - DNA, 22 bp, Homo sapiens
atctcagtcatgcataaatatg

SEQ ID NO: 5572116 - DNA, 14 bp, Homo sapiens
atctcagtgaagaa

SEQ ID NO: 5572117 - DNA, 17 bp, Homo sapiens
atctcagtgaagaatac

SEQ ID NO: 5572118 - DNA, 20 bp, Homo sapiens
atctcagtgaagaatacttc

SEQ ID NO: 5572119 - DNA, 17 bp, Homo sapiens
atctcagtgctgtaaaa

SEQ ID NO: 5572120 - DNA, 23 bp, Homo sapiens
atctcagtggttaagattcctaa

SEQ ID NO: 5572121 - DNA, 19 bp, Homo sapiens
atctcagttgattttctgg

SEQ ID NO: 5572122 - DNA, 17 bp, Homo sapiens
atctcagttgtttgctt

SEQ ID NO: 5572123 - DNA, 17 bp, Homo sapiens
atctcataatttataca

SEQ ID NO: 5572124 - DNA, 18 bp, Homo sapiens
atctcataatttatacag

SEQ ID NO: 5572125 - DNA, 15 bp, Homo sapiens
atctcatacctctga

SEQ ID NO: 5572126 - DNA, 16 bp, Homo sapiens
atctcatactgtctgg

SEQ ID NO: 5572127 - DNA, 16 bp, Homo sapiens
atctcatcaacaaaga

SEQ ID NO: 5572128 - DNA, 17 bp, Homo sapiens
atctcatcccaataaaa

SEQ ID NO: 5572129 - DNA, 19 bp, Homo sapiens
atctcatccccaaactgta

SEQ ID NO: 5572130 - DNA, 13 bp, Homo sapiens
atctcatctgtct

SEQ ID NO: 5572131 - DNA, 19 bp, Homo sapiens
atctcatgacattatattt

SEQ ID NO: 5572132 - DNA, 21 bp, Homo sapiens
atctcatgatacaggcgggag

SEQ ID NO: 5572133 - DNA, 16 bp, Homo sapiens
atctcatgattccatg

SEQ ID NO: 5572134 - DNA, 20 bp, Homo sapiens
atctcatgccagtgccttat

SEQ ID NO: 5572135 - DNA, 23 bp, Homo sapiens
atctcatgcccctggctgggacg

SEQ ID NO: 5572136 - DNA, 14 bp, Homo sapiens
atctcattactgct

SEQ ID NO: 5572137 - DNA, 21 bp, Homo sapiens
atctcattactgcttcatttt

SEQ ID NO: 5572138 - DNA, 23 bp, Homo sapiens
atctcattactgcttcatttttg

SEQ ID NO: 5572139 - DNA, 11 bp, Homo sapiens
atctcattatt

SEQ ID NO: 5572140 - DNA, 13 bp, Homo sapiens
atctcattatttc

SEQ ID NO: 5572141 - DNA, 17 bp, Homo sapiens
atctcattatttcaaaa

SEQ ID NO: 5572142 - DNA, 21 bp, Homo sapiens
atctcattatttcaaaatgat

SEQ ID NO: 5572143 - DNA, 16 bp, Homo sapiens
atctcattatttctgg

SEQ ID NO: 5572144 - DNA, 16 bp, Homo sapiens
atctcattcagtatta

SEQ ID NO: 5572145 - DNA, 16 bp, Homo sapiens
atctcattgcttacaa

SEQ ID NO: 5572146 - DNA, 15 bp, Homo sapiens
atctcattggaccct

SEQ ID NO: 5572147 - DNA, 20 bp, Homo sapiens
atctcatttaagggaaaaat

SEQ ID NO: 5572148 - DNA, 15 bp, Homo sapiens
atctcatttctcaac

SEQ ID NO: 5572149 - DNA, 23 bp, Homo sapiens
atctcatttttccgtaaaaatga

SEQ ID NO: 5572150 - DNA, 17 bp, Homo sapiens
atctccaaaactagcat

SEQ ID NO: 5572151 - DNA, 17 bp, Homo sapiens
atctccaaactaaaccc

SEQ ID NO: 5572152 - DNA, 17 bp, Homo sapiens
atctccaagaatgctga

SEQ ID NO: 5572153 - DNA, 18 bp, Homo sapiens
atctccaagacctggtgt

SEQ ID NO: 5572154 - DNA, 19 bp, Homo sapiens
atctccaagataagcctga

SEQ ID NO: 5572155 - DNA, 17 bp, Homo sapiens
atctccaagcagcttag

SEQ ID NO: 5572156 - DNA, 16 bp, Homo sapiens
atctccaatggaaagc

SEQ ID NO: 5572157 - DNA, 23 bp, Homo sapiens
atctccaatggaaagcttttcag

SEQ ID NO: 5572158 - DNA, 13 bp, Homo sapiens
atctccacctgct

SEQ ID NO: 5572159 - DNA, 23 bp, Homo sapiens
atctccactggacccttgattca

SEQ ID NO: 5572160 - DNA, 12 bp, Homo sapiens
atctccactttt

SEQ ID NO: 5572161 - DNA, 21 bp, Homo sapiens
atctccagccaatttcaaaga

SEQ ID NO: 5572162 - DNA, 20 bp, Homo sapiens
atctccaggattgaagagca

SEQ ID NO: 5572163 - DNA, 13 bp, Homo sapiens
atctccaggccca

SEQ ID NO: 5572164 - DNA, 20 bp, Homo sapiens
atctccaggcccagcctggc

SEQ ID NO: 5572165 - DNA, 23 bp, Homo sapiens
atctccaggcccagcctggcccc

SEQ ID NO: 5572166 - DNA, 17 bp, Homo sapiens
atctccagggctgcccc

SEQ ID NO: 5572167 - DNA, 18 bp, Homo sapiens
atctccagtattcttgtc

SEQ ID NO: 5572168 - DNA, 23 bp, Homo sapiens
atctgctctagattcataaatac

SEQ ID NO: 5572169 - DNA, 15 bp, Homo sapiens
atctgctctccttcc

SEQ ID NO: 5572170 - DNA, 12 bp, Homo sapiens
atctgctctgag

SEQ ID NO: 5572171 - DNA, 20 bp, Homo sapiens
atctgctgacagatgttcca

SEQ ID NO: 5572172 - DNA, 21 bp, Homo sapiens
atctgctgacagatgttccat

SEQ ID NO: 5572173 - DNA, 15 bp, Homo sapiens
atctgctgagctctg

SEQ ID NO: 5572174 - DNA, 13 bp, Homo sapiens
atctgctgcacct

SEQ ID NO: 5572175 - DNA, 17 bp, Homo sapiens
atctgctgcagagcagt

SEQ ID NO: 5572176 - DNA, 21 bp, Homo sapiens
atctgctgcatagctctattt

SEQ ID NO: 5572177 - DNA, 18 bp, Homo sapiens
atctgctgcctctgaaaa

SEQ ID NO: 5572178 - DNA, 21 bp, Homo sapiens
atctgctgcctctgaaaatat

SEQ ID NO: 5572179 - DNA, 20 bp, Homo sapiens
atctgctgctgaaactgtgt

SEQ ID NO: 5572180 - DNA, 15 bp, Homo sapiens
atctgctgggctggc

SEQ ID NO: 5572181 - DNA, 13 bp, Homo sapiens
atctgctgtaata

SEQ ID NO: 5572182 - DNA, 14 bp, Homo sapiens
atctgctgtaataa

SEQ ID NO: 5572183 - DNA, 15 bp, Homo sapiens
atctgctgtatatgg

SEQ ID NO: 5572184 - DNA, 11 bp, Homo sapiens
atctgctgtcc

SEQ ID NO: 5572185 - DNA, 16 bp, Homo sapiens
atctgctgtccagaca

SEQ ID NO: 5572186 - DNA, 21 bp, Homo sapiens
atctgctgtccagacagcctg

SEQ ID NO: 5572187 - DNA, 22 bp, Homo sapiens
atctgctgtccagacagcctgt

SEQ ID NO: 5572188 - DNA, 22 bp, Homo sapiens
atctgctgtcctgtttctgtca

SEQ ID NO: 5572189 - DNA, 22 bp, Homo sapiens
atctgctgtcttttctttgcca

SEQ ID NO: 5572190 - DNA, 15 bp, Homo sapiens
atctgctgtgactgt

SEQ ID NO: 5572191 - DNA, 20 bp, Homo sapiens
atctgctgttgccatagccc

SEQ ID NO: 5572192 - DNA, 12 bp, Homo sapiens
atctgcttcagt

SEQ ID NO: 5572193 - DNA, 21 bp, Homo sapiens
atctgcttcatccaatgtgaa

SEQ ID NO: 5572194 - DNA, 18 bp, Homo sapiens
atctgcttccctggggcc

SEQ ID NO: 5572195 - DNA, 15 bp, Homo sapiens
atctgcttctagctt

SEQ ID NO: 5572196 - DNA, 18 bp, Homo sapiens
atctgcttgtattttcca

SEQ ID NO: 5572197 - DNA, 19 bp, Homo sapiens
atctgctttattgcctctg

SEQ ID NO: 5572198 - DNA, 13 bp, Homo sapiens
atctgctttctgt

SEQ ID NO: 5572199 - DNA, 15 bp, Homo sapiens
atctgctttctgttc

SEQ ID NO: 5572200 - DNA, 21 bp, Homo sapiens
atctgctttgttaatgaaaat

SEQ ID NO: 5572201 - DNA, 22 bp, Homo sapiens
atctgctttttaaagaatgctc

SEQ ID NO: 5572202 - DNA, 20 bp, Homo sapiens
atctggaaaaaaaaaaatat

SEQ ID NO: 5572203 - DNA, 22 bp, Homo sapiens
atctggaaaaacttgctcccag

SEQ ID NO: 5572204 - DNA, 21 bp, Homo sapiens
atctggaaacctctacatatt

SEQ ID NO: 5572205 - DNA, 14 bp, Homo sapiens
atctggaacccaga

SEQ ID NO: 5572206 - DNA, 16 bp, Homo sapiens
atctggaacccagact

SEQ ID NO: 5572207 - DNA, 17 bp, Homo sapiens
atctggaacccagactc

SEQ ID NO: 5572208 - DNA, 19 bp, Homo sapiens
atctggaacccagactcag

SEQ ID NO: 5572209 - DNA, 23 bp, Homo sapiens
atctggaacccagactcagacat

SEQ ID NO: 5572210 - DNA, 19 bp, Homo sapiens
atctggaacctcagcctgg

SEQ ID NO: 5572211 - DNA, 13 bp, Homo sapiens
atctggaagagct

SEQ ID NO: 5572212 - DNA, 21 bp, Homo sapiens
atctggaagagctaggcaggg

SEQ ID NO: 5572213 - DNA, 16 bp, Homo sapiens
atctggaaggcccctc

SEQ ID NO: 5572214 - DNA, 21 bp, Homo sapiens
atctggaagggccaaggtctg

SEQ ID NO: 5572215 - DNA, 10 bp, Homo sapiens
atctggaagt

SEQ ID NO: 5572216 - DNA, 21 bp, Homo sapiens
atctggaattggtttagccca

SEQ ID NO: 5572217 - DNA, 13 bp, Homo sapiens
atctggacacttc

SEQ ID NO: 5572218 - DNA, 19 bp, Homo sapiens
atctggaccccatctgtga

SEQ ID NO: 5572219 - DNA, 21 bp, Homo sapiens
atctggaccccatctgtgaat

SEQ ID NO: 5572220 - DNA, 17 bp, Homo sapiens
atctggacccttggcct

SEQ ID NO: 5572221 - DNA, 20 bp, Homo sapiens
atctggagaactatacctgc

SEQ ID NO: 5572222 - DNA, 21 bp, Homo sapiens
atctggagaccagggagcctt

SEQ ID NO: 5572223 - DNA, 16 bp, Homo sapiens
atctggagagaacagg

SEQ ID NO: 5572224 - DNA, 19 bp, Homo sapiens
atctggagagcccagagtc

SEQ ID NO: 5572225 - DNA, 15 bp, Homo sapiens
atctggagcctgatg

SEQ ID NO: 5572226 - DNA, 17 bp, Homo sapiens
atctggaggccttccag

SEQ ID NO: 5572227 - DNA, 18 bp, Homo sapiens
atctggaggctcccatgg

SEQ ID NO: 5572228 - DNA, 22 bp, Homo sapiens
atctggagtctgaaggagagga

SEQ ID NO: 5572229 - DNA, 23 bp, Homo sapiens
atctggagtctgaaggagaggag

SEQ ID NO: 5572230 - DNA, 18 bp, Homo sapiens
atctggagtctttgataa

SEQ ID NO: 5572231 - DNA, 18 bp, Homo sapiens
atctggagttctcaaaga

SEQ ID NO: 5572232 - DNA, 23 bp, Homo sapiens
atctggagttggagccgcacatc

SEQ ID NO: 5572233 - DNA, 20 bp, Homo sapiens
atctggataggagcctgctg

SEQ ID NO: 5572234 - DNA, 24 bp, Homo sapiens
atctggatatcaaggtggaaatgg

SEQ ID NO: 5572235 - DNA, 12 bp, Homo sapiens
atctggatgtaa

SEQ ID NO: 5572236 - DNA, 13 bp, Homo sapiens
atctggatgtaaa

SEQ ID NO: 5572237 - DNA, 23 bp, Homo sapiens
atctggcacgtggccaggagcca

SEQ ID NO: 5572238 - DNA, 14 bp, Homo sapiens
atctggcactgtta

SEQ ID NO: 5572239 - DNA, 22 bp, Homo sapiens
atctggcagagcctcagctgta

SEQ ID NO: 5572240 - DNA, 21 bp, Homo sapiens
atctggcattctacacctgga

SEQ ID NO: 5572241 - DNA, 14 bp, Homo sapiens
atctggccattgca

SEQ ID NO: 5572242 - DNA, 18 bp, Homo sapiens
atctggcccaagctgggc

SEQ ID NO: 5572243 - DNA, 14 bp, Homo sapiens
atctggcccaggct

SEQ ID NO: 5572244 - DNA, 19 bp, Homo sapiens
atctggcccaggctggccc

SEQ ID NO: 5572245 - DNA, 14 bp, Homo sapiens
atctggcccagggt

SEQ ID NO: 5572246 - DNA, 15 bp, Homo sapiens
atctggcccagggtg

SEQ ID NO: 5572247 - DNA, 16 bp, Homo sapiens
atctggcccagggtgt

SEQ ID NO: 5572248 - DNA, 21 bp, Homo sapiens
atctggccccaggtagaaact

SEQ ID NO: 5572249 - DNA, 14 bp, Homo sapiens
atctggccctgctg

SEQ ID NO: 5572250 - DNA, 19 bp, Homo sapiens
atctggccctgctgccccc

SEQ ID NO: 5572251 - DNA, 18 bp, Homo sapiens
atctggcctatgaccctg

SEQ ID NO: 5572252 - DNA, 19 bp, Homo sapiens
atctggcctatgaccctgt

SEQ ID NO: 5572253 - DNA, 22 bp, Homo sapiens
atctggcctatgaccctgtgcc

SEQ ID NO: 5572254 - DNA, 23 bp, Homo sapiens
atctggcctatgaccctgtgcct

SEQ ID NO: 5572255 - DNA, 17 bp, Homo sapiens
atctggcctggcctggc

SEQ ID NO: 5572256 - DNA, 18 bp, Homo sapiens
atctggcctggcctggcc

SEQ ID NO: 5572257 - DNA, 16 bp, Homo sapiens
atctggcctgggggct

SEQ ID NO: 5572258 - DNA, 11 bp, Homo sapiens
atctggcctta

SEQ ID NO: 5572259 - DNA, 16 bp, Homo sapiens
atctggcggaggtctc

SEQ ID NO: 5572260 - DNA, 19 bp, Homo sapiens
atctggcggaggtctctgg

SEQ ID NO: 5572261 - DNA, 22 bp, Homo sapiens
atctggcggaggtctctgggag

SEQ ID NO: 5572262 - DNA, 23 bp, Homo sapiens
atctggcggaggtctctgggagc

SEQ ID NO: 5572263 - DNA, 14 bp, Homo sapiens
atctggcgttcttt

SEQ ID NO: 5572264 - DNA, 14 bp, Homo sapiens
atctggctcctcct

SEQ ID NO: 5572265 - DNA, 13 bp, Homo sapiens
atctggctcctgt

SEQ ID NO: 5572266 - DNA, 15 bp, Homo sapiens
atctggctgcacagg

SEQ ID NO: 5572267 - DNA, 16 bp, Homo sapiens
atctggctgcacaggc

SEQ ID NO: 5572268 - DNA, 21 bp, Homo sapiens
atctggctgcagttttgctat

SEQ ID NO: 5572269 - DNA, 11 bp, Homo sapiens
atctggctggt

SEQ ID NO: 5572270 - DNA, 22 bp, Homo sapiens
atctggctggtaaatgacatct

SEQ ID NO: 5572271 - DNA, 20 bp, Homo sapiens
atctggctgtctagaatgtg

SEQ ID NO: 5572272 - DNA, 16 bp, Homo sapiens
atctggcttacagggg

SEQ ID NO: 5572273 - DNA, 18 bp, Homo sapiens
atctggcttattttaatg

SEQ ID NO: 5572274 - DNA, 21 bp, Homo sapiens
atctggcttattttaatgtga

SEQ ID NO: 5572275 - DNA, 11 bp, Homo sapiens
atctggcttcc

SEQ ID NO: 5572276 - DNA, 16 bp, Homo sapiens
atctggcttccctgga

SEQ ID NO: 5572277 - DNA, 17 bp, Homo sapiens
atctggcttccctggaa

SEQ ID NO: 5572278 - DNA, 14 bp, Homo sapiens
atctggcttctgca

SEQ ID NO: 5572279 - DNA, 20 bp, Homo sapiens
atctggcttctggccaggaa

SEQ ID NO: 5572280 - DNA, 14 bp, Homo sapiens
atctgggaaagaca

SEQ ID NO: 5572281 - DNA, 20 bp, Homo sapiens
atctgggaaatgaggttttt

SEQ ID NO: 5572282 - DNA, 19 bp, Homo sapiens
atctgggaactcccaagaa

SEQ ID NO: 5572283 - DNA, 15 bp, Homo sapiens
atctgggaagctatt

SEQ ID NO: 5572284 - DNA, 20 bp, Homo sapiens
atctgggaccctttccttcc

SEQ ID NO: 5572285 - DNA, 23 bp, Homo sapiens
atctgggaccctttccttccttc

SEQ ID NO: 5572286 - DNA, 16 bp, Homo sapiens
atctgggactgtgcct

SEQ ID NO: 5572287 - DNA, 18 bp, Homo sapiens
atctgggactgtgcctgg

SEQ ID NO: 5572288 - DNA, 21 bp, Homo sapiens
atctgggaggcagaacaggct

SEQ ID NO: 5572289 - DNA, 22 bp, Homo sapiens
atctgggaggctggtctccctc

SEQ ID NO: 5572290 - DNA, 20 bp, Homo sapiens
atctgggaggtctccactga

SEQ ID NO: 5572291 - DNA, 15 bp, Homo sapiens
atctgggatcatgat

SEQ ID NO: 5572292 - DNA, 17 bp, Homo sapiens
atctgggattattcttt

SEQ ID NO: 5572293 - DNA, 10 bp, Homo sapiens
atctgggcaa

SEQ ID NO: 5572294 - DNA, 19 bp, Homo sapiens
atctgggcacaatcattgg

SEQ ID NO: 5572295 - DNA, 22 bp, Homo sapiens
atctgggcattaagtcagtggc

SEQ ID NO: 5572296 - DNA, 14 bp, Homo sapiens
atctgggccagaag

SEQ ID NO: 5572297 - DNA, 16 bp, Homo sapiens
atctgggcctgggcta

SEQ ID NO: 5572298 - DNA, 15 bp, Homo sapiens
atctgggccttggcc

SEQ ID NO: 5572299 - DNA, 17 bp, Homo sapiens
atctgggctgtgggcaa

SEQ ID NO: 5572300 - DNA, 18 bp, Homo sapiens
atctggggagcaggcagc

SEQ ID NO: 5572301 - DNA, 12 bp, Homo sapiens
atctggggaggc

SEQ ID NO: 5572302 - DNA, 22 bp, Homo sapiens
atctggggaggcaggcattcct

SEQ ID NO: 5572303 - DNA, 23 bp, Homo sapiens
atctggggcagcaccctataaat

SEQ ID NO: 5572304 - DNA, 15 bp, Homo sapiens
atctgggggagtgga

SEQ ID NO: 5572305 - DNA, 17 bp, Homo sapiens
atctgggggagtggaat

SEQ ID NO: 5572306 - DNA, 20 bp, Homo sapiens
atctggggttggcaacagga

SEQ ID NO: 5572307 - DNA, 16 bp, Homo sapiens
atctgggtaagaagaa

SEQ ID NO: 5572308 - DNA, 17 bp, Homo sapiens
atctgggtaagaagaaa

SEQ ID NO: 5572309 - DNA, 17 bp, Homo sapiens
atctgggtagctgtaag

SEQ ID NO: 5572310 - DNA, 18 bp, Homo sapiens
atctgggtagctgtaagg

SEQ ID NO: 5572311 - DNA, 15 bp, Homo sapiens
atctgggtatctttc

SEQ ID NO: 5572312 - DNA, 22 bp, Homo sapiens
atctgggtctcccaggacacat

SEQ ID NO: 5572313 - DNA, 13 bp, Homo sapiens
atctgggtgccct

SEQ ID NO: 5572314 - DNA, 14 bp, Homo sapiens
atctgggtgccctg

SEQ ID NO: 5572315 - DNA, 15 bp, Homo sapiens
atctgggtgccctga

SEQ ID NO: 5572316 - DNA, 23 bp, Homo sapiens
atctgggtgggataatggactca

SEQ ID NO: 5572317 - DNA, 16 bp, Homo sapiens
atctgggttttagaaa

SEQ ID NO: 5572318 - DNA, 21 bp, Homo sapiens
atctgggttttagaaattcta

SEQ ID NO: 5572319 - DNA, 19 bp, Homo sapiens
atctggtagaagggaaagc

SEQ ID NO: 5572320 - DNA, 15 bp, Homo sapiens
atctggtatatgtca

SEQ ID NO: 5572321 - DNA, 16 bp, Homo sapiens
atctggtatatgtcat

SEQ ID NO: 5572322 - DNA, 18 bp, Homo sapiens
atctggtatatgtcatta

SEQ ID NO: 5572323 - DNA, 16 bp, Homo sapiens
atctggtattaaatgc

SEQ ID NO: 5572324 - DNA, 17 bp, Homo sapiens
atctggtccatatttac

SEQ ID NO: 5572325 - DNA, 18 bp, Homo sapiens
atctggtcctacccatcc

SEQ ID NO: 5572326 - DNA, 16 bp, Homo sapiens
atctggtctaatttat

SEQ ID NO: 5572327 - DNA, 23 bp, Homo sapiens
atctggtctcgtgttcgctggct

SEQ ID NO: 5572328 - DNA, 14 bp, Homo sapiens
atctggtgacaaat

SEQ ID NO: 5572329 - DNA, 20 bp, Homo sapiens
atctggtgacaaatattctc

SEQ ID NO: 5572330 - DNA, 16 bp, Homo sapiens
atctggtgactttcct

SEQ ID NO: 5572331 - DNA, 17 bp, Homo sapiens
atctggtgactttcctc

SEQ ID NO: 5572332 - DNA, 15 bp, Homo sapiens
atctggtgcctttcc

SEQ ID NO: 5572333 - DNA, 18 bp, Homo sapiens
atctggtgcgtgtggccc

SEQ ID NO: 5572334 - DNA, 22 bp, Homo sapiens
atctggtgcgtgtggccctgtg

SEQ ID NO: 5572335 - DNA, 17 bp, Homo sapiens
atctggtgtaggaagtt

SEQ ID NO: 5572336 - DNA, 15 bp, Homo sapiens
atctggtgttgggga

SEQ ID NO: 5572337 - DNA, 23 bp, Homo sapiens
atctggtgtttcagcatacataa

SEQ ID NO: 5572338 - DNA, 17 bp, Homo sapiens
atctggttataattttg

SEQ ID NO: 5572339 - DNA, 21 bp, Homo sapiens
atctggttcattcttcagata

SEQ ID NO: 5572340 - DNA, 15 bp, Homo sapiens
atctggttttattac

SEQ ID NO: 5572341 - DNA, 16 bp, Homo sapiens
atctggtttttaaaag

SEQ ID NO: 5572342 - DNA, 18 bp, Homo sapiens
atctggtttttaaaagat

SEQ ID NO: 5572343 - DNA, 21 bp, Homo sapiens
atctgtaaaaattgttataat

SEQ ID NO: 5572344 - DNA, 17 bp, Homo sapiens
atctgtaaaaccaggct

SEQ ID NO: 5572345 - DNA, 21 bp, Homo sapiens
atcttggcctaaacctcagtt

SEQ ID NO: 5572346 - DNA, 16 bp, Homo sapiens
atcttggccttactgt

SEQ ID NO: 5572347 - DNA, 15 bp, Homo sapiens
atcttggctcactgc

SEQ ID NO: 5572348 - DNA, 17 bp, Homo sapiens
atcttggctcagtttgt

SEQ ID NO: 5572349 - DNA, 15 bp, Homo sapiens
atcttggcttcttaa

SEQ ID NO: 5572350 - DNA, 22 bp, Homo sapiens
atcttgggaacagggttactgt

SEQ ID NO: 5572351 - DNA, 23 bp, Homo sapiens
atcttggggacatctctttgaat

SEQ ID NO: 5572352 - DNA, 21 bp, Homo sapiens
atcttggggcaagactgcaaa

SEQ ID NO: 5572353 - DNA, 22 bp, Homo sapiens
atcttggggcaagactgcaaac

SEQ ID NO: 5572354 - DNA, 23 bp, Homo sapiens
atcttgggggacagggctggccc

SEQ ID NO: 5572355 - DNA, 23 bp, Homo sapiens
atcttgggggggtggccgctgag

SEQ ID NO: 5572356 - DNA, 15 bp, Homo sapiens
atcttgggtgtattc

SEQ ID NO: 5572357 - DNA, 20 bp, Homo sapiens
atcttgggtgtattctctgt

SEQ ID NO: 5572358 - DNA, 14 bp, Homo sapiens
atcttgggtttcta

SEQ ID NO: 5572359 - DNA, 18 bp, Homo sapiens
atcttggtagtacatttt

SEQ ID NO: 5572360 - DNA, 18 bp, Homo sapiens
atcttggtagttctgtgc

SEQ ID NO: 5572361 - DNA, 23 bp, Homo sapiens
atcttggtagttctgtgcctccc

SEQ ID NO: 5572362 - DNA, 15 bp, Homo sapiens
atcttggtatgggct

SEQ ID NO: 5572363 - DNA, 21 bp, Homo sapiens
atcttggtatgggctgttctg

SEQ ID NO: 5572364 - DNA, 19 bp, Homo sapiens
atcttggtccaggaaatgt

SEQ ID NO: 5572365 - DNA, 19 bp, Homo sapiens
atcttggtcctgtcaccct

SEQ ID NO: 5572366 - DNA, 15 bp, Homo sapiens
atcttggtgtaactt

SEQ ID NO: 5572367 - DNA, 19 bp, Homo sapiens
atcttggtgtgttaagagt

SEQ ID NO: 5572368 - DNA, 17 bp, Homo sapiens
atcttggtttgccttcc

SEQ ID NO: 5572369 - DNA, 15 bp, Homo sapiens
atcttggtttggtac

SEQ ID NO: 5572370 - DNA, 19 bp, Homo sapiens
atcttggtttggtacagtt

SEQ ID NO: 5572371 - DNA, 22 bp, Homo sapiens
atcttggtttgtcagtttatct

SEQ ID NO: 5572372 - DNA, 22 bp, Homo sapiens
atcttgtaaataatgcttaaca

SEQ ID NO: 5572373 - DNA, 14 bp, Homo sapiens
atcttgtaaatatt

SEQ ID NO: 5572374 - DNA, 19 bp, Homo sapiens
atcttgtagctttatcaaa

SEQ ID NO: 5572375 - DNA, 18 bp, Homo sapiens
atcttgtaggatctactt

SEQ ID NO: 5572376 - DNA, 15 bp, Homo sapiens
atcttgtaggtcatt

SEQ ID NO: 5572377 - DNA, 16 bp, Homo sapiens
atcttgtcatgtgtat

SEQ ID NO: 5572378 - DNA, 23 bp, Homo sapiens
atcttgtccctaagtaagtttct

SEQ ID NO: 5572379 - DNA, 13 bp, Homo sapiens
atcttgtctcaat

SEQ ID NO: 5572380 - DNA, 16 bp, Homo sapiens
atcttgtctcaatgct

SEQ ID NO: 5572381 - DNA, 23 bp, Homo sapiens
atcttgtctcaatgctcataacg

SEQ ID NO: 5572382 - DNA, 15 bp, Homo sapiens
atcttgtctctgggc

SEQ ID NO: 5572383 - DNA, 10 bp, Homo sapiens
atcttgtctt

SEQ ID NO: 5572384 - DNA, 15 bp, Homo sapiens
atcttgtcttttccc

SEQ ID NO: 5572385 - DNA, 18 bp, Homo sapiens
atcttgtcttttcccctc

SEQ ID NO: 5572386 - DNA, 19 bp, Homo sapiens
atcttgtgaaaataattga

SEQ ID NO: 5572387 - DNA, 21 bp, Homo sapiens
atcttgtgagtggataatcag

SEQ ID NO: 5572388 - DNA, 15 bp, Homo sapiens
atcttgtgcatgcaa

SEQ ID NO: 5572389 - DNA, 20 bp, Homo sapiens
atcttgtgctagaatacttt

SEQ ID NO: 5572390 - DNA, 13 bp, Homo sapiens
atcttgtgcttct

SEQ ID NO: 5572391 - DNA, 15 bp, Homo sapiens
atcttgtggggccag

SEQ ID NO: 5572392 - DNA, 16 bp, Homo sapiens
atcttgtggggccagg

SEQ ID NO: 5572393 - DNA, 15 bp, Homo sapiens
atcttgtgtatggat

SEQ ID NO: 5572394 - DNA, 22 bp, Homo sapiens
atcttgtgtgattaacttattt

SEQ ID NO: 5572395 - DNA, 17 bp, Homo sapiens
atcttgtgttgtccttt

SEQ ID NO: 5572396 - DNA, 22 bp, Homo sapiens
atcttgtgttgtccttttgtct

SEQ ID NO: 5572397 - DNA, 16 bp, Homo sapiens
atcttgttaatgtcat

SEQ ID NO: 5572398 - DNA, 22 bp, Homo sapiens
atcttgttaatgtcattgctaa

SEQ ID NO: 5572399 - DNA, 16 bp, Homo sapiens
atcttgttaatttcat

SEQ ID NO: 5572400 - DNA, 14 bp, Homo sapiens
atcttgttactgct

SEQ ID NO: 5572401 - DNA, 20 bp, Homo sapiens
atcttgttattaatgtttct

SEQ ID NO: 5572402 - DNA, 14 bp, Homo sapiens
atcttgttattatt

SEQ ID NO: 5572403 - DNA, 14 bp, Homo sapiens
atcttgttcttccc

SEQ ID NO: 5572404 - DNA, 15 bp, Homo sapiens
atcttgttcttcccc

SEQ ID NO: 5572405 - DNA, 15 bp, Homo sapiens
atcttgtttacaata

SEQ ID NO: 5572406 - DNA, 22 bp, Homo sapiens
atcttgtttacaataaagaatt

SEQ ID NO: 5572407 - DNA, 23 bp, Homo sapiens
atcttgtttacaataaagaattc

SEQ ID NO: 5572408 - DNA, 15 bp, Homo sapiens
atcttgtttctgaaa

SEQ ID NO: 5572409 - DNA, 16 bp, Homo sapiens
atcttgtttctgaaaa

SEQ ID NO: 5572410 - DNA, 14 bp, Homo sapiens
atcttgtttgttac

SEQ ID NO: 5572411 - DNA, 18 bp, Homo sapiens
atcttgtttgttactgtc

SEQ ID NO: 5572412 - DNA, 21 bp, Homo sapiens
atcttgtttgttactgtcatt

SEQ ID NO: 5572413 - DNA, 21 bp, Homo sapiens
atcttgttttaagcaaatgca

SEQ ID NO: 5572414 - DNA, 17 bp, Homo sapiens
atcttgttttgaaaata

SEQ ID NO: 5572415 - DNA, 20 bp, Homo sapiens
atctttaaaaaaaaatcttg

SEQ ID NO: 5572416 - DNA, 22 bp, Homo sapiens
atctttaaaaaaaaatcttgtg

SEQ ID NO: 5572417 - DNA, 21 bp, Homo sapiens
atctttaaagccgtgctcttt

SEQ ID NO: 5572418 - DNA, 16 bp, Homo sapiens
atctttaaataaatgt

SEQ ID NO: 5572419 - DNA, 17 bp, Homo sapiens
atctttaaataaatgtg

SEQ ID NO: 5572420 - DNA, 12 bp, Homo sapiens
atctttaaatac

SEQ ID NO: 5572421 - DNA, 14 bp, Homo sapiens
atctttaaatataa

SEQ ID NO: 5572422 - DNA, 15 bp, Homo sapiens
atctttaacaattgt

SEQ ID NO: 5572423 - DNA, 17 bp, Homo sapiens
atctttaacaattgtct

SEQ ID NO: 5572424 - DNA, 19 bp, Homo sapiens
atctttaacaattgtctta

SEQ ID NO: 5572425 - DNA, 20 bp, Homo sapiens
atctttaacaattgtcttaa

SEQ ID NO: 5572426 - DNA, 12 bp, Homo sapiens
atctttaacata

SEQ ID NO: 5572427 - DNA, 19 bp, Homo sapiens
atctttaacatagtcctgt

SEQ ID NO: 5572428 - DNA, 17 bp, Homo sapiens
atctttaagaatgctta

SEQ ID NO: 5572429 - DNA, 19 bp, Homo sapiens
atctttaatcaatgtgaca

SEQ ID NO: 5572430 - DNA, 11 bp, Homo sapiens
atctttaatta

SEQ ID NO: 5572431 - DNA, 13 bp, Homo sapiens
atctttaattaaa

SEQ ID NO: 5572432 - DNA, 22 bp, Homo sapiens
atctttaattccttatcctagc

SEQ ID NO: 5572433 - DNA, 14 bp, Homo sapiens
atctttaatttata

SEQ ID NO: 5572434 - DNA, 22 bp, Homo sapiens
atctttacataattcagagtgg

SEQ ID NO: 5572435 - DNA, 15 bp, Homo sapiens
atctttaccaaaaac

SEQ ID NO: 5572436 - DNA, 22 bp, Homo sapiens
atctttacgtactgtaactgct

SEQ ID NO: 5572437 - DNA, 12 bp, Homo sapiens
atctttagcagt

SEQ ID NO: 5572438 - DNA, 23 bp, Homo sapiens
atctttagcagtttcctcagtga

SEQ ID NO: 5572439 - DNA, 15 bp, Homo sapiens
atctttagttgaatt

SEQ ID NO: 5572440 - DNA, 23 bp, Homo sapiens
atctttatacagattttctagaa

SEQ ID NO: 5572441 - DNA, 22 bp, Homo sapiens
atctttatactgggtttcaaga

SEQ ID NO: 5572442 - DNA, 22 bp, Homo sapiens
atctttatagaaggaatttgta

SEQ ID NO: 5572443 - DNA, 18 bp, Homo sapiens
atctttatcatcggagtt

SEQ ID NO: 5572444 - DNA, 23 bp, Homo sapiens
atctttattaaatattcagaaaa

SEQ ID NO: 5572445 - DNA, 20 bp, Homo sapiens
atctttattaacctcagcat

SEQ ID NO: 5572446 - DNA, 16 bp, Homo sapiens
atctttattgaaattc

SEQ ID NO: 5572447 - DNA, 18 bp, Homo sapiens
atctttattgagaaagag

SEQ ID NO: 5572448 - DNA, 22 bp, Homo sapiens
atctttattttagtcttgatgt

SEQ ID NO: 5572449 - DNA, 19 bp, Homo sapiens
atctttattttattattca

SEQ ID NO: 5572450 - DNA, 18 bp, Homo sapiens
atctttcaaaccagcttc

SEQ ID NO: 5572451 - DNA, 15 bp, Homo sapiens
atctttcaaccacct

SEQ ID NO: 5572452 - DNA, 17 bp, Homo sapiens
atctttcacacttccac

SEQ ID NO: 5572453 - DNA, 22 bp, Homo sapiens
atctttcacacttccaccagcc

SEQ ID NO: 5572454 - DNA, 13 bp, Homo sapiens
atctttcaccaag

SEQ ID NO: 5572455 - DNA, 18 bp, Homo sapiens
atctttcacccacagaaa

SEQ ID NO: 5572456 - DNA, 19 bp, Homo sapiens
atctttcacccacagaaag

SEQ ID NO: 5572457 - DNA, 21 bp, Homo sapiens
atctttcacttgaaagatttt

SEQ ID NO: 5572458 - DNA, 12 bp, Homo sapiens
atctttcagaaa

SEQ ID NO: 5572459 - DNA, 23 bp, Homo sapiens
atctttcagaaataaaagtatga

SEQ ID NO: 5572460 - DNA, 16 bp, Homo sapiens
atctttcagaaatata

SEQ ID NO: 5572461 - DNA, 14 bp, Homo sapiens
atctttcagcctgc

SEQ ID NO: 5572462 - DNA, 14 bp, Homo sapiens
atctttcagttatt

SEQ ID NO: 5572463 - DNA, 18 bp, Homo sapiens
atctttcatagttctgtt

SEQ ID NO: 5572464 - DNA, 19 bp, Homo sapiens
atctttcatagttctgtta

SEQ ID NO: 5572465 - DNA, 14 bp, Homo sapiens
atctttcatgtctt

SEQ ID NO: 5572466 - DNA, 15 bp, Homo sapiens
atctttcatgtcttg

SEQ ID NO: 5572467 - DNA, 19 bp, Homo sapiens
atctttcattaaaggcttc

SEQ ID NO: 5572468 - DNA, 16 bp, Homo sapiens
atctttccatctcatt

SEQ ID NO: 5572469 - DNA, 20 bp, Homo sapiens
atctttccatctcattacag

SEQ ID NO: 5572470 - DNA, 15 bp, Homo sapiens
atctttcccaggccg

SEQ ID NO: 5572471 - DNA, 16 bp, Homo sapiens
atctttccctccttgg

SEQ ID NO: 5572472 - DNA, 13 bp, Homo sapiens
atctttcctcaag

SEQ ID NO: 5572473 - DNA, 20 bp, Homo sapiens
atctttcctcaagtatcttc

SEQ ID NO: 5572474 - DNA, 22 bp, Homo sapiens
atctttcctcaagtatcttcta

SEQ ID NO: 5572475 - DNA, 23 bp, Homo sapiens
atctttcctcaagtatcttctat

SEQ ID NO: 5572476 - DNA, 21 bp, Homo sapiens
atctttcctccaaactcctgc

SEQ ID NO: 5572477 - DNA, 11 bp, Homo sapiens
atctttcctgt

SEQ ID NO: 5572478 - DNA, 13 bp, Homo sapiens
atctttccttcct

SEQ ID NO: 5572479 - DNA, 19 bp, Homo sapiens
atctttccttgtctctcat

SEQ ID NO: 5572480 - DNA, 17 bp, Homo sapiens
atctttcgataaacaac

SEQ ID NO: 5572481 - DNA, 23 bp, Homo sapiens
atctttcgcacagcagttccgga

SEQ ID NO: 5572482 - DNA, 17 bp, Homo sapiens
atctttcggtctcctta

SEQ ID NO: 5572483 - DNA, 20 bp, Homo sapiens
atctttcgttggttgtttct

SEQ ID NO: 5572484 - DNA, 22 bp, Homo sapiens
atctttctatataaaatgtatt

SEQ ID NO: 5572485 - DNA, 16 bp, Homo sapiens
atctttctattccaaa

SEQ ID NO: 5572486 - DNA, 13 bp, Homo sapiens
atctttctcacac

SEQ ID NO: 5572487 - DNA, 11 bp, Homo sapiens
atctttctcat

SEQ ID NO: 5572488 - DNA, 14 bp, Homo sapiens
atctttctcctggt

SEQ ID NO: 5572489 - DNA, 18 bp, Homo sapiens
atctttctcttacctgtt

SEQ ID NO: 5572490 - DNA, 13 bp, Homo sapiens
atctttctcttcc

SEQ ID NO: 5572491 - DNA, 14 bp, Homo sapiens
atctttctgggagc

SEQ ID NO: 5572492 - DNA, 14 bp, Homo sapiens
atctttctgttact

SEQ ID NO: 5572493 - DNA, 22 bp, Homo sapiens
atctttcttctattttattccc

SEQ ID NO: 5572494 - DNA, 14 bp, Homo sapiens
atctttctttccat

SEQ ID NO: 5572495 - DNA, 12 bp, Homo sapiens
atctttctttct

SEQ ID NO: 5572496 - DNA, 18 bp, Homo sapiens
atctttctttctctaatg

SEQ ID NO: 5572497 - DNA, 15 bp, Homo sapiens
atctttctttcttag

SEQ ID NO: 5572498 - DNA, 20 bp, Homo sapiens
atctttctttggatgggact

SEQ ID NO: 5572499 - DNA, 21 bp, Homo sapiens
atctttcttttgattcttcct

SEQ ID NO: 5572500 - DNA, 22 bp, Homo sapiens
atctttctttttaagaaattcc

SEQ ID NO: 5572501 - DNA, 14 bp, Homo sapiens
atctttgaaaagaa

SEQ ID NO: 5572502 - DNA, 16 bp, Homo sapiens
atctttgaaagctgaa

SEQ ID NO: 5572503 - DNA, 22 bp, Homo sapiens
atctttgaaaggttagagaata

SEQ ID NO: 5572504 - DNA, 16 bp, Homo sapiens
atctttgaaattatgt

SEQ ID NO: 5572505 - DNA, 19 bp, Homo sapiens
atctttgaaattatgtaaa

SEQ ID NO: 5572506 - DNA, 15 bp, Homo sapiens
atctttgaatatgta

SEQ ID NO: 5572507 - DNA, 22 bp, Homo sapiens
atctttgaatttcttgattttt

SEQ ID NO: 5572508 - DNA, 16 bp, Homo sapiens
atctttgaccaaccga

SEQ ID NO: 5572509 - DNA, 13 bp, Homo sapiens
atctttgactgaa

SEQ ID NO: 5572510 - DNA, 17 bp, Homo sapiens
atctttgactgaaaaaa

SEQ ID NO: 5572511 - DNA, 22 bp, Homo sapiens
atctttgagataatttaaccct

SEQ ID NO: 5572512 - DNA, 11 bp, Homo sapiens
atctttgagcc

SEQ ID NO: 5572513 - DNA, 18 bp, Homo sapiens
atctttgagtgtattcta

SEQ ID NO: 5572514 - DNA, 20 bp, Homo sapiens
atctttgatcgtatatttct

SEQ ID NO: 5572515 - DNA, 15 bp, Homo sapiens
atctttgatgtgttg

SEQ ID NO: 5572516 - DNA, 17 bp, Homo sapiens
atctttgatgtgttgtt

SEQ ID NO: 5572517 - DNA, 21 bp, Homo sapiens
atctttgatgtgttgttcttg

SEQ ID NO: 5572518 - DNA, 14 bp, Homo sapiens
atctttgattctcc

SEQ ID NO: 5572519 - DNA, 20 bp, Homo sapiens
atctttgattctccttcagc

SEQ ID NO: 5572520 - DNA, 15 bp, Homo sapiens
atctttgatttagag

SEQ ID NO: 5572521 - DNA, 23 bp, Homo sapiens
atctttgcacaatcaataaaaat

SEQ ID NO: 5572522 - DNA, 13 bp, Homo sapiens
atgaagtttaaat

SEQ ID NO: 5572523 - DNA, 17 bp, Homo sapiens
atgaagtttatacagta

SEQ ID NO: 5572524 - DNA, 18 bp, Homo sapiens
atgaagtttatattatca

SEQ ID NO: 5572525 - DNA, 19 bp, Homo sapiens
atgaagtttgaacttcata

SEQ ID NO: 5572526 - DNA, 22 bp, Homo sapiens
atgaagtttgtagttgttttaa

SEQ ID NO: 5572527 - DNA, 13 bp, Homo sapiens
atgaagtttttaa

SEQ ID NO: 5572528 - DNA, 17 bp, Homo sapiens
atgaagtttttaaaaat

SEQ ID NO: 5572529 - DNA, 19 bp, Homo sapiens
atgaagttttttttataca

SEQ ID NO: 5572530 - DNA, 23 bp, Homo sapiens
atgaagttttttttatacaggat

SEQ ID NO: 5572531 - DNA, 15 bp, Homo sapiens
atgaataaaaataaa

SEQ ID NO: 5572532 - DNA, 21 bp, Homo sapiens
atgaataaaaataaagttttt

SEQ ID NO: 5572533 - DNA, 13 bp, Homo sapiens
atgaataaaatgt

SEQ ID NO: 5572534 - DNA, 14 bp, Homo sapiens
atgaataaaatgtt

SEQ ID NO: 5572535 - DNA, 14 bp, Homo sapiens
atgaataaactgaa

SEQ ID NO: 5572536 - DNA, 15 bp, Homo sapiens
atgaataaactgaat

SEQ ID NO: 5572537 - DNA, 17 bp, Homo sapiens
atgaataaactgaatat

SEQ ID NO: 5572538 - DNA, 15 bp, Homo sapiens
atgaataaagaatgc

SEQ ID NO: 5572539 - DNA, 17 bp, Homo sapiens
atgaataaagcctttgt

SEQ ID NO: 5572540 - DNA, 14 bp, Homo sapiens
atgaataacattta

SEQ ID NO: 5572541 - DNA, 16 bp, Homo sapiens
atgaataacatttaaa

SEQ ID NO: 5572542 - DNA, 17 bp, Homo sapiens
atgaataacatttaaat

SEQ ID NO: 5572543 - DNA, 18 bp, Homo sapiens
atgaataacatttaaatt

SEQ ID NO: 5572544 - DNA, 21 bp, Homo sapiens
atgaataagctttctctcaga

SEQ ID NO: 5572545 - DNA, 13 bp, Homo sapiens
atgaataagtttt

SEQ ID NO: 5572546 - DNA, 19 bp, Homo sapiens
atgaataatgcctttgtaa

SEQ ID NO: 5572547 - DNA, 23 bp, Homo sapiens
atgaataattatgtttacctcac

SEQ ID NO: 5572548 - DNA, 23 bp, Homo sapiens
atgaataattgaggttaggaacc

SEQ ID NO: 5572549 - DNA, 14 bp, Homo sapiens
atgaataattgcat

SEQ ID NO: 5572550 - DNA, 16 bp, Homo sapiens
atgaatacagcagcaa

SEQ ID NO: 5572551 - DNA, 21 bp, Homo sapiens
atgaatacatttccaaaatgg

SEQ ID NO: 5572552 - DNA, 13 bp, Homo sapiens
atgaatagaagaa

SEQ ID NO: 5572553 - DNA, 14 bp, Homo sapiens
atgaatagaagaaa

SEQ ID NO: 5572554 - DNA, 18 bp, Homo sapiens
atgaatagaagaaagaaa

SEQ ID NO: 5572555 - DNA, 19 bp, Homo sapiens
atgaatagaagaaagaaaa

SEQ ID NO: 5572556 - DNA, 18 bp, Homo sapiens
atgaatagacataaattg

SEQ ID NO: 5572557 - DNA, 21 bp, Homo sapiens
atgaatagatggaatttggaa

SEQ ID NO: 5572558 - DNA, 12 bp, Homo sapiens
atgaatataaaa

SEQ ID NO: 5572559 - DNA, 13 bp, Homo sapiens
atgaatatatggc

SEQ ID NO: 5572560 - DNA, 20 bp, Homo sapiens
atgaatatatggcatttgca

SEQ ID NO: 5572561 - DNA, 23 bp, Homo sapiens
atgaatatatttaagcaacatct

SEQ ID NO: 5572562 - DNA, 15 bp, Homo sapiens
atgaatatcaagaat

SEQ ID NO: 5572563 - DNA, 22 bp, Homo sapiens
atgaatatcattgattttataa

SEQ ID NO: 5572564 - DNA, 22 bp, Homo sapiens
atgaatatctattaatatatgt

SEQ ID NO: 5572565 - DNA, 12 bp, Homo sapiens
atgaatatctgg

SEQ ID NO: 5572566 - DNA, 20 bp, Homo sapiens
atgaatattacatgtaaagc

SEQ ID NO: 5572567 - DNA, 13 bp, Homo sapiens
atgaatattgatg

SEQ ID NO: 5572568 - DNA, 16 bp, Homo sapiens
atgaatatttagtgtt

SEQ ID NO: 5572569 - DNA, 15 bp, Homo sapiens
atgaatatttataac

SEQ ID NO: 5572570 - DNA, 13 bp, Homo sapiens
atgaatatttctt

SEQ ID NO: 5572571 - DNA, 21 bp, Homo sapiens
atgaatattttatattaaaat

SEQ ID NO: 5572572 - DNA, 19 bp, Homo sapiens
atgaatattttgataataa

SEQ ID NO: 5572573 - DNA, 17 bp, Homo sapiens
atgaatcaatgaaaaat

SEQ ID NO: 5572574 - DNA, 21 bp, Homo sapiens
atgaatcactgtttttagaca

SEQ ID NO: 5572575 - DNA, 19 bp, Homo sapiens
atgaatcagtatgaagaca

SEQ ID NO: 5572576 - DNA, 20 bp, Homo sapiens
atgaatcattgttaaccaca

SEQ ID NO: 5572577 - DNA, 14 bp, Homo sapiens
atgaatccaaatgt

SEQ ID NO: 5572578 - DNA, 21 bp, Homo sapiens
atgaatccaaatgtgaaagat

SEQ ID NO: 5572579 - DNA, 24 bp, Homo sapiens
atgaatccatcgatttgtattaat

SEQ ID NO: 5572580 - DNA, 17 bp, Homo sapiens
atgaatccattggagaa

SEQ ID NO: 5572581 - DNA, 18 bp, Homo sapiens
atgaatcccacccacatg

SEQ ID NO: 5572582 - DNA, 21 bp, Homo sapiens
atgaatcccacccacatgtga

SEQ ID NO: 5572583 - DNA, 16 bp, Homo sapiens
atgaatcgcaagttaa

SEQ ID NO: 5572584 - DNA, 17 bp, Homo sapiens
atgaatcgcttctcttt

SEQ ID NO: 5572585 - DNA, 20 bp, Homo sapiens
atgaatcgcttctcttttga

SEQ ID NO: 5572586 - DNA, 17 bp, Homo sapiens
atgaatcgttcaactcc

SEQ ID NO: 5572587 - DNA, 16 bp, Homo sapiens
atgaatctacatttgt

SEQ ID NO: 5572588 - DNA, 21 bp, Homo sapiens
atgaatctacatttgtttgta

SEQ ID NO: 5572589 - DNA, 11 bp, Homo sapiens
atgaatctatg

SEQ ID NO: 5572590 - DNA, 18 bp, Homo sapiens
atgaatctattatactgt

SEQ ID NO: 5572591 - DNA, 23 bp, Homo sapiens
atgaatctattatactgtattaa

SEQ ID NO: 5572592 - DNA, 20 bp, Homo sapiens
atgaatctcccactccagcg

SEQ ID NO: 5572593 - DNA, 15 bp, Homo sapiens
atgaatctgattttt

SEQ ID NO: 5572594 - DNA, 22 bp, Homo sapiens
atgaatctgatttttatgatga

SEQ ID NO: 5572595 - DNA, 20 bp, Homo sapiens
atgaatctggtgttggggaa

SEQ ID NO: 5572596 - DNA, 23 bp, Homo sapiens
atgaatctgtctcccagttatga

SEQ ID NO: 5572597 - DNA, 14 bp, Homo sapiens
atgaatctgtgctg

SEQ ID NO: 5572598 - DNA, 13 bp, Homo sapiens
atgaatctttcat

SEQ ID NO: 5572599 - DNA, 16 bp, Homo sapiens
atgaatctttgactga

SEQ ID NO: 5572600 - DNA, 14 bp, Homo sapiens
atgaatgaaatata

SEQ ID NO: 5572601 - DNA, 14 bp, Homo sapiens
atgaatgacaacat

SEQ ID NO: 5572602 - DNA, 16 bp, Homo sapiens
atgaatgagaatctac

SEQ ID NO: 5572603 - DNA, 19 bp, Homo sapiens
atgaatgagaatgtgccat

SEQ ID NO: 5572604 - DNA, 18 bp, Homo sapiens
atgaatgagcattctgca

SEQ ID NO: 5572605 - DNA, 22 bp, Homo sapiens
atgaatgaggaacaatcacaaa

SEQ ID NO: 5572606 - DNA, 19 bp, Homo sapiens
atgaatgaggtcccaggca

SEQ ID NO: 5572607 - DNA, 20 bp, Homo sapiens
atgaatgaggtcccaggcag

SEQ ID NO: 5572608 - DNA, 22 bp, Homo sapiens
atgaatgatcattgaaagtaaa

SEQ ID NO: 5572609 - DNA, 15 bp, Homo sapiens
atgaatgatgtttta

SEQ ID NO: 5572610 - DNA, 18 bp, Homo sapiens
atgaatgattaaattatg

SEQ ID NO: 5572611 - DNA, 15 bp, Homo sapiens
atgaatgatttgcat

SEQ ID NO: 5572612 - DNA, 16 bp, Homo sapiens
atgaatgcaaaattgt

SEQ ID NO: 5572613 - DNA, 15 bp, Homo sapiens
atgaatgcacactag

SEQ ID NO: 5572614 - DNA, 12 bp, Homo sapiens
atgaatgcagat

SEQ ID NO: 5572615 - DNA, 16 bp, Homo sapiens
atgaatgcagtataaa

SEQ ID NO: 5572616 - DNA, 20 bp, Homo sapiens
atgaatgcagtataaaatgt

SEQ ID NO: 5572617 - DNA, 21 bp, Homo sapiens
atgaatgcccagtgagactgt

SEQ ID NO: 5572618 - DNA, 21 bp, Homo sapiens
atgaatgcccccagctggccc

SEQ ID NO: 5572619 - DNA, 13 bp, Homo sapiens
atgaatgctgacc

SEQ ID NO: 5572620 - DNA, 15 bp, Homo sapiens
atgaatgcttaaaga

SEQ ID NO: 5572621 - DNA, 23 bp, Homo sapiens
atgaatggctcactatggtgcca

SEQ ID NO: 5572622 - DNA, 17 bp, Homo sapiens
atgaatgggaaagtatt

SEQ ID NO: 5572623 - DNA, 16 bp, Homo sapiens
atgaatgggcatttct

SEQ ID NO: 5572624 - DNA, 17 bp, Homo sapiens
atgaatgggcatttcta

SEQ ID NO: 5572625 - DNA, 21 bp, Homo sapiens
atgaatgggctgagctgcctg

SEQ ID NO: 5572626 - DNA, 16 bp, Homo sapiens
atgaatgtaatctaat

SEQ ID NO: 5572627 - DNA, 16 bp, Homo sapiens
atgaatgtatgtgcac

SEQ ID NO: 5572628 - DNA, 20 bp, Homo sapiens
atgaatgtatttatttggga

SEQ ID NO: 5572629 - DNA, 12 bp, Homo sapiens
atgaatgtcaca

SEQ ID NO: 5572630 - DNA, 18 bp, Homo sapiens
atgaatgtcacatttgaa

SEQ ID NO: 5572631 - DNA, 14 bp, Homo sapiens
atgaatgtgcattt

SEQ ID NO: 5572632 - DNA, 14 bp, Homo sapiens
atgaatgtgctggt

SEQ ID NO: 5572633 - DNA, 23 bp, Homo sapiens
atgaatgttcctgcctccttgat

SEQ ID NO: 5572634 - DNA, 11 bp, Homo sapiens
atgaatgttta

SEQ ID NO: 5572635 - DNA, 16 bp, Homo sapiens
atgaattaaataaacc

SEQ ID NO: 5572636 - DNA, 20 bp, Homo sapiens
atgaattaaatattgaaaca

SEQ ID NO: 5572637 - DNA, 18 bp, Homo sapiens
atgaattacatttgtata

SEQ ID NO: 5572638 - DNA, 15 bp, Homo sapiens
atgaattataaatgt

SEQ ID NO: 5572639 - DNA, 16 bp, Homo sapiens
atgaattataacagtt

SEQ ID NO: 5572640 - DNA, 15 bp, Homo sapiens
atgaattatataatt

SEQ ID NO: 5572641 - DNA, 15 bp, Homo sapiens
atgaattatttttga

SEQ ID NO: 5572642 - DNA, 22 bp, Homo sapiens
atgaattcaacctcagccctga

SEQ ID NO: 5572643 - DNA, 17 bp, Homo sapiens
atgaattcaagaaagga

SEQ ID NO: 5572644 - DNA, 20 bp, Homo sapiens
atgaattcacaaacaaatgg

SEQ ID NO: 5572645 - DNA, 22 bp, Homo sapiens
atgaattcacaaacaaatggct

SEQ ID NO: 5572646 - DNA, 16 bp, Homo sapiens
atgaattcctagaatt

SEQ ID NO: 5572647 - DNA, 14 bp, Homo sapiens
atgaattcttcaac

SEQ ID NO: 5572648 - DNA, 20 bp, Homo sapiens
atgaattcttgagtttacat

SEQ ID NO: 5572649 - DNA, 19 bp, Homo sapiens
atgaattctttgtttatgc

SEQ ID NO: 5572650 - DNA, 22 bp, Homo sapiens
atgaattgaaaaacaattttct

SEQ ID NO: 5572651 - DNA, 13 bp, Homo sapiens
atgaattgaaatt

SEQ ID NO: 5572652 - DNA, 12 bp, Homo sapiens
atgaattgatga

SEQ ID NO: 5572653 - DNA, 16 bp, Homo sapiens
atgaattgatgactat

SEQ ID NO: 5572654 - DNA, 13 bp, Homo sapiens
atgaattgccttt

SEQ ID NO: 5572655 - DNA, 12 bp, Homo sapiens
atgaattggaac

SEQ ID NO: 5572656 - DNA, 23 bp, Homo sapiens
atgaattgggggaggacacattt

SEQ ID NO: 5572657 - DNA, 12 bp, Homo sapiens
atgaattgtaaa

SEQ ID NO: 5572658 - DNA, 13 bp, Homo sapiens
atgaattgtacag

SEQ ID NO: 5572659 - DNA, 22 bp, Homo sapiens
atgaattgtacagaatatttct

SEQ ID NO: 5572660 - DNA, 13 bp, Homo sapiens
atgaattgtattt

SEQ ID NO: 5572661 - DNA, 13 bp, Homo sapiens
atgaatttaaata

SEQ ID NO: 5572662 - DNA, 23 bp, Homo sapiens
atgaatttaaatataattctgta

SEQ ID NO: 5572663 - DNA, 23 bp, Homo sapiens
atgaatttagaaatattcaaaat

SEQ ID NO: 5572664 - DNA, 12 bp, Homo sapiens
atgaatttagtg

SEQ ID NO: 5572665 - DNA, 15 bp, Homo sapiens
atgaatttatcttta

SEQ ID NO: 5572666 - DNA, 14 bp, Homo sapiens
atgaatttgactgg

SEQ ID NO: 5572667 - DNA, 18 bp, Homo sapiens
atgaatttgggatactaa

SEQ ID NO: 5572668 - DNA, 19 bp, Homo sapiens
atgaatttgtaatgtcttg

SEQ ID NO: 5572669 - DNA, 15 bp, Homo sapiens
atgaatttgtccatt

SEQ ID NO: 5572670 - DNA, 20 bp, Homo sapiens
atgaatttgtcgcaaagacg

SEQ ID NO: 5572671 - DNA, 20 bp, Homo sapiens
atgaattttaaaagcatata

SEQ ID NO: 5572672 - DNA, 17 bp, Homo sapiens
atgaattttaaagtatg

SEQ ID NO: 5572673 - DNA, 22 bp, Homo sapiens
atgaattttaaagtatgcatta

SEQ ID NO: 5572674 - DNA, 15 bp, Homo sapiens
atgaattttaaataa

SEQ ID NO: 5572675 - DNA, 15 bp, Homo sapiens
atgaattttaagggt

SEQ ID NO: 5572676 - DNA, 15 bp, Homo sapiens
atgaattttatgtga

SEQ ID NO: 5572677 - DNA, 13 bp, Homo sapiens
atgaattttccac

SEQ ID NO: 5572678 - DNA, 19 bp, Homo sapiens
atgaattttctgcagctgt

SEQ ID NO: 5572679 - DNA, 20 bp, Homo sapiens
atgaattttctgcagctgtt

SEQ ID NO: 5572680 - DNA, 19 bp, Homo sapiens
atgaattttgtaagtataa

SEQ ID NO: 5572681 - DNA, 19 bp, Homo sapiens
atgaattttgtatgctgaa

SEQ ID NO: 5572682 - DNA, 20 bp, Homo sapiens
atgaatttttttatttctgt

SEQ ID NO: 5572683 - DNA, 22 bp, Homo sapiens
atgaatttttttcatcttctct

SEQ ID NO: 5572684 - DNA, 17 bp, Homo sapiens
atgacaaaaaatgtttt

SEQ ID NO: 5572685 - DNA, 15 bp, Homo sapiens
atgacaaaaattatt

SEQ ID NO: 5572686 - DNA, 19 bp, Homo sapiens
atgacaaaaattcaactca

SEQ ID NO: 5572687 - DNA, 22 bp, Homo sapiens
atgacaaaatagcccagccttt

SEQ ID NO: 5572688 - DNA, 22 bp, Homo sapiens
atgacaaacccaggagtttgtg

SEQ ID NO: 5572689 - DNA, 18 bp, Homo sapiens
atgacaaatgtattaatg

SEQ ID NO: 5572690 - DNA, 16 bp, Homo sapiens
atgacaacaaattttg

SEQ ID NO: 5572691 - DNA, 14 bp, Homo sapiens
atgacaacacttaa

SEQ ID NO: 5572692 - DNA, 14 bp, Homo sapiens
atgacaacagaaaa

SEQ ID NO: 5572693 - DNA, 16 bp, Homo sapiens
atgacaacagaaaaac

SEQ ID NO: 5572694 - DNA, 17 bp, Homo sapiens
atgacaacagaaaaaca

SEQ ID NO: 5572695 - DNA, 21 bp, Homo sapiens
atgacaacagaaaaacaatct

SEQ ID NO: 5572696 - DNA, 14 bp, Homo sapiens
atgacaacagaagc

SEQ ID NO: 5572697 - DNA, 19 bp, Homo sapiens
atgacaacagaagcttcag

SEQ ID NO: 5572698 - DNA, 21 bp, Homo sapiens
atgacaacattgcattgtgac

SEQ ID NO: 5572699 - DNA, 23 bp, Homo sapiens
atgacaacctgtgtgagagaatt

SEQ ID NO: 5572700 - DNA, 19 bp, Homo sapiens
atgagagacacactgaaga

SEQ ID NO: 5572701 - DNA, 20 bp, Homo sapiens
atgagagcataatttaaaaa

SEQ ID NO: 5572702 - DNA, 18 bp, Homo sapiens
atgagagcccagaggtaa

SEQ ID NO: 5572703 - DNA, 12 bp, Homo sapiens
atgagaggaaat

SEQ ID NO: 5572704 - DNA, 13 bp, Homo sapiens
atgagaggaaatc

SEQ ID NO: 5572705 - DNA, 14 bp, Homo sapiens
atgagaggaaatca

SEQ ID NO: 5572706 - DNA, 15 bp, Homo sapiens
atgagaggaaatcac

SEQ ID NO: 5572707 - DNA, 17 bp, Homo sapiens
atgagagtagggccctg

SEQ ID NO: 5572708 - DNA, 18 bp, Homo sapiens
atgagagtagggccctga

SEQ ID NO: 5572709 - DNA, 15 bp, Homo sapiens
atgagagttccttct

SEQ ID NO: 5572710 - DNA, 17 bp, Homo sapiens
atgagagttccttctca

SEQ ID NO: 5572711 - DNA, 13 bp, Homo sapiens
atgagagtttctg

SEQ ID NO: 5572712 - DNA, 20 bp, Homo sapiens
atgagagttttggatgcagt

SEQ ID NO: 5572713 - DNA, 21 bp, Homo sapiens
atgagagttttggatgcagtg

SEQ ID NO: 5572714 - DNA, 22 bp, Homo sapiens
atgagatacatttgatcttgta

SEQ ID NO: 5572715 - DNA, 20 bp, Homo sapiens
atgagatcactgaacttttc

SEQ ID NO: 5572716 - DNA, 23 bp, Homo sapiens
atgagatcactgaacttttcaaa

SEQ ID NO: 5572717 - DNA, 22 bp, Homo sapiens
atgagatctaagcctttccata

SEQ ID NO: 5572718 - DNA, 16 bp, Homo sapiens
atgagatctttctaaa

SEQ ID NO: 5572719 - DNA, 12 bp, Homo sapiens
atgagatgctgg

SEQ ID NO: 5572720 - DNA, 14 bp, Homo sapiens
atgagatgctggct

SEQ ID NO: 5572721 - DNA, 15 bp, Homo sapiens
atgagatgctggctt

SEQ ID NO: 5572722 - DNA, 19 bp, Homo sapiens
atgagatgctggcttgggc

SEQ ID NO: 5572723 - DNA, 22 bp, Homo sapiens
atgagatgctggcttgggcagc

SEQ ID NO: 5572724 - DNA, 21 bp, Homo sapiens
atgagatgggttgagtttgct

SEQ ID NO: 5572725 - DNA, 13 bp, Homo sapiens
atgagatgtaata

SEQ ID NO: 5572726 - DNA, 18 bp, Homo sapiens
atgagatgtaatacacca

SEQ ID NO: 5572727 - DNA, 12 bp, Homo sapiens
atgagatgtgtg

SEQ ID NO: 5572728 - DNA, 15 bp, Homo sapiens
atgagattcagtgaa

SEQ ID NO: 5572729 - DNA, 19 bp, Homo sapiens
atgagattcagtgaactaa

SEQ ID NO: 5572730 - DNA, 16 bp, Homo sapiens
atgagattccctctcc

SEQ ID NO: 5572731 - DNA, 19 bp, Homo sapiens
atgagattggaaaaaatta

SEQ ID NO: 5572732 - DNA, 22 bp, Homo sapiens
atgagattggaaaaaattagac

SEQ ID NO: 5572733 - DNA, 16 bp, Homo sapiens
atgagattgtacattt

SEQ ID NO: 5572734 - DNA, 19 bp, Homo sapiens
atgagatttctttgaatgt

SEQ ID NO: 5572735 - DNA, 16 bp, Homo sapiens
atgagatttgccagca

SEQ ID NO: 5572736 - DNA, 16 bp, Homo sapiens
atgagatttttcatgt

SEQ ID NO: 5572737 - DNA, 17 bp, Homo sapiens
atgagatttttcatgta

SEQ ID NO: 5572738 - DNA, 17 bp, Homo sapiens
atgagcaaccacattta

SEQ ID NO: 5572739 - DNA, 23 bp, Homo sapiens
atgagcaaggaatacaagacaaa

SEQ ID NO: 5572740 - DNA, 17 bp, Homo sapiens
atgagcacatctctctg

SEQ ID NO: 5572741 - DNA, 21 bp, Homo sapiens
atgagcacatctctctgccct

SEQ ID NO: 5572742 - DNA, 13 bp, Homo sapiens
atgagcacctcca

SEQ ID NO: 5572743 - DNA, 14 bp, Homo sapiens
atgagcacctccat

SEQ ID NO: 5572744 - DNA, 16 bp, Homo sapiens
atgagcactcctgatt

SEQ ID NO: 5572745 - DNA, 13 bp, Homo sapiens
atgagcacttcta

SEQ ID NO: 5572746 - DNA, 18 bp, Homo sapiens
atgagcagcccctcccag

SEQ ID NO: 5572747 - DNA, 20 bp, Homo sapiens
atgagcagcccttacagtat

SEQ ID NO: 5572748 - DNA, 15 bp, Homo sapiens
atgagcaggagcttg

SEQ ID NO: 5572749 - DNA, 16 bp, Homo sapiens
atgagcaggagcttgg

SEQ ID NO: 5572750 - DNA, 18 bp, Homo sapiens
atgagcaggagcttgggt

SEQ ID NO: 5572751 - DNA, 22 bp, Homo sapiens
atgagcatcagagagtgtacat

SEQ ID NO: 5572752 - DNA, 16 bp, Homo sapiens
atgagcatcaggccag

SEQ ID NO: 5572753 - DNA, 14 bp, Homo sapiens
atgagcatcccagg

SEQ ID NO: 5572754 - DNA, 16 bp, Homo sapiens
atgagcatcctgagcc

SEQ ID NO: 5572755 - DNA, 17 bp, Homo sapiens
atgagcatcctgagccc

SEQ ID NO: 5572756 - DNA, 18 bp, Homo sapiens
atgagcatctcaaatgtt

SEQ ID NO: 5572757 - DNA, 18 bp, Homo sapiens
atgagcatgcattttctt

SEQ ID NO: 5572758 - DNA, 15 bp, Homo sapiens
atgagcatggagctg

SEQ ID NO: 5572759 - DNA, 23 bp, Homo sapiens
atgagcatttgtttgaccccagt

SEQ ID NO: 5572760 - DNA, 15 bp, Homo sapiens
atgagccaaaaactg

SEQ ID NO: 5572761 - DNA, 13 bp, Homo sapiens
atgagccaaaatg

SEQ ID NO: 5572762 - DNA, 14 bp, Homo sapiens
atgagccaaaatga

SEQ ID NO: 5572763 - DNA, 16 bp, Homo sapiens
atgagccaaaatgact

SEQ ID NO: 5572764 - DNA, 21 bp, Homo sapiens
atgagccaaaatgactttgaa

SEQ ID NO: 5572765 - DNA, 13 bp, Homo sapiens
atgagccaccatg

SEQ ID NO: 5572766 - DNA, 18 bp, Homo sapiens
atgagccaccgcgcccag

SEQ ID NO: 5572767 - DNA, 23 bp, Homo sapiens
atgagccaccgcgcctggcctct

SEQ ID NO: 5572768 - DNA, 15 bp, Homo sapiens
atgagccactgtgcc

SEQ ID NO: 5572769 - DNA, 21 bp, Homo sapiens
atgagccatattaattgcctg

SEQ ID NO: 5572770 - DNA, 20 bp, Homo sapiens
atgagccatcactagaagaa

SEQ ID NO: 5572771 - DNA, 16 bp, Homo sapiens
atgagcccagagaaca

SEQ ID NO: 5572772 - DNA, 14 bp, Homo sapiens
atgagccctaaaaa

SEQ ID NO: 5572773 - DNA, 12 bp, Homo sapiens
atgagccctggc

SEQ ID NO: 5572774 - DNA, 21 bp, Homo sapiens
atgagccctggctcccacctg

SEQ ID NO: 5572775 - DNA, 19 bp, Homo sapiens
atgagccgcccaaggcctt

SEQ ID NO: 5572776 - DNA, 21 bp, Homo sapiens
atgagccgcccaaggccttcc

SEQ ID NO: 5572777 - DNA, 20 bp, Homo sapiens
atgagccggttattacttct

SEQ ID NO: 5572778 - DNA, 16 bp, Homo sapiens
atgagcctacgctgaa

SEQ ID NO: 5572779 - DNA, 23 bp, Homo sapiens
atgagcctacgctgaagatggca

SEQ ID NO: 5572780 - DNA, 13 bp, Homo sapiens
atgagcctgcccg

SEQ ID NO: 5572781 - DNA, 14 bp, Homo sapiens
atgagcctgcccgc

SEQ ID NO: 5572782 - DNA, 16 bp, Homo sapiens
atgagcctgcccgctg

SEQ ID NO: 5572783 - DNA, 17 bp, Homo sapiens
atgagcctgctggaagc

SEQ ID NO: 5572784 - DNA, 12 bp, Homo sapiens
atgagcctggca

SEQ ID NO: 5572785 - DNA, 14 bp, Homo sapiens
atgagcctggcaag

SEQ ID NO: 5572786 - DNA, 15 bp, Homo sapiens
atgagcctgggctca

SEQ ID NO: 5572787 - DNA, 23 bp, Homo sapiens
atgagcctgggctcatagtgaga

SEQ ID NO: 5572788 - DNA, 14 bp, Homo sapiens
atgagcctgtttat

SEQ ID NO: 5572789 - DNA, 22 bp, Homo sapiens
atgagcctgtttattgccatta

SEQ ID NO: 5572790 - DNA, 23 bp, Homo sapiens
atgagcctttgtgctttttgtca

SEQ ID NO: 5572791 - DNA, 14 bp, Homo sapiens
atgagcgccacctc

SEQ ID NO: 5572792 - DNA, 18 bp, Homo sapiens
atgagcgtcaaagaaaat

SEQ ID NO: 5572793 - DNA, 13 bp, Homo sapiens
atgagcgtcactg

SEQ ID NO: 5572794 - DNA, 17 bp, Homo sapiens
atgagcgtcctaaggca

SEQ ID NO: 5572795 - DNA, 22 bp, Homo sapiens
atgagctacttcttattcactt

SEQ ID NO: 5572796 - DNA, 20 bp, Homo sapiens
atgagctatcctttcaaaca

SEQ ID NO: 5572797 - DNA, 22 bp, Homo sapiens
atgagctattaaaactcagcct

SEQ ID NO: 5572798 - DNA, 21 bp, Homo sapiens
atgagctatttccattccaga

SEQ ID NO: 5572799 - DNA, 22 bp, Homo sapiens
atgagctatttccattccagaa

SEQ ID NO: 5572800 - DNA, 13 bp, Homo sapiens
atgagctcagcct

SEQ ID NO: 5572801 - DNA, 16 bp, Homo sapiens
atgagctcatgtagca

SEQ ID NO: 5572802 - DNA, 13 bp, Homo sapiens
atgagctccagac

SEQ ID NO: 5572803 - DNA, 14 bp, Homo sapiens
atgagctccagacc

SEQ ID NO: 5572804 - DNA, 20 bp, Homo sapiens
atgagctccagacccccagc

SEQ ID NO: 5572805 - DNA, 22 bp, Homo sapiens
atgagctccagacccccagcaa

SEQ ID NO: 5572806 - DNA, 21 bp, Homo sapiens
atgagctcccacaagcctgag

SEQ ID NO: 5572807 - DNA, 19 bp, Homo sapiens
atgagctcctgatcagagg

SEQ ID NO: 5572808 - DNA, 22 bp, Homo sapiens
atgagctcgcatttgtcaatga

SEQ ID NO: 5572809 - DNA, 15 bp, Homo sapiens
atgagctctacccag

SEQ ID NO: 5572810 - DNA, 16 bp, Homo sapiens
atgagctctacccagg

SEQ ID NO: 5572811 - DNA, 20 bp, Homo sapiens
atgagctctctaatagaagt

SEQ ID NO: 5572812 - DNA, 19 bp, Homo sapiens
atgagctctgaaatcttcc

SEQ ID NO: 5572813 - DNA, 16 bp, Homo sapiens
atgagctctgaacaaa

SEQ ID NO: 5572814 - DNA, 16 bp, Homo sapiens
atgagctgaaaagtga

SEQ ID NO: 5572815 - DNA, 12 bp, Homo sapiens
atgagctgaggg

SEQ ID NO: 5572816 - DNA, 20 bp, Homo sapiens
atgagctggagctaaggcca

SEQ ID NO: 5572817 - DNA, 12 bp, Homo sapiens
atgagctgggcc

SEQ ID NO: 5572818 - DNA, 15 bp, Homo sapiens
atgagctgtatctgt

SEQ ID NO: 5572819 - DNA, 22 bp, Homo sapiens
atgagctgttggaagaaaagaa

SEQ ID NO: 5572820 - DNA, 17 bp, Homo sapiens
atgagcttagggtgttt

SEQ ID NO: 5572821 - DNA, 13 bp, Homo sapiens
atgagctttccag

SEQ ID NO: 5572822 - DNA, 18 bp, Homo sapiens
atgagctttctgaacagc

SEQ ID NO: 5572823 - DNA, 18 bp, Homo sapiens
atgagctttctttgcact

SEQ ID NO: 5572824 - DNA, 23 bp, Homo sapiens
atgagctttctttgcacttaaaa

SEQ ID NO: 5572825 - DNA, 14 bp, Homo sapiens
atgaggaaaaaatg

SEQ ID NO: 5572826 - DNA, 15 bp, Homo sapiens
atgaggaaaagaaaa

SEQ ID NO: 5572827 - DNA, 20 bp, Homo sapiens
atgaggaaacaggcctcaag

SEQ ID NO: 5572828 - DNA, 23 bp, Homo sapiens
atgaggaaactgagtcactcaca

SEQ ID NO: 5572829 - DNA, 15 bp, Homo sapiens
atgaggaaagacaca

SEQ ID NO: 5572830 - DNA, 23 bp, Homo sapiens
atgaggaaatgccacaaattgta

SEQ ID NO: 5572831 - DNA, 15 bp, Homo sapiens
atgaggaacctcaaa

SEQ ID NO: 5572832 - DNA, 12 bp, Homo sapiens
atgaggaagaat

SEQ ID NO: 5572833 - DNA, 16 bp, Homo sapiens
atgaggaatagttttc

SEQ ID NO: 5572834 - DNA, 17 bp, Homo sapiens
atgaggaatccaaaaga

SEQ ID NO: 5572835 - DNA, 17 bp, Homo sapiens
atgaggaatgtatatgt

SEQ ID NO: 5572836 - DNA, 19 bp, Homo sapiens
atgaggacagagggcacat

SEQ ID NO: 5572837 - DNA, 15 bp, Homo sapiens
atgaggacagagtgg

SEQ ID NO: 5572838 - DNA, 13 bp, Homo sapiens
atgaggacatgtt

SEQ ID NO: 5572839 - DNA, 17 bp, Homo sapiens
atgaggacccagagctg

SEQ ID NO: 5572840 - DNA, 15 bp, Homo sapiens
atgaggacgtgtctg

SEQ ID NO: 5572841 - DNA, 21 bp, Homo sapiens
atgaggagaaaaaaagcatgt

SEQ ID NO: 5572842 - DNA, 17 bp, Homo sapiens
atgaggagcgtggactc

SEQ ID NO: 5572843 - DNA, 19 bp, Homo sapiens
atgaggagcgtggactctg

SEQ ID NO: 5572844 - DNA, 13 bp, Homo sapiens
atgaggaggatgc

SEQ ID NO: 5572845 - DNA, 18 bp, Homo sapiens
atgaggaggatgctaaaa

SEQ ID NO: 5572846 - DNA, 18 bp, Homo sapiens
atgaggaggattgcttct

SEQ ID NO: 5572847 - DNA, 13 bp, Homo sapiens
atgaggaggcaga

SEQ ID NO: 5572848 - DNA, 14 bp, Homo sapiens
atgaggagggtggg

SEQ ID NO: 5572849 - DNA, 20 bp, Homo sapiens
atgaggaggtacaaaagtta

SEQ ID NO: 5572850 - DNA, 23 bp, Homo sapiens
atgaggatccgaaacggcagcct

SEQ ID NO: 5572851 - DNA, 22 bp, Homo sapiens
atgaggatgcagagtcagcaga

SEQ ID NO: 5572852 - DNA, 15 bp, Homo sapiens
atgaggcaaacagca

SEQ ID NO: 5572853 - DNA, 18 bp, Homo sapiens
atgaggcaactcagcagg

SEQ ID NO: 5572854 - DNA, 20 bp, Homo sapiens
atgaggcaactcagcaggct

SEQ ID NO: 5572855 - DNA, 15 bp, Homo sapiens
atgaggcacttctgt

SEQ ID NO: 5572856 - DNA, 22 bp, Homo sapiens
atgaggcattttactatgcctg

SEQ ID NO: 5572857 - DNA, 12 bp, Homo sapiens
atgaggccagac

SEQ ID NO: 5572858 - DNA, 13 bp, Homo sapiens
atgaggccagacc

SEQ ID NO: 5572859 - DNA, 17 bp, Homo sapiens
atgaggccatgcaaggg

SEQ ID NO: 5572860 - DNA, 15 bp, Homo sapiens
atgaggccatggact

SEQ ID NO: 5572861 - DNA, 14 bp, Homo sapiens
atgaggccctccac

SEQ ID NO: 5572862 - DNA, 21 bp, Homo sapiens
atgaggccgctagaggcctga

SEQ ID NO: 5572863 - DNA, 18 bp, Homo sapiens
atgaggcctcagtggact

SEQ ID NO: 5572864 - DNA, 22 bp, Homo sapiens
atgaggcctcttggacctctgc

SEQ ID NO: 5572865 - DNA, 23 bp, Homo sapiens
atgaggcctcttggacctctgct

SEQ ID NO: 5572866 - DNA, 19 bp, Homo sapiens
atgaggcctttccccagtg

SEQ ID NO: 5572867 - DNA, 17 bp, Homo sapiens
atgaggctattaaaaga

SEQ ID NO: 5572868 - DNA, 14 bp, Homo sapiens
atgaggctgaggca

SEQ ID NO: 5572869 - DNA, 14 bp, Homo sapiens
atgaggctggatag

SEQ ID NO: 5572870 - DNA, 15 bp, Homo sapiens
atgaggcttcccaga

SEQ ID NO: 5572871 - DNA, 17 bp, Homo sapiens
atgaggcttcttcctgg

SEQ ID NO: 5572872 - DNA, 18 bp, Homo sapiens
atgaggcttcttcctgga

SEQ ID NO: 5572873 - DNA, 23 bp, Homo sapiens
atgaggcttcttcctggatgggg

SEQ ID NO: 5572874 - DNA, 18 bp, Homo sapiens
atgaggcttgctgagagg

SEQ ID NO: 5572875 - DNA, 13 bp, Homo sapiens
atgagggaaaaga

SEQ ID NO: 5572876 - DNA, 14 bp, Homo sapiens
atgagggaaacaaa

SEQ ID NO: 5572877 - DNA, 18 bp, Homo sapiens
atgagggagacagaccac

SEQ ID NO: 5572878 - DNA, 18 bp, Homo sapiens
atgatgttgaatatttgt

SEQ ID NO: 5572879 - DNA, 17 bp, Homo sapiens
atgatgttgataatttc

SEQ ID NO: 5572880 - DNA, 20 bp, Homo sapiens
atgatgttgataatttcagg

SEQ ID NO: 5572881 - DNA, 14 bp, Homo sapiens
atgatgttgctgtt

SEQ ID NO: 5572882 - DNA, 19 bp, Homo sapiens
atgatgttggtccaaagtg

SEQ ID NO: 5572883 - DNA, 15 bp, Homo sapiens
atgatgtttcacata

SEQ ID NO: 5572884 - DNA, 22 bp, Homo sapiens
atgatgtttccctctccttcca

SEQ ID NO: 5572885 - DNA, 21 bp, Homo sapiens
atgatgttttaaaaaaatttg

SEQ ID NO: 5572886 - DNA, 14 bp, Homo sapiens
atgatgttttccct

SEQ ID NO: 5572887 - DNA, 13 bp, Homo sapiens
atgatgttttgat

SEQ ID NO: 5572888 - DNA, 20 bp, Homo sapiens
atgatgttttgcaaaggaaa

SEQ ID NO: 5572889 - DNA, 16 bp, Homo sapiens
atgattaaaatggtga

SEQ ID NO: 5572890 - DNA, 20 bp, Homo sapiens
atgattaaacacctgacaca

SEQ ID NO: 5572891 - DNA, 24 bp, Homo sapiens
atgattaaataagattctaacggt

SEQ ID NO: 5572892 - DNA, 14 bp, Homo sapiens
atgattaaattatg

SEQ ID NO: 5572893 - DNA, 21 bp, Homo sapiens
atgattaaattttagtacatt

SEQ ID NO: 5572894 - DNA, 19 bp, Homo sapiens
atgattaaccacttcagct

SEQ ID NO: 5572895 - DNA, 21 bp, Homo sapiens
atgattaaccacttcagctga

SEQ ID NO: 5572896 - DNA, 15 bp, Homo sapiens
atgattaatacaata

SEQ ID NO: 5572897 - DNA, 12 bp, Homo sapiens
atgattaatcag

SEQ ID NO: 5572898 - DNA, 13 bp, Homo sapiens
atgattaatcagc

SEQ ID NO: 5572899 - DNA, 17 bp, Homo sapiens
atgattaatcagctgtt

SEQ ID NO: 5572900 - DNA, 13 bp, Homo sapiens
atgattaatgcat

SEQ ID NO: 5572901 - DNA, 16 bp, Homo sapiens
atgattaattcacctt

SEQ ID NO: 5572902 - DNA, 19 bp, Homo sapiens
atgattactggcctttttc

SEQ ID NO: 5572903 - DNA, 23 bp, Homo sapiens
atgattagaaattacctgtggat

SEQ ID NO: 5572904 - DNA, 16 bp, Homo sapiens
atgattagacaatgtg

SEQ ID NO: 5572905 - DNA, 21 bp, Homo sapiens
atgattagacaatgtggaatt

SEQ ID NO: 5572906 - DNA, 12 bp, Homo sapiens
atgattataagc

SEQ ID NO: 5572907 - DNA, 19 bp, Homo sapiens
atgattataatgctatttt

SEQ ID NO: 5572908 - DNA, 21 bp, Homo sapiens
atgattatacaaaagagcatg

SEQ ID NO: 5572909 - DNA, 23 bp, Homo sapiens
atgattatacaaaagagcatgga

SEQ ID NO: 5572910 - DNA, 15 bp, Homo sapiens
atgattatagataaa

SEQ ID NO: 5572911 - DNA, 13 bp, Homo sapiens
atgattatcttga

SEQ ID NO: 5572912 - DNA, 21 bp, Homo sapiens
atgattatcttgatttcccaa

SEQ ID NO: 5572913 - DNA, 15 bp, Homo sapiens
atgattattatttaa

SEQ ID NO: 5572914 - DNA, 21 bp, Homo sapiens
atgattcaaattgctgcttgg

SEQ ID NO: 5572915 - DNA, 12 bp, Homo sapiens
atgattcaagcc

SEQ ID NO: 5572916 - DNA, 14 bp, Homo sapiens
atgattcaagccat

SEQ ID NO: 5572917 - DNA, 14 bp, Homo sapiens
atgattcaatgtga

SEQ ID NO: 5572918 - DNA, 23 bp, Homo sapiens
atgattcacaactaggacctcat

SEQ ID NO: 5572919 - DNA, 23 bp, Homo sapiens
atgattcacatgctaaagccagg

SEQ ID NO: 5572920 - DNA, 20 bp, Homo sapiens
atgattcactatttaaacta

SEQ ID NO: 5572921 - DNA, 17 bp, Homo sapiens
atgattcacttttattg

SEQ ID NO: 5572922 - DNA, 18 bp, Homo sapiens
atgattcacttttattgt

SEQ ID NO: 5572923 - DNA, 21 bp, Homo sapiens
atgattcacttttattgtata

SEQ ID NO: 5572924 - DNA, 16 bp, Homo sapiens
atgattcagtgcattt

SEQ ID NO: 5572925 - DNA, 16 bp, Homo sapiens
atgattcagtgttaaa

SEQ ID NO: 5572926 - DNA, 13 bp, Homo sapiens
atgattcattttt

SEQ ID NO: 5572927 - DNA, 12 bp, Homo sapiens
atgattccaaat

SEQ ID NO: 5572928 - DNA, 13 bp, Homo sapiens
atgattccagcca

SEQ ID NO: 5572929 - DNA, 16 bp, Homo sapiens
atgattccaggtggca

SEQ ID NO: 5572930 - DNA, 14 bp, Homo sapiens
atgattccctcctc

SEQ ID NO: 5572931 - DNA, 18 bp, Homo sapiens
atgattcccttttcttta

SEQ ID NO: 5572932 - DNA, 18 bp, Homo sapiens
atgattcctggacatcac

SEQ ID NO: 5572933 - DNA, 13 bp, Homo sapiens
atgattccttcct

SEQ ID NO: 5572934 - DNA, 23 bp, Homo sapiens
atgattcgcccaaagccagacag

SEQ ID NO: 5572935 - DNA, 23 bp, Homo sapiens
atgattctaatttttaagcaaaa

SEQ ID NO: 5572936 - DNA, 19 bp, Homo sapiens
atgattctagtacataatt

SEQ ID NO: 5572937 - DNA, 16 bp, Homo sapiens
atgattctctgagtgg

SEQ ID NO: 5572938 - DNA, 24 bp, Homo sapiens
atgattctctgagtggtggttcct

SEQ ID NO: 5572939 - DNA, 23 bp, Homo sapiens
atgattctcttagacacttttat

SEQ ID NO: 5572940 - DNA, 22 bp, Homo sapiens
atgattcttaacacagccttcc

SEQ ID NO: 5572941 - DNA, 21 bp, Homo sapiens
atgattcttccagataatgtc

SEQ ID NO: 5572942 - DNA, 20 bp, Homo sapiens
atgattcttccttttattaa

SEQ ID NO: 5572943 - DNA, 14 bp, Homo sapiens
atgattgaaaagaa

SEQ ID NO: 5572944 - DNA, 16 bp, Homo sapiens
atgattgaatctactt

SEQ ID NO: 5572945 - DNA, 19 bp, Homo sapiens
atgattgaattatatgttc

SEQ ID NO: 5572946 - DNA, 15 bp, Homo sapiens
atgattgaattttta

SEQ ID NO: 5572947 - DNA, 22 bp, Homo sapiens
atgattgaatttttaagcaaat

SEQ ID NO: 5572948 - DNA, 15 bp, Homo sapiens
atgattgcactaaat

SEQ ID NO: 5572949 - DNA, 12 bp, Homo sapiens
atgattgcagaa

SEQ ID NO: 5572950 - DNA, 19 bp, Homo sapiens
atgattgcctttttataac

SEQ ID NO: 5572951 - DNA, 15 bp, Homo sapiens
atgattgcttttaaa

SEQ ID NO: 5572952 - DNA, 17 bp, Homo sapiens
atgattgcttttaaaat

SEQ ID NO: 5572953 - DNA, 19 bp, Homo sapiens
atgattggcttaaagtgaa

SEQ ID NO: 5572954 - DNA, 19 bp, Homo sapiens
atgattggttaaaatgtga

SEQ ID NO: 5572955 - DNA, 20 bp, Homo sapiens
atgattggttaaaatgtgat

SEQ ID NO: 5572956 - DNA, 16 bp, Homo sapiens
atgattggttcagttt

SEQ ID NO: 5572957 - DNA, 15 bp, Homo sapiens
atgattgtaacatat

SEQ ID NO: 5572958 - DNA, 16 bp, Homo sapiens
atgattgtaagtccca

SEQ ID NO: 5572959 - DNA, 17 bp, Homo sapiens
atgattgtataatgtga

SEQ ID NO: 5572960 - DNA, 16 bp, Homo sapiens
atgattgttcataata

SEQ ID NO: 5572961 - DNA, 21 bp, Homo sapiens
atgattgttcttttgtttcat

SEQ ID NO: 5572962 - DNA, 20 bp, Homo sapiens
atgattgtttaattgtaggt

SEQ ID NO: 5572963 - DNA, 19 bp, Homo sapiens
atgattgtttgcacagagg

SEQ ID NO: 5572964 - DNA, 17 bp, Homo sapiens
atgatttaaaaaataaa

SEQ ID NO: 5572965 - DNA, 21 bp, Homo sapiens
atgatttaaaaaataaatata

SEQ ID NO: 5572966 - DNA, 18 bp, Homo sapiens
atgatttaataaaataat

SEQ ID NO: 5572967 - DNA, 15 bp, Homo sapiens
atgatttaatccaga

SEQ ID NO: 5572968 - DNA, 16 bp, Homo sapiens
atgatttaattcttac

SEQ ID NO: 5572969 - DNA, 16 bp, Homo sapiens
atgatttacagagaag

SEQ ID NO: 5572970 - DNA, 14 bp, Homo sapiens
atgatttactcatt

SEQ ID NO: 5572971 - DNA, 15 bp, Homo sapiens
atgatttactcatta

SEQ ID NO: 5572972 - DNA, 20 bp, Homo sapiens
atgatttagggaagcaggga

SEQ ID NO: 5572973 - DNA, 19 bp, Homo sapiens
atgatttatttgtcctttt

SEQ ID NO: 5572974 - DNA, 20 bp, Homo sapiens
atgatttcaagatgttatat

SEQ ID NO: 5572975 - DNA, 12 bp, Homo sapiens
atgatttcaata

SEQ ID NO: 5572976 - DNA, 12 bp, Homo sapiens
atgatttcacaa

SEQ ID NO: 5572977 - DNA, 16 bp, Homo sapiens
atgatttcacaaatat

SEQ ID NO: 5572978 - DNA, 17 bp, Homo sapiens
atgatttcacaaatatt

SEQ ID NO: 5572979 - DNA, 23 bp, Homo sapiens
atgatttcacaaatattaaaaag

SEQ ID NO: 5572980 - DNA, 13 bp, Homo sapiens
atgatttcagaaa

SEQ ID NO: 5572981 - DNA, 15 bp, Homo sapiens
atgatttcagaaaca

SEQ ID NO: 5572982 - DNA, 22 bp, Homo sapiens
atgatttcagttcatcaaatca

SEQ ID NO: 5572983 - DNA, 15 bp, Homo sapiens
atgatttcatattga

SEQ ID NO: 5572984 - DNA, 22 bp, Homo sapiens
atgatttcatcttctggaatat

SEQ ID NO: 5572985 - DNA, 14 bp, Homo sapiens
atgatttcatttca

SEQ ID NO: 5572986 - DNA, 20 bp, Homo sapiens
atgatttccaaagagaaaaa

SEQ ID NO: 5572987 - DNA, 15 bp, Homo sapiens
atgatttccttcaat

SEQ ID NO: 5572988 - DNA, 13 bp, Homo sapiens
atgatttccttga

SEQ ID NO: 5572989 - DNA, 18 bp, Homo sapiens
atgatttccttgaatgtg

SEQ ID NO: 5572990 - DNA, 20 bp, Homo sapiens
atgatttccttgaatgtggc

SEQ ID NO: 5572991 - DNA, 20 bp, Homo sapiens
atgatttctatgaacttgtc

SEQ ID NO: 5572992 - DNA, 13 bp, Homo sapiens
atgatttctatgc

SEQ ID NO: 5572993 - DNA, 16 bp, Homo sapiens
atgatttctatgctga

SEQ ID NO: 5572994 - DNA, 19 bp, Homo sapiens
atgatttctgtgaagcaaa

SEQ ID NO: 5572995 - DNA, 18 bp, Homo sapiens
atgatttgcaactttaga

SEQ ID NO: 5572996 - DNA, 20 bp, Homo sapiens
atgatttggggattcagatt

SEQ ID NO: 5572997 - DNA, 13 bp, Homo sapiens
atgatttggggga

SEQ ID NO: 5572998 - DNA, 14 bp, Homo sapiens
atgatttggggtga

SEQ ID NO: 5572999 - DNA, 13 bp, Homo sapiens
atgatttgtaaag

SEQ ID NO: 5573000 - DNA, 17 bp, Homo sapiens
atgatttgtacttggaa

SEQ ID NO: 5573001 - DNA, 11 bp, Homo sapiens
atgatttgtca

SEQ ID NO: 5573002 - DNA, 19 bp, Homo sapiens
atgatttgttttgaatttt

SEQ ID NO: 5573003 - DNA, 15 bp, Homo sapiens
atgattttatacata

SEQ ID NO: 5573004 - DNA, 11 bp, Homo sapiens
atgattttatt

SEQ ID NO: 5573005 - DNA, 18 bp, Homo sapiens
atgattttcatttcatga

SEQ ID NO: 5573006 - DNA, 18 bp, Homo sapiens
atgattttcctccctggt

SEQ ID NO: 5573007 - DNA, 20 bp, Homo sapiens
atgattttcctttttcttcg

SEQ ID NO: 5573008 - DNA, 23 bp, Homo sapiens
atgattttcctttttcttcgctg

SEQ ID NO: 5573009 - DNA, 14 bp, Homo sapiens
atgattttcttttg

SEQ ID NO: 5573010 - DNA, 22 bp, Homo sapiens
atgattttggaactgtgtttca

SEQ ID NO: 5573011 - DNA, 15 bp, Homo sapiens
atgattttggccact

SEQ ID NO: 5573012 - DNA, 16 bp, Homo sapiens
atgatttttaaagaaa

SEQ ID NO: 5573013 - DNA, 22 bp, Homo sapiens
atgatttttaagtacaaaaaag

SEQ ID NO: 5573014 - DNA, 18 bp, Homo sapiens
atgatttttacaataatt

SEQ ID NO: 5573015 - DNA, 11 bp, Homo sapiens
atgatttttag

SEQ ID NO: 5573016 - DNA, 15 bp, Homo sapiens
atgatttttagacta

SEQ ID NO: 5573017 - DNA, 15 bp, Homo sapiens
atgatttttctttac

SEQ ID NO: 5573018 - DNA, 17 bp, Homo sapiens
atgatttttctttacaa

SEQ ID NO: 5573019 - DNA, 19 bp, Homo sapiens
atgatttttgctatttcta

SEQ ID NO: 5573020 - DNA, 21 bp, Homo sapiens
atgatttttgtgtatccagta

SEQ ID NO: 5573021 - DNA, 17 bp, Homo sapiens
atgattttttaaaagaa

SEQ ID NO: 5573022 - DNA, 15 bp, Homo sapiens
atgattttttaagca

SEQ ID NO: 5573023 - DNA, 17 bp, Homo sapiens
atgattttttaagcaga

SEQ ID NO: 5573024 - DNA, 21 bp, Homo sapiens
atgattttttaaggagctggg

SEQ ID NO: 5573025 - DNA, 18 bp, Homo sapiens
atgattttttaagtctat

SEQ ID NO: 5573026 - DNA, 16 bp, Homo sapiens
atgatttttttttcca

SEQ ID NO: 5573027 - DNA, 23 bp, Homo sapiens
atgcaaaaaaaaaaaaagcaatt

SEQ ID NO: 5573028 - DNA, 23 bp, Homo sapiens
atgcaaaaaaaaaaatgtcaaga

SEQ ID NO: 5573029 - DNA, 21 bp, Homo sapiens
atgcaaaaaagaaacaataaa

SEQ ID NO: 5573030 - DNA, 15 bp, Homo sapiens
atgcaaaaaatctta

SEQ ID NO: 5573031 - DNA, 17 bp, Homo sapiens
atgcaaaaaattcttta

SEQ ID NO: 5573032 - DNA, 12 bp, Homo sapiens
atgcaaaaacat

SEQ ID NO: 5573033 - DNA, 16 bp, Homo sapiens
atgcaaaaacatatgt

SEQ ID NO: 5573034 - DNA, 23 bp, Homo sapiens
atgcaaaaagctagtcaacagta

SEQ ID NO: 5573035 - DNA, 22 bp, Homo sapiens
atgcaaaaatgaattcacccct

SEQ ID NO: 5573036 - DNA, 19 bp, Homo sapiens
atgcaaaagccaagaaagt

SEQ ID NO: 5573037 - DNA, 20 bp, Homo sapiens
atgcaaaagccaagaaagta

SEQ ID NO: 5573038 - DNA, 23 bp, Homo sapiens
atgcaaaagtacaagggctgaga

SEQ ID NO: 5573039 - DNA, 15 bp, Homo sapiens
atgcaaaataaagaa

SEQ ID NO: 5573040 - DNA, 15 bp, Homo sapiens
atgcaaaatagacat

SEQ ID NO: 5573041 - DNA, 13 bp, Homo sapiens
atgcaaaatgaaa

SEQ ID NO: 5573042 - DNA, 13 bp, Homo sapiens
atgcaaaatggaa

SEQ ID NO: 5573043 - DNA, 24 bp, Homo sapiens
atgcaaaattgttttcacttgtat

SEQ ID NO: 5573044 - DNA, 13 bp, Homo sapiens
atgcaaaatttgt

SEQ ID NO: 5573045 - DNA, 18 bp, Homo sapiens
atgcaaaatttttttaat

SEQ ID NO: 5573046 - DNA, 16 bp, Homo sapiens
atgcaaacaagaaacg

SEQ ID NO: 5573047 - DNA, 20 bp, Homo sapiens
atgcaaacactgtgtattta

SEQ ID NO: 5573048 - DNA, 21 bp, Homo sapiens
atgcaaaccatcattgaaatc

SEQ ID NO: 5573049 - DNA, 20 bp, Homo sapiens
atgcaaaccatcatttaatt

SEQ ID NO: 5573050 - DNA, 23 bp, Homo sapiens
atgcaaaccgttaggaaaaccag

SEQ ID NO: 5573051 - DNA, 13 bp, Homo sapiens
atgcaaactcttt

SEQ ID NO: 5573052 - DNA, 22 bp, Homo sapiens
atgcaaactctttggtcgtttt

SEQ ID NO: 5573053 - DNA, 14 bp, Homo sapiens
atgcaaactgcttt

SEQ ID NO: 5573054 - DNA, 16 bp, Homo sapiens
atgcaaactgctttat

SEQ ID NO: 5573055 - DNA, 22 bp, Homo sapiens
atgcagtgtgtctttataaagc

SEQ ID NO: 5573056 - DNA, 21 bp, Homo sapiens
atgcagtgtttccctctgtgt

SEQ ID NO: 5573057 - DNA, 19 bp, Homo sapiens
atgcagttacaaattataa

SEQ ID NO: 5573058 - DNA, 20 bp, Homo sapiens
atgcagttacaaattataat

SEQ ID NO: 5573059 - DNA, 22 bp, Homo sapiens
atgcagttacaaattataatgt

SEQ ID NO: 5573060 - DNA, 20 bp, Homo sapiens
atgcagttagctgaagaatt

SEQ ID NO: 5573061 - DNA, 22 bp, Homo sapiens
atgcagttcaaaaacaagacag

SEQ ID NO: 5573062 - DNA, 13 bp, Homo sapiens
atgcagttcctgg

SEQ ID NO: 5573063 - DNA, 15 bp, Homo sapiens
atgcagttcctggcc

SEQ ID NO: 5573064 - DNA, 13 bp, Homo sapiens
atgcagttctgaa

SEQ ID NO: 5573065 - DNA, 15 bp, Homo sapiens
atgcagttctgaaga

SEQ ID NO: 5573066 - DNA, 19 bp, Homo sapiens
atgcagttctgaagaagat

SEQ ID NO: 5573067 - DNA, 15 bp, Homo sapiens
atgcagttctgagca

SEQ ID NO: 5573068 - DNA, 19 bp, Homo sapiens
atgcagttgataagaggaa

SEQ ID NO: 5573069 - DNA, 14 bp, Homo sapiens
atgcagttgtctct

SEQ ID NO: 5573070 - DNA, 14 bp, Homo sapiens
atgcagtttgaaat

SEQ ID NO: 5573071 - DNA, 15 bp, Homo sapiens
atgcagttttaagaa

SEQ ID NO: 5573072 - DNA, 20 bp, Homo sapiens
atgcagttttttggaagaaa

SEQ ID NO: 5573073 - DNA, 16 bp, Homo sapiens
atgcataaaaaaatga

SEQ ID NO: 5573074 - DNA, 18 bp, Homo sapiens
atgcataaaaaaatgatg

SEQ ID NO: 5573075 - DNA, 14 bp, Homo sapiens
atgcataaaaatta

SEQ ID NO: 5573076 - DNA, 20 bp, Homo sapiens
atgcataaaaattaaatgga

SEQ ID NO: 5573077 - DNA, 20 bp, Homo sapiens
atgcataaaagggtcaaacc

SEQ ID NO: 5573078 - DNA, 15 bp, Homo sapiens
atgcataaaatatat

SEQ ID NO: 5573079 - DNA, 15 bp, Homo sapiens
atgcataaactaaaa

SEQ ID NO: 5573080 - DNA, 19 bp, Homo sapiens
atgcataaactaaaaacta

SEQ ID NO: 5573081 - DNA, 13 bp, Homo sapiens
atgcataaataaa

SEQ ID NO: 5573082 - DNA, 13 bp, Homo sapiens
atgcataaatgca

SEQ ID NO: 5573083 - DNA, 19 bp, Homo sapiens
atgcataactgacaaatca

SEQ ID NO: 5573084 - DNA, 20 bp, Homo sapiens
atgcataactgacaaatcaa

SEQ ID NO: 5573085 - DNA, 22 bp, Homo sapiens
atgcataatgaaccgtttacag

SEQ ID NO: 5573086 - DNA, 14 bp, Homo sapiens
atgcataatttatg

SEQ ID NO: 5573087 - DNA, 22 bp, Homo sapiens
atgcatacaaatctcactgtat

SEQ ID NO: 5573088 - DNA, 14 bp, Homo sapiens
atgcatacaagttt

SEQ ID NO: 5573089 - DNA, 21 bp, Homo sapiens
atgcatacaataaaagagctt

SEQ ID NO: 5573090 - DNA, 10 bp, Homo sapiens
atgcatacac

SEQ ID NO: 5573091 - DNA, 15 bp, Homo sapiens
atgcatacacacaca

SEQ ID NO: 5573092 - DNA, 14 bp, Homo sapiens
atgcatacatacac

SEQ ID NO: 5573093 - DNA, 11 bp, Homo sapiens
atgcatacatg

SEQ ID NO: 5573094 - DNA, 15 bp, Homo sapiens
atgcatacatgctgc

SEQ ID NO: 5573095 - DNA, 23 bp, Homo sapiens
atgcatactaatttttgcttaac

SEQ ID NO: 5573096 - DNA, 15 bp, Homo sapiens
atgcatactgttgat

SEQ ID NO: 5573097 - DNA, 22 bp, Homo sapiens
atgcatactgttgatacaaacc

SEQ ID NO: 5573098 - DNA, 18 bp, Homo sapiens
atgcatacttcaaaagta

SEQ ID NO: 5573099 - DNA, 17 bp, Homo sapiens
atgcatagacaagtgtt

SEQ ID NO: 5573100 - DNA, 16 bp, Homo sapiens
atgcatagagcaatta

SEQ ID NO: 5573101 - DNA, 16 bp, Homo sapiens
atgcatagagtgtgat

SEQ ID NO: 5573102 - DNA, 15 bp, Homo sapiens
atgcatatagacaca

SEQ ID NO: 5573103 - DNA, 14 bp, Homo sapiens
atgcatatatatgt

SEQ ID NO: 5573104 - DNA, 17 bp, Homo sapiens
atgcatatcctgagcca

SEQ ID NO: 5573105 - DNA, 13 bp, Homo sapiens
atgcatattcaac

SEQ ID NO: 5573106 - DNA, 17 bp, Homo sapiens
atgcatattcaacacac

SEQ ID NO: 5573107 - DNA, 21 bp, Homo sapiens
atgcatattcaacacactgcc

SEQ ID NO: 5573108 - DNA, 15 bp, Homo sapiens
atgcatattcaatgt

SEQ ID NO: 5573109 - DNA, 16 bp, Homo sapiens
atgcatatttatagag

SEQ ID NO: 5573110 - DNA, 12 bp, Homo sapiens
atgcatatttct

SEQ ID NO: 5573111 - DNA, 15 bp, Homo sapiens
atgcatatttctatg

SEQ ID NO: 5573112 - DNA, 14 bp, Homo sapiens
atgcatatttttgc

SEQ ID NO: 5573113 - DNA, 23 bp, Homo sapiens
atgcatattttttttctttttac

SEQ ID NO: 5573114 - DNA, 21 bp, Homo sapiens
atgcatcacgtaccccactgg

SEQ ID NO: 5573115 - DNA, 19 bp, Homo sapiens
atgcatcagataacaactg

SEQ ID NO: 5573116 - DNA, 21 bp, Homo sapiens
atgcatcataaaacaaatccc

SEQ ID NO: 5573117 - DNA, 18 bp, Homo sapiens
atgcatcatctcttcctc

SEQ ID NO: 5573118 - DNA, 23 bp, Homo sapiens
atgcatcatttcaggagttactg

SEQ ID NO: 5573119 - DNA, 19 bp, Homo sapiens
atgcatccaaataggagtc

SEQ ID NO: 5573120 - DNA, 14 bp, Homo sapiens
atgcatccattcct

SEQ ID NO: 5573121 - DNA, 17 bp, Homo sapiens
atgcatccattcctcag

SEQ ID NO: 5573122 - DNA, 23 bp, Homo sapiens
atgcatccatttcagtttgttta

SEQ ID NO: 5573123 - DNA, 17 bp, Homo sapiens
atgcatcccactgctga

SEQ ID NO: 5573124 - DNA, 16 bp, Homo sapiens
atgcatctacttggca

SEQ ID NO: 5573125 - DNA, 19 bp, Homo sapiens
atgcatctacttggcaagg

SEQ ID NO: 5573126 - DNA, 12 bp, Homo sapiens
atgcatctgttt

SEQ ID NO: 5573127 - DNA, 13 bp, Homo sapiens
atgcatcttctgt

SEQ ID NO: 5573128 - DNA, 19 bp, Homo sapiens
atgcatctttaattcctta

SEQ ID NO: 5573129 - DNA, 19 bp, Homo sapiens
atgcatctttgatgtgttg

SEQ ID NO: 5573130 - DNA, 14 bp, Homo sapiens
atgcatgaaatgaa

SEQ ID NO: 5573131 - DNA, 12 bp, Homo sapiens
atgcatgaagca

SEQ ID NO: 5573132 - DNA, 16 bp, Homo sapiens
atgcatgaagtaatat

SEQ ID NO: 5573133 - DNA, 20 bp, Homo sapiens
atgcatgagaactaaataga

SEQ ID NO: 5573134 - DNA, 22 bp, Homo sapiens
atgcatgagcacctttctggct

SEQ ID NO: 5573135 - DNA, 13 bp, Homo sapiens
atgcatgagctcc

SEQ ID NO: 5573136 - DNA, 18 bp, Homo sapiens
atgcatgatattgtatgt

SEQ ID NO: 5573137 - DNA, 22 bp, Homo sapiens
atgcatgatgactcttcttatc

SEQ ID NO: 5573138 - DNA, 15 bp, Homo sapiens
atgcatgatgccctc

SEQ ID NO: 5573139 - DNA, 11 bp, Homo sapiens
atgcatgattt

SEQ ID NO: 5573140 - DNA, 16 bp, Homo sapiens
atgcatgcaaatgagc

SEQ ID NO: 5573141 - DNA, 20 bp, Homo sapiens
atgcatgcagccactgtgct

SEQ ID NO: 5573142 - DNA, 12 bp, Homo sapiens
atgcatgctaaa

SEQ ID NO: 5573143 - DNA, 15 bp, Homo sapiens
atgcatgctttccat

SEQ ID NO: 5573144 - DNA, 17 bp, Homo sapiens
atgcatgctttccatat

SEQ ID NO: 5573145 - DNA, 15 bp, Homo sapiens
atgcatgctttggaa

SEQ ID NO: 5573146 - DNA, 12 bp, Homo sapiens
atgcatggaaac

SEQ ID NO: 5573147 - DNA, 16 bp, Homo sapiens
atgcatggaaattccc

SEQ ID NO: 5573148 - DNA, 21 bp, Homo sapiens
atgcatggcagcaggcctgtt

SEQ ID NO: 5573149 - DNA, 18 bp, Homo sapiens
atgcatggggcgggtcct

SEQ ID NO: 5573150 - DNA, 17 bp, Homo sapiens
atgcatggtgccccagg

SEQ ID NO: 5573151 - DNA, 19 bp, Homo sapiens
atgcatggtgccccaggac

SEQ ID NO: 5573152 - DNA, 20 bp, Homo sapiens
atgcatggtgccccaggacc

SEQ ID NO: 5573153 - DNA, 16 bp, Homo sapiens
atgcatggtttcagca

SEQ ID NO: 5573154 - DNA, 13 bp, Homo sapiens
atgcatgtaatca

SEQ ID NO: 5573155 - DNA, 16 bp, Homo sapiens
atgcatgtattcacta

SEQ ID NO: 5573156 - DNA, 23 bp, Homo sapiens
atgcatgtattcactaaaataaa

SEQ ID NO: 5573157 - DNA, 20 bp, Homo sapiens
atgcatgtctgccaaaatgc

SEQ ID NO: 5573158 - DNA, 15 bp, Homo sapiens
atgcatgtcttttaa

SEQ ID NO: 5573159 - DNA, 17 bp, Homo sapiens
atgcatgtgaagaaagg

SEQ ID NO: 5573160 - DNA, 15 bp, Homo sapiens
atgcatgttctcctc

SEQ ID NO: 5573161 - DNA, 17 bp, Homo sapiens
atgcatgttctcctcta

SEQ ID NO: 5573162 - DNA, 12 bp, Homo sapiens
atgcattaaaaa

SEQ ID NO: 5573163 - DNA, 17 bp, Homo sapiens
atgcattaaaagaaaat

SEQ ID NO: 5573164 - DNA, 15 bp, Homo sapiens
atgcattaaacctgt

SEQ ID NO: 5573165 - DNA, 20 bp, Homo sapiens
atgcattaaacctgtctcca

SEQ ID NO: 5573166 - DNA, 20 bp, Homo sapiens
atgcattaccttctgttcct

SEQ ID NO: 5573167 - DNA, 18 bp, Homo sapiens
atgcattatatcaaatct

SEQ ID NO: 5573168 - DNA, 13 bp, Homo sapiens
atgcattattaaa

SEQ ID NO: 5573169 - DNA, 16 bp, Homo sapiens
atgcattattaaattg

SEQ ID NO: 5573170 - DNA, 21 bp, Homo sapiens
atgcattattttgtcataaaa

SEQ ID NO: 5573171 - DNA, 17 bp, Homo sapiens
atgcattcacctgccct

SEQ ID NO: 5573172 - DNA, 23 bp, Homo sapiens
atgcattctaccactacattttg

SEQ ID NO: 5573173 - DNA, 18 bp, Homo sapiens
atgcattctagtgcagaa

SEQ ID NO: 5573174 - DNA, 20 bp, Homo sapiens
atgcattctagtgcagaagc

SEQ ID NO: 5573175 - DNA, 21 bp, Homo sapiens
atgcattctgataggaggggg

SEQ ID NO: 5573176 - DNA, 14 bp, Homo sapiens
atgcattcttctct

SEQ ID NO: 5573177 - DNA, 19 bp, Homo sapiens
atgcattcttctctgttgt

SEQ ID NO: 5573178 - DNA, 21 bp, Homo sapiens
atgcattcttggttggctggc

SEQ ID NO: 5573179 - DNA, 14 bp, Homo sapiens
atgcattctttata

SEQ ID NO: 5573180 - DNA, 19 bp, Homo sapiens
atgcattctttatagtgaa

SEQ ID NO: 5573181 - DNA, 21 bp, Homo sapiens
atgcattctttcttctcttta

SEQ ID NO: 5573182 - DNA, 22 bp, Homo sapiens
atgcattgaacatcttgcattc

SEQ ID NO: 5573183 - DNA, 15 bp, Homo sapiens
atgcattgagctgcc

SEQ ID NO: 5573184 - DNA, 23 bp, Homo sapiens
atgcattgcctgtaacaatgtaa

SEQ ID NO: 5573185 - DNA, 15 bp, Homo sapiens
atgcattggcctctg

SEQ ID NO: 5573186 - DNA, 16 bp, Homo sapiens
atgcattggcctctgt

SEQ ID NO: 5573187 - DNA, 16 bp, Homo sapiens
atgcattgtcttgtgg

SEQ ID NO: 5573188 - DNA, 24 bp, Homo sapiens
atgcattgtgaattgcctgccatg

SEQ ID NO: 5573189 - DNA, 15 bp, Homo sapiens
atgcattgttgaggt

SEQ ID NO: 5573190 - DNA, 14 bp, Homo sapiens
atgcattgttgtaa

SEQ ID NO: 5573191 - DNA, 16 bp, Homo sapiens
atgcattgttgtaaag

SEQ ID NO: 5573192 - DNA, 14 bp, Homo sapiens
atgcatttaaaata

SEQ ID NO: 5573193 - DNA, 20 bp, Homo sapiens
atgcatttaaactcatttga

SEQ ID NO: 5573194 - DNA, 18 bp, Homo sapiens
atgcatttaagttgtaaa

SEQ ID NO: 5573195 - DNA, 19 bp, Homo sapiens
atgcatttaagttgtaaac

SEQ ID NO: 5573196 - DNA, 12 bp, Homo sapiens
atgcatttaata

SEQ ID NO: 5573197 - DNA, 22 bp, Homo sapiens
atgcatttaataaagatgagtt

SEQ ID NO: 5573198 - DNA, 13 bp, Homo sapiens
atgcatttagcat

SEQ ID NO: 5573199 - DNA, 17 bp, Homo sapiens
atgcatttagcatgagt

SEQ ID NO: 5573200 - DNA, 20 bp, Homo sapiens
atgcatttatagatcatttc

SEQ ID NO: 5573201 - DNA, 21 bp, Homo sapiens
atgcatttatagatcatttct

SEQ ID NO: 5573202 - DNA, 13 bp, Homo sapiens
atgcatttcaaat

SEQ ID NO: 5573203 - DNA, 14 bp, Homo sapiens
atgcatttcaaatg

SEQ ID NO: 5573204 - DNA, 15 bp, Homo sapiens
atgcatttcattcaa

SEQ ID NO: 5573205 - DNA, 14 bp, Homo sapiens
atgcatttccacac

SEQ ID NO: 5573206 - DNA, 10 bp, Homo sapiens
atgcatttga

SEQ ID NO: 5573207 - DNA, 20 bp, Homo sapiens
atgcatttgatttgtttagt

SEQ ID NO: 5573208 - DNA, 18 bp, Homo sapiens
atgcatttggaaccaaag

SEQ ID NO: 5573209 - DNA, 18 bp, Homo sapiens
atgcatttggcaacccaa

SEQ ID NO: 5573210 - DNA, 17 bp, Homo sapiens
atgcatttgggtccagg

SEQ ID NO: 5573211 - DNA, 18 bp, Homo sapiens
atgcatttgggtccagga

SEQ ID NO: 5573212 - DNA, 20 bp, Homo sapiens
atgcatttgggtccaggagg

SEQ ID NO: 5573213 - DNA, 17 bp, Homo sapiens
atgcattttaaatgtct

SEQ ID NO: 5573214 - DNA, 20 bp, Homo sapiens
atgcattttaaatgtctata

SEQ ID NO: 5573215 - DNA, 19 bp, Homo sapiens
atgcattttatagaatgtg

SEQ ID NO: 5573216 - DNA, 23 bp, Homo sapiens
atgcattttattttagacacaaa

SEQ ID NO: 5573217 - DNA, 18 bp, Homo sapiens
atgcattttcttcagaat

SEQ ID NO: 5573218 - DNA, 19 bp, Homo sapiens
atgcattttcttcagaatt

SEQ ID NO: 5573219 - DNA, 18 bp, Homo sapiens
atgcattttgctagacag

SEQ ID NO: 5573220 - DNA, 14 bp, Homo sapiens
atgcattttgctgc

SEQ ID NO: 5573221 - DNA, 15 bp, Homo sapiens
atgcattttgctttg

SEQ ID NO: 5573222 - DNA, 18 bp, Homo sapiens
atgcattttgtgtacagt

SEQ ID NO: 5573223 - DNA, 19 bp, Homo sapiens
atgcattttgtttggtatt

SEQ ID NO: 5573224 - DNA, 22 bp, Homo sapiens
atgcattttgtttggtattgta

SEQ ID NO: 5573225 - DNA, 22 bp, Homo sapiens
atgcatttttgatgggaagaaa

SEQ ID NO: 5573226 - DNA, 17 bp, Homo sapiens
atgccaaaaaaaaatac

SEQ ID NO: 5573227 - DNA, 18 bp, Homo sapiens
atgccaaaatattgctta

SEQ ID NO: 5573228 - DNA, 16 bp, Homo sapiens
atgccaaaatgacttt

SEQ ID NO: 5573229 - DNA, 19 bp, Homo sapiens
atgccaaaatgactttata

SEQ ID NO: 5573230 - DNA, 19 bp, Homo sapiens
atgccaaacactagctctg

SEQ ID NO: 5573231 - DNA, 22 bp, Homo sapiens
atgccaaagatgtttgaaaatg

SEQ ID NO: 5573232 - DNA, 14 bp, Homo sapiens
atgccaaagcagac

SEQ ID NO: 5573233 - DNA, 15 bp, Homo sapiens
atgctattgaaatta

SEQ ID NO: 5573234 - DNA, 17 bp, Homo sapiens
atgctattgacaataaa

SEQ ID NO: 5573235 - DNA, 21 bp, Homo sapiens
atgctattgacaataaaatat

SEQ ID NO: 5573236 - DNA, 12 bp, Homo sapiens
atgctattgtct

SEQ ID NO: 5573237 - DNA, 18 bp, Homo sapiens
atgctattgttgtgggct

SEQ ID NO: 5573238 - DNA, 14 bp, Homo sapiens
atgctatttctata

SEQ ID NO: 5573239 - DNA, 15 bp, Homo sapiens
atgctatttctatat

SEQ ID NO: 5573240 - DNA, 21 bp, Homo sapiens
atgctatttctatattttcat

SEQ ID NO: 5573241 - DNA, 22 bp, Homo sapiens
atgctatttctatattttcatt

SEQ ID NO: 5573242 - DNA, 23 bp, Homo sapiens
atgctatttctatattttcattc

SEQ ID NO: 5573243 - DNA, 19 bp, Homo sapiens
atgctatttctggcctcag

SEQ ID NO: 5573244 - DNA, 21 bp, Homo sapiens
atgctatttctggcctcagca

SEQ ID NO: 5573245 - DNA, 21 bp, Homo sapiens
atgctatttgcaattcctgct

SEQ ID NO: 5573246 - DNA, 21 bp, Homo sapiens
atgctatttgccaagaccatt

SEQ ID NO: 5573247 - DNA, 19 bp, Homo sapiens
atgctattttaaaattcat

SEQ ID NO: 5573248 - DNA, 21 bp, Homo sapiens
atgctatttttattaatataa

SEQ ID NO: 5573249 - DNA, 23 bp, Homo sapiens
atgctattttttcccttctcttc

SEQ ID NO: 5573250 - DNA, 16 bp, Homo sapiens
atgctcaaagaaatct

SEQ ID NO: 5573251 - DNA, 17 bp, Homo sapiens
atgctcaaagaaatcta

SEQ ID NO: 5573252 - DNA, 21 bp, Homo sapiens
atgctcaacccccctcccaga

SEQ ID NO: 5573253 - DNA, 14 bp, Homo sapiens
atgctcaagttttt

SEQ ID NO: 5573254 - DNA, 17 bp, Homo sapiens
atgctcaatgtgctgtt

SEQ ID NO: 5573255 - DNA, 16 bp, Homo sapiens
atgctcaatttcagca

SEQ ID NO: 5573256 - DNA, 13 bp, Homo sapiens
atgctcacactcc

SEQ ID NO: 5573257 - DNA, 15 bp, Homo sapiens
atgctcacagtctca

SEQ ID NO: 5573258 - DNA, 14 bp, Homo sapiens
atgctcacctctag

SEQ ID NO: 5573259 - DNA, 18 bp, Homo sapiens
atgctcacctctagcctt

SEQ ID NO: 5573260 - DNA, 12 bp, Homo sapiens
atgctcacctga

SEQ ID NO: 5573261 - DNA, 17 bp, Homo sapiens
atgctcacttttgtgaa

SEQ ID NO: 5573262 - DNA, 18 bp, Homo sapiens
atgctcagaagccagtct

SEQ ID NO: 5573263 - DNA, 17 bp, Homo sapiens
atgctcagaccagctct

SEQ ID NO: 5573264 - DNA, 18 bp, Homo sapiens
atgctcagccctgactgg

SEQ ID NO: 5573265 - DNA, 15 bp, Homo sapiens
atgctcagccttgct

SEQ ID NO: 5573266 - DNA, 16 bp, Homo sapiens
atgctcagccttgctg

SEQ ID NO: 5573267 - DNA, 21 bp, Homo sapiens
atgctcagccttgctgctctg

SEQ ID NO: 5573268 - DNA, 12 bp, Homo sapiens
atgctcaggggc

SEQ ID NO: 5573269 - DNA, 22 bp, Homo sapiens
atgctcaggggccctggagcag

SEQ ID NO: 5573270 - DNA, 18 bp, Homo sapiens
atgctcagggtcactgaa

SEQ ID NO: 5573271 - DNA, 21 bp, Homo sapiens
atgctcagttgctaaacactg

SEQ ID NO: 5573272 - DNA, 15 bp, Homo sapiens
atgctcataaagatg

SEQ ID NO: 5573273 - DNA, 16 bp, Homo sapiens
atgctcataacggatc

SEQ ID NO: 5573274 - DNA, 13 bp, Homo sapiens
atgctcatgtata

SEQ ID NO: 5573275 - DNA, 19 bp, Homo sapiens
atgctcattcatattcctg

SEQ ID NO: 5573276 - DNA, 23 bp, Homo sapiens
atgctcattccatgactctgcct

SEQ ID NO: 5573277 - DNA, 16 bp, Homo sapiens
atgctcattttcttta

SEQ ID NO: 5573278 - DNA, 18 bp, Homo sapiens
atgctccaagattctaga

SEQ ID NO: 5573279 - DNA, 19 bp, Homo sapiens
atgctccaagattctagat

SEQ ID NO: 5573280 - DNA, 20 bp, Homo sapiens
atgctccaagattctagatg

SEQ ID NO: 5573281 - DNA, 14 bp, Homo sapiens
atgctccactattt

SEQ ID NO: 5573282 - DNA, 18 bp, Homo sapiens
atgctccagccaacccct

SEQ ID NO: 5573283 - DNA, 21 bp, Homo sapiens
atgctccagccaacccctgtg

SEQ ID NO: 5573284 - DNA, 14 bp, Homo sapiens
atgctccaggatct

SEQ ID NO: 5573285 - DNA, 11 bp, Homo sapiens
atgctccaggg

SEQ ID NO: 5573286 - DNA, 18 bp, Homo sapiens
atgctccagggcagcctc

SEQ ID NO: 5573287 - DNA, 20 bp, Homo sapiens
atgctcccaactcccttctg

SEQ ID NO: 5573288 - DNA, 20 bp, Homo sapiens
atgctcccacctgaatttgt

SEQ ID NO: 5573289 - DNA, 17 bp, Homo sapiens
atgctcccagcatttgt

SEQ ID NO: 5573290 - DNA, 20 bp, Homo sapiens
atgctcccagctgtgctgtg

SEQ ID NO: 5573291 - DNA, 17 bp, Homo sapiens
atgctcccatctcctga

SEQ ID NO: 5573292 - DNA, 12 bp, Homo sapiens
atgctccccaca

SEQ ID NO: 5573293 - DNA, 13 bp, Homo sapiens
atgctccccacag

SEQ ID NO: 5573294 - DNA, 23 bp, Homo sapiens
atgctccccacagcgtccctggc

SEQ ID NO: 5573295 - DNA, 18 bp, Homo sapiens
atgctcccccatcctccc

SEQ ID NO: 5573296 - DNA, 20 bp, Homo sapiens
atgctcccccatcctcccct

SEQ ID NO: 5573297 - DNA, 21 bp, Homo sapiens
atgctcccccatcctcccctt

SEQ ID NO: 5573298 - DNA, 22 bp, Homo sapiens
atgctcccccatcctccccttc

SEQ ID NO: 5573299 - DNA, 14 bp, Homo sapiens
atgctccctcagcc

SEQ ID NO: 5573300 - DNA, 17 bp, Homo sapiens
atgctccctcagcctca

SEQ ID NO: 5573301 - DNA, 20 bp, Homo sapiens
atgctccctcagcctcagag

SEQ ID NO: 5573302 - DNA, 14 bp, Homo sapiens
atgctccctcatgc

SEQ ID NO: 5573303 - DNA, 14 bp, Homo sapiens
atgctccctcccct

SEQ ID NO: 5573304 - DNA, 19 bp, Homo sapiens
atgctccctcccctgccct

SEQ ID NO: 5573305 - DNA, 14 bp, Homo sapiens
atgctcctagaagt

SEQ ID NO: 5573306 - DNA, 14 bp, Homo sapiens
atgctcctccgggt

SEQ ID NO: 5573307 - DNA, 13 bp, Homo sapiens
atgctcctcttcc

SEQ ID NO: 5573308 - DNA, 14 bp, Homo sapiens
atgctcctcttccc

SEQ ID NO: 5573309 - DNA, 18 bp, Homo sapiens
atgctcctcttccccaga

SEQ ID NO: 5573310 - DNA, 20 bp, Homo sapiens
atgctcctcttccccagacg

SEQ ID NO: 5573311 - DNA, 19 bp, Homo sapiens
atgctccttgagaggagaa

SEQ ID NO: 5573312 - DNA, 15 bp, Homo sapiens
atgctccttgttcct

SEQ ID NO: 5573313 - DNA, 18 bp, Homo sapiens
atgctccttgttcctaga

SEQ ID NO: 5573314 - DNA, 17 bp, Homo sapiens
atgctcgccatcaaggt

SEQ ID NO: 5573315 - DNA, 19 bp, Homo sapiens
atgctcgtcatacagtaaa

SEQ ID NO: 5573316 - DNA, 22 bp, Homo sapiens
atgctctaatgagcatttcctt

SEQ ID NO: 5573317 - DNA, 17 bp, Homo sapiens
atgctctagtgccttct

SEQ ID NO: 5573318 - DNA, 19 bp, Homo sapiens
atgctctatcttgctctgt

SEQ ID NO: 5573319 - DNA, 21 bp, Homo sapiens
atgctctcatatatattttaa

SEQ ID NO: 5573320 - DNA, 14 bp, Homo sapiens
atgctctcctttcc

SEQ ID NO: 5573321 - DNA, 20 bp, Homo sapiens
atgctctctatagaggagga

SEQ ID NO: 5573322 - DNA, 13 bp, Homo sapiens
atgctctctcttc

SEQ ID NO: 5573323 - DNA, 14 bp, Homo sapiens
atgctctctcttct

SEQ ID NO: 5573324 - DNA, 14 bp, Homo sapiens
atgctctctgaggc

SEQ ID NO: 5573325 - DNA, 22 bp, Homo sapiens
atgctctctgcagccagcccag

SEQ ID NO: 5573326 - DNA, 15 bp, Homo sapiens
atgctctgagaaatt

SEQ ID NO: 5573327 - DNA, 17 bp, Homo sapiens
atgctctgcagcattga

SEQ ID NO: 5573328 - DNA, 22 bp, Homo sapiens
atgctctgcagcattgaagtat

SEQ ID NO: 5573329 - DNA, 13 bp, Homo sapiens
atgctctgcccca

SEQ ID NO: 5573330 - DNA, 21 bp, Homo sapiens
atgctctgccccaagccccca

SEQ ID NO: 5573331 - DNA, 13 bp, Homo sapiens
atgctctgtgaca

SEQ ID NO: 5573332 - DNA, 16 bp, Homo sapiens
atgctcttaaaatatc

SEQ ID NO: 5573333 - DNA, 23 bp, Homo sapiens
atgctcttaaaatatcttccttt

SEQ ID NO: 5573334 - DNA, 15 bp, Homo sapiens
atgctcttatttcat

SEQ ID NO: 5573335 - DNA, 15 bp, Homo sapiens
atgctcttctgtgga

SEQ ID NO: 5573336 - DNA, 20 bp, Homo sapiens
atgctcttgaaatattcaga

SEQ ID NO: 5573337 - DNA, 15 bp, Homo sapiens
atgctcttgtccctg

SEQ ID NO: 5573338 - DNA, 18 bp, Homo sapiens
atgctctttaaataataa

SEQ ID NO: 5573339 - DNA, 18 bp, Homo sapiens
atgctctttcaccctgcc

SEQ ID NO: 5573340 - DNA, 15 bp, Homo sapiens
atgctctttcccacc

SEQ ID NO: 5573341 - DNA, 15 bp, Homo sapiens
atgctctttcccagg

SEQ ID NO: 5573342 - DNA, 16 bp, Homo sapiens
atgctctttcccagga

SEQ ID NO: 5573343 - DNA, 19 bp, Homo sapiens
atgctctttcccttttctg

SEQ ID NO: 5573344 - DNA, 23 bp, Homo sapiens
atgctctttcccttttctgttta

SEQ ID NO: 5573345 - DNA, 17 bp, Homo sapiens
atgctgaaaaaacacct

SEQ ID NO: 5573346 - DNA, 17 bp, Homo sapiens
atgctgaaaaatatagc

SEQ ID NO: 5573347 - DNA, 14 bp, Homo sapiens
atgctgaaaattgc

SEQ ID NO: 5573348 - DNA, 23 bp, Homo sapiens
atgctgaaacaatgcctacagct

SEQ ID NO: 5573349 - DNA, 17 bp, Homo sapiens
atgctgaaataaactag

SEQ ID NO: 5573350 - DNA, 15 bp, Homo sapiens
atgctgaaatctatt

SEQ ID NO: 5573351 - DNA, 14 bp, Homo sapiens
atgctgaacgcaga

SEQ ID NO: 5573352 - DNA, 17 bp, Homo sapiens
atgctgaacgcagaaga

SEQ ID NO: 5573353 - DNA, 18 bp, Homo sapiens
atgctgaatactcctccc

SEQ ID NO: 5573354 - DNA, 18 bp, Homo sapiens
atgctgaatatatagaat

SEQ ID NO: 5573355 - DNA, 19 bp, Homo sapiens
atgctgaatatctgttcac

SEQ ID NO: 5573356 - DNA, 22 bp, Homo sapiens
atgctgaatatctgttcacttt

SEQ ID NO: 5573357 - DNA, 16 bp, Homo sapiens
atgctgaatccacctc

SEQ ID NO: 5573358 - DNA, 17 bp, Homo sapiens
atgctgaatgccccctg

SEQ ID NO: 5573359 - DNA, 17 bp, Homo sapiens
atgctgaattattttgt

SEQ ID NO: 5573360 - DNA, 22 bp, Homo sapiens
atgctgaattattttgttgtga

SEQ ID NO: 5573361 - DNA, 13 bp, Homo sapiens
atgctgaatttct

SEQ ID NO: 5573362 - DNA, 12 bp, Homo sapiens
atgctgacacca

SEQ ID NO: 5573363 - DNA, 13 bp, Homo sapiens
atgctgacaccag

SEQ ID NO: 5573364 - DNA, 20 bp, Homo sapiens
atgctgactgtactcctccc

SEQ ID NO: 5573365 - DNA, 14 bp, Homo sapiens
atgctgagaaatta

SEQ ID NO: 5573366 - DNA, 14 bp, Homo sapiens
atgctgagattctt

SEQ ID NO: 5573367 - DNA, 23 bp, Homo sapiens
atgctgagcccggaaactccaca

SEQ ID NO: 5573368 - DNA, 18 bp, Homo sapiens
atgctgagctgaagaaat

SEQ ID NO: 5573369 - DNA, 22 bp, Homo sapiens
atgctgagcttgtcttttctgc

SEQ ID NO: 5573370 - DNA, 21 bp, Homo sapiens
atgctgaggccacccactgac

SEQ ID NO: 5573371 - DNA, 17 bp, Homo sapiens
atgctgaggcccctagg

SEQ ID NO: 5573372 - DNA, 22 bp, Homo sapiens
atgctgaggcctgggccgctgc

SEQ ID NO: 5573373 - DNA, 18 bp, Homo sapiens
atgctgaggttttgaata

SEQ ID NO: 5573374 - DNA, 21 bp, Homo sapiens
atgctgaggttttgaataaaa

SEQ ID NO: 5573375 - DNA, 17 bp, Homo sapiens
atgctgataatcatttt

SEQ ID NO: 5573376 - DNA, 22 bp, Homo sapiens
atgctgatcatcgccagaggtg

SEQ ID NO: 5573377 - DNA, 15 bp, Homo sapiens
atgctgatcttttaa

SEQ ID NO: 5573378 - DNA, 21 bp, Homo sapiens
atgctgatgaatcactgtttt

SEQ ID NO: 5573379 - DNA, 22 bp, Homo sapiens
atgctgatgatcaaaacctgtg

SEQ ID NO: 5573380 - DNA, 14 bp, Homo sapiens
atgctgatgtcctc

SEQ ID NO: 5573381 - DNA, 16 bp, Homo sapiens
atgctgatgtcctcac

SEQ ID NO: 5573382 - DNA, 21 bp, Homo sapiens
atgctgatgttcagtgtaatt

SEQ ID NO: 5573383 - DNA, 22 bp, Homo sapiens
atgctgatgttcagtgtaattt

SEQ ID NO: 5573384 - DNA, 21 bp, Homo sapiens
atgctgattcaaggcattatt

SEQ ID NO: 5573385 - DNA, 20 bp, Homo sapiens
atgctgcaagcgaggtccaa

SEQ ID NO: 5573386 - DNA, 19 bp, Homo sapiens
atgctgcacagatggattt

SEQ ID NO: 5573387 - DNA, 18 bp, Homo sapiens
atgctgcaggacttgaga

SEQ ID NO: 5573388 - DNA, 19 bp, Homo sapiens
atgctgcaggacttgagaa

SEQ ID NO: 5573389 - DNA, 14 bp, Homo sapiens
atgctgcatatgtt

SEQ ID NO: 5573390 - DNA, 14 bp, Homo sapiens
atgctgccaaattt

SEQ ID NO: 5573391 - DNA, 13 bp, Homo sapiens
atgctgccaatat

SEQ ID NO: 5573392 - DNA, 22 bp, Homo sapiens
atgctgccaatatcctaataaa

SEQ ID NO: 5573393 - DNA, 18 bp, Homo sapiens
atgctgccatgcccacca

SEQ ID NO: 5573394 - DNA, 15 bp, Homo sapiens
atgctgcccaccccc

SEQ ID NO: 5573395 - DNA, 17 bp, Homo sapiens
atgctgcccagccactc

SEQ ID NO: 5573396 - DNA, 15 bp, Homo sapiens
atgctgcccatgcca

SEQ ID NO: 5573397 - DNA, 17 bp, Homo sapiens
atgctgcccatgccacc

SEQ ID NO: 5573398 - DNA, 11 bp, Homo sapiens
atgctgcccct

SEQ ID NO: 5573399 - DNA, 16 bp, Homo sapiens
atgctgcccctgcctt

SEQ ID NO: 5573400 - DNA, 16 bp, Homo sapiens
atgctgccctgtgagt

SEQ ID NO: 5573401 - DNA, 13 bp, Homo sapiens
atgctgccggcac

SEQ ID NO: 5573402 - DNA, 19 bp, Homo sapiens
atgctgcctagtgctacag

SEQ ID NO: 5573403 - DNA, 15 bp, Homo sapiens
atgctgcctcaggac

SEQ ID NO: 5573404 - DNA, 18 bp, Homo sapiens
atgctgcctcaggaccca

SEQ ID NO: 5573405 - DNA, 12 bp, Homo sapiens
atgctgcctcca

SEQ ID NO: 5573406 - DNA, 19 bp, Homo sapiens
atgctgcctgagtattact

SEQ ID NO: 5573407 - DNA, 11 bp, Homo sapiens
atgctgcctgc

SEQ ID NO: 5573408 - DNA, 14 bp, Homo sapiens
atgctgcctgccat

SEQ ID NO: 5573409 - DNA, 19 bp, Homo sapiens
atgctgcctgccatgtgtg

SEQ ID NO: 5573410 - DNA, 20 bp, Homo sapiens
atgctgcctgccatgtgtga

SEQ ID NO: 5573411 - DNA, 11 bp, Homo sapiens
atggaaatcca

SEQ ID NO: 5573412 - DNA, 12 bp, Homo sapiens
atggaaatccac

SEQ ID NO: 5573413 - DNA, 13 bp, Homo sapiens
atggaaatcctgt

SEQ ID NO: 5573414 - DNA, 19 bp, Homo sapiens
atggaaatgggcagagcag

SEQ ID NO: 5573415 - DNA, 20 bp, Homo sapiens
atggaaatgtaataataatg

SEQ ID NO: 5573416 - DNA, 17 bp, Homo sapiens
atggaaatttaaagcag

SEQ ID NO: 5573417 - DNA, 18 bp, Homo sapiens
atggaacacaaacacatt

SEQ ID NO: 5573418 - DNA, 13 bp, Homo sapiens
atggaacacacac

SEQ ID NO: 5573419 - DNA, 14 bp, Homo sapiens
atggaacacacaca

SEQ ID NO: 5573420 - DNA, 14 bp, Homo sapiens
atggaacacttcga

SEQ ID NO: 5573421 - DNA, 15 bp, Homo sapiens
atggaacaggctcag

SEQ ID NO: 5573422 - DNA, 12 bp, Homo sapiens
atggaacagtga

SEQ ID NO: 5573423 - DNA, 16 bp, Homo sapiens
atggaacataaaatac

SEQ ID NO: 5573424 - DNA, 18 bp, Homo sapiens
atggaaccgcaggaagct

SEQ ID NO: 5573425 - DNA, 14 bp, Homo sapiens
atggaacctccttt

SEQ ID NO: 5573426 - DNA, 18 bp, Homo sapiens
atggaacctgacgtagct

SEQ ID NO: 5573427 - DNA, 13 bp, Homo sapiens
atggaaccttccc

SEQ ID NO: 5573428 - DNA, 14 bp, Homo sapiens
atggaaccttccct

SEQ ID NO: 5573429 - DNA, 18 bp, Homo sapiens
atggaacgcattttgggt

SEQ ID NO: 5573430 - DNA, 17 bp, Homo sapiens
atggaacgcgttgaaat

SEQ ID NO: 5573431 - DNA, 19 bp, Homo sapiens
atggaacgcgttgaaattg

SEQ ID NO: 5573432 - DNA, 19 bp, Homo sapiens
atggaactactgtactttg

SEQ ID NO: 5573433 - DNA, 22 bp, Homo sapiens
atggaactcagctgtctgtggc

SEQ ID NO: 5573434 - DNA, 19 bp, Homo sapiens
atggaactcattcctgcct

SEQ ID NO: 5573435 - DNA, 20 bp, Homo sapiens
atggaactcctaaataaact

SEQ ID NO: 5573436 - DNA, 13 bp, Homo sapiens
atggaactgtaat

SEQ ID NO: 5573437 - DNA, 18 bp, Homo sapiens
atggaactgtgtatttat

SEQ ID NO: 5573438 - DNA, 19 bp, Homo sapiens
atggaacttaaaacatatg

SEQ ID NO: 5573439 - DNA, 14 bp, Homo sapiens
atggaacttagcca

SEQ ID NO: 5573440 - DNA, 15 bp, Homo sapiens
atggaacttccctcc

SEQ ID NO: 5573441 - DNA, 18 bp, Homo sapiens
atggaacttctaatatat

SEQ ID NO: 5573442 - DNA, 13 bp, Homo sapiens
atggaagaaagaa

SEQ ID NO: 5573443 - DNA, 14 bp, Homo sapiens
atggaagaaagaag

SEQ ID NO: 5573444 - DNA, 14 bp, Homo sapiens
atggaagaaagtaa

SEQ ID NO: 5573445 - DNA, 19 bp, Homo sapiens
atggaagacaaatacacat

SEQ ID NO: 5573446 - DNA, 13 bp, Homo sapiens
atggaagagaaat

SEQ ID NO: 5573447 - DNA, 12 bp, Homo sapiens
atggaagagaag

SEQ ID NO: 5573448 - DNA, 20 bp, Homo sapiens
atggaagaggaaaaggctgg

SEQ ID NO: 5573449 - DNA, 19 bp, Homo sapiens
atggaagaggctacagggc

SEQ ID NO: 5573450 - DNA, 18 bp, Homo sapiens
atggaagcaattgctcat

SEQ ID NO: 5573451 - DNA, 15 bp, Homo sapiens
atggaagccacatca

SEQ ID NO: 5573452 - DNA, 21 bp, Homo sapiens
atggaagcctccacctgcagc

SEQ ID NO: 5573453 - DNA, 15 bp, Homo sapiens
atggaagcttccagt

SEQ ID NO: 5573454 - DNA, 17 bp, Homo sapiens
atggaaggaggcctcca

SEQ ID NO: 5573455 - DNA, 13 bp, Homo sapiens
atggaagggaggg

SEQ ID NO: 5573456 - DNA, 19 bp, Homo sapiens
atggaagggccttctccac

SEQ ID NO: 5573457 - DNA, 14 bp, Homo sapiens
atggaaggggctga

SEQ ID NO: 5573458 - DNA, 18 bp, Homo sapiens
atggaaggggcttctgga

SEQ ID NO: 5573459 - DNA, 15 bp, Homo sapiens
atggaaggtgccaga

SEQ ID NO: 5573460 - DNA, 21 bp, Homo sapiens
atggaaggtgccagaaggaag

SEQ ID NO: 5573461 - DNA, 22 bp, Homo sapiens
atggaaggtgccagaaggaagg

SEQ ID NO: 5573462 - DNA, 23 bp, Homo sapiens
atggaaggtgccagaaggaaggt

SEQ ID NO: 5573463 - DNA, 22 bp, Homo sapiens
atggaaggtttgtatattgtca

SEQ ID NO: 5573464 - DNA, 23 bp, Homo sapiens
atggaagtaaaggcattccacag

SEQ ID NO: 5573465 - DNA, 21 bp, Homo sapiens
atggaagtactataatttacc

SEQ ID NO: 5573466 - DNA, 17 bp, Homo sapiens
atggaagtggcagtgaa

SEQ ID NO: 5573467 - DNA, 18 bp, Homo sapiens
atggaagtgtattggttt

SEQ ID NO: 5573468 - DNA, 15 bp, Homo sapiens
atggaataaattatg

SEQ ID NO: 5573469 - DNA, 15 bp, Homo sapiens
atggaataagtgtac

SEQ ID NO: 5573470 - DNA, 17 bp, Homo sapiens
atggaataagtgtacat

SEQ ID NO: 5573471 - DNA, 14 bp, Homo sapiens
atggaataataaat

SEQ ID NO: 5573472 - DNA, 15 bp, Homo sapiens
atggaatacagtgtt

SEQ ID NO: 5573473 - DNA, 17 bp, Homo sapiens
atggaatacagtgttat

SEQ ID NO: 5573474 - DNA, 16 bp, Homo sapiens
atggaatactcttata

SEQ ID NO: 5573475 - DNA, 17 bp, Homo sapiens
atggaatagttctgtat

SEQ ID NO: 5573476 - DNA, 18 bp, Homo sapiens
atggaatatcagaagtat

SEQ ID NO: 5573477 - DNA, 15 bp, Homo sapiens
atggaatatcatctg

SEQ ID NO: 5573478 - DNA, 16 bp, Homo sapiens
atggaatcacagccaa

SEQ ID NO: 5573479 - DNA, 17 bp, Homo sapiens
atggaatcgatttcctc

SEQ ID NO: 5573480 - DNA, 18 bp, Homo sapiens
atggaatcgatttcctcc

SEQ ID NO: 5573481 - DNA, 20 bp, Homo sapiens
atggaatctaccaactgttt

SEQ ID NO: 5573482 - DNA, 14 bp, Homo sapiens
atggaatcttctcc

SEQ ID NO: 5573483 - DNA, 13 bp, Homo sapiens
atggaatgagggt

SEQ ID NO: 5573484 - DNA, 22 bp, Homo sapiens
atggaatgattggttaaaatgt

SEQ ID NO: 5573485 - DNA, 16 bp, Homo sapiens
atggaatgctgtgtta

SEQ ID NO: 5573486 - DNA, 21 bp, Homo sapiens
atggaatgctgtgttaaataa

SEQ ID NO: 5573487 - DNA, 14 bp, Homo sapiens
atggaatgcttctt

SEQ ID NO: 5573488 - DNA, 15 bp, Homo sapiens
atggaattaaatgtg

SEQ ID NO: 5573489 - DNA, 15 bp, Homo sapiens
atggaattactccaa

SEQ ID NO: 5573490 - DNA, 19 bp, Homo sapiens
atggaattatgtataacaa

SEQ ID NO: 5573491 - DNA, 23 bp, Homo sapiens
atggaattccctcctgagtgccc

SEQ ID NO: 5573492 - DNA, 18 bp, Homo sapiens
atggaattcgtgttatga

SEQ ID NO: 5573493 - DNA, 21 bp, Homo sapiens
atggaattcgtgttatgaatc

SEQ ID NO: 5573494 - DNA, 18 bp, Homo sapiens
atggaattcttcctcctc

SEQ ID NO: 5573495 - DNA, 19 bp, Homo sapiens
atggaattcttcctcctct

SEQ ID NO: 5573496 - DNA, 20 bp, Homo sapiens
atggaattcttcctcctctg

SEQ ID NO: 5573497 - DNA, 14 bp, Homo sapiens
atggaattgatttg

SEQ ID NO: 5573498 - DNA, 23 bp, Homo sapiens
atggaattggagctcgtgggaca

SEQ ID NO: 5573499 - DNA, 12 bp, Homo sapiens
atggaatttata

SEQ ID NO: 5573500 - DNA, 21 bp, Homo sapiens
atggaatttataattcagtat

SEQ ID NO: 5573501 - DNA, 13 bp, Homo sapiens
atggaatttcata

SEQ ID NO: 5573502 - DNA, 12 bp, Homo sapiens
atggaatttgta

SEQ ID NO: 5573503 - DNA, 15 bp, Homo sapiens
atggaatttgtaagt

SEQ ID NO: 5573504 - DNA, 17 bp, Homo sapiens
atggaatttgtaagttt

SEQ ID NO: 5573505 - DNA, 14 bp, Homo sapiens
atggaatttttctg

SEQ ID NO: 5573506 - DNA, 21 bp, Homo sapiens
atggaattttttcctgctagt

SEQ ID NO: 5573507 - DNA, 17 bp, Homo sapiens
atggaattttttgaata

SEQ ID NO: 5573508 - DNA, 17 bp, Homo sapiens
atggacaaaggcctggc

SEQ ID NO: 5573509 - DNA, 17 bp, Homo sapiens
atggacaaagttctgta

SEQ ID NO: 5573510 - DNA, 16 bp, Homo sapiens
atggacaaataagttt

SEQ ID NO: 5573511 - DNA, 20 bp, Homo sapiens
atggacaacttatttaaaaa

SEQ ID NO: 5573512 - DNA, 13 bp, Homo sapiens
atggacaatggac

SEQ ID NO: 5573513 - DNA, 15 bp, Homo sapiens
atggacaatggaccg

SEQ ID NO: 5573514 - DNA, 16 bp, Homo sapiens
atggacaatttaccac

SEQ ID NO: 5573515 - DNA, 13 bp, Homo sapiens
atggacacaaaaa

SEQ ID NO: 5573516 - DNA, 15 bp, Homo sapiens
atggacacaaatttt

SEQ ID NO: 5573517 - DNA, 17 bp, Homo sapiens
atggacacattttctcc

SEQ ID NO: 5573518 - DNA, 18 bp, Homo sapiens
atggacacattttctcct

SEQ ID NO: 5573519 - DNA, 16 bp, Homo sapiens
atggacacgagccaca

SEQ ID NO: 5573520 - DNA, 17 bp, Homo sapiens
atggacacgagccacaa

SEQ ID NO: 5573521 - DNA, 16 bp, Homo sapiens
atggacactaatgcag

SEQ ID NO: 5573522 - DNA, 11 bp, Homo sapiens
atggacactcc

SEQ ID NO: 5573523 - DNA, 15 bp, Homo sapiens
atggacactccagtg

SEQ ID NO: 5573524 - DNA, 20 bp, Homo sapiens
atggacactgccttagcctc

SEQ ID NO: 5573525 - DNA, 22 bp, Homo sapiens
atggacactgccttagcctctt

SEQ ID NO: 5573526 - DNA, 17 bp, Homo sapiens
atggacactgtgacaat

SEQ ID NO: 5573527 - DNA, 23 bp, Homo sapiens
atggacactttgaaatgtgtttc

SEQ ID NO: 5573528 - DNA, 19 bp, Homo sapiens
atggacagaagaaggcagc

SEQ ID NO: 5573529 - DNA, 16 bp, Homo sapiens
atggacagacacctcc

SEQ ID NO: 5573530 - DNA, 17 bp, Homo sapiens
atggacagatggaccaa

SEQ ID NO: 5573531 - DNA, 19 bp, Homo sapiens
atggacagatggaccaaaa

SEQ ID NO: 5573532 - DNA, 16 bp, Homo sapiens
atggacagattaatat

SEQ ID NO: 5573533 - DNA, 15 bp, Homo sapiens
atggacagctgagca

SEQ ID NO: 5573534 - DNA, 19 bp, Homo sapiens
atggacagctttattttaa

SEQ ID NO: 5573535 - DNA, 23 bp, Homo sapiens
atggacaggatggggttctggaa

SEQ ID NO: 5573536 - DNA, 19 bp, Homo sapiens
atggacaggctggctccag

SEQ ID NO: 5573537 - DNA, 14 bp, Homo sapiens
atggacagggccag

SEQ ID NO: 5573538 - DNA, 15 bp, Homo sapiens
atggacagggccagg

SEQ ID NO: 5573539 - DNA, 16 bp, Homo sapiens
atggacagttagcatt

SEQ ID NO: 5573540 - DNA, 18 bp, Homo sapiens
atggacagttcacaccct

SEQ ID NO: 5573541 - DNA, 17 bp, Homo sapiens
atggacagtttgtttcc

SEQ ID NO: 5573542 - DNA, 20 bp, Homo sapiens
atggacagtttgtttcctgt

SEQ ID NO: 5573543 - DNA, 13 bp, Homo sapiens
atggacatcctgt

SEQ ID NO: 5573544 - DNA, 20 bp, Homo sapiens
atggacatcctgtataagca

SEQ ID NO: 5573545 - DNA, 19 bp, Homo sapiens
atggacatcttgtcatttt

SEQ ID NO: 5573546 - DNA, 19 bp, Homo sapiens
atggacatgatcttcttta

SEQ ID NO: 5573547 - DNA, 14 bp, Homo sapiens
atggacatggtggc

SEQ ID NO: 5573548 - DNA, 20 bp, Homo sapiens
atggacatgtaaaaagacaa

SEQ ID NO: 5573549 - DNA, 20 bp, Homo sapiens
atggacatttagaagaaaga

SEQ ID NO: 5573550 - DNA, 21 bp, Homo sapiens
atggaccaaaagatgggtggt

SEQ ID NO: 5573551 - DNA, 23 bp, Homo sapiens
atggaccaaagccacctgctgcg

SEQ ID NO: 5573552 - DNA, 15 bp, Homo sapiens
atggaccaaatgtaa

SEQ ID NO: 5573553 - DNA, 17 bp, Homo sapiens
atggaccaacctgctct

SEQ ID NO: 5573554 - DNA, 20 bp, Homo sapiens
atggaccaacctgctctgtc

SEQ ID NO: 5573555 - DNA, 22 bp, Homo sapiens
atggaccaacctgctctgtccc

SEQ ID NO: 5573556 - DNA, 16 bp, Homo sapiens
atggaccagtggctgg

SEQ ID NO: 5573557 - DNA, 20 bp, Homo sapiens
atggacccaagataaaagaa

SEQ ID NO: 5573558 - DNA, 14 bp, Homo sapiens
atggacccactacc

SEQ ID NO: 5573559 - DNA, 14 bp, Homo sapiens
atggaccccagcat

SEQ ID NO: 5573560 - DNA, 15 bp, Homo sapiens
atggaccctcgcagc

SEQ ID NO: 5573561 - DNA, 21 bp, Homo sapiens
atggaccctctcctggactcg

SEQ ID NO: 5573562 - DNA, 16 bp, Homo sapiens
atggaccggagagtgg

SEQ ID NO: 5573563 - DNA, 20 bp, Homo sapiens
atggaccgggtgggcctggc

SEQ ID NO: 5573564 - DNA, 15 bp, Homo sapiens
atggacctaacattc

SEQ ID NO: 5573565 - DNA, 15 bp, Homo sapiens
atggacctagcttga

SEQ ID NO: 5573566 - DNA, 16 bp, Homo sapiens
atggacctagcttgag

SEQ ID NO: 5573567 - DNA, 14 bp, Homo sapiens
atggacctcagcaa

SEQ ID NO: 5573568 - DNA, 20 bp, Homo sapiens
atggacctcagcaagctgcc

SEQ ID NO: 5573569 - DNA, 18 bp, Homo sapiens
atggacctccaggctcca

SEQ ID NO: 5573570 - DNA, 16 bp, Homo sapiens
atggaccttctctcca

SEQ ID NO: 5573571 - DNA, 14 bp, Homo sapiens
atggacgaatatga

SEQ ID NO: 5573572 - DNA, 18 bp, Homo sapiens
atggacgaatatgaatgt

SEQ ID NO: 5573573 - DNA, 18 bp, Homo sapiens
atggacgacctccagctc

SEQ ID NO: 5573574 - DNA, 20 bp, Homo sapiens
atggacgagtgagctaccag

SEQ ID NO: 5573575 - DNA, 20 bp, Homo sapiens
atggacgcaggccctgtcca

SEQ ID NO: 5573576 - DNA, 22 bp, Homo sapiens
atggacggccccgtcagccaca

SEQ ID NO: 5573577 - DNA, 22 bp, Homo sapiens
atggacggtgctccaggcaggc

SEQ ID NO: 5573578 - DNA, 23 bp, Homo sapiens
atggacgtgttatgactccagaa

SEQ ID NO: 5573579 - DNA, 17 bp, Homo sapiens
atggactatacatacta

SEQ ID NO: 5573580 - DNA, 21 bp, Homo sapiens
atggactcatggcttagaaat

SEQ ID NO: 5573581 - DNA, 14 bp, Homo sapiens
atggactctgtcct

SEQ ID NO: 5573582 - DNA, 17 bp, Homo sapiens
atggactcttcccccac

SEQ ID NO: 5573583 - DNA, 12 bp, Homo sapiens
atggactggcca

SEQ ID NO: 5573584 - DNA, 14 bp, Homo sapiens
atggactgggagga

SEQ ID NO: 5573585 - DNA, 22 bp, Homo sapiens
atggactggggagcacaggtgt

SEQ ID NO: 5573586 - DNA, 15 bp, Homo sapiens
atggactggtttgag

SEQ ID NO: 5573587 - DNA, 19 bp, Homo sapiens
atggactgttcatttgaaa

SEQ ID NO: 5573588 - DNA, 13 bp, Homo sapiens
atggactgttgcc

SEQ ID NO: 5573589 - DNA, 13 bp, Homo sapiens
atggacttgaaaa

SEQ ID NO: 5573590 - DNA, 18 bp, Homo sapiens
atggctggggccgctggg

SEQ ID NO: 5573591 - DNA, 11 bp, Homo sapiens
atggctggggg

SEQ ID NO: 5573592 - DNA, 20 bp, Homo sapiens
atggctggggggtctcagca

SEQ ID NO: 5573593 - DNA, 19 bp, Homo sapiens
atggctgggtcagggccag

SEQ ID NO: 5573594 - DNA, 23 bp, Homo sapiens
atggctgggtccttgggcctggc

SEQ ID NO: 5573595 - DNA, 16 bp, Homo sapiens
atggctgggtttgggc

SEQ ID NO: 5573596 - DNA, 21 bp, Homo sapiens
atggctgtcccctgcaagtgg

SEQ ID NO: 5573597 - DNA, 12 bp, Homo sapiens
atggctgtcctt

SEQ ID NO: 5573598 - DNA, 14 bp, Homo sapiens
atggctgtgaaaat

SEQ ID NO: 5573599 - DNA, 20 bp, Homo sapiens
atggctgtgaaaattacacc

SEQ ID NO: 5573600 - DNA, 15 bp, Homo sapiens
atggctgtgaggatg

SEQ ID NO: 5573601 - DNA, 15 bp, Homo sapiens
atggctgtgcctctg

SEQ ID NO: 5573602 - DNA, 21 bp, Homo sapiens
atggctgtgtttgcagcctgc

SEQ ID NO: 5573603 - DNA, 17 bp, Homo sapiens
atggctgttatctgtct

SEQ ID NO: 5573604 - DNA, 23 bp, Homo sapiens
atggcttaaaaatacttaataaa

SEQ ID NO: 5573605 - DNA, 14 bp, Homo sapiens
atggcttaatctta

SEQ ID NO: 5573606 - DNA, 16 bp, Homo sapiens
atggcttacttacaaa

SEQ ID NO: 5573607 - DNA, 13 bp, Homo sapiens
atggcttaggaat

SEQ ID NO: 5573608 - DNA, 18 bp, Homo sapiens
atggcttatccagctggt

SEQ ID NO: 5573609 - DNA, 16 bp, Homo sapiens
atggcttattgtgtga

SEQ ID NO: 5573610 - DNA, 23 bp, Homo sapiens
atggcttcccatctgtggttttc

SEQ ID NO: 5573611 - DNA, 21 bp, Homo sapiens
atggcttccccattgccttct

SEQ ID NO: 5573612 - DNA, 20 bp, Homo sapiens
atggcttccgtgagacacaa

SEQ ID NO: 5573613 - DNA, 16 bp, Homo sapiens
atggcttcctcctccc

SEQ ID NO: 5573614 - DNA, 19 bp, Homo sapiens
atggcttcctcctccctcc

SEQ ID NO: 5573615 - DNA, 17 bp, Homo sapiens
atggcttcggagggccg

SEQ ID NO: 5573616 - DNA, 17 bp, Homo sapiens
atggcttctatgatcag

SEQ ID NO: 5573617 - DNA, 13 bp, Homo sapiens
atggcttggggag

SEQ ID NO: 5573618 - DNA, 18 bp, Homo sapiens
atggcttgtagggtgagg

SEQ ID NO: 5573619 - DNA, 15 bp, Homo sapiens
atggcttgtgaactg

SEQ ID NO: 5573620 - DNA, 17 bp, Homo sapiens
atggcttgtgaactgct

SEQ ID NO: 5573621 - DNA, 19 bp, Homo sapiens
atggcttgtgaactgctgg

SEQ ID NO: 5573622 - DNA, 14 bp, Homo sapiens
atggcttgttcatc

SEQ ID NO: 5573623 - DNA, 16 bp, Homo sapiens
atggcttgttctctgg

SEQ ID NO: 5573624 - DNA, 20 bp, Homo sapiens
atggctttaaactaccctcc

SEQ ID NO: 5573625 - DNA, 21 bp, Homo sapiens
atggctttcagaaaacgggaa

SEQ ID NO: 5573626 - DNA, 17 bp, Homo sapiens
atggctttcatcctgtg

SEQ ID NO: 5573627 - DNA, 18 bp, Homo sapiens
atggctttcatcctgtgt

SEQ ID NO: 5573628 - DNA, 15 bp, Homo sapiens
atggctttgtataga

SEQ ID NO: 5573629 - DNA, 16 bp, Homo sapiens
atggctttgtatagaa

SEQ ID NO: 5573630 - DNA, 18 bp, Homo sapiens
atggctttgtatagaacc

SEQ ID NO: 5573631 - DNA, 19 bp, Homo sapiens
atggctttgtatagaacct

SEQ ID NO: 5573632 - DNA, 18 bp, Homo sapiens
atggctttgtcttgaaaa

SEQ ID NO: 5573633 - DNA, 21 bp, Homo sapiens
atggctttgtcttgaaaaaaa

SEQ ID NO: 5573634 - DNA, 14 bp, Homo sapiens
atggctttgtgctg

SEQ ID NO: 5573635 - DNA, 22 bp, Homo sapiens
atggcttttcccaacccccagc

SEQ ID NO: 5573636 - DNA, 12 bp, Homo sapiens
atggcttttctc

SEQ ID NO: 5573637 - DNA, 20 bp, Homo sapiens
atggcttttcttacccagat

SEQ ID NO: 5573638 - DNA, 20 bp, Homo sapiens
atggcttttgtttcttccct

SEQ ID NO: 5573639 - DNA, 22 bp, Homo sapiens
atggctttttctttttttgcat

SEQ ID NO: 5573640 - DNA, 15 bp, Homo sapiens
atgggaaaaaaacaa

SEQ ID NO: 5573641 - DNA, 16 bp, Homo sapiens
atgggaaaaaaacaaa

SEQ ID NO: 5573642 - DNA, 19 bp, Homo sapiens
atgggaaaaaacttaaaaa

SEQ ID NO: 5573643 - DNA, 18 bp, Homo sapiens
atgggaaaaactgcagtc

SEQ ID NO: 5573644 - DNA, 17 bp, Homo sapiens
atgggaaaaaggctgga

SEQ ID NO: 5573645 - DNA, 20 bp, Homo sapiens
atgggaaaaatctaaaatgt

SEQ ID NO: 5573646 - DNA, 22 bp, Homo sapiens
atgggaaaaatctaaaatgtgt

SEQ ID NO: 5573647 - DNA, 18 bp, Homo sapiens
atgggaaaactgccaata

SEQ ID NO: 5573648 - DNA, 15 bp, Homo sapiens
atgggaaaacttcac

SEQ ID NO: 5573649 - DNA, 12 bp, Homo sapiens
atgggaaaagag

SEQ ID NO: 5573650 - DNA, 14 bp, Homo sapiens
atgggaaaagagat

SEQ ID NO: 5573651 - DNA, 13 bp, Homo sapiens
atgggaaaatatt

SEQ ID NO: 5573652 - DNA, 14 bp, Homo sapiens
atgggaaaatattt

SEQ ID NO: 5573653 - DNA, 12 bp, Homo sapiens
atgggaaacaaa

SEQ ID NO: 5573654 - DNA, 23 bp, Homo sapiens
atgggaaactgcttttccacaag

SEQ ID NO: 5573655 - DNA, 23 bp, Homo sapiens
atgggaaagaccctaggtgctca

SEQ ID NO: 5573656 - DNA, 18 bp, Homo sapiens
atgggaaagccacctctc

SEQ ID NO: 5573657 - DNA, 13 bp, Homo sapiens
atgggaaagtatt

SEQ ID NO: 5573658 - DNA, 20 bp, Homo sapiens
atgggaaagtatttttgaaa

SEQ ID NO: 5573659 - DNA, 11 bp, Homo sapiens
atgggaaatag

SEQ ID NO: 5573660 - DNA, 17 bp, Homo sapiens
atgggaaatagcggccc

SEQ ID NO: 5573661 - DNA, 14 bp, Homo sapiens
atgggaaatagtct

SEQ ID NO: 5573662 - DNA, 15 bp, Homo sapiens
atgggaaatagtctg

SEQ ID NO: 5573663 - DNA, 14 bp, Homo sapiens
atgggaaatgagcc

SEQ ID NO: 5573664 - DNA, 16 bp, Homo sapiens
atgggaaatgagccag

SEQ ID NO: 5573665 - DNA, 21 bp, Homo sapiens
atgggaacactggcagactgt

SEQ ID NO: 5573666 - DNA, 23 bp, Homo sapiens
atgggaacagtaaagaaagcaga

SEQ ID NO: 5573667 - DNA, 18 bp, Homo sapiens
atgggaactgaattgtgt

SEQ ID NO: 5573668 - DNA, 14 bp, Homo sapiens
atgggaagactcag

SEQ ID NO: 5573669 - DNA, 15 bp, Homo sapiens
atgggaagatggtag

SEQ ID NO: 5573670 - DNA, 18 bp, Homo sapiens
atgggaagatggtagcag

SEQ ID NO: 5573671 - DNA, 15 bp, Homo sapiens
atgggaagcaggacc

SEQ ID NO: 5573672 - DNA, 12 bp, Homo sapiens
atgggaagccat

SEQ ID NO: 5573673 - DNA, 16 bp, Homo sapiens
atgggaaggaggggag

SEQ ID NO: 5573674 - DNA, 13 bp, Homo sapiens
atgggaagggctt

SEQ ID NO: 5573675 - DNA, 14 bp, Homo sapiens
atgggaagggtaga

SEQ ID NO: 5573676 - DNA, 17 bp, Homo sapiens
atgggaataattgcttt

SEQ ID NO: 5573677 - DNA, 19 bp, Homo sapiens
atgggaatagggagacagg

SEQ ID NO: 5573678 - DNA, 22 bp, Homo sapiens
atgggaatataatattgtctct

SEQ ID NO: 5573679 - DNA, 16 bp, Homo sapiens
atgggaatcattccac

SEQ ID NO: 5573680 - DNA, 21 bp, Homo sapiens
atgggaatgaagcttgtgtat

SEQ ID NO: 5573681 - DNA, 15 bp, Homo sapiens
atgggaatgaatgtc

SEQ ID NO: 5573682 - DNA, 21 bp, Homo sapiens
atgggaatgaatgtcagtgtg

SEQ ID NO: 5573683 - DNA, 17 bp, Homo sapiens
atgggaatgaggtggga

SEQ ID NO: 5573684 - DNA, 19 bp, Homo sapiens
atgggaattgcgctcaggg

SEQ ID NO: 5573685 - DNA, 15 bp, Homo sapiens
atgggaatttgtcag

SEQ ID NO: 5573686 - DNA, 17 bp, Homo sapiens
atgggaattttaacttt

SEQ ID NO: 5573687 - DNA, 20 bp, Homo sapiens
atgggacattagcattgagt

SEQ ID NO: 5573688 - DNA, 13 bp, Homo sapiens
atgggacattttt

SEQ ID NO: 5573689 - DNA, 20 bp, Homo sapiens
atgggacccaagtctgaacg

SEQ ID NO: 5573690 - DNA, 19 bp, Homo sapiens
atgggaccgtgccccacct

SEQ ID NO: 5573691 - DNA, 22 bp, Homo sapiens
atgggacctataactgcccagc

SEQ ID NO: 5573692 - DNA, 12 bp, Homo sapiens
atgggacctggc

SEQ ID NO: 5573693 - DNA, 15 bp, Homo sapiens
atgggacgaggacat

SEQ ID NO: 5573694 - DNA, 17 bp, Homo sapiens
atgggacggaggtcctt

SEQ ID NO: 5573695 - DNA, 18 bp, Homo sapiens
atgggactcattgtagaa

SEQ ID NO: 5573696 - DNA, 18 bp, Homo sapiens
atgggactctgaactgga

SEQ ID NO: 5573697 - DNA, 16 bp, Homo sapiens
atgggactgggagggc

SEQ ID NO: 5573698 - DNA, 13 bp, Homo sapiens
atgggacttcttt

SEQ ID NO: 5573699 - DNA, 20 bp, Homo sapiens
atgggacttcttttcacatt

SEQ ID NO: 5573700 - DNA, 23 bp, Homo sapiens
atgggactttccttccctctcct

SEQ ID NO: 5573701 - DNA, 22 bp, Homo sapiens
atgggagaagaggggtatagga

SEQ ID NO: 5573702 - DNA, 22 bp, Homo sapiens
atgggagaatcagcagaacctg

SEQ ID NO: 5573703 - DNA, 22 bp, Homo sapiens
atgggagacaatttcacatgga

SEQ ID NO: 5573704 - DNA, 14 bp, Homo sapiens
atgggagagtcaag

SEQ ID NO: 5573705 - DNA, 14 bp, Homo sapiens
atgggagagtccag

SEQ ID NO: 5573706 - DNA, 18 bp, Homo sapiens
atgggagagtccaggcct

SEQ ID NO: 5573707 - DNA, 14 bp, Homo sapiens
atgggagcaacata

SEQ ID NO: 5573708 - DNA, 13 bp, Homo sapiens
atgggagccagga

SEQ ID NO: 5573709 - DNA, 14 bp, Homo sapiens
atgggagccaggag

SEQ ID NO: 5573710 - DNA, 12 bp, Homo sapiens
atgggagccggg

SEQ ID NO: 5573711 - DNA, 19 bp, Homo sapiens
atgggagctcctctcctgg

SEQ ID NO: 5573712 - DNA, 23 bp, Homo sapiens
atgggagctcctctcctggagga

SEQ ID NO: 5573713 - DNA, 21 bp, Homo sapiens
atgggagctggttagaaatgc

SEQ ID NO: 5573714 - DNA, 22 bp, Homo sapiens
atgggagctggttagaaatgca

SEQ ID NO: 5573715 - DNA, 20 bp, Homo sapiens
atgggaggaaaagcccagga

SEQ ID NO: 5573716 - DNA, 19 bp, Homo sapiens
atgggaggaaggcccaggg

SEQ ID NO: 5573717 - DNA, 20 bp, Homo sapiens
atgggaggaaggcccagggg

SEQ ID NO: 5573718 - DNA, 23 bp, Homo sapiens
atgggaggagagccactgggccc

SEQ ID NO: 5573719 - DNA, 13 bp, Homo sapiens
atgggaggaggaa

SEQ ID NO: 5573720 - DNA, 13 bp, Homo sapiens
atgggaggcagcc

SEQ ID NO: 5573721 - DNA, 17 bp, Homo sapiens
atgggaggctcctggtg

SEQ ID NO: 5573722 - DNA, 17 bp, Homo sapiens
atgggaggcttgctgaa

SEQ ID NO: 5573723 - DNA, 13 bp, Homo sapiens
atgggagggagct

SEQ ID NO: 5573724 - DNA, 18 bp, Homo sapiens
atgggagggaggctcagg

SEQ ID NO: 5573725 - DNA, 19 bp, Homo sapiens
atgggagggagggagaggt

SEQ ID NO: 5573726 - DNA, 20 bp, Homo sapiens
atgggagggggcttgaagcc

SEQ ID NO: 5573727 - DNA, 22 bp, Homo sapiens
atgggaggtggaagcagaggcc

SEQ ID NO: 5573728 - DNA, 23 bp, Homo sapiens
atgggaggtggaagcagaggccc

SEQ ID NO: 5573729 - DNA, 18 bp, Homo sapiens
atgggaggtggggcctca

SEQ ID NO: 5573730 - DNA, 17 bp, Homo sapiens
atgggagtgaacatttc

SEQ ID NO: 5573731 - DNA, 18 bp, Homo sapiens
atgggagtgaacatttct

SEQ ID NO: 5573732 - DNA, 13 bp, Homo sapiens
atgggagtgggca

SEQ ID NO: 5573733 - DNA, 15 bp, Homo sapiens
atgggagtgggcacc

SEQ ID NO: 5573734 - DNA, 14 bp, Homo sapiens
atgggataaatgcc

SEQ ID NO: 5573735 - DNA, 17 bp, Homo sapiens
atgggatacaacctccc

SEQ ID NO: 5573736 - DNA, 21 bp, Homo sapiens
atgggatacaacctccctctt

SEQ ID NO: 5573737 - DNA, 17 bp, Homo sapiens
atgggatcatttttcca

SEQ ID NO: 5573738 - DNA, 23 bp, Homo sapiens
atgggatctgtaaggaactggaa

SEQ ID NO: 5573739 - DNA, 22 bp, Homo sapiens
atgggatggtcggatctcacag

SEQ ID NO: 5573740 - DNA, 21 bp, Homo sapiens
atgggatgtatgaatacagca

SEQ ID NO: 5573741 - DNA, 21 bp, Homo sapiens
atgggatgtgctgttttctgt

SEQ ID NO: 5573742 - DNA, 22 bp, Homo sapiens
atgggattagattcatctatgg

SEQ ID NO: 5573743 - DNA, 13 bp, Homo sapiens
atgggatttcatg

SEQ ID NO: 5573744 - DNA, 14 bp, Homo sapiens
atgggcaaaactga

SEQ ID NO: 5573745 - DNA, 20 bp, Homo sapiens
atgggcaaagcttgtcaaag

SEQ ID NO: 5573746 - DNA, 20 bp, Homo sapiens
atgggcaattctgacttctc

SEQ ID NO: 5573747 - DNA, 22 bp, Homo sapiens
atgggcaattctgacttctccc

SEQ ID NO: 5573748 - DNA, 18 bp, Homo sapiens
atgggcacaaagggccca

SEQ ID NO: 5573749 - DNA, 18 bp, Homo sapiens
atgggcacaatcttggtc

SEQ ID NO: 5573750 - DNA, 14 bp, Homo sapiens
atgggcacacacac

SEQ ID NO: 5573751 - DNA, 15 bp, Homo sapiens
atgggcacctcatgg

SEQ ID NO: 5573752 - DNA, 17 bp, Homo sapiens
atgggcacctctgctgt

SEQ ID NO: 5573753 - DNA, 14 bp, Homo sapiens
atgggcactgctgg

SEQ ID NO: 5573754 - DNA, 12 bp, Homo sapiens
atgggcagccca

SEQ ID NO: 5573755 - DNA, 22 bp, Homo sapiens
atgggcagcccaaagctgcagg

SEQ ID NO: 5573756 - DNA, 18 bp, Homo sapiens
atgggcagctccatcctc

SEQ ID NO: 5573757 - DNA, 19 bp, Homo sapiens
atgggcagctccatcctct

SEQ ID NO: 5573758 - DNA, 13 bp, Homo sapiens
atgggcagctggg

SEQ ID NO: 5573759 - DNA, 15 bp, Homo sapiens
atgggcagctggggg

SEQ ID NO: 5573760 - DNA, 13 bp, Homo sapiens
atgggcaggagac

SEQ ID NO: 5573761 - DNA, 12 bp, Homo sapiens
atgggcaggtgg

SEQ ID NO: 5573762 - DNA, 15 bp, Homo sapiens
atgggcaggtggcct

SEQ ID NO: 5573763 - DNA, 24 bp, Homo sapiens
atgggcaggtggcctctgctggtc

SEQ ID NO: 5573764 - DNA, 15 bp, Homo sapiens
atgggcagtgcctcc

SEQ ID NO: 5573765 - DNA, 15 bp, Homo sapiens
atgggcagttctccc

SEQ ID NO: 5573766 - DNA, 21 bp, Homo sapiens
atgggcagttctcccagggag

SEQ ID NO: 5573767 - DNA, 22 bp, Homo sapiens
atgggcagttctcccagggagt

SEQ ID NO: 5573768 - DNA, 16 bp, Homo sapiens
atgggtatgctcaggt

SEQ ID NO: 5573769 - DNA, 14 bp, Homo sapiens
atgggtcacaggaa

SEQ ID NO: 5573770 - DNA, 15 bp, Homo sapiens
atgggtcagggtgtg

SEQ ID NO: 5573771 - DNA, 15 bp, Homo sapiens
atgggtcatgacaag

SEQ ID NO: 5573772 - DNA, 17 bp, Homo sapiens
atgggtccaagagacat

SEQ ID NO: 5573773 - DNA, 14 bp, Homo sapiens
atgggtccagaaga

SEQ ID NO: 5573774 - DNA, 12 bp, Homo sapiens
atgggtccaggg

SEQ ID NO: 5573775 - DNA, 14 bp, Homo sapiens
atgggtccagggcc

SEQ ID NO: 5573776 - DNA, 22 bp, Homo sapiens
atgggtccaggggtctgtctgc

SEQ ID NO: 5573777 - DNA, 13 bp, Homo sapiens
atgggtcccctcc

SEQ ID NO: 5573778 - DNA, 20 bp, Homo sapiens
atgggtcccgggttagcctg

SEQ ID NO: 5573779 - DNA, 22 bp, Homo sapiens
atgggtcccttccccctgctcc

SEQ ID NO: 5573780 - DNA, 15 bp, Homo sapiens
atgggtcctcggccc

SEQ ID NO: 5573781 - DNA, 19 bp, Homo sapiens
atgggtcctcggcccatct

SEQ ID NO: 5573782 - DNA, 13 bp, Homo sapiens
atgggtcctgcaa

SEQ ID NO: 5573783 - DNA, 13 bp, Homo sapiens
atgggtcgggaga

SEQ ID NO: 5573784 - DNA, 19 bp, Homo sapiens
atgggtcttagctctttct

SEQ ID NO: 5573785 - DNA, 15 bp, Homo sapiens
atgggtgaaggctgg

SEQ ID NO: 5573786 - DNA, 20 bp, Homo sapiens
atgggtgattatgaaatgcc

SEQ ID NO: 5573787 - DNA, 16 bp, Homo sapiens
atgggtgctatcagag

SEQ ID NO: 5573788 - DNA, 13 bp, Homo sapiens
atgggtgctgccc

SEQ ID NO: 5573789 - DNA, 15 bp, Homo sapiens
atgggtgctggcaga

SEQ ID NO: 5573790 - DNA, 13 bp, Homo sapiens
atgggtggaaagg

SEQ ID NO: 5573791 - DNA, 23 bp, Homo sapiens
atgggtggcaccaaccttgctgg

SEQ ID NO: 5573792 - DNA, 17 bp, Homo sapiens
atgggtggtaacaagag

SEQ ID NO: 5573793 - DNA, 16 bp, Homo sapiens
atgggtgtcccctggt

SEQ ID NO: 5573794 - DNA, 19 bp, Homo sapiens
atgggtgtcccctggtgcc

SEQ ID NO: 5573795 - DNA, 14 bp, Homo sapiens
atgggtgtgggagt

SEQ ID NO: 5573796 - DNA, 13 bp, Homo sapiens
atgggtgtgtgtt

SEQ ID NO: 5573797 - DNA, 22 bp, Homo sapiens
atgggttagggaaaacattcca

SEQ ID NO: 5573798 - DNA, 23 bp, Homo sapiens
atgggttatttttattaaatgta

SEQ ID NO: 5573799 - DNA, 13 bp, Homo sapiens
atgggttccagag

SEQ ID NO: 5573800 - DNA, 14 bp, Homo sapiens
atgggttccagagg

SEQ ID NO: 5573801 - DNA, 22 bp, Homo sapiens
atgggttcctcccttcttctga

SEQ ID NO: 5573802 - DNA, 15 bp, Homo sapiens
atgggttctcagtgg

SEQ ID NO: 5573803 - DNA, 21 bp, Homo sapiens
atgggtttattttcattctgc

SEQ ID NO: 5573804 - DNA, 16 bp, Homo sapiens
atgggttttatgagat

SEQ ID NO: 5573805 - DNA, 21 bp, Homo sapiens
atggtaaagccatgttaaatg

SEQ ID NO: 5573806 - DNA, 15 bp, Homo sapiens
atggtaaataactgt

SEQ ID NO: 5573807 - DNA, 23 bp, Homo sapiens
atggtaacactttgctttctgaa

SEQ ID NO: 5573808 - DNA, 13 bp, Homo sapiens
atggtaacagatt

SEQ ID NO: 5573809 - DNA, 22 bp, Homo sapiens
atggtaaccagccacagtacat

SEQ ID NO: 5573810 - DNA, 17 bp, Homo sapiens
atggtaagactgtaatt

SEQ ID NO: 5573811 - DNA, 20 bp, Homo sapiens
atggtaatagaatagcacag

SEQ ID NO: 5573812 - DNA, 21 bp, Homo sapiens
atggtaattcacttcagttta

SEQ ID NO: 5573813 - DNA, 14 bp, Homo sapiens
atggtaattgttgc

SEQ ID NO: 5573814 - DNA, 14 bp, Homo sapiens
atggtactacccca

SEQ ID NO: 5573815 - DNA, 13 bp, Homo sapiens
atggtactattta

SEQ ID NO: 5573816 - DNA, 22 bp, Homo sapiens
atggtactcccaaactgacaat

SEQ ID NO: 5573817 - DNA, 13 bp, Homo sapiens
atggtacttcctc

SEQ ID NO: 5573818 - DNA, 13 bp, Homo sapiens
atggtagaaaaat

SEQ ID NO: 5573819 - DNA, 18 bp, Homo sapiens
atggtagaaaaatttcac

SEQ ID NO: 5573820 - DNA, 13 bp, Homo sapiens
atggtagaaactt

SEQ ID NO: 5573821 - DNA, 21 bp, Homo sapiens
atggtagaaactttggaagtt

SEQ ID NO: 5573822 - DNA, 23 bp, Homo sapiens
atggtagaaattttatctcttct

SEQ ID NO: 5573823 - DNA, 14 bp, Homo sapiens
atggtagaagtgag

SEQ ID NO: 5573824 - DNA, 13 bp, Homo sapiens
atggtagaccttt

SEQ ID NO: 5573825 - DNA, 16 bp, Homo sapiens
atggtagactgtgaca

SEQ ID NO: 5573826 - DNA, 15 bp, Homo sapiens
atggtagagagagtt

SEQ ID NO: 5573827 - DNA, 12 bp, Homo sapiens
atggtagcagat

SEQ ID NO: 5573828 - DNA, 23 bp, Homo sapiens
atggtagcattttaaacaaaata

SEQ ID NO: 5573829 - DNA, 24 bp, Homo sapiens
atggtagctgaaaaaactatattt

SEQ ID NO: 5573830 - DNA, 19 bp, Homo sapiens
atggtaggaagaagctctc

SEQ ID NO: 5573831 - DNA, 19 bp, Homo sapiens
atggtaggaccctcgagag

SEQ ID NO: 5573832 - DNA, 23 bp, Homo sapiens
atggtaggaccctcgagagcctt

SEQ ID NO: 5573833 - DNA, 17 bp, Homo sapiens
atggtaggcatttccta

SEQ ID NO: 5573834 - DNA, 15 bp, Homo sapiens
atggtagggagagac

SEQ ID NO: 5573835 - DNA, 19 bp, Homo sapiens
atggtaggggcttaaaaga

SEQ ID NO: 5573836 - DNA, 21 bp, Homo sapiens
atggtagtctaaccaaatgca

SEQ ID NO: 5573837 - DNA, 22 bp, Homo sapiens
atggtagtctaaccaaatgcat

SEQ ID NO: 5573838 - DNA, 14 bp, Homo sapiens
atggtagtggcaaa

SEQ ID NO: 5573839 - DNA, 19 bp, Homo sapiens
atggtagttattctgcctt

SEQ ID NO: 5573840 - DNA, 22 bp, Homo sapiens
atggtagtttctgtggttggct

SEQ ID NO: 5573841 - DNA, 15 bp, Homo sapiens
atggtagttttacag

SEQ ID NO: 5573842 - DNA, 17 bp, Homo sapiens
atggtagttttttcatc

SEQ ID NO: 5573843 - DNA, 20 bp, Homo sapiens
atggtataaggaaatatcat

SEQ ID NO: 5573844 - DNA, 13 bp, Homo sapiens
atggtataattga

SEQ ID NO: 5573845 - DNA, 17 bp, Homo sapiens
atggtatatattttgaa

SEQ ID NO: 5573846 - DNA, 21 bp, Homo sapiens
atggtatcatattaacatatt

SEQ ID NO: 5573847 - DNA, 16 bp, Homo sapiens
atggtatcattacaat

SEQ ID NO: 5573848 - DNA, 15 bp, Homo sapiens
atggtatcctactga

SEQ ID NO: 5573849 - DNA, 18 bp, Homo sapiens
atggtatcctactgagca

SEQ ID NO: 5573850 - DNA, 21 bp, Homo sapiens
atggtatctgggtaagaagaa

SEQ ID NO: 5573851 - DNA, 16 bp, Homo sapiens
atggtatctgttactc

SEQ ID NO: 5573852 - DNA, 20 bp, Homo sapiens
atggtatgagctgagggggg

SEQ ID NO: 5573853 - DNA, 19 bp, Homo sapiens
atggtatgcacaattccat

SEQ ID NO: 5573854 - DNA, 22 bp, Homo sapiens
atggtatgcagcatacaaaaat

SEQ ID NO: 5573855 - DNA, 17 bp, Homo sapiens
atggtatgctggccagc

SEQ ID NO: 5573856 - DNA, 22 bp, Homo sapiens
atggtatgctggccagcaccct

SEQ ID NO: 5573857 - DNA, 20 bp, Homo sapiens
atggtatgtgagctaggaga

SEQ ID NO: 5573858 - DNA, 14 bp, Homo sapiens
atggtattgagaag

SEQ ID NO: 5573859 - DNA, 18 bp, Homo sapiens
atggtattgtaatgaata

SEQ ID NO: 5573860 - DNA, 22 bp, Homo sapiens
atggtattttcgtgcatttgtg

SEQ ID NO: 5573861 - DNA, 18 bp, Homo sapiens
atggtattttctagactg

SEQ ID NO: 5573862 - DNA, 20 bp, Homo sapiens
atggtcaaaaagtgatggct

SEQ ID NO: 5573863 - DNA, 12 bp, Homo sapiens
atggtcaagcct

SEQ ID NO: 5573864 - DNA, 17 bp, Homo sapiens
atggtcaagttcccaac

SEQ ID NO: 5573865 - DNA, 17 bp, Homo sapiens
atggtcaatatttgtaa

SEQ ID NO: 5573866 - DNA, 21 bp, Homo sapiens
atggtcaatgcagtttttatc

SEQ ID NO: 5573867 - DNA, 17 bp, Homo sapiens
atggtcacgcacctggg

SEQ ID NO: 5573868 - DNA, 24 bp, Homo sapiens
atggtcacgtttggtgcttctcag

SEQ ID NO: 5573869 - DNA, 18 bp, Homo sapiens
atggtcagacacaaacaa

SEQ ID NO: 5573870 - DNA, 18 bp, Homo sapiens
atggtcagccctagggtg

SEQ ID NO: 5573871 - DNA, 12 bp, Homo sapiens
atggtcagctcc

SEQ ID NO: 5573872 - DNA, 15 bp, Homo sapiens
atggtcatatttaaa

SEQ ID NO: 5573873 - DNA, 21 bp, Homo sapiens
atggtcatcaccacccttcca

SEQ ID NO: 5573874 - DNA, 22 bp, Homo sapiens
atggtcatctttttctctaaaa

SEQ ID NO: 5573875 - DNA, 20 bp, Homo sapiens
atggtccaattagtttcctt

SEQ ID NO: 5573876 - DNA, 12 bp, Homo sapiens
atggtccagaaa

SEQ ID NO: 5573877 - DNA, 19 bp, Homo sapiens
atggtccaggagaaggcca

SEQ ID NO: 5573878 - DNA, 17 bp, Homo sapiens
atggtccaggatctcca

SEQ ID NO: 5573879 - DNA, 22 bp, Homo sapiens
atggtccatcactattcaagga

SEQ ID NO: 5573880 - DNA, 18 bp, Homo sapiens
atggtccatcccctgagg

SEQ ID NO: 5573881 - DNA, 16 bp, Homo sapiens
atggtcccacctgtgc

SEQ ID NO: 5573882 - DNA, 21 bp, Homo sapiens
atggtcccacttccccatctg

SEQ ID NO: 5573883 - DNA, 20 bp, Homo sapiens
atggtcccaggaagcaggga

SEQ ID NO: 5573884 - DNA, 18 bp, Homo sapiens
atggtcccatccaggcag

SEQ ID NO: 5573885 - DNA, 19 bp, Homo sapiens
atggtcccatccaggcagt

SEQ ID NO: 5573886 - DNA, 20 bp, Homo sapiens
atggtcccatccaggcagtc

SEQ ID NO: 5573887 - DNA, 16 bp, Homo sapiens
atggtcccatctgcag

SEQ ID NO: 5573888 - DNA, 18 bp, Homo sapiens
atggtccgctttcctgga

SEQ ID NO: 5573889 - DNA, 16 bp, Homo sapiens
atggtccgtgcccagg

SEQ ID NO: 5573890 - DNA, 15 bp, Homo sapiens
atggtccgtgctaag

SEQ ID NO: 5573891 - DNA, 18 bp, Homo sapiens
atggtcctaaaagcaaaa

SEQ ID NO: 5573892 - DNA, 15 bp, Homo sapiens
atggtcctagacaaa

SEQ ID NO: 5573893 - DNA, 21 bp, Homo sapiens
atggtcctatttttgtgaaga

SEQ ID NO: 5573894 - DNA, 15 bp, Homo sapiens
atggtcctgaatgta

SEQ ID NO: 5573895 - DNA, 13 bp, Homo sapiens
atggtcctggctg

SEQ ID NO: 5573896 - DNA, 14 bp, Homo sapiens
atggtcctggggct

SEQ ID NO: 5573897 - DNA, 19 bp, Homo sapiens
atggtcctggggctctgtg

SEQ ID NO: 5573898 - DNA, 15 bp, Homo sapiens
atggtcgcccaggag

SEQ ID NO: 5573899 - DNA, 20 bp, Homo sapiens
atggtcggatctcacaggct

SEQ ID NO: 5573900 - DNA, 14 bp, Homo sapiens
atggtctcaatctc

SEQ ID NO: 5573901 - DNA, 14 bp, Homo sapiens
atggtctccacctg

SEQ ID NO: 5573902 - DNA, 14 bp, Homo sapiens
atggtctcttccag

SEQ ID NO: 5573903 - DNA, 21 bp, Homo sapiens
atggtctcttccagcccagac

SEQ ID NO: 5573904 - DNA, 21 bp, Homo sapiens
atggtctcttccctttgtgta

SEQ ID NO: 5573905 - DNA, 22 bp, Homo sapiens
atggtctcttccctttgtgtat

SEQ ID NO: 5573906 - DNA, 23 bp, Homo sapiens
atggtctcttccctttgtgtatc

SEQ ID NO: 5573907 - DNA, 16 bp, Homo sapiens
atggtctgagtggggc

SEQ ID NO: 5573908 - DNA, 22 bp, Homo sapiens
atggtctgagtggggcttcctg

SEQ ID NO: 5573909 - DNA, 18 bp, Homo sapiens
atggtctggatctcctga

SEQ ID NO: 5573910 - DNA, 20 bp, Homo sapiens
atggtctggatctcctgacc

SEQ ID NO: 5573911 - DNA, 15 bp, Homo sapiens
atggtcttacagcag

SEQ ID NO: 5573912 - DNA, 16 bp, Homo sapiens
atggtcttacagcagg

SEQ ID NO: 5573913 - DNA, 17 bp, Homo sapiens
atggtcttacagcaggc

SEQ ID NO: 5573914 - DNA, 15 bp, Homo sapiens
atggtcttacattgg

SEQ ID NO: 5573915 - DNA, 23 bp, Homo sapiens
atggtcttgagccagtaatcttt

SEQ ID NO: 5573916 - DNA, 17 bp, Homo sapiens
atggtcttgatctcctg

SEQ ID NO: 5573917 - DNA, 12 bp, Homo sapiens
atggtgaaaatg

SEQ ID NO: 5573918 - DNA, 19 bp, Homo sapiens
atggtgaaaccccgtctct

SEQ ID NO: 5573919 - DNA, 24 bp, Homo sapiens
atggtgaaaccccgtctctactaa

SEQ ID NO: 5573920 - DNA, 21 bp, Homo sapiens
atggtgaaacctggtctctac

SEQ ID NO: 5573921 - DNA, 16 bp, Homo sapiens
atggtgaactgtcatt

SEQ ID NO: 5573922 - DNA, 18 bp, Homo sapiens
atggtgaagtaacatgca

SEQ ID NO: 5573923 - DNA, 17 bp, Homo sapiens
atggtgaagtcacatta

SEQ ID NO: 5573924 - DNA, 17 bp, Homo sapiens
atggtgaatattacatt

SEQ ID NO: 5573925 - DNA, 14 bp, Homo sapiens
atggtgacacacag

SEQ ID NO: 5573926 - DNA, 16 bp, Homo sapiens
atggtgacagctgcaa

SEQ ID NO: 5573927 - DNA, 15 bp, Homo sapiens
atggtgacattgaaa

SEQ ID NO: 5573928 - DNA, 12 bp, Homo sapiens
atggtgacctct

SEQ ID NO: 5573929 - DNA, 13 bp, Homo sapiens
atggtgacctctc

SEQ ID NO: 5573930 - DNA, 23 bp, Homo sapiens
atggtgacctctccggcctggcc

SEQ ID NO: 5573931 - DNA, 13 bp, Homo sapiens
atggtgacttttt

SEQ ID NO: 5573932 - DNA, 17 bp, Homo sapiens
atggtgagaaaaatgta

SEQ ID NO: 5573933 - DNA, 17 bp, Homo sapiens
atggtgagaattaaaat

SEQ ID NO: 5573934 - DNA, 12 bp, Homo sapiens
atggtgaggctg

SEQ ID NO: 5573935 - DNA, 19 bp, Homo sapiens
atggtgagtctatttttaa

SEQ ID NO: 5573936 - DNA, 15 bp, Homo sapiens
atggtgatactccaa

SEQ ID NO: 5573937 - DNA, 23 bp, Homo sapiens
atggtgatcctctattttgtgat

SEQ ID NO: 5573938 - DNA, 18 bp, Homo sapiens
atggtgatgcaagtcact

SEQ ID NO: 5573939 - DNA, 19 bp, Homo sapiens
atggtgatgcagtcttaga

SEQ ID NO: 5573940 - DNA, 13 bp, Homo sapiens
atggtgatgttga

SEQ ID NO: 5573941 - DNA, 16 bp, Homo sapiens
atggtgatttcttgct

SEQ ID NO: 5573942 - DNA, 16 bp, Homo sapiens
atggtgattttaaatg

SEQ ID NO: 5573943 - DNA, 18 bp, Homo sapiens
atggtgcaaaaaaaaact

SEQ ID NO: 5573944 - DNA, 19 bp, Homo sapiens
atggtgcaatgacctttca

SEQ ID NO: 5573945 - DNA, 14 bp, Homo sapiens
atggtgcaatttgt

SEQ ID NO: 5573946 - DNA, 23 bp, Homo sapiens
atgtaatgttttctttgcaaagt

SEQ ID NO: 5573947 - DNA, 24 bp, Homo sapiens
atgtaatgtttttatttcaattgt

SEQ ID NO: 5573948 - DNA, 19 bp, Homo sapiens
atgtaattaaactgttaac

SEQ ID NO: 5573949 - DNA, 17 bp, Homo sapiens
atgtaattaacatatct

SEQ ID NO: 5573950 - DNA, 17 bp, Homo sapiens
atgtaattaagtactat

SEQ ID NO: 5573951 - DNA, 15 bp, Homo sapiens
atgtaattagctctg

SEQ ID NO: 5573952 - DNA, 19 bp, Homo sapiens
atgtaattagctctggggg

SEQ ID NO: 5573953 - DNA, 15 bp, Homo sapiens
atgtaattatatata

SEQ ID NO: 5573954 - DNA, 15 bp, Homo sapiens
atgtaattatttatg

SEQ ID NO: 5573955 - DNA, 15 bp, Homo sapiens
atgtaattcaggact

SEQ ID NO: 5573956 - DNA, 17 bp, Homo sapiens
atgtaattctcatgaaa

SEQ ID NO: 5573957 - DNA, 21 bp, Homo sapiens
atgtaattgtccctctgtggc

SEQ ID NO: 5573958 - DNA, 19 bp, Homo sapiens
atgtaatttaatgcctgcc

SEQ ID NO: 5573959 - DNA, 20 bp, Homo sapiens
atgtaatttaatgcctgccc

SEQ ID NO: 5573960 - DNA, 13 bp, Homo sapiens
atgtaatttagtc

SEQ ID NO: 5573961 - DNA, 22 bp, Homo sapiens
atgtaatttagtctaacacagt

SEQ ID NO: 5573962 - DNA, 16 bp, Homo sapiens
atgtaatttcaaaata

SEQ ID NO: 5573963 - DNA, 17 bp, Homo sapiens
atgtaatttcaaaatac

SEQ ID NO: 5573964 - DNA, 12 bp, Homo sapiens
atgtaatttcag

SEQ ID NO: 5573965 - DNA, 12 bp, Homo sapiens
atgtaatttctt

SEQ ID NO: 5573966 - DNA, 21 bp, Homo sapiens
atgtaatttgcattactctgg

SEQ ID NO: 5573967 - DNA, 16 bp, Homo sapiens
atgtaatttgtacagg

SEQ ID NO: 5573968 - DNA, 21 bp, Homo sapiens
atgtaatttgtacaggggcca

SEQ ID NO: 5573969 - DNA, 13 bp, Homo sapiens
atgtaatttgtgt

SEQ ID NO: 5573970 - DNA, 22 bp, Homo sapiens
atgtaatttgtttcccctagct

SEQ ID NO: 5573971 - DNA, 23 bp, Homo sapiens
atgtaattttattttaaaatttc

SEQ ID NO: 5573972 - DNA, 15 bp, Homo sapiens
atgtaatttttaaag

SEQ ID NO: 5573973 - DNA, 17 bp, Homo sapiens
atgtacaaaagtaccat

SEQ ID NO: 5573974 - DNA, 21 bp, Homo sapiens
atgtacaaaataaagttacat

SEQ ID NO: 5573975 - DNA, 13 bp, Homo sapiens
atgtacaaaatga

SEQ ID NO: 5573976 - DNA, 17 bp, Homo sapiens
atgtacaaaatgaattg

SEQ ID NO: 5573977 - DNA, 21 bp, Homo sapiens
atgtacaaaatgaattgcctt

SEQ ID NO: 5573978 - DNA, 22 bp, Homo sapiens
atgtacaaaatgaattgccttt

SEQ ID NO: 5573979 - DNA, 15 bp, Homo sapiens
atgtacaaacatgtt

SEQ ID NO: 5573980 - DNA, 12 bp, Homo sapiens
atgtacaaacta

SEQ ID NO: 5573981 - DNA, 21 bp, Homo sapiens
atgtacaaactagtttttata

SEQ ID NO: 5573982 - DNA, 16 bp, Homo sapiens
atgtacaaagatactt

SEQ ID NO: 5573983 - DNA, 14 bp, Homo sapiens
atgtacaagttgag

SEQ ID NO: 5573984 - DNA, 20 bp, Homo sapiens
atgtacaagttttgtataaa

SEQ ID NO: 5573985 - DNA, 20 bp, Homo sapiens
atgtacaataagaacttcta

SEQ ID NO: 5573986 - DNA, 16 bp, Homo sapiens
atgtacaatacaatgt

SEQ ID NO: 5573987 - DNA, 22 bp, Homo sapiens
atgtacaatacaatgtacaatt

SEQ ID NO: 5573988 - DNA, 18 bp, Homo sapiens
atgtacaattatgtctct

SEQ ID NO: 5573989 - DNA, 13 bp, Homo sapiens
atgtacacatttt

SEQ ID NO: 5573990 - DNA, 19 bp, Homo sapiens
atgtacaccacatgctatt

SEQ ID NO: 5573991 - DNA, 21 bp, Homo sapiens
atgtacaccacatgctattgt

SEQ ID NO: 5573992 - DNA, 24 bp, Homo sapiens
atgtacaccacatgctattgtctg

SEQ ID NO: 5573993 - DNA, 21 bp, Homo sapiens
atgtacactttttacagcagc

SEQ ID NO: 5573994 - DNA, 21 bp, Homo sapiens
atgtacagaaaatagctttta

SEQ ID NO: 5573995 - DNA, 16 bp, Homo sapiens
atgtacagaacacaaa

SEQ ID NO: 5573996 - DNA, 17 bp, Homo sapiens
atgtacagaacacaaat

SEQ ID NO: 5573997 - DNA, 23 bp, Homo sapiens
atgtacagacatatttaactggt

SEQ ID NO: 5573998 - DNA, 16 bp, Homo sapiens
atgtacagagctttct

SEQ ID NO: 5573999 - DNA, 17 bp, Homo sapiens
atgtacagagctttctt

SEQ ID NO: 5574000 - DNA, 18 bp, Homo sapiens
atgtacagaggtcagcac

SEQ ID NO: 5574001 - DNA, 16 bp, Homo sapiens
atgtacagattctttc

SEQ ID NO: 5574002 - DNA, 13 bp, Homo sapiens
atgtacagctctc

SEQ ID NO: 5574003 - DNA, 22 bp, Homo sapiens
atgtacagtctcaattttgtat

SEQ ID NO: 5574004 - DNA, 11 bp, Homo sapiens
atgtacagtgt

SEQ ID NO: 5574005 - DNA, 14 bp, Homo sapiens
atgtacagtgttct

SEQ ID NO: 5574006 - DNA, 15 bp, Homo sapiens
atgtacagttcataa

SEQ ID NO: 5574007 - DNA, 18 bp, Homo sapiens
atgtacagttgagctcag

SEQ ID NO: 5574008 - DNA, 23 bp, Homo sapiens
atgtacataccggggctcctctc

SEQ ID NO: 5574009 - DNA, 15 bp, Homo sapiens
atgtacatacgctct

SEQ ID NO: 5574010 - DNA, 19 bp, Homo sapiens
atgtacatagagtgagaag

SEQ ID NO: 5574011 - DNA, 21 bp, Homo sapiens
atgtacatagtaaagtatttt

SEQ ID NO: 5574012 - DNA, 21 bp, Homo sapiens
atgtacatagttatttttctc

SEQ ID NO: 5574013 - DNA, 21 bp, Homo sapiens
atgtacatcagtttgttcctt

SEQ ID NO: 5574014 - DNA, 16 bp, Homo sapiens
atgtacatctctccct

SEQ ID NO: 5574015 - DNA, 17 bp, Homo sapiens
atgtacatgtactgatt

SEQ ID NO: 5574016 - DNA, 11 bp, Homo sapiens
atgtacatgtg

SEQ ID NO: 5574017 - DNA, 22 bp, Homo sapiens
atgtacatgtgtagggaaagtt

SEQ ID NO: 5574018 - DNA, 18 bp, Homo sapiens
atgtacatgttcctttgt

SEQ ID NO: 5574019 - DNA, 14 bp, Homo sapiens
atgtacattaatta

SEQ ID NO: 5574020 - DNA, 11 bp, Homo sapiens
atgtacattac

SEQ ID NO: 5574021 - DNA, 14 bp, Homo sapiens
atgtacattacaga

SEQ ID NO: 5574022 - DNA, 18 bp, Homo sapiens
atgtacattacagattaa

SEQ ID NO: 5574023 - DNA, 21 bp, Homo sapiens
atgtacattacagattaaaga

SEQ ID NO: 5574024 - DNA, 15 bp, Homo sapiens
atgtacatttaataa

SEQ ID NO: 5574025 - DNA, 15 bp, Homo sapiens
atgtacatttctcag

SEQ ID NO: 5574026 - DNA, 16 bp, Homo sapiens
atgtacatttctcagg

SEQ ID NO: 5574027 - DNA, 16 bp, Homo sapiens
atgtacatttggaact

SEQ ID NO: 5574028 - DNA, 17 bp, Homo sapiens
atgtacatttgtctttt

SEQ ID NO: 5574029 - DNA, 19 bp, Homo sapiens
atgtaccatatgatctgtt

SEQ ID NO: 5574030 - DNA, 18 bp, Homo sapiens
atgtaccatgttgcccag

SEQ ID NO: 5574031 - DNA, 20 bp, Homo sapiens
atgtacccaccgggccactc

SEQ ID NO: 5574032 - DNA, 21 bp, Homo sapiens
atgtacccaccgggccactcc

SEQ ID NO: 5574033 - DNA, 20 bp, Homo sapiens
atgtacccctctcagtctgc

SEQ ID NO: 5574034 - DNA, 22 bp, Homo sapiens
atgtaccctaccctgcacattg

SEQ ID NO: 5574035 - DNA, 17 bp, Homo sapiens
atgtaccctctgaaata

SEQ ID NO: 5574036 - DNA, 17 bp, Homo sapiens
atgtacctcccctgcct

SEQ ID NO: 5574037 - DNA, 19 bp, Homo sapiens
atgtacctcccctgccttg

SEQ ID NO: 5574038 - DNA, 23 bp, Homo sapiens
atgtacctcccctgccttgctgt

SEQ ID NO: 5574039 - DNA, 14 bp, Homo sapiens
atgtacctctttta

SEQ ID NO: 5574040 - DNA, 15 bp, Homo sapiens
atgtacctttcttca

SEQ ID NO: 5574041 - DNA, 11 bp, Homo sapiens
atgtacctttt

SEQ ID NO: 5574042 - DNA, 17 bp, Homo sapiens
atgtacgacttgcatac

SEQ ID NO: 5574043 - DNA, 15 bp, Homo sapiens
atgtacgataaagta

SEQ ID NO: 5574044 - DNA, 15 bp, Homo sapiens
atgtacgtatatata

SEQ ID NO: 5574045 - DNA, 14 bp, Homo sapiens
atgtacgtttgtat

SEQ ID NO: 5574046 - DNA, 13 bp, Homo sapiens
atgtactaagaat

SEQ ID NO: 5574047 - DNA, 22 bp, Homo sapiens
atgtactaagaatgtccttatt

SEQ ID NO: 5574048 - DNA, 17 bp, Homo sapiens
atgtactacagctatat

SEQ ID NO: 5574049 - DNA, 18 bp, Homo sapiens
atgtactacagctatatt

SEQ ID NO: 5574050 - DNA, 19 bp, Homo sapiens
atgtactacagctatattt

SEQ ID NO: 5574051 - DNA, 21 bp, Homo sapiens
atgtactacagctatatttga

SEQ ID NO: 5574052 - DNA, 16 bp, Homo sapiens
atgtactacatttgca

SEQ ID NO: 5574053 - DNA, 20 bp, Homo sapiens
atgtactaggatactgctgc

SEQ ID NO: 5574054 - DNA, 19 bp, Homo sapiens
atgtactagtactgtgtac

SEQ ID NO: 5574055 - DNA, 18 bp, Homo sapiens
atgtactagtgttctgtt

SEQ ID NO: 5574056 - DNA, 17 bp, Homo sapiens
atgtactataacataga

SEQ ID NO: 5574057 - DNA, 20 bp, Homo sapiens
atgtactatatgtatatctt

SEQ ID NO: 5574058 - DNA, 17 bp, Homo sapiens
atgtactcctctttaca

SEQ ID NO: 5574059 - DNA, 14 bp, Homo sapiens
atgtactctctaag

SEQ ID NO: 5574060 - DNA, 17 bp, Homo sapiens
atgtactgaattccata

SEQ ID NO: 5574061 - DNA, 15 bp, Homo sapiens
atgtactgaattctt

SEQ ID NO: 5574062 - DNA, 19 bp, Homo sapiens
atgtactgaattctttatc

SEQ ID NO: 5574063 - DNA, 20 bp, Homo sapiens
atgtactgagacaaaaagga

SEQ ID NO: 5574064 - DNA, 14 bp, Homo sapiens
atgtactgagattt

SEQ ID NO: 5574065 - DNA, 18 bp, Homo sapiens
atgtactgagccttgtaa

SEQ ID NO: 5574066 - DNA, 16 bp, Homo sapiens
atgtactgattgagaa

SEQ ID NO: 5574067 - DNA, 22 bp, Homo sapiens
atgtactgcaaagtcgccagtc

SEQ ID NO: 5574068 - DNA, 19 bp, Homo sapiens
atgtactggtaattgtaca

SEQ ID NO: 5574069 - DNA, 20 bp, Homo sapiens
atgtactggtaattgtacaa

SEQ ID NO: 5574070 - DNA, 17 bp, Homo sapiens
atgtactgtaaacagtt

SEQ ID NO: 5574071 - DNA, 11 bp, Homo sapiens
atgtactgtac

SEQ ID NO: 5574072 - DNA, 15 bp, Homo sapiens
atgtactgtacataa

SEQ ID NO: 5574073 - DNA, 16 bp, Homo sapiens
atgtactgtacataaa

SEQ ID NO: 5574074 - DNA, 12 bp, Homo sapiens
atgtactgtata

SEQ ID NO: 5574075 - DNA, 19 bp, Homo sapiens
atgtactgtatattacaga

SEQ ID NO: 5574076 - DNA, 15 bp, Homo sapiens
atgtactgttgaaaa

SEQ ID NO: 5574077 - DNA, 17 bp, Homo sapiens
atgtactgttgaaaaag

SEQ ID NO: 5574078 - DNA, 14 bp, Homo sapiens
atgtacttaaatga

SEQ ID NO: 5574079 - DNA, 15 bp, Homo sapiens
atgtacttaaatgag

SEQ ID NO: 5574080 - DNA, 15 bp, Homo sapiens
atgtacttagctgta

SEQ ID NO: 5574081 - DNA, 16 bp, Homo sapiens
atgtacttcatgctgt

SEQ ID NO: 5574082 - DNA, 19 bp, Homo sapiens
atgtacttctctgtgtgca

SEQ ID NO: 5574083 - DNA, 22 bp, Homo sapiens
atgtacttgatactgaatgcat

SEQ ID NO: 5574084 - DNA, 17 bp, Homo sapiens
atgtacttgtcaaagaa

SEQ ID NO: 5574085 - DNA, 18 bp, Homo sapiens
atgtacttgtcaaagaag

SEQ ID NO: 5574086 - DNA, 16 bp, Homo sapiens
atgtacttgtttgcta

SEQ ID NO: 5574087 - DNA, 22 bp, Homo sapiens
atgtactttcattccctttcat

SEQ ID NO: 5574088 - DNA, 14 bp, Homo sapiens
atgtactttttaaa

SEQ ID NO: 5574089 - DNA, 18 bp, Homo sapiens
atgtactttttattgcat

SEQ ID NO: 5574090 - DNA, 21 bp, Homo sapiens
atgtagaaactgaggcccaga

SEQ ID NO: 5574091 - DNA, 22 bp, Homo sapiens
atgtagaaactgaggcccagag

SEQ ID NO: 5574092 - DNA, 14 bp, Homo sapiens
atgtagaaacttaa

SEQ ID NO: 5574093 - DNA, 12 bp, Homo sapiens
atgtagaaagct

SEQ ID NO: 5574094 - DNA, 20 bp, Homo sapiens
atgtagaaagttgtaaaata

SEQ ID NO: 5574095 - DNA, 18 bp, Homo sapiens
atgtagaaataaattact

SEQ ID NO: 5574096 - DNA, 13 bp, Homo sapiens
atgtagaaatgtt

SEQ ID NO: 5574097 - DNA, 15 bp, Homo sapiens
atgtagaaattctaa

SEQ ID NO: 5574098 - DNA, 16 bp, Homo sapiens
atgtagaaattcttca

SEQ ID NO: 5574099 - DNA, 14 bp, Homo sapiens
atgtagaactcagc

SEQ ID NO: 5574100 - DNA, 18 bp, Homo sapiens
atgtagaactcagcagtt

SEQ ID NO: 5574101 - DNA, 12 bp, Homo sapiens
atgtagaagaaa

SEQ ID NO: 5574102 - DNA, 17 bp, Homo sapiens
atgtagaagaaagcaaa

SEQ ID NO: 5574103 - DNA, 18 bp, Homo sapiens
atgtagaagagggagaag

SEQ ID NO: 5574104 - DNA, 22 bp, Homo sapiens
atgtagaaggcaggatttagcc

SEQ ID NO: 5574105 - DNA, 15 bp, Homo sapiens
atgtagaataggcag

SEQ ID NO: 5574106 - DNA, 18 bp, Homo sapiens
atgtagaatgatttttgc

SEQ ID NO: 5574107 - DNA, 14 bp, Homo sapiens
atgtagaattgaaa

SEQ ID NO: 5574108 - DNA, 21 bp, Homo sapiens
atgtagacaaaacttataatt

SEQ ID NO: 5574109 - DNA, 22 bp, Homo sapiens
atgtagacaaaacttataattt

SEQ ID NO: 5574110 - DNA, 16 bp, Homo sapiens
atgtagacagatattt

SEQ ID NO: 5574111 - DNA, 17 bp, Homo sapiens
atgtagacataaagaag

SEQ ID NO: 5574112 - DNA, 16 bp, Homo sapiens
atgtagacattgtaaa

SEQ ID NO: 5574113 - DNA, 16 bp, Homo sapiens
atgtagactatataca

SEQ ID NO: 5574114 - DNA, 18 bp, Homo sapiens
atgtagactctgacttcc

SEQ ID NO: 5574115 - DNA, 18 bp, Homo sapiens
atgtagagagaacaggtg

SEQ ID NO: 5574116 - DNA, 17 bp, Homo sapiens
atgtagagagataccat

SEQ ID NO: 5574117 - DNA, 18 bp, Homo sapiens
atgtagaggcttgtttac

SEQ ID NO: 5574118 - DNA, 19 bp, Homo sapiens
atgtagataaactcagaaa

SEQ ID NO: 5574119 - DNA, 15 bp, Homo sapiens
atgtagatacagatc

SEQ ID NO: 5574120 - DNA, 15 bp, Homo sapiens
atgtagatatttggc

SEQ ID NO: 5574121 - DNA, 16 bp, Homo sapiens
atgtagatatttggct

SEQ ID NO: 5574122 - DNA, 16 bp, Homo sapiens
atgtagatttatttca

SEQ ID NO: 5574123 - DNA, 20 bp, Homo sapiens
atgtagatttatttcatcat

SEQ ID NO: 5574124 - DNA, 14 bp, Homo sapiens
atgtatgaaggctt

SEQ ID NO: 5574125 - DNA, 13 bp, Homo sapiens
atgtatgaatgta

SEQ ID NO: 5574126 - DNA, 18 bp, Homo sapiens
atgtatgaggtacaacct

SEQ ID NO: 5574127 - DNA, 16 bp, Homo sapiens
atgtatgagtgtatgt

SEQ ID NO: 5574128 - DNA, 20 bp, Homo sapiens
atgtatgataaacagttgaa

SEQ ID NO: 5574129 - DNA, 16 bp, Homo sapiens
atgtatgcacacacat

SEQ ID NO: 5574130 - DNA, 17 bp, Homo sapiens
atgtatgcacacacata

SEQ ID NO: 5574131 - DNA, 14 bp, Homo sapiens
atgtatgcattcac

SEQ ID NO: 5574132 - DNA, 17 bp, Homo sapiens
atgtatgccatgtatgt

SEQ ID NO: 5574133 - DNA, 22 bp, Homo sapiens
atgtatgccatgtatgttgcat

SEQ ID NO: 5574134 - DNA, 23 bp, Homo sapiens
atgtatgccttcgggaaaattca

SEQ ID NO: 5574135 - DNA, 14 bp, Homo sapiens
atgtatgcttcata

SEQ ID NO: 5574136 - DNA, 14 bp, Homo sapiens
atgtatgcttccag

SEQ ID NO: 5574137 - DNA, 17 bp, Homo sapiens
atgtatggatatatttg

SEQ ID NO: 5574138 - DNA, 19 bp, Homo sapiens
atgtatggatatatttgaa

SEQ ID NO: 5574139 - DNA, 19 bp, Homo sapiens
atgtatgggtagggtaaat

SEQ ID NO: 5574140 - DNA, 13 bp, Homo sapiens
atgtatggtatct

SEQ ID NO: 5574141 - DNA, 18 bp, Homo sapiens
atgtatggtatctttaga

SEQ ID NO: 5574142 - DNA, 14 bp, Homo sapiens
atgtatgtaaaaat

SEQ ID NO: 5574143 - DNA, 15 bp, Homo sapiens
atgtatgtaaaatat

SEQ ID NO: 5574144 - DNA, 13 bp, Homo sapiens
atgtatgtacaat

SEQ ID NO: 5574145 - DNA, 22 bp, Homo sapiens
atgtatgtacaatacaatgtac

SEQ ID NO: 5574146 - DNA, 12 bp, Homo sapiens
atgtatgtatca

SEQ ID NO: 5574147 - DNA, 20 bp, Homo sapiens
atgtatgtccattcactttc

SEQ ID NO: 5574148 - DNA, 23 bp, Homo sapiens
atgtatgtgaaagtgtaaaatag

SEQ ID NO: 5574149 - DNA, 22 bp, Homo sapiens
atgtatgtgcacatgtgtctgt

SEQ ID NO: 5574150 - DNA, 17 bp, Homo sapiens
atgtatgtgcactgtca

SEQ ID NO: 5574151 - DNA, 20 bp, Homo sapiens
atgtatgtgcactgtcactt

SEQ ID NO: 5574152 - DNA, 17 bp, Homo sapiens
atgtatgtgccaatttt

SEQ ID NO: 5574153 - DNA, 15 bp, Homo sapiens
atgtatgtgtaagta

SEQ ID NO: 5574154 - DNA, 12 bp, Homo sapiens
atgtatgtgtag

SEQ ID NO: 5574155 - DNA, 15 bp, Homo sapiens
atgtatgtgtatatg

SEQ ID NO: 5574156 - DNA, 20 bp, Homo sapiens
atgtatgtgtcactgcatgg

SEQ ID NO: 5574157 - DNA, 11 bp, Homo sapiens
atgtatgtgtg

SEQ ID NO: 5574158 - DNA, 17 bp, Homo sapiens
atgtatgtgtgaaacaa

SEQ ID NO: 5574159 - DNA, 13 bp, Homo sapiens
atgtatgtgtgac

SEQ ID NO: 5574160 - DNA, 22 bp, Homo sapiens
atgtatgtgtgacaagtgtgtc

SEQ ID NO: 5574161 - DNA, 23 bp, Homo sapiens
atgtatgtgtgagtgtatgtata

SEQ ID NO: 5574162 - DNA, 14 bp, Homo sapiens
atgtatgtgtggct

SEQ ID NO: 5574163 - DNA, 16 bp, Homo sapiens
atgtatgtgtggctgt

SEQ ID NO: 5574164 - DNA, 14 bp, Homo sapiens
atgtatgtgtgtat

SEQ ID NO: 5574165 - DNA, 15 bp, Homo sapiens
atgtatgtgtgtatg

SEQ ID NO: 5574166 - DNA, 18 bp, Homo sapiens
atgtatgtgtgtctattt

SEQ ID NO: 5574167 - DNA, 12 bp, Homo sapiens
atgtatgtgttt

SEQ ID NO: 5574168 - DNA, 16 bp, Homo sapiens
atgtatgtgtttagaa

SEQ ID NO: 5574169 - DNA, 17 bp, Homo sapiens
atgtatgttatgatatt

SEQ ID NO: 5574170 - DNA, 20 bp, Homo sapiens
atgtatgttcagaagaaatt

SEQ ID NO: 5574171 - DNA, 14 bp, Homo sapiens
atgtatgtttacat

SEQ ID NO: 5574172 - DNA, 18 bp, Homo sapiens
atgtatgtttttttccaa

SEQ ID NO: 5574173 - DNA, 18 bp, Homo sapiens
atgtattaaacttttcat

SEQ ID NO: 5574174 - DNA, 19 bp, Homo sapiens
atgtattaacctacctgtg

SEQ ID NO: 5574175 - DNA, 19 bp, Homo sapiens
atgtattaagccaaacatg

SEQ ID NO: 5574176 - DNA, 13 bp, Homo sapiens
atgtattacatga

SEQ ID NO: 5574177 - DNA, 22 bp, Homo sapiens
atgtattaccagccccccaccc

SEQ ID NO: 5574178 - DNA, 22 bp, Homo sapiens
atgtattagtatggttcaagat

SEQ ID NO: 5574179 - DNA, 13 bp, Homo sapiens
atgtattagtgtc

SEQ ID NO: 5574180 - DNA, 14 bp, Homo sapiens
atgtattataactt

SEQ ID NO: 5574181 - DNA, 13 bp, Homo sapiens
atgtattatgaaa

SEQ ID NO: 5574182 - DNA, 12 bp, Homo sapiens
atgtattatgca

SEQ ID NO: 5574183 - DNA, 16 bp, Homo sapiens
atgtattatgcaaagt

SEQ ID NO: 5574184 - DNA, 23 bp, Homo sapiens
atgtattattattaaagaaaaat

SEQ ID NO: 5574185 - DNA, 16 bp, Homo sapiens
atgtattattctgcag

SEQ ID NO: 5574186 - DNA, 20 bp, Homo sapiens
atgtattattctgcagcatg

SEQ ID NO: 5574187 - DNA, 22 bp, Homo sapiens
atgtattatttcattatgtaaa

SEQ ID NO: 5574188 - DNA, 16 bp, Homo sapiens
atgtattattttctat

SEQ ID NO: 5574189 - DNA, 23 bp, Homo sapiens
atgtattattttctatagctctt

SEQ ID NO: 5574190 - DNA, 13 bp, Homo sapiens
atgtattcaagca

SEQ ID NO: 5574191 - DNA, 17 bp, Homo sapiens
atgtattcacctttctt

SEQ ID NO: 5574192 - DNA, 15 bp, Homo sapiens
atgtattcagagcca

SEQ ID NO: 5574193 - DNA, 24 bp, Homo sapiens
atgtattcagctttagtagatatt

SEQ ID NO: 5574194 - DNA, 17 bp, Homo sapiens
atgtattcatccagagt

SEQ ID NO: 5574195 - DNA, 14 bp, Homo sapiens
atgtattcctatga

SEQ ID NO: 5574196 - DNA, 15 bp, Homo sapiens
atgtattcctatgac

SEQ ID NO: 5574197 - DNA, 19 bp, Homo sapiens
atgtattcctgaaaagctg

SEQ ID NO: 5574198 - DNA, 19 bp, Homo sapiens
atgtattctagctaatgta

SEQ ID NO: 5574199 - DNA, 22 bp, Homo sapiens
atgtattctgggtattctatta

SEQ ID NO: 5574200 - DNA, 17 bp, Homo sapiens
atgtattctgtatccgt

SEQ ID NO: 5574201 - DNA, 20 bp, Homo sapiens
atgtattcttttatataact

SEQ ID NO: 5574202 - DNA, 17 bp, Homo sapiens
atgtattcttttctcag

SEQ ID NO: 5574203 - DNA, 14 bp, Homo sapiens
atgtattgataaga

SEQ ID NO: 5574204 - DNA, 14 bp, Homo sapiens
atgtattggcattt

SEQ ID NO: 5574205 - DNA, 13 bp, Homo sapiens
atgtattggcctg

SEQ ID NO: 5574206 - DNA, 14 bp, Homo sapiens
atgtattgtaatct

SEQ ID NO: 5574207 - DNA, 19 bp, Homo sapiens
atgtattgtaatctttcat

SEQ ID NO: 5574208 - DNA, 12 bp, Homo sapiens
atgtattgtacc

SEQ ID NO: 5574209 - DNA, 15 bp, Homo sapiens
atgtattgtaccttt

SEQ ID NO: 5574210 - DNA, 18 bp, Homo sapiens
atgtattgtgcaatgtgt

SEQ ID NO: 5574211 - DNA, 19 bp, Homo sapiens
atgtattgtgcaatgtgta

SEQ ID NO: 5574212 - DNA, 24 bp, Homo sapiens
atgtattgtgcaatgtgtataaac

SEQ ID NO: 5574213 - DNA, 12 bp, Homo sapiens
atgtatttaaaa

SEQ ID NO: 5574214 - DNA, 15 bp, Homo sapiens
atgtatttaaagaac

SEQ ID NO: 5574215 - DNA, 14 bp, Homo sapiens
atgtatttaaagtt

SEQ ID NO: 5574216 - DNA, 15 bp, Homo sapiens
atgtatttaaagttg

SEQ ID NO: 5574217 - DNA, 23 bp, Homo sapiens
atgtatttaagatgtacatttaa

SEQ ID NO: 5574218 - DNA, 12 bp, Homo sapiens
atgtatttaatt

SEQ ID NO: 5574219 - DNA, 17 bp, Homo sapiens
atgtatttaccaaaaat

SEQ ID NO: 5574220 - DNA, 16 bp, Homo sapiens
atgtatttatgtcttt

SEQ ID NO: 5574221 - DNA, 18 bp, Homo sapiens
atgtatttatgtgtatat

SEQ ID NO: 5574222 - DNA, 23 bp, Homo sapiens
atgtatttatgtgtatatttgta

SEQ ID NO: 5574223 - DNA, 19 bp, Homo sapiens
atgtatttatttaaaagat

SEQ ID NO: 5574224 - DNA, 21 bp, Homo sapiens
atgtatttatttaaaagattc

SEQ ID NO: 5574225 - DNA, 22 bp, Homo sapiens
atgtatttatttaaaagattca

SEQ ID NO: 5574226 - DNA, 14 bp, Homo sapiens
atgtatttcattgc

SEQ ID NO: 5574227 - DNA, 19 bp, Homo sapiens
atgtatttcctggatgttt

SEQ ID NO: 5574228 - DNA, 21 bp, Homo sapiens
atgtatttctatatagacttg

SEQ ID NO: 5574229 - DNA, 13 bp, Homo sapiens
atgtatttgatgt

SEQ ID NO: 5574230 - DNA, 20 bp, Homo sapiens
atgtatttgttaaagaaaca

SEQ ID NO: 5574231 - DNA, 16 bp, Homo sapiens
atgtatttgttatata

SEQ ID NO: 5574232 - DNA, 18 bp, Homo sapiens
atgtatttgttatatata

SEQ ID NO: 5574233 - DNA, 12 bp, Homo sapiens
atgtatttgttc

SEQ ID NO: 5574234 - DNA, 13 bp, Homo sapiens
atgtatttgttca

SEQ ID NO: 5574235 - DNA, 14 bp, Homo sapiens
atgtattttacaca

SEQ ID NO: 5574236 - DNA, 15 bp, Homo sapiens
atgtattttcaataa

SEQ ID NO: 5574237 - DNA, 18 bp, Homo sapiens
atgtattttcagctcaat

SEQ ID NO: 5574238 - DNA, 14 bp, Homo sapiens
atgtattttcatag

SEQ ID NO: 5574239 - DNA, 16 bp, Homo sapiens
atgtattttccaagta

SEQ ID NO: 5574240 - DNA, 20 bp, Homo sapiens
atgtattttcctaatgtgat

SEQ ID NO: 5574241 - DNA, 14 bp, Homo sapiens
atgtattttgaaga

SEQ ID NO: 5574242 - DNA, 16 bp, Homo sapiens
atgtattttgaagaat

SEQ ID NO: 5574243 - DNA, 18 bp, Homo sapiens
atgtattttgaagaatat

SEQ ID NO: 5574244 - DNA, 14 bp, Homo sapiens
atgtattttggaag

SEQ ID NO: 5574245 - DNA, 18 bp, Homo sapiens
atgtattttggaagacat

SEQ ID NO: 5574246 - DNA, 20 bp, Homo sapiens
atgtattttggaagacatat

SEQ ID NO: 5574247 - DNA, 23 bp, Homo sapiens
atgtattttggaagacatatatt

SEQ ID NO: 5574248 - DNA, 20 bp, Homo sapiens
atgtattttgtgagtttgtt

SEQ ID NO: 5574249 - DNA, 19 bp, Homo sapiens
atgtatttttcaaaacata

SEQ ID NO: 5574250 - DNA, 21 bp, Homo sapiens
atgtatttttcttgctgttca

SEQ ID NO: 5574251 - DNA, 16 bp, Homo sapiens
atgtatttttgtaaat

SEQ ID NO: 5574252 - DNA, 18 bp, Homo sapiens
atgtatttttgtaaatag

SEQ ID NO: 5574253 - DNA, 19 bp, Homo sapiens
atgtatttttgtaaatagt

SEQ ID NO: 5574254 - DNA, 20 bp, Homo sapiens
atgtatttttgtaaatagtt

SEQ ID NO: 5574255 - DNA, 21 bp, Homo sapiens
atgtattttttagaccctcta

SEQ ID NO: 5574256 - DNA, 15 bp, Homo sapiens
atgtattttttgaat

SEQ ID NO: 5574257 - DNA, 16 bp, Homo sapiens
atgtcaaaaagggctt

SEQ ID NO: 5574258 - DNA, 21 bp, Homo sapiens
atgtcaaaaatatttttatgt

SEQ ID NO: 5574259 - DNA, 15 bp, Homo sapiens
atgtcaaaagtagaa

SEQ ID NO: 5574260 - DNA, 12 bp, Homo sapiens
atgtcaaaatca

SEQ ID NO: 5574261 - DNA, 17 bp, Homo sapiens
atgtcaaaattgtttaa

SEQ ID NO: 5574262 - DNA, 13 bp, Homo sapiens
atgtcaaacaaat

SEQ ID NO: 5574263 - DNA, 18 bp, Homo sapiens
atgtcaaacagtgccaaa

SEQ ID NO: 5574264 - DNA, 22 bp, Homo sapiens
atgtcaaacagtgccaaatgct

SEQ ID NO: 5574265 - DNA, 20 bp, Homo sapiens
atgtcaaagagaaaacttat

SEQ ID NO: 5574266 - DNA, 19 bp, Homo sapiens
atgtcaaagtgtaacagat

SEQ ID NO: 5574267 - DNA, 23 bp, Homo sapiens
atgtcaaatatttagatgtaatt

SEQ ID NO: 5574268 - DNA, 17 bp, Homo sapiens
atgtcaaatcaaggcaa

SEQ ID NO: 5574269 - DNA, 12 bp, Homo sapiens
atgtcaaatgga

SEQ ID NO: 5574270 - DNA, 18 bp, Homo sapiens
atgtcaaattgtgcaaaa

SEQ ID NO: 5574271 - DNA, 19 bp, Homo sapiens
atgtcaaattgtgcaaaat

SEQ ID NO: 5574272 - DNA, 20 bp, Homo sapiens
atgtcaaattgtgcaaaata

SEQ ID NO: 5574273 - DNA, 22 bp, Homo sapiens
atgtcaaattgtgcaaaatatt

SEQ ID NO: 5574274 - DNA, 14 bp, Homo sapiens
atgtcaacttctgg

SEQ ID NO: 5574275 - DNA, 15 bp, Homo sapiens
atgtcaagaggctga

SEQ ID NO: 5574276 - DNA, 22 bp, Homo sapiens
atgtcaaggcagttgcttgtgt

SEQ ID NO: 5574277 - DNA, 14 bp, Homo sapiens
atgtcaagggcagc

SEQ ID NO: 5574278 - DNA, 21 bp, Homo sapiens
atgtcaagggcagctttgctc

SEQ ID NO: 5574279 - DNA, 16 bp, Homo sapiens
atgtcaagtaccaaaa

SEQ ID NO: 5574280 - DNA, 16 bp, Homo sapiens
atgtcaagtggcagct

SEQ ID NO: 5574281 - DNA, 16 bp, Homo sapiens
atgtcaagttgggttc

SEQ ID NO: 5574282 - DNA, 19 bp, Homo sapiens
atgtcaataaacaacagct

SEQ ID NO: 5574283 - DNA, 19 bp, Homo sapiens
atgtcaataactttatatg

SEQ ID NO: 5574284 - DNA, 21 bp, Homo sapiens
atgtcaataactttatatgaa

SEQ ID NO: 5574285 - DNA, 17 bp, Homo sapiens
atgtcaatgctatggac

SEQ ID NO: 5574286 - DNA, 22 bp, Homo sapiens
atgtcaatgctatggactgcac

SEQ ID NO: 5574287 - DNA, 19 bp, Homo sapiens
atgtcaattcataaaaaca

SEQ ID NO: 5574288 - DNA, 22 bp, Homo sapiens
atgtcaattgatatttctgtgt

SEQ ID NO: 5574289 - DNA, 20 bp, Homo sapiens
atgtcaatttgtatatcatg

SEQ ID NO: 5574290 - DNA, 18 bp, Homo sapiens
atgtcacaaattgatcaa

SEQ ID NO: 5574291 - DNA, 19 bp, Homo sapiens
atgtcacaaattgatcaag

SEQ ID NO: 5574292 - DNA, 23 bp, Homo sapiens
atgtcacaacatggtgctacttc

SEQ ID NO: 5574293 - DNA, 21 bp, Homo sapiens
atgtcacaataaaacaatctc

SEQ ID NO: 5574294 - DNA, 19 bp, Homo sapiens
atgtcacaggcaggtccag

SEQ ID NO: 5574295 - DNA, 14 bp, Homo sapiens
atgtcacagggcca

SEQ ID NO: 5574296 - DNA, 13 bp, Homo sapiens
atgtcacagtcca

SEQ ID NO: 5574297 - DNA, 15 bp, Homo sapiens
atgtcacagtttgtt

SEQ ID NO: 5574298 - DNA, 20 bp, Homo sapiens
atgtcacataatgaatgcta

SEQ ID NO: 5574299 - DNA, 16 bp, Homo sapiens
atgtcacatgccacaa

SEQ ID NO: 5574300 - DNA, 15 bp, Homo sapiens
atgtcacatttgaat

SEQ ID NO: 5574301 - DNA, 16 bp, Homo sapiens
atgtcacatttgaatt

SEQ ID NO: 5574302 - DNA, 13 bp, Homo sapiens
atgtcttggtact

SEQ ID NO: 5574303 - DNA, 15 bp, Homo sapiens
atgtcttggtacttg

SEQ ID NO: 5574304 - DNA, 16 bp, Homo sapiens
atgtcttggtttccat

SEQ ID NO: 5574305 - DNA, 21 bp, Homo sapiens
atgtcttgtatttaaaaacat

SEQ ID NO: 5574306 - DNA, 11 bp, Homo sapiens
atgtcttgtgt

SEQ ID NO: 5574307 - DNA, 22 bp, Homo sapiens
atgtcttgtgtatttctctgtg

SEQ ID NO: 5574308 - DNA, 23 bp, Homo sapiens
atgtcttgtgtatttctctgtga

SEQ ID NO: 5574309 - DNA, 18 bp, Homo sapiens
atgtcttgttaatattct

SEQ ID NO: 5574310 - DNA, 17 bp, Homo sapiens
atgtcttgttcctgtgc

SEQ ID NO: 5574311 - DNA, 15 bp, Homo sapiens
atgtctttaaaatga

SEQ ID NO: 5574312 - DNA, 16 bp, Homo sapiens
atgtctttaatgcaat

SEQ ID NO: 5574313 - DNA, 17 bp, Homo sapiens
atgtctttactggacct

SEQ ID NO: 5574314 - DNA, 21 bp, Homo sapiens
atgtctttactggacctgaaa

SEQ ID NO: 5574315 - DNA, 19 bp, Homo sapiens
atgtctttattagtaacat

SEQ ID NO: 5574316 - DNA, 21 bp, Homo sapiens
atgtctttccaaattatttct

SEQ ID NO: 5574317 - DNA, 19 bp, Homo sapiens
atgtctttccacttctctg

SEQ ID NO: 5574318 - DNA, 12 bp, Homo sapiens
atgtctttccta

SEQ ID NO: 5574319 - DNA, 22 bp, Homo sapiens
atgtctttcctatttgcacacg

SEQ ID NO: 5574320 - DNA, 19 bp, Homo sapiens
atgtctttggcttcagaat

SEQ ID NO: 5574321 - DNA, 13 bp, Homo sapiens
atgtctttgtaag

SEQ ID NO: 5574322 - DNA, 22 bp, Homo sapiens
atgtctttgtaagtcagtgttg

SEQ ID NO: 5574323 - DNA, 23 bp, Homo sapiens
atgtctttgttggaaaagaatac

SEQ ID NO: 5574324 - DNA, 18 bp, Homo sapiens
atgtcttttagaagatag

SEQ ID NO: 5574325 - DNA, 18 bp, Homo sapiens
atgtcttttatagtggaa

SEQ ID NO: 5574326 - DNA, 16 bp, Homo sapiens
atgtcttttcaaaagg

SEQ ID NO: 5574327 - DNA, 16 bp, Homo sapiens
atgtcttttcttggca

SEQ ID NO: 5574328 - DNA, 15 bp, Homo sapiens
atgtcttttgaatat

SEQ ID NO: 5574329 - DNA, 16 bp, Homo sapiens
atgtcttttgaatatt

SEQ ID NO: 5574330 - DNA, 19 bp, Homo sapiens
atgtcttttgatgaataga

SEQ ID NO: 5574331 - DNA, 20 bp, Homo sapiens
atgtctttttaagcttattt

SEQ ID NO: 5574332 - DNA, 22 bp, Homo sapiens
atgtctttttattaaaatattt

SEQ ID NO: 5574333 - DNA, 22 bp, Homo sapiens
atgtcttttttttaatgtgctg

SEQ ID NO: 5574334 - DNA, 18 bp, Homo sapiens
atgtgaaaaaaaaaagta

SEQ ID NO: 5574335 - DNA, 15 bp, Homo sapiens
atgtgaaaaactaat

SEQ ID NO: 5574336 - DNA, 13 bp, Homo sapiens
atgtgaaaaagga

SEQ ID NO: 5574337 - DNA, 14 bp, Homo sapiens
atgtgaaaaaggaa

SEQ ID NO: 5574338 - DNA, 18 bp, Homo sapiens
atgtgaaaaattaacttt

SEQ ID NO: 5574339 - DNA, 12 bp, Homo sapiens
atgtgaaaagat

SEQ ID NO: 5574340 - DNA, 12 bp, Homo sapiens
atgtgaaaagca

SEQ ID NO: 5574341 - DNA, 16 bp, Homo sapiens
atgtgaaaatatactt

SEQ ID NO: 5574342 - DNA, 18 bp, Homo sapiens
atgtgaaaatatttaaag

SEQ ID NO: 5574343 - DNA, 13 bp, Homo sapiens
atgtgaaaatgct

SEQ ID NO: 5574344 - DNA, 17 bp, Homo sapiens
atgtgaaacacatgcca

SEQ ID NO: 5574345 - DNA, 16 bp, Homo sapiens
atgtgaaacatccgtt

SEQ ID NO: 5574346 - DNA, 14 bp, Homo sapiens
atgtgaaacatgtt

SEQ ID NO: 5574347 - DNA, 15 bp, Homo sapiens
atgtgaaacatgttt

SEQ ID NO: 5574348 - DNA, 12 bp, Homo sapiens
atgtgaaacatt

SEQ ID NO: 5574349 - DNA, 12 bp, Homo sapiens
atgtgaaacctt

SEQ ID NO: 5574350 - DNA, 13 bp, Homo sapiens
atgtgaaaccttt

SEQ ID NO: 5574351 - DNA, 19 bp, Homo sapiens
atgtgaaaccttttttaag

SEQ ID NO: 5574352 - DNA, 21 bp, Homo sapiens
atgtgaaaccttttttaagat

SEQ ID NO: 5574353 - DNA, 20 bp, Homo sapiens
atgtgaaactacagatcttt

SEQ ID NO: 5574354 - DNA, 14 bp, Homo sapiens
atgtgaaactgaga

SEQ ID NO: 5574355 - DNA, 22 bp, Homo sapiens
atgtgaaactggattaaactta

SEQ ID NO: 5574356 - DNA, 17 bp, Homo sapiens
atgtgaaagattattta

SEQ ID NO: 5574357 - DNA, 16 bp, Homo sapiens
atgtgaaaggaacatt

SEQ ID NO: 5574358 - DNA, 15 bp, Homo sapiens
atgtgaaagtgtaaa

SEQ ID NO: 5574359 - DNA, 17 bp, Homo sapiens
atgtgaaagtgtaaaat

SEQ ID NO: 5574360 - DNA, 14 bp, Homo sapiens
atgtgaaataaaga

SEQ ID NO: 5574361 - DNA, 19 bp, Homo sapiens
atgtgaaatgcttatgctt

SEQ ID NO: 5574362 - DNA, 17 bp, Homo sapiens
atgtgaaatgctttctg

SEQ ID NO: 5574363 - DNA, 19 bp, Homo sapiens
atgtgaaatttttatttgt

SEQ ID NO: 5574364 - DNA, 24 bp, Homo sapiens
atgtgaaatttttccacactatgt

SEQ ID NO: 5574365 - DNA, 15 bp, Homo sapiens
atgtgaacacatcag

SEQ ID NO: 5574366 - DNA, 14 bp, Homo sapiens
atgtgaacagcata

SEQ ID NO: 5574367 - DNA, 11 bp, Homo sapiens
atgtgaacagt

SEQ ID NO: 5574368 - DNA, 23 bp, Homo sapiens
atgtgaacagttgtgtttgaagc

SEQ ID NO: 5574369 - DNA, 12 bp, Homo sapiens
atgtgaacattc

SEQ ID NO: 5574370 - DNA, 16 bp, Homo sapiens
atgtgaacccgggacg

SEQ ID NO: 5574371 - DNA, 14 bp, Homo sapiens
atgtgaactagctg

SEQ ID NO: 5574372 - DNA, 21 bp, Homo sapiens
atgtgaactctcccctcccca

SEQ ID NO: 5574373 - DNA, 16 bp, Homo sapiens
atgtgaactttctcag

SEQ ID NO: 5574374 - DNA, 23 bp, Homo sapiens
atgtgaactttctcagcatatat

SEQ ID NO: 5574375 - DNA, 16 bp, Homo sapiens
atgtgaagaaaaagac

SEQ ID NO: 5574376 - DNA, 13 bp, Homo sapiens
atgtgaagaaata

SEQ ID NO: 5574377 - DNA, 14 bp, Homo sapiens
atgtgaagaaataa

SEQ ID NO: 5574378 - DNA, 15 bp, Homo sapiens
atgtgaagaaataag

SEQ ID NO: 5574379 - DNA, 21 bp, Homo sapiens
atgtgaagaggtctgattggc

SEQ ID NO: 5574380 - DNA, 14 bp, Homo sapiens
atgtgaagatgcat

SEQ ID NO: 5574381 - DNA, 13 bp, Homo sapiens
atgtgaagcatgc

SEQ ID NO: 5574382 - DNA, 16 bp, Homo sapiens
atgtgaaggtgtttca

SEQ ID NO: 5574383 - DNA, 13 bp, Homo sapiens
atgtgaagtgtta

SEQ ID NO: 5574384 - DNA, 12 bp, Homo sapiens
atgtgaagtttt

SEQ ID NO: 5574385 - DNA, 19 bp, Homo sapiens
atgtgaagttttccttgct

SEQ ID NO: 5574386 - DNA, 21 bp, Homo sapiens
atgtgaagttttccttgctat

SEQ ID NO: 5574387 - DNA, 20 bp, Homo sapiens
atgtgaatatttgtaaaaat

SEQ ID NO: 5574388 - DNA, 16 bp, Homo sapiens
atgtgaatctatgctg

SEQ ID NO: 5574389 - DNA, 16 bp, Homo sapiens
atgtgaattactaact

SEQ ID NO: 5574390 - DNA, 21 bp, Homo sapiens
atgtgaattactaacttctaa

SEQ ID NO: 5574391 - DNA, 18 bp, Homo sapiens
atgtgaattattgacact

SEQ ID NO: 5574392 - DNA, 19 bp, Homo sapiens
atgtgaattattgacactg

SEQ ID NO: 5574393 - DNA, 17 bp, Homo sapiens
atgtgaattctgtgaag

SEQ ID NO: 5574394 - DNA, 17 bp, Homo sapiens
atgtgaattgaagtcat

SEQ ID NO: 5574395 - DNA, 20 bp, Homo sapiens
atgtgaattgaagtcatcat

SEQ ID NO: 5574396 - DNA, 11 bp, Homo sapiens
atgtgaattgt

SEQ ID NO: 5574397 - DNA, 18 bp, Homo sapiens
atgtgaatttaatgctta

SEQ ID NO: 5574398 - DNA, 11 bp, Homo sapiens
atgtgaatttt

SEQ ID NO: 5574399 - DNA, 19 bp, Homo sapiens
atgtgaatttttaagctgc

SEQ ID NO: 5574400 - DNA, 18 bp, Homo sapiens
atgtgaatttttattgtt

SEQ ID NO: 5574401 - DNA, 16 bp, Homo sapiens
atgtgacaacattttt

SEQ ID NO: 5574402 - DNA, 23 bp, Homo sapiens
atgtgacaacatttttgtacatt

SEQ ID NO: 5574403 - DNA, 14 bp, Homo sapiens
atgtgacaaccttt

SEQ ID NO: 5574404 - DNA, 18 bp, Homo sapiens
atgtgacaacctttgtgt

SEQ ID NO: 5574405 - DNA, 23 bp, Homo sapiens
atgtgacaacctttgtgtaataa

SEQ ID NO: 5574406 - DNA, 16 bp, Homo sapiens
atgtgacaataatatt

SEQ ID NO: 5574407 - DNA, 21 bp, Homo sapiens
atgtgacaattttgtacaaat

SEQ ID NO: 5574408 - DNA, 14 bp, Homo sapiens
atgtgacacattct

SEQ ID NO: 5574409 - DNA, 15 bp, Homo sapiens
atgtgacaccaaagc

SEQ ID NO: 5574410 - DNA, 19 bp, Homo sapiens
atgtgacacctaactcttt

SEQ ID NO: 5574411 - DNA, 14 bp, Homo sapiens
atgtgacagtggcg

SEQ ID NO: 5574412 - DNA, 18 bp, Homo sapiens
atgtgacattaacaaata

SEQ ID NO: 5574413 - DNA, 21 bp, Homo sapiens
atgtgacattaacaaataaaa

SEQ ID NO: 5574414 - DNA, 16 bp, Homo sapiens
atgtgacatttacacc

SEQ ID NO: 5574415 - DNA, 13 bp, Homo sapiens
atgtgacatttat

SEQ ID NO: 5574416 - DNA, 14 bp, Homo sapiens
atgtgacatttata

SEQ ID NO: 5574417 - DNA, 13 bp, Homo sapiens
atgtgacatttgt

SEQ ID NO: 5574418 - DNA, 23 bp, Homo sapiens
atgtgacatttgtcattttcatt

SEQ ID NO: 5574419 - DNA, 19 bp, Homo sapiens
atgtgaccactctgtcttg

SEQ ID NO: 5574420 - DNA, 15 bp, Homo sapiens
atgtgaccataatgt

SEQ ID NO: 5574421 - DNA, 16 bp, Homo sapiens
atgtgacccaccagtg

SEQ ID NO: 5574422 - DNA, 17 bp, Homo sapiens
atgtgacccaccagtgc

SEQ ID NO: 5574423 - DNA, 18 bp, Homo sapiens
atgtgacccaccagtgcc

SEQ ID NO: 5574424 - DNA, 19 bp, Homo sapiens
atgtgacccaccagtgcct

SEQ ID NO: 5574425 - DNA, 12 bp, Homo sapiens
atgtgaccctcc

SEQ ID NO: 5574426 - DNA, 14 bp, Homo sapiens
atgtgaccctccaa

SEQ ID NO: 5574427 - DNA, 12 bp, Homo sapiens
atgtgactctga

SEQ ID NO: 5574428 - DNA, 18 bp, Homo sapiens
atgtgactctgaagctga

SEQ ID NO: 5574429 - DNA, 14 bp, Homo sapiens
atgtgactgtataa

SEQ ID NO: 5574430 - DNA, 18 bp, Homo sapiens
atgtgactttgcatcagc

SEQ ID NO: 5574431 - DNA, 16 bp, Homo sapiens
atgtgactttttttgg

SEQ ID NO: 5574432 - DNA, 16 bp, Homo sapiens
atgtgagaaatgtcta

SEQ ID NO: 5574433 - DNA, 19 bp, Homo sapiens
atgtgagaacttttcatag

SEQ ID NO: 5574434 - DNA, 11 bp, Homo sapiens
atgtgagacag

SEQ ID NO: 5574435 - DNA, 15 bp, Homo sapiens
atgtgagacagcaag

SEQ ID NO: 5574436 - DNA, 13 bp, Homo sapiens
atgtgagaccatt

SEQ ID NO: 5574437 - DNA, 16 bp, Homo sapiens
atgtgagaggtttgac

SEQ ID NO: 5574438 - DNA, 18 bp, Homo sapiens
atgtgagatagttttcat

SEQ ID NO: 5574439 - DNA, 21 bp, Homo sapiens
atgtgagattactttgtcccg

SEQ ID NO: 5574440 - DNA, 15 bp, Homo sapiens
atgtgagatttcctt

SEQ ID NO: 5574441 - DNA, 17 bp, Homo sapiens
atgtgagccaccgtgcc

SEQ ID NO: 5574442 - DNA, 22 bp, Homo sapiens
atgtgagccaccgtgcctggcc

SEQ ID NO: 5574443 - DNA, 14 bp, Homo sapiens
atgtgagctataat

SEQ ID NO: 5574444 - DNA, 16 bp, Homo sapiens
atgtgagctgctgcca

SEQ ID NO: 5574445 - DNA, 21 bp, Homo sapiens
atgtgaggaagaactacagct

SEQ ID NO: 5574446 - DNA, 15 bp, Homo sapiens
atgtgaggaggaaaa

SEQ ID NO: 5574447 - DNA, 15 bp, Homo sapiens
atgtgaggcaataag

SEQ ID NO: 5574448 - DNA, 21 bp, Homo sapiens
atgtgagtagtcttatgtaaa

SEQ ID NO: 5574449 - DNA, 14 bp, Homo sapiens
atgtgagtattctc

SEQ ID NO: 5574450 - DNA, 17 bp, Homo sapiens
atgtgagtattctcatt

SEQ ID NO: 5574451 - DNA, 21 bp, Homo sapiens
atgtgagtcctgttgaagact

SEQ ID NO: 5574452 - DNA, 18 bp, Homo sapiens
atgtgagtgccttttgca

SEQ ID NO: 5574453 - DNA, 23 bp, Homo sapiens
atgtgagtgccttttgcagaaga

SEQ ID NO: 5574454 - DNA, 17 bp, Homo sapiens
atgtgagtgtgtgtgat

SEQ ID NO: 5574455 - DNA, 22 bp, Homo sapiens
atgtgagtttggtctggactga

SEQ ID NO: 5574456 - DNA, 20 bp, Homo sapiens
atgtgataaggaaatcaact

SEQ ID NO: 5574457 - DNA, 21 bp, Homo sapiens
atgtgataagttcttatgcca

SEQ ID NO: 5574458 - DNA, 19 bp, Homo sapiens
atgtgataattgtaaaggt

SEQ ID NO: 5574459 - DNA, 17 bp, Homo sapiens
atgtgatacactgaatg

SEQ ID NO: 5574460 - DNA, 15 bp, Homo sapiens
atgtgatacattttt

SEQ ID NO: 5574461 - DNA, 21 bp, Homo sapiens
atgtgatacattttttaagct

SEQ ID NO: 5574462 - DNA, 14 bp, Homo sapiens
atgtgatataaaat

SEQ ID NO: 5574463 - DNA, 18 bp, Homo sapiens
atgtgatataaaatattc

SEQ ID NO: 5574464 - DNA, 15 bp, Homo sapiens
atgtgatatataagt

SEQ ID NO: 5574465 - DNA, 17 bp, Homo sapiens
atgtgatatataagtgt

SEQ ID NO: 5574466 - DNA, 14 bp, Homo sapiens
atgtgatatgtgta

SEQ ID NO: 5574467 - DNA, 23 bp, Homo sapiens
atgtgatatgtgtaatatcattt

SEQ ID NO: 5574468 - DNA, 14 bp, Homo sapiens
atgtgatatgtttt

SEQ ID NO: 5574469 - DNA, 16 bp, Homo sapiens
atgtgatattctaaga

SEQ ID NO: 5574470 - DNA, 15 bp, Homo sapiens
atgtgatattttcac

SEQ ID NO: 5574471 - DNA, 17 bp, Homo sapiens
atgtgatcaactgttca

SEQ ID NO: 5574472 - DNA, 13 bp, Homo sapiens
atgtgatctatta

SEQ ID NO: 5574473 - DNA, 11 bp, Homo sapiens
atgtgatctca

SEQ ID NO: 5574474 - DNA, 19 bp, Homo sapiens
atgtgatctgtcttgtaat

SEQ ID NO: 5574475 - DNA, 19 bp, Homo sapiens
atgtgatgagaggaaatca

SEQ ID NO: 5574476 - DNA, 17 bp, Homo sapiens
atgtgatgatgtaattg

SEQ ID NO: 5574477 - DNA, 17 bp, Homo sapiens
atgtgatgccaaagatg

SEQ ID NO: 5574478 - DNA, 14 bp, Homo sapiens
atgtgatgctggaa

SEQ ID NO: 5574479 - DNA, 23 bp, Homo sapiens
atgtgatggatggcacaatgaat

SEQ ID NO: 5574480 - DNA, 21 bp, Homo sapiens
atgtgatggtacacagtgggt

SEQ ID NO: 5574481 - DNA, 13 bp, Homo sapiens
atgtgatgtaact

SEQ ID NO: 5574482 - DNA, 21 bp, Homo sapiens
atgtgtcccccctgtggtctg

SEQ ID NO: 5574483 - DNA, 11 bp, Homo sapiens
atgtgtcccct

SEQ ID NO: 5574484 - DNA, 14 bp, Homo sapiens
atgtgtcccctcac

SEQ ID NO: 5574485 - DNA, 15 bp, Homo sapiens
atgtgtcccctcact

SEQ ID NO: 5574486 - DNA, 18 bp, Homo sapiens
atgtgtcccctcactctg

SEQ ID NO: 5574487 - DNA, 22 bp, Homo sapiens
atgtgtccctggcgctgtgcta

SEQ ID NO: 5574488 - DNA, 13 bp, Homo sapiens
atgtgtcccttcc

SEQ ID NO: 5574489 - DNA, 14 bp, Homo sapiens
atgtgtcccttcca

SEQ ID NO: 5574490 - DNA, 20 bp, Homo sapiens
atgtgtccgtgaaagttgtg

SEQ ID NO: 5574491 - DNA, 18 bp, Homo sapiens
atgtgtcctatctatctt

SEQ ID NO: 5574492 - DNA, 19 bp, Homo sapiens
atgtgtcctatctatcttc

SEQ ID NO: 5574493 - DNA, 14 bp, Homo sapiens
atgtgtcctcctgc

SEQ ID NO: 5574494 - DNA, 17 bp, Homo sapiens
atgtgtcctcctgctct

SEQ ID NO: 5574495 - DNA, 18 bp, Homo sapiens
atgtgtcctcctgctctg

SEQ ID NO: 5574496 - DNA, 21 bp, Homo sapiens
atgtgtcctcctgctctgctt

SEQ ID NO: 5574497 - DNA, 22 bp, Homo sapiens
atgtgtcctcctgctctgcttc

SEQ ID NO: 5574498 - DNA, 14 bp, Homo sapiens
atgtgtcctggtga

SEQ ID NO: 5574499 - DNA, 13 bp, Homo sapiens
atgtgtcctggtt

SEQ ID NO: 5574500 - DNA, 17 bp, Homo sapiens
atgtgtctagcaaagcc

SEQ ID NO: 5574501 - DNA, 18 bp, Homo sapiens
atgtgtctagcaaagcca

SEQ ID NO: 5574502 - DNA, 19 bp, Homo sapiens
atgtgtctcaggaaaacag

SEQ ID NO: 5574503 - DNA, 12 bp, Homo sapiens
atgtgtctccca

SEQ ID NO: 5574504 - DNA, 23 bp, Homo sapiens
atgtgtctcccaggtgcatttct

SEQ ID NO: 5574505 - DNA, 13 bp, Homo sapiens
atgtgtctcctgt

SEQ ID NO: 5574506 - DNA, 14 bp, Homo sapiens
atgtgtctctgctt

SEQ ID NO: 5574507 - DNA, 13 bp, Homo sapiens
atgtgtctgcaac

SEQ ID NO: 5574508 - DNA, 16 bp, Homo sapiens
atgtgtctgcaacatg

SEQ ID NO: 5574509 - DNA, 19 bp, Homo sapiens
atgtgtctgccacattaac

SEQ ID NO: 5574510 - DNA, 21 bp, Homo sapiens
atgtgtctgctaatgtaaact

SEQ ID NO: 5574511 - DNA, 13 bp, Homo sapiens
atgtgtctggaag

SEQ ID NO: 5574512 - DNA, 14 bp, Homo sapiens
atgtgtctggaaga

SEQ ID NO: 5574513 - DNA, 17 bp, Homo sapiens
atgtgtctgggagagcc

SEQ ID NO: 5574514 - DNA, 18 bp, Homo sapiens
atgtgtctgggagagcct

SEQ ID NO: 5574515 - DNA, 23 bp, Homo sapiens
atgtgtctgggagagcctggcaa

SEQ ID NO: 5574516 - DNA, 13 bp, Homo sapiens
atgtgtctgtatt

SEQ ID NO: 5574517 - DNA, 18 bp, Homo sapiens
atgtgtctgtatttcatg

SEQ ID NO: 5574518 - DNA, 20 bp, Homo sapiens
atgtgtctgtatttcatgtg

SEQ ID NO: 5574519 - DNA, 19 bp, Homo sapiens
atgtgtctttatagatgta

SEQ ID NO: 5574520 - DNA, 14 bp, Homo sapiens
atgtgtctttctaa

SEQ ID NO: 5574521 - DNA, 19 bp, Homo sapiens
atgtgtctttctaagaaat

SEQ ID NO: 5574522 - DNA, 16 bp, Homo sapiens
atgtgtgaaacaatgt

SEQ ID NO: 5574523 - DNA, 13 bp, Homo sapiens
atgtgtgaaacct

SEQ ID NO: 5574524 - DNA, 18 bp, Homo sapiens
atgtgtgaaacctgacac

SEQ ID NO: 5574525 - DNA, 14 bp, Homo sapiens
atgtgtgaagctga

SEQ ID NO: 5574526 - DNA, 22 bp, Homo sapiens
atgtgtgagataacttccttca

SEQ ID NO: 5574527 - DNA, 18 bp, Homo sapiens
atgtgtgagcatcctgca

SEQ ID NO: 5574528 - DNA, 22 bp, Homo sapiens
atgtgtgagctttttttaaata

SEQ ID NO: 5574529 - DNA, 17 bp, Homo sapiens
atgtgtgagtgtatgta

SEQ ID NO: 5574530 - DNA, 21 bp, Homo sapiens
atgtgtgagtgtatgtataca

SEQ ID NO: 5574531 - DNA, 13 bp, Homo sapiens
atgtgtgagtgtg

SEQ ID NO: 5574532 - DNA, 13 bp, Homo sapiens
atgtgtgatgctg

SEQ ID NO: 5574533 - DNA, 16 bp, Homo sapiens
atgtgtgatgctgaca

SEQ ID NO: 5574534 - DNA, 18 bp, Homo sapiens
atgtgtgatgctgacacc

SEQ ID NO: 5574535 - DNA, 20 bp, Homo sapiens
atgtgtgatgctgacaccag

SEQ ID NO: 5574536 - DNA, 16 bp, Homo sapiens
atgtgtgcagacaatt

SEQ ID NO: 5574537 - DNA, 20 bp, Homo sapiens
atgtgtgcagacaattctcc

SEQ ID NO: 5574538 - DNA, 15 bp, Homo sapiens
atgtgtgcagagcag

SEQ ID NO: 5574539 - DNA, 18 bp, Homo sapiens
atgtgtgcagagcagaca

SEQ ID NO: 5574540 - DNA, 12 bp, Homo sapiens
atgtgtgcagga

SEQ ID NO: 5574541 - DNA, 14 bp, Homo sapiens
atgtgtgcatgtga

SEQ ID NO: 5574542 - DNA, 17 bp, Homo sapiens
atgtgtgcatgtgagca

SEQ ID NO: 5574543 - DNA, 18 bp, Homo sapiens
atgtgtgcatgtgtgtat

SEQ ID NO: 5574544 - DNA, 20 bp, Homo sapiens
atgtgtgcatgtgtgtataa

SEQ ID NO: 5574545 - DNA, 11 bp, Homo sapiens
atgtgtgccat

SEQ ID NO: 5574546 - DNA, 18 bp, Homo sapiens
atgtgtgccatagagttt

SEQ ID NO: 5574547 - DNA, 14 bp, Homo sapiens
atgtgtgccctgga

SEQ ID NO: 5574548 - DNA, 17 bp, Homo sapiens
atgtgtgcctgtggcag

SEQ ID NO: 5574549 - DNA, 16 bp, Homo sapiens
atgtgtgctcacaatg

SEQ ID NO: 5574550 - DNA, 19 bp, Homo sapiens
atgtgtgctcttatcccca

SEQ ID NO: 5574551 - DNA, 22 bp, Homo sapiens
atgtgtgctcttatccccagct

SEQ ID NO: 5574552 - DNA, 16 bp, Homo sapiens
atgtgtgctttattga

SEQ ID NO: 5574553 - DNA, 15 bp, Homo sapiens
atgtgtggcagattt

SEQ ID NO: 5574554 - DNA, 14 bp, Homo sapiens
atgtgtggcctgca

SEQ ID NO: 5574555 - DNA, 15 bp, Homo sapiens
atgtgtgggaaaggg

SEQ ID NO: 5574556 - DNA, 15 bp, Homo sapiens
atgtgtgggtgctga

SEQ ID NO: 5574557 - DNA, 21 bp, Homo sapiens
atgtgtgggtgtgtgttacat

SEQ ID NO: 5574558 - DNA, 17 bp, Homo sapiens
atgtgtggtggcctcag

SEQ ID NO: 5574559 - DNA, 15 bp, Homo sapiens
atgtgtggtttataa

SEQ ID NO: 5574560 - DNA, 17 bp, Homo sapiens
atgtgtgtaggttatct

SEQ ID NO: 5574561 - DNA, 23 bp, Homo sapiens
atgtgtgtaggttatctttttaa

SEQ ID NO: 5574562 - DNA, 14 bp, Homo sapiens
atgtgtgtatatat

SEQ ID NO: 5574563 - DNA, 15 bp, Homo sapiens
atgtgtgtatatatg

SEQ ID NO: 5574564 - DNA, 20 bp, Homo sapiens
atgtgtgtatatatgtgtat

SEQ ID NO: 5574565 - DNA, 15 bp, Homo sapiens
atgtgtgtatatgga

SEQ ID NO: 5574566 - DNA, 14 bp, Homo sapiens
atgtgtgtatatgt

SEQ ID NO: 5574567 - DNA, 16 bp, Homo sapiens
atgtgtgtatatgtat

SEQ ID NO: 5574568 - DNA, 20 bp, Homo sapiens
atgtgtgtattttttcatag

SEQ ID NO: 5574569 - DNA, 11 bp, Homo sapiens
atgtgtgtgag

SEQ ID NO: 5574570 - DNA, 13 bp, Homo sapiens
atgtgtgtgatgt

SEQ ID NO: 5574571 - DNA, 19 bp, Homo sapiens
atgtgtgtgatgtgacatt

SEQ ID NO: 5574572 - DNA, 16 bp, Homo sapiens
atgtgtgtgcaagtgt

SEQ ID NO: 5574573 - DNA, 12 bp, Homo sapiens
atgtgtgtgcag

SEQ ID NO: 5574574 - DNA, 21 bp, Homo sapiens
atgtgtgtgccaagccctggc

SEQ ID NO: 5574575 - DNA, 15 bp, Homo sapiens
atgtgtgtgctcagg

SEQ ID NO: 5574576 - DNA, 16 bp, Homo sapiens
atgtgtgtggtgtgtg

SEQ ID NO: 5574577 - DNA, 22 bp, Homo sapiens
atgtgtgtggttttttttctaa

SEQ ID NO: 5574578 - DNA, 22 bp, Homo sapiens
atgtgtgtgtatataaatacat

SEQ ID NO: 5574579 - DNA, 13 bp, Homo sapiens
atgtgtgtgtctc

SEQ ID NO: 5574580 - DNA, 18 bp, Homo sapiens
atgtgtgtgtctgtgcgt

SEQ ID NO: 5574581 - DNA, 19 bp, Homo sapiens
atgtgtgtgtgggtgtgtg

SEQ ID NO: 5574582 - DNA, 21 bp, Homo sapiens
atgtgtgtgtgggtgtgtgcg

SEQ ID NO: 5574583 - DNA, 18 bp, Homo sapiens
atgtgtgtgtgtctccat

SEQ ID NO: 5574584 - DNA, 14 bp, Homo sapiens
atgtgtgtgtgtgt

SEQ ID NO: 5574585 - DNA, 16 bp, Homo sapiens
atgtgtgtgtgtgtgt

SEQ ID NO: 5574586 - DNA, 23 bp, Homo sapiens
atgtgtgtgtgttgtgtgtggga

SEQ ID NO: 5574587 - DNA, 15 bp, Homo sapiens
atgtgtgttgatact

SEQ ID NO: 5574588 - DNA, 16 bp, Homo sapiens
atgtgtgttgatactg

SEQ ID NO: 5574589 - DNA, 17 bp, Homo sapiens
atgtgtgttgatactgt

SEQ ID NO: 5574590 - DNA, 21 bp, Homo sapiens
atgtgtgttgatactgttgca

SEQ ID NO: 5574591 - DNA, 17 bp, Homo sapiens
atgtgtgttgtcagcct

SEQ ID NO: 5574592 - DNA, 19 bp, Homo sapiens
atgtgtgttgtcagcctgt

SEQ ID NO: 5574593 - DNA, 20 bp, Homo sapiens
atgtgtgttgtcagcctgtg

SEQ ID NO: 5574594 - DNA, 21 bp, Homo sapiens
atgtgtgttgtcagcctgtgc

SEQ ID NO: 5574595 - DNA, 14 bp, Homo sapiens
atgtgtgttgtttc

SEQ ID NO: 5574596 - DNA, 15 bp, Homo sapiens
atgtgtgttgtttcc

SEQ ID NO: 5574597 - DNA, 21 bp, Homo sapiens
atgtgtgttgtttccatagct

SEQ ID NO: 5574598 - DNA, 19 bp, Homo sapiens
atgtgtgtttaaataaagt

SEQ ID NO: 5574599 - DNA, 14 bp, Homo sapiens
atgtgtgtttctgt

SEQ ID NO: 5574600 - DNA, 16 bp, Homo sapiens
atgtgttaaatttagt

SEQ ID NO: 5574601 - DNA, 17 bp, Homo sapiens
atgtgttaaatttagtg

SEQ ID NO: 5574602 - DNA, 17 bp, Homo sapiens
atgtgttaatcttaatg

SEQ ID NO: 5574603 - DNA, 17 bp, Homo sapiens
atgtgttagcactgata

SEQ ID NO: 5574604 - DNA, 16 bp, Homo sapiens
atgtgttatgaacatc

SEQ ID NO: 5574605 - DNA, 23 bp, Homo sapiens
atgtgttcaaggaccacatgtgt

SEQ ID NO: 5574606 - DNA, 14 bp, Homo sapiens
atgtgttccaaatt

SEQ ID NO: 5574607 - DNA, 22 bp, Homo sapiens
atgtgttcctcttgttctaatc

SEQ ID NO: 5574608 - DNA, 19 bp, Homo sapiens
atgtgttcggttttgttgt

SEQ ID NO: 5574609 - DNA, 20 bp, Homo sapiens
atgtgttctcggagtgtgta

SEQ ID NO: 5574610 - DNA, 13 bp, Homo sapiens
atgtgttcttatt

SEQ ID NO: 5574611 - DNA, 14 bp, Homo sapiens
atgtgttgaaaacc

SEQ ID NO: 5574612 - DNA, 18 bp, Homo sapiens
atgtgttgaaaaccaaaa

SEQ ID NO: 5574613 - DNA, 20 bp, Homo sapiens
atgtgttgacgtaagctcta

SEQ ID NO: 5574614 - DNA, 22 bp, Homo sapiens
atgtgttgattcttgaaaactg

SEQ ID NO: 5574615 - DNA, 22 bp, Homo sapiens
atgtgttgcaaattattctagt

SEQ ID NO: 5574616 - DNA, 16 bp, Homo sapiens
atgtgttgccaaagct

SEQ ID NO: 5574617 - DNA, 17 bp, Homo sapiens
atgtgttggacaaatgt

SEQ ID NO: 5574618 - DNA, 22 bp, Homo sapiens
atgtgttggacaaatgtgaaga

SEQ ID NO: 5574619 - DNA, 14 bp, Homo sapiens
atgtgttgtgatag

SEQ ID NO: 5574620 - DNA, 22 bp, Homo sapiens
atgtgtttaaattattttatca

SEQ ID NO: 5574621 - DNA, 15 bp, Homo sapiens
atgtgtttactttaa

SEQ ID NO: 5574622 - DNA, 17 bp, Homo sapiens
atgtgtttagaattgaa

SEQ ID NO: 5574623 - DNA, 12 bp, Homo sapiens
atgtgtttcaaa

SEQ ID NO: 5574624 - DNA, 21 bp, Homo sapiens
atgtgtttccttttcaggaga

SEQ ID NO: 5574625 - DNA, 14 bp, Homo sapiens
atgtgtttctgtaa

SEQ ID NO: 5574626 - DNA, 18 bp, Homo sapiens
atgtgtttctgtaacaaa

SEQ ID NO: 5574627 - DNA, 19 bp, Homo sapiens
atgtgtttctgtaacaaat

SEQ ID NO: 5574628 - DNA, 15 bp, Homo sapiens
atgtgtttgaacttc

SEQ ID NO: 5574629 - DNA, 15 bp, Homo sapiens
atgtgtttgctttct

SEQ ID NO: 5574630 - DNA, 16 bp, Homo sapiens
atgtgtttgctttctg

SEQ ID NO: 5574631 - DNA, 23 bp, Homo sapiens
atgtgtttggagttaaaatgtgt

SEQ ID NO: 5574632 - DNA, 19 bp, Homo sapiens
atgtgtttggatacatctg

SEQ ID NO: 5574633 - DNA, 14 bp, Homo sapiens
atgtgttttaataa

SEQ ID NO: 5574634 - DNA, 20 bp, Homo sapiens
atgtgttttaataaacgttt

SEQ ID NO: 5574635 - DNA, 16 bp, Homo sapiens
atgtgttttataaaat

SEQ ID NO: 5574636 - DNA, 17 bp, Homo sapiens
atgtgttttcatcattt

SEQ ID NO: 5574637 - DNA, 15 bp, Homo sapiens
atgtgttttgctttt

SEQ ID NO: 5574638 - DNA, 22 bp, Homo sapiens
atgtgtttttctatatagttcc

SEQ ID NO: 5574639 - DNA, 21 bp, Homo sapiens
atgtgtttttgggaagaagaa

SEQ ID NO: 5574640 - DNA, 15 bp, Homo sapiens
atgttaaaaaaataa

SEQ ID NO: 5574641 - DNA, 21 bp, Homo sapiens
atgttaaaaaaataagaagaa

SEQ ID NO: 5574642 - DNA, 18 bp, Homo sapiens
atgttaaaacaaattaaa

SEQ ID NO: 5574643 - DNA, 12 bp, Homo sapiens
atgttaaaacat

SEQ ID NO: 5574644 - DNA, 11 bp, Homo sapiens
atgttaaaaga

SEQ ID NO: 5574645 - DNA, 14 bp, Homo sapiens
atgttaaaataaat

SEQ ID NO: 5574646 - DNA, 14 bp, Homo sapiens
atgttaaaatgtgt

SEQ ID NO: 5574647 - DNA, 23 bp, Homo sapiens
atgttaaactagcatatctgcct

SEQ ID NO: 5574648 - DNA, 21 bp, Homo sapiens
atgttaaactctgttgtaagt

SEQ ID NO: 5574649 - DNA, 21 bp, Homo sapiens
atgttaaacttacttagtgtt

SEQ ID NO: 5574650 - DNA, 18 bp, Homo sapiens
atgttaaagagaatgagt

SEQ ID NO: 5574651 - DNA, 22 bp, Homo sapiens
atgttaaagaggcgtcttgtat

SEQ ID NO: 5574652 - DNA, 17 bp, Homo sapiens
atgttaaagatgtagca

SEQ ID NO: 5574653 - DNA, 20 bp, Homo sapiens
atgttaaagatgtagcaaac

SEQ ID NO: 5574654 - DNA, 12 bp, Homo sapiens
atgttaaagcat

SEQ ID NO: 5574655 - DNA, 22 bp, Homo sapiens
atgttaaagtttaagtgtgcag

SEQ ID NO: 5574656 - DNA, 17 bp, Homo sapiens
atgttaaataaattgta

SEQ ID NO: 5574657 - DNA, 22 bp, Homo sapiens
atgttaaataaattgtatattc

SEQ ID NO: 5574658 - DNA, 19 bp, Homo sapiens
atgttaaatactgtgcaga

SEQ ID NO: 5574659 - DNA, 24 bp, Homo sapiens
atgttaaataggcggggcttgcct

SEQ ID NO: 5574660 - DNA, 19 bp, Homo sapiens
attagaagtataaggtgct

SEQ ID NO: 5574661 - DNA, 20 bp, Homo sapiens
attagaagtataaggtgctc

SEQ ID NO: 5574662 - DNA, 16 bp, Homo sapiens
attagaagtctttcag

SEQ ID NO: 5574663 - DNA, 14 bp, Homo sapiens
attagaagtgttaa

SEQ ID NO: 5574664 - DNA, 15 bp, Homo sapiens
attagaatagaactt

SEQ ID NO: 5574665 - DNA, 20 bp, Homo sapiens
attagaatataaaaaatgtt

SEQ ID NO: 5574666 - DNA, 14 bp, Homo sapiens
attagaatgaaaat

SEQ ID NO: 5574667 - DNA, 20 bp, Homo sapiens
attagaatggataagatgat

SEQ ID NO: 5574668 - DNA, 12 bp, Homo sapiens
attagaatgtga

SEQ ID NO: 5574669 - DNA, 15 bp, Homo sapiens
attagaattctgtat

SEQ ID NO: 5574670 - DNA, 22 bp, Homo sapiens
attagaattgtgtgttaatgtc

SEQ ID NO: 5574671 - DNA, 15 bp, Homo sapiens
attagacaaatttgt

SEQ ID NO: 5574672 - DNA, 14 bp, Homo sapiens
attagacaatgtgg

SEQ ID NO: 5574673 - DNA, 20 bp, Homo sapiens
attagacacacatatacatt

SEQ ID NO: 5574674 - DNA, 23 bp, Homo sapiens
attagacagtaagagtttacaag

SEQ ID NO: 5574675 - DNA, 15 bp, Homo sapiens
attagactcctcctc

SEQ ID NO: 5574676 - DNA, 19 bp, Homo sapiens
attagactctctagtttta

SEQ ID NO: 5574677 - DNA, 16 bp, Homo sapiens
attagactggacagct

SEQ ID NO: 5574678 - DNA, 19 bp, Homo sapiens
attagacttctgttttcaa

SEQ ID NO: 5574679 - DNA, 13 bp, Homo sapiens
attagagaagctg

SEQ ID NO: 5574680 - DNA, 18 bp, Homo sapiens
attagagagatttttcat

SEQ ID NO: 5574681 - DNA, 17 bp, Homo sapiens
attagagagtgttgaaa

SEQ ID NO: 5574682 - DNA, 13 bp, Homo sapiens
attagagatatag

SEQ ID NO: 5574683 - DNA, 20 bp, Homo sapiens
attagagattacctcctgag

SEQ ID NO: 5574684 - DNA, 22 bp, Homo sapiens
attagagcacagcttcttctgc

SEQ ID NO: 5574685 - DNA, 23 bp, Homo sapiens
attagagcacagcttcttctgcc

SEQ ID NO: 5574686 - DNA, 14 bp, Homo sapiens
attagagcattgaa

SEQ ID NO: 5574687 - DNA, 14 bp, Homo sapiens
attagagcttaaat

SEQ ID NO: 5574688 - DNA, 19 bp, Homo sapiens
attagagggaggagaatga

SEQ ID NO: 5574689 - DNA, 19 bp, Homo sapiens
attagagggatgagacaga

SEQ ID NO: 5574690 - DNA, 16 bp, Homo sapiens
attagaggtttgtcaa

SEQ ID NO: 5574691 - DNA, 18 bp, Homo sapiens
attagaggtttgtcaaca

SEQ ID NO: 5574692 - DNA, 22 bp, Homo sapiens
attagagtggttattcattatt

SEQ ID NO: 5574693 - DNA, 18 bp, Homo sapiens
attagataaacacaggca

SEQ ID NO: 5574694 - DNA, 14 bp, Homo sapiens
attagataatattt

SEQ ID NO: 5574695 - DNA, 15 bp, Homo sapiens
attagataatatttt

SEQ ID NO: 5574696 - DNA, 18 bp, Homo sapiens
attagataatcttttaca

SEQ ID NO: 5574697 - DNA, 23 bp, Homo sapiens
attagatatcaatgttaatgata

SEQ ID NO: 5574698 - DNA, 21 bp, Homo sapiens
attagatcaaatagttgcata

SEQ ID NO: 5574699 - DNA, 19 bp, Homo sapiens
attagatcctaagatgtgt

SEQ ID NO: 5574700 - DNA, 18 bp, Homo sapiens
attagatctaaacagtta

SEQ ID NO: 5574701 - DNA, 11 bp, Homo sapiens
attagatgaat

SEQ ID NO: 5574702 - DNA, 18 bp, Homo sapiens
attagatgactgaatttc

SEQ ID NO: 5574703 - DNA, 19 bp, Homo sapiens
attagatgattatatattg

SEQ ID NO: 5574704 - DNA, 22 bp, Homo sapiens
attagatgctctgagaaattga

SEQ ID NO: 5574705 - DNA, 16 bp, Homo sapiens
attagatggcttattt

SEQ ID NO: 5574706 - DNA, 14 bp, Homo sapiens
attagatgtcatga

SEQ ID NO: 5574707 - DNA, 13 bp, Homo sapiens
attagatgtgatt

SEQ ID NO: 5574708 - DNA, 20 bp, Homo sapiens
attagatgttactgtgtgaa

SEQ ID NO: 5574709 - DNA, 21 bp, Homo sapiens
attagatgttctctatcattt

SEQ ID NO: 5574710 - DNA, 14 bp, Homo sapiens
attagatgtttata

SEQ ID NO: 5574711 - DNA, 19 bp, Homo sapiens
attagatgtttatttagaa

SEQ ID NO: 5574712 - DNA, 14 bp, Homo sapiens
attagattatattg

SEQ ID NO: 5574713 - DNA, 19 bp, Homo sapiens
attagattatttctgtatt

SEQ ID NO: 5574714 - DNA, 19 bp, Homo sapiens
attagattcctttcctgtg

SEQ ID NO: 5574715 - DNA, 16 bp, Homo sapiens
attagattttatttta

SEQ ID NO: 5574716 - DNA, 18 bp, Homo sapiens
attagattttattttact

SEQ ID NO: 5574717 - DNA, 20 bp, Homo sapiens
attagattttattttactat

SEQ ID NO: 5574718 - DNA, 17 bp, Homo sapiens
attagattttcctcctt

SEQ ID NO: 5574719 - DNA, 21 bp, Homo sapiens
attagattttcctcctttcct

SEQ ID NO: 5574720 - DNA, 16 bp, Homo sapiens
attagcaaaaaaagtt

SEQ ID NO: 5574721 - DNA, 17 bp, Homo sapiens
attagcaaaaaaagttg

SEQ ID NO: 5574722 - DNA, 13 bp, Homo sapiens
attagcaaggcag

SEQ ID NO: 5574723 - DNA, 15 bp, Homo sapiens
attagcaaggcagag

SEQ ID NO: 5574724 - DNA, 19 bp, Homo sapiens
attagcaaggcagagcctt

SEQ ID NO: 5574725 - DNA, 14 bp, Homo sapiens
attagcaaggctgg

SEQ ID NO: 5574726 - DNA, 22 bp, Homo sapiens
attagcaatgaattagttgcat

SEQ ID NO: 5574727 - DNA, 16 bp, Homo sapiens
attagcacagatttta

SEQ ID NO: 5574728 - DNA, 23 bp, Homo sapiens
attagcacagattttaattgtca

SEQ ID NO: 5574729 - DNA, 18 bp, Homo sapiens
attagcacatatttcaca

SEQ ID NO: 5574730 - DNA, 12 bp, Homo sapiens
attagcaccagc

SEQ ID NO: 5574731 - DNA, 22 bp, Homo sapiens
attagcaccagcttgcttctct

SEQ ID NO: 5574732 - DNA, 17 bp, Homo sapiens
attagcagaatggagaa

SEQ ID NO: 5574733 - DNA, 22 bp, Homo sapiens
attagcagaatggagaaagtaa

SEQ ID NO: 5574734 - DNA, 15 bp, Homo sapiens
attagcatgaaaggt

SEQ ID NO: 5574735 - DNA, 15 bp, Homo sapiens
attagcatgcaagct

SEQ ID NO: 5574736 - DNA, 15 bp, Homo sapiens
attagcattccttaa

SEQ ID NO: 5574737 - DNA, 15 bp, Homo sapiens
attagccaaagaggc

SEQ ID NO: 5574738 - DNA, 16 bp, Homo sapiens
attagccaaccaggct

SEQ ID NO: 5574739 - DNA, 23 bp, Homo sapiens
attagccaactgtttccctgctg

SEQ ID NO: 5574740 - DNA, 11 bp, Homo sapiens
attagccagga

SEQ ID NO: 5574741 - DNA, 13 bp, Homo sapiens
attagccaggatc

SEQ ID NO: 5574742 - DNA, 15 bp, Homo sapiens
attagccaggctggt

SEQ ID NO: 5574743 - DNA, 17 bp, Homo sapiens
attagccagtaatcctg

SEQ ID NO: 5574744 - DNA, 19 bp, Homo sapiens
attagccagtaatcctgta

SEQ ID NO: 5574745 - DNA, 20 bp, Homo sapiens
attagccagtcatggtggca

SEQ ID NO: 5574746 - DNA, 14 bp, Homo sapiens
attagccagtcatt

SEQ ID NO: 5574747 - DNA, 20 bp, Homo sapiens
attagccatgcaacatggat

SEQ ID NO: 5574748 - DNA, 18 bp, Homo sapiens
attagccgggcatgatgg

SEQ ID NO: 5574749 - DNA, 18 bp, Homo sapiens
attagccgggcatggtgg

SEQ ID NO: 5574750 - DNA, 19 bp, Homo sapiens
attagccgggcatggtggc

SEQ ID NO: 5574751 - DNA, 13 bp, Homo sapiens
attagccgtccca

SEQ ID NO: 5574752 - DNA, 14 bp, Homo sapiens
attagcctgagtag

SEQ ID NO: 5574753 - DNA, 14 bp, Homo sapiens
attagcctgtagct

SEQ ID NO: 5574754 - DNA, 19 bp, Homo sapiens
attagctatatttttatat

SEQ ID NO: 5574755 - DNA, 21 bp, Homo sapiens
attagctctcgcctcaggctt

SEQ ID NO: 5574756 - DNA, 13 bp, Homo sapiens
attagctctggac

SEQ ID NO: 5574757 - DNA, 12 bp, Homo sapiens
attagctctggg

SEQ ID NO: 5574758 - DNA, 13 bp, Homo sapiens
attagctctgggg

SEQ ID NO: 5574759 - DNA, 12 bp, Homo sapiens
attagctgcttc

SEQ ID NO: 5574760 - DNA, 20 bp, Homo sapiens
attagctggttggagagcta

SEQ ID NO: 5574761 - DNA, 13 bp, Homo sapiens
attagctgtaaat

SEQ ID NO: 5574762 - DNA, 16 bp, Homo sapiens
attagctgtaaataca

SEQ ID NO: 5574763 - DNA, 16 bp, Homo sapiens
attagctgtgtgaaat

SEQ ID NO: 5574764 - DNA, 21 bp, Homo sapiens
attagcttatgttaactgaca

SEQ ID NO: 5574765 - DNA, 13 bp, Homo sapiens
attagcttgctta

SEQ ID NO: 5574766 - DNA, 17 bp, Homo sapiens
attagcttggggccagg

SEQ ID NO: 5574767 - DNA, 18 bp, Homo sapiens
attagcttggggccaggg

SEQ ID NO: 5574768 - DNA, 20 bp, Homo sapiens
attagctttactgtttgtta

SEQ ID NO: 5574769 - DNA, 22 bp, Homo sapiens
attagctttattatggcttgtg

SEQ ID NO: 5574770 - DNA, 15 bp, Homo sapiens
attagctttttcatc

SEQ ID NO: 5574771 - DNA, 15 bp, Homo sapiens
attaggaaaagatat

SEQ ID NO: 5574772 - DNA, 21 bp, Homo sapiens
attaggaagcttgatttgctt

SEQ ID NO: 5574773 - DNA, 15 bp, Homo sapiens
attaggaaggccatg

SEQ ID NO: 5574774 - DNA, 20 bp, Homo sapiens
attaggaagtcacagattct

SEQ ID NO: 5574775 - DNA, 20 bp, Homo sapiens
attaggaagtgtaacagctg

SEQ ID NO: 5574776 - DNA, 13 bp, Homo sapiens
attaggaataaat

SEQ ID NO: 5574777 - DNA, 19 bp, Homo sapiens
attaggaatcattctgtaa

SEQ ID NO: 5574778 - DNA, 22 bp, Homo sapiens
attaggacaatcagtcccctcc

SEQ ID NO: 5574779 - DNA, 14 bp, Homo sapiens
attaggactgtata

SEQ ID NO: 5574780 - DNA, 22 bp, Homo sapiens
attaggagaaacacattcttat

SEQ ID NO: 5574781 - DNA, 22 bp, Homo sapiens
attaggaggctcaacaataaaa

SEQ ID NO: 5574782 - DNA, 20 bp, Homo sapiens
attaggagtaattcttttct

SEQ ID NO: 5574783 - DNA, 14 bp, Homo sapiens
attaggataactaa

SEQ ID NO: 5574784 - DNA, 19 bp, Homo sapiens
attaggatctatgcaattt

SEQ ID NO: 5574785 - DNA, 14 bp, Homo sapiens
attaggatttcatg

SEQ ID NO: 5574786 - DNA, 16 bp, Homo sapiens
attaggatttcatgat

SEQ ID NO: 5574787 - DNA, 14 bp, Homo sapiens
attaggattttgat

SEQ ID NO: 5574788 - DNA, 15 bp, Homo sapiens
attaggcaaagtaca

SEQ ID NO: 5574789 - DNA, 20 bp, Homo sapiens
attaggcaaggctatgtgat

SEQ ID NO: 5574790 - DNA, 15 bp, Homo sapiens
attaggcacacagat

SEQ ID NO: 5574791 - DNA, 17 bp, Homo sapiens
attaggcatgttcaggg

SEQ ID NO: 5574792 - DNA, 18 bp, Homo sapiens
attaggcatgttcaggga

SEQ ID NO: 5574793 - DNA, 13 bp, Homo sapiens
attaggccagcaa

SEQ ID NO: 5574794 - DNA, 21 bp, Homo sapiens
attaggccttatgtaaggaga

SEQ ID NO: 5574795 - DNA, 22 bp, Homo sapiens
attaggctgtaactactttata

SEQ ID NO: 5574796 - DNA, 16 bp, Homo sapiens
attagggagaaaattc

SEQ ID NO: 5574797 - DNA, 18 bp, Homo sapiens
attagggagaaaattcaa

SEQ ID NO: 5574798 - DNA, 23 bp, Homo sapiens
attagggagaaaattcaattgta

SEQ ID NO: 5574799 - DNA, 12 bp, Homo sapiens
attagggagctc

SEQ ID NO: 5574800 - DNA, 23 bp, Homo sapiens
attagggcaattggaacaaagtg

SEQ ID NO: 5574801 - DNA, 18 bp, Homo sapiens
attagggcatttgagaaa

SEQ ID NO: 5574802 - DNA, 16 bp, Homo sapiens
attaggggattcttct

SEQ ID NO: 5574803 - DNA, 22 bp, Homo sapiens
attaggggttaaagcagacagt

SEQ ID NO: 5574804 - DNA, 18 bp, Homo sapiens
attaggtactatctgtga

SEQ ID NO: 5574805 - DNA, 14 bp, Homo sapiens
attaggtagacttt

SEQ ID NO: 5574806 - DNA, 16 bp, Homo sapiens
attaggtatgtttgta

SEQ ID NO: 5574807 - DNA, 19 bp, Homo sapiens
attaggtattacaagtaat

SEQ ID NO: 5574808 - DNA, 20 bp, Homo sapiens
attaggtcgttttccaaaga

SEQ ID NO: 5574809 - DNA, 18 bp, Homo sapiens
attaggtctgcattttct

SEQ ID NO: 5574810 - DNA, 16 bp, Homo sapiens
attaggtcttaaagta

SEQ ID NO: 5574811 - DNA, 19 bp, Homo sapiens
attaggtcttgctggaaga

SEQ ID NO: 5574812 - DNA, 20 bp, Homo sapiens
attaggtcttgctggaagac

SEQ ID NO: 5574813 - DNA, 16 bp, Homo sapiens
attaggtgtgactgaa

SEQ ID NO: 5574814 - DNA, 21 bp, Homo sapiens
attaggtgtgactgaatttct

SEQ ID NO: 5574815 - DNA, 13 bp, Homo sapiens
attaggtgttgaa

SEQ ID NO: 5574816 - DNA, 18 bp, Homo sapiens
attaggttaacattgttg

SEQ ID NO: 5574817 - DNA, 16 bp, Homo sapiens
attaggttaagtctca

SEQ ID NO: 5574818 - DNA, 19 bp, Homo sapiens
attaggttgaaacatatct

SEQ ID NO: 5574819 - DNA, 16 bp, Homo sapiens
attaggtttctttgaa

SEQ ID NO: 5574820 - DNA, 21 bp, Homo sapiens
attaggttttgtacaattgaa

SEQ ID NO: 5574821 - DNA, 13 bp, Homo sapiens
attagtaaatgtc

SEQ ID NO: 5574822 - DNA, 15 bp, Homo sapiens
attagtaaatgtctt

SEQ ID NO: 5574823 - DNA, 21 bp, Homo sapiens
attagtaaatgtctttgtaag

SEQ ID NO: 5574824 - DNA, 23 bp, Homo sapiens
attagtaaatgtctttgtaagtc

SEQ ID NO: 5574825 - DNA, 23 bp, Homo sapiens
attagtaacataataaattaaaa

SEQ ID NO: 5574826 - DNA, 13 bp, Homo sapiens
attagtaacatca

SEQ ID NO: 5574827 - DNA, 16 bp, Homo sapiens
attagtaacatgtgtt

SEQ ID NO: 5574828 - DNA, 15 bp, Homo sapiens
attagtaactttgaa

SEQ ID NO: 5574829 - DNA, 21 bp, Homo sapiens
attagtacagtagcttaaata

SEQ ID NO: 5574830 - DNA, 13 bp, Homo sapiens
attagtactttat

SEQ ID NO: 5574831 - DNA, 15 bp, Homo sapiens
attagtactttatag

SEQ ID NO: 5574832 - DNA, 19 bp, Homo sapiens
attagtagaaaatacatta

SEQ ID NO: 5574833 - DNA, 18 bp, Homo sapiens
attagtagaaatgccaga

SEQ ID NO: 5574834 - DNA, 19 bp, Homo sapiens
attagtatcacaaaaccac

SEQ ID NO: 5574835 - DNA, 14 bp, Homo sapiens
attagtatcctgtt

SEQ ID NO: 5574836 - DNA, 19 bp, Homo sapiens
attagtatgtctgtttttg

SEQ ID NO: 5574837 - DNA, 22 bp, Homo sapiens
attagtattaatactacccata

SEQ ID NO: 5574838 - DNA, 15 bp, Homo sapiens
attattccctgaatt

SEQ ID NO: 5574839 - DNA, 16 bp, Homo sapiens
attattccctgaattg

SEQ ID NO: 5574840 - DNA, 20 bp, Homo sapiens
attattccctgaattgtttg

SEQ ID NO: 5574841 - DNA, 22 bp, Homo sapiens
attattccctgtacaatattta

SEQ ID NO: 5574842 - DNA, 21 bp, Homo sapiens
attattccgtattacattttt

SEQ ID NO: 5574843 - DNA, 12 bp, Homo sapiens
attattcctcag

SEQ ID NO: 5574844 - DNA, 18 bp, Homo sapiens
attattcctcagattgct

SEQ ID NO: 5574845 - DNA, 21 bp, Homo sapiens
attattcctcagattgctgaa

SEQ ID NO: 5574846 - DNA, 22 bp, Homo sapiens
attattcctcagattgctgaat

SEQ ID NO: 5574847 - DNA, 13 bp, Homo sapiens
attattcctccag

SEQ ID NO: 5574848 - DNA, 22 bp, Homo sapiens
attattcctctcaccccactcc

SEQ ID NO: 5574849 - DNA, 12 bp, Homo sapiens
attattcctgca

SEQ ID NO: 5574850 - DNA, 16 bp, Homo sapiens
attattccttcttcta

SEQ ID NO: 5574851 - DNA, 12 bp, Homo sapiens
attattctaatt

SEQ ID NO: 5574852 - DNA, 17 bp, Homo sapiens
attattctaattttata

SEQ ID NO: 5574853 - DNA, 14 bp, Homo sapiens
attattctcattta

SEQ ID NO: 5574854 - DNA, 12 bp, Homo sapiens
attattctcttt

SEQ ID NO: 5574855 - DNA, 22 bp, Homo sapiens
attattctgcctacgttctctt

SEQ ID NO: 5574856 - DNA, 17 bp, Homo sapiens
attattcttgagttttt

SEQ ID NO: 5574857 - DNA, 17 bp, Homo sapiens
attattctttgaaaaca

SEQ ID NO: 5574858 - DNA, 19 bp, Homo sapiens
attattctttgaaaacaga

SEQ ID NO: 5574859 - DNA, 20 bp, Homo sapiens
attattgaatgttatatcat

SEQ ID NO: 5574860 - DNA, 22 bp, Homo sapiens
attattgaatgttatatcatca

SEQ ID NO: 5574861 - DNA, 13 bp, Homo sapiens
attattgacactg

SEQ ID NO: 5574862 - DNA, 14 bp, Homo sapiens
attattgacactga

SEQ ID NO: 5574863 - DNA, 21 bp, Homo sapiens
attattgagctctatttcccc

SEQ ID NO: 5574864 - DNA, 12 bp, Homo sapiens
attattgagttc

SEQ ID NO: 5574865 - DNA, 21 bp, Homo sapiens
attattgagttccagttgaag

SEQ ID NO: 5574866 - DNA, 20 bp, Homo sapiens
attattgagttctgaagtag

SEQ ID NO: 5574867 - DNA, 13 bp, Homo sapiens
attattgatatat

SEQ ID NO: 5574868 - DNA, 19 bp, Homo sapiens
attattgatcaaaatcaaa

SEQ ID NO: 5574869 - DNA, 12 bp, Homo sapiens
attattgcatta

SEQ ID NO: 5574870 - DNA, 15 bp, Homo sapiens
attattgccaaataa

SEQ ID NO: 5574871 - DNA, 16 bp, Homo sapiens
attattgctgttgctt

SEQ ID NO: 5574872 - DNA, 18 bp, Homo sapiens
attattgctgttgcttga

SEQ ID NO: 5574873 - DNA, 15 bp, Homo sapiens
attattgcttattgc

SEQ ID NO: 5574874 - DNA, 14 bp, Homo sapiens
attattggaattaa

SEQ ID NO: 5574875 - DNA, 18 bp, Homo sapiens
attattggaattaacctg

SEQ ID NO: 5574876 - DNA, 18 bp, Homo sapiens
attattggacttccattt

SEQ ID NO: 5574877 - DNA, 14 bp, Homo sapiens
attattggcaaagt

SEQ ID NO: 5574878 - DNA, 18 bp, Homo sapiens
attattggtatatttgta

SEQ ID NO: 5574879 - DNA, 20 bp, Homo sapiens
attattggttggtgtgaaga

SEQ ID NO: 5574880 - DNA, 22 bp, Homo sapiens
attattggttggtgtgaagaaa

SEQ ID NO: 5574881 - DNA, 12 bp, Homo sapiens
attattgtaaac

SEQ ID NO: 5574882 - DNA, 17 bp, Homo sapiens
attattgtaaacttttt

SEQ ID NO: 5574883 - DNA, 20 bp, Homo sapiens
attattgtaaactttttcaa

SEQ ID NO: 5574884 - DNA, 13 bp, Homo sapiens
attattgtaagtt

SEQ ID NO: 5574885 - DNA, 16 bp, Homo sapiens
attattgtagtttgaa

SEQ ID NO: 5574886 - DNA, 19 bp, Homo sapiens
attattgtagtttgaaagt

SEQ ID NO: 5574887 - DNA, 13 bp, Homo sapiens
attattgtattta

SEQ ID NO: 5574888 - DNA, 19 bp, Homo sapiens
attattgtgacaaaatgtt

SEQ ID NO: 5574889 - DNA, 23 bp, Homo sapiens
attattgtgacttcactgtatat

SEQ ID NO: 5574890 - DNA, 18 bp, Homo sapiens
attattgtggtaggcctt

SEQ ID NO: 5574891 - DNA, 23 bp, Homo sapiens
attattgtggtaggccttttaac

SEQ ID NO: 5574892 - DNA, 18 bp, Homo sapiens
attattgttgcattaaaa

SEQ ID NO: 5574893 - DNA, 12 bp, Homo sapiens
attattgtttat

SEQ ID NO: 5574894 - DNA, 21 bp, Homo sapiens
attattgtttatgccaaatgt

SEQ ID NO: 5574895 - DNA, 13 bp, Homo sapiens
attatttaaagaa

SEQ ID NO: 5574896 - DNA, 14 bp, Homo sapiens
attatttaaagaaa

SEQ ID NO: 5574897 - DNA, 15 bp, Homo sapiens
attatttaaagcaca

SEQ ID NO: 5574898 - DNA, 18 bp, Homo sapiens
attatttaaataaaatca

SEQ ID NO: 5574899 - DNA, 20 bp, Homo sapiens
attatttaaataaaatcacc

SEQ ID NO: 5574900 - DNA, 22 bp, Homo sapiens
attatttaaatgtacttatatt

SEQ ID NO: 5574901 - DNA, 22 bp, Homo sapiens
attatttaaatgttgaaatctt

SEQ ID NO: 5574902 - DNA, 12 bp, Homo sapiens
attatttaactc

SEQ ID NO: 5574903 - DNA, 21 bp, Homo sapiens
attatttaataacattacctt

SEQ ID NO: 5574904 - DNA, 13 bp, Homo sapiens
attatttaataag

SEQ ID NO: 5574905 - DNA, 12 bp, Homo sapiens
attatttaatat

SEQ ID NO: 5574906 - DNA, 20 bp, Homo sapiens
attatttaatatgcatcttt

SEQ ID NO: 5574907 - DNA, 15 bp, Homo sapiens
attatttaattgcaa

SEQ ID NO: 5574908 - DNA, 14 bp, Homo sapiens
attatttaatttgt

SEQ ID NO: 5574909 - DNA, 19 bp, Homo sapiens
attatttacatcactttgt

SEQ ID NO: 5574910 - DNA, 22 bp, Homo sapiens
attatttacatcactttgtgaa

SEQ ID NO: 5574911 - DNA, 14 bp, Homo sapiens
attatttagagcca

SEQ ID NO: 5574912 - DNA, 19 bp, Homo sapiens
attatttatcgaaagtaaa

SEQ ID NO: 5574913 - DNA, 14 bp, Homo sapiens
attatttatgtatg

SEQ ID NO: 5574914 - DNA, 21 bp, Homo sapiens
attatttattaaaaatgttct

SEQ ID NO: 5574915 - DNA, 15 bp, Homo sapiens
attatttattaaatt

SEQ ID NO: 5574916 - DNA, 13 bp, Homo sapiens
attatttattact

SEQ ID NO: 5574917 - DNA, 22 bp, Homo sapiens
attatttattacttgtgcactt

SEQ ID NO: 5574918 - DNA, 12 bp, Homo sapiens
attatttattgt

SEQ ID NO: 5574919 - DNA, 20 bp, Homo sapiens
attatttattgttaaattac

SEQ ID NO: 5574920 - DNA, 14 bp, Homo sapiens
attatttatttaat

SEQ ID NO: 5574921 - DNA, 15 bp, Homo sapiens
attatttatttattt

SEQ ID NO: 5574922 - DNA, 14 bp, Homo sapiens
attatttatttctg

SEQ ID NO: 5574923 - DNA, 13 bp, Homo sapiens
attatttatttga

SEQ ID NO: 5574924 - DNA, 22 bp, Homo sapiens
attatttcaaggaatagagttt

SEQ ID NO: 5574925 - DNA, 11 bp, Homo sapiens
attatttcaga

SEQ ID NO: 5574926 - DNA, 21 bp, Homo sapiens
attatttcatacaaaactgtt

SEQ ID NO: 5574927 - DNA, 19 bp, Homo sapiens
attatttctaccattaaaa

SEQ ID NO: 5574928 - DNA, 22 bp, Homo sapiens
attatttctaggaagaatttta

SEQ ID NO: 5574929 - DNA, 22 bp, Homo sapiens
attatttctccatcccctccct

SEQ ID NO: 5574930 - DNA, 19 bp, Homo sapiens
attatttctgtatttggct

SEQ ID NO: 5574931 - DNA, 21 bp, Homo sapiens
attatttctgttcttacaaat

SEQ ID NO: 5574932 - DNA, 16 bp, Homo sapiens
attatttcttctctta

SEQ ID NO: 5574933 - DNA, 18 bp, Homo sapiens
attatttgaagatttaat

SEQ ID NO: 5574934 - DNA, 13 bp, Homo sapiens
attatttgagaag

SEQ ID NO: 5574935 - DNA, 12 bp, Homo sapiens
attatttgatat

SEQ ID NO: 5574936 - DNA, 16 bp, Homo sapiens
attatttgattattta

SEQ ID NO: 5574937 - DNA, 18 bp, Homo sapiens
attatttgattatttaag

SEQ ID NO: 5574938 - DNA, 21 bp, Homo sapiens
attatttgattatttaagact

SEQ ID NO: 5574939 - DNA, 17 bp, Homo sapiens
attatttgcatgttatg

SEQ ID NO: 5574940 - DNA, 15 bp, Homo sapiens
attatttgccttctg

SEQ ID NO: 5574941 - DNA, 13 bp, Homo sapiens
attatttgccttt

SEQ ID NO: 5574942 - DNA, 22 bp, Homo sapiens
attatttggagcctgccaagag

SEQ ID NO: 5574943 - DNA, 18 bp, Homo sapiens
attatttggcagtttggt

SEQ ID NO: 5574944 - DNA, 21 bp, Homo sapiens
attatttggcatgcttaaata

SEQ ID NO: 5574945 - DNA, 15 bp, Homo sapiens
attatttgtaagata

SEQ ID NO: 5574946 - DNA, 17 bp, Homo sapiens
attatttgtaagatatt

SEQ ID NO: 5574947 - DNA, 18 bp, Homo sapiens
attatttgtactttgttt

SEQ ID NO: 5574948 - DNA, 11 bp, Homo sapiens
attatttgtat

SEQ ID NO: 5574949 - DNA, 16 bp, Homo sapiens
attatttgtatgtatt

SEQ ID NO: 5574950 - DNA, 17 bp, Homo sapiens
attatttgtatgtatta

SEQ ID NO: 5574951 - DNA, 12 bp, Homo sapiens
attatttgtctt

SEQ ID NO: 5574952 - DNA, 15 bp, Homo sapiens
attatttgtgcattt

SEQ ID NO: 5574953 - DNA, 23 bp, Homo sapiens
attatttgtgcattttattgact

SEQ ID NO: 5574954 - DNA, 17 bp, Homo sapiens
attatttgtgtaataga

SEQ ID NO: 5574955 - DNA, 18 bp, Homo sapiens
attatttgtgtaatagaa

SEQ ID NO: 5574956 - DNA, 13 bp, Homo sapiens
attattttaaaaa

SEQ ID NO: 5574957 - DNA, 15 bp, Homo sapiens
attattttaaaatat

SEQ ID NO: 5574958 - DNA, 19 bp, Homo sapiens
attattttaaaatatatga

SEQ ID NO: 5574959 - DNA, 16 bp, Homo sapiens
attattttaaaatatt

SEQ ID NO: 5574960 - DNA, 16 bp, Homo sapiens
attattttaaaatcaa

SEQ ID NO: 5574961 - DNA, 14 bp, Homo sapiens
attattttaaacaa

SEQ ID NO: 5574962 - DNA, 17 bp, Homo sapiens
attattttaaattataa

SEQ ID NO: 5574963 - DNA, 22 bp, Homo sapiens
attattttaaattataaggact

SEQ ID NO: 5574964 - DNA, 18 bp, Homo sapiens
attattttaaatttcttt

SEQ ID NO: 5574965 - DNA, 14 bp, Homo sapiens
attattttaataat

SEQ ID NO: 5574966 - DNA, 14 bp, Homo sapiens
attattttaatatt

SEQ ID NO: 5574967 - DNA, 12 bp, Homo sapiens
attattttacag

SEQ ID NO: 5574968 - DNA, 21 bp, Homo sapiens
attattttagcttcagttgtt

SEQ ID NO: 5574969 - DNA, 21 bp, Homo sapiens
attattttatatcatacagtt

SEQ ID NO: 5574970 - DNA, 15 bp, Homo sapiens
attattttatctggt

SEQ ID NO: 5574971 - DNA, 18 bp, Homo sapiens
attattttatgttgcata

SEQ ID NO: 5574972 - DNA, 22 bp, Homo sapiens
attattttattatgaaacttgt

SEQ ID NO: 5574973 - DNA, 18 bp, Homo sapiens
attattttcaaaggaaaa

SEQ ID NO: 5574974 - DNA, 12 bp, Homo sapiens
attattttcatc

SEQ ID NO: 5574975 - DNA, 23 bp, Homo sapiens
attattttcatccttgtcttatt

SEQ ID NO: 5574976 - DNA, 17 bp, Homo sapiens
attattttcattacaat

SEQ ID NO: 5574977 - DNA, 21 bp, Homo sapiens
attattttcattacaatggaa

SEQ ID NO: 5574978 - DNA, 18 bp, Homo sapiens
attattttccaaaatcta

SEQ ID NO: 5574979 - DNA, 16 bp, Homo sapiens
attattttcccacaat

SEQ ID NO: 5574980 - DNA, 18 bp, Homo sapiens
attattttcccatttgct

SEQ ID NO: 5574981 - DNA, 16 bp, Homo sapiens
attattttccttccat

SEQ ID NO: 5574982 - DNA, 20 bp, Homo sapiens
attattttccttccatgctc

SEQ ID NO: 5574983 - DNA, 19 bp, Homo sapiens
attattttctatagctctt

SEQ ID NO: 5574984 - DNA, 14 bp, Homo sapiens
attattttcttcat

SEQ ID NO: 5574985 - DNA, 21 bp, Homo sapiens
attattttgaatgtcacaaat

SEQ ID NO: 5574986 - DNA, 14 bp, Homo sapiens
attattttgataaa

SEQ ID NO: 5574987 - DNA, 19 bp, Homo sapiens
attattttgataaattact

SEQ ID NO: 5574988 - DNA, 17 bp, Homo sapiens
attattttggggtctct

SEQ ID NO: 5574989 - DNA, 21 bp, Homo sapiens
attattttggggtctcttttg

SEQ ID NO: 5574990 - DNA, 15 bp, Homo sapiens
attattttgtatgga

SEQ ID NO: 5574991 - DNA, 16 bp, Homo sapiens
attattttgtcataaa

SEQ ID NO: 5574992 - DNA, 18 bp, Homo sapiens
attattttgtcataaaat

SEQ ID NO: 5574993 - DNA, 21 bp, Homo sapiens
attattttgtcataaaatgct

SEQ ID NO: 5574994 - DNA, 23 bp, Homo sapiens
attattttgtgcaacataacaat

SEQ ID NO: 5574995 - DNA, 14 bp, Homo sapiens
attattttgttact

SEQ ID NO: 5574996 - DNA, 18 bp, Homo sapiens
attattttgttactgtct

SEQ ID NO: 5574997 - DNA, 20 bp, Homo sapiens
attattttgttactgtctgt

SEQ ID NO: 5574998 - DNA, 17 bp, Homo sapiens
attattttgttcataca

SEQ ID NO: 5574999 - DNA, 21 bp, Homo sapiens
attattttgttcatacatatt

SEQ ID NO: 5575000 - DNA, 18 bp, Homo sapiens
attatttttataattgta

SEQ ID NO: 5575001 - DNA, 12 bp, Homo sapiens
attatttttcaa

SEQ ID NO: 5575002 - DNA, 13 bp, Homo sapiens
attatttttcaat

SEQ ID NO: 5575003 - DNA, 22 bp, Homo sapiens
attatttttcaattatgtttga

SEQ ID NO: 5575004 - DNA, 16 bp, Homo sapiens
attatttttctctctc

SEQ ID NO: 5575005 - DNA, 17 bp, Homo sapiens
attatttttgagcagga

SEQ ID NO: 5575006 - DNA, 11 bp, Homo sapiens
attatttttgt

SEQ ID NO: 5575007 - DNA, 17 bp, Homo sapiens
attatttttgtgtttct

SEQ ID NO: 5575008 - DNA, 18 bp, Homo sapiens
attattttttaaaaaggt

SEQ ID NO: 5575009 - DNA, 16 bp, Homo sapiens
attattttttaataaa

SEQ ID NO: 5575010 - DNA, 16 bp, Homo sapiens
attattttttatactg

SEQ ID NO: 5575011 - DNA, 14 bp, Homo sapiens
attattttttcaga

SEQ ID NO: 5575012 - DNA, 17 bp, Homo sapiens
attatttttttaaaatt

SEQ ID NO: 5575013 - DNA, 18 bp, Homo sapiens
attatttttttaaaattt

SEQ ID NO: 5575014 - DNA, 16 bp, Homo sapiens
attatttttttaaact

SEQ ID NO: 5575015 - DNA, 22 bp, Homo sapiens
attatttttttaaacttcagtt

SEQ ID NO: 5575016 - DNA, 18 bp, Homo sapiens
attatttttttaaagaaa

SEQ ID NO: 5575017 - DNA, 12 bp, Homo sapiens
attcaggcactg

SEQ ID NO: 5575018 - DNA, 11 bp, Homo sapiens
attcaggcagc

SEQ ID NO: 5575019 - DNA, 21 bp, Homo sapiens
attcaggccagcccagccagg

SEQ ID NO: 5575020 - DNA, 17 bp, Homo sapiens
attcaggcctctgagga

SEQ ID NO: 5575021 - DNA, 18 bp, Homo sapiens
attcaggcctctgaggag

SEQ ID NO: 5575022 - DNA, 11 bp, Homo sapiens
attcaggctgc

SEQ ID NO: 5575023 - DNA, 13 bp, Homo sapiens
attcaggctgctt

SEQ ID NO: 5575024 - DNA, 13 bp, Homo sapiens
attcaggggcttt

SEQ ID NO: 5575025 - DNA, 17 bp, Homo sapiens
attcaggggctttgggc

SEQ ID NO: 5575026 - DNA, 18 bp, Homo sapiens
attcaggggctttgggcc

SEQ ID NO: 5575027 - DNA, 21 bp, Homo sapiens
attcaggggctttgggcccaa

SEQ ID NO: 5575028 - DNA, 19 bp, Homo sapiens
attcagggttatttgaggg

SEQ ID NO: 5575029 - DNA, 15 bp, Homo sapiens
attcaggtaatacaa

SEQ ID NO: 5575030 - DNA, 17 bp, Homo sapiens
attcaggtaatacaaac

SEQ ID NO: 5575031 - DNA, 17 bp, Homo sapiens
attcaggtatgttgcct

SEQ ID NO: 5575032 - DNA, 18 bp, Homo sapiens
attcaggtatgttgcctt

SEQ ID NO: 5575033 - DNA, 19 bp, Homo sapiens
attcaggtgaaaatgttca

SEQ ID NO: 5575034 - DNA, 19 bp, Homo sapiens
attcaggtgacctcctgca

SEQ ID NO: 5575035 - DNA, 18 bp, Homo sapiens
attcaggtgcagaggaag

SEQ ID NO: 5575036 - DNA, 21 bp, Homo sapiens
attcaggtgctagaagcctac

SEQ ID NO: 5575037 - DNA, 23 bp, Homo sapiens
attcaggtggccagaagagcttg

SEQ ID NO: 5575038 - DNA, 15 bp, Homo sapiens
attcaggtttttcct

SEQ ID NO: 5575039 - DNA, 16 bp, Homo sapiens
attcaggtttttcctt

SEQ ID NO: 5575040 - DNA, 14 bp, Homo sapiens
attcagtaaacaaa

SEQ ID NO: 5575041 - DNA, 22 bp, Homo sapiens
attcagtaagtagcaaccctgt

SEQ ID NO: 5575042 - DNA, 20 bp, Homo sapiens
attcagtaccctatggagta

SEQ ID NO: 5575043 - DNA, 14 bp, Homo sapiens
attcagtatgtttt

SEQ ID NO: 5575044 - DNA, 22 bp, Homo sapiens
attcagtatgttttacactgta

SEQ ID NO: 5575045 - DNA, 14 bp, Homo sapiens
attcagtattttgc

SEQ ID NO: 5575046 - DNA, 12 bp, Homo sapiens
attcagtcacat

SEQ ID NO: 5575047 - DNA, 18 bp, Homo sapiens
attcagtccgcctggccg

SEQ ID NO: 5575048 - DNA, 17 bp, Homo sapiens
attcagtctatgctgtg

SEQ ID NO: 5575049 - DNA, 14 bp, Homo sapiens
attcagtctcagct

SEQ ID NO: 5575050 - DNA, 17 bp, Homo sapiens
attcagtctcagctgct

SEQ ID NO: 5575051 - DNA, 14 bp, Homo sapiens
attcagtcttctgg

SEQ ID NO: 5575052 - DNA, 15 bp, Homo sapiens
attcagtcttctgga

SEQ ID NO: 5575053 - DNA, 17 bp, Homo sapiens
attcagtgaaaaagata

SEQ ID NO: 5575054 - DNA, 18 bp, Homo sapiens
attcagtgaatttgtcca

SEQ ID NO: 5575055 - DNA, 18 bp, Homo sapiens
attcagtgagacacagag

SEQ ID NO: 5575056 - DNA, 21 bp, Homo sapiens
attcagtgagggtcttcttac

SEQ ID NO: 5575057 - DNA, 21 bp, Homo sapiens
attcagtgatatgtaaattaa

SEQ ID NO: 5575058 - DNA, 23 bp, Homo sapiens
attcagtgatatgtaaattaaat

SEQ ID NO: 5575059 - DNA, 13 bp, Homo sapiens
attcagtgatggc

SEQ ID NO: 5575060 - DNA, 16 bp, Homo sapiens
attcagtgatgtgcct

SEQ ID NO: 5575061 - DNA, 19 bp, Homo sapiens
attcagtgattactgtcaa

SEQ ID NO: 5575062 - DNA, 22 bp, Homo sapiens
attcagtgcacctgcctcagct

SEQ ID NO: 5575063 - DNA, 16 bp, Homo sapiens
attcagtgcattttca

SEQ ID NO: 5575064 - DNA, 20 bp, Homo sapiens
attcagtgcattttcaacat

SEQ ID NO: 5575065 - DNA, 20 bp, Homo sapiens
attcagtgctgtggcctggg

SEQ ID NO: 5575066 - DNA, 21 bp, Homo sapiens
attcagtggaggctggcaggg

SEQ ID NO: 5575067 - DNA, 21 bp, Homo sapiens
attcagtgtaaattaattaca

SEQ ID NO: 5575068 - DNA, 19 bp, Homo sapiens
attcagtgttaaatgtgat

SEQ ID NO: 5575069 - DNA, 14 bp, Homo sapiens
attcagttaagaaa

SEQ ID NO: 5575070 - DNA, 15 bp, Homo sapiens
attcagttaagaaaa

SEQ ID NO: 5575071 - DNA, 16 bp, Homo sapiens
attcagttaagaaaaa

SEQ ID NO: 5575072 - DNA, 22 bp, Homo sapiens
attcagttccaatacttcatta

SEQ ID NO: 5575073 - DNA, 15 bp, Homo sapiens
attcagttctaggcc

SEQ ID NO: 5575074 - DNA, 17 bp, Homo sapiens
attcagttctaggcctt

SEQ ID NO: 5575075 - DNA, 18 bp, Homo sapiens
attcagttctaggccttt

SEQ ID NO: 5575076 - DNA, 20 bp, Homo sapiens
attcagttctaggcctttcc

SEQ ID NO: 5575077 - DNA, 21 bp, Homo sapiens
attcagttctaggcctttcct

SEQ ID NO: 5575078 - DNA, 14 bp, Homo sapiens
attcagtttaagag

SEQ ID NO: 5575079 - DNA, 13 bp, Homo sapiens
attcagtttcata

SEQ ID NO: 5575080 - DNA, 17 bp, Homo sapiens
attcagtttcataaaag

SEQ ID NO: 5575081 - DNA, 18 bp, Homo sapiens
attcagtttctaaaattg

SEQ ID NO: 5575082 - DNA, 23 bp, Homo sapiens
attcagttttagtttcaaaatgt

SEQ ID NO: 5575083 - DNA, 14 bp, Homo sapiens
attcagttttcatt

SEQ ID NO: 5575084 - DNA, 15 bp, Homo sapiens
attcagttttcattt

SEQ ID NO: 5575085 - DNA, 19 bp, Homo sapiens
attcagttttcccactttt

SEQ ID NO: 5575086 - DNA, 19 bp, Homo sapiens
attcagtttttgtatcttg

SEQ ID NO: 5575087 - DNA, 15 bp, Homo sapiens
attcataaaaactgc

SEQ ID NO: 5575088 - DNA, 16 bp, Homo sapiens
attcataaaaactgct

SEQ ID NO: 5575089 - DNA, 15 bp, Homo sapiens
attcataaaaataac

SEQ ID NO: 5575090 - DNA, 23 bp, Homo sapiens
attcataaaaataaccaaaaaat

SEQ ID NO: 5575091 - DNA, 14 bp, Homo sapiens
attcataaagagaa

SEQ ID NO: 5575092 - DNA, 15 bp, Homo sapiens
attcataaagagaaa

SEQ ID NO: 5575093 - DNA, 18 bp, Homo sapiens
attcataaagagaaaatg

SEQ ID NO: 5575094 - DNA, 20 bp, Homo sapiens
attcataaagagaaaatgat

SEQ ID NO: 5575095 - DNA, 15 bp, Homo sapiens
attcataaatacaaa

SEQ ID NO: 5575096 - DNA, 21 bp, Homo sapiens
attcataactaatgaattgaa

SEQ ID NO: 5575097 - DNA, 13 bp, Homo sapiens
attcataaggaaa

SEQ ID NO: 5575098 - DNA, 13 bp, Homo sapiens
attcataataaat

SEQ ID NO: 5575099 - DNA, 19 bp, Homo sapiens
attcataataaattttcta

SEQ ID NO: 5575100 - DNA, 20 bp, Homo sapiens
attcataataaattttctaa

SEQ ID NO: 5575101 - DNA, 13 bp, Homo sapiens
attcataatgaat

SEQ ID NO: 5575102 - DNA, 14 bp, Homo sapiens
attcataatgactt

SEQ ID NO: 5575103 - DNA, 22 bp, Homo sapiens
attcataattaaaatttatctt

SEQ ID NO: 5575104 - DNA, 24 bp, Homo sapiens
attcataattaaaatttatcttaa

SEQ ID NO: 5575105 - DNA, 14 bp, Homo sapiens
attcataattagaa

SEQ ID NO: 5575106 - DNA, 13 bp, Homo sapiens
attcatacacaac

SEQ ID NO: 5575107 - DNA, 16 bp, Homo sapiens
attcatacacaacgta

SEQ ID NO: 5575108 - DNA, 15 bp, Homo sapiens
attcatacagcacta

SEQ ID NO: 5575109 - DNA, 13 bp, Homo sapiens
attcatacctgtt

SEQ ID NO: 5575110 - DNA, 15 bp, Homo sapiens
attcatactcctttt

SEQ ID NO: 5575111 - DNA, 19 bp, Homo sapiens
attcatactctgttgcctc

SEQ ID NO: 5575112 - DNA, 21 bp, Homo sapiens
attcatactctgttgcctcct

SEQ ID NO: 5575113 - DNA, 14 bp, Homo sapiens
attcatacttaaaa

SEQ ID NO: 5575114 - DNA, 16 bp, Homo sapiens
attcatagaagggcta

SEQ ID NO: 5575115 - DNA, 16 bp, Homo sapiens
attcatagaataacaa

SEQ ID NO: 5575116 - DNA, 23 bp, Homo sapiens
attcatagaataacaactgctgg

SEQ ID NO: 5575117 - DNA, 19 bp, Homo sapiens
attcatagcagcttattca

SEQ ID NO: 5575118 - DNA, 22 bp, Homo sapiens
attcatagcagcttattcacaa

SEQ ID NO: 5575119 - DNA, 18 bp, Homo sapiens
attcatagcatcctgatt

SEQ ID NO: 5575120 - DNA, 21 bp, Homo sapiens
attcatagcatcctgattatt

SEQ ID NO: 5575121 - DNA, 21 bp, Homo sapiens
attcatagggaaaggttttgt

SEQ ID NO: 5575122 - DNA, 18 bp, Homo sapiens
attcatagtaaaatacct

SEQ ID NO: 5575123 - DNA, 17 bp, Homo sapiens
attcatagtaagattga

SEQ ID NO: 5575124 - DNA, 16 bp, Homo sapiens
attcatagtagaactt

SEQ ID NO: 5575125 - DNA, 12 bp, Homo sapiens
attcatatattg

SEQ ID NO: 5575126 - DNA, 13 bp, Homo sapiens
attcatatattgc

SEQ ID NO: 5575127 - DNA, 20 bp, Homo sapiens
attcatatattgcatttctg

SEQ ID NO: 5575128 - DNA, 15 bp, Homo sapiens
attcatatgcatatt

SEQ ID NO: 5575129 - DNA, 16 bp, Homo sapiens
attcatatgcatattt

SEQ ID NO: 5575130 - DNA, 20 bp, Homo sapiens
attcatattacaatatttgt

SEQ ID NO: 5575131 - DNA, 22 bp, Homo sapiens
attcatattcctgcctttcttc

SEQ ID NO: 5575132 - DNA, 17 bp, Homo sapiens
attcatattgaatataa

SEQ ID NO: 5575133 - DNA, 20 bp, Homo sapiens
attcatattggaaaaatcac

SEQ ID NO: 5575134 - DNA, 14 bp, Homo sapiens
attcatatttgcaa

SEQ ID NO: 5575135 - DNA, 19 bp, Homo sapiens
attcatatttgcaataaaa

SEQ ID NO: 5575136 - DNA, 12 bp, Homo sapiens
attcatatttgt

SEQ ID NO: 5575137 - DNA, 22 bp, Homo sapiens
attcatatttgtactttctgtt

SEQ ID NO: 5575138 - DNA, 20 bp, Homo sapiens
attcatattttctttcaaaa

SEQ ID NO: 5575139 - DNA, 20 bp, Homo sapiens
attcatcaaataaaccttgt

SEQ ID NO: 5575140 - DNA, 23 bp, Homo sapiens
attcatcaatatccctcttgtaa

SEQ ID NO: 5575141 - DNA, 19 bp, Homo sapiens
attcatcactccaaaaaca

SEQ ID NO: 5575142 - DNA, 20 bp, Homo sapiens
attcatcactccaaaaacag

SEQ ID NO: 5575143 - DNA, 14 bp, Homo sapiens
attcatcagcattt

SEQ ID NO: 5575144 - DNA, 20 bp, Homo sapiens
attcatcattttctccacct

SEQ ID NO: 5575145 - DNA, 18 bp, Homo sapiens
attcatccaagttaaatg

SEQ ID NO: 5575146 - DNA, 15 bp, Homo sapiens
attcatccagcagtg

SEQ ID NO: 5575147 - DNA, 17 bp, Homo sapiens
attcatccagcagtgtt

SEQ ID NO: 5575148 - DNA, 15 bp, Homo sapiens
attcatcctcacatg

SEQ ID NO: 5575149 - DNA, 18 bp, Homo sapiens
attcatcctcacatgtgg

SEQ ID NO: 5575150 - DNA, 21 bp, Homo sapiens
attcatcctgggatgtaaacc

SEQ ID NO: 5575151 - DNA, 19 bp, Homo sapiens
attcatctaataaatcagt

SEQ ID NO: 5575152 - DNA, 17 bp, Homo sapiens
attcatctagttaagtc

SEQ ID NO: 5575153 - DNA, 20 bp, Homo sapiens
attcatctatttcgagtgtt

SEQ ID NO: 5575154 - DNA, 18 bp, Homo sapiens
attcatctcatgctctct

SEQ ID NO: 5575155 - DNA, 19 bp, Homo sapiens
attcatctcatgctctctg

SEQ ID NO: 5575156 - DNA, 18 bp, Homo sapiens
attcatctctcaaactta

SEQ ID NO: 5575157 - DNA, 12 bp, Homo sapiens
attcatctctgg

SEQ ID NO: 5575158 - DNA, 11 bp, Homo sapiens
attcatctgca

SEQ ID NO: 5575159 - DNA, 17 bp, Homo sapiens
attcatctggaggctgc

SEQ ID NO: 5575160 - DNA, 18 bp, Homo sapiens
attcatctgggaggcaga

SEQ ID NO: 5575161 - DNA, 13 bp, Homo sapiens
attcatctgtcta

SEQ ID NO: 5575162 - DNA, 21 bp, Homo sapiens
attcatctgtgaatctgcttt

SEQ ID NO: 5575163 - DNA, 20 bp, Homo sapiens
attcatctgtttttcttttt

SEQ ID NO: 5575164 - DNA, 16 bp, Homo sapiens
attcatcttcttcttt

SEQ ID NO: 5575165 - DNA, 16 bp, Homo sapiens
attcatctttcagaaa

SEQ ID NO: 5575166 - DNA, 20 bp, Homo sapiens
attcatctttcctttgctct

SEQ ID NO: 5575167 - DNA, 22 bp, Homo sapiens
attcatctttcctttgctctgg

SEQ ID NO: 5575168 - DNA, 16 bp, Homo sapiens
attcatcttttaatca

SEQ ID NO: 5575169 - DNA, 17 bp, Homo sapiens
attcatgaatcttgaga

SEQ ID NO: 5575170 - DNA, 23 bp, Homo sapiens
attcatgagattggtcattaaat

SEQ ID NO: 5575171 - DNA, 19 bp, Homo sapiens
attcatgatgctagttctt

SEQ ID NO: 5575172 - DNA, 17 bp, Homo sapiens
attcatgcaacttgatt

SEQ ID NO: 5575173 - DNA, 22 bp, Homo sapiens
attcatgcaagagtttcttgta

SEQ ID NO: 5575174 - DNA, 21 bp, Homo sapiens
attcatgcaagtggagctgtc

SEQ ID NO: 5575175 - DNA, 13 bp, Homo sapiens
attcatgcctggc

SEQ ID NO: 5575176 - DNA, 16 bp, Homo sapiens
attcatgcctttcata

SEQ ID NO: 5575177 - DNA, 18 bp, Homo sapiens
attcatgcctttcatagt

SEQ ID NO: 5575178 - DNA, 22 bp, Homo sapiens
attcatgcctttcatagtttat

SEQ ID NO: 5575179 - DNA, 14 bp, Homo sapiens
attcatgctaccca

SEQ ID NO: 5575180 - DNA, 21 bp, Homo sapiens
attcatgctactgccaacctg

SEQ ID NO: 5575181 - DNA, 12 bp, Homo sapiens
attcatgctgcc

SEQ ID NO: 5575182 - DNA, 20 bp, Homo sapiens
attcatgctgcctgccatgt

SEQ ID NO: 5575183 - DNA, 14 bp, Homo sapiens
attcatgctttctc

SEQ ID NO: 5575184 - DNA, 17 bp, Homo sapiens
attcatgctttctcctt

SEQ ID NO: 5575185 - DNA, 18 bp, Homo sapiens
attcatgctttctccttt

SEQ ID NO: 5575186 - DNA, 17 bp, Homo sapiens
attcatggaactttcat

SEQ ID NO: 5575187 - DNA, 18 bp, Homo sapiens
attcatggaactttcata

SEQ ID NO: 5575188 - DNA, 20 bp, Homo sapiens
attcatggaccactgtttct

SEQ ID NO: 5575189 - DNA, 22 bp, Homo sapiens
attcatggagtagcctggactg

SEQ ID NO: 5575190 - DNA, 17 bp, Homo sapiens
attcatggcctggggga

SEQ ID NO: 5575191 - DNA, 21 bp, Homo sapiens
attcatggctttaacagtaat

SEQ ID NO: 5575192 - DNA, 16 bp, Homo sapiens
attcatggttcaagta

SEQ ID NO: 5575193 - DNA, 19 bp, Homo sapiens
attcatggttttaaagcta

SEQ ID NO: 5575194 - DNA, 13 bp, Homo sapiens
attcctacttaaa

SEQ ID NO: 5575195 - DNA, 14 bp, Homo sapiens
attcctacttaaac

SEQ ID NO: 5575196 - DNA, 17 bp, Homo sapiens
attcctacttaaacaaa

SEQ ID NO: 5575197 - DNA, 24 bp, Homo sapiens
attcctagaaaagtttgttttact

SEQ ID NO: 5575198 - DNA, 18 bp, Homo sapiens
attcctagaaattgaaca

SEQ ID NO: 5575199 - DNA, 16 bp, Homo sapiens
attcctagaattaaac

SEQ ID NO: 5575200 - DNA, 17 bp, Homo sapiens
attcctagctgtaaata

SEQ ID NO: 5575201 - DNA, 20 bp, Homo sapiens
attcctagtggatgactgtt

SEQ ID NO: 5575202 - DNA, 14 bp, Homo sapiens
attcctagttggtg

SEQ ID NO: 5575203 - DNA, 19 bp, Homo sapiens
attcctatatcctgtgact

SEQ ID NO: 5575204 - DNA, 17 bp, Homo sapiens
attcctatctgtggatg

SEQ ID NO: 5575205 - DNA, 24 bp, Homo sapiens
attcctatgatggatggcagactc

SEQ ID NO: 5575206 - DNA, 14 bp, Homo sapiens
attcctattaatgt

SEQ ID NO: 5575207 - DNA, 16 bp, Homo sapiens
attcctattaatgtct

SEQ ID NO: 5575208 - DNA, 15 bp, Homo sapiens
attcctattactgca

SEQ ID NO: 5575209 - DNA, 20 bp, Homo sapiens
attcctattgtgatttgact

SEQ ID NO: 5575210 - DNA, 17 bp, Homo sapiens
attcctcacagccttgg

SEQ ID NO: 5575211 - DNA, 22 bp, Homo sapiens
attcctcacagccttggctcct

SEQ ID NO: 5575212 - DNA, 14 bp, Homo sapiens
attcctcagggaca

SEQ ID NO: 5575213 - DNA, 14 bp, Homo sapiens
attcctcagttgtt

SEQ ID NO: 5575214 - DNA, 22 bp, Homo sapiens
attcctcagttgttaacttcta

SEQ ID NO: 5575215 - DNA, 19 bp, Homo sapiens
attcctcatcctcagatgc

SEQ ID NO: 5575216 - DNA, 18 bp, Homo sapiens
attcctcatgaatgtaaa

SEQ ID NO: 5575217 - DNA, 19 bp, Homo sapiens
attcctcatgaatgtaaat

SEQ ID NO: 5575218 - DNA, 23 bp, Homo sapiens
attcctcatgaatgtaaatttgt

SEQ ID NO: 5575219 - DNA, 22 bp, Homo sapiens
attcctccaaatctcttgcttg

SEQ ID NO: 5575220 - DNA, 14 bp, Homo sapiens
attcctccactctg

SEQ ID NO: 5575221 - DNA, 22 bp, Homo sapiens
attcctccactctgtatctatg

SEQ ID NO: 5575222 - DNA, 23 bp, Homo sapiens
attcctccagagacactgagcca

SEQ ID NO: 5575223 - DNA, 19 bp, Homo sapiens
attcctccagcctcccctc

SEQ ID NO: 5575224 - DNA, 12 bp, Homo sapiens
attcctccccac

SEQ ID NO: 5575225 - DNA, 17 bp, Homo sapiens
attcctccccaccctgt

SEQ ID NO: 5575226 - DNA, 21 bp, Homo sapiens
attcctccccaccctgtccca

SEQ ID NO: 5575227 - DNA, 11 bp, Homo sapiens
attcctccctc

SEQ ID NO: 5575228 - DNA, 13 bp, Homo sapiens
attcctcctgctc

SEQ ID NO: 5575229 - DNA, 14 bp, Homo sapiens
attcctcctgctca

SEQ ID NO: 5575230 - DNA, 15 bp, Homo sapiens
attcctcctgctcat

SEQ ID NO: 5575231 - DNA, 16 bp, Homo sapiens
attcctcctgctcata

SEQ ID NO: 5575232 - DNA, 12 bp, Homo sapiens
attcctccttcc

SEQ ID NO: 5575233 - DNA, 16 bp, Homo sapiens
attcctccttcccccc

SEQ ID NO: 5575234 - DNA, 16 bp, Homo sapiens
attcctctaagatctt

SEQ ID NO: 5575235 - DNA, 16 bp, Homo sapiens
attcctctaatgttgt

SEQ ID NO: 5575236 - DNA, 20 bp, Homo sapiens
attcctctactaacaatcag

SEQ ID NO: 5575237 - DNA, 16 bp, Homo sapiens
attcctctcatttcca

SEQ ID NO: 5575238 - DNA, 14 bp, Homo sapiens
attcctctccaggc

SEQ ID NO: 5575239 - DNA, 17 bp, Homo sapiens
attcctctccaggccag

SEQ ID NO: 5575240 - DNA, 13 bp, Homo sapiens
attcctctcttaa

SEQ ID NO: 5575241 - DNA, 15 bp, Homo sapiens
attcctcttcattgt

SEQ ID NO: 5575242 - DNA, 19 bp, Homo sapiens
attcctcttggcaagatgt

SEQ ID NO: 5575243 - DNA, 19 bp, Homo sapiens
attcctctttgcccaaaat

SEQ ID NO: 5575244 - DNA, 14 bp, Homo sapiens
attcctctttgctt

SEQ ID NO: 5575245 - DNA, 16 bp, Homo sapiens
attcctctttgctttg

SEQ ID NO: 5575246 - DNA, 18 bp, Homo sapiens
attcctctttgctttgct

SEQ ID NO: 5575247 - DNA, 14 bp, Homo sapiens
attcctgaaaagct

SEQ ID NO: 5575248 - DNA, 19 bp, Homo sapiens
attcctgaaaagctgcatt

SEQ ID NO: 5575249 - DNA, 13 bp, Homo sapiens
attcctgaaagaa

SEQ ID NO: 5575250 - DNA, 15 bp, Homo sapiens
attcctgaagaacca

SEQ ID NO: 5575251 - DNA, 19 bp, Homo sapiens
attcctgaatgaaatatca

SEQ ID NO: 5575252 - DNA, 12 bp, Homo sapiens
attcctgaccca

SEQ ID NO: 5575253 - DNA, 14 bp, Homo sapiens
attcctgacccagg

SEQ ID NO: 5575254 - DNA, 16 bp, Homo sapiens
attcctgacccaggcc

SEQ ID NO: 5575255 - DNA, 15 bp, Homo sapiens
attcctgaccctcac

SEQ ID NO: 5575256 - DNA, 14 bp, Homo sapiens
attcctgaccctcc

SEQ ID NO: 5575257 - DNA, 18 bp, Homo sapiens
attcctgacctccgccat

SEQ ID NO: 5575258 - DNA, 22 bp, Homo sapiens
attcctgagatttcctcctggc

SEQ ID NO: 5575259 - DNA, 16 bp, Homo sapiens
attcctgagctggcct

SEQ ID NO: 5575260 - DNA, 19 bp, Homo sapiens
attcctgatactgggtaca

SEQ ID NO: 5575261 - DNA, 19 bp, Homo sapiens
attcctgatatgatttaaa

SEQ ID NO: 5575262 - DNA, 20 bp, Homo sapiens
attcctgatatgatttaaaa

SEQ ID NO: 5575263 - DNA, 17 bp, Homo sapiens
attcctgatcttcccac

SEQ ID NO: 5575264 - DNA, 17 bp, Homo sapiens
attcctgcagcctggag

SEQ ID NO: 5575265 - DNA, 12 bp, Homo sapiens
attcctgcattt

SEQ ID NO: 5575266 - DNA, 15 bp, Homo sapiens
attcctgcatttgtg

SEQ ID NO: 5575267 - DNA, 19 bp, Homo sapiens
attcctgccctgctgttta

SEQ ID NO: 5575268 - DNA, 13 bp, Homo sapiens
attcctgcctggt

SEQ ID NO: 5575269 - DNA, 17 bp, Homo sapiens
attcctgcctgtctcct

SEQ ID NO: 5575270 - DNA, 21 bp, Homo sapiens
attcctgcctttaagccaaag

SEQ ID NO: 5575271 - DNA, 19 bp, Homo sapiens
attcctgcctttcttccat

SEQ ID NO: 5575272 - DNA, 21 bp, Homo sapiens
attcctgctatgacagctggc

SEQ ID NO: 5575273 - DNA, 18 bp, Homo sapiens
attcctggaaaccacagt

SEQ ID NO: 5575274 - DNA, 15 bp, Homo sapiens
attcctggaacctgg

SEQ ID NO: 5575275 - DNA, 12 bp, Homo sapiens
attcctggactt

SEQ ID NO: 5575276 - DNA, 23 bp, Homo sapiens
attcctggagcccgaggcaccag

SEQ ID NO: 5575277 - DNA, 19 bp, Homo sapiens
attcctggcatgacactct

SEQ ID NO: 5575278 - DNA, 15 bp, Homo sapiens
attcctgggcaagaa

SEQ ID NO: 5575279 - DNA, 21 bp, Homo sapiens
attcctgggcaagaacctaaa

SEQ ID NO: 5575280 - DNA, 13 bp, Homo sapiens
attcctgggcaca

SEQ ID NO: 5575281 - DNA, 15 bp, Homo sapiens
attcctgggcacagt

SEQ ID NO: 5575282 - DNA, 17 bp, Homo sapiens
attcctgggcctgtccc

SEQ ID NO: 5575283 - DNA, 18 bp, Homo sapiens
attcctggtacccagcca

SEQ ID NO: 5575284 - DNA, 18 bp, Homo sapiens
attcctggttatcctatt

SEQ ID NO: 5575285 - DNA, 22 bp, Homo sapiens
attcctggtttgactcagttcc

SEQ ID NO: 5575286 - DNA, 13 bp, Homo sapiens
attcctgtaaata

SEQ ID NO: 5575287 - DNA, 15 bp, Homo sapiens
attcctgtaactttt

SEQ ID NO: 5575288 - DNA, 17 bp, Homo sapiens
attcctgtaacttttaa

SEQ ID NO: 5575289 - DNA, 13 bp, Homo sapiens
attcctgtgccct

SEQ ID NO: 5575290 - DNA, 19 bp, Homo sapiens
attcctgtgttcaatattt

SEQ ID NO: 5575291 - DNA, 13 bp, Homo sapiens
attcctgttctct

SEQ ID NO: 5575292 - DNA, 13 bp, Homo sapiens
attcctgttgacc

SEQ ID NO: 5575293 - DNA, 18 bp, Homo sapiens
attcctgttgctgtcttc

SEQ ID NO: 5575294 - DNA, 24 bp, Homo sapiens
attcctgttgtgtaataacagaac

SEQ ID NO: 5575295 - DNA, 15 bp, Homo sapiens
attccttaaatgaac

SEQ ID NO: 5575296 - DNA, 20 bp, Homo sapiens
attccttaaatgaactactg

SEQ ID NO: 5575297 - DNA, 23 bp, Homo sapiens
attccttaaatgaactactgcta

SEQ ID NO: 5575298 - DNA, 14 bp, Homo sapiens
attccttacttgca

SEQ ID NO: 5575299 - DNA, 15 bp, Homo sapiens
attccttacttgcac

SEQ ID NO: 5575300 - DNA, 17 bp, Homo sapiens
attccttacttgcactg

SEQ ID NO: 5575301 - DNA, 20 bp, Homo sapiens
attccttagataccttgaaa

SEQ ID NO: 5575302 - DNA, 18 bp, Homo sapiens
attccttagcagctcagg

SEQ ID NO: 5575303 - DNA, 20 bp, Homo sapiens
attccttagcagctcaggcg

SEQ ID NO: 5575304 - DNA, 24 bp, Homo sapiens
attccttagcttagacctcagcct

SEQ ID NO: 5575305 - DNA, 20 bp, Homo sapiens
attccttatttaagacatgt

SEQ ID NO: 5575306 - DNA, 15 bp, Homo sapiens
attccttcaaataaa

SEQ ID NO: 5575307 - DNA, 17 bp, Homo sapiens
attccttcaaataaaga

SEQ ID NO: 5575308 - DNA, 18 bp, Homo sapiens
attccttcacacagttca

SEQ ID NO: 5575309 - DNA, 13 bp, Homo sapiens
attccttcactca

SEQ ID NO: 5575310 - DNA, 14 bp, Homo sapiens
attccttcactcat

SEQ ID NO: 5575311 - DNA, 15 bp, Homo sapiens
attccttcagatttg

SEQ ID NO: 5575312 - DNA, 17 bp, Homo sapiens
attccttcagcacttta

SEQ ID NO: 5575313 - DNA, 17 bp, Homo sapiens
attccttcgaaaggcct

SEQ ID NO: 5575314 - DNA, 18 bp, Homo sapiens
attccttctaactgaagg

SEQ ID NO: 5575315 - DNA, 19 bp, Homo sapiens
attccttctaagtgtactt

SEQ ID NO: 5575316 - DNA, 15 bp, Homo sapiens
attccttctctgaac

SEQ ID NO: 5575317 - DNA, 16 bp, Homo sapiens
attccttctggccttt

SEQ ID NO: 5575318 - DNA, 22 bp, Homo sapiens
attccttctggcctttcctctc

SEQ ID NO: 5575319 - DNA, 14 bp, Homo sapiens
attccttctttgat

SEQ ID NO: 5575320 - DNA, 21 bp, Homo sapiens
attccttctttgataatgtta

SEQ ID NO: 5575321 - DNA, 23 bp, Homo sapiens
attccttctttgataatgttaaa

SEQ ID NO: 5575322 - DNA, 17 bp, Homo sapiens
attccttgaggacagac

SEQ ID NO: 5575323 - DNA, 16 bp, Homo sapiens
attccttgagtttcat

SEQ ID NO: 5575324 - DNA, 19 bp, Homo sapiens
attccttgatcattttggg

SEQ ID NO: 5575325 - DNA, 20 bp, Homo sapiens
attccttgatcattttggga

SEQ ID NO: 5575326 - DNA, 13 bp, Homo sapiens
attccttgcccca

SEQ ID NO: 5575327 - DNA, 16 bp, Homo sapiens
attccttgcgcctcag

SEQ ID NO: 5575328 - DNA, 17 bp, Homo sapiens
attccttggagccactg

SEQ ID NO: 5575329 - DNA, 17 bp, Homo sapiens
attccttggcccagcag

SEQ ID NO: 5575330 - DNA, 16 bp, Homo sapiens
attcctttaaaatatt

SEQ ID NO: 5575331 - DNA, 22 bp, Homo sapiens
attcctttaaagtgagtactgt

SEQ ID NO: 5575332 - DNA, 20 bp, Homo sapiens
attcctttaacaacatgttt

SEQ ID NO: 5575333 - DNA, 20 bp, Homo sapiens
attcctttacaactaaataa

SEQ ID NO: 5575334 - DNA, 23 bp, Homo sapiens
attcctttacaactaaataacac

SEQ ID NO: 5575335 - DNA, 12 bp, Homo sapiens
attcctttccag

SEQ ID NO: 5575336 - DNA, 11 bp, Homo sapiens
attcctttccc

SEQ ID NO: 5575337 - DNA, 17 bp, Homo sapiens
attcctttcccttcctc

SEQ ID NO: 5575338 - DNA, 20 bp, Homo sapiens
attcctttcccttcctcttc

SEQ ID NO: 5575339 - DNA, 17 bp, Homo sapiens
attcctttccctttagc

SEQ ID NO: 5575340 - DNA, 12 bp, Homo sapiens
attcctttcctt

SEQ ID NO: 5575341 - DNA, 23 bp, Homo sapiens
attcctttcttgtgccctgggcc

SEQ ID NO: 5575342 - DNA, 20 bp, Homo sapiens
attcctttgaatattttttg

SEQ ID NO: 5575343 - DNA, 23 bp, Homo sapiens
attcctttgaatattttttgaag

SEQ ID NO: 5575344 - DNA, 20 bp, Homo sapiens
attcctttgaccaaatagtt

SEQ ID NO: 5575345 - DNA, 18 bp, Homo sapiens
attcctttggccactgta

SEQ ID NO: 5575346 - DNA, 12 bp, Homo sapiens
attccttttaaa

SEQ ID NO: 5575347 - DNA, 13 bp, Homo sapiens
attccttttaaaa

SEQ ID NO: 5575348 - DNA, 15 bp, Homo sapiens
attccttttaaaatg

SEQ ID NO: 5575349 - DNA, 16 bp, Homo sapiens
attccttttaaagaag

SEQ ID NO: 5575350 - DNA, 22 bp, Homo sapiens
attccttttataagatttaatt

SEQ ID NO: 5575351 - DNA, 14 bp, Homo sapiens
attccttttctgta

SEQ ID NO: 5575352 - DNA, 19 bp, Homo sapiens
attccttttcttgtttatc

SEQ ID NO: 5575353 - DNA, 20 bp, Homo sapiens
attccttttcttgtttatca

SEQ ID NO: 5575354 - DNA, 18 bp, Homo sapiens
attccttttgatggggag

SEQ ID NO: 5575355 - DNA, 19 bp, Homo sapiens
attccttttgatggggaga

SEQ ID NO: 5575356 - DNA, 21 bp, Homo sapiens
attcctttttatttgtttgca

SEQ ID NO: 5575357 - DNA, 12 bp, Homo sapiens
attcctttttct

SEQ ID NO: 5575358 - DNA, 17 bp, Homo sapiens
attcctttttcttcact

SEQ ID NO: 5575359 - DNA, 15 bp, Homo sapiens
attcgaaccaggaaa

SEQ ID NO: 5575360 - DNA, 19 bp, Homo sapiens
attcgaagtcagctaattg

SEQ ID NO: 5575361 - DNA, 13 bp, Homo sapiens
attcgaatctctg

SEQ ID NO: 5575362 - DNA, 16 bp, Homo sapiens
attcgacctgatttac

SEQ ID NO: 5575363 - DNA, 15 bp, Homo sapiens
attcgagctatattt

SEQ ID NO: 5575364 - DNA, 19 bp, Homo sapiens
attcgaggtgtcaccctgc

SEQ ID NO: 5575365 - DNA, 22 bp, Homo sapiens
attcgaggtgtcaccctgcaga

SEQ ID NO: 5575366 - DNA, 15 bp, Homo sapiens
attcgatgcccccct

SEQ ID NO: 5575367 - DNA, 21 bp, Homo sapiens
attcgcagtgcccagtgatgg

SEQ ID NO: 5575368 - DNA, 22 bp, Homo sapiens
attcgcatgtttaatgtgaact

SEQ ID NO: 5575369 - DNA, 17 bp, Homo sapiens
attcgccacacagtatt

SEQ ID NO: 5575370 - DNA, 13 bp, Homo sapiens
attcgcccacccg

SEQ ID NO: 5575371 - DNA, 19 bp, Homo sapiens
attcgcccgagctgtttat

SEQ ID NO: 5575372 - DNA, 17 bp, Homo sapiens
attcttatttttaattt

SEQ ID NO: 5575373 - DNA, 14 bp, Homo sapiens
attcttcaaccagt

SEQ ID NO: 5575374 - DNA, 21 bp, Homo sapiens
attcttcaagatcccatttga

SEQ ID NO: 5575375 - DNA, 16 bp, Homo sapiens
attcttcaatttgaaa

SEQ ID NO: 5575376 - DNA, 19 bp, Homo sapiens
attcttcacctttgtaaga

SEQ ID NO: 5575377 - DNA, 13 bp, Homo sapiens
attcttcactgtc

SEQ ID NO: 5575378 - DNA, 13 bp, Homo sapiens
attcttcagcttg

SEQ ID NO: 5575379 - DNA, 21 bp, Homo sapiens
attcttcagtgtctctgtttt

SEQ ID NO: 5575380 - DNA, 16 bp, Homo sapiens
attcttcatgaaatgt

SEQ ID NO: 5575381 - DNA, 12 bp, Homo sapiens
attcttcattat

SEQ ID NO: 5575382 - DNA, 20 bp, Homo sapiens
attcttccaacacatttcac

SEQ ID NO: 5575383 - DNA, 22 bp, Homo sapiens
attcttccaagctgagagtcta

SEQ ID NO: 5575384 - DNA, 19 bp, Homo sapiens
attcttccacctcagcctc

SEQ ID NO: 5575385 - DNA, 12 bp, Homo sapiens
attcttccagaa

SEQ ID NO: 5575386 - DNA, 21 bp, Homo sapiens
attcttccagtgcaacaaaat

SEQ ID NO: 5575387 - DNA, 15 bp, Homo sapiens
attcttccatcatca

SEQ ID NO: 5575388 - DNA, 18 bp, Homo sapiens
attcttccatcatcactg

SEQ ID NO: 5575389 - DNA, 20 bp, Homo sapiens
attcttccatcatcactgta

SEQ ID NO: 5575390 - DNA, 21 bp, Homo sapiens
attcttccatcatcactgtaa

SEQ ID NO: 5575391 - DNA, 15 bp, Homo sapiens
attcttccatctgat

SEQ ID NO: 5575392 - DNA, 18 bp, Homo sapiens
attcttcccgctccccac

SEQ ID NO: 5575393 - DNA, 20 bp, Homo sapiens
attcttccctatctttgcca

SEQ ID NO: 5575394 - DNA, 12 bp, Homo sapiens
attcttccctgg

SEQ ID NO: 5575395 - DNA, 13 bp, Homo sapiens
attcttccctggg

SEQ ID NO: 5575396 - DNA, 23 bp, Homo sapiens
attcttccgcaccctccctagct

SEQ ID NO: 5575397 - DNA, 19 bp, Homo sapiens
attcttcctctccttccca

SEQ ID NO: 5575398 - DNA, 20 bp, Homo sapiens
attcttcctctccttcccac

SEQ ID NO: 5575399 - DNA, 21 bp, Homo sapiens
attcttccttccctcctttta

SEQ ID NO: 5575400 - DNA, 22 bp, Homo sapiens
attcttccttccctccttttaa

SEQ ID NO: 5575401 - DNA, 22 bp, Homo sapiens
attcttccttgccacaatcact

SEQ ID NO: 5575402 - DNA, 13 bp, Homo sapiens
attcttcctttgt

SEQ ID NO: 5575403 - DNA, 14 bp, Homo sapiens
attcttccttttat

SEQ ID NO: 5575404 - DNA, 19 bp, Homo sapiens
attcttcggaggaggtgga

SEQ ID NO: 5575405 - DNA, 19 bp, Homo sapiens
attcttcggtctgaatttt

SEQ ID NO: 5575406 - DNA, 15 bp, Homo sapiens
attcttctaaagcac

SEQ ID NO: 5575407 - DNA, 23 bp, Homo sapiens
attcttctaaagcactggtttca

SEQ ID NO: 5575408 - DNA, 12 bp, Homo sapiens
attcttctagag

SEQ ID NO: 5575409 - DNA, 23 bp, Homo sapiens
attcttctcgacttcaggagctg

SEQ ID NO: 5575410 - DNA, 12 bp, Homo sapiens
attcttctcttg

SEQ ID NO: 5575411 - DNA, 12 bp, Homo sapiens
attcttctgatc

SEQ ID NO: 5575412 - DNA, 15 bp, Homo sapiens
attcttctgatcact

SEQ ID NO: 5575413 - DNA, 12 bp, Homo sapiens
attcttctgctt

SEQ ID NO: 5575414 - DNA, 13 bp, Homo sapiens
attcttctgggtg

SEQ ID NO: 5575415 - DNA, 14 bp, Homo sapiens
attcttctgtattt

SEQ ID NO: 5575416 - DNA, 15 bp, Homo sapiens
attcttctgtatttc

SEQ ID NO: 5575417 - DNA, 18 bp, Homo sapiens
attcttctgtatttctag

SEQ ID NO: 5575418 - DNA, 19 bp, Homo sapiens
attcttctgtatttctagg

SEQ ID NO: 5575419 - DNA, 15 bp, Homo sapiens
attcttcttctcaag

SEQ ID NO: 5575420 - DNA, 18 bp, Homo sapiens
attcttcttgaaaataaa

SEQ ID NO: 5575421 - DNA, 14 bp, Homo sapiens
attcttctttcttt

SEQ ID NO: 5575422 - DNA, 13 bp, Homo sapiens
attcttcttttgg

SEQ ID NO: 5575423 - DNA, 15 bp, Homo sapiens
attcttcttttggca

SEQ ID NO: 5575424 - DNA, 16 bp, Homo sapiens
attcttgaaagctgtg

SEQ ID NO: 5575425 - DNA, 14 bp, Homo sapiens
attcttgaaagtat

SEQ ID NO: 5575426 - DNA, 23 bp, Homo sapiens
attcttgactccttggtgctaaa

SEQ ID NO: 5575427 - DNA, 16 bp, Homo sapiens
attcttgagaagtaac

SEQ ID NO: 5575428 - DNA, 17 bp, Homo sapiens
attcttgagaagtaact

SEQ ID NO: 5575429 - DNA, 13 bp, Homo sapiens
attcttgagttta

SEQ ID NO: 5575430 - DNA, 14 bp, Homo sapiens
attcttgagttttg

SEQ ID NO: 5575431 - DNA, 18 bp, Homo sapiens
attcttgagttttgataa

SEQ ID NO: 5575432 - DNA, 15 bp, Homo sapiens
attcttgagtttttg

SEQ ID NO: 5575433 - DNA, 14 bp, Homo sapiens
attcttgatctcta

SEQ ID NO: 5575434 - DNA, 14 bp, Homo sapiens
attcttgatgtaaa

SEQ ID NO: 5575435 - DNA, 18 bp, Homo sapiens
attcttgatgtaaaatct

SEQ ID NO: 5575436 - DNA, 14 bp, Homo sapiens
attcttgcactgta

SEQ ID NO: 5575437 - DNA, 22 bp, Homo sapiens
attcttgcactgtatccaagtt

SEQ ID NO: 5575438 - DNA, 20 bp, Homo sapiens
attcttgctttagaaaacat

SEQ ID NO: 5575439 - DNA, 19 bp, Homo sapiens
attcttgctttcacaaata

SEQ ID NO: 5575440 - DNA, 14 bp, Homo sapiens
attcttggcatcta

SEQ ID NO: 5575441 - DNA, 22 bp, Homo sapiens
attcttggcccgcacagagctg

SEQ ID NO: 5575442 - DNA, 18 bp, Homo sapiens
attcttggcttaatcatt

SEQ ID NO: 5575443 - DNA, 20 bp, Homo sapiens
attcttgggggttgccattc

SEQ ID NO: 5575444 - DNA, 17 bp, Homo sapiens
attcttggtatttggat

SEQ ID NO: 5575445 - DNA, 13 bp, Homo sapiens
attcttggttgtt

SEQ ID NO: 5575446 - DNA, 15 bp, Homo sapiens
attcttgtaaatctt

SEQ ID NO: 5575447 - DNA, 17 bp, Homo sapiens
attcttgtaaatctttt

SEQ ID NO: 5575448 - DNA, 13 bp, Homo sapiens
attcttgtaactt

SEQ ID NO: 5575449 - DNA, 21 bp, Homo sapiens
attcttgtattcctgattaac

SEQ ID NO: 5575450 - DNA, 22 bp, Homo sapiens
attcttgtattcctgattaacc

SEQ ID NO: 5575451 - DNA, 14 bp, Homo sapiens
attcttgtcaaaaa

SEQ ID NO: 5575452 - DNA, 17 bp, Homo sapiens
attcttgtcacaataaa

SEQ ID NO: 5575453 - DNA, 18 bp, Homo sapiens
attcttgtcacaataaat

SEQ ID NO: 5575454 - DNA, 14 bp, Homo sapiens
attcttgtccacat

SEQ ID NO: 5575455 - DNA, 18 bp, Homo sapiens
attcttgtccacattcta

SEQ ID NO: 5575456 - DNA, 20 bp, Homo sapiens
attcttgtccacattctact

SEQ ID NO: 5575457 - DNA, 22 bp, Homo sapiens
attcttgtccacattctacttc

SEQ ID NO: 5575458 - DNA, 13 bp, Homo sapiens
attcttgtcctgg

SEQ ID NO: 5575459 - DNA, 12 bp, Homo sapiens
attcttgtgaat

SEQ ID NO: 5575460 - DNA, 16 bp, Homo sapiens
attcttgtgcctcagc

SEQ ID NO: 5575461 - DNA, 17 bp, Homo sapiens
attcttgtggttaaaaa

SEQ ID NO: 5575462 - DNA, 19 bp, Homo sapiens
attcttgttgctgtacaaa

SEQ ID NO: 5575463 - DNA, 21 bp, Homo sapiens
attcttgttgctgtacaaaag

SEQ ID NO: 5575464 - DNA, 13 bp, Homo sapiens
attcttgtttgaa

SEQ ID NO: 5575465 - DNA, 18 bp, Homo sapiens
attcttgttttacatttg

SEQ ID NO: 5575466 - DNA, 13 bp, Homo sapiens
attctttaaacta

SEQ ID NO: 5575467 - DNA, 16 bp, Homo sapiens
attctttaaactactg

SEQ ID NO: 5575468 - DNA, 18 bp, Homo sapiens
attctttaaatatatatt

SEQ ID NO: 5575469 - DNA, 12 bp, Homo sapiens
attctttaaatt

SEQ ID NO: 5575470 - DNA, 15 bp, Homo sapiens
attctttaaggagat

SEQ ID NO: 5575471 - DNA, 18 bp, Homo sapiens
attctttaaggagataga

SEQ ID NO: 5575472 - DNA, 15 bp, Homo sapiens
attctttaatagaag

SEQ ID NO: 5575473 - DNA, 17 bp, Homo sapiens
attctttacaaaatgaa

SEQ ID NO: 5575474 - DNA, 18 bp, Homo sapiens
attctttactattaaaat

SEQ ID NO: 5575475 - DNA, 18 bp, Homo sapiens
attctttagatttttaaa

SEQ ID NO: 5575476 - DNA, 19 bp, Homo sapiens
attctttagatttttaaat

SEQ ID NO: 5575477 - DNA, 19 bp, Homo sapiens
attctttagcttacctggg

SEQ ID NO: 5575478 - DNA, 20 bp, Homo sapiens
attctttagcttacctgggc

SEQ ID NO: 5575479 - DNA, 15 bp, Homo sapiens
attctttagtactca

SEQ ID NO: 5575480 - DNA, 20 bp, Homo sapiens
attctttagtcattccaagt

SEQ ID NO: 5575481 - DNA, 21 bp, Homo sapiens
attctttataaaatgtataaa

SEQ ID NO: 5575482 - DNA, 13 bp, Homo sapiens
attctttatacaa

SEQ ID NO: 5575483 - DNA, 18 bp, Homo sapiens
attctttatacaacagtg

SEQ ID NO: 5575484 - DNA, 19 bp, Homo sapiens
attctttatacaacagtgc

SEQ ID NO: 5575485 - DNA, 21 bp, Homo sapiens
attctttatagtgaagtgtta

SEQ ID NO: 5575486 - DNA, 22 bp, Homo sapiens
attctttatagtgaagtgttaa

SEQ ID NO: 5575487 - DNA, 23 bp, Homo sapiens
attctttatatatggacagcttt

SEQ ID NO: 5575488 - DNA, 15 bp, Homo sapiens
attctttattctgcg

SEQ ID NO: 5575489 - DNA, 21 bp, Homo sapiens
attctttatttctgtcattca

SEQ ID NO: 5575490 - DNA, 19 bp, Homo sapiens
attctttcaagtgaatcta

SEQ ID NO: 5575491 - DNA, 22 bp, Homo sapiens
attctttcaatacagatatatt

SEQ ID NO: 5575492 - DNA, 21 bp, Homo sapiens
attctttcaatccacagtatt

SEQ ID NO: 5575493 - DNA, 22 bp, Homo sapiens
attctttcacaaggtacaaaat

SEQ ID NO: 5575494 - DNA, 23 bp, Homo sapiens
attctttcacttgatgtttgtta

SEQ ID NO: 5575495 - DNA, 18 bp, Homo sapiens
attctttcagctgtgtct

SEQ ID NO: 5575496 - DNA, 14 bp, Homo sapiens
attctttccatgac

SEQ ID NO: 5575497 - DNA, 17 bp, Homo sapiens
attctttccattatgat

SEQ ID NO: 5575498 - DNA, 22 bp, Homo sapiens
attctttccattatgattcttt

SEQ ID NO: 5575499 - DNA, 17 bp, Homo sapiens
attctttccatttgcat

SEQ ID NO: 5575500 - DNA, 13 bp, Homo sapiens
attctttcccaac

SEQ ID NO: 5575501 - DNA, 20 bp, Homo sapiens
attctttcccagtctgtcga

SEQ ID NO: 5575502 - DNA, 20 bp, Homo sapiens
attctttcccagtgagtctc

SEQ ID NO: 5575503 - DNA, 15 bp, Homo sapiens
attctttccccagag

SEQ ID NO: 5575504 - DNA, 13 bp, Homo sapiens
attctttccctag

SEQ ID NO: 5575505 - DNA, 13 bp, Homo sapiens
attctttcctaaa

SEQ ID NO: 5575506 - DNA, 22 bp, Homo sapiens
attctttccttctctgaaagtg

SEQ ID NO: 5575507 - DNA, 16 bp, Homo sapiens
attctttctcataaaa

SEQ ID NO: 5575508 - DNA, 14 bp, Homo sapiens
attctttctccttt

SEQ ID NO: 5575509 - DNA, 19 bp, Homo sapiens
attctttctctttgaaaaa

SEQ ID NO: 5575510 - DNA, 14 bp, Homo sapiens
attctttctgtctc

SEQ ID NO: 5575511 - DNA, 17 bp, Homo sapiens
attctttcttctcttta

SEQ ID NO: 5575512 - DNA, 18 bp, Homo sapiens
attctttctttttccttc

SEQ ID NO: 5575513 - DNA, 19 bp, Homo sapiens
attctttctttttccttca

SEQ ID NO: 5575514 - DNA, 12 bp, Homo sapiens
attctttgaaaa

SEQ ID NO: 5575515 - DNA, 22 bp, Homo sapiens
attctttgaaaacagatgacca

SEQ ID NO: 5575516 - DNA, 16 bp, Homo sapiens
attctttgatatgttg

SEQ ID NO: 5575517 - DNA, 23 bp, Homo sapiens
attctttgatatgttgatgaaat

SEQ ID NO: 5575518 - DNA, 21 bp, Homo sapiens
attctttgcactttttcttaa

SEQ ID NO: 5575519 - DNA, 15 bp, Homo sapiens
attctttgccacctt

SEQ ID NO: 5575520 - DNA, 18 bp, Homo sapiens
attctttgctagttggag

SEQ ID NO: 5575521 - DNA, 22 bp, Homo sapiens
attctttgctagttggagtgct

SEQ ID NO: 5575522 - DNA, 19 bp, Homo sapiens
attctttgggcgttggtca

SEQ ID NO: 5575523 - DNA, 20 bp, Homo sapiens
attctttgtattaccaaagc

SEQ ID NO: 5575524 - DNA, 14 bp, Homo sapiens
attctttgttctgt

SEQ ID NO: 5575525 - DNA, 14 bp, Homo sapiens
attctttgttgctt

SEQ ID NO: 5575526 - DNA, 22 bp, Homo sapiens
attcttttaaaaaattcttgta

SEQ ID NO: 5575527 - DNA, 13 bp, Homo sapiens
attcttttaaata

SEQ ID NO: 5575528 - DNA, 19 bp, Homo sapiens
attcttttaaatatttgtg

SEQ ID NO: 5575529 - DNA, 22 bp, Homo sapiens
attcttttaggacaattactgt

SEQ ID NO: 5575530 - DNA, 22 bp, Homo sapiens
attcttttatactcagctttct

SEQ ID NO: 5575531 - DNA, 15 bp, Homo sapiens
attcttttatataac

SEQ ID NO: 5575532 - DNA, 13 bp, Homo sapiens
attcttttcaaaa

SEQ ID NO: 5575533 - DNA, 17 bp, Homo sapiens
attcttttcaaaattgt

SEQ ID NO: 5575534 - DNA, 20 bp, Homo sapiens
attcttttcagcttgtttct

SEQ ID NO: 5575535 - DNA, 21 bp, Homo sapiens
attcttttcagcttgtttcta

SEQ ID NO: 5575536 - DNA, 19 bp, Homo sapiens
attcttttccaagctcctt

SEQ ID NO: 5575537 - DNA, 13 bp, Homo sapiens
attcttttctcag

SEQ ID NO: 5575538 - DNA, 19 bp, Homo sapiens
attcttttctcagtgttgg

SEQ ID NO: 5575539 - DNA, 14 bp, Homo sapiens
attcttttgccaag

SEQ ID NO: 5575540 - DNA, 13 bp, Homo sapiens
attcttttgtaat

SEQ ID NO: 5575541 - DNA, 16 bp, Homo sapiens
attcttttgtaattta

SEQ ID NO: 5575542 - DNA, 21 bp, Homo sapiens
attcttttgtttatattgttt

SEQ ID NO: 5575543 - DNA, 15 bp, Homo sapiens
attcttttgtttcca

SEQ ID NO: 5575544 - DNA, 13 bp, Homo sapiens
attctttttctga

SEQ ID NO: 5575545 - DNA, 18 bp, Homo sapiens
attctttttctgttgaaa

SEQ ID NO: 5575546 - DNA, 14 bp, Homo sapiens
attcttttttatta

SEQ ID NO: 5575547 - DNA, 19 bp, Homo sapiens
attcttttttattaatcac

SEQ ID NO: 5575548 - DNA, 16 bp, Homo sapiens
attcttttttcaatgt

SEQ ID NO: 5575549 - DNA, 23 bp, Homo sapiens
attcttttttcttccccctccat

SEQ ID NO: 5575550 - DNA, 9 bp, Homo sapiens
attgcattt

SEQ ID NO: 5575551 - DNA, 12 bp, Homo sapiens
attgcatttctg

SEQ ID NO: 5575552 - DNA, 17 bp, Homo sapiens
attgcatttctgtattt

SEQ ID NO: 5575553 - DNA, 16 bp, Homo sapiens
attgcatttgctgttg

SEQ ID NO: 5575554 - DNA, 18 bp, Homo sapiens
attgcatttgctgttgtt

SEQ ID NO: 5575555 - DNA, 19 bp, Homo sapiens
attgcatttgctgttgttt

SEQ ID NO: 5575556 - DNA, 20 bp, Homo sapiens
attgcattttttaaaacaag

SEQ ID NO: 5575557 - DNA, 22 bp, Homo sapiens
attgccaaaacccagctgcacc

SEQ ID NO: 5575558 - DNA, 13 bp, Homo sapiens
attgccaaaatat

SEQ ID NO: 5575559 - DNA, 13 bp, Homo sapiens
attgccaaacatt

SEQ ID NO: 5575560 - DNA, 22 bp, Homo sapiens
attgccaagctcaggaccaggc

SEQ ID NO: 5575561 - DNA, 23 bp, Homo sapiens
attgccaaggcatccccagtgcc

SEQ ID NO: 5575562 - DNA, 19 bp, Homo sapiens
attgccaatcttgttttaa

SEQ ID NO: 5575563 - DNA, 17 bp, Homo sapiens
attgccacctctggcca

SEQ ID NO: 5575564 - DNA, 18 bp, Homo sapiens
attgccacctctggccaa

SEQ ID NO: 5575565 - DNA, 23 bp, Homo sapiens
attgccacctctggccaaatatg

SEQ ID NO: 5575566 - DNA, 21 bp, Homo sapiens
attgccagctgacatcttgaa

SEQ ID NO: 5575567 - DNA, 12 bp, Homo sapiens
attgccaggaga

SEQ ID NO: 5575568 - DNA, 14 bp, Homo sapiens
attgccaggagatg

SEQ ID NO: 5575569 - DNA, 15 bp, Homo sapiens
attgccagtgtcttt

SEQ ID NO: 5575570 - DNA, 16 bp, Homo sapiens
attgccagtgtctttc

SEQ ID NO: 5575571 - DNA, 18 bp, Homo sapiens
attgccagtgtctttctt

SEQ ID NO: 5575572 - DNA, 20 bp, Homo sapiens
attgccagtgtctttctttg

SEQ ID NO: 5575573 - DNA, 19 bp, Homo sapiens
attgccataatatgatgca

SEQ ID NO: 5575574 - DNA, 12 bp, Homo sapiens
attgccatattg

SEQ ID NO: 5575575 - DNA, 15 bp, Homo sapiens
attgccatattgcac

SEQ ID NO: 5575576 - DNA, 16 bp, Homo sapiens
attgccatattgcaca

SEQ ID NO: 5575577 - DNA, 19 bp, Homo sapiens
attgccatcgggtgccaaa

SEQ ID NO: 5575578 - DNA, 23 bp, Homo sapiens
attgccatcgggtgccaaataaa

SEQ ID NO: 5575579 - DNA, 20 bp, Homo sapiens
attgccatgaaccatgctta

SEQ ID NO: 5575580 - DNA, 18 bp, Homo sapiens
attgccattttattaaac

SEQ ID NO: 5575581 - DNA, 20 bp, Homo sapiens
attgcccacacctgcctctg

SEQ ID NO: 5575582 - DNA, 17 bp, Homo sapiens
attgcccacgctggagt

SEQ ID NO: 5575583 - DNA, 21 bp, Homo sapiens
attgcccacgctggagtgcag

SEQ ID NO: 5575584 - DNA, 15 bp, Homo sapiens
attgcccaggctggt

SEQ ID NO: 5575585 - DNA, 10 bp, Homo sapiens
attgcccagt

SEQ ID NO: 5575586 - DNA, 15 bp, Homo sapiens
attgcccagtctttc

SEQ ID NO: 5575587 - DNA, 16 bp, Homo sapiens
attgcccagtctttca

SEQ ID NO: 5575588 - DNA, 15 bp, Homo sapiens
attgcccagtgagcc

SEQ ID NO: 5575589 - DNA, 21 bp, Homo sapiens
attgcccagtgagccctgctc

SEQ ID NO: 5575590 - DNA, 18 bp, Homo sapiens
attgcccatccatctgct

SEQ ID NO: 5575591 - DNA, 16 bp, Homo sapiens
attgcccatgatataa

SEQ ID NO: 5575592 - DNA, 21 bp, Homo sapiens
attgcccatggctgggaacat

SEQ ID NO: 5575593 - DNA, 16 bp, Homo sapiens
attgccccaagatagg

SEQ ID NO: 5575594 - DNA, 14 bp, Homo sapiens
attgccccagagcc

SEQ ID NO: 5575595 - DNA, 15 bp, Homo sapiens
attgccccagagccc

SEQ ID NO: 5575596 - DNA, 23 bp, Homo sapiens
attgccccatccagacctggctc

SEQ ID NO: 5575597 - DNA, 14 bp, Homo sapiens
attgccccatgaga

SEQ ID NO: 5575598 - DNA, 16 bp, Homo sapiens
attgcccccagggcac

SEQ ID NO: 5575599 - DNA, 16 bp, Homo sapiens
attgccccctctcact

SEQ ID NO: 5575600 - DNA, 15 bp, Homo sapiens
attgcccctctgcct

SEQ ID NO: 5575601 - DNA, 17 bp, Homo sapiens
attgcccctctgccttg

SEQ ID NO: 5575602 - DNA, 17 bp, Homo sapiens
attgcccctggctttgc

SEQ ID NO: 5575603 - DNA, 20 bp, Homo sapiens
attgcccctggctttgcctc

SEQ ID NO: 5575604 - DNA, 18 bp, Homo sapiens
attgcccgcgctcaggag

SEQ ID NO: 5575605 - DNA, 12 bp, Homo sapiens
attgccctgagg

SEQ ID NO: 5575606 - DNA, 15 bp, Homo sapiens
attgccctgaggggc

SEQ ID NO: 5575607 - DNA, 17 bp, Homo sapiens
attgccctgaggggcct

SEQ ID NO: 5575608 - DNA, 19 bp, Homo sapiens
attgccctgaggggcctgc

SEQ ID NO: 5575609 - DNA, 13 bp, Homo sapiens
attgccctgccag

SEQ ID NO: 5575610 - DNA, 15 bp, Homo sapiens
attgccctgccaggc

SEQ ID NO: 5575611 - DNA, 18 bp, Homo sapiens
attgccgacagcacagat

SEQ ID NO: 5575612 - DNA, 22 bp, Homo sapiens
attgccgtcctggactctgtgt

SEQ ID NO: 5575613 - DNA, 18 bp, Homo sapiens
attgcctaaaatttctga

SEQ ID NO: 5575614 - DNA, 19 bp, Homo sapiens
attgcctacaataaaaaga

SEQ ID NO: 5575615 - DNA, 20 bp, Homo sapiens
attgcctacaataaaaagaa

SEQ ID NO: 5575616 - DNA, 14 bp, Homo sapiens
attgcctacattta

SEQ ID NO: 5575617 - DNA, 23 bp, Homo sapiens
attgcctagaaatatctttctct

SEQ ID NO: 5575618 - DNA, 20 bp, Homo sapiens
attgcctataatacttgcaa

SEQ ID NO: 5575619 - DNA, 16 bp, Homo sapiens
attgcctcaataaagc

SEQ ID NO: 5575620 - DNA, 17 bp, Homo sapiens
attgcctcaataaagct

SEQ ID NO: 5575621 - DNA, 10 bp, Homo sapiens
attgcctcca

SEQ ID NO: 5575622 - DNA, 16 bp, Homo sapiens
attgcctcccttcctc

SEQ ID NO: 5575623 - DNA, 13 bp, Homo sapiens
attgcctcctcct

SEQ ID NO: 5575624 - DNA, 22 bp, Homo sapiens
attgcctctactttgattctga

SEQ ID NO: 5575625 - DNA, 11 bp, Homo sapiens
attgcctctga

SEQ ID NO: 5575626 - DNA, 18 bp, Homo sapiens
attgcctctgaaaagtgt

SEQ ID NO: 5575627 - DNA, 13 bp, Homo sapiens
attgcctctgaga

SEQ ID NO: 5575628 - DNA, 21 bp, Homo sapiens
attgcctctgtcttaaagaat

SEQ ID NO: 5575629 - DNA, 19 bp, Homo sapiens
attgcctcttgcaggctga

SEQ ID NO: 5575630 - DNA, 20 bp, Homo sapiens
attgcctcttttcacatttt

SEQ ID NO: 5575631 - DNA, 21 bp, Homo sapiens
attgcctcttttcacattttt

SEQ ID NO: 5575632 - DNA, 17 bp, Homo sapiens
attgcctgcagagagaa

SEQ ID NO: 5575633 - DNA, 16 bp, Homo sapiens
attgcctgccatggct

SEQ ID NO: 5575634 - DNA, 18 bp, Homo sapiens
attgcctgccatggctgt

SEQ ID NO: 5575635 - DNA, 16 bp, Homo sapiens
attgcctggactgacc

SEQ ID NO: 5575636 - DNA, 19 bp, Homo sapiens
attgcctgtaacaatgtaa

SEQ ID NO: 5575637 - DNA, 12 bp, Homo sapiens
attgcctgttaa

SEQ ID NO: 5575638 - DNA, 14 bp, Homo sapiens
attgcctgttcata

SEQ ID NO: 5575639 - DNA, 14 bp, Homo sapiens
attgcctgttctgc

SEQ ID NO: 5575640 - DNA, 12 bp, Homo sapiens
attgccttcagc

SEQ ID NO: 5575641 - DNA, 23 bp, Homo sapiens
attgccttcctcgtgcagagctg

SEQ ID NO: 5575642 - DNA, 15 bp, Homo sapiens
attgccttctttgaa

SEQ ID NO: 5575643 - DNA, 18 bp, Homo sapiens
attgccttctttgaagaa

SEQ ID NO: 5575644 - DNA, 18 bp, Homo sapiens
attgccttgatgtttcta

SEQ ID NO: 5575645 - DNA, 22 bp, Homo sapiens
attgccttgggcctgggaatct

SEQ ID NO: 5575646 - DNA, 13 bp, Homo sapiens
attgcctttctgt

SEQ ID NO: 5575647 - DNA, 16 bp, Homo sapiens
attgcctttgaatgtt

SEQ ID NO: 5575648 - DNA, 15 bp, Homo sapiens
attgcctttgataat

SEQ ID NO: 5575649 - DNA, 19 bp, Homo sapiens
attgcctttgtaatatgag

SEQ ID NO: 5575650 - DNA, 20 bp, Homo sapiens
attgcctttttataactttt

SEQ ID NO: 5575651 - DNA, 21 bp, Homo sapiens
attgcctttttataacttttt

SEQ ID NO: 5575652 - DNA, 17 bp, Homo sapiens
attgccttttttctgta

SEQ ID NO: 5575653 - DNA, 23 bp, Homo sapiens
attgcgaaacaacttgtgttcta

SEQ ID NO: 5575654 - DNA, 13 bp, Homo sapiens
attgcgagaaaca

SEQ ID NO: 5575655 - DNA, 14 bp, Homo sapiens
attgcgagagatgt

SEQ ID NO: 5575656 - DNA, 21 bp, Homo sapiens
attgcgagagatgtgtgttga

SEQ ID NO: 5575657 - DNA, 14 bp, Homo sapiens
attgcgcctaatgt

SEQ ID NO: 5575658 - DNA, 14 bp, Homo sapiens
attgcgcctttgta

SEQ ID NO: 5575659 - DNA, 14 bp, Homo sapiens
attgcgctcagggg

SEQ ID NO: 5575660 - DNA, 16 bp, Homo sapiens
attgcggacagccacg

SEQ ID NO: 5575661 - DNA, 18 bp, Homo sapiens
attgcggcctgttgggca

SEQ ID NO: 5575662 - DNA, 15 bp, Homo sapiens
attgcgtagaggcta

SEQ ID NO: 5575663 - DNA, 20 bp, Homo sapiens
attgcgtagaggctacaggg

SEQ ID NO: 5575664 - DNA, 13 bp, Homo sapiens
attgcgttggtct

SEQ ID NO: 5575665 - DNA, 20 bp, Homo sapiens
attgcgttggtctctgcatt

SEQ ID NO: 5575666 - DNA, 15 bp, Homo sapiens
attgctaaaaaataa

SEQ ID NO: 5575667 - DNA, 21 bp, Homo sapiens
attgctaaaaaataaataaaa

SEQ ID NO: 5575668 - DNA, 19 bp, Homo sapiens
attgctaaaagtgcattta

SEQ ID NO: 5575669 - DNA, 20 bp, Homo sapiens
attgctaaaagtgcatttaa

SEQ ID NO: 5575670 - DNA, 21 bp, Homo sapiens
attgctaaaagtgcatttaag

SEQ ID NO: 5575671 - DNA, 14 bp, Homo sapiens
attgctaaagtcag

SEQ ID NO: 5575672 - DNA, 18 bp, Homo sapiens
attgctaaatgtaacagt

SEQ ID NO: 5575673 - DNA, 18 bp, Homo sapiens
attgctaaccactgtctg

SEQ ID NO: 5575674 - DNA, 14 bp, Homo sapiens
attgctaacgtttt

SEQ ID NO: 5575675 - DNA, 14 bp, Homo sapiens
attgctaatgttgc

SEQ ID NO: 5575676 - DNA, 18 bp, Homo sapiens
attgctaatgttgctgga

SEQ ID NO: 5575677 - DNA, 14 bp, Homo sapiens
attgctaattgctg

SEQ ID NO: 5575678 - DNA, 15 bp, Homo sapiens
attgctaatttaaag

SEQ ID NO: 5575679 - DNA, 16 bp, Homo sapiens
attgctaatttagaga

SEQ ID NO: 5575680 - DNA, 19 bp, Homo sapiens
attgctacaacatcactaa

SEQ ID NO: 5575681 - DNA, 14 bp, Homo sapiens
attgctacacacac

SEQ ID NO: 5575682 - DNA, 15 bp, Homo sapiens
attgctacacacaca

SEQ ID NO: 5575683 - DNA, 20 bp, Homo sapiens
attgctacacttacaagtaa

SEQ ID NO: 5575684 - DNA, 21 bp, Homo sapiens
attgctacctcagtgctcctg

SEQ ID NO: 5575685 - DNA, 20 bp, Homo sapiens
attgctactataatcaaatg

SEQ ID NO: 5575686 - DNA, 21 bp, Homo sapiens
attgctactataatcaaatga

SEQ ID NO: 5575687 - DNA, 14 bp, Homo sapiens
attgctactgtcct

SEQ ID NO: 5575688 - DNA, 20 bp, Homo sapiens
attgctactgtcctacccac

SEQ ID NO: 5575689 - DNA, 19 bp, Homo sapiens
attgctagagctcctccct

SEQ ID NO: 5575690 - DNA, 14 bp, Homo sapiens
attgctagataaaa

SEQ ID NO: 5575691 - DNA, 22 bp, Homo sapiens
attgctagccagcattccatat

SEQ ID NO: 5575692 - DNA, 18 bp, Homo sapiens
attgctagtatttgaatt

SEQ ID NO: 5575693 - DNA, 19 bp, Homo sapiens
attgctagtatttgaatta

SEQ ID NO: 5575694 - DNA, 20 bp, Homo sapiens
attgctagtatttgaattaa

SEQ ID NO: 5575695 - DNA, 14 bp, Homo sapiens
attgctataaatcg

SEQ ID NO: 5575696 - DNA, 15 bp, Homo sapiens
attgctatcagcaat

SEQ ID NO: 5575697 - DNA, 16 bp, Homo sapiens
attgctatcagcaatg

SEQ ID NO: 5575698 - DNA, 17 bp, Homo sapiens
attgctatcatttggct

SEQ ID NO: 5575699 - DNA, 19 bp, Homo sapiens
attgctatcgccctccttt

SEQ ID NO: 5575700 - DNA, 20 bp, Homo sapiens
attgctatcgccctcctttc

SEQ ID NO: 5575701 - DNA, 22 bp, Homo sapiens
attgctatctggaggccttcca

SEQ ID NO: 5575702 - DNA, 16 bp, Homo sapiens
attgctatcttttctg

SEQ ID NO: 5575703 - DNA, 18 bp, Homo sapiens
attgctatcttttctgga

SEQ ID NO: 5575704 - DNA, 22 bp, Homo sapiens
attgctatgttttgacattttt

SEQ ID NO: 5575705 - DNA, 15 bp, Homo sapiens
attgctatttaaata

SEQ ID NO: 5575706 - DNA, 13 bp, Homo sapiens
attgctatttata

SEQ ID NO: 5575707 - DNA, 14 bp, Homo sapiens
attgctcaaaaaag

SEQ ID NO: 5575708 - DNA, 13 bp, Homo sapiens
attgctcagcccg

SEQ ID NO: 5575709 - DNA, 15 bp, Homo sapiens
attgctcaggctggt

SEQ ID NO: 5575710 - DNA, 14 bp, Homo sapiens
attgctcataatga

SEQ ID NO: 5575711 - DNA, 21 bp, Homo sapiens
attgctccaagatgttctcct

SEQ ID NO: 5575712 - DNA, 12 bp, Homo sapiens
attgctccagag

SEQ ID NO: 5575713 - DNA, 15 bp, Homo sapiens
attgctccattcctg

SEQ ID NO: 5575714 - DNA, 13 bp, Homo sapiens
attgctcccagga

SEQ ID NO: 5575715 - DNA, 18 bp, Homo sapiens
attgctccctaagactgt

SEQ ID NO: 5575716 - DNA, 18 bp, Homo sapiens
attgctcctcccacttct

SEQ ID NO: 5575717 - DNA, 22 bp, Homo sapiens
attgctcctgcatgcaactaat

SEQ ID NO: 5575718 - DNA, 20 bp, Homo sapiens
attgctcgcccagacaccat

SEQ ID NO: 5575719 - DNA, 15 bp, Homo sapiens
attgctctacagata

SEQ ID NO: 5575720 - DNA, 14 bp, Homo sapiens
attgctctctgggc

SEQ ID NO: 5575721 - DNA, 19 bp, Homo sapiens
attgctctgaatatgtcat

SEQ ID NO: 5575722 - DNA, 13 bp, Homo sapiens
attgctctgcccc

SEQ ID NO: 5575723 - DNA, 14 bp, Homo sapiens
attgctctgcccca

SEQ ID NO: 5575724 - DNA, 14 bp, Homo sapiens
attgctctggagca

SEQ ID NO: 5575725 - DNA, 21 bp, Homo sapiens
attgctctggggcttgctatt

SEQ ID NO: 5575726 - DNA, 15 bp, Homo sapiens
attgctctgttccca

SEQ ID NO: 5575727 - DNA, 19 bp, Homo sapiens
attgctcttagtcccaagc

SEQ ID NO: 5575728 - DNA, 14 bp, Homo sapiens
attgctcttctcca

SEQ ID NO: 5575729 - DNA, 20 bp, Homo sapiens
attggataaagtttggtgtt

SEQ ID NO: 5575730 - DNA, 23 bp, Homo sapiens
attggatacagcagtagacattt

SEQ ID NO: 5575731 - DNA, 14 bp, Homo sapiens
attggatatttgat

SEQ ID NO: 5575732 - DNA, 14 bp, Homo sapiens
attggatcaggaac

SEQ ID NO: 5575733 - DNA, 21 bp, Homo sapiens
attggatctattgatttgaaa

SEQ ID NO: 5575734 - DNA, 20 bp, Homo sapiens
attggatcttttactttaaa

SEQ ID NO: 5575735 - DNA, 16 bp, Homo sapiens
attggatgaaaagaga

SEQ ID NO: 5575736 - DNA, 17 bp, Homo sapiens
attggatgattgttcat

SEQ ID NO: 5575737 - DNA, 18 bp, Homo sapiens
attggattattcatttaa

SEQ ID NO: 5575738 - DNA, 19 bp, Homo sapiens
attggattattcatttaaa

SEQ ID NO: 5575739 - DNA, 22 bp, Homo sapiens
attggattattcatttaaaatg

SEQ ID NO: 5575740 - DNA, 19 bp, Homo sapiens
attggattatttaataaca

SEQ ID NO: 5575741 - DNA, 20 bp, Homo sapiens
attggattatttaataacat

SEQ ID NO: 5575742 - DNA, 19 bp, Homo sapiens
attggattctgagagctgt

SEQ ID NO: 5575743 - DNA, 23 bp, Homo sapiens
attggattgcgcctttgtattat

SEQ ID NO: 5575744 - DNA, 15 bp, Homo sapiens
attggatttgctgtg

SEQ ID NO: 5575745 - DNA, 21 bp, Homo sapiens
attggattttatgttgacatt

SEQ ID NO: 5575746 - DNA, 16 bp, Homo sapiens
attggatttttgttaa

SEQ ID NO: 5575747 - DNA, 16 bp, Homo sapiens
attggcaaactagaat

SEQ ID NO: 5575748 - DNA, 15 bp, Homo sapiens
attggcaaagtgaca

SEQ ID NO: 5575749 - DNA, 20 bp, Homo sapiens
attggcaatacctagtgata

SEQ ID NO: 5575750 - DNA, 23 bp, Homo sapiens
attggcaatgggccgtcccctct

SEQ ID NO: 5575751 - DNA, 11 bp, Homo sapiens
attggcagcag

SEQ ID NO: 5575752 - DNA, 17 bp, Homo sapiens
attggcagctcaaagac

SEQ ID NO: 5575753 - DNA, 16 bp, Homo sapiens
attggcagcttcaaaa

SEQ ID NO: 5575754 - DNA, 23 bp, Homo sapiens
attggcagcttcaaaacagaacg

SEQ ID NO: 5575755 - DNA, 17 bp, Homo sapiens
attggcaggataagaaa

SEQ ID NO: 5575756 - DNA, 22 bp, Homo sapiens
attggcaggtgtgggctcccac

SEQ ID NO: 5575757 - DNA, 19 bp, Homo sapiens
attggcagtgactttgtat

SEQ ID NO: 5575758 - DNA, 18 bp, Homo sapiens
attggcagttcctggcat

SEQ ID NO: 5575759 - DNA, 15 bp, Homo sapiens
attggcatggaaatt

SEQ ID NO: 5575760 - DNA, 21 bp, Homo sapiens
attggcatggaaatttaaagc

SEQ ID NO: 5575761 - DNA, 21 bp, Homo sapiens
attggcatggatttctgtctt

SEQ ID NO: 5575762 - DNA, 14 bp, Homo sapiens
attggcatggcttt

SEQ ID NO: 5575763 - DNA, 23 bp, Homo sapiens
attggcattctttgcaatactgc

SEQ ID NO: 5575764 - DNA, 15 bp, Homo sapiens
attggccaattaaaa

SEQ ID NO: 5575765 - DNA, 14 bp, Homo sapiens
attggccagagagt

SEQ ID NO: 5575766 - DNA, 14 bp, Homo sapiens
attggccagagcct

SEQ ID NO: 5575767 - DNA, 20 bp, Homo sapiens
attggccagtgagaagctga

SEQ ID NO: 5575768 - DNA, 17 bp, Homo sapiens
attggccccgcagtgcc

SEQ ID NO: 5575769 - DNA, 19 bp, Homo sapiens
attggccctcattccaagc

SEQ ID NO: 5575770 - DNA, 13 bp, Homo sapiens
attggccctgccc

SEQ ID NO: 5575771 - DNA, 14 bp, Homo sapiens
attggcctccaggg

SEQ ID NO: 5575772 - DNA, 15 bp, Homo sapiens
attggcctccagggc

SEQ ID NO: 5575773 - DNA, 15 bp, Homo sapiens
attggcctctgtgta

SEQ ID NO: 5575774 - DNA, 17 bp, Homo sapiens
attggcctgaacagatg

SEQ ID NO: 5575775 - DNA, 14 bp, Homo sapiens
attggcctggcctc

SEQ ID NO: 5575776 - DNA, 17 bp, Homo sapiens
attggcctggcctccag

SEQ ID NO: 5575777 - DNA, 20 bp, Homo sapiens
attggcctggcctccagctc

SEQ ID NO: 5575778 - DNA, 11 bp, Homo sapiens
attggcctgtt

SEQ ID NO: 5575779 - DNA, 12 bp, Homo sapiens
attggcctgttc

SEQ ID NO: 5575780 - DNA, 10 bp, Homo sapiens
attggcctta

SEQ ID NO: 5575781 - DNA, 20 bp, Homo sapiens
attggctagaggttcaaaga

SEQ ID NO: 5575782 - DNA, 23 bp, Homo sapiens
attggctagaggttcaaagatat

SEQ ID NO: 5575783 - DNA, 15 bp, Homo sapiens
attggctataacatg

SEQ ID NO: 5575784 - DNA, 19 bp, Homo sapiens
attggctatataaaatgtg

SEQ ID NO: 5575785 - DNA, 21 bp, Homo sapiens
attggctcacactgagaatgt

SEQ ID NO: 5575786 - DNA, 18 bp, Homo sapiens
attggctccaattcataa

SEQ ID NO: 5575787 - DNA, 22 bp, Homo sapiens
attggctcctccatctagagat

SEQ ID NO: 5575788 - DNA, 22 bp, Homo sapiens
attggctgctttgcctctacca

SEQ ID NO: 5575789 - DNA, 20 bp, Homo sapiens
attggctggattgccttgta

SEQ ID NO: 5575790 - DNA, 17 bp, Homo sapiens
attggctgggagtggtg

SEQ ID NO: 5575791 - DNA, 15 bp, Homo sapiens
attggcttaaaggga

SEQ ID NO: 5575792 - DNA, 19 bp, Homo sapiens
attggcttaaagtgaagga

SEQ ID NO: 5575793 - DNA, 15 bp, Homo sapiens
attggcttactgaaa

SEQ ID NO: 5575794 - DNA, 14 bp, Homo sapiens
attggcttgcactt

SEQ ID NO: 5575795 - DNA, 15 bp, Homo sapiens
attggcttgtagaat

SEQ ID NO: 5575796 - DNA, 19 bp, Homo sapiens
attggcttgtagaattgtt

SEQ ID NO: 5575797 - DNA, 23 bp, Homo sapiens
attggctttaaacacccttcaca

SEQ ID NO: 5575798 - DNA, 10 bp, Homo sapiens
attggctttc

SEQ ID NO: 5575799 - DNA, 19 bp, Homo sapiens
attggctttctctccttgg

SEQ ID NO: 5575800 - DNA, 19 bp, Homo sapiens
attggcttttctgatccag

SEQ ID NO: 5575801 - DNA, 21 bp, Homo sapiens
attggctttttaaattttcca

SEQ ID NO: 5575802 - DNA, 16 bp, Homo sapiens
attgggaaaaaagcaa

SEQ ID NO: 5575803 - DNA, 13 bp, Homo sapiens
attgggaaatctt

SEQ ID NO: 5575804 - DNA, 20 bp, Homo sapiens
attgggaaggaaatatattt

SEQ ID NO: 5575805 - DNA, 15 bp, Homo sapiens
attgggacaacagtg

SEQ ID NO: 5575806 - DNA, 14 bp, Homo sapiens
attgggagaaatca

SEQ ID NO: 5575807 - DNA, 16 bp, Homo sapiens
attgggagggacaggg

SEQ ID NO: 5575808 - DNA, 22 bp, Homo sapiens
attgggagtccaggcacaggat

SEQ ID NO: 5575809 - DNA, 21 bp, Homo sapiens
attgggattaacataaaagag

SEQ ID NO: 5575810 - DNA, 15 bp, Homo sapiens
attgggattgggggg

SEQ ID NO: 5575811 - DNA, 13 bp, Homo sapiens
attgggcaataaa

SEQ ID NO: 5575812 - DNA, 21 bp, Homo sapiens
attgggcactatttatttaca

SEQ ID NO: 5575813 - DNA, 19 bp, Homo sapiens
attgggcagaatcctgggc

SEQ ID NO: 5575814 - DNA, 18 bp, Homo sapiens
attgggcagcagactgtg

SEQ ID NO: 5575815 - DNA, 14 bp, Homo sapiens
attgggcagcgccc

SEQ ID NO: 5575816 - DNA, 20 bp, Homo sapiens
attgggcagcgcccttcctc

SEQ ID NO: 5575817 - DNA, 22 bp, Homo sapiens
attgggcagcgcccttcctctc

SEQ ID NO: 5575818 - DNA, 23 bp, Homo sapiens
attgggcattagtgtcccccctt

SEQ ID NO: 5575819 - DNA, 20 bp, Homo sapiens
attgggcccttagaatgtga

SEQ ID NO: 5575820 - DNA, 22 bp, Homo sapiens
attgggcccttagaatgtgaaa

SEQ ID NO: 5575821 - DNA, 23 bp, Homo sapiens
attgggcccttagaatgtgaaaa

SEQ ID NO: 5575822 - DNA, 18 bp, Homo sapiens
attgggcggctctgaagc

SEQ ID NO: 5575823 - DNA, 16 bp, Homo sapiens
attgggcggggcttct

SEQ ID NO: 5575824 - DNA, 15 bp, Homo sapiens
attgggctgcaggct

SEQ ID NO: 5575825 - DNA, 15 bp, Homo sapiens
attgggctggctctg

SEQ ID NO: 5575826 - DNA, 19 bp, Homo sapiens
attggggaaatttttaagt

SEQ ID NO: 5575827 - DNA, 16 bp, Homo sapiens
attggggaagagagcc

SEQ ID NO: 5575828 - DNA, 15 bp, Homo sapiens
attggggattcttaa

SEQ ID NO: 5575829 - DNA, 18 bp, Homo sapiens
attggggcctcacccaga

SEQ ID NO: 5575830 - DNA, 14 bp, Homo sapiens
attggggctcccag

SEQ ID NO: 5575831 - DNA, 17 bp, Homo sapiens
attgggggaggaaaagt

SEQ ID NO: 5575832 - DNA, 19 bp, Homo sapiens
attgggggatgtgaagaaa

SEQ ID NO: 5575833 - DNA, 16 bp, Homo sapiens
attgggggccctgggg

SEQ ID NO: 5575834 - DNA, 19 bp, Homo sapiens
attgggggctggtgccagc

SEQ ID NO: 5575835 - DNA, 22 bp, Homo sapiens
attgggggctggtgccagcctt

SEQ ID NO: 5575836 - DNA, 22 bp, Homo sapiens
attggggggaaagagggagcaa

SEQ ID NO: 5575837 - DNA, 19 bp, Homo sapiens
attgggggggccaaaagga

SEQ ID NO: 5575838 - DNA, 22 bp, Homo sapiens
attgggggggccaaaaggaaaa

SEQ ID NO: 5575839 - DNA, 23 bp, Homo sapiens
attgggggggccaaaaggaaaaa

SEQ ID NO: 5575840 - DNA, 16 bp, Homo sapiens
attgggggggcttggg

SEQ ID NO: 5575841 - DNA, 14 bp, Homo sapiens
attggggtgacctt

SEQ ID NO: 5575842 - DNA, 23 bp, Homo sapiens
attggggtttctggttggaggcc

SEQ ID NO: 5575843 - DNA, 15 bp, Homo sapiens
attggggtttgattt

SEQ ID NO: 5575844 - DNA, 22 bp, Homo sapiens
attgggtatcaagacatagcat

SEQ ID NO: 5575845 - DNA, 14 bp, Homo sapiens
attgggtcagaccc

SEQ ID NO: 5575846 - DNA, 15 bp, Homo sapiens
attgggtctattcca

SEQ ID NO: 5575847 - DNA, 19 bp, Homo sapiens
attgggtctattccagctc

SEQ ID NO: 5575848 - DNA, 22 bp, Homo sapiens
attgggtggaggaccgttctct

SEQ ID NO: 5575849 - DNA, 20 bp, Homo sapiens
attgggtggggggcttcata

SEQ ID NO: 5575850 - DNA, 22 bp, Homo sapiens
attgggtggggggcttcataca

SEQ ID NO: 5575851 - DNA, 15 bp, Homo sapiens
attgggtgtgccctg

SEQ ID NO: 5575852 - DNA, 17 bp, Homo sapiens
attgggtgtgccctggc

SEQ ID NO: 5575853 - DNA, 14 bp, Homo sapiens
attgggttcatgat

SEQ ID NO: 5575854 - DNA, 18 bp, Homo sapiens
attgggttcatgatgcag

SEQ ID NO: 5575855 - DNA, 22 bp, Homo sapiens
attgggttcatgatgcagtctc

SEQ ID NO: 5575856 - DNA, 18 bp, Homo sapiens
attgggttccattctcac

SEQ ID NO: 5575857 - DNA, 18 bp, Homo sapiens
attgggtttttattgttg

SEQ ID NO: 5575858 - DNA, 22 bp, Homo sapiens
attgggtttttggacttctggg

SEQ ID NO: 5575859 - DNA, 19 bp, Homo sapiens
attggtaaaaacagcagct

SEQ ID NO: 5575860 - DNA, 22 bp, Homo sapiens
attggtaaaaacagcagctcat

SEQ ID NO: 5575861 - DNA, 16 bp, Homo sapiens
attggtaactgcctgg

SEQ ID NO: 5575862 - DNA, 13 bp, Homo sapiens
attggtaattaaa

SEQ ID NO: 5575863 - DNA, 14 bp, Homo sapiens
attggtaattaaaa

SEQ ID NO: 5575864 - DNA, 15 bp, Homo sapiens
attggtaattaaaag

SEQ ID NO: 5575865 - DNA, 16 bp, Homo sapiens
attggtaattaaaaga

SEQ ID NO: 5575866 - DNA, 20 bp, Homo sapiens
attggtacataggcttctat

SEQ ID NO: 5575867 - DNA, 23 bp, Homo sapiens
attggtactgccttaaagataca

SEQ ID NO: 5575868 - DNA, 19 bp, Homo sapiens
attggtatagccatgattt

SEQ ID NO: 5575869 - DNA, 18 bp, Homo sapiens
attggtatgatgctgccg

SEQ ID NO: 5575870 - DNA, 17 bp, Homo sapiens
attggtattaaagaatg

SEQ ID NO: 5575871 - DNA, 20 bp, Homo sapiens
attggtccaacagtttgatg

SEQ ID NO: 5575872 - DNA, 20 bp, Homo sapiens
attggtccaccctttcatag

SEQ ID NO: 5575873 - DNA, 14 bp, Homo sapiens
attggtctaattta

SEQ ID NO: 5575874 - DNA, 14 bp, Homo sapiens
attggtctcctctc

SEQ ID NO: 5575875 - DNA, 21 bp, Homo sapiens
attggtcttaatgttgaatgt

SEQ ID NO: 5575876 - DNA, 19 bp, Homo sapiens
attggtgacgatgggtgtt

SEQ ID NO: 5575877 - DNA, 17 bp, Homo sapiens
attggtgagttaggaac

SEQ ID NO: 5575878 - DNA, 15 bp, Homo sapiens
attggtgataagtgg

SEQ ID NO: 5575879 - DNA, 16 bp, Homo sapiens
attggtgctatttgaa

SEQ ID NO: 5575880 - DNA, 17 bp, Homo sapiens
attggtgctatttgaag

SEQ ID NO: 5575881 - DNA, 18 bp, Homo sapiens
attggtgcttgactctca

SEQ ID NO: 5575882 - DNA, 13 bp, Homo sapiens
attggtgctttgt

SEQ ID NO: 5575883 - DNA, 14 bp, Homo sapiens
attggtgctttgtg

SEQ ID NO: 5575884 - DNA, 15 bp, Homo sapiens
attggtgctttgtgt

SEQ ID NO: 5575885 - DNA, 18 bp, Homo sapiens
attggtgctttgtgtcta

SEQ ID NO: 5575886 - DNA, 21 bp, Homo sapiens
attggtggcagattttacaaa

SEQ ID NO: 5575887 - DNA, 16 bp, Homo sapiens
attggtggctttcctt

SEQ ID NO: 5575888 - DNA, 22 bp, Homo sapiens
attggtgggaagcaagcagggg

SEQ ID NO: 5575889 - DNA, 18 bp, Homo sapiens
attggtgtaaatcttttt

SEQ ID NO: 5575890 - DNA, 19 bp, Homo sapiens
attggtgtaaggtactttc

SEQ ID NO: 5575891 - DNA, 18 bp, Homo sapiens
attggtgtatatcatgaa

SEQ ID NO: 5575892 - DNA, 16 bp, Homo sapiens
attggtgtcattttct

SEQ ID NO: 5575893 - DNA, 21 bp, Homo sapiens
attggtgtgaatgctgtacct

SEQ ID NO: 5575894 - DNA, 12 bp, Homo sapiens
attggtgttgac

SEQ ID NO: 5575895 - DNA, 22 bp, Homo sapiens
attggtgttgccagttgtcctc

SEQ ID NO: 5575896 - DNA, 23 bp, Homo sapiens
attggtgttgtactcaattttaa

SEQ ID NO: 5575897 - DNA, 18 bp, Homo sapiens
attggtgttgtcattgta

SEQ ID NO: 5575898 - DNA, 18 bp, Homo sapiens
attggtgtttttttctat

SEQ ID NO: 5575899 - DNA, 19 bp, Homo sapiens
attggttaatgaaaaatct

SEQ ID NO: 5575900 - DNA, 13 bp, Homo sapiens
attggttaatttt

SEQ ID NO: 5575901 - DNA, 20 bp, Homo sapiens
attggttacaaatttttact

SEQ ID NO: 5575902 - DNA, 23 bp, Homo sapiens
attggttactggtgatgttgaaa

SEQ ID NO: 5575903 - DNA, 15 bp, Homo sapiens
attggttcatgcctg

SEQ ID NO: 5575904 - DNA, 17 bp, Homo sapiens
attggttcatgcctggg

SEQ ID NO: 5575905 - DNA, 17 bp, Homo sapiens
attgtggaaaaccagga

SEQ ID NO: 5575906 - DNA, 18 bp, Homo sapiens
attgtggaagacagtgtg

SEQ ID NO: 5575907 - DNA, 23 bp, Homo sapiens
attgtggaataaatccttcgtcc

SEQ ID NO: 5575908 - DNA, 20 bp, Homo sapiens
attgtggaatgttggataag

SEQ ID NO: 5575909 - DNA, 18 bp, Homo sapiens
attgtggagaggagagaa

SEQ ID NO: 5575910 - DNA, 21 bp, Homo sapiens
attgtggataacaaagatatc

SEQ ID NO: 5575911 - DNA, 22 bp, Homo sapiens
attgtggatgtgttcattcaag

SEQ ID NO: 5575912 - DNA, 22 bp, Homo sapiens
attgtggcccagataaggcttt

SEQ ID NO: 5575913 - DNA, 13 bp, Homo sapiens
attgtggctccct

SEQ ID NO: 5575914 - DNA, 19 bp, Homo sapiens
attgtggctccctgggggc

SEQ ID NO: 5575915 - DNA, 14 bp, Homo sapiens
attgtgggaagggg

SEQ ID NO: 5575916 - DNA, 16 bp, Homo sapiens
attgtgggcataaact

SEQ ID NO: 5575917 - DNA, 19 bp, Homo sapiens
attgtgggcatgagctgct

SEQ ID NO: 5575918 - DNA, 20 bp, Homo sapiens
attgtgggcatgagctgctg

SEQ ID NO: 5575919 - DNA, 20 bp, Homo sapiens
attgtgggccatgaaccaaa

SEQ ID NO: 5575920 - DNA, 18 bp, Homo sapiens
attgtggggagagaaatc

SEQ ID NO: 5575921 - DNA, 12 bp, Homo sapiens
attgtggggtgc

SEQ ID NO: 5575922 - DNA, 23 bp, Homo sapiens
attgtggggtgcagctgggtggg

SEQ ID NO: 5575923 - DNA, 23 bp, Homo sapiens
attgtggtaggccttttaacatt

SEQ ID NO: 5575924 - DNA, 12 bp, Homo sapiens
attgtggtgcca

SEQ ID NO: 5575925 - DNA, 14 bp, Homo sapiens
attgtggtgggccc

SEQ ID NO: 5575926 - DNA, 12 bp, Homo sapiens
attgtggttggt

SEQ ID NO: 5575927 - DNA, 15 bp, Homo sapiens
attgtggtttagatc

SEQ ID NO: 5575928 - DNA, 20 bp, Homo sapiens
attgtggtttatatatttaa

SEQ ID NO: 5575929 - DNA, 15 bp, Homo sapiens
attgtgtaaaaaatg

SEQ ID NO: 5575930 - DNA, 17 bp, Homo sapiens
attgtgtaaaaaatgga

SEQ ID NO: 5575931 - DNA, 20 bp, Homo sapiens
attgtgtaaaaaatggaaaa

SEQ ID NO: 5575932 - DNA, 16 bp, Homo sapiens
attgtgtaaaggaaca

SEQ ID NO: 5575933 - DNA, 24 bp, Homo sapiens
attgtgtaaattcctgttgtctga

SEQ ID NO: 5575934 - DNA, 14 bp, Homo sapiens
attgtgtacaaagt

SEQ ID NO: 5575935 - DNA, 21 bp, Homo sapiens
attgtgtacatagagcaatgt

SEQ ID NO: 5575936 - DNA, 19 bp, Homo sapiens
attgtgtacttttcctttg

SEQ ID NO: 5575937 - DNA, 12 bp, Homo sapiens
attgtgtagacg

SEQ ID NO: 5575938 - DNA, 23 bp, Homo sapiens
attgtgtagccccttttctttgg

SEQ ID NO: 5575939 - DNA, 16 bp, Homo sapiens
attgtgtagccttttt

SEQ ID NO: 5575940 - DNA, 18 bp, Homo sapiens
attgtgtataactggatt

SEQ ID NO: 5575941 - DNA, 17 bp, Homo sapiens
attgtgtatagatattt

SEQ ID NO: 5575942 - DNA, 14 bp, Homo sapiens
attgtgtatatatc

SEQ ID NO: 5575943 - DNA, 15 bp, Homo sapiens
attgtgtatatgttg

SEQ ID NO: 5575944 - DNA, 12 bp, Homo sapiens
attgtgtattta

SEQ ID NO: 5575945 - DNA, 23 bp, Homo sapiens
attgtgtattttctttgggggtg

SEQ ID NO: 5575946 - DNA, 17 bp, Homo sapiens
attgtgtcccattcccc

SEQ ID NO: 5575947 - DNA, 14 bp, Homo sapiens
attgtgtctcttgg

SEQ ID NO: 5575948 - DNA, 16 bp, Homo sapiens
attgtgtctgtggtcc

SEQ ID NO: 5575949 - DNA, 17 bp, Homo sapiens
attgtgtcttttgcatg

SEQ ID NO: 5575950 - DNA, 20 bp, Homo sapiens
attgtgtgaaaaaagaaaat

SEQ ID NO: 5575951 - DNA, 14 bp, Homo sapiens
attgtgtgatccag

SEQ ID NO: 5575952 - DNA, 19 bp, Homo sapiens
attgtgtgatccagccctg

SEQ ID NO: 5575953 - DNA, 16 bp, Homo sapiens
attgtgtgcgctgcct

SEQ ID NO: 5575954 - DNA, 20 bp, Homo sapiens
attgtgtgcgctgcctggcc

SEQ ID NO: 5575955 - DNA, 22 bp, Homo sapiens
attgtgtgcgctgcctggccag

SEQ ID NO: 5575956 - DNA, 13 bp, Homo sapiens
attgtgtggagaa

SEQ ID NO: 5575957 - DNA, 18 bp, Homo sapiens
attgtgtggagaagtgtg

SEQ ID NO: 5575958 - DNA, 19 bp, Homo sapiens
attgtgtggattctttaaa

SEQ ID NO: 5575959 - DNA, 23 bp, Homo sapiens
attgtgtggtctggttcctgtgt

SEQ ID NO: 5575960 - DNA, 17 bp, Homo sapiens
attgtgtggtttcccct

SEQ ID NO: 5575961 - DNA, 17 bp, Homo sapiens
attgtgtgtcttcagga

SEQ ID NO: 5575962 - DNA, 13 bp, Homo sapiens
attgtgtgtgcaa

SEQ ID NO: 5575963 - DNA, 19 bp, Homo sapiens
attgtgtgtgcaagaaaac

SEQ ID NO: 5575964 - DNA, 16 bp, Homo sapiens
attgtgtgttatttaa

SEQ ID NO: 5575965 - DNA, 18 bp, Homo sapiens
attgtgtgttatttaaat

SEQ ID NO: 5575966 - DNA, 17 bp, Homo sapiens
attgtgttattttacta

SEQ ID NO: 5575967 - DNA, 15 bp, Homo sapiens
attgtgttgaagaag

SEQ ID NO: 5575968 - DNA, 20 bp, Homo sapiens
attgtgttgacattaagaat

SEQ ID NO: 5575969 - DNA, 23 bp, Homo sapiens
attgtgttgccttagcacttctt

SEQ ID NO: 5575970 - DNA, 18 bp, Homo sapiens
attgtgttggctttacaa

SEQ ID NO: 5575971 - DNA, 20 bp, Homo sapiens
attgtgttggctttacaaat

SEQ ID NO: 5575972 - DNA, 21 bp, Homo sapiens
attgtgttgtcttcagcagtc

SEQ ID NO: 5575973 - DNA, 14 bp, Homo sapiens
attgtgtttacatt

SEQ ID NO: 5575974 - DNA, 23 bp, Homo sapiens
attgtgtttacattttatggtgc

SEQ ID NO: 5575975 - DNA, 20 bp, Homo sapiens
attgtgtttatgcatttcaa

SEQ ID NO: 5575976 - DNA, 15 bp, Homo sapiens
attgtgtttcacaaa

SEQ ID NO: 5575977 - DNA, 12 bp, Homo sapiens
attgtgtttcta

SEQ ID NO: 5575978 - DNA, 18 bp, Homo sapiens
attgtgtttgtcattagc

SEQ ID NO: 5575979 - DNA, 17 bp, Homo sapiens
attgtgtttgtgtgctg

SEQ ID NO: 5575980 - DNA, 18 bp, Homo sapiens
attgtgtttgttcataat

SEQ ID NO: 5575981 - DNA, 14 bp, Homo sapiens
attgtgttttaaca

SEQ ID NO: 5575982 - DNA, 19 bp, Homo sapiens
attgtgttttaacaccaac

SEQ ID NO: 5575983 - DNA, 21 bp, Homo sapiens
attgtgttttcttcgtggatt

SEQ ID NO: 5575984 - DNA, 13 bp, Homo sapiens
attgttaaaacct

SEQ ID NO: 5575985 - DNA, 15 bp, Homo sapiens
attgttaaaataact

SEQ ID NO: 5575986 - DNA, 16 bp, Homo sapiens
attgttaaacaaatga

SEQ ID NO: 5575987 - DNA, 16 bp, Homo sapiens
attgttaaatacacat

SEQ ID NO: 5575988 - DNA, 17 bp, Homo sapiens
attgttaaatacacatt

SEQ ID NO: 5575989 - DNA, 15 bp, Homo sapiens
attgttaaattacat

SEQ ID NO: 5575990 - DNA, 23 bp, Homo sapiens
attgttaagtctaaatatttcct

SEQ ID NO: 5575991 - DNA, 17 bp, Homo sapiens
attgttaataataatta

SEQ ID NO: 5575992 - DNA, 19 bp, Homo sapiens
attgttaataataattatt

SEQ ID NO: 5575993 - DNA, 19 bp, Homo sapiens
attgttaatacaaggtata

SEQ ID NO: 5575994 - DNA, 23 bp, Homo sapiens
attgttaatacaaggtataataa

SEQ ID NO: 5575995 - DNA, 15 bp, Homo sapiens
attgttaatcaaaga

SEQ ID NO: 5575996 - DNA, 18 bp, Homo sapiens
attgttaatctctgttat

SEQ ID NO: 5575997 - DNA, 20 bp, Homo sapiens
attgttaatgcctataactt

SEQ ID NO: 5575998 - DNA, 15 bp, Homo sapiens
attgttaattatgta

SEQ ID NO: 5575999 - DNA, 17 bp, Homo sapiens
attgttaattatgtaca

SEQ ID NO: 5576000 - DNA, 19 bp, Homo sapiens
attgttaattgctgaggca

SEQ ID NO: 5576001 - DNA, 16 bp, Homo sapiens
attgttaatttcagtc

SEQ ID NO: 5576002 - DNA, 12 bp, Homo sapiens
attgttacaagt

SEQ ID NO: 5576003 - DNA, 20 bp, Homo sapiens
attgttacattatgtggaaa

SEQ ID NO: 5576004 - DNA, 23 bp, Homo sapiens
attgttacctgtcattttgcact

SEQ ID NO: 5576005 - DNA, 19 bp, Homo sapiens
attgttagcaaactatttc

SEQ ID NO: 5576006 - DNA, 21 bp, Homo sapiens
attgttaggaaatgtcatcaa

SEQ ID NO: 5576007 - DNA, 17 bp, Homo sapiens
attgttagggtcagcca

SEQ ID NO: 5576008 - DNA, 19 bp, Homo sapiens
attgttagggtcagccatt

SEQ ID NO: 5576009 - DNA, 19 bp, Homo sapiens
attgttagtaaacataggt

SEQ ID NO: 5576010 - DNA, 16 bp, Homo sapiens
attgttagtctcttga

SEQ ID NO: 5576011 - DNA, 16 bp, Homo sapiens
attgttataaaataac

SEQ ID NO: 5576012 - DNA, 20 bp, Homo sapiens
attgttataaataaaattgt

SEQ ID NO: 5576013 - DNA, 22 bp, Homo sapiens
attgttatatacatactatgaa

SEQ ID NO: 5576014 - DNA, 16 bp, Homo sapiens
attgttatattgtcct

SEQ ID NO: 5576015 - DNA, 12 bp, Homo sapiens
attgttatcaaa

SEQ ID NO: 5576016 - DNA, 20 bp, Homo sapiens
attgttatgtaaaactcgct

SEQ ID NO: 5576017 - DNA, 13 bp, Homo sapiens
attgttattaaat

SEQ ID NO: 5576018 - DNA, 20 bp, Homo sapiens
attgttatttaatagctgtg

SEQ ID NO: 5576019 - DNA, 16 bp, Homo sapiens
attgttatttctgtag

SEQ ID NO: 5576020 - DNA, 19 bp, Homo sapiens
attgttcaaacaatatcat

SEQ ID NO: 5576021 - DNA, 16 bp, Homo sapiens
attgttcagaaaagca

SEQ ID NO: 5576022 - DNA, 13 bp, Homo sapiens
attgttcagaaga

SEQ ID NO: 5576023 - DNA, 16 bp, Homo sapiens
attgttcatgttacca

SEQ ID NO: 5576024 - DNA, 18 bp, Homo sapiens
attgttccaaatgaatgt

SEQ ID NO: 5576025 - DNA, 14 bp, Homo sapiens
attgttccaagaca

SEQ ID NO: 5576026 - DNA, 15 bp, Homo sapiens
attgttccaagacat

SEQ ID NO: 5576027 - DNA, 21 bp, Homo sapiens
attgttccaagacattgtcaa

SEQ ID NO: 5576028 - DNA, 16 bp, Homo sapiens
attgttccagagacaa

SEQ ID NO: 5576029 - DNA, 22 bp, Homo sapiens
attgttcccgatggtctctctc

SEQ ID NO: 5576030 - DNA, 16 bp, Homo sapiens
attgttccctatgaaa

SEQ ID NO: 5576031 - DNA, 14 bp, Homo sapiens
attgttcccttcct

SEQ ID NO: 5576032 - DNA, 12 bp, Homo sapiens
attgttcctccc

SEQ ID NO: 5576033 - DNA, 14 bp, Homo sapiens
attgttctcagaat

SEQ ID NO: 5576034 - DNA, 17 bp, Homo sapiens
attgttctcttaaatat

SEQ ID NO: 5576035 - DNA, 19 bp, Homo sapiens
attgttcttagtttgcagt

SEQ ID NO: 5576036 - DNA, 18 bp, Homo sapiens
attgttcttattctggca

SEQ ID NO: 5576037 - DNA, 14 bp, Homo sapiens
attgttcttttcaa

SEQ ID NO: 5576038 - DNA, 16 bp, Homo sapiens
attgttcttttgtttc

SEQ ID NO: 5576039 - DNA, 14 bp, Homo sapiens
attgttgaataaat

SEQ ID NO: 5576040 - DNA, 18 bp, Homo sapiens
attgttgaataaatgtat

SEQ ID NO: 5576041 - DNA, 17 bp, Homo sapiens
attgttgacagttctga

SEQ ID NO: 5576042 - DNA, 13 bp, Homo sapiens
attgttgactaaa

SEQ ID NO: 5576043 - DNA, 22 bp, Homo sapiens
attgttgaggtggtctgaatgt

SEQ ID NO: 5576044 - DNA, 14 bp, Homo sapiens
attgttgattaatt

SEQ ID NO: 5576045 - DNA, 18 bp, Homo sapiens
attgttggcgctgaggtg

SEQ ID NO: 5576046 - DNA, 12 bp, Homo sapiens
attgttggctat

SEQ ID NO: 5576047 - DNA, 13 bp, Homo sapiens
attgttggctatt

SEQ ID NO: 5576048 - DNA, 16 bp, Homo sapiens
attgttggctatttga

SEQ ID NO: 5576049 - DNA, 13 bp, Homo sapiens
attgttgggaaag

SEQ ID NO: 5576050 - DNA, 14 bp, Homo sapiens
attgttgggaaagg

SEQ ID NO: 5576051 - DNA, 20 bp, Homo sapiens
attgttggtaattattttgg

SEQ ID NO: 5576052 - DNA, 21 bp, Homo sapiens
attgttggtgaattttcaagg

SEQ ID NO: 5576053 - DNA, 14 bp, Homo sapiens
attgttgtataatt

SEQ ID NO: 5576054 - DNA, 15 bp, Homo sapiens
attgttgtataattt

SEQ ID NO: 5576055 - DNA, 16 bp, Homo sapiens
attgttgtccttttca

SEQ ID NO: 5576056 - DNA, 13 bp, Homo sapiens
attgttgtgctta

SEQ ID NO: 5576057 - DNA, 18 bp, Homo sapiens
attgttgtggtttaaata

SEQ ID NO: 5576058 - DNA, 19 bp, Homo sapiens
attgttgtggtttaaatac

SEQ ID NO: 5576059 - DNA, 12 bp, Homo sapiens
attgttgtgtat

SEQ ID NO: 5576060 - DNA, 15 bp, Homo sapiens
attgttgtgtataat

SEQ ID NO: 5576061 - DNA, 19 bp, Homo sapiens
attgttgtttgccatactt

SEQ ID NO: 5576062 - DNA, 21 bp, Homo sapiens
attgtttaaaaacaggaaaaa

SEQ ID NO: 5576063 - DNA, 22 bp, Homo sapiens
attgtttaaaaaccgaataaat

SEQ ID NO: 5576064 - DNA, 14 bp, Homo sapiens
attgtttaaaagca

SEQ ID NO: 5576065 - DNA, 15 bp, Homo sapiens
attgtttaaaatcat

SEQ ID NO: 5576066 - DNA, 13 bp, Homo sapiens
attgtttaaaatt

SEQ ID NO: 5576067 - DNA, 19 bp, Homo sapiens
attgtttaaaattcagttt

SEQ ID NO: 5576068 - DNA, 12 bp, Homo sapiens
attgtttaaaga

SEQ ID NO: 5576069 - DNA, 15 bp, Homo sapiens
attgtttaatgcaaa

SEQ ID NO: 5576070 - DNA, 15 bp, Homo sapiens
attgtttaattgtag

SEQ ID NO: 5576071 - DNA, 21 bp, Homo sapiens
attgtttacaggatattccaa

SEQ ID NO: 5576072 - DNA, 20 bp, Homo sapiens
attgtttacgtttgatacaa

SEQ ID NO: 5576073 - DNA, 16 bp, Homo sapiens
attgtttagattttgt

SEQ ID NO: 5576074 - DNA, 16 bp, Homo sapiens
attgtttagtggaaaa

SEQ ID NO: 5576075 - DNA, 22 bp, Homo sapiens
attgtttatacacaactttgca

SEQ ID NO: 5576076 - DNA, 16 bp, Homo sapiens
attgtttatatggata

SEQ ID NO: 5576077 - DNA, 19 bp, Homo sapiens
attgtttatctagatgtaa

SEQ ID NO: 5576078 - DNA, 18 bp, Homo sapiens
attgtttatgccaaatgt

SEQ ID NO: 5576079 - DNA, 12 bp, Homo sapiens
attgtttatgta

SEQ ID NO: 5576080 - DNA, 21 bp, Homo sapiens
attgtttatttatcagtgaca

SEQ ID NO: 5576081 - DNA, 19 bp, Homo sapiens
attgtttatttttctatga

SEQ ID NO: 5576082 - DNA, 13 bp, Homo sapiens
attgtttcagaat

SEQ ID NO: 5576083 - DNA, 20 bp, Homo sapiens
atttaagttgtaaacgtctt

SEQ ID NO: 5576084 - DNA, 12 bp, Homo sapiens
atttaagtttgt

SEQ ID NO: 5576085 - DNA, 22 bp, Homo sapiens
atttaagtttgttgctgtcaag

SEQ ID NO: 5576086 - DNA, 16 bp, Homo sapiens
atttaataaaaaggaa

SEQ ID NO: 5576087 - DNA, 15 bp, Homo sapiens
atttaataaaactgc

SEQ ID NO: 5576088 - DNA, 22 bp, Homo sapiens
atttaataaaataattctaaag

SEQ ID NO: 5576089 - DNA, 11 bp, Homo sapiens
atttaataaag

SEQ ID NO: 5576090 - DNA, 19 bp, Homo sapiens
atttaataaagaaatattt

SEQ ID NO: 5576091 - DNA, 23 bp, Homo sapiens
atttaataaagaaatatttacct

SEQ ID NO: 5576092 - DNA, 17 bp, Homo sapiens
atttaataaagatgagt

SEQ ID NO: 5576093 - DNA, 12 bp, Homo sapiens
atttaataacat

SEQ ID NO: 5576094 - DNA, 13 bp, Homo sapiens
atttaataacata

SEQ ID NO: 5576095 - DNA, 19 bp, Homo sapiens
atttaataacattacctta

SEQ ID NO: 5576096 - DNA, 22 bp, Homo sapiens
atttaataactttgctggaaaa

SEQ ID NO: 5576097 - DNA, 16 bp, Homo sapiens
atttaataatatactt

SEQ ID NO: 5576098 - DNA, 18 bp, Homo sapiens
atttaataatatacttgt

SEQ ID NO: 5576099 - DNA, 22 bp, Homo sapiens
atttaataatgctttaaaataa

SEQ ID NO: 5576100 - DNA, 16 bp, Homo sapiens
atttaataatgtatgt

SEQ ID NO: 5576101 - DNA, 19 bp, Homo sapiens
atttaataatgtatgtaca

SEQ ID NO: 5576102 - DNA, 15 bp, Homo sapiens
atttaatacagataa

SEQ ID NO: 5576103 - DNA, 12 bp, Homo sapiens
atttaatacagc

SEQ ID NO: 5576104 - DNA, 19 bp, Homo sapiens
atttaataccagatacctt

SEQ ID NO: 5576105 - DNA, 15 bp, Homo sapiens
atttaatacctttgg

SEQ ID NO: 5576106 - DNA, 16 bp, Homo sapiens
atttaatagctgtgat

SEQ ID NO: 5576107 - DNA, 22 bp, Homo sapiens
atttaataggtttggacaaaat

SEQ ID NO: 5576108 - DNA, 17 bp, Homo sapiens
atttaatagtgttaatc

SEQ ID NO: 5576109 - DNA, 19 bp, Homo sapiens
atttaatagtgttaatcaa

SEQ ID NO: 5576110 - DNA, 20 bp, Homo sapiens
atttaatagtgttaatcaat

SEQ ID NO: 5576111 - DNA, 23 bp, Homo sapiens
atttaatagtgttaatcaattta

SEQ ID NO: 5576112 - DNA, 21 bp, Homo sapiens
atttaatatactgcatatcct

SEQ ID NO: 5576113 - DNA, 14 bp, Homo sapiens
atttaatatagcta

SEQ ID NO: 5576114 - DNA, 17 bp, Homo sapiens
atttaatatagctattt

SEQ ID NO: 5576115 - DNA, 14 bp, Homo sapiens
atttaatatatata

SEQ ID NO: 5576116 - DNA, 13 bp, Homo sapiens
atttaatatctga

SEQ ID NO: 5576117 - DNA, 22 bp, Homo sapiens
atttaatatctggcactgttaa

SEQ ID NO: 5576118 - DNA, 23 bp, Homo sapiens
atttaatatctggcactgttaat

SEQ ID NO: 5576119 - DNA, 15 bp, Homo sapiens
atttaatatgcaaag

SEQ ID NO: 5576120 - DNA, 15 bp, Homo sapiens
atttaatatgcatct

SEQ ID NO: 5576121 - DNA, 16 bp, Homo sapiens
atttaatatgcatctt

SEQ ID NO: 5576122 - DNA, 23 bp, Homo sapiens
atttaatatgcatctttgagaat

SEQ ID NO: 5576123 - DNA, 14 bp, Homo sapiens
atttaatattatat

SEQ ID NO: 5576124 - DNA, 16 bp, Homo sapiens
atttaatatttactct

SEQ ID NO: 5576125 - DNA, 17 bp, Homo sapiens
atttaatatttttcaaa

SEQ ID NO: 5576126 - DNA, 20 bp, Homo sapiens
atttaatatttttcaaaatc

SEQ ID NO: 5576127 - DNA, 14 bp, Homo sapiens
atttaatcaggagg

SEQ ID NO: 5576128 - DNA, 21 bp, Homo sapiens
atttaatcatttccagcaaaa

SEQ ID NO: 5576129 - DNA, 16 bp, Homo sapiens
atttaatccagatctg

SEQ ID NO: 5576130 - DNA, 23 bp, Homo sapiens
atttaatccagttataagaagaa

SEQ ID NO: 5576131 - DNA, 22 bp, Homo sapiens
atttaatccttctttgtaatac

SEQ ID NO: 5576132 - DNA, 22 bp, Homo sapiens
atttaatcttgaaggaacacaa

SEQ ID NO: 5576133 - DNA, 17 bp, Homo sapiens
atttaatcttttatgat

SEQ ID NO: 5576134 - DNA, 14 bp, Homo sapiens
atttaatgaaagac

SEQ ID NO: 5576135 - DNA, 16 bp, Homo sapiens
atttaatgaaagactg

SEQ ID NO: 5576136 - DNA, 12 bp, Homo sapiens
atttaatgactt

SEQ ID NO: 5576137 - DNA, 17 bp, Homo sapiens
atttaatgacttttgaa

SEQ ID NO: 5576138 - DNA, 18 bp, Homo sapiens
atttaatgatgattatgg

SEQ ID NO: 5576139 - DNA, 13 bp, Homo sapiens
atttaatgcatta

SEQ ID NO: 5576140 - DNA, 20 bp, Homo sapiens
atttaatggactgtgaattt

SEQ ID NO: 5576141 - DNA, 15 bp, Homo sapiens
atttaatggcagcta

SEQ ID NO: 5576142 - DNA, 19 bp, Homo sapiens
atttaatggccaaatggtt

SEQ ID NO: 5576143 - DNA, 15 bp, Homo sapiens
atttaatgtaaataa

SEQ ID NO: 5576144 - DNA, 14 bp, Homo sapiens
atttaatgtagaca

SEQ ID NO: 5576145 - DNA, 13 bp, Homo sapiens
atttaatgttaca

SEQ ID NO: 5576146 - DNA, 18 bp, Homo sapiens
atttaatgtttgtaagca

SEQ ID NO: 5576147 - DNA, 20 bp, Homo sapiens
atttaatgtttgtaagcaat

SEQ ID NO: 5576148 - DNA, 17 bp, Homo sapiens
atttaatgttttaaatg

SEQ ID NO: 5576149 - DNA, 13 bp, Homo sapiens
atttaatgttttc

SEQ ID NO: 5576150 - DNA, 14 bp, Homo sapiens
atttaatgttttca

SEQ ID NO: 5576151 - DNA, 18 bp, Homo sapiens
atttaatgtttttaatca

SEQ ID NO: 5576152 - DNA, 21 bp, Homo sapiens
atttaatgtttttaatcacat

SEQ ID NO: 5576153 - DNA, 14 bp, Homo sapiens
atttaattaaagca

SEQ ID NO: 5576154 - DNA, 15 bp, Homo sapiens
atttaattaaagcac

SEQ ID NO: 5576155 - DNA, 12 bp, Homo sapiens
atttaattacaa

SEQ ID NO: 5576156 - DNA, 22 bp, Homo sapiens
atttaattagtgctaagtgtga

SEQ ID NO: 5576157 - DNA, 14 bp, Homo sapiens
atttaattatatta

SEQ ID NO: 5576158 - DNA, 17 bp, Homo sapiens
atttaattcataattag

SEQ ID NO: 5576159 - DNA, 15 bp, Homo sapiens
atttaattcatgttt

SEQ ID NO: 5576160 - DNA, 18 bp, Homo sapiens
atttaattcctcttttta

SEQ ID NO: 5576161 - DNA, 12 bp, Homo sapiens
atttaattctta

SEQ ID NO: 5576162 - DNA, 17 bp, Homo sapiens
atttaattcttatttct

SEQ ID NO: 5576163 - DNA, 18 bp, Homo sapiens
atttaattcttatttctg

SEQ ID NO: 5576164 - DNA, 22 bp, Homo sapiens
atttaattctttctattttcac

SEQ ID NO: 5576165 - DNA, 23 bp, Homo sapiens
atttaattctttctattttcaca

SEQ ID NO: 5576166 - DNA, 13 bp, Homo sapiens
atttaattgaaac

SEQ ID NO: 5576167 - DNA, 18 bp, Homo sapiens
atttaattgtaaactgta

SEQ ID NO: 5576168 - DNA, 18 bp, Homo sapiens
atttaattgtgtaactgt

SEQ ID NO: 5576169 - DNA, 19 bp, Homo sapiens
atttaattgtgtaactgtt

SEQ ID NO: 5576170 - DNA, 13 bp, Homo sapiens
atttaatttagat

SEQ ID NO: 5576171 - DNA, 21 bp, Homo sapiens
atttaatttagatattttcca

SEQ ID NO: 5576172 - DNA, 22 bp, Homo sapiens
atttaatttagatattttccat

SEQ ID NO: 5576173 - DNA, 22 bp, Homo sapiens
atttaatttataggcagatctt

SEQ ID NO: 5576174 - DNA, 23 bp, Homo sapiens
atttaatttatgtgaaagagttc

SEQ ID NO: 5576175 - DNA, 12 bp, Homo sapiens
atttaatttcat

SEQ ID NO: 5576176 - DNA, 16 bp, Homo sapiens
atttaatttcataaat

SEQ ID NO: 5576177 - DNA, 20 bp, Homo sapiens
atttaatttcataaattggc

SEQ ID NO: 5576178 - DNA, 13 bp, Homo sapiens
atttaatttcatg

SEQ ID NO: 5576179 - DNA, 17 bp, Homo sapiens
atttaatttcatgtata

SEQ ID NO: 5576180 - DNA, 13 bp, Homo sapiens
atttaatttctat

SEQ ID NO: 5576181 - DNA, 22 bp, Homo sapiens
atttaatttctattgtgtttca

SEQ ID NO: 5576182 - DNA, 18 bp, Homo sapiens
atttaatttgaaatatgg

SEQ ID NO: 5576183 - DNA, 22 bp, Homo sapiens
atttaatttgatatcacagtct

SEQ ID NO: 5576184 - DNA, 22 bp, Homo sapiens
atttaatttgccaaaataatgt

SEQ ID NO: 5576185 - DNA, 18 bp, Homo sapiens
atttaatttgtaaaactt

SEQ ID NO: 5576186 - DNA, 22 bp, Homo sapiens
atttaattttcctggaaagact

SEQ ID NO: 5576187 - DNA, 22 bp, Homo sapiens
atttaattttgacactgaaata

SEQ ID NO: 5576188 - DNA, 19 bp, Homo sapiens
atttaatttttaaatgttt

SEQ ID NO: 5576189 - DNA, 15 bp, Homo sapiens
atttaatttttgcaa

SEQ ID NO: 5576190 - DNA, 20 bp, Homo sapiens
atttacaaaaatataaaata

SEQ ID NO: 5576191 - DNA, 16 bp, Homo sapiens
atttacaaaagattta

SEQ ID NO: 5576192 - DNA, 15 bp, Homo sapiens
atttacaaactgaag

SEQ ID NO: 5576193 - DNA, 16 bp, Homo sapiens
atttacaaagtgtgta

SEQ ID NO: 5576194 - DNA, 17 bp, Homo sapiens
atttacaaagtgtgtat

SEQ ID NO: 5576195 - DNA, 16 bp, Homo sapiens
atttacaaatgggaaa

SEQ ID NO: 5576196 - DNA, 20 bp, Homo sapiens
atttacaacactttaatggg

SEQ ID NO: 5576197 - DNA, 15 bp, Homo sapiens
atttacaactgaaac

SEQ ID NO: 5576198 - DNA, 22 bp, Homo sapiens
atttacaactgggggagggtga

SEQ ID NO: 5576199 - DNA, 18 bp, Homo sapiens
atttacaagactaacctt

SEQ ID NO: 5576200 - DNA, 17 bp, Homo sapiens
atttacaagatattatt

SEQ ID NO: 5576201 - DNA, 18 bp, Homo sapiens
atttacaagatattatta

SEQ ID NO: 5576202 - DNA, 22 bp, Homo sapiens
atttacaagatattattaattt

SEQ ID NO: 5576203 - DNA, 18 bp, Homo sapiens
atttacaataaatattct

SEQ ID NO: 5576204 - DNA, 19 bp, Homo sapiens
atttacaataaatattctg

SEQ ID NO: 5576205 - DNA, 15 bp, Homo sapiens
atttacaatatatga

SEQ ID NO: 5576206 - DNA, 17 bp, Homo sapiens
atttacaatgtgtatca

SEQ ID NO: 5576207 - DNA, 13 bp, Homo sapiens
atttacaatttca

SEQ ID NO: 5576208 - DNA, 20 bp, Homo sapiens
atttacacaggtttagttga

SEQ ID NO: 5576209 - DNA, 19 bp, Homo sapiens
atttacacagtgagactgt

SEQ ID NO: 5576210 - DNA, 22 bp, Homo sapiens
atttacacagtgagactgtaca

SEQ ID NO: 5576211 - DNA, 20 bp, Homo sapiens
atttacacatcttaaaagtg

SEQ ID NO: 5576212 - DNA, 13 bp, Homo sapiens
atttacacattct

SEQ ID NO: 5576213 - DNA, 13 bp, Homo sapiens
atttacaccacac

SEQ ID NO: 5576214 - DNA, 16 bp, Homo sapiens
atttacaccacacttt

SEQ ID NO: 5576215 - DNA, 21 bp, Homo sapiens
atttacactatgataaagttg

SEQ ID NO: 5576216 - DNA, 21 bp, Homo sapiens
atttacactcgaactcgggag

SEQ ID NO: 5576217 - DNA, 14 bp, Homo sapiens
atttacactgccat

SEQ ID NO: 5576218 - DNA, 12 bp, Homo sapiens
atttacactttt

SEQ ID NO: 5576219 - DNA, 16 bp, Homo sapiens
atttacagagaagtga

SEQ ID NO: 5576220 - DNA, 19 bp, Homo sapiens
atttacagatgaatgtatt

SEQ ID NO: 5576221 - DNA, 23 bp, Homo sapiens
atttacagccagtgggagatgtt

SEQ ID NO: 5576222 - DNA, 16 bp, Homo sapiens
atttacaggaacttca

SEQ ID NO: 5576223 - DNA, 15 bp, Homo sapiens
atttacaggacttct

SEQ ID NO: 5576224 - DNA, 18 bp, Homo sapiens
atttacaggacttctctt

SEQ ID NO: 5576225 - DNA, 13 bp, Homo sapiens
atttacaggaggg

SEQ ID NO: 5576226 - DNA, 17 bp, Homo sapiens
atttacaggttcttagg

SEQ ID NO: 5576227 - DNA, 17 bp, Homo sapiens
atttacagtctctttct

SEQ ID NO: 5576228 - DNA, 19 bp, Homo sapiens
atttacagtctctttcttc

SEQ ID NO: 5576229 - DNA, 22 bp, Homo sapiens
atttacagtctctttcttcctt

SEQ ID NO: 5576230 - DNA, 23 bp, Homo sapiens
atttacagtgaaaatgtaagctg

SEQ ID NO: 5576231 - DNA, 17 bp, Homo sapiens
atttacagttactgcct

SEQ ID NO: 5576232 - DNA, 24 bp, Homo sapiens
atttacagtttcaaaaactgtatt

SEQ ID NO: 5576233 - DNA, 17 bp, Homo sapiens
atttacataaagactgt

SEQ ID NO: 5576234 - DNA, 18 bp, Homo sapiens
atttacatagtcatttag

SEQ ID NO: 5576235 - DNA, 21 bp, Homo sapiens
atttacatagtgcaaaactgt

SEQ ID NO: 5576236 - DNA, 14 bp, Homo sapiens
atttacatcagaag

SEQ ID NO: 5576237 - DNA, 19 bp, Homo sapiens
atttacatcagaagtttgc

SEQ ID NO: 5576238 - DNA, 16 bp, Homo sapiens
atttacatcatttctt

SEQ ID NO: 5576239 - DNA, 18 bp, Homo sapiens
atttacatgaattgcatt

SEQ ID NO: 5576240 - DNA, 18 bp, Homo sapiens
atttacatgctactaaat

SEQ ID NO: 5576241 - DNA, 20 bp, Homo sapiens
atttacatgctactaaattt

SEQ ID NO: 5576242 - DNA, 19 bp, Homo sapiens
atttacatgttttaaagaa

SEQ ID NO: 5576243 - DNA, 15 bp, Homo sapiens
atttacattctagtt

SEQ ID NO: 5576244 - DNA, 19 bp, Homo sapiens
atttacattctagttcaga

SEQ ID NO: 5576245 - DNA, 11 bp, Homo sapiens
atttacattta

SEQ ID NO: 5576246 - DNA, 20 bp, Homo sapiens
atttacatttaatacagata

SEQ ID NO: 5576247 - DNA, 13 bp, Homo sapiens
atttacatttatc

SEQ ID NO: 5576248 - DNA, 18 bp, Homo sapiens
atttacatttatctatta

SEQ ID NO: 5576249 - DNA, 16 bp, Homo sapiens
atttaccaaattgctt

SEQ ID NO: 5576250 - DNA, 17 bp, Homo sapiens
atttaccaacatgtatc

SEQ ID NO: 5576251 - DNA, 18 bp, Homo sapiens
atttaccaaggatgaatt

SEQ ID NO: 5576252 - DNA, 18 bp, Homo sapiens
atttaccacaaaagcaaa

SEQ ID NO: 5576253 - DNA, 22 bp, Homo sapiens
atttaccacaaaagcaaaattt

SEQ ID NO: 5576254 - DNA, 17 bp, Homo sapiens
atttaccacagcagctg

SEQ ID NO: 5576255 - DNA, 14 bp, Homo sapiens
atttaccacaggat

SEQ ID NO: 5576256 - DNA, 17 bp, Homo sapiens
atttaccacaggatgca

SEQ ID NO: 5576257 - DNA, 20 bp, Homo sapiens
atttaccacaggatgcatat

SEQ ID NO: 5576258 - DNA, 22 bp, Homo sapiens
atttaccacaggatgcatatta

SEQ ID NO: 5576259 - DNA, 14 bp, Homo sapiens
atttaccagaaata

SEQ ID NO: 5576260 - DNA, 15 bp, Homo sapiens
atttagtcaacatat

SEQ ID NO: 5576261 - DNA, 18 bp, Homo sapiens
atttagtccaatgaagat

SEQ ID NO: 5576262 - DNA, 17 bp, Homo sapiens
atttagtcccttaaaaa

SEQ ID NO: 5576263 - DNA, 12 bp, Homo sapiens
atttagtcctgt

SEQ ID NO: 5576264 - DNA, 17 bp, Homo sapiens
atttagtctaacacagt

SEQ ID NO: 5576265 - DNA, 18 bp, Homo sapiens
atttagtctaagatgatt

SEQ ID NO: 5576266 - DNA, 16 bp, Homo sapiens
atttagtctctttatt

SEQ ID NO: 5576267 - DNA, 13 bp, Homo sapiens
atttagtgagcat

SEQ ID NO: 5576268 - DNA, 15 bp, Homo sapiens
atttagtgcctattt

SEQ ID NO: 5576269 - DNA, 19 bp, Homo sapiens
atttagtgctaaacaagta

SEQ ID NO: 5576270 - DNA, 13 bp, Homo sapiens
atttagtgctctt

SEQ ID NO: 5576271 - DNA, 15 bp, Homo sapiens
atttagtgctcttaa

SEQ ID NO: 5576272 - DNA, 24 bp, Homo sapiens
atttagtggtggtagaaatgattc

SEQ ID NO: 5576273 - DNA, 13 bp, Homo sapiens
atttagtgtgaat

SEQ ID NO: 5576274 - DNA, 15 bp, Homo sapiens
atttagtgtgaatat

SEQ ID NO: 5576275 - DNA, 13 bp, Homo sapiens
atttagttatagt

SEQ ID NO: 5576276 - DNA, 16 bp, Homo sapiens
atttagttctttgtta

SEQ ID NO: 5576277 - DNA, 23 bp, Homo sapiens
atttagttgcagtccagctcttt

SEQ ID NO: 5576278 - DNA, 19 bp, Homo sapiens
atttagttgtggaaagata

SEQ ID NO: 5576279 - DNA, 20 bp, Homo sapiens
atttagtttcagtagattgc

SEQ ID NO: 5576280 - DNA, 23 bp, Homo sapiens
atttagtttcagtagattgcaga

SEQ ID NO: 5576281 - DNA, 15 bp, Homo sapiens
atttagtttgattat

SEQ ID NO: 5576282 - DNA, 18 bp, Homo sapiens
atttagtttgtactcagt

SEQ ID NO: 5576283 - DNA, 16 bp, Homo sapiens
atttagttttgtaact

SEQ ID NO: 5576284 - DNA, 14 bp, Homo sapiens
atttagtttttaac

SEQ ID NO: 5576285 - DNA, 19 bp, Homo sapiens
atttagtttttgtaattta

SEQ ID NO: 5576286 - DNA, 21 bp, Homo sapiens
atttataaaaagatgatcgct

SEQ ID NO: 5576287 - DNA, 16 bp, Homo sapiens
atttataaaaatataa

SEQ ID NO: 5576288 - DNA, 15 bp, Homo sapiens
atttataaaacttct

SEQ ID NO: 5576289 - DNA, 17 bp, Homo sapiens
atttataaacagacaat

SEQ ID NO: 5576290 - DNA, 21 bp, Homo sapiens
atttataaacagacaatatgt

SEQ ID NO: 5576291 - DNA, 12 bp, Homo sapiens
atttataaacta

SEQ ID NO: 5576292 - DNA, 18 bp, Homo sapiens
atttataaactagatctc

SEQ ID NO: 5576293 - DNA, 13 bp, Homo sapiens
atttataaagcaa

SEQ ID NO: 5576294 - DNA, 14 bp, Homo sapiens
atttataaagcaaa

SEQ ID NO: 5576295 - DNA, 14 bp, Homo sapiens
atttataaatatat

SEQ ID NO: 5576296 - DNA, 14 bp, Homo sapiens
atttataaatgaag

SEQ ID NO: 5576297 - DNA, 17 bp, Homo sapiens
atttataaatgagcaaa

SEQ ID NO: 5576298 - DNA, 15 bp, Homo sapiens
atttataaatgcact

SEQ ID NO: 5576299 - DNA, 20 bp, Homo sapiens
atttataaatgcactgtaat

SEQ ID NO: 5576300 - DNA, 15 bp, Homo sapiens
atttataaatgctat

SEQ ID NO: 5576301 - DNA, 14 bp, Homo sapiens
atttataacaaata

SEQ ID NO: 5576302 - DNA, 22 bp, Homo sapiens
atttataacagttataaagaaa

SEQ ID NO: 5576303 - DNA, 17 bp, Homo sapiens
atttataacattgtaaa

SEQ ID NO: 5576304 - DNA, 18 bp, Homo sapiens
atttataactaatatggt

SEQ ID NO: 5576305 - DNA, 16 bp, Homo sapiens
atttataactcatcat

SEQ ID NO: 5576306 - DNA, 23 bp, Homo sapiens
atttataactcatcataaaataa

SEQ ID NO: 5576307 - DNA, 19 bp, Homo sapiens
atttataagaaaaatgtga

SEQ ID NO: 5576308 - DNA, 17 bp, Homo sapiens
atttataagcagattta

SEQ ID NO: 5576309 - DNA, 22 bp, Homo sapiens
atttataagcagatttaacaat

SEQ ID NO: 5576310 - DNA, 17 bp, Homo sapiens
atttataagcattgcca

SEQ ID NO: 5576311 - DNA, 23 bp, Homo sapiens
atttataagcattgccattgaag

SEQ ID NO: 5576312 - DNA, 15 bp, Homo sapiens
atttataagccaaag

SEQ ID NO: 5576313 - DNA, 21 bp, Homo sapiens
atttataaggacagagatttg

SEQ ID NO: 5576314 - DNA, 22 bp, Homo sapiens
atttataagtgactttaaactt

SEQ ID NO: 5576315 - DNA, 17 bp, Homo sapiens
atttataatacagaatc

SEQ ID NO: 5576316 - DNA, 15 bp, Homo sapiens
atttataatactgtt

SEQ ID NO: 5576317 - DNA, 16 bp, Homo sapiens
atttataatactgttt

SEQ ID NO: 5576318 - DNA, 17 bp, Homo sapiens
atttataatactgtttt

SEQ ID NO: 5576319 - DNA, 18 bp, Homo sapiens
atttataatactgtttta

SEQ ID NO: 5576320 - DNA, 20 bp, Homo sapiens
atttataatactgttttaaa

SEQ ID NO: 5576321 - DNA, 18 bp, Homo sapiens
atttataatataaatata

SEQ ID NO: 5576322 - DNA, 13 bp, Homo sapiens
atttataattaaa

SEQ ID NO: 5576323 - DNA, 22 bp, Homo sapiens
atttataattaaagaaaattgc

SEQ ID NO: 5576324 - DNA, 17 bp, Homo sapiens
atttataattgcatcta

SEQ ID NO: 5576325 - DNA, 17 bp, Homo sapiens
atttataatttaaatga

SEQ ID NO: 5576326 - DNA, 18 bp, Homo sapiens
atttataatttaaatgat

SEQ ID NO: 5576327 - DNA, 19 bp, Homo sapiens
atttataatttaaatgata

SEQ ID NO: 5576328 - DNA, 16 bp, Homo sapiens
atttatacaaaataat

SEQ ID NO: 5576329 - DNA, 21 bp, Homo sapiens
atttatacaaaataatttaac

SEQ ID NO: 5576330 - DNA, 15 bp, Homo sapiens
atttatacaaagaaa

SEQ ID NO: 5576331 - DNA, 18 bp, Homo sapiens
atttatacaaagaaactt

SEQ ID NO: 5576332 - DNA, 20 bp, Homo sapiens
atttatacaaagaaactttt

SEQ ID NO: 5576333 - DNA, 13 bp, Homo sapiens
atttatacaagat

SEQ ID NO: 5576334 - DNA, 15 bp, Homo sapiens
atttatacaagattg

SEQ ID NO: 5576335 - DNA, 22 bp, Homo sapiens
atttatacaagattgaaaatct

SEQ ID NO: 5576336 - DNA, 21 bp, Homo sapiens
atttatacaccagcaatttag

SEQ ID NO: 5576337 - DNA, 22 bp, Homo sapiens
atttatacaccagcaatttaga

SEQ ID NO: 5576338 - DNA, 19 bp, Homo sapiens
atttatacagtgccttgct

SEQ ID NO: 5576339 - DNA, 15 bp, Homo sapiens
atttatacagttgaa

SEQ ID NO: 5576340 - DNA, 18 bp, Homo sapiens
atttatacatacagagat

SEQ ID NO: 5576341 - DNA, 19 bp, Homo sapiens
atttatacccccaggaaac

SEQ ID NO: 5576342 - DNA, 23 bp, Homo sapiens
atttatacctcaattttcactgt

SEQ ID NO: 5576343 - DNA, 13 bp, Homo sapiens
atttatacctttg

SEQ ID NO: 5576344 - DNA, 16 bp, Homo sapiens
atttatactggcatgc

SEQ ID NO: 5576345 - DNA, 18 bp, Homo sapiens
atttatacttaaaaaatc

SEQ ID NO: 5576346 - DNA, 23 bp, Homo sapiens
atttatagaacagttgatttccc

SEQ ID NO: 5576347 - DNA, 16 bp, Homo sapiens
atttatagaagaaatg

SEQ ID NO: 5576348 - DNA, 17 bp, Homo sapiens
atttatagaatttaata

SEQ ID NO: 5576349 - DNA, 15 bp, Homo sapiens
atttatagagttcat

SEQ ID NO: 5576350 - DNA, 23 bp, Homo sapiens
atttatagcaaagttatcttaaa

SEQ ID NO: 5576351 - DNA, 19 bp, Homo sapiens
atttatagcaagatattga

SEQ ID NO: 5576352 - DNA, 21 bp, Homo sapiens
atttatagcaagatattgatc

SEQ ID NO: 5576353 - DNA, 20 bp, Homo sapiens
atttataggcagatctttaa

SEQ ID NO: 5576354 - DNA, 14 bp, Homo sapiens
atttataggccagg

SEQ ID NO: 5576355 - DNA, 22 bp, Homo sapiens
atttataggcgttttttgggga

SEQ ID NO: 5576356 - DNA, 16 bp, Homo sapiens
atttatagtaaccatt

SEQ ID NO: 5576357 - DNA, 18 bp, Homo sapiens
atttatagtatgtgactt

SEQ ID NO: 5576358 - DNA, 16 bp, Homo sapiens
atttatagtttataca

SEQ ID NO: 5576359 - DNA, 17 bp, Homo sapiens
atttatagtttatacag

SEQ ID NO: 5576360 - DNA, 12 bp, Homo sapiens
atttatagtttg

SEQ ID NO: 5576361 - DNA, 22 bp, Homo sapiens
atttatagtttgtacatgcatt

SEQ ID NO: 5576362 - DNA, 20 bp, Homo sapiens
atttatataaaacttaaaaa

SEQ ID NO: 5576363 - DNA, 13 bp, Homo sapiens
atttatataaagt

SEQ ID NO: 5576364 - DNA, 16 bp, Homo sapiens
atttatataaagtatt

SEQ ID NO: 5576365 - DNA, 18 bp, Homo sapiens
atttatataaatgtaaaa

SEQ ID NO: 5576366 - DNA, 15 bp, Homo sapiens
atttatataaatttt

SEQ ID NO: 5576367 - DNA, 15 bp, Homo sapiens
atttatataattatg

SEQ ID NO: 5576368 - DNA, 18 bp, Homo sapiens
atttatataattatgtta

SEQ ID NO: 5576369 - DNA, 17 bp, Homo sapiens
atttatatactttttca

SEQ ID NO: 5576370 - DNA, 16 bp, Homo sapiens
atttatatatatatgt

SEQ ID NO: 5576371 - DNA, 20 bp, Homo sapiens
atttatatatatatgtatat

SEQ ID NO: 5576372 - DNA, 22 bp, Homo sapiens
atttatatatcatagtataaat

SEQ ID NO: 5576373 - DNA, 23 bp, Homo sapiens
atttatatatctaagttcacagt

SEQ ID NO: 5576374 - DNA, 19 bp, Homo sapiens
atttatatatgaaaactat

SEQ ID NO: 5576375 - DNA, 20 bp, Homo sapiens
atttatatatgaaaactata

SEQ ID NO: 5576376 - DNA, 22 bp, Homo sapiens
atttatatatgaaaactataca

SEQ ID NO: 5576377 - DNA, 20 bp, Homo sapiens
atttatatatggcatattta

SEQ ID NO: 5576378 - DNA, 14 bp, Homo sapiens
atttatatatgtat

SEQ ID NO: 5576379 - DNA, 22 bp, Homo sapiens
atttatatcacacaatatagtt

SEQ ID NO: 5576380 - DNA, 16 bp, Homo sapiens
atttatatctatagta

SEQ ID NO: 5576381 - DNA, 14 bp, Homo sapiens
atttatatctgctt

SEQ ID NO: 5576382 - DNA, 20 bp, Homo sapiens
atttatatcttatatataat

SEQ ID NO: 5576383 - DNA, 23 bp, Homo sapiens
atttatatcttatatataataat

SEQ ID NO: 5576384 - DNA, 17 bp, Homo sapiens
atttatatcttgttatt

SEQ ID NO: 5576385 - DNA, 18 bp, Homo sapiens
atttatatcttgttatta

SEQ ID NO: 5576386 - DNA, 14 bp, Homo sapiens
atttatatctttat

SEQ ID NO: 5576387 - DNA, 17 bp, Homo sapiens
atttatatctttatgca

SEQ ID NO: 5576388 - DNA, 21 bp, Homo sapiens
atttatatctttatgcaaaaa

SEQ ID NO: 5576389 - DNA, 21 bp, Homo sapiens
atttatatgaagcaagctgtg

SEQ ID NO: 5576390 - DNA, 19 bp, Homo sapiens
atttatatggggaatatat

SEQ ID NO: 5576391 - DNA, 17 bp, Homo sapiens
atttatatgtacatgag

SEQ ID NO: 5576392 - DNA, 16 bp, Homo sapiens
atttatatgtactgtt

SEQ ID NO: 5576393 - DNA, 19 bp, Homo sapiens
atttatatgttattaaaca

SEQ ID NO: 5576394 - DNA, 14 bp, Homo sapiens
atttatattagagt

SEQ ID NO: 5576395 - DNA, 20 bp, Homo sapiens
atttatattagagtgccctt

SEQ ID NO: 5576396 - DNA, 15 bp, Homo sapiens
atttatattcattca

SEQ ID NO: 5576397 - DNA, 19 bp, Homo sapiens
atttatattccatttacat

SEQ ID NO: 5576398 - DNA, 23 bp, Homo sapiens
atttatattccgtatttaaagtt

SEQ ID NO: 5576399 - DNA, 21 bp, Homo sapiens
atttatattgataagatcttt

SEQ ID NO: 5576400 - DNA, 15 bp, Homo sapiens
atttatattgtaaat

SEQ ID NO: 5576401 - DNA, 18 bp, Homo sapiens
atttatattgtaaatatt

SEQ ID NO: 5576402 - DNA, 17 bp, Homo sapiens
atttatattgtatattc

SEQ ID NO: 5576403 - DNA, 19 bp, Homo sapiens
atttatattgtatattctg

SEQ ID NO: 5576404 - DNA, 20 bp, Homo sapiens
atttatattgtatattctgg

SEQ ID NO: 5576405 - DNA, 16 bp, Homo sapiens
atttatatttaaatta

SEQ ID NO: 5576406 - DNA, 16 bp, Homo sapiens
atttatatttattgac

SEQ ID NO: 5576407 - DNA, 20 bp, Homo sapiens
atttatatttattgactctt

SEQ ID NO: 5576408 - DNA, 15 bp, Homo sapiens
atttatatttggaaa

SEQ ID NO: 5576409 - DNA, 19 bp, Homo sapiens
atttatatttgtctcattt

SEQ ID NO: 5576410 - DNA, 13 bp, Homo sapiens
atttatatttttg

SEQ ID NO: 5576411 - DNA, 18 bp, Homo sapiens
atttatcaaaatgtagct

SEQ ID NO: 5576412 - DNA, 21 bp, Homo sapiens
atttatcaaaccctagccttg

SEQ ID NO: 5576413 - DNA, 20 bp, Homo sapiens
atttatcaaagcatagatgt

SEQ ID NO: 5576414 - DNA, 17 bp, Homo sapiens
atttatcaactgtcaaa

SEQ ID NO: 5576415 - DNA, 14 bp, Homo sapiens
atttatcaatattt

SEQ ID NO: 5576416 - DNA, 17 bp, Homo sapiens
atttatcaatcagtata

SEQ ID NO: 5576417 - DNA, 18 bp, Homo sapiens
atttatcaatcagtataa

SEQ ID NO: 5576418 - DNA, 19 bp, Homo sapiens
atttatcaatttttcccag

SEQ ID NO: 5576419 - DNA, 14 bp, Homo sapiens
atttatcacacaaa

SEQ ID NO: 5576420 - DNA, 17 bp, Homo sapiens
atttatcatatttaata

SEQ ID NO: 5576421 - DNA, 22 bp, Homo sapiens
atttatcatggtcctgaatgta

SEQ ID NO: 5576422 - DNA, 13 bp, Homo sapiens
atttatcattctt

SEQ ID NO: 5576423 - DNA, 14 bp, Homo sapiens
atttatcattttag

SEQ ID NO: 5576424 - DNA, 17 bp, Homo sapiens
atttatccaaaatgtgt

SEQ ID NO: 5576425 - DNA, 19 bp, Homo sapiens
atttatccaaagcattgca

SEQ ID NO: 5576426 - DNA, 21 bp, Homo sapiens
atttatccacaggaaagtgtt

SEQ ID NO: 5576427 - DNA, 18 bp, Homo sapiens
atttatccctcattcatc

SEQ ID NO: 5576428 - DNA, 14 bp, Homo sapiens
atttatccctttcc

SEQ ID NO: 5576429 - DNA, 15 bp, Homo sapiens
atttatccctttcct

SEQ ID NO: 5576430 - DNA, 17 bp, Homo sapiens
atttatccctttcctgg

SEQ ID NO: 5576431 - DNA, 20 bp, Homo sapiens
atttatcctagaaaattgtt

SEQ ID NO: 5576432 - DNA, 16 bp, Homo sapiens
atttatcctagtattc

SEQ ID NO: 5576433 - DNA, 21 bp, Homo sapiens
atttatcctataagatgacaa

SEQ ID NO: 5576434 - DNA, 18 bp, Homo sapiens
atttatcctcacataaaa

SEQ ID NO: 5576435 - DNA, 16 bp, Homo sapiens
atttatccttgttaag

SEQ ID NO: 5576436 - DNA, 16 bp, Homo sapiens
atttatcgcaacatga

SEQ ID NO: 5576437 - DNA, 14 bp, Homo sapiens
atttcactgtctgt

SEQ ID NO: 5576438 - DNA, 15 bp, Homo sapiens
atttcactgtctttt

SEQ ID NO: 5576439 - DNA, 21 bp, Homo sapiens
atttcactgtcttttaaaaaa

SEQ ID NO: 5576440 - DNA, 12 bp, Homo sapiens
atttcacttaat

SEQ ID NO: 5576441 - DNA, 18 bp, Homo sapiens
atttcacttaataatttt

SEQ ID NO: 5576442 - DNA, 15 bp, Homo sapiens
atttcacttgaaatt

SEQ ID NO: 5576443 - DNA, 15 bp, Homo sapiens
atttcacttgagtgg

SEQ ID NO: 5576444 - DNA, 12 bp, Homo sapiens
atttcacttgat

SEQ ID NO: 5576445 - DNA, 16 bp, Homo sapiens
atttcactttaaagtc

SEQ ID NO: 5576446 - DNA, 19 bp, Homo sapiens
atttcagaaaatgaaaaat

SEQ ID NO: 5576447 - DNA, 14 bp, Homo sapiens
atttcagaaacatc

SEQ ID NO: 5576448 - DNA, 13 bp, Homo sapiens
atttcagaaatac

SEQ ID NO: 5576449 - DNA, 15 bp, Homo sapiens
atttcagaagagact

SEQ ID NO: 5576450 - DNA, 14 bp, Homo sapiens
atttcagaaggaga

SEQ ID NO: 5576451 - DNA, 19 bp, Homo sapiens
atttcagaaggagaaggaa

SEQ ID NO: 5576452 - DNA, 21 bp, Homo sapiens
atttcagaaggagaaggctgg

SEQ ID NO: 5576453 - DNA, 21 bp, Homo sapiens
atttcagaagttagtttgtat

SEQ ID NO: 5576454 - DNA, 13 bp, Homo sapiens
atttcagaagttt

SEQ ID NO: 5576455 - DNA, 16 bp, Homo sapiens
atttcagacctagcag

SEQ ID NO: 5576456 - DNA, 12 bp, Homo sapiens
atttcagactcc

SEQ ID NO: 5576457 - DNA, 20 bp, Homo sapiens
atttcagactgcagagggga

SEQ ID NO: 5576458 - DNA, 16 bp, Homo sapiens
atttcagagaggcctt

SEQ ID NO: 5576459 - DNA, 21 bp, Homo sapiens
atttcagatgattcaaatatc

SEQ ID NO: 5576460 - DNA, 15 bp, Homo sapiens
atttcagatgtaatg

SEQ ID NO: 5576461 - DNA, 16 bp, Homo sapiens
atttcagatgtaatgt

SEQ ID NO: 5576462 - DNA, 18 bp, Homo sapiens
atttcagatgtaatgttt

SEQ ID NO: 5576463 - DNA, 19 bp, Homo sapiens
atttcagatgtaatgtttt

SEQ ID NO: 5576464 - DNA, 20 bp, Homo sapiens
atttcagatgtaatgttttc

SEQ ID NO: 5576465 - DNA, 15 bp, Homo sapiens
atttcagattttaaa

SEQ ID NO: 5576466 - DNA, 17 bp, Homo sapiens
atttcagattttgataa

SEQ ID NO: 5576467 - DNA, 22 bp, Homo sapiens
atttcagattttgataactgtt

SEQ ID NO: 5576468 - DNA, 12 bp, Homo sapiens
atttcagccaaa

SEQ ID NO: 5576469 - DNA, 19 bp, Homo sapiens
atttcagccaatctggaca

SEQ ID NO: 5576470 - DNA, 11 bp, Homo sapiens
atttcagccat

SEQ ID NO: 5576471 - DNA, 20 bp, Homo sapiens
atttcagctagttaataatt

SEQ ID NO: 5576472 - DNA, 18 bp, Homo sapiens
atttcagcttgaacctgc

SEQ ID NO: 5576473 - DNA, 20 bp, Homo sapiens
atttcaggaaaatgtattga

SEQ ID NO: 5576474 - DNA, 14 bp, Homo sapiens
atttcaggaattta

SEQ ID NO: 5576475 - DNA, 18 bp, Homo sapiens
atttcaggaatttaaaat

SEQ ID NO: 5576476 - DNA, 19 bp, Homo sapiens
atttcaggactctctccag

SEQ ID NO: 5576477 - DNA, 15 bp, Homo sapiens
atttcaggagcagcc

SEQ ID NO: 5576478 - DNA, 20 bp, Homo sapiens
atttcaggaggaatactgaa

SEQ ID NO: 5576479 - DNA, 15 bp, Homo sapiens
atttcaggagggatt

SEQ ID NO: 5576480 - DNA, 19 bp, Homo sapiens
atttcaggcagcaggggct

SEQ ID NO: 5576481 - DNA, 19 bp, Homo sapiens
atttcaggcattggatatt

SEQ ID NO: 5576482 - DNA, 14 bp, Homo sapiens
atttcaggccctca

SEQ ID NO: 5576483 - DNA, 15 bp, Homo sapiens
atttcaggccctcag

SEQ ID NO: 5576484 - DNA, 18 bp, Homo sapiens
atttcaggccctcagctg

SEQ ID NO: 5576485 - DNA, 17 bp, Homo sapiens
atttcaggctccccaga

SEQ ID NO: 5576486 - DNA, 18 bp, Homo sapiens
atttcagggacctcaggg

SEQ ID NO: 5576487 - DNA, 15 bp, Homo sapiens
atttcagggagaaac

SEQ ID NO: 5576488 - DNA, 21 bp, Homo sapiens
atttcagggagaaactccaaa

SEQ ID NO: 5576489 - DNA, 19 bp, Homo sapiens
atttcaggggtcgtcacca

SEQ ID NO: 5576490 - DNA, 21 bp, Homo sapiens
atttcaggttttgtaaagatg

SEQ ID NO: 5576491 - DNA, 19 bp, Homo sapiens
atttcagtaagctgtgtgg

SEQ ID NO: 5576492 - DNA, 16 bp, Homo sapiens
atttcagtaatgtctt

SEQ ID NO: 5576493 - DNA, 17 bp, Homo sapiens
atttcagtacttcagca

SEQ ID NO: 5576494 - DNA, 19 bp, Homo sapiens
atttcagtacttcagcaag

SEQ ID NO: 5576495 - DNA, 22 bp, Homo sapiens
atttcagtacttcagcaagaga

SEQ ID NO: 5576496 - DNA, 14 bp, Homo sapiens
atttcagtagaatt

SEQ ID NO: 5576497 - DNA, 15 bp, Homo sapiens
atttcagtagtttct

SEQ ID NO: 5576498 - DNA, 17 bp, Homo sapiens
atttcagtatcatctcc

SEQ ID NO: 5576499 - DNA, 17 bp, Homo sapiens
atttcagtattttccag

SEQ ID NO: 5576500 - DNA, 18 bp, Homo sapiens
atttcagtcaattctgat

SEQ ID NO: 5576501 - DNA, 20 bp, Homo sapiens
atttcagtcaattctgatgt

SEQ ID NO: 5576502 - DNA, 19 bp, Homo sapiens
atttcagtcttttcctgtt

SEQ ID NO: 5576503 - DNA, 20 bp, Homo sapiens
atttcagtgataatgttcat

SEQ ID NO: 5576504 - DNA, 22 bp, Homo sapiens
atttcagtgataatgttcattt

SEQ ID NO: 5576505 - DNA, 17 bp, Homo sapiens
atttcagtgcagtaatt

SEQ ID NO: 5576506 - DNA, 15 bp, Homo sapiens
atttcagtggaatag

SEQ ID NO: 5576507 - DNA, 21 bp, Homo sapiens
atttcagtggaatagatgtct

SEQ ID NO: 5576508 - DNA, 14 bp, Homo sapiens
atttcagtggcttc

SEQ ID NO: 5576509 - DNA, 17 bp, Homo sapiens
atttcagtgtaaagtgt

SEQ ID NO: 5576510 - DNA, 17 bp, Homo sapiens
atttcagtgtattgttt

SEQ ID NO: 5576511 - DNA, 18 bp, Homo sapiens
atttcagtgttttcattt

SEQ ID NO: 5576512 - DNA, 16 bp, Homo sapiens
atttcagttacttacc

SEQ ID NO: 5576513 - DNA, 21 bp, Homo sapiens
atttcagttattgtccctggc

SEQ ID NO: 5576514 - DNA, 21 bp, Homo sapiens
atttcagtttttcatttgttt

SEQ ID NO: 5576515 - DNA, 11 bp, Homo sapiens
atttcataaat

SEQ ID NO: 5576516 - DNA, 14 bp, Homo sapiens
atttcataaattaa

SEQ ID NO: 5576517 - DNA, 21 bp, Homo sapiens
atttcataaattaacaaagtg

SEQ ID NO: 5576518 - DNA, 22 bp, Homo sapiens
atttcataaattggctcctttc

SEQ ID NO: 5576519 - DNA, 14 bp, Homo sapiens
atttcataagcaca

SEQ ID NO: 5576520 - DNA, 19 bp, Homo sapiens
atttcataagcacatccaa

SEQ ID NO: 5576521 - DNA, 15 bp, Homo sapiens
atttcataattcaga

SEQ ID NO: 5576522 - DNA, 16 bp, Homo sapiens
atttcataatttgttt

SEQ ID NO: 5576523 - DNA, 12 bp, Homo sapiens
atttcatacaaa

SEQ ID NO: 5576524 - DNA, 22 bp, Homo sapiens
atttcatacaacagaaaccaga

SEQ ID NO: 5576525 - DNA, 20 bp, Homo sapiens
atttcatacctatcatctta

SEQ ID NO: 5576526 - DNA, 14 bp, Homo sapiens
atttcatagttcag

SEQ ID NO: 5576527 - DNA, 17 bp, Homo sapiens
atttcatataaatggaa

SEQ ID NO: 5576528 - DNA, 18 bp, Homo sapiens
atttcatatactataatt

SEQ ID NO: 5576529 - DNA, 13 bp, Homo sapiens
atttcatatctaa

SEQ ID NO: 5576530 - DNA, 15 bp, Homo sapiens
atttcatattctttc

SEQ ID NO: 5576531 - DNA, 18 bp, Homo sapiens
atttcatattctttcaat

SEQ ID NO: 5576532 - DNA, 18 bp, Homo sapiens
atttcatcatattataca

SEQ ID NO: 5576533 - DNA, 17 bp, Homo sapiens
atttcatccatatttct

SEQ ID NO: 5576534 - DNA, 19 bp, Homo sapiens
atttcatctatttctgaga

SEQ ID NO: 5576535 - DNA, 16 bp, Homo sapiens
atttcatctgctctcc

SEQ ID NO: 5576536 - DNA, 19 bp, Homo sapiens
atttcatctgctctccttc

SEQ ID NO: 5576537 - DNA, 21 bp, Homo sapiens
atttcatctgctctccttcct

SEQ ID NO: 5576538 - DNA, 19 bp, Homo sapiens
atttcatctgggtggtctg

SEQ ID NO: 5576539 - DNA, 15 bp, Homo sapiens
atttcatcttctgga

SEQ ID NO: 5576540 - DNA, 20 bp, Homo sapiens
atttcatcttctggaatatt

SEQ ID NO: 5576541 - DNA, 20 bp, Homo sapiens
atttcatcttgcaaatgttg

SEQ ID NO: 5576542 - DNA, 15 bp, Homo sapiens
atttcatctttccaa

SEQ ID NO: 5576543 - DNA, 16 bp, Homo sapiens
atttcatctttccaaa

SEQ ID NO: 5576544 - DNA, 16 bp, Homo sapiens
atttcatgaaaaagct

SEQ ID NO: 5576545 - DNA, 19 bp, Homo sapiens
atttcatgaaaacttttta

SEQ ID NO: 5576546 - DNA, 15 bp, Homo sapiens
atttcatgaaaatga

SEQ ID NO: 5576547 - DNA, 20 bp, Homo sapiens
atttcatgactggtgcgttc

SEQ ID NO: 5576548 - DNA, 21 bp, Homo sapiens
atttcatgctatcagaaacag

SEQ ID NO: 5576549 - DNA, 20 bp, Homo sapiens
atttcatgtaaaacagaaaa

SEQ ID NO: 5576550 - DNA, 21 bp, Homo sapiens
atttcatgtatttctttagaa

SEQ ID NO: 5576551 - DNA, 13 bp, Homo sapiens
atttcatgtccat

SEQ ID NO: 5576552 - DNA, 21 bp, Homo sapiens
atttcatgtcctgtgtcagtt

SEQ ID NO: 5576553 - DNA, 14 bp, Homo sapiens
atttcatgtgatct

SEQ ID NO: 5576554 - DNA, 15 bp, Homo sapiens
atttcatgtgatcta

SEQ ID NO: 5576555 - DNA, 16 bp, Homo sapiens
atttcatgtgctatag

SEQ ID NO: 5576556 - DNA, 16 bp, Homo sapiens
atttcatgtggctgta

SEQ ID NO: 5576557 - DNA, 22 bp, Homo sapiens
atttcatgtgtcaacttcaaca

SEQ ID NO: 5576558 - DNA, 23 bp, Homo sapiens
atttcattacatttctgaattgt

SEQ ID NO: 5576559 - DNA, 19 bp, Homo sapiens
atttcattatctgtactga

SEQ ID NO: 5576560 - DNA, 20 bp, Homo sapiens
atttcattatctgtactgaa

SEQ ID NO: 5576561 - DNA, 15 bp, Homo sapiens
atttcattatgcttt

SEQ ID NO: 5576562 - DNA, 17 bp, Homo sapiens
atttcattcaaatcagt

SEQ ID NO: 5576563 - DNA, 12 bp, Homo sapiens
atttcattccat

SEQ ID NO: 5576564 - DNA, 15 bp, Homo sapiens
atttcattctcttga

SEQ ID NO: 5576565 - DNA, 17 bp, Homo sapiens
atttcattgaatacttt

SEQ ID NO: 5576566 - DNA, 14 bp, Homo sapiens
atttcattgcactt

SEQ ID NO: 5576567 - DNA, 18 bp, Homo sapiens
atttcattgcctgtgtat

SEQ ID NO: 5576568 - DNA, 19 bp, Homo sapiens
atttcattggtcttctttt

SEQ ID NO: 5576569 - DNA, 19 bp, Homo sapiens
atttcattggttaattttt

SEQ ID NO: 5576570 - DNA, 14 bp, Homo sapiens
atttcattgtatga

SEQ ID NO: 5576571 - DNA, 19 bp, Homo sapiens
atttcattgtatgatgtgt

SEQ ID NO: 5576572 - DNA, 21 bp, Homo sapiens
atttcattgtatgatgtgttg

SEQ ID NO: 5576573 - DNA, 13 bp, Homo sapiens
atttcatttaaat

SEQ ID NO: 5576574 - DNA, 23 bp, Homo sapiens
atttcatttatactgtagcaata

SEQ ID NO: 5576575 - DNA, 18 bp, Homo sapiens
atttcatttcaactgttt

SEQ ID NO: 5576576 - DNA, 12 bp, Homo sapiens
atttcatttctt

SEQ ID NO: 5576577 - DNA, 15 bp, Homo sapiens
atttcatttcttgtc

SEQ ID NO: 5576578 - DNA, 21 bp, Homo sapiens
atttcatttcttgtcaattat

SEQ ID NO: 5576579 - DNA, 21 bp, Homo sapiens
atttcatttgctgttcatctt

SEQ ID NO: 5576580 - DNA, 17 bp, Homo sapiens
atttcatttgtaacttt

SEQ ID NO: 5576581 - DNA, 18 bp, Homo sapiens
atttcattttagtatttt

SEQ ID NO: 5576582 - DNA, 21 bp, Homo sapiens
atttcattttgtaacaaatga

SEQ ID NO: 5576583 - DNA, 23 bp, Homo sapiens
atttcatttttcaatagcacata

SEQ ID NO: 5576584 - DNA, 16 bp, Homo sapiens
atttcattttttgcat

SEQ ID NO: 5576585 - DNA, 15 bp, Homo sapiens
atttccaaaagcaca

SEQ ID NO: 5576586 - DNA, 20 bp, Homo sapiens
atttccaaaataaaatgaaa

SEQ ID NO: 5576587 - DNA, 23 bp, Homo sapiens
atttccaaaataaaatgaaaaat

SEQ ID NO: 5576588 - DNA, 18 bp, Homo sapiens
atttccaaaataatctat

SEQ ID NO: 5576589 - DNA, 22 bp, Homo sapiens
atttccaaaataatctatatta

SEQ ID NO: 5576590 - DNA, 15 bp, Homo sapiens
atttccaaactgttg

SEQ ID NO: 5576591 - DNA, 17 bp, Homo sapiens
atttccaaataaaatga

SEQ ID NO: 5576592 - DNA, 21 bp, Homo sapiens
atttccaacaccacagacaca

SEQ ID NO: 5576593 - DNA, 20 bp, Homo sapiens
atttccaactcgaatctgtg

SEQ ID NO: 5576594 - DNA, 13 bp, Homo sapiens
atttccaatgtga

SEQ ID NO: 5576595 - DNA, 21 bp, Homo sapiens
atttccacaattcttctgtca

SEQ ID NO: 5576596 - DNA, 14 bp, Homo sapiens
atttccacaccaag

SEQ ID NO: 5576597 - DNA, 17 bp, Homo sapiens
atttccacataaaggta

SEQ ID NO: 5576598 - DNA, 23 bp, Homo sapiens
atttccacatggaatcaatcttt

SEQ ID NO: 5576599 - DNA, 15 bp, Homo sapiens
atttccaccaagggt

SEQ ID NO: 5576600 - DNA, 14 bp, Homo sapiens
atttccactatttt

SEQ ID NO: 5576601 - DNA, 20 bp, Homo sapiens
atttccactattttcaaaga

SEQ ID NO: 5576602 - DNA, 16 bp, Homo sapiens
atttccactgaacaaa

SEQ ID NO: 5576603 - DNA, 15 bp, Homo sapiens
atttccactgtatat

SEQ ID NO: 5576604 - DNA, 18 bp, Homo sapiens
atttccactgtatatttt

SEQ ID NO: 5576605 - DNA, 13 bp, Homo sapiens
atttccactgtgc

SEQ ID NO: 5576606 - DNA, 22 bp, Homo sapiens
atttccacttgccctgttctct

SEQ ID NO: 5576607 - DNA, 22 bp, Homo sapiens
atttccagaaccacacttgaaa

SEQ ID NO: 5576608 - DNA, 10 bp, Homo sapiens
atttccagag

SEQ ID NO: 5576609 - DNA, 22 bp, Homo sapiens
atttccagcaaaatatatgttt

SEQ ID NO: 5576610 - DNA, 17 bp, Homo sapiens
atttccagccaaagcct

SEQ ID NO: 5576611 - DNA, 24 bp, Homo sapiens
atttccagccgcaatctggctcct

SEQ ID NO: 5576612 - DNA, 15 bp, Homo sapiens
atttccaggaaaaaa

SEQ ID NO: 5576613 - DNA, 14 bp, Homo sapiens
atttccaggcccct

SEQ ID NO: 5576614 - DNA, 17 bp, Homo sapiens
atttccagtacctttgt

SEQ ID NO: 5576615 - DNA, 19 bp, Homo sapiens
atttctaagcgcctattgt

SEQ ID NO: 5576616 - DNA, 16 bp, Homo sapiens
atttctaagtatttaa

SEQ ID NO: 5576617 - DNA, 19 bp, Homo sapiens
atttctaagtatttaaatg

SEQ ID NO: 5576618 - DNA, 24 bp, Homo sapiens
atttctaagttaaatcattttcat

SEQ ID NO: 5576619 - DNA, 20 bp, Homo sapiens
atttctaatccttttcctta

SEQ ID NO: 5576620 - DNA, 18 bp, Homo sapiens
atttctaatgttggacac

SEQ ID NO: 5576621 - DNA, 16 bp, Homo sapiens
atttctaatgtttact

SEQ ID NO: 5576622 - DNA, 21 bp, Homo sapiens
atttctaatgtttactatata

SEQ ID NO: 5576623 - DNA, 22 bp, Homo sapiens
atttctaattatgtagctcttt

SEQ ID NO: 5576624 - DNA, 13 bp, Homo sapiens
atttctaattgta

SEQ ID NO: 5576625 - DNA, 15 bp, Homo sapiens
atttctaatttgaat

SEQ ID NO: 5576626 - DNA, 14 bp, Homo sapiens
atttctacaaaata

SEQ ID NO: 5576627 - DNA, 19 bp, Homo sapiens
atttctacaactggagttt

SEQ ID NO: 5576628 - DNA, 20 bp, Homo sapiens
atttctaccaaggcatatca

SEQ ID NO: 5576629 - DNA, 15 bp, Homo sapiens
atttctaccagatgt

SEQ ID NO: 5576630 - DNA, 21 bp, Homo sapiens
atttctaccattaaaatcttg

SEQ ID NO: 5576631 - DNA, 18 bp, Homo sapiens
atttctactatatacata

SEQ ID NO: 5576632 - DNA, 15 bp, Homo sapiens
atttctactctccca

SEQ ID NO: 5576633 - DNA, 20 bp, Homo sapiens
atttctactcttaagtttct

SEQ ID NO: 5576634 - DNA, 14 bp, Homo sapiens
atttctactgtata

SEQ ID NO: 5576635 - DNA, 23 bp, Homo sapiens
atttctactgtataaacaaatta

SEQ ID NO: 5576636 - DNA, 21 bp, Homo sapiens
atttctactgtcaaatgatgt

SEQ ID NO: 5576637 - DNA, 14 bp, Homo sapiens
atttctactttgat

SEQ ID NO: 5576638 - DNA, 14 bp, Homo sapiens
atttctagaaacaa

SEQ ID NO: 5576639 - DNA, 15 bp, Homo sapiens
atttctagaacaatt

SEQ ID NO: 5576640 - DNA, 21 bp, Homo sapiens
atttctagaacaattacatgt

SEQ ID NO: 5576641 - DNA, 16 bp, Homo sapiens
atttctagcaggcagg

SEQ ID NO: 5576642 - DNA, 16 bp, Homo sapiens
atttctagcttatcta

SEQ ID NO: 5576643 - DNA, 16 bp, Homo sapiens
atttctagctttttaa

SEQ ID NO: 5576644 - DNA, 17 bp, Homo sapiens
atttctaggaagaattt

SEQ ID NO: 5576645 - DNA, 20 bp, Homo sapiens
atttctaggactgaattatg

SEQ ID NO: 5576646 - DNA, 17 bp, Homo sapiens
atttctaggcaaaattg

SEQ ID NO: 5576647 - DNA, 21 bp, Homo sapiens
atttctaggcaaaattgtgaa

SEQ ID NO: 5576648 - DNA, 11 bp, Homo sapiens
atttctaggta

SEQ ID NO: 5576649 - DNA, 20 bp, Homo sapiens
atttctagtagaaagaaaat

SEQ ID NO: 5576650 - DNA, 22 bp, Homo sapiens
atttctagtagaaagaaaatgt

SEQ ID NO: 5576651 - DNA, 17 bp, Homo sapiens
atttctagtatctattg

SEQ ID NO: 5576652 - DNA, 18 bp, Homo sapiens
atttctagtatctattgt

SEQ ID NO: 5576653 - DNA, 18 bp, Homo sapiens
atttctagtgtatactct

SEQ ID NO: 5576654 - DNA, 16 bp, Homo sapiens
atttctagttatttat

SEQ ID NO: 5576655 - DNA, 15 bp, Homo sapiens
atttctataaaaata

SEQ ID NO: 5576656 - DNA, 13 bp, Homo sapiens
atttctatacagt

SEQ ID NO: 5576657 - DNA, 15 bp, Homo sapiens
atttctatacagtag

SEQ ID NO: 5576658 - DNA, 22 bp, Homo sapiens
atttctatacagtagcttgaaa

SEQ ID NO: 5576659 - DNA, 19 bp, Homo sapiens
atttctatagccaaagctg

SEQ ID NO: 5576660 - DNA, 14 bp, Homo sapiens
atttctatatttat

SEQ ID NO: 5576661 - DNA, 16 bp, Homo sapiens
atttctatattttcat

SEQ ID NO: 5576662 - DNA, 19 bp, Homo sapiens
atttctatattttcattct

SEQ ID NO: 5576663 - DNA, 22 bp, Homo sapiens
atttctatcagccttgctaaag

SEQ ID NO: 5576664 - DNA, 15 bp, Homo sapiens
atttctatctgcaaa

SEQ ID NO: 5576665 - DNA, 17 bp, Homo sapiens
atttctatctgcaaata

SEQ ID NO: 5576666 - DNA, 18 bp, Homo sapiens
atttctatgaaatattat

SEQ ID NO: 5576667 - DNA, 20 bp, Homo sapiens
atttctatgaaatattatgt

SEQ ID NO: 5576668 - DNA, 15 bp, Homo sapiens
atttctatgacaaat

SEQ ID NO: 5576669 - DNA, 21 bp, Homo sapiens
atttctatgagacctccccca

SEQ ID NO: 5576670 - DNA, 19 bp, Homo sapiens
atttctatgctgagtttgt

SEQ ID NO: 5576671 - DNA, 21 bp, Homo sapiens
atttctatgctgagtttgtgc

SEQ ID NO: 5576672 - DNA, 13 bp, Homo sapiens
atttctatggctt

SEQ ID NO: 5576673 - DNA, 15 bp, Homo sapiens
atttctatgtaaatt

SEQ ID NO: 5576674 - DNA, 22 bp, Homo sapiens
atttctatgtatgtgccaattt

SEQ ID NO: 5576675 - DNA, 15 bp, Homo sapiens
atttctatgtcattt

SEQ ID NO: 5576676 - DNA, 22 bp, Homo sapiens
atttctatgtcatttttaatgt

SEQ ID NO: 5576677 - DNA, 15 bp, Homo sapiens
atttctatgttgtaa

SEQ ID NO: 5576678 - DNA, 15 bp, Homo sapiens
atttctattaatatc

SEQ ID NO: 5576679 - DNA, 20 bp, Homo sapiens
atttctattccctaacttgt

SEQ ID NO: 5576680 - DNA, 12 bp, Homo sapiens
atttctatttat

SEQ ID NO: 5576681 - DNA, 13 bp, Homo sapiens
atttctatttatt

SEQ ID NO: 5576682 - DNA, 18 bp, Homo sapiens
atttctatttctcctcca

SEQ ID NO: 5576683 - DNA, 20 bp, Homo sapiens
atttctatttctcctccatg

SEQ ID NO: 5576684 - DNA, 18 bp, Homo sapiens
atttctattttgcagcag

SEQ ID NO: 5576685 - DNA, 12 bp, Homo sapiens
atttctattttt

SEQ ID NO: 5576686 - DNA, 20 bp, Homo sapiens
atttctcaaagatctgaatt

SEQ ID NO: 5576687 - DNA, 22 bp, Homo sapiens
atttctcaaagtttttacagtg

SEQ ID NO: 5576688 - DNA, 18 bp, Homo sapiens
atttctcaatagttctta

SEQ ID NO: 5576689 - DNA, 14 bp, Homo sapiens
atttctcactgaga

SEQ ID NO: 5576690 - DNA, 18 bp, Homo sapiens
atttctcagactttggaa

SEQ ID NO: 5576691 - DNA, 15 bp, Homo sapiens
atttctcaggctagg

SEQ ID NO: 5576692 - DNA, 14 bp, Homo sapiens
atttctcagggaag

SEQ ID NO: 5576693 - DNA, 20 bp, Homo sapiens
atttctcatacttagaaaca

SEQ ID NO: 5576694 - DNA, 22 bp, Homo sapiens
atttctcataggctatgccatg

SEQ ID NO: 5576695 - DNA, 14 bp, Homo sapiens
atttctcatgtgct

SEQ ID NO: 5576696 - DNA, 18 bp, Homo sapiens
atttctcatgtgctttgt

SEQ ID NO: 5576697 - DNA, 21 bp, Homo sapiens
atttctcatgtgctttgtagc

SEQ ID NO: 5576698 - DNA, 15 bp, Homo sapiens
atttctcatgttgaa

SEQ ID NO: 5576699 - DNA, 14 bp, Homo sapiens
atttctcatgtttt

SEQ ID NO: 5576700 - DNA, 21 bp, Homo sapiens
atttctcattgatcacagatg

SEQ ID NO: 5576701 - DNA, 17 bp, Homo sapiens
atttctcattgcctctt

SEQ ID NO: 5576702 - DNA, 13 bp, Homo sapiens
atttctcatttat

SEQ ID NO: 5576703 - DNA, 17 bp, Homo sapiens
atttctccagacccaga

SEQ ID NO: 5576704 - DNA, 16 bp, Homo sapiens
atttctccagttggga

SEQ ID NO: 5576705 - DNA, 20 bp, Homo sapiens
atttctccatcccctccctg

SEQ ID NO: 5576706 - DNA, 16 bp, Homo sapiens
atttctccatctttat

SEQ ID NO: 5576707 - DNA, 19 bp, Homo sapiens
atttctccatctttataga

SEQ ID NO: 5576708 - DNA, 14 bp, Homo sapiens
atttctccattaaa

SEQ ID NO: 5576709 - DNA, 13 bp, Homo sapiens
atttctcctactt

SEQ ID NO: 5576710 - DNA, 17 bp, Homo sapiens
atttctcctcatttaat

SEQ ID NO: 5576711 - DNA, 21 bp, Homo sapiens
atttctcctcatttaatattt

SEQ ID NO: 5576712 - DNA, 15 bp, Homo sapiens
atttctcctctttct

SEQ ID NO: 5576713 - DNA, 20 bp, Homo sapiens
atttctcctgcgtgttctca

SEQ ID NO: 5576714 - DNA, 11 bp, Homo sapiens
atttctccttt

SEQ ID NO: 5576715 - DNA, 17 bp, Homo sapiens
atttctcctttcctaca

SEQ ID NO: 5576716 - DNA, 15 bp, Homo sapiens
atttctcctttgcaa

SEQ ID NO: 5576717 - DNA, 21 bp, Homo sapiens
atttctcctttgcaatagcag

SEQ ID NO: 5576718 - DNA, 20 bp, Homo sapiens
atttctccttttgtgttcca

SEQ ID NO: 5576719 - DNA, 17 bp, Homo sapiens
atttctctacagatgtc

SEQ ID NO: 5576720 - DNA, 21 bp, Homo sapiens
atttctctatgtttattctag

SEQ ID NO: 5576721 - DNA, 15 bp, Homo sapiens
atttctctcaatttg

SEQ ID NO: 5576722 - DNA, 14 bp, Homo sapiens
atttctctccccac

SEQ ID NO: 5576723 - DNA, 20 bp, Homo sapiens
atttctctccccactgaaaa

SEQ ID NO: 5576724 - DNA, 23 bp, Homo sapiens
atttctctccttaacctccagca

SEQ ID NO: 5576725 - DNA, 23 bp, Homo sapiens
atttctctctttcttggtgtctg

SEQ ID NO: 5576726 - DNA, 13 bp, Homo sapiens
atttctctgagca

SEQ ID NO: 5576727 - DNA, 18 bp, Homo sapiens
atttctctgagcagtcag

SEQ ID NO: 5576728 - DNA, 12 bp, Homo sapiens
atttctctgtga

SEQ ID NO: 5576729 - DNA, 15 bp, Homo sapiens
atttctctgttccat

SEQ ID NO: 5576730 - DNA, 23 bp, Homo sapiens
atttctctgttccatagttaaag

SEQ ID NO: 5576731 - DNA, 14 bp, Homo sapiens
atttctcttcctaa

SEQ ID NO: 5576732 - DNA, 20 bp, Homo sapiens
atttctcttctacccttttc

SEQ ID NO: 5576733 - DNA, 22 bp, Homo sapiens
atttctcttctacccttttcct

SEQ ID NO: 5576734 - DNA, 12 bp, Homo sapiens
atttctcttctc

SEQ ID NO: 5576735 - DNA, 13 bp, Homo sapiens
atttctcttctca

SEQ ID NO: 5576736 - DNA, 17 bp, Homo sapiens
atttctcttgggcaggc

SEQ ID NO: 5576737 - DNA, 18 bp, Homo sapiens
atttctcttgggcaggca

SEQ ID NO: 5576738 - DNA, 22 bp, Homo sapiens
atttctcttgtattatctcctt

SEQ ID NO: 5576739 - DNA, 19 bp, Homo sapiens
atttctctttaaactatgt

SEQ ID NO: 5576740 - DNA, 17 bp, Homo sapiens
atttctctttctctctc

SEQ ID NO: 5576741 - DNA, 16 bp, Homo sapiens
atttctctttctttac

SEQ ID NO: 5576742 - DNA, 18 bp, Homo sapiens
atttctctttctttacaa

SEQ ID NO: 5576743 - DNA, 13 bp, Homo sapiens
atttctctttgaa

SEQ ID NO: 5576744 - DNA, 17 bp, Homo sapiens
atttctctttttgaaaa

SEQ ID NO: 5576745 - DNA, 15 bp, Homo sapiens
atttctgaaaaagag

SEQ ID NO: 5576746 - DNA, 17 bp, Homo sapiens
atttctgaactgttaca

SEQ ID NO: 5576747 - DNA, 14 bp, Homo sapiens
atttctgaagaagt

SEQ ID NO: 5576748 - DNA, 15 bp, Homo sapiens
atttctgaagtgctt

SEQ ID NO: 5576749 - DNA, 22 bp, Homo sapiens
atttctgaagtgcttgtatagc

SEQ ID NO: 5576750 - DNA, 18 bp, Homo sapiens
atttctgaattcaaagct

SEQ ID NO: 5576751 - DNA, 20 bp, Homo sapiens
atttctgaattcaaagcttg

SEQ ID NO: 5576752 - DNA, 15 bp, Homo sapiens
atttctgaattgttg

SEQ ID NO: 5576753 - DNA, 14 bp, Homo sapiens
atttctgacatcaa

SEQ ID NO: 5576754 - DNA, 17 bp, Homo sapiens
atttctgagaaggtcct

SEQ ID NO: 5576755 - DNA, 23 bp, Homo sapiens
atttctgagagtgaaaccatgac

SEQ ID NO: 5576756 - DNA, 16 bp, Homo sapiens
atttctgataagacat

SEQ ID NO: 5576757 - DNA, 16 bp, Homo sapiens
atttctgatcagaggt

SEQ ID NO: 5576758 - DNA, 24 bp, Homo sapiens
atttctgatcagaggtgtacacta

SEQ ID NO: 5576759 - DNA, 13 bp, Homo sapiens
atttctgatgatg

SEQ ID NO: 5576760 - DNA, 14 bp, Homo sapiens
atttctgatgatgt

SEQ ID NO: 5576761 - DNA, 22 bp, Homo sapiens
atttctgatgttccagcttcta

SEQ ID NO: 5576762 - DNA, 14 bp, Homo sapiens
atttctgattctga

SEQ ID NO: 5576763 - DNA, 15 bp, Homo sapiens
atttctgattctgat

SEQ ID NO: 5576764 - DNA, 11 bp, Homo sapiens
atttctgattt

SEQ ID NO: 5576765 - DNA, 13 bp, Homo sapiens
atttctgatttca

SEQ ID NO: 5576766 - DNA, 15 bp, Homo sapiens
atttctgatttcact

SEQ ID NO: 5576767 - DNA, 16 bp, Homo sapiens
atttctgatttcataa

SEQ ID NO: 5576768 - DNA, 22 bp, Homo sapiens
atttctgatttcataattcaga

SEQ ID NO: 5576769 - DNA, 13 bp, Homo sapiens
atttctgatttta

SEQ ID NO: 5576770 - DNA, 16 bp, Homo sapiens
atttctgattttatgt

SEQ ID NO: 5576771 - DNA, 17 bp, Homo sapiens
atttctgattttatgta

SEQ ID NO: 5576772 - DNA, 19 bp, Homo sapiens
atttctgattttatgtaaa

SEQ ID NO: 5576773 - DNA, 20 bp, Homo sapiens
atttctgcacaggtctctgt

SEQ ID NO: 5576774 - DNA, 21 bp, Homo sapiens
atttctgcagatcttccgtgg

SEQ ID NO: 5576775 - DNA, 20 bp, Homo sapiens
atttctgccaagtcagttct

SEQ ID NO: 5576776 - DNA, 17 bp, Homo sapiens
atttctgccaataaatt

SEQ ID NO: 5576777 - DNA, 20 bp, Homo sapiens
atttctgccaataaattcta

SEQ ID NO: 5576778 - DNA, 12 bp, Homo sapiens
atttctgccagc

SEQ ID NO: 5576779 - DNA, 19 bp, Homo sapiens
atttctgccatgatgttta

SEQ ID NO: 5576780 - DNA, 18 bp, Homo sapiens
atttctgccatttcatgt

SEQ ID NO: 5576781 - DNA, 19 bp, Homo sapiens
atttctgccatttcatgtc

SEQ ID NO: 5576782 - DNA, 23 bp, Homo sapiens
atttctgccctcagcttcaaata

SEQ ID NO: 5576783 - DNA, 23 bp, Homo sapiens
atttctgcctataaatttactct

SEQ ID NO: 5576784 - DNA, 16 bp, Homo sapiens
atttctgccttccttg

SEQ ID NO: 5576785 - DNA, 20 bp, Homo sapiens
atttctgctaaatatcacct

SEQ ID NO: 5576786 - DNA, 20 bp, Homo sapiens
atttctgctaagttctccca

SEQ ID NO: 5576787 - DNA, 20 bp, Homo sapiens
atttctgctcagattccccc

SEQ ID NO: 5576788 - DNA, 21 bp, Homo sapiens
atttctgctctggaataaagt

SEQ ID NO: 5576789 - DNA, 16 bp, Homo sapiens
atttctgctgaatttt

SEQ ID NO: 5576790 - DNA, 20 bp, Homo sapiens
atttctgctgaattttcaca

SEQ ID NO: 5576791 - DNA, 14 bp, Homo sapiens
atttctgcttcctg

SEQ ID NO: 5576792 - DNA, 17 bp, Homo sapiens
atttctgcttttgcatc

SEQ ID NO: 5576793 - DNA, 22 bp, Homo sapiens
atttgcaacaggggaggaaaaa

SEQ ID NO: 5576794 - DNA, 23 bp, Homo sapiens
atttgcaacaggggaggaaaaaa

SEQ ID NO: 5576795 - DNA, 21 bp, Homo sapiens
atttgcaacagtaatcagagt

SEQ ID NO: 5576796 - DNA, 19 bp, Homo sapiens
atttgcaaccatcagaatt

SEQ ID NO: 5576797 - DNA, 20 bp, Homo sapiens
atttgcaagggaaaagtctc

SEQ ID NO: 5576798 - DNA, 19 bp, Homo sapiens
atttgcaagtcatggctgt

SEQ ID NO: 5576799 - DNA, 18 bp, Homo sapiens
atttgcaataacagctgc

SEQ ID NO: 5576800 - DNA, 19 bp, Homo sapiens
atttgcaataacagctgca

SEQ ID NO: 5576801 - DNA, 20 bp, Homo sapiens
atttgcaataacagctgcaa

SEQ ID NO: 5576802 - DNA, 15 bp, Homo sapiens
atttgcaattagaaa

SEQ ID NO: 5576803 - DNA, 16 bp, Homo sapiens
atttgcaattcatgta

SEQ ID NO: 5576804 - DNA, 22 bp, Homo sapiens
atttgcaattcatgtaacagtt

SEQ ID NO: 5576805 - DNA, 18 bp, Homo sapiens
atttgcaatttgagccat

SEQ ID NO: 5576806 - DNA, 18 bp, Homo sapiens
atttgcacaaaaagatac

SEQ ID NO: 5576807 - DNA, 15 bp, Homo sapiens
atttgcacaagtttt

SEQ ID NO: 5576808 - DNA, 15 bp, Homo sapiens
atttgcacaatattt

SEQ ID NO: 5576809 - DNA, 20 bp, Homo sapiens
atttgcacacattggccgct

SEQ ID NO: 5576810 - DNA, 23 bp, Homo sapiens
atttgcacacattggccgcttca

SEQ ID NO: 5576811 - DNA, 23 bp, Homo sapiens
atttgcacctctgttcatttcac

SEQ ID NO: 5576812 - DNA, 20 bp, Homo sapiens
atttgcacggtttgtgagag

SEQ ID NO: 5576813 - DNA, 18 bp, Homo sapiens
atttgcactaatgtgtta

SEQ ID NO: 5576814 - DNA, 11 bp, Homo sapiens
atttgcactga

SEQ ID NO: 5576815 - DNA, 15 bp, Homo sapiens
atttgcactgcttta

SEQ ID NO: 5576816 - DNA, 19 bp, Homo sapiens
atttgcacttatgtacttg

SEQ ID NO: 5576817 - DNA, 20 bp, Homo sapiens
atttgcagaccaggaaggaa

SEQ ID NO: 5576818 - DNA, 22 bp, Homo sapiens
atttgcagagacaggacctgac

SEQ ID NO: 5576819 - DNA, 12 bp, Homo sapiens
atttgcagaggc

SEQ ID NO: 5576820 - DNA, 17 bp, Homo sapiens
atttgcaggatctgtct

SEQ ID NO: 5576821 - DNA, 22 bp, Homo sapiens
atttgcaggattcccttctggg

SEQ ID NO: 5576822 - DNA, 14 bp, Homo sapiens
atttgcaggatttt

SEQ ID NO: 5576823 - DNA, 14 bp, Homo sapiens
atttgcagggtcct

SEQ ID NO: 5576824 - DNA, 21 bp, Homo sapiens
atttgcaggtgaccagaatga

SEQ ID NO: 5576825 - DNA, 9 bp, Homo sapiens
atttgcagt

SEQ ID NO: 5576826 - DNA, 9 bp, Homo sapiens
atttgcata

SEQ ID NO: 5576827 - DNA, 22 bp, Homo sapiens
atttgcataacaattcctctac

SEQ ID NO: 5576828 - DNA, 18 bp, Homo sapiens
atttgcataatatgcata

SEQ ID NO: 5576829 - DNA, 19 bp, Homo sapiens
atttgcataatatgcatat

SEQ ID NO: 5576830 - DNA, 13 bp, Homo sapiens
atttgcatactta

SEQ ID NO: 5576831 - DNA, 19 bp, Homo sapiens
atttgcatatttattgcat

SEQ ID NO: 5576832 - DNA, 16 bp, Homo sapiens
atttgcatattttgag

SEQ ID NO: 5576833 - DNA, 21 bp, Homo sapiens
atttgcatctgaaataggaaa

SEQ ID NO: 5576834 - DNA, 18 bp, Homo sapiens
atttgcatgaaagcacaa

SEQ ID NO: 5576835 - DNA, 21 bp, Homo sapiens
atttgcatggctccagaaatg

SEQ ID NO: 5576836 - DNA, 20 bp, Homo sapiens
atttgcatgggagggggaga

SEQ ID NO: 5576837 - DNA, 18 bp, Homo sapiens
atttgcattaaattcaca

SEQ ID NO: 5576838 - DNA, 22 bp, Homo sapiens
atttgcattactctggtggatt

SEQ ID NO: 5576839 - DNA, 15 bp, Homo sapiens
atttgcattatgtat

SEQ ID NO: 5576840 - DNA, 21 bp, Homo sapiens
atttgcattgaacacaaactg

SEQ ID NO: 5576841 - DNA, 22 bp, Homo sapiens
atttgcattgaacacaaactgt

SEQ ID NO: 5576842 - DNA, 12 bp, Homo sapiens
atttgcatttgt

SEQ ID NO: 5576843 - DNA, 16 bp, Homo sapiens
atttgcatttgtttat

SEQ ID NO: 5576844 - DNA, 23 bp, Homo sapiens
atttgcatttgtttatgtaattt

SEQ ID NO: 5576845 - DNA, 16 bp, Homo sapiens
atttgcatttttgtat

SEQ ID NO: 5576846 - DNA, 18 bp, Homo sapiens
atttgcattttttaaatt

SEQ ID NO: 5576847 - DNA, 22 bp, Homo sapiens
atttgccaaaaactaaaattca

SEQ ID NO: 5576848 - DNA, 20 bp, Homo sapiens
atttgccaaaataatgtctt

SEQ ID NO: 5576849 - DNA, 14 bp, Homo sapiens
atttgccaagtctc

SEQ ID NO: 5576850 - DNA, 20 bp, Homo sapiens
atttgccaataaagcttttg

SEQ ID NO: 5576851 - DNA, 16 bp, Homo sapiens
atttgccaatgtatat

SEQ ID NO: 5576852 - DNA, 20 bp, Homo sapiens
atttgccactgatattcaga

SEQ ID NO: 5576853 - DNA, 22 bp, Homo sapiens
atttgccactgatattcagaat

SEQ ID NO: 5576854 - DNA, 19 bp, Homo sapiens
atttgccacttagtatttt

SEQ ID NO: 5576855 - DNA, 23 bp, Homo sapiens
atttgccagacagagatcagaat

SEQ ID NO: 5576856 - DNA, 20 bp, Homo sapiens
atttgccagagccaaatttt

SEQ ID NO: 5576857 - DNA, 16 bp, Homo sapiens
atttgccatgctgcta

SEQ ID NO: 5576858 - DNA, 19 bp, Homo sapiens
atttgccatgggcttcact

SEQ ID NO: 5576859 - DNA, 16 bp, Homo sapiens
atttgccattcctgga

SEQ ID NO: 5576860 - DNA, 18 bp, Homo sapiens
atttgccattggtttctg

SEQ ID NO: 5576861 - DNA, 23 bp, Homo sapiens
atttgcccaattccaggtgtgca

SEQ ID NO: 5576862 - DNA, 21 bp, Homo sapiens
atttgcccatttacacttttg

SEQ ID NO: 5576863 - DNA, 22 bp, Homo sapiens
atttgccccaacttaagtttag

SEQ ID NO: 5576864 - DNA, 15 bp, Homo sapiens
atttgccccttgagc

SEQ ID NO: 5576865 - DNA, 14 bp, Homo sapiens
atttgccctcccat

SEQ ID NO: 5576866 - DNA, 12 bp, Homo sapiens
atttgccctggg

SEQ ID NO: 5576867 - DNA, 15 bp, Homo sapiens
atttgcccttcagga

SEQ ID NO: 5576868 - DNA, 22 bp, Homo sapiens
atttgcccttcaggacccttct

SEQ ID NO: 5576869 - DNA, 17 bp, Homo sapiens
atttgccgatttcctaa

SEQ ID NO: 5576870 - DNA, 20 bp, Homo sapiens
atttgccgatttcctaagct

SEQ ID NO: 5576871 - DNA, 22 bp, Homo sapiens
atttgccgatttcctaagctgt

SEQ ID NO: 5576872 - DNA, 13 bp, Homo sapiens
atttgcctatttc

SEQ ID NO: 5576873 - DNA, 12 bp, Homo sapiens
atttgcctcacc

SEQ ID NO: 5576874 - DNA, 16 bp, Homo sapiens
atttgcctccagtgca

SEQ ID NO: 5576875 - DNA, 21 bp, Homo sapiens
atttgcctgcttctttccaga

SEQ ID NO: 5576876 - DNA, 20 bp, Homo sapiens
atttgccttaggaagtgact

SEQ ID NO: 5576877 - DNA, 15 bp, Homo sapiens
atttgccttctgaaa

SEQ ID NO: 5576878 - DNA, 18 bp, Homo sapiens
atttgccttctgaaatgt

SEQ ID NO: 5576879 - DNA, 17 bp, Homo sapiens
atttgccttgcagaact

SEQ ID NO: 5576880 - DNA, 18 bp, Homo sapiens
atttgccttgcagaactg

SEQ ID NO: 5576881 - DNA, 19 bp, Homo sapiens
atttgccttgcagaactgc

SEQ ID NO: 5576882 - DNA, 22 bp, Homo sapiens
atttgccttgcagaactgccat

SEQ ID NO: 5576883 - DNA, 23 bp, Homo sapiens
atttgccttgcagaactgccatt

SEQ ID NO: 5576884 - DNA, 22 bp, Homo sapiens
atttgcgcctcggtatctggct

SEQ ID NO: 5576885 - DNA, 19 bp, Homo sapiens
atttgcgtatgtaaacatt

SEQ ID NO: 5576886 - DNA, 22 bp, Homo sapiens
atttgcgtccgcacgcggccgc

SEQ ID NO: 5576887 - DNA, 17 bp, Homo sapiens
atttgctaagcatattt

SEQ ID NO: 5576888 - DNA, 18 bp, Homo sapiens
atttgctaatcaaagcca

SEQ ID NO: 5576889 - DNA, 16 bp, Homo sapiens
atttgctaatgaattt

SEQ ID NO: 5576890 - DNA, 15 bp, Homo sapiens
atttgctactgtaca

SEQ ID NO: 5576891 - DNA, 22 bp, Homo sapiens
atttgctagttctgctgccctc

SEQ ID NO: 5576892 - DNA, 23 bp, Homo sapiens
atttgctatctgaactaattcat

SEQ ID NO: 5576893 - DNA, 20 bp, Homo sapiens
atttgctatgagctggggat

SEQ ID NO: 5576894 - DNA, 16 bp, Homo sapiens
atttgctatttacaaa

SEQ ID NO: 5576895 - DNA, 20 bp, Homo sapiens
atttgctcacttggtaaatg

SEQ ID NO: 5576896 - DNA, 16 bp, Homo sapiens
atttgctcataagtaa

SEQ ID NO: 5576897 - DNA, 12 bp, Homo sapiens
atttgctcctgg

SEQ ID NO: 5576898 - DNA, 18 bp, Homo sapiens
atttgctcttcagatgcc

SEQ ID NO: 5576899 - DNA, 10 bp, Homo sapiens
atttgctgaa

SEQ ID NO: 5576900 - DNA, 14 bp, Homo sapiens
atttgctgaactca

SEQ ID NO: 5576901 - DNA, 13 bp, Homo sapiens
atttgctgaataa

SEQ ID NO: 5576902 - DNA, 19 bp, Homo sapiens
atttgctgaataacaacaa

SEQ ID NO: 5576903 - DNA, 20 bp, Homo sapiens
atttgctgaataacaacaat

SEQ ID NO: 5576904 - DNA, 21 bp, Homo sapiens
atttgctgaataacaacaatt

SEQ ID NO: 5576905 - DNA, 21 bp, Homo sapiens
atttgctgagtttcccttcct

SEQ ID NO: 5576906 - DNA, 14 bp, Homo sapiens
atttgctgcaaaga

SEQ ID NO: 5576907 - DNA, 18 bp, Homo sapiens
atttgctgcaaagagaaa

SEQ ID NO: 5576908 - DNA, 20 bp, Homo sapiens
atttgctgccaaatgcgtat

SEQ ID NO: 5576909 - DNA, 13 bp, Homo sapiens
atttgctgccatt

SEQ ID NO: 5576910 - DNA, 13 bp, Homo sapiens
atttgctgccctg

SEQ ID NO: 5576911 - DNA, 16 bp, Homo sapiens
atttgctgccctgggg

SEQ ID NO: 5576912 - DNA, 12 bp, Homo sapiens
atttgctgctga

SEQ ID NO: 5576913 - DNA, 17 bp, Homo sapiens
atttgctggcctggcag

SEQ ID NO: 5576914 - DNA, 20 bp, Homo sapiens
atttgctggcctggcagggg

SEQ ID NO: 5576915 - DNA, 23 bp, Homo sapiens
atttgctgggctttttttttctc

SEQ ID NO: 5576916 - DNA, 17 bp, Homo sapiens
atttgctgtctttttgt

SEQ ID NO: 5576917 - DNA, 13 bp, Homo sapiens
atttgctgttgat

SEQ ID NO: 5576918 - DNA, 21 bp, Homo sapiens
atttgctgttgtttctataaa

SEQ ID NO: 5576919 - DNA, 24 bp, Homo sapiens
atttgcttaaaattgctagtgatt

SEQ ID NO: 5576920 - DNA, 22 bp, Homo sapiens
atttgcttaaatatccatatta

SEQ ID NO: 5576921 - DNA, 23 bp, Homo sapiens
atttgcttgcaatctaatctgaa

SEQ ID NO: 5576922 - DNA, 15 bp, Homo sapiens
atttgctttaattaa

SEQ ID NO: 5576923 - DNA, 22 bp, Homo sapiens
atttgctttagagacagggact

SEQ ID NO: 5576924 - DNA, 16 bp, Homo sapiens
atttgctttcctctga

SEQ ID NO: 5576925 - DNA, 22 bp, Homo sapiens
atttgctttcctctgagattct

SEQ ID NO: 5576926 - DNA, 20 bp, Homo sapiens
atttgctttcttttctccca

SEQ ID NO: 5576927 - DNA, 12 bp, Homo sapiens
atttgcttttca

SEQ ID NO: 5576928 - DNA, 11 bp, Homo sapiens
atttgcttttt

SEQ ID NO: 5576929 - DNA, 16 bp, Homo sapiens
atttggaaactaataa

SEQ ID NO: 5576930 - DNA, 18 bp, Homo sapiens
atttggaaactaataaaa

SEQ ID NO: 5576931 - DNA, 16 bp, Homo sapiens
atttggaaagagacca

SEQ ID NO: 5576932 - DNA, 15 bp, Homo sapiens
atttggaaaggaatg

SEQ ID NO: 5576933 - DNA, 18 bp, Homo sapiens
atttggaaaggaatgcaa

SEQ ID NO: 5576934 - DNA, 15 bp, Homo sapiens
atttggaaataaagt

SEQ ID NO: 5576935 - DNA, 17 bp, Homo sapiens
atttggaaataaagtca

SEQ ID NO: 5576936 - DNA, 11 bp, Homo sapiens
atttggaaatc

SEQ ID NO: 5576937 - DNA, 12 bp, Homo sapiens
atttggaaatcc

SEQ ID NO: 5576938 - DNA, 13 bp, Homo sapiens
atttggaaatctt

SEQ ID NO: 5576939 - DNA, 19 bp, Homo sapiens
atttggaacagtgacaata

SEQ ID NO: 5576940 - DNA, 22 bp, Homo sapiens
atttggaaccaaagtctaaact

SEQ ID NO: 5576941 - DNA, 21 bp, Homo sapiens
atttggaacttacaaagggtc

SEQ ID NO: 5576942 - DNA, 21 bp, Homo sapiens
atttggaagagaggcacctgc

SEQ ID NO: 5576943 - DNA, 21 bp, Homo sapiens
atttggaataaaaattccaga

SEQ ID NO: 5576944 - DNA, 17 bp, Homo sapiens
atttggaatatttgaat

SEQ ID NO: 5576945 - DNA, 15 bp, Homo sapiens
atttggaattgacat

SEQ ID NO: 5576946 - DNA, 22 bp, Homo sapiens
atttggaattgacattctctat

SEQ ID NO: 5576947 - DNA, 15 bp, Homo sapiens
atttggactgtctat

SEQ ID NO: 5576948 - DNA, 13 bp, Homo sapiens
atttggactgttt

SEQ ID NO: 5576949 - DNA, 20 bp, Homo sapiens
atttggactgttttccttca

SEQ ID NO: 5576950 - DNA, 11 bp, Homo sapiens
atttggagact

SEQ ID NO: 5576951 - DNA, 23 bp, Homo sapiens
atttggaggctggagtaatcaga

SEQ ID NO: 5576952 - DNA, 15 bp, Homo sapiens
atttggagggcctgg

SEQ ID NO: 5576953 - DNA, 17 bp, Homo sapiens
atttggagggcctgggc

SEQ ID NO: 5576954 - DNA, 21 bp, Homo sapiens
atttggagtggaggcattgtt

SEQ ID NO: 5576955 - DNA, 22 bp, Homo sapiens
atttggagtggaggcattgttt

SEQ ID NO: 5576956 - DNA, 13 bp, Homo sapiens
atttggataataa

SEQ ID NO: 5576957 - DNA, 17 bp, Homo sapiens
atttggatatctgttag

SEQ ID NO: 5576958 - DNA, 13 bp, Homo sapiens
atttggatctatt

SEQ ID NO: 5576959 - DNA, 17 bp, Homo sapiens
atttggattagaaattt

SEQ ID NO: 5576960 - DNA, 19 bp, Homo sapiens
atttggattattctttctc

SEQ ID NO: 5576961 - DNA, 13 bp, Homo sapiens
atttggattcaca

SEQ ID NO: 5576962 - DNA, 20 bp, Homo sapiens
atttggatttaaaagcctgc

SEQ ID NO: 5576963 - DNA, 13 bp, Homo sapiens
atttggattttaa

SEQ ID NO: 5576964 - DNA, 14 bp, Homo sapiens
atttggcaaaatgt

SEQ ID NO: 5576965 - DNA, 16 bp, Homo sapiens
atttggcactatggtt

SEQ ID NO: 5576966 - DNA, 19 bp, Homo sapiens
atttggcagaactgctggg

SEQ ID NO: 5576967 - DNA, 20 bp, Homo sapiens
atttggcagaactgctgggg

SEQ ID NO: 5576968 - DNA, 23 bp, Homo sapiens
atttggcagaactgctggggctg

SEQ ID NO: 5576969 - DNA, 21 bp, Homo sapiens
attttaatgcacctgaatgtt

SEQ ID NO: 5576970 - DNA, 22 bp, Homo sapiens
attttaatgcagttgcttacta

SEQ ID NO: 5576971 - DNA, 20 bp, Homo sapiens
attttaatgctgtttctaag

SEQ ID NO: 5576972 - DNA, 21 bp, Homo sapiens
attttaatgctgtttctaaga

SEQ ID NO: 5576973 - DNA, 19 bp, Homo sapiens
attttaatgtaaaattcat

SEQ ID NO: 5576974 - DNA, 16 bp, Homo sapiens
attttaatgtatattt

SEQ ID NO: 5576975 - DNA, 19 bp, Homo sapiens
attttaatgtatatttgct

SEQ ID NO: 5576976 - DNA, 20 bp, Homo sapiens
attttaatgtatatttgctg

SEQ ID NO: 5576977 - DNA, 13 bp, Homo sapiens
attttaatgtgaa

SEQ ID NO: 5576978 - DNA, 18 bp, Homo sapiens
attttaatgtgatgatgt

SEQ ID NO: 5576979 - DNA, 17 bp, Homo sapiens
attttaattaaaaaatc

SEQ ID NO: 5576980 - DNA, 14 bp, Homo sapiens
attttaattaaaat

SEQ ID NO: 5576981 - DNA, 13 bp, Homo sapiens
attttaattatta

SEQ ID NO: 5576982 - DNA, 22 bp, Homo sapiens
attttaattatttatatttcct

SEQ ID NO: 5576983 - DNA, 16 bp, Homo sapiens
attttaattcaagaaa

SEQ ID NO: 5576984 - DNA, 17 bp, Homo sapiens
attttaattcaagaaat

SEQ ID NO: 5576985 - DNA, 14 bp, Homo sapiens
attttaattcaggt

SEQ ID NO: 5576986 - DNA, 18 bp, Homo sapiens
attttaattcaggtgata

SEQ ID NO: 5576987 - DNA, 12 bp, Homo sapiens
attttaattcat

SEQ ID NO: 5576988 - DNA, 24 bp, Homo sapiens
attttaattcatcccaactgtctt

SEQ ID NO: 5576989 - DNA, 16 bp, Homo sapiens
attttaattggaggaa

SEQ ID NO: 5576990 - DNA, 15 bp, Homo sapiens
attttaattgtcatg

SEQ ID NO: 5576991 - DNA, 19 bp, Homo sapiens
attttaatttactgattcc

SEQ ID NO: 5576992 - DNA, 12 bp, Homo sapiens
attttaatttat

SEQ ID NO: 5576993 - DNA, 13 bp, Homo sapiens
attttaatttcaa

SEQ ID NO: 5576994 - DNA, 16 bp, Homo sapiens
attttaatttcaggaa

SEQ ID NO: 5576995 - DNA, 12 bp, Homo sapiens
attttaatttct

SEQ ID NO: 5576996 - DNA, 14 bp, Homo sapiens
attttaatttctga

SEQ ID NO: 5576997 - DNA, 19 bp, Homo sapiens
attttaatttgtattgaag

SEQ ID NO: 5576998 - DNA, 18 bp, Homo sapiens
attttaattttaaaatgt

SEQ ID NO: 5576999 - DNA, 18 bp, Homo sapiens
attttaattttaaagagt

SEQ ID NO: 5577000 - DNA, 17 bp, Homo sapiens
attttaatttttaaatg

SEQ ID NO: 5577001 - DNA, 11 bp, Homo sapiens
attttacaaaa

SEQ ID NO: 5577002 - DNA, 17 bp, Homo sapiens
attttacaaaagatgta

SEQ ID NO: 5577003 - DNA, 19 bp, Homo sapiens
attttacaaatattaagaa

SEQ ID NO: 5577004 - DNA, 20 bp, Homo sapiens
attttacaaatattaagaaa

SEQ ID NO: 5577005 - DNA, 14 bp, Homo sapiens
attttacaaattgt

SEQ ID NO: 5577006 - DNA, 22 bp, Homo sapiens
attttacaagggcataaagtaa

SEQ ID NO: 5577007 - DNA, 13 bp, Homo sapiens
attttacaattga

SEQ ID NO: 5577008 - DNA, 17 bp, Homo sapiens
attttacaattgaaatg

SEQ ID NO: 5577009 - DNA, 15 bp, Homo sapiens
attttacacaaatgt

SEQ ID NO: 5577010 - DNA, 17 bp, Homo sapiens
attttacacagaaacac

SEQ ID NO: 5577011 - DNA, 20 bp, Homo sapiens
attttacacagaaacactgc

SEQ ID NO: 5577012 - DNA, 23 bp, Homo sapiens
attttacacagaaacactgcctt

SEQ ID NO: 5577013 - DNA, 22 bp, Homo sapiens
attttacacagcaattttgtat

SEQ ID NO: 5577014 - DNA, 23 bp, Homo sapiens
attttacacagcaattttgtatc

SEQ ID NO: 5577015 - DNA, 12 bp, Homo sapiens
attttacacatt

SEQ ID NO: 5577016 - DNA, 12 bp, Homo sapiens
attttacacttg

SEQ ID NO: 5577017 - DNA, 17 bp, Homo sapiens
attttacacttgcttta

SEQ ID NO: 5577018 - DNA, 19 bp, Homo sapiens
attttacagagaatctgaa

SEQ ID NO: 5577019 - DNA, 13 bp, Homo sapiens
attttacagagct

SEQ ID NO: 5577020 - DNA, 17 bp, Homo sapiens
attttacagtaaatgtt

SEQ ID NO: 5577021 - DNA, 17 bp, Homo sapiens
attttacagtaataata

SEQ ID NO: 5577022 - DNA, 14 bp, Homo sapiens
attttacagtatct

SEQ ID NO: 5577023 - DNA, 17 bp, Homo sapiens
attttacagtatcttca

SEQ ID NO: 5577024 - DNA, 12 bp, Homo sapiens
attttacagtct

SEQ ID NO: 5577025 - DNA, 14 bp, Homo sapiens
attttacagtctct

SEQ ID NO: 5577026 - DNA, 20 bp, Homo sapiens
attttacagtctctgttgta

SEQ ID NO: 5577027 - DNA, 14 bp, Homo sapiens
attttacagttaag

SEQ ID NO: 5577028 - DNA, 16 bp, Homo sapiens
attttacattctgtct

SEQ ID NO: 5577029 - DNA, 19 bp, Homo sapiens
attttacatttagagtatt

SEQ ID NO: 5577030 - DNA, 14 bp, Homo sapiens
attttacatttcta

SEQ ID NO: 5577031 - DNA, 16 bp, Homo sapiens
attttaccaaagcatc

SEQ ID NO: 5577032 - DNA, 23 bp, Homo sapiens
attttaccaagttatataaagag

SEQ ID NO: 5577033 - DNA, 17 bp, Homo sapiens
attttaccactaatttt

SEQ ID NO: 5577034 - DNA, 20 bp, Homo sapiens
attttaccactaattttgtt

SEQ ID NO: 5577035 - DNA, 21 bp, Homo sapiens
attttaccagatgttttgatg

SEQ ID NO: 5577036 - DNA, 16 bp, Homo sapiens
attttaccagcagaag

SEQ ID NO: 5577037 - DNA, 18 bp, Homo sapiens
attttaccatatggaata

SEQ ID NO: 5577038 - DNA, 22 bp, Homo sapiens
attttaccctgaggtcactgct

SEQ ID NO: 5577039 - DNA, 19 bp, Homo sapiens
attttacctagctaattat

SEQ ID NO: 5577040 - DNA, 16 bp, Homo sapiens
attttacctattctga

SEQ ID NO: 5577041 - DNA, 19 bp, Homo sapiens
attttacctattctgaaaa

SEQ ID NO: 5577042 - DNA, 17 bp, Homo sapiens
attttacctctctctgg

SEQ ID NO: 5577043 - DNA, 15 bp, Homo sapiens
attttacctcttatt

SEQ ID NO: 5577044 - DNA, 21 bp, Homo sapiens
attttacctgggatatgacaa

SEQ ID NO: 5577045 - DNA, 22 bp, Homo sapiens
attttacctgtttttgtttctt

SEQ ID NO: 5577046 - DNA, 17 bp, Homo sapiens
attttacctttgacaaa

SEQ ID NO: 5577047 - DNA, 18 bp, Homo sapiens
attttacgttttagaaaa

SEQ ID NO: 5577048 - DNA, 18 bp, Homo sapiens
attttactaaaatcgtat

SEQ ID NO: 5577049 - DNA, 17 bp, Homo sapiens
attttactactgtggaa

SEQ ID NO: 5577050 - DNA, 16 bp, Homo sapiens
attttactacttgtta

SEQ ID NO: 5577051 - DNA, 19 bp, Homo sapiens
attttactagaaatgggaa

SEQ ID NO: 5577052 - DNA, 23 bp, Homo sapiens
attttactagaaatgggaatcat

SEQ ID NO: 5577053 - DNA, 15 bp, Homo sapiens
attttactatttggg

SEQ ID NO: 5577054 - DNA, 22 bp, Homo sapiens
attttactccataaacagactg

SEQ ID NO: 5577055 - DNA, 17 bp, Homo sapiens
attttactgattaacaa

SEQ ID NO: 5577056 - DNA, 20 bp, Homo sapiens
attttactgattaacaaata

SEQ ID NO: 5577057 - DNA, 14 bp, Homo sapiens
attttactgtctta

SEQ ID NO: 5577058 - DNA, 18 bp, Homo sapiens
attttactgtcttgaatt

SEQ ID NO: 5577059 - DNA, 14 bp, Homo sapiens
attttactgtgaaa

SEQ ID NO: 5577060 - DNA, 22 bp, Homo sapiens
attttactgttgtacaatcatg

SEQ ID NO: 5577061 - DNA, 19 bp, Homo sapiens
attttacttagctggagaa

SEQ ID NO: 5577062 - DNA, 13 bp, Homo sapiens
attttacttccat

SEQ ID NO: 5577063 - DNA, 14 bp, Homo sapiens
attttacttccatt

SEQ ID NO: 5577064 - DNA, 15 bp, Homo sapiens
attttacttgcacct

SEQ ID NO: 5577065 - DNA, 14 bp, Homo sapiens
attttactttgtac

SEQ ID NO: 5577066 - DNA, 18 bp, Homo sapiens
attttactttgtgcaata

SEQ ID NO: 5577067 - DNA, 19 bp, Homo sapiens
attttacttttctgccaaa

SEQ ID NO: 5577068 - DNA, 13 bp, Homo sapiens
attttacttttta

SEQ ID NO: 5577069 - DNA, 22 bp, Homo sapiens
attttagaaaatgtttggaatt

SEQ ID NO: 5577070 - DNA, 21 bp, Homo sapiens
attttagaaacccctctgtag

SEQ ID NO: 5577071 - DNA, 18 bp, Homo sapiens
attttagaaactacaaat

SEQ ID NO: 5577072 - DNA, 20 bp, Homo sapiens
attttagaaactacaaatat

SEQ ID NO: 5577073 - DNA, 24 bp, Homo sapiens
attttagaaactacaaatataggt

SEQ ID NO: 5577074 - DNA, 13 bp, Homo sapiens
attttagaaagaa

SEQ ID NO: 5577075 - DNA, 14 bp, Homo sapiens
attttagaaagcta

SEQ ID NO: 5577076 - DNA, 13 bp, Homo sapiens
attttagaaatat

SEQ ID NO: 5577077 - DNA, 15 bp, Homo sapiens
attttagaaatattc

SEQ ID NO: 5577078 - DNA, 19 bp, Homo sapiens
attttagaacaattttctt

SEQ ID NO: 5577079 - DNA, 20 bp, Homo sapiens
attttagaataaaattataa

SEQ ID NO: 5577080 - DNA, 16 bp, Homo sapiens
attttagacaaatcta

SEQ ID NO: 5577081 - DNA, 19 bp, Homo sapiens
attttagacactgggagaa

SEQ ID NO: 5577082 - DNA, 20 bp, Homo sapiens
attttagacgatcacagaaa

SEQ ID NO: 5577083 - DNA, 16 bp, Homo sapiens
attttagacttacctt

SEQ ID NO: 5577084 - DNA, 12 bp, Homo sapiens
attttagacttt

SEQ ID NO: 5577085 - DNA, 13 bp, Homo sapiens
attttagatatat

SEQ ID NO: 5577086 - DNA, 22 bp, Homo sapiens
attttagatggaataagagaaa

SEQ ID NO: 5577087 - DNA, 20 bp, Homo sapiens
attttagatttaccttgtta

SEQ ID NO: 5577088 - DNA, 17 bp, Homo sapiens
attttagatttctttga

SEQ ID NO: 5577089 - DNA, 23 bp, Homo sapiens
attttagcaaagcgggttataat

SEQ ID NO: 5577090 - DNA, 13 bp, Homo sapiens
attttagcagaga

SEQ ID NO: 5577091 - DNA, 15 bp, Homo sapiens
attttagcatattaa

SEQ ID NO: 5577092 - DNA, 23 bp, Homo sapiens
attttagcatgatgaaactgtca

SEQ ID NO: 5577093 - DNA, 12 bp, Homo sapiens
attttagcattt

SEQ ID NO: 5577094 - DNA, 19 bp, Homo sapiens
attttagctaggatttgaa

SEQ ID NO: 5577095 - DNA, 13 bp, Homo sapiens
attttagcttttg

SEQ ID NO: 5577096 - DNA, 11 bp, Homo sapiens
attttaggaaa

SEQ ID NO: 5577097 - DNA, 16 bp, Homo sapiens
attttaggaaagttgt

SEQ ID NO: 5577098 - DNA, 21 bp, Homo sapiens
attttaggaaatgaatgtgtg

SEQ ID NO: 5577099 - DNA, 19 bp, Homo sapiens
attttaggagctaaggctc

SEQ ID NO: 5577100 - DNA, 21 bp, Homo sapiens
attttaggagctaaggctcta

SEQ ID NO: 5577101 - DNA, 20 bp, Homo sapiens
attttaggcactcttaaatg

SEQ ID NO: 5577102 - DNA, 22 bp, Homo sapiens
attttagggtcaatgagagcca

SEQ ID NO: 5577103 - DNA, 20 bp, Homo sapiens
attttaggtcccagaatgga

SEQ ID NO: 5577104 - DNA, 17 bp, Homo sapiens
attttaggtgctgttat

SEQ ID NO: 5577105 - DNA, 22 bp, Homo sapiens
attttaggtgctgttatgtttt

SEQ ID NO: 5577106 - DNA, 15 bp, Homo sapiens
attttaggtgttgat

SEQ ID NO: 5577107 - DNA, 14 bp, Homo sapiens
attttagtacattt

SEQ ID NO: 5577108 - DNA, 17 bp, Homo sapiens
attttagtatatttata

SEQ ID NO: 5577109 - DNA, 13 bp, Homo sapiens
attttagtattca

SEQ ID NO: 5577110 - DNA, 20 bp, Homo sapiens
attttagtattcattctgca

SEQ ID NO: 5577111 - DNA, 18 bp, Homo sapiens
attttagtctgtcatcca

SEQ ID NO: 5577112 - DNA, 20 bp, Homo sapiens
attttagtctgtcatccaga

SEQ ID NO: 5577113 - DNA, 22 bp, Homo sapiens
attttagtcttgctgtttcttg

SEQ ID NO: 5577114 - DNA, 12 bp, Homo sapiens
attttagtgtat

SEQ ID NO: 5577115 - DNA, 17 bp, Homo sapiens
attttagtgtgtaaaat

SEQ ID NO: 5577116 - DNA, 19 bp, Homo sapiens
attttagtgtgtaaaatta

SEQ ID NO: 5577117 - DNA, 21 bp, Homo sapiens
attttagtgtgtaaaattaat

SEQ ID NO: 5577118 - DNA, 22 bp, Homo sapiens
attttagttatagtgtttaact

SEQ ID NO: 5577119 - DNA, 13 bp, Homo sapiens
attttagtttata

SEQ ID NO: 5577120 - DNA, 22 bp, Homo sapiens
attttagttttgtgcttagtta

SEQ ID NO: 5577121 - DNA, 20 bp, Homo sapiens
attttataaatcgcttttga

SEQ ID NO: 5577122 - DNA, 14 bp, Homo sapiens
attttataagaaaa

SEQ ID NO: 5577123 - DNA, 16 bp, Homo sapiens
attttataagaaaaac

SEQ ID NO: 5577124 - DNA, 17 bp, Homo sapiens
attttataagaaaaact

SEQ ID NO: 5577125 - DNA, 20 bp, Homo sapiens
attttataagaattttgctt

SEQ ID NO: 5577126 - DNA, 18 bp, Homo sapiens
attttataagcacagaca

SEQ ID NO: 5577127 - DNA, 20 bp, Homo sapiens
attttataaggacttcctga

SEQ ID NO: 5577128 - DNA, 19 bp, Homo sapiens
attttataatcaatgaatt

SEQ ID NO: 5577129 - DNA, 12 bp, Homo sapiens
attttataattt

SEQ ID NO: 5577130 - DNA, 14 bp, Homo sapiens
attttatacaagaa

SEQ ID NO: 5577131 - DNA, 17 bp, Homo sapiens
attttatacaagaaggg

SEQ ID NO: 5577132 - DNA, 12 bp, Homo sapiens
attttatacaat

SEQ ID NO: 5577133 - DNA, 14 bp, Homo sapiens
attttatacatagt

SEQ ID NO: 5577134 - DNA, 17 bp, Homo sapiens
attttatacatagtcac

SEQ ID NO: 5577135 - DNA, 20 bp, Homo sapiens
attttatacatagtcacaaa

SEQ ID NO: 5577136 - DNA, 15 bp, Homo sapiens
attttatacattaac

SEQ ID NO: 5577137 - DNA, 11 bp, Homo sapiens
attttatactg

SEQ ID NO: 5577138 - DNA, 18 bp, Homo sapiens
attttatagaaaatgcat

SEQ ID NO: 5577139 - DNA, 22 bp, Homo sapiens
attttatagaaaatgcattatt

SEQ ID NO: 5577140 - DNA, 19 bp, Homo sapiens
attttataggactgttctt

SEQ ID NO: 5577141 - DNA, 20 bp, Homo sapiens
attttataggactgttcttt

SEQ ID NO: 5577142 - DNA, 17 bp, Homo sapiens
attttatataaaatcca

SEQ ID NO: 5577143 - DNA, 14 bp, Homo sapiens
attttatataataa

SEQ ID NO: 5577144 - DNA, 19 bp, Homo sapiens
attttatataataaagtat

SEQ ID NO: 5577145 - DNA, 15 bp, Homo sapiens
attttatatcattgg

SEQ ID NO: 5577146 - DNA, 16 bp, Homo sapiens
attttatatcatttta

SEQ ID NO: 5577147 - DNA, 16 bp, Homo sapiens
attttcttgcctgagg

SEQ ID NO: 5577148 - DNA, 15 bp, Homo sapiens
attttcttggaattt

SEQ ID NO: 5577149 - DNA, 18 bp, Homo sapiens
attttcttgtatgatagt

SEQ ID NO: 5577150 - DNA, 15 bp, Homo sapiens
attttctttaaaaga

SEQ ID NO: 5577151 - DNA, 18 bp, Homo sapiens
attttctttaatgctttt

SEQ ID NO: 5577152 - DNA, 18 bp, Homo sapiens
attttctttatcattgct

SEQ ID NO: 5577153 - DNA, 14 bp, Homo sapiens
attttctttatgga

SEQ ID NO: 5577154 - DNA, 17 bp, Homo sapiens
attttctttctagtttg

SEQ ID NO: 5577155 - DNA, 14 bp, Homo sapiens
attttctttctatg

SEQ ID NO: 5577156 - DNA, 15 bp, Homo sapiens
attttctttctatgt

SEQ ID NO: 5577157 - DNA, 21 bp, Homo sapiens
attttctttctctactttgag

SEQ ID NO: 5577158 - DNA, 23 bp, Homo sapiens
attttctttctttttctggaaat

SEQ ID NO: 5577159 - DNA, 16 bp, Homo sapiens
attttctttctttttt

SEQ ID NO: 5577160 - DNA, 15 bp, Homo sapiens
attttctttgggggt

SEQ ID NO: 5577161 - DNA, 16 bp, Homo sapiens
attttcttttaagcat

SEQ ID NO: 5577162 - DNA, 19 bp, Homo sapiens
attttcttttaagcatttg

SEQ ID NO: 5577163 - DNA, 13 bp, Homo sapiens
attttcttttata

SEQ ID NO: 5577164 - DNA, 21 bp, Homo sapiens
attttcttttatatctgtaaa

SEQ ID NO: 5577165 - DNA, 13 bp, Homo sapiens
attttcttttctg

SEQ ID NO: 5577166 - DNA, 21 bp, Homo sapiens
attttcttttgtgcccctgct

SEQ ID NO: 5577167 - DNA, 20 bp, Homo sapiens
attttcttttgttttcttca

SEQ ID NO: 5577168 - DNA, 21 bp, Homo sapiens
attttcttttgttttcttcat

SEQ ID NO: 5577169 - DNA, 17 bp, Homo sapiens
attttctttttaaattt

SEQ ID NO: 5577170 - DNA, 17 bp, Homo sapiens
attttctttttaacttt

SEQ ID NO: 5577171 - DNA, 17 bp, Homo sapiens
attttctttttctgaag

SEQ ID NO: 5577172 - DNA, 16 bp, Homo sapiens
attttctttttcttaa

SEQ ID NO: 5577173 - DNA, 12 bp, Homo sapiens
attttctttttg

SEQ ID NO: 5577174 - DNA, 20 bp, Homo sapiens
attttcttttttgataattt

SEQ ID NO: 5577175 - DNA, 17 bp, Homo sapiens
attttctttttttaact

SEQ ID NO: 5577176 - DNA, 23 bp, Homo sapiens
attttctttttttattaaacaga

SEQ ID NO: 5577177 - DNA, 15 bp, Homo sapiens
attttgaaaaactgc

SEQ ID NO: 5577178 - DNA, 14 bp, Homo sapiens
attttgaaaaatta

SEQ ID NO: 5577179 - DNA, 17 bp, Homo sapiens
attttgaaaaattccta

SEQ ID NO: 5577180 - DNA, 18 bp, Homo sapiens
attttgaaaaattcctat

SEQ ID NO: 5577181 - DNA, 21 bp, Homo sapiens
attttgaaaacacttatttta

SEQ ID NO: 5577182 - DNA, 19 bp, Homo sapiens
attttgaaaacccctggct

SEQ ID NO: 5577183 - DNA, 18 bp, Homo sapiens
attttgaaaactacattt

SEQ ID NO: 5577184 - DNA, 12 bp, Homo sapiens
attttgaaaagt

SEQ ID NO: 5577185 - DNA, 14 bp, Homo sapiens
attttgaaaagtat

SEQ ID NO: 5577186 - DNA, 15 bp, Homo sapiens
attttgaaaagtatc

SEQ ID NO: 5577187 - DNA, 19 bp, Homo sapiens
attttgaaaggagaaaaaa

SEQ ID NO: 5577188 - DNA, 12 bp, Homo sapiens
attttgaaatga

SEQ ID NO: 5577189 - DNA, 14 bp, Homo sapiens
attttgaaatgatt

SEQ ID NO: 5577190 - DNA, 23 bp, Homo sapiens
attttgaaatgattcatctttca

SEQ ID NO: 5577191 - DNA, 17 bp, Homo sapiens
attttgaagaaaacaca

SEQ ID NO: 5577192 - DNA, 19 bp, Homo sapiens
attttgaagaaaacacaac

SEQ ID NO: 5577193 - DNA, 16 bp, Homo sapiens
attttgaagaatattt

SEQ ID NO: 5577194 - DNA, 23 bp, Homo sapiens
attttgaagaatatttaagaaaa

SEQ ID NO: 5577195 - DNA, 13 bp, Homo sapiens
attttgaagctaa

SEQ ID NO: 5577196 - DNA, 18 bp, Homo sapiens
attttgaagctaattatt

SEQ ID NO: 5577197 - DNA, 13 bp, Homo sapiens
attttgaaggaaa

SEQ ID NO: 5577198 - DNA, 13 bp, Homo sapiens
attttgaagtgct

SEQ ID NO: 5577199 - DNA, 20 bp, Homo sapiens
attttgaataaataaatgta

SEQ ID NO: 5577200 - DNA, 14 bp, Homo sapiens
attttgaataccat

SEQ ID NO: 5577201 - DNA, 15 bp, Homo sapiens
attttgaataccatt

SEQ ID NO: 5577202 - DNA, 11 bp, Homo sapiens
attttgaatca

SEQ ID NO: 5577203 - DNA, 12 bp, Homo sapiens
attttgaatcaa

SEQ ID NO: 5577204 - DNA, 15 bp, Homo sapiens
attttgaatctgtgt

SEQ ID NO: 5577205 - DNA, 13 bp, Homo sapiens
attttgaatgtac

SEQ ID NO: 5577206 - DNA, 22 bp, Homo sapiens
attttgaatgtcacaaattgat

SEQ ID NO: 5577207 - DNA, 15 bp, Homo sapiens
attttgaatgtgatc

SEQ ID NO: 5577208 - DNA, 21 bp, Homo sapiens
attttgaattagattatttct

SEQ ID NO: 5577209 - DNA, 19 bp, Homo sapiens
attttgacaaaaatgtttg

SEQ ID NO: 5577210 - DNA, 12 bp, Homo sapiens
attttgacaaca

SEQ ID NO: 5577211 - DNA, 19 bp, Homo sapiens
attttgacactatatctgt

SEQ ID NO: 5577212 - DNA, 16 bp, Homo sapiens
attttgacactgaaat

SEQ ID NO: 5577213 - DNA, 18 bp, Homo sapiens
attttgacactgaaataa

SEQ ID NO: 5577214 - DNA, 16 bp, Homo sapiens
attttgacagaagcta

SEQ ID NO: 5577215 - DNA, 18 bp, Homo sapiens
attttgacctactctcat

SEQ ID NO: 5577216 - DNA, 16 bp, Homo sapiens
attttgaccttgtatt

SEQ ID NO: 5577217 - DNA, 18 bp, Homo sapiens
attttgacggacactgtg

SEQ ID NO: 5577218 - DNA, 17 bp, Homo sapiens
attttgactgtgattta

SEQ ID NO: 5577219 - DNA, 19 bp, Homo sapiens
attttgacttagtaacttt

SEQ ID NO: 5577220 - DNA, 23 bp, Homo sapiens
attttgagaaactgctgcagatt

SEQ ID NO: 5577221 - DNA, 22 bp, Homo sapiens
attttgagaatgctgacacttt

SEQ ID NO: 5577222 - DNA, 19 bp, Homo sapiens
attttgagatgtaaaaaga

SEQ ID NO: 5577223 - DNA, 16 bp, Homo sapiens
attttgagcaaagaaa

SEQ ID NO: 5577224 - DNA, 18 bp, Homo sapiens
attttgagcaaagaaact

SEQ ID NO: 5577225 - DNA, 13 bp, Homo sapiens
attttgagcatta

SEQ ID NO: 5577226 - DNA, 20 bp, Homo sapiens
attttgagccttattaaaat

SEQ ID NO: 5577227 - DNA, 19 bp, Homo sapiens
attttgagctatttccttc

SEQ ID NO: 5577228 - DNA, 18 bp, Homo sapiens
attttgaggtaaagatat

SEQ ID NO: 5577229 - DNA, 13 bp, Homo sapiens
attttgagtgact

SEQ ID NO: 5577230 - DNA, 18 bp, Homo sapiens
attttgagtggcaaaata

SEQ ID NO: 5577231 - DNA, 21 bp, Homo sapiens
attttgagttaatttttgtat

SEQ ID NO: 5577232 - DNA, 19 bp, Homo sapiens
attttgagtttcagctgga

SEQ ID NO: 5577233 - DNA, 22 bp, Homo sapiens
attttgagtttcagctggaaac

SEQ ID NO: 5577234 - DNA, 16 bp, Homo sapiens
attttgataaattact

SEQ ID NO: 5577235 - DNA, 18 bp, Homo sapiens
attttgataataaattga

SEQ ID NO: 5577236 - DNA, 19 bp, Homo sapiens
attttgataccagaaggga

SEQ ID NO: 5577237 - DNA, 23 bp, Homo sapiens
attttgatagcaatgttccagga

SEQ ID NO: 5577238 - DNA, 17 bp, Homo sapiens
attttgatatacattgt

SEQ ID NO: 5577239 - DNA, 18 bp, Homo sapiens
attttgatatacattgtg

SEQ ID NO: 5577240 - DNA, 21 bp, Homo sapiens
attttgatcactgcattttgt

SEQ ID NO: 5577241 - DNA, 16 bp, Homo sapiens
attttgatgcagcatt

SEQ ID NO: 5577242 - DNA, 22 bp, Homo sapiens
attttgatgcagcatttgataa

SEQ ID NO: 5577243 - DNA, 24 bp, Homo sapiens
attttgatgcagcatttgataatg

SEQ ID NO: 5577244 - DNA, 17 bp, Homo sapiens
attttgatgtaaagatg

SEQ ID NO: 5577245 - DNA, 19 bp, Homo sapiens
attttgatgtattattata

SEQ ID NO: 5577246 - DNA, 18 bp, Homo sapiens
attttgatgtgacaataa

SEQ ID NO: 5577247 - DNA, 19 bp, Homo sapiens
attttgatgtgacaataat

SEQ ID NO: 5577248 - DNA, 14 bp, Homo sapiens
attttgattattgt

SEQ ID NO: 5577249 - DNA, 22 bp, Homo sapiens
attttgattattgtatttattc

SEQ ID NO: 5577250 - DNA, 18 bp, Homo sapiens
attttgattgtttgatga

SEQ ID NO: 5577251 - DNA, 20 bp, Homo sapiens
attttgattgtttgatgaat

SEQ ID NO: 5577252 - DNA, 21 bp, Homo sapiens
attttgattgtttgatgaata

SEQ ID NO: 5577253 - DNA, 21 bp, Homo sapiens
attttgatttttttgttcatt

SEQ ID NO: 5577254 - DNA, 20 bp, Homo sapiens
attttgattttttttttaaa

SEQ ID NO: 5577255 - DNA, 22 bp, Homo sapiens
attttgcaaaaatcctattctg

SEQ ID NO: 5577256 - DNA, 14 bp, Homo sapiens
attttgcaaaatga

SEQ ID NO: 5577257 - DNA, 14 bp, Homo sapiens
attttgcaaaattt

SEQ ID NO: 5577258 - DNA, 15 bp, Homo sapiens
attttgcaaaatttc

SEQ ID NO: 5577259 - DNA, 22 bp, Homo sapiens
attttgcaaacccaactaagcc

SEQ ID NO: 5577260 - DNA, 21 bp, Homo sapiens
attttgcaaagatttaatctg

SEQ ID NO: 5577261 - DNA, 17 bp, Homo sapiens
attttgcaaatctgtta

SEQ ID NO: 5577262 - DNA, 18 bp, Homo sapiens
attttgcaaggtgcattt

SEQ ID NO: 5577263 - DNA, 12 bp, Homo sapiens
attttgcacaaa

SEQ ID NO: 5577264 - DNA, 18 bp, Homo sapiens
attttgcacccactgaaa

SEQ ID NO: 5577265 - DNA, 18 bp, Homo sapiens
attttgcactctgtaatt

SEQ ID NO: 5577266 - DNA, 12 bp, Homo sapiens
attttgcactgt

SEQ ID NO: 5577267 - DNA, 15 bp, Homo sapiens
attttgcagaaggaa

SEQ ID NO: 5577268 - DNA, 21 bp, Homo sapiens
attttgcagaaggaaatgatg

SEQ ID NO: 5577269 - DNA, 16 bp, Homo sapiens
attttgcagcagtgag

SEQ ID NO: 5577270 - DNA, 12 bp, Homo sapiens
attttgcataaa

SEQ ID NO: 5577271 - DNA, 15 bp, Homo sapiens
attttgcataataaa

SEQ ID NO: 5577272 - DNA, 12 bp, Homo sapiens
attttgcatact

SEQ ID NO: 5577273 - DNA, 19 bp, Homo sapiens
attttgcatatatgttctt

SEQ ID NO: 5577274 - DNA, 20 bp, Homo sapiens
attttgcatatccttttagt

SEQ ID NO: 5577275 - DNA, 15 bp, Homo sapiens
attttgcattccaga

SEQ ID NO: 5577276 - DNA, 19 bp, Homo sapiens
attttgcattccagaatct

SEQ ID NO: 5577277 - DNA, 14 bp, Homo sapiens
attttgcatttagt

SEQ ID NO: 5577278 - DNA, 15 bp, Homo sapiens
attttgcatttagtt

SEQ ID NO: 5577279 - DNA, 18 bp, Homo sapiens
attttgccagtgggaact

SEQ ID NO: 5577280 - DNA, 21 bp, Homo sapiens
attttgcccaacctaatgctc

SEQ ID NO: 5577281 - DNA, 17 bp, Homo sapiens
attttgccctcctgccc

SEQ ID NO: 5577282 - DNA, 22 bp, Homo sapiens
attttgcccttccatagcctaa

SEQ ID NO: 5577283 - DNA, 23 bp, Homo sapiens
attttgcccttgacaaagtcaag

SEQ ID NO: 5577284 - DNA, 23 bp, Homo sapiens
attttgcctaatacattaaagca

SEQ ID NO: 5577285 - DNA, 18 bp, Homo sapiens
attttgcctcttttctct

SEQ ID NO: 5577286 - DNA, 15 bp, Homo sapiens
attttgcctgagtgt

SEQ ID NO: 5577287 - DNA, 13 bp, Homo sapiens
attttgcctttaa

SEQ ID NO: 5577288 - DNA, 17 bp, Homo sapiens
attttgcgatgtgtttt

SEQ ID NO: 5577289 - DNA, 17 bp, Homo sapiens
attttgcgtcagagaaa

SEQ ID NO: 5577290 - DNA, 12 bp, Homo sapiens
attttgctaact

SEQ ID NO: 5577291 - DNA, 16 bp, Homo sapiens
attttgctaactgggt

SEQ ID NO: 5577292 - DNA, 17 bp, Homo sapiens
attttgctaactgggtt

SEQ ID NO: 5577293 - DNA, 18 bp, Homo sapiens
attttgctaactgggtta

SEQ ID NO: 5577294 - DNA, 20 bp, Homo sapiens
attttgctaactgggttaaa

SEQ ID NO: 5577295 - DNA, 19 bp, Homo sapiens
attttgctaactggttaaa

SEQ ID NO: 5577296 - DNA, 21 bp, Homo sapiens
attttgctaccaaagaatgca

SEQ ID NO: 5577297 - DNA, 19 bp, Homo sapiens
attttgctatcaacaataa

SEQ ID NO: 5577298 - DNA, 19 bp, Homo sapiens
attttgctattgtaaatat

SEQ ID NO: 5577299 - DNA, 22 bp, Homo sapiens
attttgctattgtaaatatgtt

SEQ ID NO: 5577300 - DNA, 13 bp, Homo sapiens
attttgctcttgt

SEQ ID NO: 5577301 - DNA, 21 bp, Homo sapiens
attttgctgactttaaaagga

SEQ ID NO: 5577302 - DNA, 20 bp, Homo sapiens
attttgctgagttgttctaa

SEQ ID NO: 5577303 - DNA, 20 bp, Homo sapiens
attttgctgcttgatgatga

SEQ ID NO: 5577304 - DNA, 15 bp, Homo sapiens
attttgctggagact

SEQ ID NO: 5577305 - DNA, 14 bp, Homo sapiens
attttgcttcccat

SEQ ID NO: 5577306 - DNA, 18 bp, Homo sapiens
attttgcttctctttcta

SEQ ID NO: 5577307 - DNA, 11 bp, Homo sapiens
attttgcttta

SEQ ID NO: 5577308 - DNA, 13 bp, Homo sapiens
attttgctttggt

SEQ ID NO: 5577309 - DNA, 19 bp, Homo sapiens
attttgctttggttaaaaa

SEQ ID NO: 5577310 - DNA, 22 bp, Homo sapiens
attttgctttgtctttctctcc

SEQ ID NO: 5577311 - DNA, 16 bp, Homo sapiens
attttggaaaaatgtc

SEQ ID NO: 5577312 - DNA, 19 bp, Homo sapiens
attttggaaagtttttgta

SEQ ID NO: 5577313 - DNA, 13 bp, Homo sapiens
attttggaaattg

SEQ ID NO: 5577314 - DNA, 18 bp, Homo sapiens
attttggaaattgttgta

SEQ ID NO: 5577315 - DNA, 21 bp, Homo sapiens
attttggaactgtgtttcaaa

SEQ ID NO: 5577316 - DNA, 19 bp, Homo sapiens
attttggaagaattcatga

SEQ ID NO: 5577317 - DNA, 15 bp, Homo sapiens
attttggaagacata

SEQ ID NO: 5577318 - DNA, 16 bp, Homo sapiens
attttggaagacatat

SEQ ID NO: 5577319 - DNA, 20 bp, Homo sapiens
attttggaagttttcaggac

SEQ ID NO: 5577320 - DNA, 20 bp, Homo sapiens
attttggaataatttctatt

SEQ ID NO: 5577321 - DNA, 22 bp, Homo sapiens
attttggaataatttctattaa

SEQ ID NO: 5577322 - DNA, 18 bp, Homo sapiens
attttggactgagatttc

SEQ ID NO: 5577323 - DNA, 14 bp, Homo sapiens
attttggagaaatt

SEQ ID NO: 5577324 - DNA, 14 bp, Homo sapiens
atttttcaaataga

SEQ ID NO: 5577325 - DNA, 16 bp, Homo sapiens
atttttcaaatagatt

SEQ ID NO: 5577326 - DNA, 21 bp, Homo sapiens
atttttcaacaaatatcttgt

SEQ ID NO: 5577327 - DNA, 22 bp, Homo sapiens
atttttcaacatttttttttct

SEQ ID NO: 5577328 - DNA, 20 bp, Homo sapiens
atttttcaaccagcatttta

SEQ ID NO: 5577329 - DNA, 15 bp, Homo sapiens
atttttcaacttgga

SEQ ID NO: 5577330 - DNA, 13 bp, Homo sapiens
atttttcaacttt

SEQ ID NO: 5577331 - DNA, 23 bp, Homo sapiens
atttttcaactttgaataaagaa

SEQ ID NO: 5577332 - DNA, 17 bp, Homo sapiens
atttttcaataaagcat

SEQ ID NO: 5577333 - DNA, 21 bp, Homo sapiens
atttttcaataaagcatttat

SEQ ID NO: 5577334 - DNA, 17 bp, Homo sapiens
atttttcaataataaaa

SEQ ID NO: 5577335 - DNA, 19 bp, Homo sapiens
atttttcaatagcgtgtgt

SEQ ID NO: 5577336 - DNA, 14 bp, Homo sapiens
atttttcaatatat

SEQ ID NO: 5577337 - DNA, 22 bp, Homo sapiens
atttttcaatatattgaacttt

SEQ ID NO: 5577338 - DNA, 14 bp, Homo sapiens
atttttcaatattt

SEQ ID NO: 5577339 - DNA, 11 bp, Homo sapiens
atttttcaatc

SEQ ID NO: 5577340 - DNA, 15 bp, Homo sapiens
atttttcacatatct

SEQ ID NO: 5577341 - DNA, 18 bp, Homo sapiens
atttttcacatatctagt

SEQ ID NO: 5577342 - DNA, 16 bp, Homo sapiens
atttttcagatataaa

SEQ ID NO: 5577343 - DNA, 12 bp, Homo sapiens
atttttcagcag

SEQ ID NO: 5577344 - DNA, 18 bp, Homo sapiens
atttttcagctctctgta

SEQ ID NO: 5577345 - DNA, 16 bp, Homo sapiens
atttttcagtagcagg

SEQ ID NO: 5577346 - DNA, 17 bp, Homo sapiens
atttttcatacttttct

SEQ ID NO: 5577347 - DNA, 22 bp, Homo sapiens
atttttcatcagtcatcactct

SEQ ID NO: 5577348 - DNA, 18 bp, Homo sapiens
atttttcatctcttcaat

SEQ ID NO: 5577349 - DNA, 18 bp, Homo sapiens
atttttcatgataatgaa

SEQ ID NO: 5577350 - DNA, 15 bp, Homo sapiens
atttttccaaaataa

SEQ ID NO: 5577351 - DNA, 21 bp, Homo sapiens
atttttccaactactaataga

SEQ ID NO: 5577352 - DNA, 21 bp, Homo sapiens
atttttccacactatgtgtgt

SEQ ID NO: 5577353 - DNA, 18 bp, Homo sapiens
atttttccaggactcttt

SEQ ID NO: 5577354 - DNA, 14 bp, Homo sapiens
atttttccatgtgt

SEQ ID NO: 5577355 - DNA, 20 bp, Homo sapiens
atttttccatttatttatga

SEQ ID NO: 5577356 - DNA, 19 bp, Homo sapiens
atttttcccaggcaaataa

SEQ ID NO: 5577357 - DNA, 23 bp, Homo sapiens
atttttcctatgctattgacaat

SEQ ID NO: 5577358 - DNA, 13 bp, Homo sapiens
atttttcctcaaa

SEQ ID NO: 5577359 - DNA, 12 bp, Homo sapiens
atttttcctttc

SEQ ID NO: 5577360 - DNA, 23 bp, Homo sapiens
atttttcggaggccccactgatg

SEQ ID NO: 5577361 - DNA, 12 bp, Homo sapiens
atttttctaaaa

SEQ ID NO: 5577362 - DNA, 17 bp, Homo sapiens
atttttctaaaaaaaga

SEQ ID NO: 5577363 - DNA, 16 bp, Homo sapiens
atttttctaaacgtaa

SEQ ID NO: 5577364 - DNA, 14 bp, Homo sapiens
atttttctaaagaa

SEQ ID NO: 5577365 - DNA, 17 bp, Homo sapiens
atttttctaaccttgaa

SEQ ID NO: 5577366 - DNA, 18 bp, Homo sapiens
atttttctaaccttgaat

SEQ ID NO: 5577367 - DNA, 12 bp, Homo sapiens
atttttctaact

SEQ ID NO: 5577368 - DNA, 19 bp, Homo sapiens
atttttctaagtgtaacct

SEQ ID NO: 5577369 - DNA, 17 bp, Homo sapiens
atttttctataaatcag

SEQ ID NO: 5577370 - DNA, 18 bp, Homo sapiens
atttttctataaatcagt

SEQ ID NO: 5577371 - DNA, 16 bp, Homo sapiens
atttttctatctggtt

SEQ ID NO: 5577372 - DNA, 12 bp, Homo sapiens
atttttctcatg

SEQ ID NO: 5577373 - DNA, 21 bp, Homo sapiens
atttttctcccaagaaacctg

SEQ ID NO: 5577374 - DNA, 10 bp, Homo sapiens
atttttctct

SEQ ID NO: 5577375 - DNA, 11 bp, Homo sapiens
atttttctctc

SEQ ID NO: 5577376 - DNA, 14 bp, Homo sapiens
atttttctcttcat

SEQ ID NO: 5577377 - DNA, 15 bp, Homo sapiens
atttttctgactttt

SEQ ID NO: 5577378 - DNA, 19 bp, Homo sapiens
atttttctgccctgggttc

SEQ ID NO: 5577379 - DNA, 19 bp, Homo sapiens
atttttctgggaagaaaat

SEQ ID NO: 5577380 - DNA, 19 bp, Homo sapiens
atttttctgggcttttcct

SEQ ID NO: 5577381 - DNA, 14 bp, Homo sapiens
atttttctgtactt

SEQ ID NO: 5577382 - DNA, 22 bp, Homo sapiens
atttttctgttggtcttaacta

SEQ ID NO: 5577383 - DNA, 22 bp, Homo sapiens
atttttcttagggaaggataca

SEQ ID NO: 5577384 - DNA, 15 bp, Homo sapiens
atttttcttatttat

SEQ ID NO: 5577385 - DNA, 17 bp, Homo sapiens
atttttcttatttatgt

SEQ ID NO: 5577386 - DNA, 22 bp, Homo sapiens
atttttcttatttatgtaacaa

SEQ ID NO: 5577387 - DNA, 15 bp, Homo sapiens
atttttcttatttca

SEQ ID NO: 5577388 - DNA, 19 bp, Homo sapiens
atttttcttatttcatttc

SEQ ID NO: 5577389 - DNA, 15 bp, Homo sapiens
atttttcttcagact

SEQ ID NO: 5577390 - DNA, 20 bp, Homo sapiens
atttttcttgttgcatcttt

SEQ ID NO: 5577391 - DNA, 16 bp, Homo sapiens
atttttctttaaagcc

SEQ ID NO: 5577392 - DNA, 18 bp, Homo sapiens
atttttctttaaagccag

SEQ ID NO: 5577393 - DNA, 14 bp, Homo sapiens
atttttctttacaa

SEQ ID NO: 5577394 - DNA, 23 bp, Homo sapiens
atttttctttagtcatttaagaa

SEQ ID NO: 5577395 - DNA, 23 bp, Homo sapiens
atttttcttttaagccctgctct

SEQ ID NO: 5577396 - DNA, 16 bp, Homo sapiens
atttttctttttaaga

SEQ ID NO: 5577397 - DNA, 17 bp, Homo sapiens
atttttgaaaaaagtac

SEQ ID NO: 5577398 - DNA, 17 bp, Homo sapiens
atttttgaaaaatattg

SEQ ID NO: 5577399 - DNA, 19 bp, Homo sapiens
atttttgaaaaatattgct

SEQ ID NO: 5577400 - DNA, 18 bp, Homo sapiens
atttttgaaactgcattt

SEQ ID NO: 5577401 - DNA, 14 bp, Homo sapiens
atttttgaataaaa

SEQ ID NO: 5577402 - DNA, 22 bp, Homo sapiens
atttttgaatgtagtaagtaaa

SEQ ID NO: 5577403 - DNA, 17 bp, Homo sapiens
atttttgaatgtgattt

SEQ ID NO: 5577404 - DNA, 15 bp, Homo sapiens
atttttgaattcttt

SEQ ID NO: 5577405 - DNA, 16 bp, Homo sapiens
atttttgaattcttta

SEQ ID NO: 5577406 - DNA, 14 bp, Homo sapiens
atttttgacacttt

SEQ ID NO: 5577407 - DNA, 14 bp, Homo sapiens
atttttgacagaat

SEQ ID NO: 5577408 - DNA, 21 bp, Homo sapiens
atttttgacagactatttgct

SEQ ID NO: 5577409 - DNA, 22 bp, Homo sapiens
atttttgagcaggagcagaaag

SEQ ID NO: 5577410 - DNA, 19 bp, Homo sapiens
atttttgaggaattatcat

SEQ ID NO: 5577411 - DNA, 15 bp, Homo sapiens
atttttgagtaaaac

SEQ ID NO: 5577412 - DNA, 14 bp, Homo sapiens
atttttgagttaca

SEQ ID NO: 5577413 - DNA, 18 bp, Homo sapiens
atttttgatagactgaag

SEQ ID NO: 5577414 - DNA, 19 bp, Homo sapiens
atttttgatatctcaatct

SEQ ID NO: 5577415 - DNA, 17 bp, Homo sapiens
atttttgatcaatgtat

SEQ ID NO: 5577416 - DNA, 20 bp, Homo sapiens
atttttgatcaatgtatatg

SEQ ID NO: 5577417 - DNA, 13 bp, Homo sapiens
atttttgattcag

SEQ ID NO: 5577418 - DNA, 12 bp, Homo sapiens
atttttgcaata

SEQ ID NO: 5577419 - DNA, 17 bp, Homo sapiens
atttttgcaataatgca

SEQ ID NO: 5577420 - DNA, 20 bp, Homo sapiens
atttttgcactggaatatct

SEQ ID NO: 5577421 - DNA, 21 bp, Homo sapiens
atttttgcactggaatatctg

SEQ ID NO: 5577422 - DNA, 14 bp, Homo sapiens
atttttgcaggagc

SEQ ID NO: 5577423 - DNA, 13 bp, Homo sapiens
atttttgccaaaa

SEQ ID NO: 5577424 - DNA, 15 bp, Homo sapiens
atttttgccatacat

SEQ ID NO: 5577425 - DNA, 17 bp, Homo sapiens
atttttgcctatcttta

SEQ ID NO: 5577426 - DNA, 18 bp, Homo sapiens
atttttgcctatctttaa

SEQ ID NO: 5577427 - DNA, 16 bp, Homo sapiens
atttttgctcttctgt

SEQ ID NO: 5577428 - DNA, 14 bp, Homo sapiens
atttttgctgtttt

SEQ ID NO: 5577429 - DNA, 15 bp, Homo sapiens
atttttgcttaacat

SEQ ID NO: 5577430 - DNA, 16 bp, Homo sapiens
atttttgcttaacatt

SEQ ID NO: 5577431 - DNA, 15 bp, Homo sapiens
atttttgcttttaga

SEQ ID NO: 5577432 - DNA, 18 bp, Homo sapiens
atttttgcttttagaaaa

SEQ ID NO: 5577433 - DNA, 20 bp, Homo sapiens
atttttgcttttagaaaagg

SEQ ID NO: 5577434 - DNA, 23 bp, Homo sapiens
atttttggagaaatgtcataaat

SEQ ID NO: 5577435 - DNA, 17 bp, Homo sapiens
atttttggaggtttatt

SEQ ID NO: 5577436 - DNA, 18 bp, Homo sapiens
atttttggattgacagta

SEQ ID NO: 5577437 - DNA, 15 bp, Homo sapiens
atttttggcaaagcc

SEQ ID NO: 5577438 - DNA, 16 bp, Homo sapiens
atttttggcattcctc

SEQ ID NO: 5577439 - DNA, 17 bp, Homo sapiens
atttttggcattcctct

SEQ ID NO: 5577440 - DNA, 21 bp, Homo sapiens
atttttggggggagtaaagaa

SEQ ID NO: 5577441 - DNA, 15 bp, Homo sapiens
atttttggtatttat

SEQ ID NO: 5577442 - DNA, 17 bp, Homo sapiens
atttttggtatttatgt

SEQ ID NO: 5577443 - DNA, 19 bp, Homo sapiens
atttttggttgaataaact

SEQ ID NO: 5577444 - DNA, 16 bp, Homo sapiens
atttttgtaaaaaggg

SEQ ID NO: 5577445 - DNA, 22 bp, Homo sapiens
atttttgtaaaaagggaaaaag

SEQ ID NO: 5577446 - DNA, 19 bp, Homo sapiens
atttttgtaaactggaatt

SEQ ID NO: 5577447 - DNA, 15 bp, Homo sapiens
atttttgtaaagttt

SEQ ID NO: 5577448 - DNA, 17 bp, Homo sapiens
atttttgtaaagtttcc

SEQ ID NO: 5577449 - DNA, 13 bp, Homo sapiens
atttttgtaaatg

SEQ ID NO: 5577450 - DNA, 19 bp, Homo sapiens
atttttgtaaatgtgtaca

SEQ ID NO: 5577451 - DNA, 13 bp, Homo sapiens
atttttgtaataa

SEQ ID NO: 5577452 - DNA, 18 bp, Homo sapiens
atttttgtaataaaaggt

SEQ ID NO: 5577453 - DNA, 23 bp, Homo sapiens
atttttgtaataaaaggtatgaa

SEQ ID NO: 5577454 - DNA, 21 bp, Homo sapiens
atttttgtaataacatttaat

SEQ ID NO: 5577455 - DNA, 21 bp, Homo sapiens
atttttgtaatgtgaaaagta

SEQ ID NO: 5577456 - DNA, 12 bp, Homo sapiens
atttttgtacag

SEQ ID NO: 5577457 - DNA, 12 bp, Homo sapiens
atttttgtacat

SEQ ID NO: 5577458 - DNA, 13 bp, Homo sapiens
atttttgtacata

SEQ ID NO: 5577459 - DNA, 17 bp, Homo sapiens
atttttgtacatattgt

SEQ ID NO: 5577460 - DNA, 14 bp, Homo sapiens
atttttgtacatcc

SEQ ID NO: 5577461 - DNA, 14 bp, Homo sapiens
atttttgtacatta

SEQ ID NO: 5577462 - DNA, 19 bp, Homo sapiens
atttttgtacattacacta

SEQ ID NO: 5577463 - DNA, 23 bp, Homo sapiens
atttttgtacattacactaaatt

SEQ ID NO: 5577464 - DNA, 19 bp, Homo sapiens
atttttgtacattatgtta

SEQ ID NO: 5577465 - DNA, 20 bp, Homo sapiens
atttttgtacccttcctaca

SEQ ID NO: 5577466 - DNA, 14 bp, Homo sapiens
atttttgtactgtg

SEQ ID NO: 5577467 - DNA, 16 bp, Homo sapiens
atttttgtactgtgct

SEQ ID NO: 5577468 - DNA, 19 bp, Homo sapiens
atttttgtactgtgctgat

SEQ ID NO: 5577469 - DNA, 12 bp, Homo sapiens
atttttgtactt

SEQ ID NO: 5577470 - DNA, 15 bp, Homo sapiens
atttttgtagtagcg

SEQ ID NO: 5577471 - DNA, 13 bp, Homo sapiens
atttttgtatgtc

SEQ ID NO: 5577472 - DNA, 19 bp, Homo sapiens
atttttgtattcaattaaa

SEQ ID NO: 5577473 - DNA, 18 bp, Homo sapiens
atttttgtattttgtaca

SEQ ID NO: 5577474 - DNA, 19 bp, Homo sapiens
atttttgtatttttagtag

SEQ ID NO: 5577475 - DNA, 20 bp, Homo sapiens
atttttgtcacggaaagcat

SEQ ID NO: 5577476 - DNA, 23 bp, Homo sapiens
atttttgtcattttaaaatctga

SEQ ID NO: 5577477 - DNA, 17 bp, Homo sapiens
atttttgtccctgctcc

SEQ ID NO: 5577478 - DNA, 15 bp, Homo sapiens
atttttgtctgcagc

SEQ ID NO: 5577479 - DNA, 14 bp, Homo sapiens
atttttgtcttgtg

SEQ ID NO: 5577480 - DNA, 21 bp, Homo sapiens
atttttgtctttatctcaagt

SEQ ID NO: 5577481 - DNA, 20 bp, Homo sapiens
atttttgtggcatgttgtaa

SEQ ID NO: 5577482 - DNA, 12 bp, Homo sapiens
atttttgtgtat

SEQ ID NO: 5577483 - DNA, 22 bp, Homo sapiens
atttttgtgtcatttattcaag

SEQ ID NO: 5577484 - DNA, 15 bp, Homo sapiens
atttttgtgtttcta

SEQ ID NO: 5577485 - DNA, 22 bp, Homo sapiens
atttttgtgtttgaaagtgaaa

SEQ ID NO: 5577486 - DNA, 18 bp, Homo sapiens
atttttgtgttttcttgt

SEQ ID NO: 5577487 - DNA, 19 bp, Homo sapiens
atttttgtgttttcttgta

SEQ ID NO: 5577488 - DNA, 20 bp, Homo sapiens
atttttgtgttttcttgtaa

SEQ ID NO: 5577489 - DNA, 12 bp, Homo sapiens
atttttgttaat

SEQ ID NO: 5577490 - DNA, 20 bp, Homo sapiens
atttttgttagtttacaata

SEQ ID NO: 5577491 - DNA, 18 bp, Homo sapiens
atttttgttgcagtgtag

SEQ ID NO: 5577492 - DNA, 12 bp, Homo sapiens
atttttgttgtt

SEQ ID NO: 5577493 - DNA, 19 bp, Homo sapiens
atttttgtttggactgttt

SEQ ID NO: 5577494 - DNA, 21 bp, Homo sapiens
atttttgttttcattatctca

SEQ ID NO: 5577495 - DNA, 22 bp, Homo sapiens
atttttgttttccactgtgcta

SEQ ID NO: 5577496 - DNA, 14 bp, Homo sapiens
atttttgttttccc

SEQ ID NO: 5577497 - DNA, 15 bp, Homo sapiens
atttttgttttcccc

SEQ ID NO: 5577498 - DNA, 16 bp, Homo sapiens
atttttgttttcccca

SEQ ID NO: 5577499 - DNA, 14 bp, Homo sapiens
atttttgttttgaa

SEQ ID NO: 5577500 - DNA, 21 bp, Homo sapiens
atttttgtttttggtttctta

SEQ ID NO: 5577501 - DNA, 17 bp, Homo sapiens
atttttgtttttgtaat

SEQ ID NO: 5577502 - DNA, 23 bp, Homo sapiens
atttttgtttttgtctttttcct

SEQ ID NO: 5577503 - DNA, 21 bp, Homo sapiens
caaaaatattttatgatccag

SEQ ID NO: 5577504 - DNA, 22 bp, Homo sapiens
caaaaatattttgcaagctctg

SEQ ID NO: 5577505 - DNA, 18 bp, Homo sapiens
caaaaatcaaagaacaga

SEQ ID NO: 5577506 - DNA, 19 bp, Homo sapiens
caaaaatcaacctatcaaa

SEQ ID NO: 5577507 - DNA, 15 bp, Homo sapiens
caaaaatcagcagat

SEQ ID NO: 5577508 - DNA, 14 bp, Homo sapiens
caaaaatcatcaaa

SEQ ID NO: 5577509 - DNA, 19 bp, Homo sapiens
caaaaatcattaacacttt

SEQ ID NO: 5577510 - DNA, 19 bp, Homo sapiens
caaaaatctcccagtgaca

SEQ ID NO: 5577511 - DNA, 17 bp, Homo sapiens
caaaaatctgaagattg

SEQ ID NO: 5577512 - DNA, 20 bp, Homo sapiens
caaaaatctgaagattgttt

SEQ ID NO: 5577513 - DNA, 13 bp, Homo sapiens
caaaaatgaattc

SEQ ID NO: 5577514 - DNA, 17 bp, Homo sapiens
caaaaatgacaacagaa

SEQ ID NO: 5577515 - DNA, 21 bp, Homo sapiens
caaaaatgacaacagaaaaac

SEQ ID NO: 5577516 - DNA, 16 bp, Homo sapiens
caaaaatgactctaaa

SEQ ID NO: 5577517 - DNA, 19 bp, Homo sapiens
caaaaatgatcctcagtgc

SEQ ID NO: 5577518 - DNA, 13 bp, Homo sapiens
caaaaatgatttt

SEQ ID NO: 5577519 - DNA, 23 bp, Homo sapiens
caaaaatgggaaaaataaaagaa

SEQ ID NO: 5577520 - DNA, 22 bp, Homo sapiens
caaaaatggtgagcgatcattt

SEQ ID NO: 5577521 - DNA, 21 bp, Homo sapiens
caaaaatggtggtttgtcata

SEQ ID NO: 5577522 - DNA, 20 bp, Homo sapiens
caaaaatgtaaaaaacaaaa

SEQ ID NO: 5577523 - DNA, 13 bp, Homo sapiens
caaaaatgtgcct

SEQ ID NO: 5577524 - DNA, 14 bp, Homo sapiens
caaaaatgttccct

SEQ ID NO: 5577525 - DNA, 21 bp, Homo sapiens
caaaaatgttcccttgaccat

SEQ ID NO: 5577526 - DNA, 13 bp, Homo sapiens
caaaaatgttgaa

SEQ ID NO: 5577527 - DNA, 14 bp, Homo sapiens
caaaaatgtttgta

SEQ ID NO: 5577528 - DNA, 15 bp, Homo sapiens
caaaaatgtttgtac

SEQ ID NO: 5577529 - DNA, 13 bp, Homo sapiens
caaaaattaaaat

SEQ ID NO: 5577530 - DNA, 18 bp, Homo sapiens
caaaaattaaatatatat

SEQ ID NO: 5577531 - DNA, 14 bp, Homo sapiens
caaaaattagccgg

SEQ ID NO: 5577532 - DNA, 15 bp, Homo sapiens
caaaaattagccggg

SEQ ID NO: 5577533 - DNA, 17 bp, Homo sapiens
caaaaattagccgggca

SEQ ID NO: 5577534 - DNA, 16 bp, Homo sapiens
caaaaattaggtattt

SEQ ID NO: 5577535 - DNA, 18 bp, Homo sapiens
caaaaattaggtattttg

SEQ ID NO: 5577536 - DNA, 15 bp, Homo sapiens
caaaaattatgcaat

SEQ ID NO: 5577537 - DNA, 22 bp, Homo sapiens
caaaaattatgcaattcagtgt

SEQ ID NO: 5577538 - DNA, 12 bp, Homo sapiens
caaaaattatta

SEQ ID NO: 5577539 - DNA, 23 bp, Homo sapiens
caaaaattcacaagctgcctccc

SEQ ID NO: 5577540 - DNA, 23 bp, Homo sapiens
caaaaattcagagtccttgcaaa

SEQ ID NO: 5577541 - DNA, 14 bp, Homo sapiens
caaaaattgccaag

SEQ ID NO: 5577542 - DNA, 16 bp, Homo sapiens
caaaaatttgacattg

SEQ ID NO: 5577543 - DNA, 16 bp, Homo sapiens
caaaaattttgtgaca

SEQ ID NO: 5577544 - DNA, 22 bp, Homo sapiens
caaaaatttttggattgacagt

SEQ ID NO: 5577545 - DNA, 11 bp, Homo sapiens
caaaacaaaaa

SEQ ID NO: 5577546 - DNA, 21 bp, Homo sapiens
caaaacaaaaaaacccagggg

SEQ ID NO: 5577547 - DNA, 18 bp, Homo sapiens
caaaacaaaaagatgtct

SEQ ID NO: 5577548 - DNA, 19 bp, Homo sapiens
caaaacaaaacaaaacaaa

SEQ ID NO: 5577549 - DNA, 15 bp, Homo sapiens
caaaacaaaacaaac

SEQ ID NO: 5577550 - DNA, 16 bp, Homo sapiens
caaaacaaaacaaact

SEQ ID NO: 5577551 - DNA, 10 bp, Homo sapiens
caaaacaaac

SEQ ID NO: 5577552 - DNA, 21 bp, Homo sapiens
caaaacaaacaaaaaaaagaa

SEQ ID NO: 5577553 - DNA, 16 bp, Homo sapiens
caaaacaaacaaacac

SEQ ID NO: 5577554 - DNA, 14 bp, Homo sapiens
caaaacaaactcat

SEQ ID NO: 5577555 - DNA, 13 bp, Homo sapiens
caaaacaaacttc

SEQ ID NO: 5577556 - DNA, 21 bp, Homo sapiens
caaaacaaagcaattctttca

SEQ ID NO: 5577557 - DNA, 16 bp, Homo sapiens
caaaacaaaggcctaa

SEQ ID NO: 5577558 - DNA, 22 bp, Homo sapiens
caaaacaaaggcctaattctat

SEQ ID NO: 5577559 - DNA, 15 bp, Homo sapiens
caaaacaaagtcttt

SEQ ID NO: 5577560 - DNA, 16 bp, Homo sapiens
caaaacaaagtctttg

SEQ ID NO: 5577561 - DNA, 18 bp, Homo sapiens
caaaacaacaaaaaccaa

SEQ ID NO: 5577562 - DNA, 12 bp, Homo sapiens
caaaacaacaac

SEQ ID NO: 5577563 - DNA, 16 bp, Homo sapiens
caaaacaacagcaaca

SEQ ID NO: 5577564 - DNA, 19 bp, Homo sapiens
caaaacaaccatcctgctc

SEQ ID NO: 5577565 - DNA, 23 bp, Homo sapiens
caaaacaagagcctgattttttg

SEQ ID NO: 5577566 - DNA, 16 bp, Homo sapiens
caaaacaagcctggta

SEQ ID NO: 5577567 - DNA, 23 bp, Homo sapiens
caaaacaagtgacatgaagggag

SEQ ID NO: 5577568 - DNA, 15 bp, Homo sapiens
caaaacaatctattt

SEQ ID NO: 5577569 - DNA, 16 bp, Homo sapiens
caaaacaatctattta

SEQ ID NO: 5577570 - DNA, 14 bp, Homo sapiens
caaaacaatggtgt

SEQ ID NO: 5577571 - DNA, 16 bp, Homo sapiens
caaaacaatgtttaaa

SEQ ID NO: 5577572 - DNA, 19 bp, Homo sapiens
caaaacaccaaagaattgt

SEQ ID NO: 5577573 - DNA, 20 bp, Homo sapiens
caaaacacctgacagcccct

SEQ ID NO: 5577574 - DNA, 23 bp, Homo sapiens
caaaacactcattcttttttcta

SEQ ID NO: 5577575 - DNA, 11 bp, Homo sapiens
caaaacactgt

SEQ ID NO: 5577576 - DNA, 16 bp, Homo sapiens
caaaacactgtggaac

SEQ ID NO: 5577577 - DNA, 15 bp, Homo sapiens
caaaacacttaggaa

SEQ ID NO: 5577578 - DNA, 21 bp, Homo sapiens
caaaacacttaggaagaaatc

SEQ ID NO: 5577579 - DNA, 21 bp, Homo sapiens
caaaacagatggtagagagag

SEQ ID NO: 5577580 - DNA, 22 bp, Homo sapiens
caaaacagctttgtctccaaag

SEQ ID NO: 5577581 - DNA, 20 bp, Homo sapiens
caaaacaggaggggaaaaaa

SEQ ID NO: 5577582 - DNA, 21 bp, Homo sapiens
caaaacagtattgacttgtat

SEQ ID NO: 5577583 - DNA, 23 bp, Homo sapiens
caaaacatagctggttaaccttg

SEQ ID NO: 5577584 - DNA, 15 bp, Homo sapiens
caaaacatatcaatt

SEQ ID NO: 5577585 - DNA, 16 bp, Homo sapiens
caaaacatattttaca

SEQ ID NO: 5577586 - DNA, 17 bp, Homo sapiens
caaaacatctctgcagt

SEQ ID NO: 5577587 - DNA, 22 bp, Homo sapiens
caaaacatgctacctgatccca

SEQ ID NO: 5577588 - DNA, 13 bp, Homo sapiens
caaaacattccaa

SEQ ID NO: 5577589 - DNA, 15 bp, Homo sapiens
caaaacattccgttt

SEQ ID NO: 5577590 - DNA, 22 bp, Homo sapiens
caaaacatttaaataaaacttt

SEQ ID NO: 5577591 - DNA, 14 bp, Homo sapiens
caaaacatttctaa

SEQ ID NO: 5577592 - DNA, 12 bp, Homo sapiens
caaaaccaaaca

SEQ ID NO: 5577593 - DNA, 14 bp, Homo sapiens
caaaaccaaactgg

SEQ ID NO: 5577594 - DNA, 22 bp, Homo sapiens
caaaaccaaacttgttcattta

SEQ ID NO: 5577595 - DNA, 14 bp, Homo sapiens
caaaaccaaattga

SEQ ID NO: 5577596 - DNA, 15 bp, Homo sapiens
caaaaccaatgctga

SEQ ID NO: 5577597 - DNA, 18 bp, Homo sapiens
caaaaccaatgctgatga

SEQ ID NO: 5577598 - DNA, 18 bp, Homo sapiens
caaaaccacagccctgtc

SEQ ID NO: 5577599 - DNA, 19 bp, Homo sapiens
caaaaccacagccctgtca

SEQ ID NO: 5577600 - DNA, 22 bp, Homo sapiens
caaaaccagagggcagtctagt

SEQ ID NO: 5577601 - DNA, 12 bp, Homo sapiens
caaaaccagctg

SEQ ID NO: 5577602 - DNA, 14 bp, Homo sapiens
caaaaccagctgct

SEQ ID NO: 5577603 - DNA, 17 bp, Homo sapiens
caaaaccaggcctctgc

SEQ ID NO: 5577604 - DNA, 19 bp, Homo sapiens
caaaaccaggcctctgctg

SEQ ID NO: 5577605 - DNA, 23 bp, Homo sapiens
caaaaccaggtccaatgagcttt

SEQ ID NO: 5577606 - DNA, 20 bp, Homo sapiens
caaaaccatccatccctaga

SEQ ID NO: 5577607 - DNA, 21 bp, Homo sapiens
caaaaccatcttctgtgttta

SEQ ID NO: 5577608 - DNA, 23 bp, Homo sapiens
caaaaccatcttctgtgtttatg

SEQ ID NO: 5577609 - DNA, 23 bp, Homo sapiens
caaaaccatgcctggtattttca

SEQ ID NO: 5577610 - DNA, 13 bp, Homo sapiens
caaaacccacctt

SEQ ID NO: 5577611 - DNA, 13 bp, Homo sapiens
caaaacccagctg

SEQ ID NO: 5577612 - DNA, 15 bp, Homo sapiens
caaaacccagctgca

SEQ ID NO: 5577613 - DNA, 22 bp, Homo sapiens
caaaacccaggacatctcctgg

SEQ ID NO: 5577614 - DNA, 16 bp, Homo sapiens
caaaacccatgcattt

SEQ ID NO: 5577615 - DNA, 14 bp, Homo sapiens
caaaacccatgtgg

SEQ ID NO: 5577616 - DNA, 17 bp, Homo sapiens
caaaaccctcagcactg

SEQ ID NO: 5577617 - DNA, 17 bp, Homo sapiens
caaaaccctgaagccat

SEQ ID NO: 5577618 - DNA, 16 bp, Homo sapiens
caaaacccttacagtg

SEQ ID NO: 5577619 - DNA, 12 bp, Homo sapiens
caaaaccgccag

SEQ ID NO: 5577620 - DNA, 14 bp, Homo sapiens
caaaacctaccctg

SEQ ID NO: 5577621 - DNA, 18 bp, Homo sapiens
caaaacctcagttaaact

SEQ ID NO: 5577622 - DNA, 19 bp, Homo sapiens
caaaacctcatgacagcca

SEQ ID NO: 5577623 - DNA, 18 bp, Homo sapiens
caaaacctgattggccac

SEQ ID NO: 5577624 - DNA, 21 bp, Homo sapiens
caaaacctgattggccactgg

SEQ ID NO: 5577625 - DNA, 17 bp, Homo sapiens
caaaacctgcagttaac

SEQ ID NO: 5577626 - DNA, 20 bp, Homo sapiens
caaaacctgcagttcctgag

SEQ ID NO: 5577627 - DNA, 14 bp, Homo sapiens
caaaacctgcttcc

SEQ ID NO: 5577628 - DNA, 15 bp, Homo sapiens
caaaacctgcttcct

SEQ ID NO: 5577629 - DNA, 19 bp, Homo sapiens
caaaacctgcttccttcag

SEQ ID NO: 5577630 - DNA, 20 bp, Homo sapiens
caaaacctgcttccttcagt

SEQ ID NO: 5577631 - DNA, 13 bp, Homo sapiens
caaaacctgtgcc

SEQ ID NO: 5577632 - DNA, 16 bp, Homo sapiens
caaaacctgtgccagg

SEQ ID NO: 5577633 - DNA, 17 bp, Homo sapiens
caaaacctgtgccaggc

SEQ ID NO: 5577634 - DNA, 23 bp, Homo sapiens
caaaaccttgctaattttctcaa

SEQ ID NO: 5577635 - DNA, 22 bp, Homo sapiens
caaaacgatgaagttatgctgt

SEQ ID NO: 5577636 - DNA, 23 bp, Homo sapiens
caaaacgcatggagtgtgtattg

SEQ ID NO: 5577637 - DNA, 17 bp, Homo sapiens
caaaacggatccgggca

SEQ ID NO: 5577638 - DNA, 19 bp, Homo sapiens
caaaacggatgagttatta

SEQ ID NO: 5577639 - DNA, 13 bp, Homo sapiens
caaaacggggcag

SEQ ID NO: 5577640 - DNA, 14 bp, Homo sapiens
caaaacgtcttatt

SEQ ID NO: 5577641 - DNA, 15 bp, Homo sapiens
caaaacgtcttattg

SEQ ID NO: 5577642 - DNA, 19 bp, Homo sapiens
caaaacgttttatgtgaat

SEQ ID NO: 5577643 - DNA, 21 bp, Homo sapiens
caaaactacttttctaaaatc

SEQ ID NO: 5577644 - DNA, 17 bp, Homo sapiens
caaaactagacaaaagt

SEQ ID NO: 5577645 - DNA, 23 bp, Homo sapiens
caaaactatacttgaacaaaagg

SEQ ID NO: 5577646 - DNA, 13 bp, Homo sapiens
caaaactatggaa

SEQ ID NO: 5577647 - DNA, 23 bp, Homo sapiens
caaaactatttttgtaaaagaca

SEQ ID NO: 5577648 - DNA, 23 bp, Homo sapiens
caaaactcagtctcaaataataa

SEQ ID NO: 5577649 - DNA, 21 bp, Homo sapiens
caaaactcatttcctatgtaa

SEQ ID NO: 5577650 - DNA, 23 bp, Homo sapiens
caaaactccactcagcacaatta

SEQ ID NO: 5577651 - DNA, 17 bp, Homo sapiens
caaaactccgcccccag

SEQ ID NO: 5577652 - DNA, 21 bp, Homo sapiens
caaaactccgcccccagccta

SEQ ID NO: 5577653 - DNA, 14 bp, Homo sapiens
caaaactccgtctc

SEQ ID NO: 5577654 - DNA, 20 bp, Homo sapiens
caaaactctcctctgctgct

SEQ ID NO: 5577655 - DNA, 15 bp, Homo sapiens
caaaactgcatttca

SEQ ID NO: 5577656 - DNA, 18 bp, Homo sapiens
caaaactgcctacccacc

SEQ ID NO: 5577657 - DNA, 22 bp, Homo sapiens
caaaactgcctcaggaggcagg

SEQ ID NO: 5577658 - DNA, 17 bp, Homo sapiens
caaaactgcctgaaagc

SEQ ID NO: 5577659 - DNA, 12 bp, Homo sapiens
caaaactgctcc

SEQ ID NO: 5577660 - DNA, 19 bp, Homo sapiens
caaaactgctttgtgcata

SEQ ID NO: 5577661 - DNA, 22 bp, Homo sapiens
caaaactggaactgttgttgaa

SEQ ID NO: 5577662 - DNA, 11 bp, Homo sapiens
caaaactgttc

SEQ ID NO: 5577663 - DNA, 21 bp, Homo sapiens
caaaactgttcttttgcattt

SEQ ID NO: 5577664 - DNA, 18 bp, Homo sapiens
caaaacttaaaagcaaga

SEQ ID NO: 5577665 - DNA, 22 bp, Homo sapiens
caaaacttaagatgggcctgta

SEQ ID NO: 5577666 - DNA, 19 bp, Homo sapiens
caaaacttccaaggccctg

SEQ ID NO: 5577667 - DNA, 16 bp, Homo sapiens
caaaacttcctgtttg

SEQ ID NO: 5577668 - DNA, 11 bp, Homo sapiens
caaaacttctt

SEQ ID NO: 5577669 - DNA, 21 bp, Homo sapiens
caaaacttcttagaaaattaa

SEQ ID NO: 5577670 - DNA, 17 bp, Homo sapiens
caaaacttcttgtcaga

SEQ ID NO: 5577671 - DNA, 19 bp, Homo sapiens
caaaactttcgttgttatt

SEQ ID NO: 5577672 - DNA, 15 bp, Homo sapiens
caaaacttttggcaa

SEQ ID NO: 5577673 - DNA, 18 bp, Homo sapiens
caaaactttttaaatttt

SEQ ID NO: 5577674 - DNA, 16 bp, Homo sapiens
caaaagaaaatgtgta

SEQ ID NO: 5577675 - DNA, 19 bp, Homo sapiens
caaaagaaaccatgacaaa

SEQ ID NO: 5577676 - DNA, 22 bp, Homo sapiens
caaaagaaacttaccaattgat

SEQ ID NO: 5577677 - DNA, 20 bp, Homo sapiens
caaaagaaagcaaattattt

SEQ ID NO: 5577678 - DNA, 23 bp, Homo sapiens
caaaagaaatctcctaacaaaag

SEQ ID NO: 5577679 - DNA, 21 bp, Homo sapiens
caaaagaaatttaagttctat

SEQ ID NO: 5577680 - DNA, 10 bp, Homo sapiens
caaacaaaaa

SEQ ID NO: 5577681 - DNA, 16 bp, Homo sapiens
caaacaaaaaaaagaa

SEQ ID NO: 5577682 - DNA, 18 bp, Homo sapiens
caaacaaaaaaaagaacc

SEQ ID NO: 5577683 - DNA, 23 bp, Homo sapiens
caaacaaaaaagaaaagtagaaa

SEQ ID NO: 5577684 - DNA, 21 bp, Homo sapiens
caaacaaaaaatacaataaat

SEQ ID NO: 5577685 - DNA, 16 bp, Homo sapiens
caaacaaaaaggttct

SEQ ID NO: 5577686 - DNA, 11 bp, Homo sapiens
caaacaaaact

SEQ ID NO: 5577687 - DNA, 17 bp, Homo sapiens
caaacaaaagcagccct

SEQ ID NO: 5577688 - DNA, 14 bp, Homo sapiens
caaacaaaatttct

SEQ ID NO: 5577689 - DNA, 15 bp, Homo sapiens
caaacaaacaaaaat

SEQ ID NO: 5577690 - DNA, 15 bp, Homo sapiens
caaacaaacaaacaa

SEQ ID NO: 5577691 - DNA, 20 bp, Homo sapiens
caaacaaaggatttgaaaac

SEQ ID NO: 5577692 - DNA, 15 bp, Homo sapiens
caaacaaatatgcaa

SEQ ID NO: 5577693 - DNA, 21 bp, Homo sapiens
caaacaaatcattttgatgta

SEQ ID NO: 5577694 - DNA, 14 bp, Homo sapiens
caaacaacaaagca

SEQ ID NO: 5577695 - DNA, 22 bp, Homo sapiens
caaacaacagaaagtcattcct

SEQ ID NO: 5577696 - DNA, 16 bp, Homo sapiens
caaacaaccatttttt

SEQ ID NO: 5577697 - DNA, 17 bp, Homo sapiens
caaacaagaatgtccct

SEQ ID NO: 5577698 - DNA, 14 bp, Homo sapiens
caaacaagcacaga

SEQ ID NO: 5577699 - DNA, 16 bp, Homo sapiens
caaacaagcatataaa

SEQ ID NO: 5577700 - DNA, 17 bp, Homo sapiens
caaacaagccccctgcc

SEQ ID NO: 5577701 - DNA, 17 bp, Homo sapiens
caaacaagcttgatttt

SEQ ID NO: 5577702 - DNA, 11 bp, Homo sapiens
caaacaaggaa

SEQ ID NO: 5577703 - DNA, 12 bp, Homo sapiens
caaacaaggaag

SEQ ID NO: 5577704 - DNA, 12 bp, Homo sapiens
caaacaataaag

SEQ ID NO: 5577705 - DNA, 20 bp, Homo sapiens
caaacaatcccaatctttct

SEQ ID NO: 5577706 - DNA, 12 bp, Homo sapiens
caaacaatgaaa

SEQ ID NO: 5577707 - DNA, 14 bp, Homo sapiens
caaacaatgaagaa

SEQ ID NO: 5577708 - DNA, 21 bp, Homo sapiens
caaacaatgaagaattatgta

SEQ ID NO: 5577709 - DNA, 17 bp, Homo sapiens
caaacaatgacaaagca

SEQ ID NO: 5577710 - DNA, 19 bp, Homo sapiens
caaacaatggaaactgaat

SEQ ID NO: 5577711 - DNA, 19 bp, Homo sapiens
caaacaattcaatcaaagc

SEQ ID NO: 5577712 - DNA, 22 bp, Homo sapiens
caaacaattcaatcaaagctac

SEQ ID NO: 5577713 - DNA, 14 bp, Homo sapiens
caaacaattctgat

SEQ ID NO: 5577714 - DNA, 16 bp, Homo sapiens
caaacaattctgatga

SEQ ID NO: 5577715 - DNA, 18 bp, Homo sapiens
caaacaattgaagtcaat

SEQ ID NO: 5577716 - DNA, 21 bp, Homo sapiens
caaacaatttagccagaatgt

SEQ ID NO: 5577717 - DNA, 21 bp, Homo sapiens
caaacacaaaacattcatgta

SEQ ID NO: 5577718 - DNA, 14 bp, Homo sapiens
caaacacaacacaa

SEQ ID NO: 5577719 - DNA, 15 bp, Homo sapiens
caaacacaagaaatc

SEQ ID NO: 5577720 - DNA, 23 bp, Homo sapiens
caaacacaaggtcatggccacac

SEQ ID NO: 5577721 - DNA, 19 bp, Homo sapiens
caaacacaatggagtgtgt

SEQ ID NO: 5577722 - DNA, 11 bp, Homo sapiens
caaacacacac

SEQ ID NO: 5577723 - DNA, 16 bp, Homo sapiens
caaacacactgtaaat

SEQ ID NO: 5577724 - DNA, 16 bp, Homo sapiens
caaacacagccctgga

SEQ ID NO: 5577725 - DNA, 21 bp, Homo sapiens
caaacacagttacacttgtgc

SEQ ID NO: 5577726 - DNA, 16 bp, Homo sapiens
caaacacataacaata

SEQ ID NO: 5577727 - DNA, 15 bp, Homo sapiens
caaacacatacagga

SEQ ID NO: 5577728 - DNA, 15 bp, Homo sapiens
caaacacatggggga

SEQ ID NO: 5577729 - DNA, 14 bp, Homo sapiens
caaacacattataa

SEQ ID NO: 5577730 - DNA, 14 bp, Homo sapiens
caaacacattgtta

SEQ ID NO: 5577731 - DNA, 17 bp, Homo sapiens
caaacacattgttattt

SEQ ID NO: 5577732 - DNA, 22 bp, Homo sapiens
caaacacccaagcacaaactgt

SEQ ID NO: 5577733 - DNA, 23 bp, Homo sapiens
caaacacccaagtggcccccacc

SEQ ID NO: 5577734 - DNA, 12 bp, Homo sapiens
caaacacccaga

SEQ ID NO: 5577735 - DNA, 22 bp, Homo sapiens
caaacacctgctgatgtggcaa

SEQ ID NO: 5577736 - DNA, 21 bp, Homo sapiens
caaacaccttcagtgctggtg

SEQ ID NO: 5577737 - DNA, 21 bp, Homo sapiens
caaacaccttccagctcctgt

SEQ ID NO: 5577738 - DNA, 20 bp, Homo sapiens
caaacaccttcttattatat

SEQ ID NO: 5577739 - DNA, 12 bp, Homo sapiens
caaacactccac

SEQ ID NO: 5577740 - DNA, 19 bp, Homo sapiens
caaacactgaatcatgtta

SEQ ID NO: 5577741 - DNA, 17 bp, Homo sapiens
caaacactgaggcagcc

SEQ ID NO: 5577742 - DNA, 19 bp, Homo sapiens
caaacactgcagtttcctg

SEQ ID NO: 5577743 - DNA, 14 bp, Homo sapiens
caaacactgtgatt

SEQ ID NO: 5577744 - DNA, 16 bp, Homo sapiens
caaacagaaaacatgt

SEQ ID NO: 5577745 - DNA, 15 bp, Homo sapiens
caaacagaaacacaa

SEQ ID NO: 5577746 - DNA, 16 bp, Homo sapiens
caaacagaacagggtc

SEQ ID NO: 5577747 - DNA, 14 bp, Homo sapiens
caaacagaagtgca

SEQ ID NO: 5577748 - DNA, 17 bp, Homo sapiens
caaacagaagtgcatcc

SEQ ID NO: 5577749 - DNA, 19 bp, Homo sapiens
caaacagaagtgcatcctg

SEQ ID NO: 5577750 - DNA, 15 bp, Homo sapiens
caaacagaattttcc

SEQ ID NO: 5577751 - DNA, 22 bp, Homo sapiens
caaacagaattttccatttatt

SEQ ID NO: 5577752 - DNA, 19 bp, Homo sapiens
caaacagacaaaacagata

SEQ ID NO: 5577753 - DNA, 18 bp, Homo sapiens
caaacagagctactgaga

SEQ ID NO: 5577754 - DNA, 22 bp, Homo sapiens
caaacagagtatgtccgatggt

SEQ ID NO: 5577755 - DNA, 18 bp, Homo sapiens
caaacagattcttttatg

SEQ ID NO: 5577756 - DNA, 20 bp, Homo sapiens
caaacagcaaaccaagagat

SEQ ID NO: 5577757 - DNA, 21 bp, Homo sapiens
caaacagcaagagtaagcagt

SEQ ID NO: 5577758 - DNA, 19 bp, Homo sapiens
caaacagcatcaaaataca

SEQ ID NO: 5577759 - DNA, 20 bp, Homo sapiens
caaacagcatcaaaatacaa

SEQ ID NO: 5577760 - DNA, 16 bp, Homo sapiens
caaacagcccttcctt

SEQ ID NO: 5577761 - DNA, 23 bp, Homo sapiens
caaacagctattggcaagtttta

SEQ ID NO: 5577762 - DNA, 17 bp, Homo sapiens
caaacagctgaaagagg

SEQ ID NO: 5577763 - DNA, 15 bp, Homo sapiens
caaacaggaaaatga

SEQ ID NO: 5577764 - DNA, 13 bp, Homo sapiens
caaacaggacagc

SEQ ID NO: 5577765 - DNA, 20 bp, Homo sapiens
caaacagggtggcccaggtg

SEQ ID NO: 5577766 - DNA, 15 bp, Homo sapiens
caaacaggtgctggc

SEQ ID NO: 5577767 - DNA, 23 bp, Homo sapiens
caaacaggtgctggcccagcatg

SEQ ID NO: 5577768 - DNA, 24 bp, Homo sapiens
caaacaggtgctggcccagcatgg

SEQ ID NO: 5577769 - DNA, 19 bp, Homo sapiens
caaacaggttgttttctac

SEQ ID NO: 5577770 - DNA, 16 bp, Homo sapiens
caaacagtaaaggcca

SEQ ID NO: 5577771 - DNA, 15 bp, Homo sapiens
caaacagtagagaac

SEQ ID NO: 5577772 - DNA, 14 bp, Homo sapiens
caaacagtaggttg

SEQ ID NO: 5577773 - DNA, 19 bp, Homo sapiens
caaacagtatataactttt

SEQ ID NO: 5577774 - DNA, 13 bp, Homo sapiens
caaacagtgaatt

SEQ ID NO: 5577775 - DNA, 22 bp, Homo sapiens
caaacagtgaatttaagcatga

SEQ ID NO: 5577776 - DNA, 12 bp, Homo sapiens
caaacagtgcca

SEQ ID NO: 5577777 - DNA, 15 bp, Homo sapiens
caaacagtgccaaat

SEQ ID NO: 5577778 - DNA, 17 bp, Homo sapiens
caaacatacccatctgc

SEQ ID NO: 5577779 - DNA, 18 bp, Homo sapiens
caaacatacccatctgca

SEQ ID NO: 5577780 - DNA, 15 bp, Homo sapiens
caaacatagacagat

SEQ ID NO: 5577781 - DNA, 12 bp, Homo sapiens
caaacatagccc

SEQ ID NO: 5577782 - DNA, 16 bp, Homo sapiens
caaacatagcccctgc

SEQ ID NO: 5577783 - DNA, 20 bp, Homo sapiens
caaacatagcccctgccccg

SEQ ID NO: 5577784 - DNA, 21 bp, Homo sapiens
caaacatatatatactattaa

SEQ ID NO: 5577785 - DNA, 15 bp, Homo sapiens
caaacatattctttt

SEQ ID NO: 5577786 - DNA, 19 bp, Homo sapiens
caaacatcacaaaatgtaa

SEQ ID NO: 5577787 - DNA, 21 bp, Homo sapiens
caaacatcactctgctgctta

SEQ ID NO: 5577788 - DNA, 15 bp, Homo sapiens
caaacatcagtcaat

SEQ ID NO: 5577789 - DNA, 22 bp, Homo sapiens
caaacatgaagtgtgtttcctt

SEQ ID NO: 5577790 - DNA, 17 bp, Homo sapiens
caaacatgccctcaggc

SEQ ID NO: 5577791 - DNA, 13 bp, Homo sapiens
caaacatgcttat

SEQ ID NO: 5577792 - DNA, 21 bp, Homo sapiens
caaacatgcttataacattaa

SEQ ID NO: 5577793 - DNA, 14 bp, Homo sapiens
caaacatggagaaa

SEQ ID NO: 5577794 - DNA, 17 bp, Homo sapiens
caaacatggagaaatct

SEQ ID NO: 5577795 - DNA, 20 bp, Homo sapiens
caaacatggatacttcctgg

SEQ ID NO: 5577796 - DNA, 21 bp, Homo sapiens
caaacatggatacttcctggg

SEQ ID NO: 5577797 - DNA, 23 bp, Homo sapiens
caaacatggggttggctgggccc

SEQ ID NO: 5577798 - DNA, 15 bp, Homo sapiens
caaacatgtatgtat

SEQ ID NO: 5577799 - DNA, 15 bp, Homo sapiens
caaacatgtatttat

SEQ ID NO: 5577800 - DNA, 16 bp, Homo sapiens
caaacatgtatttatg

SEQ ID NO: 5577801 - DNA, 21 bp, Homo sapiens
caaacatgtgcaactcttgta

SEQ ID NO: 5577802 - DNA, 20 bp, Homo sapiens
caaacattaatcaccaaagt

SEQ ID NO: 5577803 - DNA, 17 bp, Homo sapiens
caaacattaatgttgat

SEQ ID NO: 5577804 - DNA, 20 bp, Homo sapiens
caaacattaatgttgatttc

SEQ ID NO: 5577805 - DNA, 19 bp, Homo sapiens
caaacattagtactttata

SEQ ID NO: 5577806 - DNA, 18 bp, Homo sapiens
caaacattgagactgcta

SEQ ID NO: 5577807 - DNA, 19 bp, Homo sapiens
caaacattgctgcctttgt

SEQ ID NO: 5577808 - DNA, 19 bp, Homo sapiens
caaacattgtgttgacatt

SEQ ID NO: 5577809 - DNA, 10 bp, Homo sapiens
caaacattta

SEQ ID NO: 5577810 - DNA, 15 bp, Homo sapiens
caaacatttcaaagt

SEQ ID NO: 5577811 - DNA, 22 bp, Homo sapiens
caaacatttcatccgtgtgtat

SEQ ID NO: 5577812 - DNA, 17 bp, Homo sapiens
caaacatttctgtgaaa

SEQ ID NO: 5577813 - DNA, 18 bp, Homo sapiens
caaacatttctgtgaaac

SEQ ID NO: 5577814 - DNA, 12 bp, Homo sapiens
caaacatttctt

SEQ ID NO: 5577815 - DNA, 14 bp, Homo sapiens
caaacattttgtat

SEQ ID NO: 5577816 - DNA, 14 bp, Homo sapiens
caaaccaaagagta

SEQ ID NO: 5577817 - DNA, 15 bp, Homo sapiens
caaaccaaagctgcc

SEQ ID NO: 5577818 - DNA, 16 bp, Homo sapiens
caaaccaaagctgcct

SEQ ID NO: 5577819 - DNA, 20 bp, Homo sapiens
caaaccaacaggctaccaac

SEQ ID NO: 5577820 - DNA, 13 bp, Homo sapiens
caaaccaacatct

SEQ ID NO: 5577821 - DNA, 16 bp, Homo sapiens
caaaccaacatctttg

SEQ ID NO: 5577822 - DNA, 17 bp, Homo sapiens
caaaccaacctttctga

SEQ ID NO: 5577823 - DNA, 22 bp, Homo sapiens
caaaccaacctttctgacatca

SEQ ID NO: 5577824 - DNA, 11 bp, Homo sapiens
caaaccaagaa

SEQ ID NO: 5577825 - DNA, 19 bp, Homo sapiens
caaaccaagggtacagatc

SEQ ID NO: 5577826 - DNA, 23 bp, Homo sapiens
caaaccaagggtacagatcccca

SEQ ID NO: 5577827 - DNA, 17 bp, Homo sapiens
caaaccaagtgccttga

SEQ ID NO: 5577828 - DNA, 18 bp, Homo sapiens
caaaccaatacagaattg

SEQ ID NO: 5577829 - DNA, 22 bp, Homo sapiens
caaaccaccaggactgaaagaa

SEQ ID NO: 5577830 - DNA, 17 bp, Homo sapiens
caaaccacgcctcttga

SEQ ID NO: 5577831 - DNA, 14 bp, Homo sapiens
caaaccacttgcct

SEQ ID NO: 5577832 - DNA, 19 bp, Homo sapiens
caaaccactttttgcagct

SEQ ID NO: 5577833 - DNA, 14 bp, Homo sapiens
caaaccagcttcat

SEQ ID NO: 5577834 - DNA, 23 bp, Homo sapiens
caaaccaggacactaccctgaga

SEQ ID NO: 5577835 - DNA, 17 bp, Homo sapiens
caaaccaggactctgcc

SEQ ID NO: 5577836 - DNA, 22 bp, Homo sapiens
caaaccaggagcattttgtgtc

SEQ ID NO: 5577837 - DNA, 23 bp, Homo sapiens
caaaccagggggaagcaccagcc

SEQ ID NO: 5577838 - DNA, 13 bp, Homo sapiens
caaaccagggtgc

SEQ ID NO: 5577839 - DNA, 16 bp, Homo sapiens
caaaccaggtgcaatt

SEQ ID NO: 5577840 - DNA, 16 bp, Homo sapiens
caaaccagtttattct

SEQ ID NO: 5577841 - DNA, 15 bp, Homo sapiens
caaaccataaacttc

SEQ ID NO: 5577842 - DNA, 18 bp, Homo sapiens
caaaccatcagctgcttt

SEQ ID NO: 5577843 - DNA, 19 bp, Homo sapiens
caaaccatcattgaaatct

SEQ ID NO: 5577844 - DNA, 14 bp, Homo sapiens
caaaccatctggtg

SEQ ID NO: 5577845 - DNA, 16 bp, Homo sapiens
caaaccatctggtgcc

SEQ ID NO: 5577846 - DNA, 16 bp, Homo sapiens
caaaccatgagaattt

SEQ ID NO: 5577847 - DNA, 17 bp, Homo sapiens
caaaccatgagaatttg

SEQ ID NO: 5577848 - DNA, 12 bp, Homo sapiens
caaaccatgcct

SEQ ID NO: 5577849 - DNA, 14 bp, Homo sapiens
caaaccattgctct

SEQ ID NO: 5577850 - DNA, 13 bp, Homo sapiens
caaaccatttaat

SEQ ID NO: 5577851 - DNA, 22 bp, Homo sapiens
caaaccatttaattcataatta

SEQ ID NO: 5577852 - DNA, 21 bp, Homo sapiens
caaacccaaaacctcatgaca

SEQ ID NO: 5577853 - DNA, 14 bp, Homo sapiens
caaacccaaaagaa

SEQ ID NO: 5577854 - DNA, 13 bp, Homo sapiens
caaacccaaagat

SEQ ID NO: 5577855 - DNA, 17 bp, Homo sapiens
caaacccaactaagcca

SEQ ID NO: 5577856 - DNA, 17 bp, Homo sapiens
caaacccagaaagattt

SEQ ID NO: 5577857 - DNA, 20 bp, Homo sapiens
caaacccagacggctccact

SEQ ID NO: 5577858 - DNA, 16 bp, Homo sapiens
caaacccagaggtgga

SEQ ID NO: 5577859 - DNA, 19 bp, Homo sapiens
caaagagtgaaatattgta

SEQ ID NO: 5577860 - DNA, 21 bp, Homo sapiens
caaagagtgaaatattgtaaa

SEQ ID NO: 5577861 - DNA, 23 bp, Homo sapiens
caaagagtgaaatattgtaaatg

SEQ ID NO: 5577862 - DNA, 23 bp, Homo sapiens
caaagagttatatgacttcttgt

SEQ ID NO: 5577863 - DNA, 15 bp, Homo sapiens
caaagagttcaagaa

SEQ ID NO: 5577864 - DNA, 15 bp, Homo sapiens
caaagataacattgt

SEQ ID NO: 5577865 - DNA, 18 bp, Homo sapiens
caaagataacgcaggaga

SEQ ID NO: 5577866 - DNA, 22 bp, Homo sapiens
caaagataacgcaggagagaga

SEQ ID NO: 5577867 - DNA, 21 bp, Homo sapiens
caaagataagacttgtttctt

SEQ ID NO: 5577868 - DNA, 22 bp, Homo sapiens
caaagataagacttgtttcttt

SEQ ID NO: 5577869 - DNA, 22 bp, Homo sapiens
caaagataaggactagatacta

SEQ ID NO: 5577870 - DNA, 23 bp, Homo sapiens
caaagataatgcatatttttgca

SEQ ID NO: 5577871 - DNA, 19 bp, Homo sapiens
caaagataatgttatacat

SEQ ID NO: 5577872 - DNA, 19 bp, Homo sapiens
caaagataatttatttcaa

SEQ ID NO: 5577873 - DNA, 22 bp, Homo sapiens
caaagatacaagaaaaagtaga

SEQ ID NO: 5577874 - DNA, 18 bp, Homo sapiens
caaagatacttgatgcac

SEQ ID NO: 5577875 - DNA, 17 bp, Homo sapiens
caaagatagacaggtcc

SEQ ID NO: 5577876 - DNA, 22 bp, Homo sapiens
caaagatagacaggtcctgatt

SEQ ID NO: 5577877 - DNA, 23 bp, Homo sapiens
caaagatagagaatgccctcagc

SEQ ID NO: 5577878 - DNA, 15 bp, Homo sapiens
caaagatatatattc

SEQ ID NO: 5577879 - DNA, 12 bp, Homo sapiens
caaagatatctt

SEQ ID NO: 5577880 - DNA, 16 bp, Homo sapiens
caaagatattatttat

SEQ ID NO: 5577881 - DNA, 19 bp, Homo sapiens
caaagatattatttatcga

SEQ ID NO: 5577882 - DNA, 14 bp, Homo sapiens
caaagatattttgc

SEQ ID NO: 5577883 - DNA, 22 bp, Homo sapiens
caaagatattttgctttgtgat

SEQ ID NO: 5577884 - DNA, 23 bp, Homo sapiens
caaagatattttgctttgtgatt

SEQ ID NO: 5577885 - DNA, 17 bp, Homo sapiens
caaagatcaaaataaaa

SEQ ID NO: 5577886 - DNA, 20 bp, Homo sapiens
caaagatcaaaataaaaagt

SEQ ID NO: 5577887 - DNA, 13 bp, Homo sapiens
caaagatcaaatg

SEQ ID NO: 5577888 - DNA, 16 bp, Homo sapiens
caaagatcaaatgaaa

SEQ ID NO: 5577889 - DNA, 15 bp, Homo sapiens
caaagatctcagcag

SEQ ID NO: 5577890 - DNA, 20 bp, Homo sapiens
caaagatctgtcctcagcct

SEQ ID NO: 5577891 - DNA, 22 bp, Homo sapiens
caaagatgaaagctgtttcatt

SEQ ID NO: 5577892 - DNA, 20 bp, Homo sapiens
caaagatgaatgaagcaaat

SEQ ID NO: 5577893 - DNA, 19 bp, Homo sapiens
caaagatgaccataaccac

SEQ ID NO: 5577894 - DNA, 22 bp, Homo sapiens
caaagatgacttgaaatgaggc

SEQ ID NO: 5577895 - DNA, 23 bp, Homo sapiens
caaagatgagctctgaacaaaca

SEQ ID NO: 5577896 - DNA, 19 bp, Homo sapiens
caaagatgcgtttgcctcc

SEQ ID NO: 5577897 - DNA, 18 bp, Homo sapiens
caaagatggctcagaggg

SEQ ID NO: 5577898 - DNA, 20 bp, Homo sapiens
caaagatgggtgaaggctgg

SEQ ID NO: 5577899 - DNA, 17 bp, Homo sapiens
caaagatggtggctgtg

SEQ ID NO: 5577900 - DNA, 20 bp, Homo sapiens
caaagatggtggctgtgtct

SEQ ID NO: 5577901 - DNA, 15 bp, Homo sapiens
caaagatgtactgag

SEQ ID NO: 5577902 - DNA, 13 bp, Homo sapiens
caaagatgtcctg

SEQ ID NO: 5577903 - DNA, 20 bp, Homo sapiens
caaagatgtgggttcttttt

SEQ ID NO: 5577904 - DNA, 22 bp, Homo sapiens
caaagatgtgttcaggcattcc

SEQ ID NO: 5577905 - DNA, 17 bp, Homo sapiens
caaagatgtttgaaaat

SEQ ID NO: 5577906 - DNA, 16 bp, Homo sapiens
caaagattaaatgtgt

SEQ ID NO: 5577907 - DNA, 13 bp, Homo sapiens
caaagattgagaa

SEQ ID NO: 5577908 - DNA, 14 bp, Homo sapiens
caaagattgagaag

SEQ ID NO: 5577909 - DNA, 16 bp, Homo sapiens
caaagattgagaagcc

SEQ ID NO: 5577910 - DNA, 17 bp, Homo sapiens
caaagattgttggcagt

SEQ ID NO: 5577911 - DNA, 17 bp, Homo sapiens
caaagatttcatatcta

SEQ ID NO: 5577912 - DNA, 21 bp, Homo sapiens
caaagattttcaaacaaaata

SEQ ID NO: 5577913 - DNA, 13 bp, Homo sapiens
caaagatttttgg

SEQ ID NO: 5577914 - DNA, 17 bp, Homo sapiens
caaagcaaaagaagtaa

SEQ ID NO: 5577915 - DNA, 13 bp, Homo sapiens
caaagcaaagaaa

SEQ ID NO: 5577916 - DNA, 13 bp, Homo sapiens
caaagcaaaggca

SEQ ID NO: 5577917 - DNA, 14 bp, Homo sapiens
caaagcaacaaatt

SEQ ID NO: 5577918 - DNA, 19 bp, Homo sapiens
caaagcaacaaattaacta

SEQ ID NO: 5577919 - DNA, 14 bp, Homo sapiens
caaagcaacatggc

SEQ ID NO: 5577920 - DNA, 19 bp, Homo sapiens
caaagcaaccacaaatgca

SEQ ID NO: 5577921 - DNA, 22 bp, Homo sapiens
caaagcaacccgctggagccca

SEQ ID NO: 5577922 - DNA, 17 bp, Homo sapiens
caaagcaacgactactt

SEQ ID NO: 5577923 - DNA, 15 bp, Homo sapiens
caaagcaagcacctg

SEQ ID NO: 5577924 - DNA, 13 bp, Homo sapiens
caaagcaaggaaa

SEQ ID NO: 5577925 - DNA, 13 bp, Homo sapiens
caaagcaagggct

SEQ ID NO: 5577926 - DNA, 17 bp, Homo sapiens
caaagcaagggctccag

SEQ ID NO: 5577927 - DNA, 18 bp, Homo sapiens
caaagcaagggctccagc

SEQ ID NO: 5577928 - DNA, 15 bp, Homo sapiens
caaagcaaggtacag

SEQ ID NO: 5577929 - DNA, 14 bp, Homo sapiens
caaagcaataatag

SEQ ID NO: 5577930 - DNA, 16 bp, Homo sapiens
caaagcaatcttttat

SEQ ID NO: 5577931 - DNA, 18 bp, Homo sapiens
caaagcaatgcattttgg

SEQ ID NO: 5577932 - DNA, 21 bp, Homo sapiens
caaagcaatttactgatgaga

SEQ ID NO: 5577933 - DNA, 14 bp, Homo sapiens
caaagcacagagag

SEQ ID NO: 5577934 - DNA, 15 bp, Homo sapiens
caaagcacagtgtta

SEQ ID NO: 5577935 - DNA, 17 bp, Homo sapiens
caaagcacagtttgaac

SEQ ID NO: 5577936 - DNA, 11 bp, Homo sapiens
caaagcacatg

SEQ ID NO: 5577937 - DNA, 19 bp, Homo sapiens
caaagcacatgcttagctt

SEQ ID NO: 5577938 - DNA, 18 bp, Homo sapiens
caaagcaccaaaataaga

SEQ ID NO: 5577939 - DNA, 12 bp, Homo sapiens
caaagcaccagc

SEQ ID NO: 5577940 - DNA, 21 bp, Homo sapiens
caaagcacccatttcaatgtg

SEQ ID NO: 5577941 - DNA, 18 bp, Homo sapiens
caaagcacctgaaccact

SEQ ID NO: 5577942 - DNA, 20 bp, Homo sapiens
caaagcacctgaaccactgt

SEQ ID NO: 5577943 - DNA, 22 bp, Homo sapiens
caaagcactgacttctaagtaa

SEQ ID NO: 5577944 - DNA, 15 bp, Homo sapiens
caaagcagagagcat

SEQ ID NO: 5577945 - DNA, 23 bp, Homo sapiens
caaagcagagatcgacagacagc

SEQ ID NO: 5577946 - DNA, 19 bp, Homo sapiens
caaagcagagtgaaattca

SEQ ID NO: 5577947 - DNA, 13 bp, Homo sapiens
caaagcagagtgg

SEQ ID NO: 5577948 - DNA, 23 bp, Homo sapiens
caaagcagagtgggacttggaga

SEQ ID NO: 5577949 - DNA, 17 bp, Homo sapiens
caaagcagattttccta

SEQ ID NO: 5577950 - DNA, 22 bp, Homo sapiens
caaagcagattttcctaaggcc

SEQ ID NO: 5577951 - DNA, 14 bp, Homo sapiens
caaagcagcagcca

SEQ ID NO: 5577952 - DNA, 15 bp, Homo sapiens
caaagcagcagccac

SEQ ID NO: 5577953 - DNA, 12 bp, Homo sapiens
caaagcagccac

SEQ ID NO: 5577954 - DNA, 23 bp, Homo sapiens
caaagcagctgtaatttagttaa

SEQ ID NO: 5577955 - DNA, 16 bp, Homo sapiens
caaagcagctttaaaa

SEQ ID NO: 5577956 - DNA, 20 bp, Homo sapiens
caaagcagctttaaaaaaat

SEQ ID NO: 5577957 - DNA, 22 bp, Homo sapiens
caaagcagctttaaaaaaataa

SEQ ID NO: 5577958 - DNA, 13 bp, Homo sapiens
caaagcaggagtg

SEQ ID NO: 5577959 - DNA, 18 bp, Homo sapiens
caaagcaggggagtatgc

SEQ ID NO: 5577960 - DNA, 21 bp, Homo sapiens
caaagcaggggagtatgcaaa

SEQ ID NO: 5577961 - DNA, 18 bp, Homo sapiens
caaagcagtgcatgctgt

SEQ ID NO: 5577962 - DNA, 18 bp, Homo sapiens
caaagcagttgggagtac

SEQ ID NO: 5577963 - DNA, 18 bp, Homo sapiens
caaagcagtttttccccc

SEQ ID NO: 5577964 - DNA, 14 bp, Homo sapiens
caaagcatcaaata

SEQ ID NO: 5577965 - DNA, 20 bp, Homo sapiens
caaagcatcaaataatacat

SEQ ID NO: 5577966 - DNA, 23 bp, Homo sapiens
caaagcatcttgcattatgcaat

SEQ ID NO: 5577967 - DNA, 11 bp, Homo sapiens
caaagcatgcc

SEQ ID NO: 5577968 - DNA, 20 bp, Homo sapiens
caaagcatgctcagtattga

SEQ ID NO: 5577969 - DNA, 17 bp, Homo sapiens
caaagcatggacattta

SEQ ID NO: 5577970 - DNA, 18 bp, Homo sapiens
caaagcatgggaaaaaga

SEQ ID NO: 5577971 - DNA, 19 bp, Homo sapiens
caaagcatgggaaaaagag

SEQ ID NO: 5577972 - DNA, 20 bp, Homo sapiens
caaagcatttgactttctgt

SEQ ID NO: 5577973 - DNA, 22 bp, Homo sapiens
caaagccaaactctgccagcca

SEQ ID NO: 5577974 - DNA, 21 bp, Homo sapiens
caaagccaaagctaggcctgg

SEQ ID NO: 5577975 - DNA, 22 bp, Homo sapiens
caaagccaaagctaggcctggc

SEQ ID NO: 5577976 - DNA, 23 bp, Homo sapiens
caaagccaaggcagcgaccccag

SEQ ID NO: 5577977 - DNA, 14 bp, Homo sapiens
caaagccacatttt

SEQ ID NO: 5577978 - DNA, 21 bp, Homo sapiens
caaagccaccaacagccactc

SEQ ID NO: 5577979 - DNA, 21 bp, Homo sapiens
caaagccaccaagggcctcac

SEQ ID NO: 5577980 - DNA, 20 bp, Homo sapiens
caaagccacctctgtcattt

SEQ ID NO: 5577981 - DNA, 15 bp, Homo sapiens
caaagccactggaag

SEQ ID NO: 5577982 - DNA, 17 bp, Homo sapiens
caaagccactggaagga

SEQ ID NO: 5577983 - DNA, 20 bp, Homo sapiens
caaagccactggaaggagca

SEQ ID NO: 5577984 - DNA, 21 bp, Homo sapiens
caaagccactggaaggagcac

SEQ ID NO: 5577985 - DNA, 14 bp, Homo sapiens
caaagccagaagct

SEQ ID NO: 5577986 - DNA, 21 bp, Homo sapiens
caaagccagaggagaagacaa

SEQ ID NO: 5577987 - DNA, 21 bp, Homo sapiens
caaagccagagtggccacggc

SEQ ID NO: 5577988 - DNA, 16 bp, Homo sapiens
caaagccagctctgag

SEQ ID NO: 5577989 - DNA, 21 bp, Homo sapiens
caaagccaggtccctctcatt

SEQ ID NO: 5577990 - DNA, 17 bp, Homo sapiens
caaagccagtgaaatgt

SEQ ID NO: 5577991 - DNA, 16 bp, Homo sapiens
caaagccatattctaa

SEQ ID NO: 5577992 - DNA, 16 bp, Homo sapiens
caaagccattctttta

SEQ ID NO: 5577993 - DNA, 17 bp, Homo sapiens
caaagcccaaagtggta

SEQ ID NO: 5577994 - DNA, 14 bp, Homo sapiens
caaagcccagcccg

SEQ ID NO: 5577995 - DNA, 13 bp, Homo sapiens
caaagcccagctt

SEQ ID NO: 5577996 - DNA, 22 bp, Homo sapiens
caaagccccacctttaagtcct

SEQ ID NO: 5577997 - DNA, 20 bp, Homo sapiens
caaagccccatgctggagcc

SEQ ID NO: 5577998 - DNA, 22 bp, Homo sapiens
caaagcccccacttctctccag

SEQ ID NO: 5577999 - DNA, 15 bp, Homo sapiens
caaagcccccagagc

SEQ ID NO: 5578000 - DNA, 18 bp, Homo sapiens
caaagcccccagagccca

SEQ ID NO: 5578001 - DNA, 14 bp, Homo sapiens
caaagcccctggaa

SEQ ID NO: 5578002 - DNA, 14 bp, Homo sapiens
caaagccctgcctc

SEQ ID NO: 5578003 - DNA, 16 bp, Homo sapiens
caaagccctgcctctg

SEQ ID NO: 5578004 - DNA, 15 bp, Homo sapiens
caaagccctgtcctt

SEQ ID NO: 5578005 - DNA, 22 bp, Homo sapiens
caaagcccttggaacaccctgg

SEQ ID NO: 5578006 - DNA, 19 bp, Homo sapiens
caaagccggcctgagaaac

SEQ ID NO: 5578007 - DNA, 23 bp, Homo sapiens
caaagccgtgcctttctctggct

SEQ ID NO: 5578008 - DNA, 21 bp, Homo sapiens
caaagcctccagcatcttttc

SEQ ID NO: 5578009 - DNA, 18 bp, Homo sapiens
caaagcctcctccagccg

SEQ ID NO: 5578010 - DNA, 13 bp, Homo sapiens
caaagcctcttca

SEQ ID NO: 5578011 - DNA, 22 bp, Homo sapiens
caaagcctcttcaaaaagcaga

SEQ ID NO: 5578012 - DNA, 13 bp, Homo sapiens
caaagcctgagga

SEQ ID NO: 5578013 - DNA, 15 bp, Homo sapiens
caaagcctgaggaca

SEQ ID NO: 5578014 - DNA, 17 bp, Homo sapiens
caaagcctgcgttctca

SEQ ID NO: 5578015 - DNA, 13 bp, Homo sapiens
caaagcctgggca

SEQ ID NO: 5578016 - DNA, 21 bp, Homo sapiens
caaagcctgttcatggcagat

SEQ ID NO: 5578017 - DNA, 13 bp, Homo sapiens
caaagccttacac

SEQ ID NO: 5578018 - DNA, 18 bp, Homo sapiens
caaagccttggtcccgtg

SEQ ID NO: 5578019 - DNA, 15 bp, Homo sapiens
caaagcctttaaatt

SEQ ID NO: 5578020 - DNA, 19 bp, Homo sapiens
caaagcgaattttaaaaga

SEQ ID NO: 5578021 - DNA, 20 bp, Homo sapiens
caaagcgaattttaaaagat

SEQ ID NO: 5578022 - DNA, 13 bp, Homo sapiens
caaagcgacagat

SEQ ID NO: 5578023 - DNA, 20 bp, Homo sapiens
caaagcgagatcccatctct

SEQ ID NO: 5578024 - DNA, 17 bp, Homo sapiens
caaagcgcccacccagg

SEQ ID NO: 5578025 - DNA, 18 bp, Homo sapiens
caaagcgcccacccaggt

SEQ ID NO: 5578026 - DNA, 19 bp, Homo sapiens
caaagcgcccacccaggtc

SEQ ID NO: 5578027 - DNA, 18 bp, Homo sapiens
caaagcgctcgccccgca

SEQ ID NO: 5578028 - DNA, 17 bp, Homo sapiens
caaagcggggggagggt

SEQ ID NO: 5578029 - DNA, 23 bp, Homo sapiens
caaagcggtttaaccacattaat

SEQ ID NO: 5578030 - DNA, 16 bp, Homo sapiens
caaagctacaggactg

SEQ ID NO: 5578031 - DNA, 23 bp, Homo sapiens
caaagctaccttttttttacgga

SEQ ID NO: 5578032 - DNA, 14 bp, Homo sapiens
caaagctaggaaag

SEQ ID NO: 5578033 - DNA, 16 bp, Homo sapiens
caaagctaggatggtt

SEQ ID NO: 5578034 - DNA, 23 bp, Homo sapiens
caaagctaggatggttctgtgac

SEQ ID NO: 5578035 - DNA, 14 bp, Homo sapiens
caaaggtaaatcag

SEQ ID NO: 5578036 - DNA, 22 bp, Homo sapiens
caaaggtaaatcagactatgaa

SEQ ID NO: 5578037 - DNA, 21 bp, Homo sapiens
caaaggtagattttacagaga

SEQ ID NO: 5578038 - DNA, 17 bp, Homo sapiens
caaaggtcaaaaacaaa

SEQ ID NO: 5578039 - DNA, 20 bp, Homo sapiens
caaaggtccgcaccctgtcc

SEQ ID NO: 5578040 - DNA, 19 bp, Homo sapiens
caaaggtcgggacagctgt

SEQ ID NO: 5578041 - DNA, 22 bp, Homo sapiens
caaaggtcgggacagctgtgcc

SEQ ID NO: 5578042 - DNA, 23 bp, Homo sapiens
caaaggtctatctactaaactag

SEQ ID NO: 5578043 - DNA, 13 bp, Homo sapiens
caaaggtcttttt

SEQ ID NO: 5578044 - DNA, 20 bp, Homo sapiens
caaaggtctttttaaaccag

SEQ ID NO: 5578045 - DNA, 16 bp, Homo sapiens
caaaggtgaaggaata

SEQ ID NO: 5578046 - DNA, 19 bp, Homo sapiens
caaaggtgaaggaatatat

SEQ ID NO: 5578047 - DNA, 16 bp, Homo sapiens
caaaggtgattttcct

SEQ ID NO: 5578048 - DNA, 19 bp, Homo sapiens
caaaggtgcactccagact

SEQ ID NO: 5578049 - DNA, 23 bp, Homo sapiens
caaaggtgcactccagactctgg

SEQ ID NO: 5578050 - DNA, 19 bp, Homo sapiens
caaaggtggaataaacatt

SEQ ID NO: 5578051 - DNA, 13 bp, Homo sapiens
caaaggtggcctg

SEQ ID NO: 5578052 - DNA, 14 bp, Homo sapiens
caaaggtggcctgc

SEQ ID NO: 5578053 - DNA, 13 bp, Homo sapiens
caaaggtggctct

SEQ ID NO: 5578054 - DNA, 14 bp, Homo sapiens
caaaggtggtaaat

SEQ ID NO: 5578055 - DNA, 20 bp, Homo sapiens
caaaggtggtaaattcagac

SEQ ID NO: 5578056 - DNA, 19 bp, Homo sapiens
caaaggttactgttgagaa

SEQ ID NO: 5578057 - DNA, 19 bp, Homo sapiens
caaaggttcagaaaattaa

SEQ ID NO: 5578058 - DNA, 14 bp, Homo sapiens
caaaggttctaggt

SEQ ID NO: 5578059 - DNA, 19 bp, Homo sapiens
caaaggttctaggtttcaa

SEQ ID NO: 5578060 - DNA, 17 bp, Homo sapiens
caaaggttgtacatagt

SEQ ID NO: 5578061 - DNA, 13 bp, Homo sapiens
caaaggtttaaat

SEQ ID NO: 5578062 - DNA, 20 bp, Homo sapiens
caaaggtttaaatgaacaag

SEQ ID NO: 5578063 - DNA, 18 bp, Homo sapiens
caaaggtttggaaggagc

SEQ ID NO: 5578064 - DNA, 19 bp, Homo sapiens
caaaggtttggaaggagca

SEQ ID NO: 5578065 - DNA, 11 bp, Homo sapiens
caaaggttttc

SEQ ID NO: 5578066 - DNA, 14 bp, Homo sapiens
caaaggttttgtct

SEQ ID NO: 5578067 - DNA, 13 bp, Homo sapiens
caaagtaaaagaa

SEQ ID NO: 5578068 - DNA, 15 bp, Homo sapiens
caaagtaaaagaaac

SEQ ID NO: 5578069 - DNA, 23 bp, Homo sapiens
caaagtaaaagaaaccacttctg

SEQ ID NO: 5578070 - DNA, 13 bp, Homo sapiens
caaagtaaaatga

SEQ ID NO: 5578071 - DNA, 16 bp, Homo sapiens
caaagtaaactgtgta

SEQ ID NO: 5578072 - DNA, 16 bp, Homo sapiens
caaagtaaaggcctcc

SEQ ID NO: 5578073 - DNA, 18 bp, Homo sapiens
caaagtaaaggcctcctc

SEQ ID NO: 5578074 - DNA, 20 bp, Homo sapiens
caaagtaaaggcctcctccc

SEQ ID NO: 5578075 - DNA, 22 bp, Homo sapiens
caaagtaaaggcctcctccccc

SEQ ID NO: 5578076 - DNA, 22 bp, Homo sapiens
caaagtaacctgggcttaagtt

SEQ ID NO: 5578077 - DNA, 18 bp, Homo sapiens
caaagtaatgacagaaca

SEQ ID NO: 5578078 - DNA, 20 bp, Homo sapiens
caaagtacaatgtgtttttc

SEQ ID NO: 5578079 - DNA, 21 bp, Homo sapiens
caaagtacactgtttcaaact

SEQ ID NO: 5578080 - DNA, 22 bp, Homo sapiens
caaagtacactgtttcaaactt

SEQ ID NO: 5578081 - DNA, 20 bp, Homo sapiens
caaagtacagaaaaatactt

SEQ ID NO: 5578082 - DNA, 20 bp, Homo sapiens
caaagtacaggtactttgtc

SEQ ID NO: 5578083 - DNA, 16 bp, Homo sapiens
caaagtacattgtaaa

SEQ ID NO: 5578084 - DNA, 18 bp, Homo sapiens
caaagtaccacactgagt

SEQ ID NO: 5578085 - DNA, 18 bp, Homo sapiens
caaagtactaaaactaga

SEQ ID NO: 5578086 - DNA, 16 bp, Homo sapiens
caaagtactcctcact

SEQ ID NO: 5578087 - DNA, 14 bp, Homo sapiens
caaagtactcttta

SEQ ID NO: 5578088 - DNA, 20 bp, Homo sapiens
caaagtactctttaacatac

SEQ ID NO: 5578089 - DNA, 11 bp, Homo sapiens
caaagtactgt

SEQ ID NO: 5578090 - DNA, 14 bp, Homo sapiens
caaagtagagaagt

SEQ ID NO: 5578091 - DNA, 19 bp, Homo sapiens
caaagtaggtatacaaaag

SEQ ID NO: 5578092 - DNA, 21 bp, Homo sapiens
caaagtagttttattttaata

SEQ ID NO: 5578093 - DNA, 20 bp, Homo sapiens
caaagtataaatttgtgtaa

SEQ ID NO: 5578094 - DNA, 15 bp, Homo sapiens
caaagtataacaatt

SEQ ID NO: 5578095 - DNA, 14 bp, Homo sapiens
caaagtataatctt

SEQ ID NO: 5578096 - DNA, 17 bp, Homo sapiens
caaagtatctaacaaaa

SEQ ID NO: 5578097 - DNA, 19 bp, Homo sapiens
caaagtatctaacaaaacc

SEQ ID NO: 5578098 - DNA, 17 bp, Homo sapiens
caaagtatgcaatgctt

SEQ ID NO: 5578099 - DNA, 23 bp, Homo sapiens
caaagtatgtggttttgtaattt

SEQ ID NO: 5578100 - DNA, 16 bp, Homo sapiens
caaagtattaagcata

SEQ ID NO: 5578101 - DNA, 21 bp, Homo sapiens
caaagtattaagcatatattt

SEQ ID NO: 5578102 - DNA, 19 bp, Homo sapiens
caaagtattgtaaattata

SEQ ID NO: 5578103 - DNA, 17 bp, Homo sapiens
caaagtattgtgaaagt

SEQ ID NO: 5578104 - DNA, 20 bp, Homo sapiens
caaagtcaataaaagagctg

SEQ ID NO: 5578105 - DNA, 15 bp, Homo sapiens
caaagtcacagtcgt

SEQ ID NO: 5578106 - DNA, 19 bp, Homo sapiens
caaagtcacttccccaaga

SEQ ID NO: 5578107 - DNA, 20 bp, Homo sapiens
caaagtcacttccccaagat

SEQ ID NO: 5578108 - DNA, 22 bp, Homo sapiens
caaagtcacttccccaagatct

SEQ ID NO: 5578109 - DNA, 20 bp, Homo sapiens
caaagtcagaacaaattcag

SEQ ID NO: 5578110 - DNA, 17 bp, Homo sapiens
caaagtcagcagggacc

SEQ ID NO: 5578111 - DNA, 18 bp, Homo sapiens
caaagtcatcccctctca

SEQ ID NO: 5578112 - DNA, 23 bp, Homo sapiens
caaagtcatcccctctcaggaga

SEQ ID NO: 5578113 - DNA, 21 bp, Homo sapiens
caaagtcatgcaaaggctggg

SEQ ID NO: 5578114 - DNA, 17 bp, Homo sapiens
caaagtcattaaagaca

SEQ ID NO: 5578115 - DNA, 13 bp, Homo sapiens
caaagtcccttcc

SEQ ID NO: 5578116 - DNA, 18 bp, Homo sapiens
caaagtcccttgagactc

SEQ ID NO: 5578117 - DNA, 17 bp, Homo sapiens
caaagtcctttttttcc

SEQ ID NO: 5578118 - DNA, 19 bp, Homo sapiens
caaagtcctttttttccat

SEQ ID NO: 5578119 - DNA, 19 bp, Homo sapiens
caaagtcgacatactcatt

SEQ ID NO: 5578120 - DNA, 14 bp, Homo sapiens
caaagtctaaactg

SEQ ID NO: 5578121 - DNA, 20 bp, Homo sapiens
caaagtctaaagtttacagt

SEQ ID NO: 5578122 - DNA, 15 bp, Homo sapiens
caaagtctaggttgg

SEQ ID NO: 5578123 - DNA, 19 bp, Homo sapiens
caaagtctcaatgaaatag

SEQ ID NO: 5578124 - DNA, 19 bp, Homo sapiens
caaagtctccagaagaaaa

SEQ ID NO: 5578125 - DNA, 15 bp, Homo sapiens
caaagtctctcattt

SEQ ID NO: 5578126 - DNA, 22 bp, Homo sapiens
caaagtctgccgcccacctcgc

SEQ ID NO: 5578127 - DNA, 13 bp, Homo sapiens
caaagtctgtgtg

SEQ ID NO: 5578128 - DNA, 22 bp, Homo sapiens
caaagtcttaaaataacttata

SEQ ID NO: 5578129 - DNA, 19 bp, Homo sapiens
caaagtcttgatagcaagc

SEQ ID NO: 5578130 - DNA, 23 bp, Homo sapiens
caaagtgaaggacatagaggtat

SEQ ID NO: 5578131 - DNA, 20 bp, Homo sapiens
caaagtgatagaaaagtgtg

SEQ ID NO: 5578132 - DNA, 18 bp, Homo sapiens
caaagtgattcactgtgc

SEQ ID NO: 5578133 - DNA, 12 bp, Homo sapiens
caaagtgcaaag

SEQ ID NO: 5578134 - DNA, 13 bp, Homo sapiens
caaagtgcaaagc

SEQ ID NO: 5578135 - DNA, 15 bp, Homo sapiens
caaagtgcaaagctg

SEQ ID NO: 5578136 - DNA, 16 bp, Homo sapiens
caaagtgcaaatactc

SEQ ID NO: 5578137 - DNA, 12 bp, Homo sapiens
caaagtgcaagg

SEQ ID NO: 5578138 - DNA, 15 bp, Homo sapiens
caaagtgcacacaca

SEQ ID NO: 5578139 - DNA, 15 bp, Homo sapiens
caaagtgcagccctt

SEQ ID NO: 5578140 - DNA, 17 bp, Homo sapiens
caaagtgcagcccttcc

SEQ ID NO: 5578141 - DNA, 14 bp, Homo sapiens
caaagtgccaaaga

SEQ ID NO: 5578142 - DNA, 15 bp, Homo sapiens
caaagtgccaaagaa

SEQ ID NO: 5578143 - DNA, 18 bp, Homo sapiens
caaagtgcccatggtggc

SEQ ID NO: 5578144 - DNA, 13 bp, Homo sapiens
caaagtgccctca

SEQ ID NO: 5578145 - DNA, 14 bp, Homo sapiens
caaagtgccctcat

SEQ ID NO: 5578146 - DNA, 16 bp, Homo sapiens
caaagtgcctgggaag

SEQ ID NO: 5578147 - DNA, 14 bp, Homo sapiens
caaagtgcctgggc

SEQ ID NO: 5578148 - DNA, 22 bp, Homo sapiens
caaagtgctattacgaagttca

SEQ ID NO: 5578149 - DNA, 15 bp, Homo sapiens
caaagtgctggattg

SEQ ID NO: 5578150 - DNA, 13 bp, Homo sapiens
caaagtgctggga

SEQ ID NO: 5578151 - DNA, 18 bp, Homo sapiens
caaagtgctgggattaca

SEQ ID NO: 5578152 - DNA, 19 bp, Homo sapiens
caaagtgctgggattacag

SEQ ID NO: 5578153 - DNA, 20 bp, Homo sapiens
caaagtgctgggattacagg

SEQ ID NO: 5578154 - DNA, 15 bp, Homo sapiens
caaagtggaacgaaa

SEQ ID NO: 5578155 - DNA, 14 bp, Homo sapiens
caaagtggaaggaa

SEQ ID NO: 5578156 - DNA, 16 bp, Homo sapiens
caaagtggaaggaaag

SEQ ID NO: 5578157 - DNA, 14 bp, Homo sapiens
caaagtggagctgg

SEQ ID NO: 5578158 - DNA, 17 bp, Homo sapiens
caaagtggcagggaccg

SEQ ID NO: 5578159 - DNA, 18 bp, Homo sapiens
caaagtggggagggacaa

SEQ ID NO: 5578160 - DNA, 22 bp, Homo sapiens
caaagtggggggtggacacaga

SEQ ID NO: 5578161 - DNA, 20 bp, Homo sapiens
caaagtgggtactttctgaa

SEQ ID NO: 5578162 - DNA, 22 bp, Homo sapiens
caaagtgggtactttctgaaaa

SEQ ID NO: 5578163 - DNA, 19 bp, Homo sapiens
caaagtggtatagaaatgc

SEQ ID NO: 5578164 - DNA, 16 bp, Homo sapiens
caaagtggtgagaggc

SEQ ID NO: 5578165 - DNA, 12 bp, Homo sapiens
caaagtgtatat

SEQ ID NO: 5578166 - DNA, 20 bp, Homo sapiens
caaagtgtatatttattcat

SEQ ID NO: 5578167 - DNA, 22 bp, Homo sapiens
caaagtgtatgcagtattcttg

SEQ ID NO: 5578168 - DNA, 22 bp, Homo sapiens
caaagtgtattaggaagtgttt

SEQ ID NO: 5578169 - DNA, 22 bp, Homo sapiens
caaagtgtattttataaaatta

SEQ ID NO: 5578170 - DNA, 18 bp, Homo sapiens
caaagtgtcactccataa

SEQ ID NO: 5578171 - DNA, 23 bp, Homo sapiens
caaagtgtcactccataaaaaga

SEQ ID NO: 5578172 - DNA, 15 bp, Homo sapiens
caaagtgtcagtgtt

SEQ ID NO: 5578173 - DNA, 16 bp, Homo sapiens
caaagtgtcagtgttg

SEQ ID NO: 5578174 - DNA, 19 bp, Homo sapiens
caaagtgtcttttgacatt

SEQ ID NO: 5578175 - DNA, 21 bp, Homo sapiens
caaagtgtgtaattatgtaaa

SEQ ID NO: 5578176 - DNA, 12 bp, Homo sapiens
caaagtgtgtat

SEQ ID NO: 5578177 - DNA, 22 bp, Homo sapiens
caaagtgtgtctgggatttttt

SEQ ID NO: 5578178 - DNA, 22 bp, Homo sapiens
caaagtgttgctgtggctccat

SEQ ID NO: 5578179 - DNA, 19 bp, Homo sapiens
caaagtgttgggattacag

SEQ ID NO: 5578180 - DNA, 21 bp, Homo sapiens
caaagtgttgtcttattccta

SEQ ID NO: 5578181 - DNA, 14 bp, Homo sapiens
caaagtgttgtgtt

SEQ ID NO: 5578182 - DNA, 23 bp, Homo sapiens
caaagtgttgtgttcctggctga

SEQ ID NO: 5578183 - DNA, 13 bp, Homo sapiens
caaagtgtttaat

SEQ ID NO: 5578184 - DNA, 19 bp, Homo sapiens
caaagtgtttaattgtata

SEQ ID NO: 5578185 - DNA, 21 bp, Homo sapiens
caaagtgtttaattgtataaa

SEQ ID NO: 5578186 - DNA, 19 bp, Homo sapiens
caaagtgttttgtaccagt

SEQ ID NO: 5578187 - DNA, 23 bp, Homo sapiens
caaagtgttttgtaccagtgaat

SEQ ID NO: 5578188 - DNA, 21 bp, Homo sapiens
caaagttaaacgtgatgtgct

SEQ ID NO: 5578189 - DNA, 15 bp, Homo sapiens
caaagttaaatgtat

SEQ ID NO: 5578190 - DNA, 16 bp, Homo sapiens
caaagttaacctacct

SEQ ID NO: 5578191 - DNA, 22 bp, Homo sapiens
caaagttaattgtatttatgta

SEQ ID NO: 5578192 - DNA, 17 bp, Homo sapiens
caaagttagagaactaa

SEQ ID NO: 5578193 - DNA, 15 bp, Homo sapiens
caaagttagttcagt

SEQ ID NO: 5578194 - DNA, 17 bp, Homo sapiens
caaagttatatttactt

SEQ ID NO: 5578195 - DNA, 13 bp, Homo sapiens
caaagttatccag

SEQ ID NO: 5578196 - DNA, 22 bp, Homo sapiens
caaagttatcttaaatatgaat

SEQ ID NO: 5578197 - DNA, 22 bp, Homo sapiens
caaagttattccccatcttcca

SEQ ID NO: 5578198 - DNA, 20 bp, Homo sapiens
caaagttcacattaactcag

SEQ ID NO: 5578199 - DNA, 18 bp, Homo sapiens
caaagttccaaaatgcca

SEQ ID NO: 5578200 - DNA, 13 bp, Homo sapiens
caaagttccagtt

SEQ ID NO: 5578201 - DNA, 14 bp, Homo sapiens
caaagttccagttt

SEQ ID NO: 5578202 - DNA, 20 bp, Homo sapiens
caaagttcctgttcacctta

SEQ ID NO: 5578203 - DNA, 22 bp, Homo sapiens
caaagttctaataatttctaat

SEQ ID NO: 5578204 - DNA, 13 bp, Homo sapiens
caaagttctcaga

SEQ ID NO: 5578205 - DNA, 17 bp, Homo sapiens
caaagttctgtgtttaa

SEQ ID NO: 5578206 - DNA, 20 bp, Homo sapiens
caaagttctgtgtttaattt

SEQ ID NO: 5578207 - DNA, 22 bp, Homo sapiens
caaagttctgtgtttaatttct

SEQ ID NO: 5578208 - DNA, 17 bp, Homo sapiens
caaagttgcctaaatcc

SEQ ID NO: 5578209 - DNA, 22 bp, Homo sapiens
caaagttgttgtaacctgctgt

SEQ ID NO: 5578210 - DNA, 15 bp, Homo sapiens
caaagtttacattgt

SEQ ID NO: 5578211 - DNA, 19 bp, Homo sapiens
caaatatgattctcctctc

SEQ ID NO: 5578212 - DNA, 12 bp, Homo sapiens
caaatatgcaaa

SEQ ID NO: 5578213 - DNA, 14 bp, Homo sapiens
caaatatgcaaagc

SEQ ID NO: 5578214 - DNA, 17 bp, Homo sapiens
caaatatgcaaagcact

SEQ ID NO: 5578215 - DNA, 18 bp, Homo sapiens
caaatatgcaaagcactg

SEQ ID NO: 5578216 - DNA, 18 bp, Homo sapiens
caaatatgcccctcccca

SEQ ID NO: 5578217 - DNA, 18 bp, Homo sapiens
caaatatgctttgggtca

SEQ ID NO: 5578218 - DNA, 17 bp, Homo sapiens
caaatatgtaaacttta

SEQ ID NO: 5578219 - DNA, 19 bp, Homo sapiens
caaatatgtaaactttaac

SEQ ID NO: 5578220 - DNA, 13 bp, Homo sapiens
caaatatgtggtc

SEQ ID NO: 5578221 - DNA, 18 bp, Homo sapiens
caaatatgttaaagttta

SEQ ID NO: 5578222 - DNA, 13 bp, Homo sapiens
caaatattaaaaa

SEQ ID NO: 5578223 - DNA, 22 bp, Homo sapiens
caaatattaaaaagtcttttaa

SEQ ID NO: 5578224 - DNA, 23 bp, Homo sapiens
caaatattaaaaagtcttttaaa

SEQ ID NO: 5578225 - DNA, 15 bp, Homo sapiens
caaatattaaaattg

SEQ ID NO: 5578226 - DNA, 12 bp, Homo sapiens
caaatattaaga

SEQ ID NO: 5578227 - DNA, 14 bp, Homo sapiens
caaatattaagaaa

SEQ ID NO: 5578228 - DNA, 16 bp, Homo sapiens
caaatattaagaaaat

SEQ ID NO: 5578229 - DNA, 15 bp, Homo sapiens
caaatattaccaaaa

SEQ ID NO: 5578230 - DNA, 12 bp, Homo sapiens
caaatattagca

SEQ ID NO: 5578231 - DNA, 21 bp, Homo sapiens
caaatattagcaaagaagctt

SEQ ID NO: 5578232 - DNA, 23 bp, Homo sapiens
caaatattattcaagtgcctctt

SEQ ID NO: 5578233 - DNA, 13 bp, Homo sapiens
caaatattcagaa

SEQ ID NO: 5578234 - DNA, 14 bp, Homo sapiens
caaatattctaaaa

SEQ ID NO: 5578235 - DNA, 18 bp, Homo sapiens
caaatattctaaaaaaga

SEQ ID NO: 5578236 - DNA, 11 bp, Homo sapiens
caaatattgaa

SEQ ID NO: 5578237 - DNA, 13 bp, Homo sapiens
caaatattgaagt

SEQ ID NO: 5578238 - DNA, 14 bp, Homo sapiens
caaatattgaagtt

SEQ ID NO: 5578239 - DNA, 14 bp, Homo sapiens
caaatattgaatgc

SEQ ID NO: 5578240 - DNA, 16 bp, Homo sapiens
caaatattgaatgcct

SEQ ID NO: 5578241 - DNA, 17 bp, Homo sapiens
caaatattgaatgcctt

SEQ ID NO: 5578242 - DNA, 18 bp, Homo sapiens
caaatattgcttggacta

SEQ ID NO: 5578243 - DNA, 13 bp, Homo sapiens
caaatattgttaa

SEQ ID NO: 5578244 - DNA, 23 bp, Homo sapiens
caaatattgttgacaactgtgac

SEQ ID NO: 5578245 - DNA, 12 bp, Homo sapiens
caaatatttatt

SEQ ID NO: 5578246 - DNA, 16 bp, Homo sapiens
caaatatttattttct

SEQ ID NO: 5578247 - DNA, 19 bp, Homo sapiens
caaatatttctagacactt

SEQ ID NO: 5578248 - DNA, 23 bp, Homo sapiens
caaatattttgtcactgctgtaa

SEQ ID NO: 5578249 - DNA, 18 bp, Homo sapiens
caaatattttttgagtgt

SEQ ID NO: 5578250 - DNA, 18 bp, Homo sapiens
caaatcaaaaacaggcag

SEQ ID NO: 5578251 - DNA, 15 bp, Homo sapiens
caaatcaaaataaaa

SEQ ID NO: 5578252 - DNA, 18 bp, Homo sapiens
caaatcaaaatctctcca

SEQ ID NO: 5578253 - DNA, 16 bp, Homo sapiens
caaatcaaagcaaggg

SEQ ID NO: 5578254 - DNA, 13 bp, Homo sapiens
caaatcaacagaa

SEQ ID NO: 5578255 - DNA, 21 bp, Homo sapiens
caaatcaacagaagcatttgt

SEQ ID NO: 5578256 - DNA, 14 bp, Homo sapiens
caaatcaagcttca

SEQ ID NO: 5578257 - DNA, 17 bp, Homo sapiens
caaatcaaggataaata

SEQ ID NO: 5578258 - DNA, 22 bp, Homo sapiens
caaatcaagtttccaagcaaat

SEQ ID NO: 5578259 - DNA, 24 bp, Homo sapiens
caaatcaagtttccaagcaaatgt

SEQ ID NO: 5578260 - DNA, 15 bp, Homo sapiens
caaatcaatacacta

SEQ ID NO: 5578261 - DNA, 20 bp, Homo sapiens
caaatcaatctgtaaaacta

SEQ ID NO: 5578262 - DNA, 19 bp, Homo sapiens
caaatcaattctagtcata

SEQ ID NO: 5578263 - DNA, 14 bp, Homo sapiens
caaatcaccacaaa

SEQ ID NO: 5578264 - DNA, 19 bp, Homo sapiens
caaatcaccacaaactgta

SEQ ID NO: 5578265 - DNA, 20 bp, Homo sapiens
caaatcaccacaaactgtaa

SEQ ID NO: 5578266 - DNA, 19 bp, Homo sapiens
caaatcacccaatcccagt

SEQ ID NO: 5578267 - DNA, 19 bp, Homo sapiens
caaatcacccactccttta

SEQ ID NO: 5578268 - DNA, 23 bp, Homo sapiens
caaatcacccactcctttacaac

SEQ ID NO: 5578269 - DNA, 14 bp, Homo sapiens
caaatcacttcaat

SEQ ID NO: 5578270 - DNA, 22 bp, Homo sapiens
caaatcagaagtcatcttgcta

SEQ ID NO: 5578271 - DNA, 20 bp, Homo sapiens
caaatcagacacaattagag

SEQ ID NO: 5578272 - DNA, 17 bp, Homo sapiens
caaatcagcaagcttgt

SEQ ID NO: 5578273 - DNA, 13 bp, Homo sapiens
caaatcaggcttt

SEQ ID NO: 5578274 - DNA, 15 bp, Homo sapiens
caaatcaggggccag

SEQ ID NO: 5578275 - DNA, 19 bp, Homo sapiens
caaatcaggggccagagag

SEQ ID NO: 5578276 - DNA, 18 bp, Homo sapiens
caaatcagtatattttct

SEQ ID NO: 5578277 - DNA, 13 bp, Homo sapiens
caaatcagtcagt

SEQ ID NO: 5578278 - DNA, 15 bp, Homo sapiens
caaatcagtctcaca

SEQ ID NO: 5578279 - DNA, 16 bp, Homo sapiens
caaatcagtgatctat

SEQ ID NO: 5578280 - DNA, 17 bp, Homo sapiens
caaatcagtgatctatg

SEQ ID NO: 5578281 - DNA, 14 bp, Homo sapiens
caaatcagttacta

SEQ ID NO: 5578282 - DNA, 20 bp, Homo sapiens
caaatcagttactaagaaga

SEQ ID NO: 5578283 - DNA, 21 bp, Homo sapiens
caaatcagttactaagaagaa

SEQ ID NO: 5578284 - DNA, 14 bp, Homo sapiens
caaatcataatgta

SEQ ID NO: 5578285 - DNA, 13 bp, Homo sapiens
caaatcatcctga

SEQ ID NO: 5578286 - DNA, 20 bp, Homo sapiens
caaatcatctgcattcctga

SEQ ID NO: 5578287 - DNA, 12 bp, Homo sapiens
caaatcatgttt

SEQ ID NO: 5578288 - DNA, 14 bp, Homo sapiens
caaatcattcaaaa

SEQ ID NO: 5578289 - DNA, 18 bp, Homo sapiens
caaatcattccttagata

SEQ ID NO: 5578290 - DNA, 16 bp, Homo sapiens
caaatcatttgtttaa

SEQ ID NO: 5578291 - DNA, 17 bp, Homo sapiens
caaatcatttgtttaaa

SEQ ID NO: 5578292 - DNA, 23 bp, Homo sapiens
caaatcattttgatgtattatta

SEQ ID NO: 5578293 - DNA, 21 bp, Homo sapiens
caaatcatttttgagactggt

SEQ ID NO: 5578294 - DNA, 16 bp, Homo sapiens
caaatccaaggaaaca

SEQ ID NO: 5578295 - DNA, 18 bp, Homo sapiens
caaatccaaggaaacatg

SEQ ID NO: 5578296 - DNA, 16 bp, Homo sapiens
caaatccactgacaga

SEQ ID NO: 5578297 - DNA, 22 bp, Homo sapiens
caaatccagcctgctgcctgct

SEQ ID NO: 5578298 - DNA, 15 bp, Homo sapiens
caaatccaggacttt

SEQ ID NO: 5578299 - DNA, 15 bp, Homo sapiens
caaatccagtggtgg

SEQ ID NO: 5578300 - DNA, 17 bp, Homo sapiens
caaatccagtggtgggt

SEQ ID NO: 5578301 - DNA, 19 bp, Homo sapiens
caaatccataccccctgcc

SEQ ID NO: 5578302 - DNA, 20 bp, Homo sapiens
caaatccataccccctgccc

SEQ ID NO: 5578303 - DNA, 18 bp, Homo sapiens
caaatccatgtgtccccc

SEQ ID NO: 5578304 - DNA, 14 bp, Homo sapiens
caaatcccagggaa

SEQ ID NO: 5578305 - DNA, 14 bp, Homo sapiens
caaatcccatttct

SEQ ID NO: 5578306 - DNA, 21 bp, Homo sapiens
caaatcccccgactccctccc

SEQ ID NO: 5578307 - DNA, 15 bp, Homo sapiens
caaatccgaaatcag

SEQ ID NO: 5578308 - DNA, 22 bp, Homo sapiens
caaatccgaacctcctctgtga

SEQ ID NO: 5578309 - DNA, 19 bp, Homo sapiens
caaatccgctctcttcctg

SEQ ID NO: 5578310 - DNA, 20 bp, Homo sapiens
caaatccgctctcttcctgc

SEQ ID NO: 5578311 - DNA, 21 bp, Homo sapiens
caaatccgctctcttcctgcc

SEQ ID NO: 5578312 - DNA, 22 bp, Homo sapiens
caaatcctaaggggagctacag

SEQ ID NO: 5578313 - DNA, 23 bp, Homo sapiens
caaatcctagactgctcctgggc

SEQ ID NO: 5578314 - DNA, 19 bp, Homo sapiens
caaatcctaggctcctggg

SEQ ID NO: 5578315 - DNA, 21 bp, Homo sapiens
caaatcctaggctcctgggag

SEQ ID NO: 5578316 - DNA, 13 bp, Homo sapiens
caaatcctatgtg

SEQ ID NO: 5578317 - DNA, 15 bp, Homo sapiens
caaatcctatgtgat

SEQ ID NO: 5578318 - DNA, 16 bp, Homo sapiens
caaatcctatgtgatt

SEQ ID NO: 5578319 - DNA, 22 bp, Homo sapiens
caaatcctatgtgattttaact

SEQ ID NO: 5578320 - DNA, 15 bp, Homo sapiens
caaatcctatttaaa

SEQ ID NO: 5578321 - DNA, 17 bp, Homo sapiens
caaatcctatttaaaga

SEQ ID NO: 5578322 - DNA, 20 bp, Homo sapiens
caaatcctccctacttccaa

SEQ ID NO: 5578323 - DNA, 22 bp, Homo sapiens
caaatcctccctacttccaaga

SEQ ID NO: 5578324 - DNA, 14 bp, Homo sapiens
caaatcctcttttg

SEQ ID NO: 5578325 - DNA, 13 bp, Homo sapiens
caaatcctggaag

SEQ ID NO: 5578326 - DNA, 16 bp, Homo sapiens
caaatccttgagcact

SEQ ID NO: 5578327 - DNA, 11 bp, Homo sapiens
caaatccttgg

SEQ ID NO: 5578328 - DNA, 17 bp, Homo sapiens
caaatcctttctgcccc

SEQ ID NO: 5578329 - DNA, 22 bp, Homo sapiens
caaatcctttctgccccccagg

SEQ ID NO: 5578330 - DNA, 21 bp, Homo sapiens
caaatcgtacattgtgccctg

SEQ ID NO: 5578331 - DNA, 18 bp, Homo sapiens
caaatcgtagcgtttgtt

SEQ ID NO: 5578332 - DNA, 19 bp, Homo sapiens
caaatcgtccagcgacctt

SEQ ID NO: 5578333 - DNA, 21 bp, Homo sapiens
caaatcgtggcacgtattgct

SEQ ID NO: 5578334 - DNA, 20 bp, Homo sapiens
caaatctaaaatgcaaagaa

SEQ ID NO: 5578335 - DNA, 22 bp, Homo sapiens
caaatctaaagttgctccatac

SEQ ID NO: 5578336 - DNA, 14 bp, Homo sapiens
caaatctaatctct

SEQ ID NO: 5578337 - DNA, 16 bp, Homo sapiens
caaatctaatgtaaga

SEQ ID NO: 5578338 - DNA, 16 bp, Homo sapiens
caaatctactgagcca

SEQ ID NO: 5578339 - DNA, 19 bp, Homo sapiens
caaatctactgagccacgg

SEQ ID NO: 5578340 - DNA, 15 bp, Homo sapiens
caaatctataaagaa

SEQ ID NO: 5578341 - DNA, 18 bp, Homo sapiens
caaatctcctctttgtga

SEQ ID NO: 5578342 - DNA, 16 bp, Homo sapiens
caaatctcctgctgat

SEQ ID NO: 5578343 - DNA, 14 bp, Homo sapiens
caaatctcttgctt

SEQ ID NO: 5578344 - DNA, 20 bp, Homo sapiens
caaatctcttgcttgtcatt

SEQ ID NO: 5578345 - DNA, 21 bp, Homo sapiens
caaatctcttgcttgtcattg

SEQ ID NO: 5578346 - DNA, 21 bp, Homo sapiens
caaatctgacatattatgcct

SEQ ID NO: 5578347 - DNA, 14 bp, Homo sapiens
caaatctgactttt

SEQ ID NO: 5578348 - DNA, 18 bp, Homo sapiens
caaatctgactttttctg

SEQ ID NO: 5578349 - DNA, 20 bp, Homo sapiens
caaatctgactttttctgtg

SEQ ID NO: 5578350 - DNA, 21 bp, Homo sapiens
caaatctgccaagagagatgt

SEQ ID NO: 5578351 - DNA, 13 bp, Homo sapiens
caaatctgggctc

SEQ ID NO: 5578352 - DNA, 20 bp, Homo sapiens
caaatctggtccatatttac

SEQ ID NO: 5578353 - DNA, 16 bp, Homo sapiens
caaatctgtataaatg

SEQ ID NO: 5578354 - DNA, 17 bp, Homo sapiens
caaatctgtataaatgt

SEQ ID NO: 5578355 - DNA, 18 bp, Homo sapiens
caaatctgtataaatgtc

SEQ ID NO: 5578356 - DNA, 20 bp, Homo sapiens
caaatctgtataaatgtcta

SEQ ID NO: 5578357 - DNA, 15 bp, Homo sapiens
caaatctgtcctctg

SEQ ID NO: 5578358 - DNA, 16 bp, Homo sapiens
caaatctgtcctctgt

SEQ ID NO: 5578359 - DNA, 16 bp, Homo sapiens
caaatctgtctcccca

SEQ ID NO: 5578360 - DNA, 12 bp, Homo sapiens
caaatctgtgta

SEQ ID NO: 5578361 - DNA, 17 bp, Homo sapiens
caaatctgtgtatatta

SEQ ID NO: 5578362 - DNA, 21 bp, Homo sapiens
caaatcttcaaggtgtaaaat

SEQ ID NO: 5578363 - DNA, 13 bp, Homo sapiens
caaatcttcctgg

SEQ ID NO: 5578364 - DNA, 21 bp, Homo sapiens
caaatcttggcaatattcctt

SEQ ID NO: 5578365 - DNA, 19 bp, Homo sapiens
caaatcttgttattgaagt

SEQ ID NO: 5578366 - DNA, 21 bp, Homo sapiens
caaatctttctgtaaacagaa

SEQ ID NO: 5578367 - DNA, 19 bp, Homo sapiens
caaatcttttagtcattat

SEQ ID NO: 5578368 - DNA, 17 bp, Homo sapiens
caaatgaaaaatctcaa

SEQ ID NO: 5578369 - DNA, 13 bp, Homo sapiens
caaatgaaaacaa

SEQ ID NO: 5578370 - DNA, 19 bp, Homo sapiens
caaatgaaacctacaggaa

SEQ ID NO: 5578371 - DNA, 19 bp, Homo sapiens
caaatgaaagttttatttt

SEQ ID NO: 5578372 - DNA, 14 bp, Homo sapiens
caaatgaaatgcca

SEQ ID NO: 5578373 - DNA, 19 bp, Homo sapiens
caaatgaaatgccaaagga

SEQ ID NO: 5578374 - DNA, 13 bp, Homo sapiens
caaatgaaatgta

SEQ ID NO: 5578375 - DNA, 16 bp, Homo sapiens
caaatgaactttaaaa

SEQ ID NO: 5578376 - DNA, 19 bp, Homo sapiens
caaatgaacttttacagaa

SEQ ID NO: 5578377 - DNA, 22 bp, Homo sapiens
caaatgaacttttacagaatgc

SEQ ID NO: 5578378 - DNA, 23 bp, Homo sapiens
caaatgaacttttacagaatgca

SEQ ID NO: 5578379 - DNA, 14 bp, Homo sapiens
caaatgaagaaagt

SEQ ID NO: 5578380 - DNA, 15 bp, Homo sapiens
caaatgaagaaagtc

SEQ ID NO: 5578381 - DNA, 16 bp, Homo sapiens
caaatgaagaaagtca

SEQ ID NO: 5578382 - DNA, 22 bp, Homo sapiens
caaatgaataatgcctttgtaa

SEQ ID NO: 5578383 - DNA, 23 bp, Homo sapiens
caaatgaataatgcctttgtaac

SEQ ID NO: 5578384 - DNA, 14 bp, Homo sapiens
caaatgaatgatta

SEQ ID NO: 5578385 - DNA, 19 bp, Homo sapiens
caaatgaatgattaaatta

SEQ ID NO: 5578386 - DNA, 20 bp, Homo sapiens
caaatgaatgattaaattat

SEQ ID NO: 5578387 - DNA, 18 bp, Homo sapiens
caaatgaatgcctttcaa

SEQ ID NO: 5578388 - DNA, 20 bp, Homo sapiens
caaatgaatgcctttcaaac

SEQ ID NO: 5578389 - DNA, 15 bp, Homo sapiens
caacaaaactatgga

SEQ ID NO: 5578390 - DNA, 12 bp, Homo sapiens
caacaaaataca

SEQ ID NO: 5578391 - DNA, 14 bp, Homo sapiens
caacaaaatacatt

SEQ ID NO: 5578392 - DNA, 20 bp, Homo sapiens
caacaaaccctctgtagcta

SEQ ID NO: 5578393 - DNA, 19 bp, Homo sapiens
caacaaactcaaaatgtgg

SEQ ID NO: 5578394 - DNA, 21 bp, Homo sapiens
caacaaactgcacatgatttc

SEQ ID NO: 5578395 - DNA, 12 bp, Homo sapiens
caacaaagaaat

SEQ ID NO: 5578396 - DNA, 14 bp, Homo sapiens
caacaaagaaatat

SEQ ID NO: 5578397 - DNA, 21 bp, Homo sapiens
caacaaagaagaaccatcttt

SEQ ID NO: 5578398 - DNA, 20 bp, Homo sapiens
caacaaagagcgagtcccct

SEQ ID NO: 5578399 - DNA, 21 bp, Homo sapiens
caacaaagattgagaagccat

SEQ ID NO: 5578400 - DNA, 17 bp, Homo sapiens
caacaaagcacagtgtt

SEQ ID NO: 5578401 - DNA, 17 bp, Homo sapiens
caacaaagcatgctcag

SEQ ID NO: 5578402 - DNA, 19 bp, Homo sapiens
caacaaagccaacagtcaa

SEQ ID NO: 5578403 - DNA, 13 bp, Homo sapiens
caacaaaggaagt

SEQ ID NO: 5578404 - DNA, 17 bp, Homo sapiens
caacaaagtcacagtcg

SEQ ID NO: 5578405 - DNA, 20 bp, Homo sapiens
caacaaagttccacttccag

SEQ ID NO: 5578406 - DNA, 15 bp, Homo sapiens
caacaaataatttaa

SEQ ID NO: 5578407 - DNA, 16 bp, Homo sapiens
caacaaatacttccat

SEQ ID NO: 5578408 - DNA, 14 bp, Homo sapiens
caacaaatgaattt

SEQ ID NO: 5578409 - DNA, 16 bp, Homo sapiens
caacaaatgtgggtga

SEQ ID NO: 5578410 - DNA, 14 bp, Homo sapiens
caacaaattaaata

SEQ ID NO: 5578411 - DNA, 15 bp, Homo sapiens
caacaaattaaataa

SEQ ID NO: 5578412 - DNA, 19 bp, Homo sapiens
caacaaattaaataaatta

SEQ ID NO: 5578413 - DNA, 16 bp, Homo sapiens
caacaaatttcattgc

SEQ ID NO: 5578414 - DNA, 19 bp, Homo sapiens
caacaaatttcattgcact

SEQ ID NO: 5578415 - DNA, 13 bp, Homo sapiens
caacaacaaaaac

SEQ ID NO: 5578416 - DNA, 14 bp, Homo sapiens
caacaacaacaata

SEQ ID NO: 5578417 - DNA, 17 bp, Homo sapiens
caacaacaaggaccctg

SEQ ID NO: 5578418 - DNA, 14 bp, Homo sapiens
caacaacaataaca

SEQ ID NO: 5578419 - DNA, 13 bp, Homo sapiens
caacaacaataca

SEQ ID NO: 5578420 - DNA, 18 bp, Homo sapiens
caacaacaatacaacaag

SEQ ID NO: 5578421 - DNA, 16 bp, Homo sapiens
caacaacaattggtaa

SEQ ID NO: 5578422 - DNA, 17 bp, Homo sapiens
caacaacagaagggaaa

SEQ ID NO: 5578423 - DNA, 22 bp, Homo sapiens
caacaacagtcagccagcttgg

SEQ ID NO: 5578424 - DNA, 14 bp, Homo sapiens
caacaacatgaaac

SEQ ID NO: 5578425 - DNA, 15 bp, Homo sapiens
caacaacatgtcaaa

SEQ ID NO: 5578426 - DNA, 17 bp, Homo sapiens
caacaaccacacttaaa

SEQ ID NO: 5578427 - DNA, 18 bp, Homo sapiens
caacaaccaccaccttat

SEQ ID NO: 5578428 - DNA, 16 bp, Homo sapiens
caacaacgtgagagaa

SEQ ID NO: 5578429 - DNA, 18 bp, Homo sapiens
caacaacgtgagagaaag

SEQ ID NO: 5578430 - DNA, 19 bp, Homo sapiens
caacaacgtgagagaaaga

SEQ ID NO: 5578431 - DNA, 19 bp, Homo sapiens
caacaactccaggaaaact

SEQ ID NO: 5578432 - DNA, 16 bp, Homo sapiens
caacaactttgtttct

SEQ ID NO: 5578433 - DNA, 16 bp, Homo sapiens
caacaagaacaacaac

SEQ ID NO: 5578434 - DNA, 15 bp, Homo sapiens
caacaagaagaaata

SEQ ID NO: 5578435 - DNA, 16 bp, Homo sapiens
caacaagaagaaatat

SEQ ID NO: 5578436 - DNA, 18 bp, Homo sapiens
caacaagaagaaatatga

SEQ ID NO: 5578437 - DNA, 21 bp, Homo sapiens
caacaagaatgcattccctga

SEQ ID NO: 5578438 - DNA, 18 bp, Homo sapiens
caacaagaccgccccagg

SEQ ID NO: 5578439 - DNA, 17 bp, Homo sapiens
caacaagactgccaggt

SEQ ID NO: 5578440 - DNA, 18 bp, Homo sapiens
caacaagactgccaggtg

SEQ ID NO: 5578441 - DNA, 14 bp, Homo sapiens
caacaagagcgaaa

SEQ ID NO: 5578442 - DNA, 22 bp, Homo sapiens
caacaagcccgttagccccagg

SEQ ID NO: 5578443 - DNA, 23 bp, Homo sapiens
caacaagcctgaaagtaatttca

SEQ ID NO: 5578444 - DNA, 18 bp, Homo sapiens
caacaaggaaactttcct

SEQ ID NO: 5578445 - DNA, 20 bp, Homo sapiens
caacaaggacaactttatgt

SEQ ID NO: 5578446 - DNA, 12 bp, Homo sapiens
caacaaggaccc

SEQ ID NO: 5578447 - DNA, 13 bp, Homo sapiens
caacaaggaccct

SEQ ID NO: 5578448 - DNA, 14 bp, Homo sapiens
caacaaggaccctg

SEQ ID NO: 5578449 - DNA, 12 bp, Homo sapiens
caacaaggccct

SEQ ID NO: 5578450 - DNA, 15 bp, Homo sapiens
caacaagggagagac

SEQ ID NO: 5578451 - DNA, 18 bp, Homo sapiens
caacaagggagagacctc

SEQ ID NO: 5578452 - DNA, 21 bp, Homo sapiens
caacaagggagagacctcatc

SEQ ID NO: 5578453 - DNA, 18 bp, Homo sapiens
caacaaggggtcaatgtc

SEQ ID NO: 5578454 - DNA, 20 bp, Homo sapiens
caacaaggtggtgtgatctt

SEQ ID NO: 5578455 - DNA, 13 bp, Homo sapiens
caacaataaaaaa

SEQ ID NO: 5578456 - DNA, 15 bp, Homo sapiens
caacaataaaatttt

SEQ ID NO: 5578457 - DNA, 14 bp, Homo sapiens
caacaataaagagc

SEQ ID NO: 5578458 - DNA, 16 bp, Homo sapiens
caacaataaagagctc

SEQ ID NO: 5578459 - DNA, 17 bp, Homo sapiens
caacaataaagagctca

SEQ ID NO: 5578460 - DNA, 12 bp, Homo sapiens
caacaataaata

SEQ ID NO: 5578461 - DNA, 11 bp, Homo sapiens
caacaataaca

SEQ ID NO: 5578462 - DNA, 15 bp, Homo sapiens
caacaataataaatg

SEQ ID NO: 5578463 - DNA, 16 bp, Homo sapiens
caacaatacaacaaga

SEQ ID NO: 5578464 - DNA, 22 bp, Homo sapiens
caacaatgctttgataaaatat

SEQ ID NO: 5578465 - DNA, 14 bp, Homo sapiens
caacaattagagga

SEQ ID NO: 5578466 - DNA, 18 bp, Homo sapiens
caacaattaggtctgcat

SEQ ID NO: 5578467 - DNA, 20 bp, Homo sapiens
caacaattaggtctgcattt

SEQ ID NO: 5578468 - DNA, 15 bp, Homo sapiens
caacaattggtaaaa

SEQ ID NO: 5578469 - DNA, 18 bp, Homo sapiens
caacaattggtaaaactc

SEQ ID NO: 5578470 - DNA, 17 bp, Homo sapiens
caacaattggtgtcatt

SEQ ID NO: 5578471 - DNA, 22 bp, Homo sapiens
caacaattggtgtcattttctt

SEQ ID NO: 5578472 - DNA, 20 bp, Homo sapiens
caacaatttaggaatgctca

SEQ ID NO: 5578473 - DNA, 13 bp, Homo sapiens
caacaatttcaat

SEQ ID NO: 5578474 - DNA, 13 bp, Homo sapiens
caacaattttcta

SEQ ID NO: 5578475 - DNA, 12 bp, Homo sapiens
caacacaaagac

SEQ ID NO: 5578476 - DNA, 16 bp, Homo sapiens
caacacaaagagaaaa

SEQ ID NO: 5578477 - DNA, 14 bp, Homo sapiens
caacacaagaaaac

SEQ ID NO: 5578478 - DNA, 20 bp, Homo sapiens
caacacaagctggaagcaca

SEQ ID NO: 5578479 - DNA, 21 bp, Homo sapiens
caacacaaggtgggcagggag

SEQ ID NO: 5578480 - DNA, 17 bp, Homo sapiens
caacacaatcaaaagat

SEQ ID NO: 5578481 - DNA, 16 bp, Homo sapiens
caacacaatccgttgc

SEQ ID NO: 5578482 - DNA, 13 bp, Homo sapiens
caacacacacaca

SEQ ID NO: 5578483 - DNA, 16 bp, Homo sapiens
caacacacagcagata

SEQ ID NO: 5578484 - DNA, 13 bp, Homo sapiens
caacacagcctgg

SEQ ID NO: 5578485 - DNA, 16 bp, Homo sapiens
caacacagcctgggcc

SEQ ID NO: 5578486 - DNA, 15 bp, Homo sapiens
caacacagctgcttc

SEQ ID NO: 5578487 - DNA, 20 bp, Homo sapiens
caacacatcaggaaagagag

SEQ ID NO: 5578488 - DNA, 20 bp, Homo sapiens
caacacattacttgcacaag

SEQ ID NO: 5578489 - DNA, 21 bp, Homo sapiens
caacacatttcacttttctgt

SEQ ID NO: 5578490 - DNA, 13 bp, Homo sapiens
caacacatttttg

SEQ ID NO: 5578491 - DNA, 18 bp, Homo sapiens
caacaccacagacacaca

SEQ ID NO: 5578492 - DNA, 19 bp, Homo sapiens
caacaccacagacacacac

SEQ ID NO: 5578493 - DNA, 20 bp, Homo sapiens
caacaccacagacacacaca

SEQ ID NO: 5578494 - DNA, 14 bp, Homo sapiens
caacaccagcccct

SEQ ID NO: 5578495 - DNA, 14 bp, Homo sapiens
caacaccaggactt

SEQ ID NO: 5578496 - DNA, 22 bp, Homo sapiens
caacaccaggacttaagacaaa

SEQ ID NO: 5578497 - DNA, 20 bp, Homo sapiens
caacacccaaaggtggcctg

SEQ ID NO: 5578498 - DNA, 18 bp, Homo sapiens
caacacccaagtccaccc

SEQ ID NO: 5578499 - DNA, 23 bp, Homo sapiens
caacaccccgcctgcctcctggc

SEQ ID NO: 5578500 - DNA, 23 bp, Homo sapiens
caacaccctgcttctcccgggga

SEQ ID NO: 5578501 - DNA, 15 bp, Homo sapiens
caacacctcctcctg

SEQ ID NO: 5578502 - DNA, 16 bp, Homo sapiens
caacacctcctcctgc

SEQ ID NO: 5578503 - DNA, 23 bp, Homo sapiens
caacacctcctcctgctgctcac

SEQ ID NO: 5578504 - DNA, 18 bp, Homo sapiens
caacacctccttgctttg

SEQ ID NO: 5578505 - DNA, 11 bp, Homo sapiens
caacacctgcc

SEQ ID NO: 5578506 - DNA, 19 bp, Homo sapiens
caacacctgccgtaagtta

SEQ ID NO: 5578507 - DNA, 13 bp, Homo sapiens
caacacctgctgc

SEQ ID NO: 5578508 - DNA, 22 bp, Homo sapiens
caacaccttcagaggctgaggt

SEQ ID NO: 5578509 - DNA, 18 bp, Homo sapiens
caacaccttcctcctgca

SEQ ID NO: 5578510 - DNA, 17 bp, Homo sapiens
caacaccttcttggctt

SEQ ID NO: 5578511 - DNA, 20 bp, Homo sapiens
caacacgcatggtcaaccct

SEQ ID NO: 5578512 - DNA, 21 bp, Homo sapiens
caacacggagcagggagagct

SEQ ID NO: 5578513 - DNA, 19 bp, Homo sapiens
caacacgtcattgtgtaag

SEQ ID NO: 5578514 - DNA, 23 bp, Homo sapiens
caacacgtcattgtgtaaggaaa

SEQ ID NO: 5578515 - DNA, 14 bp, Homo sapiens
caacacgtggaggt

SEQ ID NO: 5578516 - DNA, 15 bp, Homo sapiens
caacactatatattt

SEQ ID NO: 5578517 - DNA, 15 bp, Homo sapiens
caacactcactgcct

SEQ ID NO: 5578518 - DNA, 16 bp, Homo sapiens
caacactcactgcctg

SEQ ID NO: 5578519 - DNA, 20 bp, Homo sapiens
caacactcatcacacttcat

SEQ ID NO: 5578520 - DNA, 21 bp, Homo sapiens
caacactcatcacacttcatt

SEQ ID NO: 5578521 - DNA, 20 bp, Homo sapiens
caacactcattgacctgagg

SEQ ID NO: 5578522 - DNA, 13 bp, Homo sapiens
caacactctactt

SEQ ID NO: 5578523 - DNA, 19 bp, Homo sapiens
caacactctacttgaagca

SEQ ID NO: 5578524 - DNA, 22 bp, Homo sapiens
caacactcttcttgagcagacc

SEQ ID NO: 5578525 - DNA, 23 bp, Homo sapiens
caacactgaaaaaatactaccta

SEQ ID NO: 5578526 - DNA, 21 bp, Homo sapiens
caacactgatttccccttttg

SEQ ID NO: 5578527 - DNA, 12 bp, Homo sapiens
caacactgccag

SEQ ID NO: 5578528 - DNA, 13 bp, Homo sapiens
caacactgctgtc

SEQ ID NO: 5578529 - DNA, 16 bp, Homo sapiens
caacactgctgtccac

SEQ ID NO: 5578530 - DNA, 20 bp, Homo sapiens
caacactgggaaacagaggc

SEQ ID NO: 5578531 - DNA, 22 bp, Homo sapiens
caacactggtctgctgttccag

SEQ ID NO: 5578532 - DNA, 23 bp, Homo sapiens
caacactggtgtgacctgagggc

SEQ ID NO: 5578533 - DNA, 17 bp, Homo sapiens
caacactgtccttccct

SEQ ID NO: 5578534 - DNA, 19 bp, Homo sapiens
caacactgtccttccctgc

SEQ ID NO: 5578535 - DNA, 23 bp, Homo sapiens
caacactgtccttccctgccact

SEQ ID NO: 5578536 - DNA, 13 bp, Homo sapiens
caacactgtgccc

SEQ ID NO: 5578537 - DNA, 19 bp, Homo sapiens
caacactgtgccctggtgg

SEQ ID NO: 5578538 - DNA, 13 bp, Homo sapiens
caacactgtgggt

SEQ ID NO: 5578539 - DNA, 21 bp, Homo sapiens
caacactgtgggtgtgtgact

SEQ ID NO: 5578540 - DNA, 18 bp, Homo sapiens
caacacttaatcatttta

SEQ ID NO: 5578541 - DNA, 15 bp, Homo sapiens
caacacttattttct

SEQ ID NO: 5578542 - DNA, 16 bp, Homo sapiens
caacacttattttctg

SEQ ID NO: 5578543 - DNA, 23 bp, Homo sapiens
caacacttgcaggggtccctgct

SEQ ID NO: 5578544 - DNA, 22 bp, Homo sapiens
caacacttgtgttgctttctga

SEQ ID NO: 5578545 - DNA, 18 bp, Homo sapiens
caacactttgagcatttt

SEQ ID NO: 5578546 - DNA, 20 bp, Homo sapiens
caacactttgagcattttta

SEQ ID NO: 5578547 - DNA, 16 bp, Homo sapiens
caacagaaaaacaatc

SEQ ID NO: 5578548 - DNA, 14 bp, Homo sapiens
caacagaaaaatgg

SEQ ID NO: 5578549 - DNA, 14 bp, Homo sapiens
caacagaaaacaat

SEQ ID NO: 5578550 - DNA, 10 bp, Homo sapiens
caacagaaac

SEQ ID NO: 5578551 - DNA, 19 bp, Homo sapiens
caacagaaacatgccagaa

SEQ ID NO: 5578552 - DNA, 13 bp, Homo sapiens
caacagaaacatt

SEQ ID NO: 5578553 - DNA, 19 bp, Homo sapiens
caacagaaaccaagagaca

SEQ ID NO: 5578554 - DNA, 19 bp, Homo sapiens
caacagaaaccttttattt

SEQ ID NO: 5578555 - DNA, 19 bp, Homo sapiens
caacagaaataaaatacac

SEQ ID NO: 5578556 - DNA, 22 bp, Homo sapiens
caacagaacatatgttgcaaga

SEQ ID NO: 5578557 - DNA, 16 bp, Homo sapiens
caacagaagcttcaga

SEQ ID NO: 5578558 - DNA, 15 bp, Homo sapiens
caacagaagcttcca

SEQ ID NO: 5578559 - DNA, 12 bp, Homo sapiens
caacagaagtgg

SEQ ID NO: 5578560 - DNA, 17 bp, Homo sapiens
caacagaataaagcagc

SEQ ID NO: 5578561 - DNA, 22 bp, Homo sapiens
caacagaataaagcagcctgat

SEQ ID NO: 5578562 - DNA, 20 bp, Homo sapiens
caacagaatgaaaaatgaaa

SEQ ID NO: 5578563 - DNA, 21 bp, Homo sapiens
caacagaatgaaaaatgaaag

SEQ ID NO: 5578564 - DNA, 22 bp, Homo sapiens
caacagaatgaaaaatgaaaga

SEQ ID NO: 5578565 - DNA, 16 bp, Homo sapiens
caacagaatttttccc

SEQ ID NO: 5578566 - DNA, 13 bp, Homo sapiens
caacagacaccct

SEQ ID NO: 5578567 - DNA, 14 bp, Homo sapiens
caacagacaccctc

SEQ ID NO: 5578568 - DNA, 16 bp, Homo sapiens
caaccctcagctgcct

SEQ ID NO: 5578569 - DNA, 18 bp, Homo sapiens
caaccctcaggggaaaac

SEQ ID NO: 5578570 - DNA, 15 bp, Homo sapiens
caaccctcatcacca

SEQ ID NO: 5578571 - DNA, 20 bp, Homo sapiens
caaccctccctcagcccctc

SEQ ID NO: 5578572 - DNA, 17 bp, Homo sapiens
caaccctcggagccccc

SEQ ID NO: 5578573 - DNA, 13 bp, Homo sapiens
caaccctctggaa

SEQ ID NO: 5578574 - DNA, 13 bp, Homo sapiens
caaccctgaagca

SEQ ID NO: 5578575 - DNA, 18 bp, Homo sapiens
caaccctgaggtatctgt

SEQ ID NO: 5578576 - DNA, 20 bp, Homo sapiens
caaccctgaggtatctgtgt

SEQ ID NO: 5578577 - DNA, 12 bp, Homo sapiens
caaccctgcaaa

SEQ ID NO: 5578578 - DNA, 12 bp, Homo sapiens
caaccctgccct

SEQ ID NO: 5578579 - DNA, 22 bp, Homo sapiens
caaccctgcctgccgctgcacc

SEQ ID NO: 5578580 - DNA, 23 bp, Homo sapiens
caaccctgcctgccgctgcacct

SEQ ID NO: 5578581 - DNA, 19 bp, Homo sapiens
caaccctggaaaaggagtt

SEQ ID NO: 5578582 - DNA, 13 bp, Homo sapiens
caaccctggagag

SEQ ID NO: 5578583 - DNA, 23 bp, Homo sapiens
caaccctggagagttcaatggct

SEQ ID NO: 5578584 - DNA, 14 bp, Homo sapiens
caaccctggcctca

SEQ ID NO: 5578585 - DNA, 17 bp, Homo sapiens
caaccctggcctcactt

SEQ ID NO: 5578586 - DNA, 12 bp, Homo sapiens
caaccctgggac

SEQ ID NO: 5578587 - DNA, 20 bp, Homo sapiens
caaccctgggctggggagga

SEQ ID NO: 5578588 - DNA, 20 bp, Homo sapiens
caaccctggggaaggagcca

SEQ ID NO: 5578589 - DNA, 21 bp, Homo sapiens
caaccctggggaaggagccag

SEQ ID NO: 5578590 - DNA, 13 bp, Homo sapiens
caaccctggtgtg

SEQ ID NO: 5578591 - DNA, 22 bp, Homo sapiens
caaccctgtcagaatcatgctg

SEQ ID NO: 5578592 - DNA, 22 bp, Homo sapiens
caaccctgttgagtatttgctg

SEQ ID NO: 5578593 - DNA, 15 bp, Homo sapiens
caaccctgtttcctg

SEQ ID NO: 5578594 - DNA, 17 bp, Homo sapiens
caaccctgttttatact

SEQ ID NO: 5578595 - DNA, 15 bp, Homo sapiens
caacccttacccctt

SEQ ID NO: 5578596 - DNA, 19 bp, Homo sapiens
caacccttaccccttagcc

SEQ ID NO: 5578597 - DNA, 22 bp, Homo sapiens
caacccttagcttttagcctgg

SEQ ID NO: 5578598 - DNA, 17 bp, Homo sapiens
caacccttccctcacct

SEQ ID NO: 5578599 - DNA, 10 bp, Homo sapiens
caacccttct

SEQ ID NO: 5578600 - DNA, 17 bp, Homo sapiens
caaccgatgctccagcc

SEQ ID NO: 5578601 - DNA, 22 bp, Homo sapiens
caaccgatgctccagccaaccc

SEQ ID NO: 5578602 - DNA, 18 bp, Homo sapiens
caaccgcatctgctcatc

SEQ ID NO: 5578603 - DNA, 14 bp, Homo sapiens
caaccggatgccag

SEQ ID NO: 5578604 - DNA, 17 bp, Homo sapiens
caaccgggaaaggcatc

SEQ ID NO: 5578605 - DNA, 21 bp, Homo sapiens
caaccgggatgggagccgggc

SEQ ID NO: 5578606 - DNA, 21 bp, Homo sapiens
caaccggtcccttccatgccc

SEQ ID NO: 5578607 - DNA, 22 bp, Homo sapiens
caaccggtcccttccatgccct

SEQ ID NO: 5578608 - DNA, 21 bp, Homo sapiens
caaccggtggatcctcaaaca

SEQ ID NO: 5578609 - DNA, 21 bp, Homo sapiens
caaccgtccccggcccctgcc

SEQ ID NO: 5578610 - DNA, 22 bp, Homo sapiens
caaccgtccccggcccctgccc

SEQ ID NO: 5578611 - DNA, 22 bp, Homo sapiens
caaccgtcctgctgtccctgtc

SEQ ID NO: 5578612 - DNA, 18 bp, Homo sapiens
caaccgttggaaacataa

SEQ ID NO: 5578613 - DNA, 22 bp, Homo sapiens
caacctaaatggagaaagctgt

SEQ ID NO: 5578614 - DNA, 17 bp, Homo sapiens
caacctaacctgtgtct

SEQ ID NO: 5578615 - DNA, 20 bp, Homo sapiens
caacctacagtggagggaga

SEQ ID NO: 5578616 - DNA, 21 bp, Homo sapiens
caacctacagtggagggagac

SEQ ID NO: 5578617 - DNA, 19 bp, Homo sapiens
caacctacattccaccctg

SEQ ID NO: 5578618 - DNA, 22 bp, Homo sapiens
caacctaccaccccttcctgtc

SEQ ID NO: 5578619 - DNA, 14 bp, Homo sapiens
caacctactgtcta

SEQ ID NO: 5578620 - DNA, 16 bp, Homo sapiens
caacctagaaaccttt

SEQ ID NO: 5578621 - DNA, 19 bp, Homo sapiens
caacctagaatgtcagatt

SEQ ID NO: 5578622 - DNA, 14 bp, Homo sapiens
caacctaggagcag

SEQ ID NO: 5578623 - DNA, 21 bp, Homo sapiens
caacctattaaaatacatttt

SEQ ID NO: 5578624 - DNA, 16 bp, Homo sapiens
caacctatttgactgc

SEQ ID NO: 5578625 - DNA, 16 bp, Homo sapiens
caacctcaccaaacta

SEQ ID NO: 5578626 - DNA, 17 bp, Homo sapiens
caacctcaccttcctgt

SEQ ID NO: 5578627 - DNA, 15 bp, Homo sapiens
caacctcactgccct

SEQ ID NO: 5578628 - DNA, 11 bp, Homo sapiens
caacctcagca

SEQ ID NO: 5578629 - DNA, 14 bp, Homo sapiens
caacctcagcaacc

SEQ ID NO: 5578630 - DNA, 14 bp, Homo sapiens
caacctcagggctc

SEQ ID NO: 5578631 - DNA, 22 bp, Homo sapiens
caacctccacatcccatgttga

SEQ ID NO: 5578632 - DNA, 18 bp, Homo sapiens
caacctccacctcccagg

SEQ ID NO: 5578633 - DNA, 16 bp, Homo sapiens
caacctccaccttctg

SEQ ID NO: 5578634 - DNA, 12 bp, Homo sapiens
caacctccagac

SEQ ID NO: 5578635 - DNA, 17 bp, Homo sapiens
caacctccagactcagc

SEQ ID NO: 5578636 - DNA, 20 bp, Homo sapiens
caacctccagactcagcaga

SEQ ID NO: 5578637 - DNA, 13 bp, Homo sapiens
caacctcccatcc

SEQ ID NO: 5578638 - DNA, 14 bp, Homo sapiens
caacctcccatccc

SEQ ID NO: 5578639 - DNA, 19 bp, Homo sapiens
caacctccccgcagagctc

SEQ ID NO: 5578640 - DNA, 15 bp, Homo sapiens
caacctccccggctc

SEQ ID NO: 5578641 - DNA, 17 bp, Homo sapiens
caacctcccctggtcct

SEQ ID NO: 5578642 - DNA, 15 bp, Homo sapiens
caacctccctcttgt

SEQ ID NO: 5578643 - DNA, 19 bp, Homo sapiens
caacctccgcatcccgggt

SEQ ID NO: 5578644 - DNA, 20 bp, Homo sapiens
caacctccgcatccggggtt

SEQ ID NO: 5578645 - DNA, 17 bp, Homo sapiens
caacctcctgctctggg

SEQ ID NO: 5578646 - DNA, 18 bp, Homo sapiens
caacctcctgctctggga

SEQ ID NO: 5578647 - DNA, 13 bp, Homo sapiens
caacctcctgtgg

SEQ ID NO: 5578648 - DNA, 15 bp, Homo sapiens
caacctcctgtgggc

SEQ ID NO: 5578649 - DNA, 16 bp, Homo sapiens
caacctcgctccaact

SEQ ID NO: 5578650 - DNA, 22 bp, Homo sapiens
caacctcggcttgtgggctggt

SEQ ID NO: 5578651 - DNA, 20 bp, Homo sapiens
caacctctacctcctgggtt

SEQ ID NO: 5578652 - DNA, 21 bp, Homo sapiens
caacctctctgatcttgtgct

SEQ ID NO: 5578653 - DNA, 23 bp, Homo sapiens
caacctctctgatcttgtgctca

SEQ ID NO: 5578654 - DNA, 14 bp, Homo sapiens
caacctctgcctcc

SEQ ID NO: 5578655 - DNA, 20 bp, Homo sapiens
caacctctgcctcctgggtt

SEQ ID NO: 5578656 - DNA, 16 bp, Homo sapiens
caacctctgcttccca

SEQ ID NO: 5578657 - DNA, 19 bp, Homo sapiens
caacctctgtggtcaccca

SEQ ID NO: 5578658 - DNA, 20 bp, Homo sapiens
caacctctgtggtcacccat

SEQ ID NO: 5578659 - DNA, 23 bp, Homo sapiens
caacctctgtggtcacccatgca

SEQ ID NO: 5578660 - DNA, 23 bp, Homo sapiens
caacctctgttccccacccagtt

SEQ ID NO: 5578661 - DNA, 17 bp, Homo sapiens
caacctcttcagctggg

SEQ ID NO: 5578662 - DNA, 20 bp, Homo sapiens
caacctcttcctcctgacac

SEQ ID NO: 5578663 - DNA, 17 bp, Homo sapiens
caacctcttcctcctgg

SEQ ID NO: 5578664 - DNA, 16 bp, Homo sapiens
caacctcttctggctc

SEQ ID NO: 5578665 - DNA, 17 bp, Homo sapiens
caacctcttctggctca

SEQ ID NO: 5578666 - DNA, 20 bp, Homo sapiens
caacctctttgcgtttcctt

SEQ ID NO: 5578667 - DNA, 20 bp, Homo sapiens
caacctctttttcctcctgg

SEQ ID NO: 5578668 - DNA, 13 bp, Homo sapiens
caacctgaaccta

SEQ ID NO: 5578669 - DNA, 16 bp, Homo sapiens
caacctgaacctagga

SEQ ID NO: 5578670 - DNA, 22 bp, Homo sapiens
caacctgaaggtcccctggcag

SEQ ID NO: 5578671 - DNA, 24 bp, Homo sapiens
caacctgaatacccttttctgacc

SEQ ID NO: 5578672 - DNA, 23 bp, Homo sapiens
caacctgaatcttttttttatat

SEQ ID NO: 5578673 - DNA, 15 bp, Homo sapiens
caacctgaattaaag

SEQ ID NO: 5578674 - DNA, 17 bp, Homo sapiens
caacctgaattaaagtc

SEQ ID NO: 5578675 - DNA, 21 bp, Homo sapiens
caacctgacagcaaacacagt

SEQ ID NO: 5578676 - DNA, 12 bp, Homo sapiens
caacctgagcct

SEQ ID NO: 5578677 - DNA, 17 bp, Homo sapiens
caacctgcaaagatctg

SEQ ID NO: 5578678 - DNA, 15 bp, Homo sapiens
caacctgcactctac

SEQ ID NO: 5578679 - DNA, 19 bp, Homo sapiens
caacctgcaggctcccgag

SEQ ID NO: 5578680 - DNA, 17 bp, Homo sapiens
caacctgccacaatgtg

SEQ ID NO: 5578681 - DNA, 23 bp, Homo sapiens
caacctgcccaaagattgatttg

SEQ ID NO: 5578682 - DNA, 17 bp, Homo sapiens
caacctgcccctcccca

SEQ ID NO: 5578683 - DNA, 22 bp, Homo sapiens
caacctgcccctccccagccct

SEQ ID NO: 5578684 - DNA, 17 bp, Homo sapiens
caacctgcctgtgcatg

SEQ ID NO: 5578685 - DNA, 16 bp, Homo sapiens
caacctgctctcctct

SEQ ID NO: 5578686 - DNA, 17 bp, Homo sapiens
caacctgctctcctctt

SEQ ID NO: 5578687 - DNA, 17 bp, Homo sapiens
caacctggacttcctgt

SEQ ID NO: 5578688 - DNA, 14 bp, Homo sapiens
caacctggaggctg

SEQ ID NO: 5578689 - DNA, 15 bp, Homo sapiens
caacctggaggctgg

SEQ ID NO: 5578690 - DNA, 16 bp, Homo sapiens
caacctggaggctgga

SEQ ID NO: 5578691 - DNA, 18 bp, Homo sapiens
caacctggaggctggacc

SEQ ID NO: 5578692 - DNA, 23 bp, Homo sapiens
caacctggaggctggaccaactg

SEQ ID NO: 5578693 - DNA, 21 bp, Homo sapiens
caacctggcataggactcttt

SEQ ID NO: 5578694 - DNA, 19 bp, Homo sapiens
caacctgggtccaaataaa

SEQ ID NO: 5578695 - DNA, 20 bp, Homo sapiens
caacctgggtccaaataaaa

SEQ ID NO: 5578696 - DNA, 21 bp, Homo sapiens
caacctggtgcatcgaaatgt

SEQ ID NO: 5578697 - DNA, 22 bp, Homo sapiens
caacctggtggcaccagatgca

SEQ ID NO: 5578698 - DNA, 19 bp, Homo sapiens
caacctgtaataaatatga

SEQ ID NO: 5578699 - DNA, 12 bp, Homo sapiens
caacctgtgcaa

SEQ ID NO: 5578700 - DNA, 19 bp, Homo sapiens
caacctgtgcaaaataaaa

SEQ ID NO: 5578701 - DNA, 12 bp, Homo sapiens
caacctgtggct

SEQ ID NO: 5578702 - DNA, 15 bp, Homo sapiens
caacctgtggctcag

SEQ ID NO: 5578703 - DNA, 22 bp, Homo sapiens
caacctgtggctcaggggagca

SEQ ID NO: 5578704 - DNA, 14 bp, Homo sapiens
caacctgtgtctta

SEQ ID NO: 5578705 - DNA, 22 bp, Homo sapiens
caacctgttacctactttgact

SEQ ID NO: 5578706 - DNA, 22 bp, Homo sapiens
caacctgttcttagagtgtagc

SEQ ID NO: 5578707 - DNA, 14 bp, Homo sapiens
caacctgtttctac

SEQ ID NO: 5578708 - DNA, 14 bp, Homo sapiens
caaccttaaagcaa

SEQ ID NO: 5578709 - DNA, 23 bp, Homo sapiens
caaccttacttacagcataaggg

SEQ ID NO: 5578710 - DNA, 14 bp, Homo sapiens
caaccttcaaagaa

SEQ ID NO: 5578711 - DNA, 22 bp, Homo sapiens
caaccttccaacttcctgtggc

SEQ ID NO: 5578712 - DNA, 23 bp, Homo sapiens
caaccttccaacttcctgtggcc

SEQ ID NO: 5578713 - DNA, 22 bp, Homo sapiens
caaccttcctttttttaaattt

SEQ ID NO: 5578714 - DNA, 23 bp, Homo sapiens
caaccttcctttttttaaatttt

SEQ ID NO: 5578715 - DNA, 19 bp, Homo sapiens
caaccttcgccacctgggt

SEQ ID NO: 5578716 - DNA, 12 bp, Homo sapiens
caaccttctgcc

SEQ ID NO: 5578717 - DNA, 13 bp, Homo sapiens
caaccttctgccc

SEQ ID NO: 5578718 - DNA, 15 bp, Homo sapiens
caaccttctgccctc

SEQ ID NO: 5578719 - DNA, 17 bp, Homo sapiens
caaccttctgccctcct

SEQ ID NO: 5578720 - DNA, 19 bp, Homo sapiens
caaccttctgccctcctgc

SEQ ID NO: 5578721 - DNA, 16 bp, Homo sapiens
caaccttctgtggctc

SEQ ID NO: 5578722 - DNA, 17 bp, Homo sapiens
caaccttctgtggctca

SEQ ID NO: 5578723 - DNA, 16 bp, Homo sapiens
caaccttgagacagct

SEQ ID NO: 5578724 - DNA, 15 bp, Homo sapiens
caaccttggccttct

SEQ ID NO: 5578725 - DNA, 15 bp, Homo sapiens
caaccttggcttggc

SEQ ID NO: 5578726 - DNA, 13 bp, Homo sapiens
caaccttgtttat

SEQ ID NO: 5578727 - DNA, 21 bp, Homo sapiens
caaccttgtttattaaattgc

SEQ ID NO: 5578728 - DNA, 16 bp, Homo sapiens
caacctttaaaaaagc

SEQ ID NO: 5578729 - DNA, 14 bp, Homo sapiens
caacctttaaaatt

SEQ ID NO: 5578730 - DNA, 24 bp, Homo sapiens
caacctttaaaattgtcacctctg

SEQ ID NO: 5578731 - DNA, 17 bp, Homo sapiens
caacctttcacctttgt

SEQ ID NO: 5578732 - DNA, 22 bp, Homo sapiens
caacctttcccatttcgtgtaa

SEQ ID NO: 5578733 - DNA, 15 bp, Homo sapiens
caacctttccctcac

SEQ ID NO: 5578734 - DNA, 18 bp, Homo sapiens
caacctttgtaagaaaac

SEQ ID NO: 5578735 - DNA, 22 bp, Homo sapiens
caacctttgtgtggctcctggt

SEQ ID NO: 5578736 - DNA, 19 bp, Homo sapiens
caacgaagccggacacggc

SEQ ID NO: 5578737 - DNA, 15 bp, Homo sapiens
caacgaatttacagt

SEQ ID NO: 5578738 - DNA, 19 bp, Homo sapiens
caacgaccagggccgagga

SEQ ID NO: 5578739 - DNA, 15 bp, Homo sapiens
caacgagcctcctca

SEQ ID NO: 5578740 - DNA, 12 bp, Homo sapiens
caacgaggaagc

SEQ ID NO: 5578741 - DNA, 13 bp, Homo sapiens
caacgaggaagcc

SEQ ID NO: 5578742 - DNA, 19 bp, Homo sapiens
caacgatcacaaatgactt

SEQ ID NO: 5578743 - DNA, 17 bp, Homo sapiens
caacgattcacagcctc

SEQ ID NO: 5578744 - DNA, 18 bp, Homo sapiens
caactcttgattatccat

SEQ ID NO: 5578745 - DNA, 13 bp, Homo sapiens
caactctttgaga

SEQ ID NO: 5578746 - DNA, 18 bp, Homo sapiens
caactctttgttatttga

SEQ ID NO: 5578747 - DNA, 15 bp, Homo sapiens
caactgaaaatgaat

SEQ ID NO: 5578748 - DNA, 19 bp, Homo sapiens
caactgaacgacaaagcat

SEQ ID NO: 5578749 - DNA, 13 bp, Homo sapiens
caactgaagacaa

SEQ ID NO: 5578750 - DNA, 15 bp, Homo sapiens
caactgaagagacac

SEQ ID NO: 5578751 - DNA, 15 bp, Homo sapiens
caactgaagccttct

SEQ ID NO: 5578752 - DNA, 15 bp, Homo sapiens
caactgaaggaaggc

SEQ ID NO: 5578753 - DNA, 21 bp, Homo sapiens
caactgaaggcaacctggaag

SEQ ID NO: 5578754 - DNA, 14 bp, Homo sapiens
caactgaaggggtg

SEQ ID NO: 5578755 - DNA, 21 bp, Homo sapiens
caactgaaggggtgcacccac

SEQ ID NO: 5578756 - DNA, 18 bp, Homo sapiens
caactgaataaatacctc

SEQ ID NO: 5578757 - DNA, 14 bp, Homo sapiens
caactgaataaatt

SEQ ID NO: 5578758 - DNA, 19 bp, Homo sapiens
caactgaataaattcagta

SEQ ID NO: 5578759 - DNA, 14 bp, Homo sapiens
caactgacacagga

SEQ ID NO: 5578760 - DNA, 16 bp, Homo sapiens
caactgacacaggaaa

SEQ ID NO: 5578761 - DNA, 13 bp, Homo sapiens
caactgacactcc

SEQ ID NO: 5578762 - DNA, 14 bp, Homo sapiens
caactgacactccc

SEQ ID NO: 5578763 - DNA, 15 bp, Homo sapiens
caactgaccagcctc

SEQ ID NO: 5578764 - DNA, 15 bp, Homo sapiens
caactgactgactta

SEQ ID NO: 5578765 - DNA, 17 bp, Homo sapiens
caactgagaagccaagc

SEQ ID NO: 5578766 - DNA, 18 bp, Homo sapiens
caactgagaagccaagcc

SEQ ID NO: 5578767 - DNA, 18 bp, Homo sapiens
caactgagagctgagcgc

SEQ ID NO: 5578768 - DNA, 14 bp, Homo sapiens
caactgagatctcc

SEQ ID NO: 5578769 - DNA, 17 bp, Homo sapiens
caactgaggcagacagc

SEQ ID NO: 5578770 - DNA, 21 bp, Homo sapiens
caactgaggcagacagcagct

SEQ ID NO: 5578771 - DNA, 15 bp, Homo sapiens
caactgatatacttg

SEQ ID NO: 5578772 - DNA, 23 bp, Homo sapiens
caactgatcatttgcagctgctg

SEQ ID NO: 5578773 - DNA, 16 bp, Homo sapiens
caactgatcctgctcc

SEQ ID NO: 5578774 - DNA, 20 bp, Homo sapiens
caactgatcctgctccagca

SEQ ID NO: 5578775 - DNA, 22 bp, Homo sapiens
caactgatcctgctccagcagc

SEQ ID NO: 5578776 - DNA, 23 bp, Homo sapiens
caactgatcctgctccagcagca

SEQ ID NO: 5578777 - DNA, 15 bp, Homo sapiens
caactgatctgttat

SEQ ID NO: 5578778 - DNA, 21 bp, Homo sapiens
caactgatgatagacttcgaa

SEQ ID NO: 5578779 - DNA, 19 bp, Homo sapiens
caactgattttgtatgtaa

SEQ ID NO: 5578780 - DNA, 23 bp, Homo sapiens
caactgcaaagaaagtgggaggt

SEQ ID NO: 5578781 - DNA, 11 bp, Homo sapiens
caactgcacaa

SEQ ID NO: 5578782 - DNA, 11 bp, Homo sapiens
caactgcagga

SEQ ID NO: 5578783 - DNA, 18 bp, Homo sapiens
caactgcatccaggcctg

SEQ ID NO: 5578784 - DNA, 22 bp, Homo sapiens
caactgcatccaggcctgaggc

SEQ ID NO: 5578785 - DNA, 23 bp, Homo sapiens
caactgccaaataaaatgtttac

SEQ ID NO: 5578786 - DNA, 13 bp, Homo sapiens
caactgcccagca

SEQ ID NO: 5578787 - DNA, 14 bp, Homo sapiens
caactgccccaggg

SEQ ID NO: 5578788 - DNA, 11 bp, Homo sapiens
caactgcccta

SEQ ID NO: 5578789 - DNA, 12 bp, Homo sapiens
caactgccctaa

SEQ ID NO: 5578790 - DNA, 21 bp, Homo sapiens
caactgcctaaggccctttgt

SEQ ID NO: 5578791 - DNA, 14 bp, Homo sapiens
caactgcctactcc

SEQ ID NO: 5578792 - DNA, 23 bp, Homo sapiens
caactgcctccttgccagcccca

SEQ ID NO: 5578793 - DNA, 17 bp, Homo sapiens
caactgcctggatgtgt

SEQ ID NO: 5578794 - DNA, 15 bp, Homo sapiens
caactgctaatctac

SEQ ID NO: 5578795 - DNA, 15 bp, Homo sapiens
caactgctaatgcaa

SEQ ID NO: 5578796 - DNA, 20 bp, Homo sapiens
caactgctccagcctctgcc

SEQ ID NO: 5578797 - DNA, 21 bp, Homo sapiens
caactgctccagcctctgccg

SEQ ID NO: 5578798 - DNA, 23 bp, Homo sapiens
caactgctccagcctctgccgct

SEQ ID NO: 5578799 - DNA, 17 bp, Homo sapiens
caactgctgatgctcat

SEQ ID NO: 5578800 - DNA, 13 bp, Homo sapiens
caactgctgcccc

SEQ ID NO: 5578801 - DNA, 14 bp, Homo sapiens
caactgctgcccca

SEQ ID NO: 5578802 - DNA, 14 bp, Homo sapiens
caactgctgctttt

SEQ ID NO: 5578803 - DNA, 20 bp, Homo sapiens
caactgctgtggccccctgt

SEQ ID NO: 5578804 - DNA, 23 bp, Homo sapiens
caactgctttgttttggctgctc

SEQ ID NO: 5578805 - DNA, 11 bp, Homo sapiens
caactggaaaa

SEQ ID NO: 5578806 - DNA, 14 bp, Homo sapiens
caactggaagcaca

SEQ ID NO: 5578807 - DNA, 23 bp, Homo sapiens
caactggagttccttatccctct

SEQ ID NO: 5578808 - DNA, 22 bp, Homo sapiens
caactggccggtctgcaagtca

SEQ ID NO: 5578809 - DNA, 13 bp, Homo sapiens
caactggctgaaa

SEQ ID NO: 5578810 - DNA, 15 bp, Homo sapiens
caactggctggccag

SEQ ID NO: 5578811 - DNA, 15 bp, Homo sapiens
caactggctgggaca

SEQ ID NO: 5578812 - DNA, 12 bp, Homo sapiens
caactggcttct

SEQ ID NO: 5578813 - DNA, 18 bp, Homo sapiens
caactgggcatttcaatc

SEQ ID NO: 5578814 - DNA, 21 bp, Homo sapiens
caactggggggaccaaatagc

SEQ ID NO: 5578815 - DNA, 23 bp, Homo sapiens
caactggggggaccaaatagcca

SEQ ID NO: 5578816 - DNA, 22 bp, Homo sapiens
caactggggttgcgtctgaggc

SEQ ID NO: 5578817 - DNA, 19 bp, Homo sapiens
caactgggtccagaagaga

SEQ ID NO: 5578818 - DNA, 20 bp, Homo sapiens
caactggtccactcagggct

SEQ ID NO: 5578819 - DNA, 16 bp, Homo sapiens
caactgtaaagcaaat

SEQ ID NO: 5578820 - DNA, 22 bp, Homo sapiens
caactgtataccgtgtgctcca

SEQ ID NO: 5578821 - DNA, 19 bp, Homo sapiens
caactgtattaaagaaaaa

SEQ ID NO: 5578822 - DNA, 21 bp, Homo sapiens
caactgtcaaatatgttctgg

SEQ ID NO: 5578823 - DNA, 14 bp, Homo sapiens
caactgtcagttca

SEQ ID NO: 5578824 - DNA, 16 bp, Homo sapiens
caactgtcagttcatc

SEQ ID NO: 5578825 - DNA, 21 bp, Homo sapiens
caactgtctcctacctctgct

SEQ ID NO: 5578826 - DNA, 20 bp, Homo sapiens
caactgtctctcttctcaga

SEQ ID NO: 5578827 - DNA, 13 bp, Homo sapiens
caactgtgaatat

SEQ ID NO: 5578828 - DNA, 16 bp, Homo sapiens
caactgtgaatatgag

SEQ ID NO: 5578829 - DNA, 12 bp, Homo sapiens
caactgtgcagc

SEQ ID NO: 5578830 - DNA, 14 bp, Homo sapiens
caactgtgcagcac

SEQ ID NO: 5578831 - DNA, 17 bp, Homo sapiens
caactgtgcagcaccct

SEQ ID NO: 5578832 - DNA, 18 bp, Homo sapiens
caactgtggataaatttt

SEQ ID NO: 5578833 - DNA, 21 bp, Homo sapiens
caactgtggataaattttgga

SEQ ID NO: 5578834 - DNA, 17 bp, Homo sapiens
caactgtggtagctcca

SEQ ID NO: 5578835 - DNA, 18 bp, Homo sapiens
caactgtggtagctccag

SEQ ID NO: 5578836 - DNA, 19 bp, Homo sapiens
caactgtggtagctccagc

SEQ ID NO: 5578837 - DNA, 23 bp, Homo sapiens
caactgtggtagctccagcgatg

SEQ ID NO: 5578838 - DNA, 18 bp, Homo sapiens
caactgtgtctctgaatt

SEQ ID NO: 5578839 - DNA, 12 bp, Homo sapiens
caactgtgtgat

SEQ ID NO: 5578840 - DNA, 22 bp, Homo sapiens
caactgtgtgattaaaaggtat

SEQ ID NO: 5578841 - DNA, 16 bp, Homo sapiens
caactgtgttcattag

SEQ ID NO: 5578842 - DNA, 16 bp, Homo sapiens
caactgtgttgtatta

SEQ ID NO: 5578843 - DNA, 22 bp, Homo sapiens
caactgtgttgtattaacaaaa

SEQ ID NO: 5578844 - DNA, 19 bp, Homo sapiens
caactgttatgaaataaag

SEQ ID NO: 5578845 - DNA, 17 bp, Homo sapiens
caactgtttccctgctg

SEQ ID NO: 5578846 - DNA, 18 bp, Homo sapiens
caactgtttccctgctga

SEQ ID NO: 5578847 - DNA, 19 bp, Homo sapiens
caacttaaacctgtgcttt

SEQ ID NO: 5578848 - DNA, 15 bp, Homo sapiens
caacttaacatgaaa

SEQ ID NO: 5578849 - DNA, 14 bp, Homo sapiens
caacttaagtttag

SEQ ID NO: 5578850 - DNA, 15 bp, Homo sapiens
caacttaatgttctg

SEQ ID NO: 5578851 - DNA, 17 bp, Homo sapiens
caacttagaaaccaaat

SEQ ID NO: 5578852 - DNA, 16 bp, Homo sapiens
caacttagaatagttt

SEQ ID NO: 5578853 - DNA, 20 bp, Homo sapiens
caacttagatctctcctgca

SEQ ID NO: 5578854 - DNA, 15 bp, Homo sapiens
caacttagctcaggt

SEQ ID NO: 5578855 - DNA, 18 bp, Homo sapiens
caacttaggctacagaat

SEQ ID NO: 5578856 - DNA, 11 bp, Homo sapiens
caacttattaa

SEQ ID NO: 5578857 - DNA, 19 bp, Homo sapiens
caacttatttaaaaatatt

SEQ ID NO: 5578858 - DNA, 16 bp, Homo sapiens
caacttatttaaatga

SEQ ID NO: 5578859 - DNA, 21 bp, Homo sapiens
caacttatttctgaaaaagag

SEQ ID NO: 5578860 - DNA, 21 bp, Homo sapiens
caacttcaagaattaatattt

SEQ ID NO: 5578861 - DNA, 18 bp, Homo sapiens
caacttcaagtgcatgct

SEQ ID NO: 5578862 - DNA, 17 bp, Homo sapiens
caacttcaccaccccct

SEQ ID NO: 5578863 - DNA, 14 bp, Homo sapiens
caacttcagtcctg

SEQ ID NO: 5578864 - DNA, 15 bp, Homo sapiens
caacttcagttttat

SEQ ID NO: 5578865 - DNA, 16 bp, Homo sapiens
caacttcatcccagct

SEQ ID NO: 5578866 - DNA, 16 bp, Homo sapiens
caacttcattgctaca

SEQ ID NO: 5578867 - DNA, 15 bp, Homo sapiens
caacttcatttgaca

SEQ ID NO: 5578868 - DNA, 15 bp, Homo sapiens
caacttccaaagggt

SEQ ID NO: 5578869 - DNA, 12 bp, Homo sapiens
caacttcccaaa

SEQ ID NO: 5578870 - DNA, 14 bp, Homo sapiens
caacttcccaaagc

SEQ ID NO: 5578871 - DNA, 13 bp, Homo sapiens
caacttcccacac

SEQ ID NO: 5578872 - DNA, 16 bp, Homo sapiens
caacttcccaggccga

SEQ ID NO: 5578873 - DNA, 15 bp, Homo sapiens
caacttccctgttct

SEQ ID NO: 5578874 - DNA, 19 bp, Homo sapiens
caacttcctcccttacaga

SEQ ID NO: 5578875 - DNA, 22 bp, Homo sapiens
caacttcctcccttacagagca

SEQ ID NO: 5578876 - DNA, 14 bp, Homo sapiens
caacttcctctgcc

SEQ ID NO: 5578877 - DNA, 18 bp, Homo sapiens
caacttcctctgccatgt

SEQ ID NO: 5578878 - DNA, 14 bp, Homo sapiens
caacttctaattgc

SEQ ID NO: 5578879 - DNA, 13 bp, Homo sapiens
caacttctcccac

SEQ ID NO: 5578880 - DNA, 14 bp, Homo sapiens
caacttctgtccct

SEQ ID NO: 5578881 - DNA, 24 bp, Homo sapiens
caacttgaaattatatctgtggtc

SEQ ID NO: 5578882 - DNA, 19 bp, Homo sapiens
caacttgaaggattgcatc

SEQ ID NO: 5578883 - DNA, 18 bp, Homo sapiens
caacttgacaccactaag

SEQ ID NO: 5578884 - DNA, 21 bp, Homo sapiens
caacttgagatgtatgaaggc

SEQ ID NO: 5578885 - DNA, 19 bp, Homo sapiens
caacttgagcatgttactg

SEQ ID NO: 5578886 - DNA, 21 bp, Homo sapiens
caacttgagggcccagagcag

SEQ ID NO: 5578887 - DNA, 20 bp, Homo sapiens
caacttgatgttccacctgc

SEQ ID NO: 5578888 - DNA, 21 bp, Homo sapiens
caacttgatgttccacctgcc

SEQ ID NO: 5578889 - DNA, 19 bp, Homo sapiens
caacttgcaatttgcaagg

SEQ ID NO: 5578890 - DNA, 17 bp, Homo sapiens
caacttgcctttgaaga

SEQ ID NO: 5578891 - DNA, 17 bp, Homo sapiens
caacttgctcctttcca

SEQ ID NO: 5578892 - DNA, 14 bp, Homo sapiens
caacttgcttatca

SEQ ID NO: 5578893 - DNA, 13 bp, Homo sapiens
caacttggatcat

SEQ ID NO: 5578894 - DNA, 13 bp, Homo sapiens
caacttggcagct

SEQ ID NO: 5578895 - DNA, 19 bp, Homo sapiens
caacttggcttcctttctt

SEQ ID NO: 5578896 - DNA, 12 bp, Homo sapiens
caacttggcttt

SEQ ID NO: 5578897 - DNA, 13 bp, Homo sapiens
caacttggctttc

SEQ ID NO: 5578898 - DNA, 12 bp, Homo sapiens
caacttgggaac

SEQ ID NO: 5578899 - DNA, 18 bp, Homo sapiens
caacttgtatccaggcct

SEQ ID NO: 5578900 - DNA, 20 bp, Homo sapiens
caacttgtatccaggcctgg

SEQ ID NO: 5578901 - DNA, 16 bp, Homo sapiens
caacttgtatttccaa

SEQ ID NO: 5578902 - DNA, 16 bp, Homo sapiens
caacttgtctctgtag

SEQ ID NO: 5578903 - DNA, 20 bp, Homo sapiens
caacttgtctgggaattgtg

SEQ ID NO: 5578904 - DNA, 12 bp, Homo sapiens
caacttgtgaac

SEQ ID NO: 5578905 - DNA, 23 bp, Homo sapiens
caacttgtgataggtacctgagt

SEQ ID NO: 5578906 - DNA, 16 bp, Homo sapiens
caacttgtgttctatt

SEQ ID NO: 5578907 - DNA, 16 bp, Homo sapiens
caactttaagaggaca

SEQ ID NO: 5578908 - DNA, 14 bp, Homo sapiens
caactttagaaaga

SEQ ID NO: 5578909 - DNA, 23 bp, Homo sapiens
caactttatgtagagaaaaggag

SEQ ID NO: 5578910 - DNA, 16 bp, Homo sapiens
caactttattttgaat

SEQ ID NO: 5578911 - DNA, 17 bp, Homo sapiens
caactttcaagaacttg

SEQ ID NO: 5578912 - DNA, 15 bp, Homo sapiens
caactttcacagtga

SEQ ID NO: 5578913 - DNA, 22 bp, Homo sapiens
caactttcacagtgaagtgcct

SEQ ID NO: 5578914 - DNA, 24 bp, Homo sapiens
caactttcactataatgtgaaatg

SEQ ID NO: 5578915 - DNA, 14 bp, Homo sapiens
caactttcacttct

SEQ ID NO: 5578916 - DNA, 16 bp, Homo sapiens
caactttcacttcttc

SEQ ID NO: 5578917 - DNA, 13 bp, Homo sapiens
caactttcagtgg

SEQ ID NO: 5578918 - DNA, 23 bp, Homo sapiens
caactttcccttgccctgggctg

SEQ ID NO: 5578919 - DNA, 15 bp, Homo sapiens
caactttctcactgc

SEQ ID NO: 5578920 - DNA, 19 bp, Homo sapiens
caactttctcactgctgtc

SEQ ID NO: 5578921 - DNA, 12 bp, Homo sapiens
caactttctgta

SEQ ID NO: 5578922 - DNA, 23 bp, Homo sapiens
caactttctgtaaactcaaaact

SEQ ID NO: 5578923 - DNA, 21 bp, Homo sapiens
caagagccttggtgtccacct

SEQ ID NO: 5578924 - DNA, 17 bp, Homo sapiens
caagagcgaaactccat

SEQ ID NO: 5578925 - DNA, 18 bp, Homo sapiens
caagagcgaaactccgtc

SEQ ID NO: 5578926 - DNA, 14 bp, Homo sapiens
caagagctcaggag

SEQ ID NO: 5578927 - DNA, 18 bp, Homo sapiens
caagagctcaggagaagg

SEQ ID NO: 5578928 - DNA, 22 bp, Homo sapiens
caagagctcaggagaaggcctg

SEQ ID NO: 5578929 - DNA, 14 bp, Homo sapiens
caagagctgccctc

SEQ ID NO: 5578930 - DNA, 20 bp, Homo sapiens
caagagctgccctccttgtc

SEQ ID NO: 5578931 - DNA, 13 bp, Homo sapiens
caagagctgctgt

SEQ ID NO: 5578932 - DNA, 14 bp, Homo sapiens
caagagcttttaca

SEQ ID NO: 5578933 - DNA, 23 bp, Homo sapiens
caagaggaaaatgccctgtccct

SEQ ID NO: 5578934 - DNA, 20 bp, Homo sapiens
caagaggaatctgtttctct

SEQ ID NO: 5578935 - DNA, 15 bp, Homo sapiens
caagaggaatgaaaa

SEQ ID NO: 5578936 - DNA, 16 bp, Homo sapiens
caagaggacacaatgg

SEQ ID NO: 5578937 - DNA, 15 bp, Homo sapiens
caagaggactgagac

SEQ ID NO: 5578938 - DNA, 13 bp, Homo sapiens
caagaggagcagg

SEQ ID NO: 5578939 - DNA, 17 bp, Homo sapiens
caagaggagcaggaagc

SEQ ID NO: 5578940 - DNA, 14 bp, Homo sapiens
caagaggagccccc

SEQ ID NO: 5578941 - DNA, 16 bp, Homo sapiens
caagaggagcccccac

SEQ ID NO: 5578942 - DNA, 14 bp, Homo sapiens
caagaggaggacag

SEQ ID NO: 5578943 - DNA, 17 bp, Homo sapiens
caagaggcaaaggaatc

SEQ ID NO: 5578944 - DNA, 21 bp, Homo sapiens
caagaggcaggttagaagaac

SEQ ID NO: 5578945 - DNA, 16 bp, Homo sapiens
caagaggccagggtgg

SEQ ID NO: 5578946 - DNA, 20 bp, Homo sapiens
caagaggccagggtggccag

SEQ ID NO: 5578947 - DNA, 18 bp, Homo sapiens
caagaggcccagggagca

SEQ ID NO: 5578948 - DNA, 19 bp, Homo sapiens
caagaggccgtggctgctg

SEQ ID NO: 5578949 - DNA, 19 bp, Homo sapiens
caagaggcctcatgcctgc

SEQ ID NO: 5578950 - DNA, 21 bp, Homo sapiens
caagaggcgtgtgcaggccga

SEQ ID NO: 5578951 - DNA, 15 bp, Homo sapiens
caagaggctgaggca

SEQ ID NO: 5578952 - DNA, 13 bp, Homo sapiens
caagaggctggtt

SEQ ID NO: 5578953 - DNA, 14 bp, Homo sapiens
caagaggctggttt

SEQ ID NO: 5578954 - DNA, 19 bp, Homo sapiens
caagaggctgtagaaaggg

SEQ ID NO: 5578955 - DNA, 20 bp, Homo sapiens
caagagggaacaaaactgtt

SEQ ID NO: 5578956 - DNA, 16 bp, Homo sapiens
caagagggaatccccg

SEQ ID NO: 5578957 - DNA, 18 bp, Homo sapiens
caagagggacagagcccg

SEQ ID NO: 5578958 - DNA, 22 bp, Homo sapiens
caagagggacagagcccgggag

SEQ ID NO: 5578959 - DNA, 19 bp, Homo sapiens
caagagggacgcctggggg

SEQ ID NO: 5578960 - DNA, 18 bp, Homo sapiens
caagagggactccaagcc

SEQ ID NO: 5578961 - DNA, 14 bp, Homo sapiens
caagagggactgta

SEQ ID NO: 5578962 - DNA, 17 bp, Homo sapiens
caagagggactgtattt

SEQ ID NO: 5578963 - DNA, 20 bp, Homo sapiens
caagagggactgtatttctg

SEQ ID NO: 5578964 - DNA, 23 bp, Homo sapiens
caagagggactgtatttctgtgg

SEQ ID NO: 5578965 - DNA, 13 bp, Homo sapiens
caagagggagggg

SEQ ID NO: 5578966 - DNA, 18 bp, Homo sapiens
caagagggcaaagctgat

SEQ ID NO: 5578967 - DNA, 17 bp, Homo sapiens
caagagggcaagcctct

SEQ ID NO: 5578968 - DNA, 13 bp, Homo sapiens
caagagggcactg

SEQ ID NO: 5578969 - DNA, 18 bp, Homo sapiens
caagaggggcgggctcag

SEQ ID NO: 5578970 - DNA, 19 bp, Homo sapiens
caagaggggcgggctcaga

SEQ ID NO: 5578971 - DNA, 15 bp, Homo sapiens
caagagggggacctg

SEQ ID NO: 5578972 - DNA, 16 bp, Homo sapiens
caagaggggtggagac

SEQ ID NO: 5578973 - DNA, 21 bp, Homo sapiens
caagaggggtggagactgctt

SEQ ID NO: 5578974 - DNA, 23 bp, Homo sapiens
caagaggggtggagactgcttcc

SEQ ID NO: 5578975 - DNA, 12 bp, Homo sapiens
caagagggtctg

SEQ ID NO: 5578976 - DNA, 16 bp, Homo sapiens
caagagggtctgagga

SEQ ID NO: 5578977 - DNA, 22 bp, Homo sapiens
caagagggttcacacagcccag

SEQ ID NO: 5578978 - DNA, 21 bp, Homo sapiens
caagaggtacagggtttttac

SEQ ID NO: 5578979 - DNA, 20 bp, Homo sapiens
caagaggtctgagccctggt

SEQ ID NO: 5578980 - DNA, 15 bp, Homo sapiens
caagaggtgcctggg

SEQ ID NO: 5578981 - DNA, 19 bp, Homo sapiens
caagaggtgcctgggagga

SEQ ID NO: 5578982 - DNA, 19 bp, Homo sapiens
caagagtaaatattgtcac

SEQ ID NO: 5578983 - DNA, 16 bp, Homo sapiens
caagagtaactttact

SEQ ID NO: 5578984 - DNA, 17 bp, Homo sapiens
caagagtagcaccttca

SEQ ID NO: 5578985 - DNA, 15 bp, Homo sapiens
caagagtatgagaaa

SEQ ID NO: 5578986 - DNA, 21 bp, Homo sapiens
caagagtatgtggcaaaacat

SEQ ID NO: 5578987 - DNA, 23 bp, Homo sapiens
caagagtatgtggcaaaacatat

SEQ ID NO: 5578988 - DNA, 16 bp, Homo sapiens
caagagtattccattt

SEQ ID NO: 5578989 - DNA, 22 bp, Homo sapiens
caagagtccccagactctgcct

SEQ ID NO: 5578990 - DNA, 23 bp, Homo sapiens
caagagtccccagactctgccta

SEQ ID NO: 5578991 - DNA, 19 bp, Homo sapiens
caagagtcgctgtgccaca

SEQ ID NO: 5578992 - DNA, 14 bp, Homo sapiens
caagagtctaaaga

SEQ ID NO: 5578993 - DNA, 18 bp, Homo sapiens
caagagtctctccagcct

SEQ ID NO: 5578994 - DNA, 23 bp, Homo sapiens
caagagtctctccagcctcacag

SEQ ID NO: 5578995 - DNA, 16 bp, Homo sapiens
caagagtctggggacc

SEQ ID NO: 5578996 - DNA, 19 bp, Homo sapiens
caagagtgaattccctcac

SEQ ID NO: 5578997 - DNA, 14 bp, Homo sapiens
caagagtgattctt

SEQ ID NO: 5578998 - DNA, 15 bp, Homo sapiens
caagagtggccccac

SEQ ID NO: 5578999 - DNA, 20 bp, Homo sapiens
caagagtggccccacctggc

SEQ ID NO: 5579000 - DNA, 20 bp, Homo sapiens
caagagtggggggaggaagc

SEQ ID NO: 5579001 - DNA, 14 bp, Homo sapiens
caagagtgttcttt

SEQ ID NO: 5579002 - DNA, 17 bp, Homo sapiens
caagagttcagtgctca

SEQ ID NO: 5579003 - DNA, 15 bp, Homo sapiens
caagagtttcttgta

SEQ ID NO: 5579004 - DNA, 14 bp, Homo sapiens
caagagttttaaca

SEQ ID NO: 5579005 - DNA, 23 bp, Homo sapiens
caagataaacacaatttcttcat

SEQ ID NO: 5579006 - DNA, 14 bp, Homo sapiens
caagataaacatta

SEQ ID NO: 5579007 - DNA, 15 bp, Homo sapiens
caagataaacattat

SEQ ID NO: 5579008 - DNA, 14 bp, Homo sapiens
caagataaaggaca

SEQ ID NO: 5579009 - DNA, 17 bp, Homo sapiens
caagataagcctgagcc

SEQ ID NO: 5579010 - DNA, 19 bp, Homo sapiens
caagataagcctgagcctt

SEQ ID NO: 5579011 - DNA, 19 bp, Homo sapiens
caagataaggagaaagaaa

SEQ ID NO: 5579012 - DNA, 13 bp, Homo sapiens
caagataataaaa

SEQ ID NO: 5579013 - DNA, 18 bp, Homo sapiens
caagataattttcagctg

SEQ ID NO: 5579014 - DNA, 20 bp, Homo sapiens
caagatacacttgtaaataa

SEQ ID NO: 5579015 - DNA, 15 bp, Homo sapiens
caagatacctttttt

SEQ ID NO: 5579016 - DNA, 15 bp, Homo sapiens
caagatactggacta

SEQ ID NO: 5579017 - DNA, 12 bp, Homo sapiens
caagatagaaag

SEQ ID NO: 5579018 - DNA, 21 bp, Homo sapiens
caagatatggaagtggattgt

SEQ ID NO: 5579019 - DNA, 15 bp, Homo sapiens
caagatatggacaca

SEQ ID NO: 5579020 - DNA, 16 bp, Homo sapiens
caagatattatgtata

SEQ ID NO: 5579021 - DNA, 21 bp, Homo sapiens
caagatattcaggtggccaga

SEQ ID NO: 5579022 - DNA, 19 bp, Homo sapiens
caagatattgatcaaatat

SEQ ID NO: 5579023 - DNA, 17 bp, Homo sapiens
caagatattgtacataa

SEQ ID NO: 5579024 - DNA, 17 bp, Homo sapiens
caagatatttatatgtt

SEQ ID NO: 5579025 - DNA, 16 bp, Homo sapiens
caagatcaaaaaggct

SEQ ID NO: 5579026 - DNA, 17 bp, Homo sapiens
caagatcaaaaaggctt

SEQ ID NO: 5579027 - DNA, 17 bp, Homo sapiens
caagatcaacattccag

SEQ ID NO: 5579028 - DNA, 16 bp, Homo sapiens
caagatcaattccctc

SEQ ID NO: 5579029 - DNA, 14 bp, Homo sapiens
caagatccaggcag

SEQ ID NO: 5579030 - DNA, 13 bp, Homo sapiens
caagatccaggtg

SEQ ID NO: 5579031 - DNA, 18 bp, Homo sapiens
caagatccatctaaactg

SEQ ID NO: 5579032 - DNA, 13 bp, Homo sapiens
caagatccatttg

SEQ ID NO: 5579033 - DNA, 14 bp, Homo sapiens
caagatccatttgc

SEQ ID NO: 5579034 - DNA, 16 bp, Homo sapiens
caagatccatttgcct

SEQ ID NO: 5579035 - DNA, 13 bp, Homo sapiens
caagatcccattt

SEQ ID NO: 5579036 - DNA, 16 bp, Homo sapiens
caagatccgtggtttg

SEQ ID NO: 5579037 - DNA, 22 bp, Homo sapiens
caagatcctgtctttaaggaaa

SEQ ID NO: 5579038 - DNA, 13 bp, Homo sapiens
caagatcgcacca

SEQ ID NO: 5579039 - DNA, 18 bp, Homo sapiens
caagatcgcaccactgca

SEQ ID NO: 5579040 - DNA, 16 bp, Homo sapiens
caagatcgctgtgcta

SEQ ID NO: 5579041 - DNA, 18 bp, Homo sapiens
caagatctgccagacctg

SEQ ID NO: 5579042 - DNA, 14 bp, Homo sapiens
caagatctttcagg

SEQ ID NO: 5579043 - DNA, 15 bp, Homo sapiens
caagatgacagctct

SEQ ID NO: 5579044 - DNA, 15 bp, Homo sapiens
caagatgactggggt

SEQ ID NO: 5579045 - DNA, 16 bp, Homo sapiens
caagatgactggggtg

SEQ ID NO: 5579046 - DNA, 19 bp, Homo sapiens
caagatgagagaactggag

SEQ ID NO: 5579047 - DNA, 21 bp, Homo sapiens
caagatgagattggcatggct

SEQ ID NO: 5579048 - DNA, 17 bp, Homo sapiens
caagatgagcctgggct

SEQ ID NO: 5579049 - DNA, 19 bp, Homo sapiens
caagatgagctgcagcccc

SEQ ID NO: 5579050 - DNA, 21 bp, Homo sapiens
caagatgagctgcagcccccc

SEQ ID NO: 5579051 - DNA, 15 bp, Homo sapiens
caagatgagctgtgc

SEQ ID NO: 5579052 - DNA, 16 bp, Homo sapiens
caagatgcaaatgttt

SEQ ID NO: 5579053 - DNA, 16 bp, Homo sapiens
caagatgccaacatcg

SEQ ID NO: 5579054 - DNA, 18 bp, Homo sapiens
caagatgccaacatcggt

SEQ ID NO: 5579055 - DNA, 21 bp, Homo sapiens
caagatgccaaggaggtccca

SEQ ID NO: 5579056 - DNA, 15 bp, Homo sapiens
caagatgcctcttct

SEQ ID NO: 5579057 - DNA, 16 bp, Homo sapiens
caagatgcctcttcta

SEQ ID NO: 5579058 - DNA, 12 bp, Homo sapiens
caagatgcctga

SEQ ID NO: 5579059 - DNA, 21 bp, Homo sapiens
caagatggaaaataaattata

SEQ ID NO: 5579060 - DNA, 19 bp, Homo sapiens
caagatggaatttatcaaa

SEQ ID NO: 5579061 - DNA, 21 bp, Homo sapiens
caagatggacttacctggcag

SEQ ID NO: 5579062 - DNA, 16 bp, Homo sapiens
caagatggagaggaag

SEQ ID NO: 5579063 - DNA, 21 bp, Homo sapiens
caagatggaggggctgactca

SEQ ID NO: 5579064 - DNA, 23 bp, Homo sapiens
caagatggcacagggcatgaaat

SEQ ID NO: 5579065 - DNA, 21 bp, Homo sapiens
caagatggcgaccaccaaagt

SEQ ID NO: 5579066 - DNA, 22 bp, Homo sapiens
caagatggcgaccaccaaagtc

SEQ ID NO: 5579067 - DNA, 23 bp, Homo sapiens
caagatggcgccaccgcactcca

SEQ ID NO: 5579068 - DNA, 20 bp, Homo sapiens
caagatggctgctgcctgct

SEQ ID NO: 5579069 - DNA, 22 bp, Homo sapiens
caagatggtccatttgttcctg

SEQ ID NO: 5579070 - DNA, 20 bp, Homo sapiens
caagatgtcaaataaagcaa

SEQ ID NO: 5579071 - DNA, 19 bp, Homo sapiens
caagatgtcctccttgttc

SEQ ID NO: 5579072 - DNA, 21 bp, Homo sapiens
caagatgtcctccttgttcta

SEQ ID NO: 5579073 - DNA, 13 bp, Homo sapiens
caagatgtctgtc

SEQ ID NO: 5579074 - DNA, 13 bp, Homo sapiens
caagatgtgaatt

SEQ ID NO: 5579075 - DNA, 19 bp, Homo sapiens
caagatgttatattaaaga

SEQ ID NO: 5579076 - DNA, 19 bp, Homo sapiens
caagatgttgatttttact

SEQ ID NO: 5579077 - DNA, 14 bp, Homo sapiens
caagatgtttctta

SEQ ID NO: 5579078 - DNA, 17 bp, Homo sapiens
caagatgttttgtataa

SEQ ID NO: 5579079 - DNA, 20 bp, Homo sapiens
caagatgttttgtataaaat

SEQ ID NO: 5579080 - DNA, 14 bp, Homo sapiens
caagattaaatgta

SEQ ID NO: 5579081 - DNA, 15 bp, Homo sapiens
caagattatgtgact

SEQ ID NO: 5579082 - DNA, 13 bp, Homo sapiens
caagattcagcta

SEQ ID NO: 5579083 - DNA, 17 bp, Homo sapiens
caagattcccagagaca

SEQ ID NO: 5579084 - DNA, 13 bp, Homo sapiens
caagattcccagg

SEQ ID NO: 5579085 - DNA, 14 bp, Homo sapiens
caagattcccagga

SEQ ID NO: 5579086 - DNA, 20 bp, Homo sapiens
caagattcccaggagttctg

SEQ ID NO: 5579087 - DNA, 10 bp, Homo sapiens
caagattccg

SEQ ID NO: 5579088 - DNA, 22 bp, Homo sapiens
caagattcgccaatctcataca

SEQ ID NO: 5579089 - DNA, 19 bp, Homo sapiens
caagattgagctctctgcc

SEQ ID NO: 5579090 - DNA, 18 bp, Homo sapiens
caagattggaaagacagg

SEQ ID NO: 5579091 - DNA, 22 bp, Homo sapiens
caagattgttcctgcttttccc

SEQ ID NO: 5579092 - DNA, 16 bp, Homo sapiens
caagatttaaaattaa

SEQ ID NO: 5579093 - DNA, 20 bp, Homo sapiens
caagatttaaaattaaattt

SEQ ID NO: 5579094 - DNA, 14 bp, Homo sapiens
caagatttagaaaa

SEQ ID NO: 5579095 - DNA, 16 bp, Homo sapiens
caagatttagaaaaaa

SEQ ID NO: 5579096 - DNA, 18 bp, Homo sapiens
caagatttcacatcagct

SEQ ID NO: 5579097 - DNA, 21 bp, Homo sapiens
caagatttccacaattcttct

SEQ ID NO: 5579098 - DNA, 23 bp, Homo sapiens
caagatttccctaaaaattccac

SEQ ID NO: 5579099 - DNA, 16 bp, Homo sapiens
caagatttgaccaaat

SEQ ID NO: 5579100 - DNA, 19 bp, Homo sapiens
caagatttgtaattacagg

SEQ ID NO: 5579101 - DNA, 14 bp, Homo sapiens
caagccagctggag

SEQ ID NO: 5579102 - DNA, 14 bp, Homo sapiens
caagccagcttcct

SEQ ID NO: 5579103 - DNA, 19 bp, Homo sapiens
caagccagcttcctgtgca

SEQ ID NO: 5579104 - DNA, 22 bp, Homo sapiens
caagccagcttcctgtgcagaa

SEQ ID NO: 5579105 - DNA, 19 bp, Homo sapiens
caagccaggagaagacccc

SEQ ID NO: 5579106 - DNA, 20 bp, Homo sapiens
caagccaggagaagacccct

SEQ ID NO: 5579107 - DNA, 20 bp, Homo sapiens
caagccaggagaccctgtct

SEQ ID NO: 5579108 - DNA, 19 bp, Homo sapiens
caagccagggatggggcca

SEQ ID NO: 5579109 - DNA, 12 bp, Homo sapiens
caagccagggcc

SEQ ID NO: 5579110 - DNA, 14 bp, Homo sapiens
caagccagggccca

SEQ ID NO: 5579111 - DNA, 21 bp, Homo sapiens
caagccagggcccagagccct

SEQ ID NO: 5579112 - DNA, 14 bp, Homo sapiens
caagccatcatcct

SEQ ID NO: 5579113 - DNA, 20 bp, Homo sapiens
caagccatggtgacacacag

SEQ ID NO: 5579114 - DNA, 19 bp, Homo sapiens
caagccatgtataaatgtg

SEQ ID NO: 5579115 - DNA, 21 bp, Homo sapiens
caagccatgtataaatgtgat

SEQ ID NO: 5579116 - DNA, 19 bp, Homo sapiens
caagccattcacttcccca

SEQ ID NO: 5579117 - DNA, 21 bp, Homo sapiens
caagccattttttgaggagag

SEQ ID NO: 5579118 - DNA, 22 bp, Homo sapiens
caagcccacagcacagctccct

SEQ ID NO: 5579119 - DNA, 19 bp, Homo sapiens
caagcccacctcggccctc

SEQ ID NO: 5579120 - DNA, 18 bp, Homo sapiens
caagcccactggccagct

SEQ ID NO: 5579121 - DNA, 17 bp, Homo sapiens
caagcccagcactgctt

SEQ ID NO: 5579122 - DNA, 19 bp, Homo sapiens
caagcccagcccatggaga

SEQ ID NO: 5579123 - DNA, 18 bp, Homo sapiens
caagcccaggacactgcc

SEQ ID NO: 5579124 - DNA, 22 bp, Homo sapiens
caagcccaggacactgcctttg

SEQ ID NO: 5579125 - DNA, 14 bp, Homo sapiens
caagcccaggcttc

SEQ ID NO: 5579126 - DNA, 14 bp, Homo sapiens
caagcccaggtgcc

SEQ ID NO: 5579127 - DNA, 17 bp, Homo sapiens
caagccccagcagccct

SEQ ID NO: 5579128 - DNA, 22 bp, Homo sapiens
caagccccagcagccctcaaca

SEQ ID NO: 5579129 - DNA, 13 bp, Homo sapiens
caagccccaggca

SEQ ID NO: 5579130 - DNA, 15 bp, Homo sapiens
caagccccaggcagg

SEQ ID NO: 5579131 - DNA, 23 bp, Homo sapiens
caagccccattcacggcctggca

SEQ ID NO: 5579132 - DNA, 16 bp, Homo sapiens
caagccccccacacct

SEQ ID NO: 5579133 - DNA, 17 bp, Homo sapiens
caagcccccccttccac

SEQ ID NO: 5579134 - DNA, 14 bp, Homo sapiens
caagccccctggca

SEQ ID NO: 5579135 - DNA, 23 bp, Homo sapiens
caagccccctggcagctgcccct

SEQ ID NO: 5579136 - DNA, 19 bp, Homo sapiens
caagcccctagtcttagag

SEQ ID NO: 5579137 - DNA, 13 bp, Homo sapiens
caagcccctgccc

SEQ ID NO: 5579138 - DNA, 17 bp, Homo sapiens
caagcccctgcccatct

SEQ ID NO: 5579139 - DNA, 20 bp, Homo sapiens
caagcccctgccctggggag

SEQ ID NO: 5579140 - DNA, 15 bp, Homo sapiens
caagccccttctctc

SEQ ID NO: 5579141 - DNA, 20 bp, Homo sapiens
caagcccgcctccagcacca

SEQ ID NO: 5579142 - DNA, 15 bp, Homo sapiens
caagcccgtgacaga

SEQ ID NO: 5579143 - DNA, 18 bp, Homo sapiens
caagccctacagagctgt

SEQ ID NO: 5579144 - DNA, 13 bp, Homo sapiens
caagccctccaca

SEQ ID NO: 5579145 - DNA, 14 bp, Homo sapiens
caagccctccgcct

SEQ ID NO: 5579146 - DNA, 23 bp, Homo sapiens
caagccctcctccccagagctgg

SEQ ID NO: 5579147 - DNA, 14 bp, Homo sapiens
caagccctgagagt

SEQ ID NO: 5579148 - DNA, 19 bp, Homo sapiens
caagccctgaggcctgagg

SEQ ID NO: 5579149 - DNA, 22 bp, Homo sapiens
caagccctgaggcctgaggcct

SEQ ID NO: 5579150 - DNA, 12 bp, Homo sapiens
caagccctgccc

SEQ ID NO: 5579151 - DNA, 13 bp, Homo sapiens
caagccctgccca

SEQ ID NO: 5579152 - DNA, 22 bp, Homo sapiens
caagccctgcttgctggaaaac

SEQ ID NO: 5579153 - DNA, 23 bp, Homo sapiens
caagccctggagaaatgggagct

SEQ ID NO: 5579154 - DNA, 12 bp, Homo sapiens
caagccctggca

SEQ ID NO: 5579155 - DNA, 13 bp, Homo sapiens
caagccctggccc

SEQ ID NO: 5579156 - DNA, 17 bp, Homo sapiens
caagccctggggcaggg

SEQ ID NO: 5579157 - DNA, 13 bp, Homo sapiens
caagccctggtga

SEQ ID NO: 5579158 - DNA, 16 bp, Homo sapiens
caagcccttggggagg

SEQ ID NO: 5579159 - DNA, 12 bp, Homo sapiens
caagccctttgc

SEQ ID NO: 5579160 - DNA, 14 bp, Homo sapiens
caagccctttgctg

SEQ ID NO: 5579161 - DNA, 17 bp, Homo sapiens
caagccgcaagctctca

SEQ ID NO: 5579162 - DNA, 14 bp, Homo sapiens
caagccgggagcca

SEQ ID NO: 5579163 - DNA, 20 bp, Homo sapiens
caagccgtggccggggtcca

SEQ ID NO: 5579164 - DNA, 15 bp, Homo sapiens
caagccgtggcttcc

SEQ ID NO: 5579165 - DNA, 18 bp, Homo sapiens
caagcctaagggatcctg

SEQ ID NO: 5579166 - DNA, 14 bp, Homo sapiens
caagcctagcctga

SEQ ID NO: 5579167 - DNA, 16 bp, Homo sapiens
caagcctcagcaaacc

SEQ ID NO: 5579168 - DNA, 22 bp, Homo sapiens
caagcctcatgccaaccctggg

SEQ ID NO: 5579169 - DNA, 14 bp, Homo sapiens
caagcctccacagc

SEQ ID NO: 5579170 - DNA, 15 bp, Homo sapiens
caagcctccacagcg

SEQ ID NO: 5579171 - DNA, 17 bp, Homo sapiens
caagcctccacagcgag

SEQ ID NO: 5579172 - DNA, 23 bp, Homo sapiens
caagcctctagtgtaccaagtgc

SEQ ID NO: 5579173 - DNA, 12 bp, Homo sapiens
caagcctctgcc

SEQ ID NO: 5579174 - DNA, 15 bp, Homo sapiens
caagcctctgtcttt

SEQ ID NO: 5579175 - DNA, 16 bp, Homo sapiens
caagcctctgtctttt

SEQ ID NO: 5579176 - DNA, 23 bp, Homo sapiens
caagcctcttattccaggagaag

SEQ ID NO: 5579177 - DNA, 21 bp, Homo sapiens
caagcctgaccacgctttcta

SEQ ID NO: 5579178 - DNA, 13 bp, Homo sapiens
caagcctgagaac

SEQ ID NO: 5579179 - DNA, 21 bp, Homo sapiens
caagcctgagggaaaggccag

SEQ ID NO: 5579180 - DNA, 22 bp, Homo sapiens
caagcctgatttaggcactgct

SEQ ID NO: 5579181 - DNA, 14 bp, Homo sapiens
caagcctgccccgg

SEQ ID NO: 5579182 - DNA, 16 bp, Homo sapiens
caagcctgccccggcc

SEQ ID NO: 5579183 - DNA, 18 bp, Homo sapiens
caagcctgccccggccac

SEQ ID NO: 5579184 - DNA, 15 bp, Homo sapiens
caagcctgcctccca

SEQ ID NO: 5579185 - DNA, 21 bp, Homo sapiens
caagcctggagcccctgtgtt

SEQ ID NO: 5579186 - DNA, 13 bp, Homo sapiens
caagcctggagga

SEQ ID NO: 5579187 - DNA, 21 bp, Homo sapiens
caagcctggagtaggcctggg

SEQ ID NO: 5579188 - DNA, 10 bp, Homo sapiens
caagcctggc

SEQ ID NO: 5579189 - DNA, 14 bp, Homo sapiens
caagcctggcaagg

SEQ ID NO: 5579190 - DNA, 14 bp, Homo sapiens
caagcctggcaccc

SEQ ID NO: 5579191 - DNA, 20 bp, Homo sapiens
caagcctggcacccaccgtc

SEQ ID NO: 5579192 - DNA, 12 bp, Homo sapiens
caagcctggccc

SEQ ID NO: 5579193 - DNA, 20 bp, Homo sapiens
caagcctggcccagtgagag

SEQ ID NO: 5579194 - DNA, 22 bp, Homo sapiens
caagcctggcccccgacccagc

SEQ ID NO: 5579195 - DNA, 18 bp, Homo sapiens
caagcctggtcagcccaa

SEQ ID NO: 5579196 - DNA, 17 bp, Homo sapiens
caagcctggtctcctcc

SEQ ID NO: 5579197 - DNA, 18 bp, Homo sapiens
caagcctgtaatcccagc

SEQ ID NO: 5579198 - DNA, 19 bp, Homo sapiens
caagcctgtgcaaaaaaat

SEQ ID NO: 5579199 - DNA, 16 bp, Homo sapiens
caagcctgtgggcagc

SEQ ID NO: 5579200 - DNA, 23 bp, Homo sapiens
caagcctgtgggcagcatgccca

SEQ ID NO: 5579201 - DNA, 19 bp, Homo sapiens
caagccttactcacctctc

SEQ ID NO: 5579202 - DNA, 23 bp, Homo sapiens
caagccttactcacctctctcta

SEQ ID NO: 5579203 - DNA, 11 bp, Homo sapiens
caagccttctg

SEQ ID NO: 5579204 - DNA, 14 bp, Homo sapiens
caagccttgattgg

SEQ ID NO: 5579205 - DNA, 17 bp, Homo sapiens
caagcctttatggctgc

SEQ ID NO: 5579206 - DNA, 18 bp, Homo sapiens
caagcgacacaggctgcc

SEQ ID NO: 5579207 - DNA, 15 bp, Homo sapiens
caagcgaccaaggat

SEQ ID NO: 5579208 - DNA, 15 bp, Homo sapiens
caagcgactctcctg

SEQ ID NO: 5579209 - DNA, 19 bp, Homo sapiens
caagcgagaatgcaggccc

SEQ ID NO: 5579210 - DNA, 14 bp, Homo sapiens
caagcgagcacagt

SEQ ID NO: 5579211 - DNA, 20 bp, Homo sapiens
caagcgaggtcaacagagaa

SEQ ID NO: 5579212 - DNA, 16 bp, Homo sapiens
caagcgattctcctgc

SEQ ID NO: 5579213 - DNA, 17 bp, Homo sapiens
caagcgattctcctgcc

SEQ ID NO: 5579214 - DNA, 20 bp, Homo sapiens
caagcgattctcctgcctca

SEQ ID NO: 5579215 - DNA, 22 bp, Homo sapiens
caagcgattctcctgcctcagc

SEQ ID NO: 5579216 - DNA, 17 bp, Homo sapiens
caagcgattctcttgcc

SEQ ID NO: 5579217 - DNA, 21 bp, Homo sapiens
caagcgattctcttgcctcaa

SEQ ID NO: 5579218 - DNA, 19 bp, Homo sapiens
caagcgattcttctgcttc

SEQ ID NO: 5579219 - DNA, 18 bp, Homo sapiens
caagcgattcttgtgcct

SEQ ID NO: 5579220 - DNA, 21 bp, Homo sapiens
caagcgattcttgtgcctcag

SEQ ID NO: 5579221 - DNA, 20 bp, Homo sapiens
caagcgattttcctgcttca

SEQ ID NO: 5579222 - DNA, 14 bp, Homo sapiens
caagcgcagggagg

SEQ ID NO: 5579223 - DNA, 16 bp, Homo sapiens
caagcgccctggcccc

SEQ ID NO: 5579224 - DNA, 19 bp, Homo sapiens
caagcgccctggcccccac

SEQ ID NO: 5579225 - DNA, 14 bp, Homo sapiens
caagcgctccaggg

SEQ ID NO: 5579226 - DNA, 15 bp, Homo sapiens
caagcgctcccagcc

SEQ ID NO: 5579227 - DNA, 15 bp, Homo sapiens
caagcgcttctgctg

SEQ ID NO: 5579228 - DNA, 15 bp, Homo sapiens
caagcggtgtctctc

SEQ ID NO: 5579229 - DNA, 16 bp, Homo sapiens
caagcgtctgggcaag

SEQ ID NO: 5579230 - DNA, 22 bp, Homo sapiens
caagcgtgattcctgctgcctg

SEQ ID NO: 5579231 - DNA, 16 bp, Homo sapiens
caagcgtgctgcctct

SEQ ID NO: 5579232 - DNA, 17 bp, Homo sapiens
caagcgtgctgcctctc

SEQ ID NO: 5579233 - DNA, 15 bp, Homo sapiens
caagcgtgttctcag

SEQ ID NO: 5579234 - DNA, 15 bp, Homo sapiens
caagcgttcctggcc

SEQ ID NO: 5579235 - DNA, 16 bp, Homo sapiens
caagctaagcactgcc

SEQ ID NO: 5579236 - DNA, 17 bp, Homo sapiens
caagctaagtaaaaata

SEQ ID NO: 5579237 - DNA, 18 bp, Homo sapiens
caagctaagtaaaaatat

SEQ ID NO: 5579238 - DNA, 23 bp, Homo sapiens
caagctaattgggagtccaggca

SEQ ID NO: 5579239 - DNA, 17 bp, Homo sapiens
caagctactttatgtaa

SEQ ID NO: 5579240 - DNA, 15 bp, Homo sapiens
caagctaggaaagag

SEQ ID NO: 5579241 - DNA, 16 bp, Homo sapiens
caagctaggaaagagg

SEQ ID NO: 5579242 - DNA, 17 bp, Homo sapiens
caagctaggaaagagga

SEQ ID NO: 5579243 - DNA, 17 bp, Homo sapiens
caagctaggccccagag

SEQ ID NO: 5579244 - DNA, 19 bp, Homo sapiens
caagctaggccccagaggc

SEQ ID NO: 5579245 - DNA, 23 bp, Homo sapiens
caagctaggccccagaggccctg

SEQ ID NO: 5579246 - DNA, 15 bp, Homo sapiens
caagctagtgtttct

SEQ ID NO: 5579247 - DNA, 17 bp, Homo sapiens
caagctagtgtttctag

SEQ ID NO: 5579248 - DNA, 18 bp, Homo sapiens
caagctataaaagcccat

SEQ ID NO: 5579249 - DNA, 15 bp, Homo sapiens
caagctatctaaagt

SEQ ID NO: 5579250 - DNA, 16 bp, Homo sapiens
caagctattcctttcc

SEQ ID NO: 5579251 - DNA, 18 bp, Homo sapiens
caagctattcctttccct

SEQ ID NO: 5579252 - DNA, 17 bp, Homo sapiens
caagctattctcatgcc

SEQ ID NO: 5579253 - DNA, 16 bp, Homo sapiens
caagctatttctctgg

SEQ ID NO: 5579254 - DNA, 16 bp, Homo sapiens
caagctcaaagcgtgg

SEQ ID NO: 5579255 - DNA, 14 bp, Homo sapiens
caagctcaaggcaa

SEQ ID NO: 5579256 - DNA, 18 bp, Homo sapiens
caagctcaaggcaatggg

SEQ ID NO: 5579257 - DNA, 15 bp, Homo sapiens
caagctcacacctgt

SEQ ID NO: 5579258 - DNA, 21 bp, Homo sapiens
caagctcacacctgtccttct

SEQ ID NO: 5579259 - DNA, 12 bp, Homo sapiens
caagctcacagt

SEQ ID NO: 5579260 - DNA, 16 bp, Homo sapiens
caagctcacagttcct

SEQ ID NO: 5579261 - DNA, 22 bp, Homo sapiens
caagctcacagttcctcgccct

SEQ ID NO: 5579262 - DNA, 17 bp, Homo sapiens
caagctcaccctgctcc

SEQ ID NO: 5579263 - DNA, 21 bp, Homo sapiens
caagctcactccccaaccccc

SEQ ID NO: 5579264 - DNA, 15 bp, Homo sapiens
caagctcagaaggct

SEQ ID NO: 5579265 - DNA, 20 bp, Homo sapiens
caagctcagagcagcctctg

SEQ ID NO: 5579266 - DNA, 14 bp, Homo sapiens
caagctcatgtcat

SEQ ID NO: 5579267 - DNA, 19 bp, Homo sapiens
caagctcatgtcattatga

SEQ ID NO: 5579268 - DNA, 19 bp, Homo sapiens
caagctccaagccccatct

SEQ ID NO: 5579269 - DNA, 16 bp, Homo sapiens
caagctcccaagagct

SEQ ID NO: 5579270 - DNA, 18 bp, Homo sapiens
caagctcccaagagcttc

SEQ ID NO: 5579271 - DNA, 12 bp, Homo sapiens
caagctcccagg

SEQ ID NO: 5579272 - DNA, 14 bp, Homo sapiens
caagctcccaggca

SEQ ID NO: 5579273 - DNA, 15 bp, Homo sapiens
caagctcccaggcat

SEQ ID NO: 5579274 - DNA, 13 bp, Homo sapiens
caagctccctgcc

SEQ ID NO: 5579275 - DNA, 20 bp, Homo sapiens
caagctccctggagccctgt

SEQ ID NO: 5579276 - DNA, 23 bp, Homo sapiens
caagctccctggtgagggagcct

SEQ ID NO: 5579277 - DNA, 20 bp, Homo sapiens
caagctccgcctcccgggtt

SEQ ID NO: 5579278 - DNA, 12 bp, Homo sapiens
caagctcctcct

SEQ ID NO: 5579279 - DNA, 13 bp, Homo sapiens
caaggccccttcc

SEQ ID NO: 5579280 - DNA, 14 bp, Homo sapiens
caaggccccttcca

SEQ ID NO: 5579281 - DNA, 15 bp, Homo sapiens
caaggccccttccac

SEQ ID NO: 5579282 - DNA, 19 bp, Homo sapiens
caaggcccgagcagctgag

SEQ ID NO: 5579283 - DNA, 21 bp, Homo sapiens
caaggcccgagcagctgagca

SEQ ID NO: 5579284 - DNA, 15 bp, Homo sapiens
caaggccctcggagc

SEQ ID NO: 5579285 - DNA, 18 bp, Homo sapiens
caaggccctcggagctgg

SEQ ID NO: 5579286 - DNA, 21 bp, Homo sapiens
caaggccctgcatctgtctgc

SEQ ID NO: 5579287 - DNA, 22 bp, Homo sapiens
caaggccctgcatctgtctgct

SEQ ID NO: 5579288 - DNA, 12 bp, Homo sapiens
caaggccctgcc

SEQ ID NO: 5579289 - DNA, 12 bp, Homo sapiens
caaggccctgtc

SEQ ID NO: 5579290 - DNA, 14 bp, Homo sapiens
caaggccctgtccc

SEQ ID NO: 5579291 - DNA, 16 bp, Homo sapiens
caaggccctgtctctg

SEQ ID NO: 5579292 - DNA, 21 bp, Homo sapiens
caaggccctgtctctggctac

SEQ ID NO: 5579293 - DNA, 17 bp, Homo sapiens
caaggccgaagctctgg

SEQ ID NO: 5579294 - DNA, 20 bp, Homo sapiens
caaggccgagcgttcccagc

SEQ ID NO: 5579295 - DNA, 22 bp, Homo sapiens
caaggccgagcgttcccagcag

SEQ ID NO: 5579296 - DNA, 24 bp, Homo sapiens
caaggccgagcgttcccagcaggg

SEQ ID NO: 5579297 - DNA, 17 bp, Homo sapiens
caaggccgagggccagg

SEQ ID NO: 5579298 - DNA, 14 bp, Homo sapiens
caaggccgcccacc

SEQ ID NO: 5579299 - DNA, 16 bp, Homo sapiens
caaggccgcccacctg

SEQ ID NO: 5579300 - DNA, 24 bp, Homo sapiens
caaggccgcccacctgcatcagcc

SEQ ID NO: 5579301 - DNA, 22 bp, Homo sapiens
caaggccgcggcccagacccac

SEQ ID NO: 5579302 - DNA, 22 bp, Homo sapiens
caaggccggagacccacagccc

SEQ ID NO: 5579303 - DNA, 22 bp, Homo sapiens
caaggcctatgccacctgcagc

SEQ ID NO: 5579304 - DNA, 14 bp, Homo sapiens
caaggcctcaggag

SEQ ID NO: 5579305 - DNA, 18 bp, Homo sapiens
caaggcctcaggagagca

SEQ ID NO: 5579306 - DNA, 16 bp, Homo sapiens
caaggcctccagccac

SEQ ID NO: 5579307 - DNA, 13 bp, Homo sapiens
caaggcctcccac

SEQ ID NO: 5579308 - DNA, 15 bp, Homo sapiens
caaggcctcccacag

SEQ ID NO: 5579309 - DNA, 17 bp, Homo sapiens
caaggcctcccacagtg

SEQ ID NO: 5579310 - DNA, 12 bp, Homo sapiens
caaggcctctca

SEQ ID NO: 5579311 - DNA, 13 bp, Homo sapiens
caaggcctctcag

SEQ ID NO: 5579312 - DNA, 12 bp, Homo sapiens
caaggcctctct

SEQ ID NO: 5579313 - DNA, 17 bp, Homo sapiens
caaggcctctctctgcc

SEQ ID NO: 5579314 - DNA, 20 bp, Homo sapiens
caaggcctctctctgcctga

SEQ ID NO: 5579315 - DNA, 14 bp, Homo sapiens
caaggcctggtctg

SEQ ID NO: 5579316 - DNA, 21 bp, Homo sapiens
caaggcctggtgtttcttgat

SEQ ID NO: 5579317 - DNA, 22 bp, Homo sapiens
caaggccttcagtttatttcca

SEQ ID NO: 5579318 - DNA, 18 bp, Homo sapiens
caaggccttctcaggctg

SEQ ID NO: 5579319 - DNA, 22 bp, Homo sapiens
caaggccttggtggagcagcca

SEQ ID NO: 5579320 - DNA, 13 bp, Homo sapiens
caaggcctttcct

SEQ ID NO: 5579321 - DNA, 15 bp, Homo sapiens
caaggcctttctgtg

SEQ ID NO: 5579322 - DNA, 19 bp, Homo sapiens
caaggcgcgctcagatgcc

SEQ ID NO: 5579323 - DNA, 21 bp, Homo sapiens
caaggcgcgctcagatgccgg

SEQ ID NO: 5579324 - DNA, 14 bp, Homo sapiens
caaggcggcccctc

SEQ ID NO: 5579325 - DNA, 19 bp, Homo sapiens
caaggcgggagcatctctt

SEQ ID NO: 5579326 - DNA, 17 bp, Homo sapiens
caaggcgggagggcctg

SEQ ID NO: 5579327 - DNA, 20 bp, Homo sapiens
caaggcgggcggatcacctg

SEQ ID NO: 5579328 - DNA, 14 bp, Homo sapiens
caaggcggtacact

SEQ ID NO: 5579329 - DNA, 15 bp, Homo sapiens
caaggcggtacacta

SEQ ID NO: 5579330 - DNA, 13 bp, Homo sapiens
caaggcggtgctt

SEQ ID NO: 5579331 - DNA, 21 bp, Homo sapiens
caaggcggtggacttgaactt

SEQ ID NO: 5579332 - DNA, 14 bp, Homo sapiens
caaggctatgtgat

SEQ ID NO: 5579333 - DNA, 15 bp, Homo sapiens
caaggctcactgcag

SEQ ID NO: 5579334 - DNA, 16 bp, Homo sapiens
caaggctcactgcagc

SEQ ID NO: 5579335 - DNA, 10 bp, Homo sapiens
caaggctcag

SEQ ID NO: 5579336 - DNA, 16 bp, Homo sapiens
caaggctcagaaggaa

SEQ ID NO: 5579337 - DNA, 19 bp, Homo sapiens
caaggctcccgtactgtct

SEQ ID NO: 5579338 - DNA, 23 bp, Homo sapiens
caaggctcttctccttggaggac

SEQ ID NO: 5579339 - DNA, 16 bp, Homo sapiens
caaggctgaaaagtgc

SEQ ID NO: 5579340 - DNA, 22 bp, Homo sapiens
caaggctgagacagtgaatttg

SEQ ID NO: 5579341 - DNA, 15 bp, Homo sapiens
caaggctgagagctc

SEQ ID NO: 5579342 - DNA, 12 bp, Homo sapiens
caaggctgcagt

SEQ ID NO: 5579343 - DNA, 15 bp, Homo sapiens
caaggctgcagtgag

SEQ ID NO: 5579344 - DNA, 22 bp, Homo sapiens
caaggctgcagtgagccgagat

SEQ ID NO: 5579345 - DNA, 12 bp, Homo sapiens
caaggctgccag

SEQ ID NO: 5579346 - DNA, 22 bp, Homo sapiens
caaggctgcctggagaaaggat

SEQ ID NO: 5579347 - DNA, 21 bp, Homo sapiens
caaggctgctaagtggaagac

SEQ ID NO: 5579348 - DNA, 12 bp, Homo sapiens
caaggctgctca

SEQ ID NO: 5579349 - DNA, 21 bp, Homo sapiens
caaggctgctcagaggggccc

SEQ ID NO: 5579350 - DNA, 12 bp, Homo sapiens
caaggctgctgc

SEQ ID NO: 5579351 - DNA, 15 bp, Homo sapiens
caaggctgctgccgg

SEQ ID NO: 5579352 - DNA, 16 bp, Homo sapiens
caaggctgcttagaat

SEQ ID NO: 5579353 - DNA, 13 bp, Homo sapiens
caaggctggccag

SEQ ID NO: 5579354 - DNA, 15 bp, Homo sapiens
caaggctggccagca

SEQ ID NO: 5579355 - DNA, 22 bp, Homo sapiens
caaggctggccagcaaggcagg

SEQ ID NO: 5579356 - DNA, 14 bp, Homo sapiens
caaggctggggcat

SEQ ID NO: 5579357 - DNA, 22 bp, Homo sapiens
caaggctgggtaatgtgaaggc

SEQ ID NO: 5579358 - DNA, 14 bp, Homo sapiens
caaggctgtcaatt

SEQ ID NO: 5579359 - DNA, 14 bp, Homo sapiens
caaggctgtcttct

SEQ ID NO: 5579360 - DNA, 19 bp, Homo sapiens
caaggctgtcttctcccag

SEQ ID NO: 5579361 - DNA, 22 bp, Homo sapiens
caaggctgtcttctcccagagc

SEQ ID NO: 5579362 - DNA, 15 bp, Homo sapiens
caaggctgtgccagg

SEQ ID NO: 5579363 - DNA, 17 bp, Homo sapiens
caaggctgtgccaggct

SEQ ID NO: 5579364 - DNA, 13 bp, Homo sapiens
caaggctgtgctc

SEQ ID NO: 5579365 - DNA, 17 bp, Homo sapiens
caaggctgtgctcttcc

SEQ ID NO: 5579366 - DNA, 14 bp, Homo sapiens
caaggctgttgcat

SEQ ID NO: 5579367 - DNA, 16 bp, Homo sapiens
caaggcttaaaagagt

SEQ ID NO: 5579368 - DNA, 20 bp, Homo sapiens
caaggcttgctgcagatact

SEQ ID NO: 5579369 - DNA, 23 bp, Homo sapiens
caaggcttggagaggtatgtgcc

SEQ ID NO: 5579370 - DNA, 15 bp, Homo sapiens
caaggctttctctac

SEQ ID NO: 5579371 - DNA, 15 bp, Homo sapiens
caagggaaaagtctc

SEQ ID NO: 5579372 - DNA, 21 bp, Homo sapiens
caagggaaaataaaaaaagaa

SEQ ID NO: 5579373 - DNA, 23 bp, Homo sapiens
caagggaaaataaaaaaagaaaa

SEQ ID NO: 5579374 - DNA, 14 bp, Homo sapiens
caagggaaaggggt

SEQ ID NO: 5579375 - DNA, 15 bp, Homo sapiens
caagggaacctgtgt

SEQ ID NO: 5579376 - DNA, 18 bp, Homo sapiens
caagggaagcctgcctgg

SEQ ID NO: 5579377 - DNA, 17 bp, Homo sapiens
caagggaagtgaccaag

SEQ ID NO: 5579378 - DNA, 12 bp, Homo sapiens
caagggaatgaa

SEQ ID NO: 5579379 - DNA, 19 bp, Homo sapiens
caagggacaaggacacgcg

SEQ ID NO: 5579380 - DNA, 15 bp, Homo sapiens
caagggacagcccac

SEQ ID NO: 5579381 - DNA, 19 bp, Homo sapiens
caagggacagcccacggtc

SEQ ID NO: 5579382 - DNA, 21 bp, Homo sapiens
caagggacaggaaggtctgat

SEQ ID NO: 5579383 - DNA, 17 bp, Homo sapiens
caagggacaggtgggcc

SEQ ID NO: 5579384 - DNA, 20 bp, Homo sapiens
caagggacaggtgggcctgg

SEQ ID NO: 5579385 - DNA, 15 bp, Homo sapiens
caagggacctgctca

SEQ ID NO: 5579386 - DNA, 23 bp, Homo sapiens
caagggactgaagtatacattta

SEQ ID NO: 5579387 - DNA, 13 bp, Homo sapiens
caagggagaaaag

SEQ ID NO: 5579388 - DNA, 18 bp, Homo sapiens
caagggagaaaagagaaa

SEQ ID NO: 5579389 - DNA, 19 bp, Homo sapiens
caagggagagacctcatca

SEQ ID NO: 5579390 - DNA, 15 bp, Homo sapiens
caagggaggcccagc

SEQ ID NO: 5579391 - DNA, 21 bp, Homo sapiens
caagggaggggagaaaggaac

SEQ ID NO: 5579392 - DNA, 18 bp, Homo sapiens
caagggaggggtggtatt

SEQ ID NO: 5579393 - DNA, 16 bp, Homo sapiens
caagggatataaaatg

SEQ ID NO: 5579394 - DNA, 13 bp, Homo sapiens
caagggatggtgc

SEQ ID NO: 5579395 - DNA, 12 bp, Homo sapiens
caagggattctg

SEQ ID NO: 5579396 - DNA, 15 bp, Homo sapiens
caagggattctggga

SEQ ID NO: 5579397 - DNA, 17 bp, Homo sapiens
caagggattctgggaag

SEQ ID NO: 5579398 - DNA, 20 bp, Homo sapiens
caagggcacaaactgcagct

SEQ ID NO: 5579399 - DNA, 15 bp, Homo sapiens
caagggcagagaact

SEQ ID NO: 5579400 - DNA, 14 bp, Homo sapiens
caagggcagctttg

SEQ ID NO: 5579401 - DNA, 18 bp, Homo sapiens
caagggcagctttgctca

SEQ ID NO: 5579402 - DNA, 23 bp, Homo sapiens
caagggcagggggcccctttgct

SEQ ID NO: 5579403 - DNA, 22 bp, Homo sapiens
caagggcaggttgatcagtgag

SEQ ID NO: 5579404 - DNA, 14 bp, Homo sapiens
caagggcagtggag

SEQ ID NO: 5579405 - DNA, 18 bp, Homo sapiens
caagggcataaattattg

SEQ ID NO: 5579406 - DNA, 15 bp, Homo sapiens
caagggcatcaggca

SEQ ID NO: 5579407 - DNA, 17 bp, Homo sapiens
caagggcatcaggcact

SEQ ID NO: 5579408 - DNA, 18 bp, Homo sapiens
caagggcatcaggcactg

SEQ ID NO: 5579409 - DNA, 19 bp, Homo sapiens
caagggcatcaggcactgg

SEQ ID NO: 5579410 - DNA, 23 bp, Homo sapiens
caagggcatcaggcactggtggc

SEQ ID NO: 5579411 - DNA, 17 bp, Homo sapiens
caagggcatgagcattg

SEQ ID NO: 5579412 - DNA, 18 bp, Homo sapiens
caagggccaaacccactt

SEQ ID NO: 5579413 - DNA, 20 bp, Homo sapiens
caagggccatgctgaaggga

SEQ ID NO: 5579414 - DNA, 21 bp, Homo sapiens
caagggccatgctgaagggac

SEQ ID NO: 5579415 - DNA, 19 bp, Homo sapiens
caagggcccagaccctggg

SEQ ID NO: 5579416 - DNA, 21 bp, Homo sapiens
caagggcccagaccctgggca

SEQ ID NO: 5579417 - DNA, 15 bp, Homo sapiens
caagggcccagaggg

SEQ ID NO: 5579418 - DNA, 15 bp, Homo sapiens
caagggccccagggg

SEQ ID NO: 5579419 - DNA, 13 bp, Homo sapiens
caagggccctcac

SEQ ID NO: 5579420 - DNA, 14 bp, Homo sapiens
caagggccctcact

SEQ ID NO: 5579421 - DNA, 15 bp, Homo sapiens
caagggccctggcac

SEQ ID NO: 5579422 - DNA, 15 bp, Homo sapiens
caagggcccttctct

SEQ ID NO: 5579423 - DNA, 12 bp, Homo sapiens
caagggcctctt

SEQ ID NO: 5579424 - DNA, 13 bp, Homo sapiens
caagggcctggcc

SEQ ID NO: 5579425 - DNA, 16 bp, Homo sapiens
caagggcctggcctga

SEQ ID NO: 5579426 - DNA, 19 bp, Homo sapiens
caagggcctggcctgagct

SEQ ID NO: 5579427 - DNA, 18 bp, Homo sapiens
caagggcggggctatgcc

SEQ ID NO: 5579428 - DNA, 12 bp, Homo sapiens
caagggctccag

SEQ ID NO: 5579429 - DNA, 19 bp, Homo sapiens
caagggctccccactgcct

SEQ ID NO: 5579430 - DNA, 20 bp, Homo sapiens
caagggctcctatctttcct

SEQ ID NO: 5579431 - DNA, 16 bp, Homo sapiens
caagggctgcaatgcc

SEQ ID NO: 5579432 - DNA, 19 bp, Homo sapiens
caagggctgcttcaaactc

SEQ ID NO: 5579433 - DNA, 15 bp, Homo sapiens
caagggctggcactt

SEQ ID NO: 5579434 - DNA, 12 bp, Homo sapiens
caagggctgggg

SEQ ID NO: 5579435 - DNA, 17 bp, Homo sapiens
caagggctggggcggag

SEQ ID NO: 5579436 - DNA, 21 bp, Homo sapiens
caagggcttacacgtggagga

SEQ ID NO: 5579437 - DNA, 22 bp, Homo sapiens
caagggcttacacgtggaggaa

SEQ ID NO: 5579438 - DNA, 20 bp, Homo sapiens
caagggcttctgcaccctcc

SEQ ID NO: 5579439 - DNA, 23 bp, Homo sapiens
caagggcttctgcaccctccacc

SEQ ID NO: 5579440 - DNA, 18 bp, Homo sapiens
caaggggaatcagaactc

SEQ ID NO: 5579441 - DNA, 21 bp, Homo sapiens
caaggggacccataggaaatc

SEQ ID NO: 5579442 - DNA, 23 bp, Homo sapiens
caaggggaccgccccaggcaccg

SEQ ID NO: 5579443 - DNA, 15 bp, Homo sapiens
caaggggactaaagt

SEQ ID NO: 5579444 - DNA, 18 bp, Homo sapiens
caaggggacttgtgccag

SEQ ID NO: 5579445 - DNA, 17 bp, Homo sapiens
caaggggagggccagga

SEQ ID NO: 5579446 - DNA, 23 bp, Homo sapiens
caaggggagtcaccttcccttgc

SEQ ID NO: 5579447 - DNA, 19 bp, Homo sapiens
caaggggcagtctggaggg

SEQ ID NO: 5579448 - DNA, 14 bp, Homo sapiens
caaggggccagctg

SEQ ID NO: 5579449 - DNA, 16 bp, Homo sapiens
caaggggccagctgcc

SEQ ID NO: 5579450 - DNA, 21 bp, Homo sapiens
caaggggcccacaaaggggag

SEQ ID NO: 5579451 - DNA, 12 bp, Homo sapiens
caaggggcccag

SEQ ID NO: 5579452 - DNA, 21 bp, Homo sapiens
caaggggcccagtgctggcca

SEQ ID NO: 5579453 - DNA, 22 bp, Homo sapiens
caaggggcccttggagcgtgga

SEQ ID NO: 5579454 - DNA, 18 bp, Homo sapiens
caaggggcctccaacctt

SEQ ID NO: 5579455 - DNA, 19 bp, Homo sapiens
caaggggcctccaaccttc

SEQ ID NO: 5579456 - DNA, 22 bp, Homo sapiens
caaggggcctccaaccttctgc

SEQ ID NO: 5579457 - DNA, 18 bp, Homo sapiens
caagtgatattgtcttca

SEQ ID NO: 5579458 - DNA, 21 bp, Homo sapiens
caagtgatcctcacgccttgg

SEQ ID NO: 5579459 - DNA, 22 bp, Homo sapiens
caagtgatccttccacctcagt

SEQ ID NO: 5579460 - DNA, 16 bp, Homo sapiens
caagtgatctttcaat

SEQ ID NO: 5579461 - DNA, 20 bp, Homo sapiens
caagtgattctcatgcctca

SEQ ID NO: 5579462 - DNA, 22 bp, Homo sapiens
caagtgattctcatgcctcagc

SEQ ID NO: 5579463 - DNA, 16 bp, Homo sapiens
caagtgattctcctgc

SEQ ID NO: 5579464 - DNA, 17 bp, Homo sapiens
caagtgattctcctgcc

SEQ ID NO: 5579465 - DNA, 19 bp, Homo sapiens
caagtgattctcctgcctc

SEQ ID NO: 5579466 - DNA, 22 bp, Homo sapiens
caagtgattctcctgcctcagc

SEQ ID NO: 5579467 - DNA, 12 bp, Homo sapiens
caagtgcaagga

SEQ ID NO: 5579468 - DNA, 22 bp, Homo sapiens
caagtgcaatatgggcgggcag

SEQ ID NO: 5579469 - DNA, 16 bp, Homo sapiens
caagtgcaatgccccc

SEQ ID NO: 5579470 - DNA, 22 bp, Homo sapiens
caagtgcaatgccccctcccct

SEQ ID NO: 5579471 - DNA, 23 bp, Homo sapiens
caagtgcaggcgactggaggcag

SEQ ID NO: 5579472 - DNA, 17 bp, Homo sapiens
caagtgcatttctgggc

SEQ ID NO: 5579473 - DNA, 18 bp, Homo sapiens
caagtgccaagacacagc

SEQ ID NO: 5579474 - DNA, 23 bp, Homo sapiens
caagtgccactgcccgagctggt

SEQ ID NO: 5579475 - DNA, 21 bp, Homo sapiens
caagtgccagaggtgggcagg

SEQ ID NO: 5579476 - DNA, 20 bp, Homo sapiens
caagtgccagggctgggccc

SEQ ID NO: 5579477 - DNA, 13 bp, Homo sapiens
caagtgccatccc

SEQ ID NO: 5579478 - DNA, 14 bp, Homo sapiens
caagtgccatccca

SEQ ID NO: 5579479 - DNA, 17 bp, Homo sapiens
caagtgccattcatcct

SEQ ID NO: 5579480 - DNA, 15 bp, Homo sapiens
caagtgcccagtgga

SEQ ID NO: 5579481 - DNA, 15 bp, Homo sapiens
caagtgccccctcac

SEQ ID NO: 5579482 - DNA, 16 bp, Homo sapiens
caagtgccccctcacc

SEQ ID NO: 5579483 - DNA, 15 bp, Homo sapiens
caagtgcccgccctg

SEQ ID NO: 5579484 - DNA, 17 bp, Homo sapiens
caagtgcccgccctgcc

SEQ ID NO: 5579485 - DNA, 20 bp, Homo sapiens
caagtgcccgccctgcccct

SEQ ID NO: 5579486 - DNA, 21 bp, Homo sapiens
caagtgcccgccctgcccctg

SEQ ID NO: 5579487 - DNA, 16 bp, Homo sapiens
caagtgccgcaaattg

SEQ ID NO: 5579488 - DNA, 17 bp, Homo sapiens
caagtgccgcaaattgt

SEQ ID NO: 5579489 - DNA, 12 bp, Homo sapiens
caagtgcctaga

SEQ ID NO: 5579490 - DNA, 15 bp, Homo sapiens
caagtgcctagactg

SEQ ID NO: 5579491 - DNA, 21 bp, Homo sapiens
caagtgcctagactgttactt

SEQ ID NO: 5579492 - DNA, 11 bp, Homo sapiens
caagtgcctca

SEQ ID NO: 5579493 - DNA, 16 bp, Homo sapiens
caagtgcctcacctcg

SEQ ID NO: 5579494 - DNA, 14 bp, Homo sapiens
caagtgcctgcacc

SEQ ID NO: 5579495 - DNA, 15 bp, Homo sapiens
caagtgcctgcacca

SEQ ID NO: 5579496 - DNA, 14 bp, Homo sapiens
caagtgcctgctta

SEQ ID NO: 5579497 - DNA, 16 bp, Homo sapiens
caagtgcctgctttta

SEQ ID NO: 5579498 - DNA, 17 bp, Homo sapiens
caagtgccttgagctgc

SEQ ID NO: 5579499 - DNA, 16 bp, Homo sapiens
caagtgctcagggaaa

SEQ ID NO: 5579500 - DNA, 18 bp, Homo sapiens
caagtgctgaacagtgga

SEQ ID NO: 5579501 - DNA, 21 bp, Homo sapiens
caagtgctgcacaaaagcaga

SEQ ID NO: 5579502 - DNA, 20 bp, Homo sapiens
caagtgctggagtctcctga

SEQ ID NO: 5579503 - DNA, 18 bp, Homo sapiens
caagtgctgtttgggcag

SEQ ID NO: 5579504 - DNA, 19 bp, Homo sapiens
caagtgctgtttgggcagg

SEQ ID NO: 5579505 - DNA, 19 bp, Homo sapiens
caagtgcttcctacaaaga

SEQ ID NO: 5579506 - DNA, 19 bp, Homo sapiens
caagtggaccttgagacca

SEQ ID NO: 5579507 - DNA, 16 bp, Homo sapiens
caagtggactcagggc

SEQ ID NO: 5579508 - DNA, 18 bp, Homo sapiens
caagtggactcagggcag

SEQ ID NO: 5579509 - DNA, 21 bp, Homo sapiens
caagtggagcctgacagccag

SEQ ID NO: 5579510 - DNA, 21 bp, Homo sapiens
caagtggagctgtctgtctct

SEQ ID NO: 5579511 - DNA, 14 bp, Homo sapiens
caagtggatatttt

SEQ ID NO: 5579512 - DNA, 15 bp, Homo sapiens
caagtggatggccca

SEQ ID NO: 5579513 - DNA, 22 bp, Homo sapiens
caagtggatgggaatttgtcag

SEQ ID NO: 5579514 - DNA, 14 bp, Homo sapiens
caagtggatgtttt

SEQ ID NO: 5579515 - DNA, 20 bp, Homo sapiens
caagtggatgtttttaatga

SEQ ID NO: 5579516 - DNA, 20 bp, Homo sapiens
caagtggcaaagctgttctt

SEQ ID NO: 5579517 - DNA, 23 bp, Homo sapiens
caagtggcagagcttggactgga

SEQ ID NO: 5579518 - DNA, 22 bp, Homo sapiens
caagtggcagtttttaaaattg

SEQ ID NO: 5579519 - DNA, 18 bp, Homo sapiens
caagtggcataaagcata

SEQ ID NO: 5579520 - DNA, 19 bp, Homo sapiens
caagtggcatgtgctgtga

SEQ ID NO: 5579521 - DNA, 19 bp, Homo sapiens
caagtggctcccacaccct

SEQ ID NO: 5579522 - DNA, 23 bp, Homo sapiens
caagtgggagagcccgtgggggc

SEQ ID NO: 5579523 - DNA, 19 bp, Homo sapiens
caagtgggcagtcaccacc

SEQ ID NO: 5579524 - DNA, 20 bp, Homo sapiens
caagtgggcagtcaccaccc

SEQ ID NO: 5579525 - DNA, 21 bp, Homo sapiens
caagtgggcagtcaccaccca

SEQ ID NO: 5579526 - DNA, 20 bp, Homo sapiens
caagtggggcctccttgtcc

SEQ ID NO: 5579527 - DNA, 16 bp, Homo sapiens
caagtggggctcgcca

SEQ ID NO: 5579528 - DNA, 21 bp, Homo sapiens
caagtggggctcgccatgccg

SEQ ID NO: 5579529 - DNA, 19 bp, Homo sapiens
caagtgggtacccccagga

SEQ ID NO: 5579530 - DNA, 20 bp, Homo sapiens
caagtggtaatttttgtaca

SEQ ID NO: 5579531 - DNA, 14 bp, Homo sapiens
caagtggtcaggag

SEQ ID NO: 5579532 - DNA, 17 bp, Homo sapiens
caagtggtccacaagct

SEQ ID NO: 5579533 - DNA, 13 bp, Homo sapiens
caagtggtccagc

SEQ ID NO: 5579534 - DNA, 18 bp, Homo sapiens
caagtggtggtaaccctg

SEQ ID NO: 5579535 - DNA, 19 bp, Homo sapiens
caagtggtggtaaccctgg

SEQ ID NO: 5579536 - DNA, 22 bp, Homo sapiens
caagtggtggtaaccctggtgg

SEQ ID NO: 5579537 - DNA, 20 bp, Homo sapiens
caagtggtgtttattgcaat

SEQ ID NO: 5579538 - DNA, 22 bp, Homo sapiens
caagtggttaagaatgtatatc

SEQ ID NO: 5579539 - DNA, 19 bp, Homo sapiens
caagtggttctccttcctc

SEQ ID NO: 5579540 - DNA, 15 bp, Homo sapiens
caagtggttgtttta

SEQ ID NO: 5579541 - DNA, 23 bp, Homo sapiens
caagtggtttgggccccattcag

SEQ ID NO: 5579542 - DNA, 16 bp, Homo sapiens
caagtgtaaaatattt

SEQ ID NO: 5579543 - DNA, 21 bp, Homo sapiens
caagtgtaataaatcaaaatt

SEQ ID NO: 5579544 - DNA, 12 bp, Homo sapiens
caagtgtaatga

SEQ ID NO: 5579545 - DNA, 13 bp, Homo sapiens
caagtgtaattag

SEQ ID NO: 5579546 - DNA, 23 bp, Homo sapiens
caagtgtaattagcttttggaga

SEQ ID NO: 5579547 - DNA, 12 bp, Homo sapiens
caagtgtacagt

SEQ ID NO: 5579548 - DNA, 14 bp, Homo sapiens
caagtgtacagtat

SEQ ID NO: 5579549 - DNA, 21 bp, Homo sapiens
caagtgtagatgtagcattgt

SEQ ID NO: 5579550 - DNA, 22 bp, Homo sapiens
caagtgtagatgtagcattgtt

SEQ ID NO: 5579551 - DNA, 11 bp, Homo sapiens
caagtgtataa

SEQ ID NO: 5579552 - DNA, 14 bp, Homo sapiens
caagtgtataatgt

SEQ ID NO: 5579553 - DNA, 16 bp, Homo sapiens
caagtgtataatgttg

SEQ ID NO: 5579554 - DNA, 22 bp, Homo sapiens
caagtgtataatgttggtgtgg

SEQ ID NO: 5579555 - DNA, 22 bp, Homo sapiens
caagtgtatatttgtatcacac

SEQ ID NO: 5579556 - DNA, 22 bp, Homo sapiens
caagtgtatgcacgtgtgcaca

SEQ ID NO: 5579557 - DNA, 17 bp, Homo sapiens
caagtgtattttaaaat

SEQ ID NO: 5579558 - DNA, 19 bp, Homo sapiens
caagtgtcacctccttccc

SEQ ID NO: 5579559 - DNA, 15 bp, Homo sapiens
caagtgtcctggacc

SEQ ID NO: 5579560 - DNA, 22 bp, Homo sapiens
caagtgtcctggaccctggcct

SEQ ID NO: 5579561 - DNA, 17 bp, Homo sapiens
caagtgtctcagtccac

SEQ ID NO: 5579562 - DNA, 20 bp, Homo sapiens
caagtgtctcagtccacctg

SEQ ID NO: 5579563 - DNA, 22 bp, Homo sapiens
caagtgtctcttgactggctca

SEQ ID NO: 5579564 - DNA, 14 bp, Homo sapiens
caagtgtgaacaaa

SEQ ID NO: 5579565 - DNA, 15 bp, Homo sapiens
caagtgtgaatactg

SEQ ID NO: 5579566 - DNA, 20 bp, Homo sapiens
caagtgtgcatggctgggga

SEQ ID NO: 5579567 - DNA, 13 bp, Homo sapiens
caagtgtgcctgc

SEQ ID NO: 5579568 - DNA, 23 bp, Homo sapiens
caagtgtggaattggagaaaagc

SEQ ID NO: 5579569 - DNA, 23 bp, Homo sapiens
caagtgtggagagggcagggtcc

SEQ ID NO: 5579570 - DNA, 15 bp, Homo sapiens
caagtgtggaggaga

SEQ ID NO: 5579571 - DNA, 21 bp, Homo sapiens
caagtgtgggccactgtggtg

SEQ ID NO: 5579572 - DNA, 18 bp, Homo sapiens
caagtgtggggggtcctt

SEQ ID NO: 5579573 - DNA, 11 bp, Homo sapiens
caagtgtgtgc

SEQ ID NO: 5579574 - DNA, 19 bp, Homo sapiens
caagtgtgtgcacatgtgt

SEQ ID NO: 5579575 - DNA, 20 bp, Homo sapiens
caagtgtgtgcacatgtgtg

SEQ ID NO: 5579576 - DNA, 20 bp, Homo sapiens
caagtgtgtgcatgtgtgcg

SEQ ID NO: 5579577 - DNA, 19 bp, Homo sapiens
caagtgtgtgtgcaatgtt

SEQ ID NO: 5579578 - DNA, 18 bp, Homo sapiens
caagtgttaggtcaataa

SEQ ID NO: 5579579 - DNA, 16 bp, Homo sapiens
caagtgttcactgctc

SEQ ID NO: 5579580 - DNA, 19 bp, Homo sapiens
caagtgttctaaaatgaaa

SEQ ID NO: 5579581 - DNA, 23 bp, Homo sapiens
caagtgttcttaggtttactgtg

SEQ ID NO: 5579582 - DNA, 22 bp, Homo sapiens
caagtgtttattaaaatactgt

SEQ ID NO: 5579583 - DNA, 21 bp, Homo sapiens
caagtgtttctagtaacagta

SEQ ID NO: 5579584 - DNA, 15 bp, Homo sapiens
caagtgtttcttgtt

SEQ ID NO: 5579585 - DNA, 17 bp, Homo sapiens
caagtgttttagatgtt

SEQ ID NO: 5579586 - DNA, 14 bp, Homo sapiens
caagtgttttggag

SEQ ID NO: 5579587 - DNA, 17 bp, Homo sapiens
caagtgttttggagaaa

SEQ ID NO: 5579588 - DNA, 18 bp, Homo sapiens
caagttaaagtgaataac

SEQ ID NO: 5579589 - DNA, 12 bp, Homo sapiens
caagttaaatgt

SEQ ID NO: 5579590 - DNA, 13 bp, Homo sapiens
caagttaagagaa

SEQ ID NO: 5579591 - DNA, 14 bp, Homo sapiens
caagttaaggcttc

SEQ ID NO: 5579592 - DNA, 19 bp, Homo sapiens
caagttaatgtactttcat

SEQ ID NO: 5579593 - DNA, 16 bp, Homo sapiens
caagttagaaaacata

SEQ ID NO: 5579594 - DNA, 13 bp, Homo sapiens
caagttagctcag

SEQ ID NO: 5579595 - DNA, 14 bp, Homo sapiens
caagttagctcagg

SEQ ID NO: 5579596 - DNA, 16 bp, Homo sapiens
caagttagctcaggag

SEQ ID NO: 5579597 - DNA, 17 bp, Homo sapiens
caagttagctcaggagg

SEQ ID NO: 5579598 - DNA, 16 bp, Homo sapiens
caagttagggtctatg

SEQ ID NO: 5579599 - DNA, 19 bp, Homo sapiens
caagttaggtatgtttgca

SEQ ID NO: 5579600 - DNA, 17 bp, Homo sapiens
caagttagttcaatcct

SEQ ID NO: 5579601 - DNA, 20 bp, Homo sapiens
caagttataaatcaatgtca

SEQ ID NO: 5579602 - DNA, 15 bp, Homo sapiens
caagttataggaaag

SEQ ID NO: 5579603 - DNA, 19 bp, Homo sapiens
caagttataggaaaggaag

SEQ ID NO: 5579604 - DNA, 17 bp, Homo sapiens
caagttatattgaatat

SEQ ID NO: 5579605 - DNA, 19 bp, Homo sapiens
caagttatattgaatatat

SEQ ID NO: 5579606 - DNA, 14 bp, Homo sapiens
caagttatctttcc

SEQ ID NO: 5579607 - DNA, 15 bp, Homo sapiens
caagttattaatttc

SEQ ID NO: 5579608 - DNA, 16 bp, Homo sapiens
caagttattcagaaat

SEQ ID NO: 5579609 - DNA, 20 bp, Homo sapiens
caagttattttatttgctta

SEQ ID NO: 5579610 - DNA, 14 bp, Homo sapiens
caagttatttttct

SEQ ID NO: 5579611 - DNA, 17 bp, Homo sapiens
caagttcaagactgaaa

SEQ ID NO: 5579612 - DNA, 23 bp, Homo sapiens
caagttcacacctgcagattcta

SEQ ID NO: 5579613 - DNA, 14 bp, Homo sapiens
caagttcagccacc

SEQ ID NO: 5579614 - DNA, 15 bp, Homo sapiens
caagttcagccaccg

SEQ ID NO: 5579615 - DNA, 21 bp, Homo sapiens
caagttcagggaagcaggcag

SEQ ID NO: 5579616 - DNA, 15 bp, Homo sapiens
caagttccagctggt

SEQ ID NO: 5579617 - DNA, 21 bp, Homo sapiens
caagttccatgcttgagcaat

SEQ ID NO: 5579618 - DNA, 23 bp, Homo sapiens
caagttccccatccctgtcattt

SEQ ID NO: 5579619 - DNA, 17 bp, Homo sapiens
caagttccctggagaaa

SEQ ID NO: 5579620 - DNA, 17 bp, Homo sapiens
caagttccgtctcctct

SEQ ID NO: 5579621 - DNA, 16 bp, Homo sapiens
caagttcctgcactcc

SEQ ID NO: 5579622 - DNA, 21 bp, Homo sapiens
caagttccttggccatgcaga

SEQ ID NO: 5579623 - DNA, 12 bp, Homo sapiens
caagttctaaga

SEQ ID NO: 5579624 - DNA, 13 bp, Homo sapiens
caagttctaagat

SEQ ID NO: 5579625 - DNA, 14 bp, Homo sapiens
caagttctaagatt

SEQ ID NO: 5579626 - DNA, 18 bp, Homo sapiens
caagttctaagattctaa

SEQ ID NO: 5579627 - DNA, 13 bp, Homo sapiens
caagttctagaga

SEQ ID NO: 5579628 - DNA, 18 bp, Homo sapiens
caagttctagagaagagg

SEQ ID NO: 5579629 - DNA, 16 bp, Homo sapiens
caagttctaggccccc

SEQ ID NO: 5579630 - DNA, 17 bp, Homo sapiens
caagttctaggcccccc

SEQ ID NO: 5579631 - DNA, 16 bp, Homo sapiens
caagttctatttcttg

SEQ ID NO: 5579632 - DNA, 16 bp, Homo sapiens
caagttcttcacctct

SEQ ID NO: 5579633 - DNA, 21 bp, Homo sapiens
caatatacaactgtaaagcaa

SEQ ID NO: 5579634 - DNA, 23 bp, Homo sapiens
caatatacaactgtaaagcaaat

SEQ ID NO: 5579635 - DNA, 14 bp, Homo sapiens
caatatacttcact

SEQ ID NO: 5579636 - DNA, 14 bp, Homo sapiens
caatatagaaacac

SEQ ID NO: 5579637 - DNA, 19 bp, Homo sapiens
caatatagaaacacgaact

SEQ ID NO: 5579638 - DNA, 12 bp, Homo sapiens
caatatagcaag

SEQ ID NO: 5579639 - DNA, 18 bp, Homo sapiens
caatatataataaatggg

SEQ ID NO: 5579640 - DNA, 22 bp, Homo sapiens
caatatatagtgggtacatcaa

SEQ ID NO: 5579641 - DNA, 21 bp, Homo sapiens
caatatatagttagctttatt

SEQ ID NO: 5579642 - DNA, 21 bp, Homo sapiens
caatatatattatatatatct

SEQ ID NO: 5579643 - DNA, 22 bp, Homo sapiens
caatatatctaaattgaataat

SEQ ID NO: 5579644 - DNA, 16 bp, Homo sapiens
caatatatgatatata

SEQ ID NO: 5579645 - DNA, 22 bp, Homo sapiens
caatatatgatatataaacctt

SEQ ID NO: 5579646 - DNA, 22 bp, Homo sapiens
caatatatgtaaattataagta

SEQ ID NO: 5579647 - DNA, 12 bp, Homo sapiens
caatatatgtat

SEQ ID NO: 5579648 - DNA, 18 bp, Homo sapiens
caatatatttttactgct

SEQ ID NO: 5579649 - DNA, 20 bp, Homo sapiens
caatatcagttattttttga

SEQ ID NO: 5579650 - DNA, 15 bp, Homo sapiens
caatatcatattcta

SEQ ID NO: 5579651 - DNA, 20 bp, Homo sapiens
caatatcatgtcttgtgcat

SEQ ID NO: 5579652 - DNA, 13 bp, Homo sapiens
caatatcatgtga

SEQ ID NO: 5579653 - DNA, 13 bp, Homo sapiens
caatatcatgtgt

SEQ ID NO: 5579654 - DNA, 13 bp, Homo sapiens
caatatcattact

SEQ ID NO: 5579655 - DNA, 15 bp, Homo sapiens
caatatcattactaa

SEQ ID NO: 5579656 - DNA, 21 bp, Homo sapiens
caatatcattactaacttctt

SEQ ID NO: 5579657 - DNA, 21 bp, Homo sapiens
caatatcattttcctgggagt

SEQ ID NO: 5579658 - DNA, 17 bp, Homo sapiens
caatatccaattttaaa

SEQ ID NO: 5579659 - DNA, 17 bp, Homo sapiens
caatatccattctgtag

SEQ ID NO: 5579660 - DNA, 13 bp, Homo sapiens
caatatcccaaca

SEQ ID NO: 5579661 - DNA, 15 bp, Homo sapiens
caatatcccaacatt

SEQ ID NO: 5579662 - DNA, 20 bp, Homo sapiens
caatatcccaacattctgca

SEQ ID NO: 5579663 - DNA, 19 bp, Homo sapiens
caatatccctcttgtaagt

SEQ ID NO: 5579664 - DNA, 12 bp, Homo sapiens
caatatcctaat

SEQ ID NO: 5579665 - DNA, 15 bp, Homo sapiens
caatatcctaataaa

SEQ ID NO: 5579666 - DNA, 18 bp, Homo sapiens
caatatcctaataaaaag

SEQ ID NO: 5579667 - DNA, 14 bp, Homo sapiens
caatatcctcgctc

SEQ ID NO: 5579668 - DNA, 13 bp, Homo sapiens
caatatcctttgc

SEQ ID NO: 5579669 - DNA, 15 bp, Homo sapiens
caatatcctttgcct

SEQ ID NO: 5579670 - DNA, 17 bp, Homo sapiens
caatatcgtacctgtcc

SEQ ID NO: 5579671 - DNA, 17 bp, Homo sapiens
caatatctaatatatat

SEQ ID NO: 5579672 - DNA, 13 bp, Homo sapiens
caatatctgcagc

SEQ ID NO: 5579673 - DNA, 15 bp, Homo sapiens
caatatcttgcttga

SEQ ID NO: 5579674 - DNA, 16 bp, Homo sapiens
caatatcttgcttgaa

SEQ ID NO: 5579675 - DNA, 12 bp, Homo sapiens
caatatctttaa

SEQ ID NO: 5579676 - DNA, 14 bp, Homo sapiens
caatatgaaaagga

SEQ ID NO: 5579677 - DNA, 19 bp, Homo sapiens
caatatgaaggactattaa

SEQ ID NO: 5579678 - DNA, 23 bp, Homo sapiens
caatatgaagttactttcttaat

SEQ ID NO: 5579679 - DNA, 20 bp, Homo sapiens
caatatgaattaggtgtact

SEQ ID NO: 5579680 - DNA, 22 bp, Homo sapiens
caatatgaggggactgcatgca

SEQ ID NO: 5579681 - DNA, 18 bp, Homo sapiens
caatatgattttaaattt

SEQ ID NO: 5579682 - DNA, 14 bp, Homo sapiens
caatatgcaagcag

SEQ ID NO: 5579683 - DNA, 15 bp, Homo sapiens
caatatgcaagcagc

SEQ ID NO: 5579684 - DNA, 19 bp, Homo sapiens
caatatgcaagcagctttt

SEQ ID NO: 5579685 - DNA, 11 bp, Homo sapiens
caatatgctta

SEQ ID NO: 5579686 - DNA, 12 bp, Homo sapiens
caatatgcttac

SEQ ID NO: 5579687 - DNA, 20 bp, Homo sapiens
caatatgcttattctatcca

SEQ ID NO: 5579688 - DNA, 18 bp, Homo sapiens
caatatggacatgtaaaa

SEQ ID NO: 5579689 - DNA, 21 bp, Homo sapiens
caatatggacatgtaaaaaga

SEQ ID NO: 5579690 - DNA, 12 bp, Homo sapiens
caatatggagaa

SEQ ID NO: 5579691 - DNA, 13 bp, Homo sapiens
caatatgggagga

SEQ ID NO: 5579692 - DNA, 21 bp, Homo sapiens
caatatgggaggaacaaagac

SEQ ID NO: 5579693 - DNA, 18 bp, Homo sapiens
caatatgggcgggcagtc

SEQ ID NO: 5579694 - DNA, 14 bp, Homo sapiens
caatatgtatatat

SEQ ID NO: 5579695 - DNA, 17 bp, Homo sapiens
caatatgtatatatgta

SEQ ID NO: 5579696 - DNA, 23 bp, Homo sapiens
caatatgtatatatgtatttcta

SEQ ID NO: 5579697 - DNA, 12 bp, Homo sapiens
caatatgtatgc

SEQ ID NO: 5579698 - DNA, 17 bp, Homo sapiens
caatatgtatgcttttt

SEQ ID NO: 5579699 - DNA, 21 bp, Homo sapiens
caatatgtatgctttttacct

SEQ ID NO: 5579700 - DNA, 16 bp, Homo sapiens
caatatgtattaatat

SEQ ID NO: 5579701 - DNA, 13 bp, Homo sapiens
caatatgtattgt

SEQ ID NO: 5579702 - DNA, 22 bp, Homo sapiens
caatatgtgagtgccttttgca

SEQ ID NO: 5579703 - DNA, 12 bp, Homo sapiens
caatatgtgcca

SEQ ID NO: 5579704 - DNA, 22 bp, Homo sapiens
caatattaaatacagacactaa

SEQ ID NO: 5579705 - DNA, 22 bp, Homo sapiens
caatattaacacgctgcctggt

SEQ ID NO: 5579706 - DNA, 17 bp, Homo sapiens
caatattaatgccttta

SEQ ID NO: 5579707 - DNA, 17 bp, Homo sapiens
caatattaccatcttaa

SEQ ID NO: 5579708 - DNA, 23 bp, Homo sapiens
caatattaccttaagatttttct

SEQ ID NO: 5579709 - DNA, 15 bp, Homo sapiens
caatattactttgtc

SEQ ID NO: 5579710 - DNA, 22 bp, Homo sapiens
caatattactttgtcttttcaa

SEQ ID NO: 5579711 - DNA, 23 bp, Homo sapiens
caatattactttgtcttttcaat

SEQ ID NO: 5579712 - DNA, 14 bp, Homo sapiens
caatattatactaa

SEQ ID NO: 5579713 - DNA, 22 bp, Homo sapiens
caatattatactaagaaaagat

SEQ ID NO: 5579714 - DNA, 20 bp, Homo sapiens
caatattatgaaatttcact

SEQ ID NO: 5579715 - DNA, 13 bp, Homo sapiens
caatattcaaatg

SEQ ID NO: 5579716 - DNA, 15 bp, Homo sapiens
caatattcaaatgcg

SEQ ID NO: 5579717 - DNA, 16 bp, Homo sapiens
caatattcaataaagc

SEQ ID NO: 5579718 - DNA, 19 bp, Homo sapiens
caatattcaatcaaaattt

SEQ ID NO: 5579719 - DNA, 19 bp, Homo sapiens
caatattccagatctttca

SEQ ID NO: 5579720 - DNA, 13 bp, Homo sapiens
caatattcctgaa

SEQ ID NO: 5579721 - DNA, 13 bp, Homo sapiens
caatattccttag

SEQ ID NO: 5579722 - DNA, 19 bp, Homo sapiens
caatattctctgtacatat

SEQ ID NO: 5579723 - DNA, 22 bp, Homo sapiens
caatattctctgtacatattag

SEQ ID NO: 5579724 - DNA, 15 bp, Homo sapiens
caatattgaactttt

SEQ ID NO: 5579725 - DNA, 14 bp, Homo sapiens
caatattgaatttt

SEQ ID NO: 5579726 - DNA, 17 bp, Homo sapiens
caatattgactttgtct

SEQ ID NO: 5579727 - DNA, 21 bp, Homo sapiens
caatattgattgggaaaacat

SEQ ID NO: 5579728 - DNA, 14 bp, Homo sapiens
caatattgtacagt

SEQ ID NO: 5579729 - DNA, 17 bp, Homo sapiens
caatattgtacagtttt

SEQ ID NO: 5579730 - DNA, 14 bp, Homo sapiens
caatattgtatatt

SEQ ID NO: 5579731 - DNA, 9 bp, Homo sapiens
caatattta

SEQ ID NO: 5579732 - DNA, 15 bp, Homo sapiens
caatatttaaggaga

SEQ ID NO: 5579733 - DNA, 18 bp, Homo sapiens
caatatttaatcttttat

SEQ ID NO: 5579734 - DNA, 15 bp, Homo sapiens
caatatttagaaaat

SEQ ID NO: 5579735 - DNA, 18 bp, Homo sapiens
caatatttagaaaatttt

SEQ ID NO: 5579736 - DNA, 21 bp, Homo sapiens
caatatttagaaaattttgta

SEQ ID NO: 5579737 - DNA, 14 bp, Homo sapiens
caatatttagtaaa

SEQ ID NO: 5579738 - DNA, 12 bp, Homo sapiens
caatatttataa

SEQ ID NO: 5579739 - DNA, 17 bp, Homo sapiens
caatatttataaagaat

SEQ ID NO: 5579740 - DNA, 16 bp, Homo sapiens
caatatttataattaa

SEQ ID NO: 5579741 - DNA, 12 bp, Homo sapiens
caatatttatta

SEQ ID NO: 5579742 - DNA, 17 bp, Homo sapiens
caatatttattacacaa

SEQ ID NO: 5579743 - DNA, 14 bp, Homo sapiens
caatatttattatt

SEQ ID NO: 5579744 - DNA, 19 bp, Homo sapiens
caatatttattattttcac

SEQ ID NO: 5579745 - DNA, 17 bp, Homo sapiens
caatatttatttccaga

SEQ ID NO: 5579746 - DNA, 17 bp, Homo sapiens
caatatttcctcatgtg

SEQ ID NO: 5579747 - DNA, 21 bp, Homo sapiens
caatatttctgctttctttga

SEQ ID NO: 5579748 - DNA, 15 bp, Homo sapiens
caatatttgaatttt

SEQ ID NO: 5579749 - DNA, 23 bp, Homo sapiens
caatatttgtggtttaactttgt

SEQ ID NO: 5579750 - DNA, 23 bp, Homo sapiens
caatatttgtgtgctaaacgtgt

SEQ ID NO: 5579751 - DNA, 23 bp, Homo sapiens
caatattttaagcattactcttg

SEQ ID NO: 5579752 - DNA, 24 bp, Homo sapiens
caatattttaataaagtagttatt

SEQ ID NO: 5579753 - DNA, 21 bp, Homo sapiens
caatattttatggttatgttt

SEQ ID NO: 5579754 - DNA, 23 bp, Homo sapiens
caatattttatggttatgttttt

SEQ ID NO: 5579755 - DNA, 13 bp, Homo sapiens
caatattttccat

SEQ ID NO: 5579756 - DNA, 16 bp, Homo sapiens
caatattttccatgaa

SEQ ID NO: 5579757 - DNA, 19 bp, Homo sapiens
caatattttctttaatgct

SEQ ID NO: 5579758 - DNA, 17 bp, Homo sapiens
caatattttcttttccc

SEQ ID NO: 5579759 - DNA, 22 bp, Homo sapiens
caatattttgtatattatgttt

SEQ ID NO: 5579760 - DNA, 20 bp, Homo sapiens
caatatttttatatcatgca

SEQ ID NO: 5579761 - DNA, 18 bp, Homo sapiens
caatcaaaatcacctccc

SEQ ID NO: 5579762 - DNA, 19 bp, Homo sapiens
caatcaaagaattacagta

SEQ ID NO: 5579763 - DNA, 13 bp, Homo sapiens
caatcaaagctac

SEQ ID NO: 5579764 - DNA, 14 bp, Homo sapiens
caatcaaagctacc

SEQ ID NO: 5579765 - DNA, 13 bp, Homo sapiens
caatcaaatatat

SEQ ID NO: 5579766 - DNA, 14 bp, Homo sapiens
caatcaaatctgct

SEQ ID NO: 5579767 - DNA, 19 bp, Homo sapiens
caatcaacagcatgtctac

SEQ ID NO: 5579768 - DNA, 15 bp, Homo sapiens
caatcaactctaata

SEQ ID NO: 5579769 - DNA, 16 bp, Homo sapiens
caatcaagagcttcca

SEQ ID NO: 5579770 - DNA, 17 bp, Homo sapiens
caatcaagagcttccag

SEQ ID NO: 5579771 - DNA, 18 bp, Homo sapiens
caatcaatacagcttcat

SEQ ID NO: 5579772 - DNA, 18 bp, Homo sapiens
caatcaatggtgcaaaaa

SEQ ID NO: 5579773 - DNA, 21 bp, Homo sapiens
caatcaatttaaatgtttact

SEQ ID NO: 5579774 - DNA, 15 bp, Homo sapiens
caatcaatttaaatt

SEQ ID NO: 5579775 - DNA, 23 bp, Homo sapiens
caatcacaaaagctgtgtctctg

SEQ ID NO: 5579776 - DNA, 17 bp, Homo sapiens
caatcacactacacatc

SEQ ID NO: 5579777 - DNA, 15 bp, Homo sapiens
caatcacagctcctc

SEQ ID NO: 5579778 - DNA, 22 bp, Homo sapiens
caatcacagtctcagttctctt

SEQ ID NO: 5579779 - DNA, 16 bp, Homo sapiens
caatcaccaccaggta

SEQ ID NO: 5579780 - DNA, 17 bp, Homo sapiens
caatcactaaactttat

SEQ ID NO: 5579781 - DNA, 18 bp, Homo sapiens
caatcactaaatatctag

SEQ ID NO: 5579782 - DNA, 23 bp, Homo sapiens
caatcactagtcaagaaaaatat

SEQ ID NO: 5579783 - DNA, 14 bp, Homo sapiens
caatcactattctt

SEQ ID NO: 5579784 - DNA, 16 bp, Homo sapiens
caatcactgaaaacta

SEQ ID NO: 5579785 - DNA, 23 bp, Homo sapiens
caatcactgaaacaaaaattgtc

SEQ ID NO: 5579786 - DNA, 15 bp, Homo sapiens
caatcactgtgctat

SEQ ID NO: 5579787 - DNA, 16 bp, Homo sapiens
caatcactttttggaa

SEQ ID NO: 5579788 - DNA, 15 bp, Homo sapiens
caatcagaagaaagg

SEQ ID NO: 5579789 - DNA, 15 bp, Homo sapiens
caatcagaatcatca

SEQ ID NO: 5579790 - DNA, 17 bp, Homo sapiens
caatcagagagcctaga

SEQ ID NO: 5579791 - DNA, 16 bp, Homo sapiens
caatcagattttcctg

SEQ ID NO: 5579792 - DNA, 22 bp, Homo sapiens
caatcagcaaacacaataagag

SEQ ID NO: 5579793 - DNA, 11 bp, Homo sapiens
caatcagctcc

SEQ ID NO: 5579794 - DNA, 12 bp, Homo sapiens
caatcagctcct

SEQ ID NO: 5579795 - DNA, 19 bp, Homo sapiens
caatcaggtaagatcataa

SEQ ID NO: 5579796 - DNA, 21 bp, Homo sapiens
caatcagtagcttaagaaaaa

SEQ ID NO: 5579797 - DNA, 15 bp, Homo sapiens
caatcagtataattc

SEQ ID NO: 5579798 - DNA, 15 bp, Homo sapiens
caatcagtcccctcc

SEQ ID NO: 5579799 - DNA, 16 bp, Homo sapiens
caatcagtcccctccc

SEQ ID NO: 5579800 - DNA, 17 bp, Homo sapiens
caatcagtcccctccca

SEQ ID NO: 5579801 - DNA, 20 bp, Homo sapiens
caatcagtcccctcccatct

SEQ ID NO: 5579802 - DNA, 22 bp, Homo sapiens
caatcagtcccctcccatctgg

SEQ ID NO: 5579803 - DNA, 15 bp, Homo sapiens
caatcagtgtgaatg

SEQ ID NO: 5579804 - DNA, 22 bp, Homo sapiens
caatcagttgactttaagtgaa

SEQ ID NO: 5579805 - DNA, 23 bp, Homo sapiens
caatcataaagtgcacaccttta

SEQ ID NO: 5579806 - DNA, 14 bp, Homo sapiens
caatcatatgtgat

SEQ ID NO: 5579807 - DNA, 13 bp, Homo sapiens
caatcatctagat

SEQ ID NO: 5579808 - DNA, 15 bp, Homo sapiens
caatcatctgtgtga

SEQ ID NO: 5579809 - DNA, 17 bp, Homo sapiens
caatcatctgtgtgaaa

SEQ ID NO: 5579810 - DNA, 20 bp, Homo sapiens
caatcatctgtgtgaaaatg

SEQ ID NO: 5579811 - DNA, 16 bp, Homo sapiens
caatgctgtattttaa

SEQ ID NO: 5579812 - DNA, 14 bp, Homo sapiens
caatgcttatggaa

SEQ ID NO: 5579813 - DNA, 21 bp, Homo sapiens
caatgcttctgcatactgtgt

SEQ ID NO: 5579814 - DNA, 15 bp, Homo sapiens
caatgcttctgttga

SEQ ID NO: 5579815 - DNA, 13 bp, Homo sapiens
caatgcttctttt

SEQ ID NO: 5579816 - DNA, 23 bp, Homo sapiens
caatgcttcttttagtcagaaat

SEQ ID NO: 5579817 - DNA, 17 bp, Homo sapiens
caatgctttatttgtaa

SEQ ID NO: 5579818 - DNA, 21 bp, Homo sapiens
caatgctttgcccctgagaca

SEQ ID NO: 5579819 - DNA, 17 bp, Homo sapiens
caatgcttttaatgaat

SEQ ID NO: 5579820 - DNA, 18 bp, Homo sapiens
caatgcttttaatgaatt

SEQ ID NO: 5579821 - DNA, 19 bp, Homo sapiens
caatggaaaacctggggga

SEQ ID NO: 5579822 - DNA, 16 bp, Homo sapiens
caatggaaaatataat

SEQ ID NO: 5579823 - DNA, 17 bp, Homo sapiens
caatggaaacatcactg

SEQ ID NO: 5579824 - DNA, 13 bp, Homo sapiens
caatggaaactga

SEQ ID NO: 5579825 - DNA, 23 bp, Homo sapiens
caatggaaattcccgtgttgctt

SEQ ID NO: 5579826 - DNA, 18 bp, Homo sapiens
caatggaagaagaaagga

SEQ ID NO: 5579827 - DNA, 22 bp, Homo sapiens
caatggaccggagagtgggggt

SEQ ID NO: 5579828 - DNA, 13 bp, Homo sapiens
caatggagaaaat

SEQ ID NO: 5579829 - DNA, 15 bp, Homo sapiens
caatggagaaaatga

SEQ ID NO: 5579830 - DNA, 16 bp, Homo sapiens
caatggagaaaatgaa

SEQ ID NO: 5579831 - DNA, 14 bp, Homo sapiens
caatggagaatata

SEQ ID NO: 5579832 - DNA, 20 bp, Homo sapiens
caatggagactgtctcaaga

SEQ ID NO: 5579833 - DNA, 11 bp, Homo sapiens
caatggagtct

SEQ ID NO: 5579834 - DNA, 19 bp, Homo sapiens
caatggagtctgcagtgag

SEQ ID NO: 5579835 - DNA, 17 bp, Homo sapiens
caatggagttcagagat

SEQ ID NO: 5579836 - DNA, 19 bp, Homo sapiens
caatggattatacaaaaaa

SEQ ID NO: 5579837 - DNA, 19 bp, Homo sapiens
caatggcacctctgccctt

SEQ ID NO: 5579838 - DNA, 21 bp, Homo sapiens
caatggcacctctgcccttcc

SEQ ID NO: 5579839 - DNA, 11 bp, Homo sapiens
caatggcagcc

SEQ ID NO: 5579840 - DNA, 16 bp, Homo sapiens
caatggcagccttggc

SEQ ID NO: 5579841 - DNA, 13 bp, Homo sapiens
caatggcaggttt

SEQ ID NO: 5579842 - DNA, 17 bp, Homo sapiens
caatggcaggttttaca

SEQ ID NO: 5579843 - DNA, 20 bp, Homo sapiens
caatggccagagcctctggc

SEQ ID NO: 5579844 - DNA, 12 bp, Homo sapiens
caatggccagcc

SEQ ID NO: 5579845 - DNA, 20 bp, Homo sapiens
caatggccagcccagatggc

SEQ ID NO: 5579846 - DNA, 15 bp, Homo sapiens
caatggccaggggcc

SEQ ID NO: 5579847 - DNA, 18 bp, Homo sapiens
caatggccaggggccagg

SEQ ID NO: 5579848 - DNA, 19 bp, Homo sapiens
caatggcccgacatttctt

SEQ ID NO: 5579849 - DNA, 16 bp, Homo sapiens
caatggcgcagtgcct

SEQ ID NO: 5579850 - DNA, 21 bp, Homo sapiens
caatggcgcagtgcctctggt

SEQ ID NO: 5579851 - DNA, 23 bp, Homo sapiens
caatggcgcctgctccctccaga

SEQ ID NO: 5579852 - DNA, 19 bp, Homo sapiens
caatggctaattcccagag

SEQ ID NO: 5579853 - DNA, 22 bp, Homo sapiens
caatggctgctgaagctgcctg

SEQ ID NO: 5579854 - DNA, 21 bp, Homo sapiens
caatggctgggtttgggcagt

SEQ ID NO: 5579855 - DNA, 22 bp, Homo sapiens
caatggctgggtttgggcagtg

SEQ ID NO: 5579856 - DNA, 23 bp, Homo sapiens
caatgggaagcagacaataactt

SEQ ID NO: 5579857 - DNA, 18 bp, Homo sapiens
caatgggactggagtcag

SEQ ID NO: 5579858 - DNA, 20 bp, Homo sapiens
caatgggagcacatagccct

SEQ ID NO: 5579859 - DNA, 19 bp, Homo sapiens
caatgggagctgaggccac

SEQ ID NO: 5579860 - DNA, 17 bp, Homo sapiens
caatgggagggggctcc

SEQ ID NO: 5579861 - DNA, 23 bp, Homo sapiens
caatgggagggggctccatggag

SEQ ID NO: 5579862 - DNA, 20 bp, Homo sapiens
caatgggatgtatgaataca

SEQ ID NO: 5579863 - DNA, 21 bp, Homo sapiens
caatgggatgtatgaatacag

SEQ ID NO: 5579864 - DNA, 15 bp, Homo sapiens
caatgggcactggga

SEQ ID NO: 5579865 - DNA, 17 bp, Homo sapiens
caatgggcactgggatg

SEQ ID NO: 5579866 - DNA, 18 bp, Homo sapiens
caatgggccgtcccctct

SEQ ID NO: 5579867 - DNA, 19 bp, Homo sapiens
caatggggaattttttgat

SEQ ID NO: 5579868 - DNA, 20 bp, Homo sapiens
caatggggactttgttggta

SEQ ID NO: 5579869 - DNA, 11 bp, Homo sapiens
caatggggaga

SEQ ID NO: 5579870 - DNA, 16 bp, Homo sapiens
caatggggagaggcaa

SEQ ID NO: 5579871 - DNA, 19 bp, Homo sapiens
caatggggagaggcaaatg

SEQ ID NO: 5579872 - DNA, 22 bp, Homo sapiens
caatggggatgttgtgtttctg

SEQ ID NO: 5579873 - DNA, 15 bp, Homo sapiens
caatggggccagcac

SEQ ID NO: 5579874 - DNA, 19 bp, Homo sapiens
caatggggccagcactgga

SEQ ID NO: 5579875 - DNA, 17 bp, Homo sapiens
caatggggcggggcttc

SEQ ID NO: 5579876 - DNA, 19 bp, Homo sapiens
caatggggcggggcttctc

SEQ ID NO: 5579877 - DNA, 20 bp, Homo sapiens
caatggggcggggcttctct

SEQ ID NO: 5579878 - DNA, 22 bp, Homo sapiens
caatgggggggcggctgagctc

SEQ ID NO: 5579879 - DNA, 24 bp, Homo sapiens
caatgggggggcggctgagctcca

SEQ ID NO: 5579880 - DNA, 17 bp, Homo sapiens
caatggggggtcttgct

SEQ ID NO: 5579881 - DNA, 22 bp, Homo sapiens
caatgggtaaataaatgctgct

SEQ ID NO: 5579882 - DNA, 17 bp, Homo sapiens
caatgggtaaccattaa

SEQ ID NO: 5579883 - DNA, 20 bp, Homo sapiens
caatgggtaagggagggaag

SEQ ID NO: 5579884 - DNA, 23 bp, Homo sapiens
caatgggtttttccctgtacagt

SEQ ID NO: 5579885 - DNA, 23 bp, Homo sapiens
caatggtaaaatgagtgatctca

SEQ ID NO: 5579886 - DNA, 16 bp, Homo sapiens
caatggtaattataaa

SEQ ID NO: 5579887 - DNA, 15 bp, Homo sapiens
caatggtagctctga

SEQ ID NO: 5579888 - DNA, 14 bp, Homo sapiens
caatggtagtttct

SEQ ID NO: 5579889 - DNA, 15 bp, Homo sapiens
caatggtgagggctg

SEQ ID NO: 5579890 - DNA, 14 bp, Homo sapiens
caatggtgcaaaaa

SEQ ID NO: 5579891 - DNA, 15 bp, Homo sapiens
caatggtgcaaaaaa

SEQ ID NO: 5579892 - DNA, 19 bp, Homo sapiens
caatggtgcttggaggggg

SEQ ID NO: 5579893 - DNA, 17 bp, Homo sapiens
caatggtgttgccctga

SEQ ID NO: 5579894 - DNA, 21 bp, Homo sapiens
caatggttgggacaatggcaa

SEQ ID NO: 5579895 - DNA, 14 bp, Homo sapiens
caatggtttcaaag

SEQ ID NO: 5579896 - DNA, 18 bp, Homo sapiens
caatggtttcaaagaaag

SEQ ID NO: 5579897 - DNA, 13 bp, Homo sapiens
caatggtttgcaa

SEQ ID NO: 5579898 - DNA, 16 bp, Homo sapiens
caatggtttgcaagga

SEQ ID NO: 5579899 - DNA, 20 bp, Homo sapiens
caatggtttgcaaggaagcc

SEQ ID NO: 5579900 - DNA, 21 bp, Homo sapiens
caatggtttgtgtcaaaactg

SEQ ID NO: 5579901 - DNA, 11 bp, Homo sapiens
caatgtaaaaa

SEQ ID NO: 5579902 - DNA, 12 bp, Homo sapiens
caatgtaaaaat

SEQ ID NO: 5579903 - DNA, 20 bp, Homo sapiens
caatgtaaacacttaacaga

SEQ ID NO: 5579904 - DNA, 14 bp, Homo sapiens
caatgtaacactgg

SEQ ID NO: 5579905 - DNA, 18 bp, Homo sapiens
caatgtaacattaattct

SEQ ID NO: 5579906 - DNA, 13 bp, Homo sapiens
caatgtaattatt

SEQ ID NO: 5579907 - DNA, 13 bp, Homo sapiens
caatgtacaatta

SEQ ID NO: 5579908 - DNA, 21 bp, Homo sapiens
caatgtacaattatgtctctt

SEQ ID NO: 5579909 - DNA, 22 bp, Homo sapiens
caatgtacaattatgtctcttg

SEQ ID NO: 5579910 - DNA, 21 bp, Homo sapiens
caatgtaccatgttgcccaga

SEQ ID NO: 5579911 - DNA, 20 bp, Homo sapiens
caatgtactcttccgatgtt

SEQ ID NO: 5579912 - DNA, 19 bp, Homo sapiens
caatgtagaggggaaaaga

SEQ ID NO: 5579913 - DNA, 20 bp, Homo sapiens
caatgtagataagtgttctg

SEQ ID NO: 5579914 - DNA, 23 bp, Homo sapiens
caatgtagtcagaattagctgct

SEQ ID NO: 5579915 - DNA, 13 bp, Homo sapiens
caatgtataaaga

SEQ ID NO: 5579916 - DNA, 15 bp, Homo sapiens
caatgtataaagatt

SEQ ID NO: 5579917 - DNA, 22 bp, Homo sapiens
caatgtataaagattgtactta

SEQ ID NO: 5579918 - DNA, 19 bp, Homo sapiens
caatgtatacttcagtgct

SEQ ID NO: 5579919 - DNA, 23 bp, Homo sapiens
caatgtatcccttctcacagcac

SEQ ID NO: 5579920 - DNA, 16 bp, Homo sapiens
caatgtatgtaatttg

SEQ ID NO: 5579921 - DNA, 15 bp, Homo sapiens
caatgtatgtacaat

SEQ ID NO: 5579922 - DNA, 22 bp, Homo sapiens
caatgtatgtgaaagtgtaaaa

SEQ ID NO: 5579923 - DNA, 13 bp, Homo sapiens
caatgtatttagc

SEQ ID NO: 5579924 - DNA, 20 bp, Homo sapiens
caatgtatttatttaaaaga

SEQ ID NO: 5579925 - DNA, 21 bp, Homo sapiens
caatgtattttggaagacata

SEQ ID NO: 5579926 - DNA, 13 bp, Homo sapiens
caatgtcaagtgg

SEQ ID NO: 5579927 - DNA, 13 bp, Homo sapiens
caatgtcagcctt

SEQ ID NO: 5579928 - DNA, 21 bp, Homo sapiens
caatgtcaggaacagaaggat

SEQ ID NO: 5579929 - DNA, 20 bp, Homo sapiens
caatgtccacctgtgagaaa

SEQ ID NO: 5579930 - DNA, 12 bp, Homo sapiens
caatgtccaggt

SEQ ID NO: 5579931 - DNA, 20 bp, Homo sapiens
caatgtccaggtcacaggca

SEQ ID NO: 5579932 - DNA, 18 bp, Homo sapiens
caatgtccccctcacccc

SEQ ID NO: 5579933 - DNA, 15 bp, Homo sapiens
caatgtcctgaaaca

SEQ ID NO: 5579934 - DNA, 22 bp, Homo sapiens
caatgtcctgaaacatgaaccc

SEQ ID NO: 5579935 - DNA, 21 bp, Homo sapiens
caatgtcgagtatattattat

SEQ ID NO: 5579936 - DNA, 16 bp, Homo sapiens
caatgtctaaaaacat

SEQ ID NO: 5579937 - DNA, 16 bp, Homo sapiens
caatgtctgagtgaac

SEQ ID NO: 5579938 - DNA, 15 bp, Homo sapiens
caatgtctgcagccc

SEQ ID NO: 5579939 - DNA, 17 bp, Homo sapiens
caatgtctgcagccctg

SEQ ID NO: 5579940 - DNA, 15 bp, Homo sapiens
caatgtctggagacc

SEQ ID NO: 5579941 - DNA, 20 bp, Homo sapiens
caatgtctggagaccaccag

SEQ ID NO: 5579942 - DNA, 17 bp, Homo sapiens
caatgtctggggacagg

SEQ ID NO: 5579943 - DNA, 18 bp, Homo sapiens
caatgtcttaaataaaac

SEQ ID NO: 5579944 - DNA, 14 bp, Homo sapiens
caatgtcttcccac

SEQ ID NO: 5579945 - DNA, 16 bp, Homo sapiens
caatgtcttcttgaaa

SEQ ID NO: 5579946 - DNA, 21 bp, Homo sapiens
caatgtcttgatgcatgcact

SEQ ID NO: 5579947 - DNA, 23 bp, Homo sapiens
caatgtcttggtacttgctgcta

SEQ ID NO: 5579948 - DNA, 11 bp, Homo sapiens
caatgtgaaaa

SEQ ID NO: 5579949 - DNA, 12 bp, Homo sapiens
caatgtgaaaaa

SEQ ID NO: 5579950 - DNA, 13 bp, Homo sapiens
caatgtgaaactg

SEQ ID NO: 5579951 - DNA, 17 bp, Homo sapiens
caatgtgaaactgagac

SEQ ID NO: 5579952 - DNA, 17 bp, Homo sapiens
caatgtgaaagattatt

SEQ ID NO: 5579953 - DNA, 23 bp, Homo sapiens
caatgtgaaagattatttaaatg

SEQ ID NO: 5579954 - DNA, 18 bp, Homo sapiens
caatgtgaactttattaa

SEQ ID NO: 5579955 - DNA, 20 bp, Homo sapiens
caatgtgaataatggcactg

SEQ ID NO: 5579956 - DNA, 18 bp, Homo sapiens
caatgtgaatcagaccct

SEQ ID NO: 5579957 - DNA, 17 bp, Homo sapiens
caatgtgaccaggggtg

SEQ ID NO: 5579958 - DNA, 18 bp, Homo sapiens
caatgtgacctggggcag

SEQ ID NO: 5579959 - DNA, 14 bp, Homo sapiens
caatgtgagtccca

SEQ ID NO: 5579960 - DNA, 18 bp, Homo sapiens
caatgtgagtcccagagc

SEQ ID NO: 5579961 - DNA, 18 bp, Homo sapiens
caatgtgatataaacagc

SEQ ID NO: 5579962 - DNA, 19 bp, Homo sapiens
caatgtgatatgtgtaata

SEQ ID NO: 5579963 - DNA, 22 bp, Homo sapiens
caatgtgatctatgtttcatct

SEQ ID NO: 5579964 - DNA, 15 bp, Homo sapiens
caatgtgatggtcag

SEQ ID NO: 5579965 - DNA, 17 bp, Homo sapiens
caatgtgcccagtcatg

SEQ ID NO: 5579966 - DNA, 14 bp, Homo sapiens
caatgtgccttgat

SEQ ID NO: 5579967 - DNA, 16 bp, Homo sapiens
caatgtgccttgattg

SEQ ID NO: 5579968 - DNA, 12 bp, Homo sapiens
caatgtgctgtt

SEQ ID NO: 5579969 - DNA, 23 bp, Homo sapiens
caatgtgctgttgattctttcaa

SEQ ID NO: 5579970 - DNA, 22 bp, Homo sapiens
caatgtgcttccgagattcaga

SEQ ID NO: 5579971 - DNA, 18 bp, Homo sapiens
caatgtggaaaaaatatt

SEQ ID NO: 5579972 - DNA, 23 bp, Homo sapiens
caatgtggaaaaaatattttaaa

SEQ ID NO: 5579973 - DNA, 19 bp, Homo sapiens
caatgtggaattacataac

SEQ ID NO: 5579974 - DNA, 13 bp, Homo sapiens
caatgtggcaaga

SEQ ID NO: 5579975 - DNA, 21 bp, Homo sapiens
caatgtggcctaaaaatgcaa

SEQ ID NO: 5579976 - DNA, 17 bp, Homo sapiens
caatgtgggctgcccct

SEQ ID NO: 5579977 - DNA, 18 bp, Homo sapiens
caatgtggtgacacctcc

SEQ ID NO: 5579978 - DNA, 20 bp, Homo sapiens
caatgtggtgacacctcccc

SEQ ID NO: 5579979 - DNA, 21 bp, Homo sapiens
caatgtggtgacacctccccc

SEQ ID NO: 5579980 - DNA, 21 bp, Homo sapiens
caatgtggttgcaaggccgct

SEQ ID NO: 5579981 - DNA, 15 bp, Homo sapiens
caatgtgtataaaca

SEQ ID NO: 5579982 - DNA, 17 bp, Homo sapiens
caatgtgtataaacaag

SEQ ID NO: 5579983 - DNA, 18 bp, Homo sapiens
caatgtgtataaacaaga

SEQ ID NO: 5579984 - DNA, 20 bp, Homo sapiens
caatgtgtataaacaagaaa

SEQ ID NO: 5579985 - DNA, 23 bp, Homo sapiens
caatgtgtataaacaagaaaaat

SEQ ID NO: 5579986 - DNA, 16 bp, Homo sapiens
caatgtgtataaattg

SEQ ID NO: 5579987 - DNA, 13 bp, Homo sapiens
caattctcctgcc

SEQ ID NO: 5579988 - DNA, 14 bp, Homo sapiens
caattctcctgcct

SEQ ID NO: 5579989 - DNA, 21 bp, Homo sapiens
caattctcctgcctcagcctc

SEQ ID NO: 5579990 - DNA, 21 bp, Homo sapiens
caattctgaaggggaaaacct

SEQ ID NO: 5579991 - DNA, 13 bp, Homo sapiens
caattctgactgt

SEQ ID NO: 5579992 - DNA, 15 bp, Homo sapiens
caattctgactgtcc

SEQ ID NO: 5579993 - DNA, 18 bp, Homo sapiens
caattctgatacagcctt

SEQ ID NO: 5579994 - DNA, 12 bp, Homo sapiens
caattctgcatg

SEQ ID NO: 5579995 - DNA, 18 bp, Homo sapiens
caattctgccccacaccc

SEQ ID NO: 5579996 - DNA, 21 bp, Homo sapiens
caattctgccccacacccagc

SEQ ID NO: 5579997 - DNA, 14 bp, Homo sapiens
caattctgcccgct

SEQ ID NO: 5579998 - DNA, 22 bp, Homo sapiens
caattctgcccgctccatggaa

SEQ ID NO: 5579999 - DNA, 23 bp, Homo sapiens
caattctgcctgcctcctccctc

SEQ ID NO: 5580000 - DNA, 13 bp, Homo sapiens
caattctggaagc

SEQ ID NO: 5580001 - DNA, 18 bp, Homo sapiens
caattctgggagaatgaa

SEQ ID NO: 5580002 - DNA, 13 bp, Homo sapiens
caattctgggtgc

SEQ ID NO: 5580003 - DNA, 18 bp, Homo sapiens
caattctgtaattacata

SEQ ID NO: 5580004 - DNA, 19 bp, Homo sapiens
caattctgtaggttaaaaa

SEQ ID NO: 5580005 - DNA, 12 bp, Homo sapiens
caattctgtccc

SEQ ID NO: 5580006 - DNA, 14 bp, Homo sapiens
caattctgtccctg

SEQ ID NO: 5580007 - DNA, 17 bp, Homo sapiens
caattctgtccctgtcc

SEQ ID NO: 5580008 - DNA, 18 bp, Homo sapiens
caattctgtccctgtccc

SEQ ID NO: 5580009 - DNA, 10 bp, Homo sapiens
caattctgtg

SEQ ID NO: 5580010 - DNA, 22 bp, Homo sapiens
caattctgttttaggttaaaaa

SEQ ID NO: 5580011 - DNA, 18 bp, Homo sapiens
caattcttacaaacatgt

SEQ ID NO: 5580012 - DNA, 15 bp, Homo sapiens
caattcttcttctca

SEQ ID NO: 5580013 - DNA, 16 bp, Homo sapiens
caattcttgagaccca

SEQ ID NO: 5580014 - DNA, 15 bp, Homo sapiens
caattcttgccaaat

SEQ ID NO: 5580015 - DNA, 16 bp, Homo sapiens
caattcttgtaacttt

SEQ ID NO: 5580016 - DNA, 12 bp, Homo sapiens
caattctttata

SEQ ID NO: 5580017 - DNA, 23 bp, Homo sapiens
caattctttatacaacagtgcta

SEQ ID NO: 5580018 - DNA, 13 bp, Homo sapiens
caattctttcaag

SEQ ID NO: 5580019 - DNA, 17 bp, Homo sapiens
caattctttgttgctta

SEQ ID NO: 5580020 - DNA, 14 bp, Homo sapiens
caattcttttgaaa

SEQ ID NO: 5580021 - DNA, 16 bp, Homo sapiens
caattgaaaagtgttc

SEQ ID NO: 5580022 - DNA, 13 bp, Homo sapiens
caattgaaagctt

SEQ ID NO: 5580023 - DNA, 22 bp, Homo sapiens
caattgaaatttttaaatcatt

SEQ ID NO: 5580024 - DNA, 18 bp, Homo sapiens
caattgaacttaaataaa

SEQ ID NO: 5580025 - DNA, 12 bp, Homo sapiens
caattgaagcat

SEQ ID NO: 5580026 - DNA, 18 bp, Homo sapiens
caattgaagcatgaacgt

SEQ ID NO: 5580027 - DNA, 17 bp, Homo sapiens
caattgaagtaaacttt

SEQ ID NO: 5580028 - DNA, 21 bp, Homo sapiens
caattgaagtaaactttttgt

SEQ ID NO: 5580029 - DNA, 15 bp, Homo sapiens
caattgaatggtcag

SEQ ID NO: 5580030 - DNA, 15 bp, Homo sapiens
caattgacaaatgat

SEQ ID NO: 5580031 - DNA, 22 bp, Homo sapiens
caattgacaacagttacataat

SEQ ID NO: 5580032 - DNA, 20 bp, Homo sapiens
caattgacattcctttgaat

SEQ ID NO: 5580033 - DNA, 14 bp, Homo sapiens
caattgactgccct

SEQ ID NO: 5580034 - DNA, 22 bp, Homo sapiens
caattgactgccctcttactgt

SEQ ID NO: 5580035 - DNA, 20 bp, Homo sapiens
caattgagtaattctagaca

SEQ ID NO: 5580036 - DNA, 18 bp, Homo sapiens
caattgatatttctgtgt

SEQ ID NO: 5580037 - DNA, 14 bp, Homo sapiens
caattgatctcttt

SEQ ID NO: 5580038 - DNA, 13 bp, Homo sapiens
caattgatctttt

SEQ ID NO: 5580039 - DNA, 13 bp, Homo sapiens
caattgatggact

SEQ ID NO: 5580040 - DNA, 12 bp, Homo sapiens
caattgatgttt

SEQ ID NO: 5580041 - DNA, 21 bp, Homo sapiens
caattgatgttttacgtgcaa

SEQ ID NO: 5580042 - DNA, 14 bp, Homo sapiens
caattgattgtgaa

SEQ ID NO: 5580043 - DNA, 19 bp, Homo sapiens
caattgattttaaaccata

SEQ ID NO: 5580044 - DNA, 17 bp, Homo sapiens
caattgcacaaatacaa

SEQ ID NO: 5580045 - DNA, 13 bp, Homo sapiens
caattgcactgct

SEQ ID NO: 5580046 - DNA, 16 bp, Homo sapiens
caattgcactgctgtt

SEQ ID NO: 5580047 - DNA, 23 bp, Homo sapiens
caattgcagcagacccagcagca

SEQ ID NO: 5580048 - DNA, 16 bp, Homo sapiens
caattgctcccatcag

SEQ ID NO: 5580049 - DNA, 18 bp, Homo sapiens
caattgctgcatcttagt

SEQ ID NO: 5580050 - DNA, 17 bp, Homo sapiens
caattggacaattattt

SEQ ID NO: 5580051 - DNA, 12 bp, Homo sapiens
caattggaggaa

SEQ ID NO: 5580052 - DNA, 21 bp, Homo sapiens
caattggattggaatgcagag

SEQ ID NO: 5580053 - DNA, 21 bp, Homo sapiens
caattggcaccgaagcccaga

SEQ ID NO: 5580054 - DNA, 17 bp, Homo sapiens
caattggcagtgacttt

SEQ ID NO: 5580055 - DNA, 18 bp, Homo sapiens
caattggcagtgactttg

SEQ ID NO: 5580056 - DNA, 20 bp, Homo sapiens
caattggcatcattctcctt

SEQ ID NO: 5580057 - DNA, 17 bp, Homo sapiens
caattgggagctgccaa

SEQ ID NO: 5580058 - DNA, 20 bp, Homo sapiens
caattgggagctgccaagag

SEQ ID NO: 5580059 - DNA, 14 bp, Homo sapiens
caattggggaagaa

SEQ ID NO: 5580060 - DNA, 22 bp, Homo sapiens
caattggtggaattcctcttta

SEQ ID NO: 5580061 - DNA, 12 bp, Homo sapiens
caattggttgtt

SEQ ID NO: 5580062 - DNA, 12 bp, Homo sapiens
caattgtaaaaa

SEQ ID NO: 5580063 - DNA, 19 bp, Homo sapiens
caattgtaaaactgaggca

SEQ ID NO: 5580064 - DNA, 14 bp, Homo sapiens
caattgtaaattga

SEQ ID NO: 5580065 - DNA, 15 bp, Homo sapiens
caattgtatatatat

SEQ ID NO: 5580066 - DNA, 22 bp, Homo sapiens
caattgtatatatatgtgaact

SEQ ID NO: 5580067 - DNA, 15 bp, Homo sapiens
caattgtcacttttt

SEQ ID NO: 5580068 - DNA, 17 bp, Homo sapiens
caattgtcactttttat

SEQ ID NO: 5580069 - DNA, 17 bp, Homo sapiens
caattgtcatttataaa

SEQ ID NO: 5580070 - DNA, 21 bp, Homo sapiens
caattgtcgaaaagagtcttc

SEQ ID NO: 5580071 - DNA, 12 bp, Homo sapiens
caattgtcttaa

SEQ ID NO: 5580072 - DNA, 17 bp, Homo sapiens
caattgtcttaaaacca

SEQ ID NO: 5580073 - DNA, 18 bp, Homo sapiens
caattgtcttaaaaccag

SEQ ID NO: 5580074 - DNA, 22 bp, Homo sapiens
caattgtcttttttttcctttg

SEQ ID NO: 5580075 - DNA, 23 bp, Homo sapiens
caattgtgaaaaaatttacttta

SEQ ID NO: 5580076 - DNA, 14 bp, Homo sapiens
caattgtgaacatg

SEQ ID NO: 5580077 - DNA, 15 bp, Homo sapiens
caattgtgaacatga

SEQ ID NO: 5580078 - DNA, 14 bp, Homo sapiens
caattgtgacagca

SEQ ID NO: 5580079 - DNA, 19 bp, Homo sapiens
caattgtgagaattactgt

SEQ ID NO: 5580080 - DNA, 20 bp, Homo sapiens
caattgtgagaattactgtt

SEQ ID NO: 5580081 - DNA, 14 bp, Homo sapiens
caattgtgctgcca

SEQ ID NO: 5580082 - DNA, 16 bp, Homo sapiens
caattgtgctgccatt

SEQ ID NO: 5580083 - DNA, 11 bp, Homo sapiens
caattgtggat

SEQ ID NO: 5580084 - DNA, 18 bp, Homo sapiens
caattgtgtagccttttt

SEQ ID NO: 5580085 - DNA, 19 bp, Homo sapiens
caattgttctgggtgattt

SEQ ID NO: 5580086 - DNA, 13 bp, Homo sapiens
caatttaaaacaa

SEQ ID NO: 5580087 - DNA, 14 bp, Homo sapiens
caatttaaaacaat

SEQ ID NO: 5580088 - DNA, 17 bp, Homo sapiens
caatttaaaatatagat

SEQ ID NO: 5580089 - DNA, 15 bp, Homo sapiens
caatttaaaatattt

SEQ ID NO: 5580090 - DNA, 16 bp, Homo sapiens
caatttaaacccattt

SEQ ID NO: 5580091 - DNA, 22 bp, Homo sapiens
caatttaaacccattttagtca

SEQ ID NO: 5580092 - DNA, 23 bp, Homo sapiens
caatttaaaggaaagttctatta

SEQ ID NO: 5580093 - DNA, 13 bp, Homo sapiens
caatttaaatgtt

SEQ ID NO: 5580094 - DNA, 14 bp, Homo sapiens
caatttaaatgttt

SEQ ID NO: 5580095 - DNA, 16 bp, Homo sapiens
caatttaaatgtttac

SEQ ID NO: 5580096 - DNA, 17 bp, Homo sapiens
caatttaaatgtttact

SEQ ID NO: 5580097 - DNA, 22 bp, Homo sapiens
caatttaaatgtttactataga

SEQ ID NO: 5580098 - DNA, 15 bp, Homo sapiens
caatttaattcttat

SEQ ID NO: 5580099 - DNA, 19 bp, Homo sapiens
caatttaattcttatttct

SEQ ID NO: 5580100 - DNA, 21 bp, Homo sapiens
caatttaattcttatttctgt

SEQ ID NO: 5580101 - DNA, 15 bp, Homo sapiens
caatttacaaagtgt

SEQ ID NO: 5580102 - DNA, 21 bp, Homo sapiens
caatttacaaagtgtgtatta

SEQ ID NO: 5580103 - DNA, 22 bp, Homo sapiens
caatttaccacaggatgcatat

SEQ ID NO: 5580104 - DNA, 18 bp, Homo sapiens
caatttactttttaaaca

SEQ ID NO: 5580105 - DNA, 19 bp, Homo sapiens
caatttactttttaaacag

SEQ ID NO: 5580106 - DNA, 11 bp, Homo sapiens
caatttagaaa

SEQ ID NO: 5580107 - DNA, 13 bp, Homo sapiens
caatttagaaaac

SEQ ID NO: 5580108 - DNA, 15 bp, Homo sapiens
caatttagaaaacat

SEQ ID NO: 5580109 - DNA, 22 bp, Homo sapiens
caatttagaaaacattcatcca

SEQ ID NO: 5580110 - DNA, 18 bp, Homo sapiens
caatttagcaaactgatg

SEQ ID NO: 5580111 - DNA, 11 bp, Homo sapiens
caatttataac

SEQ ID NO: 5580112 - DNA, 22 bp, Homo sapiens
caatttatacctcaattttcac

SEQ ID NO: 5580113 - DNA, 15 bp, Homo sapiens
caatttatatcttta

SEQ ID NO: 5580114 - DNA, 23 bp, Homo sapiens
caatttatatgcttcacatagca

SEQ ID NO: 5580115 - DNA, 21 bp, Homo sapiens
caatttatatttaataaaatt

SEQ ID NO: 5580116 - DNA, 17 bp, Homo sapiens
caatttatgttaacaga

SEQ ID NO: 5580117 - DNA, 20 bp, Homo sapiens
caatttatgttaacagatga

SEQ ID NO: 5580118 - DNA, 14 bp, Homo sapiens
caatttattttatt

SEQ ID NO: 5580119 - DNA, 19 bp, Homo sapiens
caatttattttattttagc

SEQ ID NO: 5580120 - DNA, 20 bp, Homo sapiens
caatttcaaaaaaataaaat

SEQ ID NO: 5580121 - DNA, 18 bp, Homo sapiens
caatttcaaaatgcatgt

SEQ ID NO: 5580122 - DNA, 20 bp, Homo sapiens
caatttcaaaatgcatgtga

SEQ ID NO: 5580123 - DNA, 21 bp, Homo sapiens
caatttcaaaatgcatgtgat

SEQ ID NO: 5580124 - DNA, 14 bp, Homo sapiens
caatttcaaaatgt

SEQ ID NO: 5580125 - DNA, 14 bp, Homo sapiens
caatttcaaacttt

SEQ ID NO: 5580126 - DNA, 16 bp, Homo sapiens
caatttcaaacttttg

SEQ ID NO: 5580127 - DNA, 21 bp, Homo sapiens
caatttcaaacttttgaaaga

SEQ ID NO: 5580128 - DNA, 17 bp, Homo sapiens
caatttcaaagaaaaca

SEQ ID NO: 5580129 - DNA, 12 bp, Homo sapiens
caatttcagctc

SEQ ID NO: 5580130 - DNA, 21 bp, Homo sapiens
caatttcagttttaaaaatga

SEQ ID NO: 5580131 - DNA, 18 bp, Homo sapiens
caatttccatatagtcta

SEQ ID NO: 5580132 - DNA, 23 bp, Homo sapiens
caatttccattcttttaaatggg

SEQ ID NO: 5580133 - DNA, 14 bp, Homo sapiens
caatttcccaccca

SEQ ID NO: 5580134 - DNA, 14 bp, Homo sapiens
caatttcccagaag

SEQ ID NO: 5580135 - DNA, 17 bp, Homo sapiens
caatttcccagaaggga

SEQ ID NO: 5580136 - DNA, 22 bp, Homo sapiens
caatttcccagactagatttca

SEQ ID NO: 5580137 - DNA, 18 bp, Homo sapiens
caatttccccctgttctt

SEQ ID NO: 5580138 - DNA, 23 bp, Homo sapiens
caatttccctcaggttctatttt

SEQ ID NO: 5580139 - DNA, 19 bp, Homo sapiens
caatttcctcatctgggtc

SEQ ID NO: 5580140 - DNA, 14 bp, Homo sapiens
caatttcctttaaa

SEQ ID NO: 5580141 - DNA, 19 bp, Homo sapiens
caatttcctttatatttag

SEQ ID NO: 5580142 - DNA, 13 bp, Homo sapiens
caatttcggattt

SEQ ID NO: 5580143 - DNA, 17 bp, Homo sapiens
caatttcggattttttc

SEQ ID NO: 5580144 - DNA, 22 bp, Homo sapiens
caatttcggattttttccaaaa

SEQ ID NO: 5580145 - DNA, 17 bp, Homo sapiens
caatttctaatgtttac

SEQ ID NO: 5580146 - DNA, 16 bp, Homo sapiens
caatttctactttgaa

SEQ ID NO: 5580147 - DNA, 21 bp, Homo sapiens
caatttctactttgaagtcat

SEQ ID NO: 5580148 - DNA, 23 bp, Homo sapiens
caatttctagtacctgtgactct

SEQ ID NO: 5580149 - DNA, 19 bp, Homo sapiens
caatttctattaaaggttc

SEQ ID NO: 5580150 - DNA, 14 bp, Homo sapiens
caatttctctgcac

SEQ ID NO: 5580151 - DNA, 13 bp, Homo sapiens
caatttctgaaca

SEQ ID NO: 5580152 - DNA, 13 bp, Homo sapiens
caatttctgctgt

SEQ ID NO: 5580153 - DNA, 14 bp, Homo sapiens
caatttctgtacat

SEQ ID NO: 5580154 - DNA, 22 bp, Homo sapiens
caatttctgtgttgccaagctc

SEQ ID NO: 5580155 - DNA, 9 bp, Homo sapiens
caatttctt

SEQ ID NO: 5580156 - DNA, 11 bp, Homo sapiens
caatttcttac

SEQ ID NO: 5580157 - DNA, 15 bp, Homo sapiens
caatttcttccttcc

SEQ ID NO: 5580158 - DNA, 21 bp, Homo sapiens
caatttgaaaagcccacataa

SEQ ID NO: 5580159 - DNA, 12 bp, Homo sapiens
caatttgaaggt

SEQ ID NO: 5580160 - DNA, 23 bp, Homo sapiens
caatttgagactgaaatttagta

SEQ ID NO: 5580161 - DNA, 21 bp, Homo sapiens
caatttgagccatttaaagac

SEQ ID NO: 5580162 - DNA, 16 bp, Homo sapiens
caatttgatacataat

SEQ ID NO: 5580163 - DNA, 22 bp, Homo sapiens
caatttgcaccagttttatcca

SEQ ID NO: 5580164 - DNA, 22 bp, Homo sapiens
caatttgcactgttacttttta

SEQ ID NO: 5580165 - DNA, 21 bp, Homo sapiens
caatttgccttaggaagtgac

SEQ ID NO: 5580166 - DNA, 13 bp, Homo sapiens
cacaaaggagagc

SEQ ID NO: 5580167 - DNA, 19 bp, Homo sapiens
cacaaaggccaaactgctg

SEQ ID NO: 5580168 - DNA, 16 bp, Homo sapiens
cacaaagggcccagat

SEQ ID NO: 5580169 - DNA, 12 bp, Homo sapiens
cacaaaggggag

SEQ ID NO: 5580170 - DNA, 22 bp, Homo sapiens
cacaaaggggatcataaagtta

SEQ ID NO: 5580171 - DNA, 21 bp, Homo sapiens
cacaaaggtggaataaacatt

SEQ ID NO: 5580172 - DNA, 17 bp, Homo sapiens
cacaaagtgaaattagt

SEQ ID NO: 5580173 - DNA, 20 bp, Homo sapiens
cacaaagtgagaaattatga

SEQ ID NO: 5580174 - DNA, 13 bp, Homo sapiens
cacaaagtggcat

SEQ ID NO: 5580175 - DNA, 15 bp, Homo sapiens
cacaaagttctcaga

SEQ ID NO: 5580176 - DNA, 18 bp, Homo sapiens
cacaaagttgtttaacta

SEQ ID NO: 5580177 - DNA, 22 bp, Homo sapiens
cacaaagtttgtggtaatttgt

SEQ ID NO: 5580178 - DNA, 10 bp, Homo sapiens
cacaaataaa

SEQ ID NO: 5580179 - DNA, 13 bp, Homo sapiens
cacaaataacaag

SEQ ID NO: 5580180 - DNA, 17 bp, Homo sapiens
cacaaataccagagcac

SEQ ID NO: 5580181 - DNA, 18 bp, Homo sapiens
cacaaataccagagcaca

SEQ ID NO: 5580182 - DNA, 13 bp, Homo sapiens
cacaaataggtat

SEQ ID NO: 5580183 - DNA, 20 bp, Homo sapiens
cacaaatagttatcttttaa

SEQ ID NO: 5580184 - DNA, 14 bp, Homo sapiens
cacaaatattaaaa

SEQ ID NO: 5580185 - DNA, 23 bp, Homo sapiens
cacaaatatttattttctttctg

SEQ ID NO: 5580186 - DNA, 19 bp, Homo sapiens
cacaaatccctatgttgct

SEQ ID NO: 5580187 - DNA, 14 bp, Homo sapiens
cacaaatctatatt

SEQ ID NO: 5580188 - DNA, 13 bp, Homo sapiens
cacaaatgacttt

SEQ ID NO: 5580189 - DNA, 10 bp, Homo sapiens
cacaaatgca

SEQ ID NO: 5580190 - DNA, 15 bp, Homo sapiens
cacaaatgcagacac

SEQ ID NO: 5580191 - DNA, 16 bp, Homo sapiens
cacaaatgcagacaca

SEQ ID NO: 5580192 - DNA, 19 bp, Homo sapiens
cacaaatgcagacacacaa

SEQ ID NO: 5580193 - DNA, 15 bp, Homo sapiens
cacaaatgctcaaag

SEQ ID NO: 5580194 - DNA, 15 bp, Homo sapiens
cacaaatggctacat

SEQ ID NO: 5580195 - DNA, 15 bp, Homo sapiens
cacaaatgtcattgt

SEQ ID NO: 5580196 - DNA, 16 bp, Homo sapiens
cacaaatgtcattgtc

SEQ ID NO: 5580197 - DNA, 17 bp, Homo sapiens
cacaaatgtcattgtct

SEQ ID NO: 5580198 - DNA, 18 bp, Homo sapiens
cacaaatgtcattgtcta

SEQ ID NO: 5580199 - DNA, 21 bp, Homo sapiens
cacaaatgtcattgtctactc

SEQ ID NO: 5580200 - DNA, 11 bp, Homo sapiens
cacaaatgtcc

SEQ ID NO: 5580201 - DNA, 14 bp, Homo sapiens
cacaaatgtgtact

SEQ ID NO: 5580202 - DNA, 16 bp, Homo sapiens
cacaaatgtgtatttt

SEQ ID NO: 5580203 - DNA, 23 bp, Homo sapiens
cacaaatgtgtatttttgttgca

SEQ ID NO: 5580204 - DNA, 20 bp, Homo sapiens
cacaaatgtgtcccagtgaa

SEQ ID NO: 5580205 - DNA, 12 bp, Homo sapiens
cacaaattcagt

SEQ ID NO: 5580206 - DNA, 13 bp, Homo sapiens
cacaaattttcaa

SEQ ID NO: 5580207 - DNA, 12 bp, Homo sapiens
cacaacaaaaat

SEQ ID NO: 5580208 - DNA, 17 bp, Homo sapiens
cacaacaaaaatttgaa

SEQ ID NO: 5580209 - DNA, 15 bp, Homo sapiens
cacaacaaaaggaag

SEQ ID NO: 5580210 - DNA, 19 bp, Homo sapiens
cacaacaaacctattgtag

SEQ ID NO: 5580211 - DNA, 14 bp, Homo sapiens
cacaacacaagaaa

SEQ ID NO: 5580212 - DNA, 17 bp, Homo sapiens
cacaacacaagaaaact

SEQ ID NO: 5580213 - DNA, 21 bp, Homo sapiens
cacaacacaagaaaactcaaa

SEQ ID NO: 5580214 - DNA, 20 bp, Homo sapiens
cacaacacaagcaccccaga

SEQ ID NO: 5580215 - DNA, 16 bp, Homo sapiens
cacaacacacacactc

SEQ ID NO: 5580216 - DNA, 12 bp, Homo sapiens
cacaacacagat

SEQ ID NO: 5580217 - DNA, 13 bp, Homo sapiens
cacaacaccagga

SEQ ID NO: 5580218 - DNA, 14 bp, Homo sapiens
cacaacaccaggac

SEQ ID NO: 5580219 - DNA, 14 bp, Homo sapiens
cacaacagaataaa

SEQ ID NO: 5580220 - DNA, 20 bp, Homo sapiens
cacaacagaataaagcagcc

SEQ ID NO: 5580221 - DNA, 21 bp, Homo sapiens
cacaacagaataaagcagcct

SEQ ID NO: 5580222 - DNA, 12 bp, Homo sapiens
cacaacagattt

SEQ ID NO: 5580223 - DNA, 14 bp, Homo sapiens
cacaacagcctggg

SEQ ID NO: 5580224 - DNA, 14 bp, Homo sapiens
cacaacatgcacat

SEQ ID NO: 5580225 - DNA, 14 bp, Homo sapiens
cacaacatggtgct

SEQ ID NO: 5580226 - DNA, 23 bp, Homo sapiens
cacaaccaccgttacaagtatac

SEQ ID NO: 5580227 - DNA, 16 bp, Homo sapiens
cacaaccagccaggca

SEQ ID NO: 5580228 - DNA, 19 bp, Homo sapiens
cacaacccaagcaacattt

SEQ ID NO: 5580229 - DNA, 21 bp, Homo sapiens
cacaacccatctacccctgga

SEQ ID NO: 5580230 - DNA, 19 bp, Homo sapiens
cacaaccctctggaagtgg

SEQ ID NO: 5580231 - DNA, 20 bp, Homo sapiens
cacaaccctctggaagtggc

SEQ ID NO: 5580232 - DNA, 22 bp, Homo sapiens
cacaaccgtccccggcccctgc

SEQ ID NO: 5580233 - DNA, 14 bp, Homo sapiens
cacaacctaaatgg

SEQ ID NO: 5580234 - DNA, 16 bp, Homo sapiens
cacaacctaaatggag

SEQ ID NO: 5580235 - DNA, 18 bp, Homo sapiens
cacaacctactctgcaaa

SEQ ID NO: 5580236 - DNA, 18 bp, Homo sapiens
cacaacctcctcctccag

SEQ ID NO: 5580237 - DNA, 17 bp, Homo sapiens
cacaacctgaaagacaa

SEQ ID NO: 5580238 - DNA, 16 bp, Homo sapiens
cacaaccttcggctcc

SEQ ID NO: 5580239 - DNA, 14 bp, Homo sapiens
cacaacgggccagc

SEQ ID NO: 5580240 - DNA, 16 bp, Homo sapiens
cacaacgtgcaactga

SEQ ID NO: 5580241 - DNA, 14 bp, Homo sapiens
cacaacgtgcattg

SEQ ID NO: 5580242 - DNA, 13 bp, Homo sapiens
cacaactaacaat

SEQ ID NO: 5580243 - DNA, 14 bp, Homo sapiens
cacaactaacaatg

SEQ ID NO: 5580244 - DNA, 15 bp, Homo sapiens
cacaactaacaatgc

SEQ ID NO: 5580245 - DNA, 17 bp, Homo sapiens
cacaactaggacctcat

SEQ ID NO: 5580246 - DNA, 18 bp, Homo sapiens
cacaactaggacctcata

SEQ ID NO: 5580247 - DNA, 23 bp, Homo sapiens
cacaactcactccttttaaagaa

SEQ ID NO: 5580248 - DNA, 12 bp, Homo sapiens
cacaactccctt

SEQ ID NO: 5580249 - DNA, 19 bp, Homo sapiens
cacaactgcaataacttct

SEQ ID NO: 5580250 - DNA, 21 bp, Homo sapiens
cacaactgcaataacttctga

SEQ ID NO: 5580251 - DNA, 23 bp, Homo sapiens
cacaactgcaataacttctgacc

SEQ ID NO: 5580252 - DNA, 22 bp, Homo sapiens
cacaactgctgtggccccctgt

SEQ ID NO: 5580253 - DNA, 13 bp, Homo sapiens
cacaactgctgtt

SEQ ID NO: 5580254 - DNA, 13 bp, Homo sapiens
cacaactgtgata

SEQ ID NO: 5580255 - DNA, 19 bp, Homo sapiens
cacaactgtgtgattaaaa

SEQ ID NO: 5580256 - DNA, 19 bp, Homo sapiens
cacaacttagaaaccaaat

SEQ ID NO: 5580257 - DNA, 17 bp, Homo sapiens
cacaacttagtgtaata

SEQ ID NO: 5580258 - DNA, 18 bp, Homo sapiens
cacaacttcagcagggga

SEQ ID NO: 5580259 - DNA, 20 bp, Homo sapiens
cacaacttcccattaaaaat

SEQ ID NO: 5580260 - DNA, 15 bp, Homo sapiens
cacaacttgggttct

SEQ ID NO: 5580261 - DNA, 20 bp, Homo sapiens
cacaacttgtcacccaaagc

SEQ ID NO: 5580262 - DNA, 12 bp, Homo sapiens
cacaacttgttt

SEQ ID NO: 5580263 - DNA, 20 bp, Homo sapiens
cacaacttgtttttggtttt

SEQ ID NO: 5580264 - DNA, 21 bp, Homo sapiens
cacaactttattgattgaatt

SEQ ID NO: 5580265 - DNA, 22 bp, Homo sapiens
cacaagaaaactcaaagaatgt

SEQ ID NO: 5580266 - DNA, 13 bp, Homo sapiens
cacaagaaatgaa

SEQ ID NO: 5580267 - DNA, 14 bp, Homo sapiens
cacaagaaggccag

SEQ ID NO: 5580268 - DNA, 17 bp, Homo sapiens
cacaagaaggccagccc

SEQ ID NO: 5580269 - DNA, 18 bp, Homo sapiens
cacaagaaggccagccca

SEQ ID NO: 5580270 - DNA, 12 bp, Homo sapiens
cacaagaagtgg

SEQ ID NO: 5580271 - DNA, 17 bp, Homo sapiens
cacaagaagtgggagtg

SEQ ID NO: 5580272 - DNA, 22 bp, Homo sapiens
cacaagaagtgggagtgggaga

SEQ ID NO: 5580273 - DNA, 17 bp, Homo sapiens
cacaagaatcacttgaa

SEQ ID NO: 5580274 - DNA, 12 bp, Homo sapiens
cacaagaatcta

SEQ ID NO: 5580275 - DNA, 13 bp, Homo sapiens
cacaagaatggat

SEQ ID NO: 5580276 - DNA, 14 bp, Homo sapiens
cacaagaatggatc

SEQ ID NO: 5580277 - DNA, 23 bp, Homo sapiens
cacaagacccaaaaggcagaagc

SEQ ID NO: 5580278 - DNA, 23 bp, Homo sapiens
cacaagacccaagtagctgctac

SEQ ID NO: 5580279 - DNA, 22 bp, Homo sapiens
cacaagacccctgctcctgact

SEQ ID NO: 5580280 - DNA, 14 bp, Homo sapiens
cacaagactggccc

SEQ ID NO: 5580281 - DNA, 22 bp, Homo sapiens
cacaagactggcccagtgccag

SEQ ID NO: 5580282 - DNA, 15 bp, Homo sapiens
cacaagagacttaaa

SEQ ID NO: 5580283 - DNA, 14 bp, Homo sapiens
cacaagagcccagg

SEQ ID NO: 5580284 - DNA, 15 bp, Homo sapiens
cacaagagctccttg

SEQ ID NO: 5580285 - DNA, 13 bp, Homo sapiens
cacaagagctgga

SEQ ID NO: 5580286 - DNA, 22 bp, Homo sapiens
cacaagagggactgtatttctg

SEQ ID NO: 5580287 - DNA, 18 bp, Homo sapiens
cacaagagtccccagact

SEQ ID NO: 5580288 - DNA, 14 bp, Homo sapiens
cacaagagtgaatt

SEQ ID NO: 5580289 - DNA, 15 bp, Homo sapiens
cacaagatggaaaaa

SEQ ID NO: 5580290 - DNA, 21 bp, Homo sapiens
cacaagatggaaaaaaaaaac

SEQ ID NO: 5580291 - DNA, 12 bp, Homo sapiens
cacaagatgttg

SEQ ID NO: 5580292 - DNA, 17 bp, Homo sapiens
cacaagattcccagaga

SEQ ID NO: 5580293 - DNA, 22 bp, Homo sapiens
cacaagattcccagagacagga

SEQ ID NO: 5580294 - DNA, 21 bp, Homo sapiens
cacaagcaataattaggatct

SEQ ID NO: 5580295 - DNA, 22 bp, Homo sapiens
cacaagcaatgcaagaaaaaaa

SEQ ID NO: 5580296 - DNA, 12 bp, Homo sapiens
cacaagcacaat

SEQ ID NO: 5580297 - DNA, 19 bp, Homo sapiens
cacaagcacaattgatctc

SEQ ID NO: 5580298 - DNA, 14 bp, Homo sapiens
cacaagcaccccag

SEQ ID NO: 5580299 - DNA, 17 bp, Homo sapiens
cacaagcagacacacac

SEQ ID NO: 5580300 - DNA, 20 bp, Homo sapiens
cacaagcagacacacacata

SEQ ID NO: 5580301 - DNA, 13 bp, Homo sapiens
cacaagcagggca

SEQ ID NO: 5580302 - DNA, 14 bp, Homo sapiens
cacaagcattcctt

SEQ ID NO: 5580303 - DNA, 12 bp, Homo sapiens
cacaagccacag

SEQ ID NO: 5580304 - DNA, 15 bp, Homo sapiens
cacaagccacgcctg

SEQ ID NO: 5580305 - DNA, 12 bp, Homo sapiens
cacaagccaggg

SEQ ID NO: 5580306 - DNA, 23 bp, Homo sapiens
cacaagcccaggtcctgctgcct

SEQ ID NO: 5580307 - DNA, 10 bp, Homo sapiens
cacaagcccg

SEQ ID NO: 5580308 - DNA, 18 bp, Homo sapiens
cacaagccgtgttttatg

SEQ ID NO: 5580309 - DNA, 15 bp, Homo sapiens
cacaagcctctgccc

SEQ ID NO: 5580310 - DNA, 20 bp, Homo sapiens
cacaagcctctgcccaggca

SEQ ID NO: 5580311 - DNA, 15 bp, Homo sapiens
cacaagcctgagaac

SEQ ID NO: 5580312 - DNA, 19 bp, Homo sapiens
cacaagcctgagaactgaa

SEQ ID NO: 5580313 - DNA, 15 bp, Homo sapiens
cacaagcctgaggga

SEQ ID NO: 5580314 - DNA, 14 bp, Homo sapiens
cacaagccttcggc

SEQ ID NO: 5580315 - DNA, 16 bp, Homo sapiens
cacaagcgctcccagc

SEQ ID NO: 5580316 - DNA, 19 bp, Homo sapiens
cacaagcgctcccagcctg

SEQ ID NO: 5580317 - DNA, 21 bp, Homo sapiens
cacaagcgctcccagcctgcc

SEQ ID NO: 5580318 - DNA, 18 bp, Homo sapiens
cacaagcggccctgacac

SEQ ID NO: 5580319 - DNA, 17 bp, Homo sapiens
cacaagctcaggtcctg

SEQ ID NO: 5580320 - DNA, 14 bp, Homo sapiens
cacaagctccaagc

SEQ ID NO: 5580321 - DNA, 17 bp, Homo sapiens
cacaagctccaagctcc

SEQ ID NO: 5580322 - DNA, 19 bp, Homo sapiens
cacaagctccaagctccca

SEQ ID NO: 5580323 - DNA, 23 bp, Homo sapiens
cacaagctccaagctcccaggca

SEQ ID NO: 5580324 - DNA, 18 bp, Homo sapiens
cacaagctgcactgtgaa

SEQ ID NO: 5580325 - DNA, 13 bp, Homo sapiens
cacaagctgcctc

SEQ ID NO: 5580326 - DNA, 14 bp, Homo sapiens
cacaagctgcctcc

SEQ ID NO: 5580327 - DNA, 17 bp, Homo sapiens
cacaagctgcctctgac

SEQ ID NO: 5580328 - DNA, 14 bp, Homo sapiens
cacaagctggaagc

SEQ ID NO: 5580329 - DNA, 15 bp, Homo sapiens
cacaagctggaagca

SEQ ID NO: 5580330 - DNA, 18 bp, Homo sapiens
cacaagctgtccctgcag

SEQ ID NO: 5580331 - DNA, 20 bp, Homo sapiens
cacaagctgtccctgcaggg

SEQ ID NO: 5580332 - DNA, 19 bp, Homo sapiens
cacaagcttgtatatacat

SEQ ID NO: 5580333 - DNA, 21 bp, Homo sapiens
cacaagcttgtatatacatat

SEQ ID NO: 5580334 - DNA, 19 bp, Homo sapiens
cacaaggaaaaggaggagg

SEQ ID NO: 5580335 - DNA, 21 bp, Homo sapiens
cacaaggaaccctcaggccac

SEQ ID NO: 5580336 - DNA, 16 bp, Homo sapiens
cacaaggaactcttga

SEQ ID NO: 5580337 - DNA, 19 bp, Homo sapiens
cacaaggacgctggctact

SEQ ID NO: 5580338 - DNA, 18 bp, Homo sapiens
cacaaggactgccgcctt

SEQ ID NO: 5580339 - DNA, 23 bp, Homo sapiens
cacaaggactgccgccttctcgc

SEQ ID NO: 5580340 - DNA, 14 bp, Homo sapiens
cacaaggacttcct

SEQ ID NO: 5580341 - DNA, 22 bp, Homo sapiens
cacaaggacttcctgtccagct

SEQ ID NO: 5580342 - DNA, 22 bp, Homo sapiens
cacaaggagctttcttgtttct

SEQ ID NO: 5580343 - DNA, 22 bp, Homo sapiens
cacaaggataatagagtagcct

SEQ ID NO: 5580344 - DNA, 17 bp, Homo sapiens
cacaaggatagatgctg

SEQ ID NO: 5580345 - DNA, 11 bp, Homo sapiens
cacaaggcagc

SEQ ID NO: 5580346 - DNA, 23 bp, Homo sapiens
cacacatataaacatcacacaca

SEQ ID NO: 5580347 - DNA, 14 bp, Homo sapiens
cacacatatacata

SEQ ID NO: 5580348 - DNA, 15 bp, Homo sapiens
cacacatatacatat

SEQ ID NO: 5580349 - DNA, 16 bp, Homo sapiens
cacacatatatacata

SEQ ID NO: 5580350 - DNA, 18 bp, Homo sapiens
cacacatatataggcagt

SEQ ID NO: 5580351 - DNA, 13 bp, Homo sapiens
cacacatatatat

SEQ ID NO: 5580352 - DNA, 20 bp, Homo sapiens
cacacatatatattacaagg

SEQ ID NO: 5580353 - DNA, 15 bp, Homo sapiens
cacacatcaccaggt

SEQ ID NO: 5580354 - DNA, 14 bp, Homo sapiens
cacacatcatctgt

SEQ ID NO: 5580355 - DNA, 22 bp, Homo sapiens
cacacatccagctgcccctccc

SEQ ID NO: 5580356 - DNA, 12 bp, Homo sapiens
cacacatcccag

SEQ ID NO: 5580357 - DNA, 17 bp, Homo sapiens
cacacatcccagcccaa

SEQ ID NO: 5580358 - DNA, 17 bp, Homo sapiens
cacacatccccagccag

SEQ ID NO: 5580359 - DNA, 19 bp, Homo sapiens
cacacatcctgctgggccc

SEQ ID NO: 5580360 - DNA, 18 bp, Homo sapiens
cacacatcgttgccgcag

SEQ ID NO: 5580361 - DNA, 16 bp, Homo sapiens
cacacatctggccctg

SEQ ID NO: 5580362 - DNA, 20 bp, Homo sapiens
cacacatctgggtgccctga

SEQ ID NO: 5580363 - DNA, 14 bp, Homo sapiens
cacacatcttacct

SEQ ID NO: 5580364 - DNA, 22 bp, Homo sapiens
cacacatgaagtccaagcattt

SEQ ID NO: 5580365 - DNA, 22 bp, Homo sapiens
cacacatgagcatcaggccagg

SEQ ID NO: 5580366 - DNA, 15 bp, Homo sapiens
cacacatgcaaggga

SEQ ID NO: 5580367 - DNA, 13 bp, Homo sapiens
cacacatgcacac

SEQ ID NO: 5580368 - DNA, 16 bp, Homo sapiens
cacacatgcatacaca

SEQ ID NO: 5580369 - DNA, 19 bp, Homo sapiens
cacacatgcatacacacac

SEQ ID NO: 5580370 - DNA, 22 bp, Homo sapiens
cacacatgcatcctcccctctc

SEQ ID NO: 5580371 - DNA, 16 bp, Homo sapiens
cacacatgccctcctg

SEQ ID NO: 5580372 - DNA, 22 bp, Homo sapiens
cacacatggaaacccataggcc

SEQ ID NO: 5580373 - DNA, 14 bp, Homo sapiens
cacacatggaaggt

SEQ ID NO: 5580374 - DNA, 16 bp, Homo sapiens
cacacatggacacaga

SEQ ID NO: 5580375 - DNA, 17 bp, Homo sapiens
cacacatggatgagcac

SEQ ID NO: 5580376 - DNA, 18 bp, Homo sapiens
cacacatggctaattttt

SEQ ID NO: 5580377 - DNA, 16 bp, Homo sapiens
cacacatgggcagccc

SEQ ID NO: 5580378 - DNA, 18 bp, Homo sapiens
cacacatgggcagcccaa

SEQ ID NO: 5580379 - DNA, 14 bp, Homo sapiens
cacacattccagcc

SEQ ID NO: 5580380 - DNA, 19 bp, Homo sapiens
cacacattccagccaggcc

SEQ ID NO: 5580381 - DNA, 22 bp, Homo sapiens
cacacattccagccaggcccag

SEQ ID NO: 5580382 - DNA, 18 bp, Homo sapiens
cacacattccagggctgg

SEQ ID NO: 5580383 - DNA, 20 bp, Homo sapiens
cacacattccagggctgggg

SEQ ID NO: 5580384 - DNA, 13 bp, Homo sapiens
cacacattccatt

SEQ ID NO: 5580385 - DNA, 23 bp, Homo sapiens
cacacattcccccaccagctgca

SEQ ID NO: 5580386 - DNA, 14 bp, Homo sapiens
cacacattctgcct

SEQ ID NO: 5580387 - DNA, 19 bp, Homo sapiens
cacacattcttaaggcaat

SEQ ID NO: 5580388 - DNA, 14 bp, Homo sapiens
cacacatttcactg

SEQ ID NO: 5580389 - DNA, 22 bp, Homo sapiens
cacacatttcactgtctgtctg

SEQ ID NO: 5580390 - DNA, 14 bp, Homo sapiens
cacacatttcccta

SEQ ID NO: 5580391 - DNA, 19 bp, Homo sapiens
cacacattttaattttcct

SEQ ID NO: 5580392 - DNA, 16 bp, Homo sapiens
cacacattttttaaat

SEQ ID NO: 5580393 - DNA, 20 bp, Homo sapiens
cacaccaaagggagagttcc

SEQ ID NO: 5580394 - DNA, 19 bp, Homo sapiens
cacaccaaattgctgagat

SEQ ID NO: 5580395 - DNA, 18 bp, Homo sapiens
cacaccaaccaggccttc

SEQ ID NO: 5580396 - DNA, 18 bp, Homo sapiens
cacaccaagcagcaacag

SEQ ID NO: 5580397 - DNA, 21 bp, Homo sapiens
cacaccaatcttactttgtaa

SEQ ID NO: 5580398 - DNA, 12 bp, Homo sapiens
cacaccaccctc

SEQ ID NO: 5580399 - DNA, 14 bp, Homo sapiens
cacaccaccctccc

SEQ ID NO: 5580400 - DNA, 18 bp, Homo sapiens
cacaccactaaccatccc

SEQ ID NO: 5580401 - DNA, 21 bp, Homo sapiens
cacaccactaaccatccccaa

SEQ ID NO: 5580402 - DNA, 19 bp, Homo sapiens
cacaccactgccctgcctg

SEQ ID NO: 5580403 - DNA, 18 bp, Homo sapiens
cacaccactgttgccttt

SEQ ID NO: 5580404 - DNA, 12 bp, Homo sapiens
cacaccagaaga

SEQ ID NO: 5580405 - DNA, 20 bp, Homo sapiens
cacaccagagacaagcagag

SEQ ID NO: 5580406 - DNA, 13 bp, Homo sapiens
cacaccagagccc

SEQ ID NO: 5580407 - DNA, 13 bp, Homo sapiens
cacaccagcactt

SEQ ID NO: 5580408 - DNA, 16 bp, Homo sapiens
cacaccagccctggtg

SEQ ID NO: 5580409 - DNA, 14 bp, Homo sapiens
cacaccagccgctg

SEQ ID NO: 5580410 - DNA, 15 bp, Homo sapiens
cacaccagccgctgc

SEQ ID NO: 5580411 - DNA, 19 bp, Homo sapiens
cacaccagccgctgcaggg

SEQ ID NO: 5580412 - DNA, 13 bp, Homo sapiens
cacaccagctgct

SEQ ID NO: 5580413 - DNA, 14 bp, Homo sapiens
cacaccaggataga

SEQ ID NO: 5580414 - DNA, 22 bp, Homo sapiens
cacaccaggccgtcctcccggg

SEQ ID NO: 5580415 - DNA, 18 bp, Homo sapiens
cacaccaggcgctaattc

SEQ ID NO: 5580416 - DNA, 19 bp, Homo sapiens
cacaccagggccagcctct

SEQ ID NO: 5580417 - DNA, 19 bp, Homo sapiens
cacaccagtcacacattat

SEQ ID NO: 5580418 - DNA, 16 bp, Homo sapiens
cacaccagttactgtt

SEQ ID NO: 5580419 - DNA, 21 bp, Homo sapiens
cacaccataagctactgccat

SEQ ID NO: 5580420 - DNA, 16 bp, Homo sapiens
cacaccatatgtccac

SEQ ID NO: 5580421 - DNA, 15 bp, Homo sapiens
cacaccatctggccc

SEQ ID NO: 5580422 - DNA, 19 bp, Homo sapiens
cacaccatctggcccaggc

SEQ ID NO: 5580423 - DNA, 20 bp, Homo sapiens
cacaccatcttaaatgacag

SEQ ID NO: 5580424 - DNA, 16 bp, Homo sapiens
cacaccattttgtaaa

SEQ ID NO: 5580425 - DNA, 14 bp, Homo sapiens
cacacccaaagctg

SEQ ID NO: 5580426 - DNA, 15 bp, Homo sapiens
cacacccaaagctga

SEQ ID NO: 5580427 - DNA, 17 bp, Homo sapiens
cacacccaaggggcccg

SEQ ID NO: 5580428 - DNA, 19 bp, Homo sapiens
cacacccaccccctctgga

SEQ ID NO: 5580429 - DNA, 22 bp, Homo sapiens
cacacccaccgtccgccctgct

SEQ ID NO: 5580430 - DNA, 13 bp, Homo sapiens
cacacccacctgc

SEQ ID NO: 5580431 - DNA, 16 bp, Homo sapiens
cacacccacctgctgc

SEQ ID NO: 5580432 - DNA, 19 bp, Homo sapiens
cacacccacctgctgctgt

SEQ ID NO: 5580433 - DNA, 14 bp, Homo sapiens
cacacccactccct

SEQ ID NO: 5580434 - DNA, 13 bp, Homo sapiens
cacacccactgcc

SEQ ID NO: 5580435 - DNA, 16 bp, Homo sapiens
cacacccactgccccg

SEQ ID NO: 5580436 - DNA, 14 bp, Homo sapiens
cacacccagccagc

SEQ ID NO: 5580437 - DNA, 12 bp, Homo sapiens
cacacccagcct

SEQ ID NO: 5580438 - DNA, 13 bp, Homo sapiens
cacacccagcctc

SEQ ID NO: 5580439 - DNA, 14 bp, Homo sapiens
cacacccagctact

SEQ ID NO: 5580440 - DNA, 12 bp, Homo sapiens
cacaccccacct

SEQ ID NO: 5580441 - DNA, 21 bp, Homo sapiens
cacaccccagactccaggccc

SEQ ID NO: 5580442 - DNA, 22 bp, Homo sapiens
cacaccccagactccaggcccc

SEQ ID NO: 5580443 - DNA, 13 bp, Homo sapiens
cacaccccagcgc

SEQ ID NO: 5580444 - DNA, 18 bp, Homo sapiens
cacaccccatctctcttc

SEQ ID NO: 5580445 - DNA, 18 bp, Homo sapiens
cacacccccaagccacag

SEQ ID NO: 5580446 - DNA, 13 bp, Homo sapiens
cacacccccaccc

SEQ ID NO: 5580447 - DNA, 23 bp, Homo sapiens
cacaccccccagtcgagccctgc

SEQ ID NO: 5580448 - DNA, 14 bp, Homo sapiens
cacaccccgtctgc

SEQ ID NO: 5580449 - DNA, 16 bp, Homo sapiens
cacaccccgtctgccc

SEQ ID NO: 5580450 - DNA, 20 bp, Homo sapiens
cacaccccgtctgccccttg

SEQ ID NO: 5580451 - DNA, 17 bp, Homo sapiens
cacacccctctgctgca

SEQ ID NO: 5580452 - DNA, 17 bp, Homo sapiens
cacacccctgcacacac

SEQ ID NO: 5580453 - DNA, 22 bp, Homo sapiens
cacacccctgcacacacctgca

SEQ ID NO: 5580454 - DNA, 13 bp, Homo sapiens
cacacccctgtcc

SEQ ID NO: 5580455 - DNA, 18 bp, Homo sapiens
cacacccctgtcccaccc

SEQ ID NO: 5580456 - DNA, 20 bp, Homo sapiens
cacacccgaagtcctgtcac

SEQ ID NO: 5580457 - DNA, 15 bp, Homo sapiens
cacacccgcctgaca

SEQ ID NO: 5580458 - DNA, 16 bp, Homo sapiens
cacaccctacagcaga

SEQ ID NO: 5580459 - DNA, 13 bp, Homo sapiens
cacaccctacctt

SEQ ID NO: 5580460 - DNA, 18 bp, Homo sapiens
cacaccctcactctgcca

SEQ ID NO: 5580461 - DNA, 17 bp, Homo sapiens
cacaccctccagcacag

SEQ ID NO: 5580462 - DNA, 18 bp, Homo sapiens
cacaccctccagcacaga

SEQ ID NO: 5580463 - DNA, 14 bp, Homo sapiens
cacaccctccccat

SEQ ID NO: 5580464 - DNA, 23 bp, Homo sapiens
cacaccctccccattcagacact

SEQ ID NO: 5580465 - DNA, 21 bp, Homo sapiens
cacaccctcccccgccactcc

SEQ ID NO: 5580466 - DNA, 12 bp, Homo sapiens
cacaccctctgt

SEQ ID NO: 5580467 - DNA, 12 bp, Homo sapiens
cacaccctgagg

SEQ ID NO: 5580468 - DNA, 13 bp, Homo sapiens
cacaccctgaggt

SEQ ID NO: 5580469 - DNA, 22 bp, Homo sapiens
cacaccctgaggtcagggagtg

SEQ ID NO: 5580470 - DNA, 15 bp, Homo sapiens
cacaccctgcaaggc

SEQ ID NO: 5580471 - DNA, 16 bp, Homo sapiens
cacaccctgcaaggcc

SEQ ID NO: 5580472 - DNA, 15 bp, Homo sapiens
cacaccctgcccctg

SEQ ID NO: 5580473 - DNA, 16 bp, Homo sapiens
cacaccctgcccctgc

SEQ ID NO: 5580474 - DNA, 17 bp, Homo sapiens
cacaccctgcccctgca

SEQ ID NO: 5580475 - DNA, 19 bp, Homo sapiens
cacaccctgcccctgcaaa

SEQ ID NO: 5580476 - DNA, 13 bp, Homo sapiens
cacaccctgcctg

SEQ ID NO: 5580477 - DNA, 15 bp, Homo sapiens
cacaccctgcctgct

SEQ ID NO: 5580478 - DNA, 13 bp, Homo sapiens
cacaccctggacg

SEQ ID NO: 5580479 - DNA, 12 bp, Homo sapiens
cacaccctggag

SEQ ID NO: 5580480 - DNA, 21 bp, Homo sapiens
cacaccctggagtggcatggt

SEQ ID NO: 5580481 - DNA, 14 bp, Homo sapiens
cacaccctgtttta

SEQ ID NO: 5580482 - DNA, 15 bp, Homo sapiens
cacacccttccccac

SEQ ID NO: 5580483 - DNA, 17 bp, Homo sapiens
cacacccttccccactc

SEQ ID NO: 5580484 - DNA, 20 bp, Homo sapiens
cacaccgagggcgaccccgt

SEQ ID NO: 5580485 - DNA, 12 bp, Homo sapiens
cacaccgccatc

SEQ ID NO: 5580486 - DNA, 21 bp, Homo sapiens
cacaccgccatcctctgcctc

SEQ ID NO: 5580487 - DNA, 20 bp, Homo sapiens
cacaccgcggccaggcaccc

SEQ ID NO: 5580488 - DNA, 21 bp, Homo sapiens
cacaccgcggccaggcaccca

SEQ ID NO: 5580489 - DNA, 14 bp, Homo sapiens
cacaccgctggctc

SEQ ID NO: 5580490 - DNA, 16 bp, Homo sapiens
cacaccgctggctccg

SEQ ID NO: 5580491 - DNA, 21 bp, Homo sapiens
cacaccgggccaagtgaagaa

SEQ ID NO: 5580492 - DNA, 17 bp, Homo sapiens
cacaccgtccctctccc

SEQ ID NO: 5580493 - DNA, 21 bp, Homo sapiens
cacaccgtccctctccccgga

SEQ ID NO: 5580494 - DNA, 15 bp, Homo sapiens
cacaccgtcttcctt

SEQ ID NO: 5580495 - DNA, 19 bp, Homo sapiens
cacacctatggctggctgg

SEQ ID NO: 5580496 - DNA, 16 bp, Homo sapiens
cacacctcacgctctg

SEQ ID NO: 5580497 - DNA, 17 bp, Homo sapiens
cacacctcacgctctgg

SEQ ID NO: 5580498 - DNA, 18 bp, Homo sapiens
cacacctcactctttata

SEQ ID NO: 5580499 - DNA, 16 bp, Homo sapiens
cacacctcactgtcat

SEQ ID NO: 5580500 - DNA, 21 bp, Homo sapiens
cacacctcactgtcatctgcc

SEQ ID NO: 5580501 - DNA, 23 bp, Homo sapiens
cacacctcactgtcatctgccag

SEQ ID NO: 5580502 - DNA, 15 bp, Homo sapiens
cacacctcagcccca

SEQ ID NO: 5580503 - DNA, 17 bp, Homo sapiens
cacacctcagccccact

SEQ ID NO: 5580504 - DNA, 17 bp, Homo sapiens
cacacctcagttccctt

SEQ ID NO: 5580505 - DNA, 20 bp, Homo sapiens
cacacctcagttcccttggc

SEQ ID NO: 5580506 - DNA, 21 bp, Homo sapiens
cacacctcagttcccttggcc

SEQ ID NO: 5580507 - DNA, 13 bp, Homo sapiens
cacacctccacag

SEQ ID NO: 5580508 - DNA, 14 bp, Homo sapiens
cacacctccacccg

SEQ ID NO: 5580509 - DNA, 18 bp, Homo sapiens
cacacctccacccgtcct

SEQ ID NO: 5580510 - DNA, 14 bp, Homo sapiens
cacacctccctgaa

SEQ ID NO: 5580511 - DNA, 17 bp, Homo sapiens
cacacctccgagacagt

SEQ ID NO: 5580512 - DNA, 10 bp, Homo sapiens
cacacctcct

SEQ ID NO: 5580513 - DNA, 23 bp, Homo sapiens
cacacctcctcccactgcccact

SEQ ID NO: 5580514 - DNA, 12 bp, Homo sapiens
cacacctcctct

SEQ ID NO: 5580515 - DNA, 19 bp, Homo sapiens
cacacctccttccctctct

SEQ ID NO: 5580516 - DNA, 22 bp, Homo sapiens
cacacctccttccctctctgga

SEQ ID NO: 5580517 - DNA, 12 bp, Homo sapiens
cacacctctgcc

SEQ ID NO: 5580518 - DNA, 16 bp, Homo sapiens
cacacctctgcccctt

SEQ ID NO: 5580519 - DNA, 21 bp, Homo sapiens
cacacctctgccccttgggcc

SEQ ID NO: 5580520 - DNA, 22 bp, Homo sapiens
cacacctctgccccttgggcct

SEQ ID NO: 5580521 - DNA, 22 bp, Homo sapiens
cacacctctggatccctggagg

SEQ ID NO: 5580522 - DNA, 22 bp, Homo sapiens
cacacctctgtccctcaaaatt

SEQ ID NO: 5580523 - DNA, 18 bp, Homo sapiens
cacacctgacaaatggaa

SEQ ID NO: 5580524 - DNA, 13 bp, Homo sapiens
cacacctgagcgc

SEQ ID NO: 5580525 - DNA, 14 bp, Homo sapiens
cacagagaagggaa

SEQ ID NO: 5580526 - DNA, 20 bp, Homo sapiens
cacagagaagtttgtagcca

SEQ ID NO: 5580527 - DNA, 21 bp, Homo sapiens
cacagagaagtttgtagccag

SEQ ID NO: 5580528 - DNA, 18 bp, Homo sapiens
cacagagacggtctggaa

SEQ ID NO: 5580529 - DNA, 20 bp, Homo sapiens
cacagagagacagacttgag

SEQ ID NO: 5580530 - DNA, 22 bp, Homo sapiens
cacagagagacagacttgagaa

SEQ ID NO: 5580531 - DNA, 16 bp, Homo sapiens
cacagagagcggcttc

SEQ ID NO: 5580532 - DNA, 16 bp, Homo sapiens
cacagagaggagggga

SEQ ID NO: 5580533 - DNA, 19 bp, Homo sapiens
cacagagaggaggggacca

SEQ ID NO: 5580534 - DNA, 14 bp, Homo sapiens
cacagagagggaca

SEQ ID NO: 5580535 - DNA, 20 bp, Homo sapiens
cacagagatatgcacacaca

SEQ ID NO: 5580536 - DNA, 23 bp, Homo sapiens
cacagagcaagagataagtcttt

SEQ ID NO: 5580537 - DNA, 15 bp, Homo sapiens
cacagagcacactta

SEQ ID NO: 5580538 - DNA, 15 bp, Homo sapiens
cacagagcacgcctg

SEQ ID NO: 5580539 - DNA, 21 bp, Homo sapiens
cacagagcacgcctgccatct

SEQ ID NO: 5580540 - DNA, 20 bp, Homo sapiens
cacagagcctgcctcagctg

SEQ ID NO: 5580541 - DNA, 22 bp, Homo sapiens
cacagagcctgcctcagctgct

SEQ ID NO: 5580542 - DNA, 14 bp, Homo sapiens
cacagagcctggcc

SEQ ID NO: 5580543 - DNA, 19 bp, Homo sapiens
cacagagcgcctcacctgc

SEQ ID NO: 5580544 - DNA, 13 bp, Homo sapiens
cacagagcgggga

SEQ ID NO: 5580545 - DNA, 14 bp, Homo sapiens
cacagagctctcca

SEQ ID NO: 5580546 - DNA, 18 bp, Homo sapiens
cacagagctctccagctc

SEQ ID NO: 5580547 - DNA, 21 bp, Homo sapiens
cacagagctctccagctccaa

SEQ ID NO: 5580548 - DNA, 20 bp, Homo sapiens
cacagagctggcgactgcag

SEQ ID NO: 5580549 - DNA, 21 bp, Homo sapiens
cacagagctttggtctgtgtg

SEQ ID NO: 5580550 - DNA, 22 bp, Homo sapiens
cacagaggaagaacacagcgca

SEQ ID NO: 5580551 - DNA, 16 bp, Homo sapiens
cacagaggaagagcag

SEQ ID NO: 5580552 - DNA, 16 bp, Homo sapiens
cacagaggacagtgct

SEQ ID NO: 5580553 - DNA, 19 bp, Homo sapiens
cacagaggacagtgctgac

SEQ ID NO: 5580554 - DNA, 16 bp, Homo sapiens
cacagaggacctcttt

SEQ ID NO: 5580555 - DNA, 16 bp, Homo sapiens
cacagaggacggcttc

SEQ ID NO: 5580556 - DNA, 21 bp, Homo sapiens
cacagaggaggtcagcaaagg

SEQ ID NO: 5580557 - DNA, 16 bp, Homo sapiens
cacagaggagtgcagc

SEQ ID NO: 5580558 - DNA, 22 bp, Homo sapiens
cacagaggatgctgacatcatt

SEQ ID NO: 5580559 - DNA, 16 bp, Homo sapiens
cacagaggatggcttc

SEQ ID NO: 5580560 - DNA, 19 bp, Homo sapiens
cacagaggatggcttcccc

SEQ ID NO: 5580561 - DNA, 15 bp, Homo sapiens
cacagaggccaggca

SEQ ID NO: 5580562 - DNA, 17 bp, Homo sapiens
cacagaggccaggcatg

SEQ ID NO: 5580563 - DNA, 11 bp, Homo sapiens
cacagaggccc

SEQ ID NO: 5580564 - DNA, 14 bp, Homo sapiens
cacagaggcctgac

SEQ ID NO: 5580565 - DNA, 14 bp, Homo sapiens
cacagaggctgtgg

SEQ ID NO: 5580566 - DNA, 18 bp, Homo sapiens
cacagaggcttcttcaga

SEQ ID NO: 5580567 - DNA, 22 bp, Homo sapiens
cacagagggaagtttaaaaccc

SEQ ID NO: 5580568 - DNA, 15 bp, Homo sapiens
cacagagggcgctcc

SEQ ID NO: 5580569 - DNA, 17 bp, Homo sapiens
cacagagggcgctcctg

SEQ ID NO: 5580570 - DNA, 18 bp, Homo sapiens
cacagagggctgtgtctt

SEQ ID NO: 5580571 - DNA, 14 bp, Homo sapiens
cacagaggggctcg

SEQ ID NO: 5580572 - DNA, 17 bp, Homo sapiens
cacagagggtcccattg

SEQ ID NO: 5580573 - DNA, 16 bp, Homo sapiens
cacagagtcaaggcct

SEQ ID NO: 5580574 - DNA, 18 bp, Homo sapiens
cacagagtcaaggcctgc

SEQ ID NO: 5580575 - DNA, 16 bp, Homo sapiens
cacagagtctgtgtgt

SEQ ID NO: 5580576 - DNA, 15 bp, Homo sapiens
cacagagtgagactc

SEQ ID NO: 5580577 - DNA, 16 bp, Homo sapiens
cacagagtgagccagt

SEQ ID NO: 5580578 - DNA, 17 bp, Homo sapiens
cacagagtgagccagtg

SEQ ID NO: 5580579 - DNA, 16 bp, Homo sapiens
cacagagtgctggact

SEQ ID NO: 5580580 - DNA, 19 bp, Homo sapiens
cacagagtggagccctcag

SEQ ID NO: 5580581 - DNA, 22 bp, Homo sapiens
cacagagtggagccctcagttt

SEQ ID NO: 5580582 - DNA, 21 bp, Homo sapiens
cacagagtgtagccaggtccc

SEQ ID NO: 5580583 - DNA, 22 bp, Homo sapiens
cacagagtgtggtccctccact

SEQ ID NO: 5580584 - DNA, 17 bp, Homo sapiens
cacagagtgtgtttttg

SEQ ID NO: 5580585 - DNA, 21 bp, Homo sapiens
cacagagtgtgtttttgcact

SEQ ID NO: 5580586 - DNA, 21 bp, Homo sapiens
cacagagttgttacattttta

SEQ ID NO: 5580587 - DNA, 21 bp, Homo sapiens
cacagagtttgtagtaaatat

SEQ ID NO: 5580588 - DNA, 19 bp, Homo sapiens
cacagataacataaataaa

SEQ ID NO: 5580589 - DNA, 19 bp, Homo sapiens
cacagataactgaaaatta

SEQ ID NO: 5580590 - DNA, 14 bp, Homo sapiens
cacagatacatggg

SEQ ID NO: 5580591 - DNA, 15 bp, Homo sapiens
cacagatacatgggg

SEQ ID NO: 5580592 - DNA, 15 bp, Homo sapiens
cacagatacctcatc

SEQ ID NO: 5580593 - DNA, 17 bp, Homo sapiens
cacagatacctcatcat

SEQ ID NO: 5580594 - DNA, 22 bp, Homo sapiens
cacagatacctcatcatccacc

SEQ ID NO: 5580595 - DNA, 20 bp, Homo sapiens
cacagatatacacatggatg

SEQ ID NO: 5580596 - DNA, 19 bp, Homo sapiens
cacagatatactttgtgga

SEQ ID NO: 5580597 - DNA, 20 bp, Homo sapiens
cacagatattgttataaata

SEQ ID NO: 5580598 - DNA, 20 bp, Homo sapiens
cacagatatttccatttctt

SEQ ID NO: 5580599 - DNA, 14 bp, Homo sapiens
cacagatcacagct

SEQ ID NO: 5580600 - DNA, 19 bp, Homo sapiens
cacagatcacagcttcagc

SEQ ID NO: 5580601 - DNA, 15 bp, Homo sapiens
cacagatcccctgga

SEQ ID NO: 5580602 - DNA, 15 bp, Homo sapiens
cacagatctcttgtt

SEQ ID NO: 5580603 - DNA, 22 bp, Homo sapiens
cacagatgaggagcagctgggg

SEQ ID NO: 5580604 - DNA, 13 bp, Homo sapiens
cacagatgaggcc

SEQ ID NO: 5580605 - DNA, 15 bp, Homo sapiens
cacagatgaggcccc

SEQ ID NO: 5580606 - DNA, 22 bp, Homo sapiens
cacagatgccatggcctgtgct

SEQ ID NO: 5580607 - DNA, 16 bp, Homo sapiens
cacagatgctccaggg

SEQ ID NO: 5580608 - DNA, 22 bp, Homo sapiens
cacagatgctggcctcttggca

SEQ ID NO: 5580609 - DNA, 21 bp, Homo sapiens
cacagatggaagaagttttaa

SEQ ID NO: 5580610 - DNA, 20 bp, Homo sapiens
cacagatggatttgcctgtg

SEQ ID NO: 5580611 - DNA, 20 bp, Homo sapiens
cacagatggctttcagggca

SEQ ID NO: 5580612 - DNA, 18 bp, Homo sapiens
cacagatgggcaaaccct

SEQ ID NO: 5580613 - DNA, 19 bp, Homo sapiens
cacagatgggcaaggcctt

SEQ ID NO: 5580614 - DNA, 16 bp, Homo sapiens
cacagatgtaattatg

SEQ ID NO: 5580615 - DNA, 16 bp, Homo sapiens
cacagatgtctctggg

SEQ ID NO: 5580616 - DNA, 18 bp, Homo sapiens
cacagatgtgcccagagt

SEQ ID NO: 5580617 - DNA, 15 bp, Homo sapiens
cacagatgtgtctgg

SEQ ID NO: 5580618 - DNA, 23 bp, Homo sapiens
cacagatgtgtctgggagagcct

SEQ ID NO: 5580619 - DNA, 21 bp, Homo sapiens
cacagattaaacttcacctac

SEQ ID NO: 5580620 - DNA, 19 bp, Homo sapiens
cacagattatgttcctgct

SEQ ID NO: 5580621 - DNA, 23 bp, Homo sapiens
cacagattatgttcctgctgtat

SEQ ID NO: 5580622 - DNA, 13 bp, Homo sapiens
cacagattcccag

SEQ ID NO: 5580623 - DNA, 14 bp, Homo sapiens
cacagattcccagg

SEQ ID NO: 5580624 - DNA, 22 bp, Homo sapiens
cacagattcccaggccagggct

SEQ ID NO: 5580625 - DNA, 18 bp, Homo sapiens
cacagattctttttttct

SEQ ID NO: 5580626 - DNA, 13 bp, Homo sapiens
cacagattgaaga

SEQ ID NO: 5580627 - DNA, 15 bp, Homo sapiens
cacagattgaagaat

SEQ ID NO: 5580628 - DNA, 21 bp, Homo sapiens
cacagattgaagaatctgccc

SEQ ID NO: 5580629 - DNA, 16 bp, Homo sapiens
cacagattgctgaaac

SEQ ID NO: 5580630 - DNA, 20 bp, Homo sapiens
cacagattgtttctatacaa

SEQ ID NO: 5580631 - DNA, 13 bp, Homo sapiens
cacagattttaat

SEQ ID NO: 5580632 - DNA, 16 bp, Homo sapiens
cacagattttaattgt

SEQ ID NO: 5580633 - DNA, 21 bp, Homo sapiens
cacagattttaattgtcatgg

SEQ ID NO: 5580634 - DNA, 14 bp, Homo sapiens
cacagattttgaat

SEQ ID NO: 5580635 - DNA, 19 bp, Homo sapiens
cacagatttttatgttttc

SEQ ID NO: 5580636 - DNA, 21 bp, Homo sapiens
cacagatttttatgttttctt

SEQ ID NO: 5580637 - DNA, 23 bp, Homo sapiens
cacagatttttatgttttctttc

SEQ ID NO: 5580638 - DNA, 17 bp, Homo sapiens
cacagcaaactgtcccc

SEQ ID NO: 5580639 - DNA, 14 bp, Homo sapiens
cacagcaaccccag

SEQ ID NO: 5580640 - DNA, 21 bp, Homo sapiens
cacagcaacgatcacaaatga

SEQ ID NO: 5580641 - DNA, 15 bp, Homo sapiens
cacagcaactgacct

SEQ ID NO: 5580642 - DNA, 18 bp, Homo sapiens
cacagcaaggaggctggc

SEQ ID NO: 5580643 - DNA, 21 bp, Homo sapiens
cacagcaaggaggctggctgg

SEQ ID NO: 5580644 - DNA, 21 bp, Homo sapiens
cacagcacaaacacacctctg

SEQ ID NO: 5580645 - DNA, 16 bp, Homo sapiens
cacagcacaaattagt

SEQ ID NO: 5580646 - DNA, 18 bp, Homo sapiens
cacagcacaaattagtta

SEQ ID NO: 5580647 - DNA, 23 bp, Homo sapiens
cacagcacaaattagttatatat

SEQ ID NO: 5580648 - DNA, 16 bp, Homo sapiens
cacagcacaccagccg

SEQ ID NO: 5580649 - DNA, 17 bp, Homo sapiens
cacagcacaccagccgc

SEQ ID NO: 5580650 - DNA, 20 bp, Homo sapiens
cacagcacaccagccgctgc

SEQ ID NO: 5580651 - DNA, 12 bp, Homo sapiens
cacagcacagcc

SEQ ID NO: 5580652 - DNA, 13 bp, Homo sapiens
cacagcacagctc

SEQ ID NO: 5580653 - DNA, 19 bp, Homo sapiens
cacagcacatgctggccag

SEQ ID NO: 5580654 - DNA, 21 bp, Homo sapiens
cacagcacatgctggccagcc

SEQ ID NO: 5580655 - DNA, 11 bp, Homo sapiens
cacagcacatt

SEQ ID NO: 5580656 - DNA, 18 bp, Homo sapiens
cacagcacccactaccat

SEQ ID NO: 5580657 - DNA, 13 bp, Homo sapiens
cacagcacccagg

SEQ ID NO: 5580658 - DNA, 18 bp, Homo sapiens
cacagcaccgtgccaacc

SEQ ID NO: 5580659 - DNA, 19 bp, Homo sapiens
cacagcaccgtgccaaccc

SEQ ID NO: 5580660 - DNA, 16 bp, Homo sapiens
cacagcacctcctctc

SEQ ID NO: 5580661 - DNA, 22 bp, Homo sapiens
cacagcacctcctctctgctgg

SEQ ID NO: 5580662 - DNA, 15 bp, Homo sapiens
cacagcactgcctgc

SEQ ID NO: 5580663 - DNA, 16 bp, Homo sapiens
cacagcactttggttt

SEQ ID NO: 5580664 - DNA, 14 bp, Homo sapiens
cacagcagaatgaa

SEQ ID NO: 5580665 - DNA, 16 bp, Homo sapiens
cacagcagaatgaaga

SEQ ID NO: 5580666 - DNA, 13 bp, Homo sapiens
cacagcagacacc

SEQ ID NO: 5580667 - DNA, 21 bp, Homo sapiens
cacagcagcacctcctccatg

SEQ ID NO: 5580668 - DNA, 22 bp, Homo sapiens
cacagcagcacctcctccatgc

SEQ ID NO: 5580669 - DNA, 12 bp, Homo sapiens
cacagcagcact

SEQ ID NO: 5580670 - DNA, 18 bp, Homo sapiens
cacagcagcatcttcaaa

SEQ ID NO: 5580671 - DNA, 12 bp, Homo sapiens
cacagcagcccc

SEQ ID NO: 5580672 - DNA, 21 bp, Homo sapiens
cacagcagcctccaacacaag

SEQ ID NO: 5580673 - DNA, 19 bp, Homo sapiens
cacagcagcctgcttccca

SEQ ID NO: 5580674 - DNA, 18 bp, Homo sapiens
cacagcagcgcagccgag

SEQ ID NO: 5580675 - DNA, 21 bp, Homo sapiens
cacagcagcgcagccgagccc

SEQ ID NO: 5580676 - DNA, 12 bp, Homo sapiens
cacagcaggacc

SEQ ID NO: 5580677 - DNA, 12 bp, Homo sapiens
cacagcaggatc

SEQ ID NO: 5580678 - DNA, 15 bp, Homo sapiens
cacagcaggctgcca

SEQ ID NO: 5580679 - DNA, 18 bp, Homo sapiens
cacagcaggggctggccc

SEQ ID NO: 5580680 - DNA, 22 bp, Homo sapiens
cacagcagtacttgctcaataa

SEQ ID NO: 5580681 - DNA, 13 bp, Homo sapiens
cacagcagtcaca

SEQ ID NO: 5580682 - DNA, 13 bp, Homo sapiens
cacagcagtgagt

SEQ ID NO: 5580683 - DNA, 17 bp, Homo sapiens
cacagcagtgtcccctg

SEQ ID NO: 5580684 - DNA, 20 bp, Homo sapiens
cacagcagtgtcccctgccc

SEQ ID NO: 5580685 - DNA, 21 bp, Homo sapiens
cacagcagtgtcccctgcccc

SEQ ID NO: 5580686 - DNA, 22 bp, Homo sapiens
cacagcagtgtcccctgcccca

SEQ ID NO: 5580687 - DNA, 23 bp, Homo sapiens
cacagcagtgtcccctgccccag

SEQ ID NO: 5580688 - DNA, 23 bp, Homo sapiens
cacagcagtgtgaatagcctggc

SEQ ID NO: 5580689 - DNA, 20 bp, Homo sapiens
cacagcatcattttgcattc

SEQ ID NO: 5580690 - DNA, 14 bp, Homo sapiens
cacagcatcgggag

SEQ ID NO: 5580691 - DNA, 15 bp, Homo sapiens
cacagcatcgggagc

SEQ ID NO: 5580692 - DNA, 22 bp, Homo sapiens
cacagcatcgggagcacccaga

SEQ ID NO: 5580693 - DNA, 12 bp, Homo sapiens
cacagcatctca

SEQ ID NO: 5580694 - DNA, 16 bp, Homo sapiens
cacagcatctctatga

SEQ ID NO: 5580695 - DNA, 15 bp, Homo sapiens
cacagcatgcattta

SEQ ID NO: 5580696 - DNA, 19 bp, Homo sapiens
cacagcatgcatttagcat

SEQ ID NO: 5580697 - DNA, 16 bp, Homo sapiens
cacagcatggaggagg

SEQ ID NO: 5580698 - DNA, 22 bp, Homo sapiens
cacagcatggaggaggagggag

SEQ ID NO: 5580699 - DNA, 16 bp, Homo sapiens
cacagcatgggtccag

SEQ ID NO: 5580700 - DNA, 12 bp, Homo sapiens
cacagcatgtgc

SEQ ID NO: 5580701 - DNA, 14 bp, Homo sapiens
cacagcatttcaag

SEQ ID NO: 5580702 - DNA, 21 bp, Homo sapiens
cacaggcctctcttttccccg

SEQ ID NO: 5580703 - DNA, 22 bp, Homo sapiens
cacaggcctctcttttccccgc

SEQ ID NO: 5580704 - DNA, 15 bp, Homo sapiens
cacaggcctctgcct

SEQ ID NO: 5580705 - DNA, 17 bp, Homo sapiens
cacaggcctctgcctgc

SEQ ID NO: 5580706 - DNA, 12 bp, Homo sapiens
cacaggcctggc

SEQ ID NO: 5580707 - DNA, 13 bp, Homo sapiens
cacaggcctggcc

SEQ ID NO: 5580708 - DNA, 19 bp, Homo sapiens
cacaggcctggcccagcca

SEQ ID NO: 5580709 - DNA, 21 bp, Homo sapiens
cacaggcctggcccagccagc

SEQ ID NO: 5580710 - DNA, 16 bp, Homo sapiens
cacaggcctggcctca

SEQ ID NO: 5580711 - DNA, 17 bp, Homo sapiens
cacaggcctggcctcaa

SEQ ID NO: 5580712 - DNA, 13 bp, Homo sapiens
cacaggcctgtgt

SEQ ID NO: 5580713 - DNA, 24 bp, Homo sapiens
cacaggcctgtgtagctgtgacct

SEQ ID NO: 5580714 - DNA, 14 bp, Homo sapiens
cacaggcctgttcc

SEQ ID NO: 5580715 - DNA, 16 bp, Homo sapiens
cacaggccttctgtgg

SEQ ID NO: 5580716 - DNA, 15 bp, Homo sapiens
cacaggctagatccc

SEQ ID NO: 5580717 - DNA, 15 bp, Homo sapiens
cacaggctcaggcag

SEQ ID NO: 5580718 - DNA, 16 bp, Homo sapiens
cacaggctcaggcagg

SEQ ID NO: 5580719 - DNA, 17 bp, Homo sapiens
cacaggctccaaactgg

SEQ ID NO: 5580720 - DNA, 22 bp, Homo sapiens
cacaggctgagtgcaggcccac

SEQ ID NO: 5580721 - DNA, 13 bp, Homo sapiens
cacaggctgcccc

SEQ ID NO: 5580722 - DNA, 15 bp, Homo sapiens
cacaggctgccccac

SEQ ID NO: 5580723 - DNA, 19 bp, Homo sapiens
cacaggctgccccacccct

SEQ ID NO: 5580724 - DNA, 12 bp, Homo sapiens
cacaggctgccg

SEQ ID NO: 5580725 - DNA, 21 bp, Homo sapiens
cacaggctgcctcatgaccct

SEQ ID NO: 5580726 - DNA, 16 bp, Homo sapiens
cacaggctgggctggg

SEQ ID NO: 5580727 - DNA, 18 bp, Homo sapiens
cacaggctgggctgggca

SEQ ID NO: 5580728 - DNA, 22 bp, Homo sapiens
cacaggctgggctgggcactgc

SEQ ID NO: 5580729 - DNA, 14 bp, Homo sapiens
cacaggctgggtca

SEQ ID NO: 5580730 - DNA, 19 bp, Homo sapiens
cacaggctgtaaattgaac

SEQ ID NO: 5580731 - DNA, 19 bp, Homo sapiens
cacaggcttacgctgctct

SEQ ID NO: 5580732 - DNA, 22 bp, Homo sapiens
cacaggcttacgctgctctcct

SEQ ID NO: 5580733 - DNA, 13 bp, Homo sapiens
cacaggcttgctg

SEQ ID NO: 5580734 - DNA, 21 bp, Homo sapiens
cacagggaagggcttggccag

SEQ ID NO: 5580735 - DNA, 22 bp, Homo sapiens
cacagggaatggccacaaacct

SEQ ID NO: 5580736 - DNA, 17 bp, Homo sapiens
cacagggaccagggcca

SEQ ID NO: 5580737 - DNA, 21 bp, Homo sapiens
cacagggacttgaagttgtta

SEQ ID NO: 5580738 - DNA, 17 bp, Homo sapiens
cacagggagaattgaaa

SEQ ID NO: 5580739 - DNA, 13 bp, Homo sapiens
cacagggagctgg

SEQ ID NO: 5580740 - DNA, 16 bp, Homo sapiens
cacagggaggctgcag

SEQ ID NO: 5580741 - DNA, 20 bp, Homo sapiens
cacagggagtgcacatatcc

SEQ ID NO: 5580742 - DNA, 19 bp, Homo sapiens
cacagggcaccagaggccg

SEQ ID NO: 5580743 - DNA, 13 bp, Homo sapiens
cacagggcagagc

SEQ ID NO: 5580744 - DNA, 14 bp, Homo sapiens
cacagggcagagcc

SEQ ID NO: 5580745 - DNA, 16 bp, Homo sapiens
cacagggcagctgggc

SEQ ID NO: 5580746 - DNA, 21 bp, Homo sapiens
cacagggcagctgggcccaac

SEQ ID NO: 5580747 - DNA, 22 bp, Homo sapiens
cacagggcagctgggcccaacc

SEQ ID NO: 5580748 - DNA, 12 bp, Homo sapiens
cacagggcaggc

SEQ ID NO: 5580749 - DNA, 17 bp, Homo sapiens
cacagggcaggggtggt

SEQ ID NO: 5580750 - DNA, 15 bp, Homo sapiens
cacagggcagtacct

SEQ ID NO: 5580751 - DNA, 18 bp, Homo sapiens
cacagggcagtacctgag

SEQ ID NO: 5580752 - DNA, 15 bp, Homo sapiens
cacagggcatgcctg

SEQ ID NO: 5580753 - DNA, 19 bp, Homo sapiens
cacagggcatgcctggcct

SEQ ID NO: 5580754 - DNA, 14 bp, Homo sapiens
cacagggccagagg

SEQ ID NO: 5580755 - DNA, 15 bp, Homo sapiens
cacagggccagaggg

SEQ ID NO: 5580756 - DNA, 14 bp, Homo sapiens
cacagggccccaga

SEQ ID NO: 5580757 - DNA, 22 bp, Homo sapiens
cacagggccccagaaggcaggg

SEQ ID NO: 5580758 - DNA, 18 bp, Homo sapiens
cacagggcctgactttta

SEQ ID NO: 5580759 - DNA, 19 bp, Homo sapiens
cacagggcctgacttttac

SEQ ID NO: 5580760 - DNA, 18 bp, Homo sapiens
cacagggcctggcccatg

SEQ ID NO: 5580761 - DNA, 22 bp, Homo sapiens
cacagggcgaggggttggtggg

SEQ ID NO: 5580762 - DNA, 14 bp, Homo sapiens
cacagggcggtacc

SEQ ID NO: 5580763 - DNA, 21 bp, Homo sapiens
cacagggcggtaccttgtgcc

SEQ ID NO: 5580764 - DNA, 14 bp, Homo sapiens
cacagggctcacag

SEQ ID NO: 5580765 - DNA, 18 bp, Homo sapiens
cacagggctcacagggca

SEQ ID NO: 5580766 - DNA, 19 bp, Homo sapiens
cacagggctcacagggcag

SEQ ID NO: 5580767 - DNA, 20 bp, Homo sapiens
cacagggctcacagggcagg

SEQ ID NO: 5580768 - DNA, 21 bp, Homo sapiens
cacagggctgttttgcctccc

SEQ ID NO: 5580769 - DNA, 15 bp, Homo sapiens
cacaggggacactga

SEQ ID NO: 5580770 - DNA, 17 bp, Homo sapiens
cacaggggacagggctg

SEQ ID NO: 5580771 - DNA, 15 bp, Homo sapiens
cacaggggcaggcct

SEQ ID NO: 5580772 - DNA, 17 bp, Homo sapiens
cacaggggcaggcctgg

SEQ ID NO: 5580773 - DNA, 19 bp, Homo sapiens
cacaggggcaggcctggga

SEQ ID NO: 5580774 - DNA, 16 bp, Homo sapiens
cacaggggccaccacc

SEQ ID NO: 5580775 - DNA, 14 bp, Homo sapiens
cacaggggccccag

SEQ ID NO: 5580776 - DNA, 18 bp, Homo sapiens
cacaggggccccagatct

SEQ ID NO: 5580777 - DNA, 19 bp, Homo sapiens
cacaggggccccagatctg

SEQ ID NO: 5580778 - DNA, 23 bp, Homo sapiens
cacaggggccccagatctgcctg

SEQ ID NO: 5580779 - DNA, 21 bp, Homo sapiens
cacaggggccctgtacagtga

SEQ ID NO: 5580780 - DNA, 16 bp, Homo sapiens
cacaggggcggggcag

SEQ ID NO: 5580781 - DNA, 20 bp, Homo sapiens
cacagggggattctgagcag

SEQ ID NO: 5580782 - DNA, 21 bp, Homo sapiens
cacagggggattctgagcagt

SEQ ID NO: 5580783 - DNA, 21 bp, Homo sapiens
cacaggggtggagtttctgac

SEQ ID NO: 5580784 - DNA, 21 bp, Homo sapiens
cacaggggtgtttgtgtgtgt

SEQ ID NO: 5580785 - DNA, 23 bp, Homo sapiens
cacagggtactaaaagaaactat

SEQ ID NO: 5580786 - DNA, 14 bp, Homo sapiens
cacagggtctgcac

SEQ ID NO: 5580787 - DNA, 15 bp, Homo sapiens
cacagggtctgcctc

SEQ ID NO: 5580788 - DNA, 16 bp, Homo sapiens
cacagggtctgcctcc

SEQ ID NO: 5580789 - DNA, 17 bp, Homo sapiens
cacagggtctgctcttt

SEQ ID NO: 5580790 - DNA, 20 bp, Homo sapiens
cacagggtgagggccacctc

SEQ ID NO: 5580791 - DNA, 21 bp, Homo sapiens
cacagggtgagggccacctcc

SEQ ID NO: 5580792 - DNA, 16 bp, Homo sapiens
cacagggttgggccca

SEQ ID NO: 5580793 - DNA, 15 bp, Homo sapiens
cacaggtcctccatc

SEQ ID NO: 5580794 - DNA, 16 bp, Homo sapiens
cacaggtcctccatca

SEQ ID NO: 5580795 - DNA, 21 bp, Homo sapiens
cacaggtcttcactgcccagg

SEQ ID NO: 5580796 - DNA, 22 bp, Homo sapiens
cacaggtcttcactgcccaggg

SEQ ID NO: 5580797 - DNA, 15 bp, Homo sapiens
cacaggtctttccta

SEQ ID NO: 5580798 - DNA, 20 bp, Homo sapiens
cacaggtctttcctaaggct

SEQ ID NO: 5580799 - DNA, 22 bp, Homo sapiens
cacaggtgaggggcaggacctg

SEQ ID NO: 5580800 - DNA, 18 bp, Homo sapiens
cacaggtgcccgccacca

SEQ ID NO: 5580801 - DNA, 22 bp, Homo sapiens
cacaggtgccgccagctgccgc

SEQ ID NO: 5580802 - DNA, 18 bp, Homo sapiens
cacaggtgcgggaccatc

SEQ ID NO: 5580803 - DNA, 20 bp, Homo sapiens
cacaggtgcgggaccatctg

SEQ ID NO: 5580804 - DNA, 19 bp, Homo sapiens
cacaggtggggactgggca

SEQ ID NO: 5580805 - DNA, 16 bp, Homo sapiens
cacaggtgtcagccat

SEQ ID NO: 5580806 - DNA, 21 bp, Homo sapiens
cacaggtgtccccagcccact

SEQ ID NO: 5580807 - DNA, 16 bp, Homo sapiens
cacaggtgtggtgtaa

SEQ ID NO: 5580808 - DNA, 22 bp, Homo sapiens
cacaggtgttccgtgggaccct

SEQ ID NO: 5580809 - DNA, 17 bp, Homo sapiens
cacaggtgttggaagcc

SEQ ID NO: 5580810 - DNA, 23 bp, Homo sapiens
cacaggttagggtgtgtgccaca

SEQ ID NO: 5580811 - DNA, 20 bp, Homo sapiens
cacaggttcacgtgcagctc

SEQ ID NO: 5580812 - DNA, 14 bp, Homo sapiens
cacaggttccatag

SEQ ID NO: 5580813 - DNA, 15 bp, Homo sapiens
cacaggttggaagag

SEQ ID NO: 5580814 - DNA, 15 bp, Homo sapiens
cacaggtttagttga

SEQ ID NO: 5580815 - DNA, 18 bp, Homo sapiens
cacaggtttgttttttca

SEQ ID NO: 5580816 - DNA, 18 bp, Homo sapiens
cacaggttttagcattgt

SEQ ID NO: 5580817 - DNA, 14 bp, Homo sapiens
cacagtaaaaataa

SEQ ID NO: 5580818 - DNA, 16 bp, Homo sapiens
cacagtaaaaataaaa

SEQ ID NO: 5580819 - DNA, 17 bp, Homo sapiens
cacagtaaaaataaaat

SEQ ID NO: 5580820 - DNA, 13 bp, Homo sapiens
cacagtaaagagt

SEQ ID NO: 5580821 - DNA, 20 bp, Homo sapiens
cacagtaatctttcggtctc

SEQ ID NO: 5580822 - DNA, 15 bp, Homo sapiens
cacagtaatgtagaa

SEQ ID NO: 5580823 - DNA, 17 bp, Homo sapiens
cacagtaatgtagaaat

SEQ ID NO: 5580824 - DNA, 15 bp, Homo sapiens
cacagtacaataatg

SEQ ID NO: 5580825 - DNA, 18 bp, Homo sapiens
cacagtacaataatgtac

SEQ ID NO: 5580826 - DNA, 21 bp, Homo sapiens
cacagtacaataatgtactca

SEQ ID NO: 5580827 - DNA, 18 bp, Homo sapiens
cacagtacacacaaaaac

SEQ ID NO: 5580828 - DNA, 16 bp, Homo sapiens
cacagtacataataca

SEQ ID NO: 5580829 - DNA, 18 bp, Homo sapiens
cacagtaccggattctct

SEQ ID NO: 5580830 - DNA, 20 bp, Homo sapiens
cacagtagaactgtctgtga

SEQ ID NO: 5580831 - DNA, 16 bp, Homo sapiens
cacagtagagccagct

SEQ ID NO: 5580832 - DNA, 17 bp, Homo sapiens
cacagtagagccagctt

SEQ ID NO: 5580833 - DNA, 15 bp, Homo sapiens
cacagtagagtaggg

SEQ ID NO: 5580834 - DNA, 19 bp, Homo sapiens
cacagtagagtagggtaga

SEQ ID NO: 5580835 - DNA, 13 bp, Homo sapiens
cacagtaggatgt

SEQ ID NO: 5580836 - DNA, 24 bp, Homo sapiens
cacagtaggtcccggccagctctg

SEQ ID NO: 5580837 - DNA, 22 bp, Homo sapiens
cacagtagtgttctgttcactt

SEQ ID NO: 5580838 - DNA, 21 bp, Homo sapiens
cacagtagtgttgggtggagg

SEQ ID NO: 5580839 - DNA, 23 bp, Homo sapiens
cacagtagtgttgggtggaggat

SEQ ID NO: 5580840 - DNA, 19 bp, Homo sapiens
cacagtatattttatttca

SEQ ID NO: 5580841 - DNA, 17 bp, Homo sapiens
cacagtatctgctgttc

SEQ ID NO: 5580842 - DNA, 22 bp, Homo sapiens
cacagtatctgctgttcttcag

SEQ ID NO: 5580843 - DNA, 22 bp, Homo sapiens
cacagtatgagaagaaaaatgg

SEQ ID NO: 5580844 - DNA, 15 bp, Homo sapiens
cacagtatgggctac

SEQ ID NO: 5580845 - DNA, 19 bp, Homo sapiens
cacagtattacttctgcta

SEQ ID NO: 5580846 - DNA, 13 bp, Homo sapiens
cacagtattatgc

SEQ ID NO: 5580847 - DNA, 15 bp, Homo sapiens
cacagtattgctcac

SEQ ID NO: 5580848 - DNA, 19 bp, Homo sapiens
cacagtattgttcttgtaa

SEQ ID NO: 5580849 - DNA, 14 bp, Homo sapiens
cacagtatttgtaa

SEQ ID NO: 5580850 - DNA, 23 bp, Homo sapiens
cacagtcacccctccctccctct

SEQ ID NO: 5580851 - DNA, 19 bp, Homo sapiens
cacagtcactgatgtacaa

SEQ ID NO: 5580852 - DNA, 15 bp, Homo sapiens
cacagtcagaaggac

SEQ ID NO: 5580853 - DNA, 21 bp, Homo sapiens
cacagtcagaaggacggcagg

SEQ ID NO: 5580854 - DNA, 24 bp, Homo sapiens
cacagtcagggcggggctggccag

SEQ ID NO: 5580855 - DNA, 13 bp, Homo sapiens
cacagtcaggggc

SEQ ID NO: 5580856 - DNA, 13 bp, Homo sapiens
cacagtcagtgga

SEQ ID NO: 5580857 - DNA, 19 bp, Homo sapiens
cacagtcatggtggccacg

SEQ ID NO: 5580858 - DNA, 20 bp, Homo sapiens
cacagtccacagctgaagag

SEQ ID NO: 5580859 - DNA, 17 bp, Homo sapiens
cacagtcccactgtgca

SEQ ID NO: 5580860 - DNA, 17 bp, Homo sapiens
cacagtcccccacccac

SEQ ID NO: 5580861 - DNA, 21 bp, Homo sapiens
cacagtcccccacccacctcc

SEQ ID NO: 5580862 - DNA, 17 bp, Homo sapiens
cacagtccctcctgttg

SEQ ID NO: 5580863 - DNA, 21 bp, Homo sapiens
cacagtcctatgtacagagct

SEQ ID NO: 5580864 - DNA, 18 bp, Homo sapiens
cacagtcctcacacacgg

SEQ ID NO: 5580865 - DNA, 17 bp, Homo sapiens
cacagtcctcacagcct

SEQ ID NO: 5580866 - DNA, 20 bp, Homo sapiens
cacagtcctcacagcctctc

SEQ ID NO: 5580867 - DNA, 16 bp, Homo sapiens
cacagtctagattaga

SEQ ID NO: 5580868 - DNA, 13 bp, Homo sapiens
cacagtctcagtc

SEQ ID NO: 5580869 - DNA, 19 bp, Homo sapiens
cacagtctcagttctcttg

SEQ ID NO: 5580870 - DNA, 18 bp, Homo sapiens
cacagtctctccctgggg

SEQ ID NO: 5580871 - DNA, 13 bp, Homo sapiens
cacagtctctgga

SEQ ID NO: 5580872 - DNA, 15 bp, Homo sapiens
cacagtctctggaaa

SEQ ID NO: 5580873 - DNA, 22 bp, Homo sapiens
cacagtctctttaatcttcagt

SEQ ID NO: 5580874 - DNA, 22 bp, Homo sapiens
cacagtctggtgcttgggagag

SEQ ID NO: 5580875 - DNA, 12 bp, Homo sapiens
cacagtcttctg

SEQ ID NO: 5580876 - DNA, 14 bp, Homo sapiens
cacagtcttgtgaa

SEQ ID NO: 5580877 - DNA, 17 bp, Homo sapiens
cacagtgaaggctgtcc

SEQ ID NO: 5580878 - DNA, 22 bp, Homo sapiens
cacatagttctgtaataaaact

SEQ ID NO: 5580879 - DNA, 21 bp, Homo sapiens
cacatataaacacagtaagat

SEQ ID NO: 5580880 - DNA, 22 bp, Homo sapiens
cacatataaatgtactttttct

SEQ ID NO: 5580881 - DNA, 15 bp, Homo sapiens
cacatataacactta

SEQ ID NO: 5580882 - DNA, 14 bp, Homo sapiens
cacatataacatgc

SEQ ID NO: 5580883 - DNA, 15 bp, Homo sapiens
cacatatacacacac

SEQ ID NO: 5580884 - DNA, 12 bp, Homo sapiens
cacatatacata

SEQ ID NO: 5580885 - DNA, 14 bp, Homo sapiens
cacatatacatcta

SEQ ID NO: 5580886 - DNA, 12 bp, Homo sapiens
cacatatacatt

SEQ ID NO: 5580887 - DNA, 18 bp, Homo sapiens
cacatatacctataatgt

SEQ ID NO: 5580888 - DNA, 15 bp, Homo sapiens
cacatatatacatac

SEQ ID NO: 5580889 - DNA, 18 bp, Homo sapiens
cacatatatacatacgca

SEQ ID NO: 5580890 - DNA, 15 bp, Homo sapiens
cacatatatatccta

SEQ ID NO: 5580891 - DNA, 15 bp, Homo sapiens
cacatatatgtatat

SEQ ID NO: 5580892 - DNA, 18 bp, Homo sapiens
cacatatccaggcaccag

SEQ ID NO: 5580893 - DNA, 17 bp, Homo sapiens
cacatatcttacagcca

SEQ ID NO: 5580894 - DNA, 17 bp, Homo sapiens
cacatatgggtgctggc

SEQ ID NO: 5580895 - DNA, 16 bp, Homo sapiens
cacatatgtctgtatc

SEQ ID NO: 5580896 - DNA, 16 bp, Homo sapiens
cacatattattggtca

SEQ ID NO: 5580897 - DNA, 15 bp, Homo sapiens
cacatattcaaattc

SEQ ID NO: 5580898 - DNA, 18 bp, Homo sapiens
cacatattctattataga

SEQ ID NO: 5580899 - DNA, 13 bp, Homo sapiens
cacatattgaaaa

SEQ ID NO: 5580900 - DNA, 20 bp, Homo sapiens
cacatattgatttccgttaa

SEQ ID NO: 5580901 - DNA, 15 bp, Homo sapiens
cacatatttgatagt

SEQ ID NO: 5580902 - DNA, 14 bp, Homo sapiens
cacatcaaaccttt

SEQ ID NO: 5580903 - DNA, 14 bp, Homo sapiens
cacatcaaataaga

SEQ ID NO: 5580904 - DNA, 12 bp, Homo sapiens
cacatcaacatt

SEQ ID NO: 5580905 - DNA, 16 bp, Homo sapiens
cacatcaactttatgt

SEQ ID NO: 5580906 - DNA, 13 bp, Homo sapiens
cacatcaagcttt

SEQ ID NO: 5580907 - DNA, 20 bp, Homo sapiens
cacatcacaagactatgcca

SEQ ID NO: 5580908 - DNA, 13 bp, Homo sapiens
cacatcacctctt

SEQ ID NO: 5580909 - DNA, 22 bp, Homo sapiens
cacatcacctctttgcccccga

SEQ ID NO: 5580910 - DNA, 20 bp, Homo sapiens
cacatcacgaaggaaaactg

SEQ ID NO: 5580911 - DNA, 21 bp, Homo sapiens
cacatcacgaaggaaaactgc

SEQ ID NO: 5580912 - DNA, 23 bp, Homo sapiens
cacatcacgaaggaaaactgcca

SEQ ID NO: 5580913 - DNA, 11 bp, Homo sapiens
cacatcactga

SEQ ID NO: 5580914 - DNA, 15 bp, Homo sapiens
cacatcagaaaggaa

SEQ ID NO: 5580915 - DNA, 19 bp, Homo sapiens
cacatcagcacgatttctg

SEQ ID NO: 5580916 - DNA, 20 bp, Homo sapiens
cacatcagcacgatttctgt

SEQ ID NO: 5580917 - DNA, 22 bp, Homo sapiens
cacatcagcacgatttctgttt

SEQ ID NO: 5580918 - DNA, 23 bp, Homo sapiens
cacatcagcatgttttctgcttt

SEQ ID NO: 5580919 - DNA, 23 bp, Homo sapiens
cacatcagcttgccctgttaaaa

SEQ ID NO: 5580920 - DNA, 22 bp, Homo sapiens
cacatcagggcggcctcccagg

SEQ ID NO: 5580921 - DNA, 19 bp, Homo sapiens
cacatcatattctattgtt

SEQ ID NO: 5580922 - DNA, 22 bp, Homo sapiens
cacatcatgtaatagtggcttt

SEQ ID NO: 5580923 - DNA, 13 bp, Homo sapiens
cacatcatgttac

SEQ ID NO: 5580924 - DNA, 18 bp, Homo sapiens
cacatcattcattcactg

SEQ ID NO: 5580925 - DNA, 19 bp, Homo sapiens
cacatcatttgggatacca

SEQ ID NO: 5580926 - DNA, 12 bp, Homo sapiens
cacatccaactc

SEQ ID NO: 5580927 - DNA, 20 bp, Homo sapiens
cacatccaccaaactcctgc

SEQ ID NO: 5580928 - DNA, 22 bp, Homo sapiens
cacatccagctgcccctccctc

SEQ ID NO: 5580929 - DNA, 16 bp, Homo sapiens
cacatccatctacttt

SEQ ID NO: 5580930 - DNA, 17 bp, Homo sapiens
cacatccattccagagc

SEQ ID NO: 5580931 - DNA, 14 bp, Homo sapiens
cacatccattccca

SEQ ID NO: 5580932 - DNA, 23 bp, Homo sapiens
cacatccatttcatctatttctg

SEQ ID NO: 5580933 - DNA, 15 bp, Homo sapiens
cacatcccagcagcc

SEQ ID NO: 5580934 - DNA, 14 bp, Homo sapiens
cacatcccagccca

SEQ ID NO: 5580935 - DNA, 15 bp, Homo sapiens
cacatcccagcccaa

SEQ ID NO: 5580936 - DNA, 12 bp, Homo sapiens
cacatcccagga

SEQ ID NO: 5580937 - DNA, 13 bp, Homo sapiens
cacatcccaggag

SEQ ID NO: 5580938 - DNA, 22 bp, Homo sapiens
cacatcccaggcttcaccctga

SEQ ID NO: 5580939 - DNA, 16 bp, Homo sapiens
cacatcccattgggac

SEQ ID NO: 5580940 - DNA, 23 bp, Homo sapiens
cacatcccattgggactccatgc

SEQ ID NO: 5580941 - DNA, 15 bp, Homo sapiens
cacatccccaaaggt

SEQ ID NO: 5580942 - DNA, 13 bp, Homo sapiens
cacatccccacct

SEQ ID NO: 5580943 - DNA, 21 bp, Homo sapiens
cacatccccagagcccagctc

SEQ ID NO: 5580944 - DNA, 23 bp, Homo sapiens
cacatccccagagcccagctctt

SEQ ID NO: 5580945 - DNA, 17 bp, Homo sapiens
cacatccccagccaggg

SEQ ID NO: 5580946 - DNA, 18 bp, Homo sapiens
cacatccccgctggctgg

SEQ ID NO: 5580947 - DNA, 17 bp, Homo sapiens
cacatcccggcctcttc

SEQ ID NO: 5580948 - DNA, 20 bp, Homo sapiens
cacatcccggcctcttccac

SEQ ID NO: 5580949 - DNA, 21 bp, Homo sapiens
cacatcccggcctcttccacc

SEQ ID NO: 5580950 - DNA, 17 bp, Homo sapiens
cacatccctaacatcat

SEQ ID NO: 5580951 - DNA, 19 bp, Homo sapiens
cacatccctgccctcctac

SEQ ID NO: 5580952 - DNA, 17 bp, Homo sapiens
cacatcccttcatatca

SEQ ID NO: 5580953 - DNA, 17 bp, Homo sapiens
cacatccgccttttgta

SEQ ID NO: 5580954 - DNA, 15 bp, Homo sapiens
cacatcctcctgccc

SEQ ID NO: 5580955 - DNA, 18 bp, Homo sapiens
cacatcctcctgcccagc

SEQ ID NO: 5580956 - DNA, 13 bp, Homo sapiens
cacatcctctcca

SEQ ID NO: 5580957 - DNA, 18 bp, Homo sapiens
cacatccttctcactgcc

SEQ ID NO: 5580958 - DNA, 15 bp, Homo sapiens
cacatcctttctaaa

SEQ ID NO: 5580959 - DNA, 17 bp, Homo sapiens
cacatcgcagcccctgt

SEQ ID NO: 5580960 - DNA, 14 bp, Homo sapiens
cacatctaaagctt

SEQ ID NO: 5580961 - DNA, 17 bp, Homo sapiens
cacatctaacctcatct

SEQ ID NO: 5580962 - DNA, 22 bp, Homo sapiens
cacatctagtagttgttctgaa

SEQ ID NO: 5580963 - DNA, 21 bp, Homo sapiens
cacatctcaacaggcctcagg

SEQ ID NO: 5580964 - DNA, 13 bp, Homo sapiens
cacatctcaggga

SEQ ID NO: 5580965 - DNA, 22 bp, Homo sapiens
cacatctcagggaactgaccct

SEQ ID NO: 5580966 - DNA, 17 bp, Homo sapiens
cacatctccagaaaaat

SEQ ID NO: 5580967 - DNA, 22 bp, Homo sapiens
cacatctcccccatagcaccct

SEQ ID NO: 5580968 - DNA, 14 bp, Homo sapiens
cacatctctggaaa

SEQ ID NO: 5580969 - DNA, 19 bp, Homo sapiens
cacatctcttagtccctct

SEQ ID NO: 5580970 - DNA, 18 bp, Homo sapiens
cacatctgaatctccttg

SEQ ID NO: 5580971 - DNA, 13 bp, Homo sapiens
cacatctgcattt

SEQ ID NO: 5580972 - DNA, 21 bp, Homo sapiens
cacatctgcattttcacccca

SEQ ID NO: 5580973 - DNA, 15 bp, Homo sapiens
cacatctgcctcctc

SEQ ID NO: 5580974 - DNA, 12 bp, Homo sapiens
cacatctggctg

SEQ ID NO: 5580975 - DNA, 18 bp, Homo sapiens
cacatctgggtgccctga

SEQ ID NO: 5580976 - DNA, 18 bp, Homo sapiens
cacatctgtcctcaccct

SEQ ID NO: 5580977 - DNA, 15 bp, Homo sapiens
cacatctgtggagat

SEQ ID NO: 5580978 - DNA, 18 bp, Homo sapiens
cacatctgtgtcttgttt

SEQ ID NO: 5580979 - DNA, 15 bp, Homo sapiens
cacatctgtttcaaa

SEQ ID NO: 5580980 - DNA, 15 bp, Homo sapiens
cacatctgttttgta

SEQ ID NO: 5580981 - DNA, 16 bp, Homo sapiens
cacatcttacctctca

SEQ ID NO: 5580982 - DNA, 12 bp, Homo sapiens
cacatcttccct

SEQ ID NO: 5580983 - DNA, 21 bp, Homo sapiens
cacatcttgaaaatgccacca

SEQ ID NO: 5580984 - DNA, 22 bp, Homo sapiens
cacatcttgctctgctgacaga

SEQ ID NO: 5580985 - DNA, 23 bp, Homo sapiens
cacatcttgctctgctgacagac

SEQ ID NO: 5580986 - DNA, 13 bp, Homo sapiens
cacatcttggcac

SEQ ID NO: 5580987 - DNA, 14 bp, Homo sapiens
cacatcttgtcttt

SEQ ID NO: 5580988 - DNA, 13 bp, Homo sapiens
cacatctttactc

SEQ ID NO: 5580989 - DNA, 22 bp, Homo sapiens
cacatctttatctgttcttgct

SEQ ID NO: 5580990 - DNA, 21 bp, Homo sapiens
cacatctttcctcaagtatct

SEQ ID NO: 5580991 - DNA, 14 bp, Homo sapiens
cacatctttcctgt

SEQ ID NO: 5580992 - DNA, 15 bp, Homo sapiens
cacatctttttcact

SEQ ID NO: 5580993 - DNA, 18 bp, Homo sapiens
cacatgaaccatccttcc

SEQ ID NO: 5580994 - DNA, 23 bp, Homo sapiens
cacatgaacttagattttacatg

SEQ ID NO: 5580995 - DNA, 18 bp, Homo sapiens
cacatgaagaaatactgc

SEQ ID NO: 5580996 - DNA, 20 bp, Homo sapiens
cacatgaagtccaagcattt

SEQ ID NO: 5580997 - DNA, 20 bp, Homo sapiens
cacatgaatctgcacatctg

SEQ ID NO: 5580998 - DNA, 18 bp, Homo sapiens
cacatgaattattacagt

SEQ ID NO: 5580999 - DNA, 20 bp, Homo sapiens
cacatgacatttgtcctgca

SEQ ID NO: 5581000 - DNA, 21 bp, Homo sapiens
cacatgacatttgtcctgcag

SEQ ID NO: 5581001 - DNA, 23 bp, Homo sapiens
cacatgacctgatcactagcctg

SEQ ID NO: 5581002 - DNA, 22 bp, Homo sapiens
cacatgactctcattttattta

SEQ ID NO: 5581003 - DNA, 19 bp, Homo sapiens
cacatgacttattatgcat

SEQ ID NO: 5581004 - DNA, 17 bp, Homo sapiens
cacatgagcatcaggcc

SEQ ID NO: 5581005 - DNA, 20 bp, Homo sapiens
cacatgagcatcaggccagg

SEQ ID NO: 5581006 - DNA, 21 bp, Homo sapiens
cacatgagcatcaggccaggc

SEQ ID NO: 5581007 - DNA, 13 bp, Homo sapiens
cacatgaggaggg

SEQ ID NO: 5581008 - DNA, 16 bp, Homo sapiens
cacatgaggccatctc

SEQ ID NO: 5581009 - DNA, 17 bp, Homo sapiens
cacatgagtcccagtgg

SEQ ID NO: 5581010 - DNA, 16 bp, Homo sapiens
cacatgattccagcca

SEQ ID NO: 5581011 - DNA, 17 bp, Homo sapiens
cacatgatttcacaaat

SEQ ID NO: 5581012 - DNA, 20 bp, Homo sapiens
cacatgatttcacaaatatt

SEQ ID NO: 5581013 - DNA, 13 bp, Homo sapiens
cacatgattttct

SEQ ID NO: 5581014 - DNA, 18 bp, Homo sapiens
cacatgattttcttttgt

SEQ ID NO: 5581015 - DNA, 19 bp, Homo sapiens
cacatgcaaggtcattttt

SEQ ID NO: 5581016 - DNA, 14 bp, Homo sapiens
cacatgcacatgta

SEQ ID NO: 5581017 - DNA, 18 bp, Homo sapiens
cacatgcacgtgtgtgca

SEQ ID NO: 5581018 - DNA, 15 bp, Homo sapiens
cacatgcactcagtg

SEQ ID NO: 5581019 - DNA, 21 bp, Homo sapiens
cacatgcacttttgggccttt

SEQ ID NO: 5581020 - DNA, 18 bp, Homo sapiens
cacatgcagaataatcct

SEQ ID NO: 5581021 - DNA, 14 bp, Homo sapiens
cacatgccactgcc

SEQ ID NO: 5581022 - DNA, 19 bp, Homo sapiens
cacatgccactgcctgcac

SEQ ID NO: 5581023 - DNA, 16 bp, Homo sapiens
cacatgccccaggctc

SEQ ID NO: 5581024 - DNA, 14 bp, Homo sapiens
cacatgcccctccc

SEQ ID NO: 5581025 - DNA, 22 bp, Homo sapiens
cacatgcccctcttagaagaaa

SEQ ID NO: 5581026 - DNA, 18 bp, Homo sapiens
cacatgccctaatgtctg

SEQ ID NO: 5581027 - DNA, 15 bp, Homo sapiens
cacatgccctcctgg

SEQ ID NO: 5581028 - DNA, 17 bp, Homo sapiens
cacatgccctcctggac

SEQ ID NO: 5581029 - DNA, 18 bp, Homo sapiens
cacatgcctctctcaggc

SEQ ID NO: 5581030 - DNA, 21 bp, Homo sapiens
cacatgcctctctcaggccaa

SEQ ID NO: 5581031 - DNA, 16 bp, Homo sapiens
cacatgcgctcctggc

SEQ ID NO: 5581032 - DNA, 21 bp, Homo sapiens
cacatgcgggctcgcccatac

SEQ ID NO: 5581033 - DNA, 13 bp, Homo sapiens
cacatgctatgtt

SEQ ID NO: 5581034 - DNA, 20 bp, Homo sapiens
cacatgctctcaatatataa

SEQ ID NO: 5581035 - DNA, 20 bp, Homo sapiens
cacatgctgaggttttgaat

SEQ ID NO: 5581036 - DNA, 17 bp, Homo sapiens
cacatgctgagtctccc

SEQ ID NO: 5581037 - DNA, 18 bp, Homo sapiens
cacatgctgagtctccca

SEQ ID NO: 5581038 - DNA, 17 bp, Homo sapiens
cacatgctgcctggcac

SEQ ID NO: 5581039 - DNA, 14 bp, Homo sapiens
cacatgctggacag

SEQ ID NO: 5581040 - DNA, 23 bp, Homo sapiens
cacatgctggacaggtctgggag

SEQ ID NO: 5581041 - DNA, 15 bp, Homo sapiens
cacatgctggccagc

SEQ ID NO: 5581042 - DNA, 18 bp, Homo sapiens
cacatgctggccagcctg

SEQ ID NO: 5581043 - DNA, 15 bp, Homo sapiens
cacatgctggctcct

SEQ ID NO: 5581044 - DNA, 17 bp, Homo sapiens
cacatgctggctcctga

SEQ ID NO: 5581045 - DNA, 21 bp, Homo sapiens
cacatgctgtctggccctggg

SEQ ID NO: 5581046 - DNA, 21 bp, Homo sapiens
cacatggaacttaaaacatat

SEQ ID NO: 5581047 - DNA, 15 bp, Homo sapiens
cacatggaatgaggg

SEQ ID NO: 5581048 - DNA, 15 bp, Homo sapiens
cacatggacagactt

SEQ ID NO: 5581049 - DNA, 22 bp, Homo sapiens
cacatggagccccctctgccgg

SEQ ID NO: 5581050 - DNA, 17 bp, Homo sapiens
cacatggcagatgattt

SEQ ID NO: 5581051 - DNA, 15 bp, Homo sapiens
cacatggcagatttg

SEQ ID NO: 5581052 - DNA, 15 bp, Homo sapiens
cacatggcatgtttt

SEQ ID NO: 5581053 - DNA, 18 bp, Homo sapiens
cacatggccatagaggcc

SEQ ID NO: 5581054 - DNA, 22 bp, Homo sapiens
cacatggccatagaggcccagg

SEQ ID NO: 5581055 - DNA, 21 bp, Homo sapiens
cacattttcttaatccagtct

SEQ ID NO: 5581056 - DNA, 22 bp, Homo sapiens
cacattttgacacaatgttgca

SEQ ID NO: 5581057 - DNA, 14 bp, Homo sapiens
cacattttgcttta

SEQ ID NO: 5581058 - DNA, 22 bp, Homo sapiens
cacattttgtaaatctgtactt

SEQ ID NO: 5581059 - DNA, 12 bp, Homo sapiens
cacattttgtac

SEQ ID NO: 5581060 - DNA, 18 bp, Homo sapiens
cacattttgtacattgtg

SEQ ID NO: 5581061 - DNA, 16 bp, Homo sapiens
cacattttgtataatt

SEQ ID NO: 5581062 - DNA, 21 bp, Homo sapiens
cacattttgtataattgtatc

SEQ ID NO: 5581063 - DNA, 15 bp, Homo sapiens
cacattttgtatgga

SEQ ID NO: 5581064 - DNA, 20 bp, Homo sapiens
cacattttgtggctgttgag

SEQ ID NO: 5581065 - DNA, 16 bp, Homo sapiens
cacatttttaaattgt

SEQ ID NO: 5581066 - DNA, 13 bp, Homo sapiens
cacatttttctta

SEQ ID NO: 5581067 - DNA, 14 bp, Homo sapiens
cacatttttcttag

SEQ ID NO: 5581068 - DNA, 21 bp, Homo sapiens
cacatttttgcacagattatg

SEQ ID NO: 5581069 - DNA, 23 bp, Homo sapiens
cacatttttgcacagattatgct

SEQ ID NO: 5581070 - DNA, 21 bp, Homo sapiens
cacatttttggatttctgtga

SEQ ID NO: 5581071 - DNA, 23 bp, Homo sapiens
cacatttttggatttctgtgaag

SEQ ID NO: 5581072 - DNA, 14 bp, Homo sapiens
cacatttttttcta

SEQ ID NO: 5581073 - DNA, 12 bp, Homo sapiens
caccaaaaaata

SEQ ID NO: 5581074 - DNA, 17 bp, Homo sapiens
caccaaaaaatatctag

SEQ ID NO: 5581075 - DNA, 15 bp, Homo sapiens
caccaaaagaagtaa

SEQ ID NO: 5581076 - DNA, 14 bp, Homo sapiens
caccaaaatgaacc

SEQ ID NO: 5581077 - DNA, 23 bp, Homo sapiens
caccaaaattattaatcctcttg

SEQ ID NO: 5581078 - DNA, 13 bp, Homo sapiens
caccaaacatttc

SEQ ID NO: 5581079 - DNA, 21 bp, Homo sapiens
caccaaaccagacagaggcag

SEQ ID NO: 5581080 - DNA, 20 bp, Homo sapiens
caccaaaccctgtcctccca

SEQ ID NO: 5581081 - DNA, 13 bp, Homo sapiens
caccaaactgcca

SEQ ID NO: 5581082 - DNA, 17 bp, Homo sapiens
caccaaagagaatgccc

SEQ ID NO: 5581083 - DNA, 20 bp, Homo sapiens
caccaaaggaaacccaattc

SEQ ID NO: 5581084 - DNA, 16 bp, Homo sapiens
caccaaaggagacata

SEQ ID NO: 5581085 - DNA, 13 bp, Homo sapiens
caccaaagttcta

SEQ ID NO: 5581086 - DNA, 21 bp, Homo sapiens
caccaaatcaaaatctctcca

SEQ ID NO: 5581087 - DNA, 22 bp, Homo sapiens
caccaaatcgtagcgtttgtta

SEQ ID NO: 5581088 - DNA, 14 bp, Homo sapiens
caccaaatctgtct

SEQ ID NO: 5581089 - DNA, 19 bp, Homo sapiens
caccaacaacagtcagcca

SEQ ID NO: 5581090 - DNA, 14 bp, Homo sapiens
caccaacacacagg

SEQ ID NO: 5581091 - DNA, 14 bp, Homo sapiens
caccaacactgtaa

SEQ ID NO: 5581092 - DNA, 21 bp, Homo sapiens
caccaacatactcccatctgt

SEQ ID NO: 5581093 - DNA, 23 bp, Homo sapiens
caccaacatactcccatctgtga

SEQ ID NO: 5581094 - DNA, 22 bp, Homo sapiens
caccaaccacagcatcgggagc

SEQ ID NO: 5581095 - DNA, 14 bp, Homo sapiens
caccaaccagacag

SEQ ID NO: 5581096 - DNA, 13 bp, Homo sapiens
caccaaccaggcc

SEQ ID NO: 5581097 - DNA, 21 bp, Homo sapiens
caccaacccagccgctgcccg

SEQ ID NO: 5581098 - DNA, 13 bp, Homo sapiens
caccaacctccag

SEQ ID NO: 5581099 - DNA, 23 bp, Homo sapiens
caccaacctccagactcagcaga

SEQ ID NO: 5581100 - DNA, 16 bp, Homo sapiens
caccaacgtctgtgcc

SEQ ID NO: 5581101 - DNA, 18 bp, Homo sapiens
caccaactactacctgta

SEQ ID NO: 5581102 - DNA, 18 bp, Homo sapiens
caccaactcctaatttta

SEQ ID NO: 5581103 - DNA, 16 bp, Homo sapiens
caccaactctctctgc

SEQ ID NO: 5581104 - DNA, 20 bp, Homo sapiens
caccaactctctctgccccc

SEQ ID NO: 5581105 - DNA, 22 bp, Homo sapiens
caccaactctgcactccatggc

SEQ ID NO: 5581106 - DNA, 15 bp, Homo sapiens
caccaacttacaaaa

SEQ ID NO: 5581107 - DNA, 18 bp, Homo sapiens
caccaagaaggggctcga

SEQ ID NO: 5581108 - DNA, 15 bp, Homo sapiens
caccaagagtacagg

SEQ ID NO: 5581109 - DNA, 15 bp, Homo sapiens
caccaagatgtctgt

SEQ ID NO: 5581110 - DNA, 16 bp, Homo sapiens
caccaagcaagtccct

SEQ ID NO: 5581111 - DNA, 15 bp, Homo sapiens
caccaagcacagcag

SEQ ID NO: 5581112 - DNA, 12 bp, Homo sapiens
caccaagcccag

SEQ ID NO: 5581113 - DNA, 15 bp, Homo sapiens
caccaagcccagtta

SEQ ID NO: 5581114 - DNA, 14 bp, Homo sapiens
caccaagccctgca

SEQ ID NO: 5581115 - DNA, 19 bp, Homo sapiens
caccaagcctggtcagccc

SEQ ID NO: 5581116 - DNA, 17 bp, Homo sapiens
caccaagctcacacctg

SEQ ID NO: 5581117 - DNA, 15 bp, Homo sapiens
caccaagctcacagt

SEQ ID NO: 5581118 - DNA, 20 bp, Homo sapiens
caccaagctcacagttcctc

SEQ ID NO: 5581119 - DNA, 14 bp, Homo sapiens
caccaagctgtgcc

SEQ ID NO: 5581120 - DNA, 20 bp, Homo sapiens
caccaagctgtgccaccctg

SEQ ID NO: 5581121 - DNA, 13 bp, Homo sapiens
caccaaggccctg

SEQ ID NO: 5581122 - DNA, 16 bp, Homo sapiens
caccaaggccctgcat

SEQ ID NO: 5581123 - DNA, 23 bp, Homo sapiens
caccaaggccctgcatctgtctg

SEQ ID NO: 5581124 - DNA, 13 bp, Homo sapiens
caccaaggctgcc

SEQ ID NO: 5581125 - DNA, 19 bp, Homo sapiens
caccaagggtatctgctgc

SEQ ID NO: 5581126 - DNA, 21 bp, Homo sapiens
caccaagggtatctgctgcct

SEQ ID NO: 5581127 - DNA, 17 bp, Homo sapiens
caccaaggtctcacact

SEQ ID NO: 5581128 - DNA, 23 bp, Homo sapiens
caccaaggtctcacactcctcct

SEQ ID NO: 5581129 - DNA, 15 bp, Homo sapiens
caccaaggtcttcag

SEQ ID NO: 5581130 - DNA, 20 bp, Homo sapiens
caccaaggtcttcagccatc

SEQ ID NO: 5581131 - DNA, 21 bp, Homo sapiens
caccaaggtcttcagccatca

SEQ ID NO: 5581132 - DNA, 14 bp, Homo sapiens
caccaagtaaatct

SEQ ID NO: 5581133 - DNA, 21 bp, Homo sapiens
caccaagtaaatctatctcta

SEQ ID NO: 5581134 - DNA, 15 bp, Homo sapiens
caccaagtacaagga

SEQ ID NO: 5581135 - DNA, 19 bp, Homo sapiens
caccaagtacagccttcac

SEQ ID NO: 5581136 - DNA, 19 bp, Homo sapiens
caccaagtattaaactgta

SEQ ID NO: 5581137 - DNA, 15 bp, Homo sapiens
caccaagtgcaatag

SEQ ID NO: 5581138 - DNA, 19 bp, Homo sapiens
caccaagtggctgggtgcc

SEQ ID NO: 5581139 - DNA, 22 bp, Homo sapiens
caccaagtggctgggtgccctc

SEQ ID NO: 5581140 - DNA, 23 bp, Homo sapiens
caccaagtgtctagagtcatgtg

SEQ ID NO: 5581141 - DNA, 13 bp, Homo sapiens
caccaataaaaat

SEQ ID NO: 5581142 - DNA, 16 bp, Homo sapiens
caccaataacttcaga

SEQ ID NO: 5581143 - DNA, 20 bp, Homo sapiens
caccaataacttcagagaag

SEQ ID NO: 5581144 - DNA, 21 bp, Homo sapiens
caccaataacttcagagaagt

SEQ ID NO: 5581145 - DNA, 23 bp, Homo sapiens
caccaataacttcagagaagtca

SEQ ID NO: 5581146 - DNA, 22 bp, Homo sapiens
caccaataatggggcagacaca

SEQ ID NO: 5581147 - DNA, 21 bp, Homo sapiens
caccaatattaacacgctgcc

SEQ ID NO: 5581148 - DNA, 16 bp, Homo sapiens
caccaatcagcactct

SEQ ID NO: 5581149 - DNA, 14 bp, Homo sapiens
caccaatcagcgct

SEQ ID NO: 5581150 - DNA, 17 bp, Homo sapiens
caccaatcagcgctctg

SEQ ID NO: 5581151 - DNA, 14 bp, Homo sapiens
caccaatcccaggg

SEQ ID NO: 5581152 - DNA, 21 bp, Homo sapiens
caccaatcccagggctggctc

SEQ ID NO: 5581153 - DNA, 23 bp, Homo sapiens
caccaatcccagggctggctctg

SEQ ID NO: 5581154 - DNA, 16 bp, Homo sapiens
caccaatcctcaccta

SEQ ID NO: 5581155 - DNA, 14 bp, Homo sapiens
caccaatctgccct

SEQ ID NO: 5581156 - DNA, 19 bp, Homo sapiens
caccaatcttactttgtaa

SEQ ID NO: 5581157 - DNA, 22 bp, Homo sapiens
caccaatcttactttgtaaatt

SEQ ID NO: 5581158 - DNA, 19 bp, Homo sapiens
caccaatcttgtttatagc

SEQ ID NO: 5581159 - DNA, 21 bp, Homo sapiens
caccaatgccgccgtgtttcc

SEQ ID NO: 5581160 - DNA, 23 bp, Homo sapiens
caccaatgtacccaccgggccac

SEQ ID NO: 5581161 - DNA, 17 bp, Homo sapiens
caccaattccacttcct

SEQ ID NO: 5581162 - DNA, 23 bp, Homo sapiens
caccaatttggtaaaaatgctgc

SEQ ID NO: 5581163 - DNA, 22 bp, Homo sapiens
caccacaacaaagtgcttcctt

SEQ ID NO: 5581164 - DNA, 17 bp, Homo sapiens
caccacaaccctgttgc

SEQ ID NO: 5581165 - DNA, 19 bp, Homo sapiens
caccacaactaacaatgcc

SEQ ID NO: 5581166 - DNA, 16 bp, Homo sapiens
caccacaagctgagca

SEQ ID NO: 5581167 - DNA, 20 bp, Homo sapiens
caccacaattctccctatct

SEQ ID NO: 5581168 - DNA, 13 bp, Homo sapiens
caccacacacaac

SEQ ID NO: 5581169 - DNA, 15 bp, Homo sapiens
caccacacacaccct

SEQ ID NO: 5581170 - DNA, 17 bp, Homo sapiens
caccacacacacccttc

SEQ ID NO: 5581171 - DNA, 20 bp, Homo sapiens
caccacacacacccttcccc

SEQ ID NO: 5581172 - DNA, 16 bp, Homo sapiens
caccacacatcccagc

SEQ ID NO: 5581173 - DNA, 15 bp, Homo sapiens
caccacacccagccc

SEQ ID NO: 5581174 - DNA, 17 bp, Homo sapiens
caccacacccaggtctc

SEQ ID NO: 5581175 - DNA, 13 bp, Homo sapiens
caccacacccctg

SEQ ID NO: 5581176 - DNA, 16 bp, Homo sapiens
caccacactaaaacat

SEQ ID NO: 5581177 - DNA, 15 bp, Homo sapiens
caccacactcagccc

SEQ ID NO: 5581178 - DNA, 21 bp, Homo sapiens
caccacactccccgcctgtcc

SEQ ID NO: 5581179 - DNA, 16 bp, Homo sapiens
caccacactttcaaag

SEQ ID NO: 5581180 - DNA, 18 bp, Homo sapiens
caccacactttcaaagac

SEQ ID NO: 5581181 - DNA, 13 bp, Homo sapiens
caccacagacaca

SEQ ID NO: 5581182 - DNA, 14 bp, Homo sapiens
caccacagacacac

SEQ ID NO: 5581183 - DNA, 18 bp, Homo sapiens
caccacagacgccacctg

SEQ ID NO: 5581184 - DNA, 19 bp, Homo sapiens
caccacagccagcacctgg

SEQ ID NO: 5581185 - DNA, 20 bp, Homo sapiens
caccacagccggtcagagga

SEQ ID NO: 5581186 - DNA, 19 bp, Homo sapiens
caccacagcctccccttcc

SEQ ID NO: 5581187 - DNA, 22 bp, Homo sapiens
caccacagcctccccttcccag

SEQ ID NO: 5581188 - DNA, 12 bp, Homo sapiens
caccacagcctt

SEQ ID NO: 5581189 - DNA, 15 bp, Homo sapiens
caccacatcttgtct

SEQ ID NO: 5581190 - DNA, 21 bp, Homo sapiens
caccacatcttgtcttttccc

SEQ ID NO: 5581191 - DNA, 13 bp, Homo sapiens
caccacatgctat

SEQ ID NO: 5581192 - DNA, 19 bp, Homo sapiens
caccacatgtgcacatgca

SEQ ID NO: 5581193 - DNA, 16 bp, Homo sapiens
caccacattgcctcat

SEQ ID NO: 5581194 - DNA, 13 bp, Homo sapiens
caccaccaacagg

SEQ ID NO: 5581195 - DNA, 13 bp, Homo sapiens
caccaccactggc

SEQ ID NO: 5581196 - DNA, 15 bp, Homo sapiens
caccaccactggcca

SEQ ID NO: 5581197 - DNA, 18 bp, Homo sapiens
caccaccactggccacca

SEQ ID NO: 5581198 - DNA, 15 bp, Homo sapiens
caccaccactgtccc

SEQ ID NO: 5581199 - DNA, 16 bp, Homo sapiens
caccaccactgtccct

SEQ ID NO: 5581200 - DNA, 13 bp, Homo sapiens
caccaccactgtg

SEQ ID NO: 5581201 - DNA, 18 bp, Homo sapiens
caccaccagatgagaagt

SEQ ID NO: 5581202 - DNA, 13 bp, Homo sapiens
caccaccaggagc

SEQ ID NO: 5581203 - DNA, 14 bp, Homo sapiens
caccaccaggagca

SEQ ID NO: 5581204 - DNA, 16 bp, Homo sapiens
caccaccaggagcagc

SEQ ID NO: 5581205 - DNA, 23 bp, Homo sapiens
caccaccatttaatttcatgtat

SEQ ID NO: 5581206 - DNA, 11 bp, Homo sapiens
caccacccaaa

SEQ ID NO: 5581207 - DNA, 19 bp, Homo sapiens
caccacccaacctgtcctt

SEQ ID NO: 5581208 - DNA, 14 bp, Homo sapiens
caccacccacccca

SEQ ID NO: 5581209 - DNA, 13 bp, Homo sapiens
caccacccagccc

SEQ ID NO: 5581210 - DNA, 14 bp, Homo sapiens
caccacccagccct

SEQ ID NO: 5581211 - DNA, 17 bp, Homo sapiens
caccacccagcccttcc

SEQ ID NO: 5581212 - DNA, 16 bp, Homo sapiens
caccaccccaacaaac

SEQ ID NO: 5581213 - DNA, 13 bp, Homo sapiens
caccaccccaccc

SEQ ID NO: 5581214 - DNA, 14 bp, Homo sapiens
caccacccccactg

SEQ ID NO: 5581215 - DNA, 14 bp, Homo sapiens
caccacccctacca

SEQ ID NO: 5581216 - DNA, 17 bp, Homo sapiens
caccaccccttgcccaa

SEQ ID NO: 5581217 - DNA, 14 bp, Homo sapiens
caccaccctcaggt

SEQ ID NO: 5581218 - DNA, 12 bp, Homo sapiens
caccaccctccc

SEQ ID NO: 5581219 - DNA, 17 bp, Homo sapiens
caccaccctccttccca

SEQ ID NO: 5581220 - DNA, 13 bp, Homo sapiens
caccaccctgtct

SEQ ID NO: 5581221 - DNA, 16 bp, Homo sapiens
caccaccctgtcttcc

SEQ ID NO: 5581222 - DNA, 17 bp, Homo sapiens
caccaccctgtcttcct

SEQ ID NO: 5581223 - DNA, 19 bp, Homo sapiens
caccaccctgtcttcctct

SEQ ID NO: 5581224 - DNA, 23 bp, Homo sapiens
caccaccctgtcttcctctgcaa

SEQ ID NO: 5581225 - DNA, 20 bp, Homo sapiens
caccaccgaatatattactg

SEQ ID NO: 5581226 - DNA, 20 bp, Homo sapiens
caccaccgaccaactccaga

SEQ ID NO: 5581227 - DNA, 13 bp, Homo sapiens
caccaccggggca

SEQ ID NO: 5581228 - DNA, 22 bp, Homo sapiens
caccaccggggcactggctgct

SEQ ID NO: 5581229 - DNA, 22 bp, Homo sapiens
caccacctaggccactcctcca

SEQ ID NO: 5581230 - DNA, 18 bp, Homo sapiens
caccacctcactcctgtt

SEQ ID NO: 5581231 - DNA, 14 bp, Homo sapiens
caccacctcagagt

SEQ ID NO: 5581232 - DNA, 12 bp, Homo sapiens
caccacctctcc

SEQ ID NO: 5581233 - DNA, 14 bp, Homo sapiens
caccatgccaggct

SEQ ID NO: 5581234 - DNA, 20 bp, Homo sapiens
caccatgcccagctaatttt

SEQ ID NO: 5581235 - DNA, 16 bp, Homo sapiens
caccatgcccagctag

SEQ ID NO: 5581236 - DNA, 21 bp, Homo sapiens
caccatgcccggctaattttt

SEQ ID NO: 5581237 - DNA, 15 bp, Homo sapiens
caccatgcttgcctg

SEQ ID NO: 5581238 - DNA, 20 bp, Homo sapiens
caccatgcttgcctgaagct

SEQ ID NO: 5581239 - DNA, 19 bp, Homo sapiens
caccatggaccagcccatt

SEQ ID NO: 5581240 - DNA, 18 bp, Homo sapiens
caccatggaggcaggctc

SEQ ID NO: 5581241 - DNA, 19 bp, Homo sapiens
caccatgggaaactgttgt

SEQ ID NO: 5581242 - DNA, 23 bp, Homo sapiens
caccatgggaaactgttgtgggc

SEQ ID NO: 5581243 - DNA, 23 bp, Homo sapiens
caccatgggaggtggggcctcaa

SEQ ID NO: 5581244 - DNA, 23 bp, Homo sapiens
caccatggggtcctaccaataga

SEQ ID NO: 5581245 - DNA, 15 bp, Homo sapiens
caccatggtgactgc

SEQ ID NO: 5581246 - DNA, 15 bp, Homo sapiens
caccatgtaaaacaa

SEQ ID NO: 5581247 - DNA, 18 bp, Homo sapiens
caccatgtacatagcttg

SEQ ID NO: 5581248 - DNA, 16 bp, Homo sapiens
caccatgtatgtggaa

SEQ ID NO: 5581249 - DNA, 17 bp, Homo sapiens
caccatgtgagctcttc

SEQ ID NO: 5581250 - DNA, 21 bp, Homo sapiens
caccatgtgcatcaggaaaca

SEQ ID NO: 5581251 - DNA, 14 bp, Homo sapiens
caccatgtgggcac

SEQ ID NO: 5581252 - DNA, 19 bp, Homo sapiens
caccatgtgggcacggagg

SEQ ID NO: 5581253 - DNA, 16 bp, Homo sapiens
caccatgttcccagct

SEQ ID NO: 5581254 - DNA, 17 bp, Homo sapiens
caccatgttcccagctc

SEQ ID NO: 5581255 - DNA, 18 bp, Homo sapiens
caccatgttcccagctca

SEQ ID NO: 5581256 - DNA, 18 bp, Homo sapiens
caccatgttggccaggct

SEQ ID NO: 5581257 - DNA, 20 bp, Homo sapiens
caccatgttggccaggcttg

SEQ ID NO: 5581258 - DNA, 20 bp, Homo sapiens
caccatgttggtcaggctgg

SEQ ID NO: 5581259 - DNA, 22 bp, Homo sapiens
caccatgttggtcaggctggtc

SEQ ID NO: 5581260 - DNA, 22 bp, Homo sapiens
caccatgtttgagctcagaccc

SEQ ID NO: 5581261 - DNA, 13 bp, Homo sapiens
caccattataaaa

SEQ ID NO: 5581262 - DNA, 19 bp, Homo sapiens
caccattataaaaacactt

SEQ ID NO: 5581263 - DNA, 19 bp, Homo sapiens
caccattatattttgaaag

SEQ ID NO: 5581264 - DNA, 21 bp, Homo sapiens
caccattcacatttgatgtac

SEQ ID NO: 5581265 - DNA, 22 bp, Homo sapiens
caccattcaggaacctggacca

SEQ ID NO: 5581266 - DNA, 23 bp, Homo sapiens
caccattccacatccccaccttc

SEQ ID NO: 5581267 - DNA, 11 bp, Homo sapiens
caccattcctg

SEQ ID NO: 5581268 - DNA, 22 bp, Homo sapiens
caccattcctgcctttaagcca

SEQ ID NO: 5581269 - DNA, 23 bp, Homo sapiens
caccattcctgcctttaagccaa

SEQ ID NO: 5581270 - DNA, 20 bp, Homo sapiens
caccattcgtacataatact

SEQ ID NO: 5581271 - DNA, 13 bp, Homo sapiens
caccattctacct

SEQ ID NO: 5581272 - DNA, 14 bp, Homo sapiens
caccattctcctgc

SEQ ID NO: 5581273 - DNA, 23 bp, Homo sapiens
caccattctcctgcctcaccctc

SEQ ID NO: 5581274 - DNA, 15 bp, Homo sapiens
caccattctgaattt

SEQ ID NO: 5581275 - DNA, 13 bp, Homo sapiens
caccattctgact

SEQ ID NO: 5581276 - DNA, 13 bp, Homo sapiens
caccattgaaggc

SEQ ID NO: 5581277 - DNA, 15 bp, Homo sapiens
caccattgaaggctt

SEQ ID NO: 5581278 - DNA, 16 bp, Homo sapiens
caccattgctggaaaa

SEQ ID NO: 5581279 - DNA, 21 bp, Homo sapiens
caccattggacagtctccctg

SEQ ID NO: 5581280 - DNA, 22 bp, Homo sapiens
caccattggacagtctccctga

SEQ ID NO: 5581281 - DNA, 21 bp, Homo sapiens
caccattgtgaagcacctact

SEQ ID NO: 5581282 - DNA, 17 bp, Homo sapiens
caccatttaaaaacagg

SEQ ID NO: 5581283 - DNA, 14 bp, Homo sapiens
caccatttaaaaat

SEQ ID NO: 5581284 - DNA, 23 bp, Homo sapiens
caccatttaatcatttccagcaa

SEQ ID NO: 5581285 - DNA, 14 bp, Homo sapiens
caccatttaatttc

SEQ ID NO: 5581286 - DNA, 21 bp, Homo sapiens
caccatttaatttcatgtata

SEQ ID NO: 5581287 - DNA, 22 bp, Homo sapiens
caccatttaatttcatgtatat

SEQ ID NO: 5581288 - DNA, 16 bp, Homo sapiens
caccatttcatccata

SEQ ID NO: 5581289 - DNA, 22 bp, Homo sapiens
caccatttcatccatatttctt

SEQ ID NO: 5581290 - DNA, 18 bp, Homo sapiens
caccatttccccagggca

SEQ ID NO: 5581291 - DNA, 19 bp, Homo sapiens
caccatttccccagggcac

SEQ ID NO: 5581292 - DNA, 17 bp, Homo sapiens
caccatttcccctgtgg

SEQ ID NO: 5581293 - DNA, 20 bp, Homo sapiens
caccatttcttctgcacaaa

SEQ ID NO: 5581294 - DNA, 22 bp, Homo sapiens
caccatttggcatccctgggcc

SEQ ID NO: 5581295 - DNA, 23 bp, Homo sapiens
caccattttttttttctttttgg

SEQ ID NO: 5581296 - DNA, 18 bp, Homo sapiens
cacccaaaaatatctcct

SEQ ID NO: 5581297 - DNA, 21 bp, Homo sapiens
cacccaaaaatatctcctcca

SEQ ID NO: 5581298 - DNA, 13 bp, Homo sapiens
cacccaaaagcac

SEQ ID NO: 5581299 - DNA, 17 bp, Homo sapiens
cacccaaacacttctgc

SEQ ID NO: 5581300 - DNA, 15 bp, Homo sapiens
cacccaaaccccggg

SEQ ID NO: 5581301 - DNA, 22 bp, Homo sapiens
cacccaaagaggtatttatctt

SEQ ID NO: 5581302 - DNA, 18 bp, Homo sapiens
cacccaaagcatggacta

SEQ ID NO: 5581303 - DNA, 22 bp, Homo sapiens
cacccaaagcctgtcccaggac

SEQ ID NO: 5581304 - DNA, 18 bp, Homo sapiens
cacccaaagctgagcctg

SEQ ID NO: 5581305 - DNA, 22 bp, Homo sapiens
cacccaaagctgagcctgcagg

SEQ ID NO: 5581306 - DNA, 13 bp, Homo sapiens
cacccaaagggtt

SEQ ID NO: 5581307 - DNA, 17 bp, Homo sapiens
cacccaaatcacatctc

SEQ ID NO: 5581308 - DNA, 20 bp, Homo sapiens
cacccaaccaactttccccc

SEQ ID NO: 5581309 - DNA, 15 bp, Homo sapiens
cacccaacctgtcct

SEQ ID NO: 5581310 - DNA, 14 bp, Homo sapiens
cacccaactactga

SEQ ID NO: 5581311 - DNA, 16 bp, Homo sapiens
cacccaactccacagg

SEQ ID NO: 5581312 - DNA, 20 bp, Homo sapiens
cacccaactccacagggctg

SEQ ID NO: 5581313 - DNA, 15 bp, Homo sapiens
cacccaacttcccct

SEQ ID NO: 5581314 - DNA, 19 bp, Homo sapiens
cacccaagagattgttgtt

SEQ ID NO: 5581315 - DNA, 14 bp, Homo sapiens
cacccaagagggct

SEQ ID NO: 5581316 - DNA, 21 bp, Homo sapiens
cacccaagagggctgcttccc

SEQ ID NO: 5581317 - DNA, 16 bp, Homo sapiens
cacccaagcacaaact

SEQ ID NO: 5581318 - DNA, 16 bp, Homo sapiens
cacccaagcccaaact

SEQ ID NO: 5581319 - DNA, 16 bp, Homo sapiens
cacccaagcctgctgg

SEQ ID NO: 5581320 - DNA, 17 bp, Homo sapiens
cacccaagcctgctggc

SEQ ID NO: 5581321 - DNA, 18 bp, Homo sapiens
cacccaagcctgctggct

SEQ ID NO: 5581322 - DNA, 19 bp, Homo sapiens
cacccaagcttggcagccg

SEQ ID NO: 5581323 - DNA, 21 bp, Homo sapiens
cacccaagcttggcagccgag

SEQ ID NO: 5581324 - DNA, 15 bp, Homo sapiens
cacccaagggcctgg

SEQ ID NO: 5581325 - DNA, 18 bp, Homo sapiens
cacccaagggcctggcct

SEQ ID NO: 5581326 - DNA, 21 bp, Homo sapiens
cacccaatcaagggaagaagg

SEQ ID NO: 5581327 - DNA, 14 bp, Homo sapiens
cacccaattccact

SEQ ID NO: 5581328 - DNA, 17 bp, Homo sapiens
cacccaattccactctg

SEQ ID NO: 5581329 - DNA, 15 bp, Homo sapiens
cacccaattttaaaa

SEQ ID NO: 5581330 - DNA, 14 bp, Homo sapiens
cacccacaaagaaa

SEQ ID NO: 5581331 - DNA, 21 bp, Homo sapiens
cacccacaaccctctggaagt

SEQ ID NO: 5581332 - DNA, 14 bp, Homo sapiens
cacccacaagcccg

SEQ ID NO: 5581333 - DNA, 17 bp, Homo sapiens
cacccacaagcccgtga

SEQ ID NO: 5581334 - DNA, 23 bp, Homo sapiens
cacccacacactcgcccgcccac

SEQ ID NO: 5581335 - DNA, 14 bp, Homo sapiens
cacccacacagctg

SEQ ID NO: 5581336 - DNA, 16 bp, Homo sapiens
cacccacacagctgcc

SEQ ID NO: 5581337 - DNA, 17 bp, Homo sapiens
cacccacacagctgccc

SEQ ID NO: 5581338 - DNA, 20 bp, Homo sapiens
cacccacaccccgtctgccc

SEQ ID NO: 5581339 - DNA, 20 bp, Homo sapiens
cacccacaccctacagcaga

SEQ ID NO: 5581340 - DNA, 17 bp, Homo sapiens
cacccacagaaagagag

SEQ ID NO: 5581341 - DNA, 19 bp, Homo sapiens
cacccacagtggagagggc

SEQ ID NO: 5581342 - DNA, 14 bp, Homo sapiens
cacccacatcccca

SEQ ID NO: 5581343 - DNA, 12 bp, Homo sapiens
cacccacatgtg

SEQ ID NO: 5581344 - DNA, 17 bp, Homo sapiens
cacccaccaaccctcag

SEQ ID NO: 5581345 - DNA, 13 bp, Homo sapiens
cacccaccaccgc

SEQ ID NO: 5581346 - DNA, 14 bp, Homo sapiens
cacccaccaccgct

SEQ ID NO: 5581347 - DNA, 15 bp, Homo sapiens
cacccaccaccgctc

SEQ ID NO: 5581348 - DNA, 13 bp, Homo sapiens
cacccaccactct

SEQ ID NO: 5581349 - DNA, 14 bp, Homo sapiens
cacccaccactctc

SEQ ID NO: 5581350 - DNA, 15 bp, Homo sapiens
cacccaccagctcca

SEQ ID NO: 5581351 - DNA, 15 bp, Homo sapiens
cacccaccagggctc

SEQ ID NO: 5581352 - DNA, 13 bp, Homo sapiens
cacccaccatgga

SEQ ID NO: 5581353 - DNA, 14 bp, Homo sapiens
cacccacccatgca

SEQ ID NO: 5581354 - DNA, 16 bp, Homo sapiens
cacccaccccaagctg

SEQ ID NO: 5581355 - DNA, 14 bp, Homo sapiens
cacccaccccacag

SEQ ID NO: 5581356 - DNA, 15 bp, Homo sapiens
cacccaccccatgga

SEQ ID NO: 5581357 - DNA, 14 bp, Homo sapiens
cacccacccccagg

SEQ ID NO: 5581358 - DNA, 12 bp, Homo sapiens
cacccaccccct

SEQ ID NO: 5581359 - DNA, 14 bp, Homo sapiens
cacccaccccctct

SEQ ID NO: 5581360 - DNA, 13 bp, Homo sapiens
cacccaccccctg

SEQ ID NO: 5581361 - DNA, 17 bp, Homo sapiens
cacccaccccctgcctg

SEQ ID NO: 5581362 - DNA, 18 bp, Homo sapiens
cacccaccccctgcctgg

SEQ ID NO: 5581363 - DNA, 20 bp, Homo sapiens
cacccacccctcctgggccc

SEQ ID NO: 5581364 - DNA, 14 bp, Homo sapiens
cacccacccctgca

SEQ ID NO: 5581365 - DNA, 14 bp, Homo sapiens
cacccacccctgcc

SEQ ID NO: 5581366 - DNA, 15 bp, Homo sapiens
cacccacccctgccc

SEQ ID NO: 5581367 - DNA, 17 bp, Homo sapiens
cacccacccctgcccag

SEQ ID NO: 5581368 - DNA, 15 bp, Homo sapiens
cacccaccctctggt

SEQ ID NO: 5581369 - DNA, 14 bp, Homo sapiens
cacccaccctggga

SEQ ID NO: 5581370 - DNA, 22 bp, Homo sapiens
cacccaccgtccgccctgctcc

SEQ ID NO: 5581371 - DNA, 23 bp, Homo sapiens
cacccaccgtctcggccctgaac

SEQ ID NO: 5581372 - DNA, 15 bp, Homo sapiens
cacccacctcagcct

SEQ ID NO: 5581373 - DNA, 20 bp, Homo sapiens
cacccacctccacccagccc

SEQ ID NO: 5581374 - DNA, 21 bp, Homo sapiens
cacccacctccctgcctccag

SEQ ID NO: 5581375 - DNA, 23 bp, Homo sapiens
cacccacctccctgcctccagga

SEQ ID NO: 5581376 - DNA, 12 bp, Homo sapiens
cacccacctcct

SEQ ID NO: 5581377 - DNA, 13 bp, Homo sapiens
cacccacctcctg

SEQ ID NO: 5581378 - DNA, 14 bp, Homo sapiens
cacccacctcctgc

SEQ ID NO: 5581379 - DNA, 15 bp, Homo sapiens
cacccacctctgcca

SEQ ID NO: 5581380 - DNA, 13 bp, Homo sapiens
cacccacctctgg

SEQ ID NO: 5581381 - DNA, 18 bp, Homo sapiens
cacccacctctgggtcct

SEQ ID NO: 5581382 - DNA, 15 bp, Homo sapiens
cacccacctcttgtg

SEQ ID NO: 5581383 - DNA, 14 bp, Homo sapiens
cacccacctgacca

SEQ ID NO: 5581384 - DNA, 15 bp, Homo sapiens
cacccacctgctgct

SEQ ID NO: 5581385 - DNA, 14 bp, Homo sapiens
cacccacctgtttt

SEQ ID NO: 5581386 - DNA, 18 bp, Homo sapiens
cacccacctgttttctga

SEQ ID NO: 5581387 - DNA, 19 bp, Homo sapiens
cacccacctgttttctgaa

SEQ ID NO: 5581388 - DNA, 17 bp, Homo sapiens
cacccaccttccttgcg

SEQ ID NO: 5581389 - DNA, 19 bp, Homo sapiens
cacccaccttgacgtttct

SEQ ID NO: 5581390 - DNA, 22 bp, Homo sapiens
cacccaccttgacgtttcttct

SEQ ID NO: 5581391 - DNA, 14 bp, Homo sapiens
cacccacctttgca

SEQ ID NO: 5581392 - DNA, 19 bp, Homo sapiens
cacccacgcatacacacat

SEQ ID NO: 5581393 - DNA, 23 bp, Homo sapiens
cacccacgtgagagaatctgcct

SEQ ID NO: 5581394 - DNA, 22 bp, Homo sapiens
cacccactagccctctttctct

SEQ ID NO: 5581395 - DNA, 14 bp, Homo sapiens
cacccactcagcca

SEQ ID NO: 5581396 - DNA, 19 bp, Homo sapiens
cacccactcagccattctc

SEQ ID NO: 5581397 - DNA, 15 bp, Homo sapiens
cacccactcagctcc

SEQ ID NO: 5581398 - DNA, 17 bp, Homo sapiens
cacccactcccttcccc

SEQ ID NO: 5581399 - DNA, 21 bp, Homo sapiens
cacccactccggattccggcc

SEQ ID NO: 5581400 - DNA, 13 bp, Homo sapiens
cacccactcctat

SEQ ID NO: 5581401 - DNA, 15 bp, Homo sapiens
cacccactctgcact

SEQ ID NO: 5581402 - DNA, 17 bp, Homo sapiens
cacccactctgcactgg

SEQ ID NO: 5581403 - DNA, 13 bp, Homo sapiens
cacccactgaccc

SEQ ID NO: 5581404 - DNA, 11 bp, Homo sapiens
cacccactggc

SEQ ID NO: 5581405 - DNA, 17 bp, Homo sapiens
cacccactggccagtcc

SEQ ID NO: 5581406 - DNA, 23 bp, Homo sapiens
cacccactggccagtcctagagc

SEQ ID NO: 5581407 - DNA, 14 bp, Homo sapiens
cacccactgtccgc

SEQ ID NO: 5581408 - DNA, 17 bp, Homo sapiens
cacccacttagtccact

SEQ ID NO: 5581409 - DNA, 21 bp, Homo sapiens
cacccagaaattccttcccac

SEQ ID NO: 5581410 - DNA, 14 bp, Homo sapiens
cacccagaccctcc

SEQ ID NO: 5581411 - DNA, 19 bp, Homo sapiens
cacccctgaactggcccca

SEQ ID NO: 5581412 - DNA, 15 bp, Homo sapiens
cacccctgagccagc

SEQ ID NO: 5581413 - DNA, 13 bp, Homo sapiens
cacccctgcacac

SEQ ID NO: 5581414 - DNA, 18 bp, Homo sapiens
cacccctgcacacacctg

SEQ ID NO: 5581415 - DNA, 20 bp, Homo sapiens
cacccctgcacacacctgca

SEQ ID NO: 5581416 - DNA, 19 bp, Homo sapiens
cacccctgccactcaccct

SEQ ID NO: 5581417 - DNA, 13 bp, Homo sapiens
cacccctgcccag

SEQ ID NO: 5581418 - DNA, 22 bp, Homo sapiens
cacccctgcccaggcagtcttt

SEQ ID NO: 5581419 - DNA, 13 bp, Homo sapiens
cacccctgccccc

SEQ ID NO: 5581420 - DNA, 18 bp, Homo sapiens
cacccctgcccccacttc

SEQ ID NO: 5581421 - DNA, 22 bp, Homo sapiens
cacccctgccccgttgcttccc

SEQ ID NO: 5581422 - DNA, 16 bp, Homo sapiens
cacccctgcccctgtg

SEQ ID NO: 5581423 - DNA, 17 bp, Homo sapiens
cacccctgcccctgtgg

SEQ ID NO: 5581424 - DNA, 19 bp, Homo sapiens
cacccctgcccctgtggga

SEQ ID NO: 5581425 - DNA, 20 bp, Homo sapiens
cacccctgcccctgtgggac

SEQ ID NO: 5581426 - DNA, 22 bp, Homo sapiens
cacccctgcccctgtgggactc

SEQ ID NO: 5581427 - DNA, 13 bp, Homo sapiens
cacccctgccggc

SEQ ID NO: 5581428 - DNA, 20 bp, Homo sapiens
cacccctgccggccttggcc

SEQ ID NO: 5581429 - DNA, 22 bp, Homo sapiens
cacccctgcctcccatgcctgg

SEQ ID NO: 5581430 - DNA, 20 bp, Homo sapiens
cacccctggaagagcccagt

SEQ ID NO: 5581431 - DNA, 18 bp, Homo sapiens
cacccctggcctgactcc

SEQ ID NO: 5581432 - DNA, 20 bp, Homo sapiens
cacccctggctaccttgtgg

SEQ ID NO: 5581433 - DNA, 23 bp, Homo sapiens
cacccctggctaccttgtgggaa

SEQ ID NO: 5581434 - DNA, 13 bp, Homo sapiens
cacccctgggcag

SEQ ID NO: 5581435 - DNA, 12 bp, Homo sapiens
cacccctgggcc

SEQ ID NO: 5581436 - DNA, 13 bp, Homo sapiens
cacccctgggcca

SEQ ID NO: 5581437 - DNA, 14 bp, Homo sapiens
cacccctgggccag

SEQ ID NO: 5581438 - DNA, 12 bp, Homo sapiens
cacccctggggg

SEQ ID NO: 5581439 - DNA, 17 bp, Homo sapiens
cacccctggttctcatc

SEQ ID NO: 5581440 - DNA, 16 bp, Homo sapiens
cacccctgtacccagc

SEQ ID NO: 5581441 - DNA, 20 bp, Homo sapiens
cacccctgtcccacccacac

SEQ ID NO: 5581442 - DNA, 20 bp, Homo sapiens
cacccctgtctgcgccgctg

SEQ ID NO: 5581443 - DNA, 12 bp, Homo sapiens
cacccctgtgct

SEQ ID NO: 5581444 - DNA, 23 bp, Homo sapiens
cacccctgtgctcccctgccaca

SEQ ID NO: 5581445 - DNA, 23 bp, Homo sapiens
caccccttaccccaaagagaaag

SEQ ID NO: 5581446 - DNA, 14 bp, Homo sapiens
caccccttaggccc

SEQ ID NO: 5581447 - DNA, 16 bp, Homo sapiens
caccccttaggccccg

SEQ ID NO: 5581448 - DNA, 17 bp, Homo sapiens
caccccttatccaggac

SEQ ID NO: 5581449 - DNA, 21 bp, Homo sapiens
caccccttcataccgcctcgt

SEQ ID NO: 5581450 - DNA, 23 bp, Homo sapiens
caccccttcataccgcctcgtgc

SEQ ID NO: 5581451 - DNA, 12 bp, Homo sapiens
caccccttcccc

SEQ ID NO: 5581452 - DNA, 18 bp, Homo sapiens
caccccttccccaggccc

SEQ ID NO: 5581453 - DNA, 18 bp, Homo sapiens
caccccttccctatagga

SEQ ID NO: 5581454 - DNA, 15 bp, Homo sapiens
caccccttcctcagc

SEQ ID NO: 5581455 - DNA, 16 bp, Homo sapiens
caccccttcctcgtgg

SEQ ID NO: 5581456 - DNA, 12 bp, Homo sapiens
caccccttcctg

SEQ ID NO: 5581457 - DNA, 19 bp, Homo sapiens
caccccttcgacatgctgc

SEQ ID NO: 5581458 - DNA, 17 bp, Homo sapiens
caccccttgcccaacca

SEQ ID NO: 5581459 - DNA, 12 bp, Homo sapiens
caccccttgctc

SEQ ID NO: 5581460 - DNA, 19 bp, Homo sapiens
caccccttgctctcaaccc

SEQ ID NO: 5581461 - DNA, 15 bp, Homo sapiens
caccccttgctctct

SEQ ID NO: 5581462 - DNA, 19 bp, Homo sapiens
caccccttggaggagagag

SEQ ID NO: 5581463 - DNA, 17 bp, Homo sapiens
caccccttggcccctca

SEQ ID NO: 5581464 - DNA, 17 bp, Homo sapiens
cacccctttcctcccca

SEQ ID NO: 5581465 - DNA, 12 bp, Homo sapiens
cacccctttcta

SEQ ID NO: 5581466 - DNA, 18 bp, Homo sapiens
cacccctttctgtcccac

SEQ ID NO: 5581467 - DNA, 17 bp, Homo sapiens
cacccgaagtcctgtca

SEQ ID NO: 5581468 - DNA, 22 bp, Homo sapiens
cacccgaagtcctgtcactgag

SEQ ID NO: 5581469 - DNA, 20 bp, Homo sapiens
cacccgacctggctgcccct

SEQ ID NO: 5581470 - DNA, 16 bp, Homo sapiens
cacccgactccagtcc

SEQ ID NO: 5581471 - DNA, 14 bp, Homo sapiens
cacccgactcctca

SEQ ID NO: 5581472 - DNA, 15 bp, Homo sapiens
cacccgactcctcaa

SEQ ID NO: 5581473 - DNA, 16 bp, Homo sapiens
cacccgactcctcaaa

SEQ ID NO: 5581474 - DNA, 14 bp, Homo sapiens
cacccgaggggggc

SEQ ID NO: 5581475 - DNA, 16 bp, Homo sapiens
cacccgaggggggccc

SEQ ID NO: 5581476 - DNA, 19 bp, Homo sapiens
cacccgagtacctccagtc

SEQ ID NO: 5581477 - DNA, 17 bp, Homo sapiens
cacccgagttcctctgg

SEQ ID NO: 5581478 - DNA, 14 bp, Homo sapiens
cacccgatgctgct

SEQ ID NO: 5581479 - DNA, 23 bp, Homo sapiens
cacccgatgctgctttcccctgt

SEQ ID NO: 5581480 - DNA, 22 bp, Homo sapiens
cacccgcatgtacaaaaacaca

SEQ ID NO: 5581481 - DNA, 21 bp, Homo sapiens
cacccgcccacccgccttgtg

SEQ ID NO: 5581482 - DNA, 16 bp, Homo sapiens
cacccgcccagccggg

SEQ ID NO: 5581483 - DNA, 15 bp, Homo sapiens
cacccgccccagaga

SEQ ID NO: 5581484 - DNA, 21 bp, Homo sapiens
cacccgccccagagactgccc

SEQ ID NO: 5581485 - DNA, 13 bp, Homo sapiens
cacccgccctgtg

SEQ ID NO: 5581486 - DNA, 15 bp, Homo sapiens
cacccgctgcccctc

SEQ ID NO: 5581487 - DNA, 14 bp, Homo sapiens
cacccggaaagact

SEQ ID NO: 5581488 - DNA, 17 bp, Homo sapiens
cacccggaaagactgaa

SEQ ID NO: 5581489 - DNA, 23 bp, Homo sapiens
cacccggacaggtggggcctcag

SEQ ID NO: 5581490 - DNA, 22 bp, Homo sapiens
cacccggatctccaggcccagc

SEQ ID NO: 5581491 - DNA, 23 bp, Homo sapiens
cacccggatctccaggcccagcc

SEQ ID NO: 5581492 - DNA, 21 bp, Homo sapiens
cacccggcagccccccagtgt

SEQ ID NO: 5581493 - DNA, 14 bp, Homo sapiens
cacccggcccctgc

SEQ ID NO: 5581494 - DNA, 20 bp, Homo sapiens
cacccggcccggctgagccc

SEQ ID NO: 5581495 - DNA, 13 bp, Homo sapiens
cacccggcctctt

SEQ ID NO: 5581496 - DNA, 21 bp, Homo sapiens
cacccggcctggatgccagct

SEQ ID NO: 5581497 - DNA, 18 bp, Homo sapiens
cacccggctccccctgct

SEQ ID NO: 5581498 - DNA, 15 bp, Homo sapiens
cacccggctgcagag

SEQ ID NO: 5581499 - DNA, 21 bp, Homo sapiens
cacccggctgcagaggccaga

SEQ ID NO: 5581500 - DNA, 13 bp, Homo sapiens
cacccggctgggc

SEQ ID NO: 5581501 - DNA, 23 bp, Homo sapiens
cacccgggggagcccagtgaagc

SEQ ID NO: 5581502 - DNA, 21 bp, Homo sapiens
cacccggtgggacccccgtgg

SEQ ID NO: 5581503 - DNA, 15 bp, Homo sapiens
cacccgtaggcaaat

SEQ ID NO: 5581504 - DNA, 21 bp, Homo sapiens
cacccgtaggcagcctctctg

SEQ ID NO: 5581505 - DNA, 22 bp, Homo sapiens
cacccgtaggcagcctctctgc

SEQ ID NO: 5581506 - DNA, 16 bp, Homo sapiens
cacccgtccccacacg

SEQ ID NO: 5581507 - DNA, 14 bp, Homo sapiens
cacccgtcctccct

SEQ ID NO: 5581508 - DNA, 17 bp, Homo sapiens
cacccgtcctccctcag

SEQ ID NO: 5581509 - DNA, 18 bp, Homo sapiens
cacccgtcctccctcagc

SEQ ID NO: 5581510 - DNA, 21 bp, Homo sapiens
cacccgtcctccctcagcctc

SEQ ID NO: 5581511 - DNA, 15 bp, Homo sapiens
cacccgtctctctgc

SEQ ID NO: 5581512 - DNA, 17 bp, Homo sapiens
cacccgtctctctgccc

SEQ ID NO: 5581513 - DNA, 22 bp, Homo sapiens
cacccgtcttcaatctctgttc

SEQ ID NO: 5581514 - DNA, 23 bp, Homo sapiens
cacccgtgagcgcctgtgcacac

SEQ ID NO: 5581515 - DNA, 13 bp, Homo sapiens
cacccgtgccacg

SEQ ID NO: 5581516 - DNA, 21 bp, Homo sapiens
cacccgtgccacgcgctctgc

SEQ ID NO: 5581517 - DNA, 22 bp, Homo sapiens
cacccgtgccacgcgctctgca

SEQ ID NO: 5581518 - DNA, 16 bp, Homo sapiens
cacccgtggagatggg

SEQ ID NO: 5581519 - DNA, 17 bp, Homo sapiens
cacccgtggggtgctgc

SEQ ID NO: 5581520 - DNA, 14 bp, Homo sapiens
cacccgttaattta

SEQ ID NO: 5581521 - DNA, 21 bp, Homo sapiens
cacccgttctgctggcctgga

SEQ ID NO: 5581522 - DNA, 14 bp, Homo sapiens
cacccgtttccaag

SEQ ID NO: 5581523 - DNA, 16 bp, Homo sapiens
caccctaaagtctcag

SEQ ID NO: 5581524 - DNA, 18 bp, Homo sapiens
caccctaaagtctcaggt

SEQ ID NO: 5581525 - DNA, 16 bp, Homo sapiens
caccctaactcttgct

SEQ ID NO: 5581526 - DNA, 20 bp, Homo sapiens
caccctaactcttgctcact

SEQ ID NO: 5581527 - DNA, 22 bp, Homo sapiens
caccctaactcttgctcactcc

SEQ ID NO: 5581528 - DNA, 16 bp, Homo sapiens
caccctaactgagctg

SEQ ID NO: 5581529 - DNA, 16 bp, Homo sapiens
caccctaagggcagcc

SEQ ID NO: 5581530 - DNA, 19 bp, Homo sapiens
caccctaagggcagccctc

SEQ ID NO: 5581531 - DNA, 13 bp, Homo sapiens
caccctacagcag

SEQ ID NO: 5581532 - DNA, 17 bp, Homo sapiens
caccctacagcagatcc

SEQ ID NO: 5581533 - DNA, 18 bp, Homo sapiens
caccctacagcagatcca

SEQ ID NO: 5581534 - DNA, 19 bp, Homo sapiens
caccctacagcagatccac

SEQ ID NO: 5581535 - DNA, 18 bp, Homo sapiens
caccctaccagctcctcc

SEQ ID NO: 5581536 - DNA, 21 bp, Homo sapiens
caccctaccagctcctccagc

SEQ ID NO: 5581537 - DNA, 16 bp, Homo sapiens
caccctacctgttcag

SEQ ID NO: 5581538 - DNA, 22 bp, Homo sapiens
caccctaccttccccagacttg

SEQ ID NO: 5581539 - DNA, 20 bp, Homo sapiens
caccctacgctcatctctgg

SEQ ID NO: 5581540 - DNA, 15 bp, Homo sapiens
caccctactctggat

SEQ ID NO: 5581541 - DNA, 18 bp, Homo sapiens
caccctagtcccttcccc

SEQ ID NO: 5581542 - DNA, 13 bp, Homo sapiens
caccctatatata

SEQ ID NO: 5581543 - DNA, 17 bp, Homo sapiens
caccctatccctgtaca

SEQ ID NO: 5581544 - DNA, 18 bp, Homo sapiens
caccctatccctgtacag

SEQ ID NO: 5581545 - DNA, 15 bp, Homo sapiens
caccctatggccact

SEQ ID NO: 5581546 - DNA, 20 bp, Homo sapiens
caccctatggccactggccg

SEQ ID NO: 5581547 - DNA, 16 bp, Homo sapiens
caccctcaaatgtcag

SEQ ID NO: 5581548 - DNA, 18 bp, Homo sapiens
caccctcaacctcttctg

SEQ ID NO: 5581549 - DNA, 22 bp, Homo sapiens
caccctcacacacacagctggg

SEQ ID NO: 5581550 - DNA, 15 bp, Homo sapiens
caccctcacccactc

SEQ ID NO: 5581551 - DNA, 19 bp, Homo sapiens
caccctcaccccctcctgg

SEQ ID NO: 5581552 - DNA, 22 bp, Homo sapiens
caccctcaccccctcctggcaa

SEQ ID NO: 5581553 - DNA, 22 bp, Homo sapiens
caccctcaccgcggctggatgg

SEQ ID NO: 5581554 - DNA, 17 bp, Homo sapiens
caccctcactctgccag

SEQ ID NO: 5581555 - DNA, 20 bp, Homo sapiens
caccctcactggctctcctg

SEQ ID NO: 5581556 - DNA, 18 bp, Homo sapiens
caccctcagcaccccttc

SEQ ID NO: 5581557 - DNA, 20 bp, Homo sapiens
caccctcagcaccccttcca

SEQ ID NO: 5581558 - DNA, 12 bp, Homo sapiens
caccctcagctg

SEQ ID NO: 5581559 - DNA, 18 bp, Homo sapiens
caccctcagggagcctcc

SEQ ID NO: 5581560 - DNA, 15 bp, Homo sapiens
caccctcaggtgcct

SEQ ID NO: 5581561 - DNA, 14 bp, Homo sapiens
caccctcatgctgt

SEQ ID NO: 5581562 - DNA, 16 bp, Homo sapiens
caccctcatgctgtgt

SEQ ID NO: 5581563 - DNA, 19 bp, Homo sapiens
caccctcattccctcggga

SEQ ID NO: 5581564 - DNA, 19 bp, Homo sapiens
caccctcatttttccttta

SEQ ID NO: 5581565 - DNA, 16 bp, Homo sapiens
caccctccacaggagc

SEQ ID NO: 5581566 - DNA, 17 bp, Homo sapiens
caccctccacaggagcc

SEQ ID NO: 5581567 - DNA, 14 bp, Homo sapiens
caccctccaccctg

SEQ ID NO: 5581568 - DNA, 18 bp, Homo sapiens
caccctccaccctgtccc

SEQ ID NO: 5581569 - DNA, 14 bp, Homo sapiens
caccctccacctct

SEQ ID NO: 5581570 - DNA, 17 bp, Homo sapiens
caccctccacctctcac

SEQ ID NO: 5581571 - DNA, 15 bp, Homo sapiens
caccctccactcagc

SEQ ID NO: 5581572 - DNA, 19 bp, Homo sapiens
caccctccactctgaggtc

SEQ ID NO: 5581573 - DNA, 16 bp, Homo sapiens
caccctccagcacaga

SEQ ID NO: 5581574 - DNA, 19 bp, Homo sapiens
caccctccagcacagactg

SEQ ID NO: 5581575 - DNA, 14 bp, Homo sapiens
caccctccatgctc

SEQ ID NO: 5581576 - DNA, 21 bp, Homo sapiens
caccctccatgctcctcacct

SEQ ID NO: 5581577 - DNA, 16 bp, Homo sapiens
caccctcccacccggc

SEQ ID NO: 5581578 - DNA, 19 bp, Homo sapiens
caccctcccagacctgcct

SEQ ID NO: 5581579 - DNA, 22 bp, Homo sapiens
caccctcccagacctgcctctt

SEQ ID NO: 5581580 - DNA, 16 bp, Homo sapiens
caccctcccagctctg

SEQ ID NO: 5581581 - DNA, 20 bp, Homo sapiens
caccctcccccgccactcct

SEQ ID NO: 5581582 - DNA, 21 bp, Homo sapiens
caccctcccctatgctggtag

SEQ ID NO: 5581583 - DNA, 14 bp, Homo sapiens
caccctcccctccc

SEQ ID NO: 5581584 - DNA, 14 bp, Homo sapiens
caccctcccctctc

SEQ ID NO: 5581585 - DNA, 19 bp, Homo sapiens
caccctcccctctcttgca

SEQ ID NO: 5581586 - DNA, 16 bp, Homo sapiens
caccctccccttccca

SEQ ID NO: 5581587 - DNA, 11 bp, Homo sapiens
caccctcccta

SEQ ID NO: 5581588 - DNA, 14 bp, Homo sapiens
caccctccctccag

SEQ ID NO: 5581589 - DNA, 22 bp, Homo sapiens
caccctccctccgatccttcct

SEQ ID NO: 5581590 - DNA, 21 bp, Homo sapiens
caccctccggcgggtgacagc

SEQ ID NO: 5581591 - DNA, 13 bp, Homo sapiens
caccctcctactg

SEQ ID NO: 5581592 - DNA, 19 bp, Homo sapiens
caccctcctagcctgctct

SEQ ID NO: 5581593 - DNA, 20 bp, Homo sapiens
caccctcctagcctgctctg

SEQ ID NO: 5581594 - DNA, 18 bp, Homo sapiens
caccctcctccctccaag

SEQ ID NO: 5581595 - DNA, 14 bp, Homo sapiens
caccctcctctagc

SEQ ID NO: 5581596 - DNA, 21 bp, Homo sapiens
caccctcctctagccatccct

SEQ ID NO: 5581597 - DNA, 11 bp, Homo sapiens
caccctcctgc

SEQ ID NO: 5581598 - DNA, 15 bp, Homo sapiens
caccctcctgcccca

SEQ ID NO: 5581599 - DNA, 15 bp, Homo sapiens
caccctcctggcaca

SEQ ID NO: 5581600 - DNA, 14 bp, Homo sapiens
caccctcctgtctt

SEQ ID NO: 5581601 - DNA, 18 bp, Homo sapiens
caccctcctgtcttccca

SEQ ID NO: 5581602 - DNA, 21 bp, Homo sapiens
caccctcctgtcttcccaggg

SEQ ID NO: 5581603 - DNA, 13 bp, Homo sapiens
caccctccttccc

SEQ ID NO: 5581604 - DNA, 14 bp, Homo sapiens
caccctccttccca

SEQ ID NO: 5581605 - DNA, 20 bp, Homo sapiens
caccctccttgagactggag

SEQ ID NO: 5581606 - DNA, 19 bp, Homo sapiens
caccctcgaagcgcgccac

SEQ ID NO: 5581607 - DNA, 23 bp, Homo sapiens
caccctcgaagcgcgccactcgc

SEQ ID NO: 5581608 - DNA, 24 bp, Homo sapiens
caccctcgaagcgcgccactcgct

SEQ ID NO: 5581609 - DNA, 15 bp, Homo sapiens
caccctcgctgccac

SEQ ID NO: 5581610 - DNA, 18 bp, Homo sapiens
caccctcgctgccaccca

SEQ ID NO: 5581611 - DNA, 21 bp, Homo sapiens
caccctcggggatgtgtcctg

SEQ ID NO: 5581612 - DNA, 22 bp, Homo sapiens
caccctcggggatgtgtcctga

SEQ ID NO: 5581613 - DNA, 22 bp, Homo sapiens
caccctcggggggtcacaggcc

SEQ ID NO: 5581614 - DNA, 23 bp, Homo sapiens
caccctcggggggtcacaggccc

SEQ ID NO: 5581615 - DNA, 17 bp, Homo sapiens
caccctcgtggacacct

SEQ ID NO: 5581616 - DNA, 14 bp, Homo sapiens
caccctctatccca

SEQ ID NO: 5581617 - DNA, 16 bp, Homo sapiens
caccctctatcccaat

SEQ ID NO: 5581618 - DNA, 16 bp, Homo sapiens
caccctctccacaccc

SEQ ID NO: 5581619 - DNA, 15 bp, Homo sapiens
caccctctcctgggg

SEQ ID NO: 5581620 - DNA, 21 bp, Homo sapiens
caccctctctgtccaatctgc

SEQ ID NO: 5581621 - DNA, 18 bp, Homo sapiens
caccctctgagctttgca

SEQ ID NO: 5581622 - DNA, 16 bp, Homo sapiens
caccctctgcagggca

SEQ ID NO: 5581623 - DNA, 23 bp, Homo sapiens
caccctctgcccagggagtcctt

SEQ ID NO: 5581624 - DNA, 14 bp, Homo sapiens
caccctctgctgca

SEQ ID NO: 5581625 - DNA, 11 bp, Homo sapiens
caccctctggg

SEQ ID NO: 5581626 - DNA, 12 bp, Homo sapiens
caccctctggga

SEQ ID NO: 5581627 - DNA, 14 bp, Homo sapiens
caccctctgggagt

SEQ ID NO: 5581628 - DNA, 14 bp, Homo sapiens
caccctctgggcag

SEQ ID NO: 5581629 - DNA, 13 bp, Homo sapiens
caccctctgggga

SEQ ID NO: 5581630 - DNA, 14 bp, Homo sapiens
caccctctggggac

SEQ ID NO: 5581631 - DNA, 20 bp, Homo sapiens
caccctctgggggtcctctc

SEQ ID NO: 5581632 - DNA, 11 bp, Homo sapiens
caccctctgtc

SEQ ID NO: 5581633 - DNA, 13 bp, Homo sapiens
caccctctgtccc

SEQ ID NO: 5581634 - DNA, 19 bp, Homo sapiens
caccctctgtccccacgag

SEQ ID NO: 5581635 - DNA, 22 bp, Homo sapiens
caccctctgtccttcccccagc

SEQ ID NO: 5581636 - DNA, 16 bp, Homo sapiens
caccctcttcctactg

SEQ ID NO: 5581637 - DNA, 17 bp, Homo sapiens
caccctgaaagccctga

SEQ ID NO: 5581638 - DNA, 21 bp, Homo sapiens
caccctgaacaacgagccttt

SEQ ID NO: 5581639 - DNA, 23 bp, Homo sapiens
caccctgaacatttagtaccctg

SEQ ID NO: 5581640 - DNA, 23 bp, Homo sapiens
caccctgaagtcagcgggcccag

SEQ ID NO: 5581641 - DNA, 18 bp, Homo sapiens
caccctgaatggttccat

SEQ ID NO: 5581642 - DNA, 22 bp, Homo sapiens
caccctgaattcattgtctcag

SEQ ID NO: 5581643 - DNA, 12 bp, Homo sapiens
caccctgagccg

SEQ ID NO: 5581644 - DNA, 20 bp, Homo sapiens
caccctgagctcggggacag

SEQ ID NO: 5581645 - DNA, 18 bp, Homo sapiens
caccctgaggagtctgag

SEQ ID NO: 5581646 - DNA, 18 bp, Homo sapiens
caccctgaggagtgatgg

SEQ ID NO: 5581647 - DNA, 20 bp, Homo sapiens
caccctgaggagtgatgggc

SEQ ID NO: 5581648 - DNA, 11 bp, Homo sapiens
caccctgaggg

SEQ ID NO: 5581649 - DNA, 20 bp, Homo sapiens
caccctgaggtcagggagtg

SEQ ID NO: 5581650 - DNA, 14 bp, Homo sapiens
caccctgcaaggcc

SEQ ID NO: 5581651 - DNA, 17 bp, Homo sapiens
caccctgcacctgctgc

SEQ ID NO: 5581652 - DNA, 11 bp, Homo sapiens
caccctgcaga

SEQ ID NO: 5581653 - DNA, 19 bp, Homo sapiens
caccctgcagagcacacag

SEQ ID NO: 5581654 - DNA, 23 bp, Homo sapiens
caccctgcagagcacacaggtac

SEQ ID NO: 5581655 - DNA, 14 bp, Homo sapiens
caccctgcagagct

SEQ ID NO: 5581656 - DNA, 18 bp, Homo sapiens
caccctgcattacatgtg

SEQ ID NO: 5581657 - DNA, 10 bp, Homo sapiens
caccctgcca

SEQ ID NO: 5581658 - DNA, 19 bp, Homo sapiens
caccctgccaagactcctc

SEQ ID NO: 5581659 - DNA, 18 bp, Homo sapiens
caccctgccaccctctgc

SEQ ID NO: 5581660 - DNA, 15 bp, Homo sapiens
caccctgcccagtct

SEQ ID NO: 5581661 - DNA, 19 bp, Homo sapiens
caccctgccccaccccacc

SEQ ID NO: 5581662 - DNA, 15 bp, Homo sapiens
caccctgcccctaag

SEQ ID NO: 5581663 - DNA, 17 bp, Homo sapiens
caccctgcccctgcaaa

SEQ ID NO: 5581664 - DNA, 21 bp, Homo sapiens
caccctgcccctgcaaagaca

SEQ ID NO: 5581665 - DNA, 20 bp, Homo sapiens
caccctgcccctttcttccc

SEQ ID NO: 5581666 - DNA, 22 bp, Homo sapiens
caccctgcccctttcttcccca

SEQ ID NO: 5581667 - DNA, 20 bp, Homo sapiens
caccctgccctcatgggacc

SEQ ID NO: 5581668 - DNA, 12 bp, Homo sapiens
caccctgccctg

SEQ ID NO: 5581669 - DNA, 16 bp, Homo sapiens
caccctgccctggcct

SEQ ID NO: 5581670 - DNA, 21 bp, Homo sapiens
caccctgcctacgccaggaga

SEQ ID NO: 5581671 - DNA, 13 bp, Homo sapiens
caccctgcctgct

SEQ ID NO: 5581672 - DNA, 15 bp, Homo sapiens
caccctgcctgctgt

SEQ ID NO: 5581673 - DNA, 14 bp, Homo sapiens
caccctgcctgtgg

SEQ ID NO: 5581674 - DNA, 13 bp, Homo sapiens
caccctgccttat

SEQ ID NO: 5581675 - DNA, 19 bp, Homo sapiens
caccctgccttatcttgca

SEQ ID NO: 5581676 - DNA, 14 bp, Homo sapiens
caccctgcgggcca

SEQ ID NO: 5581677 - DNA, 15 bp, Homo sapiens
caccctgcgggccag

SEQ ID NO: 5581678 - DNA, 16 bp, Homo sapiens
caccctgcgggccagg

SEQ ID NO: 5581679 - DNA, 19 bp, Homo sapiens
caccctgcgggccagggtc

SEQ ID NO: 5581680 - DNA, 16 bp, Homo sapiens
caccctgctcctcctg

SEQ ID NO: 5581681 - DNA, 21 bp, Homo sapiens
caccctgctcctcctgccctg

SEQ ID NO: 5581682 - DNA, 12 bp, Homo sapiens
caccctgctctc

SEQ ID NO: 5581683 - DNA, 16 bp, Homo sapiens
caccctgctgagtctg

SEQ ID NO: 5581684 - DNA, 15 bp, Homo sapiens
caccctgctgccttc

SEQ ID NO: 5581685 - DNA, 13 bp, Homo sapiens
caccctgcttctc

SEQ ID NO: 5581686 - DNA, 21 bp, Homo sapiens
caccctgcttctcccggggac

SEQ ID NO: 5581687 - DNA, 15 bp, Homo sapiens
caccctgcttctgct

SEQ ID NO: 5581688 - DNA, 16 bp, Homo sapiens
caccctgcttctgctg

SEQ ID NO: 5581689 - DNA, 16 bp, Homo sapiens
caccctgcttggccca

SEQ ID NO: 5581690 - DNA, 19 bp, Homo sapiens
caccctgcttggggcctgg

SEQ ID NO: 5581691 - DNA, 20 bp, Homo sapiens
caccctgcttggggcctggc

SEQ ID NO: 5581692 - DNA, 17 bp, Homo sapiens
caccctggaaaggggag

SEQ ID NO: 5581693 - DNA, 11 bp, Homo sapiens
caccctggaat

SEQ ID NO: 5581694 - DNA, 22 bp, Homo sapiens
caccctggaggctctctctgcc

SEQ ID NO: 5581695 - DNA, 23 bp, Homo sapiens
caccctggagtggcatggtcctg

SEQ ID NO: 5581696 - DNA, 13 bp, Homo sapiens
caccctggcccca

SEQ ID NO: 5581697 - DNA, 16 bp, Homo sapiens
caccctggccccaact

SEQ ID NO: 5581698 - DNA, 12 bp, Homo sapiens
caccctggcccg

SEQ ID NO: 5581699 - DNA, 17 bp, Homo sapiens
caccctggcccgcccct

SEQ ID NO: 5581700 - DNA, 21 bp, Homo sapiens
caccctggccgagtccaagct

SEQ ID NO: 5581701 - DNA, 19 bp, Homo sapiens
caccctggcctagaccagc

SEQ ID NO: 5581702 - DNA, 13 bp, Homo sapiens
caccctggcctga

SEQ ID NO: 5581703 - DNA, 15 bp, Homo sapiens
caccctggcctggtc

SEQ ID NO: 5581704 - DNA, 16 bp, Homo sapiens
caccctggctgggatc

SEQ ID NO: 5581705 - DNA, 19 bp, Homo sapiens
caccctgggatggaacctc

SEQ ID NO: 5581706 - DNA, 23 bp, Homo sapiens
caccctgggatggaacctcagga

SEQ ID NO: 5581707 - DNA, 19 bp, Homo sapiens
caccctgggatgggccacc

SEQ ID NO: 5581708 - DNA, 20 bp, Homo sapiens
caccctgggatgggccaccc

SEQ ID NO: 5581709 - DNA, 22 bp, Homo sapiens
caccctgggcagtgagtgccat

SEQ ID NO: 5581710 - DNA, 16 bp, Homo sapiens
caccctgggccacgcc

SEQ ID NO: 5581711 - DNA, 12 bp, Homo sapiens
caccctgggccc

SEQ ID NO: 5581712 - DNA, 23 bp, Homo sapiens
caccctgggccctgggctggaat

SEQ ID NO: 5581713 - DNA, 14 bp, Homo sapiens
caccctgggcctcc

SEQ ID NO: 5581714 - DNA, 19 bp, Homo sapiens
caccctgggctctgtgggc

SEQ ID NO: 5581715 - DNA, 13 bp, Homo sapiens
caccctggggcct

SEQ ID NO: 5581716 - DNA, 14 bp, Homo sapiens
caccctggggcctg

SEQ ID NO: 5581717 - DNA, 19 bp, Homo sapiens
caccctggggcctggacct

SEQ ID NO: 5581718 - DNA, 17 bp, Homo sapiens
caccctgggtgccattc

SEQ ID NO: 5581719 - DNA, 21 bp, Homo sapiens
caccctgggtttggcccctgg

SEQ ID NO: 5581720 - DNA, 14 bp, Homo sapiens
caccctggtcctga

SEQ ID NO: 5581721 - DNA, 15 bp, Homo sapiens
caccctggtgggcca

SEQ ID NO: 5581722 - DNA, 16 bp, Homo sapiens
caccctgtacctcatc

SEQ ID NO: 5581723 - DNA, 22 bp, Homo sapiens
caccctgtacctcatcccatga

SEQ ID NO: 5581724 - DNA, 16 bp, Homo sapiens
caccctgtagatgttc

SEQ ID NO: 5581725 - DNA, 18 bp, Homo sapiens
caccctgtagatgttcta

SEQ ID NO: 5581726 - DNA, 23 bp, Homo sapiens
caccctgtccaaactgcctaagc

SEQ ID NO: 5581727 - DNA, 15 bp, Homo sapiens
caccctgtcccaggc

SEQ ID NO: 5581728 - DNA, 18 bp, Homo sapiens
caccctgtcccaggcagc

SEQ ID NO: 5581729 - DNA, 15 bp, Homo sapiens
caccctgtcccccag

SEQ ID NO: 5581730 - DNA, 20 bp, Homo sapiens
caccctgtcccccagctctg

SEQ ID NO: 5581731 - DNA, 22 bp, Homo sapiens
caccctgtcccccagctctggt

SEQ ID NO: 5581732 - DNA, 23 bp, Homo sapiens
caccctgtcccccagctctggtg

SEQ ID NO: 5581733 - DNA, 17 bp, Homo sapiens
caccctgtcctatgact

SEQ ID NO: 5581734 - DNA, 19 bp, Homo sapiens
caccctgtcctgcacaccc

SEQ ID NO: 5581735 - DNA, 20 bp, Homo sapiens
caccctgtcctgcacaccct

SEQ ID NO: 5581736 - DNA, 22 bp, Homo sapiens
caccctgtcctgcacaccctgg

SEQ ID NO: 5581737 - DNA, 15 bp, Homo sapiens
caccctgtctgcagg

SEQ ID NO: 5581738 - DNA, 12 bp, Homo sapiens
caccctgtcttc

SEQ ID NO: 5581739 - DNA, 23 bp, Homo sapiens
caccctgtgatggggccctgcct

SEQ ID NO: 5581740 - DNA, 15 bp, Homo sapiens
caccctgtgcccctt

SEQ ID NO: 5581741 - DNA, 16 bp, Homo sapiens
caccctgtggccctgg

SEQ ID NO: 5581742 - DNA, 12 bp, Homo sapiens
caccctgtgggt

SEQ ID NO: 5581743 - DNA, 20 bp, Homo sapiens
caccctgtgggtgtctccct

SEQ ID NO: 5581744 - DNA, 22 bp, Homo sapiens
caccctgttacttatgtagaaa

SEQ ID NO: 5581745 - DNA, 16 bp, Homo sapiens
caccctgttccctctt

SEQ ID NO: 5581746 - DNA, 18 bp, Homo sapiens
caccctgttcctgctgct

SEQ ID NO: 5581747 - DNA, 18 bp, Homo sapiens
caccctgtttggattttt

SEQ ID NO: 5581748 - DNA, 22 bp, Homo sapiens
caccctgtttggatttttaatt

SEQ ID NO: 5581749 - DNA, 17 bp, Homo sapiens
cacccttaacccaagga

SEQ ID NO: 5581750 - DNA, 20 bp, Homo sapiens
cacccttaacccaaggagca

SEQ ID NO: 5581751 - DNA, 23 bp, Homo sapiens
cacccttaacccaaggagcacag

SEQ ID NO: 5581752 - DNA, 16 bp, Homo sapiens
cacccttaccatgtgc

SEQ ID NO: 5581753 - DNA, 16 bp, Homo sapiens
cacccttacttcctgg

SEQ ID NO: 5581754 - DNA, 22 bp, Homo sapiens
cacccttacttcctggcctctt

SEQ ID NO: 5581755 - DNA, 20 bp, Homo sapiens
cacccttcacataccctccc

SEQ ID NO: 5581756 - DNA, 22 bp, Homo sapiens
cacccttcacataccctccccc

SEQ ID NO: 5581757 - DNA, 22 bp, Homo sapiens
cacccttcacgctggcttccag

SEQ ID NO: 5581758 - DNA, 23 bp, Homo sapiens
cacccttcacgctggcttccagc

SEQ ID NO: 5581759 - DNA, 16 bp, Homo sapiens
cacccttcagacccca

SEQ ID NO: 5581760 - DNA, 11 bp, Homo sapiens
cacccttcccc

SEQ ID NO: 5581761 - DNA, 21 bp, Homo sapiens
cacccttccccactcccgtga

SEQ ID NO: 5581762 - DNA, 14 bp, Homo sapiens
cacccttcccctcc

SEQ ID NO: 5581763 - DNA, 22 bp, Homo sapiens
cacccttcccctccttctccct

SEQ ID NO: 5581764 - DNA, 23 bp, Homo sapiens
cacccttcccctccttctccctt

SEQ ID NO: 5581765 - DNA, 22 bp, Homo sapiens
cacctctgggccctgcaggagg

SEQ ID NO: 5581766 - DNA, 13 bp, Homo sapiens
cacctctgggctt

SEQ ID NO: 5581767 - DNA, 17 bp, Homo sapiens
cacctctggtggctcct

SEQ ID NO: 5581768 - DNA, 18 bp, Homo sapiens
cacctctggtggctcctc

SEQ ID NO: 5581769 - DNA, 19 bp, Homo sapiens
cacctctgtcatttgttgt

SEQ ID NO: 5581770 - DNA, 20 bp, Homo sapiens
cacctctgtgacccctcctt

SEQ ID NO: 5581771 - DNA, 17 bp, Homo sapiens
cacctctgtgacctcag

SEQ ID NO: 5581772 - DNA, 12 bp, Homo sapiens
cacctctgtgca

SEQ ID NO: 5581773 - DNA, 13 bp, Homo sapiens
cacctctgtgcag

SEQ ID NO: 5581774 - DNA, 22 bp, Homo sapiens
cacctctgtgctgcatcccacc

SEQ ID NO: 5581775 - DNA, 14 bp, Homo sapiens
cacctcttcacaat

SEQ ID NO: 5581776 - DNA, 14 bp, Homo sapiens
cacctcttcacccc

SEQ ID NO: 5581777 - DNA, 20 bp, Homo sapiens
cacctcttcaccccccactc

SEQ ID NO: 5581778 - DNA, 11 bp, Homo sapiens
cacctcttcca

SEQ ID NO: 5581779 - DNA, 19 bp, Homo sapiens
cacctcttccactccttct

SEQ ID NO: 5581780 - DNA, 13 bp, Homo sapiens
cacctcttccgac

SEQ ID NO: 5581781 - DNA, 24 bp, Homo sapiens
cacctcttcctctggttcctttca

SEQ ID NO: 5581782 - DNA, 15 bp, Homo sapiens
cacctcttcctggcc

SEQ ID NO: 5581783 - DNA, 16 bp, Homo sapiens
cacctcttcctggccg

SEQ ID NO: 5581784 - DNA, 12 bp, Homo sapiens
cacctcttcctt

SEQ ID NO: 5581785 - DNA, 17 bp, Homo sapiens
cacctcttctcttcctg

SEQ ID NO: 5581786 - DNA, 11 bp, Homo sapiens
cacctcttctt

SEQ ID NO: 5581787 - DNA, 22 bp, Homo sapiens
cacctcttcttttcacctcttt

SEQ ID NO: 5581788 - DNA, 13 bp, Homo sapiens
cacctcttgggca

SEQ ID NO: 5581789 - DNA, 12 bp, Homo sapiens
cacctctttaaa

SEQ ID NO: 5581790 - DNA, 14 bp, Homo sapiens
cacctgaaacactt

SEQ ID NO: 5581791 - DNA, 15 bp, Homo sapiens
cacctgaaacacttt

SEQ ID NO: 5581792 - DNA, 15 bp, Homo sapiens
cacctgaaagcctgt

SEQ ID NO: 5581793 - DNA, 18 bp, Homo sapiens
cacctgaaattaatttgt

SEQ ID NO: 5581794 - DNA, 22 bp, Homo sapiens
cacctgaaattaatttgtgaat

SEQ ID NO: 5581795 - DNA, 14 bp, Homo sapiens
cacctgaaccactg

SEQ ID NO: 5581796 - DNA, 16 bp, Homo sapiens
cacctgaaccccagag

SEQ ID NO: 5581797 - DNA, 19 bp, Homo sapiens
cacctgaactgaacaccat

SEQ ID NO: 5581798 - DNA, 14 bp, Homo sapiens
cacctgaagactca

SEQ ID NO: 5581799 - DNA, 17 bp, Homo sapiens
cacctgaatcagctgga

SEQ ID NO: 5581800 - DNA, 20 bp, Homo sapiens
cacctgaatcagctggacat

SEQ ID NO: 5581801 - DNA, 15 bp, Homo sapiens
cacctgaatttgtat

SEQ ID NO: 5581802 - DNA, 20 bp, Homo sapiens
cacctgacaatggcagctag

SEQ ID NO: 5581803 - DNA, 17 bp, Homo sapiens
cacctgacacaccaggc

SEQ ID NO: 5581804 - DNA, 18 bp, Homo sapiens
cacctgacagcccctccc

SEQ ID NO: 5581805 - DNA, 22 bp, Homo sapiens
cacctgaccgctgcccaggtgg

SEQ ID NO: 5581806 - DNA, 17 bp, Homo sapiens
cacctgacctctgaaga

SEQ ID NO: 5581807 - DNA, 15 bp, Homo sapiens
cacctgacctctgca

SEQ ID NO: 5581808 - DNA, 18 bp, Homo sapiens
cacctgacctctgcaaga

SEQ ID NO: 5581809 - DNA, 21 bp, Homo sapiens
cacctgacctcttgctgccag

SEQ ID NO: 5581810 - DNA, 21 bp, Homo sapiens
cacctgacgctgcatgagaca

SEQ ID NO: 5581811 - DNA, 16 bp, Homo sapiens
cacctgacggctgggg

SEQ ID NO: 5581812 - DNA, 15 bp, Homo sapiens
cacctgacttggctg

SEQ ID NO: 5581813 - DNA, 21 bp, Homo sapiens
cacctgacttggctggggagg

SEQ ID NO: 5581814 - DNA, 14 bp, Homo sapiens
cacctgagacccta

SEQ ID NO: 5581815 - DNA, 21 bp, Homo sapiens
cacctgagcccggatgcttct

SEQ ID NO: 5581816 - DNA, 23 bp, Homo sapiens
cacctgagcccggatgcttctcc

SEQ ID NO: 5581817 - DNA, 14 bp, Homo sapiens
cacctgagctttgg

SEQ ID NO: 5581818 - DNA, 14 bp, Homo sapiens
cacctgaggcagga

SEQ ID NO: 5581819 - DNA, 13 bp, Homo sapiens
cacctgaggccca

SEQ ID NO: 5581820 - DNA, 16 bp, Homo sapiens
cacctgaggcccagca

SEQ ID NO: 5581821 - DNA, 13 bp, Homo sapiens
cacctgaggcccc

SEQ ID NO: 5581822 - DNA, 19 bp, Homo sapiens
cacctgaggctcagcccta

SEQ ID NO: 5581823 - DNA, 22 bp, Homo sapiens
cacctgaggctgaggcaggaga

SEQ ID NO: 5581824 - DNA, 18 bp, Homo sapiens
cacctgagggggaaaaaa

SEQ ID NO: 5581825 - DNA, 15 bp, Homo sapiens
cacctgaggtgggcc

SEQ ID NO: 5581826 - DNA, 20 bp, Homo sapiens
cacctgaggtgggcccagga

SEQ ID NO: 5581827 - DNA, 21 bp, Homo sapiens
cacctgaggtgggctggggct

SEQ ID NO: 5581828 - DNA, 18 bp, Homo sapiens
cacctgaggttaggagtt

SEQ ID NO: 5581829 - DNA, 17 bp, Homo sapiens
cacctgagtgtccttgc

SEQ ID NO: 5581830 - DNA, 15 bp, Homo sapiens
cacctgagttcctga

SEQ ID NO: 5581831 - DNA, 17 bp, Homo sapiens
cacctgatattcaggct

SEQ ID NO: 5581832 - DNA, 20 bp, Homo sapiens
cacctgatctggcccaagct

SEQ ID NO: 5581833 - DNA, 16 bp, Homo sapiens
cacctgatgacatggt

SEQ ID NO: 5581834 - DNA, 15 bp, Homo sapiens
cacctgattcaacta

SEQ ID NO: 5581835 - DNA, 17 bp, Homo sapiens
cacctgattttgaaggt

SEQ ID NO: 5581836 - DNA, 12 bp, Homo sapiens
cacctgcaagat

SEQ ID NO: 5581837 - DNA, 15 bp, Homo sapiens
cacctgcaagcccca

SEQ ID NO: 5581838 - DNA, 18 bp, Homo sapiens
cacctgcaagccccaggg

SEQ ID NO: 5581839 - DNA, 19 bp, Homo sapiens
cacctgcaagccccagggc

SEQ ID NO: 5581840 - DNA, 21 bp, Homo sapiens
cacctgcaagccccagggcct

SEQ ID NO: 5581841 - DNA, 21 bp, Homo sapiens
cacctgcaagtgcccgccctg

SEQ ID NO: 5581842 - DNA, 22 bp, Homo sapiens
cacctgcaagtgcccgccctgc

SEQ ID NO: 5581843 - DNA, 23 bp, Homo sapiens
cacctgcaagtgcccgccctgcc

SEQ ID NO: 5581844 - DNA, 16 bp, Homo sapiens
cacctgcaatcccagc

SEQ ID NO: 5581845 - DNA, 17 bp, Homo sapiens
cacctgcaatcccagca

SEQ ID NO: 5581846 - DNA, 11 bp, Homo sapiens
cacctgcacac

SEQ ID NO: 5581847 - DNA, 21 bp, Homo sapiens
cacctgcacacccctgcacac

SEQ ID NO: 5581848 - DNA, 14 bp, Homo sapiens
cacctgcacactcc

SEQ ID NO: 5581849 - DNA, 23 bp, Homo sapiens
cacctgcacactccatctcctgc

SEQ ID NO: 5581850 - DNA, 15 bp, Homo sapiens
cacctgcacctcccc

SEQ ID NO: 5581851 - DNA, 23 bp, Homo sapiens
cacctgcacttaaggcactctgt

SEQ ID NO: 5581852 - DNA, 13 bp, Homo sapiens
cacctgcagattc

SEQ ID NO: 5581853 - DNA, 11 bp, Homo sapiens
cacctgcagcc

SEQ ID NO: 5581854 - DNA, 17 bp, Homo sapiens
cacctgcagccccaggc

SEQ ID NO: 5581855 - DNA, 20 bp, Homo sapiens
cacctgcagccccaggcctc

SEQ ID NO: 5581856 - DNA, 20 bp, Homo sapiens
cacctgcagcgctgggcccc

SEQ ID NO: 5581857 - DNA, 14 bp, Homo sapiens
cacctgcagcgtct

SEQ ID NO: 5581858 - DNA, 14 bp, Homo sapiens
cacctgcagctccc

SEQ ID NO: 5581859 - DNA, 11 bp, Homo sapiens
cacctgcagga

SEQ ID NO: 5581860 - DNA, 23 bp, Homo sapiens
cacctgcaggaccctgtcctgca

SEQ ID NO: 5581861 - DNA, 21 bp, Homo sapiens
cacctgcagggagcagcacgc

SEQ ID NO: 5581862 - DNA, 12 bp, Homo sapiens
cacctgcagtgc

SEQ ID NO: 5581863 - DNA, 22 bp, Homo sapiens
cacctgcagtgccagctccctc

SEQ ID NO: 5581864 - DNA, 14 bp, Homo sapiens
cacctgcatcagcc

SEQ ID NO: 5581865 - DNA, 19 bp, Homo sapiens
cacctgcatcagcctctgg

SEQ ID NO: 5581866 - DNA, 20 bp, Homo sapiens
cacctgcatcagcctctggc

SEQ ID NO: 5581867 - DNA, 23 bp, Homo sapiens
cacctgcatcagcctctggccag

SEQ ID NO: 5581868 - DNA, 10 bp, Homo sapiens
cacctgccac

SEQ ID NO: 5581869 - DNA, 17 bp, Homo sapiens
cacctgccacccccagg

SEQ ID NO: 5581870 - DNA, 15 bp, Homo sapiens
cacctgccaccctgg

SEQ ID NO: 5581871 - DNA, 23 bp, Homo sapiens
cacctgccaccctgggcctggca

SEQ ID NO: 5581872 - DNA, 12 bp, Homo sapiens
cacctgccaccg

SEQ ID NO: 5581873 - DNA, 16 bp, Homo sapiens
cacctgccaccgccag

SEQ ID NO: 5581874 - DNA, 18 bp, Homo sapiens
cacctgccactaggctgg

SEQ ID NO: 5581875 - DNA, 15 bp, Homo sapiens
cacctgccagccatc

SEQ ID NO: 5581876 - DNA, 16 bp, Homo sapiens
cacctgccagccatca

SEQ ID NO: 5581877 - DNA, 14 bp, Homo sapiens
cacctgccagcctg

SEQ ID NO: 5581878 - DNA, 17 bp, Homo sapiens
cacctgccagcctggct

SEQ ID NO: 5581879 - DNA, 22 bp, Homo sapiens
cacctgccagcggtttcctggt

SEQ ID NO: 5581880 - DNA, 17 bp, Homo sapiens
cacctgccagggacaga

SEQ ID NO: 5581881 - DNA, 17 bp, Homo sapiens
cacctgccatttgcacc

SEQ ID NO: 5581882 - DNA, 19 bp, Homo sapiens
cacctgcccaacctgctct

SEQ ID NO: 5581883 - DNA, 14 bp, Homo sapiens
cacctgcccagtta

SEQ ID NO: 5581884 - DNA, 18 bp, Homo sapiens
cacctgcccagttagccc

SEQ ID NO: 5581885 - DNA, 22 bp, Homo sapiens
cacctgcccagttagcccggcc

SEQ ID NO: 5581886 - DNA, 16 bp, Homo sapiens
cacctgccccaactct

SEQ ID NO: 5581887 - DNA, 12 bp, Homo sapiens
cacctgccccag

SEQ ID NO: 5581888 - DNA, 14 bp, Homo sapiens
cacctgccccagcg

SEQ ID NO: 5581889 - DNA, 13 bp, Homo sapiens
cacctgccccagg

SEQ ID NO: 5581890 - DNA, 14 bp, Homo sapiens
cacctgccccaggc

SEQ ID NO: 5581891 - DNA, 15 bp, Homo sapiens
cacctgcccccacag

SEQ ID NO: 5581892 - DNA, 18 bp, Homo sapiens
cacctgcccccacagctc

SEQ ID NO: 5581893 - DNA, 20 bp, Homo sapiens
cacctgcccccacagctcct

SEQ ID NO: 5581894 - DNA, 22 bp, Homo sapiens
cacctgcccccacagctccttg

SEQ ID NO: 5581895 - DNA, 15 bp, Homo sapiens
cacctgccccctggt

SEQ ID NO: 5581896 - DNA, 13 bp, Homo sapiens
cacctgccccctt

SEQ ID NO: 5581897 - DNA, 15 bp, Homo sapiens
cacctgcccccttct

SEQ ID NO: 5581898 - DNA, 19 bp, Homo sapiens
cacctgcccccttctccca

SEQ ID NO: 5581899 - DNA, 20 bp, Homo sapiens
cacctgcccccttctcccac

SEQ ID NO: 5581900 - DNA, 18 bp, Homo sapiens
cacctgccccgtagagaa

SEQ ID NO: 5581901 - DNA, 13 bp, Homo sapiens
cacctgccccgtg

SEQ ID NO: 5581902 - DNA, 14 bp, Homo sapiens
cacctgccctacct

SEQ ID NO: 5581903 - DNA, 14 bp, Homo sapiens
cacctgccctctgt

SEQ ID NO: 5581904 - DNA, 13 bp, Homo sapiens
cacctgccctgcc

SEQ ID NO: 5581905 - DNA, 21 bp, Homo sapiens
cacctgccctgccctgccacc

SEQ ID NO: 5581906 - DNA, 23 bp, Homo sapiens
cacctgcccttttttctgcctcc

SEQ ID NO: 5581907 - DNA, 13 bp, Homo sapiens
cacctgccgacct

SEQ ID NO: 5581908 - DNA, 17 bp, Homo sapiens
cacctgccgccctgtgg

SEQ ID NO: 5581909 - DNA, 18 bp, Homo sapiens
cacctgccgccctgtggg

SEQ ID NO: 5581910 - DNA, 22 bp, Homo sapiens
cacctgccgctgcttgagtgga

SEQ ID NO: 5581911 - DNA, 17 bp, Homo sapiens
cacctgccggctctggg

SEQ ID NO: 5581912 - DNA, 24 bp, Homo sapiens
cacctgccgtggacttggggtcag

SEQ ID NO: 5581913 - DNA, 12 bp, Homo sapiens
cacctgcctcag

SEQ ID NO: 5581914 - DNA, 13 bp, Homo sapiens
cacctgcctcagg

SEQ ID NO: 5581915 - DNA, 20 bp, Homo sapiens
cacctgcctccaccagcaag

SEQ ID NO: 5581916 - DNA, 14 bp, Homo sapiens
cacctgcctccagc

SEQ ID NO: 5581917 - DNA, 23 bp, Homo sapiens
cacctgcctccggcctgcactcc

SEQ ID NO: 5581918 - DNA, 16 bp, Homo sapiens
cacctgcctctgaact

SEQ ID NO: 5581919 - DNA, 10 bp, Homo sapiens
cacctgcctg

SEQ ID NO: 5581920 - DNA, 11 bp, Homo sapiens
cacctgcctgc

SEQ ID NO: 5581921 - DNA, 14 bp, Homo sapiens
cacctgcctgcaga

SEQ ID NO: 5581922 - DNA, 23 bp, Homo sapiens
cacctgcctgcagagcaggaaat

SEQ ID NO: 5581923 - DNA, 15 bp, Homo sapiens
cacctgcctgccctc

SEQ ID NO: 5581924 - DNA, 18 bp, Homo sapiens
cacctgcctggccggcca

SEQ ID NO: 5581925 - DNA, 22 bp, Homo sapiens
cacctgcctggccggccagcca

SEQ ID NO: 5581926 - DNA, 23 bp, Homo sapiens
cacctgcctggtgcattgctgtg

SEQ ID NO: 5581927 - DNA, 16 bp, Homo sapiens
cacctgccttctaccc

SEQ ID NO: 5581928 - DNA, 17 bp, Homo sapiens
cacctgccttggcctcc

SEQ ID NO: 5581929 - DNA, 22 bp, Homo sapiens
cacctgcgagaggtccctgctt

SEQ ID NO: 5581930 - DNA, 21 bp, Homo sapiens
cacctgcgcaagtgcctggga

SEQ ID NO: 5581931 - DNA, 15 bp, Homo sapiens
cacctgcgcacaggt

SEQ ID NO: 5581932 - DNA, 20 bp, Homo sapiens
cacctgcgcagggccctctg

SEQ ID NO: 5581933 - DNA, 18 bp, Homo sapiens
cacctgcggggccaccca

SEQ ID NO: 5581934 - DNA, 19 bp, Homo sapiens
cacctgcggtgctatctcc

SEQ ID NO: 5581935 - DNA, 20 bp, Homo sapiens
cacctgcggtgctatctccc

SEQ ID NO: 5581936 - DNA, 21 bp, Homo sapiens
cacctgctagtcgcccctcag

SEQ ID NO: 5581937 - DNA, 15 bp, Homo sapiens
cacctgctcacaggg

SEQ ID NO: 5581938 - DNA, 13 bp, Homo sapiens
cacctgctccaga

SEQ ID NO: 5581939 - DNA, 14 bp, Homo sapiens
cacctgctcccaca

SEQ ID NO: 5581940 - DNA, 20 bp, Homo sapiens
cacctgctcccacagaaggg

SEQ ID NO: 5581941 - DNA, 13 bp, Homo sapiens
cacctgctcccag

SEQ ID NO: 5581942 - DNA, 19 bp, Homo sapiens
cacctgctcccaggccagt

SEQ ID NO: 5581943 - DNA, 20 bp, Homo sapiens
cacctgctcccagtcctgcc

SEQ ID NO: 5581944 - DNA, 15 bp, Homo sapiens
cacgacgtcagcctc

SEQ ID NO: 5581945 - DNA, 12 bp, Homo sapiens
cacgactcttcc

SEQ ID NO: 5581946 - DNA, 15 bp, Homo sapiens
cacgactgcgggagc

SEQ ID NO: 5581947 - DNA, 13 bp, Homo sapiens
cacgactgtctcc

SEQ ID NO: 5581948 - DNA, 20 bp, Homo sapiens
cacgactgttgtacaagctc

SEQ ID NO: 5581949 - DNA, 21 bp, Homo sapiens
cacgactgttgtacaagctca

SEQ ID NO: 5581950 - DNA, 22 bp, Homo sapiens
cacgactgttgtacaagctcag

SEQ ID NO: 5581951 - DNA, 17 bp, Homo sapiens
cacgacttctgtttcac

SEQ ID NO: 5581952 - DNA, 13 bp, Homo sapiens
cacgagatttctt

SEQ ID NO: 5581953 - DNA, 22 bp, Homo sapiens
cacgagatttcttttttatgtg

SEQ ID NO: 5581954 - DNA, 14 bp, Homo sapiens
cacgagcaaaccca

SEQ ID NO: 5581955 - DNA, 20 bp, Homo sapiens
cacgagcaaacccagaggtg

SEQ ID NO: 5581956 - DNA, 22 bp, Homo sapiens
cacgagcaaacccagaggtgga

SEQ ID NO: 5581957 - DNA, 23 bp, Homo sapiens
cacgagcagacacccttggagct

SEQ ID NO: 5581958 - DNA, 12 bp, Homo sapiens
cacgagccacaa

SEQ ID NO: 5581959 - DNA, 16 bp, Homo sapiens
cacgagccacaagctg

SEQ ID NO: 5581960 - DNA, 17 bp, Homo sapiens
cacgagccacaagctgc

SEQ ID NO: 5581961 - DNA, 18 bp, Homo sapiens
cacgagccacaagctgca

SEQ ID NO: 5581962 - DNA, 18 bp, Homo sapiens
cacgagcccattctcatg

SEQ ID NO: 5581963 - DNA, 20 bp, Homo sapiens
cacgagctgtttactaggga

SEQ ID NO: 5581964 - DNA, 17 bp, Homo sapiens
cacgaggaggaaccagg

SEQ ID NO: 5581965 - DNA, 19 bp, Homo sapiens
cacgaggccttcagaaaag

SEQ ID NO: 5581966 - DNA, 20 bp, Homo sapiens
cacgagggtaggaccctcat

SEQ ID NO: 5581967 - DNA, 22 bp, Homo sapiens
cacgagggtctcccctcctgca

SEQ ID NO: 5581968 - DNA, 23 bp, Homo sapiens
cacgagggtctcccctcctgcac

SEQ ID NO: 5581969 - DNA, 21 bp, Homo sapiens
cacgagtaagatattatttaa

SEQ ID NO: 5581970 - DNA, 17 bp, Homo sapiens
cacgagtaagattaaga

SEQ ID NO: 5581971 - DNA, 23 bp, Homo sapiens
cacgagtcacctgcaagccccag

SEQ ID NO: 5581972 - DNA, 22 bp, Homo sapiens
cacgagtgtagtcccggaggcc

SEQ ID NO: 5581973 - DNA, 20 bp, Homo sapiens
cacgataaataatcggccca

SEQ ID NO: 5581974 - DNA, 17 bp, Homo sapiens
cacgatcccctccccca

SEQ ID NO: 5581975 - DNA, 14 bp, Homo sapiens
cacgatcctgccac

SEQ ID NO: 5581976 - DNA, 13 bp, Homo sapiens
cacgatctcggct

SEQ ID NO: 5581977 - DNA, 15 bp, Homo sapiens
cacgatgaaaaactt

SEQ ID NO: 5581978 - DNA, 19 bp, Homo sapiens
cacgatgcatttaataaag

SEQ ID NO: 5581979 - DNA, 21 bp, Homo sapiens
cacgatgcatttaataaagat

SEQ ID NO: 5581980 - DNA, 22 bp, Homo sapiens
cacgatgcatttaataaagatg

SEQ ID NO: 5581981 - DNA, 17 bp, Homo sapiens
cacgatgccgagacctc

SEQ ID NO: 5581982 - DNA, 21 bp, Homo sapiens
cacgatgccgagacctcaagc

SEQ ID NO: 5581983 - DNA, 18 bp, Homo sapiens
cacgatgtggccctggcc

SEQ ID NO: 5581984 - DNA, 14 bp, Homo sapiens
cacgattagcttta

SEQ ID NO: 5581985 - DNA, 19 bp, Homo sapiens
cacgattatgactaaagta

SEQ ID NO: 5581986 - DNA, 20 bp, Homo sapiens
cacgattccaacccaggtct

SEQ ID NO: 5581987 - DNA, 21 bp, Homo sapiens
cacgattccaacccaggtctg

SEQ ID NO: 5581988 - DNA, 12 bp, Homo sapiens
cacgattccagt

SEQ ID NO: 5581989 - DNA, 19 bp, Homo sapiens
cacgattttcaagattcta

SEQ ID NO: 5581990 - DNA, 21 bp, Homo sapiens
cacgattttctccagctcaga

SEQ ID NO: 5581991 - DNA, 23 bp, Homo sapiens
cacgattttctccagctcagaac

SEQ ID NO: 5581992 - DNA, 17 bp, Homo sapiens
cacgcaaatacactcca

SEQ ID NO: 5581993 - DNA, 15 bp, Homo sapiens
cacgcaacacatttt

SEQ ID NO: 5581994 - DNA, 14 bp, Homo sapiens
cacgcaacccttgc

SEQ ID NO: 5581995 - DNA, 16 bp, Homo sapiens
cacgcaacccttgctg

SEQ ID NO: 5581996 - DNA, 19 bp, Homo sapiens
cacgcaacccttgctgctg

SEQ ID NO: 5581997 - DNA, 11 bp, Homo sapiens
cacgcaagtgc

SEQ ID NO: 5581998 - DNA, 16 bp, Homo sapiens
cacgcacaaacacaca

SEQ ID NO: 5581999 - DNA, 20 bp, Homo sapiens
cacgcacaaacacacacact

SEQ ID NO: 5582000 - DNA, 12 bp, Homo sapiens
cacgcacacaca

SEQ ID NO: 5582001 - DNA, 15 bp, Homo sapiens
cacgcacacacacaa

SEQ ID NO: 5582002 - DNA, 20 bp, Homo sapiens
cacgcacacacacacacagg

SEQ ID NO: 5582003 - DNA, 19 bp, Homo sapiens
cacgcacacacacatacag

SEQ ID NO: 5582004 - DNA, 15 bp, Homo sapiens
cacgcacactgtctg

SEQ ID NO: 5582005 - DNA, 22 bp, Homo sapiens
cacgcaccactgcttcccactg

SEQ ID NO: 5582006 - DNA, 13 bp, Homo sapiens
cacgcacccacac

SEQ ID NO: 5582007 - DNA, 20 bp, Homo sapiens
cacgcacccacaccctacag

SEQ ID NO: 5582008 - DNA, 23 bp, Homo sapiens
cacgcacccacaccctacagcag

SEQ ID NO: 5582009 - DNA, 21 bp, Homo sapiens
cacgcaccccgcccctgcatg

SEQ ID NO: 5582010 - DNA, 17 bp, Homo sapiens
cacgcacctccacgcca

SEQ ID NO: 5582011 - DNA, 12 bp, Homo sapiens
cacgcacctccc

SEQ ID NO: 5582012 - DNA, 15 bp, Homo sapiens
cacgcacctgcctca

SEQ ID NO: 5582013 - DNA, 21 bp, Homo sapiens
cacgcacctgtagtcccagct

SEQ ID NO: 5582014 - DNA, 14 bp, Homo sapiens
cacgcacgcacaca

SEQ ID NO: 5582015 - DNA, 16 bp, Homo sapiens
cacgcacgcacacaca

SEQ ID NO: 5582016 - DNA, 22 bp, Homo sapiens
cacgcactctccccgctcaggg

SEQ ID NO: 5582017 - DNA, 20 bp, Homo sapiens
cacgcactgggccacggagg

SEQ ID NO: 5582018 - DNA, 21 bp, Homo sapiens
cacgcactgggccacggagga

SEQ ID NO: 5582019 - DNA, 16 bp, Homo sapiens
cacgcactggtgccaa

SEQ ID NO: 5582020 - DNA, 20 bp, Homo sapiens
cacgcacttctggggccagc

SEQ ID NO: 5582021 - DNA, 13 bp, Homo sapiens
cacgcagacacac

SEQ ID NO: 5582022 - DNA, 18 bp, Homo sapiens
cacgcagagaagccccgg

SEQ ID NO: 5582023 - DNA, 11 bp, Homo sapiens
cacgcagagcc

SEQ ID NO: 5582024 - DNA, 12 bp, Homo sapiens
cacgcagagccc

SEQ ID NO: 5582025 - DNA, 18 bp, Homo sapiens
cacgcagagccccggagc

SEQ ID NO: 5582026 - DNA, 23 bp, Homo sapiens
cacgcagagccccggagcaccac

SEQ ID NO: 5582027 - DNA, 20 bp, Homo sapiens
cacgcagaggacgcacgctc

SEQ ID NO: 5582028 - DNA, 14 bp, Homo sapiens
cacgcagcaccctt

SEQ ID NO: 5582029 - DNA, 19 bp, Homo sapiens
cacgcagcaggaagatccc

SEQ ID NO: 5582030 - DNA, 16 bp, Homo sapiens
cacgcagccaggacac

SEQ ID NO: 5582031 - DNA, 21 bp, Homo sapiens
cacgcagccaggacaccgggc

SEQ ID NO: 5582032 - DNA, 16 bp, Homo sapiens
cacgcagcctgctctg

SEQ ID NO: 5582033 - DNA, 19 bp, Homo sapiens
cacgcagcctgctctggag

SEQ ID NO: 5582034 - DNA, 12 bp, Homo sapiens
cacgcaggaagc

SEQ ID NO: 5582035 - DNA, 22 bp, Homo sapiens
cacgcaggcggggcagtatgtg

SEQ ID NO: 5582036 - DNA, 22 bp, Homo sapiens
cacgcaggctgagtgcactggc

SEQ ID NO: 5582037 - DNA, 19 bp, Homo sapiens
cacgcagggccatccactg

SEQ ID NO: 5582038 - DNA, 14 bp, Homo sapiens
cacgcaggggccct

SEQ ID NO: 5582039 - DNA, 18 bp, Homo sapiens
cacgcaggggccctgagc

SEQ ID NO: 5582040 - DNA, 13 bp, Homo sapiens
cacgcagttcttt

SEQ ID NO: 5582041 - DNA, 22 bp, Homo sapiens
cacgcatacacacatgccctcc

SEQ ID NO: 5582042 - DNA, 15 bp, Homo sapiens
cacgcatgcagtgtt

SEQ ID NO: 5582043 - DNA, 14 bp, Homo sapiens
cacgcatgcctcag

SEQ ID NO: 5582044 - DNA, 16 bp, Homo sapiens
cacgcatgggcattgc

SEQ ID NO: 5582045 - DNA, 19 bp, Homo sapiens
cacgcatgggcattgcagc

SEQ ID NO: 5582046 - DNA, 21 bp, Homo sapiens
cacgcatgggcattgcagcct

SEQ ID NO: 5582047 - DNA, 16 bp, Homo sapiens
cacgccaacagccccc

SEQ ID NO: 5582048 - DNA, 12 bp, Homo sapiens
cacgccacagcc

SEQ ID NO: 5582049 - DNA, 15 bp, Homo sapiens
cacgccaccacacct

SEQ ID NO: 5582050 - DNA, 11 bp, Homo sapiens
cacgccacccc

SEQ ID NO: 5582051 - DNA, 13 bp, Homo sapiens
cacgccactgcac

SEQ ID NO: 5582052 - DNA, 22 bp, Homo sapiens
cacgccactgcactccagcctg

SEQ ID NO: 5582053 - DNA, 15 bp, Homo sapiens
cacgccactgcctcc

SEQ ID NO: 5582054 - DNA, 20 bp, Homo sapiens
cacgccagattctttcctga

SEQ ID NO: 5582055 - DNA, 22 bp, Homo sapiens
cacgccagctggcccagtgggt

SEQ ID NO: 5582056 - DNA, 19 bp, Homo sapiens
cacgccagtttcaccattt

SEQ ID NO: 5582057 - DNA, 18 bp, Homo sapiens
cacgccattgtactccag

SEQ ID NO: 5582058 - DNA, 14 bp, Homo sapiens
cacgcccaccagcc

SEQ ID NO: 5582059 - DNA, 16 bp, Homo sapiens
cacgcccaccagcctt

SEQ ID NO: 5582060 - DNA, 13 bp, Homo sapiens
cacgccccacact

SEQ ID NO: 5582061 - DNA, 13 bp, Homo sapiens
cacgccccagccc

SEQ ID NO: 5582062 - DNA, 14 bp, Homo sapiens
cacgccccggtccc

SEQ ID NO: 5582063 - DNA, 15 bp, Homo sapiens
cacgcccctccccag

SEQ ID NO: 5582064 - DNA, 18 bp, Homo sapiens
cacgcccctccccagccc

SEQ ID NO: 5582065 - DNA, 17 bp, Homo sapiens
cacgcccgactctctcc

SEQ ID NO: 5582066 - DNA, 19 bp, Homo sapiens
cacgcccgactctctccat

SEQ ID NO: 5582067 - DNA, 15 bp, Homo sapiens
cacgcccgcaccccc

SEQ ID NO: 5582068 - DNA, 16 bp, Homo sapiens
cacgcccgcacccccg

SEQ ID NO: 5582069 - DNA, 19 bp, Homo sapiens
cacgcccgtcctgcctgtg

SEQ ID NO: 5582070 - DNA, 17 bp, Homo sapiens
cacgccctactccactg

SEQ ID NO: 5582071 - DNA, 15 bp, Homo sapiens
cacgccctcccctcc

SEQ ID NO: 5582072 - DNA, 20 bp, Homo sapiens
cacgccctcccctcccctgc

SEQ ID NO: 5582073 - DNA, 14 bp, Homo sapiens
cacgccctccctgc

SEQ ID NO: 5582074 - DNA, 15 bp, Homo sapiens
cacgccctcctccct

SEQ ID NO: 5582075 - DNA, 19 bp, Homo sapiens
cacgccctctcctccccct

SEQ ID NO: 5582076 - DNA, 21 bp, Homo sapiens
cacgccctgttcacgctcacc

SEQ ID NO: 5582077 - DNA, 16 bp, Homo sapiens
cacgcccttggagcct

SEQ ID NO: 5582078 - DNA, 18 bp, Homo sapiens
cacgcccttggagccttc

SEQ ID NO: 5582079 - DNA, 23 bp, Homo sapiens
cacgccgatataagccatagccc

SEQ ID NO: 5582080 - DNA, 14 bp, Homo sapiens
cacgccgccctcca

SEQ ID NO: 5582081 - DNA, 17 bp, Homo sapiens
cacgccgccctccatcc

SEQ ID NO: 5582082 - DNA, 16 bp, Homo sapiens
cacgccggccacaccc

SEQ ID NO: 5582083 - DNA, 23 bp, Homo sapiens
cacgccggccacacccctctgct

SEQ ID NO: 5582084 - DNA, 13 bp, Homo sapiens
cacgccggcctct

SEQ ID NO: 5582085 - DNA, 20 bp, Homo sapiens
cacgccgggagaagccacct

SEQ ID NO: 5582086 - DNA, 22 bp, Homo sapiens
cacgccggggctggccctgccc

SEQ ID NO: 5582087 - DNA, 19 bp, Homo sapiens
cacgccgggtcgcctgccc

SEQ ID NO: 5582088 - DNA, 21 bp, Homo sapiens
cacgccgtaattctttctgtc

SEQ ID NO: 5582089 - DNA, 14 bp, Homo sapiens
cacgccgtctgtcc

SEQ ID NO: 5582090 - DNA, 18 bp, Homo sapiens
cacgcctagcctcacgct

SEQ ID NO: 5582091 - DNA, 21 bp, Homo sapiens
cacgcctataatcccagcact

SEQ ID NO: 5582092 - DNA, 16 bp, Homo sapiens
cacgcctatgccctgc

SEQ ID NO: 5582093 - DNA, 18 bp, Homo sapiens
cacgcctcaccagccccc

SEQ ID NO: 5582094 - DNA, 13 bp, Homo sapiens
cacgcctcccact

SEQ ID NO: 5582095 - DNA, 14 bp, Homo sapiens
cacgcctcccactg

SEQ ID NO: 5582096 - DNA, 22 bp, Homo sapiens
cacgcctcccactggggtccag

SEQ ID NO: 5582097 - DNA, 13 bp, Homo sapiens
cacgcctcctggc

SEQ ID NO: 5582098 - DNA, 15 bp, Homo sapiens
cacgcctcctggcca

SEQ ID NO: 5582099 - DNA, 17 bp, Homo sapiens
cacgcctctccccacct

SEQ ID NO: 5582100 - DNA, 22 bp, Homo sapiens
cacgcctctccccaccttcttg

SEQ ID NO: 5582101 - DNA, 23 bp, Homo sapiens
cacgcctctctcagcccaggtct

SEQ ID NO: 5582102 - DNA, 22 bp, Homo sapiens
cacgcctgagagtggcactggg

SEQ ID NO: 5582103 - DNA, 17 bp, Homo sapiens
cacgcctgcaaacgctg

SEQ ID NO: 5582104 - DNA, 22 bp, Homo sapiens
cacgcctgcaaacgctgcctgc

SEQ ID NO: 5582105 - DNA, 11 bp, Homo sapiens
cacgcctgccc

SEQ ID NO: 5582106 - DNA, 19 bp, Homo sapiens
cacgcctgtaatcccagca

SEQ ID NO: 5582107 - DNA, 23 bp, Homo sapiens
cacgcctgtaatcccagcacttt

SEQ ID NO: 5582108 - DNA, 22 bp, Homo sapiens
cacgcctgtaatcccagctact

SEQ ID NO: 5582109 - DNA, 17 bp, Homo sapiens
cacgcctgtcctcctgg

SEQ ID NO: 5582110 - DNA, 19 bp, Homo sapiens
cacgcctgtcctcctggaa

SEQ ID NO: 5582111 - DNA, 19 bp, Homo sapiens
cacgccttcatgccagtgc

SEQ ID NO: 5582112 - DNA, 15 bp, Homo sapiens
cacgccttcccctca

SEQ ID NO: 5582113 - DNA, 16 bp, Homo sapiens
cacgccttcccctcag

SEQ ID NO: 5582114 - DNA, 15 bp, Homo sapiens
cacgccttggcctcc

SEQ ID NO: 5582115 - DNA, 20 bp, Homo sapiens
cacgccttgttcctgctctt

SEQ ID NO: 5582116 - DNA, 15 bp, Homo sapiens
cacgcgacttctcag

SEQ ID NO: 5582117 - DNA, 20 bp, Homo sapiens
cacgcgcccccctcccagag

SEQ ID NO: 5582118 - DNA, 22 bp, Homo sapiens
cacgcgcccccctcccagaggc

SEQ ID NO: 5582119 - DNA, 23 bp, Homo sapiens
cacgcgcccccctcccagaggcg

SEQ ID NO: 5582120 - DNA, 17 bp, Homo sapiens
cacgcgccctttctacc

SEQ ID NO: 5582121 - DNA, 13 bp, Homo sapiens
cacgcgcgcacac

SEQ ID NO: 5582122 - DNA, 22 bp, Homo sapiens
cacgcgcgcacacacacacata

SEQ ID NO: 5582123 - DNA, 17 bp, Homo sapiens
cacgcgcgcgcacacac

SEQ ID NO: 5582124 - DNA, 13 bp, Homo sapiens
cacgcgctctgca

SEQ ID NO: 5582125 - DNA, 16 bp, Homo sapiens
cacgcgctctgcatgc

SEQ ID NO: 5582126 - DNA, 17 bp, Homo sapiens
cacgcgctctgcatgct

SEQ ID NO: 5582127 - DNA, 19 bp, Homo sapiens
cacgcgcttcgacttttct

SEQ ID NO: 5582128 - DNA, 21 bp, Homo sapiens
cacgcgtatgttcgttgcagc

SEQ ID NO: 5582129 - DNA, 17 bp, Homo sapiens
cacgcgtgcataaaaac

SEQ ID NO: 5582130 - DNA, 20 bp, Homo sapiens
cacgcgtgtgctcctctcct

SEQ ID NO: 5582131 - DNA, 22 bp, Homo sapiens
cacgctaatcccgattcaccct

SEQ ID NO: 5582132 - DNA, 20 bp, Homo sapiens
cacgctcaatgcccagtaaa

SEQ ID NO: 5582133 - DNA, 17 bp, Homo sapiens
cacgctcacccagtcac

SEQ ID NO: 5582134 - DNA, 21 bp, Homo sapiens
cacgctcacccagtcacctcc

SEQ ID NO: 5582135 - DNA, 19 bp, Homo sapiens
cacgctcatgtcctgtcct

SEQ ID NO: 5582136 - DNA, 15 bp, Homo sapiens
cacgctccagctgcc

SEQ ID NO: 5582137 - DNA, 17 bp, Homo sapiens
cacgctcccccgcagtc

SEQ ID NO: 5582138 - DNA, 19 bp, Homo sapiens
cacgctccccgcctgttcc

SEQ ID NO: 5582139 - DNA, 19 bp, Homo sapiens
cacgctcccctccatcccc

SEQ ID NO: 5582140 - DNA, 20 bp, Homo sapiens
cacgctccctgacttctccc

SEQ ID NO: 5582141 - DNA, 18 bp, Homo sapiens
cacgctcctgccctcgtc

SEQ ID NO: 5582142 - DNA, 15 bp, Homo sapiens
cacgctcgcgggcag

SEQ ID NO: 5582143 - DNA, 19 bp, Homo sapiens
cacgctcgctgccatcacc

SEQ ID NO: 5582144 - DNA, 21 bp, Homo sapiens
cacgctcttgaggaagcccag

SEQ ID NO: 5582145 - DNA, 23 bp, Homo sapiens
cacgctgaatgagaagtaaatta

SEQ ID NO: 5582146 - DNA, 16 bp, Homo sapiens
cacgctgacagcctcc

SEQ ID NO: 5582147 - DNA, 18 bp, Homo sapiens
cacgctgacagcctccta

SEQ ID NO: 5582148 - DNA, 21 bp, Homo sapiens
cacgctgacagcctcctaggc

SEQ ID NO: 5582149 - DNA, 22 bp, Homo sapiens
cacgctgatgtttatgtactgt

SEQ ID NO: 5582150 - DNA, 12 bp, Homo sapiens
cacgctgcccag

SEQ ID NO: 5582151 - DNA, 14 bp, Homo sapiens
cacgctgcccaggc

SEQ ID NO: 5582152 - DNA, 15 bp, Homo sapiens
cacgctgcccaggct

SEQ ID NO: 5582153 - DNA, 20 bp, Homo sapiens
cacgctgcccaggctctgct

SEQ ID NO: 5582154 - DNA, 15 bp, Homo sapiens
cacgctgcctcctca

SEQ ID NO: 5582155 - DNA, 18 bp, Homo sapiens
cacgctgcctgccaaagt

SEQ ID NO: 5582156 - DNA, 22 bp, Homo sapiens
cacgctgcctgccaaagtagtc

SEQ ID NO: 5582157 - DNA, 13 bp, Homo sapiens
cacgctgcctggt

SEQ ID NO: 5582158 - DNA, 16 bp, Homo sapiens
cacgctgcctggtctg

SEQ ID NO: 5582159 - DNA, 17 bp, Homo sapiens
cacgctgctctgcccca

SEQ ID NO: 5582160 - DNA, 20 bp, Homo sapiens
cacgctggagtgcagtgagc

SEQ ID NO: 5582161 - DNA, 21 bp, Homo sapiens
cacgctggagtgcagtgagcc

SEQ ID NO: 5582162 - DNA, 12 bp, Homo sapiens
cacgctggcctt

SEQ ID NO: 5582163 - DNA, 16 bp, Homo sapiens
cacgctgggacacaga

SEQ ID NO: 5582164 - DNA, 17 bp, Homo sapiens
cacgctgggcctaggat

SEQ ID NO: 5582165 - DNA, 22 bp, Homo sapiens
cacgctggggctctctgagact

SEQ ID NO: 5582166 - DNA, 22 bp, Homo sapiens
cacgctgtcctctcgagcccag

SEQ ID NO: 5582167 - DNA, 16 bp, Homo sapiens
cacgctgtctccagac

SEQ ID NO: 5582168 - DNA, 17 bp, Homo sapiens
cacgctgtctccagacc

SEQ ID NO: 5582169 - DNA, 13 bp, Homo sapiens
cacgctgtctctt

SEQ ID NO: 5582170 - DNA, 23 bp, Homo sapiens
cacgctgtctcttcttaaccctg

SEQ ID NO: 5582171 - DNA, 22 bp, Homo sapiens
cacgctgtgggcaggtgggagc

SEQ ID NO: 5582172 - DNA, 21 bp, Homo sapiens
cacgctgtgtccctcaattac

SEQ ID NO: 5582173 - DNA, 17 bp, Homo sapiens
cacgcttattgcccagg

SEQ ID NO: 5582174 - DNA, 11 bp, Homo sapiens
cacgcttctga

SEQ ID NO: 5582175 - DNA, 15 bp, Homo sapiens
cacgcttctggaggt

SEQ ID NO: 5582176 - DNA, 23 bp, Homo sapiens
cacgcttctggaggtggggaggg

SEQ ID NO: 5582177 - DNA, 20 bp, Homo sapiens
cacgcttcttcttttgagca

SEQ ID NO: 5582178 - DNA, 18 bp, Homo sapiens
cacgctttcagcgaatga

SEQ ID NO: 5582179 - DNA, 14 bp, Homo sapiens
cacgctttctagct

SEQ ID NO: 5582180 - DNA, 18 bp, Homo sapiens
cacgctttgatgagcatt

SEQ ID NO: 5582181 - DNA, 14 bp, Homo sapiens
cacgctttgtttac

SEQ ID NO: 5582182 - DNA, 21 bp, Homo sapiens
cacgcttttaattctcatttg

SEQ ID NO: 5582183 - DNA, 13 bp, Homo sapiens
cacgcttttgtga

SEQ ID NO: 5582184 - DNA, 15 bp, Homo sapiens
cacggaagttttcaa

SEQ ID NO: 5582185 - DNA, 15 bp, Homo sapiens
cacggacaataaacc

SEQ ID NO: 5582186 - DNA, 17 bp, Homo sapiens
cacggacaataaacctc

SEQ ID NO: 5582187 - DNA, 20 bp, Homo sapiens
cacggaccactcgaggcctg

SEQ ID NO: 5582188 - DNA, 20 bp, Homo sapiens
cacggaccatctttagcagt

SEQ ID NO: 5582189 - DNA, 19 bp, Homo sapiens
cacggaccatgtggtatgt

SEQ ID NO: 5582190 - DNA, 14 bp, Homo sapiens
cacggaccctgtgt

SEQ ID NO: 5582191 - DNA, 18 bp, Homo sapiens
cacggaccgcatcctcca

SEQ ID NO: 5582192 - DNA, 20 bp, Homo sapiens
cacggaccgcatcctccagg

SEQ ID NO: 5582193 - DNA, 19 bp, Homo sapiens
cacggactgaggtgcctgc

SEQ ID NO: 5582194 - DNA, 20 bp, Homo sapiens
cacggactgaggtgcctgct

SEQ ID NO: 5582195 - DNA, 19 bp, Homo sapiens
cacggagacagaggaaagg

SEQ ID NO: 5582196 - DNA, 15 bp, Homo sapiens
cacggagaggccact

SEQ ID NO: 5582197 - DNA, 21 bp, Homo sapiens
cacggagcagttcagagtgga

SEQ ID NO: 5582198 - DNA, 16 bp, Homo sapiens
cacggagccactcctc

SEQ ID NO: 5582199 - DNA, 22 bp, Homo sapiens
cacggagccgcgggacagccaa

SEQ ID NO: 5582200 - DNA, 17 bp, Homo sapiens
cacggagctcctggcag

SEQ ID NO: 5582201 - DNA, 18 bp, Homo sapiens
cacggaggagggatgctg

SEQ ID NO: 5582202 - DNA, 22 bp, Homo sapiens
cacggaggagggatgctgctcc

SEQ ID NO: 5582203 - DNA, 18 bp, Homo sapiens
cacggaggcctcgagcag

SEQ ID NO: 5582204 - DNA, 21 bp, Homo sapiens
cacggaggctcgtgcatgtaa

SEQ ID NO: 5582205 - DNA, 16 bp, Homo sapiens
cacggagggagcgaca

SEQ ID NO: 5582206 - DNA, 17 bp, Homo sapiens
cacggagtgttggggct

SEQ ID NO: 5582207 - DNA, 20 bp, Homo sapiens
cacggagtgttggggctggg

SEQ ID NO: 5582208 - DNA, 22 bp, Homo sapiens
cacggagtgttggggctggggg

SEQ ID NO: 5582209 - DNA, 14 bp, Homo sapiens
cacggagtttccat

SEQ ID NO: 5582210 - DNA, 23 bp, Homo sapiens
cacggatccatgtagcaggactg

SEQ ID NO: 5582211 - DNA, 18 bp, Homo sapiens
cacggatgcgtgggcaga

SEQ ID NO: 5582212 - DNA, 21 bp, Homo sapiens
cacggatgcgtgggcagagga

SEQ ID NO: 5582213 - DNA, 22 bp, Homo sapiens
cacggatgcgtgggcagaggaa

SEQ ID NO: 5582214 - DNA, 16 bp, Homo sapiens
cacggatggcggtgga

SEQ ID NO: 5582215 - DNA, 18 bp, Homo sapiens
cacggatggtgcatgggc

SEQ ID NO: 5582216 - DNA, 17 bp, Homo sapiens
cacggatttgtgtctgt

SEQ ID NO: 5582217 - DNA, 20 bp, Homo sapiens
cacggcaatcagaagaaagg

SEQ ID NO: 5582218 - DNA, 20 bp, Homo sapiens
cacggcacctgggccctggg

SEQ ID NO: 5582219 - DNA, 14 bp, Homo sapiens
cacggcactccagc

SEQ ID NO: 5582220 - DNA, 20 bp, Homo sapiens
cacggcactccagcctgggc

SEQ ID NO: 5582221 - DNA, 13 bp, Homo sapiens
cacggcagccaca

SEQ ID NO: 5582222 - DNA, 20 bp, Homo sapiens
cacggcagccaccctgccat

SEQ ID NO: 5582223 - DNA, 21 bp, Homo sapiens
cacggcagccaccctgccatg

SEQ ID NO: 5582224 - DNA, 12 bp, Homo sapiens
cacggcagctgt

SEQ ID NO: 5582225 - DNA, 21 bp, Homo sapiens
cacggcaggacaacgaggaag

SEQ ID NO: 5582226 - DNA, 23 bp, Homo sapiens
cacggcaggacaacgaggaagcc

SEQ ID NO: 5582227 - DNA, 21 bp, Homo sapiens
cacggcatcgcatccgtcctg

SEQ ID NO: 5582228 - DNA, 22 bp, Homo sapiens
cacggcattatgatcccttccc

SEQ ID NO: 5582229 - DNA, 17 bp, Homo sapiens
cacggccaacaaagctg

SEQ ID NO: 5582230 - DNA, 16 bp, Homo sapiens
cacggccacacagctg

SEQ ID NO: 5582231 - DNA, 18 bp, Homo sapiens
cacggccacacagctgcc

SEQ ID NO: 5582232 - DNA, 13 bp, Homo sapiens
cacggccacatca

SEQ ID NO: 5582233 - DNA, 11 bp, Homo sapiens
cacggccaccc

SEQ ID NO: 5582234 - DNA, 18 bp, Homo sapiens
cacggccacccacccttc

SEQ ID NO: 5582235 - DNA, 12 bp, Homo sapiens
cacggccaccct

SEQ ID NO: 5582236 - DNA, 16 bp, Homo sapiens
cacggccactgcagtc

SEQ ID NO: 5582237 - DNA, 14 bp, Homo sapiens
cacggccaggccag

SEQ ID NO: 5582238 - DNA, 14 bp, Homo sapiens
cacggccatgacca

SEQ ID NO: 5582239 - DNA, 19 bp, Homo sapiens
cacggccatgagggctgga

SEQ ID NO: 5582240 - DNA, 20 bp, Homo sapiens
cacggccatgagggctggag

SEQ ID NO: 5582241 - DNA, 13 bp, Homo sapiens
cacggcccaggga

SEQ ID NO: 5582242 - DNA, 15 bp, Homo sapiens
cacggcccagggagg

SEQ ID NO: 5582243 - DNA, 16 bp, Homo sapiens
cacggcccagggaggg

SEQ ID NO: 5582244 - DNA, 21 bp, Homo sapiens
cacggccccgaagggccccca

SEQ ID NO: 5582245 - DNA, 23 bp, Homo sapiens
cacggcccggcccctcaccctct

SEQ ID NO: 5582246 - DNA, 14 bp, Homo sapiens
cacggccctcctgg

SEQ ID NO: 5582247 - DNA, 16 bp, Homo sapiens
cacggccctgtcagag

SEQ ID NO: 5582248 - DNA, 15 bp, Homo sapiens
cacggccgctccagg

SEQ ID NO: 5582249 - DNA, 19 bp, Homo sapiens
cacggccgctccaggggtg

SEQ ID NO: 5582250 - DNA, 13 bp, Homo sapiens
cacggccgtccct

SEQ ID NO: 5582251 - DNA, 12 bp, Homo sapiens
cacggcctcctt

SEQ ID NO: 5582252 - DNA, 12 bp, Homo sapiens
cacggcctctgg

SEQ ID NO: 5582253 - DNA, 13 bp, Homo sapiens
cacggcctctggg

SEQ ID NO: 5582254 - DNA, 16 bp, Homo sapiens
cacggcctctggggag

SEQ ID NO: 5582255 - DNA, 18 bp, Homo sapiens
cacggcctctggggagac

SEQ ID NO: 5582256 - DNA, 11 bp, Homo sapiens
cacggcctggc

SEQ ID NO: 5582257 - DNA, 16 bp, Homo sapiens
cacggcctggcatgca

SEQ ID NO: 5582258 - DNA, 14 bp, Homo sapiens
cacggcctgggagg

SEQ ID NO: 5582259 - DNA, 17 bp, Homo sapiens
cacggcctgggagggtg

SEQ ID NO: 5582260 - DNA, 15 bp, Homo sapiens
cacggcggcagggtg

SEQ ID NO: 5582261 - DNA, 20 bp, Homo sapiens
cacggcgggatcctccacag

SEQ ID NO: 5582262 - DNA, 21 bp, Homo sapiens
cacggcgtccctgagggccct

SEQ ID NO: 5582263 - DNA, 12 bp, Homo sapiens
cacggctccgag

SEQ ID NO: 5582264 - DNA, 23 bp, Homo sapiens
cacggctccgagggcggccaggg

SEQ ID NO: 5582265 - DNA, 22 bp, Homo sapiens
cacggctcctcgagatcccaac

SEQ ID NO: 5582266 - DNA, 20 bp, Homo sapiens
cacggctctaggtggggcgg

SEQ ID NO: 5582267 - DNA, 12 bp, Homo sapiens
cacggctctggg

SEQ ID NO: 5582268 - DNA, 15 bp, Homo sapiens
cacggctctgtgccc

SEQ ID NO: 5582269 - DNA, 17 bp, Homo sapiens
cacggctgcacctgcag

SEQ ID NO: 5582270 - DNA, 21 bp, Homo sapiens
cacggctgcacctgcagggag

SEQ ID NO: 5582271 - DNA, 23 bp, Homo sapiens
cacggctgcacctgcagggagca

SEQ ID NO: 5582272 - DNA, 20 bp, Homo sapiens
cacggctgcctgacactgag

SEQ ID NO: 5582273 - DNA, 16 bp, Homo sapiens
cacggctgcgcactgt

SEQ ID NO: 5582274 - DNA, 13 bp, Homo sapiens
cacggctggtcac

SEQ ID NO: 5582275 - DNA, 21 bp, Homo sapiens
cacggctggtcactctgccct

SEQ ID NO: 5582276 - DNA, 24 bp, Homo sapiens
cacggctggtcactctgccctctg

SEQ ID NO: 5582277 - DNA, 21 bp, Homo sapiens
cacggcttcactgaccagcgg

SEQ ID NO: 5582278 - DNA, 21 bp, Homo sapiens
cacgggaagcctccgtcagga

SEQ ID NO: 5582279 - DNA, 21 bp, Homo sapiens
cacgggaccgtcagcatgggc

SEQ ID NO: 5582280 - DNA, 17 bp, Homo sapiens
cacgggcaaagaaaaca

SEQ ID NO: 5582281 - DNA, 21 bp, Homo sapiens
cacgggcacagctgctgtgcc

SEQ ID NO: 5582282 - DNA, 14 bp, Homo sapiens
cacgggcagcctgg

SEQ ID NO: 5582283 - DNA, 15 bp, Homo sapiens
cacgggcagcctggc

SEQ ID NO: 5582284 - DNA, 20 bp, Homo sapiens
cacgggcatgcacacggctg

SEQ ID NO: 5582285 - DNA, 18 bp, Homo sapiens
cacgggcccgctcaacct

SEQ ID NO: 5582286 - DNA, 23 bp, Homo sapiens
cacgggcccgctcaacctctcag

SEQ ID NO: 5582287 - DNA, 13 bp, Homo sapiens
cacgggccctgcc

SEQ ID NO: 5582288 - DNA, 17 bp, Homo sapiens
cacgggccggccagctg

SEQ ID NO: 5582289 - DNA, 16 bp, Homo sapiens
cacgggcctcagtttc

SEQ ID NO: 5582290 - DNA, 18 bp, Homo sapiens
cacgggcctcagtttccc

SEQ ID NO: 5582291 - DNA, 14 bp, Homo sapiens
cacgggcctctgct

SEQ ID NO: 5582292 - DNA, 22 bp, Homo sapiens
cacgggcctctgcttgccagcc

SEQ ID NO: 5582293 - DNA, 18 bp, Homo sapiens
cacgggcctgtccacagg

SEQ ID NO: 5582294 - DNA, 24 bp, Homo sapiens
cacgggcctgtccacaggcttctg

SEQ ID NO: 5582295 - DNA, 20 bp, Homo sapiens
cacgggcggtcctgcacaga

SEQ ID NO: 5582296 - DNA, 17 bp, Homo sapiens
cacgggctgtctgggtg

SEQ ID NO: 5582297 - DNA, 17 bp, Homo sapiens
cactaggataggaactg

SEQ ID NO: 5582298 - DNA, 14 bp, Homo sapiens
cactaggatcccac

SEQ ID NO: 5582299 - DNA, 22 bp, Homo sapiens
cactaggcaagtgtatattttg

SEQ ID NO: 5582300 - DNA, 16 bp, Homo sapiens
cactaggcacccagct

SEQ ID NO: 5582301 - DNA, 22 bp, Homo sapiens
cactaggctgggtgcccacagc

SEQ ID NO: 5582302 - DNA, 20 bp, Homo sapiens
cactagggaatcctgcggca

SEQ ID NO: 5582303 - DNA, 19 bp, Homo sapiens
cactagggactatcaggta

SEQ ID NO: 5582304 - DNA, 17 bp, Homo sapiens
cactagggccttggaaa

SEQ ID NO: 5582305 - DNA, 22 bp, Homo sapiens
cactaggtaggcttctacctgc

SEQ ID NO: 5582306 - DNA, 19 bp, Homo sapiens
cactaggtgaacagcagga

SEQ ID NO: 5582307 - DNA, 23 bp, Homo sapiens
cactaggtgaacagcaggatgcc

SEQ ID NO: 5582308 - DNA, 16 bp, Homo sapiens
cactaggtgtccccaa

SEQ ID NO: 5582309 - DNA, 14 bp, Homo sapiens
cactagtatttcta

SEQ ID NO: 5582310 - DNA, 16 bp, Homo sapiens
cactagtcaccgacag

SEQ ID NO: 5582311 - DNA, 21 bp, Homo sapiens
cactagtcaccgacagcggcc

SEQ ID NO: 5582312 - DNA, 14 bp, Homo sapiens
cactagtctgtgta

SEQ ID NO: 5582313 - DNA, 16 bp, Homo sapiens
cactagtgcaaatcat

SEQ ID NO: 5582314 - DNA, 21 bp, Homo sapiens
cactagtgcaattccaagaaa

SEQ ID NO: 5582315 - DNA, 12 bp, Homo sapiens
cactagtgccaa

SEQ ID NO: 5582316 - DNA, 12 bp, Homo sapiens
cactagtggaaa

SEQ ID NO: 5582317 - DNA, 17 bp, Homo sapiens
cactagtgtcaggcccc

SEQ ID NO: 5582318 - DNA, 22 bp, Homo sapiens
cactagtgtcaggcccccagtg

SEQ ID NO: 5582319 - DNA, 23 bp, Homo sapiens
cactagtgtcaggcccccagtgg

SEQ ID NO: 5582320 - DNA, 18 bp, Homo sapiens
cactagttcagaggaagc

SEQ ID NO: 5582321 - DNA, 19 bp, Homo sapiens
cactagtttttcctgtgca

SEQ ID NO: 5582322 - DNA, 20 bp, Homo sapiens
cactataatgatctaagaag

SEQ ID NO: 5582323 - DNA, 18 bp, Homo sapiens
cactataatgtaagctct

SEQ ID NO: 5582324 - DNA, 14 bp, Homo sapiens
cactatacagattc

SEQ ID NO: 5582325 - DNA, 17 bp, Homo sapiens
cactatacaggctggga

SEQ ID NO: 5582326 - DNA, 19 bp, Homo sapiens
cactatacaggctgggaag

SEQ ID NO: 5582327 - DNA, 16 bp, Homo sapiens
cactatagccatttgc

SEQ ID NO: 5582328 - DNA, 14 bp, Homo sapiens
cactatagcctagg

SEQ ID NO: 5582329 - DNA, 20 bp, Homo sapiens
cactatagtgtaataatgtt

SEQ ID NO: 5582330 - DNA, 14 bp, Homo sapiens
cactatataaataa

SEQ ID NO: 5582331 - DNA, 23 bp, Homo sapiens
cactatataggcatcacattttt

SEQ ID NO: 5582332 - DNA, 17 bp, Homo sapiens
cactatatatatttcta

SEQ ID NO: 5582333 - DNA, 12 bp, Homo sapiens
cactatattttt

SEQ ID NO: 5582334 - DNA, 19 bp, Homo sapiens
cactatccatgcaccaaac

SEQ ID NO: 5582335 - DNA, 18 bp, Homo sapiens
cactatcccggctgccct

SEQ ID NO: 5582336 - DNA, 18 bp, Homo sapiens
cactatctgggtgcatga

SEQ ID NO: 5582337 - DNA, 21 bp, Homo sapiens
cactatcttcttcaaatacaa

SEQ ID NO: 5582338 - DNA, 20 bp, Homo sapiens
cactatctttcaggaaattt

SEQ ID NO: 5582339 - DNA, 14 bp, Homo sapiens
cactatgaagatgt

SEQ ID NO: 5582340 - DNA, 14 bp, Homo sapiens
cactatgaatctat

SEQ ID NO: 5582341 - DNA, 15 bp, Homo sapiens
cactatgacactgag

SEQ ID NO: 5582342 - DNA, 13 bp, Homo sapiens
cactatgataaag

SEQ ID NO: 5582343 - DNA, 17 bp, Homo sapiens
cactatgataaagttgt

SEQ ID NO: 5582344 - DNA, 21 bp, Homo sapiens
cactatgataaagttgtaaat

SEQ ID NO: 5582345 - DNA, 14 bp, Homo sapiens
cactatgcatttta

SEQ ID NO: 5582346 - DNA, 18 bp, Homo sapiens
cactatgggaagctctgt

SEQ ID NO: 5582347 - DNA, 19 bp, Homo sapiens
cactatggggtggggtggg

SEQ ID NO: 5582348 - DNA, 21 bp, Homo sapiens
cactatggtatgctggccagc

SEQ ID NO: 5582349 - DNA, 17 bp, Homo sapiens
cactatggtatttgagt

SEQ ID NO: 5582350 - DNA, 13 bp, Homo sapiens
cactatggtgcca

SEQ ID NO: 5582351 - DNA, 18 bp, Homo sapiens
cactatgtccagctagcc

SEQ ID NO: 5582352 - DNA, 22 bp, Homo sapiens
cactatgtccatgaaaaacagc

SEQ ID NO: 5582353 - DNA, 12 bp, Homo sapiens
cactatgtgtgt

SEQ ID NO: 5582354 - DNA, 22 bp, Homo sapiens
cactatgtgtgttgtttccata

SEQ ID NO: 5582355 - DNA, 20 bp, Homo sapiens
cactatgttgcccaggcagg

SEQ ID NO: 5582356 - DNA, 18 bp, Homo sapiens
cactatgttgcccaggct

SEQ ID NO: 5582357 - DNA, 13 bp, Homo sapiens
cactatgtttctc

SEQ ID NO: 5582358 - DNA, 15 bp, Homo sapiens
cactatgtttctcag

SEQ ID NO: 5582359 - DNA, 16 bp, Homo sapiens
cactatgtttctcaga

SEQ ID NO: 5582360 - DNA, 20 bp, Homo sapiens
cactattaatctttcttttg

SEQ ID NO: 5582361 - DNA, 17 bp, Homo sapiens
cactattataagtgctt

SEQ ID NO: 5582362 - DNA, 12 bp, Homo sapiens
cactattcatca

SEQ ID NO: 5582363 - DNA, 15 bp, Homo sapiens
cactattcctaggag

SEQ ID NO: 5582364 - DNA, 15 bp, Homo sapiens
cactattctccagaa

SEQ ID NO: 5582365 - DNA, 14 bp, Homo sapiens
cactattgaaaaat

SEQ ID NO: 5582366 - DNA, 16 bp, Homo sapiens
cactattgcattgttc

SEQ ID NO: 5582367 - DNA, 14 bp, Homo sapiens
cactattggacttt

SEQ ID NO: 5582368 - DNA, 15 bp, Homo sapiens
cactattgtaatcat

SEQ ID NO: 5582369 - DNA, 23 bp, Homo sapiens
cactattgtgaatatttggaatt

SEQ ID NO: 5582370 - DNA, 14 bp, Homo sapiens
cactattgtttaga

SEQ ID NO: 5582371 - DNA, 13 bp, Homo sapiens
cactatttccaaa

SEQ ID NO: 5582372 - DNA, 15 bp, Homo sapiens
cactatttccaaaag

SEQ ID NO: 5582373 - DNA, 13 bp, Homo sapiens
cactatttccttt

SEQ ID NO: 5582374 - DNA, 18 bp, Homo sapiens
cactatttctggaatgct

SEQ ID NO: 5582375 - DNA, 16 bp, Homo sapiens
cactatttgcagaggc

SEQ ID NO: 5582376 - DNA, 14 bp, Homo sapiens
cactatttgtgact

SEQ ID NO: 5582377 - DNA, 12 bp, Homo sapiens
cactattttaga

SEQ ID NO: 5582378 - DNA, 13 bp, Homo sapiens
cactattttatgc

SEQ ID NO: 5582379 - DNA, 16 bp, Homo sapiens
cactattttcaaagaa

SEQ ID NO: 5582380 - DNA, 21 bp, Homo sapiens
cactattttcactagggctga

SEQ ID NO: 5582381 - DNA, 14 bp, Homo sapiens
cactattttcagaa

SEQ ID NO: 5582382 - DNA, 18 bp, Homo sapiens
cactattttcagaatctg

SEQ ID NO: 5582383 - DNA, 17 bp, Homo sapiens
cactcaaaagctgggca

SEQ ID NO: 5582384 - DNA, 18 bp, Homo sapiens
cactcaaaagctgggcag

SEQ ID NO: 5582385 - DNA, 22 bp, Homo sapiens
cactcaaaatgatgcaaccaaa

SEQ ID NO: 5582386 - DNA, 13 bp, Homo sapiens
cactcaaacaatc

SEQ ID NO: 5582387 - DNA, 22 bp, Homo sapiens
cactcaaagagggtgagggcct

SEQ ID NO: 5582388 - DNA, 14 bp, Homo sapiens
cactcaacaataaa

SEQ ID NO: 5582389 - DNA, 16 bp, Homo sapiens
cactcaactctgagcc

SEQ ID NO: 5582390 - DNA, 17 bp, Homo sapiens
cactcaagaagcaggct

SEQ ID NO: 5582391 - DNA, 23 bp, Homo sapiens
cactcaagaagcaggctacactg

SEQ ID NO: 5582392 - DNA, 22 bp, Homo sapiens
cactcaagaccaaatggaaaca

SEQ ID NO: 5582393 - DNA, 17 bp, Homo sapiens
cactcaagaccaggctg

SEQ ID NO: 5582394 - DNA, 16 bp, Homo sapiens
cactcaagacccggtt

SEQ ID NO: 5582395 - DNA, 15 bp, Homo sapiens
cactcaagagccctt

SEQ ID NO: 5582396 - DNA, 22 bp, Homo sapiens
cactcaagagcccttccaggag

SEQ ID NO: 5582397 - DNA, 15 bp, Homo sapiens
cactcaagcactgat

SEQ ID NO: 5582398 - DNA, 15 bp, Homo sapiens
cactcaagccaagca

SEQ ID NO: 5582399 - DNA, 16 bp, Homo sapiens
cactcaagccaagcag

SEQ ID NO: 5582400 - DNA, 12 bp, Homo sapiens
cactcaagcctg

SEQ ID NO: 5582401 - DNA, 15 bp, Homo sapiens
cactcaaggaaaaga

SEQ ID NO: 5582402 - DNA, 13 bp, Homo sapiens
cactcaaggacag

SEQ ID NO: 5582403 - DNA, 22 bp, Homo sapiens
cactcaaggacaggagcctggt

SEQ ID NO: 5582404 - DNA, 11 bp, Homo sapiens
cactcaaggcg

SEQ ID NO: 5582405 - DNA, 19 bp, Homo sapiens
cactcaaggcggtgcttga

SEQ ID NO: 5582406 - DNA, 16 bp, Homo sapiens
cactcaagttgtttaa

SEQ ID NO: 5582407 - DNA, 16 bp, Homo sapiens
cactcaataaacagtc

SEQ ID NO: 5582408 - DNA, 17 bp, Homo sapiens
cactcaataaacagtca

SEQ ID NO: 5582409 - DNA, 12 bp, Homo sapiens
cactcaataaat

SEQ ID NO: 5582410 - DNA, 19 bp, Homo sapiens
cactcaatccatccatgta

SEQ ID NO: 5582411 - DNA, 17 bp, Homo sapiens
cactcaatgcagccaga

SEQ ID NO: 5582412 - DNA, 14 bp, Homo sapiens
cactcaatgggaga

SEQ ID NO: 5582413 - DNA, 19 bp, Homo sapiens
cactcacaatttaaaatat

SEQ ID NO: 5582414 - DNA, 22 bp, Homo sapiens
cactcacaatttaaaatatttc

SEQ ID NO: 5582415 - DNA, 15 bp, Homo sapiens
cactcacacagccag

SEQ ID NO: 5582416 - DNA, 14 bp, Homo sapiens
cactcacacaggac

SEQ ID NO: 5582417 - DNA, 13 bp, Homo sapiens
cactcacactggc

SEQ ID NO: 5582418 - DNA, 14 bp, Homo sapiens
cactcacactggcc

SEQ ID NO: 5582419 - DNA, 19 bp, Homo sapiens
cactcacagacctggagcc

SEQ ID NO: 5582420 - DNA, 17 bp, Homo sapiens
cactcacagagacacag

SEQ ID NO: 5582421 - DNA, 15 bp, Homo sapiens
cactcacaggctaca

SEQ ID NO: 5582422 - DNA, 14 bp, Homo sapiens
cactcacatgctgg

SEQ ID NO: 5582423 - DNA, 20 bp, Homo sapiens
cactcaccacaagctgagca

SEQ ID NO: 5582424 - DNA, 22 bp, Homo sapiens
cactcaccagccctagctgtcc

SEQ ID NO: 5582425 - DNA, 22 bp, Homo sapiens
cactcaccagggtccgcaccag

SEQ ID NO: 5582426 - DNA, 14 bp, Homo sapiens
cactcaccagtggc

SEQ ID NO: 5582427 - DNA, 16 bp, Homo sapiens
cactcaccagtggcct

SEQ ID NO: 5582428 - DNA, 18 bp, Homo sapiens
cactcaccagtgtcccct

SEQ ID NO: 5582429 - DNA, 16 bp, Homo sapiens
cactcacccatgtgcc

SEQ ID NO: 5582430 - DNA, 18 bp, Homo sapiens
cactcacccttcctggcc

SEQ ID NO: 5582431 - DNA, 14 bp, Homo sapiens
cactcaccgaagcc

SEQ ID NO: 5582432 - DNA, 13 bp, Homo sapiens
cactcacctctaa

SEQ ID NO: 5582433 - DNA, 22 bp, Homo sapiens
cactcacctttctccactgggt

SEQ ID NO: 5582434 - DNA, 15 bp, Homo sapiens
cactcactcactcca

SEQ ID NO: 5582435 - DNA, 16 bp, Homo sapiens
cactcactcactccaa

SEQ ID NO: 5582436 - DNA, 19 bp, Homo sapiens
cactcactcactccccact

SEQ ID NO: 5582437 - DNA, 16 bp, Homo sapiens
cactcactccaagacc

SEQ ID NO: 5582438 - DNA, 13 bp, Homo sapiens
cactcactcccca

SEQ ID NO: 5582439 - DNA, 15 bp, Homo sapiens
cactcactcctgaga

SEQ ID NO: 5582440 - DNA, 13 bp, Homo sapiens
cactcactgaggc

SEQ ID NO: 5582441 - DNA, 22 bp, Homo sapiens
cactcactgaggccatcagggc

SEQ ID NO: 5582442 - DNA, 23 bp, Homo sapiens
cactcactgaggccatcagggcc

SEQ ID NO: 5582443 - DNA, 13 bp, Homo sapiens
cactcactgcctg

SEQ ID NO: 5582444 - DNA, 16 bp, Homo sapiens
cactcactgcctgcag

SEQ ID NO: 5582445 - DNA, 19 bp, Homo sapiens
cactcagaaaattccctgg

SEQ ID NO: 5582446 - DNA, 13 bp, Homo sapiens
cactcagaaagag

SEQ ID NO: 5582447 - DNA, 19 bp, Homo sapiens
cactcagaaagaggtctcc

SEQ ID NO: 5582448 - DNA, 23 bp, Homo sapiens
cactcagaaagaggtctccccat

SEQ ID NO: 5582449 - DNA, 16 bp, Homo sapiens
cactcagaactctcca

SEQ ID NO: 5582450 - DNA, 12 bp, Homo sapiens
cactcagaagac

SEQ ID NO: 5582451 - DNA, 16 bp, Homo sapiens
cactcagaagacactg

SEQ ID NO: 5582452 - DNA, 19 bp, Homo sapiens
cactcagaagacactgatg

SEQ ID NO: 5582453 - DNA, 14 bp, Homo sapiens
cactcagaagcctg

SEQ ID NO: 5582454 - DNA, 19 bp, Homo sapiens
cactcagaagcctgggggc

SEQ ID NO: 5582455 - DNA, 18 bp, Homo sapiens
cactcagagacatgcaga

SEQ ID NO: 5582456 - DNA, 14 bp, Homo sapiens
cactcagagctgct

SEQ ID NO: 5582457 - DNA, 12 bp, Homo sapiens
cactcagcacaa

SEQ ID NO: 5582458 - DNA, 13 bp, Homo sapiens
cactcagcacaag

SEQ ID NO: 5582459 - DNA, 15 bp, Homo sapiens
cactcagcaccactc

SEQ ID NO: 5582460 - DNA, 14 bp, Homo sapiens
cactcagcaccccc

SEQ ID NO: 5582461 - DNA, 12 bp, Homo sapiens
cactcagcactc

SEQ ID NO: 5582462 - DNA, 15 bp, Homo sapiens
cactcagcactctgg

SEQ ID NO: 5582463 - DNA, 18 bp, Homo sapiens
cactcagcactctggact

SEQ ID NO: 5582464 - DNA, 12 bp, Homo sapiens
cactcagcagcc

SEQ ID NO: 5582465 - DNA, 13 bp, Homo sapiens
cactcagcagccc

SEQ ID NO: 5582466 - DNA, 20 bp, Homo sapiens
cactcagcagccccctgccc

SEQ ID NO: 5582467 - DNA, 12 bp, Homo sapiens
cactcagccaca

SEQ ID NO: 5582468 - DNA, 20 bp, Homo sapiens
cactcagccacaaagccccc

SEQ ID NO: 5582469 - DNA, 16 bp, Homo sapiens
cactcagccaccctga

SEQ ID NO: 5582470 - DNA, 19 bp, Homo sapiens
cactcagccacgaccagcc

SEQ ID NO: 5582471 - DNA, 22 bp, Homo sapiens
cactcagccacgaccagcccct

SEQ ID NO: 5582472 - DNA, 18 bp, Homo sapiens
cactcagccattctctac

SEQ ID NO: 5582473 - DNA, 19 bp, Homo sapiens
cactcagccattctctacc

SEQ ID NO: 5582474 - DNA, 22 bp, Homo sapiens
cactcagccatttccccctcct

SEQ ID NO: 5582475 - DNA, 23 bp, Homo sapiens
cactcagccatttccccctcctc

SEQ ID NO: 5582476 - DNA, 21 bp, Homo sapiens
cactcagcccctacccctgcc

SEQ ID NO: 5582477 - DNA, 15 bp, Homo sapiens
cactctgggcctggg

SEQ ID NO: 5582478 - DNA, 12 bp, Homo sapiens
cactctggggac

SEQ ID NO: 5582479 - DNA, 14 bp, Homo sapiens
cactctgtaattga

SEQ ID NO: 5582480 - DNA, 17 bp, Homo sapiens
cactctgtaattgcaaa

SEQ ID NO: 5582481 - DNA, 22 bp, Homo sapiens
cactctgtaattgcacttttta

SEQ ID NO: 5582482 - DNA, 23 bp, Homo sapiens
cactctgtaattgcactttttaa

SEQ ID NO: 5582483 - DNA, 23 bp, Homo sapiens
cactctgtagcaaatttgtttaa

SEQ ID NO: 5582484 - DNA, 16 bp, Homo sapiens
cactctgtatctatgc

SEQ ID NO: 5582485 - DNA, 14 bp, Homo sapiens
cactctgtcagcca

SEQ ID NO: 5582486 - DNA, 18 bp, Homo sapiens
cactctgtcagccagccg

SEQ ID NO: 5582487 - DNA, 18 bp, Homo sapiens
cactctgtccctgtcctt

SEQ ID NO: 5582488 - DNA, 16 bp, Homo sapiens
cactctgtcgcccagt

SEQ ID NO: 5582489 - DNA, 19 bp, Homo sapiens
cactctgtcgcccagtctg

SEQ ID NO: 5582490 - DNA, 19 bp, Homo sapiens
cactctgtcgctcaggctg

SEQ ID NO: 5582491 - DNA, 15 bp, Homo sapiens
cactctgtggccagc

SEQ ID NO: 5582492 - DNA, 18 bp, Homo sapiens
cactctgtggccagcctg

SEQ ID NO: 5582493 - DNA, 24 bp, Homo sapiens
cactctgtggccagcctggcatca

SEQ ID NO: 5582494 - DNA, 13 bp, Homo sapiens
cactctgtggtcc

SEQ ID NO: 5582495 - DNA, 23 bp, Homo sapiens
cactctgtgtctgagtggcttca

SEQ ID NO: 5582496 - DNA, 23 bp, Homo sapiens
cactctgtgtgggaaaatggcag

SEQ ID NO: 5582497 - DNA, 17 bp, Homo sapiens
cactctgttatttagac

SEQ ID NO: 5582498 - DNA, 19 bp, Homo sapiens
cactctgttcccctccccc

SEQ ID NO: 5582499 - DNA, 12 bp, Homo sapiens
cactctgttcct

SEQ ID NO: 5582500 - DNA, 16 bp, Homo sapiens
cactctgttgaccagg

SEQ ID NO: 5582501 - DNA, 19 bp, Homo sapiens
cactctgtttgctcaccca

SEQ ID NO: 5582502 - DNA, 22 bp, Homo sapiens
cactctgtttgctcacccagga

SEQ ID NO: 5582503 - DNA, 14 bp, Homo sapiens
cactcttaaagcaa

SEQ ID NO: 5582504 - DNA, 22 bp, Homo sapiens
cactcttaaagcaaaaaatgaa

SEQ ID NO: 5582505 - DNA, 18 bp, Homo sapiens
cactcttattgcccacgc

SEQ ID NO: 5582506 - DNA, 14 bp, Homo sapiens
cactcttcaagttt

SEQ ID NO: 5582507 - DNA, 18 bp, Homo sapiens
cactcttcctcatcctgc

SEQ ID NO: 5582508 - DNA, 22 bp, Homo sapiens
cactcttctctcctttctccct

SEQ ID NO: 5582509 - DNA, 18 bp, Homo sapiens
cactcttcttgagcagac

SEQ ID NO: 5582510 - DNA, 17 bp, Homo sapiens
cactcttgaagtccagg

SEQ ID NO: 5582511 - DNA, 13 bp, Homo sapiens
cactcttgactca

SEQ ID NO: 5582512 - DNA, 14 bp, Homo sapiens
cactcttggagcct

SEQ ID NO: 5582513 - DNA, 16 bp, Homo sapiens
cactcttggagcctgc

SEQ ID NO: 5582514 - DNA, 19 bp, Homo sapiens
cactcttggagcctgcaga

SEQ ID NO: 5582515 - DNA, 11 bp, Homo sapiens
cactcttggct

SEQ ID NO: 5582516 - DNA, 20 bp, Homo sapiens
cactcttggctattgaagat

SEQ ID NO: 5582517 - DNA, 21 bp, Homo sapiens
cactcttgtacaaaagaaaaa

SEQ ID NO: 5582518 - DNA, 22 bp, Homo sapiens
cactcttgtactgcctgccacc

SEQ ID NO: 5582519 - DNA, 20 bp, Homo sapiens
cactcttgtcacccaggctg

SEQ ID NO: 5582520 - DNA, 21 bp, Homo sapiens
cactcttgtcacccaggctgg

SEQ ID NO: 5582521 - DNA, 22 bp, Homo sapiens
cactcttgtcacccaggctgga

SEQ ID NO: 5582522 - DNA, 13 bp, Homo sapiens
cactctttaagtg

SEQ ID NO: 5582523 - DNA, 19 bp, Homo sapiens
cactctttacctttattga

SEQ ID NO: 5582524 - DNA, 16 bp, Homo sapiens
cactctttatagtgca

SEQ ID NO: 5582525 - DNA, 15 bp, Homo sapiens
cactctttctcccta

SEQ ID NO: 5582526 - DNA, 11 bp, Homo sapiens
cactctttctt

SEQ ID NO: 5582527 - DNA, 15 bp, Homo sapiens
cactctttctttctc

SEQ ID NO: 5582528 - DNA, 14 bp, Homo sapiens
cactctttgctaca

SEQ ID NO: 5582529 - DNA, 16 bp, Homo sapiens
cactctttgctacaat

SEQ ID NO: 5582530 - DNA, 19 bp, Homo sapiens
cactctttgctacaataaa

SEQ ID NO: 5582531 - DNA, 15 bp, Homo sapiens
cactcttttatacaa

SEQ ID NO: 5582532 - DNA, 12 bp, Homo sapiens
cactcttttgat

SEQ ID NO: 5582533 - DNA, 13 bp, Homo sapiens
cactgaaaaaata

SEQ ID NO: 5582534 - DNA, 14 bp, Homo sapiens
cactgaaaaaatgt

SEQ ID NO: 5582535 - DNA, 16 bp, Homo sapiens
cactgaaaactatgca

SEQ ID NO: 5582536 - DNA, 19 bp, Homo sapiens
cactgaaaagctttcctga

SEQ ID NO: 5582537 - DNA, 22 bp, Homo sapiens
cactgaaaataccatcaggcct

SEQ ID NO: 5582538 - DNA, 22 bp, Homo sapiens
cactgaaaattggacagattgc

SEQ ID NO: 5582539 - DNA, 11 bp, Homo sapiens
cactgaaacaa

SEQ ID NO: 5582540 - DNA, 23 bp, Homo sapiens
cactgaaacaaaaattgtcttta

SEQ ID NO: 5582541 - DNA, 13 bp, Homo sapiens
cactgaaaccaaa

SEQ ID NO: 5582542 - DNA, 20 bp, Homo sapiens
cactgaaacctctgttctca

SEQ ID NO: 5582543 - DNA, 20 bp, Homo sapiens
cactgaaagctctgttgcaa

SEQ ID NO: 5582544 - DNA, 20 bp, Homo sapiens
cactgaaagttttgtaaaag

SEQ ID NO: 5582545 - DNA, 18 bp, Homo sapiens
cactgaaatagagtgaat

SEQ ID NO: 5582546 - DNA, 16 bp, Homo sapiens
cactgaaatatacaca

SEQ ID NO: 5582547 - DNA, 22 bp, Homo sapiens
cactgaaatgccttactttgta

SEQ ID NO: 5582548 - DNA, 19 bp, Homo sapiens
cactgaaattctaaatatt

SEQ ID NO: 5582549 - DNA, 17 bp, Homo sapiens
cactgaaattgcctgaa

SEQ ID NO: 5582550 - DNA, 20 bp, Homo sapiens
cactgaaattgcctgaaacc

SEQ ID NO: 5582551 - DNA, 14 bp, Homo sapiens
cactgaacagaatt

SEQ ID NO: 5582552 - DNA, 19 bp, Homo sapiens
cactgaacaggctggggcc

SEQ ID NO: 5582553 - DNA, 12 bp, Homo sapiens
cactgaacatgc

SEQ ID NO: 5582554 - DNA, 16 bp, Homo sapiens
cactgaacatttgctt

SEQ ID NO: 5582555 - DNA, 20 bp, Homo sapiens
cactgaacctctggctagag

SEQ ID NO: 5582556 - DNA, 16 bp, Homo sapiens
cactgaactgctttta

SEQ ID NO: 5582557 - DNA, 15 bp, Homo sapiens
cactgaacttttcaa

SEQ ID NO: 5582558 - DNA, 16 bp, Homo sapiens
cactgaacttttcaaa

SEQ ID NO: 5582559 - DNA, 21 bp, Homo sapiens
cactgaacttttcaaaataaa

SEQ ID NO: 5582560 - DNA, 22 bp, Homo sapiens
cactgaagaaagaggaaccccc

SEQ ID NO: 5582561 - DNA, 23 bp, Homo sapiens
cactgaagaagtcactgaacaaa

SEQ ID NO: 5582562 - DNA, 14 bp, Homo sapiens
cactgaagagctct

SEQ ID NO: 5582563 - DNA, 15 bp, Homo sapiens
cactgaagagctctt

SEQ ID NO: 5582564 - DNA, 16 bp, Homo sapiens
cactgaagagctcttg

SEQ ID NO: 5582565 - DNA, 19 bp, Homo sapiens
cactgaagagctcttggcc

SEQ ID NO: 5582566 - DNA, 14 bp, Homo sapiens
cactgaagagtatg

SEQ ID NO: 5582567 - DNA, 14 bp, Homo sapiens
cactgaagatagaa

SEQ ID NO: 5582568 - DNA, 23 bp, Homo sapiens
cactgaagccggacagctgccca

SEQ ID NO: 5582569 - DNA, 14 bp, Homo sapiens
cactgaagcctgcg

SEQ ID NO: 5582570 - DNA, 17 bp, Homo sapiens
cactgaagctttttagt

SEQ ID NO: 5582571 - DNA, 15 bp, Homo sapiens
cactgaaggacctga

SEQ ID NO: 5582572 - DNA, 22 bp, Homo sapiens
cactgaaggctttcagggcctc

SEQ ID NO: 5582573 - DNA, 19 bp, Homo sapiens
cactgaagggaatcacatc

SEQ ID NO: 5582574 - DNA, 18 bp, Homo sapiens
cactgaagtgcttgcaga

SEQ ID NO: 5582575 - DNA, 19 bp, Homo sapiens
cactgaagttaacagagac

SEQ ID NO: 5582576 - DNA, 21 bp, Homo sapiens
cactgaagtttgataaatagt

SEQ ID NO: 5582577 - DNA, 14 bp, Homo sapiens
cactgaatatttat

SEQ ID NO: 5582578 - DNA, 15 bp, Homo sapiens
cactgaatccctgta

SEQ ID NO: 5582579 - DNA, 19 bp, Homo sapiens
cactgaatcgtttcatgta

SEQ ID NO: 5582580 - DNA, 23 bp, Homo sapiens
cactgaatctcccctcctcacag

SEQ ID NO: 5582581 - DNA, 18 bp, Homo sapiens
cactgaatctgagaaagt

SEQ ID NO: 5582582 - DNA, 13 bp, Homo sapiens
cactgaatctgta

SEQ ID NO: 5582583 - DNA, 15 bp, Homo sapiens
cactgaatctgtaca

SEQ ID NO: 5582584 - DNA, 15 bp, Homo sapiens
cactgaatcttcacg

SEQ ID NO: 5582585 - DNA, 21 bp, Homo sapiens
cactgaatggctgacctgacc

SEQ ID NO: 5582586 - DNA, 21 bp, Homo sapiens
cactgaattagccaaaacact

SEQ ID NO: 5582587 - DNA, 14 bp, Homo sapiens
cactgaattgcttg

SEQ ID NO: 5582588 - DNA, 15 bp, Homo sapiens
cactgaatttataaa

SEQ ID NO: 5582589 - DNA, 19 bp, Homo sapiens
cactgaatttataaagtac

SEQ ID NO: 5582590 - DNA, 18 bp, Homo sapiens
cactgacaaagtcatccc

SEQ ID NO: 5582591 - DNA, 13 bp, Homo sapiens
cactgacacaaag

SEQ ID NO: 5582592 - DNA, 23 bp, Homo sapiens
cactgacacatcagcatgttttc

SEQ ID NO: 5582593 - DNA, 19 bp, Homo sapiens
cactgacaccctggtcctg

SEQ ID NO: 5582594 - DNA, 16 bp, Homo sapiens
cactgacacctttgca

SEQ ID NO: 5582595 - DNA, 20 bp, Homo sapiens
cactgacactggtattcctg

SEQ ID NO: 5582596 - DNA, 11 bp, Homo sapiens
cactgacagat

SEQ ID NO: 5582597 - DNA, 17 bp, Homo sapiens
cactgacagcctcccac

SEQ ID NO: 5582598 - DNA, 20 bp, Homo sapiens
cactgacagcctcccacccc

SEQ ID NO: 5582599 - DNA, 13 bp, Homo sapiens
cactgacagcctg

SEQ ID NO: 5582600 - DNA, 18 bp, Homo sapiens
cactgacagcctgggggg

SEQ ID NO: 5582601 - DNA, 19 bp, Homo sapiens
cactgacagcctggggggg

SEQ ID NO: 5582602 - DNA, 14 bp, Homo sapiens
cactgacagccttt

SEQ ID NO: 5582603 - DNA, 23 bp, Homo sapiens
cactgacatcaattttaccctga

SEQ ID NO: 5582604 - DNA, 14 bp, Homo sapiens
cactgaccacactg

SEQ ID NO: 5582605 - DNA, 16 bp, Homo sapiens
cactgaccacactgta

SEQ ID NO: 5582606 - DNA, 15 bp, Homo sapiens
cactgaccagcggct

SEQ ID NO: 5582607 - DNA, 23 bp, Homo sapiens
cactgaccatccactctaccctc

SEQ ID NO: 5582608 - DNA, 18 bp, Homo sapiens
cactgacccaactgatcc

SEQ ID NO: 5582609 - DNA, 18 bp, Homo sapiens
cactgacccacctgcgct

SEQ ID NO: 5582610 - DNA, 21 bp, Homo sapiens
cactgacccactcggatggac

SEQ ID NO: 5582611 - DNA, 17 bp, Homo sapiens
cactgaccctggagcgg

SEQ ID NO: 5582612 - DNA, 15 bp, Homo sapiens
cactgacccttccag

SEQ ID NO: 5582613 - DNA, 21 bp, Homo sapiens
cactgacccttccagacatac

SEQ ID NO: 5582614 - DNA, 23 bp, Homo sapiens
cactgaccgccgcttccagcttc

SEQ ID NO: 5582615 - DNA, 14 bp, Homo sapiens
cactgacctcaccg

SEQ ID NO: 5582616 - DNA, 18 bp, Homo sapiens
cactgacctcaccggcat

SEQ ID NO: 5582617 - DNA, 22 bp, Homo sapiens
cactgacctcaccggcatgctg

SEQ ID NO: 5582618 - DNA, 24 bp, Homo sapiens
cactgacctcaccggcatgctggc

SEQ ID NO: 5582619 - DNA, 12 bp, Homo sapiens
cactgacctgcc

SEQ ID NO: 5582620 - DNA, 15 bp, Homo sapiens
cactgacctgcccat

SEQ ID NO: 5582621 - DNA, 23 bp, Homo sapiens
cactgacctggttgtccaggtct

SEQ ID NO: 5582622 - DNA, 15 bp, Homo sapiens
cactgacctgtaggt

SEQ ID NO: 5582623 - DNA, 18 bp, Homo sapiens
cactgacctgtcatgccc

SEQ ID NO: 5582624 - DNA, 20 bp, Homo sapiens
cactgaccttggagagacac

SEQ ID NO: 5582625 - DNA, 22 bp, Homo sapiens
cactgaccttggagagacacag

SEQ ID NO: 5582626 - DNA, 19 bp, Homo sapiens
cactgactactggctctca

SEQ ID NO: 5582627 - DNA, 22 bp, Homo sapiens
cactgactgaatgctgttaata

SEQ ID NO: 5582628 - DNA, 14 bp, Homo sapiens
cactgactggaagg

SEQ ID NO: 5582629 - DNA, 20 bp, Homo sapiens
cactgactgggaccaggcac

SEQ ID NO: 5582630 - DNA, 16 bp, Homo sapiens
cactgactgtatggca

SEQ ID NO: 5582631 - DNA, 14 bp, Homo sapiens
cactgacttgctgt

SEQ ID NO: 5582632 - DNA, 17 bp, Homo sapiens
cactgagaaagaggcag

SEQ ID NO: 5582633 - DNA, 16 bp, Homo sapiens
cactgagaaggcccca

SEQ ID NO: 5582634 - DNA, 18 bp, Homo sapiens
cactgagaaggccccagg

SEQ ID NO: 5582635 - DNA, 19 bp, Homo sapiens
cactgagaaggccccaggg

SEQ ID NO: 5582636 - DNA, 22 bp, Homo sapiens
cactgagaatgctaatggttgg

SEQ ID NO: 5582637 - DNA, 18 bp, Homo sapiens
cactgagaatgtaagaac

SEQ ID NO: 5582638 - DNA, 19 bp, Homo sapiens
cactgagaatgtaagaact

SEQ ID NO: 5582639 - DNA, 21 bp, Homo sapiens
cactgagacaaatcctaggct

SEQ ID NO: 5582640 - DNA, 17 bp, Homo sapiens
cactgagaccaaggctt

SEQ ID NO: 5582641 - DNA, 15 bp, Homo sapiens
cactgagagctgctc

SEQ ID NO: 5582642 - DNA, 18 bp, Homo sapiens
cactgagagctgctcctt

SEQ ID NO: 5582643 - DNA, 14 bp, Homo sapiens
cactgagaggcctg

SEQ ID NO: 5582644 - DNA, 16 bp, Homo sapiens
cactgagaggcctgga

SEQ ID NO: 5582645 - DNA, 17 bp, Homo sapiens
cactgagaggcctggag

SEQ ID NO: 5582646 - DNA, 14 bp, Homo sapiens
cactgagagggcaa

SEQ ID NO: 5582647 - DNA, 18 bp, Homo sapiens
cactgagataccagcgag

SEQ ID NO: 5582648 - DNA, 22 bp, Homo sapiens
cactgagatccagagaggctgg

SEQ ID NO: 5582649 - DNA, 17 bp, Homo sapiens
cactgagatctgtttga

SEQ ID NO: 5582650 - DNA, 22 bp, Homo sapiens
cactgagattgacctgaggaga

SEQ ID NO: 5582651 - DNA, 14 bp, Homo sapiens
cactgagcaaagca

SEQ ID NO: 5582652 - DNA, 20 bp, Homo sapiens
cactgagcaagatcttgtct

SEQ ID NO: 5582653 - DNA, 16 bp, Homo sapiens
cactgagcactgtttt

SEQ ID NO: 5582654 - DNA, 13 bp, Homo sapiens
cactgctgctcct

SEQ ID NO: 5582655 - DNA, 18 bp, Homo sapiens
cactgctgctcctctttc

SEQ ID NO: 5582656 - DNA, 22 bp, Homo sapiens
cactgctgctgcctctgaaaca

SEQ ID NO: 5582657 - DNA, 17 bp, Homo sapiens
cactgctggagaggccc

SEQ ID NO: 5582658 - DNA, 13 bp, Homo sapiens
cactgctggctgc

SEQ ID NO: 5582659 - DNA, 17 bp, Homo sapiens
cactgctgggtggccca

SEQ ID NO: 5582660 - DNA, 18 bp, Homo sapiens
cactgctgggtggcccat

SEQ ID NO: 5582661 - DNA, 17 bp, Homo sapiens
cactgctggtgccaggg

SEQ ID NO: 5582662 - DNA, 16 bp, Homo sapiens
cactgctgtaaagcaa

SEQ ID NO: 5582663 - DNA, 17 bp, Homo sapiens
cactgctgtaaagcaaa

SEQ ID NO: 5582664 - DNA, 21 bp, Homo sapiens
cactgctgtaaagcaaaatat

SEQ ID NO: 5582665 - DNA, 13 bp, Homo sapiens
cactgctgtaact

SEQ ID NO: 5582666 - DNA, 18 bp, Homo sapiens
cactgctgtacccagatg

SEQ ID NO: 5582667 - DNA, 20 bp, Homo sapiens
cactgctgtacccagatgcc

SEQ ID NO: 5582668 - DNA, 16 bp, Homo sapiens
cactgctgtcagccaa

SEQ ID NO: 5582669 - DNA, 14 bp, Homo sapiens
cactgctgtcctct

SEQ ID NO: 5582670 - DNA, 17 bp, Homo sapiens
cactgctgtcctctccc

SEQ ID NO: 5582671 - DNA, 19 bp, Homo sapiens
cactgctgtcctctccccc

SEQ ID NO: 5582672 - DNA, 23 bp, Homo sapiens
cactgctgtgagtgcgcctcacc

SEQ ID NO: 5582673 - DNA, 18 bp, Homo sapiens
cactgctgttaaagacat

SEQ ID NO: 5582674 - DNA, 18 bp, Homo sapiens
cactgctgttatatttca

SEQ ID NO: 5582675 - DNA, 22 bp, Homo sapiens
cactgctgttcctgctccatga

SEQ ID NO: 5582676 - DNA, 14 bp, Homo sapiens
cactgcttccagtg

SEQ ID NO: 5582677 - DNA, 22 bp, Homo sapiens
cactgcttccagtgaggctctg

SEQ ID NO: 5582678 - DNA, 15 bp, Homo sapiens
cactgcttcccactg

SEQ ID NO: 5582679 - DNA, 17 bp, Homo sapiens
cactgcttctcggaggc

SEQ ID NO: 5582680 - DNA, 20 bp, Homo sapiens
cactgcttctcggaggccag

SEQ ID NO: 5582681 - DNA, 16 bp, Homo sapiens
cactgcttctcggcca

SEQ ID NO: 5582682 - DNA, 16 bp, Homo sapiens
cactgcttctgctttt

SEQ ID NO: 5582683 - DNA, 13 bp, Homo sapiens
cactgcttgagga

SEQ ID NO: 5582684 - DNA, 17 bp, Homo sapiens
cactgcttgaggagggg

SEQ ID NO: 5582685 - DNA, 23 bp, Homo sapiens
cactgcttgatgaagcaaggaag

SEQ ID NO: 5582686 - DNA, 17 bp, Homo sapiens
cactgctttattttagg

SEQ ID NO: 5582687 - DNA, 17 bp, Homo sapiens
cactgcttttggcctgg

SEQ ID NO: 5582688 - DNA, 18 bp, Homo sapiens
cactgcttttggcctgga

SEQ ID NO: 5582689 - DNA, 13 bp, Homo sapiens
cactggaaaacat

SEQ ID NO: 5582690 - DNA, 17 bp, Homo sapiens
cactggaaaataaattt

SEQ ID NO: 5582691 - DNA, 18 bp, Homo sapiens
cactggaaaggaaagatg

SEQ ID NO: 5582692 - DNA, 16 bp, Homo sapiens
cactggaaaggggaga

SEQ ID NO: 5582693 - DNA, 22 bp, Homo sapiens
cactggaaaggggagagcctgc

SEQ ID NO: 5582694 - DNA, 22 bp, Homo sapiens
cactggaaattgaggtccatgg

SEQ ID NO: 5582695 - DNA, 16 bp, Homo sapiens
cactggaaccacctgg

SEQ ID NO: 5582696 - DNA, 16 bp, Homo sapiens
cactggaacctccctg

SEQ ID NO: 5582697 - DNA, 22 bp, Homo sapiens
cactggaacgtttcactgcaaa

SEQ ID NO: 5582698 - DNA, 12 bp, Homo sapiens
cactggaagcag

SEQ ID NO: 5582699 - DNA, 14 bp, Homo sapiens
cactggaaggaaca

SEQ ID NO: 5582700 - DNA, 14 bp, Homo sapiens
cactggaaggagca

SEQ ID NO: 5582701 - DNA, 17 bp, Homo sapiens
cactggaaggagcacat

SEQ ID NO: 5582702 - DNA, 22 bp, Homo sapiens
cactggaatataaaacagtcat

SEQ ID NO: 5582703 - DNA, 22 bp, Homo sapiens
cactggaatcgatctgtactgt

SEQ ID NO: 5582704 - DNA, 19 bp, Homo sapiens
cactggaatgaagaccatg

SEQ ID NO: 5582705 - DNA, 20 bp, Homo sapiens
cactggacagacccaggtct

SEQ ID NO: 5582706 - DNA, 20 bp, Homo sapiens
cactggacatggcccattgg

SEQ ID NO: 5582707 - DNA, 14 bp, Homo sapiens
cactggaccaggtc

SEQ ID NO: 5582708 - DNA, 15 bp, Homo sapiens
cactggaccaggtcc

SEQ ID NO: 5582709 - DNA, 16 bp, Homo sapiens
cactggaccccactgg

SEQ ID NO: 5582710 - DNA, 21 bp, Homo sapiens
cactggaccccactggctgag

SEQ ID NO: 5582711 - DNA, 22 bp, Homo sapiens
cactggaccccactggctgaga

SEQ ID NO: 5582712 - DNA, 15 bp, Homo sapiens
cactggacctggggg

SEQ ID NO: 5582713 - DNA, 16 bp, Homo sapiens
cactggacctgggggt

SEQ ID NO: 5582714 - DNA, 15 bp, Homo sapiens
cactggactcacctc

SEQ ID NO: 5582715 - DNA, 18 bp, Homo sapiens
cactggactcacctcccc

SEQ ID NO: 5582716 - DNA, 15 bp, Homo sapiens
cactggactccggcc

SEQ ID NO: 5582717 - DNA, 23 bp, Homo sapiens
cactggactccggggccccactg

SEQ ID NO: 5582718 - DNA, 14 bp, Homo sapiens
cactggactgcatg

SEQ ID NO: 5582719 - DNA, 14 bp, Homo sapiens
cactggacttgcct

SEQ ID NO: 5582720 - DNA, 20 bp, Homo sapiens
cactggagaagaatatcaaa

SEQ ID NO: 5582721 - DNA, 21 bp, Homo sapiens
cactggagaagaatatcaaat

SEQ ID NO: 5582722 - DNA, 21 bp, Homo sapiens
cactggagcaccaggcacgaa

SEQ ID NO: 5582723 - DNA, 19 bp, Homo sapiens
cactggagcagaaggggag

SEQ ID NO: 5582724 - DNA, 20 bp, Homo sapiens
cactggagccacaggcaggg

SEQ ID NO: 5582725 - DNA, 14 bp, Homo sapiens
cactggagcccagg

SEQ ID NO: 5582726 - DNA, 15 bp, Homo sapiens
cactggagcccagga

SEQ ID NO: 5582727 - DNA, 18 bp, Homo sapiens
cactggaggagagaagaa

SEQ ID NO: 5582728 - DNA, 16 bp, Homo sapiens
cactggaggagcagct

SEQ ID NO: 5582729 - DNA, 20 bp, Homo sapiens
cactggaggggcccacccac

SEQ ID NO: 5582730 - DNA, 20 bp, Homo sapiens
cactggaggttgaagccaag

SEQ ID NO: 5582731 - DNA, 21 bp, Homo sapiens
cactggaggttgaagccaagt

SEQ ID NO: 5582732 - DNA, 16 bp, Homo sapiens
cactggagtccagtct

SEQ ID NO: 5582733 - DNA, 17 bp, Homo sapiens
cactggagtgcagggag

SEQ ID NO: 5582734 - DNA, 18 bp, Homo sapiens
cactggagtgcagggagg

SEQ ID NO: 5582735 - DNA, 19 bp, Homo sapiens
cactggagtggctcgccag

SEQ ID NO: 5582736 - DNA, 21 bp, Homo sapiens
cactggagtggctcgccaggc

SEQ ID NO: 5582737 - DNA, 22 bp, Homo sapiens
cactggagttacattaatgtta

SEQ ID NO: 5582738 - DNA, 18 bp, Homo sapiens
cactggagttcactttca

SEQ ID NO: 5582739 - DNA, 22 bp, Homo sapiens
cactggatcaagttcagccacc

SEQ ID NO: 5582740 - DNA, 23 bp, Homo sapiens
cactggatcaagttcagccaccg

SEQ ID NO: 5582741 - DNA, 22 bp, Homo sapiens
cactggatccatccgtccagcc

SEQ ID NO: 5582742 - DNA, 23 bp, Homo sapiens
cactggatcttcagaaggctaga

SEQ ID NO: 5582743 - DNA, 15 bp, Homo sapiens
cactggatgaaaatg

SEQ ID NO: 5582744 - DNA, 23 bp, Homo sapiens
cactggattataagttctatttt

SEQ ID NO: 5582745 - DNA, 17 bp, Homo sapiens
cactggattggtcattt

SEQ ID NO: 5582746 - DNA, 18 bp, Homo sapiens
cactggattgtagaactt

SEQ ID NO: 5582747 - DNA, 22 bp, Homo sapiens
cactggattgtagaacttgttg

SEQ ID NO: 5582748 - DNA, 15 bp, Homo sapiens
cactggcaatatttg

SEQ ID NO: 5582749 - DNA, 16 bp, Homo sapiens
cactggcaatgaaaaa

SEQ ID NO: 5582750 - DNA, 19 bp, Homo sapiens
cactggcacgtttgtgaga

SEQ ID NO: 5582751 - DNA, 11 bp, Homo sapiens
cactggcactt

SEQ ID NO: 5582752 - DNA, 20 bp, Homo sapiens
cactggcacttgcctgctgc

SEQ ID NO: 5582753 - DNA, 19 bp, Homo sapiens
cactggcagactgtgtaaa

SEQ ID NO: 5582754 - DNA, 14 bp, Homo sapiens
cactggcagagcac

SEQ ID NO: 5582755 - DNA, 16 bp, Homo sapiens
cactggcagagcacag

SEQ ID NO: 5582756 - DNA, 18 bp, Homo sapiens
cactggcagagcacagcc

SEQ ID NO: 5582757 - DNA, 14 bp, Homo sapiens
cactggcagcccca

SEQ ID NO: 5582758 - DNA, 19 bp, Homo sapiens
cactggcaggatcacagct

SEQ ID NO: 5582759 - DNA, 14 bp, Homo sapiens
cactggcaggtgtg

SEQ ID NO: 5582760 - DNA, 18 bp, Homo sapiens
cactggcatctctggagt

SEQ ID NO: 5582761 - DNA, 10 bp, Homo sapiens
cactggccac

SEQ ID NO: 5582762 - DNA, 17 bp, Homo sapiens
cactggccaccaggctg

SEQ ID NO: 5582763 - DNA, 18 bp, Homo sapiens
cactggccaccaggctgg

SEQ ID NO: 5582764 - DNA, 19 bp, Homo sapiens
cactggccaccaggctggc

SEQ ID NO: 5582765 - DNA, 20 bp, Homo sapiens
cactggccaccaggctggcg

SEQ ID NO: 5582766 - DNA, 21 bp, Homo sapiens
cactggccaccaggctggcgc

SEQ ID NO: 5582767 - DNA, 22 bp, Homo sapiens
cactggccaccaggctggcgca

SEQ ID NO: 5582768 - DNA, 13 bp, Homo sapiens
cactggccagaga

SEQ ID NO: 5582769 - DNA, 15 bp, Homo sapiens
cactggccagagagg

SEQ ID NO: 5582770 - DNA, 20 bp, Homo sapiens
cactggccagagagggccca

SEQ ID NO: 5582771 - DNA, 21 bp, Homo sapiens
cactggccagagagggcccag

SEQ ID NO: 5582772 - DNA, 22 bp, Homo sapiens
cactggccagagagggcccagc

SEQ ID NO: 5582773 - DNA, 18 bp, Homo sapiens
cactggccagtcctagag

SEQ ID NO: 5582774 - DNA, 21 bp, Homo sapiens
cactggccagtcctagagctc

SEQ ID NO: 5582775 - DNA, 17 bp, Homo sapiens
cactggccatctccacc

SEQ ID NO: 5582776 - DNA, 14 bp, Homo sapiens
cactggccccaccc

SEQ ID NO: 5582777 - DNA, 24 bp, Homo sapiens
cactggcccctcaaatcgtccagc

SEQ ID NO: 5582778 - DNA, 15 bp, Homo sapiens
cactggccgctgagc

SEQ ID NO: 5582779 - DNA, 17 bp, Homo sapiens
cactggccgctgagcgc

SEQ ID NO: 5582780 - DNA, 20 bp, Homo sapiens
cactggcctctccccaggaa

SEQ ID NO: 5582781 - DNA, 10 bp, Homo sapiens
cactggcctg

SEQ ID NO: 5582782 - DNA, 13 bp, Homo sapiens
cactggcctggcg

SEQ ID NO: 5582783 - DNA, 21 bp, Homo sapiens
cactggcctgggtctccctgg

SEQ ID NO: 5582784 - DNA, 11 bp, Homo sapiens
cactggcctgt

SEQ ID NO: 5582785 - DNA, 23 bp, Homo sapiens
cactggccttctgatgaaatgtt

SEQ ID NO: 5582786 - DNA, 13 bp, Homo sapiens
cactggcgaggag

SEQ ID NO: 5582787 - DNA, 13 bp, Homo sapiens
cactggcgccttc

SEQ ID NO: 5582788 - DNA, 18 bp, Homo sapiens
cactggcgccttctcgga

SEQ ID NO: 5582789 - DNA, 22 bp, Homo sapiens
cactggcgccttctcggagctg

SEQ ID NO: 5582790 - DNA, 21 bp, Homo sapiens
cactggcggtcaagtgtggag

SEQ ID NO: 5582791 - DNA, 13 bp, Homo sapiens
cactggctcaccc

SEQ ID NO: 5582792 - DNA, 17 bp, Homo sapiens
cactggctcacccagtc

SEQ ID NO: 5582793 - DNA, 17 bp, Homo sapiens
cactggctcatgcccct

SEQ ID NO: 5582794 - DNA, 18 bp, Homo sapiens
cactggctcatgcccctt

SEQ ID NO: 5582795 - DNA, 14 bp, Homo sapiens
cactggctccacat

SEQ ID NO: 5582796 - DNA, 15 bp, Homo sapiens
cactggctccatgat

SEQ ID NO: 5582797 - DNA, 12 bp, Homo sapiens
cactggctcctc

SEQ ID NO: 5582798 - DNA, 16 bp, Homo sapiens
cactggctcctcccag

SEQ ID NO: 5582799 - DNA, 18 bp, Homo sapiens
cactggctcctcccagca

SEQ ID NO: 5582800 - DNA, 11 bp, Homo sapiens
cactggctctc

SEQ ID NO: 5582801 - DNA, 15 bp, Homo sapiens
cactggctctccaag

SEQ ID NO: 5582802 - DNA, 13 bp, Homo sapiens
cactggctctggg

SEQ ID NO: 5582803 - DNA, 22 bp, Homo sapiens
cactggctgaacttggagaggg

SEQ ID NO: 5582804 - DNA, 21 bp, Homo sapiens
cactggctgagaatctggggg

SEQ ID NO: 5582805 - DNA, 14 bp, Homo sapiens
cactggctgccagc

SEQ ID NO: 5582806 - DNA, 20 bp, Homo sapiens
cactggctgccagctatttt

SEQ ID NO: 5582807 - DNA, 15 bp, Homo sapiens
cactggctgcctcca

SEQ ID NO: 5582808 - DNA, 19 bp, Homo sapiens
cactggctgcctccactcc

SEQ ID NO: 5582809 - DNA, 20 bp, Homo sapiens
cactggctgcctccactccc

SEQ ID NO: 5582810 - DNA, 14 bp, Homo sapiens
cactggctgctctg

SEQ ID NO: 5582811 - DNA, 15 bp, Homo sapiens
cactggctgctctgt

SEQ ID NO: 5582812 - DNA, 23 bp, Homo sapiens
cactggctggactggaggctggg

SEQ ID NO: 5582813 - DNA, 14 bp, Homo sapiens
cactggctggcctg

SEQ ID NO: 5582814 - DNA, 17 bp, Homo sapiens
cactggctggcctgagc

SEQ ID NO: 5582815 - DNA, 18 bp, Homo sapiens
cactggctggcctgagca

SEQ ID NO: 5582816 - DNA, 13 bp, Homo sapiens
cactggctggctc

SEQ ID NO: 5582817 - DNA, 13 bp, Homo sapiens
cactggctgggag

SEQ ID NO: 5582818 - DNA, 14 bp, Homo sapiens
cactggctgggagt

SEQ ID NO: 5582819 - DNA, 16 bp, Homo sapiens
cactggctggggcaga

SEQ ID NO: 5582820 - DNA, 18 bp, Homo sapiens
cactggctggggcagagg

SEQ ID NO: 5582821 - DNA, 19 bp, Homo sapiens
cactggctggggcagaggg

SEQ ID NO: 5582822 - DNA, 22 bp, Homo sapiens
cactggctggggcagaggggca

SEQ ID NO: 5582823 - DNA, 13 bp, Homo sapiens
cactgggaaacag

SEQ ID NO: 5582824 - DNA, 18 bp, Homo sapiens
cactgggaagaagcaagg

SEQ ID NO: 5582825 - DNA, 23 bp, Homo sapiens
cactgggaagctggagtgctgct

SEQ ID NO: 5582826 - DNA, 16 bp, Homo sapiens
cactgggaaggaaaca

SEQ ID NO: 5582827 - DNA, 20 bp, Homo sapiens
cactgggaatgtcctgtaga

SEQ ID NO: 5582828 - DNA, 20 bp, Homo sapiens
cactgggaatttatttatgt

SEQ ID NO: 5582829 - DNA, 22 bp, Homo sapiens
cactgggactcccagcagagcc

SEQ ID NO: 5582830 - DNA, 23 bp, Homo sapiens
cactgggactcccagcagagccc

SEQ ID NO: 5582831 - DNA, 18 bp, Homo sapiens
cactgttggcacttatag

SEQ ID NO: 5582832 - DNA, 16 bp, Homo sapiens
cactgttgggtgggtg

SEQ ID NO: 5582833 - DNA, 23 bp, Homo sapiens
cactgttgtgaatcaccaaagga

SEQ ID NO: 5582834 - DNA, 11 bp, Homo sapiens
cactgtttaag

SEQ ID NO: 5582835 - DNA, 16 bp, Homo sapiens
cactgtttaatcatag

SEQ ID NO: 5582836 - DNA, 18 bp, Homo sapiens
cactgtttacaagaaaaa

SEQ ID NO: 5582837 - DNA, 15 bp, Homo sapiens
cactgtttagatttg

SEQ ID NO: 5582838 - DNA, 20 bp, Homo sapiens
cactgtttagatttgccata

SEQ ID NO: 5582839 - DNA, 21 bp, Homo sapiens
cactgtttcactactcagcat

SEQ ID NO: 5582840 - DNA, 20 bp, Homo sapiens
cactgtttcatctcagcttt

SEQ ID NO: 5582841 - DNA, 21 bp, Homo sapiens
cactgtttcatctcagctttt

SEQ ID NO: 5582842 - DNA, 13 bp, Homo sapiens
cactgtttcctgg

SEQ ID NO: 5582843 - DNA, 17 bp, Homo sapiens
cactgtttctcttgagc

SEQ ID NO: 5582844 - DNA, 23 bp, Homo sapiens
cactgttttaaaagatcatagtt

SEQ ID NO: 5582845 - DNA, 19 bp, Homo sapiens
cactgttttatctctgtga

SEQ ID NO: 5582846 - DNA, 16 bp, Homo sapiens
cactgttttctagtgt

SEQ ID NO: 5582847 - DNA, 17 bp, Homo sapiens
cactgttttctagtgta

SEQ ID NO: 5582848 - DNA, 23 bp, Homo sapiens
cactgttttctagtgtatcaaaa

SEQ ID NO: 5582849 - DNA, 22 bp, Homo sapiens
cactgttttgaatctcataatt

SEQ ID NO: 5582850 - DNA, 15 bp, Homo sapiens
cactgtttttaatct

SEQ ID NO: 5582851 - DNA, 19 bp, Homo sapiens
cactgtttttattccttcc

SEQ ID NO: 5582852 - DNA, 15 bp, Homo sapiens
cactgtttttccata

SEQ ID NO: 5582853 - DNA, 16 bp, Homo sapiens
cactgtttttccatag

SEQ ID NO: 5582854 - DNA, 13 bp, Homo sapiens
cacttaaaaagac

SEQ ID NO: 5582855 - DNA, 16 bp, Homo sapiens
cacttaaaaattagca

SEQ ID NO: 5582856 - DNA, 22 bp, Homo sapiens
cacttaaaacacgttttaagga

SEQ ID NO: 5582857 - DNA, 13 bp, Homo sapiens
cacttaaaagaaa

SEQ ID NO: 5582858 - DNA, 22 bp, Homo sapiens
cacttaaaagctggctttcatc

SEQ ID NO: 5582859 - DNA, 17 bp, Homo sapiens
cacttaaaatacatgaa

SEQ ID NO: 5582860 - DNA, 13 bp, Homo sapiens
cacttaaaatcaa

SEQ ID NO: 5582861 - DNA, 16 bp, Homo sapiens
cacttaaacttgcaca

SEQ ID NO: 5582862 - DNA, 19 bp, Homo sapiens
cacttaaacttgcacattt

SEQ ID NO: 5582863 - DNA, 21 bp, Homo sapiens
cacttaaacttgcacatttga

SEQ ID NO: 5582864 - DNA, 14 bp, Homo sapiens
cacttaaactttgt

SEQ ID NO: 5582865 - DNA, 18 bp, Homo sapiens
cacttaaagaagtatttt

SEQ ID NO: 5582866 - DNA, 21 bp, Homo sapiens
cacttaaagggtcttatgaaa

SEQ ID NO: 5582867 - DNA, 19 bp, Homo sapiens
cacttaaatacctctggct

SEQ ID NO: 5582868 - DNA, 15 bp, Homo sapiens
cacttaaatatcaat

SEQ ID NO: 5582869 - DNA, 16 bp, Homo sapiens
cacttaaattcttttg

SEQ ID NO: 5582870 - DNA, 20 bp, Homo sapiens
cacttaaatttcttggcaaa

SEQ ID NO: 5582871 - DNA, 17 bp, Homo sapiens
cacttaaatttgttctt

SEQ ID NO: 5582872 - DNA, 22 bp, Homo sapiens
cacttaaatttgttctttgttt

SEQ ID NO: 5582873 - DNA, 18 bp, Homo sapiens
cacttaacaaacaaattt

SEQ ID NO: 5582874 - DNA, 15 bp, Homo sapiens
cacttaacacatgaa

SEQ ID NO: 5582875 - DNA, 23 bp, Homo sapiens
cacttaaccaagacaaaaagcca

SEQ ID NO: 5582876 - DNA, 13 bp, Homo sapiens
cacttaacctgct

SEQ ID NO: 5582877 - DNA, 20 bp, Homo sapiens
cacttaactataaggtgcct

SEQ ID NO: 5582878 - DNA, 17 bp, Homo sapiens
cacttaagagaatattt

SEQ ID NO: 5582879 - DNA, 22 bp, Homo sapiens
cacttaagagaatattttaagt

SEQ ID NO: 5582880 - DNA, 13 bp, Homo sapiens
cacttaagtgtct

SEQ ID NO: 5582881 - DNA, 14 bp, Homo sapiens
cacttaagtgtctg

SEQ ID NO: 5582882 - DNA, 21 bp, Homo sapiens
cacttaagttagcctccacca

SEQ ID NO: 5582883 - DNA, 20 bp, Homo sapiens
cacttaagttagttccactg

SEQ ID NO: 5582884 - DNA, 12 bp, Homo sapiens
cacttaatagca

SEQ ID NO: 5582885 - DNA, 13 bp, Homo sapiens
cacttaatagcaa

SEQ ID NO: 5582886 - DNA, 14 bp, Homo sapiens
cacttaatcatttt

SEQ ID NO: 5582887 - DNA, 14 bp, Homo sapiens
cacttaatgtatgt

SEQ ID NO: 5582888 - DNA, 15 bp, Homo sapiens
cacttaatgtatgtt

SEQ ID NO: 5582889 - DNA, 14 bp, Homo sapiens
cacttaattacagt

SEQ ID NO: 5582890 - DNA, 20 bp, Homo sapiens
cacttaattctcattatgaa

SEQ ID NO: 5582891 - DNA, 15 bp, Homo sapiens
cacttaatttgtaaa

SEQ ID NO: 5582892 - DNA, 16 bp, Homo sapiens
cacttaatttgtaaac

SEQ ID NO: 5582893 - DNA, 22 bp, Homo sapiens
cacttaatttgtaaacttctga

SEQ ID NO: 5582894 - DNA, 23 bp, Homo sapiens
cacttacaaataaatccaagact

SEQ ID NO: 5582895 - DNA, 12 bp, Homo sapiens
cacttacaagtg

SEQ ID NO: 5582896 - DNA, 13 bp, Homo sapiens
cacttacaatttt

SEQ ID NO: 5582897 - DNA, 17 bp, Homo sapiens
cacttacaccagtttga

SEQ ID NO: 5582898 - DNA, 16 bp, Homo sapiens
cacttacactttatgc

SEQ ID NO: 5582899 - DNA, 19 bp, Homo sapiens
cacttacatatatttttaa

SEQ ID NO: 5582900 - DNA, 15 bp, Homo sapiens
cacttaccgccctgc

SEQ ID NO: 5582901 - DNA, 16 bp, Homo sapiens
cacttaccgccctgcg

SEQ ID NO: 5582902 - DNA, 20 bp, Homo sapiens
cacttaccgccctgcgggcc

SEQ ID NO: 5582903 - DNA, 21 bp, Homo sapiens
cacttacctgagttgaagagg

SEQ ID NO: 5582904 - DNA, 15 bp, Homo sapiens
cacttacctgcttga

SEQ ID NO: 5582905 - DNA, 18 bp, Homo sapiens
cacttaccttcaataaag

SEQ ID NO: 5582906 - DNA, 16 bp, Homo sapiens
cacttacgtaaaacat

SEQ ID NO: 5582907 - DNA, 17 bp, Homo sapiens
cacttacgtaaaacatt

SEQ ID NO: 5582908 - DNA, 18 bp, Homo sapiens
cacttacgtaaaacattt

SEQ ID NO: 5582909 - DNA, 21 bp, Homo sapiens
cacttactggtaggaccaagc

SEQ ID NO: 5582910 - DNA, 17 bp, Homo sapiens
cacttactgtaagacat

SEQ ID NO: 5582911 - DNA, 16 bp, Homo sapiens
cacttactgtttctgt

SEQ ID NO: 5582912 - DNA, 18 bp, Homo sapiens
cacttactgtttctgtca

SEQ ID NO: 5582913 - DNA, 17 bp, Homo sapiens
cacttacttaccctcac

SEQ ID NO: 5582914 - DNA, 16 bp, Homo sapiens
cacttacttgcttatt

SEQ ID NO: 5582915 - DNA, 18 bp, Homo sapiens
cacttactttaatgcgaa

SEQ ID NO: 5582916 - DNA, 17 bp, Homo sapiens
cacttagaaattgcatt

SEQ ID NO: 5582917 - DNA, 20 bp, Homo sapiens
cacttagaaattgcatttcc

SEQ ID NO: 5582918 - DNA, 14 bp, Homo sapiens
cacttagaagatgt

SEQ ID NO: 5582919 - DNA, 14 bp, Homo sapiens
cacttagaatacta

SEQ ID NO: 5582920 - DNA, 16 bp, Homo sapiens
cacttagaatagcatt

SEQ ID NO: 5582921 - DNA, 22 bp, Homo sapiens
cacttagattaagattttactt

SEQ ID NO: 5582922 - DNA, 21 bp, Homo sapiens
cacttagcaggcaccgccacg

SEQ ID NO: 5582923 - DNA, 15 bp, Homo sapiens
cacttagcagggaca

SEQ ID NO: 5582924 - DNA, 20 bp, Homo sapiens
cacttagcagggacaggaga

SEQ ID NO: 5582925 - DNA, 15 bp, Homo sapiens
cacttagcccaagag

SEQ ID NO: 5582926 - DNA, 20 bp, Homo sapiens
cacttagcctttcttttctt

SEQ ID NO: 5582927 - DNA, 23 bp, Homo sapiens
cacttagctgttggaatgttgtt

SEQ ID NO: 5582928 - DNA, 17 bp, Homo sapiens
cacttaggagaagtctt

SEQ ID NO: 5582929 - DNA, 13 bp, Homo sapiens
cacttagtaggtc

SEQ ID NO: 5582930 - DNA, 16 bp, Homo sapiens
cacttagtaggtcctc

SEQ ID NO: 5582931 - DNA, 21 bp, Homo sapiens
cacttagtaggtcctcaataa

SEQ ID NO: 5582932 - DNA, 19 bp, Homo sapiens
cacttagtagtttttacaa

SEQ ID NO: 5582933 - DNA, 13 bp, Homo sapiens
cacttagtatgca

SEQ ID NO: 5582934 - DNA, 16 bp, Homo sapiens
cacttagtatgcagtt

SEQ ID NO: 5582935 - DNA, 20 bp, Homo sapiens
cacttagtgaggacctgaca

SEQ ID NO: 5582936 - DNA, 13 bp, Homo sapiens
cacttagtgctgg

SEQ ID NO: 5582937 - DNA, 18 bp, Homo sapiens
cacttagttttgggaggg

SEQ ID NO: 5582938 - DNA, 21 bp, Homo sapiens
cacttataaaataacttgcat

SEQ ID NO: 5582939 - DNA, 19 bp, Homo sapiens
cacttataaatatcctgct

SEQ ID NO: 5582940 - DNA, 21 bp, Homo sapiens
cacttataagtgggagctaaa

SEQ ID NO: 5582941 - DNA, 11 bp, Homo sapiens
cacttatacca

SEQ ID NO: 5582942 - DNA, 15 bp, Homo sapiens
cacttataccaaagg

SEQ ID NO: 5582943 - DNA, 16 bp, Homo sapiens
cacttatagcctctgt

SEQ ID NO: 5582944 - DNA, 21 bp, Homo sapiens
cacttatctcgaatttgaaga

SEQ ID NO: 5582945 - DNA, 24 bp, Homo sapiens
cacttatctcgaatttgaagagat

SEQ ID NO: 5582946 - DNA, 16 bp, Homo sapiens
cacttatctgatactt

SEQ ID NO: 5582947 - DNA, 16 bp, Homo sapiens
cacttatctgatcaga

SEQ ID NO: 5582948 - DNA, 14 bp, Homo sapiens
cacttatgctgctg

SEQ ID NO: 5582949 - DNA, 15 bp, Homo sapiens
cacttatgctgctgt

SEQ ID NO: 5582950 - DNA, 16 bp, Homo sapiens
cacttatgctgctgtg

SEQ ID NO: 5582951 - DNA, 14 bp, Homo sapiens
cacttatgtacttg

SEQ ID NO: 5582952 - DNA, 17 bp, Homo sapiens
cacttatgtacttgata

SEQ ID NO: 5582953 - DNA, 23 bp, Homo sapiens
cacttattattaataatgaagta

SEQ ID NO: 5582954 - DNA, 20 bp, Homo sapiens
cacttattccccattcttcc

SEQ ID NO: 5582955 - DNA, 17 bp, Homo sapiens
cacttattctcaagaag

SEQ ID NO: 5582956 - DNA, 16 bp, Homo sapiens
cacttattgtaaattt

SEQ ID NO: 5582957 - DNA, 16 bp, Homo sapiens
cacttatttattgttg

SEQ ID NO: 5582958 - DNA, 20 bp, Homo sapiens
cacttatttattgttgcctt

SEQ ID NO: 5582959 - DNA, 13 bp, Homo sapiens
cacttatttcact

SEQ ID NO: 5582960 - DNA, 22 bp, Homo sapiens
cacttatttcactatcttcttc

SEQ ID NO: 5582961 - DNA, 17 bp, Homo sapiens
cacttatttcataaaca

SEQ ID NO: 5582962 - DNA, 14 bp, Homo sapiens
cacttatttccatg

SEQ ID NO: 5582963 - DNA, 12 bp, Homo sapiens
cacttatttcta

SEQ ID NO: 5582964 - DNA, 19 bp, Homo sapiens
cacttatttttttcccaag

SEQ ID NO: 5582965 - DNA, 22 bp, Homo sapiens
cacttcaaacatgccctcaggc

SEQ ID NO: 5582966 - DNA, 23 bp, Homo sapiens
cacttcaaacatgccctcaggct

SEQ ID NO: 5582967 - DNA, 14 bp, Homo sapiens
cacttcaaagctaa

SEQ ID NO: 5582968 - DNA, 18 bp, Homo sapiens
cacttcaaattcaaataa

SEQ ID NO: 5582969 - DNA, 22 bp, Homo sapiens
cacttcaacccccagctaataa

SEQ ID NO: 5582970 - DNA, 14 bp, Homo sapiens
cacttcaagcaaag

SEQ ID NO: 5582971 - DNA, 22 bp, Homo sapiens
cacttcaaggtgacagaaggac

SEQ ID NO: 5582972 - DNA, 19 bp, Homo sapiens
cacttcaataattgtccat

SEQ ID NO: 5582973 - DNA, 14 bp, Homo sapiens
cacttcacagagtg

SEQ ID NO: 5582974 - DNA, 16 bp, Homo sapiens
cacttcacccccaact

SEQ ID NO: 5582975 - DNA, 14 bp, Homo sapiens
cacttcaccttctg

SEQ ID NO: 5582976 - DNA, 19 bp, Homo sapiens
cacttcactaaagtgtcat

SEQ ID NO: 5582977 - DNA, 21 bp, Homo sapiens
cacttcactgcgaagaccctc

SEQ ID NO: 5582978 - DNA, 13 bp, Homo sapiens
cacttcactgtgc

SEQ ID NO: 5582979 - DNA, 15 bp, Homo sapiens
cacttcactttcttc

SEQ ID NO: 5582980 - DNA, 16 bp, Homo sapiens
cacttcactttcttca

SEQ ID NO: 5582981 - DNA, 22 bp, Homo sapiens
cacttcactttcttcaaagcca

SEQ ID NO: 5582982 - DNA, 16 bp, Homo sapiens
cacttcagaattccat

SEQ ID NO: 5582983 - DNA, 20 bp, Homo sapiens
cacttcagacacaggaaaaa

SEQ ID NO: 5582984 - DNA, 16 bp, Homo sapiens
cacttcagagagctgg

SEQ ID NO: 5582985 - DNA, 13 bp, Homo sapiens
cacttcagatctg

SEQ ID NO: 5582986 - DNA, 19 bp, Homo sapiens
cacttcagatctgaggttg

SEQ ID NO: 5582987 - DNA, 14 bp, Homo sapiens
cacttcagcccagc

SEQ ID NO: 5582988 - DNA, 20 bp, Homo sapiens
cacttcaggagaaactgctg

SEQ ID NO: 5582989 - DNA, 20 bp, Homo sapiens
cacttcaggagccctactga

SEQ ID NO: 5582990 - DNA, 20 bp, Homo sapiens
cacttcaggctcttctcctt

SEQ ID NO: 5582991 - DNA, 18 bp, Homo sapiens
cacttcagggcagatttt

SEQ ID NO: 5582992 - DNA, 12 bp, Homo sapiens
cacttcaggtcc

SEQ ID NO: 5582993 - DNA, 14 bp, Homo sapiens
cacttcataatcca

SEQ ID NO: 5582994 - DNA, 15 bp, Homo sapiens
cacttcatcaatcaa

SEQ ID NO: 5582995 - DNA, 15 bp, Homo sapiens
cacttcatccagatg

SEQ ID NO: 5582996 - DNA, 15 bp, Homo sapiens
cacttcatcttctca

SEQ ID NO: 5582997 - DNA, 17 bp, Homo sapiens
cacttcatgcccactgc

SEQ ID NO: 5582998 - DNA, 15 bp, Homo sapiens
cacttcatgtaaagt

SEQ ID NO: 5582999 - DNA, 15 bp, Homo sapiens
cacttcattccagca

SEQ ID NO: 5583000 - DNA, 17 bp, Homo sapiens
cacttcattccagcagc

SEQ ID NO: 5583001 - DNA, 22 bp, Homo sapiens
cacttcattcttgaaagctgtg

SEQ ID NO: 5583002 - DNA, 17 bp, Homo sapiens
cacttcattctttatat

SEQ ID NO: 5583003 - DNA, 13 bp, Homo sapiens
cacttcattttta

SEQ ID NO: 5583004 - DNA, 14 bp, Homo sapiens
cacttccaccagcc

SEQ ID NO: 5583005 - DNA, 18 bp, Homo sapiens
cacttccaccagcctgca

SEQ ID NO: 5583006 - DNA, 19 bp, Homo sapiens
cacttccaccagcctgcac

SEQ ID NO: 5583007 - DNA, 13 bp, Homo sapiens
cacttccaccccc

SEQ ID NO: 5583008 - DNA, 19 bp, Homo sapiens
cacttccacctccagcctc

SEQ ID NO: 5583009 - DNA, 15 bp, Homo sapiens
cagaaacagccattg

SEQ ID NO: 5583010 - DNA, 19 bp, Homo sapiens
cagaaacagctgcttctcc

SEQ ID NO: 5583011 - DNA, 21 bp, Homo sapiens
cagaaacagggggaaaatgtt

SEQ ID NO: 5583012 - DNA, 18 bp, Homo sapiens
cagaaacaggtgcatctg

SEQ ID NO: 5583013 - DNA, 17 bp, Homo sapiens
cagaaacatcagttact

SEQ ID NO: 5583014 - DNA, 19 bp, Homo sapiens
cagaaacatcagttactct

SEQ ID NO: 5583015 - DNA, 13 bp, Homo sapiens
cagaaacatctct

SEQ ID NO: 5583016 - DNA, 15 bp, Homo sapiens
cagaaacatctctgg

SEQ ID NO: 5583017 - DNA, 16 bp, Homo sapiens
cagaaacatctctggc

SEQ ID NO: 5583018 - DNA, 12 bp, Homo sapiens
cagaaacatgaa

SEQ ID NO: 5583019 - DNA, 19 bp, Homo sapiens
cagaaaccaacaagaacca

SEQ ID NO: 5583020 - DNA, 18 bp, Homo sapiens
cagaaaccagaaaagcaa

SEQ ID NO: 5583021 - DNA, 14 bp, Homo sapiens
cagaaaccagttat

SEQ ID NO: 5583022 - DNA, 15 bp, Homo sapiens
cagaaaccattctag

SEQ ID NO: 5583023 - DNA, 22 bp, Homo sapiens
cagaaacctatcctcactgccc

SEQ ID NO: 5583024 - DNA, 18 bp, Homo sapiens
cagaaacctatctcaggg

SEQ ID NO: 5583025 - DNA, 21 bp, Homo sapiens
cagaaacctatctcagggagg

SEQ ID NO: 5583026 - DNA, 17 bp, Homo sapiens
cagaaacctgggagaga

SEQ ID NO: 5583027 - DNA, 17 bp, Homo sapiens
cagaaaccttgtttgtt

SEQ ID NO: 5583028 - DNA, 22 bp, Homo sapiens
cagaaacgagatcgggaagcag

SEQ ID NO: 5583029 - DNA, 17 bp, Homo sapiens
cagaaacgcatccagca

SEQ ID NO: 5583030 - DNA, 15 bp, Homo sapiens
cagaaacgtgttaaa

SEQ ID NO: 5583031 - DNA, 19 bp, Homo sapiens
cagaaactcctgtttctcc

SEQ ID NO: 5583032 - DNA, 21 bp, Homo sapiens
cagaaactccttttgctgtct

SEQ ID NO: 5583033 - DNA, 22 bp, Homo sapiens
cagaaactgaaccaacagaagc

SEQ ID NO: 5583034 - DNA, 13 bp, Homo sapiens
cagaaactgatgc

SEQ ID NO: 5583035 - DNA, 14 bp, Homo sapiens
cagaaactttttct

SEQ ID NO: 5583036 - DNA, 23 bp, Homo sapiens
cagaaacttttttctctaaagga

SEQ ID NO: 5583037 - DNA, 16 bp, Homo sapiens
cagaaagaaaatgaat

SEQ ID NO: 5583038 - DNA, 19 bp, Homo sapiens
cagaaagaaaatgaatttg

SEQ ID NO: 5583039 - DNA, 14 bp, Homo sapiens
cagaaagaagcagt

SEQ ID NO: 5583040 - DNA, 15 bp, Homo sapiens
cagaaagaagtcagt

SEQ ID NO: 5583041 - DNA, 11 bp, Homo sapiens
cagaaagacat

SEQ ID NO: 5583042 - DNA, 20 bp, Homo sapiens
cagaaagactgagctcaagg

SEQ ID NO: 5583043 - DNA, 12 bp, Homo sapiens
cagaaagagctc

SEQ ID NO: 5583044 - DNA, 15 bp, Homo sapiens
cagaaagagggacaa

SEQ ID NO: 5583045 - DNA, 21 bp, Homo sapiens
cagaaagagggacaagagggt

SEQ ID NO: 5583046 - DNA, 18 bp, Homo sapiens
cagaaagatggagaggca

SEQ ID NO: 5583047 - DNA, 18 bp, Homo sapiens
cagaaagatttggaaaat

SEQ ID NO: 5583048 - DNA, 21 bp, Homo sapiens
cagaaagatttggaaaattca

SEQ ID NO: 5583049 - DNA, 14 bp, Homo sapiens
cagaaagcaaatca

SEQ ID NO: 5583050 - DNA, 18 bp, Homo sapiens
cagaaagcaaatcagaca

SEQ ID NO: 5583051 - DNA, 21 bp, Homo sapiens
cagaaagcaaatcagacacaa

SEQ ID NO: 5583052 - DNA, 12 bp, Homo sapiens
cagaaagcaaca

SEQ ID NO: 5583053 - DNA, 15 bp, Homo sapiens
cagaaagcagaggct

SEQ ID NO: 5583054 - DNA, 16 bp, Homo sapiens
cagaaagcagaggctg

SEQ ID NO: 5583055 - DNA, 18 bp, Homo sapiens
cagaaagcataaaattct

SEQ ID NO: 5583056 - DNA, 22 bp, Homo sapiens
cagaaagcatccctcacccatc

SEQ ID NO: 5583057 - DNA, 17 bp, Homo sapiens
cagaaagcatctattcc

SEQ ID NO: 5583058 - DNA, 20 bp, Homo sapiens
cagaaagccccacccaggcc

SEQ ID NO: 5583059 - DNA, 19 bp, Homo sapiens
cagaaagccctcttggggg

SEQ ID NO: 5583060 - DNA, 14 bp, Homo sapiens
cagaaagcctatca

SEQ ID NO: 5583061 - DNA, 15 bp, Homo sapiens
cagaaagcctccgct

SEQ ID NO: 5583062 - DNA, 20 bp, Homo sapiens
cagaaagcctccgctgggct

SEQ ID NO: 5583063 - DNA, 22 bp, Homo sapiens
cagaaagcctccgctgggcttc

SEQ ID NO: 5583064 - DNA, 13 bp, Homo sapiens
cagaaagcctcct

SEQ ID NO: 5583065 - DNA, 19 bp, Homo sapiens
cagaaagcctcctgccccc

SEQ ID NO: 5583066 - DNA, 23 bp, Homo sapiens
cagaaagcctcctgccccctgcc

SEQ ID NO: 5583067 - DNA, 15 bp, Homo sapiens
cagaaagcctctctc

SEQ ID NO: 5583068 - DNA, 17 bp, Homo sapiens
cagaaagcctctctctc

SEQ ID NO: 5583069 - DNA, 22 bp, Homo sapiens
cagaaagcctgggtgacatttg

SEQ ID NO: 5583070 - DNA, 18 bp, Homo sapiens
cagaaagctgtgaacagg

SEQ ID NO: 5583071 - DNA, 15 bp, Homo sapiens
cagaaagcttcaaat

SEQ ID NO: 5583072 - DNA, 18 bp, Homo sapiens
cagaaagctttattttga

SEQ ID NO: 5583073 - DNA, 20 bp, Homo sapiens
cagaaaggaaaagattcctg

SEQ ID NO: 5583074 - DNA, 20 bp, Homo sapiens
cagaaaggatatttaagaaa

SEQ ID NO: 5583075 - DNA, 21 bp, Homo sapiens
cagaaaggatgttttgtccca

SEQ ID NO: 5583076 - DNA, 20 bp, Homo sapiens
cagaaaggcaggtttcattt

SEQ ID NO: 5583077 - DNA, 12 bp, Homo sapiens
cagaaaggctgc

SEQ ID NO: 5583078 - DNA, 15 bp, Homo sapiens
cagaaaggcttttta

SEQ ID NO: 5583079 - DNA, 14 bp, Homo sapiens
cagaaagggaaagt

SEQ ID NO: 5583080 - DNA, 20 bp, Homo sapiens
cagaaagggaacagtccata

SEQ ID NO: 5583081 - DNA, 16 bp, Homo sapiens
cagaaagggagggctc

SEQ ID NO: 5583082 - DNA, 21 bp, Homo sapiens
cagaaagggagggctctgagg

SEQ ID NO: 5583083 - DNA, 23 bp, Homo sapiens
cagaaagggagggctctgaggcg

SEQ ID NO: 5583084 - DNA, 22 bp, Homo sapiens
cagaaagggcaacaataaaata

SEQ ID NO: 5583085 - DNA, 17 bp, Homo sapiens
cagaaagggcagcccct

SEQ ID NO: 5583086 - DNA, 18 bp, Homo sapiens
cagaaagggcagcttcag

SEQ ID NO: 5583087 - DNA, 19 bp, Homo sapiens
cagaaaggggcattttgta

SEQ ID NO: 5583088 - DNA, 12 bp, Homo sapiens
cagaaaggggct

SEQ ID NO: 5583089 - DNA, 13 bp, Homo sapiens
cagaaagggtgcc

SEQ ID NO: 5583090 - DNA, 22 bp, Homo sapiens
cagaaagggtgccagttgggct

SEQ ID NO: 5583091 - DNA, 19 bp, Homo sapiens
cagaaaggtctctggaggg

SEQ ID NO: 5583092 - DNA, 13 bp, Homo sapiens
cagaaaggtgcag

SEQ ID NO: 5583093 - DNA, 13 bp, Homo sapiens
cagaaaggtgtga

SEQ ID NO: 5583094 - DNA, 17 bp, Homo sapiens
cagaaaggtgtgaggag

SEQ ID NO: 5583095 - DNA, 18 bp, Homo sapiens
cagaaaggtgtgaggaga

SEQ ID NO: 5583096 - DNA, 21 bp, Homo sapiens
cagaaaggttctgcccgggaa

SEQ ID NO: 5583097 - DNA, 20 bp, Homo sapiens
cagaaaggttttcttctttt

SEQ ID NO: 5583098 - DNA, 18 bp, Homo sapiens
cagaaagtaagcatttcc

SEQ ID NO: 5583099 - DNA, 20 bp, Homo sapiens
cagaaagtaatttcttctca

SEQ ID NO: 5583100 - DNA, 16 bp, Homo sapiens
cagaaagtcaccagga

SEQ ID NO: 5583101 - DNA, 20 bp, Homo sapiens
cagaaagtgaggaagcctaa

SEQ ID NO: 5583102 - DNA, 18 bp, Homo sapiens
cagaaagtgataagtgca

SEQ ID NO: 5583103 - DNA, 18 bp, Homo sapiens
cagaaagtgcagcatgga

SEQ ID NO: 5583104 - DNA, 21 bp, Homo sapiens
cagaaagtgcagcatggagga

SEQ ID NO: 5583105 - DNA, 23 bp, Homo sapiens
cagaaagtggccatgccaccctg

SEQ ID NO: 5583106 - DNA, 14 bp, Homo sapiens
cagaaagtgggggt

SEQ ID NO: 5583107 - DNA, 19 bp, Homo sapiens
cagaaagtggtgctcagtt

SEQ ID NO: 5583108 - DNA, 11 bp, Homo sapiens
cagaaagttat

SEQ ID NO: 5583109 - DNA, 21 bp, Homo sapiens
cagaaagttggaaaggaaaaa

SEQ ID NO: 5583110 - DNA, 16 bp, Homo sapiens
cagaaagtttgaagca

SEQ ID NO: 5583111 - DNA, 23 bp, Homo sapiens
cagaaataaaacaactctgatgt

SEQ ID NO: 5583112 - DNA, 14 bp, Homo sapiens
cagaaataaaagta

SEQ ID NO: 5583113 - DNA, 23 bp, Homo sapiens
cagaaataaaatttgataaacat

SEQ ID NO: 5583114 - DNA, 12 bp, Homo sapiens
cagaaataaaga

SEQ ID NO: 5583115 - DNA, 21 bp, Homo sapiens
cagaaatacaaaaaattagct

SEQ ID NO: 5583116 - DNA, 15 bp, Homo sapiens
cagaaatacaacaga

SEQ ID NO: 5583117 - DNA, 13 bp, Homo sapiens
cagaaatacatat

SEQ ID NO: 5583118 - DNA, 17 bp, Homo sapiens
cagaaatactgctctga

SEQ ID NO: 5583119 - DNA, 14 bp, Homo sapiens
cagaaatagctatg

SEQ ID NO: 5583120 - DNA, 15 bp, Homo sapiens
cagaaatagctcctc

SEQ ID NO: 5583121 - DNA, 17 bp, Homo sapiens
cagaaatagttgtctgt

SEQ ID NO: 5583122 - DNA, 21 bp, Homo sapiens
cagaaatagttgtctgtgctt

SEQ ID NO: 5583123 - DNA, 17 bp, Homo sapiens
cagaaatataaacacat

SEQ ID NO: 5583124 - DNA, 23 bp, Homo sapiens
cagaaatataaacacattaaaag

SEQ ID NO: 5583125 - DNA, 21 bp, Homo sapiens
cagaaatataataaaatgtgt

SEQ ID NO: 5583126 - DNA, 15 bp, Homo sapiens
cagaaatatagtgca

SEQ ID NO: 5583127 - DNA, 20 bp, Homo sapiens
cagaaatatcgctgatgcag

SEQ ID NO: 5583128 - DNA, 18 bp, Homo sapiens
cagaaatatgattgattt

SEQ ID NO: 5583129 - DNA, 15 bp, Homo sapiens
cagaaatatgtggtt

SEQ ID NO: 5583130 - DNA, 20 bp, Homo sapiens
cagaaatattctacacatat

SEQ ID NO: 5583131 - DNA, 16 bp, Homo sapiens
cagaaatcaaactgct

SEQ ID NO: 5583132 - DNA, 19 bp, Homo sapiens
cagaaatcactgtgaaatt

SEQ ID NO: 5583133 - DNA, 22 bp, Homo sapiens
cagaaatcactgtgaaatttca

SEQ ID NO: 5583134 - DNA, 14 bp, Homo sapiens
cagaaatcagagga

SEQ ID NO: 5583135 - DNA, 18 bp, Homo sapiens
cagaaatcagaggagaga

SEQ ID NO: 5583136 - DNA, 14 bp, Homo sapiens
cagaaatccatcta

SEQ ID NO: 5583137 - DNA, 16 bp, Homo sapiens
cagaaatcccagttca

SEQ ID NO: 5583138 - DNA, 21 bp, Homo sapiens
cagaaatcccagttcatgttg

SEQ ID NO: 5583139 - DNA, 22 bp, Homo sapiens
cagaaatcctctgttaatgtgg

SEQ ID NO: 5583140 - DNA, 15 bp, Homo sapiens
cagaaatctgaggaa

SEQ ID NO: 5583141 - DNA, 14 bp, Homo sapiens
cagaaatgaaacag

SEQ ID NO: 5583142 - DNA, 19 bp, Homo sapiens
cagaaatgacaacaaggcc

SEQ ID NO: 5583143 - DNA, 20 bp, Homo sapiens
cagaaatgagatcaggctct

SEQ ID NO: 5583144 - DNA, 18 bp, Homo sapiens
cagaaatgaggaggatgc

SEQ ID NO: 5583145 - DNA, 18 bp, Homo sapiens
cagaaatgagtgataaat

SEQ ID NO: 5583146 - DNA, 13 bp, Homo sapiens
cagaaatgctctg

SEQ ID NO: 5583147 - DNA, 18 bp, Homo sapiens
cagaaatgctgctggcca

SEQ ID NO: 5583148 - DNA, 17 bp, Homo sapiens
cagaaatgtccctttct

SEQ ID NO: 5583149 - DNA, 22 bp, Homo sapiens
cagaaatgtccctttcttctcc

SEQ ID NO: 5583150 - DNA, 11 bp, Homo sapiens
cagaaatgtct

SEQ ID NO: 5583151 - DNA, 11 bp, Homo sapiens
cagaaatgttt

SEQ ID NO: 5583152 - DNA, 14 bp, Homo sapiens
cagaaattaaaata

SEQ ID NO: 5583153 - DNA, 15 bp, Homo sapiens
cagaaattaaaatat

SEQ ID NO: 5583154 - DNA, 16 bp, Homo sapiens
cagaaattaaaatatt

SEQ ID NO: 5583155 - DNA, 13 bp, Homo sapiens
cagaaattaagat

SEQ ID NO: 5583156 - DNA, 16 bp, Homo sapiens
cagaaattattttcta

SEQ ID NO: 5583157 - DNA, 15 bp, Homo sapiens
cagaaattccagtaa

SEQ ID NO: 5583158 - DNA, 14 bp, Homo sapiens
cagaaattctgttt

SEQ ID NO: 5583159 - DNA, 19 bp, Homo sapiens
cagaaattctgtttttaaa

SEQ ID NO: 5583160 - DNA, 20 bp, Homo sapiens
cagaaattctgtttttaaaa

SEQ ID NO: 5583161 - DNA, 22 bp, Homo sapiens
cagaaattctgtttttaaaaat

SEQ ID NO: 5583162 - DNA, 13 bp, Homo sapiens
cagaaattgaaag

SEQ ID NO: 5583163 - DNA, 14 bp, Homo sapiens
cagaaattgcataa

SEQ ID NO: 5583164 - DNA, 11 bp, Homo sapiens
cagaaattgga

SEQ ID NO: 5583165 - DNA, 20 bp, Homo sapiens
cagaaattggaacagaatgt

SEQ ID NO: 5583166 - DNA, 19 bp, Homo sapiens
cagaaattggtaccttgca

SEQ ID NO: 5583167 - DNA, 13 bp, Homo sapiens
cagaaattgtata

SEQ ID NO: 5583168 - DNA, 15 bp, Homo sapiens
cagaaattgtatatt

SEQ ID NO: 5583169 - DNA, 16 bp, Homo sapiens
cagaaattgtatattg

SEQ ID NO: 5583170 - DNA, 13 bp, Homo sapiens
cagaaatttacca

SEQ ID NO: 5583171 - DNA, 22 bp, Homo sapiens
cagaaatttaccacaaaagcaa

SEQ ID NO: 5583172 - DNA, 14 bp, Homo sapiens
cagaaatttttatt

SEQ ID NO: 5583173 - DNA, 14 bp, Homo sapiens
cagaacaaaagata

SEQ ID NO: 5583174 - DNA, 19 bp, Homo sapiens
cagaacaaaagataaaact

SEQ ID NO: 5583175 - DNA, 17 bp, Homo sapiens
cagaacaaactcagatc

SEQ ID NO: 5583176 - DNA, 20 bp, Homo sapiens
cagaacaaactcagatctca

SEQ ID NO: 5583177 - DNA, 16 bp, Homo sapiens
cagaacaaatgaagac

SEQ ID NO: 5583178 - DNA, 19 bp, Homo sapiens
cagaacaaatgtgtttttc

SEQ ID NO: 5583179 - DNA, 22 bp, Homo sapiens
cagaacaaatgtgtttttctat

SEQ ID NO: 5583180 - DNA, 18 bp, Homo sapiens
cagaacacaaccttgttt

SEQ ID NO: 5583181 - DNA, 17 bp, Homo sapiens
cagaacaccaagtaaat

SEQ ID NO: 5583182 - DNA, 21 bp, Homo sapiens
cagaacaccccgctctggcag

SEQ ID NO: 5583183 - DNA, 23 bp, Homo sapiens
cagaacaccccgctctggcagta

SEQ ID NO: 5583184 - DNA, 19 bp, Homo sapiens
cagaacacggcagctgctg

SEQ ID NO: 5583185 - DNA, 13 bp, Homo sapiens
cagaacactgcag

SEQ ID NO: 5583186 - DNA, 21 bp, Homo sapiens
cagaacacttcagcctgtgca

SEQ ID NO: 5583187 - DNA, 15 bp, Homo sapiens
cagaaggggagggga

SEQ ID NO: 5583188 - DNA, 20 bp, Homo sapiens
cagaaggggaggggagacag

SEQ ID NO: 5583189 - DNA, 21 bp, Homo sapiens
cagaaggggatgggaaataaa

SEQ ID NO: 5583190 - DNA, 20 bp, Homo sapiens
cagaaggggcacgcctgccc

SEQ ID NO: 5583191 - DNA, 17 bp, Homo sapiens
cagaaggggctgcttgc

SEQ ID NO: 5583192 - DNA, 19 bp, Homo sapiens
cagaaggggctgcttgctt

SEQ ID NO: 5583193 - DNA, 16 bp, Homo sapiens
cagaagggggaacgca

SEQ ID NO: 5583194 - DNA, 17 bp, Homo sapiens
cagaagggggagaccaa

SEQ ID NO: 5583195 - DNA, 14 bp, Homo sapiens
cagaagggggccat

SEQ ID NO: 5583196 - DNA, 15 bp, Homo sapiens
cagaagggggtctct

SEQ ID NO: 5583197 - DNA, 20 bp, Homo sapiens
cagaaggggtttggtctggg

SEQ ID NO: 5583198 - DNA, 16 bp, Homo sapiens
cagaagggtagctggg

SEQ ID NO: 5583199 - DNA, 19 bp, Homo sapiens
cagaagggtagctgggcgg

SEQ ID NO: 5583200 - DNA, 17 bp, Homo sapiens
cagaagggtaggttaga

SEQ ID NO: 5583201 - DNA, 16 bp, Homo sapiens
cagaagggtttatacc

SEQ ID NO: 5583202 - DNA, 14 bp, Homo sapiens
cagaaggtaggggc

SEQ ID NO: 5583203 - DNA, 18 bp, Homo sapiens
cagaaggtaggggccgtg

SEQ ID NO: 5583204 - DNA, 21 bp, Homo sapiens
cagaaggtatcagttatatga

SEQ ID NO: 5583205 - DNA, 16 bp, Homo sapiens
cagaaggtatttttga

SEQ ID NO: 5583206 - DNA, 21 bp, Homo sapiens
cagaaggtgaactttgtgctt

SEQ ID NO: 5583207 - DNA, 16 bp, Homo sapiens
cagaaggttgtgatga

SEQ ID NO: 5583208 - DNA, 21 bp, Homo sapiens
cagaagtaaagtttatttcat

SEQ ID NO: 5583209 - DNA, 22 bp, Homo sapiens
cagaagtaaagtttatttcatg

SEQ ID NO: 5583210 - DNA, 17 bp, Homo sapiens
cagaagtaactcccact

SEQ ID NO: 5583211 - DNA, 15 bp, Homo sapiens
cagaagtaacttatt

SEQ ID NO: 5583212 - DNA, 17 bp, Homo sapiens
cagaagtaacttatttt

SEQ ID NO: 5583213 - DNA, 22 bp, Homo sapiens
cagaagtacttttctgttcatc

SEQ ID NO: 5583214 - DNA, 14 bp, Homo sapiens
cagaagtaggaagg

SEQ ID NO: 5583215 - DNA, 17 bp, Homo sapiens
cagaagtaggaaggaaa

SEQ ID NO: 5583216 - DNA, 13 bp, Homo sapiens
cagaagtagggga

SEQ ID NO: 5583217 - DNA, 22 bp, Homo sapiens
cagaagtagttttgttcatgaa

SEQ ID NO: 5583218 - DNA, 22 bp, Homo sapiens
cagaagtattcttttcaattat

SEQ ID NO: 5583219 - DNA, 19 bp, Homo sapiens
cagaagtattgtttacatt

SEQ ID NO: 5583220 - DNA, 16 bp, Homo sapiens
cagaagtcaaggctta

SEQ ID NO: 5583221 - DNA, 18 bp, Homo sapiens
cagaagtcaaggcttaga

SEQ ID NO: 5583222 - DNA, 22 bp, Homo sapiens
cagaagtcacacattacaaagt

SEQ ID NO: 5583223 - DNA, 23 bp, Homo sapiens
cagaagtcagttgcaaattttag

SEQ ID NO: 5583224 - DNA, 16 bp, Homo sapiens
cagaagtcatgaagcc

SEQ ID NO: 5583225 - DNA, 16 bp, Homo sapiens
cagaagtccagagtct

SEQ ID NO: 5583226 - DNA, 18 bp, Homo sapiens
cagaagtcctccctcctg

SEQ ID NO: 5583227 - DNA, 20 bp, Homo sapiens
cagaagtcctccctcctgca

SEQ ID NO: 5583228 - DNA, 24 bp, Homo sapiens
cagaagtcctccctcctgcaggct

SEQ ID NO: 5583229 - DNA, 12 bp, Homo sapiens
cagaagtcctgt

SEQ ID NO: 5583230 - DNA, 21 bp, Homo sapiens
cagaagtcctgtatgtctgtc

SEQ ID NO: 5583231 - DNA, 19 bp, Homo sapiens
cagaagtccttaagcagag

SEQ ID NO: 5583232 - DNA, 21 bp, Homo sapiens
cagaagtccttaagcagagga

SEQ ID NO: 5583233 - DNA, 15 bp, Homo sapiens
cagaagtctcctcaa

SEQ ID NO: 5583234 - DNA, 19 bp, Homo sapiens
cagaagtctggctttgctc

SEQ ID NO: 5583235 - DNA, 14 bp, Homo sapiens
cagaagtgaaaaag

SEQ ID NO: 5583236 - DNA, 19 bp, Homo sapiens
cagaagtgagcccccccct

SEQ ID NO: 5583237 - DNA, 17 bp, Homo sapiens
cagaagtgagctttgct

SEQ ID NO: 5583238 - DNA, 20 bp, Homo sapiens
cagaagtgaggatgagaccc

SEQ ID NO: 5583239 - DNA, 21 bp, Homo sapiens
cagaagtgaggatgagaccca

SEQ ID NO: 5583240 - DNA, 23 bp, Homo sapiens
cagaagtgaggatgagacccagc

SEQ ID NO: 5583241 - DNA, 13 bp, Homo sapiens
cagaagtgattta

SEQ ID NO: 5583242 - DNA, 24 bp, Homo sapiens
cagaagtgatttagttgtggaaag

SEQ ID NO: 5583243 - DNA, 12 bp, Homo sapiens
cagaagtgcatc

SEQ ID NO: 5583244 - DNA, 14 bp, Homo sapiens
cagaagtgcatcct

SEQ ID NO: 5583245 - DNA, 21 bp, Homo sapiens
cagaagtgcatcctgattatt

SEQ ID NO: 5583246 - DNA, 22 bp, Homo sapiens
cagaagtgcatcctgattattt

SEQ ID NO: 5583247 - DNA, 20 bp, Homo sapiens
cagaagtgcccttcctgctg

SEQ ID NO: 5583248 - DNA, 21 bp, Homo sapiens
cagaagtgcccttcctgctgc

SEQ ID NO: 5583249 - DNA, 22 bp, Homo sapiens
cagaagtgctctttgtggcagt

SEQ ID NO: 5583250 - DNA, 23 bp, Homo sapiens
cagaagtgctctttgtggcagtg

SEQ ID NO: 5583251 - DNA, 14 bp, Homo sapiens
cagaagtggaagga

SEQ ID NO: 5583252 - DNA, 17 bp, Homo sapiens
cagaagtgtttcatgca

SEQ ID NO: 5583253 - DNA, 14 bp, Homo sapiens
cagaagttactttt

SEQ ID NO: 5583254 - DNA, 16 bp, Homo sapiens
cagaagttagtttgta

SEQ ID NO: 5583255 - DNA, 18 bp, Homo sapiens
cagaagttagtttgtata

SEQ ID NO: 5583256 - DNA, 19 bp, Homo sapiens
cagaagttagtttgtatat

SEQ ID NO: 5583257 - DNA, 15 bp, Homo sapiens
cagaagttgatgtgg

SEQ ID NO: 5583258 - DNA, 14 bp, Homo sapiens
cagaagttgtgaaa

SEQ ID NO: 5583259 - DNA, 17 bp, Homo sapiens
cagaagttgtgaaacta

SEQ ID NO: 5583260 - DNA, 16 bp, Homo sapiens
cagaagttgtgctaaa

SEQ ID NO: 5583261 - DNA, 22 bp, Homo sapiens
cagaagtttaaatctttgttaa

SEQ ID NO: 5583262 - DNA, 19 bp, Homo sapiens
cagaagtttctgccgcagc

SEQ ID NO: 5583263 - DNA, 22 bp, Homo sapiens
cagaagtttctgccgcagccct

SEQ ID NO: 5583264 - DNA, 23 bp, Homo sapiens
cagaagtttgagatcagcctggg

SEQ ID NO: 5583265 - DNA, 20 bp, Homo sapiens
cagaagtttgcaaataggca

SEQ ID NO: 5583266 - DNA, 20 bp, Homo sapiens
cagaataaaagttcctctcc

SEQ ID NO: 5583267 - DNA, 16 bp, Homo sapiens
cagaataaagaacatt

SEQ ID NO: 5583268 - DNA, 13 bp, Homo sapiens
cagaataaagcaa

SEQ ID NO: 5583269 - DNA, 18 bp, Homo sapiens
cagaataaagcaattttc

SEQ ID NO: 5583270 - DNA, 20 bp, Homo sapiens
cagaataaagcaattttcct

SEQ ID NO: 5583271 - DNA, 21 bp, Homo sapiens
cagaataaagcaattttcctt

SEQ ID NO: 5583272 - DNA, 23 bp, Homo sapiens
cagaataaagcaattttccttga

SEQ ID NO: 5583273 - DNA, 14 bp, Homo sapiens
cagaataaagcagc

SEQ ID NO: 5583274 - DNA, 15 bp, Homo sapiens
cagaataaagcagcc

SEQ ID NO: 5583275 - DNA, 20 bp, Homo sapiens
cagaataaagcagcctgatt

SEQ ID NO: 5583276 - DNA, 22 bp, Homo sapiens
cagaataaatgggtaacactga

SEQ ID NO: 5583277 - DNA, 23 bp, Homo sapiens
cagaataaatgggtaacactgat

SEQ ID NO: 5583278 - DNA, 18 bp, Homo sapiens
cagaataaatgttttaca

SEQ ID NO: 5583279 - DNA, 21 bp, Homo sapiens
cagaataaatgttttacaact

SEQ ID NO: 5583280 - DNA, 16 bp, Homo sapiens
cagaataaattaatat

SEQ ID NO: 5583281 - DNA, 22 bp, Homo sapiens
cagaataaattaatattgtatt

SEQ ID NO: 5583282 - DNA, 18 bp, Homo sapiens
cagaataactacctcctc

SEQ ID NO: 5583283 - DNA, 12 bp, Homo sapiens
cagaataagtgc

SEQ ID NO: 5583284 - DNA, 15 bp, Homo sapiens
cagaataagttattg

SEQ ID NO: 5583285 - DNA, 16 bp, Homo sapiens
cagaataatggaaaca

SEQ ID NO: 5583286 - DNA, 15 bp, Homo sapiens
cagaataccttcttc

SEQ ID NO: 5583287 - DNA, 21 bp, Homo sapiens
cagaataccttcttcgctgct

SEQ ID NO: 5583288 - DNA, 23 bp, Homo sapiens
cagaataccttcttcgctgctag

SEQ ID NO: 5583289 - DNA, 24 bp, Homo sapiens
cagaatactgcttgcttacaatct

SEQ ID NO: 5583290 - DNA, 17 bp, Homo sapiens
cagaatactgggttctt

SEQ ID NO: 5583291 - DNA, 16 bp, Homo sapiens
cagaatagataaattt

SEQ ID NO: 5583292 - DNA, 18 bp, Homo sapiens
cagaatagataaattttg

SEQ ID NO: 5583293 - DNA, 22 bp, Homo sapiens
cagaatagccacatttggaata

SEQ ID NO: 5583294 - DNA, 21 bp, Homo sapiens
cagaatagcttccaataaagc

SEQ ID NO: 5583295 - DNA, 14 bp, Homo sapiens
cagaataggaaaac

SEQ ID NO: 5583296 - DNA, 15 bp, Homo sapiens
cagaataggaagata

SEQ ID NO: 5583297 - DNA, 14 bp, Homo sapiens
cagaatagtatttt

SEQ ID NO: 5583298 - DNA, 18 bp, Homo sapiens
cagaatagtttacacact

SEQ ID NO: 5583299 - DNA, 21 bp, Homo sapiens
cagaatatacacattttgtaa

SEQ ID NO: 5583300 - DNA, 24 bp, Homo sapiens
cagaatatacacattttgtaaatc

SEQ ID NO: 5583301 - DNA, 15 bp, Homo sapiens
cagaatatctgggat

SEQ ID NO: 5583302 - DNA, 15 bp, Homo sapiens
cagaatatgacaatc

SEQ ID NO: 5583303 - DNA, 23 bp, Homo sapiens
cagaatatgattcactatttaaa

SEQ ID NO: 5583304 - DNA, 13 bp, Homo sapiens
cagaatatgtttc

SEQ ID NO: 5583305 - DNA, 16 bp, Homo sapiens
cagaatattaaatatt

SEQ ID NO: 5583306 - DNA, 19 bp, Homo sapiens
cagaatattaaatattata

SEQ ID NO: 5583307 - DNA, 14 bp, Homo sapiens
cagaatattaaatt

SEQ ID NO: 5583308 - DNA, 16 bp, Homo sapiens
cagaatattaagcaca

SEQ ID NO: 5583309 - DNA, 13 bp, Homo sapiens
cagaatattgctt

SEQ ID NO: 5583310 - DNA, 17 bp, Homo sapiens
cagaatatttctattga

SEQ ID NO: 5583311 - DNA, 15 bp, Homo sapiens
cagaatattttgtaa

SEQ ID NO: 5583312 - DNA, 21 bp, Homo sapiens
cagaatatttttatatttcct

SEQ ID NO: 5583313 - DNA, 23 bp, Homo sapiens
cagaatatttttatatttccttt

SEQ ID NO: 5583314 - DNA, 22 bp, Homo sapiens
cagaatcaaacctttttatatt

SEQ ID NO: 5583315 - DNA, 13 bp, Homo sapiens
cagaatcaaagca

SEQ ID NO: 5583316 - DNA, 20 bp, Homo sapiens
cagaatcaaagcaatgcatt

SEQ ID NO: 5583317 - DNA, 19 bp, Homo sapiens
cagaatcagaatcatggag

SEQ ID NO: 5583318 - DNA, 21 bp, Homo sapiens
cagaatcagaatcatggagaa

SEQ ID NO: 5583319 - DNA, 18 bp, Homo sapiens
cagaatcagcacagataa

SEQ ID NO: 5583320 - DNA, 22 bp, Homo sapiens
cagaatcagtgttaaattcatt

SEQ ID NO: 5583321 - DNA, 15 bp, Homo sapiens
cagaatcataatttt

SEQ ID NO: 5583322 - DNA, 19 bp, Homo sapiens
cagaatcatatgattctgc

SEQ ID NO: 5583323 - DNA, 21 bp, Homo sapiens
cagaatcatgctgttctcttt

SEQ ID NO: 5583324 - DNA, 16 bp, Homo sapiens
cagaatcatggagaaa

SEQ ID NO: 5583325 - DNA, 21 bp, Homo sapiens
cagaatccacaaagccgtgcc

SEQ ID NO: 5583326 - DNA, 18 bp, Homo sapiens
cagaatccataaatgtgt

SEQ ID NO: 5583327 - DNA, 15 bp, Homo sapiens
cagaatcccctgggg

SEQ ID NO: 5583328 - DNA, 14 bp, Homo sapiens
cagaatcctcagtt

SEQ ID NO: 5583329 - DNA, 16 bp, Homo sapiens
cagaatctaaacgtgg

SEQ ID NO: 5583330 - DNA, 20 bp, Homo sapiens
cagaatctaaacgtggtcac

SEQ ID NO: 5583331 - DNA, 22 bp, Homo sapiens
cagaatctaaacgtggtcacct

SEQ ID NO: 5583332 - DNA, 17 bp, Homo sapiens
cagaatctaaagccagt

SEQ ID NO: 5583333 - DNA, 17 bp, Homo sapiens
cagaatctcaaataact

SEQ ID NO: 5583334 - DNA, 13 bp, Homo sapiens
cagaatctctgag

SEQ ID NO: 5583335 - DNA, 14 bp, Homo sapiens
cagaatctctgagc

SEQ ID NO: 5583336 - DNA, 17 bp, Homo sapiens
cagaatctctgagccaa

SEQ ID NO: 5583337 - DNA, 21 bp, Homo sapiens
cagaatctgctgttgccatag

SEQ ID NO: 5583338 - DNA, 22 bp, Homo sapiens
cagaatctgttgagttgctgcc

SEQ ID NO: 5583339 - DNA, 13 bp, Homo sapiens
cagaatcttctgg

SEQ ID NO: 5583340 - DNA, 14 bp, Homo sapiens
cagaatcttctggg

SEQ ID NO: 5583341 - DNA, 17 bp, Homo sapiens
cagaatcttgactttct

SEQ ID NO: 5583342 - DNA, 13 bp, Homo sapiens
cagaatcttgtat

SEQ ID NO: 5583343 - DNA, 16 bp, Homo sapiens
cagaatcttgtatttg

SEQ ID NO: 5583344 - DNA, 14 bp, Homo sapiens
cagaatctttgcaa

SEQ ID NO: 5583345 - DNA, 16 bp, Homo sapiens
cagaatctttgttaag

SEQ ID NO: 5583346 - DNA, 12 bp, Homo sapiens
cagaatgaaaaa

SEQ ID NO: 5583347 - DNA, 21 bp, Homo sapiens
cagaatgaaaaatgaaagatg

SEQ ID NO: 5583348 - DNA, 19 bp, Homo sapiens
cagaatgaaaactgtaaat

SEQ ID NO: 5583349 - DNA, 18 bp, Homo sapiens
cagaatgaacccataggg

SEQ ID NO: 5583350 - DNA, 21 bp, Homo sapiens
cagaatgaaccctcctccttt

SEQ ID NO: 5583351 - DNA, 18 bp, Homo sapiens
cagaatgaagacctaaat

SEQ ID NO: 5583352 - DNA, 12 bp, Homo sapiens
cagaatgaatct

SEQ ID NO: 5583353 - DNA, 11 bp, Homo sapiens
cagaatgaatt

SEQ ID NO: 5583354 - DNA, 14 bp, Homo sapiens
cagaatgaattcga

SEQ ID NO: 5583355 - DNA, 15 bp, Homo sapiens
cagaatgaccttgag

SEQ ID NO: 5583356 - DNA, 19 bp, Homo sapiens
cagaatgactctggaacca

SEQ ID NO: 5583357 - DNA, 23 bp, Homo sapiens
cagaatgacttttattgagctct

SEQ ID NO: 5583358 - DNA, 16 bp, Homo sapiens
cagaatgagatgattt

SEQ ID NO: 5583359 - DNA, 20 bp, Homo sapiens
cagaatgagatgatttaatt

SEQ ID NO: 5583360 - DNA, 15 bp, Homo sapiens
cagaatgaggctgct

SEQ ID NO: 5583361 - DNA, 20 bp, Homo sapiens
cagaatgcagttgttgtaca

SEQ ID NO: 5583362 - DNA, 14 bp, Homo sapiens
cagaatgcattaaa

SEQ ID NO: 5583363 - DNA, 13 bp, Homo sapiens
cagactccaatgg

SEQ ID NO: 5583364 - DNA, 14 bp, Homo sapiens
cagactccaatggg

SEQ ID NO: 5583365 - DNA, 20 bp, Homo sapiens
cagactccaatggggccagc

SEQ ID NO: 5583366 - DNA, 23 bp, Homo sapiens
cagactccaatggggccagcact

SEQ ID NO: 5583367 - DNA, 14 bp, Homo sapiens
cagactccagcccc

SEQ ID NO: 5583368 - DNA, 16 bp, Homo sapiens
cagactccagcccctg

SEQ ID NO: 5583369 - DNA, 16 bp, Homo sapiens
cagactccaggccccc

SEQ ID NO: 5583370 - DNA, 15 bp, Homo sapiens
cagactccatctctt

SEQ ID NO: 5583371 - DNA, 17 bp, Homo sapiens
cagactcccattcctga

SEQ ID NO: 5583372 - DNA, 20 bp, Homo sapiens
cagactcccattcctgaaga

SEQ ID NO: 5583373 - DNA, 17 bp, Homo sapiens
cagactccctcccctgc

SEQ ID NO: 5583374 - DNA, 18 bp, Homo sapiens
cagactccctcccctgcc

SEQ ID NO: 5583375 - DNA, 14 bp, Homo sapiens
cagactcccttgct

SEQ ID NO: 5583376 - DNA, 18 bp, Homo sapiens
cagactccgcctgaggcc

SEQ ID NO: 5583377 - DNA, 16 bp, Homo sapiens
cagactccggcctgta

SEQ ID NO: 5583378 - DNA, 20 bp, Homo sapiens
cagactccggcctgtaatca

SEQ ID NO: 5583379 - DNA, 14 bp, Homo sapiens
cagactcctcagat

SEQ ID NO: 5583380 - DNA, 14 bp, Homo sapiens
cagactcctgagga

SEQ ID NO: 5583381 - DNA, 21 bp, Homo sapiens
cagactcctgaggacagctgt

SEQ ID NO: 5583382 - DNA, 13 bp, Homo sapiens
cagactcctgagt

SEQ ID NO: 5583383 - DNA, 15 bp, Homo sapiens
cagactcctggcttc

SEQ ID NO: 5583384 - DNA, 21 bp, Homo sapiens
cagactcgagagggctgagcc

SEQ ID NO: 5583385 - DNA, 17 bp, Homo sapiens
cagactcgctagcactc

SEQ ID NO: 5583386 - DNA, 19 bp, Homo sapiens
cagactctaaatatttcat

SEQ ID NO: 5583387 - DNA, 17 bp, Homo sapiens
cagactctaagaaagaa

SEQ ID NO: 5583388 - DNA, 18 bp, Homo sapiens
cagactctacagaggcca

SEQ ID NO: 5583389 - DNA, 20 bp, Homo sapiens
cagactctacagaggccatg

SEQ ID NO: 5583390 - DNA, 18 bp, Homo sapiens
cagactctaggttataca

SEQ ID NO: 5583391 - DNA, 15 bp, Homo sapiens
cagactctcagccca

SEQ ID NO: 5583392 - DNA, 19 bp, Homo sapiens
cagactctcagcccagaag

SEQ ID NO: 5583393 - DNA, 21 bp, Homo sapiens
cagactctcagcccagaagaa

SEQ ID NO: 5583394 - DNA, 13 bp, Homo sapiens
cagactctcaggt

SEQ ID NO: 5583395 - DNA, 23 bp, Homo sapiens
cagactctctcctctctctccct

SEQ ID NO: 5583396 - DNA, 14 bp, Homo sapiens
cagactctgagctg

SEQ ID NO: 5583397 - DNA, 20 bp, Homo sapiens
cagactctgcctagaaacag

SEQ ID NO: 5583398 - DNA, 12 bp, Homo sapiens
cagactctgtga

SEQ ID NO: 5583399 - DNA, 19 bp, Homo sapiens
cagactcttacgtggagag

SEQ ID NO: 5583400 - DNA, 13 bp, Homo sapiens
cagactcttccac

SEQ ID NO: 5583401 - DNA, 20 bp, Homo sapiens
cagactcttccaccagagca

SEQ ID NO: 5583402 - DNA, 22 bp, Homo sapiens
cagactcttccaccagagcagg

SEQ ID NO: 5583403 - DNA, 13 bp, Homo sapiens
cagactcttgcct

SEQ ID NO: 5583404 - DNA, 18 bp, Homo sapiens
cagactcttgcctgtttc

SEQ ID NO: 5583405 - DNA, 18 bp, Homo sapiens
cagactctttaataaatt

SEQ ID NO: 5583406 - DNA, 19 bp, Homo sapiens
cagactctttaataaattg

SEQ ID NO: 5583407 - DNA, 20 bp, Homo sapiens
cagactctttttttgagtga

SEQ ID NO: 5583408 - DNA, 22 bp, Homo sapiens
cagactctttttttgagtgaca

SEQ ID NO: 5583409 - DNA, 11 bp, Homo sapiens
cagactgaaag

SEQ ID NO: 5583410 - DNA, 20 bp, Homo sapiens
cagactgaaaggtgtgaaca

SEQ ID NO: 5583411 - DNA, 21 bp, Homo sapiens
cagactgacccccatctgagc

SEQ ID NO: 5583412 - DNA, 22 bp, Homo sapiens
cagactgacccccatctgagct

SEQ ID NO: 5583413 - DNA, 23 bp, Homo sapiens
cagactgacccccatctgagctg

SEQ ID NO: 5583414 - DNA, 17 bp, Homo sapiens
cagactgagctctccag

SEQ ID NO: 5583415 - DNA, 18 bp, Homo sapiens
cagactgagctctccagg

SEQ ID NO: 5583416 - DNA, 15 bp, Homo sapiens
cagactgatgagcac

SEQ ID NO: 5583417 - DNA, 22 bp, Homo sapiens
cagactgatgagcacatctctc

SEQ ID NO: 5583418 - DNA, 13 bp, Homo sapiens
cagactgcaatat

SEQ ID NO: 5583419 - DNA, 13 bp, Homo sapiens
cagactgcaccca

SEQ ID NO: 5583420 - DNA, 14 bp, Homo sapiens
cagactgcacccag

SEQ ID NO: 5583421 - DNA, 16 bp, Homo sapiens
cagactgcacccagga

SEQ ID NO: 5583422 - DNA, 19 bp, Homo sapiens
cagactgcacccaggaggg

SEQ ID NO: 5583423 - DNA, 14 bp, Homo sapiens
cagactgccaaaga

SEQ ID NO: 5583424 - DNA, 18 bp, Homo sapiens
cagactgcctgtctgctt

SEQ ID NO: 5583425 - DNA, 20 bp, Homo sapiens
cagactgcctgtctgcttgc

SEQ ID NO: 5583426 - DNA, 18 bp, Homo sapiens
cagactgcggagcagcct

SEQ ID NO: 5583427 - DNA, 22 bp, Homo sapiens
cagactgctagtgttctgtcta

SEQ ID NO: 5583428 - DNA, 13 bp, Homo sapiens
cagactgctggga

SEQ ID NO: 5583429 - DNA, 20 bp, Homo sapiens
cagactgctgggactggcca

SEQ ID NO: 5583430 - DNA, 23 bp, Homo sapiens
cagactgctgggactggccaggt

SEQ ID NO: 5583431 - DNA, 16 bp, Homo sapiens
cagactgcttggccag

SEQ ID NO: 5583432 - DNA, 17 bp, Homo sapiens
cagactgcttggccaga

SEQ ID NO: 5583433 - DNA, 19 bp, Homo sapiens
cagactgcttggccagatg

SEQ ID NO: 5583434 - DNA, 20 bp, Homo sapiens
cagactgcttggccagatgc

SEQ ID NO: 5583435 - DNA, 23 bp, Homo sapiens
cagactggaaaagtgatgtattt

SEQ ID NO: 5583436 - DNA, 22 bp, Homo sapiens
cagactggaagacacttcagat

SEQ ID NO: 5583437 - DNA, 14 bp, Homo sapiens
cagactggaagcac

SEQ ID NO: 5583438 - DNA, 20 bp, Homo sapiens
cagactggaagcacagcttc

SEQ ID NO: 5583439 - DNA, 16 bp, Homo sapiens
cagactggaatagtgg

SEQ ID NO: 5583440 - DNA, 21 bp, Homo sapiens
cagactggaggtcgaagcaat

SEQ ID NO: 5583441 - DNA, 22 bp, Homo sapiens
cagactggatggaaacttcctg

SEQ ID NO: 5583442 - DNA, 15 bp, Homo sapiens
cagactggcaataaa

SEQ ID NO: 5583443 - DNA, 15 bp, Homo sapiens
cagactggccgggca

SEQ ID NO: 5583444 - DNA, 21 bp, Homo sapiens
cagactggcctgaggagcagc

SEQ ID NO: 5583445 - DNA, 18 bp, Homo sapiens
cagactggcggagaagga

SEQ ID NO: 5583446 - DNA, 16 bp, Homo sapiens
cagactgggcccaggc

SEQ ID NO: 5583447 - DNA, 18 bp, Homo sapiens
cagactgggcccaggcag

SEQ ID NO: 5583448 - DNA, 19 bp, Homo sapiens
cagactgggcccaggcagg

SEQ ID NO: 5583449 - DNA, 24 bp, Homo sapiens
cagactgggcccaggcaggtctgc

SEQ ID NO: 5583450 - DNA, 16 bp, Homo sapiens
cagactggggcatcct

SEQ ID NO: 5583451 - DNA, 21 bp, Homo sapiens
cagactggggcatcctgtgcc

SEQ ID NO: 5583452 - DNA, 20 bp, Homo sapiens
cagactggtgagcagactgg

SEQ ID NO: 5583453 - DNA, 19 bp, Homo sapiens
cagactggtgttaatgagt

SEQ ID NO: 5583454 - DNA, 16 bp, Homo sapiens
cagactgtaagatgtt

SEQ ID NO: 5583455 - DNA, 17 bp, Homo sapiens
cagactgtaagatgttg

SEQ ID NO: 5583456 - DNA, 13 bp, Homo sapiens
cagactgtagaga

SEQ ID NO: 5583457 - DNA, 22 bp, Homo sapiens
cagactgtagcttctcttgctc

SEQ ID NO: 5583458 - DNA, 16 bp, Homo sapiens
cagactgtccagggaa

SEQ ID NO: 5583459 - DNA, 18 bp, Homo sapiens
cagactgtgcaatactta

SEQ ID NO: 5583460 - DNA, 22 bp, Homo sapiens
cagactgtggctgcagagacct

SEQ ID NO: 5583461 - DNA, 11 bp, Homo sapiens
cagactgtggt

SEQ ID NO: 5583462 - DNA, 14 bp, Homo sapiens
cagactgtgtaaaa

SEQ ID NO: 5583463 - DNA, 21 bp, Homo sapiens
cagactgtgtaaaaagagagc

SEQ ID NO: 5583464 - DNA, 14 bp, Homo sapiens
cagactgtgtattc

SEQ ID NO: 5583465 - DNA, 24 bp, Homo sapiens
cagactgttagaaaatggacactg

SEQ ID NO: 5583466 - DNA, 18 bp, Homo sapiens
cagactgttccctccaag

SEQ ID NO: 5583467 - DNA, 16 bp, Homo sapiens
cagactgttgtccctg

SEQ ID NO: 5583468 - DNA, 20 bp, Homo sapiens
cagactgttttactgtttta

SEQ ID NO: 5583469 - DNA, 18 bp, Homo sapiens
cagacttaaacttcctta

SEQ ID NO: 5583470 - DNA, 18 bp, Homo sapiens
cagacttaacagacccag

SEQ ID NO: 5583471 - DNA, 18 bp, Homo sapiens
cagacttagtttttataa

SEQ ID NO: 5583472 - DNA, 17 bp, Homo sapiens
cagacttcaaaaggaat

SEQ ID NO: 5583473 - DNA, 14 bp, Homo sapiens
cagacttcaagatc

SEQ ID NO: 5583474 - DNA, 15 bp, Homo sapiens
cagacttcacactgc

SEQ ID NO: 5583475 - DNA, 17 bp, Homo sapiens
cagacttcacagcgtct

SEQ ID NO: 5583476 - DNA, 12 bp, Homo sapiens
cagacttcccac

SEQ ID NO: 5583477 - DNA, 22 bp, Homo sapiens
cagacttcccacggctcctcga

SEQ ID NO: 5583478 - DNA, 24 bp, Homo sapiens
cagacttccttgagacacggagcc

SEQ ID NO: 5583479 - DNA, 19 bp, Homo sapiens
cagacttcgctattcccag

SEQ ID NO: 5583480 - DNA, 24 bp, Homo sapiens
cagacttcgctattcccaggcagg

SEQ ID NO: 5583481 - DNA, 14 bp, Homo sapiens
cagacttctccaga

SEQ ID NO: 5583482 - DNA, 15 bp, Homo sapiens
cagacttctggaagg

SEQ ID NO: 5583483 - DNA, 19 bp, Homo sapiens
cagacttctggaaggctgg

SEQ ID NO: 5583484 - DNA, 21 bp, Homo sapiens
cagacttctggaaggctggct

SEQ ID NO: 5583485 - DNA, 15 bp, Homo sapiens
cagacttctggccta

SEQ ID NO: 5583486 - DNA, 15 bp, Homo sapiens
cagacttgcactgaa

SEQ ID NO: 5583487 - DNA, 16 bp, Homo sapiens
cagacttgcactgaag

SEQ ID NO: 5583488 - DNA, 20 bp, Homo sapiens
cagacttgccatgtgactct

SEQ ID NO: 5583489 - DNA, 18 bp, Homo sapiens
cagacttgcccaggtcac

SEQ ID NO: 5583490 - DNA, 20 bp, Homo sapiens
cagacttgcggccacagcac

SEQ ID NO: 5583491 - DNA, 24 bp, Homo sapiens
cagacttggcctccagctgttctt

SEQ ID NO: 5583492 - DNA, 23 bp, Homo sapiens
cagacttgggagctttaaagagc

SEQ ID NO: 5583493 - DNA, 11 bp, Homo sapiens
cagacttgttg

SEQ ID NO: 5583494 - DNA, 13 bp, Homo sapiens
cagacttgtttcc

SEQ ID NO: 5583495 - DNA, 15 bp, Homo sapiens
cagacttgtttcctg

SEQ ID NO: 5583496 - DNA, 20 bp, Homo sapiens
cagacttgtttcctgtgccc

SEQ ID NO: 5583497 - DNA, 17 bp, Homo sapiens
cagactttcccaaatgt

SEQ ID NO: 5583498 - DNA, 18 bp, Homo sapiens
cagactttcccaaatgta

SEQ ID NO: 5583499 - DNA, 22 bp, Homo sapiens
cagactttcccaaatgtattga

SEQ ID NO: 5583500 - DNA, 19 bp, Homo sapiens
cagactttctacacctgtt

SEQ ID NO: 5583501 - DNA, 17 bp, Homo sapiens
cagactttgagcctgca

SEQ ID NO: 5583502 - DNA, 18 bp, Homo sapiens
cagactttgctgcatttt

SEQ ID NO: 5583503 - DNA, 21 bp, Homo sapiens
cagactttgctgcattttaca

SEQ ID NO: 5583504 - DNA, 20 bp, Homo sapiens
cagactttgcttcccattgt

SEQ ID NO: 5583505 - DNA, 20 bp, Homo sapiens
cagactttgtgttcatttca

SEQ ID NO: 5583506 - DNA, 22 bp, Homo sapiens
cagactttgtgttcatttcatt

SEQ ID NO: 5583507 - DNA, 19 bp, Homo sapiens
cagacttttaaagacttgc

SEQ ID NO: 5583508 - DNA, 15 bp, Homo sapiens
cagacttttcagaag

SEQ ID NO: 5583509 - DNA, 16 bp, Homo sapiens
cagacttttcagaaga

SEQ ID NO: 5583510 - DNA, 17 bp, Homo sapiens
cagacttttggccccag

SEQ ID NO: 5583511 - DNA, 21 bp, Homo sapiens
cagactttttaaattcctgct

SEQ ID NO: 5583512 - DNA, 21 bp, Homo sapiens
cagacttttttaaacatcaaa

SEQ ID NO: 5583513 - DNA, 15 bp, Homo sapiens
cagagaaaacacttt

SEQ ID NO: 5583514 - DNA, 16 bp, Homo sapiens
cagagaaaacactttc

SEQ ID NO: 5583515 - DNA, 18 bp, Homo sapiens
cagagaaaacccggagca

SEQ ID NO: 5583516 - DNA, 15 bp, Homo sapiens
cagagaaaagcaggc

SEQ ID NO: 5583517 - DNA, 13 bp, Homo sapiens
cagagaaaatgaa

SEQ ID NO: 5583518 - DNA, 15 bp, Homo sapiens
cagagaaaatgaatt

SEQ ID NO: 5583519 - DNA, 16 bp, Homo sapiens
cagagaaaatgaattt

SEQ ID NO: 5583520 - DNA, 17 bp, Homo sapiens
cagagaaaatgaatttg

SEQ ID NO: 5583521 - DNA, 21 bp, Homo sapiens
cagagaaaatgaattttttcc

SEQ ID NO: 5583522 - DNA, 19 bp, Homo sapiens
cagagaaaatgagaaagga

SEQ ID NO: 5583523 - DNA, 24 bp, Homo sapiens
cagagaaaatgagaaaggacagag

SEQ ID NO: 5583524 - DNA, 15 bp, Homo sapiens
cagagaaacagacag

SEQ ID NO: 5583525 - DNA, 14 bp, Homo sapiens
cagagaaaccagct

SEQ ID NO: 5583526 - DNA, 16 bp, Homo sapiens
cagagaaaccagcttc

SEQ ID NO: 5583527 - DNA, 19 bp, Homo sapiens
cagagaaaccagcttcctt

SEQ ID NO: 5583528 - DNA, 16 bp, Homo sapiens
cagagaaacccaggga

SEQ ID NO: 5583529 - DNA, 19 bp, Homo sapiens
cagagaaactaacttggtg

SEQ ID NO: 5583530 - DNA, 15 bp, Homo sapiens
cagagaaagaaaagg

SEQ ID NO: 5583531 - DNA, 22 bp, Homo sapiens
cagagaaagaagagacaggagg

SEQ ID NO: 5583532 - DNA, 23 bp, Homo sapiens
cagagaaagaagagacaggaggg

SEQ ID NO: 5583533 - DNA, 11 bp, Homo sapiens
cagagaaagca

SEQ ID NO: 5583534 - DNA, 22 bp, Homo sapiens
cagagaaagcaaaggtgcactc

SEQ ID NO: 5583535 - DNA, 13 bp, Homo sapiens
cagagaaagcgca

SEQ ID NO: 5583536 - DNA, 16 bp, Homo sapiens
cagagaaagcgcagat

SEQ ID NO: 5583537 - DNA, 17 bp, Homo sapiens
cagagaaagcgcagatg

SEQ ID NO: 5583538 - DNA, 23 bp, Homo sapiens
cagagaaagtacttctccaccct

SEQ ID NO: 5583539 - DNA, 12 bp, Homo sapiens
cagagagcatta

SEQ ID NO: 5583540 - DNA, 18 bp, Homo sapiens
cagagagccattttgtga

SEQ ID NO: 5583541 - DNA, 21 bp, Homo sapiens
cagagagccattttgtgaatg

SEQ ID NO: 5583542 - DNA, 23 bp, Homo sapiens
cagagagccattttgtgaatgga

SEQ ID NO: 5583543 - DNA, 19 bp, Homo sapiens
cagagagcctggtgctgct

SEQ ID NO: 5583544 - DNA, 21 bp, Homo sapiens
cagagagcgaccagcaggctc

SEQ ID NO: 5583545 - DNA, 22 bp, Homo sapiens
cagagagcggtctcaggctggt

SEQ ID NO: 5583546 - DNA, 23 bp, Homo sapiens
cagagagctgaagtactgcaccc

SEQ ID NO: 5583547 - DNA, 19 bp, Homo sapiens
cagagagctggtagttagt

SEQ ID NO: 5583548 - DNA, 17 bp, Homo sapiens
cagagagcttaaattgt

SEQ ID NO: 5583549 - DNA, 19 bp, Homo sapiens
cagagaggaaattctccac

SEQ ID NO: 5583550 - DNA, 11 bp, Homo sapiens
cagagaggaag

SEQ ID NO: 5583551 - DNA, 13 bp, Homo sapiens
cagagaggaatca

SEQ ID NO: 5583552 - DNA, 13 bp, Homo sapiens
cagagaggacaaa

SEQ ID NO: 5583553 - DNA, 20 bp, Homo sapiens
cagagaggacaaaataaagt

SEQ ID NO: 5583554 - DNA, 17 bp, Homo sapiens
cagagaggaccaacatc

SEQ ID NO: 5583555 - DNA, 18 bp, Homo sapiens
cagagaggactgtaggga

SEQ ID NO: 5583556 - DNA, 17 bp, Homo sapiens
cagagaggagaaacaca

SEQ ID NO: 5583557 - DNA, 18 bp, Homo sapiens
cagagaggagaaacacat

SEQ ID NO: 5583558 - DNA, 20 bp, Homo sapiens
cagagaggagtcagagagaa

SEQ ID NO: 5583559 - DNA, 16 bp, Homo sapiens
cagagaggatacattt

SEQ ID NO: 5583560 - DNA, 13 bp, Homo sapiens
cagagaggcaagg

SEQ ID NO: 5583561 - DNA, 18 bp, Homo sapiens
cagagaggccaggtgcag

SEQ ID NO: 5583562 - DNA, 13 bp, Homo sapiens
cagagaggccttt

SEQ ID NO: 5583563 - DNA, 17 bp, Homo sapiens
cagagaggctggatgac

SEQ ID NO: 5583564 - DNA, 15 bp, Homo sapiens
cagagaggctgtggt

SEQ ID NO: 5583565 - DNA, 16 bp, Homo sapiens
cagagaggctgtggtt

SEQ ID NO: 5583566 - DNA, 16 bp, Homo sapiens
cagagagggaaaaggc

SEQ ID NO: 5583567 - DNA, 20 bp, Homo sapiens
cagagagggaagctgaggcc

SEQ ID NO: 5583568 - DNA, 22 bp, Homo sapiens
cagagagggaagctgaggccca

SEQ ID NO: 5583569 - DNA, 21 bp, Homo sapiens
cagagagggatgggttcctgc

SEQ ID NO: 5583570 - DNA, 20 bp, Homo sapiens
cagagagggcccagctgtag

SEQ ID NO: 5583571 - DNA, 17 bp, Homo sapiens
cagagaggggacatttc

SEQ ID NO: 5583572 - DNA, 20 bp, Homo sapiens
cagagaggggaggtgggagg

SEQ ID NO: 5583573 - DNA, 13 bp, Homo sapiens
cagagaggggcag

SEQ ID NO: 5583574 - DNA, 17 bp, Homo sapiens
cagagaggggctgctct

SEQ ID NO: 5583575 - DNA, 20 bp, Homo sapiens
cagagagggggccacctccc

SEQ ID NO: 5583576 - DNA, 22 bp, Homo sapiens
cagagagggggccacctcccca

SEQ ID NO: 5583577 - DNA, 20 bp, Homo sapiens
cagagagggtgggagtgggc

SEQ ID NO: 5583578 - DNA, 23 bp, Homo sapiens
cagagagggtggtgacctctgcc

SEQ ID NO: 5583579 - DNA, 20 bp, Homo sapiens
cagagaggtagcactctcag

SEQ ID NO: 5583580 - DNA, 21 bp, Homo sapiens
cagagaggtggatcctgtagg

SEQ ID NO: 5583581 - DNA, 20 bp, Homo sapiens
cagagaggtttgcagtccca

SEQ ID NO: 5583582 - DNA, 22 bp, Homo sapiens
cagagagtaagcacttaaaaaa

SEQ ID NO: 5583583 - DNA, 21 bp, Homo sapiens
cagagagtacactgtgtctct

SEQ ID NO: 5583584 - DNA, 19 bp, Homo sapiens
cagagagtacagactgcag

SEQ ID NO: 5583585 - DNA, 18 bp, Homo sapiens
cagagagtcccactgcct

SEQ ID NO: 5583586 - DNA, 22 bp, Homo sapiens
cagagagtcccactgcctcagg

SEQ ID NO: 5583587 - DNA, 14 bp, Homo sapiens
cagagagtcctctg

SEQ ID NO: 5583588 - DNA, 16 bp, Homo sapiens
cagagagtcctttggg

SEQ ID NO: 5583589 - DNA, 13 bp, Homo sapiens
cagagagtggctc

SEQ ID NO: 5583590 - DNA, 13 bp, Homo sapiens
cagagagttctgg

SEQ ID NO: 5583591 - DNA, 17 bp, Homo sapiens
cagagagttctggtgag

SEQ ID NO: 5583592 - DNA, 23 bp, Homo sapiens
cagagataaagcttaggtcaaag

SEQ ID NO: 5583593 - DNA, 19 bp, Homo sapiens
cagagataaataaaagata

SEQ ID NO: 5583594 - DNA, 13 bp, Homo sapiens
cagagatataaat

SEQ ID NO: 5583595 - DNA, 16 bp, Homo sapiens
cagagatataaatgaa

SEQ ID NO: 5583596 - DNA, 19 bp, Homo sapiens
cagagatatacaaatatat

SEQ ID NO: 5583597 - DNA, 17 bp, Homo sapiens
cagagatatctatgaaa

SEQ ID NO: 5583598 - DNA, 17 bp, Homo sapiens
cagagatcaggatcagc

SEQ ID NO: 5583599 - DNA, 19 bp, Homo sapiens
cagagatccaaaagaagcc

SEQ ID NO: 5583600 - DNA, 22 bp, Homo sapiens
cagagatccattgccatcagtg

SEQ ID NO: 5583601 - DNA, 20 bp, Homo sapiens
cagagatcgacagacagcca

SEQ ID NO: 5583602 - DNA, 14 bp, Homo sapiens
cagagatctccctt

SEQ ID NO: 5583603 - DNA, 23 bp, Homo sapiens
cagagatcttggtatgggctgtt

SEQ ID NO: 5583604 - DNA, 21 bp, Homo sapiens
cagagatgatcagtccaactg

SEQ ID NO: 5583605 - DNA, 13 bp, Homo sapiens
cagagatgccagc

SEQ ID NO: 5583606 - DNA, 14 bp, Homo sapiens
cagagatgccagcc

SEQ ID NO: 5583607 - DNA, 17 bp, Homo sapiens
cagagatgccagccctt

SEQ ID NO: 5583608 - DNA, 15 bp, Homo sapiens
cagagatgcctccac

SEQ ID NO: 5583609 - DNA, 19 bp, Homo sapiens
cagagatgcctccaccgct

SEQ ID NO: 5583610 - DNA, 21 bp, Homo sapiens
cagagatgcctccaccgctgc

SEQ ID NO: 5583611 - DNA, 14 bp, Homo sapiens
cagagatgcctccc

SEQ ID NO: 5583612 - DNA, 16 bp, Homo sapiens
cagagatgcctccctg

SEQ ID NO: 5583613 - DNA, 23 bp, Homo sapiens
cagagatgcctccctgagctaga

SEQ ID NO: 5583614 - DNA, 17 bp, Homo sapiens
cagagatgcctgatttc

SEQ ID NO: 5583615 - DNA, 20 bp, Homo sapiens
cagagatgcctgatttcatt

SEQ ID NO: 5583616 - DNA, 12 bp, Homo sapiens
cagagatggaca

SEQ ID NO: 5583617 - DNA, 15 bp, Homo sapiens
cagagatggacagag

SEQ ID NO: 5583618 - DNA, 23 bp, Homo sapiens
cagagatggaggttctctcggag

SEQ ID NO: 5583619 - DNA, 13 bp, Homo sapiens
cagagatggcaga

SEQ ID NO: 5583620 - DNA, 15 bp, Homo sapiens
cagagatggcagagc

SEQ ID NO: 5583621 - DNA, 14 bp, Homo sapiens
cagagatggctcct

SEQ ID NO: 5583622 - DNA, 18 bp, Homo sapiens
cagagatggctccttggg

SEQ ID NO: 5583623 - DNA, 20 bp, Homo sapiens
cagagatggtcatatttaaa

SEQ ID NO: 5583624 - DNA, 13 bp, Homo sapiens
cagagatgtactg

SEQ ID NO: 5583625 - DNA, 22 bp, Homo sapiens
cagagatgtccatttttacaag

SEQ ID NO: 5583626 - DNA, 14 bp, Homo sapiens
cagagatgtgcacc

SEQ ID NO: 5583627 - DNA, 17 bp, Homo sapiens
cagagatgtgcccccac

SEQ ID NO: 5583628 - DNA, 14 bp, Homo sapiens
cagagattaaaaaa

SEQ ID NO: 5583629 - DNA, 15 bp, Homo sapiens
cagagattaaaaaag

SEQ ID NO: 5583630 - DNA, 13 bp, Homo sapiens
cagagattctgga

SEQ ID NO: 5583631 - DNA, 15 bp, Homo sapiens
cagagattgcttctc

SEQ ID NO: 5583632 - DNA, 24 bp, Homo sapiens
cagagattgggtttttggacttct

SEQ ID NO: 5583633 - DNA, 19 bp, Homo sapiens
cagagatttctcattgact

SEQ ID NO: 5583634 - DNA, 20 bp, Homo sapiens
cagagatttctcattgactt

SEQ ID NO: 5583635 - DNA, 22 bp, Homo sapiens
cagagatttggtaactcatttg

SEQ ID NO: 5583636 - DNA, 16 bp, Homo sapiens
cagagcaaaaatgtaa

SEQ ID NO: 5583637 - DNA, 21 bp, Homo sapiens
cagagcaaaaatgtaaaaaac

SEQ ID NO: 5583638 - DNA, 23 bp, Homo sapiens
cagagcaaaaatgtaaaaaacaa

SEQ ID NO: 5583639 - DNA, 24 bp, Homo sapiens
cagagcaaaagacttgagccatcc

SEQ ID NO: 5583640 - DNA, 14 bp, Homo sapiens
cagagcaaacagaa

SEQ ID NO: 5583641 - DNA, 17 bp, Homo sapiens
cagagcaaagggccagg

SEQ ID NO: 5583642 - DNA, 19 bp, Homo sapiens
cagagcaaatgagggaggg

SEQ ID NO: 5583643 - DNA, 18 bp, Homo sapiens
cagagcaacccctggacc

SEQ ID NO: 5583644 - DNA, 21 bp, Homo sapiens
cagagcaacccctggacccca

SEQ ID NO: 5583645 - DNA, 22 bp, Homo sapiens
cagagcaacccctggaccccag

SEQ ID NO: 5583646 - DNA, 23 bp, Homo sapiens
cagagcaacccctggaccccagc

SEQ ID NO: 5583647 - DNA, 17 bp, Homo sapiens
cagagcaagaccccatc

SEQ ID NO: 5583648 - DNA, 15 bp, Homo sapiens
cagagcaagactcca

SEQ ID NO: 5583649 - DNA, 20 bp, Homo sapiens
cagagcaagactccgtctca

SEQ ID NO: 5583650 - DNA, 20 bp, Homo sapiens
cagagcaagactctgtctca

SEQ ID NO: 5583651 - DNA, 18 bp, Homo sapiens
cagagcaagatcctgtct

SEQ ID NO: 5583652 - DNA, 20 bp, Homo sapiens
cagagcaagatcctgtcttt

SEQ ID NO: 5583653 - DNA, 17 bp, Homo sapiens
cagagcaagcctttgac

SEQ ID NO: 5583654 - DNA, 19 bp, Homo sapiens
cagagcaagcctttgacct

SEQ ID NO: 5583655 - DNA, 21 bp, Homo sapiens
cagagcaagcctttgacctgt

SEQ ID NO: 5583656 - DNA, 22 bp, Homo sapiens
cagagcaagcgaaagagcaaag

SEQ ID NO: 5583657 - DNA, 20 bp, Homo sapiens
cagagcaagtcctcactctt

SEQ ID NO: 5583658 - DNA, 21 bp, Homo sapiens
cagagcaagtcctcactcttc

SEQ ID NO: 5583659 - DNA, 19 bp, Homo sapiens
cagagcaataacactatat

SEQ ID NO: 5583660 - DNA, 22 bp, Homo sapiens
cagagcaatgcttttaatgaat

SEQ ID NO: 5583661 - DNA, 16 bp, Homo sapiens
cagagcaattccaggc

SEQ ID NO: 5583662 - DNA, 18 bp, Homo sapiens
cagagcaattccaggctg

SEQ ID NO: 5583663 - DNA, 20 bp, Homo sapiens
cagagcaattccaggctgag

SEQ ID NO: 5583664 - DNA, 19 bp, Homo sapiens
cagagcacaaacttcagaa

SEQ ID NO: 5583665 - DNA, 18 bp, Homo sapiens
cagagcacaagaaggcca

SEQ ID NO: 5583666 - DNA, 20 bp, Homo sapiens
cagagcacaagaaggccagc

SEQ ID NO: 5583667 - DNA, 23 bp, Homo sapiens
cagagcacaagaaggccagccca

SEQ ID NO: 5583668 - DNA, 20 bp, Homo sapiens
cagagcacacaggtacagca

SEQ ID NO: 5583669 - DNA, 15 bp, Homo sapiens
cagagcacagattca

SEQ ID NO: 5583670 - DNA, 13 bp, Homo sapiens
cagagcacagccc

SEQ ID NO: 5583671 - DNA, 15 bp, Homo sapiens
cagagcacagcccac

SEQ ID NO: 5583672 - DNA, 15 bp, Homo sapiens
cagagcaccccctgc

SEQ ID NO: 5583673 - DNA, 16 bp, Homo sapiens
cagagcaccccctgct

SEQ ID NO: 5583674 - DNA, 19 bp, Homo sapiens
cagagcaccccctgctcca

SEQ ID NO: 5583675 - DNA, 18 bp, Homo sapiens
cagagcacctcaggaccc

SEQ ID NO: 5583676 - DNA, 21 bp, Homo sapiens
cagagcacctgctgtctgggt

SEQ ID NO: 5583677 - DNA, 14 bp, Homo sapiens
cagagcacctgtag

SEQ ID NO: 5583678 - DNA, 22 bp, Homo sapiens
cagagcaccttagacagtccct

SEQ ID NO: 5583679 - DNA, 22 bp, Homo sapiens
cagagcactaggttcaattccc

SEQ ID NO: 5583680 - DNA, 14 bp, Homo sapiens
cagagcactcccta

SEQ ID NO: 5583681 - DNA, 15 bp, Homo sapiens
cagagcactgctcca

SEQ ID NO: 5583682 - DNA, 18 bp, Homo sapiens
cagagcactgtgtaacca

SEQ ID NO: 5583683 - DNA, 22 bp, Homo sapiens
cagagcactgtgttcacacttt

SEQ ID NO: 5583684 - DNA, 17 bp, Homo sapiens
cagagcagagaccatcc

SEQ ID NO: 5583685 - DNA, 19 bp, Homo sapiens
cagagcagagaccatccct

SEQ ID NO: 5583686 - DNA, 19 bp, Homo sapiens
cagagcagagcaaatgagg

SEQ ID NO: 5583687 - DNA, 13 bp, Homo sapiens
cagagcagagcct

SEQ ID NO: 5583688 - DNA, 14 bp, Homo sapiens
cagagcagatgcag

SEQ ID NO: 5583689 - DNA, 16 bp, Homo sapiens
cagagcagatgcagag

SEQ ID NO: 5583690 - DNA, 18 bp, Homo sapiens
cagagcagatggcagatg

SEQ ID NO: 5583691 - DNA, 19 bp, Homo sapiens
cagagcagatggcagatgc

SEQ ID NO: 5583692 - DNA, 11 bp, Homo sapiens
cagagcagcaa

SEQ ID NO: 5583693 - DNA, 14 bp, Homo sapiens
cagagcagcagcac

SEQ ID NO: 5583694 - DNA, 22 bp, Homo sapiens
cagagcagcagcacctttctct

SEQ ID NO: 5583695 - DNA, 11 bp, Homo sapiens
cagagcagcct

SEQ ID NO: 5583696 - DNA, 19 bp, Homo sapiens
cagagcagctaactccgag

SEQ ID NO: 5583697 - DNA, 23 bp, Homo sapiens
cagagcagctaactccgagagca

SEQ ID NO: 5583698 - DNA, 16 bp, Homo sapiens
cagagcagctccacca

SEQ ID NO: 5583699 - DNA, 16 bp, Homo sapiens
cagagcagctccccag

SEQ ID NO: 5583700 - DNA, 18 bp, Homo sapiens
cagagcagctccccagga

SEQ ID NO: 5583701 - DNA, 21 bp, Homo sapiens
cagagcagctccccaggagct

SEQ ID NO: 5583702 - DNA, 23 bp, Homo sapiens
cagagcaggaaggacaggaagct

SEQ ID NO: 5583703 - DNA, 18 bp, Homo sapiens
cagagcaggacctccctt

SEQ ID NO: 5583704 - DNA, 12 bp, Homo sapiens
cagagcaggagc

SEQ ID NO: 5583705 - DNA, 16 bp, Homo sapiens
cagagcaggagcatcc

SEQ ID NO: 5583706 - DNA, 13 bp, Homo sapiens
cagagcaggagcc

SEQ ID NO: 5583707 - DNA, 16 bp, Homo sapiens
cagagcaggagcccct

SEQ ID NO: 5583708 - DNA, 17 bp, Homo sapiens
cagagcaggagcccctg

SEQ ID NO: 5583709 - DNA, 19 bp, Homo sapiens
cagagcaggaggcagggct

SEQ ID NO: 5583710 - DNA, 23 bp, Homo sapiens
cagagcaggaggcagggctctgg

SEQ ID NO: 5583711 - DNA, 12 bp, Homo sapiens
cagagcaggctc

SEQ ID NO: 5583712 - DNA, 12 bp, Homo sapiens
cagagcagggcc

SEQ ID NO: 5583713 - DNA, 17 bp, Homo sapiens
cagagcaggggctgctg

SEQ ID NO: 5583714 - DNA, 19 bp, Homo sapiens
cagagcaggggctgctggg

SEQ ID NO: 5583715 - DNA, 20 bp, Homo sapiens
cagagctaaactccttcctg

SEQ ID NO: 5583716 - DNA, 21 bp, Homo sapiens
cagagctaaactccttcctgg

SEQ ID NO: 5583717 - DNA, 22 bp, Homo sapiens
cagagctaactgggttacagtg

SEQ ID NO: 5583718 - DNA, 15 bp, Homo sapiens
cagagctactgagac

SEQ ID NO: 5583719 - DNA, 16 bp, Homo sapiens
cagagctactgagact

SEQ ID NO: 5583720 - DNA, 18 bp, Homo sapiens
cagagctactgagacttg

SEQ ID NO: 5583721 - DNA, 16 bp, Homo sapiens
cagagctacttgggcc

SEQ ID NO: 5583722 - DNA, 15 bp, Homo sapiens
cagagctagaggcca

SEQ ID NO: 5583723 - DNA, 13 bp, Homo sapiens
cagagctaggccc

SEQ ID NO: 5583724 - DNA, 17 bp, Homo sapiens
cagagctaggctgtgga

SEQ ID NO: 5583725 - DNA, 18 bp, Homo sapiens
cagagctagggctgctgc

SEQ ID NO: 5583726 - DNA, 22 bp, Homo sapiens
cagagctagggctgctgcttct

SEQ ID NO: 5583727 - DNA, 20 bp, Homo sapiens
cagagctcaaaacaaggcga

SEQ ID NO: 5583728 - DNA, 12 bp, Homo sapiens
cagagctcacaa

SEQ ID NO: 5583729 - DNA, 13 bp, Homo sapiens
cagagctcagcac

SEQ ID NO: 5583730 - DNA, 19 bp, Homo sapiens
cagagctcagcacagcctc

SEQ ID NO: 5583731 - DNA, 23 bp, Homo sapiens
cagagctcatcccccctgctgcc

SEQ ID NO: 5583732 - DNA, 22 bp, Homo sapiens
cagagctcatttcggggtcagg

SEQ ID NO: 5583733 - DNA, 15 bp, Homo sapiens
cagagctccacagaa

SEQ ID NO: 5583734 - DNA, 15 bp, Homo sapiens
cagagctccatgctg

SEQ ID NO: 5583735 - DNA, 14 bp, Homo sapiens
cagagctcccagga

SEQ ID NO: 5583736 - DNA, 17 bp, Homo sapiens
cagagctcccaggacgc

SEQ ID NO: 5583737 - DNA, 20 bp, Homo sapiens
cagagctcccaggacgcagg

SEQ ID NO: 5583738 - DNA, 13 bp, Homo sapiens
cagagctccgatg

SEQ ID NO: 5583739 - DNA, 20 bp, Homo sapiens
cagagctccgatgcccgccc

SEQ ID NO: 5583740 - DNA, 13 bp, Homo sapiens
cagagctcctctg

SEQ ID NO: 5583741 - DNA, 14 bp, Homo sapiens
cagagctctacagg

SEQ ID NO: 5583742 - DNA, 17 bp, Homo sapiens
cagagctctacaggcct

SEQ ID NO: 5583743 - DNA, 18 bp, Homo sapiens
cagagctctacaggcctg

SEQ ID NO: 5583744 - DNA, 14 bp, Homo sapiens
cagagctctccagc

SEQ ID NO: 5583745 - DNA, 23 bp, Homo sapiens
cagagctctcccctcctgctggg

SEQ ID NO: 5583746 - DNA, 15 bp, Homo sapiens
cagagctctcgagga

SEQ ID NO: 5583747 - DNA, 12 bp, Homo sapiens
cagagctctctc

SEQ ID NO: 5583748 - DNA, 14 bp, Homo sapiens
cagagctctctgag

SEQ ID NO: 5583749 - DNA, 22 bp, Homo sapiens
cagagctctgacccacagcctc

SEQ ID NO: 5583750 - DNA, 18 bp, Homo sapiens
cagagctcttcaagctgt

SEQ ID NO: 5583751 - DNA, 21 bp, Homo sapiens
cagagctcttcaagctgtccc

SEQ ID NO: 5583752 - DNA, 12 bp, Homo sapiens
cagagctgaaga

SEQ ID NO: 5583753 - DNA, 13 bp, Homo sapiens
cagagctgaccca

SEQ ID NO: 5583754 - DNA, 14 bp, Homo sapiens
cagagctgaggatt

SEQ ID NO: 5583755 - DNA, 21 bp, Homo sapiens
cagagctgaggatttcctgga

SEQ ID NO: 5583756 - DNA, 22 bp, Homo sapiens
cagagctgaggatttcctggag

SEQ ID NO: 5583757 - DNA, 17 bp, Homo sapiens
cagagctgagggccctg

SEQ ID NO: 5583758 - DNA, 19 bp, Homo sapiens
cagagctgagggccctgtg

SEQ ID NO: 5583759 - DNA, 21 bp, Homo sapiens
cagagctgagggccctgtgga

SEQ ID NO: 5583760 - DNA, 18 bp, Homo sapiens
cagagctgagtcggctgg

SEQ ID NO: 5583761 - DNA, 19 bp, Homo sapiens
cagagctgagtcggctggg

SEQ ID NO: 5583762 - DNA, 21 bp, Homo sapiens
cagagctgagtcggctgggca

SEQ ID NO: 5583763 - DNA, 23 bp, Homo sapiens
cagagctgagtcggctgggcagg

SEQ ID NO: 5583764 - DNA, 15 bp, Homo sapiens
cagagctgcacttgg

SEQ ID NO: 5583765 - DNA, 20 bp, Homo sapiens
cagagctgcacttggcctca

SEQ ID NO: 5583766 - DNA, 15 bp, Homo sapiens
cagagctgcagccag

SEQ ID NO: 5583767 - DNA, 16 bp, Homo sapiens
cagagctgcagccagt

SEQ ID NO: 5583768 - DNA, 23 bp, Homo sapiens
cagagctgcagccagtcaggcag

SEQ ID NO: 5583769 - DNA, 16 bp, Homo sapiens
cagagctgccacctgc

SEQ ID NO: 5583770 - DNA, 18 bp, Homo sapiens
cagagctgccacctgcct

SEQ ID NO: 5583771 - DNA, 15 bp, Homo sapiens
cagagctgccctctc

SEQ ID NO: 5583772 - DNA, 17 bp, Homo sapiens
cagagctgccctctcct

SEQ ID NO: 5583773 - DNA, 22 bp, Homo sapiens
cagagctgccgacttggagact

SEQ ID NO: 5583774 - DNA, 13 bp, Homo sapiens
cagagctgcctat

SEQ ID NO: 5583775 - DNA, 15 bp, Homo sapiens
cagagctgcctcccc

SEQ ID NO: 5583776 - DNA, 16 bp, Homo sapiens
cagagctgcctcccca

SEQ ID NO: 5583777 - DNA, 17 bp, Homo sapiens
cagagctgcctccccaa

SEQ ID NO: 5583778 - DNA, 19 bp, Homo sapiens
cagagctgcctccccaatc

SEQ ID NO: 5583779 - DNA, 13 bp, Homo sapiens
cagagctgcctgc

SEQ ID NO: 5583780 - DNA, 14 bp, Homo sapiens
cagagctgcgggct

SEQ ID NO: 5583781 - DNA, 17 bp, Homo sapiens
cagagctgcgggctgag

SEQ ID NO: 5583782 - DNA, 14 bp, Homo sapiens
cagagctgcttctg

SEQ ID NO: 5583783 - DNA, 15 bp, Homo sapiens
cagagctgcttctgt

SEQ ID NO: 5583784 - DNA, 15 bp, Homo sapiens
cagagctggaacaca

SEQ ID NO: 5583785 - DNA, 13 bp, Homo sapiens
cagagctggaagg

SEQ ID NO: 5583786 - DNA, 21 bp, Homo sapiens
cagagctggaaggcagggcag

SEQ ID NO: 5583787 - DNA, 23 bp, Homo sapiens
cagagctggaaggcagggcagag

SEQ ID NO: 5583788 - DNA, 21 bp, Homo sapiens
cagagctggagatgaggccag

SEQ ID NO: 5583789 - DNA, 15 bp, Homo sapiens
cagagctggagcccc

SEQ ID NO: 5583790 - DNA, 18 bp, Homo sapiens
cagagctggagcccccag

SEQ ID NO: 5583791 - DNA, 14 bp, Homo sapiens
cagagctggatgct

SEQ ID NO: 5583792 - DNA, 20 bp, Homo sapiens
cagagctggattcaattcct

SEQ ID NO: 5583793 - DNA, 22 bp, Homo sapiens
cagagctggccaggccactggg

SEQ ID NO: 5583794 - DNA, 13 bp, Homo sapiens
cagagctggcctc

SEQ ID NO: 5583795 - DNA, 18 bp, Homo sapiens
cagagctggcctccccca

SEQ ID NO: 5583796 - DNA, 17 bp, Homo sapiens
cagagctggcgctcagc

SEQ ID NO: 5583797 - DNA, 21 bp, Homo sapiens
cagagctggcgctcagcagcc

SEQ ID NO: 5583798 - DNA, 15 bp, Homo sapiens
cagagctgggaggca

SEQ ID NO: 5583799 - DNA, 20 bp, Homo sapiens
cagagctgggatgtttctgt

SEQ ID NO: 5583800 - DNA, 13 bp, Homo sapiens
cagagctgggtgg

SEQ ID NO: 5583801 - DNA, 23 bp, Homo sapiens
cagagctggtgcggctggccatg

SEQ ID NO: 5583802 - DNA, 18 bp, Homo sapiens
cagagctggtggacccag

SEQ ID NO: 5583803 - DNA, 21 bp, Homo sapiens
cagagctggtggacccaggga

SEQ ID NO: 5583804 - DNA, 15 bp, Homo sapiens
cagagctgtgccagc

SEQ ID NO: 5583805 - DNA, 16 bp, Homo sapiens
cagagctgtgccagca

SEQ ID NO: 5583806 - DNA, 18 bp, Homo sapiens
cagagctgttataaattt

SEQ ID NO: 5583807 - DNA, 23 bp, Homo sapiens
cagagctgttataaatttatcaa

SEQ ID NO: 5583808 - DNA, 17 bp, Homo sapiens
cagagctgttggcctcg

SEQ ID NO: 5583809 - DNA, 18 bp, Homo sapiens
cagagctgttggcctcgc

SEQ ID NO: 5583810 - DNA, 19 bp, Homo sapiens
cagagctgtttatggcctc

SEQ ID NO: 5583811 - DNA, 19 bp, Homo sapiens
cagagctgtttggatacag

SEQ ID NO: 5583812 - DNA, 21 bp, Homo sapiens
cagagcttattggccactggg

SEQ ID NO: 5583813 - DNA, 15 bp, Homo sapiens
cagagcttcagggct

SEQ ID NO: 5583814 - DNA, 16 bp, Homo sapiens
cagagcttcagggctg

SEQ ID NO: 5583815 - DNA, 14 bp, Homo sapiens
cagagcttcctggg

SEQ ID NO: 5583816 - DNA, 15 bp, Homo sapiens
cagagcttctcctga

SEQ ID NO: 5583817 - DNA, 18 bp, Homo sapiens
cagagcttctcctgacca

SEQ ID NO: 5583818 - DNA, 20 bp, Homo sapiens
cagagcttctcctgaccagg

SEQ ID NO: 5583819 - DNA, 17 bp, Homo sapiens
cagagcttctctgggct

SEQ ID NO: 5583820 - DNA, 18 bp, Homo sapiens
cagagcttctctgggctg

SEQ ID NO: 5583821 - DNA, 20 bp, Homo sapiens
cagagcttctctgggctgaa

SEQ ID NO: 5583822 - DNA, 22 bp, Homo sapiens
cagagcttctctgggctgaatg

SEQ ID NO: 5583823 - DNA, 23 bp, Homo sapiens
cagagcttcttccaggtgcccag

SEQ ID NO: 5583824 - DNA, 15 bp, Homo sapiens
cagagcttgaagatt

SEQ ID NO: 5583825 - DNA, 16 bp, Homo sapiens
cagagcttggactgga

SEQ ID NO: 5583826 - DNA, 23 bp, Homo sapiens
cagagcttggagagtcttgggcc

SEQ ID NO: 5583827 - DNA, 16 bp, Homo sapiens
cagagcttgtagccct

SEQ ID NO: 5583828 - DNA, 17 bp, Homo sapiens
cagagcttgtagccctg

SEQ ID NO: 5583829 - DNA, 18 bp, Homo sapiens
cagagcttgtagccctgg

SEQ ID NO: 5583830 - DNA, 18 bp, Homo sapiens
cagagcttgtggaaagcg

SEQ ID NO: 5583831 - DNA, 15 bp, Homo sapiens
cagagcttgtggtgg

SEQ ID NO: 5583832 - DNA, 16 bp, Homo sapiens
cagagctttaaaagta

SEQ ID NO: 5583833 - DNA, 22 bp, Homo sapiens
cagagctttaaaagtatcttta

SEQ ID NO: 5583834 - DNA, 15 bp, Homo sapiens
cagagctttggtctg

SEQ ID NO: 5583835 - DNA, 13 bp, Homo sapiens
cagagctttgtca

SEQ ID NO: 5583836 - DNA, 16 bp, Homo sapiens
cagagctttgtcactt

SEQ ID NO: 5583837 - DNA, 15 bp, Homo sapiens
cagagcttttcagat

SEQ ID NO: 5583838 - DNA, 22 bp, Homo sapiens
cagagcttttcgaactgtgctc

SEQ ID NO: 5583839 - DNA, 20 bp, Homo sapiens
cagagcttttgcatttcctg

SEQ ID NO: 5583840 - DNA, 13 bp, Homo sapiens
cagagctttttgg

SEQ ID NO: 5583841 - DNA, 19 bp, Homo sapiens
cagaggaaaaacagaggat

SEQ ID NO: 5583842 - DNA, 18 bp, Homo sapiens
cagaggaaaaagaaaaac

SEQ ID NO: 5583843 - DNA, 21 bp, Homo sapiens
cagaggaaaaatgggagccag

SEQ ID NO: 5583844 - DNA, 22 bp, Homo sapiens
cagaggaaaaatgggagccagg

SEQ ID NO: 5583845 - DNA, 18 bp, Homo sapiens
cagaggaaatctgtaaca

SEQ ID NO: 5583846 - DNA, 18 bp, Homo sapiens
cagaggaacccccaccag

SEQ ID NO: 5583847 - DNA, 17 bp, Homo sapiens
cagaggaactgtccaga

SEQ ID NO: 5583848 - DNA, 20 bp, Homo sapiens
cagaggaactgtccagagag

SEQ ID NO: 5583849 - DNA, 21 bp, Homo sapiens
cagaggaactgtccagagagc

SEQ ID NO: 5583850 - DNA, 16 bp, Homo sapiens
cagaggaagagcaggc

SEQ ID NO: 5583851 - DNA, 15 bp, Homo sapiens
cagaggaagcccctt

SEQ ID NO: 5583852 - DNA, 12 bp, Homo sapiens
cagaggaaggaa

SEQ ID NO: 5583853 - DNA, 15 bp, Homo sapiens
cagaggaaggaaaca

SEQ ID NO: 5583854 - DNA, 23 bp, Homo sapiens
cagaggaagggaggcctgagggg

SEQ ID NO: 5583855 - DNA, 18 bp, Homo sapiens
cagaggaatcactcttgt

SEQ ID NO: 5583856 - DNA, 19 bp, Homo sapiens
cagaggaatcctggcagcc

SEQ ID NO: 5583857 - DNA, 22 bp, Homo sapiens
cagaggaatcctggcagcccag

SEQ ID NO: 5583858 - DNA, 18 bp, Homo sapiens
cagaggaatgtagggcct

SEQ ID NO: 5583859 - DNA, 21 bp, Homo sapiens
cagaggaatgtagggcctgca

SEQ ID NO: 5583860 - DNA, 17 bp, Homo sapiens
cagaggaatttatacct

SEQ ID NO: 5583861 - DNA, 19 bp, Homo sapiens
cagaggaatttggctgctt

SEQ ID NO: 5583862 - DNA, 16 bp, Homo sapiens
cagaggacaaggaagt

SEQ ID NO: 5583863 - DNA, 18 bp, Homo sapiens
cagaggacaaggaagtgg

SEQ ID NO: 5583864 - DNA, 23 bp, Homo sapiens
cagaggacacctgtactggagag

SEQ ID NO: 5583865 - DNA, 13 bp, Homo sapiens
cagaggacagatc

SEQ ID NO: 5583866 - DNA, 23 bp, Homo sapiens
cagaggacagatcaatggcgcag

SEQ ID NO: 5583867 - DNA, 20 bp, Homo sapiens
cagaggacagcttccccatc

SEQ ID NO: 5583868 - DNA, 22 bp, Homo sapiens
cagaggacagtatttgtgggga

SEQ ID NO: 5583869 - DNA, 15 bp, Homo sapiens
cagaggacagtgctg

SEQ ID NO: 5583870 - DNA, 20 bp, Homo sapiens
cagaggaccagcacactccc

SEQ ID NO: 5583871 - DNA, 16 bp, Homo sapiens
cagaggaccagggcct

SEQ ID NO: 5583872 - DNA, 15 bp, Homo sapiens
cagaggacccacctg

SEQ ID NO: 5583873 - DNA, 20 bp, Homo sapiens
cagaggacctgtatttaagc

SEQ ID NO: 5583874 - DNA, 22 bp, Homo sapiens
cagaggacctgtatttaagcaa

SEQ ID NO: 5583875 - DNA, 23 bp, Homo sapiens
cagaggacgcacgctcgctgcca

SEQ ID NO: 5583876 - DNA, 20 bp, Homo sapiens
cagaggacggcttccccatc

SEQ ID NO: 5583877 - DNA, 19 bp, Homo sapiens
cagaggactcccaaccctg

SEQ ID NO: 5583878 - DNA, 14 bp, Homo sapiens
cagaggactgtgat

SEQ ID NO: 5583879 - DNA, 15 bp, Homo sapiens
cagaggagaggagac

SEQ ID NO: 5583880 - DNA, 21 bp, Homo sapiens
cagaggagaggagacagacac

SEQ ID NO: 5583881 - DNA, 18 bp, Homo sapiens
cagaggagagtggcctgg

SEQ ID NO: 5583882 - DNA, 20 bp, Homo sapiens
cagaggagagtggcctgggt

SEQ ID NO: 5583883 - DNA, 13 bp, Homo sapiens
cagaggagcagac

SEQ ID NO: 5583884 - DNA, 21 bp, Homo sapiens
cagaggagcagaccagcactt

SEQ ID NO: 5583885 - DNA, 23 bp, Homo sapiens
cagaggagcagaccagcacttca

SEQ ID NO: 5583886 - DNA, 17 bp, Homo sapiens
cagaggagcatcagctg

SEQ ID NO: 5583887 - DNA, 21 bp, Homo sapiens
cagaggagcatcagctgtctg

SEQ ID NO: 5583888 - DNA, 16 bp, Homo sapiens
cagaggagccacctgg

SEQ ID NO: 5583889 - DNA, 11 bp, Homo sapiens
cagaggagccc

SEQ ID NO: 5583890 - DNA, 15 bp, Homo sapiens
cagaggagcccagcg

SEQ ID NO: 5583891 - DNA, 22 bp, Homo sapiens
cagagggcccaggcaggccacc

SEQ ID NO: 5583892 - DNA, 22 bp, Homo sapiens
cagagggcccctcactggctgg

SEQ ID NO: 5583893 - DNA, 15 bp, Homo sapiens
cagagggcctgcaag

SEQ ID NO: 5583894 - DNA, 19 bp, Homo sapiens
cagagggcctgcaagggag

SEQ ID NO: 5583895 - DNA, 21 bp, Homo sapiens
cagagggcgccaccaccacct

SEQ ID NO: 5583896 - DNA, 13 bp, Homo sapiens
cagagggctgatg

SEQ ID NO: 5583897 - DNA, 11 bp, Homo sapiens
cagagggctgg

SEQ ID NO: 5583898 - DNA, 13 bp, Homo sapiens
cagagggctggag

SEQ ID NO: 5583899 - DNA, 19 bp, Homo sapiens
cagagggctggaggcccag

SEQ ID NO: 5583900 - DNA, 14 bp, Homo sapiens
cagagggctggatt

SEQ ID NO: 5583901 - DNA, 22 bp, Homo sapiens
cagagggctttcagcgccccca

SEQ ID NO: 5583902 - DNA, 23 bp, Homo sapiens
cagagggctttcagcgcccccag

SEQ ID NO: 5583903 - DNA, 19 bp, Homo sapiens
cagaggggacgctgaggaa

SEQ ID NO: 5583904 - DNA, 15 bp, Homo sapiens
cagaggggactctgg

SEQ ID NO: 5583905 - DNA, 15 bp, Homo sapiens
cagaggggagaggaa

SEQ ID NO: 5583906 - DNA, 17 bp, Homo sapiens
cagaggggagcagcggc

SEQ ID NO: 5583907 - DNA, 19 bp, Homo sapiens
cagaggggagcagtggcca

SEQ ID NO: 5583908 - DNA, 21 bp, Homo sapiens
cagaggggagcttgagggaca

SEQ ID NO: 5583909 - DNA, 22 bp, Homo sapiens
cagaggggagcttgagggacaa

SEQ ID NO: 5583910 - DNA, 21 bp, Homo sapiens
cagaggggcagccgctaggag

SEQ ID NO: 5583911 - DNA, 19 bp, Homo sapiens
cagaggggcaggccctgca

SEQ ID NO: 5583912 - DNA, 13 bp, Homo sapiens
cagaggggccagg

SEQ ID NO: 5583913 - DNA, 21 bp, Homo sapiens
cagaggggcctgccacctgga

SEQ ID NO: 5583914 - DNA, 22 bp, Homo sapiens
cagaggggcctgccacctggac

SEQ ID NO: 5583915 - DNA, 23 bp, Homo sapiens
cagaggggcgttctcccaaagat

SEQ ID NO: 5583916 - DNA, 18 bp, Homo sapiens
cagagggggaaataagag

SEQ ID NO: 5583917 - DNA, 21 bp, Homo sapiens
cagagggggactgctgctgcc

SEQ ID NO: 5583918 - DNA, 20 bp, Homo sapiens
cagagggggagtagccaagc

SEQ ID NO: 5583919 - DNA, 14 bp, Homo sapiens
cagagggggccaga

SEQ ID NO: 5583920 - DNA, 18 bp, Homo sapiens
cagagggggccagaggga

SEQ ID NO: 5583921 - DNA, 18 bp, Homo sapiens
cagagggggcgtgcctgc

SEQ ID NO: 5583922 - DNA, 13 bp, Homo sapiens
cagagggggtggc

SEQ ID NO: 5583923 - DNA, 14 bp, Homo sapiens
cagagggggtggcc

SEQ ID NO: 5583924 - DNA, 20 bp, Homo sapiens
cagaggggtaggcagagcct

SEQ ID NO: 5583925 - DNA, 21 bp, Homo sapiens
cagaggggtcacgtgtaggag

SEQ ID NO: 5583926 - DNA, 18 bp, Homo sapiens
cagaggggtgctgctcct

SEQ ID NO: 5583927 - DNA, 18 bp, Homo sapiens
cagagggtagggcagcag

SEQ ID NO: 5583928 - DNA, 15 bp, Homo sapiens
cagagggtcacagtg

SEQ ID NO: 5583929 - DNA, 16 bp, Homo sapiens
cagagggtctgggggc

SEQ ID NO: 5583930 - DNA, 23 bp, Homo sapiens
cagagggtggagatgtcagtctg

SEQ ID NO: 5583931 - DNA, 19 bp, Homo sapiens
cagagggtgggtgttcata

SEQ ID NO: 5583932 - DNA, 16 bp, Homo sapiens
cagagggtgtcaaaca

SEQ ID NO: 5583933 - DNA, 20 bp, Homo sapiens
cagagggtgtggctttccag

SEQ ID NO: 5583934 - DNA, 17 bp, Homo sapiens
cagagggttgtgatttt

SEQ ID NO: 5583935 - DNA, 22 bp, Homo sapiens
cagaggtaaaaaaaagaagtgt

SEQ ID NO: 5583936 - DNA, 18 bp, Homo sapiens
cagaggtaaaagtgtgag

SEQ ID NO: 5583937 - DNA, 20 bp, Homo sapiens
cagaggtaaaagtgtgagca

SEQ ID NO: 5583938 - DNA, 14 bp, Homo sapiens
cagaggtaacagaa

SEQ ID NO: 5583939 - DNA, 16 bp, Homo sapiens
cagaggtaacagaaca

SEQ ID NO: 5583940 - DNA, 16 bp, Homo sapiens
cagaggtaccctgggt

SEQ ID NO: 5583941 - DNA, 18 bp, Homo sapiens
cagaggtaccctgggtgt

SEQ ID NO: 5583942 - DNA, 14 bp, Homo sapiens
cagaggtagcattg

SEQ ID NO: 5583943 - DNA, 19 bp, Homo sapiens
cagaggtaggagaactggg

SEQ ID NO: 5583944 - DNA, 22 bp, Homo sapiens
cagaggtagtctcactgcttga

SEQ ID NO: 5583945 - DNA, 23 bp, Homo sapiens
cagaggtattaaaactaaatttc

SEQ ID NO: 5583946 - DNA, 19 bp, Homo sapiens
cagaggtcagactaagaaa

SEQ ID NO: 5583947 - DNA, 18 bp, Homo sapiens
cagaggtcaggaagcagg

SEQ ID NO: 5583948 - DNA, 13 bp, Homo sapiens
cagaggtccagcc

SEQ ID NO: 5583949 - DNA, 14 bp, Homo sapiens
cagaggtccagccc

SEQ ID NO: 5583950 - DNA, 15 bp, Homo sapiens
cagaggtccaggccc

SEQ ID NO: 5583951 - DNA, 20 bp, Homo sapiens
cagaggtccaggtcccagcc

SEQ ID NO: 5583952 - DNA, 18 bp, Homo sapiens
cagaggtcccagccccag

SEQ ID NO: 5583953 - DNA, 23 bp, Homo sapiens
cagaggtcccagccccaggcctg

SEQ ID NO: 5583954 - DNA, 16 bp, Homo sapiens
cagaggtcccctgagg

SEQ ID NO: 5583955 - DNA, 20 bp, Homo sapiens
cagaggtctcatctcccagg

SEQ ID NO: 5583956 - DNA, 21 bp, Homo sapiens
cagaggtctcatctcccaggc

SEQ ID NO: 5583957 - DNA, 18 bp, Homo sapiens
cagaggtctccaaactga

SEQ ID NO: 5583958 - DNA, 16 bp, Homo sapiens
cagaggtctccctata

SEQ ID NO: 5583959 - DNA, 19 bp, Homo sapiens
cagaggtctctgccggctc

SEQ ID NO: 5583960 - DNA, 16 bp, Homo sapiens
cagaggtctgtgctga

SEQ ID NO: 5583961 - DNA, 17 bp, Homo sapiens
cagaggtcttcagggct

SEQ ID NO: 5583962 - DNA, 18 bp, Homo sapiens
cagaggtgagaactcaga

SEQ ID NO: 5583963 - DNA, 18 bp, Homo sapiens
cagaggtgagcagaggag

SEQ ID NO: 5583964 - DNA, 14 bp, Homo sapiens
cagaggtgagggag

SEQ ID NO: 5583965 - DNA, 14 bp, Homo sapiens
cagaggtggaaaat

SEQ ID NO: 5583966 - DNA, 13 bp, Homo sapiens
cagaggtggagcc

SEQ ID NO: 5583967 - DNA, 13 bp, Homo sapiens
cagaggtggatgt

SEQ ID NO: 5583968 - DNA, 23 bp, Homo sapiens
cagaggtggatgttatgaacagc

SEQ ID NO: 5583969 - DNA, 10 bp, Homo sapiens
cagaggtggc

SEQ ID NO: 5583970 - DNA, 11 bp, Homo sapiens
cagaggtggcc

SEQ ID NO: 5583971 - DNA, 17 bp, Homo sapiens
cagaggtggccagagct

SEQ ID NO: 5583972 - DNA, 19 bp, Homo sapiens
cagaggtggccagagctgg

SEQ ID NO: 5583973 - DNA, 21 bp, Homo sapiens
cagaggtggccagagctggga

SEQ ID NO: 5583974 - DNA, 16 bp, Homo sapiens
cagaggtggccctccc

SEQ ID NO: 5583975 - DNA, 18 bp, Homo sapiens
cagaggtggccctcccag

SEQ ID NO: 5583976 - DNA, 18 bp, Homo sapiens
cagaggtggctctggaat

SEQ ID NO: 5583977 - DNA, 19 bp, Homo sapiens
cagaggtgggaggcccctg

SEQ ID NO: 5583978 - DNA, 19 bp, Homo sapiens
cagaggtgggatcctccct

SEQ ID NO: 5583979 - DNA, 12 bp, Homo sapiens
cagaggtgggca

SEQ ID NO: 5583980 - DNA, 15 bp, Homo sapiens
cagaggtgggcaggt

SEQ ID NO: 5583981 - DNA, 16 bp, Homo sapiens
cagaggtgggcaggtg

SEQ ID NO: 5583982 - DNA, 23 bp, Homo sapiens
cagaggtgggcaggtggtggcac

SEQ ID NO: 5583983 - DNA, 14 bp, Homo sapiens
cagaggtggggaag

SEQ ID NO: 5583984 - DNA, 19 bp, Homo sapiens
cagaggtggtctggtgcca

SEQ ID NO: 5583985 - DNA, 17 bp, Homo sapiens
cagaggtgtacactaac

SEQ ID NO: 5583986 - DNA, 20 bp, Homo sapiens
cagaggtgtacactaacatt

SEQ ID NO: 5583987 - DNA, 18 bp, Homo sapiens
cagaggttatctgcctgg

SEQ ID NO: 5583988 - DNA, 19 bp, Homo sapiens
cagaggttatctgcctggc

SEQ ID NO: 5583989 - DNA, 21 bp, Homo sapiens
cagaggttatctgcctggcct

SEQ ID NO: 5583990 - DNA, 21 bp, Homo sapiens
cagaggttctttgagggactg

SEQ ID NO: 5583991 - DNA, 17 bp, Homo sapiens
cagaggttgcagtgagc

SEQ ID NO: 5583992 - DNA, 22 bp, Homo sapiens
cagaggttgtagtgagccaaga

SEQ ID NO: 5583993 - DNA, 18 bp, Homo sapiens
cagaggttgtgcactgtt

SEQ ID NO: 5583994 - DNA, 14 bp, Homo sapiens
cagaggtttcttga

SEQ ID NO: 5583995 - DNA, 19 bp, Homo sapiens
cagaggtttgaaggagaat

SEQ ID NO: 5583996 - DNA, 13 bp, Homo sapiens
cagagtaaaagta

SEQ ID NO: 5583997 - DNA, 18 bp, Homo sapiens
cagagtaaattgctctgt

SEQ ID NO: 5583998 - DNA, 18 bp, Homo sapiens
cagagtaacaaaaaataa

SEQ ID NO: 5583999 - DNA, 14 bp, Homo sapiens
cagagtaacaggat

SEQ ID NO: 5584000 - DNA, 20 bp, Homo sapiens
cagagtaacgagaagacaaa

SEQ ID NO: 5584001 - DNA, 14 bp, Homo sapiens
cagagtacatccat

SEQ ID NO: 5584002 - DNA, 20 bp, Homo sapiens
cagagtacgtcctgcctggc

SEQ ID NO: 5584003 - DNA, 19 bp, Homo sapiens
cagagtacgttaaaagcaa

SEQ ID NO: 5584004 - DNA, 19 bp, Homo sapiens
cagagtagagggcttggga

SEQ ID NO: 5584005 - DNA, 19 bp, Homo sapiens
cagagtagccatgaggagg

SEQ ID NO: 5584006 - DNA, 20 bp, Homo sapiens
cagagtagccatgaggaggc

SEQ ID NO: 5584007 - DNA, 23 bp, Homo sapiens
cagagtagccatgaggaggcaga

SEQ ID NO: 5584008 - DNA, 21 bp, Homo sapiens
cagagtagctgcttcctggac

SEQ ID NO: 5584009 - DNA, 21 bp, Homo sapiens
cagagtaggtgggtaggagcc

SEQ ID NO: 5584010 - DNA, 15 bp, Homo sapiens
cagagtatatatgta

SEQ ID NO: 5584011 - DNA, 16 bp, Homo sapiens
cagagtatatatgtac

SEQ ID NO: 5584012 - DNA, 23 bp, Homo sapiens
cagagtatatatgtacagttata

SEQ ID NO: 5584013 - DNA, 20 bp, Homo sapiens
cagagtatatttaagaagcc

SEQ ID NO: 5584014 - DNA, 23 bp, Homo sapiens
cagagtatatttttgtctgcagc

SEQ ID NO: 5584015 - DNA, 18 bp, Homo sapiens
cagagtatgagtgcaagc

SEQ ID NO: 5584016 - DNA, 14 bp, Homo sapiens
cagagtatgggcac

SEQ ID NO: 5584017 - DNA, 21 bp, Homo sapiens
cagagtatgtcagtccaataa

SEQ ID NO: 5584018 - DNA, 14 bp, Homo sapiens
cagagtatgttctt

SEQ ID NO: 5584019 - DNA, 15 bp, Homo sapiens
cagagtatgttcttg

SEQ ID NO: 5584020 - DNA, 20 bp, Homo sapiens
cagagtatttgaaaaatgta

SEQ ID NO: 5584021 - DNA, 14 bp, Homo sapiens
cagagtcaacaaat

SEQ ID NO: 5584022 - DNA, 15 bp, Homo sapiens
cagagtcaacaaatt

SEQ ID NO: 5584023 - DNA, 23 bp, Homo sapiens
cagagtcaacaaattaaataaat

SEQ ID NO: 5584024 - DNA, 16 bp, Homo sapiens
cagagtcaagctgatg

SEQ ID NO: 5584025 - DNA, 22 bp, Homo sapiens
cagagtcacaagcctcgaggtg

SEQ ID NO: 5584026 - DNA, 21 bp, Homo sapiens
cagagtcacctttccccactc

SEQ ID NO: 5584027 - DNA, 21 bp, Homo sapiens
cagagtcaccttttctgtggc

SEQ ID NO: 5584028 - DNA, 22 bp, Homo sapiens
cagagtcaccttttctgtggct

SEQ ID NO: 5584029 - DNA, 17 bp, Homo sapiens
cagagtcagaggagaag

SEQ ID NO: 5584030 - DNA, 15 bp, Homo sapiens
cagagtcagcacagg

SEQ ID NO: 5584031 - DNA, 14 bp, Homo sapiens
cagagtcagcagaa

SEQ ID NO: 5584032 - DNA, 22 bp, Homo sapiens
cagagtcagccattcctgttct

SEQ ID NO: 5584033 - DNA, 14 bp, Homo sapiens
cagagtcaggaaga

SEQ ID NO: 5584034 - DNA, 14 bp, Homo sapiens
cagagtcattgtta

SEQ ID NO: 5584035 - DNA, 17 bp, Homo sapiens
cagagtccaatttaagg

SEQ ID NO: 5584036 - DNA, 15 bp, Homo sapiens
cagagtccaggcccc

SEQ ID NO: 5584037 - DNA, 16 bp, Homo sapiens
cagagtccaggcccca

SEQ ID NO: 5584038 - DNA, 21 bp, Homo sapiens
cagagtccagtgctctgcctc

SEQ ID NO: 5584039 - DNA, 22 bp, Homo sapiens
cagagtccagtgctctgcctca

SEQ ID NO: 5584040 - DNA, 22 bp, Homo sapiens
cagagtccatttcccacatctt

SEQ ID NO: 5584041 - DNA, 23 bp, Homo sapiens
cagagtccatttcccacatcttt

SEQ ID NO: 5584042 - DNA, 13 bp, Homo sapiens
cagagtcccccca

SEQ ID NO: 5584043 - DNA, 14 bp, Homo sapiens
cagagtccctgcct

SEQ ID NO: 5584044 - DNA, 16 bp, Homo sapiens
cagagtccggaggcag

SEQ ID NO: 5584045 - DNA, 15 bp, Homo sapiens
cagagtcctgccttc

SEQ ID NO: 5584046 - DNA, 18 bp, Homo sapiens
cagagtcctgccttcttc

SEQ ID NO: 5584047 - DNA, 14 bp, Homo sapiens
cagagtcctggccc

SEQ ID NO: 5584048 - DNA, 19 bp, Homo sapiens
cagagtccttagtggaggg

SEQ ID NO: 5584049 - DNA, 23 bp, Homo sapiens
cagagtccttagtggaggggttt

SEQ ID NO: 5584050 - DNA, 20 bp, Homo sapiens
cagagtccttattcttctca

SEQ ID NO: 5584051 - DNA, 15 bp, Homo sapiens
cagagtcggaacgga

SEQ ID NO: 5584052 - DNA, 21 bp, Homo sapiens
cagagtcgttggagactgaag

SEQ ID NO: 5584053 - DNA, 22 bp, Homo sapiens
cagagtcgttggagactgaaga

SEQ ID NO: 5584054 - DNA, 20 bp, Homo sapiens
cagagtctagcgtagtgcag

SEQ ID NO: 5584055 - DNA, 18 bp, Homo sapiens
cagagtctataacagaaa

SEQ ID NO: 5584056 - DNA, 15 bp, Homo sapiens
cagagtctgacagga

SEQ ID NO: 5584057 - DNA, 18 bp, Homo sapiens
cagagtctgacaggaaga

SEQ ID NO: 5584058 - DNA, 12 bp, Homo sapiens
cagagtctgagc

SEQ ID NO: 5584059 - DNA, 13 bp, Homo sapiens
cagagtctgagcc

SEQ ID NO: 5584060 - DNA, 14 bp, Homo sapiens
cagagtctgagccc

SEQ ID NO: 5584061 - DNA, 18 bp, Homo sapiens
cagagtctggcctgccag

SEQ ID NO: 5584062 - DNA, 19 bp, Homo sapiens
cagagtctggcctgccagg

SEQ ID NO: 5584063 - DNA, 24 bp, Homo sapiens
cagagtctggcctgccaggctcct

SEQ ID NO: 5584064 - DNA, 20 bp, Homo sapiens
cagagtctggtgaagctcac

SEQ ID NO: 5584065 - DNA, 15 bp, Homo sapiens
cagagtctgtctctt

SEQ ID NO: 5584066 - DNA, 20 bp, Homo sapiens
cagagtcttcactaaccttt

SEQ ID NO: 5584067 - DNA, 15 bp, Homo sapiens
cagatcttgttcttt

SEQ ID NO: 5584068 - DNA, 20 bp, Homo sapiens
cagatctttctcttccctga

SEQ ID NO: 5584069 - DNA, 22 bp, Homo sapiens
cagatcttttctttaaaataaa

SEQ ID NO: 5584070 - DNA, 13 bp, Homo sapiens
cagatctttttgt

SEQ ID NO: 5584071 - DNA, 19 bp, Homo sapiens
cagatcttttttttttccc

SEQ ID NO: 5584072 - DNA, 17 bp, Homo sapiens
cagatgaaaaaaactaa

SEQ ID NO: 5584073 - DNA, 18 bp, Homo sapiens
cagatgaaaaggagcctg

SEQ ID NO: 5584074 - DNA, 18 bp, Homo sapiens
cagatgaaaccaggtcac

SEQ ID NO: 5584075 - DNA, 16 bp, Homo sapiens
cagatgaaatgttctg

SEQ ID NO: 5584076 - DNA, 22 bp, Homo sapiens
cagatgaaatgttctgttcacc

SEQ ID NO: 5584077 - DNA, 12 bp, Homo sapiens
cagatgaacatt

SEQ ID NO: 5584078 - DNA, 22 bp, Homo sapiens
cagatgaactctttctggcctg

SEQ ID NO: 5584079 - DNA, 23 bp, Homo sapiens
cagatgaactctttctggcctgc

SEQ ID NO: 5584080 - DNA, 21 bp, Homo sapiens
cagatgaagaaggagcagaat

SEQ ID NO: 5584081 - DNA, 17 bp, Homo sapiens
cagatgaagctttggcc

SEQ ID NO: 5584082 - DNA, 13 bp, Homo sapiens
cagatgaaggaaa

SEQ ID NO: 5584083 - DNA, 19 bp, Homo sapiens
cagatgaatgactccagga

SEQ ID NO: 5584084 - DNA, 19 bp, Homo sapiens
cagatgaatgataaactct

SEQ ID NO: 5584085 - DNA, 19 bp, Homo sapiens
cagatgaattgataaaaga

SEQ ID NO: 5584086 - DNA, 20 bp, Homo sapiens
cagatgacaaaaattcaact

SEQ ID NO: 5584087 - DNA, 21 bp, Homo sapiens
cagatgacagaggtttgaagg

SEQ ID NO: 5584088 - DNA, 23 bp, Homo sapiens
cagatgacagaggtttgaaggag

SEQ ID NO: 5584089 - DNA, 21 bp, Homo sapiens
cagatgacagggagctgggga

SEQ ID NO: 5584090 - DNA, 20 bp, Homo sapiens
cagatgacatttcgtttttt

SEQ ID NO: 5584091 - DNA, 18 bp, Homo sapiens
cagatgaccccagaaact

SEQ ID NO: 5584092 - DNA, 17 bp, Homo sapiens
cagatgacccctgccca

SEQ ID NO: 5584093 - DNA, 18 bp, Homo sapiens
cagatgacctgaggaaag

SEQ ID NO: 5584094 - DNA, 23 bp, Homo sapiens
cagatgactatgcagaggcctgg

SEQ ID NO: 5584095 - DNA, 19 bp, Homo sapiens
cagatgagaaactcttgag

SEQ ID NO: 5584096 - DNA, 14 bp, Homo sapiens
cagatgagaacaaa

SEQ ID NO: 5584097 - DNA, 15 bp, Homo sapiens
cagatgagaacaaag

SEQ ID NO: 5584098 - DNA, 16 bp, Homo sapiens
cagatgagaacaaagc

SEQ ID NO: 5584099 - DNA, 18 bp, Homo sapiens
cagatgagaacaaagctg

SEQ ID NO: 5584100 - DNA, 19 bp, Homo sapiens
cagatgagaacaaagctgt

SEQ ID NO: 5584101 - DNA, 21 bp, Homo sapiens
cagatgagaacaaagctgtta

SEQ ID NO: 5584102 - DNA, 16 bp, Homo sapiens
cagatgagaagactag

SEQ ID NO: 5584103 - DNA, 22 bp, Homo sapiens
cagatgagaagactagcagcta

SEQ ID NO: 5584104 - DNA, 17 bp, Homo sapiens
cagatgagagtttctgg

SEQ ID NO: 5584105 - DNA, 20 bp, Homo sapiens
cagatgagattccctctcct

SEQ ID NO: 5584106 - DNA, 16 bp, Homo sapiens
cagatgagcagaagct

SEQ ID NO: 5584107 - DNA, 18 bp, Homo sapiens
cagatgagcaggagcttg

SEQ ID NO: 5584108 - DNA, 15 bp, Homo sapiens
cagatgaggacagag

SEQ ID NO: 5584109 - DNA, 20 bp, Homo sapiens
cagatgaggagcagctgggg

SEQ ID NO: 5584110 - DNA, 17 bp, Homo sapiens
cagatgaggatccgaaa

SEQ ID NO: 5584111 - DNA, 15 bp, Homo sapiens
cagatgaggccctgc

SEQ ID NO: 5584112 - DNA, 16 bp, Homo sapiens
cagatgaggccctgca

SEQ ID NO: 5584113 - DNA, 20 bp, Homo sapiens
cagatgaggccctgcacctt

SEQ ID NO: 5584114 - DNA, 18 bp, Homo sapiens
cagatgaggggccactga

SEQ ID NO: 5584115 - DNA, 22 bp, Homo sapiens
cagatgaggggccactgaccca

SEQ ID NO: 5584116 - DNA, 21 bp, Homo sapiens
cagatgaggtcaacacaggta

SEQ ID NO: 5584117 - DNA, 15 bp, Homo sapiens
cagatgagtgtgtgt

SEQ ID NO: 5584118 - DNA, 16 bp, Homo sapiens
cagatgagtgtgtgtt

SEQ ID NO: 5584119 - DNA, 15 bp, Homo sapiens
cagatgataaaagga

SEQ ID NO: 5584120 - DNA, 17 bp, Homo sapiens
cagatgataaatattta

SEQ ID NO: 5584121 - DNA, 15 bp, Homo sapiens
cagatgatccttgca

SEQ ID NO: 5584122 - DNA, 15 bp, Homo sapiens
cagatgatctctcca

SEQ ID NO: 5584123 - DNA, 15 bp, Homo sapiens
cagatgatgaagaaa

SEQ ID NO: 5584124 - DNA, 19 bp, Homo sapiens
cagatgatgagaatttcta

SEQ ID NO: 5584125 - DNA, 22 bp, Homo sapiens
cagatgatgagaatttctaaaa

SEQ ID NO: 5584126 - DNA, 17 bp, Homo sapiens
cagatgatgccagctgt

SEQ ID NO: 5584127 - DNA, 21 bp, Homo sapiens
cagatgatgctttgagaacat

SEQ ID NO: 5584128 - DNA, 18 bp, Homo sapiens
cagatgatggccatttct

SEQ ID NO: 5584129 - DNA, 19 bp, Homo sapiens
cagatgatggccatttcta

SEQ ID NO: 5584130 - DNA, 18 bp, Homo sapiens
cagatgatgggagtggga

SEQ ID NO: 5584131 - DNA, 23 bp, Homo sapiens
cagatgatggggtcagcaggccc

SEQ ID NO: 5584132 - DNA, 18 bp, Homo sapiens
cagatgatttcccccctc

SEQ ID NO: 5584133 - DNA, 15 bp, Homo sapiens
cagatgattttcctc

SEQ ID NO: 5584134 - DNA, 16 bp, Homo sapiens
cagatgattttcctcc

SEQ ID NO: 5584135 - DNA, 16 bp, Homo sapiens
cagatgcaacctcact

SEQ ID NO: 5584136 - DNA, 19 bp, Homo sapiens
cagatgcaacctcactatg

SEQ ID NO: 5584137 - DNA, 14 bp, Homo sapiens
cagatgcaccagcc

SEQ ID NO: 5584138 - DNA, 17 bp, Homo sapiens
cagatgcaccagccctt

SEQ ID NO: 5584139 - DNA, 16 bp, Homo sapiens
cagatgcaccccaaca

SEQ ID NO: 5584140 - DNA, 13 bp, Homo sapiens
cagatgcagctct

SEQ ID NO: 5584141 - DNA, 14 bp, Homo sapiens
cagatgcagctctt

SEQ ID NO: 5584142 - DNA, 17 bp, Homo sapiens
cagatgcagctcttcct

SEQ ID NO: 5584143 - DNA, 18 bp, Homo sapiens
cagatgcagctcttcctg

SEQ ID NO: 5584144 - DNA, 19 bp, Homo sapiens
cagatgcagctcttcctgg

SEQ ID NO: 5584145 - DNA, 14 bp, Homo sapiens
cagatgcaggacag

SEQ ID NO: 5584146 - DNA, 16 bp, Homo sapiens
cagatgcaggacagga

SEQ ID NO: 5584147 - DNA, 22 bp, Homo sapiens
cagatgcaggacaggaggcggc

SEQ ID NO: 5584148 - DNA, 13 bp, Homo sapiens
cagatgcagggca

SEQ ID NO: 5584149 - DNA, 14 bp, Homo sapiens
cagatgcagggctg

SEQ ID NO: 5584150 - DNA, 14 bp, Homo sapiens
cagatgcagttttc

SEQ ID NO: 5584151 - DNA, 12 bp, Homo sapiens
cagatgccaaaa

SEQ ID NO: 5584152 - DNA, 16 bp, Homo sapiens
cagatgccaacttccc

SEQ ID NO: 5584153 - DNA, 13 bp, Homo sapiens
cagatgccagagc

SEQ ID NO: 5584154 - DNA, 19 bp, Homo sapiens
cagatgcccagagggccca

SEQ ID NO: 5584155 - DNA, 16 bp, Homo sapiens
cagatgccccagagct

SEQ ID NO: 5584156 - DNA, 12 bp, Homo sapiens
cagatgcccgag

SEQ ID NO: 5584157 - DNA, 17 bp, Homo sapiens
cagatgcccgagcaccg

SEQ ID NO: 5584158 - DNA, 18 bp, Homo sapiens
cagatgcccttgctgggc

SEQ ID NO: 5584159 - DNA, 21 bp, Homo sapiens
cagatgccggagccccaagac

SEQ ID NO: 5584160 - DNA, 21 bp, Homo sapiens
cagatgcctacttttggcctc

SEQ ID NO: 5584161 - DNA, 15 bp, Homo sapiens
cagatgcctcagagg

SEQ ID NO: 5584162 - DNA, 14 bp, Homo sapiens
cagatgcctcccca

SEQ ID NO: 5584163 - DNA, 18 bp, Homo sapiens
cagatgcctccccaagac

SEQ ID NO: 5584164 - DNA, 12 bp, Homo sapiens
cagatgcctcct

SEQ ID NO: 5584165 - DNA, 12 bp, Homo sapiens
cagatgcctggt

SEQ ID NO: 5584166 - DNA, 20 bp, Homo sapiens
cagatgcctggtgagcaggg

SEQ ID NO: 5584167 - DNA, 15 bp, Homo sapiens
cagatgccttctaga

SEQ ID NO: 5584168 - DNA, 21 bp, Homo sapiens
cagatgcggggacaggctgga

SEQ ID NO: 5584169 - DNA, 13 bp, Homo sapiens
cagatgcgtccca

SEQ ID NO: 5584170 - DNA, 22 bp, Homo sapiens
cagatgcgtcccaagatgttga

SEQ ID NO: 5584171 - DNA, 16 bp, Homo sapiens
cagatgcgtgcccagc

SEQ ID NO: 5584172 - DNA, 17 bp, Homo sapiens
cagatgctaataaactg

SEQ ID NO: 5584173 - DNA, 18 bp, Homo sapiens
cagatgctagagcctctg

SEQ ID NO: 5584174 - DNA, 16 bp, Homo sapiens
cagatgctaggaagct

SEQ ID NO: 5584175 - DNA, 19 bp, Homo sapiens
cagatgctccaagattcta

SEQ ID NO: 5584176 - DNA, 20 bp, Homo sapiens
cagatgctccaagattctag

SEQ ID NO: 5584177 - DNA, 21 bp, Homo sapiens
cagatgctccaagattctaga

SEQ ID NO: 5584178 - DNA, 12 bp, Homo sapiens
cagatgctctga

SEQ ID NO: 5584179 - DNA, 21 bp, Homo sapiens
cagatgctgaattgagaataa

SEQ ID NO: 5584180 - DNA, 14 bp, Homo sapiens
cagatgctgagcca

SEQ ID NO: 5584181 - DNA, 17 bp, Homo sapiens
cagatgctgagccatag

SEQ ID NO: 5584182 - DNA, 16 bp, Homo sapiens
cagatgctgatgttca

SEQ ID NO: 5584183 - DNA, 20 bp, Homo sapiens
cagatgctgatgttcagtgt

SEQ ID NO: 5584184 - DNA, 21 bp, Homo sapiens
cagatgctgatgttcagtgta

SEQ ID NO: 5584185 - DNA, 20 bp, Homo sapiens
cagatgctgctgaagagagg

SEQ ID NO: 5584186 - DNA, 12 bp, Homo sapiens
cagatgctggcc

SEQ ID NO: 5584187 - DNA, 15 bp, Homo sapiens
cagatgctggcctct

SEQ ID NO: 5584188 - DNA, 17 bp, Homo sapiens
cagatgctggcctcttg

SEQ ID NO: 5584189 - DNA, 23 bp, Homo sapiens
cagatgctggcctcttggcacct

SEQ ID NO: 5584190 - DNA, 12 bp, Homo sapiens
cagatgctgggg

SEQ ID NO: 5584191 - DNA, 18 bp, Homo sapiens
cagatgctggtcatgtgt

SEQ ID NO: 5584192 - DNA, 15 bp, Homo sapiens
cagatgctggtggag

SEQ ID NO: 5584193 - DNA, 16 bp, Homo sapiens
cagatgctggtggagg

SEQ ID NO: 5584194 - DNA, 21 bp, Homo sapiens
cagatgctgtcactggcagag

SEQ ID NO: 5584195 - DNA, 23 bp, Homo sapiens
cagatgctgtcactggcagagca

SEQ ID NO: 5584196 - DNA, 14 bp, Homo sapiens
cagatgctttcctg

SEQ ID NO: 5584197 - DNA, 16 bp, Homo sapiens
cagatgcttttgtgag

SEQ ID NO: 5584198 - DNA, 18 bp, Homo sapiens
cagatggaaatattttga

SEQ ID NO: 5584199 - DNA, 14 bp, Homo sapiens
cagatggaaccgca

SEQ ID NO: 5584200 - DNA, 20 bp, Homo sapiens
cagatggaaccgcaggaagc

SEQ ID NO: 5584201 - DNA, 22 bp, Homo sapiens
cagatggaaccgcaggaagctg

SEQ ID NO: 5584202 - DNA, 19 bp, Homo sapiens
cagatggaagaagttttaa

SEQ ID NO: 5584203 - DNA, 21 bp, Homo sapiens
cagatggaagaagttttaact

SEQ ID NO: 5584204 - DNA, 16 bp, Homo sapiens
cagatggaatgctgtg

SEQ ID NO: 5584205 - DNA, 19 bp, Homo sapiens
cagatggaatgctgtgtta

SEQ ID NO: 5584206 - DNA, 21 bp, Homo sapiens
cagatggaatgctgtgttaaa

SEQ ID NO: 5584207 - DNA, 15 bp, Homo sapiens
cagatggacactgcc

SEQ ID NO: 5584208 - DNA, 16 bp, Homo sapiens
cagatggacgcaggcc

SEQ ID NO: 5584209 - DNA, 20 bp, Homo sapiens
cagatggacgcaggccctgt

SEQ ID NO: 5584210 - DNA, 13 bp, Homo sapiens
cagatggactggg

SEQ ID NO: 5584211 - DNA, 18 bp, Homo sapiens
cagatggactgggaggag

SEQ ID NO: 5584212 - DNA, 15 bp, Homo sapiens
cagatggagaaacag

SEQ ID NO: 5584213 - DNA, 12 bp, Homo sapiens
cagatggagacc

SEQ ID NO: 5584214 - DNA, 22 bp, Homo sapiens
cagatggaggttctcagagcca

SEQ ID NO: 5584215 - DNA, 22 bp, Homo sapiens
cagatggattgataattgcatt

SEQ ID NO: 5584216 - DNA, 15 bp, Homo sapiens
cagatggatttgcct

SEQ ID NO: 5584217 - DNA, 16 bp, Homo sapiens
cagatggcacctgtgg

SEQ ID NO: 5584218 - DNA, 14 bp, Homo sapiens
cagatggcagatgc

SEQ ID NO: 5584219 - DNA, 15 bp, Homo sapiens
cagatggcagctttt

SEQ ID NO: 5584220 - DNA, 19 bp, Homo sapiens
cagatggcagcttttaaaa

SEQ ID NO: 5584221 - DNA, 22 bp, Homo sapiens
cagatggcatgtgtttacttta

SEQ ID NO: 5584222 - DNA, 13 bp, Homo sapiens
cagatggcccaag

SEQ ID NO: 5584223 - DNA, 16 bp, Homo sapiens
cagatggcccctccac

SEQ ID NO: 5584224 - DNA, 18 bp, Homo sapiens
cagatggcccctccactg

SEQ ID NO: 5584225 - DNA, 14 bp, Homo sapiens
cagatggctccctg

SEQ ID NO: 5584226 - DNA, 18 bp, Homo sapiens
cagatggctccctgggct

SEQ ID NO: 5584227 - DNA, 14 bp, Homo sapiens
cagatggctgtgaa

SEQ ID NO: 5584228 - DNA, 15 bp, Homo sapiens
cagatggctgtgaaa

SEQ ID NO: 5584229 - DNA, 22 bp, Homo sapiens
cagatgggacaagttagtcttt

SEQ ID NO: 5584230 - DNA, 22 bp, Homo sapiens
cagatgggaggaaagagagcag

SEQ ID NO: 5584231 - DNA, 23 bp, Homo sapiens
cagatgggaggaaagagagcagg

SEQ ID NO: 5584232 - DNA, 17 bp, Homo sapiens
cagatgggatgggcttt

SEQ ID NO: 5584233 - DNA, 14 bp, Homo sapiens
cagatggggcctct

SEQ ID NO: 5584234 - DNA, 15 bp, Homo sapiens
cagatggggcctctg

SEQ ID NO: 5584235 - DNA, 18 bp, Homo sapiens
cagatggggcctgggctg

SEQ ID NO: 5584236 - DNA, 19 bp, Homo sapiens
cagatgggggaaagcacag

SEQ ID NO: 5584237 - DNA, 15 bp, Homo sapiens
cagatgggggcctct

SEQ ID NO: 5584238 - DNA, 18 bp, Homo sapiens
cagatggggtctgtgact

SEQ ID NO: 5584239 - DNA, 21 bp, Homo sapiens
cagatgggtctgatattaatc

SEQ ID NO: 5584240 - DNA, 22 bp, Homo sapiens
cagatgggtctgatattaatca

SEQ ID NO: 5584241 - DNA, 18 bp, Homo sapiens
cagatgggtgcttggagg

SEQ ID NO: 5584242 - DNA, 17 bp, Homo sapiens
cagatggtactgctgag

SEQ ID NO: 5584243 - DNA, 22 bp, Homo sapiens
cagatggtactgctgaggtccc

SEQ ID NO: 5584244 - DNA, 15 bp, Homo sapiens
cagatggtagagaga

SEQ ID NO: 5584245 - DNA, 13 bp, Homo sapiens
cagatggtgtcat

SEQ ID NO: 5584246 - DNA, 19 bp, Homo sapiens
cagatggtgtcctgcatgt

SEQ ID NO: 5584247 - DNA, 15 bp, Homo sapiens
cagatggttgcaatt

SEQ ID NO: 5584248 - DNA, 22 bp, Homo sapiens
cagatggttgcaattgatcctt

SEQ ID NO: 5584249 - DNA, 12 bp, Homo sapiens
cagatggttgtg

SEQ ID NO: 5584250 - DNA, 20 bp, Homo sapiens
cagatgtaaatcgggaagga

SEQ ID NO: 5584251 - DNA, 14 bp, Homo sapiens
cagatgtacatgtg

SEQ ID NO: 5584252 - DNA, 15 bp, Homo sapiens
cagatgtaggaggga

SEQ ID NO: 5584253 - DNA, 23 bp, Homo sapiens
cagatgtaggggaagagatgttt

SEQ ID NO: 5584254 - DNA, 15 bp, Homo sapiens
cagatgtcagcttcc

SEQ ID NO: 5584255 - DNA, 19 bp, Homo sapiens
cagatgtcagcttcccagc

SEQ ID NO: 5584256 - DNA, 19 bp, Homo sapiens
cagatgtccatcagatgac

SEQ ID NO: 5584257 - DNA, 22 bp, Homo sapiens
cagatgtcccttgatgcacaga

SEQ ID NO: 5584258 - DNA, 19 bp, Homo sapiens
cagatgtcctaatggtgat

SEQ ID NO: 5584259 - DNA, 18 bp, Homo sapiens
cagatgtcgctgggtcct

SEQ ID NO: 5584260 - DNA, 19 bp, Homo sapiens
cagatgtctcccctgccac

SEQ ID NO: 5584261 - DNA, 13 bp, Homo sapiens
cagatgtctctgg

SEQ ID NO: 5584262 - DNA, 15 bp, Homo sapiens
cagatgtcttccctg

SEQ ID NO: 5584263 - DNA, 17 bp, Homo sapiens
cagatgtcttccctggg

SEQ ID NO: 5584264 - DNA, 13 bp, Homo sapiens
cagatgtcttctg

SEQ ID NO: 5584265 - DNA, 15 bp, Homo sapiens
cagatgtcttctgcc

SEQ ID NO: 5584266 - DNA, 18 bp, Homo sapiens
cagatgtcttctgcctgt

SEQ ID NO: 5584267 - DNA, 22 bp, Homo sapiens
cagatgtcttctgcctgttata

SEQ ID NO: 5584268 - DNA, 11 bp, Homo sapiens
cagatgtgaaa

SEQ ID NO: 5584269 - DNA, 16 bp, Homo sapiens
cagatgtgactgtata

SEQ ID NO: 5584270 - DNA, 23 bp, Homo sapiens
cagatgtgagccaccgtgcctgg

SEQ ID NO: 5584271 - DNA, 16 bp, Homo sapiens
cagatgtgatgcttga

SEQ ID NO: 5584272 - DNA, 18 bp, Homo sapiens
cagatgtgcaataatttg

SEQ ID NO: 5584273 - DNA, 15 bp, Homo sapiens
cagatgtgcagcaga

SEQ ID NO: 5584274 - DNA, 17 bp, Homo sapiens
cagatgtgcagcagatt

SEQ ID NO: 5584275 - DNA, 13 bp, Homo sapiens
cagatgtgcccag

SEQ ID NO: 5584276 - DNA, 18 bp, Homo sapiens
cagatgtgctataatctg

SEQ ID NO: 5584277 - DNA, 22 bp, Homo sapiens
cagatgtgctataatctgtttt

SEQ ID NO: 5584278 - DNA, 17 bp, Homo sapiens
cagatgtggacatgcac

SEQ ID NO: 5584279 - DNA, 18 bp, Homo sapiens
cagatgtggacatgcacc

SEQ ID NO: 5584280 - DNA, 19 bp, Homo sapiens
cagatgtggacatgcaccc

SEQ ID NO: 5584281 - DNA, 19 bp, Homo sapiens
cagatgtggctactgacat

SEQ ID NO: 5584282 - DNA, 16 bp, Homo sapiens
cagatgtgggctcaga

SEQ ID NO: 5584283 - DNA, 22 bp, Homo sapiens
cagatgtggggagggtgtctgg

SEQ ID NO: 5584284 - DNA, 20 bp, Homo sapiens
cagatgtggtaactgttaaa

SEQ ID NO: 5584285 - DNA, 22 bp, Homo sapiens
cagatgtgttcctccattttct

SEQ ID NO: 5584286 - DNA, 20 bp, Homo sapiens
cagatgttatttttgtattt

SEQ ID NO: 5584287 - DNA, 23 bp, Homo sapiens
cagatgttatttttgtattttta

SEQ ID NO: 5584288 - DNA, 16 bp, Homo sapiens
cagatgttgaagacag

SEQ ID NO: 5584289 - DNA, 14 bp, Homo sapiens
cagatgtttaaaac

SEQ ID NO: 5584290 - DNA, 16 bp, Homo sapiens
cagatgtttaatgaag

SEQ ID NO: 5584291 - DNA, 14 bp, Homo sapiens
cagatgtttcatca

SEQ ID NO: 5584292 - DNA, 19 bp, Homo sapiens
cagatgtttcatcaatgca

SEQ ID NO: 5584293 - DNA, 14 bp, Homo sapiens
cagatgtttccaag

SEQ ID NO: 5584294 - DNA, 18 bp, Homo sapiens
cagatgtttccagacttc

SEQ ID NO: 5584295 - DNA, 23 bp, Homo sapiens
cagatgtttccagacttccttga

SEQ ID NO: 5584296 - DNA, 18 bp, Homo sapiens
cagatgtttctcatttta

SEQ ID NO: 5584297 - DNA, 22 bp, Homo sapiens
cagatgtttcttttgtatgtaa

SEQ ID NO: 5584298 - DNA, 15 bp, Homo sapiens
cagatgtttgcctca

SEQ ID NO: 5584299 - DNA, 22 bp, Homo sapiens
cagatgtttgttttcaaaatac

SEQ ID NO: 5584300 - DNA, 20 bp, Homo sapiens
cagatgttttacgcaaggaa

SEQ ID NO: 5584301 - DNA, 22 bp, Homo sapiens
cagatgttttacgcaaggaagg

SEQ ID NO: 5584302 - DNA, 13 bp, Homo sapiens
cagatgttttaga

SEQ ID NO: 5584303 - DNA, 14 bp, Homo sapiens
cagatgttttagag

SEQ ID NO: 5584304 - DNA, 21 bp, Homo sapiens
cagatgttttagagataaata

SEQ ID NO: 5584305 - DNA, 17 bp, Homo sapiens
cagatgttttatttatg

SEQ ID NO: 5584306 - DNA, 14 bp, Homo sapiens
cagattaaacttca

SEQ ID NO: 5584307 - DNA, 16 bp, Homo sapiens
cagattaaattacagc

SEQ ID NO: 5584308 - DNA, 16 bp, Homo sapiens
cagattaataacagaa

SEQ ID NO: 5584309 - DNA, 17 bp, Homo sapiens
cagattacaataaatcc

SEQ ID NO: 5584310 - DNA, 20 bp, Homo sapiens
cagattacaggaatgaagaa

SEQ ID NO: 5584311 - DNA, 17 bp, Homo sapiens
cagattactccttcctt

SEQ ID NO: 5584312 - DNA, 14 bp, Homo sapiens
cagattactgccca

SEQ ID NO: 5584313 - DNA, 21 bp, Homo sapiens
cagattactgctttaatcaga

SEQ ID NO: 5584314 - DNA, 16 bp, Homo sapiens
cagattacttcagggc

SEQ ID NO: 5584315 - DNA, 20 bp, Homo sapiens
cagattagatgtgccaataa

SEQ ID NO: 5584316 - DNA, 21 bp, Homo sapiens
cagattagatgtgccaataac

SEQ ID NO: 5584317 - DNA, 18 bp, Homo sapiens
cagattaggacacagtgt

SEQ ID NO: 5584318 - DNA, 18 bp, Homo sapiens
cagattagttctttttgc

SEQ ID NO: 5584319 - DNA, 16 bp, Homo sapiens
cagattataataaatt

SEQ ID NO: 5584320 - DNA, 21 bp, Homo sapiens
cagattataataaattgtcat

SEQ ID NO: 5584321 - DNA, 19 bp, Homo sapiens
cagattatgagacacagga

SEQ ID NO: 5584322 - DNA, 20 bp, Homo sapiens
cagattatgttcctgctgta

SEQ ID NO: 5584323 - DNA, 14 bp, Homo sapiens
cagattattaaaat

SEQ ID NO: 5584324 - DNA, 15 bp, Homo sapiens
cagattattaaaatt

SEQ ID NO: 5584325 - DNA, 22 bp, Homo sapiens
cagattattaaaattagtgctg

SEQ ID NO: 5584326 - DNA, 18 bp, Homo sapiens
cagattattcactgattt

SEQ ID NO: 5584327 - DNA, 18 bp, Homo sapiens
cagattattggctgcttt

SEQ ID NO: 5584328 - DNA, 21 bp, Homo sapiens
cagattatttccagttttttg

SEQ ID NO: 5584329 - DNA, 23 bp, Homo sapiens
cagattattttagtctgtcatcc

SEQ ID NO: 5584330 - DNA, 18 bp, Homo sapiens
cagattattttctatatt

SEQ ID NO: 5584331 - DNA, 15 bp, Homo sapiens
cagattcaaagcgaa

SEQ ID NO: 5584332 - DNA, 14 bp, Homo sapiens
cagattcacactgt

SEQ ID NO: 5584333 - DNA, 18 bp, Homo sapiens
cagattcactttgtttat

SEQ ID NO: 5584334 - DNA, 18 bp, Homo sapiens
cagattcaggagctcagt

SEQ ID NO: 5584335 - DNA, 14 bp, Homo sapiens
cagattcaggcatt

SEQ ID NO: 5584336 - DNA, 15 bp, Homo sapiens
cagattcaggcattt

SEQ ID NO: 5584337 - DNA, 16 bp, Homo sapiens
cagattcaggccagcc

SEQ ID NO: 5584338 - DNA, 20 bp, Homo sapiens
cagattcaggccagcccagc

SEQ ID NO: 5584339 - DNA, 16 bp, Homo sapiens
cagattcagtcttgcc

SEQ ID NO: 5584340 - DNA, 17 bp, Homo sapiens
cagattcagtcttgcct

SEQ ID NO: 5584341 - DNA, 23 bp, Homo sapiens
cagattcataaagtaatgatgaa

SEQ ID NO: 5584342 - DNA, 21 bp, Homo sapiens
cagattccaggcgatgtgcaa

SEQ ID NO: 5584343 - DNA, 14 bp, Homo sapiens
cagattcccactgc

SEQ ID NO: 5584344 - DNA, 19 bp, Homo sapiens
cagattcccagaccttaag

SEQ ID NO: 5584345 - DNA, 18 bp, Homo sapiens
cagattcccagagcaaaa

SEQ ID NO: 5584346 - DNA, 14 bp, Homo sapiens
cagattcccaggcc

SEQ ID NO: 5584347 - DNA, 15 bp, Homo sapiens
cagattcccaggcca

SEQ ID NO: 5584348 - DNA, 18 bp, Homo sapiens
cagattcccaggccaggc

SEQ ID NO: 5584349 - DNA, 20 bp, Homo sapiens
cagattcccaggccaggctc

SEQ ID NO: 5584350 - DNA, 13 bp, Homo sapiens
cagattccctgtt

SEQ ID NO: 5584351 - DNA, 19 bp, Homo sapiens
cagattcctgggcctgtcc

SEQ ID NO: 5584352 - DNA, 20 bp, Homo sapiens
cagattcctgggcctgtccc

SEQ ID NO: 5584353 - DNA, 12 bp, Homo sapiens
cagattccttcc

SEQ ID NO: 5584354 - DNA, 14 bp, Homo sapiens
cagattcctttggc

SEQ ID NO: 5584355 - DNA, 19 bp, Homo sapiens
cagattcgtggtcttttcc

SEQ ID NO: 5584356 - DNA, 22 bp, Homo sapiens
cagattctaagttgttggcctt

SEQ ID NO: 5584357 - DNA, 13 bp, Homo sapiens
cagattctgagca

SEQ ID NO: 5584358 - DNA, 19 bp, Homo sapiens
cagattctgagcaaaggcc

SEQ ID NO: 5584359 - DNA, 22 bp, Homo sapiens
cagattctgagcaaaggccctg

SEQ ID NO: 5584360 - DNA, 23 bp, Homo sapiens
cagattctgagcaaaggccctgg

SEQ ID NO: 5584361 - DNA, 18 bp, Homo sapiens
cagattctgcctatgtaa

SEQ ID NO: 5584362 - DNA, 14 bp, Homo sapiens
cagattctgcctct

SEQ ID NO: 5584363 - DNA, 15 bp, Homo sapiens
cagattctgcctctc

SEQ ID NO: 5584364 - DNA, 16 bp, Homo sapiens
cagattctgcctctct

SEQ ID NO: 5584365 - DNA, 12 bp, Homo sapiens
cagattcttcag

SEQ ID NO: 5584366 - DNA, 12 bp, Homo sapiens
cagattgaaaag

SEQ ID NO: 5584367 - DNA, 12 bp, Homo sapiens
cagattgaagaa

SEQ ID NO: 5584368 - DNA, 13 bp, Homo sapiens
cagattgaagaat

SEQ ID NO: 5584369 - DNA, 16 bp, Homo sapiens
cagattgaagaatctg

SEQ ID NO: 5584370 - DNA, 22 bp, Homo sapiens
cagattgaagaatctgcccctg

SEQ ID NO: 5584371 - DNA, 22 bp, Homo sapiens
cagattgagttttcttctgtga

SEQ ID NO: 5584372 - DNA, 16 bp, Homo sapiens
cagattgctacacaca

SEQ ID NO: 5584373 - DNA, 18 bp, Homo sapiens
cagattgctgaaactgtg

SEQ ID NO: 5584374 - DNA, 15 bp, Homo sapiens
cagattgctgggagg

SEQ ID NO: 5584375 - DNA, 17 bp, Homo sapiens
cagattgcttaaaagca

SEQ ID NO: 5584376 - DNA, 15 bp, Homo sapiens
cagattggaaggaga

SEQ ID NO: 5584377 - DNA, 23 bp, Homo sapiens
cagattggaaggagacacagatg

SEQ ID NO: 5584378 - DNA, 22 bp, Homo sapiens
cagattggcacccctttctagt

SEQ ID NO: 5584379 - DNA, 18 bp, Homo sapiens
cagattggctcacactga

SEQ ID NO: 5584380 - DNA, 17 bp, Homo sapiens
cagattgggctggctct

SEQ ID NO: 5584381 - DNA, 13 bp, Homo sapiens
cagattgggggcc

SEQ ID NO: 5584382 - DNA, 16 bp, Homo sapiens
cagattgggggccctg

SEQ ID NO: 5584383 - DNA, 19 bp, Homo sapiens
cagattggttcatgcctgg

SEQ ID NO: 5584384 - DNA, 21 bp, Homo sapiens
cagattggttcatgcctgggg

SEQ ID NO: 5584385 - DNA, 15 bp, Homo sapiens
cagattgtatctgaa

SEQ ID NO: 5584386 - DNA, 21 bp, Homo sapiens
cagattgtggaatgttggata

SEQ ID NO: 5584387 - DNA, 15 bp, Homo sapiens
cagattgtggggtgc

SEQ ID NO: 5584388 - DNA, 15 bp, Homo sapiens
cagattgtgtacata

SEQ ID NO: 5584389 - DNA, 19 bp, Homo sapiens
cagattgttagagagtata

SEQ ID NO: 5584390 - DNA, 17 bp, Homo sapiens
cagatttactgtcccag

SEQ ID NO: 5584391 - DNA, 18 bp, Homo sapiens
cagatttactgtcccagg

SEQ ID NO: 5584392 - DNA, 22 bp, Homo sapiens
cagatttattcctttgttactt

SEQ ID NO: 5584393 - DNA, 19 bp, Homo sapiens
cagatttatttttgaaaca

SEQ ID NO: 5584394 - DNA, 12 bp, Homo sapiens
cagatttcaaat

SEQ ID NO: 5584395 - DNA, 19 bp, Homo sapiens
cagatttcaaattaatctt

SEQ ID NO: 5584396 - DNA, 16 bp, Homo sapiens
cagatttcactctcct

SEQ ID NO: 5584397 - DNA, 18 bp, Homo sapiens
cagatttcactctccttg

SEQ ID NO: 5584398 - DNA, 20 bp, Homo sapiens
cagatttcactctccttggt

SEQ ID NO: 5584399 - DNA, 20 bp, Homo sapiens
cagatttccattgtgtggcc

SEQ ID NO: 5584400 - DNA, 12 bp, Homo sapiens
cagatttcctca

SEQ ID NO: 5584401 - DNA, 15 bp, Homo sapiens
cagatttcctgtgtg

SEQ ID NO: 5584402 - DNA, 14 bp, Homo sapiens
cagatttctcacct

SEQ ID NO: 5584403 - DNA, 16 bp, Homo sapiens
cagatttctcactata

SEQ ID NO: 5584404 - DNA, 17 bp, Homo sapiens
cagatttctggttgatt

SEQ ID NO: 5584405 - DNA, 13 bp, Homo sapiens
cagatttctgtaa

SEQ ID NO: 5584406 - DNA, 23 bp, Homo sapiens
cagatttgaagacaaaaatactc

SEQ ID NO: 5584407 - DNA, 18 bp, Homo sapiens
cagatttgaggctggttt

SEQ ID NO: 5584408 - DNA, 19 bp, Homo sapiens
cagatttgaggctggtttt

SEQ ID NO: 5584409 - DNA, 17 bp, Homo sapiens
cagatttgcaacagcaa

SEQ ID NO: 5584410 - DNA, 13 bp, Homo sapiens
cagatttgcacaa

SEQ ID NO: 5584411 - DNA, 19 bp, Homo sapiens
cagatttgcttttctttgc

SEQ ID NO: 5584412 - DNA, 14 bp, Homo sapiens
cagatttgggctgg

SEQ ID NO: 5584413 - DNA, 22 bp, Homo sapiens
cagatttggggtataggtctca

SEQ ID NO: 5584414 - DNA, 23 bp, Homo sapiens
cagatttgtaacattagttttaa

SEQ ID NO: 5584415 - DNA, 12 bp, Homo sapiens
cagatttgtgaa

SEQ ID NO: 5584416 - DNA, 23 bp, Homo sapiens
cagatttgtgaactcagccaagc

SEQ ID NO: 5584417 - DNA, 24 bp, Homo sapiens
cagatttgtgaactcagccaagca

SEQ ID NO: 5584418 - DNA, 22 bp, Homo sapiens
cagatttgtggggacctcagcc

SEQ ID NO: 5584419 - DNA, 14 bp, Homo sapiens
cagatttgtgttat

SEQ ID NO: 5584420 - DNA, 14 bp, Homo sapiens
cagatttgttcatt

SEQ ID NO: 5584421 - DNA, 23 bp, Homo sapiens
cagcacgggcacagctgctgtgc

SEQ ID NO: 5584422 - DNA, 15 bp, Homo sapiens
cagcacgttttctgg

SEQ ID NO: 5584423 - DNA, 14 bp, Homo sapiens
cagcactaaagcag

SEQ ID NO: 5584424 - DNA, 18 bp, Homo sapiens
cagcactaaggccgtgtc

SEQ ID NO: 5584425 - DNA, 20 bp, Homo sapiens
cagcactaattagtgtccaa

SEQ ID NO: 5584426 - DNA, 16 bp, Homo sapiens
cagcactactgggtgt

SEQ ID NO: 5584427 - DNA, 22 bp, Homo sapiens
cagcactacttacttagagatg

SEQ ID NO: 5584428 - DNA, 17 bp, Homo sapiens
cagcactagagtcaccc

SEQ ID NO: 5584429 - DNA, 15 bp, Homo sapiens
cagcactagccaaac

SEQ ID NO: 5584430 - DNA, 15 bp, Homo sapiens
cagcactcaataaag

SEQ ID NO: 5584431 - DNA, 15 bp, Homo sapiens
cagcactcacacagg

SEQ ID NO: 5584432 - DNA, 23 bp, Homo sapiens
cagcactcagaaaagaaaaccat

SEQ ID NO: 5584433 - DNA, 13 bp, Homo sapiens
cagcactcagcct

SEQ ID NO: 5584434 - DNA, 14 bp, Homo sapiens
cagcactcagcctc

SEQ ID NO: 5584435 - DNA, 19 bp, Homo sapiens
cagcactcagcctcattca

SEQ ID NO: 5584436 - DNA, 13 bp, Homo sapiens
cagcactcagtga

SEQ ID NO: 5584437 - DNA, 11 bp, Homo sapiens
cagcactccat

SEQ ID NO: 5584438 - DNA, 13 bp, Homo sapiens
cagcactcccagg

SEQ ID NO: 5584439 - DNA, 16 bp, Homo sapiens
cagcactcccagggcc

SEQ ID NO: 5584440 - DNA, 17 bp, Homo sapiens
cagcactcccagggccc

SEQ ID NO: 5584441 - DNA, 20 bp, Homo sapiens
cagcactccccagagctgtg

SEQ ID NO: 5584442 - DNA, 14 bp, Homo sapiens
cagcactccccttg

SEQ ID NO: 5584443 - DNA, 18 bp, Homo sapiens
cagcactccccttgcctt

SEQ ID NO: 5584444 - DNA, 22 bp, Homo sapiens
cagcactccccttgccttcccc

SEQ ID NO: 5584445 - DNA, 20 bp, Homo sapiens
cagcactcctctgtctctgc

SEQ ID NO: 5584446 - DNA, 22 bp, Homo sapiens
cagcactctctaaatcttcctt

SEQ ID NO: 5584447 - DNA, 14 bp, Homo sapiens
cagcactctggact

SEQ ID NO: 5584448 - DNA, 15 bp, Homo sapiens
cagcactctgtaaaa

SEQ ID NO: 5584449 - DNA, 11 bp, Homo sapiens
cagcactgaaa

SEQ ID NO: 5584450 - DNA, 14 bp, Homo sapiens
cagcactgaaaata

SEQ ID NO: 5584451 - DNA, 15 bp, Homo sapiens
cagcactgaggaaga

SEQ ID NO: 5584452 - DNA, 17 bp, Homo sapiens
cagcactgaggaagaac

SEQ ID NO: 5584453 - DNA, 13 bp, Homo sapiens
cagcactgcccaa

SEQ ID NO: 5584454 - DNA, 20 bp, Homo sapiens
cagcactgcccatcagtgac

SEQ ID NO: 5584455 - DNA, 15 bp, Homo sapiens
cagcactgcccatcc

SEQ ID NO: 5584456 - DNA, 17 bp, Homo sapiens
cagcactgcccatccca

SEQ ID NO: 5584457 - DNA, 20 bp, Homo sapiens
cagcactgcccatcccaccc

SEQ ID NO: 5584458 - DNA, 22 bp, Homo sapiens
cagcactgcccatcccacccca

SEQ ID NO: 5584459 - DNA, 13 bp, Homo sapiens
cagcactgcctgc

SEQ ID NO: 5584460 - DNA, 14 bp, Homo sapiens
cagcactgcctgcc

SEQ ID NO: 5584461 - DNA, 18 bp, Homo sapiens
cagcactgcctgctccca

SEQ ID NO: 5584462 - DNA, 14 bp, Homo sapiens
cagcactgctgcct

SEQ ID NO: 5584463 - DNA, 15 bp, Homo sapiens
cagcactgctgcctc

SEQ ID NO: 5584464 - DNA, 18 bp, Homo sapiens
cagcactgctgcctcagc

SEQ ID NO: 5584465 - DNA, 22 bp, Homo sapiens
cagcactggaggggcccaccca

SEQ ID NO: 5584466 - DNA, 20 bp, Homo sapiens
cagcactgggaagctggagt

SEQ ID NO: 5584467 - DNA, 14 bp, Homo sapiens
cagcactgtctcag

SEQ ID NO: 5584468 - DNA, 16 bp, Homo sapiens
cagcacttacaatttt

SEQ ID NO: 5584469 - DNA, 16 bp, Homo sapiens
cagcacttagacctgc

SEQ ID NO: 5584470 - DNA, 19 bp, Homo sapiens
cagcacttagacctgccag

SEQ ID NO: 5584471 - DNA, 21 bp, Homo sapiens
cagcacttagacctgccagcc

SEQ ID NO: 5584472 - DNA, 13 bp, Homo sapiens
cagcacttccatg

SEQ ID NO: 5584473 - DNA, 18 bp, Homo sapiens
cagcacttgcttgcggaa

SEQ ID NO: 5584474 - DNA, 19 bp, Homo sapiens
cagcacttggagaggctga

SEQ ID NO: 5584475 - DNA, 17 bp, Homo sapiens
cagcacttgtctcattt

SEQ ID NO: 5584476 - DNA, 16 bp, Homo sapiens
cagcacttgttttcag

SEQ ID NO: 5584477 - DNA, 19 bp, Homo sapiens
cagcactttgagaggctga

SEQ ID NO: 5584478 - DNA, 15 bp, Homo sapiens
cagcactttgggaag

SEQ ID NO: 5584479 - DNA, 16 bp, Homo sapiens
cagcactttgggaggc

SEQ ID NO: 5584480 - DNA, 19 bp, Homo sapiens
cagcactttgggaggcagg

SEQ ID NO: 5584481 - DNA, 18 bp, Homo sapiens
cagcactttgggaggcct

SEQ ID NO: 5584482 - DNA, 19 bp, Homo sapiens
cagcactttggtaggcaaa

SEQ ID NO: 5584483 - DNA, 18 bp, Homo sapiens
cagcagaaaacctgttca

SEQ ID NO: 5584484 - DNA, 19 bp, Homo sapiens
cagcagaaaacctgttcag

SEQ ID NO: 5584485 - DNA, 13 bp, Homo sapiens
cagcagaaaagtg

SEQ ID NO: 5584486 - DNA, 16 bp, Homo sapiens
cagcagaaaagtgctt

SEQ ID NO: 5584487 - DNA, 16 bp, Homo sapiens
cagcagaaacccccag

SEQ ID NO: 5584488 - DNA, 17 bp, Homo sapiens
cagcagaaacccccagg

SEQ ID NO: 5584489 - DNA, 18 bp, Homo sapiens
cagcagaaacccccagga

SEQ ID NO: 5584490 - DNA, 19 bp, Homo sapiens
cagcagaaacccccaggag

SEQ ID NO: 5584491 - DNA, 12 bp, Homo sapiens
cagcagaaagac

SEQ ID NO: 5584492 - DNA, 15 bp, Homo sapiens
cagcagaaatgcctt

SEQ ID NO: 5584493 - DNA, 16 bp, Homo sapiens
cagcagaacctgcaca

SEQ ID NO: 5584494 - DNA, 13 bp, Homo sapiens
cagcagaacctgt

SEQ ID NO: 5584495 - DNA, 16 bp, Homo sapiens
cagcagaacctgtagg

SEQ ID NO: 5584496 - DNA, 24 bp, Homo sapiens
cagcagaactgaagtgtgctgtga

SEQ ID NO: 5584497 - DNA, 16 bp, Homo sapiens
cagcagaagagggagg

SEQ ID NO: 5584498 - DNA, 15 bp, Homo sapiens
cagcagaaggccttg

SEQ ID NO: 5584499 - DNA, 18 bp, Homo sapiens
cagcagaaggccttgcct

SEQ ID NO: 5584500 - DNA, 13 bp, Homo sapiens
cagcagaaggggg

SEQ ID NO: 5584501 - DNA, 13 bp, Homo sapiens
cagcagaatgaag

SEQ ID NO: 5584502 - DNA, 18 bp, Homo sapiens
cagcagaatgactctgga

SEQ ID NO: 5584503 - DNA, 23 bp, Homo sapiens
cagcagaattgaccgacagcttt

SEQ ID NO: 5584504 - DNA, 17 bp, Homo sapiens
cagcagacaaaatgaaa

SEQ ID NO: 5584505 - DNA, 21 bp, Homo sapiens
cagcagacacacatgggcagc

SEQ ID NO: 5584506 - DNA, 23 bp, Homo sapiens
cagcagacacacatgggcagccc

SEQ ID NO: 5584507 - DNA, 12 bp, Homo sapiens
cagcagacagag

SEQ ID NO: 5584508 - DNA, 18 bp, Homo sapiens
cagcagacagagccagga

SEQ ID NO: 5584509 - DNA, 14 bp, Homo sapiens
cagcagacattgtc

SEQ ID NO: 5584510 - DNA, 16 bp, Homo sapiens
cagcagacattgtcag

SEQ ID NO: 5584511 - DNA, 14 bp, Homo sapiens
cagcagactatgaa

SEQ ID NO: 5584512 - DNA, 15 bp, Homo sapiens
cagcagactcagctc

SEQ ID NO: 5584513 - DNA, 18 bp, Homo sapiens
cagcagactcagctctga

SEQ ID NO: 5584514 - DNA, 13 bp, Homo sapiens
cagcagactgtgt

SEQ ID NO: 5584515 - DNA, 18 bp, Homo sapiens
cagcagagacttgggaca

SEQ ID NO: 5584516 - DNA, 10 bp, Homo sapiens
cagcagagag

SEQ ID NO: 5584517 - DNA, 23 bp, Homo sapiens
cagcagagagagagagagagaaa

SEQ ID NO: 5584518 - DNA, 17 bp, Homo sapiens
cagcagagagccctggg

SEQ ID NO: 5584519 - DNA, 23 bp, Homo sapiens
cagcagagaggtttgcagtccca

SEQ ID NO: 5584520 - DNA, 11 bp, Homo sapiens
cagcagagcac

SEQ ID NO: 5584521 - DNA, 11 bp, Homo sapiens
cagcagagcca

SEQ ID NO: 5584522 - DNA, 13 bp, Homo sapiens
cagcagagccagg

SEQ ID NO: 5584523 - DNA, 19 bp, Homo sapiens
cagcagagccagggcaggg

SEQ ID NO: 5584524 - DNA, 15 bp, Homo sapiens
cagcagagccatctg

SEQ ID NO: 5584525 - DNA, 14 bp, Homo sapiens
cagcagagccgccc

SEQ ID NO: 5584526 - DNA, 20 bp, Homo sapiens
cagcagagccgttcctggga

SEQ ID NO: 5584527 - DNA, 22 bp, Homo sapiens
cagcagagcggggtcccctctg

SEQ ID NO: 5584528 - DNA, 21 bp, Homo sapiens
cagcagaggacagtctggaga

SEQ ID NO: 5584529 - DNA, 23 bp, Homo sapiens
cagcagaggacagtctggagaag

SEQ ID NO: 5584530 - DNA, 11 bp, Homo sapiens
cagcagaggag

SEQ ID NO: 5584531 - DNA, 22 bp, Homo sapiens
cagcagaggcggtcttcaacat

SEQ ID NO: 5584532 - DNA, 16 bp, Homo sapiens
cagcagaggtgagaac

SEQ ID NO: 5584533 - DNA, 21 bp, Homo sapiens
cagcagaggtgagaactcaga

SEQ ID NO: 5584534 - DNA, 23 bp, Homo sapiens
cagcagaggtgagaactcagaag

SEQ ID NO: 5584535 - DNA, 20 bp, Homo sapiens
cagcagaggtttgctgacag

SEQ ID NO: 5584536 - DNA, 22 bp, Homo sapiens
cagcagagtgagcaagggggcc

SEQ ID NO: 5584537 - DNA, 15 bp, Homo sapiens
cagcagagtgcttta

SEQ ID NO: 5584538 - DNA, 13 bp, Homo sapiens
cagcagagtgtgg

SEQ ID NO: 5584539 - DNA, 20 bp, Homo sapiens
cagcagagttattgaatctt

SEQ ID NO: 5584540 - DNA, 22 bp, Homo sapiens
cagcagagttattgaatcttaa

SEQ ID NO: 5584541 - DNA, 19 bp, Homo sapiens
cagcagagttgtcttaaat

SEQ ID NO: 5584542 - DNA, 24 bp, Homo sapiens
cagcagataacaatgcagcaaggc

SEQ ID NO: 5584543 - DNA, 22 bp, Homo sapiens
cagcagataaggccgagcccac

SEQ ID NO: 5584544 - DNA, 13 bp, Homo sapiens
cagcagatccacc

SEQ ID NO: 5584545 - DNA, 16 bp, Homo sapiens
cagcagatccacctgc

SEQ ID NO: 5584546 - DNA, 18 bp, Homo sapiens
cagcagatcccagctcac

SEQ ID NO: 5584547 - DNA, 18 bp, Homo sapiens
cagcagatgccagtgaag

SEQ ID NO: 5584548 - DNA, 17 bp, Homo sapiens
cagcagatggaaagaaa

SEQ ID NO: 5584549 - DNA, 18 bp, Homo sapiens
cagcagatggaaagaaag

SEQ ID NO: 5584550 - DNA, 16 bp, Homo sapiens
cagcagatgtttaatg

SEQ ID NO: 5584551 - DNA, 18 bp, Homo sapiens
cagcagatgtttaatgaa

SEQ ID NO: 5584552 - DNA, 17 bp, Homo sapiens
cagcagattccacagga

SEQ ID NO: 5584553 - DNA, 20 bp, Homo sapiens
cagcagattccacaggacac

SEQ ID NO: 5584554 - DNA, 14 bp, Homo sapiens
cagcagattggaag

SEQ ID NO: 5584555 - DNA, 15 bp, Homo sapiens
cagcagattggaagg

SEQ ID NO: 5584556 - DNA, 23 bp, Homo sapiens
cagcagattggaaggagacacag

SEQ ID NO: 5584557 - DNA, 13 bp, Homo sapiens
cagcagattttag

SEQ ID NO: 5584558 - DNA, 14 bp, Homo sapiens
cagcagcaacaact

SEQ ID NO: 5584559 - DNA, 11 bp, Homo sapiens
cagcagcaaga

SEQ ID NO: 5584560 - DNA, 13 bp, Homo sapiens
cagcagcaagaaa

SEQ ID NO: 5584561 - DNA, 15 bp, Homo sapiens
cagcagcaagaaaaa

SEQ ID NO: 5584562 - DNA, 14 bp, Homo sapiens
cagcagcaagtaca

SEQ ID NO: 5584563 - DNA, 23 bp, Homo sapiens
cagcagcaatgcaatgtggaaat

SEQ ID NO: 5584564 - DNA, 23 bp, Homo sapiens
cagcagcacaattctgtccctgt

SEQ ID NO: 5584565 - DNA, 19 bp, Homo sapiens
cagcagcacacctcagccc

SEQ ID NO: 5584566 - DNA, 12 bp, Homo sapiens
cagcagcaccca

SEQ ID NO: 5584567 - DNA, 22 bp, Homo sapiens
cagcagcacctgccctacctgc

SEQ ID NO: 5584568 - DNA, 19 bp, Homo sapiens
cagcagcacctttctctga

SEQ ID NO: 5584569 - DNA, 20 bp, Homo sapiens
cagcagcacctttctctgag

SEQ ID NO: 5584570 - DNA, 20 bp, Homo sapiens
cagcagcactcccgctgcac

SEQ ID NO: 5584571 - DNA, 22 bp, Homo sapiens
cagcagcactggaaccacctgg

SEQ ID NO: 5584572 - DNA, 15 bp, Homo sapiens
cagcagcagagagcc

SEQ ID NO: 5584573 - DNA, 15 bp, Homo sapiens
cagcagcagcaacct

SEQ ID NO: 5584574 - DNA, 14 bp, Homo sapiens
cagcagcagcagca

SEQ ID NO: 5584575 - DNA, 13 bp, Homo sapiens
cagcagcagcagg

SEQ ID NO: 5584576 - DNA, 16 bp, Homo sapiens
cagcagcagcccaagc

SEQ ID NO: 5584577 - DNA, 15 bp, Homo sapiens
cagcagcagccctgc

SEQ ID NO: 5584578 - DNA, 16 bp, Homo sapiens
cagcagcagccctgcc

SEQ ID NO: 5584579 - DNA, 15 bp, Homo sapiens
cagcagcagcctgca

SEQ ID NO: 5584580 - DNA, 13 bp, Homo sapiens
cagcagcagctct

SEQ ID NO: 5584581 - DNA, 15 bp, Homo sapiens
cagcagcagctctga

SEQ ID NO: 5584582 - DNA, 22 bp, Homo sapiens
cagcagcaggatgggctgagct

SEQ ID NO: 5584583 - DNA, 10 bp, Homo sapiens
cagcagcata

SEQ ID NO: 5584584 - DNA, 21 bp, Homo sapiens
cagcagcatcccagccttgag

SEQ ID NO: 5584585 - DNA, 11 bp, Homo sapiens
cagcagccagc

SEQ ID NO: 5584586 - DNA, 13 bp, Homo sapiens
cagcagccagcac

SEQ ID NO: 5584587 - DNA, 15 bp, Homo sapiens
cagcagccagccctg

SEQ ID NO: 5584588 - DNA, 23 bp, Homo sapiens
cagcagccagccctgcctggagg

SEQ ID NO: 5584589 - DNA, 17 bp, Homo sapiens
cagcagccagctctcag

SEQ ID NO: 5584590 - DNA, 20 bp, Homo sapiens
cagcagccagctctcagcca

SEQ ID NO: 5584591 - DNA, 21 bp, Homo sapiens
cagcagccagggacccccaga

SEQ ID NO: 5584592 - DNA, 22 bp, Homo sapiens
cagcagccagggacccccagaa

SEQ ID NO: 5584593 - DNA, 13 bp, Homo sapiens
cagcagccagtct

SEQ ID NO: 5584594 - DNA, 21 bp, Homo sapiens
cagcagccatcataggaaggg

SEQ ID NO: 5584595 - DNA, 16 bp, Homo sapiens
cagcagcccaagctta

SEQ ID NO: 5584596 - DNA, 20 bp, Homo sapiens
cagcagcccaagcttccctc

SEQ ID NO: 5584597 - DNA, 19 bp, Homo sapiens
cagcagcccatggcctctg

SEQ ID NO: 5584598 - DNA, 20 bp, Homo sapiens
cagcagcccccagctcccac

SEQ ID NO: 5584599 - DNA, 23 bp, Homo sapiens
cagcagcccccagctcccacctc

SEQ ID NO: 5584600 - DNA, 22 bp, Homo sapiens
cagcatggcatccaagactctt

SEQ ID NO: 5584601 - DNA, 18 bp, Homo sapiens
cagcatgggtccttgatg

SEQ ID NO: 5584602 - DNA, 16 bp, Homo sapiens
cagcatggtgcatgcc

SEQ ID NO: 5584603 - DNA, 12 bp, Homo sapiens
cagcatgtacaa

SEQ ID NO: 5584604 - DNA, 14 bp, Homo sapiens
cagcatgtacaaaa

SEQ ID NO: 5584605 - DNA, 12 bp, Homo sapiens
cagcatgtcact

SEQ ID NO: 5584606 - DNA, 18 bp, Homo sapiens
cagcatgtcactcccaga

SEQ ID NO: 5584607 - DNA, 12 bp, Homo sapiens
cagcatgtctac

SEQ ID NO: 5584608 - DNA, 13 bp, Homo sapiens
cagcatgtctcag

SEQ ID NO: 5584609 - DNA, 19 bp, Homo sapiens
cagcatgtgccaagattct

SEQ ID NO: 5584610 - DNA, 16 bp, Homo sapiens
cagcatgtgccctcct

SEQ ID NO: 5584611 - DNA, 13 bp, Homo sapiens
cagcatgtgcctt

SEQ ID NO: 5584612 - DNA, 21 bp, Homo sapiens
cagcatgtgctcagccccaga

SEQ ID NO: 5584613 - DNA, 20 bp, Homo sapiens
cagcatgtgggtgtcagtgt

SEQ ID NO: 5584614 - DNA, 17 bp, Homo sapiens
cagcatgttgctgagga

SEQ ID NO: 5584615 - DNA, 18 bp, Homo sapiens
cagcatgttgctgaggag

SEQ ID NO: 5584616 - DNA, 16 bp, Homo sapiens
cagcatgttttctgct

SEQ ID NO: 5584617 - DNA, 19 bp, Homo sapiens
cagcatgttttctgcttta

SEQ ID NO: 5584618 - DNA, 19 bp, Homo sapiens
cagcattacctctttggaa

SEQ ID NO: 5584619 - DNA, 12 bp, Homo sapiens
cagcattagata

SEQ ID NO: 5584620 - DNA, 15 bp, Homo sapiens
cagcattcaaaatag

SEQ ID NO: 5584621 - DNA, 22 bp, Homo sapiens
cagcattcaaaatagttctatt

SEQ ID NO: 5584622 - DNA, 12 bp, Homo sapiens
cagcattcagca

SEQ ID NO: 5584623 - DNA, 15 bp, Homo sapiens
cagcattcagcacac

SEQ ID NO: 5584624 - DNA, 16 bp, Homo sapiens
cagcattcagcacaca

SEQ ID NO: 5584625 - DNA, 17 bp, Homo sapiens
cagcattcagcacaccc

SEQ ID NO: 5584626 - DNA, 21 bp, Homo sapiens
cagcattcagcacaccccaag

SEQ ID NO: 5584627 - DNA, 15 bp, Homo sapiens
cagcattcatttgtt

SEQ ID NO: 5584628 - DNA, 16 bp, Homo sapiens
cagcattccagcccct

SEQ ID NO: 5584629 - DNA, 14 bp, Homo sapiens
cagcattccagctc

SEQ ID NO: 5584630 - DNA, 14 bp, Homo sapiens
cagcattcccacca

SEQ ID NO: 5584631 - DNA, 17 bp, Homo sapiens
cagcattcccaccaaca

SEQ ID NO: 5584632 - DNA, 15 bp, Homo sapiens
cagcattcccaggga

SEQ ID NO: 5584633 - DNA, 23 bp, Homo sapiens
cagcattcccagggaccttggaa

SEQ ID NO: 5584634 - DNA, 17 bp, Homo sapiens
cagcattcccaggtagg

SEQ ID NO: 5584635 - DNA, 20 bp, Homo sapiens
cagcattcccaggtaggcca

SEQ ID NO: 5584636 - DNA, 13 bp, Homo sapiens
cagcattccctac

SEQ ID NO: 5584637 - DNA, 18 bp, Homo sapiens
cagcattctcaggcacca

SEQ ID NO: 5584638 - DNA, 14 bp, Homo sapiens
cagcattgactcag

SEQ ID NO: 5584639 - DNA, 19 bp, Homo sapiens
cagcattgatatttgtgca

SEQ ID NO: 5584640 - DNA, 21 bp, Homo sapiens
cagcattgatatttgtgcatt

SEQ ID NO: 5584641 - DNA, 22 bp, Homo sapiens
cagcattgatatttgtgcattt

SEQ ID NO: 5584642 - DNA, 15 bp, Homo sapiens
cagcattgctggttc

SEQ ID NO: 5584643 - DNA, 17 bp, Homo sapiens
cagcattgctggttcta

SEQ ID NO: 5584644 - DNA, 13 bp, Homo sapiens
cagcattgctttc

SEQ ID NO: 5584645 - DNA, 16 bp, Homo sapiens
cagcattgctttctga

SEQ ID NO: 5584646 - DNA, 22 bp, Homo sapiens
cagcattggcctggccagacca

SEQ ID NO: 5584647 - DNA, 18 bp, Homo sapiens
cagcattgtaattatgta

SEQ ID NO: 5584648 - DNA, 19 bp, Homo sapiens
cagcattgtctttgctgta

SEQ ID NO: 5584649 - DNA, 19 bp, Homo sapiens
cagcattgtgacttggaga

SEQ ID NO: 5584650 - DNA, 12 bp, Homo sapiens
cagcattgtgtg

SEQ ID NO: 5584651 - DNA, 15 bp, Homo sapiens
cagcattgtgtggaa

SEQ ID NO: 5584652 - DNA, 14 bp, Homo sapiens
cagcatttacagaa

SEQ ID NO: 5584653 - DNA, 13 bp, Homo sapiens
cagcatttactat

SEQ ID NO: 5584654 - DNA, 21 bp, Homo sapiens
cagcatttagctggccacatg

SEQ ID NO: 5584655 - DNA, 22 bp, Homo sapiens
cagcatttagctggccacatgg

SEQ ID NO: 5584656 - DNA, 22 bp, Homo sapiens
cagcatttagtgaagttgtgca

SEQ ID NO: 5584657 - DNA, 22 bp, Homo sapiens
cagcatttcctcagtctccctt

SEQ ID NO: 5584658 - DNA, 18 bp, Homo sapiens
cagcatttccttccagcc

SEQ ID NO: 5584659 - DNA, 19 bp, Homo sapiens
cagcatttccttccagccc

SEQ ID NO: 5584660 - DNA, 17 bp, Homo sapiens
cagcatttgataatgat

SEQ ID NO: 5584661 - DNA, 14 bp, Homo sapiens
cagcatttgatctg

SEQ ID NO: 5584662 - DNA, 20 bp, Homo sapiens
cagcatttgattaacatttg

SEQ ID NO: 5584663 - DNA, 20 bp, Homo sapiens
cagcatttgctttcctctga

SEQ ID NO: 5584664 - DNA, 14 bp, Homo sapiens
cagcatttggtttt

SEQ ID NO: 5584665 - DNA, 12 bp, Homo sapiens
cagcattttact

SEQ ID NO: 5584666 - DNA, 13 bp, Homo sapiens
cagcattttacta

SEQ ID NO: 5584667 - DNA, 21 bp, Homo sapiens
cagcattttcacattttgcct

SEQ ID NO: 5584668 - DNA, 14 bp, Homo sapiens
cagcattttgctgc

SEQ ID NO: 5584669 - DNA, 20 bp, Homo sapiens
cagcatttttaattttcaca

SEQ ID NO: 5584670 - DNA, 21 bp, Homo sapiens
cagcatttttaattttcacaa

SEQ ID NO: 5584671 - DNA, 18 bp, Homo sapiens
cagcatttttatttcaga

SEQ ID NO: 5584672 - DNA, 23 bp, Homo sapiens
cagcatttttctttagtcattta

SEQ ID NO: 5584673 - DNA, 18 bp, Homo sapiens
cagccaaaagtaagtgga

SEQ ID NO: 5584674 - DNA, 17 bp, Homo sapiens
cagccaaacacagagcg

SEQ ID NO: 5584675 - DNA, 20 bp, Homo sapiens
cagccaaacacagagcggga

SEQ ID NO: 5584676 - DNA, 14 bp, Homo sapiens
cagccaaacagagc

SEQ ID NO: 5584677 - DNA, 16 bp, Homo sapiens
cagccaaacagagcct

SEQ ID NO: 5584678 - DNA, 22 bp, Homo sapiens
cagccaaactgtagatgaagag

SEQ ID NO: 5584679 - DNA, 12 bp, Homo sapiens
cagccaaagaaa

SEQ ID NO: 5584680 - DNA, 13 bp, Homo sapiens
cagccaaagaaac

SEQ ID NO: 5584681 - DNA, 19 bp, Homo sapiens
cagccaaagaaatgggcct

SEQ ID NO: 5584682 - DNA, 20 bp, Homo sapiens
cagccaaagaaatgggcctg

SEQ ID NO: 5584683 - DNA, 20 bp, Homo sapiens
cagccaaagataatctctca

SEQ ID NO: 5584684 - DNA, 15 bp, Homo sapiens
cagccaaagcatgcc

SEQ ID NO: 5584685 - DNA, 16 bp, Homo sapiens
cagccaaagcctcctc

SEQ ID NO: 5584686 - DNA, 18 bp, Homo sapiens
cagccaaagcctcctcca

SEQ ID NO: 5584687 - DNA, 19 bp, Homo sapiens
cagccaaaggggagccaga

SEQ ID NO: 5584688 - DNA, 20 bp, Homo sapiens
cagccaaaggggagccagaa

SEQ ID NO: 5584689 - DNA, 20 bp, Homo sapiens
cagccaaataaaacctcagg

SEQ ID NO: 5584690 - DNA, 22 bp, Homo sapiens
cagccaaatgacttcatttctg

SEQ ID NO: 5584691 - DNA, 22 bp, Homo sapiens
cagccaaatgtaattgaataaa

SEQ ID NO: 5584692 - DNA, 14 bp, Homo sapiens
cagccaaattgcag

SEQ ID NO: 5584693 - DNA, 14 bp, Homo sapiens
cagccaaatttaaa

SEQ ID NO: 5584694 - DNA, 19 bp, Homo sapiens
cagccaacacgcacctgcc

SEQ ID NO: 5584695 - DNA, 20 bp, Homo sapiens
cagccaacacgcacctgcct

SEQ ID NO: 5584696 - DNA, 15 bp, Homo sapiens
cagccaacagctaca

SEQ ID NO: 5584697 - DNA, 18 bp, Homo sapiens
cagccaacaggtggcagg

SEQ ID NO: 5584698 - DNA, 22 bp, Homo sapiens
cagccaacattgccttgcattt

SEQ ID NO: 5584699 - DNA, 14 bp, Homo sapiens
cagccaacccctgt

SEQ ID NO: 5584700 - DNA, 19 bp, Homo sapiens
cagccaacgagacacattg

SEQ ID NO: 5584701 - DNA, 23 bp, Homo sapiens
cagccaacgagacacattgcctt

SEQ ID NO: 5584702 - DNA, 22 bp, Homo sapiens
cagccaactagcccctggggtg

SEQ ID NO: 5584703 - DNA, 17 bp, Homo sapiens
cagccaagaagcctgca

SEQ ID NO: 5584704 - DNA, 13 bp, Homo sapiens
cagccaagaccat

SEQ ID NO: 5584705 - DNA, 22 bp, Homo sapiens
cagccaagattttcctcttgtg

SEQ ID NO: 5584706 - DNA, 23 bp, Homo sapiens
cagccaagattttcctcttgtga

SEQ ID NO: 5584707 - DNA, 11 bp, Homo sapiens
cagccaagcac

SEQ ID NO: 5584708 - DNA, 16 bp, Homo sapiens
cagccaagcacagtgg

SEQ ID NO: 5584709 - DNA, 16 bp, Homo sapiens
cagccaagcctgactt

SEQ ID NO: 5584710 - DNA, 13 bp, Homo sapiens
cagccaagcttgt

SEQ ID NO: 5584711 - DNA, 13 bp, Homo sapiens
cagccaaggaatg

SEQ ID NO: 5584712 - DNA, 20 bp, Homo sapiens
cagccaaggaatgtgtccaa

SEQ ID NO: 5584713 - DNA, 22 bp, Homo sapiens
cagccaaggccgaagctctggc

SEQ ID NO: 5584714 - DNA, 23 bp, Homo sapiens
cagccaaggccgaagctctggct

SEQ ID NO: 5584715 - DNA, 18 bp, Homo sapiens
cagccaaggggctgcgct

SEQ ID NO: 5584716 - DNA, 14 bp, Homo sapiens
cagccaagtgcaga

SEQ ID NO: 5584717 - DNA, 16 bp, Homo sapiens
cagccaagtgcagagt

SEQ ID NO: 5584718 - DNA, 20 bp, Homo sapiens
cagccaagtgccaaatgctc

SEQ ID NO: 5584719 - DNA, 14 bp, Homo sapiens
cagccaagtgcctt

SEQ ID NO: 5584720 - DNA, 14 bp, Homo sapiens
cagccaagttttat

SEQ ID NO: 5584721 - DNA, 21 bp, Homo sapiens
cagccaataaatcaactccag

SEQ ID NO: 5584722 - DNA, 23 bp, Homo sapiens
cagccaataaatcaactccagct

SEQ ID NO: 5584723 - DNA, 15 bp, Homo sapiens
cagccaatatttaaa

SEQ ID NO: 5584724 - DNA, 20 bp, Homo sapiens
cagccaatctagaggcaagc

SEQ ID NO: 5584725 - DNA, 20 bp, Homo sapiens
cagccaatctccaggctccc

SEQ ID NO: 5584726 - DNA, 22 bp, Homo sapiens
cagccaatctccaggctccctc

SEQ ID NO: 5584727 - DNA, 20 bp, Homo sapiens
cagccaatttcaaagaaaac

SEQ ID NO: 5584728 - DNA, 22 bp, Homo sapiens
cagccaatttcaaagaaaacag

SEQ ID NO: 5584729 - DNA, 17 bp, Homo sapiens
cagccaatttcccggag

SEQ ID NO: 5584730 - DNA, 12 bp, Homo sapiens
cagccacacaca

SEQ ID NO: 5584731 - DNA, 18 bp, Homo sapiens
cagccacacacacagaaa

SEQ ID NO: 5584732 - DNA, 23 bp, Homo sapiens
cagccacacacacagaaaatata

SEQ ID NO: 5584733 - DNA, 16 bp, Homo sapiens
cagccacacagagcct

SEQ ID NO: 5584734 - DNA, 14 bp, Homo sapiens
cagccacaccgctg

SEQ ID NO: 5584735 - DNA, 13 bp, Homo sapiens
cagccacactggg

SEQ ID NO: 5584736 - DNA, 14 bp, Homo sapiens
cagccacactgggc

SEQ ID NO: 5584737 - DNA, 15 bp, Homo sapiens
cagccacacttcctt

SEQ ID NO: 5584738 - DNA, 15 bp, Homo sapiens
cagccacagacccct

SEQ ID NO: 5584739 - DNA, 17 bp, Homo sapiens
cagccacagacccctgg

SEQ ID NO: 5584740 - DNA, 20 bp, Homo sapiens
cagccacagacccctgggag

SEQ ID NO: 5584741 - DNA, 23 bp, Homo sapiens
cagccacagagcaaaagagggtt

SEQ ID NO: 5584742 - DNA, 10 bp, Homo sapiens
cagccacagg

SEQ ID NO: 5584743 - DNA, 12 bp, Homo sapiens
cagccacaggac

SEQ ID NO: 5584744 - DNA, 13 bp, Homo sapiens
cagccacaggacc

SEQ ID NO: 5584745 - DNA, 15 bp, Homo sapiens
cagccacaggaccac

SEQ ID NO: 5584746 - DNA, 16 bp, Homo sapiens
cagccacaggaccacc

SEQ ID NO: 5584747 - DNA, 23 bp, Homo sapiens
cagccacaggactgagccctctc

SEQ ID NO: 5584748 - DNA, 22 bp, Homo sapiens
cagccacagggaagctcacaca

SEQ ID NO: 5584749 - DNA, 14 bp, Homo sapiens
cagccacaggggat

SEQ ID NO: 5584750 - DNA, 11 bp, Homo sapiens
cagccacatat

SEQ ID NO: 5584751 - DNA, 19 bp, Homo sapiens
cagccacatccccaagccc

SEQ ID NO: 5584752 - DNA, 12 bp, Homo sapiens
cagccacatgcc

SEQ ID NO: 5584753 - DNA, 15 bp, Homo sapiens
cagccaccaaggctg

SEQ ID NO: 5584754 - DNA, 15 bp, Homo sapiens
cagccaccaccactg

SEQ ID NO: 5584755 - DNA, 22 bp, Homo sapiens
cagccaccaccctcaggtgcct

SEQ ID NO: 5584756 - DNA, 17 bp, Homo sapiens
cagccaccactcagtgc

SEQ ID NO: 5584757 - DNA, 12 bp, Homo sapiens
cagccaccagcg

SEQ ID NO: 5584758 - DNA, 14 bp, Homo sapiens
cagccaccagtgga

SEQ ID NO: 5584759 - DNA, 24 bp, Homo sapiens
cagccaccagtggacctagcctgg

SEQ ID NO: 5584760 - DNA, 11 bp, Homo sapiens
cagccacccaa

SEQ ID NO: 5584761 - DNA, 14 bp, Homo sapiens
cagccacccaagcc

SEQ ID NO: 5584762 - DNA, 15 bp, Homo sapiens
cagccacccaagcct

SEQ ID NO: 5584763 - DNA, 17 bp, Homo sapiens
cagccacccaagcctgc

SEQ ID NO: 5584764 - DNA, 21 bp, Homo sapiens
cagccacccaagcctgctggc

SEQ ID NO: 5584765 - DNA, 17 bp, Homo sapiens
cagccacccagccagga

SEQ ID NO: 5584766 - DNA, 15 bp, Homo sapiens
cagccaccccatgct

SEQ ID NO: 5584767 - DNA, 15 bp, Homo sapiens
cagccacccccaggc

SEQ ID NO: 5584768 - DNA, 17 bp, Homo sapiens
cagccacccccaggcat

SEQ ID NO: 5584769 - DNA, 21 bp, Homo sapiens
cagccaccccctcccccatca

SEQ ID NO: 5584770 - DNA, 17 bp, Homo sapiens
cagccaccccgggctct

SEQ ID NO: 5584771 - DNA, 20 bp, Homo sapiens
cagccaccccgggctctctg

SEQ ID NO: 5584772 - DNA, 13 bp, Homo sapiens
cagccacccctca

SEQ ID NO: 5584773 - DNA, 23 bp, Homo sapiens
cagccacccctcctctagctctg

SEQ ID NO: 5584774 - DNA, 13 bp, Homo sapiens
cagccacccctgc

SEQ ID NO: 5584775 - DNA, 22 bp, Homo sapiens
cagccacccctgccactcaccc

SEQ ID NO: 5584776 - DNA, 22 bp, Homo sapiens
cagccacccggatctccaggcc

SEQ ID NO: 5584777 - DNA, 23 bp, Homo sapiens
cagccacccggatctccaggccc

SEQ ID NO: 5584778 - DNA, 18 bp, Homo sapiens
cagcccatgtcaatcaag

SEQ ID NO: 5584779 - DNA, 18 bp, Homo sapiens
cagcccattctctctcct

SEQ ID NO: 5584780 - DNA, 21 bp, Homo sapiens
cagcccattctctctcctgtc

SEQ ID NO: 5584781 - DNA, 19 bp, Homo sapiens
cagcccattgctgccaagg

SEQ ID NO: 5584782 - DNA, 22 bp, Homo sapiens
cagcccattggccgagctcctg

SEQ ID NO: 5584783 - DNA, 23 bp, Homo sapiens
cagcccattggccgagctcctgg

SEQ ID NO: 5584784 - DNA, 13 bp, Homo sapiens
cagcccatttctc

SEQ ID NO: 5584785 - DNA, 16 bp, Homo sapiens
cagcccatttctccag

SEQ ID NO: 5584786 - DNA, 20 bp, Homo sapiens
cagcccatttctccagaacc

SEQ ID NO: 5584787 - DNA, 17 bp, Homo sapiens
cagcccatttgggcaga

SEQ ID NO: 5584788 - DNA, 16 bp, Homo sapiens
cagccccaaaccaggg

SEQ ID NO: 5584789 - DNA, 21 bp, Homo sapiens
cagccccaagcttctgagtct

SEQ ID NO: 5584790 - DNA, 12 bp, Homo sapiens
cagccccaaggg

SEQ ID NO: 5584791 - DNA, 21 bp, Homo sapiens
cagccccaatccagagaagcg

SEQ ID NO: 5584792 - DNA, 11 bp, Homo sapiens
cagccccacac

SEQ ID NO: 5584793 - DNA, 13 bp, Homo sapiens
cagccccacacca

SEQ ID NO: 5584794 - DNA, 21 bp, Homo sapiens
cagccccacaccagggccagc

SEQ ID NO: 5584795 - DNA, 13 bp, Homo sapiens
cagccccacagcc

SEQ ID NO: 5584796 - DNA, 14 bp, Homo sapiens
cagccccacagccc

SEQ ID NO: 5584797 - DNA, 16 bp, Homo sapiens
cagccccacagcccac

SEQ ID NO: 5584798 - DNA, 20 bp, Homo sapiens
cagccccacagcccacgtcc

SEQ ID NO: 5584799 - DNA, 21 bp, Homo sapiens
cagccccacagtcccattcct

SEQ ID NO: 5584800 - DNA, 12 bp, Homo sapiens
cagccccaccca

SEQ ID NO: 5584801 - DNA, 22 bp, Homo sapiens
cagccccacccaggagggaggg

SEQ ID NO: 5584802 - DNA, 21 bp, Homo sapiens
cagccccaccccagggcagcc

SEQ ID NO: 5584803 - DNA, 23 bp, Homo sapiens
cagccccacccccagccaggcta

SEQ ID NO: 5584804 - DNA, 23 bp, Homo sapiens
cagccccacccctaagtgcccaa

SEQ ID NO: 5584805 - DNA, 14 bp, Homo sapiens
cagccccacccttg

SEQ ID NO: 5584806 - DNA, 13 bp, Homo sapiens
cagccccacggga

SEQ ID NO: 5584807 - DNA, 13 bp, Homo sapiens
cagccccactgcc

SEQ ID NO: 5584808 - DNA, 20 bp, Homo sapiens
cagccccactgccagcagca

SEQ ID NO: 5584809 - DNA, 21 bp, Homo sapiens
cagccccactgccagcagcag

SEQ ID NO: 5584810 - DNA, 22 bp, Homo sapiens
cagccccactgccagcagcagc

SEQ ID NO: 5584811 - DNA, 14 bp, Homo sapiens
cagccccactgccc

SEQ ID NO: 5584812 - DNA, 20 bp, Homo sapiens
cagccccactgccctccagg

SEQ ID NO: 5584813 - DNA, 23 bp, Homo sapiens
cagccccactgccctccagggcc

SEQ ID NO: 5584814 - DNA, 12 bp, Homo sapiens
cagccccagaga

SEQ ID NO: 5584815 - DNA, 17 bp, Homo sapiens
cagccccagagagagga

SEQ ID NO: 5584816 - DNA, 15 bp, Homo sapiens
cagccccagccaggg

SEQ ID NO: 5584817 - DNA, 15 bp, Homo sapiens
cagccccagcctgct

SEQ ID NO: 5584818 - DNA, 17 bp, Homo sapiens
cagccccagcctgctag

SEQ ID NO: 5584819 - DNA, 19 bp, Homo sapiens
cagccccagcgagtctgga

SEQ ID NO: 5584820 - DNA, 23 bp, Homo sapiens
cagccccagcgagtctggagacc

SEQ ID NO: 5584821 - DNA, 16 bp, Homo sapiens
cagccccaggaccaag

SEQ ID NO: 5584822 - DNA, 16 bp, Homo sapiens
cagccccaggccagct

SEQ ID NO: 5584823 - DNA, 14 bp, Homo sapiens
cagccccaggcctg

SEQ ID NO: 5584824 - DNA, 16 bp, Homo sapiens
cagccccaggcctggc

SEQ ID NO: 5584825 - DNA, 16 bp, Homo sapiens
cagccccagggccctg

SEQ ID NO: 5584826 - DNA, 18 bp, Homo sapiens
cagccccagggccctgct

SEQ ID NO: 5584827 - DNA, 15 bp, Homo sapiens
cagccccagggcctg

SEQ ID NO: 5584828 - DNA, 14 bp, Homo sapiens
cagccccaggggtg

SEQ ID NO: 5584829 - DNA, 18 bp, Homo sapiens
cagccccagtgcccacag

SEQ ID NO: 5584830 - DNA, 18 bp, Homo sapiens
cagccccatagaaaacaa

SEQ ID NO: 5584831 - DNA, 13 bp, Homo sapiens
cagccccatcaga

SEQ ID NO: 5584832 - DNA, 21 bp, Homo sapiens
cagccccatcccaaacccttc

SEQ ID NO: 5584833 - DNA, 16 bp, Homo sapiens
cagccccatccctgtc

SEQ ID NO: 5584834 - DNA, 17 bp, Homo sapiens
cagccccatccctgtcc

SEQ ID NO: 5584835 - DNA, 12 bp, Homo sapiens
cagccccatcct

SEQ ID NO: 5584836 - DNA, 16 bp, Homo sapiens
cagccccatcctctgt

SEQ ID NO: 5584837 - DNA, 20 bp, Homo sapiens
cagccccatctgtgcattct

SEQ ID NO: 5584838 - DNA, 22 bp, Homo sapiens
cagccccatcttggtcctgtca

SEQ ID NO: 5584839 - DNA, 22 bp, Homo sapiens
cagccccattctgcctgcccag

SEQ ID NO: 5584840 - DNA, 15 bp, Homo sapiens
cagcccccaaagagc

SEQ ID NO: 5584841 - DNA, 18 bp, Homo sapiens
cagcccccaaccccaaga

SEQ ID NO: 5584842 - DNA, 14 bp, Homo sapiens
cagcccccacagcc

SEQ ID NO: 5584843 - DNA, 20 bp, Homo sapiens
cagcccccacagtgctgtct

SEQ ID NO: 5584844 - DNA, 21 bp, Homo sapiens
cagcccccacagtgctgtctg

SEQ ID NO: 5584845 - DNA, 17 bp, Homo sapiens
cagcccccacatcctgt

SEQ ID NO: 5584846 - DNA, 22 bp, Homo sapiens
cagcccccaccccagcacagct

SEQ ID NO: 5584847 - DNA, 17 bp, Homo sapiens
cagcccccacccccgtc

SEQ ID NO: 5584848 - DNA, 22 bp, Homo sapiens
cagcccccacctccgccccaga

SEQ ID NO: 5584849 - DNA, 13 bp, Homo sapiens
cagcccccactcc

SEQ ID NO: 5584850 - DNA, 16 bp, Homo sapiens
cagcccccactgacct

SEQ ID NO: 5584851 - DNA, 21 bp, Homo sapiens
cagcccccactgacctgccca

SEQ ID NO: 5584852 - DNA, 22 bp, Homo sapiens
cagcccccactttcctacaaaa

SEQ ID NO: 5584853 - DNA, 15 bp, Homo sapiens
cagcccccagcccct

SEQ ID NO: 5584854 - DNA, 18 bp, Homo sapiens
cagcccccaggatctggg

SEQ ID NO: 5584855 - DNA, 13 bp, Homo sapiens
cagcccccaggcc

SEQ ID NO: 5584856 - DNA, 15 bp, Homo sapiens
cagcccccaggccag

SEQ ID NO: 5584857 - DNA, 13 bp, Homo sapiens
cagcccccagggc

SEQ ID NO: 5584858 - DNA, 17 bp, Homo sapiens
cagcccccagtgcgctc

SEQ ID NO: 5584859 - DNA, 20 bp, Homo sapiens
cagcccccatcacccaagcc

SEQ ID NO: 5584860 - DNA, 14 bp, Homo sapiens
cagccccccacccc

SEQ ID NO: 5584861 - DNA, 19 bp, Homo sapiens
cagccccccaccccacaga

SEQ ID NO: 5584862 - DNA, 15 bp, Homo sapiens
cagccccccaggctg

SEQ ID NO: 5584863 - DNA, 17 bp, Homo sapiens
cagccccccaggctgcc

SEQ ID NO: 5584864 - DNA, 16 bp, Homo sapiens
cagccccccagtgtcc

SEQ ID NO: 5584865 - DNA, 21 bp, Homo sapiens
cagccccccagtgtccccagg

SEQ ID NO: 5584866 - DNA, 12 bp, Homo sapiens
cagcccccccac

SEQ ID NO: 5584867 - DNA, 17 bp, Homo sapiens
cagcccccccacccacc

SEQ ID NO: 5584868 - DNA, 22 bp, Homo sapiens
cagcccccccacccacccccag

SEQ ID NO: 5584869 - DNA, 23 bp, Homo sapiens
cagcccccccacccacccccagg

SEQ ID NO: 5584870 - DNA, 13 bp, Homo sapiens
cagcccccccctc

SEQ ID NO: 5584871 - DNA, 15 bp, Homo sapiens
cagcccccccctcaa

SEQ ID NO: 5584872 - DNA, 19 bp, Homo sapiens
cagccccctaaaagcactc

SEQ ID NO: 5584873 - DNA, 17 bp, Homo sapiens
cagccccctaagagagc

SEQ ID NO: 5584874 - DNA, 19 bp, Homo sapiens
cagccccctaagagagcac

SEQ ID NO: 5584875 - DNA, 12 bp, Homo sapiens
cagccccctcac

SEQ ID NO: 5584876 - DNA, 14 bp, Homo sapiens
cagccccctcacag

SEQ ID NO: 5584877 - DNA, 11 bp, Homo sapiens
cagccccctcc

SEQ ID NO: 5584878 - DNA, 13 bp, Homo sapiens
cagccccctccac

SEQ ID NO: 5584879 - DNA, 16 bp, Homo sapiens
cagccccctccacacc

SEQ ID NO: 5584880 - DNA, 19 bp, Homo sapiens
cagccccctccagctcatg

SEQ ID NO: 5584881 - DNA, 14 bp, Homo sapiens
cagccccctcccac

SEQ ID NO: 5584882 - DNA, 21 bp, Homo sapiens
cagccccctcccaccgctgcc

SEQ ID NO: 5584883 - DNA, 22 bp, Homo sapiens
cagccccctcccaccgctgcct

SEQ ID NO: 5584884 - DNA, 18 bp, Homo sapiens
cagccccctgaccactca

SEQ ID NO: 5584885 - DNA, 20 bp, Homo sapiens
cagccccctgaccactcaga

SEQ ID NO: 5584886 - DNA, 22 bp, Homo sapiens
cagccccctgaccactcagaga

SEQ ID NO: 5584887 - DNA, 12 bp, Homo sapiens
cagccccctggc

SEQ ID NO: 5584888 - DNA, 17 bp, Homo sapiens
cagccccctggcatgtt

SEQ ID NO: 5584889 - DNA, 22 bp, Homo sapiens
cagccccctttgggcccaggga

SEQ ID NO: 5584890 - DNA, 16 bp, Homo sapiens
cagccccgactccagc

SEQ ID NO: 5584891 - DNA, 17 bp, Homo sapiens
cagccccgactccagcc

SEQ ID NO: 5584892 - DNA, 20 bp, Homo sapiens
cagccccgactccagccagc

SEQ ID NO: 5584893 - DNA, 21 bp, Homo sapiens
cagccccgactccagccagcg

SEQ ID NO: 5584894 - DNA, 16 bp, Homo sapiens
cagccccgacttcctg

SEQ ID NO: 5584895 - DNA, 19 bp, Homo sapiens
cagccccgacttcctgact

SEQ ID NO: 5584896 - DNA, 18 bp, Homo sapiens
cagccccgcctccaggcc

SEQ ID NO: 5584897 - DNA, 13 bp, Homo sapiens
cagccccgcctgt

SEQ ID NO: 5584898 - DNA, 17 bp, Homo sapiens
cagccccgcctgtcaca

SEQ ID NO: 5584899 - DNA, 23 bp, Homo sapiens
cagccccgcgaccacccctgtgc

SEQ ID NO: 5584900 - DNA, 21 bp, Homo sapiens
cagccccgcggatcaaccagg

SEQ ID NO: 5584901 - DNA, 14 bp, Homo sapiens
cagccccgctccca

SEQ ID NO: 5584902 - DNA, 13 bp, Homo sapiens
cagccccggccac

SEQ ID NO: 5584903 - DNA, 14 bp, Homo sapiens
cagccccggccact

SEQ ID NO: 5584904 - DNA, 18 bp, Homo sapiens
cagccccggggccccctg

SEQ ID NO: 5584905 - DNA, 21 bp, Homo sapiens
cagccccggggccccctggtc

SEQ ID NO: 5584906 - DNA, 19 bp, Homo sapiens
cagccccggtggctgggca

SEQ ID NO: 5584907 - DNA, 20 bp, Homo sapiens
cagccccggtggctgggcag

SEQ ID NO: 5584908 - DNA, 17 bp, Homo sapiens
cagccccgtcccagagg

SEQ ID NO: 5584909 - DNA, 22 bp, Homo sapiens
cagccccgtgtagccccgggct

SEQ ID NO: 5584910 - DNA, 18 bp, Homo sapiens
cagccccgttttggggac

SEQ ID NO: 5584911 - DNA, 20 bp, Homo sapiens
cagcccctacccctgccctg

SEQ ID NO: 5584912 - DNA, 12 bp, Homo sapiens
cagcccctagaa

SEQ ID NO: 5584913 - DNA, 13 bp, Homo sapiens
cagcccctagaaa

SEQ ID NO: 5584914 - DNA, 16 bp, Homo sapiens
cagcccctagaaaccc

SEQ ID NO: 5584915 - DNA, 21 bp, Homo sapiens
cagcccctagaaacccaagct

SEQ ID NO: 5584916 - DNA, 24 bp, Homo sapiens
cagcccctagaaacccaagctcct

SEQ ID NO: 5584917 - DNA, 14 bp, Homo sapiens
cagcccctagcaga

SEQ ID NO: 5584918 - DNA, 16 bp, Homo sapiens
cagcccctagcagagc

SEQ ID NO: 5584919 - DNA, 12 bp, Homo sapiens
cagcccctagcc

SEQ ID NO: 5584920 - DNA, 12 bp, Homo sapiens
cagcccctagga

SEQ ID NO: 5584921 - DNA, 21 bp, Homo sapiens
cagcccctatagcactgagct

SEQ ID NO: 5584922 - DNA, 14 bp, Homo sapiens
cagcccctcaaccc

SEQ ID NO: 5584923 - DNA, 15 bp, Homo sapiens
cagcccctccatctg

SEQ ID NO: 5584924 - DNA, 14 bp, Homo sapiens
cagcccctcccacc

SEQ ID NO: 5584925 - DNA, 21 bp, Homo sapiens
cagcccctcccaccacagcag

SEQ ID NO: 5584926 - DNA, 20 bp, Homo sapiens
cagcccctccccacaccagt

SEQ ID NO: 5584927 - DNA, 21 bp, Homo sapiens
cagcccctccccagactctca

SEQ ID NO: 5584928 - DNA, 22 bp, Homo sapiens
cagcccctcccccatctcccac

SEQ ID NO: 5584929 - DNA, 15 bp, Homo sapiens
cagcccctccccgcc

SEQ ID NO: 5584930 - DNA, 22 bp, Homo sapiens
cagcccctccccgcctcctccc

SEQ ID NO: 5584931 - DNA, 12 bp, Homo sapiens
cagcccctcctc

SEQ ID NO: 5584932 - DNA, 18 bp, Homo sapiens
cagcccctcctccctcaa

SEQ ID NO: 5584933 - DNA, 19 bp, Homo sapiens
cagcccctcctctgccacc

SEQ ID NO: 5584934 - DNA, 15 bp, Homo sapiens
cagcccctcgaggcc

SEQ ID NO: 5584935 - DNA, 13 bp, Homo sapiens
cagcccctctggt

SEQ ID NO: 5584936 - DNA, 14 bp, Homo sapiens
cagcccctctggtc

SEQ ID NO: 5584937 - DNA, 22 bp, Homo sapiens
cagcccctctggtcgctcctgc

SEQ ID NO: 5584938 - DNA, 12 bp, Homo sapiens
cagcccctcttc

SEQ ID NO: 5584939 - DNA, 13 bp, Homo sapiens
cagcccctcttcc

SEQ ID NO: 5584940 - DNA, 14 bp, Homo sapiens
cagcccctcttccc

SEQ ID NO: 5584941 - DNA, 21 bp, Homo sapiens
cagcccctcttgccccccacc

SEQ ID NO: 5584942 - DNA, 23 bp, Homo sapiens
cagcccctgagagcctgtggagg

SEQ ID NO: 5584943 - DNA, 16 bp, Homo sapiens
cagcccctgatctctg

SEQ ID NO: 5584944 - DNA, 17 bp, Homo sapiens
cagcccctgatctctga

SEQ ID NO: 5584945 - DNA, 11 bp, Homo sapiens
cagcccctgca

SEQ ID NO: 5584946 - DNA, 13 bp, Homo sapiens
cagcccctgcaca

SEQ ID NO: 5584947 - DNA, 12 bp, Homo sapiens
cagcccctgcag

SEQ ID NO: 5584948 - DNA, 14 bp, Homo sapiens
cagcccctgcagac

SEQ ID NO: 5584949 - DNA, 22 bp, Homo sapiens
cagcccctgcagacgtctggcc

SEQ ID NO: 5584950 - DNA, 17 bp, Homo sapiens
cagcccctgccccagcc

SEQ ID NO: 5584951 - DNA, 23 bp, Homo sapiens
cagcccctgccccagcccaagtc

SEQ ID NO: 5584952 - DNA, 18 bp, Homo sapiens
cagcccctgcctgggttg

SEQ ID NO: 5584953 - DNA, 18 bp, Homo sapiens
cagcccctgctgtgtggg

SEQ ID NO: 5584954 - DNA, 16 bp, Homo sapiens
cagcccctggacccct

SEQ ID NO: 5584955 - DNA, 23 bp, Homo sapiens
cagcccctggacccctggggtgg

SEQ ID NO: 5584956 - DNA, 18 bp, Homo sapiens
cagcctcaaatccaggac

SEQ ID NO: 5584957 - DNA, 18 bp, Homo sapiens
cagcctcaacctccctgg

SEQ ID NO: 5584958 - DNA, 19 bp, Homo sapiens
cagcctcaacctcctgggc

SEQ ID NO: 5584959 - DNA, 21 bp, Homo sapiens
cagcctcaagtcactcccaag

SEQ ID NO: 5584960 - DNA, 13 bp, Homo sapiens
cagcctcacagaa

SEQ ID NO: 5584961 - DNA, 14 bp, Homo sapiens
cagcctcacagaag

SEQ ID NO: 5584962 - DNA, 15 bp, Homo sapiens
cagcctcacagatgc

SEQ ID NO: 5584963 - DNA, 22 bp, Homo sapiens
cagcctcacagatgctggcctc

SEQ ID NO: 5584964 - DNA, 14 bp, Homo sapiens
cagcctcacagtcc

SEQ ID NO: 5584965 - DNA, 20 bp, Homo sapiens
cagcctcacagtccttacca

SEQ ID NO: 5584966 - DNA, 17 bp, Homo sapiens
cagcctcacccctgccc

SEQ ID NO: 5584967 - DNA, 21 bp, Homo sapiens
cagcctcacccctgcccctgt

SEQ ID NO: 5584968 - DNA, 14 bp, Homo sapiens
cagcctcactccat

SEQ ID NO: 5584969 - DNA, 20 bp, Homo sapiens
cagcctcactccatttccca

SEQ ID NO: 5584970 - DNA, 21 bp, Homo sapiens
cagcctcacttggtctgccag

SEQ ID NO: 5584971 - DNA, 23 bp, Homo sapiens
cagcctcacttggtctgccaggc

SEQ ID NO: 5584972 - DNA, 15 bp, Homo sapiens
cagcctcagaagcct

SEQ ID NO: 5584973 - DNA, 16 bp, Homo sapiens
cagcctcagaagcctt

SEQ ID NO: 5584974 - DNA, 17 bp, Homo sapiens
cagcctcagaagccttc

SEQ ID NO: 5584975 - DNA, 21 bp, Homo sapiens
cagcctcagaaggccccagag

SEQ ID NO: 5584976 - DNA, 23 bp, Homo sapiens
cagcctcagaaggccccagagag

SEQ ID NO: 5584977 - DNA, 19 bp, Homo sapiens
cagcctcagagatctccct

SEQ ID NO: 5584978 - DNA, 22 bp, Homo sapiens
cagcctcagagatctcccttct

SEQ ID NO: 5584979 - DNA, 12 bp, Homo sapiens
cagcctcagagg

SEQ ID NO: 5584980 - DNA, 21 bp, Homo sapiens
cagcctcagaggagctctacc

SEQ ID NO: 5584981 - DNA, 13 bp, Homo sapiens
cagcctcagaggc

SEQ ID NO: 5584982 - DNA, 15 bp, Homo sapiens
cagcctcagagtggt

SEQ ID NO: 5584983 - DNA, 12 bp, Homo sapiens
cagcctcagccc

SEQ ID NO: 5584984 - DNA, 20 bp, Homo sapiens
cagcctcagcgcggccctcc

SEQ ID NO: 5584985 - DNA, 21 bp, Homo sapiens
cagcctcagcggaccactctt

SEQ ID NO: 5584986 - DNA, 13 bp, Homo sapiens
cagcctcagctca

SEQ ID NO: 5584987 - DNA, 21 bp, Homo sapiens
cagcctcaggactgggagccc

SEQ ID NO: 5584988 - DNA, 23 bp, Homo sapiens
cagcctcaggcttgagggagggc

SEQ ID NO: 5584989 - DNA, 22 bp, Homo sapiens
cagcctcagggacgactctgac

SEQ ID NO: 5584990 - DNA, 19 bp, Homo sapiens
cagcctcagggcttcctta

SEQ ID NO: 5584991 - DNA, 22 bp, Homo sapiens
cagcctcagtcctcccctcaca

SEQ ID NO: 5584992 - DNA, 21 bp, Homo sapiens
cagcctcagtgaccctggctc

SEQ ID NO: 5584993 - DNA, 14 bp, Homo sapiens
cagcctcagtgcag

SEQ ID NO: 5584994 - DNA, 15 bp, Homo sapiens
cagcctcagtgccac

SEQ ID NO: 5584995 - DNA, 16 bp, Homo sapiens
cagcctcagtgccact

SEQ ID NO: 5584996 - DNA, 20 bp, Homo sapiens
cagcctcatactcctgggct

SEQ ID NO: 5584997 - DNA, 18 bp, Homo sapiens
cagcctcatcctgagaga

SEQ ID NO: 5584998 - DNA, 20 bp, Homo sapiens
cagcctcattctgaggcctg

SEQ ID NO: 5584999 - DNA, 18 bp, Homo sapiens
cagcctcattgtgccaag

SEQ ID NO: 5585000 - DNA, 22 bp, Homo sapiens
cagcctccaaagtggagctggg

SEQ ID NO: 5585001 - DNA, 13 bp, Homo sapiens
cagcctccaagaa

SEQ ID NO: 5585002 - DNA, 14 bp, Homo sapiens
cagcctccaatgca

SEQ ID NO: 5585003 - DNA, 21 bp, Homo sapiens
cagcctccaatgcattggcct

SEQ ID NO: 5585004 - DNA, 23 bp, Homo sapiens
cagcctccaatgcattggcctct

SEQ ID NO: 5585005 - DNA, 18 bp, Homo sapiens
cagcctccaccttgctct

SEQ ID NO: 5585006 - DNA, 19 bp, Homo sapiens
cagcctccaccttgctctt

SEQ ID NO: 5585007 - DNA, 13 bp, Homo sapiens
cagcctccacttc

SEQ ID NO: 5585008 - DNA, 15 bp, Homo sapiens
cagcctccacttccc

SEQ ID NO: 5585009 - DNA, 17 bp, Homo sapiens
cagcctccacttccctc

SEQ ID NO: 5585010 - DNA, 12 bp, Homo sapiens
cagcctccagag

SEQ ID NO: 5585011 - DNA, 17 bp, Homo sapiens
cagcctccagagaagcc

SEQ ID NO: 5585012 - DNA, 18 bp, Homo sapiens
cagcctccagagaagccc

SEQ ID NO: 5585013 - DNA, 13 bp, Homo sapiens
cagcctccagagc

SEQ ID NO: 5585014 - DNA, 16 bp, Homo sapiens
cagcctccagagccag

SEQ ID NO: 5585015 - DNA, 18 bp, Homo sapiens
cagcctccagagccagcc

SEQ ID NO: 5585016 - DNA, 19 bp, Homo sapiens
cagcctccagagccagcct

SEQ ID NO: 5585017 - DNA, 22 bp, Homo sapiens
cagcctccagagccagcctggg

SEQ ID NO: 5585018 - DNA, 15 bp, Homo sapiens
cagcctccagcctct

SEQ ID NO: 5585019 - DNA, 12 bp, Homo sapiens
cagcctccaggc

SEQ ID NO: 5585020 - DNA, 18 bp, Homo sapiens
cagcctccaggcccccaa

SEQ ID NO: 5585021 - DNA, 15 bp, Homo sapiens
cagcctccagggcat

SEQ ID NO: 5585022 - DNA, 23 bp, Homo sapiens
cagcctccagggcattgctcagc

SEQ ID NO: 5585023 - DNA, 24 bp, Homo sapiens
cagcctccagggcattgctcagcc

SEQ ID NO: 5585024 - DNA, 22 bp, Homo sapiens
cagcctccagtctgctctcagc

SEQ ID NO: 5585025 - DNA, 16 bp, Homo sapiens
cagcctccagtgctgg

SEQ ID NO: 5585026 - DNA, 18 bp, Homo sapiens
cagcctccagtgctggct

SEQ ID NO: 5585027 - DNA, 14 bp, Homo sapiens
cagcctccatgctg

SEQ ID NO: 5585028 - DNA, 20 bp, Homo sapiens
cagcctccatgctgcctcca

SEQ ID NO: 5585029 - DNA, 15 bp, Homo sapiens
cagcctccatgtttt

SEQ ID NO: 5585030 - DNA, 18 bp, Homo sapiens
cagcctcccaaagtgctg

SEQ ID NO: 5585031 - DNA, 22 bp, Homo sapiens
cagcctcccaaagtgctgagat

SEQ ID NO: 5585032 - DNA, 22 bp, Homo sapiens
cagcctcccaaagtgctgggat

SEQ ID NO: 5585033 - DNA, 21 bp, Homo sapiens
cagcctcccaagtagctggga

SEQ ID NO: 5585034 - DNA, 22 bp, Homo sapiens
cagcctcccaagtagctgggat

SEQ ID NO: 5585035 - DNA, 18 bp, Homo sapiens
cagcctcccacaggtggt

SEQ ID NO: 5585036 - DNA, 15 bp, Homo sapiens
cagcctcccacagtg

SEQ ID NO: 5585037 - DNA, 19 bp, Homo sapiens
cagcctcccacccccatct

SEQ ID NO: 5585038 - DNA, 12 bp, Homo sapiens
cagcctcccaga

SEQ ID NO: 5585039 - DNA, 13 bp, Homo sapiens
cagcctcccagag

SEQ ID NO: 5585040 - DNA, 14 bp, Homo sapiens
cagcctcccagagt

SEQ ID NO: 5585041 - DNA, 17 bp, Homo sapiens
cagcctcccagctttct

SEQ ID NO: 5585042 - DNA, 16 bp, Homo sapiens
cagcctcccatccagg

SEQ ID NO: 5585043 - DNA, 18 bp, Homo sapiens
cagcctcccatccagggc

SEQ ID NO: 5585044 - DNA, 16 bp, Homo sapiens
cagcctccccacccag

SEQ ID NO: 5585045 - DNA, 16 bp, Homo sapiens
cagcctcccccaggct

SEQ ID NO: 5585046 - DNA, 18 bp, Homo sapiens
cagcctcccccgccagcc

SEQ ID NO: 5585047 - DNA, 21 bp, Homo sapiens
cagcctcccccgccagcccca

SEQ ID NO: 5585048 - DNA, 15 bp, Homo sapiens
cagcctccccctgct

SEQ ID NO: 5585049 - DNA, 15 bp, Homo sapiens
cagcctccccttccc

SEQ ID NO: 5585050 - DNA, 20 bp, Homo sapiens
cagcctccccttcccagacc

SEQ ID NO: 5585051 - DNA, 20 bp, Homo sapiens
cagcctccccttcttcccgc

SEQ ID NO: 5585052 - DNA, 21 bp, Homo sapiens
cagcctcccgaatagctggga

SEQ ID NO: 5585053 - DNA, 21 bp, Homo sapiens
cagcctcccgagtagctggga

SEQ ID NO: 5585054 - DNA, 16 bp, Homo sapiens
cagcctccctgaagcc

SEQ ID NO: 5585055 - DNA, 18 bp, Homo sapiens
cagcctccctgaagcctt

SEQ ID NO: 5585056 - DNA, 13 bp, Homo sapiens
cagcctccctgag

SEQ ID NO: 5585057 - DNA, 15 bp, Homo sapiens
cagcctccctgagcc

SEQ ID NO: 5585058 - DNA, 24 bp, Homo sapiens
cagcctccctgagcctgcattctg

SEQ ID NO: 5585059 - DNA, 13 bp, Homo sapiens
cagcctccctgtc

SEQ ID NO: 5585060 - DNA, 22 bp, Homo sapiens
cagcctccctgtcactcagctg

SEQ ID NO: 5585061 - DNA, 19 bp, Homo sapiens
cagcctccctgtctccagc

SEQ ID NO: 5585062 - DNA, 21 bp, Homo sapiens
cagcctcccttccatgcccca

SEQ ID NO: 5585063 - DNA, 17 bp, Homo sapiens
cagcctccgagagggag

SEQ ID NO: 5585064 - DNA, 19 bp, Homo sapiens
cagcctccgagagggagag

SEQ ID NO: 5585065 - DNA, 19 bp, Homo sapiens
cagcctccgccaagatcta

SEQ ID NO: 5585066 - DNA, 17 bp, Homo sapiens
cagcctccgccattcca

SEQ ID NO: 5585067 - DNA, 21 bp, Homo sapiens
cagcctccgcttccctggttc

SEQ ID NO: 5585068 - DNA, 22 bp, Homo sapiens
cagcctccggatgacacaaata

SEQ ID NO: 5585069 - DNA, 23 bp, Homo sapiens
cagcctccggggttcagcctcct

SEQ ID NO: 5585070 - DNA, 19 bp, Homo sapiens
cagcctccgtatttcagac

SEQ ID NO: 5585071 - DNA, 22 bp, Homo sapiens
cagcctccgtcatccatgccct

SEQ ID NO: 5585072 - DNA, 21 bp, Homo sapiens
cagcctcctaagcagctggga

SEQ ID NO: 5585073 - DNA, 14 bp, Homo sapiens
cagcctcctaggct

SEQ ID NO: 5585074 - DNA, 17 bp, Homo sapiens
cagcctcctaggctccc

SEQ ID NO: 5585075 - DNA, 17 bp, Homo sapiens
cagcctcctcatctggg

SEQ ID NO: 5585076 - DNA, 20 bp, Homo sapiens
cagcctcctcccaccaccct

SEQ ID NO: 5585077 - DNA, 13 bp, Homo sapiens
cagcctcctcctg

SEQ ID NO: 5585078 - DNA, 17 bp, Homo sapiens
cagcctcctctggacgg

SEQ ID NO: 5585079 - DNA, 17 bp, Homo sapiens
cagcctcctctgtctgc

SEQ ID NO: 5585080 - DNA, 15 bp, Homo sapiens
cagcctcctgagcct

SEQ ID NO: 5585081 - DNA, 18 bp, Homo sapiens
cagcctcctgagcctgtg

SEQ ID NO: 5585082 - DNA, 14 bp, Homo sapiens
cagcctcctgagta

SEQ ID NO: 5585083 - DNA, 18 bp, Homo sapiens
cagcctcctgagtagctg

SEQ ID NO: 5585084 - DNA, 14 bp, Homo sapiens
cagcctcctggggg

SEQ ID NO: 5585085 - DNA, 18 bp, Homo sapiens
cagcctcctgtttgcagg

SEQ ID NO: 5585086 - DNA, 16 bp, Homo sapiens
cagcctccttgcctgg

SEQ ID NO: 5585087 - DNA, 19 bp, Homo sapiens
cagcctccttgctgacccc

SEQ ID NO: 5585088 - DNA, 20 bp, Homo sapiens
cagcctcctttgtgtgtatt

SEQ ID NO: 5585089 - DNA, 21 bp, Homo sapiens
cagcctcgaactcctgggctc

SEQ ID NO: 5585090 - DNA, 23 bp, Homo sapiens
cagcctcgaactcctgggctcaa

SEQ ID NO: 5585091 - DNA, 18 bp, Homo sapiens
cagcctcgacctccctgg

SEQ ID NO: 5585092 - DNA, 19 bp, Homo sapiens
cagcctcgacctccctggc

SEQ ID NO: 5585093 - DNA, 20 bp, Homo sapiens
cagcctcgacctccctggct

SEQ ID NO: 5585094 - DNA, 18 bp, Homo sapiens
cagcctcgaggctggtgg

SEQ ID NO: 5585095 - DNA, 19 bp, Homo sapiens
cagcctcgaggctggtggt

SEQ ID NO: 5585096 - DNA, 23 bp, Homo sapiens
cagcctcgaggctggtggttttc

SEQ ID NO: 5585097 - DNA, 19 bp, Homo sapiens
cagcctcgagtgcccctgt

SEQ ID NO: 5585098 - DNA, 22 bp, Homo sapiens
cagcctcgagtgcccctgtccc

SEQ ID NO: 5585099 - DNA, 16 bp, Homo sapiens
cagcctcgcacaggcc

SEQ ID NO: 5585100 - DNA, 22 bp, Homo sapiens
cagcctcgcacaggccctagct

SEQ ID NO: 5585101 - DNA, 21 bp, Homo sapiens
cagcctcgcatgccagagcct

SEQ ID NO: 5585102 - DNA, 19 bp, Homo sapiens
cagcctcgcccctggcaga

SEQ ID NO: 5585103 - DNA, 14 bp, Homo sapiens
cagcctcgcctgtc

SEQ ID NO: 5585104 - DNA, 16 bp, Homo sapiens
cagcctcgctttgagg

SEQ ID NO: 5585105 - DNA, 20 bp, Homo sapiens
cagcctcggggatggggagg

SEQ ID NO: 5585106 - DNA, 23 bp, Homo sapiens
cagcctcgttaggacaaggctgt

SEQ ID NO: 5585107 - DNA, 22 bp, Homo sapiens
cagcctcgttggaagaggaaca

SEQ ID NO: 5585108 - DNA, 23 bp, Homo sapiens
cagcctcgttggaagaggaacag

SEQ ID NO: 5585109 - DNA, 19 bp, Homo sapiens
cagcctctacagccgtccc

SEQ ID NO: 5585110 - DNA, 14 bp, Homo sapiens
cagcctctccccag

SEQ ID NO: 5585111 - DNA, 19 bp, Homo sapiens
cagcctctccccaggtcca

SEQ ID NO: 5585112 - DNA, 23 bp, Homo sapiens
cagcctctccccaggtccagctc

SEQ ID NO: 5585113 - DNA, 14 bp, Homo sapiens
cagcctctcccggc

SEQ ID NO: 5585114 - DNA, 19 bp, Homo sapiens
cagcctctcccggctgcct

SEQ ID NO: 5585115 - DNA, 20 bp, Homo sapiens
cagcctctcccggctgcctg

SEQ ID NO: 5585116 - DNA, 21 bp, Homo sapiens
cagcctctcccggctgcctgc

SEQ ID NO: 5585117 - DNA, 11 bp, Homo sapiens
cagcctctcct

SEQ ID NO: 5585118 - DNA, 23 bp, Homo sapiens
cagcctctcctccttgggcaggg

SEQ ID NO: 5585119 - DNA, 14 bp, Homo sapiens
cagcctctctgcta

SEQ ID NO: 5585120 - DNA, 14 bp, Homo sapiens
cagcctctctggct

SEQ ID NO: 5585121 - DNA, 23 bp, Homo sapiens
cagcctctctggctcagcccggg

SEQ ID NO: 5585122 - DNA, 15 bp, Homo sapiens
cagcctctctggctg

SEQ ID NO: 5585123 - DNA, 19 bp, Homo sapiens
cagcctctctggctggtct

SEQ ID NO: 5585124 - DNA, 20 bp, Homo sapiens
cagcctctctggctggtctt

SEQ ID NO: 5585125 - DNA, 14 bp, Homo sapiens
cagcctctcttcct

SEQ ID NO: 5585126 - DNA, 20 bp, Homo sapiens
cagcctctcttcctatccca

SEQ ID NO: 5585127 - DNA, 23 bp, Homo sapiens
cagcctctcttcctatcccatcc

SEQ ID NO: 5585128 - DNA, 22 bp, Homo sapiens
cagcctctcttggtttccttcc

SEQ ID NO: 5585129 - DNA, 12 bp, Homo sapiens
cagcctctgaag

SEQ ID NO: 5585130 - DNA, 14 bp, Homo sapiens
cagcctctgacccc

SEQ ID NO: 5585131 - DNA, 20 bp, Homo sapiens
cagcgacctctctgcctctc

SEQ ID NO: 5585132 - DNA, 16 bp, Homo sapiens
cagcgacgcggcccgc

SEQ ID NO: 5585133 - DNA, 22 bp, Homo sapiens
cagcgactccgttggccactcc

SEQ ID NO: 5585134 - DNA, 12 bp, Homo sapiens
cagcgactggat

SEQ ID NO: 5585135 - DNA, 20 bp, Homo sapiens
cagcgactggatgctcgcca

SEQ ID NO: 5585136 - DNA, 19 bp, Homo sapiens
cagcgagagagtttcaaaa

SEQ ID NO: 5585137 - DNA, 15 bp, Homo sapiens
cagcgagccacagga

SEQ ID NO: 5585138 - DNA, 17 bp, Homo sapiens
cagcgagccctggtggc

SEQ ID NO: 5585139 - DNA, 12 bp, Homo sapiens
cagcgagcctgc

SEQ ID NO: 5585140 - DNA, 13 bp, Homo sapiens
cagcgagcctgct

SEQ ID NO: 5585141 - DNA, 16 bp, Homo sapiens
cagcgagcctgtgcct

SEQ ID NO: 5585142 - DNA, 15 bp, Homo sapiens
cagcgaggcgaggct

SEQ ID NO: 5585143 - DNA, 17 bp, Homo sapiens
cagcgaggcgaggctgc

SEQ ID NO: 5585144 - DNA, 19 bp, Homo sapiens
cagcgaggcgaggctgcct

SEQ ID NO: 5585145 - DNA, 19 bp, Homo sapiens
cagcgaggctgggctggcc

SEQ ID NO: 5585146 - DNA, 22 bp, Homo sapiens
cagcgaggtgggagaggcctca

SEQ ID NO: 5585147 - DNA, 16 bp, Homo sapiens
cagcgagtctggagac

SEQ ID NO: 5585148 - DNA, 17 bp, Homo sapiens
cagcgatggcaggcctg

SEQ ID NO: 5585149 - DNA, 22 bp, Homo sapiens
cagcgatgtatgcagctatctg

SEQ ID NO: 5585150 - DNA, 23 bp, Homo sapiens
cagcgatgtatgcagctatctgg

SEQ ID NO: 5585151 - DNA, 23 bp, Homo sapiens
cagcgattattgatcaaaatcaa

SEQ ID NO: 5585152 - DNA, 21 bp, Homo sapiens
cagcgattccctctcccaggc

SEQ ID NO: 5585153 - DNA, 22 bp, Homo sapiens
cagcgattccctctcccaggcc

SEQ ID NO: 5585154 - DNA, 23 bp, Homo sapiens
cagcgattcctgccaagtagggt

SEQ ID NO: 5585155 - DNA, 18 bp, Homo sapiens
cagcgatttcaagaagga

SEQ ID NO: 5585156 - DNA, 23 bp, Homo sapiens
cagcgcaacagctgtgtgtgccc

SEQ ID NO: 5585157 - DNA, 21 bp, Homo sapiens
cagcgcagccgagccccagga

SEQ ID NO: 5585158 - DNA, 23 bp, Homo sapiens
cagcgcagccgagccccaggagc

SEQ ID NO: 5585159 - DNA, 14 bp, Homo sapiens
cagcgcaggccctg

SEQ ID NO: 5585160 - DNA, 17 bp, Homo sapiens
cagcgcaggctgcagag

SEQ ID NO: 5585161 - DNA, 18 bp, Homo sapiens
cagcgcaggctgcagagc

SEQ ID NO: 5585162 - DNA, 19 bp, Homo sapiens
cagcgcagggctggcacgt

SEQ ID NO: 5585163 - DNA, 16 bp, Homo sapiens
cagcgcatcctgcagg

SEQ ID NO: 5585164 - DNA, 17 bp, Homo sapiens
cagcgcatggcgccccg

SEQ ID NO: 5585165 - DNA, 18 bp, Homo sapiens
cagcgcatggcgccccgg

SEQ ID NO: 5585166 - DNA, 13 bp, Homo sapiens
cagcgcatgtgtc

SEQ ID NO: 5585167 - DNA, 18 bp, Homo sapiens
cagcgcattgttttgcat

SEQ ID NO: 5585168 - DNA, 20 bp, Homo sapiens
cagcgccaaatgttcatcct

SEQ ID NO: 5585169 - DNA, 14 bp, Homo sapiens
cagcgccaagcaac

SEQ ID NO: 5585170 - DNA, 22 bp, Homo sapiens
cagcgccaagcaacctgggtcc

SEQ ID NO: 5585171 - DNA, 23 bp, Homo sapiens
cagcgccactgtccgctgtctcc

SEQ ID NO: 5585172 - DNA, 19 bp, Homo sapiens
cagcgccaggctgaccaca

SEQ ID NO: 5585173 - DNA, 13 bp, Homo sapiens
cagcgccagggcc

SEQ ID NO: 5585174 - DNA, 15 bp, Homo sapiens
cagcgccagggccca

SEQ ID NO: 5585175 - DNA, 16 bp, Homo sapiens
cagcgccagggcccag

SEQ ID NO: 5585176 - DNA, 15 bp, Homo sapiens
cagcgccatgtgtgt

SEQ ID NO: 5585177 - DNA, 18 bp, Homo sapiens
cagcgcccaaaggacgca

SEQ ID NO: 5585178 - DNA, 19 bp, Homo sapiens
cagcgcccagcctggcccc

SEQ ID NO: 5585179 - DNA, 14 bp, Homo sapiens
cagcgcccaggcct

SEQ ID NO: 5585180 - DNA, 21 bp, Homo sapiens
cagcgcccaggcctgctggca

SEQ ID NO: 5585181 - DNA, 20 bp, Homo sapiens
cagcgcccagggaggagtca

SEQ ID NO: 5585182 - DNA, 14 bp, Homo sapiens
cagcgcccccactc

SEQ ID NO: 5585183 - DNA, 16 bp, Homo sapiens
cagcgcccccactcct

SEQ ID NO: 5585184 - DNA, 21 bp, Homo sapiens
cagcgcccccactcctcctcc

SEQ ID NO: 5585185 - DNA, 13 bp, Homo sapiens
cagcgcccccagg

SEQ ID NO: 5585186 - DNA, 15 bp, Homo sapiens
cagcgcccccaggcc

SEQ ID NO: 5585187 - DNA, 16 bp, Homo sapiens
cagcgcccccaggcct

SEQ ID NO: 5585188 - DNA, 20 bp, Homo sapiens
cagcgcccccaggcctgccc

SEQ ID NO: 5585189 - DNA, 20 bp, Homo sapiens
cagcgcccccatctgtcttc

SEQ ID NO: 5585190 - DNA, 19 bp, Homo sapiens
cagcgcccgctgggctgag

SEQ ID NO: 5585191 - DNA, 13 bp, Homo sapiens
cagcgcccttcct

SEQ ID NO: 5585192 - DNA, 16 bp, Homo sapiens
cagcgcccttcctctc

SEQ ID NO: 5585193 - DNA, 23 bp, Homo sapiens
cagcgcctagtggggtctccctc

SEQ ID NO: 5585194 - DNA, 16 bp, Homo sapiens
cagcgcctccaccctg

SEQ ID NO: 5585195 - DNA, 18 bp, Homo sapiens
cagcgcctccaccctgcc

SEQ ID NO: 5585196 - DNA, 23 bp, Homo sapiens
cagcgcctccaccctgccctgct

SEQ ID NO: 5585197 - DNA, 12 bp, Homo sapiens
cagcgcctcccg

SEQ ID NO: 5585198 - DNA, 21 bp, Homo sapiens
cagcgcctcccgccgcctcgg

SEQ ID NO: 5585199 - DNA, 22 bp, Homo sapiens
cagcgcctcccgccgcctcggg

SEQ ID NO: 5585200 - DNA, 23 bp, Homo sapiens
cagcgcctcccgccgcctcgggc

SEQ ID NO: 5585201 - DNA, 12 bp, Homo sapiens
cagcgcctccct

SEQ ID NO: 5585202 - DNA, 14 bp, Homo sapiens
cagcgcctccctcc

SEQ ID NO: 5585203 - DNA, 19 bp, Homo sapiens
cagcgcctcctggacctga

SEQ ID NO: 5585204 - DNA, 12 bp, Homo sapiens
cagcgcctgccc

SEQ ID NO: 5585205 - DNA, 18 bp, Homo sapiens
cagcgcctgccctccctg

SEQ ID NO: 5585206 - DNA, 21 bp, Homo sapiens
cagcgcctgccctccctgggg

SEQ ID NO: 5585207 - DNA, 23 bp, Homo sapiens
cagcgcctgccctccctggggtc

SEQ ID NO: 5585208 - DNA, 22 bp, Homo sapiens
cagcgcctgtcccctcacagac

SEQ ID NO: 5585209 - DNA, 24 bp, Homo sapiens
cagcgcctgtcccctcacagactc

SEQ ID NO: 5585210 - DNA, 22 bp, Homo sapiens
cagcgcctttcccaactctagc

SEQ ID NO: 5585211 - DNA, 20 bp, Homo sapiens
cagcgcggacatcccctgct

SEQ ID NO: 5585212 - DNA, 13 bp, Homo sapiens
cagcgcggccagc

SEQ ID NO: 5585213 - DNA, 14 bp, Homo sapiens
cagcgcggccagcg

SEQ ID NO: 5585214 - DNA, 18 bp, Homo sapiens
cagcgcggcttggccgcc

SEQ ID NO: 5585215 - DNA, 22 bp, Homo sapiens
cagcgcggcttggccgccatcc

SEQ ID NO: 5585216 - DNA, 20 bp, Homo sapiens
cagcgcgggcggaggcggct

SEQ ID NO: 5585217 - DNA, 19 bp, Homo sapiens
cagcgcgtgcacagcgcgg

SEQ ID NO: 5585218 - DNA, 14 bp, Homo sapiens
cagcgctccctgtc

SEQ ID NO: 5585219 - DNA, 18 bp, Homo sapiens
cagcgctcctcctgtgtg

SEQ ID NO: 5585220 - DNA, 22 bp, Homo sapiens
cagcgctcgccacgctcagtgc

SEQ ID NO: 5585221 - DNA, 21 bp, Homo sapiens
cagcgctcggcccggagcagc

SEQ ID NO: 5585222 - DNA, 16 bp, Homo sapiens
cagcgctctcctggac

SEQ ID NO: 5585223 - DNA, 13 bp, Homo sapiens
cagcgctctgcct

SEQ ID NO: 5585224 - DNA, 20 bp, Homo sapiens
cagcgctggccgggaccccg

SEQ ID NO: 5585225 - DNA, 16 bp, Homo sapiens
cagcgctgggccccaa

SEQ ID NO: 5585226 - DNA, 19 bp, Homo sapiens
cagcgctgggccccaaggc

SEQ ID NO: 5585227 - DNA, 20 bp, Homo sapiens
cagcgctgtcaggattgcga

SEQ ID NO: 5585228 - DNA, 19 bp, Homo sapiens
cagcgctgttgaggggtcc

SEQ ID NO: 5585229 - DNA, 15 bp, Homo sapiens
cagcgcttaaaaaaa

SEQ ID NO: 5585230 - DNA, 13 bp, Homo sapiens
cagcggaaacagg

SEQ ID NO: 5585231 - DNA, 21 bp, Homo sapiens
cagcggaaagccctgtgctcc

SEQ ID NO: 5585232 - DNA, 16 bp, Homo sapiens
cagcggagaggacccc

SEQ ID NO: 5585233 - DNA, 21 bp, Homo sapiens
cagcggagtctgtcctgtgac

SEQ ID NO: 5585234 - DNA, 15 bp, Homo sapiens
cagcggcagagcaat

SEQ ID NO: 5585235 - DNA, 15 bp, Homo sapiens
cagcggcccaagagc

SEQ ID NO: 5585236 - DNA, 13 bp, Homo sapiens
cagcggcccagat

SEQ ID NO: 5585237 - DNA, 17 bp, Homo sapiens
cagcggccccgcacccc

SEQ ID NO: 5585238 - DNA, 17 bp, Homo sapiens
cagcggccccttgactc

SEQ ID NO: 5585239 - DNA, 13 bp, Homo sapiens
cagcggcccggcc

SEQ ID NO: 5585240 - DNA, 15 bp, Homo sapiens
cagcggcccggccca

SEQ ID NO: 5585241 - DNA, 18 bp, Homo sapiens
cagcggcccggcccacgc

SEQ ID NO: 5585242 - DNA, 19 bp, Homo sapiens
cagcggcccggcccacgca

SEQ ID NO: 5585243 - DNA, 13 bp, Homo sapiens
cagcggccctccc

SEQ ID NO: 5585244 - DNA, 15 bp, Homo sapiens
cagcggccctcccag

SEQ ID NO: 5585245 - DNA, 11 bp, Homo sapiens
cagcggcctca

SEQ ID NO: 5585246 - DNA, 20 bp, Homo sapiens
cagcggccttgaagacagag

SEQ ID NO: 5585247 - DNA, 22 bp, Homo sapiens
cagcggccttgaagacagagca

SEQ ID NO: 5585248 - DNA, 21 bp, Homo sapiens
cagcggccttgaagaggcagg

SEQ ID NO: 5585249 - DNA, 16 bp, Homo sapiens
cagcggcggaggcgca

SEQ ID NO: 5585250 - DNA, 14 bp, Homo sapiens
cagcggctcctgca

SEQ ID NO: 5585251 - DNA, 15 bp, Homo sapiens
cagcggctcctgcaa

SEQ ID NO: 5585252 - DNA, 17 bp, Homo sapiens
cagcggctcttcctgga

SEQ ID NO: 5585253 - DNA, 14 bp, Homo sapiens
cagcggctgccctc

SEQ ID NO: 5585254 - DNA, 18 bp, Homo sapiens
cagcggctggacttggag

SEQ ID NO: 5585255 - DNA, 14 bp, Homo sapiens
cagcggctggtgca

SEQ ID NO: 5585256 - DNA, 16 bp, Homo sapiens
cagcggcttagccaag

SEQ ID NO: 5585257 - DNA, 20 bp, Homo sapiens
cagcggcttagccaagccct

SEQ ID NO: 5585258 - DNA, 23 bp, Homo sapiens
cagcggcttagccaagccctaag

SEQ ID NO: 5585259 - DNA, 21 bp, Homo sapiens
cagcggcttgcctgcctgctc

SEQ ID NO: 5585260 - DNA, 16 bp, Homo sapiens
cagcgggaatggcagc

SEQ ID NO: 5585261 - DNA, 22 bp, Homo sapiens
cagcgggaatggcagctgccac

SEQ ID NO: 5585262 - DNA, 19 bp, Homo sapiens
cagcgggagcctccctgcc

SEQ ID NO: 5585263 - DNA, 13 bp, Homo sapiens
cagcgggcacagg

SEQ ID NO: 5585264 - DNA, 16 bp, Homo sapiens
cagcgggcacagggca

SEQ ID NO: 5585265 - DNA, 13 bp, Homo sapiens
cagcgggcaggtt

SEQ ID NO: 5585266 - DNA, 15 bp, Homo sapiens
cagcgggccaggcag

SEQ ID NO: 5585267 - DNA, 14 bp, Homo sapiens
cagcgggccaggcc

SEQ ID NO: 5585268 - DNA, 14 bp, Homo sapiens
cagcgggcccaggc

SEQ ID NO: 5585269 - DNA, 14 bp, Homo sapiens
cagcgggccctctg

SEQ ID NO: 5585270 - DNA, 18 bp, Homo sapiens
cagcgggcgctgctggga

SEQ ID NO: 5585271 - DNA, 17 bp, Homo sapiens
cagcgggcggaggggat

SEQ ID NO: 5585272 - DNA, 23 bp, Homo sapiens
cagcgggcggaggggatccagcc

SEQ ID NO: 5585273 - DNA, 21 bp, Homo sapiens
cagcggggacagctccttctg

SEQ ID NO: 5585274 - DNA, 18 bp, Homo sapiens
cagcggggccccagggct

SEQ ID NO: 5585275 - DNA, 14 bp, Homo sapiens
cagcggggcgaagc

SEQ ID NO: 5585276 - DNA, 14 bp, Homo sapiens
cagcggggctgctc

SEQ ID NO: 5585277 - DNA, 21 bp, Homo sapiens
cagcgggggaggcccgcagag

SEQ ID NO: 5585278 - DNA, 14 bp, Homo sapiens
cagcgggggccttg

SEQ ID NO: 5585279 - DNA, 20 bp, Homo sapiens
cagcgggggcggcccagcct

SEQ ID NO: 5585280 - DNA, 21 bp, Homo sapiens
cagcgggggcggcccagcctc

SEQ ID NO: 5585281 - DNA, 22 bp, Homo sapiens
cagcgggggcggcccagcctct

SEQ ID NO: 5585282 - DNA, 22 bp, Homo sapiens
cagcgggtacttatttctcagc

SEQ ID NO: 5585283 - DNA, 23 bp, Homo sapiens
cagcgggtacttatttctcagct

SEQ ID NO: 5585284 - DNA, 13 bp, Homo sapiens
cagcgggtctcct

SEQ ID NO: 5585285 - DNA, 15 bp, Homo sapiens
cagcgggtctcctcc

SEQ ID NO: 5585286 - DNA, 15 bp, Homo sapiens
cagcggtccatgggt

SEQ ID NO: 5585287 - DNA, 18 bp, Homo sapiens
cagcggtggaaggagcct

SEQ ID NO: 5585288 - DNA, 19 bp, Homo sapiens
cagcggtggaaggagcctg

SEQ ID NO: 5585289 - DNA, 14 bp, Homo sapiens
cagcggtggcctct

SEQ ID NO: 5585290 - DNA, 15 bp, Homo sapiens
cagcggtggcctctt

SEQ ID NO: 5585291 - DNA, 14 bp, Homo sapiens
cagcggtgggaagg

SEQ ID NO: 5585292 - DNA, 23 bp, Homo sapiens
cagcggtgggaaggaaaggcaga

SEQ ID NO: 5585293 - DNA, 20 bp, Homo sapiens
cagcggtgtggaccgaggaa

SEQ ID NO: 5585294 - DNA, 17 bp, Homo sapiens
cagcggttcctgtgcag

SEQ ID NO: 5585295 - DNA, 20 bp, Homo sapiens
cagcggttcctgtgcagatg

SEQ ID NO: 5585296 - DNA, 17 bp, Homo sapiens
cagcggttgtaaataca

SEQ ID NO: 5585297 - DNA, 15 bp, Homo sapiens
cagcggtttggggag

SEQ ID NO: 5585298 - DNA, 14 bp, Homo sapiens
cagcgtaaaatggt

SEQ ID NO: 5585299 - DNA, 22 bp, Homo sapiens
cagcgtaacggagggtgaagag

SEQ ID NO: 5585300 - DNA, 12 bp, Homo sapiens
cagcgtagtgtt

SEQ ID NO: 5585301 - DNA, 14 bp, Homo sapiens
cagcgtcactccag

SEQ ID NO: 5585302 - DNA, 18 bp, Homo sapiens
cagcgtcactccagtgct

SEQ ID NO: 5585303 - DNA, 13 bp, Homo sapiens
cagcgtcagaagt

SEQ ID NO: 5585304 - DNA, 20 bp, Homo sapiens
cagcgtcaggcctacctcaa

SEQ ID NO: 5585305 - DNA, 14 bp, Homo sapiens
cagcgtcccagtct

SEQ ID NO: 5585306 - DNA, 13 bp, Homo sapiens
cagcgtcccccgc

SEQ ID NO: 5585307 - DNA, 19 bp, Homo sapiens
cagcgtcccccgccgcgcc

SEQ ID NO: 5585308 - DNA, 15 bp, Homo sapiens
cagctcctcatccag

SEQ ID NO: 5585309 - DNA, 15 bp, Homo sapiens
cagctcctccagccc

SEQ ID NO: 5585310 - DNA, 16 bp, Homo sapiens
cagctcctccagccct

SEQ ID NO: 5585311 - DNA, 21 bp, Homo sapiens
cagctcctccatgcctgacca

SEQ ID NO: 5585312 - DNA, 21 bp, Homo sapiens
cagctcctcccctgccgcctc

SEQ ID NO: 5585313 - DNA, 15 bp, Homo sapiens
cagctcctccctgtg

SEQ ID NO: 5585314 - DNA, 21 bp, Homo sapiens
cagctcctcccttgttctcta

SEQ ID NO: 5585315 - DNA, 19 bp, Homo sapiens
cagctcctcctcttggagc

SEQ ID NO: 5585316 - DNA, 15 bp, Homo sapiens
cagctcctcgggtgg

SEQ ID NO: 5585317 - DNA, 13 bp, Homo sapiens
cagctcctctcct

SEQ ID NO: 5585318 - DNA, 11 bp, Homo sapiens
cagctcctctg

SEQ ID NO: 5585319 - DNA, 14 bp, Homo sapiens
cagctcctctgtct

SEQ ID NO: 5585320 - DNA, 15 bp, Homo sapiens
cagctcctcttcctg

SEQ ID NO: 5585321 - DNA, 18 bp, Homo sapiens
cagctcctgaccaaagac

SEQ ID NO: 5585322 - DNA, 22 bp, Homo sapiens
cagctcctgaccagttgcagtc

SEQ ID NO: 5585323 - DNA, 14 bp, Homo sapiens
cagctcctgacctt

SEQ ID NO: 5585324 - DNA, 14 bp, Homo sapiens
cagctcctgagtag

SEQ ID NO: 5585325 - DNA, 15 bp, Homo sapiens
cagctcctgagtagc

SEQ ID NO: 5585326 - DNA, 20 bp, Homo sapiens
cagctcctgagtagctgggc

SEQ ID NO: 5585327 - DNA, 16 bp, Homo sapiens
cagctcctgccccgcc

SEQ ID NO: 5585328 - DNA, 17 bp, Homo sapiens
cagctcctgccccgccg

SEQ ID NO: 5585329 - DNA, 21 bp, Homo sapiens
cagctcctggaccaggcccat

SEQ ID NO: 5585330 - DNA, 15 bp, Homo sapiens
cagctcctgtaacat

SEQ ID NO: 5585331 - DNA, 16 bp, Homo sapiens
cagctccttaaactga

SEQ ID NO: 5585332 - DNA, 23 bp, Homo sapiens
cagctccttagacacctatcaga

SEQ ID NO: 5585333 - DNA, 15 bp, Homo sapiens
cagctccttcctagc

SEQ ID NO: 5585334 - DNA, 13 bp, Homo sapiens
cagctccttcctg

SEQ ID NO: 5585335 - DNA, 23 bp, Homo sapiens
cagctccttctgtcctactctgt

SEQ ID NO: 5585336 - DNA, 20 bp, Homo sapiens
cagctccttgacctatgagc

SEQ ID NO: 5585337 - DNA, 17 bp, Homo sapiens
cagctccttgggaggaa

SEQ ID NO: 5585338 - DNA, 20 bp, Homo sapiens
cagctccttgggaggaagca

SEQ ID NO: 5585339 - DNA, 21 bp, Homo sapiens
cagctccttgggaggaagcag

SEQ ID NO: 5585340 - DNA, 22 bp, Homo sapiens
cagctccttggggcagggcctg

SEQ ID NO: 5585341 - DNA, 13 bp, Homo sapiens
cagctcctttccc

SEQ ID NO: 5585342 - DNA, 19 bp, Homo sapiens
cagctcctttctcctgtga

SEQ ID NO: 5585343 - DNA, 21 bp, Homo sapiens
cagctcctttctgtcctggag

SEQ ID NO: 5585344 - DNA, 12 bp, Homo sapiens
cagctccttttc

SEQ ID NO: 5585345 - DNA, 13 bp, Homo sapiens
cagctccttttcc

SEQ ID NO: 5585346 - DNA, 20 bp, Homo sapiens
cagctccttttccagagcat

SEQ ID NO: 5585347 - DNA, 19 bp, Homo sapiens
cagctcgaattaagaatat

SEQ ID NO: 5585348 - DNA, 18 bp, Homo sapiens
cagctcgatccaaattgt

SEQ ID NO: 5585349 - DNA, 22 bp, Homo sapiens
cagctcgcacccccctgttcta

SEQ ID NO: 5585350 - DNA, 18 bp, Homo sapiens
cagctcgctgcccaggga

SEQ ID NO: 5585351 - DNA, 20 bp, Homo sapiens
cagctcgctggctttctctc

SEQ ID NO: 5585352 - DNA, 21 bp, Homo sapiens
cagctcgctggctttctctct

SEQ ID NO: 5585353 - DNA, 22 bp, Homo sapiens
cagctcgctggctttctctctg

SEQ ID NO: 5585354 - DNA, 16 bp, Homo sapiens
cagctcggtacccggg

SEQ ID NO: 5585355 - DNA, 19 bp, Homo sapiens
cagctctaaagcagagatg

SEQ ID NO: 5585356 - DNA, 17 bp, Homo sapiens
cagctctaagcagccag

SEQ ID NO: 5585357 - DNA, 22 bp, Homo sapiens
cagctctaagcagccaggaggg

SEQ ID NO: 5585358 - DNA, 20 bp, Homo sapiens
cagctctacattctgctctg

SEQ ID NO: 5585359 - DNA, 22 bp, Homo sapiens
cagctctacattctgctctgcc

SEQ ID NO: 5585360 - DNA, 16 bp, Homo sapiens
cagctctactccaggc

SEQ ID NO: 5585361 - DNA, 15 bp, Homo sapiens
cagctctactggtct

SEQ ID NO: 5585362 - DNA, 20 bp, Homo sapiens
cagctctagcctctggactg

SEQ ID NO: 5585363 - DNA, 21 bp, Homo sapiens
cagctctagcctctggactgg

SEQ ID NO: 5585364 - DNA, 12 bp, Homo sapiens
cagctctaggct

SEQ ID NO: 5585365 - DNA, 15 bp, Homo sapiens
cagctctcactggcc

SEQ ID NO: 5585366 - DNA, 13 bp, Homo sapiens
cagctctcagcca

SEQ ID NO: 5585367 - DNA, 15 bp, Homo sapiens
cagctctcagggctg

SEQ ID NO: 5585368 - DNA, 15 bp, Homo sapiens
cagctctcatgctgc

SEQ ID NO: 5585369 - DNA, 12 bp, Homo sapiens
cagctctccagt

SEQ ID NO: 5585370 - DNA, 13 bp, Homo sapiens
cagctctccagtc

SEQ ID NO: 5585371 - DNA, 14 bp, Homo sapiens
cagctctccagtca

SEQ ID NO: 5585372 - DNA, 13 bp, Homo sapiens
cagctctcccaca

SEQ ID NO: 5585373 - DNA, 20 bp, Homo sapiens
cagctctccccaggcatttg

SEQ ID NO: 5585374 - DNA, 19 bp, Homo sapiens
cagctctcccctgcgcagg

SEQ ID NO: 5585375 - DNA, 14 bp, Homo sapiens
cagctctccctcac

SEQ ID NO: 5585376 - DNA, 15 bp, Homo sapiens
cagctctccctctgg

SEQ ID NO: 5585377 - DNA, 21 bp, Homo sapiens
cagctctccctctggccctgc

SEQ ID NO: 5585378 - DNA, 14 bp, Homo sapiens
cagctctcctccag

SEQ ID NO: 5585379 - DNA, 19 bp, Homo sapiens
cagctctcctccagccctg

SEQ ID NO: 5585380 - DNA, 20 bp, Homo sapiens
cagctctcctccagccctgg

SEQ ID NO: 5585381 - DNA, 22 bp, Homo sapiens
cagctctcctccagccctgggc

SEQ ID NO: 5585382 - DNA, 23 bp, Homo sapiens
cagctctcctccagccctgggca

SEQ ID NO: 5585383 - DNA, 15 bp, Homo sapiens
cagctctcctcctcc

SEQ ID NO: 5585384 - DNA, 13 bp, Homo sapiens
cagctctcctggc

SEQ ID NO: 5585385 - DNA, 14 bp, Homo sapiens
cagctctcctggct

SEQ ID NO: 5585386 - DNA, 16 bp, Homo sapiens
cagctctcctggctcc

SEQ ID NO: 5585387 - DNA, 16 bp, Homo sapiens
cagctctcgttctcct

SEQ ID NO: 5585388 - DNA, 15 bp, Homo sapiens
cagctctctctaccc

SEQ ID NO: 5585389 - DNA, 23 bp, Homo sapiens
cagctctctctacccggcccaga

SEQ ID NO: 5585390 - DNA, 15 bp, Homo sapiens
cagctctctctcctg

SEQ ID NO: 5585391 - DNA, 13 bp, Homo sapiens
cagctctctgacg

SEQ ID NO: 5585392 - DNA, 15 bp, Homo sapiens
cagctctctgacgct

SEQ ID NO: 5585393 - DNA, 12 bp, Homo sapiens
cagctctctgct

SEQ ID NO: 5585394 - DNA, 13 bp, Homo sapiens
cagctctctgctg

SEQ ID NO: 5585395 - DNA, 15 bp, Homo sapiens
cagctctctgctggg

SEQ ID NO: 5585396 - DNA, 20 bp, Homo sapiens
cagctctctgggacctcctt

SEQ ID NO: 5585397 - DNA, 20 bp, Homo sapiens
cagctctctgggcacccggt

SEQ ID NO: 5585398 - DNA, 13 bp, Homo sapiens
cagctctcttcct

SEQ ID NO: 5585399 - DNA, 14 bp, Homo sapiens
cagctctcttcctg

SEQ ID NO: 5585400 - DNA, 18 bp, Homo sapiens
cagctctgaaaccagtgt

SEQ ID NO: 5585401 - DNA, 16 bp, Homo sapiens
cagctctgacatccct

SEQ ID NO: 5585402 - DNA, 21 bp, Homo sapiens
cagctctgacatcccttcctg

SEQ ID NO: 5585403 - DNA, 20 bp, Homo sapiens
cagctctgagccagattaca

SEQ ID NO: 5585404 - DNA, 13 bp, Homo sapiens
cagctctgagccg

SEQ ID NO: 5585405 - DNA, 12 bp, Homo sapiens
cagctctgaggc

SEQ ID NO: 5585406 - DNA, 18 bp, Homo sapiens
cagctctgaggggaggca

SEQ ID NO: 5585407 - DNA, 22 bp, Homo sapiens
cagctctgatctgaggctaaga

SEQ ID NO: 5585408 - DNA, 15 bp, Homo sapiens
cagctctgcaagaat

SEQ ID NO: 5585409 - DNA, 22 bp, Homo sapiens
cagctctgccgtctctggagcg

SEQ ID NO: 5585410 - DNA, 18 bp, Homo sapiens
cagctctgctatgagtgt

SEQ ID NO: 5585411 - DNA, 12 bp, Homo sapiens
cagctctgcttg

SEQ ID NO: 5585412 - DNA, 13 bp, Homo sapiens
cagctctgcttgc

SEQ ID NO: 5585413 - DNA, 16 bp, Homo sapiens
cagctctgctttttcc

SEQ ID NO: 5585414 - DNA, 17 bp, Homo sapiens
cagctctggacagcccc

SEQ ID NO: 5585415 - DNA, 11 bp, Homo sapiens
cagctctggag

SEQ ID NO: 5585416 - DNA, 12 bp, Homo sapiens
cagctctggaga

SEQ ID NO: 5585417 - DNA, 13 bp, Homo sapiens
cagctctggagaa

SEQ ID NO: 5585418 - DNA, 13 bp, Homo sapiens
cagctctggcaca

SEQ ID NO: 5585419 - DNA, 18 bp, Homo sapiens
cagctctggcatggctag

SEQ ID NO: 5585420 - DNA, 15 bp, Homo sapiens
cagctctggccacaa

SEQ ID NO: 5585421 - DNA, 17 bp, Homo sapiens
cagctctggctcacaga

SEQ ID NO: 5585422 - DNA, 19 bp, Homo sapiens
cagctctggctctgcctca

SEQ ID NO: 5585423 - DNA, 21 bp, Homo sapiens
cagctctggctctgcctcagg

SEQ ID NO: 5585424 - DNA, 12 bp, Homo sapiens
cagctctggctt

SEQ ID NO: 5585425 - DNA, 15 bp, Homo sapiens
cagctctgggcctct

SEQ ID NO: 5585426 - DNA, 17 bp, Homo sapiens
cagctctgggcctcttt

SEQ ID NO: 5585427 - DNA, 19 bp, Homo sapiens
cagctctggggcagaggaa

SEQ ID NO: 5585428 - DNA, 23 bp, Homo sapiens
cagctctggtccaggccctgtgg

SEQ ID NO: 5585429 - DNA, 18 bp, Homo sapiens
cagctctggtccatagag

SEQ ID NO: 5585430 - DNA, 21 bp, Homo sapiens
cagctctggtccatagagagc

SEQ ID NO: 5585431 - DNA, 14 bp, Homo sapiens
cagctctgtcaccc

SEQ ID NO: 5585432 - DNA, 23 bp, Homo sapiens
cagctctgtccccaccccatggg

SEQ ID NO: 5585433 - DNA, 12 bp, Homo sapiens
cagctctgtcct

SEQ ID NO: 5585434 - DNA, 14 bp, Homo sapiens
cagctctgtcctgg

SEQ ID NO: 5585435 - DNA, 17 bp, Homo sapiens
cagctctgtcctgggag

SEQ ID NO: 5585436 - DNA, 18 bp, Homo sapiens
cagctctgtcctgggagt

SEQ ID NO: 5585437 - DNA, 23 bp, Homo sapiens
cagctctgtcctgggagtgagct

SEQ ID NO: 5585438 - DNA, 13 bp, Homo sapiens
cagctctgtggcc

SEQ ID NO: 5585439 - DNA, 15 bp, Homo sapiens
cagctctgtggcctg

SEQ ID NO: 5585440 - DNA, 21 bp, Homo sapiens
cagctctgtgttgccatgtgt

SEQ ID NO: 5585441 - DNA, 16 bp, Homo sapiens
cagctctgttcttcct

SEQ ID NO: 5585442 - DNA, 20 bp, Homo sapiens
cagctctgttcttcctcagc

SEQ ID NO: 5585443 - DNA, 23 bp, Homo sapiens
cagctctgttcttcctcagccag

SEQ ID NO: 5585444 - DNA, 15 bp, Homo sapiens
cagctcttaaatgta

SEQ ID NO: 5585445 - DNA, 18 bp, Homo sapiens
cagctcttcactcagcca

SEQ ID NO: 5585446 - DNA, 21 bp, Homo sapiens
cagctcttcactcagccacac

SEQ ID NO: 5585447 - DNA, 15 bp, Homo sapiens
cagctcttcattcca

SEQ ID NO: 5585448 - DNA, 13 bp, Homo sapiens
cagctcttccagg

SEQ ID NO: 5585449 - DNA, 18 bp, Homo sapiens
cagctcttccagggcagc

SEQ ID NO: 5585450 - DNA, 22 bp, Homo sapiens
cagctcttccagggcagcggct

SEQ ID NO: 5585451 - DNA, 23 bp, Homo sapiens
cagctcttccagggcagcggctc

SEQ ID NO: 5585452 - DNA, 18 bp, Homo sapiens
cagctcttcccctttcct

SEQ ID NO: 5585453 - DNA, 20 bp, Homo sapiens
cagctcttcctagctggaga

SEQ ID NO: 5585454 - DNA, 13 bp, Homo sapiens
cagctcttctctt

SEQ ID NO: 5585455 - DNA, 18 bp, Homo sapiens
cagctcttctcttcctag

SEQ ID NO: 5585456 - DNA, 21 bp, Homo sapiens
cagctcttctcttcctagatc

SEQ ID NO: 5585457 - DNA, 18 bp, Homo sapiens
cagctcttctgggcagag

SEQ ID NO: 5585458 - DNA, 19 bp, Homo sapiens
cagctcttctgggcagagc

SEQ ID NO: 5585459 - DNA, 21 bp, Homo sapiens
cagctcttctgggcagagcct

SEQ ID NO: 5585460 - DNA, 22 bp, Homo sapiens
cagctcttctgggcagagcctg

SEQ ID NO: 5585461 - DNA, 23 bp, Homo sapiens
cagctcttctgggcagagcctgt

SEQ ID NO: 5585462 - DNA, 15 bp, Homo sapiens
cagctcttgaagtat

SEQ ID NO: 5585463 - DNA, 20 bp, Homo sapiens
cagctcttgcccttccctgt

SEQ ID NO: 5585464 - DNA, 14 bp, Homo sapiens
cagctcttgctaat

SEQ ID NO: 5585465 - DNA, 21 bp, Homo sapiens
cagctcttgctaatcagtgtc

SEQ ID NO: 5585466 - DNA, 15 bp, Homo sapiens
cagctcttgctctct

SEQ ID NO: 5585467 - DNA, 16 bp, Homo sapiens
cagctcttgctctctt

SEQ ID NO: 5585468 - DNA, 19 bp, Homo sapiens
cagctcttgctctcttgtg

SEQ ID NO: 5585469 - DNA, 17 bp, Homo sapiens
cagctcttggcccctgt

SEQ ID NO: 5585470 - DNA, 16 bp, Homo sapiens
cagctcttggctccac

SEQ ID NO: 5585471 - DNA, 18 bp, Homo sapiens
cagctcttggtgggccca

SEQ ID NO: 5585472 - DNA, 19 bp, Homo sapiens
cagctcttggtgggcccag

SEQ ID NO: 5585473 - DNA, 14 bp, Homo sapiens
cagctctttccaaa

SEQ ID NO: 5585474 - DNA, 16 bp, Homo sapiens
cagctctttcctcctt

SEQ ID NO: 5585475 - DNA, 17 bp, Homo sapiens
cagctctttcctccttc

SEQ ID NO: 5585476 - DNA, 21 bp, Homo sapiens
cagctctttcctccttccatg

SEQ ID NO: 5585477 - DNA, 16 bp, Homo sapiens
cagctctttcttcttt

SEQ ID NO: 5585478 - DNA, 22 bp, Homo sapiens
cagctgaaacattccgaagagg

SEQ ID NO: 5585479 - DNA, 11 bp, Homo sapiens
cagctgaaatt

SEQ ID NO: 5585480 - DNA, 18 bp, Homo sapiens
cagctgaaattcaccaag

SEQ ID NO: 5585481 - DNA, 19 bp, Homo sapiens
cagctgaaattcaccaaga

SEQ ID NO: 5585482 - DNA, 20 bp, Homo sapiens
cagctgaaattgaaaagtta

SEQ ID NO: 5585483 - DNA, 22 bp, Homo sapiens
cagctgaacagtgttggctttc

SEQ ID NO: 5585484 - DNA, 15 bp, Homo sapiens
cagctgaaccctgct

SEQ ID NO: 5585485 - DNA, 20 bp, Homo sapiens
cagctgaagaaaaaatcaga

SEQ ID NO: 5585486 - DNA, 18 bp, Homo sapiens
cagctgctgttctcagga

SEQ ID NO: 5585487 - DNA, 13 bp, Homo sapiens
cagctgctgttga

SEQ ID NO: 5585488 - DNA, 17 bp, Homo sapiens
cagctgctgttgaactt

SEQ ID NO: 5585489 - DNA, 18 bp, Homo sapiens
cagctgctgttgaacttt

SEQ ID NO: 5585490 - DNA, 17 bp, Homo sapiens
cagctgcttctcccccc

SEQ ID NO: 5585491 - DNA, 18 bp, Homo sapiens
cagctgcttctcccccca

SEQ ID NO: 5585492 - DNA, 23 bp, Homo sapiens
cagctgcttctccccccatccca

SEQ ID NO: 5585493 - DNA, 13 bp, Homo sapiens
cagctgcttctgc

SEQ ID NO: 5585494 - DNA, 15 bp, Homo sapiens
cagctgcttctgccc

SEQ ID NO: 5585495 - DNA, 20 bp, Homo sapiens
cagctgcttctgcccacccc

SEQ ID NO: 5585496 - DNA, 10 bp, Homo sapiens
cagctgcttg

SEQ ID NO: 5585497 - DNA, 21 bp, Homo sapiens
cagctgcttgggcttcatcct

SEQ ID NO: 5585498 - DNA, 17 bp, Homo sapiens
cagctgcttgtcctgct

SEQ ID NO: 5585499 - DNA, 16 bp, Homo sapiens
cagctgcttgtgggcc

SEQ ID NO: 5585500 - DNA, 21 bp, Homo sapiens
cagctgcttgtgggcccggag

SEQ ID NO: 5585501 - DNA, 15 bp, Homo sapiens
cagctgcttgtgtcc

SEQ ID NO: 5585502 - DNA, 16 bp, Homo sapiens
cagctgctttgacaaa

SEQ ID NO: 5585503 - DNA, 20 bp, Homo sapiens
cagctgctttgacaaaatga

SEQ ID NO: 5585504 - DNA, 15 bp, Homo sapiens
cagctgcttttgcat

SEQ ID NO: 5585505 - DNA, 22 bp, Homo sapiens
cagctggaaaagggtcttggga

SEQ ID NO: 5585506 - DNA, 13 bp, Homo sapiens
cagctggaaactt

SEQ ID NO: 5585507 - DNA, 20 bp, Homo sapiens
cagctggaaagttgggcccc

SEQ ID NO: 5585508 - DNA, 14 bp, Homo sapiens
cagctggaagtcta

SEQ ID NO: 5585509 - DNA, 24 bp, Homo sapiens
cagctggaagtctacctgctggac

SEQ ID NO: 5585510 - DNA, 23 bp, Homo sapiens
cagctggaagtggctctggggtc

SEQ ID NO: 5585511 - DNA, 18 bp, Homo sapiens
cagctggaatgtgccaca

SEQ ID NO: 5585512 - DNA, 19 bp, Homo sapiens
cagctggaatgtgccacag

SEQ ID NO: 5585513 - DNA, 22 bp, Homo sapiens
cagctggaattgctgctctctg

SEQ ID NO: 5585514 - DNA, 15 bp, Homo sapiens
cagctggacagaggg

SEQ ID NO: 5585515 - DNA, 23 bp, Homo sapiens
cagctggacagaggggactctgg

SEQ ID NO: 5585516 - DNA, 24 bp, Homo sapiens
cagctggacagaggggactctggg

SEQ ID NO: 5585517 - DNA, 21 bp, Homo sapiens
cagctggacatactgctggag

SEQ ID NO: 5585518 - DNA, 17 bp, Homo sapiens
cagctggaccatctctg

SEQ ID NO: 5585519 - DNA, 22 bp, Homo sapiens
cagctggacccatttgccagga

SEQ ID NO: 5585520 - DNA, 17 bp, Homo sapiens
cagctggaccctgacca

SEQ ID NO: 5585521 - DNA, 23 bp, Homo sapiens
cagctggaccctgaccagctccc

SEQ ID NO: 5585522 - DNA, 20 bp, Homo sapiens
cagctggaccctgcttcacc

SEQ ID NO: 5585523 - DNA, 19 bp, Homo sapiens
cagctggactctgcatccc

SEQ ID NO: 5585524 - DNA, 13 bp, Homo sapiens
cagctggagaaat

SEQ ID NO: 5585525 - DNA, 13 bp, Homo sapiens
cagctggaggcag

SEQ ID NO: 5585526 - DNA, 14 bp, Homo sapiens
cagctggaggcagg

SEQ ID NO: 5585527 - DNA, 22 bp, Homo sapiens
cagctggaggcaggggcttcct

SEQ ID NO: 5585528 - DNA, 23 bp, Homo sapiens
cagctggaggcaggggcttcctg

SEQ ID NO: 5585529 - DNA, 16 bp, Homo sapiens
cagctggagtgagggc

SEQ ID NO: 5585530 - DNA, 16 bp, Homo sapiens
cagctggatcgctgca

SEQ ID NO: 5585531 - DNA, 13 bp, Homo sapiens
cagctggatctgc

SEQ ID NO: 5585532 - DNA, 23 bp, Homo sapiens
cagctggatgagaatttgagtgc

SEQ ID NO: 5585533 - DNA, 12 bp, Homo sapiens
cagctggcactg

SEQ ID NO: 5585534 - DNA, 18 bp, Homo sapiens
cagctggcactgacagcc

SEQ ID NO: 5585535 - DNA, 19 bp, Homo sapiens
cagctggcactgacagcct

SEQ ID NO: 5585536 - DNA, 14 bp, Homo sapiens
cagctggcagcaga

SEQ ID NO: 5585537 - DNA, 15 bp, Homo sapiens
cagctggcagcagag

SEQ ID NO: 5585538 - DNA, 18 bp, Homo sapiens
cagctggcagcagagtgt

SEQ ID NO: 5585539 - DNA, 15 bp, Homo sapiens
cagctggcagcgcct

SEQ ID NO: 5585540 - DNA, 13 bp, Homo sapiens
cagctggcaggag

SEQ ID NO: 5585541 - DNA, 11 bp, Homo sapiens
cagctggccac

SEQ ID NO: 5585542 - DNA, 19 bp, Homo sapiens
cagctggccaccatggcac

SEQ ID NO: 5585543 - DNA, 15 bp, Homo sapiens
cagctggcccactgc

SEQ ID NO: 5585544 - DNA, 15 bp, Homo sapiens
cagctggcccagtgg

SEQ ID NO: 5585545 - DNA, 19 bp, Homo sapiens
cagctggcccccagccctg

SEQ ID NO: 5585546 - DNA, 21 bp, Homo sapiens
cagctggcccccagccctggg

SEQ ID NO: 5585547 - DNA, 18 bp, Homo sapiens
cagctggcccgtgacaga

SEQ ID NO: 5585548 - DNA, 14 bp, Homo sapiens
cagctggccggaag

SEQ ID NO: 5585549 - DNA, 17 bp, Homo sapiens
cagctggccggaaggag

SEQ ID NO: 5585550 - DNA, 17 bp, Homo sapiens
cagctggccgtcacttg

SEQ ID NO: 5585551 - DNA, 19 bp, Homo sapiens
cagctggcctctagaacac

SEQ ID NO: 5585552 - DNA, 15 bp, Homo sapiens
cagctggcctggaca

SEQ ID NO: 5585553 - DNA, 13 bp, Homo sapiens
cagctggcctggg

SEQ ID NO: 5585554 - DNA, 15 bp, Homo sapiens
cagctggcctggggt

SEQ ID NO: 5585555 - DNA, 21 bp, Homo sapiens
cagctggcggaacctggctgc

SEQ ID NO: 5585556 - DNA, 15 bp, Homo sapiens
cagctggcggaggct

SEQ ID NO: 5585557 - DNA, 13 bp, Homo sapiens
cagctggcgggtg

SEQ ID NO: 5585558 - DNA, 24 bp, Homo sapiens
cagctggctagcattcctcaggaa

SEQ ID NO: 5585559 - DNA, 16 bp, Homo sapiens
cagctggctatctact

SEQ ID NO: 5585560 - DNA, 11 bp, Homo sapiens
cagctggctct

SEQ ID NO: 5585561 - DNA, 13 bp, Homo sapiens
cagctggctctga

SEQ ID NO: 5585562 - DNA, 23 bp, Homo sapiens
cagctggctctgaatgtagccag

SEQ ID NO: 5585563 - DNA, 14 bp, Homo sapiens
cagctggctctgca

SEQ ID NO: 5585564 - DNA, 18 bp, Homo sapiens
cagctggctgctgacagg

SEQ ID NO: 5585565 - DNA, 22 bp, Homo sapiens
cagctggctgctgacaggatgt

SEQ ID NO: 5585566 - DNA, 13 bp, Homo sapiens
cagctggctgggc

SEQ ID NO: 5585567 - DNA, 14 bp, Homo sapiens
cagctggctgggcc

SEQ ID NO: 5585568 - DNA, 14 bp, Homo sapiens
cagctggctgggtc

SEQ ID NO: 5585569 - DNA, 14 bp, Homo sapiens
cagctggctttgca

SEQ ID NO: 5585570 - DNA, 16 bp, Homo sapiens
cagctgggaagccctt

SEQ ID NO: 5585571 - DNA, 16 bp, Homo sapiens
cagctgggacctaatg

SEQ ID NO: 5585572 - DNA, 12 bp, Homo sapiens
cagctgggagaa

SEQ ID NO: 5585573 - DNA, 19 bp, Homo sapiens
cagctgggagccagtgtgc

SEQ ID NO: 5585574 - DNA, 22 bp, Homo sapiens
cagctgggagccagtgtgccca

SEQ ID NO: 5585575 - DNA, 16 bp, Homo sapiens
cagctgggagcctggt

SEQ ID NO: 5585576 - DNA, 14 bp, Homo sapiens
cagctgggaggcaa

SEQ ID NO: 5585577 - DNA, 23 bp, Homo sapiens
cagctgggaggcaagaggggtgg

SEQ ID NO: 5585578 - DNA, 22 bp, Homo sapiens
cagctgggatacacacggctcc

SEQ ID NO: 5585579 - DNA, 20 bp, Homo sapiens
cagctgggatctgactgcac

SEQ ID NO: 5585580 - DNA, 22 bp, Homo sapiens
cagctgggatctgactgcacgt

SEQ ID NO: 5585581 - DNA, 17 bp, Homo sapiens
cagctgggcaaagccac

SEQ ID NO: 5585582 - DNA, 15 bp, Homo sapiens
cagctgggcagggtg

SEQ ID NO: 5585583 - DNA, 12 bp, Homo sapiens
cagctgggcagt

SEQ ID NO: 5585584 - DNA, 14 bp, Homo sapiens
cagctgggcatgcc

SEQ ID NO: 5585585 - DNA, 20 bp, Homo sapiens
cagctgggcatgccatgtct

SEQ ID NO: 5585586 - DNA, 21 bp, Homo sapiens
cagctgggcatgccatgtctg

SEQ ID NO: 5585587 - DNA, 22 bp, Homo sapiens
cagctgggcatgccatgtctga

SEQ ID NO: 5585588 - DNA, 21 bp, Homo sapiens
cagctgggcccaaccctgtct

SEQ ID NO: 5585589 - DNA, 20 bp, Homo sapiens
cagctgggcccacagccccc

SEQ ID NO: 5585590 - DNA, 22 bp, Homo sapiens
cagctgggcccacagcccccac

SEQ ID NO: 5585591 - DNA, 14 bp, Homo sapiens
cagctgggcccagc

SEQ ID NO: 5585592 - DNA, 16 bp, Homo sapiens
cagctgggcccagcac

SEQ ID NO: 5585593 - DNA, 12 bp, Homo sapiens
cagctgggcccc

SEQ ID NO: 5585594 - DNA, 19 bp, Homo sapiens
cagctgggccccatgctct

SEQ ID NO: 5585595 - DNA, 21 bp, Homo sapiens
cagctgggccccatgctctgc

SEQ ID NO: 5585596 - DNA, 13 bp, Homo sapiens
cagctgggccggc

SEQ ID NO: 5585597 - DNA, 14 bp, Homo sapiens
cagctgggccggcc

SEQ ID NO: 5585598 - DNA, 20 bp, Homo sapiens
cagctgggccgggacccagg

SEQ ID NO: 5585599 - DNA, 14 bp, Homo sapiens
cagctgggcctcct

SEQ ID NO: 5585600 - DNA, 16 bp, Homo sapiens
cagctgggcctcctgc

SEQ ID NO: 5585601 - DNA, 22 bp, Homo sapiens
cagctgggcctcctgcctccgg

SEQ ID NO: 5585602 - DNA, 23 bp, Homo sapiens
cagctgggcctcctgcctccggg

SEQ ID NO: 5585603 - DNA, 15 bp, Homo sapiens
cagctgggctctgcc

SEQ ID NO: 5585604 - DNA, 18 bp, Homo sapiens
cagctgggctctgccacc

SEQ ID NO: 5585605 - DNA, 11 bp, Homo sapiens
cagctgggctg

SEQ ID NO: 5585606 - DNA, 12 bp, Homo sapiens
cagctgggctgt

SEQ ID NO: 5585607 - DNA, 15 bp, Homo sapiens
cagctgggcttggcc

SEQ ID NO: 5585608 - DNA, 20 bp, Homo sapiens
cagctgggcttggcctggag

SEQ ID NO: 5585609 - DNA, 23 bp, Homo sapiens
cagctgggcttggcctggagagg

SEQ ID NO: 5585610 - DNA, 14 bp, Homo sapiens
cagctggggagatg

SEQ ID NO: 5585611 - DNA, 15 bp, Homo sapiens
cagctggggagcagc

SEQ ID NO: 5585612 - DNA, 18 bp, Homo sapiens
cagctggggagcagctga

SEQ ID NO: 5585613 - DNA, 20 bp, Homo sapiens
cagctggggagcagctgaga

SEQ ID NO: 5585614 - DNA, 15 bp, Homo sapiens
cagctggggccagag

SEQ ID NO: 5585615 - DNA, 22 bp, Homo sapiens
cagctggggccagaggctggga

SEQ ID NO: 5585616 - DNA, 19 bp, Homo sapiens
cagctggggccaggctggg

SEQ ID NO: 5585617 - DNA, 22 bp, Homo sapiens
cagctggggccaggctgggtcg

SEQ ID NO: 5585618 - DNA, 14 bp, Homo sapiens
cagctggggcccct

SEQ ID NO: 5585619 - DNA, 16 bp, Homo sapiens
cagctggggcccctcg

SEQ ID NO: 5585620 - DNA, 23 bp, Homo sapiens
cagctggggcccctcggctaccc

SEQ ID NO: 5585621 - DNA, 21 bp, Homo sapiens
cagctggggccggttttcctc

SEQ ID NO: 5585622 - DNA, 16 bp, Homo sapiens
cagctggggctgtgga

SEQ ID NO: 5585623 - DNA, 20 bp, Homo sapiens
cagctggggtaggctgtctg

SEQ ID NO: 5585624 - DNA, 14 bp, Homo sapiens
cagctggggtcctg

SEQ ID NO: 5585625 - DNA, 23 bp, Homo sapiens
cagctggggtgcagggatgtggg

SEQ ID NO: 5585626 - DNA, 23 bp, Homo sapiens
cagctggggtggggacctcaggc

SEQ ID NO: 5585627 - DNA, 22 bp, Homo sapiens
cagctgggtgcagaagctgtgg

SEQ ID NO: 5585628 - DNA, 16 bp, Homo sapiens
cagctgggtgccccag

SEQ ID NO: 5585629 - DNA, 19 bp, Homo sapiens
cagctgggtgccccaggga

SEQ ID NO: 5585630 - DNA, 20 bp, Homo sapiens
cagctgggtggcactgccat

SEQ ID NO: 5585631 - DNA, 13 bp, Homo sapiens
cagctgggtgggg

SEQ ID NO: 5585632 - DNA, 24 bp, Homo sapiens
cagctgggtggggcagcacacctc

SEQ ID NO: 5585633 - DNA, 19 bp, Homo sapiens
cagctggtcagtctttgct

SEQ ID NO: 5585634 - DNA, 20 bp, Homo sapiens
cagctggtcagtctttgctc

SEQ ID NO: 5585635 - DNA, 17 bp, Homo sapiens
cagctggtccagggcct

SEQ ID NO: 5585636 - DNA, 22 bp, Homo sapiens
cagctggtcctccactttgctg

SEQ ID NO: 5585637 - DNA, 19 bp, Homo sapiens
cagctggtcctgaccagga

SEQ ID NO: 5585638 - DNA, 20 bp, Homo sapiens
cagctggtcctgaccaggat

SEQ ID NO: 5585639 - DNA, 13 bp, Homo sapiens
cagctggtcctgt

SEQ ID NO: 5585640 - DNA, 14 bp, Homo sapiens
cagctggtctgttt

SEQ ID NO: 5585641 - DNA, 15 bp, Homo sapiens
cagctggtcttttct

SEQ ID NO: 5585642 - DNA, 18 bp, Homo sapiens
cagctggtgaatccatga

SEQ ID NO: 5585643 - DNA, 22 bp, Homo sapiens
cagctggtgccaaatagcccca

SEQ ID NO: 5585644 - DNA, 14 bp, Homo sapiens
cagctggtgcccca

SEQ ID NO: 5585645 - DNA, 15 bp, Homo sapiens
cagctggtgccccac

SEQ ID NO: 5585646 - DNA, 17 bp, Homo sapiens
cagctggtgccccacct

SEQ ID NO: 5585647 - DNA, 19 bp, Homo sapiens
cagctggtgccccacctgc

SEQ ID NO: 5585648 - DNA, 18 bp, Homo sapiens
cagctggtgccctgcttt

SEQ ID NO: 5585649 - DNA, 23 bp, Homo sapiens
cagctggtgccctgctttcagat

SEQ ID NO: 5585650 - DNA, 13 bp, Homo sapiens
cagctggtgctgc

SEQ ID NO: 5585651 - DNA, 14 bp, Homo sapiens
cagctggtgctgca

SEQ ID NO: 5585652 - DNA, 17 bp, Homo sapiens
cagctggtgctgcaagg

SEQ ID NO: 5585653 - DNA, 14 bp, Homo sapiens
cagctggtggatgg

SEQ ID NO: 5585654 - DNA, 19 bp, Homo sapiens
cagctggtggtatctgagt

SEQ ID NO: 5585655 - DNA, 11 bp, Homo sapiens
cagctggtgta

SEQ ID NO: 5585656 - DNA, 15 bp, Homo sapiens
cagctggtgtagcta

SEQ ID NO: 5585657 - DNA, 22 bp, Homo sapiens
cagctggtgtcactctgcctct

SEQ ID NO: 5585658 - DNA, 22 bp, Homo sapiens
cagctggttactcagggttcat

SEQ ID NO: 5585659 - DNA, 16 bp, Homo sapiens
cagctgtaatctatga

SEQ ID NO: 5585660 - DNA, 20 bp, Homo sapiens
cagctgtaccggccactgca

SEQ ID NO: 5585661 - DNA, 23 bp, Homo sapiens
cagctgtaccggccactgcaacc

SEQ ID NO: 5585662 - DNA, 15 bp, Homo sapiens
cagctgtactgagtt

SEQ ID NO: 5585663 - DNA, 19 bp, Homo sapiens
caggaaaagaaaaatttct

SEQ ID NO: 5585664 - DNA, 23 bp, Homo sapiens
caggaaaagagggagaagaaaga

SEQ ID NO: 5585665 - DNA, 19 bp, Homo sapiens
caggaaaagcctctgtgtc

SEQ ID NO: 5585666 - DNA, 16 bp, Homo sapiens
caggaaaaggcctggg

SEQ ID NO: 5585667 - DNA, 21 bp, Homo sapiens
caggaaaaggctaagaaaaag

SEQ ID NO: 5585668 - DNA, 23 bp, Homo sapiens
caggaaaagggcattttgtacaa

SEQ ID NO: 5585669 - DNA, 22 bp, Homo sapiens
caggaaaaggtagcttacctga

SEQ ID NO: 5585670 - DNA, 11 bp, Homo sapiens
caggaaaataa

SEQ ID NO: 5585671 - DNA, 22 bp, Homo sapiens
caggaaaatacgaaaatcccat

SEQ ID NO: 5585672 - DNA, 22 bp, Homo sapiens
caggaaaatgtatccagaggaa

SEQ ID NO: 5585673 - DNA, 16 bp, Homo sapiens
caggaaaatgtgaggg

SEQ ID NO: 5585674 - DNA, 22 bp, Homo sapiens
caggaaacaaaccttgccttga

SEQ ID NO: 5585675 - DNA, 18 bp, Homo sapiens
caggaaacaagggaaggg

SEQ ID NO: 5585676 - DNA, 18 bp, Homo sapiens
caggaaaccccgagaagg

SEQ ID NO: 5585677 - DNA, 15 bp, Homo sapiens
caggaaaccctggct

SEQ ID NO: 5585678 - DNA, 20 bp, Homo sapiens
caggaaactccacatctgcc

SEQ ID NO: 5585679 - DNA, 16 bp, Homo sapiens
caggaaagaagcattt

SEQ ID NO: 5585680 - DNA, 12 bp, Homo sapiens
caggaaagaata

SEQ ID NO: 5585681 - DNA, 21 bp, Homo sapiens
caggaaagactggccctctag

SEQ ID NO: 5585682 - DNA, 15 bp, Homo sapiens
caggaaagagctagg

SEQ ID NO: 5585683 - DNA, 18 bp, Homo sapiens
caggaaagagctaggaac

SEQ ID NO: 5585684 - DNA, 21 bp, Homo sapiens
caggaaagagctaggaaccct

SEQ ID NO: 5585685 - DNA, 15 bp, Homo sapiens
caggaaagagggagc

SEQ ID NO: 5585686 - DNA, 19 bp, Homo sapiens
caggaaagatgtcccacag

SEQ ID NO: 5585687 - DNA, 20 bp, Homo sapiens
caggaaagatgtcccacagg

SEQ ID NO: 5585688 - DNA, 22 bp, Homo sapiens
caggaaagatgtcccacaggga

SEQ ID NO: 5585689 - DNA, 19 bp, Homo sapiens
caggaaagcatgcattgaa

SEQ ID NO: 5585690 - DNA, 13 bp, Homo sapiens
caggaaagccaca

SEQ ID NO: 5585691 - DNA, 14 bp, Homo sapiens
caggaaagccacat

SEQ ID NO: 5585692 - DNA, 15 bp, Homo sapiens
caggaaagccctccc

SEQ ID NO: 5585693 - DNA, 20 bp, Homo sapiens
caggaaagccctcccccttc

SEQ ID NO: 5585694 - DNA, 23 bp, Homo sapiens
caggaaagccctcccccttcccc

SEQ ID NO: 5585695 - DNA, 14 bp, Homo sapiens
caggaaaggaggac

SEQ ID NO: 5585696 - DNA, 18 bp, Homo sapiens
caggaaaggcccagccac

SEQ ID NO: 5585697 - DNA, 19 bp, Homo sapiens
caggaaaggccccaatctt

SEQ ID NO: 5585698 - DNA, 16 bp, Homo sapiens
caggaaaggctccagg

SEQ ID NO: 5585699 - DNA, 20 bp, Homo sapiens
caggaaaggctccaggagca

SEQ ID NO: 5585700 - DNA, 17 bp, Homo sapiens
caggaaagggaaggccc

SEQ ID NO: 5585701 - DNA, 22 bp, Homo sapiens
caggaaagttcagagttttctg

SEQ ID NO: 5585702 - DNA, 19 bp, Homo sapiens
caggaaataccaactgaag

SEQ ID NO: 5585703 - DNA, 22 bp, Homo sapiens
caggaaatataaacttaaaata

SEQ ID NO: 5585704 - DNA, 15 bp, Homo sapiens
caggaaatatatatg

SEQ ID NO: 5585705 - DNA, 16 bp, Homo sapiens
caggaaatatatatgt

SEQ ID NO: 5585706 - DNA, 22 bp, Homo sapiens
caggaaatatctgtgaaggact

SEQ ID NO: 5585707 - DNA, 16 bp, Homo sapiens
caggaaatatgtcccc

SEQ ID NO: 5585708 - DNA, 23 bp, Homo sapiens
caggaaatcaaatatgcaaagca

SEQ ID NO: 5585709 - DNA, 17 bp, Homo sapiens
caggaaatcagagctgg

SEQ ID NO: 5585710 - DNA, 20 bp, Homo sapiens
caggaaatgagagatagagg

SEQ ID NO: 5585711 - DNA, 21 bp, Homo sapiens
caggaaatgctgacccatggg

SEQ ID NO: 5585712 - DNA, 23 bp, Homo sapiens
caggaaatgctgacccatgggca

SEQ ID NO: 5585713 - DNA, 12 bp, Homo sapiens
caggaaatgtag

SEQ ID NO: 5585714 - DNA, 16 bp, Homo sapiens
caggaaattcagccca

SEQ ID NO: 5585715 - DNA, 14 bp, Homo sapiens
caggaaatttttgc

SEQ ID NO: 5585716 - DNA, 21 bp, Homo sapiens
caggaaatttttgcatgttta

SEQ ID NO: 5585717 - DNA, 14 bp, Homo sapiens
caggaacacacagg

SEQ ID NO: 5585718 - DNA, 15 bp, Homo sapiens
caggaacacatgcac

SEQ ID NO: 5585719 - DNA, 15 bp, Homo sapiens
caggaacacccagcc

SEQ ID NO: 5585720 - DNA, 15 bp, Homo sapiens
caggaacagaaggat

SEQ ID NO: 5585721 - DNA, 13 bp, Homo sapiens
caggaacagagac

SEQ ID NO: 5585722 - DNA, 14 bp, Homo sapiens
caggaacagagact

SEQ ID NO: 5585723 - DNA, 18 bp, Homo sapiens
caggaacagagactctgg

SEQ ID NO: 5585724 - DNA, 19 bp, Homo sapiens
caggaacagagactctgga

SEQ ID NO: 5585725 - DNA, 20 bp, Homo sapiens
caggaacagagactctggaa

SEQ ID NO: 5585726 - DNA, 20 bp, Homo sapiens
caggaacagctatgggagcc

SEQ ID NO: 5585727 - DNA, 22 bp, Homo sapiens
caggaacagctatgggagcccc

SEQ ID NO: 5585728 - DNA, 23 bp, Homo sapiens
caggaacagctatgggagcccca

SEQ ID NO: 5585729 - DNA, 19 bp, Homo sapiens
caggaacagggaccagctc

SEQ ID NO: 5585730 - DNA, 17 bp, Homo sapiens
caggaacagtggctggg

SEQ ID NO: 5585731 - DNA, 18 bp, Homo sapiens
caggaacagtggctgggt

SEQ ID NO: 5585732 - DNA, 18 bp, Homo sapiens
caggaacattcccacata

SEQ ID NO: 5585733 - DNA, 12 bp, Homo sapiens
caggaaccaaaa

SEQ ID NO: 5585734 - DNA, 23 bp, Homo sapiens
caggaaccaaaaaaccccagcta

SEQ ID NO: 5585735 - DNA, 16 bp, Homo sapiens
caggaaccaaaaagag

SEQ ID NO: 5585736 - DNA, 14 bp, Homo sapiens
caggaaccacagat

SEQ ID NO: 5585737 - DNA, 15 bp, Homo sapiens
caggaaccagggcct

SEQ ID NO: 5585738 - DNA, 19 bp, Homo sapiens
caggaaccagggcctccct

SEQ ID NO: 5585739 - DNA, 23 bp, Homo sapiens
caggaaccatagttgacagttcc

SEQ ID NO: 5585740 - DNA, 18 bp, Homo sapiens
caggaacccaccctctcc

SEQ ID NO: 5585741 - DNA, 19 bp, Homo sapiens
caggaacccaccctctcca

SEQ ID NO: 5585742 - DNA, 20 bp, Homo sapiens
caggaacccatcactgtgtc

SEQ ID NO: 5585743 - DNA, 22 bp, Homo sapiens
caggaacccatcactgtgtctc

SEQ ID NO: 5585744 - DNA, 23 bp, Homo sapiens
caggaacccatcactgtgtctca

SEQ ID NO: 5585745 - DNA, 18 bp, Homo sapiens
caggaaccctcctcctgt

SEQ ID NO: 5585746 - DNA, 12 bp, Homo sapiens
caggaaccctgg

SEQ ID NO: 5585747 - DNA, 15 bp, Homo sapiens
caggaaccctggaga

SEQ ID NO: 5585748 - DNA, 19 bp, Homo sapiens
caggaacccttacagtaga

SEQ ID NO: 5585749 - DNA, 19 bp, Homo sapiens
caggaacccttgcatccat

SEQ ID NO: 5585750 - DNA, 21 bp, Homo sapiens
caggaaccgaacatatcattt

SEQ ID NO: 5585751 - DNA, 20 bp, Homo sapiens
caggaacctcgagtactgtg

SEQ ID NO: 5585752 - DNA, 19 bp, Homo sapiens
caggaacgagcactggcca

SEQ ID NO: 5585753 - DNA, 21 bp, Homo sapiens
caggaacgctctcctcgagcc

SEQ ID NO: 5585754 - DNA, 16 bp, Homo sapiens
caggaactcccagcaa

SEQ ID NO: 5585755 - DNA, 22 bp, Homo sapiens
caggaactctaaggtacacact

SEQ ID NO: 5585756 - DNA, 13 bp, Homo sapiens
caggaactctgtg

SEQ ID NO: 5585757 - DNA, 16 bp, Homo sapiens
caggaactctgtgtga

SEQ ID NO: 5585758 - DNA, 19 bp, Homo sapiens
caggaactctgtgtgagag

SEQ ID NO: 5585759 - DNA, 19 bp, Homo sapiens
caggaactgaaaaccagtc

SEQ ID NO: 5585760 - DNA, 15 bp, Homo sapiens
caggaactgagccag

SEQ ID NO: 5585761 - DNA, 17 bp, Homo sapiens
caggaactgcctgggcc

SEQ ID NO: 5585762 - DNA, 13 bp, Homo sapiens
caggaactgggcc

SEQ ID NO: 5585763 - DNA, 19 bp, Homo sapiens
caggaactgggctgggcct

SEQ ID NO: 5585764 - DNA, 17 bp, Homo sapiens
caggaacttctagctca

SEQ ID NO: 5585765 - DNA, 14 bp, Homo sapiens
caggaacttgaata

SEQ ID NO: 5585766 - DNA, 12 bp, Homo sapiens
caggaagaaact

SEQ ID NO: 5585767 - DNA, 14 bp, Homo sapiens
caggaagaaacttt

SEQ ID NO: 5585768 - DNA, 14 bp, Homo sapiens
caggaagaaagaat

SEQ ID NO: 5585769 - DNA, 17 bp, Homo sapiens
caggaagaaagaatgtt

SEQ ID NO: 5585770 - DNA, 13 bp, Homo sapiens
caggaagaagaga

SEQ ID NO: 5585771 - DNA, 16 bp, Homo sapiens
caggaagaaggcccgg

SEQ ID NO: 5585772 - DNA, 22 bp, Homo sapiens
caggaagacccaacacatggga

SEQ ID NO: 5585773 - DNA, 13 bp, Homo sapiens
caggaagactgga

SEQ ID NO: 5585774 - DNA, 20 bp, Homo sapiens
caggaagactggacccccag

SEQ ID NO: 5585775 - DNA, 19 bp, Homo sapiens
caggaagacttccagcttt

SEQ ID NO: 5585776 - DNA, 22 bp, Homo sapiens
caggaagacttccagctttctc

SEQ ID NO: 5585777 - DNA, 23 bp, Homo sapiens
caggaagacttccagctttctct

SEQ ID NO: 5585778 - DNA, 14 bp, Homo sapiens
caggaagagaagga

SEQ ID NO: 5585779 - DNA, 13 bp, Homo sapiens
caggaagagagag

SEQ ID NO: 5585780 - DNA, 14 bp, Homo sapiens
caggaagagagaga

SEQ ID NO: 5585781 - DNA, 21 bp, Homo sapiens
caggaagagagagagagaggt

SEQ ID NO: 5585782 - DNA, 14 bp, Homo sapiens
caggaagaggccca

SEQ ID NO: 5585783 - DNA, 14 bp, Homo sapiens
caggaagaggtaat

SEQ ID NO: 5585784 - DNA, 16 bp, Homo sapiens
caggaagataaaaatc

SEQ ID NO: 5585785 - DNA, 18 bp, Homo sapiens
caggaagatcccccagaa

SEQ ID NO: 5585786 - DNA, 18 bp, Homo sapiens
caggaagatcttaaattt

SEQ ID NO: 5585787 - DNA, 20 bp, Homo sapiens
caggaagatgtatgctttga

SEQ ID NO: 5585788 - DNA, 18 bp, Homo sapiens
caggaagcacagcaggtt

SEQ ID NO: 5585789 - DNA, 15 bp, Homo sapiens
caggaagcacaggcc

SEQ ID NO: 5585790 - DNA, 14 bp, Homo sapiens
caggaagcacccca

SEQ ID NO: 5585791 - DNA, 18 bp, Homo sapiens
caggaagcattcagagag

SEQ ID NO: 5585792 - DNA, 22 bp, Homo sapiens
caggaagcattcagagagcagc

SEQ ID NO: 5585793 - DNA, 15 bp, Homo sapiens
caggaagccagagcc

SEQ ID NO: 5585794 - DNA, 16 bp, Homo sapiens
caggaagccagagccc

SEQ ID NO: 5585795 - DNA, 18 bp, Homo sapiens
caggaagcccaattgctg

SEQ ID NO: 5585796 - DNA, 13 bp, Homo sapiens
caggaagccccca

SEQ ID NO: 5585797 - DNA, 19 bp, Homo sapiens
caggaagcccccaagttga

SEQ ID NO: 5585798 - DNA, 13 bp, Homo sapiens
caggaagccccgc

SEQ ID NO: 5585799 - DNA, 19 bp, Homo sapiens
caggaagccccgctcaggt

SEQ ID NO: 5585800 - DNA, 23 bp, Homo sapiens
caggaagccccgctcaggtagcc

SEQ ID NO: 5585801 - DNA, 22 bp, Homo sapiens
caggaagccggtgcctgggtgg

SEQ ID NO: 5585802 - DNA, 14 bp, Homo sapiens
caggaagcctcctg

SEQ ID NO: 5585803 - DNA, 14 bp, Homo sapiens
caggaagccttccc

SEQ ID NO: 5585804 - DNA, 12 bp, Homo sapiens
caggaagctcag

SEQ ID NO: 5585805 - DNA, 17 bp, Homo sapiens
caggaagctcagactgg

SEQ ID NO: 5585806 - DNA, 13 bp, Homo sapiens
caggaagctcagc

SEQ ID NO: 5585807 - DNA, 16 bp, Homo sapiens
caggaagctcagcctt

SEQ ID NO: 5585808 - DNA, 17 bp, Homo sapiens
caggaagctcagggcct

SEQ ID NO: 5585809 - DNA, 18 bp, Homo sapiens
caggaagctcagggcctg

SEQ ID NO: 5585810 - DNA, 15 bp, Homo sapiens
caggaagctggcaga

SEQ ID NO: 5585811 - DNA, 23 bp, Homo sapiens
caggaagctttggtgagaacctg

SEQ ID NO: 5585812 - DNA, 14 bp, Homo sapiens
caggaaggaaaact

SEQ ID NO: 5585813 - DNA, 20 bp, Homo sapiens
caggaaggaaaactatgtat

SEQ ID NO: 5585814 - DNA, 18 bp, Homo sapiens
caggaaggaaacaacatt

SEQ ID NO: 5585815 - DNA, 13 bp, Homo sapiens
caggaaggaagag

SEQ ID NO: 5585816 - DNA, 14 bp, Homo sapiens
caggaaggacagac

SEQ ID NO: 5585817 - DNA, 12 bp, Homo sapiens
caggaaggagag

SEQ ID NO: 5585818 - DNA, 14 bp, Homo sapiens
caggaaggagagcc

SEQ ID NO: 5585819 - DNA, 19 bp, Homo sapiens
caggaaggagctgcctgga

SEQ ID NO: 5585820 - DNA, 19 bp, Homo sapiens
caggaaggatggcaagcac

SEQ ID NO: 5585821 - DNA, 13 bp, Homo sapiens
caggaaggcagct

SEQ ID NO: 5585822 - DNA, 14 bp, Homo sapiens
caggaaggcagctg

SEQ ID NO: 5585823 - DNA, 19 bp, Homo sapiens
caggaaggccacagtgctg

SEQ ID NO: 5585824 - DNA, 16 bp, Homo sapiens
caggaaggccacttgt

SEQ ID NO: 5585825 - DNA, 23 bp, Homo sapiens
caggaaggcccctctgtggagcg

SEQ ID NO: 5585826 - DNA, 14 bp, Homo sapiens
caggaaggcctagg

SEQ ID NO: 5585827 - DNA, 20 bp, Homo sapiens
caggaaggcctaggctagga

SEQ ID NO: 5585828 - DNA, 14 bp, Homo sapiens
caggaaggcctggg

SEQ ID NO: 5585829 - DNA, 18 bp, Homo sapiens
caggaaggcctgggtgga

SEQ ID NO: 5585830 - DNA, 18 bp, Homo sapiens
caggaaggcggcaggcag

SEQ ID NO: 5585831 - DNA, 20 bp, Homo sapiens
caggaaggcggcaggcagag

SEQ ID NO: 5585832 - DNA, 23 bp, Homo sapiens
caggaaggcggcaggcagagaag

SEQ ID NO: 5585833 - DNA, 23 bp, Homo sapiens
caggaagggaaagcgggcagccc

SEQ ID NO: 5585834 - DNA, 14 bp, Homo sapiens
caggaagggaagcg

SEQ ID NO: 5585835 - DNA, 15 bp, Homo sapiens
caggaagggaagcgt

SEQ ID NO: 5585836 - DNA, 16 bp, Homo sapiens
caggaagggagaggag

SEQ ID NO: 5585837 - DNA, 15 bp, Homo sapiens
caggaagggagggag

SEQ ID NO: 5585838 - DNA, 22 bp, Homo sapiens
caggaagggagggagctgaggc

SEQ ID NO: 5585839 - DNA, 21 bp, Homo sapiens
caggaagggcaggaaggagag

SEQ ID NO: 5585840 - DNA, 17 bp, Homo sapiens
caggacccccttcccct

SEQ ID NO: 5585841 - DNA, 18 bp, Homo sapiens
caggacccctcagctccc

SEQ ID NO: 5585842 - DNA, 12 bp, Homo sapiens
caggacccctga

SEQ ID NO: 5585843 - DNA, 13 bp, Homo sapiens
caggacccctggg

SEQ ID NO: 5585844 - DNA, 15 bp, Homo sapiens
caggacccgccagcc

SEQ ID NO: 5585845 - DNA, 17 bp, Homo sapiens
caggacccgcctgctcc

SEQ ID NO: 5585846 - DNA, 13 bp, Homo sapiens
caggaccctccac

SEQ ID NO: 5585847 - DNA, 16 bp, Homo sapiens
caggaccctcgccgga

SEQ ID NO: 5585848 - DNA, 20 bp, Homo sapiens
caggaccctcgctggccccc

SEQ ID NO: 5585849 - DNA, 21 bp, Homo sapiens
caggaccctcgctggccccca

SEQ ID NO: 5585850 - DNA, 14 bp, Homo sapiens
caggaccctgaagg

SEQ ID NO: 5585851 - DNA, 17 bp, Homo sapiens
caggaccctgaaggggc

SEQ ID NO: 5585852 - DNA, 18 bp, Homo sapiens
caggaccctgaaggggcc

SEQ ID NO: 5585853 - DNA, 17 bp, Homo sapiens
caggaccctgccaggca

SEQ ID NO: 5585854 - DNA, 21 bp, Homo sapiens
caggaccctgccaggcacagg

SEQ ID NO: 5585855 - DNA, 17 bp, Homo sapiens
caggaccctggacccag

SEQ ID NO: 5585856 - DNA, 18 bp, Homo sapiens
caggaccctggacccagc

SEQ ID NO: 5585857 - DNA, 15 bp, Homo sapiens
caggaccctgggtca

SEQ ID NO: 5585858 - DNA, 14 bp, Homo sapiens
caggaccctgtcag

SEQ ID NO: 5585859 - DNA, 23 bp, Homo sapiens
caggaccctgtcaggattgcagg

SEQ ID NO: 5585860 - DNA, 18 bp, Homo sapiens
caggaccctgtcctgcag

SEQ ID NO: 5585861 - DNA, 19 bp, Homo sapiens
caggaccctgtcctgcagt

SEQ ID NO: 5585862 - DNA, 22 bp, Homo sapiens
caggaccctgtcctgcagtccc

SEQ ID NO: 5585863 - DNA, 19 bp, Homo sapiens
caggacctagagccgggca

SEQ ID NO: 5585864 - DNA, 20 bp, Homo sapiens
caggacctcagagtccaggc

SEQ ID NO: 5585865 - DNA, 21 bp, Homo sapiens
caggacctcagagtccaggcc

SEQ ID NO: 5585866 - DNA, 13 bp, Homo sapiens
caggacctcaggt

SEQ ID NO: 5585867 - DNA, 17 bp, Homo sapiens
caggacctccaagccac

SEQ ID NO: 5585868 - DNA, 19 bp, Homo sapiens
caggacctccaagccactg

SEQ ID NO: 5585869 - DNA, 23 bp, Homo sapiens
caggacctcccttccgaccctct

SEQ ID NO: 5585870 - DNA, 13 bp, Homo sapiens
caggacctccggg

SEQ ID NO: 5585871 - DNA, 17 bp, Homo sapiens
caggacctcgtgccacc

SEQ ID NO: 5585872 - DNA, 20 bp, Homo sapiens
caggacctctggacctcagg

SEQ ID NO: 5585873 - DNA, 13 bp, Homo sapiens
caggacctgagcc

SEQ ID NO: 5585874 - DNA, 18 bp, Homo sapiens
caggacctgagcctggcc

SEQ ID NO: 5585875 - DNA, 16 bp, Homo sapiens
caggacctgcctagca

SEQ ID NO: 5585876 - DNA, 20 bp, Homo sapiens
caggacctgcctagcatggg

SEQ ID NO: 5585877 - DNA, 18 bp, Homo sapiens
caggacctggagacagga

SEQ ID NO: 5585878 - DNA, 13 bp, Homo sapiens
caggacctggcat

SEQ ID NO: 5585879 - DNA, 16 bp, Homo sapiens
caggacctggctgcca

SEQ ID NO: 5585880 - DNA, 18 bp, Homo sapiens
caggacctggctgccata

SEQ ID NO: 5585881 - DNA, 20 bp, Homo sapiens
caggacctgggacctcccct

SEQ ID NO: 5585882 - DNA, 20 bp, Homo sapiens
caggaccttcgggctgtgcc

SEQ ID NO: 5585883 - DNA, 22 bp, Homo sapiens
caggaccttcgggctgtgcccg

SEQ ID NO: 5585884 - DNA, 16 bp, Homo sapiens
caggaccttgcttcct

SEQ ID NO: 5585885 - DNA, 20 bp, Homo sapiens
caggaccttttgaagtagtt

SEQ ID NO: 5585886 - DNA, 22 bp, Homo sapiens
caggacgaatgcatattcaaca

SEQ ID NO: 5585887 - DNA, 19 bp, Homo sapiens
caggacgatttcactgaca

SEQ ID NO: 5585888 - DNA, 16 bp, Homo sapiens
caggacgcagggagac

SEQ ID NO: 5585889 - DNA, 17 bp, Homo sapiens
caggacgcagggagacc

SEQ ID NO: 5585890 - DNA, 16 bp, Homo sapiens
caggacgcatgcaggg

SEQ ID NO: 5585891 - DNA, 14 bp, Homo sapiens
caggacgccactca

SEQ ID NO: 5585892 - DNA, 17 bp, Homo sapiens
caggacgccactcattt

SEQ ID NO: 5585893 - DNA, 18 bp, Homo sapiens
caggacgccactcatttc

SEQ ID NO: 5585894 - DNA, 21 bp, Homo sapiens
caggacgcttctgaatgctgc

SEQ ID NO: 5585895 - DNA, 19 bp, Homo sapiens
caggacggctcctcagagc

SEQ ID NO: 5585896 - DNA, 22 bp, Homo sapiens
caggacgggccacacgtggctg

SEQ ID NO: 5585897 - DNA, 16 bp, Homo sapiens
caggacggggccggcc

SEQ ID NO: 5585898 - DNA, 20 bp, Homo sapiens
caggacggggccggccaggt

SEQ ID NO: 5585899 - DNA, 16 bp, Homo sapiens
caggacggtctgtgcc

SEQ ID NO: 5585900 - DNA, 20 bp, Homo sapiens
caggacgtcctatctccccc

SEQ ID NO: 5585901 - DNA, 16 bp, Homo sapiens
caggacgtgggctggg

SEQ ID NO: 5585902 - DNA, 17 bp, Homo sapiens
caggacgttagactgtt

SEQ ID NO: 5585903 - DNA, 23 bp, Homo sapiens
caggacgttaggcccgggcccct

SEQ ID NO: 5585904 - DNA, 17 bp, Homo sapiens
caggactaacactcaga

SEQ ID NO: 5585905 - DNA, 19 bp, Homo sapiens
caggactaacactcagaag

SEQ ID NO: 5585906 - DNA, 15 bp, Homo sapiens
caggactagagcaca

SEQ ID NO: 5585907 - DNA, 16 bp, Homo sapiens
caggactagagcacaa

SEQ ID NO: 5585908 - DNA, 17 bp, Homo sapiens
caggactatagcccagg

SEQ ID NO: 5585909 - DNA, 19 bp, Homo sapiens
caggactcagaagcctctg

SEQ ID NO: 5585910 - DNA, 14 bp, Homo sapiens
caggactcagctcc

SEQ ID NO: 5585911 - DNA, 21 bp, Homo sapiens
caggactcagctccccagagt

SEQ ID NO: 5585912 - DNA, 14 bp, Homo sapiens
caggactccactgg

SEQ ID NO: 5585913 - DNA, 16 bp, Homo sapiens
caggactccactggac

SEQ ID NO: 5585914 - DNA, 20 bp, Homo sapiens
caggactccactggacagac

SEQ ID NO: 5585915 - DNA, 12 bp, Homo sapiens
caggactcccag

SEQ ID NO: 5585916 - DNA, 15 bp, Homo sapiens
caggactccccaggc

SEQ ID NO: 5585917 - DNA, 20 bp, Homo sapiens
caggactccccaggccaggc

SEQ ID NO: 5585918 - DNA, 19 bp, Homo sapiens
caggactcctggcagggcc

SEQ ID NO: 5585919 - DNA, 15 bp, Homo sapiens
caggactctctccag

SEQ ID NO: 5585920 - DNA, 16 bp, Homo sapiens
caggactctctccagg

SEQ ID NO: 5585921 - DNA, 18 bp, Homo sapiens
caggactctctccaggag

SEQ ID NO: 5585922 - DNA, 16 bp, Homo sapiens
caggactctctttctt

SEQ ID NO: 5585923 - DNA, 18 bp, Homo sapiens
caggactctgaaaaggaa

SEQ ID NO: 5585924 - DNA, 12 bp, Homo sapiens
caggactctgac

SEQ ID NO: 5585925 - DNA, 15 bp, Homo sapiens
caggactctgcagat

SEQ ID NO: 5585926 - DNA, 20 bp, Homo sapiens
caggactctgcagcctcaga

SEQ ID NO: 5585927 - DNA, 12 bp, Homo sapiens
caggactctgcc

SEQ ID NO: 5585928 - DNA, 18 bp, Homo sapiens
caggactctgccttccag

SEQ ID NO: 5585929 - DNA, 13 bp, Homo sapiens
caggactctgcgg

SEQ ID NO: 5585930 - DNA, 20 bp, Homo sapiens
caggactctgcgggaggctg

SEQ ID NO: 5585931 - DNA, 22 bp, Homo sapiens
caggactctgcgggaggctggg

SEQ ID NO: 5585932 - DNA, 23 bp, Homo sapiens
caggactctgcgggaggctgggg

SEQ ID NO: 5585933 - DNA, 13 bp, Homo sapiens
caggactctggca

SEQ ID NO: 5585934 - DNA, 16 bp, Homo sapiens
caggactctggcactt

SEQ ID NO: 5585935 - DNA, 18 bp, Homo sapiens
caggactcttgtgaaaag

SEQ ID NO: 5585936 - DNA, 20 bp, Homo sapiens
caggactgaattgtccccag

SEQ ID NO: 5585937 - DNA, 21 bp, Homo sapiens
caggactgaattgtccccagt

SEQ ID NO: 5585938 - DNA, 17 bp, Homo sapiens
caggactgagccctctc

SEQ ID NO: 5585939 - DNA, 18 bp, Homo sapiens
caggactgagccctctca

SEQ ID NO: 5585940 - DNA, 12 bp, Homo sapiens
caggactgatgt

SEQ ID NO: 5585941 - DNA, 17 bp, Homo sapiens
caggactgatgtctcct

SEQ ID NO: 5585942 - DNA, 21 bp, Homo sapiens
caggactgcaaaaatccttct

SEQ ID NO: 5585943 - DNA, 23 bp, Homo sapiens
caggactgcaaaaatccttctcc

SEQ ID NO: 5585944 - DNA, 13 bp, Homo sapiens
caggactgcacag

SEQ ID NO: 5585945 - DNA, 21 bp, Homo sapiens
caggactgcagagcagatggc

SEQ ID NO: 5585946 - DNA, 13 bp, Homo sapiens
caggactgcattg

SEQ ID NO: 5585947 - DNA, 14 bp, Homo sapiens
caggactggctcac

SEQ ID NO: 5585948 - DNA, 14 bp, Homo sapiens
caggactgggagcc

SEQ ID NO: 5585949 - DNA, 20 bp, Homo sapiens
caggactgggccacttctgg

SEQ ID NO: 5585950 - DNA, 15 bp, Homo sapiens
caggactgggccggg

SEQ ID NO: 5585951 - DNA, 16 bp, Homo sapiens
caggactgggccgggc

SEQ ID NO: 5585952 - DNA, 23 bp, Homo sapiens
caggactgggccgggcccagggc

SEQ ID NO: 5585953 - DNA, 19 bp, Homo sapiens
caggactggggcttgccag

SEQ ID NO: 5585954 - DNA, 20 bp, Homo sapiens
caggactggggcttgccagg

SEQ ID NO: 5585955 - DNA, 16 bp, Homo sapiens
caggactgggtctgac

SEQ ID NO: 5585956 - DNA, 18 bp, Homo sapiens
caggactgggtctgacct

SEQ ID NO: 5585957 - DNA, 23 bp, Homo sapiens
caggactgggtctgacctggtgg

SEQ ID NO: 5585958 - DNA, 17 bp, Homo sapiens
caggactggttccttcc

SEQ ID NO: 5585959 - DNA, 20 bp, Homo sapiens
caggactggttccttcctta

SEQ ID NO: 5585960 - DNA, 22 bp, Homo sapiens
caggactgtccccttgaaggag

SEQ ID NO: 5585961 - DNA, 23 bp, Homo sapiens
caggactgtccccttgaaggaga

SEQ ID NO: 5585962 - DNA, 15 bp, Homo sapiens
caggactgtgactca

SEQ ID NO: 5585963 - DNA, 13 bp, Homo sapiens
caggactgtgcct

SEQ ID NO: 5585964 - DNA, 15 bp, Homo sapiens
caggactgtttcaaa

SEQ ID NO: 5585965 - DNA, 15 bp, Homo sapiens
caggacttaaaatga

SEQ ID NO: 5585966 - DNA, 21 bp, Homo sapiens
caggacttaacggctccagga

SEQ ID NO: 5585967 - DNA, 23 bp, Homo sapiens
caggacttaacggctccaggatt

SEQ ID NO: 5585968 - DNA, 21 bp, Homo sapiens
caggacttaagacaaatggga

SEQ ID NO: 5585969 - DNA, 21 bp, Homo sapiens
caggacttccccggagggctg

SEQ ID NO: 5585970 - DNA, 21 bp, Homo sapiens
caggacttgctaaagcacttt

SEQ ID NO: 5585971 - DNA, 19 bp, Homo sapiens
caggactttgaggcaagtg

SEQ ID NO: 5585972 - DNA, 21 bp, Homo sapiens
caggactttgatgcatttcca

SEQ ID NO: 5585973 - DNA, 20 bp, Homo sapiens
caggagaaaatgcaatttga

SEQ ID NO: 5585974 - DNA, 20 bp, Homo sapiens
caggagaaagatgaaactga

SEQ ID NO: 5585975 - DNA, 22 bp, Homo sapiens
caggagaaagccgggggagggg

SEQ ID NO: 5585976 - DNA, 16 bp, Homo sapiens
caggagaacctaacat

SEQ ID NO: 5585977 - DNA, 12 bp, Homo sapiens
caggagaagaaa

SEQ ID NO: 5585978 - DNA, 19 bp, Homo sapiens
caggagaagaaagaactat

SEQ ID NO: 5585979 - DNA, 21 bp, Homo sapiens
caggagaagaaagaggtgacc

SEQ ID NO: 5585980 - DNA, 15 bp, Homo sapiens
caggagaagaacaag

SEQ ID NO: 5585981 - DNA, 19 bp, Homo sapiens
caggagaagaacctgaaga

SEQ ID NO: 5585982 - DNA, 14 bp, Homo sapiens
caggagaagacccc

SEQ ID NO: 5585983 - DNA, 18 bp, Homo sapiens
caggagaagacccctgcc

SEQ ID NO: 5585984 - DNA, 19 bp, Homo sapiens
caggagaagacccctgccc

SEQ ID NO: 5585985 - DNA, 17 bp, Homo sapiens
caggagaagctcagctg

SEQ ID NO: 5585986 - DNA, 14 bp, Homo sapiens
caggagaaggcctg

SEQ ID NO: 5585987 - DNA, 19 bp, Homo sapiens
caggagaaggcctgccccc

SEQ ID NO: 5585988 - DNA, 14 bp, Homo sapiens
caggagaagggaca

SEQ ID NO: 5585989 - DNA, 19 bp, Homo sapiens
caggagaagggacaaaagg

SEQ ID NO: 5585990 - DNA, 12 bp, Homo sapiens
caggagaagggg

SEQ ID NO: 5585991 - DNA, 14 bp, Homo sapiens
caggagaagtgctc

SEQ ID NO: 5585992 - DNA, 15 bp, Homo sapiens
caggagaagtgctcc

SEQ ID NO: 5585993 - DNA, 16 bp, Homo sapiens
caggagaagtgctccc

SEQ ID NO: 5585994 - DNA, 17 bp, Homo sapiens
caggagaagtgctccct

SEQ ID NO: 5585995 - DNA, 19 bp, Homo sapiens
caggagaagtgctccctgg

SEQ ID NO: 5585996 - DNA, 13 bp, Homo sapiens
caggagaagttaa

SEQ ID NO: 5585997 - DNA, 15 bp, Homo sapiens
caggagaatcactcg

SEQ ID NO: 5585998 - DNA, 23 bp, Homo sapiens
caggagaatcactgcagcccagg

SEQ ID NO: 5585999 - DNA, 13 bp, Homo sapiens
caggagaatcgct

SEQ ID NO: 5586000 - DNA, 22 bp, Homo sapiens
caggagaatcgcttgaacccag

SEQ ID NO: 5586001 - DNA, 23 bp, Homo sapiens
caggagaatcgcttgaacctggg

SEQ ID NO: 5586002 - DNA, 24 bp, Homo sapiens
caggagaatctacacgcatgatgg

SEQ ID NO: 5586003 - DNA, 19 bp, Homo sapiens
caggagaatggggttcctg

SEQ ID NO: 5586004 - DNA, 21 bp, Homo sapiens
caggagaatggggttcctgct

SEQ ID NO: 5586005 - DNA, 23 bp, Homo sapiens
caggagaatggggttcctgctgt

SEQ ID NO: 5586006 - DNA, 20 bp, Homo sapiens
caggagaattaggaaggcca

SEQ ID NO: 5586007 - DNA, 14 bp, Homo sapiens
caggagacaggaag

SEQ ID NO: 5586008 - DNA, 15 bp, Homo sapiens
caggagacaggaagg

SEQ ID NO: 5586009 - DNA, 16 bp, Homo sapiens
caggagacatatatag

SEQ ID NO: 5586010 - DNA, 13 bp, Homo sapiens
caggagaccaccc

SEQ ID NO: 5586011 - DNA, 14 bp, Homo sapiens
caggagaccacccc

SEQ ID NO: 5586012 - DNA, 23 bp, Homo sapiens
caggagaccacccccgagcttgc

SEQ ID NO: 5586013 - DNA, 20 bp, Homo sapiens
caggagaccacggggagcaa

SEQ ID NO: 5586014 - DNA, 19 bp, Homo sapiens
caggagacccaacaatgag

SEQ ID NO: 5586015 - DNA, 19 bp, Homo sapiens
caggagacccacctgaggc

SEQ ID NO: 5586016 - DNA, 15 bp, Homo sapiens
caggagacctccagc

SEQ ID NO: 5586017 - DNA, 17 bp, Homo sapiens
caggagtgggtggggag

SEQ ID NO: 5586018 - DNA, 20 bp, Homo sapiens
caggagtggtgcagacagaa

SEQ ID NO: 5586019 - DNA, 17 bp, Homo sapiens
caggagtgtcctcttcc

SEQ ID NO: 5586020 - DNA, 21 bp, Homo sapiens
caggagtgtcctcttccctct

SEQ ID NO: 5586021 - DNA, 16 bp, Homo sapiens
caggagtgtcctgccc

SEQ ID NO: 5586022 - DNA, 19 bp, Homo sapiens
caggagtgtcctgcccatg

SEQ ID NO: 5586023 - DNA, 19 bp, Homo sapiens
caggagtgtcctggctgtg

SEQ ID NO: 5586024 - DNA, 22 bp, Homo sapiens
caggagtgtcctggctgtgaat

SEQ ID NO: 5586025 - DNA, 19 bp, Homo sapiens
caggagttagaggccagcc

SEQ ID NO: 5586026 - DNA, 21 bp, Homo sapiens
caggagttcaataaatgtctg

SEQ ID NO: 5586027 - DNA, 16 bp, Homo sapiens
caggagttcagcggag

SEQ ID NO: 5586028 - DNA, 21 bp, Homo sapiens
caggagttcgagaccagccca

SEQ ID NO: 5586029 - DNA, 22 bp, Homo sapiens
caggagttcgagaccagcctcg

SEQ ID NO: 5586030 - DNA, 23 bp, Homo sapiens
caggagttcgagaccagcctggc

SEQ ID NO: 5586031 - DNA, 17 bp, Homo sapiens
caggagttcgagagcag

SEQ ID NO: 5586032 - DNA, 22 bp, Homo sapiens
caggagttcgagagcagcctgg

SEQ ID NO: 5586033 - DNA, 23 bp, Homo sapiens
caggagttcgagagcagcctggc

SEQ ID NO: 5586034 - DNA, 24 bp, Homo sapiens
caggagttcgagagcagcctggcc

SEQ ID NO: 5586035 - DNA, 18 bp, Homo sapiens
caggagttcgaggcgagc

SEQ ID NO: 5586036 - DNA, 18 bp, Homo sapiens
caggagttcgaggctgca

SEQ ID NO: 5586037 - DNA, 19 bp, Homo sapiens
caggagttcgaggctgcag

SEQ ID NO: 5586038 - DNA, 13 bp, Homo sapiens
caggagttctgaa

SEQ ID NO: 5586039 - DNA, 22 bp, Homo sapiens
caggagttctgctcattctaat

SEQ ID NO: 5586040 - DNA, 16 bp, Homo sapiens
caggagttggaagtgt

SEQ ID NO: 5586041 - DNA, 17 bp, Homo sapiens
caggagttggagaccag

SEQ ID NO: 5586042 - DNA, 19 bp, Homo sapiens
caggagttggagaccaggc

SEQ ID NO: 5586043 - DNA, 15 bp, Homo sapiens
caggagttgggggca

SEQ ID NO: 5586044 - DNA, 18 bp, Homo sapiens
caggagttgggggcaggt

SEQ ID NO: 5586045 - DNA, 19 bp, Homo sapiens
caggagttgggggcaggtc

SEQ ID NO: 5586046 - DNA, 21 bp, Homo sapiens
caggagttgggggcaggtcag

SEQ ID NO: 5586047 - DNA, 22 bp, Homo sapiens
caggagttgtgagccctctagg

SEQ ID NO: 5586048 - DNA, 24 bp, Homo sapiens
caggagttgtgagccctctagggc

SEQ ID NO: 5586049 - DNA, 21 bp, Homo sapiens
caggagttgtgtctaggctgg

SEQ ID NO: 5586050 - DNA, 21 bp, Homo sapiens
caggagtttgagacaagccct

SEQ ID NO: 5586051 - DNA, 22 bp, Homo sapiens
caggagtttgagacaagccctg

SEQ ID NO: 5586052 - DNA, 16 bp, Homo sapiens
caggagtttgagacca

SEQ ID NO: 5586053 - DNA, 21 bp, Homo sapiens
caggagtttgagaccaggctg

SEQ ID NO: 5586054 - DNA, 22 bp, Homo sapiens
caggagtttgagaccaggctgg

SEQ ID NO: 5586055 - DNA, 18 bp, Homo sapiens
caggagtttgaggctgca

SEQ ID NO: 5586056 - DNA, 13 bp, Homo sapiens
caggagtttgtgg

SEQ ID NO: 5586057 - DNA, 14 bp, Homo sapiens
caggagtttgtggt

SEQ ID NO: 5586058 - DNA, 21 bp, Homo sapiens
caggagtttgtggtaacttga

SEQ ID NO: 5586059 - DNA, 22 bp, Homo sapiens
caggagttttactgcctgtagc

SEQ ID NO: 5586060 - DNA, 14 bp, Homo sapiens
caggataaggagac

SEQ ID NO: 5586061 - DNA, 17 bp, Homo sapiens
caggataaggagactga

SEQ ID NO: 5586062 - DNA, 16 bp, Homo sapiens
caggataataaaacat

SEQ ID NO: 5586063 - DNA, 20 bp, Homo sapiens
caggataatatatttgcaga

SEQ ID NO: 5586064 - DNA, 14 bp, Homo sapiens
caggatacatgtgc

SEQ ID NO: 5586065 - DNA, 20 bp, Homo sapiens
caggatactctgtcagatgg

SEQ ID NO: 5586066 - DNA, 19 bp, Homo sapiens
caggatactggcacagagg

SEQ ID NO: 5586067 - DNA, 17 bp, Homo sapiens
caggatagagtgggaca

SEQ ID NO: 5586068 - DNA, 19 bp, Homo sapiens
caggatagataactctttg

SEQ ID NO: 5586069 - DNA, 22 bp, Homo sapiens
caggatagctcttcctccccag

SEQ ID NO: 5586070 - DNA, 14 bp, Homo sapiens
caggatatcacctg

SEQ ID NO: 5586071 - DNA, 21 bp, Homo sapiens
caggatatccttatcagagct

SEQ ID NO: 5586072 - DNA, 22 bp, Homo sapiens
caggatattagttaatgagcca

SEQ ID NO: 5586073 - DNA, 17 bp, Homo sapiens
caggatattatgtttct

SEQ ID NO: 5586074 - DNA, 13 bp, Homo sapiens
caggatattccaa

SEQ ID NO: 5586075 - DNA, 14 bp, Homo sapiens
caggatattccaaa

SEQ ID NO: 5586076 - DNA, 19 bp, Homo sapiens
caggatattggttcttccc

SEQ ID NO: 5586077 - DNA, 18 bp, Homo sapiens
caggatcacagctcacgg

SEQ ID NO: 5586078 - DNA, 20 bp, Homo sapiens
caggatcactctctgctggc

SEQ ID NO: 5586079 - DNA, 20 bp, Homo sapiens
caggatcagattgcatgtga

SEQ ID NO: 5586080 - DNA, 17 bp, Homo sapiens
caggatcagccccgctc

SEQ ID NO: 5586081 - DNA, 22 bp, Homo sapiens
caggatcatggtgtaataagac

SEQ ID NO: 5586082 - DNA, 23 bp, Homo sapiens
caggatcatggtgtaataagaca

SEQ ID NO: 5586083 - DNA, 13 bp, Homo sapiens
caggatccagcct

SEQ ID NO: 5586084 - DNA, 14 bp, Homo sapiens
caggatccagcctc

SEQ ID NO: 5586085 - DNA, 15 bp, Homo sapiens
caggatccagcctca

SEQ ID NO: 5586086 - DNA, 17 bp, Homo sapiens
caggatccagtgacatg

SEQ ID NO: 5586087 - DNA, 23 bp, Homo sapiens
caggatcccaagcgtcccgtccc

SEQ ID NO: 5586088 - DNA, 15 bp, Homo sapiens
caggatcccagagct

SEQ ID NO: 5586089 - DNA, 15 bp, Homo sapiens
caggatcccctgcta

SEQ ID NO: 5586090 - DNA, 20 bp, Homo sapiens
caggatccctcccagatcct

SEQ ID NO: 5586091 - DNA, 14 bp, Homo sapiens
caggatccctcctg

SEQ ID NO: 5586092 - DNA, 16 bp, Homo sapiens
caggatccgctgccac

SEQ ID NO: 5586093 - DNA, 19 bp, Homo sapiens
caggatcctattctcacca

SEQ ID NO: 5586094 - DNA, 14 bp, Homo sapiens
caggatcctcctgg

SEQ ID NO: 5586095 - DNA, 19 bp, Homo sapiens
caggatcctggcctgagaa

SEQ ID NO: 5586096 - DNA, 15 bp, Homo sapiens
caggatcggcttcct

SEQ ID NO: 5586097 - DNA, 21 bp, Homo sapiens
caggatcggcttcctcagggg

SEQ ID NO: 5586098 - DNA, 17 bp, Homo sapiens
caggatctcaagccagc

SEQ ID NO: 5586099 - DNA, 20 bp, Homo sapiens
caggatctcaagccagcccc

SEQ ID NO: 5586100 - DNA, 20 bp, Homo sapiens
caggatctcctgccagccca

SEQ ID NO: 5586101 - DNA, 22 bp, Homo sapiens
caggatctcctgccagcccagc

SEQ ID NO: 5586102 - DNA, 22 bp, Homo sapiens
caggatctctttccccaaggac

SEQ ID NO: 5586103 - DNA, 18 bp, Homo sapiens
caggatctgctccaacag

SEQ ID NO: 5586104 - DNA, 23 bp, Homo sapiens
caggatgaaagttcccccatcag

SEQ ID NO: 5586105 - DNA, 15 bp, Homo sapiens
caggatgaacccagg

SEQ ID NO: 5586106 - DNA, 16 bp, Homo sapiens
caggatgaacccagga

SEQ ID NO: 5586107 - DNA, 17 bp, Homo sapiens
caggatgaacccaggac

SEQ ID NO: 5586108 - DNA, 18 bp, Homo sapiens
caggatgaactagccatg

SEQ ID NO: 5586109 - DNA, 20 bp, Homo sapiens
caggatgaaggcgtgcaagg

SEQ ID NO: 5586110 - DNA, 17 bp, Homo sapiens
caggatgaaggggccag

SEQ ID NO: 5586111 - DNA, 22 bp, Homo sapiens
caggatgaaggggccagaccac

SEQ ID NO: 5586112 - DNA, 16 bp, Homo sapiens
caggatgacatagcca

SEQ ID NO: 5586113 - DNA, 15 bp, Homo sapiens
caggatgaggccccg

SEQ ID NO: 5586114 - DNA, 16 bp, Homo sapiens
caggatgaggccccgc

SEQ ID NO: 5586115 - DNA, 20 bp, Homo sapiens
caggatgaggccccgccttt

SEQ ID NO: 5586116 - DNA, 20 bp, Homo sapiens
caggatgaggtctcgaccct

SEQ ID NO: 5586117 - DNA, 20 bp, Homo sapiens
caggatgatgactatggaaa

SEQ ID NO: 5586118 - DNA, 23 bp, Homo sapiens
caggatgcacggtttctgttctg

SEQ ID NO: 5586119 - DNA, 15 bp, Homo sapiens
caggatgcatattaa

SEQ ID NO: 5586120 - DNA, 15 bp, Homo sapiens
caggatgcatgcagg

SEQ ID NO: 5586121 - DNA, 13 bp, Homo sapiens
caggatgccacgc

SEQ ID NO: 5586122 - DNA, 21 bp, Homo sapiens
caggatgccacgcctggaagg

SEQ ID NO: 5586123 - DNA, 16 bp, Homo sapiens
caggatgccagcccct

SEQ ID NO: 5586124 - DNA, 20 bp, Homo sapiens
caggatgccagcccctgcct

SEQ ID NO: 5586125 - DNA, 23 bp, Homo sapiens
caggatgccagcccctgcctggg

SEQ ID NO: 5586126 - DNA, 13 bp, Homo sapiens
caggatgcccaga

SEQ ID NO: 5586127 - DNA, 22 bp, Homo sapiens
caggatgcccagggccactctg

SEQ ID NO: 5586128 - DNA, 21 bp, Homo sapiens
caggatgccctgttgggggct

SEQ ID NO: 5586129 - DNA, 19 bp, Homo sapiens
caggatgctaaagatgatg

SEQ ID NO: 5586130 - DNA, 13 bp, Homo sapiens
caggatgctggcc

SEQ ID NO: 5586131 - DNA, 15 bp, Homo sapiens
caggatgctgggtgg

SEQ ID NO: 5586132 - DNA, 22 bp, Homo sapiens
caggatggaattcttcctcctc

SEQ ID NO: 5586133 - DNA, 17 bp, Homo sapiens
caggatggactcttctc

SEQ ID NO: 5586134 - DNA, 22 bp, Homo sapiens
caggatggactcttctcggctc

SEQ ID NO: 5586135 - DNA, 15 bp, Homo sapiens
caggatggagcaagc

SEQ ID NO: 5586136 - DNA, 20 bp, Homo sapiens
caggatggagcaagctcttc

SEQ ID NO: 5586137 - DNA, 21 bp, Homo sapiens
caggatggagcaagctcttcc

SEQ ID NO: 5586138 - DNA, 23 bp, Homo sapiens
caggatggaggggtggtcctgac

SEQ ID NO: 5586139 - DNA, 20 bp, Homo sapiens
caggatggatgcatcacact

SEQ ID NO: 5586140 - DNA, 22 bp, Homo sapiens
caggatggcagcaatggcgctg

SEQ ID NO: 5586141 - DNA, 22 bp, Homo sapiens
caggatggcctttccttccctc

SEQ ID NO: 5586142 - DNA, 15 bp, Homo sapiens
caggatggctgtgtg

SEQ ID NO: 5586143 - DNA, 12 bp, Homo sapiens
caggatgggaag

SEQ ID NO: 5586144 - DNA, 18 bp, Homo sapiens
caggatggggaggggctc

SEQ ID NO: 5586145 - DNA, 19 bp, Homo sapiens
caggatggggaggggctct

SEQ ID NO: 5586146 - DNA, 17 bp, Homo sapiens
caggatggggttctgga

SEQ ID NO: 5586147 - DNA, 15 bp, Homo sapiens
caggatggtaattct

SEQ ID NO: 5586148 - DNA, 16 bp, Homo sapiens
caggatggtcccagcg

SEQ ID NO: 5586149 - DNA, 21 bp, Homo sapiens
caggatggtctcgatatcctg

SEQ ID NO: 5586150 - DNA, 18 bp, Homo sapiens
caggatggtctcgatctc

SEQ ID NO: 5586151 - DNA, 19 bp, Homo sapiens
caggatggtgggcaggatc

SEQ ID NO: 5586152 - DNA, 22 bp, Homo sapiens
caggatggtgttactgcagttg

SEQ ID NO: 5586153 - DNA, 17 bp, Homo sapiens
caggatggttactgagg

SEQ ID NO: 5586154 - DNA, 21 bp, Homo sapiens
caggatggttactgaggacca

SEQ ID NO: 5586155 - DNA, 23 bp, Homo sapiens
caggatggttcccttgatgaaga

SEQ ID NO: 5586156 - DNA, 18 bp, Homo sapiens
caggatgtaggggttaac

SEQ ID NO: 5586157 - DNA, 15 bp, Homo sapiens
caggatgtggcactg

SEQ ID NO: 5586158 - DNA, 16 bp, Homo sapiens
caggatgtggcactgc

SEQ ID NO: 5586159 - DNA, 21 bp, Homo sapiens
caggatgtggcttatgagata

SEQ ID NO: 5586160 - DNA, 21 bp, Homo sapiens
caggattaactaaagaagagg

SEQ ID NO: 5586161 - DNA, 19 bp, Homo sapiens
caggattagataaggctgt

SEQ ID NO: 5586162 - DNA, 15 bp, Homo sapiens
caggattcagccgga

SEQ ID NO: 5586163 - DNA, 17 bp, Homo sapiens
caggattcaggcctctg

SEQ ID NO: 5586164 - DNA, 15 bp, Homo sapiens
caggattccaaagtt

SEQ ID NO: 5586165 - DNA, 20 bp, Homo sapiens
caggattccaaagttttgaa

SEQ ID NO: 5586166 - DNA, 12 bp, Homo sapiens
caggattcccag

SEQ ID NO: 5586167 - DNA, 13 bp, Homo sapiens
caggattcccaga

SEQ ID NO: 5586168 - DNA, 15 bp, Homo sapiens
caggattcctctctc

SEQ ID NO: 5586169 - DNA, 22 bp, Homo sapiens
caggattcctcttttctctgcc

SEQ ID NO: 5586170 - DNA, 19 bp, Homo sapiens
caggattctcaccagctgt

SEQ ID NO: 5586171 - DNA, 13 bp, Homo sapiens
caggattctctgc

SEQ ID NO: 5586172 - DNA, 18 bp, Homo sapiens
caggattctgggaggctt

SEQ ID NO: 5586173 - DNA, 19 bp, Homo sapiens
caggattcttcccgctccc

SEQ ID NO: 5586174 - DNA, 21 bp, Homo sapiens
caggattcttcccgctcccca

SEQ ID NO: 5586175 - DNA, 15 bp, Homo sapiens
caggattgaagagca

SEQ ID NO: 5586176 - DNA, 23 bp, Homo sapiens
caggattgcaggtgcctggcttg

SEQ ID NO: 5586177 - DNA, 17 bp, Homo sapiens
caggattgcgagagatg

SEQ ID NO: 5586178 - DNA, 23 bp, Homo sapiens
caggattgcgagagatgtgtgtt

SEQ ID NO: 5586179 - DNA, 21 bp, Homo sapiens
caggattggcctgtgtctggc

SEQ ID NO: 5586180 - DNA, 20 bp, Homo sapiens
caggattgggccaacaagga

SEQ ID NO: 5586181 - DNA, 14 bp, Homo sapiens
caggattggggaag

SEQ ID NO: 5586182 - DNA, 17 bp, Homo sapiens
caggattgtctgctgcc

SEQ ID NO: 5586183 - DNA, 18 bp, Homo sapiens
caggattgtctgctgcct

SEQ ID NO: 5586184 - DNA, 20 bp, Homo sapiens
caggattgtctgctgcctcc

SEQ ID NO: 5586185 - DNA, 21 bp, Homo sapiens
caggattgtctgctgcctcca

SEQ ID NO: 5586186 - DNA, 23 bp, Homo sapiens
caggattgtgcaatagtcagagt

SEQ ID NO: 5586187 - DNA, 20 bp, Homo sapiens
caggatttaaaaactggaac

SEQ ID NO: 5586188 - DNA, 15 bp, Homo sapiens
caggatttataaagc

SEQ ID NO: 5586189 - DNA, 18 bp, Homo sapiens
caggatttatacatacag

SEQ ID NO: 5586190 - DNA, 12 bp, Homo sapiens
caggatttctaa

SEQ ID NO: 5586191 - DNA, 12 bp, Homo sapiens
caggccagctgt

SEQ ID NO: 5586192 - DNA, 15 bp, Homo sapiens
caggccagcttcgtg

SEQ ID NO: 5586193 - DNA, 13 bp, Homo sapiens
caggccaggacca

SEQ ID NO: 5586194 - DNA, 21 bp, Homo sapiens
caggccaggaccaagggcaga

SEQ ID NO: 5586195 - DNA, 13 bp, Homo sapiens
caggccaggactc

SEQ ID NO: 5586196 - DNA, 12 bp, Homo sapiens
caggccaggcat

SEQ ID NO: 5586197 - DNA, 11 bp, Homo sapiens
caggccaggcc

SEQ ID NO: 5586198 - DNA, 16 bp, Homo sapiens
caggccaggccaccag

SEQ ID NO: 5586199 - DNA, 13 bp, Homo sapiens
caggccaggccag

SEQ ID NO: 5586200 - DNA, 13 bp, Homo sapiens
caggccaggccct

SEQ ID NO: 5586201 - DNA, 16 bp, Homo sapiens
caggccaggccctctg

SEQ ID NO: 5586202 - DNA, 18 bp, Homo sapiens
caggccaggccctctgcc

SEQ ID NO: 5586203 - DNA, 12 bp, Homo sapiens
caggccaggctc

SEQ ID NO: 5586204 - DNA, 21 bp, Homo sapiens
caggccaggctcccgacccca

SEQ ID NO: 5586205 - DNA, 21 bp, Homo sapiens
caggccaggctccttcctgtc

SEQ ID NO: 5586206 - DNA, 22 bp, Homo sapiens
caggccagggcagttgacaggt

SEQ ID NO: 5586207 - DNA, 22 bp, Homo sapiens
caggccagggctcaccagctgg

SEQ ID NO: 5586208 - DNA, 15 bp, Homo sapiens
caggccagggctcct

SEQ ID NO: 5586209 - DNA, 21 bp, Homo sapiens
caggccagggctcctgtggca

SEQ ID NO: 5586210 - DNA, 21 bp, Homo sapiens
caggccagggggccagtccct

SEQ ID NO: 5586211 - DNA, 10 bp, Homo sapiens
caggccaggt

SEQ ID NO: 5586212 - DNA, 12 bp, Homo sapiens
caggccaggtcc

SEQ ID NO: 5586213 - DNA, 16 bp, Homo sapiens
caggccaggtgcagtg

SEQ ID NO: 5586214 - DNA, 13 bp, Homo sapiens
caggccaggtgcc

SEQ ID NO: 5586215 - DNA, 19 bp, Homo sapiens
caggccaggtgcccaggaa

SEQ ID NO: 5586216 - DNA, 18 bp, Homo sapiens
caggccaggtgggcggac

SEQ ID NO: 5586217 - DNA, 19 bp, Homo sapiens
caggccaggtgggcggaca

SEQ ID NO: 5586218 - DNA, 19 bp, Homo sapiens
caggccaggttatgcctca

SEQ ID NO: 5586219 - DNA, 20 bp, Homo sapiens
caggccagtaatcccagtga

SEQ ID NO: 5586220 - DNA, 23 bp, Homo sapiens
caggccagtcagacgccaggcac

SEQ ID NO: 5586221 - DNA, 14 bp, Homo sapiens
caggccagtgccag

SEQ ID NO: 5586222 - DNA, 15 bp, Homo sapiens
caggccagtggacag

SEQ ID NO: 5586223 - DNA, 22 bp, Homo sapiens
caggccagtggacagagggaga

SEQ ID NO: 5586224 - DNA, 17 bp, Homo sapiens
caggccagtgggcctgg

SEQ ID NO: 5586225 - DNA, 18 bp, Homo sapiens
caggccatccggccccca

SEQ ID NO: 5586226 - DNA, 16 bp, Homo sapiens
caggccatcttccagg

SEQ ID NO: 5586227 - DNA, 15 bp, Homo sapiens
caggccatggaggca

SEQ ID NO: 5586228 - DNA, 18 bp, Homo sapiens
caggccatggaggcagaa

SEQ ID NO: 5586229 - DNA, 14 bp, Homo sapiens
caggccatggccaa

SEQ ID NO: 5586230 - DNA, 22 bp, Homo sapiens
caggccatggccaaggggccag

SEQ ID NO: 5586231 - DNA, 23 bp, Homo sapiens
caggccatggccaaggggccagc

SEQ ID NO: 5586232 - DNA, 14 bp, Homo sapiens
caggccatgtggcc

SEQ ID NO: 5586233 - DNA, 20 bp, Homo sapiens
caggccatgtggcctgccca

SEQ ID NO: 5586234 - DNA, 21 bp, Homo sapiens
caggccatgtggcctgcccag

SEQ ID NO: 5586235 - DNA, 21 bp, Homo sapiens
caggccattccccgtctctgg

SEQ ID NO: 5586236 - DNA, 16 bp, Homo sapiens
caggccattctgccgc

SEQ ID NO: 5586237 - DNA, 19 bp, Homo sapiens
caggcccaagagatgaaga

SEQ ID NO: 5586238 - DNA, 17 bp, Homo sapiens
caggcccaaggctcccg

SEQ ID NO: 5586239 - DNA, 15 bp, Homo sapiens
caggcccaatctggg

SEQ ID NO: 5586240 - DNA, 23 bp, Homo sapiens
caggcccaccatcaccaccgcct

SEQ ID NO: 5586241 - DNA, 17 bp, Homo sapiens
caggcccacgaggagca

SEQ ID NO: 5586242 - DNA, 18 bp, Homo sapiens
caggcccacgaggagcag

SEQ ID NO: 5586243 - DNA, 23 bp, Homo sapiens
caggcccactccccagccccagc

SEQ ID NO: 5586244 - DNA, 17 bp, Homo sapiens
caggcccactgtgcctc

SEQ ID NO: 5586245 - DNA, 11 bp, Homo sapiens
caggcccagaa

SEQ ID NO: 5586246 - DNA, 12 bp, Homo sapiens
caggcccagaag

SEQ ID NO: 5586247 - DNA, 13 bp, Homo sapiens
caggcccagaagg

SEQ ID NO: 5586248 - DNA, 21 bp, Homo sapiens
caggcccagaggagccaagtc

SEQ ID NO: 5586249 - DNA, 12 bp, Homo sapiens
caggcccagcct

SEQ ID NO: 5586250 - DNA, 19 bp, Homo sapiens
caggcccagcctctctggc

SEQ ID NO: 5586251 - DNA, 20 bp, Homo sapiens
caggcccagcctctctggct

SEQ ID NO: 5586252 - DNA, 15 bp, Homo sapiens
caggcccagcctctt

SEQ ID NO: 5586253 - DNA, 16 bp, Homo sapiens
caggcccagcctggcc

SEQ ID NO: 5586254 - DNA, 17 bp, Homo sapiens
caggcccagcctggccc

SEQ ID NO: 5586255 - DNA, 11 bp, Homo sapiens
caggcccagcg

SEQ ID NO: 5586256 - DNA, 15 bp, Homo sapiens
caggcccagcgcggc

SEQ ID NO: 5586257 - DNA, 20 bp, Homo sapiens
caggcccagcgcggccagcg

SEQ ID NO: 5586258 - DNA, 21 bp, Homo sapiens
caggcccagcgcggccagcgt

SEQ ID NO: 5586259 - DNA, 22 bp, Homo sapiens
caggcccagcgcggccagcgtc

SEQ ID NO: 5586260 - DNA, 20 bp, Homo sapiens
caggcccaggaaggcggcag

SEQ ID NO: 5586261 - DNA, 13 bp, Homo sapiens
caggcccaggaga

SEQ ID NO: 5586262 - DNA, 15 bp, Homo sapiens
caggcccaggcagag

SEQ ID NO: 5586263 - DNA, 22 bp, Homo sapiens
caggcccaggcagagctgacgg

SEQ ID NO: 5586264 - DNA, 17 bp, Homo sapiens
caggcccaggcaggccc

SEQ ID NO: 5586265 - DNA, 20 bp, Homo sapiens
caggcccaggcaggcccagc

SEQ ID NO: 5586266 - DNA, 22 bp, Homo sapiens
caggcccaggcaggcccagcct

SEQ ID NO: 5586267 - DNA, 14 bp, Homo sapiens
caggcccaggccag

SEQ ID NO: 5586268 - DNA, 18 bp, Homo sapiens
caggcccaggccagcccc

SEQ ID NO: 5586269 - DNA, 19 bp, Homo sapiens
caggcccaggccagccccc

SEQ ID NO: 5586270 - DNA, 14 bp, Homo sapiens
caggcccaggcctc

SEQ ID NO: 5586271 - DNA, 12 bp, Homo sapiens
caggcccaggga

SEQ ID NO: 5586272 - DNA, 13 bp, Homo sapiens
caggcccagggag

SEQ ID NO: 5586273 - DNA, 14 bp, Homo sapiens
caggcccagggagg

SEQ ID NO: 5586274 - DNA, 17 bp, Homo sapiens
caggcccagggagggaa

SEQ ID NO: 5586275 - DNA, 24 bp, Homo sapiens
caggcccatctcaggtgccactcc

SEQ ID NO: 5586276 - DNA, 21 bp, Homo sapiens
caggcccatgggaggctggag

SEQ ID NO: 5586277 - DNA, 22 bp, Homo sapiens
caggcccatgggaggctggagt

SEQ ID NO: 5586278 - DNA, 17 bp, Homo sapiens
caggccccaaaaccaca

SEQ ID NO: 5586279 - DNA, 18 bp, Homo sapiens
caggccccaacctgaagg

SEQ ID NO: 5586280 - DNA, 16 bp, Homo sapiens
caggccccacccctgt

SEQ ID NO: 5586281 - DNA, 15 bp, Homo sapiens
caggccccacccctt

SEQ ID NO: 5586282 - DNA, 17 bp, Homo sapiens
caggccccaccccttcc

SEQ ID NO: 5586283 - DNA, 22 bp, Homo sapiens
caggccccaccggccaggccgc

SEQ ID NO: 5586284 - DNA, 17 bp, Homo sapiens
caggccccacgccctct

SEQ ID NO: 5586285 - DNA, 23 bp, Homo sapiens
caggccccacgccctctcctccc

SEQ ID NO: 5586286 - DNA, 13 bp, Homo sapiens
caggccccagaca

SEQ ID NO: 5586287 - DNA, 16 bp, Homo sapiens
caggccccagacaggg

SEQ ID NO: 5586288 - DNA, 13 bp, Homo sapiens
caggccccagcaa

SEQ ID NO: 5586289 - DNA, 14 bp, Homo sapiens
caggccccagccaa

SEQ ID NO: 5586290 - DNA, 19 bp, Homo sapiens
caggccccagccaagtgcc

SEQ ID NO: 5586291 - DNA, 23 bp, Homo sapiens
caggccccagccaagtgccttcc

SEQ ID NO: 5586292 - DNA, 12 bp, Homo sapiens
caggccccagga

SEQ ID NO: 5586293 - DNA, 15 bp, Homo sapiens
caggccccaggaaag

SEQ ID NO: 5586294 - DNA, 14 bp, Homo sapiens
caggccccaggaag

SEQ ID NO: 5586295 - DNA, 13 bp, Homo sapiens
caggccccaggac

SEQ ID NO: 5586296 - DNA, 18 bp, Homo sapiens
caggccccaggcagggcc

SEQ ID NO: 5586297 - DNA, 19 bp, Homo sapiens
caggccccaggctggatgc

SEQ ID NO: 5586298 - DNA, 19 bp, Homo sapiens
caggccccaggggagaaag

SEQ ID NO: 5586299 - DNA, 15 bp, Homo sapiens
caggccccaggtcat

SEQ ID NO: 5586300 - DNA, 16 bp, Homo sapiens
caggccccatgacctc

SEQ ID NO: 5586301 - DNA, 17 bp, Homo sapiens
caggccccatgacctcc

SEQ ID NO: 5586302 - DNA, 22 bp, Homo sapiens
caggccccatgacctccagctt

SEQ ID NO: 5586303 - DNA, 14 bp, Homo sapiens
caggcccccaaccc

SEQ ID NO: 5586304 - DNA, 19 bp, Homo sapiens
caggcccccaacccctcct

SEQ ID NO: 5586305 - DNA, 21 bp, Homo sapiens
caggcccccaacccctcctcc

SEQ ID NO: 5586306 - DNA, 20 bp, Homo sapiens
caggcccccaacccctcctt

SEQ ID NO: 5586307 - DNA, 19 bp, Homo sapiens
caggcccccaccacacatc

SEQ ID NO: 5586308 - DNA, 20 bp, Homo sapiens
caggcccccaccacacatcc

SEQ ID NO: 5586309 - DNA, 19 bp, Homo sapiens
caggcccccacctggctca

SEQ ID NO: 5586310 - DNA, 13 bp, Homo sapiens
caggcccccagcc

SEQ ID NO: 5586311 - DNA, 14 bp, Homo sapiens
caggcccccctgtc

SEQ ID NO: 5586312 - DNA, 16 bp, Homo sapiens
caggcccccgccttgg

SEQ ID NO: 5586313 - DNA, 11 bp, Homo sapiens
caggcccccgg

SEQ ID NO: 5586314 - DNA, 20 bp, Homo sapiens
caggcccccggggaggggcc

SEQ ID NO: 5586315 - DNA, 20 bp, Homo sapiens
caggccccgaggacccagac

SEQ ID NO: 5586316 - DNA, 23 bp, Homo sapiens
caggccccgccccctcggcccct

SEQ ID NO: 5586317 - DNA, 23 bp, Homo sapiens
caggcccctccctctccagcagg

SEQ ID NO: 5586318 - DNA, 12 bp, Homo sapiens
caggcccctctc

SEQ ID NO: 5586319 - DNA, 13 bp, Homo sapiens
caggcccctgagg

SEQ ID NO: 5586320 - DNA, 16 bp, Homo sapiens
caggcccctgaggact

SEQ ID NO: 5586321 - DNA, 17 bp, Homo sapiens
caggcccctgaggactg

SEQ ID NO: 5586322 - DNA, 18 bp, Homo sapiens
caggcccctgaggactgg

SEQ ID NO: 5586323 - DNA, 19 bp, Homo sapiens
caggcccctgaggactgga

SEQ ID NO: 5586324 - DNA, 20 bp, Homo sapiens
caggcccctgccaccctggg

SEQ ID NO: 5586325 - DNA, 16 bp, Homo sapiens
caggcccctggaggct

SEQ ID NO: 5586326 - DNA, 23 bp, Homo sapiens
caggcccctggaggctgcctccc

SEQ ID NO: 5586327 - DNA, 19 bp, Homo sapiens
caggcccctttggacctgc

SEQ ID NO: 5586328 - DNA, 22 bp, Homo sapiens
caggccccttttcactccctcc

SEQ ID NO: 5586329 - DNA, 15 bp, Homo sapiens
caggcccgacagaga

SEQ ID NO: 5586330 - DNA, 17 bp, Homo sapiens
caggcccgacagagaga

SEQ ID NO: 5586331 - DNA, 18 bp, Homo sapiens
caggcccgacagagagat

SEQ ID NO: 5586332 - DNA, 20 bp, Homo sapiens
caggcccgagatgtgaccca

SEQ ID NO: 5586333 - DNA, 22 bp, Homo sapiens
caggcccgagcgcctgcgttcc

SEQ ID NO: 5586334 - DNA, 17 bp, Homo sapiens
caggcccgcaccccggc

SEQ ID NO: 5586335 - DNA, 23 bp, Homo sapiens
caggcccgcaccccggcctcagg

SEQ ID NO: 5586336 - DNA, 13 bp, Homo sapiens
caggcccgcactg

SEQ ID NO: 5586337 - DNA, 15 bp, Homo sapiens
caggcccgcactggg

SEQ ID NO: 5586338 - DNA, 12 bp, Homo sapiens
caggcccgccct

SEQ ID NO: 5586339 - DNA, 21 bp, Homo sapiens
caggcccgccctctgcctcct

SEQ ID NO: 5586340 - DNA, 16 bp, Homo sapiens
caggcccgccctgccc

SEQ ID NO: 5586341 - DNA, 15 bp, Homo sapiens
caggcccgcgggcac

SEQ ID NO: 5586342 - DNA, 17 bp, Homo sapiens
caggcccgcgggcacag

SEQ ID NO: 5586343 - DNA, 18 bp, Homo sapiens
caggcccgcgggcacagc

SEQ ID NO: 5586344 - DNA, 20 bp, Homo sapiens
caggcccggactcaccaact

SEQ ID NO: 5586345 - DNA, 15 bp, Homo sapiens
caggcccggatgcag

SEQ ID NO: 5586346 - DNA, 20 bp, Homo sapiens
caggcccggatgcagaggcc

SEQ ID NO: 5586347 - DNA, 16 bp, Homo sapiens
caggcccggcagggcg

SEQ ID NO: 5586348 - DNA, 14 bp, Homo sapiens
caggcccggctcca

SEQ ID NO: 5586349 - DNA, 16 bp, Homo sapiens
caggcccggctccagg

SEQ ID NO: 5586350 - DNA, 17 bp, Homo sapiens
caggcccggctccaggc

SEQ ID NO: 5586351 - DNA, 20 bp, Homo sapiens
caggcccggctccaggctcc

SEQ ID NO: 5586352 - DNA, 17 bp, Homo sapiens
caggcccggtgaggcca

SEQ ID NO: 5586353 - DNA, 22 bp, Homo sapiens
caggcccgtcagcatcactgat

SEQ ID NO: 5586354 - DNA, 17 bp, Homo sapiens
caggcccgtcggagctg

SEQ ID NO: 5586355 - DNA, 21 bp, Homo sapiens
caggcccgtctgtccatctgc

SEQ ID NO: 5586356 - DNA, 23 bp, Homo sapiens
caggcccgtctgtccatctgccc

SEQ ID NO: 5586357 - DNA, 20 bp, Homo sapiens
caggccctaagatgccttga

SEQ ID NO: 5586358 - DNA, 14 bp, Homo sapiens
caggccctcagctg

SEQ ID NO: 5586359 - DNA, 15 bp, Homo sapiens
caggccctcagctgt

SEQ ID NO: 5586360 - DNA, 14 bp, Homo sapiens
caggccctccatgg

SEQ ID NO: 5586361 - DNA, 12 bp, Homo sapiens
caggccctccca

SEQ ID NO: 5586362 - DNA, 18 bp, Homo sapiens
caggccctcccaccaccc

SEQ ID NO: 5586363 - DNA, 21 bp, Homo sapiens
caggccctcccaccaccccat

SEQ ID NO: 5586364 - DNA, 22 bp, Homo sapiens
caggccctccctgactccctgt

SEQ ID NO: 5586365 - DNA, 12 bp, Homo sapiens
caggccctccgc

SEQ ID NO: 5586366 - DNA, 16 bp, Homo sapiens
caggccctcctctccc

SEQ ID NO: 5586367 - DNA, 15 bp, Homo sapiens
caggccctcctgctg

SEQ ID NO: 5586368 - DNA, 19 bp, Homo sapiens
caggccctcctgctggctg

SEQ ID NO: 5586369 - DNA, 19 bp, Homo sapiens
caggctcggaggaccctgg

SEQ ID NO: 5586370 - DNA, 21 bp, Homo sapiens
caggctcggaggaccctggaa

SEQ ID NO: 5586371 - DNA, 20 bp, Homo sapiens
caggctcggcctgcccccac

SEQ ID NO: 5586372 - DNA, 16 bp, Homo sapiens
caggctcgtcagccac

SEQ ID NO: 5586373 - DNA, 14 bp, Homo sapiens
caggctctagagag

SEQ ID NO: 5586374 - DNA, 21 bp, Homo sapiens
caggctctagagagagggaga

SEQ ID NO: 5586375 - DNA, 14 bp, Homo sapiens
caggctctcaggcc

SEQ ID NO: 5586376 - DNA, 16 bp, Homo sapiens
caggctctcaggccag

SEQ ID NO: 5586377 - DNA, 18 bp, Homo sapiens
caggctctcaggccagct

SEQ ID NO: 5586378 - DNA, 20 bp, Homo sapiens
caggctctcaggccagctgc

SEQ ID NO: 5586379 - DNA, 13 bp, Homo sapiens
caggctctccctc

SEQ ID NO: 5586380 - DNA, 17 bp, Homo sapiens
caggctctcctggctgt

SEQ ID NO: 5586381 - DNA, 11 bp, Homo sapiens
caggctctctc

SEQ ID NO: 5586382 - DNA, 13 bp, Homo sapiens
caggctctctcct

SEQ ID NO: 5586383 - DNA, 16 bp, Homo sapiens
caggctctctcctctc

SEQ ID NO: 5586384 - DNA, 19 bp, Homo sapiens
caggctctcttgtattctt

SEQ ID NO: 5586385 - DNA, 12 bp, Homo sapiens
caggctctcttt

SEQ ID NO: 5586386 - DNA, 16 bp, Homo sapiens
caggctctgaatctct

SEQ ID NO: 5586387 - DNA, 21 bp, Homo sapiens
caggctctgcacagacaagca

SEQ ID NO: 5586388 - DNA, 14 bp, Homo sapiens
caggctctgccctg

SEQ ID NO: 5586389 - DNA, 23 bp, Homo sapiens
caggctctgccctgccctagctc

SEQ ID NO: 5586390 - DNA, 12 bp, Homo sapiens
caggctctgctg

SEQ ID NO: 5586391 - DNA, 14 bp, Homo sapiens
caggctctgctgac

SEQ ID NO: 5586392 - DNA, 19 bp, Homo sapiens
caggctctgctggtggaaa

SEQ ID NO: 5586393 - DNA, 17 bp, Homo sapiens
caggctctggagccaga

SEQ ID NO: 5586394 - DNA, 19 bp, Homo sapiens
caggctctggagccagaga

SEQ ID NO: 5586395 - DNA, 15 bp, Homo sapiens
caggctctggccctt

SEQ ID NO: 5586396 - DNA, 18 bp, Homo sapiens
caggctctggcccttgcc

SEQ ID NO: 5586397 - DNA, 14 bp, Homo sapiens
caggctctgggaag

SEQ ID NO: 5586398 - DNA, 16 bp, Homo sapiens
caggctctgggaaggg

SEQ ID NO: 5586399 - DNA, 20 bp, Homo sapiens
caggctctgggaaggggtgc

SEQ ID NO: 5586400 - DNA, 15 bp, Homo sapiens
caggctctgggcaca

SEQ ID NO: 5586401 - DNA, 18 bp, Homo sapiens
caggctctgggcacagtg

SEQ ID NO: 5586402 - DNA, 14 bp, Homo sapiens
caggctctgtgctg

SEQ ID NO: 5586403 - DNA, 19 bp, Homo sapiens
caggctctgtgctgaccct

SEQ ID NO: 5586404 - DNA, 15 bp, Homo sapiens
caggctctgtggagg

SEQ ID NO: 5586405 - DNA, 13 bp, Homo sapiens
caggctcttcctg

SEQ ID NO: 5586406 - DNA, 14 bp, Homo sapiens
caggctcttcctgg

SEQ ID NO: 5586407 - DNA, 16 bp, Homo sapiens
caggctcttcctggac

SEQ ID NO: 5586408 - DNA, 17 bp, Homo sapiens
caggctcttcctggacc

SEQ ID NO: 5586409 - DNA, 23 bp, Homo sapiens
caggctcttcctggacctgagtc

SEQ ID NO: 5586410 - DNA, 16 bp, Homo sapiens
caggctcttctttccc

SEQ ID NO: 5586411 - DNA, 20 bp, Homo sapiens
caggctgaaatatccaccca

SEQ ID NO: 5586412 - DNA, 23 bp, Homo sapiens
caggctgaaatatccacccagca

SEQ ID NO: 5586413 - DNA, 15 bp, Homo sapiens
caggctgaccacagc

SEQ ID NO: 5586414 - DNA, 17 bp, Homo sapiens
caggctgaccacagcac

SEQ ID NO: 5586415 - DNA, 20 bp, Homo sapiens
caggctgaccacagcacagc

SEQ ID NO: 5586416 - DNA, 21 bp, Homo sapiens
caggctgaccacagcacagcc

SEQ ID NO: 5586417 - DNA, 22 bp, Homo sapiens
caggctgaccacagcacagcca

SEQ ID NO: 5586418 - DNA, 18 bp, Homo sapiens
caggctgacgttccgggc

SEQ ID NO: 5586419 - DNA, 23 bp, Homo sapiens
caggctgactgggggcctctgcc

SEQ ID NO: 5586420 - DNA, 16 bp, Homo sapiens
caggctgagagccaga

SEQ ID NO: 5586421 - DNA, 18 bp, Homo sapiens
caggctgagcccagccac

SEQ ID NO: 5586422 - DNA, 19 bp, Homo sapiens
caggctgagcccagccacc

SEQ ID NO: 5586423 - DNA, 22 bp, Homo sapiens
caggctgagcccagccacctcc

SEQ ID NO: 5586424 - DNA, 13 bp, Homo sapiens
caggctgagcctc

SEQ ID NO: 5586425 - DNA, 21 bp, Homo sapiens
caggctgagctttctagccta

SEQ ID NO: 5586426 - DNA, 21 bp, Homo sapiens
caggctgagggtcgtgggaaa

SEQ ID NO: 5586427 - DNA, 17 bp, Homo sapiens
caggctgaggtggggaa

SEQ ID NO: 5586428 - DNA, 18 bp, Homo sapiens
caggctgaggtggggaag

SEQ ID NO: 5586429 - DNA, 19 bp, Homo sapiens
caggctgaggtggggaagg

SEQ ID NO: 5586430 - DNA, 13 bp, Homo sapiens
caggctgagtgca

SEQ ID NO: 5586431 - DNA, 16 bp, Homo sapiens
caggctgagtgcaggc

SEQ ID NO: 5586432 - DNA, 20 bp, Homo sapiens
caggctgagtgcaggcccac

SEQ ID NO: 5586433 - DNA, 21 bp, Homo sapiens
caggctgagtgcaggcccacc

SEQ ID NO: 5586434 - DNA, 21 bp, Homo sapiens
caggctgcacctctggctaga

SEQ ID NO: 5586435 - DNA, 23 bp, Homo sapiens
caggctgcacctctggctagagc

SEQ ID NO: 5586436 - DNA, 14 bp, Homo sapiens
caggctgcactgca

SEQ ID NO: 5586437 - DNA, 17 bp, Homo sapiens
caggctgcactgcagtg

SEQ ID NO: 5586438 - DNA, 18 bp, Homo sapiens
caggctgcactgcagtga

SEQ ID NO: 5586439 - DNA, 15 bp, Homo sapiens
caggctgcagaggca

SEQ ID NO: 5586440 - DNA, 17 bp, Homo sapiens
caggctgcagcaggcag

SEQ ID NO: 5586441 - DNA, 14 bp, Homo sapiens
caggctgcagcctc

SEQ ID NO: 5586442 - DNA, 15 bp, Homo sapiens
caggctgcagcctcc

SEQ ID NO: 5586443 - DNA, 19 bp, Homo sapiens
caggctgcagctggacaga

SEQ ID NO: 5586444 - DNA, 16 bp, Homo sapiens
caggctgcaggagggc

SEQ ID NO: 5586445 - DNA, 20 bp, Homo sapiens
caggctgcaggagggcactg

SEQ ID NO: 5586446 - DNA, 21 bp, Homo sapiens
caggctgcaggagggcactgg

SEQ ID NO: 5586447 - DNA, 16 bp, Homo sapiens
caggctgcagtgcaat

SEQ ID NO: 5586448 - DNA, 18 bp, Homo sapiens
caggctgcagtggctccc

SEQ ID NO: 5586449 - DNA, 19 bp, Homo sapiens
caggctgcagtggctcccc

SEQ ID NO: 5586450 - DNA, 22 bp, Homo sapiens
caggctgcatagaaggaggaga

SEQ ID NO: 5586451 - DNA, 16 bp, Homo sapiens
caggctgccagtgcct

SEQ ID NO: 5586452 - DNA, 17 bp, Homo sapiens
caggctgccagtgcctg

SEQ ID NO: 5586453 - DNA, 17 bp, Homo sapiens
caggctgcccactctgg

SEQ ID NO: 5586454 - DNA, 12 bp, Homo sapiens
caggctgcccag

SEQ ID NO: 5586455 - DNA, 14 bp, Homo sapiens
caggctgcccagag

SEQ ID NO: 5586456 - DNA, 15 bp, Homo sapiens
caggctgcccagagc

SEQ ID NO: 5586457 - DNA, 16 bp, Homo sapiens
caggctgcccagcggc

SEQ ID NO: 5586458 - DNA, 13 bp, Homo sapiens
caggctgccccac

SEQ ID NO: 5586459 - DNA, 19 bp, Homo sapiens
caggctgcccccaacactc

SEQ ID NO: 5586460 - DNA, 23 bp, Homo sapiens
caggctgccgctgctctcccagg

SEQ ID NO: 5586461 - DNA, 20 bp, Homo sapiens
caggctgcctcctgccctta

SEQ ID NO: 5586462 - DNA, 11 bp, Homo sapiens
caggctgcctg

SEQ ID NO: 5586463 - DNA, 20 bp, Homo sapiens
caggctgcctgagcacctcc

SEQ ID NO: 5586464 - DNA, 14 bp, Homo sapiens
caggctgcctgagt

SEQ ID NO: 5586465 - DNA, 15 bp, Homo sapiens
caggctgcctgagtc

SEQ ID NO: 5586466 - DNA, 19 bp, Homo sapiens
caggctgcgcctgcccgcc

SEQ ID NO: 5586467 - DNA, 21 bp, Homo sapiens
caggctgcgcctgcccgcccg

SEQ ID NO: 5586468 - DNA, 17 bp, Homo sapiens
caggctgcgtccctccg

SEQ ID NO: 5586469 - DNA, 12 bp, Homo sapiens
caggctgctaac

SEQ ID NO: 5586470 - DNA, 19 bp, Homo sapiens
caggctgctaacctggaaa

SEQ ID NO: 5586471 - DNA, 18 bp, Homo sapiens
caggctgctcagggctgg

SEQ ID NO: 5586472 - DNA, 15 bp, Homo sapiens
caggctgctctcaaa

SEQ ID NO: 5586473 - DNA, 20 bp, Homo sapiens
caggctgctcttgaactcct

SEQ ID NO: 5586474 - DNA, 11 bp, Homo sapiens
caggctgctgc

SEQ ID NO: 5586475 - DNA, 16 bp, Homo sapiens
caggctgctgcatggc

SEQ ID NO: 5586476 - DNA, 20 bp, Homo sapiens
caggctgctgcatggcactg

SEQ ID NO: 5586477 - DNA, 16 bp, Homo sapiens
caggctgctggaggaa

SEQ ID NO: 5586478 - DNA, 22 bp, Homo sapiens
caggctgcttcaatcccagcct

SEQ ID NO: 5586479 - DNA, 15 bp, Homo sapiens
caggctgcttgggat

SEQ ID NO: 5586480 - DNA, 20 bp, Homo sapiens
caggctggaagatagctgtg

SEQ ID NO: 5586481 - DNA, 17 bp, Homo sapiens
caggctggacaccctct

SEQ ID NO: 5586482 - DNA, 23 bp, Homo sapiens
caggctggacaccctctgccgag

SEQ ID NO: 5586483 - DNA, 14 bp, Homo sapiens
caggctggacgtgg

SEQ ID NO: 5586484 - DNA, 23 bp, Homo sapiens
caggctggagactggaccgctga

SEQ ID NO: 5586485 - DNA, 17 bp, Homo sapiens
caggctggagagcactg

SEQ ID NO: 5586486 - DNA, 19 bp, Homo sapiens
caggctggagagcactgcc

SEQ ID NO: 5586487 - DNA, 21 bp, Homo sapiens
caggctggagagcactgccag

SEQ ID NO: 5586488 - DNA, 23 bp, Homo sapiens
caggctggagataacagcctctt

SEQ ID NO: 5586489 - DNA, 15 bp, Homo sapiens
caggctggagatcct

SEQ ID NO: 5586490 - DNA, 21 bp, Homo sapiens
caggctggaggtaaggccttt

SEQ ID NO: 5586491 - DNA, 20 bp, Homo sapiens
caggctggagtgcagtgaca

SEQ ID NO: 5586492 - DNA, 22 bp, Homo sapiens
caggctggagtgcagtgacaca

SEQ ID NO: 5586493 - DNA, 18 bp, Homo sapiens
caggctggagtgcagtgg

SEQ ID NO: 5586494 - DNA, 20 bp, Homo sapiens
caggctggagtgcagtggcg

SEQ ID NO: 5586495 - DNA, 13 bp, Homo sapiens
caggctggagtta

SEQ ID NO: 5586496 - DNA, 16 bp, Homo sapiens
caggctggagttattg

SEQ ID NO: 5586497 - DNA, 21 bp, Homo sapiens
caggctggcaccgccttctct

SEQ ID NO: 5586498 - DNA, 13 bp, Homo sapiens
caggctggcagct

SEQ ID NO: 5586499 - DNA, 16 bp, Homo sapiens
caggctggcagctctc

SEQ ID NO: 5586500 - DNA, 20 bp, Homo sapiens
caggctggcagctctccagt

SEQ ID NO: 5586501 - DNA, 13 bp, Homo sapiens
caggctggcatct

SEQ ID NO: 5586502 - DNA, 18 bp, Homo sapiens
caggctggcatctccccc

SEQ ID NO: 5586503 - DNA, 19 bp, Homo sapiens
caggctggcatctccccca

SEQ ID NO: 5586504 - DNA, 20 bp, Homo sapiens
caggctggcatctcccccac

SEQ ID NO: 5586505 - DNA, 14 bp, Homo sapiens
caggctggccagcc

SEQ ID NO: 5586506 - DNA, 15 bp, Homo sapiens
caggctggccagccc

SEQ ID NO: 5586507 - DNA, 23 bp, Homo sapiens
caggctggccagccccacagccc

SEQ ID NO: 5586508 - DNA, 17 bp, Homo sapiens
caggctggccagccgct

SEQ ID NO: 5586509 - DNA, 14 bp, Homo sapiens
caggctggccagtc

SEQ ID NO: 5586510 - DNA, 18 bp, Homo sapiens
caggctggccagtccagg

SEQ ID NO: 5586511 - DNA, 19 bp, Homo sapiens
caggctggccagtccaggc

SEQ ID NO: 5586512 - DNA, 15 bp, Homo sapiens
caggctggcccccac

SEQ ID NO: 5586513 - DNA, 12 bp, Homo sapiens
caggctggccct

SEQ ID NO: 5586514 - DNA, 16 bp, Homo sapiens
caggctggcgcagcca

SEQ ID NO: 5586515 - DNA, 17 bp, Homo sapiens
caggctggcgcagccaa

SEQ ID NO: 5586516 - DNA, 15 bp, Homo sapiens
caggctggcgtgcag

SEQ ID NO: 5586517 - DNA, 19 bp, Homo sapiens
caggctggcgtgcagtggt

SEQ ID NO: 5586518 - DNA, 23 bp, Homo sapiens
caggctggctcctggggatggcc

SEQ ID NO: 5586519 - DNA, 24 bp, Homo sapiens
caggctggctcctggggatggcca

SEQ ID NO: 5586520 - DNA, 12 bp, Homo sapiens
caggctggctcg

SEQ ID NO: 5586521 - DNA, 15 bp, Homo sapiens
caggctgggaagtgt

SEQ ID NO: 5586522 - DNA, 14 bp, Homo sapiens
caggctgggacgga

SEQ ID NO: 5586523 - DNA, 14 bp, Homo sapiens
caggctgggagagc

SEQ ID NO: 5586524 - DNA, 16 bp, Homo sapiens
caggctgggagagcct

SEQ ID NO: 5586525 - DNA, 22 bp, Homo sapiens
caggctgggagagccttccagg

SEQ ID NO: 5586526 - DNA, 15 bp, Homo sapiens
caggctgggaggctc

SEQ ID NO: 5586527 - DNA, 12 bp, Homo sapiens
caggctgggcag

SEQ ID NO: 5586528 - DNA, 16 bp, Homo sapiens
caggctgggcagcccc

SEQ ID NO: 5586529 - DNA, 20 bp, Homo sapiens
caggctgggcagccccagag

SEQ ID NO: 5586530 - DNA, 21 bp, Homo sapiens
caggctgggcagccccagaga

SEQ ID NO: 5586531 - DNA, 20 bp, Homo sapiens
caggctgggccatgtccaaa

SEQ ID NO: 5586532 - DNA, 23 bp, Homo sapiens
caggctgggccatgtccaaagag

SEQ ID NO: 5586533 - DNA, 12 bp, Homo sapiens
caggctgggccg

SEQ ID NO: 5586534 - DNA, 23 bp, Homo sapiens
caggctgggccgcaagggcctgg

SEQ ID NO: 5586535 - DNA, 18 bp, Homo sapiens
caggctgggctctgcctg

SEQ ID NO: 5586536 - DNA, 21 bp, Homo sapiens
caggctgggctgggcactgct

SEQ ID NO: 5586537 - DNA, 14 bp, Homo sapiens
caggctgggcttca

SEQ ID NO: 5586538 - DNA, 22 bp, Homo sapiens
caggctgggcttcagtggcagc

SEQ ID NO: 5586539 - DNA, 13 bp, Homo sapiens
caggctggggagg

SEQ ID NO: 5586540 - DNA, 19 bp, Homo sapiens
caggctggggaggccagtg

SEQ ID NO: 5586541 - DNA, 22 bp, Homo sapiens
caggctggggaggccagtgttg

SEQ ID NO: 5586542 - DNA, 15 bp, Homo sapiens
caggctggggcctgg

SEQ ID NO: 5586543 - DNA, 17 bp, Homo sapiens
caggctggggcctggcc

SEQ ID NO: 5586544 - DNA, 14 bp, Homo sapiens
caggctggggcctt

SEQ ID NO: 5586545 - DNA, 12 bp, Homo sapiens
caggctgggtca

SEQ ID NO: 5586546 - DNA, 20 bp, Homo sapiens
caggctgggtcaaaagagcc

SEQ ID NO: 5586547 - DNA, 17 bp, Homo sapiens
cagggatcacagaccac

SEQ ID NO: 5586548 - DNA, 20 bp, Homo sapiens
cagggatcacagaccacagg

SEQ ID NO: 5586549 - DNA, 19 bp, Homo sapiens
cagggatcactggctggcc

SEQ ID NO: 5586550 - DNA, 14 bp, Homo sapiens
cagggatctcagag

SEQ ID NO: 5586551 - DNA, 22 bp, Homo sapiens
cagggatctcagaggctcagag

SEQ ID NO: 5586552 - DNA, 17 bp, Homo sapiens
cagggatcttctccctc

SEQ ID NO: 5586553 - DNA, 23 bp, Homo sapiens
cagggatgagcatggagctggcc

SEQ ID NO: 5586554 - DNA, 20 bp, Homo sapiens
cagggatgattcaagccatt

SEQ ID NO: 5586555 - DNA, 23 bp, Homo sapiens
cagggatgccaacaccttcttgg

SEQ ID NO: 5586556 - DNA, 23 bp, Homo sapiens
cagggatgccctggaggtggctg

SEQ ID NO: 5586557 - DNA, 21 bp, Homo sapiens
cagggatgctcattccatgac

SEQ ID NO: 5586558 - DNA, 15 bp, Homo sapiens
cagggatgctgggct

SEQ ID NO: 5586559 - DNA, 22 bp, Homo sapiens
cagggatgctggtggctggtga

SEQ ID NO: 5586560 - DNA, 14 bp, Homo sapiens
cagggatggaggga

SEQ ID NO: 5586561 - DNA, 15 bp, Homo sapiens
cagggatggcagtgg

SEQ ID NO: 5586562 - DNA, 20 bp, Homo sapiens
cagggatggcccagctgatc

SEQ ID NO: 5586563 - DNA, 21 bp, Homo sapiens
cagggatgggggatgggccag

SEQ ID NO: 5586564 - DNA, 23 bp, Homo sapiens
cagggatgggggatgggccaggg

SEQ ID NO: 5586565 - DNA, 20 bp, Homo sapiens
cagggatgggggtggctggg

SEQ ID NO: 5586566 - DNA, 18 bp, Homo sapiens
cagggatgtctgttgaaa

SEQ ID NO: 5586567 - DNA, 13 bp, Homo sapiens
cagggatgtgggt

SEQ ID NO: 5586568 - DNA, 21 bp, Homo sapiens
cagggatgtgggttccacaga

SEQ ID NO: 5586569 - DNA, 17 bp, Homo sapiens
cagggattccctgtccc

SEQ ID NO: 5586570 - DNA, 14 bp, Homo sapiens
cagggattctctca

SEQ ID NO: 5586571 - DNA, 23 bp, Homo sapiens
cagggattctgggcttggggtgt

SEQ ID NO: 5586572 - DNA, 17 bp, Homo sapiens
cagggatttagcccatg

SEQ ID NO: 5586573 - DNA, 18 bp, Homo sapiens
cagggatttgcctcacct

SEQ ID NO: 5586574 - DNA, 23 bp, Homo sapiens
cagggcaaaagggcagctgtgat

SEQ ID NO: 5586575 - DNA, 21 bp, Homo sapiens
cagggcaaaatattcactggg

SEQ ID NO: 5586576 - DNA, 22 bp, Homo sapiens
cagggcaaaatcgccataggcc

SEQ ID NO: 5586577 - DNA, 18 bp, Homo sapiens
cagggcaaaatgaactaa

SEQ ID NO: 5586578 - DNA, 13 bp, Homo sapiens
cagggcaaagcca

SEQ ID NO: 5586579 - DNA, 14 bp, Homo sapiens
cagggcaaagccag

SEQ ID NO: 5586580 - DNA, 22 bp, Homo sapiens
cagggcaaatgacatgcactga

SEQ ID NO: 5586581 - DNA, 23 bp, Homo sapiens
cagggcaaatgacatgcactgac

SEQ ID NO: 5586582 - DNA, 23 bp, Homo sapiens
cagggcaaatgtttacattttgt

SEQ ID NO: 5586583 - DNA, 15 bp, Homo sapiens
cagggcaacaagccc

SEQ ID NO: 5586584 - DNA, 11 bp, Homo sapiens
cagggcaagct

SEQ ID NO: 5586585 - DNA, 22 bp, Homo sapiens
cagggcaagctccgcaggactt

SEQ ID NO: 5586586 - DNA, 20 bp, Homo sapiens
cagggcaaggacacagcgcg

SEQ ID NO: 5586587 - DNA, 15 bp, Homo sapiens
cagggcaaggccatt

SEQ ID NO: 5586588 - DNA, 19 bp, Homo sapiens
cagggcaaggccccttcca

SEQ ID NO: 5586589 - DNA, 13 bp, Homo sapiens
cagggcaatgcca

SEQ ID NO: 5586590 - DNA, 17 bp, Homo sapiens
cagggcaatgccatcag

SEQ ID NO: 5586591 - DNA, 21 bp, Homo sapiens
cagggcaatgccatcagcccc

SEQ ID NO: 5586592 - DNA, 22 bp, Homo sapiens
cagggcaatgccatcagcccct

SEQ ID NO: 5586593 - DNA, 23 bp, Homo sapiens
cagggcaatgccatcagcccctg

SEQ ID NO: 5586594 - DNA, 15 bp, Homo sapiens
cagggcacaccgggc

SEQ ID NO: 5586595 - DNA, 17 bp, Homo sapiens
cagggcacaccgggcac

SEQ ID NO: 5586596 - DNA, 19 bp, Homo sapiens
cagggcacaccgggcactc

SEQ ID NO: 5586597 - DNA, 21 bp, Homo sapiens
cagggcacaccgggcactcag

SEQ ID NO: 5586598 - DNA, 22 bp, Homo sapiens
cagggcacaccgggcactcaga

SEQ ID NO: 5586599 - DNA, 23 bp, Homo sapiens
cagggcacaccgggcactcagaa

SEQ ID NO: 5586600 - DNA, 15 bp, Homo sapiens
cagggcacagaaggc

SEQ ID NO: 5586601 - DNA, 15 bp, Homo sapiens
cagggcacagctgcc

SEQ ID NO: 5586602 - DNA, 17 bp, Homo sapiens
cagggcacagctgccct

SEQ ID NO: 5586603 - DNA, 18 bp, Homo sapiens
cagggcacagctgccctg

SEQ ID NO: 5586604 - DNA, 23 bp, Homo sapiens
cagggcacagctgccctgctgcc

SEQ ID NO: 5586605 - DNA, 15 bp, Homo sapiens
cagggcacagctgga

SEQ ID NO: 5586606 - DNA, 14 bp, Homo sapiens
cagggcacaggagc

SEQ ID NO: 5586607 - DNA, 15 bp, Homo sapiens
cagggcacaggccat

SEQ ID NO: 5586608 - DNA, 18 bp, Homo sapiens
cagggcacaggccatgga

SEQ ID NO: 5586609 - DNA, 12 bp, Homo sapiens
cagggcacaggg

SEQ ID NO: 5586610 - DNA, 16 bp, Homo sapiens
cagggcaccaagccca

SEQ ID NO: 5586611 - DNA, 18 bp, Homo sapiens
cagggcaccaagcccaca

SEQ ID NO: 5586612 - DNA, 14 bp, Homo sapiens
cagggcaccagagg

SEQ ID NO: 5586613 - DNA, 22 bp, Homo sapiens
cagggcaccctgtggccctggc

SEQ ID NO: 5586614 - DNA, 21 bp, Homo sapiens
cagggcaccgtattcctctcc

SEQ ID NO: 5586615 - DNA, 18 bp, Homo sapiens
cagggcacgcaggaccag

SEQ ID NO: 5586616 - DNA, 16 bp, Homo sapiens
cagggcacggggacct

SEQ ID NO: 5586617 - DNA, 19 bp, Homo sapiens
cagggcacggggacctgga

SEQ ID NO: 5586618 - DNA, 17 bp, Homo sapiens
cagggcactctgttccc

SEQ ID NO: 5586619 - DNA, 14 bp, Homo sapiens
cagggcactgccag

SEQ ID NO: 5586620 - DNA, 15 bp, Homo sapiens
cagggcactgccagc

SEQ ID NO: 5586621 - DNA, 15 bp, Homo sapiens
cagggcactgtctgc

SEQ ID NO: 5586622 - DNA, 20 bp, Homo sapiens
cagggcacttcacagagtgt

SEQ ID NO: 5586623 - DNA, 18 bp, Homo sapiens
cagggcagaaccaagaac

SEQ ID NO: 5586624 - DNA, 13 bp, Homo sapiens
cagggcagcagat

SEQ ID NO: 5586625 - DNA, 14 bp, Homo sapiens
cagggcagcagccg

SEQ ID NO: 5586626 - DNA, 16 bp, Homo sapiens
cagggcagcaggaggc

SEQ ID NO: 5586627 - DNA, 15 bp, Homo sapiens
cagggcagcaggctt

SEQ ID NO: 5586628 - DNA, 16 bp, Homo sapiens
cagggcagcagtgggg

SEQ ID NO: 5586629 - DNA, 19 bp, Homo sapiens
cagggcagcagtggggtga

SEQ ID NO: 5586630 - DNA, 16 bp, Homo sapiens
cagggcagcatggaga

SEQ ID NO: 5586631 - DNA, 18 bp, Homo sapiens
cagggcagcccctgcaga

SEQ ID NO: 5586632 - DNA, 20 bp, Homo sapiens
cagggcagccgtcacccctg

SEQ ID NO: 5586633 - DNA, 12 bp, Homo sapiens
cagggcagcctc

SEQ ID NO: 5586634 - DNA, 17 bp, Homo sapiens
cagggcagcctccacct

SEQ ID NO: 5586635 - DNA, 13 bp, Homo sapiens
cagggcagcctgt

SEQ ID NO: 5586636 - DNA, 15 bp, Homo sapiens
cagggcagcctgtgg

SEQ ID NO: 5586637 - DNA, 18 bp, Homo sapiens
cagggcagcctgtgggag

SEQ ID NO: 5586638 - DNA, 15 bp, Homo sapiens
cagggcagcgccagg

SEQ ID NO: 5586639 - DNA, 16 bp, Homo sapiens
cagggcagcgccaggc

SEQ ID NO: 5586640 - DNA, 17 bp, Homo sapiens
cagggcagcgccaggct

SEQ ID NO: 5586641 - DNA, 13 bp, Homo sapiens
cagggcagcggct

SEQ ID NO: 5586642 - DNA, 21 bp, Homo sapiens
cagggcagctgcctggccatg

SEQ ID NO: 5586643 - DNA, 17 bp, Homo sapiens
cagggcagctgggccca

SEQ ID NO: 5586644 - DNA, 22 bp, Homo sapiens
cagggcagctgggcccaaccct

SEQ ID NO: 5586645 - DNA, 18 bp, Homo sapiens
cagggcaggaccagccca

SEQ ID NO: 5586646 - DNA, 20 bp, Homo sapiens
cagggcaggaccagcccacg

SEQ ID NO: 5586647 - DNA, 13 bp, Homo sapiens
cagggcaggcccc

SEQ ID NO: 5586648 - DNA, 12 bp, Homo sapiens
cagggcaggcct

SEQ ID NO: 5586649 - DNA, 13 bp, Homo sapiens
cagggcagggcca

SEQ ID NO: 5586650 - DNA, 15 bp, Homo sapiens
cagggcagggcgagc

SEQ ID NO: 5586651 - DNA, 16 bp, Homo sapiens
cagggcagggcgagct

SEQ ID NO: 5586652 - DNA, 15 bp, Homo sapiens
cagggcagggctcat

SEQ ID NO: 5586653 - DNA, 16 bp, Homo sapiens
cagggcagggctctga

SEQ ID NO: 5586654 - DNA, 16 bp, Homo sapiens
cagggcaggggtggtg

SEQ ID NO: 5586655 - DNA, 19 bp, Homo sapiens
cagggcaggggtggtggag

SEQ ID NO: 5586656 - DNA, 12 bp, Homo sapiens
cagggcagggtc

SEQ ID NO: 5586657 - DNA, 15 bp, Homo sapiens
cagggcagggtctgg

SEQ ID NO: 5586658 - DNA, 16 bp, Homo sapiens
cagggcagggtctggg

SEQ ID NO: 5586659 - DNA, 13 bp, Homo sapiens
cagggcaggtggg

SEQ ID NO: 5586660 - DNA, 19 bp, Homo sapiens
cagggcagtacctgagggt

SEQ ID NO: 5586661 - DNA, 23 bp, Homo sapiens
cagggcagtacctgagggtctgt

SEQ ID NO: 5586662 - DNA, 21 bp, Homo sapiens
cagggcagtgacaagtggagg

SEQ ID NO: 5586663 - DNA, 22 bp, Homo sapiens
cagggcagtgctagtgagctgg

SEQ ID NO: 5586664 - DNA, 18 bp, Homo sapiens
cagggcagtggccaagcc

SEQ ID NO: 5586665 - DNA, 22 bp, Homo sapiens
cagggcagtggccaagcctgct

SEQ ID NO: 5586666 - DNA, 21 bp, Homo sapiens
cagggcagtggcttctttcca

SEQ ID NO: 5586667 - DNA, 22 bp, Homo sapiens
cagggcagtgtggtgggagggg

SEQ ID NO: 5586668 - DNA, 24 bp, Homo sapiens
cagggcagttgtcgggcagtcctg

SEQ ID NO: 5586669 - DNA, 21 bp, Homo sapiens
cagggcatctccaggaaggcg

SEQ ID NO: 5586670 - DNA, 14 bp, Homo sapiens
cagggcatctcctg

SEQ ID NO: 5586671 - DNA, 18 bp, Homo sapiens
cagggcatcttgctggct

SEQ ID NO: 5586672 - DNA, 20 bp, Homo sapiens
cagggcatcttgctggctac

SEQ ID NO: 5586673 - DNA, 19 bp, Homo sapiens
cagggcatgcattttgcag

SEQ ID NO: 5586674 - DNA, 18 bp, Homo sapiens
cagggcatgccccggcca

SEQ ID NO: 5586675 - DNA, 16 bp, Homo sapiens
cagggcatgcctggcc

SEQ ID NO: 5586676 - DNA, 18 bp, Homo sapiens
cagggcatgcctggcctg

SEQ ID NO: 5586677 - DNA, 23 bp, Homo sapiens
cagggcatgcctggcctgaggac

SEQ ID NO: 5586678 - DNA, 24 bp, Homo sapiens
cagggcatgcctggcctgaggacc

SEQ ID NO: 5586679 - DNA, 20 bp, Homo sapiens
cagggcatggccaggtggcc

SEQ ID NO: 5586680 - DNA, 17 bp, Homo sapiens
cagggcatggctgggaa

SEQ ID NO: 5586681 - DNA, 16 bp, Homo sapiens
cagggcatgtgtatgt

SEQ ID NO: 5586682 - DNA, 14 bp, Homo sapiens
cagggcattcgggc

SEQ ID NO: 5586683 - DNA, 16 bp, Homo sapiens
cagggcattcgggcca

SEQ ID NO: 5586684 - DNA, 18 bp, Homo sapiens
cagggcattcgggccaca

SEQ ID NO: 5586685 - DNA, 19 bp, Homo sapiens
cagggcattcgggccacag

SEQ ID NO: 5586686 - DNA, 21 bp, Homo sapiens
cagggcattgctcagcccgct

SEQ ID NO: 5586687 - DNA, 22 bp, Homo sapiens
cagggccaaacgctgagccacc

SEQ ID NO: 5586688 - DNA, 18 bp, Homo sapiens
cagggccaaagcacagct

SEQ ID NO: 5586689 - DNA, 18 bp, Homo sapiens
cagggccaacccttctcc

SEQ ID NO: 5586690 - DNA, 16 bp, Homo sapiens
cagggccaagccggcc

SEQ ID NO: 5586691 - DNA, 17 bp, Homo sapiens
cagggccaagccggccc

SEQ ID NO: 5586692 - DNA, 23 bp, Homo sapiens
cagggccaagccggcccaaccca

SEQ ID NO: 5586693 - DNA, 15 bp, Homo sapiens
cagggccaccgcagg

SEQ ID NO: 5586694 - DNA, 12 bp, Homo sapiens
cagggccacctg

SEQ ID NO: 5586695 - DNA, 16 bp, Homo sapiens
cagggccacctgcagg

SEQ ID NO: 5586696 - DNA, 17 bp, Homo sapiens
cagggccacgctccagc

SEQ ID NO: 5586697 - DNA, 17 bp, Homo sapiens
cagggccacgtgccagg

SEQ ID NO: 5586698 - DNA, 18 bp, Homo sapiens
cagggccacgtgccaggc

SEQ ID NO: 5586699 - DNA, 19 bp, Homo sapiens
cagggccactcccggcact

SEQ ID NO: 5586700 - DNA, 18 bp, Homo sapiens
cagggccactctgcctct

SEQ ID NO: 5586701 - DNA, 11 bp, Homo sapiens
cagggccagaa

SEQ ID NO: 5586702 - DNA, 15 bp, Homo sapiens
cagggccagactgga

SEQ ID NO: 5586703 - DNA, 18 bp, Homo sapiens
cagggccagactggaaga

SEQ ID NO: 5586704 - DNA, 13 bp, Homo sapiens
cagggccagagca

SEQ ID NO: 5586705 - DNA, 14 bp, Homo sapiens
cagggccagagcag

SEQ ID NO: 5586706 - DNA, 16 bp, Homo sapiens
cagggccagagcagct

SEQ ID NO: 5586707 - DNA, 17 bp, Homo sapiens
cagggccagagcagctc

SEQ ID NO: 5586708 - DNA, 20 bp, Homo sapiens
cagggccagagggagctgga

SEQ ID NO: 5586709 - DNA, 22 bp, Homo sapiens
cagggccagatgagcagaagct

SEQ ID NO: 5586710 - DNA, 21 bp, Homo sapiens
cagggccagcaggcagcgcct

SEQ ID NO: 5586711 - DNA, 11 bp, Homo sapiens
cagggccagga

SEQ ID NO: 5586712 - DNA, 12 bp, Homo sapiens
cagggccaggaa

SEQ ID NO: 5586713 - DNA, 13 bp, Homo sapiens
cagggccaggaag

SEQ ID NO: 5586714 - DNA, 14 bp, Homo sapiens
cagggccaggactg

SEQ ID NO: 5586715 - DNA, 18 bp, Homo sapiens
cagggccaggactgagcc

SEQ ID NO: 5586716 - DNA, 20 bp, Homo sapiens
cagggccaggattcaggcct

SEQ ID NO: 5586717 - DNA, 13 bp, Homo sapiens
cagggccaggccc

SEQ ID NO: 5586718 - DNA, 15 bp, Homo sapiens
cagggccaggcccag

SEQ ID NO: 5586719 - DNA, 15 bp, Homo sapiens
cagggccaggcctct

SEQ ID NO: 5586720 - DNA, 18 bp, Homo sapiens
cagggccaggcctctgct

SEQ ID NO: 5586721 - DNA, 15 bp, Homo sapiens
cagggccagggcaat

SEQ ID NO: 5586722 - DNA, 16 bp, Homo sapiens
cagggccagggcaatg

SEQ ID NO: 5586723 - DNA, 17 bp, Homo sapiens
cagggccagggcaatgc

SEQ ID NO: 5586724 - DNA, 19 bp, Homo sapiens
caggggcccaggctcccct

SEQ ID NO: 5586725 - DNA, 14 bp, Homo sapiens
caggggccccagat

SEQ ID NO: 5586726 - DNA, 24 bp, Homo sapiens
caggggccccagatctgcctgggc

SEQ ID NO: 5586727 - DNA, 18 bp, Homo sapiens
caggggcccctccagctt

SEQ ID NO: 5586728 - DNA, 21 bp, Homo sapiens
caggggcccctcctctgtgct

SEQ ID NO: 5586729 - DNA, 17 bp, Homo sapiens
caggggcccctggggac

SEQ ID NO: 5586730 - DNA, 23 bp, Homo sapiens
caggggcccgggaactcctgcca

SEQ ID NO: 5586731 - DNA, 18 bp, Homo sapiens
caggggccctacctgggg

SEQ ID NO: 5586732 - DNA, 19 bp, Homo sapiens
caggggccctacctgggga

SEQ ID NO: 5586733 - DNA, 11 bp, Homo sapiens
caggggccctg

SEQ ID NO: 5586734 - DNA, 19 bp, Homo sapiens
caggggcccttgggacagc

SEQ ID NO: 5586735 - DNA, 22 bp, Homo sapiens
caggggcccttgggacagccag

SEQ ID NO: 5586736 - DNA, 17 bp, Homo sapiens
caggggcctcaggggag

SEQ ID NO: 5586737 - DNA, 18 bp, Homo sapiens
caggggcctcaggggagc

SEQ ID NO: 5586738 - DNA, 21 bp, Homo sapiens
caggggcctctctcctgcctg

SEQ ID NO: 5586739 - DNA, 13 bp, Homo sapiens
caggggcctgcag

SEQ ID NO: 5586740 - DNA, 16 bp, Homo sapiens
caggggcctgcccagt

SEQ ID NO: 5586741 - DNA, 12 bp, Homo sapiens
caggggcctgga

SEQ ID NO: 5586742 - DNA, 22 bp, Homo sapiens
caggggcctggagatcctcctg

SEQ ID NO: 5586743 - DNA, 23 bp, Homo sapiens
caggggcctggagatcctcctgc

SEQ ID NO: 5586744 - DNA, 19 bp, Homo sapiens
caggggcctggaggtctgg

SEQ ID NO: 5586745 - DNA, 24 bp, Homo sapiens
caggggcctggaggtctggctgag

SEQ ID NO: 5586746 - DNA, 13 bp, Homo sapiens
caggggcctgggc

SEQ ID NO: 5586747 - DNA, 17 bp, Homo sapiens
caggggcctgggccggc

SEQ ID NO: 5586748 - DNA, 19 bp, Homo sapiens
caggggcggggcaggaatg

SEQ ID NO: 5586749 - DNA, 22 bp, Homo sapiens
caggggcgggtgatgagacctg

SEQ ID NO: 5586750 - DNA, 15 bp, Homo sapiens
caggggcgtggaggg

SEQ ID NO: 5586751 - DNA, 21 bp, Homo sapiens
caggggctatcccttctcaga

SEQ ID NO: 5586752 - DNA, 12 bp, Homo sapiens
caggggctccag

SEQ ID NO: 5586753 - DNA, 13 bp, Homo sapiens
caggggctccagc

SEQ ID NO: 5586754 - DNA, 14 bp, Homo sapiens
caggggctccagca

SEQ ID NO: 5586755 - DNA, 21 bp, Homo sapiens
caggggctccctccgccccca

SEQ ID NO: 5586756 - DNA, 13 bp, Homo sapiens
caggggctcctgg

SEQ ID NO: 5586757 - DNA, 18 bp, Homo sapiens
caggggctcctgggttgg

SEQ ID NO: 5586758 - DNA, 19 bp, Homo sapiens
caggggctcctgggttgga

SEQ ID NO: 5586759 - DNA, 23 bp, Homo sapiens
caggggctcctgggttggaggga

SEQ ID NO: 5586760 - DNA, 20 bp, Homo sapiens
caggggctctggagagaaac

SEQ ID NO: 5586761 - DNA, 12 bp, Homo sapiens
caggggctctgt

SEQ ID NO: 5586762 - DNA, 21 bp, Homo sapiens
caggggctctgtggcaaaaag

SEQ ID NO: 5586763 - DNA, 16 bp, Homo sapiens
caggggctgcatcctc

SEQ ID NO: 5586764 - DNA, 20 bp, Homo sapiens
caggggctgcatcctcagcc

SEQ ID NO: 5586765 - DNA, 22 bp, Homo sapiens
caggggctgcatcctcagcccc

SEQ ID NO: 5586766 - DNA, 13 bp, Homo sapiens
caggggctgctca

SEQ ID NO: 5586767 - DNA, 21 bp, Homo sapiens
caggggctgctcatcacccag

SEQ ID NO: 5586768 - DNA, 13 bp, Homo sapiens
caggggctgcttc

SEQ ID NO: 5586769 - DNA, 16 bp, Homo sapiens
caggggctgcttcctc

SEQ ID NO: 5586770 - DNA, 20 bp, Homo sapiens
caggggctgcttcctcctgg

SEQ ID NO: 5586771 - DNA, 13 bp, Homo sapiens
caggggctggagg

SEQ ID NO: 5586772 - DNA, 13 bp, Homo sapiens
caggggctggccc

SEQ ID NO: 5586773 - DNA, 15 bp, Homo sapiens
caggggctggcttca

SEQ ID NO: 5586774 - DNA, 22 bp, Homo sapiens
caggggctgggcatcccagctt

SEQ ID NO: 5586775 - DNA, 18 bp, Homo sapiens
caggggctggtgggacag

SEQ ID NO: 5586776 - DNA, 20 bp, Homo sapiens
caggggctggtgggacagtg

SEQ ID NO: 5586777 - DNA, 23 bp, Homo sapiens
caggggcttcacccatgaaatta

SEQ ID NO: 5586778 - DNA, 22 bp, Homo sapiens
caggggcttcccacagcctctt

SEQ ID NO: 5586779 - DNA, 19 bp, Homo sapiens
caggggcttcccactttgg

SEQ ID NO: 5586780 - DNA, 20 bp, Homo sapiens
caggggcttcccactttggc

SEQ ID NO: 5586781 - DNA, 23 bp, Homo sapiens
caggggcttctccccctcagctc

SEQ ID NO: 5586782 - DNA, 21 bp, Homo sapiens
caggggctttgggcccaagaa

SEQ ID NO: 5586783 - DNA, 20 bp, Homo sapiens
caggggctttggtggcccct

SEQ ID NO: 5586784 - DNA, 21 bp, Homo sapiens
caggggctttggtggcccctc

SEQ ID NO: 5586785 - DNA, 17 bp, Homo sapiens
cagggggaagcaccagc

SEQ ID NO: 5586786 - DNA, 20 bp, Homo sapiens
cagggggaagcaccagcctc

SEQ ID NO: 5586787 - DNA, 21 bp, Homo sapiens
cagggggaagcaccagcctca

SEQ ID NO: 5586788 - DNA, 23 bp, Homo sapiens
cagggggaagcaccagcctcagt

SEQ ID NO: 5586789 - DNA, 23 bp, Homo sapiens
cagggggaaggccaaggggagtc

SEQ ID NO: 5586790 - DNA, 18 bp, Homo sapiens
cagggggacctaggctcc

SEQ ID NO: 5586791 - DNA, 16 bp, Homo sapiens
cagggggagaaggaag

SEQ ID NO: 5586792 - DNA, 22 bp, Homo sapiens
cagggggagctgggcctggtct

SEQ ID NO: 5586793 - DNA, 22 bp, Homo sapiens
cagggggaggaggacttggagg

SEQ ID NO: 5586794 - DNA, 18 bp, Homo sapiens
cagggggattctgagcag

SEQ ID NO: 5586795 - DNA, 21 bp, Homo sapiens
cagggggattctgagcagtgc

SEQ ID NO: 5586796 - DNA, 16 bp, Homo sapiens
cagggggcaaggagaa

SEQ ID NO: 5586797 - DNA, 13 bp, Homo sapiens
cagggggccagct

SEQ ID NO: 5586798 - DNA, 17 bp, Homo sapiens
cagggggccagctgggg

SEQ ID NO: 5586799 - DNA, 12 bp, Homo sapiens
cagggggccccg

SEQ ID NO: 5586800 - DNA, 22 bp, Homo sapiens
cagggggccccgccagggctgg

SEQ ID NO: 5586801 - DNA, 21 bp, Homo sapiens
cagggggcccgaacagggact

SEQ ID NO: 5586802 - DNA, 11 bp, Homo sapiens
cagggggccct

SEQ ID NO: 5586803 - DNA, 13 bp, Homo sapiens
cagggggccctgc

SEQ ID NO: 5586804 - DNA, 23 bp, Homo sapiens
cagggggccctgccccaccccat

SEQ ID NO: 5586805 - DNA, 18 bp, Homo sapiens
cagggggcctgcaggccc

SEQ ID NO: 5586806 - DNA, 22 bp, Homo sapiens
cagggggcctgcaggccccagc

SEQ ID NO: 5586807 - DNA, 13 bp, Homo sapiens
cagggggctgctg

SEQ ID NO: 5586808 - DNA, 14 bp, Homo sapiens
cagggggctgctgc

SEQ ID NO: 5586809 - DNA, 22 bp, Homo sapiens
cagggggcttcctgaggggaga

SEQ ID NO: 5586810 - DNA, 13 bp, Homo sapiens
caggggggctgtg

SEQ ID NO: 5586811 - DNA, 14 bp, Homo sapiens
caggggggctgtgc

SEQ ID NO: 5586812 - DNA, 15 bp, Homo sapiens
caggggggctgtgcc

SEQ ID NO: 5586813 - DNA, 22 bp, Homo sapiens
caggggggctgtgccaacctgt

SEQ ID NO: 5586814 - DNA, 21 bp, Homo sapiens
caggggggtcggaagcctgtc

SEQ ID NO: 5586815 - DNA, 22 bp, Homo sapiens
caggggggtcggaagcctgtcc

SEQ ID NO: 5586816 - DNA, 19 bp, Homo sapiens
caggggggttgtgaggcct

SEQ ID NO: 5586817 - DNA, 18 bp, Homo sapiens
cagggggtctggctggtg

SEQ ID NO: 5586818 - DNA, 20 bp, Homo sapiens
cagggggtctggctggtgtt

SEQ ID NO: 5586819 - DNA, 17 bp, Homo sapiens
cagggggtgaggggcag

SEQ ID NO: 5586820 - DNA, 22 bp, Homo sapiens
cagggggtgaggggcaggtcta

SEQ ID NO: 5586821 - DNA, 17 bp, Homo sapiens
cagggggtgccctccca

SEQ ID NO: 5586822 - DNA, 23 bp, Homo sapiens
cagggggtgccctcccagacccc

SEQ ID NO: 5586823 - DNA, 23 bp, Homo sapiens
cagggggtgggaaggggatggac

SEQ ID NO: 5586824 - DNA, 20 bp, Homo sapiens
caggggtaccaggcacatgg

SEQ ID NO: 5586825 - DNA, 22 bp, Homo sapiens
caggggtaccaggcacatggct

SEQ ID NO: 5586826 - DNA, 22 bp, Homo sapiens
caggggtaggggtagggagcct

SEQ ID NO: 5586827 - DNA, 22 bp, Homo sapiens
caggggtatatttagaccctgt

SEQ ID NO: 5586828 - DNA, 16 bp, Homo sapiens
caggggtcaccttgag

SEQ ID NO: 5586829 - DNA, 18 bp, Homo sapiens
caggggtcaccttgagag

SEQ ID NO: 5586830 - DNA, 17 bp, Homo sapiens
caggggtcactgaggcc

SEQ ID NO: 5586831 - DNA, 23 bp, Homo sapiens
caggggtcaggtgtcaggcccgt

SEQ ID NO: 5586832 - DNA, 14 bp, Homo sapiens
caggggtcagtgca

SEQ ID NO: 5586833 - DNA, 16 bp, Homo sapiens
caggggtccaggcccc

SEQ ID NO: 5586834 - DNA, 14 bp, Homo sapiens
caggggtcccccct

SEQ ID NO: 5586835 - DNA, 17 bp, Homo sapiens
caggggtcccctggcag

SEQ ID NO: 5586836 - DNA, 20 bp, Homo sapiens
caggggtcctgcaggtcctg

SEQ ID NO: 5586837 - DNA, 20 bp, Homo sapiens
caggggtcgcgatgatgggc

SEQ ID NO: 5586838 - DNA, 21 bp, Homo sapiens
caggggtcgtcaccacctctc

SEQ ID NO: 5586839 - DNA, 23 bp, Homo sapiens
caggggtctcccaacaagtgctc

SEQ ID NO: 5586840 - DNA, 14 bp, Homo sapiens
caggggtctccctg

SEQ ID NO: 5586841 - DNA, 17 bp, Homo sapiens
caggggtctccctgagc

SEQ ID NO: 5586842 - DNA, 15 bp, Homo sapiens
caggggtctccctgg

SEQ ID NO: 5586843 - DNA, 19 bp, Homo sapiens
caggggtctccctggctcc

SEQ ID NO: 5586844 - DNA, 21 bp, Homo sapiens
caggggtctccctggctccct

SEQ ID NO: 5586845 - DNA, 22 bp, Homo sapiens
caggggtctgggagtcaggccc

SEQ ID NO: 5586846 - DNA, 17 bp, Homo sapiens
caggggtgacacagact

SEQ ID NO: 5586847 - DNA, 16 bp, Homo sapiens
caggggtgagagcacc

SEQ ID NO: 5586848 - DNA, 18 bp, Homo sapiens
caggggtgagagcaccca

SEQ ID NO: 5586849 - DNA, 19 bp, Homo sapiens
caggggtgagagcacccac

SEQ ID NO: 5586850 - DNA, 20 bp, Homo sapiens
caggggtgatttcagagagg

SEQ ID NO: 5586851 - DNA, 20 bp, Homo sapiens
caggggtgccccctcctctc

SEQ ID NO: 5586852 - DNA, 16 bp, Homo sapiens
caggggtgcctgtggg

SEQ ID NO: 5586853 - DNA, 18 bp, Homo sapiens
caggggtgcctgtggggg

SEQ ID NO: 5586854 - DNA, 15 bp, Homo sapiens
caggggtgctcctgt

SEQ ID NO: 5586855 - DNA, 16 bp, Homo sapiens
caggggtgctggggca

SEQ ID NO: 5586856 - DNA, 17 bp, Homo sapiens
caggggtgctgtggaca

SEQ ID NO: 5586857 - DNA, 15 bp, Homo sapiens
caggggtgggagagc

SEQ ID NO: 5586858 - DNA, 20 bp, Homo sapiens
caggggtggggcccatgggg

SEQ ID NO: 5586859 - DNA, 15 bp, Homo sapiens
caggggtggggggtg

SEQ ID NO: 5586860 - DNA, 23 bp, Homo sapiens
caggggtgtcccagtcccagcct

SEQ ID NO: 5586861 - DNA, 15 bp, Homo sapiens
caggggttagagcag

SEQ ID NO: 5586862 - DNA, 20 bp, Homo sapiens
caggggttccttctgggcat

SEQ ID NO: 5586863 - DNA, 21 bp, Homo sapiens
caggggttccttctgggcatt

SEQ ID NO: 5586864 - DNA, 13 bp, Homo sapiens
caggggttcgaga

SEQ ID NO: 5586865 - DNA, 13 bp, Homo sapiens
caggggttgcagt

SEQ ID NO: 5586866 - DNA, 13 bp, Homo sapiens
caggggttggcag

SEQ ID NO: 5586867 - DNA, 17 bp, Homo sapiens
caggggttggtcaaggc

SEQ ID NO: 5586868 - DNA, 21 bp, Homo sapiens
caggggttggtcaaggccacc

SEQ ID NO: 5586869 - DNA, 20 bp, Homo sapiens
caggggtttgggtgggggct

SEQ ID NO: 5586870 - DNA, 21 bp, Homo sapiens
cagggtaactaactaaaacaa

SEQ ID NO: 5586871 - DNA, 15 bp, Homo sapiens
cagggtacaaaaaat

SEQ ID NO: 5586872 - DNA, 18 bp, Homo sapiens
cagggtacccgcctgagc

SEQ ID NO: 5586873 - DNA, 19 bp, Homo sapiens
cagggtacctcaagcccca

SEQ ID NO: 5586874 - DNA, 16 bp, Homo sapiens
cagggtactaaaagaa

SEQ ID NO: 5586875 - DNA, 19 bp, Homo sapiens
cagggtagaaaaaggagct

SEQ ID NO: 5586876 - DNA, 18 bp, Homo sapiens
cagggtagacttggagct

SEQ ID NO: 5586877 - DNA, 17 bp, Homo sapiens
cagggtagagcaaagga

SEQ ID NO: 5586878 - DNA, 17 bp, Homo sapiens
cagggtagatttctctt

SEQ ID NO: 5586879 - DNA, 21 bp, Homo sapiens
cagggtagatttctcttgggc

SEQ ID NO: 5586880 - DNA, 13 bp, Homo sapiens
cagggtagcccgc

SEQ ID NO: 5586881 - DNA, 16 bp, Homo sapiens
cagggtaggctggagt

SEQ ID NO: 5586882 - DNA, 23 bp, Homo sapiens
cagggtaggggagggtggggcaa

SEQ ID NO: 5586883 - DNA, 17 bp, Homo sapiens
cagggtagggggcctga

SEQ ID NO: 5586884 - DNA, 23 bp, Homo sapiens
cagggtatggactatctgtctgg

SEQ ID NO: 5586885 - DNA, 20 bp, Homo sapiens
cagggtattccagagtgggg

SEQ ID NO: 5586886 - DNA, 19 bp, Homo sapiens
cagggtattgcttgccact

SEQ ID NO: 5586887 - DNA, 14 bp, Homo sapiens
cagggtcaagcctc

SEQ ID NO: 5586888 - DNA, 16 bp, Homo sapiens
cagggtcagaaacagg

SEQ ID NO: 5586889 - DNA, 19 bp, Homo sapiens
cagggtcataagtggggag

SEQ ID NO: 5586890 - DNA, 21 bp, Homo sapiens
cagggtccaacatagagccgg

SEQ ID NO: 5586891 - DNA, 19 bp, Homo sapiens
cagggtccacagctggaaa

SEQ ID NO: 5586892 - DNA, 18 bp, Homo sapiens
cagggtccagaccctgaa

SEQ ID NO: 5586893 - DNA, 18 bp, Homo sapiens
cagggtccaggagagcct

SEQ ID NO: 5586894 - DNA, 19 bp, Homo sapiens
cagggtcccacagccacgt

SEQ ID NO: 5586895 - DNA, 16 bp, Homo sapiens
cagggtcccaggaagc

SEQ ID NO: 5586896 - DNA, 16 bp, Homo sapiens
cagggtcccctcccca

SEQ ID NO: 5586897 - DNA, 16 bp, Homo sapiens
cagggtccctcaggac

SEQ ID NO: 5586898 - DNA, 19 bp, Homo sapiens
caggtctgcaagggcccag

SEQ ID NO: 5586899 - DNA, 21 bp, Homo sapiens
caggtctgcaagggcccagag

SEQ ID NO: 5586900 - DNA, 18 bp, Homo sapiens
caggtctgcaggccacca

SEQ ID NO: 5586901 - DNA, 20 bp, Homo sapiens
caggtctgcaggccaccagc

SEQ ID NO: 5586902 - DNA, 22 bp, Homo sapiens
caggtctgcaggccaccagctg

SEQ ID NO: 5586903 - DNA, 13 bp, Homo sapiens
caggtctgcctgg

SEQ ID NO: 5586904 - DNA, 17 bp, Homo sapiens
caggtctgcctggttcc

SEQ ID NO: 5586905 - DNA, 17 bp, Homo sapiens
caggtctgggagaggca

SEQ ID NO: 5586906 - DNA, 20 bp, Homo sapiens
caggtctgggagaggcagag

SEQ ID NO: 5586907 - DNA, 13 bp, Homo sapiens
caggtctggggct

SEQ ID NO: 5586908 - DNA, 21 bp, Homo sapiens
caggtctgtaactgcccagcc

SEQ ID NO: 5586909 - DNA, 15 bp, Homo sapiens
caggtctgtatgtca

SEQ ID NO: 5586910 - DNA, 19 bp, Homo sapiens
caggtcttcactgcccagg

SEQ ID NO: 5586911 - DNA, 13 bp, Homo sapiens
caggtcttccaga

SEQ ID NO: 5586912 - DNA, 16 bp, Homo sapiens
caggtcttccagacct

SEQ ID NO: 5586913 - DNA, 18 bp, Homo sapiens
caggtcttgaactcctgg

SEQ ID NO: 5586914 - DNA, 19 bp, Homo sapiens
caggtcttgaactcctggc

SEQ ID NO: 5586915 - DNA, 19 bp, Homo sapiens
caggtcttgactcatggca

SEQ ID NO: 5586916 - DNA, 20 bp, Homo sapiens
caggtcttgactcatggcag

SEQ ID NO: 5586917 - DNA, 19 bp, Homo sapiens
caggtcttggagctgagcc

SEQ ID NO: 5586918 - DNA, 18 bp, Homo sapiens
caggtcttgttcaagcag

SEQ ID NO: 5586919 - DNA, 15 bp, Homo sapiens
caggtcttttcaaat

SEQ ID NO: 5586920 - DNA, 21 bp, Homo sapiens
caggtgaaatccacaccagtc

SEQ ID NO: 5586921 - DNA, 18 bp, Homo sapiens
caggtgaaggaggctcca

SEQ ID NO: 5586922 - DNA, 13 bp, Homo sapiens
caggtgaataaag

SEQ ID NO: 5586923 - DNA, 12 bp, Homo sapiens
caggtgaataac

SEQ ID NO: 5586924 - DNA, 20 bp, Homo sapiens
caggtgaataataaaatcaa

SEQ ID NO: 5586925 - DNA, 13 bp, Homo sapiens
caggtgacaagcg

SEQ ID NO: 5586926 - DNA, 22 bp, Homo sapiens
caggtgacacgcttctgagcag

SEQ ID NO: 5586927 - DNA, 16 bp, Homo sapiens
caggtgacatgtgaaa

SEQ ID NO: 5586928 - DNA, 23 bp, Homo sapiens
caggtgaccaaaatccccttctc

SEQ ID NO: 5586929 - DNA, 16 bp, Homo sapiens
caggtgacctcctgca

SEQ ID NO: 5586930 - DNA, 17 bp, Homo sapiens
caggtgacctcctgcag

SEQ ID NO: 5586931 - DNA, 20 bp, Homo sapiens
caggtgacgatttagctgtg

SEQ ID NO: 5586932 - DNA, 18 bp, Homo sapiens
caggtgacggactcagac

SEQ ID NO: 5586933 - DNA, 22 bp, Homo sapiens
caggtgacttctagcagagacc

SEQ ID NO: 5586934 - DNA, 13 bp, Homo sapiens
caggtgagaaagg

SEQ ID NO: 5586935 - DNA, 15 bp, Homo sapiens
caggtgagaacccag

SEQ ID NO: 5586936 - DNA, 15 bp, Homo sapiens
caggtgagcagacag

SEQ ID NO: 5586937 - DNA, 15 bp, Homo sapiens
caggtgagcaggcag

SEQ ID NO: 5586938 - DNA, 13 bp, Homo sapiens
caggtgagccaag

SEQ ID NO: 5586939 - DNA, 20 bp, Homo sapiens
caggtgagcccatggccctc

SEQ ID NO: 5586940 - DNA, 22 bp, Homo sapiens
caggtgagctctgacccttggg

SEQ ID NO: 5586941 - DNA, 14 bp, Homo sapiens
caggtgaggcccaa

SEQ ID NO: 5586942 - DNA, 22 bp, Homo sapiens
caggtgagggaaggagacagga

SEQ ID NO: 5586943 - DNA, 18 bp, Homo sapiens
caggtgaggtcagcacat

SEQ ID NO: 5586944 - DNA, 20 bp, Homo sapiens
caggtgatccacccacctca

SEQ ID NO: 5586945 - DNA, 21 bp, Homo sapiens
caggtgatccacccacctcag

SEQ ID NO: 5586946 - DNA, 18 bp, Homo sapiens
caggtgatccacctgcct

SEQ ID NO: 5586947 - DNA, 19 bp, Homo sapiens
caggtgatccgcccacctc

SEQ ID NO: 5586948 - DNA, 23 bp, Homo sapiens
caggtgatccgcccacctcagcc

SEQ ID NO: 5586949 - DNA, 16 bp, Homo sapiens
caggtgatctgcccgc

SEQ ID NO: 5586950 - DNA, 22 bp, Homo sapiens
caggtgatctgtttgaggagag

SEQ ID NO: 5586951 - DNA, 19 bp, Homo sapiens
caggtgatgctctggcttg

SEQ ID NO: 5586952 - DNA, 14 bp, Homo sapiens
caggtgattctgat

SEQ ID NO: 5586953 - DNA, 19 bp, Homo sapiens
caggtgcaagagacagagc

SEQ ID NO: 5586954 - DNA, 22 bp, Homo sapiens
caggtgcaagagacagagcccc

SEQ ID NO: 5586955 - DNA, 23 bp, Homo sapiens
caggtgcaagagacagagccccc

SEQ ID NO: 5586956 - DNA, 20 bp, Homo sapiens
caggtgcaatctactggaaa

SEQ ID NO: 5586957 - DNA, 22 bp, Homo sapiens
caggtgcacaagctccaagctc

SEQ ID NO: 5586958 - DNA, 15 bp, Homo sapiens
caggtgcacagacgt

SEQ ID NO: 5586959 - DNA, 22 bp, Homo sapiens
caggtgcacgccaccacacctg

SEQ ID NO: 5586960 - DNA, 16 bp, Homo sapiens
caggtgcagaccttgg

SEQ ID NO: 5586961 - DNA, 12 bp, Homo sapiens
caggtgcagagg

SEQ ID NO: 5586962 - DNA, 13 bp, Homo sapiens
caggtgcagagga

SEQ ID NO: 5586963 - DNA, 19 bp, Homo sapiens
caggtgcagaggaagtaca

SEQ ID NO: 5586964 - DNA, 23 bp, Homo sapiens
caggtgcagaggtaccctgggtg

SEQ ID NO: 5586965 - DNA, 17 bp, Homo sapiens
caggtgcagatgggctg

SEQ ID NO: 5586966 - DNA, 17 bp, Homo sapiens
caggtgcagccagaggc

SEQ ID NO: 5586967 - DNA, 19 bp, Homo sapiens
caggtgcagccagaggcac

SEQ ID NO: 5586968 - DNA, 19 bp, Homo sapiens
caggtgcagccccagggcc

SEQ ID NO: 5586969 - DNA, 21 bp, Homo sapiens
caggtgcagccccagggcctg

SEQ ID NO: 5586970 - DNA, 22 bp, Homo sapiens
caggtgcagccccagggcctgc

SEQ ID NO: 5586971 - DNA, 15 bp, Homo sapiens
caggtgcagtcccag

SEQ ID NO: 5586972 - DNA, 12 bp, Homo sapiens
caggtgcagtgg

SEQ ID NO: 5586973 - DNA, 13 bp, Homo sapiens
caggtgcagtggc

SEQ ID NO: 5586974 - DNA, 15 bp, Homo sapiens
caggtgcatctgcag

SEQ ID NO: 5586975 - DNA, 19 bp, Homo sapiens
caggtgcatctgcaggcac

SEQ ID NO: 5586976 - DNA, 21 bp, Homo sapiens
caggtgcatgcatgccctctc

SEQ ID NO: 5586977 - DNA, 14 bp, Homo sapiens
caggtgccactccc

SEQ ID NO: 5586978 - DNA, 19 bp, Homo sapiens
caggtgccactccctgagc

SEQ ID NO: 5586979 - DNA, 16 bp, Homo sapiens
caggtgccactgaccg

SEQ ID NO: 5586980 - DNA, 16 bp, Homo sapiens
caggtgccagcctgag

SEQ ID NO: 5586981 - DNA, 21 bp, Homo sapiens
caggtgccagggcccacccca

SEQ ID NO: 5586982 - DNA, 22 bp, Homo sapiens
caggtgccagggcccaccccag

SEQ ID NO: 5586983 - DNA, 19 bp, Homo sapiens
caggtgccagttatggcta

SEQ ID NO: 5586984 - DNA, 20 bp, Homo sapiens
caggtgccatgcctgctccc

SEQ ID NO: 5586985 - DNA, 22 bp, Homo sapiens
caggtgccccacctccccagag

SEQ ID NO: 5586986 - DNA, 22 bp, Homo sapiens
caggtgcccctctctccatcag

SEQ ID NO: 5586987 - DNA, 14 bp, Homo sapiens
caggtgcccctctt

SEQ ID NO: 5586988 - DNA, 21 bp, Homo sapiens
caggtgcccgcgccaggccct

SEQ ID NO: 5586989 - DNA, 13 bp, Homo sapiens
caggtgccctgtg

SEQ ID NO: 5586990 - DNA, 15 bp, Homo sapiens
caggtgccgacactg

SEQ ID NO: 5586991 - DNA, 22 bp, Homo sapiens
caggtgccgacactgagctgtg

SEQ ID NO: 5586992 - DNA, 23 bp, Homo sapiens
caggtgccgccagctgccgcacc

SEQ ID NO: 5586993 - DNA, 21 bp, Homo sapiens
caggtgcctccaattggtgct

SEQ ID NO: 5586994 - DNA, 13 bp, Homo sapiens
caggtgcctccag

SEQ ID NO: 5586995 - DNA, 14 bp, Homo sapiens
caggtgcctccagg

SEQ ID NO: 5586996 - DNA, 16 bp, Homo sapiens
caggtgcctccaggtg

SEQ ID NO: 5586997 - DNA, 17 bp, Homo sapiens
caggtgcctggcttgct

SEQ ID NO: 5586998 - DNA, 20 bp, Homo sapiens
caggtgcctggcttgctgtg

SEQ ID NO: 5586999 - DNA, 16 bp, Homo sapiens
caggtgcctggggctg

SEQ ID NO: 5587000 - DNA, 21 bp, Homo sapiens
caggtgcctggggctggctgc

SEQ ID NO: 5587001 - DNA, 23 bp, Homo sapiens
caggtgcctgtccttgaaaaaca

SEQ ID NO: 5587002 - DNA, 14 bp, Homo sapiens
caggtgcctttcaa

SEQ ID NO: 5587003 - DNA, 21 bp, Homo sapiens
caggtgcctttcaaatttaga

SEQ ID NO: 5587004 - DNA, 19 bp, Homo sapiens
caggtgcgggaccatctga

SEQ ID NO: 5587005 - DNA, 16 bp, Homo sapiens
caggtgcgtgccacat

SEQ ID NO: 5587006 - DNA, 17 bp, Homo sapiens
caggtgcgtgtgtctct

SEQ ID NO: 5587007 - DNA, 20 bp, Homo sapiens
caggtgcgtgtgtctctgtc

SEQ ID NO: 5587008 - DNA, 21 bp, Homo sapiens
caggtgcgtgtgtctctgtct

SEQ ID NO: 5587009 - DNA, 16 bp, Homo sapiens
caggtgctagaagcct

SEQ ID NO: 5587010 - DNA, 22 bp, Homo sapiens
caggtgctagggtgcctgctct

SEQ ID NO: 5587011 - DNA, 23 bp, Homo sapiens
caggtgctatgtcccaagagcca

SEQ ID NO: 5587012 - DNA, 20 bp, Homo sapiens
caggtgctattgttactctt

SEQ ID NO: 5587013 - DNA, 19 bp, Homo sapiens
caggtgctcaataaatgat

SEQ ID NO: 5587014 - DNA, 22 bp, Homo sapiens
caggtgctcaatggagaatata

SEQ ID NO: 5587015 - DNA, 18 bp, Homo sapiens
caggtgctcatgctgctc

SEQ ID NO: 5587016 - DNA, 16 bp, Homo sapiens
caggtgctcattgtaa

SEQ ID NO: 5587017 - DNA, 11 bp, Homo sapiens
caggtgctgcc

SEQ ID NO: 5587018 - DNA, 13 bp, Homo sapiens
caggtgctgcctt

SEQ ID NO: 5587019 - DNA, 14 bp, Homo sapiens
caggtgctgccttg

SEQ ID NO: 5587020 - DNA, 19 bp, Homo sapiens
caggtgctgctaccctccc

SEQ ID NO: 5587021 - DNA, 20 bp, Homo sapiens
caggtgctgctaccctccct

SEQ ID NO: 5587022 - DNA, 21 bp, Homo sapiens
caggtgctgctaccctccctg

SEQ ID NO: 5587023 - DNA, 23 bp, Homo sapiens
caggtgctgctaccctccctgct

SEQ ID NO: 5587024 - DNA, 18 bp, Homo sapiens
caggtgctggagcactgg

SEQ ID NO: 5587025 - DNA, 19 bp, Homo sapiens
caggtgctggagcactggg

SEQ ID NO: 5587026 - DNA, 15 bp, Homo sapiens
caggtgctggaggca

SEQ ID NO: 5587027 - DNA, 13 bp, Homo sapiens
caggtgctggccc

SEQ ID NO: 5587028 - DNA, 16 bp, Homo sapiens
caggtgctggcccagc

SEQ ID NO: 5587029 - DNA, 18 bp, Homo sapiens
caggtgctggcccagcat

SEQ ID NO: 5587030 - DNA, 19 bp, Homo sapiens
caggtgctggcccagcatg

SEQ ID NO: 5587031 - DNA, 14 bp, Homo sapiens
caggtgctgggaat

SEQ ID NO: 5587032 - DNA, 20 bp, Homo sapiens
caggtgctgggctggactgg

SEQ ID NO: 5587033 - DNA, 13 bp, Homo sapiens
caggtgctggggc

SEQ ID NO: 5587034 - DNA, 14 bp, Homo sapiens
caggtgctgtgaca

SEQ ID NO: 5587035 - DNA, 23 bp, Homo sapiens
caggtgcttttccctatccacag

SEQ ID NO: 5587036 - DNA, 16 bp, Homo sapiens
caggtgcttttgatgt

SEQ ID NO: 5587037 - DNA, 20 bp, Homo sapiens
caggtgcttttgatgtgaaa

SEQ ID NO: 5587038 - DNA, 16 bp, Homo sapiens
caggtgcttttggcag

SEQ ID NO: 5587039 - DNA, 17 bp, Homo sapiens
caggtgcttttggcaga

SEQ ID NO: 5587040 - DNA, 20 bp, Homo sapiens
caggtgcttttggcagagac

SEQ ID NO: 5587041 - DNA, 18 bp, Homo sapiens
caggtggaaaaactgaga

SEQ ID NO: 5587042 - DNA, 16 bp, Homo sapiens
caggtggaacaggagg

SEQ ID NO: 5587043 - DNA, 17 bp, Homo sapiens
caggtggaacaggagga

SEQ ID NO: 5587044 - DNA, 15 bp, Homo sapiens
caggtggacgctgca

SEQ ID NO: 5587045 - DNA, 21 bp, Homo sapiens
caggtggacgctgcagacccc

SEQ ID NO: 5587046 - DNA, 22 bp, Homo sapiens
caggtggagagagtggtaaaaa

SEQ ID NO: 5587047 - DNA, 20 bp, Homo sapiens
caggtggagagcactagaag

SEQ ID NO: 5587048 - DNA, 11 bp, Homo sapiens
caggtggaggc

SEQ ID NO: 5587049 - DNA, 17 bp, Homo sapiens
caggtggaggcaacagg

SEQ ID NO: 5587050 - DNA, 17 bp, Homo sapiens
caggtggaggcgagcca

SEQ ID NO: 5587051 - DNA, 19 bp, Homo sapiens
caggtggaggcgagccaga

SEQ ID NO: 5587052 - DNA, 21 bp, Homo sapiens
caggtggagggcacagccctc

SEQ ID NO: 5587053 - DNA, 21 bp, Homo sapiens
caggtggagggtttgcactcc

SEQ ID NO: 5587054 - DNA, 17 bp, Homo sapiens
caggtggaggtggcatc

SEQ ID NO: 5587055 - DNA, 21 bp, Homo sapiens
caggtggaggtgtcaggctgc

SEQ ID NO: 5587056 - DNA, 18 bp, Homo sapiens
caggtggatcacgaggtc

SEQ ID NO: 5587057 - DNA, 16 bp, Homo sapiens
caggtggatcatgagg

SEQ ID NO: 5587058 - DNA, 15 bp, Homo sapiens
caggtggcacctgca

SEQ ID NO: 5587059 - DNA, 23 bp, Homo sapiens
caggtggcacttccacctccagc

SEQ ID NO: 5587060 - DNA, 15 bp, Homo sapiens
caggtggcaggacca

SEQ ID NO: 5587061 - DNA, 16 bp, Homo sapiens
caggtggcaggaccag

SEQ ID NO: 5587062 - DNA, 20 bp, Homo sapiens
caggtggcaggaccaggact

SEQ ID NO: 5587063 - DNA, 12 bp, Homo sapiens
caggtggcattt

SEQ ID NO: 5587064 - DNA, 16 bp, Homo sapiens
caggtggcatttgcag

SEQ ID NO: 5587065 - DNA, 11 bp, Homo sapiens
caggtggccac

SEQ ID NO: 5587066 - DNA, 14 bp, Homo sapiens
caggtggccacagc

SEQ ID NO: 5587067 - DNA, 21 bp, Homo sapiens
caggtggccactccagacccc

SEQ ID NO: 5587068 - DNA, 12 bp, Homo sapiens
caggtggccagg

SEQ ID NO: 5587069 - DNA, 16 bp, Homo sapiens
caggtggccagggctc

SEQ ID NO: 5587070 - DNA, 19 bp, Homo sapiens
caggtggccatgcctcagc

SEQ ID NO: 5587071 - DNA, 17 bp, Homo sapiens
caggtggccgcccctga

SEQ ID NO: 5587072 - DNA, 20 bp, Homo sapiens
caggtggccgcccctgaggc

SEQ ID NO: 5587073 - DNA, 16 bp, Homo sapiens
caggtggcctaaggct

SEQ ID NO: 5587074 - DNA, 21 bp, Homo sapiens
caggtttatattgggaagctg

SEQ ID NO: 5587075 - DNA, 14 bp, Homo sapiens
caggtttctggaca

SEQ ID NO: 5587076 - DNA, 15 bp, Homo sapiens
caggtttcttctctg

SEQ ID NO: 5587077 - DNA, 17 bp, Homo sapiens
caggtttgaattaggct

SEQ ID NO: 5587078 - DNA, 18 bp, Homo sapiens
caggtttgaccaggaaag

SEQ ID NO: 5587079 - DNA, 23 bp, Homo sapiens
caggtttgatgcctgtgaagaac

SEQ ID NO: 5587080 - DNA, 21 bp, Homo sapiens
caggtttgcacctaagtgtgt

SEQ ID NO: 5587081 - DNA, 14 bp, Homo sapiens
caggtttgccagtg

SEQ ID NO: 5587082 - DNA, 21 bp, Homo sapiens
caggtttgccagtgaagactt

SEQ ID NO: 5587083 - DNA, 15 bp, Homo sapiens
caggtttgctgtgtc

SEQ ID NO: 5587084 - DNA, 15 bp, Homo sapiens
caggtttgggacccc

SEQ ID NO: 5587085 - DNA, 15 bp, Homo sapiens
caggtttgtcctggt

SEQ ID NO: 5587086 - DNA, 16 bp, Homo sapiens
caggtttgtcctggtc

SEQ ID NO: 5587087 - DNA, 14 bp, Homo sapiens
caggttttatgaga

SEQ ID NO: 5587088 - DNA, 19 bp, Homo sapiens
caggttttcacataaatgc

SEQ ID NO: 5587089 - DNA, 21 bp, Homo sapiens
caggttttcaccatagcctac

SEQ ID NO: 5587090 - DNA, 12 bp, Homo sapiens
caggttttcctg

SEQ ID NO: 5587091 - DNA, 20 bp, Homo sapiens
caggttttcttctaatcata

SEQ ID NO: 5587092 - DNA, 18 bp, Homo sapiens
caggttttcttttaagaa

SEQ ID NO: 5587093 - DNA, 14 bp, Homo sapiens
caggttttgcactc

SEQ ID NO: 5587094 - DNA, 12 bp, Homo sapiens
caggtttttcaa

SEQ ID NO: 5587095 - DNA, 15 bp, Homo sapiens
caggtttttcaatta

SEQ ID NO: 5587096 - DNA, 16 bp, Homo sapiens
caggtttttcaattaa

SEQ ID NO: 5587097 - DNA, 17 bp, Homo sapiens
caggtttttcaattaaa

SEQ ID NO: 5587098 - DNA, 23 bp, Homo sapiens
caggtttttcaattaaacggatt

SEQ ID NO: 5587099 - DNA, 21 bp, Homo sapiens
caggtttttcatctgaaaagc

SEQ ID NO: 5587100 - DNA, 12 bp, Homo sapiens
caggtttttccc

SEQ ID NO: 5587101 - DNA, 22 bp, Homo sapiens
caggtttttgcccatcctccca

SEQ ID NO: 5587102 - DNA, 21 bp, Homo sapiens
cagtaaaaaatggtgttttat

SEQ ID NO: 5587103 - DNA, 20 bp, Homo sapiens
cagtaaaaacttgtactatg

SEQ ID NO: 5587104 - DNA, 21 bp, Homo sapiens
cagtaaaaacttgtactatgt

SEQ ID NO: 5587105 - DNA, 21 bp, Homo sapiens
cagtaaaacaattgtgacagc

SEQ ID NO: 5587106 - DNA, 18 bp, Homo sapiens
cagtaaaagccttattct

SEQ ID NO: 5587107 - DNA, 15 bp, Homo sapiens
cagtaaaagtcttct

SEQ ID NO: 5587108 - DNA, 19 bp, Homo sapiens
cagtaaaagtcttctccca

SEQ ID NO: 5587109 - DNA, 15 bp, Homo sapiens
cagtaaaataaaaaa

SEQ ID NO: 5587110 - DNA, 21 bp, Homo sapiens
cagtaaaatactattgcctca

SEQ ID NO: 5587111 - DNA, 14 bp, Homo sapiens
cagtaaaatagctg

SEQ ID NO: 5587112 - DNA, 21 bp, Homo sapiens
cagtaaaattaagtgtgtata

SEQ ID NO: 5587113 - DNA, 20 bp, Homo sapiens
cagtaaaattgccatattgc

SEQ ID NO: 5587114 - DNA, 14 bp, Homo sapiens
cagtaaaatttcag

SEQ ID NO: 5587115 - DNA, 15 bp, Homo sapiens
cagtaaacactgtgt

SEQ ID NO: 5587116 - DNA, 21 bp, Homo sapiens
cagtaaacactgtgtattgtt

SEQ ID NO: 5587117 - DNA, 17 bp, Homo sapiens
cagtaaacatttgtaaa

SEQ ID NO: 5587118 - DNA, 22 bp, Homo sapiens
cagtaaacatttgtaaaaatac

SEQ ID NO: 5587119 - DNA, 16 bp, Homo sapiens
cagtaaaccactgaaa

SEQ ID NO: 5587120 - DNA, 18 bp, Homo sapiens
cagtaaaccactgaaaaa

SEQ ID NO: 5587121 - DNA, 15 bp, Homo sapiens
cagtaaacggtgtat

SEQ ID NO: 5587122 - DNA, 19 bp, Homo sapiens
cagtaaacgtgtttgtggt

SEQ ID NO: 5587123 - DNA, 23 bp, Homo sapiens
cagtaaagaacatccctcctggg

SEQ ID NO: 5587124 - DNA, 13 bp, Homo sapiens
cagtaaagagaaa

SEQ ID NO: 5587125 - DNA, 15 bp, Homo sapiens
cagtaaagagaaact

SEQ ID NO: 5587126 - DNA, 23 bp, Homo sapiens
cagtaaagagaaactttgtgcta

SEQ ID NO: 5587127 - DNA, 14 bp, Homo sapiens
cagtaaagtttaaa

SEQ ID NO: 5587128 - DNA, 14 bp, Homo sapiens
cagtaaataaattg

SEQ ID NO: 5587129 - DNA, 23 bp, Homo sapiens
cagtaaataactggaaaacagaa

SEQ ID NO: 5587130 - DNA, 21 bp, Homo sapiens
cagtaaatacttgcagttgtg

SEQ ID NO: 5587131 - DNA, 14 bp, Homo sapiens
cagtaaatccacag

SEQ ID NO: 5587132 - DNA, 17 bp, Homo sapiens
cagtaaatccacagtga

SEQ ID NO: 5587133 - DNA, 18 bp, Homo sapiens
cagtaaatcctcatttga

SEQ ID NO: 5587134 - DNA, 19 bp, Homo sapiens
cagtaaatgaactgatttt

SEQ ID NO: 5587135 - DNA, 22 bp, Homo sapiens
cagtaaatgggggtgcatttga

SEQ ID NO: 5587136 - DNA, 17 bp, Homo sapiens
cagtaaatgttacttct

SEQ ID NO: 5587137 - DNA, 18 bp, Homo sapiens
cagtaacacatctttaat

SEQ ID NO: 5587138 - DNA, 16 bp, Homo sapiens
cagtaacatgcaacaa

SEQ ID NO: 5587139 - DNA, 19 bp, Homo sapiens
cagtaacatgcaacaaaaa

SEQ ID NO: 5587140 - DNA, 16 bp, Homo sapiens
cagtaaccaagagtta

SEQ ID NO: 5587141 - DNA, 12 bp, Homo sapiens
cagtaaccattt

SEQ ID NO: 5587142 - DNA, 14 bp, Homo sapiens
cagtaacccaaatc

SEQ ID NO: 5587143 - DNA, 20 bp, Homo sapiens
cagtaacccccttaaattta

SEQ ID NO: 5587144 - DNA, 21 bp, Homo sapiens
cagtaacccccttaaatttaa

SEQ ID NO: 5587145 - DNA, 18 bp, Homo sapiens
cagtaacgcgtcttcctg

SEQ ID NO: 5587146 - DNA, 10 bp, Homo sapiens
cagtaactgt

SEQ ID NO: 5587147 - DNA, 19 bp, Homo sapiens
cagtaactgtccctgcttt

SEQ ID NO: 5587148 - DNA, 21 bp, Homo sapiens
cagtaactgtccctgctttct

SEQ ID NO: 5587149 - DNA, 16 bp, Homo sapiens
cagtaacttggttata

SEQ ID NO: 5587150 - DNA, 18 bp, Homo sapiens
cagtaacttggttataca

SEQ ID NO: 5587151 - DNA, 19 bp, Homo sapiens
cagtaacttggttatacat

SEQ ID NO: 5587152 - DNA, 14 bp, Homo sapiens
cagtaactttatgt

SEQ ID NO: 5587153 - DNA, 17 bp, Homo sapiens
cagtaactttatgtgta

SEQ ID NO: 5587154 - DNA, 17 bp, Homo sapiens
cagtaacttttttgtgt

SEQ ID NO: 5587155 - DNA, 18 bp, Homo sapiens
cagtaacttttttgtgta

SEQ ID NO: 5587156 - DNA, 20 bp, Homo sapiens
cagtaagaagattctcgccc

SEQ ID NO: 5587157 - DNA, 22 bp, Homo sapiens
cagtaagaccggaagctcctgg

SEQ ID NO: 5587158 - DNA, 16 bp, Homo sapiens
cagtaagagtttacaa

SEQ ID NO: 5587159 - DNA, 17 bp, Homo sapiens
cagtaagagtttacaag

SEQ ID NO: 5587160 - DNA, 21 bp, Homo sapiens
cagtaagagtttacaagaaat

SEQ ID NO: 5587161 - DNA, 23 bp, Homo sapiens
cagtaagagtttacaagaaataa

SEQ ID NO: 5587162 - DNA, 21 bp, Homo sapiens
cagtaagataggttctgcttt

SEQ ID NO: 5587163 - DNA, 15 bp, Homo sapiens
cagtaagatcactgt

SEQ ID NO: 5587164 - DNA, 20 bp, Homo sapiens
cagtaagatcactgtttaga

SEQ ID NO: 5587165 - DNA, 19 bp, Homo sapiens
cagtaagctgctctattgt

SEQ ID NO: 5587166 - DNA, 20 bp, Homo sapiens
cagtaaggatttttatgtac

SEQ ID NO: 5587167 - DNA, 16 bp, Homo sapiens
cagtaaggcagctctg

SEQ ID NO: 5587168 - DNA, 15 bp, Homo sapiens
cagtaagggaaatag

SEQ ID NO: 5587169 - DNA, 22 bp, Homo sapiens
cagtaagggcgtggctctgggt

SEQ ID NO: 5587170 - DNA, 14 bp, Homo sapiens
cagtaaggtagaaa

SEQ ID NO: 5587171 - DNA, 17 bp, Homo sapiens
cagtaagtaaagtggtt

SEQ ID NO: 5587172 - DNA, 23 bp, Homo sapiens
cagtaagtataacaaactatgta

SEQ ID NO: 5587173 - DNA, 20 bp, Homo sapiens
cagtaagttatctttgaata

SEQ ID NO: 5587174 - DNA, 13 bp, Homo sapiens
cagtaagttctgt

SEQ ID NO: 5587175 - DNA, 16 bp, Homo sapiens
cagtaagttctgtggt

SEQ ID NO: 5587176 - DNA, 16 bp, Homo sapiens
cagtaataaaaagcca

SEQ ID NO: 5587177 - DNA, 19 bp, Homo sapiens
cagtaataaaaagccacca

SEQ ID NO: 5587178 - DNA, 17 bp, Homo sapiens
cagtaataaaacatctt

SEQ ID NO: 5587179 - DNA, 18 bp, Homo sapiens
cagtaataaaacatcttt

SEQ ID NO: 5587180 - DNA, 17 bp, Homo sapiens
cagtaataaatgaatgt

SEQ ID NO: 5587181 - DNA, 13 bp, Homo sapiens
cagtaataactct

SEQ ID NO: 5587182 - DNA, 12 bp, Homo sapiens
cagtaataatca

SEQ ID NO: 5587183 - DNA, 14 bp, Homo sapiens
cagtaatatgttta

SEQ ID NO: 5587184 - DNA, 20 bp, Homo sapiens
cagtaatattggcatagaaa

SEQ ID NO: 5587185 - DNA, 13 bp, Homo sapiens
cagtaatatttat

SEQ ID NO: 5587186 - DNA, 21 bp, Homo sapiens
cagtaatcagagttaccatta

SEQ ID NO: 5587187 - DNA, 16 bp, Homo sapiens
cagtaatcctggggga

SEQ ID NO: 5587188 - DNA, 12 bp, Homo sapiens
cagtaatcctgt

SEQ ID NO: 5587189 - DNA, 16 bp, Homo sapiens
cagtaatcctgtagga

SEQ ID NO: 5587190 - DNA, 16 bp, Homo sapiens
cagtaatctatgtgtt

SEQ ID NO: 5587191 - DNA, 22 bp, Homo sapiens
cagtaatctatgtgtttctgta

SEQ ID NO: 5587192 - DNA, 23 bp, Homo sapiens
cagtaatctatgtgtttctgtaa

SEQ ID NO: 5587193 - DNA, 18 bp, Homo sapiens
cagtaatgctgcaggaaa

SEQ ID NO: 5587194 - DNA, 20 bp, Homo sapiens
cagtaatgctgcaggaaaag

SEQ ID NO: 5587195 - DNA, 12 bp, Homo sapiens
cagtaatgtaga

SEQ ID NO: 5587196 - DNA, 16 bp, Homo sapiens
cagtaatgtagaaatg

SEQ ID NO: 5587197 - DNA, 18 bp, Homo sapiens
cagtaatgtcataaagtg

SEQ ID NO: 5587198 - DNA, 20 bp, Homo sapiens
cagtaattaatatctcctgg

SEQ ID NO: 5587199 - DNA, 22 bp, Homo sapiens
cagtaattaatatctcctggaa

SEQ ID NO: 5587200 - DNA, 13 bp, Homo sapiens
cagtaattattat

SEQ ID NO: 5587201 - DNA, 14 bp, Homo sapiens
cagtaattcaactg

SEQ ID NO: 5587202 - DNA, 23 bp, Homo sapiens
cagtaattcaactggaaattaaa

SEQ ID NO: 5587203 - DNA, 18 bp, Homo sapiens
cagtaattcgtttgctag

SEQ ID NO: 5587204 - DNA, 11 bp, Homo sapiens
cagtaatttat

SEQ ID NO: 5587205 - DNA, 21 bp, Homo sapiens
cagtacaacccataatcatgt

SEQ ID NO: 5587206 - DNA, 15 bp, Homo sapiens
cagtacaatcagcag

SEQ ID NO: 5587207 - DNA, 21 bp, Homo sapiens
cagtacaatgtgactttgaaa

SEQ ID NO: 5587208 - DNA, 20 bp, Homo sapiens
cagtacaattctttgttgct

SEQ ID NO: 5587209 - DNA, 16 bp, Homo sapiens
cagtacacttcctgtg

SEQ ID NO: 5587210 - DNA, 22 bp, Homo sapiens
cagtacagagaaattctgtggt

SEQ ID NO: 5587211 - DNA, 12 bp, Homo sapiens
cagtacaggcag

SEQ ID NO: 5587212 - DNA, 19 bp, Homo sapiens
cagtacaggcagcacagag

SEQ ID NO: 5587213 - DNA, 14 bp, Homo sapiens
cagtacagggcagg

SEQ ID NO: 5587214 - DNA, 16 bp, Homo sapiens
cagtacagtatttaca

SEQ ID NO: 5587215 - DNA, 17 bp, Homo sapiens
cagtacagtggttctac

SEQ ID NO: 5587216 - DNA, 18 bp, Homo sapiens
cagtacatacgtctgcca

SEQ ID NO: 5587217 - DNA, 13 bp, Homo sapiens
cagtacatatgta

SEQ ID NO: 5587218 - DNA, 17 bp, Homo sapiens
cagtacatatgtaattc

SEQ ID NO: 5587219 - DNA, 16 bp, Homo sapiens
cagtacatcttgtgca

SEQ ID NO: 5587220 - DNA, 18 bp, Homo sapiens
cagtacatcttgtgcatg

SEQ ID NO: 5587221 - DNA, 20 bp, Homo sapiens
cagtacatcttgtgcatgca

SEQ ID NO: 5587222 - DNA, 22 bp, Homo sapiens
cagtacatgacccggatgaact

SEQ ID NO: 5587223 - DNA, 22 bp, Homo sapiens
cagtacatgggtgactatctcc

SEQ ID NO: 5587224 - DNA, 12 bp, Homo sapiens
cagtacatttaa

SEQ ID NO: 5587225 - DNA, 17 bp, Homo sapiens
cagtacatttaaatttt

SEQ ID NO: 5587226 - DNA, 14 bp, Homo sapiens
cagtaccaaatttc

SEQ ID NO: 5587227 - DNA, 16 bp, Homo sapiens
cagtaccatcccactg

SEQ ID NO: 5587228 - DNA, 23 bp, Homo sapiens
cagtaccatttaatggggaggac

SEQ ID NO: 5587229 - DNA, 17 bp, Homo sapiens
cagtacccacctgagct

SEQ ID NO: 5587230 - DNA, 19 bp, Homo sapiens
cagtacccgactgtttatt

SEQ ID NO: 5587231 - DNA, 14 bp, Homo sapiens
cagtaccctaccct

SEQ ID NO: 5587232 - DNA, 15 bp, Homo sapiens
cagtaccctctcagc

SEQ ID NO: 5587233 - DNA, 19 bp, Homo sapiens
cagtaccctctcagctcca

SEQ ID NO: 5587234 - DNA, 15 bp, Homo sapiens
cagtacccttggcct

SEQ ID NO: 5587235 - DNA, 20 bp, Homo sapiens
cagtacctataaagtaaagc

SEQ ID NO: 5587236 - DNA, 18 bp, Homo sapiens
cagtacctatgacttttt

SEQ ID NO: 5587237 - DNA, 13 bp, Homo sapiens
cagtacctccaag

SEQ ID NO: 5587238 - DNA, 23 bp, Homo sapiens
cagtacctcccctccccgccccc

SEQ ID NO: 5587239 - DNA, 20 bp, Homo sapiens
cagtacctcctgtctctggc

SEQ ID NO: 5587240 - DNA, 18 bp, Homo sapiens
cagtacctcgtttctaca

SEQ ID NO: 5587241 - DNA, 13 bp, Homo sapiens
cagtacctctcaa

SEQ ID NO: 5587242 - DNA, 21 bp, Homo sapiens
cagtacctctgtatagaaatc

SEQ ID NO: 5587243 - DNA, 22 bp, Homo sapiens
cagtacctgagggtctgtaggt

SEQ ID NO: 5587244 - DNA, 13 bp, Homo sapiens
cagtacctggagg

SEQ ID NO: 5587245 - DNA, 14 bp, Homo sapiens
cagtacctggagga

SEQ ID NO: 5587246 - DNA, 14 bp, Homo sapiens
cagtacctgggaaa

SEQ ID NO: 5587247 - DNA, 21 bp, Homo sapiens
cagtacctgggaaaggaccca

SEQ ID NO: 5587248 - DNA, 22 bp, Homo sapiens
cagtacctgggaaaggacccac

SEQ ID NO: 5587249 - DNA, 23 bp, Homo sapiens
cagtacctgggaaaggacccacc

SEQ ID NO: 5587250 - DNA, 23 bp, Homo sapiens
cagtaccttaggttctttctgaa

SEQ ID NO: 5587251 - DNA, 21 bp, Homo sapiens
cagtatgtgatggactgggga

SEQ ID NO: 5587252 - DNA, 15 bp, Homo sapiens
cagtatgtgggatat

SEQ ID NO: 5587253 - DNA, 19 bp, Homo sapiens
cagtatgtgggatattgaa

SEQ ID NO: 5587254 - DNA, 18 bp, Homo sapiens
cagtatgtgggggcttca

SEQ ID NO: 5587255 - DNA, 19 bp, Homo sapiens
cagtatgtgggggcttcat

SEQ ID NO: 5587256 - DNA, 23 bp, Homo sapiens
cagtatgtgggggcttcatctct

SEQ ID NO: 5587257 - DNA, 12 bp, Homo sapiens
cagtatgtgtct

SEQ ID NO: 5587258 - DNA, 23 bp, Homo sapiens
cagtatgttccaaaccctcctgg

SEQ ID NO: 5587259 - DNA, 16 bp, Homo sapiens
cagtatgttttacact

SEQ ID NO: 5587260 - DNA, 18 bp, Homo sapiens
cagtatgttttacactgt

SEQ ID NO: 5587261 - DNA, 18 bp, Homo sapiens
cagtatgtttttacataa

SEQ ID NO: 5587262 - DNA, 18 bp, Homo sapiens
cagtattaaactctcctt

SEQ ID NO: 5587263 - DNA, 23 bp, Homo sapiens
cagtattaaattagatatcttca

SEQ ID NO: 5587264 - DNA, 14 bp, Homo sapiens
cagtattaacacta

SEQ ID NO: 5587265 - DNA, 22 bp, Homo sapiens
cagtattaatactaaaatatgt

SEQ ID NO: 5587266 - DNA, 18 bp, Homo sapiens
cagtattacttctgctac

SEQ ID NO: 5587267 - DNA, 19 bp, Homo sapiens
cagtattacttctgctaca

SEQ ID NO: 5587268 - DNA, 22 bp, Homo sapiens
cagtattactttctgccgctgt

SEQ ID NO: 5587269 - DNA, 15 bp, Homo sapiens
cagtattatatgtac

SEQ ID NO: 5587270 - DNA, 15 bp, Homo sapiens
cagtattatctaaat

SEQ ID NO: 5587271 - DNA, 20 bp, Homo sapiens
cagtattatctaaatgaatg

SEQ ID NO: 5587272 - DNA, 14 bp, Homo sapiens
cagtattatctgtg

SEQ ID NO: 5587273 - DNA, 16 bp, Homo sapiens
cagtattatctgtgtt

SEQ ID NO: 5587274 - DNA, 14 bp, Homo sapiens
cagtattcccactc

SEQ ID NO: 5587275 - DNA, 20 bp, Homo sapiens
cagtattccctttttaaatg

SEQ ID NO: 5587276 - DNA, 17 bp, Homo sapiens
cagtattctaaagtttt

SEQ ID NO: 5587277 - DNA, 21 bp, Homo sapiens
cagtattctaggtagtgccct

SEQ ID NO: 5587278 - DNA, 14 bp, Homo sapiens
cagtattctcagag

SEQ ID NO: 5587279 - DNA, 12 bp, Homo sapiens
cagtattctgcc

SEQ ID NO: 5587280 - DNA, 14 bp, Homo sapiens
cagtattctgtagc

SEQ ID NO: 5587281 - DNA, 17 bp, Homo sapiens
cagtattctgtagccaa

SEQ ID NO: 5587282 - DNA, 12 bp, Homo sapiens
cagtattgaaaa

SEQ ID NO: 5587283 - DNA, 12 bp, Homo sapiens
cagtattgaagc

SEQ ID NO: 5587284 - DNA, 20 bp, Homo sapiens
cagtattgaagcattttata

SEQ ID NO: 5587285 - DNA, 21 bp, Homo sapiens
cagtattgaagcattttataa

SEQ ID NO: 5587286 - DNA, 19 bp, Homo sapiens
cagtattgacaataagaaa

SEQ ID NO: 5587287 - DNA, 21 bp, Homo sapiens
cagtattgacgacctacatct

SEQ ID NO: 5587288 - DNA, 23 bp, Homo sapiens
cagtattgacgacctacatctga

SEQ ID NO: 5587289 - DNA, 16 bp, Homo sapiens
cagtattgagtgttct

SEQ ID NO: 5587290 - DNA, 17 bp, Homo sapiens
cagtattgccccctctc

SEQ ID NO: 5587291 - DNA, 20 bp, Homo sapiens
cagtattgccccctctcact

SEQ ID NO: 5587292 - DNA, 21 bp, Homo sapiens
cagtattgctcacccagtgcc

SEQ ID NO: 5587293 - DNA, 13 bp, Homo sapiens
cagtattgctgat

SEQ ID NO: 5587294 - DNA, 15 bp, Homo sapiens
cagtattgggcagga

SEQ ID NO: 5587295 - DNA, 16 bp, Homo sapiens
cagtattgggcaggag

SEQ ID NO: 5587296 - DNA, 16 bp, Homo sapiens
cagtattgtacaaagt

SEQ ID NO: 5587297 - DNA, 17 bp, Homo sapiens
cagtattgtagaaagct

SEQ ID NO: 5587298 - DNA, 15 bp, Homo sapiens
cagtattgtgtaaag

SEQ ID NO: 5587299 - DNA, 18 bp, Homo sapiens
cagtattgtgtaaaggaa

SEQ ID NO: 5587300 - DNA, 13 bp, Homo sapiens
cagtattgttctt

SEQ ID NO: 5587301 - DNA, 13 bp, Homo sapiens
cagtatttaacat

SEQ ID NO: 5587302 - DNA, 20 bp, Homo sapiens
cagtatttaatgaaacccta

SEQ ID NO: 5587303 - DNA, 22 bp, Homo sapiens
cagtatttacaagctatttttg

SEQ ID NO: 5587304 - DNA, 13 bp, Homo sapiens
cagtatttactct

SEQ ID NO: 5587305 - DNA, 19 bp, Homo sapiens
cagtatttattttgtaatt

SEQ ID NO: 5587306 - DNA, 22 bp, Homo sapiens
cagtatttattttgtaattatg

SEQ ID NO: 5587307 - DNA, 16 bp, Homo sapiens
cagtatttcaactgct

SEQ ID NO: 5587308 - DNA, 15 bp, Homo sapiens
cagtatttcatttct

SEQ ID NO: 5587309 - DNA, 13 bp, Homo sapiens
cagtatttccttc

SEQ ID NO: 5587310 - DNA, 14 bp, Homo sapiens
cagtatttccttcc

SEQ ID NO: 5587311 - DNA, 17 bp, Homo sapiens
cagtatttccttccact

SEQ ID NO: 5587312 - DNA, 19 bp, Homo sapiens
cagtatttccttccactgt

SEQ ID NO: 5587313 - DNA, 20 bp, Homo sapiens
cagtatttctacattacagc

SEQ ID NO: 5587314 - DNA, 21 bp, Homo sapiens
cagtatttctcttttattctg

SEQ ID NO: 5587315 - DNA, 13 bp, Homo sapiens
cagtatttgtaat

SEQ ID NO: 5587316 - DNA, 18 bp, Homo sapiens
cagtatttgtaattaaaa

SEQ ID NO: 5587317 - DNA, 23 bp, Homo sapiens
cagtatttgtaattaaaagcaaa

SEQ ID NO: 5587318 - DNA, 15 bp, Homo sapiens
cagtatttgtgggga

SEQ ID NO: 5587319 - DNA, 22 bp, Homo sapiens
cagtattttaaatgaagtgatt

SEQ ID NO: 5587320 - DNA, 13 bp, Homo sapiens
cagtattttagtg

SEQ ID NO: 5587321 - DNA, 23 bp, Homo sapiens
cagtattttagtggaccctgaaa

SEQ ID NO: 5587322 - DNA, 17 bp, Homo sapiens
cagtattttattaaagc

SEQ ID NO: 5587323 - DNA, 11 bp, Homo sapiens
cagtattttcc

SEQ ID NO: 5587324 - DNA, 18 bp, Homo sapiens
cagtattttccagcctta

SEQ ID NO: 5587325 - DNA, 15 bp, Homo sapiens
cagtattttctgttt

SEQ ID NO: 5587326 - DNA, 23 bp, Homo sapiens
cagtattttctgtttttatgttt

SEQ ID NO: 5587327 - DNA, 18 bp, Homo sapiens
cagtattttggagaaatt

SEQ ID NO: 5587328 - DNA, 23 bp, Homo sapiens
cagtattttggagaaattattta

SEQ ID NO: 5587329 - DNA, 16 bp, Homo sapiens
cagtattttgtgtcct

SEQ ID NO: 5587330 - DNA, 17 bp, Homo sapiens
cagtattttgtgtcctc

SEQ ID NO: 5587331 - DNA, 14 bp, Homo sapiens
cagtatttttgctg

SEQ ID NO: 5587332 - DNA, 20 bp, Homo sapiens
cagtatttttttttaatttt

SEQ ID NO: 5587333 - DNA, 22 bp, Homo sapiens
cagtcaaacaagttgtgccttt

SEQ ID NO: 5587334 - DNA, 19 bp, Homo sapiens
cagtcaaagacgctgagtg

SEQ ID NO: 5587335 - DNA, 20 bp, Homo sapiens
cagtcaaagcggatgctggc

SEQ ID NO: 5587336 - DNA, 18 bp, Homo sapiens
cagtcaaatttacattta

SEQ ID NO: 5587337 - DNA, 16 bp, Homo sapiens
cagtcaacaaactatt

SEQ ID NO: 5587338 - DNA, 21 bp, Homo sapiens
cagtcaacagattcagaatga

SEQ ID NO: 5587339 - DNA, 15 bp, Homo sapiens
cagtcaacagttcaa

SEQ ID NO: 5587340 - DNA, 20 bp, Homo sapiens
cagtcaacagttcaaagaag

SEQ ID NO: 5587341 - DNA, 14 bp, Homo sapiens
cagtcaacctgggc

SEQ ID NO: 5587342 - DNA, 19 bp, Homo sapiens
cagtcaacggggggctcct

SEQ ID NO: 5587343 - DNA, 22 bp, Homo sapiens
cagtcaacggggggctcctgcc

SEQ ID NO: 5587344 - DNA, 14 bp, Homo sapiens
cagtcaagaagaaa

SEQ ID NO: 5587345 - DNA, 15 bp, Homo sapiens
cagtcaagcagaaaa

SEQ ID NO: 5587346 - DNA, 14 bp, Homo sapiens
cagtcaagctccta

SEQ ID NO: 5587347 - DNA, 16 bp, Homo sapiens
cagtcaagctcctagt

SEQ ID NO: 5587348 - DNA, 15 bp, Homo sapiens
cagtcaattaacaat

SEQ ID NO: 5587349 - DNA, 20 bp, Homo sapiens
cagtcaattgcttgagcatg

SEQ ID NO: 5587350 - DNA, 22 bp, Homo sapiens
cagtcacaaaccagcctggggc

SEQ ID NO: 5587351 - DNA, 23 bp, Homo sapiens
cagtcacaaaccagcctggggcc

SEQ ID NO: 5587352 - DNA, 19 bp, Homo sapiens
cagtcacaacagagtgaaa

SEQ ID NO: 5587353 - DNA, 22 bp, Homo sapiens
cagtcacaacagagtgaaaaat

SEQ ID NO: 5587354 - DNA, 23 bp, Homo sapiens
cagtcacacatcagctcaaaatt

SEQ ID NO: 5587355 - DNA, 20 bp, Homo sapiens
cagtcacactgtggccagta

SEQ ID NO: 5587356 - DNA, 22 bp, Homo sapiens
cagtcacactgttactccacag

SEQ ID NO: 5587357 - DNA, 15 bp, Homo sapiens
cagtcacaggcccag

SEQ ID NO: 5587358 - DNA, 16 bp, Homo sapiens
cagtcacatcacaata

SEQ ID NO: 5587359 - DNA, 16 bp, Homo sapiens
cagtcaccaagtgtat

SEQ ID NO: 5587360 - DNA, 14 bp, Homo sapiens
cagtcaccacccag

SEQ ID NO: 5587361 - DNA, 13 bp, Homo sapiens
cagtcacccccac

SEQ ID NO: 5587362 - DNA, 16 bp, Homo sapiens
cagtcacccccacttc

SEQ ID NO: 5587363 - DNA, 21 bp, Homo sapiens
cagtcacccccacttcccact

SEQ ID NO: 5587364 - DNA, 16 bp, Homo sapiens
cagtcaccccggccac

SEQ ID NO: 5587365 - DNA, 21 bp, Homo sapiens
cagtcacccctccctccctct

SEQ ID NO: 5587366 - DNA, 14 bp, Homo sapiens
cagtcacccctgtc

SEQ ID NO: 5587367 - DNA, 17 bp, Homo sapiens
cagtcaccctgtggcaa

SEQ ID NO: 5587368 - DNA, 15 bp, Homo sapiens
cagtcacccttctgg

SEQ ID NO: 5587369 - DNA, 17 bp, Homo sapiens
cagtcacctaagcaatc

SEQ ID NO: 5587370 - DNA, 16 bp, Homo sapiens
cagtcacctcatggaa

SEQ ID NO: 5587371 - DNA, 12 bp, Homo sapiens
cagtcacctccc

SEQ ID NO: 5587372 - DNA, 16 bp, Homo sapiens
cagtcaccttctgggc

SEQ ID NO: 5587373 - DNA, 23 bp, Homo sapiens
cagtcacgtgaggcccctgtgca

SEQ ID NO: 5587374 - DNA, 24 bp, Homo sapiens
cagtcactctagtcaatgacatga

SEQ ID NO: 5587375 - DNA, 17 bp, Homo sapiens
cagtcactgaattccat

SEQ ID NO: 5587376 - DNA, 15 bp, Homo sapiens
cagtcactgcatttg

SEQ ID NO: 5587377 - DNA, 21 bp, Homo sapiens
cagtcactgcatttgcctgct

SEQ ID NO: 5587378 - DNA, 23 bp, Homo sapiens
cagtcactgcatttgcctgcttc

SEQ ID NO: 5587379 - DNA, 18 bp, Homo sapiens
cagtcactgccactttgc

SEQ ID NO: 5587380 - DNA, 14 bp, Homo sapiens
cagtcactggaggt

SEQ ID NO: 5587381 - DNA, 18 bp, Homo sapiens
cagtcactgggagaggtt

SEQ ID NO: 5587382 - DNA, 22 bp, Homo sapiens
cagtcactgtccctcaaatgac

SEQ ID NO: 5587383 - DNA, 22 bp, Homo sapiens
cagtcacttcggccagagctga

SEQ ID NO: 5587384 - DNA, 23 bp, Homo sapiens
cagtcacttcggccagagctgaa

SEQ ID NO: 5587385 - DNA, 21 bp, Homo sapiens
cagtcacttgggagctgctgg

SEQ ID NO: 5587386 - DNA, 23 bp, Homo sapiens
cagtcactttttcccctgcaatg

SEQ ID NO: 5587387 - DNA, 16 bp, Homo sapiens
cagtcagaaggacggc

SEQ ID NO: 5587388 - DNA, 19 bp, Homo sapiens
cagtcagacgccaggcacc

SEQ ID NO: 5587389 - DNA, 17 bp, Homo sapiens
cagtcagatttccagtc

SEQ ID NO: 5587390 - DNA, 15 bp, Homo sapiens
cagtcagatttttaa

SEQ ID NO: 5587391 - DNA, 22 bp, Homo sapiens
cagtcagatttttaaagttttg

SEQ ID NO: 5587392 - DNA, 13 bp, Homo sapiens
cagtcagcacaga

SEQ ID NO: 5587393 - DNA, 19 bp, Homo sapiens
cagtcagcatgcttcccag

SEQ ID NO: 5587394 - DNA, 20 bp, Homo sapiens
cagtcagcatgcttcccaga

SEQ ID NO: 5587395 - DNA, 22 bp, Homo sapiens
cagtcagcatgcttcccagagg

SEQ ID NO: 5587396 - DNA, 12 bp, Homo sapiens
cagtcagccagc

SEQ ID NO: 5587397 - DNA, 15 bp, Homo sapiens
cagtcagccagcttg

SEQ ID NO: 5587398 - DNA, 12 bp, Homo sapiens
cagtcagcccag

SEQ ID NO: 5587399 - DNA, 14 bp, Homo sapiens
cagtcagcccagtg

SEQ ID NO: 5587400 - DNA, 22 bp, Homo sapiens
cagtcagccctgattgtgccag

SEQ ID NO: 5587401 - DNA, 18 bp, Homo sapiens
cagtcagcctctctccca

SEQ ID NO: 5587402 - DNA, 16 bp, Homo sapiens
cagtcagcctggctgg

SEQ ID NO: 5587403 - DNA, 19 bp, Homo sapiens
cagtcagcctggctgggct

SEQ ID NO: 5587404 - DNA, 22 bp, Homo sapiens
cagtcagctcttcatctgccca

SEQ ID NO: 5587405 - DNA, 22 bp, Homo sapiens
cagtcaggaaagagaacttcca

SEQ ID NO: 5587406 - DNA, 21 bp, Homo sapiens
cagtcaggaagcctcctgctg

SEQ ID NO: 5587407 - DNA, 16 bp, Homo sapiens
cagtcaggctctctgg

SEQ ID NO: 5587408 - DNA, 13 bp, Homo sapiens
cagtcagggacag

SEQ ID NO: 5587409 - DNA, 15 bp, Homo sapiens
cagtcagggacagca

SEQ ID NO: 5587410 - DNA, 16 bp, Homo sapiens
cagtcagggacagcag

SEQ ID NO: 5587411 - DNA, 16 bp, Homo sapiens
cagtcagggcccagag

SEQ ID NO: 5587412 - DNA, 13 bp, Homo sapiens
cagtcagggcggg

SEQ ID NO: 5587413 - DNA, 19 bp, Homo sapiens
cagtcagggcggggctggc

SEQ ID NO: 5587414 - DNA, 20 bp, Homo sapiens
cagtcagggcggggctggcc

SEQ ID NO: 5587415 - DNA, 23 bp, Homo sapiens
cagtcagggcggggctggccagc

SEQ ID NO: 5587416 - DNA, 12 bp, Homo sapiens
cagtcaggggca

SEQ ID NO: 5587417 - DNA, 12 bp, Homo sapiens
cagtcaggggcc

SEQ ID NO: 5587418 - DNA, 23 bp, Homo sapiens
cagtcaggggctgggcatcccag

SEQ ID NO: 5587419 - DNA, 22 bp, Homo sapiens
cagtcagggtttgtcagaggaa

SEQ ID NO: 5587420 - DNA, 15 bp, Homo sapiens
cagtcaggttgaaga

SEQ ID NO: 5587421 - DNA, 17 bp, Homo sapiens
cagtcagtgcaaatgtc

SEQ ID NO: 5587422 - DNA, 15 bp, Homo sapiens
cagtcagttcccgga

SEQ ID NO: 5587423 - DNA, 19 bp, Homo sapiens
cagtcagttcccggagcac

SEQ ID NO: 5587424 - DNA, 20 bp, Homo sapiens
cagtcagttcccggagcaca

SEQ ID NO: 5587425 - DNA, 21 bp, Homo sapiens
cagtcagttcccggagcacag

SEQ ID NO: 5587426 - DNA, 16 bp, Homo sapiens
cagtcagttttgctcc

SEQ ID NO: 5587427 - DNA, 19 bp, Homo sapiens
cagtctggaggtcccagac

SEQ ID NO: 5587428 - DNA, 23 bp, Homo sapiens
cagtctggaggtcccagacatgc

SEQ ID NO: 5587429 - DNA, 12 bp, Homo sapiens
cagtctggccac

SEQ ID NO: 5587430 - DNA, 17 bp, Homo sapiens
cagtctggccactgtca

SEQ ID NO: 5587431 - DNA, 20 bp, Homo sapiens
cagtctgggtaacagggaga

SEQ ID NO: 5587432 - DNA, 17 bp, Homo sapiens
cagtctgtaaaatacat

SEQ ID NO: 5587433 - DNA, 20 bp, Homo sapiens
cagtctgtaaaatacatgta

SEQ ID NO: 5587434 - DNA, 23 bp, Homo sapiens
cagtctgtagggagtgaagccac

SEQ ID NO: 5587435 - DNA, 17 bp, Homo sapiens
cagtctgtcacccaggc

SEQ ID NO: 5587436 - DNA, 23 bp, Homo sapiens
cagtctgtcatgaacatgttcct

SEQ ID NO: 5587437 - DNA, 24 bp, Homo sapiens
cagtctgtcatgaacatgttcctg

SEQ ID NO: 5587438 - DNA, 15 bp, Homo sapiens
cagtctgtccacgtg

SEQ ID NO: 5587439 - DNA, 18 bp, Homo sapiens
cagtctgtctactgtggt

SEQ ID NO: 5587440 - DNA, 11 bp, Homo sapiens
cagtctgtctt

SEQ ID NO: 5587441 - DNA, 17 bp, Homo sapiens
cagtctgtcttctgtat

SEQ ID NO: 5587442 - DNA, 22 bp, Homo sapiens
cagtctgtcttctgtatataaa

SEQ ID NO: 5587443 - DNA, 15 bp, Homo sapiens
cagtctgttcactgc

SEQ ID NO: 5587444 - DNA, 21 bp, Homo sapiens
cagtctgttcactgcattcac

SEQ ID NO: 5587445 - DNA, 21 bp, Homo sapiens
cagtctgttccccatggccac

SEQ ID NO: 5587446 - DNA, 12 bp, Homo sapiens
cagtctgttctc

SEQ ID NO: 5587447 - DNA, 19 bp, Homo sapiens
cagtcttaatattcagaga

SEQ ID NO: 5587448 - DNA, 16 bp, Homo sapiens
cagtcttaccaatgac

SEQ ID NO: 5587449 - DNA, 22 bp, Homo sapiens
cagtcttagatcatagttttat

SEQ ID NO: 5587450 - DNA, 17 bp, Homo sapiens
cagtcttatgcttccag

SEQ ID NO: 5587451 - DNA, 15 bp, Homo sapiens
cagtcttcacttgca

SEQ ID NO: 5587452 - DNA, 22 bp, Homo sapiens
cagtcttcacttgcactggggg

SEQ ID NO: 5587453 - DNA, 19 bp, Homo sapiens
cagtcttccacaaagaaaa

SEQ ID NO: 5587454 - DNA, 16 bp, Homo sapiens
cagtcttccacctgga

SEQ ID NO: 5587455 - DNA, 17 bp, Homo sapiens
cagtcttccacctggaa

SEQ ID NO: 5587456 - DNA, 19 bp, Homo sapiens
cagtcttccacctggaagc

SEQ ID NO: 5587457 - DNA, 13 bp, Homo sapiens
cagtcttcctctt

SEQ ID NO: 5587458 - DNA, 20 bp, Homo sapiens
cagtcttcctcttagcctct

SEQ ID NO: 5587459 - DNA, 23 bp, Homo sapiens
cagtcttcctcttagcctctgga

SEQ ID NO: 5587460 - DNA, 16 bp, Homo sapiens
cagtcttcctgacact

SEQ ID NO: 5587461 - DNA, 19 bp, Homo sapiens
cagtcttctctctggctca

SEQ ID NO: 5587462 - DNA, 13 bp, Homo sapiens
cagtcttctggat

SEQ ID NO: 5587463 - DNA, 17 bp, Homo sapiens
cagtcttcttcacccgc

SEQ ID NO: 5587464 - DNA, 23 bp, Homo sapiens
cagtcttgaatttctaaaaaaca

SEQ ID NO: 5587465 - DNA, 15 bp, Homo sapiens
cagtcttgcaacagt

SEQ ID NO: 5587466 - DNA, 14 bp, Homo sapiens
cagtcttgcagcag

SEQ ID NO: 5587467 - DNA, 13 bp, Homo sapiens
cagtcttgcctag

SEQ ID NO: 5587468 - DNA, 18 bp, Homo sapiens
cagtcttgcctaggccaa

SEQ ID NO: 5587469 - DNA, 16 bp, Homo sapiens
cagtcttgtactgtga

SEQ ID NO: 5587470 - DNA, 13 bp, Homo sapiens
cagtcttgtgaac

SEQ ID NO: 5587471 - DNA, 18 bp, Homo sapiens
cagtctttaaaggcccag

SEQ ID NO: 5587472 - DNA, 23 bp, Homo sapiens
cagtctttaaaggcccagcccct

SEQ ID NO: 5587473 - DNA, 13 bp, Homo sapiens
cagtctttaagat

SEQ ID NO: 5587474 - DNA, 19 bp, Homo sapiens
cagtctttatttttttccc

SEQ ID NO: 5587475 - DNA, 20 bp, Homo sapiens
cagtctttatttttttccca

SEQ ID NO: 5587476 - DNA, 20 bp, Homo sapiens
cagtctttcaactcattgca

SEQ ID NO: 5587477 - DNA, 13 bp, Homo sapiens
cagtctttccccc

SEQ ID NO: 5587478 - DNA, 18 bp, Homo sapiens
cagtctttggagagctca

SEQ ID NO: 5587479 - DNA, 20 bp, Homo sapiens
cagtctttgggggattcaaa

SEQ ID NO: 5587480 - DNA, 21 bp, Homo sapiens
cagtctttgggggattcaaat

SEQ ID NO: 5587481 - DNA, 15 bp, Homo sapiens
cagtcttttcctacg

SEQ ID NO: 5587482 - DNA, 12 bp, Homo sapiens
cagtcttttgtc

SEQ ID NO: 5587483 - DNA, 12 bp, Homo sapiens
cagtctttttct

SEQ ID NO: 5587484 - DNA, 21 bp, Homo sapiens
cagtctttttctgttgtaact

SEQ ID NO: 5587485 - DNA, 15 bp, Homo sapiens
cagtgaaaaacatta

SEQ ID NO: 5587486 - DNA, 14 bp, Homo sapiens
cagtgaaaaactat

SEQ ID NO: 5587487 - DNA, 13 bp, Homo sapiens
cagtgaaaaagat

SEQ ID NO: 5587488 - DNA, 20 bp, Homo sapiens
cagtgaaaacaagtgctggc

SEQ ID NO: 5587489 - DNA, 13 bp, Homo sapiens
cagtgaaaactag

SEQ ID NO: 5587490 - DNA, 18 bp, Homo sapiens
cagtgaaaatgtaagctg

SEQ ID NO: 5587491 - DNA, 13 bp, Homo sapiens
cagtgaaagaagc

SEQ ID NO: 5587492 - DNA, 13 bp, Homo sapiens
cagtgaaagcatc

SEQ ID NO: 5587493 - DNA, 14 bp, Homo sapiens
cagtgaaagcatca

SEQ ID NO: 5587494 - DNA, 21 bp, Homo sapiens
cagtgaaaggcctgcttttgt

SEQ ID NO: 5587495 - DNA, 22 bp, Homo sapiens
cagtgaaagtcaattcagtgat

SEQ ID NO: 5587496 - DNA, 15 bp, Homo sapiens
cagtgaaatgtgaag

SEQ ID NO: 5587497 - DNA, 15 bp, Homo sapiens
cagtgaacacatttt

SEQ ID NO: 5587498 - DNA, 20 bp, Homo sapiens
cagtgaacataactgtaaca

SEQ ID NO: 5587499 - DNA, 15 bp, Homo sapiens
cagtgaacattccca

SEQ ID NO: 5587500 - DNA, 20 bp, Homo sapiens
cagtgaacattcccagccca

SEQ ID NO: 5587501 - DNA, 21 bp, Homo sapiens
cagtgaactatttttaaggtc

SEQ ID NO: 5587502 - DNA, 22 bp, Homo sapiens
cagtgaactatttttaaggtct

SEQ ID NO: 5587503 - DNA, 14 bp, Homo sapiens
cagtgaactcctgc

SEQ ID NO: 5587504 - DNA, 15 bp, Homo sapiens
cagtgaactcctgcc

SEQ ID NO: 5587505 - DNA, 14 bp, Homo sapiens
cagtgaactgagac

SEQ ID NO: 5587506 - DNA, 17 bp, Homo sapiens
cagtgaacttgtctggc

SEQ ID NO: 5587507 - DNA, 20 bp, Homo sapiens
cagtgaagacgtcaggggca

SEQ ID NO: 5587508 - DNA, 20 bp, Homo sapiens
cagtgaagatattttatttc

SEQ ID NO: 5587509 - DNA, 13 bp, Homo sapiens
cagtgaagatgca

SEQ ID NO: 5587510 - DNA, 15 bp, Homo sapiens
cagtgaagatgcagg

SEQ ID NO: 5587511 - DNA, 16 bp, Homo sapiens
cagtgaagatgctgta

SEQ ID NO: 5587512 - DNA, 18 bp, Homo sapiens
cagtgaagatgtgtaaat

SEQ ID NO: 5587513 - DNA, 19 bp, Homo sapiens
cagtgaagatgtgtaaata

SEQ ID NO: 5587514 - DNA, 20 bp, Homo sapiens
cagtgaagatgtgtaaataa

SEQ ID NO: 5587515 - DNA, 22 bp, Homo sapiens
cagtgaagatgtgtaaataagc

SEQ ID NO: 5587516 - DNA, 16 bp, Homo sapiens
cagtgaagatttacct

SEQ ID NO: 5587517 - DNA, 22 bp, Homo sapiens
cagtgaagcaatttcagtttta

SEQ ID NO: 5587518 - DNA, 13 bp, Homo sapiens
cagtgaagcagca

SEQ ID NO: 5587519 - DNA, 18 bp, Homo sapiens
cagtgaagcccaggagga

SEQ ID NO: 5587520 - DNA, 23 bp, Homo sapiens
cagtgaaggtggggagaagctga

SEQ ID NO: 5587521 - DNA, 22 bp, Homo sapiens
cagtgaagtagcctcttgtgta

SEQ ID NO: 5587522 - DNA, 20 bp, Homo sapiens
cagtgaagtctagaatcata

SEQ ID NO: 5587523 - DNA, 20 bp, Homo sapiens
cagtgaagtgcctttttcct

SEQ ID NO: 5587524 - DNA, 21 bp, Homo sapiens
cagtgaagtgcctttttccta

SEQ ID NO: 5587525 - DNA, 14 bp, Homo sapiens
cagtgaagttgctg

SEQ ID NO: 5587526 - DNA, 15 bp, Homo sapiens
cagtgaagttgctgc

SEQ ID NO: 5587527 - DNA, 16 bp, Homo sapiens
cagtgaagttgctgct

SEQ ID NO: 5587528 - DNA, 18 bp, Homo sapiens
cagtgaagttgctgcttc

SEQ ID NO: 5587529 - DNA, 13 bp, Homo sapiens
cagtgaataaata

SEQ ID NO: 5587530 - DNA, 22 bp, Homo sapiens
cagtgaatagtaacaataaata

SEQ ID NO: 5587531 - DNA, 16 bp, Homo sapiens
cagtgaatataaatgt

SEQ ID NO: 5587532 - DNA, 23 bp, Homo sapiens
cagtgaatccctgggagcgcctg

SEQ ID NO: 5587533 - DNA, 18 bp, Homo sapiens
cagtgaatgctagacaga

SEQ ID NO: 5587534 - DNA, 21 bp, Homo sapiens
cagtgaatggtgccattttcg

SEQ ID NO: 5587535 - DNA, 12 bp, Homo sapiens
cagtgaattctt

SEQ ID NO: 5587536 - DNA, 20 bp, Homo sapiens
cagtgaattgacccatgttc

SEQ ID NO: 5587537 - DNA, 19 bp, Homo sapiens
cagtgaatttttgcaataa

SEQ ID NO: 5587538 - DNA, 22 bp, Homo sapiens
cagtgaatttttgcaataatgc

SEQ ID NO: 5587539 - DNA, 23 bp, Homo sapiens
cagtgaatttttgcaataatgca

SEQ ID NO: 5587540 - DNA, 19 bp, Homo sapiens
cagtgacaaaatgggagga

SEQ ID NO: 5587541 - DNA, 20 bp, Homo sapiens
cagtgacaaaatgggaggag

SEQ ID NO: 5587542 - DNA, 14 bp, Homo sapiens
cagtgacaaaccat

SEQ ID NO: 5587543 - DNA, 14 bp, Homo sapiens
cagtgacaagtgga

SEQ ID NO: 5587544 - DNA, 18 bp, Homo sapiens
cagtgacaagtggagggg

SEQ ID NO: 5587545 - DNA, 19 bp, Homo sapiens
cagtgacaagtggaggggg

SEQ ID NO: 5587546 - DNA, 21 bp, Homo sapiens
cagtgacactaaaacaagagg

SEQ ID NO: 5587547 - DNA, 22 bp, Homo sapiens
cagtgacactaaaacaagagga

SEQ ID NO: 5587548 - DNA, 19 bp, Homo sapiens
cagtgacacttcagagagc

SEQ ID NO: 5587549 - DNA, 16 bp, Homo sapiens
cagtgacagagttcac

SEQ ID NO: 5587550 - DNA, 20 bp, Homo sapiens
cagtgacagagttcactata

SEQ ID NO: 5587551 - DNA, 15 bp, Homo sapiens
cagtgacagctagga

SEQ ID NO: 5587552 - DNA, 20 bp, Homo sapiens
cagtgacatcaaagcctggc

SEQ ID NO: 5587553 - DNA, 22 bp, Homo sapiens
cagtgacatcaaagcctggcct

SEQ ID NO: 5587554 - DNA, 15 bp, Homo sapiens
cagtgacatgagact

SEQ ID NO: 5587555 - DNA, 15 bp, Homo sapiens
cagtgaccacttatt

SEQ ID NO: 5587556 - DNA, 14 bp, Homo sapiens
cagtgaccccagaa

SEQ ID NO: 5587557 - DNA, 16 bp, Homo sapiens
cagtgaccctggagct

SEQ ID NO: 5587558 - DNA, 16 bp, Homo sapiens
cagtgaccctggctcc

SEQ ID NO: 5587559 - DNA, 18 bp, Homo sapiens
cagtgacctctctctctg

SEQ ID NO: 5587560 - DNA, 21 bp, Homo sapiens
cagtgacctgaccggcacctg

SEQ ID NO: 5587561 - DNA, 14 bp, Homo sapiens
cagtgacctgagga

SEQ ID NO: 5587562 - DNA, 18 bp, Homo sapiens
cagtgacctgaggaagcg

SEQ ID NO: 5587563 - DNA, 14 bp, Homo sapiens
cagtgaccttttct

SEQ ID NO: 5587564 - DNA, 16 bp, Homo sapiens
cagtgaccttttcttc

SEQ ID NO: 5587565 - DNA, 17 bp, Homo sapiens
cagtgaccttttcttca

SEQ ID NO: 5587566 - DNA, 21 bp, Homo sapiens
cagtgaccttttcttcatttt

SEQ ID NO: 5587567 - DNA, 11 bp, Homo sapiens
cagtgactcca

SEQ ID NO: 5587568 - DNA, 12 bp, Homo sapiens
cagtgactccag

SEQ ID NO: 5587569 - DNA, 13 bp, Homo sapiens
cagtgactccagg

SEQ ID NO: 5587570 - DNA, 14 bp, Homo sapiens
cagtgactccagga

SEQ ID NO: 5587571 - DNA, 16 bp, Homo sapiens
cagtgactccaggaga

SEQ ID NO: 5587572 - DNA, 21 bp, Homo sapiens
cagtgactccaggagaggagc

SEQ ID NO: 5587573 - DNA, 18 bp, Homo sapiens
cagtgactccagggtgac

SEQ ID NO: 5587574 - DNA, 14 bp, Homo sapiens
cagtgactccccag

SEQ ID NO: 5587575 - DNA, 16 bp, Homo sapiens
cagtgactccccagcc

SEQ ID NO: 5587576 - DNA, 17 bp, Homo sapiens
cagtgactccccagccc

SEQ ID NO: 5587577 - DNA, 19 bp, Homo sapiens
cagtgactccccagcccag

SEQ ID NO: 5587578 - DNA, 14 bp, Homo sapiens
cagtgactcctgct

SEQ ID NO: 5587579 - DNA, 22 bp, Homo sapiens
cagtgactcctgctggtacctg

SEQ ID NO: 5587580 - DNA, 17 bp, Homo sapiens
cagtgactcgggctcct

SEQ ID NO: 5587581 - DNA, 18 bp, Homo sapiens
cagtgactcgggctcctg

SEQ ID NO: 5587582 - DNA, 14 bp, Homo sapiens
cagtgactgctgcg

SEQ ID NO: 5587583 - DNA, 18 bp, Homo sapiens
cagtgactggcaggtgca

SEQ ID NO: 5587584 - DNA, 22 bp, Homo sapiens
cagtgactgggccctgtccagg

SEQ ID NO: 5587585 - DNA, 20 bp, Homo sapiens
cagtgactgtcgtgtttaca

SEQ ID NO: 5587586 - DNA, 20 bp, Homo sapiens
cagtgactgtggccatggtc

SEQ ID NO: 5587587 - DNA, 16 bp, Homo sapiens
cagtgacttctggctt

SEQ ID NO: 5587588 - DNA, 23 bp, Homo sapiens
cagtgacttgcaatccaggctgt

SEQ ID NO: 5587589 - DNA, 18 bp, Homo sapiens
cagtgacttgttctgagt

SEQ ID NO: 5587590 - DNA, 17 bp, Homo sapiens
cagtgactttacaggag

SEQ ID NO: 5587591 - DNA, 18 bp, Homo sapiens
cagtgactttacaggagg

SEQ ID NO: 5587592 - DNA, 22 bp, Homo sapiens
cagtgactttgtatagagaatt

SEQ ID NO: 5587593 - DNA, 22 bp, Homo sapiens
cagtgactttttctgagctttt

SEQ ID NO: 5587594 - DNA, 22 bp, Homo sapiens
cagtgagaaaaagctcctgtcc

SEQ ID NO: 5587595 - DNA, 20 bp, Homo sapiens
cagtgagaagctgaggccta

SEQ ID NO: 5587596 - DNA, 22 bp, Homo sapiens
cagtgagaagctgaggcctatg

SEQ ID NO: 5587597 - DNA, 18 bp, Homo sapiens
cagtgagaagggcctgct

SEQ ID NO: 5587598 - DNA, 17 bp, Homo sapiens
cagtgagacagtctgga

SEQ ID NO: 5587599 - DNA, 20 bp, Homo sapiens
cagtgagacagtctggaaag

SEQ ID NO: 5587600 - DNA, 17 bp, Homo sapiens
cagtgagactgcaggtg

SEQ ID NO: 5587601 - DNA, 20 bp, Homo sapiens
cagtgagactgcaggtgggc

SEQ ID NO: 5587602 - DNA, 17 bp, Homo sapiens
cagtgagactgtacata

SEQ ID NO: 5587603 - DNA, 21 bp, Homo sapiens
cagtggaccgcccttttcccc

SEQ ID NO: 5587604 - DNA, 14 bp, Homo sapiens
cagtggacggagag

SEQ ID NO: 5587605 - DNA, 16 bp, Homo sapiens
cagtggacggagagcc

SEQ ID NO: 5587606 - DNA, 18 bp, Homo sapiens
cagtggacggagagcctt

SEQ ID NO: 5587607 - DNA, 17 bp, Homo sapiens
cagtggacggaggtccc

SEQ ID NO: 5587608 - DNA, 22 bp, Homo sapiens
cagtggactcagaaagccaaca

SEQ ID NO: 5587609 - DNA, 18 bp, Homo sapiens
cagtggactttccacccc

SEQ ID NO: 5587610 - DNA, 23 bp, Homo sapiens
cagtggactttccaccccctccc

SEQ ID NO: 5587611 - DNA, 14 bp, Homo sapiens
cagtggagaaatat

SEQ ID NO: 5587612 - DNA, 21 bp, Homo sapiens
cagtggagaggggacttggat

SEQ ID NO: 5587613 - DNA, 16 bp, Homo sapiens
cagtggagcccaggag

SEQ ID NO: 5587614 - DNA, 17 bp, Homo sapiens
cagtggagcccaggagt

SEQ ID NO: 5587615 - DNA, 14 bp, Homo sapiens
cagtggagcctgcc

SEQ ID NO: 5587616 - DNA, 18 bp, Homo sapiens
cagtggagcctgccgccc

SEQ ID NO: 5587617 - DNA, 14 bp, Homo sapiens
cagtggagcctggg

SEQ ID NO: 5587618 - DNA, 14 bp, Homo sapiens
cagtggagctggca

SEQ ID NO: 5587619 - DNA, 17 bp, Homo sapiens
cagtggagctggtctgc

SEQ ID NO: 5587620 - DNA, 14 bp, Homo sapiens
cagtggaggctgct

SEQ ID NO: 5587621 - DNA, 18 bp, Homo sapiens
cagtggaggctgctgtga

SEQ ID NO: 5587622 - DNA, 12 bp, Homo sapiens
cagtggaggggg

SEQ ID NO: 5587623 - DNA, 14 bp, Homo sapiens
cagtggaggtgctg

SEQ ID NO: 5587624 - DNA, 18 bp, Homo sapiens
cagtggagtaatttatgc

SEQ ID NO: 5587625 - DNA, 22 bp, Homo sapiens
cagtggagtaatttatgcctta

SEQ ID NO: 5587626 - DNA, 21 bp, Homo sapiens
cagtggagtgcaaaaggcttg

SEQ ID NO: 5587627 - DNA, 22 bp, Homo sapiens
cagtggatatgacccacactgc

SEQ ID NO: 5587628 - DNA, 23 bp, Homo sapiens
cagtggatatgacccacactgcc

SEQ ID NO: 5587629 - DNA, 20 bp, Homo sapiens
cagtggatgttagcctgcaa

SEQ ID NO: 5587630 - DNA, 13 bp, Homo sapiens
cagtggattccag

SEQ ID NO: 5587631 - DNA, 15 bp, Homo sapiens
cagtggcaacttgtg

SEQ ID NO: 5587632 - DNA, 17 bp, Homo sapiens
cagtggcaagaatgaaa

SEQ ID NO: 5587633 - DNA, 16 bp, Homo sapiens
cagtggcacaatcatg

SEQ ID NO: 5587634 - DNA, 19 bp, Homo sapiens
cagtggcacgatctcagct

SEQ ID NO: 5587635 - DNA, 18 bp, Homo sapiens
cagtggcacggagagaag

SEQ ID NO: 5587636 - DNA, 23 bp, Homo sapiens
cagtggcacggagagaaggccca

SEQ ID NO: 5587637 - DNA, 14 bp, Homo sapiens
cagtggcactaaaa

SEQ ID NO: 5587638 - DNA, 16 bp, Homo sapiens
cagtggcactctgtgt

SEQ ID NO: 5587639 - DNA, 17 bp, Homo sapiens
cagtggcactctgtgtg

SEQ ID NO: 5587640 - DNA, 21 bp, Homo sapiens
cagtggcactgaagtggccct

SEQ ID NO: 5587641 - DNA, 16 bp, Homo sapiens
cagtggcagcaaagga

SEQ ID NO: 5587642 - DNA, 21 bp, Homo sapiens
cagtggcaggacccttaggaa

SEQ ID NO: 5587643 - DNA, 20 bp, Homo sapiens
cagtggcaggcagaggccca

SEQ ID NO: 5587644 - DNA, 21 bp, Homo sapiens
cagtggcaggcagaggcccag

SEQ ID NO: 5587645 - DNA, 12 bp, Homo sapiens
cagtggcagggc

SEQ ID NO: 5587646 - DNA, 15 bp, Homo sapiens
cagtggcagggcaca

SEQ ID NO: 5587647 - DNA, 19 bp, Homo sapiens
cagtggcagggcacagggc

SEQ ID NO: 5587648 - DNA, 17 bp, Homo sapiens
cagtggcagggctcagg

SEQ ID NO: 5587649 - DNA, 18 bp, Homo sapiens
cagtggcagggctcagga

SEQ ID NO: 5587650 - DNA, 16 bp, Homo sapiens
cagtggcatggctcca

SEQ ID NO: 5587651 - DNA, 19 bp, Homo sapiens
cagtggcatggctccagtc

SEQ ID NO: 5587652 - DNA, 23 bp, Homo sapiens
cagtggccaagatcacagtggcc

SEQ ID NO: 5587653 - DNA, 15 bp, Homo sapiens
cagtggccaagcctg

SEQ ID NO: 5587654 - DNA, 16 bp, Homo sapiens
cagtggccaagcctgc

SEQ ID NO: 5587655 - DNA, 20 bp, Homo sapiens
cagtggccacgttcagggag

SEQ ID NO: 5587656 - DNA, 13 bp, Homo sapiens
cagtggccactca

SEQ ID NO: 5587657 - DNA, 11 bp, Homo sapiens
cagtggccagg

SEQ ID NO: 5587658 - DNA, 14 bp, Homo sapiens
cagtggccaggtgc

SEQ ID NO: 5587659 - DNA, 15 bp, Homo sapiens
cagtggccaggtgcc

SEQ ID NO: 5587660 - DNA, 23 bp, Homo sapiens
cagtggccaggtgccgacactga

SEQ ID NO: 5587661 - DNA, 23 bp, Homo sapiens
cagtggcccagggaatcagggag

SEQ ID NO: 5587662 - DNA, 21 bp, Homo sapiens
cagtggcccatggcattttat

SEQ ID NO: 5587663 - DNA, 18 bp, Homo sapiens
cagtggcccatgtgactg

SEQ ID NO: 5587664 - DNA, 21 bp, Homo sapiens
cagtggcccccactcacaggg

SEQ ID NO: 5587665 - DNA, 13 bp, Homo sapiens
cagtggcccccgg

SEQ ID NO: 5587666 - DNA, 17 bp, Homo sapiens
cagtggcccccgggcct

SEQ ID NO: 5587667 - DNA, 19 bp, Homo sapiens
cagtggcccccgggcctgc

SEQ ID NO: 5587668 - DNA, 23 bp, Homo sapiens
cagtggcccccgggcctgcacag

SEQ ID NO: 5587669 - DNA, 23 bp, Homo sapiens
cagtggcccgcgtgattgtggca

SEQ ID NO: 5587670 - DNA, 20 bp, Homo sapiens
cagtggccgaaccccccact

SEQ ID NO: 5587671 - DNA, 22 bp, Homo sapiens
cagtggccgaaccccccactcc

SEQ ID NO: 5587672 - DNA, 20 bp, Homo sapiens
cagtggccgcaagcgcaggg

SEQ ID NO: 5587673 - DNA, 22 bp, Homo sapiens
cagtggccgcaagcgcagggag

SEQ ID NO: 5587674 - DNA, 24 bp, Homo sapiens
cagtggccgggctggggaggcctg

SEQ ID NO: 5587675 - DNA, 22 bp, Homo sapiens
cagtggccggggctgaagccac

SEQ ID NO: 5587676 - DNA, 18 bp, Homo sapiens
cagtggcctacaaatcag

SEQ ID NO: 5587677 - DNA, 23 bp, Homo sapiens
cagtggcctacaaatcagtaatt

SEQ ID NO: 5587678 - DNA, 11 bp, Homo sapiens
cagtggcctct

SEQ ID NO: 5587679 - DNA, 21 bp, Homo sapiens
cagtggcctgatctctgctcc

SEQ ID NO: 5587680 - DNA, 16 bp, Homo sapiens
cagtggcctggatgca

SEQ ID NO: 5587681 - DNA, 13 bp, Homo sapiens
cagtggcctggcc

SEQ ID NO: 5587682 - DNA, 15 bp, Homo sapiens
cagtggcctggccgt

SEQ ID NO: 5587683 - DNA, 15 bp, Homo sapiens
cagtggcctggctcc

SEQ ID NO: 5587684 - DNA, 23 bp, Homo sapiens
cagtggcctggctccgctgtgtg

SEQ ID NO: 5587685 - DNA, 18 bp, Homo sapiens
cagtggccttacccctgc

SEQ ID NO: 5587686 - DNA, 17 bp, Homo sapiens
cagtggccttccccagc

SEQ ID NO: 5587687 - DNA, 19 bp, Homo sapiens
cagtggccttccccagcat

SEQ ID NO: 5587688 - DNA, 23 bp, Homo sapiens
cagtggccttgagcttcaaaatg

SEQ ID NO: 5587689 - DNA, 15 bp, Homo sapiens
cagtggccttgcttc

SEQ ID NO: 5587690 - DNA, 17 bp, Homo sapiens
cagtggccttggtcctt

SEQ ID NO: 5587691 - DNA, 11 bp, Homo sapiens
cagtggccttt

SEQ ID NO: 5587692 - DNA, 16 bp, Homo sapiens
cagtggcctttcagtg

SEQ ID NO: 5587693 - DNA, 19 bp, Homo sapiens
cagtggcgaaatccctgct

SEQ ID NO: 5587694 - DNA, 21 bp, Homo sapiens
cagtggcgcaatctcggctca

SEQ ID NO: 5587695 - DNA, 14 bp, Homo sapiens
cagtggcgcatgcc

SEQ ID NO: 5587696 - DNA, 17 bp, Homo sapiens
cagtggcgcatgcctgt

SEQ ID NO: 5587697 - DNA, 20 bp, Homo sapiens
cagtggcgcattctaggctc

SEQ ID NO: 5587698 - DNA, 21 bp, Homo sapiens
cagtggcgccatctcggctca

SEQ ID NO: 5587699 - DNA, 18 bp, Homo sapiens
cagtggcgcgatctcagc

SEQ ID NO: 5587700 - DNA, 21 bp, Homo sapiens
cagtggcgcgatctcagctca

SEQ ID NO: 5587701 - DNA, 16 bp, Homo sapiens
cagtggcgggcccact

SEQ ID NO: 5587702 - DNA, 21 bp, Homo sapiens
cagtggcgtgatctcagctca

SEQ ID NO: 5587703 - DNA, 19 bp, Homo sapiens
cagtggcgttgttgcatgt

SEQ ID NO: 5587704 - DNA, 14 bp, Homo sapiens
cagtggctcacgcc

SEQ ID NO: 5587705 - DNA, 17 bp, Homo sapiens
cagtggctcacgcctgt

SEQ ID NO: 5587706 - DNA, 14 bp, Homo sapiens
cagtggctcataaa

SEQ ID NO: 5587707 - DNA, 16 bp, Homo sapiens
cagtggctcataaaaa

SEQ ID NO: 5587708 - DNA, 21 bp, Homo sapiens
cagtggctcataaaaataaaa

SEQ ID NO: 5587709 - DNA, 14 bp, Homo sapiens
cagtggctcatgcc

SEQ ID NO: 5587710 - DNA, 11 bp, Homo sapiens
cagtggctccc

SEQ ID NO: 5587711 - DNA, 16 bp, Homo sapiens
cagtggctcctataat

SEQ ID NO: 5587712 - DNA, 18 bp, Homo sapiens
cagtggctcgctccctgt

SEQ ID NO: 5587713 - DNA, 17 bp, Homo sapiens
cagtggctctcagagca

SEQ ID NO: 5587714 - DNA, 18 bp, Homo sapiens
cagtggctctcagagcag

SEQ ID NO: 5587715 - DNA, 13 bp, Homo sapiens
cagtggctgctgc

SEQ ID NO: 5587716 - DNA, 15 bp, Homo sapiens
cagtggctgctgccc

SEQ ID NO: 5587717 - DNA, 17 bp, Homo sapiens
cagtggctgctgcccag

SEQ ID NO: 5587718 - DNA, 20 bp, Homo sapiens
cagtggctggaagaaccact

SEQ ID NO: 5587719 - DNA, 22 bp, Homo sapiens
cagtggctggaagaaccactgt

SEQ ID NO: 5587720 - DNA, 16 bp, Homo sapiens
cagtggctggatctgt

SEQ ID NO: 5587721 - DNA, 18 bp, Homo sapiens
cagtggctggatctgtga

SEQ ID NO: 5587722 - DNA, 20 bp, Homo sapiens
cagtggctggatctgtgagg

SEQ ID NO: 5587723 - DNA, 12 bp, Homo sapiens
cagtggctgggt

SEQ ID NO: 5587724 - DNA, 17 bp, Homo sapiens
cagtggctgggtgggcc

SEQ ID NO: 5587725 - DNA, 20 bp, Homo sapiens
cagtggctgggtgggcccag

SEQ ID NO: 5587726 - DNA, 13 bp, Homo sapiens
cagtggctggtct

SEQ ID NO: 5587727 - DNA, 15 bp, Homo sapiens
cagtggctggtctca

SEQ ID NO: 5587728 - DNA, 14 bp, Homo sapiens
cagtggctggtgcc

SEQ ID NO: 5587729 - DNA, 13 bp, Homo sapiens
cagtggctgtcac

SEQ ID NO: 5587730 - DNA, 12 bp, Homo sapiens
cagtggctgtga

SEQ ID NO: 5587731 - DNA, 15 bp, Homo sapiens
cagtggctgtgaagg

SEQ ID NO: 5587732 - DNA, 19 bp, Homo sapiens
cagtggcttcatctgtcaa

SEQ ID NO: 5587733 - DNA, 21 bp, Homo sapiens
cagtggcttcccagctctgac

SEQ ID NO: 5587734 - DNA, 19 bp, Homo sapiens
cagtggcttctccagggaa

SEQ ID NO: 5587735 - DNA, 18 bp, Homo sapiens
cagtggcttctcccaaca

SEQ ID NO: 5587736 - DNA, 17 bp, Homo sapiens
cagtggcttggagcaga

SEQ ID NO: 5587737 - DNA, 15 bp, Homo sapiens
cagtgggaaatatgc

SEQ ID NO: 5587738 - DNA, 11 bp, Homo sapiens
cagtgggaact

SEQ ID NO: 5587739 - DNA, 17 bp, Homo sapiens
cagtgggaactggaggg

SEQ ID NO: 5587740 - DNA, 13 bp, Homo sapiens
cagtgggaagaat

SEQ ID NO: 5587741 - DNA, 19 bp, Homo sapiens
cagtgggaatgttctttct

SEQ ID NO: 5587742 - DNA, 19 bp, Homo sapiens
cagtgggacagggcatggc

SEQ ID NO: 5587743 - DNA, 23 bp, Homo sapiens
cagtgggaccacatgccactgcc

SEQ ID NO: 5587744 - DNA, 14 bp, Homo sapiens
cagtgggagaaaac

SEQ ID NO: 5587745 - DNA, 23 bp, Homo sapiens
cagtgggagactaagatgtatta

SEQ ID NO: 5587746 - DNA, 17 bp, Homo sapiens
cagtgggagatgttaga

SEQ ID NO: 5587747 - DNA, 18 bp, Homo sapiens
cagtgggagccagggctg

SEQ ID NO: 5587748 - DNA, 17 bp, Homo sapiens
cagtgggagccctgacc

SEQ ID NO: 5587749 - DNA, 15 bp, Homo sapiens
cagtgggagctgcct

SEQ ID NO: 5587750 - DNA, 16 bp, Homo sapiens
cagtgggagctgcctg

SEQ ID NO: 5587751 - DNA, 17 bp, Homo sapiens
cagtgggagctgcctgt

SEQ ID NO: 5587752 - DNA, 23 bp, Homo sapiens
cagtgggagctgcctgttcagct

SEQ ID NO: 5587753 - DNA, 19 bp, Homo sapiens
cagtgggaggacagagccg

SEQ ID NO: 5587754 - DNA, 20 bp, Homo sapiens
cagtgggaggacagagccgg

SEQ ID NO: 5587755 - DNA, 13 bp, Homo sapiens
cagtgggaggcaa

SEQ ID NO: 5587756 - DNA, 11 bp, Homo sapiens
cagtgggaggg

SEQ ID NO: 5587757 - DNA, 12 bp, Homo sapiens
cagtgggagggg

SEQ ID NO: 5587758 - DNA, 14 bp, Homo sapiens
cagtgggaggggca

SEQ ID NO: 5587759 - DNA, 16 bp, Homo sapiens
cagtgggaggggcagg

SEQ ID NO: 5587760 - DNA, 20 bp, Homo sapiens
cagtgggaggggcaggctga

SEQ ID NO: 5587761 - DNA, 22 bp, Homo sapiens
cagtgggagggtaccagcagaa

SEQ ID NO: 5587762 - DNA, 21 bp, Homo sapiens
cagtgggaggtgagaccacct

SEQ ID NO: 5587763 - DNA, 22 bp, Homo sapiens
cagtgggatgggacagggaggc

SEQ ID NO: 5587764 - DNA, 15 bp, Homo sapiens
cagtgggatttggta

SEQ ID NO: 5587765 - DNA, 20 bp, Homo sapiens
cagtgggcaggaggccccag

SEQ ID NO: 5587766 - DNA, 21 bp, Homo sapiens
cagtgggcaggaggccccagg

SEQ ID NO: 5587767 - DNA, 22 bp, Homo sapiens
cagtgggcaggaggccccaggc

SEQ ID NO: 5587768 - DNA, 12 bp, Homo sapiens
cagtgggcaggg

SEQ ID NO: 5587769 - DNA, 14 bp, Homo sapiens
cagtgggcaggtgg

SEQ ID NO: 5587770 - DNA, 15 bp, Homo sapiens
cagtgggcatcagca

SEQ ID NO: 5587771 - DNA, 17 bp, Homo sapiens
cagtgggccctggctct

SEQ ID NO: 5587772 - DNA, 20 bp, Homo sapiens
cagtgggccctggctctgtc

SEQ ID NO: 5587773 - DNA, 12 bp, Homo sapiens
cagtgggccggc

SEQ ID NO: 5587774 - DNA, 20 bp, Homo sapiens
cagtgggccggccccaggct

SEQ ID NO: 5587775 - DNA, 12 bp, Homo sapiens
cagtgggcctgg

SEQ ID NO: 5587776 - DNA, 13 bp, Homo sapiens
cagtgggcctggt

SEQ ID NO: 5587777 - DNA, 19 bp, Homo sapiens
cagtgggcctggtagcaca

SEQ ID NO: 5587778 - DNA, 15 bp, Homo sapiens
cagtgggcctgtgtg

SEQ ID NO: 5587779 - DNA, 17 bp, Homo sapiens
cagtgggcctgtgtgtg

SEQ ID NO: 5587780 - DNA, 18 bp, Homo sapiens
cagtgggcgttgggagcc

SEQ ID NO: 5587781 - DNA, 18 bp, Homo sapiens
cagtgtgaggccagggca

SEQ ID NO: 5587782 - DNA, 15 bp, Homo sapiens
cagtgtgaggctgta

SEQ ID NO: 5587783 - DNA, 19 bp, Homo sapiens
cagtgtgagggaaagagct

SEQ ID NO: 5587784 - DNA, 14 bp, Homo sapiens
cagtgtgagggtgc

SEQ ID NO: 5587785 - DNA, 19 bp, Homo sapiens
cagtgtgagggtgcaggga

SEQ ID NO: 5587786 - DNA, 19 bp, Homo sapiens
cagtgtgagtataaaataa

SEQ ID NO: 5587787 - DNA, 18 bp, Homo sapiens
cagtgtgatcccaagtgc

SEQ ID NO: 5587788 - DNA, 19 bp, Homo sapiens
cagtgtgatcccaagtgcc

SEQ ID NO: 5587789 - DNA, 14 bp, Homo sapiens
cagtgtgcaaggca

SEQ ID NO: 5587790 - DNA, 15 bp, Homo sapiens
cagtgtgcactaagg

SEQ ID NO: 5587791 - DNA, 23 bp, Homo sapiens
cagtgtgcactaaggggcccggc

SEQ ID NO: 5587792 - DNA, 13 bp, Homo sapiens
cagtgtgcatggg

SEQ ID NO: 5587793 - DNA, 11 bp, Homo sapiens
cagtgtgccac

SEQ ID NO: 5587794 - DNA, 21 bp, Homo sapiens
cagtgtgcccaaaagccatgt

SEQ ID NO: 5587795 - DNA, 17 bp, Homo sapiens
cagtgtgccccccatcc

SEQ ID NO: 5587796 - DNA, 23 bp, Homo sapiens
cagtgtgccccccatcctggccc

SEQ ID NO: 5587797 - DNA, 22 bp, Homo sapiens
cagtgtgcctggttaatattaa

SEQ ID NO: 5587798 - DNA, 14 bp, Homo sapiens
cagtgtgcggagct

SEQ ID NO: 5587799 - DNA, 16 bp, Homo sapiens
cagtgtgcggagctga

SEQ ID NO: 5587800 - DNA, 23 bp, Homo sapiens
cagtgtgcgttggaatcacctgg

SEQ ID NO: 5587801 - DNA, 19 bp, Homo sapiens
cagtgtgctaacctcactg

SEQ ID NO: 5587802 - DNA, 18 bp, Homo sapiens
cagtgtgctttgcatttt

SEQ ID NO: 5587803 - DNA, 15 bp, Homo sapiens
cagtgtggactctgg

SEQ ID NO: 5587804 - DNA, 14 bp, Homo sapiens
cagtgtggagaccc

SEQ ID NO: 5587805 - DNA, 15 bp, Homo sapiens
cagtgtggagagggg

SEQ ID NO: 5587806 - DNA, 23 bp, Homo sapiens
cagtgtggagaggggtgcaccca

SEQ ID NO: 5587807 - DNA, 22 bp, Homo sapiens
cagtgtggagttcaccttggaa

SEQ ID NO: 5587808 - DNA, 13 bp, Homo sapiens
cagtgtggcccca

SEQ ID NO: 5587809 - DNA, 13 bp, Homo sapiens
cagtgtggcctct

SEQ ID NO: 5587810 - DNA, 14 bp, Homo sapiens
cagtgtggcctctt

SEQ ID NO: 5587811 - DNA, 19 bp, Homo sapiens
cagtgtggcctcttctgag

SEQ ID NO: 5587812 - DNA, 14 bp, Homo sapiens
cagtgtggctccca

SEQ ID NO: 5587813 - DNA, 24 bp, Homo sapiens
cagtgtggctcccacaggtcttca

SEQ ID NO: 5587814 - DNA, 11 bp, Homo sapiens
cagtgtggctt

SEQ ID NO: 5587815 - DNA, 19 bp, Homo sapiens
cagtgtggcttaaacattt

SEQ ID NO: 5587816 - DNA, 20 bp, Homo sapiens
cagtgtgggcgctctcccta

SEQ ID NO: 5587817 - DNA, 18 bp, Homo sapiens
cagtgtggggcagccgtc

SEQ ID NO: 5587818 - DNA, 15 bp, Homo sapiens
cagtgtgtaaataat

SEQ ID NO: 5587819 - DNA, 20 bp, Homo sapiens
cagtgtgtcacactgagctg

SEQ ID NO: 5587820 - DNA, 18 bp, Homo sapiens
cagtgtgtcagtttttcc

SEQ ID NO: 5587821 - DNA, 21 bp, Homo sapiens
cagtgtgtccttggggcacag

SEQ ID NO: 5587822 - DNA, 22 bp, Homo sapiens
cagtgtgtctttataaagctgt

SEQ ID NO: 5587823 - DNA, 20 bp, Homo sapiens
cagtgtgtgaactgctttca

SEQ ID NO: 5587824 - DNA, 13 bp, Homo sapiens
cagtgtgtgctca

SEQ ID NO: 5587825 - DNA, 22 bp, Homo sapiens
cagtgtgtgctcagcagcccca

SEQ ID NO: 5587826 - DNA, 22 bp, Homo sapiens
cagtgtgtggctttcagagcct

SEQ ID NO: 5587827 - DNA, 21 bp, Homo sapiens
cagtgttaaagtggtctgaac

SEQ ID NO: 5587828 - DNA, 16 bp, Homo sapiens
cagtgttaaatgaaat

SEQ ID NO: 5587829 - DNA, 23 bp, Homo sapiens
cagtgttaagtgtttgaaaacgt

SEQ ID NO: 5587830 - DNA, 20 bp, Homo sapiens
cagtgttaatactgagaaaa

SEQ ID NO: 5587831 - DNA, 17 bp, Homo sapiens
cagtgttacctgtgtgc

SEQ ID NO: 5587832 - DNA, 18 bp, Homo sapiens
cagtgttacctgtgtgct

SEQ ID NO: 5587833 - DNA, 16 bp, Homo sapiens
cagtgttacttgcagg

SEQ ID NO: 5587834 - DNA, 23 bp, Homo sapiens
cagtgttacttgcaggtactttg

SEQ ID NO: 5587835 - DNA, 16 bp, Homo sapiens
cagtgttacttttaat

SEQ ID NO: 5587836 - DNA, 15 bp, Homo sapiens
cagtgttagagaaat

SEQ ID NO: 5587837 - DNA, 20 bp, Homo sapiens
cagtgttaggcctggcacag

SEQ ID NO: 5587838 - DNA, 23 bp, Homo sapiens
cagtgttaggcctggcacagtgt

SEQ ID NO: 5587839 - DNA, 17 bp, Homo sapiens
cagtgttagtattcacc

SEQ ID NO: 5587840 - DNA, 14 bp, Homo sapiens
cagtgttagtggga

SEQ ID NO: 5587841 - DNA, 15 bp, Homo sapiens
cagtgttagtgggaa

SEQ ID NO: 5587842 - DNA, 11 bp, Homo sapiens
cagtgttattt

SEQ ID NO: 5587843 - DNA, 16 bp, Homo sapiens
cagtgttcaaattctg

SEQ ID NO: 5587844 - DNA, 18 bp, Homo sapiens
cagtgttccttgtgcccg

SEQ ID NO: 5587845 - DNA, 17 bp, Homo sapiens
cagtgttcgcttggctc

SEQ ID NO: 5587846 - DNA, 14 bp, Homo sapiens
cagtgttctgagcc

SEQ ID NO: 5587847 - DNA, 18 bp, Homo sapiens
cagtgttctgtgaatagc

SEQ ID NO: 5587848 - DNA, 15 bp, Homo sapiens
cagtgttgacatagc

SEQ ID NO: 5587849 - DNA, 16 bp, Homo sapiens
cagtgttgacatagcc

SEQ ID NO: 5587850 - DNA, 17 bp, Homo sapiens
cagtgttgacatagcct

SEQ ID NO: 5587851 - DNA, 21 bp, Homo sapiens
cagtgttgacatagcctttgt

SEQ ID NO: 5587852 - DNA, 18 bp, Homo sapiens
cagtgttgagccttttcc

SEQ ID NO: 5587853 - DNA, 19 bp, Homo sapiens
cagtgttgcatatgagcct

SEQ ID NO: 5587854 - DNA, 18 bp, Homo sapiens
cagtgttgcgtttttcct

SEQ ID NO: 5587855 - DNA, 19 bp, Homo sapiens
cagtgttgcgtttttcctt

SEQ ID NO: 5587856 - DNA, 13 bp, Homo sapiens
cagtgttgctcag

SEQ ID NO: 5587857 - DNA, 16 bp, Homo sapiens
cagtgttgctcagctc

SEQ ID NO: 5587858 - DNA, 17 bp, Homo sapiens
cagtgttgctcagctcc

SEQ ID NO: 5587859 - DNA, 18 bp, Homo sapiens
cagtgttgctcagctcct

SEQ ID NO: 5587860 - DNA, 17 bp, Homo sapiens
cagtgttgggttttttt

SEQ ID NO: 5587861 - DNA, 23 bp, Homo sapiens
cagtgttgtgccccttcactcat

SEQ ID NO: 5587862 - DNA, 17 bp, Homo sapiens
cagtgttgtgggcttcc

SEQ ID NO: 5587863 - DNA, 23 bp, Homo sapiens
cagtgttgtgggcttcctgctgg

SEQ ID NO: 5587864 - DNA, 19 bp, Homo sapiens
cagtgttgtttgtaaataa

SEQ ID NO: 5587865 - DNA, 21 bp, Homo sapiens
cagtgttgtttgtaaataaga

SEQ ID NO: 5587866 - DNA, 22 bp, Homo sapiens
cagtgttgtttgtaaataagag

SEQ ID NO: 5587867 - DNA, 16 bp, Homo sapiens
cagtgtttactttaaa

SEQ ID NO: 5587868 - DNA, 18 bp, Homo sapiens
cagtgtttagaagagcct

SEQ ID NO: 5587869 - DNA, 15 bp, Homo sapiens
cagtgtttatgacga

SEQ ID NO: 5587870 - DNA, 13 bp, Homo sapiens
cagtgtttcaatt

SEQ ID NO: 5587871 - DNA, 15 bp, Homo sapiens
cagtgtttccagtga

SEQ ID NO: 5587872 - DNA, 19 bp, Homo sapiens
cagtgtttccagtgacaca

SEQ ID NO: 5587873 - DNA, 19 bp, Homo sapiens
cagtgtttccctctgtgtt

SEQ ID NO: 5587874 - DNA, 11 bp, Homo sapiens
cagtgtttcct

SEQ ID NO: 5587875 - DNA, 17 bp, Homo sapiens
cagtgtttcttcacttc

SEQ ID NO: 5587876 - DNA, 15 bp, Homo sapiens
cagtgtttgttggat

SEQ ID NO: 5587877 - DNA, 17 bp, Homo sapiens
cagtgttttagctgttt

SEQ ID NO: 5587878 - DNA, 15 bp, Homo sapiens
cagtgttttctggga

SEQ ID NO: 5587879 - DNA, 13 bp, Homo sapiens
cagtgttttcttg

SEQ ID NO: 5587880 - DNA, 11 bp, Homo sapiens
cagtgttttgg

SEQ ID NO: 5587881 - DNA, 20 bp, Homo sapiens
cagtgttttggactccatct

SEQ ID NO: 5587882 - DNA, 21 bp, Homo sapiens
cagtgttttggtggaaaaaac

SEQ ID NO: 5587883 - DNA, 23 bp, Homo sapiens
cagtgttttggtggaaaaaacat

SEQ ID NO: 5587884 - DNA, 14 bp, Homo sapiens
cagtgtttttgaaa

SEQ ID NO: 5587885 - DNA, 19 bp, Homo sapiens
cagtgtttttgcaggtgag

SEQ ID NO: 5587886 - DNA, 15 bp, Homo sapiens
cagtgtttttgtaaa

SEQ ID NO: 5587887 - DNA, 19 bp, Homo sapiens
cagtgtttttgtaaagtgt

SEQ ID NO: 5587888 - DNA, 21 bp, Homo sapiens
cagtgtttttgtaaagtgtgg

SEQ ID NO: 5587889 - DNA, 22 bp, Homo sapiens
cagtgttttttaggaaaagcat

SEQ ID NO: 5587890 - DNA, 19 bp, Homo sapiens
cagttaaaaaaaattttaa

SEQ ID NO: 5587891 - DNA, 21 bp, Homo sapiens
cagttaaactggcttaactta

SEQ ID NO: 5587892 - DNA, 12 bp, Homo sapiens
cagttaaagcca

SEQ ID NO: 5587893 - DNA, 19 bp, Homo sapiens
cagttaaaggttgccagca

SEQ ID NO: 5587894 - DNA, 13 bp, Homo sapiens
cagttaaatatga

SEQ ID NO: 5587895 - DNA, 16 bp, Homo sapiens
cagttaaatatgattt

SEQ ID NO: 5587896 - DNA, 16 bp, Homo sapiens
cagttaactttcagaa

SEQ ID NO: 5587897 - DNA, 18 bp, Homo sapiens
cagttaagaaaaaaataa

SEQ ID NO: 5587898 - DNA, 21 bp, Homo sapiens
cagttaagaaaaaaataattt

SEQ ID NO: 5587899 - DNA, 22 bp, Homo sapiens
cagttaagaaaaaaataatttt

SEQ ID NO: 5587900 - DNA, 20 bp, Homo sapiens
cagttaagaagccctgcaga

SEQ ID NO: 5587901 - DNA, 14 bp, Homo sapiens
cagttaagagaaat

SEQ ID NO: 5587902 - DNA, 20 bp, Homo sapiens
cagttaagcctttggaaaca

SEQ ID NO: 5587903 - DNA, 22 bp, Homo sapiens
cagttaagctaaagcagtgttt

SEQ ID NO: 5587904 - DNA, 14 bp, Homo sapiens
cagttaaggaaaga

SEQ ID NO: 5587905 - DNA, 16 bp, Homo sapiens
cagttaagtattttga

SEQ ID NO: 5587906 - DNA, 15 bp, Homo sapiens
cagttaagtttttcc

SEQ ID NO: 5587907 - DNA, 15 bp, Homo sapiens
cagttaattagcatt

SEQ ID NO: 5587908 - DNA, 14 bp, Homo sapiens
cagttaatttttcc

SEQ ID NO: 5587909 - DNA, 18 bp, Homo sapiens
cagttacagggcccaggt

SEQ ID NO: 5587910 - DNA, 19 bp, Homo sapiens
cagttacagtggcagtatt

SEQ ID NO: 5587911 - DNA, 21 bp, Homo sapiens
cagttaccaaacattacaaaa

SEQ ID NO: 5587912 - DNA, 20 bp, Homo sapiens
cagttaccattaaaccatct

SEQ ID NO: 5587913 - DNA, 18 bp, Homo sapiens
cagttacctttgctgtca

SEQ ID NO: 5587914 - DNA, 22 bp, Homo sapiens
cagttactatttttatattcta

SEQ ID NO: 5587915 - DNA, 20 bp, Homo sapiens
cagttactcagaattctcta

SEQ ID NO: 5587916 - DNA, 13 bp, Homo sapiens
cagttactcagcc

SEQ ID NO: 5587917 - DNA, 15 bp, Homo sapiens
cagttactcagccct

SEQ ID NO: 5587918 - DNA, 17 bp, Homo sapiens
cagttactcagccctgg

SEQ ID NO: 5587919 - DNA, 18 bp, Homo sapiens
cagttactcagccctggg

SEQ ID NO: 5587920 - DNA, 19 bp, Homo sapiens
cagttactcagccctgggc

SEQ ID NO: 5587921 - DNA, 16 bp, Homo sapiens
cagttactgaaatctt

SEQ ID NO: 5587922 - DNA, 19 bp, Homo sapiens
cagttactgatgctcctga

SEQ ID NO: 5587923 - DNA, 19 bp, Homo sapiens
cagttactggtttcagttg

SEQ ID NO: 5587924 - DNA, 20 bp, Homo sapiens
cagttacttatgatttaaaa

SEQ ID NO: 5587925 - DNA, 17 bp, Homo sapiens
cagttacttgtgttcat

SEQ ID NO: 5587926 - DNA, 19 bp, Homo sapiens
cagttacttgtgttcattg

SEQ ID NO: 5587927 - DNA, 20 bp, Homo sapiens
cagttacttgtgttcattga

SEQ ID NO: 5587928 - DNA, 22 bp, Homo sapiens
cagttagaaatacattatgctt

SEQ ID NO: 5587929 - DNA, 15 bp, Homo sapiens
cagttagactcaaag

SEQ ID NO: 5587930 - DNA, 15 bp, Homo sapiens
cagttagagcagcct

SEQ ID NO: 5587931 - DNA, 15 bp, Homo sapiens
cagttagcaaacttt

SEQ ID NO: 5587932 - DNA, 16 bp, Homo sapiens
cagttagcaaactttg

SEQ ID NO: 5587933 - DNA, 15 bp, Homo sapiens
cagttagcacagagg

SEQ ID NO: 5587934 - DNA, 15 bp, Homo sapiens
cagttaggctagaga

SEQ ID NO: 5587935 - DNA, 19 bp, Homo sapiens
cagttaggctagagacaga

SEQ ID NO: 5587936 - DNA, 23 bp, Homo sapiens
cagttaggctagagacagatgct

SEQ ID NO: 5587937 - DNA, 18 bp, Homo sapiens
cagttagttagaattgga

SEQ ID NO: 5587938 - DNA, 21 bp, Homo sapiens
cagttagttagaattggaaat

SEQ ID NO: 5587939 - DNA, 19 bp, Homo sapiens
cagttagttgtgaaagaaa

SEQ ID NO: 5587940 - DNA, 15 bp, Homo sapiens
cagttataacagatg

SEQ ID NO: 5587941 - DNA, 15 bp, Homo sapiens
cagttataagaagaa

SEQ ID NO: 5587942 - DNA, 15 bp, Homo sapiens
cagttataatttcaa

SEQ ID NO: 5587943 - DNA, 13 bp, Homo sapiens
cagttatatgata

SEQ ID NO: 5587944 - DNA, 16 bp, Homo sapiens
cagttatatgatattc

SEQ ID NO: 5587945 - DNA, 14 bp, Homo sapiens
cagttatcctgcaa

SEQ ID NO: 5587946 - DNA, 17 bp, Homo sapiens
cagttatcctttgtgag

SEQ ID NO: 5587947 - DNA, 20 bp, Homo sapiens
cagttatcttagctggatat

SEQ ID NO: 5587948 - DNA, 13 bp, Homo sapiens
cagttatgaatca

SEQ ID NO: 5587949 - DNA, 20 bp, Homo sapiens
cagttatgagtataatacat

SEQ ID NO: 5587950 - DNA, 22 bp, Homo sapiens
cagttatgagtataatacatta

SEQ ID NO: 5587951 - DNA, 22 bp, Homo sapiens
cagttatgatttttttttcata

SEQ ID NO: 5587952 - DNA, 15 bp, Homo sapiens
cagttattactgttt

SEQ ID NO: 5587953 - DNA, 17 bp, Homo sapiens
cagttattatatttaca

SEQ ID NO: 5587954 - DNA, 22 bp, Homo sapiens
cagttattatatttacaaatgg

SEQ ID NO: 5587955 - DNA, 21 bp, Homo sapiens
cagttattcattctgtgatca

SEQ ID NO: 5587956 - DNA, 14 bp, Homo sapiens
cagttatttatagt

SEQ ID NO: 5587957 - DNA, 18 bp, Homo sapiens
cagttatttatttccaaa

SEQ ID NO: 5587958 - DNA, 13 bp, Homo sapiens
cataaaggaaaag

SEQ ID NO: 5587959 - DNA, 21 bp, Homo sapiens
cataaaggaaaagacacattt

SEQ ID NO: 5587960 - DNA, 16 bp, Homo sapiens
cataaaggacactgga

SEQ ID NO: 5587961 - DNA, 19 bp, Homo sapiens
cataaaggacactggatca

SEQ ID NO: 5587962 - DNA, 21 bp, Homo sapiens
cataaaggataaacttttaga

SEQ ID NO: 5587963 - DNA, 18 bp, Homo sapiens
cataaaggatatttcaaa

SEQ ID NO: 5587964 - DNA, 21 bp, Homo sapiens
cataaaggatatttcaaatga

SEQ ID NO: 5587965 - DNA, 23 bp, Homo sapiens
cataaaggatatttcaaatgatt

SEQ ID NO: 5587966 - DNA, 13 bp, Homo sapiens
cataaagggattt

SEQ ID NO: 5587967 - DNA, 19 bp, Homo sapiens
cataaagggtgtaggggcc

SEQ ID NO: 5587968 - DNA, 16 bp, Homo sapiens
cataaagggttgaaaa

SEQ ID NO: 5587969 - DNA, 22 bp, Homo sapiens
cataaaggtggtatgtgtgtgt

SEQ ID NO: 5587970 - DNA, 21 bp, Homo sapiens
cataaaggttattttctcctg

SEQ ID NO: 5587971 - DNA, 19 bp, Homo sapiens
cataaaggtttacagtgaa

SEQ ID NO: 5587972 - DNA, 14 bp, Homo sapiens
cataaagtaaatac

SEQ ID NO: 5587973 - DNA, 20 bp, Homo sapiens
cataaagtatgccttcctgt

SEQ ID NO: 5587974 - DNA, 16 bp, Homo sapiens
cataaagtctgagaaa

SEQ ID NO: 5587975 - DNA, 14 bp, Homo sapiens
cataaagtgagaaa

SEQ ID NO: 5587976 - DNA, 21 bp, Homo sapiens
cataaagttctctgtaattac

SEQ ID NO: 5587977 - DNA, 21 bp, Homo sapiens
cataaagttgataaagatttt

SEQ ID NO: 5587978 - DNA, 15 bp, Homo sapiens
cataaatacaaaaat

SEQ ID NO: 5587979 - DNA, 15 bp, Homo sapiens
cataaatactgtcaa

SEQ ID NO: 5587980 - DNA, 15 bp, Homo sapiens
cataaatagtaaata

SEQ ID NO: 5587981 - DNA, 12 bp, Homo sapiens
cataaatatgca

SEQ ID NO: 5587982 - DNA, 11 bp, Homo sapiens
cataaatcaac

SEQ ID NO: 5587983 - DNA, 18 bp, Homo sapiens
cataaatcatgttgttgt

SEQ ID NO: 5587984 - DNA, 16 bp, Homo sapiens
cataaatccttgatga

SEQ ID NO: 5587985 - DNA, 15 bp, Homo sapiens
cataaatctgtctga

SEQ ID NO: 5587986 - DNA, 18 bp, Homo sapiens
cataaatctgttagcatt

SEQ ID NO: 5587987 - DNA, 14 bp, Homo sapiens
cataaatgaaagaa

SEQ ID NO: 5587988 - DNA, 13 bp, Homo sapiens
cataaatgaattt

SEQ ID NO: 5587989 - DNA, 14 bp, Homo sapiens
cataaatgaggaaa

SEQ ID NO: 5587990 - DNA, 16 bp, Homo sapiens
cataaatgcagcccat

SEQ ID NO: 5587991 - DNA, 21 bp, Homo sapiens
cataaatggattaattactaa

SEQ ID NO: 5587992 - DNA, 14 bp, Homo sapiens
cataaatgtgttcc

SEQ ID NO: 5587993 - DNA, 17 bp, Homo sapiens
cataaattaatgattct

SEQ ID NO: 5587994 - DNA, 18 bp, Homo sapiens
cataaattatttctaaaa

SEQ ID NO: 5587995 - DNA, 21 bp, Homo sapiens
cataaattatttctaaaacat

SEQ ID NO: 5587996 - DNA, 22 bp, Homo sapiens
cataaattatttgattatttaa

SEQ ID NO: 5587997 - DNA, 18 bp, Homo sapiens
cataaattcaactttgta

SEQ ID NO: 5587998 - DNA, 11 bp, Homo sapiens
cataaattggc

SEQ ID NO: 5587999 - DNA, 15 bp, Homo sapiens
cataaattggctcct

SEQ ID NO: 5588000 - DNA, 20 bp, Homo sapiens
cataaattggctcctttccc

SEQ ID NO: 5588001 - DNA, 13 bp, Homo sapiens
cataaattgtaat

SEQ ID NO: 5588002 - DNA, 15 bp, Homo sapiens
cataaattgtactgt

SEQ ID NO: 5588003 - DNA, 16 bp, Homo sapiens
cataaattgtactgtt

SEQ ID NO: 5588004 - DNA, 13 bp, Homo sapiens
cataaattttaat

SEQ ID NO: 5588005 - DNA, 16 bp, Homo sapiens
cataaattttaattca

SEQ ID NO: 5588006 - DNA, 22 bp, Homo sapiens
cataaattttttgaagtcttta

SEQ ID NO: 5588007 - DNA, 21 bp, Homo sapiens
cataacaaaccatctggtgcc

SEQ ID NO: 5588008 - DNA, 16 bp, Homo sapiens
cataacaaaggcaaga

SEQ ID NO: 5588009 - DNA, 13 bp, Homo sapiens
cataacaaagggc

SEQ ID NO: 5588010 - DNA, 19 bp, Homo sapiens
cataacaattcccccatcc

SEQ ID NO: 5588011 - DNA, 15 bp, Homo sapiens
cataacaattcctct

SEQ ID NO: 5588012 - DNA, 16 bp, Homo sapiens
cataacaattcctcta

SEQ ID NO: 5588013 - DNA, 16 bp, Homo sapiens
cataacagattatgta

SEQ ID NO: 5588014 - DNA, 20 bp, Homo sapiens
cataacagattttttttgga

SEQ ID NO: 5588015 - DNA, 21 bp, Homo sapiens
cataacaggcattgcactaaa

SEQ ID NO: 5588016 - DNA, 19 bp, Homo sapiens
cataacagggtaaattatt

SEQ ID NO: 5588017 - DNA, 13 bp, Homo sapiens
cataacagtgcca

SEQ ID NO: 5588018 - DNA, 19 bp, Homo sapiens
cataacataaatctgtgaa

SEQ ID NO: 5588019 - DNA, 14 bp, Homo sapiens
cataacattgattt

SEQ ID NO: 5588020 - DNA, 22 bp, Homo sapiens
cataacattgattttaaaaata

SEQ ID NO: 5588021 - DNA, 19 bp, Homo sapiens
cataacatttaaagagatt

SEQ ID NO: 5588022 - DNA, 22 bp, Homo sapiens
cataacatttaaagagatttcc

SEQ ID NO: 5588023 - DNA, 12 bp, Homo sapiens
cataaccaaaga

SEQ ID NO: 5588024 - DNA, 13 bp, Homo sapiens
cataaccaacaat

SEQ ID NO: 5588025 - DNA, 23 bp, Homo sapiens
cataaccaacattaaaactcata

SEQ ID NO: 5588026 - DNA, 16 bp, Homo sapiens
cataaccaacatttta

SEQ ID NO: 5588027 - DNA, 14 bp, Homo sapiens
cataaccaagaaat

SEQ ID NO: 5588028 - DNA, 15 bp, Homo sapiens
cataaccaagaaata

SEQ ID NO: 5588029 - DNA, 13 bp, Homo sapiens
cataaccactgct

SEQ ID NO: 5588030 - DNA, 14 bp, Homo sapiens
cataaccactgctt

SEQ ID NO: 5588031 - DNA, 22 bp, Homo sapiens
cataaccatgtgaaaaggcaaa

SEQ ID NO: 5588032 - DNA, 18 bp, Homo sapiens
cataacccacttgtcact

SEQ ID NO: 5588033 - DNA, 16 bp, Homo sapiens
cataaccgtgaagctc

SEQ ID NO: 5588034 - DNA, 19 bp, Homo sapiens
cataaccttaaaaaggact

SEQ ID NO: 5588035 - DNA, 22 bp, Homo sapiens
cataacgccaccatcaacttaa

SEQ ID NO: 5588036 - DNA, 21 bp, Homo sapiens
cataacggttaagaaagcact

SEQ ID NO: 5588037 - DNA, 16 bp, Homo sapiens
cataacgtgcccccag

SEQ ID NO: 5588038 - DNA, 20 bp, Homo sapiens
cataacgttagactgcaata

SEQ ID NO: 5588039 - DNA, 17 bp, Homo sapiens
cataacgtttttccttt

SEQ ID NO: 5588040 - DNA, 21 bp, Homo sapiens
cataacgtttttcctttaaaa

SEQ ID NO: 5588041 - DNA, 13 bp, Homo sapiens
cataactaaattt

SEQ ID NO: 5588042 - DNA, 17 bp, Homo sapiens
cataactaaatttgata

SEQ ID NO: 5588043 - DNA, 18 bp, Homo sapiens
cataactaaatttgatac

SEQ ID NO: 5588044 - DNA, 22 bp, Homo sapiens
cataactaatacagctgagcta

SEQ ID NO: 5588045 - DNA, 18 bp, Homo sapiens
cataactaatgaattgaa

SEQ ID NO: 5588046 - DNA, 20 bp, Homo sapiens
cataactaatgaattgaaat

SEQ ID NO: 5588047 - DNA, 16 bp, Homo sapiens
cataactacagagtct

SEQ ID NO: 5588048 - DNA, 17 bp, Homo sapiens
cataactacagagtctg

SEQ ID NO: 5588049 - DNA, 13 bp, Homo sapiens
cataactagaact

SEQ ID NO: 5588050 - DNA, 15 bp, Homo sapiens
cataactagagcacg

SEQ ID NO: 5588051 - DNA, 23 bp, Homo sapiens
cataactagagtatgtgtatgta

SEQ ID NO: 5588052 - DNA, 21 bp, Homo sapiens
cataactatctttttgaaagc

SEQ ID NO: 5588053 - DNA, 20 bp, Homo sapiens
cataactcacacccctgccc

SEQ ID NO: 5588054 - DNA, 14 bp, Homo sapiens
cataactgaacatc

SEQ ID NO: 5588055 - DNA, 13 bp, Homo sapiens
cataactgacaaa

SEQ ID NO: 5588056 - DNA, 19 bp, Homo sapiens
cataactgacaaatcaagt

SEQ ID NO: 5588057 - DNA, 15 bp, Homo sapiens
cataactgatctatt

SEQ ID NO: 5588058 - DNA, 12 bp, Homo sapiens
cataactgcctt

SEQ ID NO: 5588059 - DNA, 19 bp, Homo sapiens
cataactgccttgaacctg

SEQ ID NO: 5588060 - DNA, 23 bp, Homo sapiens
cataactgccttgaacctgtgag

SEQ ID NO: 5588061 - DNA, 22 bp, Homo sapiens
cataactgctacttgctctgct

SEQ ID NO: 5588062 - DNA, 16 bp, Homo sapiens
cataactggattttga

SEQ ID NO: 5588063 - DNA, 18 bp, Homo sapiens
cataactggtttgactct

SEQ ID NO: 5588064 - DNA, 20 bp, Homo sapiens
cataactggtttgactctgt

SEQ ID NO: 5588065 - DNA, 22 bp, Homo sapiens
cataactggtttgactctgtcc

SEQ ID NO: 5588066 - DNA, 15 bp, Homo sapiens
cataactgtgattct

SEQ ID NO: 5588067 - DNA, 15 bp, Homo sapiens
cataacttaataaat

SEQ ID NO: 5588068 - DNA, 16 bp, Homo sapiens
cataacttattgctga

SEQ ID NO: 5588069 - DNA, 17 bp, Homo sapiens
cataacttcagtgcaag

SEQ ID NO: 5588070 - DNA, 20 bp, Homo sapiens
cataacttccagtatcattt

SEQ ID NO: 5588071 - DNA, 21 bp, Homo sapiens
cataacttgctgaatttcagg

SEQ ID NO: 5588072 - DNA, 16 bp, Homo sapiens
cataacttgtttgtaa

SEQ ID NO: 5588073 - DNA, 17 bp, Homo sapiens
cataacttgtttgtaaa

SEQ ID NO: 5588074 - DNA, 15 bp, Homo sapiens
cataagaaaaagaat

SEQ ID NO: 5588075 - DNA, 19 bp, Homo sapiens
cataagacaaacactgcca

SEQ ID NO: 5588076 - DNA, 14 bp, Homo sapiens
cataagaccaatct

SEQ ID NO: 5588077 - DNA, 16 bp, Homo sapiens
cataagaccctaagcc

SEQ ID NO: 5588078 - DNA, 12 bp, Homo sapiens
cataagagaaac

SEQ ID NO: 5588079 - DNA, 14 bp, Homo sapiens
cataagagaaacct

SEQ ID NO: 5588080 - DNA, 22 bp, Homo sapiens
cataagagaaagaggccagaca

SEQ ID NO: 5588081 - DNA, 16 bp, Homo sapiens
cataagagagatgaga

SEQ ID NO: 5588082 - DNA, 23 bp, Homo sapiens
cataagagccacaggtctttatg

SEQ ID NO: 5588083 - DNA, 22 bp, Homo sapiens
cataagaggagtaggccctggt

SEQ ID NO: 5588084 - DNA, 17 bp, Homo sapiens
cataagaggttctaact

SEQ ID NO: 5588085 - DNA, 18 bp, Homo sapiens
cataagagtaacagtcat

SEQ ID NO: 5588086 - DNA, 24 bp, Homo sapiens
cataagataaaatgatgttataca

SEQ ID NO: 5588087 - DNA, 15 bp, Homo sapiens
cataagatattttat

SEQ ID NO: 5588088 - DNA, 20 bp, Homo sapiens
cataagattaaaggaaggaa

SEQ ID NO: 5588089 - DNA, 22 bp, Homo sapiens
cataagattaaaggaaggaaaa

SEQ ID NO: 5588090 - DNA, 17 bp, Homo sapiens
cataagattatatacaa

SEQ ID NO: 5588091 - DNA, 16 bp, Homo sapiens
cataagattgtgaagg

SEQ ID NO: 5588092 - DNA, 15 bp, Homo sapiens
cataagcaacaattt

SEQ ID NO: 5588093 - DNA, 17 bp, Homo sapiens
cataagcaacaattttc

SEQ ID NO: 5588094 - DNA, 18 bp, Homo sapiens
cataagcaatcattttat

SEQ ID NO: 5588095 - DNA, 15 bp, Homo sapiens
cataagcacctaaaa

SEQ ID NO: 5588096 - DNA, 20 bp, Homo sapiens
cataagccaatttttctgca

SEQ ID NO: 5588097 - DNA, 23 bp, Homo sapiens
cataagcctccatttagttcttt

SEQ ID NO: 5588098 - DNA, 20 bp, Homo sapiens
cataagctactgccatcctg

SEQ ID NO: 5588099 - DNA, 19 bp, Homo sapiens
cataagctagaaaaattag

SEQ ID NO: 5588100 - DNA, 12 bp, Homo sapiens
cataagctattt

SEQ ID NO: 5588101 - DNA, 13 bp, Homo sapiens
cataagctatttt

SEQ ID NO: 5588102 - DNA, 16 bp, Homo sapiens
cataagctatttttct

SEQ ID NO: 5588103 - DNA, 21 bp, Homo sapiens
cataagctggtatcagtggtt

SEQ ID NO: 5588104 - DNA, 22 bp, Homo sapiens
cataagcttggtgacaaaattc

SEQ ID NO: 5588105 - DNA, 14 bp, Homo sapiens
cataagctttgtaa

SEQ ID NO: 5588106 - DNA, 17 bp, Homo sapiens
cataagctttgtaattc

SEQ ID NO: 5588107 - DNA, 19 bp, Homo sapiens
cataaggacgtgtgtaaat

SEQ ID NO: 5588108 - DNA, 20 bp, Homo sapiens
cataaggacgtgtgtaaata

SEQ ID NO: 5588109 - DNA, 23 bp, Homo sapiens
cataaggacgtgtgtaaatatgt

SEQ ID NO: 5588110 - DNA, 17 bp, Homo sapiens
cataaggagacttctgt

SEQ ID NO: 5588111 - DNA, 12 bp, Homo sapiens
cataaggcctgc

SEQ ID NO: 5588112 - DNA, 16 bp, Homo sapiens
cataaggcctgccctc

SEQ ID NO: 5588113 - DNA, 23 bp, Homo sapiens
cataaggctggatggcacctcag

SEQ ID NO: 5588114 - DNA, 23 bp, Homo sapiens
cataaggggtttgccatttgata

SEQ ID NO: 5588115 - DNA, 14 bp, Homo sapiens
cataagggtagccc

SEQ ID NO: 5588116 - DNA, 16 bp, Homo sapiens
cataaggtgcagtagg

SEQ ID NO: 5588117 - DNA, 15 bp, Homo sapiens
cataagtaaacaaca

SEQ ID NO: 5588118 - DNA, 20 bp, Homo sapiens
cataagtaaacaacatattt

SEQ ID NO: 5588119 - DNA, 13 bp, Homo sapiens
cataagtaaatgt

SEQ ID NO: 5588120 - DNA, 16 bp, Homo sapiens
cataagtaaatgtctt

SEQ ID NO: 5588121 - DNA, 21 bp, Homo sapiens
cataagtaacttttaaaattt

SEQ ID NO: 5588122 - DNA, 24 bp, Homo sapiens
cataagtaacttttaaaatttgtc

SEQ ID NO: 5588123 - DNA, 12 bp, Homo sapiens
cataagtaagaa

SEQ ID NO: 5588124 - DNA, 15 bp, Homo sapiens
cataagtaagaaatt

SEQ ID NO: 5588125 - DNA, 21 bp, Homo sapiens
cataagtaagacttgattggt

SEQ ID NO: 5588126 - DNA, 13 bp, Homo sapiens
cataagtaatatt

SEQ ID NO: 5588127 - DNA, 22 bp, Homo sapiens
cataagtaattcaagaaaacaa

SEQ ID NO: 5588128 - DNA, 19 bp, Homo sapiens
cataagtattatgtctctt

SEQ ID NO: 5588129 - DNA, 17 bp, Homo sapiens
cataagtatttggaatt

SEQ ID NO: 5588130 - DNA, 20 bp, Homo sapiens
cataagtcctttcaattcca

SEQ ID NO: 5588131 - DNA, 14 bp, Homo sapiens
cataagtgaattta

SEQ ID NO: 5588132 - DNA, 19 bp, Homo sapiens
cataagtgacaccaataaa

SEQ ID NO: 5588133 - DNA, 23 bp, Homo sapiens
cataagtgacaccaataaatgtt

SEQ ID NO: 5588134 - DNA, 18 bp, Homo sapiens
cataagtgacagtttaac

SEQ ID NO: 5588135 - DNA, 22 bp, Homo sapiens
catacttttgcaaaataagtaa

SEQ ID NO: 5588136 - DNA, 16 bp, Homo sapiens
catacttttggctcct

SEQ ID NO: 5588137 - DNA, 14 bp, Homo sapiens
catactttttaaaa

SEQ ID NO: 5588138 - DNA, 22 bp, Homo sapiens
catactttttaaatgtaaagat

SEQ ID NO: 5588139 - DNA, 20 bp, Homo sapiens
catagaaaaaagtagcaaat

SEQ ID NO: 5588140 - DNA, 11 bp, Homo sapiens
catagaaaaat

SEQ ID NO: 5588141 - DNA, 21 bp, Homo sapiens
catagaaaaatgatgtcttta

SEQ ID NO: 5588142 - DNA, 22 bp, Homo sapiens
catagaaaacaatctgcccacc

SEQ ID NO: 5588143 - DNA, 15 bp, Homo sapiens
catagaaaataagga

SEQ ID NO: 5588144 - DNA, 22 bp, Homo sapiens
catagaaaattgaaacacagag

SEQ ID NO: 5588145 - DNA, 15 bp, Homo sapiens
catagaaacatacac

SEQ ID NO: 5588146 - DNA, 16 bp, Homo sapiens
catagaaacatgacac

SEQ ID NO: 5588147 - DNA, 16 bp, Homo sapiens
catagaaactgaggag

SEQ ID NO: 5588148 - DNA, 11 bp, Homo sapiens
catagaaagac

SEQ ID NO: 5588149 - DNA, 23 bp, Homo sapiens
catagaaatggaaattttgctat

SEQ ID NO: 5588150 - DNA, 23 bp, Homo sapiens
catagaaatgtaggtcctcagaa

SEQ ID NO: 5588151 - DNA, 18 bp, Homo sapiens
catagaacagaaatatat

SEQ ID NO: 5588152 - DNA, 20 bp, Homo sapiens
catagaacagaaatatataa

SEQ ID NO: 5588153 - DNA, 15 bp, Homo sapiens
catagaactgggtaa

SEQ ID NO: 5588154 - DNA, 16 bp, Homo sapiens
catagaagccacatcg

SEQ ID NO: 5588155 - DNA, 16 bp, Homo sapiens
catagaaggaagtgtg

SEQ ID NO: 5588156 - DNA, 12 bp, Homo sapiens
catagaagtgtt

SEQ ID NO: 5588157 - DNA, 18 bp, Homo sapiens
catagaatagcatgttgt

SEQ ID NO: 5588158 - DNA, 17 bp, Homo sapiens
catagaatagcgacagg

SEQ ID NO: 5588159 - DNA, 13 bp, Homo sapiens
catagaattttga

SEQ ID NO: 5588160 - DNA, 16 bp, Homo sapiens
catagacaaaggcctt

SEQ ID NO: 5588161 - DNA, 18 bp, Homo sapiens
catagacaattcctccag

SEQ ID NO: 5588162 - DNA, 11 bp, Homo sapiens
catagacacag

SEQ ID NO: 5588163 - DNA, 15 bp, Homo sapiens
catagacacagtatt

SEQ ID NO: 5588164 - DNA, 23 bp, Homo sapiens
catagacagatgtggacatgcac

SEQ ID NO: 5588165 - DNA, 16 bp, Homo sapiens
catagacatgaaaggt

SEQ ID NO: 5588166 - DNA, 23 bp, Homo sapiens
catagacatggatgcgaggacca

SEQ ID NO: 5588167 - DNA, 17 bp, Homo sapiens
catagacatttcaaaat

SEQ ID NO: 5588168 - DNA, 22 bp, Homo sapiens
catagacatttcaaaattaata

SEQ ID NO: 5588169 - DNA, 19 bp, Homo sapiens
catagacccatctggaggc

SEQ ID NO: 5588170 - DNA, 16 bp, Homo sapiens
catagaccctctcaag

SEQ ID NO: 5588171 - DNA, 23 bp, Homo sapiens
catagaccctctttcttgtttgt

SEQ ID NO: 5588172 - DNA, 13 bp, Homo sapiens
catagagaaacct

SEQ ID NO: 5588173 - DNA, 13 bp, Homo sapiens
catagagaggcct

SEQ ID NO: 5588174 - DNA, 14 bp, Homo sapiens
catagagaggcctg

SEQ ID NO: 5588175 - DNA, 15 bp, Homo sapiens
catagagaggcctgc

SEQ ID NO: 5588176 - DNA, 18 bp, Homo sapiens
catagagagggagaagaa

SEQ ID NO: 5588177 - DNA, 22 bp, Homo sapiens
catagagagggagaagaagtca

SEQ ID NO: 5588178 - DNA, 16 bp, Homo sapiens
catagagatatgcaca

SEQ ID NO: 5588179 - DNA, 22 bp, Homo sapiens
catagagatatgcacacacaga

SEQ ID NO: 5588180 - DNA, 22 bp, Homo sapiens
catagagatatttaaaagacaa

SEQ ID NO: 5588181 - DNA, 14 bp, Homo sapiens
catagagatgagcc

SEQ ID NO: 5588182 - DNA, 16 bp, Homo sapiens
catagagatgagccca

SEQ ID NO: 5588183 - DNA, 20 bp, Homo sapiens
catagagatgagcccaccct

SEQ ID NO: 5588184 - DNA, 17 bp, Homo sapiens
catagagatttgtctaa

SEQ ID NO: 5588185 - DNA, 13 bp, Homo sapiens
catagagatttta

SEQ ID NO: 5588186 - DNA, 14 bp, Homo sapiens
catagagcaatgtt

SEQ ID NO: 5588187 - DNA, 18 bp, Homo sapiens
catagagccctattctct

SEQ ID NO: 5588188 - DNA, 15 bp, Homo sapiens
catagagccctggcc

SEQ ID NO: 5588189 - DNA, 17 bp, Homo sapiens
catagagccctggccag

SEQ ID NO: 5588190 - DNA, 22 bp, Homo sapiens
catagagccgggtgtccccaac

SEQ ID NO: 5588191 - DNA, 23 bp, Homo sapiens
catagagctttttaatagcacta

SEQ ID NO: 5588192 - DNA, 19 bp, Homo sapiens
catagaggcccaggcacca

SEQ ID NO: 5588193 - DNA, 21 bp, Homo sapiens
catagaggcttctccgccagc

SEQ ID NO: 5588194 - DNA, 23 bp, Homo sapiens
catagaggcttctccgccagcct

SEQ ID NO: 5588195 - DNA, 18 bp, Homo sapiens
catagagggagaggaagc

SEQ ID NO: 5588196 - DNA, 21 bp, Homo sapiens
catagagggagaggaagcaca

SEQ ID NO: 5588197 - DNA, 16 bp, Homo sapiens
catagaggttttgtat

SEQ ID NO: 5588198 - DNA, 17 bp, Homo sapiens
catagagtacactgcct

SEQ ID NO: 5588199 - DNA, 19 bp, Homo sapiens
catagagtacactgcctgc

SEQ ID NO: 5588200 - DNA, 17 bp, Homo sapiens
catagagtcccccctcc

SEQ ID NO: 5588201 - DNA, 23 bp, Homo sapiens
catagagtgactccaagaacaat

SEQ ID NO: 5588202 - DNA, 13 bp, Homo sapiens
catagagtgagtt

SEQ ID NO: 5588203 - DNA, 14 bp, Homo sapiens
catagataagaact

SEQ ID NO: 5588204 - DNA, 19 bp, Homo sapiens
catagataagaactttgca

SEQ ID NO: 5588205 - DNA, 19 bp, Homo sapiens
catagataatattgtttgg

SEQ ID NO: 5588206 - DNA, 20 bp, Homo sapiens
catagataccattttgaaat

SEQ ID NO: 5588207 - DNA, 21 bp, Homo sapiens
catagataggcccctggggct

SEQ ID NO: 5588208 - DNA, 15 bp, Homo sapiens
catagatataaagcc

SEQ ID NO: 5588209 - DNA, 20 bp, Homo sapiens
catagatattggaagagaga

SEQ ID NO: 5588210 - DNA, 14 bp, Homo sapiens
catagatattttca

SEQ ID NO: 5588211 - DNA, 13 bp, Homo sapiens
catagatcagcca

SEQ ID NO: 5588212 - DNA, 14 bp, Homo sapiens
catagatcagccat

SEQ ID NO: 5588213 - DNA, 19 bp, Homo sapiens
catagatcagccattaaaa

SEQ ID NO: 5588214 - DNA, 16 bp, Homo sapiens
catagatcctaagcca

SEQ ID NO: 5588215 - DNA, 15 bp, Homo sapiens
catagatcttctgaa

SEQ ID NO: 5588216 - DNA, 19 bp, Homo sapiens
catagatgagaaaactgag

SEQ ID NO: 5588217 - DNA, 12 bp, Homo sapiens
catagatgcctg

SEQ ID NO: 5588218 - DNA, 14 bp, Homo sapiens
catagatggaccag

SEQ ID NO: 5588219 - DNA, 16 bp, Homo sapiens
catagattaatggcac

SEQ ID NO: 5588220 - DNA, 18 bp, Homo sapiens
catagattaatggcactg

SEQ ID NO: 5588221 - DNA, 14 bp, Homo sapiens
catagattattata

SEQ ID NO: 5588222 - DNA, 16 bp, Homo sapiens
catagattcacctgta

SEQ ID NO: 5588223 - DNA, 18 bp, Homo sapiens
catagattcacctgtaaa

SEQ ID NO: 5588224 - DNA, 17 bp, Homo sapiens
catagattccctgagca

SEQ ID NO: 5588225 - DNA, 20 bp, Homo sapiens
catagatttaagtgaataca

SEQ ID NO: 5588226 - DNA, 16 bp, Homo sapiens
catagatttctgattt

SEQ ID NO: 5588227 - DNA, 17 bp, Homo sapiens
catagatttctgatttt

SEQ ID NO: 5588228 - DNA, 19 bp, Homo sapiens
catagatttctgattttat

SEQ ID NO: 5588229 - DNA, 13 bp, Homo sapiens
catagcaaacttc

SEQ ID NO: 5588230 - DNA, 19 bp, Homo sapiens
catagcaagcttttgctca

SEQ ID NO: 5588231 - DNA, 21 bp, Homo sapiens
catagcacaagataaattgag

SEQ ID NO: 5588232 - DNA, 13 bp, Homo sapiens
catagcacatgtt

SEQ ID NO: 5588233 - DNA, 23 bp, Homo sapiens
catagcaccctgccctcatggga

SEQ ID NO: 5588234 - DNA, 19 bp, Homo sapiens
catagcagagaatgaaagg

SEQ ID NO: 5588235 - DNA, 17 bp, Homo sapiens
catagcagaggggccag

SEQ ID NO: 5588236 - DNA, 18 bp, Homo sapiens
catagcagaggggccagg

SEQ ID NO: 5588237 - DNA, 20 bp, Homo sapiens
catagcagaggggccaggcc

SEQ ID NO: 5588238 - DNA, 21 bp, Homo sapiens
catagcagaggggccaggccc

SEQ ID NO: 5588239 - DNA, 22 bp, Homo sapiens
catagcagaggggccaggccca

SEQ ID NO: 5588240 - DNA, 17 bp, Homo sapiens
catagcagatctgtttt

SEQ ID NO: 5588241 - DNA, 17 bp, Homo sapiens
catagcagattttaatt

SEQ ID NO: 5588242 - DNA, 12 bp, Homo sapiens
catagcagcttt

SEQ ID NO: 5588243 - DNA, 17 bp, Homo sapiens
catagcataatatgaag

SEQ ID NO: 5588244 - DNA, 23 bp, Homo sapiens
catagcataatatgaagcctttg

SEQ ID NO: 5588245 - DNA, 15 bp, Homo sapiens
catagcatgacattt

SEQ ID NO: 5588246 - DNA, 18 bp, Homo sapiens
catagcatgacatttctt

SEQ ID NO: 5588247 - DNA, 19 bp, Homo sapiens
catagcatgcttcctttct

SEQ ID NO: 5588248 - DNA, 21 bp, Homo sapiens
catagcatgcttcctttctct

SEQ ID NO: 5588249 - DNA, 15 bp, Homo sapiens
catagcatgtcaact

SEQ ID NO: 5588250 - DNA, 18 bp, Homo sapiens
catagcatgtcaactttt

SEQ ID NO: 5588251 - DNA, 11 bp, Homo sapiens
catagcattca

SEQ ID NO: 5588252 - DNA, 13 bp, Homo sapiens
catagccaaacag

SEQ ID NO: 5588253 - DNA, 21 bp, Homo sapiens
catagccagcattcagcacac

SEQ ID NO: 5588254 - DNA, 22 bp, Homo sapiens
catagccagcattcagcacaca

SEQ ID NO: 5588255 - DNA, 15 bp, Homo sapiens
catagccaggaaact

SEQ ID NO: 5588256 - DNA, 18 bp, Homo sapiens
catagccagttctgacag

SEQ ID NO: 5588257 - DNA, 16 bp, Homo sapiens
catagcccagacacag

SEQ ID NO: 5588258 - DNA, 23 bp, Homo sapiens
catagcccatccctgcctggtca

SEQ ID NO: 5588259 - DNA, 19 bp, Homo sapiens
catagcccatgttaagtcc

SEQ ID NO: 5588260 - DNA, 23 bp, Homo sapiens
catagccccaggcccgccctgcc

SEQ ID NO: 5588261 - DNA, 19 bp, Homo sapiens
catagccccggccccccgc

SEQ ID NO: 5588262 - DNA, 16 bp, Homo sapiens
catagcccctgccccg

SEQ ID NO: 5588263 - DNA, 12 bp, Homo sapiens
catagccctcac

SEQ ID NO: 5588264 - DNA, 15 bp, Homo sapiens
catagccctcctgag

SEQ ID NO: 5588265 - DNA, 22 bp, Homo sapiens
catagccctggtgctcctgccc

SEQ ID NO: 5588266 - DNA, 15 bp, Homo sapiens
catagccctgttgac

SEQ ID NO: 5588267 - DNA, 19 bp, Homo sapiens
catagcctaatccctgggc

SEQ ID NO: 5588268 - DNA, 15 bp, Homo sapiens
catagcctatattta

SEQ ID NO: 5588269 - DNA, 23 bp, Homo sapiens
catagcctccaaacatgttccca

SEQ ID NO: 5588270 - DNA, 19 bp, Homo sapiens
catagcctccacggagagc

SEQ ID NO: 5588271 - DNA, 21 bp, Homo sapiens
catagccttggggttggacat

SEQ ID NO: 5588272 - DNA, 11 bp, Homo sapiens
catagcctttg

SEQ ID NO: 5588273 - DNA, 15 bp, Homo sapiens
catagcgctggctca

SEQ ID NO: 5588274 - DNA, 16 bp, Homo sapiens
catagcgctggctcag

SEQ ID NO: 5588275 - DNA, 19 bp, Homo sapiens
catagcgtcctgccctgcc

SEQ ID NO: 5588276 - DNA, 20 bp, Homo sapiens
catagcgtcctgccctgccc

SEQ ID NO: 5588277 - DNA, 17 bp, Homo sapiens
catagctacatcagttt

SEQ ID NO: 5588278 - DNA, 17 bp, Homo sapiens
catagctattttccttg

SEQ ID NO: 5588279 - DNA, 18 bp, Homo sapiens
catagctcaagaattgtt

SEQ ID NO: 5588280 - DNA, 13 bp, Homo sapiens
catagctcaataa

SEQ ID NO: 5588281 - DNA, 19 bp, Homo sapiens
catagctcaataaaagaat

SEQ ID NO: 5588282 - DNA, 17 bp, Homo sapiens
catagctcactgcagcc

SEQ ID NO: 5588283 - DNA, 18 bp, Homo sapiens
catagctcactgcagcct

SEQ ID NO: 5588284 - DNA, 18 bp, Homo sapiens
catagctccttcccagga

SEQ ID NO: 5588285 - DNA, 20 bp, Homo sapiens
catagctccttggagcaggc

SEQ ID NO: 5588286 - DNA, 14 bp, Homo sapiens
catagctctccttc

SEQ ID NO: 5588287 - DNA, 16 bp, Homo sapiens
catagctctgtacatc

SEQ ID NO: 5588288 - DNA, 13 bp, Homo sapiens
catagctgctgcc

SEQ ID NO: 5588289 - DNA, 14 bp, Homo sapiens
catagctggttaac

SEQ ID NO: 5588290 - DNA, 20 bp, Homo sapiens
catagctggttcctgctaga

SEQ ID NO: 5588291 - DNA, 21 bp, Homo sapiens
catagctgtacttcttgaata

SEQ ID NO: 5588292 - DNA, 15 bp, Homo sapiens
catagctgtgatttt

SEQ ID NO: 5588293 - DNA, 22 bp, Homo sapiens
catagcttacaagccagctgga

SEQ ID NO: 5588294 - DNA, 18 bp, Homo sapiens
catagcttattattgaag

SEQ ID NO: 5588295 - DNA, 20 bp, Homo sapiens
catagctttagagaagccat

SEQ ID NO: 5588296 - DNA, 21 bp, Homo sapiens
catagctttagagaagccata

SEQ ID NO: 5588297 - DNA, 18 bp, Homo sapiens
cataggaacatgtagttt

SEQ ID NO: 5588298 - DNA, 21 bp, Homo sapiens
cataggaagacataaaacttt

SEQ ID NO: 5588299 - DNA, 17 bp, Homo sapiens
cataggaagtggctggt

SEQ ID NO: 5588300 - DNA, 21 bp, Homo sapiens
cataggaagtggctggtctgg

SEQ ID NO: 5588301 - DNA, 20 bp, Homo sapiens
cataggaagttagcctttat

SEQ ID NO: 5588302 - DNA, 14 bp, Homo sapiens
cataggaattaaat

SEQ ID NO: 5588303 - DNA, 22 bp, Homo sapiens
cataggacctgcatccttcctg

SEQ ID NO: 5588304 - DNA, 16 bp, Homo sapiens
cataggactctttggt

SEQ ID NO: 5588305 - DNA, 16 bp, Homo sapiens
cataggagtttggagg

SEQ ID NO: 5588306 - DNA, 19 bp, Homo sapiens
cataggagtttggaggaag

SEQ ID NO: 5588307 - DNA, 18 bp, Homo sapiens
cataggcaatatctttaa

SEQ ID NO: 5588308 - DNA, 20 bp, Homo sapiens
cataggcaccttttactgtg

SEQ ID NO: 5588309 - DNA, 13 bp, Homo sapiens
cataggcagagcc

SEQ ID NO: 5588310 - DNA, 21 bp, Homo sapiens
cataggcagagcccgcccacc

SEQ ID NO: 5588311 - DNA, 18 bp, Homo sapiens
cataggcatcatttcaca

SEQ ID NO: 5588312 - DNA, 17 bp, Homo sapiens
catatgtaacagtcaaa

SEQ ID NO: 5588313 - DNA, 14 bp, Homo sapiens
catatgtacagaag

SEQ ID NO: 5588314 - DNA, 15 bp, Homo sapiens
catatgtaccatgta

SEQ ID NO: 5588315 - DNA, 17 bp, Homo sapiens
catatgtacttgtttgc

SEQ ID NO: 5588316 - DNA, 17 bp, Homo sapiens
catatgtagaaacattt

SEQ ID NO: 5588317 - DNA, 18 bp, Homo sapiens
catatgtagaaacattta

SEQ ID NO: 5588318 - DNA, 12 bp, Homo sapiens
catatgtagcat

SEQ ID NO: 5588319 - DNA, 24 bp, Homo sapiens
catatgtagccttcacacagatag

SEQ ID NO: 5588320 - DNA, 18 bp, Homo sapiens
catatgtaggaaaatttt

SEQ ID NO: 5588321 - DNA, 12 bp, Homo sapiens
catatgtatact

SEQ ID NO: 5588322 - DNA, 21 bp, Homo sapiens
catatgtatctaaatgaaaag

SEQ ID NO: 5588323 - DNA, 15 bp, Homo sapiens
catatgtatctttgg

SEQ ID NO: 5588324 - DNA, 13 bp, Homo sapiens
catatgtatgtgt

SEQ ID NO: 5588325 - DNA, 16 bp, Homo sapiens
catatgtcactagaat

SEQ ID NO: 5588326 - DNA, 21 bp, Homo sapiens
catatgtcactagaatggata

SEQ ID NO: 5588327 - DNA, 22 bp, Homo sapiens
catatgtctataacaaaagcaa

SEQ ID NO: 5588328 - DNA, 17 bp, Homo sapiens
catatgtctgcttctgt

SEQ ID NO: 5588329 - DNA, 13 bp, Homo sapiens
catatgtctgtct

SEQ ID NO: 5588330 - DNA, 18 bp, Homo sapiens
catatgtctgtctttgca

SEQ ID NO: 5588331 - DNA, 21 bp, Homo sapiens
catatgtgaagacagagcaga

SEQ ID NO: 5588332 - DNA, 21 bp, Homo sapiens
catatgtgagtgaaagtactt

SEQ ID NO: 5588333 - DNA, 15 bp, Homo sapiens
catatgtgatctgtc

SEQ ID NO: 5588334 - DNA, 13 bp, Homo sapiens
catatgtggaaat

SEQ ID NO: 5588335 - DNA, 15 bp, Homo sapiens
catatgttaaagctt

SEQ ID NO: 5588336 - DNA, 19 bp, Homo sapiens
catatgttaataaactgca

SEQ ID NO: 5588337 - DNA, 15 bp, Homo sapiens
catatgttacactaa

SEQ ID NO: 5588338 - DNA, 23 bp, Homo sapiens
catatgttagcattaaagttcta

SEQ ID NO: 5588339 - DNA, 20 bp, Homo sapiens
catatgttccatgcctggcc

SEQ ID NO: 5588340 - DNA, 12 bp, Homo sapiens
catatgttgcaa

SEQ ID NO: 5588341 - DNA, 16 bp, Homo sapiens
catatgttgctcagtc

SEQ ID NO: 5588342 - DNA, 21 bp, Homo sapiens
catatgtttattcaaaatatt

SEQ ID NO: 5588343 - DNA, 21 bp, Homo sapiens
catatgtttccccatctctgt

SEQ ID NO: 5588344 - DNA, 19 bp, Homo sapiens
catatgttttccacataaa

SEQ ID NO: 5588345 - DNA, 23 bp, Homo sapiens
catattaaaattacagatgtgaa

SEQ ID NO: 5588346 - DNA, 16 bp, Homo sapiens
catattaaacaaaaac

SEQ ID NO: 5588347 - DNA, 15 bp, Homo sapiens
catattaaacttctg

SEQ ID NO: 5588348 - DNA, 18 bp, Homo sapiens
catattaaagataagact

SEQ ID NO: 5588349 - DNA, 18 bp, Homo sapiens
catattaaaggcttttgg

SEQ ID NO: 5588350 - DNA, 15 bp, Homo sapiens
catattaaataataa

SEQ ID NO: 5588351 - DNA, 14 bp, Homo sapiens
catattaacaaatt

SEQ ID NO: 5588352 - DNA, 18 bp, Homo sapiens
catattaacaaattgcat

SEQ ID NO: 5588353 - DNA, 19 bp, Homo sapiens
catattaacaaattgcatt

SEQ ID NO: 5588354 - DNA, 20 bp, Homo sapiens
catattaagaatagtctctg

SEQ ID NO: 5588355 - DNA, 13 bp, Homo sapiens
catattaagaatg

SEQ ID NO: 5588356 - DNA, 22 bp, Homo sapiens
catattaagacagtgtacaaaa

SEQ ID NO: 5588357 - DNA, 20 bp, Homo sapiens
catattaagcactttaagct

SEQ ID NO: 5588358 - DNA, 14 bp, Homo sapiens
catattaatacaat

SEQ ID NO: 5588359 - DNA, 19 bp, Homo sapiens
catattaatataagtttct

SEQ ID NO: 5588360 - DNA, 17 bp, Homo sapiens
catattacaatatttgt

SEQ ID NO: 5588361 - DNA, 16 bp, Homo sapiens
catattaccagaaaat

SEQ ID NO: 5588362 - DNA, 15 bp, Homo sapiens
catattacctggatt

SEQ ID NO: 5588363 - DNA, 22 bp, Homo sapiens
catattacgttgtttcttatag

SEQ ID NO: 5588364 - DNA, 19 bp, Homo sapiens
catattactccacaccttt

SEQ ID NO: 5588365 - DNA, 16 bp, Homo sapiens
catattactgttgcat

SEQ ID NO: 5588366 - DNA, 21 bp, Homo sapiens
catattactgttgcatttact

SEQ ID NO: 5588367 - DNA, 16 bp, Homo sapiens
catattagaaaacttt

SEQ ID NO: 5588368 - DNA, 18 bp, Homo sapiens
catattagaaaactttgt

SEQ ID NO: 5588369 - DNA, 19 bp, Homo sapiens
catattagcgacaacagat

SEQ ID NO: 5588370 - DNA, 18 bp, Homo sapiens
catattagtattaatact

SEQ ID NO: 5588371 - DNA, 21 bp, Homo sapiens
catattataaaggataaagaa

SEQ ID NO: 5588372 - DNA, 14 bp, Homo sapiens
catattataaataa

SEQ ID NO: 5588373 - DNA, 15 bp, Homo sapiens
catattataaataaa

SEQ ID NO: 5588374 - DNA, 15 bp, Homo sapiens
catattatgcctgaa

SEQ ID NO: 5588375 - DNA, 15 bp, Homo sapiens
catattatttcattg

SEQ ID NO: 5588376 - DNA, 20 bp, Homo sapiens
catattattttagtgtgtaa

SEQ ID NO: 5588377 - DNA, 21 bp, Homo sapiens
catattattttagtgtgtaaa

SEQ ID NO: 5588378 - DNA, 22 bp, Homo sapiens
catattattttagtgtgtaaaa

SEQ ID NO: 5588379 - DNA, 21 bp, Homo sapiens
catattattttatgttgcata

SEQ ID NO: 5588380 - DNA, 14 bp, Homo sapiens
catattatttttaa

SEQ ID NO: 5588381 - DNA, 19 bp, Homo sapiens
catattcaaagtatataca

SEQ ID NO: 5588382 - DNA, 22 bp, Homo sapiens
catattcaaagtatatacagag

SEQ ID NO: 5588383 - DNA, 14 bp, Homo sapiens
catattcaacacac

SEQ ID NO: 5588384 - DNA, 20 bp, Homo sapiens
catattcaactattcttcat

SEQ ID NO: 5588385 - DNA, 14 bp, Homo sapiens
catattcacacctc

SEQ ID NO: 5588386 - DNA, 22 bp, Homo sapiens
catattcacagtgaacataact

SEQ ID NO: 5588387 - DNA, 15 bp, Homo sapiens
catattcaggaagct

SEQ ID NO: 5588388 - DNA, 22 bp, Homo sapiens
catattcctgcagcctggaggc

SEQ ID NO: 5588389 - DNA, 12 bp, Homo sapiens
catattcctgcc

SEQ ID NO: 5588390 - DNA, 12 bp, Homo sapiens
catattcctttg

SEQ ID NO: 5588391 - DNA, 17 bp, Homo sapiens
catattctaaaaccatt

SEQ ID NO: 5588392 - DNA, 17 bp, Homo sapiens
catattctcatggcttt

SEQ ID NO: 5588393 - DNA, 13 bp, Homo sapiens
catattctgtctg

SEQ ID NO: 5588394 - DNA, 15 bp, Homo sapiens
catattcttgtgctt

SEQ ID NO: 5588395 - DNA, 17 bp, Homo sapiens
catattctttcaattct

SEQ ID NO: 5588396 - DNA, 15 bp, Homo sapiens
catattgaaaagcac

SEQ ID NO: 5588397 - DNA, 16 bp, Homo sapiens
catattgaaaagcaca

SEQ ID NO: 5588398 - DNA, 13 bp, Homo sapiens
catattgactttt

SEQ ID NO: 5588399 - DNA, 20 bp, Homo sapiens
catattgagaacctaatgca

SEQ ID NO: 5588400 - DNA, 19 bp, Homo sapiens
catattgagaataattatt

SEQ ID NO: 5588401 - DNA, 21 bp, Homo sapiens
catattgagatcagcattcaa

SEQ ID NO: 5588402 - DNA, 15 bp, Homo sapiens
catattgataataaa

SEQ ID NO: 5588403 - DNA, 19 bp, Homo sapiens
catattgatagatgcaaga

SEQ ID NO: 5588404 - DNA, 21 bp, Homo sapiens
catattgatctttttatcatg

SEQ ID NO: 5588405 - DNA, 20 bp, Homo sapiens
catattgatgaaaagattta

SEQ ID NO: 5588406 - DNA, 17 bp, Homo sapiens
catattgatttccgtta

SEQ ID NO: 5588407 - DNA, 21 bp, Homo sapiens
catattgatttccgttaaaat

SEQ ID NO: 5588408 - DNA, 17 bp, Homo sapiens
catattgcacatgtctt

SEQ ID NO: 5588409 - DNA, 23 bp, Homo sapiens
catattgcacatgtcttaatgaa

SEQ ID NO: 5588410 - DNA, 21 bp, Homo sapiens
catattgcatactattaaaca

SEQ ID NO: 5588411 - DNA, 22 bp, Homo sapiens
catattgcatactattaaacat

SEQ ID NO: 5588412 - DNA, 22 bp, Homo sapiens
catattgctatctaatggggaa

SEQ ID NO: 5588413 - DNA, 14 bp, Homo sapiens
catattgctcttaa

SEQ ID NO: 5588414 - DNA, 18 bp, Homo sapiens
catattgctcttaaaaat

SEQ ID NO: 5588415 - DNA, 16 bp, Homo sapiens
catattgctgagagaa

SEQ ID NO: 5588416 - DNA, 13 bp, Homo sapiens
catattgcttttt

SEQ ID NO: 5588417 - DNA, 17 bp, Homo sapiens
catattgggtaatgttt

SEQ ID NO: 5588418 - DNA, 17 bp, Homo sapiens
catattgtaaaacaggt

SEQ ID NO: 5588419 - DNA, 14 bp, Homo sapiens
catattgtacactt

SEQ ID NO: 5588420 - DNA, 23 bp, Homo sapiens
catattgtacacttttttgggga

SEQ ID NO: 5588421 - DNA, 13 bp, Homo sapiens
catattgtatgta

SEQ ID NO: 5588422 - DNA, 16 bp, Homo sapiens
catattgtatgtaagt

SEQ ID NO: 5588423 - DNA, 18 bp, Homo sapiens
catattgtatgtaagtaa

SEQ ID NO: 5588424 - DNA, 21 bp, Homo sapiens
catattgtgccaatatgtatt

SEQ ID NO: 5588425 - DNA, 22 bp, Homo sapiens
catattgtgccaatatgtattg

SEQ ID NO: 5588426 - DNA, 23 bp, Homo sapiens
catattgtgcttcacagtagagc

SEQ ID NO: 5588427 - DNA, 21 bp, Homo sapiens
catattgtgtaatttaagtga

SEQ ID NO: 5588428 - DNA, 19 bp, Homo sapiens
catattgttactggtacca

SEQ ID NO: 5588429 - DNA, 23 bp, Homo sapiens
catattgttagggtcagccattt

SEQ ID NO: 5588430 - DNA, 14 bp, Homo sapiens
catattgttattat

SEQ ID NO: 5588431 - DNA, 16 bp, Homo sapiens
catattgttgaaaggt

SEQ ID NO: 5588432 - DNA, 18 bp, Homo sapiens
catattgtttcagtgttc

SEQ ID NO: 5588433 - DNA, 18 bp, Homo sapiens
catattgttttaaaataa

SEQ ID NO: 5588434 - DNA, 15 bp, Homo sapiens
catatttaaagccaa

SEQ ID NO: 5588435 - DNA, 13 bp, Homo sapiens
catatttaaaggg

SEQ ID NO: 5588436 - DNA, 14 bp, Homo sapiens
catatttaaaggga

SEQ ID NO: 5588437 - DNA, 14 bp, Homo sapiens
catatttaactggt

SEQ ID NO: 5588438 - DNA, 17 bp, Homo sapiens
catatttaataatgctt

SEQ ID NO: 5588439 - DNA, 22 bp, Homo sapiens
catatttaataggataaattaa

SEQ ID NO: 5588440 - DNA, 15 bp, Homo sapiens
catatttaatgtttt

SEQ ID NO: 5588441 - DNA, 18 bp, Homo sapiens
catatttaatgttttaaa

SEQ ID NO: 5588442 - DNA, 23 bp, Homo sapiens
catatttaatgttttaaatgtac

SEQ ID NO: 5588443 - DNA, 20 bp, Homo sapiens
catatttacattctagttca

SEQ ID NO: 5588444 - DNA, 16 bp, Homo sapiens
catatttacctcagcc

SEQ ID NO: 5588445 - DNA, 16 bp, Homo sapiens
catatttactacctta

SEQ ID NO: 5588446 - DNA, 14 bp, Homo sapiens
catatttacttctt

SEQ ID NO: 5588447 - DNA, 15 bp, Homo sapiens
catatttagtatacc

SEQ ID NO: 5588448 - DNA, 23 bp, Homo sapiens
catatttagtataccagagaagg

SEQ ID NO: 5588449 - DNA, 17 bp, Homo sapiens
catatttataaaaataa

SEQ ID NO: 5588450 - DNA, 14 bp, Homo sapiens
catatttataagag

SEQ ID NO: 5588451 - DNA, 19 bp, Homo sapiens
catatttatagagttatta

SEQ ID NO: 5588452 - DNA, 21 bp, Homo sapiens
catatttattgcattgctggt

SEQ ID NO: 5588453 - DNA, 23 bp, Homo sapiens
catatttatttttacctgctttt

SEQ ID NO: 5588454 - DNA, 12 bp, Homo sapiens
catatttcaatt

SEQ ID NO: 5588455 - DNA, 14 bp, Homo sapiens
catatttcataagc

SEQ ID NO: 5588456 - DNA, 21 bp, Homo sapiens
catatttcataagcacatcca

SEQ ID NO: 5588457 - DNA, 14 bp, Homo sapiens
catatttcatgttg

SEQ ID NO: 5588458 - DNA, 13 bp, Homo sapiens
catatttccaata

SEQ ID NO: 5588459 - DNA, 23 bp, Homo sapiens
catatttctgtatatttgtcatg

SEQ ID NO: 5588460 - DNA, 23 bp, Homo sapiens
catatttctgtggagggttgcca

SEQ ID NO: 5588461 - DNA, 16 bp, Homo sapiens
catatttgaagggtct

SEQ ID NO: 5588462 - DNA, 17 bp, Homo sapiens
catatttgatttctaat

SEQ ID NO: 5588463 - DNA, 23 bp, Homo sapiens
catatttgatttctaattgtaag

SEQ ID NO: 5588464 - DNA, 15 bp, Homo sapiens
catatttgcaataaa

SEQ ID NO: 5588465 - DNA, 16 bp, Homo sapiens
catatttgcaataaaa

SEQ ID NO: 5588466 - DNA, 18 bp, Homo sapiens
catatttgccaataaagc

SEQ ID NO: 5588467 - DNA, 19 bp, Homo sapiens
catatttgccaataaagct

SEQ ID NO: 5588468 - DNA, 21 bp, Homo sapiens
catatttgccaataaagcttt

SEQ ID NO: 5588469 - DNA, 15 bp, Homo sapiens
catatttggaagaaa

SEQ ID NO: 5588470 - DNA, 19 bp, Homo sapiens
catatttggtgatgagact

SEQ ID NO: 5588471 - DNA, 18 bp, Homo sapiens
catatttgtaaaatgaca

SEQ ID NO: 5588472 - DNA, 23 bp, Homo sapiens
catatttgtactttctgttaaaa

SEQ ID NO: 5588473 - DNA, 19 bp, Homo sapiens
catatttgtatgtttttct

SEQ ID NO: 5588474 - DNA, 22 bp, Homo sapiens
catatttgtatgtttttctgta

SEQ ID NO: 5588475 - DNA, 17 bp, Homo sapiens
catatttgtctttgaat

SEQ ID NO: 5588476 - DNA, 21 bp, Homo sapiens
catatttgtggcccgtgcagc

SEQ ID NO: 5588477 - DNA, 20 bp, Homo sapiens
catatttgttaaatatttac

SEQ ID NO: 5588478 - DNA, 16 bp, Homo sapiens
catatttgttacttta

SEQ ID NO: 5588479 - DNA, 15 bp, Homo sapiens
catattttaaaaaat

SEQ ID NO: 5588480 - DNA, 21 bp, Homo sapiens
catattttaaaagagaaaaac

SEQ ID NO: 5588481 - DNA, 17 bp, Homo sapiens
catattttaaacagagg

SEQ ID NO: 5588482 - DNA, 14 bp, Homo sapiens
catattttaatttc

SEQ ID NO: 5588483 - DNA, 16 bp, Homo sapiens
catattttaatttcaa

SEQ ID NO: 5588484 - DNA, 13 bp, Homo sapiens
catattttacatc

SEQ ID NO: 5588485 - DNA, 18 bp, Homo sapiens
catattttacttggaaat

SEQ ID NO: 5588486 - DNA, 22 bp, Homo sapiens
catattttacttggaaatatta

SEQ ID NO: 5588487 - DNA, 18 bp, Homo sapiens
catattttattactgttt

SEQ ID NO: 5588488 - DNA, 16 bp, Homo sapiens
catattttattgtatt

SEQ ID NO: 5588489 - DNA, 20 bp, Homo sapiens
catcatattgtatgtaagta

SEQ ID NO: 5588490 - DNA, 13 bp, Homo sapiens
catcatcaaggca

SEQ ID NO: 5588491 - DNA, 18 bp, Homo sapiens
catcatcacgacacattt

SEQ ID NO: 5588492 - DNA, 14 bp, Homo sapiens
catcatcactgtaa

SEQ ID NO: 5588493 - DNA, 12 bp, Homo sapiens
catcatcagagc

SEQ ID NO: 5588494 - DNA, 15 bp, Homo sapiens
catcatcatggccag

SEQ ID NO: 5588495 - DNA, 16 bp, Homo sapiens
catcatccagatgtgg

SEQ ID NO: 5588496 - DNA, 18 bp, Homo sapiens
catcatccattctctctg

SEQ ID NO: 5588497 - DNA, 13 bp, Homo sapiens
catcatcccagct

SEQ ID NO: 5588498 - DNA, 16 bp, Homo sapiens
catcatcctaagctat

SEQ ID NO: 5588499 - DNA, 13 bp, Homo sapiens
catcatcctctgg

SEQ ID NO: 5588500 - DNA, 14 bp, Homo sapiens
catcatcctttgtt

SEQ ID NO: 5588501 - DNA, 14 bp, Homo sapiens
catcatctctgaag

SEQ ID NO: 5588502 - DNA, 12 bp, Homo sapiens
catcatctctgc

SEQ ID NO: 5588503 - DNA, 15 bp, Homo sapiens
catcatctctgcctt

SEQ ID NO: 5588504 - DNA, 22 bp, Homo sapiens
catcatctctgcctttgagtgt

SEQ ID NO: 5588505 - DNA, 15 bp, Homo sapiens
catcatctcttcctc

SEQ ID NO: 5588506 - DNA, 18 bp, Homo sapiens
catcatctcttcctcaca

SEQ ID NO: 5588507 - DNA, 19 bp, Homo sapiens
catcatctcttttcccact

SEQ ID NO: 5588508 - DNA, 13 bp, Homo sapiens
catcatctgctgc

SEQ ID NO: 5588509 - DNA, 22 bp, Homo sapiens
catcatctgggaacttgtcaca

SEQ ID NO: 5588510 - DNA, 20 bp, Homo sapiens
catcatctgtttgtaatcat

SEQ ID NO: 5588511 - DNA, 21 bp, Homo sapiens
catcatcttagactttgcaag

SEQ ID NO: 5588512 - DNA, 21 bp, Homo sapiens
catcatgagccgttgctaatg

SEQ ID NO: 5588513 - DNA, 18 bp, Homo sapiens
catcatgatggaaaaaat

SEQ ID NO: 5588514 - DNA, 13 bp, Homo sapiens
catcatgccctct

SEQ ID NO: 5588515 - DNA, 13 bp, Homo sapiens
catcatgcctctg

SEQ ID NO: 5588516 - DNA, 19 bp, Homo sapiens
catcatgcctctgaggcca

SEQ ID NO: 5588517 - DNA, 14 bp, Homo sapiens
catcatgccttgat

SEQ ID NO: 5588518 - DNA, 16 bp, Homo sapiens
catcatggaccaaatg

SEQ ID NO: 5588519 - DNA, 21 bp, Homo sapiens
catcatggactgagctggggg

SEQ ID NO: 5588520 - DNA, 14 bp, Homo sapiens
catcatggccagct

SEQ ID NO: 5588521 - DNA, 21 bp, Homo sapiens
catcatggccagctggaggca

SEQ ID NO: 5588522 - DNA, 21 bp, Homo sapiens
catcatggggggagcaccctg

SEQ ID NO: 5588523 - DNA, 17 bp, Homo sapiens
catcatggtttttgaag

SEQ ID NO: 5588524 - DNA, 20 bp, Homo sapiens
catcatgtaaattaccagta

SEQ ID NO: 5588525 - DNA, 21 bp, Homo sapiens
catcatgtaatagtggctttc

SEQ ID NO: 5588526 - DNA, 10 bp, Homo sapiens
catcatgtca

SEQ ID NO: 5588527 - DNA, 22 bp, Homo sapiens
catcatgtcctatagtttgtca

SEQ ID NO: 5588528 - DNA, 17 bp, Homo sapiens
catcatgtctgtatact

SEQ ID NO: 5588529 - DNA, 22 bp, Homo sapiens
catcatgtggccccacccaatc

SEQ ID NO: 5588530 - DNA, 13 bp, Homo sapiens
catcatgtttaca

SEQ ID NO: 5588531 - DNA, 21 bp, Homo sapiens
catcatgtttacagaggacag

SEQ ID NO: 5588532 - DNA, 23 bp, Homo sapiens
catcattaaaggaaacgtggcag

SEQ ID NO: 5588533 - DNA, 16 bp, Homo sapiens
catcattaagaataat

SEQ ID NO: 5588534 - DNA, 21 bp, Homo sapiens
catcattaataagtgaagaat

SEQ ID NO: 5588535 - DNA, 13 bp, Homo sapiens
catcattagaaca

SEQ ID NO: 5588536 - DNA, 14 bp, Homo sapiens
catcattagaacaa

SEQ ID NO: 5588537 - DNA, 12 bp, Homo sapiens
catcattattat

SEQ ID NO: 5588538 - DNA, 15 bp, Homo sapiens
catcattattgtagt

SEQ ID NO: 5588539 - DNA, 17 bp, Homo sapiens
catcattattgtagttt

SEQ ID NO: 5588540 - DNA, 21 bp, Homo sapiens
catcattattgtagtttgaaa

SEQ ID NO: 5588541 - DNA, 19 bp, Homo sapiens
catcattatttatgtattg

SEQ ID NO: 5588542 - DNA, 22 bp, Homo sapiens
catcattcatccaggactgaga

SEQ ID NO: 5588543 - DNA, 11 bp, Homo sapiens
catcattccaa

SEQ ID NO: 5588544 - DNA, 15 bp, Homo sapiens
catcattcctgtcag

SEQ ID NO: 5588545 - DNA, 23 bp, Homo sapiens
catcattcctgtcagagctttca

SEQ ID NO: 5588546 - DNA, 16 bp, Homo sapiens
catcattccttctggc

SEQ ID NO: 5588547 - DNA, 17 bp, Homo sapiens
catcattccttctggcc

SEQ ID NO: 5588548 - DNA, 19 bp, Homo sapiens
catcattcctttttattta

SEQ ID NO: 5588549 - DNA, 14 bp, Homo sapiens
catcattctacata

SEQ ID NO: 5588550 - DNA, 15 bp, Homo sapiens
catcattctctgtct

SEQ ID NO: 5588551 - DNA, 16 bp, Homo sapiens
catcattctctgtctc

SEQ ID NO: 5588552 - DNA, 24 bp, Homo sapiens
catcattctctgtctcatccatca

SEQ ID NO: 5588553 - DNA, 14 bp, Homo sapiens
catcattctgtgtc

SEQ ID NO: 5588554 - DNA, 19 bp, Homo sapiens
catcattctgtgtctctgc

SEQ ID NO: 5588555 - DNA, 15 bp, Homo sapiens
catcattcttgtggg

SEQ ID NO: 5588556 - DNA, 21 bp, Homo sapiens
catcattcttgtgggagacag

SEQ ID NO: 5588557 - DNA, 23 bp, Homo sapiens
catcattcttgtgggagacagca

SEQ ID NO: 5588558 - DNA, 14 bp, Homo sapiens
catcattgaaatct

SEQ ID NO: 5588559 - DNA, 15 bp, Homo sapiens
catcattgaaatctt

SEQ ID NO: 5588560 - DNA, 20 bp, Homo sapiens
catcattgaaatctttttgc

SEQ ID NO: 5588561 - DNA, 19 bp, Homo sapiens
catcattgatgatcactgt

SEQ ID NO: 5588562 - DNA, 21 bp, Homo sapiens
catcattgatgatcactgtga

SEQ ID NO: 5588563 - DNA, 23 bp, Homo sapiens
catcattgatgatcactgtgaaa

SEQ ID NO: 5588564 - DNA, 18 bp, Homo sapiens
catcattgcacctgcagg

SEQ ID NO: 5588565 - DNA, 13 bp, Homo sapiens
catcattgcagat

SEQ ID NO: 5588566 - DNA, 20 bp, Homo sapiens
catcattggccctcattcca

SEQ ID NO: 5588567 - DNA, 19 bp, Homo sapiens
catcattgtatatatgtgt

SEQ ID NO: 5588568 - DNA, 14 bp, Homo sapiens
catcattgtcagcc

SEQ ID NO: 5588569 - DNA, 15 bp, Homo sapiens
catcattgtcagcct

SEQ ID NO: 5588570 - DNA, 12 bp, Homo sapiens
catcatttaaaa

SEQ ID NO: 5588571 - DNA, 18 bp, Homo sapiens
catcatttaaaaaaaaag

SEQ ID NO: 5588572 - DNA, 21 bp, Homo sapiens
catcatttaaaaaaaaagaat

SEQ ID NO: 5588573 - DNA, 20 bp, Homo sapiens
catcatttaaacatgcagaa

SEQ ID NO: 5588574 - DNA, 16 bp, Homo sapiens
catcatttaactgaac

SEQ ID NO: 5588575 - DNA, 12 bp, Homo sapiens
catcatttcagc

SEQ ID NO: 5588576 - DNA, 20 bp, Homo sapiens
catcatttctttttgggaga

SEQ ID NO: 5588577 - DNA, 14 bp, Homo sapiens
catcattttacagt

SEQ ID NO: 5588578 - DNA, 19 bp, Homo sapiens
catcattttctacttgttt

SEQ ID NO: 5588579 - DNA, 18 bp, Homo sapiens
catccaaaagtgaccagc

SEQ ID NO: 5588580 - DNA, 21 bp, Homo sapiens
catccaaaagtgaccagcata

SEQ ID NO: 5588581 - DNA, 21 bp, Homo sapiens
catccaaaatattttttgcaa

SEQ ID NO: 5588582 - DNA, 21 bp, Homo sapiens
catccaaacactgaggcagcc

SEQ ID NO: 5588583 - DNA, 22 bp, Homo sapiens
catccaaacactgaggcagcct

SEQ ID NO: 5588584 - DNA, 17 bp, Homo sapiens
catccaaagcagacagc

SEQ ID NO: 5588585 - DNA, 18 bp, Homo sapiens
catccaaagcagacagct

SEQ ID NO: 5588586 - DNA, 19 bp, Homo sapiens
catccaaaggctcctgaga

SEQ ID NO: 5588587 - DNA, 13 bp, Homo sapiens
catccaaagttcc

SEQ ID NO: 5588588 - DNA, 15 bp, Homo sapiens
catccaaatggctgc

SEQ ID NO: 5588589 - DNA, 13 bp, Homo sapiens
catccaacaagaa

SEQ ID NO: 5588590 - DNA, 14 bp, Homo sapiens
catccaacaagaag

SEQ ID NO: 5588591 - DNA, 15 bp, Homo sapiens
catccaacaagaaga

SEQ ID NO: 5588592 - DNA, 18 bp, Homo sapiens
catccaacaagaagaaat

SEQ ID NO: 5588593 - DNA, 19 bp, Homo sapiens
catccaacatttcctcagg

SEQ ID NO: 5588594 - DNA, 16 bp, Homo sapiens
catccaaccccccacc

SEQ ID NO: 5588595 - DNA, 15 bp, Homo sapiens
catccaactccagca

SEQ ID NO: 5588596 - DNA, 17 bp, Homo sapiens
catccaactccagcaac

SEQ ID NO: 5588597 - DNA, 15 bp, Homo sapiens
catccaactccagga

SEQ ID NO: 5588598 - DNA, 22 bp, Homo sapiens
catccaactcctggagatttca

SEQ ID NO: 5588599 - DNA, 14 bp, Homo sapiens
catccaactctaaa

SEQ ID NO: 5588600 - DNA, 16 bp, Homo sapiens
catccaagccagagtt

SEQ ID NO: 5588601 - DNA, 12 bp, Homo sapiens
catccaagctta

SEQ ID NO: 5588602 - DNA, 22 bp, Homo sapiens
catccaaggaacttcatgcttg

SEQ ID NO: 5588603 - DNA, 14 bp, Homo sapiens
catccaaggagaaa

SEQ ID NO: 5588604 - DNA, 16 bp, Homo sapiens
catccaaggcaaacaa

SEQ ID NO: 5588605 - DNA, 19 bp, Homo sapiens
catccaaggcaaacaatcc

SEQ ID NO: 5588606 - DNA, 22 bp, Homo sapiens
catccaataaaaatcaggagcc

SEQ ID NO: 5588607 - DNA, 17 bp, Homo sapiens
catccaataggaatgct

SEQ ID NO: 5588608 - DNA, 21 bp, Homo sapiens
catccaataggaatgctaaca

SEQ ID NO: 5588609 - DNA, 21 bp, Homo sapiens
catccaatcctcactgggtgg

SEQ ID NO: 5588610 - DNA, 20 bp, Homo sapiens
catccaatctaaccacatca

SEQ ID NO: 5588611 - DNA, 18 bp, Homo sapiens
catccacaataaccaaga

SEQ ID NO: 5588612 - DNA, 21 bp, Homo sapiens
catccacacaacaccaggact

SEQ ID NO: 5588613 - DNA, 18 bp, Homo sapiens
catccacacacagcagct

SEQ ID NO: 5588614 - DNA, 19 bp, Homo sapiens
catccacacacagcagctc

SEQ ID NO: 5588615 - DNA, 20 bp, Homo sapiens
catccacacacagcagctcc

SEQ ID NO: 5588616 - DNA, 22 bp, Homo sapiens
catccacacacagcagctccaa

SEQ ID NO: 5588617 - DNA, 14 bp, Homo sapiens
catccacacatgaa

SEQ ID NO: 5588618 - DNA, 15 bp, Homo sapiens
catccacaccctctc

SEQ ID NO: 5588619 - DNA, 18 bp, Homo sapiens
catccacaccctctcctt

SEQ ID NO: 5588620 - DNA, 23 bp, Homo sapiens
catccacacttaagccctcgtgc

SEQ ID NO: 5588621 - DNA, 16 bp, Homo sapiens
catccacataagcact

SEQ ID NO: 5588622 - DNA, 13 bp, Homo sapiens
catccacatgcac

SEQ ID NO: 5588623 - DNA, 21 bp, Homo sapiens
catccacatgcacatgtattc

SEQ ID NO: 5588624 - DNA, 17 bp, Homo sapiens
catccacattttaacag

SEQ ID NO: 5588625 - DNA, 20 bp, Homo sapiens
catccaccaaactcctgcct

SEQ ID NO: 5588626 - DNA, 19 bp, Homo sapiens
catccacccagtgctgcca

SEQ ID NO: 5588627 - DNA, 21 bp, Homo sapiens
catccacccagtgctgccatg

SEQ ID NO: 5588628 - DNA, 19 bp, Homo sapiens
catccaccccagccccact

SEQ ID NO: 5588629 - DNA, 23 bp, Homo sapiens
catccaccccagccccactgccc

SEQ ID NO: 5588630 - DNA, 12 bp, Homo sapiens
catccaccccat

SEQ ID NO: 5588631 - DNA, 20 bp, Homo sapiens
catccaccccggctccccct

SEQ ID NO: 5588632 - DNA, 19 bp, Homo sapiens
catccacccgctgcccctc

SEQ ID NO: 5588633 - DNA, 21 bp, Homo sapiens
catccacccgctgcccctccc

SEQ ID NO: 5588634 - DNA, 20 bp, Homo sapiens
catccaccgccaccccactg

SEQ ID NO: 5588635 - DNA, 18 bp, Homo sapiens
catccaccgctgctccac

SEQ ID NO: 5588636 - DNA, 17 bp, Homo sapiens
catccaccgtcccctcc

SEQ ID NO: 5588637 - DNA, 16 bp, Homo sapiens
catccacctccttctc

SEQ ID NO: 5588638 - DNA, 22 bp, Homo sapiens
catccacctgtcttggcctccc

SEQ ID NO: 5588639 - DNA, 17 bp, Homo sapiens
catccaccttcccttct

SEQ ID NO: 5588640 - DNA, 19 bp, Homo sapiens
catccaccttcctgcccag

SEQ ID NO: 5588641 - DNA, 20 bp, Homo sapiens
catccaccttcctgcccagg

SEQ ID NO: 5588642 - DNA, 21 bp, Homo sapiens
catccaccttggctctgccag

SEQ ID NO: 5588643 - DNA, 21 bp, Homo sapiens
catccacgtagggggcagggg

SEQ ID NO: 5588644 - DNA, 23 bp, Homo sapiens
catccacgtagggggcaggggca

SEQ ID NO: 5588645 - DNA, 16 bp, Homo sapiens
catccacgtggcctct

SEQ ID NO: 5588646 - DNA, 20 bp, Homo sapiens
catccactaggtgcccagtc

SEQ ID NO: 5588647 - DNA, 22 bp, Homo sapiens
catccactagtgcaaatcatag

SEQ ID NO: 5588648 - DNA, 14 bp, Homo sapiens
catccactctaccc

SEQ ID NO: 5588649 - DNA, 18 bp, Homo sapiens
catccactctaccctccc

SEQ ID NO: 5588650 - DNA, 23 bp, Homo sapiens
catccactgtgccatgtgccagg

SEQ ID NO: 5588651 - DNA, 20 bp, Homo sapiens
catccagaactgctaccttc

SEQ ID NO: 5588652 - DNA, 16 bp, Homo sapiens
catccagatgtggcta

SEQ ID NO: 5588653 - DNA, 20 bp, Homo sapiens
catccagatgtgtgcaatgt

SEQ ID NO: 5588654 - DNA, 12 bp, Homo sapiens
catccagcaaga

SEQ ID NO: 5588655 - DNA, 11 bp, Homo sapiens
catccagcagc

SEQ ID NO: 5588656 - DNA, 19 bp, Homo sapiens
catccagcagtctctgcct

SEQ ID NO: 5588657 - DNA, 20 bp, Homo sapiens
catccagcagtgttgctcag

SEQ ID NO: 5588658 - DNA, 13 bp, Homo sapiens
catccagccacgg

SEQ ID NO: 5588659 - DNA, 14 bp, Homo sapiens
catccagccacgga

SEQ ID NO: 5588660 - DNA, 22 bp, Homo sapiens
catccagccagaccccacgctg

SEQ ID NO: 5588661 - DNA, 14 bp, Homo sapiens
catccagcctccag

SEQ ID NO: 5588662 - DNA, 19 bp, Homo sapiens
catccagcctccagggcat

SEQ ID NO: 5588663 - DNA, 12 bp, Homo sapiens
catccagcctgt

SEQ ID NO: 5588664 - DNA, 16 bp, Homo sapiens
catccagctacttagc

SEQ ID NO: 5588665 - DNA, 22 bp, Homo sapiens
catccagctacttagctggcca

SEQ ID NO: 5588666 - DNA, 13 bp, Homo sapiens
catcggtgcctgg

SEQ ID NO: 5588667 - DNA, 14 bp, Homo sapiens
catcggtgcctggt

SEQ ID NO: 5588668 - DNA, 17 bp, Homo sapiens
catcggtgtccatttat

SEQ ID NO: 5588669 - DNA, 15 bp, Homo sapiens
catcgtaggcagcca

SEQ ID NO: 5588670 - DNA, 18 bp, Homo sapiens
catcgtaggtgatttgaa

SEQ ID NO: 5588671 - DNA, 16 bp, Homo sapiens
catcgtataaggaaat

SEQ ID NO: 5588672 - DNA, 23 bp, Homo sapiens
catcgtataaggaaatccagccc

SEQ ID NO: 5588673 - DNA, 23 bp, Homo sapiens
catcgtatttcttttttttaata

SEQ ID NO: 5588674 - DNA, 16 bp, Homo sapiens
catcgtccagccctcc

SEQ ID NO: 5588675 - DNA, 13 bp, Homo sapiens
catcgtcctggga

SEQ ID NO: 5588676 - DNA, 17 bp, Homo sapiens
catcgtctcatcctcct

SEQ ID NO: 5588677 - DNA, 17 bp, Homo sapiens
catcgtgaagaagcctg

SEQ ID NO: 5588678 - DNA, 22 bp, Homo sapiens
catcgtgggtcactacagggag

SEQ ID NO: 5588679 - DNA, 16 bp, Homo sapiens
catcgtggtgggggag

SEQ ID NO: 5588680 - DNA, 22 bp, Homo sapiens
catcgttttcttcactgtcctc

SEQ ID NO: 5588681 - DNA, 19 bp, Homo sapiens
catcgttttctttgctgtg

SEQ ID NO: 5588682 - DNA, 22 bp, Homo sapiens
catcgttttctttgctgtgcca

SEQ ID NO: 5588683 - DNA, 23 bp, Homo sapiens
catctaaaaatagacttaaatct

SEQ ID NO: 5588684 - DNA, 21 bp, Homo sapiens
catctaaaaatatacatgttt

SEQ ID NO: 5588685 - DNA, 14 bp, Homo sapiens
catctaaaatactc

SEQ ID NO: 5588686 - DNA, 17 bp, Homo sapiens
catctaaaccagaagga

SEQ ID NO: 5588687 - DNA, 18 bp, Homo sapiens
catctaaaccagaaggaa

SEQ ID NO: 5588688 - DNA, 19 bp, Homo sapiens
catctaaaccagaaggaag

SEQ ID NO: 5588689 - DNA, 17 bp, Homo sapiens
catctaaactaagatgt

SEQ ID NO: 5588690 - DNA, 20 bp, Homo sapiens
catctaaactttaatatgta

SEQ ID NO: 5588691 - DNA, 15 bp, Homo sapiens
catctaaagctttat

SEQ ID NO: 5588692 - DNA, 18 bp, Homo sapiens
catctaaagctttatctt

SEQ ID NO: 5588693 - DNA, 19 bp, Homo sapiens
catctaaataattcatctt

SEQ ID NO: 5588694 - DNA, 15 bp, Homo sapiens
catctaaatacctgc

SEQ ID NO: 5588695 - DNA, 13 bp, Homo sapiens
catctaaatatta

SEQ ID NO: 5588696 - DNA, 15 bp, Homo sapiens
catctaaatattatg

SEQ ID NO: 5588697 - DNA, 19 bp, Homo sapiens
catctaaattgatcattca

SEQ ID NO: 5588698 - DNA, 15 bp, Homo sapiens
catctaacctcatct

SEQ ID NO: 5588699 - DNA, 13 bp, Homo sapiens
catctaagacatt

SEQ ID NO: 5588700 - DNA, 19 bp, Homo sapiens
catctaagcattccacact

SEQ ID NO: 5588701 - DNA, 15 bp, Homo sapiens
catctaagctgcagc

SEQ ID NO: 5588702 - DNA, 16 bp, Homo sapiens
catctaagctgcagct

SEQ ID NO: 5588703 - DNA, 20 bp, Homo sapiens
catctaagctgcagcttcct

SEQ ID NO: 5588704 - DNA, 13 bp, Homo sapiens
catctaatgaaaa

SEQ ID NO: 5588705 - DNA, 15 bp, Homo sapiens
catctaatgaaaaac

SEQ ID NO: 5588706 - DNA, 17 bp, Homo sapiens
catctaatgcttgttta

SEQ ID NO: 5588707 - DNA, 15 bp, Homo sapiens
catctaattctgatt

SEQ ID NO: 5588708 - DNA, 14 bp, Homo sapiens
catctaattcttat

SEQ ID NO: 5588709 - DNA, 18 bp, Homo sapiens
catctacacagcctggac

SEQ ID NO: 5588710 - DNA, 19 bp, Homo sapiens
catctacctagatttaata

SEQ ID NO: 5588711 - DNA, 17 bp, Homo sapiens
catctacctgctccttg

SEQ ID NO: 5588712 - DNA, 17 bp, Homo sapiens
catctacgaagccacag

SEQ ID NO: 5588713 - DNA, 18 bp, Homo sapiens
catctacgaagccacagg

SEQ ID NO: 5588714 - DNA, 20 bp, Homo sapiens
catctacgaagccacaggcc

SEQ ID NO: 5588715 - DNA, 15 bp, Homo sapiens
catctactacagggt

SEQ ID NO: 5588716 - DNA, 19 bp, Homo sapiens
catctactcccaagtatgg

SEQ ID NO: 5588717 - DNA, 20 bp, Homo sapiens
catctactctaaagaaaaat

SEQ ID NO: 5588718 - DNA, 17 bp, Homo sapiens
catctactctggaccaa

SEQ ID NO: 5588719 - DNA, 23 bp, Homo sapiens
catctactcttttgaagtgtttt

SEQ ID NO: 5588720 - DNA, 20 bp, Homo sapiens
catctagaaagctttgaatg

SEQ ID NO: 5588721 - DNA, 19 bp, Homo sapiens
catctagaggcttccttca

SEQ ID NO: 5588722 - DNA, 15 bp, Homo sapiens
catctagcacagctg

SEQ ID NO: 5588723 - DNA, 14 bp, Homo sapiens
catctagcagctgg

SEQ ID NO: 5588724 - DNA, 15 bp, Homo sapiens
catctagcagctggc

SEQ ID NO: 5588725 - DNA, 16 bp, Homo sapiens
catctagcagctggcc

SEQ ID NO: 5588726 - DNA, 13 bp, Homo sapiens
catctagccagag

SEQ ID NO: 5588727 - DNA, 23 bp, Homo sapiens
catctagccagaggctggagaca

SEQ ID NO: 5588728 - DNA, 21 bp, Homo sapiens
catctagccagcccctcttcc

SEQ ID NO: 5588729 - DNA, 23 bp, Homo sapiens
catctagctccataattgcaagg

SEQ ID NO: 5588730 - DNA, 13 bp, Homo sapiens
catctagctggag

SEQ ID NO: 5588731 - DNA, 17 bp, Homo sapiens
catctaggtaaattaca

SEQ ID NO: 5588732 - DNA, 18 bp, Homo sapiens
catctaggtaatttttac

SEQ ID NO: 5588733 - DNA, 15 bp, Homo sapiens
catctaggtcctggc

SEQ ID NO: 5588734 - DNA, 16 bp, Homo sapiens
catctaggtcctggct

SEQ ID NO: 5588735 - DNA, 23 bp, Homo sapiens
catctagttaagtcgctgaacaa

SEQ ID NO: 5588736 - DNA, 23 bp, Homo sapiens
catctagttcccctgtttattca

SEQ ID NO: 5588737 - DNA, 20 bp, Homo sapiens
catctagtttccctggtgcc

SEQ ID NO: 5588738 - DNA, 21 bp, Homo sapiens
catctagtttccctggtgccc

SEQ ID NO: 5588739 - DNA, 14 bp, Homo sapiens
catctataaaatga

SEQ ID NO: 5588740 - DNA, 17 bp, Homo sapiens
catctatcactgcatta

SEQ ID NO: 5588741 - DNA, 14 bp, Homo sapiens
catctatcgagttt

SEQ ID NO: 5588742 - DNA, 20 bp, Homo sapiens
catctatcgagtttgcaatg

SEQ ID NO: 5588743 - DNA, 13 bp, Homo sapiens
catctatctgtgc

SEQ ID NO: 5588744 - DNA, 23 bp, Homo sapiens
catctatgagggtgtttcctcta

SEQ ID NO: 5588745 - DNA, 17 bp, Homo sapiens
catctatgctctttcct

SEQ ID NO: 5588746 - DNA, 20 bp, Homo sapiens
catctatggagggcagagtg

SEQ ID NO: 5588747 - DNA, 19 bp, Homo sapiens
catctatggttctaaatat

SEQ ID NO: 5588748 - DNA, 17 bp, Homo sapiens
catctatgtgaatattt

SEQ ID NO: 5588749 - DNA, 18 bp, Homo sapiens
catctatgtgtatgttga

SEQ ID NO: 5588750 - DNA, 16 bp, Homo sapiens
catctattcccaaaga

SEQ ID NO: 5588751 - DNA, 16 bp, Homo sapiens
catctattctctgcct

SEQ ID NO: 5588752 - DNA, 17 bp, Homo sapiens
catctattctctgcctt

SEQ ID NO: 5588753 - DNA, 22 bp, Homo sapiens
catctattctttgtaccatctg

SEQ ID NO: 5588754 - DNA, 18 bp, Homo sapiens
catctattgatagtttca

SEQ ID NO: 5588755 - DNA, 13 bp, Homo sapiens
catctatttctga

SEQ ID NO: 5588756 - DNA, 14 bp, Homo sapiens
catctatttggaac

SEQ ID NO: 5588757 - DNA, 17 bp, Homo sapiens
catctattttgatgcag

SEQ ID NO: 5588758 - DNA, 16 bp, Homo sapiens
catctcaaaacaaaac

SEQ ID NO: 5588759 - DNA, 17 bp, Homo sapiens
catctcaaaacaaaaca

SEQ ID NO: 5588760 - DNA, 16 bp, Homo sapiens
catctcaaacactgct

SEQ ID NO: 5588761 - DNA, 21 bp, Homo sapiens
catctcaatggaaacatcact

SEQ ID NO: 5588762 - DNA, 13 bp, Homo sapiens
catctcaatggca

SEQ ID NO: 5588763 - DNA, 17 bp, Homo sapiens
catctcacacatgagca

SEQ ID NO: 5588764 - DNA, 23 bp, Homo sapiens
catctcacctttttaaatcctaa

SEQ ID NO: 5588765 - DNA, 16 bp, Homo sapiens
catctcacttcagttg

SEQ ID NO: 5588766 - DNA, 17 bp, Homo sapiens
catctcacttcttcttc

SEQ ID NO: 5588767 - DNA, 13 bp, Homo sapiens
catctcactttgc

SEQ ID NO: 5588768 - DNA, 13 bp, Homo sapiens
catctcagaagat

SEQ ID NO: 5588769 - DNA, 13 bp, Homo sapiens
catctcagacctt

SEQ ID NO: 5588770 - DNA, 14 bp, Homo sapiens
catctcagaccttt

SEQ ID NO: 5588771 - DNA, 17 bp, Homo sapiens
catctcagcctcctgag

SEQ ID NO: 5588772 - DNA, 23 bp, Homo sapiens
catctcagcctcctgagcctgtg

SEQ ID NO: 5588773 - DNA, 19 bp, Homo sapiens
catctcagctcactgcaac

SEQ ID NO: 5588774 - DNA, 13 bp, Homo sapiens
catctcaggagat

SEQ ID NO: 5588775 - DNA, 21 bp, Homo sapiens
catctcaggccacctgccccc

SEQ ID NO: 5588776 - DNA, 21 bp, Homo sapiens
catctcagggaactgaccctc

SEQ ID NO: 5588777 - DNA, 19 bp, Homo sapiens
catctcaggggccagagga

SEQ ID NO: 5588778 - DNA, 18 bp, Homo sapiens
catctcagggtccagacc

SEQ ID NO: 5588779 - DNA, 19 bp, Homo sapiens
catctcagggtccagaccc

SEQ ID NO: 5588780 - DNA, 23 bp, Homo sapiens
catctcaggtggcatttgcaggt

SEQ ID NO: 5588781 - DNA, 23 bp, Homo sapiens
catctcagtcactttttcccctg

SEQ ID NO: 5588782 - DNA, 21 bp, Homo sapiens
catctcagtgaagaatacttc

SEQ ID NO: 5588783 - DNA, 18 bp, Homo sapiens
catctcagtgctgtaaaa

SEQ ID NO: 5588784 - DNA, 12 bp, Homo sapiens
catctcatcatg

SEQ ID NO: 5588785 - DNA, 15 bp, Homo sapiens
catctcatccatcaa

SEQ ID NO: 5588786 - DNA, 22 bp, Homo sapiens
catctcatcctattacttttca

SEQ ID NO: 5588787 - DNA, 16 bp, Homo sapiens
catctcatcctggcac

SEQ ID NO: 5588788 - DNA, 18 bp, Homo sapiens
catctcatgaggggagag

SEQ ID NO: 5588789 - DNA, 18 bp, Homo sapiens
catctcatgagtgtgccc

SEQ ID NO: 5588790 - DNA, 19 bp, Homo sapiens
catctcatgagtgtgcccc

SEQ ID NO: 5588791 - DNA, 22 bp, Homo sapiens
catctcatgcccctggctggga

SEQ ID NO: 5588792 - DNA, 22 bp, Homo sapiens
catctcatttaagggaaaaata

SEQ ID NO: 5588793 - DNA, 20 bp, Homo sapiens
catctcatttaatcctccct

SEQ ID NO: 5588794 - DNA, 21 bp, Homo sapiens
catctcatttgtattccattg

SEQ ID NO: 5588795 - DNA, 17 bp, Homo sapiens
catctccaaaaacagta

SEQ ID NO: 5588796 - DNA, 20 bp, Homo sapiens
catctccaaaaacagtaaaa

SEQ ID NO: 5588797 - DNA, 21 bp, Homo sapiens
catctccaaatatcagtgggc

SEQ ID NO: 5588798 - DNA, 22 bp, Homo sapiens
catctccaaatatcagtgggct

SEQ ID NO: 5588799 - DNA, 18 bp, Homo sapiens
catctccaaatcttgcca

SEQ ID NO: 5588800 - DNA, 18 bp, Homo sapiens
catctccaagaatgctga

SEQ ID NO: 5588801 - DNA, 20 bp, Homo sapiens
catctccaagaatgctgaaa

SEQ ID NO: 5588802 - DNA, 22 bp, Homo sapiens
catctccaatggaaagcttttc

SEQ ID NO: 5588803 - DNA, 16 bp, Homo sapiens
catctccagcatcctg

SEQ ID NO: 5588804 - DNA, 17 bp, Homo sapiens
catctccagcatgtaac

SEQ ID NO: 5588805 - DNA, 14 bp, Homo sapiens
catctccagggaag

SEQ ID NO: 5588806 - DNA, 15 bp, Homo sapiens
catctccagggaagc

SEQ ID NO: 5588807 - DNA, 20 bp, Homo sapiens
catctccagggagtcccctc

SEQ ID NO: 5588808 - DNA, 21 bp, Homo sapiens
catctccagtatcctgctggt

SEQ ID NO: 5588809 - DNA, 20 bp, Homo sapiens
catctccatcatatgcctga

SEQ ID NO: 5588810 - DNA, 20 bp, Homo sapiens
catctcccaaagtgctggga

SEQ ID NO: 5588811 - DNA, 12 bp, Homo sapiens
catctcccaagg

SEQ ID NO: 5588812 - DNA, 14 bp, Homo sapiens
catctcccaaggct

SEQ ID NO: 5588813 - DNA, 18 bp, Homo sapiens
catctcccaaggctgcca

SEQ ID NO: 5588814 - DNA, 15 bp, Homo sapiens
catctcccaccctgt

SEQ ID NO: 5588815 - DNA, 16 bp, Homo sapiens
catctcccaccctgta

SEQ ID NO: 5588816 - DNA, 21 bp, Homo sapiens
catctcccaccctgtacctca

SEQ ID NO: 5588817 - DNA, 18 bp, Homo sapiens
catctcccagataatgtg

SEQ ID NO: 5588818 - DNA, 22 bp, Homo sapiens
catctcccagataatgtgaaaa

SEQ ID NO: 5588819 - DNA, 18 bp, Homo sapiens
catctcccagatcctgga

SEQ ID NO: 5588820 - DNA, 22 bp, Homo sapiens
catctcccagatcctggaaaca

SEQ ID NO: 5588821 - DNA, 17 bp, Homo sapiens
catctcccaggccccag

SEQ ID NO: 5588822 - DNA, 19 bp, Homo sapiens
catctcccaggccccaggg

SEQ ID NO: 5588823 - DNA, 21 bp, Homo sapiens
catctcccaggccccagggga

SEQ ID NO: 5588824 - DNA, 22 bp, Homo sapiens
catctcccatgtgtgatgctga

SEQ ID NO: 5588825 - DNA, 23 bp, Homo sapiens
catctcccatgtgtgatgctgac

SEQ ID NO: 5588826 - DNA, 15 bp, Homo sapiens
catctccccaggcct

SEQ ID NO: 5588827 - DNA, 15 bp, Homo sapiens
catctcccccaccct

SEQ ID NO: 5588828 - DNA, 20 bp, Homo sapiens
catctcccccaccctgtgcc

SEQ ID NO: 5588829 - DNA, 21 bp, Homo sapiens
catctcccccatagcaccctg

SEQ ID NO: 5588830 - DNA, 24 bp, Homo sapiens
catctcccccatcccccactgcca

SEQ ID NO: 5588831 - DNA, 20 bp, Homo sapiens
catctcccctagctcaccag

SEQ ID NO: 5588832 - DNA, 16 bp, Homo sapiens
catctcccctcagctc

SEQ ID NO: 5588833 - DNA, 21 bp, Homo sapiens
catctcccctcagctcggctc

SEQ ID NO: 5588834 - DNA, 15 bp, Homo sapiens
catctccctccccag

SEQ ID NO: 5588835 - DNA, 18 bp, Homo sapiens
catctccctcctccaggt

SEQ ID NO: 5588836 - DNA, 23 bp, Homo sapiens
catctccctgaccttctccaggg

SEQ ID NO: 5588837 - DNA, 13 bp, Homo sapiens
catctccctgcca

SEQ ID NO: 5588838 - DNA, 16 bp, Homo sapiens
catctccctgccatcc

SEQ ID NO: 5588839 - DNA, 19 bp, Homo sapiens
catctccctgccatccccc

SEQ ID NO: 5588840 - DNA, 20 bp, Homo sapiens
catctccctgccatccccct

SEQ ID NO: 5588841 - DNA, 16 bp, Homo sapiens
catctccctgcctggc

SEQ ID NO: 5588842 - DNA, 17 bp, Homo sapiens
catcttaaatgacagtg

SEQ ID NO: 5588843 - DNA, 16 bp, Homo sapiens
catcttaactctttgc

SEQ ID NO: 5588844 - DNA, 19 bp, Homo sapiens
catcttaactctttgcctt

SEQ ID NO: 5588845 - DNA, 16 bp, Homo sapiens
catcttaacttggcta

SEQ ID NO: 5588846 - DNA, 15 bp, Homo sapiens
catcttaagagatgc

SEQ ID NO: 5588847 - DNA, 13 bp, Homo sapiens
catcttaatcttt

SEQ ID NO: 5588848 - DNA, 15 bp, Homo sapiens
catcttaatctttat

SEQ ID NO: 5588849 - DNA, 23 bp, Homo sapiens
catcttacagagactctccctga

SEQ ID NO: 5588850 - DNA, 13 bp, Homo sapiens
catcttactgaag

SEQ ID NO: 5588851 - DNA, 22 bp, Homo sapiens
catcttacttggctttttacta

SEQ ID NO: 5588852 - DNA, 22 bp, Homo sapiens
catcttaggttggcaaaaaggc

SEQ ID NO: 5588853 - DNA, 20 bp, Homo sapiens
catcttagtatttgcatatt

SEQ ID NO: 5588854 - DNA, 13 bp, Homo sapiens
catcttagtttac

SEQ ID NO: 5588855 - DNA, 19 bp, Homo sapiens
catcttatagcactttgaa

SEQ ID NO: 5588856 - DNA, 21 bp, Homo sapiens
catcttatgctaactgtagat

SEQ ID NO: 5588857 - DNA, 21 bp, Homo sapiens
catcttatttattttagcaaa

SEQ ID NO: 5588858 - DNA, 14 bp, Homo sapiens
catcttcaaagctt

SEQ ID NO: 5588859 - DNA, 22 bp, Homo sapiens
catcttcaatttattactgaaa

SEQ ID NO: 5588860 - DNA, 15 bp, Homo sapiens
catcttcacgcctgg

SEQ ID NO: 5588861 - DNA, 9 bp, Homo sapiens
catcttcag

SEQ ID NO: 5588862 - DNA, 19 bp, Homo sapiens
catcttcagctcccatagc

SEQ ID NO: 5588863 - DNA, 14 bp, Homo sapiens
catcttcagcttct

SEQ ID NO: 5588864 - DNA, 20 bp, Homo sapiens
catcttcagtcgtctgtccc

SEQ ID NO: 5588865 - DNA, 13 bp, Homo sapiens
catcttcatataa

SEQ ID NO: 5588866 - DNA, 19 bp, Homo sapiens
catcttcattaatactgtg

SEQ ID NO: 5588867 - DNA, 22 bp, Homo sapiens
catcttccaagggtactaagga

SEQ ID NO: 5588868 - DNA, 21 bp, Homo sapiens
catcttccagaagtgtgattg

SEQ ID NO: 5588869 - DNA, 14 bp, Homo sapiens
catcttccaggtgg

SEQ ID NO: 5588870 - DNA, 14 bp, Homo sapiens
catcttcccaaccc

SEQ ID NO: 5588871 - DNA, 14 bp, Homo sapiens
catcttcccagcag

SEQ ID NO: 5588872 - DNA, 23 bp, Homo sapiens
catcttccccaacgaaaagcaca

SEQ ID NO: 5588873 - DNA, 20 bp, Homo sapiens
catcttcccgcctcagcctc

SEQ ID NO: 5588874 - DNA, 11 bp, Homo sapiens
catcttccctg

SEQ ID NO: 5588875 - DNA, 13 bp, Homo sapiens
catcttcctctgc

SEQ ID NO: 5588876 - DNA, 14 bp, Homo sapiens
catcttcctgagct

SEQ ID NO: 5588877 - DNA, 14 bp, Homo sapiens
catcttcctgctgc

SEQ ID NO: 5588878 - DNA, 18 bp, Homo sapiens
catcttcctgctgctgta

SEQ ID NO: 5588879 - DNA, 12 bp, Homo sapiens
catcttcctgtg

SEQ ID NO: 5588880 - DNA, 14 bp, Homo sapiens
catcttcctgtgtc

SEQ ID NO: 5588881 - DNA, 17 bp, Homo sapiens
catcttcctgtgtcctg

SEQ ID NO: 5588882 - DNA, 16 bp, Homo sapiens
catcttccttctcagc

SEQ ID NO: 5588883 - DNA, 14 bp, Homo sapiens
catcttcgggacca

SEQ ID NO: 5588884 - DNA, 17 bp, Homo sapiens
catcttctcagctccca

SEQ ID NO: 5588885 - DNA, 14 bp, Homo sapiens
catcttctccatct

SEQ ID NO: 5588886 - DNA, 17 bp, Homo sapiens
catcttctccccacagc

SEQ ID NO: 5588887 - DNA, 20 bp, Homo sapiens
catcttctccccacagcctc

SEQ ID NO: 5588888 - DNA, 21 bp, Homo sapiens
catcttctccccgaggctgcc

SEQ ID NO: 5588889 - DNA, 22 bp, Homo sapiens
catcttctccccgaggctgccc

SEQ ID NO: 5588890 - DNA, 12 bp, Homo sapiens
catcttctggaa

SEQ ID NO: 5588891 - DNA, 13 bp, Homo sapiens
catcttctggaat

SEQ ID NO: 5588892 - DNA, 14 bp, Homo sapiens
catcttctggcttg

SEQ ID NO: 5588893 - DNA, 14 bp, Homo sapiens
catcttcttcacca

SEQ ID NO: 5588894 - DNA, 15 bp, Homo sapiens
catcttcttcccagt

SEQ ID NO: 5588895 - DNA, 13 bp, Homo sapiens
catcttcttccct

SEQ ID NO: 5588896 - DNA, 14 bp, Homo sapiens
catcttcttccctt

SEQ ID NO: 5588897 - DNA, 19 bp, Homo sapiens
catcttcttcccttaactc

SEQ ID NO: 5588898 - DNA, 12 bp, Homo sapiens
catcttctttct

SEQ ID NO: 5588899 - DNA, 21 bp, Homo sapiens
catcttctttgcagcctgggt

SEQ ID NO: 5588900 - DNA, 22 bp, Homo sapiens
catcttctttgcagcctgggtg

SEQ ID NO: 5588901 - DNA, 17 bp, Homo sapiens
catcttgaaaatgccac

SEQ ID NO: 5588902 - DNA, 19 bp, Homo sapiens
catcttgaaaatgccacca

SEQ ID NO: 5588903 - DNA, 15 bp, Homo sapiens
catcttgaatatttg

SEQ ID NO: 5588904 - DNA, 13 bp, Homo sapiens
catcttgaatcct

SEQ ID NO: 5588905 - DNA, 21 bp, Homo sapiens
catcttgaattgtaaggaatg

SEQ ID NO: 5588906 - DNA, 15 bp, Homo sapiens
catcttgaccaagca

SEQ ID NO: 5588907 - DNA, 19 bp, Homo sapiens
catcttgactaggtattgt

SEQ ID NO: 5588908 - DNA, 21 bp, Homo sapiens
catcttgatctgctcagccct

SEQ ID NO: 5588909 - DNA, 22 bp, Homo sapiens
catcttgatctgctcagccctg

SEQ ID NO: 5588910 - DNA, 19 bp, Homo sapiens
catcttgatctttgagccc

SEQ ID NO: 5588911 - DNA, 22 bp, Homo sapiens
catcttgatctttgagcccatt

SEQ ID NO: 5588912 - DNA, 17 bp, Homo sapiens
catcttgcaagcaaatc

SEQ ID NO: 5588913 - DNA, 13 bp, Homo sapiens
catcttgcacaca

SEQ ID NO: 5588914 - DNA, 21 bp, Homo sapiens
catcttgcagcatttactatg

SEQ ID NO: 5588915 - DNA, 13 bp, Homo sapiens
catcttgcattat

SEQ ID NO: 5588916 - DNA, 16 bp, Homo sapiens
catcttgcattatgca

SEQ ID NO: 5588917 - DNA, 13 bp, Homo sapiens
catcttgccccct

SEQ ID NO: 5588918 - DNA, 19 bp, Homo sapiens
catcttgcccgctcaggct

SEQ ID NO: 5588919 - DNA, 21 bp, Homo sapiens
catcttgcctacttttcttta

SEQ ID NO: 5588920 - DNA, 15 bp, Homo sapiens
catcttgcctccagg

SEQ ID NO: 5588921 - DNA, 19 bp, Homo sapiens
catcttgcctccaggtgca

SEQ ID NO: 5588922 - DNA, 22 bp, Homo sapiens
catcttgcctccaggtgcagag

SEQ ID NO: 5588923 - DNA, 16 bp, Homo sapiens
catcttgctaccagta

SEQ ID NO: 5588924 - DNA, 22 bp, Homo sapiens
catcttgctaccagtatttaga

SEQ ID NO: 5588925 - DNA, 17 bp, Homo sapiens
catcttgctctgctgac

SEQ ID NO: 5588926 - DNA, 20 bp, Homo sapiens
catcttgctctgctgacaga

SEQ ID NO: 5588927 - DNA, 15 bp, Homo sapiens
catcttgctctgtgg

SEQ ID NO: 5588928 - DNA, 18 bp, Homo sapiens
catcttgctctgtggcct

SEQ ID NO: 5588929 - DNA, 13 bp, Homo sapiens
catcttgctggct

SEQ ID NO: 5588930 - DNA, 15 bp, Homo sapiens
catcttgcttcccta

SEQ ID NO: 5588931 - DNA, 19 bp, Homo sapiens
catcttggaaatcattgtg

SEQ ID NO: 5588932 - DNA, 20 bp, Homo sapiens
catcttggaaatcattgtgt

SEQ ID NO: 5588933 - DNA, 21 bp, Homo sapiens
catcttgggattcctcccctg

SEQ ID NO: 5588934 - DNA, 18 bp, Homo sapiens
catcttggggacatctct

SEQ ID NO: 5588935 - DNA, 11 bp, Homo sapiens
catcttggggg

SEQ ID NO: 5588936 - DNA, 22 bp, Homo sapiens
catcttggtcctgtcaccctgg

SEQ ID NO: 5588937 - DNA, 12 bp, Homo sapiens
catcttgtaaat

SEQ ID NO: 5588938 - DNA, 17 bp, Homo sapiens
catcttgtatacacata

SEQ ID NO: 5588939 - DNA, 21 bp, Homo sapiens
catcttgtctaagacccccat

SEQ ID NO: 5588940 - DNA, 12 bp, Homo sapiens
catcttgtcttt

SEQ ID NO: 5588941 - DNA, 16 bp, Homo sapiens
catcttgtcttttccc

SEQ ID NO: 5588942 - DNA, 15 bp, Homo sapiens
catcttgtgagtgga

SEQ ID NO: 5588943 - DNA, 14 bp, Homo sapiens
catcttgtgcatgc

SEQ ID NO: 5588944 - DNA, 15 bp, Homo sapiens
catcttgtgcatgca

SEQ ID NO: 5588945 - DNA, 16 bp, Homo sapiens
catcttgtgcatgcaa

SEQ ID NO: 5588946 - DNA, 16 bp, Homo sapiens
catcttgtggggccag

SEQ ID NO: 5588947 - DNA, 15 bp, Homo sapiens
catcttgtgttttat

SEQ ID NO: 5588948 - DNA, 16 bp, Homo sapiens
catcttgttcttcccc

SEQ ID NO: 5588949 - DNA, 15 bp, Homo sapiens
catcttgtttcattt

SEQ ID NO: 5588950 - DNA, 19 bp, Homo sapiens
catctttaaacagtatttc

SEQ ID NO: 5588951 - DNA, 13 bp, Homo sapiens
catctttaagtat

SEQ ID NO: 5588952 - DNA, 14 bp, Homo sapiens
catctttaattcct

SEQ ID NO: 5588953 - DNA, 17 bp, Homo sapiens
catctttaattccttat

SEQ ID NO: 5588954 - DNA, 15 bp, Homo sapiens
catctttaatttata

SEQ ID NO: 5588955 - DNA, 23 bp, Homo sapiens
catctttagcagtttcctcagtg

SEQ ID NO: 5588956 - DNA, 17 bp, Homo sapiens
catctttatcattaaac

SEQ ID NO: 5588957 - DNA, 16 bp, Homo sapiens
catctttatcctaaaa

SEQ ID NO: 5588958 - DNA, 17 bp, Homo sapiens
catctttatctcctggg

SEQ ID NO: 5588959 - DNA, 17 bp, Homo sapiens
catctttattaacctca

SEQ ID NO: 5588960 - DNA, 21 bp, Homo sapiens
catctttattgaaattctatt

SEQ ID NO: 5588961 - DNA, 17 bp, Homo sapiens
catctttattgaacttg

SEQ ID NO: 5588962 - DNA, 23 bp, Homo sapiens
catctttcagaaataaaagtatg

SEQ ID NO: 5588963 - DNA, 21 bp, Homo sapiens
catctttccctccttggtgat

SEQ ID NO: 5588964 - DNA, 12 bp, Homo sapiens
catctttccctg

SEQ ID NO: 5588965 - DNA, 21 bp, Homo sapiens
catctttcctccaaactcctg

SEQ ID NO: 5588966 - DNA, 21 bp, Homo sapiens
catctttcctgatggcaggat

SEQ ID NO: 5588967 - DNA, 11 bp, Homo sapiens
catctttctct

SEQ ID NO: 5588968 - DNA, 17 bp, Homo sapiens
catctttctcttcccat

SEQ ID NO: 5588969 - DNA, 23 bp, Homo sapiens
catctttctgattccgcaccctg

SEQ ID NO: 5588970 - DNA, 16 bp, Homo sapiens
catctttcttctattt

SEQ ID NO: 5588971 - DNA, 18 bp, Homo sapiens
catctttgaaaagaaaaa

SEQ ID NO: 5588972 - DNA, 12 bp, Homo sapiens
catctttgaaat

SEQ ID NO: 5588973 - DNA, 22 bp, Homo sapiens
catctttgaaattatgtaaatt

SEQ ID NO: 5588974 - DNA, 19 bp, Homo sapiens
catctttgacactctgcag

SEQ ID NO: 5588975 - DNA, 19 bp, Homo sapiens
catctttgagaatattata

SEQ ID NO: 5588976 - DNA, 17 bp, Homo sapiens
catctttgatccttctg

SEQ ID NO: 5588977 - DNA, 23 bp, Homo sapiens
catctttgatccttctgagctcc

SEQ ID NO: 5588978 - DNA, 13 bp, Homo sapiens
catctttgatgtg

SEQ ID NO: 5588979 - DNA, 14 bp, Homo sapiens
catctttgatgtgt

SEQ ID NO: 5588980 - DNA, 18 bp, Homo sapiens
catctttgatgtgttgtt

SEQ ID NO: 5588981 - DNA, 21 bp, Homo sapiens
catctttgccatatggaggac

SEQ ID NO: 5588982 - DNA, 18 bp, Homo sapiens
catctttgcccttctggt

SEQ ID NO: 5588983 - DNA, 17 bp, Homo sapiens
catctttgcgaaaagat

SEQ ID NO: 5588984 - DNA, 22 bp, Homo sapiens
catctttgggacacctcagaaa

SEQ ID NO: 5588985 - DNA, 19 bp, Homo sapiens
catctttgggagagttcat

SEQ ID NO: 5588986 - DNA, 21 bp, Homo sapiens
catctttggggaggtgttcac

SEQ ID NO: 5588987 - DNA, 18 bp, Homo sapiens
catctttgtatatttaca

SEQ ID NO: 5588988 - DNA, 17 bp, Homo sapiens
catctttgtttttaaaa

SEQ ID NO: 5588989 - DNA, 14 bp, Homo sapiens
catcttttaatatg

SEQ ID NO: 5588990 - DNA, 22 bp, Homo sapiens
catcttttaatcatgagcctgt

SEQ ID NO: 5588991 - DNA, 19 bp, Homo sapiens
catcttttaggggaagtga

SEQ ID NO: 5588992 - DNA, 15 bp, Homo sapiens
catcttttcctgatg

SEQ ID NO: 5588993 - DNA, 20 bp, Homo sapiens
catcttttcctgatggctgg

SEQ ID NO: 5588994 - DNA, 13 bp, Homo sapiens
catcttttctaat

SEQ ID NO: 5588995 - DNA, 19 bp, Homo sapiens
catcttttctagagacaca

SEQ ID NO: 5588996 - DNA, 16 bp, Homo sapiens
catcttttcttgcctc

SEQ ID NO: 5588997 - DNA, 21 bp, Homo sapiens
catcttttgaggcttctgttc

SEQ ID NO: 5588998 - DNA, 15 bp, Homo sapiens
catcttttgatcttt

SEQ ID NO: 5588999 - DNA, 17 bp, Homo sapiens
catcttttgggaagcca

SEQ ID NO: 5589000 - DNA, 19 bp, Homo sapiens
catcttttgtattaagaaa

SEQ ID NO: 5589001 - DNA, 22 bp, Homo sapiens
catcttttgtattaagaaagga

SEQ ID NO: 5589002 - DNA, 14 bp, Homo sapiens
catcttttgtgaga

SEQ ID NO: 5589003 - DNA, 21 bp, Homo sapiens
catcttttgtgagatgtaatt

SEQ ID NO: 5589004 - DNA, 17 bp, Homo sapiens
catcttttgttctccta

SEQ ID NO: 5589005 - DNA, 21 bp, Homo sapiens
catctttttaaagcttatcca

SEQ ID NO: 5589006 - DNA, 21 bp, Homo sapiens
catctttttatgcaaaagtca

SEQ ID NO: 5589007 - DNA, 21 bp, Homo sapiens
catctttttctagagttatct

SEQ ID NO: 5589008 - DNA, 22 bp, Homo sapiens
catctttttctagagttatctt

SEQ ID NO: 5589009 - DNA, 17 bp, Homo sapiens
catctttttcttgggtg

SEQ ID NO: 5589010 - DNA, 14 bp, Homo sapiens
catctttttgtgtg

SEQ ID NO: 5589011 - DNA, 14 bp, Homo sapiens
catgaaaaacaaac

SEQ ID NO: 5589012 - DNA, 20 bp, Homo sapiens
catgaaaaaccatttttgaa

SEQ ID NO: 5589013 - DNA, 15 bp, Homo sapiens
catgaaaaagcagct

SEQ ID NO: 5589014 - DNA, 21 bp, Homo sapiens
catgaaaaatcatgggccaga

SEQ ID NO: 5589015 - DNA, 22 bp, Homo sapiens
catgaaaaatcatgggccagag

SEQ ID NO: 5589016 - DNA, 21 bp, Homo sapiens
catgaaaacaagaaagaaatg

SEQ ID NO: 5589017 - DNA, 14 bp, Homo sapiens
catgaaaacattga

SEQ ID NO: 5589018 - DNA, 15 bp, Homo sapiens
catgaaaacattgat

SEQ ID NO: 5589019 - DNA, 17 bp, Homo sapiens
catgaaaacgttttatt

SEQ ID NO: 5589020 - DNA, 20 bp, Homo sapiens
catgagttctgcacatacag

SEQ ID NO: 5589021 - DNA, 23 bp, Homo sapiens
catgagttggggtctggcagcct

SEQ ID NO: 5589022 - DNA, 22 bp, Homo sapiens
catgagtttgccctggtttcac

SEQ ID NO: 5589023 - DNA, 22 bp, Homo sapiens
catgagttttttctcttgggct

SEQ ID NO: 5589024 - DNA, 14 bp, Homo sapiens
catgataaaataag

SEQ ID NO: 5589025 - DNA, 16 bp, Homo sapiens
catgataaaataagta

SEQ ID NO: 5589026 - DNA, 13 bp, Homo sapiens
catgataaatgat

SEQ ID NO: 5589027 - DNA, 21 bp, Homo sapiens
catgataagaacagagtgcct

SEQ ID NO: 5589028 - DNA, 17 bp, Homo sapiens
catgataataggtcata

SEQ ID NO: 5589029 - DNA, 14 bp, Homo sapiens
catgatacattttt

SEQ ID NO: 5589030 - DNA, 22 bp, Homo sapiens
catgataccacctttactgtgc

SEQ ID NO: 5589031 - DNA, 19 bp, Homo sapiens
catgataccaggcccagga

SEQ ID NO: 5589032 - DNA, 17 bp, Homo sapiens
catgatacctattaaag

SEQ ID NO: 5589033 - DNA, 22 bp, Homo sapiens
catgatacctattaaaggaaaa

SEQ ID NO: 5589034 - DNA, 13 bp, Homo sapiens
catgatacgctta

SEQ ID NO: 5589035 - DNA, 17 bp, Homo sapiens
catgatactgctgcttg

SEQ ID NO: 5589036 - DNA, 18 bp, Homo sapiens
catgatactgctgcttgt

SEQ ID NO: 5589037 - DNA, 23 bp, Homo sapiens
catgatactttaatttttataaa

SEQ ID NO: 5589038 - DNA, 15 bp, Homo sapiens
catgatagaaagaat

SEQ ID NO: 5589039 - DNA, 20 bp, Homo sapiens
catgatagaaagaataaaat

SEQ ID NO: 5589040 - DNA, 16 bp, Homo sapiens
catgatagatataaag

SEQ ID NO: 5589041 - DNA, 17 bp, Homo sapiens
catgatagttaaactac

SEQ ID NO: 5589042 - DNA, 14 bp, Homo sapiens
catgatataacttt

SEQ ID NO: 5589043 - DNA, 16 bp, Homo sapiens
catgatattgtatgta

SEQ ID NO: 5589044 - DNA, 15 bp, Homo sapiens
catgatcaaaatgca

SEQ ID NO: 5589045 - DNA, 18 bp, Homo sapiens
catgatcaaaatgcatac

SEQ ID NO: 5589046 - DNA, 21 bp, Homo sapiens
catgatcatagctcactgcag

SEQ ID NO: 5589047 - DNA, 24 bp, Homo sapiens
catgatcatagctcactgcagcct

SEQ ID NO: 5589048 - DNA, 22 bp, Homo sapiens
catgatccacccacctcagcct

SEQ ID NO: 5589049 - DNA, 23 bp, Homo sapiens
catgatccacccacctcagcctc

SEQ ID NO: 5589050 - DNA, 22 bp, Homo sapiens
catgatccagctgtgtgttttc

SEQ ID NO: 5589051 - DNA, 20 bp, Homo sapiens
catgatccccgtctctgccc

SEQ ID NO: 5589052 - DNA, 21 bp, Homo sapiens
catgatccccgtctctgccct

SEQ ID NO: 5589053 - DNA, 22 bp, Homo sapiens
catgatccctgtgttgtctcta

SEQ ID NO: 5589054 - DNA, 13 bp, Homo sapiens
catgatcctgagt

SEQ ID NO: 5589055 - DNA, 20 bp, Homo sapiens
catgatcgagccactgcact

SEQ ID NO: 5589056 - DNA, 21 bp, Homo sapiens
catgatctccctgccgcctca

SEQ ID NO: 5589057 - DNA, 20 bp, Homo sapiens
catgatctgactttaattgt

SEQ ID NO: 5589058 - DNA, 22 bp, Homo sapiens
catgatgaatgacctgactttt

SEQ ID NO: 5589059 - DNA, 20 bp, Homo sapiens
catgatgacttagtacaaag

SEQ ID NO: 5589060 - DNA, 22 bp, Homo sapiens
catgatgacttagtacaaagtt

SEQ ID NO: 5589061 - DNA, 23 bp, Homo sapiens
catgatgacttagtacaaagttt

SEQ ID NO: 5589062 - DNA, 14 bp, Homo sapiens
catgatgatagttg

SEQ ID NO: 5589063 - DNA, 19 bp, Homo sapiens
catgatgatagttgaatgt

SEQ ID NO: 5589064 - DNA, 16 bp, Homo sapiens
catgatgatgatgatt

SEQ ID NO: 5589065 - DNA, 13 bp, Homo sapiens
catgatgcacagt

SEQ ID NO: 5589066 - DNA, 23 bp, Homo sapiens
catgatgcacagtatctgctgtt

SEQ ID NO: 5589067 - DNA, 24 bp, Homo sapiens
catgatgcacagtatctgctgttc

SEQ ID NO: 5589068 - DNA, 14 bp, Homo sapiens
catgatgcagtctc

SEQ ID NO: 5589069 - DNA, 12 bp, Homo sapiens
catgatgccctc

SEQ ID NO: 5589070 - DNA, 16 bp, Homo sapiens
catgatgccctcccct

SEQ ID NO: 5589071 - DNA, 20 bp, Homo sapiens
catgatgccctcccctcagc

SEQ ID NO: 5589072 - DNA, 20 bp, Homo sapiens
catgatgcctctgtcttctg

SEQ ID NO: 5589073 - DNA, 18 bp, Homo sapiens
catgatgctcatgactta

SEQ ID NO: 5589074 - DNA, 18 bp, Homo sapiens
catgatgcttttactgaa

SEQ ID NO: 5589075 - DNA, 18 bp, Homo sapiens
catgatggagcgcacctg

SEQ ID NO: 5589076 - DNA, 15 bp, Homo sapiens
catgatggagctgat

SEQ ID NO: 5589077 - DNA, 12 bp, Homo sapiens
catgatggagtc

SEQ ID NO: 5589078 - DNA, 19 bp, Homo sapiens
catgatggagtcaggtttg

SEQ ID NO: 5589079 - DNA, 23 bp, Homo sapiens
catgatggagtcaggtttggggt

SEQ ID NO: 5589080 - DNA, 23 bp, Homo sapiens
catgatggattcccccccctttc

SEQ ID NO: 5589081 - DNA, 12 bp, Homo sapiens
catgatggcaac

SEQ ID NO: 5589082 - DNA, 22 bp, Homo sapiens
catgatggcaacagaaaccaag

SEQ ID NO: 5589083 - DNA, 22 bp, Homo sapiens
catgatgggaaaatatttcctg

SEQ ID NO: 5589084 - DNA, 22 bp, Homo sapiens
catgatgggaatagggagacag

SEQ ID NO: 5589085 - DNA, 21 bp, Homo sapiens
catgatgggaggtgtgccaga

SEQ ID NO: 5589086 - DNA, 12 bp, Homo sapiens
catgatggtgag

SEQ ID NO: 5589087 - DNA, 17 bp, Homo sapiens
catgatggtgcatgcct

SEQ ID NO: 5589088 - DNA, 20 bp, Homo sapiens
catgatggtgctgacctctg

SEQ ID NO: 5589089 - DNA, 22 bp, Homo sapiens
catgatggttattttcttttct

SEQ ID NO: 5589090 - DNA, 20 bp, Homo sapiens
catgatgtaaaaaatattaa

SEQ ID NO: 5589091 - DNA, 20 bp, Homo sapiens
catgatgtagtgcctctttc

SEQ ID NO: 5589092 - DNA, 12 bp, Homo sapiens
catgatgtatat

SEQ ID NO: 5589093 - DNA, 12 bp, Homo sapiens
catgatgtcctt

SEQ ID NO: 5589094 - DNA, 21 bp, Homo sapiens
catgatgtgaagagtttcaca

SEQ ID NO: 5589095 - DNA, 19 bp, Homo sapiens
catgatgttaaccagaata

SEQ ID NO: 5589096 - DNA, 13 bp, Homo sapiens
catgatgttaact

SEQ ID NO: 5589097 - DNA, 13 bp, Homo sapiens
catgatgtttgcc

SEQ ID NO: 5589098 - DNA, 15 bp, Homo sapiens
catgatgtttgccca

SEQ ID NO: 5589099 - DNA, 19 bp, Homo sapiens
catgatgtttttaaaatct

SEQ ID NO: 5589100 - DNA, 20 bp, Homo sapiens
catgatgtttttaaaatctt

SEQ ID NO: 5589101 - DNA, 22 bp, Homo sapiens
catgattaaccacttcagctga

SEQ ID NO: 5589102 - DNA, 20 bp, Homo sapiens
catgattagacaatgtggaa

SEQ ID NO: 5589103 - DNA, 21 bp, Homo sapiens
catgattatagcaactaatgt

SEQ ID NO: 5589104 - DNA, 21 bp, Homo sapiens
catgattattagttgaccaac

SEQ ID NO: 5589105 - DNA, 13 bp, Homo sapiens
catgattcatttt

SEQ ID NO: 5589106 - DNA, 22 bp, Homo sapiens
catgattccaagggcccagagg

SEQ ID NO: 5589107 - DNA, 23 bp, Homo sapiens
catgattccaagggcccagaggg

SEQ ID NO: 5589108 - DNA, 15 bp, Homo sapiens
catgattccatgccc

SEQ ID NO: 5589109 - DNA, 15 bp, Homo sapiens
catgattccctcctc

SEQ ID NO: 5589110 - DNA, 13 bp, Homo sapiens
catgattccttta

SEQ ID NO: 5589111 - DNA, 22 bp, Homo sapiens
catgattcctttaacaacatgt

SEQ ID NO: 5589112 - DNA, 20 bp, Homo sapiens
catgattctacccttattgc

SEQ ID NO: 5589113 - DNA, 17 bp, Homo sapiens
catgattctatgtaatg

SEQ ID NO: 5589114 - DNA, 18 bp, Homo sapiens
catgattctctgagtggt

SEQ ID NO: 5589115 - DNA, 23 bp, Homo sapiens
catgattggcttaaagtgaagga

SEQ ID NO: 5589116 - DNA, 20 bp, Homo sapiens
catgatttaatccagatctg

SEQ ID NO: 5589117 - DNA, 15 bp, Homo sapiens
catgatttagcaagc

SEQ ID NO: 5589118 - DNA, 17 bp, Homo sapiens
catgatttagcaagcaa

SEQ ID NO: 5589119 - DNA, 18 bp, Homo sapiens
catgatttagcaagcaac

SEQ ID NO: 5589120 - DNA, 22 bp, Homo sapiens
catgatttagcaagcaactaat

SEQ ID NO: 5589121 - DNA, 21 bp, Homo sapiens
catgatttagggaagcaggga

SEQ ID NO: 5589122 - DNA, 14 bp, Homo sapiens
catgatttatatat

SEQ ID NO: 5589123 - DNA, 12 bp, Homo sapiens
catgatttcaaa

SEQ ID NO: 5589124 - DNA, 18 bp, Homo sapiens
catgatttcaatgattgt

SEQ ID NO: 5589125 - DNA, 12 bp, Homo sapiens
catgatttcaca

SEQ ID NO: 5589126 - DNA, 15 bp, Homo sapiens
catgatttcacaaat

SEQ ID NO: 5589127 - DNA, 16 bp, Homo sapiens
catgatttcatgtact

SEQ ID NO: 5589128 - DNA, 20 bp, Homo sapiens
catgatttcatgtactgcat

SEQ ID NO: 5589129 - DNA, 19 bp, Homo sapiens
catgatttcccactgcact

SEQ ID NO: 5589130 - DNA, 14 bp, Homo sapiens
catgatttccttga

SEQ ID NO: 5589131 - DNA, 18 bp, Homo sapiens
catgatttccttgaatgt

SEQ ID NO: 5589132 - DNA, 18 bp, Homo sapiens
catgatttctgtgaagca

SEQ ID NO: 5589133 - DNA, 13 bp, Homo sapiens
catgatttgaaaa

SEQ ID NO: 5589134 - DNA, 16 bp, Homo sapiens
catgatttgtcccagc

SEQ ID NO: 5589135 - DNA, 19 bp, Homo sapiens
catgatttgtcccagcctg

SEQ ID NO: 5589136 - DNA, 13 bp, Homo sapiens
catgattttacag

SEQ ID NO: 5589137 - DNA, 14 bp, Homo sapiens
catgattttacaga

SEQ ID NO: 5589138 - DNA, 16 bp, Homo sapiens
catgattttatacata

SEQ ID NO: 5589139 - DNA, 20 bp, Homo sapiens
catgattttatacatagtca

SEQ ID NO: 5589140 - DNA, 15 bp, Homo sapiens
catgattttctaaaa

SEQ ID NO: 5589141 - DNA, 15 bp, Homo sapiens
catgattttggccac

SEQ ID NO: 5589142 - DNA, 21 bp, Homo sapiens
catgattttttacaaattatg

SEQ ID NO: 5589143 - DNA, 19 bp, Homo sapiens
catgcaaaaaaaaaaatgt

SEQ ID NO: 5589144 - DNA, 15 bp, Homo sapiens
catgcaaaaatgaat

SEQ ID NO: 5589145 - DNA, 16 bp, Homo sapiens
catgcaaaaatgaatt

SEQ ID NO: 5589146 - DNA, 13 bp, Homo sapiens
catgcaaaagaaa

SEQ ID NO: 5589147 - DNA, 22 bp, Homo sapiens
catgcaaaagcaatcatagaga

SEQ ID NO: 5589148 - DNA, 18 bp, Homo sapiens
catgcaaacaagaaacgt

SEQ ID NO: 5589149 - DNA, 14 bp, Homo sapiens
catgcaaactcttt

SEQ ID NO: 5589150 - DNA, 21 bp, Homo sapiens
catgcaaagcaacgactactt

SEQ ID NO: 5589151 - DNA, 22 bp, Homo sapiens
catgcaaatgagctctgaaatc

SEQ ID NO: 5589152 - DNA, 14 bp, Homo sapiens
catgcaaatgctgt

SEQ ID NO: 5589153 - DNA, 12 bp, Homo sapiens
catgcaaattgt

SEQ ID NO: 5589154 - DNA, 17 bp, Homo sapiens
catgcaacaccctcttc

SEQ ID NO: 5589155 - DNA, 22 bp, Homo sapiens
catgcaacatggatatgtattg

SEQ ID NO: 5589156 - DNA, 20 bp, Homo sapiens
catgcaagaactcatcactg

SEQ ID NO: 5589157 - DNA, 13 bp, Homo sapiens
catgcaagaattt

SEQ ID NO: 5589158 - DNA, 15 bp, Homo sapiens
catgcaagaatttct

SEQ ID NO: 5589159 - DNA, 23 bp, Homo sapiens
catgcaagggatgaattgtaaaa

SEQ ID NO: 5589160 - DNA, 14 bp, Homo sapiens
catgcaaggggaaa

SEQ ID NO: 5589161 - DNA, 12 bp, Homo sapiens
catgcaaggtca

SEQ ID NO: 5589162 - DNA, 18 bp, Homo sapiens
catgcaaggtcatttttt

SEQ ID NO: 5589163 - DNA, 14 bp, Homo sapiens
catgcaagtagctg

SEQ ID NO: 5589164 - DNA, 20 bp, Homo sapiens
catgcaagtgagaaagacat

SEQ ID NO: 5589165 - DNA, 22 bp, Homo sapiens
catgcaagtgagaaagacatct

SEQ ID NO: 5589166 - DNA, 17 bp, Homo sapiens
catgcaagtgctatgcc

SEQ ID NO: 5589167 - DNA, 14 bp, Homo sapiens
catgcaagtgctgt

SEQ ID NO: 5589168 - DNA, 20 bp, Homo sapiens
catgcaagtgctgtttgggc

SEQ ID NO: 5589169 - DNA, 21 bp, Homo sapiens
catgcaagtggagctgtctgt

SEQ ID NO: 5589170 - DNA, 18 bp, Homo sapiens
catgcaataaaatttaaa

SEQ ID NO: 5589171 - DNA, 16 bp, Homo sapiens
catgcaatgacatctt

SEQ ID NO: 5589172 - DNA, 14 bp, Homo sapiens
catgcaattttatt

SEQ ID NO: 5589173 - DNA, 17 bp, Homo sapiens
catgcacaactctccaa

SEQ ID NO: 5589174 - DNA, 22 bp, Homo sapiens
catgcacaagatgccccaggga

SEQ ID NO: 5589175 - DNA, 19 bp, Homo sapiens
catgcacacaaacacctcc

SEQ ID NO: 5589176 - DNA, 12 bp, Homo sapiens
catgcacacaca

SEQ ID NO: 5589177 - DNA, 16 bp, Homo sapiens
catgcacacacacaca

SEQ ID NO: 5589178 - DNA, 12 bp, Homo sapiens
catgcacactca

SEQ ID NO: 5589179 - DNA, 15 bp, Homo sapiens
catgcacactgttgg

SEQ ID NO: 5589180 - DNA, 13 bp, Homo sapiens
catgcacagctgc

SEQ ID NO: 5589181 - DNA, 23 bp, Homo sapiens
catgcacagctgcttgtcctgct

SEQ ID NO: 5589182 - DNA, 14 bp, Homo sapiens
catgcacagctgta

SEQ ID NO: 5589183 - DNA, 22 bp, Homo sapiens
catgcacagtacaataatgtac

SEQ ID NO: 5589184 - DNA, 14 bp, Homo sapiens
catgcacagtattt

SEQ ID NO: 5589185 - DNA, 19 bp, Homo sapiens
catgcacagtatttgtaat

SEQ ID NO: 5589186 - DNA, 21 bp, Homo sapiens
catgcacatgccttaagccag

SEQ ID NO: 5589187 - DNA, 22 bp, Homo sapiens
catgcacatgctgtctggccct

SEQ ID NO: 5589188 - DNA, 13 bp, Homo sapiens
catgcacatgtat

SEQ ID NO: 5589189 - DNA, 16 bp, Homo sapiens
catgcacattcatcct

SEQ ID NO: 5589190 - DNA, 15 bp, Homo sapiens
catgcacattttgta

SEQ ID NO: 5589191 - DNA, 18 bp, Homo sapiens
catgcacattttgtacat

SEQ ID NO: 5589192 - DNA, 12 bp, Homo sapiens
catgcaccaaac

SEQ ID NO: 5589193 - DNA, 18 bp, Homo sapiens
catgcaccaggactggct

SEQ ID NO: 5589194 - DNA, 22 bp, Homo sapiens
catgcaccaggactggctgtgt

SEQ ID NO: 5589195 - DNA, 20 bp, Homo sapiens
catgcacccgcatgtacaaa

SEQ ID NO: 5589196 - DNA, 22 bp, Homo sapiens
catggaaaaatgccatcaaatg

SEQ ID NO: 5589197 - DNA, 13 bp, Homo sapiens
catggaaaaatgg

SEQ ID NO: 5589198 - DNA, 16 bp, Homo sapiens
catggaaaacagagta

SEQ ID NO: 5589199 - DNA, 14 bp, Homo sapiens
catggaaaagccca

SEQ ID NO: 5589200 - DNA, 15 bp, Homo sapiens
catggaaaagttctt

SEQ ID NO: 5589201 - DNA, 20 bp, Homo sapiens
catggaaaatgtcctgtggt

SEQ ID NO: 5589202 - DNA, 23 bp, Homo sapiens
catggaaacaagatgaaattcca

SEQ ID NO: 5589203 - DNA, 14 bp, Homo sapiens
catggaaagactgg

SEQ ID NO: 5589204 - DNA, 13 bp, Homo sapiens
catggaaagatgg

SEQ ID NO: 5589205 - DNA, 18 bp, Homo sapiens
catggaaagatggggagc

SEQ ID NO: 5589206 - DNA, 20 bp, Homo sapiens
catggaaagggtcttccttc

SEQ ID NO: 5589207 - DNA, 13 bp, Homo sapiens
catggaaatatta

SEQ ID NO: 5589208 - DNA, 16 bp, Homo sapiens
catggaaatattatgc

SEQ ID NO: 5589209 - DNA, 19 bp, Homo sapiens
catggaaatattatgcaaa

SEQ ID NO: 5589210 - DNA, 21 bp, Homo sapiens
catggaaatcagccaagtttt

SEQ ID NO: 5589211 - DNA, 19 bp, Homo sapiens
catggaaatttaaagcagg

SEQ ID NO: 5589212 - DNA, 21 bp, Homo sapiens
catggaacacaaacacattgt

SEQ ID NO: 5589213 - DNA, 18 bp, Homo sapiens
catggaacgcgttgaaat

SEQ ID NO: 5589214 - DNA, 19 bp, Homo sapiens
catggaactcattcctgcc

SEQ ID NO: 5589215 - DNA, 17 bp, Homo sapiens
catggaacttaaaacat

SEQ ID NO: 5589216 - DNA, 13 bp, Homo sapiens
catggaactttca

SEQ ID NO: 5589217 - DNA, 15 bp, Homo sapiens
catggaagattagag

SEQ ID NO: 5589218 - DNA, 21 bp, Homo sapiens
catggaagattagaggtttgt

SEQ ID NO: 5589219 - DNA, 13 bp, Homo sapiens
catggaagattga

SEQ ID NO: 5589220 - DNA, 12 bp, Homo sapiens
catggaagctgg

SEQ ID NO: 5589221 - DNA, 18 bp, Homo sapiens
catggaagctggcaggag

SEQ ID NO: 5589222 - DNA, 23 bp, Homo sapiens
catggaaggcaagattgtgtccc

SEQ ID NO: 5589223 - DNA, 15 bp, Homo sapiens
catggaaggcggcac

SEQ ID NO: 5589224 - DNA, 14 bp, Homo sapiens
catggaaggttagg

SEQ ID NO: 5589225 - DNA, 19 bp, Homo sapiens
catggaaggttaggtttgt

SEQ ID NO: 5589226 - DNA, 16 bp, Homo sapiens
catggaagtaattaag

SEQ ID NO: 5589227 - DNA, 20 bp, Homo sapiens
catggaagtaattaaggtac

SEQ ID NO: 5589228 - DNA, 20 bp, Homo sapiens
catggaagtactataattta

SEQ ID NO: 5589229 - DNA, 16 bp, Homo sapiens
catggaagttggggca

SEQ ID NO: 5589230 - DNA, 16 bp, Homo sapiens
catggaataacatgta

SEQ ID NO: 5589231 - DNA, 17 bp, Homo sapiens
catggaatcgaagtgtt

SEQ ID NO: 5589232 - DNA, 17 bp, Homo sapiens
catggaatctgatgaaa

SEQ ID NO: 5589233 - DNA, 22 bp, Homo sapiens
catggaatcttgctgcaggccc

SEQ ID NO: 5589234 - DNA, 17 bp, Homo sapiens
catggaatgactgaaga

SEQ ID NO: 5589235 - DNA, 20 bp, Homo sapiens
catggaatgcttgaaaaatg

SEQ ID NO: 5589236 - DNA, 15 bp, Homo sapiens
catggaatggttata

SEQ ID NO: 5589237 - DNA, 18 bp, Homo sapiens
catggaattggtttaaac

SEQ ID NO: 5589238 - DNA, 22 bp, Homo sapiens
catggaattggtttaaactttt

SEQ ID NO: 5589239 - DNA, 17 bp, Homo sapiens
catggaatttaatttat

SEQ ID NO: 5589240 - DNA, 16 bp, Homo sapiens
catggacaatataaac

SEQ ID NO: 5589241 - DNA, 15 bp, Homo sapiens
catggacaatggacc

SEQ ID NO: 5589242 - DNA, 12 bp, Homo sapiens
catggacacaga

SEQ ID NO: 5589243 - DNA, 22 bp, Homo sapiens
catggacaccccttatccagga

SEQ ID NO: 5589244 - DNA, 20 bp, Homo sapiens
catggacactacacccagca

SEQ ID NO: 5589245 - DNA, 22 bp, Homo sapiens
catggacactacacccagcaat

SEQ ID NO: 5589246 - DNA, 18 bp, Homo sapiens
catggacactccagtgcc

SEQ ID NO: 5589247 - DNA, 19 bp, Homo sapiens
catggacactccagtgcca

SEQ ID NO: 5589248 - DNA, 20 bp, Homo sapiens
catggacagacttcacagcg

SEQ ID NO: 5589249 - DNA, 24 bp, Homo sapiens
catggacagacttcacagcgtctg

SEQ ID NO: 5589250 - DNA, 16 bp, Homo sapiens
catggacagctgagca

SEQ ID NO: 5589251 - DNA, 15 bp, Homo sapiens
catggacaggctggc

SEQ ID NO: 5589252 - DNA, 18 bp, Homo sapiens
catggacaggctggctcc

SEQ ID NO: 5589253 - DNA, 12 bp, Homo sapiens
catggacagggc

SEQ ID NO: 5589254 - DNA, 16 bp, Homo sapiens
catggacagggccagg

SEQ ID NO: 5589255 - DNA, 15 bp, Homo sapiens
catggacatgggcag

SEQ ID NO: 5589256 - DNA, 20 bp, Homo sapiens
catggacatttagaagaaag

SEQ ID NO: 5589257 - DNA, 21 bp, Homo sapiens
catggaccactgtttcttgct

SEQ ID NO: 5589258 - DNA, 22 bp, Homo sapiens
catggaccactgtttcttgctt

SEQ ID NO: 5589259 - DNA, 14 bp, Homo sapiens
catggaccagcatc

SEQ ID NO: 5589260 - DNA, 15 bp, Homo sapiens
catggaccagcatct

SEQ ID NO: 5589261 - DNA, 21 bp, Homo sapiens
catggaccagcatctggtctt

SEQ ID NO: 5589262 - DNA, 13 bp, Homo sapiens
catggaccatgct

SEQ ID NO: 5589263 - DNA, 15 bp, Homo sapiens
catggacctaacatt

SEQ ID NO: 5589264 - DNA, 16 bp, Homo sapiens
catggacctaacattc

SEQ ID NO: 5589265 - DNA, 16 bp, Homo sapiens
catggacctgcacttg

SEQ ID NO: 5589266 - DNA, 16 bp, Homo sapiens
catggacctggtgccc

SEQ ID NO: 5589267 - DNA, 18 bp, Homo sapiens
catggaccttctctccag

SEQ ID NO: 5589268 - DNA, 21 bp, Homo sapiens
catggaccttctctccagagc

SEQ ID NO: 5589269 - DNA, 20 bp, Homo sapiens
catggacgaatatgaatgtc

SEQ ID NO: 5589270 - DNA, 15 bp, Homo sapiens
catggacgcctggct

SEQ ID NO: 5589271 - DNA, 18 bp, Homo sapiens
catggactccaggatcct

SEQ ID NO: 5589272 - DNA, 23 bp, Homo sapiens
catggactccaggatcctcctgg

SEQ ID NO: 5589273 - DNA, 22 bp, Homo sapiens
catggactctgggtttcatatc

SEQ ID NO: 5589274 - DNA, 24 bp, Homo sapiens
catggactctgggtttcatatcca

SEQ ID NO: 5589275 - DNA, 15 bp, Homo sapiens
catggactgagctgg

SEQ ID NO: 5589276 - DNA, 14 bp, Homo sapiens
catggactgttgcc

SEQ ID NO: 5589277 - DNA, 15 bp, Homo sapiens
catggacttcacata

SEQ ID NO: 5589278 - DNA, 12 bp, Homo sapiens
catggacttgta

SEQ ID NO: 5589279 - DNA, 16 bp, Homo sapiens
catggacttgtatatt

SEQ ID NO: 5589280 - DNA, 11 bp, Homo sapiens
catggagaaac

SEQ ID NO: 5589281 - DNA, 14 bp, Homo sapiens
catggagaaaccct

SEQ ID NO: 5589282 - DNA, 13 bp, Homo sapiens
catggagaaagct

SEQ ID NO: 5589283 - DNA, 19 bp, Homo sapiens
catggagaaagctgacttg

SEQ ID NO: 5589284 - DNA, 23 bp, Homo sapiens
catggagaaagctgacttggctg

SEQ ID NO: 5589285 - DNA, 20 bp, Homo sapiens
catggagaaccacctacccc

SEQ ID NO: 5589286 - DNA, 15 bp, Homo sapiens
catggagaagcagaa

SEQ ID NO: 5589287 - DNA, 23 bp, Homo sapiens
catggagaagggttctgccctgc

SEQ ID NO: 5589288 - DNA, 20 bp, Homo sapiens
catggagaatctgctgcata

SEQ ID NO: 5589289 - DNA, 20 bp, Homo sapiens
catggagaatgggacgagga

SEQ ID NO: 5589290 - DNA, 18 bp, Homo sapiens
catggagacaataaacag

SEQ ID NO: 5589291 - DNA, 12 bp, Homo sapiens
catggagagaga

SEQ ID NO: 5589292 - DNA, 16 bp, Homo sapiens
catggagagagactca

SEQ ID NO: 5589293 - DNA, 20 bp, Homo sapiens
catggagagctggagcctgg

SEQ ID NO: 5589294 - DNA, 21 bp, Homo sapiens
catggagagctggagcctggt

SEQ ID NO: 5589295 - DNA, 17 bp, Homo sapiens
catggagatctgaaggg

SEQ ID NO: 5589296 - DNA, 18 bp, Homo sapiens
catggagattgacctgga

SEQ ID NO: 5589297 - DNA, 15 bp, Homo sapiens
catggagcagccccc

SEQ ID NO: 5589298 - DNA, 14 bp, Homo sapiens
catggagccccagc

SEQ ID NO: 5589299 - DNA, 18 bp, Homo sapiens
catggagccccagccccc

SEQ ID NO: 5589300 - DNA, 15 bp, Homo sapiens
catggagccccctct

SEQ ID NO: 5589301 - DNA, 19 bp, Homo sapiens
catggagcctacctctgtc

SEQ ID NO: 5589302 - DNA, 19 bp, Homo sapiens
catggagctcttccatttc

SEQ ID NO: 5589303 - DNA, 12 bp, Homo sapiens
catggagctggc

SEQ ID NO: 5589304 - DNA, 15 bp, Homo sapiens
catggagctgggcta

SEQ ID NO: 5589305 - DNA, 20 bp, Homo sapiens
catggagctgtcacctctca

SEQ ID NO: 5589306 - DNA, 21 bp, Homo sapiens
catggagctgtcacctctcag

SEQ ID NO: 5589307 - DNA, 14 bp, Homo sapiens
catggagctgtcat

SEQ ID NO: 5589308 - DNA, 23 bp, Homo sapiens
catggaggaggagggaggcgctg

SEQ ID NO: 5589309 - DNA, 13 bp, Homo sapiens
catggaggatggt

SEQ ID NO: 5589310 - DNA, 21 bp, Homo sapiens
catggaggatggtgtcctgag

SEQ ID NO: 5589311 - DNA, 13 bp, Homo sapiens
catggaggcacac

SEQ ID NO: 5589312 - DNA, 20 bp, Homo sapiens
catggaggcacacagctgca

SEQ ID NO: 5589313 - DNA, 16 bp, Homo sapiens
catggaggcagatgcc

SEQ ID NO: 5589314 - DNA, 20 bp, Homo sapiens
catggaggcaggctccccct

SEQ ID NO: 5589315 - DNA, 13 bp, Homo sapiens
catggaggccctc

SEQ ID NO: 5589316 - DNA, 13 bp, Homo sapiens
catggaggcgcct

SEQ ID NO: 5589317 - DNA, 18 bp, Homo sapiens
catggagggagggagtgg

SEQ ID NO: 5589318 - DNA, 21 bp, Homo sapiens
catggagggtatactgagggg

SEQ ID NO: 5589319 - DNA, 21 bp, Homo sapiens
catggagggtttagtgcttat

SEQ ID NO: 5589320 - DNA, 15 bp, Homo sapiens
catggaggttctaag

SEQ ID NO: 5589321 - DNA, 18 bp, Homo sapiens
catggaggttctaaggcc

SEQ ID NO: 5589322 - DNA, 20 bp, Homo sapiens
catggagtagcctggactgt

SEQ ID NO: 5589323 - DNA, 16 bp, Homo sapiens
catggagtatatgtca

SEQ ID NO: 5589324 - DNA, 13 bp, Homo sapiens
catggagtggcag

SEQ ID NO: 5589325 - DNA, 14 bp, Homo sapiens
catggagtggcagc

SEQ ID NO: 5589326 - DNA, 23 bp, Homo sapiens
catggagtggcagcccagccagc

SEQ ID NO: 5589327 - DNA, 14 bp, Homo sapiens
catggagtgtgtat

SEQ ID NO: 5589328 - DNA, 18 bp, Homo sapiens
catggagtgtgtattgtt

SEQ ID NO: 5589329 - DNA, 20 bp, Homo sapiens
catggagtgtgtattgttcc

SEQ ID NO: 5589330 - DNA, 21 bp, Homo sapiens
catggagtgtgtattgttccc

SEQ ID NO: 5589331 - DNA, 20 bp, Homo sapiens
catggagtgttggcttctca

SEQ ID NO: 5589332 - DNA, 13 bp, Homo sapiens
catggagtgtttg

SEQ ID NO: 5589333 - DNA, 20 bp, Homo sapiens
catggatgagtaaactgttt

SEQ ID NO: 5589334 - DNA, 20 bp, Homo sapiens
catggatgattcttttccca

SEQ ID NO: 5589335 - DNA, 13 bp, Homo sapiens
catggatgcacac

SEQ ID NO: 5589336 - DNA, 15 bp, Homo sapiens
catggatgcacgcac

SEQ ID NO: 5589337 - DNA, 17 bp, Homo sapiens
catggatgcagaaatga

SEQ ID NO: 5589338 - DNA, 14 bp, Homo sapiens
catggatgcatgcc

SEQ ID NO: 5589339 - DNA, 17 bp, Homo sapiens
catggatgcatttcaaa

SEQ ID NO: 5589340 - DNA, 18 bp, Homo sapiens
catggatgcatttcaaat

SEQ ID NO: 5589341 - DNA, 21 bp, Homo sapiens
catggatgcatttcaaatgtt

SEQ ID NO: 5589342 - DNA, 19 bp, Homo sapiens
catggatgcgaggaccact

SEQ ID NO: 5589343 - DNA, 13 bp, Homo sapiens
catggatgtgttg

SEQ ID NO: 5589344 - DNA, 21 bp, Homo sapiens
catggattaatagagttggag

SEQ ID NO: 5589345 - DNA, 17 bp, Homo sapiens
catggattccactgaaa

SEQ ID NO: 5589346 - DNA, 15 bp, Homo sapiens
catggattgccacag

SEQ ID NO: 5589347 - DNA, 13 bp, Homo sapiens
catggattgtaca

SEQ ID NO: 5589348 - DNA, 22 bp, Homo sapiens
catggatttattttttgtaact

SEQ ID NO: 5589349 - DNA, 23 bp, Homo sapiens
catggatttattttttgtaactc

SEQ ID NO: 5589350 - DNA, 22 bp, Homo sapiens
catggatttctctgctcacaga

SEQ ID NO: 5589351 - DNA, 14 bp, Homo sapiens
catggattttccag

SEQ ID NO: 5589352 - DNA, 14 bp, Homo sapiens
catggattttggat

SEQ ID NO: 5589353 - DNA, 23 bp, Homo sapiens
catggattttggataaatcattt

SEQ ID NO: 5589354 - DNA, 21 bp, Homo sapiens
catggatttttacaagatcca

SEQ ID NO: 5589355 - DNA, 17 bp, Homo sapiens
catggcaaatcaggggc

SEQ ID NO: 5589356 - DNA, 21 bp, Homo sapiens
catggcaaatcaggggccaga

SEQ ID NO: 5589357 - DNA, 23 bp, Homo sapiens
catggcaaatcaggggccagaga

SEQ ID NO: 5589358 - DNA, 14 bp, Homo sapiens
catggcaaatgggc

SEQ ID NO: 5589359 - DNA, 18 bp, Homo sapiens
catggcaaatgggcagct

SEQ ID NO: 5589360 - DNA, 23 bp, Homo sapiens
catggcaacgtgtgaactgcaac

SEQ ID NO: 5589361 - DNA, 15 bp, Homo sapiens
catggcaataaatgg

SEQ ID NO: 5589362 - DNA, 15 bp, Homo sapiens
catggcaatgaaaat

SEQ ID NO: 5589363 - DNA, 16 bp, Homo sapiens
catggcaatgaaaatt

SEQ ID NO: 5589364 - DNA, 18 bp, Homo sapiens
catggcaatggcatgccc

SEQ ID NO: 5589365 - DNA, 17 bp, Homo sapiens
catggcaattctggaag

SEQ ID NO: 5589366 - DNA, 14 bp, Homo sapiens
catggcacaggccc

SEQ ID NO: 5589367 - DNA, 20 bp, Homo sapiens
catggcaccaaagccaccag

SEQ ID NO: 5589368 - DNA, 14 bp, Homo sapiens
catggcaccagccc

SEQ ID NO: 5589369 - DNA, 17 bp, Homo sapiens
catggcaccagccccct

SEQ ID NO: 5589370 - DNA, 20 bp, Homo sapiens
catggcaccagccccctgga

SEQ ID NO: 5589371 - DNA, 22 bp, Homo sapiens
catggcaccagccccctggatg

SEQ ID NO: 5589372 - DNA, 19 bp, Homo sapiens
catggcactaaaccacttc

SEQ ID NO: 5589373 - DNA, 17 bp, Homo sapiens
catgtgaccattctgcc

SEQ ID NO: 5589374 - DNA, 20 bp, Homo sapiens
catgtgaccattctgcctct

SEQ ID NO: 5589375 - DNA, 16 bp, Homo sapiens
catgtgactagcgcct

SEQ ID NO: 5589376 - DNA, 13 bp, Homo sapiens
catgtgactctga

SEQ ID NO: 5589377 - DNA, 17 bp, Homo sapiens
catgtgactctggcttg

SEQ ID NO: 5589378 - DNA, 17 bp, Homo sapiens
catgtgactctttccaa

SEQ ID NO: 5589379 - DNA, 18 bp, Homo sapiens
catgtgacttctcccctg

SEQ ID NO: 5589380 - DNA, 20 bp, Homo sapiens
catgtgagaaagcagatcat

SEQ ID NO: 5589381 - DNA, 20 bp, Homo sapiens
catgtgagcatgtcacttcc

SEQ ID NO: 5589382 - DNA, 12 bp, Homo sapiens
catgtgagccac

SEQ ID NO: 5589383 - DNA, 18 bp, Homo sapiens
catgtgagccaccgctgc

SEQ ID NO: 5589384 - DNA, 23 bp, Homo sapiens
catgtgagccaccgctgccagca

SEQ ID NO: 5589385 - DNA, 18 bp, Homo sapiens
catgtgagctgctgccat

SEQ ID NO: 5589386 - DNA, 22 bp, Homo sapiens
catgtgaggactgggggcacct

SEQ ID NO: 5589387 - DNA, 16 bp, Homo sapiens
catgtgaggaggaaaa

SEQ ID NO: 5589388 - DNA, 17 bp, Homo sapiens
catgtgaggaggaaaag

SEQ ID NO: 5589389 - DNA, 17 bp, Homo sapiens
catgtgagtctgggata

SEQ ID NO: 5589390 - DNA, 18 bp, Homo sapiens
catgtgagtctgggatat

SEQ ID NO: 5589391 - DNA, 21 bp, Homo sapiens
catgtgataattgtaaaggtg

SEQ ID NO: 5589392 - DNA, 15 bp, Homo sapiens
catgtgatacatttt

SEQ ID NO: 5589393 - DNA, 16 bp, Homo sapiens
catgtgatacattttt

SEQ ID NO: 5589394 - DNA, 12 bp, Homo sapiens
catgtgatcctt

SEQ ID NO: 5589395 - DNA, 17 bp, Homo sapiens
catgtgatgagaggaaa

SEQ ID NO: 5589396 - DNA, 21 bp, Homo sapiens
catgtgatgagaggaaatcac

SEQ ID NO: 5589397 - DNA, 18 bp, Homo sapiens
catgtgatggacactcca

SEQ ID NO: 5589398 - DNA, 22 bp, Homo sapiens
catgtgatggacactccaggga

SEQ ID NO: 5589399 - DNA, 14 bp, Homo sapiens
catgtgatgtcatg

SEQ ID NO: 5589400 - DNA, 15 bp, Homo sapiens
catgtgattaatgtt

SEQ ID NO: 5589401 - DNA, 18 bp, Homo sapiens
catgtgattaccctctgg

SEQ ID NO: 5589402 - DNA, 22 bp, Homo sapiens
catgtgattggcagcttcaaaa

SEQ ID NO: 5589403 - DNA, 21 bp, Homo sapiens
catgtgcaaacccactcagag

SEQ ID NO: 5589404 - DNA, 17 bp, Homo sapiens
catgtgcaactcttgta

SEQ ID NO: 5589405 - DNA, 18 bp, Homo sapiens
catgtgcacccggcctgg

SEQ ID NO: 5589406 - DNA, 17 bp, Homo sapiens
catgtgcacctatggcc

SEQ ID NO: 5589407 - DNA, 20 bp, Homo sapiens
catgtgcacctatggcccag

SEQ ID NO: 5589408 - DNA, 23 bp, Homo sapiens
catgtgcagggtgggctggtgaa

SEQ ID NO: 5589409 - DNA, 13 bp, Homo sapiens
catgtgcagtgct

SEQ ID NO: 5589410 - DNA, 19 bp, Homo sapiens
catgtgcattattttccag

SEQ ID NO: 5589411 - DNA, 19 bp, Homo sapiens
catgtgccaagattctact

SEQ ID NO: 5589412 - DNA, 21 bp, Homo sapiens
catgtgccagttgcctggatt

SEQ ID NO: 5589413 - DNA, 17 bp, Homo sapiens
catgtgccccctctacc

SEQ ID NO: 5589414 - DNA, 15 bp, Homo sapiens
catgtgcccctgcca

SEQ ID NO: 5589415 - DNA, 17 bp, Homo sapiens
catgtgcccctgccaag

SEQ ID NO: 5589416 - DNA, 18 bp, Homo sapiens
catgtgccctcctgaggg

SEQ ID NO: 5589417 - DNA, 13 bp, Homo sapiens
catgtgccctgcc

SEQ ID NO: 5589418 - DNA, 15 bp, Homo sapiens
catgtgccctgcctt

SEQ ID NO: 5589419 - DNA, 17 bp, Homo sapiens
catgtgcctctgtcctt

SEQ ID NO: 5589420 - DNA, 15 bp, Homo sapiens
catgtgcctgatcca

SEQ ID NO: 5589421 - DNA, 20 bp, Homo sapiens
catgtgcctgcaccaggaga

SEQ ID NO: 5589422 - DNA, 22 bp, Homo sapiens
catgtgcctgcaccaggagaca

SEQ ID NO: 5589423 - DNA, 13 bp, Homo sapiens
catgtgcctggaa

SEQ ID NO: 5589424 - DNA, 12 bp, Homo sapiens
catgtgcctttc

SEQ ID NO: 5589425 - DNA, 17 bp, Homo sapiens
catgtgcctttctttgc

SEQ ID NO: 5589426 - DNA, 23 bp, Homo sapiens
catgtgcctttctttgcctctgc

SEQ ID NO: 5589427 - DNA, 16 bp, Homo sapiens
catgtgcgaacacagt

SEQ ID NO: 5589428 - DNA, 19 bp, Homo sapiens
catgtgcgtttcatgtgtt

SEQ ID NO: 5589429 - DNA, 20 bp, Homo sapiens
catgtgcgtttcatgtgttt

SEQ ID NO: 5589430 - DNA, 17 bp, Homo sapiens
catgtgctaataagttt

SEQ ID NO: 5589431 - DNA, 17 bp, Homo sapiens
catgtgctacaggggcc

SEQ ID NO: 5589432 - DNA, 20 bp, Homo sapiens
catgtgctacaggggccaga

SEQ ID NO: 5589433 - DNA, 22 bp, Homo sapiens
catgtgctacaggggccagaag

SEQ ID NO: 5589434 - DNA, 18 bp, Homo sapiens
catgtgctattgaactga

SEQ ID NO: 5589435 - DNA, 18 bp, Homo sapiens
catgtgctcagccccaga

SEQ ID NO: 5589436 - DNA, 19 bp, Homo sapiens
catgtgctgccctgttgcc

SEQ ID NO: 5589437 - DNA, 21 bp, Homo sapiens
catgtgctgggaaatgcagaa

SEQ ID NO: 5589438 - DNA, 19 bp, Homo sapiens
catgtgctggtaaatgtta

SEQ ID NO: 5589439 - DNA, 13 bp, Homo sapiens
catgtgctgtctc

SEQ ID NO: 5589440 - DNA, 22 bp, Homo sapiens
catgtgctgtctccatgctgga

SEQ ID NO: 5589441 - DNA, 13 bp, Homo sapiens
catgtgctgtgca

SEQ ID NO: 5589442 - DNA, 20 bp, Homo sapiens
catgtgctgtgcacccgtgc

SEQ ID NO: 5589443 - DNA, 14 bp, Homo sapiens
catgtgctgtgtga

SEQ ID NO: 5589444 - DNA, 13 bp, Homo sapiens
catgtgcttcatc

SEQ ID NO: 5589445 - DNA, 16 bp, Homo sapiens
catgtgctttgtagct

SEQ ID NO: 5589446 - DNA, 18 bp, Homo sapiens
catgtgctttgtagctta

SEQ ID NO: 5589447 - DNA, 21 bp, Homo sapiens
catgtggaaaaaaaaaagatg

SEQ ID NO: 5589448 - DNA, 16 bp, Homo sapiens
catgtggaaagtgaat

SEQ ID NO: 5589449 - DNA, 23 bp, Homo sapiens
catgtggaaagtgaatttgaatg

SEQ ID NO: 5589450 - DNA, 22 bp, Homo sapiens
catgtggaaatgacccaaacat

SEQ ID NO: 5589451 - DNA, 23 bp, Homo sapiens
catgtggaaggcaagccaggctc

SEQ ID NO: 5589452 - DNA, 17 bp, Homo sapiens
catgtggagacttcatc

SEQ ID NO: 5589453 - DNA, 15 bp, Homo sapiens
catgtggagtcagcc

SEQ ID NO: 5589454 - DNA, 22 bp, Homo sapiens
catgtggatatcagttaccaaa

SEQ ID NO: 5589455 - DNA, 20 bp, Homo sapiens
catgtggcaaaatatggttt

SEQ ID NO: 5589456 - DNA, 15 bp, Homo sapiens
catgtggcaacctgt

SEQ ID NO: 5589457 - DNA, 12 bp, Homo sapiens
catgtggcagca

SEQ ID NO: 5589458 - DNA, 12 bp, Homo sapiens
catgtggccaag

SEQ ID NO: 5589459 - DNA, 19 bp, Homo sapiens
catgtggcctaatattgaa

SEQ ID NO: 5589460 - DNA, 15 bp, Homo sapiens
catgtggcctgccca

SEQ ID NO: 5589461 - DNA, 17 bp, Homo sapiens
catgtggcctgcccagc

SEQ ID NO: 5589462 - DNA, 14 bp, Homo sapiens
catgtggcctgtgg

SEQ ID NO: 5589463 - DNA, 12 bp, Homo sapiens
catgtggccttg

SEQ ID NO: 5589464 - DNA, 16 bp, Homo sapiens
catgtggctccccctg

SEQ ID NO: 5589465 - DNA, 11 bp, Homo sapiens
catgtggctga

SEQ ID NO: 5589466 - DNA, 22 bp, Homo sapiens
catgtggctgtagatcccaaga

SEQ ID NO: 5589467 - DNA, 23 bp, Homo sapiens
catgtggcttctctgtctctgtg

SEQ ID NO: 5589468 - DNA, 12 bp, Homo sapiens
catgtgggagct

SEQ ID NO: 5589469 - DNA, 16 bp, Homo sapiens
catgtgggaggaagaa

SEQ ID NO: 5589470 - DNA, 16 bp, Homo sapiens
catgtgggatgagttt

SEQ ID NO: 5589471 - DNA, 15 bp, Homo sapiens
catgtgggcgcccac

SEQ ID NO: 5589472 - DNA, 16 bp, Homo sapiens
catgtgggcgcccacc

SEQ ID NO: 5589473 - DNA, 17 bp, Homo sapiens
catgtgggctgaaggat

SEQ ID NO: 5589474 - DNA, 22 bp, Homo sapiens
catgtggggaggttaatctagg

SEQ ID NO: 5589475 - DNA, 15 bp, Homo sapiens
catgtggggccaggt

SEQ ID NO: 5589476 - DNA, 16 bp, Homo sapiens
catgtgggtcatacct

SEQ ID NO: 5589477 - DNA, 16 bp, Homo sapiens
catgtgggtgagccag

SEQ ID NO: 5589478 - DNA, 20 bp, Homo sapiens
catgtgggtgagccagtgga

SEQ ID NO: 5589479 - DNA, 21 bp, Homo sapiens
catgtgggttgtgatattgac

SEQ ID NO: 5589480 - DNA, 17 bp, Homo sapiens
catgtgtacagaaacaa

SEQ ID NO: 5589481 - DNA, 19 bp, Homo sapiens
catgtgtacagaaacaact

SEQ ID NO: 5589482 - DNA, 22 bp, Homo sapiens
catgtgtacattctgcctagag

SEQ ID NO: 5589483 - DNA, 21 bp, Homo sapiens
catgtgtagatattatgtata

SEQ ID NO: 5589484 - DNA, 15 bp, Homo sapiens
catgtgtagcctatg

SEQ ID NO: 5589485 - DNA, 16 bp, Homo sapiens
catgtgtagcctgtgc

SEQ ID NO: 5589486 - DNA, 13 bp, Homo sapiens
catgtgtataaaa

SEQ ID NO: 5589487 - DNA, 12 bp, Homo sapiens
catgtgtatgtg

SEQ ID NO: 5589488 - DNA, 17 bp, Homo sapiens
catgtgtcacttgtgct

SEQ ID NO: 5589489 - DNA, 18 bp, Homo sapiens
catgtgtcacttgtgctt

SEQ ID NO: 5589490 - DNA, 22 bp, Homo sapiens
catgtgtcacttgtgctttgct

SEQ ID NO: 5589491 - DNA, 24 bp, Homo sapiens
catgtgtcatgaagaatgtttctg

SEQ ID NO: 5589492 - DNA, 17 bp, Homo sapiens
catgtgtcccagaagat

SEQ ID NO: 5589493 - DNA, 21 bp, Homo sapiens
catgtgtcccccctgtggtct

SEQ ID NO: 5589494 - DNA, 23 bp, Homo sapiens
catgtgtcccccctgtggtctgt

SEQ ID NO: 5589495 - DNA, 14 bp, Homo sapiens
catgtgtcccctca

SEQ ID NO: 5589496 - DNA, 15 bp, Homo sapiens
catgtgtcccctcac

SEQ ID NO: 5589497 - DNA, 16 bp, Homo sapiens
catgtgtcccctcact

SEQ ID NO: 5589498 - DNA, 21 bp, Homo sapiens
catgtgtccctggcgctgtgc

SEQ ID NO: 5589499 - DNA, 20 bp, Homo sapiens
catgtgtcctggtgagaaaa

SEQ ID NO: 5589500 - DNA, 21 bp, Homo sapiens
catgtgtcctggtgagaaaat

SEQ ID NO: 5589501 - DNA, 14 bp, Homo sapiens
catgtgtctgtatt

SEQ ID NO: 5589502 - DNA, 24 bp, Homo sapiens
catgtgtctgtattcatacagcac

SEQ ID NO: 5589503 - DNA, 14 bp, Homo sapiens
catgtgtgatgctg

SEQ ID NO: 5589504 - DNA, 14 bp, Homo sapiens
catgtgtgcagagc

SEQ ID NO: 5589505 - DNA, 15 bp, Homo sapiens
catgtgtgcagagca

SEQ ID NO: 5589506 - DNA, 16 bp, Homo sapiens
catgtgtgcagagcag

SEQ ID NO: 5589507 - DNA, 17 bp, Homo sapiens
catgtgtgcagagcaga

SEQ ID NO: 5589508 - DNA, 20 bp, Homo sapiens
catgtgtgcatgtgagcaca

SEQ ID NO: 5589509 - DNA, 17 bp, Homo sapiens
catgtgtgcctggccgc

SEQ ID NO: 5589510 - DNA, 14 bp, Homo sapiens
catgtgtgcctgtg

SEQ ID NO: 5589511 - DNA, 22 bp, Homo sapiens
catgtgtgctcacaatgttctg

SEQ ID NO: 5589512 - DNA, 18 bp, Homo sapiens
catgtgtgctcttcttct

SEQ ID NO: 5589513 - DNA, 14 bp, Homo sapiens
catgtgtgctgaac

SEQ ID NO: 5589514 - DNA, 12 bp, Homo sapiens
catgtgtggaaa

SEQ ID NO: 5589515 - DNA, 13 bp, Homo sapiens
catgtgtggaagt

SEQ ID NO: 5589516 - DNA, 18 bp, Homo sapiens
catgtgtggtggtgtttt

SEQ ID NO: 5589517 - DNA, 11 bp, Homo sapiens
catgtgtgtat

SEQ ID NO: 5589518 - DNA, 16 bp, Homo sapiens
catgtgtgtatatatg

SEQ ID NO: 5589519 - DNA, 17 bp, Homo sapiens
catgtgtgtatatatgt

SEQ ID NO: 5589520 - DNA, 19 bp, Homo sapiens
catgtgtgtatatatgtgt

SEQ ID NO: 5589521 - DNA, 23 bp, Homo sapiens
catgtgtgtatcaccctcagctg

SEQ ID NO: 5589522 - DNA, 14 bp, Homo sapiens
catgtgtgtatttt

SEQ ID NO: 5589523 - DNA, 13 bp, Homo sapiens
catgtgtgtcagc

SEQ ID NO: 5589524 - DNA, 12 bp, Homo sapiens
catgtgtgtcca

SEQ ID NO: 5589525 - DNA, 21 bp, Homo sapiens
catgtgtgtccacgactgtct

SEQ ID NO: 5589526 - DNA, 22 bp, Homo sapiens
catgtgtgtccacgactgtctc

SEQ ID NO: 5589527 - DNA, 21 bp, Homo sapiens
catgtgtgtgcaagtgtgtgc

SEQ ID NO: 5589528 - DNA, 19 bp, Homo sapiens
catgtgtgtgtgtgtgtgt

SEQ ID NO: 5589529 - DNA, 19 bp, Homo sapiens
catgtgttatctacctcaa

SEQ ID NO: 5589530 - DNA, 16 bp, Homo sapiens
catgtgttatgttttc

SEQ ID NO: 5589531 - DNA, 14 bp, Homo sapiens
catgtgttcattct

SEQ ID NO: 5589532 - DNA, 13 bp, Homo sapiens
catgtgttccctt

SEQ ID NO: 5589533 - DNA, 14 bp, Homo sapiens
catgtgttgaaaaa

SEQ ID NO: 5589534 - DNA, 22 bp, Homo sapiens
catgtgttgagcgtattcttga

SEQ ID NO: 5589535 - DNA, 17 bp, Homo sapiens
catgtgttgcaaattat

SEQ ID NO: 5589536 - DNA, 20 bp, Homo sapiens
catgtgttgcaaattattct

SEQ ID NO: 5589537 - DNA, 19 bp, Homo sapiens
catgtgttgcagctgtcac

SEQ ID NO: 5589538 - DNA, 21 bp, Homo sapiens
catgtgttgcagctgtcacca

SEQ ID NO: 5589539 - DNA, 14 bp, Homo sapiens
catgtgtttctgac

SEQ ID NO: 5589540 - DNA, 20 bp, Homo sapiens
catgtgttttaattccaata

SEQ ID NO: 5589541 - DNA, 18 bp, Homo sapiens
catgtgttttataaaatc

SEQ ID NO: 5589542 - DNA, 15 bp, Homo sapiens
catgtgttttcatca

SEQ ID NO: 5589543 - DNA, 22 bp, Homo sapiens
catgttaaaccatgggataaat

SEQ ID NO: 5589544 - DNA, 13 bp, Homo sapiens
catgttaaagagg

SEQ ID NO: 5589545 - DNA, 15 bp, Homo sapiens
catgttaaatgactt

SEQ ID NO: 5589546 - DNA, 15 bp, Homo sapiens
catgttaagtgccat

SEQ ID NO: 5589547 - DNA, 16 bp, Homo sapiens
catgttaagttacagt

SEQ ID NO: 5589548 - DNA, 19 bp, Homo sapiens
catgttaatacatcatttt

SEQ ID NO: 5589549 - DNA, 16 bp, Homo sapiens
catgttaatatttgaa

SEQ ID NO: 5589550 - DNA, 19 bp, Homo sapiens
catgttaattaaactgaag

SEQ ID NO: 5589551 - DNA, 15 bp, Homo sapiens
cattatttttctgta

SEQ ID NO: 5589552 - DNA, 23 bp, Homo sapiens
cattatttttgtagttagacaat

SEQ ID NO: 5589553 - DNA, 20 bp, Homo sapiens
cattatttttgttagcaaag

SEQ ID NO: 5589554 - DNA, 16 bp, Homo sapiens
cattattttttgttga

SEQ ID NO: 5589555 - DNA, 21 bp, Homo sapiens
cattcaaaaaactctctccca

SEQ ID NO: 5589556 - DNA, 22 bp, Homo sapiens
cattcaaaaaactctctcccag

SEQ ID NO: 5589557 - DNA, 20 bp, Homo sapiens
cattcaaaaacatggccaca

SEQ ID NO: 5589558 - DNA, 23 bp, Homo sapiens
cattcaaaaacatggccacatcc

SEQ ID NO: 5589559 - DNA, 24 bp, Homo sapiens
cattcaaaaagacagcagacaaaa

SEQ ID NO: 5589560 - DNA, 14 bp, Homo sapiens
cattcaaaaatttc

SEQ ID NO: 5589561 - DNA, 15 bp, Homo sapiens
cattcaaaagcacaa

SEQ ID NO: 5589562 - DNA, 16 bp, Homo sapiens
cattcaaaatagttct

SEQ ID NO: 5589563 - DNA, 23 bp, Homo sapiens
cattcaaaatagttctatttcta

SEQ ID NO: 5589564 - DNA, 16 bp, Homo sapiens
cattcaaaatgtccag

SEQ ID NO: 5589565 - DNA, 19 bp, Homo sapiens
cattcaaacctcacaacag

SEQ ID NO: 5589566 - DNA, 13 bp, Homo sapiens
cattcaaactgca

SEQ ID NO: 5589567 - DNA, 19 bp, Homo sapiens
cattcaaatcagtgatcta

SEQ ID NO: 5589568 - DNA, 14 bp, Homo sapiens
cattcaaattcttt

SEQ ID NO: 5589569 - DNA, 13 bp, Homo sapiens
cattcaaatttgt

SEQ ID NO: 5589570 - DNA, 13 bp, Homo sapiens
cattcaacacatt

SEQ ID NO: 5589571 - DNA, 16 bp, Homo sapiens
cattcaacacattttt

SEQ ID NO: 5589572 - DNA, 15 bp, Homo sapiens
cattcaaccttacca

SEQ ID NO: 5589573 - DNA, 22 bp, Homo sapiens
cattcaactttagtatttttac

SEQ ID NO: 5589574 - DNA, 23 bp, Homo sapiens
cattcaactttagtatttttact

SEQ ID NO: 5589575 - DNA, 19 bp, Homo sapiens
cattcaagagaggtgctat

SEQ ID NO: 5589576 - DNA, 16 bp, Homo sapiens
cattcaagtcagctct

SEQ ID NO: 5589577 - DNA, 18 bp, Homo sapiens
cattcaagtgtaaaatat

SEQ ID NO: 5589578 - DNA, 19 bp, Homo sapiens
cattcaagtgtaaaatatt

SEQ ID NO: 5589579 - DNA, 20 bp, Homo sapiens
cattcaagtgtaaaatattt

SEQ ID NO: 5589580 - DNA, 21 bp, Homo sapiens
cattcaagtgtaaaatatttt

SEQ ID NO: 5589581 - DNA, 17 bp, Homo sapiens
cattcaatctttggagg

SEQ ID NO: 5589582 - DNA, 14 bp, Homo sapiens
cattcaatgaatta

SEQ ID NO: 5589583 - DNA, 22 bp, Homo sapiens
cattcaattagtggtcataaaa

SEQ ID NO: 5589584 - DNA, 21 bp, Homo sapiens
cattcaatttattcaagaaaa

SEQ ID NO: 5589585 - DNA, 21 bp, Homo sapiens
cattcaatttcaggctcccca

SEQ ID NO: 5589586 - DNA, 19 bp, Homo sapiens
cattcacaactatgaaatc

SEQ ID NO: 5589587 - DNA, 15 bp, Homo sapiens
cattcacaagcctcc

SEQ ID NO: 5589588 - DNA, 15 bp, Homo sapiens
cattcacacacagcc

SEQ ID NO: 5589589 - DNA, 19 bp, Homo sapiens
cattcacagcccagaacca

SEQ ID NO: 5589590 - DNA, 19 bp, Homo sapiens
cattcacagcgcctcctgg

SEQ ID NO: 5589591 - DNA, 22 bp, Homo sapiens
cattcacagcgcctcctggacc

SEQ ID NO: 5589592 - DNA, 22 bp, Homo sapiens
cattcacagttctttgggccag

SEQ ID NO: 5589593 - DNA, 13 bp, Homo sapiens
cattcacatttca

SEQ ID NO: 5589594 - DNA, 15 bp, Homo sapiens
cattcacatttcaag

SEQ ID NO: 5589595 - DNA, 20 bp, Homo sapiens
cattcacatttgatgtacat

SEQ ID NO: 5589596 - DNA, 21 bp, Homo sapiens
cattcacatttgatgtacatg

SEQ ID NO: 5589597 - DNA, 12 bp, Homo sapiens
cattcacatttt

SEQ ID NO: 5589598 - DNA, 22 bp, Homo sapiens
cattcaccaaatgatgccactt

SEQ ID NO: 5589599 - DNA, 13 bp, Homo sapiens
cattcacccagac

SEQ ID NO: 5589600 - DNA, 14 bp, Homo sapiens
cattcacccagaca

SEQ ID NO: 5589601 - DNA, 13 bp, Homo sapiens
cattcacctgccc

SEQ ID NO: 5589602 - DNA, 19 bp, Homo sapiens
cattcacctgccccaactc

SEQ ID NO: 5589603 - DNA, 22 bp, Homo sapiens
cattcacggagatatgaagagc

SEQ ID NO: 5589604 - DNA, 14 bp, Homo sapiens
cattcacggcctgg

SEQ ID NO: 5589605 - DNA, 15 bp, Homo sapiens
cattcactagctttg

SEQ ID NO: 5589606 - DNA, 11 bp, Homo sapiens
cattcactgat

SEQ ID NO: 5589607 - DNA, 14 bp, Homo sapiens
cattcactgctgat

SEQ ID NO: 5589608 - DNA, 14 bp, Homo sapiens
cattcacttcactg

SEQ ID NO: 5589609 - DNA, 15 bp, Homo sapiens
cattcacttcataat

SEQ ID NO: 5589610 - DNA, 15 bp, Homo sapiens
cattcacttgcattt

SEQ ID NO: 5589611 - DNA, 14 bp, Homo sapiens
cattcagaaaactt

SEQ ID NO: 5589612 - DNA, 14 bp, Homo sapiens
cattcagaaagctt

SEQ ID NO: 5589613 - DNA, 15 bp, Homo sapiens
cattcagaaatgttg

SEQ ID NO: 5589614 - DNA, 17 bp, Homo sapiens
cattcagaactctcaga

SEQ ID NO: 5589615 - DNA, 13 bp, Homo sapiens
cattcagaagaaa

SEQ ID NO: 5589616 - DNA, 17 bp, Homo sapiens
cattcagaagaaaaaga

SEQ ID NO: 5589617 - DNA, 15 bp, Homo sapiens
cattcagacacttca

SEQ ID NO: 5589618 - DNA, 19 bp, Homo sapiens
cattcagagactgcccttc

SEQ ID NO: 5589619 - DNA, 22 bp, Homo sapiens
cattcagagactgcccttctca

SEQ ID NO: 5589620 - DNA, 18 bp, Homo sapiens
cattcagagctatggtgc

SEQ ID NO: 5589621 - DNA, 13 bp, Homo sapiens
cattcagagtcag

SEQ ID NO: 5589622 - DNA, 21 bp, Homo sapiens
cattcagatataagatttgta

SEQ ID NO: 5589623 - DNA, 13 bp, Homo sapiens
cattcagcacaca

SEQ ID NO: 5589624 - DNA, 19 bp, Homo sapiens
cattcagcacaccccaagg

SEQ ID NO: 5589625 - DNA, 15 bp, Homo sapiens
cattcagcagaatga

SEQ ID NO: 5589626 - DNA, 23 bp, Homo sapiens
cattcagcagaatgactctggaa

SEQ ID NO: 5589627 - DNA, 19 bp, Homo sapiens
cattcagcatctactctaa

SEQ ID NO: 5589628 - DNA, 16 bp, Homo sapiens
cattcagcatgggtcc

SEQ ID NO: 5589629 - DNA, 15 bp, Homo sapiens
cattcagctaacaaa

SEQ ID NO: 5589630 - DNA, 13 bp, Homo sapiens
cattcagcttcct

SEQ ID NO: 5589631 - DNA, 13 bp, Homo sapiens
cattcaggaaaac

SEQ ID NO: 5589632 - DNA, 20 bp, Homo sapiens
cattcaggaaaactgacaga

SEQ ID NO: 5589633 - DNA, 17 bp, Homo sapiens
cattcaggaagatgaaa

SEQ ID NO: 5589634 - DNA, 19 bp, Homo sapiens
cattcaggaattcttggag

SEQ ID NO: 5589635 - DNA, 14 bp, Homo sapiens
cattcaggcagcac

SEQ ID NO: 5589636 - DNA, 16 bp, Homo sapiens
cattcagggttataca

SEQ ID NO: 5589637 - DNA, 15 bp, Homo sapiens
cattcaggtgacctc

SEQ ID NO: 5589638 - DNA, 18 bp, Homo sapiens
cattcaggtgttctcttc

SEQ ID NO: 5589639 - DNA, 19 bp, Homo sapiens
cattcaggtgttctcttct

SEQ ID NO: 5589640 - DNA, 15 bp, Homo sapiens
cattcagtaagttct

SEQ ID NO: 5589641 - DNA, 14 bp, Homo sapiens
cattcagtacttta

SEQ ID NO: 5589642 - DNA, 14 bp, Homo sapiens
cattcagtcccaaa

SEQ ID NO: 5589643 - DNA, 23 bp, Homo sapiens
cattcagtccgcctggccggctc

SEQ ID NO: 5589644 - DNA, 14 bp, Homo sapiens
cattcagtgagaca

SEQ ID NO: 5589645 - DNA, 20 bp, Homo sapiens
cattcagtgagacacagagt

SEQ ID NO: 5589646 - DNA, 15 bp, Homo sapiens
cattcagtggcaact

SEQ ID NO: 5589647 - DNA, 15 bp, Homo sapiens
cattcagttctaggc

SEQ ID NO: 5589648 - DNA, 18 bp, Homo sapiens
cattcagttctaggcctt

SEQ ID NO: 5589649 - DNA, 14 bp, Homo sapiens
cattcataaacttt

SEQ ID NO: 5589650 - DNA, 13 bp, Homo sapiens
cattcataaggaa

SEQ ID NO: 5589651 - DNA, 15 bp, Homo sapiens
cattcataaggaaat

SEQ ID NO: 5589652 - DNA, 14 bp, Homo sapiens
cattcataatttta

SEQ ID NO: 5589653 - DNA, 18 bp, Homo sapiens
cattcatactaaataaaa

SEQ ID NO: 5589654 - DNA, 18 bp, Homo sapiens
cattcatacttaaaaatt

SEQ ID NO: 5589655 - DNA, 19 bp, Homo sapiens
cattcatatcctccgccct

SEQ ID NO: 5589656 - DNA, 19 bp, Homo sapiens
cattcatattacaatattt

SEQ ID NO: 5589657 - DNA, 15 bp, Homo sapiens
cattcatattcctgc

SEQ ID NO: 5589658 - DNA, 20 bp, Homo sapiens
cattcatccagttgcaataa

SEQ ID NO: 5589659 - DNA, 22 bp, Homo sapiens
cattcatccagttgcaataaaa

SEQ ID NO: 5589660 - DNA, 16 bp, Homo sapiens
cattcatccatccgtt

SEQ ID NO: 5589661 - DNA, 17 bp, Homo sapiens
cattcatcctcacatgt

SEQ ID NO: 5589662 - DNA, 14 bp, Homo sapiens
cattcatccttcca

SEQ ID NO: 5589663 - DNA, 23 bp, Homo sapiens
cattcatcctttaagaaaaacat

SEQ ID NO: 5589664 - DNA, 13 bp, Homo sapiens
cattcatctcatt

SEQ ID NO: 5589665 - DNA, 20 bp, Homo sapiens
cattcatctttcctttgctc

SEQ ID NO: 5589666 - DNA, 16 bp, Homo sapiens
cattcatgacaacatg

SEQ ID NO: 5589667 - DNA, 23 bp, Homo sapiens
cattcatgcaagagtttcttgta

SEQ ID NO: 5589668 - DNA, 18 bp, Homo sapiens
cattcatgccaaagcaaa

SEQ ID NO: 5589669 - DNA, 21 bp, Homo sapiens
cattcatgccaaagcaaaaga

SEQ ID NO: 5589670 - DNA, 15 bp, Homo sapiens
cattcatggatattt

SEQ ID NO: 5589671 - DNA, 16 bp, Homo sapiens
cattcatggttatgaa

SEQ ID NO: 5589672 - DNA, 17 bp, Homo sapiens
cattcatgtaactctcc

SEQ ID NO: 5589673 - DNA, 16 bp, Homo sapiens
cattcatgttttaaaa

SEQ ID NO: 5589674 - DNA, 18 bp, Homo sapiens
cattcattacctgtttat

SEQ ID NO: 5589675 - DNA, 23 bp, Homo sapiens
cattcatttacaacttccagatt

SEQ ID NO: 5589676 - DNA, 20 bp, Homo sapiens
cattcatttagctaaacgga

SEQ ID NO: 5589677 - DNA, 14 bp, Homo sapiens
cattcattttatat

SEQ ID NO: 5589678 - DNA, 17 bp, Homo sapiens
cattcattttatattga

SEQ ID NO: 5589679 - DNA, 22 bp, Homo sapiens
cattcattttatattgaaaaaa

SEQ ID NO: 5589680 - DNA, 11 bp, Homo sapiens
cattcattttt

SEQ ID NO: 5589681 - DNA, 16 bp, Homo sapiens
cattcatttttatagc

SEQ ID NO: 5589682 - DNA, 20 bp, Homo sapiens
cattccaaaagggggcctgg

SEQ ID NO: 5589683 - DNA, 24 bp, Homo sapiens
cattccaaaatacaatgttatcaa

SEQ ID NO: 5589684 - DNA, 19 bp, Homo sapiens
cattccaaaggggacccct

SEQ ID NO: 5589685 - DNA, 12 bp, Homo sapiens
cattccaaagtt

SEQ ID NO: 5589686 - DNA, 22 bp, Homo sapiens
cattccaactatctcatttcca

SEQ ID NO: 5589687 - DNA, 17 bp, Homo sapiens
cattccaagaactataa

SEQ ID NO: 5589688 - DNA, 13 bp, Homo sapiens
cattccaagacag

SEQ ID NO: 5589689 - DNA, 14 bp, Homo sapiens
cattccaagactct

SEQ ID NO: 5589690 - DNA, 20 bp, Homo sapiens
cattccaattctaaatccga

SEQ ID NO: 5589691 - DNA, 14 bp, Homo sapiens
cattccacactgtt

SEQ ID NO: 5589692 - DNA, 24 bp, Homo sapiens
cattccacaggacgaatgcatatt

SEQ ID NO: 5589693 - DNA, 21 bp, Homo sapiens
cattccacaggatcatcattt

SEQ ID NO: 5589694 - DNA, 14 bp, Homo sapiens
cattccaccacccc

SEQ ID NO: 5589695 - DNA, 22 bp, Homo sapiens
cattccaccttcccatgccctg

SEQ ID NO: 5589696 - DNA, 15 bp, Homo sapiens
cattccactgtgcgt

SEQ ID NO: 5589697 - DNA, 16 bp, Homo sapiens
cattccagagctgcag

SEQ ID NO: 5589698 - DNA, 13 bp, Homo sapiens
cattccagagtgc

SEQ ID NO: 5589699 - DNA, 17 bp, Homo sapiens
cattccagatcccaggc

SEQ ID NO: 5589700 - DNA, 13 bp, Homo sapiens
cattccagcagct

SEQ ID NO: 5589701 - DNA, 20 bp, Homo sapiens
cattccagccaggcccaggc

SEQ ID NO: 5589702 - DNA, 13 bp, Homo sapiens
cattccagcccct

SEQ ID NO: 5589703 - DNA, 22 bp, Homo sapiens
cattccagcccctctggtcgct

SEQ ID NO: 5589704 - DNA, 18 bp, Homo sapiens
cattccagcgtctgctgt

SEQ ID NO: 5589705 - DNA, 16 bp, Homo sapiens
cattccagctctgccc

SEQ ID NO: 5589706 - DNA, 17 bp, Homo sapiens
cattccagctctgcccc

SEQ ID NO: 5589707 - DNA, 15 bp, Homo sapiens
cattccaggaaaact

SEQ ID NO: 5589708 - DNA, 12 bp, Homo sapiens
cattccaggcag

SEQ ID NO: 5589709 - DNA, 18 bp, Homo sapiens
cattccaggcagcctctg

SEQ ID NO: 5589710 - DNA, 19 bp, Homo sapiens
cattccaggcagcctctgt

SEQ ID NO: 5589711 - DNA, 17 bp, Homo sapiens
cattccaggcccgaagc

SEQ ID NO: 5589712 - DNA, 14 bp, Homo sapiens
cattccagggctgg

SEQ ID NO: 5589713 - DNA, 18 bp, Homo sapiens
cattccaggggcctcagg

SEQ ID NO: 5589714 - DNA, 18 bp, Homo sapiens
cattccagtaactttttt

SEQ ID NO: 5589715 - DNA, 17 bp, Homo sapiens
cattccagtacagtatt

SEQ ID NO: 5589716 - DNA, 23 bp, Homo sapiens
cattccagtacagtattctttta

SEQ ID NO: 5589717 - DNA, 16 bp, Homo sapiens
cattccagtcaggctc

SEQ ID NO: 5589718 - DNA, 15 bp, Homo sapiens
cattccataaatgtc

SEQ ID NO: 5589719 - DNA, 20 bp, Homo sapiens
cattccatatatatctgagt

SEQ ID NO: 5589720 - DNA, 16 bp, Homo sapiens
cattccatcacagcca

SEQ ID NO: 5589721 - DNA, 21 bp, Homo sapiens
cattccatcacagccagccca

SEQ ID NO: 5589722 - DNA, 23 bp, Homo sapiens
cattccatcacagccagcccagc

SEQ ID NO: 5589723 - DNA, 15 bp, Homo sapiens
cattccatctagttt

SEQ ID NO: 5589724 - DNA, 18 bp, Homo sapiens
cattccatgacgcaggag

SEQ ID NO: 5589725 - DNA, 16 bp, Homo sapiens
cattccatgactctgc

SEQ ID NO: 5589726 - DNA, 20 bp, Homo sapiens
cattccatgactctgcctaa

SEQ ID NO: 5589727 - DNA, 11 bp, Homo sapiens
cattccatgat

SEQ ID NO: 5589728 - DNA, 13 bp, Homo sapiens
cattccatgattt

SEQ ID NO: 5589729 - DNA, 20 bp, Homo sapiens
cattgcctcggctggctccc

SEQ ID NO: 5589730 - DNA, 23 bp, Homo sapiens
cattgcctgatttgttccttctg

SEQ ID NO: 5589731 - DNA, 14 bp, Homo sapiens
cattgcctgtaaca

SEQ ID NO: 5589732 - DNA, 19 bp, Homo sapiens
cattgcctgttctgcttcg

SEQ ID NO: 5589733 - DNA, 20 bp, Homo sapiens
cattgccttgagcttttcag

SEQ ID NO: 5589734 - DNA, 17 bp, Homo sapiens
cattgccttgggcctgg

SEQ ID NO: 5589735 - DNA, 14 bp, Homo sapiens
cattgcctttccag

SEQ ID NO: 5589736 - DNA, 23 bp, Homo sapiens
cattgcctttccagggttattta

SEQ ID NO: 5589737 - DNA, 14 bp, Homo sapiens
cattgcggccccag

SEQ ID NO: 5589738 - DNA, 16 bp, Homo sapiens
cattgcggccccagga

SEQ ID NO: 5589739 - DNA, 21 bp, Homo sapiens
cattgcggcctgttgggcaga

SEQ ID NO: 5589740 - DNA, 17 bp, Homo sapiens
cattgcgttattttctt

SEQ ID NO: 5589741 - DNA, 16 bp, Homo sapiens
cattgctaaaaaataa

SEQ ID NO: 5589742 - DNA, 17 bp, Homo sapiens
cattgctaaaaaataaa

SEQ ID NO: 5589743 - DNA, 15 bp, Homo sapiens
cattgctaatttaaa

SEQ ID NO: 5589744 - DNA, 14 bp, Homo sapiens
cattgctacactta

SEQ ID NO: 5589745 - DNA, 14 bp, Homo sapiens
cattgctaccacag

SEQ ID NO: 5589746 - DNA, 15 bp, Homo sapiens
cattgctaccacaga

SEQ ID NO: 5589747 - DNA, 18 bp, Homo sapiens
cattgctaccacagactt

SEQ ID NO: 5589748 - DNA, 22 bp, Homo sapiens
cattgctcagcccgcttggcca

SEQ ID NO: 5589749 - DNA, 15 bp, Homo sapiens
cattgctccattcac

SEQ ID NO: 5589750 - DNA, 17 bp, Homo sapiens
cattgctctatgtctgc

SEQ ID NO: 5589751 - DNA, 21 bp, Homo sapiens
cattgctctatgtctgccttc

SEQ ID NO: 5589752 - DNA, 15 bp, Homo sapiens
cattgctgacagagc

SEQ ID NO: 5589753 - DNA, 16 bp, Homo sapiens
cattgctgacagagcc

SEQ ID NO: 5589754 - DNA, 14 bp, Homo sapiens
cattgctgagcctc

SEQ ID NO: 5589755 - DNA, 16 bp, Homo sapiens
cattgctgagcctctg

SEQ ID NO: 5589756 - DNA, 18 bp, Homo sapiens
cattgctgagcctctgct

SEQ ID NO: 5589757 - DNA, 18 bp, Homo sapiens
cattgctgcatatttgac

SEQ ID NO: 5589758 - DNA, 11 bp, Homo sapiens
cattgctgcca

SEQ ID NO: 5589759 - DNA, 21 bp, Homo sapiens
cattgctgccaaggtggaggg

SEQ ID NO: 5589760 - DNA, 22 bp, Homo sapiens
cattgctgccaaggtggaggga

SEQ ID NO: 5589761 - DNA, 22 bp, Homo sapiens
cattgctgcccgtttgtacatg

SEQ ID NO: 5589762 - DNA, 12 bp, Homo sapiens
cattgctgcctt

SEQ ID NO: 5589763 - DNA, 22 bp, Homo sapiens
cattgctgcctttgtccccaca

SEQ ID NO: 5589764 - DNA, 20 bp, Homo sapiens
cattgctgctccttagctgc

SEQ ID NO: 5589765 - DNA, 23 bp, Homo sapiens
cattgctgctccttagctgccaa

SEQ ID NO: 5589766 - DNA, 13 bp, Homo sapiens
cattgctggacta

SEQ ID NO: 5589767 - DNA, 12 bp, Homo sapiens
cattgctggctg

SEQ ID NO: 5589768 - DNA, 20 bp, Homo sapiens
cattgctggtagagaccccc

SEQ ID NO: 5589769 - DNA, 18 bp, Homo sapiens
cattgctggtcatccttg

SEQ ID NO: 5589770 - DNA, 19 bp, Homo sapiens
cattgctggtcttgtaaga

SEQ ID NO: 5589771 - DNA, 21 bp, Homo sapiens
cattgctggttctatttaatg

SEQ ID NO: 5589772 - DNA, 22 bp, Homo sapiens
cattgctgtaggatctaaggct

SEQ ID NO: 5589773 - DNA, 18 bp, Homo sapiens
cattgctgtccttgggta

SEQ ID NO: 5589774 - DNA, 19 bp, Homo sapiens
cattgctgtctgcagcctt

SEQ ID NO: 5589775 - DNA, 20 bp, Homo sapiens
cattgctgtctgcagccttg

SEQ ID NO: 5589776 - DNA, 11 bp, Homo sapiens
cattgctgtgt

SEQ ID NO: 5589777 - DNA, 13 bp, Homo sapiens
cattgctgtgtga

SEQ ID NO: 5589778 - DNA, 19 bp, Homo sapiens
cattgctgttgtccaacta

SEQ ID NO: 5589779 - DNA, 13 bp, Homo sapiens
cattgctgttgtt

SEQ ID NO: 5589780 - DNA, 14 bp, Homo sapiens
cattgcttaccttg

SEQ ID NO: 5589781 - DNA, 17 bp, Homo sapiens
cattgcttaccttggtt

SEQ ID NO: 5589782 - DNA, 15 bp, Homo sapiens
cattgcttcattaaa

SEQ ID NO: 5589783 - DNA, 20 bp, Homo sapiens
cattgcttcattaaaacaag

SEQ ID NO: 5589784 - DNA, 14 bp, Homo sapiens
cattgctttactgg

SEQ ID NO: 5589785 - DNA, 18 bp, Homo sapiens
cattgctttcgtgtaaat

SEQ ID NO: 5589786 - DNA, 12 bp, Homo sapiens
cattgctttctg

SEQ ID NO: 5589787 - DNA, 16 bp, Homo sapiens
cattgctttgaagcag

SEQ ID NO: 5589788 - DNA, 17 bp, Homo sapiens
cattgcttttaaaacta

SEQ ID NO: 5589789 - DNA, 20 bp, Homo sapiens
cattgcttttattttgaaaa

SEQ ID NO: 5589790 - DNA, 11 bp, Homo sapiens
cattgcttttc

SEQ ID NO: 5589791 - DNA, 19 bp, Homo sapiens
cattgcttttgtttcttaa

SEQ ID NO: 5589792 - DNA, 21 bp, Homo sapiens
cattggaaaatttaagacaag

SEQ ID NO: 5589793 - DNA, 18 bp, Homo sapiens
cattggaaataactggaa

SEQ ID NO: 5589794 - DNA, 12 bp, Homo sapiens
cattggaaatta

SEQ ID NO: 5589795 - DNA, 20 bp, Homo sapiens
cattggaaatttagcattgt

SEQ ID NO: 5589796 - DNA, 13 bp, Homo sapiens
cattggaaatttc

SEQ ID NO: 5589797 - DNA, 14 bp, Homo sapiens
cattggaaatttca

SEQ ID NO: 5589798 - DNA, 16 bp, Homo sapiens
cattggaaatttcacg

SEQ ID NO: 5589799 - DNA, 19 bp, Homo sapiens
cattggaaatttcacgtca

SEQ ID NO: 5589800 - DNA, 14 bp, Homo sapiens
cattggaactggag

SEQ ID NO: 5589801 - DNA, 19 bp, Homo sapiens
cattggaactggaggcagg

SEQ ID NO: 5589802 - DNA, 22 bp, Homo sapiens
cattggaagcaggttaaatgtt

SEQ ID NO: 5589803 - DNA, 13 bp, Homo sapiens
cattggaagccat

SEQ ID NO: 5589804 - DNA, 16 bp, Homo sapiens
cattggaagcctcaaa

SEQ ID NO: 5589805 - DNA, 13 bp, Homo sapiens
cattggaagctcc

SEQ ID NO: 5589806 - DNA, 18 bp, Homo sapiens
cattggaatgttctcaga

SEQ ID NO: 5589807 - DNA, 19 bp, Homo sapiens
cattggaatgttctcagat

SEQ ID NO: 5589808 - DNA, 18 bp, Homo sapiens
cattggacccacatgagg

SEQ ID NO: 5589809 - DNA, 22 bp, Homo sapiens
cattggagaagcggtggataac

SEQ ID NO: 5589810 - DNA, 16 bp, Homo sapiens
cattggagatgtttag

SEQ ID NO: 5589811 - DNA, 17 bp, Homo sapiens
cattggagcattttcaa

SEQ ID NO: 5589812 - DNA, 12 bp, Homo sapiens
cattggagctga

SEQ ID NO: 5589813 - DNA, 19 bp, Homo sapiens
cattggagctgactgttct

SEQ ID NO: 5589814 - DNA, 16 bp, Homo sapiens
cattggagtcctggtt

SEQ ID NO: 5589815 - DNA, 14 bp, Homo sapiens
cattggatctgcaa

SEQ ID NO: 5589816 - DNA, 22 bp, Homo sapiens
cattggcaaagtgacaaagcaa

SEQ ID NO: 5589817 - DNA, 16 bp, Homo sapiens
cattggcagcaggtgc

SEQ ID NO: 5589818 - DNA, 20 bp, Homo sapiens
cattggcagcaggtgctgct

SEQ ID NO: 5589819 - DNA, 18 bp, Homo sapiens
cattggcagtgtgtcaca

SEQ ID NO: 5589820 - DNA, 16 bp, Homo sapiens
cattggcatctgcttt

SEQ ID NO: 5589821 - DNA, 18 bp, Homo sapiens
cattggccagctcataaa

SEQ ID NO: 5589822 - DNA, 12 bp, Homo sapiens
cattggcctctg

SEQ ID NO: 5589823 - DNA, 14 bp, Homo sapiens
cattggcctctgtc

SEQ ID NO: 5589824 - DNA, 16 bp, Homo sapiens
cattggcctcttgtcc

SEQ ID NO: 5589825 - DNA, 18 bp, Homo sapiens
cattggcctcttgtccct

SEQ ID NO: 5589826 - DNA, 21 bp, Homo sapiens
cattggcctcttgtcccttgg

SEQ ID NO: 5589827 - DNA, 17 bp, Homo sapiens
cattggcctggcctcca

SEQ ID NO: 5589828 - DNA, 20 bp, Homo sapiens
cattggccttaactggccct

SEQ ID NO: 5589829 - DNA, 20 bp, Homo sapiens
cattggctagaatcagggtg

SEQ ID NO: 5589830 - DNA, 19 bp, Homo sapiens
cattggctcagcccgctga

SEQ ID NO: 5589831 - DNA, 22 bp, Homo sapiens
cattggctcttgaactgagctt

SEQ ID NO: 5589832 - DNA, 15 bp, Homo sapiens
cattggcttcaagaa

SEQ ID NO: 5589833 - DNA, 13 bp, Homo sapiens
cattgggagaagc

SEQ ID NO: 5589834 - DNA, 22 bp, Homo sapiens
cattgggcacagtccagaccca

SEQ ID NO: 5589835 - DNA, 19 bp, Homo sapiens
cattgggcagcgcccttcc

SEQ ID NO: 5589836 - DNA, 20 bp, Homo sapiens
cattgggcagcgcccttcct

SEQ ID NO: 5589837 - DNA, 22 bp, Homo sapiens
cattgggcagcgcccttcctct

SEQ ID NO: 5589838 - DNA, 15 bp, Homo sapiens
cattggggctcccag

SEQ ID NO: 5589839 - DNA, 16 bp, Homo sapiens
cattggggctcccagc

SEQ ID NO: 5589840 - DNA, 17 bp, Homo sapiens
cattggggctcccagcc

SEQ ID NO: 5589841 - DNA, 21 bp, Homo sapiens
cattggggctcccagccaggc

SEQ ID NO: 5589842 - DNA, 19 bp, Homo sapiens
cattggggggccgggcagg

SEQ ID NO: 5589843 - DNA, 21 bp, Homo sapiens
cattggggttcctctgtacag

SEQ ID NO: 5589844 - DNA, 17 bp, Homo sapiens
cattgggtctattccag

SEQ ID NO: 5589845 - DNA, 19 bp, Homo sapiens
cattgggtctattccagct

SEQ ID NO: 5589846 - DNA, 19 bp, Homo sapiens
cattgggtggggctcctgg

SEQ ID NO: 5589847 - DNA, 22 bp, Homo sapiens
cattgggtggggctcctgggag

SEQ ID NO: 5589848 - DNA, 23 bp, Homo sapiens
cattgggtggggctcctgggagg

SEQ ID NO: 5589849 - DNA, 18 bp, Homo sapiens
cattgggtgggtaaattc

SEQ ID NO: 5589850 - DNA, 19 bp, Homo sapiens
cattgggtgggtaaattca

SEQ ID NO: 5589851 - DNA, 19 bp, Homo sapiens
cattgggtttggggccatg

SEQ ID NO: 5589852 - DNA, 16 bp, Homo sapiens
cattggtaagattgca

SEQ ID NO: 5589853 - DNA, 15 bp, Homo sapiens
cattggtctgcatgt

SEQ ID NO: 5589854 - DNA, 13 bp, Homo sapiens
cattggtgttgtc

SEQ ID NO: 5589855 - DNA, 15 bp, Homo sapiens
cattggttaattttt

SEQ ID NO: 5589856 - DNA, 15 bp, Homo sapiens
cattggttacaaatt

SEQ ID NO: 5589857 - DNA, 18 bp, Homo sapiens
cattggttcacctgtgac

SEQ ID NO: 5589858 - DNA, 20 bp, Homo sapiens
cattggttcacctgtgactc

SEQ ID NO: 5589859 - DNA, 22 bp, Homo sapiens
cattggttccctttgctccacc

SEQ ID NO: 5589860 - DNA, 15 bp, Homo sapiens
cattggttcttgtat

SEQ ID NO: 5589861 - DNA, 18 bp, Homo sapiens
cattggttcttgtattaa

SEQ ID NO: 5589862 - DNA, 22 bp, Homo sapiens
cattggttcttgtattaagaat

SEQ ID NO: 5589863 - DNA, 15 bp, Homo sapiens
cattggtttgagaaa

SEQ ID NO: 5589864 - DNA, 22 bp, Homo sapiens
cattgtaaaagcattttgtaat

SEQ ID NO: 5589865 - DNA, 13 bp, Homo sapiens
cattgtaaaataa

SEQ ID NO: 5589866 - DNA, 23 bp, Homo sapiens
cattgtaaacaaactcttgaaga

SEQ ID NO: 5589867 - DNA, 11 bp, Homo sapiens
cattgtaaata

SEQ ID NO: 5589868 - DNA, 17 bp, Homo sapiens
cattgtaaataaatttt

SEQ ID NO: 5589869 - DNA, 16 bp, Homo sapiens
cattgtaaatatttga

SEQ ID NO: 5589870 - DNA, 18 bp, Homo sapiens
cattgtaaatctgaagaa

SEQ ID NO: 5589871 - DNA, 19 bp, Homo sapiens
cattgtaaatctgaagaaa

SEQ ID NO: 5589872 - DNA, 17 bp, Homo sapiens
cattgtaaatgaacata

SEQ ID NO: 5589873 - DNA, 20 bp, Homo sapiens
cattgtaacctcgtgtctag

SEQ ID NO: 5589874 - DNA, 22 bp, Homo sapiens
cattgtaacctcgtgtctagta

SEQ ID NO: 5589875 - DNA, 15 bp, Homo sapiens
cattgtaatctgcaa

SEQ ID NO: 5589876 - DNA, 17 bp, Homo sapiens
cattgtaatctgctttg

SEQ ID NO: 5589877 - DNA, 15 bp, Homo sapiens
cattgtaatgttact

SEQ ID NO: 5589878 - DNA, 16 bp, Homo sapiens
cattgtaatgttactg

SEQ ID NO: 5589879 - DNA, 19 bp, Homo sapiens
cattgtaattatgtaaata

SEQ ID NO: 5589880 - DNA, 17 bp, Homo sapiens
cattgtaatttgaagat

SEQ ID NO: 5589881 - DNA, 18 bp, Homo sapiens
cattgtacaagtattaca

SEQ ID NO: 5589882 - DNA, 13 bp, Homo sapiens
cattgtactccag

SEQ ID NO: 5589883 - DNA, 15 bp, Homo sapiens
cattgtactccagcc

SEQ ID NO: 5589884 - DNA, 22 bp, Homo sapiens
cattgtactccagcctgggcaa

SEQ ID NO: 5589885 - DNA, 14 bp, Homo sapiens
cattgtagaaaagc

SEQ ID NO: 5589886 - DNA, 14 bp, Homo sapiens
cattgtagaaacac

SEQ ID NO: 5589887 - DNA, 19 bp, Homo sapiens
cattgtagagcacatttag

SEQ ID NO: 5589888 - DNA, 15 bp, Homo sapiens
cattgtagagcttct

SEQ ID NO: 5589889 - DNA, 16 bp, Homo sapiens
cattgtagattttgtt

SEQ ID NO: 5589890 - DNA, 18 bp, Homo sapiens
cattgtagcctaatattc

SEQ ID NO: 5589891 - DNA, 21 bp, Homo sapiens
cattgtagcctaatattcatg

SEQ ID NO: 5589892 - DNA, 19 bp, Homo sapiens
cattgtagcgtctttcttt

SEQ ID NO: 5589893 - DNA, 15 bp, Homo sapiens
cattgtagtgctttg

SEQ ID NO: 5589894 - DNA, 19 bp, Homo sapiens
cattgtatagatataatga

SEQ ID NO: 5589895 - DNA, 20 bp, Homo sapiens
cattgtatagatataatgaa

SEQ ID NO: 5589896 - DNA, 21 bp, Homo sapiens
cattgtataggccatctgtaa

SEQ ID NO: 5589897 - DNA, 22 bp, Homo sapiens
cattgtatagttggaatcatat

SEQ ID NO: 5589898 - DNA, 14 bp, Homo sapiens
cattgtatatatgt

SEQ ID NO: 5589899 - DNA, 21 bp, Homo sapiens
cattgtatcgatgttatgtaa

SEQ ID NO: 5589900 - DNA, 18 bp, Homo sapiens
cattgtatctgtctttcc

SEQ ID NO: 5589901 - DNA, 20 bp, Homo sapiens
cattgtatgatgtgttgtga

SEQ ID NO: 5589902 - DNA, 16 bp, Homo sapiens
cattgtatgcagggag

SEQ ID NO: 5589903 - DNA, 17 bp, Homo sapiens
cattgtatgcagggagc

SEQ ID NO: 5589904 - DNA, 15 bp, Homo sapiens
cattgtatgtggtca

SEQ ID NO: 5589905 - DNA, 21 bp, Homo sapiens
cattgtatgttaatagaaaat

SEQ ID NO: 5589906 - DNA, 20 bp, Homo sapiens
catttcaaggaacagccaca

SEQ ID NO: 5589907 - DNA, 16 bp, Homo sapiens
catttcaatcattgaa

SEQ ID NO: 5589908 - DNA, 19 bp, Homo sapiens
catttcaatgtcagccttt

SEQ ID NO: 5589909 - DNA, 23 bp, Homo sapiens
catttcaatgtcagcctttgtta

SEQ ID NO: 5589910 - DNA, 14 bp, Homo sapiens
catttcaatgtgta

SEQ ID NO: 5589911 - DNA, 20 bp, Homo sapiens
catttcaatgtgtataaatt

SEQ ID NO: 5589912 - DNA, 17 bp, Homo sapiens
catttcaattcctggcc

SEQ ID NO: 5589913 - DNA, 19 bp, Homo sapiens
catttcaattcctggccct

SEQ ID NO: 5589914 - DNA, 17 bp, Homo sapiens
catttcacatgccttgc

SEQ ID NO: 5589915 - DNA, 12 bp, Homo sapiens
catttcacatta

SEQ ID NO: 5589916 - DNA, 13 bp, Homo sapiens
catttcacccctc

SEQ ID NO: 5589917 - DNA, 22 bp, Homo sapiens
catttcacccctccctttctcc

SEQ ID NO: 5589918 - DNA, 17 bp, Homo sapiens
catttcacgaactgttc

SEQ ID NO: 5589919 - DNA, 19 bp, Homo sapiens
catttcactaagctcctcc

SEQ ID NO: 5589920 - DNA, 13 bp, Homo sapiens
catttcactgtct

SEQ ID NO: 5589921 - DNA, 14 bp, Homo sapiens
catttcactttaaa

SEQ ID NO: 5589922 - DNA, 21 bp, Homo sapiens
catttcactttaaagtctttc

SEQ ID NO: 5589923 - DNA, 11 bp, Homo sapiens
catttcagaaa

SEQ ID NO: 5589924 - DNA, 20 bp, Homo sapiens
catttcagagggtaagtaaa

SEQ ID NO: 5589925 - DNA, 16 bp, Homo sapiens
catttcagattttaaa

SEQ ID NO: 5589926 - DNA, 13 bp, Homo sapiens
catttcaggactc

SEQ ID NO: 5589927 - DNA, 23 bp, Homo sapiens
catttcaggactctctccaggag

SEQ ID NO: 5589928 - DNA, 16 bp, Homo sapiens
catttcaggagcagcc

SEQ ID NO: 5589929 - DNA, 13 bp, Homo sapiens
catttcaggaggt

SEQ ID NO: 5589930 - DNA, 13 bp, Homo sapiens
catttcagggaga

SEQ ID NO: 5589931 - DNA, 21 bp, Homo sapiens
catttcagtaaacctgtctga

SEQ ID NO: 5589932 - DNA, 14 bp, Homo sapiens
catttcagtatcat

SEQ ID NO: 5589933 - DNA, 16 bp, Homo sapiens
catttcagtggcttcc

SEQ ID NO: 5589934 - DNA, 15 bp, Homo sapiens
catttcataaaaatc

SEQ ID NO: 5589935 - DNA, 22 bp, Homo sapiens
catttcataaggcctgccctcc

SEQ ID NO: 5589936 - DNA, 15 bp, Homo sapiens
catttcatacaacag

SEQ ID NO: 5589937 - DNA, 20 bp, Homo sapiens
catttcatagccaaacagga

SEQ ID NO: 5589938 - DNA, 15 bp, Homo sapiens
catttcatagtttca

SEQ ID NO: 5589939 - DNA, 17 bp, Homo sapiens
catttcatcaagattaa

SEQ ID NO: 5589940 - DNA, 22 bp, Homo sapiens
catttcatccgtgtgtatgtgt

SEQ ID NO: 5589941 - DNA, 15 bp, Homo sapiens
catttcatcctgttg

SEQ ID NO: 5589942 - DNA, 17 bp, Homo sapiens
catttcatcctttcact

SEQ ID NO: 5589943 - DNA, 20 bp, Homo sapiens
catttcatctactacagggt

SEQ ID NO: 5589944 - DNA, 18 bp, Homo sapiens
catttcatctatttctga

SEQ ID NO: 5589945 - DNA, 14 bp, Homo sapiens
catttcatctgggt

SEQ ID NO: 5589946 - DNA, 21 bp, Homo sapiens
catttcatgaaaaagctgctt

SEQ ID NO: 5589947 - DNA, 19 bp, Homo sapiens
catttcatgctatcagaaa

SEQ ID NO: 5589948 - DNA, 15 bp, Homo sapiens
catttcatgtatagt

SEQ ID NO: 5589949 - DNA, 14 bp, Homo sapiens
catttcatgtattt

SEQ ID NO: 5589950 - DNA, 19 bp, Homo sapiens
catttcatgtatttcttta

SEQ ID NO: 5589951 - DNA, 20 bp, Homo sapiens
catttcatgtatttctttag

SEQ ID NO: 5589952 - DNA, 18 bp, Homo sapiens
catttcattagccatgca

SEQ ID NO: 5589953 - DNA, 16 bp, Homo sapiens
catttcattatgcttt

SEQ ID NO: 5589954 - DNA, 16 bp, Homo sapiens
catttcattcaaatca

SEQ ID NO: 5589955 - DNA, 19 bp, Homo sapiens
catttcattccattgccta

SEQ ID NO: 5589956 - DNA, 21 bp, Homo sapiens
catttcattcctaacacagca

SEQ ID NO: 5589957 - DNA, 17 bp, Homo sapiens
catttcattgtacaagt

SEQ ID NO: 5589958 - DNA, 18 bp, Homo sapiens
catttcatttatactgta

SEQ ID NO: 5589959 - DNA, 14 bp, Homo sapiens
catttcatttccta

SEQ ID NO: 5589960 - DNA, 18 bp, Homo sapiens
catttccaaacttgaaaa

SEQ ID NO: 5589961 - DNA, 16 bp, Homo sapiens
catttccaaatgaact

SEQ ID NO: 5589962 - DNA, 13 bp, Homo sapiens
catttccaacacc

SEQ ID NO: 5589963 - DNA, 19 bp, Homo sapiens
catttccaacaccacagac

SEQ ID NO: 5589964 - DNA, 20 bp, Homo sapiens
catttccaacaccacagaca

SEQ ID NO: 5589965 - DNA, 22 bp, Homo sapiens
catttccaacaccacagacaca

SEQ ID NO: 5589966 - DNA, 13 bp, Homo sapiens
catttccaacagc

SEQ ID NO: 5589967 - DNA, 18 bp, Homo sapiens
catttccaactcaggtta

SEQ ID NO: 5589968 - DNA, 18 bp, Homo sapiens
catttccaagaggctgta

SEQ ID NO: 5589969 - DNA, 12 bp, Homo sapiens
catttccaagct

SEQ ID NO: 5589970 - DNA, 14 bp, Homo sapiens
catttccaagctgt

SEQ ID NO: 5589971 - DNA, 16 bp, Homo sapiens
catttccaagctgtta

SEQ ID NO: 5589972 - DNA, 23 bp, Homo sapiens
catttccaccaagggtatctgct

SEQ ID NO: 5589973 - DNA, 16 bp, Homo sapiens
catttccactgtatat

SEQ ID NO: 5589974 - DNA, 14 bp, Homo sapiens
catttccagcattt

SEQ ID NO: 5589975 - DNA, 12 bp, Homo sapiens
catttccagcct

SEQ ID NO: 5589976 - DNA, 17 bp, Homo sapiens
catttccagcttctcag

SEQ ID NO: 5589977 - DNA, 20 bp, Homo sapiens
catttccagggcagcagccg

SEQ ID NO: 5589978 - DNA, 15 bp, Homo sapiens
catttccattgctta

SEQ ID NO: 5589979 - DNA, 16 bp, Homo sapiens
catttccattgcttat

SEQ ID NO: 5589980 - DNA, 20 bp, Homo sapiens
catttccatttattgtttga

SEQ ID NO: 5589981 - DNA, 18 bp, Homo sapiens
catttcccaaagtcctct

SEQ ID NO: 5589982 - DNA, 16 bp, Homo sapiens
catttcccacatcttt

SEQ ID NO: 5589983 - DNA, 14 bp, Homo sapiens
catttcccatctgc

SEQ ID NO: 5589984 - DNA, 14 bp, Homo sapiens
catttccccagggc

SEQ ID NO: 5589985 - DNA, 15 bp, Homo sapiens
catttccccagggca

SEQ ID NO: 5589986 - DNA, 16 bp, Homo sapiens
catttcccccaaaggc

SEQ ID NO: 5589987 - DNA, 20 bp, Homo sapiens
catttcccccaccccatttc

SEQ ID NO: 5589988 - DNA, 19 bp, Homo sapiens
catttcccctcccgcttcc

SEQ ID NO: 5589989 - DNA, 16 bp, Homo sapiens
catttcccctcccgtc

SEQ ID NO: 5589990 - DNA, 20 bp, Homo sapiens
catttcccctgtggtttgtt

SEQ ID NO: 5589991 - DNA, 15 bp, Homo sapiens
catttccctatttta

SEQ ID NO: 5589992 - DNA, 10 bp, Homo sapiens
catttccctc

SEQ ID NO: 5589993 - DNA, 21 bp, Homo sapiens
catttccgtccccccccaggc

SEQ ID NO: 5589994 - DNA, 19 bp, Homo sapiens
catttccgtggtttctcat

SEQ ID NO: 5589995 - DNA, 16 bp, Homo sapiens
catttccgttttgcct

SEQ ID NO: 5589996 - DNA, 20 bp, Homo sapiens
catttcctagctgttctaat

SEQ ID NO: 5589997 - DNA, 23 bp, Homo sapiens
catttcctatcacctatttccat

SEQ ID NO: 5589998 - DNA, 22 bp, Homo sapiens
catttcctcacactaagagggc

SEQ ID NO: 5589999 - DNA, 20 bp, Homo sapiens
catttcctcagcttatctct

SEQ ID NO: 5590000 - DNA, 19 bp, Homo sapiens
catttcctcaggcaattcc

SEQ ID NO: 5590001 - DNA, 18 bp, Homo sapiens
catttcctcgcagcctct

SEQ ID NO: 5590002 - DNA, 13 bp, Homo sapiens
catttcctcttcc

SEQ ID NO: 5590003 - DNA, 14 bp, Homo sapiens
catttcctcttcct

SEQ ID NO: 5590004 - DNA, 16 bp, Homo sapiens
catttcctcttccttc

SEQ ID NO: 5590005 - DNA, 17 bp, Homo sapiens
catttcctgaggtggat

SEQ ID NO: 5590006 - DNA, 11 bp, Homo sapiens
catttcctgcc

SEQ ID NO: 5590007 - DNA, 12 bp, Homo sapiens
catttcctgccc

SEQ ID NO: 5590008 - DNA, 19 bp, Homo sapiens
catttcctgcccttcctca

SEQ ID NO: 5590009 - DNA, 20 bp, Homo sapiens
catttcctgcccttcctcag

SEQ ID NO: 5590010 - DNA, 12 bp, Homo sapiens
catttcctgggt

SEQ ID NO: 5590011 - DNA, 20 bp, Homo sapiens
catttcctgggtggctactc

SEQ ID NO: 5590012 - DNA, 12 bp, Homo sapiens
catttcctgtgt

SEQ ID NO: 5590013 - DNA, 13 bp, Homo sapiens
catttcctgtgtc

SEQ ID NO: 5590014 - DNA, 20 bp, Homo sapiens
catttcctgtgtttgtcctg

SEQ ID NO: 5590015 - DNA, 12 bp, Homo sapiens
catttccttgga

SEQ ID NO: 5590016 - DNA, 13 bp, Homo sapiens
catttccttggag

SEQ ID NO: 5590017 - DNA, 14 bp, Homo sapiens
catttccttggagg

SEQ ID NO: 5590018 - DNA, 17 bp, Homo sapiens
catttccttggaggcca

SEQ ID NO: 5590019 - DNA, 15 bp, Homo sapiens
catttccttgtcccg

SEQ ID NO: 5590020 - DNA, 17 bp, Homo sapiens
catttcgcccctcattt

SEQ ID NO: 5590021 - DNA, 22 bp, Homo sapiens
catttcgggaagggcatgcacg

SEQ ID NO: 5590022 - DNA, 18 bp, Homo sapiens
catttcgtatttctcata

SEQ ID NO: 5590023 - DNA, 20 bp, Homo sapiens
catttcgtgagccccatctt

SEQ ID NO: 5590024 - DNA, 20 bp, Homo sapiens
catttcgttccctgattatt

SEQ ID NO: 5590025 - DNA, 13 bp, Homo sapiens
catttctaacata

SEQ ID NO: 5590026 - DNA, 20 bp, Homo sapiens
catttctaactaaggacagg

SEQ ID NO: 5590027 - DNA, 19 bp, Homo sapiens
catttctaactctgatgta

SEQ ID NO: 5590028 - DNA, 21 bp, Homo sapiens
catttctaattatgtagctct

SEQ ID NO: 5590029 - DNA, 16 bp, Homo sapiens
catttctaattcctgt

SEQ ID NO: 5590030 - DNA, 15 bp, Homo sapiens
catttctaatttgaa

SEQ ID NO: 5590031 - DNA, 16 bp, Homo sapiens
catttctaattttaag

SEQ ID NO: 5590032 - DNA, 19 bp, Homo sapiens
catttctactatgatcaga

SEQ ID NO: 5590033 - DNA, 17 bp, Homo sapiens
catttctactctcccat

SEQ ID NO: 5590034 - DNA, 23 bp, Homo sapiens
catttctactcttaagtttctca

SEQ ID NO: 5590035 - DNA, 19 bp, Homo sapiens
catttctagaacaattaca

SEQ ID NO: 5590036 - DNA, 20 bp, Homo sapiens
catttctagaacaattacat

SEQ ID NO: 5590037 - DNA, 14 bp, Homo sapiens
catttctaggcaaa

SEQ ID NO: 5590038 - DNA, 13 bp, Homo sapiens
catttctatactt

SEQ ID NO: 5590039 - DNA, 20 bp, Homo sapiens
catttctatattcctccagc

SEQ ID NO: 5590040 - DNA, 21 bp, Homo sapiens
catttctatattcctccagct

SEQ ID NO: 5590041 - DNA, 17 bp, Homo sapiens
catttctatcagtactt

SEQ ID NO: 5590042 - DNA, 18 bp, Homo sapiens
catttctatttatttact

SEQ ID NO: 5590043 - DNA, 11 bp, Homo sapiens
catttctcagg

SEQ ID NO: 5590044 - DNA, 19 bp, Homo sapiens
catttctcataattttgca

SEQ ID NO: 5590045 - DNA, 16 bp, Homo sapiens
catttctcatgttgaa

SEQ ID NO: 5590046 - DNA, 13 bp, Homo sapiens
catttctccagaa

SEQ ID NO: 5590047 - DNA, 21 bp, Homo sapiens
catttctctaactcctgccat

SEQ ID NO: 5590048 - DNA, 18 bp, Homo sapiens
catttctctccaggaagt

SEQ ID NO: 5590049 - DNA, 13 bp, Homo sapiens
catttctctgagc

SEQ ID NO: 5590050 - DNA, 14 bp, Homo sapiens
catttctctgagca

SEQ ID NO: 5590051 - DNA, 11 bp, Homo sapiens
catttctctgc

SEQ ID NO: 5590052 - DNA, 18 bp, Homo sapiens
catttctcttactgcaaa

SEQ ID NO: 5590053 - DNA, 21 bp, Homo sapiens
catttctcttcagtgtgttga

SEQ ID NO: 5590054 - DNA, 14 bp, Homo sapiens
catttctcttcccc

SEQ ID NO: 5590055 - DNA, 14 bp, Homo sapiens
catttctcttctca

SEQ ID NO: 5590056 - DNA, 21 bp, Homo sapiens
catttctcttctcagctcttc

SEQ ID NO: 5590057 - DNA, 13 bp, Homo sapiens
catttctctttaa

SEQ ID NO: 5590058 - DNA, 17 bp, Homo sapiens
catttctgaactgttac

SEQ ID NO: 5590059 - DNA, 18 bp, Homo sapiens
catttctgaactgttaca

SEQ ID NO: 5590060 - DNA, 17 bp, Homo sapiens
catttctgaatagaaat

SEQ ID NO: 5590061 - DNA, 22 bp, Homo sapiens
catttctgagtttcattctcct

SEQ ID NO: 5590062 - DNA, 19 bp, Homo sapiens
catttctgatactttctgt

SEQ ID NO: 5590063 - DNA, 20 bp, Homo sapiens
catttctgatatttgctgga

SEQ ID NO: 5590064 - DNA, 15 bp, Homo sapiens
catttctgatgtctc

SEQ ID NO: 5590065 - DNA, 16 bp, Homo sapiens
catttctgattctgat

SEQ ID NO: 5590066 - DNA, 12 bp, Homo sapiens
catttctgcaga

SEQ ID NO: 5590067 - DNA, 12 bp, Homo sapiens
catttctgcctc

SEQ ID NO: 5590068 - DNA, 24 bp, Homo sapiens
catttctgccttttgttcatttca

SEQ ID NO: 5590069 - DNA, 16 bp, Homo sapiens
catttctgctctcagc

SEQ ID NO: 5590070 - DNA, 19 bp, Homo sapiens
catttctggcttctagtct

SEQ ID NO: 5590071 - DNA, 16 bp, Homo sapiens
catttctgtatactgt

SEQ ID NO: 5590072 - DNA, 19 bp, Homo sapiens
catttctgtatactgtaaa

SEQ ID NO: 5590073 - DNA, 14 bp, Homo sapiens
catttctgtatttt

SEQ ID NO: 5590074 - DNA, 21 bp, Homo sapiens
catttctgtattttttgtttg

SEQ ID NO: 5590075 - DNA, 12 bp, Homo sapiens
catttctgtctc

SEQ ID NO: 5590076 - DNA, 16 bp, Homo sapiens
catttctgtctcccct

SEQ ID NO: 5590077 - DNA, 16 bp, Homo sapiens
catttctgtgaaacta

SEQ ID NO: 5590078 - DNA, 17 bp, Homo sapiens
catttctgtgaaactat

SEQ ID NO: 5590079 - DNA, 18 bp, Homo sapiens
catttcttaaaacacatg

SEQ ID NO: 5590080 - DNA, 20 bp, Homo sapiens
catttcttaaaacacatgat

SEQ ID NO: 5590081 - DNA, 15 bp, Homo sapiens
catttcttaaaactt

SEQ ID NO: 5590082 - DNA, 22 bp, Homo sapiens
catttcttacgttctttcactt

SEQ ID NO: 5590083 - DNA, 19 bp, Homo sapiens
catttcttataccttctga

SEQ ID NO: 5590084 - DNA, 11 bp, Homo sapiens
catttcttatt

SEQ ID NO: 5590085 - DNA, 19 bp, Homo sapiens
catttttaaacttgaaata

SEQ ID NO: 5590086 - DNA, 14 bp, Homo sapiens
catttttaaagcct

SEQ ID NO: 5590087 - DNA, 16 bp, Homo sapiens
catttttaaagcctgg

SEQ ID NO: 5590088 - DNA, 18 bp, Homo sapiens
catttttaaagcctggct

SEQ ID NO: 5590089 - DNA, 22 bp, Homo sapiens
catttttaaatgtcagttgaaa

SEQ ID NO: 5590090 - DNA, 16 bp, Homo sapiens
catttttaactactgt

SEQ ID NO: 5590091 - DNA, 16 bp, Homo sapiens
catttttaagaaagga

SEQ ID NO: 5590092 - DNA, 15 bp, Homo sapiens
catttttaagactgt

SEQ ID NO: 5590093 - DNA, 23 bp, Homo sapiens
catttttaagctccatgtgcata

SEQ ID NO: 5590094 - DNA, 22 bp, Homo sapiens
catttttaatattactgtcttt

SEQ ID NO: 5590095 - DNA, 23 bp, Homo sapiens
catttttaatattactgtcttta

SEQ ID NO: 5590096 - DNA, 13 bp, Homo sapiens
catttttaatgta

SEQ ID NO: 5590097 - DNA, 19 bp, Homo sapiens
catttttaatgtatctatt

SEQ ID NO: 5590098 - DNA, 20 bp, Homo sapiens
catttttaatgtatctattt

SEQ ID NO: 5590099 - DNA, 14 bp, Homo sapiens
catttttaattcct

SEQ ID NO: 5590100 - DNA, 23 bp, Homo sapiens
catttttaatttaacaaactaaa

SEQ ID NO: 5590101 - DNA, 19 bp, Homo sapiens
catttttacaaataggtag

SEQ ID NO: 5590102 - DNA, 20 bp, Homo sapiens
catttttacaatgtaattat

SEQ ID NO: 5590103 - DNA, 23 bp, Homo sapiens
catttttacaccaatttggtaaa

SEQ ID NO: 5590104 - DNA, 17 bp, Homo sapiens
catttttacactattgt

SEQ ID NO: 5590105 - DNA, 18 bp, Homo sapiens
catttttaccatcactga

SEQ ID NO: 5590106 - DNA, 17 bp, Homo sapiens
catttttactaaagcag

SEQ ID NO: 5590107 - DNA, 19 bp, Homo sapiens
catttttactaaagcagtg

SEQ ID NO: 5590108 - DNA, 22 bp, Homo sapiens
catttttagaaatcacaacaaa

SEQ ID NO: 5590109 - DNA, 19 bp, Homo sapiens
catttttagattggttctg

SEQ ID NO: 5590110 - DNA, 21 bp, Homo sapiens
catttttagattggttctgtt

SEQ ID NO: 5590111 - DNA, 16 bp, Homo sapiens
catttttagcctgtgt

SEQ ID NO: 5590112 - DNA, 20 bp, Homo sapiens
catttttagtagagacaggg

SEQ ID NO: 5590113 - DNA, 16 bp, Homo sapiens
catttttagtttaaaa

SEQ ID NO: 5590114 - DNA, 17 bp, Homo sapiens
catttttataaatttta

SEQ ID NO: 5590115 - DNA, 22 bp, Homo sapiens
catttttatcaggatttcctct

SEQ ID NO: 5590116 - DNA, 13 bp, Homo sapiens
catttttatccct

SEQ ID NO: 5590117 - DNA, 12 bp, Homo sapiens
catttttatcta

SEQ ID NO: 5590118 - DNA, 15 bp, Homo sapiens
catttttatgcagac

SEQ ID NO: 5590119 - DNA, 22 bp, Homo sapiens
catttttattacccttctttcc

SEQ ID NO: 5590120 - DNA, 17 bp, Homo sapiens
catttttatttatgaag

SEQ ID NO: 5590121 - DNA, 22 bp, Homo sapiens
catttttatttcagattttgat

SEQ ID NO: 5590122 - DNA, 17 bp, Homo sapiens
catttttcaaaaaggga

SEQ ID NO: 5590123 - DNA, 14 bp, Homo sapiens
catttttcaacttt

SEQ ID NO: 5590124 - DNA, 19 bp, Homo sapiens
catttttcaactttgaata

SEQ ID NO: 5590125 - DNA, 20 bp, Homo sapiens
catttttcaactttgaataa

SEQ ID NO: 5590126 - DNA, 12 bp, Homo sapiens
catttttcaata

SEQ ID NO: 5590127 - DNA, 13 bp, Homo sapiens
catttttcaataa

SEQ ID NO: 5590128 - DNA, 16 bp, Homo sapiens
catttttcatgataat

SEQ ID NO: 5590129 - DNA, 21 bp, Homo sapiens
catttttcattcacttctctt

SEQ ID NO: 5590130 - DNA, 18 bp, Homo sapiens
catttttcattcatgaat

SEQ ID NO: 5590131 - DNA, 19 bp, Homo sapiens
catttttccagagctgcag

SEQ ID NO: 5590132 - DNA, 17 bp, Homo sapiens
catttttccatgacatt

SEQ ID NO: 5590133 - DNA, 13 bp, Homo sapiens
catttttcccagg

SEQ ID NO: 5590134 - DNA, 14 bp, Homo sapiens
catttttcccagga

SEQ ID NO: 5590135 - DNA, 20 bp, Homo sapiens
catttttcccttgtcctttc

SEQ ID NO: 5590136 - DNA, 16 bp, Homo sapiens
catttttccgtaaaaa

SEQ ID NO: 5590137 - DNA, 18 bp, Homo sapiens
catttttcctaacaggat

SEQ ID NO: 5590138 - DNA, 14 bp, Homo sapiens
catttttcctctgt

SEQ ID NO: 5590139 - DNA, 17 bp, Homo sapiens
catttttctataaatca

SEQ ID NO: 5590140 - DNA, 14 bp, Homo sapiens
catttttctgatgg

SEQ ID NO: 5590141 - DNA, 23 bp, Homo sapiens
catttttcttagggaaggataca

SEQ ID NO: 5590142 - DNA, 14 bp, Homo sapiens
catttttcttattt

SEQ ID NO: 5590143 - DNA, 12 bp, Homo sapiens
catttttcttgg

SEQ ID NO: 5590144 - DNA, 24 bp, Homo sapiens
catttttctttagtcatttaagaa

SEQ ID NO: 5590145 - DNA, 11 bp, Homo sapiens
catttttgaac

SEQ ID NO: 5590146 - DNA, 20 bp, Homo sapiens
catttttgaaccctcggtgt

SEQ ID NO: 5590147 - DNA, 13 bp, Homo sapiens
catttttgagcca

SEQ ID NO: 5590148 - DNA, 16 bp, Homo sapiens
catttttgagtaaaac

SEQ ID NO: 5590149 - DNA, 13 bp, Homo sapiens
catttttgctaat

SEQ ID NO: 5590150 - DNA, 16 bp, Homo sapiens
catttttgctgaattc

SEQ ID NO: 5590151 - DNA, 11 bp, Homo sapiens
catttttgctt

SEQ ID NO: 5590152 - DNA, 17 bp, Homo sapiens
catttttgcttcctagt

SEQ ID NO: 5590153 - DNA, 22 bp, Homo sapiens
catttttggatttctgtgaagt

SEQ ID NO: 5590154 - DNA, 14 bp, Homo sapiens
catttttgggggga

SEQ ID NO: 5590155 - DNA, 14 bp, Homo sapiens
catttttgtaatgc

SEQ ID NO: 5590156 - DNA, 12 bp, Homo sapiens
catttttgtaca

SEQ ID NO: 5590157 - DNA, 13 bp, Homo sapiens
catttttgtacag

SEQ ID NO: 5590158 - DNA, 17 bp, Homo sapiens
catttttgtacattatg

SEQ ID NO: 5590159 - DNA, 19 bp, Homo sapiens
catttttgtaggaagcatt

SEQ ID NO: 5590160 - DNA, 12 bp, Homo sapiens
catttttgtata

SEQ ID NO: 5590161 - DNA, 20 bp, Homo sapiens
catttttgtataaaaaggaa

SEQ ID NO: 5590162 - DNA, 22 bp, Homo sapiens
catttttgtataaaaaggaaat

SEQ ID NO: 5590163 - DNA, 21 bp, Homo sapiens
catttttgtattttgtacaaa

SEQ ID NO: 5590164 - DNA, 20 bp, Homo sapiens
catttttgtattttgtttaa

SEQ ID NO: 5590165 - DNA, 23 bp, Homo sapiens
catttttgtcagtctgagtcatc

SEQ ID NO: 5590166 - DNA, 16 bp, Homo sapiens
catttttgtctgtcct

SEQ ID NO: 5590167 - DNA, 14 bp, Homo sapiens
catttttgtgcaca

SEQ ID NO: 5590168 - DNA, 22 bp, Homo sapiens
catttttgtttctacctcccag

SEQ ID NO: 5590169 - DNA, 17 bp, Homo sapiens
catttttgttttgaaag

SEQ ID NO: 5590170 - DNA, 20 bp, Homo sapiens
catttttgttttgaaagttt

SEQ ID NO: 5590171 - DNA, 22 bp, Homo sapiens
catttttgtttttggtttctta

SEQ ID NO: 5590172 - DNA, 15 bp, Homo sapiens
cattttttaaaacaa

SEQ ID NO: 5590173 - DNA, 13 bp, Homo sapiens
cattttttaaatg

SEQ ID NO: 5590174 - DNA, 18 bp, Homo sapiens
cattttttaagaaaacat

SEQ ID NO: 5590175 - DNA, 19 bp, Homo sapiens
cattttttaagaaaacatt

SEQ ID NO: 5590176 - DNA, 22 bp, Homo sapiens
cattttttaagaaaacatttct

SEQ ID NO: 5590177 - DNA, 18 bp, Homo sapiens
cattttttaatgtgctct

SEQ ID NO: 5590178 - DNA, 16 bp, Homo sapiens
cattttttaatttact

SEQ ID NO: 5590179 - DNA, 21 bp, Homo sapiens
cattttttaatttacttgttt

SEQ ID NO: 5590180 - DNA, 15 bp, Homo sapiens
cattttttaggaaat

SEQ ID NO: 5590181 - DNA, 20 bp, Homo sapiens
cattttttaggacatcttaa

SEQ ID NO: 5590182 - DNA, 20 bp, Homo sapiens
cattttttatatatatgcat

SEQ ID NO: 5590183 - DNA, 17 bp, Homo sapiens
cattttttatgatatca

SEQ ID NO: 5590184 - DNA, 22 bp, Homo sapiens
cattttttatgatatcattgtt

SEQ ID NO: 5590185 - DNA, 14 bp, Homo sapiens
cattttttgaaatg

SEQ ID NO: 5590186 - DNA, 22 bp, Homo sapiens
cattttttgagtctccttcata

SEQ ID NO: 5590187 - DNA, 18 bp, Homo sapiens
cattttttgggcagcaat

SEQ ID NO: 5590188 - DNA, 17 bp, Homo sapiens
catttttttaatttatt

SEQ ID NO: 5590189 - DNA, 18 bp, Homo sapiens
catttttttattcagcag

SEQ ID NO: 5590190 - DNA, 12 bp, Homo sapiens
catttttttccc

SEQ ID NO: 5590191 - DNA, 15 bp, Homo sapiens
catttttttccttta

SEQ ID NO: 5590192 - DNA, 23 bp, Homo sapiens
catttttttctacctataacact

SEQ ID NO: 5590193 - DNA, 19 bp, Homo sapiens
catttttttctctctggag

SEQ ID NO: 5590194 - DNA, 18 bp, Homo sapiens
catttttttgttccaaaa

SEQ ID NO: 5590195 - DNA, 22 bp, Homo sapiens
cattttttttaagaaaaaggat

SEQ ID NO: 5590196 - DNA, 14 bp, Homo sapiens
cattttttttcaag

SEQ ID NO: 5590197 - DNA, 15 bp, Homo sapiens
cattttttttcaagt

SEQ ID NO: 5590198 - DNA, 23 bp, Homo sapiens
cattttttttctttgaataaatg

SEQ ID NO: 5590199 - DNA, 18 bp, Homo sapiens
catttttttttcaatcaa

SEQ ID NO: 5590200 - DNA, 22 bp, Homo sapiens
cattttttttttcaataaaact

SEQ ID NO: 5590201 - DNA, 23 bp, Homo sapiens
cattttttttttcaataaaactt

SEQ ID NO: 5590202 - DNA, 20 bp, Homo sapiens
cattttttttttctttttgg

SEQ ID NO: 5590203 - DNA, 22 bp, Homo sapiens
catttttttttttaattttgta

SEQ ID NO: 5590204 - DNA, 14 bp, Homo sapiens
ccaaaaaaaggaaa

SEQ ID NO: 5590205 - DNA, 16 bp, Homo sapiens
ccaaaaaaaggaaaaa

SEQ ID NO: 5590206 - DNA, 22 bp, Homo sapiens
ccaaaaaaaggaaaaataatca

SEQ ID NO: 5590207 - DNA, 18 bp, Homo sapiens
ccaaaaaaataaggtgta

SEQ ID NO: 5590208 - DNA, 13 bp, Homo sapiens
ccaaaaaaatact

SEQ ID NO: 5590209 - DNA, 12 bp, Homo sapiens
ccaaaaaactac

SEQ ID NO: 5590210 - DNA, 15 bp, Homo sapiens
ccaaaaaagcaaaca

SEQ ID NO: 5590211 - DNA, 19 bp, Homo sapiens
ccaaaaaatatctagtaat

SEQ ID NO: 5590212 - DNA, 22 bp, Homo sapiens
ccaaaaaattctacaacacaca

SEQ ID NO: 5590213 - DNA, 21 bp, Homo sapiens
ccaaaaacaaagtgcaaagct

SEQ ID NO: 5590214 - DNA, 22 bp, Homo sapiens
ccaaaaacaaagtgcaaagctg

SEQ ID NO: 5590215 - DNA, 19 bp, Homo sapiens
ccaaaaacaataaacgaaa

SEQ ID NO: 5590216 - DNA, 14 bp, Homo sapiens
ccaaaaacatttga

SEQ ID NO: 5590217 - DNA, 23 bp, Homo sapiens
ccaaaaacatttgattaataaaa

SEQ ID NO: 5590218 - DNA, 12 bp, Homo sapiens
ccaaaaaccaaa

SEQ ID NO: 5590219 - DNA, 16 bp, Homo sapiens
ccaaaaagaccagact

SEQ ID NO: 5590220 - DNA, 17 bp, Homo sapiens
ccaaaaagaccagacta

SEQ ID NO: 5590221 - DNA, 16 bp, Homo sapiens
ccaaaaagagactgat

SEQ ID NO: 5590222 - DNA, 16 bp, Homo sapiens
ccaaaaataaatatat

SEQ ID NO: 5590223 - DNA, 18 bp, Homo sapiens
ccaaaaatacaacacaga

SEQ ID NO: 5590224 - DNA, 20 bp, Homo sapiens
ccaaaaatacaacacagacg

SEQ ID NO: 5590225 - DNA, 15 bp, Homo sapiens
ccaaaaatagaaatt

SEQ ID NO: 5590226 - DNA, 16 bp, Homo sapiens
ccaaaaatctgcctgg

SEQ ID NO: 5590227 - DNA, 17 bp, Homo sapiens
ccaaaaatctgcctggg

SEQ ID NO: 5590228 - DNA, 16 bp, Homo sapiens
ccaaaaattagccgag

SEQ ID NO: 5590229 - DNA, 20 bp, Homo sapiens
ccaaaaattgccaagtgcct

SEQ ID NO: 5590230 - DNA, 12 bp, Homo sapiens
ccaaaacaaaca

SEQ ID NO: 5590231 - DNA, 22 bp, Homo sapiens
ccaaaacaagagcctgattttt

SEQ ID NO: 5590232 - DNA, 21 bp, Homo sapiens
ccaaaacaatctatttaaaaa

SEQ ID NO: 5590233 - DNA, 11 bp, Homo sapiens
ccaaaacacat

SEQ ID NO: 5590234 - DNA, 14 bp, Homo sapiens
ccaaaacaccccaa

SEQ ID NO: 5590235 - DNA, 18 bp, Homo sapiens
ccaaaacacgcacaccct

SEQ ID NO: 5590236 - DNA, 18 bp, Homo sapiens
ccaaaacagctttgtctc

SEQ ID NO: 5590237 - DNA, 22 bp, Homo sapiens
ccaaaacatattcaaagcagca

SEQ ID NO: 5590238 - DNA, 20 bp, Homo sapiens
ccaaaacatccacttaagtt

SEQ ID NO: 5590239 - DNA, 17 bp, Homo sapiens
ccaaaacatgcaccctg

SEQ ID NO: 5590240 - DNA, 13 bp, Homo sapiens
ccaaaacatttct

SEQ ID NO: 5590241 - DNA, 18 bp, Homo sapiens
ccaaaacattttaaatga

SEQ ID NO: 5590242 - DNA, 13 bp, Homo sapiens
ccaaaaccaatgc

SEQ ID NO: 5590243 - DNA, 15 bp, Homo sapiens
ccaaaaccacagccc

SEQ ID NO: 5590244 - DNA, 16 bp, Homo sapiens
ccaaaaccaggcctct

SEQ ID NO: 5590245 - DNA, 19 bp, Homo sapiens
ccaaaaccaggcctctgct

SEQ ID NO: 5590246 - DNA, 11 bp, Homo sapiens
ccaaaaccatc

SEQ ID NO: 5590247 - DNA, 17 bp, Homo sapiens
ccaaaaccatccatccc

SEQ ID NO: 5590248 - DNA, 18 bp, Homo sapiens
ccaaaaccgccagctctg

SEQ ID NO: 5590249 - DNA, 21 bp, Homo sapiens
ccaaaacgtgggtatttcctg

SEQ ID NO: 5590250 - DNA, 17 bp, Homo sapiens
ccaaaactctcctctgc

SEQ ID NO: 5590251 - DNA, 21 bp, Homo sapiens
ccaaaactctcctctgctgct

SEQ ID NO: 5590252 - DNA, 11 bp, Homo sapiens
ccaaaactgct

SEQ ID NO: 5590253 - DNA, 22 bp, Homo sapiens
ccaaaacttctcttgaaaagtt

SEQ ID NO: 5590254 - DNA, 12 bp, Homo sapiens
ccaaaagaaaaa

SEQ ID NO: 5590255 - DNA, 13 bp, Homo sapiens
ccaaaagacatta

SEQ ID NO: 5590256 - DNA, 19 bp, Homo sapiens
ccaaaagacattagagaaa

SEQ ID NO: 5590257 - DNA, 22 bp, Homo sapiens
ccaaaagacattagagaaaacc

SEQ ID NO: 5590258 - DNA, 16 bp, Homo sapiens
ccaaaagatgccttga

SEQ ID NO: 5590259 - DNA, 16 bp, Homo sapiens
ccaaaagattgctgaa

SEQ ID NO: 5590260 - DNA, 18 bp, Homo sapiens
ccaaaagattgctgaaaa

SEQ ID NO: 5590261 - DNA, 15 bp, Homo sapiens
ccaaaagcacaaaat

SEQ ID NO: 5590262 - DNA, 13 bp, Homo sapiens
ccaaatcttcctc

SEQ ID NO: 5590263 - DNA, 22 bp, Homo sapiens
ccaaatgaccgagccctggaga

SEQ ID NO: 5590264 - DNA, 17 bp, Homo sapiens
ccaaatgacttcatttc

SEQ ID NO: 5590265 - DNA, 18 bp, Homo sapiens
ccaaatgatagaaacaga

SEQ ID NO: 5590266 - DNA, 20 bp, Homo sapiens
ccaaatgatagaactgtact

SEQ ID NO: 5590267 - DNA, 17 bp, Homo sapiens
ccaaatgcaaaattagt

SEQ ID NO: 5590268 - DNA, 18 bp, Homo sapiens
ccaaatgcacaagctcag

SEQ ID NO: 5590269 - DNA, 18 bp, Homo sapiens
ccaaatgcattcatgttt

SEQ ID NO: 5590270 - DNA, 17 bp, Homo sapiens
ccaaatgcctgttgtat

SEQ ID NO: 5590271 - DNA, 22 bp, Homo sapiens
ccaaatgcctgttgtatttatg

SEQ ID NO: 5590272 - DNA, 16 bp, Homo sapiens
ccaaatgctctctctt

SEQ ID NO: 5590273 - DNA, 13 bp, Homo sapiens
ccaaatgctgggg

SEQ ID NO: 5590274 - DNA, 17 bp, Homo sapiens
ccaaatgctggggcagg

SEQ ID NO: 5590275 - DNA, 20 bp, Homo sapiens
ccaaatgctggggcaggggg

SEQ ID NO: 5590276 - DNA, 23 bp, Homo sapiens
ccaaatggaaatgggcagagcag

SEQ ID NO: 5590277 - DNA, 18 bp, Homo sapiens
ccaaatggagaagctgca

SEQ ID NO: 5590278 - DNA, 16 bp, Homo sapiens
ccaaatggctgctttg

SEQ ID NO: 5590279 - DNA, 14 bp, Homo sapiens
ccaaatggtacaaa

SEQ ID NO: 5590280 - DNA, 15 bp, Homo sapiens
ccaaatgtaaaatat

SEQ ID NO: 5590281 - DNA, 18 bp, Homo sapiens
ccaaatgtaattgaataa

SEQ ID NO: 5590282 - DNA, 19 bp, Homo sapiens
ccaaatgtcctttctcaga

SEQ ID NO: 5590283 - DNA, 19 bp, Homo sapiens
ccaaatgtcggggttgggg

SEQ ID NO: 5590284 - DNA, 23 bp, Homo sapiens
ccaaatgtcggggttggggtggg

SEQ ID NO: 5590285 - DNA, 17 bp, Homo sapiens
ccaaatgtgaaagatgc

SEQ ID NO: 5590286 - DNA, 21 bp, Homo sapiens
ccaaatgtgatcaactgttca

SEQ ID NO: 5590287 - DNA, 19 bp, Homo sapiens
ccaaatgtgccatactaat

SEQ ID NO: 5590288 - DNA, 20 bp, Homo sapiens
ccaaatgtgtataattttaa

SEQ ID NO: 5590289 - DNA, 19 bp, Homo sapiens
ccaaatgtgtgcccagctt

SEQ ID NO: 5590290 - DNA, 18 bp, Homo sapiens
ccaaatgttaactgccaa

SEQ ID NO: 5590291 - DNA, 18 bp, Homo sapiens
ccaaatgtttacagggag

SEQ ID NO: 5590292 - DNA, 12 bp, Homo sapiens
ccaaatgtttat

SEQ ID NO: 5590293 - DNA, 22 bp, Homo sapiens
ccaaatgtttataaaggtaaaa

SEQ ID NO: 5590294 - DNA, 14 bp, Homo sapiens
ccaaattaatcttt

SEQ ID NO: 5590295 - DNA, 17 bp, Homo sapiens
ccaaattaatcttttaa

SEQ ID NO: 5590296 - DNA, 21 bp, Homo sapiens
ccaaattaatcttttaaaaat

SEQ ID NO: 5590297 - DNA, 22 bp, Homo sapiens
ccaaattacaagtattcagttc

SEQ ID NO: 5590298 - DNA, 13 bp, Homo sapiens
ccaaattagccag

SEQ ID NO: 5590299 - DNA, 21 bp, Homo sapiens
ccaaattagtgaaccaaaaat

SEQ ID NO: 5590300 - DNA, 19 bp, Homo sapiens
ccaaattatcaagctaata

SEQ ID NO: 5590301 - DNA, 19 bp, Homo sapiens
ccaaattatcctggtcttt

SEQ ID NO: 5590302 - DNA, 14 bp, Homo sapiens
ccaaattatgtgaa

SEQ ID NO: 5590303 - DNA, 11 bp, Homo sapiens
ccaaattattt

SEQ ID NO: 5590304 - DNA, 18 bp, Homo sapiens
ccaaattatttgtgtaat

SEQ ID NO: 5590305 - DNA, 13 bp, Homo sapiens
ccaaattcagttt

SEQ ID NO: 5590306 - DNA, 20 bp, Homo sapiens
ccaaattccttggcatgcct

SEQ ID NO: 5590307 - DNA, 22 bp, Homo sapiens
ccaaattctttcagtggctacc

SEQ ID NO: 5590308 - DNA, 18 bp, Homo sapiens
ccaaattgatgggtgggc

SEQ ID NO: 5590309 - DNA, 16 bp, Homo sapiens
ccaaattgcactgaag

SEQ ID NO: 5590310 - DNA, 14 bp, Homo sapiens
ccaaattgcagaag

SEQ ID NO: 5590311 - DNA, 16 bp, Homo sapiens
ccaaattgccttcagc

SEQ ID NO: 5590312 - DNA, 18 bp, Homo sapiens
ccaaattgctgagatgtt

SEQ ID NO: 5590313 - DNA, 16 bp, Homo sapiens
ccaaattgcttctagg

SEQ ID NO: 5590314 - DNA, 21 bp, Homo sapiens
ccaaattgcttgagcctggct

SEQ ID NO: 5590315 - DNA, 14 bp, Homo sapiens
ccaaattgggagat

SEQ ID NO: 5590316 - DNA, 16 bp, Homo sapiens
ccaaattggtgtttct

SEQ ID NO: 5590317 - DNA, 22 bp, Homo sapiens
ccaaattgtcacctgcttctct

SEQ ID NO: 5590318 - DNA, 20 bp, Homo sapiens
ccaaattgtctgtctgctct

SEQ ID NO: 5590319 - DNA, 21 bp, Homo sapiens
ccaaattgtctgtctgctctt

SEQ ID NO: 5590320 - DNA, 16 bp, Homo sapiens
ccaaattgtttgtaca

SEQ ID NO: 5590321 - DNA, 18 bp, Homo sapiens
ccaaatttaaaactgttg

SEQ ID NO: 5590322 - DNA, 11 bp, Homo sapiens
ccaaatttaga

SEQ ID NO: 5590323 - DNA, 14 bp, Homo sapiens
ccaaatttatcaaa

SEQ ID NO: 5590324 - DNA, 23 bp, Homo sapiens
ccaaatttcatacctatcatctt

SEQ ID NO: 5590325 - DNA, 18 bp, Homo sapiens
ccaaatttcctgtttgaa

SEQ ID NO: 5590326 - DNA, 15 bp, Homo sapiens
ccaaatttgattgat

SEQ ID NO: 5590327 - DNA, 22 bp, Homo sapiens
ccaaatttgctttacatatgat

SEQ ID NO: 5590328 - DNA, 20 bp, Homo sapiens
ccaaattttatgatttttct

SEQ ID NO: 5590329 - DNA, 21 bp, Homo sapiens
ccaaattttggccaaagtgtt

SEQ ID NO: 5590330 - DNA, 12 bp, Homo sapiens
ccaacaaaccat

SEQ ID NO: 5590331 - DNA, 15 bp, Homo sapiens
ccaacaaacctgctt

SEQ ID NO: 5590332 - DNA, 22 bp, Homo sapiens
ccaacaaagaaaggtgccatgt

SEQ ID NO: 5590333 - DNA, 22 bp, Homo sapiens
ccaacaacaacgaggttcctat

SEQ ID NO: 5590334 - DNA, 14 bp, Homo sapiens
ccaacaacagtcag

SEQ ID NO: 5590335 - DNA, 21 bp, Homo sapiens
ccaacaacagtcagccagctt

SEQ ID NO: 5590336 - DNA, 22 bp, Homo sapiens
ccaacaacatgaaactgcctat

SEQ ID NO: 5590337 - DNA, 19 bp, Homo sapiens
ccaacaacttttccctcac

SEQ ID NO: 5590338 - DNA, 20 bp, Homo sapiens
ccaacaagaagaaatatgaa

SEQ ID NO: 5590339 - DNA, 19 bp, Homo sapiens
ccaacaagaataaaggcag

SEQ ID NO: 5590340 - DNA, 15 bp, Homo sapiens
ccaacaagaatgcat

SEQ ID NO: 5590341 - DNA, 23 bp, Homo sapiens
ccaacaagggcagtggaggtgct

SEQ ID NO: 5590342 - DNA, 21 bp, Homo sapiens
ccaacaataaacaggaatttt

SEQ ID NO: 5590343 - DNA, 20 bp, Homo sapiens
ccaacaatactttgtgtctt

SEQ ID NO: 5590344 - DNA, 16 bp, Homo sapiens
ccaacaatggggtggg

SEQ ID NO: 5590345 - DNA, 18 bp, Homo sapiens
ccaacaatggggtgggcc

SEQ ID NO: 5590346 - DNA, 15 bp, Homo sapiens
ccaacaattggaggg

SEQ ID NO: 5590347 - DNA, 20 bp, Homo sapiens
ccaacacaaggtgggcaggg

SEQ ID NO: 5590348 - DNA, 17 bp, Homo sapiens
ccaacacaatctttcct

SEQ ID NO: 5590349 - DNA, 19 bp, Homo sapiens
ccaacacacgtccactccc

SEQ ID NO: 5590350 - DNA, 13 bp, Homo sapiens
ccaacacaggcaa

SEQ ID NO: 5590351 - DNA, 14 bp, Homo sapiens
ccaacacaggcaag

SEQ ID NO: 5590352 - DNA, 12 bp, Homo sapiens
ccaacacagttg

SEQ ID NO: 5590353 - DNA, 21 bp, Homo sapiens
ccaacacatcacttaccactt

SEQ ID NO: 5590354 - DNA, 23 bp, Homo sapiens
ccaacacatttcacttttctgta

SEQ ID NO: 5590355 - DNA, 13 bp, Homo sapiens
ccaacaccaagca

SEQ ID NO: 5590356 - DNA, 23 bp, Homo sapiens
ccaacaccaagcacagcagcctg

SEQ ID NO: 5590357 - DNA, 22 bp, Homo sapiens
ccaacaccacaaacctttcagc

SEQ ID NO: 5590358 - DNA, 15 bp, Homo sapiens
ccaacaccacagaaa

SEQ ID NO: 5590359 - DNA, 16 bp, Homo sapiens
ccaacaccacagacac

SEQ ID NO: 5590360 - DNA, 18 bp, Homo sapiens
ccaacaccacagacacac

SEQ ID NO: 5590361 - DNA, 16 bp, Homo sapiens
ccaacaccaccccttg

SEQ ID NO: 5590362 - DNA, 17 bp, Homo sapiens
ccaacaccagcccctgc

SEQ ID NO: 5590363 - DNA, 13 bp, Homo sapiens
ccaacaccaggga

SEQ ID NO: 5590364 - DNA, 22 bp, Homo sapiens
ccaacacccccgacggcctcca

SEQ ID NO: 5590365 - DNA, 20 bp, Homo sapiens
ccaacaccctgtctaaaaaa

SEQ ID NO: 5590366 - DNA, 14 bp, Homo sapiens
ccaacacctgctgc

SEQ ID NO: 5590367 - DNA, 15 bp, Homo sapiens
ccaacacctgctgcg

SEQ ID NO: 5590368 - DNA, 19 bp, Homo sapiens
ccaacaccttcttggcttc

SEQ ID NO: 5590369 - DNA, 23 bp, Homo sapiens
ccaacaccttcttggcttctggg

SEQ ID NO: 5590370 - DNA, 17 bp, Homo sapiens
ccaacacgcacctgcct

SEQ ID NO: 5590371 - DNA, 15 bp, Homo sapiens
ccaacactccaggcc

SEQ ID NO: 5590372 - DNA, 13 bp, Homo sapiens
ccaacactgccag

SEQ ID NO: 5590373 - DNA, 15 bp, Homo sapiens
ccaacactgccagca

SEQ ID NO: 5590374 - DNA, 14 bp, Homo sapiens
ccaacactgtgccc

SEQ ID NO: 5590375 - DNA, 17 bp, Homo sapiens
ccaacactgtgccctgg

SEQ ID NO: 5590376 - DNA, 20 bp, Homo sapiens
ccaacactgtgggtgtgtga

SEQ ID NO: 5590377 - DNA, 12 bp, Homo sapiens
ccaacacttcca

SEQ ID NO: 5590378 - DNA, 13 bp, Homo sapiens
ccaacacttccag

SEQ ID NO: 5590379 - DNA, 19 bp, Homo sapiens
ccaacacttgtgttgcttt

SEQ ID NO: 5590380 - DNA, 20 bp, Homo sapiens
ccaacactttgagcattttt

SEQ ID NO: 5590381 - DNA, 22 bp, Homo sapiens
ccaacagaaaccttttattttt

SEQ ID NO: 5590382 - DNA, 18 bp, Homo sapiens
ccaacagaacccacagta

SEQ ID NO: 5590383 - DNA, 18 bp, Homo sapiens
ccaacagaactaaatgtt

SEQ ID NO: 5590384 - DNA, 16 bp, Homo sapiens
ccaacagaagcagact

SEQ ID NO: 5590385 - DNA, 23 bp, Homo sapiens
ccaacagaagcagacttttcaga

SEQ ID NO: 5590386 - DNA, 12 bp, Homo sapiens
ccaacagacacc

SEQ ID NO: 5590387 - DNA, 14 bp, Homo sapiens
ccaacagacaccct

SEQ ID NO: 5590388 - DNA, 18 bp, Homo sapiens
ccaacagacaccctccac

SEQ ID NO: 5590389 - DNA, 17 bp, Homo sapiens
ccaacagacctggtgct

SEQ ID NO: 5590390 - DNA, 23 bp, Homo sapiens
ccaacagatgagcgaaaatgtat

SEQ ID NO: 5590391 - DNA, 17 bp, Homo sapiens
ccaacagcacctccccg

SEQ ID NO: 5590392 - DNA, 22 bp, Homo sapiens
ccaacagcacttttcctcttct

SEQ ID NO: 5590393 - DNA, 11 bp, Homo sapiens
ccaacagcagc

SEQ ID NO: 5590394 - DNA, 14 bp, Homo sapiens
ccaacagcagtgat

SEQ ID NO: 5590395 - DNA, 20 bp, Homo sapiens
ccaacagccactcagaaaag

SEQ ID NO: 5590396 - DNA, 14 bp, Homo sapiens
ccaacagcccagca

SEQ ID NO: 5590397 - DNA, 16 bp, Homo sapiens
ccaacagcccccccct

SEQ ID NO: 5590398 - DNA, 14 bp, Homo sapiens
ccaacagcctctgt

SEQ ID NO: 5590399 - DNA, 16 bp, Homo sapiens
ccaacagcgcccaaag

SEQ ID NO: 5590400 - DNA, 18 bp, Homo sapiens
ccaacagctacaacagcc

SEQ ID NO: 5590401 - DNA, 22 bp, Homo sapiens
ccaacagctggaccctgaccag

SEQ ID NO: 5590402 - DNA, 17 bp, Homo sapiens
ccaacaggaggacaatt

SEQ ID NO: 5590403 - DNA, 20 bp, Homo sapiens
ccaacaggaggacaattcat

SEQ ID NO: 5590404 - DNA, 22 bp, Homo sapiens
ccaacaggctgttctgcactga

SEQ ID NO: 5590405 - DNA, 19 bp, Homo sapiens
ccaacagggtagatttctc

SEQ ID NO: 5590406 - DNA, 20 bp, Homo sapiens
ccaacagggtagatttctct

SEQ ID NO: 5590407 - DNA, 21 bp, Homo sapiens
ccaacagggtagatttctctt

SEQ ID NO: 5590408 - DNA, 24 bp, Homo sapiens
ccaacaggtaaacacataaatgaa

SEQ ID NO: 5590409 - DNA, 19 bp, Homo sapiens
ccaacagtcaaaacagaga

SEQ ID NO: 5590410 - DNA, 14 bp, Homo sapiens
ccaacagtgtgaag

SEQ ID NO: 5590411 - DNA, 15 bp, Homo sapiens
ccaacagtgtgaagt

SEQ ID NO: 5590412 - DNA, 12 bp, Homo sapiens
ccaacagttcct

SEQ ID NO: 5590413 - DNA, 12 bp, Homo sapiens
ccaacagttgta

SEQ ID NO: 5590414 - DNA, 17 bp, Homo sapiens
ccaacagttgtatgttt

SEQ ID NO: 5590415 - DNA, 16 bp, Homo sapiens
ccaacatactcccatc

SEQ ID NO: 5590416 - DNA, 19 bp, Homo sapiens
ccaacatactcccatctgt

SEQ ID NO: 5590417 - DNA, 22 bp, Homo sapiens
ccaacatatatttattgagtac

SEQ ID NO: 5590418 - DNA, 17 bp, Homo sapiens
ccaacatcacagcccag

SEQ ID NO: 5590419 - DNA, 18 bp, Homo sapiens
ccaacatcacagcccagc

SEQ ID NO: 5590420 - DNA, 21 bp, Homo sapiens
ccaacatcatcaggaagcctg

SEQ ID NO: 5590421 - DNA, 20 bp, Homo sapiens
ccaacatcccattgccctgg

SEQ ID NO: 5590422 - DNA, 21 bp, Homo sapiens
ccaacatcccattgccctggt

SEQ ID NO: 5590423 - DNA, 23 bp, Homo sapiens
ccaacatcggtgtggactacagg

SEQ ID NO: 5590424 - DNA, 17 bp, Homo sapiens
ccaacatcgtgaaaccc

SEQ ID NO: 5590425 - DNA, 18 bp, Homo sapiens
ccaacatctacaaaacat

SEQ ID NO: 5590426 - DNA, 18 bp, Homo sapiens
ccaacatctccagctgga

SEQ ID NO: 5590427 - DNA, 20 bp, Homo sapiens
ccaacatctttctttttaag

SEQ ID NO: 5590428 - DNA, 18 bp, Homo sapiens
ccaacatgaggacagaag

SEQ ID NO: 5590429 - DNA, 13 bp, Homo sapiens
ccaacatgcactg

SEQ ID NO: 5590430 - DNA, 23 bp, Homo sapiens
ccaacatgcactgatgttgtgtt

SEQ ID NO: 5590431 - DNA, 16 bp, Homo sapiens
ccaacatgcctgcacc

SEQ ID NO: 5590432 - DNA, 15 bp, Homo sapiens
ccaacatggagaaac

SEQ ID NO: 5590433 - DNA, 22 bp, Homo sapiens
ccaacatggagaaaccctgtct

SEQ ID NO: 5590434 - DNA, 23 bp, Homo sapiens
ccaacatggagaaaccctgtctc

SEQ ID NO: 5590435 - DNA, 14 bp, Homo sapiens
ccaacatgggaggg

SEQ ID NO: 5590436 - DNA, 19 bp, Homo sapiens
ccaacatgggagggatcag

SEQ ID NO: 5590437 - DNA, 20 bp, Homo sapiens
ccaacatggtgaaaccccca

SEQ ID NO: 5590438 - DNA, 15 bp, Homo sapiens
ccaagctgggcccca

SEQ ID NO: 5590439 - DNA, 16 bp, Homo sapiens
ccaagctgggccccag

SEQ ID NO: 5590440 - DNA, 20 bp, Homo sapiens
ccaagctggtcccactcagt

SEQ ID NO: 5590441 - DNA, 22 bp, Homo sapiens
ccaagctgtatgtacttccagt

SEQ ID NO: 5590442 - DNA, 20 bp, Homo sapiens
ccaagctgtgaccctcaatt

SEQ ID NO: 5590443 - DNA, 17 bp, Homo sapiens
ccaagctgtgccaccct

SEQ ID NO: 5590444 - DNA, 12 bp, Homo sapiens
ccaagctgtgct

SEQ ID NO: 5590445 - DNA, 13 bp, Homo sapiens
ccaagctgtggca

SEQ ID NO: 5590446 - DNA, 18 bp, Homo sapiens
ccaagctgtggcagccgt

SEQ ID NO: 5590447 - DNA, 12 bp, Homo sapiens
ccaagctgttaa

SEQ ID NO: 5590448 - DNA, 14 bp, Homo sapiens
ccaagctgttttct

SEQ ID NO: 5590449 - DNA, 17 bp, Homo sapiens
ccaagcttaaggagagg

SEQ ID NO: 5590450 - DNA, 16 bp, Homo sapiens
ccaagcttagtcctgg

SEQ ID NO: 5590451 - DNA, 15 bp, Homo sapiens
ccaagcttcaaccct

SEQ ID NO: 5590452 - DNA, 19 bp, Homo sapiens
ccaagcttcaaccctcagc

SEQ ID NO: 5590453 - DNA, 19 bp, Homo sapiens
ccaagcttcaagtgatata

SEQ ID NO: 5590454 - DNA, 16 bp, Homo sapiens
ccaagcttcagagcct

SEQ ID NO: 5590455 - DNA, 17 bp, Homo sapiens
ccaagcttcagagccta

SEQ ID NO: 5590456 - DNA, 18 bp, Homo sapiens
ccaagcttcagagcctag

SEQ ID NO: 5590457 - DNA, 23 bp, Homo sapiens
ccaagcttcagagcctagccacc

SEQ ID NO: 5590458 - DNA, 21 bp, Homo sapiens
ccaagcttccatagctgctgc

SEQ ID NO: 5590459 - DNA, 11 bp, Homo sapiens
ccaagcttccc

SEQ ID NO: 5590460 - DNA, 13 bp, Homo sapiens
ccaagcttcccaa

SEQ ID NO: 5590461 - DNA, 14 bp, Homo sapiens
ccaagcttcctgtg

SEQ ID NO: 5590462 - DNA, 15 bp, Homo sapiens
ccaagcttcctgtgc

SEQ ID NO: 5590463 - DNA, 23 bp, Homo sapiens
ccaagcttcctgtgccctcaccc

SEQ ID NO: 5590464 - DNA, 17 bp, Homo sapiens
ccaagcttcctttgttt

SEQ ID NO: 5590465 - DNA, 22 bp, Homo sapiens
ccaagcttggtttgtggcgtct

SEQ ID NO: 5590466 - DNA, 18 bp, Homo sapiens
ccaagcttgtgagagctg

SEQ ID NO: 5590467 - DNA, 15 bp, Homo sapiens
ccaagcttgttatca

SEQ ID NO: 5590468 - DNA, 17 bp, Homo sapiens
ccaagcttgttatcagc

SEQ ID NO: 5590469 - DNA, 23 bp, Homo sapiens
ccaagcttgtttccctgctggcc

SEQ ID NO: 5590470 - DNA, 19 bp, Homo sapiens
ccaagctttcaaacatgtt

SEQ ID NO: 5590471 - DNA, 20 bp, Homo sapiens
ccaagctttgaggctctgtc

SEQ ID NO: 5590472 - DNA, 14 bp, Homo sapiens
ccaaggaaaactgc

SEQ ID NO: 5590473 - DNA, 17 bp, Homo sapiens
ccaaggaaaattgaaag

SEQ ID NO: 5590474 - DNA, 20 bp, Homo sapiens
ccaaggaaaccacagctgct

SEQ ID NO: 5590475 - DNA, 21 bp, Homo sapiens
ccaaggaaaccacagctgctg

SEQ ID NO: 5590476 - DNA, 22 bp, Homo sapiens
ccaaggaaaccacagctgctgg

SEQ ID NO: 5590477 - DNA, 21 bp, Homo sapiens
ccaaggaaaggcatgtacaaa

SEQ ID NO: 5590478 - DNA, 23 bp, Homo sapiens
ccaaggaaatattgagagagaag

SEQ ID NO: 5590479 - DNA, 13 bp, Homo sapiens
ccaaggaacaaaa

SEQ ID NO: 5590480 - DNA, 11 bp, Homo sapiens
ccaaggaacct

SEQ ID NO: 5590481 - DNA, 18 bp, Homo sapiens
ccaaggaacctaattgaa

SEQ ID NO: 5590482 - DNA, 21 bp, Homo sapiens
ccaaggaacttcatgcttgat

SEQ ID NO: 5590483 - DNA, 23 bp, Homo sapiens
ccaaggaagcagaagacgggagg

SEQ ID NO: 5590484 - DNA, 21 bp, Homo sapiens
ccaaggaagcagcctcagagt

SEQ ID NO: 5590485 - DNA, 18 bp, Homo sapiens
ccaaggaagctccttcct

SEQ ID NO: 5590486 - DNA, 15 bp, Homo sapiens
ccaaggaaggagccc

SEQ ID NO: 5590487 - DNA, 16 bp, Homo sapiens
ccaaggaaggagcccc

SEQ ID NO: 5590488 - DNA, 23 bp, Homo sapiens
ccaaggaatgtgtccaagacaca

SEQ ID NO: 5590489 - DNA, 16 bp, Homo sapiens
ccaaggacagtcagca

SEQ ID NO: 5590490 - DNA, 17 bp, Homo sapiens
ccaaggacagttcagag

SEQ ID NO: 5590491 - DNA, 14 bp, Homo sapiens
ccaaggacccaggc

SEQ ID NO: 5590492 - DNA, 15 bp, Homo sapiens
ccaaggacccaggcg

SEQ ID NO: 5590493 - DNA, 18 bp, Homo sapiens
ccaaggacccaggcgctg

SEQ ID NO: 5590494 - DNA, 14 bp, Homo sapiens
ccaaggacccctca

SEQ ID NO: 5590495 - DNA, 16 bp, Homo sapiens
ccaaggacctgcctcc

SEQ ID NO: 5590496 - DNA, 22 bp, Homo sapiens
ccaaggaccttttggaatgact

SEQ ID NO: 5590497 - DNA, 19 bp, Homo sapiens
ccaaggactgactttgcca

SEQ ID NO: 5590498 - DNA, 15 bp, Homo sapiens
ccaaggactgaggga

SEQ ID NO: 5590499 - DNA, 23 bp, Homo sapiens
ccaaggactgagggactctgaag

SEQ ID NO: 5590500 - DNA, 11 bp, Homo sapiens
ccaaggactgc

SEQ ID NO: 5590501 - DNA, 16 bp, Homo sapiens
ccaaggacttccacat

SEQ ID NO: 5590502 - DNA, 19 bp, Homo sapiens
ccaaggacttccacatttt

SEQ ID NO: 5590503 - DNA, 20 bp, Homo sapiens
ccaaggacttccacattttt

SEQ ID NO: 5590504 - DNA, 19 bp, Homo sapiens
ccaaggactttccagtgag

SEQ ID NO: 5590505 - DNA, 14 bp, Homo sapiens
ccaaggagaaacag

SEQ ID NO: 5590506 - DNA, 21 bp, Homo sapiens
ccaaggagaaacagagacagg

SEQ ID NO: 5590507 - DNA, 15 bp, Homo sapiens
ccaaggagaacaaat

SEQ ID NO: 5590508 - DNA, 14 bp, Homo sapiens
ccaaggagacacaa

SEQ ID NO: 5590509 - DNA, 16 bp, Homo sapiens
ccaaggagcacaggtc

SEQ ID NO: 5590510 - DNA, 14 bp, Homo sapiens
ccaaggagcagaga

SEQ ID NO: 5590511 - DNA, 21 bp, Homo sapiens
ccaaggagcatccttggcagt

SEQ ID NO: 5590512 - DNA, 20 bp, Homo sapiens
ccaaggagctgagaatagaa

SEQ ID NO: 5590513 - DNA, 15 bp, Homo sapiens
ccaaggagctgctat

SEQ ID NO: 5590514 - DNA, 22 bp, Homo sapiens
ccaaggagctgctatagcctgg

SEQ ID NO: 5590515 - DNA, 12 bp, Homo sapiens
ccaaggaggatt

SEQ ID NO: 5590516 - DNA, 18 bp, Homo sapiens
ccaaggaggcctggggag

SEQ ID NO: 5590517 - DNA, 21 bp, Homo sapiens
ccaaggaggcggccgctggcc

SEQ ID NO: 5590518 - DNA, 14 bp, Homo sapiens
ccaaggaggggcca

SEQ ID NO: 5590519 - DNA, 12 bp, Homo sapiens
ccaaggaggggg

SEQ ID NO: 5590520 - DNA, 13 bp, Homo sapiens
ccaaggagggggc

SEQ ID NO: 5590521 - DNA, 18 bp, Homo sapiens
ccaaggagtaagtacaaa

SEQ ID NO: 5590522 - DNA, 18 bp, Homo sapiens
ccaaggataattaaatat

SEQ ID NO: 5590523 - DNA, 20 bp, Homo sapiens
ccaaggatcctctccactcc

SEQ ID NO: 5590524 - DNA, 18 bp, Homo sapiens
ccaaggatgccttagcat

SEQ ID NO: 5590525 - DNA, 14 bp, Homo sapiens
ccaaggcaaacaat

SEQ ID NO: 5590526 - DNA, 21 bp, Homo sapiens
ccaaggcaaggggtgcctggg

SEQ ID NO: 5590527 - DNA, 22 bp, Homo sapiens
ccaaggcaaggggtgcctggga

SEQ ID NO: 5590528 - DNA, 16 bp, Homo sapiens
ccaaggcactgagcgc

SEQ ID NO: 5590529 - DNA, 22 bp, Homo sapiens
ccaaggcagcctccagagccag

SEQ ID NO: 5590530 - DNA, 18 bp, Homo sapiens
ccaaggcagcgaccccag

SEQ ID NO: 5590531 - DNA, 14 bp, Homo sapiens
ccaaggcagggccc

SEQ ID NO: 5590532 - DNA, 16 bp, Homo sapiens
ccaaggcagggcccag

SEQ ID NO: 5590533 - DNA, 11 bp, Homo sapiens
ccaaggcaggt

SEQ ID NO: 5590534 - DNA, 17 bp, Homo sapiens
ccaaggcagtgcatgca

SEQ ID NO: 5590535 - DNA, 16 bp, Homo sapiens
ccaaggcatccccagt

SEQ ID NO: 5590536 - DNA, 17 bp, Homo sapiens
ccaaggcatccccagtg

SEQ ID NO: 5590537 - DNA, 17 bp, Homo sapiens
ccaaggcattctcccag

SEQ ID NO: 5590538 - DNA, 17 bp, Homo sapiens
ccaaggccaaaggaagc

SEQ ID NO: 5590539 - DNA, 11 bp, Homo sapiens
ccaaggccacc

SEQ ID NO: 5590540 - DNA, 15 bp, Homo sapiens
ccaaggccagagtgg

SEQ ID NO: 5590541 - DNA, 18 bp, Homo sapiens
ccaaggccagagtggcct

SEQ ID NO: 5590542 - DNA, 22 bp, Homo sapiens
ccaaggccagcccacacagccc

SEQ ID NO: 5590543 - DNA, 14 bp, Homo sapiens
ccaaggcccagcta

SEQ ID NO: 5590544 - DNA, 16 bp, Homo sapiens
ccaaggccccagggac

SEQ ID NO: 5590545 - DNA, 23 bp, Homo sapiens
ccaaggccccagggacagaggcc

SEQ ID NO: 5590546 - DNA, 17 bp, Homo sapiens
ccaaggccccctgcctg

SEQ ID NO: 5590547 - DNA, 20 bp, Homo sapiens
ccaaggccccctgcctgccc

SEQ ID NO: 5590548 - DNA, 18 bp, Homo sapiens
ccaaggccctgctttttt

SEQ ID NO: 5590549 - DNA, 22 bp, Homo sapiens
ccaaggccgccagcgtgtggag

SEQ ID NO: 5590550 - DNA, 23 bp, Homo sapiens
ccaaggccgccagcgtgtggagc

SEQ ID NO: 5590551 - DNA, 18 bp, Homo sapiens
ccaaggccggagacccac

SEQ ID NO: 5590552 - DNA, 22 bp, Homo sapiens
ccaaggcctaccccagttccta

SEQ ID NO: 5590553 - DNA, 19 bp, Homo sapiens
ccaaggcctatgccacctg

SEQ ID NO: 5590554 - DNA, 16 bp, Homo sapiens
ccaaggcctccctcag

SEQ ID NO: 5590555 - DNA, 12 bp, Homo sapiens
ccaaggcctctc

SEQ ID NO: 5590556 - DNA, 13 bp, Homo sapiens
ccaaggcctctct

SEQ ID NO: 5590557 - DNA, 20 bp, Homo sapiens
ccaaggcctctctctgcctg

SEQ ID NO: 5590558 - DNA, 21 bp, Homo sapiens
ccaaggcctctctctgcctga

SEQ ID NO: 5590559 - DNA, 13 bp, Homo sapiens
ccaaggccttccc

SEQ ID NO: 5590560 - DNA, 15 bp, Homo sapiens
ccaaggcggcccctc

SEQ ID NO: 5590561 - DNA, 14 bp, Homo sapiens
ccaaggcgtgcagg

SEQ ID NO: 5590562 - DNA, 16 bp, Homo sapiens
ccaaggctcactgcag

SEQ ID NO: 5590563 - DNA, 18 bp, Homo sapiens
ccaaggctcactgcagcg

SEQ ID NO: 5590564 - DNA, 18 bp, Homo sapiens
ccaaggctctcccctctc

SEQ ID NO: 5590565 - DNA, 13 bp, Homo sapiens
ccaaggctgccag

SEQ ID NO: 5590566 - DNA, 12 bp, Homo sapiens
ccaaggctgcct

SEQ ID NO: 5590567 - DNA, 17 bp, Homo sapiens
ccaaggctgcgtctgga

SEQ ID NO: 5590568 - DNA, 19 bp, Homo sapiens
ccaaggctgcgtctggagg

SEQ ID NO: 5590569 - DNA, 13 bp, Homo sapiens
ccaaggctgctca

SEQ ID NO: 5590570 - DNA, 14 bp, Homo sapiens
ccaaggctggggga

SEQ ID NO: 5590571 - DNA, 15 bp, Homo sapiens
ccaaggctggtccca

SEQ ID NO: 5590572 - DNA, 17 bp, Homo sapiens
ccaaggctttaaagctg

SEQ ID NO: 5590573 - DNA, 21 bp, Homo sapiens
ccaaggctttaaagctgagag

SEQ ID NO: 5590574 - DNA, 16 bp, Homo sapiens
ccaaggctttctctac

SEQ ID NO: 5590575 - DNA, 17 bp, Homo sapiens
ccaagggaaaggggtgc

SEQ ID NO: 5590576 - DNA, 21 bp, Homo sapiens
ccaagggaaaggggtgctttt

SEQ ID NO: 5590577 - DNA, 16 bp, Homo sapiens
ccaagggaacctgtgt

SEQ ID NO: 5590578 - DNA, 20 bp, Homo sapiens
ccaagggacaaccccatcat

SEQ ID NO: 5590579 - DNA, 20 bp, Homo sapiens
ccaagggacacaggagacca

SEQ ID NO: 5590580 - DNA, 16 bp, Homo sapiens
ccaagggacagcccac

SEQ ID NO: 5590581 - DNA, 18 bp, Homo sapiens
ccaagggacaggagaaga

SEQ ID NO: 5590582 - DNA, 15 bp, Homo sapiens
ccaagggacaggtgg

SEQ ID NO: 5590583 - DNA, 20 bp, Homo sapiens
ccaagggacaggtgggcctg

SEQ ID NO: 5590584 - DNA, 21 bp, Homo sapiens
ccaagggacaggtgggcctgg

SEQ ID NO: 5590585 - DNA, 21 bp, Homo sapiens
ccaagggacgttgacctggac

SEQ ID NO: 5590586 - DNA, 11 bp, Homo sapiens
ccaagggaggc

SEQ ID NO: 5590587 - DNA, 18 bp, Homo sapiens
ccaagggaggctgctgct

SEQ ID NO: 5590588 - DNA, 20 bp, Homo sapiens
ccaagggagggaagggccac

SEQ ID NO: 5590589 - DNA, 23 bp, Homo sapiens
ccaagggagggtgcagccctctt

SEQ ID NO: 5590590 - DNA, 19 bp, Homo sapiens
ccaagggatgaaagagaag

SEQ ID NO: 5590591 - DNA, 18 bp, Homo sapiens
ccaagggatggacatctt

SEQ ID NO: 5590592 - DNA, 18 bp, Homo sapiens
ccaagggatggcaccact

SEQ ID NO: 5590593 - DNA, 21 bp, Homo sapiens
ccaagggatgggacctgatga

SEQ ID NO: 5590594 - DNA, 22 bp, Homo sapiens
ccaagggatgggacctgatgac

SEQ ID NO: 5590595 - DNA, 15 bp, Homo sapiens
ccaagggccaaaccc

SEQ ID NO: 5590596 - DNA, 15 bp, Homo sapiens
ccaagggcccagacc

SEQ ID NO: 5590597 - DNA, 19 bp, Homo sapiens
ccaagggcccagaccctgg

SEQ ID NO: 5590598 - DNA, 14 bp, Homo sapiens
ccaagggcccagag

SEQ ID NO: 5590599 - DNA, 15 bp, Homo sapiens
ccaagggcccagagg

SEQ ID NO: 5590600 - DNA, 11 bp, Homo sapiens
ccaagggcccc

SEQ ID NO: 5590601 - DNA, 16 bp, Homo sapiens
ccaagggccccagggg

SEQ ID NO: 5590602 - DNA, 15 bp, Homo sapiens
ccaagggccctcact

SEQ ID NO: 5590603 - DNA, 21 bp, Homo sapiens
ccaagggccctcactcaggaa

SEQ ID NO: 5590604 - DNA, 16 bp, Homo sapiens
ccaagggccctggcac

SEQ ID NO: 5590605 - DNA, 21 bp, Homo sapiens
ccaagggccctggcaccccca

SEQ ID NO: 5590606 - DNA, 17 bp, Homo sapiens
ccaagggcctcccacca

SEQ ID NO: 5590607 - DNA, 19 bp, Homo sapiens
ccaagggcctcccaccaga

SEQ ID NO: 5590608 - DNA, 22 bp, Homo sapiens
ccaagggcctcccaccagagac

SEQ ID NO: 5590609 - DNA, 15 bp, Homo sapiens
ccaagggcctggcct

SEQ ID NO: 5590610 - DNA, 20 bp, Homo sapiens
ccaagggctccagggccagg

SEQ ID NO: 5590611 - DNA, 13 bp, Homo sapiens
ccaagggctgccg

SEQ ID NO: 5590612 - DNA, 19 bp, Homo sapiens
ccaagggctggggcggagc

SEQ ID NO: 5590613 - DNA, 14 bp, Homo sapiens
ccaagggcttctgc

SEQ ID NO: 5590614 - DNA, 19 bp, Homo sapiens
ccaagggcttctgcaccct

SEQ ID NO: 5590615 - DNA, 21 bp, Homo sapiens
ccaagggcttctgcaccctcc

SEQ ID NO: 5590616 - DNA, 17 bp, Homo sapiens
ccaattatgcactggcc

SEQ ID NO: 5590617 - DNA, 12 bp, Homo sapiens
ccaattatggaa

SEQ ID NO: 5590618 - DNA, 22 bp, Homo sapiens
ccaattatgtgacaacctttgt

SEQ ID NO: 5590619 - DNA, 17 bp, Homo sapiens
ccaattatgttaaacta

SEQ ID NO: 5590620 - DNA, 15 bp, Homo sapiens
ccaattattgatata

SEQ ID NO: 5590621 - DNA, 18 bp, Homo sapiens
ccaattattgatatatat

SEQ ID NO: 5590622 - DNA, 20 bp, Homo sapiens
ccaattattgatatatatta

SEQ ID NO: 5590623 - DNA, 21 bp, Homo sapiens
ccaattattgatatatattat

SEQ ID NO: 5590624 - DNA, 18 bp, Homo sapiens
ccaattattgttacacat

SEQ ID NO: 5590625 - DNA, 21 bp, Homo sapiens
ccaattcaaccctttgcccca

SEQ ID NO: 5590626 - DNA, 13 bp, Homo sapiens
ccaattcaataca

SEQ ID NO: 5590627 - DNA, 15 bp, Homo sapiens
ccaattcacccactc

SEQ ID NO: 5590628 - DNA, 14 bp, Homo sapiens
ccaattcagacagg

SEQ ID NO: 5590629 - DNA, 20 bp, Homo sapiens
ccaattccaatttcaaaatg

SEQ ID NO: 5590630 - DNA, 19 bp, Homo sapiens
ccaattccacagtctctgg

SEQ ID NO: 5590631 - DNA, 23 bp, Homo sapiens
ccaattccaccaagacagtgctg

SEQ ID NO: 5590632 - DNA, 16 bp, Homo sapiens
ccaattccagagctgt

SEQ ID NO: 5590633 - DNA, 14 bp, Homo sapiens
ccaattccccctta

SEQ ID NO: 5590634 - DNA, 23 bp, Homo sapiens
ccaattcctcatttgttcattaa

SEQ ID NO: 5590635 - DNA, 18 bp, Homo sapiens
ccaattcggggcctgctg

SEQ ID NO: 5590636 - DNA, 20 bp, Homo sapiens
ccaattcggggcctgctgga

SEQ ID NO: 5590637 - DNA, 23 bp, Homo sapiens
ccaattctaaatccgacttgaat

SEQ ID NO: 5590638 - DNA, 14 bp, Homo sapiens
ccaattctgaaata

SEQ ID NO: 5590639 - DNA, 22 bp, Homo sapiens
ccaattctgcctgcctcctccc

SEQ ID NO: 5590640 - DNA, 17 bp, Homo sapiens
ccaattctggacagaca

SEQ ID NO: 5590641 - DNA, 18 bp, Homo sapiens
ccaattctggacagacag

SEQ ID NO: 5590642 - DNA, 19 bp, Homo sapiens
ccaattctttagtgctgat

SEQ ID NO: 5590643 - DNA, 13 bp, Homo sapiens
ccaattgaaaagt

SEQ ID NO: 5590644 - DNA, 16 bp, Homo sapiens
ccaattgactctcaca

SEQ ID NO: 5590645 - DNA, 15 bp, Homo sapiens
ccaattgatgtatat

SEQ ID NO: 5590646 - DNA, 23 bp, Homo sapiens
ccaattgatgttttacgtgcaaa

SEQ ID NO: 5590647 - DNA, 13 bp, Homo sapiens
ccaattgccctgc

SEQ ID NO: 5590648 - DNA, 14 bp, Homo sapiens
ccaattgccctgcc

SEQ ID NO: 5590649 - DNA, 17 bp, Homo sapiens
ccaattgccctgccagg

SEQ ID NO: 5590650 - DNA, 18 bp, Homo sapiens
ccaattgccctgccaggc

SEQ ID NO: 5590651 - DNA, 18 bp, Homo sapiens
ccaattgcctcttgcagg

SEQ ID NO: 5590652 - DNA, 13 bp, Homo sapiens
ccaattgctaccg

SEQ ID NO: 5590653 - DNA, 13 bp, Homo sapiens
ccaattggaggaa

SEQ ID NO: 5590654 - DNA, 13 bp, Homo sapiens
ccaattgtgctgc

SEQ ID NO: 5590655 - DNA, 15 bp, Homo sapiens
ccaatttaattccat

SEQ ID NO: 5590656 - DNA, 20 bp, Homo sapiens
ccaatttacactcaaccatg

SEQ ID NO: 5590657 - DNA, 18 bp, Homo sapiens
ccaatttcccggagccat

SEQ ID NO: 5590658 - DNA, 22 bp, Homo sapiens
ccaatttcggattttttccaaa

SEQ ID NO: 5590659 - DNA, 18 bp, Homo sapiens
ccaatttctattaaaggt

SEQ ID NO: 5590660 - DNA, 16 bp, Homo sapiens
ccaatttcttccttcc

SEQ ID NO: 5590661 - DNA, 19 bp, Homo sapiens
ccaatttgcacattaaatg

SEQ ID NO: 5590662 - DNA, 18 bp, Homo sapiens
ccaatttgcaccagtttt

SEQ ID NO: 5590663 - DNA, 22 bp, Homo sapiens
ccaatttggtaaaaatgctgct

SEQ ID NO: 5590664 - DNA, 22 bp, Homo sapiens
ccaatttgtctcctactctgtg

SEQ ID NO: 5590665 - DNA, 17 bp, Homo sapiens
ccaattttaaaaaataa

SEQ ID NO: 5590666 - DNA, 20 bp, Homo sapiens
ccaattttaaaaaataacat

SEQ ID NO: 5590667 - DNA, 21 bp, Homo sapiens
ccaattttaacttagagcttt

SEQ ID NO: 5590668 - DNA, 16 bp, Homo sapiens
ccaattttaatttagt

SEQ ID NO: 5590669 - DNA, 21 bp, Homo sapiens
ccaattttaatttagtaaatg

SEQ ID NO: 5590670 - DNA, 22 bp, Homo sapiens
ccaattttaatttagtaaatgt

SEQ ID NO: 5590671 - DNA, 20 bp, Homo sapiens
ccaattttcagacacatttt

SEQ ID NO: 5590672 - DNA, 14 bp, Homo sapiens
ccaatttttgtact

SEQ ID NO: 5590673 - DNA, 19 bp, Homo sapiens
ccaatttttgttttcccca

SEQ ID NO: 5590674 - DNA, 23 bp, Homo sapiens
ccaattttttaagtgaaaatata

SEQ ID NO: 5590675 - DNA, 16 bp, Homo sapiens
ccaatttttttttcct

SEQ ID NO: 5590676 - DNA, 12 bp, Homo sapiens
ccacaaaaacaa

SEQ ID NO: 5590677 - DNA, 14 bp, Homo sapiens
ccacaaaaataaaa

SEQ ID NO: 5590678 - DNA, 18 bp, Homo sapiens
ccacaaaactctgtcagg

SEQ ID NO: 5590679 - DNA, 14 bp, Homo sapiens
ccacaaaagaagtg

SEQ ID NO: 5590680 - DNA, 15 bp, Homo sapiens
ccacaaaagaagtga

SEQ ID NO: 5590681 - DNA, 20 bp, Homo sapiens
ccacaaaagacagacccagt

SEQ ID NO: 5590682 - DNA, 22 bp, Homo sapiens
ccacaaaatagagattaatttt

SEQ ID NO: 5590683 - DNA, 19 bp, Homo sapiens
ccacaaacacagccctgga

SEQ ID NO: 5590684 - DNA, 17 bp, Homo sapiens
ccacaaacactgtgggg

SEQ ID NO: 5590685 - DNA, 16 bp, Homo sapiens
ccacaaaccctgctga

SEQ ID NO: 5590686 - DNA, 23 bp, Homo sapiens
ccacaaaccctgctgaacacagt

SEQ ID NO: 5590687 - DNA, 15 bp, Homo sapiens
ccacaaacctgcccg

SEQ ID NO: 5590688 - DNA, 23 bp, Homo sapiens
ccacaaacggagcccctgaaagc

SEQ ID NO: 5590689 - DNA, 14 bp, Homo sapiens
ccacaaactccagg

SEQ ID NO: 5590690 - DNA, 23 bp, Homo sapiens
ccacaaactccaggctggaagta

SEQ ID NO: 5590691 - DNA, 16 bp, Homo sapiens
ccacaaactgatttct

SEQ ID NO: 5590692 - DNA, 17 bp, Homo sapiens
ccacaaagaagattctt

SEQ ID NO: 5590693 - DNA, 20 bp, Homo sapiens
ccacaaagcacagtttgaac

SEQ ID NO: 5590694 - DNA, 19 bp, Homo sapiens
ccacaaagcagtggcttag

SEQ ID NO: 5590695 - DNA, 17 bp, Homo sapiens
ccacaaagccccccagc

SEQ ID NO: 5590696 - DNA, 19 bp, Homo sapiens
ccacaaagccccccagctc

SEQ ID NO: 5590697 - DNA, 16 bp, Homo sapiens
ccacaaagccgtgcct

SEQ ID NO: 5590698 - DNA, 14 bp, Homo sapiens
ccacaaagccttat

SEQ ID NO: 5590699 - DNA, 22 bp, Homo sapiens
ccacaaagccttatcaagtgtc

SEQ ID NO: 5590700 - DNA, 18 bp, Homo sapiens
ccacaaaggagagctagc

SEQ ID NO: 5590701 - DNA, 14 bp, Homo sapiens
ccacaaagggtagc

SEQ ID NO: 5590702 - DNA, 18 bp, Homo sapiens
ccacaaagggtagcctgg

SEQ ID NO: 5590703 - DNA, 16 bp, Homo sapiens
ccacaaaggtcacagg

SEQ ID NO: 5590704 - DNA, 21 bp, Homo sapiens
ccacaaatcaaagcaagggct

SEQ ID NO: 5590705 - DNA, 23 bp, Homo sapiens
ccacaaatcaaagcaagggctcc

SEQ ID NO: 5590706 - DNA, 15 bp, Homo sapiens
ccacaaatcttcagt

SEQ ID NO: 5590707 - DNA, 12 bp, Homo sapiens
ccacaaatgcct

SEQ ID NO: 5590708 - DNA, 16 bp, Homo sapiens
ccacaaatgtcctcag

SEQ ID NO: 5590709 - DNA, 17 bp, Homo sapiens
ccacaaatgtcctcaga

SEQ ID NO: 5590710 - DNA, 13 bp, Homo sapiens
ccacaaattcatg

SEQ ID NO: 5590711 - DNA, 22 bp, Homo sapiens
ccacaacaaagtgcttcctttt

SEQ ID NO: 5590712 - DNA, 17 bp, Homo sapiens
ccacaacagaataaagc

SEQ ID NO: 5590713 - DNA, 19 bp, Homo sapiens
ccacaacagaataaagcag

SEQ ID NO: 5590714 - DNA, 20 bp, Homo sapiens
ccacaacagaataaagcagc

SEQ ID NO: 5590715 - DNA, 21 bp, Homo sapiens
ccacaacagaataaagcagcc

SEQ ID NO: 5590716 - DNA, 22 bp, Homo sapiens
ccacaacagaataaagcagcct

SEQ ID NO: 5590717 - DNA, 23 bp, Homo sapiens
ccacaacagaataaagcagcctg

SEQ ID NO: 5590718 - DNA, 18 bp, Homo sapiens
ccacaacagcctggggtt

SEQ ID NO: 5590719 - DNA, 18 bp, Homo sapiens
ccacaaccctctggaagt

SEQ ID NO: 5590720 - DNA, 20 bp, Homo sapiens
ccacaacctccacctcctgg

SEQ ID NO: 5590721 - DNA, 16 bp, Homo sapiens
ccacaacgtgcaactg

SEQ ID NO: 5590722 - DNA, 19 bp, Homo sapiens
ccacaactaacaatgcctt

SEQ ID NO: 5590723 - DNA, 22 bp, Homo sapiens
ccacaactactagtgtgactcc

SEQ ID NO: 5590724 - DNA, 23 bp, Homo sapiens
ccacaactactagtgtgactcct

SEQ ID NO: 5590725 - DNA, 17 bp, Homo sapiens
ccacaactcccttgcac

SEQ ID NO: 5590726 - DNA, 12 bp, Homo sapiens
ccacaactgaca

SEQ ID NO: 5590727 - DNA, 21 bp, Homo sapiens
ccacaacttgtcacccaaagc

SEQ ID NO: 5590728 - DNA, 14 bp, Homo sapiens
ccacaacttttaac

SEQ ID NO: 5590729 - DNA, 22 bp, Homo sapiens
ccacaagaaatgaaagcaggga

SEQ ID NO: 5590730 - DNA, 16 bp, Homo sapiens
ccacaagaaatttgat

SEQ ID NO: 5590731 - DNA, 18 bp, Homo sapiens
ccacaagaactcccttct

SEQ ID NO: 5590732 - DNA, 15 bp, Homo sapiens
ccacaagaataagca

SEQ ID NO: 5590733 - DNA, 21 bp, Homo sapiens
ccacaagagatcagcagtggc

SEQ ID NO: 5590734 - DNA, 13 bp, Homo sapiens
ccacaagagccca

SEQ ID NO: 5590735 - DNA, 16 bp, Homo sapiens
ccacaagagcccaggc

SEQ ID NO: 5590736 - DNA, 17 bp, Homo sapiens
ccacaagagcccaggcc

SEQ ID NO: 5590737 - DNA, 19 bp, Homo sapiens
ccacaagagcccaggcctc

SEQ ID NO: 5590738 - DNA, 14 bp, Homo sapiens
ccacaagagcccca

SEQ ID NO: 5590739 - DNA, 16 bp, Homo sapiens
ccacaagagctccttg

SEQ ID NO: 5590740 - DNA, 17 bp, Homo sapiens
ccacaagagctccttga

SEQ ID NO: 5590741 - DNA, 17 bp, Homo sapiens
ccacaagattcccagag

SEQ ID NO: 5590742 - DNA, 20 bp, Homo sapiens
ccacaagattcccagagaca

SEQ ID NO: 5590743 - DNA, 21 bp, Homo sapiens
ccacaagattcccagagacag

SEQ ID NO: 5590744 - DNA, 12 bp, Homo sapiens
ccacaagcacaa

SEQ ID NO: 5590745 - DNA, 13 bp, Homo sapiens
ccacaagcacaat

SEQ ID NO: 5590746 - DNA, 13 bp, Homo sapiens
ccacaagcaccac

SEQ ID NO: 5590747 - DNA, 19 bp, Homo sapiens
ccacaagccataaaccaat

SEQ ID NO: 5590748 - DNA, 21 bp, Homo sapiens
ccacaagcctctgcccaggca

SEQ ID NO: 5590749 - DNA, 14 bp, Homo sapiens
ccacaagcctgagg

SEQ ID NO: 5590750 - DNA, 21 bp, Homo sapiens
ccacaagcctgagggaaaggc

SEQ ID NO: 5590751 - DNA, 20 bp, Homo sapiens
ccacaagcctgcctcgcctt

SEQ ID NO: 5590752 - DNA, 19 bp, Homo sapiens
ccacaagctgagcaggaca

SEQ ID NO: 5590753 - DNA, 15 bp, Homo sapiens
ccacaagctgcactg

SEQ ID NO: 5590754 - DNA, 21 bp, Homo sapiens
ccacaagctgcactgtgaacc

SEQ ID NO: 5590755 - DNA, 15 bp, Homo sapiens
ccacaagctgcctct

SEQ ID NO: 5590756 - DNA, 21 bp, Homo sapiens
ccacaagctgtccctgcaggg

SEQ ID NO: 5590757 - DNA, 19 bp, Homo sapiens
ccacaaggaaaaggaggag

SEQ ID NO: 5590758 - DNA, 16 bp, Homo sapiens
ccacaaggaaccctca

SEQ ID NO: 5590759 - DNA, 20 bp, Homo sapiens
ccacaaggaaccctcaggcc

SEQ ID NO: 5590760 - DNA, 13 bp, Homo sapiens
ccacaaggaagaa

SEQ ID NO: 5590761 - DNA, 24 bp, Homo sapiens
ccacaaggaataaatgagagggaa

SEQ ID NO: 5590762 - DNA, 17 bp, Homo sapiens
ccacaaggacttcctgt

SEQ ID NO: 5590763 - DNA, 15 bp, Homo sapiens
ccacaaggcccagcc

SEQ ID NO: 5590764 - DNA, 16 bp, Homo sapiens
ccacaaggcctggtct

SEQ ID NO: 5590765 - DNA, 21 bp, Homo sapiens
ccacaaggcctggtctgggag

SEQ ID NO: 5590766 - DNA, 13 bp, Homo sapiens
ccacaaggctggc

SEQ ID NO: 5590767 - DNA, 18 bp, Homo sapiens
ccacaaggggcttttccc

SEQ ID NO: 5590768 - DNA, 20 bp, Homo sapiens
ccacaagggtgcccacctct

SEQ ID NO: 5590769 - DNA, 17 bp, Homo sapiens
ccacaaggtccactccc

SEQ ID NO: 5590770 - DNA, 21 bp, Homo sapiens
ccacaaggtccccccaccgct

SEQ ID NO: 5590771 - DNA, 21 bp, Homo sapiens
ccacaagtgaatctttctcct

SEQ ID NO: 5590772 - DNA, 20 bp, Homo sapiens
ccacaagtgccctccaggct

SEQ ID NO: 5590773 - DNA, 18 bp, Homo sapiens
ccacaagttctttcccag

SEQ ID NO: 5590774 - DNA, 19 bp, Homo sapiens
ccacaataaactcgtgact

SEQ ID NO: 5590775 - DNA, 21 bp, Homo sapiens
ccacaataaagatcgccccca

SEQ ID NO: 5590776 - DNA, 15 bp, Homo sapiens
ccacaatcaccgatg

SEQ ID NO: 5590777 - DNA, 15 bp, Homo sapiens
ccacaatcccaccta

SEQ ID NO: 5590778 - DNA, 21 bp, Homo sapiens
ccacaatcccacctagcccag

SEQ ID NO: 5590779 - DNA, 14 bp, Homo sapiens
ccacaatctgagca

SEQ ID NO: 5590780 - DNA, 20 bp, Homo sapiens
ccacaatctggcttagtgcc

SEQ ID NO: 5590781 - DNA, 17 bp, Homo sapiens
ccacaatgcctctccca

SEQ ID NO: 5590782 - DNA, 18 bp, Homo sapiens
ccacaattaaaccgcatg

SEQ ID NO: 5590783 - DNA, 13 bp, Homo sapiens
ccacaattctttt

SEQ ID NO: 5590784 - DNA, 15 bp, Homo sapiens
ccacaatttctttaa

SEQ ID NO: 5590785 - DNA, 21 bp, Homo sapiens
ccacaatttctttaaaaaaga

SEQ ID NO: 5590786 - DNA, 15 bp, Homo sapiens
ccacacaaaatgtca

SEQ ID NO: 5590787 - DNA, 14 bp, Homo sapiens
ccacacaaagattt

SEQ ID NO: 5590788 - DNA, 21 bp, Homo sapiens
ccacacaacatccaagtggcc

SEQ ID NO: 5590789 - DNA, 22 bp, Homo sapiens
ccacacaaggatagatgctggc

SEQ ID NO: 5590790 - DNA, 14 bp, Homo sapiens
ccacacacacaaaa

SEQ ID NO: 5590791 - DNA, 21 bp, Homo sapiens
ccacacacacaaggtgctcag

SEQ ID NO: 5590792 - DNA, 17 bp, Homo sapiens
ccactccccccatccta

SEQ ID NO: 5590793 - DNA, 19 bp, Homo sapiens
ccactcccccgtttctcct

SEQ ID NO: 5590794 - DNA, 21 bp, Homo sapiens
ccactcccccgtttctccttt

SEQ ID NO: 5590795 - DNA, 16 bp, Homo sapiens
ccactcccccttccct

SEQ ID NO: 5590796 - DNA, 20 bp, Homo sapiens
ccactcccccttcccttgga

SEQ ID NO: 5590797 - DNA, 19 bp, Homo sapiens
ccactcccctaaactccag

SEQ ID NO: 5590798 - DNA, 18 bp, Homo sapiens
ccactcccctcatccact

SEQ ID NO: 5590799 - DNA, 15 bp, Homo sapiens
ccactcccgccacac

SEQ ID NO: 5590800 - DNA, 18 bp, Homo sapiens
ccactccctcctaaccta

SEQ ID NO: 5590801 - DNA, 13 bp, Homo sapiens
ccactccctgcaa

SEQ ID NO: 5590802 - DNA, 13 bp, Homo sapiens
ccactccctgctc

SEQ ID NO: 5590803 - DNA, 14 bp, Homo sapiens
ccactccctgtcca

SEQ ID NO: 5590804 - DNA, 18 bp, Homo sapiens
ccactcccttgctggccc

SEQ ID NO: 5590805 - DNA, 14 bp, Homo sapiens
ccactccctttcca

SEQ ID NO: 5590806 - DNA, 24 bp, Homo sapiens
ccactccctttgcgtcaggagcag

SEQ ID NO: 5590807 - DNA, 17 bp, Homo sapiens
ccactccgactccccct

SEQ ID NO: 5590808 - DNA, 18 bp, Homo sapiens
ccactccgactccccctc

SEQ ID NO: 5590809 - DNA, 23 bp, Homo sapiens
ccactccgagaggtgggccagtc

SEQ ID NO: 5590810 - DNA, 12 bp, Homo sapiens
ccactccgccag

SEQ ID NO: 5590811 - DNA, 16 bp, Homo sapiens
ccactccgccagccac

SEQ ID NO: 5590812 - DNA, 18 bp, Homo sapiens
ccactccgccagccacag

SEQ ID NO: 5590813 - DNA, 18 bp, Homo sapiens
ccactcctcactgcccca

SEQ ID NO: 5590814 - DNA, 12 bp, Homo sapiens
ccactcctcagt

SEQ ID NO: 5590815 - DNA, 24 bp, Homo sapiens
ccactcctccgagacccaggagac

SEQ ID NO: 5590816 - DNA, 13 bp, Homo sapiens
ccactcctcctcc

SEQ ID NO: 5590817 - DNA, 16 bp, Homo sapiens
ccactcctcctccagc

SEQ ID NO: 5590818 - DNA, 14 bp, Homo sapiens
ccactcctcctcct

SEQ ID NO: 5590819 - DNA, 16 bp, Homo sapiens
ccactcctcctccttt

SEQ ID NO: 5590820 - DNA, 12 bp, Homo sapiens
ccactcctctaa

SEQ ID NO: 5590821 - DNA, 15 bp, Homo sapiens
ccactcctctgctga

SEQ ID NO: 5590822 - DNA, 15 bp, Homo sapiens
ccactcctcttattt

SEQ ID NO: 5590823 - DNA, 20 bp, Homo sapiens
ccactcctgccagcccggct

SEQ ID NO: 5590824 - DNA, 12 bp, Homo sapiens
ccactcctggga

SEQ ID NO: 5590825 - DNA, 14 bp, Homo sapiens
ccactcctgggccc

SEQ ID NO: 5590826 - DNA, 14 bp, Homo sapiens
ccactcctgtacac

SEQ ID NO: 5590827 - DNA, 14 bp, Homo sapiens
ccactcctgtcccg

SEQ ID NO: 5590828 - DNA, 20 bp, Homo sapiens
ccactcctgtcccgccttcc

SEQ ID NO: 5590829 - DNA, 20 bp, Homo sapiens
ccactcctgtccctgtagct

SEQ ID NO: 5590830 - DNA, 19 bp, Homo sapiens
ccactccttcatgtttgga

SEQ ID NO: 5590831 - DNA, 16 bp, Homo sapiens
ccactccttccatctc

SEQ ID NO: 5590832 - DNA, 13 bp, Homo sapiens
ccactccttcctg

SEQ ID NO: 5590833 - DNA, 14 bp, Homo sapiens
ccactccttcctgc

SEQ ID NO: 5590834 - DNA, 22 bp, Homo sapiens
ccactccttcctgccacctgct

SEQ ID NO: 5590835 - DNA, 22 bp, Homo sapiens
ccactcctttacaaccatactt

SEQ ID NO: 5590836 - DNA, 23 bp, Homo sapiens
ccactcgacccagaatggagcct

SEQ ID NO: 5590837 - DNA, 14 bp, Homo sapiens
ccactcgaggcctg

SEQ ID NO: 5590838 - DNA, 15 bp, Homo sapiens
ccactcgccttctta

SEQ ID NO: 5590839 - DNA, 23 bp, Homo sapiens
ccactcgggaggctgagacagga

SEQ ID NO: 5590840 - DNA, 22 bp, Homo sapiens
ccactcgggggtggagtgagac

SEQ ID NO: 5590841 - DNA, 23 bp, Homo sapiens
ccactcgggggtggagtgagact

SEQ ID NO: 5590842 - DNA, 20 bp, Homo sapiens
ccactctaccctcccacccc

SEQ ID NO: 5590843 - DNA, 12 bp, Homo sapiens
ccactctacctc

SEQ ID NO: 5590844 - DNA, 19 bp, Homo sapiens
ccactctagggcagtggag

SEQ ID NO: 5590845 - DNA, 16 bp, Homo sapiens
ccactctagttctaga

SEQ ID NO: 5590846 - DNA, 19 bp, Homo sapiens
ccactctagttctagatga

SEQ ID NO: 5590847 - DNA, 17 bp, Homo sapiens
ccactctatgagttgga

SEQ ID NO: 5590848 - DNA, 13 bp, Homo sapiens
ccactctcagagg

SEQ ID NO: 5590849 - DNA, 13 bp, Homo sapiens
ccactctcaggac

SEQ ID NO: 5590850 - DNA, 15 bp, Homo sapiens
ccactctcaggacca

SEQ ID NO: 5590851 - DNA, 19 bp, Homo sapiens
ccactctcaggaccaccct

SEQ ID NO: 5590852 - DNA, 14 bp, Homo sapiens
ccactctcattccc

SEQ ID NO: 5590853 - DNA, 17 bp, Homo sapiens
ccactctcattccccag

SEQ ID NO: 5590854 - DNA, 13 bp, Homo sapiens
ccactctccacct

SEQ ID NO: 5590855 - DNA, 17 bp, Homo sapiens
ccactctccacctcact

SEQ ID NO: 5590856 - DNA, 18 bp, Homo sapiens
ccactctccacctcacta

SEQ ID NO: 5590857 - DNA, 19 bp, Homo sapiens
ccactctccacctcactag

SEQ ID NO: 5590858 - DNA, 20 bp, Homo sapiens
ccactctcccccaccccctc

SEQ ID NO: 5590859 - DNA, 18 bp, Homo sapiens
ccactctcccctccctct

SEQ ID NO: 5590860 - DNA, 23 bp, Homo sapiens
ccactctcccctccctcttcctt

SEQ ID NO: 5590861 - DNA, 12 bp, Homo sapiens
ccactctcctga

SEQ ID NO: 5590862 - DNA, 14 bp, Homo sapiens
ccactctcctgagg

SEQ ID NO: 5590863 - DNA, 13 bp, Homo sapiens
ccactctcggggc

SEQ ID NO: 5590864 - DNA, 15 bp, Homo sapiens
ccactctctcaccca

SEQ ID NO: 5590865 - DNA, 16 bp, Homo sapiens
ccactctctcacccac

SEQ ID NO: 5590866 - DNA, 18 bp, Homo sapiens
ccactctctcacccacca

SEQ ID NO: 5590867 - DNA, 20 bp, Homo sapiens
ccactctctcacccaccagc

SEQ ID NO: 5590868 - DNA, 14 bp, Homo sapiens
ccactctctgccca

SEQ ID NO: 5590869 - DNA, 16 bp, Homo sapiens
ccactctctgcccact

SEQ ID NO: 5590870 - DNA, 21 bp, Homo sapiens
ccactctgaagtcccttcctg

SEQ ID NO: 5590871 - DNA, 23 bp, Homo sapiens
ccactctgaagtcccttcctgtc

SEQ ID NO: 5590872 - DNA, 16 bp, Homo sapiens
ccactctgaggtctca

SEQ ID NO: 5590873 - DNA, 19 bp, Homo sapiens
ccactctgaggtctcacct

SEQ ID NO: 5590874 - DNA, 22 bp, Homo sapiens
ccactctgaggtctcaccttcg

SEQ ID NO: 5590875 - DNA, 22 bp, Homo sapiens
ccactctgattcacctcttcct

SEQ ID NO: 5590876 - DNA, 13 bp, Homo sapiens
ccactctgcaaga

SEQ ID NO: 5590877 - DNA, 21 bp, Homo sapiens
ccactctgccccttgccctcc

SEQ ID NO: 5590878 - DNA, 16 bp, Homo sapiens
ccactctgctcccagc

SEQ ID NO: 5590879 - DNA, 23 bp, Homo sapiens
ccactctgctctgatgcatcaga

SEQ ID NO: 5590880 - DNA, 21 bp, Homo sapiens
ccactctgctgaggccagagg

SEQ ID NO: 5590881 - DNA, 13 bp, Homo sapiens
ccactctgctgcc

SEQ ID NO: 5590882 - DNA, 20 bp, Homo sapiens
ccactctgcttctctgactt

SEQ ID NO: 5590883 - DNA, 23 bp, Homo sapiens
ccactctggagcatttctcatca

SEQ ID NO: 5590884 - DNA, 11 bp, Homo sapiens
ccactctggat

SEQ ID NO: 5590885 - DNA, 21 bp, Homo sapiens
ccactctggattcagccttct

SEQ ID NO: 5590886 - DNA, 23 bp, Homo sapiens
ccactctggattcagccttcttt

SEQ ID NO: 5590887 - DNA, 13 bp, Homo sapiens
ccactctggcagc

SEQ ID NO: 5590888 - DNA, 15 bp, Homo sapiens
ccactctggcagcca

SEQ ID NO: 5590889 - DNA, 19 bp, Homo sapiens
ccactctgggcaaagcccc

SEQ ID NO: 5590890 - DNA, 13 bp, Homo sapiens
ccactctgggcac

SEQ ID NO: 5590891 - DNA, 14 bp, Homo sapiens
ccactctgggcaca

SEQ ID NO: 5590892 - DNA, 23 bp, Homo sapiens
ccactctggggacccgctggggg

SEQ ID NO: 5590893 - DNA, 12 bp, Homo sapiens
ccactctgtaat

SEQ ID NO: 5590894 - DNA, 13 bp, Homo sapiens
ccactctgtaatt

SEQ ID NO: 5590895 - DNA, 19 bp, Homo sapiens
ccactctgtaattgcaaaa

SEQ ID NO: 5590896 - DNA, 11 bp, Homo sapiens
ccactctgtgc

SEQ ID NO: 5590897 - DNA, 13 bp, Homo sapiens
ccactctgtggcc

SEQ ID NO: 5590898 - DNA, 16 bp, Homo sapiens
ccactctgtggccagc

SEQ ID NO: 5590899 - DNA, 18 bp, Homo sapiens
ccactctgtggccagcct

SEQ ID NO: 5590900 - DNA, 20 bp, Homo sapiens
ccactctgtggccagcctgg

SEQ ID NO: 5590901 - DNA, 23 bp, Homo sapiens
ccactctgtggccagcctggcat

SEQ ID NO: 5590902 - DNA, 22 bp, Homo sapiens
ccactctgtttgctcacccagg

SEQ ID NO: 5590903 - DNA, 20 bp, Homo sapiens
ccactcttctctcctttctc

SEQ ID NO: 5590904 - DNA, 15 bp, Homo sapiens
ccactcttgaagagg

SEQ ID NO: 5590905 - DNA, 15 bp, Homo sapiens
ccactctttctttca

SEQ ID NO: 5590906 - DNA, 13 bp, Homo sapiens
ccactctttgcta

SEQ ID NO: 5590907 - DNA, 21 bp, Homo sapiens
ccactctttgctacaataaat

SEQ ID NO: 5590908 - DNA, 22 bp, Homo sapiens
ccactctttgctacaataaatg

SEQ ID NO: 5590909 - DNA, 17 bp, Homo sapiens
ccactgaaaaaatatat

SEQ ID NO: 5590910 - DNA, 19 bp, Homo sapiens
ccactgaaaaaatatatgt

SEQ ID NO: 5590911 - DNA, 22 bp, Homo sapiens
ccactgaaaacatttcaaagct

SEQ ID NO: 5590912 - DNA, 23 bp, Homo sapiens
ccactgaaaacatttcaaagctg

SEQ ID NO: 5590913 - DNA, 17 bp, Homo sapiens
ccactgaaatgaccaag

SEQ ID NO: 5590914 - DNA, 21 bp, Homo sapiens
ccactgaaatgaccaagacag

SEQ ID NO: 5590915 - DNA, 18 bp, Homo sapiens
ccactgaagcccatttct

SEQ ID NO: 5590916 - DNA, 17 bp, Homo sapiens
ccactgaatctgagaaa

SEQ ID NO: 5590917 - DNA, 13 bp, Homo sapiens
ccactgaattcac

SEQ ID NO: 5590918 - DNA, 14 bp, Homo sapiens
ccactgaattcact

SEQ ID NO: 5590919 - DNA, 15 bp, Homo sapiens
ccactgaattcactc

SEQ ID NO: 5590920 - DNA, 18 bp, Homo sapiens
ccactgaattcactccag

SEQ ID NO: 5590921 - DNA, 13 bp, Homo sapiens
ccactgacagata

SEQ ID NO: 5590922 - DNA, 20 bp, Homo sapiens
ccactgacagcctccacctt

SEQ ID NO: 5590923 - DNA, 17 bp, Homo sapiens
ccactgacagcctccca

SEQ ID NO: 5590924 - DNA, 13 bp, Homo sapiens
ccactgaccagaa

SEQ ID NO: 5590925 - DNA, 15 bp, Homo sapiens
ccactgacccaactg

SEQ ID NO: 5590926 - DNA, 12 bp, Homo sapiens
ccactgacccac

SEQ ID NO: 5590927 - DNA, 23 bp, Homo sapiens
ccactgaccgggatccagttcca

SEQ ID NO: 5590928 - DNA, 13 bp, Homo sapiens
ccactgacctcac

SEQ ID NO: 5590929 - DNA, 15 bp, Homo sapiens
ccactgacctcaccg

SEQ ID NO: 5590930 - DNA, 23 bp, Homo sapiens
ccactgacctcaccggcatgctg

SEQ ID NO: 5590931 - DNA, 17 bp, Homo sapiens
ccactgacctgcccatg

SEQ ID NO: 5590932 - DNA, 12 bp, Homo sapiens
ccactgacctgg

SEQ ID NO: 5590933 - DNA, 18 bp, Homo sapiens
ccactgacctggaagagc

SEQ ID NO: 5590934 - DNA, 22 bp, Homo sapiens
ccactgagactttcccctctcg

SEQ ID NO: 5590935 - DNA, 19 bp, Homo sapiens
ccactgagagatctgctgt

SEQ ID NO: 5590936 - DNA, 17 bp, Homo sapiens
ccactgagagctgctcc

SEQ ID NO: 5590937 - DNA, 18 bp, Homo sapiens
ccactgagaggacagaga

SEQ ID NO: 5590938 - DNA, 19 bp, Homo sapiens
ccactgagcatcacaataa

SEQ ID NO: 5590939 - DNA, 17 bp, Homo sapiens
ccactgagcccttgcac

SEQ ID NO: 5590940 - DNA, 23 bp, Homo sapiens
ccactgagcccttgcacaggcca

SEQ ID NO: 5590941 - DNA, 13 bp, Homo sapiens
ccactgagcctgg

SEQ ID NO: 5590942 - DNA, 14 bp, Homo sapiens
ccactgagcctggc

SEQ ID NO: 5590943 - DNA, 13 bp, Homo sapiens
ccactgagctggc

SEQ ID NO: 5590944 - DNA, 15 bp, Homo sapiens
ccactgagctggctg

SEQ ID NO: 5590945 - DNA, 16 bp, Homo sapiens
ccactgaggagacaga

SEQ ID NO: 5590946 - DNA, 17 bp, Homo sapiens
ccactgaggagacagaa

SEQ ID NO: 5590947 - DNA, 23 bp, Homo sapiens
ccactgaggagacagaaagcctc

SEQ ID NO: 5590948 - DNA, 19 bp, Homo sapiens
ccactgatgctgttctctt

SEQ ID NO: 5590949 - DNA, 18 bp, Homo sapiens
ccactgattggccagccg

SEQ ID NO: 5590950 - DNA, 15 bp, Homo sapiens
ccactgatttagcca

SEQ ID NO: 5590951 - DNA, 16 bp, Homo sapiens
ccactgatttagccat

SEQ ID NO: 5590952 - DNA, 11 bp, Homo sapiens
ccactgcaaac

SEQ ID NO: 5590953 - DNA, 16 bp, Homo sapiens
ccactgcaaataaagc

SEQ ID NO: 5590954 - DNA, 18 bp, Homo sapiens
ccactgcaacccatgagc

SEQ ID NO: 5590955 - DNA, 22 bp, Homo sapiens
ccactgcaacttgtgaactcca

SEQ ID NO: 5590956 - DNA, 14 bp, Homo sapiens
ccactgcacagagc

SEQ ID NO: 5590957 - DNA, 13 bp, Homo sapiens
ccactgcaccccc

SEQ ID NO: 5590958 - DNA, 21 bp, Homo sapiens
ccactgcacccccctgtgcct

SEQ ID NO: 5590959 - DNA, 22 bp, Homo sapiens
ccactgcacccccctgtgcctg

SEQ ID NO: 5590960 - DNA, 17 bp, Homo sapiens
ccactgcaccgggccac

SEQ ID NO: 5590961 - DNA, 19 bp, Homo sapiens
ccactgcaccgggccacag

SEQ ID NO: 5590962 - DNA, 20 bp, Homo sapiens
ccactgcactatagcctagg

SEQ ID NO: 5590963 - DNA, 13 bp, Homo sapiens
ccactgcactcca

SEQ ID NO: 5590964 - DNA, 17 bp, Homo sapiens
ccactgcactccagcct

SEQ ID NO: 5590965 - DNA, 20 bp, Homo sapiens
ccactgcactccagcctggc

SEQ ID NO: 5590966 - DNA, 21 bp, Homo sapiens
ccactgcactccagcctgggg

SEQ ID NO: 5590967 - DNA, 21 bp, Homo sapiens
ccactgcactccagcctgggt

SEQ ID NO: 5590968 - DNA, 23 bp, Homo sapiens
ccactgcactccagcctgggtga

SEQ ID NO: 5590969 - DNA, 18 bp, Homo sapiens
ccactgcagaagacagta

SEQ ID NO: 5590970 - DNA, 15 bp, Homo sapiens
ccagaatctgctgtt

SEQ ID NO: 5590971 - DNA, 23 bp, Homo sapiens
ccagaatctgctgttgccatagc

SEQ ID NO: 5590972 - DNA, 19 bp, Homo sapiens
ccagaatcttcgtcctgcc

SEQ ID NO: 5590973 - DNA, 20 bp, Homo sapiens
ccagaatcttcgtcctgccc

SEQ ID NO: 5590974 - DNA, 21 bp, Homo sapiens
ccagaatcttcgtcctgcccc

SEQ ID NO: 5590975 - DNA, 16 bp, Homo sapiens
ccagaatgagacatcc

SEQ ID NO: 5590976 - DNA, 14 bp, Homo sapiens
ccagaatgctgggt

SEQ ID NO: 5590977 - DNA, 21 bp, Homo sapiens
ccagaatgctgtacatctatt

SEQ ID NO: 5590978 - DNA, 17 bp, Homo sapiens
ccagaatggagtctttt

SEQ ID NO: 5590979 - DNA, 12 bp, Homo sapiens
ccagaatgtaag

SEQ ID NO: 5590980 - DNA, 14 bp, Homo sapiens
ccagaatgtgctgc

SEQ ID NO: 5590981 - DNA, 19 bp, Homo sapiens
ccagaattacccttcctca

SEQ ID NO: 5590982 - DNA, 21 bp, Homo sapiens
ccagaattagtcctcacagcc

SEQ ID NO: 5590983 - DNA, 13 bp, Homo sapiens
ccagaattcacta

SEQ ID NO: 5590984 - DNA, 16 bp, Homo sapiens
ccagaattctggacaa

SEQ ID NO: 5590985 - DNA, 15 bp, Homo sapiens
ccagaattgtcctca

SEQ ID NO: 5590986 - DNA, 13 bp, Homo sapiens
ccagaatttcaaa

SEQ ID NO: 5590987 - DNA, 19 bp, Homo sapiens
ccagaatttcccaaagcag

SEQ ID NO: 5590988 - DNA, 16 bp, Homo sapiens
ccagaatttggaaatc

SEQ ID NO: 5590989 - DNA, 20 bp, Homo sapiens
ccagacaaaaaaatttaaaa

SEQ ID NO: 5590990 - DNA, 17 bp, Homo sapiens
ccagacaaataggagtg

SEQ ID NO: 5590991 - DNA, 15 bp, Homo sapiens
ccagacaaatttaaa

SEQ ID NO: 5590992 - DNA, 14 bp, Homo sapiens
ccagacaaccaaaa

SEQ ID NO: 5590993 - DNA, 16 bp, Homo sapiens
ccagacaagccctgct

SEQ ID NO: 5590994 - DNA, 15 bp, Homo sapiens
ccagacaagctgttg

SEQ ID NO: 5590995 - DNA, 22 bp, Homo sapiens
ccagacaatctcgtaggtgtcc

SEQ ID NO: 5590996 - DNA, 18 bp, Homo sapiens
ccagacacaaactgccaa

SEQ ID NO: 5590997 - DNA, 18 bp, Homo sapiens
ccagacacagaagaggct

SEQ ID NO: 5590998 - DNA, 16 bp, Homo sapiens
ccagacacagactggc

SEQ ID NO: 5590999 - DNA, 16 bp, Homo sapiens
ccagacacagatacat

SEQ ID NO: 5591000 - DNA, 15 bp, Homo sapiens
ccagacacaggccct

SEQ ID NO: 5591001 - DNA, 19 bp, Homo sapiens
ccagacacaggccctccct

SEQ ID NO: 5591002 - DNA, 12 bp, Homo sapiens
ccagacacatgg

SEQ ID NO: 5591003 - DNA, 17 bp, Homo sapiens
ccagacacatgtccaag

SEQ ID NO: 5591004 - DNA, 19 bp, Homo sapiens
ccagacaccacagacgcca

SEQ ID NO: 5591005 - DNA, 13 bp, Homo sapiens
ccagacaccatca

SEQ ID NO: 5591006 - DNA, 21 bp, Homo sapiens
ccagacactgagcttctgaga

SEQ ID NO: 5591007 - DNA, 11 bp, Homo sapiens
ccagacactgg

SEQ ID NO: 5591008 - DNA, 12 bp, Homo sapiens
ccagacactggt

SEQ ID NO: 5591009 - DNA, 13 bp, Homo sapiens
ccagacactggtt

SEQ ID NO: 5591010 - DNA, 12 bp, Homo sapiens
ccagacagacag

SEQ ID NO: 5591011 - DNA, 18 bp, Homo sapiens
ccagacagacatctctgc

SEQ ID NO: 5591012 - DNA, 15 bp, Homo sapiens
ccagacagagggtca

SEQ ID NO: 5591013 - DNA, 22 bp, Homo sapiens
ccagacagcaaggtgtggaggc

SEQ ID NO: 5591014 - DNA, 13 bp, Homo sapiens
ccagacagcacag

SEQ ID NO: 5591015 - DNA, 20 bp, Homo sapiens
ccagacagccccaagcttct

SEQ ID NO: 5591016 - DNA, 17 bp, Homo sapiens
ccagacagcctgtatct

SEQ ID NO: 5591017 - DNA, 21 bp, Homo sapiens
ccagacaggaggagtgggaca

SEQ ID NO: 5591018 - DNA, 20 bp, Homo sapiens
ccagacaggccctccctgtc

SEQ ID NO: 5591019 - DNA, 14 bp, Homo sapiens
ccagacagggctcc

SEQ ID NO: 5591020 - DNA, 22 bp, Homo sapiens
ccagacagggctccagcctgtc

SEQ ID NO: 5591021 - DNA, 13 bp, Homo sapiens
ccagacagggtgg

SEQ ID NO: 5591022 - DNA, 14 bp, Homo sapiens
ccagacagggtggg

SEQ ID NO: 5591023 - DNA, 20 bp, Homo sapiens
ccagacagggtgggcttcct

SEQ ID NO: 5591024 - DNA, 16 bp, Homo sapiens
ccagacataaaggaaa

SEQ ID NO: 5591025 - DNA, 17 bp, Homo sapiens
ccagacataaaggaaaa

SEQ ID NO: 5591026 - DNA, 18 bp, Homo sapiens
ccagacataaaggaaaag

SEQ ID NO: 5591027 - DNA, 22 bp, Homo sapiens
ccagacatacgaaacacaaacc

SEQ ID NO: 5591028 - DNA, 18 bp, Homo sapiens
ccagacatcaccctttgc

SEQ ID NO: 5591029 - DNA, 16 bp, Homo sapiens
ccagacatgctgccca

SEQ ID NO: 5591030 - DNA, 21 bp, Homo sapiens
ccagacatgctgcccaccccc

SEQ ID NO: 5591031 - DNA, 14 bp, Homo sapiens
ccagacatggacct

SEQ ID NO: 5591032 - DNA, 14 bp, Homo sapiens
ccagacattgtatt

SEQ ID NO: 5591033 - DNA, 15 bp, Homo sapiens
ccagaccaaccctgg

SEQ ID NO: 5591034 - DNA, 15 bp, Homo sapiens
ccagaccaaggcagg

SEQ ID NO: 5591035 - DNA, 18 bp, Homo sapiens
ccagaccaccagccgccc

SEQ ID NO: 5591036 - DNA, 20 bp, Homo sapiens
ccagaccacctccctgccct

SEQ ID NO: 5591037 - DNA, 16 bp, Homo sapiens
ccagaccacctgccag

SEQ ID NO: 5591038 - DNA, 18 bp, Homo sapiens
ccagaccacctgccagcc

SEQ ID NO: 5591039 - DNA, 17 bp, Homo sapiens
ccagaccagccctgcag

SEQ ID NO: 5591040 - DNA, 22 bp, Homo sapiens
ccagaccaggaaaggcttggct

SEQ ID NO: 5591041 - DNA, 16 bp, Homo sapiens
ccagaccagtagtgac

SEQ ID NO: 5591042 - DNA, 17 bp, Homo sapiens
ccagaccagtagtgacc

SEQ ID NO: 5591043 - DNA, 14 bp, Homo sapiens
ccagaccattgtct

SEQ ID NO: 5591044 - DNA, 21 bp, Homo sapiens
ccagaccattgtctcagagca

SEQ ID NO: 5591045 - DNA, 18 bp, Homo sapiens
ccagaccattgtcttcca

SEQ ID NO: 5591046 - DNA, 19 bp, Homo sapiens
ccagaccattgtcttccaa

SEQ ID NO: 5591047 - DNA, 16 bp, Homo sapiens
ccagacccaacccatg

SEQ ID NO: 5591048 - DNA, 16 bp, Homo sapiens
ccagacccacctggag

SEQ ID NO: 5591049 - DNA, 20 bp, Homo sapiens
ccagacccactctgcggccc

SEQ ID NO: 5591050 - DNA, 15 bp, Homo sapiens
ccagacccagaggtc

SEQ ID NO: 5591051 - DNA, 18 bp, Homo sapiens
ccagacccagggcagtgt

SEQ ID NO: 5591052 - DNA, 9 bp, Homo sapiens
ccagacccc

SEQ ID NO: 5591053 - DNA, 13 bp, Homo sapiens
ccagaccccacag

SEQ ID NO: 5591054 - DNA, 12 bp, Homo sapiens
ccagaccccatc

SEQ ID NO: 5591055 - DNA, 15 bp, Homo sapiens
ccagaccccatccag

SEQ ID NO: 5591056 - DNA, 21 bp, Homo sapiens
ccagaccccatccagccaggg

SEQ ID NO: 5591057 - DNA, 16 bp, Homo sapiens
ccagacccccacccct

SEQ ID NO: 5591058 - DNA, 21 bp, Homo sapiens
ccagacccccaccccttcccc

SEQ ID NO: 5591059 - DNA, 19 bp, Homo sapiens
ccagacccccagcaaccct

SEQ ID NO: 5591060 - DNA, 14 bp, Homo sapiens
ccagaccccgtggc

SEQ ID NO: 5591061 - DNA, 19 bp, Homo sapiens
ccagaccccgtggctctgg

SEQ ID NO: 5591062 - DNA, 23 bp, Homo sapiens
ccagaccccgtggctctgggaga

SEQ ID NO: 5591063 - DNA, 12 bp, Homo sapiens
ccagacccctct

SEQ ID NO: 5591064 - DNA, 17 bp, Homo sapiens
ccagacccctctggcca

SEQ ID NO: 5591065 - DNA, 14 bp, Homo sapiens
ccagacccctggct

SEQ ID NO: 5591066 - DNA, 17 bp, Homo sapiens
ccagacccctggctttt

SEQ ID NO: 5591067 - DNA, 24 bp, Homo sapiens
ccagacccctggcttttcactgct

SEQ ID NO: 5591068 - DNA, 15 bp, Homo sapiens
ccagacccctgtggc

SEQ ID NO: 5591069 - DNA, 14 bp, Homo sapiens
ccagacccggctgc

SEQ ID NO: 5591070 - DNA, 15 bp, Homo sapiens
ccagacccggctgcg

SEQ ID NO: 5591071 - DNA, 16 bp, Homo sapiens
ccagaccctccttccc

SEQ ID NO: 5591072 - DNA, 13 bp, Homo sapiens
ccagaccctgaag

SEQ ID NO: 5591073 - DNA, 12 bp, Homo sapiens
ccagaccctgcc

SEQ ID NO: 5591074 - DNA, 13 bp, Homo sapiens
ccagaccctgcct

SEQ ID NO: 5591075 - DNA, 17 bp, Homo sapiens
ccagaccctgcctgagc

SEQ ID NO: 5591076 - DNA, 14 bp, Homo sapiens
ccagaccctgggca

SEQ ID NO: 5591077 - DNA, 23 bp, Homo sapiens
ccagacccttcttgcctgctggg

SEQ ID NO: 5591078 - DNA, 18 bp, Homo sapiens
ccagaccgatccttccca

SEQ ID NO: 5591079 - DNA, 13 bp, Homo sapiens
ccagacctagacc

SEQ ID NO: 5591080 - DNA, 16 bp, Homo sapiens
ccagacctagacctgg

SEQ ID NO: 5591081 - DNA, 18 bp, Homo sapiens
ccagacctagacctgggc

SEQ ID NO: 5591082 - DNA, 22 bp, Homo sapiens
ccagacctagcaggctgttcca

SEQ ID NO: 5591083 - DNA, 21 bp, Homo sapiens
ccagacctatatctggagtga

SEQ ID NO: 5591084 - DNA, 21 bp, Homo sapiens
ccagacctgaatgcttctgag

SEQ ID NO: 5591085 - DNA, 13 bp, Homo sapiens
ccagacctgaggc

SEQ ID NO: 5591086 - DNA, 14 bp, Homo sapiens
ccagacctgaggcg

SEQ ID NO: 5591087 - DNA, 16 bp, Homo sapiens
ccagacctgatcctgg

SEQ ID NO: 5591088 - DNA, 17 bp, Homo sapiens
ccagacctgatcctgga

SEQ ID NO: 5591089 - DNA, 19 bp, Homo sapiens
ccagacctgatcctggagg

SEQ ID NO: 5591090 - DNA, 20 bp, Homo sapiens
ccagacctgcagacgcccag

SEQ ID NO: 5591091 - DNA, 12 bp, Homo sapiens
ccagacctgcat

SEQ ID NO: 5591092 - DNA, 17 bp, Homo sapiens
ccagacctgcccctccc

SEQ ID NO: 5591093 - DNA, 12 bp, Homo sapiens
ccagacctgccg

SEQ ID NO: 5591094 - DNA, 14 bp, Homo sapiens
ccagacctgcctct

SEQ ID NO: 5591095 - DNA, 23 bp, Homo sapiens
ccagacctggcctctgccatcct

SEQ ID NO: 5591096 - DNA, 14 bp, Homo sapiens
ccagacctgggccc

SEQ ID NO: 5591097 - DNA, 21 bp, Homo sapiens
ccagacctgggccctggttcc

SEQ ID NO: 5591098 - DNA, 20 bp, Homo sapiens
ccagacctgttagcagacag

SEQ ID NO: 5591099 - DNA, 15 bp, Homo sapiens
ccagaccttctagga

SEQ ID NO: 5591100 - DNA, 19 bp, Homo sapiens
ccagaccttgttcacactc

SEQ ID NO: 5591101 - DNA, 21 bp, Homo sapiens
ccagacgcatagactgaggta

SEQ ID NO: 5591102 - DNA, 19 bp, Homo sapiens
ccagacgcctgatattgaa

SEQ ID NO: 5591103 - DNA, 20 bp, Homo sapiens
ccagacgctcattcagcatc

SEQ ID NO: 5591104 - DNA, 22 bp, Homo sapiens
ccagacgctcattcagcatctg

SEQ ID NO: 5591105 - DNA, 18 bp, Homo sapiens
ccagacgctgccgctgcc

SEQ ID NO: 5591106 - DNA, 20 bp, Homo sapiens
ccagacggctccactaggac

SEQ ID NO: 5591107 - DNA, 19 bp, Homo sapiens
ccagacggttcaccagcct

SEQ ID NO: 5591108 - DNA, 20 bp, Homo sapiens
ccagacggttcaccagcctc

SEQ ID NO: 5591109 - DNA, 17 bp, Homo sapiens
ccagacgtaggggaggg

SEQ ID NO: 5591110 - DNA, 21 bp, Homo sapiens
ccagacgtcaggccctgactc

SEQ ID NO: 5591111 - DNA, 16 bp, Homo sapiens
ccagacgtggtggctc

SEQ ID NO: 5591112 - DNA, 17 bp, Homo sapiens
ccagacgtggtggctca

SEQ ID NO: 5591113 - DNA, 22 bp, Homo sapiens
ccagacgtggtggctcacacct

SEQ ID NO: 5591114 - DNA, 22 bp, Homo sapiens
ccagactaaaggatccagagag

SEQ ID NO: 5591115 - DNA, 14 bp, Homo sapiens
ccagactacagggc

SEQ ID NO: 5591116 - DNA, 17 bp, Homo sapiens
ccagactactattttct

SEQ ID NO: 5591117 - DNA, 16 bp, Homo sapiens
ccagactacttgggag

SEQ ID NO: 5591118 - DNA, 18 bp, Homo sapiens
ccagactagatgtagtat

SEQ ID NO: 5591119 - DNA, 15 bp, Homo sapiens
ccagactatgcagct

SEQ ID NO: 5591120 - DNA, 17 bp, Homo sapiens
ccagactcagagctctc

SEQ ID NO: 5591121 - DNA, 22 bp, Homo sapiens
ccagactcagagctctctctac

SEQ ID NO: 5591122 - DNA, 14 bp, Homo sapiens
ccagactcaggttc

SEQ ID NO: 5591123 - DNA, 18 bp, Homo sapiens
ccagactcaggttccaga

SEQ ID NO: 5591124 - DNA, 12 bp, Homo sapiens
ccagactccagg

SEQ ID NO: 5591125 - DNA, 21 bp, Homo sapiens
ccagactcctgactgtctccc

SEQ ID NO: 5591126 - DNA, 17 bp, Homo sapiens
ccagactcctttcctct

SEQ ID NO: 5591127 - DNA, 17 bp, Homo sapiens
ccagactcgagagggct

SEQ ID NO: 5591128 - DNA, 20 bp, Homo sapiens
ccagactcgagagggctgag

SEQ ID NO: 5591129 - DNA, 22 bp, Homo sapiens
ccagactcgagagggctgagcc

SEQ ID NO: 5591130 - DNA, 23 bp, Homo sapiens
ccagactcgagagggctgagccc

SEQ ID NO: 5591131 - DNA, 15 bp, Homo sapiens
ccagactctaggtta

SEQ ID NO: 5591132 - DNA, 21 bp, Homo sapiens
ccagactctaggttatacaat

SEQ ID NO: 5591133 - DNA, 14 bp, Homo sapiens
ccagactctcaggt

SEQ ID NO: 5591134 - DNA, 12 bp, Homo sapiens
ccagactctgcc

SEQ ID NO: 5591135 - DNA, 12 bp, Homo sapiens
ccagactctggg

SEQ ID NO: 5591136 - DNA, 20 bp, Homo sapiens
ccagactgaaccagagctgg

SEQ ID NO: 5591137 - DNA, 18 bp, Homo sapiens
ccagactgagctctccag

SEQ ID NO: 5591138 - DNA, 20 bp, Homo sapiens
ccagactgagctctccaggc

SEQ ID NO: 5591139 - DNA, 21 bp, Homo sapiens
ccagactgagctctccaggcc

SEQ ID NO: 5591140 - DNA, 22 bp, Homo sapiens
ccagactgagctctccaggcca

SEQ ID NO: 5591141 - DNA, 23 bp, Homo sapiens
ccagactgagctctccaggccag

SEQ ID NO: 5591142 - DNA, 15 bp, Homo sapiens
ccagactgatgagca

SEQ ID NO: 5591143 - DNA, 12 bp, Homo sapiens
ccagactgcgga

SEQ ID NO: 5591144 - DNA, 15 bp, Homo sapiens
ccagactgcggagca

SEQ ID NO: 5591145 - DNA, 11 bp, Homo sapiens
ccagactggaa

SEQ ID NO: 5591146 - DNA, 17 bp, Homo sapiens
ccagactggaagacact

SEQ ID NO: 5591147 - DNA, 20 bp, Homo sapiens
ccagactggaagacacttca

SEQ ID NO: 5591148 - DNA, 18 bp, Homo sapiens
ccagactggagtgcagtg

SEQ ID NO: 5591149 - DNA, 20 bp, Homo sapiens
ccagcaaggggaccccgaga

SEQ ID NO: 5591150 - DNA, 16 bp, Homo sapiens
ccagcaaggtggagtg

SEQ ID NO: 5591151 - DNA, 23 bp, Homo sapiens
ccagcaagtccttaggctactgt

SEQ ID NO: 5591152 - DNA, 22 bp, Homo sapiens
ccagcaagtgagagctgggtgt

SEQ ID NO: 5591153 - DNA, 16 bp, Homo sapiens
ccagcaatgccctgcc

SEQ ID NO: 5591154 - DNA, 22 bp, Homo sapiens
ccagcaatgccctgccttgctg

SEQ ID NO: 5591155 - DNA, 17 bp, Homo sapiens
ccagcaatgcctgcctg

SEQ ID NO: 5591156 - DNA, 23 bp, Homo sapiens
ccagcaattacaacggagtcaaa

SEQ ID NO: 5591157 - DNA, 19 bp, Homo sapiens
ccagcaattctcctgcctc

SEQ ID NO: 5591158 - DNA, 20 bp, Homo sapiens
ccagcaattctcctgcctca

SEQ ID NO: 5591159 - DNA, 21 bp, Homo sapiens
ccagcaattctctttctttta

SEQ ID NO: 5591160 - DNA, 17 bp, Homo sapiens
ccagcacaaagcactgg

SEQ ID NO: 5591161 - DNA, 19 bp, Homo sapiens
ccagcacaccaagtggctg

SEQ ID NO: 5591162 - DNA, 15 bp, Homo sapiens
ccagcacactattta

SEQ ID NO: 5591163 - DNA, 17 bp, Homo sapiens
ccagcacactgcttctc

SEQ ID NO: 5591164 - DNA, 21 bp, Homo sapiens
ccagcacagagcgtccttccc

SEQ ID NO: 5591165 - DNA, 16 bp, Homo sapiens
ccagcacagccacctc

SEQ ID NO: 5591166 - DNA, 18 bp, Homo sapiens
ccagcacagccacctccg

SEQ ID NO: 5591167 - DNA, 22 bp, Homo sapiens
ccagcacagccacctccgccag

SEQ ID NO: 5591168 - DNA, 12 bp, Homo sapiens
ccagcacagctc

SEQ ID NO: 5591169 - DNA, 19 bp, Homo sapiens
ccagcacagctcctcccct

SEQ ID NO: 5591170 - DNA, 15 bp, Homo sapiens
ccagcacagctgagg

SEQ ID NO: 5591171 - DNA, 15 bp, Homo sapiens
ccagcacaggcacct

SEQ ID NO: 5591172 - DNA, 12 bp, Homo sapiens
ccagcacagggg

SEQ ID NO: 5591173 - DNA, 13 bp, Homo sapiens
ccagcacaggggc

SEQ ID NO: 5591174 - DNA, 20 bp, Homo sapiens
ccagcacaggggccccagat

SEQ ID NO: 5591175 - DNA, 19 bp, Homo sapiens
ccagcacatcgccagccct

SEQ ID NO: 5591176 - DNA, 23 bp, Homo sapiens
ccagcacatggccatagaggccc

SEQ ID NO: 5591177 - DNA, 14 bp, Homo sapiens
ccagcacatttcct

SEQ ID NO: 5591178 - DNA, 17 bp, Homo sapiens
ccagcaccaccaggtct

SEQ ID NO: 5591179 - DNA, 22 bp, Homo sapiens
ccagcacccagtcctctgcctc

SEQ ID NO: 5591180 - DNA, 23 bp, Homo sapiens
ccagcacccagtcctctgcctcc

SEQ ID NO: 5591181 - DNA, 15 bp, Homo sapiens
ccagcacccatgccc

SEQ ID NO: 5591182 - DNA, 22 bp, Homo sapiens
ccagcacccatgccccactctg

SEQ ID NO: 5591183 - DNA, 15 bp, Homo sapiens
ccagcacccccacgc

SEQ ID NO: 5591184 - DNA, 16 bp, Homo sapiens
ccagcacccccacgcc

SEQ ID NO: 5591185 - DNA, 18 bp, Homo sapiens
ccagcaccccctctcctg

SEQ ID NO: 5591186 - DNA, 19 bp, Homo sapiens
ccagcaccccctctcctgg

SEQ ID NO: 5591187 - DNA, 20 bp, Homo sapiens
ccagcaccccctctcctgga

SEQ ID NO: 5591188 - DNA, 23 bp, Homo sapiens
ccagcaccccctctcctggaggg

SEQ ID NO: 5591189 - DNA, 16 bp, Homo sapiens
ccagcaccctctcctg

SEQ ID NO: 5591190 - DNA, 19 bp, Homo sapiens
ccagcaccctctcctgggg

SEQ ID NO: 5591191 - DNA, 20 bp, Homo sapiens
ccagcaccctctcctggggg

SEQ ID NO: 5591192 - DNA, 18 bp, Homo sapiens
ccagcaccggaccagcct

SEQ ID NO: 5591193 - DNA, 19 bp, Homo sapiens
ccagcaccggaccagcctg

SEQ ID NO: 5591194 - DNA, 20 bp, Homo sapiens
ccagcaccggaccagcctgg

SEQ ID NO: 5591195 - DNA, 21 bp, Homo sapiens
ccagcaccggaccagcctggc

SEQ ID NO: 5591196 - DNA, 13 bp, Homo sapiens
ccagcacctcctc

SEQ ID NO: 5591197 - DNA, 19 bp, Homo sapiens
ccagcacctgccagggccc

SEQ ID NO: 5591198 - DNA, 20 bp, Homo sapiens
ccagcacctgccagggcccg

SEQ ID NO: 5591199 - DNA, 14 bp, Homo sapiens
ccagcacctgctcc

SEQ ID NO: 5591200 - DNA, 15 bp, Homo sapiens
ccagcacctgctccc

SEQ ID NO: 5591201 - DNA, 21 bp, Homo sapiens
ccagcaccttaggaggccgag

SEQ ID NO: 5591202 - DNA, 16 bp, Homo sapiens
ccagcaccttgtgcct

SEQ ID NO: 5591203 - DNA, 20 bp, Homo sapiens
ccagcaccttgtgcctgggg

SEQ ID NO: 5591204 - DNA, 15 bp, Homo sapiens
ccagcacctttgtaa

SEQ ID NO: 5591205 - DNA, 20 bp, Homo sapiens
ccagcacgcgacttctcagg

SEQ ID NO: 5591206 - DNA, 17 bp, Homo sapiens
ccagcacgttttctggc

SEQ ID NO: 5591207 - DNA, 19 bp, Homo sapiens
ccagcacgttttctggctt

SEQ ID NO: 5591208 - DNA, 23 bp, Homo sapiens
ccagcacgttttctggcttctgc

SEQ ID NO: 5591209 - DNA, 24 bp, Homo sapiens
ccagcactaaagcagtggacacca

SEQ ID NO: 5591210 - DNA, 20 bp, Homo sapiens
ccagcactaaggccgtgtct

SEQ ID NO: 5591211 - DNA, 19 bp, Homo sapiens
ccagcactagtaaaggagg

SEQ ID NO: 5591212 - DNA, 20 bp, Homo sapiens
ccagcactatgctttccttc

SEQ ID NO: 5591213 - DNA, 16 bp, Homo sapiens
ccagcactcaataaag

SEQ ID NO: 5591214 - DNA, 16 bp, Homo sapiens
ccagcactcagcctca

SEQ ID NO: 5591215 - DNA, 14 bp, Homo sapiens
ccagcactcccagg

SEQ ID NO: 5591216 - DNA, 15 bp, Homo sapiens
ccagcactcccaggg

SEQ ID NO: 5591217 - DNA, 17 bp, Homo sapiens
ccagcactcctctgtct

SEQ ID NO: 5591218 - DNA, 19 bp, Homo sapiens
ccagcactcctctgtctct

SEQ ID NO: 5591219 - DNA, 10 bp, Homo sapiens
ccagcactga

SEQ ID NO: 5591220 - DNA, 13 bp, Homo sapiens
ccagcactgaccc

SEQ ID NO: 5591221 - DNA, 15 bp, Homo sapiens
ccagcactgaggaag

SEQ ID NO: 5591222 - DNA, 15 bp, Homo sapiens
ccagcactgcccatc

SEQ ID NO: 5591223 - DNA, 17 bp, Homo sapiens
ccagcactgcctcctgt

SEQ ID NO: 5591224 - DNA, 21 bp, Homo sapiens
ccagcactgcctcctgttttc

SEQ ID NO: 5591225 - DNA, 19 bp, Homo sapiens
ccagcactgcttgaggaaa

SEQ ID NO: 5591226 - DNA, 18 bp, Homo sapiens
ccagcactgtgaagaccc

SEQ ID NO: 5591227 - DNA, 17 bp, Homo sapiens
ccagcacttcaggaggc

SEQ ID NO: 5591228 - DNA, 19 bp, Homo sapiens
ccagcacttgtccagctga

SEQ ID NO: 5591229 - DNA, 20 bp, Homo sapiens
ccagcacttgtccagctgag

SEQ ID NO: 5591230 - DNA, 21 bp, Homo sapiens
ccagcactttgagaggctgag

SEQ ID NO: 5591231 - DNA, 13 bp, Homo sapiens
ccagcactttggg

SEQ ID NO: 5591232 - DNA, 14 bp, Homo sapiens
ccagcactttggga

SEQ ID NO: 5591233 - DNA, 19 bp, Homo sapiens
ccagcactttgggaagctg

SEQ ID NO: 5591234 - DNA, 19 bp, Homo sapiens
ccagcactttgggaggcca

SEQ ID NO: 5591235 - DNA, 21 bp, Homo sapiens
ccagcactttgggaggccaag

SEQ ID NO: 5591236 - DNA, 21 bp, Homo sapiens
ccagcactttgggaggctgag

SEQ ID NO: 5591237 - DNA, 23 bp, Homo sapiens
ccagcactttgggaggctgaggc

SEQ ID NO: 5591238 - DNA, 12 bp, Homo sapiens
ccagcagaaaag

SEQ ID NO: 5591239 - DNA, 18 bp, Homo sapiens
ccagcagaaatgccccca

SEQ ID NO: 5591240 - DNA, 15 bp, Homo sapiens
ccagcagaagacaaa

SEQ ID NO: 5591241 - DNA, 17 bp, Homo sapiens
ccagcagaagccagagg

SEQ ID NO: 5591242 - DNA, 12 bp, Homo sapiens
ccagcagacaga

SEQ ID NO: 5591243 - DNA, 13 bp, Homo sapiens
ccagcagacagag

SEQ ID NO: 5591244 - DNA, 17 bp, Homo sapiens
ccagcagacagagccag

SEQ ID NO: 5591245 - DNA, 18 bp, Homo sapiens
ccagcagacagagccagg

SEQ ID NO: 5591246 - DNA, 20 bp, Homo sapiens
ccagcagacagagccaggag

SEQ ID NO: 5591247 - DNA, 22 bp, Homo sapiens
ccagcagacagagccaggagaa

SEQ ID NO: 5591248 - DNA, 12 bp, Homo sapiens
ccagcagacatt

SEQ ID NO: 5591249 - DNA, 16 bp, Homo sapiens
ccagcagacttgagtc

SEQ ID NO: 5591250 - DNA, 14 bp, Homo sapiens
ccagcagagccagg

SEQ ID NO: 5591251 - DNA, 18 bp, Homo sapiens
ccagcagagcccaccagc

SEQ ID NO: 5591252 - DNA, 12 bp, Homo sapiens
ccagcagagccg

SEQ ID NO: 5591253 - DNA, 19 bp, Homo sapiens
ccagcagagccgttcctgg

SEQ ID NO: 5591254 - DNA, 22 bp, Homo sapiens
ccagcagaggcaggctgggacg

SEQ ID NO: 5591255 - DNA, 15 bp, Homo sapiens
ccagcagaggtgatt

SEQ ID NO: 5591256 - DNA, 17 bp, Homo sapiens
ccagcagataaggccga

SEQ ID NO: 5591257 - DNA, 15 bp, Homo sapiens
ccagcagatcccagc

SEQ ID NO: 5591258 - DNA, 17 bp, Homo sapiens
ccagcagatcccagctc

SEQ ID NO: 5591259 - DNA, 21 bp, Homo sapiens
ccagcagcaactgaaaatgaa

SEQ ID NO: 5591260 - DNA, 16 bp, Homo sapiens
ccagcagcaatctgtc

SEQ ID NO: 5591261 - DNA, 18 bp, Homo sapiens
ccagcagcaatctgtctt

SEQ ID NO: 5591262 - DNA, 15 bp, Homo sapiens
ccagcagcacaattc

SEQ ID NO: 5591263 - DNA, 20 bp, Homo sapiens
ccagcagcacaattctgtcc

SEQ ID NO: 5591264 - DNA, 23 bp, Homo sapiens
ccagcagcacaattctgtccctg

SEQ ID NO: 5591265 - DNA, 24 bp, Homo sapiens
ccagcagcacaattctgtccctgt

SEQ ID NO: 5591266 - DNA, 15 bp, Homo sapiens
ccagcagcacacctc

SEQ ID NO: 5591267 - DNA, 17 bp, Homo sapiens
ccagcagcacacctcag

SEQ ID NO: 5591268 - DNA, 22 bp, Homo sapiens
ccagcagcacacctcagcccca

SEQ ID NO: 5591269 - DNA, 14 bp, Homo sapiens
ccagcagcactgga

SEQ ID NO: 5591270 - DNA, 17 bp, Homo sapiens
ccagcagcagaatggaa

SEQ ID NO: 5591271 - DNA, 12 bp, Homo sapiens
ccagcagcagca

SEQ ID NO: 5591272 - DNA, 14 bp, Homo sapiens
ccagcagcagcagg

SEQ ID NO: 5591273 - DNA, 18 bp, Homo sapiens
ccagcagcagcaggtgat

SEQ ID NO: 5591274 - DNA, 12 bp, Homo sapiens
ccagcagcagga

SEQ ID NO: 5591275 - DNA, 16 bp, Homo sapiens
ccagcagcaggatggg

SEQ ID NO: 5591276 - DNA, 20 bp, Homo sapiens
ccagcagcaggatgggctga

SEQ ID NO: 5591277 - DNA, 13 bp, Homo sapiens
ccagcagccagcc

SEQ ID NO: 5591278 - DNA, 20 bp, Homo sapiens
ccagcagccagctctcagcc

SEQ ID NO: 5591279 - DNA, 21 bp, Homo sapiens
ccagcagccagctctcagcca

SEQ ID NO: 5591280 - DNA, 21 bp, Homo sapiens
ccagcagccccgtctgcccac

SEQ ID NO: 5591281 - DNA, 23 bp, Homo sapiens
ccagcagccccgtctgcccacca

SEQ ID NO: 5591282 - DNA, 21 bp, Homo sapiens
ccagcagcccctgagagcctg

SEQ ID NO: 5591283 - DNA, 13 bp, Homo sapiens
ccagcagccctca

SEQ ID NO: 5591284 - DNA, 22 bp, Homo sapiens
ccagcagccctcaacaggccca

SEQ ID NO: 5591285 - DNA, 19 bp, Homo sapiens
ccagcagcccttgtttata

SEQ ID NO: 5591286 - DNA, 15 bp, Homo sapiens
ccagcagcctcgcac

SEQ ID NO: 5591287 - DNA, 22 bp, Homo sapiens
ccagcagcctcgcacaggccct

SEQ ID NO: 5591288 - DNA, 17 bp, Homo sapiens
ccagcagcctgccagca

SEQ ID NO: 5591289 - DNA, 20 bp, Homo sapiens
ccagcagcctggaccctgtg

SEQ ID NO: 5591290 - DNA, 14 bp, Homo sapiens
ccagcagccttcca

SEQ ID NO: 5591291 - DNA, 18 bp, Homo sapiens
ccagcagcgcgcaggcct

SEQ ID NO: 5591292 - DNA, 19 bp, Homo sapiens
ccagcagcgcgcaggcctg

SEQ ID NO: 5591293 - DNA, 22 bp, Homo sapiens
ccagcagcgcgcaggcctgcgt

SEQ ID NO: 5591294 - DNA, 24 bp, Homo sapiens
ccagcagcggaaccgcccaggatc

SEQ ID NO: 5591295 - DNA, 15 bp, Homo sapiens
ccagcagcggcccag

SEQ ID NO: 5591296 - DNA, 17 bp, Homo sapiens
ccagcagcggcccagat

SEQ ID NO: 5591297 - DNA, 23 bp, Homo sapiens
ccagcagcgggggcggcccagcc

SEQ ID NO: 5591298 - DNA, 19 bp, Homo sapiens
ccagcagcggtaccccagg

SEQ ID NO: 5591299 - DNA, 14 bp, Homo sapiens
ccagcagctcaaga

SEQ ID NO: 5591300 - DNA, 21 bp, Homo sapiens
ccagcagctgatgcctccttg

SEQ ID NO: 5591301 - DNA, 16 bp, Homo sapiens
ccagcagctgatgctg

SEQ ID NO: 5591302 - DNA, 13 bp, Homo sapiens
ccagcagctgcac

SEQ ID NO: 5591303 - DNA, 17 bp, Homo sapiens
ccagcagctgcacccca

SEQ ID NO: 5591304 - DNA, 12 bp, Homo sapiens
ccagcagctgcg

SEQ ID NO: 5591305 - DNA, 21 bp, Homo sapiens
ccagcagctgggccggccagc

SEQ ID NO: 5591306 - DNA, 14 bp, Homo sapiens
ccagcagctgtcag

SEQ ID NO: 5591307 - DNA, 15 bp, Homo sapiens
ccagcagctgtcaga

SEQ ID NO: 5591308 - DNA, 17 bp, Homo sapiens
ccagcagcttggctgag

SEQ ID NO: 5591309 - DNA, 18 bp, Homo sapiens
ccagcagcttggctgagc

SEQ ID NO: 5591310 - DNA, 22 bp, Homo sapiens
ccagcagcttggctgagccccc

SEQ ID NO: 5591311 - DNA, 22 bp, Homo sapiens
ccagcagctttagaatcccagc

SEQ ID NO: 5591312 - DNA, 12 bp, Homo sapiens
ccagcaggaggg

SEQ ID NO: 5591313 - DNA, 18 bp, Homo sapiens
ccagcaggagggaaggac

SEQ ID NO: 5591314 - DNA, 16 bp, Homo sapiens
ccagcaggagggacag

SEQ ID NO: 5591315 - DNA, 22 bp, Homo sapiens
ccagcaggaggttctgggcctc

SEQ ID NO: 5591316 - DNA, 23 bp, Homo sapiens
ccagcaggcagagtggcgtggcc

SEQ ID NO: 5591317 - DNA, 16 bp, Homo sapiens
ccagcaggcagcgcct

SEQ ID NO: 5591318 - DNA, 21 bp, Homo sapiens
ccagcaggcagcgcctgtccc

SEQ ID NO: 5591319 - DNA, 22 bp, Homo sapiens
ccagcaggcagcgcctgtcccc

SEQ ID NO: 5591320 - DNA, 15 bp, Homo sapiens
ccagcaggcccagca

SEQ ID NO: 5591321 - DNA, 17 bp, Homo sapiens
ccagcaggcccagcatg

SEQ ID NO: 5591322 - DNA, 18 bp, Homo sapiens
ccagcaggcgggctcctt

SEQ ID NO: 5591323 - DNA, 15 bp, Homo sapiens
ccagcaggctcctgg

SEQ ID NO: 5591324 - DNA, 19 bp, Homo sapiens
ccagcaggctcctggctgt

SEQ ID NO: 5591325 - DNA, 18 bp, Homo sapiens
ccagcctgggacacacac

SEQ ID NO: 5591326 - DNA, 19 bp, Homo sapiens
ccagcctgggacacacaca

SEQ ID NO: 5591327 - DNA, 19 bp, Homo sapiens
ccagcctgggcaacagagc

SEQ ID NO: 5591328 - DNA, 16 bp, Homo sapiens
ccagcctgggcagcca

SEQ ID NO: 5591329 - DNA, 22 bp, Homo sapiens
ccagcctgggcagccaggctgc

SEQ ID NO: 5591330 - DNA, 14 bp, Homo sapiens
ccagcctgggccca

SEQ ID NO: 5591331 - DNA, 18 bp, Homo sapiens
ccagcctgggcccatctc

SEQ ID NO: 5591332 - DNA, 13 bp, Homo sapiens
ccagcctgggcct

SEQ ID NO: 5591333 - DNA, 14 bp, Homo sapiens
ccagcctgggccta

SEQ ID NO: 5591334 - DNA, 21 bp, Homo sapiens
ccagcctgggcctatggagag

SEQ ID NO: 5591335 - DNA, 21 bp, Homo sapiens
ccagcctgggcgacagagcaa

SEQ ID NO: 5591336 - DNA, 15 bp, Homo sapiens
ccagcctgggctcct

SEQ ID NO: 5591337 - DNA, 23 bp, Homo sapiens
ccagcctgggctcctctgcatct

SEQ ID NO: 5591338 - DNA, 15 bp, Homo sapiens
ccagcctggggaccc

SEQ ID NO: 5591339 - DNA, 19 bp, Homo sapiens
ccagcctggggaccccact

SEQ ID NO: 5591340 - DNA, 12 bp, Homo sapiens
ccagcctggggc

SEQ ID NO: 5591341 - DNA, 19 bp, Homo sapiens
ccagcctggggcctggcag

SEQ ID NO: 5591342 - DNA, 20 bp, Homo sapiens
ccagcctggggcctggcagg

SEQ ID NO: 5591343 - DNA, 21 bp, Homo sapiens
ccagcctggggccttcctggc

SEQ ID NO: 5591344 - DNA, 14 bp, Homo sapiens
ccagcctggggctc

SEQ ID NO: 5591345 - DNA, 21 bp, Homo sapiens
ccagcctggggctccctctct

SEQ ID NO: 5591346 - DNA, 23 bp, Homo sapiens
ccagcctgggggacagagcaaga

SEQ ID NO: 5591347 - DNA, 17 bp, Homo sapiens
ccagcctgggggctggg

SEQ ID NO: 5591348 - DNA, 13 bp, Homo sapiens
ccagcctggggtc

SEQ ID NO: 5591349 - DNA, 12 bp, Homo sapiens
ccagcctgggtg

SEQ ID NO: 5591350 - DNA, 13 bp, Homo sapiens
ccagcctgggtga

SEQ ID NO: 5591351 - DNA, 16 bp, Homo sapiens
ccagcctgggtgacag

SEQ ID NO: 5591352 - DNA, 19 bp, Homo sapiens
ccagcctgggtgacagagc

SEQ ID NO: 5591353 - DNA, 16 bp, Homo sapiens
ccagcctggtggccca

SEQ ID NO: 5591354 - DNA, 18 bp, Homo sapiens
ccagcctggtggcccagc

SEQ ID NO: 5591355 - DNA, 19 bp, Homo sapiens
ccagcctggtggcccagct

SEQ ID NO: 5591356 - DNA, 18 bp, Homo sapiens
ccagcctgtaccttgctg

SEQ ID NO: 5591357 - DNA, 17 bp, Homo sapiens
ccagcctgtcacccagc

SEQ ID NO: 5591358 - DNA, 22 bp, Homo sapiens
ccagcctgtcccactggctcct

SEQ ID NO: 5591359 - DNA, 19 bp, Homo sapiens
ccagcctgtcccatggaca

SEQ ID NO: 5591360 - DNA, 23 bp, Homo sapiens
ccagcctgtcccatggacactcc

SEQ ID NO: 5591361 - DNA, 18 bp, Homo sapiens
ccagcctgtggcctcagc

SEQ ID NO: 5591362 - DNA, 20 bp, Homo sapiens
ccagcctgttggacccgctc

SEQ ID NO: 5591363 - DNA, 23 bp, Homo sapiens
ccagccttaatagacttctctta

SEQ ID NO: 5591364 - DNA, 13 bp, Homo sapiens
ccagccttccagg

SEQ ID NO: 5591365 - DNA, 15 bp, Homo sapiens
ccagccttcctctgc

SEQ ID NO: 5591366 - DNA, 20 bp, Homo sapiens
ccagccttcctctgcagctg

SEQ ID NO: 5591367 - DNA, 15 bp, Homo sapiens
ccagccttctctcaa

SEQ ID NO: 5591368 - DNA, 18 bp, Homo sapiens
ccagccttctctctctgg

SEQ ID NO: 5591369 - DNA, 18 bp, Homo sapiens
ccagccttcttccatccc

SEQ ID NO: 5591370 - DNA, 19 bp, Homo sapiens
ccagccttcttccatccca

SEQ ID NO: 5591371 - DNA, 18 bp, Homo sapiens
ccagccttctttgcttgc

SEQ ID NO: 5591372 - DNA, 20 bp, Homo sapiens
ccagccttgaactgtggcca

SEQ ID NO: 5591373 - DNA, 17 bp, Homo sapiens
ccagccttgagccctgg

SEQ ID NO: 5591374 - DNA, 15 bp, Homo sapiens
ccagccttgctctct

SEQ ID NO: 5591375 - DNA, 16 bp, Homo sapiens
ccagccttgctctctt

SEQ ID NO: 5591376 - DNA, 21 bp, Homo sapiens
ccagccttgctctcttcaata

SEQ ID NO: 5591377 - DNA, 23 bp, Homo sapiens
ccagccttgctctcttcaataaa

SEQ ID NO: 5591378 - DNA, 18 bp, Homo sapiens
ccagccttggcatctaga

SEQ ID NO: 5591379 - DNA, 20 bp, Homo sapiens
ccagccttggtgggggagcc

SEQ ID NO: 5591380 - DNA, 10 bp, Homo sapiens
ccagccttgt

SEQ ID NO: 5591381 - DNA, 23 bp, Homo sapiens
ccagccttgtacagtctgctcct

SEQ ID NO: 5591382 - DNA, 10 bp, Homo sapiens
ccagcctttc

SEQ ID NO: 5591383 - DNA, 14 bp, Homo sapiens
ccagcctttcttcc

SEQ ID NO: 5591384 - DNA, 16 bp, Homo sapiens
ccagcctttgctccct

SEQ ID NO: 5591385 - DNA, 18 bp, Homo sapiens
ccagcctttgctccctcc

SEQ ID NO: 5591386 - DNA, 20 bp, Homo sapiens
ccagcctttgggtcctgggc

SEQ ID NO: 5591387 - DNA, 23 bp, Homo sapiens
ccagcctttgttccccactggag

SEQ ID NO: 5591388 - DNA, 13 bp, Homo sapiens
ccagccttttgag

SEQ ID NO: 5591389 - DNA, 17 bp, Homo sapiens
ccagcgacctctctgcc

SEQ ID NO: 5591390 - DNA, 18 bp, Homo sapiens
ccagcgacctctctgcct

SEQ ID NO: 5591391 - DNA, 20 bp, Homo sapiens
ccagcgacctctctgcctct

SEQ ID NO: 5591392 - DNA, 15 bp, Homo sapiens
ccagcgagccacagg

SEQ ID NO: 5591393 - DNA, 16 bp, Homo sapiens
ccagcgagccacagga

SEQ ID NO: 5591394 - DNA, 13 bp, Homo sapiens
ccagcgagccctg

SEQ ID NO: 5591395 - DNA, 21 bp, Homo sapiens
ccagcgagccctggtggcagt

SEQ ID NO: 5591396 - DNA, 20 bp, Homo sapiens
ccagcgagtctggagaccag

SEQ ID NO: 5591397 - DNA, 20 bp, Homo sapiens
ccagcgatctctccactgtg

SEQ ID NO: 5591398 - DNA, 19 bp, Homo sapiens
ccagcgatggtgctgccca

SEQ ID NO: 5591399 - DNA, 23 bp, Homo sapiens
ccagcgattccctctcccaggcc

SEQ ID NO: 5591400 - DNA, 19 bp, Homo sapiens
ccagcgatttttgaggatt

SEQ ID NO: 5591401 - DNA, 15 bp, Homo sapiens
ccagcgcagagtagc

SEQ ID NO: 5591402 - DNA, 14 bp, Homo sapiens
ccagcgccagggcc

SEQ ID NO: 5591403 - DNA, 19 bp, Homo sapiens
ccagcgccagggcccaggc

SEQ ID NO: 5591404 - DNA, 18 bp, Homo sapiens
ccagcgcccccactcctc

SEQ ID NO: 5591405 - DNA, 22 bp, Homo sapiens
ccagcgcccccactcctcctcc

SEQ ID NO: 5591406 - DNA, 24 bp, Homo sapiens
ccagcgcccccactcctcctcctt

SEQ ID NO: 5591407 - DNA, 13 bp, Homo sapiens
ccagcgcccctca

SEQ ID NO: 5591408 - DNA, 14 bp, Homo sapiens
ccagcgcccgctgg

SEQ ID NO: 5591409 - DNA, 17 bp, Homo sapiens
ccagcgcccgctgggct

SEQ ID NO: 5591410 - DNA, 22 bp, Homo sapiens
ccagcgcccgctgggctgagcc

SEQ ID NO: 5591411 - DNA, 22 bp, Homo sapiens
ccagcgcctagtggggtctccc

SEQ ID NO: 5591412 - DNA, 13 bp, Homo sapiens
ccagcgcctccct

SEQ ID NO: 5591413 - DNA, 18 bp, Homo sapiens
ccagcgcctccctccacc

SEQ ID NO: 5591414 - DNA, 20 bp, Homo sapiens
ccagcgcctccctccacccc

SEQ ID NO: 5591415 - DNA, 13 bp, Homo sapiens
ccagcgcctgccc

SEQ ID NO: 5591416 - DNA, 14 bp, Homo sapiens
ccagcgcctgcccg

SEQ ID NO: 5591417 - DNA, 22 bp, Homo sapiens
ccagcgcctgccctccctgggg

SEQ ID NO: 5591418 - DNA, 15 bp, Homo sapiens
ccagcgcggacatcc

SEQ ID NO: 5591419 - DNA, 15 bp, Homo sapiens
ccagcgcggccagcg

SEQ ID NO: 5591420 - DNA, 16 bp, Homo sapiens
ccagcgcggccagcgt

SEQ ID NO: 5591421 - DNA, 17 bp, Homo sapiens
ccagcgcggccagcgtc

SEQ ID NO: 5591422 - DNA, 22 bp, Homo sapiens
ccagcgcggcttggccgccatc

SEQ ID NO: 5591423 - DNA, 14 bp, Homo sapiens
ccagcgctcgccac

SEQ ID NO: 5591424 - DNA, 18 bp, Homo sapiens
ccagcgctctcctggacg

SEQ ID NO: 5591425 - DNA, 20 bp, Homo sapiens
ccagcgctctcctggacgcc

SEQ ID NO: 5591426 - DNA, 13 bp, Homo sapiens
ccagcgctctgcc

SEQ ID NO: 5591427 - DNA, 16 bp, Homo sapiens
ccagcgctgaacagac

SEQ ID NO: 5591428 - DNA, 18 bp, Homo sapiens
ccagcgctgaacagaccg

SEQ ID NO: 5591429 - DNA, 23 bp, Homo sapiens
ccagcgctgaacagaccggggtg

SEQ ID NO: 5591430 - DNA, 15 bp, Homo sapiens
ccagcgctgctggtc

SEQ ID NO: 5591431 - DNA, 22 bp, Homo sapiens
ccagcgctggcccccccagccc

SEQ ID NO: 5591432 - DNA, 17 bp, Homo sapiens
ccagcgctggctccagg

SEQ ID NO: 5591433 - DNA, 15 bp, Homo sapiens
ccagcgcttctggtc

SEQ ID NO: 5591434 - DNA, 12 bp, Homo sapiens
ccagcggaaaca

SEQ ID NO: 5591435 - DNA, 16 bp, Homo sapiens
ccagcggacagtggca

SEQ ID NO: 5591436 - DNA, 17 bp, Homo sapiens
ccagcggacagtggcag

SEQ ID NO: 5591437 - DNA, 19 bp, Homo sapiens
ccagcggcagatgggcctg

SEQ ID NO: 5591438 - DNA, 16 bp, Homo sapiens
ccagcggcccaagagc

SEQ ID NO: 5591439 - DNA, 20 bp, Homo sapiens
ccagcggcccaagagcccgt

SEQ ID NO: 5591440 - DNA, 14 bp, Homo sapiens
ccagcggcccctcc

SEQ ID NO: 5591441 - DNA, 15 bp, Homo sapiens
ccagcggcccctccc

SEQ ID NO: 5591442 - DNA, 16 bp, Homo sapiens
ccagcggccctcccag

SEQ ID NO: 5591443 - DNA, 18 bp, Homo sapiens
ccagcggccctcccaggc

SEQ ID NO: 5591444 - DNA, 19 bp, Homo sapiens
ccagcggccctcccaggcg

SEQ ID NO: 5591445 - DNA, 23 bp, Homo sapiens
ccagcggcctcagggtctaagga

SEQ ID NO: 5591446 - DNA, 22 bp, Homo sapiens
ccagcggccttgaagaggcagg

SEQ ID NO: 5591447 - DNA, 17 bp, Homo sapiens
ccagcggctccaactcc

SEQ ID NO: 5591448 - DNA, 22 bp, Homo sapiens
ccagcggctcttcctggacagt

SEQ ID NO: 5591449 - DNA, 14 bp, Homo sapiens
ccagcggctgctca

SEQ ID NO: 5591450 - DNA, 15 bp, Homo sapiens
ccagcggcttagcca

SEQ ID NO: 5591451 - DNA, 19 bp, Homo sapiens
ccagcggcttagccaagcc

SEQ ID NO: 5591452 - DNA, 15 bp, Homo sapiens
ccagcgggcacaggg

SEQ ID NO: 5591453 - DNA, 12 bp, Homo sapiens
ccagcgggcaga

SEQ ID NO: 5591454 - DNA, 22 bp, Homo sapiens
ccagcgggcagatgggcggacg

SEQ ID NO: 5591455 - DNA, 19 bp, Homo sapiens
ccagcgggccctctgccga

SEQ ID NO: 5591456 - DNA, 19 bp, Homo sapiens
ccagcgggctggcgggcct

SEQ ID NO: 5591457 - DNA, 20 bp, Homo sapiens
ccagcggtccaatgccacct

SEQ ID NO: 5591458 - DNA, 19 bp, Homo sapiens
ccagcggtccatgggtctg

SEQ ID NO: 5591459 - DNA, 14 bp, Homo sapiens
ccagcggtccctgc

SEQ ID NO: 5591460 - DNA, 17 bp, Homo sapiens
ccagcggtttcctggtg

SEQ ID NO: 5591461 - DNA, 22 bp, Homo sapiens
ccagcgtatatataagaaagac

SEQ ID NO: 5591462 - DNA, 20 bp, Homo sapiens
ccagcgtcactccagtgctc

SEQ ID NO: 5591463 - DNA, 13 bp, Homo sapiens
ccagcgtcagaag

SEQ ID NO: 5591464 - DNA, 13 bp, Homo sapiens
ccagcgtcaggcc

SEQ ID NO: 5591465 - DNA, 20 bp, Homo sapiens
ccagcgtcaggcctacctca

SEQ ID NO: 5591466 - DNA, 19 bp, Homo sapiens
ccagcgtcagtttcactcc

SEQ ID NO: 5591467 - DNA, 17 bp, Homo sapiens
ccagcgtcccagggtac

SEQ ID NO: 5591468 - DNA, 18 bp, Homo sapiens
ccagcgtcccagggtacc

SEQ ID NO: 5591469 - DNA, 22 bp, Homo sapiens
ccagcgtcccagtctctggcag

SEQ ID NO: 5591470 - DNA, 15 bp, Homo sapiens
ccagcgtcccttggt

SEQ ID NO: 5591471 - DNA, 22 bp, Homo sapiens
ccagcgtcctcagcaccccact

SEQ ID NO: 5591472 - DNA, 19 bp, Homo sapiens
ccagcgtcctcctctgtga

SEQ ID NO: 5591473 - DNA, 20 bp, Homo sapiens
ccagcgtgacggagcccaca

SEQ ID NO: 5591474 - DNA, 20 bp, Homo sapiens
ccagcgtgcaccccgccgga

SEQ ID NO: 5591475 - DNA, 16 bp, Homo sapiens
ccagcgtggcccaggc

SEQ ID NO: 5591476 - DNA, 17 bp, Homo sapiens
ccagcgtggcccaggcc

SEQ ID NO: 5591477 - DNA, 18 bp, Homo sapiens
ccagcgtggcccaggccg

SEQ ID NO: 5591478 - DNA, 23 bp, Homo sapiens
ccagcgtggcgcagtggccctga

SEQ ID NO: 5591479 - DNA, 23 bp, Homo sapiens
ccagcgtggggctaacgggcgcc

SEQ ID NO: 5591480 - DNA, 13 bp, Homo sapiens
ccagcgtgggggt

SEQ ID NO: 5591481 - DNA, 21 bp, Homo sapiens
ccagcgtgggggtggccactc

SEQ ID NO: 5591482 - DNA, 23 bp, Homo sapiens
ccagcgtgggggtggccactcct

SEQ ID NO: 5591483 - DNA, 18 bp, Homo sapiens
ccagcgtgtggagcagag

SEQ ID NO: 5591484 - DNA, 19 bp, Homo sapiens
ccagcgtgtgtatccgact

SEQ ID NO: 5591485 - DNA, 22 bp, Homo sapiens
ccagcgttcccttctccccctt

SEQ ID NO: 5591486 - DNA, 14 bp, Homo sapiens
ccagcgttcttcag

SEQ ID NO: 5591487 - DNA, 21 bp, Homo sapiens
ccagcgttcttcaggagatga

SEQ ID NO: 5591488 - DNA, 13 bp, Homo sapiens
ccagcgtttattg

SEQ ID NO: 5591489 - DNA, 17 bp, Homo sapiens
ccagcgtttgaggggct

SEQ ID NO: 5591490 - DNA, 21 bp, Homo sapiens
ccagctaaacaccaacccctg

SEQ ID NO: 5591491 - DNA, 16 bp, Homo sapiens
ccagctaaagaggtgg

SEQ ID NO: 5591492 - DNA, 23 bp, Homo sapiens
ccagctaactccagtctcctgac

SEQ ID NO: 5591493 - DNA, 13 bp, Homo sapiens
ccagctaagaacc

SEQ ID NO: 5591494 - DNA, 21 bp, Homo sapiens
ccagctaaggacatttcccag

SEQ ID NO: 5591495 - DNA, 17 bp, Homo sapiens
ccagctacacctttctc

SEQ ID NO: 5591496 - DNA, 23 bp, Homo sapiens
ccagctacattcctcagctgcca

SEQ ID NO: 5591497 - DNA, 18 bp, Homo sapiens
ccagctaccccttctttg

SEQ ID NO: 5591498 - DNA, 23 bp, Homo sapiens
ccagctaccccttctttgcaggg

SEQ ID NO: 5591499 - DNA, 16 bp, Homo sapiens
ccagctaccctttttc

SEQ ID NO: 5591500 - DNA, 21 bp, Homo sapiens
ccagctaccctttttctccag

SEQ ID NO: 5591501 - DNA, 14 bp, Homo sapiens
ccagcttcacttct

SEQ ID NO: 5591502 - DNA, 16 bp, Homo sapiens
ccagcttcacttctga

SEQ ID NO: 5591503 - DNA, 13 bp, Homo sapiens
ccagcttcagctc

SEQ ID NO: 5591504 - DNA, 15 bp, Homo sapiens
ccagcttcagctcaa

SEQ ID NO: 5591505 - DNA, 15 bp, Homo sapiens
ccagcttcaggcacc

SEQ ID NO: 5591506 - DNA, 22 bp, Homo sapiens
ccagcttcaggcaccagcatcc

SEQ ID NO: 5591507 - DNA, 14 bp, Homo sapiens
ccagcttcaggtga

SEQ ID NO: 5591508 - DNA, 16 bp, Homo sapiens
ccagcttcaggtgacc

SEQ ID NO: 5591509 - DNA, 14 bp, Homo sapiens
ccagcttccagcag

SEQ ID NO: 5591510 - DNA, 16 bp, Homo sapiens
ccagcttcccctcact

SEQ ID NO: 5591511 - DNA, 19 bp, Homo sapiens
ccagcttcccctcgctgtc

SEQ ID NO: 5591512 - DNA, 13 bp, Homo sapiens
ccagcttcctggt

SEQ ID NO: 5591513 - DNA, 18 bp, Homo sapiens
ccagcttcctgtgcagaa

SEQ ID NO: 5591514 - DNA, 14 bp, Homo sapiens
ccagcttccttcag

SEQ ID NO: 5591515 - DNA, 15 bp, Homo sapiens
ccagcttccttcaga

SEQ ID NO: 5591516 - DNA, 15 bp, Homo sapiens
ccagcttcgtgctgg

SEQ ID NO: 5591517 - DNA, 23 bp, Homo sapiens
ccagcttctcagtttctgcctgg

SEQ ID NO: 5591518 - DNA, 16 bp, Homo sapiens
ccagcttctccaggct

SEQ ID NO: 5591519 - DNA, 17 bp, Homo sapiens
ccagcttctccaggctc

SEQ ID NO: 5591520 - DNA, 22 bp, Homo sapiens
ccagcttctcctgcgccccgcc

SEQ ID NO: 5591521 - DNA, 23 bp, Homo sapiens
ccagcttctcctgcgccccgccc

SEQ ID NO: 5591522 - DNA, 17 bp, Homo sapiens
ccagcttctctctccag

SEQ ID NO: 5591523 - DNA, 22 bp, Homo sapiens
ccagcttctctctccctgtcac

SEQ ID NO: 5591524 - DNA, 21 bp, Homo sapiens
ccagcttctggtactctccta

SEQ ID NO: 5591525 - DNA, 17 bp, Homo sapiens
ccagcttctttctcggt

SEQ ID NO: 5591526 - DNA, 14 bp, Homo sapiens
ccagcttctttgca

SEQ ID NO: 5591527 - DNA, 13 bp, Homo sapiens
ccagcttgccccc

SEQ ID NO: 5591528 - DNA, 23 bp, Homo sapiens
ccagcttgcctgtttcttctcta

SEQ ID NO: 5591529 - DNA, 23 bp, Homo sapiens
ccagcttgctcttcagtgggaga

SEQ ID NO: 5591530 - DNA, 22 bp, Homo sapiens
ccagcttgctgaggggcaggga

SEQ ID NO: 5591531 - DNA, 15 bp, Homo sapiens
ccagcttgcttctct

SEQ ID NO: 5591532 - DNA, 16 bp, Homo sapiens
ccagcttgcttctctg

SEQ ID NO: 5591533 - DNA, 16 bp, Homo sapiens
ccagcttggagtgcca

SEQ ID NO: 5591534 - DNA, 23 bp, Homo sapiens
ccagcttggctcacaaggcccag

SEQ ID NO: 5591535 - DNA, 14 bp, Homo sapiens
ccagcttggctcag

SEQ ID NO: 5591536 - DNA, 17 bp, Homo sapiens
ccagcttgggcagatct

SEQ ID NO: 5591537 - DNA, 19 bp, Homo sapiens
ccagcttgggcccagctgg

SEQ ID NO: 5591538 - DNA, 24 bp, Homo sapiens
ccagcttgggcccagctgggctct

SEQ ID NO: 5591539 - DNA, 19 bp, Homo sapiens
ccagcttggggccaccaaa

SEQ ID NO: 5591540 - DNA, 17 bp, Homo sapiens
ccagcttggttccagga

SEQ ID NO: 5591541 - DNA, 16 bp, Homo sapiens
ccagcttgtaggagct

SEQ ID NO: 5591542 - DNA, 22 bp, Homo sapiens
ccagcttgtggagccccacact

SEQ ID NO: 5591543 - DNA, 15 bp, Homo sapiens
ccagcttgttattta

SEQ ID NO: 5591544 - DNA, 17 bp, Homo sapiens
ccagcttgttctgggct

SEQ ID NO: 5591545 - DNA, 19 bp, Homo sapiens
ccagcttgttctgggctca

SEQ ID NO: 5591546 - DNA, 21 bp, Homo sapiens
ccagctttaagggttgtgagc

SEQ ID NO: 5591547 - DNA, 17 bp, Homo sapiens
ccagctttactgtggct

SEQ ID NO: 5591548 - DNA, 18 bp, Homo sapiens
ccagctttatctgtcaca

SEQ ID NO: 5591549 - DNA, 19 bp, Homo sapiens
ccagctttccatctgagga

SEQ ID NO: 5591550 - DNA, 12 bp, Homo sapiens
ccagctttccct

SEQ ID NO: 5591551 - DNA, 18 bp, Homo sapiens
ccagctttccctccccag

SEQ ID NO: 5591552 - DNA, 16 bp, Homo sapiens
ccagctttccttctgc

SEQ ID NO: 5591553 - DNA, 17 bp, Homo sapiens
ccagctttccttctgcc

SEQ ID NO: 5591554 - DNA, 19 bp, Homo sapiens
ccagctttgcccaacacca

SEQ ID NO: 5591555 - DNA, 16 bp, Homo sapiens
ccagcttttaaccatc

SEQ ID NO: 5591556 - DNA, 21 bp, Homo sapiens
ccagcttttaaccatctgata

SEQ ID NO: 5591557 - DNA, 23 bp, Homo sapiens
ccagcttttcccaaaagcccatt

SEQ ID NO: 5591558 - DNA, 19 bp, Homo sapiens
ccagcttttcttgccagct

SEQ ID NO: 5591559 - DNA, 20 bp, Homo sapiens
ccagcttttcttgccagctc

SEQ ID NO: 5591560 - DNA, 22 bp, Homo sapiens
ccagcttttcttgccagctcag

SEQ ID NO: 5591561 - DNA, 15 bp, Homo sapiens
ccaggaaaaaataaa

SEQ ID NO: 5591562 - DNA, 19 bp, Homo sapiens
ccaggaaaaaataaaaaga

SEQ ID NO: 5591563 - DNA, 20 bp, Homo sapiens
ccaggaaaaaataaaaagag

SEQ ID NO: 5591564 - DNA, 14 bp, Homo sapiens
ccaggaaaaagaac

SEQ ID NO: 5591565 - DNA, 16 bp, Homo sapiens
ccaggaaaagccattt

SEQ ID NO: 5591566 - DNA, 19 bp, Homo sapiens
ccaggaaactccacatctg

SEQ ID NO: 5591567 - DNA, 20 bp, Homo sapiens
ccaggaaactccacatctgc

SEQ ID NO: 5591568 - DNA, 23 bp, Homo sapiens
ccaggaaactccacatctgcctt

SEQ ID NO: 5591569 - DNA, 23 bp, Homo sapiens
ccaggaaactctgcattctagta

SEQ ID NO: 5591570 - DNA, 15 bp, Homo sapiens
ccaggaaactcttgc

SEQ ID NO: 5591571 - DNA, 16 bp, Homo sapiens
ccaggaaagagcagtc

SEQ ID NO: 5591572 - DNA, 23 bp, Homo sapiens
ccaggaaagagcagtcagagtcc

SEQ ID NO: 5591573 - DNA, 23 bp, Homo sapiens
ccaggaaagatgtcccacaggga

SEQ ID NO: 5591574 - DNA, 11 bp, Homo sapiens
ccaggaaagca

SEQ ID NO: 5591575 - DNA, 15 bp, Homo sapiens
ccaggaaagccacac

SEQ ID NO: 5591576 - DNA, 20 bp, Homo sapiens
ccaggaaagccacacggaga

SEQ ID NO: 5591577 - DNA, 20 bp, Homo sapiens
ccaggaaagcgcctccaacc

SEQ ID NO: 5591578 - DNA, 21 bp, Homo sapiens
ccaggaaaggacggctgagca

SEQ ID NO: 5591579 - DNA, 23 bp, Homo sapiens
ccaggaaaggacggctgagcatg

SEQ ID NO: 5591580 - DNA, 14 bp, Homo sapiens
ccaggaaaggagga

SEQ ID NO: 5591581 - DNA, 19 bp, Homo sapiens
ccaggaaaggattttataa

SEQ ID NO: 5591582 - DNA, 19 bp, Homo sapiens
ccaggaaaggctccaggag

SEQ ID NO: 5591583 - DNA, 20 bp, Homo sapiens
ccaggaaaggctccaggagc

SEQ ID NO: 5591584 - DNA, 21 bp, Homo sapiens
ccaggaaaggctccaggagca

SEQ ID NO: 5591585 - DNA, 13 bp, Homo sapiens
ccaggaaaggctt

SEQ ID NO: 5591586 - DNA, 15 bp, Homo sapiens
ccaggaaaggcttgg

SEQ ID NO: 5591587 - DNA, 19 bp, Homo sapiens
ccaggaaaggcttggctgg

SEQ ID NO: 5591588 - DNA, 22 bp, Homo sapiens
ccaggaaaggcttggctggtgt

SEQ ID NO: 5591589 - DNA, 21 bp, Homo sapiens
ccaggaacaatcgatggcctt

SEQ ID NO: 5591590 - DNA, 16 bp, Homo sapiens
ccaggaacacatgcac

SEQ ID NO: 5591591 - DNA, 21 bp, Homo sapiens
ccaggaacacatgcacacaca

SEQ ID NO: 5591592 - DNA, 11 bp, Homo sapiens
ccaggaacagg

SEQ ID NO: 5591593 - DNA, 14 bp, Homo sapiens
ccaggaacctcctc

SEQ ID NO: 5591594 - DNA, 19 bp, Homo sapiens
ccaggaacgctctcctcga

SEQ ID NO: 5591595 - DNA, 22 bp, Homo sapiens
ccaggaactcgcacctgtgctg

SEQ ID NO: 5591596 - DNA, 14 bp, Homo sapiens
ccaggaactgggcc

SEQ ID NO: 5591597 - DNA, 11 bp, Homo sapiens
ccaggaagaag

SEQ ID NO: 5591598 - DNA, 23 bp, Homo sapiens
ccaggaagaggggcgctgccccc

SEQ ID NO: 5591599 - DNA, 17 bp, Homo sapiens
ccaggaagatcccccag

SEQ ID NO: 5591600 - DNA, 18 bp, Homo sapiens
ccaggaagatcccccaga

SEQ ID NO: 5591601 - DNA, 13 bp, Homo sapiens
ccaggaagatgaa

SEQ ID NO: 5591602 - DNA, 17 bp, Homo sapiens
ccaggaagatgaatcct

SEQ ID NO: 5591603 - DNA, 20 bp, Homo sapiens
ccaggaagattttaaaggac

SEQ ID NO: 5591604 - DNA, 16 bp, Homo sapiens
ccaggaagcacaggcc

SEQ ID NO: 5591605 - DNA, 17 bp, Homo sapiens
ccaggaagcacaggcca

SEQ ID NO: 5591606 - DNA, 20 bp, Homo sapiens
ccaggaagcacaggccaggg

SEQ ID NO: 5591607 - DNA, 17 bp, Homo sapiens
ccaggaagcacaggtcc

SEQ ID NO: 5591608 - DNA, 13 bp, Homo sapiens
ccaggaagccaga

SEQ ID NO: 5591609 - DNA, 14 bp, Homo sapiens
ccaggaagccagag

SEQ ID NO: 5591610 - DNA, 13 bp, Homo sapiens
ccaggaagcccac

SEQ ID NO: 5591611 - DNA, 22 bp, Homo sapiens
ccaggaagcccacactatgcac

SEQ ID NO: 5591612 - DNA, 18 bp, Homo sapiens
ccaggaagccccgctcag

SEQ ID NO: 5591613 - DNA, 21 bp, Homo sapiens
ccaggaaggacagactggccg

SEQ ID NO: 5591614 - DNA, 13 bp, Homo sapiens
ccaggaaggcagc

SEQ ID NO: 5591615 - DNA, 15 bp, Homo sapiens
ccaggaaggcctagg

SEQ ID NO: 5591616 - DNA, 21 bp, Homo sapiens
ccaggaaggcctaggctagga

SEQ ID NO: 5591617 - DNA, 18 bp, Homo sapiens
ccaggaaggcggcaggca

SEQ ID NO: 5591618 - DNA, 20 bp, Homo sapiens
ccaggaagggaaagcgggca

SEQ ID NO: 5591619 - DNA, 16 bp, Homo sapiens
ccaggaagggagggag

SEQ ID NO: 5591620 - DNA, 19 bp, Homo sapiens
ccaggaagggagggagctg

SEQ ID NO: 5591621 - DNA, 20 bp, Homo sapiens
ccaggaagggagggagctga

SEQ ID NO: 5591622 - DNA, 14 bp, Homo sapiens
ccaggaagggtcaa

SEQ ID NO: 5591623 - DNA, 18 bp, Homo sapiens
ccaggaagtaattttctt

SEQ ID NO: 5591624 - DNA, 21 bp, Homo sapiens
ccaggaagtcatcctgcaatg

SEQ ID NO: 5591625 - DNA, 16 bp, Homo sapiens
ccaggaagtgtttatg

SEQ ID NO: 5591626 - DNA, 18 bp, Homo sapiens
ccaggaatagtggacatg

SEQ ID NO: 5591627 - DNA, 22 bp, Homo sapiens
ccaggaatagtggacatggtca

SEQ ID NO: 5591628 - DNA, 14 bp, Homo sapiens
ccaggaatattaag

SEQ ID NO: 5591629 - DNA, 20 bp, Homo sapiens
ccaggaatattgtcatcctt

SEQ ID NO: 5591630 - DNA, 23 bp, Homo sapiens
ccaggaatcggagcgaagcagag

SEQ ID NO: 5591631 - DNA, 16 bp, Homo sapiens
ccaggaatctgccatt

SEQ ID NO: 5591632 - DNA, 23 bp, Homo sapiens
ccaggaatgaaatatagatgtta

SEQ ID NO: 5591633 - DNA, 16 bp, Homo sapiens
ccaggaatgctgggcc

SEQ ID NO: 5591634 - DNA, 14 bp, Homo sapiens
ccaggaatgtttca

SEQ ID NO: 5591635 - DNA, 15 bp, Homo sapiens
ccaggaatgtttcag

SEQ ID NO: 5591636 - DNA, 20 bp, Homo sapiens
ccaggaatgtttcagctgca

SEQ ID NO: 5591637 - DNA, 21 bp, Homo sapiens
ccaggaatttcccaggaccct

SEQ ID NO: 5591638 - DNA, 23 bp, Homo sapiens
ccaggaatttgggaccctgcttt

SEQ ID NO: 5591639 - DNA, 17 bp, Homo sapiens
ccaggacaagcatggtc

SEQ ID NO: 5591640 - DNA, 23 bp, Homo sapiens
ccaggacaatgaaatactccagc

SEQ ID NO: 5591641 - DNA, 20 bp, Homo sapiens
ccaggacaccacacccagcc

SEQ ID NO: 5591642 - DNA, 23 bp, Homo sapiens
ccaggacaccacacccagcctca

SEQ ID NO: 5591643 - DNA, 14 bp, Homo sapiens
ccaggacaccgggc

SEQ ID NO: 5591644 - DNA, 13 bp, Homo sapiens
ccaggacacctgc

SEQ ID NO: 5591645 - DNA, 15 bp, Homo sapiens
ccaggacacctgccc

SEQ ID NO: 5591646 - DNA, 15 bp, Homo sapiens
ccaggacactgcctt

SEQ ID NO: 5591647 - DNA, 17 bp, Homo sapiens
ccaggacactgcctttg

SEQ ID NO: 5591648 - DNA, 19 bp, Homo sapiens
ccaggacactgcctttgct

SEQ ID NO: 5591649 - DNA, 23 bp, Homo sapiens
ccaggacactgcctttgctgcct

SEQ ID NO: 5591650 - DNA, 12 bp, Homo sapiens
ccaggacagcag

SEQ ID NO: 5591651 - DNA, 12 bp, Homo sapiens
ccaggacagctg

SEQ ID NO: 5591652 - DNA, 16 bp, Homo sapiens
ccaggacagctgcagg

SEQ ID NO: 5591653 - DNA, 17 bp, Homo sapiens
ccaggacagctggctgc

SEQ ID NO: 5591654 - DNA, 22 bp, Homo sapiens
ccaggacagctggctgctgaca

SEQ ID NO: 5591655 - DNA, 17 bp, Homo sapiens
ccaggacagctggttcg

SEQ ID NO: 5591656 - DNA, 17 bp, Homo sapiens
ccaggacaggatccagg

SEQ ID NO: 5591657 - DNA, 19 bp, Homo sapiens
ccaggacaggatccaggcc

SEQ ID NO: 5591658 - DNA, 15 bp, Homo sapiens
ccaggacaggcccgg

SEQ ID NO: 5591659 - DNA, 13 bp, Homo sapiens
ccaggacagttta

SEQ ID NO: 5591660 - DNA, 19 bp, Homo sapiens
ccaggacatctcctggcta

SEQ ID NO: 5591661 - DNA, 23 bp, Homo sapiens
ccaggacatgcaataaaatttaa

SEQ ID NO: 5591662 - DNA, 17 bp, Homo sapiens
ccaggaccacacagtcc

SEQ ID NO: 5591663 - DNA, 22 bp, Homo sapiens
ccaggaccacacagtccccaga

SEQ ID NO: 5591664 - DNA, 12 bp, Homo sapiens
ccaggaccacag

SEQ ID NO: 5591665 - DNA, 21 bp, Homo sapiens
ccaggaccacaggctcaggca

SEQ ID NO: 5591666 - DNA, 11 bp, Homo sapiens
ccaggaccagc

SEQ ID NO: 5591667 - DNA, 13 bp, Homo sapiens
ccaggaccagcct

SEQ ID NO: 5591668 - DNA, 18 bp, Homo sapiens
ccaggaccagcctgtacc

SEQ ID NO: 5591669 - DNA, 15 bp, Homo sapiens
ccaggaccagctcag

SEQ ID NO: 5591670 - DNA, 21 bp, Homo sapiens
ccaggaccatcctggagggct

SEQ ID NO: 5591671 - DNA, 13 bp, Homo sapiens
ccaggacccaggg

SEQ ID NO: 5591672 - DNA, 15 bp, Homo sapiens
ccaggacccagggag

SEQ ID NO: 5591673 - DNA, 16 bp, Homo sapiens
ccaggacccagggtcc

SEQ ID NO: 5591674 - DNA, 12 bp, Homo sapiens
ccaggaccccaa

SEQ ID NO: 5591675 - DNA, 15 bp, Homo sapiens
ccaggacccctcagc

SEQ ID NO: 5591676 - DNA, 17 bp, Homo sapiens
ccaggacccctgtccag

SEQ ID NO: 5591677 - DNA, 19 bp, Homo sapiens
ccaggacccctgtccagga

SEQ ID NO: 5591678 - DNA, 16 bp, Homo sapiens
ccaggcctccccagca

SEQ ID NO: 5591679 - DNA, 14 bp, Homo sapiens
ccaggcctcccgca

SEQ ID NO: 5591680 - DNA, 16 bp, Homo sapiens
ccaggcctcccgcatg

SEQ ID NO: 5591681 - DNA, 21 bp, Homo sapiens
ccaggcctcccgcatgctgcc

SEQ ID NO: 5591682 - DNA, 13 bp, Homo sapiens
ccaggcctccctc

SEQ ID NO: 5591683 - DNA, 15 bp, Homo sapiens
ccaggcctccctgca

SEQ ID NO: 5591684 - DNA, 16 bp, Homo sapiens
ccaggcctccctgcag

SEQ ID NO: 5591685 - DNA, 19 bp, Homo sapiens
ccaggcctccctgcagact

SEQ ID NO: 5591686 - DNA, 12 bp, Homo sapiens
ccaggcctccta

SEQ ID NO: 5591687 - DNA, 18 bp, Homo sapiens
ccaggcctcctacagctt

SEQ ID NO: 5591688 - DNA, 13 bp, Homo sapiens
ccaggcctcctag

SEQ ID NO: 5591689 - DNA, 14 bp, Homo sapiens
ccaggcctcctagg

SEQ ID NO: 5591690 - DNA, 19 bp, Homo sapiens
ccaggcctcctaggggaag

SEQ ID NO: 5591691 - DNA, 13 bp, Homo sapiens
ccaggcctcgcct

SEQ ID NO: 5591692 - DNA, 14 bp, Homo sapiens
ccaggcctcgcctg

SEQ ID NO: 5591693 - DNA, 23 bp, Homo sapiens
ccaggcctcgcctgccctcctct

SEQ ID NO: 5591694 - DNA, 21 bp, Homo sapiens
ccaggcctctagttccagaag

SEQ ID NO: 5591695 - DNA, 14 bp, Homo sapiens
ccaggcctctgccc

SEQ ID NO: 5591696 - DNA, 16 bp, Homo sapiens
ccaggcctctgctgcc

SEQ ID NO: 5591697 - DNA, 16 bp, Homo sapiens
ccaggcctctgtgtcc

SEQ ID NO: 5591698 - DNA, 17 bp, Homo sapiens
ccaggcctgaggctgct

SEQ ID NO: 5591699 - DNA, 20 bp, Homo sapiens
ccaggcctgaggctgctgac

SEQ ID NO: 5591700 - DNA, 19 bp, Homo sapiens
ccaggcctgatcttgcctg

SEQ ID NO: 5591701 - DNA, 24 bp, Homo sapiens
ccaggcctgattcactggcctggc

SEQ ID NO: 5591702 - DNA, 14 bp, Homo sapiens
ccaggcctgcagca

SEQ ID NO: 5591703 - DNA, 16 bp, Homo sapiens
ccaggcctgcagcagg

SEQ ID NO: 5591704 - DNA, 16 bp, Homo sapiens
ccaggcctgcaggggc

SEQ ID NO: 5591705 - DNA, 11 bp, Homo sapiens
ccaggcctgcc

SEQ ID NO: 5591706 - DNA, 12 bp, Homo sapiens
ccaggcctgcca

SEQ ID NO: 5591707 - DNA, 14 bp, Homo sapiens
ccaggcctgccagc

SEQ ID NO: 5591708 - DNA, 17 bp, Homo sapiens
ccaggcctgccagcccc

SEQ ID NO: 5591709 - DNA, 14 bp, Homo sapiens
ccaggcctgccctg

SEQ ID NO: 5591710 - DNA, 17 bp, Homo sapiens
ccaggcctgccctgcta

SEQ ID NO: 5591711 - DNA, 12 bp, Homo sapiens
ccaggcctgcct

SEQ ID NO: 5591712 - DNA, 16 bp, Homo sapiens
ccaggcctgctggcat

SEQ ID NO: 5591713 - DNA, 18 bp, Homo sapiens
ccaggcctgctggcatca

SEQ ID NO: 5591714 - DNA, 20 bp, Homo sapiens
ccaggcctgctggcatcagg

SEQ ID NO: 5591715 - DNA, 10 bp, Homo sapiens
ccaggcctgg

SEQ ID NO: 5591716 - DNA, 15 bp, Homo sapiens
ccaggcctggacggg

SEQ ID NO: 5591717 - DNA, 12 bp, Homo sapiens
ccaggcctggag

SEQ ID NO: 5591718 - DNA, 22 bp, Homo sapiens
ccaggcctggcctcgcctgcct

SEQ ID NO: 5591719 - DNA, 19 bp, Homo sapiens
ccaggcctggcctctgggc

SEQ ID NO: 5591720 - DNA, 17 bp, Homo sapiens
ccaggcctggctccccg

SEQ ID NO: 5591721 - DNA, 19 bp, Homo sapiens
ccaggcctggctccccgag

SEQ ID NO: 5591722 - DNA, 16 bp, Homo sapiens
ccaggcctgggatgca

SEQ ID NO: 5591723 - DNA, 18 bp, Homo sapiens
ccaggcctgggatgcagt

SEQ ID NO: 5591724 - DNA, 13 bp, Homo sapiens
ccaggcctgggcc

SEQ ID NO: 5591725 - DNA, 19 bp, Homo sapiens
ccaggcctgggtcacgctc

SEQ ID NO: 5591726 - DNA, 20 bp, Homo sapiens
ccaggcctgggtcacgctca

SEQ ID NO: 5591727 - DNA, 16 bp, Homo sapiens
ccaggcctgggtctgt

SEQ ID NO: 5591728 - DNA, 22 bp, Homo sapiens
ccaggcctgtcaagagggagga

SEQ ID NO: 5591729 - DNA, 20 bp, Homo sapiens
ccaggccttacatctggctg

SEQ ID NO: 5591730 - DNA, 11 bp, Homo sapiens
ccaggccttgc

SEQ ID NO: 5591731 - DNA, 19 bp, Homo sapiens
ccaggcgccccttccccct

SEQ ID NO: 5591732 - DNA, 15 bp, Homo sapiens
ccaggcgcctgcgct

SEQ ID NO: 5591733 - DNA, 16 bp, Homo sapiens
ccaggcgctagcacag

SEQ ID NO: 5591734 - DNA, 17 bp, Homo sapiens
ccaggcgctgcatacag

SEQ ID NO: 5591735 - DNA, 23 bp, Homo sapiens
ccaggcgctgcatacaggggagg

SEQ ID NO: 5591736 - DNA, 19 bp, Homo sapiens
ccaggcggaggggcttgga

SEQ ID NO: 5591737 - DNA, 20 bp, Homo sapiens
ccaggcggaggggcttggag

SEQ ID NO: 5591738 - DNA, 13 bp, Homo sapiens
ccaggcggccctg

SEQ ID NO: 5591739 - DNA, 15 bp, Homo sapiens
ccaggcggccctggg

SEQ ID NO: 5591740 - DNA, 15 bp, Homo sapiens
ccaggcgggcggcac

SEQ ID NO: 5591741 - DNA, 17 bp, Homo sapiens
ccaggcgggctcaagga

SEQ ID NO: 5591742 - DNA, 18 bp, Homo sapiens
ccaggcgggctcaaggaa

SEQ ID NO: 5591743 - DNA, 23 bp, Homo sapiens
ccaggcggggcgccccaagagcc

SEQ ID NO: 5591744 - DNA, 17 bp, Homo sapiens
ccaggcggtcactgccc

SEQ ID NO: 5591745 - DNA, 18 bp, Homo sapiens
ccaggcggtttcacgccc

SEQ ID NO: 5591746 - DNA, 16 bp, Homo sapiens
ccaggcgtagggccag

SEQ ID NO: 5591747 - DNA, 17 bp, Homo sapiens
ccaggcgtagggccagg

SEQ ID NO: 5591748 - DNA, 18 bp, Homo sapiens
ccaggcgttggtgccact

SEQ ID NO: 5591749 - DNA, 21 bp, Homo sapiens
ccaggctagactaggaggttc

SEQ ID NO: 5591750 - DNA, 18 bp, Homo sapiens
ccaggctagctggagcct

SEQ ID NO: 5591751 - DNA, 18 bp, Homo sapiens
ccaggctatggttgccac

SEQ ID NO: 5591752 - DNA, 20 bp, Homo sapiens
ccaggctatggttgccaccc

SEQ ID NO: 5591753 - DNA, 23 bp, Homo sapiens
ccaggctatggttgccaccccaa

SEQ ID NO: 5591754 - DNA, 22 bp, Homo sapiens
ccaggctattcggcaaggaagt

SEQ ID NO: 5591755 - DNA, 19 bp, Homo sapiens
ccaggctcacaactgtttt

SEQ ID NO: 5591756 - DNA, 22 bp, Homo sapiens
ccaggctcacctttagaacagg

SEQ ID NO: 5591757 - DNA, 21 bp, Homo sapiens
ccaggctcaggctgcccagcg

SEQ ID NO: 5591758 - DNA, 11 bp, Homo sapiens
ccaggctccaa

SEQ ID NO: 5591759 - DNA, 14 bp, Homo sapiens
ccaggctccaatgg

SEQ ID NO: 5591760 - DNA, 13 bp, Homo sapiens
ccaggctccagca

SEQ ID NO: 5591761 - DNA, 17 bp, Homo sapiens
ccaggctccagcacatc

SEQ ID NO: 5591762 - DNA, 16 bp, Homo sapiens
ccaggctccaggctga

SEQ ID NO: 5591763 - DNA, 20 bp, Homo sapiens
ccaggctccaggctgactgg

SEQ ID NO: 5591764 - DNA, 13 bp, Homo sapiens
ccaggctccatgg

SEQ ID NO: 5591765 - DNA, 19 bp, Homo sapiens
ccaggctccatggggaagt

SEQ ID NO: 5591766 - DNA, 13 bp, Homo sapiens
ccaggctcccagc

SEQ ID NO: 5591767 - DNA, 22 bp, Homo sapiens
ccaggctcccgaccccatccac

SEQ ID NO: 5591768 - DNA, 15 bp, Homo sapiens
ccaggctccctgacc

SEQ ID NO: 5591769 - DNA, 14 bp, Homo sapiens
ccaggctccgccct

SEQ ID NO: 5591770 - DNA, 18 bp, Homo sapiens
ccaggctccgcccttagt

SEQ ID NO: 5591771 - DNA, 20 bp, Homo sapiens
ccaggctcctttagcgccca

SEQ ID NO: 5591772 - DNA, 20 bp, Homo sapiens
ccaggctcgtggactgagtg

SEQ ID NO: 5591773 - DNA, 12 bp, Homo sapiens
ccaggctctccc

SEQ ID NO: 5591774 - DNA, 14 bp, Homo sapiens
ccaggctctccctc

SEQ ID NO: 5591775 - DNA, 21 bp, Homo sapiens
ccaggctctcgctgccctgtg

SEQ ID NO: 5591776 - DNA, 17 bp, Homo sapiens
ccaggctctgcctggag

SEQ ID NO: 5591777 - DNA, 22 bp, Homo sapiens
ccaggctctgcctggaggatcc

SEQ ID NO: 5591778 - DNA, 13 bp, Homo sapiens
ccaggctctgctg

SEQ ID NO: 5591779 - DNA, 21 bp, Homo sapiens
ccaggctctgggaaggggtgc

SEQ ID NO: 5591780 - DNA, 16 bp, Homo sapiens
ccaggctctgggcaca

SEQ ID NO: 5591781 - DNA, 17 bp, Homo sapiens
ccaggctctgggcacag

SEQ ID NO: 5591782 - DNA, 20 bp, Homo sapiens
ccaggctctgggcacagtgc

SEQ ID NO: 5591783 - DNA, 22 bp, Homo sapiens
ccaggctctgggcacagtgctg

SEQ ID NO: 5591784 - DNA, 13 bp, Homo sapiens
ccaggctctgtgc

SEQ ID NO: 5591785 - DNA, 19 bp, Homo sapiens
ccaggctctgtgctgaccc

SEQ ID NO: 5591786 - DNA, 12 bp, Homo sapiens
ccaggctcttcc

SEQ ID NO: 5591787 - DNA, 14 bp, Homo sapiens
ccaggctcttcctg

SEQ ID NO: 5591788 - DNA, 20 bp, Homo sapiens
ccaggctcttcctggacctg

SEQ ID NO: 5591789 - DNA, 23 bp, Homo sapiens
ccaggctctttggggtcagccag

SEQ ID NO: 5591790 - DNA, 19 bp, Homo sapiens
ccaggctgaattacagtga

SEQ ID NO: 5591791 - DNA, 15 bp, Homo sapiens
ccaggctgaccacag

SEQ ID NO: 5591792 - DNA, 16 bp, Homo sapiens
ccaggctgaccacagc

SEQ ID NO: 5591793 - DNA, 20 bp, Homo sapiens
ccaggctgaccacagcacag

SEQ ID NO: 5591794 - DNA, 22 bp, Homo sapiens
ccaggctgactgggggcctctg

SEQ ID NO: 5591795 - DNA, 21 bp, Homo sapiens
ccaggctgagccatgaggagc

SEQ ID NO: 5591796 - DNA, 14 bp, Homo sapiens
ccaggctgagcctc

SEQ ID NO: 5591797 - DNA, 19 bp, Homo sapiens
ccaggctgagcctcagtct

SEQ ID NO: 5591798 - DNA, 17 bp, Homo sapiens
ccaggctgagtgagcca

SEQ ID NO: 5591799 - DNA, 21 bp, Homo sapiens
ccaggctgagtgagccacaga

SEQ ID NO: 5591800 - DNA, 13 bp, Homo sapiens
ccaggctgatgct

SEQ ID NO: 5591801 - DNA, 13 bp, Homo sapiens
ccaggctgcactg

SEQ ID NO: 5591802 - DNA, 21 bp, Homo sapiens
ccaggctgcagatgatcaggg

SEQ ID NO: 5591803 - DNA, 16 bp, Homo sapiens
ccaggctgcagcctcc

SEQ ID NO: 5591804 - DNA, 17 bp, Homo sapiens
ccaggctgcagcctcca

SEQ ID NO: 5591805 - DNA, 12 bp, Homo sapiens
ccaggctgcagg

SEQ ID NO: 5591806 - DNA, 15 bp, Homo sapiens
ccaggctgcagggac

SEQ ID NO: 5591807 - DNA, 18 bp, Homo sapiens
ccaggctgcatagaagga

SEQ ID NO: 5591808 - DNA, 10 bp, Homo sapiens
ccaggctgcc

SEQ ID NO: 5591809 - DNA, 19 bp, Homo sapiens
ccaggctgccaaggccaga

SEQ ID NO: 5591810 - DNA, 13 bp, Homo sapiens
ccaggctgcccac

SEQ ID NO: 5591811 - DNA, 16 bp, Homo sapiens
ccaggctgcccagagc

SEQ ID NO: 5591812 - DNA, 19 bp, Homo sapiens
ccaggctgcccagagctgc

SEQ ID NO: 5591813 - DNA, 15 bp, Homo sapiens
ccaggctgccgtggg

SEQ ID NO: 5591814 - DNA, 16 bp, Homo sapiens
ccaggctgcctcctgc

SEQ ID NO: 5591815 - DNA, 15 bp, Homo sapiens
ccaggctgcctcgga

SEQ ID NO: 5591816 - DNA, 15 bp, Homo sapiens
ccaggctgcctgagc

SEQ ID NO: 5591817 - DNA, 17 bp, Homo sapiens
ccaggctgcctgagcac

SEQ ID NO: 5591818 - DNA, 14 bp, Homo sapiens
ccaggctgcgcctg

SEQ ID NO: 5591819 - DNA, 15 bp, Homo sapiens
ccaggctgcgcctgc

SEQ ID NO: 5591820 - DNA, 21 bp, Homo sapiens
ccaggctgcgtccctccgagc

SEQ ID NO: 5591821 - DNA, 17 bp, Homo sapiens
ccaggctgctcagggct

SEQ ID NO: 5591822 - DNA, 14 bp, Homo sapiens
ccaggctgctctca

SEQ ID NO: 5591823 - DNA, 23 bp, Homo sapiens
ccaggctgctctcaaacccctga

SEQ ID NO: 5591824 - DNA, 21 bp, Homo sapiens
ccaggctgctcttgaactcct

SEQ ID NO: 5591825 - DNA, 21 bp, Homo sapiens
ccaggctgctcttgaattcct

SEQ ID NO: 5591826 - DNA, 13 bp, Homo sapiens
ccaggctggaagt

SEQ ID NO: 5591827 - DNA, 17 bp, Homo sapiens
ccaggctggacaccctc

SEQ ID NO: 5591828 - DNA, 22 bp, Homo sapiens
ccaggctggacaccctctgccg

SEQ ID NO: 5591829 - DNA, 18 bp, Homo sapiens
ccaggctggactgcagtg

SEQ ID NO: 5591830 - DNA, 22 bp, Homo sapiens
ccaggctggactgcagtggcct

SEQ ID NO: 5591831 - DNA, 15 bp, Homo sapiens
ccaggctggagaccc

SEQ ID NO: 5591832 - DNA, 12 bp, Homo sapiens
ccaggctggagt

SEQ ID NO: 5591833 - DNA, 16 bp, Homo sapiens
ccaggctggagtgcag

SEQ ID NO: 5591834 - DNA, 18 bp, Homo sapiens
ccaggctggagtgcagtg

SEQ ID NO: 5591835 - DNA, 12 bp, Homo sapiens
ccaggctggcca

SEQ ID NO: 5591836 - DNA, 14 bp, Homo sapiens
ccaggctggccagc

SEQ ID NO: 5591837 - DNA, 15 bp, Homo sapiens
ccaggctggccagcc

SEQ ID NO: 5591838 - DNA, 16 bp, Homo sapiens
ccaggctggccagccc

SEQ ID NO: 5591839 - DNA, 21 bp, Homo sapiens
ccaggctggccagccccacag

SEQ ID NO: 5591840 - DNA, 22 bp, Homo sapiens
ccaggctggccagccccacagc

SEQ ID NO: 5591841 - DNA, 16 bp, Homo sapiens
ccaggctggcccccac

SEQ ID NO: 5591842 - DNA, 17 bp, Homo sapiens
ccaggctggcccccacc

SEQ ID NO: 5591843 - DNA, 23 bp, Homo sapiens
ccaggctggcgcagccaaggccg

SEQ ID NO: 5591844 - DNA, 16 bp, Homo sapiens
ccaggctggcgtgcag

SEQ ID NO: 5591845 - DNA, 17 bp, Homo sapiens
ccaggctggcgtgcagt

SEQ ID NO: 5591846 - DNA, 16 bp, Homo sapiens
ccaggctggcttgccc

SEQ ID NO: 5591847 - DNA, 22 bp, Homo sapiens
ccaggctgggagagccttccag

SEQ ID NO: 5591848 - DNA, 16 bp, Homo sapiens
ccaggctgggaggctc

SEQ ID NO: 5591849 - DNA, 17 bp, Homo sapiens
ccaggctgggaggctcg

SEQ ID NO: 5591850 - DNA, 13 bp, Homo sapiens
ccaggctgggcac

SEQ ID NO: 5591851 - DNA, 14 bp, Homo sapiens
ccaggctgggctct

SEQ ID NO: 5591852 - DNA, 16 bp, Homo sapiens
ccaggctgggctgagc

SEQ ID NO: 5591853 - DNA, 16 bp, Homo sapiens
ccaggctggggcctgg

SEQ ID NO: 5591854 - DNA, 24 bp, Homo sapiens
ccaggctgggtcgccctggactgt

SEQ ID NO: 5591855 - DNA, 20 bp, Homo sapiens
ccaggctggtccgagctgag

SEQ ID NO: 5591856 - DNA, 22 bp, Homo sapiens
ccaggctggtccgagctgagga

SEQ ID NO: 5591857 - DNA, 14 bp, Homo sapiens
ccaggtgccttgga

SEQ ID NO: 5591858 - DNA, 15 bp, Homo sapiens
ccaggtgcggcctgg

SEQ ID NO: 5591859 - DNA, 16 bp, Homo sapiens
ccaggtgcggcctggg

SEQ ID NO: 5591860 - DNA, 21 bp, Homo sapiens
ccaggtgcgtgtgtctctgtc

SEQ ID NO: 5591861 - DNA, 20 bp, Homo sapiens
ccaggtgctagggtgcctgc

SEQ ID NO: 5591862 - DNA, 14 bp, Homo sapiens
ccaggtgctcagcc

SEQ ID NO: 5591863 - DNA, 15 bp, Homo sapiens
ccaggtgctcattgt

SEQ ID NO: 5591864 - DNA, 15 bp, Homo sapiens
ccaggtgctggaggc

SEQ ID NO: 5591865 - DNA, 16 bp, Homo sapiens
ccaggtgctggaggca

SEQ ID NO: 5591866 - DNA, 15 bp, Homo sapiens
ccaggtggaattact

SEQ ID NO: 5591867 - DNA, 17 bp, Homo sapiens
ccaggtggagggcacag

SEQ ID NO: 5591868 - DNA, 20 bp, Homo sapiens
ccaggtggagggcacagccc

SEQ ID NO: 5591869 - DNA, 22 bp, Homo sapiens
ccaggtggagggtttgcactcc

SEQ ID NO: 5591870 - DNA, 17 bp, Homo sapiens
ccaggtggaggtgccag

SEQ ID NO: 5591871 - DNA, 19 bp, Homo sapiens
ccaggtggaggtgccagga

SEQ ID NO: 5591872 - DNA, 17 bp, Homo sapiens
ccaggtggcaaagtact

SEQ ID NO: 5591873 - DNA, 15 bp, Homo sapiens
ccaggtggcacctgc

SEQ ID NO: 5591874 - DNA, 13 bp, Homo sapiens
ccaggtggcagga

SEQ ID NO: 5591875 - DNA, 21 bp, Homo sapiens
ccaggtggccactccagaccc

SEQ ID NO: 5591876 - DNA, 13 bp, Homo sapiens
ccaggtggcctgc

SEQ ID NO: 5591877 - DNA, 16 bp, Homo sapiens
ccaggtggctattttg

SEQ ID NO: 5591878 - DNA, 18 bp, Homo sapiens
ccaggtgggaacggctga

SEQ ID NO: 5591879 - DNA, 13 bp, Homo sapiens
ccaggtgggagag

SEQ ID NO: 5591880 - DNA, 13 bp, Homo sapiens
ccaggtgggagcg

SEQ ID NO: 5591881 - DNA, 19 bp, Homo sapiens
ccaggtgggcgggcagcac

SEQ ID NO: 5591882 - DNA, 20 bp, Homo sapiens
ccaggtggggtgaggcagtg

SEQ ID NO: 5591883 - DNA, 23 bp, Homo sapiens
ccaggtggggtgaggcagtgggt

SEQ ID NO: 5591884 - DNA, 20 bp, Homo sapiens
ccaggtggggtttcctgcat

SEQ ID NO: 5591885 - DNA, 23 bp, Homo sapiens
ccaggtgtgcacgtggcatgtgg

SEQ ID NO: 5591886 - DNA, 17 bp, Homo sapiens
ccaggtgtgcccctcca

SEQ ID NO: 5591887 - DNA, 20 bp, Homo sapiens
ccaggtgtgcccctccaagt

SEQ ID NO: 5591888 - DNA, 14 bp, Homo sapiens
ccaggtgtgcctgg

SEQ ID NO: 5591889 - DNA, 16 bp, Homo sapiens
ccaggtgtgcctgtgc

SEQ ID NO: 5591890 - DNA, 17 bp, Homo sapiens
ccaggtgtgcctgtgct

SEQ ID NO: 5591891 - DNA, 18 bp, Homo sapiens
ccaggtgtgcctgtgctc

SEQ ID NO: 5591892 - DNA, 21 bp, Homo sapiens
ccaggtgtgcctgtgctcctg

SEQ ID NO: 5591893 - DNA, 24 bp, Homo sapiens
ccaggtgtgcctgtgctcctgccc

SEQ ID NO: 5591894 - DNA, 13 bp, Homo sapiens
ccaggtgtgtgct

SEQ ID NO: 5591895 - DNA, 19 bp, Homo sapiens
ccaggtgttaacattccaa

SEQ ID NO: 5591896 - DNA, 17 bp, Homo sapiens
ccaggtgttactgtaat

SEQ ID NO: 5591897 - DNA, 18 bp, Homo sapiens
ccaggtgttgccatttct

SEQ ID NO: 5591898 - DNA, 20 bp, Homo sapiens
ccaggtgttgttgagggcat

SEQ ID NO: 5591899 - DNA, 19 bp, Homo sapiens
ccaggtgtttgtggggctg

SEQ ID NO: 5591900 - DNA, 13 bp, Homo sapiens
ccaggttaaaatt

SEQ ID NO: 5591901 - DNA, 21 bp, Homo sapiens
ccaggttaaaattttaatttc

SEQ ID NO: 5591902 - DNA, 17 bp, Homo sapiens
ccaggttaggaaggcag

SEQ ID NO: 5591903 - DNA, 20 bp, Homo sapiens
ccaggttcaacccacagcta

SEQ ID NO: 5591904 - DNA, 20 bp, Homo sapiens
ccaggttcaagcgattctcc

SEQ ID NO: 5591905 - DNA, 21 bp, Homo sapiens
ccaggttcacactcagaaaga

SEQ ID NO: 5591906 - DNA, 13 bp, Homo sapiens
ccaggttcactta

SEQ ID NO: 5591907 - DNA, 18 bp, Homo sapiens
ccaggttccatccaccac

SEQ ID NO: 5591908 - DNA, 19 bp, Homo sapiens
ccaggttcccccagcaagc

SEQ ID NO: 5591909 - DNA, 13 bp, Homo sapiens
ccaggttcctcaa

SEQ ID NO: 5591910 - DNA, 22 bp, Homo sapiens
ccaggttcctgtactactgcct

SEQ ID NO: 5591911 - DNA, 15 bp, Homo sapiens
ccaggttctatttgg

SEQ ID NO: 5591912 - DNA, 23 bp, Homo sapiens
ccaggttctccgttagctcctgt

SEQ ID NO: 5591913 - DNA, 16 bp, Homo sapiens
ccaggttgactaagaa

SEQ ID NO: 5591914 - DNA, 13 bp, Homo sapiens
ccaggttgcagct

SEQ ID NO: 5591915 - DNA, 14 bp, Homo sapiens
ccaggttgcagctg

SEQ ID NO: 5591916 - DNA, 16 bp, Homo sapiens
ccaggttgcagctgct

SEQ ID NO: 5591917 - DNA, 19 bp, Homo sapiens
ccaggttgcagctgctctt

SEQ ID NO: 5591918 - DNA, 18 bp, Homo sapiens
ccaggttgcctcaacagc

SEQ ID NO: 5591919 - DNA, 19 bp, Homo sapiens
ccaggttgcctcaacagca

SEQ ID NO: 5591920 - DNA, 21 bp, Homo sapiens
ccaggttggaggccctaggcg

SEQ ID NO: 5591921 - DNA, 17 bp, Homo sapiens
ccaggttggcctggtgg

SEQ ID NO: 5591922 - DNA, 14 bp, Homo sapiens
ccaggttggctctg

SEQ ID NO: 5591923 - DNA, 21 bp, Homo sapiens
ccaggttgggaacatgctgga

SEQ ID NO: 5591924 - DNA, 17 bp, Homo sapiens
ccaggttgtcactgaga

SEQ ID NO: 5591925 - DNA, 19 bp, Homo sapiens
ccaggtttaagtagatttc

SEQ ID NO: 5591926 - DNA, 16 bp, Homo sapiens
ccaggtttcttctctg

SEQ ID NO: 5591927 - DNA, 17 bp, Homo sapiens
ccaggtttcttctctgg

SEQ ID NO: 5591928 - DNA, 17 bp, Homo sapiens
ccaggtttgcaggagcc

SEQ ID NO: 5591929 - DNA, 15 bp, Homo sapiens
ccaggtttgctgtgt

SEQ ID NO: 5591930 - DNA, 16 bp, Homo sapiens
ccaggtttgctgtgtc

SEQ ID NO: 5591931 - DNA, 17 bp, Homo sapiens
ccaggttttctgctctg

SEQ ID NO: 5591932 - DNA, 16 bp, Homo sapiens
ccaggttttctgggtg

SEQ ID NO: 5591933 - DNA, 19 bp, Homo sapiens
ccaggttttctgggtgtcc

SEQ ID NO: 5591934 - DNA, 20 bp, Homo sapiens
ccaggttttctgggtgtcca

SEQ ID NO: 5591935 - DNA, 23 bp, Homo sapiens
ccaggttttgcactcttgtttct

SEQ ID NO: 5591936 - DNA, 23 bp, Homo sapiens
ccaggttttgttccgcccagtgg

SEQ ID NO: 5591937 - DNA, 14 bp, Homo sapiens
ccaggtttttcaat

SEQ ID NO: 5591938 - DNA, 15 bp, Homo sapiens
ccaggtttttcaatt

SEQ ID NO: 5591939 - DNA, 20 bp, Homo sapiens
ccaggtttttcaattaaacg

SEQ ID NO: 5591940 - DNA, 23 bp, Homo sapiens
ccaggtttttcaattaaacggat

SEQ ID NO: 5591941 - DNA, 22 bp, Homo sapiens
ccagtaaaatactattgcctca

SEQ ID NO: 5591942 - DNA, 11 bp, Homo sapiens
ccagtaaaatt

SEQ ID NO: 5591943 - DNA, 13 bp, Homo sapiens
ccagtaaaattgc

SEQ ID NO: 5591944 - DNA, 17 bp, Homo sapiens
ccagtaaaattgccata

SEQ ID NO: 5591945 - DNA, 14 bp, Homo sapiens
ccagtaaaatttca

SEQ ID NO: 5591946 - DNA, 19 bp, Homo sapiens
ccagtaaaatttcaggatt

SEQ ID NO: 5591947 - DNA, 12 bp, Homo sapiens
ccagtaaacaga

SEQ ID NO: 5591948 - DNA, 22 bp, Homo sapiens
ccagtaaatgggggtgcatttg

SEQ ID NO: 5591949 - DNA, 23 bp, Homo sapiens
ccagtaaatgggggtgcatttga

SEQ ID NO: 5591950 - DNA, 15 bp, Homo sapiens
ccagtaacaggctca

SEQ ID NO: 5591951 - DNA, 16 bp, Homo sapiens
ccagtaacaggctcaa

SEQ ID NO: 5591952 - DNA, 16 bp, Homo sapiens
ccagtaacctcggaga

SEQ ID NO: 5591953 - DNA, 23 bp, Homo sapiens
ccagtaactgtgctgtactgagc

SEQ ID NO: 5591954 - DNA, 19 bp, Homo sapiens
ccagtaacttttttgtgta

SEQ ID NO: 5591955 - DNA, 22 bp, Homo sapiens
ccagtaacttttttgtgtatgt

SEQ ID NO: 5591956 - DNA, 16 bp, Homo sapiens
ccagtaagatcactgt

SEQ ID NO: 5591957 - DNA, 21 bp, Homo sapiens
ccagtaagatcactgtttaga

SEQ ID NO: 5591958 - DNA, 19 bp, Homo sapiens
ccagtaagtgataaatcta

SEQ ID NO: 5591959 - DNA, 18 bp, Homo sapiens
ccagtaataaaaagccac

SEQ ID NO: 5591960 - DNA, 19 bp, Homo sapiens
ccagtaataaaaagccacc

SEQ ID NO: 5591961 - DNA, 22 bp, Homo sapiens
ccagtaataaaaagccaccaca

SEQ ID NO: 5591962 - DNA, 17 bp, Homo sapiens
ccagtacaagatctcag

SEQ ID NO: 5591963 - DNA, 15 bp, Homo sapiens
ccagtacattctcag

SEQ ID NO: 5591964 - DNA, 20 bp, Homo sapiens
ccagtacctcctgtctctgg

SEQ ID NO: 5591965 - DNA, 18 bp, Homo sapiens
ccagtaccttctgccaga

SEQ ID NO: 5591966 - DNA, 16 bp, Homo sapiens
ccagtacctttgtcac

SEQ ID NO: 5591967 - DNA, 19 bp, Homo sapiens
ccagtacgtcccgctgctg

SEQ ID NO: 5591968 - DNA, 14 bp, Homo sapiens
ccagtactggagct

SEQ ID NO: 5591969 - DNA, 17 bp, Homo sapiens
ccagtactttggaaagc

SEQ ID NO: 5591970 - DNA, 22 bp, Homo sapiens
ccagtagaccttgttacttctg

SEQ ID NO: 5591971 - DNA, 11 bp, Homo sapiens
ccagtagagaa

SEQ ID NO: 5591972 - DNA, 15 bp, Homo sapiens
ccagtagcaggcccg

SEQ ID NO: 5591973 - DNA, 21 bp, Homo sapiens
ccagtagctacggttccctgc

SEQ ID NO: 5591974 - DNA, 19 bp, Homo sapiens
ccagtagctccgcgtgtct

SEQ ID NO: 5591975 - DNA, 22 bp, Homo sapiens
ccagtagctccgcgtgtctcat

SEQ ID NO: 5591976 - DNA, 22 bp, Homo sapiens
ccagtagctgccaaaaagaaca

SEQ ID NO: 5591977 - DNA, 14 bp, Homo sapiens
ccagtagctgggat

SEQ ID NO: 5591978 - DNA, 19 bp, Homo sapiens
ccagtagctgggattacag

SEQ ID NO: 5591979 - DNA, 19 bp, Homo sapiens
ccagtaggaaatcaggcag

SEQ ID NO: 5591980 - DNA, 20 bp, Homo sapiens
ccagtaggggcttataataa

SEQ ID NO: 5591981 - DNA, 19 bp, Homo sapiens
ccagtaggttgaggacagg

SEQ ID NO: 5591982 - DNA, 16 bp, Homo sapiens
ccagtagtaccttgtt

SEQ ID NO: 5591983 - DNA, 13 bp, Homo sapiens
ccagtagtcagaa

SEQ ID NO: 5591984 - DNA, 21 bp, Homo sapiens
ccagtataaaattacagtgga

SEQ ID NO: 5591985 - DNA, 19 bp, Homo sapiens
ccagtataaattacatgca

SEQ ID NO: 5591986 - DNA, 17 bp, Homo sapiens
ccagtatacaagataag

SEQ ID NO: 5591987 - DNA, 14 bp, Homo sapiens
ccagtatacctcat

SEQ ID NO: 5591988 - DNA, 15 bp, Homo sapiens
ccagtatacctcatt

SEQ ID NO: 5591989 - DNA, 23 bp, Homo sapiens
ccagtatacctcatttttcatac

SEQ ID NO: 5591990 - DNA, 13 bp, Homo sapiens
ccagtatcgctca

SEQ ID NO: 5591991 - DNA, 20 bp, Homo sapiens
ccagtatctcttcagtctct

SEQ ID NO: 5591992 - DNA, 13 bp, Homo sapiens
ccagtatgacaga

SEQ ID NO: 5591993 - DNA, 15 bp, Homo sapiens
ccagtatgagcccta

SEQ ID NO: 5591994 - DNA, 17 bp, Homo sapiens
ccagtatgttttaacaa

SEQ ID NO: 5591995 - DNA, 17 bp, Homo sapiens
ccagtattactgctgct

SEQ ID NO: 5591996 - DNA, 18 bp, Homo sapiens
ccagtattactgctgctg

SEQ ID NO: 5591997 - DNA, 20 bp, Homo sapiens
ccagtattactgctgctgtg

SEQ ID NO: 5591998 - DNA, 14 bp, Homo sapiens
ccagtattagactg

SEQ ID NO: 5591999 - DNA, 22 bp, Homo sapiens
ccagtattctaaagttttgcaa

SEQ ID NO: 5592000 - DNA, 16 bp, Homo sapiens
ccagtattctcagagc

SEQ ID NO: 5592001 - DNA, 21 bp, Homo sapiens
ccagtattctcagagcatgtg

SEQ ID NO: 5592002 - DNA, 12 bp, Homo sapiens
ccagtattcttg

SEQ ID NO: 5592003 - DNA, 17 bp, Homo sapiens
ccagtattgaaaacttc

SEQ ID NO: 5592004 - DNA, 19 bp, Homo sapiens
ccagtattgaaaacttcaa

SEQ ID NO: 5592005 - DNA, 14 bp, Homo sapiens
ccagtattgccccc

SEQ ID NO: 5592006 - DNA, 17 bp, Homo sapiens
ccagtatttaacttctg

SEQ ID NO: 5592007 - DNA, 22 bp, Homo sapiens
ccagtatttaacttctgaggaa

SEQ ID NO: 5592008 - DNA, 17 bp, Homo sapiens
ccagtatttagaagcca

SEQ ID NO: 5592009 - DNA, 14 bp, Homo sapiens
ccagtattttaaaa

SEQ ID NO: 5592010 - DNA, 14 bp, Homo sapiens
ccagtatttttaaa

SEQ ID NO: 5592011 - DNA, 22 bp, Homo sapiens
ccagtatttttatacggaaaaa

SEQ ID NO: 5592012 - DNA, 14 bp, Homo sapiens
ccagtcaacctggg

SEQ ID NO: 5592013 - DNA, 22 bp, Homo sapiens
ccagtcaacggggggctcctgc

SEQ ID NO: 5592014 - DNA, 16 bp, Homo sapiens
ccagtcaagaagaaaa

SEQ ID NO: 5592015 - DNA, 16 bp, Homo sapiens
ccagtcaagctcctag

SEQ ID NO: 5592016 - DNA, 20 bp, Homo sapiens
ccagtcaagttccctcctgc

SEQ ID NO: 5592017 - DNA, 14 bp, Homo sapiens
ccagtcacactccc

SEQ ID NO: 5592018 - DNA, 15 bp, Homo sapiens
ccagtcacactgtgg

SEQ ID NO: 5592019 - DNA, 18 bp, Homo sapiens
ccagtcacagccatttca

SEQ ID NO: 5592020 - DNA, 17 bp, Homo sapiens
ccagtcacattgccatc

SEQ ID NO: 5592021 - DNA, 13 bp, Homo sapiens
ccagtcaccccgg

SEQ ID NO: 5592022 - DNA, 18 bp, Homo sapiens
ccagtcacctcctgctcc

SEQ ID NO: 5592023 - DNA, 19 bp, Homo sapiens
ccagtcaccttctgggcaa

SEQ ID NO: 5592024 - DNA, 17 bp, Homo sapiens
ccagtcactgctgcaag

SEQ ID NO: 5592025 - DNA, 19 bp, Homo sapiens
ccagtcagacgccaggcac

SEQ ID NO: 5592026 - DNA, 14 bp, Homo sapiens
ccagtcagcctctc

SEQ ID NO: 5592027 - DNA, 22 bp, Homo sapiens
ccagtcagcctctctcccagtc

SEQ ID NO: 5592028 - DNA, 19 bp, Homo sapiens
ccagtcagcctggctgggc

SEQ ID NO: 5592029 - DNA, 15 bp, Homo sapiens
ccagtcaggatgagg

SEQ ID NO: 5592030 - DNA, 20 bp, Homo sapiens
ccagtcaggatgaggccccg

SEQ ID NO: 5592031 - DNA, 15 bp, Homo sapiens
ccagtcaggcccagg

SEQ ID NO: 5592032 - DNA, 18 bp, Homo sapiens
ccagtcatcatctcttga

SEQ ID NO: 5592033 - DNA, 22 bp, Homo sapiens
ccagtcatcctgccctgcagca

SEQ ID NO: 5592034 - DNA, 14 bp, Homo sapiens
ccagtgatggcatt

SEQ ID NO: 5592035 - DNA, 19 bp, Homo sapiens
ccagtgatggcattactct

SEQ ID NO: 5592036 - DNA, 18 bp, Homo sapiens
ccagtgatgtgctggagc

SEQ ID NO: 5592037 - DNA, 20 bp, Homo sapiens
ccagtgatgtgctggagctg

SEQ ID NO: 5592038 - DNA, 14 bp, Homo sapiens
ccagtgcaaatgca

SEQ ID NO: 5592039 - DNA, 17 bp, Homo sapiens
ccagtgcaaatgcatgc

SEQ ID NO: 5592040 - DNA, 14 bp, Homo sapiens
ccagtgcaacagca

SEQ ID NO: 5592041 - DNA, 19 bp, Homo sapiens
ccagtgcaatctgtccaga

SEQ ID NO: 5592042 - DNA, 20 bp, Homo sapiens
ccagtgcaatctgtccagac

SEQ ID NO: 5592043 - DNA, 20 bp, Homo sapiens
ccagtgcacagggaagggct

SEQ ID NO: 5592044 - DNA, 14 bp, Homo sapiens
ccagtgcacccact

SEQ ID NO: 5592045 - DNA, 20 bp, Homo sapiens
ccagtgcacctccctcccca

SEQ ID NO: 5592046 - DNA, 21 bp, Homo sapiens
ccagtgcactccggtcccaaa

SEQ ID NO: 5592047 - DNA, 14 bp, Homo sapiens
ccagtgcactgaaa

SEQ ID NO: 5592048 - DNA, 16 bp, Homo sapiens
ccagtgcacttgctgg

SEQ ID NO: 5592049 - DNA, 12 bp, Homo sapiens
ccagtgcagaaa

SEQ ID NO: 5592050 - DNA, 15 bp, Homo sapiens
ccagtgcaggctggc

SEQ ID NO: 5592051 - DNA, 24 bp, Homo sapiens
ccagtgcaggtatttcagaaggag

SEQ ID NO: 5592052 - DNA, 18 bp, Homo sapiens
ccagtgcagtttctaagc

SEQ ID NO: 5592053 - DNA, 19 bp, Homo sapiens
ccagtgcatcacatctgca

SEQ ID NO: 5592054 - DNA, 18 bp, Homo sapiens
ccagtgcatggtggccag

SEQ ID NO: 5592055 - DNA, 19 bp, Homo sapiens
ccagtgcatggtggccaga

SEQ ID NO: 5592056 - DNA, 13 bp, Homo sapiens
ccagtgccaagga

SEQ ID NO: 5592057 - DNA, 14 bp, Homo sapiens
ccagtgccaaggac

SEQ ID NO: 5592058 - DNA, 14 bp, Homo sapiens
ccagtgccacagag

SEQ ID NO: 5592059 - DNA, 17 bp, Homo sapiens
ccagtgccactgccccc

SEQ ID NO: 5592060 - DNA, 14 bp, Homo sapiens
ccagtgccagctcc

SEQ ID NO: 5592061 - DNA, 16 bp, Homo sapiens
ccagtgccagctccag

SEQ ID NO: 5592062 - DNA, 17 bp, Homo sapiens
ccagtgccagctggtga

SEQ ID NO: 5592063 - DNA, 13 bp, Homo sapiens
ccagtgccaggac

SEQ ID NO: 5592064 - DNA, 15 bp, Homo sapiens
ccagtgccaggacag

SEQ ID NO: 5592065 - DNA, 17 bp, Homo sapiens
ccagtgccaggacagct

SEQ ID NO: 5592066 - DNA, 20 bp, Homo sapiens
ccagtgccaggacagctggc

SEQ ID NO: 5592067 - DNA, 23 bp, Homo sapiens
ccagtgccagggtgggctgggga

SEQ ID NO: 5592068 - DNA, 14 bp, Homo sapiens
ccagtgccattcca

SEQ ID NO: 5592069 - DNA, 22 bp, Homo sapiens
ccagtgcccaaagtctgtgtga

SEQ ID NO: 5592070 - DNA, 13 bp, Homo sapiens
ccagtgcccattc

SEQ ID NO: 5592071 - DNA, 18 bp, Homo sapiens
ccagtgcccccactgacc

SEQ ID NO: 5592072 - DNA, 13 bp, Homo sapiens
ccagtgccccctg

SEQ ID NO: 5592073 - DNA, 20 bp, Homo sapiens
ccagtgcccggtgcagggcc

SEQ ID NO: 5592074 - DNA, 23 bp, Homo sapiens
ccagtgccctctcccctcagcct

SEQ ID NO: 5592075 - DNA, 18 bp, Homo sapiens
ccagtgccctgagccagg

SEQ ID NO: 5592076 - DNA, 15 bp, Homo sapiens
ccagtgccctggggc

SEQ ID NO: 5592077 - DNA, 13 bp, Homo sapiens
ccagtgccgagga

SEQ ID NO: 5592078 - DNA, 16 bp, Homo sapiens
ccagtgccgaggacat

SEQ ID NO: 5592079 - DNA, 15 bp, Homo sapiens
ccagtgccgctcctg

SEQ ID NO: 5592080 - DNA, 20 bp, Homo sapiens
ccagtgccgctcctgcttcc

SEQ ID NO: 5592081 - DNA, 14 bp, Homo sapiens
ccagtgcctacatc

SEQ ID NO: 5592082 - DNA, 19 bp, Homo sapiens
ccagtgcctcaccttccaa

SEQ ID NO: 5592083 - DNA, 11 bp, Homo sapiens
ccagtgcctct

SEQ ID NO: 5592084 - DNA, 14 bp, Homo sapiens
ccagtgcctctccc

SEQ ID NO: 5592085 - DNA, 19 bp, Homo sapiens
ccagtgcctctccctgctg

SEQ ID NO: 5592086 - DNA, 18 bp, Homo sapiens
ccagtgcctgcacatcat

SEQ ID NO: 5592087 - DNA, 21 bp, Homo sapiens
ccagtgcctgccactctctgg

SEQ ID NO: 5592088 - DNA, 13 bp, Homo sapiens
ccagtgcctgggt

SEQ ID NO: 5592089 - DNA, 23 bp, Homo sapiens
ccagtgcctgtgagcatggggcc

SEQ ID NO: 5592090 - DNA, 18 bp, Homo sapiens
ccagtgccttacctcctg

SEQ ID NO: 5592091 - DNA, 21 bp, Homo sapiens
ccagtgccttacctcctgccc

SEQ ID NO: 5592092 - DNA, 22 bp, Homo sapiens
ccagtgccttacctcctgccca

SEQ ID NO: 5592093 - DNA, 15 bp, Homo sapiens
ccagtgcgattctgg

SEQ ID NO: 5592094 - DNA, 23 bp, Homo sapiens
ccagtgcggacccttcccagccc

SEQ ID NO: 5592095 - DNA, 19 bp, Homo sapiens
ccagtgcggttcctcatct

SEQ ID NO: 5592096 - DNA, 22 bp, Homo sapiens
ccagtgctaagctgccctgagg

SEQ ID NO: 5592097 - DNA, 15 bp, Homo sapiens
ccagtgctcacacaa

SEQ ID NO: 5592098 - DNA, 19 bp, Homo sapiens
ccagtgctcacacaatcag

SEQ ID NO: 5592099 - DNA, 22 bp, Homo sapiens
ccagtgctcaccagccctgcag

SEQ ID NO: 5592100 - DNA, 17 bp, Homo sapiens
ccagtgctcagctgtgg

SEQ ID NO: 5592101 - DNA, 22 bp, Homo sapiens
ccagtgctcagctgtggctgga

SEQ ID NO: 5592102 - DNA, 16 bp, Homo sapiens
ccagtgctctgcctca

SEQ ID NO: 5592103 - DNA, 17 bp, Homo sapiens
ccagtgctctgcctcag

SEQ ID NO: 5592104 - DNA, 18 bp, Homo sapiens
ccagtgctctgcctcaga

SEQ ID NO: 5592105 - DNA, 13 bp, Homo sapiens
ccagtgctgccat

SEQ ID NO: 5592106 - DNA, 14 bp, Homo sapiens
ccagtgctgccatg

SEQ ID NO: 5592107 - DNA, 18 bp, Homo sapiens
ccagtgctgccatgccac

SEQ ID NO: 5592108 - DNA, 23 bp, Homo sapiens
ccagtgctgccatgccactgcca

SEQ ID NO: 5592109 - DNA, 13 bp, Homo sapiens
ccagtgctgccca

SEQ ID NO: 5592110 - DNA, 14 bp, Homo sapiens
ccagtgctgcccat

SEQ ID NO: 5592111 - DNA, 17 bp, Homo sapiens
ccagtgctgcccatgag

SEQ ID NO: 5592112 - DNA, 14 bp, Homo sapiens
ccagtgctgctgta

SEQ ID NO: 5592113 - DNA, 16 bp, Homo sapiens
ccagtgctgcttcttg

SEQ ID NO: 5592114 - DNA, 14 bp, Homo sapiens
ccagtgctggccac

SEQ ID NO: 5592115 - DNA, 15 bp, Homo sapiens
ccagtgctggctgct

SEQ ID NO: 5592116 - DNA, 19 bp, Homo sapiens
ccagtgctggctgctggcc

SEQ ID NO: 5592117 - DNA, 19 bp, Homo sapiens
ccagtgctgtgagcaggcg

SEQ ID NO: 5592118 - DNA, 21 bp, Homo sapiens
ccagtgcttctccaacactga

SEQ ID NO: 5592119 - DNA, 17 bp, Homo sapiens
ccagtgcttggctgccc

SEQ ID NO: 5592120 - DNA, 19 bp, Homo sapiens
ccagtgcttggctgcccca

SEQ ID NO: 5592121 - DNA, 21 bp, Homo sapiens
ccagtgctttatccacattgt

SEQ ID NO: 5592122 - DNA, 17 bp, Homo sapiens
ccagtggaagttcttca

SEQ ID NO: 5592123 - DNA, 18 bp, Homo sapiens
ccagtggaagttcttcaa

SEQ ID NO: 5592124 - DNA, 22 bp, Homo sapiens
ccagtggaagttcttcaagagg

SEQ ID NO: 5592125 - DNA, 18 bp, Homo sapiens
ccagtggaattccaactt

SEQ ID NO: 5592126 - DNA, 16 bp, Homo sapiens
ccagtggaccctggac

SEQ ID NO: 5592127 - DNA, 15 bp, Homo sapiens
ccagtggacctagcc

SEQ ID NO: 5592128 - DNA, 19 bp, Homo sapiens
ccagtggacctagcctgga

SEQ ID NO: 5592129 - DNA, 19 bp, Homo sapiens
ccagtggactcgcgagagg

SEQ ID NO: 5592130 - DNA, 12 bp, Homo sapiens
ccagtggagacg

SEQ ID NO: 5592131 - DNA, 22 bp, Homo sapiens
ccagtggaggagttcatggaag

SEQ ID NO: 5592132 - DNA, 18 bp, Homo sapiens
ccagtggcactctgtgtg

SEQ ID NO: 5592133 - DNA, 13 bp, Homo sapiens
ccagtggcagggc

SEQ ID NO: 5592134 - DNA, 15 bp, Homo sapiens
ccagtggcagggcac

SEQ ID NO: 5592135 - DNA, 16 bp, Homo sapiens
ccagtggcagggcaca

SEQ ID NO: 5592136 - DNA, 19 bp, Homo sapiens
ccagtggcagggcacaggg

SEQ ID NO: 5592137 - DNA, 15 bp, Homo sapiens
ccagtggccactcag

SEQ ID NO: 5592138 - DNA, 16 bp, Homo sapiens
ccagtggccactcagc

SEQ ID NO: 5592139 - DNA, 19 bp, Homo sapiens
ccagtggcccccactcaca

SEQ ID NO: 5592140 - DNA, 22 bp, Homo sapiens
ccagtggcccccgggcctgcac

SEQ ID NO: 5592141 - DNA, 14 bp, Homo sapiens
ccagtggccggttg

SEQ ID NO: 5592142 - DNA, 17 bp, Homo sapiens
ccagtggcctcaaccct

SEQ ID NO: 5592143 - DNA, 15 bp, Homo sapiens
ccagtggcctggctc

SEQ ID NO: 5592144 - DNA, 16 bp, Homo sapiens
ccagtggcctggctcc

SEQ ID NO: 5592145 - DNA, 19 bp, Homo sapiens
ccagtggccttccccagca

SEQ ID NO: 5592146 - DNA, 13 bp, Homo sapiens
ccagtggcctttc

SEQ ID NO: 5592147 - DNA, 21 bp, Homo sapiens
ccagtggcggcacgtccttgg

SEQ ID NO: 5592148 - DNA, 15 bp, Homo sapiens
ccagtggctgctgcc

SEQ ID NO: 5592149 - DNA, 16 bp, Homo sapiens
ccagtggctgctgccc

SEQ ID NO: 5592150 - DNA, 18 bp, Homo sapiens
ccagtggctgctgcccag

SEQ ID NO: 5592151 - DNA, 13 bp, Homo sapiens
ccagtggctggtc

SEQ ID NO: 5592152 - DNA, 14 bp, Homo sapiens
ccagtggctggtct

SEQ ID NO: 5592153 - DNA, 17 bp, Homo sapiens
ccagtggcttctcccaa

SEQ ID NO: 5592154 - DNA, 18 bp, Homo sapiens
ccagtggcttctcccaac

SEQ ID NO: 5592155 - DNA, 16 bp, Homo sapiens
ccagtgggaactgtgc

SEQ ID NO: 5592156 - DNA, 16 bp, Homo sapiens
ccagtgggagatgtta

SEQ ID NO: 5592157 - DNA, 15 bp, Homo sapiens
ccagtgggaggacag

SEQ ID NO: 5592158 - DNA, 13 bp, Homo sapiens
ccagtgggagggg

SEQ ID NO: 5592159 - DNA, 14 bp, Homo sapiens
ccagtgggaggggc

SEQ ID NO: 5592160 - DNA, 18 bp, Homo sapiens
ccagtgggaggggcaggc

SEQ ID NO: 5592161 - DNA, 19 bp, Homo sapiens
ccagtgggaggggcaggct

SEQ ID NO: 5592162 - DNA, 21 bp, Homo sapiens
ccagtgggaggggcaggctga

SEQ ID NO: 5592163 - DNA, 20 bp, Homo sapiens
ccagtgggaggtgagaccac

SEQ ID NO: 5592164 - DNA, 21 bp, Homo sapiens
ccagtgggatgggacagggag

SEQ ID NO: 5592165 - DNA, 17 bp, Homo sapiens
ccagtgggatgggctct

SEQ ID NO: 5592166 - DNA, 18 bp, Homo sapiens
ccagtgggccagccacag

SEQ ID NO: 5592167 - DNA, 14 bp, Homo sapiens
ccagtgggcccgga

SEQ ID NO: 5592168 - DNA, 18 bp, Homo sapiens
ccagtggggaactgaggg

SEQ ID NO: 5592169 - DNA, 17 bp, Homo sapiens
ccagtggggcctgtgga

SEQ ID NO: 5592170 - DNA, 22 bp, Homo sapiens
ccagtggggcctgtggaatgag

SEQ ID NO: 5592171 - DNA, 22 bp, Homo sapiens
ccagtgggtgatgcttttgctg

SEQ ID NO: 5592172 - DNA, 15 bp, Homo sapiens
ccagtggtaccagct

SEQ ID NO: 5592173 - DNA, 17 bp, Homo sapiens
ccagtggtaccagctca

SEQ ID NO: 5592174 - DNA, 18 bp, Homo sapiens
ccagtggtcatgctcagc

SEQ ID NO: 5592175 - DNA, 19 bp, Homo sapiens
ccagtggtcatgctcagcc

SEQ ID NO: 5592176 - DNA, 13 bp, Homo sapiens
ccagtggtctcac

SEQ ID NO: 5592177 - DNA, 18 bp, Homo sapiens
ccagtggtctggaaacag

SEQ ID NO: 5592178 - DNA, 20 bp, Homo sapiens
ccagtggtggaggtgggtgt

SEQ ID NO: 5592179 - DNA, 16 bp, Homo sapiens
ccagtggtgggtaatt

SEQ ID NO: 5592180 - DNA, 20 bp, Homo sapiens
ccagtgtaaagaataaatga

SEQ ID NO: 5592181 - DNA, 18 bp, Homo sapiens
ccagtgtaaattcagtct

SEQ ID NO: 5592182 - DNA, 22 bp, Homo sapiens
ccagtgtaactggctgctccct

SEQ ID NO: 5592183 - DNA, 12 bp, Homo sapiens
ccagtgtacata

SEQ ID NO: 5592184 - DNA, 18 bp, Homo sapiens
ccagtgtagcatcttcct

SEQ ID NO: 5592185 - DNA, 14 bp, Homo sapiens
ccagtgtagccttg

SEQ ID NO: 5592186 - DNA, 20 bp, Homo sapiens
ccagtgtatcaggtcaggga

SEQ ID NO: 5592187 - DNA, 20 bp, Homo sapiens
ccagtgtatgagagggccct

SEQ ID NO: 5592188 - DNA, 22 bp, Homo sapiens
ccagtgtcaagttgtgcttgtt

SEQ ID NO: 5592189 - DNA, 16 bp, Homo sapiens
ccagtgtcacctctct

SEQ ID NO: 5592190 - DNA, 22 bp, Homo sapiens
ccagtgtcacctctctcagagc

SEQ ID NO: 5592191 - DNA, 14 bp, Homo sapiens
ccagtgtccatgtt

SEQ ID NO: 5592192 - DNA, 18 bp, Homo sapiens
ccagtgtccccacgtatg

SEQ ID NO: 5592193 - DNA, 13 bp, Homo sapiens
ccagtgtccccag

SEQ ID NO: 5592194 - DNA, 14 bp, Homo sapiens
ccagtgtcccctcc

SEQ ID NO: 5592195 - DNA, 15 bp, Homo sapiens
ccagtgtcccctttc

SEQ ID NO: 5592196 - DNA, 17 bp, Homo sapiens
ccagtgtcctccaagtg

SEQ ID NO: 5592197 - DNA, 23 bp, Homo sapiens
ccagtgtctaggcactgagcagg

SEQ ID NO: 5592198 - DNA, 16 bp, Homo sapiens
ccagtgtctggcccag

SEQ ID NO: 5592199 - DNA, 20 bp, Homo sapiens
ccagtgtctggcccagccat

SEQ ID NO: 5592200 - DNA, 15 bp, Homo sapiens
ccagtgtctgtcccg

SEQ ID NO: 5592201 - DNA, 21 bp, Homo sapiens
ccagtgtctgtcccggggtcc

SEQ ID NO: 5592202 - DNA, 14 bp, Homo sapiens
ccagtgtcttcctg

SEQ ID NO: 5592203 - DNA, 17 bp, Homo sapiens
ccagtgtcttcctgtgg

SEQ ID NO: 5592204 - DNA, 13 bp, Homo sapiens
ccagtgtctttct

SEQ ID NO: 5592205 - DNA, 14 bp, Homo sapiens
ccagtgtctttctt

SEQ ID NO: 5592206 - DNA, 23 bp, Homo sapiens
ccagtgtgacaaggattgctact

SEQ ID NO: 5592207 - DNA, 23 bp, Homo sapiens
ccagtgtgcacgcctgcaggctg

SEQ ID NO: 5592208 - DNA, 18 bp, Homo sapiens
ccagtgtgggcttgacca

SEQ ID NO: 5592209 - DNA, 22 bp, Homo sapiens
ccagtgtggggttctgctggga

SEQ ID NO: 5592210 - DNA, 21 bp, Homo sapiens
ccagtgtgtaaattgtattct

SEQ ID NO: 5592211 - DNA, 13 bp, Homo sapiens
ccagtgtgtgctc

SEQ ID NO: 5592212 - DNA, 14 bp, Homo sapiens
ccatccccctgccc

SEQ ID NO: 5592213 - DNA, 15 bp, Homo sapiens
ccatcccccttcttc

SEQ ID NO: 5592214 - DNA, 23 bp, Homo sapiens
ccatcccccttcttcctcccctc

SEQ ID NO: 5592215 - DNA, 19 bp, Homo sapiens
ccatccccgtccatgctca

SEQ ID NO: 5592216 - DNA, 12 bp, Homo sapiens
ccatcccctcaa

SEQ ID NO: 5592217 - DNA, 11 bp, Homo sapiens
ccatcccctcc

SEQ ID NO: 5592218 - DNA, 12 bp, Homo sapiens
ccatcccctccc

SEQ ID NO: 5592219 - DNA, 14 bp, Homo sapiens
ccatcccctccctg

SEQ ID NO: 5592220 - DNA, 17 bp, Homo sapiens
ccatcccctcctagcac

SEQ ID NO: 5592221 - DNA, 13 bp, Homo sapiens
ccatcccgaagcc

SEQ ID NO: 5592222 - DNA, 17 bp, Homo sapiens
ccatcccgacatggacc

SEQ ID NO: 5592223 - DNA, 22 bp, Homo sapiens
ccatcccgacatggacccggag

SEQ ID NO: 5592224 - DNA, 19 bp, Homo sapiens
ccatcccgcccttcccaca

SEQ ID NO: 5592225 - DNA, 16 bp, Homo sapiens
ccatcccgccttctcc

SEQ ID NO: 5592226 - DNA, 18 bp, Homo sapiens
ccatcccgccttctccag

SEQ ID NO: 5592227 - DNA, 18 bp, Homo sapiens
ccatcccgctcttttcct

SEQ ID NO: 5592228 - DNA, 18 bp, Homo sapiens
ccatcccgcttagcctgc

SEQ ID NO: 5592229 - DNA, 19 bp, Homo sapiens
ccatcccgcttagcctgcc

SEQ ID NO: 5592230 - DNA, 23 bp, Homo sapiens
ccatcccgcttagcctgcctcac

SEQ ID NO: 5592231 - DNA, 19 bp, Homo sapiens
ccatcccgtaagaccacct

SEQ ID NO: 5592232 - DNA, 12 bp, Homo sapiens
ccatccctacca

SEQ ID NO: 5592233 - DNA, 21 bp, Homo sapiens
ccatccctagaagagcacaga

SEQ ID NO: 5592234 - DNA, 16 bp, Homo sapiens
ccatccctccccagtt

SEQ ID NO: 5592235 - DNA, 15 bp, Homo sapiens
ccatccctccctcca

SEQ ID NO: 5592236 - DNA, 12 bp, Homo sapiens
ccatccctcggg

SEQ ID NO: 5592237 - DNA, 22 bp, Homo sapiens
ccatccctcgtggtccccaaca

SEQ ID NO: 5592238 - DNA, 17 bp, Homo sapiens
ccatccctctcctctgc

SEQ ID NO: 5592239 - DNA, 17 bp, Homo sapiens
ccatccctgaaggcccc

SEQ ID NO: 5592240 - DNA, 13 bp, Homo sapiens
ccatccctgcctg

SEQ ID NO: 5592241 - DNA, 14 bp, Homo sapiens
ccatccctgcctgg

SEQ ID NO: 5592242 - DNA, 16 bp, Homo sapiens
ccatccctgcctggag

SEQ ID NO: 5592243 - DNA, 17 bp, Homo sapiens
ccatccctgcctggagg

SEQ ID NO: 5592244 - DNA, 19 bp, Homo sapiens
ccatccctgcctggaggct

SEQ ID NO: 5592245 - DNA, 15 bp, Homo sapiens
ccatccctgcctggt

SEQ ID NO: 5592246 - DNA, 16 bp, Homo sapiens
ccatccctgcctggtc

SEQ ID NO: 5592247 - DNA, 12 bp, Homo sapiens
ccatccctgctc

SEQ ID NO: 5592248 - DNA, 23 bp, Homo sapiens
ccatccctggccccctccctgga

SEQ ID NO: 5592249 - DNA, 14 bp, Homo sapiens
ccatccctggctga

SEQ ID NO: 5592250 - DNA, 15 bp, Homo sapiens
ccatccctggctgac

SEQ ID NO: 5592251 - DNA, 12 bp, Homo sapiens
ccatccctgggc

SEQ ID NO: 5592252 - DNA, 17 bp, Homo sapiens
ccatccctgggcccctc

SEQ ID NO: 5592253 - DNA, 18 bp, Homo sapiens
ccatccctgggcccctcc

SEQ ID NO: 5592254 - DNA, 20 bp, Homo sapiens
ccatccctgggcccctccac

SEQ ID NO: 5592255 - DNA, 14 bp, Homo sapiens
ccatccctggtgaa

SEQ ID NO: 5592256 - DNA, 13 bp, Homo sapiens
ccatccctgtcct

SEQ ID NO: 5592257 - DNA, 22 bp, Homo sapiens
ccatcccttcaaccccacttcc

SEQ ID NO: 5592258 - DNA, 13 bp, Homo sapiens
ccatcccttcctg

SEQ ID NO: 5592259 - DNA, 17 bp, Homo sapiens
ccatcccttcggagcca

SEQ ID NO: 5592260 - DNA, 20 bp, Homo sapiens
ccatcccttcggagccaaca

SEQ ID NO: 5592261 - DNA, 14 bp, Homo sapiens
ccatcccttgggga

SEQ ID NO: 5592262 - DNA, 14 bp, Homo sapiens
ccatcccttttcct

SEQ ID NO: 5592263 - DNA, 16 bp, Homo sapiens
ccatcccttttcctgt

SEQ ID NO: 5592264 - DNA, 19 bp, Homo sapiens
ccatcccttttcctgtcag

SEQ ID NO: 5592265 - DNA, 22 bp, Homo sapiens
ccatcccttttcctgtcagtgt

SEQ ID NO: 5592266 - DNA, 23 bp, Homo sapiens
ccatcccttttcctttctggccc

SEQ ID NO: 5592267 - DNA, 17 bp, Homo sapiens
ccatccctttttttaca

SEQ ID NO: 5592268 - DNA, 16 bp, Homo sapiens
ccatccgccagggccc

SEQ ID NO: 5592269 - DNA, 19 bp, Homo sapiens
ccatccggcccccagagcg

SEQ ID NO: 5592270 - DNA, 17 bp, Homo sapiens
ccatccgggacgcttcc

SEQ ID NO: 5592271 - DNA, 18 bp, Homo sapiens
ccatccgggacgcttcca

SEQ ID NO: 5592272 - DNA, 21 bp, Homo sapiens
ccatccgggacgcttccagac

SEQ ID NO: 5592273 - DNA, 22 bp, Homo sapiens
ccatccggtcccctgcctggaa

SEQ ID NO: 5592274 - DNA, 23 bp, Homo sapiens
ccatccggtggcctattccagga

SEQ ID NO: 5592275 - DNA, 23 bp, Homo sapiens
ccatcctaatcatccaatgctca

SEQ ID NO: 5592276 - DNA, 15 bp, Homo sapiens
ccatcctacccagcg

SEQ ID NO: 5592277 - DNA, 18 bp, Homo sapiens
ccatcctacccagcgtgg

SEQ ID NO: 5592278 - DNA, 20 bp, Homo sapiens
ccatcctacccagcgtggcc

SEQ ID NO: 5592279 - DNA, 12 bp, Homo sapiens
ccatcctaccct

SEQ ID NO: 5592280 - DNA, 17 bp, Homo sapiens
ccatcctaccctcgggc

SEQ ID NO: 5592281 - DNA, 22 bp, Homo sapiens
ccatcctaccctcgggcccacc

SEQ ID NO: 5592282 - DNA, 17 bp, Homo sapiens
ccatcctaggaaccagc

SEQ ID NO: 5592283 - DNA, 15 bp, Homo sapiens
ccatcctcacccaga

SEQ ID NO: 5592284 - DNA, 23 bp, Homo sapiens
ccatcctcagaggctgagccctg

SEQ ID NO: 5592285 - DNA, 16 bp, Homo sapiens
ccatcctcatccctga

SEQ ID NO: 5592286 - DNA, 17 bp, Homo sapiens
ccatcctcatccctgac

SEQ ID NO: 5592287 - DNA, 16 bp, Homo sapiens
ccatcctccagagaaa

SEQ ID NO: 5592288 - DNA, 18 bp, Homo sapiens
ccatcctccagccctgcc

SEQ ID NO: 5592289 - DNA, 16 bp, Homo sapiens
ccatcctccagcttct

SEQ ID NO: 5592290 - DNA, 17 bp, Homo sapiens
ccatcctccccttccct

SEQ ID NO: 5592291 - DNA, 14 bp, Homo sapiens
ccatcctccctcca

SEQ ID NO: 5592292 - DNA, 20 bp, Homo sapiens
ccatcctccctccacctcaa

SEQ ID NO: 5592293 - DNA, 18 bp, Homo sapiens
ccatcctcctccttccta

SEQ ID NO: 5592294 - DNA, 14 bp, Homo sapiens
ccatcctcctctcc

SEQ ID NO: 5592295 - DNA, 15 bp, Homo sapiens
ccatcctcctctcca

SEQ ID NO: 5592296 - DNA, 19 bp, Homo sapiens
ccatcctcctctccatgca

SEQ ID NO: 5592297 - DNA, 14 bp, Homo sapiens
ccatcctcctgccc

SEQ ID NO: 5592298 - DNA, 23 bp, Homo sapiens
ccatcctcctgcccccaccccag

SEQ ID NO: 5592299 - DNA, 14 bp, Homo sapiens
ccatcctctgcctc

SEQ ID NO: 5592300 - DNA, 14 bp, Homo sapiens
ccatcctgaactgg

SEQ ID NO: 5592301 - DNA, 11 bp, Homo sapiens
ccatcctgacc

SEQ ID NO: 5592302 - DNA, 12 bp, Homo sapiens
ccatcctgacca

SEQ ID NO: 5592303 - DNA, 17 bp, Homo sapiens
ccatcctgaggaccgcc

SEQ ID NO: 5592304 - DNA, 19 bp, Homo sapiens
ccatcctgaggaccgcccc

SEQ ID NO: 5592305 - DNA, 20 bp, Homo sapiens
ccatcctgaggctccacttg

SEQ ID NO: 5592306 - DNA, 16 bp, Homo sapiens
ccatcctgaggtgcct

SEQ ID NO: 5592307 - DNA, 17 bp, Homo sapiens
ccatcctgaggtgcctc

SEQ ID NO: 5592308 - DNA, 18 bp, Homo sapiens
ccatcctgaggtgcctcc

SEQ ID NO: 5592309 - DNA, 20 bp, Homo sapiens
ccatcctgaggtgcctccca

SEQ ID NO: 5592310 - DNA, 18 bp, Homo sapiens
ccatcctgatcccagacc

SEQ ID NO: 5592311 - DNA, 12 bp, Homo sapiens
ccatcctgatgg

SEQ ID NO: 5592312 - DNA, 18 bp, Homo sapiens
ccatcctgcaaaggccct

SEQ ID NO: 5592313 - DNA, 20 bp, Homo sapiens
ccatcctgcaaaggcccttg

SEQ ID NO: 5592314 - DNA, 15 bp, Homo sapiens
ccatcctgcagcctc

SEQ ID NO: 5592315 - DNA, 11 bp, Homo sapiens
ccatcctgcca

SEQ ID NO: 5592316 - DNA, 15 bp, Homo sapiens
ccatcctgccaggag

SEQ ID NO: 5592317 - DNA, 17 bp, Homo sapiens
ccatcctgccaggagca

SEQ ID NO: 5592318 - DNA, 19 bp, Homo sapiens
ccatcctgccaggagcagc

SEQ ID NO: 5592319 - DNA, 19 bp, Homo sapiens
ccatcctgctagcacctcc

SEQ ID NO: 5592320 - DNA, 22 bp, Homo sapiens
ccatcctgctagcacctcccca

SEQ ID NO: 5592321 - DNA, 23 bp, Homo sapiens
ccatcctgctagcacctccccag

SEQ ID NO: 5592322 - DNA, 13 bp, Homo sapiens
ccatcctggccca

SEQ ID NO: 5592323 - DNA, 16 bp, Homo sapiens
ccatcctggcccatca

SEQ ID NO: 5592324 - DNA, 17 bp, Homo sapiens
ccatcctggcccatcag

SEQ ID NO: 5592325 - DNA, 13 bp, Homo sapiens
ccatcctggcccc

SEQ ID NO: 5592326 - DNA, 12 bp, Homo sapiens
ccatcctggcta

SEQ ID NO: 5592327 - DNA, 12 bp, Homo sapiens
ccatcctgggcc

SEQ ID NO: 5592328 - DNA, 19 bp, Homo sapiens
ccatcctgggccttacctc

SEQ ID NO: 5592329 - DNA, 14 bp, Homo sapiens
ccatcctggggttg

SEQ ID NO: 5592330 - DNA, 24 bp, Homo sapiens
ccatcctgtgtccccttcatcctt

SEQ ID NO: 5592331 - DNA, 16 bp, Homo sapiens
ccatccttaactgtcc

SEQ ID NO: 5592332 - DNA, 17 bp, Homo sapiens
ccatccttcaccagagc

SEQ ID NO: 5592333 - DNA, 18 bp, Homo sapiens
ccatccttcaccagagcc

SEQ ID NO: 5592334 - DNA, 20 bp, Homo sapiens
ccatccttcaccagagccca

SEQ ID NO: 5592335 - DNA, 21 bp, Homo sapiens
ccatccttcaccagagcccat

SEQ ID NO: 5592336 - DNA, 12 bp, Homo sapiens
ccatccttcccg

SEQ ID NO: 5592337 - DNA, 15 bp, Homo sapiens
ccatccttcccgcag

SEQ ID NO: 5592338 - DNA, 16 bp, Homo sapiens
ccatccttcccgcagc

SEQ ID NO: 5592339 - DNA, 18 bp, Homo sapiens
ccatccttcccgcagcac

SEQ ID NO: 5592340 - DNA, 15 bp, Homo sapiens
ccatccttccctttg

SEQ ID NO: 5592341 - DNA, 14 bp, Homo sapiens
ccatccttctcccc

SEQ ID NO: 5592342 - DNA, 14 bp, Homo sapiens
ccatccttgcactt

SEQ ID NO: 5592343 - DNA, 17 bp, Homo sapiens
ccatccttgctgcagct

SEQ ID NO: 5592344 - DNA, 22 bp, Homo sapiens
ccatcgattgtgtacttttcct

SEQ ID NO: 5592345 - DNA, 17 bp, Homo sapiens
ccatcgccagctgatga

SEQ ID NO: 5592346 - DNA, 22 bp, Homo sapiens
ccatcgccagctgatgactcaa

SEQ ID NO: 5592347 - DNA, 19 bp, Homo sapiens
ccatcgccccaccgcagct

SEQ ID NO: 5592348 - DNA, 16 bp, Homo sapiens
ccatcgccttctgggg

SEQ ID NO: 5592349 - DNA, 16 bp, Homo sapiens
ccatcgctctgagcat

SEQ ID NO: 5592350 - DNA, 16 bp, Homo sapiens
ccatcgctgtcatctc

SEQ ID NO: 5592351 - DNA, 14 bp, Homo sapiens
ccatcgctgtgtgt

SEQ ID NO: 5592352 - DNA, 23 bp, Homo sapiens
ccatcgctgtgtgttagttccca

SEQ ID NO: 5592353 - DNA, 14 bp, Homo sapiens
ccatcggaagagag

SEQ ID NO: 5592354 - DNA, 16 bp, Homo sapiens
ccatcggaagagaggg

SEQ ID NO: 5592355 - DNA, 19 bp, Homo sapiens
ccatcggaagagagggctg

SEQ ID NO: 5592356 - DNA, 22 bp, Homo sapiens
ccatcggaagagagggctgagc

SEQ ID NO: 5592357 - DNA, 18 bp, Homo sapiens
ccatcggccctgtcccct

SEQ ID NO: 5592358 - DNA, 15 bp, Homo sapiens
ccatcgggtgccaaa

SEQ ID NO: 5592359 - DNA, 14 bp, Homo sapiens
ccatcggtcagcag

SEQ ID NO: 5592360 - DNA, 23 bp, Homo sapiens
ccatcgtattaaaaaacaattaa

SEQ ID NO: 5592361 - DNA, 20 bp, Homo sapiens
ccatcgtctcatcctccttt

SEQ ID NO: 5592362 - DNA, 22 bp, Homo sapiens
ccatcgtctcatcctcctttca

SEQ ID NO: 5592363 - DNA, 17 bp, Homo sapiens
ccatcgtgaagaagcct

SEQ ID NO: 5592364 - DNA, 14 bp, Homo sapiens
ccatctaaactgcc

SEQ ID NO: 5592365 - DNA, 15 bp, Homo sapiens
ccatctacccctgga

SEQ ID NO: 5592366 - DNA, 19 bp, Homo sapiens
ccatctactcttttgaagt

SEQ ID NO: 5592367 - DNA, 16 bp, Homo sapiens
ccatctagcagctggc

SEQ ID NO: 5592368 - DNA, 14 bp, Homo sapiens
ccatctagccagcc

SEQ ID NO: 5592369 - DNA, 18 bp, Homo sapiens
ccatctaggtcctggctg

SEQ ID NO: 5592370 - DNA, 20 bp, Homo sapiens
ccatctagtcacaaagactc

SEQ ID NO: 5592371 - DNA, 16 bp, Homo sapiens
ccatctatgcagaaca

SEQ ID NO: 5592372 - DNA, 14 bp, Homo sapiens
ccatctattctctg

SEQ ID NO: 5592373 - DNA, 17 bp, Homo sapiens
ccatctcacacatgagc

SEQ ID NO: 5592374 - DNA, 18 bp, Homo sapiens
ccatctcacctcctgctg

SEQ ID NO: 5592375 - DNA, 18 bp, Homo sapiens
ccatctcagcctcctgag

SEQ ID NO: 5592376 - DNA, 19 bp, Homo sapiens
ccatctcagcctcctgagc

SEQ ID NO: 5592377 - DNA, 13 bp, Homo sapiens
ccatctcaggaga

SEQ ID NO: 5592378 - DNA, 14 bp, Homo sapiens
ccatctcaggagat

SEQ ID NO: 5592379 - DNA, 20 bp, Homo sapiens
ccatctcaggccacctgccc

SEQ ID NO: 5592380 - DNA, 11 bp, Homo sapiens
ccatctcaggt

SEQ ID NO: 5592381 - DNA, 15 bp, Homo sapiens
ccatctcaggtgcca

SEQ ID NO: 5592382 - DNA, 17 bp, Homo sapiens
ccatctcaggtgccact

SEQ ID NO: 5592383 - DNA, 22 bp, Homo sapiens
ccatctcaggtgccactccctg

SEQ ID NO: 5592384 - DNA, 23 bp, Homo sapiens
ccatctcaggtgccactccctga

SEQ ID NO: 5592385 - DNA, 17 bp, Homo sapiens
ccatctcaggttggcgg

SEQ ID NO: 5592386 - DNA, 15 bp, Homo sapiens
ccatctcatcctggc

SEQ ID NO: 5592387 - DNA, 20 bp, Homo sapiens
ccatctcatgaggggagagg

SEQ ID NO: 5592388 - DNA, 16 bp, Homo sapiens
ccatctccaagaatgc

SEQ ID NO: 5592389 - DNA, 19 bp, Homo sapiens
ccatctccaagataagcct

SEQ ID NO: 5592390 - DNA, 18 bp, Homo sapiens
ccatctccacaggagaga

SEQ ID NO: 5592391 - DNA, 17 bp, Homo sapiens
ccatgccctggaccagc

SEQ ID NO: 5592392 - DNA, 19 bp, Homo sapiens
ccatgccctggaccagccg

SEQ ID NO: 5592393 - DNA, 19 bp, Homo sapiens
ccatgccggtacacagcca

SEQ ID NO: 5592394 - DNA, 17 bp, Homo sapiens
ccatgccgtctgccgga

SEQ ID NO: 5592395 - DNA, 16 bp, Homo sapiens
ccatgcctaaagccca

SEQ ID NO: 5592396 - DNA, 16 bp, Homo sapiens
ccatgcctcaagaaca

SEQ ID NO: 5592397 - DNA, 13 bp, Homo sapiens
ccatgcctcatgc

SEQ ID NO: 5592398 - DNA, 14 bp, Homo sapiens
ccatgcctcatgcc

SEQ ID NO: 5592399 - DNA, 16 bp, Homo sapiens
ccatgcctcatgccac

SEQ ID NO: 5592400 - DNA, 17 bp, Homo sapiens
ccatgcctcatgccaca

SEQ ID NO: 5592401 - DNA, 11 bp, Homo sapiens
ccatgcctccc

SEQ ID NO: 5592402 - DNA, 20 bp, Homo sapiens
ccatgcctccctgggccacc

SEQ ID NO: 5592403 - DNA, 15 bp, Homo sapiens
ccatgcctcctcagg

SEQ ID NO: 5592404 - DNA, 16 bp, Homo sapiens
ccatgcctcctcagga

SEQ ID NO: 5592405 - DNA, 12 bp, Homo sapiens
ccatgcctggcc

SEQ ID NO: 5592406 - DNA, 13 bp, Homo sapiens
ccatgcctggccc

SEQ ID NO: 5592407 - DNA, 23 bp, Homo sapiens
ccatgcctggtcccaagacagtg

SEQ ID NO: 5592408 - DNA, 22 bp, Homo sapiens
ccatgcctgtagctttcctggt

SEQ ID NO: 5592409 - DNA, 18 bp, Homo sapiens
ccatgcctgtccagcctg

SEQ ID NO: 5592410 - DNA, 16 bp, Homo sapiens
ccatgcgacactggga

SEQ ID NO: 5592411 - DNA, 22 bp, Homo sapiens
ccatgcgaggggccagcagagg

SEQ ID NO: 5592412 - DNA, 21 bp, Homo sapiens
ccatgcgcagatgaggggcca

SEQ ID NO: 5592413 - DNA, 13 bp, Homo sapiens
ccatgcgctcagg

SEQ ID NO: 5592414 - DNA, 23 bp, Homo sapiens
ccatgcgtgccgcctgctcctca

SEQ ID NO: 5592415 - DNA, 16 bp, Homo sapiens
ccatgctcagctcagc

SEQ ID NO: 5592416 - DNA, 17 bp, Homo sapiens
ccatgctcatctgctgg

SEQ ID NO: 5592417 - DNA, 15 bp, Homo sapiens
ccatgctcccaactc

SEQ ID NO: 5592418 - DNA, 13 bp, Homo sapiens
ccatgctccgcct

SEQ ID NO: 5592419 - DNA, 15 bp, Homo sapiens
ccatgctcctcactg

SEQ ID NO: 5592420 - DNA, 13 bp, Homo sapiens
ccatgctcctctt

SEQ ID NO: 5592421 - DNA, 13 bp, Homo sapiens
ccatgctctctgt

SEQ ID NO: 5592422 - DNA, 19 bp, Homo sapiens
ccatgctctgccccaagcc

SEQ ID NO: 5592423 - DNA, 18 bp, Homo sapiens
ccatgctctttcaccctg

SEQ ID NO: 5592424 - DNA, 20 bp, Homo sapiens
ccatgctctttcaccctgcc

SEQ ID NO: 5592425 - DNA, 16 bp, Homo sapiens
ccatgctgaaggctcc

SEQ ID NO: 5592426 - DNA, 16 bp, Homo sapiens
ccatgctgaagggacc

SEQ ID NO: 5592427 - DNA, 17 bp, Homo sapiens
ccatgctgagagctggg

SEQ ID NO: 5592428 - DNA, 17 bp, Homo sapiens
ccatgctgaggcctggg

SEQ ID NO: 5592429 - DNA, 13 bp, Homo sapiens
ccatgctgccctg

SEQ ID NO: 5592430 - DNA, 16 bp, Homo sapiens
ccatgctgccctgtga

SEQ ID NO: 5592431 - DNA, 17 bp, Homo sapiens
ccatgctgccctgtgag

SEQ ID NO: 5592432 - DNA, 14 bp, Homo sapiens
ccatgctgcctcca

SEQ ID NO: 5592433 - DNA, 17 bp, Homo sapiens
ccatgctgccttcaggg

SEQ ID NO: 5592434 - DNA, 12 bp, Homo sapiens
ccatgctgctat

SEQ ID NO: 5592435 - DNA, 20 bp, Homo sapiens
ccatgctgctggggaagaca

SEQ ID NO: 5592436 - DNA, 17 bp, Homo sapiens
ccatgctggagcctgtg

SEQ ID NO: 5592437 - DNA, 19 bp, Homo sapiens
ccatgctggagcctgtgta

SEQ ID NO: 5592438 - DNA, 22 bp, Homo sapiens
ccatgctggagcctgtgtaaca

SEQ ID NO: 5592439 - DNA, 21 bp, Homo sapiens
ccatgctggcggcgcagaggg

SEQ ID NO: 5592440 - DNA, 16 bp, Homo sapiens
ccatgctggctgaaga

SEQ ID NO: 5592441 - DNA, 16 bp, Homo sapiens
ccatgctggctggggc

SEQ ID NO: 5592442 - DNA, 16 bp, Homo sapiens
ccatgctgggaagacg

SEQ ID NO: 5592443 - DNA, 21 bp, Homo sapiens
ccatgctgggaagacgcctga

SEQ ID NO: 5592444 - DNA, 20 bp, Homo sapiens
ccatgctgggccactgggga

SEQ ID NO: 5592445 - DNA, 24 bp, Homo sapiens
ccatgctgggccggggtgtggaat

SEQ ID NO: 5592446 - DNA, 13 bp, Homo sapiens
ccatgctgggctc

SEQ ID NO: 5592447 - DNA, 16 bp, Homo sapiens
ccatgctggtcagaga

SEQ ID NO: 5592448 - DNA, 13 bp, Homo sapiens
ccatgctgtccct

SEQ ID NO: 5592449 - DNA, 21 bp, Homo sapiens
ccatgctgtccctgcactgtg

SEQ ID NO: 5592450 - DNA, 15 bp, Homo sapiens
ccatgctgtccctgt

SEQ ID NO: 5592451 - DNA, 17 bp, Homo sapiens
ccatgctgtccctgtgg

SEQ ID NO: 5592452 - DNA, 18 bp, Homo sapiens
ccatgctgtccctgtggg

SEQ ID NO: 5592453 - DNA, 22 bp, Homo sapiens
ccatgctgtgtgagaccagggg

SEQ ID NO: 5592454 - DNA, 21 bp, Homo sapiens
ccatgctgttgattgctaaat

SEQ ID NO: 5592455 - DNA, 21 bp, Homo sapiens
ccatgctgttttccctttgcc

SEQ ID NO: 5592456 - DNA, 19 bp, Homo sapiens
ccatgcttacgtgatcctc

SEQ ID NO: 5592457 - DNA, 16 bp, Homo sapiens
ccatgcttagtcactg

SEQ ID NO: 5592458 - DNA, 22 bp, Homo sapiens
ccatgcttctcatcttgtgaaa

SEQ ID NO: 5592459 - DNA, 12 bp, Homo sapiens
ccatgcttcttg

SEQ ID NO: 5592460 - DNA, 14 bp, Homo sapiens
ccatgcttcttgcc

SEQ ID NO: 5592461 - DNA, 21 bp, Homo sapiens
ccatgcttcttgccccttggg

SEQ ID NO: 5592462 - DNA, 14 bp, Homo sapiens
ccatgctttatgtg

SEQ ID NO: 5592463 - DNA, 12 bp, Homo sapiens
ccatgctttcct

SEQ ID NO: 5592464 - DNA, 18 bp, Homo sapiens
ccatgctttccttttctt

SEQ ID NO: 5592465 - DNA, 20 bp, Homo sapiens
ccatgctttccttttcttcc

SEQ ID NO: 5592466 - DNA, 22 bp, Homo sapiens
ccatgctttccttttcttcctt

SEQ ID NO: 5592467 - DNA, 20 bp, Homo sapiens
ccatgctttgagtccacgcc

SEQ ID NO: 5592468 - DNA, 16 bp, Homo sapiens
ccatggaaaaatgcca

SEQ ID NO: 5592469 - DNA, 15 bp, Homo sapiens
ccatggaaataaaaa

SEQ ID NO: 5592470 - DNA, 17 bp, Homo sapiens
ccatggaacagccctgc

SEQ ID NO: 5592471 - DNA, 18 bp, Homo sapiens
ccatggaacagccctgca

SEQ ID NO: 5592472 - DNA, 22 bp, Homo sapiens
ccatggaaccatggaggaggaa

SEQ ID NO: 5592473 - DNA, 19 bp, Homo sapiens
ccatggaactgtttccttc

SEQ ID NO: 5592474 - DNA, 13 bp, Homo sapiens
ccatggaagctgg

SEQ ID NO: 5592475 - DNA, 22 bp, Homo sapiens
ccatggaagctggcaggagaca

SEQ ID NO: 5592476 - DNA, 23 bp, Homo sapiens
ccatggaagctggcaggagacac

SEQ ID NO: 5592477 - DNA, 19 bp, Homo sapiens
ccatggaatgactgaagac

SEQ ID NO: 5592478 - DNA, 21 bp, Homo sapiens
ccatggaatgactgaagacag

SEQ ID NO: 5592479 - DNA, 18 bp, Homo sapiens
ccatggaattccctcctg

SEQ ID NO: 5592480 - DNA, 21 bp, Homo sapiens
ccatggacactacacccagca

SEQ ID NO: 5592481 - DNA, 16 bp, Homo sapiens
ccatggacaggctggc

SEQ ID NO: 5592482 - DNA, 17 bp, Homo sapiens
ccatggacatgggcagc

SEQ ID NO: 5592483 - DNA, 18 bp, Homo sapiens
ccatggacatgggcagca

SEQ ID NO: 5592484 - DNA, 16 bp, Homo sapiens
ccatggacctgcactt

SEQ ID NO: 5592485 - DNA, 17 bp, Homo sapiens
ccatggacgaatatgaa

SEQ ID NO: 5592486 - DNA, 22 bp, Homo sapiens
ccatggacgaatatgaatgtca

SEQ ID NO: 5592487 - DNA, 22 bp, Homo sapiens
ccatggactctacactgtgaac

SEQ ID NO: 5592488 - DNA, 19 bp, Homo sapiens
ccatggagaaagctgactt

SEQ ID NO: 5592489 - DNA, 19 bp, Homo sapiens
ccatggagacaataaacag

SEQ ID NO: 5592490 - DNA, 20 bp, Homo sapiens
ccatggagacgtggtgggac

SEQ ID NO: 5592491 - DNA, 19 bp, Homo sapiens
ccatggagagctggagcct

SEQ ID NO: 5592492 - DNA, 19 bp, Homo sapiens
ccatggagattgacctgga

SEQ ID NO: 5592493 - DNA, 14 bp, Homo sapiens
ccatggagccagct

SEQ ID NO: 5592494 - DNA, 17 bp, Homo sapiens
ccatggagccagctccc

SEQ ID NO: 5592495 - DNA, 12 bp, Homo sapiens
ccatggagcccc

SEQ ID NO: 5592496 - DNA, 17 bp, Homo sapiens
ccatggagccccagccc

SEQ ID NO: 5592497 - DNA, 18 bp, Homo sapiens
ccatggagccccagcccc

SEQ ID NO: 5592498 - DNA, 11 bp, Homo sapiens
ccatggagcct

SEQ ID NO: 5592499 - DNA, 22 bp, Homo sapiens
ccatggaggaggtgtcccaagc

SEQ ID NO: 5592500 - DNA, 13 bp, Homo sapiens
ccatggaggcagg

SEQ ID NO: 5592501 - DNA, 22 bp, Homo sapiens
ccatggaggcaggctccccctg

SEQ ID NO: 5592502 - DNA, 23 bp, Homo sapiens
ccatggagtgagacccaggagcc

SEQ ID NO: 5592503 - DNA, 14 bp, Homo sapiens
ccatggagtggcag

SEQ ID NO: 5592504 - DNA, 23 bp, Homo sapiens
ccatggatatgttgtattaactg

SEQ ID NO: 5592505 - DNA, 14 bp, Homo sapiens
ccatggatcttgct

SEQ ID NO: 5592506 - DNA, 21 bp, Homo sapiens
ccatggatttcgtttttcttg

SEQ ID NO: 5592507 - DNA, 15 bp, Homo sapiens
ccatggcaaatgggc

SEQ ID NO: 5592508 - DNA, 14 bp, Homo sapiens
ccatggcaccagcc

SEQ ID NO: 5592509 - DNA, 19 bp, Homo sapiens
ccatggcaccagccccctg

SEQ ID NO: 5592510 - DNA, 21 bp, Homo sapiens
ccatggcaccagccccctgga

SEQ ID NO: 5592511 - DNA, 22 bp, Homo sapiens
ccatggcacctttgagagaggg

SEQ ID NO: 5592512 - DNA, 23 bp, Homo sapiens
ccatggcactctatgttctaaga

SEQ ID NO: 5592513 - DNA, 19 bp, Homo sapiens
ccatggcagcagccaggga

SEQ ID NO: 5592514 - DNA, 13 bp, Homo sapiens
ccatggcagctcc

SEQ ID NO: 5592515 - DNA, 14 bp, Homo sapiens
ccatggcagctcct

SEQ ID NO: 5592516 - DNA, 13 bp, Homo sapiens
ccatggcaggaag

SEQ ID NO: 5592517 - DNA, 14 bp, Homo sapiens
ccatggcaggaagg

SEQ ID NO: 5592518 - DNA, 23 bp, Homo sapiens
ccatggcatgcgccaccatgccc

SEQ ID NO: 5592519 - DNA, 22 bp, Homo sapiens
ccatggccacatcctcatggcc

SEQ ID NO: 5592520 - DNA, 23 bp, Homo sapiens
ccatggccacgaggaagcagcaa

SEQ ID NO: 5592521 - DNA, 16 bp, Homo sapiens
ccatggccagcagcac

SEQ ID NO: 5592522 - DNA, 18 bp, Homo sapiens
ccatggccaggagtgggt

SEQ ID NO: 5592523 - DNA, 12 bp, Homo sapiens
ccatggcccagc

SEQ ID NO: 5592524 - DNA, 16 bp, Homo sapiens
ccatggccccagctgg

SEQ ID NO: 5592525 - DNA, 16 bp, Homo sapiens
ccatggccccaggccc

SEQ ID NO: 5592526 - DNA, 12 bp, Homo sapiens
ccatggccccca

SEQ ID NO: 5592527 - DNA, 15 bp, Homo sapiens
ccatggcccccaata

SEQ ID NO: 5592528 - DNA, 16 bp, Homo sapiens
ccatggcccccaataa

SEQ ID NO: 5592529 - DNA, 17 bp, Homo sapiens
ccatggcccccaataaa

SEQ ID NO: 5592530 - DNA, 18 bp, Homo sapiens
ccatggccccccactccc

SEQ ID NO: 5592531 - DNA, 11 bp, Homo sapiens
ccatggccctg

SEQ ID NO: 5592532 - DNA, 13 bp, Homo sapiens
ccatggccctgtc

SEQ ID NO: 5592533 - DNA, 14 bp, Homo sapiens
ccatggccctgtgc

SEQ ID NO: 5592534 - DNA, 13 bp, Homo sapiens
ccatggcccttcc

SEQ ID NO: 5592535 - DNA, 23 bp, Homo sapiens
ccatggccgaagccccttggaga

SEQ ID NO: 5592536 - DNA, 22 bp, Homo sapiens
ccatggccggctttcaggagct

SEQ ID NO: 5592537 - DNA, 22 bp, Homo sapiens
ccatggcctcagccctgctccc

SEQ ID NO: 5592538 - DNA, 23 bp, Homo sapiens
ccatggcctcagccctgctccct

SEQ ID NO: 5592539 - DNA, 16 bp, Homo sapiens
ccatggcctgcaaact

SEQ ID NO: 5592540 - DNA, 19 bp, Homo sapiens
ccatggcctgctgggcttg

SEQ ID NO: 5592541 - DNA, 14 bp, Homo sapiens
ccatggcctttcta

SEQ ID NO: 5592542 - DNA, 20 bp, Homo sapiens
ccatggctaaggcaccagcc

SEQ ID NO: 5592543 - DNA, 16 bp, Homo sapiens
ccatggctcaggcaag

SEQ ID NO: 5592544 - DNA, 18 bp, Homo sapiens
ccatggctcaggcaagcc

SEQ ID NO: 5592545 - DNA, 17 bp, Homo sapiens
ccatggctcagggtggt

SEQ ID NO: 5592546 - DNA, 17 bp, Homo sapiens
ccatggctctatttctt

SEQ ID NO: 5592547 - DNA, 14 bp, Homo sapiens
ccatggctgaagct

SEQ ID NO: 5592548 - DNA, 15 bp, Homo sapiens
ccatggctgaagctg

SEQ ID NO: 5592549 - DNA, 17 bp, Homo sapiens
ccatggctgaagctgga

SEQ ID NO: 5592550 - DNA, 19 bp, Homo sapiens
ccatggctggatgtgcatc

SEQ ID NO: 5592551 - DNA, 19 bp, Homo sapiens
ccatggcttgttctctgga

SEQ ID NO: 5592552 - DNA, 20 bp, Homo sapiens
ccatggcttgttctctggaa

SEQ ID NO: 5592553 - DNA, 17 bp, Homo sapiens
ccatggctttcatcctg

SEQ ID NO: 5592554 - DNA, 13 bp, Homo sapiens
ccatggctttgtg

SEQ ID NO: 5592555 - DNA, 17 bp, Homo sapiens
ccatggctttgtgctgc

SEQ ID NO: 5592556 - DNA, 16 bp, Homo sapiens
ccatgggaataataga

SEQ ID NO: 5592557 - DNA, 11 bp, Homo sapiens
ccatgggacca

SEQ ID NO: 5592558 - DNA, 21 bp, Homo sapiens
ccatgggaccaaacctagccc

SEQ ID NO: 5592559 - DNA, 17 bp, Homo sapiens
ccatgggacctcctccc

SEQ ID NO: 5592560 - DNA, 20 bp, Homo sapiens
ccatgggagagtccaggcct

SEQ ID NO: 5592561 - DNA, 17 bp, Homo sapiens
ccatgggagccagctgc

SEQ ID NO: 5592562 - DNA, 19 bp, Homo sapiens
ccatgggaggcctttccct

SEQ ID NO: 5592563 - DNA, 17 bp, Homo sapiens
ccatgggaggctggagt

SEQ ID NO: 5592564 - DNA, 19 bp, Homo sapiens
ccatgggaggtggggcctc

SEQ ID NO: 5592565 - DNA, 17 bp, Homo sapiens
ccatgggataaatgcca

SEQ ID NO: 5592566 - DNA, 19 bp, Homo sapiens
ccatgggataaatgccatc

SEQ ID NO: 5592567 - DNA, 23 bp, Homo sapiens
ccatgggatacaacctccctctt

SEQ ID NO: 5592568 - DNA, 17 bp, Homo sapiens
ccatgggatatgtggtg

SEQ ID NO: 5592569 - DNA, 20 bp, Homo sapiens
ccatttcatccatatttctt

SEQ ID NO: 5592570 - DNA, 17 bp, Homo sapiens
ccatttcatctatttct

SEQ ID NO: 5592571 - DNA, 15 bp, Homo sapiens
ccatttcccacatct

SEQ ID NO: 5592572 - DNA, 16 bp, Homo sapiens
ccatttcccacttcca

SEQ ID NO: 5592573 - DNA, 16 bp, Homo sapiens
ccatttccccagggca

SEQ ID NO: 5592574 - DNA, 17 bp, Homo sapiens
ccatttccccagggcac

SEQ ID NO: 5592575 - DNA, 19 bp, Homo sapiens
ccatttcctcagcttatct

SEQ ID NO: 5592576 - DNA, 16 bp, Homo sapiens
ccatttcctcttcctt

SEQ ID NO: 5592577 - DNA, 20 bp, Homo sapiens
ccatttcctcttccttctct

SEQ ID NO: 5592578 - DNA, 10 bp, Homo sapiens
ccatttcctg

SEQ ID NO: 5592579 - DNA, 11 bp, Homo sapiens
ccatttcctga

SEQ ID NO: 5592580 - DNA, 13 bp, Homo sapiens
ccatttcctgaga

SEQ ID NO: 5592581 - DNA, 12 bp, Homo sapiens
ccatttcctgat

SEQ ID NO: 5592582 - DNA, 13 bp, Homo sapiens
ccatttccttatg

SEQ ID NO: 5592583 - DNA, 13 bp, Homo sapiens
ccatttccttgga

SEQ ID NO: 5592584 - DNA, 14 bp, Homo sapiens
ccatttccttggag

SEQ ID NO: 5592585 - DNA, 21 bp, Homo sapiens
ccatttccttttctctgccct

SEQ ID NO: 5592586 - DNA, 12 bp, Homo sapiens
ccatttctaatt

SEQ ID NO: 5592587 - DNA, 13 bp, Homo sapiens
ccatttctaatta

SEQ ID NO: 5592588 - DNA, 18 bp, Homo sapiens
ccatttctactctcccat

SEQ ID NO: 5592589 - DNA, 12 bp, Homo sapiens
ccatttctattt

SEQ ID NO: 5592590 - DNA, 15 bp, Homo sapiens
ccatttctcactagt

SEQ ID NO: 5592591 - DNA, 17 bp, Homo sapiens
ccatttctcactagtgt

SEQ ID NO: 5592592 - DNA, 19 bp, Homo sapiens
ccatttctcactagtgtca

SEQ ID NO: 5592593 - DNA, 19 bp, Homo sapiens
ccatttctcagtggcttct

SEQ ID NO: 5592594 - DNA, 14 bp, Homo sapiens
ccatttctccagaa

SEQ ID NO: 5592595 - DNA, 20 bp, Homo sapiens
ccatttctgaactgttacaa

SEQ ID NO: 5592596 - DNA, 19 bp, Homo sapiens
ccatttctgaggtgcactg

SEQ ID NO: 5592597 - DNA, 12 bp, Homo sapiens
ccatttctgcct

SEQ ID NO: 5592598 - DNA, 13 bp, Homo sapiens
ccatttctgcctc

SEQ ID NO: 5592599 - DNA, 22 bp, Homo sapiens
ccatttctgctcagattccccc

SEQ ID NO: 5592600 - DNA, 17 bp, Homo sapiens
ccatttcttatttaatt

SEQ ID NO: 5592601 - DNA, 16 bp, Homo sapiens
ccatttcttcagaggg

SEQ ID NO: 5592602 - DNA, 15 bp, Homo sapiens
ccatttcttcccaag

SEQ ID NO: 5592603 - DNA, 13 bp, Homo sapiens
ccatttcttcctc

SEQ ID NO: 5592604 - DNA, 15 bp, Homo sapiens
ccatttcttcctcac

SEQ ID NO: 5592605 - DNA, 18 bp, Homo sapiens
ccatttcttcctcactat

SEQ ID NO: 5592606 - DNA, 13 bp, Homo sapiens
ccatttcttctct

SEQ ID NO: 5592607 - DNA, 21 bp, Homo sapiens
ccatttcttctctctgttccc

SEQ ID NO: 5592608 - DNA, 12 bp, Homo sapiens
ccatttctttct

SEQ ID NO: 5592609 - DNA, 12 bp, Homo sapiens
ccatttctttta

SEQ ID NO: 5592610 - DNA, 20 bp, Homo sapiens
ccatttgaggatttagaagt

SEQ ID NO: 5592611 - DNA, 21 bp, Homo sapiens
ccatttgatttcgatgtacag

SEQ ID NO: 5592612 - DNA, 18 bp, Homo sapiens
ccatttgcaataacagct

SEQ ID NO: 5592613 - DNA, 20 bp, Homo sapiens
ccatttgcaataacagctgc

SEQ ID NO: 5592614 - DNA, 18 bp, Homo sapiens
ccatttgcagaccaggaa

SEQ ID NO: 5592615 - DNA, 20 bp, Homo sapiens
ccatttgccagattgcccca

SEQ ID NO: 5592616 - DNA, 15 bp, Homo sapiens
ccatttgcctttctg

SEQ ID NO: 5592617 - DNA, 19 bp, Homo sapiens
ccatttgcctttctgggag

SEQ ID NO: 5592618 - DNA, 13 bp, Homo sapiens
ccatttgctgccc

SEQ ID NO: 5592619 - DNA, 18 bp, Homo sapiens
ccatttgctgccctgggg

SEQ ID NO: 5592620 - DNA, 21 bp, Homo sapiens
ccatttgctgccctggggcat

SEQ ID NO: 5592621 - DNA, 18 bp, Homo sapiens
ccatttggacaaaatgga

SEQ ID NO: 5592622 - DNA, 17 bp, Homo sapiens
ccatttggattttaaac

SEQ ID NO: 5592623 - DNA, 22 bp, Homo sapiens
ccatttggcagaactgctgggg

SEQ ID NO: 5592624 - DNA, 19 bp, Homo sapiens
ccatttggcatccctgggc

SEQ ID NO: 5592625 - DNA, 14 bp, Homo sapiens
ccatttggccggct

SEQ ID NO: 5592626 - DNA, 17 bp, Homo sapiens
ccatttgggcagagagg

SEQ ID NO: 5592627 - DNA, 18 bp, Homo sapiens
ccatttggtgaagtgaaa

SEQ ID NO: 5592628 - DNA, 12 bp, Homo sapiens
ccatttgtaaaa

SEQ ID NO: 5592629 - DNA, 12 bp, Homo sapiens
ccatttgtaata

SEQ ID NO: 5592630 - DNA, 13 bp, Homo sapiens
ccatttgtaataa

SEQ ID NO: 5592631 - DNA, 18 bp, Homo sapiens
ccatttgtaataaagtat

SEQ ID NO: 5592632 - DNA, 13 bp, Homo sapiens
ccatttgtaattt

SEQ ID NO: 5592633 - DNA, 15 bp, Homo sapiens
ccatttgtagtgagc

SEQ ID NO: 5592634 - DNA, 15 bp, Homo sapiens
ccatttgtatacttt

SEQ ID NO: 5592635 - DNA, 15 bp, Homo sapiens
ccatttgtattcaaa

SEQ ID NO: 5592636 - DNA, 15 bp, Homo sapiens
ccatttgtcccaagt

SEQ ID NO: 5592637 - DNA, 13 bp, Homo sapiens
ccatttgtcccag

SEQ ID NO: 5592638 - DNA, 18 bp, Homo sapiens
ccatttgtccttttctgc

SEQ ID NO: 5592639 - DNA, 12 bp, Homo sapiens
ccatttgtcttt

SEQ ID NO: 5592640 - DNA, 18 bp, Homo sapiens
ccatttgtgccagaggaa

SEQ ID NO: 5592641 - DNA, 19 bp, Homo sapiens
ccatttgttacagtttctt

SEQ ID NO: 5592642 - DNA, 14 bp, Homo sapiens
ccatttgttcctgc

SEQ ID NO: 5592643 - DNA, 23 bp, Homo sapiens
ccatttgttgagccccagtcctg

SEQ ID NO: 5592644 - DNA, 16 bp, Homo sapiens
ccatttgttgctgctg

SEQ ID NO: 5592645 - DNA, 18 bp, Homo sapiens
ccatttgttgctgctgct

SEQ ID NO: 5592646 - DNA, 18 bp, Homo sapiens
ccatttgtttgtgcttca

SEQ ID NO: 5592647 - DNA, 16 bp, Homo sapiens
ccattttaaattttat

SEQ ID NO: 5592648 - DNA, 14 bp, Homo sapiens
ccattttaagtccc

SEQ ID NO: 5592649 - DNA, 23 bp, Homo sapiens
ccattttaagtccctgtcacctc

SEQ ID NO: 5592650 - DNA, 14 bp, Homo sapiens
ccattttaatttta

SEQ ID NO: 5592651 - DNA, 17 bp, Homo sapiens
ccattttacagatttct

SEQ ID NO: 5592652 - DNA, 19 bp, Homo sapiens
ccattttagtcactttttt

SEQ ID NO: 5592653 - DNA, 23 bp, Homo sapiens
ccattttatcatcctttcagttt

SEQ ID NO: 5592654 - DNA, 21 bp, Homo sapiens
ccattttattaaacattttca

SEQ ID NO: 5592655 - DNA, 15 bp, Homo sapiens
ccattttatttcttt

SEQ ID NO: 5592656 - DNA, 19 bp, Homo sapiens
ccattttattttttgggcc

SEQ ID NO: 5592657 - DNA, 18 bp, Homo sapiens
ccattttcaactgctttg

SEQ ID NO: 5592658 - DNA, 20 bp, Homo sapiens
ccattttcaagcaaaacagt

SEQ ID NO: 5592659 - DNA, 15 bp, Homo sapiens
ccattttcattctgt

SEQ ID NO: 5592660 - DNA, 22 bp, Homo sapiens
ccattttcccccactactgcag

SEQ ID NO: 5592661 - DNA, 16 bp, Homo sapiens
ccattttccccctgtg

SEQ ID NO: 5592662 - DNA, 16 bp, Homo sapiens
ccattttccccttcct

SEQ ID NO: 5592663 - DNA, 22 bp, Homo sapiens
ccattttcctacaggcagtctc

SEQ ID NO: 5592664 - DNA, 23 bp, Homo sapiens
ccattttcctacaggcagtctct

SEQ ID NO: 5592665 - DNA, 11 bp, Homo sapiens
ccattttcctg

SEQ ID NO: 5592666 - DNA, 12 bp, Homo sapiens
ccattttctaaa

SEQ ID NO: 5592667 - DNA, 22 bp, Homo sapiens
ccattttctaaactgttttcat

SEQ ID NO: 5592668 - DNA, 20 bp, Homo sapiens
ccattttctctattctttcc

SEQ ID NO: 5592669 - DNA, 21 bp, Homo sapiens
ccattttgcaaaatttccagt

SEQ ID NO: 5592670 - DNA, 19 bp, Homo sapiens
ccattttgccacctttcct

SEQ ID NO: 5592671 - DNA, 23 bp, Homo sapiens
ccattttggattcttatggacaa

SEQ ID NO: 5592672 - DNA, 20 bp, Homo sapiens
ccattttggtgtctttctct

SEQ ID NO: 5592673 - DNA, 22 bp, Homo sapiens
ccattttggtgtctttctcttt

SEQ ID NO: 5592674 - DNA, 22 bp, Homo sapiens
ccattttgtaaatgaaacttaa

SEQ ID NO: 5592675 - DNA, 14 bp, Homo sapiens
ccattttgtaactg

SEQ ID NO: 5592676 - DNA, 15 bp, Homo sapiens
ccattttgtgaagcc

SEQ ID NO: 5592677 - DNA, 18 bp, Homo sapiens
ccattttgtgaagccctg

SEQ ID NO: 5592678 - DNA, 23 bp, Homo sapiens
ccatttttactaaagcagtgttt

SEQ ID NO: 5592679 - DNA, 12 bp, Homo sapiens
ccatttttccca

SEQ ID NO: 5592680 - DNA, 11 bp, Homo sapiens
ccatttttcct

SEQ ID NO: 5592681 - DNA, 16 bp, Homo sapiens
ccatttttcctctgtt

SEQ ID NO: 5592682 - DNA, 12 bp, Homo sapiens
ccatttttcctt

SEQ ID NO: 5592683 - DNA, 14 bp, Homo sapiens
ccatttttgctaat

SEQ ID NO: 5592684 - DNA, 21 bp, Homo sapiens
ccattttttaaaaaagcaagg

SEQ ID NO: 5592685 - DNA, 17 bp, Homo sapiens
ccattttttaaggaaac

SEQ ID NO: 5592686 - DNA, 19 bp, Homo sapiens
ccattttttaaggaaacaa

SEQ ID NO: 5592687 - DNA, 22 bp, Homo sapiens
ccattttttgtctgtgataaca

SEQ ID NO: 5592688 - DNA, 14 bp, Homo sapiens
cccaaaaaagcgaa

SEQ ID NO: 5592689 - DNA, 17 bp, Homo sapiens
cccaaaaagatgcttta

SEQ ID NO: 5592690 - DNA, 22 bp, Homo sapiens
cccaaaaatgttcccttgacca

SEQ ID NO: 5592691 - DNA, 15 bp, Homo sapiens
cccaaaacagctttg

SEQ ID NO: 5592692 - DNA, 19 bp, Homo sapiens
cccaaaacccttacagtga

SEQ ID NO: 5592693 - DNA, 21 bp, Homo sapiens
cccaaaacctttccccagaca

SEQ ID NO: 5592694 - DNA, 16 bp, Homo sapiens
cccaaaactctcctct

SEQ ID NO: 5592695 - DNA, 20 bp, Homo sapiens
cccaaaactctcctctgctg

SEQ ID NO: 5592696 - DNA, 23 bp, Homo sapiens
cccaaaagaaactgacatgccct

SEQ ID NO: 5592697 - DNA, 11 bp, Homo sapiens
cccaaaagatt

SEQ ID NO: 5592698 - DNA, 14 bp, Homo sapiens
cccaaaagattgct

SEQ ID NO: 5592699 - DNA, 11 bp, Homo sapiens
cccaaaagcac

SEQ ID NO: 5592700 - DNA, 13 bp, Homo sapiens
cccaaaatgtgaa

SEQ ID NO: 5592701 - DNA, 15 bp, Homo sapiens
cccaaaatgtgaagc

SEQ ID NO: 5592702 - DNA, 20 bp, Homo sapiens
cccaaaattagccagtaatc

SEQ ID NO: 5592703 - DNA, 22 bp, Homo sapiens
cccaaaattagggagctcttga

SEQ ID NO: 5592704 - DNA, 17 bp, Homo sapiens
cccaaaattatcagtgc

SEQ ID NO: 5592705 - DNA, 18 bp, Homo sapiens
cccaaaatttattttata

SEQ ID NO: 5592706 - DNA, 14 bp, Homo sapiens
cccaaacacaaaac

SEQ ID NO: 5592707 - DNA, 16 bp, Homo sapiens
cccaaacaccttccag

SEQ ID NO: 5592708 - DNA, 21 bp, Homo sapiens
cccaaacaccttccagctcct

SEQ ID NO: 5592709 - DNA, 22 bp, Homo sapiens
cccaaacaccttccagctcctg

SEQ ID NO: 5592710 - DNA, 16 bp, Homo sapiens
cccaaacagcatgtgc

SEQ ID NO: 5592711 - DNA, 19 bp, Homo sapiens
cccaaacagcatgtgctca

SEQ ID NO: 5592712 - DNA, 22 bp, Homo sapiens
cccaaacagcatgtgctcagcc

SEQ ID NO: 5592713 - DNA, 20 bp, Homo sapiens
cccaaacagctgtatttata

SEQ ID NO: 5592714 - DNA, 14 bp, Homo sapiens
cccaaacatctggc

SEQ ID NO: 5592715 - DNA, 16 bp, Homo sapiens
cccaaaccagggggaa

SEQ ID NO: 5592716 - DNA, 20 bp, Homo sapiens
cccaaaccagggggaagcac

SEQ ID NO: 5592717 - DNA, 23 bp, Homo sapiens
cccaaacccagtctcctctccat

SEQ ID NO: 5592718 - DNA, 15 bp, Homo sapiens
cccaaacccatggct

SEQ ID NO: 5592719 - DNA, 22 bp, Homo sapiens
cccaaacccatggctctatttc

SEQ ID NO: 5592720 - DNA, 14 bp, Homo sapiens
cccaaaccccagcc

SEQ ID NO: 5592721 - DNA, 13 bp, Homo sapiens
cccaaaccctgct

SEQ ID NO: 5592722 - DNA, 21 bp, Homo sapiens
cccaaacctgggaaggccagc

SEQ ID NO: 5592723 - DNA, 20 bp, Homo sapiens
cccaaactccccttccctgg

SEQ ID NO: 5592724 - DNA, 16 bp, Homo sapiens
cccaaactcctttctt

SEQ ID NO: 5592725 - DNA, 20 bp, Homo sapiens
cccaaactgtgccctgcctt

SEQ ID NO: 5592726 - DNA, 19 bp, Homo sapiens
cccaaacttccaggttcca

SEQ ID NO: 5592727 - DNA, 10 bp, Homo sapiens
cccaaacttt

SEQ ID NO: 5592728 - DNA, 15 bp, Homo sapiens
cccaaactttaaaat

SEQ ID NO: 5592729 - DNA, 17 bp, Homo sapiens
cccaaactttaaaatgc

SEQ ID NO: 5592730 - DNA, 23 bp, Homo sapiens
cccaaagaattcctgaagccaga

SEQ ID NO: 5592731 - DNA, 16 bp, Homo sapiens
cccaaagagctgccta

SEQ ID NO: 5592732 - DNA, 13 bp, Homo sapiens
cccaaagagctgt

SEQ ID NO: 5592733 - DNA, 17 bp, Homo sapiens
cccaaagagctgtggct

SEQ ID NO: 5592734 - DNA, 23 bp, Homo sapiens
cccaaagagctgtggctgggggg

SEQ ID NO: 5592735 - DNA, 15 bp, Homo sapiens
cccaaagaggcccgc

SEQ ID NO: 5592736 - DNA, 17 bp, Homo sapiens
cccaaagatagacaggt

SEQ ID NO: 5592737 - DNA, 23 bp, Homo sapiens
cccaaagattaggtcgttttcca

SEQ ID NO: 5592738 - DNA, 18 bp, Homo sapiens
cccaaagcaagcacctgg

SEQ ID NO: 5592739 - DNA, 15 bp, Homo sapiens
cccaaagcacatgct

SEQ ID NO: 5592740 - DNA, 12 bp, Homo sapiens
cccaaagcccag

SEQ ID NO: 5592741 - DNA, 19 bp, Homo sapiens
cccaaagcggtccctgtcc

SEQ ID NO: 5592742 - DNA, 20 bp, Homo sapiens
cccaaagctttcctgcccca

SEQ ID NO: 5592743 - DNA, 21 bp, Homo sapiens
cccaaaggaagctttctctgc

SEQ ID NO: 5592744 - DNA, 20 bp, Homo sapiens
cccaaaggatgagaatgtga

SEQ ID NO: 5592745 - DNA, 11 bp, Homo sapiens
cccaaaggcat

SEQ ID NO: 5592746 - DNA, 21 bp, Homo sapiens
cccaaaggcatcccagcctgg

SEQ ID NO: 5592747 - DNA, 17 bp, Homo sapiens
cccaaaggcccagggag

SEQ ID NO: 5592748 - DNA, 17 bp, Homo sapiens
cccaatttaagagtcct

SEQ ID NO: 5592749 - DNA, 15 bp, Homo sapiens
cccaatttcacagag

SEQ ID NO: 5592750 - DNA, 20 bp, Homo sapiens
cccaattttaaaaaataaca

SEQ ID NO: 5592751 - DNA, 20 bp, Homo sapiens
cccacaaaaaattgctccta

SEQ ID NO: 5592752 - DNA, 15 bp, Homo sapiens
cccacaaaggcaaag

SEQ ID NO: 5592753 - DNA, 15 bp, Homo sapiens
cccacaaaggggaga

SEQ ID NO: 5592754 - DNA, 17 bp, Homo sapiens
cccacaaaggggagaag

SEQ ID NO: 5592755 - DNA, 14 bp, Homo sapiens
cccacaacacgcct

SEQ ID NO: 5592756 - DNA, 19 bp, Homo sapiens
cccacaacccaaaaggttt

SEQ ID NO: 5592757 - DNA, 18 bp, Homo sapiens
cccacaaccttcggctcc

SEQ ID NO: 5592758 - DNA, 13 bp, Homo sapiens
cccacaagaaatg

SEQ ID NO: 5592759 - DNA, 16 bp, Homo sapiens
cccacaagcaccactc

SEQ ID NO: 5592760 - DNA, 19 bp, Homo sapiens
cccacaagcaccactctgg

SEQ ID NO: 5592761 - DNA, 20 bp, Homo sapiens
cccacaagcctctgcccagg

SEQ ID NO: 5592762 - DNA, 13 bp, Homo sapiens
cccacaagcctga

SEQ ID NO: 5592763 - DNA, 15 bp, Homo sapiens
cccacaagcctgagg

SEQ ID NO: 5592764 - DNA, 16 bp, Homo sapiens
cccacaagctgcctct

SEQ ID NO: 5592765 - DNA, 19 bp, Homo sapiens
cccacaaggaaccctcagg

SEQ ID NO: 5592766 - DNA, 22 bp, Homo sapiens
cccacaaggaaccctcaggcca

SEQ ID NO: 5592767 - DNA, 13 bp, Homo sapiens
cccacaaggcctg

SEQ ID NO: 5592768 - DNA, 13 bp, Homo sapiens
cccacaagtggtg

SEQ ID NO: 5592769 - DNA, 14 bp, Homo sapiens
cccacaagtggtgg

SEQ ID NO: 5592770 - DNA, 22 bp, Homo sapiens
cccacaatataaaactgtactt

SEQ ID NO: 5592771 - DNA, 16 bp, Homo sapiens
cccacaatctgagcac

SEQ ID NO: 5592772 - DNA, 23 bp, Homo sapiens
cccacaatcttaaggggcagctt

SEQ ID NO: 5592773 - DNA, 17 bp, Homo sapiens
cccacacacacacacat

SEQ ID NO: 5592774 - DNA, 19 bp, Homo sapiens
cccacacacacacacatgc

SEQ ID NO: 5592775 - DNA, 16 bp, Homo sapiens
cccacacacactcctt

SEQ ID NO: 5592776 - DNA, 11 bp, Homo sapiens
cccacacacag

SEQ ID NO: 5592777 - DNA, 19 bp, Homo sapiens
cccacacacaggccttctg

SEQ ID NO: 5592778 - DNA, 13 bp, Homo sapiens
cccacacactcgc

SEQ ID NO: 5592779 - DNA, 15 bp, Homo sapiens
cccacacactcgccc

SEQ ID NO: 5592780 - DNA, 19 bp, Homo sapiens
cccacacactttccatctc

SEQ ID NO: 5592781 - DNA, 20 bp, Homo sapiens
cccacacactttccatctct

SEQ ID NO: 5592782 - DNA, 18 bp, Homo sapiens
cccacacagaggacctct

SEQ ID NO: 5592783 - DNA, 18 bp, Homo sapiens
cccacacagcccgagccc

SEQ ID NO: 5592784 - DNA, 12 bp, Homo sapiens
cccacacagcct

SEQ ID NO: 5592785 - DNA, 13 bp, Homo sapiens
cccacacaggcct

SEQ ID NO: 5592786 - DNA, 14 bp, Homo sapiens
cccacacaggcctg

SEQ ID NO: 5592787 - DNA, 15 bp, Homo sapiens
cccacacaggcctgg

SEQ ID NO: 5592788 - DNA, 14 bp, Homo sapiens
cccacacaggtggc

SEQ ID NO: 5592789 - DNA, 20 bp, Homo sapiens
cccacacatgtttacagaac

SEQ ID NO: 5592790 - DNA, 21 bp, Homo sapiens
cccacacatgtttacagaact

SEQ ID NO: 5592791 - DNA, 16 bp, Homo sapiens
cccacaccaccgccct

SEQ ID NO: 5592792 - DNA, 15 bp, Homo sapiens
cccacaccagccttg

SEQ ID NO: 5592793 - DNA, 18 bp, Homo sapiens
cccacacccacccttttt

SEQ ID NO: 5592794 - DNA, 15 bp, Homo sapiens
cccacacccagggct

SEQ ID NO: 5592795 - DNA, 15 bp, Homo sapiens
cccacaccccagccc

SEQ ID NO: 5592796 - DNA, 16 bp, Homo sapiens
cccacaccccagccca

SEQ ID NO: 5592797 - DNA, 22 bp, Homo sapiens
cccacaccccagcccaccctgc

SEQ ID NO: 5592798 - DNA, 22 bp, Homo sapiens
cccacaccccgtctgccccttg

SEQ ID NO: 5592799 - DNA, 14 bp, Homo sapiens
cccacaccctcggg

SEQ ID NO: 5592800 - DNA, 23 bp, Homo sapiens
cccacaccctcggggggtcacag

SEQ ID NO: 5592801 - DNA, 20 bp, Homo sapiens
cccacaccgcgtcccagctc

SEQ ID NO: 5592802 - DNA, 16 bp, Homo sapiens
cccacaccgtcttcct

SEQ ID NO: 5592803 - DNA, 13 bp, Homo sapiens
cccacacctcagt

SEQ ID NO: 5592804 - DNA, 19 bp, Homo sapiens
cccacacctccacagttca

SEQ ID NO: 5592805 - DNA, 13 bp, Homo sapiens
cccacacctcctc

SEQ ID NO: 5592806 - DNA, 17 bp, Homo sapiens
cccacacctcctctcac

SEQ ID NO: 5592807 - DNA, 18 bp, Homo sapiens
cccacacctcctctcact

SEQ ID NO: 5592808 - DNA, 15 bp, Homo sapiens
cccacacctctgcca

SEQ ID NO: 5592809 - DNA, 16 bp, Homo sapiens
cccacacctctgccag

SEQ ID NO: 5592810 - DNA, 11 bp, Homo sapiens
cccacacctgg

SEQ ID NO: 5592811 - DNA, 14 bp, Homo sapiens
cccacacctggccc

SEQ ID NO: 5592812 - DNA, 15 bp, Homo sapiens
cccacacctggccct

SEQ ID NO: 5592813 - DNA, 12 bp, Homo sapiens
cccacacctggg

SEQ ID NO: 5592814 - DNA, 17 bp, Homo sapiens
cccacaccttccagggc

SEQ ID NO: 5592815 - DNA, 18 bp, Homo sapiens
cccacacggactcccggg

SEQ ID NO: 5592816 - DNA, 22 bp, Homo sapiens
cccacacggaggcatctgcacc

SEQ ID NO: 5592817 - DNA, 23 bp, Homo sapiens
cccacacggaggcatctgcaccc

SEQ ID NO: 5592818 - DNA, 14 bp, Homo sapiens
cccacacggcagcc

SEQ ID NO: 5592819 - DNA, 20 bp, Homo sapiens
cccacacgtgctcgcagcct

SEQ ID NO: 5592820 - DNA, 22 bp, Homo sapiens
cccacactacgcagaagagaaa

SEQ ID NO: 5592821 - DNA, 14 bp, Homo sapiens
cccacactatgcac

SEQ ID NO: 5592822 - DNA, 18 bp, Homo sapiens
cccacactatgcacagag

SEQ ID NO: 5592823 - DNA, 14 bp, Homo sapiens
cccacactcactcc

SEQ ID NO: 5592824 - DNA, 12 bp, Homo sapiens
cccacactcaga

SEQ ID NO: 5592825 - DNA, 18 bp, Homo sapiens
cccacactcccccagact

SEQ ID NO: 5592826 - DNA, 14 bp, Homo sapiens
cccacactccccgc

SEQ ID NO: 5592827 - DNA, 17 bp, Homo sapiens
cccacactccccgcctt

SEQ ID NO: 5592828 - DNA, 14 bp, Homo sapiens
cccacactcctaca

SEQ ID NO: 5592829 - DNA, 17 bp, Homo sapiens
cccacactgaaaccaaa

SEQ ID NO: 5592830 - DNA, 19 bp, Homo sapiens
cccacactgaaattctaaa

SEQ ID NO: 5592831 - DNA, 19 bp, Homo sapiens
cccacactggggtgccgcc

SEQ ID NO: 5592832 - DNA, 22 bp, Homo sapiens
cccacactggggtgccgcctgc

SEQ ID NO: 5592833 - DNA, 17 bp, Homo sapiens
cccacactgtggccagg

SEQ ID NO: 5592834 - DNA, 14 bp, Homo sapiens
cccacacttccctg

SEQ ID NO: 5592835 - DNA, 19 bp, Homo sapiens
cccacacttgagaggatga

SEQ ID NO: 5592836 - DNA, 16 bp, Homo sapiens
cccacactttatatac

SEQ ID NO: 5592837 - DNA, 12 bp, Homo sapiens
cccacagaaaga

SEQ ID NO: 5592838 - DNA, 14 bp, Homo sapiens
cccacagaactgct

SEQ ID NO: 5592839 - DNA, 17 bp, Homo sapiens
cccacagaactgcttac

SEQ ID NO: 5592840 - DNA, 23 bp, Homo sapiens
cccacagactcaaatgctcagac

SEQ ID NO: 5592841 - DNA, 15 bp, Homo sapiens
cccacagactccggc

SEQ ID NO: 5592842 - DNA, 18 bp, Homo sapiens
cccacagactccggcctg

SEQ ID NO: 5592843 - DNA, 20 bp, Homo sapiens
cccacagactccggcctgta

SEQ ID NO: 5592844 - DNA, 17 bp, Homo sapiens
cccacagactgccccag

SEQ ID NO: 5592845 - DNA, 19 bp, Homo sapiens
cccacagactgccccagcc

SEQ ID NO: 5592846 - DNA, 20 bp, Homo sapiens
cccacagagatgcatgcgca

SEQ ID NO: 5592847 - DNA, 14 bp, Homo sapiens
cccacagagcctgg

SEQ ID NO: 5592848 - DNA, 23 bp, Homo sapiens
cccacagagtgccatccctgaga

SEQ ID NO: 5592849 - DNA, 20 bp, Homo sapiens
cccacagagtgctggactgt

SEQ ID NO: 5592850 - DNA, 21 bp, Homo sapiens
cccacagagtgtggtccctcc

SEQ ID NO: 5592851 - DNA, 14 bp, Homo sapiens
cccacagcacccag

SEQ ID NO: 5592852 - DNA, 18 bp, Homo sapiens
cccacagcacccaggctc

SEQ ID NO: 5592853 - DNA, 15 bp, Homo sapiens
cccacagcagcaata

SEQ ID NO: 5592854 - DNA, 12 bp, Homo sapiens
cccacagccata

SEQ ID NO: 5592855 - DNA, 15 bp, Homo sapiens
cccacagcccacgtc

SEQ ID NO: 5592856 - DNA, 22 bp, Homo sapiens
cccacagcccacgtcctgtcag

SEQ ID NO: 5592857 - DNA, 13 bp, Homo sapiens
cccacagccctga

SEQ ID NO: 5592858 - DNA, 13 bp, Homo sapiens
cccacagcctcct

SEQ ID NO: 5592859 - DNA, 14 bp, Homo sapiens
cccacagcctctgg

SEQ ID NO: 5592860 - DNA, 14 bp, Homo sapiens
cccacagcgagcct

SEQ ID NO: 5592861 - DNA, 15 bp, Homo sapiens
cccacagcgagcctg

SEQ ID NO: 5592862 - DNA, 16 bp, Homo sapiens
cccacagcgagcctgt

SEQ ID NO: 5592863 - DNA, 13 bp, Homo sapiens
cccacagcgctgg

SEQ ID NO: 5592864 - DNA, 17 bp, Homo sapiens
cccacagcgtccctggc

SEQ ID NO: 5592865 - DNA, 14 bp, Homo sapiens
cccacagctacctg

SEQ ID NO: 5592866 - DNA, 14 bp, Homo sapiens
cccacagctcagct

SEQ ID NO: 5592867 - DNA, 16 bp, Homo sapiens
cccacagctcagctgc

SEQ ID NO: 5592868 - DNA, 14 bp, Homo sapiens
cccacagctcccac

SEQ ID NO: 5592869 - DNA, 20 bp, Homo sapiens
cccacagctcccaccccacc

SEQ ID NO: 5592870 - DNA, 13 bp, Homo sapiens
cccacagctctgc

SEQ ID NO: 5592871 - DNA, 17 bp, Homo sapiens
cccacagctctgctgga

SEQ ID NO: 5592872 - DNA, 17 bp, Homo sapiens
cccacagctctgggcct

SEQ ID NO: 5592873 - DNA, 13 bp, Homo sapiens
cccacagctgggg

SEQ ID NO: 5592874 - DNA, 13 bp, Homo sapiens
cccacagcttggg

SEQ ID NO: 5592875 - DNA, 19 bp, Homo sapiens
cccacaggagcgtgtccta

SEQ ID NO: 5592876 - DNA, 13 bp, Homo sapiens
cccacaggagggc

SEQ ID NO: 5592877 - DNA, 20 bp, Homo sapiens
cccacaggcacattaactgt

SEQ ID NO: 5592878 - DNA, 13 bp, Homo sapiens
cccacaggcagct

SEQ ID NO: 5592879 - DNA, 21 bp, Homo sapiens
cccacaggccccccgcagcac

SEQ ID NO: 5592880 - DNA, 12 bp, Homo sapiens
cccacaggcctg

SEQ ID NO: 5592881 - DNA, 12 bp, Homo sapiens
cccacagggaaa

SEQ ID NO: 5592882 - DNA, 18 bp, Homo sapiens
cccacagggaccaagaag

SEQ ID NO: 5592883 - DNA, 17 bp, Homo sapiens
cccacagggcctgactt

SEQ ID NO: 5592884 - DNA, 22 bp, Homo sapiens
cccacaggtcttcactgcccag

SEQ ID NO: 5592885 - DNA, 23 bp, Homo sapiens
cccacaggtgaggggcaggacct

SEQ ID NO: 5592886 - DNA, 18 bp, Homo sapiens
cccacagtgagaggggag

SEQ ID NO: 5592887 - DNA, 15 bp, Homo sapiens
cccacagtgccaccc

SEQ ID NO: 5592888 - DNA, 19 bp, Homo sapiens
cccacagtgtcaggcactg

SEQ ID NO: 5592889 - DNA, 21 bp, Homo sapiens
cccacagtgtcaggcactggg

SEQ ID NO: 5592890 - DNA, 19 bp, Homo sapiens
cccacagttcttaatacag

SEQ ID NO: 5592891 - DNA, 15 bp, Homo sapiens
cccacagttgctcta

SEQ ID NO: 5592892 - DNA, 13 bp, Homo sapiens
cccacagttgtgt

SEQ ID NO: 5592893 - DNA, 18 bp, Homo sapiens
cccacagttgtgttcatg

SEQ ID NO: 5592894 - DNA, 16 bp, Homo sapiens
cccacagttttaataa

SEQ ID NO: 5592895 - DNA, 20 bp, Homo sapiens
cccacagttttaataagaac

SEQ ID NO: 5592896 - DNA, 19 bp, Homo sapiens
cccacataaaagccccagc

SEQ ID NO: 5592897 - DNA, 20 bp, Homo sapiens
cccacataaaagccccagct

SEQ ID NO: 5592898 - DNA, 23 bp, Homo sapiens
cccacatacgtgagggggagctg

SEQ ID NO: 5592899 - DNA, 21 bp, Homo sapiens
cccacatatcttacagccaga

SEQ ID NO: 5592900 - DNA, 16 bp, Homo sapiens
cccacatatggcacaa

SEQ ID NO: 5592901 - DNA, 13 bp, Homo sapiens
cccacatcccagg

SEQ ID NO: 5592902 - DNA, 16 bp, Homo sapiens
cccacatcccaggctt

SEQ ID NO: 5592903 - DNA, 20 bp, Homo sapiens
cccacatcccaggcttcacc

SEQ ID NO: 5592904 - DNA, 12 bp, Homo sapiens
cccacatccccc

SEQ ID NO: 5592905 - DNA, 20 bp, Homo sapiens
cccacatccctgggcctgct

SEQ ID NO: 5592906 - DNA, 22 bp, Homo sapiens
cccacatccctgggcctgctgc

SEQ ID NO: 5592907 - DNA, 21 bp, Homo sapiens
cccacatccttctcactgcca

SEQ ID NO: 5592908 - DNA, 20 bp, Homo sapiens
cccacatgaggccatctcag

SEQ ID NO: 5592909 - DNA, 15 bp, Homo sapiens
cccacatgcatgtct

SEQ ID NO: 5592910 - DNA, 23 bp, Homo sapiens
cccacatgcatgtctgcctatgc

SEQ ID NO: 5592911 - DNA, 12 bp, Homo sapiens
cccacatgccag

SEQ ID NO: 5592912 - DNA, 18 bp, Homo sapiens
cccacatgcctgcgcctg

SEQ ID NO: 5592913 - DNA, 23 bp, Homo sapiens
cccacatggccatcttctttctt

SEQ ID NO: 5592914 - DNA, 17 bp, Homo sapiens
cccacatgggacctggc

SEQ ID NO: 5592915 - DNA, 14 bp, Homo sapiens
cccacatgtccagc

SEQ ID NO: 5592916 - DNA, 17 bp, Homo sapiens
cccacatgtgtccatcc

SEQ ID NO: 5592917 - DNA, 19 bp, Homo sapiens
cccacattctggctccacc

SEQ ID NO: 5592918 - DNA, 15 bp, Homo sapiens
cccacattgcccaca

SEQ ID NO: 5592919 - DNA, 14 bp, Homo sapiens
cccacattggaccc

SEQ ID NO: 5592920 - DNA, 21 bp, Homo sapiens
cccacatttacctcgaggctc

SEQ ID NO: 5592921 - DNA, 21 bp, Homo sapiens
cccacatttgtgccgacactg

SEQ ID NO: 5592922 - DNA, 23 bp, Homo sapiens
cccacatttgtgccgacactgtt

SEQ ID NO: 5592923 - DNA, 16 bp, Homo sapiens
cccaccaaactgcaca

SEQ ID NO: 5592924 - DNA, 15 bp, Homo sapiens
cccaccaacctccag

SEQ ID NO: 5592925 - DNA, 15 bp, Homo sapiens
cccaccaactctctc

SEQ ID NO: 5592926 - DNA, 19 bp, Homo sapiens
cccaccaaggtctcacact

SEQ ID NO: 5592927 - DNA, 20 bp, Homo sapiens
cccaccaaggtctcacactc

SEQ ID NO: 5592928 - DNA, 20 bp, Homo sapiens
cccactgtggggcaagcctg

SEQ ID NO: 5592929 - DNA, 21 bp, Homo sapiens
cccactgtttctcttgagctg

SEQ ID NO: 5592930 - DNA, 22 bp, Homo sapiens
cccactgtttctcttgagctgg

SEQ ID NO: 5592931 - DNA, 20 bp, Homo sapiens
cccacttagccgcaccctgc

SEQ ID NO: 5592932 - DNA, 21 bp, Homo sapiens
cccacttagccgtccatggca

SEQ ID NO: 5592933 - DNA, 15 bp, Homo sapiens
cccacttagtccact

SEQ ID NO: 5592934 - DNA, 20 bp, Homo sapiens
cccacttagtccactctgag

SEQ ID NO: 5592935 - DNA, 14 bp, Homo sapiens
cccacttccattcc

SEQ ID NO: 5592936 - DNA, 19 bp, Homo sapiens
cccacttcccctcctaccc

SEQ ID NO: 5592937 - DNA, 16 bp, Homo sapiens
cccacttccctgacac

SEQ ID NO: 5592938 - DNA, 19 bp, Homo sapiens
cccacttccctgacactgc

SEQ ID NO: 5592939 - DNA, 15 bp, Homo sapiens
cccacttccctgggc

SEQ ID NO: 5592940 - DNA, 14 bp, Homo sapiens
cccacttcctttcc

SEQ ID NO: 5592941 - DNA, 16 bp, Homo sapiens
cccacttcctttccta

SEQ ID NO: 5592942 - DNA, 21 bp, Homo sapiens
cccacttctcatcacacacat

SEQ ID NO: 5592943 - DNA, 22 bp, Homo sapiens
cccacttctcatcacacacatg

SEQ ID NO: 5592944 - DNA, 23 bp, Homo sapiens
cccacttctcatcacacacatgg

SEQ ID NO: 5592945 - DNA, 23 bp, Homo sapiens
cccacttctccttcgctttcctg

SEQ ID NO: 5592946 - DNA, 14 bp, Homo sapiens
cccacttctctcca

SEQ ID NO: 5592947 - DNA, 18 bp, Homo sapiens
cccacttctctccaggct

SEQ ID NO: 5592948 - DNA, 14 bp, Homo sapiens
cccacttctgcact

SEQ ID NO: 5592949 - DNA, 14 bp, Homo sapiens
cccacttctgccag

SEQ ID NO: 5592950 - DNA, 13 bp, Homo sapiens
cccacttctggca

SEQ ID NO: 5592951 - DNA, 18 bp, Homo sapiens
cccacttctggcatggga

SEQ ID NO: 5592952 - DNA, 14 bp, Homo sapiens
cccacttctggcca

SEQ ID NO: 5592953 - DNA, 15 bp, Homo sapiens
cccacttctggcctc

SEQ ID NO: 5592954 - DNA, 16 bp, Homo sapiens
cccacttctggcctcc

SEQ ID NO: 5592955 - DNA, 18 bp, Homo sapiens
cccacttctggcctccag

SEQ ID NO: 5592956 - DNA, 14 bp, Homo sapiens
cccacttctgtgta

SEQ ID NO: 5592957 - DNA, 16 bp, Homo sapiens
cccacttgcagtcttg

SEQ ID NO: 5592958 - DNA, 13 bp, Homo sapiens
cccacttgcctct

SEQ ID NO: 5592959 - DNA, 21 bp, Homo sapiens
cccacttgcctcttccttgaa

SEQ ID NO: 5592960 - DNA, 12 bp, Homo sapiens
cccacttgcctg

SEQ ID NO: 5592961 - DNA, 22 bp, Homo sapiens
cccacttgcctgtcaccccagt

SEQ ID NO: 5592962 - DNA, 13 bp, Homo sapiens
cccacttgggagc

SEQ ID NO: 5592963 - DNA, 22 bp, Homo sapiens
cccacttgtcactgacacaaag

SEQ ID NO: 5592964 - DNA, 16 bp, Homo sapiens
cccacttgtcatccat

SEQ ID NO: 5592965 - DNA, 17 bp, Homo sapiens
cccactttcatctacct

SEQ ID NO: 5592966 - DNA, 19 bp, Homo sapiens
cccactttcctacaaaatg

SEQ ID NO: 5592967 - DNA, 14 bp, Homo sapiens
cccactttcctgag

SEQ ID NO: 5592968 - DNA, 17 bp, Homo sapiens
cccactttcctgagctg

SEQ ID NO: 5592969 - DNA, 19 bp, Homo sapiens
cccactttcctgagctgtc

SEQ ID NO: 5592970 - DNA, 21 bp, Homo sapiens
cccactttcctgagctgtcgc

SEQ ID NO: 5592971 - DNA, 15 bp, Homo sapiens
cccactttcgcctcc

SEQ ID NO: 5592972 - DNA, 18 bp, Homo sapiens
cccactttcgcctcctcc

SEQ ID NO: 5592973 - DNA, 21 bp, Homo sapiens
cccactttcgcctcctccagc

SEQ ID NO: 5592974 - DNA, 16 bp, Homo sapiens
cccactttcttctacc

SEQ ID NO: 5592975 - DNA, 17 bp, Homo sapiens
cccactttgtctgtaca

SEQ ID NO: 5592976 - DNA, 21 bp, Homo sapiens
cccactttgtctgtacatact

SEQ ID NO: 5592977 - DNA, 22 bp, Homo sapiens
cccactttttggtaatatatat

SEQ ID NO: 5592978 - DNA, 14 bp, Homo sapiens
cccagaaaaaaagc

SEQ ID NO: 5592979 - DNA, 19 bp, Homo sapiens
cccagaaaaactggctctg

SEQ ID NO: 5592980 - DNA, 17 bp, Homo sapiens
cccagaaaacctccagt

SEQ ID NO: 5592981 - DNA, 15 bp, Homo sapiens
cccagaaaaggacag

SEQ ID NO: 5592982 - DNA, 16 bp, Homo sapiens
cccagaaaaggacaga

SEQ ID NO: 5592983 - DNA, 15 bp, Homo sapiens
cccagaaaatgaaat

SEQ ID NO: 5592984 - DNA, 14 bp, Homo sapiens
cccagaaacaacag

SEQ ID NO: 5592985 - DNA, 19 bp, Homo sapiens
cccagaaagattttctcca

SEQ ID NO: 5592986 - DNA, 20 bp, Homo sapiens
cccagaaagcctcctgcccc

SEQ ID NO: 5592987 - DNA, 13 bp, Homo sapiens
cccagaaagctgc

SEQ ID NO: 5592988 - DNA, 18 bp, Homo sapiens
cccagaaagctgccagag

SEQ ID NO: 5592989 - DNA, 15 bp, Homo sapiens
cccagaaaggagact

SEQ ID NO: 5592990 - DNA, 17 bp, Homo sapiens
cccagaaaggagactag

SEQ ID NO: 5592991 - DNA, 14 bp, Homo sapiens
cccagaaatcactg

SEQ ID NO: 5592992 - DNA, 16 bp, Homo sapiens
cccagaaatcactgtg

SEQ ID NO: 5592993 - DNA, 19 bp, Homo sapiens
cccagaaatcactgtgaaa

SEQ ID NO: 5592994 - DNA, 18 bp, Homo sapiens
cccagaaatgccgctgtg

SEQ ID NO: 5592995 - DNA, 21 bp, Homo sapiens
cccagaaatgccgctgtgtcc

SEQ ID NO: 5592996 - DNA, 16 bp, Homo sapiens
cccagaaattccttcc

SEQ ID NO: 5592997 - DNA, 18 bp, Homo sapiens
cccagaaattccttccca

SEQ ID NO: 5592998 - DNA, 17 bp, Homo sapiens
cccagaaattctggccc

SEQ ID NO: 5592999 - DNA, 22 bp, Homo sapiens
cccagaaattctggcccagcca

SEQ ID NO: 5593000 - DNA, 18 bp, Homo sapiens
cccagaacaaaaagaaat

SEQ ID NO: 5593001 - DNA, 20 bp, Homo sapiens
cccagaacaaaaagaaatct

SEQ ID NO: 5593002 - DNA, 22 bp, Homo sapiens
cccagaacacactccatcagct

SEQ ID NO: 5593003 - DNA, 19 bp, Homo sapiens
cccagaacatacactgtga

SEQ ID NO: 5593004 - DNA, 20 bp, Homo sapiens
cccagaacatacactgtgaa

SEQ ID NO: 5593005 - DNA, 14 bp, Homo sapiens
cccagaaccacaga

SEQ ID NO: 5593006 - DNA, 15 bp, Homo sapiens
cccagaaccacagat

SEQ ID NO: 5593007 - DNA, 14 bp, Homo sapiens
cccagaacccacat

SEQ ID NO: 5593008 - DNA, 22 bp, Homo sapiens
cccagaacctctaagtgctgct

SEQ ID NO: 5593009 - DNA, 18 bp, Homo sapiens
cccagaaccttgatgggg

SEQ ID NO: 5593010 - DNA, 17 bp, Homo sapiens
cccagaacgcatgcagg

SEQ ID NO: 5593011 - DNA, 17 bp, Homo sapiens
cccagaacgggcctccc

SEQ ID NO: 5593012 - DNA, 16 bp, Homo sapiens
cccagaactattctgg

SEQ ID NO: 5593013 - DNA, 17 bp, Homo sapiens
cccagaactctgcctgc

SEQ ID NO: 5593014 - DNA, 15 bp, Homo sapiens
cccagaactgccccc

SEQ ID NO: 5593015 - DNA, 19 bp, Homo sapiens
cccagaactgcccccactg

SEQ ID NO: 5593016 - DNA, 14 bp, Homo sapiens
cccagaactggctg

SEQ ID NO: 5593017 - DNA, 15 bp, Homo sapiens
cccagaacttccctg

SEQ ID NO: 5593018 - DNA, 22 bp, Homo sapiens
cccagaagatgtattcagagcc

SEQ ID NO: 5593019 - DNA, 23 bp, Homo sapiens
cccagaagatgtattcagagcca

SEQ ID NO: 5593020 - DNA, 20 bp, Homo sapiens
cccagaagctcaaggctgca

SEQ ID NO: 5593021 - DNA, 21 bp, Homo sapiens
cccagaaggaacccggtccca

SEQ ID NO: 5593022 - DNA, 22 bp, Homo sapiens
cccagaaggctgggtccagggg

SEQ ID NO: 5593023 - DNA, 21 bp, Homo sapiens
cccagaagggagttgctcact

SEQ ID NO: 5593024 - DNA, 23 bp, Homo sapiens
cccagaagggagttgctcactca

SEQ ID NO: 5593025 - DNA, 19 bp, Homo sapiens
cccagaataagttattgca

SEQ ID NO: 5593026 - DNA, 22 bp, Homo sapiens
cccagaataagttattgcagtt

SEQ ID NO: 5593027 - DNA, 12 bp, Homo sapiens
cccagaatcaaa

SEQ ID NO: 5593028 - DNA, 15 bp, Homo sapiens
cccagaatcccagcc

SEQ ID NO: 5593029 - DNA, 15 bp, Homo sapiens
cccagaatccctcta

SEQ ID NO: 5593030 - DNA, 14 bp, Homo sapiens
cccagaatctctga

SEQ ID NO: 5593031 - DNA, 18 bp, Homo sapiens
cccagaatgagacatcca

SEQ ID NO: 5593032 - DNA, 18 bp, Homo sapiens
cccagaatgcctcctgca

SEQ ID NO: 5593033 - DNA, 14 bp, Homo sapiens
cccagaatggagcc

SEQ ID NO: 5593034 - DNA, 21 bp, Homo sapiens
cccagaatggagcctgctctc

SEQ ID NO: 5593035 - DNA, 20 bp, Homo sapiens
cccagaatttaccatcatct

SEQ ID NO: 5593036 - DNA, 19 bp, Homo sapiens
cccagacaaggagagcgga

SEQ ID NO: 5593037 - DNA, 14 bp, Homo sapiens
cccagacacagact

SEQ ID NO: 5593038 - DNA, 22 bp, Homo sapiens
cccagacacagactggcaataa

SEQ ID NO: 5593039 - DNA, 14 bp, Homo sapiens
cccagacacatggg

SEQ ID NO: 5593040 - DNA, 18 bp, Homo sapiens
cccagacacattctcctg

SEQ ID NO: 5593041 - DNA, 15 bp, Homo sapiens
cccagacaccacaga

SEQ ID NO: 5593042 - DNA, 20 bp, Homo sapiens
cccagacagacatctctgca

SEQ ID NO: 5593043 - DNA, 21 bp, Homo sapiens
cccagacagctccctctgcct

SEQ ID NO: 5593044 - DNA, 14 bp, Homo sapiens
cccagacagctgct

SEQ ID NO: 5593045 - DNA, 20 bp, Homo sapiens
cccagacagctgctcagagc

SEQ ID NO: 5593046 - DNA, 14 bp, Homo sapiens
cccagacagctgga

SEQ ID NO: 5593047 - DNA, 16 bp, Homo sapiens
cccagacagctggacc

SEQ ID NO: 5593048 - DNA, 18 bp, Homo sapiens
cccagacagggctccagc

SEQ ID NO: 5593049 - DNA, 21 bp, Homo sapiens
cccagacagggctccagcctg

SEQ ID NO: 5593050 - DNA, 19 bp, Homo sapiens
cccagacatgctgcccacc

SEQ ID NO: 5593051 - DNA, 18 bp, Homo sapiens
cccagaccaaccctggga

SEQ ID NO: 5593052 - DNA, 15 bp, Homo sapiens
cccagaccaatggca

SEQ ID NO: 5593053 - DNA, 22 bp, Homo sapiens
cccagaccacctccctgccctg

SEQ ID NO: 5593054 - DNA, 15 bp, Homo sapiens
cccagaccagtagtg

SEQ ID NO: 5593055 - DNA, 16 bp, Homo sapiens
cccagaccagtagtga

SEQ ID NO: 5593056 - DNA, 23 bp, Homo sapiens
cccagaccagtagtgaccaatcg

SEQ ID NO: 5593057 - DNA, 23 bp, Homo sapiens
cccagacccaactcgcctgtgga

SEQ ID NO: 5593058 - DNA, 14 bp, Homo sapiens
cccagacccagagg

SEQ ID NO: 5593059 - DNA, 13 bp, Homo sapiens
cccagacccaggg

SEQ ID NO: 5593060 - DNA, 15 bp, Homo sapiens
cccagacccagggca

SEQ ID NO: 5593061 - DNA, 17 bp, Homo sapiens
cccagacccagggcagt

SEQ ID NO: 5593062 - DNA, 13 bp, Homo sapiens
cccagacccagtg

SEQ ID NO: 5593063 - DNA, 14 bp, Homo sapiens
cccagacccagtgg

SEQ ID NO: 5593064 - DNA, 14 bp, Homo sapiens
cccagaccccaggg

SEQ ID NO: 5593065 - DNA, 17 bp, Homo sapiens
cccagaccccatccagc

SEQ ID NO: 5593066 - DNA, 20 bp, Homo sapiens
cccagacccctctggccagg

SEQ ID NO: 5593067 - DNA, 21 bp, Homo sapiens
cccagacccctctggccagga

SEQ ID NO: 5593068 - DNA, 13 bp, Homo sapiens
cccagaccctcct

SEQ ID NO: 5593069 - DNA, 19 bp, Homo sapiens
cccagaccctccttcccca

SEQ ID NO: 5593070 - DNA, 21 bp, Homo sapiens
cccagaccctccttccccacc

SEQ ID NO: 5593071 - DNA, 17 bp, Homo sapiens
cccagaccctggaggaa

SEQ ID NO: 5593072 - DNA, 19 bp, Homo sapiens
cccagacccttcttgcctg

SEQ ID NO: 5593073 - DNA, 13 bp, Homo sapiens
cccagaccggctt

SEQ ID NO: 5593074 - DNA, 16 bp, Homo sapiens
cccagaccggcttctc

SEQ ID NO: 5593075 - DNA, 10 bp, Homo sapiens
cccagacctc

SEQ ID NO: 5593076 - DNA, 13 bp, Homo sapiens
cccagacctgccg

SEQ ID NO: 5593077 - DNA, 14 bp, Homo sapiens
cccagacctgcctc

SEQ ID NO: 5593078 - DNA, 14 bp, Homo sapiens
cccagacctggcct

SEQ ID NO: 5593079 - DNA, 15 bp, Homo sapiens
cccagacctggcctc

SEQ ID NO: 5593080 - DNA, 17 bp, Homo sapiens
cccagacctggcctctg

SEQ ID NO: 5593081 - DNA, 21 bp, Homo sapiens
cccagacctgtcgtctctccc

SEQ ID NO: 5593082 - DNA, 18 bp, Homo sapiens
cccagaccttaagacact

SEQ ID NO: 5593083 - DNA, 21 bp, Homo sapiens
cccagaccttttatccactta

SEQ ID NO: 5593084 - DNA, 15 bp, Homo sapiens
cccagacgatgtctt

SEQ ID NO: 5593085 - DNA, 17 bp, Homo sapiens
cccagacgatgtcttca

SEQ ID NO: 5593086 - DNA, 15 bp, Homo sapiens
cccagacgcctggct

SEQ ID NO: 5593087 - DNA, 22 bp, Homo sapiens
cccagactaaaggatccagaga

SEQ ID NO: 5593088 - DNA, 23 bp, Homo sapiens
cccagactaaaggatccagagag

SEQ ID NO: 5593089 - DNA, 17 bp, Homo sapiens
cccagactactattttc

SEQ ID NO: 5593090 - DNA, 17 bp, Homo sapiens
cccagactcagagggaa

SEQ ID NO: 5593091 - DNA, 13 bp, Homo sapiens
cccagactccagg

SEQ ID NO: 5593092 - DNA, 20 bp, Homo sapiens
cccagactcctttcctctga

SEQ ID NO: 5593093 - DNA, 15 bp, Homo sapiens
cccagactctgccta

SEQ ID NO: 5593094 - DNA, 14 bp, Homo sapiens
cccagactgagctc

SEQ ID NO: 5593095 - DNA, 18 bp, Homo sapiens
cccagactgagctctcca

SEQ ID NO: 5593096 - DNA, 21 bp, Homo sapiens
cccagactgagctctccaggc

SEQ ID NO: 5593097 - DNA, 22 bp, Homo sapiens
cccagactgagctctccaggcc

SEQ ID NO: 5593098 - DNA, 14 bp, Homo sapiens
cccagactgatgag

SEQ ID NO: 5593099 - DNA, 16 bp, Homo sapiens
cccagactgatgagca

SEQ ID NO: 5593100 - DNA, 21 bp, Homo sapiens
cccagactggagtgcagtggt

SEQ ID NO: 5593101 - DNA, 17 bp, Homo sapiens
cccagactgggcccagg

SEQ ID NO: 5593102 - DNA, 10 bp, Homo sapiens
cccagacttg

SEQ ID NO: 5593103 - DNA, 15 bp, Homo sapiens
cccagacttgcactg

SEQ ID NO: 5593104 - DNA, 23 bp, Homo sapiens
cccagacttgcactggggtggga

SEQ ID NO: 5593105 - DNA, 23 bp, Homo sapiens
cccagacttgctgaatcggaatc

SEQ ID NO: 5593106 - DNA, 16 bp, Homo sapiens
cccagctagggctgga

SEQ ID NO: 5593107 - DNA, 17 bp, Homo sapiens
cccagctagggctggac

SEQ ID NO: 5593108 - DNA, 18 bp, Homo sapiens
cccagctatggccccagg

SEQ ID NO: 5593109 - DNA, 21 bp, Homo sapiens
cccagctatggccccagggtt

SEQ ID NO: 5593110 - DNA, 19 bp, Homo sapiens
cccagctcagagccccgcc

SEQ ID NO: 5593111 - DNA, 16 bp, Homo sapiens
cccagctcaggggcag

SEQ ID NO: 5593112 - DNA, 23 bp, Homo sapiens
cccagctcatgtaggtgagcctg

SEQ ID NO: 5593113 - DNA, 16 bp, Homo sapiens
cccagctccactcagg

SEQ ID NO: 5593114 - DNA, 18 bp, Homo sapiens
cccagctccactcagggc

SEQ ID NO: 5593115 - DNA, 19 bp, Homo sapiens
cccagctccactcagggct

SEQ ID NO: 5593116 - DNA, 22 bp, Homo sapiens
cccagctccactcagggctggc

SEQ ID NO: 5593117 - DNA, 13 bp, Homo sapiens
cccagctccagca

SEQ ID NO: 5593118 - DNA, 12 bp, Homo sapiens
cccagctccagg

SEQ ID NO: 5593119 - DNA, 14 bp, Homo sapiens
cccagctccaggca

SEQ ID NO: 5593120 - DNA, 17 bp, Homo sapiens
cccagctccaggcagga

SEQ ID NO: 5593121 - DNA, 16 bp, Homo sapiens
cccagctccaggggcc

SEQ ID NO: 5593122 - DNA, 18 bp, Homo sapiens
cccagctccaggggccct

SEQ ID NO: 5593123 - DNA, 12 bp, Homo sapiens
cccagctcccca

SEQ ID NO: 5593124 - DNA, 14 bp, Homo sapiens
cccagctcccccag

SEQ ID NO: 5593125 - DNA, 19 bp, Homo sapiens
cccagctcccccaggcaga

SEQ ID NO: 5593126 - DNA, 19 bp, Homo sapiens
cccagctcccccgggaggg

SEQ ID NO: 5593127 - DNA, 13 bp, Homo sapiens
cccagctcccctc

SEQ ID NO: 5593128 - DNA, 17 bp, Homo sapiens
cccagctcccctctttt

SEQ ID NO: 5593129 - DNA, 14 bp, Homo sapiens
cccagctccctgca

SEQ ID NO: 5593130 - DNA, 22 bp, Homo sapiens
cccagctccgacctctctcagc

SEQ ID NO: 5593131 - DNA, 12 bp, Homo sapiens
cccagctccgga

SEQ ID NO: 5593132 - DNA, 12 bp, Homo sapiens
cccagctcctcg

SEQ ID NO: 5593133 - DNA, 13 bp, Homo sapiens
cccagctcctctg

SEQ ID NO: 5593134 - DNA, 15 bp, Homo sapiens
cccagctcctctgag

SEQ ID NO: 5593135 - DNA, 16 bp, Homo sapiens
cccagctcctctgagc

SEQ ID NO: 5593136 - DNA, 20 bp, Homo sapiens
cccagctcctctgagccata

SEQ ID NO: 5593137 - DNA, 21 bp, Homo sapiens
cccagctcctctgagccatac

SEQ ID NO: 5593138 - DNA, 17 bp, Homo sapiens
cccagctcctcttcctg

SEQ ID NO: 5593139 - DNA, 18 bp, Homo sapiens
cccagctcctcttcctgc

SEQ ID NO: 5593140 - DNA, 11 bp, Homo sapiens
cccagctcctg

SEQ ID NO: 5593141 - DNA, 16 bp, Homo sapiens
cccagctcctgaataa

SEQ ID NO: 5593142 - DNA, 20 bp, Homo sapiens
cccagctcctgacactgctg

SEQ ID NO: 5593143 - DNA, 22 bp, Homo sapiens
cccagctcctgacactgctgga

SEQ ID NO: 5593144 - DNA, 20 bp, Homo sapiens
cccagctccttggctgcagc

SEQ ID NO: 5593145 - DNA, 21 bp, Homo sapiens
cccagctccttggctgcagcc

SEQ ID NO: 5593146 - DNA, 23 bp, Homo sapiens
cccagctccttggctgcagccat

SEQ ID NO: 5593147 - DNA, 22 bp, Homo sapiens
cccagctcctttctcctgtgaa

SEQ ID NO: 5593148 - DNA, 23 bp, Homo sapiens
cccagctcctttctcctgtgaat

SEQ ID NO: 5593149 - DNA, 20 bp, Homo sapiens
cccagctccttttgtcccca

SEQ ID NO: 5593150 - DNA, 13 bp, Homo sapiens
cccagctctaagc

SEQ ID NO: 5593151 - DNA, 19 bp, Homo sapiens
cccagctctacattctgct

SEQ ID NO: 5593152 - DNA, 22 bp, Homo sapiens
cccagctctacattctgctctg

SEQ ID NO: 5593153 - DNA, 16 bp, Homo sapiens
cccagctctactccag

SEQ ID NO: 5593154 - DNA, 18 bp, Homo sapiens
cccagctctagcctctgg

SEQ ID NO: 5593155 - DNA, 22 bp, Homo sapiens
cccagctctagcctctggactg

SEQ ID NO: 5593156 - DNA, 13 bp, Homo sapiens
cccagctctcagg

SEQ ID NO: 5593157 - DNA, 15 bp, Homo sapiens
cccagctctcagggc

SEQ ID NO: 5593158 - DNA, 12 bp, Homo sapiens
cccagctctccc

SEQ ID NO: 5593159 - DNA, 13 bp, Homo sapiens
cccagctctccca

SEQ ID NO: 5593160 - DNA, 13 bp, Homo sapiens
cccagctctccct

SEQ ID NO: 5593161 - DNA, 13 bp, Homo sapiens
cccagctctctga

SEQ ID NO: 5593162 - DNA, 19 bp, Homo sapiens
cccagctctcttctggctt

SEQ ID NO: 5593163 - DNA, 11 bp, Homo sapiens
cccagctctga

SEQ ID NO: 5593164 - DNA, 22 bp, Homo sapiens
cccagctctgaaaccagtgtta

SEQ ID NO: 5593165 - DNA, 14 bp, Homo sapiens
cccagctctgaccc

SEQ ID NO: 5593166 - DNA, 22 bp, Homo sapiens
cccagctctgaggactgcacca

SEQ ID NO: 5593167 - DNA, 14 bp, Homo sapiens
cccagctctgaggg

SEQ ID NO: 5593168 - DNA, 20 bp, Homo sapiens
cccagctctgaggggagggg

SEQ ID NO: 5593169 - DNA, 12 bp, Homo sapiens
cccagctctgcg

SEQ ID NO: 5593170 - DNA, 14 bp, Homo sapiens
cccagctctggtcc

SEQ ID NO: 5593171 - DNA, 18 bp, Homo sapiens
cccagctctggtccatag

SEQ ID NO: 5593172 - DNA, 23 bp, Homo sapiens
cccagctctggtccatagagagc

SEQ ID NO: 5593173 - DNA, 19 bp, Homo sapiens
cccagctcttgctctcttg

SEQ ID NO: 5593174 - DNA, 22 bp, Homo sapiens
cccagctctttgttcagttgac

SEQ ID NO: 5593175 - DNA, 17 bp, Homo sapiens
cccagctgaaggcagtg

SEQ ID NO: 5593176 - DNA, 17 bp, Homo sapiens
cccagctgacagtcctc

SEQ ID NO: 5593177 - DNA, 14 bp, Homo sapiens
cccagctgactgtg

SEQ ID NO: 5593178 - DNA, 13 bp, Homo sapiens
cccagctgaggct

SEQ ID NO: 5593179 - DNA, 21 bp, Homo sapiens
cccagctgattagtgtctaag

SEQ ID NO: 5593180 - DNA, 11 bp, Homo sapiens
cccagctgcac

SEQ ID NO: 5593181 - DNA, 13 bp, Homo sapiens
cccagctgcaccc

SEQ ID NO: 5593182 - DNA, 21 bp, Homo sapiens
cccagctgcacctgccagcct

SEQ ID NO: 5593183 - DNA, 15 bp, Homo sapiens
cccagctgccaggcg

SEQ ID NO: 5593184 - DNA, 18 bp, Homo sapiens
cccagctgccaggcggcc

SEQ ID NO: 5593185 - DNA, 15 bp, Homo sapiens
cccagctgcccctcc

SEQ ID NO: 5593186 - DNA, 17 bp, Homo sapiens
cccagctgcccctccct

SEQ ID NO: 5593187 - DNA, 12 bp, Homo sapiens
cccagctgcctg

SEQ ID NO: 5593188 - DNA, 19 bp, Homo sapiens
cccagctgcctggagaggg

SEQ ID NO: 5593189 - DNA, 20 bp, Homo sapiens
cccagctgcctggagagggt

SEQ ID NO: 5593190 - DNA, 20 bp, Homo sapiens
cccagctgcgtttttttata

SEQ ID NO: 5593191 - DNA, 16 bp, Homo sapiens
cccagctgctcccctg

SEQ ID NO: 5593192 - DNA, 21 bp, Homo sapiens
cccagctgctcccctgccacg

SEQ ID NO: 5593193 - DNA, 13 bp, Homo sapiens
cccagctgctcct

SEQ ID NO: 5593194 - DNA, 17 bp, Homo sapiens
cccagctgctcctcgca

SEQ ID NO: 5593195 - DNA, 22 bp, Homo sapiens
cccagctgctctaagcccagga

SEQ ID NO: 5593196 - DNA, 15 bp, Homo sapiens
cccagctgctctgcc

SEQ ID NO: 5593197 - DNA, 15 bp, Homo sapiens
cccagctgcttgtgt

SEQ ID NO: 5593198 - DNA, 12 bp, Homo sapiens
cccagctggcag

SEQ ID NO: 5593199 - DNA, 15 bp, Homo sapiens
cccagctggcagcgc

SEQ ID NO: 5593200 - DNA, 19 bp, Homo sapiens
cccagctggcagcgcctcc

SEQ ID NO: 5593201 - DNA, 20 bp, Homo sapiens
cccagctggcagcgcctccc

SEQ ID NO: 5593202 - DNA, 14 bp, Homo sapiens
cccagctggccgga

SEQ ID NO: 5593203 - DNA, 20 bp, Homo sapiens
cccagctggccggaaggaga

SEQ ID NO: 5593204 - DNA, 12 bp, Homo sapiens
cccagctggcct

SEQ ID NO: 5593205 - DNA, 23 bp, Homo sapiens
cccagctggcctggcccccagct

SEQ ID NO: 5593206 - DNA, 15 bp, Homo sapiens
cccagctggctgggt

SEQ ID NO: 5593207 - DNA, 11 bp, Homo sapiens
cccagctggga

SEQ ID NO: 5593208 - DNA, 18 bp, Homo sapiens
cccagctgggaggcaaga

SEQ ID NO: 5593209 - DNA, 18 bp, Homo sapiens
cccagctgggctctgcca

SEQ ID NO: 5593210 - DNA, 22 bp, Homo sapiens
cccagctgggctctgccaccct

SEQ ID NO: 5593211 - DNA, 23 bp, Homo sapiens
cccagctggggccaggctgggtc

SEQ ID NO: 5593212 - DNA, 12 bp, Homo sapiens
cccagctgggtc

SEQ ID NO: 5593213 - DNA, 19 bp, Homo sapiens
cccagctgggtcaggcagg

SEQ ID NO: 5593214 - DNA, 17 bp, Homo sapiens
cccagctggtcctgtgg

SEQ ID NO: 5593215 - DNA, 18 bp, Homo sapiens
cccagctggtcctgtgga

SEQ ID NO: 5593216 - DNA, 23 bp, Homo sapiens
cccagctggtcctgtggatggga

SEQ ID NO: 5593217 - DNA, 16 bp, Homo sapiens
cccagctggtgggaag

SEQ ID NO: 5593218 - DNA, 19 bp, Homo sapiens
cccagctggtgggaagcgt

SEQ ID NO: 5593219 - DNA, 22 bp, Homo sapiens
cccagctggtgggaagcgtctg

SEQ ID NO: 5593220 - DNA, 17 bp, Homo sapiens
cccagctgtagccatgg

SEQ ID NO: 5593221 - DNA, 19 bp, Homo sapiens
cccagctgtagccatggct

SEQ ID NO: 5593222 - DNA, 20 bp, Homo sapiens
cccagctgtagccatggctc

SEQ ID NO: 5593223 - DNA, 23 bp, Homo sapiens
cccagctgtagccatggctcagg

SEQ ID NO: 5593224 - DNA, 15 bp, Homo sapiens
cccagctgtctgtgt

SEQ ID NO: 5593225 - DNA, 23 bp, Homo sapiens
cccagctgtctgtgtcagcctgt

SEQ ID NO: 5593226 - DNA, 15 bp, Homo sapiens
cccagctgtgagcct

SEQ ID NO: 5593227 - DNA, 17 bp, Homo sapiens
cccagctgtgagccttg

SEQ ID NO: 5593228 - DNA, 18 bp, Homo sapiens
cccagctgtgagccttgg

SEQ ID NO: 5593229 - DNA, 18 bp, Homo sapiens
cccagctgtgctgggagg

SEQ ID NO: 5593230 - DNA, 22 bp, Homo sapiens
cccagctgtgcttatggtacca

SEQ ID NO: 5593231 - DNA, 23 bp, Homo sapiens
cccagctgtgggcggctcctggt

SEQ ID NO: 5593232 - DNA, 21 bp, Homo sapiens
cccagcttcaaagcttaaaaa

SEQ ID NO: 5593233 - DNA, 20 bp, Homo sapiens
cccagcttcacctctgggac

SEQ ID NO: 5593234 - DNA, 19 bp, Homo sapiens
cccagcttccagcaggagg

SEQ ID NO: 5593235 - DNA, 19 bp, Homo sapiens
cccagcttctctctccctg

SEQ ID NO: 5593236 - DNA, 20 bp, Homo sapiens
cccagcttctctctccctgt

SEQ ID NO: 5593237 - DNA, 15 bp, Homo sapiens
cccagcttgaaacct

SEQ ID NO: 5593238 - DNA, 14 bp, Homo sapiens
cccagcttgctgag

SEQ ID NO: 5593239 - DNA, 15 bp, Homo sapiens
cccagcttgctgagg

SEQ ID NO: 5593240 - DNA, 13 bp, Homo sapiens
cccagcttggctc

SEQ ID NO: 5593241 - DNA, 22 bp, Homo sapiens
cccagcttgggcagatctccca

SEQ ID NO: 5593242 - DNA, 23 bp, Homo sapiens
cccagcttgggcccagctgggct

SEQ ID NO: 5593243 - DNA, 18 bp, Homo sapiens
cccagcttgtaggagctg

SEQ ID NO: 5593244 - DNA, 17 bp, Homo sapiens
cccagctttaaaaagaa

SEQ ID NO: 5593245 - DNA, 19 bp, Homo sapiens
cccagctttaaaaagaaaa

SEQ ID NO: 5593246 - DNA, 15 bp, Homo sapiens
cccagctttatctgt

SEQ ID NO: 5593247 - DNA, 18 bp, Homo sapiens
cccagctttatctgtcac

SEQ ID NO: 5593248 - DNA, 20 bp, Homo sapiens
cccagctttatctgtcacac

SEQ ID NO: 5593249 - DNA, 19 bp, Homo sapiens
cccagctttccctgccagg

SEQ ID NO: 5593250 - DNA, 20 bp, Homo sapiens
cccagctttccctgccaggc

SEQ ID NO: 5593251 - DNA, 18 bp, Homo sapiens
cccagctttgcccaacac

SEQ ID NO: 5593252 - DNA, 21 bp, Homo sapiens
cccagcttttcttgccagctc

SEQ ID NO: 5593253 - DNA, 18 bp, Homo sapiens
cccaggaaaaacctgtgg

SEQ ID NO: 5593254 - DNA, 16 bp, Homo sapiens
cccaggaaagaggcat

SEQ ID NO: 5593255 - DNA, 14 bp, Homo sapiens
cccaggaaaggagg

SEQ ID NO: 5593256 - DNA, 15 bp, Homo sapiens
cccaggaaaggagga

SEQ ID NO: 5593257 - DNA, 18 bp, Homo sapiens
cccaggaaaggaggacca

SEQ ID NO: 5593258 - DNA, 19 bp, Homo sapiens
cccaggaaaggaggaccag

SEQ ID NO: 5593259 - DNA, 19 bp, Homo sapiens
cccaggaaaggcaggattg

SEQ ID NO: 5593260 - DNA, 15 bp, Homo sapiens
cccaggaaaggctcc

SEQ ID NO: 5593261 - DNA, 17 bp, Homo sapiens
cccaggaaaggctccag

SEQ ID NO: 5593262 - DNA, 21 bp, Homo sapiens
cccaggaaaggctccaggagc

SEQ ID NO: 5593263 - DNA, 18 bp, Homo sapiens
cccaggaacgtttctgaa

SEQ ID NO: 5593264 - DNA, 22 bp, Homo sapiens
cccaggaacgtttctgaacaat

SEQ ID NO: 5593265 - DNA, 23 bp, Homo sapiens
cccaggaactcgcacctgtgctg

SEQ ID NO: 5593266 - DNA, 15 bp, Homo sapiens
cccaggaagcaggga

SEQ ID NO: 5593267 - DNA, 14 bp, Homo sapiens
cccaggaagcccac

SEQ ID NO: 5593268 - DNA, 15 bp, Homo sapiens
cccaggaagcccaca

SEQ ID NO: 5593269 - DNA, 17 bp, Homo sapiens
cccaggaagcccacact

SEQ ID NO: 5593270 - DNA, 18 bp, Homo sapiens
cccaggaagcccactgcc

SEQ ID NO: 5593271 - DNA, 13 bp, Homo sapiens
cccaggaaggcct

SEQ ID NO: 5593272 - DNA, 22 bp, Homo sapiens
cccaggaaggcctaggctagga

SEQ ID NO: 5593273 - DNA, 20 bp, Homo sapiens
cccaggaaggcggcaggcag

SEQ ID NO: 5593274 - DNA, 22 bp, Homo sapiens
cccaggaaggcggcaggcagag

SEQ ID NO: 5593275 - DNA, 12 bp, Homo sapiens
cccaggaaggga

SEQ ID NO: 5593276 - DNA, 15 bp, Homo sapiens
cccaggaagggaggg

SEQ ID NO: 5593277 - DNA, 17 bp, Homo sapiens
cccaggaagtggctcag

SEQ ID NO: 5593278 - DNA, 22 bp, Homo sapiens
cccaggaatgccaaggagacat

SEQ ID NO: 5593279 - DNA, 19 bp, Homo sapiens
cccaggaatggagcctgca

SEQ ID NO: 5593280 - DNA, 22 bp, Homo sapiens
cccaggaatggagcctgcacgg

SEQ ID NO: 5593281 - DNA, 20 bp, Homo sapiens
cccaggacaccacacccagc

SEQ ID NO: 5593282 - DNA, 21 bp, Homo sapiens
cccaggacaccacacccagcc

SEQ ID NO: 5593283 - DNA, 19 bp, Homo sapiens
cccagtcctcactgtcctg

SEQ ID NO: 5593284 - DNA, 16 bp, Homo sapiens
cccagtcctcaggcag

SEQ ID NO: 5593285 - DNA, 14 bp, Homo sapiens
cccagtcctggcca

SEQ ID NO: 5593286 - DNA, 14 bp, Homo sapiens
cccagtcctggcct

SEQ ID NO: 5593287 - DNA, 22 bp, Homo sapiens
cccagtcctggcctggcttctc

SEQ ID NO: 5593288 - DNA, 23 bp, Homo sapiens
cccagtcctggcctggcttctcc

SEQ ID NO: 5593289 - DNA, 14 bp, Homo sapiens
cccagtccttccac

SEQ ID NO: 5593290 - DNA, 18 bp, Homo sapiens
cccagtcgagccctgcag

SEQ ID NO: 5593291 - DNA, 24 bp, Homo sapiens
cccagtctacgttctccagcccac

SEQ ID NO: 5593292 - DNA, 15 bp, Homo sapiens
cccagtctcatctcc

SEQ ID NO: 5593293 - DNA, 16 bp, Homo sapiens
cccagtctcatctcct

SEQ ID NO: 5593294 - DNA, 20 bp, Homo sapiens
cccagtctcatctcctgacc

SEQ ID NO: 5593295 - DNA, 13 bp, Homo sapiens
cccagtctccagg

SEQ ID NO: 5593296 - DNA, 15 bp, Homo sapiens
cccagtctccaggga

SEQ ID NO: 5593297 - DNA, 16 bp, Homo sapiens
cccagtctctgctcca

SEQ ID NO: 5593298 - DNA, 15 bp, Homo sapiens
cccagtctctggcag

SEQ ID NO: 5593299 - DNA, 18 bp, Homo sapiens
cccagtctggaatgcagt

SEQ ID NO: 5593300 - DNA, 20 bp, Homo sapiens
cccagtctggaatgcagtgg

SEQ ID NO: 5593301 - DNA, 11 bp, Homo sapiens
cccagtctgtc

SEQ ID NO: 5593302 - DNA, 13 bp, Homo sapiens
cccagtcttcctt

SEQ ID NO: 5593303 - DNA, 15 bp, Homo sapiens
cccagtcttccttgt

SEQ ID NO: 5593304 - DNA, 17 bp, Homo sapiens
cccagtcttgagtgggc

SEQ ID NO: 5593305 - DNA, 15 bp, Homo sapiens
cccagtgaaaactag

SEQ ID NO: 5593306 - DNA, 19 bp, Homo sapiens
cccagtgaaaactagagct

SEQ ID NO: 5593307 - DNA, 14 bp, Homo sapiens
cccagtgaaataaa

SEQ ID NO: 5593308 - DNA, 18 bp, Homo sapiens
cccagtgaatccctggga

SEQ ID NO: 5593309 - DNA, 15 bp, Homo sapiens
cccagtgacaacatc

SEQ ID NO: 5593310 - DNA, 15 bp, Homo sapiens
cccagtgacagctag

SEQ ID NO: 5593311 - DNA, 21 bp, Homo sapiens
cccagtgaccgggggaagctg

SEQ ID NO: 5593312 - DNA, 16 bp, Homo sapiens
cccagtgacctgaccg

SEQ ID NO: 5593313 - DNA, 16 bp, Homo sapiens
cccagtgactccaggg

SEQ ID NO: 5593314 - DNA, 13 bp, Homo sapiens
cccagtgagactg

SEQ ID NO: 5593315 - DNA, 13 bp, Homo sapiens
cccagtgagccct

SEQ ID NO: 5593316 - DNA, 16 bp, Homo sapiens
cccagtgagccctgct

SEQ ID NO: 5593317 - DNA, 19 bp, Homo sapiens
cccagtgagccctgctctt

SEQ ID NO: 5593318 - DNA, 19 bp, Homo sapiens
cccagtgagcctctgcgcc

SEQ ID NO: 5593319 - DNA, 23 bp, Homo sapiens
cccagtgagtctctggggcaggc

SEQ ID NO: 5593320 - DNA, 18 bp, Homo sapiens
cccagtgatctcgactcc

SEQ ID NO: 5593321 - DNA, 19 bp, Homo sapiens
cccagtgcaatctgtccag

SEQ ID NO: 5593322 - DNA, 21 bp, Homo sapiens
cccagtgcaatctgtccagac

SEQ ID NO: 5593323 - DNA, 14 bp, Homo sapiens
cccagtgcacccac

SEQ ID NO: 5593324 - DNA, 22 bp, Homo sapiens
cccagtgcacctccctccccag

SEQ ID NO: 5593325 - DNA, 16 bp, Homo sapiens
cccagtgcacttgctg

SEQ ID NO: 5593326 - DNA, 10 bp, Homo sapiens
cccagtgcag

SEQ ID NO: 5593327 - DNA, 11 bp, Homo sapiens
cccagtgcaga

SEQ ID NO: 5593328 - DNA, 15 bp, Homo sapiens
cccagtgcagaatgt

SEQ ID NO: 5593329 - DNA, 12 bp, Homo sapiens
cccagtgcatgg

SEQ ID NO: 5593330 - DNA, 14 bp, Homo sapiens
cccagtgcatggtg

SEQ ID NO: 5593331 - DNA, 22 bp, Homo sapiens
cccagtgcatggtggccagagg

SEQ ID NO: 5593332 - DNA, 15 bp, Homo sapiens
cccagtgccaaactt

SEQ ID NO: 5593333 - DNA, 16 bp, Homo sapiens
cccagtgccaaacttg

SEQ ID NO: 5593334 - DNA, 16 bp, Homo sapiens
cccagtgccacagaga

SEQ ID NO: 5593335 - DNA, 17 bp, Homo sapiens
cccagtgccacagagaa

SEQ ID NO: 5593336 - DNA, 15 bp, Homo sapiens
cccagtgccactgcc

SEQ ID NO: 5593337 - DNA, 17 bp, Homo sapiens
cccagtgccactgcccc

SEQ ID NO: 5593338 - DNA, 18 bp, Homo sapiens
cccagtgccactgccccc

SEQ ID NO: 5593339 - DNA, 12 bp, Homo sapiens
cccagtgccagc

SEQ ID NO: 5593340 - DNA, 20 bp, Homo sapiens
cccagtgccagcaagtcctt

SEQ ID NO: 5593341 - DNA, 14 bp, Homo sapiens
cccagtgccagctc

SEQ ID NO: 5593342 - DNA, 17 bp, Homo sapiens
cccagtgccagctggtg

SEQ ID NO: 5593343 - DNA, 20 bp, Homo sapiens
cccagtgcccacaggatcag

SEQ ID NO: 5593344 - DNA, 21 bp, Homo sapiens
cccagtgcccacaggatcagt

SEQ ID NO: 5593345 - DNA, 20 bp, Homo sapiens
cccagtgcccccactgacca

SEQ ID NO: 5593346 - DNA, 16 bp, Homo sapiens
cccagtgccctggggc

SEQ ID NO: 5593347 - DNA, 17 bp, Homo sapiens
cccagtgccctggggct

SEQ ID NO: 5593348 - DNA, 23 bp, Homo sapiens
cccagtgccctggggctgatctc

SEQ ID NO: 5593349 - DNA, 12 bp, Homo sapiens
cccagtgcctgc

SEQ ID NO: 5593350 - DNA, 15 bp, Homo sapiens
cccagtgcctgccac

SEQ ID NO: 5593351 - DNA, 16 bp, Homo sapiens
cccagtgctcacacaa

SEQ ID NO: 5593352 - DNA, 22 bp, Homo sapiens
cccagtgctcacacaatcagac

SEQ ID NO: 5593353 - DNA, 14 bp, Homo sapiens
cccagtgctcacca

SEQ ID NO: 5593354 - DNA, 16 bp, Homo sapiens
cccagtgctcaccagc

SEQ ID NO: 5593355 - DNA, 16 bp, Homo sapiens
cccagtgctcctgtgc

SEQ ID NO: 5593356 - DNA, 19 bp, Homo sapiens
cccagtgctcctgtgcagg

SEQ ID NO: 5593357 - DNA, 17 bp, Homo sapiens
cccagtgctgccatgcc

SEQ ID NO: 5593358 - DNA, 19 bp, Homo sapiens
cccagtgctgctgtaaata

SEQ ID NO: 5593359 - DNA, 22 bp, Homo sapiens
cccagtggactcgcgagagggt

SEQ ID NO: 5593360 - DNA, 16 bp, Homo sapiens
cccagtggcagggcac

SEQ ID NO: 5593361 - DNA, 16 bp, Homo sapiens
cccagtggccactcag

SEQ ID NO: 5593362 - DNA, 18 bp, Homo sapiens
cccagtggcctcaaccct

SEQ ID NO: 5593363 - DNA, 16 bp, Homo sapiens
cccagtggctgctgcc

SEQ ID NO: 5593364 - DNA, 21 bp, Homo sapiens
cccagtggctgctgcccaggc

SEQ ID NO: 5593365 - DNA, 21 bp, Homo sapiens
cccagtgggaagagtgtgggg

SEQ ID NO: 5593366 - DNA, 13 bp, Homo sapiens
cccagtgggacca

SEQ ID NO: 5593367 - DNA, 18 bp, Homo sapiens
cccagtgggaccacatgc

SEQ ID NO: 5593368 - DNA, 17 bp, Homo sapiens
cccagtgggaggggcag

SEQ ID NO: 5593369 - DNA, 22 bp, Homo sapiens
cccagtgggaggggcaggctga

SEQ ID NO: 5593370 - DNA, 22 bp, Homo sapiens
cccagtgggatgggacagggag

SEQ ID NO: 5593371 - DNA, 13 bp, Homo sapiens
cccagtgggctgt

SEQ ID NO: 5593372 - DNA, 14 bp, Homo sapiens
cccagtgggctgtg

SEQ ID NO: 5593373 - DNA, 16 bp, Homo sapiens
cccagtgggctgtgtt

SEQ ID NO: 5593374 - DNA, 18 bp, Homo sapiens
cccagtggggacagggag

SEQ ID NO: 5593375 - DNA, 14 bp, Homo sapiens
cccagtggtcagca

SEQ ID NO: 5593376 - DNA, 20 bp, Homo sapiens
cccagtggtgaacagaacct

SEQ ID NO: 5593377 - DNA, 19 bp, Homo sapiens
cccagtggtgcgggccagg

SEQ ID NO: 5593378 - DNA, 20 bp, Homo sapiens
cccagtgtaaagaataaatg

SEQ ID NO: 5593379 - DNA, 17 bp, Homo sapiens
cccagtgtcagctgtgg

SEQ ID NO: 5593380 - DNA, 14 bp, Homo sapiens
cccagtgtccccag

SEQ ID NO: 5593381 - DNA, 15 bp, Homo sapiens
cccagtgtccccagg

SEQ ID NO: 5593382 - DNA, 19 bp, Homo sapiens
cccagtgtccccaggggca

SEQ ID NO: 5593383 - DNA, 20 bp, Homo sapiens
cccagtgtccccaggggcac

SEQ ID NO: 5593384 - DNA, 15 bp, Homo sapiens
cccagtgtctggccc

SEQ ID NO: 5593385 - DNA, 23 bp, Homo sapiens
cccagtgtctggcccagccatgg

SEQ ID NO: 5593386 - DNA, 16 bp, Homo sapiens
cccagtgtcttcctgt

SEQ ID NO: 5593387 - DNA, 17 bp, Homo sapiens
cccagtgtcttcctgtg

SEQ ID NO: 5593388 - DNA, 20 bp, Homo sapiens
cccagtgtcttcctgtgggg

SEQ ID NO: 5593389 - DNA, 21 bp, Homo sapiens
cccagtgtgagaccccaaaga

SEQ ID NO: 5593390 - DNA, 14 bp, Homo sapiens
cccagtgtgcacgc

SEQ ID NO: 5593391 - DNA, 20 bp, Homo sapiens
cccagtgtgcacgcctgcag

SEQ ID NO: 5593392 - DNA, 14 bp, Homo sapiens
cccagtgtggactc

SEQ ID NO: 5593393 - DNA, 18 bp, Homo sapiens
cccagtgtggactctgga

SEQ ID NO: 5593394 - DNA, 20 bp, Homo sapiens
cccagtgtggactctggact

SEQ ID NO: 5593395 - DNA, 14 bp, Homo sapiens
cccagtgtgtgctc

SEQ ID NO: 5593396 - DNA, 16 bp, Homo sapiens
cccagtgtgtgctcag

SEQ ID NO: 5593397 - DNA, 17 bp, Homo sapiens
cccagtgtgtgctcagc

SEQ ID NO: 5593398 - DNA, 19 bp, Homo sapiens
cccagtgtgtgctcagcag

SEQ ID NO: 5593399 - DNA, 22 bp, Homo sapiens
cccagtgtgtgctcagcagccc

SEQ ID NO: 5593400 - DNA, 21 bp, Homo sapiens
cccagtgttgtttgtaaataa

SEQ ID NO: 5593401 - DNA, 18 bp, Homo sapiens
cccagtgtttccacactt

SEQ ID NO: 5593402 - DNA, 17 bp, Homo sapiens
cccagtgttttaggagc

SEQ ID NO: 5593403 - DNA, 16 bp, Homo sapiens
cccagtgttttctttg

SEQ ID NO: 5593404 - DNA, 22 bp, Homo sapiens
cccagttaatactccagagaca

SEQ ID NO: 5593405 - DNA, 22 bp, Homo sapiens
cccagttacttttttacactga

SEQ ID NO: 5593406 - DNA, 16 bp, Homo sapiens
cccagttagcccggcc

SEQ ID NO: 5593407 - DNA, 19 bp, Homo sapiens
cccagttagcccggccaag

SEQ ID NO: 5593408 - DNA, 16 bp, Homo sapiens
cccagttcagtctgta

SEQ ID NO: 5593409 - DNA, 19 bp, Homo sapiens
cccagttcagtctgtaggg

SEQ ID NO: 5593410 - DNA, 12 bp, Homo sapiens
cccagttcatgt

SEQ ID NO: 5593411 - DNA, 18 bp, Homo sapiens
cccagttcctatgacaca

SEQ ID NO: 5593412 - DNA, 19 bp, Homo sapiens
cccagttcgcctggagccc

SEQ ID NO: 5593413 - DNA, 21 bp, Homo sapiens
cccagttcgcctggagccctc

SEQ ID NO: 5593414 - DNA, 21 bp, Homo sapiens
cccagttctacaagcatattt

SEQ ID NO: 5593415 - DNA, 18 bp, Homo sapiens
cccagttctcgtgccctt

SEQ ID NO: 5593416 - DNA, 19 bp, Homo sapiens
cccagttctcgtgccctta

SEQ ID NO: 5593417 - DNA, 15 bp, Homo sapiens
cccagttctgctcct

SEQ ID NO: 5593418 - DNA, 16 bp, Homo sapiens
cccagttctgctcctc

SEQ ID NO: 5593419 - DNA, 21 bp, Homo sapiens
cccagttcttcatttggagga

SEQ ID NO: 5593420 - DNA, 16 bp, Homo sapiens
cccagttcttcctgca

SEQ ID NO: 5593421 - DNA, 20 bp, Homo sapiens
cccagttgcactcaggtgac

SEQ ID NO: 5593422 - DNA, 17 bp, Homo sapiens
cccagttgccatctgcg

SEQ ID NO: 5593423 - DNA, 15 bp, Homo sapiens
cccagttgctgtcac

SEQ ID NO: 5593424 - DNA, 15 bp, Homo sapiens
cccagttggaaaatt

SEQ ID NO: 5593425 - DNA, 16 bp, Homo sapiens
cccagttggagctcca

SEQ ID NO: 5593426 - DNA, 17 bp, Homo sapiens
cccagttggaggagact

SEQ ID NO: 5593427 - DNA, 21 bp, Homo sapiens
cccagttggaggagactgggc

SEQ ID NO: 5593428 - DNA, 14 bp, Homo sapiens
cccagttgggtgga

SEQ ID NO: 5593429 - DNA, 22 bp, Homo sapiens
cccagttgtccgtgaagagaaa

SEQ ID NO: 5593430 - DNA, 21 bp, Homo sapiens
cccagtttatggatatgctgc

SEQ ID NO: 5593431 - DNA, 15 bp, Homo sapiens
cccagtttgcagaaa

SEQ ID NO: 5593432 - DNA, 16 bp, Homo sapiens
cccagtttgcagaaaa

SEQ ID NO: 5593433 - DNA, 22 bp, Homo sapiens
cccagtttgggaactcatcaaa

SEQ ID NO: 5593434 - DNA, 19 bp, Homo sapiens
cccagttttgttgccccag

SEQ ID NO: 5593435 - DNA, 20 bp, Homo sapiens
cccataaaatgatcctgcca

SEQ ID NO: 5593436 - DNA, 19 bp, Homo sapiens
cccataaagtctgagaaat

SEQ ID NO: 5593437 - DNA, 18 bp, Homo sapiens
cccataaataaaagtaca

SEQ ID NO: 5593438 - DNA, 22 bp, Homo sapiens
cccataagacaaacactgccat

SEQ ID NO: 5593439 - DNA, 17 bp, Homo sapiens
cccataagccctgagac

SEQ ID NO: 5593440 - DNA, 19 bp, Homo sapiens
cccataagccctgagactc

SEQ ID NO: 5593441 - DNA, 20 bp, Homo sapiens
cccataagccctgagactcc

SEQ ID NO: 5593442 - DNA, 21 bp, Homo sapiens
cccataataaaggttgtgaat

SEQ ID NO: 5593443 - DNA, 21 bp, Homo sapiens
cccataattgctttgccaaaa

SEQ ID NO: 5593444 - DNA, 22 bp, Homo sapiens
cccataattttttttttccttt

SEQ ID NO: 5593445 - DNA, 16 bp, Homo sapiens
cccatacaaataagca

SEQ ID NO: 5593446 - DNA, 15 bp, Homo sapiens
cccatacaatgtatg

SEQ ID NO: 5593447 - DNA, 21 bp, Homo sapiens
cccatacaatgtatgtacaat

SEQ ID NO: 5593448 - DNA, 22 bp, Homo sapiens
cccatacaatgtatgtacaata

SEQ ID NO: 5593449 - DNA, 15 bp, Homo sapiens
cccataccatcactg

SEQ ID NO: 5593450 - DNA, 17 bp, Homo sapiens
cccatacccagtctagg

SEQ ID NO: 5593451 - DNA, 16 bp, Homo sapiens
cccatacccctgcctg

SEQ ID NO: 5593452 - DNA, 21 bp, Homo sapiens
cccatacccctgcctgggttt

SEQ ID NO: 5593453 - DNA, 22 bp, Homo sapiens
cccataccccttattgctgcca

SEQ ID NO: 5593454 - DNA, 14 bp, Homo sapiens
cccatactcagcct

SEQ ID NO: 5593455 - DNA, 22 bp, Homo sapiens
cccatactcagcctgctgccca

SEQ ID NO: 5593456 - DNA, 15 bp, Homo sapiens
cccatactgagcctg

SEQ ID NO: 5593457 - DNA, 13 bp, Homo sapiens
cccatacttcctg

SEQ ID NO: 5593458 - DNA, 16 bp, Homo sapiens
cccatacttcctggga

SEQ ID NO: 5593459 - DNA, 22 bp, Homo sapiens
cccatagaaaacaatctgccca

SEQ ID NO: 5593460 - DNA, 22 bp, Homo sapiens
cccattctgttttcccccagca

SEQ ID NO: 5593461 - DNA, 20 bp, Homo sapiens
cccattcttcctagttttct

SEQ ID NO: 5593462 - DNA, 20 bp, Homo sapiens
cccattcttttgtaatttaa

SEQ ID NO: 5593463 - DNA, 23 bp, Homo sapiens
cccattgagatcttcctgctgag

SEQ ID NO: 5593464 - DNA, 12 bp, Homo sapiens
cccattgcccag

SEQ ID NO: 5593465 - DNA, 21 bp, Homo sapiens
cccattgcccagtgagccctg

SEQ ID NO: 5593466 - DNA, 14 bp, Homo sapiens
cccattgccttctg

SEQ ID NO: 5593467 - DNA, 16 bp, Homo sapiens
cccattgctgacgatt

SEQ ID NO: 5593468 - DNA, 24 bp, Homo sapiens
cccattggaagaagaaccaggcat

SEQ ID NO: 5593469 - DNA, 21 bp, Homo sapiens
cccattggagcacctgggccc

SEQ ID NO: 5593470 - DNA, 22 bp, Homo sapiens
cccattggccgagctcctgggg

SEQ ID NO: 5593471 - DNA, 19 bp, Homo sapiens
cccattggtctgcatgtct

SEQ ID NO: 5593472 - DNA, 17 bp, Homo sapiens
cccattggtgttgtcat

SEQ ID NO: 5593473 - DNA, 20 bp, Homo sapiens
cccattggttcacctgtgac

SEQ ID NO: 5593474 - DNA, 15 bp, Homo sapiens
cccattgtccctctg

SEQ ID NO: 5593475 - DNA, 20 bp, Homo sapiens
cccattgtccctctgcccca

SEQ ID NO: 5593476 - DNA, 16 bp, Homo sapiens
cccattgtcctccttt

SEQ ID NO: 5593477 - DNA, 12 bp, Homo sapiens
cccattgtctca

SEQ ID NO: 5593478 - DNA, 12 bp, Homo sapiens
cccattgtcttc

SEQ ID NO: 5593479 - DNA, 19 bp, Homo sapiens
cccattgtgaatgttgtcc

SEQ ID NO: 5593480 - DNA, 23 bp, Homo sapiens
cccattgtgaatgttgtcctgtg

SEQ ID NO: 5593481 - DNA, 23 bp, Homo sapiens
cccattgtggtcacaggaagtag

SEQ ID NO: 5593482 - DNA, 21 bp, Homo sapiens
cccattgttgtcaaggaagaa

SEQ ID NO: 5593483 - DNA, 15 bp, Homo sapiens
cccatttaatgattg

SEQ ID NO: 5593484 - DNA, 16 bp, Homo sapiens
cccatttacacttttg

SEQ ID NO: 5593485 - DNA, 18 bp, Homo sapiens
cccatttagtgtgaatat

SEQ ID NO: 5593486 - DNA, 13 bp, Homo sapiens
cccatttcagctg

SEQ ID NO: 5593487 - DNA, 21 bp, Homo sapiens
cccatttcaggaatttaaaat

SEQ ID NO: 5593488 - DNA, 23 bp, Homo sapiens
cccatttcaggaatttaaaatta

SEQ ID NO: 5593489 - DNA, 15 bp, Homo sapiens
cccatttcccatctg

SEQ ID NO: 5593490 - DNA, 19 bp, Homo sapiens
cccatttcccatctgcacc

SEQ ID NO: 5593491 - DNA, 19 bp, Homo sapiens
cccatttcctcttccttct

SEQ ID NO: 5593492 - DNA, 14 bp, Homo sapiens
cccatttcctgatc

SEQ ID NO: 5593493 - DNA, 13 bp, Homo sapiens
cccatttcctgta

SEQ ID NO: 5593494 - DNA, 13 bp, Homo sapiens
cccatttccttgg

SEQ ID NO: 5593495 - DNA, 19 bp, Homo sapiens
cccatttccttggaggcca

SEQ ID NO: 5593496 - DNA, 21 bp, Homo sapiens
cccatttcgtgagccccatct

SEQ ID NO: 5593497 - DNA, 12 bp, Homo sapiens
cccatttctact

SEQ ID NO: 5593498 - DNA, 15 bp, Homo sapiens
cccatttctatttat

SEQ ID NO: 5593499 - DNA, 17 bp, Homo sapiens
cccatttctatttattt

SEQ ID NO: 5593500 - DNA, 19 bp, Homo sapiens
cccatttctatttatttac

SEQ ID NO: 5593501 - DNA, 14 bp, Homo sapiens
cccatttctgcctc

SEQ ID NO: 5593502 - DNA, 22 bp, Homo sapiens
cccatttctggggggagaaaaa

SEQ ID NO: 5593503 - DNA, 16 bp, Homo sapiens
cccatttctgttgctg

SEQ ID NO: 5593504 - DNA, 23 bp, Homo sapiens
cccatttctgttgctggaggggc

SEQ ID NO: 5593505 - DNA, 14 bp, Homo sapiens
cccatttcttgcta

SEQ ID NO: 5593506 - DNA, 21 bp, Homo sapiens
cccatttgagaagctgaggct

SEQ ID NO: 5593507 - DNA, 21 bp, Homo sapiens
cccatttgctgtctttttgta

SEQ ID NO: 5593508 - DNA, 15 bp, Homo sapiens
cccatttgttgctgc

SEQ ID NO: 5593509 - DNA, 19 bp, Homo sapiens
cccatttgttgctgctgct

SEQ ID NO: 5593510 - DNA, 14 bp, Homo sapiens
cccattttaacttg

SEQ ID NO: 5593511 - DNA, 22 bp, Homo sapiens
cccattttattaataatattta

SEQ ID NO: 5593512 - DNA, 15 bp, Homo sapiens
cccattttcatcctg

SEQ ID NO: 5593513 - DNA, 21 bp, Homo sapiens
cccattttcattcttgtatta

SEQ ID NO: 5593514 - DNA, 15 bp, Homo sapiens
cccattttctttaca

SEQ ID NO: 5593515 - DNA, 19 bp, Homo sapiens
cccattttctttacagtct

SEQ ID NO: 5593516 - DNA, 12 bp, Homo sapiens
cccattttgcaa

SEQ ID NO: 5593517 - DNA, 22 bp, Homo sapiens
cccattttgcaaaatttccagt

SEQ ID NO: 5593518 - DNA, 12 bp, Homo sapiens
cccatttttccc

SEQ ID NO: 5593519 - DNA, 17 bp, Homo sapiens
cccatttttgagccaag

SEQ ID NO: 5593520 - DNA, 19 bp, Homo sapiens
ccccaaaaccacagccctg

SEQ ID NO: 5593521 - DNA, 23 bp, Homo sapiens
ccccaaaactctacaccctctgc

SEQ ID NO: 5593522 - DNA, 17 bp, Homo sapiens
ccccaaaagtacttacc

SEQ ID NO: 5593523 - DNA, 13 bp, Homo sapiens
ccccaaaatatta

SEQ ID NO: 5593524 - DNA, 15 bp, Homo sapiens
ccccaaaatccaaaa

SEQ ID NO: 5593525 - DNA, 16 bp, Homo sapiens
ccccaaaatccaaaac

SEQ ID NO: 5593526 - DNA, 13 bp, Homo sapiens
ccccaaacagtga

SEQ ID NO: 5593527 - DNA, 15 bp, Homo sapiens
ccccaaacatagccc

SEQ ID NO: 5593528 - DNA, 17 bp, Homo sapiens
ccccaaacatagcccct

SEQ ID NO: 5593529 - DNA, 14 bp, Homo sapiens
ccccaaaccagggt

SEQ ID NO: 5593530 - DNA, 18 bp, Homo sapiens
ccccaaactgtagtaatt

SEQ ID NO: 5593531 - DNA, 17 bp, Homo sapiens
ccccaaagacctgcctg

SEQ ID NO: 5593532 - DNA, 15 bp, Homo sapiens
ccccaaagagcctgg

SEQ ID NO: 5593533 - DNA, 20 bp, Homo sapiens
ccccaaagagcctggagaag

SEQ ID NO: 5593534 - DNA, 18 bp, Homo sapiens
ccccaaagcagcccttcc

SEQ ID NO: 5593535 - DNA, 14 bp, Homo sapiens
ccccaaagcccagc

SEQ ID NO: 5593536 - DNA, 15 bp, Homo sapiens
ccccaaagcccagcc

SEQ ID NO: 5593537 - DNA, 18 bp, Homo sapiens
ccccaaagcccagcccgg

SEQ ID NO: 5593538 - DNA, 12 bp, Homo sapiens
ccccaaagcccc

SEQ ID NO: 5593539 - DNA, 19 bp, Homo sapiens
ccccaaagctttcctgccc

SEQ ID NO: 5593540 - DNA, 15 bp, Homo sapiens
ccccaaaggacgcct

SEQ ID NO: 5593541 - DNA, 14 bp, Homo sapiens
ccccaaaggcatcc

SEQ ID NO: 5593542 - DNA, 18 bp, Homo sapiens
ccccaaaggccaacagca

SEQ ID NO: 5593543 - DNA, 22 bp, Homo sapiens
ccccaaaggctttgccctgctg

SEQ ID NO: 5593544 - DNA, 21 bp, Homo sapiens
ccccaaagggcctcctcaccc

SEQ ID NO: 5593545 - DNA, 19 bp, Homo sapiens
ccccaaaggtggtctgctt

SEQ ID NO: 5593546 - DNA, 15 bp, Homo sapiens
ccccaaagtaaaaga

SEQ ID NO: 5593547 - DNA, 18 bp, Homo sapiens
ccccaaagtaaaagaaac

SEQ ID NO: 5593548 - DNA, 15 bp, Homo sapiens
ccccaaagtccaggc

SEQ ID NO: 5593549 - DNA, 15 bp, Homo sapiens
ccccaaatcaataca

SEQ ID NO: 5593550 - DNA, 16 bp, Homo sapiens
ccccaaattgccttca

SEQ ID NO: 5593551 - DNA, 22 bp, Homo sapiens
ccccaacaaaccatccagtgac

SEQ ID NO: 5593552 - DNA, 13 bp, Homo sapiens
ccccaacacctgc

SEQ ID NO: 5593553 - DNA, 13 bp, Homo sapiens
ccccaacactcca

SEQ ID NO: 5593554 - DNA, 16 bp, Homo sapiens
ccccaacactccaggc

SEQ ID NO: 5593555 - DNA, 19 bp, Homo sapiens
ccccaacactccaggccct

SEQ ID NO: 5593556 - DNA, 17 bp, Homo sapiens
ccccaacactgtgccct

SEQ ID NO: 5593557 - DNA, 19 bp, Homo sapiens
ccccaacactgtgccctgg

SEQ ID NO: 5593558 - DNA, 20 bp, Homo sapiens
ccccaacactgtgccctggt

SEQ ID NO: 5593559 - DNA, 14 bp, Homo sapiens
ccccaacagctgga

SEQ ID NO: 5593560 - DNA, 23 bp, Homo sapiens
ccccaacagctggaccctgacca

SEQ ID NO: 5593561 - DNA, 19 bp, Homo sapiens
ccccaacatgttcagaaaa

SEQ ID NO: 5593562 - DNA, 22 bp, Homo sapiens
ccccaaccactctttctttctc

SEQ ID NO: 5593563 - DNA, 21 bp, Homo sapiens
ccccaacccacctctcttccc

SEQ ID NO: 5593564 - DNA, 17 bp, Homo sapiens
ccccaacccacctctgg

SEQ ID NO: 5593565 - DNA, 14 bp, Homo sapiens
ccccaaccccagcc

SEQ ID NO: 5593566 - DNA, 21 bp, Homo sapiens
ccccaacccccgcaccaagca

SEQ ID NO: 5593567 - DNA, 14 bp, Homo sapiens
ccccaacccctcct

SEQ ID NO: 5593568 - DNA, 13 bp, Homo sapiens
ccccaacccctct

SEQ ID NO: 5593569 - DNA, 20 bp, Homo sapiens
ccccaacccctctccaggcc

SEQ ID NO: 5593570 - DNA, 17 bp, Homo sapiens
ccccaacccctgaggaa

SEQ ID NO: 5593571 - DNA, 23 bp, Homo sapiens
ccccaacccgtggaggctgctcg

SEQ ID NO: 5593572 - DNA, 17 bp, Homo sapiens
ccccaaccctgcccctg

SEQ ID NO: 5593573 - DNA, 23 bp, Homo sapiens
ccccaaccgtgcaacgtgtaact

SEQ ID NO: 5593574 - DNA, 13 bp, Homo sapiens
ccccaacctcagg

SEQ ID NO: 5593575 - DNA, 14 bp, Homo sapiens
ccccaacctcaggg

SEQ ID NO: 5593576 - DNA, 20 bp, Homo sapiens
ccccaacctcagggctccca

SEQ ID NO: 5593577 - DNA, 22 bp, Homo sapiens
ccccaacctcagggctcccagg

SEQ ID NO: 5593578 - DNA, 13 bp, Homo sapiens
ccccaacctgcaa

SEQ ID NO: 5593579 - DNA, 15 bp, Homo sapiens
ccccaacctgctctc

SEQ ID NO: 5593580 - DNA, 14 bp, Homo sapiens
ccccaacctgctga

SEQ ID NO: 5593581 - DNA, 21 bp, Homo sapiens
ccccaacctttccctcacccc

SEQ ID NO: 5593582 - DNA, 20 bp, Homo sapiens
ccccaacgaaaagcacatcc

SEQ ID NO: 5593583 - DNA, 20 bp, Homo sapiens
ccccaacgtcccctccgccg

SEQ ID NO: 5593584 - DNA, 20 bp, Homo sapiens
ccccaactacccccagctgt

SEQ ID NO: 5593585 - DNA, 15 bp, Homo sapiens
ccccaactccagggg

SEQ ID NO: 5593586 - DNA, 14 bp, Homo sapiens
ccccaactcccagc

SEQ ID NO: 5593587 - DNA, 19 bp, Homo sapiens
ccccaactccctctctgtg

SEQ ID NO: 5593588 - DNA, 14 bp, Homo sapiens
ccccaactcctgga

SEQ ID NO: 5593589 - DNA, 17 bp, Homo sapiens
ccccaactccttccagc

SEQ ID NO: 5593590 - DNA, 17 bp, Homo sapiens
ccccaactccttcctct

SEQ ID NO: 5593591 - DNA, 14 bp, Homo sapiens
ccccaactctcccc

SEQ ID NO: 5593592 - DNA, 17 bp, Homo sapiens
ccccaactctccccagt

SEQ ID NO: 5593593 - DNA, 19 bp, Homo sapiens
ccccaactctccccagtgc

SEQ ID NO: 5593594 - DNA, 14 bp, Homo sapiens
ccccaactctgagc

SEQ ID NO: 5593595 - DNA, 17 bp, Homo sapiens
ccccaactctgagccca

SEQ ID NO: 5593596 - DNA, 19 bp, Homo sapiens
ccccaactctgagcccatg

SEQ ID NO: 5593597 - DNA, 13 bp, Homo sapiens
ccccaactgcagg

SEQ ID NO: 5593598 - DNA, 14 bp, Homo sapiens
ccccaactgcagga

SEQ ID NO: 5593599 - DNA, 23 bp, Homo sapiens
ccccaactgctccagcctctgcc

SEQ ID NO: 5593600 - DNA, 17 bp, Homo sapiens
ccccaacttcaccaccc

SEQ ID NO: 5593601 - DNA, 20 bp, Homo sapiens
ccccaacttccctagtcccc

SEQ ID NO: 5593602 - DNA, 21 bp, Homo sapiens
ccccaagaaacctccatcctg

SEQ ID NO: 5593603 - DNA, 14 bp, Homo sapiens
ccccaagaaggctg

SEQ ID NO: 5593604 - DNA, 18 bp, Homo sapiens
ccccaagactctgctctc

SEQ ID NO: 5593605 - DNA, 21 bp, Homo sapiens
ccccaagatctgccagacctg

SEQ ID NO: 5593606 - DNA, 15 bp, Homo sapiens
ccccaagcagccagc

SEQ ID NO: 5593607 - DNA, 19 bp, Homo sapiens
ccccaagcccaccaggtgt

SEQ ID NO: 5593608 - DNA, 21 bp, Homo sapiens
ccccaagcctctgccccaagg

SEQ ID NO: 5593609 - DNA, 14 bp, Homo sapiens
ccccaagcctggca

SEQ ID NO: 5593610 - DNA, 16 bp, Homo sapiens
ccccaagcctggcagg

SEQ ID NO: 5593611 - DNA, 12 bp, Homo sapiens
ccccaaggaaga

SEQ ID NO: 5593612 - DNA, 13 bp, Homo sapiens
ccccaaggaagaa

SEQ ID NO: 5593613 - DNA, 14 bp, Homo sapiens
ccccaaggacccag

SEQ ID NO: 5593614 - DNA, 18 bp, Homo sapiens
ccccaaggacccagccct

SEQ ID NO: 5593615 - DNA, 17 bp, Homo sapiens
ccccaaggaggcagcct

SEQ ID NO: 5593616 - DNA, 13 bp, Homo sapiens
ccccaaggcactg

SEQ ID NO: 5593617 - DNA, 16 bp, Homo sapiens
ccccaaggcactgagc

SEQ ID NO: 5593618 - DNA, 12 bp, Homo sapiens
ccccaaggccag

SEQ ID NO: 5593619 - DNA, 17 bp, Homo sapiens
ccccaaggccccaggga

SEQ ID NO: 5593620 - DNA, 12 bp, Homo sapiens
ccccaaggcctc

SEQ ID NO: 5593621 - DNA, 22 bp, Homo sapiens
ccccaaggcctctctctgcctg

SEQ ID NO: 5593622 - DNA, 13 bp, Homo sapiens
ccccaaggctgcg

SEQ ID NO: 5593623 - DNA, 15 bp, Homo sapiens
ccccaagggccctgg

SEQ ID NO: 5593624 - DNA, 16 bp, Homo sapiens
ccccaagggccctggc

SEQ ID NO: 5593625 - DNA, 17 bp, Homo sapiens
ccccaagggccctggca

SEQ ID NO: 5593626 - DNA, 20 bp, Homo sapiens
ccccaagggccctggcaccc

SEQ ID NO: 5593627 - DNA, 14 bp, Homo sapiens
ccccaaggggcagt

SEQ ID NO: 5593628 - DNA, 22 bp, Homo sapiens
ccccaaggggcagtctggaggg

SEQ ID NO: 5593629 - DNA, 20 bp, Homo sapiens
ccccaagggggctgctgctc

SEQ ID NO: 5593630 - DNA, 16 bp, Homo sapiens
ccccaaggttccagag

SEQ ID NO: 5593631 - DNA, 13 bp, Homo sapiens
ccccaaggttctc

SEQ ID NO: 5593632 - DNA, 20 bp, Homo sapiens
ccccaagtagtctgctcaca

SEQ ID NO: 5593633 - DNA, 13 bp, Homo sapiens
ccccaagtgcctg

SEQ ID NO: 5593634 - DNA, 14 bp, Homo sapiens
ccccaagtgcctgc

SEQ ID NO: 5593635 - DNA, 11 bp, Homo sapiens
ccccaataaac

SEQ ID NO: 5593636 - DNA, 17 bp, Homo sapiens
ccccaataaaccagtgt

SEQ ID NO: 5593637 - DNA, 18 bp, Homo sapiens
ccccaataaaccagtgtg

SEQ ID NO: 5593638 - DNA, 15 bp, Homo sapiens
ccccaataaagcctt

SEQ ID NO: 5593639 - DNA, 22 bp, Homo sapiens
ccccagggacagggccctggag

SEQ ID NO: 5593640 - DNA, 18 bp, Homo sapiens
ccccagggagctctgggg

SEQ ID NO: 5593641 - DNA, 12 bp, Homo sapiens
ccccagggcaca

SEQ ID NO: 5593642 - DNA, 14 bp, Homo sapiens
ccccagggcacagg

SEQ ID NO: 5593643 - DNA, 16 bp, Homo sapiens
ccccagggcacaggag

SEQ ID NO: 5593644 - DNA, 14 bp, Homo sapiens
ccccagggcaccct

SEQ ID NO: 5593645 - DNA, 15 bp, Homo sapiens
ccccagggcaccctg

SEQ ID NO: 5593646 - DNA, 21 bp, Homo sapiens
ccccagggcacttcacagagt

SEQ ID NO: 5593647 - DNA, 12 bp, Homo sapiens
ccccagggcagc

SEQ ID NO: 5593648 - DNA, 13 bp, Homo sapiens
ccccagggcagcc

SEQ ID NO: 5593649 - DNA, 15 bp, Homo sapiens
ccccagggcagccag

SEQ ID NO: 5593650 - DNA, 11 bp, Homo sapiens
ccccagggccc

SEQ ID NO: 5593651 - DNA, 21 bp, Homo sapiens
ccccagggcccctccctctgc

SEQ ID NO: 5593652 - DNA, 16 bp, Homo sapiens
ccccagggccctgctc

SEQ ID NO: 5593653 - DNA, 18 bp, Homo sapiens
ccccagggccctgctcag

SEQ ID NO: 5593654 - DNA, 20 bp, Homo sapiens
ccccagggccctgctcaggc

SEQ ID NO: 5593655 - DNA, 12 bp, Homo sapiens
ccccagggcctg

SEQ ID NO: 5593656 - DNA, 15 bp, Homo sapiens
ccccagggcctgagc

SEQ ID NO: 5593657 - DNA, 16 bp, Homo sapiens
ccccagggcctgagcc

SEQ ID NO: 5593658 - DNA, 19 bp, Homo sapiens
ccccagggcctgagcctgg

SEQ ID NO: 5593659 - DNA, 16 bp, Homo sapiens
ccccagggcctgcgga

SEQ ID NO: 5593660 - DNA, 22 bp, Homo sapiens
ccccagggcctgcttccccttc

SEQ ID NO: 5593661 - DNA, 14 bp, Homo sapiens
ccccagggctagtg

SEQ ID NO: 5593662 - DNA, 14 bp, Homo sapiens
ccccagggctgtgg

SEQ ID NO: 5593663 - DNA, 20 bp, Homo sapiens
ccccaggggaaagatgagct

SEQ ID NO: 5593664 - DNA, 19 bp, Homo sapiens
ccccaggggaactggcagc

SEQ ID NO: 5593665 - DNA, 13 bp, Homo sapiens
ccccaggggcagc

SEQ ID NO: 5593666 - DNA, 20 bp, Homo sapiens
ccccaggggcagcaaggcct

SEQ ID NO: 5593667 - DNA, 14 bp, Homo sapiens
ccccaggggcagga

SEQ ID NO: 5593668 - DNA, 15 bp, Homo sapiens
ccccaggggcaggac

SEQ ID NO: 5593669 - DNA, 17 bp, Homo sapiens
ccccaggggcaggactg

SEQ ID NO: 5593670 - DNA, 23 bp, Homo sapiens
ccccaggggcgagttcctcgctc

SEQ ID NO: 5593671 - DNA, 20 bp, Homo sapiens
ccccaggggtgagccccgcc

SEQ ID NO: 5593672 - DNA, 21 bp, Homo sapiens
ccccagggtcccctgcatggc

SEQ ID NO: 5593673 - DNA, 18 bp, Homo sapiens
ccccagggtcctgggagg

SEQ ID NO: 5593674 - DNA, 12 bp, Homo sapiens
ccccagggtctg

SEQ ID NO: 5593675 - DNA, 15 bp, Homo sapiens
ccccagggtctgaaa

SEQ ID NO: 5593676 - DNA, 16 bp, Homo sapiens
ccccagggtcttccct

SEQ ID NO: 5593677 - DNA, 23 bp, Homo sapiens
ccccagggtgacatacagaaggg

SEQ ID NO: 5593678 - DNA, 15 bp, Homo sapiens
ccccagggtgcaggc

SEQ ID NO: 5593679 - DNA, 21 bp, Homo sapiens
ccccaggtacacctccccctg

SEQ ID NO: 5593680 - DNA, 17 bp, Homo sapiens
ccccaggtcagccctgt

SEQ ID NO: 5593681 - DNA, 18 bp, Homo sapiens
ccccaggtcagccctgtg

SEQ ID NO: 5593682 - DNA, 21 bp, Homo sapiens
ccccaggtcagccctgtgtct

SEQ ID NO: 5593683 - DNA, 22 bp, Homo sapiens
ccccaggtcagccctgtgtctg

SEQ ID NO: 5593684 - DNA, 20 bp, Homo sapiens
ccccaggtcaggggctccct

SEQ ID NO: 5593685 - DNA, 22 bp, Homo sapiens
ccccaggtccagctctggaggg

SEQ ID NO: 5593686 - DNA, 22 bp, Homo sapiens
ccccaggtctccccaggccctc

SEQ ID NO: 5593687 - DNA, 19 bp, Homo sapiens
ccccaggtcttcctgcttt

SEQ ID NO: 5593688 - DNA, 16 bp, Homo sapiens
ccccaggtcttttctt

SEQ ID NO: 5593689 - DNA, 16 bp, Homo sapiens
ccccaggtgagacagc

SEQ ID NO: 5593690 - DNA, 23 bp, Homo sapiens
ccccaggtgcagccccagggcct

SEQ ID NO: 5593691 - DNA, 19 bp, Homo sapiens
ccccaggtgccaccaataa

SEQ ID NO: 5593692 - DNA, 23 bp, Homo sapiens
ccccaggtggctgacccagtccc

SEQ ID NO: 5593693 - DNA, 14 bp, Homo sapiens
ccccagtaaaattg

SEQ ID NO: 5593694 - DNA, 17 bp, Homo sapiens
ccccagtaaaattgcca

SEQ ID NO: 5593695 - DNA, 16 bp, Homo sapiens
ccccagtaagccactg

SEQ ID NO: 5593696 - DNA, 11 bp, Homo sapiens
ccccagtatta

SEQ ID NO: 5593697 - DNA, 16 bp, Homo sapiens
ccccagtattagcaat

SEQ ID NO: 5593698 - DNA, 16 bp, Homo sapiens
ccccagtcacttcctg

SEQ ID NO: 5593699 - DNA, 20 bp, Homo sapiens
ccccagtcacttcctgtccg

SEQ ID NO: 5593700 - DNA, 17 bp, Homo sapiens
ccccagtcagcctctct

SEQ ID NO: 5593701 - DNA, 18 bp, Homo sapiens
ccccagtccccagccctg

SEQ ID NO: 5593702 - DNA, 12 bp, Homo sapiens
ccccagtccgcc

SEQ ID NO: 5593703 - DNA, 20 bp, Homo sapiens
ccccagtcgagccctgcagc

SEQ ID NO: 5593704 - DNA, 15 bp, Homo sapiens
ccccagtcttccttg

SEQ ID NO: 5593705 - DNA, 19 bp, Homo sapiens
ccccagtgactccagggtg

SEQ ID NO: 5593706 - DNA, 20 bp, Homo sapiens
ccccagtgcccacaggatca

SEQ ID NO: 5593707 - DNA, 22 bp, Homo sapiens
ccccagtgcccggtgcagggcc

SEQ ID NO: 5593708 - DNA, 21 bp, Homo sapiens
ccccagtgcctcaccttccaa

SEQ ID NO: 5593709 - DNA, 14 bp, Homo sapiens
ccccagtgcctgcc

SEQ ID NO: 5593710 - DNA, 16 bp, Homo sapiens
ccccagtgcctgccac

SEQ ID NO: 5593711 - DNA, 24 bp, Homo sapiens
ccccagtgcctgccactctctggg

SEQ ID NO: 5593712 - DNA, 16 bp, Homo sapiens
ccccagtgctacctct

SEQ ID NO: 5593713 - DNA, 14 bp, Homo sapiens
ccccagtgctcaca

SEQ ID NO: 5593714 - DNA, 13 bp, Homo sapiens
ccccagtgctcct

SEQ ID NO: 5593715 - DNA, 18 bp, Homo sapiens
ccccagtgctcctggccc

SEQ ID NO: 5593716 - DNA, 22 bp, Homo sapiens
ccccagtgctcctggcccttct

SEQ ID NO: 5593717 - DNA, 17 bp, Homo sapiens
ccccagtggggacaggg

SEQ ID NO: 5593718 - DNA, 19 bp, Homo sapiens
ccccagtggtgagaagact

SEQ ID NO: 5593719 - DNA, 12 bp, Homo sapiens
ccccagtggtgc

SEQ ID NO: 5593720 - DNA, 18 bp, Homo sapiens
ccccagtgtattttgtcc

SEQ ID NO: 5593721 - DNA, 22 bp, Homo sapiens
ccccagtgtggactctggactg

SEQ ID NO: 5593722 - DNA, 20 bp, Homo sapiens
ccccagttaatgtgccaaaa

SEQ ID NO: 5593723 - DNA, 16 bp, Homo sapiens
ccccagttccacagca

SEQ ID NO: 5593724 - DNA, 23 bp, Homo sapiens
ccccagttcccgggccctcctgg

SEQ ID NO: 5593725 - DNA, 15 bp, Homo sapiens
ccccagttcctatga

SEQ ID NO: 5593726 - DNA, 21 bp, Homo sapiens
ccccagttcctgtggctccct

SEQ ID NO: 5593727 - DNA, 15 bp, Homo sapiens
ccccagttcgcctgg

SEQ ID NO: 5593728 - DNA, 16 bp, Homo sapiens
ccccagttctgctcct

SEQ ID NO: 5593729 - DNA, 21 bp, Homo sapiens
ccccagttctgctcctctcca

SEQ ID NO: 5593730 - DNA, 15 bp, Homo sapiens
ccccagtttcttctt

SEQ ID NO: 5593731 - DNA, 23 bp, Homo sapiens
ccccagtttgcagaaaagcacct

SEQ ID NO: 5593732 - DNA, 18 bp, Homo sapiens
ccccagtttggggtgcca

SEQ ID NO: 5593733 - DNA, 16 bp, Homo sapiens
ccccataactcaatgg

SEQ ID NO: 5593734 - DNA, 15 bp, Homo sapiens
ccccataagccctga

SEQ ID NO: 5593735 - DNA, 19 bp, Homo sapiens
ccccataagccctgagact

SEQ ID NO: 5593736 - DNA, 18 bp, Homo sapiens
ccccataataaccctgcc

SEQ ID NO: 5593737 - DNA, 20 bp, Homo sapiens
ccccataataaccctgccag

SEQ ID NO: 5593738 - DNA, 21 bp, Homo sapiens
ccccataataaccctgccagt

SEQ ID NO: 5593739 - DNA, 22 bp, Homo sapiens
ccccataattttttttttcctt

SEQ ID NO: 5593740 - DNA, 15 bp, Homo sapiens
ccccatactcctatg

SEQ ID NO: 5593741 - DNA, 15 bp, Homo sapiens
ccccatacttcctgg

SEQ ID NO: 5593742 - DNA, 20 bp, Homo sapiens
ccccatagagaccaggaggg

SEQ ID NO: 5593743 - DNA, 12 bp, Homo sapiens
ccccatagccac

SEQ ID NO: 5593744 - DNA, 18 bp, Homo sapiens
ccccatatataaattatt

SEQ ID NO: 5593745 - DNA, 18 bp, Homo sapiens
ccccatcacaaacttaaa

SEQ ID NO: 5593746 - DNA, 21 bp, Homo sapiens
ccccatcagcaccatggaggc

SEQ ID NO: 5593747 - DNA, 15 bp, Homo sapiens
ccccatcagccctgc

SEQ ID NO: 5593748 - DNA, 14 bp, Homo sapiens
ccccatcagctccc

SEQ ID NO: 5593749 - DNA, 13 bp, Homo sapiens
ccccatcagtgct

SEQ ID NO: 5593750 - DNA, 20 bp, Homo sapiens
ccccatcagtgctccctcac

SEQ ID NO: 5593751 - DNA, 18 bp, Homo sapiens
ccccatcagttcccccag

SEQ ID NO: 5593752 - DNA, 22 bp, Homo sapiens
ccccatcatatcctttgcccca

SEQ ID NO: 5593753 - DNA, 18 bp, Homo sapiens
ccccatccagacctggct

SEQ ID NO: 5593754 - DNA, 13 bp, Homo sapiens
ccccatccagcca

SEQ ID NO: 5593755 - DNA, 16 bp, Homo sapiens
ccccatccagccacgg

SEQ ID NO: 5593756 - DNA, 15 bp, Homo sapiens
ccccatccagccagg

SEQ ID NO: 5593757 - DNA, 13 bp, Homo sapiens
ccccatccagcct

SEQ ID NO: 5593758 - DNA, 14 bp, Homo sapiens
ccccatccagcctc

SEQ ID NO: 5593759 - DNA, 15 bp, Homo sapiens
ccccatccagcctcc

SEQ ID NO: 5593760 - DNA, 21 bp, Homo sapiens
ccccatccagcctccagggca

SEQ ID NO: 5593761 - DNA, 20 bp, Homo sapiens
ccccatccatcttccctacc

SEQ ID NO: 5593762 - DNA, 18 bp, Homo sapiens
ccccatcccaggatgggt

SEQ ID NO: 5593763 - DNA, 13 bp, Homo sapiens
ccccatcccaggg

SEQ ID NO: 5593764 - DNA, 22 bp, Homo sapiens
ccccatcccattttcatcctga

SEQ ID NO: 5593765 - DNA, 20 bp, Homo sapiens
ccccatcccgtttccctcca

SEQ ID NO: 5593766 - DNA, 18 bp, Homo sapiens
ccccatccctaccactgt

SEQ ID NO: 5593767 - DNA, 13 bp, Homo sapiens
ccccatccctggc

SEQ ID NO: 5593768 - DNA, 15 bp, Homo sapiens
ccccatccctggctg

SEQ ID NO: 5593769 - DNA, 14 bp, Homo sapiens
ccccatcctcatcc

SEQ ID NO: 5593770 - DNA, 15 bp, Homo sapiens
ccccatcctccagct

SEQ ID NO: 5593771 - DNA, 13 bp, Homo sapiens
ccccatcctccct

SEQ ID NO: 5593772 - DNA, 14 bp, Homo sapiens
ccccatcctcctgc

SEQ ID NO: 5593773 - DNA, 21 bp, Homo sapiens
ccccatcctctgtacagagcc

SEQ ID NO: 5593774 - DNA, 13 bp, Homo sapiens
ccccatcctggcc

SEQ ID NO: 5593775 - DNA, 16 bp, Homo sapiens
ccccatcctggcccat

SEQ ID NO: 5593776 - DNA, 17 bp, Homo sapiens
ccccatcctggcccatc

SEQ ID NO: 5593777 - DNA, 14 bp, Homo sapiens
ccccatcctgggcc

SEQ ID NO: 5593778 - DNA, 13 bp, Homo sapiens
ccccatccttccc

SEQ ID NO: 5593779 - DNA, 21 bp, Homo sapiens
ccccatccttcccgcagcacc

SEQ ID NO: 5593780 - DNA, 23 bp, Homo sapiens
ccccatcgccagctgatgactca

SEQ ID NO: 5593781 - DNA, 14 bp, Homo sapiens
ccccatcgcctggg

SEQ ID NO: 5593782 - DNA, 19 bp, Homo sapiens
ccccatcgccttctgggga

SEQ ID NO: 5593783 - DNA, 15 bp, Homo sapiens
ccccatcggccaaga

SEQ ID NO: 5593784 - DNA, 15 bp, Homo sapiens
ccccatcggccctgt

SEQ ID NO: 5593785 - DNA, 20 bp, Homo sapiens
ccccatctaggtcctggctg

SEQ ID NO: 5593786 - DNA, 21 bp, Homo sapiens
ccccatctaggtcctggctgg

SEQ ID NO: 5593787 - DNA, 14 bp, Homo sapiens
ccccatctcaggcc

SEQ ID NO: 5593788 - DNA, 15 bp, Homo sapiens
ccccatctcatcctg

SEQ ID NO: 5593789 - DNA, 19 bp, Homo sapiens
ccccatctcatcctggcac

SEQ ID NO: 5593790 - DNA, 21 bp, Homo sapiens
ccccatctcatgcccctggct

SEQ ID NO: 5593791 - DNA, 18 bp, Homo sapiens
ccccatctccccaggcct

SEQ ID NO: 5593792 - DNA, 14 bp, Homo sapiens
ccccatctccctgc

SEQ ID NO: 5593793 - DNA, 18 bp, Homo sapiens
ccccatctccctgcctgg

SEQ ID NO: 5593794 - DNA, 20 bp, Homo sapiens
ccccatctcctcccatggcc

SEQ ID NO: 5593795 - DNA, 15 bp, Homo sapiens
ccccatctctcatcc

SEQ ID NO: 5593796 - DNA, 16 bp, Homo sapiens
ccccatctctccctcc

SEQ ID NO: 5593797 - DNA, 12 bp, Homo sapiens
ccccatctctgt

SEQ ID NO: 5593798 - DNA, 13 bp, Homo sapiens
ccccatctgagct

SEQ ID NO: 5593799 - DNA, 14 bp, Homo sapiens
ccccatctgagctg

SEQ ID NO: 5593800 - DNA, 13 bp, Homo sapiens
ccccatctgccca

SEQ ID NO: 5593801 - DNA, 13 bp, Homo sapiens
ccccatctggatg

SEQ ID NO: 5593802 - DNA, 14 bp, Homo sapiens
ccccatctggatgt

SEQ ID NO: 5593803 - DNA, 21 bp, Homo sapiens
ccccatctggatgtaaatcct

SEQ ID NO: 5593804 - DNA, 19 bp, Homo sapiens
ccccatctgggtccttgca

SEQ ID NO: 5593805 - DNA, 14 bp, Homo sapiens
ccccatctgtgaat

SEQ ID NO: 5593806 - DNA, 13 bp, Homo sapiens
ccccatctgtgtg

SEQ ID NO: 5593807 - DNA, 16 bp, Homo sapiens
ccccatcttccacctg

SEQ ID NO: 5593808 - DNA, 16 bp, Homo sapiens
ccccatcttcgggacc

SEQ ID NO: 5593809 - DNA, 21 bp, Homo sapiens
ccccatcttgatctttgagcc

SEQ ID NO: 5593810 - DNA, 22 bp, Homo sapiens
ccccatcttgatctttgagccc

SEQ ID NO: 5593811 - DNA, 23 bp, Homo sapiens
ccccatcttgggggtcacccatg

SEQ ID NO: 5593812 - DNA, 20 bp, Homo sapiens
ccccatctttgatccttctg

SEQ ID NO: 5593813 - DNA, 16 bp, Homo sapiens
ccccatgaaccctgcc

SEQ ID NO: 5593814 - DNA, 15 bp, Homo sapiens
ccccatgacctccag

SEQ ID NO: 5593815 - DNA, 18 bp, Homo sapiens
ccccatgaggaaggaaca

SEQ ID NO: 5593816 - DNA, 14 bp, Homo sapiens
ccccatgaggggat

SEQ ID NO: 5593817 - DNA, 18 bp, Homo sapiens
ccccatgagggtgttttt

SEQ ID NO: 5593818 - DNA, 13 bp, Homo sapiens
ccccctcctgcac

SEQ ID NO: 5593819 - DNA, 12 bp, Homo sapiens
ccccctcctgct

SEQ ID NO: 5593820 - DNA, 14 bp, Homo sapiens
ccccctcctgctgc

SEQ ID NO: 5593821 - DNA, 15 bp, Homo sapiens
ccccctcctgctgca

SEQ ID NO: 5593822 - DNA, 16 bp, Homo sapiens
ccccctcctgctgcag

SEQ ID NO: 5593823 - DNA, 16 bp, Homo sapiens
ccccctcctgctgtgc

SEQ ID NO: 5593824 - DNA, 13 bp, Homo sapiens
ccccctcctggca

SEQ ID NO: 5593825 - DNA, 18 bp, Homo sapiens
ccccctccttcccagctg

SEQ ID NO: 5593826 - DNA, 19 bp, Homo sapiens
ccccctccttcccagctgc

SEQ ID NO: 5593827 - DNA, 13 bp, Homo sapiens
ccccctcgccagc

SEQ ID NO: 5593828 - DNA, 13 bp, Homo sapiens
ccccctcggagcc

SEQ ID NO: 5593829 - DNA, 18 bp, Homo sapiens
ccccctcgtgccagtcgc

SEQ ID NO: 5593830 - DNA, 17 bp, Homo sapiens
ccccctctaggccttgc

SEQ ID NO: 5593831 - DNA, 10 bp, Homo sapiens
ccccctctcc

SEQ ID NO: 5593832 - DNA, 14 bp, Homo sapiens
ccccctctcccagt

SEQ ID NO: 5593833 - DNA, 15 bp, Homo sapiens
ccccctctccctgca

SEQ ID NO: 5593834 - DNA, 13 bp, Homo sapiens
ccccctctcctcc

SEQ ID NO: 5593835 - DNA, 16 bp, Homo sapiens
ccccctctcctcccag

SEQ ID NO: 5593836 - DNA, 20 bp, Homo sapiens
ccccctctcctcccagctgc

SEQ ID NO: 5593837 - DNA, 24 bp, Homo sapiens
ccccctctccttctcctagctctg

SEQ ID NO: 5593838 - DNA, 13 bp, Homo sapiens
ccccctctcgggc

SEQ ID NO: 5593839 - DNA, 22 bp, Homo sapiens
ccccctctgccggtcgggcagc

SEQ ID NO: 5593840 - DNA, 23 bp, Homo sapiens
ccccctctgccggtcgggcagcc

SEQ ID NO: 5593841 - DNA, 16 bp, Homo sapiens
ccccctctgcctttga

SEQ ID NO: 5593842 - DNA, 22 bp, Homo sapiens
ccccctctgcctttgagcttct

SEQ ID NO: 5593843 - DNA, 12 bp, Homo sapiens
ccccctctgctg

SEQ ID NO: 5593844 - DNA, 13 bp, Homo sapiens
ccccctctgcttc

SEQ ID NO: 5593845 - DNA, 19 bp, Homo sapiens
ccccctctggctccagctg

SEQ ID NO: 5593846 - DNA, 21 bp, Homo sapiens
ccccctctggctccagctggc

SEQ ID NO: 5593847 - DNA, 22 bp, Homo sapiens
ccccctgagatcccctgagccc

SEQ ID NO: 5593848 - DNA, 11 bp, Homo sapiens
ccccctgagtg

SEQ ID NO: 5593849 - DNA, 16 bp, Homo sapiens
ccccctgagtgggctg

SEQ ID NO: 5593850 - DNA, 11 bp, Homo sapiens
ccccctgcagc

SEQ ID NO: 5593851 - DNA, 23 bp, Homo sapiens
ccccctgcagccatcccaaggct

SEQ ID NO: 5593852 - DNA, 17 bp, Homo sapiens
ccccctgcagcccaggc

SEQ ID NO: 5593853 - DNA, 14 bp, Homo sapiens
ccccctgcagcttg

SEQ ID NO: 5593854 - DNA, 23 bp, Homo sapiens
ccccctgcagcttgtagccagcc

SEQ ID NO: 5593855 - DNA, 14 bp, Homo sapiens
ccccctgcaggaag

SEQ ID NO: 5593856 - DNA, 19 bp, Homo sapiens
ccccctgccagaggcctgg

SEQ ID NO: 5593857 - DNA, 16 bp, Homo sapiens
ccccctgccagtgcct

SEQ ID NO: 5593858 - DNA, 16 bp, Homo sapiens
ccccctgccccagaga

SEQ ID NO: 5593859 - DNA, 19 bp, Homo sapiens
ccccctgccccttctacac

SEQ ID NO: 5593860 - DNA, 23 bp, Homo sapiens
ccccctgccccttctacactctc

SEQ ID NO: 5593861 - DNA, 16 bp, Homo sapiens
ccccctgccctcgtgg

SEQ ID NO: 5593862 - DNA, 22 bp, Homo sapiens
ccccctgccctcgtggccagcc

SEQ ID NO: 5593863 - DNA, 13 bp, Homo sapiens
ccccctgccctgt

SEQ ID NO: 5593864 - DNA, 11 bp, Homo sapiens
ccccctgcctg

SEQ ID NO: 5593865 - DNA, 12 bp, Homo sapiens
ccccctgcctgc

SEQ ID NO: 5593866 - DNA, 20 bp, Homo sapiens
ccccctgctccaccagcagc

SEQ ID NO: 5593867 - DNA, 14 bp, Homo sapiens
ccccctgctgccat

SEQ ID NO: 5593868 - DNA, 14 bp, Homo sapiens
ccccctgctgctgc

SEQ ID NO: 5593869 - DNA, 12 bp, Homo sapiens
ccccctgctggc

SEQ ID NO: 5593870 - DNA, 12 bp, Homo sapiens
ccccctggagag

SEQ ID NO: 5593871 - DNA, 23 bp, Homo sapiens
ccccctggatgggcattgggctg

SEQ ID NO: 5593872 - DNA, 16 bp, Homo sapiens
ccccctggcagctgcc

SEQ ID NO: 5593873 - DNA, 19 bp, Homo sapiens
ccccctggcagctgcccct

SEQ ID NO: 5593874 - DNA, 17 bp, Homo sapiens
ccccctggcctccccca

SEQ ID NO: 5593875 - DNA, 13 bp, Homo sapiens
ccccctggctgac

SEQ ID NO: 5593876 - DNA, 20 bp, Homo sapiens
ccccctggctgactggccag

SEQ ID NO: 5593877 - DNA, 14 bp, Homo sapiens
ccccctggctttgg

SEQ ID NO: 5593878 - DNA, 10 bp, Homo sapiens
ccccctgggc

SEQ ID NO: 5593879 - DNA, 18 bp, Homo sapiens
ccccctgggctggggcct

SEQ ID NO: 5593880 - DNA, 19 bp, Homo sapiens
ccccctgggctggggcctc

SEQ ID NO: 5593881 - DNA, 22 bp, Homo sapiens
ccccctgggctggggcctcaga

SEQ ID NO: 5593882 - DNA, 11 bp, Homo sapiens
ccccctgggga

SEQ ID NO: 5593883 - DNA, 12 bp, Homo sapiens
ccccctggggat

SEQ ID NO: 5593884 - DNA, 19 bp, Homo sapiens
ccccctggggggcacagcc

SEQ ID NO: 5593885 - DNA, 21 bp, Homo sapiens
ccccctggggggcacagccag

SEQ ID NO: 5593886 - DNA, 17 bp, Homo sapiens
ccccctggtcccctcct

SEQ ID NO: 5593887 - DNA, 19 bp, Homo sapiens
ccccctggtggacagtcct

SEQ ID NO: 5593888 - DNA, 21 bp, Homo sapiens
ccccctggtggacagtcctgg

SEQ ID NO: 5593889 - DNA, 23 bp, Homo sapiens
ccccctggtggacagtcctggga

SEQ ID NO: 5593890 - DNA, 19 bp, Homo sapiens
ccccctgtaaggttccatc

SEQ ID NO: 5593891 - DNA, 12 bp, Homo sapiens
ccccctgtccca

SEQ ID NO: 5593892 - DNA, 15 bp, Homo sapiens
ccccctgtcccctca

SEQ ID NO: 5593893 - DNA, 12 bp, Homo sapiens
ccccctgtcctc

SEQ ID NO: 5593894 - DNA, 18 bp, Homo sapiens
ccccctgtgcctgctggg

SEQ ID NO: 5593895 - DNA, 20 bp, Homo sapiens
ccccctgtggatgctgctgc

SEQ ID NO: 5593896 - DNA, 18 bp, Homo sapiens
ccccctgtggtctgtgtg

SEQ ID NO: 5593897 - DNA, 16 bp, Homo sapiens
cccccttaaatttaat

SEQ ID NO: 5593898 - DNA, 12 bp, Homo sapiens
cccccttcagct

SEQ ID NO: 5593899 - DNA, 13 bp, Homo sapiens
cccccttcagctc

SEQ ID NO: 5593900 - DNA, 16 bp, Homo sapiens
cccccttcagctcctg

SEQ ID NO: 5593901 - DNA, 16 bp, Homo sapiens
cccccttcaggagcct

SEQ ID NO: 5593902 - DNA, 11 bp, Homo sapiens
cccccttccac

SEQ ID NO: 5593903 - DNA, 12 bp, Homo sapiens
cccccttcccat

SEQ ID NO: 5593904 - DNA, 13 bp, Homo sapiens
cccccttcctagt

SEQ ID NO: 5593905 - DNA, 14 bp, Homo sapiens
cccccttcctagtg

SEQ ID NO: 5593906 - DNA, 15 bp, Homo sapiens
cccccttcctagtga

SEQ ID NO: 5593907 - DNA, 23 bp, Homo sapiens
cccccttctgggcatctgttctg

SEQ ID NO: 5593908 - DNA, 18 bp, Homo sapiens
cccccttgaagcaataac

SEQ ID NO: 5593909 - DNA, 23 bp, Homo sapiens
cccccttgaatctgcagggagca

SEQ ID NO: 5593910 - DNA, 11 bp, Homo sapiens
cccccttggtg

SEQ ID NO: 5593911 - DNA, 15 bp, Homo sapiens
cccccttgtctgctg

SEQ ID NO: 5593912 - DNA, 15 bp, Homo sapiens
cccccttgtcttccc

SEQ ID NO: 5593913 - DNA, 20 bp, Homo sapiens
ccccctttagatctctgaag

SEQ ID NO: 5593914 - DNA, 21 bp, Homo sapiens
ccccctttagatctctgaagc

SEQ ID NO: 5593915 - DNA, 20 bp, Homo sapiens
ccccctttcctggacactca

SEQ ID NO: 5593916 - DNA, 17 bp, Homo sapiens
ccccctttctctgcctg

SEQ ID NO: 5593917 - DNA, 20 bp, Homo sapiens
ccccctttctctgcctggca

SEQ ID NO: 5593918 - DNA, 15 bp, Homo sapiens
ccccctttgctgtga

SEQ ID NO: 5593919 - DNA, 18 bp, Homo sapiens
ccccctttgctgtgagga

SEQ ID NO: 5593920 - DNA, 18 bp, Homo sapiens
ccccctttggcactggat

SEQ ID NO: 5593921 - DNA, 21 bp, Homo sapiens
ccccctttggcactggatgga

SEQ ID NO: 5593922 - DNA, 17 bp, Homo sapiens
ccccctttgtgctgtgg

SEQ ID NO: 5593923 - DNA, 18 bp, Homo sapiens
ccccctttgtgctgtggg

SEQ ID NO: 5593924 - DNA, 22 bp, Homo sapiens
cccccttttcagctgagccctg

SEQ ID NO: 5593925 - DNA, 16 bp, Homo sapiens
ccccgaagggccccca

SEQ ID NO: 5593926 - DNA, 12 bp, Homo sapiens
ccccgacactgc

SEQ ID NO: 5593927 - DNA, 13 bp, Homo sapiens
ccccgaccctgcc

SEQ ID NO: 5593928 - DNA, 15 bp, Homo sapiens
ccccgacggctgtga

SEQ ID NO: 5593929 - DNA, 15 bp, Homo sapiens
ccccgacgtgctccc

SEQ ID NO: 5593930 - DNA, 18 bp, Homo sapiens
ccccgacgtgctcccctg

SEQ ID NO: 5593931 - DNA, 13 bp, Homo sapiens
ccccgactgcctg

SEQ ID NO: 5593932 - DNA, 14 bp, Homo sapiens
ccccgactgcctgt

SEQ ID NO: 5593933 - DNA, 12 bp, Homo sapiens
ccccgagccctg

SEQ ID NO: 5593934 - DNA, 20 bp, Homo sapiens
ccccgagccgagctctcctg

SEQ ID NO: 5593935 - DNA, 17 bp, Homo sapiens
ccccgaggcccccctct

SEQ ID NO: 5593936 - DNA, 21 bp, Homo sapiens
ccccgaggcccccctctgcct

SEQ ID NO: 5593937 - DNA, 23 bp, Homo sapiens
ccccgaggccttctctgaaggac

SEQ ID NO: 5593938 - DNA, 22 bp, Homo sapiens
ccccgaggctgccccaggccgg

SEQ ID NO: 5593939 - DNA, 23 bp, Homo sapiens
ccccgaggctgccccaggccgga

SEQ ID NO: 5593940 - DNA, 13 bp, Homo sapiens
ccccgaggctgct

SEQ ID NO: 5593941 - DNA, 12 bp, Homo sapiens
ccccgagggcgg

SEQ ID NO: 5593942 - DNA, 13 bp, Homo sapiens
ccccgagtcctca

SEQ ID NO: 5593943 - DNA, 23 bp, Homo sapiens
ccccgagtgaggacgcaccgccg

SEQ ID NO: 5593944 - DNA, 20 bp, Homo sapiens
ccccgatggactcctgacca

SEQ ID NO: 5593945 - DNA, 15 bp, Homo sapiens
ccccgatggcgggga

SEQ ID NO: 5593946 - DNA, 15 bp, Homo sapiens
ccccgatgggatggc

SEQ ID NO: 5593947 - DNA, 13 bp, Homo sapiens
ccccgatgtcccc

SEQ ID NO: 5593948 - DNA, 22 bp, Homo sapiens
ccccgatgtgagccgcctcgga

SEQ ID NO: 5593949 - DNA, 16 bp, Homo sapiens
ccccgcaaaacccact

SEQ ID NO: 5593950 - DNA, 15 bp, Homo sapiens
ccccgcacagccacc

SEQ ID NO: 5593951 - DNA, 19 bp, Homo sapiens
ccccgcacagccacccgtg

SEQ ID NO: 5593952 - DNA, 16 bp, Homo sapiens
ccccgcacccccgcca

SEQ ID NO: 5593953 - DNA, 23 bp, Homo sapiens
ccccgcacctgtacagtggaacc

SEQ ID NO: 5593954 - DNA, 19 bp, Homo sapiens
ccccgcacgcaagcctcag

SEQ ID NO: 5593955 - DNA, 14 bp, Homo sapiens
ccccgcactgggct

SEQ ID NO: 5593956 - DNA, 17 bp, Homo sapiens
ccccgcagacctcccca

SEQ ID NO: 5593957 - DNA, 19 bp, Homo sapiens
ccccgcagacctccccagc

SEQ ID NO: 5593958 - DNA, 20 bp, Homo sapiens
ccccgcagacctccccagcc

SEQ ID NO: 5593959 - DNA, 21 bp, Homo sapiens
ccccgcagacctccccagccc

SEQ ID NO: 5593960 - DNA, 23 bp, Homo sapiens
ccccgcagacctccccagcccct

SEQ ID NO: 5593961 - DNA, 22 bp, Homo sapiens
ccccgcagacggtctgtgtgct

SEQ ID NO: 5593962 - DNA, 23 bp, Homo sapiens
ccccgcagacggtctgtgtgctg

SEQ ID NO: 5593963 - DNA, 17 bp, Homo sapiens
ccccgcagcacgcctct

SEQ ID NO: 5593964 - DNA, 14 bp, Homo sapiens
ccccgcagcccgtg

SEQ ID NO: 5593965 - DNA, 12 bp, Homo sapiens
ccccgcagccct

SEQ ID NO: 5593966 - DNA, 17 bp, Homo sapiens
ccccgcagccctctcca

SEQ ID NO: 5593967 - DNA, 19 bp, Homo sapiens
ccccgcaggatccctcctg

SEQ ID NO: 5593968 - DNA, 19 bp, Homo sapiens
ccccgcaggcctgccttct

SEQ ID NO: 5593969 - DNA, 12 bp, Homo sapiens
ccccgcagtccc

SEQ ID NO: 5593970 - DNA, 15 bp, Homo sapiens
ccccgcagtccccag

SEQ ID NO: 5593971 - DNA, 19 bp, Homo sapiens
ccccgcagtcgtcagcctc

SEQ ID NO: 5593972 - DNA, 24 bp, Homo sapiens
ccccgcagtcgtcagcctccctga

SEQ ID NO: 5593973 - DNA, 18 bp, Homo sapiens
ccccgcagtgtttgtgtg

SEQ ID NO: 5593974 - DNA, 19 bp, Homo sapiens
ccccgcatcccctgcctcc

SEQ ID NO: 5593975 - DNA, 22 bp, Homo sapiens
ccccgccatggtcaccctcagg

SEQ ID NO: 5593976 - DNA, 12 bp, Homo sapiens
ccccgcccacac

SEQ ID NO: 5593977 - DNA, 15 bp, Homo sapiens
ccccgcccacccacg

SEQ ID NO: 5593978 - DNA, 14 bp, Homo sapiens
ccccgcccaggctt

SEQ ID NO: 5593979 - DNA, 13 bp, Homo sapiens
ccccgccccaccc

SEQ ID NO: 5593980 - DNA, 12 bp, Homo sapiens
ccccgccccaga

SEQ ID NO: 5593981 - DNA, 14 bp, Homo sapiens
ccccgccccatcct

SEQ ID NO: 5593982 - DNA, 16 bp, Homo sapiens
ccccgcccccaagctc

SEQ ID NO: 5593983 - DNA, 13 bp, Homo sapiens
ccccgcccccacc

SEQ ID NO: 5593984 - DNA, 14 bp, Homo sapiens
ccccgcccccaccc

SEQ ID NO: 5593985 - DNA, 13 bp, Homo sapiens
ccccgccccccag

SEQ ID NO: 5593986 - DNA, 14 bp, Homo sapiens
ccccgccccccaga

SEQ ID NO: 5593987 - DNA, 15 bp, Homo sapiens
ccccgccccccagag

SEQ ID NO: 5593988 - DNA, 21 bp, Homo sapiens
ccccgccccctccctgctccc

SEQ ID NO: 5593989 - DNA, 13 bp, Homo sapiens
ccccgccccctgc

SEQ ID NO: 5593990 - DNA, 18 bp, Homo sapiens
ccccgccccctgccctcc

SEQ ID NO: 5593991 - DNA, 14 bp, Homo sapiens
ccccgcccctgcat

SEQ ID NO: 5593992 - DNA, 16 bp, Homo sapiens
ccccgcccctgcatgc

SEQ ID NO: 5593993 - DNA, 22 bp, Homo sapiens
ccccgcccctgggctaccatct

SEQ ID NO: 5593994 - DNA, 15 bp, Homo sapiens
ccccgcccctgtggc

SEQ ID NO: 5593995 - DNA, 23 bp, Homo sapiens
ccccgcccgccctcctctgcccc

SEQ ID NO: 5593996 - DNA, 15 bp, Homo sapiens
ccccgcccggcctcc

SEQ ID NO: 5593997 - DNA, 17 bp, Homo sapiens
ccccgcccggcctccta

SEQ ID NO: 5593998 - DNA, 18 bp, Homo sapiens
ccccgcccggcctcctag

SEQ ID NO: 5593999 - DNA, 20 bp, Homo sapiens
cccctcgacagctctctggg

SEQ ID NO: 5594000 - DNA, 13 bp, Homo sapiens
cccctcgaggcct

SEQ ID NO: 5594001 - DNA, 17 bp, Homo sapiens
cccctcgaggcctacag

SEQ ID NO: 5594002 - DNA, 14 bp, Homo sapiens
cccctcgcacacag

SEQ ID NO: 5594003 - DNA, 16 bp, Homo sapiens
cccctcgcacacaggg

SEQ ID NO: 5594004 - DNA, 14 bp, Homo sapiens
cccctcgccagctt

SEQ ID NO: 5594005 - DNA, 19 bp, Homo sapiens
cccctcgccagcttctcct

SEQ ID NO: 5594006 - DNA, 13 bp, Homo sapiens
cccctcgccccag

SEQ ID NO: 5594007 - DNA, 19 bp, Homo sapiens
cccctcgccttcaggagaa

SEQ ID NO: 5594008 - DNA, 19 bp, Homo sapiens
cccctcgcgcccctgtcca

SEQ ID NO: 5594009 - DNA, 14 bp, Homo sapiens
cccctcgctgctgc

SEQ ID NO: 5594010 - DNA, 20 bp, Homo sapiens
cccctcgctgtcctgctgtg

SEQ ID NO: 5594011 - DNA, 14 bp, Homo sapiens
cccctcggacagcc

SEQ ID NO: 5594012 - DNA, 13 bp, Homo sapiens
cccctcggagcct

SEQ ID NO: 5594013 - DNA, 14 bp, Homo sapiens
cccctcggagcctg

SEQ ID NO: 5594014 - DNA, 21 bp, Homo sapiens
cccctcggcattcacacacag

SEQ ID NO: 5594015 - DNA, 17 bp, Homo sapiens
cccctcggcccctcacc

SEQ ID NO: 5594016 - DNA, 17 bp, Homo sapiens
cccctcgtgccagtcgc

SEQ ID NO: 5594017 - DNA, 23 bp, Homo sapiens
cccctcgtgtgactctcttggat

SEQ ID NO: 5594018 - DNA, 16 bp, Homo sapiens
cccctcgttagccttc

SEQ ID NO: 5594019 - DNA, 18 bp, Homo sapiens
cccctctaactggacagc

SEQ ID NO: 5594020 - DNA, 19 bp, Homo sapiens
cccctctaatgctcacgct

SEQ ID NO: 5594021 - DNA, 18 bp, Homo sapiens
cccctctcacaggcagct

SEQ ID NO: 5594022 - DNA, 13 bp, Homo sapiens
cccctctcacgcc

SEQ ID NO: 5594023 - DNA, 16 bp, Homo sapiens
cccctctcacgccacc

SEQ ID NO: 5594024 - DNA, 17 bp, Homo sapiens
cccctctcacgccaccc

SEQ ID NO: 5594025 - DNA, 13 bp, Homo sapiens
cccctctcagccc

SEQ ID NO: 5594026 - DNA, 12 bp, Homo sapiens
cccctctccagg

SEQ ID NO: 5594027 - DNA, 16 bp, Homo sapiens
cccctctccaggcctg

SEQ ID NO: 5594028 - DNA, 20 bp, Homo sapiens
cccctctccaggcgccggcg

SEQ ID NO: 5594029 - DNA, 13 bp, Homo sapiens
cccctctcccctc

SEQ ID NO: 5594030 - DNA, 15 bp, Homo sapiens
cccctctccccttgg

SEQ ID NO: 5594031 - DNA, 17 bp, Homo sapiens
cccctctccccttggtt

SEQ ID NO: 5594032 - DNA, 18 bp, Homo sapiens
cccctctccctgcatggc

SEQ ID NO: 5594033 - DNA, 12 bp, Homo sapiens
cccctctccctt

SEQ ID NO: 5594034 - DNA, 13 bp, Homo sapiens
cccctctcccttc

SEQ ID NO: 5594035 - DNA, 12 bp, Homo sapiens
cccctctcctcc

SEQ ID NO: 5594036 - DNA, 17 bp, Homo sapiens
cccctctcctcccagct

SEQ ID NO: 5594037 - DNA, 14 bp, Homo sapiens
cccctctcctccgc

SEQ ID NO: 5594038 - DNA, 22 bp, Homo sapiens
cccctctcctgagcctgtctct

SEQ ID NO: 5594039 - DNA, 16 bp, Homo sapiens
cccctctcctgcatcc

SEQ ID NO: 5594040 - DNA, 14 bp, Homo sapiens
cccctctcctggag

SEQ ID NO: 5594041 - DNA, 14 bp, Homo sapiens
cccctctccttcct

SEQ ID NO: 5594042 - DNA, 17 bp, Homo sapiens
cccctctccttctccta

SEQ ID NO: 5594043 - DNA, 18 bp, Homo sapiens
cccctctcgccccatccc

SEQ ID NO: 5594044 - DNA, 13 bp, Homo sapiens
cccctctcggcca

SEQ ID NO: 5594045 - DNA, 21 bp, Homo sapiens
cccctctcgggctctctcacc

SEQ ID NO: 5594046 - DNA, 16 bp, Homo sapiens
cccctctctagggacc

SEQ ID NO: 5594047 - DNA, 12 bp, Homo sapiens
cccctctctgcc

SEQ ID NO: 5594048 - DNA, 11 bp, Homo sapiens
cccctctctgg

SEQ ID NO: 5594049 - DNA, 12 bp, Homo sapiens
cccctctctggg

SEQ ID NO: 5594050 - DNA, 18 bp, Homo sapiens
cccctctgacctgcactg

SEQ ID NO: 5594051 - DNA, 18 bp, Homo sapiens
cccctctgcaacccccca

SEQ ID NO: 5594052 - DNA, 22 bp, Homo sapiens
cccctctgcccagcttgggccc

SEQ ID NO: 5594053 - DNA, 12 bp, Homo sapiens
cccctctgcccc

SEQ ID NO: 5594054 - DNA, 13 bp, Homo sapiens
cccctctgccctg

SEQ ID NO: 5594055 - DNA, 15 bp, Homo sapiens
cccctctgccctgcg

SEQ ID NO: 5594056 - DNA, 23 bp, Homo sapiens
cccctctgccctgcgggtcacag

SEQ ID NO: 5594057 - DNA, 12 bp, Homo sapiens
cccctctgccgg

SEQ ID NO: 5594058 - DNA, 17 bp, Homo sapiens
cccctctgccttgccct

SEQ ID NO: 5594059 - DNA, 15 bp, Homo sapiens
cccctctgcctttga

SEQ ID NO: 5594060 - DNA, 13 bp, Homo sapiens
cccctctgcgccc

SEQ ID NO: 5594061 - DNA, 13 bp, Homo sapiens
cccctctgctggc

SEQ ID NO: 5594062 - DNA, 14 bp, Homo sapiens
cccctctgctggcc

SEQ ID NO: 5594063 - DNA, 16 bp, Homo sapiens
cccctctgctgtcctg

SEQ ID NO: 5594064 - DNA, 19 bp, Homo sapiens
cccctctgctgtcctgcag

SEQ ID NO: 5594065 - DNA, 13 bp, Homo sapiens
cccctctgcttct

SEQ ID NO: 5594066 - DNA, 18 bp, Homo sapiens
cccctctggagaaggcct

SEQ ID NO: 5594067 - DNA, 16 bp, Homo sapiens
cccctctggctccagc

SEQ ID NO: 5594068 - DNA, 23 bp, Homo sapiens
cccctctggtcgctcctgcccac

SEQ ID NO: 5594069 - DNA, 22 bp, Homo sapiens
cccctctgtcatcactccctgg

SEQ ID NO: 5594070 - DNA, 22 bp, Homo sapiens
cccctctgtccaggcactgaga

SEQ ID NO: 5594071 - DNA, 18 bp, Homo sapiens
cccctctgtctacaaata

SEQ ID NO: 5594072 - DNA, 21 bp, Homo sapiens
cccctctgtcttcaaggacta

SEQ ID NO: 5594073 - DNA, 13 bp, Homo sapiens
cccctctgttctc

SEQ ID NO: 5594074 - DNA, 18 bp, Homo sapiens
cccctcttattcctctag

SEQ ID NO: 5594075 - DNA, 19 bp, Homo sapiens
cccctcttcaaagcagagt

SEQ ID NO: 5594076 - DNA, 22 bp, Homo sapiens
cccctcttccaaaggcagcgtg

SEQ ID NO: 5594077 - DNA, 14 bp, Homo sapiens
cccctcttccctgg

SEQ ID NO: 5594078 - DNA, 22 bp, Homo sapiens
cccctcttcctcttgaccctgc

SEQ ID NO: 5594079 - DNA, 20 bp, Homo sapiens
cccctcttcctggagcccca

SEQ ID NO: 5594080 - DNA, 23 bp, Homo sapiens
cccctcttcctggagccccagaa

SEQ ID NO: 5594081 - DNA, 18 bp, Homo sapiens
cccctcttgagaggggtg

SEQ ID NO: 5594082 - DNA, 15 bp, Homo sapiens
cccctcttgccccaa

SEQ ID NO: 5594083 - DNA, 18 bp, Homo sapiens
cccctcttgccccaaccc

SEQ ID NO: 5594084 - DNA, 22 bp, Homo sapiens
cccctcttgccccaacccccag

SEQ ID NO: 5594085 - DNA, 22 bp, Homo sapiens
cccctcttggagaagtctcagc

SEQ ID NO: 5594086 - DNA, 23 bp, Homo sapiens
cccctcttggagaagtctcagct

SEQ ID NO: 5594087 - DNA, 13 bp, Homo sapiens
cccctctttctct

SEQ ID NO: 5594088 - DNA, 17 bp, Homo sapiens
cccctctttctctttct

SEQ ID NO: 5594089 - DNA, 10 bp, Homo sapiens
cccctgaaac

SEQ ID NO: 5594090 - DNA, 21 bp, Homo sapiens
cccctgaaacatgtgcccctg

SEQ ID NO: 5594091 - DNA, 17 bp, Homo sapiens
cccctgaagtgacccca

SEQ ID NO: 5594092 - DNA, 20 bp, Homo sapiens
cccctgaagtgaccccagct

SEQ ID NO: 5594093 - DNA, 22 bp, Homo sapiens
cccctgacccagggactctcca

SEQ ID NO: 5594094 - DNA, 18 bp, Homo sapiens
cccctgacctcactgtga

SEQ ID NO: 5594095 - DNA, 22 bp, Homo sapiens
cccctgagagtggtgccctgga

SEQ ID NO: 5594096 - DNA, 20 bp, Homo sapiens
cccctgagagtttcctcaga

SEQ ID NO: 5594097 - DNA, 19 bp, Homo sapiens
cccctgagcaatgtctgtg

SEQ ID NO: 5594098 - DNA, 12 bp, Homo sapiens
cccctgagccca

SEQ ID NO: 5594099 - DNA, 13 bp, Homo sapiens
cccctgagcccca

SEQ ID NO: 5594100 - DNA, 13 bp, Homo sapiens
cccctgagcctgt

SEQ ID NO: 5594101 - DNA, 17 bp, Homo sapiens
cccctgagcctgtgtcc

SEQ ID NO: 5594102 - DNA, 15 bp, Homo sapiens
cccctgaggactgga

SEQ ID NO: 5594103 - DNA, 13 bp, Homo sapiens
cccctgaggagct

SEQ ID NO: 5594104 - DNA, 18 bp, Homo sapiens
cccctgaggcagcccagc

SEQ ID NO: 5594105 - DNA, 20 bp, Homo sapiens
cccctgaggcagcccagctc

SEQ ID NO: 5594106 - DNA, 22 bp, Homo sapiens
cccctgagggtggtcagccaag

SEQ ID NO: 5594107 - DNA, 15 bp, Homo sapiens
cccctgaggtcagga

SEQ ID NO: 5594108 - DNA, 14 bp, Homo sapiens
cccctgagtccgcc

SEQ ID NO: 5594109 - DNA, 21 bp, Homo sapiens
cccctgagtgggctgggccct

SEQ ID NO: 5594110 - DNA, 21 bp, Homo sapiens
cccctgagttgggcagccagg

SEQ ID NO: 5594111 - DNA, 14 bp, Homo sapiens
cccctgatcactcc

SEQ ID NO: 5594112 - DNA, 17 bp, Homo sapiens
cccctgatcactcccag

SEQ ID NO: 5594113 - DNA, 19 bp, Homo sapiens
cccctgatcactcccagca

SEQ ID NO: 5594114 - DNA, 22 bp, Homo sapiens
cccctgatcactcccagcactc

SEQ ID NO: 5594115 - DNA, 18 bp, Homo sapiens
cccctgatctctgacctc

SEQ ID NO: 5594116 - DNA, 21 bp, Homo sapiens
cccctgatctctgacctctgc

SEQ ID NO: 5594117 - DNA, 23 bp, Homo sapiens
cccctgatctctgacctctgctg

SEQ ID NO: 5594118 - DNA, 19 bp, Homo sapiens
cccctgatgcagcctgtgg

SEQ ID NO: 5594119 - DNA, 20 bp, Homo sapiens
cccctgatgcagcctgtggc

SEQ ID NO: 5594120 - DNA, 15 bp, Homo sapiens
cccctgcaaaaagaa

SEQ ID NO: 5594121 - DNA, 15 bp, Homo sapiens
cccctgcaaagccca

SEQ ID NO: 5594122 - DNA, 17 bp, Homo sapiens
cccctgcaaagcccagc

SEQ ID NO: 5594123 - DNA, 20 bp, Homo sapiens
cccctgcaaagcccagcttg

SEQ ID NO: 5594124 - DNA, 21 bp, Homo sapiens
cccctgcaaagcccagcttga

SEQ ID NO: 5594125 - DNA, 12 bp, Homo sapiens
cccctgcacaca

SEQ ID NO: 5594126 - DNA, 13 bp, Homo sapiens
cccctgcacacac

SEQ ID NO: 5594127 - DNA, 14 bp, Homo sapiens
cccctgcacacacc

SEQ ID NO: 5594128 - DNA, 17 bp, Homo sapiens
cccctgcacacacctgc

SEQ ID NO: 5594129 - DNA, 11 bp, Homo sapiens
cccctgcacag

SEQ ID NO: 5594130 - DNA, 15 bp, Homo sapiens
cccctgcacagcagg

SEQ ID NO: 5594131 - DNA, 13 bp, Homo sapiens
cccctgcacagtt

SEQ ID NO: 5594132 - DNA, 18 bp, Homo sapiens
cccctgcacccacccctg

SEQ ID NO: 5594133 - DNA, 19 bp, Homo sapiens
cccctgcacccacccctgc

SEQ ID NO: 5594134 - DNA, 14 bp, Homo sapiens
cccctgcacctgct

SEQ ID NO: 5594135 - DNA, 16 bp, Homo sapiens
cccctgcacctggcct

SEQ ID NO: 5594136 - DNA, 17 bp, Homo sapiens
cccctgcacctggcctg

SEQ ID NO: 5594137 - DNA, 11 bp, Homo sapiens
cccctgcactg

SEQ ID NO: 5594138 - DNA, 21 bp, Homo sapiens
cccctgcagacgtctggccct

SEQ ID NO: 5594139 - DNA, 15 bp, Homo sapiens
cccctgcagattctg

SEQ ID NO: 5594140 - DNA, 14 bp, Homo sapiens
cccctgcagcacgg

SEQ ID NO: 5594141 - DNA, 16 bp, Homo sapiens
cccctgcagcacggac

SEQ ID NO: 5594142 - DNA, 13 bp, Homo sapiens
cccctgcagccca

SEQ ID NO: 5594143 - DNA, 17 bp, Homo sapiens
cccctgcagcccaggcc

SEQ ID NO: 5594144 - DNA, 18 bp, Homo sapiens
cccctgcagcccaggcca

SEQ ID NO: 5594145 - DNA, 21 bp, Homo sapiens
cccctgcagcctgggtctgga

SEQ ID NO: 5594146 - DNA, 17 bp, Homo sapiens
cccctgcagctcctctg

SEQ ID NO: 5594147 - DNA, 22 bp, Homo sapiens
cccctgcagcttgtagccagcc

SEQ ID NO: 5594148 - DNA, 22 bp, Homo sapiens
cccctgcaggaaggagctgcct

SEQ ID NO: 5594149 - DNA, 21 bp, Homo sapiens
cccctgcagttggcagaaagg

SEQ ID NO: 5594150 - DNA, 22 bp, Homo sapiens
cccctgcagtttggccctggag

SEQ ID NO: 5594151 - DNA, 23 bp, Homo sapiens
cccctgcagtttggccctggagc

SEQ ID NO: 5594152 - DNA, 14 bp, Homo sapiens
cccctgccaccctg

SEQ ID NO: 5594153 - DNA, 21 bp, Homo sapiens
cccctgccaccgactgcccag

SEQ ID NO: 5594154 - DNA, 22 bp, Homo sapiens
cccctgccaccgactgcccagc

SEQ ID NO: 5594155 - DNA, 18 bp, Homo sapiens
cccctgccacctccctga

SEQ ID NO: 5594156 - DNA, 12 bp, Homo sapiens
cccctgccagca

SEQ ID NO: 5594157 - DNA, 13 bp, Homo sapiens
cccctgccagccg

SEQ ID NO: 5594158 - DNA, 22 bp, Homo sapiens
cccctgccagccgaccctcctg

SEQ ID NO: 5594159 - DNA, 24 bp, Homo sapiens
cccctgccagccgaccctcctggc

SEQ ID NO: 5594160 - DNA, 15 bp, Homo sapiens
cccctgccagggcag

SEQ ID NO: 5594161 - DNA, 23 bp, Homo sapiens
cccctgccagggcagggccccag

SEQ ID NO: 5594162 - DNA, 14 bp, Homo sapiens
cccctgccagtgcc

SEQ ID NO: 5594163 - DNA, 19 bp, Homo sapiens
cccctgccagttctctgtg

SEQ ID NO: 5594164 - DNA, 19 bp, Homo sapiens
cccctgcccaagtggctct

SEQ ID NO: 5594165 - DNA, 19 bp, Homo sapiens
cccctgcccacgcccttgg

SEQ ID NO: 5594166 - DNA, 15 bp, Homo sapiens
cccctgcccagcacc

SEQ ID NO: 5594167 - DNA, 13 bp, Homo sapiens
cccctgccccaga

SEQ ID NO: 5594168 - DNA, 15 bp, Homo sapiens
cccctgccccagaga

SEQ ID NO: 5594169 - DNA, 23 bp, Homo sapiens
cccctgccccagagaagcctcag

SEQ ID NO: 5594170 - DNA, 11 bp, Homo sapiens
cccctgccccc

SEQ ID NO: 5594171 - DNA, 15 bp, Homo sapiens
cccctgccccctgca

SEQ ID NO: 5594172 - DNA, 17 bp, Homo sapiens
cccctgccccctgcagg

SEQ ID NO: 5594173 - DNA, 14 bp, Homo sapiens
cccctgccccgccc

SEQ ID NO: 5594174 - DNA, 18 bp, Homo sapiens
cccctgcccctgctactg

SEQ ID NO: 5594175 - DNA, 19 bp, Homo sapiens
cccctgcccctgtgggact

SEQ ID NO: 5594176 - DNA, 22 bp, Homo sapiens
cccctgcccgaccccatctcat

SEQ ID NO: 5594177 - DNA, 18 bp, Homo sapiens
cccctgcccgagagctct

SEQ ID NO: 5594178 - DNA, 21 bp, Homo sapiens
cccgcagggccatgcagacct

SEQ ID NO: 5594179 - DNA, 19 bp, Homo sapiens
cccgcagtccccagccctt

SEQ ID NO: 5594180 - DNA, 11 bp, Homo sapiens
cccgcagtgcc

SEQ ID NO: 5594181 - DNA, 18 bp, Homo sapiens
cccgcagtgccctgcccc

SEQ ID NO: 5594182 - DNA, 23 bp, Homo sapiens
cccgcagtgctgggaccagagcc

SEQ ID NO: 5594183 - DNA, 23 bp, Homo sapiens
cccgcatatactttaatgtttta

SEQ ID NO: 5594184 - DNA, 19 bp, Homo sapiens
cccgcatcccctgcctcca

SEQ ID NO: 5594185 - DNA, 20 bp, Homo sapiens
cccgcatcccctgcctccat

SEQ ID NO: 5594186 - DNA, 22 bp, Homo sapiens
cccgcatgctgcctgcctccgg

SEQ ID NO: 5594187 - DNA, 18 bp, Homo sapiens
cccgcatgtacaaaaaca

SEQ ID NO: 5594188 - DNA, 20 bp, Homo sapiens
cccgcatgtacaaaaacaca

SEQ ID NO: 5594189 - DNA, 16 bp, Homo sapiens
cccgcattccaggctc

SEQ ID NO: 5594190 - DNA, 14 bp, Homo sapiens
cccgccacacagac

SEQ ID NO: 5594191 - DNA, 23 bp, Homo sapiens
cccgccacatggtgtggccatca

SEQ ID NO: 5594192 - DNA, 24 bp, Homo sapiens
cccgccacctccccactccagcag

SEQ ID NO: 5594193 - DNA, 15 bp, Homo sapiens
cccgccacggccacc

SEQ ID NO: 5594194 - DNA, 17 bp, Homo sapiens
cccgccactcgccttct

SEQ ID NO: 5594195 - DNA, 14 bp, Homo sapiens
cccgccagcctcag

SEQ ID NO: 5594196 - DNA, 13 bp, Homo sapiens
cccgccaggcgca

SEQ ID NO: 5594197 - DNA, 18 bp, Homo sapiens
cccgccagggagtgtgat

SEQ ID NO: 5594198 - DNA, 20 bp, Homo sapiens
cccgccatggtcaccctcag

SEQ ID NO: 5594199 - DNA, 19 bp, Homo sapiens
cccgcccaaacctttcccc

SEQ ID NO: 5594200 - DNA, 14 bp, Homo sapiens
cccgcccacaccct

SEQ ID NO: 5594201 - DNA, 11 bp, Homo sapiens
cccgcccacca

SEQ ID NO: 5594202 - DNA, 15 bp, Homo sapiens
cccgcccacccacgc

SEQ ID NO: 5594203 - DNA, 13 bp, Homo sapiens
cccgcccaccccg

SEQ ID NO: 5594204 - DNA, 20 bp, Homo sapiens
cccgcccacccgccttgtga

SEQ ID NO: 5594205 - DNA, 17 bp, Homo sapiens
cccgcccactgtcctgg

SEQ ID NO: 5594206 - DNA, 19 bp, Homo sapiens
cccgcccactgtcctgggc

SEQ ID NO: 5594207 - DNA, 13 bp, Homo sapiens
cccgcccagctgc

SEQ ID NO: 5594208 - DNA, 12 bp, Homo sapiens
cccgcccaggct

SEQ ID NO: 5594209 - DNA, 14 bp, Homo sapiens
cccgcccaggctgg

SEQ ID NO: 5594210 - DNA, 16 bp, Homo sapiens
cccgcccatgctgtcc

SEQ ID NO: 5594211 - DNA, 21 bp, Homo sapiens
cccgccccagagactgcccac

SEQ ID NO: 5594212 - DNA, 17 bp, Homo sapiens
cccgccccagagctccg

SEQ ID NO: 5594213 - DNA, 13 bp, Homo sapiens
cccgccccagagt

SEQ ID NO: 5594214 - DNA, 14 bp, Homo sapiens
cccgccccagccct

SEQ ID NO: 5594215 - DNA, 19 bp, Homo sapiens
cccgccccagccctcagtc

SEQ ID NO: 5594216 - DNA, 15 bp, Homo sapiens
cccgccccagcctcc

SEQ ID NO: 5594217 - DNA, 19 bp, Homo sapiens
cccgccccccagagccagg

SEQ ID NO: 5594218 - DNA, 20 bp, Homo sapiens
cccgccccccagagccaggg

SEQ ID NO: 5594219 - DNA, 22 bp, Homo sapiens
cccgccccccagagccagggct

SEQ ID NO: 5594220 - DNA, 18 bp, Homo sapiens
cccgcccccgccctcgct

SEQ ID NO: 5594221 - DNA, 14 bp, Homo sapiens
cccgccccctccct

SEQ ID NO: 5594222 - DNA, 17 bp, Homo sapiens
cccgccccctccctata

SEQ ID NO: 5594223 - DNA, 16 bp, Homo sapiens
cccgccccctccctgc

SEQ ID NO: 5594224 - DNA, 16 bp, Homo sapiens
cccgccccctgccctc

SEQ ID NO: 5594225 - DNA, 17 bp, Homo sapiens
cccgccccgcccccgcc

SEQ ID NO: 5594226 - DNA, 21 bp, Homo sapiens
cccgccccgctgctcccggtg

SEQ ID NO: 5594227 - DNA, 12 bp, Homo sapiens
cccgcccctccc

SEQ ID NO: 5594228 - DNA, 16 bp, Homo sapiens
cccgcccctcccccta

SEQ ID NO: 5594229 - DNA, 11 bp, Homo sapiens
cccgcccctcg

SEQ ID NO: 5594230 - DNA, 19 bp, Homo sapiens
cccgcccctcgctgctgct

SEQ ID NO: 5594231 - DNA, 22 bp, Homo sapiens
cccgcccctcgctgctgctact

SEQ ID NO: 5594232 - DNA, 15 bp, Homo sapiens
cccgcccctgcagca

SEQ ID NO: 5594233 - DNA, 15 bp, Homo sapiens
cccgcccctgcatgc

SEQ ID NO: 5594234 - DNA, 16 bp, Homo sapiens
cccgcccctgcatgcc

SEQ ID NO: 5594235 - DNA, 18 bp, Homo sapiens
cccgcccctgcatgcctg

SEQ ID NO: 5594236 - DNA, 21 bp, Homo sapiens
cccgcccctgggctaccatct

SEQ ID NO: 5594237 - DNA, 21 bp, Homo sapiens
cccgcccgagggatggtgccc

SEQ ID NO: 5594238 - DNA, 12 bp, Homo sapiens
cccgccctcacc

SEQ ID NO: 5594239 - DNA, 21 bp, Homo sapiens
cccgccctcaggggcctctct

SEQ ID NO: 5594240 - DNA, 16 bp, Homo sapiens
cccgccctcctctgcc

SEQ ID NO: 5594241 - DNA, 13 bp, Homo sapiens
cccgccctctgcc

SEQ ID NO: 5594242 - DNA, 15 bp, Homo sapiens
cccgccctctgcgtc

SEQ ID NO: 5594243 - DNA, 16 bp, Homo sapiens
cccgccctgcccctgc

SEQ ID NO: 5594244 - DNA, 14 bp, Homo sapiens
cccgccctggctct

SEQ ID NO: 5594245 - DNA, 13 bp, Homo sapiens
cccgcccttccga

SEQ ID NO: 5594246 - DNA, 17 bp, Homo sapiens
cccgccctttccttgcc

SEQ ID NO: 5594247 - DNA, 18 bp, Homo sapiens
cccgccgcctggtactca

SEQ ID NO: 5594248 - DNA, 17 bp, Homo sapiens
cccgccgcgccagtccc

SEQ ID NO: 5594249 - DNA, 21 bp, Homo sapiens
cccgccggttggccggctggc

SEQ ID NO: 5594250 - DNA, 15 bp, Homo sapiens
cccgccgtctgcagg

SEQ ID NO: 5594251 - DNA, 20 bp, Homo sapiens
cccgccgtgtctgtggccct

SEQ ID NO: 5594252 - DNA, 21 bp, Homo sapiens
cccgccgtgtctgtggccctc

SEQ ID NO: 5594253 - DNA, 19 bp, Homo sapiens
cccgcctcagcctcctgag

SEQ ID NO: 5594254 - DNA, 13 bp, Homo sapiens
cccgcctccactc

SEQ ID NO: 5594255 - DNA, 14 bp, Homo sapiens
cccgcctccccata

SEQ ID NO: 5594256 - DNA, 20 bp, Homo sapiens
cccgcctcccggggtgcccg

SEQ ID NO: 5594257 - DNA, 24 bp, Homo sapiens
cccgcctccctctcagaggcctgc

SEQ ID NO: 5594258 - DNA, 17 bp, Homo sapiens
cccgcctcctccctgcc

SEQ ID NO: 5594259 - DNA, 23 bp, Homo sapiens
cccgcctcgacctccccacccgc

SEQ ID NO: 5594260 - DNA, 18 bp, Homo sapiens
cccgcctcggcctcccaa

SEQ ID NO: 5594261 - DNA, 13 bp, Homo sapiens
cccgcctctgcct

SEQ ID NO: 5594262 - DNA, 19 bp, Homo sapiens
cccgcctctgggctcacac

SEQ ID NO: 5594263 - DNA, 20 bp, Homo sapiens
cccgcctctgggctcacacc

SEQ ID NO: 5594264 - DNA, 13 bp, Homo sapiens
cccgcctgcagtc

SEQ ID NO: 5594265 - DNA, 18 bp, Homo sapiens
cccgcctgcagtcttctg

SEQ ID NO: 5594266 - DNA, 22 bp, Homo sapiens
cccgcctgccacctctcccagc

SEQ ID NO: 5594267 - DNA, 12 bp, Homo sapiens
cccgcctgccag

SEQ ID NO: 5594268 - DNA, 14 bp, Homo sapiens
cccgcctgccagtc

SEQ ID NO: 5594269 - DNA, 13 bp, Homo sapiens
cccgcctgccctc

SEQ ID NO: 5594270 - DNA, 14 bp, Homo sapiens
cccgcctgccctca

SEQ ID NO: 5594271 - DNA, 19 bp, Homo sapiens
cccgcctgccgtgcatggc

SEQ ID NO: 5594272 - DNA, 13 bp, Homo sapiens
cccgcctgcctgc

SEQ ID NO: 5594273 - DNA, 13 bp, Homo sapiens
cccgcctggccag

SEQ ID NO: 5594274 - DNA, 21 bp, Homo sapiens
cccgcctggccaggagcaggc

SEQ ID NO: 5594275 - DNA, 17 bp, Homo sapiens
cccgcctggccagggca

SEQ ID NO: 5594276 - DNA, 18 bp, Homo sapiens
cccgccttagagcctcgt

SEQ ID NO: 5594277 - DNA, 15 bp, Homo sapiens
cccgccttcaggttc

SEQ ID NO: 5594278 - DNA, 21 bp, Homo sapiens
cccgccttcaggttcctccta

SEQ ID NO: 5594279 - DNA, 12 bp, Homo sapiens
cccgccttccct

SEQ ID NO: 5594280 - DNA, 17 bp, Homo sapiens
cccgccttcctcctcca

SEQ ID NO: 5594281 - DNA, 20 bp, Homo sapiens
cccgccttcctcctccacag

SEQ ID NO: 5594282 - DNA, 14 bp, Homo sapiens
cccgccttcgtgtg

SEQ ID NO: 5594283 - DNA, 17 bp, Homo sapiens
cccgccttggcctccca

SEQ ID NO: 5594284 - DNA, 13 bp, Homo sapiens
cccgccttgtgag

SEQ ID NO: 5594285 - DNA, 21 bp, Homo sapiens
cccgcctttagttctccactg

SEQ ID NO: 5594286 - DNA, 22 bp, Homo sapiens
cccgccttttcccccaccctcc

SEQ ID NO: 5594287 - DNA, 13 bp, Homo sapiens
cccgcgatgccct

SEQ ID NO: 5594288 - DNA, 17 bp, Homo sapiens
cccgcgatgtggaactg

SEQ ID NO: 5594289 - DNA, 15 bp, Homo sapiens
cccgcgccaggccct

SEQ ID NO: 5594290 - DNA, 21 bp, Homo sapiens
cccgcgcccgccgcctccctc

SEQ ID NO: 5594291 - DNA, 15 bp, Homo sapiens
cccgcgcctccttcc

SEQ ID NO: 5594292 - DNA, 19 bp, Homo sapiens
cccgcgcgcgtccccctgc

SEQ ID NO: 5594293 - DNA, 15 bp, Homo sapiens
cccgcgcgtgccccc

SEQ ID NO: 5594294 - DNA, 18 bp, Homo sapiens
cccgcgcgtgcccccagc

SEQ ID NO: 5594295 - DNA, 19 bp, Homo sapiens
cccgcgcgtgcccccagcg

SEQ ID NO: 5594296 - DNA, 17 bp, Homo sapiens
cccgcgctcgcccagca

SEQ ID NO: 5594297 - DNA, 22 bp, Homo sapiens
cccgcgcttcgaactccaggct

SEQ ID NO: 5594298 - DNA, 13 bp, Homo sapiens
cccgcggcccaga

SEQ ID NO: 5594299 - DNA, 16 bp, Homo sapiens
cccgcggcctgcaccg

SEQ ID NO: 5594300 - DNA, 13 bp, Homo sapiens
cccgcggcctgga

SEQ ID NO: 5594301 - DNA, 18 bp, Homo sapiens
cccgcgggcacagccagc

SEQ ID NO: 5594302 - DNA, 21 bp, Homo sapiens
cccgcggggacattgggaagg

SEQ ID NO: 5594303 - DNA, 22 bp, Homo sapiens
cccgcggggacgtcgctgtccg

SEQ ID NO: 5594304 - DNA, 23 bp, Homo sapiens
cccgcggggacgtcgctgtccgt

SEQ ID NO: 5594305 - DNA, 22 bp, Homo sapiens
cccgcgggtggctggagcccca

SEQ ID NO: 5594306 - DNA, 17 bp, Homo sapiens
cccgcgggttctagacg

SEQ ID NO: 5594307 - DNA, 19 bp, Homo sapiens
cccgcggtgctctggcggc

SEQ ID NO: 5594308 - DNA, 16 bp, Homo sapiens
cccgcggtgctgactg

SEQ ID NO: 5594309 - DNA, 14 bp, Homo sapiens
cccgcgtccaaccc

SEQ ID NO: 5594310 - DNA, 17 bp, Homo sapiens
cccgcgtcttcagctgt

SEQ ID NO: 5594311 - DNA, 12 bp, Homo sapiens
cccgcgttcaag

SEQ ID NO: 5594312 - DNA, 14 bp, Homo sapiens
cccgcgttcaagac

SEQ ID NO: 5594313 - DNA, 15 bp, Homo sapiens
cccgcgttcaagact

SEQ ID NO: 5594314 - DNA, 22 bp, Homo sapiens
cccgctaagagggagggagggc

SEQ ID NO: 5594315 - DNA, 20 bp, Homo sapiens
cccgctagcggggccaggag

SEQ ID NO: 5594316 - DNA, 20 bp, Homo sapiens
cccgctatgatggaagtgtt

SEQ ID NO: 5594317 - DNA, 23 bp, Homo sapiens
cccgctcacgctgacagcctcct

SEQ ID NO: 5594318 - DNA, 12 bp, Homo sapiens
cccgctcagccc

SEQ ID NO: 5594319 - DNA, 17 bp, Homo sapiens
cccgctcagcccagctg

SEQ ID NO: 5594320 - DNA, 18 bp, Homo sapiens
cccgctcaggggcctgga

SEQ ID NO: 5594321 - DNA, 21 bp, Homo sapiens
cccgctcaggggcctggaggt

SEQ ID NO: 5594322 - DNA, 15 bp, Homo sapiens
cccgctcccacaccc

SEQ ID NO: 5594323 - DNA, 17 bp, Homo sapiens
cccgctcccacacccct

SEQ ID NO: 5594324 - DNA, 12 bp, Homo sapiens
cccgctcccagt

SEQ ID NO: 5594325 - DNA, 13 bp, Homo sapiens
cccgctcccagtg

SEQ ID NO: 5594326 - DNA, 15 bp, Homo sapiens
cccgctcccagtgtc

SEQ ID NO: 5594327 - DNA, 12 bp, Homo sapiens
cccgctccccac

SEQ ID NO: 5594328 - DNA, 19 bp, Homo sapiens
cccgctcctgccgcagacg

SEQ ID NO: 5594329 - DNA, 17 bp, Homo sapiens
cccgctcctggttggtc

SEQ ID NO: 5594330 - DNA, 11 bp, Homo sapiens
cccgctctgca

SEQ ID NO: 5594331 - DNA, 14 bp, Homo sapiens
cccgctctggacca

SEQ ID NO: 5594332 - DNA, 14 bp, Homo sapiens
cccgctcttgccct

SEQ ID NO: 5594333 - DNA, 13 bp, Homo sapiens
cccgctgagccca

SEQ ID NO: 5594334 - DNA, 16 bp, Homo sapiens
cccgctgagcccactc

SEQ ID NO: 5594335 - DNA, 16 bp, Homo sapiens
cccgctgatggagccc

SEQ ID NO: 5594336 - DNA, 22 bp, Homo sapiens
cccgctgcaagtcagattgctg

SEQ ID NO: 5594337 - DNA, 19 bp, Homo sapiens
cccgctgcagcctctgcct

SEQ ID NO: 5594338 - DNA, 12 bp, Homo sapiens
cccgctgcccaa

SEQ ID NO: 5594339 - DNA, 13 bp, Homo sapiens
cccgctgcccctc

SEQ ID NO: 5594340 - DNA, 14 bp, Homo sapiens
cccgctgcccctcc

SEQ ID NO: 5594341 - DNA, 20 bp, Homo sapiens
cccgctgcgctgccctgcaa

SEQ ID NO: 5594342 - DNA, 23 bp, Homo sapiens
cccgctgcgctgccctgcaaacc

SEQ ID NO: 5594343 - DNA, 15 bp, Homo sapiens
cccgctgctcccggt

SEQ ID NO: 5594344 - DNA, 15 bp, Homo sapiens
cccgctgctgctgct

SEQ ID NO: 5594345 - DNA, 12 bp, Homo sapiens
cccgctgctgtg

SEQ ID NO: 5594346 - DNA, 13 bp, Homo sapiens
cccgctgctgtgc

SEQ ID NO: 5594347 - DNA, 23 bp, Homo sapiens
cccgctgctgtgctctggggatt

SEQ ID NO: 5594348 - DNA, 13 bp, Homo sapiens
cccgctgcttcca

SEQ ID NO: 5594349 - DNA, 19 bp, Homo sapiens
cccgctggagcccacagcg

SEQ ID NO: 5594350 - DNA, 22 bp, Homo sapiens
cccgctggaggatgtgggcagc

SEQ ID NO: 5594351 - DNA, 22 bp, Homo sapiens
cccgctggctgggggcctcact

SEQ ID NO: 5594352 - DNA, 15 bp, Homo sapiens
cccgctgggggctgg

SEQ ID NO: 5594353 - DNA, 12 bp, Homo sapiens
cccgctgtggcc

SEQ ID NO: 5594354 - DNA, 14 bp, Homo sapiens
cccgcttagcctgc

SEQ ID NO: 5594355 - DNA, 23 bp, Homo sapiens
cccgcttagttcttgaattgtta

SEQ ID NO: 5594356 - DNA, 16 bp, Homo sapiens
cccgcttccccacaga

SEQ ID NO: 5594357 - DNA, 20 bp, Homo sapiens
ccctagtcaaaactattttt

SEQ ID NO: 5594358 - DNA, 18 bp, Homo sapiens
ccctagtgggagcccagc

SEQ ID NO: 5594359 - DNA, 20 bp, Homo sapiens
ccctagttagcatccaggct

SEQ ID NO: 5594360 - DNA, 11 bp, Homo sapiens
ccctagttcaa

SEQ ID NO: 5594361 - DNA, 17 bp, Homo sapiens
ccctagttcaaaacaac

SEQ ID NO: 5594362 - DNA, 16 bp, Homo sapiens
ccctagttccctctgc

SEQ ID NO: 5594363 - DNA, 19 bp, Homo sapiens
ccctagttctacctcaggc

SEQ ID NO: 5594364 - DNA, 21 bp, Homo sapiens
ccctataccctaggtctccac

SEQ ID NO: 5594365 - DNA, 17 bp, Homo sapiens
ccctataccgagaccca

SEQ ID NO: 5594366 - DNA, 21 bp, Homo sapiens
ccctataccgagacccaccat

SEQ ID NO: 5594367 - DNA, 17 bp, Homo sapiens
ccctatacctgagcctc

SEQ ID NO: 5594368 - DNA, 17 bp, Homo sapiens
ccctatagaccactggg

SEQ ID NO: 5594369 - DNA, 21 bp, Homo sapiens
ccctatagagagggggctctc

SEQ ID NO: 5594370 - DNA, 18 bp, Homo sapiens
ccctatagcactgagctc

SEQ ID NO: 5594371 - DNA, 15 bp, Homo sapiens
ccctataggaacagc

SEQ ID NO: 5594372 - DNA, 19 bp, Homo sapiens
ccctataggaacagcccag

SEQ ID NO: 5594373 - DNA, 21 bp, Homo sapiens
ccctatagtttcaccactcct

SEQ ID NO: 5594374 - DNA, 16 bp, Homo sapiens
ccctatatcagggcct

SEQ ID NO: 5594375 - DNA, 23 bp, Homo sapiens
ccctatcaagcactaaaaagttg

SEQ ID NO: 5594376 - DNA, 13 bp, Homo sapiens
ccctatcagttga

SEQ ID NO: 5594377 - DNA, 14 bp, Homo sapiens
ccctatccacccag

SEQ ID NO: 5594378 - DNA, 22 bp, Homo sapiens
ccctatcccattctccctctca

SEQ ID NO: 5594379 - DNA, 14 bp, Homo sapiens
ccctatcctctgag

SEQ ID NO: 5594380 - DNA, 14 bp, Homo sapiens
ccctatctcctgac

SEQ ID NO: 5594381 - DNA, 15 bp, Homo sapiens
ccctatctcctgaca

SEQ ID NO: 5594382 - DNA, 16 bp, Homo sapiens
ccctatctcctgacag

SEQ ID NO: 5594383 - DNA, 18 bp, Homo sapiens
ccctatctccttcccacc

SEQ ID NO: 5594384 - DNA, 14 bp, Homo sapiens
ccctatctgtgatt

SEQ ID NO: 5594385 - DNA, 13 bp, Homo sapiens
ccctatcttgtcc

SEQ ID NO: 5594386 - DNA, 17 bp, Homo sapiens
ccctatcttgtcctgga

SEQ ID NO: 5594387 - DNA, 14 bp, Homo sapiens
ccctatctttgcca

SEQ ID NO: 5594388 - DNA, 16 bp, Homo sapiens
ccctatctttgccacc

SEQ ID NO: 5594389 - DNA, 22 bp, Homo sapiens
ccctatgaagtaaagaactgca

SEQ ID NO: 5594390 - DNA, 18 bp, Homo sapiens
ccctatgccactaagcca

SEQ ID NO: 5594391 - DNA, 17 bp, Homo sapiens
ccctatggaagcatatt

SEQ ID NO: 5594392 - DNA, 16 bp, Homo sapiens
ccctatggatgtgggg

SEQ ID NO: 5594393 - DNA, 17 bp, Homo sapiens
ccctatggccactggcc

SEQ ID NO: 5594394 - DNA, 14 bp, Homo sapiens
ccctatgggcctgc

SEQ ID NO: 5594395 - DNA, 19 bp, Homo sapiens
ccctatggggaggccctgc

SEQ ID NO: 5594396 - DNA, 15 bp, Homo sapiens
ccctatgtctcagga

SEQ ID NO: 5594397 - DNA, 13 bp, Homo sapiens
ccctatgtctgca

SEQ ID NO: 5594398 - DNA, 23 bp, Homo sapiens
ccctatgttgctataagaaaagt

SEQ ID NO: 5594399 - DNA, 13 bp, Homo sapiens
ccctattaaccta

SEQ ID NO: 5594400 - DNA, 18 bp, Homo sapiens
ccctattagagaagagat

SEQ ID NO: 5594401 - DNA, 18 bp, Homo sapiens
ccctatttattgactttg

SEQ ID NO: 5594402 - DNA, 14 bp, Homo sapiens
ccctatttgtttca

SEQ ID NO: 5594403 - DNA, 20 bp, Homo sapiens
ccctattttttttctgttat

SEQ ID NO: 5594404 - DNA, 18 bp, Homo sapiens
ccctcaaaaaaagccttt

SEQ ID NO: 5594405 - DNA, 19 bp, Homo sapiens
ccctcaaaaaaagccttta

SEQ ID NO: 5594406 - DNA, 20 bp, Homo sapiens
ccctcaaaagcttcgtgcca

SEQ ID NO: 5594407 - DNA, 15 bp, Homo sapiens
ccctcaaaccctgtg

SEQ ID NO: 5594408 - DNA, 21 bp, Homo sapiens
ccctcaaacctcctcttctga

SEQ ID NO: 5594409 - DNA, 20 bp, Homo sapiens
ccctcaaagaagtcggaatg

SEQ ID NO: 5594410 - DNA, 23 bp, Homo sapiens
ccctcaaagaagtcggaatgtca

SEQ ID NO: 5594411 - DNA, 20 bp, Homo sapiens
ccctcaaatgacccaaagac

SEQ ID NO: 5594412 - DNA, 18 bp, Homo sapiens
ccctcaaatgtcagagct

SEQ ID NO: 5594413 - DNA, 12 bp, Homo sapiens
ccctcaacaagg

SEQ ID NO: 5594414 - DNA, 19 bp, Homo sapiens
ccctcaacaagggagagac

SEQ ID NO: 5594415 - DNA, 19 bp, Homo sapiens
ccctcaacaccctgcttct

SEQ ID NO: 5594416 - DNA, 12 bp, Homo sapiens
ccctcaaccctc

SEQ ID NO: 5594417 - DNA, 21 bp, Homo sapiens
ccctcaagccaatcccctcct

SEQ ID NO: 5594418 - DNA, 14 bp, Homo sapiens
ccctcaagccccag

SEQ ID NO: 5594419 - DNA, 15 bp, Homo sapiens
ccctcaagccccagc

SEQ ID NO: 5594420 - DNA, 22 bp, Homo sapiens
ccctcaaggacaaagtctccag

SEQ ID NO: 5594421 - DNA, 17 bp, Homo sapiens
ccctcaaggcctcccac

SEQ ID NO: 5594422 - DNA, 22 bp, Homo sapiens
ccctcaataaatgttgcttgga

SEQ ID NO: 5594423 - DNA, 20 bp, Homo sapiens
ccctcacacacacagctggg

SEQ ID NO: 5594424 - DNA, 23 bp, Homo sapiens
ccctcacacacacagctgggcaa

SEQ ID NO: 5594425 - DNA, 21 bp, Homo sapiens
ccctcacacacacccccccac

SEQ ID NO: 5594426 - DNA, 17 bp, Homo sapiens
ccctcacacatccagac

SEQ ID NO: 5594427 - DNA, 18 bp, Homo sapiens
ccctcacacccgcttccc

SEQ ID NO: 5594428 - DNA, 10 bp, Homo sapiens
ccctcacact

SEQ ID NO: 5594429 - DNA, 13 bp, Homo sapiens
ccctcacagactc

SEQ ID NO: 5594430 - DNA, 18 bp, Homo sapiens
ccctcacagactcttcca

SEQ ID NO: 5594431 - DNA, 19 bp, Homo sapiens
ccctcacagactcttccac

SEQ ID NO: 5594432 - DNA, 18 bp, Homo sapiens
ccctcacagcctctgacc

SEQ ID NO: 5594433 - DNA, 14 bp, Homo sapiens
ccctcacatcctct

SEQ ID NO: 5594434 - DNA, 18 bp, Homo sapiens
ccctcacatcctctccag

SEQ ID NO: 5594435 - DNA, 13 bp, Homo sapiens
ccctcacattcct

SEQ ID NO: 5594436 - DNA, 13 bp, Homo sapiens
ccctcaccaggat

SEQ ID NO: 5594437 - DNA, 18 bp, Homo sapiens
ccctcaccatccagtggg

SEQ ID NO: 5594438 - DNA, 15 bp, Homo sapiens
ccctcacccactctg

SEQ ID NO: 5594439 - DNA, 24 bp, Homo sapiens
ccctcaccccaatccctgccactg

SEQ ID NO: 5594440 - DNA, 14 bp, Homo sapiens
ccctcaccccagct

SEQ ID NO: 5594441 - DNA, 15 bp, Homo sapiens
ccctcaccccagctc

SEQ ID NO: 5594442 - DNA, 16 bp, Homo sapiens
ccctcacccccagcac

SEQ ID NO: 5594443 - DNA, 21 bp, Homo sapiens
ccctcacccccaggtgttgcc

SEQ ID NO: 5594444 - DNA, 13 bp, Homo sapiens
ccctcacccctgg

SEQ ID NO: 5594445 - DNA, 20 bp, Homo sapiens
ccctcacccctggttctcat

SEQ ID NO: 5594446 - DNA, 22 bp, Homo sapiens
ccctcacccctggttctcatct

SEQ ID NO: 5594447 - DNA, 23 bp, Homo sapiens
ccctcacccgctgcccagccctc

SEQ ID NO: 5594448 - DNA, 17 bp, Homo sapiens
ccctcaccctctgtccc

SEQ ID NO: 5594449 - DNA, 15 bp, Homo sapiens
ccctcaccctgagcc

SEQ ID NO: 5594450 - DNA, 22 bp, Homo sapiens
ccctcaccctgagccccttcct

SEQ ID NO: 5594451 - DNA, 16 bp, Homo sapiens
ccctcaccctggggct

SEQ ID NO: 5594452 - DNA, 19 bp, Homo sapiens
ccctcaccgcggctggatg

SEQ ID NO: 5594453 - DNA, 15 bp, Homo sapiens
ccctcacctcaggac

SEQ ID NO: 5594454 - DNA, 21 bp, Homo sapiens
ccctcacctcaggaccccaga

SEQ ID NO: 5594455 - DNA, 12 bp, Homo sapiens
ccctcacctctg

SEQ ID NO: 5594456 - DNA, 14 bp, Homo sapiens
ccctcacctctgat

SEQ ID NO: 5594457 - DNA, 17 bp, Homo sapiens
ccctcacctgggcacct

SEQ ID NO: 5594458 - DNA, 20 bp, Homo sapiens
ccctcaccttggcaccagac

SEQ ID NO: 5594459 - DNA, 21 bp, Homo sapiens
ccctcactaagccccggcact

SEQ ID NO: 5594460 - DNA, 21 bp, Homo sapiens
ccctcactattcttggaccat

SEQ ID NO: 5594461 - DNA, 21 bp, Homo sapiens
ccctcactcaggaaccctgga

SEQ ID NO: 5594462 - DNA, 23 bp, Homo sapiens
ccctcactcaggaaccctggaga

SEQ ID NO: 5594463 - DNA, 18 bp, Homo sapiens
ccctcactccacactggc

SEQ ID NO: 5594464 - DNA, 21 bp, Homo sapiens
ccctcactccactcccctcat

SEQ ID NO: 5594465 - DNA, 22 bp, Homo sapiens
ccctcactccactcccctcatc

SEQ ID NO: 5594466 - DNA, 12 bp, Homo sapiens
ccctcactcccc

SEQ ID NO: 5594467 - DNA, 15 bp, Homo sapiens
ccctcactccctctg

SEQ ID NO: 5594468 - DNA, 13 bp, Homo sapiens
ccctcactctcag

SEQ ID NO: 5594469 - DNA, 13 bp, Homo sapiens
ccctcactctgcc

SEQ ID NO: 5594470 - DNA, 16 bp, Homo sapiens
ccctcactctgccagg

SEQ ID NO: 5594471 - DNA, 17 bp, Homo sapiens
ccctcactctgccaggg

SEQ ID NO: 5594472 - DNA, 17 bp, Homo sapiens
ccctcactctgtcagcc

SEQ ID NO: 5594473 - DNA, 14 bp, Homo sapiens
ccctcactgagcct

SEQ ID NO: 5594474 - DNA, 15 bp, Homo sapiens
ccctcactgagcctc

SEQ ID NO: 5594475 - DNA, 12 bp, Homo sapiens
ccctcactgcct

SEQ ID NO: 5594476 - DNA, 19 bp, Homo sapiens
ccctcactggctctcctgg

SEQ ID NO: 5594477 - DNA, 20 bp, Homo sapiens
ccctcagaaaatgagtaaca

SEQ ID NO: 5594478 - DNA, 20 bp, Homo sapiens
ccctcagaaacactggggct

SEQ ID NO: 5594479 - DNA, 17 bp, Homo sapiens
ccctcagaacccttggc

SEQ ID NO: 5594480 - DNA, 21 bp, Homo sapiens
ccctcagaacccttggcttgc

SEQ ID NO: 5594481 - DNA, 16 bp, Homo sapiens
ccctcagacagccccc

SEQ ID NO: 5594482 - DNA, 18 bp, Homo sapiens
ccctcagacccaggagtc

SEQ ID NO: 5594483 - DNA, 20 bp, Homo sapiens
ccctcagacccaggagtcca

SEQ ID NO: 5594484 - DNA, 23 bp, Homo sapiens
ccctcagacccaggagtccagac

SEQ ID NO: 5594485 - DNA, 22 bp, Homo sapiens
ccctcagacccaggagtccagc

SEQ ID NO: 5594486 - DNA, 16 bp, Homo sapiens
ccctcagactcagagg

SEQ ID NO: 5594487 - DNA, 17 bp, Homo sapiens
ccctcagactcagaggt

SEQ ID NO: 5594488 - DNA, 22 bp, Homo sapiens
ccctcagactcagaggtccagg

SEQ ID NO: 5594489 - DNA, 22 bp, Homo sapiens
ccctcagagacaccaaactgcc

SEQ ID NO: 5594490 - DNA, 19 bp, Homo sapiens
ccctcagagccctgccctg

SEQ ID NO: 5594491 - DNA, 20 bp, Homo sapiens
ccctcagagccctgccctgc

SEQ ID NO: 5594492 - DNA, 15 bp, Homo sapiens
ccctcagatcccagg

SEQ ID NO: 5594493 - DNA, 16 bp, Homo sapiens
ccctcagatcccaggg

SEQ ID NO: 5594494 - DNA, 17 bp, Homo sapiens
ccctcagatcccagggt

SEQ ID NO: 5594495 - DNA, 19 bp, Homo sapiens
ccctcagatcccagggtac

SEQ ID NO: 5594496 - DNA, 20 bp, Homo sapiens
ccctcagatcccagggtaca

SEQ ID NO: 5594497 - DNA, 18 bp, Homo sapiens
ccctcagatgaaaataaa

SEQ ID NO: 5594498 - DNA, 22 bp, Homo sapiens
ccctcagatgatctctccacgg

SEQ ID NO: 5594499 - DNA, 23 bp, Homo sapiens
ccctcagatgcgttcgcctctgg

SEQ ID NO: 5594500 - DNA, 14 bp, Homo sapiens
ccctcagatgtccc

SEQ ID NO: 5594501 - DNA, 14 bp, Homo sapiens
ccctcagcacccct

SEQ ID NO: 5594502 - DNA, 19 bp, Homo sapiens
ccctcagcaccccttccat

SEQ ID NO: 5594503 - DNA, 19 bp, Homo sapiens
ccctcagccacacccaggc

SEQ ID NO: 5594504 - DNA, 14 bp, Homo sapiens
ccctcagccaccct

SEQ ID NO: 5594505 - DNA, 22 bp, Homo sapiens
ccctcagccacgcctctctcag

SEQ ID NO: 5594506 - DNA, 19 bp, Homo sapiens
ccctcagccccaccccagg

SEQ ID NO: 5594507 - DNA, 20 bp, Homo sapiens
ccctcagccccaccccaggt

SEQ ID NO: 5594508 - DNA, 14 bp, Homo sapiens
ccctcagcccctct

SEQ ID NO: 5594509 - DNA, 12 bp, Homo sapiens
ccctcagccctc

SEQ ID NO: 5594510 - DNA, 13 bp, Homo sapiens
ccctcagccctca

SEQ ID NO: 5594511 - DNA, 19 bp, Homo sapiens
ccctcagcccttgccccca

SEQ ID NO: 5594512 - DNA, 10 bp, Homo sapiens
ccctcagcct

SEQ ID NO: 5594513 - DNA, 22 bp, Homo sapiens
ccctcagcctcagaggagctct

SEQ ID NO: 5594514 - DNA, 14 bp, Homo sapiens
ccctcagcctcccc

SEQ ID NO: 5594515 - DNA, 17 bp, Homo sapiens
ccctcagcctccccttc

SEQ ID NO: 5594516 - DNA, 18 bp, Homo sapiens
ccctcagcctccccttct

SEQ ID NO: 5594517 - DNA, 19 bp, Homo sapiens
ccctcagcctccccttctt

SEQ ID NO: 5594518 - DNA, 20 bp, Homo sapiens
ccctcagcctccccttcttc

SEQ ID NO: 5594519 - DNA, 13 bp, Homo sapiens
ccctcagcctctt

SEQ ID NO: 5594520 - DNA, 16 bp, Homo sapiens
ccctcagcctgcccac

SEQ ID NO: 5594521 - DNA, 18 bp, Homo sapiens
ccctcagcctgcctgaag

SEQ ID NO: 5594522 - DNA, 13 bp, Homo sapiens
ccctcagccttga

SEQ ID NO: 5594523 - DNA, 14 bp, Homo sapiens
ccctcagcgcaggc

SEQ ID NO: 5594524 - DNA, 17 bp, Homo sapiens
ccctcagcgcaggctgc

SEQ ID NO: 5594525 - DNA, 20 bp, Homo sapiens
ccctcagcgcaggctgcaga

SEQ ID NO: 5594526 - DNA, 21 bp, Homo sapiens
ccctcagcgcaggctgcagag

SEQ ID NO: 5594527 - DNA, 23 bp, Homo sapiens
ccctcagcgcaggctgcagagcc

SEQ ID NO: 5594528 - DNA, 14 bp, Homo sapiens
ccctcagcgtctcc

SEQ ID NO: 5594529 - DNA, 16 bp, Homo sapiens
ccctcagctccccggc

SEQ ID NO: 5594530 - DNA, 16 bp, Homo sapiens
ccctcagctccctgac

SEQ ID NO: 5594531 - DNA, 16 bp, Homo sapiens
ccctcagctcggctca

SEQ ID NO: 5594532 - DNA, 21 bp, Homo sapiens
ccctcagctctccctcacacc

SEQ ID NO: 5594533 - DNA, 15 bp, Homo sapiens
ccctcagctctctgg

SEQ ID NO: 5594534 - DNA, 11 bp, Homo sapiens
ccctctccctg

SEQ ID NO: 5594535 - DNA, 17 bp, Homo sapiens
ccctctccctgcatggc

SEQ ID NO: 5594536 - DNA, 13 bp, Homo sapiens
ccctctcccttcc

SEQ ID NO: 5594537 - DNA, 20 bp, Homo sapiens
ccctctcccttccctcctcc

SEQ ID NO: 5594538 - DNA, 13 bp, Homo sapiens
ccctctccgagct

SEQ ID NO: 5594539 - DNA, 21 bp, Homo sapiens
ccctctccgcacacctctggc

SEQ ID NO: 5594540 - DNA, 22 bp, Homo sapiens
ccctctcctatgtggcagctgg

SEQ ID NO: 5594541 - DNA, 23 bp, Homo sapiens
ccctctcctatgtggcagctggg

SEQ ID NO: 5594542 - DNA, 10 bp, Homo sapiens
ccctctcctc

SEQ ID NO: 5594543 - DNA, 14 bp, Homo sapiens
ccctctcctcccag

SEQ ID NO: 5594544 - DNA, 17 bp, Homo sapiens
ccctctcctcccagctg

SEQ ID NO: 5594545 - DNA, 13 bp, Homo sapiens
ccctctcctccgt

SEQ ID NO: 5594546 - DNA, 20 bp, Homo sapiens
ccctctcctccgtggcacat

SEQ ID NO: 5594547 - DNA, 22 bp, Homo sapiens
ccctctcctctgccctctgctc

SEQ ID NO: 5594548 - DNA, 19 bp, Homo sapiens
ccctctcctgagcctgtct

SEQ ID NO: 5594549 - DNA, 21 bp, Homo sapiens
ccctctcctgagcctgtctct

SEQ ID NO: 5594550 - DNA, 22 bp, Homo sapiens
ccctctcctgagcctgtctctc

SEQ ID NO: 5594551 - DNA, 18 bp, Homo sapiens
ccctctcctgcatccctc

SEQ ID NO: 5594552 - DNA, 12 bp, Homo sapiens
ccctctcctgcc

SEQ ID NO: 5594553 - DNA, 13 bp, Homo sapiens
ccctctcctgccc

SEQ ID NO: 5594554 - DNA, 17 bp, Homo sapiens
ccctctcctgcgtgtgc

SEQ ID NO: 5594555 - DNA, 12 bp, Homo sapiens
ccctctcctggg

SEQ ID NO: 5594556 - DNA, 15 bp, Homo sapiens
ccctctcctgggcag

SEQ ID NO: 5594557 - DNA, 22 bp, Homo sapiens
ccctctcctgggcagctgcctc

SEQ ID NO: 5594558 - DNA, 12 bp, Homo sapiens
ccctctcctgtc

SEQ ID NO: 5594559 - DNA, 13 bp, Homo sapiens
ccctctcctgtcc

SEQ ID NO: 5594560 - DNA, 17 bp, Homo sapiens
ccctctccttcctgtgt

SEQ ID NO: 5594561 - DNA, 14 bp, Homo sapiens
ccctctccttcctt

SEQ ID NO: 5594562 - DNA, 15 bp, Homo sapiens
ccctctccttcctta

SEQ ID NO: 5594563 - DNA, 17 bp, Homo sapiens
ccctctccttgccccca

SEQ ID NO: 5594564 - DNA, 21 bp, Homo sapiens
ccctctccttgcccccagtgc

SEQ ID NO: 5594565 - DNA, 16 bp, Homo sapiens
ccctctccttgtcaca

SEQ ID NO: 5594566 - DNA, 15 bp, Homo sapiens
ccctctcctttcact

SEQ ID NO: 5594567 - DNA, 18 bp, Homo sapiens
ccctctcgccctggccag

SEQ ID NO: 5594568 - DNA, 16 bp, Homo sapiens
ccctctctcaccagcc

SEQ ID NO: 5594569 - DNA, 19 bp, Homo sapiens
ccctctctcaccagccttg

SEQ ID NO: 5594570 - DNA, 19 bp, Homo sapiens
ccctctctcagcacagcct

SEQ ID NO: 5594571 - DNA, 12 bp, Homo sapiens
ccctctctcata

SEQ ID NO: 5594572 - DNA, 18 bp, Homo sapiens
ccctctctcataccctcc

SEQ ID NO: 5594573 - DNA, 22 bp, Homo sapiens
ccctctctcataccctccctcc

SEQ ID NO: 5594574 - DNA, 21 bp, Homo sapiens
ccctctctcatatcactgaag

SEQ ID NO: 5594575 - DNA, 15 bp, Homo sapiens
ccctctctccctgcc

SEQ ID NO: 5594576 - DNA, 18 bp, Homo sapiens
ccctctctccctgcctca

SEQ ID NO: 5594577 - DNA, 14 bp, Homo sapiens
ccctctctccgccc

SEQ ID NO: 5594578 - DNA, 13 bp, Homo sapiens
ccctctctctgac

SEQ ID NO: 5594579 - DNA, 13 bp, Homo sapiens
ccctctctctggg

SEQ ID NO: 5594580 - DNA, 13 bp, Homo sapiens
ccctctctcttct

SEQ ID NO: 5594581 - DNA, 20 bp, Homo sapiens
ccctctctgcagacttccca

SEQ ID NO: 5594582 - DNA, 18 bp, Homo sapiens
ccctctctgcatctgacc

SEQ ID NO: 5594583 - DNA, 13 bp, Homo sapiens
ccctctctgcccc

SEQ ID NO: 5594584 - DNA, 13 bp, Homo sapiens
ccctctctgctcc

SEQ ID NO: 5594585 - DNA, 14 bp, Homo sapiens
ccctctctgctcct

SEQ ID NO: 5594586 - DNA, 18 bp, Homo sapiens
ccctctctgctccttcac

SEQ ID NO: 5594587 - DNA, 16 bp, Homo sapiens
ccctctctgctctgcg

SEQ ID NO: 5594588 - DNA, 11 bp, Homo sapiens
ccctctctgga

SEQ ID NO: 5594589 - DNA, 13 bp, Homo sapiens
ccctctctggaga

SEQ ID NO: 5594590 - DNA, 18 bp, Homo sapiens
ccctctctgtggctccaa

SEQ ID NO: 5594591 - DNA, 18 bp, Homo sapiens
ccctctctgtttaccctc

SEQ ID NO: 5594592 - DNA, 17 bp, Homo sapiens
ccctctcttccctatta

SEQ ID NO: 5594593 - DNA, 17 bp, Homo sapiens
ccctctcttccgggagc

SEQ ID NO: 5594594 - DNA, 19 bp, Homo sapiens
ccctctcttcgtcctgatc

SEQ ID NO: 5594595 - DNA, 13 bp, Homo sapiens
ccctctcttgcca

SEQ ID NO: 5594596 - DNA, 14 bp, Homo sapiens
ccctctcttgtcag

SEQ ID NO: 5594597 - DNA, 16 bp, Homo sapiens
ccctctgaacttgcct

SEQ ID NO: 5594598 - DNA, 23 bp, Homo sapiens
ccctctgaagaagggaattaggc

SEQ ID NO: 5594599 - DNA, 15 bp, Homo sapiens
ccctctgacctgcac

SEQ ID NO: 5594600 - DNA, 17 bp, Homo sapiens
ccctctgacctgcactg

SEQ ID NO: 5594601 - DNA, 20 bp, Homo sapiens
ccctctgagaattccaagga

SEQ ID NO: 5594602 - DNA, 23 bp, Homo sapiens
ccctctgagcaactgtgcagcac

SEQ ID NO: 5594603 - DNA, 20 bp, Homo sapiens
ccctctgagtgaagtccagt

SEQ ID NO: 5594604 - DNA, 11 bp, Homo sapiens
ccctctgattg

SEQ ID NO: 5594605 - DNA, 15 bp, Homo sapiens
ccctctgcaaccccc

SEQ ID NO: 5594606 - DNA, 12 bp, Homo sapiens
ccctctgcaggg

SEQ ID NO: 5594607 - DNA, 15 bp, Homo sapiens
ccctctgcagggcag

SEQ ID NO: 5594608 - DNA, 19 bp, Homo sapiens
ccctctgccaccagagacc

SEQ ID NO: 5594609 - DNA, 13 bp, Homo sapiens
ccctctgccactg

SEQ ID NO: 5594610 - DNA, 11 bp, Homo sapiens
ccctctgccca

SEQ ID NO: 5594611 - DNA, 18 bp, Homo sapiens
ccctctgcccactccctg

SEQ ID NO: 5594612 - DNA, 12 bp, Homo sapiens
ccctctgcccag

SEQ ID NO: 5594613 - DNA, 17 bp, Homo sapiens
ccctctgcccagggagt

SEQ ID NO: 5594614 - DNA, 12 bp, Homo sapiens
ccctctgcccca

SEQ ID NO: 5594615 - DNA, 17 bp, Homo sapiens
ccctctgccccaagcag

SEQ ID NO: 5594616 - DNA, 23 bp, Homo sapiens
ccctctgccccaagcagccagcc

SEQ ID NO: 5594617 - DNA, 14 bp, Homo sapiens
ccctctgccccacc

SEQ ID NO: 5594618 - DNA, 18 bp, Homo sapiens
ccctctgccccaccctca

SEQ ID NO: 5594619 - DNA, 13 bp, Homo sapiens
ccctctgccccat

SEQ ID NO: 5594620 - DNA, 15 bp, Homo sapiens
ccctctgccccatcc

SEQ ID NO: 5594621 - DNA, 18 bp, Homo sapiens
ccctctgccccatcctcc

SEQ ID NO: 5594622 - DNA, 13 bp, Homo sapiens
ccctctgccccgc

SEQ ID NO: 5594623 - DNA, 14 bp, Homo sapiens
ccctctgcccctcc

SEQ ID NO: 5594624 - DNA, 14 bp, Homo sapiens
ccctctgcccctgc

SEQ ID NO: 5594625 - DNA, 13 bp, Homo sapiens
ccctctgccctgc

SEQ ID NO: 5594626 - DNA, 17 bp, Homo sapiens
ccctctgccctgtatat

SEQ ID NO: 5594627 - DNA, 22 bp, Homo sapiens
ccctctgccgaccgcctgcttc

SEQ ID NO: 5594628 - DNA, 23 bp, Homo sapiens
ccctctgccgaccgcctgcttca

SEQ ID NO: 5594629 - DNA, 12 bp, Homo sapiens
ccctctgccggc

SEQ ID NO: 5594630 - DNA, 14 bp, Homo sapiens
ccctctgccggctc

SEQ ID NO: 5594631 - DNA, 22 bp, Homo sapiens
ccctctgccggtcgggcagcca

SEQ ID NO: 5594632 - DNA, 14 bp, Homo sapiens
ccctctgcctcatc

SEQ ID NO: 5594633 - DNA, 17 bp, Homo sapiens
ccctctgcctcatcctc

SEQ ID NO: 5594634 - DNA, 20 bp, Homo sapiens
ccctctgcctcatcctcctc

SEQ ID NO: 5594635 - DNA, 13 bp, Homo sapiens
ccctctgcctcct

SEQ ID NO: 5594636 - DNA, 15 bp, Homo sapiens
ccctctgcctcctca

SEQ ID NO: 5594637 - DNA, 20 bp, Homo sapiens
ccctctgcctcctccccagg

SEQ ID NO: 5594638 - DNA, 21 bp, Homo sapiens
ccctctgcctgaccccaggcc

SEQ ID NO: 5594639 - DNA, 14 bp, Homo sapiens
ccctctgcctgcac

SEQ ID NO: 5594640 - DNA, 18 bp, Homo sapiens
ccctctgcctgcactccc

SEQ ID NO: 5594641 - DNA, 17 bp, Homo sapiens
ccctctgcctgggatgc

SEQ ID NO: 5594642 - DNA, 13 bp, Homo sapiens
ccctctgccttgc

SEQ ID NO: 5594643 - DNA, 14 bp, Homo sapiens
ccctctgccttgca

SEQ ID NO: 5594644 - DNA, 14 bp, Homo sapiens
ccctctgcctttga

SEQ ID NO: 5594645 - DNA, 17 bp, Homo sapiens
ccctctgcgccccagcg

SEQ ID NO: 5594646 - DNA, 20 bp, Homo sapiens
ccctctgcgtcccccagccc

SEQ ID NO: 5594647 - DNA, 21 bp, Homo sapiens
ccctctgcgtcccccagccct

SEQ ID NO: 5594648 - DNA, 13 bp, Homo sapiens
ccctctgctcagc

SEQ ID NO: 5594649 - DNA, 18 bp, Homo sapiens
ccctctgctcaggcctcc

SEQ ID NO: 5594650 - DNA, 12 bp, Homo sapiens
ccctctgctcta

SEQ ID NO: 5594651 - DNA, 14 bp, Homo sapiens
ccctctgctctgcc

SEQ ID NO: 5594652 - DNA, 16 bp, Homo sapiens
ccctctgctctgcctg

SEQ ID NO: 5594653 - DNA, 21 bp, Homo sapiens
ccctctgctctgcctggagtg

SEQ ID NO: 5594654 - DNA, 19 bp, Homo sapiens
ccctctgctgaagacttgc

SEQ ID NO: 5594655 - DNA, 11 bp, Homo sapiens
ccctctgctgc

SEQ ID NO: 5594656 - DNA, 15 bp, Homo sapiens
ccctctgctgtcctg

SEQ ID NO: 5594657 - DNA, 18 bp, Homo sapiens
ccctctggaatcttcccc

SEQ ID NO: 5594658 - DNA, 20 bp, Homo sapiens
ccctctggaatcttccccaa

SEQ ID NO: 5594659 - DNA, 19 bp, Homo sapiens
ccctctggagaaggcctgg

SEQ ID NO: 5594660 - DNA, 21 bp, Homo sapiens
ccctctggagggctatggcct

SEQ ID NO: 5594661 - DNA, 21 bp, Homo sapiens
ccctctggaggggtgtggctc

SEQ ID NO: 5594662 - DNA, 18 bp, Homo sapiens
ccctctggagtggccact

SEQ ID NO: 5594663 - DNA, 22 bp, Homo sapiens
ccctctggagtggccactaagc

SEQ ID NO: 5594664 - DNA, 22 bp, Homo sapiens
ccctctggatcctgctgtggcc

SEQ ID NO: 5594665 - DNA, 16 bp, Homo sapiens
ccctctggattccctt

SEQ ID NO: 5594666 - DNA, 13 bp, Homo sapiens
ccctctggccagg

SEQ ID NO: 5594667 - DNA, 18 bp, Homo sapiens
ccctctggccaggatgga

SEQ ID NO: 5594668 - DNA, 13 bp, Homo sapiens
ccctctggccctg

SEQ ID NO: 5594669 - DNA, 14 bp, Homo sapiens
ccctctggccctgc

SEQ ID NO: 5594670 - DNA, 12 bp, Homo sapiens
ccctctggctcc

SEQ ID NO: 5594671 - DNA, 14 bp, Homo sapiens
ccctctggcttccc

SEQ ID NO: 5594672 - DNA, 20 bp, Homo sapiens
ccctctggcttgacagcatg

SEQ ID NO: 5594673 - DNA, 14 bp, Homo sapiens
ccctctgggaacct

SEQ ID NO: 5594674 - DNA, 20 bp, Homo sapiens
ccctctgggaacctcccaga

SEQ ID NO: 5594675 - DNA, 22 bp, Homo sapiens
ccctctgggaacctcccagagg

SEQ ID NO: 5594676 - DNA, 12 bp, Homo sapiens
ccctctgggagt

SEQ ID NO: 5594677 - DNA, 23 bp, Homo sapiens
ccctctgggcacgcctgctggcc

SEQ ID NO: 5594678 - DNA, 13 bp, Homo sapiens
ccctctgggcact

SEQ ID NO: 5594679 - DNA, 19 bp, Homo sapiens
ccctctgggcctgttctct

SEQ ID NO: 5594680 - DNA, 12 bp, Homo sapiens
ccctctggggac

SEQ ID NO: 5594681 - DNA, 16 bp, Homo sapiens
ccctctggggctgttc

SEQ ID NO: 5594682 - DNA, 17 bp, Homo sapiens
ccctctgggggctctgg

SEQ ID NO: 5594683 - DNA, 17 bp, Homo sapiens
ccctctgggggtcctct

SEQ ID NO: 5594684 - DNA, 21 bp, Homo sapiens
ccctctgggggtcctctctga

SEQ ID NO: 5594685 - DNA, 18 bp, Homo sapiens
ccctctggtcgctcctgc

SEQ ID NO: 5594686 - DNA, 19 bp, Homo sapiens
ccctctggtcgctcctgcc

SEQ ID NO: 5594687 - DNA, 12 bp, Homo sapiens
ccctctggttat

SEQ ID NO: 5594688 - DNA, 18 bp, Homo sapiens
ccctctggtttgccggtg

SEQ ID NO: 5594689 - DNA, 22 bp, Homo sapiens
ccctctgtagctccctcctccc

SEQ ID NO: 5594690 - DNA, 23 bp, Homo sapiens
ccctctgtagctccctcctccca

SEQ ID NO: 5594691 - DNA, 15 bp, Homo sapiens
ccctctgtatacaag

SEQ ID NO: 5594692 - DNA, 20 bp, Homo sapiens
ccctctgtcatcactccctg

SEQ ID NO: 5594693 - DNA, 22 bp, Homo sapiens
ccctctgtcatcactccctgga

SEQ ID NO: 5594694 - DNA, 23 bp, Homo sapiens
ccctctgtcatcactccctggat

SEQ ID NO: 5594695 - DNA, 15 bp, Homo sapiens
ccctctgtcatcctc

SEQ ID NO: 5594696 - DNA, 17 bp, Homo sapiens
ccctctgtccaccagcc

SEQ ID NO: 5594697 - DNA, 14 bp, Homo sapiens
ccctctgtcccacc

SEQ ID NO: 5594698 - DNA, 15 bp, Homo sapiens
ccctctgtcccaccc

SEQ ID NO: 5594699 - DNA, 21 bp, Homo sapiens
ccctctgtcccacccctagcc

SEQ ID NO: 5594700 - DNA, 17 bp, Homo sapiens
ccctctgtccccacgag

SEQ ID NO: 5594701 - DNA, 16 bp, Homo sapiens
ccctctgtccccaggc

SEQ ID NO: 5594702 - DNA, 22 bp, Homo sapiens
ccctctgtccccaggcctggct

SEQ ID NO: 5594703 - DNA, 13 bp, Homo sapiens
ccctctgtcctga

SEQ ID NO: 5594704 - DNA, 23 bp, Homo sapiens
ccctctgtccttcccccagcaca

SEQ ID NO: 5594705 - DNA, 14 bp, Homo sapiens
ccctctgtctagga

SEQ ID NO: 5594706 - DNA, 23 bp, Homo sapiens
ccctctgtcttcaggctctgccc

SEQ ID NO: 5594707 - DNA, 19 bp, Homo sapiens
ccctctgtcttctctatcc

SEQ ID NO: 5594708 - DNA, 17 bp, Homo sapiens
ccctctgtcttttctcc

SEQ ID NO: 5594709 - DNA, 22 bp, Homo sapiens
ccctctgtcttttctcctccgc

SEQ ID NO: 5594710 - DNA, 23 bp, Homo sapiens
ccctctgtggccaggagccctgg

SEQ ID NO: 5594711 - DNA, 15 bp, Homo sapiens
ccctctgtggcctgt

SEQ ID NO: 5594712 - DNA, 18 bp, Homo sapiens
ccctctgtgtctgctctc

SEQ ID NO: 5594713 - DNA, 17 bp, Homo sapiens
ccctctgttagtgccgc

SEQ ID NO: 5594714 - DNA, 14 bp, Homo sapiens
ccctgccctgagga

SEQ ID NO: 5594715 - DNA, 14 bp, Homo sapiens
ccctgccctgcacc

SEQ ID NO: 5594716 - DNA, 15 bp, Homo sapiens
ccctgccctgccacc

SEQ ID NO: 5594717 - DNA, 18 bp, Homo sapiens
ccctgccctgccacctgt

SEQ ID NO: 5594718 - DNA, 17 bp, Homo sapiens
ccctgccctgccctcac

SEQ ID NO: 5594719 - DNA, 16 bp, Homo sapiens
ccctgccctgctccta

SEQ ID NO: 5594720 - DNA, 14 bp, Homo sapiens
ccctgccctgctga

SEQ ID NO: 5594721 - DNA, 23 bp, Homo sapiens
ccctgccctgctgagcacagacg

SEQ ID NO: 5594722 - DNA, 17 bp, Homo sapiens
ccctgccctggcctacc

SEQ ID NO: 5594723 - DNA, 12 bp, Homo sapiens
ccctgccctggt

SEQ ID NO: 5594724 - DNA, 23 bp, Homo sapiens
ccctgccctggtttcctgccctg

SEQ ID NO: 5594725 - DNA, 19 bp, Homo sapiens
ccctgcccttcagcatcct

SEQ ID NO: 5594726 - DNA, 23 bp, Homo sapiens
ccctgcccttcctcctgatggag

SEQ ID NO: 5594727 - DNA, 14 bp, Homo sapiens
ccctgcccttggca

SEQ ID NO: 5594728 - DNA, 19 bp, Homo sapiens
ccctgcccttggcaccacc

SEQ ID NO: 5594729 - DNA, 20 bp, Homo sapiens
ccctgccgaggtgtggctgt

SEQ ID NO: 5594730 - DNA, 13 bp, Homo sapiens
ccctgccgcctcc

SEQ ID NO: 5594731 - DNA, 18 bp, Homo sapiens
ccctgccggccttggcct

SEQ ID NO: 5594732 - DNA, 19 bp, Homo sapiens
ccctgccggccttggcctt

SEQ ID NO: 5594733 - DNA, 17 bp, Homo sapiens
ccctgccgtcaccacca

SEQ ID NO: 5594734 - DNA, 14 bp, Homo sapiens
ccctgccgtttccc

SEQ ID NO: 5594735 - DNA, 15 bp, Homo sapiens
ccctgcctacacaca

SEQ ID NO: 5594736 - DNA, 22 bp, Homo sapiens
ccctgcctactctttgttttct

SEQ ID NO: 5594737 - DNA, 18 bp, Homo sapiens
ccctgcctatcctctgta

SEQ ID NO: 5594738 - DNA, 14 bp, Homo sapiens
ccctgcctcacatc

SEQ ID NO: 5594739 - DNA, 17 bp, Homo sapiens
ccctgcctcacatctcc

SEQ ID NO: 5594740 - DNA, 15 bp, Homo sapiens
ccctgcctcagccag

SEQ ID NO: 5594741 - DNA, 15 bp, Homo sapiens
ccctgcctcagctga

SEQ ID NO: 5594742 - DNA, 16 bp, Homo sapiens
ccctgcctcaggcctc

SEQ ID NO: 5594743 - DNA, 21 bp, Homo sapiens
ccctgcctcaggcctctgtgc

SEQ ID NO: 5594744 - DNA, 16 bp, Homo sapiens
ccctgcctcatccacc

SEQ ID NO: 5594745 - DNA, 21 bp, Homo sapiens
ccctgcctccaccctctgagc

SEQ ID NO: 5594746 - DNA, 14 bp, Homo sapiens
ccctgcctccagct

SEQ ID NO: 5594747 - DNA, 18 bp, Homo sapiens
ccctgcctccagctgtca

SEQ ID NO: 5594748 - DNA, 22 bp, Homo sapiens
ccctgcctccagctgtcagcct

SEQ ID NO: 5594749 - DNA, 12 bp, Homo sapiens
ccctgcctccat

SEQ ID NO: 5594750 - DNA, 18 bp, Homo sapiens
ccctgcctcccattctgc

SEQ ID NO: 5594751 - DNA, 11 bp, Homo sapiens
ccctgcctcct

SEQ ID NO: 5594752 - DNA, 17 bp, Homo sapiens
ccctgcctcctactcca

SEQ ID NO: 5594753 - DNA, 23 bp, Homo sapiens
ccctgcctcctgccaccccttcc

SEQ ID NO: 5594754 - DNA, 21 bp, Homo sapiens
ccctgcctcctggaggaccag

SEQ ID NO: 5594755 - DNA, 16 bp, Homo sapiens
ccctgcctcctgggaa

SEQ ID NO: 5594756 - DNA, 14 bp, Homo sapiens
ccctgcctcctttg

SEQ ID NO: 5594757 - DNA, 16 bp, Homo sapiens
ccctgcctcctttgtg

SEQ ID NO: 5594758 - DNA, 20 bp, Homo sapiens
ccctgcctcgagggccgcct

SEQ ID NO: 5594759 - DNA, 22 bp, Homo sapiens
ccctgcctctatccctggccac

SEQ ID NO: 5594760 - DNA, 12 bp, Homo sapiens
ccctgcctctca

SEQ ID NO: 5594761 - DNA, 13 bp, Homo sapiens
ccctgcctctccg

SEQ ID NO: 5594762 - DNA, 14 bp, Homo sapiens
ccctgcctctccgc

SEQ ID NO: 5594763 - DNA, 13 bp, Homo sapiens
ccctgcctctctg

SEQ ID NO: 5594764 - DNA, 21 bp, Homo sapiens
ccctgcctctctgcaggtccc

SEQ ID NO: 5594765 - DNA, 20 bp, Homo sapiens
ccctgcctcttgtgtccctg

SEQ ID NO: 5594766 - DNA, 9 bp, Homo sapiens
ccctgcctg

SEQ ID NO: 5594767 - DNA, 10 bp, Homo sapiens
ccctgcctga

SEQ ID NO: 5594768 - DNA, 18 bp, Homo sapiens
ccctgcctgacagccttc

SEQ ID NO: 5594769 - DNA, 13 bp, Homo sapiens
ccctgcctgaccc

SEQ ID NO: 5594770 - DNA, 15 bp, Homo sapiens
ccctgcctgagccca

SEQ ID NO: 5594771 - DNA, 10 bp, Homo sapiens
ccctgcctgc

SEQ ID NO: 5594772 - DNA, 12 bp, Homo sapiens
ccctgcctgcag

SEQ ID NO: 5594773 - DNA, 17 bp, Homo sapiens
ccctgcctgcagccagg

SEQ ID NO: 5594774 - DNA, 21 bp, Homo sapiens
ccctgcctgcagccagggctg

SEQ ID NO: 5594775 - DNA, 13 bp, Homo sapiens
ccctgcctgccat

SEQ ID NO: 5594776 - DNA, 12 bp, Homo sapiens
ccctgcctgccc

SEQ ID NO: 5594777 - DNA, 14 bp, Homo sapiens
ccctgcctgcccac

SEQ ID NO: 5594778 - DNA, 18 bp, Homo sapiens
ccctgcctgccgctgcac

SEQ ID NO: 5594779 - DNA, 24 bp, Homo sapiens
ccctgcctgccgctgcacctgcct

SEQ ID NO: 5594780 - DNA, 14 bp, Homo sapiens
ccctgcctgccttc

SEQ ID NO: 5594781 - DNA, 16 bp, Homo sapiens
ccctgcctgctgtgga

SEQ ID NO: 5594782 - DNA, 13 bp, Homo sapiens
ccctgcctggaac

SEQ ID NO: 5594783 - DNA, 12 bp, Homo sapiens
ccctgcctggac

SEQ ID NO: 5594784 - DNA, 13 bp, Homo sapiens
ccctgcctggacc

SEQ ID NO: 5594785 - DNA, 18 bp, Homo sapiens
ccctgcctggaccagcct

SEQ ID NO: 5594786 - DNA, 14 bp, Homo sapiens
ccctgcctggactt

SEQ ID NO: 5594787 - DNA, 19 bp, Homo sapiens
ccctgcctggaggacctga

SEQ ID NO: 5594788 - DNA, 23 bp, Homo sapiens
ccctgcctggaggacctgagcct

SEQ ID NO: 5594789 - DNA, 24 bp, Homo sapiens
ccctgcctggaggacctgagcctg

SEQ ID NO: 5594790 - DNA, 14 bp, Homo sapiens
ccctgcctggaggc

SEQ ID NO: 5594791 - DNA, 20 bp, Homo sapiens
ccctgcctggaggctcctct

SEQ ID NO: 5594792 - DNA, 17 bp, Homo sapiens
ccctgcctggcccccaa

SEQ ID NO: 5594793 - DNA, 21 bp, Homo sapiens
ccctgcctggcccccaacctc

SEQ ID NO: 5594794 - DNA, 15 bp, Homo sapiens
ccctgcctggccctc

SEQ ID NO: 5594795 - DNA, 19 bp, Homo sapiens
ccctgcctggcggcagggg

SEQ ID NO: 5594796 - DNA, 16 bp, Homo sapiens
ccctgcctgggccttg

SEQ ID NO: 5594797 - DNA, 14 bp, Homo sapiens
ccctgcctgggttg

SEQ ID NO: 5594798 - DNA, 11 bp, Homo sapiens
ccctgcctggt

SEQ ID NO: 5594799 - DNA, 14 bp, Homo sapiens
ccctgcctgtggca

SEQ ID NO: 5594800 - DNA, 16 bp, Homo sapiens
ccctgccttaacctgg

SEQ ID NO: 5594801 - DNA, 20 bp, Homo sapiens
ccctgccttaacctgggacc

SEQ ID NO: 5594802 - DNA, 22 bp, Homo sapiens
ccctgccttcctctgaggacag

SEQ ID NO: 5594803 - DNA, 15 bp, Homo sapiens
ccctgccttgccgct

SEQ ID NO: 5594804 - DNA, 22 bp, Homo sapiens
ccctgccttgccgctccccttg

SEQ ID NO: 5594805 - DNA, 23 bp, Homo sapiens
ccctgccttgccgctccccttgg

SEQ ID NO: 5594806 - DNA, 16 bp, Homo sapiens
ccctgccttgctgcct

SEQ ID NO: 5594807 - DNA, 15 bp, Homo sapiens
ccctgcctttaaatg

SEQ ID NO: 5594808 - DNA, 19 bp, Homo sapiens
ccctgcctttgggagcagg

SEQ ID NO: 5594809 - DNA, 12 bp, Homo sapiens
ccctgcctttgt

SEQ ID NO: 5594810 - DNA, 19 bp, Homo sapiens
ccctgcgaaggggccctgg

SEQ ID NO: 5594811 - DNA, 21 bp, Homo sapiens
ccctgcgaaggggccctggtc

SEQ ID NO: 5594812 - DNA, 16 bp, Homo sapiens
ccctgcgccctccctc

SEQ ID NO: 5594813 - DNA, 22 bp, Homo sapiens
ccctgcgccctccctccctcca

SEQ ID NO: 5594814 - DNA, 14 bp, Homo sapiens
ccctgcgccctgtg

SEQ ID NO: 5594815 - DNA, 17 bp, Homo sapiens
ccctgcgccctgtgcag

SEQ ID NO: 5594816 - DNA, 17 bp, Homo sapiens
ccctgcgcctccagagg

SEQ ID NO: 5594817 - DNA, 21 bp, Homo sapiens
ccctgcgcctccagaggtcct

SEQ ID NO: 5594818 - DNA, 14 bp, Homo sapiens
ccctgcgcctttcc

SEQ ID NO: 5594819 - DNA, 16 bp, Homo sapiens
ccctgcgctctctttg

SEQ ID NO: 5594820 - DNA, 16 bp, Homo sapiens
ccctgcgcttcctgag

SEQ ID NO: 5594821 - DNA, 15 bp, Homo sapiens
ccctgcgctttgaac

SEQ ID NO: 5594822 - DNA, 18 bp, Homo sapiens
ccctgcggaagccacagg

SEQ ID NO: 5594823 - DNA, 19 bp, Homo sapiens
ccctgcggaagccacaggg

SEQ ID NO: 5594824 - DNA, 12 bp, Homo sapiens
ccctgcggagcc

SEQ ID NO: 5594825 - DNA, 24 bp, Homo sapiens
ccctgcggagctgcatggacgcct

SEQ ID NO: 5594826 - DNA, 21 bp, Homo sapiens
ccctgcggccgtcaccccgcc

SEQ ID NO: 5594827 - DNA, 14 bp, Homo sapiens
ccctgcggctctgg

SEQ ID NO: 5594828 - DNA, 15 bp, Homo sapiens
ccctgcggctctgga

SEQ ID NO: 5594829 - DNA, 17 bp, Homo sapiens
ccctgcgggccacaggg

SEQ ID NO: 5594830 - DNA, 18 bp, Homo sapiens
ccctgcgggccacagggc

SEQ ID NO: 5594831 - DNA, 14 bp, Homo sapiens
ccctgcggggcggc

SEQ ID NO: 5594832 - DNA, 22 bp, Homo sapiens
ccctgcggggcggcatccgagc

SEQ ID NO: 5594833 - DNA, 21 bp, Homo sapiens
ccctgcggtcaggctgggcag

SEQ ID NO: 5594834 - DNA, 22 bp, Homo sapiens
ccctgcggtcaggctgggcagc

SEQ ID NO: 5594835 - DNA, 17 bp, Homo sapiens
ccctgcgtcccttctct

SEQ ID NO: 5594836 - DNA, 21 bp, Homo sapiens
ccctgcgtcctgacgccctgc

SEQ ID NO: 5594837 - DNA, 18 bp, Homo sapiens
ccctgcgtctcctcgtcc

SEQ ID NO: 5594838 - DNA, 17 bp, Homo sapiens
ccctgcgtggcctgagt

SEQ ID NO: 5594839 - DNA, 19 bp, Homo sapiens
ccctgcgtggcctgagtcc

SEQ ID NO: 5594840 - DNA, 15 bp, Homo sapiens
ccctgcgtggggaca

SEQ ID NO: 5594841 - DNA, 17 bp, Homo sapiens
ccctgcgtgggggccag

SEQ ID NO: 5594842 - DNA, 18 bp, Homo sapiens
ccctgcgttggagccact

SEQ ID NO: 5594843 - DNA, 17 bp, Homo sapiens
ccctgctacctgttctt

SEQ ID NO: 5594844 - DNA, 22 bp, Homo sapiens
ccctgctactgccaacctcgct

SEQ ID NO: 5594845 - DNA, 20 bp, Homo sapiens
ccctgctagcacagaggcct

SEQ ID NO: 5594846 - DNA, 19 bp, Homo sapiens
ccctgctatttcaggccct

SEQ ID NO: 5594847 - DNA, 22 bp, Homo sapiens
ccctgctatttcaggccctcag

SEQ ID NO: 5594848 - DNA, 12 bp, Homo sapiens
ccctgctcagca

SEQ ID NO: 5594849 - DNA, 15 bp, Homo sapiens
ccctgctcagctggc

SEQ ID NO: 5594850 - DNA, 18 bp, Homo sapiens
ccctgctcaggcctcacc

SEQ ID NO: 5594851 - DNA, 20 bp, Homo sapiens
ccctgctcaggcctcacctg

SEQ ID NO: 5594852 - DNA, 22 bp, Homo sapiens
ccctgctcagtgcttgggctcc

SEQ ID NO: 5594853 - DNA, 23 bp, Homo sapiens
ccctgctcatcacccggatagag

SEQ ID NO: 5594854 - DNA, 14 bp, Homo sapiens
ccctgctccaccag

SEQ ID NO: 5594855 - DNA, 19 bp, Homo sapiens
ccctgctccagaagatagc

SEQ ID NO: 5594856 - DNA, 19 bp, Homo sapiens
ccctgctccatgggcacct

SEQ ID NO: 5594857 - DNA, 23 bp, Homo sapiens
ccctgctcccaccaccagtgaga

SEQ ID NO: 5594858 - DNA, 20 bp, Homo sapiens
ccctgctcccacgcctgctt

SEQ ID NO: 5594859 - DNA, 13 bp, Homo sapiens
ccctgctcccagc

SEQ ID NO: 5594860 - DNA, 16 bp, Homo sapiens
ccctgctcccagcctg

SEQ ID NO: 5594861 - DNA, 14 bp, Homo sapiens
ccctgctcccaggt

SEQ ID NO: 5594862 - DNA, 16 bp, Homo sapiens
ccctgctccctctggg

SEQ ID NO: 5594863 - DNA, 14 bp, Homo sapiens
ccctgctccctgcc

SEQ ID NO: 5594864 - DNA, 17 bp, Homo sapiens
ccctgctccctgctccc

SEQ ID NO: 5594865 - DNA, 18 bp, Homo sapiens
ccctgctccctgctttgg

SEQ ID NO: 5594866 - DNA, 19 bp, Homo sapiens
ccctgctccctgctttggc

SEQ ID NO: 5594867 - DNA, 13 bp, Homo sapiens
ccctgctcctagc

SEQ ID NO: 5594868 - DNA, 15 bp, Homo sapiens
ccctgctcctcccaa

SEQ ID NO: 5594869 - DNA, 18 bp, Homo sapiens
ccctgctcctccctggct

SEQ ID NO: 5594870 - DNA, 19 bp, Homo sapiens
ccctgctcctccctggctg

SEQ ID NO: 5594871 - DNA, 14 bp, Homo sapiens
ccctgctcctcctg

SEQ ID NO: 5594872 - DNA, 19 bp, Homo sapiens
ccctgctcctcctgccctg

SEQ ID NO: 5594873 - DNA, 13 bp, Homo sapiens
ccctgctcctgca

SEQ ID NO: 5594874 - DNA, 16 bp, Homo sapiens
ccctgctcctgcagca

SEQ ID NO: 5594875 - DNA, 15 bp, Homo sapiens
ccctgctctacccat

SEQ ID NO: 5594876 - DNA, 21 bp, Homo sapiens
ccctgctctccgaccagacac

SEQ ID NO: 5594877 - DNA, 13 bp, Homo sapiens
ccctgctctctga

SEQ ID NO: 5594878 - DNA, 22 bp, Homo sapiens
ccctgctctgcccaggcaagga

SEQ ID NO: 5594879 - DNA, 13 bp, Homo sapiens
ccctgctctgggg

SEQ ID NO: 5594880 - DNA, 23 bp, Homo sapiens
ccctgctctgtagccacctcctt

SEQ ID NO: 5594881 - DNA, 18 bp, Homo sapiens
ccctgctctgttgcctct

SEQ ID NO: 5594882 - DNA, 19 bp, Homo sapiens
ccctgctcttctctcccca

SEQ ID NO: 5594883 - DNA, 14 bp, Homo sapiens
ccctgctctttctc

SEQ ID NO: 5594884 - DNA, 23 bp, Homo sapiens
ccctgctctttctctgagaacca

SEQ ID NO: 5594885 - DNA, 21 bp, Homo sapiens
ccctgctgaacacagtgtctg

SEQ ID NO: 5594886 - DNA, 18 bp, Homo sapiens
ccctgctgaagctgctgc

SEQ ID NO: 5594887 - DNA, 11 bp, Homo sapiens
ccctgctgaat

SEQ ID NO: 5594888 - DNA, 13 bp, Homo sapiens
ccctgctgaatgc

SEQ ID NO: 5594889 - DNA, 17 bp, Homo sapiens
ccctgctgacctcccac

SEQ ID NO: 5594890 - DNA, 21 bp, Homo sapiens
ccctgctgagtcccaggctga

SEQ ID NO: 5594891 - DNA, 13 bp, Homo sapiens
ccctgctgagtgg

SEQ ID NO: 5594892 - DNA, 13 bp, Homo sapiens
ccctgctgcaggg

SEQ ID NO: 5594893 - DNA, 20 bp, Homo sapiens
ccctggggctgatctcaggg

SEQ ID NO: 5594894 - DNA, 15 bp, Homo sapiens
ccctggggctgccct

SEQ ID NO: 5594895 - DNA, 16 bp, Homo sapiens
ccctggggctgccctc

SEQ ID NO: 5594896 - DNA, 16 bp, Homo sapiens
ccctggggctggcttt

SEQ ID NO: 5594897 - DNA, 19 bp, Homo sapiens
ccctggggctggtggattg

SEQ ID NO: 5594898 - DNA, 17 bp, Homo sapiens
ccctgggggaagccctg

SEQ ID NO: 5594899 - DNA, 19 bp, Homo sapiens
ccctgggggaagccctgga

SEQ ID NO: 5594900 - DNA, 20 bp, Homo sapiens
ccctgggggaagccctggat

SEQ ID NO: 5594901 - DNA, 22 bp, Homo sapiens
ccctgggggaggcttccagctc

SEQ ID NO: 5594902 - DNA, 15 bp, Homo sapiens
ccctgggggattcct

SEQ ID NO: 5594903 - DNA, 15 bp, Homo sapiens
ccctgggggcatcct

SEQ ID NO: 5594904 - DNA, 17 bp, Homo sapiens
ccctgggggcatcctgc

SEQ ID NO: 5594905 - DNA, 20 bp, Homo sapiens
ccctgggggcatcctgcttc

SEQ ID NO: 5594906 - DNA, 22 bp, Homo sapiens
ccctgggggcatcctgcttcct

SEQ ID NO: 5594907 - DNA, 17 bp, Homo sapiens
ccctgggggccagctgg

SEQ ID NO: 5594908 - DNA, 11 bp, Homo sapiens
ccctgggggcg

SEQ ID NO: 5594909 - DNA, 16 bp, Homo sapiens
ccctgggggcggccag

SEQ ID NO: 5594910 - DNA, 21 bp, Homo sapiens
ccctgggggtcccaggatccc

SEQ ID NO: 5594911 - DNA, 13 bp, Homo sapiens
ccctgggggtctg

SEQ ID NO: 5594912 - DNA, 19 bp, Homo sapiens
ccctgggggtctgggcgtc

SEQ ID NO: 5594913 - DNA, 23 bp, Homo sapiens
ccctgggggtggggctcctacct

SEQ ID NO: 5594914 - DNA, 22 bp, Homo sapiens
ccctgggggtttaagctctgcc

SEQ ID NO: 5594915 - DNA, 22 bp, Homo sapiens
ccctggggtaccatgtggccac

SEQ ID NO: 5594916 - DNA, 22 bp, Homo sapiens
ccctggggtatgagctgccaag

SEQ ID NO: 5594917 - DNA, 20 bp, Homo sapiens
ccctggggtcaccttctagt

SEQ ID NO: 5594918 - DNA, 23 bp, Homo sapiens
ccctggggtctctgagcagtggg

SEQ ID NO: 5594919 - DNA, 21 bp, Homo sapiens
ccctggggtgcaggcgcctca

SEQ ID NO: 5594920 - DNA, 16 bp, Homo sapiens
ccctggggtggccagg

SEQ ID NO: 5594921 - DNA, 17 bp, Homo sapiens
ccctggggtggccaggg

SEQ ID NO: 5594922 - DNA, 23 bp, Homo sapiens
ccctggggtggcgtctgcctagg

SEQ ID NO: 5594923 - DNA, 21 bp, Homo sapiens
ccctggggtgggatctgagct

SEQ ID NO: 5594924 - DNA, 22 bp, Homo sapiens
ccctggggtttccacacaggcc

SEQ ID NO: 5594925 - DNA, 19 bp, Homo sapiens
ccctgggtaagaagggtgg

SEQ ID NO: 5594926 - DNA, 18 bp, Homo sapiens
ccctgggtaccctgagcc

SEQ ID NO: 5594927 - DNA, 23 bp, Homo sapiens
ccctgggtcaccttcctgggcag

SEQ ID NO: 5594928 - DNA, 17 bp, Homo sapiens
ccctgggtcctccaaag

SEQ ID NO: 5594929 - DNA, 17 bp, Homo sapiens
ccctgggtcctcgggcc

SEQ ID NO: 5594930 - DNA, 18 bp, Homo sapiens
ccctgggtcctgcctgca

SEQ ID NO: 5594931 - DNA, 20 bp, Homo sapiens
ccctgggtgccattcccagc

SEQ ID NO: 5594932 - DNA, 15 bp, Homo sapiens
ccctgggtgggccct

SEQ ID NO: 5594933 - DNA, 21 bp, Homo sapiens
ccctgggtgggccctgccgtg

SEQ ID NO: 5594934 - DNA, 20 bp, Homo sapiens
ccctgggtgggctctgtgca

SEQ ID NO: 5594935 - DNA, 21 bp, Homo sapiens
ccctgggtgggtggtggggag

SEQ ID NO: 5594936 - DNA, 18 bp, Homo sapiens
ccctgggttagactgcca

SEQ ID NO: 5594937 - DNA, 23 bp, Homo sapiens
ccctgggttcagaaatgctgcct

SEQ ID NO: 5594938 - DNA, 18 bp, Homo sapiens
ccctgggtttggcccctg

SEQ ID NO: 5594939 - DNA, 19 bp, Homo sapiens
ccctggtaaaccaagcctc

SEQ ID NO: 5594940 - DNA, 16 bp, Homo sapiens
ccctggtaggaaagca

SEQ ID NO: 5594941 - DNA, 18 bp, Homo sapiens
ccctggtccagggaagct

SEQ ID NO: 5594942 - DNA, 18 bp, Homo sapiens
ccctggtccccccaaatc

SEQ ID NO: 5594943 - DNA, 15 bp, Homo sapiens
ccctggtcctgactt

SEQ ID NO: 5594944 - DNA, 16 bp, Homo sapiens
ccctggtcctgacttc

SEQ ID NO: 5594945 - DNA, 13 bp, Homo sapiens
ccctggtcctgca

SEQ ID NO: 5594946 - DNA, 18 bp, Homo sapiens
ccctggtcctggcctcct

SEQ ID NO: 5594947 - DNA, 23 bp, Homo sapiens
ccctggtcctggcctccttcccc

SEQ ID NO: 5594948 - DNA, 16 bp, Homo sapiens
ccctggtccttcactg

SEQ ID NO: 5594949 - DNA, 13 bp, Homo sapiens
ccctggtctcagc

SEQ ID NO: 5594950 - DNA, 12 bp, Homo sapiens
ccctggtctccg

SEQ ID NO: 5594951 - DNA, 14 bp, Homo sapiens
ccctggtctctggt

SEQ ID NO: 5594952 - DNA, 13 bp, Homo sapiens
ccctggtctggct

SEQ ID NO: 5594953 - DNA, 15 bp, Homo sapiens
ccctggtctgtggag

SEQ ID NO: 5594954 - DNA, 18 bp, Homo sapiens
ccctggtctgtggagatg

SEQ ID NO: 5594955 - DNA, 17 bp, Homo sapiens
ccctggtgaatcacctg

SEQ ID NO: 5594956 - DNA, 20 bp, Homo sapiens
ccctggtgaatcacctggct

SEQ ID NO: 5594957 - DNA, 19 bp, Homo sapiens
ccctggtgaccagaccaag

SEQ ID NO: 5594958 - DNA, 22 bp, Homo sapiens
ccctggtgagagggccgggcag

SEQ ID NO: 5594959 - DNA, 14 bp, Homo sapiens
ccctggtgaggaag

SEQ ID NO: 5594960 - DNA, 13 bp, Homo sapiens
ccctggtgcccct

SEQ ID NO: 5594961 - DNA, 12 bp, Homo sapiens
ccctggtgcctc

SEQ ID NO: 5594962 - DNA, 15 bp, Homo sapiens
ccctggtgcctggct

SEQ ID NO: 5594963 - DNA, 16 bp, Homo sapiens
ccctggtgcctggctc

SEQ ID NO: 5594964 - DNA, 17 bp, Homo sapiens
ccctggtgctcctgccc

SEQ ID NO: 5594965 - DNA, 15 bp, Homo sapiens
ccctggtgctgccac

SEQ ID NO: 5594966 - DNA, 11 bp, Homo sapiens
ccctggtgctt

SEQ ID NO: 5594967 - DNA, 17 bp, Homo sapiens
ccctggtggacagtcct

SEQ ID NO: 5594968 - DNA, 19 bp, Homo sapiens
ccctggtggacagtcctgg

SEQ ID NO: 5594969 - DNA, 23 bp, Homo sapiens
ccctggtggacagtcctgggaga

SEQ ID NO: 5594970 - DNA, 17 bp, Homo sapiens
ccctggtggcagctcac

SEQ ID NO: 5594971 - DNA, 20 bp, Homo sapiens
ccctggtggcagctcacctc

SEQ ID NO: 5594972 - DNA, 19 bp, Homo sapiens
ccctggtggccaagcctgc

SEQ ID NO: 5594973 - DNA, 15 bp, Homo sapiens
ccctggtggcctgcc

SEQ ID NO: 5594974 - DNA, 23 bp, Homo sapiens
ccctggtgggccaacaaagaaca

SEQ ID NO: 5594975 - DNA, 19 bp, Homo sapiens
ccctggtggtcacaggctg

SEQ ID NO: 5594976 - DNA, 21 bp, Homo sapiens
ccctggtgtcacatggggcct

SEQ ID NO: 5594977 - DNA, 12 bp, Homo sapiens
ccctggtgtttc

SEQ ID NO: 5594978 - DNA, 22 bp, Homo sapiens
ccctggtgtttctagcactggc

SEQ ID NO: 5594979 - DNA, 17 bp, Homo sapiens
ccctggttagctgacag

SEQ ID NO: 5594980 - DNA, 22 bp, Homo sapiens
ccctggttagctgacagtcagc

SEQ ID NO: 5594981 - DNA, 18 bp, Homo sapiens
ccctggttatattctcac

SEQ ID NO: 5594982 - DNA, 19 bp, Homo sapiens
ccctggttatattctcacg

SEQ ID NO: 5594983 - DNA, 19 bp, Homo sapiens
ccctggttcccccaggacc

SEQ ID NO: 5594984 - DNA, 15 bp, Homo sapiens
ccctggttctcatct

SEQ ID NO: 5594985 - DNA, 22 bp, Homo sapiens
ccctggttctgatgatgtgcct

SEQ ID NO: 5594986 - DNA, 23 bp, Homo sapiens
ccctggttctgatgatgtgcctg

SEQ ID NO: 5594987 - DNA, 23 bp, Homo sapiens
ccctggttgagaaacattgcttt

SEQ ID NO: 5594988 - DNA, 14 bp, Homo sapiens
ccctggttgcctct

SEQ ID NO: 5594989 - DNA, 16 bp, Homo sapiens
ccctggttgcctctct

SEQ ID NO: 5594990 - DNA, 22 bp, Homo sapiens
ccctggtttcctgccctgggag

SEQ ID NO: 5594991 - DNA, 19 bp, Homo sapiens
ccctggttttaccccagct

SEQ ID NO: 5594992 - DNA, 21 bp, Homo sapiens
ccctgtaacgtaacccattaa

SEQ ID NO: 5594993 - DNA, 12 bp, Homo sapiens
ccctgtaaggtt

SEQ ID NO: 5594994 - DNA, 21 bp, Homo sapiens
ccctgtaatcaggcaaggagg

SEQ ID NO: 5594995 - DNA, 23 bp, Homo sapiens
ccctgtaatcaggcaaggaggag

SEQ ID NO: 5594996 - DNA, 14 bp, Homo sapiens
ccctgtaatgcact

SEQ ID NO: 5594997 - DNA, 19 bp, Homo sapiens
ccctgtacccaccccagca

SEQ ID NO: 5594998 - DNA, 20 bp, Homo sapiens
ccctgtacccaccccagcac

SEQ ID NO: 5594999 - DNA, 18 bp, Homo sapiens
ccctgtacccagccacct

SEQ ID NO: 5595000 - DNA, 23 bp, Homo sapiens
ccctgtacccagccaccttcctg

SEQ ID NO: 5595001 - DNA, 17 bp, Homo sapiens
ccctgtacccagctcct

SEQ ID NO: 5595002 - DNA, 16 bp, Homo sapiens
ccctgtacctcatccc

SEQ ID NO: 5595003 - DNA, 14 bp, Homo sapiens
ccctgtacctctct

SEQ ID NO: 5595004 - DNA, 18 bp, Homo sapiens
ccctgtacctctctctgc

SEQ ID NO: 5595005 - DNA, 18 bp, Homo sapiens
ccctgtagatgttctagg

SEQ ID NO: 5595006 - DNA, 20 bp, Homo sapiens
ccctgtagatgttctaggat

SEQ ID NO: 5595007 - DNA, 19 bp, Homo sapiens
ccctgtagccctggcccgg

SEQ ID NO: 5595008 - DNA, 13 bp, Homo sapiens
ccctgtagctcag

SEQ ID NO: 5595009 - DNA, 13 bp, Homo sapiens
ccctgtagctctg

SEQ ID NO: 5595010 - DNA, 18 bp, Homo sapiens
ccctgtagctctgcctcc

SEQ ID NO: 5595011 - DNA, 21 bp, Homo sapiens
ccctgtagctctgcctccctc

SEQ ID NO: 5595012 - DNA, 14 bp, Homo sapiens
ccctgtaggttgct

SEQ ID NO: 5595013 - DNA, 17 bp, Homo sapiens
ccctgtagttaggcctg

SEQ ID NO: 5595014 - DNA, 19 bp, Homo sapiens
ccctgtagttaggcctggc

SEQ ID NO: 5595015 - DNA, 24 bp, Homo sapiens
ccctgtatgtctacctctgacttc

SEQ ID NO: 5595016 - DNA, 22 bp, Homo sapiens
ccctgtatttattcccccatct

SEQ ID NO: 5595017 - DNA, 22 bp, Homo sapiens
ccctgtcaaatatcagttaccc

SEQ ID NO: 5595018 - DNA, 20 bp, Homo sapiens
ccctgtcaagcttctctgtt

SEQ ID NO: 5595019 - DNA, 15 bp, Homo sapiens
ccctgtcacacactg

SEQ ID NO: 5595020 - DNA, 19 bp, Homo sapiens
ccctgtcaccaagctcaca

SEQ ID NO: 5595021 - DNA, 13 bp, Homo sapiens
ccctgtcacccac

SEQ ID NO: 5595022 - DNA, 18 bp, Homo sapiens
ccctgtcacccacagacc

SEQ ID NO: 5595023 - DNA, 19 bp, Homo sapiens
ccctgtcacgctcatgtcc

SEQ ID NO: 5595024 - DNA, 21 bp, Homo sapiens
ccctgtcacgctcatgtcctg

SEQ ID NO: 5595025 - DNA, 13 bp, Homo sapiens
ccctgtcactcag

SEQ ID NO: 5595026 - DNA, 15 bp, Homo sapiens
ccctgtcacttgctg

SEQ ID NO: 5595027 - DNA, 21 bp, Homo sapiens
ccctgtcacttgctggctgtg

SEQ ID NO: 5595028 - DNA, 20 bp, Homo sapiens
ccctgtcagaatcatgctgt

SEQ ID NO: 5595029 - DNA, 23 bp, Homo sapiens
ccctgtcagaatcatgctgttct

SEQ ID NO: 5595030 - DNA, 14 bp, Homo sapiens
ccctgtcagaggct

SEQ ID NO: 5595031 - DNA, 17 bp, Homo sapiens
ccctgtcagtgcagccc

SEQ ID NO: 5595032 - DNA, 21 bp, Homo sapiens
ccctgtcagtgcagcccgtgt

SEQ ID NO: 5595033 - DNA, 20 bp, Homo sapiens
ccctgtcatccagctcactc

SEQ ID NO: 5595034 - DNA, 19 bp, Homo sapiens
ccctgtcatttgaacctgg

SEQ ID NO: 5595035 - DNA, 14 bp, Homo sapiens
ccctgtccaaaagc

SEQ ID NO: 5595036 - DNA, 23 bp, Homo sapiens
ccctgtccaaaagcgccctcact

SEQ ID NO: 5595037 - DNA, 14 bp, Homo sapiens
ccctgtccaaactg

SEQ ID NO: 5595038 - DNA, 21 bp, Homo sapiens
ccctgtccaaactgcctaagc

SEQ ID NO: 5595039 - DNA, 12 bp, Homo sapiens
ccctgtcccacc

SEQ ID NO: 5595040 - DNA, 17 bp, Homo sapiens
ccctgtcccaccaactc

SEQ ID NO: 5595041 - DNA, 20 bp, Homo sapiens
ccctgtcccaccaactctgc

SEQ ID NO: 5595042 - DNA, 24 bp, Homo sapiens
ccctgtcccaccaactctgcactc

SEQ ID NO: 5595043 - DNA, 15 bp, Homo sapiens
ccctgtcccacctgg

SEQ ID NO: 5595044 - DNA, 12 bp, Homo sapiens
ccctgtcccagc

SEQ ID NO: 5595045 - DNA, 14 bp, Homo sapiens
ccctgtcccagcag

SEQ ID NO: 5595046 - DNA, 15 bp, Homo sapiens
ccctgtcccagcaga

SEQ ID NO: 5595047 - DNA, 13 bp, Homo sapiens
ccctgtcccaggc

SEQ ID NO: 5595048 - DNA, 22 bp, Homo sapiens
ccctgtcccaggcagcgccact

SEQ ID NO: 5595049 - DNA, 17 bp, Homo sapiens
ccctgtcccatgcaggc

SEQ ID NO: 5595050 - DNA, 20 bp, Homo sapiens
ccctgtcccatgcaggccct

SEQ ID NO: 5595051 - DNA, 13 bp, Homo sapiens
ccctgtcccattc

SEQ ID NO: 5595052 - DNA, 17 bp, Homo sapiens
ccctgtcccattctaga

SEQ ID NO: 5595053 - DNA, 15 bp, Homo sapiens
ccctgtccccaacag

SEQ ID NO: 5595054 - DNA, 15 bp, Homo sapiens
ccctgtccccaggcc

SEQ ID NO: 5595055 - DNA, 18 bp, Homo sapiens
ccctgtccccaggcccag

SEQ ID NO: 5595056 - DNA, 19 bp, Homo sapiens
ccctgtccccaggcccagc

SEQ ID NO: 5595057 - DNA, 23 bp, Homo sapiens
ccctgtccccagtccccagccct

SEQ ID NO: 5595058 - DNA, 13 bp, Homo sapiens
ccctgtcccccag

SEQ ID NO: 5595059 - DNA, 17 bp, Homo sapiens
ccctgtcccccagctct

SEQ ID NO: 5595060 - DNA, 19 bp, Homo sapiens
ccctgtcccccagctctgg

SEQ ID NO: 5595061 - DNA, 21 bp, Homo sapiens
ccctgtccccctcccctccca

SEQ ID NO: 5595062 - DNA, 22 bp, Homo sapiens
ccctgtccccctcccctcccag

SEQ ID NO: 5595063 - DNA, 16 bp, Homo sapiens
ccctgtcccctaggga

SEQ ID NO: 5595064 - DNA, 18 bp, Homo sapiens
ccctgtcccctagggact

SEQ ID NO: 5595065 - DNA, 15 bp, Homo sapiens
ccctgtcccctcctc

SEQ ID NO: 5595066 - DNA, 14 bp, Homo sapiens
ccctgtcccctggg

SEQ ID NO: 5595067 - DNA, 15 bp, Homo sapiens
ccctgtcccctgggg

SEQ ID NO: 5595068 - DNA, 17 bp, Homo sapiens
ccctgtcccctggggct

SEQ ID NO: 5595069 - DNA, 13 bp, Homo sapiens
cccttgccttccc

SEQ ID NO: 5595070 - DNA, 22 bp, Homo sapiens
cccttgccttcctcagctgcct

SEQ ID NO: 5595071 - DNA, 20 bp, Homo sapiens
cccttgcctttcgaggcctg

SEQ ID NO: 5595072 - DNA, 15 bp, Homo sapiens
cccttgctcatgagc

SEQ ID NO: 5595073 - DNA, 15 bp, Homo sapiens
cccttgctccagcct

SEQ ID NO: 5595074 - DNA, 18 bp, Homo sapiens
cccttgctccagcctgac

SEQ ID NO: 5595075 - DNA, 19 bp, Homo sapiens
cccttgctccagcctgaca

SEQ ID NO: 5595076 - DNA, 13 bp, Homo sapiens
cccttgctccctt

SEQ ID NO: 5595077 - DNA, 13 bp, Homo sapiens
cccttgctctcag

SEQ ID NO: 5595078 - DNA, 18 bp, Homo sapiens
cccttgctctcagctgcc

SEQ ID NO: 5595079 - DNA, 18 bp, Homo sapiens
cccttgctgaacacacac

SEQ ID NO: 5595080 - DNA, 20 bp, Homo sapiens
cccttgctgcaaacccatga

SEQ ID NO: 5595081 - DNA, 22 bp, Homo sapiens
cccttgctgcaaacccatgaag

SEQ ID NO: 5595082 - DNA, 13 bp, Homo sapiens
cccttgctgcccg

SEQ ID NO: 5595083 - DNA, 13 bp, Homo sapiens
cccttgctggccc

SEQ ID NO: 5595084 - DNA, 16 bp, Homo sapiens
cccttgctggccccag

SEQ ID NO: 5595085 - DNA, 23 bp, Homo sapiens
cccttgctggccccagccctgct

SEQ ID NO: 5595086 - DNA, 12 bp, Homo sapiens
cccttgctgggc

SEQ ID NO: 5595087 - DNA, 15 bp, Homo sapiens
cccttgctgggcctg

SEQ ID NO: 5595088 - DNA, 19 bp, Homo sapiens
cccttgctgggtccagggt

SEQ ID NO: 5595089 - DNA, 14 bp, Homo sapiens
cccttgctgtatgc

SEQ ID NO: 5595090 - DNA, 21 bp, Homo sapiens
cccttgctgtatgctgatcat

SEQ ID NO: 5595091 - DNA, 23 bp, Homo sapiens
cccttgcttctaagggatccaga

SEQ ID NO: 5595092 - DNA, 22 bp, Homo sapiens
cccttgcttgcctgcagggcca

SEQ ID NO: 5595093 - DNA, 17 bp, Homo sapiens
cccttgctttcctgggc

SEQ ID NO: 5595094 - DNA, 22 bp, Homo sapiens
cccttgctttcctgggcctttg

SEQ ID NO: 5595095 - DNA, 14 bp, Homo sapiens
cccttgcttttccc

SEQ ID NO: 5595096 - DNA, 21 bp, Homo sapiens
cccttgcttttccctcttttc

SEQ ID NO: 5595097 - DNA, 22 bp, Homo sapiens
cccttggaaacctgccctgcct

SEQ ID NO: 5595098 - DNA, 23 bp, Homo sapiens
cccttggaaacctgccctgcctg

SEQ ID NO: 5595099 - DNA, 21 bp, Homo sapiens
cccttggaaagttcagccaga

SEQ ID NO: 5595100 - DNA, 22 bp, Homo sapiens
cccttggaaagttcagccagaa

SEQ ID NO: 5595101 - DNA, 19 bp, Homo sapiens
cccttggaacaccctggat

SEQ ID NO: 5595102 - DNA, 22 bp, Homo sapiens
cccttggacaagacaaaccaag

SEQ ID NO: 5595103 - DNA, 14 bp, Homo sapiens
cccttggacatttt

SEQ ID NO: 5595104 - DNA, 15 bp, Homo sapiens
cccttggacatttta

SEQ ID NO: 5595105 - DNA, 15 bp, Homo sapiens
cccttggacctccag

SEQ ID NO: 5595106 - DNA, 16 bp, Homo sapiens
cccttggacctccagg

SEQ ID NO: 5595107 - DNA, 17 bp, Homo sapiens
cccttggacctccaggg

SEQ ID NO: 5595108 - DNA, 13 bp, Homo sapiens
cccttggagcctt

SEQ ID NO: 5595109 - DNA, 17 bp, Homo sapiens
cccttggaggagagaga

SEQ ID NO: 5595110 - DNA, 21 bp, Homo sapiens
cccttggaggagagagacccc

SEQ ID NO: 5595111 - DNA, 22 bp, Homo sapiens
cccttggaggagagagaccccg

SEQ ID NO: 5595112 - DNA, 18 bp, Homo sapiens
cccttggaggccagccag

SEQ ID NO: 5595113 - DNA, 14 bp, Homo sapiens
cccttggagggaga

SEQ ID NO: 5595114 - DNA, 15 bp, Homo sapiens
cccttggagggagag

SEQ ID NO: 5595115 - DNA, 15 bp, Homo sapiens
cccttggatcagagg

SEQ ID NO: 5595116 - DNA, 16 bp, Homo sapiens
cccttggatcagaggt

SEQ ID NO: 5595117 - DNA, 18 bp, Homo sapiens
cccttggcactgatgggc

SEQ ID NO: 5595118 - DNA, 16 bp, Homo sapiens
cccttggcactgtgga

SEQ ID NO: 5595119 - DNA, 20 bp, Homo sapiens
cccttggcactgtggaactg

SEQ ID NO: 5595120 - DNA, 21 bp, Homo sapiens
cccttggcaggtcctggccag

SEQ ID NO: 5595121 - DNA, 15 bp, Homo sapiens
cccttggccacggcc

SEQ ID NO: 5595122 - DNA, 16 bp, Homo sapiens
cccttggccacggcct

SEQ ID NO: 5595123 - DNA, 18 bp, Homo sapiens
cccttggccacggcctgg

SEQ ID NO: 5595124 - DNA, 11 bp, Homo sapiens
cccttggccag

SEQ ID NO: 5595125 - DNA, 15 bp, Homo sapiens
cccttggccccagag

SEQ ID NO: 5595126 - DNA, 16 bp, Homo sapiens
cccttggccccagagg

SEQ ID NO: 5595127 - DNA, 12 bp, Homo sapiens
cccttggcccct

SEQ ID NO: 5595128 - DNA, 13 bp, Homo sapiens
cccttggcccctc

SEQ ID NO: 5595129 - DNA, 14 bp, Homo sapiens
cccttggcctcaga

SEQ ID NO: 5595130 - DNA, 20 bp, Homo sapiens
cccttggcctccatttctgt

SEQ ID NO: 5595131 - DNA, 21 bp, Homo sapiens
cccttggcgggcagcccagcc

SEQ ID NO: 5595132 - DNA, 19 bp, Homo sapiens
cccttggctggatcaggga

SEQ ID NO: 5595133 - DNA, 23 bp, Homo sapiens
cccttggctgtgaggcccctgga

SEQ ID NO: 5595134 - DNA, 19 bp, Homo sapiens
cccttggcttcctccgtcc

SEQ ID NO: 5595135 - DNA, 22 bp, Homo sapiens
cccttgggaaggacacagcagt

SEQ ID NO: 5595136 - DNA, 22 bp, Homo sapiens
cccttgggacagccagagctgg

SEQ ID NO: 5595137 - DNA, 12 bp, Homo sapiens
cccttgggatgg

SEQ ID NO: 5595138 - DNA, 20 bp, Homo sapiens
cccttgggatgggcacaggc

SEQ ID NO: 5595139 - DNA, 22 bp, Homo sapiens
cccttgggatgggcacaggctg

SEQ ID NO: 5595140 - DNA, 22 bp, Homo sapiens
cccttgggcagagtcctgcctt

SEQ ID NO: 5595141 - DNA, 12 bp, Homo sapiens
cccttgggcagt

SEQ ID NO: 5595142 - DNA, 13 bp, Homo sapiens
cccttgggcagtt

SEQ ID NO: 5595143 - DNA, 20 bp, Homo sapiens
cccttgggcagttctcactc

SEQ ID NO: 5595144 - DNA, 12 bp, Homo sapiens
cccttgggccac

SEQ ID NO: 5595145 - DNA, 20 bp, Homo sapiens
cccttgggcctcccactccc

SEQ ID NO: 5595146 - DNA, 17 bp, Homo sapiens
cccttgggcctcccccc

SEQ ID NO: 5595147 - DNA, 21 bp, Homo sapiens
cccttgggcctgggcctctgc

SEQ ID NO: 5595148 - DNA, 15 bp, Homo sapiens
cccttgggctggaag

SEQ ID NO: 5595149 - DNA, 15 bp, Homo sapiens
cccttggggcctggc

SEQ ID NO: 5595150 - DNA, 17 bp, Homo sapiens
cccttggggcctggctt

SEQ ID NO: 5595151 - DNA, 18 bp, Homo sapiens
cccttggggcctggcttg

SEQ ID NO: 5595152 - DNA, 23 bp, Homo sapiens
cccttggggcctggcttgctcca

SEQ ID NO: 5595153 - DNA, 19 bp, Homo sapiens
cccttggggtggcgcgcct

SEQ ID NO: 5595154 - DNA, 22 bp, Homo sapiens
cccttggggtggcgcgcctgcc

SEQ ID NO: 5595155 - DNA, 23 bp, Homo sapiens
cccttggggtggcgcgcctgcct

SEQ ID NO: 5595156 - DNA, 23 bp, Homo sapiens
cccttggggtggtgctgggtcat

SEQ ID NO: 5595157 - DNA, 20 bp, Homo sapiens
cccttggggttcccccagac

SEQ ID NO: 5595158 - DNA, 20 bp, Homo sapiens
cccttggtcctggcagggcg

SEQ ID NO: 5595159 - DNA, 23 bp, Homo sapiens
cccttggtctgtacaaataatag

SEQ ID NO: 5595160 - DNA, 17 bp, Homo sapiens
cccttggtcttccatgg

SEQ ID NO: 5595161 - DNA, 14 bp, Homo sapiens
cccttggtggcaac

SEQ ID NO: 5595162 - DNA, 19 bp, Homo sapiens
cccttggtgtttcccttcc

SEQ ID NO: 5595163 - DNA, 22 bp, Homo sapiens
cccttggtgtttcccttcctcg

SEQ ID NO: 5595164 - DNA, 16 bp, Homo sapiens
cccttggtttctgggg

SEQ ID NO: 5595165 - DNA, 22 bp, Homo sapiens
cccttggtttctgggggctggt

SEQ ID NO: 5595166 - DNA, 18 bp, Homo sapiens
cccttgtaccccatccct

SEQ ID NO: 5595167 - DNA, 17 bp, Homo sapiens
cccttgtagctcctccc

SEQ ID NO: 5595168 - DNA, 23 bp, Homo sapiens
cccttgtagctcctcccctggag

SEQ ID NO: 5595169 - DNA, 12 bp, Homo sapiens
cccttgtatagt

SEQ ID NO: 5595170 - DNA, 18 bp, Homo sapiens
cccttgtatcccctgcag

SEQ ID NO: 5595171 - DNA, 16 bp, Homo sapiens
cccttgtccctggggc

SEQ ID NO: 5595172 - DNA, 18 bp, Homo sapiens
cccttgtcctgccagctg

SEQ ID NO: 5595173 - DNA, 19 bp, Homo sapiens
cccttgtcctgccagctgc

SEQ ID NO: 5595174 - DNA, 22 bp, Homo sapiens
cccttgtcggccccaccagtgc

SEQ ID NO: 5595175 - DNA, 15 bp, Homo sapiens
cccttgtctccctgg

SEQ ID NO: 5595176 - DNA, 14 bp, Homo sapiens
cccttgtctgagat

SEQ ID NO: 5595177 - DNA, 23 bp, Homo sapiens
cccttgtctgagatgctggtaat

SEQ ID NO: 5595178 - DNA, 16 bp, Homo sapiens
cccttgtctgctgctc

SEQ ID NO: 5595179 - DNA, 14 bp, Homo sapiens
cccttgtcttcccc

SEQ ID NO: 5595180 - DNA, 20 bp, Homo sapiens
cccttgtcttcccccctctc

SEQ ID NO: 5595181 - DNA, 13 bp, Homo sapiens
cccttgtgccctg

SEQ ID NO: 5595182 - DNA, 23 bp, Homo sapiens
cccttgtgggcaaaggcagggcc

SEQ ID NO: 5595183 - DNA, 18 bp, Homo sapiens
cccttgtggtcccacccc

SEQ ID NO: 5595184 - DNA, 14 bp, Homo sapiens
cccttgtgtcaaga

SEQ ID NO: 5595185 - DNA, 15 bp, Homo sapiens
cccttgtgttccttc

SEQ ID NO: 5595186 - DNA, 21 bp, Homo sapiens
cccttgtgttccttctgtgaa

SEQ ID NO: 5595187 - DNA, 12 bp, Homo sapiens
cccttgttccag

SEQ ID NO: 5595188 - DNA, 17 bp, Homo sapiens
cccttgttgcactgccc

SEQ ID NO: 5595189 - DNA, 22 bp, Homo sapiens
cccttgttgtaaaaagcccagc

SEQ ID NO: 5595190 - DNA, 18 bp, Homo sapiens
cccttgtttacagtgagg

SEQ ID NO: 5595191 - DNA, 13 bp, Homo sapiens
cccttgtttataa

SEQ ID NO: 5595192 - DNA, 17 bp, Homo sapiens
cccttgtttctgttgtt

SEQ ID NO: 5595193 - DNA, 21 bp, Homo sapiens
cccttgttttgaaactagaaa

SEQ ID NO: 5595194 - DNA, 14 bp, Homo sapiens
cccttgtttttgat

SEQ ID NO: 5595195 - DNA, 19 bp, Homo sapiens
ccctttaaccctcacactg

SEQ ID NO: 5595196 - DNA, 18 bp, Homo sapiens
ccctttacaatgtgaata

SEQ ID NO: 5595197 - DNA, 13 bp, Homo sapiens
ccctttaccctct

SEQ ID NO: 5595198 - DNA, 17 bp, Homo sapiens
ccctttactcagcccag

SEQ ID NO: 5595199 - DNA, 19 bp, Homo sapiens
ccctttactcagcccagct

SEQ ID NO: 5595200 - DNA, 20 bp, Homo sapiens
ccctttactcagcccagctg

SEQ ID NO: 5595201 - DNA, 23 bp, Homo sapiens
ccctttacttgtctttctggggt

SEQ ID NO: 5595202 - DNA, 18 bp, Homo sapiens
ccctttagatctctgaag

SEQ ID NO: 5595203 - DNA, 15 bp, Homo sapiens
ccctttagttctgct

SEQ ID NO: 5595204 - DNA, 15 bp, Homo sapiens
ccctttatttctctt

SEQ ID NO: 5595205 - DNA, 15 bp, Homo sapiens
ccctttcacaggcag

SEQ ID NO: 5595206 - DNA, 14 bp, Homo sapiens
ccctttcaccccca

SEQ ID NO: 5595207 - DNA, 23 bp, Homo sapiens
ccctttcacccctcttcccacca

SEQ ID NO: 5595208 - DNA, 18 bp, Homo sapiens
ccctttcactgaagtgaa

SEQ ID NO: 5595209 - DNA, 14 bp, Homo sapiens
ccctttcaggccta

SEQ ID NO: 5595210 - DNA, 22 bp, Homo sapiens
ccctttcagtatgtccccataa

SEQ ID NO: 5595211 - DNA, 20 bp, Homo sapiens
ccctttcatagagaggcctg

SEQ ID NO: 5595212 - DNA, 19 bp, Homo sapiens
ccctttcatcggtgcctgg

SEQ ID NO: 5595213 - DNA, 13 bp, Homo sapiens
ccctttccacgaa

SEQ ID NO: 5595214 - DNA, 13 bp, Homo sapiens
ccctttccagcca

SEQ ID NO: 5595215 - DNA, 18 bp, Homo sapiens
ccctttcccaaacccttc

SEQ ID NO: 5595216 - DNA, 23 bp, Homo sapiens
ccctttcccaccccaacctgctc

SEQ ID NO: 5595217 - DNA, 18 bp, Homo sapiens
ccctttccccattcagtg

SEQ ID NO: 5595218 - DNA, 20 bp, Homo sapiens
ccctttcccccaccccagag

SEQ ID NO: 5595219 - DNA, 22 bp, Homo sapiens
ccctttcccccaccccagagtt

SEQ ID NO: 5595220 - DNA, 23 bp, Homo sapiens
ccctttccccgacgcccacccaa

SEQ ID NO: 5595221 - DNA, 11 bp, Homo sapiens
ccctttcccct

SEQ ID NO: 5595222 - DNA, 17 bp, Homo sapiens
ccctttcccctagatcc

SEQ ID NO: 5595223 - DNA, 13 bp, Homo sapiens
ccctttccccttc

SEQ ID NO: 5595224 - DNA, 15 bp, Homo sapiens
ccctttccccttccc

SEQ ID NO: 5595225 - DNA, 16 bp, Homo sapiens
ccctttccccttcccc

SEQ ID NO: 5595226 - DNA, 15 bp, Homo sapiens
ccctttccctacctt

SEQ ID NO: 5595227 - DNA, 15 bp, Homo sapiens
ccctttccctgcata

SEQ ID NO: 5595228 - DNA, 21 bp, Homo sapiens
ccctttccggcacactgccaa

SEQ ID NO: 5595229 - DNA, 11 bp, Homo sapiens
ccctttcctaa

SEQ ID NO: 5595230 - DNA, 12 bp, Homo sapiens
ccctttcctaaa

SEQ ID NO: 5595231 - DNA, 12 bp, Homo sapiens
ccctttcctccc

SEQ ID NO: 5595232 - DNA, 23 bp, Homo sapiens
ccctttcctccccatacacacac

SEQ ID NO: 5595233 - DNA, 18 bp, Homo sapiens
ccctttccttccccctcg

SEQ ID NO: 5595234 - DNA, 14 bp, Homo sapiens
ccctttccttccta

SEQ ID NO: 5595235 - DNA, 18 bp, Homo sapiens
ccctttccttccttccct

SEQ ID NO: 5595236 - DNA, 14 bp, Homo sapiens
ccctttcgtccaca

SEQ ID NO: 5595237 - DNA, 17 bp, Homo sapiens
ccctttcgtccacatca

SEQ ID NO: 5595238 - DNA, 17 bp, Homo sapiens
ccctttctagaccaata

SEQ ID NO: 5595239 - DNA, 18 bp, Homo sapiens
ccctttctctctcctctc

SEQ ID NO: 5595240 - DNA, 18 bp, Homo sapiens
ccctttctctgcctggca

SEQ ID NO: 5595241 - DNA, 18 bp, Homo sapiens
ccctttctggaccagatc

SEQ ID NO: 5595242 - DNA, 13 bp, Homo sapiens
ccctttctggcac

SEQ ID NO: 5595243 - DNA, 21 bp, Homo sapiens
ccctttctggcacgaaatggc

SEQ ID NO: 5595244 - DNA, 22 bp, Homo sapiens
ccctttctgggcaccggggcct

SEQ ID NO: 5595245 - DNA, 17 bp, Homo sapiens
ccctttcttgacaaaac

SEQ ID NO: 5595246 - DNA, 22 bp, Homo sapiens
ccgcatgccccctcgtgccagt

SEQ ID NO: 5595247 - DNA, 23 bp, Homo sapiens
ccgcatgccccctcgtgccagtc

SEQ ID NO: 5595248 - DNA, 17 bp, Homo sapiens
ccgcatgcggcccagga

SEQ ID NO: 5595249 - DNA, 17 bp, Homo sapiens
ccgcatgctgcctgcct

SEQ ID NO: 5595250 - DNA, 17 bp, Homo sapiens
ccgcatggcagctgggc

SEQ ID NO: 5595251 - DNA, 23 bp, Homo sapiens
ccgcatggcagctgggcccacag

SEQ ID NO: 5595252 - DNA, 14 bp, Homo sapiens
ccgcatggcccctc

SEQ ID NO: 5595253 - DNA, 13 bp, Homo sapiens
ccgcatgtacaaa

SEQ ID NO: 5595254 - DNA, 17 bp, Homo sapiens
ccgcatgtacaaaaaca

SEQ ID NO: 5595255 - DNA, 12 bp, Homo sapiens
ccgcatgtgtct

SEQ ID NO: 5595256 - DNA, 13 bp, Homo sapiens
ccgcatgtgtctg

SEQ ID NO: 5595257 - DNA, 16 bp, Homo sapiens
ccgcatgtgtctgtat

SEQ ID NO: 5595258 - DNA, 14 bp, Homo sapiens
ccgcatgtgtgcct

SEQ ID NO: 5595259 - DNA, 20 bp, Homo sapiens
ccgcattcagtgcacctgcc

SEQ ID NO: 5595260 - DNA, 15 bp, Homo sapiens
ccgcattccaggctc

SEQ ID NO: 5595261 - DNA, 13 bp, Homo sapiens
ccgcattccaggg

SEQ ID NO: 5595262 - DNA, 14 bp, Homo sapiens
ccgcattccctgag

SEQ ID NO: 5595263 - DNA, 16 bp, Homo sapiens
ccgcattggtgactca

SEQ ID NO: 5595264 - DNA, 17 bp, Homo sapiens
ccgcattggtgactcac

SEQ ID NO: 5595265 - DNA, 13 bp, Homo sapiens
ccgcattggtggc

SEQ ID NO: 5595266 - DNA, 14 bp, Homo sapiens
ccgcattggtggct

SEQ ID NO: 5595267 - DNA, 16 bp, Homo sapiens
ccgccaaacactccac

SEQ ID NO: 5595268 - DNA, 14 bp, Homo sapiens
ccgccaacacgcct

SEQ ID NO: 5595269 - DNA, 20 bp, Homo sapiens
ccgccaatgcacggcctcgc

SEQ ID NO: 5595270 - DNA, 16 bp, Homo sapiens
ccgccacacagaccac

SEQ ID NO: 5595271 - DNA, 14 bp, Homo sapiens
ccgccacatccctc

SEQ ID NO: 5595272 - DNA, 11 bp, Homo sapiens
ccgccaccagc

SEQ ID NO: 5595273 - DNA, 11 bp, Homo sapiens
ccgccacccca

SEQ ID NO: 5595274 - DNA, 12 bp, Homo sapiens
ccgccaccccac

SEQ ID NO: 5595275 - DNA, 15 bp, Homo sapiens
ccgccaccccactga

SEQ ID NO: 5595276 - DNA, 19 bp, Homo sapiens
ccgccaccccactgagagc

SEQ ID NO: 5595277 - DNA, 12 bp, Homo sapiens
ccgccaccctgt

SEQ ID NO: 5595278 - DNA, 23 bp, Homo sapiens
ccgccacctatctcgtgggagag

SEQ ID NO: 5595279 - DNA, 14 bp, Homo sapiens
ccgccacctcccca

SEQ ID NO: 5595280 - DNA, 21 bp, Homo sapiens
ccgccacctccccactccagc

SEQ ID NO: 5595281 - DNA, 22 bp, Homo sapiens
ccgccacctgaggtgggctggg

SEQ ID NO: 5595282 - DNA, 19 bp, Homo sapiens
ccgccacgaggagcttcca

SEQ ID NO: 5595283 - DNA, 21 bp, Homo sapiens
ccgccacgaggagcttccagt

SEQ ID NO: 5595284 - DNA, 14 bp, Homo sapiens
ccgccacggccacc

SEQ ID NO: 5595285 - DNA, 19 bp, Homo sapiens
ccgccacggccaccctcct

SEQ ID NO: 5595286 - DNA, 19 bp, Homo sapiens
ccgccactaggtgtcccca

SEQ ID NO: 5595287 - DNA, 19 bp, Homo sapiens
ccgccagaccccgtggctc

SEQ ID NO: 5595288 - DNA, 15 bp, Homo sapiens
ccgccagagtgtcct

SEQ ID NO: 5595289 - DNA, 20 bp, Homo sapiens
ccgccagcagcgcgcaggcc

SEQ ID NO: 5595290 - DNA, 11 bp, Homo sapiens
ccgccagccac

SEQ ID NO: 5595291 - DNA, 12 bp, Homo sapiens
ccgccagccaca

SEQ ID NO: 5595292 - DNA, 16 bp, Homo sapiens
ccgccagccacaggac

SEQ ID NO: 5595293 - DNA, 19 bp, Homo sapiens
ccgccagccccgctcccac

SEQ ID NO: 5595294 - DNA, 12 bp, Homo sapiens
ccgccagcctca

SEQ ID NO: 5595295 - DNA, 18 bp, Homo sapiens
ccgccagcctcagtgcca

SEQ ID NO: 5595296 - DNA, 12 bp, Homo sapiens
ccgccagcgtgt

SEQ ID NO: 5595297 - DNA, 14 bp, Homo sapiens
ccgccagctgggag

SEQ ID NO: 5595298 - DNA, 20 bp, Homo sapiens
ccgccagcttcccttcactc

SEQ ID NO: 5595299 - DNA, 14 bp, Homo sapiens
ccgccaggaaggcc

SEQ ID NO: 5595300 - DNA, 23 bp, Homo sapiens
ccgccaggcgcatgtctgcacct

SEQ ID NO: 5595301 - DNA, 17 bp, Homo sapiens
ccgccaggcgctgcagg

SEQ ID NO: 5595302 - DNA, 21 bp, Homo sapiens
ccgccaggcgctgcagggccg

SEQ ID NO: 5595303 - DNA, 23 bp, Homo sapiens
ccgccaggcgctgcagggccgcg

SEQ ID NO: 5595304 - DNA, 16 bp, Homo sapiens
ccgccagggctgggga

SEQ ID NO: 5595305 - DNA, 17 bp, Homo sapiens
ccgccagggctggggac

SEQ ID NO: 5595306 - DNA, 19 bp, Homo sapiens
ccgccatacattaaggagc

SEQ ID NO: 5595307 - DNA, 14 bp, Homo sapiens
ccgccatccagggt

SEQ ID NO: 5595308 - DNA, 21 bp, Homo sapiens
ccgccatccagggtctggcag

SEQ ID NO: 5595309 - DNA, 18 bp, Homo sapiens
ccgccatccgggacgctt

SEQ ID NO: 5595310 - DNA, 18 bp, Homo sapiens
ccgccatccttcaccaga

SEQ ID NO: 5595311 - DNA, 20 bp, Homo sapiens
ccgccatccttcaccagagc

SEQ ID NO: 5595312 - DNA, 15 bp, Homo sapiens
ccgccatctgcgcag

SEQ ID NO: 5595313 - DNA, 20 bp, Homo sapiens
ccgccatctgcgcagggtgg

SEQ ID NO: 5595314 - DNA, 21 bp, Homo sapiens
ccgccatggggtcggctcctg

SEQ ID NO: 5595315 - DNA, 20 bp, Homo sapiens
ccgccattctcaagccctgc

SEQ ID NO: 5595316 - DNA, 14 bp, Homo sapiens
ccgccattgccacc

SEQ ID NO: 5595317 - DNA, 15 bp, Homo sapiens
ccgccattgccacca

SEQ ID NO: 5595318 - DNA, 19 bp, Homo sapiens
ccgccattgccaccaggag

SEQ ID NO: 5595319 - DNA, 13 bp, Homo sapiens
ccgccattggcct

SEQ ID NO: 5595320 - DNA, 15 bp, Homo sapiens
ccgccattggcctta

SEQ ID NO: 5595321 - DNA, 13 bp, Homo sapiens
ccgcccaaggcct

SEQ ID NO: 5595322 - DNA, 16 bp, Homo sapiens
ccgcccaaggctgcag

SEQ ID NO: 5595323 - DNA, 14 bp, Homo sapiens
ccgcccacaccctc

SEQ ID NO: 5595324 - DNA, 15 bp, Homo sapiens
ccgcccacaccctcg

SEQ ID NO: 5595325 - DNA, 12 bp, Homo sapiens
ccgcccacccac

SEQ ID NO: 5595326 - DNA, 12 bp, Homo sapiens
ccgcccacccag

SEQ ID NO: 5595327 - DNA, 15 bp, Homo sapiens
ccgcccacccagcag

SEQ ID NO: 5595328 - DNA, 16 bp, Homo sapiens
ccgcccacccagcagc

SEQ ID NO: 5595329 - DNA, 13 bp, Homo sapiens
ccgcccaccccca

SEQ ID NO: 5595330 - DNA, 12 bp, Homo sapiens
ccgcccaccccg

SEQ ID NO: 5595331 - DNA, 18 bp, Homo sapiens
ccgcccaccccgctgcct

SEQ ID NO: 5595332 - DNA, 14 bp, Homo sapiens
ccgcccacctctgc

SEQ ID NO: 5595333 - DNA, 16 bp, Homo sapiens
ccgcccacctctgctg

SEQ ID NO: 5595334 - DNA, 11 bp, Homo sapiens
ccgcccacctg

SEQ ID NO: 5595335 - DNA, 13 bp, Homo sapiens
ccgcccacctgca

SEQ ID NO: 5595336 - DNA, 20 bp, Homo sapiens
ccgcccacctgggccctagg

SEQ ID NO: 5595337 - DNA, 13 bp, Homo sapiens
ccgcccactcctg

SEQ ID NO: 5595338 - DNA, 13 bp, Homo sapiens
ccgcccactgtcc

SEQ ID NO: 5595339 - DNA, 19 bp, Homo sapiens
ccgcccactgtcctgggcg

SEQ ID NO: 5595340 - DNA, 22 bp, Homo sapiens
ccgcccagagacccaagctgcc

SEQ ID NO: 5595341 - DNA, 14 bp, Homo sapiens
ccgcccagcctcac

SEQ ID NO: 5595342 - DNA, 19 bp, Homo sapiens
ccgcccagctctcccacat

SEQ ID NO: 5595343 - DNA, 14 bp, Homo sapiens
ccgcccaggctggc

SEQ ID NO: 5595344 - DNA, 17 bp, Homo sapiens
ccgcccaggctggccag

SEQ ID NO: 5595345 - DNA, 18 bp, Homo sapiens
ccgcccaggctggccagc

SEQ ID NO: 5595346 - DNA, 12 bp, Homo sapiens
ccgcccaggctt

SEQ ID NO: 5595347 - DNA, 22 bp, Homo sapiens
ccgcccagtgggacccacagtc

SEQ ID NO: 5595348 - DNA, 15 bp, Homo sapiens
ccgcccatcaccttg

SEQ ID NO: 5595349 - DNA, 12 bp, Homo sapiens
ccgcccatccct

SEQ ID NO: 5595350 - DNA, 19 bp, Homo sapiens
ccgccccaaagtaaaagaa

SEQ ID NO: 5595351 - DNA, 13 bp, Homo sapiens
ccgccccaaccct

SEQ ID NO: 5595352 - DNA, 10 bp, Homo sapiens
ccgccccaga

SEQ ID NO: 5595353 - DNA, 13 bp, Homo sapiens
ccgccccagacac

SEQ ID NO: 5595354 - DNA, 14 bp, Homo sapiens
ccgccccagagact

SEQ ID NO: 5595355 - DNA, 20 bp, Homo sapiens
ccgccccagagactgcccac

SEQ ID NO: 5595356 - DNA, 21 bp, Homo sapiens
ccgccccagagactgcccacc

SEQ ID NO: 5595357 - DNA, 14 bp, Homo sapiens
ccgccccagagctc

SEQ ID NO: 5595358 - DNA, 15 bp, Homo sapiens
ccgccccagagctcc

SEQ ID NO: 5595359 - DNA, 12 bp, Homo sapiens
ccgccccagagt

SEQ ID NO: 5595360 - DNA, 18 bp, Homo sapiens
ccgccccagagtggccca

SEQ ID NO: 5595361 - DNA, 12 bp, Homo sapiens
ccgccccagccc

SEQ ID NO: 5595362 - DNA, 19 bp, Homo sapiens
ccgccccagccctcagtca

SEQ ID NO: 5595363 - DNA, 12 bp, Homo sapiens
ccgccccaggca

SEQ ID NO: 5595364 - DNA, 14 bp, Homo sapiens
ccgccccaggcacc

SEQ ID NO: 5595365 - DNA, 20 bp, Homo sapiens
ccgccccaggcttccgcgcc

SEQ ID NO: 5595366 - DNA, 11 bp, Homo sapiens
ccgccccaggg

SEQ ID NO: 5595367 - DNA, 14 bp, Homo sapiens
ccgccccagggtct

SEQ ID NO: 5595368 - DNA, 12 bp, Homo sapiens
ccgcccccaccc

SEQ ID NO: 5595369 - DNA, 13 bp, Homo sapiens
ccgcccccacccc

SEQ ID NO: 5595370 - DNA, 20 bp, Homo sapiens
ccgcccccagccccctcctg

SEQ ID NO: 5595371 - DNA, 13 bp, Homo sapiens
ccgcccccagtcc

SEQ ID NO: 5595372 - DNA, 20 bp, Homo sapiens
ccgccccccacacttccctg

SEQ ID NO: 5595373 - DNA, 21 bp, Homo sapiens
ccgccccccacacttccctgg

SEQ ID NO: 5595374 - DNA, 16 bp, Homo sapiens
ccgccccccagagcca

SEQ ID NO: 5595375 - DNA, 21 bp, Homo sapiens
ccgccccccagagccagggct

SEQ ID NO: 5595376 - DNA, 17 bp, Homo sapiens
ccgcccccgccctcgct

SEQ ID NO: 5595377 - DNA, 17 bp, Homo sapiens
ccgcccccgcctgggca

SEQ ID NO: 5595378 - DNA, 12 bp, Homo sapiens
ccgccccctcct

SEQ ID NO: 5595379 - DNA, 18 bp, Homo sapiens
ccgccccctcggcccctc

SEQ ID NO: 5595380 - DNA, 14 bp, Homo sapiens
ccgccccgcgcgcc

SEQ ID NO: 5595381 - DNA, 16 bp, Homo sapiens
ccgccccgggctggcc

SEQ ID NO: 5595382 - DNA, 20 bp, Homo sapiens
ccgccccgtgctcctctgcc

SEQ ID NO: 5595383 - DNA, 15 bp, Homo sapiens
ccgcccctgagccca

SEQ ID NO: 5595384 - DNA, 16 bp, Homo sapiens
ccgcccctgagcccac

SEQ ID NO: 5595385 - DNA, 16 bp, Homo sapiens
ccgcccctgcagcacg

SEQ ID NO: 5595386 - DNA, 23 bp, Homo sapiens
ccgcccctggccgcgctccgggc

SEQ ID NO: 5595387 - DNA, 17 bp, Homo sapiens
ccgcccctgtggccctg

SEQ ID NO: 5595388 - DNA, 18 bp, Homo sapiens
ccgccccttcccttccct

SEQ ID NO: 5595389 - DNA, 13 bp, Homo sapiens
ccgcccgcacgtc

SEQ ID NO: 5595390 - DNA, 14 bp, Homo sapiens
ccgcccgcccaccc

SEQ ID NO: 5595391 - DNA, 12 bp, Homo sapiens
ccgcccgccccc

SEQ ID NO: 5595392 - DNA, 14 bp, Homo sapiens
ccgcccgcccccgc

SEQ ID NO: 5595393 - DNA, 11 bp, Homo sapiens
ccgcccgccct

SEQ ID NO: 5595394 - DNA, 15 bp, Homo sapiens
ccgcccgccctcctc

SEQ ID NO: 5595395 - DNA, 23 bp, Homo sapiens
ccgcccgcttccctccttcatga

SEQ ID NO: 5595396 - DNA, 13 bp, Homo sapiens
ccgcccggcctcc

SEQ ID NO: 5595397 - DNA, 16 bp, Homo sapiens
ccgcccgggcccagag

SEQ ID NO: 5595398 - DNA, 16 bp, Homo sapiens
ccgccctcacctgcag

SEQ ID NO: 5595399 - DNA, 18 bp, Homo sapiens
ccgccctcacctgcagag

SEQ ID NO: 5595400 - DNA, 19 bp, Homo sapiens
ccgccctcacctgcagaga

SEQ ID NO: 5595401 - DNA, 13 bp, Homo sapiens
ccgccctccatcc

SEQ ID NO: 5595402 - DNA, 11 bp, Homo sapiens
ccgccctcctc

SEQ ID NO: 5595403 - DNA, 18 bp, Homo sapiens
ccgccctcctcgctgtgc

SEQ ID NO: 5595404 - DNA, 20 bp, Homo sapiens
ccgccctcctcgggccgagg

SEQ ID NO: 5595405 - DNA, 14 bp, Homo sapiens
ccgccctcctctgc

SEQ ID NO: 5595406 - DNA, 12 bp, Homo sapiens
ccgccctctgcc

SEQ ID NO: 5595407 - DNA, 19 bp, Homo sapiens
ccgccctgagcatcctggt

SEQ ID NO: 5595408 - DNA, 13 bp, Homo sapiens
ccgccctgccact

SEQ ID NO: 5595409 - DNA, 14 bp, Homo sapiens
ccgccctgcccctg

SEQ ID NO: 5595410 - DNA, 15 bp, Homo sapiens
ccgccctgctcctcc

SEQ ID NO: 5595411 - DNA, 19 bp, Homo sapiens
ccgccctgctcctccctgg

SEQ ID NO: 5595412 - DNA, 11 bp, Homo sapiens
ccgccctgctg

SEQ ID NO: 5595413 - DNA, 18 bp, Homo sapiens
ccgccctggacagatggc

SEQ ID NO: 5595414 - DNA, 16 bp, Homo sapiens
ccgccctgggctggac

SEQ ID NO: 5595415 - DNA, 20 bp, Homo sapiens
ccgccctgggctgtctgtca

SEQ ID NO: 5595416 - DNA, 24 bp, Homo sapiens
ccgccctgggctgtctgtcaccag

SEQ ID NO: 5595417 - DNA, 12 bp, Homo sapiens
ccgccctgtggg

SEQ ID NO: 5595418 - DNA, 17 bp, Homo sapiens
ccgccctttccttgcct

SEQ ID NO: 5595419 - DNA, 17 bp, Homo sapiens
ccgccgaagggcagccc

SEQ ID NO: 5595420 - DNA, 20 bp, Homo sapiens
ccgccgaagggcagccccgc

SEQ ID NO: 5595421 - DNA, 17 bp, Homo sapiens
ccgccgatcccaggtgc

SEQ ID NO: 5595422 - DNA, 18 bp, Homo sapiens
ccgccgcagaagcagccc

SEQ ID NO: 5595423 - DNA, 20 bp, Homo sapiens
ccgccgcagaccagctggcg

SEQ ID NO: 5595424 - DNA, 17 bp, Homo sapiens
ccgccgccaccagcccg

SEQ ID NO: 5595425 - DNA, 13 bp, Homo sapiens
ccgccgcccgacc

SEQ ID NO: 5595426 - DNA, 14 bp, Homo sapiens
ccgccgccgccgcc

SEQ ID NO: 5595427 - DNA, 14 bp, Homo sapiens
ccgccgcctcccac

SEQ ID NO: 5595428 - DNA, 14 bp, Homo sapiens
ccgccgcctccctc

SEQ ID NO: 5595429 - DNA, 21 bp, Homo sapiens
ccgctttcatgaacacagcct

SEQ ID NO: 5595430 - DNA, 15 bp, Homo sapiens
ccgctttcctggagc

SEQ ID NO: 5595431 - DNA, 17 bp, Homo sapiens
ccgctttgtctgtccag

SEQ ID NO: 5595432 - DNA, 18 bp, Homo sapiens
ccgctttgtctgtccagc

SEQ ID NO: 5595433 - DNA, 20 bp, Homo sapiens
ccgctttgtgattccatgga

SEQ ID NO: 5595434 - DNA, 23 bp, Homo sapiens
ccgcttttgcagcagaggagctg

SEQ ID NO: 5595435 - DNA, 19 bp, Homo sapiens
ccgcttttgttctcgcaaa

SEQ ID NO: 5595436 - DNA, 15 bp, Homo sapiens
ccggaaaacaagcct

SEQ ID NO: 5595437 - DNA, 11 bp, Homo sapiens
ccggaaagaag

SEQ ID NO: 5595438 - DNA, 15 bp, Homo sapiens
ccggaaagagagctg

SEQ ID NO: 5595439 - DNA, 20 bp, Homo sapiens
ccggaaataccatgcacaga

SEQ ID NO: 5595440 - DNA, 16 bp, Homo sapiens
ccggaacagccaaaga

SEQ ID NO: 5595441 - DNA, 20 bp, Homo sapiens
ccggaacagccaaagaaact

SEQ ID NO: 5595442 - DNA, 17 bp, Homo sapiens
ccggaaccacagggcca

SEQ ID NO: 5595443 - DNA, 23 bp, Homo sapiens
ccggaagaaccagaagtgcagcc

SEQ ID NO: 5595444 - DNA, 11 bp, Homo sapiens
ccggaagccaa

SEQ ID NO: 5595445 - DNA, 15 bp, Homo sapiens
ccggaagctcctggt

SEQ ID NO: 5595446 - DNA, 22 bp, Homo sapiens
ccggaaggaatgtcagggccag

SEQ ID NO: 5595447 - DNA, 18 bp, Homo sapiens
ccggaaggacacagtcag

SEQ ID NO: 5595448 - DNA, 21 bp, Homo sapiens
ccggaaggaggccaaccagcc

SEQ ID NO: 5595449 - DNA, 23 bp, Homo sapiens
ccggaaggaggccaaccagcccg

SEQ ID NO: 5595450 - DNA, 12 bp, Homo sapiens
ccggaaggaggg

SEQ ID NO: 5595451 - DNA, 12 bp, Homo sapiens
ccggaagggctt

SEQ ID NO: 5595452 - DNA, 21 bp, Homo sapiens
ccggaagtaaatacagcaatt

SEQ ID NO: 5595453 - DNA, 16 bp, Homo sapiens
ccggaatagagcctcg

SEQ ID NO: 5595454 - DNA, 22 bp, Homo sapiens
ccggaatcctgtcctcagcttc

SEQ ID NO: 5595455 - DNA, 16 bp, Homo sapiens
ccggaatgaccagcat

SEQ ID NO: 5595456 - DNA, 17 bp, Homo sapiens
ccggaattgtatttatt

SEQ ID NO: 5595457 - DNA, 16 bp, Homo sapiens
ccggacaagagcctgc

SEQ ID NO: 5595458 - DNA, 21 bp, Homo sapiens
ccggacacggcttcactgacc

SEQ ID NO: 5595459 - DNA, 19 bp, Homo sapiens
ccggacagctgcccagaca

SEQ ID NO: 5595460 - DNA, 20 bp, Homo sapiens
ccggacaggtggggcctcag

SEQ ID NO: 5595461 - DNA, 22 bp, Homo sapiens
ccggaccaagatgggcacatga

SEQ ID NO: 5595462 - DNA, 16 bp, Homo sapiens
ccggaccagcctggcc

SEQ ID NO: 5595463 - DNA, 14 bp, Homo sapiens
ccggacccacctca

SEQ ID NO: 5595464 - DNA, 20 bp, Homo sapiens
ccggacccttttccttagct

SEQ ID NO: 5595465 - DNA, 13 bp, Homo sapiens
ccggacctacctc

SEQ ID NO: 5595466 - DNA, 16 bp, Homo sapiens
ccggacctgagcccgc

SEQ ID NO: 5595467 - DNA, 16 bp, Homo sapiens
ccggacctggactagg

SEQ ID NO: 5595468 - DNA, 19 bp, Homo sapiens
ccggacctggactagggcc

SEQ ID NO: 5595469 - DNA, 19 bp, Homo sapiens
ccggacgcatgcagggccc

SEQ ID NO: 5595470 - DNA, 13 bp, Homo sapiens
ccggacgccgcga

SEQ ID NO: 5595471 - DNA, 12 bp, Homo sapiens
ccggacgctgga

SEQ ID NO: 5595472 - DNA, 22 bp, Homo sapiens
ccggacgctggagaccctgcgc

SEQ ID NO: 5595473 - DNA, 23 bp, Homo sapiens
ccggacgctggagaccctgcgcc

SEQ ID NO: 5595474 - DNA, 20 bp, Homo sapiens
ccggactcaagccccggact

SEQ ID NO: 5595475 - DNA, 22 bp, Homo sapiens
ccggactcaccaacttgccaca

SEQ ID NO: 5595476 - DNA, 13 bp, Homo sapiens
ccggactgaccaa

SEQ ID NO: 5595477 - DNA, 14 bp, Homo sapiens
ccggactggcagaa

SEQ ID NO: 5595478 - DNA, 23 bp, Homo sapiens
ccggacttagaaaaccagctcag

SEQ ID NO: 5595479 - DNA, 22 bp, Homo sapiens
ccggagaacatctgccttgctg

SEQ ID NO: 5595480 - DNA, 17 bp, Homo sapiens
ccggagacccacagccc

SEQ ID NO: 5595481 - DNA, 18 bp, Homo sapiens
ccggagaggagttcagga

SEQ ID NO: 5595482 - DNA, 17 bp, Homo sapiens
ccggagagggagtcagt

SEQ ID NO: 5595483 - DNA, 14 bp, Homo sapiens
ccggagagtggggg

SEQ ID NO: 5595484 - DNA, 18 bp, Homo sapiens
ccggagatgtagcaaaac

SEQ ID NO: 5595485 - DNA, 19 bp, Homo sapiens
ccggagcaaactctgctgt

SEQ ID NO: 5595486 - DNA, 17 bp, Homo sapiens
ccggagcacagccctgg

SEQ ID NO: 5595487 - DNA, 12 bp, Homo sapiens
ccggagcaccac

SEQ ID NO: 5595488 - DNA, 20 bp, Homo sapiens
ccggagcagcagcttctcca

SEQ ID NO: 5595489 - DNA, 16 bp, Homo sapiens
ccggagcagcaggaag

SEQ ID NO: 5595490 - DNA, 20 bp, Homo sapiens
ccggagcaggggtctgagcc

SEQ ID NO: 5595491 - DNA, 18 bp, Homo sapiens
ccggagcagttggcctgt

SEQ ID NO: 5595492 - DNA, 19 bp, Homo sapiens
ccggagcagttggcctgtg

SEQ ID NO: 5595493 - DNA, 11 bp, Homo sapiens
ccggagcccca

SEQ ID NO: 5595494 - DNA, 19 bp, Homo sapiens
ccggagccggcactgcatg

SEQ ID NO: 5595495 - DNA, 16 bp, Homo sapiens
ccggagcctccagctg

SEQ ID NO: 5595496 - DNA, 14 bp, Homo sapiens
ccggagcctgtgca

SEQ ID NO: 5595497 - DNA, 18 bp, Homo sapiens
ccggagcctgtgcagcct

SEQ ID NO: 5595498 - DNA, 13 bp, Homo sapiens
ccggagcgcacct

SEQ ID NO: 5595499 - DNA, 19 bp, Homo sapiens
ccggagcgccctgcagggc

SEQ ID NO: 5595500 - DNA, 14 bp, Homo sapiens
ccggagcggctgag

SEQ ID NO: 5595501 - DNA, 17 bp, Homo sapiens
ccggagcggctgaggac

SEQ ID NO: 5595502 - DNA, 16 bp, Homo sapiens
ccggagctaacactgg

SEQ ID NO: 5595503 - DNA, 17 bp, Homo sapiens
ccggagctaacactggc

SEQ ID NO: 5595504 - DNA, 19 bp, Homo sapiens
ccggagctaacactggccc

SEQ ID NO: 5595505 - DNA, 12 bp, Homo sapiens
ccggagctccag

SEQ ID NO: 5595506 - DNA, 11 bp, Homo sapiens
ccggagctggg

SEQ ID NO: 5595507 - DNA, 14 bp, Homo sapiens
ccggagctgggaag

SEQ ID NO: 5595508 - DNA, 15 bp, Homo sapiens
ccggagctgggaagg

SEQ ID NO: 5595509 - DNA, 21 bp, Homo sapiens
ccggaggactgagcccccacc

SEQ ID NO: 5595510 - DNA, 14 bp, Homo sapiens
ccggaggagcagcc

SEQ ID NO: 5595511 - DNA, 18 bp, Homo sapiens
ccggaggagcagcctcga

SEQ ID NO: 5595512 - DNA, 14 bp, Homo sapiens
ccggaggaggagat

SEQ ID NO: 5595513 - DNA, 17 bp, Homo sapiens
ccggaggcagcagacac

SEQ ID NO: 5595514 - DNA, 12 bp, Homo sapiens
ccggaggccagc

SEQ ID NO: 5595515 - DNA, 15 bp, Homo sapiens
ccggaggccagctat

SEQ ID NO: 5595516 - DNA, 21 bp, Homo sapiens
ccggaggccagctatctgcct

SEQ ID NO: 5595517 - DNA, 21 bp, Homo sapiens
ccggaggccttggggtggggg

SEQ ID NO: 5595518 - DNA, 18 bp, Homo sapiens
ccggaggcgcccacctgc

SEQ ID NO: 5595519 - DNA, 20 bp, Homo sapiens
ccggaggcgcccacctgccc

SEQ ID NO: 5595520 - DNA, 22 bp, Homo sapiens
ccggaggcgtggaggagaggag

SEQ ID NO: 5595521 - DNA, 18 bp, Homo sapiens
ccggagggcaccagggac

SEQ ID NO: 5595522 - DNA, 13 bp, Homo sapiens
ccggagggctgcg

SEQ ID NO: 5595523 - DNA, 14 bp, Homo sapiens
ccggaggggcctgg

SEQ ID NO: 5595524 - DNA, 19 bp, Homo sapiens
ccggaggggttgcggggga

SEQ ID NO: 5595525 - DNA, 16 bp, Homo sapiens
ccggaggtcactccac

SEQ ID NO: 5595526 - DNA, 16 bp, Homo sapiens
ccggagtatgtgcagt

SEQ ID NO: 5595527 - DNA, 17 bp, Homo sapiens
ccggagtatgtgcagtg

SEQ ID NO: 5595528 - DNA, 22 bp, Homo sapiens
ccggagtgtctggaattgtggc

SEQ ID NO: 5595529 - DNA, 13 bp, Homo sapiens
ccggatctccagg

SEQ ID NO: 5595530 - DNA, 16 bp, Homo sapiens
ccggatctccaggccc

SEQ ID NO: 5595531 - DNA, 18 bp, Homo sapiens
ccggatctccaggcccag

SEQ ID NO: 5595532 - DNA, 21 bp, Homo sapiens
ccggatctccaggcccagcct

SEQ ID NO: 5595533 - DNA, 17 bp, Homo sapiens
ccggatgaaacttctca

SEQ ID NO: 5595534 - DNA, 19 bp, Homo sapiens
ccggatgaaacttctcagt

SEQ ID NO: 5595535 - DNA, 20 bp, Homo sapiens
ccggatgaactcaatgcatg

SEQ ID NO: 5595536 - DNA, 12 bp, Homo sapiens
ccggatgccagc

SEQ ID NO: 5595537 - DNA, 18 bp, Homo sapiens
ccggattccggccctggc

SEQ ID NO: 5595538 - DNA, 18 bp, Homo sapiens
ccggattggccctgcccc

SEQ ID NO: 5595539 - DNA, 20 bp, Homo sapiens
ccggattggccctgcccctc

SEQ ID NO: 5595540 - DNA, 21 bp, Homo sapiens
ccggattggccctgcccctcc

SEQ ID NO: 5595541 - DNA, 13 bp, Homo sapiens
ccggatttctaac

SEQ ID NO: 5595542 - DNA, 22 bp, Homo sapiens
ccggatttctaacagtccttgc

SEQ ID NO: 5595543 - DNA, 21 bp, Homo sapiens
ccggcaaccccagttctgctc

SEQ ID NO: 5595544 - DNA, 22 bp, Homo sapiens
ccggcaaccccagttctgctcc

SEQ ID NO: 5595545 - DNA, 15 bp, Homo sapiens
ccggcaagccacagg

SEQ ID NO: 5595546 - DNA, 21 bp, Homo sapiens
ccggcaagcgcttctgctgaa

SEQ ID NO: 5595547 - DNA, 21 bp, Homo sapiens
ccggcaaggggcgcgcgcccc

SEQ ID NO: 5595548 - DNA, 16 bp, Homo sapiens
ccggcaataaaagccc

SEQ ID NO: 5595549 - DNA, 18 bp, Homo sapiens
ccggcaataaaagcccag

SEQ ID NO: 5595550 - DNA, 20 bp, Homo sapiens
ccggcaataaaagcccagga

SEQ ID NO: 5595551 - DNA, 14 bp, Homo sapiens
ccggcacactgcca

SEQ ID NO: 5595552 - DNA, 20 bp, Homo sapiens
ccggcacagggtctgctctt

SEQ ID NO: 5595553 - DNA, 20 bp, Homo sapiens
ccggcacctacatccccagg

SEQ ID NO: 5595554 - DNA, 21 bp, Homo sapiens
ccggcactcatgacggcctgc

SEQ ID NO: 5595555 - DNA, 13 bp, Homo sapiens
ccggcactgcatg

SEQ ID NO: 5595556 - DNA, 23 bp, Homo sapiens
ccggcactgggtttgctccctga

SEQ ID NO: 5595557 - DNA, 13 bp, Homo sapiens
ccggcactgtgca

SEQ ID NO: 5595558 - DNA, 14 bp, Homo sapiens
ccggcactgtgcac

SEQ ID NO: 5595559 - DNA, 16 bp, Homo sapiens
ccggcactgtgcactc

SEQ ID NO: 5595560 - DNA, 22 bp, Homo sapiens
ccggcagagctctacaggcctg

SEQ ID NO: 5595561 - DNA, 12 bp, Homo sapiens
ccggcagaggca

SEQ ID NO: 5595562 - DNA, 18 bp, Homo sapiens
ccggcagaggcagggccc

SEQ ID NO: 5595563 - DNA, 19 bp, Homo sapiens
ccggcagaggcagggccct

SEQ ID NO: 5595564 - DNA, 16 bp, Homo sapiens
ccggcagccccagcct

SEQ ID NO: 5595565 - DNA, 18 bp, Homo sapiens
ccggcagccccagcctgc

SEQ ID NO: 5595566 - DNA, 17 bp, Homo sapiens
ccggcagccccccagtg

SEQ ID NO: 5595567 - DNA, 13 bp, Homo sapiens
ccggcagcctggt

SEQ ID NO: 5595568 - DNA, 16 bp, Homo sapiens
ccggcaggccctgcag

SEQ ID NO: 5595569 - DNA, 20 bp, Homo sapiens
ccggcaggccctgcagtgtt

SEQ ID NO: 5595570 - DNA, 21 bp, Homo sapiens
ccggcaggccctgcagtgttc

SEQ ID NO: 5595571 - DNA, 14 bp, Homo sapiens
ccggcagggccccc

SEQ ID NO: 5595572 - DNA, 23 bp, Homo sapiens
ccggcagggcgggcagagggctg

SEQ ID NO: 5595573 - DNA, 17 bp, Homo sapiens
ccggcaggggcccctcc

SEQ ID NO: 5595574 - DNA, 20 bp, Homo sapiens
ccggcaggggcccctcctct

SEQ ID NO: 5595575 - DNA, 18 bp, Homo sapiens
ccggcagggtcctagaaa

SEQ ID NO: 5595576 - DNA, 21 bp, Homo sapiens
ccggcatcctgaaagccagca

SEQ ID NO: 5595577 - DNA, 18 bp, Homo sapiens
ccggcatccttgcctgtc

SEQ ID NO: 5595578 - DNA, 21 bp, Homo sapiens
ccggcatgagactcagtgcag

SEQ ID NO: 5595579 - DNA, 16 bp, Homo sapiens
ccggcatgaggccccg

SEQ ID NO: 5595580 - DNA, 19 bp, Homo sapiens
ccggcatgccgagtgcccc

SEQ ID NO: 5595581 - DNA, 14 bp, Homo sapiens
ccggcatgctggcc

SEQ ID NO: 5595582 - DNA, 23 bp, Homo sapiens
ccggcatgctggcctgtggcagg

SEQ ID NO: 5595583 - DNA, 14 bp, Homo sapiens
ccggcatggctggg

SEQ ID NO: 5595584 - DNA, 18 bp, Homo sapiens
ccggcatgtttccagcag

SEQ ID NO: 5595585 - DNA, 13 bp, Homo sapiens
ccggcattctctg

SEQ ID NO: 5595586 - DNA, 16 bp, Homo sapiens
ccggcattctctgccc

SEQ ID NO: 5595587 - DNA, 15 bp, Homo sapiens
ccggccaaggacact

SEQ ID NO: 5595588 - DNA, 15 bp, Homo sapiens
ccggccaaggaccca

SEQ ID NO: 5595589 - DNA, 17 bp, Homo sapiens
ccggccaaggacccagg

SEQ ID NO: 5595590 - DNA, 18 bp, Homo sapiens
ccggccaaggacccaggc

SEQ ID NO: 5595591 - DNA, 22 bp, Homo sapiens
ccggccaaggacccaggcgctg

SEQ ID NO: 5595592 - DNA, 17 bp, Homo sapiens
ccggccaatggaaacct

SEQ ID NO: 5595593 - DNA, 15 bp, Homo sapiens
ccggccacacccctc

SEQ ID NO: 5595594 - DNA, 18 bp, Homo sapiens
ccggccacacccctctgc

SEQ ID NO: 5595595 - DNA, 13 bp, Homo sapiens
ccggccacagctg

SEQ ID NO: 5595596 - DNA, 12 bp, Homo sapiens
ccggccacatgc

SEQ ID NO: 5595597 - DNA, 18 bp, Homo sapiens
ccggccaccagatgctga

SEQ ID NO: 5595598 - DNA, 12 bp, Homo sapiens
ccggccacctct

SEQ ID NO: 5595599 - DNA, 22 bp, Homo sapiens
ccggccacgtctgtgctctgtc

SEQ ID NO: 5595600 - DNA, 18 bp, Homo sapiens
ccggccactccctgccaa

SEQ ID NO: 5595601 - DNA, 18 bp, Homo sapiens
ccggccactctgtttgct

SEQ ID NO: 5595602 - DNA, 12 bp, Homo sapiens
ccggccactgca

SEQ ID NO: 5595603 - DNA, 14 bp, Homo sapiens
ccggccagccagcc

SEQ ID NO: 5595604 - DNA, 18 bp, Homo sapiens
ccggccagccagccactc

SEQ ID NO: 5595605 - DNA, 11 bp, Homo sapiens
ccggccagccc

SEQ ID NO: 5595606 - DNA, 17 bp, Homo sapiens
ccggccagcgggcacag

SEQ ID NO: 5595607 - DNA, 18 bp, Homo sapiens
ccgggtctcgcagcctga

SEQ ID NO: 5595608 - DNA, 23 bp, Homo sapiens
ccgggtctcgcagcctgaagcct

SEQ ID NO: 5595609 - DNA, 21 bp, Homo sapiens
ccgggtcttcctactcttctc

SEQ ID NO: 5595610 - DNA, 22 bp, Homo sapiens
ccgggtgccccccatgccctcc

SEQ ID NO: 5595611 - DNA, 20 bp, Homo sapiens
ccgggtgcctcagagcaggc

SEQ ID NO: 5595612 - DNA, 20 bp, Homo sapiens
ccgggtggaaaagaatccct

SEQ ID NO: 5595613 - DNA, 18 bp, Homo sapiens
ccgggtggcagcgcccag

SEQ ID NO: 5595614 - DNA, 15 bp, Homo sapiens
ccgggtgggcctggc

SEQ ID NO: 5595615 - DNA, 19 bp, Homo sapiens
ccgggtgggcctggcctga

SEQ ID NO: 5595616 - DNA, 19 bp, Homo sapiens
ccgggtggggggagggcac

SEQ ID NO: 5595617 - DNA, 18 bp, Homo sapiens
ccgggtgtgcctgccctg

SEQ ID NO: 5595618 - DNA, 19 bp, Homo sapiens
ccgggtgtgcctgccctgg

SEQ ID NO: 5595619 - DNA, 15 bp, Homo sapiens
ccgggtgtggcctca

SEQ ID NO: 5595620 - DNA, 16 bp, Homo sapiens
ccgggtgtggcctcag

SEQ ID NO: 5595621 - DNA, 20 bp, Homo sapiens
ccgggtgtggcctcagccct

SEQ ID NO: 5595622 - DNA, 21 bp, Homo sapiens
ccgggtgtggcctcagccctc

SEQ ID NO: 5595623 - DNA, 15 bp, Homo sapiens
ccgggttagcctggt

SEQ ID NO: 5595624 - DNA, 21 bp, Homo sapiens
ccgggttcacgccattctcct

SEQ ID NO: 5595625 - DNA, 22 bp, Homo sapiens
ccgggttcacgccattctcctg

SEQ ID NO: 5595626 - DNA, 19 bp, Homo sapiens
ccgggttcagcctggcctg

SEQ ID NO: 5595627 - DNA, 16 bp, Homo sapiens
ccgggttctcctgatt

SEQ ID NO: 5595628 - DNA, 14 bp, Homo sapiens
ccgggttggaggcc

SEQ ID NO: 5595629 - DNA, 17 bp, Homo sapiens
ccgggttggaggcctca

SEQ ID NO: 5595630 - DNA, 19 bp, Homo sapiens
ccgggttggaggcctcacc

SEQ ID NO: 5595631 - DNA, 22 bp, Homo sapiens
ccgggttggaggcctcaccctg

SEQ ID NO: 5595632 - DNA, 21 bp, Homo sapiens
ccgggtttagtatatgtcttg

SEQ ID NO: 5595633 - DNA, 22 bp, Homo sapiens
ccgggtttggcgggccaaggac

SEQ ID NO: 5595634 - DNA, 17 bp, Homo sapiens
ccgggtttggctgagcc

SEQ ID NO: 5595635 - DNA, 16 bp, Homo sapiens
ccggtaactgtcctgt

SEQ ID NO: 5595636 - DNA, 18 bp, Homo sapiens
ccggtaactgtcctgtcc

SEQ ID NO: 5595637 - DNA, 13 bp, Homo sapiens
ccggtaggctgct

SEQ ID NO: 5595638 - DNA, 15 bp, Homo sapiens
ccggtaggctgctgg

SEQ ID NO: 5595639 - DNA, 16 bp, Homo sapiens
ccggtagggaggcagc

SEQ ID NO: 5595640 - DNA, 15 bp, Homo sapiens
ccggtcaggcacaca

SEQ ID NO: 5595641 - DNA, 23 bp, Homo sapiens
ccggtcaggcacacaaggggccc

SEQ ID NO: 5595642 - DNA, 15 bp, Homo sapiens
ccggtcagtgccttt

SEQ ID NO: 5595643 - DNA, 12 bp, Homo sapiens
ccggtccacagg

SEQ ID NO: 5595644 - DNA, 19 bp, Homo sapiens
ccggtccacaggtccaagg

SEQ ID NO: 5595645 - DNA, 14 bp, Homo sapiens
ccggtccagctggc

SEQ ID NO: 5595646 - DNA, 21 bp, Homo sapiens
ccggtccagctggcctggaca

SEQ ID NO: 5595647 - DNA, 20 bp, Homo sapiens
ccggtcccacccctccctct

SEQ ID NO: 5595648 - DNA, 15 bp, Homo sapiens
ccggtcccagcctgg

SEQ ID NO: 5595649 - DNA, 18 bp, Homo sapiens
ccggtcccagcctgggct

SEQ ID NO: 5595650 - DNA, 11 bp, Homo sapiens
ccggtcccagg

SEQ ID NO: 5595651 - DNA, 14 bp, Homo sapiens
ccggtccccacaga

SEQ ID NO: 5595652 - DNA, 20 bp, Homo sapiens
ccggtccccacagactgccc

SEQ ID NO: 5595653 - DNA, 21 bp, Homo sapiens
ccggtcccctctgccccaccc

SEQ ID NO: 5595654 - DNA, 23 bp, Homo sapiens
ccggtcccggctgacacctccct

SEQ ID NO: 5595655 - DNA, 20 bp, Homo sapiens
ccggtcccttgagacctcag

SEQ ID NO: 5595656 - DNA, 22 bp, Homo sapiens
ccggtcccttgagacctcagcc

SEQ ID NO: 5595657 - DNA, 17 bp, Homo sapiens
ccggtcgggcagccagc

SEQ ID NO: 5595658 - DNA, 21 bp, Homo sapiens
ccggtcgggggggaccctcca

SEQ ID NO: 5595659 - DNA, 16 bp, Homo sapiens
ccggtctgcaagtcag

SEQ ID NO: 5595660 - DNA, 20 bp, Homo sapiens
ccggtctgcaagtcagagga

SEQ ID NO: 5595661 - DNA, 22 bp, Homo sapiens
ccggtgaggggaggggcctccc

SEQ ID NO: 5595662 - DNA, 23 bp, Homo sapiens
ccggtgaggggaggggcctcccc

SEQ ID NO: 5595663 - DNA, 22 bp, Homo sapiens
ccggtgcacaggcctctgcctg

SEQ ID NO: 5595664 - DNA, 11 bp, Homo sapiens
ccggtgcagct

SEQ ID NO: 5595665 - DNA, 14 bp, Homo sapiens
ccggtgcagggcct

SEQ ID NO: 5595666 - DNA, 20 bp, Homo sapiens
ccggtgcagggcctggcata

SEQ ID NO: 5595667 - DNA, 19 bp, Homo sapiens
ccggtgcatctggcacgtg

SEQ ID NO: 5595668 - DNA, 20 bp, Homo sapiens
ccggtgcatctggcacgtgg

SEQ ID NO: 5595669 - DNA, 18 bp, Homo sapiens
ccggtgccagctgccctt

SEQ ID NO: 5595670 - DNA, 20 bp, Homo sapiens
ccggtgccagctgcccttgc

SEQ ID NO: 5595671 - DNA, 18 bp, Homo sapiens
ccggtgccatcttccata

SEQ ID NO: 5595672 - DNA, 15 bp, Homo sapiens
ccggtgcctgggtgg

SEQ ID NO: 5595673 - DNA, 13 bp, Homo sapiens
ccggtgccttcca

SEQ ID NO: 5595674 - DNA, 14 bp, Homo sapiens
ccggtgccttccac

SEQ ID NO: 5595675 - DNA, 23 bp, Homo sapiens
ccggtgccttccaccctgccctg

SEQ ID NO: 5595676 - DNA, 14 bp, Homo sapiens
ccggtgctgcagga

SEQ ID NO: 5595677 - DNA, 20 bp, Homo sapiens
ccggtgctgggggcacagct

SEQ ID NO: 5595678 - DNA, 15 bp, Homo sapiens
ccggtgctgggttcc

SEQ ID NO: 5595679 - DNA, 21 bp, Homo sapiens
ccggtgctgggttcccactcc

SEQ ID NO: 5595680 - DNA, 22 bp, Homo sapiens
ccggtgctgggttcccactccc

SEQ ID NO: 5595681 - DNA, 13 bp, Homo sapiens
ccggtggcagtgg

SEQ ID NO: 5595682 - DNA, 18 bp, Homo sapiens
ccggtggcctattccagg

SEQ ID NO: 5595683 - DNA, 13 bp, Homo sapiens
ccggtggctctgg

SEQ ID NO: 5595684 - DNA, 14 bp, Homo sapiens
ccggtggctgggca

SEQ ID NO: 5595685 - DNA, 16 bp, Homo sapiens
ccggtggctgggcaga

SEQ ID NO: 5595686 - DNA, 16 bp, Homo sapiens
ccggtggcttctggca

SEQ ID NO: 5595687 - DNA, 18 bp, Homo sapiens
ccggtgggaccctgtccg

SEQ ID NO: 5595688 - DNA, 17 bp, Homo sapiens
ccggtgggggggcagag

SEQ ID NO: 5595689 - DNA, 22 bp, Homo sapiens
ccggtgggtccgcatccctgct

SEQ ID NO: 5595690 - DNA, 17 bp, Homo sapiens
ccggtggtttgccatgt

SEQ ID NO: 5595691 - DNA, 18 bp, Homo sapiens
ccggtgtatcctggccct

SEQ ID NO: 5595692 - DNA, 20 bp, Homo sapiens
ccggtgtatcctggccctgg

SEQ ID NO: 5595693 - DNA, 14 bp, Homo sapiens
ccggtgtccctgga

SEQ ID NO: 5595694 - DNA, 13 bp, Homo sapiens
ccggtgtgaggag

SEQ ID NO: 5595695 - DNA, 16 bp, Homo sapiens
ccggtgtgcctgcagc

SEQ ID NO: 5595696 - DNA, 17 bp, Homo sapiens
ccggtgtgtcagatttt

SEQ ID NO: 5595697 - DNA, 13 bp, Homo sapiens
ccggtgttctaag

SEQ ID NO: 5595698 - DNA, 16 bp, Homo sapiens
ccggttcattttgcac

SEQ ID NO: 5595699 - DNA, 13 bp, Homo sapiens
ccggttccacgtg

SEQ ID NO: 5595700 - DNA, 13 bp, Homo sapiens
ccggttcccacaa

SEQ ID NO: 5595701 - DNA, 20 bp, Homo sapiens
ccggttccctccccagctcc

SEQ ID NO: 5595702 - DNA, 21 bp, Homo sapiens
ccggttccctccccagctcct

SEQ ID NO: 5595703 - DNA, 20 bp, Homo sapiens
ccggttcttccagtggtttg

SEQ ID NO: 5595704 - DNA, 16 bp, Homo sapiens
ccggttgcttctggga

SEQ ID NO: 5595705 - DNA, 18 bp, Homo sapiens
ccggttggccggctggcc

SEQ ID NO: 5595706 - DNA, 20 bp, Homo sapiens
ccggtttcgaagttgatgca

SEQ ID NO: 5595707 - DNA, 21 bp, Homo sapiens
ccggtttcgaagttgatgcaa

SEQ ID NO: 5595708 - DNA, 16 bp, Homo sapiens
ccgtaaaaactgaagt

SEQ ID NO: 5595709 - DNA, 15 bp, Homo sapiens
ccgtaacccaactct

SEQ ID NO: 5595710 - DNA, 16 bp, Homo sapiens
ccgtaacccaccccca

SEQ ID NO: 5595711 - DNA, 20 bp, Homo sapiens
ccgtaataacacccttcctt

SEQ ID NO: 5595712 - DNA, 15 bp, Homo sapiens
ccgtaatcccagcta

SEQ ID NO: 5595713 - DNA, 22 bp, Homo sapiens
ccgtaatggggactctccaggc

SEQ ID NO: 5595714 - DNA, 15 bp, Homo sapiens
ccgtaattctttctg

SEQ ID NO: 5595715 - DNA, 16 bp, Homo sapiens
ccgtaattctttctgt

SEQ ID NO: 5595716 - DNA, 13 bp, Homo sapiens
ccgtaatttaact

SEQ ID NO: 5595717 - DNA, 13 bp, Homo sapiens
ccgtaccccaccc

SEQ ID NO: 5595718 - DNA, 19 bp, Homo sapiens
ccgtacccccgtggtcttt

SEQ ID NO: 5595719 - DNA, 21 bp, Homo sapiens
ccgtacccccgtggtctttga

SEQ ID NO: 5595720 - DNA, 23 bp, Homo sapiens
ccgtacccccgtggtctttgaat

SEQ ID NO: 5595721 - DNA, 23 bp, Homo sapiens
ccgtactaggttggacagccccc

SEQ ID NO: 5595722 - DNA, 18 bp, Homo sapiens
ccgtagaaatcccccttt

SEQ ID NO: 5595723 - DNA, 15 bp, Homo sapiens
ccgtagactaggaag

SEQ ID NO: 5595724 - DNA, 20 bp, Homo sapiens
ccgtagactcacggctgcac

SEQ ID NO: 5595725 - DNA, 17 bp, Homo sapiens
ccgtagctcccctggct

SEQ ID NO: 5595726 - DNA, 18 bp, Homo sapiens
ccgtagctcccctggctg

SEQ ID NO: 5595727 - DNA, 14 bp, Homo sapiens
ccgtagctctgctg

SEQ ID NO: 5595728 - DNA, 15 bp, Homo sapiens
ccgtagctctgctgc

SEQ ID NO: 5595729 - DNA, 16 bp, Homo sapiens
ccgtagctctgctgct

SEQ ID NO: 5595730 - DNA, 16 bp, Homo sapiens
ccgtagcttcagccag

SEQ ID NO: 5595731 - DNA, 15 bp, Homo sapiens
ccgtaggacaagttt

SEQ ID NO: 5595732 - DNA, 15 bp, Homo sapiens
ccgtaggcagcctct

SEQ ID NO: 5595733 - DNA, 18 bp, Homo sapiens
ccgtagggagtacctgct

SEQ ID NO: 5595734 - DNA, 20 bp, Homo sapiens
ccgtaggggctcctgagtgt

SEQ ID NO: 5595735 - DNA, 15 bp, Homo sapiens
ccgtagggtctttct

SEQ ID NO: 5595736 - DNA, 18 bp, Homo sapiens
ccgtataggatgtcagac

SEQ ID NO: 5595737 - DNA, 15 bp, Homo sapiens
ccgtatcacagtgtt

SEQ ID NO: 5595738 - DNA, 18 bp, Homo sapiens
ccgtatcacagtgttttt

SEQ ID NO: 5595739 - DNA, 13 bp, Homo sapiens
ccgtatctccctg

SEQ ID NO: 5595740 - DNA, 17 bp, Homo sapiens
ccgtatctccctggaga

SEQ ID NO: 5595741 - DNA, 21 bp, Homo sapiens
ccgtatctgcagaatgggcca

SEQ ID NO: 5595742 - DNA, 22 bp, Homo sapiens
ccgtatctgcagaatgggccac

SEQ ID NO: 5595743 - DNA, 18 bp, Homo sapiens
ccgtatgaagacagaggc

SEQ ID NO: 5595744 - DNA, 20 bp, Homo sapiens
ccgtatgaagacagaggcag

SEQ ID NO: 5595745 - DNA, 16 bp, Homo sapiens
ccgtatgctttcttca

SEQ ID NO: 5595746 - DNA, 14 bp, Homo sapiens
ccgtatttaaagtt

SEQ ID NO: 5595747 - DNA, 11 bp, Homo sapiens
ccgtcaacaaa

SEQ ID NO: 5595748 - DNA, 23 bp, Homo sapiens
ccgtcaagagtgaattccctcac

SEQ ID NO: 5595749 - DNA, 13 bp, Homo sapiens
ccgtcaccaccac

SEQ ID NO: 5595750 - DNA, 17 bp, Homo sapiens
ccgtcacccactctgca

SEQ ID NO: 5595751 - DNA, 15 bp, Homo sapiens
ccgtcaccccgccag

SEQ ID NO: 5595752 - DNA, 16 bp, Homo sapiens
ccgtcaccccgccagc

SEQ ID NO: 5595753 - DNA, 17 bp, Homo sapiens
ccgtcacccctgtttct

SEQ ID NO: 5595754 - DNA, 16 bp, Homo sapiens
ccgtcacgctttcatg

SEQ ID NO: 5595755 - DNA, 16 bp, Homo sapiens
ccgtcagcatcactga

SEQ ID NO: 5595756 - DNA, 18 bp, Homo sapiens
ccgtcagcatcactgatg

SEQ ID NO: 5595757 - DNA, 17 bp, Homo sapiens
ccgtcagccacacctgt

SEQ ID NO: 5595758 - DNA, 19 bp, Homo sapiens
ccgtcagccatcagccatg

SEQ ID NO: 5595759 - DNA, 17 bp, Homo sapiens
ccgtcagcttctcccaa

SEQ ID NO: 5595760 - DNA, 16 bp, Homo sapiens
ccgtcagggagaggtc

SEQ ID NO: 5595761 - DNA, 12 bp, Homo sapiens
ccgtcagtgctg

SEQ ID NO: 5595762 - DNA, 20 bp, Homo sapiens
ccgtcattgatggagcctga

SEQ ID NO: 5595763 - DNA, 14 bp, Homo sapiens
ccgtcattgctgct

SEQ ID NO: 5595764 - DNA, 15 bp, Homo sapiens
ccgtcattgctgctg

SEQ ID NO: 5595765 - DNA, 14 bp, Homo sapiens
ccgtccacccaggc

SEQ ID NO: 5595766 - DNA, 15 bp, Homo sapiens
ccgtccacccaggct

SEQ ID NO: 5595767 - DNA, 19 bp, Homo sapiens
ccgtccacccaggctgcac

SEQ ID NO: 5595768 - DNA, 22 bp, Homo sapiens
ccgtccagccgccattgccacc

SEQ ID NO: 5595769 - DNA, 16 bp, Homo sapiens
ccgtccatcccccttc

SEQ ID NO: 5595770 - DNA, 17 bp, Homo sapiens
ccgtccatcccccttct

SEQ ID NO: 5595771 - DNA, 16 bp, Homo sapiens
ccgtccatggcaccag

SEQ ID NO: 5595772 - DNA, 19 bp, Homo sapiens
ccgtcccaaccctgcccag

SEQ ID NO: 5595773 - DNA, 14 bp, Homo sapiens
ccgtcccagaggcc

SEQ ID NO: 5595774 - DNA, 13 bp, Homo sapiens
ccgtcccaggcca

SEQ ID NO: 5595775 - DNA, 14 bp, Homo sapiens
ccgtcccaggccac

SEQ ID NO: 5595776 - DNA, 14 bp, Homo sapiens
ccgtcccagggctc

SEQ ID NO: 5595777 - DNA, 12 bp, Homo sapiens
ccgtccccaggg

SEQ ID NO: 5595778 - DNA, 17 bp, Homo sapiens
ccgtccccccccaggcc

SEQ ID NO: 5595779 - DNA, 17 bp, Homo sapiens
ccgtccccggcccctgc

SEQ ID NO: 5595780 - DNA, 15 bp, Homo sapiens
ccgtcccctagagtc

SEQ ID NO: 5595781 - DNA, 14 bp, Homo sapiens
ccgtcccctcccag

SEQ ID NO: 5595782 - DNA, 15 bp, Homo sapiens
ccgtcccctctcccc

SEQ ID NO: 5595783 - DNA, 13 bp, Homo sapiens
ccgtcccctgcag

SEQ ID NO: 5595784 - DNA, 14 bp, Homo sapiens
ccgtcccctgggcc

SEQ ID NO: 5595785 - DNA, 20 bp, Homo sapiens
cctaaataaatctaaagtct

SEQ ID NO: 5595786 - DNA, 19 bp, Homo sapiens
cctaaataataaaaataaa

SEQ ID NO: 5595787 - DNA, 22 bp, Homo sapiens
cctaaataggtttttcttgcta

SEQ ID NO: 5595788 - DNA, 21 bp, Homo sapiens
cctaaatatccaaagactgta

SEQ ID NO: 5595789 - DNA, 20 bp, Homo sapiens
cctaaatattttcaagaaaa

SEQ ID NO: 5595790 - DNA, 16 bp, Homo sapiens
cctaaatccaaagaaa

SEQ ID NO: 5595791 - DNA, 12 bp, Homo sapiens
cctaaatccatt

SEQ ID NO: 5595792 - DNA, 16 bp, Homo sapiens
cctaaatccattttct

SEQ ID NO: 5595793 - DNA, 18 bp, Homo sapiens
cctaaatccattttctaa

SEQ ID NO: 5595794 - DNA, 13 bp, Homo sapiens
cctaaatcccaag

SEQ ID NO: 5595795 - DNA, 16 bp, Homo sapiens
cctaaatgacctcagc

SEQ ID NO: 5595796 - DNA, 14 bp, Homo sapiens
cctaaatgcaaagc

SEQ ID NO: 5595797 - DNA, 17 bp, Homo sapiens
cctaaatttgcatgaaa

SEQ ID NO: 5595798 - DNA, 20 bp, Homo sapiens
cctaaattttcctgtcctct

SEQ ID NO: 5595799 - DNA, 22 bp, Homo sapiens
cctaaattttcctgtcctcttt

SEQ ID NO: 5595800 - DNA, 22 bp, Homo sapiens
cctaacaatgttttttatactt

SEQ ID NO: 5595801 - DNA, 18 bp, Homo sapiens
cctaacacagcatgtgta

SEQ ID NO: 5595802 - DNA, 15 bp, Homo sapiens
cctaaccactaacat

SEQ ID NO: 5595803 - DNA, 12 bp, Homo sapiens
cctaaccaggcc

SEQ ID NO: 5595804 - DNA, 15 bp, Homo sapiens
cctaaccaggcccag

SEQ ID NO: 5595805 - DNA, 18 bp, Homo sapiens
cctaaccagggccagaag

SEQ ID NO: 5595806 - DNA, 15 bp, Homo sapiens
cctaaccatgggctc

SEQ ID NO: 5595807 - DNA, 19 bp, Homo sapiens
cctaacccagaaaatctga

SEQ ID NO: 5595808 - DNA, 12 bp, Homo sapiens
cctaacccccag

SEQ ID NO: 5595809 - DNA, 18 bp, Homo sapiens
cctaaccccttccagatc

SEQ ID NO: 5595810 - DNA, 14 bp, Homo sapiens
cctaaccctgggct

SEQ ID NO: 5595811 - DNA, 17 bp, Homo sapiens
cctaaccctgggctccc

SEQ ID NO: 5595812 - DNA, 18 bp, Homo sapiens
cctaacctcgggcctgct

SEQ ID NO: 5595813 - DNA, 12 bp, Homo sapiens
cctaacctgccg

SEQ ID NO: 5595814 - DNA, 13 bp, Homo sapiens
cctaacctgccga

SEQ ID NO: 5595815 - DNA, 14 bp, Homo sapiens
cctaacctgggacc

SEQ ID NO: 5595816 - DNA, 20 bp, Homo sapiens
cctaacgaagtatccttcag

SEQ ID NO: 5595817 - DNA, 22 bp, Homo sapiens
cctaacgggggtgcggcaggag

SEQ ID NO: 5595818 - DNA, 16 bp, Homo sapiens
cctaactccaccgcct

SEQ ID NO: 5595819 - DNA, 18 bp, Homo sapiens
cctaactccctaggcctg

SEQ ID NO: 5595820 - DNA, 21 bp, Homo sapiens
cctaactcctataaagtgcct

SEQ ID NO: 5595821 - DNA, 17 bp, Homo sapiens
cctaactcttctttcat

SEQ ID NO: 5595822 - DNA, 17 bp, Homo sapiens
cctaactcttgctcact

SEQ ID NO: 5595823 - DNA, 20 bp, Homo sapiens
cctaactcttgctcactccc

SEQ ID NO: 5595824 - DNA, 18 bp, Homo sapiens
cctaactgcaatgtggat

SEQ ID NO: 5595825 - DNA, 17 bp, Homo sapiens
cctaactgttcccttat

SEQ ID NO: 5595826 - DNA, 13 bp, Homo sapiens
cctaacttaacat

SEQ ID NO: 5595827 - DNA, 15 bp, Homo sapiens
cctaacttgtgaaga

SEQ ID NO: 5595828 - DNA, 13 bp, Homo sapiens
cctaactttcttg

SEQ ID NO: 5595829 - DNA, 21 bp, Homo sapiens
cctaactttcttgcttcaaaa

SEQ ID NO: 5595830 - DNA, 14 bp, Homo sapiens
cctaacttttcaat

SEQ ID NO: 5595831 - DNA, 22 bp, Homo sapiens
cctaagaaaccccagggcaggg

SEQ ID NO: 5595832 - DNA, 19 bp, Homo sapiens
cctaagaaatatgtgagat

SEQ ID NO: 5595833 - DNA, 16 bp, Homo sapiens
cctaagaagaaggcca

SEQ ID NO: 5595834 - DNA, 18 bp, Homo sapiens
cctaagaagaaggccaga

SEQ ID NO: 5595835 - DNA, 15 bp, Homo sapiens
cctaagaagtggggc

SEQ ID NO: 5595836 - DNA, 17 bp, Homo sapiens
cctaagaatttcactgt

SEQ ID NO: 5595837 - DNA, 22 bp, Homo sapiens
cctaagaatttcactgtctttt

SEQ ID NO: 5595838 - DNA, 15 bp, Homo sapiens
cctaagaccctgaat

SEQ ID NO: 5595839 - DNA, 20 bp, Homo sapiens
cctaagaccggcggccatga

SEQ ID NO: 5595840 - DNA, 23 bp, Homo sapiens
cctaagacctggggttgtcagct

SEQ ID NO: 5595841 - DNA, 21 bp, Homo sapiens
cctaagactaacaaaggcagc

SEQ ID NO: 5595842 - DNA, 20 bp, Homo sapiens
cctaagactaatgctttctg

SEQ ID NO: 5595843 - DNA, 17 bp, Homo sapiens
cctaagactgccttcag

SEQ ID NO: 5595844 - DNA, 17 bp, Homo sapiens
cctaagacttcagtcct

SEQ ID NO: 5595845 - DNA, 20 bp, Homo sapiens
cctaagagatgggactagga

SEQ ID NO: 5595846 - DNA, 20 bp, Homo sapiens
cctaagaggcgacttcctct

SEQ ID NO: 5595847 - DNA, 13 bp, Homo sapiens
cctaagaggctgc

SEQ ID NO: 5595848 - DNA, 16 bp, Homo sapiens
cctaagaggctgccct

SEQ ID NO: 5595849 - DNA, 16 bp, Homo sapiens
cctaagagtggaggag

SEQ ID NO: 5595850 - DNA, 21 bp, Homo sapiens
cctaagatatacttgtttttg

SEQ ID NO: 5595851 - DNA, 21 bp, Homo sapiens
cctaagatctcggtttgccaa

SEQ ID NO: 5595852 - DNA, 19 bp, Homo sapiens
cctaagcaatcactgggcc

SEQ ID NO: 5595853 - DNA, 21 bp, Homo sapiens
cctaagcaatcactgggccca

SEQ ID NO: 5595854 - DNA, 16 bp, Homo sapiens
cctaagcacttctaga

SEQ ID NO: 5595855 - DNA, 15 bp, Homo sapiens
cctaagcagaaagtg

SEQ ID NO: 5595856 - DNA, 13 bp, Homo sapiens
cctaagccaaggg

SEQ ID NO: 5595857 - DNA, 12 bp, Homo sapiens
cctaagccactc

SEQ ID NO: 5595858 - DNA, 17 bp, Homo sapiens
cctaagccagcctggtc

SEQ ID NO: 5595859 - DNA, 14 bp, Homo sapiens
cctaagccagctgc

SEQ ID NO: 5595860 - DNA, 18 bp, Homo sapiens
cctaagccagctgccccc

SEQ ID NO: 5595861 - DNA, 17 bp, Homo sapiens
cctaagcccccagggcc

SEQ ID NO: 5595862 - DNA, 19 bp, Homo sapiens
cctaagcctgtggctgtgg

SEQ ID NO: 5595863 - DNA, 19 bp, Homo sapiens
cctaagcttctagaggctc

SEQ ID NO: 5595864 - DNA, 22 bp, Homo sapiens
cctaaggaaactgctttatttt

SEQ ID NO: 5595865 - DNA, 13 bp, Homo sapiens
cctaaggaacctt

SEQ ID NO: 5595866 - DNA, 16 bp, Homo sapiens
cctaaggaaccttcct

SEQ ID NO: 5595867 - DNA, 13 bp, Homo sapiens
cctaaggacacac

SEQ ID NO: 5595868 - DNA, 23 bp, Homo sapiens
cctaaggacttctttaattttgg

SEQ ID NO: 5595869 - DNA, 17 bp, Homo sapiens
cctaaggatctctcagg

SEQ ID NO: 5595870 - DNA, 19 bp, Homo sapiens
cctaaggatctctcaggag

SEQ ID NO: 5595871 - DNA, 23 bp, Homo sapiens
cctaaggatctctcaggagcaca

SEQ ID NO: 5595872 - DNA, 14 bp, Homo sapiens
cctaaggcagacag

SEQ ID NO: 5595873 - DNA, 23 bp, Homo sapiens
cctaaggcagacaggaaggaagc

SEQ ID NO: 5595874 - DNA, 17 bp, Homo sapiens
cctaaggccactgtttt

SEQ ID NO: 5595875 - DNA, 18 bp, Homo sapiens
cctaaggccactgtttta

SEQ ID NO: 5595876 - DNA, 15 bp, Homo sapiens
cctaaggcccagctg

SEQ ID NO: 5595877 - DNA, 16 bp, Homo sapiens
cctaaggcccagctgc

SEQ ID NO: 5595878 - DNA, 17 bp, Homo sapiens
cctaaggctccccaccc

SEQ ID NO: 5595879 - DNA, 22 bp, Homo sapiens
cctaaggctgcaaggtttaggc

SEQ ID NO: 5595880 - DNA, 13 bp, Homo sapiens
cctaaggctgctg

SEQ ID NO: 5595881 - DNA, 15 bp, Homo sapiens
cctaagggagacagg

SEQ ID NO: 5595882 - DNA, 21 bp, Homo sapiens
cctaagggagacaggcctttc

SEQ ID NO: 5595883 - DNA, 21 bp, Homo sapiens
cctaagggcagccctccatgg

SEQ ID NO: 5595884 - DNA, 22 bp, Homo sapiens
cctaagggcagccctccatggt

SEQ ID NO: 5595885 - DNA, 18 bp, Homo sapiens
cctaagggctaaggcctc

SEQ ID NO: 5595886 - DNA, 23 bp, Homo sapiens
cctaagggctaaggcctcttgct

SEQ ID NO: 5595887 - DNA, 19 bp, Homo sapiens
cctaagggtcgaaagctct

SEQ ID NO: 5595888 - DNA, 22 bp, Homo sapiens
cctaagggtcgaaagctctaga

SEQ ID NO: 5595889 - DNA, 15 bp, Homo sapiens
cctaagtagaccaaa

SEQ ID NO: 5595890 - DNA, 20 bp, Homo sapiens
cctaagtatcaagtatagaa

SEQ ID NO: 5595891 - DNA, 13 bp, Homo sapiens
cctaagtattaaa

SEQ ID NO: 5595892 - DNA, 17 bp, Homo sapiens
cctaagtattaaaacat

SEQ ID NO: 5595893 - DNA, 21 bp, Homo sapiens
cctaagtattaaaacattgga

SEQ ID NO: 5595894 - DNA, 14 bp, Homo sapiens
cctaagtcaggtaa

SEQ ID NO: 5595895 - DNA, 13 bp, Homo sapiens
cctaagtctctgt

SEQ ID NO: 5595896 - DNA, 16 bp, Homo sapiens
cctaagtgcccaaagt

SEQ ID NO: 5595897 - DNA, 16 bp, Homo sapiens
cctaagtggctgcctt

SEQ ID NO: 5595898 - DNA, 18 bp, Homo sapiens
cctaagtggctgccttct

SEQ ID NO: 5595899 - DNA, 19 bp, Homo sapiens
cctaagtggctgccttctt

SEQ ID NO: 5595900 - DNA, 14 bp, Homo sapiens
cctaagtggctgct

SEQ ID NO: 5595901 - DNA, 16 bp, Homo sapiens
cctaagtgttgattgt

SEQ ID NO: 5595902 - DNA, 23 bp, Homo sapiens
cctaagtgtttactatgtgccag

SEQ ID NO: 5595903 - DNA, 15 bp, Homo sapiens
cctaagttcttagat

SEQ ID NO: 5595904 - DNA, 17 bp, Homo sapiens
cctaagttcttagatat

SEQ ID NO: 5595905 - DNA, 18 bp, Homo sapiens
cctaagttcttagatatc

SEQ ID NO: 5595906 - DNA, 20 bp, Homo sapiens
cctaataaaaaggtgaccat

SEQ ID NO: 5595907 - DNA, 12 bp, Homo sapiens
cctaataaaact

SEQ ID NO: 5595908 - DNA, 14 bp, Homo sapiens
cctaataaaactga

SEQ ID NO: 5595909 - DNA, 15 bp, Homo sapiens
cctaataaaactgat

SEQ ID NO: 5595910 - DNA, 23 bp, Homo sapiens
cctaataaaactgatgtgaaact

SEQ ID NO: 5595911 - DNA, 13 bp, Homo sapiens
cctaataaagaga

SEQ ID NO: 5595912 - DNA, 12 bp, Homo sapiens
cctaataaagct

SEQ ID NO: 5595913 - DNA, 14 bp, Homo sapiens
cctaataaagctgt

SEQ ID NO: 5595914 - DNA, 21 bp, Homo sapiens
cctaataaagttctgtactca

SEQ ID NO: 5595915 - DNA, 21 bp, Homo sapiens
cctaataagtttgatcaaatc

SEQ ID NO: 5595916 - DNA, 14 bp, Homo sapiens
cctaataattgtat

SEQ ID NO: 5595917 - DNA, 19 bp, Homo sapiens
cctaatatatatgtagaga

SEQ ID NO: 5595918 - DNA, 17 bp, Homo sapiens
cctaatatcaaatgcag

SEQ ID NO: 5595919 - DNA, 16 bp, Homo sapiens
cctaatatcattttat

SEQ ID NO: 5595920 - DNA, 20 bp, Homo sapiens
cctaatatcattttattcac

SEQ ID NO: 5595921 - DNA, 18 bp, Homo sapiens
cctaatattcatgctgcc

SEQ ID NO: 5595922 - DNA, 20 bp, Homo sapiens
cctaatattgaaaatgtcac

SEQ ID NO: 5595923 - DNA, 23 bp, Homo sapiens
cctaatattgaaaatgtcactgt

SEQ ID NO: 5595924 - DNA, 18 bp, Homo sapiens
cctaatcaaattctgtct

SEQ ID NO: 5595925 - DNA, 18 bp, Homo sapiens
cctaatcaagagtctctc

SEQ ID NO: 5595926 - DNA, 21 bp, Homo sapiens
cctaatcaagagtctctccag

SEQ ID NO: 5595927 - DNA, 18 bp, Homo sapiens
cctaatcactcagagcag

SEQ ID NO: 5595928 - DNA, 14 bp, Homo sapiens
cctaatcatacacc

SEQ ID NO: 5595929 - DNA, 14 bp, Homo sapiens
cctaatccacctgg

SEQ ID NO: 5595930 - DNA, 14 bp, Homo sapiens
cctaatccaggcag

SEQ ID NO: 5595931 - DNA, 19 bp, Homo sapiens
cctaatccaggcagatcca

SEQ ID NO: 5595932 - DNA, 22 bp, Homo sapiens
cctaatccctgggcattgcttt

SEQ ID NO: 5595933 - DNA, 20 bp, Homo sapiens
cctaatctatggtcgggaga

SEQ ID NO: 5595934 - DNA, 21 bp, Homo sapiens
cctaatctcatacctctgacc

SEQ ID NO: 5595935 - DNA, 21 bp, Homo sapiens
cctaatgaaagtgatgacata

SEQ ID NO: 5595936 - DNA, 18 bp, Homo sapiens
cctaatgagaagtcaaca

SEQ ID NO: 5595937 - DNA, 20 bp, Homo sapiens
cctaatgcgcaggctggccc

SEQ ID NO: 5595938 - DNA, 15 bp, Homo sapiens
cctaatgctctgaaa

SEQ ID NO: 5595939 - DNA, 13 bp, Homo sapiens
cctaatgctggcc

SEQ ID NO: 5595940 - DNA, 14 bp, Homo sapiens
cctaatggcatgga

SEQ ID NO: 5595941 - DNA, 18 bp, Homo sapiens
cctaatggctatttttga

SEQ ID NO: 5595942 - DNA, 13 bp, Homo sapiens
cctaatgtatcta

SEQ ID NO: 5595943 - DNA, 15 bp, Homo sapiens
cctaatgtatctagt

SEQ ID NO: 5595944 - DNA, 17 bp, Homo sapiens
cctaatgtcttcataaa

SEQ ID NO: 5595945 - DNA, 17 bp, Homo sapiens
cctaatgtggcagctgt

SEQ ID NO: 5595946 - DNA, 12 bp, Homo sapiens
cctaatgtgttt

SEQ ID NO: 5595947 - DNA, 17 bp, Homo sapiens
cctaattaatttcagta

SEQ ID NO: 5595948 - DNA, 12 bp, Homo sapiens
cctaattatgaa

SEQ ID NO: 5595949 - DNA, 22 bp, Homo sapiens
cctaattatgaatccaacgtgt

SEQ ID NO: 5595950 - DNA, 23 bp, Homo sapiens
cctaattatgaatccaacgtgta

SEQ ID NO: 5595951 - DNA, 11 bp, Homo sapiens
cctaattatta

SEQ ID NO: 5595952 - DNA, 20 bp, Homo sapiens
cctaattcagccatgtacag

SEQ ID NO: 5595953 - DNA, 13 bp, Homo sapiens
cctaattcatctt

SEQ ID NO: 5595954 - DNA, 14 bp, Homo sapiens
cctaattcatcttt

SEQ ID NO: 5595955 - DNA, 14 bp, Homo sapiens
cctaattccacagc

SEQ ID NO: 5595956 - DNA, 16 bp, Homo sapiens
cctaattccacagctg

SEQ ID NO: 5595957 - DNA, 14 bp, Homo sapiens
cctaattcctggca

SEQ ID NO: 5595958 - DNA, 17 bp, Homo sapiens
cctaattcctgtatgtt

SEQ ID NO: 5595959 - DNA, 21 bp, Homo sapiens
cctaattcttttatctttatt

SEQ ID NO: 5595960 - DNA, 20 bp, Homo sapiens
cctaattggaaagtgccagc

SEQ ID NO: 5595961 - DNA, 24 bp, Homo sapiens
cctaattgtatgttagaataattt

SEQ ID NO: 5595962 - DNA, 13 bp, Homo sapiens
cctaattgttaaa

SEQ ID NO: 5595963 - DNA, 14 bp, Homo sapiens
cctaggtcctctga

SEQ ID NO: 5595964 - DNA, 19 bp, Homo sapiens
cctaggtcctctgaggcac

SEQ ID NO: 5595965 - DNA, 21 bp, Homo sapiens
cctaggtctccacccctcaag

SEQ ID NO: 5595966 - DNA, 18 bp, Homo sapiens
cctaggtgacagagtgag

SEQ ID NO: 5595967 - DNA, 16 bp, Homo sapiens
cctaggtgcagctcct

SEQ ID NO: 5595968 - DNA, 15 bp, Homo sapiens
cctaggtgcccaggg

SEQ ID NO: 5595969 - DNA, 14 bp, Homo sapiens
cctaggtgctcata

SEQ ID NO: 5595970 - DNA, 12 bp, Homo sapiens
cctaggtgctgg

SEQ ID NO: 5595971 - DNA, 14 bp, Homo sapiens
cctaggtgctggat

SEQ ID NO: 5595972 - DNA, 16 bp, Homo sapiens
cctaggtgctggatgc

SEQ ID NO: 5595973 - DNA, 14 bp, Homo sapiens
cctaggtggaggca

SEQ ID NO: 5595974 - DNA, 19 bp, Homo sapiens
cctaggtgggagccaccac

SEQ ID NO: 5595975 - DNA, 16 bp, Homo sapiens
cctaggtggggcctgg

SEQ ID NO: 5595976 - DNA, 24 bp, Homo sapiens
cctaggtgggtcaactccaaggca

SEQ ID NO: 5595977 - DNA, 20 bp, Homo sapiens
cctaggttcccggtcccgag

SEQ ID NO: 5595978 - DNA, 18 bp, Homo sapiens
cctaggttccctgttctt

SEQ ID NO: 5595979 - DNA, 21 bp, Homo sapiens
cctaggttccctgttcttcct

SEQ ID NO: 5595980 - DNA, 14 bp, Homo sapiens
cctaggttctgtta

SEQ ID NO: 5595981 - DNA, 18 bp, Homo sapiens
cctaggttggtttcccct

SEQ ID NO: 5595982 - DNA, 18 bp, Homo sapiens
cctagtaaccaaggccct

SEQ ID NO: 5595983 - DNA, 16 bp, Homo sapiens
cctagtaactgctgtc

SEQ ID NO: 5595984 - DNA, 20 bp, Homo sapiens
cctagtaagaacgtactttc

SEQ ID NO: 5595985 - DNA, 14 bp, Homo sapiens
cctagtaagaagac

SEQ ID NO: 5595986 - DNA, 21 bp, Homo sapiens
cctagtaattgcctagaaata

SEQ ID NO: 5595987 - DNA, 18 bp, Homo sapiens
cctagtacattactaaat

SEQ ID NO: 5595988 - DNA, 20 bp, Homo sapiens
cctagtactctctgctctag

SEQ ID NO: 5595989 - DNA, 23 bp, Homo sapiens
cctagtactctctgctctagcca

SEQ ID NO: 5595990 - DNA, 13 bp, Homo sapiens
cctagtagctggg

SEQ ID NO: 5595991 - DNA, 19 bp, Homo sapiens
cctagtagctgggattaca

SEQ ID NO: 5595992 - DNA, 14 bp, Homo sapiens
cctagtatctggct

SEQ ID NO: 5595993 - DNA, 15 bp, Homo sapiens
cctagtatctggctg

SEQ ID NO: 5595994 - DNA, 18 bp, Homo sapiens
cctagtatgaaagctggg

SEQ ID NO: 5595995 - DNA, 17 bp, Homo sapiens
cctagtatgccctgtaa

SEQ ID NO: 5595996 - DNA, 16 bp, Homo sapiens
cctagtccagtgacct

SEQ ID NO: 5595997 - DNA, 23 bp, Homo sapiens
cctagtcccccaaagggcctcct

SEQ ID NO: 5595998 - DNA, 14 bp, Homo sapiens
cctagtcccttccc

SEQ ID NO: 5595999 - DNA, 16 bp, Homo sapiens
cctagtcccttcccct

SEQ ID NO: 5596000 - DNA, 16 bp, Homo sapiens
cctagtccgctgaaga

SEQ ID NO: 5596001 - DNA, 20 bp, Homo sapiens
cctagtccggttcttcttgt

SEQ ID NO: 5596002 - DNA, 13 bp, Homo sapiens
cctagtcgacact

SEQ ID NO: 5596003 - DNA, 18 bp, Homo sapiens
cctagtctccctcacagc

SEQ ID NO: 5596004 - DNA, 16 bp, Homo sapiens
cctagtgaaccacagg

SEQ ID NO: 5596005 - DNA, 19 bp, Homo sapiens
cctagtgaaccacaggttt

SEQ ID NO: 5596006 - DNA, 18 bp, Homo sapiens
cctagtgaaggcttctct

SEQ ID NO: 5596007 - DNA, 19 bp, Homo sapiens
cctagtgaaggcttctctc

SEQ ID NO: 5596008 - DNA, 19 bp, Homo sapiens
cctagtgacccggaggcca

SEQ ID NO: 5596009 - DNA, 17 bp, Homo sapiens
cctagtgcaaaaactgt

SEQ ID NO: 5596010 - DNA, 24 bp, Homo sapiens
cctagtgccccagactgagctctc

SEQ ID NO: 5596011 - DNA, 21 bp, Homo sapiens
cctagtgctacagatgtacat

SEQ ID NO: 5596012 - DNA, 20 bp, Homo sapiens
cctagtggagttttataaat

SEQ ID NO: 5596013 - DNA, 23 bp, Homo sapiens
cctagtggagttttataaattaa

SEQ ID NO: 5596014 - DNA, 17 bp, Homo sapiens
cctagtggatgactgtt

SEQ ID NO: 5596015 - DNA, 19 bp, Homo sapiens
cctagtggctgtccagtgc

SEQ ID NO: 5596016 - DNA, 19 bp, Homo sapiens
cctagtggcttcagcccct

SEQ ID NO: 5596017 - DNA, 22 bp, Homo sapiens
cctagtggcttcagcccctggg

SEQ ID NO: 5596018 - DNA, 15 bp, Homo sapiens
cctagtggcttgtcc

SEQ ID NO: 5596019 - DNA, 16 bp, Homo sapiens
cctagtggcttgtcct

SEQ ID NO: 5596020 - DNA, 17 bp, Homo sapiens
cctagtggggaggggcc

SEQ ID NO: 5596021 - DNA, 16 bp, Homo sapiens
cctagtgtgtgtgctt

SEQ ID NO: 5596022 - DNA, 15 bp, Homo sapiens
cctagttaaagaaag

SEQ ID NO: 5596023 - DNA, 16 bp, Homo sapiens
cctagttattttctga

SEQ ID NO: 5596024 - DNA, 21 bp, Homo sapiens
cctagttcaaaacaaccactt

SEQ ID NO: 5596025 - DNA, 21 bp, Homo sapiens
cctagttcatcccttctcttc

SEQ ID NO: 5596026 - DNA, 18 bp, Homo sapiens
cctagttccattcttggt

SEQ ID NO: 5596027 - DNA, 20 bp, Homo sapiens
cctagttccctctgctcagc

SEQ ID NO: 5596028 - DNA, 15 bp, Homo sapiens
cctagttctagaaaa

SEQ ID NO: 5596029 - DNA, 16 bp, Homo sapiens
cctagtttgctgtggc

SEQ ID NO: 5596030 - DNA, 18 bp, Homo sapiens
cctagtttgctgtggcct

SEQ ID NO: 5596031 - DNA, 13 bp, Homo sapiens
cctagttttccat

SEQ ID NO: 5596032 - DNA, 16 bp, Homo sapiens
cctagttttctcctcc

SEQ ID NO: 5596033 - DNA, 20 bp, Homo sapiens
cctagttttctcctcccagg

SEQ ID NO: 5596034 - DNA, 19 bp, Homo sapiens
cctagttttctttcctcct

SEQ ID NO: 5596035 - DNA, 23 bp, Homo sapiens
cctataaaacaggtcaatacagt

SEQ ID NO: 5596036 - DNA, 16 bp, Homo sapiens
cctataaaatgcccat

SEQ ID NO: 5596037 - DNA, 17 bp, Homo sapiens
cctataaaattaaatgc

SEQ ID NO: 5596038 - DNA, 18 bp, Homo sapiens
cctataaaggaaacacgt

SEQ ID NO: 5596039 - DNA, 11 bp, Homo sapiens
cctataaagtg

SEQ ID NO: 5596040 - DNA, 18 bp, Homo sapiens
cctataacactgtgaaga

SEQ ID NO: 5596041 - DNA, 20 bp, Homo sapiens
cctataacactgtgaagagc

SEQ ID NO: 5596042 - DNA, 16 bp, Homo sapiens
cctataactgcccagc

SEQ ID NO: 5596043 - DNA, 17 bp, Homo sapiens
cctataacttgatgcat

SEQ ID NO: 5596044 - DNA, 15 bp, Homo sapiens
cctataatacaaata

SEQ ID NO: 5596045 - DNA, 21 bp, Homo sapiens
cctataatacaaatacacaat

SEQ ID NO: 5596046 - DNA, 14 bp, Homo sapiens
cctataatctgtca

SEQ ID NO: 5596047 - DNA, 15 bp, Homo sapiens
cctataatctgtcaa

SEQ ID NO: 5596048 - DNA, 23 bp, Homo sapiens
cctataatctgtcaaaacactgt

SEQ ID NO: 5596049 - DNA, 17 bp, Homo sapiens
cctataatcttatacaa

SEQ ID NO: 5596050 - DNA, 12 bp, Homo sapiens
cctataatgaag

SEQ ID NO: 5596051 - DNA, 17 bp, Homo sapiens
cctataatgtgtgtatg

SEQ ID NO: 5596052 - DNA, 19 bp, Homo sapiens
cctataatgtgtgtatgtg

SEQ ID NO: 5596053 - DNA, 19 bp, Homo sapiens
cctatacagaacagagggc

SEQ ID NO: 5596054 - DNA, 18 bp, Homo sapiens
cctataccatatgtctgc

SEQ ID NO: 5596055 - DNA, 21 bp, Homo sapiens
cctataccatatgtctgcttc

SEQ ID NO: 5596056 - DNA, 22 bp, Homo sapiens
cctataccatatgtctgcttct

SEQ ID NO: 5596057 - DNA, 23 bp, Homo sapiens
cctataccatttccgtaattctt

SEQ ID NO: 5596058 - DNA, 20 bp, Homo sapiens
cctataccctaggtctccac

SEQ ID NO: 5596059 - DNA, 17 bp, Homo sapiens
cctatacctatgtgaaa

SEQ ID NO: 5596060 - DNA, 15 bp, Homo sapiens
cctatacctgagcct

SEQ ID NO: 5596061 - DNA, 18 bp, Homo sapiens
cctatacctgagcctcaa

SEQ ID NO: 5596062 - DNA, 13 bp, Homo sapiens
cctatactgcttg

SEQ ID NO: 5596063 - DNA, 22 bp, Homo sapiens
cctatactgcttggagctgagc

SEQ ID NO: 5596064 - DNA, 23 bp, Homo sapiens
cctatactgcttggagctgagca

SEQ ID NO: 5596065 - DNA, 18 bp, Homo sapiens
cctatagaaatagaacac

SEQ ID NO: 5596066 - DNA, 21 bp, Homo sapiens
cctatagaaatgtattttgaa

SEQ ID NO: 5596067 - DNA, 19 bp, Homo sapiens
cctatagatgatgatgtgt

SEQ ID NO: 5596068 - DNA, 18 bp, Homo sapiens
cctatagctacatgttct

SEQ ID NO: 5596069 - DNA, 13 bp, Homo sapiens
cctatagtcccag

SEQ ID NO: 5596070 - DNA, 14 bp, Homo sapiens
cctatagttttact

SEQ ID NO: 5596071 - DNA, 23 bp, Homo sapiens
cctatagttttactcctcagttc

SEQ ID NO: 5596072 - DNA, 23 bp, Homo sapiens
cctatataggaaactaagcattg

SEQ ID NO: 5596073 - DNA, 16 bp, Homo sapiens
cctatatagtttattg

SEQ ID NO: 5596074 - DNA, 16 bp, Homo sapiens
cctatatcagggcctg

SEQ ID NO: 5596075 - DNA, 17 bp, Homo sapiens
cctatatcagggcctga

SEQ ID NO: 5596076 - DNA, 20 bp, Homo sapiens
cctatatccagaaggggagc

SEQ ID NO: 5596077 - DNA, 22 bp, Homo sapiens
cctatatctggagtgagaggcc

SEQ ID NO: 5596078 - DNA, 16 bp, Homo sapiens
cctatatctgtttgta

SEQ ID NO: 5596079 - DNA, 22 bp, Homo sapiens
cctatatctgtttgtatatttg

SEQ ID NO: 5596080 - DNA, 22 bp, Homo sapiens
cctatatgcttactgtgcacct

SEQ ID NO: 5596081 - DNA, 22 bp, Homo sapiens
cctatattatcataagaatttt

SEQ ID NO: 5596082 - DNA, 14 bp, Homo sapiens
cctatattccttgt

SEQ ID NO: 5596083 - DNA, 16 bp, Homo sapiens
cctatattgatttaaa

SEQ ID NO: 5596084 - DNA, 17 bp, Homo sapiens
cctatatttttcctcaa

SEQ ID NO: 5596085 - DNA, 16 bp, Homo sapiens
cctatcaaaaagatat

SEQ ID NO: 5596086 - DNA, 11 bp, Homo sapiens
cctatcaaaac

SEQ ID NO: 5596087 - DNA, 13 bp, Homo sapiens
cctatcaaaacat

SEQ ID NO: 5596088 - DNA, 16 bp, Homo sapiens
cctatcaaaacatatc

SEQ ID NO: 5596089 - DNA, 20 bp, Homo sapiens
cctatcaacctaagcaacag

SEQ ID NO: 5596090 - DNA, 20 bp, Homo sapiens
cctatcaatccaaattccct

SEQ ID NO: 5596091 - DNA, 16 bp, Homo sapiens
cctatcacctatttcc

SEQ ID NO: 5596092 - DNA, 17 bp, Homo sapiens
cctatcagaagtttctc

SEQ ID NO: 5596093 - DNA, 20 bp, Homo sapiens
cctatcagagaagcagcatc

SEQ ID NO: 5596094 - DNA, 17 bp, Homo sapiens
cctatcagtgtgccccc

SEQ ID NO: 5596095 - DNA, 18 bp, Homo sapiens
cctatcagtgtgcccccc

SEQ ID NO: 5596096 - DNA, 24 bp, Homo sapiens
cctatcagtgtgccccccatcctg

SEQ ID NO: 5596097 - DNA, 15 bp, Homo sapiens
cctatcatcagttag

SEQ ID NO: 5596098 - DNA, 20 bp, Homo sapiens
cctatcatttattctgcttc

SEQ ID NO: 5596099 - DNA, 16 bp, Homo sapiens
cctatccaccacccca

SEQ ID NO: 5596100 - DNA, 17 bp, Homo sapiens
cctatccaccaccccac
